United States Patent 7,341,835 (METHODS OF ANALYSIS OF ALTERNATIVE SPLICING IN MOUSE) - sequence listing, part 13

SEQ ID NO: 478637 - DNA, 25 bp, Mus musculus
tcttcgctgaacgtatgaccggcaa

SEQ ID NO: 478638 - DNA, 25 bp, Mus musculus
tcttcgctggcatgcagatctacag

SEQ ID NO: 478639 - DNA, 25 bp, Mus musculus
tcttcggaaatggaagccaggtgac

SEQ ID NO: 478640 - DNA, 25 bp, Mus musculus
tcttcggacaaagcatgtcctccgt

SEQ ID NO: 478641 - DNA, 25 bp, Mus musculus
tcttcggactgagagaattatctag

SEQ ID NO: 478642 - DNA, 25 bp, Mus musculus
tcttcggagcctcatccagggttcg

SEQ ID NO: 478643 - DNA, 25 bp, Mus musculus
tcttcggcaaagaagccaggagtgc

SEQ ID NO: 478644 - DNA, 25 bp, Mus musculus
tcttcggcagccacaaagcagtaga

SEQ ID NO: 478645 - DNA, 25 bp, Mus musculus
tcttcggcttctccgcgtttcgggt

SEQ ID NO: 478646 - DNA, 25 bp, Mus musculus
tcttcgggatccatcattgtggtca

SEQ ID NO: 478647 - DNA, 25 bp, Mus musculus
tcttcgggtcaaacatcagcagcaa

SEQ ID NO: 478648 - DNA, 25 bp, Mus musculus
tcttcggtgtacagcaaaggacgca

SEQ ID NO: 478649 - DNA, 25 bp, Mus musculus
tcttcggtgtctataggctcgtccc

SEQ ID NO: 478650 - DNA, 25 bp, Mus musculus
tcttcggttgtgagctctccggcca

SEQ ID NO: 478651 - DNA, 25 bp, Mus musculus
tcttcgtaaaaccatcggcgctctg

SEQ ID NO: 478652 - DNA, 25 bp, Mus musculus
tcttcgtacggaaactggacctagc

SEQ ID NO: 478653 - DNA, 25 bp, Mus musculus
tcttcgtagaaagtctgagttcctt

SEQ ID NO: 478654 - DNA, 25 bp, Mus musculus
tcttcgtgaagatctgctgagccga

SEQ ID NO: 478655 - DNA, 25 bp, Mus musculus
tcttcgtgcacatcgggcatgccaa

SEQ ID NO: 478656 - DNA, 25 bp, Mus musculus
tcttcgtgggaaagacggctccatc

SEQ ID NO: 478657 - DNA, 25 bp, Mus musculus
tcttcgtggtatggcacacaggaca

SEQ ID NO: 478658 - DNA, 25 bp, Mus musculus
tcttcgtggtgcacatcacgcgggc

SEQ ID NO: 478659 - DNA, 25 bp, Mus musculus
tcttcgttgagtacgcgaacgctgg

SEQ ID NO: 478660 - DNA, 25 bp, Mus musculus
tcttcgtttgggagcagaacctcga

SEQ ID NO: 478661 - DNA, 25 bp, Mus musculus
tcttctaaacaaccagaggatgact

SEQ ID NO: 478662 - DNA, 25 bp, Mus musculus
tcttctaaaggatcccagtggccct

SEQ ID NO: 478663 - DNA, 25 bp, Mus musculus
tcttctaaagtggtgtatctctgat

SEQ ID NO: 478664 - DNA, 25 bp, Mus musculus
tcttctaaccagagggcatgtgtgc

SEQ ID NO: 478665 - DNA, 25 bp, Mus musculus
tcttctaagtaacagtgaattccag

SEQ ID NO: 478666 - DNA, 25 bp, Mus musculus
tcttctaatattcccggatatctga

SEQ ID NO: 478667 - DNA, 25 bp, Mus musculus
tcttctacaacgagcagcaggagac

SEQ ID NO: 478668 - DNA, 25 bp, Mus musculus
tcttctacagcccagatgcggagga

SEQ ID NO: 478669 - DNA, 25 bp, Mus musculus
tcttctaccaaagaaggagaccggg

SEQ ID NO: 478670 - DNA, 25 bp, Mus musculus
tcttctacgtgttgacaatatgcca

SEQ ID NO: 478671 - DNA, 25 bp, Mus musculus
tcttctactcgagtgttgccactgg

SEQ ID NO: 478672 - DNA, 25 bp, Mus musculus
tcttctactgagaaggtaggcgcag

SEQ ID NO: 478673 - DNA, 25 bp, Mus musculus
tcttctacttgtgtgcctgagccca

SEQ ID NO: 478674 - DNA, 25 bp, Mus musculus
tcttctagaagctcaagacgccaga

SEQ ID NO: 478675 - DNA, 25 bp, Mus musculus
tcttctagaagtcacgaggctaaca

SEQ ID NO: 478676 - DNA, 25 bp, Mus musculus
tcttctagagcacaagaggcttcac

SEQ ID NO: 478677 - DNA, 25 bp, Mus musculus
tcttctagaggagacaacagtccgg

SEQ ID NO: 478678 - DNA, 25 bp, Mus musculus
tcttctagatagacaaacagcagag

SEQ ID NO: 478679 - DNA, 25 bp, Mus musculus
tcttctagccggtagaaagcggaaa

SEQ ID NO: 478680 - DNA, 25 bp, Mus musculus
tcttctagggaaaaaggaaacagct

SEQ ID NO: 478681 - DNA, 25 bp, Mus musculus
tcttctagtccagatttccgtttga

SEQ ID NO: 478682 - DNA, 25 bp, Mus musculus
tcttctagtgagctcgtaggtacct

SEQ ID NO: 478683 - DNA, 25 bp, Mus musculus
tcttctatgattcccagcacagcca

SEQ ID NO: 478684 - DNA, 25 bp, Mus musculus
tcttctatgcatacaacaggcggag

SEQ ID NO: 478685 - DNA, 25 bp, Mus musculus
tcttctatgccagagcagggaccca

SEQ ID NO: 478686 - DNA, 25 bp, Mus musculus
tcttctatgcgcagttggccacgac

SEQ ID NO: 478687 - DNA, 25 bp, Mus musculus
tcttctatggcagcatctcgcgggc

SEQ ID NO: 478688 - DNA, 25 bp, Mus musculus
tcttctcaatgaacaaagcaggagc

SEQ ID NO: 478689 - DNA, 25 bp, Mus musculus
tcttctcaccaaagtcccagagcga

SEQ ID NO: 478690 - DNA, 25 bp, Mus musculus
tcttctcaccactatgaccctgaag

SEQ ID NO: 478691 - DNA, 25 bp, Mus musculus
tcttctcagcagataactgacagcc

SEQ ID NO: 478692 - DNA, 25 bp, Mus musculus
tcttctcagtaaaggcccaggatgc

SEQ ID NO: 478693 - DNA, 25 bp, Mus musculus
tcttctcatcattctggccgtcagc

SEQ ID NO: 478694 - DNA, 25 bp, Mus musculus
tcttctccaaggaagtcggcgcagg

SEQ ID NO: 478695 - DNA, 25 bp, Mus musculus
tcttctccaggtgagtgaaatcctc

SEQ ID NO: 478696 - DNA, 25 bp, Mus musculus
tcttctccgaaaacgggctccgtga

SEQ ID NO: 478697 - DNA, 25 bp, Mus musculus
tcttctccgactcagcacacagaag

SEQ ID NO: 478698 - DNA, 25 bp, Mus musculus
tcttctccgagctggtgcagcactg

SEQ ID NO: 478699 - DNA, 25 bp, Mus musculus
tcttctccttcaaacaataacatcg

SEQ ID NO: 478700 - DNA, 25 bp, Mus musculus
tcttctcctttgagagtggccgccg

SEQ ID NO: 478701 - DNA, 25 bp, Mus musculus
tcttctcgaagactttgtggcgctg

SEQ ID NO: 478702 - DNA, 25 bp, Mus musculus
tcttctcggagatgaccgcttggcc

SEQ ID NO: 478703 - DNA, 25 bp, Mus musculus
tcttctcgggtgataatggacctgc

SEQ ID NO: 478704 - DNA, 25 bp, Mus musculus
tcttctctgaagacgggactggaga

SEQ ID NO: 478705 - DNA, 25 bp, Mus musculus
tcttctctgctgtggttgcccgacg

SEQ ID NO: 478706 - DNA, 25 bp, Mus musculus
tcttctctggaaagaactgaggcca

SEQ ID NO: 478707 - DNA, 25 bp, Mus musculus
tcttctcttactaggtaggcccagg

SEQ ID NO: 478708 - DNA, 25 bp, Mus musculus
tcttctcttgtctgtaccagctgta

SEQ ID NO: 478709 - DNA, 25 bp, Mus musculus
tcttctgaaaggtgaccagccgtgg

SEQ ID NO: 478710 - DNA, 25 bp, Mus musculus
tcttctgacatcacgtgctgcacgg

SEQ ID NO: 478711 - DNA, 25 bp, Mus musculus
tcttctgagcgggagccatagatgc

SEQ ID NO: 478712 - DNA, 25 bp, Mus musculus
tcttctgaggcccatggcgagctac

SEQ ID NO: 478713 - DNA, 25 bp, Mus musculus
tcttctgattggcttcgaggccgca

SEQ ID NO: 478714 - DNA, 25 bp, Mus musculus
tcttctgcatatcgaggccagcgac

SEQ ID NO: 478715 - DNA, 25 bp, Mus musculus
tcttctgcatcaatgtgagcacccc

SEQ ID NO: 478716 - DNA, 25 bp, Mus musculus
tcttctgccggaacaatggctatgc

SEQ ID NO: 478717 - DNA, 25 bp, Mus musculus
tcttctgcggctgatccaaaaccag

SEQ ID NO: 478718 - DNA, 25 bp, Mus musculus
tcttctgcttctgagggtcctgtgt

SEQ ID NO: 478719 - DNA, 25 bp, Mus musculus
tcttctggaaactgtgaggaccttg

SEQ ID NO: 478720 - DNA, 25 bp, Mus musculus
tcttctggaagacgcagggctagcc

SEQ ID NO: 478721 - DNA, 25 bp, Mus musculus
tcttctggaagtatctggacctggc

SEQ ID NO: 478722 - DNA, 25 bp, Mus musculus
tcttctggatcggacccctggtggg

SEQ ID NO: 478723 - DNA, 25 bp, Mus musculus
tcttctggccagcaaggacaaaagg

SEQ ID NO: 478724 - DNA, 25 bp, Mus musculus
tcttctggccccataggagctgcct

SEQ ID NO: 478725 - DNA, 25 bp, Mus musculus
tcttctggcgcaaggaagactccga

SEQ ID NO: 478726 - DNA, 25 bp, Mus musculus
tcttctggctgggaaaggactacag

SEQ ID NO: 478727 - DNA, 25 bp, Mus musculus
tcttctgggaatcaggcatggctaa

SEQ ID NO: 478728 - DNA, 25 bp, Mus musculus
tcttctgggacaagctgaaacactg

SEQ ID NO: 478729 - DNA, 25 bp, Mus musculus
tcttctgggtagacagcagtgccac

SEQ ID NO: 478730 - DNA, 25 bp, Mus musculus
tcttctgggttcaaaatagcagccg

SEQ ID NO: 478731 - DNA, 25 bp, Mus musculus
tcttctgtaactatcaagctgtgct

SEQ ID NO: 478732 - DNA, 25 bp, Mus musculus
tcttctgtacaagtgagcgccgctg

SEQ ID NO: 478733 - DNA, 25 bp, Mus musculus
tcttctgtgacagggtgatccgaga

SEQ ID NO: 478734 - DNA, 25 bp, Mus musculus
tcttctgtgatcacaatggagcagg

SEQ ID NO: 478735 - DNA, 25 bp, Mus musculus
tcttctgtgcctaagggatcctcgg

SEQ ID NO: 478736 - DNA, 25 bp, Mus musculus
tcttctgtgggctggaacatccctt

SEQ ID NO: 478737 - DNA, 25 bp, Mus musculus
tcttctgtgtatgtactagtctgta

SEQ ID NO: 478738 - DNA, 25 bp, Mus musculus
tcttctgtgttggtgattgatgtga

SEQ ID NO: 478739 - DNA, 25 bp, Mus musculus
tcttctgttaagagttggcccagcc

SEQ ID NO: 478740 - DNA, 25 bp, Mus musculus
tcttctgttatgagggtttgcgccc

SEQ ID NO: 478741 - DNA, 25 bp, Mus musculus
tcttctgttgcttccgtgacctctg

SEQ ID NO: 478742 - DNA, 25 bp, Mus musculus
tcttcttaaaggttgattcctgtcc

SEQ ID NO: 478743 - DNA, 25 bp, Mus musculus
tcttcttagtttcatgagagccaca

SEQ ID NO: 478744 - DNA, 25 bp, Mus musculus
tcttcttatactcagaaccactatc

SEQ ID NO: 478745 - DNA, 25 bp, Mus musculus
tcttcttcaatgtaagcaggcggtt

SEQ ID NO: 478746 - DNA, 25 bp, Mus musculus
tcttcttcaccgctgggaaggacca

SEQ ID NO: 478747 - DNA, 25 bp, Mus musculus
tcttcttcagcgttactatgatgca

SEQ ID NO: 478748 - DNA, 25 bp, Mus musculus
tcttcttccagaggcacaaggtgaa

SEQ ID NO: 478749 - DNA, 25 bp, Mus musculus
tcttcttcccagtctcaagacagtg

SEQ ID NO: 478750 - DNA, 25 bp, Mus musculus
tcttcttccgggtggcagctgacat

SEQ ID NO: 478751 - DNA, 25 bp, Mus musculus
tcttcttcgtaatggatgcagccga

SEQ ID NO: 478752 - DNA, 25 bp, Mus musculus
tcttcttctgggtctacagcagctg

SEQ ID NO: 478753 - DNA, 25 bp, Mus musculus
tcttcttgcctttcagctgtagtgg

SEQ ID NO: 478754 - DNA, 25 bp, Mus musculus
tcttcttgctgtcatgaactccccg

SEQ ID NO: 478755 - DNA, 25 bp, Mus musculus
tcttcttggataggaagccaagcct

SEQ ID NO: 478756 - DNA, 25 bp, Mus musculus
tcttcttggcatacgcacagctggc

SEQ ID NO: 478757 - DNA, 25 bp, Mus musculus
tcttctttggcctggctgtgaactt

SEQ ID NO: 478758 - DNA, 25 bp, Mus musculus
tcttcttttagtccgttagatcggg

SEQ ID NO: 478759 - DNA, 25 bp, Mus musculus
tcttcttttgtttagcctcaggaac

SEQ ID NO: 478760 - DNA, 25 bp, Mus musculus
tcttctttttaggagttcgtctgca

SEQ ID NO: 478761 - DNA, 25 bp, Mus musculus
tcttgaaaacgcaccctgagagcag

SEQ ID NO: 478762 - DNA, 25 bp, Mus musculus
tcttgaaaacgctggctgggtccct

SEQ ID NO: 478763 - DNA, 25 bp, Mus musculus
tcttgaaaagctcaggcaggatagc

SEQ ID NO: 478764 - DNA, 25 bp, Mus musculus
tcttgaaaatctcgaggtaaccggc

SEQ ID NO: 478765 - DNA, 25 bp, Mus musculus
tcttgaaaatgacccgacggagctg

SEQ ID NO: 478766 - DNA, 25 bp, Mus musculus
tcttgaaactaaaacatgtctaggg

SEQ ID NO: 478767 - DNA, 25 bp, Mus musculus
tcttgaaaggtagagcagtgcgctc

SEQ ID NO: 478768 - DNA, 25 bp, Mus musculus
tcttgaaagtttgcctcagcagggc

SEQ ID NO: 478769 - DNA, 25 bp, Mus musculus
tcttgaaatgcatccagtttagggc

SEQ ID NO: 478770 - DNA, 25 bp, Mus musculus
tcttgaacaggagaagactagactc

SEQ ID NO: 478771 - DNA, 25 bp, Mus musculus
tcttgaacagggtggccaatcagac

SEQ ID NO: 478772 - DNA, 25 bp, Mus musculus
tcttgaaccaagagagctgagcccg

SEQ ID NO: 478773 - DNA, 25 bp, Mus musculus
tcttgaacgccctctgtaaagcggc

SEQ ID NO: 478774 - DNA, 25 bp, Mus musculus
tcttgaacgtgacagagacccaggc

SEQ ID NO: 478775 - DNA, 25 bp, Mus musculus
tcttgaacgtgttggacagggcctg

SEQ ID NO: 478776 - DNA, 25 bp, Mus musculus
tcttgaactagacctcggagagggc

SEQ ID NO: 478777 - DNA, 25 bp, Mus musculus
tcttgaagacttgggctggagcgac

SEQ ID NO: 478778 - DNA, 25 bp, Mus musculus
tcttgaagagaagcatcagcgattc

SEQ ID NO: 478779 - DNA, 25 bp, Mus musculus
tcttgaagaggcacgcagctgatca

SEQ ID NO: 478780 - DNA, 25 bp, Mus musculus
tcttgaagaggctttccgggttgtg

SEQ ID NO: 478781 - DNA, 25 bp, Mus musculus
tcttgaagatgagggcggcagctat

SEQ ID NO: 478782 - DNA, 25 bp, Mus musculus
tcttgaagattgcagatgggtacag

SEQ ID NO: 478783 - DNA, 25 bp, Mus musculus
tcttgaaggagcttgggactggaca

SEQ ID NO: 478784 - DNA, 25 bp, Mus musculus
tcttgaaggctgaactgggtacatc

SEQ ID NO: 478785 - DNA, 25 bp, Mus musculus
tcttgaagttcatccggccactgca

SEQ ID NO: 478786 - DNA, 25 bp, Mus musculus
tcttgaataggatgaaacgaggagg

SEQ ID NO: 478787 - DNA, 25 bp, Mus musculus
tcttgaatggagaggtcatccggct

SEQ ID NO: 478788 - DNA, 25 bp, Mus musculus
tcttgaatgtgctaccagggtggaa

SEQ ID NO: 478789 - DNA, 25 bp, Mus musculus
tcttgaattgcaggctttcatgctg

SEQ ID NO: 478790 - DNA, 25 bp, Mus musculus
tcttgaattgtctgggacctgggac

SEQ ID NO: 478791 - DNA, 25 bp, Mus musculus
tcttgacaccatgagctactacggc

SEQ ID NO: 478792 - DNA, 25 bp, Mus musculus
tcttgacagcatagaccatcccatg

SEQ ID NO: 478793 - DNA, 25 bp, Mus musculus
tcttgacagcccttgacaggacagt

SEQ ID NO: 478794 - DNA, 25 bp, Mus musculus
tcttgaccatgtcggaaacggctcc

SEQ ID NO: 478795 - DNA, 25 bp, Mus musculus
tcttgacccagtttgaaatgtaact

SEQ ID NO: 478796 - DNA, 25 bp, Mus musculus
tcttgaccccagatctggcgggagc

SEQ ID NO: 478797 - DNA, 25 bp, Mus musculus
tcttgaccccttggtgagatcacga

SEQ ID NO: 478798 - DNA, 25 bp, Mus musculus
tcttgacgcttgcaaaaagttgggt

SEQ ID NO: 478799 - DNA, 25 bp, Mus musculus
tcttgacggtcaaacaacaggactt

SEQ ID NO: 478800 - DNA, 25 bp, Mus musculus
tcttgactaagtgtccagtgtgaca

SEQ ID NO: 478801 - DNA, 25 bp, Mus musculus
tcttgactacccacactgatgccga

SEQ ID NO: 478802 - DNA, 25 bp, Mus musculus
tcttgactccagtgatgagctcagc

SEQ ID NO: 478803 - DNA, 25 bp, Mus musculus
tcttgactcgactcagaatcctgaa

SEQ ID NO: 478804 - DNA, 25 bp, Mus musculus
tcttgacttctggagccagcacggc

SEQ ID NO: 478805 - DNA, 25 bp, Mus musculus
tcttgagaacatgaagctgagcctt

SEQ ID NO: 478806 - DNA, 25 bp, Mus musculus
tcttgagacacttacggacctggga

SEQ ID NO: 478807 - DNA, 25 bp, Mus musculus
tcttgagacccagaggcagttccag

SEQ ID NO: 478808 - DNA, 25 bp, Mus musculus
tcttgagactatcctgaagcagccc

SEQ ID NO: 478809 - DNA, 25 bp, Mus musculus
tcttgagactgggaccatgtaatca

SEQ ID NO: 478810 - DNA, 25 bp, Mus musculus
tcttgagagcccatgctggagaaca

SEQ ID NO: 478811 - DNA, 25 bp, Mus musculus
tcttgagagcctctcgtgccagcca

SEQ ID NO: 478812 - DNA, 25 bp, Mus musculus
tcttgagagtgttatcagggactgg

SEQ ID NO: 478813 - DNA, 25 bp, Mus musculus
tcttgagatccgaccccgtgaatgg

SEQ ID NO: 478814 - DNA, 25 bp, Mus musculus
tcttgagcatgtataacagacccat

SEQ ID NO: 478815 - DNA, 25 bp, Mus musculus
tcttgagccagaaggcccggaactt

SEQ ID NO: 478816 - DNA, 25 bp, Mus musculus
tcttgagccccgagttatcgaggat

SEQ ID NO: 478817 - DNA, 25 bp, Mus musculus
tcttgagcggcaccaagggtccttg

SEQ ID NO: 478818 - DNA, 25 bp, Mus musculus
tcttgagctccaatatcatggtggc

SEQ ID NO: 478819 - DNA, 25 bp, Mus musculus
tcttgagcttgaaccgccttcacca

SEQ ID NO: 478820 - DNA, 25 bp, Mus musculus
tcttgaggcagcgagaaacggaaca

SEQ ID NO: 478821 - DNA, 25 bp, Mus musculus
tcttgagggagaccagctacactga

SEQ ID NO: 478822 - DNA, 25 bp, Mus musculus
tcttgagggtggtctcccacaggaa

SEQ ID NO: 478823 - DNA, 25 bp, Mus musculus
tcttgagtaacccaaagctggaagt

SEQ ID NO: 478824 - DNA, 25 bp, Mus musculus
tcttgagtccctagccattccggtt

SEQ ID NO: 478825 - DNA, 25 bp, Mus musculus
tcttgagtggcgtgtaaagtacagc

SEQ ID NO: 478826 - DNA, 25 bp, Mus musculus
tcttgagttgttcctacagaatggc

SEQ ID NO: 478827 - DNA, 25 bp, Mus musculus
tcttgataaaggtactgaaacctgg

SEQ ID NO: 478828 - DNA, 25 bp, Mus musculus
tcttgataaatgatgcggacgctct

SEQ ID NO: 478829 - DNA, 25 bp, Mus musculus
tcttgatagaaaatgtgggtaggac

SEQ ID NO: 478830 - DNA, 25 bp, Mus musculus
tcttgatcagcagaaagcacactcc

SEQ ID NO: 478831 - DNA, 25 bp, Mus musculus
tcttgatccaactgcgcgatggaac

SEQ ID NO: 478832 - DNA, 25 bp, Mus musculus
tcttgatccggaagcgaattcatct

SEQ ID NO: 478833 - DNA, 25 bp, Mus musculus
tcttgatcttctgagtgtacgtgtc

SEQ ID NO: 478834 - DNA, 25 bp, Mus musculus
tcttgatgaccttcggtgcggacct

SEQ ID NO: 478835 - DNA, 25 bp, Mus musculus
tcttgatgacgagaaatgacgtgtt

SEQ ID NO: 478836 - DNA, 25 bp, Mus musculus
tcttgatgacttactgacctgtggc

SEQ ID NO: 478837 - DNA, 25 bp, Mus musculus
tcttgatgaggtgaccacagccctg

SEQ ID NO: 478838 - DNA, 25 bp, Mus musculus
tcttgatgcgggtccgtggtaccca

SEQ ID NO: 478839 - DNA, 25 bp, Mus musculus
tcttgatggacagatgttgctgatc

SEQ ID NO: 478840 - DNA, 25 bp, Mus musculus
tcttgatgtgagatgactggttgaa

SEQ ID NO: 478841 - DNA, 25 bp, Mus musculus
tcttgcaaaggatagagctggaggc

SEQ ID NO: 478842 - DNA, 25 bp, Mus musculus
tcttgcaaatcaaaggaagcgtcag

SEQ ID NO: 478843 - DNA, 25 bp, Mus musculus
tcttgcaacggtgtaggaccagaca

SEQ ID NO: 478844 - DNA, 25 bp, Mus musculus
tcttgcaagacagagagccgagtaa

SEQ ID NO: 478845 - DNA, 25 bp, Mus musculus
tcttgcaagagaggtaggcacttcc

SEQ ID NO: 478846 - DNA, 25 bp, Mus musculus
tcttgcaggaataagcgttagggat

SEQ ID NO: 478847 - DNA, 25 bp, Mus musculus
tcttgcagtatagcttagaccggcc

SEQ ID NO: 478848 - DNA, 25 bp, Mus musculus
tcttgcagttttcaggtaagttcca

SEQ ID NO: 478849 - DNA, 25 bp, Mus musculus
tcttgcatacattcaccccaatagg

SEQ ID NO: 478850 - DNA, 25 bp, Mus musculus
tcttgcatcctgctgcaaaagctcg

SEQ ID NO: 478851 - DNA, 25 bp, Mus musculus
tcttgcatggaccacaccgtgtctg

SEQ ID NO: 478852 - DNA, 25 bp, Mus musculus
tcttgcatgttggagtactactctc

SEQ ID NO: 478853 - DNA, 25 bp, Mus musculus
tcttgccaacaggactccagggttt

SEQ ID NO: 478854 - DNA, 25 bp, Mus musculus
tcttgccaatcgaatgacagcgtgt

SEQ ID NO: 478855 - DNA, 25 bp, Mus musculus
tcttgccaattctttaacccagagc

SEQ ID NO: 478856 - DNA, 25 bp, Mus musculus
tcttgccacacaggctctgggtgaa

SEQ ID NO: 478857 - DNA, 25 bp, Mus musculus
tcttgccagcccatatcagtaaaat

SEQ ID NO: 478858 - DNA, 25 bp, Mus musculus
tcttgccagcttggaggaggccgta

SEQ ID NO: 478859 - DNA, 25 bp, Mus musculus
tcttgccaggtgaacggcagggtta

SEQ ID NO: 478860 - DNA, 25 bp, Mus musculus
tcttgccagtgaacgcctttagtcc

SEQ ID NO: 478861 - DNA, 25 bp, Mus musculus
tcttgccatcccagttgtaccagct

SEQ ID NO: 478862 - DNA, 25 bp, Mus musculus
tcttgcccccaggaagagagctcag

SEQ ID NO: 478863 - DNA, 25 bp, Mus musculus
tcttgcccgagtgctaaggaccttg

SEQ ID NO: 478864 - DNA, 25 bp, Mus musculus
tcttgcccgccctgcgtaaagtgat

SEQ ID NO: 478865 - DNA, 25 bp, Mus musculus
tcttgccctgtaaagatgcatccag

SEQ ID NO: 478866 - DNA, 25 bp, Mus musculus
tcttgcccttggtgccagccattca

SEQ ID NO: 478867 - DNA, 25 bp, Mus musculus
tcttgccctttagttcttggaacca

SEQ ID NO: 478868 - DNA, 25 bp, Mus musculus
tcttgccgagtatccaggagctccc

SEQ ID NO: 478869 - DNA, 25 bp, Mus musculus
tcttgccgcgaggaacatactggtg

SEQ ID NO: 478870 - DNA, 25 bp, Mus musculus
tcttgccgggctagtattattctgt

SEQ ID NO: 478871 - DNA, 25 bp, Mus musculus
tcttgccgtgcgcacgctaggatga

SEQ ID NO: 478872 - DNA, 25 bp, Mus musculus
tcttgcctacttaaggacaggcggc

SEQ ID NO: 478873 - DNA, 25 bp, Mus musculus
tcttgcctcaaagctgtgcgacgtc

SEQ ID NO: 478874 - DNA, 25 bp, Mus musculus
tcttgcctggacaaggagtcccagc

SEQ ID NO: 478875 - DNA, 25 bp, Mus musculus
tcttgcctgtggagacatgagggct

SEQ ID NO: 478876 - DNA, 25 bp, Mus musculus
tcttgcctgtttggtagggatggcc

SEQ ID NO: 478877 - DNA, 25 bp, Mus musculus
tcttgcctgttttccatcgggtgaa

SEQ ID NO: 478878 - DNA, 25 bp, Mus musculus
tcttgccttacaatcatggtctccc

SEQ ID NO: 478879 - DNA, 25 bp, Mus musculus
tcttgccttaggaaaccatggacat

SEQ ID NO: 478880 - DNA, 25 bp, Mus musculus
tcttgccttgatggagagcctgcct

SEQ ID NO: 478881 - DNA, 25 bp, Mus musculus
tcttgccttgcatgcgagtctgtct

SEQ ID NO: 478882 - DNA, 25 bp, Mus musculus
tcttgcctttgagcgggtctacact

SEQ ID NO: 478883 - DNA, 25 bp, Mus musculus
tcttgcctttggtaaaatcccgttg

SEQ ID NO: 478884 - DNA, 25 bp, Mus musculus
tcttgcgagttaactggcggctgcg

SEQ ID NO: 478885 - DNA, 25 bp, Mus musculus
tcttgcgcatgctgagcaggtgtgc

SEQ ID NO: 478886 - DNA, 25 bp, Mus musculus
tcttgcggttcagcttgaaggatcc

SEQ ID NO: 478887 - DNA, 25 bp, Mus musculus
tcttgcgtctcaaactcgggttggc

SEQ ID NO: 478888 - DNA, 25 bp, Mus musculus
tcttgctacaccagtgtgagggcct

SEQ ID NO: 478889 - DNA, 25 bp, Mus musculus
tcttgctcagaaccttggtattaac

SEQ ID NO: 478890 - DNA, 25 bp, Mus musculus
tcttgctcccagcagactgactcat

SEQ ID NO: 478891 - DNA, 25 bp, Mus musculus
tcttgctcgttgctttgtcccctca

SEQ ID NO: 478892 - DNA, 25 bp, Mus musculus
tcttgctctcaggttgacaggtcag

SEQ ID NO: 478893 - DNA, 25 bp, Mus musculus
tcttgctctggactgcgagtgcacc

SEQ ID NO: 478894 - DNA, 25 bp, Mus musculus
tcttgctgagataaacaccaggaca

SEQ ID NO: 478895 - DNA, 25 bp, Mus musculus
tcttgctgctggacgtgcgctttca

SEQ ID NO: 478896 - DNA, 25 bp, Mus musculus
tcttgctgcttttggaacccagaat

SEQ ID NO: 478897 - DNA, 25 bp, Mus musculus
tcttgctggaaccaaggctccggtt

SEQ ID NO: 478898 - DNA, 25 bp, Mus musculus
tcttgctggactcaggtgagagacc

SEQ ID NO: 478899 - DNA, 25 bp, Mus musculus
tcttgctggacttcgtgacggctga

SEQ ID NO: 478900 - DNA, 25 bp, Mus musculus
tcttgctggcaaagacaggtaatgt

SEQ ID NO: 478901 - DNA, 25 bp, Mus musculus
tcttgctggtataaacaaagggcca

SEQ ID NO: 478902 - DNA, 25 bp, Mus musculus
tcttgctgtatagctcaggcggccc

SEQ ID NO: 478903 - DNA, 25 bp, Mus musculus
tcttgctgtcatctgcattcgtgct

SEQ ID NO: 478904 - DNA, 25 bp, Mus musculus
tcttgctgttaagccggtcctgagc

SEQ ID NO: 478905 - DNA, 25 bp, Mus musculus
tcttgcttacagacgcaggactgcc

SEQ ID NO: 478906 - DNA, 25 bp, Mus musculus
tcttgcttaggacaccctgacggtc

SEQ ID NO: 478907 - DNA, 25 bp, Mus musculus
tcttgcttatatagcccaggtggcc

SEQ ID NO: 478908 - DNA, 25 bp, Mus musculus
tcttgcttcaaagggacgtgcgtcc

SEQ ID NO: 478909 - DNA, 25 bp, Mus musculus
tcttgcttcccctagggaggtgcct

SEQ ID NO: 478910 - DNA, 25 bp, Mus musculus
tcttgcttgtgaccaaacagctgac

SEQ ID NO: 478911 - DNA, 25 bp, Mus musculus
tcttggaaaatcagagtcatctctc

SEQ ID NO: 478912 - DNA, 25 bp, Mus musculus
tcttggaaagctggcctgctctcgg

SEQ ID NO: 478913 - DNA, 25 bp, Mus musculus
tcttggaaatccactacatgggcag

SEQ ID NO: 478914 - DNA, 25 bp, Mus musculus
tcttggaaattcagagccctggacc

SEQ ID NO: 478915 - DNA, 25 bp, Mus musculus
tcttggaagagagcctagtgcctgc

SEQ ID NO: 478916 - DNA, 25 bp, Mus musculus
tcttggaagcccctaaactctgagc

SEQ ID NO: 478917 - DNA, 25 bp, Mus musculus
tcttggaagcgctctcgacgttccg

SEQ ID NO: 478918 - DNA, 25 bp, Mus musculus
tcttggaaggcaaggtcatgccatc

SEQ ID NO: 478919 - DNA, 25 bp, Mus musculus
tcttggaaggttactgaccagctgc

SEQ ID NO: 478920 - DNA, 25 bp, Mus musculus
tcttggaagtcaaccgtcaggagct

SEQ ID NO: 478921 - DNA, 25 bp, Mus musculus
tcttggaagtgtctcggcaaccgct

SEQ ID NO: 478922 - DNA, 25 bp, Mus musculus
tcttggaataattttaagggtctgg

SEQ ID NO: 478923 - DNA, 25 bp, Mus musculus
tcttggacaaggacggttcaccgaa

SEQ ID NO: 478924 - DNA, 25 bp, Mus musculus
tcttggacataacagcaacatgggc

SEQ ID NO: 478925 - DNA, 25 bp, Mus musculus
tcttggacccaacaaaatgcgcgat

SEQ ID NO: 478926 - DNA, 25 bp, Mus musculus
tcttggacctctgccaatgaagatg

SEQ ID NO: 478927 - DNA, 25 bp, Mus musculus
tcttggacgaagaacagatcaatac

SEQ ID NO: 478928 - DNA, 25 bp, Mus musculus
tcttggagaaaacacttacctggtc

SEQ ID NO: 478929 - DNA, 25 bp, Mus musculus
tcttggagaaaacagatgtgcctgg

SEQ ID NO: 478930 - DNA, 25 bp, Mus musculus
tcttggagaacacaagccgtggtct

SEQ ID NO: 478931 - DNA, 25 bp, Mus musculus
tcttggagacaatgcccgtagcctg

SEQ ID NO: 478932 - DNA, 25 bp, Mus musculus
tcttggagcccactatcaggctgcg

SEQ ID NO: 478933 - DNA, 25 bp, Mus musculus
tcttggagccttgtttacattggta

SEQ ID NO: 478934 - DNA, 25 bp, Mus musculus
tcttggaggattgcaggccttgacc

SEQ ID NO: 478935 - DNA, 25 bp, Mus musculus
tcttggaggtcgaatccgggacacc

SEQ ID NO: 478936 - DNA, 25 bp, Mus musculus
tcttggaggtgagtagccaacttct

SEQ ID NO: 478937 - DNA, 25 bp, Mus musculus
tcttggagtcagtccagccaaaggg

SEQ ID NO: 478938 - DNA, 25 bp, Mus musculus
tcttggagtttctttcactggatca

SEQ ID NO: 478939 - DNA, 25 bp, Mus musculus
tcttggatcaagaacagcgcgggaa

SEQ ID NO: 478940 - DNA, 25 bp, Mus musculus
tcttggatcacctgataggacaccc

SEQ ID NO: 478941 - DNA, 25 bp, Mus musculus
tcttggatggatgtgccacgaggca

SEQ ID NO: 478942 - DNA, 25 bp, Mus musculus
tcttggattgagaaacatggcccca

SEQ ID NO: 478943 - DNA, 25 bp, Mus musculus
tcttggcaaaacgaaacgcaggcct

SEQ ID NO: 478944 - DNA, 25 bp, Mus musculus
tcttggcaaaggaaactcagtctac

SEQ ID NO: 478945 - DNA, 25 bp, Mus musculus
tcttggcaacgactccacgcatgtg

SEQ ID NO: 478946 - DNA, 25 bp, Mus musculus
tcttggcactgaagcttgacgcggt

SEQ ID NO: 478947 - DNA, 25 bp, Mus musculus
tcttggccagacagggaaatgacag

SEQ ID NO: 478948 - DNA, 25 bp, Mus musculus
tcttggcccctactggtctgaggag

SEQ ID NO: 478949 - DNA, 25 bp, Mus musculus
tcttggcctggaagaaccccgagtt

SEQ ID NO: 478950 - DNA, 25 bp, Mus musculus
tcttggcgaagatgtccgagctggt

SEQ ID NO: 478951 - DNA, 25 bp, Mus musculus
tcttggcggagagatctttaacctc

SEQ ID NO: 478952 - DNA, 25 bp, Mus musculus
tcttggctcttttggagtacttgac

SEQ ID NO: 478953 - DNA, 25 bp, Mus musculus
tcttggctggctggaatgtatgtct

SEQ ID NO: 478954 - DNA, 25 bp, Mus musculus
tcttggctgggatgtccgaggaacc

SEQ ID NO: 478955 - DNA, 25 bp, Mus musculus
tcttggcttgtttgcataaatttcc

SEQ ID NO: 478956 - DNA, 25 bp, Mus musculus
tcttggcttttccagccccaggact

SEQ ID NO: 478957 - DNA, 25 bp, Mus musculus
tcttgggaaaggaccaaagctcttg

SEQ ID NO: 478958 - DNA, 25 bp, Mus musculus
tcttgggaacattgctgacttgggt

SEQ ID NO: 478959 - DNA, 25 bp, Mus musculus
tcttgggaacggaagaaggaccaag

SEQ ID NO: 478960 - DNA, 25 bp, Mus musculus
tcttgggaagagctttgtaaccgtg

SEQ ID NO: 478961 - DNA, 25 bp, Mus musculus
tcttgggacacttttgggagcacag

SEQ ID NO: 478962 - DNA, 25 bp, Mus musculus
tcttgggacctctaggaggaacatg

SEQ ID NO: 478963 - DNA, 25 bp, Mus musculus
tcttgggacctgaatccacattttc

SEQ ID NO: 478964 - DNA, 25 bp, Mus musculus
tcttgggacttcaggccaggcctgg

SEQ ID NO: 478965 - DNA, 25 bp, Mus musculus
tcttgggagcccgtatctggagaca

SEQ ID NO: 478966 - DNA, 25 bp, Mus musculus
tcttgggcagacgaaaactgtagca

SEQ ID NO: 478967 - DNA, 25 bp, Mus musculus
tcttgggccacatgacagaacccct

SEQ ID NO: 478968 - DNA, 25 bp, Mus musculus
tcttgggccagagctctagcttaca

SEQ ID NO: 478969 - DNA, 25 bp, Mus musculus
tcttgggccaggtctctgcagagga

SEQ ID NO: 478970 - DNA, 25 bp, Mus musculus
tcttgggcccaatgaaggaccgagt

SEQ ID NO: 478971 - DNA, 25 bp, Mus musculus
tcttgggcccaggtatcatatacac

SEQ ID NO: 478972 - DNA, 25 bp, Mus musculus
tcttgggccgaagatgcagcctgaa

SEQ ID NO: 478973 - DNA, 25 bp, Mus musculus
tcttgggcgcgagcagaactaacgt

SEQ ID NO: 478974 - DNA, 25 bp, Mus musculus
tcttgggctcgggatctggatgtca

SEQ ID NO: 478975 - DNA, 25 bp, Mus musculus
tcttgggcttacagaagttgttggg

SEQ ID NO: 478976 - DNA, 25 bp, Mus musculus
tcttgggtcctcaaatgacctgtgg

SEQ ID NO: 478977 - DNA, 25 bp, Mus musculus
tcttgggttcccagatctgattgcc

SEQ ID NO: 478978 - DNA, 25 bp, Mus musculus
tcttgggtttctgaagtcgtcctaa

SEQ ID NO: 478979 - DNA, 25 bp, Mus musculus
tcttggtaccacgatcgaggctggg

SEQ ID NO: 478980 - DNA, 25 bp, Mus musculus
tcttggtagaaggtgcaaacgcagc

SEQ ID NO: 478981 - DNA, 25 bp, Mus musculus
tcttggtaggctccaagactctcag

SEQ ID NO: 478982 - DNA, 25 bp, Mus musculus
tcttggtatatcatccagggtggcg

SEQ ID NO: 478983 - DNA, 25 bp, Mus musculus
tcttggtatctccttggacaggata

SEQ ID NO: 478984 - DNA, 25 bp, Mus musculus
tcttggtcaaaaggcggaattccca

SEQ ID NO: 478985 - DNA, 25 bp, Mus musculus
tcttggtcacacagtctccgggtag

SEQ ID NO: 478986 - DNA, 25 bp, Mus musculus
tcttggtcaggccttcgaagttctg

SEQ ID NO: 478987 - DNA, 25 bp, Mus musculus
tcttggtcatagcagggaagatgtc

SEQ ID NO: 478988 - DNA, 25 bp, Mus musculus
tcttggtcatcggaaatgcgggaac

SEQ ID NO: 478989 - DNA, 25 bp, Mus musculus
tcttggtctgcagcatggagacact

SEQ ID NO: 478990 - DNA, 25 bp, Mus musculus
tcttggtcttcctgttgggtctggt

SEQ ID NO: 478991 - DNA, 25 bp, Mus musculus
tcttggtgaacttgtggcgagccca

SEQ ID NO: 478992 - DNA, 25 bp, Mus musculus
tcttggtgaataaatacggcagccg

SEQ ID NO: 478993 - DNA, 25 bp, Mus musculus
tcttggtgactcagacattctttag

SEQ ID NO: 478994 - DNA, 25 bp, Mus musculus
tcttggtgagatccatcaggcagct

SEQ ID NO: 478995 - DNA, 25 bp, Mus musculus
tcttggtggagcatgaacttctgca

SEQ ID NO: 478996 - DNA, 25 bp, Mus musculus
tcttggtgggtggacatgtatgctt

SEQ ID NO: 478997 - DNA, 25 bp, Mus musculus
tcttggtggtgataagctactggtc

SEQ ID NO: 478998 - DNA, 25 bp, Mus musculus
tcttggtgtctgtgtcgttcctgtc

SEQ ID NO: 478999 - DNA, 25 bp, Mus musculus
tcttggtgtcttggcctgctctgct

SEQ ID NO: 479000 - DNA, 25 bp, Mus musculus
tcttggttatctatgcagtcacagt

SEQ ID NO: 479001 - DNA, 25 bp, Mus musculus
tcttggttgctttatgggcactggg

SEQ ID NO: 479002 - DNA, 25 bp, Mus musculus
tcttggtttctttgtgaccagcaca

SEQ ID NO: 479003 - DNA, 25 bp, Mus musculus
tcttggtttgcattggtcggcggcc

SEQ ID NO: 479004 - DNA, 25 bp, Mus musculus
tcttgtaaaactgcgctgttgagac

SEQ ID NO: 479005 - DNA, 25 bp, Mus musculus
tcttgtaaatagacccagagcaggt

SEQ ID NO: 479006 - DNA, 25 bp, Mus musculus
tcttgtaacgtccaaggcaagctcc

SEQ ID NO: 479007 - DNA, 25 bp, Mus musculus
tcttgtaaggacgaaacgggactgg

SEQ ID NO: 479008 - DNA, 25 bp, Mus musculus
tcttgtaccgtgatgccgagaggca

SEQ ID NO: 479009 - DNA, 25 bp, Mus musculus
tcttgtaccttacagctttggaggc

SEQ ID NO: 479010 - DNA, 25 bp, Mus musculus
tcttgtactatgtgggcagaacccc

SEQ ID NO: 479011 - DNA, 25 bp, Mus musculus
tcttgtactcgtcgctcagcttgtc

SEQ ID NO: 479012 - DNA, 25 bp, Mus musculus
tcttgtatcgtcacttctgggctga

SEQ ID NO: 479013 - DNA, 25 bp, Mus musculus
tcttgtatctgaggaacgtgtccgc

SEQ ID NO: 479014 - DNA, 25 bp, Mus musculus
tcttgtatgaaacttcccacattgc

SEQ ID NO: 479015 - DNA, 25 bp, Mus musculus
tcttgtattcctatgaagagacaac

SEQ ID NO: 479016 - DNA, 25 bp, Mus musculus
tcttgtcagaagacgttaaggtcaa

SEQ ID NO: 479017 - DNA, 25 bp, Mus musculus
tcttgtcagagaaacacaatgggct

SEQ ID NO: 479018 - DNA, 25 bp, Mus musculus
tcttgtcagagtggctaccagcagg

SEQ ID NO: 479019 - DNA, 25 bp, Mus musculus
tcttgtcagtcttgtccaggagcgt

SEQ ID NO: 479020 - DNA, 25 bp, Mus musculus
tcttgtcatagtaccagaaagctgt

SEQ ID NO: 479021 - DNA, 25 bp, Mus musculus
tcttgtcccaaaagataggcctgag

SEQ ID NO: 479022 - DNA, 25 bp, Mus musculus
tcttgtccccctaggatcctggctt

SEQ ID NO: 479023 - DNA, 25 bp, Mus musculus
tcttgtccgggcctatgagctcatg

SEQ ID NO: 479024 - DNA, 25 bp, Mus musculus
tcttgtcctcactgtacatgtggta

SEQ ID NO: 479025 - DNA, 25 bp, Mus musculus
tcttgtcgtctttgctgggaaccga

SEQ ID NO: 479026 - DNA, 25 bp, Mus musculus
tcttgtctatttcaaaactgtcccc

SEQ ID NO: 479027 - DNA, 25 bp, Mus musculus
tcttgtcttggtgaaggctcctttt

SEQ ID NO: 479028 - DNA, 25 bp, Mus musculus
tcttgtgaaattactcaattctcaa

SEQ ID NO: 479029 - DNA, 25 bp, Mus musculus
tcttgtgaacacaaggcaccccaag

SEQ ID NO: 479030 - DNA, 25 bp, Mus musculus
tcttgtgaagtcatcgatctgcgga

SEQ ID NO: 479031 - DNA, 25 bp, Mus musculus
tcttgtgacggcaaccaggagctct

SEQ ID NO: 479032 - DNA, 25 bp, Mus musculus
tcttgtgagcaagtccaacatcggc

SEQ ID NO: 479033 - DNA, 25 bp, Mus musculus
tcttgtgagcagatcaggaccctta

SEQ ID NO: 479034 - DNA, 25 bp, Mus musculus
tcttgtgaggatctatctcatcact

SEQ ID NO: 479035 - DNA, 25 bp, Mus musculus
tcttgtgcaatgtatccggtcgtgg

SEQ ID NO: 479036 - DNA, 25 bp, Mus musculus
tcttgtgccggtctggtaatgaacc

SEQ ID NO: 479037 - DNA, 25 bp, Mus musculus
tcttgtgcgcaccatactggctaga

SEQ ID NO: 479038 - DNA, 25 bp, Mus musculus
tcttgtgctaaagctgagccgccta

SEQ ID NO: 479039 - DNA, 25 bp, Mus musculus
tcttgtgctgggaaaatctctggac

SEQ ID NO: 479040 - DNA, 25 bp, Mus musculus
tcttgtgcttagagaccataggccc

SEQ ID NO: 479041 - DNA, 25 bp, Mus musculus
tcttgtggagtagacagtgcgtcac

SEQ ID NO: 479042 - DNA, 25 bp, Mus musculus
tcttgtggcgaaaatcacggtgtca

SEQ ID NO: 479043 - DNA, 25 bp, Mus musculus
tcttgtgggcaccagaactaacacc

SEQ ID NO: 479044 - DNA, 25 bp, Mus musculus
tcttgtggtagcttctaaagcagca

SEQ ID NO: 479045 - DNA, 25 bp, Mus musculus
tcttgtggtgtgcttggaagtccct

SEQ ID NO: 479046 - DNA, 25 bp, Mus musculus
tcttgtgtacaagccctgaatggtg

SEQ ID NO: 479047 - DNA, 25 bp, Mus musculus
tcttgtgtgcaaagctccactcggt

SEQ ID NO: 479048 - DNA, 25 bp, Mus musculus
tcttgtgtggaaacctgctcgctca

SEQ ID NO: 479049 - DNA, 25 bp, Mus musculus
tcttgtgtggcaaatctgagaacgc

SEQ ID NO: 479050 - DNA, 25 bp, Mus musculus
tcttgtgtgtttacccatgagcagg

SEQ ID NO: 479051 - DNA, 25 bp, Mus musculus
tcttgtgttacaaccgcggctgtgg

SEQ ID NO: 479052 - DNA, 25 bp, Mus musculus
tcttgttaagtcatgggcacacatc

SEQ ID NO: 479053 - DNA, 25 bp, Mus musculus
tcttgttacacttcagctaggcgag

SEQ ID NO: 479054 - DNA, 25 bp, Mus musculus
tcttgttacagcagtcagacagaca

SEQ ID NO: 479055 - DNA, 25 bp, Mus musculus
tcttgttcaaagaagaggtaacagg

SEQ ID NO: 479056 - DNA, 25 bp, Mus musculus
tcttgttcactaaatgagctgggca

SEQ ID NO: 479057 - DNA, 25 bp, Mus musculus
tcttgttccattgttcagtatgaca

SEQ ID NO: 479058 - DNA, 25 bp, Mus musculus
tcttgttccttgtgctgagcgccct

SEQ ID NO: 479059 - DNA, 25 bp, Mus musculus
tcttgttctctagattcagtgtagc

SEQ ID NO: 479060 - DNA, 25 bp, Mus musculus
tcttgttctgtcttgacctcttgta

SEQ ID NO: 479061 - DNA, 25 bp, Mus musculus
tcttgttgcaacttcaatccttcgg

SEQ ID NO: 479062 - DNA, 25 bp, Mus musculus
tcttgttggcggctccgtttctttt

SEQ ID NO: 479063 - DNA, 25 bp, Mus musculus
tcttgttgggatgggtctgttatta

SEQ ID NO: 479064 - DNA, 25 bp, Mus musculus
tcttgttgggccacagagcatcgaa

SEQ ID NO: 479065 - DNA, 25 bp, Mus musculus
tcttgttgtgaatcaaagtggctgt

SEQ ID NO: 479066 - DNA, 25 bp, Mus musculus
tcttgtttgatgaaagcagctgctc

SEQ ID NO: 479067 - DNA, 25 bp, Mus musculus
tctttaaagagccatgtctgagaag

SEQ ID NO: 479068 - DNA, 25 bp, Mus musculus
tctttaaatttagcacagtgtatga

SEQ ID NO: 479069 - DNA, 25 bp, Mus musculus
tctttaacataatggcagagtggac

SEQ ID NO: 479070 - DNA, 25 bp, Mus musculus
tctttaaccaagaggtcctgcagcg

SEQ ID NO: 479071 - DNA, 25 bp, Mus musculus
tctttaagaatctcatgtaccccag

SEQ ID NO: 479072 - DNA, 25 bp, Mus musculus
tctttaagacgaagaaggctacgcc

SEQ ID NO: 479073 - DNA, 25 bp, Mus musculus
tctttaagagtgacctggagtcgcc

SEQ ID NO: 479074 - DNA, 25 bp, Mus musculus
tctttaagataaacaggagctgggc

SEQ ID NO: 479075 - DNA, 25 bp, Mus musculus
tctttaaggaaatcgactgggccca

SEQ ID NO: 479076 - DNA, 25 bp, Mus musculus
tctttaagggcttagacccaccagg

SEQ ID NO: 479077 - DNA, 25 bp, Mus musculus
tctttaatgacagatgagcctggcc

SEQ ID NO: 479078 - DNA, 25 bp, Mus musculus
tctttacaaggatccgtggtcacgg

SEQ ID NO: 479079 - DNA, 25 bp, Mus musculus
tctttacagcaagtgagtcacacct

SEQ ID NO: 479080 - DNA, 25 bp, Mus musculus
tctttaccaacaagctaagtgagcc

SEQ ID NO: 479081 - DNA, 25 bp, Mus musculus
tctttacccaccagagacaggcctg

SEQ ID NO: 479082 - DNA, 25 bp, Mus musculus
tctttacccagaaaaggtgctgtgg

SEQ ID NO: 479083 - DNA, 25 bp, Mus musculus
tctttacctgccagcctagagaggg

SEQ ID NO: 479084 - DNA, 25 bp, Mus musculus
tctttacgactaacatcttcaggaa

SEQ ID NO: 479085 - DNA, 25 bp, Mus musculus
tctttacgtccgcaagcagagggct

SEQ ID NO: 479086 - DNA, 25 bp, Mus musculus
tctttactgcttggttgaaactact

SEQ ID NO: 479087 - DNA, 25 bp, Mus musculus
tctttagaatgtggaagggtcactc

SEQ ID NO: 479088 - DNA, 25 bp, Mus musculus
tctttagaccgggaggaaactccag

SEQ ID NO: 479089 - DNA, 25 bp, Mus musculus
tctttagactgctgggtgaggcaca

SEQ ID NO: 479090 - DNA, 25 bp, Mus musculus
tctttagagtctgggctattgcgcc

SEQ ID NO: 479091 - DNA, 25 bp, Mus musculus
tctttagcaacaaggtggcctgtgc

SEQ ID NO: 479092 - DNA, 25 bp, Mus musculus
tctttagcaagaaggaaggctctga

SEQ ID NO: 479093 - DNA, 25 bp, Mus musculus
tctttagcccagtggaaagggaaga

SEQ ID NO: 479094 - DNA, 25 bp, Mus musculus
tctttaggagagagtgcaacagaga

SEQ ID NO: 479095 - DNA, 25 bp, Mus musculus
tctttaggatcccaaggagatgtcc

SEQ ID NO: 479096 - DNA, 25 bp, Mus musculus
tctttagggctgtagacaaccctga

SEQ ID NO: 479097 - DNA, 25 bp, Mus musculus
tctttataagactctgttacggcat

SEQ ID NO: 479098 - DNA, 25 bp, Mus musculus
tctttatcaaaagcagagtggagac

SEQ ID NO: 479099 - DNA, 25 bp, Mus musculus
tctttatcagtaccaggctgcttaa

SEQ ID NO: 479100 - DNA, 25 bp, Mus musculus
tctttatcccttgtagatccttcca

SEQ ID NO: 479101 - DNA, 25 bp, Mus musculus
tctttatccgggtcaggaaactggg

SEQ ID NO: 479102 - DNA, 25 bp, Mus musculus
tctttatcttgctctgtgaggaagc

SEQ ID NO: 479103 - DNA, 25 bp, Mus musculus
tctttatgccttcaaatattggtgc

SEQ ID NO: 479104 - DNA, 25 bp, Mus musculus
tctttatggagatggcggacagact

SEQ ID NO: 479105 - DNA, 25 bp, Mus musculus
tctttatgtctgctagtgggcttca

SEQ ID NO: 479106 - DNA, 25 bp, Mus musculus
tctttattacagtgcagagtccatc

SEQ ID NO: 479107 - DNA, 25 bp, Mus musculus
tctttattctatgggacaggcctta

SEQ ID NO: 479108 - DNA, 25 bp, Mus musculus
tctttattgattaactgaacgattg

SEQ ID NO: 479109 - DNA, 25 bp, Mus musculus
tctttattggcacagtaggccgctc

SEQ ID NO: 479110 - DNA, 25 bp, Mus musculus
tctttatttttagcagggggctgtc

SEQ ID NO: 479111 - DNA, 25 bp, Mus musculus
tctttcaaatacgaagtctgctcca

SEQ ID NO: 479112 - DNA, 25 bp, Mus musculus
tctttcaactgagctaatgcacctt

SEQ ID NO: 479113 - DNA, 25 bp, Mus musculus
tctttcaagtctcggctaacacggg

SEQ ID NO: 479114 - DNA, 25 bp, Mus musculus
tctttcaccttttgatggacctcag

SEQ ID NO: 479115 - DNA, 25 bp, Mus musculus
tctttcacgcaggaagctctttgtg

SEQ ID NO: 479116 - DNA, 25 bp, Mus musculus
tctttcagagacgaggccaggatct

SEQ ID NO: 479117 - DNA, 25 bp, Mus musculus
tctttcagagttaagaaggcctgcc

SEQ ID NO: 479118 - DNA, 25 bp, Mus musculus
tctttcaggaacagaattgggaccc

SEQ ID NO: 479119 - DNA, 25 bp, Mus musculus
tctttcatacgtgcgaggtgcaggg

SEQ ID NO: 479120 - DNA, 25 bp, Mus musculus
tctttcatagatccttatcagcaca

SEQ ID NO: 479121 - DNA, 25 bp, Mus musculus
tctttcatgaaggtggacactggcg

SEQ ID NO: 479122 - DNA, 25 bp, Mus musculus
tctttcatggaggacaacagccgct

SEQ ID NO: 479123 - DNA, 25 bp, Mus musculus
tctttcatgtgaacccagctgacag

SEQ ID NO: 479124 - DNA, 25 bp, Mus musculus
tctttccaccacacaaaagctgagg

SEQ ID NO: 479125 - DNA, 25 bp, Mus musculus
tctttccaccgcagaagcaaatgaa

SEQ ID NO: 479126 - DNA, 25 bp, Mus musculus
tctttccactctcccctggtgatgg

SEQ ID NO: 479127 - DNA, 25 bp, Mus musculus
tctttcccaatgatgcacttctgcc

SEQ ID NO: 479128 - DNA, 25 bp, Mus musculus
tctttcccacattaaaagtgcaggg

SEQ ID NO: 479129 - DNA, 25 bp, Mus musculus
tctttcccgaggtctgcggccggca

SEQ ID NO: 479130 - DNA, 25 bp, Mus musculus
tctttccctggcagcagtgtgagaa

SEQ ID NO: 479131 - DNA, 25 bp, Mus musculus
tctttccctttctctcgctgaaggg

SEQ ID NO: 479132 - DNA, 25 bp, Mus musculus
tctttccgagacaggacgatgtgct

SEQ ID NO: 479133 - DNA, 25 bp, Mus musculus
tctttccggaagagaagggcctgag

SEQ ID NO: 479134 - DNA, 25 bp, Mus musculus
tctttccgggagaactggcaacggg

SEQ ID NO: 479135 - DNA, 25 bp, Mus musculus
tctttcctaaacctgcctagagagg

SEQ ID NO: 479136 - DNA, 25 bp, Mus musculus
tctttcctcctgagactcttagcgt

SEQ ID NO: 479137 - DNA, 25 bp, Mus musculus
tctttcctcttcttgggtacccagg

SEQ ID NO: 479138 - DNA, 25 bp, Mus musculus
tctttcctggagaggcgttagtccc

SEQ ID NO: 479139 - DNA, 25 bp, Mus musculus
tctttcgcagccagaggcgtcttgt

SEQ ID NO: 479140 - DNA, 25 bp, Mus musculus
tctttcgcgcttttgctaaatggcg

SEQ ID NO: 479141 - DNA, 25 bp, Mus musculus
tctttcggaactgaaggagctctcg

SEQ ID NO: 479142 - DNA, 25 bp, Mus musculus
tctttcgggtcattcctgcagaggg

SEQ ID NO: 479143 - DNA, 25 bp, Mus musculus
tctttctaggcatggtgggactccg

SEQ ID NO: 479144 - DNA, 25 bp, Mus musculus
tctttctatggcgaaaatgctgctt

SEQ ID NO: 479145 - DNA, 25 bp, Mus musculus
tctttctcaataaacttcacatgga

SEQ ID NO: 479146 - DNA, 25 bp, Mus musculus
tctttctcactgtggaactggagtc

SEQ ID NO: 479147 - DNA, 25 bp, Mus musculus
tctttctccatgtcttgcggcggtg

SEQ ID NO: 479148 - DNA, 25 bp, Mus musculus
tctttctccgacagctgctccggga

SEQ ID NO: 479149 - DNA, 25 bp, Mus musculus
tctttctcctcctttccacgtgtgg

SEQ ID NO: 479150 - DNA, 25 bp, Mus musculus
tctttctctgcaaagctgggcctaa

SEQ ID NO: 479151 - DNA, 25 bp, Mus musculus
tctttctgaaacccagcactgcctt

SEQ ID NO: 479152 - DNA, 25 bp, Mus musculus
tctttctgacaacacactgcactgg

SEQ ID NO: 479153 - DNA, 25 bp, Mus musculus
tctttctgaggaagcagcgaaccaa

SEQ ID NO: 479154 - DNA, 25 bp, Mus musculus
tctttctgatatcactgtctaccca

SEQ ID NO: 479155 - DNA, 25 bp, Mus musculus
tctttctgcagcattagagccaccg

SEQ ID NO: 479156 - DNA, 25 bp, Mus musculus
tctttctgggatgagcaatggtgcc

SEQ ID NO: 479157 - DNA, 25 bp, Mus musculus
tctttctgggcagctctaccgggag

SEQ ID NO: 479158 - DNA, 25 bp, Mus musculus
tctttctgggctctaactgactggt

SEQ ID NO: 479159 - DNA, 25 bp, Mus musculus
tctttctgtccacgagcgaggtgct

SEQ ID NO: 479160 - DNA, 25 bp, Mus musculus
tctttctgtgccatgaggccaccgc

SEQ ID NO: 479161 - DNA, 25 bp, Mus musculus
tctttctgtggaggacagacggccg

SEQ ID NO: 479162 - DNA, 25 bp, Mus musculus
tctttcttatgagggctgcatggcc

SEQ ID NO: 479163 - DNA, 25 bp, Mus musculus
tctttcttccagtgagtcagccggc

SEQ ID NO: 479164 - DNA, 25 bp, Mus musculus
tctttcttcgttgtcactggtctca

SEQ ID NO: 479165 - DNA, 25 bp, Mus musculus
tctttctttgaggatagtgacctgc

SEQ ID NO: 479166 - DNA, 25 bp, Mus musculus
tctttgaaaactgtcccatgggctc

SEQ ID NO: 479167 - DNA, 25 bp, Mus musculus
tctttgaaaccaaaagtcagtgaca

SEQ ID NO: 479168 - DNA, 25 bp, Mus musculus
tctttgaaatggatagcagtccgag

SEQ ID NO: 479169 - DNA, 25 bp, Mus musculus
tctttgaagatgtccgattgccagc

SEQ ID NO: 479170 - DNA, 25 bp, Mus musculus
tctttgaagcactgggcatcgcaca

SEQ ID NO: 479171 - DNA, 25 bp, Mus musculus
tctttgaagcgctctggaaaggcca

SEQ ID NO: 479172 - DNA, 25 bp, Mus musculus
tctttgaatgcgctgctccctggat

SEQ ID NO: 479173 - DNA, 25 bp, Mus musculus
tctttgacaatgaactcctggagga

SEQ ID NO: 479174 - DNA, 25 bp, Mus musculus
tctttgacgagaacaacgacgcggc

SEQ ID NO: 479175 - DNA, 25 bp, Mus musculus
tctttgacttgcgagggacattcca

SEQ ID NO: 479176 - DNA, 25 bp, Mus musculus
tctttgagacaaccaagtgttacca

SEQ ID NO: 479177 - DNA, 25 bp, Mus musculus
tctttgagacctctgatggacgcat

SEQ ID NO: 479178 - DNA, 25 bp, Mus musculus
tctttgagagaacagctgaactcaa

SEQ ID NO: 479179 - DNA, 25 bp, Mus musculus
tctttgagagtttgtagtcccggca

SEQ ID NO: 479180 - DNA, 25 bp, Mus musculus
tctttgagccatccctggcagtagg

SEQ ID NO: 479181 - DNA, 25 bp, Mus musculus
tctttgagccttttctgaacaggtc

SEQ ID NO: 479182 - DNA, 25 bp, Mus musculus
tctttgagctgtgagcatgccctca

SEQ ID NO: 479183 - DNA, 25 bp, Mus musculus
tctttgagtacctgtgagtgggtga

SEQ ID NO: 479184 - DNA, 25 bp, Mus musculus
tctttgagtccctcaaggactggct

SEQ ID NO: 479185 - DNA, 25 bp, Mus musculus
tctttgatgaaacgaaggctgacct

SEQ ID NO: 479186 - DNA, 25 bp, Mus musculus
tctttgatgaggacaacagcgccct

SEQ ID NO: 479187 - DNA, 25 bp, Mus musculus
tctttgatggcatcttcagcaaccc

SEQ ID NO: 479188 - DNA, 25 bp, Mus musculus
tctttgatggcgatgtggaccccga

SEQ ID NO: 479189 - DNA, 25 bp, Mus musculus
tctttgatgtctcagtcacgtgaac

SEQ ID NO: 479190 - DNA, 25 bp, Mus musculus
tctttgatgtgaaccgcattggaca

SEQ ID NO: 479191 - DNA, 25 bp, Mus musculus
tctttgcagagcagaacagccgtga

SEQ ID NO: 479192 - DNA, 25 bp, Mus musculus
tctttgcagataatgggaaccttgg

SEQ ID NO: 479193 - DNA, 25 bp, Mus musculus
tctttgcagcaaggcagagaacgcc

SEQ ID NO: 479194 - DNA, 25 bp, Mus musculus
tctttgcagccgtcaaggacaccat

SEQ ID NO: 479195 - DNA, 25 bp, Mus musculus
tctttgcagcggagatcatggacgc

SEQ ID NO: 479196 - DNA, 25 bp, Mus musculus
tctttgcaggcaagtagagactcgg

SEQ ID NO: 479197 - DNA, 25 bp, Mus musculus
tctttgcagtggtgcttgccatccc

SEQ ID NO: 479198 - DNA, 25 bp, Mus musculus
tctttgcattcaagtgttcgagggc

SEQ ID NO: 479199 - DNA, 25 bp, Mus musculus
tctttgccaataccttaatgtgcct

SEQ ID NO: 479200 - DNA, 25 bp, Mus musculus
tctttgccatgtcggagctgtccgc

SEQ ID NO: 479201 - DNA, 25 bp, Mus musculus
tctttgcccatagttgagtttgcca

SEQ ID NO: 479202 - DNA, 25 bp, Mus musculus
tctttgccctgatgggcaccaccgt

SEQ ID NO: 479203 - DNA, 25 bp, Mus musculus
tctttgccgagaagctgtacgaagc

SEQ ID NO: 479204 - DNA, 25 bp, Mus musculus
tctttgccggaagagatgcatccag

SEQ ID NO: 479205 - DNA, 25 bp, Mus musculus
tctttgcctccactgatgagcgccg

SEQ ID NO: 479206 - DNA, 25 bp, Mus musculus
tctttgcctgtcatgagaagctgca

SEQ ID NO: 479207 - DNA, 25 bp, Mus musculus
tctttgccttaactccactgctgtg

SEQ ID NO: 479208 - DNA, 25 bp, Mus musculus
tctttgccttcagtgctagatataa

SEQ ID NO: 479209 - DNA, 25 bp, Mus musculus
tctttgccttctaacagggctcgag

SEQ ID NO: 479210 - DNA, 25 bp, Mus musculus
tctttgcggaacacctcagcgatga

SEQ ID NO: 479211 - DNA, 25 bp, Mus musculus
tctttgcggccatgcccaagaataa

SEQ ID NO: 479212 - DNA, 25 bp, Mus musculus
tctttgcggtaactaggtccacagg

SEQ ID NO: 479213 - DNA, 25 bp, Mus musculus
tctttgctacaaaaaccgtcactgg

SEQ ID NO: 479214 - DNA, 25 bp, Mus musculus
tctttgctgcttgagacggacctgc

SEQ ID NO: 479215 - DNA, 25 bp, Mus musculus
tctttgctggctatcctcacttgct

SEQ ID NO: 479216 - DNA, 25 bp, Mus musculus
tctttgctggtatctccctggaagg

SEQ ID NO: 479217 - DNA, 25 bp, Mus musculus
tctttgcttactggaatgtgaactc

SEQ ID NO: 479218 - DNA, 25 bp, Mus musculus
tctttggaacctaaccgcagcttgg

SEQ ID NO: 479219 - DNA, 25 bp, Mus musculus
tctttggagacgcaacgacatgaag

SEQ ID NO: 479220 - DNA, 25 bp, Mus musculus
tctttggagtgagtaggaacagcat

SEQ ID NO: 479221 - DNA, 25 bp, Mus musculus
tctttggcaaccaagaggaactgga

SEQ ID NO: 479222 - DNA, 25 bp, Mus musculus
tctttggcacatctacaggcgcacc

SEQ ID NO: 479223 - DNA, 25 bp, Mus musculus
tctttggcatggacagaccctccca

SEQ ID NO: 479224 - DNA, 25 bp, Mus musculus
tctttggcgcctaaacttattgctg

SEQ ID NO: 479225 - DNA, 25 bp, Mus musculus
tctttgggaaggagatacacagtcc

SEQ ID NO: 479226 - DNA, 25 bp, Mus musculus
tctttgggacaggacctgtttacac

SEQ ID NO: 479227 - DNA, 25 bp, Mus musculus
tctttgggagaccaatagacgcccc

SEQ ID NO: 479228 - DNA, 25 bp, Mus musculus
tctttgggatccagaactcgagcca

SEQ ID NO: 479229 - DNA, 25 bp, Mus musculus
tctttgggctagaagcaactgggca

SEQ ID NO: 479230 - DNA, 25 bp, Mus musculus
tctttggtctcagaacaggcctaga

SEQ ID NO: 479231 - DNA, 25 bp, Mus musculus
tctttggtgaaggaactaggcgacc

SEQ ID NO: 479232 - DNA, 25 bp, Mus musculus
tctttggtgacatagggcatttccc

SEQ ID NO: 479233 - DNA, 25 bp, Mus musculus
tctttggttaaactaggcccagcca

SEQ ID NO: 479234 - DNA, 25 bp, Mus musculus
tctttgtaaatgtgattgttcagta

SEQ ID NO: 479235 - DNA, 25 bp, Mus musculus
tctttgtaaggactgtatagaatta

SEQ ID NO: 479236 - DNA, 25 bp, Mus musculus
tctttgtacctgacagacctgggac

SEQ ID NO: 479237 - DNA, 25 bp, Mus musculus
tctttgtcaaaggatgaacctggaa

SEQ ID NO: 479238 - DNA, 25 bp, Mus musculus
tctttgtcgtttgacccgggcctca

SEQ ID NO: 479239 - DNA, 25 bp, Mus musculus
tctttgtctctgaagactgggccgt

SEQ ID NO: 479240 - DNA, 25 bp, Mus musculus
tctttgtgaaaaacccggatggcag

SEQ ID NO: 479241 - DNA, 25 bp, Mus musculus
tctttgtgccgctgagcaagtcccg

SEQ ID NO: 479242 - DNA, 25 bp, Mus musculus
tctttgtgcgcggatcagctgtacc

SEQ ID NO: 479243 - DNA, 25 bp, Mus musculus
tctttgtgcggcctgcggagtggag

SEQ ID NO: 479244 - DNA, 25 bp, Mus musculus
tctttgtgtgaaaaggtggaagttc

SEQ ID NO: 479245 - DNA, 25 bp, Mus musculus
tctttgttaactagggctcactgtg

SEQ ID NO: 479246 - DNA, 25 bp, Mus musculus
tctttgttaggctgcagtcggttgc

SEQ ID NO: 479247 - DNA, 25 bp, Mus musculus
tctttgttctgcctcagtcctagcc

SEQ ID NO: 479248 - DNA, 25 bp, Mus musculus
tctttgttgttaagccaagtagtcc

SEQ ID NO: 479249 - DNA, 25 bp, Mus musculus
tctttgtttaaggactgaggaccca

SEQ ID NO: 479250 - DNA, 25 bp, Mus musculus
tctttgtttctacagtgggagccaa

SEQ ID NO: 479251 - DNA, 25 bp, Mus musculus
tcttttaaaactaaagcctccgctg

SEQ ID NO: 479252 - DNA, 25 bp, Mus musculus
tcttttaagggagcaggaacaggat

SEQ ID NO: 479253 - DNA, 25 bp, Mus musculus
tcttttacagcggtgagtccttgag

SEQ ID NO: 479254 - DNA, 25 bp, Mus musculus
tcttttaccagacaaacgtggagag

SEQ ID NO: 479255 - DNA, 25 bp, Mus musculus
tcttttaccatattttctggagtgt

SEQ ID NO: 479256 - DNA, 25 bp, Mus musculus
tcttttactcaagaggctagcactg

SEQ ID NO: 479257 - DNA, 25 bp, Mus musculus
tcttttactctgttgggatgagtct

SEQ ID NO: 479258 - DNA, 25 bp, Mus musculus
tcttttactgcagtgactgtgcgtc

SEQ ID NO: 479259 - DNA, 25 bp, Mus musculus
tcttttaggcccgtccatctgtgaa

SEQ ID NO: 479260 - DNA, 25 bp, Mus musculus
tcttttatgcaggtcatcgggagga

SEQ ID NO: 479261 - DNA, 25 bp, Mus musculus
tcttttatgtgacagcgggactcct

SEQ ID NO: 479262 - DNA, 25 bp, Mus musculus
tcttttattagggtgaaggccacac

SEQ ID NO: 479263 - DNA, 25 bp, Mus musculus
tcttttatttgaggcagaatcggaa

SEQ ID NO: 479264 - DNA, 25 bp, Mus musculus
tcttttcaaggctgccatggtcccc

SEQ ID NO: 479265 - DNA, 25 bp, Mus musculus
tcttttcagaagacacatttagaca

SEQ ID NO: 479266 - DNA, 25 bp, Mus musculus
tcttttcaggtctttgctgggacca

SEQ ID NO: 479267 - DNA, 25 bp, Mus musculus
tcttttcagtactcggacggcccaa

SEQ ID NO: 479268 - DNA, 25 bp, Mus musculus
tcttttcccagaaccaggaattgtc

SEQ ID NO: 479269 - DNA, 25 bp, Mus musculus
tcttttccccatgtgatagtcattc

SEQ ID NO: 479270 - DNA, 25 bp, Mus musculus
tcttttccgacttctcaaagagaag

SEQ ID NO: 479271 - DNA, 25 bp, Mus musculus
tcttttccgagaagcggtgtgcgac

SEQ ID NO: 479272 - DNA, 25 bp, Mus musculus
tcttttccttacagatcatggagga

SEQ ID NO: 479273 - DNA, 25 bp, Mus musculus
tcttttctagggagctgaatctgag

SEQ ID NO: 479274 - DNA, 25 bp, Mus musculus
tcttttctcagactagtctgaaggg

SEQ ID NO: 479275 - DNA, 25 bp, Mus musculus
tcttttctcatgtgtaggtgttacc

SEQ ID NO: 479276 - DNA, 25 bp, Mus musculus
tcttttctctgcctggtggcagctg

SEQ ID NO: 479277 - DNA, 25 bp, Mus musculus
tcttttctgaggagtgcgctgcgcc

SEQ ID NO: 479278 - DNA, 25 bp, Mus musculus
tcttttcttaaatcagacaagaagg

SEQ ID NO: 479279 - DNA, 25 bp, Mus musculus
tcttttgaattaccgcacctctgga

SEQ ID NO: 479280 - DNA, 25 bp, Mus musculus
tcttttgagctgcagccagttgcgg

SEQ ID NO: 479281 - DNA, 25 bp, Mus musculus
tcttttgatgaaggaccgagaaacg

SEQ ID NO: 479282 - DNA, 25 bp, Mus musculus
tcttttgatggcacagcactacgtg

SEQ ID NO: 479283 - DNA, 25 bp, Mus musculus
tcttttgcaagagcgagggactcag

SEQ ID NO: 479284 - DNA, 25 bp, Mus musculus
tcttttgctgcaactctgagtccag

SEQ ID NO: 479285 - DNA, 25 bp, Mus musculus
tcttttggaagcatattgcacacct

SEQ ID NO: 479286 - DNA, 25 bp, Mus musculus
tcttttggctccgtgcctctagggc

SEQ ID NO: 479287 - DNA, 25 bp, Mus musculus
tcttttgggaagagcacaaggtcac

SEQ ID NO: 479288 - DNA, 25 bp, Mus musculus
tcttttgggtgcagtgggcaccaaa

SEQ ID NO: 479289 - DNA, 25 bp, Mus musculus
tcttttggtgcccagagagccaagc

SEQ ID NO: 479290 - DNA, 25 bp, Mus musculus
tcttttgtctgttgttccctcttcc

SEQ ID NO: 479291 - DNA, 25 bp, Mus musculus
tcttttgtggaggatgcacgagcct

SEQ ID NO: 479292 - DNA, 25 bp, Mus musculus
tcttttgttgttggcggagacgggc

SEQ ID NO: 479293 - DNA, 25 bp, Mus musculus
tctttttacactgagatgattcttc

SEQ ID NO: 479294 - DNA, 25 bp, Mus musculus
tctttttggccctccagaaaggctc

SEQ ID NO: 479295 - DNA, 25 bp, Mus musculus
tcttttttgacaaagcactgctggc

SEQ ID NO: 479296 - DNA, 25 bp, Mus musculus
tcttttttgcactcctgcgccgggt

SEQ ID NO: 479297 - DNA, 25 bp, Mus musculus
tgaaaaaagggaacattcaggaggt

SEQ ID NO: 479298 - DNA, 25 bp, Mus musculus
tgaaaaaagtagtattaaccaagtg

SEQ ID NO: 479299 - DNA, 25 bp, Mus musculus
tgaaaaacaacctgaaccccagctg

SEQ ID NO: 479300 - DNA, 25 bp, Mus musculus
tgaaaaacactgcaccgaaggagaa

SEQ ID NO: 479301 - DNA, 25 bp, Mus musculus
tgaaaaacagtttgaccacattccc

SEQ ID NO: 479302 - DNA, 25 bp, Mus musculus
tgaaaaaccaggctatctgatttta

SEQ ID NO: 479303 - DNA, 25 bp, Mus musculus
tgaaaaacttcatggagcacggact

SEQ ID NO: 479304 - DNA, 25 bp, Mus musculus
tgaaaaagccaagccgatttgcctc

SEQ ID NO: 479305 - DNA, 25 bp, Mus musculus
tgaaaaaggatcaaaacgcaccgcc

SEQ ID NO: 479306 - DNA, 25 bp, Mus musculus
tgaaaaatatgttcatggtacattg

SEQ ID NO: 479307 - DNA, 25 bp, Mus musculus
tgaaaaatatttagtgcccttttct

SEQ ID NO: 479308 - DNA, 25 bp, Mus musculus
tgaaaaatctggacataagtcgccc

SEQ ID NO: 479309 - DNA, 25 bp, Mus musculus
tgaaaacaaacggactgggtcgctg

SEQ ID NO: 479310 - DNA, 25 bp, Mus musculus
tgaaaacaagtaagccgggttcgcg

SEQ ID NO: 479311 - DNA, 25 bp, Mus musculus
tgaaaacaccgtacccattgggcat

SEQ ID NO: 479312 - DNA, 25 bp, Mus musculus
tgaaaacagtttccgggcagatcgc

SEQ ID NO: 479313 - DNA, 25 bp, Mus musculus
tgaaaacatcgtagtccacagccct

SEQ ID NO: 479314 - DNA, 25 bp, Mus musculus
tgaaaacattctagtggccaaagac

SEQ ID NO: 479315 - DNA, 25 bp, Mus musculus
tgaaaaccaaaagctggccgtgagg

SEQ ID NO: 479316 - DNA, 25 bp, Mus musculus
tgaaaaccaacctgagtcacagcgg

SEQ ID NO: 479317 - DNA, 25 bp, Mus musculus
tgaaaaccagctttcagatccgtct

SEQ ID NO: 479318 - DNA, 25 bp, Mus musculus
tgaaaaccatcttgagagaaggctg

SEQ ID NO: 479319 - DNA, 25 bp, Mus musculus
tgaaaaccccagtgctacaagatgt

SEQ ID NO: 479320 - DNA, 25 bp, Mus musculus
tgaaaacccttacgccacaattaag

SEQ ID NO: 479321 - DNA, 25 bp, Mus musculus
tgaaaacctacccatgaacctacct

SEQ ID NO: 479322 - DNA, 25 bp, Mus musculus
tgaaaacctatgacacgtacgtggg

SEQ ID NO: 479323 - DNA, 25 bp, Mus musculus
tgaaaaccttcaacatggacgagta

SEQ ID NO: 479324 - DNA, 25 bp, Mus musculus
tgaaaaccttggaggcggcttcctg

SEQ ID NO: 479325 - DNA, 25 bp, Mus musculus
tgaaaacgagtctgggcctcaagat

SEQ ID NO: 479326 - DNA, 25 bp, Mus musculus
tgaaaacgcactccagtcacagggt

SEQ ID NO: 479327 - DNA, 25 bp, Mus musculus
tgaaaacgcagctgcaggaacacgt

SEQ ID NO: 479328 - DNA, 25 bp, Mus musculus
tgaaaacgggagagtccaaggccct

SEQ ID NO: 479329 - DNA, 25 bp, Mus musculus
tgaaaacggtccaggagaaggcagc

SEQ ID NO: 479330 - DNA, 25 bp, Mus musculus
tgaaaacggtcgtgggaagagccct

SEQ ID NO: 479331 - DNA, 25 bp, Mus musculus
tgaaaactcagtcgctcgcggagcg

SEQ ID NO: 479332 - DNA, 25 bp, Mus musculus
tgaaaactcagttctctttgatgcc

SEQ ID NO: 479333 - DNA, 25 bp, Mus musculus
tgaaaactccagaggttaaacaaat

SEQ ID NO: 479334 - DNA, 25 bp, Mus musculus
tgaaaactgagtctgggagcccagc

SEQ ID NO: 479335 - DNA, 25 bp, Mus musculus
tgaaaactgtatgttaacctccaca

SEQ ID NO: 479336 - DNA, 25 bp, Mus musculus
tgaaaacttcggtgcgtaatagacg

SEQ ID NO: 479337 - DNA, 25 bp, Mus musculus
tgaaaacttcttccgagatgataaa

SEQ ID NO: 479338 - DNA, 25 bp, Mus musculus
tgaaaactttctgttgattaaatgt

SEQ ID NO: 479339 - DNA, 25 bp, Mus musculus
tgaaaagaaacatcgaccctcggca

SEQ ID NO: 479340 - DNA, 25 bp, Mus musculus
tgaaaagaaaccacgtgcaggtacg

SEQ ID NO: 479341 - DNA, 25 bp, Mus musculus
tgaaaagaacctactacgggccctg

SEQ ID NO: 479342 - DNA, 25 bp, Mus musculus
tgaaaagacagcacgattggagacg

SEQ ID NO: 479343 - DNA, 25 bp, Mus musculus
tgaaaagacatcttagcgccaggtc

SEQ ID NO: 479344 - DNA, 25 bp, Mus musculus
tgaaaagattaggaagaaatacccg

SEQ ID NO: 479345 - DNA, 25 bp, Mus musculus
tgaaaagcacagactagcgatgatc

SEQ ID NO: 479346 - DNA, 25 bp, Mus musculus
tgaaaagcactctaaggactctggg

SEQ ID NO: 479347 - DNA, 25 bp, Mus musculus
tgaaaagcagcttcctgagtccaca

SEQ ID NO: 479348 - DNA, 25 bp, Mus musculus
tgaaaagcatttccccgcctaagtg

SEQ ID NO: 479349 - DNA, 25 bp, Mus musculus
tgaaaagcccggaactggtggaagc

SEQ ID NO: 479350 - DNA, 25 bp, Mus musculus
tgaaaagcctaaccagcctgagtca

SEQ ID NO: 479351 - DNA, 25 bp, Mus musculus
tgaaaagctggtggtccttaccagc

SEQ ID NO: 479352 - DNA, 25 bp, Mus musculus
tgaaaagcttctcctgccaggtgga

SEQ ID NO: 479353 - DNA, 25 bp, Mus musculus
tgaaaaggacccacaacacggaaga

SEQ ID NO: 479354 - DNA, 25 bp, Mus musculus
tgaaaaggactatgctgaccgagag

SEQ ID NO: 479355 - DNA, 25 bp, Mus musculus
tgaaaagggcccagcgtggcgctca

SEQ ID NO: 479356 - DNA, 25 bp, Mus musculus
tgaaaagtacttcttccaggagagc

SEQ ID NO: 479357 - DNA, 25 bp, Mus musculus
tgaaaagtcttgaaccctcttctgg

SEQ ID NO: 479358 - DNA, 25 bp, Mus musculus
tgaaaagtgacaagcatgggtcccc

SEQ ID NO: 479359 - DNA, 25 bp, Mus musculus
tgaaaagtgacttgattgccgggct

SEQ ID NO: 479360 - DNA, 25 bp, Mus musculus
tgaaaagtgcaccagaccaggaggt

SEQ ID NO: 479361 - DNA, 25 bp, Mus musculus
tgaaaagttgttccttagagggtct

SEQ ID NO: 479362 - DNA, 25 bp, Mus musculus
tgaaaatacatgaaagcagtgccac

SEQ ID NO: 479363 - DNA, 25 bp, Mus musculus
tgaaaatatgcctagcggcaaggcc

SEQ ID NO: 479364 - DNA, 25 bp, Mus musculus
tgaaaatcaccactgcctgtgctgg

SEQ ID NO: 479365 - DNA, 25 bp, Mus musculus
tgaaaatcacccagcaaggcacaga

SEQ ID NO: 479366 - DNA, 25 bp, Mus musculus
tgaaaatcactcattggagctggag

SEQ ID NO: 479367 - DNA, 25 bp, Mus musculus
tgaaaatcacttagaagtccccttc

SEQ ID NO: 479368 - DNA, 25 bp, Mus musculus
tgaaaatcattgaggcagacccaac

SEQ ID NO: 479369 - DNA, 25 bp, Mus musculus
tgaaaatccagagcacagcggaggg

SEQ ID NO: 479370 - DNA, 25 bp, Mus musculus
tgaaaatcggtaaggatagtggagc

SEQ ID NO: 479371 - DNA, 25 bp, Mus musculus
tgaaaatcgtcggtagctctaactg

SEQ ID NO: 479372 - DNA, 25 bp, Mus musculus
tgaaaatgaactagggcaaagtccc

SEQ ID NO: 479373 - DNA, 25 bp, Mus musculus
tgaaaatgaagcatcccagcgctcc

SEQ ID NO: 479374 - DNA, 25 bp, Mus musculus
tgaaaatgacactcctgcaatggcc

SEQ ID NO: 479375 - DNA, 25 bp, Mus musculus
tgaaaatgcacacgtgccccggtgt

SEQ ID NO: 479376 - DNA, 25 bp, Mus musculus
tgaaaatgccaccttggagaaaacc

SEQ ID NO: 479377 - DNA, 25 bp, Mus musculus
tgaaaatgccgggatgtaccagtgc

SEQ ID NO: 479378 - DNA, 25 bp, Mus musculus
tgaaaatgccttcagggccccttga

SEQ ID NO: 479379 - DNA, 25 bp, Mus musculus
tgaaaatgcgcacatataagcccct

SEQ ID NO: 479380 - DNA, 25 bp, Mus musculus
tgaaaatggacccactgacggtagg

SEQ ID NO: 479381 - DNA, 25 bp, Mus musculus
tgaaaatggcatggccaggtgtgcc

SEQ ID NO: 479382 - DNA, 25 bp, Mus musculus
tgaaaattaccgtggcgtgcttggg

SEQ ID NO: 479383 - DNA, 25 bp, Mus musculus
tgaaaattgacctcactgtgctgct

SEQ ID NO: 479384 - DNA, 25 bp, Mus musculus
tgaaacaaacatactccaggcaggc

SEQ ID NO: 479385 - DNA, 25 bp, Mus musculus
tgaaacaaagcccacaggatacgcc

SEQ ID NO: 479386 - DNA, 25 bp, Mus musculus
tgaaacaagacctcaccagggaggc

SEQ ID NO: 479387 - DNA, 25 bp, Mus musculus
tgaaacacaagaacggaaggcctcc

SEQ ID NO: 479388 - DNA, 25 bp, Mus musculus
tgaaacacactctgggattgagccc

SEQ ID NO: 479389 - DNA, 25 bp, Mus musculus
tgaaacaccccaggaagaatatggt

SEQ ID NO: 479390 - DNA, 25 bp, Mus musculus
tgaaacacctctatctggccgaaga

SEQ ID NO: 479391 - DNA, 25 bp, Mus musculus
tgaaacacggagaaccagagacgct

SEQ ID NO: 479392 - DNA, 25 bp, Mus musculus
tgaaacacggtgacagcatgcagga

SEQ ID NO: 479393 - DNA, 25 bp, Mus musculus
tgaaacagactacacgacaggtggg

SEQ ID NO: 479394 - DNA, 25 bp, Mus musculus
tgaaacagagcccagctagtccaga

SEQ ID NO: 479395 - DNA, 25 bp, Mus musculus
tgaaacagagttggtctgtgtagcc

SEQ ID NO: 479396 - DNA, 25 bp, Mus musculus
tgaaacagcatatccaccattaaaa

SEQ ID NO: 479397 - DNA, 25 bp, Mus musculus
tgaaacagcgtgatccaggtagacc

SEQ ID NO: 479398 - DNA, 25 bp, Mus musculus
tgaaacagcgttacctggagtaccg

SEQ ID NO: 479399 - DNA, 25 bp, Mus musculus
tgaaacaggtacacagccaaagact

SEQ ID NO: 479400 - DNA, 25 bp, Mus musculus
tgaaacagttggctcgacaggcact

SEQ ID NO: 479401 - DNA, 25 bp, Mus musculus
tgaaacagttgtatgcaatgcccct

SEQ ID NO: 479402 - DNA, 25 bp, Mus musculus
tgaaacataaaaggaccgcctccgc

SEQ ID NO: 479403 - DNA, 25 bp, Mus musculus
tgaaacatgagcagaaacacaccct

SEQ ID NO: 479404 - DNA, 25 bp, Mus musculus
tgaaacatggaaccttagggcaaac

SEQ ID NO: 479405 - DNA, 25 bp, Mus musculus
tgaaacatggttggagactcacctg

SEQ ID NO: 479406 - DNA, 25 bp, Mus musculus
tgaaacatttcagtctcgcggccac

SEQ ID NO: 479407 - DNA, 25 bp, Mus musculus
tgaaaccaaacgtctggactccggt

SEQ ID NO: 479408 - DNA, 25 bp, Mus musculus
tgaaaccaaagaaacgtaaatgtgg

SEQ ID NO: 479409 - DNA, 25 bp, Mus musculus
tgaaaccacatttggagggcatgct

SEQ ID NO: 479410 - DNA, 25 bp, Mus musculus
tgaaaccaggcaggacttgcacaga

SEQ ID NO: 479411 - DNA, 25 bp, Mus musculus
tgaaaccagtttacaaggagaatga

SEQ ID NO: 479412 - DNA, 25 bp, Mus musculus
tgaaaccattagaggattttatctc

SEQ ID NO: 479413 - DNA, 25 bp, Mus musculus
tgaaacccaatcgtgagaccttgcc

SEQ ID NO: 479414 - DNA, 25 bp, Mus musculus
tgaaacccacgagaggataggaacc

SEQ ID NO: 479415 - DNA, 25 bp, Mus musculus
tgaaacccacgctcacagcacttgt

SEQ ID NO: 479416 - DNA, 25 bp, Mus musculus
tgaaacccataccaatctgtcgcag

SEQ ID NO: 479417 - DNA, 25 bp, Mus musculus
tgaaaccccatgagatccaggagaa

SEQ ID NO: 479418 - DNA, 25 bp, Mus musculus
tgaaacccgcgtggaagatgaagaa

SEQ ID NO: 479419 - DNA, 25 bp, Mus musculus
tgaaaccgctttctggcgctgctgg

SEQ ID NO: 479420 - DNA, 25 bp, Mus musculus
tgaaaccggcagctcgaacactgtg

SEQ ID NO: 479421 - DNA, 25 bp, Mus musculus
tgaaacctgaagttttagccccagg

SEQ ID NO: 479422 - DNA, 25 bp, Mus musculus
tgaaacctgagaccaagcctgcggt

SEQ ID NO: 479423 - DNA, 25 bp, Mus musculus
tgaaacgaagatacagacaggaggg

SEQ ID NO: 479424 - DNA, 25 bp, Mus musculus
tgaaacgacccatggagacgaggac

SEQ ID NO: 479425 - DNA, 25 bp, Mus musculus
tgaaacgagttgaccagcgtagccc

SEQ ID NO: 479426 - DNA, 25 bp, Mus musculus
tgaaacgcaaagatatctcggaggc

SEQ ID NO: 479427 - DNA, 25 bp, Mus musculus
tgaaacgccaaggtccaacgggtgt

SEQ ID NO: 479428 - DNA, 25 bp, Mus musculus
tgaaacgcgtgatggtgagttcctc

SEQ ID NO: 479429 - DNA, 25 bp, Mus musculus
tgaaacgctctttttccaggaacgg

SEQ ID NO: 479430 - DNA, 25 bp, Mus musculus
tgaaacggactctccaaaccctgga

SEQ ID NO: 479431 - DNA, 25 bp, Mus musculus
tgaaacgggcacagcgaagttgacc

SEQ ID NO: 479432 - DNA, 25 bp, Mus musculus
tgaaacggtccagatcactgtgggc

SEQ ID NO: 479433 - DNA, 25 bp, Mus musculus
tgaaactaagaactggaccgtccca

SEQ ID NO: 479434 - DNA, 25 bp, Mus musculus
tgaaactaatgtagctggaatcagc

SEQ ID NO: 479435 - DNA, 25 bp, Mus musculus
tgaaactaattgagtcggcccatga

SEQ ID NO: 479436 - DNA, 25 bp, Mus musculus
tgaaactaatttgaaagggtccctg

SEQ ID NO: 479437 - DNA, 25 bp, Mus musculus
tgaaactacacaacgggagcaacag

SEQ ID NO: 479438 - DNA, 25 bp, Mus musculus
tgaaactacaggcaggagagtacgt

SEQ ID NO: 479439 - DNA, 25 bp, Mus musculus
tgaaactagtgagccaagctgggac

SEQ ID NO: 479440 - DNA, 25 bp, Mus musculus
tgaaactatatttgtgactgtgcac

SEQ ID NO: 479441 - DNA, 25 bp, Mus musculus
tgaaactccagataagccaaaaggc

SEQ ID NO: 479442 - DNA, 25 bp, Mus musculus
tgaaactcctgcaacaaccctagaa

SEQ ID NO: 479443 - DNA, 25 bp, Mus musculus
tgaaactgacaatcacacaggatgg

SEQ ID NO: 479444 - DNA, 25 bp, Mus musculus
tgaaactgcagatgcctgagccgga

SEQ ID NO: 479445 - DNA, 25 bp, Mus musculus
tgaaactggataaaggccctcctgg

SEQ ID NO: 479446 - DNA, 25 bp, Mus musculus
tgaaactggcccgaaactggttttg

SEQ ID NO: 479447 - DNA, 25 bp, Mus musculus
tgaaactgtggattcttgcccgccc

SEQ ID NO: 479448 - DNA, 25 bp, Mus musculus
tgaaacttatttgaaaacccaagtg

SEQ ID NO: 479449 - DNA, 25 bp, Mus musculus
tgaaacttctggcaaacgggcagcc

SEQ ID NO: 479450 - DNA, 25 bp, Mus musculus
tgaaacttgacatgagcccaggcac

SEQ ID NO: 479451 - DNA, 25 bp, Mus musculus
tgaaacttgccttgctctgggtctg

SEQ ID NO: 479452 - DNA, 25 bp, Mus musculus
tgaaacttgctgagaggcctgagag

SEQ ID NO: 479453 - DNA, 25 bp, Mus musculus
tgaaagaagaccctatcgcagctga

SEQ ID NO: 479454 - DNA, 25 bp, Mus musculus
tgaaagaatgcagacccgtgggaaa

SEQ ID NO: 479455 - DNA, 25 bp, Mus musculus
tgaaagagccacaggctgagcctcc

SEQ ID NO: 479456 - DNA, 25 bp, Mus musculus
tgaaagatcccagtgttgctacgtg

SEQ ID NO: 479457 - DNA, 25 bp, Mus musculus
tgaaagatgctgatcccgaggctct

SEQ ID NO: 479458 - DNA, 25 bp, Mus musculus
tgaaagcaaaagtacagcgtgacaa

SEQ ID NO: 479459 - DNA, 25 bp, Mus musculus
tgaaagcaagcagccacaagagact

SEQ ID NO: 479460 - DNA, 25 bp, Mus musculus
tgaaagcaattgtggactcaccatg

SEQ ID NO: 479461 - DNA, 25 bp, Mus musculus
tgaaagcaccacattgggcctggac

SEQ ID NO: 479462 - DNA, 25 bp, Mus musculus
tgaaagcagcaaggatggacactct

SEQ ID NO: 479463 - DNA, 25 bp, Mus musculus
tgaaagcagtcctggcttctaaggc

SEQ ID NO: 479464 - DNA, 25 bp, Mus musculus
tgaaagccaggtgttcaccttcaca

SEQ ID NO: 479465 - DNA, 25 bp, Mus musculus
tgaaagccatgaagcgccaggtgga

SEQ ID NO: 479466 - DNA, 25 bp, Mus musculus
tgaaagccatgtattgaatccccgg

SEQ ID NO: 479467 - DNA, 25 bp, Mus musculus
tgaaagcctcgccttctaagaaacg

SEQ ID NO: 479468 - DNA, 25 bp, Mus musculus
tgaaagcgccgagaaagaagtcact

SEQ ID NO: 479469 - DNA, 25 bp, Mus musculus
tgaaagcggctaacaacaagaaggg

SEQ ID NO: 479470 - DNA, 25 bp, Mus musculus
tgaaagcgggcctcagatgaaggtc

SEQ ID NO: 479471 - DNA, 25 bp, Mus musculus
tgaaagcgtctatggtctgtgaagc

SEQ ID NO: 479472 - DNA, 25 bp, Mus musculus
tgaaagctaagcaggaaatgggtat

SEQ ID NO: 479473 - DNA, 25 bp, Mus musculus
tgaaagctctccgtgagtcagcgag

SEQ ID NO: 479474 - DNA, 25 bp, Mus musculus
tgaaagctctggacactcgaatggc

SEQ ID NO: 479475 - DNA, 25 bp, Mus musculus
tgaaagctgccctagtttaaaaggt

SEQ ID NO: 479476 - DNA, 25 bp, Mus musculus
tgaaagctttgactggacctgctgg

SEQ ID NO: 479477 - DNA, 25 bp, Mus musculus
tgaaaggacaaccaaagcagggcct

SEQ ID NO: 479478 - DNA, 25 bp, Mus musculus
tgaaaggactcataccacacctggg

SEQ ID NO: 479479 - DNA, 25 bp, Mus musculus
tgaaaggagtagcaactacaagaac

SEQ ID NO: 479480 - DNA, 25 bp, Mus musculus
tgaaaggagtcaaagaaagctgccc

SEQ ID NO: 479481 - DNA, 25 bp, Mus musculus
tgaaaggcactgaacgcaagagtct

SEQ ID NO: 479482 - DNA, 25 bp, Mus musculus
tgaaaggcatttgattctcagagta

SEQ ID NO: 479483 - DNA, 25 bp, Mus musculus
tgaaaggcctgtgtaaatcactact

SEQ ID NO: 479484 - DNA, 25 bp, Mus musculus
tgaaaggcgtgacttccacaagagt

SEQ ID NO: 479485 - DNA, 25 bp, Mus musculus
tgaaaggctccacatacaagcgaag

SEQ ID NO: 479486 - DNA, 25 bp, Mus musculus
tgaaagggagctgcacaccgttcac

SEQ ID NO: 479487 - DNA, 25 bp, Mus musculus
tgaaagggattaggccaggaccgaa

SEQ ID NO: 479488 - DNA, 25 bp, Mus musculus
tgaaagggctttccgttatctggtg

SEQ ID NO: 479489 - DNA, 25 bp, Mus musculus
tgaaaggtagcttggtccccagctg

SEQ ID NO: 479490 - DNA, 25 bp, Mus musculus
tgaaaggtccacagacagcgtcact

SEQ ID NO: 479491 - DNA, 25 bp, Mus musculus
tgaaaggtgataaattgccaggcac

SEQ ID NO: 479492 - DNA, 25 bp, Mus musculus
tgaaaggttggtaattccctggcgt

SEQ ID NO: 479493 - DNA, 25 bp, Mus musculus
tgaaagtaaacttagccccgctggc

SEQ ID NO: 479494 - DNA, 25 bp, Mus musculus
tgaaagtacaccttgcagagtgcac

SEQ ID NO: 479495 - DNA, 25 bp, Mus musculus
tgaaagtactctccccgtgataggt

SEQ ID NO: 479496 - DNA, 25 bp, Mus musculus
tgaaagtagccatgtcgagacccag

SEQ ID NO: 479497 - DNA, 25 bp, Mus musculus
tgaaagtcacacagagcacagaggg

SEQ ID NO: 479498 - DNA, 25 bp, Mus musculus
tgaaagtcctgcatcacgtggctaa

SEQ ID NO: 479499 - DNA, 25 bp, Mus musculus
tgaaagtgaatgtcccaaaggtgcc

SEQ ID NO: 479500 - DNA, 25 bp, Mus musculus
tgaaagtgattgacccagccacagc

SEQ ID NO: 479501 - DNA, 25 bp, Mus musculus
tgaaagtggactctctcacaggagc

SEQ ID NO: 479502 - DNA, 25 bp, Mus musculus
tgaaagtggccttccctcaggtgac

SEQ ID NO: 479503 - DNA, 25 bp, Mus musculus
tgaaagtgtacaccatggaccgcgg

SEQ ID NO: 479504 - DNA, 25 bp, Mus musculus
tgaaagttaccgttctccgctggcg

SEQ ID NO: 479505 - DNA, 25 bp, Mus musculus
tgaaagtttagtttccacctactgg

SEQ ID NO: 479506 - DNA, 25 bp, Mus musculus
tgaaataaacggttgttgggcgaca

SEQ ID NO: 479507 - DNA, 25 bp, Mus musculus
tgaaataaacgtgcgcggactgtca

SEQ ID NO: 479508 - DNA, 25 bp, Mus musculus
tgaaataacgactccaggtaccagg

SEQ ID NO: 479509 - DNA, 25 bp, Mus musculus
tgaaatacacacagccttggcccga

SEQ ID NO: 479510 - DNA, 25 bp, Mus musculus
tgaaatacattagctgccggctggt

SEQ ID NO: 479511 - DNA, 25 bp, Mus musculus
tgaaatacccttgctagactccaag

SEQ ID NO: 479512 - DNA, 25 bp, Mus musculus
tgaaatactccagtccagcggcaag

SEQ ID NO: 479513 - DNA, 25 bp, Mus musculus
tgaaatactccccaaaaggtgtgct

SEQ ID NO: 479514 - DNA, 25 bp, Mus musculus
tgaaatagctttcaccagtgtatgg

SEQ ID NO: 479515 - DNA, 25 bp, Mus musculus
tgaaatcaacaagcgcacagcagca

SEQ ID NO: 479516 - DNA, 25 bp, Mus musculus
tgaaatcaacgccttgggtctgctg

SEQ ID NO: 479517 - DNA, 25 bp, Mus musculus
tgaaatcaagatcccaccagaaccg

SEQ ID NO: 479518 - DNA, 25 bp, Mus musculus
tgaaatcaagcctacccgaagtctg

SEQ ID NO: 479519 - DNA, 25 bp, Mus musculus
tgaaatcaccctaacctggcagagg

SEQ ID NO: 479520 - DNA, 25 bp, Mus musculus
tgaaatcaccgcagacgacaggaag

SEQ ID NO: 479521 - DNA, 25 bp, Mus musculus
tgaaatccaggcttcaactttgaat

SEQ ID NO: 479522 - DNA, 25 bp, Mus musculus
tgaaatcggcctggagctgaagacc

SEQ ID NO: 479523 - DNA, 25 bp, Mus musculus
tgaaatctccctggtcaaggctgac

SEQ ID NO: 479524 - DNA, 25 bp, Mus musculus
tgaaatctgagacctgtacaaggcc

SEQ ID NO: 479525 - DNA, 25 bp, Mus musculus
tgaaatctgtctttgccaggcctgt

SEQ ID NO: 479526 - DNA, 25 bp, Mus musculus
tgaaatctgtgctaccaagtgccta

SEQ ID NO: 479527 - DNA, 25 bp, Mus musculus
tgaaatgaacaatataacggtcccc

SEQ ID NO: 479528 - DNA, 25 bp, Mus musculus
tgaaatgaaccaaaccgagctccag

SEQ ID NO: 479529 - DNA, 25 bp, Mus musculus
tgaaatgaaggttccagactgtgcg

SEQ ID NO: 479530 - DNA, 25 bp, Mus musculus
tgaaatgacctgaagatatttgtgt

SEQ ID NO: 479531 - DNA, 25 bp, Mus musculus
tgaaatgacgataaagctccacact

SEQ ID NO: 479532 - DNA, 25 bp, Mus musculus
tgaaatgagctatgtccaccgagac

SEQ ID NO: 479533 - DNA, 25 bp, Mus musculus
tgaaatgagctcagcaatattcact

SEQ ID NO: 479534 - DNA, 25 bp, Mus musculus
tgaaatgatcgtgaccaagaacggc

SEQ ID NO: 479535 - DNA, 25 bp, Mus musculus
tgaaatgcaagaacgttgtgcccct

SEQ ID NO: 479536 - DNA, 25 bp, Mus musculus
tgaaatgccactgaacgtccaggcg

SEQ ID NO: 479537 - DNA, 25 bp, Mus musculus
tgaaatgcccagttctcctagtggc

SEQ ID NO: 479538 - DNA, 25 bp, Mus musculus
tgaaatgcctcagacttaatgatcc

SEQ ID NO: 479539 - DNA, 25 bp, Mus musculus
tgaaatgcggaagcaaacaccggcg

SEQ ID NO: 479540 - DNA, 25 bp, Mus musculus
tgaaatgctagtgagcgaagctcgc

SEQ ID NO: 479541 - DNA, 25 bp, Mus musculus
tgaaatgctgaaatctcctgtgaaa

SEQ ID NO: 479542 - DNA, 25 bp, Mus musculus
tgaaatgctgaacaaggcccgagag

SEQ ID NO: 479543 - DNA, 25 bp, Mus musculus
tgaaatggaagaaggaccaccgact

SEQ ID NO: 479544 - DNA, 25 bp, Mus musculus
tgaaatgtctctccgagattgtaaa

SEQ ID NO: 479545 - DNA, 25 bp, Mus musculus
tgaaatgtgtctcccacagtaggct

SEQ ID NO: 479546 - DNA, 25 bp, Mus musculus
tgaaatgtgtgttagcaggctccca

SEQ ID NO: 479547 - DNA, 25 bp, Mus musculus
tgaaattacttggatggacccactg

SEQ ID NO: 479548 - DNA, 25 bp, Mus musculus
tgaaattataaagcctgcagcagcc

SEQ ID NO: 479549 - DNA, 25 bp, Mus musculus
tgaaattattgacgtggccacctct

SEQ ID NO: 479550 - DNA, 25 bp, Mus musculus
tgaaattcagcacgtacagacaagt

SEQ ID NO: 479551 - DNA, 25 bp, Mus musculus
tgaaattcaggtgccgatgctaccg

SEQ ID NO: 479552 - DNA, 25 bp, Mus musculus
tgaaattccaaagacaacctactgt

SEQ ID NO: 479553 - DNA, 25 bp, Mus musculus
tgaaattccacgaagagctccgacc

SEQ ID NO: 479554 - DNA, 25 bp, Mus musculus
tgaaattccgaataacccaggcagc

SEQ ID NO: 479555 - DNA, 25 bp, Mus musculus
tgaaattcctcatgggatagcccct

SEQ ID NO: 479556 - DNA, 25 bp, Mus musculus
tgaaattcgtcaagagcaactccgg

SEQ ID NO: 479557 - DNA, 25 bp, Mus musculus
tgaaattctcctaccatgccaagtg

SEQ ID NO: 479558 - DNA, 25 bp, Mus musculus
tgaaattgagtttggccatcctgat

SEQ ID NO: 479559 - DNA, 25 bp, Mus musculus
tgaaattgctaatgtccagagcggg

SEQ ID NO: 479560 - DNA, 25 bp, Mus musculus
tgaaatttatgttgcaccggaccac

SEQ ID NO: 479561 - DNA, 25 bp, Mus musculus
tgaaatttccaatcgagacgccaag

SEQ ID NO: 479562 - DNA, 25 bp, Mus musculus
tgaaatttgtgttcccttgtccgtc

SEQ ID NO: 479563 - DNA, 25 bp, Mus musculus
tgaaatttttatgaagaggaataag

SEQ ID NO: 479564 - DNA, 25 bp, Mus musculus
tgaacaaaagactcaggtggacctg

SEQ ID NO: 479565 - DNA, 25 bp, Mus musculus
tgaacaaacgctttcgcctgggctt

SEQ ID NO: 479566 - DNA, 25 bp, Mus musculus
tgaacaaactggacgacaaggagct

SEQ ID NO: 479567 - DNA, 25 bp, Mus musculus
tgaacaaagacattgcagcctgccg

SEQ ID NO: 479568 - DNA, 25 bp, Mus musculus
tgaacaaagtgggtaaattttaatg

SEQ ID NO: 479569 - DNA, 25 bp, Mus musculus
tgaacaacatgcattccgagaagct

SEQ ID NO: 479570 - DNA, 25 bp, Mus musculus
tgaacaacatgcctgtcaacaccgg

SEQ ID NO: 479571 - DNA, 25 bp, Mus musculus
tgaacaaccgctacaaccatgaagg

SEQ ID NO: 479572 - DNA, 25 bp, Mus musculus
tgaacaacgccaagatcagcccttg

SEQ ID NO: 479573 - DNA, 25 bp, Mus musculus
tgaacaagacaaatcaagtcactac

SEQ ID NO: 479574 - DNA, 25 bp, Mus musculus
tgaacaagacatctacgagtggacc

SEQ ID NO: 479575 - DNA, 25 bp, Mus musculus
tgaacaagagcagcgtatggacctg

SEQ ID NO: 479576 - DNA, 25 bp, Mus musculus
tgaacaagagcatctgcgacacacg

SEQ ID NO: 479577 - DNA, 25 bp, Mus musculus
tgaacaagaggcagaaaccacctgg

SEQ ID NO: 479578 - DNA, 25 bp, Mus musculus
tgaacaagatggtgtcaagccggaa

SEQ ID NO: 479579 - DNA, 25 bp, Mus musculus
tgaacaagtctttgaccccaaaaca

SEQ ID NO: 479580 - DNA, 25 bp, Mus musculus
tgaacaatgagcaaactgtcacgtg

SEQ ID NO: 479581 - DNA, 25 bp, Mus musculus
tgaacaattactgagccatggcgtg

SEQ ID NO: 479582 - DNA, 25 bp, Mus musculus
tgaacacaatcaacctgccaagacg

SEQ ID NO: 479583 - DNA, 25 bp, Mus musculus
tgaacacagaacgtcatccctggac

SEQ ID NO: 479584 - DNA, 25 bp, Mus musculus
tgaacacagagttagaccgcctggc

SEQ ID NO: 479585 - DNA, 25 bp, Mus musculus
tgaacacagccatgggagggaactt

SEQ ID NO: 479586 - DNA, 25 bp, Mus musculus
tgaacacaggaccaagtttggaggc

SEQ ID NO: 479587 - DNA, 25 bp, Mus musculus
tgaacacaggacttctcagtgtggc

SEQ ID NO: 479588 - DNA, 25 bp, Mus musculus
tgaacaccctaatcacttctggatc

SEQ ID NO: 479589 - DNA, 25 bp, Mus musculus
tgaacaccgggcagcgaaagaatgg

SEQ ID NO: 479590 - DNA, 25 bp, Mus musculus
tgaacacgacgtggtcaagggcatc

SEQ ID NO: 479591 - DNA, 25 bp, Mus musculus
tgaacacgcagaacttcagggtcgt

SEQ ID NO: 479592 - DNA, 25 bp, Mus musculus
tgaacacggagaatgggccaagtac

SEQ ID NO: 479593 - DNA, 25 bp, Mus musculus
tgaacacggatttcagccaggctgc

SEQ ID NO: 479594 - DNA, 25 bp, Mus musculus
tgaacacggcaggaagctagactct

SEQ ID NO: 479595 - DNA, 25 bp, Mus musculus
tgaacacggcctccggaaactaggc

SEQ ID NO: 479596 - DNA, 25 bp, Mus musculus
tgaacacgggacacatgaagagctg

SEQ ID NO: 479597 - DNA, 25 bp, Mus musculus
tgaacacggtggtcaactactgcgg

SEQ ID NO: 479598 - DNA, 25 bp, Mus musculus
tgaacacgtgtcctagaaccttgct

SEQ ID NO: 479599 - DNA, 25 bp, Mus musculus
tgaacacgtttggaagctactactg

SEQ ID NO: 479600 - DNA, 25 bp, Mus musculus
tgaacactacccaaggaggaagcct

SEQ ID NO: 479601 - DNA, 25 bp, Mus musculus
tgaacactcagtggagacacccctt

SEQ ID NO: 479602 - DNA, 25 bp, Mus musculus
tgaacactccttcggtgcagctggt

SEQ ID NO: 479603 - DNA, 25 bp, Mus musculus
tgaacactctggagatgacacctga

SEQ ID NO: 479604 - DNA, 25 bp, Mus musculus
tgaacactgtctacattcccgagga

SEQ ID NO: 479605 - DNA, 25 bp, Mus musculus
tgaacacttcactggaacacgccca

SEQ ID NO: 479606 - DNA, 25 bp, Mus musculus
tgaacacttcctagagcagcagatg

SEQ ID NO: 479607 - DNA, 25 bp, Mus musculus
tgaacactttagaacctggcctgag

SEQ ID NO: 479608 - DNA, 25 bp, Mus musculus
tgaacacttttctcagtgaacgtgg

SEQ ID NO: 479609 - DNA, 25 bp, Mus musculus
tgaacagaaaggtctctcagcgccg

SEQ ID NO: 479610 - DNA, 25 bp, Mus musculus
tgaacagaacttgcaggacctgagc

SEQ ID NO: 479611 - DNA, 25 bp, Mus musculus
tgaacagacggatacaggacggagc

SEQ ID NO: 479612 - DNA, 25 bp, Mus musculus
tgaacagagaatcggtgccagcaag

SEQ ID NO: 479613 - DNA, 25 bp, Mus musculus
tgaacagatagaccctagcaccgaa

SEQ ID NO: 479614 - DNA, 25 bp, Mus musculus
tgaacagatggacaaagcttttgtc

SEQ ID NO: 479615 - DNA, 25 bp, Mus musculus
tgaacagcaaaagtgaaccgacccg

SEQ ID NO: 479616 - DNA, 25 bp, Mus musculus
tgaacagcataccagactcaaactg

SEQ ID NO: 479617 - DNA, 25 bp, Mus musculus
tgaacagcatcaagtgaagcaacct

SEQ ID NO: 479618 - DNA, 25 bp, Mus musculus
tgaacagcccaacagtaacaaagcg

SEQ ID NO: 479619 - DNA, 25 bp, Mus musculus
tgaacagccgcttctcttgacagct

SEQ ID NO: 479620 - DNA, 25 bp, Mus musculus
tgaacagcgcattgaggaacaggct

SEQ ID NO: 479621 - DNA, 25 bp, Mus musculus
tgaacagctggcagactttgtagct

SEQ ID NO: 479622 - DNA, 25 bp, Mus musculus
tgaacaggaatgctgaagccaccat

SEQ ID NO: 479623 - DNA, 25 bp, Mus musculus
tgaacaggcacaggaacatatggct

SEQ ID NO: 479624 - DNA, 25 bp, Mus musculus
tgaacaggcagaggtcaccactatg

SEQ ID NO: 479625 - DNA, 25 bp, Mus musculus
tgaacaggccttttcgggaccagtg

SEQ ID NO: 479626 - DNA, 25 bp, Mus musculus
tgaacagtaccgcatcgatgcccgg

SEQ ID NO: 479627 - DNA, 25 bp, Mus musculus
tgaacagtcacatcggagggaaagg

SEQ ID NO: 479628 - DNA, 25 bp, Mus musculus
tgaacagtgaaggtgaagttccttc

SEQ ID NO: 479629 - DNA, 25 bp, Mus musculus
tgaacagtgacctctctcaagacag

SEQ ID NO: 479630 - DNA, 25 bp, Mus musculus
tgaacagtggcctgtgcctagaggc

SEQ ID NO: 479631 - DNA, 25 bp, Mus musculus
tgaacagtgtagtagttgatacccc

SEQ ID NO: 479632 - DNA, 25 bp, Mus musculus
tgaacagttcaaggctgcgctcagg

SEQ ID NO: 479633 - DNA, 25 bp, Mus musculus
tgaacagttgtactcagggcccagc

SEQ ID NO: 479634 - DNA, 25 bp, Mus musculus
tgaacagtttatctcaggaggacct

SEQ ID NO: 479635 - DNA, 25 bp, Mus musculus
tgaacagtttgtccacaacagagga

SEQ ID NO: 479636 - DNA, 25 bp, Mus musculus
tgaacatagaagtaggccatagaga

SEQ ID NO: 479637 - DNA, 25 bp, Mus musculus
tgaacatcaccctggtgccctacgg

SEQ ID NO: 479638 - DNA, 25 bp, Mus musculus
tgaacatcatcagctgagttgggct

SEQ ID NO: 479639 - DNA, 25 bp, Mus musculus
tgaacatcatcgactgcgtggccat

SEQ ID NO: 479640 - DNA, 25 bp, Mus musculus
tgaacatcatggactggctggcgaa

SEQ ID NO: 479641 - DNA, 25 bp, Mus musculus
tgaacatccctgatctcatccgaga

SEQ ID NO: 479642 - DNA, 25 bp, Mus musculus
tgaacatcggaagaatgcacaggct

SEQ ID NO: 479643 - DNA, 25 bp, Mus musculus
tgaacatcgggaacaactttgactc

SEQ ID NO: 479644 - DNA, 25 bp, Mus musculus
tgaacatctgtgagaacaccgaggg

SEQ ID NO: 479645 - DNA, 25 bp, Mus musculus
tgaacatcttcagcaccaaggctgg

SEQ ID NO: 479646 - DNA, 25 bp, Mus musculus
tgaacatgaaaccttacgacctgcg

SEQ ID NO: 479647 - DNA, 25 bp, Mus musculus
tgaacatgaccgttgggaatcccag

SEQ ID NO: 479648 - DNA, 25 bp, Mus musculus
tgaacatgagaagcggctgtctagc

SEQ ID NO: 479649 - DNA, 25 bp, Mus musculus
tgaacatgatgctggtgggtcccgt

SEQ ID NO: 479650 - DNA, 25 bp, Mus musculus
tgaacattaccacgaaggaactgac

SEQ ID NO: 479651 - DNA, 25 bp, Mus musculus
tgaacattcaggtctttccgaggag

SEQ ID NO: 479652 - DNA, 25 bp, Mus musculus
tgaacattccattctcaggtttctg

SEQ ID NO: 479653 - DNA, 25 bp, Mus musculus
tgaacattcccgatgcctacgcgga

SEQ ID NO: 479654 - DNA, 25 bp, Mus musculus
tgaacattctgcaggtgagcactct

SEQ ID NO: 479655 - DNA, 25 bp, Mus musculus
tgaacatttacacatatccgtgcat

SEQ ID NO: 479656 - DNA, 25 bp, Mus musculus
tgaaccaaaggagaaggctcccacg

SEQ ID NO: 479657 - DNA, 25 bp, Mus musculus
tgaaccaagttttgagccagcaagc

SEQ ID NO: 479658 - DNA, 25 bp, Mus musculus
tgaaccacaaactggacagccatgc

SEQ ID NO: 479659 - DNA, 25 bp, Mus musculus
tgaaccacaaatccaagccacagag

SEQ ID NO: 479660 - DNA, 25 bp, Mus musculus
tgaaccacacccagactatggctct

SEQ ID NO: 479661 - DNA, 25 bp, Mus musculus
tgaaccacaggtaccagatgggctg

SEQ ID NO: 479662 - DNA, 25 bp, Mus musculus
tgaaccaccaaagaatgagcatgga

SEQ ID NO: 479663 - DNA, 25 bp, Mus musculus
tgaaccagacatgggtcctgaaggc

SEQ ID NO: 479664 - DNA, 25 bp, Mus musculus
tgaaccagagaaacgccattcgggc

SEQ ID NO: 479665 - DNA, 25 bp, Mus musculus
tgaaccagcacgtggagcatctacg

SEQ ID NO: 479666 - DNA, 25 bp, Mus musculus
tgaaccagcgcatggacagctacgc

SEQ ID NO: 479667 - DNA, 25 bp, Mus musculus
tgaaccatccaaaaagtcttaaggc

SEQ ID NO: 479668 - DNA, 25 bp, Mus musculus
tgaaccatgctgtggctaaggaccc

SEQ ID NO: 479669 - DNA, 25 bp, Mus musculus
tgaaccatggttgcagctgtggcga

SEQ ID NO: 479670 - DNA, 25 bp, Mus musculus
tgaacccaaacagaagcctgcagct

SEQ ID NO: 479671 - DNA, 25 bp, Mus musculus
tgaacccacctaggagatggtctgg

SEQ ID NO: 479672 - DNA, 25 bp, Mus musculus
tgaacccacggaaacttgcaggaga

SEQ ID NO: 479673 - DNA, 25 bp, Mus musculus
tgaacccagagcagtattccaagcg

SEQ ID NO: 479674 - DNA, 25 bp, Mus musculus
tgaacccaggacacgttaaatccac

SEQ ID NO: 479675 - DNA, 25 bp, Mus musculus
tgaacccatcttggtgtctgtgtcg

SEQ ID NO: 479676 - DNA, 25 bp, Mus musculus
tgaaccccaacgacggcagcctttt

SEQ ID NO: 479677 - DNA, 25 bp, Mus musculus
tgaacccggcggagtcataagcaga

SEQ ID NO: 479678 - DNA, 25 bp, Mus musculus
tgaacccggtcctcaggaagaacag

SEQ ID NO: 479679 - DNA, 25 bp, Mus musculus
tgaaccctaaggaacaaatggagtg

SEQ ID NO: 479680 - DNA, 25 bp, Mus musculus
tgaaccctgacatcttctcagcaga

SEQ ID NO: 479681 - DNA, 25 bp, Mus musculus
tgaaccctgcgacgagaaagctctg

SEQ ID NO: 479682 - DNA, 25 bp, Mus musculus
tgaaccctgggatgtacagtcagaa

SEQ ID NO: 479683 - DNA, 25 bp, Mus musculus
tgaacccttgagtctgacacggccg

SEQ ID NO: 479684 - DNA, 25 bp, Mus musculus
tgaaccgaagcattcccgtggaggt

SEQ ID NO: 479685 - DNA, 25 bp, Mus musculus
tgaaccgaatccaaacagtccagcc

SEQ ID NO: 479686 - DNA, 25 bp, Mus musculus
tgaaccgacagaaggcagtaacctg

SEQ ID NO: 479687 - DNA, 25 bp, Mus musculus
tgaaccgcatgagccagagtcaggt

SEQ ID NO: 479688 - DNA, 25 bp, Mus musculus
tgaaccgctgctttccagggtatgg

SEQ ID NO: 479689 - DNA, 25 bp, Mus musculus
tgaaccggacagtcatcacgatggg

SEQ ID NO: 479690 - DNA, 25 bp, Mus musculus
tgaaccgtctggatgaagccctgga

SEQ ID NO: 479691 - DNA, 25 bp, Mus musculus
tgaaccgtgcctcagtcagaagacg

SEQ ID NO: 479692 - DNA, 25 bp, Mus musculus
tgaacctacagctgtgaagccctaa

SEQ ID NO: 479693 - DNA, 25 bp, Mus musculus
tgaacctaggattgacattaacgcc

SEQ ID NO: 479694 - DNA, 25 bp, Mus musculus
tgaacctcaaccttgccagggtggc

SEQ ID NO: 479695 - DNA, 25 bp, Mus musculus
tgaacctcaagctgagccgcaggct

SEQ ID NO: 479696 - DNA, 25 bp, Mus musculus
tgaacctcggctggatgaagaagac

SEQ ID NO: 479697 - DNA, 25 bp, Mus musculus
tgaacctcgtgcctggcctgtcagt

SEQ ID NO: 479698 - DNA, 25 bp, Mus musculus
tgaacctgacaagacatcaactgtg

SEQ ID NO: 479699 - DNA, 25 bp, Mus musculus
tgaacctgaccacaagcaacattgg

SEQ ID NO: 479700 - DNA, 25 bp, Mus musculus
tgaacctgaccctctccaggagagc

SEQ ID NO: 479701 - DNA, 25 bp, Mus musculus
tgaacctgaccctgcgctggagttt

SEQ ID NO: 479702 - DNA, 25 bp, Mus musculus
tgaacctgagaagctgtacgccatg

SEQ ID NO: 479703 - DNA, 25 bp, Mus musculus
tgaacctgaggccttaccatagctg

SEQ ID NO: 479704 - DNA, 25 bp, Mus musculus
tgaacctgcagaaccgcaagctggt

SEQ ID NO: 479705 - DNA, 25 bp, Mus musculus
tgaacctgcttctcaaggacctggg

SEQ ID NO: 479706 - DNA, 25 bp, Mus musculus
tgaacctggccttggagaacgcctg

SEQ ID NO: 479707 - DNA, 25 bp, Mus musculus
tgaacctggctttgggtgacttctc

SEQ ID NO: 479708 - DNA, 25 bp, Mus musculus
tgaacctggtcggagttcaatgccc

SEQ ID NO: 479709 - DNA, 25 bp, Mus musculus
tgaacctgtagccaaagctctgagg

SEQ ID NO: 479710 - DNA, 25 bp, Mus musculus
tgaacctgttgacatcccgaagcaa

SEQ ID NO: 479711 - DNA, 25 bp, Mus musculus
tgaaccttaccgatgaggccctgag

SEQ ID NO: 479712 - DNA, 25 bp, Mus musculus
tgaaccttactgtctctgaagggag

SEQ ID NO: 479713 - DNA, 25 bp, Mus musculus
tgaaccttgagacccacataatgga

SEQ ID NO: 479714 - DNA, 25 bp, Mus musculus
tgaacctttccgagtttactggagc

SEQ ID NO: 479715 - DNA, 25 bp, Mus musculus
tgaacgaaagcagatggcactccta

SEQ ID NO: 479716 - DNA, 25 bp, Mus musculus
tgaacgacaactgcaagaagctccg

SEQ ID NO: 479717 - DNA, 25 bp, Mus musculus
tgaacgacacccctgattggaaccg

SEQ ID NO: 479718 - DNA, 25 bp, Mus musculus
tgaacgaccagcttggagagcagga

SEQ ID NO: 479719 - DNA, 25 bp, Mus musculus
tgaacgactttgacgagtgcggccc

SEQ ID NO: 479720 - DNA, 25 bp, Mus musculus
tgaacgagcaatgaatcggaagact

SEQ ID NO: 479721 - DNA, 25 bp, Mus musculus
tgaacgagtttagagccacgctgtc

SEQ ID NO: 479722 - DNA, 25 bp, Mus musculus
tgaacgatgcacaggagatggatcg

SEQ ID NO: 479723 - DNA, 25 bp, Mus musculus
tgaacgattcctccagtctgctagt

SEQ ID NO: 479724 - DNA, 25 bp, Mus musculus
tgaacgcatgccagtctctggagag

SEQ ID NO: 479725 - DNA, 25 bp, Mus musculus
tgaacgccacggatctagacgaagg

SEQ ID NO: 479726 - DNA, 25 bp, Mus musculus
tgaacgcccatggtacaagcggtcc

SEQ ID NO: 479727 - DNA, 25 bp, Mus musculus
tgaacgccctgcagaactataagct

SEQ ID NO: 479728 - DNA, 25 bp, Mus musculus
tgaacgcctgcagagattccagcac

SEQ ID NO: 479729 - DNA, 25 bp, Mus musculus
tgaacgcgtttggttggcagtaagc

SEQ ID NO: 479730 - DNA, 25 bp, Mus musculus
tgaacgctggcctgcgtgctttggt

SEQ ID NO: 479731 - DNA, 25 bp, Mus musculus
tgaacgctggctgctgcccgctcgg

SEQ ID NO: 479732 - DNA, 25 bp, Mus musculus
tgaacggcaaaaacacattctggga

SEQ ID NO: 479733 - DNA, 25 bp, Mus musculus
tgaacggcaaagtggctctggtgac

SEQ ID NO: 479734 - DNA, 25 bp, Mus musculus
tgaacggcagagtggacaactacca

SEQ ID NO: 479735 - DNA, 25 bp, Mus musculus
tgaacggcccagagtttcccaggga

SEQ ID NO: 479736 - DNA, 25 bp, Mus musculus
tgaacggcttcaccaggacatgatc

SEQ ID NO: 479737 - DNA, 25 bp, Mus musculus
tgaacgggtccagccaattgcatcg

SEQ ID NO: 479738 - DNA, 25 bp, Mus musculus
tgaacgtaatgtagctccagcaggc

SEQ ID NO: 479739 - DNA, 25 bp, Mus musculus
tgaacgtagtgtagagaagctgccc

SEQ ID NO: 479740 - DNA, 25 bp, Mus musculus
tgaacgtccaatccagtgaagatgc

SEQ ID NO: 479741 - DNA, 25 bp, Mus musculus
tgaacgtgatactcgcaaactgtgg

SEQ ID NO: 479742 - DNA, 25 bp, Mus musculus
tgaacgtgatccagcacagcatgcg

SEQ ID NO: 479743 - DNA, 25 bp, Mus musculus
tgaacgttgtgtatgccctgctggg

SEQ ID NO: 479744 - DNA, 25 bp, Mus musculus
tgaactaaaggtaatcgtaagctga

SEQ ID NO: 479745 - DNA, 25 bp, Mus musculus
tgaactaagaggctgccatgtcccc

SEQ ID NO: 479746 - DNA, 25 bp, Mus musculus
tgaactaccgagtgggaacctttgg

SEQ ID NO: 479747 - DNA, 25 bp, Mus musculus
tgaactacctgagggagatgcggca

SEQ ID NO: 479748 - DNA, 25 bp, Mus musculus
tgaactacttggacagctcgatgga

SEQ ID NO: 479749 - DNA, 25 bp, Mus musculus
tgaactagcccagtccggtgatgga

SEQ ID NO: 479750 - DNA, 25 bp, Mus musculus
tgaactaggagcttgcagataccca

SEQ ID NO: 479751 - DNA, 25 bp, Mus musculus
tgaactagttccaaatctgaagccc

SEQ ID NO: 479752 - DNA, 25 bp, Mus musculus
tgaactatataccaggccctgctga

SEQ ID NO: 479753 - DNA, 25 bp, Mus musculus
tgaactatgaagtcagccgccaagt

SEQ ID NO: 479754 - DNA, 25 bp, Mus musculus
tgaactcaaagctctcggtacagga

SEQ ID NO: 479755 - DNA, 25 bp, Mus musculus
tgaactcaactactctacaaactgt

SEQ ID NO: 479756 - DNA, 25 bp, Mus musculus
tgaactcaagtcttatgcgctggga

SEQ ID NO: 479757 - DNA, 25 bp, Mus musculus
tgaactcacttgacacctcacagca

SEQ ID NO: 479758 - DNA, 25 bp, Mus musculus
tgaactcagatgtcccgaatgccgg

SEQ ID NO: 479759 - DNA, 25 bp, Mus musculus
tgaactcaggccaactccttgaaac

SEQ ID NO: 479760 - DNA, 25 bp, Mus musculus
tgaactcaggtgaacccactccctg

SEQ ID NO: 479761 - DNA, 25 bp, Mus musculus
tgaactcagtacttgtcgacagcag

SEQ ID NO: 479762 - DNA, 25 bp, Mus musculus
tgaactccacgatttccagaaagga

SEQ ID NO: 479763 - DNA, 25 bp, Mus musculus
tgaactccagagagcgatgcgctgt

SEQ ID NO: 479764 - DNA, 25 bp, Mus musculus
tgaactccgcctctaaagcagacgg

SEQ ID NO: 479765 - DNA, 25 bp, Mus musculus
tgaactccggcctgggctctatgaa

SEQ ID NO: 479766 - DNA, 25 bp, Mus musculus
tgaactcctcctgacactatgtact

SEQ ID NO: 479767 - DNA, 25 bp, Mus musculus
tgaactcgaagctaggccctgaagg

SEQ ID NO: 479768 - DNA, 25 bp, Mus musculus
tgaactcggcacattcgggaccaat

SEQ ID NO: 479769 - DNA, 25 bp, Mus musculus
tgaactcggttctaaatccctgtag

SEQ ID NO: 479770 - DNA, 25 bp, Mus musculus
tgaactcgtcgtagggtctttccag

SEQ ID NO: 479771 - DNA, 25 bp, Mus musculus
tgaactctaacgctgctgcctttgc

SEQ ID NO: 479772 - DNA, 25 bp, Mus musculus
tgaactctaccccagcaaaagtgaa

SEQ ID NO: 479773 - DNA, 25 bp, Mus musculus
tgaactctataacaccatccgagac

SEQ ID NO: 479774 - DNA, 25 bp, Mus musculus
tgaactctcgagtggaacaggtgat

SEQ ID NO: 479775 - DNA, 25 bp, Mus musculus
tgaactctgagtagtgtgatgtcac

SEQ ID NO: 479776 - DNA, 25 bp, Mus musculus
tgaactctgagtatagccaagtgcc

SEQ ID NO: 479777 - DNA, 25 bp, Mus musculus
tgaactctgccttcgtactcgtggg

SEQ ID NO: 479778 - DNA, 25 bp, Mus musculus
tgaactctgctcttattgactaggg

SEQ ID NO: 479779 - DNA, 25 bp, Mus musculus
tgaactctggtatcagccactgctg

SEQ ID NO: 479780 - DNA, 25 bp, Mus musculus
tgaactctgtacatcagcgccggac

SEQ ID NO: 479781 - DNA, 25 bp, Mus musculus
tgaactcttaagacgaacctggaga

SEQ ID NO: 479782 - DNA, 25 bp, Mus musculus
tgaactcttaattgccggctcccag

SEQ ID NO: 479783 - DNA, 25 bp, Mus musculus
tgaactgaaaaaaaagcccattgtt

SEQ ID NO: 479784 - DNA, 25 bp, Mus musculus
tgaactgaaaagaagatggcgaggc

SEQ ID NO: 479785 - DNA, 25 bp, Mus musculus
tgaactgaagcaacaagtggacgat

SEQ ID NO: 479786 - DNA, 25 bp, Mus musculus
tgaactgaccggtttagccagaggt

SEQ ID NO: 479787 - DNA, 25 bp, Mus musculus
tgaactgactggactcaagcctacg

SEQ ID NO: 479788 - DNA, 25 bp, Mus musculus
tgaactgagtgaggcggctctcgct

SEQ ID NO: 479789 - DNA, 25 bp, Mus musculus
tgaactgccagggtagtggtccgcc

SEQ ID NO: 479790 - DNA, 25 bp, Mus musculus
tgaactgcgctgtcaatgcctgaag

SEQ ID NO: 479791 - DNA, 25 bp, Mus musculus
tgaactgcttttcatggctgataag

SEQ ID NO: 479792 - DNA, 25 bp, Mus musculus
tgaactggattcagcagaccatcgc

SEQ ID NO: 479793 - DNA, 25 bp, Mus musculus
tgaactggccacatctcttagaagt

SEQ ID NO: 479794 - DNA, 25 bp, Mus musculus
tgaactggccatgaaccacttggga

SEQ ID NO: 479795 - DNA, 25 bp, Mus musculus
tgaactgggatccaaagaagcgacc

SEQ ID NO: 479796 - DNA, 25 bp, Mus musculus
tgaactgggcactagcgctggcttt

SEQ ID NO: 479797 - DNA, 25 bp, Mus musculus
tgaactgggttgcaacatactgtcc

SEQ ID NO: 479798 - DNA, 25 bp, Mus musculus
tgaactgtaaccagaacactcattc

SEQ ID NO: 479799 - DNA, 25 bp, Mus musculus
tgaactgtcagatgcagagggccct

SEQ ID NO: 479800 - DNA, 25 bp, Mus musculus
tgaactgtccctgggtgtatcaacc

SEQ ID NO: 479801 - DNA, 25 bp, Mus musculus
tgaactgtcgatgaagcatggcctc

SEQ ID NO: 479802 - DNA, 25 bp, Mus musculus
tgaactgtctggctgaagcaatggc

SEQ ID NO: 479803 - DNA, 25 bp, Mus musculus
tgaactgtgccagcttcacagcggg

SEQ ID NO: 479804 - DNA, 25 bp, Mus musculus
tgaactgtggcctcgatggactgca

SEQ ID NO: 479805 - DNA, 25 bp, Mus musculus
tgaactgttctctgttcctgtgaga

SEQ ID NO: 479806 - DNA, 25 bp, Mus musculus
tgaactgttctgaccatggccactg

SEQ ID NO: 479807 - DNA, 25 bp, Mus musculus
tgaacttaaggcaatcttcctgcat

SEQ ID NO: 479808 - DNA, 25 bp, Mus musculus
tgaacttaatgtgtcccaggcccta

SEQ ID NO: 479809 - DNA, 25 bp, Mus musculus
tgaacttacacaataacgaggcggg

SEQ ID NO: 479810 - DNA, 25 bp, Mus musculus
tgaacttagctacttgtctctgtgg

SEQ ID NO: 479811 - DNA, 25 bp, Mus musculus
tgaacttcaacatccaagcactgca

SEQ ID NO: 479812 - DNA, 25 bp, Mus musculus
tgaacttcacacataccattccagt

SEQ ID NO: 479813 - DNA, 25 bp, Mus musculus
tgaacttcagtgttaatcctggccc

SEQ ID NO: 479814 - DNA, 25 bp, Mus musculus
tgaacttccacgaggtagcgggcaa

SEQ ID NO: 479815 - DNA, 25 bp, Mus musculus
tgaacttcctgcaacacctgcgtga

SEQ ID NO: 479816 - DNA, 25 bp, Mus musculus
tgaacttcgcagagacaacattggc

SEQ ID NO: 479817 - DNA, 25 bp, Mus musculus
tgaacttcgcccgttttcttgggca

SEQ ID NO: 479818 - DNA, 25 bp, Mus musculus
tgaacttctgatatactccactgtg

SEQ ID NO: 479819 - DNA, 25 bp, Mus musculus
tgaacttctgcagaccataggagcc

SEQ ID NO: 479820 - DNA, 25 bp, Mus musculus
tgaacttctggcagcagctgagccg

SEQ ID NO: 479821 - DNA, 25 bp, Mus musculus
tgaacttctgtcgaggaaccggacc

SEQ ID NO: 479822 - DNA, 25 bp, Mus musculus
tgaacttgactgacggatctgccct

SEQ ID NO: 479823 - DNA, 25 bp, Mus musculus
tgaacttgcacctgtgaaacctcgg

SEQ ID NO: 479824 - DNA, 25 bp, Mus musculus
tgaacttgcgattccaggcactagg

SEQ ID NO: 479825 - DNA, 25 bp, Mus musculus
tgaacttggacgtggtgctaacccc

SEQ ID NO: 479826 - DNA, 25 bp, Mus musculus
tgaacttggataaccaccctgggtg

SEQ ID NO: 479827 - DNA, 25 bp, Mus musculus
tgaacttgtccaaccggcgtttgaa

SEQ ID NO: 479828 - DNA, 25 bp, Mus musculus
tgaacttgtgggtgcaaaccctagg

SEQ ID NO: 479829 - DNA, 25 bp, Mus musculus
tgaactttcaaacccctggactgcc

SEQ ID NO: 479830 - DNA, 25 bp, Mus musculus
tgaactttgcactaaccctccagga

SEQ ID NO: 479831 - DNA, 25 bp, Mus musculus
tgaactttgggagtatggtttctcc

SEQ ID NO: 479832 - DNA, 25 bp, Mus musculus
tgaactttgtgtcaccgggtcagag

SEQ ID NO: 479833 - DNA, 25 bp, Mus musculus
tgaacttttacagcagcacggcgtt

SEQ ID NO: 479834 - DNA, 25 bp, Mus musculus
tgaacttttcagcaacgggtgtacc

SEQ ID NO: 479835 - DNA, 25 bp, Mus musculus
tgaacttttcttcccaccgctgttg

SEQ ID NO: 479836 - DNA, 25 bp, Mus musculus
tgaagaaaagaagtcgtctcagtgt

SEQ ID NO: 479837 - DNA, 25 bp, Mus musculus
tgaagaaaagcaccgatgccgacct

SEQ ID NO: 479838 - DNA, 25 bp, Mus musculus
tgaagaaaatcaagggctccgggct

SEQ ID NO: 479839 - DNA, 25 bp, Mus musculus
tgaagaaagctgcaacaccacctgt

SEQ ID NO: 479840 - DNA, 25 bp, Mus musculus
tgaagaaagcttctggtcgctgtca

SEQ ID NO: 479841 - DNA, 25 bp, Mus musculus
tgaagaaagcttggtaattgacgtg

SEQ ID NO: 479842 - DNA, 25 bp, Mus musculus
tgaagaaatagccaagcctgcctgg

SEQ ID NO: 479843 - DNA, 25 bp, Mus musculus
tgaagaaatcgacccctaggcagag

SEQ ID NO: 479844 - DNA, 25 bp, Mus musculus
tgaagaaatcgaggtgagctgcacc

SEQ ID NO: 479845 - DNA, 25 bp, Mus musculus
tgaagaaatctaccaggacctgctg

SEQ ID NO: 479846 - DNA, 25 bp, Mus musculus
tgaagaacaacatccccgcaagtgg

SEQ ID NO: 479847 - DNA, 25 bp, Mus musculus
tgaagaacccatacctgagtccagc

SEQ ID NO: 479848 - DNA, 25 bp, Mus musculus
tgaagaaccgatcctaattgggaac

SEQ ID NO: 479849 - DNA, 25 bp, Mus musculus
tgaagaaccgatgaaactgaagccc

SEQ ID NO: 479850 - DNA, 25 bp, Mus musculus
tgaagaacctggtggaaccgtctcc

SEQ ID NO: 479851 - DNA, 25 bp, Mus musculus
tgaagaacgaaggatccagagctgt

SEQ ID NO: 479852 - DNA, 25 bp, Mus musculus
tgaagaacggagatcaaacctgcct

SEQ ID NO: 479853 - DNA, 25 bp, Mus musculus
tgaagaactcacacaaaatagcagg

SEQ ID NO: 479854 - DNA, 25 bp, Mus musculus
tgaagaacttgaatggcactggccc

SEQ ID NO: 479855 - DNA, 25 bp, Mus musculus
tgaagaacttgatgatttattcact

SEQ ID NO: 479856 - DNA, 25 bp, Mus musculus
tgaagaagagcagcttcgcaccctg

SEQ ID NO: 479857 - DNA, 25 bp, Mus musculus
tgaagaagcccaagatccgtaggaa

SEQ ID NO: 479858 - DNA, 25 bp, Mus musculus
tgaagaagctaagacagttgactac

SEQ ID NO: 479859 - DNA, 25 bp, Mus musculus
tgaagaaggaactgcacatgctagc

SEQ ID NO: 479860 - DNA, 25 bp, Mus musculus
tgaagaaggagtggttgcgctcccc

SEQ ID NO: 479861 - DNA, 25 bp, Mus musculus
tgaagaaggccaagcagtgaccaga

SEQ ID NO: 479862 - DNA, 25 bp, Mus musculus
tgaagaaggccacacaaacattggg

SEQ ID NO: 479863 - DNA, 25 bp, Mus musculus
tgaagaagtaatgacccactccggg

SEQ ID NO: 479864 - DNA, 25 bp, Mus musculus
tgaagaagtcccacatggaagacgc

SEQ ID NO: 479865 - DNA, 25 bp, Mus musculus
tgaagaagtcgcagagcagaccgct

SEQ ID NO: 479866 - DNA, 25 bp, Mus musculus
tgaagaagttccacgccgacatgct

SEQ ID NO: 479867 - DNA, 25 bp, Mus musculus
tgaagaatataagggtctggcgtcc

SEQ ID NO: 479868 - DNA, 25 bp, Mus musculus
tgaagaatccaaagccccagtgtac

SEQ ID NO: 479869 - DNA, 25 bp, Mus musculus
tgaagaatctggtccttgcactgac

SEQ ID NO: 479870 - DNA, 25 bp, Mus musculus
tgaagaatgaatgactccagagctc

SEQ ID NO: 479871 - DNA, 25 bp, Mus musculus
tgaagaatgacgatgcccctaactg

SEQ ID NO: 479872 - DNA, 25 bp, Mus musculus
tgaagaatgcacgatcgcctctggg

SEQ ID NO: 479873 - DNA, 25 bp, Mus musculus
tgaagaatgtcacccctcaggatac

SEQ ID NO: 479874 - DNA, 25 bp, Mus musculus
tgaagaattcatggacccagcgtct

SEQ ID NO: 479875 - DNA, 25 bp, Mus musculus
tgaagaattcttgacagccatagag

SEQ ID NO: 479876 - DNA, 25 bp, Mus musculus
tgaagacaaaaagctttggacaggc

SEQ ID NO: 479877 - DNA, 25 bp, Mus musculus
tgaagacaacttaatagacctgggc

SEQ ID NO: 479878 - DNA, 25 bp, Mus musculus
tgaagacacaagatgaggagtctgc

SEQ ID NO: 479879 - DNA, 25 bp, Mus musculus
tgaagacactacagagagactgccg

SEQ ID NO: 479880 - DNA, 25 bp, Mus musculus
tgaagacagagctgaaatgacggtg

SEQ ID NO: 479881 - DNA, 25 bp, Mus musculus
tgaagacagattcggaccagcagat

SEQ ID NO: 479882 - DNA, 25 bp, Mus musculus
tgaagacagtcccttcaaggatggg

SEQ ID NO: 479883 - DNA, 25 bp, Mus musculus
tgaagacagtctaccgccatgagaa

SEQ ID NO: 479884 - DNA, 25 bp, Mus musculus
tgaagacagtggcagagaactcaga

SEQ ID NO: 479885 - DNA, 25 bp, Mus musculus
tgaagacagtttgactaagcagcct

SEQ ID NO: 479886 - DNA, 25 bp, Mus musculus
tgaagacatacatccccagtgaagg

SEQ ID NO: 479887 - DNA, 25 bp, Mus musculus
tgaagaccaagcagatccaagatcg

SEQ ID NO: 479888 - DNA, 25 bp, Mus musculus
tgaagaccactcaaatcgaacacgg

SEQ ID NO: 479889 - DNA, 25 bp, Mus musculus
tgaagaccagaagtgttacccatag

SEQ ID NO: 479890 - DNA, 25 bp, Mus musculus
tgaagaccagagtgctcaggaagac

SEQ ID NO: 479891 - DNA, 25 bp, Mus musculus
tgaagacccggatattttctcagac

SEQ ID NO: 479892 - DNA, 25 bp, Mus musculus
tgaagaccctctgtacaggcgaagg

SEQ ID NO: 479893 - DNA, 25 bp, Mus musculus
tgaagacccttccatgtggtgatgg

SEQ ID NO: 479894 - DNA, 25 bp, Mus musculus
tgaagaccgtagctgaactgcacga

SEQ ID NO: 479895 - DNA, 25 bp, Mus musculus
tgaagaccgtgtcttcccagcaggt

SEQ ID NO: 479896 - DNA, 25 bp, Mus musculus
tgaagacctcccttacgccatgaag

SEQ ID NO: 479897 - DNA, 25 bp, Mus musculus
tgaagacctggatcctgccgagtgc

SEQ ID NO: 479898 - DNA, 25 bp, Mus musculus
tgaagacctgtgctgttgaaccagc

SEQ ID NO: 479899 - DNA, 25 bp, Mus musculus
tgaagacgaccgatccaagtcagcg

SEQ ID NO: 479900 - DNA, 25 bp, Mus musculus
tgaagacgacggctatcctgaggac

SEQ ID NO: 479901 - DNA, 25 bp, Mus musculus
tgaagacgacttttgtacgaacccg

SEQ ID NO: 479902 - DNA, 25 bp, Mus musculus
tgaagacgaggactttcaaccccgg

SEQ ID NO: 479903 - DNA, 25 bp, Mus musculus
tgaagacgccatactttgatgctgg

SEQ ID NO: 479904 - DNA, 25 bp, Mus musculus
tgaagacgccgcagagtcgagtgct

SEQ ID NO: 479905 - DNA, 25 bp, Mus musculus
tgaagacgctcatggccaaggacaa

SEQ ID NO: 479906 - DNA, 25 bp, Mus musculus
tgaagacgctgagcccgtatcggct

SEQ ID NO: 479907 - DNA, 25 bp, Mus musculus
tgaagactattacacccacgaggcc

SEQ ID NO: 479908 - DNA, 25 bp, Mus musculus
tgaagactcaccaagaactgaagac

SEQ ID NO: 479909 - DNA, 25 bp, Mus musculus
tgaagactccctgaagaatataccc

SEQ ID NO: 479910 - DNA, 25 bp, Mus musculus
tgaagactccgaagaaagcctaagc

SEQ ID NO: 479911 - DNA, 25 bp, Mus musculus
tgaagactctctacatgctgggcag

SEQ ID NO: 479912 - DNA, 25 bp, Mus musculus
tgaagactctgccaaccacgaggat

SEQ ID NO: 479913 - DNA, 25 bp, Mus musculus
tgaagactgccaaccggtggtacca

SEQ ID NO: 479914 - DNA, 25 bp, Mus musculus
tgaagacttcgtgtcagggaaatgg

SEQ ID NO: 479915 - DNA, 25 bp, Mus musculus
tgaagacttggaggccgtcgtccac

SEQ ID NO: 479916 - DNA, 25 bp, Mus musculus
tgaagagaagacttgccgaagcccg

SEQ ID NO: 479917 - DNA, 25 bp, Mus musculus
tgaagagaagatgaacagccaggct

SEQ ID NO: 479918 - DNA, 25 bp, Mus musculus
tgaagagacttacaggatgcagagc

SEQ ID NO: 479919 - DNA, 25 bp, Mus musculus
tgaagagattggatccccagcagat

SEQ ID NO: 479920 - DNA, 25 bp, Mus musculus
tgaagagcaccgtacactggaggaa

SEQ ID NO: 479921 - DNA, 25 bp, Mus musculus
tgaagagcacgtgcataagagcctg

SEQ ID NO: 479922 - DNA, 25 bp, Mus musculus
tgaagagcactgactagaaacctgg

SEQ ID NO: 479923 - DNA, 25 bp, Mus musculus
tgaagagcatttcccgtgccaagat

SEQ ID NO: 479924 - DNA, 25 bp, Mus musculus
tgaagagcccctttagactagagtg

SEQ ID NO: 479925 - DNA, 25 bp, Mus musculus
tgaagagcctccctcgtgcaatggg

SEQ ID NO: 479926 - DNA, 25 bp, Mus musculus
tgaagagcgccagaaacagctgttg

SEQ ID NO: 479927 - DNA, 25 bp, Mus musculus
tgaagagctgcacgccatgctggat

SEQ ID NO: 479928 - DNA, 25 bp, Mus musculus
tgaagagctgggtgcaaacgctacg

SEQ ID NO: 479929 - DNA, 25 bp, Mus musculus
tgaagagctgtaccgagtgcatccg

SEQ ID NO: 479930 - DNA, 25 bp, Mus musculus
tgaagaggaattggactttcgggct

SEQ ID NO: 479931 - DNA, 25 bp, Mus musculus
tgaagaggacgctctgtcgcagctg

SEQ ID NO: 479932 - DNA, 25 bp, Mus musculus
tgaagaggagactaaaaaggtgcta

SEQ ID NO: 479933 - DNA, 25 bp, Mus musculus
tgaagaggagtggactacaaaggct

SEQ ID NO: 479934 - DNA, 25 bp, Mus musculus
tgaagaggtccagcatgacatgcaa

SEQ ID NO: 479935 - DNA, 25 bp, Mus musculus
tgaagagtatcctaataagccacct

SEQ ID NO: 479936 - DNA, 25 bp, Mus musculus
tgaagagtcatccttggccatggga

SEQ ID NO: 479937 - DNA, 25 bp, Mus musculus
tgaagagtgacaacacagaggcctt

SEQ ID NO: 479938 - DNA, 25 bp, Mus musculus
tgaagagtgttgagctcagtcccca

SEQ ID NO: 479939 - DNA, 25 bp, Mus musculus
tgaagataaacgtctgccgtgagac

SEQ ID NO: 479940 - DNA, 25 bp, Mus musculus
tgaagatacgagagagaaccccaga

SEQ ID NO: 479941 - DNA, 25 bp, Mus musculus
tgaagatactgatttgtctcgggcc

SEQ ID NO: 479942 - DNA, 25 bp, Mus musculus
tgaagatagaatgctccagcgaccg

SEQ ID NO: 479943 - DNA, 25 bp, Mus musculus
tgaagatagcgtcctagacaccagc

SEQ ID NO: 479944 - DNA, 25 bp, Mus musculus
tgaagatatccagacacggcagtat

SEQ ID NO: 479945 - DNA, 25 bp, Mus musculus
tgaagatcacagactagagagcccc

SEQ ID NO: 479946 - DNA, 25 bp, Mus musculus
tgaagatcaggagccaccctcagtt

SEQ ID NO: 479947 - DNA, 25 bp, Mus musculus
tgaagatcagggatgacgaacgcct

SEQ ID NO: 479948 - DNA, 25 bp, Mus musculus
tgaagatcatcacggacagaggttc

SEQ ID NO: 479949 - DNA, 25 bp, Mus musculus
tgaagatccgccagtacagcctgga

SEQ ID NO: 479950 - DNA, 25 bp, Mus musculus
tgaagatcctcactgagcgcgggta

SEQ ID NO: 479951 - DNA, 25 bp, Mus musculus
tgaagatcgacctcaccgaggcgag

SEQ ID NO: 479952 - DNA, 25 bp, Mus musculus
tgaagatcgccatcacaatcactgt

SEQ ID NO: 479953 - DNA, 25 bp, Mus musculus
tgaagatcgtcagcagcaacgtggg

SEQ ID NO: 479954 - DNA, 25 bp, Mus musculus
tgaagatctggaagacgcgctcctg

SEQ ID NO: 479955 - DNA, 25 bp, Mus musculus
tgaagatctggacctttgaagctgg

SEQ ID NO: 479956 - DNA, 25 bp, Mus musculus
tgaagatgaacaagctccccagtaa

SEQ ID NO: 479957 - DNA, 25 bp, Mus musculus
tgaagatgagaatacaagaagacag

SEQ ID NO: 479958 - DNA, 25 bp, Mus musculus
tgaagatgatcaatgctggcctggc

SEQ ID NO: 479959 - DNA, 25 bp, Mus musculus
tgaagatgatctactgctcccactg

SEQ ID NO: 479960 - DNA, 25 bp, Mus musculus
tgaagatgcattccgaaagctgcct

SEQ ID NO: 479961 - DNA, 25 bp, Mus musculus
tgaagatgctgaccactctctagtc

SEQ ID NO: 479962 - DNA, 25 bp, Mus musculus
tgaagatgcttctccagaacctgga

SEQ ID NO: 479963 - DNA, 25 bp, Mus musculus
tgaagatggccgtgatgtccccatg

SEQ ID NO: 479964 - DNA, 25 bp, Mus musculus
tgaagatgggccacgcacattctgg

SEQ ID NO: 479965 - DNA, 25 bp, Mus musculus
tgaagatgtctcaaccctacaaaga

SEQ ID NO: 479966 - DNA, 25 bp, Mus musculus
tgaagatgtgaaccgcatgtctccg

SEQ ID NO: 479967 - DNA, 25 bp, Mus musculus
tgaagatgtgcagcatccccggtgg

SEQ ID NO: 479968 - DNA, 25 bp, Mus musculus
tgaagattcatgaagccacgggcat

SEQ ID NO: 479969 - DNA, 25 bp, Mus musculus
tgaagattccaagggcagttcccgt

SEQ ID NO: 479970 - DNA, 25 bp, Mus musculus
tgaagattccagcttgtatcaagag

SEQ ID NO: 479971 - DNA, 25 bp, Mus musculus
tgaagattccctgtcctacgaggac

SEQ ID NO: 479972 - DNA, 25 bp, Mus musculus
tgaagattcgcttaccagcctcctg

SEQ ID NO: 479973 - DNA, 25 bp, Mus musculus
tgaagattgatatcattaagcatcc

SEQ ID NO: 479974 - DNA, 25 bp, Mus musculus
tgaagattgccgaacaggagcctgg

SEQ ID NO: 479975 - DNA, 25 bp, Mus musculus
tgaagattggatagcctgcctacct

SEQ ID NO: 479976 - DNA, 25 bp, Mus musculus
tgaagattgtaagacgcatggactg

SEQ ID NO: 479977 - DNA, 25 bp, Mus musculus
tgaagattttgtccagagggagcca

SEQ ID NO: 479978 - DNA, 25 bp, Mus musculus
tgaagcaaaccttcgagcgcctcgt

SEQ ID NO: 479979 - DNA, 25 bp, Mus musculus
tgaagcaactcgcatctgaagacat

SEQ ID NO: 479980 - DNA, 25 bp, Mus musculus
tgaagcacagtgcaagcggaacacc

SEQ ID NO: 479981 - DNA, 25 bp, Mus musculus
tgaagcaccaaattactccggacgg

SEQ ID NO: 479982 - DNA, 25 bp, Mus musculus
tgaagcacctgtttcacagccgccg

SEQ ID NO: 479983 - DNA, 25 bp, Mus musculus
tgaagcaccttctgccctgtcaaaa

SEQ ID NO: 479984 - DNA, 25 bp, Mus musculus
tgaagcagagcctcagccataacct

SEQ ID NO: 479985 - DNA, 25 bp, Mus musculus
tgaagcagagttccaacgtgccggc

SEQ ID NO: 479986 - DNA, 25 bp, Mus musculus
tgaagcagcccgttgtcaggtgcag

SEQ ID NO: 479987 - DNA, 25 bp, Mus musculus
tgaagcagctgaatctcaaatcgcc

SEQ ID NO: 479988 - DNA, 25 bp, Mus musculus
tgaagcaggaactggtaagatgcct

SEQ ID NO: 479989 - DNA, 25 bp, Mus musculus
tgaagcaggtggtgcccaagactct

SEQ ID NO: 479990 - DNA, 25 bp, Mus musculus
tgaagcataagaggcaaacccagtg

SEQ ID NO: 479991 - DNA, 25 bp, Mus musculus
tgaagcatccagtttcctgcccaca

SEQ ID NO: 479992 - DNA, 25 bp, Mus musculus
tgaagcatgaacagaccctggagac

SEQ ID NO: 479993 - DNA, 25 bp, Mus musculus
tgaagcatgcccgtaatcaagtgga

SEQ ID NO: 479994 - DNA, 25 bp, Mus musculus
tgaagcatgtagagcctgaggtgct

SEQ ID NO: 479995 - DNA, 25 bp, Mus musculus
tgaagcattcaggaaaaggtctctg

SEQ ID NO: 479996 - DNA, 25 bp, Mus musculus
tgaagccaacgtgaccaaggagatg

SEQ ID NO: 479997 - DNA, 25 bp, Mus musculus
tgaagccaataagcaacatgtaaga

SEQ ID NO: 479998 - DNA, 25 bp, Mus musculus
tgaagccacgtagcctctgaggtaa

SEQ ID NO: 479999 - DNA, 25 bp, Mus musculus
tgaagccagattaggagcagcgagc

SEQ ID NO: 480000 - DNA, 25 bp, Mus musculus
tgaagccagtccagcacttagcctg

SEQ ID NO: 480001 - DNA, 25 bp, Mus musculus
tgaagccagtgagcagagcaatcgt

SEQ ID NO: 480002 - DNA, 25 bp, Mus musculus
tgaagccatgctgttgtaccccaac

SEQ ID NO: 480003 - DNA, 25 bp, Mus musculus
tgaagcccaagaagagatcggtgat

SEQ ID NO: 480004 - DNA, 25 bp, Mus musculus
tgaagcccatgaacaaggaggaaat

SEQ ID NO: 480005 - DNA, 25 bp, Mus musculus
tgaagcccctgctgttttcgcctgt

SEQ ID NO: 480006 - DNA, 25 bp, Mus musculus
tgaagcccggagaacgatgaccaat

SEQ ID NO: 480007 - DNA, 25 bp, Mus musculus
tgaagcccttctcttgctgcctcgt

SEQ ID NO: 480008 - DNA, 25 bp, Mus musculus
tgaagccgccatttaagacaacgag

SEQ ID NO: 480009 - DNA, 25 bp, Mus musculus
tgaagccggagcttgtgagccacac

SEQ ID NO: 480010 - DNA, 25 bp, Mus musculus
tgaagccggcaaacccaaggtgatg

SEQ ID NO: 480011 - DNA, 25 bp, Mus musculus
tgaagccgtgtagcaaggcacacgc

SEQ ID NO: 480012 - DNA, 25 bp, Mus musculus
tgaagcctcttctgcggcgagcaat

SEQ ID NO: 480013 - DNA, 25 bp, Mus musculus
tgaagcctgagttgaaggtagcact

SEQ ID NO: 480014 - DNA, 25 bp, Mus musculus
tgaagcctggcaccaagtcgaagct

SEQ ID NO: 480015 - DNA, 25 bp, Mus musculus
tgaagcctggccacacgttcatcac

SEQ ID NO: 480016 - DNA, 25 bp, Mus musculus
tgaagcctggctatggtaccaccgg

SEQ ID NO: 480017 - DNA, 25 bp, Mus musculus
tgaagccttcgtgaccatccaggaa

SEQ ID NO: 480018 - DNA, 25 bp, Mus musculus
tgaagccttggacacgaatccctgg

SEQ ID NO: 480019 - DNA, 25 bp, Mus musculus
tgaagccttggagctcttgggtgcc

SEQ ID NO: 480020 - DNA, 25 bp, Mus musculus
tgaagcgaacaatgacccaacatct

SEQ ID NO: 480021 - DNA, 25 bp, Mus musculus
tgaagcgaccctctcactctaggct

SEQ ID NO: 480022 - DNA, 25 bp, Mus musculus
tgaagcgactactgctggtgacgac

SEQ ID NO: 480023 - DNA, 25 bp, Mus musculus
tgaagcgagactgtgtgcactggca

SEQ ID NO: 480024 - DNA, 25 bp, Mus musculus
tgaagcgagcatatcagcagaagcc

SEQ ID NO: 480025 - DNA, 25 bp, Mus musculus
tgaagcgccaccagaactgagcgag

SEQ ID NO: 480026 - DNA, 25 bp, Mus musculus
tgaagcgccagaagaccaaggtgaa

SEQ ID NO: 480027 - DNA, 25 bp, Mus musculus
tgaagcgcgtgagcggcactatacc

SEQ ID NO: 480028 - DNA, 25 bp, Mus musculus
tgaagcgcgtgtgccagaaggagga

SEQ ID NO: 480029 - DNA, 25 bp, Mus musculus
tgaagcgctaggagcggcactcttg

SEQ ID NO: 480030 - DNA, 25 bp, Mus musculus
tgaagcggacaggacattgatctac

SEQ ID NO: 480031 - DNA, 25 bp, Mus musculus
tgaagcggcagaatgtgcgcacgtt

SEQ ID NO: 480032 - DNA, 25 bp, Mus musculus
tgaagcggctctcagctacatggcg

SEQ ID NO: 480033 - DNA, 25 bp, Mus musculus
tgaagcgtctctctgccttttacaa

SEQ ID NO: 480034 - DNA, 25 bp, Mus musculus
tgaagcgtgccaaacgacagctgtg

SEQ ID NO: 480035 - DNA, 25 bp, Mus musculus
tgaagctagagacggcatatccagt

SEQ ID NO: 480036 - DNA, 25 bp, Mus musculus
tgaagctagcaaaagttgtagcgcc

SEQ ID NO: 480037 - DNA, 25 bp, Mus musculus
tgaagctagcctccacggaactgga

SEQ ID NO: 480038 - DNA, 25 bp, Mus musculus
tgaagctaggcatagccactggccc

SEQ ID NO: 480039 - DNA, 25 bp, Mus musculus
tgaagctcacaagaatgagggcaat

SEQ ID NO: 480040 - DNA, 25 bp, Mus musculus
tgaagctcacgtgcaaagcggatgc

SEQ ID NO: 480041 - DNA, 25 bp, Mus musculus
tgaagctcagtaacagctcctggac

SEQ ID NO: 480042 - DNA, 25 bp, Mus musculus
tgaagctctcgtggaacaactgaag

SEQ ID NO: 480043 - DNA, 25 bp, Mus musculus
tgaagctctttttctaccccggcgg

SEQ ID NO: 480044 - DNA, 25 bp, Mus musculus
tgaagctgaattccttcctccatga

SEQ ID NO: 480045 - DNA, 25 bp, Mus musculus
tgaagctgacttcgaccaggaccag

SEQ ID NO: 480046 - DNA, 25 bp, Mus musculus
tgaagctgagcagaaacaggcagaa

SEQ ID NO: 480047 - DNA, 25 bp, Mus musculus
tgaagctgagcctgatcctccatga

SEQ ID NO: 480048 - DNA, 25 bp, Mus musculus
tgaagctgagggtccaagacaccta

SEQ ID NO: 480049 - DNA, 25 bp, Mus musculus
tgaagctgagggtttgttggccatc

SEQ ID NO: 480050 - DNA, 25 bp, Mus musculus
tgaagctgagtggtaacctcccgag

SEQ ID NO: 480051 - DNA, 25 bp, Mus musculus
tgaagctgatgaagaaccgcgacga

SEQ ID NO: 480052 - DNA, 25 bp, Mus musculus
tgaagctgccagactagtgaagggc

SEQ ID NO: 480053 - DNA, 25 bp, Mus musculus
tgaagctgccttgcctgatcaggac

SEQ ID NO: 480054 - DNA, 25 bp, Mus musculus
tgaagctgcgcgtgcggcttcagaa

SEQ ID NO: 480055 - DNA, 25 bp, Mus musculus
tgaagctgctgacagtgcaactgcg

SEQ ID NO: 480056 - DNA, 25 bp, Mus musculus
tgaagctgcttgaatccagactttg

SEQ ID NO: 480057 - DNA, 25 bp, Mus musculus
tgaagctgcttgcacagtcagggac

SEQ ID NO: 480058 - DNA, 25 bp, Mus musculus
tgaagctggatatctaaccaaggac

SEQ ID NO: 480059 - DNA, 25 bp, Mus musculus
tgaagctggcgctgcctgtgaaacc

SEQ ID NO: 480060 - DNA, 25 bp, Mus musculus
tgaagctgggcatcgtcaacgtgga

SEQ ID NO: 480061 - DNA, 25 bp, Mus musculus
tgaagctgtcgagaaggccacatct

SEQ ID NO: 480062 - DNA, 25 bp, Mus musculus
tgaagcttatttctcccagggactt

SEQ ID NO: 480063 - DNA, 25 bp, Mus musculus
tgaagcttcaggtatccagccagcg

SEQ ID NO: 480064 - DNA, 25 bp, Mus musculus
tgaagcttcccatgactcaagttag

SEQ ID NO: 480065 - DNA, 25 bp, Mus musculus
tgaagcttctgggttgctcacacga

SEQ ID NO: 480066 - DNA, 25 bp, Mus musculus
tgaagcttcttttcccttgggcatg

SEQ ID NO: 480067 - DNA, 25 bp, Mus musculus
tgaagcttgcacatacccggctgga

SEQ ID NO: 480068 - DNA, 25 bp, Mus musculus
tgaagcttgcgttccaaaactgctg

SEQ ID NO: 480069 - DNA, 25 bp, Mus musculus
tgaagcttgctctccctagatgggt

SEQ ID NO: 480070 - DNA, 25 bp, Mus musculus
tgaagctttcttgccaggtgaacgg

SEQ ID NO: 480071 - DNA, 25 bp, Mus musculus
tgaaggaaaccatcctgcagaagca

SEQ ID NO: 480072 - DNA, 25 bp, Mus musculus
tgaaggaaagcacagaaaacgcccc

SEQ ID NO: 480073 - DNA, 25 bp, Mus musculus
tgaaggaaagcttggcagtgttgcc

SEQ ID NO: 480074 - DNA, 25 bp, Mus musculus
tgaaggaaaggagcctacttggccc

SEQ ID NO: 480075 - DNA, 25 bp, Mus musculus
tgaaggaaatgacaacgtcagcgcc

SEQ ID NO: 480076 - DNA, 25 bp, Mus musculus
tgaaggaacaccatgaccaaccaag

SEQ ID NO: 480077 - DNA, 25 bp, Mus musculus
tgaaggaacagggaacaaaacacct

SEQ ID NO: 480078 - DNA, 25 bp, Mus musculus
tgaaggaacgccttcaggcactgca

SEQ ID NO: 480079 - DNA, 25 bp, Mus musculus
tgaaggaagaaaaggcctgagcact

SEQ ID NO: 480080 - DNA, 25 bp, Mus musculus
tgaaggaattgacacagctctgcgc

SEQ ID NO: 480081 - DNA, 25 bp, Mus musculus
tgaaggacactcactccagcaggaa

SEQ ID NO: 480082 - DNA, 25 bp, Mus musculus
tgaaggacagcatggaacgtgctgc

SEQ ID NO: 480083 - DNA, 25 bp, Mus musculus
tgaaggacagccacccatctgaaga

SEQ ID NO: 480084 - DNA, 25 bp, Mus musculus
tgaaggacagcgagaagatcccgtt

SEQ ID NO: 480085 - DNA, 25 bp, Mus musculus
tgaaggacatttcttggcagcaacc

SEQ ID NO: 480086 - DNA, 25 bp, Mus musculus
tgaaggaccacaacagccagagatg

SEQ ID NO: 480087 - DNA, 25 bp, Mus musculus
tgaaggaccctttagcccagtgaca

SEQ ID NO: 480088 - DNA, 25 bp, Mus musculus
tgaaggacgctgatctcagtcaggc

SEQ ID NO: 480089 - DNA, 25 bp, Mus musculus
tgaaggacggcagttacagcaacac

SEQ ID NO: 480090 - DNA, 25 bp, Mus musculus
tgaaggacgtgaaggacaaagccaa

SEQ ID NO: 480091 - DNA, 25 bp, Mus musculus
tgaaggacgtggacaaggaactctc

SEQ ID NO: 480092 - DNA, 25 bp, Mus musculus
tgaaggactcatttccgcctgtggg

SEQ ID NO: 480093 - DNA, 25 bp, Mus musculus
tgaaggacttagctggacgcctgcc

SEQ ID NO: 480094 - DNA, 25 bp, Mus musculus
tgaaggagaattccccagagcactg

SEQ ID NO: 480095 - DNA, 25 bp, Mus musculus
tgaaggagacatcgccagagagctc

SEQ ID NO: 480096 - DNA, 25 bp, Mus musculus
tgaaggagaccacccctaaaattgg

SEQ ID NO: 480097 - DNA, 25 bp, Mus musculus
tgaaggagacgctaccgaagccgtc

SEQ ID NO: 480098 - DNA, 25 bp, Mus musculus
tgaaggagatgagccatcacaaggc

SEQ ID NO: 480099 - DNA, 25 bp, Mus musculus
tgaaggagcatgagtaccgcctgtt

SEQ ID NO: 480100 - DNA, 25 bp, Mus musculus
tgaaggagcctgcaagaccatactg

SEQ ID NO: 480101 - DNA, 25 bp, Mus musculus
tgaaggagctaacctcagagtagtc

SEQ ID NO: 480102 - DNA, 25 bp, Mus musculus
tgaaggaggctctcaagcctggccg

SEQ ID NO: 480103 - DNA, 25 bp, Mus musculus
tgaaggagtcgaagcgcatcaacgc

SEQ ID NO: 480104 - DNA, 25 bp, Mus musculus
tgaaggataaccacgacaaaataaa

SEQ ID NO: 480105 - DNA, 25 bp, Mus musculus
tgaaggatatacctgctgccgcctc

SEQ ID NO: 480106 - DNA, 25 bp, Mus musculus
tgaaggatctggaagcacactgcct

SEQ ID NO: 480107 - DNA, 25 bp, Mus musculus
tgaaggatcttaccacagcactgtg

SEQ ID NO: 480108 - DNA, 25 bp, Mus musculus
tgaaggatcttttggtgtgacaccg

SEQ ID NO: 480109 - DNA, 25 bp, Mus musculus
tgaaggatgtcagttctgtgacctg

SEQ ID NO: 480110 - DNA, 25 bp, Mus musculus
tgaaggcaaattaccttacccaacg

SEQ ID NO: 480111 - DNA, 25 bp, Mus musculus
tgaaggcaagccctactgcaatcat

SEQ ID NO: 480112 - DNA, 25 bp, Mus musculus
tgaaggcacgagatcctagctcctg

SEQ ID NO: 480113 - DNA, 25 bp, Mus musculus
tgaaggcacgcaaacctgagtgccg

SEQ ID NO: 480114 - DNA, 25 bp, Mus musculus
tgaaggcagatacacctgcaaggtg

SEQ ID NO: 480115 - DNA, 25 bp, Mus musculus
tgaaggcaggcatcgaggttttgtt

SEQ ID NO: 480116 - DNA, 25 bp, Mus musculus
tgaaggcagtacacgagaacctggc

SEQ ID NO: 480117 - DNA, 25 bp, Mus musculus
tgaaggccaccccaaatggtttgtt

SEQ ID NO: 480118 - DNA, 25 bp, Mus musculus
tgaaggccactgtgcgaatctacct

SEQ ID NO: 480119 - DNA, 25 bp, Mus musculus
tgaaggcccaagatattatcacagc

SEQ ID NO: 480120 - DNA, 25 bp, Mus musculus
tgaaggcccacaacgagtaccgggc

SEQ ID NO: 480121 - DNA, 25 bp, Mus musculus
tgaaggcccttgagacagaacttgg

SEQ ID NO: 480122 - DNA, 25 bp, Mus musculus
tgaaggccgggatagatcgatctac

SEQ ID NO: 480123 - DNA, 25 bp, Mus musculus
tgaaggcctacttgcagcagcatgg

SEQ ID NO: 480124 - DNA, 25 bp, Mus musculus
tgaaggcctgcaacaatgactccga

SEQ ID NO: 480125 - DNA, 25 bp, Mus musculus
tgaaggcctggtctcgctgtctctg

SEQ ID NO: 480126 - DNA, 25 bp, Mus musculus
tgaaggcctttgtccaacaacttgt

SEQ ID NO: 480127 - DNA, 25 bp, Mus musculus
tgaaggcgcagcttctgaagccccg

SEQ ID NO: 480128 - DNA, 25 bp, Mus musculus
tgaaggcgctgtgtattatttgcac

SEQ ID NO: 480129 - DNA, 25 bp, Mus musculus
tgaaggcgtagccatcatgtccgac

SEQ ID NO: 480130 - DNA, 25 bp, Mus musculus
tgaaggctcatacctgcagtccact

SEQ ID NO: 480131 - DNA, 25 bp, Mus musculus
tgaaggctcgactcaagatgggact

SEQ ID NO: 480132 - DNA, 25 bp, Mus musculus
tgaaggctctcatcaacagcaggaa

SEQ ID NO: 480133 - DNA, 25 bp, Mus musculus
tgaaggctgcctccctaataaaatg

SEQ ID NO: 480134 - DNA, 25 bp, Mus musculus
tgaaggctgcgatcctgatctctgg

SEQ ID NO: 480135 - DNA, 25 bp, Mus musculus
tgaaggctggctagacgacgaacct

SEQ ID NO: 480136 - DNA, 25 bp, Mus musculus
tgaaggcttcacctgcacatcactg

SEQ ID NO: 480137 - DNA, 25 bp, Mus musculus
tgaagggacactggagtcaacccca

SEQ ID NO: 480138 - DNA, 25 bp, Mus musculus
tgaagggacatgacacagctgaagc

SEQ ID NO: 480139 - DNA, 25 bp, Mus musculus
tgaagggacccagcttggagctgaa

SEQ ID NO: 480140 - DNA, 25 bp, Mus musculus
tgaagggaccccttggtgaccagct

SEQ ID NO: 480141 - DNA, 25 bp, Mus musculus
tgaagggagcagtagcagtgtcagt

SEQ ID NO: 480142 - DNA, 25 bp, Mus musculus
tgaagggaggctgacttggacccac

SEQ ID NO: 480143 - DNA, 25 bp, Mus musculus
tgaagggccactacatgctctactg

SEQ ID NO: 480144 - DNA, 25 bp, Mus musculus
tgaagggcggctgagataccatacg

SEQ ID NO: 480145 - DNA, 25 bp, Mus musculus
tgaagggctgcctgaacatgcggac

SEQ ID NO: 480146 - DNA, 25 bp, Mus musculus
tgaagggctttagaaggagctcaga

SEQ ID NO: 480147 - DNA, 25 bp, Mus musculus
tgaagggtatcaccacggagcagct

SEQ ID NO: 480148 - DNA, 25 bp, Mus musculus
tgaaggtacaccaaaacaagccagc

SEQ ID NO: 480149 - DNA, 25 bp, Mus musculus
tgaaggtacaccgatttaagcagac

SEQ ID NO: 480150 - DNA, 25 bp, Mus musculus
tgaaggtactgaaggtaagccccgc

SEQ ID NO: 480151 - DNA, 25 bp, Mus musculus
tgaaggtagtaaaggaagcttccgc

SEQ ID NO: 480152 - DNA, 25 bp, Mus musculus
tgaaggtcagcaacgaggagtacgc

SEQ ID NO: 480153 - DNA, 25 bp, Mus musculus
tgaaggtcagcatccatcgcatgga

SEQ ID NO: 480154 - DNA, 25 bp, Mus musculus
tgaaggtcatctcccatggactaga

SEQ ID NO: 480155 - DNA, 25 bp, Mus musculus
tgaaggtccccatccagaagaggtg

SEQ ID NO: 480156 - DNA, 25 bp, Mus musculus
tgaaggtcgcgcataaaacgacccg

SEQ ID NO: 480157 - DNA, 25 bp, Mus musculus
tgaaggtctacacgctcaacgagga

SEQ ID NO: 480158 - DNA, 25 bp, Mus musculus
tgaaggtcttcatcctcgcctgcct

SEQ ID NO: 480159 - DNA, 25 bp, Mus musculus
tgaaggtcttgagcaggaacgatcc

SEQ ID NO: 480160 - DNA, 25 bp, Mus musculus
tgaaggtgaaatccccgaaccgtgg

SEQ ID NO: 480161 - DNA, 25 bp, Mus musculus
tgaaggtgacactctgttgcgcata

SEQ ID NO: 480162 - DNA, 25 bp, Mus musculus
tgaaggtgacgttcaactcggcgct

SEQ ID NO: 480163 - DNA, 25 bp, Mus musculus
tgaaggtgctgtcccagatgattct

SEQ ID NO: 480164 - DNA, 25 bp, Mus musculus
tgaaggtggaggaagaccctttgtc

SEQ ID NO: 480165 - DNA, 25 bp, Mus musculus
tgaaggtggctcacaaagaccatcc

SEQ ID NO: 480166 - DNA, 25 bp, Mus musculus
tgaaggtgggtgtttcagatccctg

SEQ ID NO: 480167 - DNA, 25 bp, Mus musculus
tgaaggttaccgagtgcatgagcac

SEQ ID NO: 480168 - DNA, 25 bp, Mus musculus
tgaaggttactttgccccatgacaa

SEQ ID NO: 480169 - DNA, 25 bp, Mus musculus
tgaaggttcacacgccaggcagtgt

SEQ ID NO: 480170 - DNA, 25 bp, Mus musculus
tgaagtaaacaccacgctaaatgct

SEQ ID NO: 480171 - DNA, 25 bp, Mus musculus
tgaagtaactatggccttcacgctg

SEQ ID NO: 480172 - DNA, 25 bp, Mus musculus
tgaagtaccagatgcagcccaagtg

SEQ ID NO: 480173 - DNA, 25 bp, Mus musculus
tgaagtactcagtccgaagtgctcg

SEQ ID NO: 480174 - DNA, 25 bp, Mus musculus
tgaagtactcatcccactgatcgcg

SEQ ID NO: 480175 - DNA, 25 bp, Mus musculus
tgaagtactgcgtgagaaggaagac

SEQ ID NO: 480176 - DNA, 25 bp, Mus musculus
tgaagtactggctcactggagggca

SEQ ID NO: 480177 - DNA, 25 bp, Mus musculus
tgaagtagacagaaaattggctcct

SEQ ID NO: 480178 - DNA, 25 bp, Mus musculus
tgaagtagcaccaggtaaccccaat

SEQ ID NO: 480179 - DNA, 25 bp, Mus musculus
tgaagtaggcaccaaactgccgcga

SEQ ID NO: 480180 - DNA, 25 bp, Mus musculus
tgaagtatccgatagaacacggcat

SEQ ID NO: 480181 - DNA, 25 bp, Mus musculus
tgaagtatgaaggtcccgtggctcc

SEQ ID NO: 480182 - DNA, 25 bp, Mus musculus
tgaagtatgttaaaaatcaatagct

SEQ ID NO: 480183 - DNA, 25 bp, Mus musculus
tgaagtattccgcacagcagttggt

SEQ ID NO: 480184 - DNA, 25 bp, Mus musculus
tgaagtcaaaatgaaccccgcaggg

SEQ ID NO: 480185 - DNA, 25 bp, Mus musculus
tgaagtcaatcaagattccagtgag

SEQ ID NO: 480186 - DNA, 25 bp, Mus musculus
tgaagtcactgaacccagcaatagg

SEQ ID NO: 480187 - DNA, 25 bp, Mus musculus
tgaagtcactgaagactgtcttggg

SEQ ID NO: 480188 - DNA, 25 bp, Mus musculus
tgaagtcacttttaccacgccagca

SEQ ID NO: 480189 - DNA, 25 bp, Mus musculus
tgaagtcagcgaaacagagcctggc

SEQ ID NO: 480190 - DNA, 25 bp, Mus musculus
tgaagtcaggattcataggcttgac

SEQ ID NO: 480191 - DNA, 25 bp, Mus musculus
tgaagtcagtcagagcacaccatgg

SEQ ID NO: 480192 - DNA, 25 bp, Mus musculus
tgaagtcatcaagtccccacaaagc

SEQ ID NO: 480193 - DNA, 25 bp, Mus musculus
tgaagtccatctaaggtccacaggc

SEQ ID NO: 480194 - DNA, 25 bp, Mus musculus
tgaagtccatggtgggtggccaact

SEQ ID NO: 480195 - DNA, 25 bp, Mus musculus
tgaagtcccagcttgaatcgaaaga

SEQ ID NO: 480196 - DNA, 25 bp, Mus musculus
tgaagtccctgccttctaggaagcc

SEQ ID NO: 480197 - DNA, 25 bp, Mus musculus
tgaagtccctgtcagctccagagag

SEQ ID NO: 480198 - DNA, 25 bp, Mus musculus
tgaagtccggttctggcccagttcg

SEQ ID NO: 480199 - DNA, 25 bp, Mus musculus
tgaagtccttcacctgacagtgggc

SEQ ID NO: 480200 - DNA, 25 bp, Mus musculus
tgaagtcgtcagtggcagtgtatac

SEQ ID NO: 480201 - DNA, 25 bp, Mus musculus
tgaagtctactctgaccaaacgtgg

SEQ ID NO: 480202 - DNA, 25 bp, Mus musculus
tgaagtctcagttagctcggaagga

SEQ ID NO: 480203 - DNA, 25 bp, Mus musculus
tgaagtctccttcctaccagaggaa

SEQ ID NO: 480204 - DNA, 25 bp, Mus musculus
tgaagtctgctgcagtaaaacactg

SEQ ID NO: 480205 - DNA, 25 bp, Mus musculus
tgaagtctgtgagctcagtcgtgag

SEQ ID NO: 480206 - DNA, 25 bp, Mus musculus
tgaagtcttcactgaaacactgact

SEQ ID NO: 480207 - DNA, 25 bp, Mus musculus
tgaagtcttcatcaacgccaaagaa

SEQ ID NO: 480208 - DNA, 25 bp, Mus musculus
tgaagtcttggagccctggtaccca

SEQ ID NO: 480209 - DNA, 25 bp, Mus musculus
tgaagtgacactggcttgcagcaga

SEQ ID NO: 480210 - DNA, 25 bp, Mus musculus
tgaagtgactctaagggctccagac

SEQ ID NO: 480211 - DNA, 25 bp, Mus musculus
tgaagtgagcacacaggtcagcgag

SEQ ID NO: 480212 - DNA, 25 bp, Mus musculus
tgaagtgagtttgcttggactcagc

SEQ ID NO: 480213 - DNA, 25 bp, Mus musculus
tgaagtgccaaggataaggcctgac

SEQ ID NO: 480214 - DNA, 25 bp, Mus musculus
tgaagtgccgtgtggtagaccgaca

SEQ ID NO: 480215 - DNA, 25 bp, Mus musculus
tgaagtgctctgaagtctgtagagg

SEQ ID NO: 480216 - DNA, 25 bp, Mus musculus
tgaagtggaactgaaatgacctctc

SEQ ID NO: 480217 - DNA, 25 bp, Mus musculus
tgaagtggccagctgacatctccag

SEQ ID NO: 480218 - DNA, 25 bp, Mus musculus
tgaagtggcgatacaagctcaccct

SEQ ID NO: 480219 - DNA, 25 bp, Mus musculus
tgaagtggctacagatcttgtgctg

SEQ ID NO: 480220 - DNA, 25 bp, Mus musculus
tgaagtgggctgtcgtatcctttgc

SEQ ID NO: 480221 - DNA, 25 bp, Mus musculus
tgaagtggtgtctcgttgttttacc

SEQ ID NO: 480222 - DNA, 25 bp, Mus musculus
tgaagtggttggtagtctctgcaag

SEQ ID NO: 480223 - DNA, 25 bp, Mus musculus
tgaagtgtccggtcaatccctgagc

SEQ ID NO: 480224 - DNA, 25 bp, Mus musculus
tgaagtgtctggatacccggtgctg

SEQ ID NO: 480225 - DNA, 25 bp, Mus musculus
tgaagtgttccttaggaaacaacac

SEQ ID NO: 480226 - DNA, 25 bp, Mus musculus
tgaagttaagaacgcccgagctgtc

SEQ ID NO: 480227 - DNA, 25 bp, Mus musculus
tgaagttagaaagtgccggctaccc

SEQ ID NO: 480228 - DNA, 25 bp, Mus musculus
tgaagttagcaagaggcgtcacgcc

SEQ ID NO: 480229 - DNA, 25 bp, Mus musculus
tgaagttcaactctaagcaggcagc

SEQ ID NO: 480230 - DNA, 25 bp, Mus musculus
tgaagttcagaagccagcagcatag

SEQ ID NO: 480231 - DNA, 25 bp, Mus musculus
tgaagttcctaatgcaatgttctct

SEQ ID NO: 480232 - DNA, 25 bp, Mus musculus
tgaagttcctcatgctctaccaggt

SEQ ID NO: 480233 - DNA, 25 bp, Mus musculus
tgaagttcctccagcaactgactgc

SEQ ID NO: 480234 - DNA, 25 bp, Mus musculus
tgaagttctccctcgaaaggttatc

SEQ ID NO: 480235 - DNA, 25 bp, Mus musculus
tgaagttctctagttcccagccaga

SEQ ID NO: 480236 - DNA, 25 bp, Mus musculus
tgaagttctttccacgtgtcctgac

SEQ ID NO: 480237 - DNA, 25 bp, Mus musculus
tgaagttgaacacagagctgcttag

SEQ ID NO: 480238 - DNA, 25 bp, Mus musculus
tgaagttgccaggaagtctgggccc

SEQ ID NO: 480239 - DNA, 25 bp, Mus musculus
tgaagttggtatgctcgccacagcc

SEQ ID NO: 480240 - DNA, 25 bp, Mus musculus
tgaagtttcagcatgaggtctaccc

SEQ ID NO: 480241 - DNA, 25 bp, Mus musculus
tgaagtttctaccagccagagtgga

SEQ ID NO: 480242 - DNA, 25 bp, Mus musculus
tgaagtttgctgaattgcaaccttg

SEQ ID NO: 480243 - DNA, 25 bp, Mus musculus
tgaagtttgtagcacacgcagcctc

SEQ ID NO: 480244 - DNA, 25 bp, Mus musculus
tgaagttttccctctctgtaccaga

SEQ ID NO: 480245 - DNA, 25 bp, Mus musculus
tgaataaaactggaataggcctgcc

SEQ ID NO: 480246 - DNA, 25 bp, Mus musculus
tgaataaaagcatcccttggctggg

SEQ ID NO: 480247 - DNA, 25 bp, Mus musculus
tgaataaaagcatccgacagcggcg

SEQ ID NO: 480248 - DNA, 25 bp, Mus musculus
tgaataaaatgctgcctgaccctgg

SEQ ID NO: 480249 - DNA, 25 bp, Mus musculus
tgaataaacctgtccactggccatg

SEQ ID NO: 480250 - DNA, 25 bp, Mus musculus
tgaataacatcacaacgtccctggg

SEQ ID NO: 480251 - DNA, 25 bp, Mus musculus
tgaataacggttccaattgcctctg

SEQ ID NO: 480252 - DNA, 25 bp, Mus musculus
tgaataagatttgcatggaaggctc

SEQ ID NO: 480253 - DNA, 25 bp, Mus musculus
tgaataatgtcaccatgcgccaagg

SEQ ID NO: 480254 - DNA, 25 bp, Mus musculus
tgaatacaaggtcatcggcacagga

SEQ ID NO: 480255 - DNA, 25 bp, Mus musculus
tgaatacaggctcttgctcctcctt

SEQ ID NO: 480256 - DNA, 25 bp, Mus musculus
tgaatacatgcagatgcagcctcca

SEQ ID NO: 480257 - DNA, 25 bp, Mus musculus
tgaatacattctggcctggtcgaga

SEQ ID NO: 480258 - DNA, 25 bp, Mus musculus
tgaataccgtgggtgtcaaagcact

SEQ ID NO: 480259 - DNA, 25 bp, Mus musculus
tgaatacctgagaatgagcggcgtc

SEQ ID NO: 480260 - DNA, 25 bp, Mus musculus
tgaatacgacctgaagtgagtttgc

SEQ ID NO: 480261 - DNA, 25 bp, Mus musculus
tgaatacgcagaagagaacctgggc

SEQ ID NO: 480262 - DNA, 25 bp, Mus musculus
tgaatacgccaggaagaggactccc

SEQ ID NO: 480263 - DNA, 25 bp, Mus musculus
tgaatacggctccatcaagacccag

SEQ ID NO: 480264 - DNA, 25 bp, Mus musculus
tgaatactagaagaaagtgcctact

SEQ ID NO: 480265 - DNA, 25 bp, Mus musculus
tgaatacttatggaggtcagccgaa

SEQ ID NO: 480266 - DNA, 25 bp, Mus musculus
tgaatacttccctactaagaaccgc

SEQ ID NO: 480267 - DNA, 25 bp, Mus musculus
tgaatactttggcttgaggccccag

SEQ ID NO: 480268 - DNA, 25 bp, Mus musculus
tgaatagagcaagacgagaggacct

SEQ ID NO: 480269 - DNA, 25 bp, Mus musculus
tgaatagctgctggttgccctgact

SEQ ID NO: 480270 - DNA, 25 bp, Mus musculus
tgaatataagcaatgagtctgtctt

SEQ ID NO: 480271 - DNA, 25 bp, Mus musculus
tgaatatattgctgccatcctggag

SEQ ID NO: 480272 - DNA, 25 bp, Mus musculus
tgaatatcttcaacgggagcggctg

SEQ ID NO: 480273 - DNA, 25 bp, Mus musculus
tgaatatgaagtgaaagacctccag

SEQ ID NO: 480274 - DNA, 25 bp, Mus musculus
tgaatatgacgatccctttgctggg

SEQ ID NO: 480275 - DNA, 25 bp, Mus musculus
tgaatatggcagcagagaacgatgc

SEQ ID NO: 480276 - DNA, 25 bp, Mus musculus
tgaatattgaattcgggagcggcca

SEQ ID NO: 480277 - DNA, 25 bp, Mus musculus
tgaatatttcttcaggcgcagccct

SEQ ID NO: 480278 - DNA, 25 bp, Mus musculus
tgaatatttgatccgcgccatccct

SEQ ID NO: 480279 - DNA, 25 bp, Mus musculus
tgaatatttgatggcacacctggct

SEQ ID NO: 480280 - DNA, 25 bp, Mus musculus
tgaatcaaaacagcctcacaggtct

SEQ ID NO: 480281 - DNA, 25 bp, Mus musculus
tgaatcaaagcgaggccaggtcaca

SEQ ID NO: 480282 - DNA, 25 bp, Mus musculus
tgaatcaacaaacagggaggccacc

SEQ ID NO: 480283 - DNA, 25 bp, Mus musculus
tgaatcaacgtgtctgctgcctgtg

SEQ ID NO: 480284 - DNA, 25 bp, Mus musculus
tgaatcaagacaaccaagcgagcag

SEQ ID NO: 480285 - DNA, 25 bp, Mus musculus
tgaatcacccttgttggcggctacc

SEQ ID NO: 480286 - DNA, 25 bp, Mus musculus
tgaatcagatgaggaagtcaccggg

SEQ ID NO: 480287 - DNA, 25 bp, Mus musculus
tgaatcagcggtacttggaggccct

SEQ ID NO: 480288 - DNA, 25 bp, Mus musculus
tgaatcagtcctatacacagggtgg

SEQ ID NO: 480289 - DNA, 25 bp, Mus musculus
tgaatcagtgtaactcaaacccatg

SEQ ID NO: 480290 - DNA, 25 bp, Mus musculus
tgaatccaaagtataggcccagctg

SEQ ID NO: 480291 - DNA, 25 bp, Mus musculus
tgaatccaaattagacttcctgggt

SEQ ID NO: 480292 - DNA, 25 bp, Mus musculus
tgaatccaggtgttcagagcctcct

SEQ ID NO: 480293 - DNA, 25 bp, Mus musculus
tgaatccatgagagagtcatactct

SEQ ID NO: 480294 - DNA, 25 bp, Mus musculus
tgaatcccaagggtcccaggacctg

SEQ ID NO: 480295 - DNA, 25 bp, Mus musculus
tgaatcccagttcatccacaaacgg

SEQ ID NO: 480296 - DNA, 25 bp, Mus musculus
tgaatccctgcatgtggtggactgc

SEQ ID NO: 480297 - DNA, 25 bp, Mus musculus
tgaatccgaaatgcctgcgtgcgtc

SEQ ID NO: 480298 - DNA, 25 bp, Mus musculus
tgaatcctcggaatctcgggtcggc

SEQ ID NO: 480299 - DNA, 25 bp, Mus musculus
tgaatcctgagaaagccaatgtggt

SEQ ID NO: 480300 - DNA, 25 bp, Mus musculus
tgaatcctgccaaaagccagtccat

SEQ ID NO: 480301 - DNA, 25 bp, Mus musculus
tgaatccttccaggacggacagggc

SEQ ID NO: 480302 - DNA, 25 bp, Mus musculus
tgaatcctttctgtttctatcagaa

SEQ ID NO: 480303 - DNA, 25 bp, Mus musculus
tgaatcgaccatgacttatccaggg

SEQ ID NO: 480304 - DNA, 25 bp, Mus musculus
tgaatcgcaagagacggctcctggc

SEQ ID NO: 480305 - DNA, 25 bp, Mus musculus
tgaatcgcaccgcatacactgtggg

SEQ ID NO: 480306 - DNA, 25 bp, Mus musculus
tgaatcgcttcaaggcctaagccac

SEQ ID NO: 480307 - DNA, 25 bp, Mus musculus
tgaatcggacatctgcagcgctggt

SEQ ID NO: 480308 - DNA, 25 bp, Mus musculus
tgaatcggagaagatcggagtcgcc

SEQ ID NO: 480309 - DNA, 25 bp, Mus musculus
tgaatcgggctagaaacctcaaggc

SEQ ID NO: 480310 - DNA, 25 bp, Mus musculus
tgaatcgtcagggaaaaattctggg

SEQ ID NO: 480311 - DNA, 25 bp, Mus musculus
tgaatcgtctgtatggctcctgaac

SEQ ID NO: 480312 - DNA, 25 bp, Mus musculus
tgaatcgttcctctgcggacctgcg

SEQ ID NO: 480313 - DNA, 25 bp, Mus musculus
tgaatctaatttcaccgcctacggg

SEQ ID NO: 480314 - DNA, 25 bp, Mus musculus
tgaatctacagaaaattgccagcct

SEQ ID NO: 480315 - DNA, 25 bp, Mus musculus
tgaatctagacaaagtggcacccca

SEQ ID NO: 480316 - DNA, 25 bp, Mus musculus
tgaatctatgctcacctgcctgctc

SEQ ID NO: 480317 - DNA, 25 bp, Mus musculus
tgaatctcacacatagactcacaca

SEQ ID NO: 480318 - DNA, 25 bp, Mus musculus
tgaatctccagctggtgtgcctgac

SEQ ID NO: 480319 - DNA, 25 bp, Mus musculus
tgaatctcccgaaatacctgaaagc

SEQ ID NO: 480320 - DNA, 25 bp, Mus musculus
tgaatctcgatgcacctaacaggga

SEQ ID NO: 480321 - DNA, 25 bp, Mus musculus
tgaatctcgtcctagacatcatgtt

SEQ ID NO: 480322 - DNA, 25 bp, Mus musculus
tgaatctctactacagtggatcccc

SEQ ID NO: 480323 - DNA, 25 bp, Mus musculus
tgaatctctggcctgtaccgcatgg

SEQ ID NO: 480324 - DNA, 25 bp, Mus musculus
tgaatctgaaatgtacctggaggct

SEQ ID NO: 480325 - DNA, 25 bp, Mus musculus
tgaatctgattctgagcacgtgcct

SEQ ID NO: 480326 - DNA, 25 bp, Mus musculus
tgaatctgatttaccgcgccagcgc

SEQ ID NO: 480327 - DNA, 25 bp, Mus musculus
tgaatctgcagtatttgatcgggtc

SEQ ID NO: 480328 - DNA, 25 bp, Mus musculus
tgaatctgtatatagcccggcaagt

SEQ ID NO: 480329 - DNA, 25 bp, Mus musculus
tgaatcttaccgagagccagcaggg

SEQ ID NO: 480330 - DNA, 25 bp, Mus musculus
tgaatcttccgctagggtagaaaaa

SEQ ID NO: 480331 - DNA, 25 bp, Mus musculus
tgaatcttcgcccagtgaggtgcca

SEQ ID NO: 480332 - DNA, 25 bp, Mus musculus
tgaatctttgtagccgcatccccaa

SEQ ID NO: 480333 - DNA, 25 bp, Mus musculus
tgaatgaacacatcaaggccctgag

SEQ ID NO: 480334 - DNA, 25 bp, Mus musculus
tgaatgaaccagcatgaacggagcc

SEQ ID NO: 480335 - DNA, 25 bp, Mus musculus
tgaatgaacccttgattcacggaca

SEQ ID NO: 480336 - DNA, 25 bp, Mus musculus
tgaatgaacggaacacagagcagct

SEQ ID NO: 480337 - DNA, 25 bp, Mus musculus
tgaatgaatcaaagaaactatgccc

SEQ ID NO: 480338 - DNA, 25 bp, Mus musculus
tgaatgaatgacacagacagtcact

SEQ ID NO: 480339 - DNA, 25 bp, Mus musculus
tgaatgacaaccctaatggccaggc

SEQ ID NO: 480340 - DNA, 25 bp, Mus musculus
tgaatgacagccacgcgtggtcctg

SEQ ID NO: 480341 - DNA, 25 bp, Mus musculus
tgaatgacatctacaggacctggcg

SEQ ID NO: 480342 - DNA, 25 bp, Mus musculus
tgaatgaccgtctggccaactacct

SEQ ID NO: 480343 - DNA, 25 bp, Mus musculus
tgaatgacgggatgagcacataccc

SEQ ID NO: 480344 - DNA, 25 bp, Mus musculus
tgaatgagaaagaggccacaaggct

SEQ ID NO: 480345 - DNA, 25 bp, Mus musculus
tgaatgagaacagcagggtacacac

SEQ ID NO: 480346 - DNA, 25 bp, Mus musculus
tgaatgagactcactgtgcccgctg

SEQ ID NO: 480347 - DNA, 25 bp, Mus musculus
tgaatgagcccaatggcaggaaact

SEQ ID NO: 480348 - DNA, 25 bp, Mus musculus
tgaatgagctcatagactgtggtgc

SEQ ID NO: 480349 - DNA, 25 bp, Mus musculus
tgaatgagctcatctaacaggaagc

SEQ ID NO: 480350 - DNA, 25 bp, Mus musculus
tgaatgaggctctgaccaggtctgg

SEQ ID NO: 480351 - DNA, 25 bp, Mus musculus
tgaatgatcaacacagaactggcca

SEQ ID NO: 480352 - DNA, 25 bp, Mus musculus
tgaatgatcttcacaaaggcggtcc

SEQ ID NO: 480353 - DNA, 25 bp, Mus musculus
tgaatgatgggctggccgagaacct

SEQ ID NO: 480354 - DNA, 25 bp, Mus musculus
tgaatgatgtcacggcttaggagcc

SEQ ID NO: 480355 - DNA, 25 bp, Mus musculus
tgaatgatgtcaggaagttctccca

SEQ ID NO: 480356 - DNA, 25 bp, Mus musculus
tgaatgcaactgacccggatgaggg

SEQ ID NO: 480357 - DNA, 25 bp, Mus musculus
tgaatgcacatgtccctcgtggcgc

SEQ ID NO: 480358 - DNA, 25 bp, Mus musculus
tgaatgcagcacgtatgtgggctct

SEQ ID NO: 480359 - DNA, 25 bp, Mus musculus
tgaatgcaggtcatgccagtgactg

SEQ ID NO: 480360 - DNA, 25 bp, Mus musculus
tgaatgccaagccatgctgctgcac

SEQ ID NO: 480361 - DNA, 25 bp, Mus musculus
tgaatgccatagacagatggtcccg

SEQ ID NO: 480362 - DNA, 25 bp, Mus musculus
tgaatgccctaaaaatccactgaga

SEQ ID NO: 480363 - DNA, 25 bp, Mus musculus
tgaatgccctcacactgagctgagc

SEQ ID NO: 480364 - DNA, 25 bp, Mus musculus
tgaatgcctgcaaaaagctgccctt

SEQ ID NO: 480365 - DNA, 25 bp, Mus musculus
tgaatgcgctctattgcccatggga

SEQ ID NO: 480366 - DNA, 25 bp, Mus musculus
tgaatgcggacaattaagggccaga

SEQ ID NO: 480367 - DNA, 25 bp, Mus musculus
tgaatgctcagtgcctaaagaagcc

SEQ ID NO: 480368 - DNA, 25 bp, Mus musculus
tgaatgctgccctctatgttacggg

SEQ ID NO: 480369 - DNA, 25 bp, Mus musculus
tgaatgctgtgtttgcctggacaag

SEQ ID NO: 480370 - DNA, 25 bp, Mus musculus
tgaatgctttcgctcgctaagggag

SEQ ID NO: 480371 - DNA, 25 bp, Mus musculus
tgaatggaagaacgacaaacgctcg

SEQ ID NO: 480372 - DNA, 25 bp, Mus musculus
tgaatggaccatgtgctgatgaagt

SEQ ID NO: 480373 - DNA, 25 bp, Mus musculus
tgaatgggcaccttaccaagctggc

SEQ ID NO: 480374 - DNA, 25 bp, Mus musculus
tgaatggtaggtaggtagccgttcc

SEQ ID NO: 480375 - DNA, 25 bp, Mus musculus
tgaatgtaaatgcaacctgaccgag

SEQ ID NO: 480376 - DNA, 25 bp, Mus musculus
tgaatgtacatgaccaagactctgg

SEQ ID NO: 480377 - DNA, 25 bp, Mus musculus
tgaatgtactcctgtgggtggccct

SEQ ID NO: 480378 - DNA, 25 bp, Mus musculus
tgaatgtagaagcaaaagatcccgg

SEQ ID NO: 480379 - DNA, 25 bp, Mus musculus
tgaatgtagaccagtgcagcacgca

SEQ ID NO: 480380 - DNA, 25 bp, Mus musculus
tgaatgtagcatgaacaacggcagc

SEQ ID NO: 480381 - DNA, 25 bp, Mus musculus
tgaatgtatccatcgcgcagactgg

SEQ ID NO: 480382 - DNA, 25 bp, Mus musculus
tgaatgtcacctgggaaggccgaga

SEQ ID NO: 480383 - DNA, 25 bp, Mus musculus
tgaatgtcatcaagctaccgggccc

SEQ ID NO: 480384 - DNA, 25 bp, Mus musculus
tgaatgtcatgcacacagtggacca

SEQ ID NO: 480385 - DNA, 25 bp, Mus musculus
tgaatgtccatgtatgggccctggg

SEQ ID NO: 480386 - DNA, 25 bp, Mus musculus
tgaatgtcgcacacagaagaagagt

SEQ ID NO: 480387 - DNA, 25 bp, Mus musculus
tgaatgtgactaaggcagacgctgg

SEQ ID NO: 480388 - DNA, 25 bp, Mus musculus
tgaatgtgagtttgcaatcgtatga

SEQ ID NO: 480389 - DNA, 25 bp, Mus musculus
tgaatgtgcactacgtcccagctga

SEQ ID NO: 480390 - DNA, 25 bp, Mus musculus
tgaatgtgtacccatcctgggctcc

SEQ ID NO: 480391 - DNA, 25 bp, Mus musculus
tgaatgttctcacctgggaccaaag

SEQ ID NO: 480392 - DNA, 25 bp, Mus musculus
tgaatgtttattcgctacactatga

SEQ ID NO: 480393 - DNA, 25 bp, Mus musculus
tgaattacccaagactagcagtgag

SEQ ID NO: 480394 - DNA, 25 bp, Mus musculus
tgaattacgaaggtctcggcgaggc

SEQ ID NO: 480395 - DNA, 25 bp, Mus musculus
tgaattagccatgttgtcaacttgc

SEQ ID NO: 480396 - DNA, 25 bp, Mus musculus
tgaattaggcaggacccggatccaa

SEQ ID NO: 480397 - DNA, 25 bp, Mus musculus
tgaattcacgtgtaacccaggctat

SEQ ID NO: 480398 - DNA, 25 bp, Mus musculus
tgaattcagcatcaaatcctgtggc

SEQ ID NO: 480399 - DNA, 25 bp, Mus musculus
tgaattcaggttgggagacaagccc

SEQ ID NO: 480400 - DNA, 25 bp, Mus musculus
tgaattcatcttggctctgagctga

SEQ ID NO: 480401 - DNA, 25 bp, Mus musculus
tgaattccaagaggtccaccagcgg

SEQ ID NO: 480402 - DNA, 25 bp, Mus musculus
tgaattccagttgtacaacttacct

SEQ ID NO: 480403 - DNA, 25 bp, Mus musculus
tgaattccctacattgtctggactg

SEQ ID NO: 480404 - DNA, 25 bp, Mus musculus
tgaattcctcataggcttcgtgtga

SEQ ID NO: 480405 - DNA, 25 bp, Mus musculus
tgaattcgccgttgcctggaagtga

SEQ ID NO: 480406 - DNA, 25 bp, Mus musculus
tgaattcggcgggttaatcaggatc

SEQ ID NO: 480407 - DNA, 25 bp, Mus musculus
tgaattctacaacaagggcatgctg

SEQ ID NO: 480408 - DNA, 25 bp, Mus musculus
tgaattctcatctagccttttggct

SEQ ID NO: 480409 - DNA, 25 bp, Mus musculus
tgaattctgctctcttcctaggcct

SEQ ID NO: 480410 - DNA, 25 bp, Mus musculus
tgaattgactgggatgacagccacc

SEQ ID NO: 480411 - DNA, 25 bp, Mus musculus
tgaattgaggctggaaggtgaacct

SEQ ID NO: 480412 - DNA, 25 bp, Mus musculus
tgaattgcacaatcagctaagtgag

SEQ ID NO: 480413 - DNA, 25 bp, Mus musculus
tgaattgccttttgaccgccatgac

SEQ ID NO: 480414 - DNA, 25 bp, Mus musculus
tgaattgtcttcgagcagaggctgg

SEQ ID NO: 480415 - DNA, 25 bp, Mus musculus
tgaattgtggcaggtgttggacacc

SEQ ID NO: 480416 - DNA, 25 bp, Mus musculus
tgaattgttacattgcgctgggacc

SEQ ID NO: 480417 - DNA, 25 bp, Mus musculus
tgaatttaacctgccctggactgag

SEQ ID NO: 480418 - DNA, 25 bp, Mus musculus
tgaatttccagttgtccagcgcggc

SEQ ID NO: 480419 - DNA, 25 bp, Mus musculus
tgaatttcccacgtgcgcttgctgg

SEQ ID NO: 480420 - DNA, 25 bp, Mus musculus
tgaatttccggaaacggtcacgaga

SEQ ID NO: 480421 - DNA, 25 bp, Mus musculus
tgaatttggcaaatgtactgtactc

SEQ ID NO: 480422 - DNA, 25 bp, Mus musculus
tgaatttggctgaggaatccagtca

SEQ ID NO: 480423 - DNA, 25 bp, Mus musculus
tgaattttatgagcacttcccttcc

SEQ ID NO: 480424 - DNA, 25 bp, Mus musculus
tgacaaaaagcagagacgcactggg

SEQ ID NO: 480425 - DNA, 25 bp, Mus musculus
tgacaaaatgtagacgagacgcctc

SEQ ID NO: 480426 - DNA, 25 bp, Mus musculus
tgacaaacagctgtgtgcccgaggc

SEQ ID NO: 480427 - DNA, 25 bp, Mus musculus
tgacaaaccgcagcaatgtgcagag

SEQ ID NO: 480428 - DNA, 25 bp, Mus musculus
tgacaaacctctggtgggccgtgac

SEQ ID NO: 480429 - DNA, 25 bp, Mus musculus
tgacaaaccttttcggtgtagcctt

SEQ ID NO: 480430 - DNA, 25 bp, Mus musculus
tgacaaacgggttacgggatggaat

SEQ ID NO: 480431 - DNA, 25 bp, Mus musculus
tgacaaactggtgaagctacacgct

SEQ ID NO: 480432 - DNA, 25 bp, Mus musculus
tgacaaaggagacacaccatccctc

SEQ ID NO: 480433 - DNA, 25 bp, Mus musculus
tgacaaaggattgacaaacaccatt

SEQ ID NO: 480434 - DNA, 25 bp, Mus musculus
tgacaaagggcaaggactccagagt

SEQ ID NO: 480435 - DNA, 25 bp, Mus musculus
tgacaaaggtaaccagaccttgcca

SEQ ID NO: 480436 - DNA, 25 bp, Mus musculus
tgacaacaacatggacttcaccgac

SEQ ID NO: 480437 - DNA, 25 bp, Mus musculus
tgacaacagactggatgagccaggc

SEQ ID NO: 480438 - DNA, 25 bp, Mus musculus
tgacaacagtgaactccaccacact

SEQ ID NO: 480439 - DNA, 25 bp, Mus musculus
tgacaacattaactcatagaacccg

SEQ ID NO: 480440 - DNA, 25 bp, Mus musculus
tgacaacccaggacaaaaagcatgt

SEQ ID NO: 480441 - DNA, 25 bp, Mus musculus
tgacaacctgaaaacggatgagcgc

SEQ ID NO: 480442 - DNA, 25 bp, Mus musculus
tgacaacgtagtggacgcaggctcg

SEQ ID NO: 480443 - DNA, 25 bp, Mus musculus
tgacaactgagtcgacagccactgc

SEQ ID NO: 480444 - DNA, 25 bp, Mus musculus
tgacaactggagtagagaagagcct

SEQ ID NO: 480445 - DNA, 25 bp, Mus musculus
tgacaacttcccctagagaatctgg

SEQ ID NO: 480446 - DNA, 25 bp, Mus musculus
tgacaacttctttgccaccggagag

SEQ ID NO: 480447 - DNA, 25 bp, Mus musculus
tgacaacttgggtggtggcactctg

SEQ ID NO: 480448 - DNA, 25 bp, Mus musculus
tgacaagaagcttggagccctcagc

SEQ ID NO: 480449 - DNA, 25 bp, Mus musculus
tgacaagaagttccgctgtcacatc

SEQ ID NO: 480450 - DNA, 25 bp, Mus musculus
tgacaagacaggaggaattagccac

SEQ ID NO: 480451 - DNA, 25 bp, Mus musculus
tgacaagatcacagaaattcccagt

SEQ ID NO: 480452 - DNA, 25 bp, Mus musculus
tgacaagatgtacacgcccctgttg

SEQ ID NO: 480453 - DNA, 25 bp, Mus musculus
tgacaagcaatcttaagagggaggc

SEQ ID NO: 480454 - DNA, 25 bp, Mus musculus
tgacaagcacttagaccaggccatg

SEQ ID NO: 480455 - DNA, 25 bp, Mus musculus
tgacaagcaggcatgtcttgggcag

SEQ ID NO: 480456 - DNA, 25 bp, Mus musculus
tgacaagcctttccgcagtggtgac

SEQ ID NO: 480457 - DNA, 25 bp, Mus musculus
tgacaagcgatcctgtgaagagagc

SEQ ID NO: 480458 - DNA, 25 bp, Mus musculus
tgacaagcgcaaggtgaaggacccg

SEQ ID NO: 480459 - DNA, 25 bp, Mus musculus
tgacaaggccctaaaccgagaacag

SEQ ID NO: 480460 - DNA, 25 bp, Mus musculus
tgacaaggccctccaaggtcagaag

SEQ ID NO: 480461 - DNA, 25 bp, Mus musculus
tgacaaggctcaactaaagcaagct

SEQ ID NO: 480462 - DNA, 25 bp, Mus musculus
tgacaagttcatcaggtacataggg

SEQ ID NO: 480463 - DNA, 25 bp, Mus musculus
tgacaagttgctgaaggatctccct

SEQ ID NO: 480464 - DNA, 25 bp, Mus musculus
tgacaagtttagacccgaacgctgg

SEQ ID NO: 480465 - DNA, 25 bp, Mus musculus
tgacaatagcattgagcactcagac

SEQ ID NO: 480466 - DNA, 25 bp, Mus musculus
tgacaatcgcctatgctcgctggga

SEQ ID NO: 480467 - DNA, 25 bp, Mus musculus
tgacaatgccaaacaagctgcttcg

SEQ ID NO: 480468 - DNA, 25 bp, Mus musculus
tgacaatgcgccagagacactcaag

SEQ ID NO: 480469 - DNA, 25 bp, Mus musculus
tgacaatgctcgtctggcagccgat

SEQ ID NO: 480470 - DNA, 25 bp, Mus musculus
tgacaatggctctgcctctaaaggt

SEQ ID NO: 480471 - DNA, 25 bp, Mus musculus
tgacaatgggacacaactggacagt

SEQ ID NO: 480472 - DNA, 25 bp, Mus musculus
tgacaattcggaagagcgcccaaat

SEQ ID NO: 480473 - DNA, 25 bp, Mus musculus
tgacaattggaagggccgtctctcc

SEQ ID NO: 480474 - DNA, 25 bp, Mus musculus
tgacaattgggtcctaacagccgct

SEQ ID NO: 480475 - DNA, 25 bp, Mus musculus
tgacaatttgcccatcaaacgggaa

SEQ ID NO: 480476 - DNA, 25 bp, Mus musculus
tgacacaagattggcctggtctgtt

SEQ ID NO: 480477 - DNA, 25 bp, Mus musculus
tgacacacgtgaagccacatagact

SEQ ID NO: 480478 - DNA, 25 bp, Mus musculus
tgacacactatgaaaagggttggct

SEQ ID NO: 480479 - DNA, 25 bp, Mus musculus
tgacacagctgaagctggcgctgcc

SEQ ID NO: 480480 - DNA, 25 bp, Mus musculus
tgacacaggcatagctccgggatct

SEQ ID NO: 480481 - DNA, 25 bp, Mus musculus
tgacacaggctgctcgaacacttac

SEQ ID NO: 480482 - DNA, 25 bp, Mus musculus
tgacacagtgtctctctaagcagcc

SEQ ID NO: 480483 - DNA, 25 bp, Mus musculus
tgacacatgataggccaggagcaaa

SEQ ID NO: 480484 - DNA, 25 bp, Mus musculus
tgacacatgcattcagtaacctctt

SEQ ID NO: 480485 - DNA, 25 bp, Mus musculus
tgacacatgccctgaaaacaagaag

SEQ ID NO: 480486 - DNA, 25 bp, Mus musculus
tgacaccagaagatgatatgccgat

SEQ ID NO: 480487 - DNA, 25 bp, Mus musculus
tgacaccaggtagggctagccaagt

SEQ ID NO: 480488 - DNA, 25 bp, Mus musculus
tgacaccccaatatacacagcatac

SEQ ID NO: 480489 - DNA, 25 bp, Mus musculus
tgacaccccacaacagaaagaactg

SEQ ID NO: 480490 - DNA, 25 bp, Mus musculus
tgacacccctgaaatcatcacagga

SEQ ID NO: 480491 - DNA, 25 bp, Mus musculus
tgacaccgaaactaatctggcagga

SEQ ID NO: 480492 - DNA, 25 bp, Mus musculus
tgacacctgccgacagtgacagtga

SEQ ID NO: 480493 - DNA, 25 bp, Mus musculus
tgacaccttgaagcttctccgaggc

SEQ ID NO: 480494 - DNA, 25 bp, Mus musculus
tgacacgaaccttggccttttggaa

SEQ ID NO: 480495 - DNA, 25 bp, Mus musculus
tgacacgattgcttcctggaggctg

SEQ ID NO: 480496 - DNA, 25 bp, Mus musculus
tgacacgcaacacaagaaactaaga

SEQ ID NO: 480497 - DNA, 25 bp, Mus musculus
tgacacgctgctaaaaggctttggt

SEQ ID NO: 480498 - DNA, 25 bp, Mus musculus
tgacacggacgctaggaactgaact

SEQ ID NO: 480499 - DNA, 25 bp, Mus musculus
tgacacggctacaggagcgactcat

SEQ ID NO: 480500 - DNA, 25 bp, Mus musculus
tgacacggtgttgtagagtgcatcc

SEQ ID NO: 480501 - DNA, 25 bp, Mus musculus
tgacactagtcagttgttgcccttg

SEQ ID NO: 480502 - DNA, 25 bp, Mus musculus
tgacactatttctggcttcttgggt

SEQ ID NO: 480503 - DNA, 25 bp, Mus musculus
tgacactcaaagagatacctcctgg

SEQ ID NO: 480504 - DNA, 25 bp, Mus musculus
tgacactcacttgggacagctctgc

SEQ ID NO: 480505 - DNA, 25 bp, Mus musculus
tgacactgactcttggaggcttgga

SEQ ID NO: 480506 - DNA, 25 bp, Mus musculus
tgacactgagcctgtccgttcagac

SEQ ID NO: 480507 - DNA, 25 bp, Mus musculus
tgacactgatgaagggcccaggcat

SEQ ID NO: 480508 - DNA, 25 bp, Mus musculus
tgacactggccgagatcaacgagta

SEQ ID NO: 480509 - DNA, 25 bp, Mus musculus
tgacactgggcactctgaaaggaag

SEQ ID NO: 480510 - DNA, 25 bp, Mus musculus
tgacactgtccttcttgagatcctg

SEQ ID NO: 480511 - DNA, 25 bp, Mus musculus
tgacacttaaacttcactctcgtgg

SEQ ID NO: 480512 - DNA, 25 bp, Mus musculus
tgacacttaaagacccaaccagctg

SEQ ID NO: 480513 - DNA, 25 bp, Mus musculus
tgacacttctagagaggctctcggt

SEQ ID NO: 480514 - DNA, 25 bp, Mus musculus
tgacacttgctcttaagcacggtgg

SEQ ID NO: 480515 - DNA, 25 bp, Mus musculus
tgacacttgtgttgaggaccagaac

SEQ ID NO: 480516 - DNA, 25 bp, Mus musculus
tgacacttgttcagagcgcagccat

SEQ ID NO: 480517 - DNA, 25 bp, Mus musculus
tgacactttggaggtcacgcacgcc

SEQ ID NO: 480518 - DNA, 25 bp, Mus musculus
tgacagaactgtggccatggcagca

SEQ ID NO: 480519 - DNA, 25 bp, Mus musculus
tgacagaagtggctaggtacctaag

SEQ ID NO: 480520 - DNA, 25 bp, Mus musculus
tgacagacacatcaggacatgagcc

SEQ ID NO: 480521 - DNA, 25 bp, Mus musculus
tgacagacacggaaggattcagcct

SEQ ID NO: 480522 - DNA, 25 bp, Mus musculus
tgacagacagcatagccttgaggcc

SEQ ID NO: 480523 - DNA, 25 bp, Mus musculus
tgacagacatcatgaccgagggcat

SEQ ID NO: 480524 - DNA, 25 bp, Mus musculus
tgacagacgagagccagcagtttcc

SEQ ID NO: 480525 - DNA, 25 bp, Mus musculus
tgacagacgagcaaagaaaagcaga

SEQ ID NO: 480526 - DNA, 25 bp, Mus musculus
tgacagacgccctcctgaggagagc

SEQ ID NO: 480527 - DNA, 25 bp, Mus musculus
tgacagacttcttaccaggcagggt

SEQ ID NO: 480528 - DNA, 25 bp, Mus musculus
tgacagagaagagattgcacaccac

SEQ ID NO: 480529 - DNA, 25 bp, Mus musculus
tgacagaggcatacagtaggcatca

SEQ ID NO: 480530 - DNA, 25 bp, Mus musculus
tgacagaggccttgcacgacctaaa

SEQ ID NO: 480531 - DNA, 25 bp, Mus musculus
tgacagataaatacagatgcttggg

SEQ ID NO: 480532 - DNA, 25 bp, Mus musculus
tgacagatcaaagatagccaagcct

SEQ ID NO: 480533 - DNA, 25 bp, Mus musculus
tgacagatgcttagatcagcctcct

SEQ ID NO: 480534 - DNA, 25 bp, Mus musculus
tgacagatgcttagtgaggacctcg

SEQ ID NO: 480535 - DNA, 25 bp, Mus musculus
tgacagatgtcagcgtgcacctgag

SEQ ID NO: 480536 - DNA, 25 bp, Mus musculus
tgacagcaatcaaggccgaagtccc

SEQ ID NO: 480537 - DNA, 25 bp, Mus musculus
tgacagcacaccagtactttagtta

SEQ ID NO: 480538 - DNA, 25 bp, Mus musculus
tgacagcacaccagtctaacagagt

SEQ ID NO: 480539 - DNA, 25 bp, Mus musculus
tgacagcagaccctccaaacctaag

SEQ ID NO: 480540 - DNA, 25 bp, Mus musculus
tgacagcagggattgggccctaaat

SEQ ID NO: 480541 - DNA, 25 bp, Mus musculus
tgacagcatcctctaccagatggtg

SEQ ID NO: 480542 - DNA, 25 bp, Mus musculus
tgacagcatgacgaagggacacctg

SEQ ID NO: 480543 - DNA, 25 bp, Mus musculus
tgacagccaccaggatcctaaaggg

SEQ ID NO: 480544 - DNA, 25 bp, Mus musculus
tgacagccacgctcaaaatgttttg

SEQ ID NO: 480545 - DNA, 25 bp, Mus musculus
tgacagccagatacaggatgccctg

SEQ ID NO: 480546 - DNA, 25 bp, Mus musculus
tgacagccagtgacagagggaaacc

SEQ ID NO: 480547 - DNA, 25 bp, Mus musculus
tgacagcccctggaagaaaacgaga

SEQ ID NO: 480548 - DNA, 25 bp, Mus musculus
tgacagcccttacctttttcacctt

SEQ ID NO: 480549 - DNA, 25 bp, Mus musculus
tgacagccgtgtgggcttcgttcgt

SEQ ID NO: 480550 - DNA, 25 bp, Mus musculus
tgacagcgaatacccttccagagtg

SEQ ID NO: 480551 - DNA, 25 bp, Mus musculus
tgacagcggcctgaccttgggtttg

SEQ ID NO: 480552 - DNA, 25 bp, Mus musculus
tgacagctacatgttccggccggtg

SEQ ID NO: 480553 - DNA, 25 bp, Mus musculus
tgacagctcaacttccaggaacagg

SEQ ID NO: 480554 - DNA, 25 bp, Mus musculus
tgacagctcagtttgtggccaggaa

SEQ ID NO: 480555 - DNA, 25 bp, Mus musculus
tgacagctccaggtcagtggatgga

SEQ ID NO: 480556 - DNA, 25 bp, Mus musculus
tgacagctcttctctataggcttag

SEQ ID NO: 480557 - DNA, 25 bp, Mus musculus
tgacagcttctgtgagcgggacacc

SEQ ID NO: 480558 - DNA, 25 bp, Mus musculus
tgacagctttgctgtaagcgctgct

SEQ ID NO: 480559 - DNA, 25 bp, Mus musculus
tgacaggaacacagtactggctctg

SEQ ID NO: 480560 - DNA, 25 bp, Mus musculus
tgacaggacttcagctaaaactggg

SEQ ID NO: 480561 - DNA, 25 bp, Mus musculus
tgacaggagagcagagcttggaaac

SEQ ID NO: 480562 - DNA, 25 bp, Mus musculus
tgacaggagcctgtgagaccaacag

SEQ ID NO: 480563 - DNA, 25 bp, Mus musculus
tgacaggattagtggtggttcccag

SEQ ID NO: 480564 - DNA, 25 bp, Mus musculus
tgacaggcatcattacacaaggagc

SEQ ID NO: 480565 - DNA, 25 bp, Mus musculus
tgacaggcgacagcaaagggaactc

SEQ ID NO: 480566 - DNA, 25 bp, Mus musculus
tgacagggagccaagccttctaact

SEQ ID NO: 480567 - DNA, 25 bp, Mus musculus
tgacagggcgtgatctgcggctaac

SEQ ID NO: 480568 - DNA, 25 bp, Mus musculus
tgacaggtgacatctcccgcaatga

SEQ ID NO: 480569 - DNA, 25 bp, Mus musculus
tgacaggtttcagacagaaccagag

SEQ ID NO: 480570 - DNA, 25 bp, Mus musculus
tgacagtaactcgatgcaattcact

SEQ ID NO: 480571 - DNA, 25 bp, Mus musculus
tgacagtaactctgggcgtgaccct

SEQ ID NO: 480572 - DNA, 25 bp, Mus musculus
tgacagtacaggacccagatgagcc

SEQ ID NO: 480573 - DNA, 25 bp, Mus musculus
tgacagtacggtcccagtaggcact

SEQ ID NO: 480574 - DNA, 25 bp, Mus musculus
tgacagtccaaagggttcctcagag

SEQ ID NO: 480575 - DNA, 25 bp, Mus musculus
tgacagtctccgcagctgctgtgac

SEQ ID NO: 480576 - DNA, 25 bp, Mus musculus
tgacagtgatgattccggagacacc

SEQ ID NO: 480577 - DNA, 25 bp, Mus musculus
tgacagtgccgaggtttaggacagc

SEQ ID NO: 480578 - DNA, 25 bp, Mus musculus
tgacagtgctcaggccatcttctct

SEQ ID NO: 480579 - DNA, 25 bp, Mus musculus
tgacagtggagtgcaacggctctga

SEQ ID NO: 480580 - DNA, 25 bp, Mus musculus
tgacagtggcctaacagaacagagt

SEQ ID NO: 480581 - DNA, 25 bp, Mus musculus
tgacagtggcgcaaatcaaggccgg

SEQ ID NO: 480582 - DNA, 25 bp, Mus musculus
tgacagtgtcaaggtgggcagaagg

SEQ ID NO: 480583 - DNA, 25 bp, Mus musculus
tgacagtgtccttgaagcttccagc

SEQ ID NO: 480584 - DNA, 25 bp, Mus musculus
tgacagttgcaaacgaggtgatcgc

SEQ ID NO: 480585 - DNA, 25 bp, Mus musculus
tgacagttggagagacgagcctttc

SEQ ID NO: 480586 - DNA, 25 bp, Mus musculus
tgacataaattagccaatgactcgg

SEQ ID NO: 480587 - DNA, 25 bp, Mus musculus
tgacatcaaggagtacaagttccgg

SEQ ID NO: 480588 - DNA, 25 bp, Mus musculus
tgacatcacagcttatctttttgga

SEQ ID NO: 480589 - DNA, 25 bp, Mus musculus
tgacatcagctgtgaggcaagctct

SEQ ID NO: 480590 - DNA, 25 bp, Mus musculus
tgacatcagcttatttccctgctac

SEQ ID NO: 480591 - DNA, 25 bp, Mus musculus
tgacatcagtatcacgagcagctgg

SEQ ID NO: 480592 - DNA, 25 bp, Mus musculus
tgacatcatcgacgcggaggtgacc

SEQ ID NO: 480593 - DNA, 25 bp, Mus musculus
tgacatcatggcctaccgaggtcgt

SEQ ID NO: 480594 - DNA, 25 bp, Mus musculus
tgacatcgatgacaaggagcctctc

SEQ ID NO: 480595 - DNA, 25 bp, Mus musculus
tgacatcgtcatcaccagggaggag

SEQ ID NO: 480596 - DNA, 25 bp, Mus musculus
tgacatctatcctgacctgctgggc

SEQ ID NO: 480597 - DNA, 25 bp, Mus musculus
tgacatctcaaagggcaggcccggc

SEQ ID NO: 480598 - DNA, 25 bp, Mus musculus
tgacatctcttctgactgtcccagg

SEQ ID NO: 480599 - DNA, 25 bp, Mus musculus
tgacatctgacacggtagtcctgag

SEQ ID NO: 480600 - DNA, 25 bp, Mus musculus
tgacatctgacattcaccacctggg

SEQ ID NO: 480601 - DNA, 25 bp, Mus musculus
tgacatctgtctagagaagcggaag

SEQ ID NO: 480602 - DNA, 25 bp, Mus musculus
tgacatctgtgtctccatccagagc

SEQ ID NO: 480603 - DNA, 25 bp, Mus musculus
tgacatcttagcaagtgaacttcca

SEQ ID NO: 480604 - DNA, 25 bp, Mus musculus
tgacatctttgccagaaggcaggcc

SEQ ID NO: 480605 - DNA, 25 bp, Mus musculus
tgacatgagtgattcaacacgaatg

SEQ ID NO: 480606 - DNA, 25 bp, Mus musculus
tgacatgcccatctacgaagctgcc

SEQ ID NO: 480607 - DNA, 25 bp, Mus musculus
tgacatgccgactccgactggtgaa

SEQ ID NO: 480608 - DNA, 25 bp, Mus musculus
tgacatggaagacgattacgaacct

SEQ ID NO: 480609 - DNA, 25 bp, Mus musculus
tgacatggagaaggctaagacgcac

SEQ ID NO: 480610 - DNA, 25 bp, Mus musculus
tgacatggccatgcataagcagatg

SEQ ID NO: 480611 - DNA, 25 bp, Mus musculus
tgacatgggcacatgggcacgaacc

SEQ ID NO: 480612 - DNA, 25 bp, Mus musculus
tgacatgggcctagggaagaccgtc

SEQ ID NO: 480613 - DNA, 25 bp, Mus musculus
tgacatggtccagtctgttgctcta

SEQ ID NO: 480614 - DNA, 25 bp, Mus musculus
tgacatggtcttcttcctgcaaggc

SEQ ID NO: 480615 - DNA, 25 bp, Mus musculus
tgacatggttagctaactgccctgg

SEQ ID NO: 480616 - DNA, 25 bp, Mus musculus
tgacatgtagatggctggtccagcc

SEQ ID NO: 480617 - DNA, 25 bp, Mus musculus
tgacatgtatgcagatggcacccag

SEQ ID NO: 480618 - DNA, 25 bp, Mus musculus
tgacatgtcaagcaagaagcatctg

SEQ ID NO: 480619 - DNA, 25 bp, Mus musculus
tgacatgtcccaaggtctccactga

SEQ ID NO: 480620 - DNA, 25 bp, Mus musculus
tgacattaactgttccttgagagag

SEQ ID NO: 480621 - DNA, 25 bp, Mus musculus
tgacattaagggaaaggcgcactgg

SEQ ID NO: 480622 - DNA, 25 bp, Mus musculus
tgacattattggactggacgcagcc

SEQ ID NO: 480623 - DNA, 25 bp, Mus musculus
tgacattcaagaaagatgaccattg

SEQ ID NO: 480624 - DNA, 25 bp, Mus musculus
tgacattcaggccaaaagccagtgt

SEQ ID NO: 480625 - DNA, 25 bp, Mus musculus
tgacattcgacatttgacaggcggc

SEQ ID NO: 480626 - DNA, 25 bp, Mus musculus
tgacattgcacgcattgaacgctgc

SEQ ID NO: 480627 - DNA, 25 bp, Mus musculus
tgacattgcactaacccagctaggg

SEQ ID NO: 480628 - DNA, 25 bp, Mus musculus
tgacattgtagccccaggaactggg

SEQ ID NO: 480629 - DNA, 25 bp, Mus musculus
tgacatttcgcagcaggtggccaac

SEQ ID NO: 480630 - DNA, 25 bp, Mus musculus
tgaccaaaatctggagtgaagacca

SEQ ID NO: 480631 - DNA, 25 bp, Mus musculus
tgaccaaactcttggaccggatgaa

SEQ ID NO: 480632 - DNA, 25 bp, Mus musculus
tgaccaacagtgtgccagaggcagc

SEQ ID NO: 480633 - DNA, 25 bp, Mus musculus
tgaccaacatggagatagcctgaag

SEQ ID NO: 480634 - DNA, 25 bp, Mus musculus
tgaccaacctggagctcagctggat

SEQ ID NO: 480635 - DNA, 25 bp, Mus musculus
tgaccaacttgttattgtggaagaa

SEQ ID NO: 480636 - DNA, 25 bp, Mus musculus
tgaccaagaaactgaaacagtgccc

SEQ ID NO: 480637 - DNA, 25 bp, Mus musculus
tgaccaagaagagtttgtatcttcg

SEQ ID NO: 480638 - DNA, 25 bp, Mus musculus
tgaccaagacctagaacgcatcctg

SEQ ID NO: 480639 - DNA, 25 bp, Mus musculus
tgaccaagcccgcatggacattagg

SEQ ID NO: 480640 - DNA, 25 bp, Mus musculus
tgaccaagcctctgcaggggcatcc

SEQ ID NO: 480641 - DNA, 25 bp, Mus musculus
tgaccaagctatgttccctgtgatg

SEQ ID NO: 480642 - DNA, 25 bp, Mus musculus
tgaccaagctcctgttgtgcgcctt

SEQ ID NO: 480643 - DNA, 25 bp, Mus musculus
tgaccaaggaaccatctaacttttt

SEQ ID NO: 480644 - DNA, 25 bp, Mus musculus
tgaccaaggctcacaaggatggccg

SEQ ID NO: 480645 - DNA, 25 bp, Mus musculus
tgaccaagtgccctgagaaaaaccg

SEQ ID NO: 480646 - DNA, 25 bp, Mus musculus
tgaccaagttcaaggctccacagta

SEQ ID NO: 480647 - DNA, 25 bp, Mus musculus
tgaccaagttggtgataaacccatc

SEQ ID NO: 480648 - DNA, 25 bp, Mus musculus
tgaccaatcctttctaccgagagcg

SEQ ID NO: 480649 - DNA, 25 bp, Mus musculus
tgaccaatgaacaagagatcctgtg

SEQ ID NO: 480650 - DNA, 25 bp, Mus musculus
tgaccaattctgtcctgctcaatgg

SEQ ID NO: 480651 - DNA, 25 bp, Mus musculus
tgaccacaccattagagcactgcaa

SEQ ID NO: 480652 - DNA, 25 bp, Mus musculus
tgaccacagagggattcagattcta

SEQ ID NO: 480653 - DNA, 25 bp, Mus musculus
tgaccacagagtgttatggattcct

SEQ ID NO: 480654 - DNA, 25 bp, Mus musculus
tgaccacagggtagcccagagttgc

SEQ ID NO: 480655 - DNA, 25 bp, Mus musculus
tgaccacagtcttaagagcccaggg

SEQ ID NO: 480656 - DNA, 25 bp, Mus musculus
tgaccacattcagctcatcagcgtg

SEQ ID NO: 480657 - DNA, 25 bp, Mus musculus
tgaccacattcccatacatctggat

SEQ ID NO: 480658 - DNA, 25 bp, Mus musculus
tgaccacccgtcaggcagattgagg

SEQ ID NO: 480659 - DNA, 25 bp, Mus musculus
tgaccaccggtgttctcaagcaaac

SEQ ID NO: 480660 - DNA, 25 bp, Mus musculus
tgaccacgaatatacagcagccggc

SEQ ID NO: 480661 - DNA, 25 bp, Mus musculus
tgaccacggatgatgacgccatgag

SEQ ID NO: 480662 - DNA, 25 bp, Mus musculus
tgaccacgtgcttgcgagaacggct

SEQ ID NO: 480663 - DNA, 25 bp, Mus musculus
tgaccacgtggcctgtgcaaggact

SEQ ID NO: 480664 - DNA, 25 bp, Mus musculus
tgaccagaacaaccgagagcatgct

SEQ ID NO: 480665 - DNA, 25 bp, Mus musculus
tgaccagaacacctgctgggcctgg

SEQ ID NO: 480666 - DNA, 25 bp, Mus musculus
tgaccagaaccagggacagatggca

SEQ ID NO: 480667 - DNA, 25 bp, Mus musculus
tgaccagaagccaggaacaagtgga

SEQ ID NO: 480668 - DNA, 25 bp, Mus musculus
tgaccagagccaggttactgaaaat

SEQ ID NO: 480669 - DNA, 25 bp, Mus musculus
tgaccagccatggtagccggaacct

SEQ ID NO: 480670 - DNA, 25 bp, Mus musculus
tgaccagccgatcgtgaagacagca

SEQ ID NO: 480671 - DNA, 25 bp, Mus musculus
tgaccagctcagagtacagtgggac

SEQ ID NO: 480672 - DNA, 25 bp, Mus musculus
tgaccaggaacacggcatctagagc

SEQ ID NO: 480673 - DNA, 25 bp, Mus musculus
tgaccaggatggagtccttttcctt

SEQ ID NO: 480674 - DNA, 25 bp, Mus musculus
tgaccagtacttaaggtgaggcctg

SEQ ID NO: 480675 - DNA, 25 bp, Mus musculus
tgaccagtctgaagacgaagcgctt

SEQ ID NO: 480676 - DNA, 25 bp, Mus musculus
tgaccagtgaccaccttgcctgtga

SEQ ID NO: 480677 - DNA, 25 bp, Mus musculus
tgaccagtgctctagctctgtgacc

SEQ ID NO: 480678 - DNA, 25 bp, Mus musculus
tgaccagtgtcagaaaatacctatg

SEQ ID NO: 480679 - DNA, 25 bp, Mus musculus
tgaccagtttcatggcagcctcgaa

SEQ ID NO: 480680 - DNA, 25 bp, Mus musculus
tgaccatacagcgttccagtgccag

SEQ ID NO: 480681 - DNA, 25 bp, Mus musculus
tgaccataggcatggcacacacgtg

SEQ ID NO: 480682 - DNA, 25 bp, Mus musculus
tgaccatcccagacactttcgtgaa

SEQ ID NO: 480683 - DNA, 25 bp, Mus musculus
tgaccatcgccacatacatgaaggg

SEQ ID NO: 480684 - DNA, 25 bp, Mus musculus
tgaccatcggctatgctgatgtgca

SEQ ID NO: 480685 - DNA, 25 bp, Mus musculus
tgaccatgagtttcggacaagccca

SEQ ID NO: 480686 - DNA, 25 bp, Mus musculus
tgaccatgcaatggaaagacctgct

SEQ ID NO: 480687 - DNA, 25 bp, Mus musculus
tgaccatggaccacctcctagtaag

SEQ ID NO: 480688 - DNA, 25 bp, Mus musculus
tgaccatggagatggcagggacact

SEQ ID NO: 480689 - DNA, 25 bp, Mus musculus
tgaccatggccttttggacagcagc

SEQ ID NO: 480690 - DNA, 25 bp, Mus musculus
tgaccatggtgacttgctgttaacg

SEQ ID NO: 480691 - DNA, 25 bp, Mus musculus
tgaccatgtcctaatccggcagtgt

SEQ ID NO: 480692 - DNA, 25 bp, Mus musculus
tgaccattacctcgatacactttgt

SEQ ID NO: 480693 - DNA, 25 bp, Mus musculus
tgaccatttggacatactgccccgc

SEQ ID NO: 480694 - DNA, 25 bp, Mus musculus
tgacccaccccaggaagagtataga

SEQ ID NO: 480695 - DNA, 25 bp, Mus musculus
tgacccaccgtgttgcctctgttga

SEQ ID NO: 480696 - DNA, 25 bp, Mus musculus
tgacccacgaagagatggaaactct

SEQ ID NO: 480697 - DNA, 25 bp, Mus musculus
tgacccacggtggatgatgatgcct

SEQ ID NO: 480698 - DNA, 25 bp, Mus musculus
tgacccagaataccaagtgcaagtg

SEQ ID NO: 480699 - DNA, 25 bp, Mus musculus
tgacccagaccccaagatatatgaa

SEQ ID NO: 480700 - DNA, 25 bp, Mus musculus
tgacccaggatacaggattatcaca

SEQ ID NO: 480701 - DNA, 25 bp, Mus musculus
tgacccaggtggtgcgaaacttcct

SEQ ID NO: 480702 - DNA, 25 bp, Mus musculus
tgacccagtccataaggtagcagtg

SEQ ID NO: 480703 - DNA, 25 bp, Mus musculus
tgacccagtgaaatctaaaggtttt

SEQ ID NO: 480704 - DNA, 25 bp, Mus musculus
tgacccagttcgcacccatactggt

SEQ ID NO: 480705 - DNA, 25 bp, Mus musculus
tgacccataggtggagaatcactga

SEQ ID NO: 480706 - DNA, 25 bp, Mus musculus
tgacccatggagcttacaaatggct

SEQ ID NO: 480707 - DNA, 25 bp, Mus musculus
tgaccccaatggataggcatgatgg

SEQ ID NO: 480708 - DNA, 25 bp, Mus musculus
tgaccccaatgtacaaggaggccgg

SEQ ID NO: 480709 - DNA, 25 bp, Mus musculus
tgaccccagagagtggctaaggcaa

SEQ ID NO: 480710 - DNA, 25 bp, Mus musculus
tgaccccaggttctaggacatgccc

SEQ ID NO: 480711 - DNA, 25 bp, Mus musculus
tgaccccattggataacctgctagg

SEQ ID NO: 480712 - DNA, 25 bp, Mus musculus
tgaccccgaggaaggcagtacttgg

SEQ ID NO: 480713 - DNA, 25 bp, Mus musculus
tgaccccgattgtggatttaccgct

SEQ ID NO: 480714 - DNA, 25 bp, Mus musculus
tgaccccgcgttcgtggcctggaac

SEQ ID NO: 480715 - DNA, 25 bp, Mus musculus
tgacccctactgcaagtgcctctgg

SEQ ID NO: 480716 - DNA, 25 bp, Mus musculus
tgacccctgaaaagcggccatcttg

SEQ ID NO: 480717 - DNA, 25 bp, Mus musculus
tgacccctggctggatgatactgca

SEQ ID NO: 480718 - DNA, 25 bp, Mus musculus
tgacccctggtggaacgagacatca

SEQ ID NO: 480719 - DNA, 25 bp, Mus musculus
tgaccccttgggttataggaccagg

SEQ ID NO: 480720 - DNA, 25 bp, Mus musculus
tgaccccttgtggtgacttgcccag

SEQ ID NO: 480721 - DNA, 25 bp, Mus musculus
tgacccgaaagcctgcaactggaag

SEQ ID NO: 480722 - DNA, 25 bp, Mus musculus
tgacccgagcccagttgataacaga

SEQ ID NO: 480723 - DNA, 25 bp, Mus musculus
tgacccgaggccgttaccgtgaatt

SEQ ID NO: 480724 - DNA, 25 bp, Mus musculus
tgacccgagggttccgatctatgac

SEQ ID NO: 480725 - DNA, 25 bp, Mus musculus
tgacccgctgtctggccttacatca

SEQ ID NO: 480726 - DNA, 25 bp, Mus musculus
tgacccggaagtctctcactggcca

SEQ ID NO: 480727 - DNA, 25 bp, Mus musculus
tgacccggatctcggagcaagtacc

SEQ ID NO: 480728 - DNA, 25 bp, Mus musculus
tgacccggcgctgaagctattccag

SEQ ID NO: 480729 - DNA, 25 bp, Mus musculus
tgacccggcgctttggaataccagg

SEQ ID NO: 480730 - DNA, 25 bp, Mus musculus
tgacccggcggtcacggtcatccgt

SEQ ID NO: 480731 - DNA, 25 bp, Mus musculus
tgacccgggcagaagaatccctgct

SEQ ID NO: 480732 - DNA, 25 bp, Mus musculus
tgacccgggctccaaatcggcgcgt

SEQ ID NO: 480733 - DNA, 25 bp, Mus musculus
tgacccgggtcaggtatgtcctctg

SEQ ID NO: 480734 - DNA, 25 bp, Mus musculus
tgacccggtaagtgggcatactggt

SEQ ID NO: 480735 - DNA, 25 bp, Mus musculus
tgacccggtctccagtcacaggatt

SEQ ID NO: 480736 - DNA, 25 bp, Mus musculus
tgacccgtgagaatgcagaactgcg

SEQ ID NO: 480737 - DNA, 25 bp, Mus musculus
tgacccgtgtgagagtggcaacttc

SEQ ID NO: 480738 - DNA, 25 bp, Mus musculus
tgaccctacgggatgtggacagctg

SEQ ID NO: 480739 - DNA, 25 bp, Mus musculus
tgaccctcaagaccacggagatgga

SEQ ID NO: 480740 - DNA, 25 bp, Mus musculus
tgaccctcaatgtggaacaggcagc

SEQ ID NO: 480741 - DNA, 25 bp, Mus musculus
tgaccctcagagatttcccacgagt

SEQ ID NO: 480742 - DNA, 25 bp, Mus musculus
tgaccctcagagtgataaacccagc

SEQ ID NO: 480743 - DNA, 25 bp, Mus musculus
tgaccctctacagtggatccagaaa

SEQ ID NO: 480744 - DNA, 25 bp, Mus musculus
tgaccctctgaccaggtactgctga

SEQ ID NO: 480745 - DNA, 25 bp, Mus musculus
tgaccctgaagggaacaccaggagg

SEQ ID NO: 480746 - DNA, 25 bp, Mus musculus
tgaccctgctgtgtggcctgaggaa

SEQ ID NO: 480747 - DNA, 25 bp, Mus musculus
tgaccctggtctgctgtgggaagcc

SEQ ID NO: 480748 - DNA, 25 bp, Mus musculus
tgaccctgtacccattgactctcta

SEQ ID NO: 480749 - DNA, 25 bp, Mus musculus
tgaccctgtcttgtgtcaagttgga

SEQ ID NO: 480750 - DNA, 25 bp, Mus musculus
tgaccctgtgctctacatgacagag

SEQ ID NO: 480751 - DNA, 25 bp, Mus musculus
tgaccctgtgctggacgagaagagt

SEQ ID NO: 480752 - DNA, 25 bp, Mus musculus
tgacccttgaccctggatactatag

SEQ ID NO: 480753 - DNA, 25 bp, Mus musculus
tgacccttttcgtgctggaccagaa

SEQ ID NO: 480754 - DNA, 25 bp, Mus musculus
tgaccgaactgtacgcatctggcgc

SEQ ID NO: 480755 - DNA, 25 bp, Mus musculus
tgaccgaagcgaggcacaaaatgtg

SEQ ID NO: 480756 - DNA, 25 bp, Mus musculus
tgaccgagaccccaatagtgcaacg

SEQ ID NO: 480757 - DNA, 25 bp, Mus musculus
tgaccgagagcttcgaggcagacta

SEQ ID NO: 480758 - DNA, 25 bp, Mus musculus
tgaccgagatcgacaacagtgctga

SEQ ID NO: 480759 - DNA, 25 bp, Mus musculus
tgaccgagctcaccactaagggaag

SEQ ID NO: 480760 - DNA, 25 bp, Mus musculus
tgaccgatgcgcaagtaaaaacctg

SEQ ID NO: 480761 - DNA, 25 bp, Mus musculus
tgaccgatttcgctcccgaagcaaa

SEQ ID NO: 480762 - DNA, 25 bp, Mus musculus
tgaccgcacctgcaatgtgagctcg

SEQ ID NO: 480763 - DNA, 25 bp, Mus musculus
tgaccgcactagtggtcgcccagtc

SEQ ID NO: 480764 - DNA, 25 bp, Mus musculus
tgaccgcactgttgatcaccttgat

SEQ ID NO: 480765 - DNA, 25 bp, Mus musculus
tgaccgccacatcgtcttctggaac

SEQ ID NO: 480766 - DNA, 25 bp, Mus musculus
tgaccgcctcggtggaaccacaaaa

SEQ ID NO: 480767 - DNA, 25 bp, Mus musculus
tgaccgcgattccaaaagggattcc

SEQ ID NO: 480768 - DNA, 25 bp, Mus musculus
tgaccgcgcagatgcactgcaggca

SEQ ID NO: 480769 - DNA, 25 bp, Mus musculus
tgaccgctgtgtggaagccttcgtg

SEQ ID NO: 480770 - DNA, 25 bp, Mus musculus
tgaccgcttcaacgtagaccatgaa

SEQ ID NO: 480771 - DNA, 25 bp, Mus musculus
tgaccggaaactggaggcctgcttc

SEQ ID NO: 480772 - DNA, 25 bp, Mus musculus
tgaccggccttatgaactgtgggac

SEQ ID NO: 480773 - DNA, 25 bp, Mus musculus
tgaccggcctttgcctgaagaggag

SEQ ID NO: 480774 - DNA, 25 bp, Mus musculus
tgaccgggacatagcgcttcttgac

SEQ ID NO: 480775 - DNA, 25 bp, Mus musculus
tgaccgggtactttttaaagcacag

SEQ ID NO: 480776 - DNA, 25 bp, Mus musculus
tgaccgggttgctcctaaagactta

SEQ ID NO: 480777 - DNA, 25 bp, Mus musculus
tgaccgggtttgttcctgagcctag

SEQ ID NO: 480778 - DNA, 25 bp, Mus musculus
tgaccgtattgtcttccgccgaggc

SEQ ID NO: 480779 - DNA, 25 bp, Mus musculus
tgaccgtccagctgatgtgccacag

SEQ ID NO: 480780 - DNA, 25 bp, Mus musculus
tgaccgtcgcatggcttccaaacgt

SEQ ID NO: 480781 - DNA, 25 bp, Mus musculus
tgaccgtgagagctgaatgcccaat

SEQ ID NO: 480782 - DNA, 25 bp, Mus musculus
tgaccgtgagggagcctgtctctat

SEQ ID NO: 480783 - DNA, 25 bp, Mus musculus
tgaccgtgcagatgccctccaggca

SEQ ID NO: 480784 - DNA, 25 bp, Mus musculus
tgaccgttaaccacacagctgagca

SEQ ID NO: 480785 - DNA, 25 bp, Mus musculus
tgaccgttacttctcagtgacccga

SEQ ID NO: 480786 - DNA, 25 bp, Mus musculus
tgaccgttgtagacttttgtaccac

SEQ ID NO: 480787 - DNA, 25 bp, Mus musculus
tgacctaaggagctgccactcgccg

SEQ ID NO: 480788 - DNA, 25 bp, Mus musculus
tgacctacacgccatctcaggaggg

SEQ ID NO: 480789 - DNA, 25 bp, Mus musculus
tgacctacagataccggaaccagaa

SEQ ID NO: 480790 - DNA, 25 bp, Mus musculus
tgacctacgtgaaggagaacgcccg

SEQ ID NO: 480791 - DNA, 25 bp, Mus musculus
tgacctacgtggacaacatggcctg

SEQ ID NO: 480792 - DNA, 25 bp, Mus musculus
tgacctactggcattgccagaccat

SEQ ID NO: 480793 - DNA, 25 bp, Mus musculus
tgacctactgttgtgagccctgaag

SEQ ID NO: 480794 - DNA, 25 bp, Mus musculus
tgacctacttcctcattctgctggg

SEQ ID NO: 480795 - DNA, 25 bp, Mus musculus
tgacctagagggatccagtaattcc

SEQ ID NO: 480796 - DNA, 25 bp, Mus musculus
tgacctagctagaatggaaacgcca

SEQ ID NO: 480797 - DNA, 25 bp, Mus musculus
tgacctatctccagagagccctgtg

SEQ ID NO: 480798 - DNA, 25 bp, Mus musculus
tgacctatttttgttggacacccgg

SEQ ID NO: 480799 - DNA, 25 bp, Mus musculus
tgacctcaacaacatctgggcctgg

SEQ ID NO: 480800 - DNA, 25 bp, Mus musculus
tgacctcaacatggagttgcgcagg

SEQ ID NO: 480801 - DNA, 25 bp, Mus musculus
tgacctcaagaggtttccccaaggt

SEQ ID NO: 480802 - DNA, 25 bp, Mus musculus
tgacctcaagtaccaggaatgcaag

SEQ ID NO: 480803 - DNA, 25 bp, Mus musculus
tgacctcactgctaacgggatgcgt

SEQ ID NO: 480804 - DNA, 25 bp, Mus musculus
tgacctcaggcacaaattctacaat

SEQ ID NO: 480805 - DNA, 25 bp, Mus musculus
tgacctccatggacaacgggcatgc

SEQ ID NO: 480806 - DNA, 25 bp, Mus musculus
tgacctcgaggagcagaacaaacgc

SEQ ID NO: 480807 - DNA, 25 bp, Mus musculus
tgacctcggagagcacgaggcagag

SEQ ID NO: 480808 - DNA, 25 bp, Mus musculus
tgacctcggcccttcgagaggatgg

SEQ ID NO: 480809 - DNA, 25 bp, Mus musculus
tgacctcggcttctcgctgtctgct

SEQ ID NO: 480810 - DNA, 25 bp, Mus musculus
tgacctctacatcccagatagtgga

SEQ ID NO: 480811 - DNA, 25 bp, Mus musculus
tgacctctactcacattcctaaacg

SEQ ID NO: 480812 - DNA, 25 bp, Mus musculus
tgacctctgacctgctgaaacgctt

SEQ ID NO: 480813 - DNA, 25 bp, Mus musculus
tgacctctgaggaactgttaaaccg

SEQ ID NO: 480814 - DNA, 25 bp, Mus musculus
tgacctctgaggatagcccaagtgc

SEQ ID NO: 480815 - DNA, 25 bp, Mus musculus
tgacctcttcggtgccctggacttt

SEQ ID NO: 480816 - DNA, 25 bp, Mus musculus
tgacctgacgctgcagtgtgagtct

SEQ ID NO: 480817 - DNA, 25 bp, Mus musculus
tgacctgagaaagagactaaatata

SEQ ID NO: 480818 - DNA, 25 bp, Mus musculus
tgacctgaggtcatcaactttgatg

SEQ ID NO: 480819 - DNA, 25 bp, Mus musculus
tgacctgcggaagccaagacttaca

SEQ ID NO: 480820 - DNA, 25 bp, Mus musculus
tgacctgcgttgaccaatcagagcg

SEQ ID NO: 480821 - DNA, 25 bp, Mus musculus
tgacctgctggatccaggccgcact

SEQ ID NO: 480822 - DNA, 25 bp, Mus musculus
tgacctggaccctgaaaccgtggat

SEQ ID NO: 480823 - DNA, 25 bp, Mus musculus
tgacctggaccctgagattgtgaag

SEQ ID NO: 480824 - DNA, 25 bp, Mus musculus
tgacctggagaaacatggaacctcg

SEQ ID NO: 480825 - DNA, 25 bp, Mus musculus
tgacctggataacctgaagctgctg

SEQ ID NO: 480826 - DNA, 25 bp, Mus musculus
tgacctggatcctctaccgaaaaaa

SEQ ID NO: 480827 - DNA, 25 bp, Mus musculus
tgacctgggaactttggaccttttg

SEQ ID NO: 480828 - DNA, 25 bp, Mus musculus
tgacctgggctgtcctgatgagagc

SEQ ID NO: 480829 - DNA, 25 bp, Mus musculus
tgacctgtaagagccagcggctgat

SEQ ID NO: 480830 - DNA, 25 bp, Mus musculus
tgacctgtaggatgtatgcggcaac

SEQ ID NO: 480831 - DNA, 25 bp, Mus musculus
tgacctgtcagggaatcagagggcc

SEQ ID NO: 480832 - DNA, 25 bp, Mus musculus
tgacctgtcagtagtggagcgtgca

SEQ ID NO: 480833 - DNA, 25 bp, Mus musculus
tgacctgtccttgcacccaaatgag

SEQ ID NO: 480834 - DNA, 25 bp, Mus musculus
tgacctgtggttggatgtactacaa

SEQ ID NO: 480835 - DNA, 25 bp, Mus musculus
tgaccttaatggaacgccaggctgt

SEQ ID NO: 480836 - DNA, 25 bp, Mus musculus
tgaccttagcctgatgcagcagccg

SEQ ID NO: 480837 - DNA, 25 bp, Mus musculus
tgaccttagctccaacctggaagaa

SEQ ID NO: 480838 - DNA, 25 bp, Mus musculus
tgaccttatagagcgcatccgggca

SEQ ID NO: 480839 - DNA, 25 bp, Mus musculus
tgaccttcaagtgacagactctgga

SEQ ID NO: 480840 - DNA, 25 bp, Mus musculus
tgaccttcacctctgggaagacttg

SEQ ID NO: 480841 - DNA, 25 bp, Mus musculus
tgaccttcccctaaaaagctttgtg

SEQ ID NO: 480842 - DNA, 25 bp, Mus musculus
tgaccttcccgctgaggcatttgga

SEQ ID NO: 480843 - DNA, 25 bp, Mus musculus
tgaccttccttcacacggatgggct

SEQ ID NO: 480844 - DNA, 25 bp, Mus musculus
tgaccttcgaccctgagctcgtgga

SEQ ID NO: 480845 - DNA, 25 bp, Mus musculus
tgaccttcgaggtggctgaggctcc

SEQ ID NO: 480846 - DNA, 25 bp, Mus musculus
tgaccttcgggtttggcactctgac

SEQ ID NO: 480847 - DNA, 25 bp, Mus musculus
tgaccttctctttgccgttggccct

SEQ ID NO: 480848 - DNA, 25 bp, Mus musculus
tgaccttctgccaaataggattcgg

SEQ ID NO: 480849 - DNA, 25 bp, Mus musculus
tgaccttgacctgcgacagggattg

SEQ ID NO: 480850 - DNA, 25 bp, Mus musculus
tgaccttgaggagtacgacgcagaa

SEQ ID NO: 480851 - DNA, 25 bp, Mus musculus
tgaccttgaggctcatccccaatga

SEQ ID NO: 480852 - DNA, 25 bp, Mus musculus
tgaccttggacagtgtgagcccaga

SEQ ID NO: 480853 - DNA, 25 bp, Mus musculus
tgaccttggactcatgacagtgcct

SEQ ID NO: 480854 - DNA, 25 bp, Mus musculus
tgaccttggcactcagaaccccatt

SEQ ID NO: 480855 - DNA, 25 bp, Mus musculus
tgaccttggccctctgagcaggaag

SEQ ID NO: 480856 - DNA, 25 bp, Mus musculus
tgaccttgggccgagttactgggac

SEQ ID NO: 480857 - DNA, 25 bp, Mus musculus
tgaccttgggtagccatacagcgac

SEQ ID NO: 480858 - DNA, 25 bp, Mus musculus
tgaccttgtggaggcactggagaaa

SEQ ID NO: 480859 - DNA, 25 bp, Mus musculus
tgaccttgtggtctgcggatgaaca

SEQ ID NO: 480860 - DNA, 25 bp, Mus musculus
tgacctttaaagacctcgggacaga

SEQ ID NO: 480861 - DNA, 25 bp, Mus musculus
tgacctttgggcgaaagccgagaac

SEQ ID NO: 480862 - DNA, 25 bp, Mus musculus
tgacgaaatacaaagaaccagctgc

SEQ ID NO: 480863 - DNA, 25 bp, Mus musculus
tgacgaattccgaaggcgcatcctg

SEQ ID NO: 480864 - DNA, 25 bp, Mus musculus
tgacgacacacacatgaaggacttg

SEQ ID NO: 480865 - DNA, 25 bp, Mus musculus
tgacgacatgagcaacgtagtcctg

SEQ ID NO: 480866 - DNA, 25 bp, Mus musculus
tgacgacatgttagtgagcaccagc

SEQ ID NO: 480867 - DNA, 25 bp, Mus musculus
tgacgacgcgtttgaagagtacagt

SEQ ID NO: 480868 - DNA, 25 bp, Mus musculus
tgacgactcacagccaacaatgtgg

SEQ ID NO: 480869 - DNA, 25 bp, Mus musculus
tgacgactcagacagcagctatggt

SEQ ID NO: 480870 - DNA, 25 bp, Mus musculus
tgacgactccttaggctcagacggg

SEQ ID NO: 480871 - DNA, 25 bp, Mus musculus
tgacgactgtgatgatcaaccaccg

SEQ ID NO: 480872 - DNA, 25 bp, Mus musculus
tgacgagacccggaatctgcagagt

SEQ ID NO: 480873 - DNA, 25 bp, Mus musculus
tgacgagagtgtgtggccttgcaac

SEQ ID NO: 480874 - DNA, 25 bp, Mus musculus
tgacgagcactactacggagaaggt

SEQ ID NO: 480875 - DNA, 25 bp, Mus musculus
tgacgagctgagaattatgcagaaa

SEQ ID NO: 480876 - DNA, 25 bp, Mus musculus
tgacgagcttctacaactggatgag

SEQ ID NO: 480877 - DNA, 25 bp, Mus musculus
tgacgaggtacaaatccaaggagct

SEQ ID NO: 480878 - DNA, 25 bp, Mus musculus
tgacgataccctggctgaataggct

SEQ ID NO: 480879 - DNA, 25 bp, Mus musculus
tgacgatctgtaaagcaggagggcc

SEQ ID NO: 480880 - DNA, 25 bp, Mus musculus
tgacgatgaatagctccagccctgg

SEQ ID NO: 480881 - DNA, 25 bp, Mus musculus
tgacgatgaccagtgttgagcgcct

SEQ ID NO: 480882 - DNA, 25 bp, Mus musculus
tgacgatgctcacagtgtagtggcc

SEQ ID NO: 480883 - DNA, 25 bp, Mus musculus
tgacgattatcacgctaccacggaa

SEQ ID NO: 480884 - DNA, 25 bp, Mus musculus
tgacgcaagcggtagagtacaacct

SEQ ID NO: 480885 - DNA, 25 bp, Mus musculus
tgacgcagagctcctacagaacttg

SEQ ID NO: 480886 - DNA, 25 bp, Mus musculus
tgacgcagtctctgaatgtggagct

SEQ ID NO: 480887 - DNA, 25 bp, Mus musculus
tgacgcccgtggtccttaagctgaa

SEQ ID NO: 480888 - DNA, 25 bp, Mus musculus
tgacgccctgagcttccatggtgat

SEQ ID NO: 480889 - DNA, 25 bp, Mus musculus
tgacgccgtcaccatggagtgtaac

SEQ ID NO: 480890 - DNA, 25 bp, Mus musculus
tgacgccgttcagcatcgaggacat

SEQ ID NO: 480891 - DNA, 25 bp, Mus musculus
tgacgcctctaagaaagcacactgt

SEQ ID NO: 480892 - DNA, 25 bp, Mus musculus
tgacgcctgagttccgcacagtagg

SEQ ID NO: 480893 - DNA, 25 bp, Mus musculus
tgacgcgagtcttcctctgagatcg

SEQ ID NO: 480894 - DNA, 25 bp, Mus musculus
tgacgctcattcctgtctgctggac

SEQ ID NO: 480895 - DNA, 25 bp, Mus musculus
tgacgctcccgaggctcatgggaac

SEQ ID NO: 480896 - DNA, 25 bp, Mus musculus
tgacgctcctcacccagcattgtgt

SEQ ID NO: 480897 - DNA, 25 bp, Mus musculus
tgacgctgatacgaacaaactgagg

SEQ ID NO: 480898 - DNA, 25 bp, Mus musculus
tgacgctgccacgatgaaggccaag

SEQ ID NO: 480899 - DNA, 25 bp, Mus musculus
tgacgctgggtatcgccatatcgac

SEQ ID NO: 480900 - DNA, 25 bp, Mus musculus
tgacggaatccgaggaggagctcct

SEQ ID NO: 480901 - DNA, 25 bp, Mus musculus
tgacggacaccagtaagtatacggg

SEQ ID NO: 480902 - DNA, 25 bp, Mus musculus
tgacggacattgagcgtatcgccat

SEQ ID NO: 480903 - DNA, 25 bp, Mus musculus
tgacggacgtgtacctgctgaacct

SEQ ID NO: 480904 - DNA, 25 bp, Mus musculus
tgacggagaaccactgcacaatgag

SEQ ID NO: 480905 - DNA, 25 bp, Mus musculus
tgacggaggacatgatgcccgagca

SEQ ID NO: 480906 - DNA, 25 bp, Mus musculus
tgacggatcattccaggcacagtag

SEQ ID NO: 480907 - DNA, 25 bp, Mus musculus
tgacggatgacctcagacggatgac

SEQ ID NO: 480908 - DNA, 25 bp, Mus musculus
tgacggcaagtcatggagttaaagc

SEQ ID NO: 480909 - DNA, 25 bp, Mus musculus
tgacggcagaggatgtacaggccct

SEQ ID NO: 480910 - DNA, 25 bp, Mus musculus
tgacggcagccagaagacatgagcc

SEQ ID NO: 480911 - DNA, 25 bp, Mus musculus
tgacggcccaattgaaatcttgagg

SEQ ID NO: 480912 - DNA, 25 bp, Mus musculus
tgacggccgaaccagtccgagattt

SEQ ID NO: 480913 - DNA, 25 bp, Mus musculus
tgacggctggcttggtgatgaacac

SEQ ID NO: 480914 - DNA, 25 bp, Mus musculus
tgacggctgtctggagaatctccca

SEQ ID NO: 480915 - DNA, 25 bp, Mus musculus
tgacggcttcaaggatgctatgacc

SEQ ID NO: 480916 - DNA, 25 bp, Mus musculus
tgacggcttctgaacgcaggagact

SEQ ID NO: 480917 - DNA, 25 bp, Mus musculus
tgacgggacctatacatgcgaagcc

SEQ ID NO: 480918 - DNA, 25 bp, Mus musculus
tgacgggcgaattctagggactcca

SEQ ID NO: 480919 - DNA, 25 bp, Mus musculus
tgacgggcgaccatgtcggacatcg

SEQ ID NO: 480920 - DNA, 25 bp, Mus musculus
tgacgggctaatgtacaggcttgag

SEQ ID NO: 480921 - DNA, 25 bp, Mus musculus
tgacgggctgcaaagcggtctctct

SEQ ID NO: 480922 - DNA, 25 bp, Mus musculus
tgacggtactcaggaaatggcacaa

SEQ ID NO: 480923 - DNA, 25 bp, Mus musculus
tgacggtcaccgacttgctgggcaa

SEQ ID NO: 480924 - DNA, 25 bp, Mus musculus
tgacggtgctaaacccaatgaagcc

SEQ ID NO: 480925 - DNA, 25 bp, Mus musculus
tgacggtggctatacgagggaatct

SEQ ID NO: 480926 - DNA, 25 bp, Mus musculus
tgacggtggtaaatctcatgtgtgg

SEQ ID NO: 480927 - DNA, 25 bp, Mus musculus
tgacggttgttatcaccgtgccggt

SEQ ID NO: 480928 - DNA, 25 bp, Mus musculus
tgacgtaaccaatctttctacccct

SEQ ID NO: 480929 - DNA, 25 bp, Mus musculus
tgacgtcacatcacttagccggacg

SEQ ID NO: 480930 - DNA, 25 bp, Mus musculus
tgacgtcaccttgcgggctcgcgta

SEQ ID NO: 480931 - DNA, 25 bp, Mus musculus
tgacgtcagcaagagatagccatcg

SEQ ID NO: 480932 - DNA, 25 bp, Mus musculus
tgacgtcagcagctagctatttgga

SEQ ID NO: 480933 - DNA, 25 bp, Mus musculus
tgacgtcatcagctcaactctcaag

SEQ ID NO: 480934 - DNA, 25 bp, Mus musculus
tgacgtccaacactgagcttctcgg

SEQ ID NO: 480935 - DNA, 25 bp, Mus musculus
tgacgtccacaggaattagatcccc

SEQ ID NO: 480936 - DNA, 25 bp, Mus musculus
tgacgtccctagctacattatgtga

SEQ ID NO: 480937 - DNA, 25 bp, Mus musculus
tgacgtccgtgagcagcacttcaac

SEQ ID NO: 480938 - DNA, 25 bp, Mus musculus
tgacgtccgttgcaccatgaaggcg

SEQ ID NO: 480939 - DNA, 25 bp, Mus musculus
tgacgtcgacatgcagcctgagggt

SEQ ID NO: 480940 - DNA, 25 bp, Mus musculus
tgacgtctgatgtcgagagctggaa

SEQ ID NO: 480941 - DNA, 25 bp, Mus musculus
tgacgtgacaaaggtgaaatacccg

SEQ ID NO: 480942 - DNA, 25 bp, Mus musculus
tgacgtgatgaaatacctaaaatgt

SEQ ID NO: 480943 - DNA, 25 bp, Mus musculus
tgacgtgcactaccggatgttctgg

SEQ ID NO: 480944 - DNA, 25 bp, Mus musculus
tgacgtgcagtagctacgatgaccg

SEQ ID NO: 480945 - DNA, 25 bp, Mus musculus
tgacgtgctactcaacaagccagtg

SEQ ID NO: 480946 - DNA, 25 bp, Mus musculus
tgacgtgtgacccaaccaagaagaa

SEQ ID NO: 480947 - DNA, 25 bp, Mus musculus
tgacgtttcatgtctctcgagcctt

SEQ ID NO: 480948 - DNA, 25 bp, Mus musculus
tgactaaaaaactgaattgtgcctt

SEQ ID NO: 480949 - DNA, 25 bp, Mus musculus
tgactaataaccttcagggccacgc

SEQ ID NO: 480950 - DNA, 25 bp, Mus musculus
tgactaattgctgggtagagggcaa

SEQ ID NO: 480951 - DNA, 25 bp, Mus musculus
tgactacaatgagatacccaacttt

SEQ ID NO: 480952 - DNA, 25 bp, Mus musculus
tgactacactgctgggcaatgccat

SEQ ID NO: 480953 - DNA, 25 bp, Mus musculus
tgactacagacagtaatacaccgtc

SEQ ID NO: 480954 - DNA, 25 bp, Mus musculus
tgactaccagcggatttgcaagatg

SEQ ID NO: 480955 - DNA, 25 bp, Mus musculus
tgactaccagtagtagacatctcag

SEQ ID NO: 480956 - DNA, 25 bp, Mus musculus
tgactaccagtgcaggtacccacgg

SEQ ID NO: 480957 - DNA, 25 bp, Mus musculus
tgactaccgggcctaggaactgtcc

SEQ ID NO: 480958 - DNA, 25 bp, Mus musculus
tgactacgatcctcccacagaaatg

SEQ ID NO: 480959 - DNA, 25 bp, Mus musculus
tgactacttctatgccttcctgcgg

SEQ ID NO: 480960 - DNA, 25 bp, Mus musculus
tgactactttttcagggcacctacc

SEQ ID NO: 480961 - DNA, 25 bp, Mus musculus
tgactagcagaagtacagccaggcc

SEQ ID NO: 480962 - DNA, 25 bp, Mus musculus
tgactagtatctaaccccagacctg

SEQ ID NO: 480963 - DNA, 25 bp, Mus musculus
tgactataacgtgagctccccagaa

SEQ ID NO: 480964 - DNA, 25 bp, Mus musculus
tgactataccaggaggatttcgcag

SEQ ID NO: 480965 - DNA, 25 bp, Mus musculus
tgactatacctattggaaatctgag

SEQ ID NO: 480966 - DNA, 25 bp, Mus musculus
tgactatcctcatagagtggccaag

SEQ ID NO: 480967 - DNA, 25 bp, Mus musculus
tgactatcctttatcattttcgtag

SEQ ID NO: 480968 - DNA, 25 bp, Mus musculus
tgactatcgtggtcagttccctgag

SEQ ID NO: 480969 - DNA, 25 bp, Mus musculus
tgactatgatgatgtcccggaggag

SEQ ID NO: 480970 - DNA, 25 bp, Mus musculus
tgactatgatggctccaggacccag

SEQ ID NO: 480971 - DNA, 25 bp, Mus musculus
tgactatgctcctggcctaggctgg

SEQ ID NO: 480972 - DNA, 25 bp, Mus musculus
tgactatggagaacagcgaacactg

SEQ ID NO: 480973 - DNA, 25 bp, Mus musculus
tgactatgggagcacctgccacttg

SEQ ID NO: 480974 - DNA, 25 bp, Mus musculus
tgactatgtgcacccacagctgcgg

SEQ ID NO: 480975 - DNA, 25 bp, Mus musculus
tgactattaagcttcctgaggtgcc

SEQ ID NO: 480976 - DNA, 25 bp, Mus musculus
tgactattcgtctaccctactgtgg

SEQ ID NO: 480977 - DNA, 25 bp, Mus musculus
tgactcaaccgcgagccttgtggat

SEQ ID NO: 480978 - DNA, 25 bp, Mus musculus
tgactcaagtgttgtaccaggctga

SEQ ID NO: 480979 - DNA, 25 bp, Mus musculus
tgactcaccaccagcgcttgagaaa

SEQ ID NO: 480980 - DNA, 25 bp, Mus musculus
tgactcacgtgcacaggcggaagat

SEQ ID NO: 480981 - DNA, 25 bp, Mus musculus
tgactcactcttgctggaactacct

SEQ ID NO: 480982 - DNA, 25 bp, Mus musculus
tgactcactttgcaacagagagcac

SEQ ID NO: 480983 - DNA, 25 bp, Mus musculus
tgactcagacaagatccttccagat

SEQ ID NO: 480984 - DNA, 25 bp, Mus musculus
tgactcagaccctgattataggcag

SEQ ID NO: 480985 - DNA, 25 bp, Mus musculus
tgactcagcgacactaggcaggatg

SEQ ID NO: 480986 - DNA, 25 bp, Mus musculus
tgactcaggaagctcacggtctctg

SEQ ID NO: 480987 - DNA, 25 bp, Mus musculus
tgactcatagggatggagaccccat

SEQ ID NO: 480988 - DNA, 25 bp, Mus musculus
tgactccaaatactgtttcttcttt

SEQ ID NO: 480989 - DNA, 25 bp, Mus musculus
tgactccagggacgaccagtgttga

SEQ ID NO: 480990 - DNA, 25 bp, Mus musculus
tgactccagtatcccaaatgtgccc

SEQ ID NO: 480991 - DNA, 25 bp, Mus musculus
tgactccagtctacttacatttggg

SEQ ID NO: 480992 - DNA, 25 bp, Mus musculus
tgactccatggattctgcgcttgag

SEQ ID NO: 480993 - DNA, 25 bp, Mus musculus
tgactcccacatctaggcctgtagg

SEQ ID NO: 480994 - DNA, 25 bp, Mus musculus
tgactccccgggtttcctgaacgag

SEQ ID NO: 480995 - DNA, 25 bp, Mus musculus
tgactccgaacaggaagaggacgag

SEQ ID NO: 480996 - DNA, 25 bp, Mus musculus
tgactccgagaaaggtgaacggtta

SEQ ID NO: 480997 - DNA, 25 bp, Mus musculus
tgactccggaagttgctcctcagga

SEQ ID NO: 480998 - DNA, 25 bp, Mus musculus
tgactccggagtgtgttaatcacac

SEQ ID NO: 480999 - DNA, 25 bp, Mus musculus
tgactccgtagagcaagacttccag

SEQ ID NO: 481000 - DNA, 25 bp, Mus musculus
tgactcctatctgattactgcttgg

SEQ ID NO: 481001 - DNA, 25 bp, Mus musculus
tgactcctcttgactgcatggtact

SEQ ID NO: 481002 - DNA, 25 bp, Mus musculus
tgactcctgaagaacggtactccga

SEQ ID NO: 481003 - DNA, 25 bp, Mus musculus
tgactcctgcaaaatcacaggaaag

SEQ ID NO: 481004 - DNA, 25 bp, Mus musculus
tgactcctgtctgcggctgtgatca

SEQ ID NO: 481005 - DNA, 25 bp, Mus musculus
tgactcgaagtctgcagtatggaga

SEQ ID NO: 481006 - DNA, 25 bp, Mus musculus
tgactcgacccaagaaggctatccc

SEQ ID NO: 481007 - DNA, 25 bp, Mus musculus
tgactcgcgacctcatcaacgttgg

SEQ ID NO: 481008 - DNA, 25 bp, Mus musculus
tgactcgtcagacaatccggctggg

SEQ ID NO: 481009 - DNA, 25 bp, Mus musculus
tgactctacatctgcaaccgtcagc

SEQ ID NO: 481010 - DNA, 25 bp, Mus musculus
tgactctagtttgcgagggccctca

SEQ ID NO: 481011 - DNA, 25 bp, Mus musculus
tgactctccagggaataggactgag

SEQ ID NO: 481012 - DNA, 25 bp, Mus musculus
tgactctgataggtgcgatcgccgg

SEQ ID NO: 481013 - DNA, 25 bp, Mus musculus
tgactctggacttacaaaggcttgg

SEQ ID NO: 481014 - DNA, 25 bp, Mus musculus
tgactctggctctcggtcttagcac

SEQ ID NO: 481015 - DNA, 25 bp, Mus musculus
tgactgaacgatgcagcagatggcc

SEQ ID NO: 481016 - DNA, 25 bp, Mus musculus
tgactgaagcccacgtacacgggta

SEQ ID NO: 481017 - DNA, 25 bp, Mus musculus
tgactgaagcccatcggagcaaagg

SEQ ID NO: 481018 - DNA, 25 bp, Mus musculus
tgactgaagttcaagcaatggtaga

SEQ ID NO: 481019 - DNA, 25 bp, Mus musculus
tgactgacactgaagagcaaattgg

SEQ ID NO: 481020 - DNA, 25 bp, Mus musculus
tgactgacaggtaattgggcgacac

SEQ ID NO: 481021 - DNA, 25 bp, Mus musculus
tgactgacagtctcagcctgggaac

SEQ ID NO: 481022 - DNA, 25 bp, Mus musculus
tgactgaccagaccatggcttacca

SEQ ID NO: 481023 - DNA, 25 bp, Mus musculus
tgactgacttcactggattgtcagc

SEQ ID NO: 481024 - DNA, 25 bp, Mus musculus
tgactgagaaacaaggtacaacctt

SEQ ID NO: 481025 - DNA, 25 bp, Mus musculus
tgactgagatccatccttaatggtg

SEQ ID NO: 481026 - DNA, 25 bp, Mus musculus
tgactgaggatagaacactccgcct

SEQ ID NO: 481027 - DNA, 25 bp, Mus musculus
tgactgaggcacacaacttccctgg

SEQ ID NO: 481028 - DNA, 25 bp, Mus musculus
tgactgataccaacatgacccttgg

SEQ ID NO: 481029 - DNA, 25 bp, Mus musculus
tgactgatagattccagcaggagct

SEQ ID NO: 481030 - DNA, 25 bp, Mus musculus
tgactgatcttttctatgctggccg

SEQ ID NO: 481031 - DNA, 25 bp, Mus musculus
tgactgattgtagggcagccagcgc

SEQ ID NO: 481032 - DNA, 25 bp, Mus musculus
tgactgcaacggaacggaagacacg

SEQ ID NO: 481033 - DNA, 25 bp, Mus musculus
tgactgcaaggaaaagcacgcactg

SEQ ID NO: 481034 - DNA, 25 bp, Mus musculus
tgactgcaaggccaggaaactaagg

SEQ ID NO: 481035 - DNA, 25 bp, Mus musculus
tgactgcacagtagatctcttggag

SEQ ID NO: 481036 - DNA, 25 bp, Mus musculus
tgactgcagaaatggatatggccct

SEQ ID NO: 481037 - DNA, 25 bp, Mus musculus
tgactgcagactcagcggagagacc

SEQ ID NO: 481038 - DNA, 25 bp, Mus musculus
tgactgcagcatccactcttcttgc

SEQ ID NO: 481039 - DNA, 25 bp, Mus musculus
tgactgcagccaaggagacaagcct

SEQ ID NO: 481040 - DNA, 25 bp, Mus musculus
tgactgcagctcactgtgcgggaag

SEQ ID NO: 481041 - DNA, 25 bp, Mus musculus
tgactgccagacttctctccgagag

SEQ ID NO: 481042 - DNA, 25 bp, Mus musculus
tgactgccattgaaggtacggcgca

SEQ ID NO: 481043 - DNA, 25 bp, Mus musculus
tgactgcccctcagtgaacgaacgg

SEQ ID NO: 481044 - DNA, 25 bp, Mus musculus
tgactgcgagttcctgcgcactgag

SEQ ID NO: 481045 - DNA, 25 bp, Mus musculus
tgactgcgataccataggccaagcc

SEQ ID NO: 481046 - DNA, 25 bp, Mus musculus
tgactgcgcccctagtggatgagag

SEQ ID NO: 481047 - DNA, 25 bp, Mus musculus
tgactgcggtgacatgttcgagaac

SEQ ID NO: 481048 - DNA, 25 bp, Mus musculus
tgactgctagttttagaagggttga

SEQ ID NO: 481049 - DNA, 25 bp, Mus musculus
tgactgctgaccgtactggtgcaca

SEQ ID NO: 481050 - DNA, 25 bp, Mus musculus
tgactgctgcacatcagaggcctgg

SEQ ID NO: 481051 - DNA, 25 bp, Mus musculus
tgactggaaaccgagagtccaggcg

SEQ ID NO: 481052 - DNA, 25 bp, Mus musculus
tgactggaaagggtacactggcaaa

SEQ ID NO: 481053 - DNA, 25 bp, Mus musculus
tgactggcaacggatcctctctgac

SEQ ID NO: 481054 - DNA, 25 bp, Mus musculus
tgactggcaagcactgtaccgactg

SEQ ID NO: 481055 - DNA, 25 bp, Mus musculus
tgactggccagcaacgtccagagat

SEQ ID NO: 481056 - DNA, 25 bp, Mus musculus
tgactggccttgtcagtgtgctgac

SEQ ID NO: 481057 - DNA, 25 bp, Mus musculus
tgactggctttttggaaaacctggg

SEQ ID NO: 481058 - DNA, 25 bp, Mus musculus
tgactgggaccagaacagaggcgat

SEQ ID NO: 481059 - DNA, 25 bp, Mus musculus
tgactgggattgaagacggccagca

SEQ ID NO: 481060 - DNA, 25 bp, Mus musculus
tgactgggcactcaaagctcagaat

SEQ ID NO: 481061 - DNA, 25 bp, Mus musculus
tgactgggcccagaatctcaagctg

SEQ ID NO: 481062 - DNA, 25 bp, Mus musculus
tgactgggcgacaccagaaccaggt

SEQ ID NO: 481063 - DNA, 25 bp, Mus musculus
tgactgggctgtgtaggagctcctt

SEQ ID NO: 481064 - DNA, 25 bp, Mus musculus
tgactgggtcctacacaaacttgag

SEQ ID NO: 481065 - DNA, 25 bp, Mus musculus
tgactgtaaacctcaccgcacaggg

SEQ ID NO: 481066 - DNA, 25 bp, Mus musculus
tgactgtaacgctcatagatgccaa

SEQ ID NO: 481067 - DNA, 25 bp, Mus musculus
tgactgtaactctaaggagcccaac

SEQ ID NO: 481068 - DNA, 25 bp, Mus musculus
tgactgtatgaatgaccaagaagag

SEQ ID NO: 481069 - DNA, 25 bp, Mus musculus
tgactgtcagctaggctccctcatg

SEQ ID NO: 481070 - DNA, 25 bp, Mus musculus
tgactgtctcctcatagagatggag

SEQ ID NO: 481071 - DNA, 25 bp, Mus musculus
tgactgtgccctaggcagaggagcc

SEQ ID NO: 481072 - DNA, 25 bp, Mus musculus
tgactgtgctccgaaagacccaaga

SEQ ID NO: 481073 - DNA, 25 bp, Mus musculus
tgactgtggtaaagccagggctgcc

SEQ ID NO: 481074 - DNA, 25 bp, Mus musculus
tgactgtggtcaataacggcacggt

SEQ ID NO: 481075 - DNA, 25 bp, Mus musculus
tgactgtggtgtgcaatccgctggc

SEQ ID NO: 481076 - DNA, 25 bp, Mus musculus
tgactgtgtgtcctgacagtgtctg

SEQ ID NO: 481077 - DNA, 25 bp, Mus musculus
tgactgttaagtgtagaatgagcca

SEQ ID NO: 481078 - DNA, 25 bp, Mus musculus
tgactgttccaaaggagaatctcct

SEQ ID NO: 481079 - DNA, 25 bp, Mus musculus
tgactgttccctctactctgcctgg

SEQ ID NO: 481080 - DNA, 25 bp, Mus musculus
tgactgttgaagatggtccccggga

SEQ ID NO: 481081 - DNA, 25 bp, Mus musculus
tgactgtttgtaaactactgaccag

SEQ ID NO: 481082 - DNA, 25 bp, Mus musculus
tgacttaaatccctgcagccatctg

SEQ ID NO: 481083 - DNA, 25 bp, Mus musculus
tgacttaacataccacgtacggcca

SEQ ID NO: 481084 - DNA, 25 bp, Mus musculus
tgacttacagaaggtgggcctggct

SEQ ID NO: 481085 - DNA, 25 bp, Mus musculus
tgacttagcattgcccacccttggg

SEQ ID NO: 481086 - DNA, 25 bp, Mus musculus
tgacttaggctctctgacaagtgct

SEQ ID NO: 481087 - DNA, 25 bp, Mus musculus
tgacttagtccacgtgatgcgcacg

SEQ ID NO: 481088 - DNA, 25 bp, Mus musculus
tgacttatgaggaaatgatggccct

SEQ ID NO: 481089 - DNA, 25 bp, Mus musculus
tgacttcaacgtggcattacaggac

SEQ ID NO: 481090 - DNA, 25 bp, Mus musculus
tgacttcaagctcaggattctcctg

SEQ ID NO: 481091 - DNA, 25 bp, Mus musculus
tgacttcaaggatgtgacgcacaca

SEQ ID NO: 481092 - DNA, 25 bp, Mus musculus
tgacttcactcagcaccttggcaag

SEQ ID NO: 481093 - DNA, 25 bp, Mus musculus
tgacttcactgcaagggccttggga

SEQ ID NO: 481094 - DNA, 25 bp, Mus musculus
tgacttcaggctggatgctatccca

SEQ ID NO: 481095 - DNA, 25 bp, Mus musculus
tgacttcagggttgtgcagcacttg

SEQ ID NO: 481096 - DNA, 25 bp, Mus musculus
tgacttcagtttccatgctgatgag

SEQ ID NO: 481097 - DNA, 25 bp, Mus musculus
tgacttccaagtgggtgacgagccc

SEQ ID NO: 481098 - DNA, 25 bp, Mus musculus
tgacttccaggcagaccagggacaa

SEQ ID NO: 481099 - DNA, 25 bp, Mus musculus
tgacttcccagctcacaaagggtga

SEQ ID NO: 481100 - DNA, 25 bp, Mus musculus
tgacttcccagtggttatcgaacct

SEQ ID NO: 481101 - DNA, 25 bp, Mus musculus
tgacttcccatttaacggtggcgga

SEQ ID NO: 481102 - DNA, 25 bp, Mus musculus
tgacttccggtatgagactcaggct

SEQ ID NO: 481103 - DNA, 25 bp, Mus musculus
tgacttcctgttccctaaaatattt

SEQ ID NO: 481104 - DNA, 25 bp, Mus musculus
tgacttcgacaacaagccgatggtg

SEQ ID NO: 481105 - DNA, 25 bp, Mus musculus
tgacttctaagatggattcctgacc

SEQ ID NO: 481106 - DNA, 25 bp, Mus musculus
tgacttctgtgctcttaaaggccag

SEQ ID NO: 481107 - DNA, 25 bp, Mus musculus
tgacttcttgaacgattcctccagt

SEQ ID NO: 481108 - DNA, 25 bp, Mus musculus
tgacttgccgcaggttacatgacca

SEQ ID NO: 481109 - DNA, 25 bp, Mus musculus
tgacttgctcaaggccagactctgg

SEQ ID NO: 481110 - DNA, 25 bp, Mus musculus
tgacttgctctcatgcctttcctga

SEQ ID NO: 481111 - DNA, 25 bp, Mus musculus
tgacttggaacaccagccatcaggt

SEQ ID NO: 481112 - DNA, 25 bp, Mus musculus
tgacttggacacaaccgatggcctg

SEQ ID NO: 481113 - DNA, 25 bp, Mus musculus
tgacttggagggttgggcattcccc

SEQ ID NO: 481114 - DNA, 25 bp, Mus musculus
tgacttggctgagcgaggactcctg

SEQ ID NO: 481115 - DNA, 25 bp, Mus musculus
tgacttgggaacgaagcactagtgc

SEQ ID NO: 481116 - DNA, 25 bp, Mus musculus
tgacttgggtggttgcctcagggct

SEQ ID NO: 481117 - DNA, 25 bp, Mus musculus
tgacttggttttttcaagtaatcct

SEQ ID NO: 481118 - DNA, 25 bp, Mus musculus
tgacttgtatttaacacccacccca

SEQ ID NO: 481119 - DNA, 25 bp, Mus musculus
tgactttaaccgctggcatcatgag

SEQ ID NO: 481120 - DNA, 25 bp, Mus musculus
tgactttagtgacttgccatggccg

SEQ ID NO: 481121 - DNA, 25 bp, Mus musculus
tgactttagtgtgtataagccactt

SEQ ID NO: 481122 - DNA, 25 bp, Mus musculus
tgactttataaagctgactgacagc

SEQ ID NO: 481123 - DNA, 25 bp, Mus musculus
tgactttcactcttcgccaagggct

SEQ ID NO: 481124 - DNA, 25 bp, Mus musculus
tgactttccaggctcctgagaaggg

SEQ ID NO: 481125 - DNA, 25 bp, Mus musculus
tgactttcctactcaagttcaaggc

SEQ ID NO: 481126 - DNA, 25 bp, Mus musculus
tgactttcgagctaacgggagagac

SEQ ID NO: 481127 - DNA, 25 bp, Mus musculus
tgactttcgtctggaccactgtccg

SEQ ID NO: 481128 - DNA, 25 bp, Mus musculus
tgactttctgttggagcctcctggg

SEQ ID NO: 481129 - DNA, 25 bp, Mus musculus
tgactttgagtgagccagaagcccc

SEQ ID NO: 481130 - DNA, 25 bp, Mus musculus
tgactttgccaagcctgggacgatg

SEQ ID NO: 481131 - DNA, 25 bp, Mus musculus
tgactttgccgaggcttcacgggaa

SEQ ID NO: 481132 - DNA, 25 bp, Mus musculus
tgactttgctttagacggcggcccc

SEQ ID NO: 481133 - DNA, 25 bp, Mus musculus
tgactttggaggtgagaccatgcca

SEQ ID NO: 481134 - DNA, 25 bp, Mus musculus
tgactttggcacctctaagcggctg

SEQ ID NO: 481135 - DNA, 25 bp, Mus musculus
tgactttggctcagagacgcctgcc

SEQ ID NO: 481136 - DNA, 25 bp, Mus musculus
tgacttttacggatgtagcgccgcg

SEQ ID NO: 481137 - DNA, 25 bp, Mus musculus
tgacttttatctgcggaacctgacc

SEQ ID NO: 481138 - DNA, 25 bp, Mus musculus
tgacttttgacccttgacccttgac

SEQ ID NO: 481139 - DNA, 25 bp, Mus musculus
tgactttttcaggaagctcacaaga

SEQ ID NO: 481140 - DNA, 25 bp, Mus musculus
tgagaaaaaacacagctgctaactt

SEQ ID NO: 481141 - DNA, 25 bp, Mus musculus
tgagaaaaaccagtccacaccagtc

SEQ ID NO: 481142 - DNA, 25 bp, Mus musculus
tgagaaaacattcctctgccgtggt

SEQ ID NO: 481143 - DNA, 25 bp, Mus musculus
tgagaaaaccttccagggtgccctg

SEQ ID NO: 481144 - DNA, 25 bp, Mus musculus
tgagaaaagaatccatgggcagaga

SEQ ID NO: 481145 - DNA, 25 bp, Mus musculus
tgagaaaagatttcataatggaagc

SEQ ID NO: 481146 - DNA, 25 bp, Mus musculus
tgagaaaagcccagaaagtgagcat

SEQ ID NO: 481147 - DNA, 25 bp, Mus musculus
tgagaaaagtctctggcagcctgat

SEQ ID NO: 481148 - DNA, 25 bp, Mus musculus
tgagaaaatcttccgccaaatggac

SEQ ID NO: 481149 - DNA, 25 bp, Mus musculus
tgagaaaatgctcaagctgcgccgc

SEQ ID NO: 481150 - DNA, 25 bp, Mus musculus
tgagaaacaaggaggtgaagaccgc

SEQ ID NO: 481151 - DNA, 25 bp, Mus musculus
tgagaaacacagttccaacctgagg

SEQ ID NO: 481152 - DNA, 25 bp, Mus musculus
tgagaaacactactgacctcagttg

SEQ ID NO: 481153 - DNA, 25 bp, Mus musculus
tgagaaaccacacgtaccaaatgct

SEQ ID NO: 481154 - DNA, 25 bp, Mus musculus
tgagaaaccagagtcgtcaccctta

SEQ ID NO: 481155 - DNA, 25 bp, Mus musculus
tgagaaaccaggctcgcatcacggt

SEQ ID NO: 481156 - DNA, 25 bp, Mus musculus
tgagaaacctgcagaaaagccagcc

SEQ ID NO: 481157 - DNA, 25 bp, Mus musculus
tgagaaacggcctaggttcaggctg

SEQ ID NO: 481158 - DNA, 25 bp, Mus musculus
tgagaaactcggtcggggaactcca

SEQ ID NO: 481159 - DNA, 25 bp, Mus musculus
tgagaaactgtaccaagccaagctg

SEQ ID NO: 481160 - DNA, 25 bp, Mus musculus
tgagaaactttgagtcctccagcga

SEQ ID NO: 481161 - DNA, 25 bp, Mus musculus
tgagaaagactccaacatccgtgaa

SEQ ID NO: 481162 - DNA, 25 bp, Mus musculus
tgagaaagatcagcagcctcgccaa

SEQ ID NO: 481163 - DNA, 25 bp, Mus musculus
tgagaaagatctgtacccagggcct

SEQ ID NO: 481164 - DNA, 25 bp, Mus musculus
tgagaaaggctttgtggcactacac

SEQ ID NO: 481165 - DNA, 25 bp, Mus musculus
tgagaaaggtttccacaactctggc

SEQ ID NO: 481166 - DNA, 25 bp, Mus musculus
tgagaaagtcccagccgtagctaac

SEQ ID NO: 481167 - DNA, 25 bp, Mus musculus
tgagaaagtccttgcaggccagcag

SEQ ID NO: 481168 - DNA, 25 bp, Mus musculus
tgagaaatccattcaatcaacagac

SEQ ID NO: 481169 - DNA, 25 bp, Mus musculus
tgagaacaaacagcatgcacaggga

SEQ ID NO: 481170 - DNA, 25 bp, Mus musculus
tgagaacaaagcacatgagaacccc

SEQ ID NO: 481171 - DNA, 25 bp, Mus musculus
tgagaacaaccagaccatgaaccgg

SEQ ID NO: 481172 - DNA, 25 bp, Mus musculus
tgagaacacggcacgtgatctgagt

SEQ ID NO: 481173 - DNA, 25 bp, Mus musculus
tgagaacattcagagcaaggacacc

SEQ ID NO: 481174 - DNA, 25 bp, Mus musculus
tgagaaccaaacagattcgagatcg

SEQ ID NO: 481175 - DNA, 25 bp, Mus musculus
tgagaaccactaagccagagcctta

SEQ ID NO: 481176 - DNA, 25 bp, Mus musculus
tgagaaccagtatggccagagagcc

SEQ ID NO: 481177 - DNA, 25 bp, Mus musculus
tgagaacccagacccttctgatggc

SEQ ID NO: 481178 - DNA, 25 bp, Mus musculus
tgagaaccctctgggtcgggctgca

SEQ ID NO: 481179 - DNA, 25 bp, Mus musculus
tgagaaccctctgtccgatgagcag

SEQ ID NO: 481180 - DNA, 25 bp, Mus musculus
tgagaaccgtgggaactctagccag

SEQ ID NO: 481181 - DNA, 25 bp, Mus musculus
tgagaacctcgatctccgtggaacg

SEQ ID NO: 481182 - DNA, 25 bp, Mus musculus
tgagaaccttaagtgggctttgccc

SEQ ID NO: 481183 - DNA, 25 bp, Mus musculus
tgagaaccttatgaagccgggcacc

SEQ ID NO: 481184 - DNA, 25 bp, Mus musculus
tgagaaccttttacgccagcatgtg

SEQ ID NO: 481185 - DNA, 25 bp, Mus musculus
tgagaacgacgctgctgaaacggag

SEQ ID NO: 481186 - DNA, 25 bp, Mus musculus
tgagaacgggcatatgttcaactgc

SEQ ID NO: 481187 - DNA, 25 bp, Mus musculus
tgagaactactacagtgccacctgc

SEQ ID NO: 481188 - DNA, 25 bp, Mus musculus
tgagaactataggaccatggcaagc

SEQ ID NO: 481189 - DNA, 25 bp, Mus musculus
tgagaactcaaacgcccgacaagaa

SEQ ID NO: 481190 - DNA, 25 bp, Mus musculus
tgagaactcgcctctgattggacgc

SEQ ID NO: 481191 - DNA, 25 bp, Mus musculus
tgagaactgcagctctggtcagaca

SEQ ID NO: 481192 - DNA, 25 bp, Mus musculus
tgagaacttgcctagggatgcagag

SEQ ID NO: 481193 - DNA, 25 bp, Mus musculus
tgagaactttgcctacagactggag

SEQ ID NO: 481194 - DNA, 25 bp, Mus musculus
tgagaactttgtacaacggcttggc

SEQ ID NO: 481195 - DNA, 25 bp, Mus musculus
tgagaagaaaacagcgagaccacgt

SEQ ID NO: 481196 - DNA, 25 bp, Mus musculus
tgagaagaaacaatccatggagcca

SEQ ID NO: 481197 - DNA, 25 bp, Mus musculus
tgagaagaaagtactgcatgaagca

SEQ ID NO: 481198 - DNA, 25 bp, Mus musculus
tgagaagaaatctccccagggccag

SEQ ID NO: 481199 - DNA, 25 bp, Mus musculus
tgagaagaacttcacagcccgggtg

SEQ ID NO: 481200 - DNA, 25 bp, Mus musculus
tgagaagaccacttcagcccaagtg

SEQ ID NO: 481201 - DNA, 25 bp, Mus musculus
tgagaagaccctcttgctctggctg

SEQ ID NO: 481202 - DNA, 25 bp, Mus musculus
tgagaagactcaaacagcactgccc

SEQ ID NO: 481203 - DNA, 25 bp, Mus musculus
tgagaagaggaattgtcacctgaac

SEQ ID NO: 481204 - DNA, 25 bp, Mus musculus
tgagaagatcctatcccaggaggcc

SEQ ID NO: 481205 - DNA, 25 bp, Mus musculus
tgagaagatcttctgctgccacggg

SEQ ID NO: 481206 - DNA, 25 bp, Mus musculus
tgagaagatggccatgagtcctgcc

SEQ ID NO: 481207 - DNA, 25 bp, Mus musculus
tgagaagcaacaagccttcctcctg

SEQ ID NO: 481208 - DNA, 25 bp, Mus musculus
tgagaagcaatggagacttaacccc

SEQ ID NO: 481209 - DNA, 25 bp, Mus musculus
tgagaagcagctcactcaggtggat

SEQ ID NO: 481210 - DNA, 25 bp, Mus musculus
tgagaagccccaagtttgtgagcgc

SEQ ID NO: 481211 - DNA, 25 bp, Mus musculus
tgagaagccgttgctgtccagtccc

SEQ ID NO: 481212 - DNA, 25 bp, Mus musculus
tgagaagcgccaccttcaagtgaac

SEQ ID NO: 481213 - DNA, 25 bp, Mus musculus
tgagaagctcttgatccaatccctg

SEQ ID NO: 481214 - DNA, 25 bp, Mus musculus
tgagaagctctttgccccggcacct

SEQ ID NO: 481215 - DNA, 25 bp, Mus musculus
tgagaagctggattctgctgcccgc

SEQ ID NO: 481216 - DNA, 25 bp, Mus musculus
tgagaagcttaagagatgccctgtg

SEQ ID NO: 481217 - DNA, 25 bp, Mus musculus
tgagaaggaactggacgtcgatgca

SEQ ID NO: 481218 - DNA, 25 bp, Mus musculus
tgagaaggcccattacagtgaggtg

SEQ ID NO: 481219 - DNA, 25 bp, Mus musculus
tgagaaggccgctgaagtgaacact

SEQ ID NO: 481220 - DNA, 25 bp, Mus musculus
tgagaaggccgtttccacagaacct

SEQ ID NO: 481221 - DNA, 25 bp, Mus musculus
tgagaaggcctggtttcagacacca

SEQ ID NO: 481222 - DNA, 25 bp, Mus musculus
tgagaaggcggctggaactcccgct

SEQ ID NO: 481223 - DNA, 25 bp, Mus musculus
tgagaaggctcagaacagcccaagg

SEQ ID NO: 481224 - DNA, 25 bp, Mus musculus
tgagaagggctacgacaaagacctg

SEQ ID NO: 481225 - DNA, 25 bp, Mus musculus
tgagaaggtcttcatccgaggcact

SEQ ID NO: 481226 - DNA, 25 bp, Mus musculus
tgagaagtacacctctgacagccgc

SEQ ID NO: 481227 - DNA, 25 bp, Mus musculus
tgagaagtcacgttctgacaggact

SEQ ID NO: 481228 - DNA, 25 bp, Mus musculus
tgagaagtcgcagaaaaccagtgga

SEQ ID NO: 481229 - DNA, 25 bp, Mus musculus
tgagaagtgttataccccatggctg

SEQ ID NO: 481230 - DNA, 25 bp, Mus musculus
tgagaataacagtccaggcctacct

SEQ ID NO: 481231 - DNA, 25 bp, Mus musculus
tgagaataccaagctgcggaggacc

SEQ ID NO: 481232 - DNA, 25 bp, Mus musculus
tgagaataccaatgagccgagccgt

SEQ ID NO: 481233 - DNA, 25 bp, Mus musculus
tgagaatagacagaagccctacagc

SEQ ID NO: 481234 - DNA, 25 bp, Mus musculus
tgagaatcaccaagaacagactgtc

SEQ ID NO: 481235 - DNA, 25 bp, Mus musculus
tgagaatcagtctttagagcttagg

SEQ ID NO: 481236 - DNA, 25 bp, Mus musculus
tgagaatcggtggaccatgctgctc

SEQ ID NO: 481237 - DNA, 25 bp, Mus musculus
tgagaatgaaaatcccgagggcgac

SEQ ID NO: 481238 - DNA, 25 bp, Mus musculus
tgagaatgacagtcacagatccctt

SEQ ID NO: 481239 - DNA, 25 bp, Mus musculus
tgagaatgcacaaccctctgaaact

SEQ ID NO: 481240 - DNA, 25 bp, Mus musculus
tgagaatgccctccacaggatgcag

SEQ ID NO: 481241 - DNA, 25 bp, Mus musculus
tgagaatgctgttccccgatgactt

SEQ ID NO: 481242 - DNA, 25 bp, Mus musculus
tgagaatggaaacctgtttgacatc

SEQ ID NO: 481243 - DNA, 25 bp, Mus musculus
tgagaatgtgaatccgagctgcccg

SEQ ID NO: 481244 - DNA, 25 bp, Mus musculus
tgagaattgaaccacgcacagagac

SEQ ID NO: 481245 - DNA, 25 bp, Mus musculus
tgagaatttctgcaactgggaccaa

SEQ ID NO: 481246 - DNA, 25 bp, Mus musculus
tgagacaaatctgacagcaagcaac

SEQ ID NO: 481247 - DNA, 25 bp, Mus musculus
tgagacacacacaagcagtaacgag

SEQ ID NO: 481248 - DNA, 25 bp, Mus musculus
tgagacacagactaactgcagaggc

SEQ ID NO: 481249 - DNA, 25 bp, Mus musculus
tgagacaccatttgcagctggaaat

SEQ ID NO: 481250 - DNA, 25 bp, Mus musculus
tgagacaccggaataccaacgtggg

SEQ ID NO: 481251 - DNA, 25 bp, Mus musculus
tgagacagactatgtgccgctgccc

SEQ ID NO: 481252 - DNA, 25 bp, Mus musculus
tgagacagactattaccgcaagggt

SEQ ID NO: 481253 - DNA, 25 bp, Mus musculus
tgagacagacttgccagtaggacct

SEQ ID NO: 481254 - DNA, 25 bp, Mus musculus
tgagacagagcatccctcgcgtgtt

SEQ ID NO: 481255 - DNA, 25 bp, Mus musculus
tgagacagatagagaccttagcccc

SEQ ID NO: 481256 - DNA, 25 bp, Mus musculus
tgagacagatgtgggaaaccctcag

SEQ ID NO: 481257 - DNA, 25 bp, Mus musculus
tgagacagcacttcaccccgttgta

SEQ ID NO: 481258 - DNA, 25 bp, Mus musculus
tgagacagccccaactggaagcatg

SEQ ID NO: 481259 - DNA, 25 bp, Mus musculus
tgagacagctcacatcgggttggcc

SEQ ID NO: 481260 - DNA, 25 bp, Mus musculus
tgagacatcagatctccaggaactg

SEQ ID NO: 481261 - DNA, 25 bp, Mus musculus
tgagacatctctccgacgactgcta

SEQ ID NO: 481262 - DNA, 25 bp, Mus musculus
tgagacatgtttgtaatcgctggcg

SEQ ID NO: 481263 - DNA, 25 bp, Mus musculus
tgagacattcacgttggactgccct

SEQ ID NO: 481264 - DNA, 25 bp, Mus musculus
tgagacattcgaaaactgtatacct

SEQ ID NO: 481265 - DNA, 25 bp, Mus musculus
tgagaccaagggatttaaagatatg

SEQ ID NO: 481266 - DNA, 25 bp, Mus musculus
tgagaccaattagcaagtgccaggc

SEQ ID NO: 481267 - DNA, 25 bp, Mus musculus
tgagaccacctctctaaggtcaaag

SEQ ID NO: 481268 - DNA, 25 bp, Mus musculus
tgagaccacgtacaccaaggatggg

SEQ ID NO: 481269 - DNA, 25 bp, Mus musculus
tgagaccacgtcgtccctgggagga

SEQ ID NO: 481270 - DNA, 25 bp, Mus musculus
tgagaccactacactgacctccagt

SEQ ID NO: 481271 - DNA, 25 bp, Mus musculus
tgagaccactagaggtcgcactgac

SEQ ID NO: 481272 - DNA, 25 bp, Mus musculus
tgagaccatccaagcccaagtgtga

SEQ ID NO: 481273 - DNA, 25 bp, Mus musculus
tgagaccattttccagcactggcgc

SEQ ID NO: 481274 - DNA, 25 bp, Mus musculus
tgagacccatttttattgctggtac

SEQ ID NO: 481275 - DNA, 25 bp, Mus musculus
tgagacccgccatctgtgacaaagc

SEQ ID NO: 481276 - DNA, 25 bp, Mus musculus
tgagacccgctgaagtgcctcagga

SEQ ID NO: 481277 - DNA, 25 bp, Mus musculus
tgagacccggagagcaattcgccgt

SEQ ID NO: 481278 - DNA, 25 bp, Mus musculus
tgagacccggcactgttacagatga

SEQ ID NO: 481279 - DNA, 25 bp, Mus musculus
tgagacccggttccttcaactgcca

SEQ ID NO: 481280 - DNA, 25 bp, Mus musculus
tgagaccctgtatgaggctccagag

SEQ ID NO: 481281 - DNA, 25 bp, Mus musculus
tgagaccgacatcttaggacagtga

SEQ ID NO: 481282 - DNA, 25 bp, Mus musculus
tgagaccgagtgtgaacaggagccc

SEQ ID NO: 481283 - DNA, 25 bp, Mus musculus
tgagaccgctaggacgcaacctcat

SEQ ID NO: 481284 - DNA, 25 bp, Mus musculus
tgagaccgtcgacgaacgcagagaa

SEQ ID NO: 481285 - DNA, 25 bp, Mus musculus
tgagaccgtgctaggctgctgtgca

SEQ ID NO: 481286 - DNA, 25 bp, Mus musculus
tgagaccgttgactccttggagacc

SEQ ID NO: 481287 - DNA, 25 bp, Mus musculus
tgagacctaacactgagtccgggcg

SEQ ID NO: 481288 - DNA, 25 bp, Mus musculus
tgagacctagcacttccaacatcgt

SEQ ID NO: 481289 - DNA, 25 bp, Mus musculus
tgagacctcgccaagtgatgatgac

SEQ ID NO: 481290 - DNA, 25 bp, Mus musculus
tgagacctcggtgtctactccgggc

SEQ ID NO: 481291 - DNA, 25 bp, Mus musculus
tgagacctggaaactgcactccttg

SEQ ID NO: 481292 - DNA, 25 bp, Mus musculus
tgagacctggagactgccgttttgt

SEQ ID NO: 481293 - DNA, 25 bp, Mus musculus
tgagacctgtgttggcgtagctcct

SEQ ID NO: 481294 - DNA, 25 bp, Mus musculus
tgagaccttgccctccacacaataa

SEQ ID NO: 481295 - DNA, 25 bp, Mus musculus
tgagaccttgccgtgggagaacaca

SEQ ID NO: 481296 - DNA, 25 bp, Mus musculus
tgagacgaaagagatgaagcacaca

SEQ ID NO: 481297 - DNA, 25 bp, Mus musculus
tgagacgaggcagcaaattgtgagc

SEQ ID NO: 481298 - DNA, 25 bp, Mus musculus
tgagacgcgtctggtggcaaagctc

SEQ ID NO: 481299 - DNA, 25 bp, Mus musculus
tgagacggaaagcaaactaagcatc

SEQ ID NO: 481300 - DNA, 25 bp, Mus musculus
tgagacggagtttctgcgcacgctg

SEQ ID NO: 481301 - DNA, 25 bp, Mus musculus
tgagacgttccgtgatgcacagcac

SEQ ID NO: 481302 - DNA, 25 bp, Mus musculus
tgagactacaaatgcgggccactct

SEQ ID NO: 481303 - DNA, 25 bp, Mus musculus
tgagactattcctatcgaatgatag

SEQ ID NO: 481304 - DNA, 25 bp, Mus musculus
tgagactcactagacccggttgaga

SEQ ID NO: 481305 - DNA, 25 bp, Mus musculus
tgagactcataggtcagctaccctg

SEQ ID NO: 481306 - DNA, 25 bp, Mus musculus
tgagactcccacaaggcagtatgct

SEQ ID NO: 481307 - DNA, 25 bp, Mus musculus
tgagactccttccacagctgtgtac

SEQ ID NO: 481308 - DNA, 25 bp, Mus musculus
tgagactcgggctgggtgtgaggaa

SEQ ID NO: 481309 - DNA, 25 bp, Mus musculus
tgagactgagcgtgactggtccgcc

SEQ ID NO: 481310 - DNA, 25 bp, Mus musculus
tgagactggaatcaagcacccttgg

SEQ ID NO: 481311 - DNA, 25 bp, Mus musculus
tgagactggccaataaccccgatat

SEQ ID NO: 481312 - DNA, 25 bp, Mus musculus
tgagactgggccttagacaaacccc

SEQ ID NO: 481313 - DNA, 25 bp, Mus musculus
tgagacttcatcgaaagcaccctgt

SEQ ID NO: 481314 - DNA, 25 bp, Mus musculus
tgagacttccttctccacagcagga

SEQ ID NO: 481315 - DNA, 25 bp, Mus musculus
tgagacttgaaaatacccgaatcct

SEQ ID NO: 481316 - DNA, 25 bp, Mus musculus
tgagacttgagaactgagacaccgt

SEQ ID NO: 481317 - DNA, 25 bp, Mus musculus
tgagactttcaaagcttcagacctg

SEQ ID NO: 481318 - DNA, 25 bp, Mus musculus
tgagactttcccatcgagagcaggc

SEQ ID NO: 481319 - DNA, 25 bp, Mus musculus
tgagagaaatcattggctggcccgg

SEQ ID NO: 481320 - DNA, 25 bp, Mus musculus
tgagagaaatgcgaagagctgcctg

SEQ ID NO: 481321 - DNA, 25 bp, Mus musculus
tgagagaacaccatccttgagtaag

SEQ ID NO: 481322 - DNA, 25 bp, Mus musculus
tgagagaagccaaaacaccgtcacc

SEQ ID NO: 481323 - DNA, 25 bp, Mus musculus
tgagagaagtgtccctcacgagtcg

SEQ ID NO: 481324 - DNA, 25 bp, Mus musculus
tgagagaatgagaatcccatgccct

SEQ ID NO: 481325 - DNA, 25 bp, Mus musculus
tgagagacagttgccggctagacag

SEQ ID NO: 481326 - DNA, 25 bp, Mus musculus
tgagagaccgaccaagaccggagat

SEQ ID NO: 481327 - DNA, 25 bp, Mus musculus
tgagagacctgctggaaatcagtac

SEQ ID NO: 481328 - DNA, 25 bp, Mus musculus
tgagagacgaaccagcgtgaagctc

SEQ ID NO: 481329 - DNA, 25 bp, Mus musculus
tgagagacggtcaagagctgcaagc

SEQ ID NO: 481330 - DNA, 25 bp, Mus musculus
tgagagactcaaagcacccgtgact

SEQ ID NO: 481331 - DNA, 25 bp, Mus musculus
tgagagacttgcaccattgggtcag

SEQ ID NO: 481332 - DNA, 25 bp, Mus musculus
tgagagagaagctaccccttggacc

SEQ ID NO: 481333 - DNA, 25 bp, Mus musculus
tgagagagccagtcttgccaaagct

SEQ ID NO: 481334 - DNA, 25 bp, Mus musculus
tgagagagctctatggaccacatgc

SEQ ID NO: 481335 - DNA, 25 bp, Mus musculus
tgagagaggcaaaagtcattggatc

SEQ ID NO: 481336 - DNA, 25 bp, Mus musculus
tgagagaggtaccaagagagaacat

SEQ ID NO: 481337 - DNA, 25 bp, Mus musculus
tgagagataccgttggaaaagccgc

SEQ ID NO: 481338 - DNA, 25 bp, Mus musculus
tgagagatgcacttccgggagctac

SEQ ID NO: 481339 - DNA, 25 bp, Mus musculus
tgagagatgtggatagaacccggct

SEQ ID NO: 481340 - DNA, 25 bp, Mus musculus
tgagagattacaccaacctgcctga

SEQ ID NO: 481341 - DNA, 25 bp, Mus musculus
tgagagattactgcctccagaggct

SEQ ID NO: 481342 - DNA, 25 bp, Mus musculus
tgagagattctggtgatccctccac

SEQ ID NO: 481343 - DNA, 25 bp, Mus musculus
tgagagcaacattgtccgcactata

SEQ ID NO: 481344 - DNA, 25 bp, Mus musculus
tgagagcaagaaaccccaggctgga

SEQ ID NO: 481345 - DNA, 25 bp, Mus musculus
tgagagcagaggcttgcccgaactc

SEQ ID NO: 481346 - DNA, 25 bp, Mus musculus
tgagagcagggcctataatgtcagc

SEQ ID NO: 481347 - DNA, 25 bp, Mus musculus
tgagagcatgaggagcaaaaacccg

SEQ ID NO: 481348 - DNA, 25 bp, Mus musculus
tgagagccacggttcccaaagctct

SEQ ID NO: 481349 - DNA, 25 bp, Mus musculus
tgagagccagaaggcacagagaagc

SEQ ID NO: 481350 - DNA, 25 bp, Mus musculus
tgagagccaggacaggaggcaaggt

SEQ ID NO: 481351 - DNA, 25 bp, Mus musculus
tgagagcccggactgtcacttttgg

SEQ ID NO: 481352 - DNA, 25 bp, Mus musculus
tgagagccgcacctaactttcagcc

SEQ ID NO: 481353 - DNA, 25 bp, Mus musculus
tgagagccgtcagaacacttgcctt

SEQ ID NO: 481354 - DNA, 25 bp, Mus musculus
tgagagcctgctcgtgccaggctat

SEQ ID NO: 481355 - DNA, 25 bp, Mus musculus
tgagagcgacagctaatgagactgc

SEQ ID NO: 481356 - DNA, 25 bp, Mus musculus
tgagagctcctccagcttgacccat

SEQ ID NO: 481357 - DNA, 25 bp, Mus musculus
tgagagctctcgaaatgagcttttg

SEQ ID NO: 481358 - DNA, 25 bp, Mus musculus
tgagagctcttgtctcggaccctcg

SEQ ID NO: 481359 - DNA, 25 bp, Mus musculus
tgagagctttccaggtcatcgagac

SEQ ID NO: 481360 - DNA, 25 bp, Mus musculus
tgagagctttcgttttcctttcagt

SEQ ID NO: 481361 - DNA, 25 bp, Mus musculus
tgagaggaaccggaaaacagcgacc

SEQ ID NO: 481362 - DNA, 25 bp, Mus musculus
tgagaggaactttagagaggagacc

SEQ ID NO: 481363 - DNA, 25 bp, Mus musculus
tgagaggaatccaagtaagttcttc

SEQ ID NO: 481364 - DNA, 25 bp, Mus musculus
tgagaggacgctagccttcactcca

SEQ ID NO: 481365 - DNA, 25 bp, Mus musculus
tgagaggactctatccagataaacc

SEQ ID NO: 481366 - DNA, 25 bp, Mus musculus
tgagaggagaccacaagcactggtg

SEQ ID NO: 481367 - DNA, 25 bp, Mus musculus
tgagaggcatcagccaactttgtgc

SEQ ID NO: 481368 - DNA, 25 bp, Mus musculus
tgagaggcccgtggaaagaagaaac

SEQ ID NO: 481369 - DNA, 25 bp, Mus musculus
tgagaggctccatcaccagaggtgc

SEQ ID NO: 481370 - DNA, 25 bp, Mus musculus
tgagaggctcttttaaaaccacagc

SEQ ID NO: 481371 - DNA, 25 bp, Mus musculus
tgagaggcttccttgcacaggctcg

SEQ ID NO: 481372 - DNA, 25 bp, Mus musculus
tgagagggtcgttccatactccacc

SEQ ID NO: 481373 - DNA, 25 bp, Mus musculus
tgagagggttggtcttctgaagttt

SEQ ID NO: 481374 - DNA, 25 bp, Mus musculus
tgagagggtttccagtctgctgacc

SEQ ID NO: 481375 - DNA, 25 bp, Mus musculus
tgagaggtacccagctctaaggaac

SEQ ID NO: 481376 - DNA, 25 bp, Mus musculus
tgagaggttccggaaacaccttcgg

SEQ ID NO: 481377 - DNA, 25 bp, Mus musculus
tgagagtcactcttgtccactggac

SEQ ID NO: 481378 - DNA, 25 bp, Mus musculus
tgagagtcctccagagaactcgagt

SEQ ID NO: 481379 - DNA, 25 bp, Mus musculus
tgagagtcttgtctttcaaagcagc

SEQ ID NO: 481380 - DNA, 25 bp, Mus musculus
tgagagtgaagggtggtccaacacc

SEQ ID NO: 481381 - DNA, 25 bp, Mus musculus
tgagagtgagggttttgttaagccc

SEQ ID NO: 481382 - DNA, 25 bp, Mus musculus
tgagagtgatctctgctcacacggc

SEQ ID NO: 481383 - DNA, 25 bp, Mus musculus
tgagagtgcacagcactgacttgcc

SEQ ID NO: 481384 - DNA, 25 bp, Mus musculus
tgagagtgcagaggagcaaccatcc

SEQ ID NO: 481385 - DNA, 25 bp, Mus musculus
tgagagttgactaccaccttttgct

SEQ ID NO: 481386 - DNA, 25 bp, Mus musculus
tgagagttttcagtgggcaacatcc

SEQ ID NO: 481387 - DNA, 25 bp, Mus musculus
tgagagttttcatcgaccacggcaa

SEQ ID NO: 481388 - DNA, 25 bp, Mus musculus
tgagataacagtgctcagacagcgg

SEQ ID NO: 481389 - DNA, 25 bp, Mus musculus
tgagatacaggatgcacgagacggc

SEQ ID NO: 481390 - DNA, 25 bp, Mus musculus
tgagatacggcagcatccacttggt

SEQ ID NO: 481391 - DNA, 25 bp, Mus musculus
tgagatactggttttactcctgtct

SEQ ID NO: 481392 - DNA, 25 bp, Mus musculus
tgagatagaccgaatgaccctgacc

SEQ ID NO: 481393 - DNA, 25 bp, Mus musculus
tgagataggcttcatctgcccagcc

SEQ ID NO: 481394 - DNA, 25 bp, Mus musculus
tgagatagggctgggaccaatagct

SEQ ID NO: 481395 - DNA, 25 bp, Mus musculus
tgagatatcaaatactgaaacgaag

SEQ ID NO: 481396 - DNA, 25 bp, Mus musculus
tgagatatcactggctcggcagatc

SEQ ID NO: 481397 - DNA, 25 bp, Mus musculus
tgagatatctctctgcgacctgtgc

SEQ ID NO: 481398 - DNA, 25 bp, Mus musculus
tgagatatgcaagagacacacagga

SEQ ID NO: 481399 - DNA, 25 bp, Mus musculus
tgagatattctcttgacagttgtgt

SEQ ID NO: 481400 - DNA, 25 bp, Mus musculus
tgagatcaaaaagaacgccaggcgc

SEQ ID NO: 481401 - DNA, 25 bp, Mus musculus
tgagatcaaaaagacagaggtgctg

SEQ ID NO: 481402 - DNA, 25 bp, Mus musculus
tgagatcaagatgtaggcaccctgg

SEQ ID NO: 481403 - DNA, 25 bp, Mus musculus
tgagatcacagctagtttccgtcgc

SEQ ID NO: 481404 - DNA, 25 bp, Mus musculus
tgagatcatgcagagagcctcacgc

SEQ ID NO: 481405 - DNA, 25 bp, Mus musculus
tgagatcattaactacattgtgtgc

SEQ ID NO: 481406 - DNA, 25 bp, Mus musculus
tgagatccagctgtctgcgggctgt

SEQ ID NO: 481407 - DNA, 25 bp, Mus musculus
tgagatccccatgtagcaattgcca

SEQ ID NO: 481408 - DNA, 25 bp, Mus musculus
tgagatccctagtcactcccaagca

SEQ ID NO: 481409 - DNA, 25 bp, Mus musculus
tgagatccgggacaacttcatcaag

SEQ ID NO: 481410 - DNA, 25 bp, Mus musculus
tgagatcctgatgccagggtaagct

SEQ ID NO: 481411 - DNA, 25 bp, Mus musculus
tgagatcgagaccagacacagtgag

SEQ ID NO: 481412 - DNA, 25 bp, Mus musculus
tgagatcgccatggaactgaaccgc

SEQ ID NO: 481413 - DNA, 25 bp, Mus musculus
tgagatcggcaacaccattgagcgg

SEQ ID NO: 481414 - DNA, 25 bp, Mus musculus
tgagatctaccagttcctacaggcg

SEQ ID NO: 481415 - DNA, 25 bp, Mus musculus
tgagatctacgaagggaccagcgaa

SEQ ID NO: 481416 - DNA, 25 bp, Mus musculus
tgagatctactccatgcacgtgctg

SEQ ID NO: 481417 - DNA, 25 bp, Mus musculus
tgagatctcggaactcacccaggaa

SEQ ID NO: 481418 - DNA, 25 bp, Mus musculus
tgagatcttttgaccacccgggaaa

SEQ ID NO: 481419 - DNA, 25 bp, Mus musculus
tgagatgaacaggaaggtcacagcc

SEQ ID NO: 481420 - DNA, 25 bp, Mus musculus
tgagatgaagctgttgaccgagctt

SEQ ID NO: 481421 - DNA, 25 bp, Mus musculus
tgagatgacatccacttgggtctac

SEQ ID NO: 481422 - DNA, 25 bp, Mus musculus
tgagatgagaggaatggaatacccc

SEQ ID NO: 481423 - DNA, 25 bp, Mus musculus
tgagatgatgaccaccgagccagtg

SEQ ID NO: 481424 - DNA, 25 bp, Mus musculus
tgagatgatgctgacaccctttggg

SEQ ID NO: 481425 - DNA, 25 bp, Mus musculus
tgagatgcacgaccacgtgaaaggc

SEQ ID NO: 481426 - DNA, 25 bp, Mus musculus
tgagatgcagaacctggaacctggc

SEQ ID NO: 481427 - DNA, 25 bp, Mus musculus
tgagatgctgagaaacccaggagaa

SEQ ID NO: 481428 - DNA, 25 bp, Mus musculus
tgagatgctttttctgccaccgcca

SEQ ID NO: 481429 - DNA, 25 bp, Mus musculus
tgagatggaataaagagcgtaggcc

SEQ ID NO: 481430 - DNA, 25 bp, Mus musculus
tgagatggagtctcgcactgtcatc

SEQ ID NO: 481431 - DNA, 25 bp, Mus musculus
tgagatggcaccagcaagtcagggc

SEQ ID NO: 481432 - DNA, 25 bp, Mus musculus
tgagatggcaggatccagcctagaa

SEQ ID NO: 481433 - DNA, 25 bp, Mus musculus
tgagatggcgtggaccagttgcctc

SEQ ID NO: 481434 - DNA, 25 bp, Mus musculus
tgagatgggatagaagcaaaatacc

SEQ ID NO: 481435 - DNA, 25 bp, Mus musculus
tgagatggtcaaaggaggccacacc

SEQ ID NO: 481436 - DNA, 25 bp, Mus musculus
tgagatggtgttcacagcccgtcgc

SEQ ID NO: 481437 - DNA, 25 bp, Mus musculus
tgagatgtcactctagcagggcctt

SEQ ID NO: 481438 - DNA, 25 bp, Mus musculus
tgagatgtgaatcatttaacaaaac

SEQ ID NO: 481439 - DNA, 25 bp, Mus musculus
tgagatgtgcaacgtggtattccca

SEQ ID NO: 481440 - DNA, 25 bp, Mus musculus
tgagatgtgccaccttcagaggatc

SEQ ID NO: 481441 - DNA, 25 bp, Mus musculus
tgagatgttctatccagagcacaga

SEQ ID NO: 481442 - DNA, 25 bp, Mus musculus
tgagattaaatcagatcaggcccgg

SEQ ID NO: 481443 - DNA, 25 bp, Mus musculus
tgagattcagggaacagaccccgtg

SEQ ID NO: 481444 - DNA, 25 bp, Mus musculus
tgagattccaactatgccaccaagc

SEQ ID NO: 481445 - DNA, 25 bp, Mus musculus
tgagattcccgattgcccatgtaca

SEQ ID NO: 481446 - DNA, 25 bp, Mus musculus
tgagattccctgtcaccactaggag

SEQ ID NO: 481447 - DNA, 25 bp, Mus musculus
tgagattggaggaaagacggccttc

SEQ ID NO: 481448 - DNA, 25 bp, Mus musculus
tgagattgtgcgaaagaagcccatc

SEQ ID NO: 481449 - DNA, 25 bp, Mus musculus
tgagatttcccactgcagcaatagc

SEQ ID NO: 481450 - DNA, 25 bp, Mus musculus
tgagatttctaaggccactgctggg

SEQ ID NO: 481451 - DNA, 25 bp, Mus musculus
tgagatttgactgcaggtccctgag

SEQ ID NO: 481452 - DNA, 25 bp, Mus musculus
tgagatttgagacgaagtttcccca

SEQ ID NO: 481453 - DNA, 25 bp, Mus musculus
tgagatttgattgttccacatcatg

SEQ ID NO: 481454 - DNA, 25 bp, Mus musculus
tgagattttccagggacccaacggg

SEQ ID NO: 481455 - DNA, 25 bp, Mus musculus
tgagcaaaaaccaccacacaagcat

SEQ ID NO: 481456 - DNA, 25 bp, Mus musculus
tgagcaaacacgcagtaaaactcca

SEQ ID NO: 481457 - DNA, 25 bp, Mus musculus
tgagcaaacataccttctgggagcc

SEQ ID NO: 481458 - DNA, 25 bp, Mus musculus
tgagcaaacgaaagctggagcgcgt

SEQ ID NO: 481459 - DNA, 25 bp, Mus musculus
tgagcaaagtcggatcaagcagcca

SEQ ID NO: 481460 - DNA, 25 bp, Mus musculus
tgagcaaatgagatccaaaagtgag

SEQ ID NO: 481461 - DNA, 25 bp, Mus musculus
tgagcaacccaggaatgagtgagcc

SEQ ID NO: 481462 - DNA, 25 bp, Mus musculus
tgagcaaccgctcaggagccatgga

SEQ ID NO: 481463 - DNA, 25 bp, Mus musculus
tgagcaacctgctactccagaacac

SEQ ID NO: 481464 - DNA, 25 bp, Mus musculus
tgagcaacctgctattggcactggg

SEQ ID NO: 481465 - DNA, 25 bp, Mus musculus
tgagcaacgccgaagacaatggcag

SEQ ID NO: 481466 - DNA, 25 bp, Mus musculus
tgagcaacgcttatgcccgggaaga

SEQ ID NO: 481467 - DNA, 25 bp, Mus musculus
tgagcaacgttccaatccctgaggc

SEQ ID NO: 481468 - DNA, 25 bp, Mus musculus
tgagcaagagctctggaaaccacct

SEQ ID NO: 481469 - DNA, 25 bp, Mus musculus
tgagcaagatgaactgtcccagaga

SEQ ID NO: 481470 - DNA, 25 bp, Mus musculus
tgagcaagcaaacatcacatagagt

SEQ ID NO: 481471 - DNA, 25 bp, Mus musculus
tgagcaagcccccagttgaatgcat

SEQ ID NO: 481472 - DNA, 25 bp, Mus musculus
tgagcaagctaaccacacctttgtg

SEQ ID NO: 481473 - DNA, 25 bp, Mus musculus
tgagcaagggcatcctggtgcaaac

SEQ ID NO: 481474 - DNA, 25 bp, Mus musculus
tgagcaagggccaaaactcctgggc

SEQ ID NO: 481475 - DNA, 25 bp, Mus musculus
tgagcaagtctctgccaagcgcaag

SEQ ID NO: 481476 - DNA, 25 bp, Mus musculus
tgagcaagtgctaccagtaccgatc

SEQ ID NO: 481477 - DNA, 25 bp, Mus musculus
tgagcaatcaagtcctccttcgata

SEQ ID NO: 481478 - DNA, 25 bp, Mus musculus
tgagcaatgacagccacacatgggt

SEQ ID NO: 481479 - DNA, 25 bp, Mus musculus
tgagcaatgcaagacacagatggga

SEQ ID NO: 481480 - DNA, 25 bp, Mus musculus
tgagcacaacaggtactgcgttcgc

SEQ ID NO: 481481 - DNA, 25 bp, Mus musculus
tgagcacagaaagcatgatccgcga

SEQ ID NO: 481482 - DNA, 25 bp, Mus musculus
tgagcacatgcaaggacagactaac

SEQ ID NO: 481483 - DNA, 25 bp, Mus musculus
tgagcaccatcaggcacttgcagga

SEQ ID NO: 481484 - DNA, 25 bp, Mus musculus
tgagcacccgggaagttctttctgg

SEQ ID NO: 481485 - DNA, 25 bp, Mus musculus
tgagcacccttgatgtctcagcaga

SEQ ID NO: 481486 - DNA, 25 bp, Mus musculus
tgagcaccgaactggcccttttagg

SEQ ID NO: 481487 - DNA, 25 bp, Mus musculus
tgagcacctctaggaagcaaggacg

SEQ ID NO: 481488 - DNA, 25 bp, Mus musculus
tgagcacggctcatggatgatactc

SEQ ID NO: 481489 - DNA, 25 bp, Mus musculus
tgagcacgtgctcgcctactattgg

SEQ ID NO: 481490 - DNA, 25 bp, Mus musculus
tgagcacgttctacacgcagctggt

SEQ ID NO: 481491 - DNA, 25 bp, Mus musculus
tgagcactagcaccagtctctgagt

SEQ ID NO: 481492 - DNA, 25 bp, Mus musculus
tgagcactcaggtgggtccattctg

SEQ ID NO: 481493 - DNA, 25 bp, Mus musculus
tgagcactgagagccactttcaggt

SEQ ID NO: 481494 - DNA, 25 bp, Mus musculus
tgagcactgtcaagccttgccgcgg

SEQ ID NO: 481495 - DNA, 25 bp, Mus musculus
tgagcactttgctactgagcccctg

SEQ ID NO: 481496 - DNA, 25 bp, Mus musculus
tgagcagaaaggagggcaatagatt

SEQ ID NO: 481497 - DNA, 25 bp, Mus musculus
tgagcagacccaccaggacagtttt

SEQ ID NO: 481498 - DNA, 25 bp, Mus musculus
tgagcagacccttctttgagcagac

SEQ ID NO: 481499 - DNA, 25 bp, Mus musculus
tgagcagacgttgcgagtcacaggc

SEQ ID NO: 481500 - DNA, 25 bp, Mus musculus
tgagcagagcagtcctattgttttg

SEQ ID NO: 481501 - DNA, 25 bp, Mus musculus
tgagcagatcctcacccagagagcg

SEQ ID NO: 481502 - DNA, 25 bp, Mus musculus
tgagcagatgacactgaagggtttc

SEQ ID NO: 481503 - DNA, 25 bp, Mus musculus
tgagcagcacaaattgcacaattgt

SEQ ID NO: 481504 - DNA, 25 bp, Mus musculus
tgagcagcaggtgcattctgcctcc

SEQ ID NO: 481505 - DNA, 25 bp, Mus musculus
tgagcagcatttcaccaaaaccttg

SEQ ID NO: 481506 - DNA, 25 bp, Mus musculus
tgagcagccctacacaaagatgaca

SEQ ID NO: 481507 - DNA, 25 bp, Mus musculus
tgagcagccgttcaccatcgaatgg

SEQ ID NO: 481508 - DNA, 25 bp, Mus musculus
tgagcagcgataggatcagcagttc

SEQ ID NO: 481509 - DNA, 25 bp, Mus musculus
tgagcagctccttcaagcgtggttc

SEQ ID NO: 481510 - DNA, 25 bp, Mus musculus
tgagcagctctatcactcgttgaag

SEQ ID NO: 481511 - DNA, 25 bp, Mus musculus
tgagcagctctgtcagcatgaacac

SEQ ID NO: 481512 - DNA, 25 bp, Mus musculus
tgagcaggacatatctgagttccct

SEQ ID NO: 481513 - DNA, 25 bp, Mus musculus
tgagcaggatgcgttcacggtgcac

SEQ ID NO: 481514 - DNA, 25 bp, Mus musculus
tgagcaggccaaagtccattcctgg

SEQ ID NO: 481515 - DNA, 25 bp, Mus musculus
tgagcaggcccacagtatcctggag

SEQ ID NO: 481516 - DNA, 25 bp, Mus musculus
tgagcagggactgtttcctacccac

SEQ ID NO: 481517 - DNA, 25 bp, Mus musculus
tgagcagggccaacctcagcataga

SEQ ID NO: 481518 - DNA, 25 bp, Mus musculus
tgagcagggctccaggtttccaaac

SEQ ID NO: 481519 - DNA, 25 bp, Mus musculus
tgagcaggtcatgattgcagcccta

SEQ ID NO: 481520 - DNA, 25 bp, Mus musculus
tgagcagtctctctactaccggcag

SEQ ID NO: 481521 - DNA, 25 bp, Mus musculus
tgagcagtctgatgcacacagggaa

SEQ ID NO: 481522 - DNA, 25 bp, Mus musculus
tgagcagtgctttgatcttggatgc

SEQ ID NO: 481523 - DNA, 25 bp, Mus musculus
tgagcagtgtctcccgagtgtatga

SEQ ID NO: 481524 - DNA, 25 bp, Mus musculus
tgagcagtgtgcatcccaggtcatg

SEQ ID NO: 481525 - DNA, 25 bp, Mus musculus
tgagcagtgtttccacagagccaga

SEQ ID NO: 481526 - DNA, 25 bp, Mus musculus
tgagcagttcacctgagcagagcgc

SEQ ID NO: 481527 - DNA, 25 bp, Mus musculus
tgagcagtttccaggtatcgagccg

SEQ ID NO: 481528 - DNA, 25 bp, Mus musculus
tgagcataatgaaaccacggtctcg

SEQ ID NO: 481529 - DNA, 25 bp, Mus musculus
tgagcatagccggttcaattcgcgg

SEQ ID NO: 481530 - DNA, 25 bp, Mus musculus
tgagcatattctctgccactgctgt

SEQ ID NO: 481531 - DNA, 25 bp, Mus musculus
tgagcatcaagaaagtcaccccgga

SEQ ID NO: 481532 - DNA, 25 bp, Mus musculus
tgagcatcaccaacatgaccacctc

SEQ ID NO: 481533 - DNA, 25 bp, Mus musculus
tgagcatcctcactgtcattagcac

SEQ ID NO: 481534 - DNA, 25 bp, Mus musculus
tgagcatcgatcagctgcaagcctt

SEQ ID NO: 481535 - DNA, 25 bp, Mus musculus
tgagcatcggctttctccacaaagg

SEQ ID NO: 481536 - DNA, 25 bp, Mus musculus
tgagcatgcctaacaggatacaact

SEQ ID NO: 481537 - DNA, 25 bp, Mus musculus
tgagcatgctcctggaaacctggaa

SEQ ID NO: 481538 - DNA, 25 bp, Mus musculus
tgagcatggagatcaagcttcgcct

SEQ ID NO: 481539 - DNA, 25 bp, Mus musculus
tgagcatgtgacacacgggcgacac

SEQ ID NO: 481540 - DNA, 25 bp, Mus musculus
tgagcatgtgggactgtacagccgc

SEQ ID NO: 481541 - DNA, 25 bp, Mus musculus
tgagcattaacccagacagcacttg

SEQ ID NO: 481542 - DNA, 25 bp, Mus musculus
tgagcattgcgactgtcttcagggc

SEQ ID NO: 481543 - DNA, 25 bp, Mus musculus
tgagcattggcttgcagcattgccg

SEQ ID NO: 481544 - DNA, 25 bp, Mus musculus
tgagcattgtaacgcagagtgcacg

SEQ ID NO: 481545 - DNA, 25 bp, Mus musculus
tgagcatttcatagaaggcagggag

SEQ ID NO: 481546 - DNA, 25 bp, Mus musculus
tgagccaaaatagggagaagacctc

SEQ ID NO: 481547 - DNA, 25 bp, Mus musculus
tgagccaaagataagagcagccggg

SEQ ID NO: 481548 - DNA, 25 bp, Mus musculus
tgagccaagctacccagctcagatg

SEQ ID NO: 481549 - DNA, 25 bp, Mus musculus
tgagccacaagttggcccccgtggt

SEQ ID NO: 481550 - DNA, 25 bp, Mus musculus
tgagccactgcccatatatggaggg

SEQ ID NO: 481551 - DNA, 25 bp, Mus musculus
tgagccacttgatacaggtgtcctt

SEQ ID NO: 481552 - DNA, 25 bp, Mus musculus
tgagccacttggatcacatgaaatc

SEQ ID NO: 481553 - DNA, 25 bp, Mus musculus
tgagccagagatccagcttcaccct

SEQ ID NO: 481554 - DNA, 25 bp, Mus musculus
tgagccagcacatccacataagttg

SEQ ID NO: 481555 - DNA, 25 bp, Mus musculus
tgagccagccttcgcgtatgcatgt

SEQ ID NO: 481556 - DNA, 25 bp, Mus musculus
tgagccaggcacacagctatatgac

SEQ ID NO: 481557 - DNA, 25 bp, Mus musculus
tgagccaggcactcacgagttcggt

SEQ ID NO: 481558 - DNA, 25 bp, Mus musculus
tgagccagggtcattatacagaaat

SEQ ID NO: 481559 - DNA, 25 bp, Mus musculus
tgagccagtgggtgttttacttcct

SEQ ID NO: 481560 - DNA, 25 bp, Mus musculus
tgagccagttacaggtgaagacgtg

SEQ ID NO: 481561 - DNA, 25 bp, Mus musculus
tgagccataattgctgcttctgaac

SEQ ID NO: 481562 - DNA, 25 bp, Mus musculus
tgagccatgcctaggtacacagtgc

SEQ ID NO: 481563 - DNA, 25 bp, Mus musculus
tgagccatggtgcacagcagagcat

SEQ ID NO: 481564 - DNA, 25 bp, Mus musculus
tgagccatggtgcacttcactgtga

SEQ ID NO: 481565 - DNA, 25 bp, Mus musculus
tgagccattacagtggcccgctggc

SEQ ID NO: 481566 - DNA, 25 bp, Mus musculus
tgagcccaagaaaagtgctgattgt

SEQ ID NO: 481567 - DNA, 25 bp, Mus musculus
tgagcccaaggacattgtgacactg

SEQ ID NO: 481568 - DNA, 25 bp, Mus musculus
tgagcccagagaaggtgcacaggcc

SEQ ID NO: 481569 - DNA, 25 bp, Mus musculus
tgagcccagatctgttaacatcccg

SEQ ID NO: 481570 - DNA, 25 bp, Mus musculus
tgagcccagccctatagaaagcaag

SEQ ID NO: 481571 - DNA, 25 bp, Mus musculus
tgagcccagtgaggaatgccaagtc

SEQ ID NO: 481572 - DNA, 25 bp, Mus musculus
tgagcccagtggaaccctaacttca

SEQ ID NO: 481573 - DNA, 25 bp, Mus musculus
tgagcccagtgggaagtagcctccg

SEQ ID NO: 481574 - DNA, 25 bp, Mus musculus
tgagcccagtggtgggtacacccgt

SEQ ID NO: 481575 - DNA, 25 bp, Mus musculus
tgagcccatatgacttgacgcagaa

SEQ ID NO: 481576 - DNA, 25 bp, Mus musculus
tgagccccaagcatcgagatgacgg

SEQ ID NO: 481577 - DNA, 25 bp, Mus musculus
tgagccccaagtactcggagcagta

SEQ ID NO: 481578 - DNA, 25 bp, Mus musculus
tgagccccagtccttcattcgcaga

SEQ ID NO: 481579 - DNA, 25 bp, Mus musculus
tgagccccgtcgtcgcgggcgtttc

SEQ ID NO: 481580 - DNA, 25 bp, Mus musculus
tgagcccctgtgagcagacagatag

SEQ ID NO: 481581 - DNA, 25 bp, Mus musculus
tgagcccgacgcagacatagacgtg

SEQ ID NO: 481582 - DNA, 25 bp, Mus musculus
tgagccctgactgccagcgatagac

SEQ ID NO: 481583 - DNA, 25 bp, Mus musculus
tgagccctgggaaaaatgacctgtg

SEQ ID NO: 481584 - DNA, 25 bp, Mus musculus
tgagccctggtaccactgtgcgaga

SEQ ID NO: 481585 - DNA, 25 bp, Mus musculus
tgagcccttgagtttagccccaaat

SEQ ID NO: 481586 - DNA, 25 bp, Mus musculus
tgagccgaccttgagggctgtccgc

SEQ ID NO: 481587 - DNA, 25 bp, Mus musculus
tgagccgagaatggaaatacagcct

SEQ ID NO: 481588 - DNA, 25 bp, Mus musculus
tgagccgcacaacctacagtctgca

SEQ ID NO: 481589 - DNA, 25 bp, Mus musculus
tgagccgcagctctttgaacctgga

SEQ ID NO: 481590 - DNA, 25 bp, Mus musculus
tgagccgcaggtctgtggatccatc

SEQ ID NO: 481591 - DNA, 25 bp, Mus musculus
tgagccgcttcatgtgtggaggaaa

SEQ ID NO: 481592 - DNA, 25 bp, Mus musculus
tgagccggactaatccaaacagcgg

SEQ ID NO: 481593 - DNA, 25 bp, Mus musculus
tgagcctaggagtgaagacagccag

SEQ ID NO: 481594 - DNA, 25 bp, Mus musculus
tgagcctcgagttgtcactgccatg

SEQ ID NO: 481595 - DNA, 25 bp, Mus musculus
tgagcctctgagcaaagctgtctgc

SEQ ID NO: 481596 - DNA, 25 bp, Mus musculus
tgagcctctgatggaaccagaaggg

SEQ ID NO: 481597 - DNA, 25 bp, Mus musculus
tgagcctcttcctgcgaaagcgatg

SEQ ID NO: 481598 - DNA, 25 bp, Mus musculus
tgagcctgagttgcagacttcagca

SEQ ID NO: 481599 - DNA, 25 bp, Mus musculus
tgagcctggctcacatatgatttct

SEQ ID NO: 481600 - DNA, 25 bp, Mus musculus
tgagcctgggcactccaattatgaa

SEQ ID NO: 481601 - DNA, 25 bp, Mus musculus
tgagcctgggtgcatgccttgttaa

SEQ ID NO: 481602 - DNA, 25 bp, Mus musculus
tgagcctggtaagaatggaccagct

SEQ ID NO: 481603 - DNA, 25 bp, Mus musculus
tgagcctggtgtgaacactgatgtg

SEQ ID NO: 481604 - DNA, 25 bp, Mus musculus
tgagcctgtctagtgctgtggccgc

SEQ ID NO: 481605 - DNA, 25 bp, Mus musculus
tgagccttacccctatggagtggaa

SEQ ID NO: 481606 - DNA, 25 bp, Mus musculus
tgagccttcctaagcctctactgac

SEQ ID NO: 481607 - DNA, 25 bp, Mus musculus
tgagccttcctttcaaaagttggtg

SEQ ID NO: 481608 - DNA, 25 bp, Mus musculus
tgagccttcgcagaacaagatgagc

SEQ ID NO: 481609 - DNA, 25 bp, Mus musculus
tgagccttcggtttcacaactatga

SEQ ID NO: 481610 - DNA, 25 bp, Mus musculus
tgagccttgacacactctctagtgc

SEQ ID NO: 481611 - DNA, 25 bp, Mus musculus
tgagccttggccttaacccagtgca

SEQ ID NO: 481612 - DNA, 25 bp, Mus musculus
tgagcctttagagtcgcaccttggg

SEQ ID NO: 481613 - DNA, 25 bp, Mus musculus
tgagcgaaccagaccagagcattaa

SEQ ID NO: 481614 - DNA, 25 bp, Mus musculus
tgagcgacacgcctgattagtccat

SEQ ID NO: 481615 - DNA, 25 bp, Mus musculus
tgagcgacagaatagaccgagagtt

SEQ ID NO: 481616 - DNA, 25 bp, Mus musculus
tgagcgagaacgacacccattgtgt

SEQ ID NO: 481617 - DNA, 25 bp, Mus musculus
tgagcgagcctcagacaagtcgaag

SEQ ID NO: 481618 - DNA, 25 bp, Mus musculus
tgagcgaggcagagtgcactgccat

SEQ ID NO: 481619 - DNA, 25 bp, Mus musculus
tgagcgaggctctgcagatccttgg

SEQ ID NO: 481620 - DNA, 25 bp, Mus musculus
tgagcgagtgcggactttgacccag

SEQ ID NO: 481621 - DNA, 25 bp, Mus musculus
tgagcgcaaagttgcacctggcggc

SEQ ID NO: 481622 - DNA, 25 bp, Mus musculus
tgagcgcaatcctatcggagctgtg

SEQ ID NO: 481623 - DNA, 25 bp, Mus musculus
tgagcgcagacctaacacgaaaagc

SEQ ID NO: 481624 - DNA, 25 bp, Mus musculus
tgagcgcagcgaaaggaagcaagct

SEQ ID NO: 481625 - DNA, 25 bp, Mus musculus
tgagcgccgcgatgacattgacaag

SEQ ID NO: 481626 - DNA, 25 bp, Mus musculus
tgagcgcctggctactgttgaagca

SEQ ID NO: 481627 - DNA, 25 bp, Mus musculus
tgagcgcgtgctgctctttgatgac

SEQ ID NO: 481628 - DNA, 25 bp, Mus musculus
tgagcgctccactatgagaagccgg

SEQ ID NO: 481629 - DNA, 25 bp, Mus musculus
tgagcgctgcggttcactttgagaa

SEQ ID NO: 481630 - DNA, 25 bp, Mus musculus
tgagcggctccttcgatcgcaagct

SEQ ID NO: 481631 - DNA, 25 bp, Mus musculus
tgagcgggaaaaagccagtgtagct

SEQ ID NO: 481632 - DNA, 25 bp, Mus musculus
tgagcgggacgcaaaggcatattga

SEQ ID NO: 481633 - DNA, 25 bp, Mus musculus
tgagcgggctgtgcattctgacgtc

SEQ ID NO: 481634 - DNA, 25 bp, Mus musculus
tgagcggtgtgtgccctacaaatag

SEQ ID NO: 481635 - DNA, 25 bp, Mus musculus
tgagcgtcaggcagaatcttcacaa

SEQ ID NO: 481636 - DNA, 25 bp, Mus musculus
tgagcgtcccactaaggcctggaga

SEQ ID NO: 481637 - DNA, 25 bp, Mus musculus
tgagcgtccgcttatggaaggtccc

SEQ ID NO: 481638 - DNA, 25 bp, Mus musculus
tgagcgtcctggtcacttcttggag

SEQ ID NO: 481639 - DNA, 25 bp, Mus musculus
tgagcgtctagagattaacgactcg

SEQ ID NO: 481640 - DNA, 25 bp, Mus musculus
tgagctaaggatcccagcaggagat

SEQ ID NO: 481641 - DNA, 25 bp, Mus musculus
tgagctaagttaggcagagactgca

SEQ ID NO: 481642 - DNA, 25 bp, Mus musculus
tgagctaattatgggcgaggacccc

SEQ ID NO: 481643 - DNA, 25 bp, Mus musculus
tgagctacaatcctattgactgagc

SEQ ID NO: 481644 - DNA, 25 bp, Mus musculus
tgagctacaggcatccaaaaggaga

SEQ ID NO: 481645 - DNA, 25 bp, Mus musculus
tgagctaccacagttgcaggccctg

SEQ ID NO: 481646 - DNA, 25 bp, Mus musculus
tgagctacctgagagttgactacca

SEQ ID NO: 481647 - DNA, 25 bp, Mus musculus
tgagctactgctaggaacctgaggg

SEQ ID NO: 481648 - DNA, 25 bp, Mus musculus
tgagctagaaaagtggcaactcccc

SEQ ID NO: 481649 - DNA, 25 bp, Mus musculus
tgagctagccatggcgttccctggc

SEQ ID NO: 481650 - DNA, 25 bp, Mus musculus
tgagctagtacacaaggagacggca

SEQ ID NO: 481651 - DNA, 25 bp, Mus musculus
tgagctatatttaccccatccctct

SEQ ID NO: 481652 - DNA, 25 bp, Mus musculus
tgagctatcagtagcacctattggt

SEQ ID NO: 481653 - DNA, 25 bp, Mus musculus
tgagctatgaggtcatcgcaggcct

SEQ ID NO: 481654 - DNA, 25 bp, Mus musculus
tgagctatgcccgtggtcctcaggg

SEQ ID NO: 481655 - DNA, 25 bp, Mus musculus
tgagctatgctcttgggaccagcgg

SEQ ID NO: 481656 - DNA, 25 bp, Mus musculus
tgagctatggcagccagcgcagagt

SEQ ID NO: 481657 - DNA, 25 bp, Mus musculus
tgagctatgtcaccaacctgggcct

SEQ ID NO: 481658 - DNA, 25 bp, Mus musculus
tgagctcaaatcgtacaagtgtctg

SEQ ID NO: 481659 - DNA, 25 bp, Mus musculus
tgagctcaactgcacactctgtgtg

SEQ ID NO: 481660 - DNA, 25 bp, Mus musculus
tgagctcaatctggagtgccggcat

SEQ ID NO: 481661 - DNA, 25 bp, Mus musculus
tgagctcacagcattcccagggtga

SEQ ID NO: 481662 - DNA, 25 bp, Mus musculus
tgagctcaccaaagatgcacagccc

SEQ ID NO: 481663 - DNA, 25 bp, Mus musculus
tgagctcaccttcaagaccgcagat

SEQ ID NO: 481664 - DNA, 25 bp, Mus musculus
tgagctcactgtaatggtgttgaag

SEQ ID NO: 481665 - DNA, 25 bp, Mus musculus
tgagctcaggcactgtccgctatgc

SEQ ID NO: 481666 - DNA, 25 bp, Mus musculus
tgagctcagggctaccaagttgcct

SEQ ID NO: 481667 - DNA, 25 bp, Mus musculus
tgagctcagtttgaatgttaccgac

SEQ ID NO: 481668 - DNA, 25 bp, Mus musculus
tgagctcatccagaagatccacaga

SEQ ID NO: 481669 - DNA, 25 bp, Mus musculus
tgagctccacattcattcacactgt

SEQ ID NO: 481670 - DNA, 25 bp, Mus musculus
tgagctccaccaagagatgctggac

SEQ ID NO: 481671 - DNA, 25 bp, Mus musculus
tgagctccaggcaccatgaactttc

SEQ ID NO: 481672 - DNA, 25 bp, Mus musculus
tgagctccagttccctttaggcaga

SEQ ID NO: 481673 - DNA, 25 bp, Mus musculus
tgagctccccaaagtgcatggattg

SEQ ID NO: 481674 - DNA, 25 bp, Mus musculus
tgagctccccgcacaagaacagtgc

SEQ ID NO: 481675 - DNA, 25 bp, Mus musculus
tgagctcctgcaaggcctggatgat

SEQ ID NO: 481676 - DNA, 25 bp, Mus musculus
tgagctcggcatttgttcaacattg

SEQ ID NO: 481677 - DNA, 25 bp, Mus musculus
tgagctctatggctgctggatgacc

SEQ ID NO: 481678 - DNA, 25 bp, Mus musculus
tgagctctcacagtcatgcatttcc

SEQ ID NO: 481679 - DNA, 25 bp, Mus musculus
tgagctctccgtctgtttcagggcg

SEQ ID NO: 481680 - DNA, 25 bp, Mus musculus
tgagctctgaactgccgcaaaggat

SEQ ID NO: 481681 - DNA, 25 bp, Mus musculus
tgagctctgagcctgaaaacatttg

SEQ ID NO: 481682 - DNA, 25 bp, Mus musculus
tgagctctgagcgtagtgcggccca

SEQ ID NO: 481683 - DNA, 25 bp, Mus musculus
tgagctctgcggcttcgtttcctga

SEQ ID NO: 481684 - DNA, 25 bp, Mus musculus
tgagctctgttacacgagccggcct

SEQ ID NO: 481685 - DNA, 25 bp, Mus musculus
tgagctcttacactacatcctgaag

SEQ ID NO: 481686 - DNA, 25 bp, Mus musculus
tgagctcttcatgctagggctaccc

SEQ ID NO: 481687 - DNA, 25 bp, Mus musculus
tgagctcttctttattttcattgtg

SEQ ID NO: 481688 - DNA, 25 bp, Mus musculus
tgagctctttagtgagtacacctga

SEQ ID NO: 481689 - DNA, 25 bp, Mus musculus
tgagctgagatcgtccttctgtaga

SEQ ID NO: 481690 - DNA, 25 bp, Mus musculus
tgagctgagcatggttccctcctgt

SEQ ID NO: 481691 - DNA, 25 bp, Mus musculus
tgagctgagcggttcacgtccagtc

SEQ ID NO: 481692 - DNA, 25 bp, Mus musculus
tgagctgatgcatcaaaatggagac

SEQ ID NO: 481693 - DNA, 25 bp, Mus musculus
tgagctgcagtcaaaaaaccgcacg

SEQ ID NO: 481694 - DNA, 25 bp, Mus musculus
tgagctgccctttctgagtccagag

SEQ ID NO: 481695 - DNA, 25 bp, Mus musculus
tgagctgcctacctgctatcctggg

SEQ ID NO: 481696 - DNA, 25 bp, Mus musculus
tgagctgcctgatagatcgctggga

SEQ ID NO: 481697 - DNA, 25 bp, Mus musculus
tgagctggcgcatcactacttagag

SEQ ID NO: 481698 - DNA, 25 bp, Mus musculus
tgagctggtgataaacactcccctg

SEQ ID NO: 481699 - DNA, 25 bp, Mus musculus
tgagctggtgatcccctgcaatgtc

SEQ ID NO: 481700 - DNA, 25 bp, Mus musculus
tgagctgtgcaccaagggcttccag

SEQ ID NO: 481701 - DNA, 25 bp, Mus musculus
tgagctgtgctcttgtcgctgggct

SEQ ID NO: 481702 - DNA, 25 bp, Mus musculus
tgagctgtgcttaggcatgcaggac

SEQ ID NO: 481703 - DNA, 25 bp, Mus musculus
tgagcttaactggacagaggccctg

SEQ ID NO: 481704 - DNA, 25 bp, Mus musculus
tgagcttatctgcacaaggactgtg

SEQ ID NO: 481705 - DNA, 25 bp, Mus musculus
tgagcttcaagtctcgggcgcgaat

SEQ ID NO: 481706 - DNA, 25 bp, Mus musculus
tgagcttcagccgagagtacacagc

SEQ ID NO: 481707 - DNA, 25 bp, Mus musculus
tgagcttcccagttgatcacatcgg

SEQ ID NO: 481708 - DNA, 25 bp, Mus musculus
tgagcttccgaggaaaggaattctg

SEQ ID NO: 481709 - DNA, 25 bp, Mus musculus
tgagcttccgtgctcgagccctggt

SEQ ID NO: 481710 - DNA, 25 bp, Mus musculus
tgagcttcgaagaggacgctctact

SEQ ID NO: 481711 - DNA, 25 bp, Mus musculus
tgagcttcgatgaatcccgggcaca

SEQ ID NO: 481712 - DNA, 25 bp, Mus musculus
tgagcttcgcagactctggtccagt

SEQ ID NO: 481713 - DNA, 25 bp, Mus musculus
tgagcttcgcagatgaggtgaccac

SEQ ID NO: 481714 - DNA, 25 bp, Mus musculus
tgagcttcgtgcagacatcgccatg

SEQ ID NO: 481715 - DNA, 25 bp, Mus musculus
tgagcttgacaacgataggcctggc

SEQ ID NO: 481716 - DNA, 25 bp, Mus musculus
tgagcttgaccttgaagacgccctg

SEQ ID NO: 481717 - DNA, 25 bp, Mus musculus
tgagcttgccaagaccttccaggac

SEQ ID NO: 481718 - DNA, 25 bp, Mus musculus
tgagcttgccttacgctggagacct

SEQ ID NO: 481719 - DNA, 25 bp, Mus musculus
tgagcttggatctgtgacaaatacc

SEQ ID NO: 481720 - DNA, 25 bp, Mus musculus
tgagcttggtcaacagcacagaagg

SEQ ID NO: 481721 - DNA, 25 bp, Mus musculus
tgagctttagcgtacgggtttgtgc

SEQ ID NO: 481722 - DNA, 25 bp, Mus musculus
tgagctttgcctcctgtcacgtgaa

SEQ ID NO: 481723 - DNA, 25 bp, Mus musculus
tgagctttgctttctcgtcagtaaa

SEQ ID NO: 481724 - DNA, 25 bp, Mus musculus
tgagctttggatactctgaccggct

SEQ ID NO: 481725 - DNA, 25 bp, Mus musculus
tgaggaaacactatgccccgggatt

SEQ ID NO: 481726 - DNA, 25 bp, Mus musculus
tgaggaaacctttgagtcgggcaca

SEQ ID NO: 481727 - DNA, 25 bp, Mus musculus
tgaggaaagacctccagcgtgtgcg

SEQ ID NO: 481728 - DNA, 25 bp, Mus musculus
tgaggaaagtcagcaagtgctctct

SEQ ID NO: 481729 - DNA, 25 bp, Mus musculus
tgaggaaagtctacaggccatggcc

SEQ ID NO: 481730 - DNA, 25 bp, Mus musculus
tgaggaaagttgacccagatgctgc

SEQ ID NO: 481731 - DNA, 25 bp, Mus musculus
tgaggaacacggtcaaagtcacggg

SEQ ID NO: 481732 - DNA, 25 bp, Mus musculus
tgaggaaccacggagtaaaactctg

SEQ ID NO: 481733 - DNA, 25 bp, Mus musculus
tgaggaaccgcaataggcttcagct

SEQ ID NO: 481734 - DNA, 25 bp, Mus musculus
tgaggaactcaaccactggatccgg

SEQ ID NO: 481735 - DNA, 25 bp, Mus musculus
tgaggaactcgacgctatgatgaag

SEQ ID NO: 481736 - DNA, 25 bp, Mus musculus
tgaggaactggcctacactggcaca

SEQ ID NO: 481737 - DNA, 25 bp, Mus musculus
tgaggaagacctaaacaacggcgtg

SEQ ID NO: 481738 - DNA, 25 bp, Mus musculus
tgaggaagtccgatcccggaatccg

SEQ ID NO: 481739 - DNA, 25 bp, Mus musculus
tgaggaatagtcttgggtaacacac

SEQ ID NO: 481740 - DNA, 25 bp, Mus musculus
tgaggaatcacttaagacattggaa

SEQ ID NO: 481741 - DNA, 25 bp, Mus musculus
tgaggaatccggtgtgcatgagaac

SEQ ID NO: 481742 - DNA, 25 bp, Mus musculus
tgaggaatgcctatgcggctggctc

SEQ ID NO: 481743 - DNA, 25 bp, Mus musculus
tgaggaatggttaaccccagctgtg

SEQ ID NO: 481744 - DNA, 25 bp, Mus musculus
tgaggacaacccaaaggaggagaat

SEQ ID NO: 481745 - DNA, 25 bp, Mus musculus
tgaggacaagttttctccgtgttgc

SEQ ID NO: 481746 - DNA, 25 bp, Mus musculus
tgaggacacactgggcccaacgcat

SEQ ID NO: 481747 - DNA, 25 bp, Mus musculus
tgaggacagctcacccattcatgac

SEQ ID NO: 481748 - DNA, 25 bp, Mus musculus
tgaggacagtggtcccacagacgtc

SEQ ID NO: 481749 - DNA, 25 bp, Mus musculus
tgaggacatgagcttagacaaggct

SEQ ID NO: 481750 - DNA, 25 bp, Mus musculus
tgaggacattaaactttgatgcaac

SEQ ID NO: 481751 - DNA, 25 bp, Mus musculus
tgaggaccagtggtgaggaacggcc

SEQ ID NO: 481752 - DNA, 25 bp, Mus musculus
tgaggaccattgcttctacattgct

SEQ ID NO: 481753 - DNA, 25 bp, Mus musculus
tgaggacccaagaggtaagacctga

SEQ ID NO: 481754 - DNA, 25 bp, Mus musculus
tgaggaccccgatgttggtactagg

SEQ ID NO: 481755 - DNA, 25 bp, Mus musculus
tgaggaccggtagggttacaagcct

SEQ ID NO: 481756 - DNA, 25 bp, Mus musculus
tgaggacctgtacaaacgctatggg

SEQ ID NO: 481757 - DNA, 25 bp, Mus musculus
tgaggaccttccagggtcggacgct

SEQ ID NO: 481758 - DNA, 25 bp, Mus musculus
tgaggaccttgtgaacgccacgtgg

SEQ ID NO: 481759 - DNA, 25 bp, Mus musculus
tgaggacgcctacacagtgctgacc

SEQ ID NO: 481760 - DNA, 25 bp, Mus musculus
tgaggactaacaaggtatcctctgg

SEQ ID NO: 481761 - DNA, 25 bp, Mus musculus
tgaggactacaacagccaagtggtc

SEQ ID NO: 481762 - DNA, 25 bp, Mus musculus
tgaggactcaccatggatacccaga

SEQ ID NO: 481763 - DNA, 25 bp, Mus musculus
tgaggactcagactactttcctgga

SEQ ID NO: 481764 - DNA, 25 bp, Mus musculus
tgaggactcttgcagaccagctcga

SEQ ID NO: 481765 - DNA, 25 bp, Mus musculus
tgaggactcttggtcacagccaggc

SEQ ID NO: 481766 - DNA, 25 bp, Mus musculus
tgaggactgtgtcactaagagtaaa

SEQ ID NO: 481767 - DNA, 25 bp, Mus musculus
tgaggacttctcagacatttgtaat

SEQ ID NO: 481768 - DNA, 25 bp, Mus musculus
tgaggacttgtatctattgggagga

SEQ ID NO: 481769 - DNA, 25 bp, Mus musculus
tgaggagaaagacacccgtagtgcc

SEQ ID NO: 481770 - DNA, 25 bp, Mus musculus
tgaggagaacattcaagacagtgag

SEQ ID NO: 481771 - DNA, 25 bp, Mus musculus
tgaggagaagtcacactctgacagg

SEQ ID NO: 481772 - DNA, 25 bp, Mus musculus
tgaggagaatcaggagacagctgca

SEQ ID NO: 481773 - DNA, 25 bp, Mus musculus
tgaggagaatcccaactgccagatc

SEQ ID NO: 481774 - DNA, 25 bp, Mus musculus
tgaggagagcctttgcaagtcagcc

SEQ ID NO: 481775 - DNA, 25 bp, Mus musculus
tgaggagagctatgacacggagtca

SEQ ID NO: 481776 - DNA, 25 bp, Mus musculus
tgaggagaggcaagaaccgagctcc

SEQ ID NO: 481777 - DNA, 25 bp, Mus musculus
tgaggagagtaccacagttgtcacc

SEQ ID NO: 481778 - DNA, 25 bp, Mus musculus
tgaggagagtctcgatatttgcccc

SEQ ID NO: 481779 - DNA, 25 bp, Mus musculus
tgaggagattccctagccacagtcc

SEQ ID NO: 481780 - DNA, 25 bp, Mus musculus
tgaggagcaacagcacattatcgcc

SEQ ID NO: 481781 - DNA, 25 bp, Mus musculus
tgaggagcaagactaagccagcatg

SEQ ID NO: 481782 - DNA, 25 bp, Mus musculus
tgaggagcactccaaacagtaccgt

SEQ ID NO: 481783 - DNA, 25 bp, Mus musculus
tgaggagcagctgacaaaggatgac

SEQ ID NO: 481784 - DNA, 25 bp, Mus musculus
tgaggagcataaggctctgggcact

SEQ ID NO: 481785 - DNA, 25 bp, Mus musculus
tgaggagcatcttcgagcagccgca

SEQ ID NO: 481786 - DNA, 25 bp, Mus musculus
tgaggagcccaccattcagatagag

SEQ ID NO: 481787 - DNA, 25 bp, Mus musculus
tgaggagcccctgattgagcctctg

SEQ ID NO: 481788 - DNA, 25 bp, Mus musculus
tgaggagccctcgacgtctagtgat

SEQ ID NO: 481789 - DNA, 25 bp, Mus musculus
tgaggagcctcctgtagtgccagtg

SEQ ID NO: 481790 - DNA, 25 bp, Mus musculus
tgaggagccttgctgcttgtcatcc

SEQ ID NO: 481791 - DNA, 25 bp, Mus musculus
tgaggagctgaagaccacaaagccc

SEQ ID NO: 481792 - DNA, 25 bp, Mus musculus
tgaggaggaaaacccttaggttcat

SEQ ID NO: 481793 - DNA, 25 bp, Mus musculus
tgaggaggacttgctgatggccacc

SEQ ID NO: 481794 - DNA, 25 bp, Mus musculus
tgaggaggcctggtgttctcgcctc

SEQ ID NO: 481795 - DNA, 25 bp, Mus musculus
tgaggagggttgtcagccgcctcta

SEQ ID NO: 481796 - DNA, 25 bp, Mus musculus
tgaggaggtaaacggcctgcacact

SEQ ID NO: 481797 - DNA, 25 bp, Mus musculus
tgaggaggttaaggtgccctagccc

SEQ ID NO: 481798 - DNA, 25 bp, Mus musculus
tgaggagtaaacttagatctaacgg

SEQ ID NO: 481799 - DNA, 25 bp, Mus musculus
tgaggagtgactcgtaagcacctgt

SEQ ID NO: 481800 - DNA, 25 bp, Mus musculus
tgaggagttcccaatgatgcgcagg

SEQ ID NO: 481801 - DNA, 25 bp, Mus musculus
tgaggagtttcagcagtcgtgagcc

SEQ ID NO: 481802 - DNA, 25 bp, Mus musculus
tgaggatagccatagagcagagcct

SEQ ID NO: 481803 - DNA, 25 bp, Mus musculus
tgaggatatcccagttgcaagctga

SEQ ID NO: 481804 - DNA, 25 bp, Mus musculus
tgaggatgaagcaactggaggacca

SEQ ID NO: 481805 - DNA, 25 bp, Mus musculus
tgaggatgacagtgacaccttctat

SEQ ID NO: 481806 - DNA, 25 bp, Mus musculus
tgaggatgaccagcacagactactc

SEQ ID NO: 481807 - DNA, 25 bp, Mus musculus
tgaggatgatcttagtggacccaca

SEQ ID NO: 481808 - DNA, 25 bp, Mus musculus
tgaggatgatgatggaaacgatgat

SEQ ID NO: 481809 - DNA, 25 bp, Mus musculus
tgaggatgcaggacattgctcaccc

SEQ ID NO: 481810 - DNA, 25 bp, Mus musculus
tgaggatgccttcttcacacagccc

SEQ ID NO: 481811 - DNA, 25 bp, Mus musculus
tgaggatgcgcttcatgagggaacc

SEQ ID NO: 481812 - DNA, 25 bp, Mus musculus
tgaggatggactgagagactcagcc

SEQ ID NO: 481813 - DNA, 25 bp, Mus musculus
tgaggatggcttcttctgagccacc

SEQ ID NO: 481814 - DNA, 25 bp, Mus musculus
tgaggatggctttctggtaaacccg

SEQ ID NO: 481815 - DNA, 25 bp, Mus musculus
tgaggatggtaatgatctatgccac

SEQ ID NO: 481816 - DNA, 25 bp, Mus musculus
tgaggatgtggctgtccgcaacaat

SEQ ID NO: 481817 - DNA, 25 bp, Mus musculus
tgaggattgctcaccgcatcaaggg

SEQ ID NO: 481818 - DNA, 25 bp, Mus musculus
tgaggcaaaaaacaggctggctcct

SEQ ID NO: 481819 - DNA, 25 bp, Mus musculus
tgaggcaagcccagagagaagctgc

SEQ ID NO: 481820 - DNA, 25 bp, Mus musculus
tgaggcaagccttcgagaacgggaa

SEQ ID NO: 481821 - DNA, 25 bp, Mus musculus
tgaggcaatcctacttcagtactgg

SEQ ID NO: 481822 - DNA, 25 bp, Mus musculus
tgaggcacatggatgcagtgagaac

SEQ ID NO: 481823 - DNA, 25 bp, Mus musculus
tgaggcaccttcatgaaggaggccc

SEQ ID NO: 481824 - DNA, 25 bp, Mus musculus
tgaggcactagagctccaggcacaa

SEQ ID NO: 481825 - DNA, 25 bp, Mus musculus
tgaggcagaagtatccccagagaga

SEQ ID NO: 481826 - DNA, 25 bp, Mus musculus
tgaggcagcaggtacatgaatgagt

SEQ ID NO: 481827 - DNA, 25 bp, Mus musculus
tgaggcaggctcgttatcagcttcg

SEQ ID NO: 481828 - DNA, 25 bp, Mus musculus
tgaggcagtcaggaacaccctggga

SEQ ID NO: 481829 - DNA, 25 bp, Mus musculus
tgaggcagtcataacccacacatgg

SEQ ID NO: 481830 - DNA, 25 bp, Mus musculus
tgaggcatacaacctatagcagtgg

SEQ ID NO: 481831 - DNA, 25 bp, Mus musculus
tgaggcatccaaacttcgaaggagg

SEQ ID NO: 481832 - DNA, 25 bp, Mus musculus
tgaggccaaacacatagcttccgtc

SEQ ID NO: 481833 - DNA, 25 bp, Mus musculus
tgaggccaaagcacacactgttcag

SEQ ID NO: 481834 - DNA, 25 bp, Mus musculus
tgaggccaaatagcgcaagatgttc

SEQ ID NO: 481835 - DNA, 25 bp, Mus musculus
tgaggccaagagacagcagctaatg

SEQ ID NO: 481836 - DNA, 25 bp, Mus musculus
tgaggccaagcctggtgatccgagt

SEQ ID NO: 481837 - DNA, 25 bp, Mus musculus
tgaggccacaaaacgcagataccag

SEQ ID NO: 481838 - DNA, 25 bp, Mus musculus
tgaggccactaggaaaccagcaata

SEQ ID NO: 481839 - DNA, 25 bp, Mus musculus
tgaggccaggaatgactctactccc

SEQ ID NO: 481840 - DNA, 25 bp, Mus musculus
tgaggccaggctattctacaaaggg

SEQ ID NO: 481841 - DNA, 25 bp, Mus musculus
tgaggcccaaggatcactcatgctg

SEQ ID NO: 481842 - DNA, 25 bp, Mus musculus
tgaggcccacgattaaggatcactg

SEQ ID NO: 481843 - DNA, 25 bp, Mus musculus
tgaggcccagaattaagtcttgcag

SEQ ID NO: 481844 - DNA, 25 bp, Mus musculus
tgaggcccgagctgcccgcttctta

SEQ ID NO: 481845 - DNA, 25 bp, Mus musculus
tgaggcccgcagagtagacagtcct

SEQ ID NO: 481846 - DNA, 25 bp, Mus musculus
tgaggcccggacttaactgctttgt

SEQ ID NO: 481847 - DNA, 25 bp, Mus musculus
tgaggcccggctgactgggcaggct

SEQ ID NO: 481848 - DNA, 25 bp, Mus musculus
tgaggccctttagcaactacaactc

SEQ ID NO: 481849 - DNA, 25 bp, Mus musculus
tgaggccgacctatggagtaacccg

SEQ ID NO: 481850 - DNA, 25 bp, Mus musculus
tgaggccgtcaaaggtctgcgcaaa

SEQ ID NO: 481851 - DNA, 25 bp, Mus musculus
tgaggcctcagccaaactgcgtctg

SEQ ID NO: 481852 - DNA, 25 bp, Mus musculus
tgaggcctgaactccagctacaagc

SEQ ID NO: 481853 - DNA, 25 bp, Mus musculus
tgaggcctgcggattccagagaagt

SEQ ID NO: 481854 - DNA, 25 bp, Mus musculus
tgaggccttcatgtaccagaaagac

SEQ ID NO: 481855 - DNA, 25 bp, Mus musculus
tgaggcctttagtaccacggagtcc

SEQ ID NO: 481856 - DNA, 25 bp, Mus musculus
tgaggcgaaagagtaaatgtcaccg

SEQ ID NO: 481857 - DNA, 25 bp, Mus musculus
tgaggcgagacttcctagaagttgg

SEQ ID NO: 481858 - DNA, 25 bp, Mus musculus
tgaggcggccaacgcttagactctt

SEQ ID NO: 481859 - DNA, 25 bp, Mus musculus
tgaggctaaagttccaccaagaccg

SEQ ID NO: 481860 - DNA, 25 bp, Mus musculus
tgaggctaaatctgagaacctgggc

SEQ ID NO: 481861 - DNA, 25 bp, Mus musculus
tgaggctacctaccatgctgggaga

SEQ ID NO: 481862 - DNA, 25 bp, Mus musculus
tgaggctcagatgcgtgcagagtct

SEQ ID NO: 481863 - DNA, 25 bp, Mus musculus
tgaggctccgtgacagaacgcggtt

SEQ ID NO: 481864 - DNA, 25 bp, Mus musculus
tgaggctcctctcagctgctgtatg

SEQ ID NO: 481865 - DNA, 25 bp, Mus musculus
tgaggctcgcatccagaaagtgacc

SEQ ID NO: 481866 - DNA, 25 bp, Mus musculus
tgaggctctccggagggcactgctc

SEQ ID NO: 481867 - DNA, 25 bp, Mus musculus
tgaggctctgcataaactccagtgg

SEQ ID NO: 481868 - DNA, 25 bp, Mus musculus
tgaggctgaacagtgtacgccaagc

SEQ ID NO: 481869 - DNA, 25 bp, Mus musculus
tgaggctgactctgagccaatggag

SEQ ID NO: 481870 - DNA, 25 bp, Mus musculus
tgaggctgacttcactcctgcgagt

SEQ ID NO: 481871 - DNA, 25 bp, Mus musculus
tgaggctgattccttcatggcaggt

SEQ ID NO: 481872 - DNA, 25 bp, Mus musculus
tgaggctgctaactttgatcagctg

SEQ ID NO: 481873 - DNA, 25 bp, Mus musculus
tgaggctgctcaagttttcccgaga

SEQ ID NO: 481874 - DNA, 25 bp, Mus musculus
tgaggctggagctcagctgccgtct

SEQ ID NO: 481875 - DNA, 25 bp, Mus musculus
tgaggctggaggagccgcgtgcgga

SEQ ID NO: 481876 - DNA, 25 bp, Mus musculus
tgaggctggccatcgccagtgaact

SEQ ID NO: 481877 - DNA, 25 bp, Mus musculus
tgaggctggccttatctgactgtcc

SEQ ID NO: 481878 - DNA, 25 bp, Mus musculus
tgaggcttagctcaagtcttgtggt

SEQ ID NO: 481879 - DNA, 25 bp, Mus musculus
tgaggcttccctaccaaatcaagaa

SEQ ID NO: 481880 - DNA, 25 bp, Mus musculus
tgaggcttctagcaagactgtggac

SEQ ID NO: 481881 - DNA, 25 bp, Mus musculus
tgaggcttggaccaaaagaacttct

SEQ ID NO: 481882 - DNA, 25 bp, Mus musculus
tgaggctttcctcatctggatgtga

SEQ ID NO: 481883 - DNA, 25 bp, Mus musculus
tgagggaaaaccacagaccatgagg

SEQ ID NO: 481884 - DNA, 25 bp, Mus musculus
tgagggaacacaccagatcaccgtg

SEQ ID NO: 481885 - DNA, 25 bp, Mus musculus
tgagggaacccagcggtcttgactg

SEQ ID NO: 481886 - DNA, 25 bp, Mus musculus
tgagggaaggatcaactacctgcag

SEQ ID NO: 481887 - DNA, 25 bp, Mus musculus
tgagggaatatcagcaccagtcgcc

SEQ ID NO: 481888 - DNA, 25 bp, Mus musculus
tgagggagaacagagacaagagaat

SEQ ID NO: 481889 - DNA, 25 bp, Mus musculus
tgagggagacacagtccagacagtc

SEQ ID NO: 481890 - DNA, 25 bp, Mus musculus
tgagggagacctcctccgaaagctg

SEQ ID NO: 481891 - DNA, 25 bp, Mus musculus
tgagggagccaggtgtcaccactta

SEQ ID NO: 481892 - DNA, 25 bp, Mus musculus
tgagggagcctacgcactagatatg

SEQ ID NO: 481893 - DNA, 25 bp, Mus musculus
tgagggagtgttagacagtcattga

SEQ ID NO: 481894 - DNA, 25 bp, Mus musculus
tgagggatagaactgcaaactctgg

SEQ ID NO: 481895 - DNA, 25 bp, Mus musculus
tgagggatcaccgatctcacatggt

SEQ ID NO: 481896 - DNA, 25 bp, Mus musculus
tgagggatgcccacaaggaaagcta

SEQ ID NO: 481897 - DNA, 25 bp, Mus musculus
tgagggatgccttccatacaggcac

SEQ ID NO: 481898 - DNA, 25 bp, Mus musculus
tgagggatggtcacagcttggcact

SEQ ID NO: 481899 - DNA, 25 bp, Mus musculus
tgagggcaaaaaatccaaagctgtt

SEQ ID NO: 481900 - DNA, 25 bp, Mus musculus
tgagggcacagatggagggagggct

SEQ ID NO: 481901 - DNA, 25 bp, Mus musculus
tgagggccaggtcaacataccgctt

SEQ ID NO: 481902 - DNA, 25 bp, Mus musculus
tgagggccgcccgactggagcggct

SEQ ID NO: 481903 - DNA, 25 bp, Mus musculus
tgagggcctccacaatgccatgtgc

SEQ ID NO: 481904 - DNA, 25 bp, Mus musculus
tgagggctctttacgttaaatccgg

SEQ ID NO: 481905 - DNA, 25 bp, Mus musculus
tgagggctgacaaacttcgggctgc

SEQ ID NO: 481906 - DNA, 25 bp, Mus musculus
tgagggctgcactccatagcgtgta

SEQ ID NO: 481907 - DNA, 25 bp, Mus musculus
tgaggggctctcaagccaaaagaga

SEQ ID NO: 481908 - DNA, 25 bp, Mus musculus
tgagggtaaattacagcaggtcctg

SEQ ID NO: 481909 - DNA, 25 bp, Mus musculus
tgagggtacagttctccccaattgc

SEQ ID NO: 481910 - DNA, 25 bp, Mus musculus
tgagggtcagggtgaatccttccag

SEQ ID NO: 481911 - DNA, 25 bp, Mus musculus
tgagggtccgagatatcaacgaggc

SEQ ID NO: 481912 - DNA, 25 bp, Mus musculus
tgagggtcgcctgtcaattgtccgg

SEQ ID NO: 481913 - DNA, 25 bp, Mus musculus
tgagggtcgtcgtgcacccattcac

SEQ ID NO: 481914 - DNA, 25 bp, Mus musculus
tgagggtgccctaaaagctacgctc

SEQ ID NO: 481915 - DNA, 25 bp, Mus musculus
tgagggttagcatccagtatcctgc

SEQ ID NO: 481916 - DNA, 25 bp, Mus musculus
tgagggttctctctcctgctagcac

SEQ ID NO: 481917 - DNA, 25 bp, Mus musculus
tgagggttttgttaagccccaggag

SEQ ID NO: 481918 - DNA, 25 bp, Mus musculus
tgaggtaaagaaggtgccacatgcc

SEQ ID NO: 481919 - DNA, 25 bp, Mus musculus
tgaggtaaccagagccatgcagaat

SEQ ID NO: 481920 - DNA, 25 bp, Mus musculus
tgaggtacactctagaagcgctaga

SEQ ID NO: 481921 - DNA, 25 bp, Mus musculus
tgaggtaccatgtgaggttccctaa

SEQ ID NO: 481922 - DNA, 25 bp, Mus musculus
tgaggtacccgccatgattaaattg

SEQ ID NO: 481923 - DNA, 25 bp, Mus musculus
tgaggtactccaacatattgcaggc

SEQ ID NO: 481924 - DNA, 25 bp, Mus musculus
tgaggtagctgaaggcacgcaaacc

SEQ ID NO: 481925 - DNA, 25 bp, Mus musculus
tgaggtatccctgtagctgtcggtc

SEQ ID NO: 481926 - DNA, 25 bp, Mus musculus
tgaggtcaacagaatcgccacttgg

SEQ ID NO: 481927 - DNA, 25 bp, Mus musculus
tgaggtcaacccagaacacgtgatt

SEQ ID NO: 481928 - DNA, 25 bp, Mus musculus
tgaggtcaacggactactggtaggc

SEQ ID NO: 481929 - DNA, 25 bp, Mus musculus
tgaggtcaagaccattgccccacct

SEQ ID NO: 481930 - DNA, 25 bp, Mus musculus
tgaggtcacctcaataaactctgtg

SEQ ID NO: 481931 - DNA, 25 bp, Mus musculus
tgaggtcagcgagaccacagagagc

SEQ ID NO: 481932 - DNA, 25 bp, Mus musculus
tgaggtcaggtagccatggagtcaa

SEQ ID NO: 481933 - DNA, 25 bp, Mus musculus
tgaggtcatacccaagcttgcaggc

SEQ ID NO: 481934 - DNA, 25 bp, Mus musculus
tgaggtcatagctaccctggccatg

SEQ ID NO: 481935 - DNA, 25 bp, Mus musculus
tgaggtccaagtcccaaaacaagga

SEQ ID NO: 481936 - DNA, 25 bp, Mus musculus
tgaggtccatctgtgtagccaagcc

SEQ ID NO: 481937 - DNA, 25 bp, Mus musculus
tgaggtcccgctccggaaataaacg

SEQ ID NO: 481938 - DNA, 25 bp, Mus musculus
tgaggtccctgcaacaggcggcttg

SEQ ID NO: 481939 - DNA, 25 bp, Mus musculus
tgaggtcgaagaatggaaggactcc

SEQ ID NO: 481940 - DNA, 25 bp, Mus musculus
tgaggtcggccaatcaaacaaagga

SEQ ID NO: 481941 - DNA, 25 bp, Mus musculus
tgaggtctcctagcacaacagtgcc

SEQ ID NO: 481942 - DNA, 25 bp, Mus musculus
tgaggtctgccaacatgagctccgg

SEQ ID NO: 481943 - DNA, 25 bp, Mus musculus
tgaggtctgtcttccctcttcagca

SEQ ID NO: 481944 - DNA, 25 bp, Mus musculus
tgaggtcttgcctctcggtttttaa

SEQ ID NO: 481945 - DNA, 25 bp, Mus musculus
tgaggtctttgggacactccggaaa

SEQ ID NO: 481946 - DNA, 25 bp, Mus musculus
tgaggtgaaatgagaagcagcagca

SEQ ID NO: 481947 - DNA, 25 bp, Mus musculus
tgaggtgaacatagacatagcttcc

SEQ ID NO: 481948 - DNA, 25 bp, Mus musculus
tgaggtgacttcctgcaaggcaacg

SEQ ID NO: 481949 - DNA, 25 bp, Mus musculus
tgaggtgagttcctgtgtcctttcc

SEQ ID NO: 481950 - DNA, 25 bp, Mus musculus
tgaggtgccactacagaatattctg

SEQ ID NO: 481951 - DNA, 25 bp, Mus musculus
tgaggtgcccttctactacaatgag

SEQ ID NO: 481952 - DNA, 25 bp, Mus musculus
tgaggtggaaactgcgatctgagac

SEQ ID NO: 481953 - DNA, 25 bp, Mus musculus
tgaggtggactctcctcggcagact

SEQ ID NO: 481954 - DNA, 25 bp, Mus musculus
tgaggtgtcacttccccaaagtggc

SEQ ID NO: 481955 - DNA, 25 bp, Mus musculus
tgaggtgtctcacatattcagtccg

SEQ ID NO: 481956 - DNA, 25 bp, Mus musculus
tgaggtgttccatcaagccagcgtg

SEQ ID NO: 481957 - DNA, 25 bp, Mus musculus
tgaggtgttccctagcctgtctgcg

SEQ ID NO: 481958 - DNA, 25 bp, Mus musculus
tgaggttaaaactcgcccctggcac

SEQ ID NO: 481959 - DNA, 25 bp, Mus musculus
tgaggttcatgttcccaaagcagga

SEQ ID NO: 481960 - DNA, 25 bp, Mus musculus
tgaggttgacctaatgagtgctgtg

SEQ ID NO: 481961 - DNA, 25 bp, Mus musculus
tgaggtttactttctgcactgcggg

SEQ ID NO: 481962 - DNA, 25 bp, Mus musculus
tgaggtttcctaccagatcggcgaa

SEQ ID NO: 481963 - DNA, 25 bp, Mus musculus
tgagtaaagcctccctaacagccag

SEQ ID NO: 481964 - DNA, 25 bp, Mus musculus
tgagtaaatccataggagcccaggg

SEQ ID NO: 481965 - DNA, 25 bp, Mus musculus
tgagtaaccacaattagccactgcg

SEQ ID NO: 481966 - DNA, 25 bp, Mus musculus
tgagtaagaacaaagacgatgcgcc

SEQ ID NO: 481967 - DNA, 25 bp, Mus musculus
tgagtaagaagaaagcgaagatgcc

SEQ ID NO: 481968 - DNA, 25 bp, Mus musculus
tgagtaagacagcacccgggtacat

SEQ ID NO: 481969 - DNA, 25 bp, Mus musculus
tgagtaagcctccatgtcggaaagc

SEQ ID NO: 481970 - DNA, 25 bp, Mus musculus
tgagtaatgacctggtagctgccca

SEQ ID NO: 481971 - DNA, 25 bp, Mus musculus
tgagtaatggccacacagctgtcat

SEQ ID NO: 481972 - DNA, 25 bp, Mus musculus
tgagtacacaaatgttgatgaaagt

SEQ ID NO: 481973 - DNA, 25 bp, Mus musculus
tgagtacatcgagcagaggaagcct

SEQ ID NO: 481974 - DNA, 25 bp, Mus musculus
tgagtacatctacgtggaccctgtg

SEQ ID NO: 481975 - DNA, 25 bp, Mus musculus
tgagtacatctcaaaaagcggtaaa

SEQ ID NO: 481976 - DNA, 25 bp, Mus musculus
tgagtacatcttcaccactgtttgt

SEQ ID NO: 481977 - DNA, 25 bp, Mus musculus
tgagtaccagaagagtctaagaacc

SEQ ID NO: 481978 - DNA, 25 bp, Mus musculus
tgagtacccagtagccgaaaaggcc

SEQ ID NO: 481979 - DNA, 25 bp, Mus musculus
tgagtactactaggccaggtagaac

SEQ ID NO: 481980 - DNA, 25 bp, Mus musculus
tgagtacttgtagacaggacacatc

SEQ ID NO: 481981 - DNA, 25 bp, Mus musculus
tgagtagaaccctcgatccagcctg

SEQ ID NO: 481982 - DNA, 25 bp, Mus musculus
tgagtagacattcccaaaaggcagg

SEQ ID NO: 481983 - DNA, 25 bp, Mus musculus
tgagtagaggcagaattgagcaccc

SEQ ID NO: 481984 - DNA, 25 bp, Mus musculus
tgagtagcttcaggcaaagccaggc

SEQ ID NO: 481985 - DNA, 25 bp, Mus musculus
tgagtaggagacaacctgagtcccg

SEQ ID NO: 481986 - DNA, 25 bp, Mus musculus
tgagtatgacgattctgctgaggcc

SEQ ID NO: 481987 - DNA, 25 bp, Mus musculus
tgagtatgagaagcaaaggccaagc

SEQ ID NO: 481988 - DNA, 25 bp, Mus musculus
tgagtatgcagtcatgagcaccagg

SEQ ID NO: 481989 - DNA, 25 bp, Mus musculus
tgagtatgcgtacactcggaccgtg

SEQ ID NO: 481990 - DNA, 25 bp, Mus musculus
tgagtatggccaccattgtgtaggc

SEQ ID NO: 481991 - DNA, 25 bp, Mus musculus
tgagtatgggactcccggcccaagg

SEQ ID NO: 481992 - DNA, 25 bp, Mus musculus
tgagtatgtaccacagcaaaagttg

SEQ ID NO: 481993 - DNA, 25 bp, Mus musculus
tgagtattcatctaccccacagagt

SEQ ID NO: 481994 - DNA, 25 bp, Mus musculus
tgagtattcccaggcttgagcgtga

SEQ ID NO: 481995 - DNA, 25 bp, Mus musculus
tgagtatttttggaagctcggcaac

SEQ ID NO: 481996 - DNA, 25 bp, Mus musculus
tgagtcaaccttgtgccaaagagag

SEQ ID NO: 481997 - DNA, 25 bp, Mus musculus
tgagtcaatgccttcctctgggcct

SEQ ID NO: 481998 - DNA, 25 bp, Mus musculus
tgagtcacaaccaatttctaagctg

SEQ ID NO: 481999 - DNA, 25 bp, Mus musculus
tgagtcaccacctacagctgcagga

SEQ ID NO: 482000 - DNA, 25 bp, Mus musculus
tgagtcacgactggttggctccgct

SEQ ID NO: 482001 - DNA, 25 bp, Mus musculus
tgagtcacgctatgtggctcggaag

SEQ ID NO: 482002 - DNA, 25 bp, Mus musculus
tgagtcagagaaaccagcccagatg

SEQ ID NO: 482003 - DNA, 25 bp, Mus musculus
tgagtcagatcaaaagaaacccagg

SEQ ID NO: 482004 - DNA, 25 bp, Mus musculus
tgagtcagattgttacgattgtcct

SEQ ID NO: 482005 - DNA, 25 bp, Mus musculus
tgagtcagccgagagtgcagatgct

SEQ ID NO: 482006 - DNA, 25 bp, Mus musculus
tgagtcagcctcatatagcctagac

SEQ ID NO: 482007 - DNA, 25 bp, Mus musculus
tgagtcagctccagtgccagatggt

SEQ ID NO: 482008 - DNA, 25 bp, Mus musculus
tgagtcaggaattctctggctctcc

SEQ ID NO: 482009 - DNA, 25 bp, Mus musculus
tgagtcatttactcctaaggagggc

SEQ ID NO: 482010 - DNA, 25 bp, Mus musculus
tgagtccaacagaaacacagacggg

SEQ ID NO: 482011 - DNA, 25 bp, Mus musculus
tgagtccacagaacacatctttatg

SEQ ID NO: 482012 - DNA, 25 bp, Mus musculus
tgagtccacagtgttcagagccgac

SEQ ID NO: 482013 - DNA, 25 bp, Mus musculus
tgagtccacgggtgaggcaggcatg

SEQ ID NO: 482014 - DNA, 25 bp, Mus musculus
tgagtccaggaactatacaggtcgg

SEQ ID NO: 482015 - DNA, 25 bp, Mus musculus
tgagtcccactgagaaagcgggcac

SEQ ID NO: 482016 - DNA, 25 bp, Mus musculus
tgagtccccaatgagttccagcgaa

SEQ ID NO: 482017 - DNA, 25 bp, Mus musculus
tgagtccccgagaaagttacagaga

SEQ ID NO: 482018 - DNA, 25 bp, Mus musculus
tgagtccccgaggagtaagggccat

SEQ ID NO: 482019 - DNA, 25 bp, Mus musculus
tgagtccccggacagagtacagtgt

SEQ ID NO: 482020 - DNA, 25 bp, Mus musculus
tgagtcccgaaatggtgcgtttacc

SEQ ID NO: 482021 - DNA, 25 bp, Mus musculus
tgagtcccgacgaagctgtggagct

SEQ ID NO: 482022 - DNA, 25 bp, Mus musculus
tgagtcccgggtggcacgtgcactt

SEQ ID NO: 482023 - DNA, 25 bp, Mus musculus
tgagtccggacagaacgggttctcc

SEQ ID NO: 482024 - DNA, 25 bp, Mus musculus
tgagtccggccacatcaaggaaggt

SEQ ID NO: 482025 - DNA, 25 bp, Mus musculus
tgagtccggctcatgaagttatgat

SEQ ID NO: 482026 - DNA, 25 bp, Mus musculus
tgagtcctagaaatgagtagcttcc

SEQ ID NO: 482027 - DNA, 25 bp, Mus musculus
tgagtcctgtgacctccttgcaagg

SEQ ID NO: 482028 - DNA, 25 bp, Mus musculus
tgagtccttcttttacactgcatgt

SEQ ID NO: 482029 - DNA, 25 bp, Mus musculus
tgagtcctttcaggtacacaaagtg

SEQ ID NO: 482030 - DNA, 25 bp, Mus musculus
tgagtcgaatcagcttttcccacgg

SEQ ID NO: 482031 - DNA, 25 bp, Mus musculus
tgagtcgctctactgaagatgcagc

SEQ ID NO: 482032 - DNA, 25 bp, Mus musculus
tgagtctaaagaaatcgccgagtcg

SEQ ID NO: 482033 - DNA, 25 bp, Mus musculus
tgagtctaagaataaggcctggcaa

SEQ ID NO: 482034 - DNA, 25 bp, Mus musculus
tgagtctactagtgctggcaggcaa

SEQ ID NO: 482035 - DNA, 25 bp, Mus musculus
tgagtctatactgatgggcctcgcc

SEQ ID NO: 482036 - DNA, 25 bp, Mus musculus
tgagtctccggaaagcagctatggc

SEQ ID NO: 482037 - DNA, 25 bp, Mus musculus
tgagtctcgccctcctatggtgtga

SEQ ID NO: 482038 - DNA, 25 bp, Mus musculus
tgagtctcgggagtcgtctgcgacc

SEQ ID NO: 482039 - DNA, 25 bp, Mus musculus
tgagtctctgctgtgacctgcctgt

SEQ ID NO: 482040 - DNA, 25 bp, Mus musculus
tgagtctgatgagagaaaacgaggc

SEQ ID NO: 482041 - DNA, 25 bp, Mus musculus
tgagtctgcctctggaactaagccc

SEQ ID NO: 482042 - DNA, 25 bp, Mus musculus
tgagtctggcgctcaccatgcagag

SEQ ID NO: 482043 - DNA, 25 bp, Mus musculus
tgagtgaaaatacttccttacccga

SEQ ID NO: 482044 - DNA, 25 bp, Mus musculus
tgagtgaagaagcatgccgaacccg

SEQ ID NO: 482045 - DNA, 25 bp, Mus musculus
tgagtgaagtctaccttggccccac

SEQ ID NO: 482046 - DNA, 25 bp, Mus musculus
tgagtgaatgcgtgcttagtgcctg

SEQ ID NO: 482047 - DNA, 25 bp, Mus musculus
tgagtgacagcacccctttggagcc

SEQ ID NO: 482048 - DNA, 25 bp, Mus musculus
tgagtgacatgaacgggctaggctt

SEQ ID NO: 482049 - DNA, 25 bp, Mus musculus
tgagtgacccaaggccagaatgtct

SEQ ID NO: 482050 - DNA, 25 bp, Mus musculus
tgagtgacccacagggagaccatga

SEQ ID NO: 482051 - DNA, 25 bp, Mus musculus
tgagtgacctctgggctcccagaag

SEQ ID NO: 482052 - DNA, 25 bp, Mus musculus
tgagtgacgccaccatgaaaatcgt

SEQ ID NO: 482053 - DNA, 25 bp, Mus musculus
tgagtgactccgacaagcagtgaac

SEQ ID NO: 482054 - DNA, 25 bp, Mus musculus
tgagtgactgttcctactgtgatgg

SEQ ID NO: 482055 - DNA, 25 bp, Mus musculus
tgagtgacttcccatggattgcatg

SEQ ID NO: 482056 - DNA, 25 bp, Mus musculus
tgagtgacttgcatcccaggaatcc

SEQ ID NO: 482057 - DNA, 25 bp, Mus musculus
tgagtgagaacgatatcctcctggt

SEQ ID NO: 482058 - DNA, 25 bp, Mus musculus
tgagtgagaagatccccattcccag

SEQ ID NO: 482059 - DNA, 25 bp, Mus musculus
tgagtgagatcattggccgagacct

SEQ ID NO: 482060 - DNA, 25 bp, Mus musculus
tgagtgagcaaaactactaccgggc

SEQ ID NO: 482061 - DNA, 25 bp, Mus musculus
tgagtgagcaacacgcagaagctcg

SEQ ID NO: 482062 - DNA, 25 bp, Mus musculus
tgagtgagctccttctgaatcctgg

SEQ ID NO: 482063 - DNA, 25 bp, Mus musculus
tgagtgatcctttgtcttaccgacc

SEQ ID NO: 482064 - DNA, 25 bp, Mus musculus
tgagtgatggcttgagacgttccgt

SEQ ID NO: 482065 - DNA, 25 bp, Mus musculus
tgagtgatttctccagccccattgc

SEQ ID NO: 482066 - DNA, 25 bp, Mus musculus
tgagtgcaacttctagtatgagagg

SEQ ID NO: 482067 - DNA, 25 bp, Mus musculus
tgagtgcaagtaccagttccaggct

SEQ ID NO: 482068 - DNA, 25 bp, Mus musculus
tgagtgcacaggactgcggagacct

SEQ ID NO: 482069 - DNA, 25 bp, Mus musculus
tgagtgcacctcagacgggagggaa

SEQ ID NO: 482070 - DNA, 25 bp, Mus musculus
tgagtgcaggccaggaaactcctgt

SEQ ID NO: 482071 - DNA, 25 bp, Mus musculus
tgagtgcatgcctgtcgtcagagac

SEQ ID NO: 482072 - DNA, 25 bp, Mus musculus
tgagtgccaacctgacgatgcaggg

SEQ ID NO: 482073 - DNA, 25 bp, Mus musculus
tgagtgccctacctgaaactatgct

SEQ ID NO: 482074 - DNA, 25 bp, Mus musculus
tgagtgccggatgctcctatagaga

SEQ ID NO: 482075 - DNA, 25 bp, Mus musculus
tgagtgcggtctacacctgcaagag

SEQ ID NO: 482076 - DNA, 25 bp, Mus musculus
tgagtgctcaccgaattccaaagaa

SEQ ID NO: 482077 - DNA, 25 bp, Mus musculus
tgagtgctccactgctgaaactggg

SEQ ID NO: 482078 - DNA, 25 bp, Mus musculus
tgagtgctcgctatcccagggatct

SEQ ID NO: 482079 - DNA, 25 bp, Mus musculus
tgagtgcttcgtgaaagtgccgcgc

SEQ ID NO: 482080 - DNA, 25 bp, Mus musculus
tgagtggactcatttgcagcctaac

SEQ ID NO: 482081 - DNA, 25 bp, Mus musculus
tgagtggtactacccctaggcaggt

SEQ ID NO: 482082 - DNA, 25 bp, Mus musculus
tgagtggtcactctctacccctgct

SEQ ID NO: 482083 - DNA, 25 bp, Mus musculus
tgagtggtcagtagggcagagcagt

SEQ ID NO: 482084 - DNA, 25 bp, Mus musculus
tgagtggtcccagacagctgcatct

SEQ ID NO: 482085 - DNA, 25 bp, Mus musculus
tgagtgtatcattccacagagccct

SEQ ID NO: 482086 - DNA, 25 bp, Mus musculus
tgagtgtcagctctgttaaatggcc

SEQ ID NO: 482087 - DNA, 25 bp, Mus musculus
tgagtgtccagctcgtccagttagc

SEQ ID NO: 482088 - DNA, 25 bp, Mus musculus
tgagtgtcccctacaatgactacgg

SEQ ID NO: 482089 - DNA, 25 bp, Mus musculus
tgagtgtgaagatgcattaatgtct

SEQ ID NO: 482090 - DNA, 25 bp, Mus musculus
tgagtgtgtcagctcttgtcacctg

SEQ ID NO: 482091 - DNA, 25 bp, Mus musculus
tgagtgttcttatcccagactgtct

SEQ ID NO: 482092 - DNA, 25 bp, Mus musculus
tgagtgttgttggatattagtgacc

SEQ ID NO: 482093 - DNA, 25 bp, Mus musculus
tgagtgtttcgaaaaagcctgccgc

SEQ ID NO: 482094 - DNA, 25 bp, Mus musculus
tgagttaagaccacatccctgatag

SEQ ID NO: 482095 - DNA, 25 bp, Mus musculus
tgagttacaggaagtcatcagcgac

SEQ ID NO: 482096 - DNA, 25 bp, Mus musculus
tgagttactccagagaaagcaggtt

SEQ ID NO: 482097 - DNA, 25 bp, Mus musculus
tgagttataaccaccttcggagggt

SEQ ID NO: 482098 - DNA, 25 bp, Mus musculus
tgagttatctgactgcatccacttg

SEQ ID NO: 482099 - DNA, 25 bp, Mus musculus
tgagttatgatgtaatccgcctgca

SEQ ID NO: 482100 - DNA, 25 bp, Mus musculus
tgagttcaaccgcatcgctgtggag

SEQ ID NO: 482101 - DNA, 25 bp, Mus musculus
tgagttcaacgcagagctagctggg

SEQ ID NO: 482102 - DNA, 25 bp, Mus musculus
tgagttcacagctgcctagacaggc

SEQ ID NO: 482103 - DNA, 25 bp, Mus musculus
tgagttcaccgacctcaacctggtg

SEQ ID NO: 482104 - DNA, 25 bp, Mus musculus
tgagttcaccgcacacatcctggaa

SEQ ID NO: 482105 - DNA, 25 bp, Mus musculus
tgagttcagagtcctcacacgaggc

SEQ ID NO: 482106 - DNA, 25 bp, Mus musculus
tgagttcagttctcgggactcacag

SEQ ID NO: 482107 - DNA, 25 bp, Mus musculus
tgagttcccacgaccagcaaacgtg

SEQ ID NO: 482108 - DNA, 25 bp, Mus musculus
tgagttcccatcacggcttctcggg

SEQ ID NO: 482109 - DNA, 25 bp, Mus musculus
tgagttccccgatgagcctaaatgg

SEQ ID NO: 482110 - DNA, 25 bp, Mus musculus
tgagttcccgttcggctccaagcag

SEQ ID NO: 482111 - DNA, 25 bp, Mus musculus
tgagttccgcaaggccttcatgaag

SEQ ID NO: 482112 - DNA, 25 bp, Mus musculus
tgagttccgctttcagggcaagaag

SEQ ID NO: 482113 - DNA, 25 bp, Mus musculus
tgagttccgtcagatgtgggccgaa

SEQ ID NO: 482114 - DNA, 25 bp, Mus musculus
tgagttcctgacacccatggaggag

SEQ ID NO: 482115 - DNA, 25 bp, Mus musculus
tgagttccttccagttcggctatga

SEQ ID NO: 482116 - DNA, 25 bp, Mus musculus
tgagttccttgtggtctactggagg

SEQ ID NO: 482117 - DNA, 25 bp, Mus musculus
tgagttcggcaagcctaccatggac

SEQ ID NO: 482118 - DNA, 25 bp, Mus musculus
tgagttctaggaatcgaacccgggt

SEQ ID NO: 482119 - DNA, 25 bp, Mus musculus
tgagttctcacatcagccccggcag

SEQ ID NO: 482120 - DNA, 25 bp, Mus musculus
tgagttctctctgtgccaaaagccg

SEQ ID NO: 482121 - DNA, 25 bp, Mus musculus
tgagttctcttcttccgcagcttcc

SEQ ID NO: 482122 - DNA, 25 bp, Mus musculus
tgagttctgcccagtctgcatcacc

SEQ ID NO: 482123 - DNA, 25 bp, Mus musculus
tgagttctgtgtggagggcccacca

SEQ ID NO: 482124 - DNA, 25 bp, Mus musculus
tgagttcttaccagcaaaagcagcc

SEQ ID NO: 482125 - DNA, 25 bp, Mus musculus
tgagttcttactcagtttcccaaag

SEQ ID NO: 482126 - DNA, 25 bp, Mus musculus
tgagttgaagatctggactccatac

SEQ ID NO: 482127 - DNA, 25 bp, Mus musculus
tgagttgagctgcacccattttccc

SEQ ID NO: 482128 - DNA, 25 bp, Mus musculus
tgagttgcaggctctttcccggctg

SEQ ID NO: 482129 - DNA, 25 bp, Mus musculus
tgagttgccatataggttccatgaa

SEQ ID NO: 482130 - DNA, 25 bp, Mus musculus
tgagttggaccagagtttgcctgaa

SEQ ID NO: 482131 - DNA, 25 bp, Mus musculus
tgagttggccacagtagaacattcg

SEQ ID NO: 482132 - DNA, 25 bp, Mus musculus
tgagttgggcggcaggcagttcagc

SEQ ID NO: 482133 - DNA, 25 bp, Mus musculus
tgagttggtggagctcagcacagcc

SEQ ID NO: 482134 - DNA, 25 bp, Mus musculus
tgagttgtaaaactgtttacccgag

SEQ ID NO: 482135 - DNA, 25 bp, Mus musculus
tgagttgtctgaactcctcctgaca

SEQ ID NO: 482136 - DNA, 25 bp, Mus musculus
tgagttgtgcgctccccatgtggcg

SEQ ID NO: 482137 - DNA, 25 bp, Mus musculus
tgagttgtgttctccatggaaggag

SEQ ID NO: 482138 - DNA, 25 bp, Mus musculus
tgagttgttagacaccccaggcaga

SEQ ID NO: 482139 - DNA, 25 bp, Mus musculus
tgagtttaccaacactgctaagcct

SEQ ID NO: 482140 - DNA, 25 bp, Mus musculus
tgagtttcaagagcacaaggtgggc

SEQ ID NO: 482141 - DNA, 25 bp, Mus musculus
tgagtttcacgctggcagagcagag

SEQ ID NO: 482142 - DNA, 25 bp, Mus musculus
tgagtttcagaccaacaggtacctg

SEQ ID NO: 482143 - DNA, 25 bp, Mus musculus
tgagtttcgaacctgggatccagag

SEQ ID NO: 482144 - DNA, 25 bp, Mus musculus
tgagtttcgacaatccggccagtgc

SEQ ID NO: 482145 - DNA, 25 bp, Mus musculus
tgagtttgaactgcggtaccggaga

SEQ ID NO: 482146 - DNA, 25 bp, Mus musculus
tgagtttgaatccttagtctgctga

SEQ ID NO: 482147 - DNA, 25 bp, Mus musculus
tgagtttgccacagggactttgcct

SEQ ID NO: 482148 - DNA, 25 bp, Mus musculus
tgagtttgtatgcacctgtttgggt

SEQ ID NO: 482149 - DNA, 25 bp, Mus musculus
tgagttttcaactggcctgtgcaag

SEQ ID NO: 482150 - DNA, 25 bp, Mus musculus
tgagttttccatagctccctgtaaa

SEQ ID NO: 482151 - DNA, 25 bp, Mus musculus
tgagttttccccttattctgagctg

SEQ ID NO: 482152 - DNA, 25 bp, Mus musculus
tgataaaaatgtctctgaagcagga

SEQ ID NO: 482153 - DNA, 25 bp, Mus musculus
tgataaaactccgtggcagtgcccc

SEQ ID NO: 482154 - DNA, 25 bp, Mus musculus
tgataaacaagcagaagggcgggct

SEQ ID NO: 482155 - DNA, 25 bp, Mus musculus
tgataaaccgaagggaatggcctgt

SEQ ID NO: 482156 - DNA, 25 bp, Mus musculus
tgataaacctgaagggtgccccagc

SEQ ID NO: 482157 - DNA, 25 bp, Mus musculus
tgataaagacacagccgaaggactg

SEQ ID NO: 482158 - DNA, 25 bp, Mus musculus
tgataaagcatagaggaggagccgc

SEQ ID NO: 482159 - DNA, 25 bp, Mus musculus
tgataaagctccttgtgacaggctg

SEQ ID NO: 482160 - DNA, 25 bp, Mus musculus
tgataaagtgccaaaggaccgctgg

SEQ ID NO: 482161 - DNA, 25 bp, Mus musculus
tgataaatcccatgcattcagcaag

SEQ ID NO: 482162 - DNA, 25 bp, Mus musculus
tgataaatctggtccatggtgcagg

SEQ ID NO: 482163 - DNA, 25 bp, Mus musculus
tgataaatgggatgtgtgcccaccc

SEQ ID NO: 482164 - DNA, 25 bp, Mus musculus
tgataacagaaacaacctcgctcct

SEQ ID NO: 482165 - DNA, 25 bp, Mus musculus
tgataacagtgactttccatttgtg

SEQ ID NO: 482166 - DNA, 25 bp, Mus musculus
tgataacatactgcgcaacaagccc

SEQ ID NO: 482167 - DNA, 25 bp, Mus musculus
tgataacattcagcagtacctgatg

SEQ ID NO: 482168 - DNA, 25 bp, Mus musculus
tgataaccccacagtagatgaccgt

SEQ ID NO: 482169 - DNA, 25 bp, Mus musculus
tgataacccgggtggccaaattccg

SEQ ID NO: 482170 - DNA, 25 bp, Mus musculus
tgataaccctcaactatgtcgccgg

SEQ ID NO: 482171 - DNA, 25 bp, Mus musculus
tgataacccttcagtgagcagccgg

SEQ ID NO: 482172 - DNA, 25 bp, Mus musculus
tgataaccgtgtagagagtgcctcc

SEQ ID NO: 482173 - DNA, 25 bp, Mus musculus
tgataaccgtgtgagctgccttggg

SEQ ID NO: 482174 - DNA, 25 bp, Mus musculus
tgataacctgctcctgaatgcccag

SEQ ID NO: 482175 - DNA, 25 bp, Mus musculus
tgataacgccagcaccaaagcaatg

SEQ ID NO: 482176 - DNA, 25 bp, Mus musculus
tgataactatgtcccgttggcaccg

SEQ ID NO: 482177 - DNA, 25 bp, Mus musculus
tgataactcaggaccaagtaccaca

SEQ ID NO: 482178 - DNA, 25 bp, Mus musculus
tgataactgctggtgacgtctaggg

SEQ ID NO: 482179 - DNA, 25 bp, Mus musculus
tgataacttgatgaagagcctggac

SEQ ID NO: 482180 - DNA, 25 bp, Mus musculus
tgataagacctacaagccagctgag

SEQ ID NO: 482181 - DNA, 25 bp, Mus musculus
tgataagcagaactctccaggtgcc

SEQ ID NO: 482182 - DNA, 25 bp, Mus musculus
tgataagcagctcactggaggcatt

SEQ ID NO: 482183 - DNA, 25 bp, Mus musculus
tgataagctctctgagtcttgggca

SEQ ID NO: 482184 - DNA, 25 bp, Mus musculus
tgataaggcacaccataaggctgag

SEQ ID NO: 482185 - DNA, 25 bp, Mus musculus
tgataaggccttcactcagcgctgc

SEQ ID NO: 482186 - DNA, 25 bp, Mus musculus
tgataaggggccctctagggctccc

SEQ ID NO: 482187 - DNA, 25 bp, Mus musculus
tgataagggtcagcagggcatcctg

SEQ ID NO: 482188 - DNA, 25 bp, Mus musculus
tgataagtgtccagcttggcgcacg

SEQ ID NO: 482189 - DNA, 25 bp, Mus musculus
tgataatatccaactgtctgcagaa

SEQ ID NO: 482190 - DNA, 25 bp, Mus musculus
tgataatcaaccatggaaagaggac

SEQ ID NO: 482191 - DNA, 25 bp, Mus musculus
tgataatgaatcacatagcacttgc

SEQ ID NO: 482192 - DNA, 25 bp, Mus musculus
tgataattccaacgcagcctctgag

SEQ ID NO: 482193 - DNA, 25 bp, Mus musculus
tgataattgactgggctgaacactc

SEQ ID NO: 482194 - DNA, 25 bp, Mus musculus
tgatacaagcccaaaacctgaagag

SEQ ID NO: 482195 - DNA, 25 bp, Mus musculus
tgatacagtagatctagagtcttgg

SEQ ID NO: 482196 - DNA, 25 bp, Mus musculus
tgatacatatgatcctgaaggcgcc

SEQ ID NO: 482197 - DNA, 25 bp, Mus musculus
tgataccaacgggagagatcatccg

SEQ ID NO: 482198 - DNA, 25 bp, Mus musculus
tgataccagccattaagacaccatg

SEQ ID NO: 482199 - DNA, 25 bp, Mus musculus
tgataccattgctgtgccagagctg

SEQ ID NO: 482200 - DNA, 25 bp, Mus musculus
tgataccgagtctcatacatcccag

SEQ ID NO: 482201 - DNA, 25 bp, Mus musculus
tgataccggattggagaacatgccc

SEQ ID NO: 482202 - DNA, 25 bp, Mus musculus
tgataccgggctggataacagccac

SEQ ID NO: 482203 - DNA, 25 bp, Mus musculus
tgatacctagcccagtcagtcgaga

SEQ ID NO: 482204 - DNA, 25 bp, Mus musculus
tgatacgaccgatgaggacacgggc

SEQ ID NO: 482205 - DNA, 25 bp, Mus musculus
tgatacgatggaaagcataaactac

SEQ ID NO: 482206 - DNA, 25 bp, Mus musculus
tgatactaactttgagccacttggg

SEQ ID NO: 482207 - DNA, 25 bp, Mus musculus
tgatactacttcaactgtggccagt

SEQ ID NO: 482208 - DNA, 25 bp, Mus musculus
tgatactcaacatgtctccactgtg

SEQ ID NO: 482209 - DNA, 25 bp, Mus musculus
tgatactccggccttcaatcgaaga

SEQ ID NO: 482210 - DNA, 25 bp, Mus musculus
tgatactctcattggtggcgccagg

SEQ ID NO: 482211 - DNA, 25 bp, Mus musculus
tgatactctgcaataaaactgtgcc

SEQ ID NO: 482212 - DNA, 25 bp, Mus musculus
tgatactgactgatgcaggccaagg

SEQ ID NO: 482213 - DNA, 25 bp, Mus musculus
tgatactgccacaaacacaggccca

SEQ ID NO: 482214 - DNA, 25 bp, Mus musculus
tgatactggcctatgctgcacctgt

SEQ ID NO: 482215 - DNA, 25 bp, Mus musculus
tgatacttacagacctcctagaggg

SEQ ID NO: 482216 - DNA, 25 bp, Mus musculus
tgatacttctatgacactcactggc

SEQ ID NO: 482217 - DNA, 25 bp, Mus musculus
tgatacttggattacccgagcctct

SEQ ID NO: 482218 - DNA, 25 bp, Mus musculus
tgatagaatccagtgtgcactttgg

SEQ ID NO: 482219 - DNA, 25 bp, Mus musculus
tgatagactcagtgggacccatgac

SEQ ID NO: 482220 - DNA, 25 bp, Mus musculus
tgatagagggtcacatctgcgccag

SEQ ID NO: 482221 - DNA, 25 bp, Mus musculus
tgatagagtgtgctgactccgccca

SEQ ID NO: 482222 - DNA, 25 bp, Mus musculus
tgatagatacgctcagacccgtgcc

SEQ ID NO: 482223 - DNA, 25 bp, Mus musculus
tgatagatgctgcagatcgagaaaa

SEQ ID NO: 482224 - DNA, 25 bp, Mus musculus
tgatagatggttacacagagtggca

SEQ ID NO: 482225 - DNA, 25 bp, Mus musculus
tgatagcacaactacaaaactaagc

SEQ ID NO: 482226 - DNA, 25 bp, Mus musculus
tgatagcaccagatgagccgcaggt

SEQ ID NO: 482227 - DNA, 25 bp, Mus musculus
tgatagcagcagacagtgggaaccc

SEQ ID NO: 482228 - DNA, 25 bp, Mus musculus
tgatagcagcaggtaattgacaggc

SEQ ID NO: 482229 - DNA, 25 bp, Mus musculus
tgatagcagcgacagctgcacttgg

SEQ ID NO: 482230 - DNA, 25 bp, Mus musculus
tgatagcatcctagaacgcaagagg

SEQ ID NO: 482231 - DNA, 25 bp, Mus musculus
tgatagccaagtgcacaggatccgc

SEQ ID NO: 482232 - DNA, 25 bp, Mus musculus
tgatagccagaaatgcacttgtgta

SEQ ID NO: 482233 - DNA, 25 bp, Mus musculus
tgatagccctacatatagaccctcc

SEQ ID NO: 482234 - DNA, 25 bp, Mus musculus
tgatagccgatgaagagtcccagga

SEQ ID NO: 482235 - DNA, 25 bp, Mus musculus
tgatagcgcctgtgtcccatctctg

SEQ ID NO: 482236 - DNA, 25 bp, Mus musculus
tgatagctctccaaggtgactgtcc

SEQ ID NO: 482237 - DNA, 25 bp, Mus musculus
tgatagctctgattgacgctggtgg

SEQ ID NO: 482238 - DNA, 25 bp, Mus musculus
tgatagctcttcgaaaggccccaag

SEQ ID NO: 482239 - DNA, 25 bp, Mus musculus
tgatagggctcatgcaacggtgctg

SEQ ID NO: 482240 - DNA, 25 bp, Mus musculus
tgatagggctgtggtggcctaccca

SEQ ID NO: 482241 - DNA, 25 bp, Mus musculus
tgataggtcgaaaaggaaagctccc

SEQ ID NO: 482242 - DNA, 25 bp, Mus musculus
tgataggtgccctcaaagagcgcag

SEQ ID NO: 482243 - DNA, 25 bp, Mus musculus
tgataggtgcttggcaacaactcag

SEQ ID NO: 482244 - DNA, 25 bp, Mus musculus
tgatagtcaagtccagtgtccccag

SEQ ID NO: 482245 - DNA, 25 bp, Mus musculus
tgatagtcacttatggcaacccagg

SEQ ID NO: 482246 - DNA, 25 bp, Mus musculus
tgatagtcagaaatgaccccaggat

SEQ ID NO: 482247 - DNA, 25 bp, Mus musculus
tgatagtccctatcagggcggagca

SEQ ID NO: 482248 - DNA, 25 bp, Mus musculus
tgatagtcctcagcggataccaaac

SEQ ID NO: 482249 - DNA, 25 bp, Mus musculus
tgatagtgccatcgaagtcttcaca

SEQ ID NO: 482250 - DNA, 25 bp, Mus musculus
tgatagtgtcatccccatggcagag

SEQ ID NO: 482251 - DNA, 25 bp, Mus musculus
tgatagttctcgtagcgtccggcct

SEQ ID NO: 482252 - DNA, 25 bp, Mus musculus
tgatagttgatggttaacatctctt

SEQ ID NO: 482253 - DNA, 25 bp, Mus musculus
tgatatagaagcataggcaaaataa

SEQ ID NO: 482254 - DNA, 25 bp, Mus musculus
tgatatagaggaatgccgggacacg

SEQ ID NO: 482255 - DNA, 25 bp, Mus musculus
tgatatatacctagccacaagcaag

SEQ ID NO: 482256 - DNA, 25 bp, Mus musculus
tgatatatgtggagcagcgactccc

SEQ ID NO: 482257 - DNA, 25 bp, Mus musculus
tgatatcaaaggtgaggactcgctg

SEQ ID NO: 482258 - DNA, 25 bp, Mus musculus
tgatatcaaatcacaggtcctgatg

SEQ ID NO: 482259 - DNA, 25 bp, Mus musculus
tgatatcaccggaaggactgatcct

SEQ ID NO: 482260 - DNA, 25 bp, Mus musculus
tgatatcacctctctggtggccggg

SEQ ID NO: 482261 - DNA, 25 bp, Mus musculus
tgatatccccgctaagggtcccaac

SEQ ID NO: 482262 - DNA, 25 bp, Mus musculus
tgatatcctttcctagagcgcagag

SEQ ID NO: 482263 - DNA, 25 bp, Mus musculus
tgatatcgcctttcagaccacctgg

SEQ ID NO: 482264 - DNA, 25 bp, Mus musculus
tgatatcgtcaagcggtacaactgg

SEQ ID NO: 482265 - DNA, 25 bp, Mus musculus
tgatatctgtgaaagctgccaggca

SEQ ID NO: 482266 - DNA, 25 bp, Mus musculus
tgatatgaaggcgagaggccacctt

SEQ ID NO: 482267 - DNA, 25 bp, Mus musculus
tgatatgacttctaggatcttctag

SEQ ID NO: 482268 - DNA, 25 bp, Mus musculus
tgatatgcgctggaacaaagggacc

SEQ ID NO: 482269 - DNA, 25 bp, Mus musculus
tgatatggaggaaatcacctgtgcc

SEQ ID NO: 482270 - DNA, 25 bp, Mus musculus
tgatatgggcatctgtccgaggctc

SEQ ID NO: 482271 - DNA, 25 bp, Mus musculus
tgatatgtaatctctggtgcaccag

SEQ ID NO: 482272 - DNA, 25 bp, Mus musculus
tgatattaatcgcatccaggcctta

SEQ ID NO: 482273 - DNA, 25 bp, Mus musculus
tgatattcagagcaggttcccagac

SEQ ID NO: 482274 - DNA, 25 bp, Mus musculus
tgatattgataagaaaccagggcct

SEQ ID NO: 482275 - DNA, 25 bp, Mus musculus
tgatattgcagcctatctgtccgct

SEQ ID NO: 482276 - DNA, 25 bp, Mus musculus
tgatattgggtcagcaccaggagcc

SEQ ID NO: 482277 - DNA, 25 bp, Mus musculus
tgatattgttattctggcgagtgac

SEQ ID NO: 482278 - DNA, 25 bp, Mus musculus
tgatatttaagagcacagcgtttgc

SEQ ID NO: 482279 - DNA, 25 bp, Mus musculus
tgatcaaaaggaggagtccccacag

SEQ ID NO: 482280 - DNA, 25 bp, Mus musculus
tgatcaaaatacacgctaagggcgt

SEQ ID NO: 482281 - DNA, 25 bp, Mus musculus
tgatcaaagaagtgctgtccctgga

SEQ ID NO: 482282 - DNA, 25 bp, Mus musculus
tgatcaaagtggagaatgaggaccc

SEQ ID NO: 482283 - DNA, 25 bp, Mus musculus
tgatcaacgctgacttctgcgcggg

SEQ ID NO: 482284 - DNA, 25 bp, Mus musculus
tgatcaactcacactgaaacatccg

SEQ ID NO: 482285 - DNA, 25 bp, Mus musculus
tgatcaagacttagagggcctcagt

SEQ ID NO: 482286 - DNA, 25 bp, Mus musculus
tgatcaagatgagcgaggcaacctc

SEQ ID NO: 482287 - DNA, 25 bp, Mus musculus
tgatcaagcatgtgaccgtcatcgg

SEQ ID NO: 482288 - DNA, 25 bp, Mus musculus
tgatcaaggaccaacaaatgctgcg

SEQ ID NO: 482289 - DNA, 25 bp, Mus musculus
tgatcaaggcaggacgccactgtgc

SEQ ID NO: 482290 - DNA, 25 bp, Mus musculus
tgatcaagttagctgcagagggcct

SEQ ID NO: 482291 - DNA, 25 bp, Mus musculus
tgatcaatataacagcccacattcc

SEQ ID NO: 482292 - DNA, 25 bp, Mus musculus
tgatcacaaacgcaaagccagaggg

SEQ ID NO: 482293 - DNA, 25 bp, Mus musculus
tgatcacagcagaggttgaagctct

SEQ ID NO: 482294 - DNA, 25 bp, Mus musculus
tgatcacagcatagctaacactgga

SEQ ID NO: 482295 - DNA, 25 bp, Mus musculus
tgatcacaggctcacagaacgcgag

SEQ ID NO: 482296 - DNA, 25 bp, Mus musculus
tgatcaccattggaaacgaacgctt

SEQ ID NO: 482297 - DNA, 25 bp, Mus musculus
tgatcaccccagaccagagagtaag

SEQ ID NO: 482298 - DNA, 25 bp, Mus musculus
tgatcaccgccctagggctgggcta

SEQ ID NO: 482299 - DNA, 25 bp, Mus musculus
tgatcaccggaaagactggaacccc

SEQ ID NO: 482300 - DNA, 25 bp, Mus musculus
tgatcactagatttcagcaggttga

SEQ ID NO: 482301 - DNA, 25 bp, Mus musculus
tgatcactctaggacaagagcagga

SEQ ID NO: 482302 - DNA, 25 bp, Mus musculus
tgatcactctgaatcctgccaaaag

SEQ ID NO: 482303 - DNA, 25 bp, Mus musculus
tgatcactttcatggccctggtggg

SEQ ID NO: 482304 - DNA, 25 bp, Mus musculus
tgatcagaaggccaacaagggaaga

SEQ ID NO: 482305 - DNA, 25 bp, Mus musculus
tgatcagagccaaagcagtgagcga

SEQ ID NO: 482306 - DNA, 25 bp, Mus musculus
tgatcagagcgggtgcaaaggcacc

SEQ ID NO: 482307 - DNA, 25 bp, Mus musculus
tgatcagccgcgtcttcgaggagaa

SEQ ID NO: 482308 - DNA, 25 bp, Mus musculus
tgatcagcctgagttcacaccggtc

SEQ ID NO: 482309 - DNA, 25 bp, Mus musculus
tgatcaggaacatagccacctctgg

SEQ ID NO: 482310 - DNA, 25 bp, Mus musculus
tgatcaggtcaatctgttaaaagct

SEQ ID NO: 482311 - DNA, 25 bp, Mus musculus
tgatcaggttcggagaagcctcgag

SEQ ID NO: 482312 - DNA, 25 bp, Mus musculus
tgatcagtagcaggggaatttttcc

SEQ ID NO: 482313 - DNA, 25 bp, Mus musculus
tgatcagtgagctagacttttccct

SEQ ID NO: 482314 - DNA, 25 bp, Mus musculus
tgatcagtttcgaatccagggcact

SEQ ID NO: 482315 - DNA, 25 bp, Mus musculus
tgatcatcatcaaacaagaggaggc

SEQ ID NO: 482316 - DNA, 25 bp, Mus musculus
tgatcatccagtccaacgggctggt

SEQ ID NO: 482317 - DNA, 25 bp, Mus musculus
tgatcatccccacttgagcaggagg

SEQ ID NO: 482318 - DNA, 25 bp, Mus musculus
tgatcatcgacagagagaaccagtg

SEQ ID NO: 482319 - DNA, 25 bp, Mus musculus
tgatcatcgtgtaccacgccaggga

SEQ ID NO: 482320 - DNA, 25 bp, Mus musculus
tgatcatctacttcggcacagccta

SEQ ID NO: 482321 - DNA, 25 bp, Mus musculus
tgatcatgactctgcttaggttatg

SEQ ID NO: 482322 - DNA, 25 bp, Mus musculus
tgatcattggaccagagcaagtgga

SEQ ID NO: 482323 - DNA, 25 bp, Mus musculus
tgatccaagccatcaacggcgagag

SEQ ID NO: 482324 - DNA, 25 bp, Mus musculus
tgatccacatctcgagcatacagta

SEQ ID NO: 482325 - DNA, 25 bp, Mus musculus
tgatccacctgatggccaaagctgg

SEQ ID NO: 482326 - DNA, 25 bp, Mus musculus
tgatccacgaagtgcaacgctttgc

SEQ ID NO: 482327 - DNA, 25 bp, Mus musculus
tgatccacgtcagaagacaatcgcc

SEQ ID NO: 482328 - DNA, 25 bp, Mus musculus
tgatccagaaggagctcaccattgg

SEQ ID NO: 482329 - DNA, 25 bp, Mus musculus
tgatccagagatggtaccggcgcta

SEQ ID NO: 482330 - DNA, 25 bp, Mus musculus
tgatccagcaaaggaaatggtgacc

SEQ ID NO: 482331 - DNA, 25 bp, Mus musculus
tgatccaggtcacctcagctgccgg

SEQ ID NO: 482332 - DNA, 25 bp, Mus musculus
tgatccaggtgaagaacgaggtgtc

SEQ ID NO: 482333 - DNA, 25 bp, Mus musculus
tgatccagtgaaacaagagagaagc

SEQ ID NO: 482334 - DNA, 25 bp, Mus musculus
tgatccagtgtctcatctttgcacc

SEQ ID NO: 482335 - DNA, 25 bp, Mus musculus
tgatccattgtcctgcagagggcag

SEQ ID NO: 482336 - DNA, 25 bp, Mus musculus
tgatcccaatgagaatgagcacctg

SEQ ID NO: 482337 - DNA, 25 bp, Mus musculus
tgatcccaatgtgcactggcagctg

SEQ ID NO: 482338 - DNA, 25 bp, Mus musculus
tgatcccaccttgcaatactaggca

SEQ ID NO: 482339 - DNA, 25 bp, Mus musculus
tgatccccagaagaggttcacctgc

SEQ ID NO: 482340 - DNA, 25 bp, Mus musculus
tgatccccatggtgctacaaagagg

SEQ ID NO: 482341 - DNA, 25 bp, Mus musculus
tgatccccgcagaatcaggaaatcc

SEQ ID NO: 482342 - DNA, 25 bp, Mus musculus
tgatccccgtgccagaatatcgttt

SEQ ID NO: 482343 - DNA, 25 bp, Mus musculus
tgatcccgagaactggcttttcccg

SEQ ID NO: 482344 - DNA, 25 bp, Mus musculus
tgatcccgcctgtctgtgagcaagc

SEQ ID NO: 482345 - DNA, 25 bp, Mus musculus
tgatcccgcgctttaggagaaggga

SEQ ID NO: 482346 - DNA, 25 bp, Mus musculus
tgatcccggaagtgacagacaatgg

SEQ ID NO: 482347 - DNA, 25 bp, Mus musculus
tgatccctcctgtgtgcgagcaagc

SEQ ID NO: 482348 - DNA, 25 bp, Mus musculus
tgatccctttcctgttgcttctaga

SEQ ID NO: 482349 - DNA, 25 bp, Mus musculus
tgatccgaagacacacactggagga

SEQ ID NO: 482350 - DNA, 25 bp, Mus musculus
tgatccgcagaggagagaagcacca

SEQ ID NO: 482351 - DNA, 25 bp, Mus musculus
tgatccgcgacgtggaactggcaga

SEQ ID NO: 482352 - DNA, 25 bp, Mus musculus
tgatccgctcactgcatgagatggg

SEQ ID NO: 482353 - DNA, 25 bp, Mus musculus
tgatccgcttctggaaacagtggag

SEQ ID NO: 482354 - DNA, 25 bp, Mus musculus
tgatccggaaacagggcaaaggcac

SEQ ID NO: 482355 - DNA, 25 bp, Mus musculus
tgatccggccgtttgctgggctcac

SEQ ID NO: 482356 - DNA, 25 bp, Mus musculus
tgatccgtagactggaactgaagag

SEQ ID NO: 482357 - DNA, 25 bp, Mus musculus
tgatccgtcagaaacggcaggcgcg

SEQ ID NO: 482358 - DNA, 25 bp, Mus musculus
tgatccgtctgatgacagtagcaga

SEQ ID NO: 482359 - DNA, 25 bp, Mus musculus
tgatccgtgactgggacaacttatc

SEQ ID NO: 482360 - DNA, 25 bp, Mus musculus
tgatcctaaaccagagagcaggccc

SEQ ID NO: 482361 - DNA, 25 bp, Mus musculus
tgatcctaagaagaagtacacacgg

SEQ ID NO: 482362 - DNA, 25 bp, Mus musculus
tgatcctcgtcaccacagttgtagg

SEQ ID NO: 482363 - DNA, 25 bp, Mus musculus
tgatcctctcaaaggtatgtgtgac

SEQ ID NO: 482364 - DNA, 25 bp, Mus musculus
tgatcctgaccccaaagtgtgtgta

SEQ ID NO: 482365 - DNA, 25 bp, Mus musculus
tgatcctgactttgacccgagtggg

SEQ ID NO: 482366 - DNA, 25 bp, Mus musculus
tgatcctgcaagtgaccatggtggt

SEQ ID NO: 482367 - DNA, 25 bp, Mus musculus
tgatcctgcgaggaaccagtacctg

SEQ ID NO: 482368 - DNA, 25 bp, Mus musculus
tgatcctggaaatactgggcagccc

SEQ ID NO: 482369 - DNA, 25 bp, Mus musculus
tgatcctggaggtaagaatgaaccc

SEQ ID NO: 482370 - DNA, 25 bp, Mus musculus
tgatcctggagtgggaggaacccct

SEQ ID NO: 482371 - DNA, 25 bp, Mus musculus
tgatcctggccatgacactagaccg

SEQ ID NO: 482372 - DNA, 25 bp, Mus musculus
tgatcctgtgctacagcactccata

SEQ ID NO: 482373 - DNA, 25 bp, Mus musculus
tgatcgacatctacagtgcaagctg

SEQ ID NO: 482374 - DNA, 25 bp, Mus musculus
tgatcgacctcaccgggaagatggt

SEQ ID NO: 482375 - DNA, 25 bp, Mus musculus
tgatcgatgacactgagctgaagca

SEQ ID NO: 482376 - DNA, 25 bp, Mus musculus
tgatcgattgaagttgcctggctcc

SEQ ID NO: 482377 - DNA, 25 bp, Mus musculus
tgatcgcagggatggaccaagctct

SEQ ID NO: 482378 - DNA, 25 bp, Mus musculus
tgatcgcatcaatcaggcccaggga

SEQ ID NO: 482379 - DNA, 25 bp, Mus musculus
tgatcgcatgagctacgacgtgccg

SEQ ID NO: 482380 - DNA, 25 bp, Mus musculus
tgatcgccgacaagtatcccgagga

SEQ ID NO: 482381 - DNA, 25 bp, Mus musculus
tgatcgctggtgtcctgtcaagaga

SEQ ID NO: 482382 - DNA, 25 bp, Mus musculus
tgatcggcagaacgccattgtagcc

SEQ ID NO: 482383 - DNA, 25 bp, Mus musculus
tgatcggttctaaacattggccctg

SEQ ID NO: 482384 - DNA, 25 bp, Mus musculus
tgatcgtaaaccactccagaacggc

SEQ ID NO: 482385 - DNA, 25 bp, Mus musculus
tgatcgtagccagaaccttgtggac

SEQ ID NO: 482386 - DNA, 25 bp, Mus musculus
tgatcgtcttcatggcaggcgtggc

SEQ ID NO: 482387 - DNA, 25 bp, Mus musculus
tgatcgtgggcaagtaattccttgg

SEQ ID NO: 482388 - DNA, 25 bp, Mus musculus
tgatcgtgggctctgtaaaaactga

SEQ ID NO: 482389 - DNA, 25 bp, Mus musculus
tgatctaaatgtgctcagaaggagc

SEQ ID NO: 482390 - DNA, 25 bp, Mus musculus
tgatctaagattacatgcctggaac

SEQ ID NO: 482391 - DNA, 25 bp, Mus musculus
tgatctaagcccatcttgttaaacc

SEQ ID NO: 482392 - DNA, 25 bp, Mus musculus
tgatctaatccagagcaaccgcagc

SEQ ID NO: 482393 - DNA, 25 bp, Mus musculus
tgatctacacataggacaggtcact

SEQ ID NO: 482394 - DNA, 25 bp, Mus musculus
tgatctacatcgtcctgaagggcaa

SEQ ID NO: 482395 - DNA, 25 bp, Mus musculus
tgatctaccgtcagcagcaatccgg

SEQ ID NO: 482396 - DNA, 25 bp, Mus musculus
tgatctacgatgctactgcctctgg

SEQ ID NO: 482397 - DNA, 25 bp, Mus musculus
tgatctagcactaatccggaagaac

SEQ ID NO: 482398 - DNA, 25 bp, Mus musculus
tgatctatctttgccggaacgccaa

SEQ ID NO: 482399 - DNA, 25 bp, Mus musculus
tgatctcaaaagtgcaaaagaccct

SEQ ID NO: 482400 - DNA, 25 bp, Mus musculus
tgatctcaactgtgcaacaaagcca

SEQ ID NO: 482401 - DNA, 25 bp, Mus musculus
tgatctcacctgaaaaccttgggaa

SEQ ID NO: 482402 - DNA, 25 bp, Mus musculus
tgatctcacgctccacctggtggtg

SEQ ID NO: 482403 - DNA, 25 bp, Mus musculus
tgatctcagaggcttcctcccaccg

SEQ ID NO: 482404 - DNA, 25 bp, Mus musculus
tgatctcagggcaataactaatgtt

SEQ ID NO: 482405 - DNA, 25 bp, Mus musculus
tgatctcattgaggcctgccgggtg

SEQ ID NO: 482406 - DNA, 25 bp, Mus musculus
tgatctccaaatctgggctcaggaa

SEQ ID NO: 482407 - DNA, 25 bp, Mus musculus
tgatctccagtctccgagtggtggg

SEQ ID NO: 482408 - DNA, 25 bp, Mus musculus
tgatctccatttgggtgacccgagg

SEQ ID NO: 482409 - DNA, 25 bp, Mus musculus
tgatctccttatccccttaggtaat

SEQ ID NO: 482410 - DNA, 25 bp, Mus musculus
tgatctccttcacggcaacttgctt

SEQ ID NO: 482411 - DNA, 25 bp, Mus musculus
tgatctccttttggagtgacaggaa

SEQ ID NO: 482412 - DNA, 25 bp, Mus musculus
tgatctctatgtgcgaggaccacga

SEQ ID NO: 482413 - DNA, 25 bp, Mus musculus
tgatctctcaggctccatctgtctc

SEQ ID NO: 482414 - DNA, 25 bp, Mus musculus
tgatctctctggaatgtcaccggac

SEQ ID NO: 482415 - DNA, 25 bp, Mus musculus
tgatctgaagcattggtgggtgtcc

SEQ ID NO: 482416 - DNA, 25 bp, Mus musculus
tgatctgcccagtccattgaaaagt

SEQ ID NO: 482417 - DNA, 25 bp, Mus musculus
tgatctggcattctggaacaaaccg

SEQ ID NO: 482418 - DNA, 25 bp, Mus musculus
tgatctgtgatctgtgctagtggac

SEQ ID NO: 482419 - DNA, 25 bp, Mus musculus
tgatctgttgcaacgaaaggctggt

SEQ ID NO: 482420 - DNA, 25 bp, Mus musculus
tgatcttacacagagcacgtggtgg

SEQ ID NO: 482421 - DNA, 25 bp, Mus musculus
tgatcttacaccagagaccagtggg

SEQ ID NO: 482422 - DNA, 25 bp, Mus musculus
tgatcttcaagtgcctggagccaga

SEQ ID NO: 482423 - DNA, 25 bp, Mus musculus
tgatcttcagccctgcaagcagagt

SEQ ID NO: 482424 - DNA, 25 bp, Mus musculus
tgatcttcgtggtagactgcgccga

SEQ ID NO: 482425 - DNA, 25 bp, Mus musculus
tgatcttctggtctacacttcccaa

SEQ ID NO: 482426 - DNA, 25 bp, Mus musculus
tgatcttgagaggatgagccgcatc

SEQ ID NO: 482427 - DNA, 25 bp, Mus musculus
tgatcttgatcagaagtggaccgac

SEQ ID NO: 482428 - DNA, 25 bp, Mus musculus
tgatcttggattgaaggcttagcct

SEQ ID NO: 482429 - DNA, 25 bp, Mus musculus
tgatcttggcgggacaaacctgagg

SEQ ID NO: 482430 - DNA, 25 bp, Mus musculus
tgatctttctggtggttcggcccta

SEQ ID NO: 482431 - DNA, 25 bp, Mus musculus
tgatgaaaacagaaaagcactcccc

SEQ ID NO: 482432 - DNA, 25 bp, Mus musculus
tgatgaaaattaagaccctgaccac

SEQ ID NO: 482433 - DNA, 25 bp, Mus musculus
tgatgaaacatactgtgaccctgca

SEQ ID NO: 482434 - DNA, 25 bp, Mus musculus
tgatgaaatcgagctggcctaccgt

SEQ ID NO: 482435 - DNA, 25 bp, Mus musculus
tgatgaacaaatccacagagccttg

SEQ ID NO: 482436 - DNA, 25 bp, Mus musculus
tgatgaacaatgtcctgccgcgtgc

SEQ ID NO: 482437 - DNA, 25 bp, Mus musculus
tgatgaacaggatccccaccatgga

SEQ ID NO: 482438 - DNA, 25 bp, Mus musculus
tgatgaagaactagcaacagcacct

SEQ ID NO: 482439 - DNA, 25 bp, Mus musculus
tgatgaagaagattgggcagtcccc

SEQ ID NO: 482440 - DNA, 25 bp, Mus musculus
tgatgaagatcatagcagccctgct

SEQ ID NO: 482441 - DNA, 25 bp, Mus musculus
tgatgaagatgacccacatatccac

SEQ ID NO: 482442 - DNA, 25 bp, Mus musculus
tgatgaagatgcacagcagcccttg

SEQ ID NO: 482443 - DNA, 25 bp, Mus musculus
tgatgaagatgctactggagagccc

SEQ ID NO: 482444 - DNA, 25 bp, Mus musculus
tgatgaagcacacagcgtcctagag

SEQ ID NO: 482445 - DNA, 25 bp, Mus musculus
tgatgaagccattgccgaccagatg

SEQ ID NO: 482446 - DNA, 25 bp, Mus musculus
tgatgaagcctcaagatgcctggtc

SEQ ID NO: 482447 - DNA, 25 bp, Mus musculus
tgatgaagctcaggccttgttggaa

SEQ ID NO: 482448 - DNA, 25 bp, Mus musculus
tgatgaaggaccgaaagctgacgtg

SEQ ID NO: 482449 - DNA, 25 bp, Mus musculus
tgatgaaggagatgatgatcctgtt

SEQ ID NO: 482450 - DNA, 25 bp, Mus musculus
tgatgaagtttgagtcccgcggcaa

SEQ ID NO: 482451 - DNA, 25 bp, Mus musculus
tgatgaatcacaaaacccagctagc

SEQ ID NO: 482452 - DNA, 25 bp, Mus musculus
tgatgaatctttctataggcagcat

SEQ ID NO: 482453 - DNA, 25 bp, Mus musculus
tgatgaatgataagaactggaaccc

SEQ ID NO: 482454 - DNA, 25 bp, Mus musculus
tgatgacacctcgaagacctttgcc

SEQ ID NO: 482455 - DNA, 25 bp, Mus musculus
tgatgacacttctcgttcccagagg

SEQ ID NO: 482456 - DNA, 25 bp, Mus musculus
tgatgacagagaccccaaaggatcc

SEQ ID NO: 482457 - DNA, 25 bp, Mus musculus
tgatgacatatcacgcatgctgggc

SEQ ID NO: 482458 - DNA, 25 bp, Mus musculus
tgatgacatgaagcggatcatccct

SEQ ID NO: 482459 - DNA, 25 bp, Mus musculus
tgatgacatgccagacccagggctt

SEQ ID NO: 482460 - DNA, 25 bp, Mus musculus
tgatgacattacttgcccggcctgc

SEQ ID NO: 482461 - DNA, 25 bp, Mus musculus
tgatgaccaagtaaccaatcgccgt

SEQ ID NO: 482462 - DNA, 25 bp, Mus musculus
tgatgaccactgaaaggacccttcc

SEQ ID NO: 482463 - DNA, 25 bp, Mus musculus
tgatgaccatattgccaggcgggtt

SEQ ID NO: 482464 - DNA, 25 bp, Mus musculus
tgatgaccccattgtgcaaacggag

SEQ ID NO: 482465 - DNA, 25 bp, Mus musculus
tgatgaccccggacggtaaaattat

SEQ ID NO: 482466 - DNA, 25 bp, Mus musculus
tgatgacccgtgacctttgaggagg

SEQ ID NO: 482467 - DNA, 25 bp, Mus musculus
tgatgaccgcatcggagccttgact

SEQ ID NO: 482468 - DNA, 25 bp, Mus musculus
tgatgactaaggaagaactgtgact

SEQ ID NO: 482469 - DNA, 25 bp, Mus musculus
tgatgactcgcttgtcctgttgcag

SEQ ID NO: 482470 - DNA, 25 bp, Mus musculus
tgatgactgacgtgatgaaatacct

SEQ ID NO: 482471 - DNA, 25 bp, Mus musculus
tgatgactggttcttaaggctgaga

SEQ ID NO: 482472 - DNA, 25 bp, Mus musculus
tgatgagaaagaggctacaggccag

SEQ ID NO: 482473 - DNA, 25 bp, Mus musculus
tgatgagacaggagggcaagtaccc

SEQ ID NO: 482474 - DNA, 25 bp, Mus musculus
tgatgagacccagcgctaattcgtc

SEQ ID NO: 482475 - DNA, 25 bp, Mus musculus
tgatgagacctccttcagtgaagcc

SEQ ID NO: 482476 - DNA, 25 bp, Mus musculus
tgatgagagaagactgtgagtgtca

SEQ ID NO: 482477 - DNA, 25 bp, Mus musculus
tgatgagagccctagcaccagcagt

SEQ ID NO: 482478 - DNA, 25 bp, Mus musculus
tgatgagcacctgagagcaaagcgc

SEQ ID NO: 482479 - DNA, 25 bp, Mus musculus
tgatgagcactacaagcagcagatg

SEQ ID NO: 482480 - DNA, 25 bp, Mus musculus
tgatgagcagataacgcaaggtcct

SEQ ID NO: 482481 - DNA, 25 bp, Mus musculus
tgatgagcatctgtcactgacggac

SEQ ID NO: 482482 - DNA, 25 bp, Mus musculus
tgatgagcctgtgcacatccaggtc

SEQ ID NO: 482483 - DNA, 25 bp, Mus musculus
tgatgagccttctgacagggacacc

SEQ ID NO: 482484 - DNA, 25 bp, Mus musculus
tgatgaggccagcagataccagtgt

SEQ ID NO: 482485 - DNA, 25 bp, Mus musculus
tgatgagtcctacctgttcccaaga

SEQ ID NO: 482486 - DNA, 25 bp, Mus musculus
tgatgagtgcaaacgcgtcagacct

SEQ ID NO: 482487 - DNA, 25 bp, Mus musculus
tgatgagtgctgtgtatgaccaatg

SEQ ID NO: 482488 - DNA, 25 bp, Mus musculus
tgatgatacccgagccagtgagagc

SEQ ID NO: 482489 - DNA, 25 bp, Mus musculus
tgatgatcagcaccattggcagcag

SEQ ID NO: 482490 - DNA, 25 bp, Mus musculus
tgatgatccccatgcaacggcggga

SEQ ID NO: 482491 - DNA, 25 bp, Mus musculus
tgatgatccgtactgcagcagtggc

SEQ ID NO: 482492 - DNA, 25 bp, Mus musculus
tgatgatctcggtcgtccatgaacg

SEQ ID NO: 482493 - DNA, 25 bp, Mus musculus
tgatgatctggttcaagtagggaat

SEQ ID NO: 482494 - DNA, 25 bp, Mus musculus
tgatgatgaattcctaccccagaga

SEQ ID NO: 482495 - DNA, 25 bp, Mus musculus
tgatgatgaggcaggcaagttacag

SEQ ID NO: 482496 - DNA, 25 bp, Mus musculus
tgatgatgccaaccctagtaaccat

SEQ ID NO: 482497 - DNA, 25 bp, Mus musculus
tgatgatgccaagagccgcagggca

SEQ ID NO: 482498 - DNA, 25 bp, Mus musculus
tgatgatggcagagtctcgtacccg

SEQ ID NO: 482499 - DNA, 25 bp, Mus musculus
tgatgattcgtgagccttgccggac

SEQ ID NO: 482500 - DNA, 25 bp, Mus musculus
tgatgattgcctacggagtgagcgc

SEQ ID NO: 482501 - DNA, 25 bp, Mus musculus
tgatgcaaatatgtccagccgctac

SEQ ID NO: 482502 - DNA, 25 bp, Mus musculus
tgatgcaacctggagtcaggcccca

SEQ ID NO: 482503 - DNA, 25 bp, Mus musculus
tgatgcacaagctgaaatggccctg

SEQ ID NO: 482504 - DNA, 25 bp, Mus musculus
tgatgcacagacagagcggaatggt

SEQ ID NO: 482505 - DNA, 25 bp, Mus musculus
tgatgcacagatggcgatacccgtc

SEQ ID NO: 482506 - DNA, 25 bp, Mus musculus
tgatgcacccacttctcaggcaggt

SEQ ID NO: 482507 - DNA, 25 bp, Mus musculus
tgatgcacctttcttttcagcccac

SEQ ID NO: 482508 - DNA, 25 bp, Mus musculus
tgatgcatatattgacacctagaga

SEQ ID NO: 482509 - DNA, 25 bp, Mus musculus
tgatgcatgctacaagcctgttggg

SEQ ID NO: 482510 - DNA, 25 bp, Mus musculus
tgatgccaccgcctgtatagtcctg

SEQ ID NO: 482511 - DNA, 25 bp, Mus musculus
tgatgcccacctatcctgtattgag

SEQ ID NO: 482512 - DNA, 25 bp, Mus musculus
tgatgccctaaagggatccaatgcc

SEQ ID NO: 482513 - DNA, 25 bp, Mus musculus
tgatgccctggagcccgaggatttg

SEQ ID NO: 482514 - DNA, 25 bp, Mus musculus
tgatgccggttgaccttaagctggg

SEQ ID NO: 482515 - DNA, 25 bp, Mus musculus
tgatgcctcagctagtgaagaagag

SEQ ID NO: 482516 - DNA, 25 bp, Mus musculus
tgatgcctccagatacgtgttcagg

SEQ ID NO: 482517 - DNA, 25 bp, Mus musculus
tgatgcctgccagttgagcaaccgc

SEQ ID NO: 482518 - DNA, 25 bp, Mus musculus
tgatgcctgtcaaaatggagatgcg

SEQ ID NO: 482519 - DNA, 25 bp, Mus musculus
tgatgcctgtgaagacagccttggt

SEQ ID NO: 482520 - DNA, 25 bp, Mus musculus
tgatgcgcagatcgatcccaactgg

SEQ ID NO: 482521 - DNA, 25 bp, Mus musculus
tgatgcgctgctacacggagatgct

SEQ ID NO: 482522 - DNA, 25 bp, Mus musculus
tgatgcggacatgcacctggacctt

SEQ ID NO: 482523 - DNA, 25 bp, Mus musculus
tgatgcggctcctggaccttcgctg

SEQ ID NO: 482524 - DNA, 25 bp, Mus musculus
tgatgcggttctgtccacagagtgc

SEQ ID NO: 482525 - DNA, 25 bp, Mus musculus
tgatgctactaccacactccgtggg

SEQ ID NO: 482526 - DNA, 25 bp, Mus musculus
tgatgctactgctctgccactggga

SEQ ID NO: 482527 - DNA, 25 bp, Mus musculus
tgatgctcaccagcaaacaggcggg

SEQ ID NO: 482528 - DNA, 25 bp, Mus musculus
tgatgctccacatgctcaacggctg

SEQ ID NO: 482529 - DNA, 25 bp, Mus musculus
tgatgctccccaaaaggtactggtt

SEQ ID NO: 482530 - DNA, 25 bp, Mus musculus
tgatgctgaagagaccaagactggc

SEQ ID NO: 482531 - DNA, 25 bp, Mus musculus
tgatgctgacgatcctctcacagac

SEQ ID NO: 482532 - DNA, 25 bp, Mus musculus
tgatgctgactgatctttcctcttc

SEQ ID NO: 482533 - DNA, 25 bp, Mus musculus
tgatgctgcaagtgggcctgatcct

SEQ ID NO: 482534 - DNA, 25 bp, Mus musculus
tgatgctgcagtgaccaacgtggag

SEQ ID NO: 482535 - DNA, 25 bp, Mus musculus
tgatgctgcctgtgcaagaatcttg

SEQ ID NO: 482536 - DNA, 25 bp, Mus musculus
tgatgctgctagtagaaccaggtgc

SEQ ID NO: 482537 - DNA, 25 bp, Mus musculus
tgatgctgcttctgtgccactggga

SEQ ID NO: 482538 - DNA, 25 bp, Mus musculus
tgatgctggcatatgcttcatcccc

SEQ ID NO: 482539 - DNA, 25 bp, Mus musculus
tgatgctgggcatgcgagactccat

SEQ ID NO: 482540 - DNA, 25 bp, Mus musculus
tgatgctgttctgaattgcccagcc

SEQ ID NO: 482541 - DNA, 25 bp, Mus musculus
tgatgcttagcctgcagccctgtgt

SEQ ID NO: 482542 - DNA, 25 bp, Mus musculus
tgatgcttccctgtgcagctctttc

SEQ ID NO: 482543 - DNA, 25 bp, Mus musculus
tgatggaacggtcctttctcttgtt

SEQ ID NO: 482544 - DNA, 25 bp, Mus musculus
tgatggaactcaggctctcaagtct

SEQ ID NO: 482545 - DNA, 25 bp, Mus musculus
tgatggaagataaactgcccggact

SEQ ID NO: 482546 - DNA, 25 bp, Mus musculus
tgatggaatgatcggagctctcgcc

SEQ ID NO: 482547 - DNA, 25 bp, Mus musculus
tgatggaccccgacgtcaggatctt

SEQ ID NO: 482548 - DNA, 25 bp, Mus musculus
tgatggaccgaatgctgtgccgtgc

SEQ ID NO: 482549 - DNA, 25 bp, Mus musculus
tgatggactggtacccgacactgtc

SEQ ID NO: 482550 - DNA, 25 bp, Mus musculus
tgatggagaccgactcttcgccaag

SEQ ID NO: 482551 - DNA, 25 bp, Mus musculus
tgatggagcaagcacaaaataggcc

SEQ ID NO: 482552 - DNA, 25 bp, Mus musculus
tgatggagccttcgcctcttgagct

SEQ ID NO: 482553 - DNA, 25 bp, Mus musculus
tgatggagctacaaggtggtgcacc

SEQ ID NO: 482554 - DNA, 25 bp, Mus musculus
tgatggagcttagaacccgctggct

SEQ ID NO: 482555 - DNA, 25 bp, Mus musculus
tgatggaggacttccggcaataccg

SEQ ID NO: 482556 - DNA, 25 bp, Mus musculus
tgatggaggagatcgaccggttcca

SEQ ID NO: 482557 - DNA, 25 bp, Mus musculus
tgatggaggagctcaatctgtgtcg

SEQ ID NO: 482558 - DNA, 25 bp, Mus musculus
tgatggagtgacaggaaaaacagct

SEQ ID NO: 482559 - DNA, 25 bp, Mus musculus
tgatggatacttgcttggagcctgg

SEQ ID NO: 482560 - DNA, 25 bp, Mus musculus
tgatggatctgtaacccctggagga

SEQ ID NO: 482561 - DNA, 25 bp, Mus musculus
tgatggatcttctcccaactgctcg

SEQ ID NO: 482562 - DNA, 25 bp, Mus musculus
tgatggcaccatcgatttccgagag

SEQ ID NO: 482563 - DNA, 25 bp, Mus musculus
tgatggcagaagtttccgcagcggc

SEQ ID NO: 482564 - DNA, 25 bp, Mus musculus
tgatggcagccttagcccaagtgga

SEQ ID NO: 482565 - DNA, 25 bp, Mus musculus
tgatggcaggatttggataataaac

SEQ ID NO: 482566 - DNA, 25 bp, Mus musculus
tgatggcagtaccttttttagcttg

SEQ ID NO: 482567 - DNA, 25 bp, Mus musculus
tgatggcagtactaaaagggatgag

SEQ ID NO: 482568 - DNA, 25 bp, Mus musculus
tgatggcataaggaacaaggcagtg

SEQ ID NO: 482569 - DNA, 25 bp, Mus musculus
tgatggcatacgaccggtacgtggc

SEQ ID NO: 482570 - DNA, 25 bp, Mus musculus
tgatggcatccaccgagctgtagat

SEQ ID NO: 482571 - DNA, 25 bp, Mus musculus
tgatggcatcgcacagcagcattgt

SEQ ID NO: 482572 - DNA, 25 bp, Mus musculus
tgatggccacccagactgtcttgac

SEQ ID NO: 482573 - DNA, 25 bp, Mus musculus
tgatggccacttggaccagtccgaa

SEQ ID NO: 482574 - DNA, 25 bp, Mus musculus
tgatggcccaagataaagcaggtgc

SEQ ID NO: 482575 - DNA, 25 bp, Mus musculus
tgatggccgctctcaggatgacatt

SEQ ID NO: 482576 - DNA, 25 bp, Mus musculus
tgatggcctcatggaacagatgtgc

SEQ ID NO: 482577 - DNA, 25 bp, Mus musculus
tgatggcgaccatcgagaaggtccg

SEQ ID NO: 482578 - DNA, 25 bp, Mus musculus
tgatggcgctgaatccgatgcctcg

SEQ ID NO: 482579 - DNA, 25 bp, Mus musculus
tgatggcgcttacctcctagggatg

SEQ ID NO: 482580 - DNA, 25 bp, Mus musculus
tgatggcggtacagctacacagccg

SEQ ID NO: 482581 - DNA, 25 bp, Mus musculus
tgatggcgtggaccgtaaaattacc

SEQ ID NO: 482582 - DNA, 25 bp, Mus musculus
tgatggctaaaggtcacctcctcct

SEQ ID NO: 482583 - DNA, 25 bp, Mus musculus
tgatggctccatggaaatgtgctca

SEQ ID NO: 482584 - DNA, 25 bp, Mus musculus
tgatggctgactaagaaaagtcaga

SEQ ID NO: 482585 - DNA, 25 bp, Mus musculus
tgatggctgcgacacgtctctactg

SEQ ID NO: 482586 - DNA, 25 bp, Mus musculus
tgatggctgctacgtgcaacttccg

SEQ ID NO: 482587 - DNA, 25 bp, Mus musculus
tgatggctggactgacctgcaggaa

SEQ ID NO: 482588 - DNA, 25 bp, Mus musculus
tgatggctgtactctcatagtggga

SEQ ID NO: 482589 - DNA, 25 bp, Mus musculus
tgatgggaagcaccacagtagccct

SEQ ID NO: 482590 - DNA, 25 bp, Mus musculus
tgatgggacccacattgccaaaaca

SEQ ID NO: 482591 - DNA, 25 bp, Mus musculus
tgatgggagctgttttactaccagg

SEQ ID NO: 482592 - DNA, 25 bp, Mus musculus
tgatgggagtacagcagtcagcgca

SEQ ID NO: 482593 - DNA, 25 bp, Mus musculus
tgatgggcagccgtcattacagcaa

SEQ ID NO: 482594 - DNA, 25 bp, Mus musculus
tgatgggccacctgctaaggacggc

SEQ ID NO: 482595 - DNA, 25 bp, Mus musculus
tgatgggccatcagagaagttaccg

SEQ ID NO: 482596 - DNA, 25 bp, Mus musculus
tgatgggccgctgacatgaatttgg

SEQ ID NO: 482597 - DNA, 25 bp, Mus musculus
tgatgggcgcagcagggatgttccc

SEQ ID NO: 482598 - DNA, 25 bp, Mus musculus
tgatggtaagtctcctgcagcgccc

SEQ ID NO: 482599 - DNA, 25 bp, Mus musculus
tgatggtcaacatggccgagctcac

SEQ ID NO: 482600 - DNA, 25 bp, Mus musculus
tgatggtcccacaggtgaactggcc

SEQ ID NO: 482601 - DNA, 25 bp, Mus musculus
tgatggtcctgctcccagagaaggg

SEQ ID NO: 482602 - DNA, 25 bp, Mus musculus
tgatggtgcagggccttgctcttga

SEQ ID NO: 482603 - DNA, 25 bp, Mus musculus
tgatggtgccttcgtgttctcccgg

SEQ ID NO: 482604 - DNA, 25 bp, Mus musculus
tgatggtggcaaaaccccagagttg

SEQ ID NO: 482605 - DNA, 25 bp, Mus musculus
tgatggtggcttttcctggacgctg

SEQ ID NO: 482606 - DNA, 25 bp, Mus musculus
tgatgtacaaaactcactgccagtg

SEQ ID NO: 482607 - DNA, 25 bp, Mus musculus
tgatgtactggagaagcttggagaa

SEQ ID NO: 482608 - DNA, 25 bp, Mus musculus
tgatgtagaattgccctgaagaggg

SEQ ID NO: 482609 - DNA, 25 bp, Mus musculus
tgatgtaggcgttcctcagggcacc

SEQ ID NO: 482610 - DNA, 25 bp, Mus musculus
tgatgtatcccctcagtgaccgcat

SEQ ID NO: 482611 - DNA, 25 bp, Mus musculus
tgatgtatgtacacgtcgcctttga

SEQ ID NO: 482612 - DNA, 25 bp, Mus musculus
tgatgtattggatttcacctcatgt

SEQ ID NO: 482613 - DNA, 25 bp, Mus musculus
tgatgtcaacgtgatcatggctgcc

SEQ ID NO: 482614 - DNA, 25 bp, Mus musculus
tgatgtcacatgagttgggccacgc

SEQ ID NO: 482615 - DNA, 25 bp, Mus musculus
tgatgtcactgacccatgaaccaca

SEQ ID NO: 482616 - DNA, 25 bp, Mus musculus
tgatgtcagccgaagacctggagcc

SEQ ID NO: 482617 - DNA, 25 bp, Mus musculus
tgatgtcatcaagggcaagccggtc

SEQ ID NO: 482618 - DNA, 25 bp, Mus musculus
tgatgtccagaccagcgtacctgag

SEQ ID NO: 482619 - DNA, 25 bp, Mus musculus
tgatgtccaggctttcagtcgggcc

SEQ ID NO: 482620 - DNA, 25 bp, Mus musculus
tgatgtcccctctcgcactgcaggc

SEQ ID NO: 482621 - DNA, 25 bp, Mus musculus
tgatgtccctcacgaagctggctga

SEQ ID NO: 482622 - DNA, 25 bp, Mus musculus
tgatgtcggcctctgcaaaaagcgg

SEQ ID NO: 482623 - DNA, 25 bp, Mus musculus
tgatgtcgttgggaattatgctccc

SEQ ID NO: 482624 - DNA, 25 bp, Mus musculus
tgatgtctaccaggcggagcttcgg

SEQ ID NO: 482625 - DNA, 25 bp, Mus musculus
tgatgtctgagaaagaagctcggtc

SEQ ID NO: 482626 - DNA, 25 bp, Mus musculus
tgatgtgaagctagtcacccagctg

SEQ ID NO: 482627 - DNA, 25 bp, Mus musculus
tgatgtgacatgtgactccccagaa

SEQ ID NO: 482628 - DNA, 25 bp, Mus musculus
tgatgtgatgcagctctgcctgcct

SEQ ID NO: 482629 - DNA, 25 bp, Mus musculus
tgatgtgatgcctctaagcgctctg

SEQ ID NO: 482630 - DNA, 25 bp, Mus musculus
tgatgtgcccaaaggtgccaagacc

SEQ ID NO: 482631 - DNA, 25 bp, Mus musculus
tgatgtgctgccagtgtccagccgg

SEQ ID NO: 482632 - DNA, 25 bp, Mus musculus
tgatgtggacctgcaacctggactg

SEQ ID NO: 482633 - DNA, 25 bp, Mus musculus
tgatgtggactggaacaagacccct

SEQ ID NO: 482634 - DNA, 25 bp, Mus musculus
tgatgtggcacagaggcagcctcgt

SEQ ID NO: 482635 - DNA, 25 bp, Mus musculus
tgatgtggcctatggagctaccggc

SEQ ID NO: 482636 - DNA, 25 bp, Mus musculus
tgatgtggctagatgctgttaacca

SEQ ID NO: 482637 - DNA, 25 bp, Mus musculus
tgatgtggctcgcagaaatgacccc

SEQ ID NO: 482638 - DNA, 25 bp, Mus musculus
tgatgtgggcagacacagctggaac

SEQ ID NO: 482639 - DNA, 25 bp, Mus musculus
tgatgtgggccaaaatcggtcctgt

SEQ ID NO: 482640 - DNA, 25 bp, Mus musculus
tgatgtggtgctacctcgccgtgtc

SEQ ID NO: 482641 - DNA, 25 bp, Mus musculus
tgatgttagcagcaggtttccacct

SEQ ID NO: 482642 - DNA, 25 bp, Mus musculus
tgatgttaggtaggtgaggtttaca

SEQ ID NO: 482643 - DNA, 25 bp, Mus musculus
tgatgttcaagaccagacccgaaga

SEQ ID NO: 482644 - DNA, 25 bp, Mus musculus
tgatgttcccggtacagaatctgac

SEQ ID NO: 482645 - DNA, 25 bp, Mus musculus
tgatgttcctgacacttggtcaaga

SEQ ID NO: 482646 - DNA, 25 bp, Mus musculus
tgatgttctgctccgaaggctgcca

SEQ ID NO: 482647 - DNA, 25 bp, Mus musculus
tgatgttcttaaagcgacagcgctc

SEQ ID NO: 482648 - DNA, 25 bp, Mus musculus
tgatgttgagatggcaccaggcacc

SEQ ID NO: 482649 - DNA, 25 bp, Mus musculus
tgatgttgcgctccacttgcacaca

SEQ ID NO: 482650 - DNA, 25 bp, Mus musculus
tgatgtttacatctgggctcagacg

SEQ ID NO: 482651 - DNA, 25 bp, Mus musculus
tgatgttttaaaggagctcccgtgg

SEQ ID NO: 482652 - DNA, 25 bp, Mus musculus
tgattaaagaatactcgtagccctg

SEQ ID NO: 482653 - DNA, 25 bp, Mus musculus
tgattaaaggcagagacccaggact

SEQ ID NO: 482654 - DNA, 25 bp, Mus musculus
tgattaagatcgaggtgcagaccaa

SEQ ID NO: 482655 - DNA, 25 bp, Mus musculus
tgattaagtacaccctggacccggt

SEQ ID NO: 482656 - DNA, 25 bp, Mus musculus
tgattacaacccgacaaggcctggt

SEQ ID NO: 482657 - DNA, 25 bp, Mus musculus
tgattacactctttcttaaaccgga

SEQ ID NO: 482658 - DNA, 25 bp, Mus musculus
tgattaccaagttcctgcggaggag

SEQ ID NO: 482659 - DNA, 25 bp, Mus musculus
tgattaccaccactgagcgaagcca

SEQ ID NO: 482660 - DNA, 25 bp, Mus musculus
tgattaccagctcaaggccattgtg

SEQ ID NO: 482661 - DNA, 25 bp, Mus musculus
tgattacccatcgtccctagagctg

SEQ ID NO: 482662 - DNA, 25 bp, Mus musculus
tgattactaagagaccctacaggct

SEQ ID NO: 482663 - DNA, 25 bp, Mus musculus
tgattactctaagtgagccgcgaga

SEQ ID NO: 482664 - DNA, 25 bp, Mus musculus
tgattactgagcctgacaaactgcg

SEQ ID NO: 482665 - DNA, 25 bp, Mus musculus
tgattagagttacagtggactcccc

SEQ ID NO: 482666 - DNA, 25 bp, Mus musculus
tgattagagttgtcagttggtgtgc

SEQ ID NO: 482667 - DNA, 25 bp, Mus musculus
tgattataaagtccctagccaggcc

SEQ ID NO: 482668 - DNA, 25 bp, Mus musculus
tgattatgccgaccagcgactgtac

SEQ ID NO: 482669 - DNA, 25 bp, Mus musculus
tgattattactctgccagcggcatg

SEQ ID NO: 482670 - DNA, 25 bp, Mus musculus
tgattattcacagtcgtcccgggct

SEQ ID NO: 482671 - DNA, 25 bp, Mus musculus
tgattattgaagaagggcccagatc

SEQ ID NO: 482672 - DNA, 25 bp, Mus musculus
tgattattgcatgaagcggcaccta

SEQ ID NO: 482673 - DNA, 25 bp, Mus musculus
tgattattttgagagccgtgcggcc

SEQ ID NO: 482674 - DNA, 25 bp, Mus musculus
tgattcaacacgaatgtcagccgtg

SEQ ID NO: 482675 - DNA, 25 bp, Mus musculus
tgattcaagttgagccacaggccta

SEQ ID NO: 482676 - DNA, 25 bp, Mus musculus
tgattcacataacaggccggcttcg

SEQ ID NO: 482677 - DNA, 25 bp, Mus musculus
tgattcaccccaagagtggccggtc

SEQ ID NO: 482678 - DNA, 25 bp, Mus musculus
tgattcaccccgagtctctctggct

SEQ ID NO: 482679 - DNA, 25 bp, Mus musculus
tgattcagaaatggctcagctaccc

SEQ ID NO: 482680 - DNA, 25 bp, Mus musculus
tgattcagaacgtgaggcacacctg

SEQ ID NO: 482681 - DNA, 25 bp, Mus musculus
tgattcagcagacagaacagcttag

SEQ ID NO: 482682 - DNA, 25 bp, Mus musculus
tgattcatcgcctgttctccgagcc

SEQ ID NO: 482683 - DNA, 25 bp, Mus musculus
tgattccaaataaaacctgagcccc

SEQ ID NO: 482684 - DNA, 25 bp, Mus musculus
tgattccagcaagcagctactaggg

SEQ ID NO: 482685 - DNA, 25 bp, Mus musculus
tgattccagtggtatctgtcccctt

SEQ ID NO: 482686 - DNA, 25 bp, Mus musculus
tgattccctggctgaaacgagaact

SEQ ID NO: 482687 - DNA, 25 bp, Mus musculus
tgattcctacgatccaaccatagag

SEQ ID NO: 482688 - DNA, 25 bp, Mus musculus
tgattcctatccaaagtgagccgcc

SEQ ID NO: 482689 - DNA, 25 bp, Mus musculus
tgattcctgccctccaaggtctgga

SEQ ID NO: 482690 - DNA, 25 bp, Mus musculus
tgattcgagcacatgtaggtagttg

SEQ ID NO: 482691 - DNA, 25 bp, Mus musculus
tgattcgcgcagacactcaagggtg

SEQ ID NO: 482692 - DNA, 25 bp, Mus musculus
tgattcggaactacacctgggtgcc

SEQ ID NO: 482693 - DNA, 25 bp, Mus musculus
tgattcgtgccagccagagctaagc

SEQ ID NO: 482694 - DNA, 25 bp, Mus musculus
tgattctcaaacaaccccaagctct

SEQ ID NO: 482695 - DNA, 25 bp, Mus musculus
tgattctcagcaccaacttggtgac

SEQ ID NO: 482696 - DNA, 25 bp, Mus musculus
tgattctctgaaccgcctgctggag

SEQ ID NO: 482697 - DNA, 25 bp, Mus musculus
tgattctgatgaggacgccgagcac

SEQ ID NO: 482698 - DNA, 25 bp, Mus musculus
tgattctggacaggatagagctgct

SEQ ID NO: 482699 - DNA, 25 bp, Mus musculus
tgattctttcccacctaagtgaggt

SEQ ID NO: 482700 - DNA, 25 bp, Mus musculus
tgattgaagcacaggagagttttgc

SEQ ID NO: 482701 - DNA, 25 bp, Mus musculus
tgattgaagcatacccacctgcaga

SEQ ID NO: 482702 - DNA, 25 bp, Mus musculus
tgattgaattttacgccccttggtg

SEQ ID NO: 482703 - DNA, 25 bp, Mus musculus
tgattgacagcctgagtcgcacggc

SEQ ID NO: 482704 - DNA, 25 bp, Mus musculus
tgattgacatccacagccattgagt

SEQ ID NO: 482705 - DNA, 25 bp, Mus musculus
tgattgaccggaagccacgtctgct

SEQ ID NO: 482706 - DNA, 25 bp, Mus musculus
tgattgacgccaccgggaaactggt

SEQ ID NO: 482707 - DNA, 25 bp, Mus musculus
tgattgagaaaaagagacgtgaccg

SEQ ID NO: 482708 - DNA, 25 bp, Mus musculus
tgattgagctacgtctccgagctgg

SEQ ID NO: 482709 - DNA, 25 bp, Mus musculus
tgattgagtattaccagcagcttgc

SEQ ID NO: 482710 - DNA, 25 bp, Mus musculus
tgattgagtggccagaacatcccaa

SEQ ID NO: 482711 - DNA, 25 bp, Mus musculus
tgattgatcgcatcgctgggctcag

SEQ ID NO: 482712 - DNA, 25 bp, Mus musculus
tgattgcagccctagactatggtcg

SEQ ID NO: 482713 - DNA, 25 bp, Mus musculus
tgattgccatgaacctggccggcgc

SEQ ID NO: 482714 - DNA, 25 bp, Mus musculus
tgattgccccagcatttattggttg

SEQ ID NO: 482715 - DNA, 25 bp, Mus musculus
tgattgctcgagatgggctcaccat

SEQ ID NO: 482716 - DNA, 25 bp, Mus musculus
tgattgctctgcacatgaccacggc

SEQ ID NO: 482717 - DNA, 25 bp, Mus musculus
tgattgctgagttgaggccgtagaa

SEQ ID NO: 482718 - DNA, 25 bp, Mus musculus
tgattgctgggatgaaagatgtcac

SEQ ID NO: 482719 - DNA, 25 bp, Mus musculus
tgattggacgctagggatgtcagct

SEQ ID NO: 482720 - DNA, 25 bp, Mus musculus
tgattggcccttacagcataggctt

SEQ ID NO: 482721 - DNA, 25 bp, Mus musculus
tgattggcctctgacagagcgtccc

SEQ ID NO: 482722 - DNA, 25 bp, Mus musculus
tgattggcttgacagatttttcccc

SEQ ID NO: 482723 - DNA, 25 bp, Mus musculus
tgattgggctcatcttgcatcacca

SEQ ID NO: 482724 - DNA, 25 bp, Mus musculus
tgattgggttcgagaccagcgtcag

SEQ ID NO: 482725 - DNA, 25 bp, Mus musculus
tgattggttaccaccccgaggagct

SEQ ID NO: 482726 - DNA, 25 bp, Mus musculus
tgattgtccccaagaatgcgactgt

SEQ ID NO: 482727 - DNA, 25 bp, Mus musculus
tgattgtggaatcccgctgacgcat

SEQ ID NO: 482728 - DNA, 25 bp, Mus musculus
tgattgttccctttgcagaccctgc

SEQ ID NO: 482729 - DNA, 25 bp, Mus musculus
tgattgtttgttcctgctggtcgca

SEQ ID NO: 482730 - DNA, 25 bp, Mus musculus
tgatttaaccgctggcttgggacgt

SEQ ID NO: 482731 - DNA, 25 bp, Mus musculus
tgatttaagccatttctgaaccggg

SEQ ID NO: 482732 - DNA, 25 bp, Mus musculus
tgatttaatagcagggcgaggccgc

SEQ ID NO: 482733 - DNA, 25 bp, Mus musculus
tgatttacacatccccaggatctcg

SEQ ID NO: 482734 - DNA, 25 bp, Mus musculus
tgatttagcacggatttgacggagc

SEQ ID NO: 482735 - DNA, 25 bp, Mus musculus
tgatttataagccagtgccccgcag

SEQ ID NO: 482736 - DNA, 25 bp, Mus musculus
tgatttatgtctttgcaggccggct

SEQ ID NO: 482737 - DNA, 25 bp, Mus musculus
tgatttcaatctctgtggcccacac

SEQ ID NO: 482738 - DNA, 25 bp, Mus musculus
tgatttcaccccaatggacagaggg

SEQ ID NO: 482739 - DNA, 25 bp, Mus musculus
tgatttccaggaaaagccccagaag

SEQ ID NO: 482740 - DNA, 25 bp, Mus musculus
tgatttccgatgcttcaaggacaga

SEQ ID NO: 482741 - DNA, 25 bp, Mus musculus
tgatttcctcatctcggcggaccgg

SEQ ID NO: 482742 - DNA, 25 bp, Mus musculus
tgatttcgacaacaagcccatggtc

SEQ ID NO: 482743 - DNA, 25 bp, Mus musculus
tgatttctaatacggcgtagggtaa

SEQ ID NO: 482744 - DNA, 25 bp, Mus musculus
tgatttgaaagttccgccctgcttg

SEQ ID NO: 482745 - DNA, 25 bp, Mus musculus
tgatttgctttggatccacacaagg

SEQ ID NO: 482746 - DNA, 25 bp, Mus musculus
tgatttggagatggccaaaataaag

SEQ ID NO: 482747 - DNA, 25 bp, Mus musculus
tgatttgtccttatgtcccagccca

SEQ ID NO: 482748 - DNA, 25 bp, Mus musculus
tgatttgtcgagaatacccagggct

SEQ ID NO: 482749 - DNA, 25 bp, Mus musculus
tgattttaaccaccctgtgagccag

SEQ ID NO: 482750 - DNA, 25 bp, Mus musculus
tgattttaatgtaggtacttggaac

SEQ ID NO: 482751 - DNA, 25 bp, Mus musculus
tgattttcaaacttaagcttctccc

SEQ ID NO: 482752 - DNA, 25 bp, Mus musculus
tgattttcatggctgcctgcagctg

SEQ ID NO: 482753 - DNA, 25 bp, Mus musculus
tgattttccaattggccaaggagga

SEQ ID NO: 482754 - DNA, 25 bp, Mus musculus
tgattttcggctggagaccacggct

SEQ ID NO: 482755 - DNA, 25 bp, Mus musculus
tgattttcttcatctcacaggaggg

SEQ ID NO: 482756 - DNA, 25 bp, Mus musculus
tgattttgaagaggcggcagagccc

SEQ ID NO: 482757 - DNA, 25 bp, Mus musculus
tgattttgggcatagcaaccacctt

SEQ ID NO: 482758 - DNA, 25 bp, Mus musculus
tgatttttaaaatgggaaactgtgg

SEQ ID NO: 482759 - DNA, 25 bp, Mus musculus
tgcaaaaaataaacctcgtccggct

SEQ ID NO: 482760 - DNA, 25 bp, Mus musculus
tgcaaaaacaactcagggaccaggg

SEQ ID NO: 482761 - DNA, 25 bp, Mus musculus
tgcaaaaacagctgcaagcgtgggc

SEQ ID NO: 482762 - DNA, 25 bp, Mus musculus
tgcaaaaccgatacacagccgtggg

SEQ ID NO: 482763 - DNA, 25 bp, Mus musculus
tgcaaaacgtccaaagccagcatct

SEQ ID NO: 482764 - DNA, 25 bp, Mus musculus
tgcaaaacttgcaccagctgtggca

SEQ ID NO: 482765 - DNA, 25 bp, Mus musculus
tgcaaaagctcgctcggcttctcgt

SEQ ID NO: 482766 - DNA, 25 bp, Mus musculus
tgcaaaaggccctatgatggatccc

SEQ ID NO: 482767 - DNA, 25 bp, Mus musculus
tgcaaaatgggattcgggcctgacc

SEQ ID NO: 482768 - DNA, 25 bp, Mus musculus
tgcaaacacaaggatcagcgaccca

SEQ ID NO: 482769 - DNA, 25 bp, Mus musculus
tgcaaacacggagggatctgtgacc

SEQ ID NO: 482770 - DNA, 25 bp, Mus musculus
tgcaaacagcatgggtcagaggtca

SEQ ID NO: 482771 - DNA, 25 bp, Mus musculus
tgcaaacagccaaccagatgctaag

SEQ ID NO: 482772 - DNA, 25 bp, Mus musculus
tgcaaacagtgccacgaagaaagac

SEQ ID NO: 482773 - DNA, 25 bp, Mus musculus
tgcaaacagtgtctcaatgaggtct

SEQ ID NO: 482774 - DNA, 25 bp, Mus musculus
tgcaaacatcaactcaaaacttcgc

SEQ ID NO: 482775 - DNA, 25 bp, Mus musculus
tgcaaacatgctgtacctccggaag

SEQ ID NO: 482776 - DNA, 25 bp, Mus musculus
tgcaaacatggagagcggttggcaa

SEQ ID NO: 482777 - DNA, 25 bp, Mus musculus
tgcaaaccaggagaaaaggagactc

SEQ ID NO: 482778 - DNA, 25 bp, Mus musculus
tgcaaacccacatggaacgggcggt

SEQ ID NO: 482779 - DNA, 25 bp, Mus musculus
tgcaaaccccaaagatccggtggaa

SEQ ID NO: 482780 - DNA, 25 bp, Mus musculus
tgcaaaccctcttgagaacaacggg

SEQ ID NO: 482781 - DNA, 25 bp, Mus musculus
tgcaaacccttagctgtagtccaga

SEQ ID NO: 482782 - DNA, 25 bp, Mus musculus
tgcaaaccgggccattaggactcaa

SEQ ID NO: 482783 - DNA, 25 bp, Mus musculus
tgcaaacgatctgaagccaaaggtc

SEQ ID NO: 482784 - DNA, 25 bp, Mus musculus
tgcaaacggagaggatcaggcttcc

SEQ ID NO: 482785 - DNA, 25 bp, Mus musculus
tgcaaacggtatggccatcgaacag

SEQ ID NO: 482786 - DNA, 25 bp, Mus musculus
tgcaaacgtttgtagtggaccagat

SEQ ID NO: 482787 - DNA, 25 bp, Mus musculus
tgcaaactaagctgcgggagctgca

SEQ ID NO: 482788 - DNA, 25 bp, Mus musculus
tgcaaactcagctgtcctgaaatgg

SEQ ID NO: 482789 - DNA, 25 bp, Mus musculus
tgcaaactgccgtatccgaagggtt

SEQ ID NO: 482790 - DNA, 25 bp, Mus musculus
tgcaaactttgaagtttttgccagg

SEQ ID NO: 482791 - DNA, 25 bp, Mus musculus
tgcaaagaacagtaacctagccagc

SEQ ID NO: 482792 - DNA, 25 bp, Mus musculus
tgcaaagaagtccacagaacccaag

SEQ ID NO: 482793 - DNA, 25 bp, Mus musculus
tgcaaagaatcaatccaagcctggg

SEQ ID NO: 482794 - DNA, 25 bp, Mus musculus
tgcaaagacatgagcgaggccttcc

SEQ ID NO: 482795 - DNA, 25 bp, Mus musculus
tgcaaagagagctagaggagacctc

SEQ ID NO: 482796 - DNA, 25 bp, Mus musculus
tgcaaagagcactggatcgggcctc

SEQ ID NO: 482797 - DNA, 25 bp, Mus musculus
tgcaaagcaaagctgcgcctggtcc

SEQ ID NO: 482798 - DNA, 25 bp, Mus musculus
tgcaaagcagctcctaggtgatcca

SEQ ID NO: 482799 - DNA, 25 bp, Mus musculus
tgcaaagcctgcaacctgggcgaag

SEQ ID NO: 482800 - DNA, 25 bp, Mus musculus
tgcaaagcgtcaagaacggtgtgcc

SEQ ID NO: 482801 - DNA, 25 bp, Mus musculus
tgcaaaggaaggttttactcaggct

SEQ ID NO: 482802 - DNA, 25 bp, Mus musculus
tgcaaaggcagatcgaggtaaggct

SEQ ID NO: 482803 - DNA, 25 bp, Mus musculus
tgcaaaggccgatgagctgcctgtt

SEQ ID NO: 482804 - DNA, 25 bp, Mus musculus
tgcaaagggaacatacggctgcctg

SEQ ID NO: 482805 - DNA, 25 bp, Mus musculus
tgcaaagtcatcagggaacccagct

SEQ ID NO: 482806 - DNA, 25 bp, Mus musculus
tgcaaagtgcaggtcaacgaggtat

SEQ ID NO: 482807 - DNA, 25 bp, Mus musculus
tgcaaagttgtgactttcccctaaa

SEQ ID NO: 482808 - DNA, 25 bp, Mus musculus
tgcaaatatctcttggagaccctgc

SEQ ID NO: 482809 - DNA, 25 bp, Mus musculus
tgcaaatcaaaaggctgagtcagga

SEQ ID NO: 482810 - DNA, 25 bp, Mus musculus
tgcaaatgcaagagtcccctaagga

SEQ ID NO: 482811 - DNA, 25 bp, Mus musculus
tgcaaatgccgtattcttctaaggg

SEQ ID NO: 482812 - DNA, 25 bp, Mus musculus
tgcaaatggaaacactcggccacct

SEQ ID NO: 482813 - DNA, 25 bp, Mus musculus
tgcaaatggagcatatggaccgcct

SEQ ID NO: 482814 - DNA, 25 bp, Mus musculus
tgcaaatggcaatggcatataccct

SEQ ID NO: 482815 - DNA, 25 bp, Mus musculus
tgcaaatgggaacaagatcagcatc

SEQ ID NO: 482816 - DNA, 25 bp, Mus musculus
tgcaaatgtcttccgggtccgaacc

SEQ ID NO: 482817 - DNA, 25 bp, Mus musculus
tgcaaattcatcgagacctctgcgg

SEQ ID NO: 482818 - DNA, 25 bp, Mus musculus
tgcaaattgggccataggcacccct

SEQ ID NO: 482819 - DNA, 25 bp, Mus musculus
tgcaaattttcaaggctaagcagcc

SEQ ID NO: 482820 - DNA, 25 bp, Mus musculus
tgcaaattttgtcttcagtgatggg

SEQ ID NO: 482821 - DNA, 25 bp, Mus musculus
tgcaacaacaaagacagcctagcgt

SEQ ID NO: 482822 - DNA, 25 bp, Mus musculus
tgcaacaactgcatgtaagatcatc

SEQ ID NO: 482823 - DNA, 25 bp, Mus musculus
tgcaacaagaccttgaccacgggcg

SEQ ID NO: 482824 - DNA, 25 bp, Mus musculus
tgcaacaagccagtctcccgtgatt

SEQ ID NO: 482825 - DNA, 25 bp, Mus musculus
tgcaacacctaagatctcacacggg

SEQ ID NO: 482826 - DNA, 25 bp, Mus musculus
tgcaacacgtgagtagcagcctggc

SEQ ID NO: 482827 - DNA, 25 bp, Mus musculus
tgcaacagctcaaggaacagtaccg

SEQ ID NO: 482828 - DNA, 25 bp, Mus musculus
tgcaacaggcggcttggccaagcct

SEQ ID NO: 482829 - DNA, 25 bp, Mus musculus
tgcaacagtgctaacagcaccagtg

SEQ ID NO: 482830 - DNA, 25 bp, Mus musculus
tgcaacagtgtgctctcaaacctca

SEQ ID NO: 482831 - DNA, 25 bp, Mus musculus
tgcaacatctacagaatggactgga

SEQ ID NO: 482832 - DNA, 25 bp, Mus musculus
tgcaacattcgcagatggtcctcgg

SEQ ID NO: 482833 - DNA, 25 bp, Mus musculus
tgcaaccaaatgatgaaacgccggg

SEQ ID NO: 482834 - DNA, 25 bp, Mus musculus
tgcaaccacctacggagctacaagt

SEQ ID NO: 482835 - DNA, 25 bp, Mus musculus
tgcaaccacctatgggaccgaaagg

SEQ ID NO: 482836 - DNA, 25 bp, Mus musculus
tgcaaccagatatccatggaggctc

SEQ ID NO: 482837 - DNA, 25 bp, Mus musculus
tgcaaccctaagacgacagcggaat

SEQ ID NO: 482838 - DNA, 25 bp, Mus musculus
tgcaaccgtctcttggattcccact

SEQ ID NO: 482839 - DNA, 25 bp, Mus musculus
tgcaacctctcttggcagatgccct

SEQ ID NO: 482840 - DNA, 25 bp, Mus musculus
tgcaacctgctccaaaagtgaacct

SEQ ID NO: 482841 - DNA, 25 bp, Mus musculus
tgcaaccttcgttccccgtgtgctg

SEQ ID NO: 482842 - DNA, 25 bp, Mus musculus
tgcaaccttgaaatgctccaggaag

SEQ ID NO: 482843 - DNA, 25 bp, Mus musculus
tgcaacgacggcttctgcgaactgt

SEQ ID NO: 482844 - DNA, 25 bp, Mus musculus
tgcaacggcaacctgggcaacatga

SEQ ID NO: 482845 - DNA, 25 bp, Mus musculus
tgcaacgtcacgagcagcagtctgt

SEQ ID NO: 482846 - DNA, 25 bp, Mus musculus
tgcaacgtgtgcctggatccgataa

SEQ ID NO: 482847 - DNA, 25 bp, Mus musculus
tgcaacgttagcaacagagccagct

SEQ ID NO: 482848 - DNA, 25 bp, Mus musculus
tgcaactaagcaacagcatcgccca

SEQ ID NO: 482849 - DNA, 25 bp, Mus musculus
tgcaactacagcaaaggcggcaggg

SEQ ID NO: 482850 - DNA, 25 bp, Mus musculus
tgcaactactgctgtgggcagcgca

SEQ ID NO: 482851 - DNA, 25 bp, Mus musculus
tgcaactagggacgaagctgcctct

SEQ ID NO: 482852 - DNA, 25 bp, Mus musculus
tgcaactcagacttgagccaggagc

SEQ ID NO: 482853 - DNA, 25 bp, Mus musculus
tgcaactcgttcctgcgggacaagg

SEQ ID NO: 482854 - DNA, 25 bp, Mus musculus
tgcaactctcacagctaacatgatg

SEQ ID NO: 482855 - DNA, 25 bp, Mus musculus
tgcaactctggtgaacgaagcggac

SEQ ID NO: 482856 - DNA, 25 bp, Mus musculus
tgcaactgggaccaaaatgtctttc

SEQ ID NO: 482857 - DNA, 25 bp, Mus musculus
tgcaactgtctagggcgctctggtg

SEQ ID NO: 482858 - DNA, 25 bp, Mus musculus
tgcaacttaacttgtcaacactggg

SEQ ID NO: 482859 - DNA, 25 bp, Mus musculus
tgcaactttacgacctggcctcagg

SEQ ID NO: 482860 - DNA, 25 bp, Mus musculus
tgcaagaaaacgcacgccaagggtg

SEQ ID NO: 482861 - DNA, 25 bp, Mus musculus
tgcaagaaacatgggttcagagagg

SEQ ID NO: 482862 - DNA, 25 bp, Mus musculus
tgcaagaaaggtgacgcaaccagat

SEQ ID NO: 482863 - DNA, 25 bp, Mus musculus
tgcaagaacccacgcccagggagtg

SEQ ID NO: 482864 - DNA, 25 bp, Mus musculus
tgcaagaagccagatccacctagga

SEQ ID NO: 482865 - DNA, 25 bp, Mus musculus
tgcaagaaggatggcttcggtaccc

SEQ ID NO: 482866 - DNA, 25 bp, Mus musculus
tgcaagaatgaatgcttcagatgct

SEQ ID NO: 482867 - DNA, 25 bp, Mus musculus
tgcaagaatgtaaccgaagacgacg

SEQ ID NO: 482868 - DNA, 25 bp, Mus musculus
tgcaagaatttaaaccagggctggt

SEQ ID NO: 482869 - DNA, 25 bp, Mus musculus
tgcaagacaaagctagactggcctg

SEQ ID NO: 482870 - DNA, 25 bp, Mus musculus
tgcaagacacacgtccttctgctgg

SEQ ID NO: 482871 - DNA, 25 bp, Mus musculus
tgcaagaccttgtcccaggcagtag

SEQ ID NO: 482872 - DNA, 25 bp, Mus musculus
tgcaagactgacagagcctgactcc

SEQ ID NO: 482873 - DNA, 25 bp, Mus musculus
tgcaagacttgtgagcacagcccgt

SEQ ID NO: 482874 - DNA, 25 bp, Mus musculus
tgcaagagaacgaaaacgggactgt

SEQ ID NO: 482875 - DNA, 25 bp, Mus musculus
tgcaagagaccgaccggatcctggt

SEQ ID NO: 482876 - DNA, 25 bp, Mus musculus
tgcaagagactgaggttaccccgga

SEQ ID NO: 482877 - DNA, 25 bp, Mus musculus
tgcaagagctgcaactatgtgctgg

SEQ ID NO: 482878 - DNA, 25 bp, Mus musculus
tgcaagaggatccacgtcagccatt

SEQ ID NO: 482879 - DNA, 25 bp, Mus musculus
tgcaagatatcacagagcagcagga

SEQ ID NO: 482880 - DNA, 25 bp, Mus musculus
tgcaagatcaacgaccagaagtggt

SEQ ID NO: 482881 - DNA, 25 bp, Mus musculus
tgcaagatcctggtagccacagatg

SEQ ID NO: 482882 - DNA, 25 bp, Mus musculus
tgcaagatcgctgacttcgggctgg

SEQ ID NO: 482883 - DNA, 25 bp, Mus musculus
tgcaagatgcactagccggctgaag

SEQ ID NO: 482884 - DNA, 25 bp, Mus musculus
tgcaagcaaagtgacagcctctggg

SEQ ID NO: 482885 - DNA, 25 bp, Mus musculus
tgcaagcacaagagcttgaacgtca

SEQ ID NO: 482886 - DNA, 25 bp, Mus musculus
tgcaagcagcatccatatacggcgc

SEQ ID NO: 482887 - DNA, 25 bp, Mus musculus
tgcaagcatggacccaaacagttcc

SEQ ID NO: 482888 - DNA, 25 bp, Mus musculus
tgcaagcatggctgctccgtctggg

SEQ ID NO: 482889 - DNA, 25 bp, Mus musculus
tgcaagccaggagatgggatcgaca

SEQ ID NO: 482890 - DNA, 25 bp, Mus musculus
tgcaagcccctaacaaagacgatat

SEQ ID NO: 482891 - DNA, 25 bp, Mus musculus
tgcaagcccgtgatgaagaaaagtc

SEQ ID NO: 482892 - DNA, 25 bp, Mus musculus
tgcaagcctcaatccagccaaagga

SEQ ID NO: 482893 - DNA, 25 bp, Mus musculus
tgcaagcctggcagcttgtgtttct

SEQ ID NO: 482894 - DNA, 25 bp, Mus musculus
tgcaagcgcttggtgatgctgcctc

SEQ ID NO: 482895 - DNA, 25 bp, Mus musculus
tgcaagcggccatagaggagaacgt

SEQ ID NO: 482896 - DNA, 25 bp, Mus musculus
tgcaagcggctggaaactctggact

SEQ ID NO: 482897 - DNA, 25 bp, Mus musculus
tgcaagctgaccgtgtagacaagag

SEQ ID NO: 482898 - DNA, 25 bp, Mus musculus
tgcaagcttactgggaggcagacct

SEQ ID NO: 482899 - DNA, 25 bp, Mus musculus
tgcaaggacaagtctgacgaggccg

SEQ ID NO: 482900 - DNA, 25 bp, Mus musculus
tgcaaggaccgaatccagaggcagc

SEQ ID NO: 482901 - DNA, 25 bp, Mus musculus
tgcaaggagaatgtccagatttgaa

SEQ ID NO: 482902 - DNA, 25 bp, Mus musculus
tgcaaggatcttggccgtggtgact

SEQ ID NO: 482903 - DNA, 25 bp, Mus musculus
tgcaaggcacatagcacaagctggg

SEQ ID NO: 482904 - DNA, 25 bp, Mus musculus
tgcaaggcatactgctcaagaccgg

SEQ ID NO: 482905 - DNA, 25 bp, Mus musculus
tgcaaggcattcgaagggacagata

SEQ ID NO: 482906 - DNA, 25 bp, Mus musculus
tgcaaggcccagtggatgagaatcc

SEQ ID NO: 482907 - DNA, 25 bp, Mus musculus
tgcaaggcttctccatgtggcggca

SEQ ID NO: 482908 - DNA, 25 bp, Mus musculus
tgcaaggcttctgggaggtcctctg

SEQ ID NO: 482909 - DNA, 25 bp, Mus musculus
tgcaagggacaaaaacagggaccgc

SEQ ID NO: 482910 - DNA, 25 bp, Mus musculus
tgcaagggacgatcgaaaagcctct

SEQ ID NO: 482911 - DNA, 25 bp, Mus musculus
tgcaagggcacaaacaggcgatggc

SEQ ID NO: 482912 - DNA, 25 bp, Mus musculus
tgcaagggcccttattgagaggagc

SEQ ID NO: 482913 - DNA, 25 bp, Mus musculus
tgcaagggccttgaataatgtaccc

SEQ ID NO: 482914 - DNA, 25 bp, Mus musculus
tgcaagggctgcaaatgcacgaact

SEQ ID NO: 482915 - DNA, 25 bp, Mus musculus
tgcaagggctggaggtttcacacac

SEQ ID NO: 482916 - DNA, 25 bp, Mus musculus
tgcaagggtcagagcagatgatgct

SEQ ID NO: 482917 - DNA, 25 bp, Mus musculus
tgcaaggtgtctacgttaagagccc

SEQ ID NO: 482918 - DNA, 25 bp, Mus musculus
tgcaagtaaatcagctaagcgagcg

SEQ ID NO: 482919 - DNA, 25 bp, Mus musculus
tgcaagtacggcgagaagtgccagt

SEQ ID NO: 482920 - DNA, 25 bp, Mus musculus
tgcaagtatcttggttggccctcat

SEQ ID NO: 482921 - DNA, 25 bp, Mus musculus
tgcaagtgcaagaggtacacccgtc

SEQ ID NO: 482922 - DNA, 25 bp, Mus musculus
tgcaagtgctaacgaaacgctatcc

SEQ ID NO: 482923 - DNA, 25 bp, Mus musculus
tgcaagtgctttttgtggaacagct

SEQ ID NO: 482924 - DNA, 25 bp, Mus musculus
tgcaagtgtggcctatttttgggac

SEQ ID NO: 482925 - DNA, 25 bp, Mus musculus
tgcaagtgttgcttctacagagcag

SEQ ID NO: 482926 - DNA, 25 bp, Mus musculus
tgcaagttacagttccaaggccaga

SEQ ID NO: 482927 - DNA, 25 bp, Mus musculus
tgcaagttcccatcatcccaggagg

SEQ ID NO: 482928 - DNA, 25 bp, Mus musculus
tgcaataccgactgactgacctggg

SEQ ID NO: 482929 - DNA, 25 bp, Mus musculus
tgcaatagcaggtggaaccttaact

SEQ ID NO: 482930 - DNA, 25 bp, Mus musculus
tgcaataggatccaacgcagcaccg

SEQ ID NO: 482931 - DNA, 25 bp, Mus musculus
tgcaatcactgtatccaacggaggg

SEQ ID NO: 482932 - DNA, 25 bp, Mus musculus
tgcaatcattaacacgctggcggtc

SEQ ID NO: 482933 - DNA, 25 bp, Mus musculus
tgcaatcctaaatagactagtcctc

SEQ ID NO: 482934 - DNA, 25 bp, Mus musculus
tgcaatcctgtcaggtagccacctt

SEQ ID NO: 482935 - DNA, 25 bp, Mus musculus
tgcaatccttgtcacgagcagctga

SEQ ID NO: 482936 - DNA, 25 bp, Mus musculus
tgcaatcgagaagcaagctcaccgg

SEQ ID NO: 482937 - DNA, 25 bp, Mus musculus
tgcaatcgcagagcagtttccaagt

SEQ ID NO: 482938 - DNA, 25 bp, Mus musculus
tgcaatgaatacatgcccagccgtg

SEQ ID NO: 482939 - DNA, 25 bp, Mus musculus
tgcaatgagttacaaaggctccacc

SEQ ID NO: 482940 - DNA, 25 bp, Mus musculus
tgcaatgcaggctacattgctggct

SEQ ID NO: 482941 - DNA, 25 bp, Mus musculus
tgcaatgcaggtaatcttcacatgt

SEQ ID NO: 482942 - DNA, 25 bp, Mus musculus
tgcaatgccgtttctcctgacaagg

SEQ ID NO: 482943 - DNA, 25 bp, Mus musculus
tgcaatgctgagagaagtccaacct

SEQ ID NO: 482944 - DNA, 25 bp, Mus musculus
tgcaatggagaccacccggttgctc

SEQ ID NO: 482945 - DNA, 25 bp, Mus musculus
tgcaatggatgtagccacagggcag

SEQ ID NO: 482946 - DNA, 25 bp, Mus musculus
tgcaatggcgaccagtggctttctc

SEQ ID NO: 482947 - DNA, 25 bp, Mus musculus
tgcaatggcggctaggtgattcccc

SEQ ID NO: 482948 - DNA, 25 bp, Mus musculus
tgcaattaagcaagtacctgttgag

SEQ ID NO: 482949 - DNA, 25 bp, Mus musculus
tgcaattaccgagccacaaagtcag

SEQ ID NO: 482950 - DNA, 25 bp, Mus musculus
tgcaattcaagacgcggagactcag

SEQ ID NO: 482951 - DNA, 25 bp, Mus musculus
tgcaattccgagatataccaggcga

SEQ ID NO: 482952 - DNA, 25 bp, Mus musculus
tgcaattcgctgtgtgaaccaggct

SEQ ID NO: 482953 - DNA, 25 bp, Mus musculus
tgcaattctggctcgcacctttacc

SEQ ID NO: 482954 - DNA, 25 bp, Mus musculus
tgcaatttgagacgttgcgccaggt

SEQ ID NO: 482955 - DNA, 25 bp, Mus musculus
tgcacaaagtaattggctaccgtgt

SEQ ID NO: 482956 - DNA, 25 bp, Mus musculus
tgcacaactgggagaatagcctggg

SEQ ID NO: 482957 - DNA, 25 bp, Mus musculus
tgcacaactgtgagactcgtcgcgg

SEQ ID NO: 482958 - DNA, 25 bp, Mus musculus
tgcacaagaagtgtgtccccacagg

SEQ ID NO: 482959 - DNA, 25 bp, Mus musculus
tgcacaaggagttcaacgcagctgt

SEQ ID NO: 482960 - DNA, 25 bp, Mus musculus
tgcacaagtgatatccgccccatat

SEQ ID NO: 482961 - DNA, 25 bp, Mus musculus
tgcacaagttcttacccaggcaaga

SEQ ID NO: 482962 - DNA, 25 bp, Mus musculus
tgcacaatccaatacagtggcctcg

SEQ ID NO: 482963 - DNA, 25 bp, Mus musculus
tgcacaatcgcttagataaacaccg

SEQ ID NO: 482964 - DNA, 25 bp, Mus musculus
tgcacaatggacacagcaagggtct

SEQ ID NO: 482965 - DNA, 25 bp, Mus musculus
tgcacaatggtggtctggagtctga

SEQ ID NO: 482966 - DNA, 25 bp, Mus musculus
tgcacacacctttggagccaggatg

SEQ ID NO: 482967 - DNA, 25 bp, Mus musculus
tgcacacacgcggtgcagacatgct

SEQ ID NO: 482968 - DNA, 25 bp, Mus musculus
tgcacacactatgaggagagcggtc

SEQ ID NO: 482969 - DNA, 25 bp, Mus musculus
tgcacacagcagtacaaggcggaga

SEQ ID NO: 482970 - DNA, 25 bp, Mus musculus
tgcacacagcagtgttctgtcccag

SEQ ID NO: 482971 - DNA, 25 bp, Mus musculus
tgcacacagcgacagagagatcata

SEQ ID NO: 482972 - DNA, 25 bp, Mus musculus
tgcacacagctggattcatgccagg

SEQ ID NO: 482973 - DNA, 25 bp, Mus musculus
tgcacacaggaatggaaatcaactc

SEQ ID NO: 482974 - DNA, 25 bp, Mus musculus
tgcacacaggcacacgatgagaggc

SEQ ID NO: 482975 - DNA, 25 bp, Mus musculus
tgcacacatggaggattacaagacc

SEQ ID NO: 482976 - DNA, 25 bp, Mus musculus
tgcacaccctcgtgctcagtagcat

SEQ ID NO: 482977 - DNA, 25 bp, Mus musculus
tgcacacctttagaaaactgaccag

SEQ ID NO: 482978 - DNA, 25 bp, Mus musculus
tgcacacgccctaggcttgaggaag

SEQ ID NO: 482979 - DNA, 25 bp, Mus musculus
tgcacacgccgcagcgatgatgagc

SEQ ID NO: 482980 - DNA, 25 bp, Mus musculus
tgcacacttcaagccctgtgggcag

SEQ ID NO: 482981 - DNA, 25 bp, Mus musculus
tgcacagaaaatcccatcaaccatg

SEQ ID NO: 482982 - DNA, 25 bp, Mus musculus
tgcacagaaacggtcagatccatag

SEQ ID NO: 482983 - DNA, 25 bp, Mus musculus
tgcacagaaagcagcacttagagct

SEQ ID NO: 482984 - DNA, 25 bp, Mus musculus
tgcacagaacagagttgggacccca

SEQ ID NO: 482985 - DNA, 25 bp, Mus musculus
tgcacagaagatgcgggagagccct

SEQ ID NO: 482986 - DNA, 25 bp, Mus musculus
tgcacagaattcgaggagatccggt

SEQ ID NO: 482987 - DNA, 25 bp, Mus musculus
tgcacagaccttgctacaggctgct

SEQ ID NO: 482988 - DNA, 25 bp, Mus musculus
tgcacagatacataccttacaggga

SEQ ID NO: 482989 - DNA, 25 bp, Mus musculus
tgcacagatggactactacggcacc

SEQ ID NO: 482990 - DNA, 25 bp, Mus musculus
tgcacagatggtatagagtatctgc

SEQ ID NO: 482991 - DNA, 25 bp, Mus musculus
tgcacagcaggagcacgatggatct

SEQ ID NO: 482992 - DNA, 25 bp, Mus musculus
tgcacagcattctccaacacaaggg

SEQ ID NO: 482993 - DNA, 25 bp, Mus musculus
tgcacagccccttcatccgtatcta

SEQ ID NO: 482994 - DNA, 25 bp, Mus musculus
tgcacaggagacaagtttacaagag

SEQ ID NO: 482995 - DNA, 25 bp, Mus musculus
tgcacaggcgcctcggctagttaaa

SEQ ID NO: 482996 - DNA, 25 bp, Mus musculus
tgcacaggcggctctctatggacac

SEQ ID NO: 482997 - DNA, 25 bp, Mus musculus
tgcacaggctgagatgccaggacct

SEQ ID NO: 482998 - DNA, 25 bp, Mus musculus
tgcacaggctgctgacccatgctct

SEQ ID NO: 482999 - DNA, 25 bp, Mus musculus
tgcacaggctggtaaatgatctccg

SEQ ID NO: 483000 - DNA, 25 bp, Mus musculus
tgcacagggtttcacggtcgtagcc

SEQ ID NO: 483001 - DNA, 25 bp, Mus musculus
tgcacaggtgatagtgtccatcagc

SEQ ID NO: 483002 - DNA, 25 bp, Mus musculus
tgcacagtaggacctgttgatatgg

SEQ ID NO: 483003 - DNA, 25 bp, Mus musculus
tgcacagtgacaatgaaggctccgt

SEQ ID NO: 483004 - DNA, 25 bp, Mus musculus
tgcacagtgataatgtttgccaagc

SEQ ID NO: 483005 - DNA, 25 bp, Mus musculus
tgcacagtggagaacggcctttcaa

SEQ ID NO: 483006 - DNA, 25 bp, Mus musculus
tgcacagtggtttccatccctgact

SEQ ID NO: 483007 - DNA, 25 bp, Mus musculus
tgcacatacagaaccaggaaccgag

SEQ ID NO: 483008 - DNA, 25 bp, Mus musculus
tgcacatatggactatgaagacgcc

SEQ ID NO: 483009 - DNA, 25 bp, Mus musculus
tgcacatcaaggtgaagcccaagcg

SEQ ID NO: 483010 - DNA, 25 bp, Mus musculus
tgcacatcattcagtctcgggagcc

SEQ ID NO: 483011 - DNA, 25 bp, Mus musculus
tgcacatccatggaggcacctgttc

SEQ ID NO: 483012 - DNA, 25 bp, Mus musculus
tgcacatcctgactagaaagctggg

SEQ ID NO: 483013 - DNA, 25 bp, Mus musculus
tgcacatcttgcgagaggagcaccg

SEQ ID NO: 483014 - DNA, 25 bp, Mus musculus
tgcacatgagcactggatcaaaggt

SEQ ID NO: 483015 - DNA, 25 bp, Mus musculus
tgcacatgctggaaagaccgagtgt

SEQ ID NO: 483016 - DNA, 25 bp, Mus musculus
tgcacatggctcactaattacgaag

SEQ ID NO: 483017 - DNA, 25 bp, Mus musculus
tgcacatgtagctgtacctgctctg

SEQ ID NO: 483018 - DNA, 25 bp, Mus musculus
tgcacatgtcatagaccagagctgg

SEQ ID NO: 483019 - DNA, 25 bp, Mus musculus
tgcacattgcacatatgcatgtttg

SEQ ID NO: 483020 - DNA, 25 bp, Mus musculus
tgcacatttgctgggaaagttccga

SEQ ID NO: 483021 - DNA, 25 bp, Mus musculus
tgcacattttgcaccgtacaccgcg

SEQ ID NO: 483022 - DNA, 25 bp, Mus musculus
tgcaccaaagaagagatggccgtcg

SEQ ID NO: 483023 - DNA, 25 bp, Mus musculus
tgcaccaaagagacttgtacagacg

SEQ ID NO: 483024 - DNA, 25 bp, Mus musculus
tgcaccaaagctctgacctctggtt

SEQ ID NO: 483025 - DNA, 25 bp, Mus musculus
tgcaccaacaccatctcagaactgg

SEQ ID NO: 483026 - DNA, 25 bp, Mus musculus
tgcaccaacaggttgtactccagga

SEQ ID NO: 483027 - DNA, 25 bp, Mus musculus
tgcaccaagtcagctggacactgga

SEQ ID NO: 483028 - DNA, 25 bp, Mus musculus
tgcaccaccagtcccagcttatgta

SEQ ID NO: 483029 - DNA, 25 bp, Mus musculus
tgcaccaccgagctctggacgctga

SEQ ID NO: 483030 - DNA, 25 bp, Mus musculus
tgcaccacgtgaatgcagtgccctt

SEQ ID NO: 483031 - DNA, 25 bp, Mus musculus
tgcaccagagactgcacactggtga

SEQ ID NO: 483032 - DNA, 25 bp, Mus musculus
tgcaccagatgttgtctcagacaaa

SEQ ID NO: 483033 - DNA, 25 bp, Mus musculus
tgcaccagcgaagtgacgtcacatg

SEQ ID NO: 483034 - DNA, 25 bp, Mus musculus
tgcaccaggagcgtatggaccagtg

SEQ ID NO: 483035 - DNA, 25 bp, Mus musculus
tgcaccatcacacaaccttacaaga

SEQ ID NO: 483036 - DNA, 25 bp, Mus musculus
tgcaccatgaggcacttagcgaggc

SEQ ID NO: 483037 - DNA, 25 bp, Mus musculus
tgcaccatgcctatagtcgataagc

SEQ ID NO: 483038 - DNA, 25 bp, Mus musculus
tgcacccacaggttcgggaggagaa

SEQ ID NO: 483039 - DNA, 25 bp, Mus musculus
tgcacccataaatgccagtgaggct

SEQ ID NO: 483040 - DNA, 25 bp, Mus musculus
tgcaccccttccttggtgggttggg

SEQ ID NO: 483041 - DNA, 25 bp, Mus musculus
tgcacccgagcccaagcttagtaac

SEQ ID NO: 483042 - DNA, 25 bp, Mus musculus
tgcacccgaggagatcttaaagcgc

SEQ ID NO: 483043 - DNA, 25 bp, Mus musculus
tgcacccgaggcattaggaagcgcg

SEQ ID NO: 483044 - DNA, 25 bp, Mus musculus
tgcacccggacaggaaagaacaacg

SEQ ID NO: 483045 - DNA, 25 bp, Mus musculus
tgcacccggagtggaatttacaggc

SEQ ID NO: 483046 - DNA, 25 bp, Mus musculus
tgcaccctaggggagcgctctctga

SEQ ID NO: 483047 - DNA, 25 bp, Mus musculus
tgcaccctccagacctgtgggattc

SEQ ID NO: 483048 - DNA, 25 bp, Mus musculus
tgcaccctgaggaatatgactacat

SEQ ID NO: 483049 - DNA, 25 bp, Mus musculus
tgcaccctggtctagtcatgtgaag

SEQ ID NO: 483050 - DNA, 25 bp, Mus musculus
tgcaccgctgccatgaagagaagag

SEQ ID NO: 483051 - DNA, 25 bp, Mus musculus
tgcaccgggcatgaatgtgagcgcc

SEQ ID NO: 483052 - DNA, 25 bp, Mus musculus
tgcacctcacttagctaatacatga

SEQ ID NO: 483053 - DNA, 25 bp, Mus musculus
tgcacctcaggagtgaacacggcct

SEQ ID NO: 483054 - DNA, 25 bp, Mus musculus
tgcacctgatgtggagccgctggaa

SEQ ID NO: 483055 - DNA, 25 bp, Mus musculus
tgcacctgccagtgagcttgaagca

SEQ ID NO: 483056 - DNA, 25 bp, Mus musculus
tgcacctgcggtttaaacgcggcgg

SEQ ID NO: 483057 - DNA, 25 bp, Mus musculus
tgcaccttcgttgctgtctacagag

SEQ ID NO: 483058 - DNA, 25 bp, Mus musculus
tgcaccttgctgctgggaacagaga

SEQ ID NO: 483059 - DNA, 25 bp, Mus musculus
tgcacgaagtatgacgaggctacag

SEQ ID NO: 483060 - DNA, 25 bp, Mus musculus
tgcacgacacagaaggtaatgcctg

SEQ ID NO: 483061 - DNA, 25 bp, Mus musculus
tgcacgacctgcacatcttggatgg

SEQ ID NO: 483062 - DNA, 25 bp, Mus musculus
tgcacgacgaggaggcagcgatgtc

SEQ ID NO: 483063 - DNA, 25 bp, Mus musculus
tgcacgagagagagaaacttccagc

SEQ ID NO: 483064 - DNA, 25 bp, Mus musculus
tgcacgaggaggaccatacactagg

SEQ ID NO: 483065 - DNA, 25 bp, Mus musculus
tgcacgcaaagctcttagcgcccga

SEQ ID NO: 483066 - DNA, 25 bp, Mus musculus
tgcacgcctcaggagccaaagtggt

SEQ ID NO: 483067 - DNA, 25 bp, Mus musculus
tgcacgctgcgtgagaacctggacc

SEQ ID NO: 483068 - DNA, 25 bp, Mus musculus
tgcacgctgtacattccggaacttt

SEQ ID NO: 483069 - DNA, 25 bp, Mus musculus
tgcacggaaggtactgtgtctcgaa

SEQ ID NO: 483070 - DNA, 25 bp, Mus musculus
tgcacggagccaaccagatgggttt

SEQ ID NO: 483071 - DNA, 25 bp, Mus musculus
tgcacggcctcctggtgaaagtaaa

SEQ ID NO: 483072 - DNA, 25 bp, Mus musculus
tgcacgggcaggaggacaaaatcta

SEQ ID NO: 483073 - DNA, 25 bp, Mus musculus
tgcacgggtcatggcttgttaacaa

SEQ ID NO: 483074 - DNA, 25 bp, Mus musculus
tgcacggtgtgtcttgtcttattac

SEQ ID NO: 483075 - DNA, 25 bp, Mus musculus
tgcacggttacagcaagtggatcct

SEQ ID NO: 483076 - DNA, 25 bp, Mus musculus
tgcacggttctatgagctggctccc

SEQ ID NO: 483077 - DNA, 25 bp, Mus musculus
tgcacgtaggctgggcaactttcct

SEQ ID NO: 483078 - DNA, 25 bp, Mus musculus
tgcacgtcctcaggtaccaggtaaa

SEQ ID NO: 483079 - DNA, 25 bp, Mus musculus
tgcacgtgaggaaggaagaaacatt

SEQ ID NO: 483080 - DNA, 25 bp, Mus musculus
tgcacgtgatcaagagggacgccct

SEQ ID NO: 483081 - DNA, 25 bp, Mus musculus
tgcacgtgcatagagctgagctgga

SEQ ID NO: 483082 - DNA, 25 bp, Mus musculus
tgcacgtgcctgtaatgtcaatggg

SEQ ID NO: 483083 - DNA, 25 bp, Mus musculus
tgcacgtggttggaagacatacatg

SEQ ID NO: 483084 - DNA, 25 bp, Mus musculus
tgcacgtgtgcatgaggaaaaccag

SEQ ID NO: 483085 - DNA, 25 bp, Mus musculus
tgcacgtgtgtggaggctccctgct

SEQ ID NO: 483086 - DNA, 25 bp, Mus musculus
tgcacgttcacgagcattcaccgta

SEQ ID NO: 483087 - DNA, 25 bp, Mus musculus
tgcacgttcaggctctgctcagatg

SEQ ID NO: 483088 - DNA, 25 bp, Mus musculus
tgcactaaggcgaaatagtcacgca

SEQ ID NO: 483089 - DNA, 25 bp, Mus musculus
tgcactacaatcacagcggcaggct

SEQ ID NO: 483090 - DNA, 25 bp, Mus musculus
tgcactacagattgccagggagccc

SEQ ID NO: 483091 - DNA, 25 bp, Mus musculus
tgcactacgcttgtgggtccacgct

SEQ ID NO: 483092 - DNA, 25 bp, Mus musculus
tgcactactctgattgatcagcaga

SEQ ID NO: 483093 - DNA, 25 bp, Mus musculus
tgcactataaatttggaccaggaag

SEQ ID NO: 483094 - DNA, 25 bp, Mus musculus
tgcactattgcactggagcttaccg

SEQ ID NO: 483095 - DNA, 25 bp, Mus musculus
tgcactcacagcaagatcaggcgct

SEQ ID NO: 483096 - DNA, 25 bp, Mus musculus
tgcactcactgcttcaactggacgc

SEQ ID NO: 483097 - DNA, 25 bp, Mus musculus
tgcactcagacgaaagcagtccctg

SEQ ID NO: 483098 - DNA, 25 bp, Mus musculus
tgcactcaggtacccagtgagcaga

SEQ ID NO: 483099 - DNA, 25 bp, Mus musculus
tgcactcctgcaagacaagtacggt

SEQ ID NO: 483100 - DNA, 25 bp, Mus musculus
tgcactctcgacactcacctgcaag

SEQ ID NO: 483101 - DNA, 25 bp, Mus musculus
tgcactctctgtatgggctgggcct

SEQ ID NO: 483102 - DNA, 25 bp, Mus musculus
tgcactctgaggtcgtggtagccct

SEQ ID NO: 483103 - DNA, 25 bp, Mus musculus
tgcactctgatgaaccaatggccct

SEQ ID NO: 483104 - DNA, 25 bp, Mus musculus
tgcactctgctctggagcatgttgg

SEQ ID NO: 483105 - DNA, 25 bp, Mus musculus
tgcactctgtcgatgagtcggagaa

SEQ ID NO: 483106 - DNA, 25 bp, Mus musculus
tgcactgaacagaacttttgggtct

SEQ ID NO: 483107 - DNA, 25 bp, Mus musculus
tgcactgacacccacatcattgaga

SEQ ID NO: 483108 - DNA, 25 bp, Mus musculus
tgcactgagaaccttatgaagccgg

SEQ ID NO: 483109 - DNA, 25 bp, Mus musculus
tgcactgagatctcggcgttcctgt

SEQ ID NO: 483110 - DNA, 25 bp, Mus musculus
tgcactgagggtacgccgagagaat

SEQ ID NO: 483111 - DNA, 25 bp, Mus musculus
tgcactgagtattgttagcccaggc

SEQ ID NO: 483112 - DNA, 25 bp, Mus musculus
tgcactgatggtctccacatgtctg

SEQ ID NO: 483113 - DNA, 25 bp, Mus musculus
tgcactgcctggaggttatgtgtac

SEQ ID NO: 483114 - DNA, 25 bp, Mus musculus
tgcactgcgtccactcgtccctggg

SEQ ID NO: 483115 - DNA, 25 bp, Mus musculus
tgcactggagaaggcgagacaagtc

SEQ ID NO: 483116 - DNA, 25 bp, Mus musculus
tgcactggatgcagagcttacacgc

SEQ ID NO: 483117 - DNA, 25 bp, Mus musculus
tgcactggcccatggcaatgccgtg

SEQ ID NO: 483118 - DNA, 25 bp, Mus musculus
tgcactgtaggtgctgggcgttaca

SEQ ID NO: 483119 - DNA, 25 bp, Mus musculus
tgcactgtcctttagacttgtagac

SEQ ID NO: 483120 - DNA, 25 bp, Mus musculus
tgcactgtgacccagatgtcaggat

SEQ ID NO: 483121 - DNA, 25 bp, Mus musculus
tgcactgtgacgagaagaccatcat

SEQ ID NO: 483122 - DNA, 25 bp, Mus musculus
tgcactgtgactcctgcatgccggc

SEQ ID NO: 483123 - DNA, 25 bp, Mus musculus
tgcactgtgagagtaatggattaat

SEQ ID NO: 483124 - DNA, 25 bp, Mus musculus
tgcactgtgcatagaagatgggtcc

SEQ ID NO: 483125 - DNA, 25 bp, Mus musculus
tgcactgtgcatagatcgcttccgg

SEQ ID NO: 483126 - DNA, 25 bp, Mus musculus
tgcactgtggcaacctacgacaagg

SEQ ID NO: 483127 - DNA, 25 bp, Mus musculus
tgcacttcaattcaggagccaaact

SEQ ID NO: 483128 - DNA, 25 bp, Mus musculus
tgcacttccaccaggagccgtttaa

SEQ ID NO: 483129 - DNA, 25 bp, Mus musculus
tgcacttccgcatgtagtatcctcc

SEQ ID NO: 483130 - DNA, 25 bp, Mus musculus
tgcacttgagtttgcataaccgccc

SEQ ID NO: 483131 - DNA, 25 bp, Mus musculus
tgcacttgccagagtcccttgaaga

SEQ ID NO: 483132 - DNA, 25 bp, Mus musculus
tgcactttatcaccagggacgcttc

SEQ ID NO: 483133 - DNA, 25 bp, Mus musculus
tgcactttgaaaaccgaggattcct

SEQ ID NO: 483134 - DNA, 25 bp, Mus musculus
tgcagaaacgggagtcggagttcaa

SEQ ID NO: 483135 - DNA, 25 bp, Mus musculus
tgcagaaagactcccactggaagcg

SEQ ID NO: 483136 - DNA, 25 bp, Mus musculus
tgcagaaagagactccctggatggc

SEQ ID NO: 483137 - DNA, 25 bp, Mus musculus
tgcagaaatatggactcaccttgct

SEQ ID NO: 483138 - DNA, 25 bp, Mus musculus
tgcagaaatctcttcggcccggtca

SEQ ID NO: 483139 - DNA, 25 bp, Mus musculus
tgcagaaatttgtgtccataggacc

SEQ ID NO: 483140 - DNA, 25 bp, Mus musculus
tgcagaacaactgacgcggctggac

SEQ ID NO: 483141 - DNA, 25 bp, Mus musculus
tgcagaacaggagtacatatcggcc

SEQ ID NO: 483142 - DNA, 25 bp, Mus musculus
tgcagaaccccaaaaatgtctgtgt

SEQ ID NO: 483143 - DNA, 25 bp, Mus musculus
tgcagaacctgagaactggagcccc

SEQ ID NO: 483144 - DNA, 25 bp, Mus musculus
tgcagaacctgtttgccgagggcaa

SEQ ID NO: 483145 - DNA, 25 bp, Mus musculus
tgcagaactaaagccgagactgtgg

SEQ ID NO: 483146 - DNA, 25 bp, Mus musculus
tgcagaactgaaacgcgagtcaccc

SEQ ID NO: 483147 - DNA, 25 bp, Mus musculus
tgcagaacttcttgaggacagcaag

SEQ ID NO: 483148 - DNA, 25 bp, Mus musculus
tgcagaagaatctggccccgctggt

SEQ ID NO: 483149 - DNA, 25 bp, Mus musculus
tgcagaagcggaaacacatccagtg

SEQ ID NO: 483150 - DNA, 25 bp, Mus musculus
tgcagaagctggcaatatggaagcc

SEQ ID NO: 483151 - DNA, 25 bp, Mus musculus
tgcagaaggaaatcacagccttggc

SEQ ID NO: 483152 - DNA, 25 bp, Mus musculus
tgcagaagtaagacgcctgagtgcc

SEQ ID NO: 483153 - DNA, 25 bp, Mus musculus
tgcagaatctgtctctaaggaaggc

SEQ ID NO: 483154 - DNA, 25 bp, Mus musculus
tgcagaatttgagcccaaggtctgt

SEQ ID NO: 483155 - DNA, 25 bp, Mus musculus
tgcagacaagggaagcaacaacagc

SEQ ID NO: 483156 - DNA, 25 bp, Mus musculus
tgcagacacacgtcaccaaagaggg

SEQ ID NO: 483157 - DNA, 25 bp, Mus musculus
tgcagacacagaaatgctctgactg

SEQ ID NO: 483158 - DNA, 25 bp, Mus musculus
tgcagacacagcacccagtatgagg

SEQ ID NO: 483159 - DNA, 25 bp, Mus musculus
tgcagacagaggctcatcacgtgcg

SEQ ID NO: 483160 - DNA, 25 bp, Mus musculus
tgcagaccaacgatgagggctcaga

SEQ ID NO: 483161 - DNA, 25 bp, Mus musculus
tgcagaccacgatcaaggagaatgt

SEQ ID NO: 483162 - DNA, 25 bp, Mus musculus
tgcagaccactgagcacagactgga

SEQ ID NO: 483163 - DNA, 25 bp, Mus musculus
tgcagaccatcaaaaaggagcccgc

SEQ ID NO: 483164 - DNA, 25 bp, Mus musculus
tgcagaccccaaagacaaacatgtg

SEQ ID NO: 483165 - DNA, 25 bp, Mus musculus
tgcagaccccatgataaagaacaag

SEQ ID NO: 483166 - DNA, 25 bp, Mus musculus
tgcagacccctgataacctgtcggt

SEQ ID NO: 483167 - DNA, 25 bp, Mus musculus
tgcagacccgagaccaaaagattgt

SEQ ID NO: 483168 - DNA, 25 bp, Mus musculus
tgcagacccgctttgtgaagaccat

SEQ ID NO: 483169 - DNA, 25 bp, Mus musculus
tgcagaccctgtagccctgatggta

SEQ ID NO: 483170 - DNA, 25 bp, Mus musculus
tgcagacctgacaagtgggcagctt

SEQ ID NO: 483171 - DNA, 25 bp, Mus musculus
tgcagacctggctatggcgttcagc

SEQ ID NO: 483172 - DNA, 25 bp, Mus musculus
tgcagacctggctcgaagaaaggat

SEQ ID NO: 483173 - DNA, 25 bp, Mus musculus
tgcagacctttgagagtacccaggc

SEQ ID NO: 483174 - DNA, 25 bp, Mus musculus
tgcagaccttttgggtggtccctcc

SEQ ID NO: 483175 - DNA, 25 bp, Mus musculus
tgcagacgagggaagtccagtgcct

SEQ ID NO: 483176 - DNA, 25 bp, Mus musculus
tgcagacggtgaactccaatggaac

SEQ ID NO: 483177 - DNA, 25 bp, Mus musculus
tgcagactaaacagggaggcgctct

SEQ ID NO: 483178 - DNA, 25 bp, Mus musculus
tgcagactacagacatccggacatg

SEQ ID NO: 483179 - DNA, 25 bp, Mus musculus
tgcagactacccaaaacagccgatt

SEQ ID NO: 483180 - DNA, 25 bp, Mus musculus
tgcagactagtctcggtggagtccc

SEQ ID NO: 483181 - DNA, 25 bp, Mus musculus
tgcagactcacgttggtaccaagaa

SEQ ID NO: 483182 - DNA, 25 bp, Mus musculus
tgcagactccttcgaccacaaaaag

SEQ ID NO: 483183 - DNA, 25 bp, Mus musculus
tgcagactcggtttctgaggaacgc

SEQ ID NO: 483184 - DNA, 25 bp, Mus musculus
tgcagactctaaggcctcagggctt

SEQ ID NO: 483185 - DNA, 25 bp, Mus musculus
tgcagactctcaaggaacaccaggt

SEQ ID NO: 483186 - DNA, 25 bp, Mus musculus
tgcagagaaaaacaagcccggtgtc

SEQ ID NO: 483187 - DNA, 25 bp, Mus musculus
tgcagagaacgtgggaaaatccgct

SEQ ID NO: 483188 - DNA, 25 bp, Mus musculus
tgcagagaactcaactacaaggaga

SEQ ID NO: 483189 - DNA, 25 bp, Mus musculus
tgcagagaagtttggcaaggccacc

SEQ ID NO: 483190 - DNA, 25 bp, Mus musculus
tgcagagactctttcgggcttttcg

SEQ ID NO: 483191 - DNA, 25 bp, Mus musculus
tgcagagacttgagccgtgggtccc

SEQ ID NO: 483192 - DNA, 25 bp, Mus musculus
tgcagagaggtcttttaagggagca

SEQ ID NO: 483193 - DNA, 25 bp, Mus musculus
tgcagagatagtggttcgagacccc

SEQ ID NO: 483194 - DNA, 25 bp, Mus musculus
tgcagagatcttttcgccagacaac

SEQ ID NO: 483195 - DNA, 25 bp, Mus musculus
tgcagagatgtcatgccagatcact

SEQ ID NO: 483196 - DNA, 25 bp, Mus musculus
tgcagagatttaaggcacgcccatc

SEQ ID NO: 483197 - DNA, 25 bp, Mus musculus
tgcagagcaaggtgaagggcaacac

SEQ ID NO: 483198 - DNA, 25 bp, Mus musculus
tgcagagcagggtcttcgggtggcc

SEQ ID NO: 483199 - DNA, 25 bp, Mus musculus
tgcagagccaccttggaacacttgg

SEQ ID NO: 483200 - DNA, 25 bp, Mus musculus
tgcagagccacggttaaaacgcttt

SEQ ID NO: 483201 - DNA, 25 bp, Mus musculus
tgcagagcccgaaccgtgaatttgg

SEQ ID NO: 483202 - DNA, 25 bp, Mus musculus
tgcagagcttgcattcactcaggaa

SEQ ID NO: 483203 - DNA, 25 bp, Mus musculus
tgcagagctttggtagccagactac

SEQ ID NO: 483204 - DNA, 25 bp, Mus musculus
tgcagaggaccaaggaatatttccc

SEQ ID NO: 483205 - DNA, 25 bp, Mus musculus
tgcagaggactcagtactgtgagct

SEQ ID NO: 483206 - DNA, 25 bp, Mus musculus
tgcagaggatgtcccagcatttccc

SEQ ID NO: 483207 - DNA, 25 bp, Mus musculus
tgcagaggcagtgttgactccacaa

SEQ ID NO: 483208 - DNA, 25 bp, Mus musculus
tgcagaggcatgtatgtggctttcc

SEQ ID NO: 483209 - DNA, 25 bp, Mus musculus
tgcagaggccctgctgcgtgagacc

SEQ ID NO: 483210 - DNA, 25 bp, Mus musculus
tgcagaggtgagtagaaaactccct

SEQ ID NO: 483211 - DNA, 25 bp, Mus musculus
tgcagagtaacatgctgtagagcca

SEQ ID NO: 483212 - DNA, 25 bp, Mus musculus
tgcagagtttactccgcctggagga

SEQ ID NO: 483213 - DNA, 25 bp, Mus musculus
tgcagataaactccgaagcccagtg

SEQ ID NO: 483214 - DNA, 25 bp, Mus musculus
tgcagatagacaaaaggcttcccag

SEQ ID NO: 483215 - DNA, 25 bp, Mus musculus
tgcagatagatgacaagtgtgggac

SEQ ID NO: 483216 - DNA, 25 bp, Mus musculus
tgcagatcagcgagaccctgccgct

SEQ ID NO: 483217 - DNA, 25 bp, Mus musculus
tgcagatccgtgttctacaacccct

SEQ ID NO: 483218 - DNA, 25 bp, Mus musculus
tgcagatctcatgtggcctggcaga

SEQ ID NO: 483219 - DNA, 25 bp, Mus musculus
tgcagatctctggattagccagcac

SEQ ID NO: 483220 - DNA, 25 bp, Mus musculus
tgcagatgaactatttagccctcca

SEQ ID NO: 483221 - DNA, 25 bp, Mus musculus
tgcagatgattcacaggccatgagc

SEQ ID NO: 483222 - DNA, 25 bp, Mus musculus
tgcagatgcaaagtgtttgccatcg

SEQ ID NO: 483223 - DNA, 25 bp, Mus musculus
tgcagatgcacagtactccagacag

SEQ ID NO: 483224 - DNA, 25 bp, Mus musculus
tgcagatgcacagttcaagaggcgc

SEQ ID NO: 483225 - DNA, 25 bp, Mus musculus
tgcagatgcgacagtatgacacccg

SEQ ID NO: 483226 - DNA, 25 bp, Mus musculus
tgcagatgggataaccagtgttccc

SEQ ID NO: 483227 - DNA, 25 bp, Mus musculus
tgcagatgtccatgttttgcctatt

SEQ ID NO: 483228 - DNA, 25 bp, Mus musculus
tgcagatgtcttcttgccccaccag

SEQ ID NO: 483229 - DNA, 25 bp, Mus musculus
tgcagattcagttcgggctcatcag

SEQ ID NO: 483230 - DNA, 25 bp, Mus musculus
tgcagcaagtcattaccagggaagc

SEQ ID NO: 483231 - DNA, 25 bp, Mus musculus
tgcagcacacacaagaacttcagaa

SEQ ID NO: 483232 - DNA, 25 bp, Mus musculus
tgcagcacacgttgtaagcgaagcc

SEQ ID NO: 483233 - DNA, 25 bp, Mus musculus
tgcagcaccttcagataaagagagt

SEQ ID NO: 483234 - DNA, 25 bp, Mus musculus
tgcagcaccttgacagcattgcagc

SEQ ID NO: 483235 - DNA, 25 bp, Mus musculus
tgcagcacgggcaaaacttgggctc

SEQ ID NO: 483236 - DNA, 25 bp, Mus musculus
tgcagcacgtcttccatgaggccgt

SEQ ID NO: 483237 - DNA, 25 bp, Mus musculus
tgcagcactggccatggacaacatc

SEQ ID NO: 483238 - DNA, 25 bp, Mus musculus
tgcagcactgtcagagccgcgtttt

SEQ ID NO: 483239 - DNA, 25 bp, Mus musculus
tgcagcagaaaaaacctccaggaag

SEQ ID NO: 483240 - DNA, 25 bp, Mus musculus
tgcagcagatgctcaagccgggatc

SEQ ID NO: 483241 - DNA, 25 bp, Mus musculus
tgcagcagcactgagcacaaggata

SEQ ID NO: 483242 - DNA, 25 bp, Mus musculus
tgcagcagcagtgtttcaggatgac

SEQ ID NO: 483243 - DNA, 25 bp, Mus musculus
tgcagcagcgactggcccaggagat

SEQ ID NO: 483244 - DNA, 25 bp, Mus musculus
tgcagcagctccttctttcgggaaa

SEQ ID NO: 483245 - DNA, 25 bp, Mus musculus
tgcagcaggcactccgagccagact

SEQ ID NO: 483246 - DNA, 25 bp, Mus musculus
tgcagcaggcgcctttaggtcaaca

SEQ ID NO: 483247 - DNA, 25 bp, Mus musculus
tgcagcaggctttggacagaactag

SEQ ID NO: 483248 - DNA, 25 bp, Mus musculus
tgcagcaggtccgtagaaagatcgt

SEQ ID NO: 483249 - DNA, 25 bp, Mus musculus
tgcagcaggttcatacgatccagga

SEQ ID NO: 483250 - DNA, 25 bp, Mus musculus
tgcagcagtttacgtcccgaggtgt

SEQ ID NO: 483251 - DNA, 25 bp, Mus musculus
tgcagcatgacaaggtggcacccgt

SEQ ID NO: 483252 - DNA, 25 bp, Mus musculus
tgcagcatgctttaatgagcgactg

SEQ ID NO: 483253 - DNA, 25 bp, Mus musculus
tgcagcatggacaaggacgaattct

SEQ ID NO: 483254 - DNA, 25 bp, Mus musculus
tgcagcatggtatgaagacaagagc

SEQ ID NO: 483255 - DNA, 25 bp, Mus musculus
tgcagccaccactgccggagctgca

SEQ ID NO: 483256 - DNA, 25 bp, Mus musculus
tgcagccagctctcgggaatatcct

SEQ ID NO: 483257 - DNA, 25 bp, Mus musculus
tgcagccagtcctcccaatgtgtag

SEQ ID NO: 483258 - DNA, 25 bp, Mus musculus
tgcagccatcccaacgtagtgactt

SEQ ID NO: 483259 - DNA, 25 bp, Mus musculus
tgcagccatgggaactactgtcgtt

SEQ ID NO: 483260 - DNA, 25 bp, Mus musculus
tgcagccatgtttggaagggaccac

SEQ ID NO: 483261 - DNA, 25 bp, Mus musculus
tgcagcccactaaacccaggaggcg

SEQ ID NO: 483262 - DNA, 25 bp, Mus musculus
tgcagccccggataagacagaggtc

SEQ ID NO: 483263 - DNA, 25 bp, Mus musculus
tgcagccccttggaaactcggagct

SEQ ID NO: 483264 - DNA, 25 bp, Mus musculus
tgcagcccgacgatgtcacagttgt

SEQ ID NO: 483265 - DNA, 25 bp, Mus musculus
tgcagccctgctagcttgggccgag

SEQ ID NO: 483266 - DNA, 25 bp, Mus musculus
tgcagccgatatggatcagtgtaaa

SEQ ID NO: 483267 - DNA, 25 bp, Mus musculus
tgcagccgtcgctgatatcacaagc

SEQ ID NO: 483268 - DNA, 25 bp, Mus musculus
tgcagcctacagatcaaagctctgg

SEQ ID NO: 483269 - DNA, 25 bp, Mus musculus
tgcagcctgagaatagagacggagc

SEQ ID NO: 483270 - DNA, 25 bp, Mus musculus
tgcagcctggcctgcattcctgtgt

SEQ ID NO: 483271 - DNA, 25 bp, Mus musculus
tgcagcctgtgagaaaagttcagtc

SEQ ID NO: 483272 - DNA, 25 bp, Mus musculus
tgcagccttagggattggaacagac

SEQ ID NO: 483273 - DNA, 25 bp, Mus musculus
tgcagccttgtcagaaacagcagtg

SEQ ID NO: 483274 - DNA, 25 bp, Mus musculus
tgcagcctttgaaagcctggagcag

SEQ ID NO: 483275 - DNA, 25 bp, Mus musculus
tgcagcgatgagaacagatgaacct

SEQ ID NO: 483276 - DNA, 25 bp, Mus musculus
tgcagcgcatcacggtgcacaagga

SEQ ID NO: 483277 - DNA, 25 bp, Mus musculus
tgcagcggctacctaaagatcagac

SEQ ID NO: 483278 - DNA, 25 bp, Mus musculus
tgcagcgtgcagatttcgggacacc

SEQ ID NO: 483279 - DNA, 25 bp, Mus musculus
tgcagctaccatgaagacattctgt

SEQ ID NO: 483280 - DNA, 25 bp, Mus musculus
tgcagctagagacgcaagacgcgct

SEQ ID NO: 483281 - DNA, 25 bp, Mus musculus
tgcagctagagcttgacaccgtggg

SEQ ID NO: 483282 - DNA, 25 bp, Mus musculus
tgcagctagccctgcagagccagag

SEQ ID NO: 483283 - DNA, 25 bp, Mus musculus
tgcagctcttctattctcgctggct

SEQ ID NO: 483284 - DNA, 25 bp, Mus musculus
tgcagctgaacaccaatgagcggct

SEQ ID NO: 483285 - DNA, 25 bp, Mus musculus
tgcagctgatcaggaccccagagtt

SEQ ID NO: 483286 - DNA, 25 bp, Mus musculus
tgcagctgcaagaagatgaactggc

SEQ ID NO: 483287 - DNA, 25 bp, Mus musculus
tgcagctgcagtaccaggctagcat

SEQ ID NO: 483288 - DNA, 25 bp, Mus musculus
tgcagctggagatcaaagtggccct

SEQ ID NO: 483289 - DNA, 25 bp, Mus musculus
tgcagctgtcaaacccatgctactg

SEQ ID NO: 483290 - DNA, 25 bp, Mus musculus
tgcagcttcagctatccgatccggg

SEQ ID NO: 483291 - DNA, 25 bp, Mus musculus
tgcagcttcgcaaacaggtcatggt

SEQ ID NO: 483292 - DNA, 25 bp, Mus musculus
tgcagcttcgctcccaagacttgct

SEQ ID NO: 483293 - DNA, 25 bp, Mus musculus
tgcagcttgcgggaaacgagaactc

SEQ ID NO: 483294 - DNA, 25 bp, Mus musculus
tgcagcttggcaggacaaggacaag

SEQ ID NO: 483295 - DNA, 25 bp, Mus musculus
tgcagctttgcaggcctcctggaag

SEQ ID NO: 483296 - DNA, 25 bp, Mus musculus
tgcaggaaaaacactcaaggatctg

SEQ ID NO: 483297 - DNA, 25 bp, Mus musculus
tgcaggaaacctggtacccgggctt

SEQ ID NO: 483298 - DNA, 25 bp, Mus musculus
tgcaggaaagagatccaggacttct

SEQ ID NO: 483299 - DNA, 25 bp, Mus musculus
tgcaggaaagtacagcattcaagac

SEQ ID NO: 483300 - DNA, 25 bp, Mus musculus
tgcaggaagacacacccagtgactg

SEQ ID NO: 483301 - DNA, 25 bp, Mus musculus
tgcaggaagactcccaaaggcttct

SEQ ID NO: 483302 - DNA, 25 bp, Mus musculus
tgcaggaagttctcagactggagtc

SEQ ID NO: 483303 - DNA, 25 bp, Mus musculus
tgcaggaatgaggtcctgatttcaa

SEQ ID NO: 483304 - DNA, 25 bp, Mus musculus
tgcaggaattatgacgtcgatgctg

SEQ ID NO: 483305 - DNA, 25 bp, Mus musculus
tgcaggacagactcactagtgaaga

SEQ ID NO: 483306 - DNA, 25 bp, Mus musculus
tgcaggaccaccgagtggaactacg

SEQ ID NO: 483307 - DNA, 25 bp, Mus musculus
tgcaggacgcagaccaaagacatgg

SEQ ID NO: 483308 - DNA, 25 bp, Mus musculus
tgcaggagcaccttctgtggagaac

SEQ ID NO: 483309 - DNA, 25 bp, Mus musculus
tgcaggagcagagtcgcaaagtagc

SEQ ID NO: 483310 - DNA, 25 bp, Mus musculus
tgcaggagctgtgtcgccagcgcat

SEQ ID NO: 483311 - DNA, 25 bp, Mus musculus
tgcaggaggcacagcacagttcatg

SEQ ID NO: 483312 - DNA, 25 bp, Mus musculus
tgcaggatatgacagagcttcgacc

SEQ ID NO: 483313 - DNA, 25 bp, Mus musculus
tgcaggatcatcatcccgcaggatg

SEQ ID NO: 483314 - DNA, 25 bp, Mus musculus
tgcaggatgacctactggagaccct

SEQ ID NO: 483315 - DNA, 25 bp, Mus musculus
tgcaggattctgctccgcgatctag

SEQ ID NO: 483316 - DNA, 25 bp, Mus musculus
tgcaggattggaagacgctacggcc

SEQ ID NO: 483317 - DNA, 25 bp, Mus musculus
tgcaggcaaagacaccaatggctca

SEQ ID NO: 483318 - DNA, 25 bp, Mus musculus
tgcaggcaaaggatccgcaggttct

SEQ ID NO: 483319 - DNA, 25 bp, Mus musculus
tgcaggcaagagtggcgcgaaccca

SEQ ID NO: 483320 - DNA, 25 bp, Mus musculus
tgcaggcaccagtcatacaagaggt

SEQ ID NO: 483321 - DNA, 25 bp, Mus musculus
tgcaggcagatgtgaagttagaaag

SEQ ID NO: 483322 - DNA, 25 bp, Mus musculus
tgcaggcagctgatgagcgcccttt

SEQ ID NO: 483323 - DNA, 25 bp, Mus musculus
tgcaggcagcttcacgattaaaact

SEQ ID NO: 483324 - DNA, 25 bp, Mus musculus
tgcaggcagcttcagtcttgagact

SEQ ID NO: 483325 - DNA, 25 bp, Mus musculus
tgcaggccagcaagtccttaactgt

SEQ ID NO: 483326 - DNA, 25 bp, Mus musculus
tgcaggccaggaaactcctgtggga

SEQ ID NO: 483327 - DNA, 25 bp, Mus musculus
tgcaggccatcttcaaccctgatac

SEQ ID NO: 483328 - DNA, 25 bp, Mus musculus
tgcaggccatgatttacgacgacgg

SEQ ID NO: 483329 - DNA, 25 bp, Mus musculus
tgcaggcccgctaacatgatgccag

SEQ ID NO: 483330 - DNA, 25 bp, Mus musculus
tgcaggccctgatagcagaaaagaa

SEQ ID NO: 483331 - DNA, 25 bp, Mus musculus
tgcaggcctccgatcctgtgagagt

SEQ ID NO: 483332 - DNA, 25 bp, Mus musculus
tgcaggcctcggacatgcaagagtt

SEQ ID NO: 483333 - DNA, 25 bp, Mus musculus
tgcaggcctgcaaactggagtggat

SEQ ID NO: 483334 - DNA, 25 bp, Mus musculus
tgcaggcggcgcatttcctaggtta

SEQ ID NO: 483335 - DNA, 25 bp, Mus musculus
tgcaggcgggtttgatcttcccatt

SEQ ID NO: 483336 - DNA, 25 bp, Mus musculus
tgcaggctgaaaagctggaccacca

SEQ ID NO: 483337 - DNA, 25 bp, Mus musculus
tgcaggctgatgagtccaagctcct

SEQ ID NO: 483338 - DNA, 25 bp, Mus musculus
tgcaggctgtagaggaggctccttc

SEQ ID NO: 483339 - DNA, 25 bp, Mus musculus
tgcaggctgtagctccatggccgaa

SEQ ID NO: 483340 - DNA, 25 bp, Mus musculus
tgcagggaaaccaccctaaataatg

SEQ ID NO: 483341 - DNA, 25 bp, Mus musculus
tgcagggaactcaacctaggacttc

SEQ ID NO: 483342 - DNA, 25 bp, Mus musculus
tgcagggagagccaatgcttgccaa

SEQ ID NO: 483343 - DNA, 25 bp, Mus musculus
tgcagggcaacccacagcatatgtg

SEQ ID NO: 483344 - DNA, 25 bp, Mus musculus
tgcagggccccagattaggaatatg

SEQ ID NO: 483345 - DNA, 25 bp, Mus musculus
tgcagggctttaacagggcaagctc

SEQ ID NO: 483346 - DNA, 25 bp, Mus musculus
tgcagggtacacgttggcgcacatg

SEQ ID NO: 483347 - DNA, 25 bp, Mus musculus
tgcagggtctacagccggagactct

SEQ ID NO: 483348 - DNA, 25 bp, Mus musculus
tgcagggtctctcattcacattcag

SEQ ID NO: 483349 - DNA, 25 bp, Mus musculus
tgcaggtaagtatacaaagatacat

SEQ ID NO: 483350 - DNA, 25 bp, Mus musculus
tgcaggtaccgagcctctaaagggt

SEQ ID NO: 483351 - DNA, 25 bp, Mus musculus
tgcaggtattgcatccagcagccag

SEQ ID NO: 483352 - DNA, 25 bp, Mus musculus
tgcaggtcaccagtcaggcagaagt

SEQ ID NO: 483353 - DNA, 25 bp, Mus musculus
tgcaggtccccactttaggatcaga

SEQ ID NO: 483354 - DNA, 25 bp, Mus musculus
tgcaggtcggatcataaggcagcct

SEQ ID NO: 483355 - DNA, 25 bp, Mus musculus
tgcaggtctgcagggattgccccat

SEQ ID NO: 483356 - DNA, 25 bp, Mus musculus
tgcaggtgaccttgggaattgccct

SEQ ID NO: 483357 - DNA, 25 bp, Mus musculus
tgcaggtgagcgaacaggatcctac

SEQ ID NO: 483358 - DNA, 25 bp, Mus musculus
tgcaggtgccattaccacagaggac

SEQ ID NO: 483359 - DNA, 25 bp, Mus musculus
tgcaggtgcccagggaacagctctt

SEQ ID NO: 483360 - DNA, 25 bp, Mus musculus
tgcaggtgtcggttgtctgtctacc

SEQ ID NO: 483361 - DNA, 25 bp, Mus musculus
tgcaggtgtgcagcggcaaactgct

SEQ ID NO: 483362 - DNA, 25 bp, Mus musculus
tgcaggttccagtcagagttcgagc

SEQ ID NO: 483363 - DNA, 25 bp, Mus musculus
tgcaggtttgtgttgcatgctggac

SEQ ID NO: 483364 - DNA, 25 bp, Mus musculus
tgcagtaaggagcactcacattgct

SEQ ID NO: 483365 - DNA, 25 bp, Mus musculus
tgcagtaagggatccagcaggcatt

SEQ ID NO: 483366 - DNA, 25 bp, Mus musculus
tgcagtaggatctccaaaccttagg

SEQ ID NO: 483367 - DNA, 25 bp, Mus musculus
tgcagtaggcagaaagggatcagac

SEQ ID NO: 483368 - DNA, 25 bp, Mus musculus
tgcagtatccagttgaaaagtcctc

SEQ ID NO: 483369 - DNA, 25 bp, Mus musculus
tgcagtatggcactacagagcttct

SEQ ID NO: 483370 - DNA, 25 bp, Mus musculus
tgcagtatgtgaaacagccgttcgt

SEQ ID NO: 483371 - DNA, 25 bp, Mus musculus
tgcagtcaaaaagtcctaaaggccg

SEQ ID NO: 483372 - DNA, 25 bp, Mus musculus
tgcagtcaagaccactcggaagaac

SEQ ID NO: 483373 - DNA, 25 bp, Mus musculus
tgcagtcaagccaggcagaccctgc

SEQ ID NO: 483374 - DNA, 25 bp, Mus musculus
tgcagtcaccctccagatgtgccat

SEQ ID NO: 483375 - DNA, 25 bp, Mus musculus
tgcagtcactcacagctcttccaga

SEQ ID NO: 483376 - DNA, 25 bp, Mus musculus
tgcagtcagcgaagagaataccgtg

SEQ ID NO: 483377 - DNA, 25 bp, Mus musculus
tgcagtccacgacaactccagatcg

SEQ ID NO: 483378 - DNA, 25 bp, Mus musculus
tgcagtccagagtgggaaaccccat

SEQ ID NO: 483379 - DNA, 25 bp, Mus musculus
tgcagtccatgccagagtcctaggc

SEQ ID NO: 483380 - DNA, 25 bp, Mus musculus
tgcagtccttcatgggacaggcctt

SEQ ID NO: 483381 - DNA, 25 bp, Mus musculus
tgcagtcgaagtgtcccagttaagg

SEQ ID NO: 483382 - DNA, 25 bp, Mus musculus
tgcagtcgacctgaacatggacggc

SEQ ID NO: 483383 - DNA, 25 bp, Mus musculus
tgcagtcgcacagcagagagtgaag

SEQ ID NO: 483384 - DNA, 25 bp, Mus musculus
tgcagtcggctggagctagcagcac

SEQ ID NO: 483385 - DNA, 25 bp, Mus musculus
tgcagtctaccatgctagaagggca

SEQ ID NO: 483386 - DNA, 25 bp, Mus musculus
tgcagtctattccacactccgatga

SEQ ID NO: 483387 - DNA, 25 bp, Mus musculus
tgcagtctccagaggtcaggtcgtt

SEQ ID NO: 483388 - DNA, 25 bp, Mus musculus
tgcagtctcctaagctgaagaacac

SEQ ID NO: 483389 - DNA, 25 bp, Mus musculus
tgcagtctcctacgagccagggaag

SEQ ID NO: 483390 - DNA, 25 bp, Mus musculus
tgcagtcttgtttcttgccttgctc

SEQ ID NO: 483391 - DNA, 25 bp, Mus musculus
tgcagtgaccctgcggactgggttc

SEQ ID NO: 483392 - DNA, 25 bp, Mus musculus
tgcagtgactgccttgagagccctg

SEQ ID NO: 483393 - DNA, 25 bp, Mus musculus
tgcagtgactgtacgatggctccct

SEQ ID NO: 483394 - DNA, 25 bp, Mus musculus
tgcagtgagaaacagacccggtatt

SEQ ID NO: 483395 - DNA, 25 bp, Mus musculus
tgcagtgagactacaagacccttga

SEQ ID NO: 483396 - DNA, 25 bp, Mus musculus
tgcagtgcagcgtaccaaatggatg

SEQ ID NO: 483397 - DNA, 25 bp, Mus musculus
tgcagtgcccagcacaatactgtaa

SEQ ID NO: 483398 - DNA, 25 bp, Mus musculus
tgcagtgctgccaggaagaactccg

SEQ ID NO: 483399 - DNA, 25 bp, Mus musculus
tgcagtggggatgaaagaagacacc

SEQ ID NO: 483400 - DNA, 25 bp, Mus musculus
tgcagtgtatgcacgagacgcagca

SEQ ID NO: 483401 - DNA, 25 bp, Mus musculus
tgcagttaagaagccagtcgttgac

SEQ ID NO: 483402 - DNA, 25 bp, Mus musculus
tgcagttacccggttgtccggttat

SEQ ID NO: 483403 - DNA, 25 bp, Mus musculus
tgcagttaccgtttggcgatcccac

SEQ ID NO: 483404 - DNA, 25 bp, Mus musculus
tgcagttcgactgtagcccagagct

SEQ ID NO: 483405 - DNA, 25 bp, Mus musculus
tgcagttcgtacacagcaccttggt

SEQ ID NO: 483406 - DNA, 25 bp, Mus musculus
tgcagttcgttttcccaggtggcca

SEQ ID NO: 483407 - DNA, 25 bp, Mus musculus
tgcagttgctacagaccaaggacct

SEQ ID NO: 483408 - DNA, 25 bp, Mus musculus
tgcagttgggcaacccagcagtgaa

SEQ ID NO: 483409 - DNA, 25 bp, Mus musculus
tgcagtttatggagcttagtcccaa

SEQ ID NO: 483410 - DNA, 25 bp, Mus musculus
tgcagtttggcgcagtgacagaccc

SEQ ID NO: 483411 - DNA, 25 bp, Mus musculus
tgcagttttagctctaagaggctct

SEQ ID NO: 483412 - DNA, 25 bp, Mus musculus
tgcataaactccagtggcagcccca

SEQ ID NO: 483413 - DNA, 25 bp, Mus musculus
tgcataaagcaaggcagtcagtaac

SEQ ID NO: 483414 - DNA, 25 bp, Mus musculus
tgcataaatcgacaaccccatgtgg

SEQ ID NO: 483415 - DNA, 25 bp, Mus musculus
tgcataacggagaccaagcgtcctc

SEQ ID NO: 483416 - DNA, 25 bp, Mus musculus
tgcataagagtcagtgagcgagcga

SEQ ID NO: 483417 - DNA, 25 bp, Mus musculus
tgcataagtaagaatatggaccatt

SEQ ID NO: 483418 - DNA, 25 bp, Mus musculus
tgcataagttccgaggaggtgccct

SEQ ID NO: 483419 - DNA, 25 bp, Mus musculus
tgcataatttctctagagggctcac

SEQ ID NO: 483420 - DNA, 25 bp, Mus musculus
tgcatacaaccaaacgaggtgatcc

SEQ ID NO: 483421 - DNA, 25 bp, Mus musculus
tgcatacacagacagagcgactcat

SEQ ID NO: 483422 - DNA, 25 bp, Mus musculus
tgcatacacttagctttgcagagac

SEQ ID NO: 483423 - DNA, 25 bp, Mus musculus
tgcatacaggcatgaagcaaggcgg

SEQ ID NO: 483424 - DNA, 25 bp, Mus musculus
tgcatacatagagagcccagacctt

SEQ ID NO: 483425 - DNA, 25 bp, Mus musculus
tgcataccccctctctcaggagaaa

SEQ ID NO: 483426 - DNA, 25 bp, Mus musculus
tgcatacgatgctgagcaggtgccc

SEQ ID NO: 483427 - DNA, 25 bp, Mus musculus
tgcatacggtttttatatcagtcag

SEQ ID NO: 483428 - DNA, 25 bp, Mus musculus
tgcatactacatagactggctgtgt

SEQ ID NO: 483429 - DNA, 25 bp, Mus musculus
tgcatagccgctttgtggagctgaa

SEQ ID NO: 483430 - DNA, 25 bp, Mus musculus
tgcatagcgacacagccaaaaggat

SEQ ID NO: 483431 - DNA, 25 bp, Mus musculus
tgcatagcgattgctgacagaacgt

SEQ ID NO: 483432 - DNA, 25 bp, Mus musculus
tgcatagtttcacagctccttgggc

SEQ ID NO: 483433 - DNA, 25 bp, Mus musculus
tgcatatccctacgcaggtgaggct

SEQ ID NO: 483434 - DNA, 25 bp, Mus musculus
tgcatatcgcagtgaggacgtccat

SEQ ID NO: 483435 - DNA, 25 bp, Mus musculus
tgcatatcgggacaaacccaggcct

SEQ ID NO: 483436 - DNA, 25 bp, Mus musculus
tgcatatctcagtagtcttcacaag

SEQ ID NO: 483437 - DNA, 25 bp, Mus musculus
tgcatatcttgcttaaagggcacaa

SEQ ID NO: 483438 - DNA, 25 bp, Mus musculus
tgcatattcatagtgccccaaaggt

SEQ ID NO: 483439 - DNA, 25 bp, Mus musculus
tgcatcaaacaggagtcgctgctca

SEQ ID NO: 483440 - DNA, 25 bp, Mus musculus
tgcatcacactgaggatttctgaac

SEQ ID NO: 483441 - DNA, 25 bp, Mus musculus
tgcatcagcctctggcacatttcct

SEQ ID NO: 483442 - DNA, 25 bp, Mus musculus
tgcatcaggatactctcaggacgtg

SEQ ID NO: 483443 - DNA, 25 bp, Mus musculus
tgcatcatgtaagctgaggccctgt

SEQ ID NO: 483444 - DNA, 25 bp, Mus musculus
tgcatcattaatgaaggccttcttg

SEQ ID NO: 483445 - DNA, 25 bp, Mus musculus
tgcatcattcccaacgagcgaaagg

SEQ ID NO: 483446 - DNA, 25 bp, Mus musculus
tgcatccaaacctttctagtagtag

SEQ ID NO: 483447 - DNA, 25 bp, Mus musculus
tgcatccaagacagaagcaccggca

SEQ ID NO: 483448 - DNA, 25 bp, Mus musculus
tgcatcccagcaactcagacagggc

SEQ ID NO: 483449 - DNA, 25 bp, Mus musculus
tgcatccccgagcagatacctactg

SEQ ID NO: 483450 - DNA, 25 bp, Mus musculus
tgcatccgcggttcagttcacagct

SEQ ID NO: 483451 - DNA, 25 bp, Mus musculus
tgcatccggcagaagggtggctact

SEQ ID NO: 483452 - DNA, 25 bp, Mus musculus
tgcatccgtgagcatctaactggga

SEQ ID NO: 483453 - DNA, 25 bp, Mus musculus
tgcatcctaacgatgctttgcatcc

SEQ ID NO: 483454 - DNA, 25 bp, Mus musculus
tgcatcctcaacaaagcagtggtgg

SEQ ID NO: 483455 - DNA, 25 bp, Mus musculus
tgcatcctcccagtggtcagaggag

SEQ ID NO: 483456 - DNA, 25 bp, Mus musculus
tgcatcctcccagtgtaaaggccaa

SEQ ID NO: 483457 - DNA, 25 bp, Mus musculus
tgcatcctgtaccacttctccgttg

SEQ ID NO: 483458 - DNA, 25 bp, Mus musculus
tgcatcgaacaaccagaatcaagat

SEQ ID NO: 483459 - DNA, 25 bp, Mus musculus
tgcatctacagacccaacaggaggt

SEQ ID NO: 483460 - DNA, 25 bp, Mus musculus
tgcatctactctggaggctcctggt

SEQ ID NO: 483461 - DNA, 25 bp, Mus musculus
tgcatctcaggtttggtgcccgatg

SEQ ID NO: 483462 - DNA, 25 bp, Mus musculus
tgcatctccacaggtgctctggcaa

SEQ ID NO: 483463 - DNA, 25 bp, Mus musculus
tgcatctccgacaccatgagcggct

SEQ ID NO: 483464 - DNA, 25 bp, Mus musculus
tgcatctctggctcttgttttgaat

SEQ ID NO: 483465 - DNA, 25 bp, Mus musculus
tgcatctgcagttgaccttctgaac

SEQ ID NO: 483466 - DNA, 25 bp, Mus musculus
tgcatctgctgtgtacaggctgggc

SEQ ID NO: 483467 - DNA, 25 bp, Mus musculus
tgcatctggaacgtctgaacaaacg

SEQ ID NO: 483468 - DNA, 25 bp, Mus musculus
tgcatctggagaatgaacaacgccc

SEQ ID NO: 483469 - DNA, 25 bp, Mus musculus
tgcatctgggatccttcctggttct

SEQ ID NO: 483470 - DNA, 25 bp, Mus musculus
tgcatcttccgtgggcgtgggctga

SEQ ID NO: 483471 - DNA, 25 bp, Mus musculus
tgcatcttccttggaactgggcctg

SEQ ID NO: 483472 - DNA, 25 bp, Mus musculus
tgcatcttctgctgtaaatgctgta

SEQ ID NO: 483473 - DNA, 25 bp, Mus musculus
tgcatcttgagctacaggcatccaa

SEQ ID NO: 483474 - DNA, 25 bp, Mus musculus
tgcatgaaaagatccagctggcccg

SEQ ID NO: 483475 - DNA, 25 bp, Mus musculus
tgcatgaacacccaaatacagttgg

SEQ ID NO: 483476 - DNA, 25 bp, Mus musculus
tgcatgaaccgtaagtggtccttta

SEQ ID NO: 483477 - DNA, 25 bp, Mus musculus
tgcatgaacgcactagacggctgct

SEQ ID NO: 483478 - DNA, 25 bp, Mus musculus
tgcatgactacgatcacccagggag

SEQ ID NO: 483479 - DNA, 25 bp, Mus musculus
tgcatgactactactccttcgtggg

SEQ ID NO: 483480 - DNA, 25 bp, Mus musculus
tgcatgactccagtgctacacctgt

SEQ ID NO: 483481 - DNA, 25 bp, Mus musculus
tgcatgactgtacagcaggcgctct

SEQ ID NO: 483482 - DNA, 25 bp, Mus musculus
tgcatgagaagagcacgacaggcct

SEQ ID NO: 483483 - DNA, 25 bp, Mus musculus
tgcatgagatacgtgtcagcccgga

SEQ ID NO: 483484 - DNA, 25 bp, Mus musculus
tgcatgagccaaagggaataccgtt

SEQ ID NO: 483485 - DNA, 25 bp, Mus musculus
tgcatgagcgaggtgacgcgtttcc

SEQ ID NO: 483486 - DNA, 25 bp, Mus musculus
tgcatgaggacaaaaaccgggtgcc

SEQ ID NO: 483487 - DNA, 25 bp, Mus musculus
tgcatgaggcagaccgtgaatggat

SEQ ID NO: 483488 - DNA, 25 bp, Mus musculus
tgcatgagtcagacaggctttaacc

SEQ ID NO: 483489 - DNA, 25 bp, Mus musculus
tgcatgatcactaaagccagaaact

SEQ ID NO: 483490 - DNA, 25 bp, Mus musculus
tgcatgcagagtgaccacatgagca

SEQ ID NO: 483491 - DNA, 25 bp, Mus musculus
tgcatgcaggaacacggagatctct

SEQ ID NO: 483492 - DNA, 25 bp, Mus musculus
tgcatgcagggctaactctcagggt

SEQ ID NO: 483493 - DNA, 25 bp, Mus musculus
tgcatgcagtagtcagaataactcc

SEQ ID NO: 483494 - DNA, 25 bp, Mus musculus
tgcatgcagtgggtactcctaggac

SEQ ID NO: 483495 - DNA, 25 bp, Mus musculus
tgcatgctaaataccagagtccctg

SEQ ID NO: 483496 - DNA, 25 bp, Mus musculus
tgcatgctcaccgagatctacgtgg

SEQ ID NO: 483497 - DNA, 25 bp, Mus musculus
tgcatgctgccaatcctgaggagct

SEQ ID NO: 483498 - DNA, 25 bp, Mus musculus
tgcatgctggactaaaacgttctgt

SEQ ID NO: 483499 - DNA, 25 bp, Mus musculus
tgcatgcttcgagccgggatttgaa

SEQ ID NO: 483500 - DNA, 25 bp, Mus musculus
tgcatgcttgggtaagaagagctct

SEQ ID NO: 483501 - DNA, 25 bp, Mus musculus
tgcatggaaccaagtagaaagtcat

SEQ ID NO: 483502 - DNA, 25 bp, Mus musculus
tgcatggagcaggtctaactagagg

SEQ ID NO: 483503 - DNA, 25 bp, Mus musculus
tgcatggcctctgtaaccgcaaggc

SEQ ID NO: 483504 - DNA, 25 bp, Mus musculus
tgcatgggcagatctataacaatct

SEQ ID NO: 483505 - DNA, 25 bp, Mus musculus
tgcatgggcccagaccagaagttta

SEQ ID NO: 483506 - DNA, 25 bp, Mus musculus
tgcatgggctagctttggactctcc

SEQ ID NO: 483507 - DNA, 25 bp, Mus musculus
tgcatggtacacacccctctgatgg

SEQ ID NO: 483508 - DNA, 25 bp, Mus musculus
tgcatgtacctagctccaaacggtc

SEQ ID NO: 483509 - DNA, 25 bp, Mus musculus
tgcatgtatatctatggttacaagt

SEQ ID NO: 483510 - DNA, 25 bp, Mus musculus
tgcatgtcgggtaaaggaagtcccc

SEQ ID NO: 483511 - DNA, 25 bp, Mus musculus
tgcatgtctacaaccgcgagggctt

SEQ ID NO: 483512 - DNA, 25 bp, Mus musculus
tgcatgtctataaaattaaccctca

SEQ ID NO: 483513 - DNA, 25 bp, Mus musculus
tgcatgtgccccaagaaccgttaaa

SEQ ID NO: 483514 - DNA, 25 bp, Mus musculus
tgcatgtgtactgtgccagccctga

SEQ ID NO: 483515 - DNA, 25 bp, Mus musculus
tgcatgtgtcggaaaagaacctctc

SEQ ID NO: 483516 - DNA, 25 bp, Mus musculus
tgcatgttctttgggcactcactgt

SEQ ID NO: 483517 - DNA, 25 bp, Mus musculus
tgcatgttgcgtaccactccgcgtg

SEQ ID NO: 483518 - DNA, 25 bp, Mus musculus
tgcatgtttgatagctcagagccac

SEQ ID NO: 483519 - DNA, 25 bp, Mus musculus
tgcattatcactagcagcggcggct

SEQ ID NO: 483520 - DNA, 25 bp, Mus musculus
tgcattcagaaaggttccctggcct

SEQ ID NO: 483521 - DNA, 25 bp, Mus musculus
tgcattcagagactgatgcccctct

SEQ ID NO: 483522 - DNA, 25 bp, Mus musculus
tgcattcaggtacaggcccggaagt

SEQ ID NO: 483523 - DNA, 25 bp, Mus musculus
tgcattcattcgtgagggaccccaa

SEQ ID NO: 483524 - DNA, 25 bp, Mus musculus
tgcattccacctagagccttaagag

SEQ ID NO: 483525 - DNA, 25 bp, Mus musculus
tgcattccggtgtgtcctctcagag

SEQ ID NO: 483526 - DNA, 25 bp, Mus musculus
tgcattcctctaccctagcggaaat

SEQ ID NO: 483527 - DNA, 25 bp, Mus musculus
tgcattcgtgctctccacctcttgg

SEQ ID NO: 483528 - DNA, 25 bp, Mus musculus
tgcattctgcttgtgagagggacgc

SEQ ID NO: 483529 - DNA, 25 bp, Mus musculus
tgcattcttctgactccaggccagt

SEQ ID NO: 483530 - DNA, 25 bp, Mus musculus
tgcattgcattttaatatccaaaac

SEQ ID NO: 483531 - DNA, 25 bp, Mus musculus
tgcattgcccagctgaaggatctcc

SEQ ID NO: 483532 - DNA, 25 bp, Mus musculus
tgcattgcctggagctggccagcga

SEQ ID NO: 483533 - DNA, 25 bp, Mus musculus
tgcattgcgggttctggacatgacg

SEQ ID NO: 483534 - DNA, 25 bp, Mus musculus
tgcattgctcagtccaacagggaac

SEQ ID NO: 483535 - DNA, 25 bp, Mus musculus
tgcattgcttgctcccttctacagt

SEQ ID NO: 483536 - DNA, 25 bp, Mus musculus
tgcatttagtactgagtcaccacag

SEQ ID NO: 483537 - DNA, 25 bp, Mus musculus
tgcatttccaaaaggttcaccgccg

SEQ ID NO: 483538 - DNA, 25 bp, Mus musculus
tgcatttcccctgacaagcattggg

SEQ ID NO: 483539 - DNA, 25 bp, Mus musculus
tgcatttgacccctagtgaccagta

SEQ ID NO: 483540 - DNA, 25 bp, Mus musculus
tgcatttgaggagacacaagcgccc

SEQ ID NO: 483541 - DNA, 25 bp, Mus musculus
tgcatttgagtgagtgcttctatca

SEQ ID NO: 483542 - DNA, 25 bp, Mus musculus
tgcatttgctgagggtagccagtaa

SEQ ID NO: 483543 - DNA, 25 bp, Mus musculus
tgcatttgtacacgccttgggagac

SEQ ID NO: 483544 - DNA, 25 bp, Mus musculus
tgccaaaacatgctggtcagaagcc

SEQ ID NO: 483545 - DNA, 25 bp, Mus musculus
tgccaaaccggccacattgtactag

SEQ ID NO: 483546 - DNA, 25 bp, Mus musculus
tgccaaactggagaagctagactct

SEQ ID NO: 483547 - DNA, 25 bp, Mus musculus
tgccaaagaaatacgctccagagtg

SEQ ID NO: 483548 - DNA, 25 bp, Mus musculus
tgccaaaggaatagtgcccacatcc

SEQ ID NO: 483549 - DNA, 25 bp, Mus musculus
tgccaaaggatttagagatcctggg

SEQ ID NO: 483550 - DNA, 25 bp, Mus musculus
tgccaaagggcagttccaacaactt

SEQ ID NO: 483551 - DNA, 25 bp, Mus musculus
tgccaaagggtaagacggccgagct

SEQ ID NO: 483552 - DNA, 25 bp, Mus musculus
tgccaaagtagagaggactgaccct

SEQ ID NO: 483553 - DNA, 25 bp, Mus musculus
tgccaacaagcagagtaacaagatc

SEQ ID NO: 483554 - DNA, 25 bp, Mus musculus
tgccaacacactggaagttactttt

SEQ ID NO: 483555 - DNA, 25 bp, Mus musculus
tgccaacaccacaatttatgcggag

SEQ ID NO: 483556 - DNA, 25 bp, Mus musculus
tgccaacagcggacacatcgagttt

SEQ ID NO: 483557 - DNA, 25 bp, Mus musculus
tgccaacatctagggaacgggatcc

SEQ ID NO: 483558 - DNA, 25 bp, Mus musculus
tgccaacattaaccatatatctgcg

SEQ ID NO: 483559 - DNA, 25 bp, Mus musculus
tgccaacccacccaagaagttcaga

SEQ ID NO: 483560 - DNA, 25 bp, Mus musculus
tgccaacctgtcacctgtagagaga

SEQ ID NO: 483561 - DNA, 25 bp, Mus musculus
tgccaacgacaagagtctcatgttc

SEQ ID NO: 483562 - DNA, 25 bp, Mus musculus
tgccaacgagttttcaaatggagtt

SEQ ID NO: 483563 - DNA, 25 bp, Mus musculus
tgccaacgcaaggtcacagggatga

SEQ ID NO: 483564 - DNA, 25 bp, Mus musculus
tgccaacgcctacgatgctttcagg

SEQ ID NO: 483565 - DNA, 25 bp, Mus musculus
tgccaacggaggatatcagtctgct

SEQ ID NO: 483566 - DNA, 25 bp, Mus musculus
tgccaacggcgaggtgactgatttc

SEQ ID NO: 483567 - DNA, 25 bp, Mus musculus
tgccaacgttcaggaggatcacaag

SEQ ID NO: 483568 - DNA, 25 bp, Mus musculus
tgccaactccagctaaatcacagac

SEQ ID NO: 483569 - DNA, 25 bp, Mus musculus
tgccaactgagaaggacgagcgact

SEQ ID NO: 483570 - DNA, 25 bp, Mus musculus
tgccaacttcttcaagctgcaggaa

SEQ ID NO: 483571 - DNA, 25 bp, Mus musculus
tgccaagaaaactccactgtcagtt

SEQ ID NO: 483572 - DNA, 25 bp, Mus musculus
tgccaagaacctcatgaccatgtgc

SEQ ID NO: 483573 - DNA, 25 bp, Mus musculus
tgccaagaactgtgcgctgagctcg

SEQ ID NO: 483574 - DNA, 25 bp, Mus musculus
tgccaagagtgtgtttgaacctgac

SEQ ID NO: 483575 - DNA, 25 bp, Mus musculus
tgccaagccgggagattgacaaggc

SEQ ID NO: 483576 - DNA, 25 bp, Mus musculus
tgccaagcgttcctgatggacaggc

SEQ ID NO: 483577 - DNA, 25 bp, Mus musculus
tgccaagctgctcgtgtcaaacctg

SEQ ID NO: 483578 - DNA, 25 bp, Mus musculus
tgccaaggagccacgagatctgagt

SEQ ID NO: 483579 - DNA, 25 bp, Mus musculus
tgccaaggcaccaaaggatttccca

SEQ ID NO: 483580 - DNA, 25 bp, Mus musculus
tgccaaggcgaaaggagaaacatct

SEQ ID NO: 483581 - DNA, 25 bp, Mus musculus
tgccaaggctgcatcacggtgtact

SEQ ID NO: 483582 - DNA, 25 bp, Mus musculus
tgccaagggtcatcacatagtattc

SEQ ID NO: 483583 - DNA, 25 bp, Mus musculus
tgccaaggtgaaccagcttctcaag

SEQ ID NO: 483584 - DNA, 25 bp, Mus musculus
tgccaaggtgctctgcgtgtccaaa

SEQ ID NO: 483585 - DNA, 25 bp, Mus musculus
tgccaagtagccacatcgagggact

SEQ ID NO: 483586 - DNA, 25 bp, Mus musculus
tgccaatatagcagagaactcggtg

SEQ ID NO: 483587 - DNA, 25 bp, Mus musculus
tgccaatgacaagcccagtctgagt

SEQ ID NO: 483588 - DNA, 25 bp, Mus musculus
tgccaatgggcctgagaaagtcaca

SEQ ID NO: 483589 - DNA, 25 bp, Mus musculus
tgccaatgtcggaataggaggcagc

SEQ ID NO: 483590 - DNA, 25 bp, Mus musculus
tgccaattaacctgactcctctgcg

SEQ ID NO: 483591 - DNA, 25 bp, Mus musculus
tgccaattgttgagaagctctgggt

SEQ ID NO: 483592 - DNA, 25 bp, Mus musculus
tgccacaaagtaaacgactaggaaa

SEQ ID NO: 483593 - DNA, 25 bp, Mus musculus
tgccacaacgctgggcactgaaatt

SEQ ID NO: 483594 - DNA, 25 bp, Mus musculus
tgccacaaggaacaagtcattaagg

SEQ ID NO: 483595 - DNA, 25 bp, Mus musculus
tgccacacactaaagagcaacagag

SEQ ID NO: 483596 - DNA, 25 bp, Mus musculus
tgccacacagagtccagaagggttt

SEQ ID NO: 483597 - DNA, 25 bp, Mus musculus
tgccacactgttggttgggcccagg

SEQ ID NO: 483598 - DNA, 25 bp, Mus musculus
tgccacagagttcaccgaaagtcta

SEQ ID NO: 483599 - DNA, 25 bp, Mus musculus
tgccacatcaaaggccgtgttcagg

SEQ ID NO: 483600 - DNA, 25 bp, Mus musculus
tgccacatctgtggaggtgccacct

SEQ ID NO: 483601 - DNA, 25 bp, Mus musculus
tgccacatgctgcaccaagggaagt

SEQ ID NO: 483602 - DNA, 25 bp, Mus musculus
tgccacatggtgacagaggagttgc

SEQ ID NO: 483603 - DNA, 25 bp, Mus musculus
tgccacattagctggtgacacggct

SEQ ID NO: 483604 - DNA, 25 bp, Mus musculus
tgccaccaataccactcgggagagg

SEQ ID NO: 483605 - DNA, 25 bp, Mus musculus
tgccaccacaaatactgagtccatt

SEQ ID NO: 483606 - DNA, 25 bp, Mus musculus
tgccaccagggaaagccactttcca

SEQ ID NO: 483607 - DNA, 25 bp, Mus musculus
tgccaccaggtcaaatgaattagag

SEQ ID NO: 483608 - DNA, 25 bp, Mus musculus
tgccaccgcagaggtccaagattcg

SEQ ID NO: 483609 - DNA, 25 bp, Mus musculus
tgccacctgcaacaagttctgccgg

SEQ ID NO: 483610 - DNA, 25 bp, Mus musculus
tgccacctttgccatacattctctg

SEQ ID NO: 483611 - DNA, 25 bp, Mus musculus
tgccacggtcctgggtcctgactga

SEQ ID NO: 483612 - DNA, 25 bp, Mus musculus
tgccactagaccagcctgaactgag

SEQ ID NO: 483613 - DNA, 25 bp, Mus musculus
tgccactctcgagaaaagacagcgg

SEQ ID NO: 483614 - DNA, 25 bp, Mus musculus
tgccactgagaacagggcgccgcat

SEQ ID NO: 483615 - DNA, 25 bp, Mus musculus
tgccactgaggtctattgcagagag

SEQ ID NO: 483616 - DNA, 25 bp, Mus musculus
tgccactgatgttgcctccagatgg

SEQ ID NO: 483617 - DNA, 25 bp, Mus musculus
tgccactgcaggtcggagacactgt

SEQ ID NO: 483618 - DNA, 25 bp, Mus musculus
tgccactggtgcaccctagtagcag

SEQ ID NO: 483619 - DNA, 25 bp, Mus musculus
tgccactgtaggcacagaatgctct

SEQ ID NO: 483620 - DNA, 25 bp, Mus musculus
tgccacttatacaaacagaagctgt

SEQ ID NO: 483621 - DNA, 25 bp, Mus musculus
tgccagaaccaaggagcgtgtcgag

SEQ ID NO: 483622 - DNA, 25 bp, Mus musculus
tgccagaagctacaattgcgttaaa

SEQ ID NO: 483623 - DNA, 25 bp, Mus musculus
tgccagaatcatcggaccagaggtg

SEQ ID NO: 483624 - DNA, 25 bp, Mus musculus
tgccagacgctgagtaacaggacct

SEQ ID NO: 483625 - DNA, 25 bp, Mus musculus
tgccagacttttgcctgtaccaggg

SEQ ID NO: 483626 - DNA, 25 bp, Mus musculus
tgccagagaacccttcaaatgccgt

SEQ ID NO: 483627 - DNA, 25 bp, Mus musculus
tgccagaggaaaagcacaatcaatg

SEQ ID NO: 483628 - DNA, 25 bp, Mus musculus
tgccagatacgctcacagggacttt

SEQ ID NO: 483629 - DNA, 25 bp, Mus musculus
tgccagattagcaggtcacccgctt

SEQ ID NO: 483630 - DNA, 25 bp, Mus musculus
tgccagattgtaccacaaaccctca

SEQ ID NO: 483631 - DNA, 25 bp, Mus musculus
tgccagcacatttaagggaagagag

SEQ ID NO: 483632 - DNA, 25 bp, Mus musculus
tgccagcacggctttgggaaacagt

SEQ ID NO: 483633 - DNA, 25 bp, Mus musculus
tgccagcagaatggacagcagcgct

SEQ ID NO: 483634 - DNA, 25 bp, Mus musculus
tgccagcaggagttggaccaggtcc

SEQ ID NO: 483635 - DNA, 25 bp, Mus musculus
tgccagcatgagagagggcatcttg

SEQ ID NO: 483636 - DNA, 25 bp, Mus musculus
tgccagcatgagtggtaaccaaggg

SEQ ID NO: 483637 - DNA, 25 bp, Mus musculus
tgccagccaagctgttgcgagactg

SEQ ID NO: 483638 - DNA, 25 bp, Mus musculus
tgccagccaccgagatgaatatgtc

SEQ ID NO: 483639 - DNA, 25 bp, Mus musculus
tgccagccaggctcaccttgtgagt

SEQ ID NO: 483640 - DNA, 25 bp, Mus musculus
tgccagcccatatcagtaaaatttc

SEQ ID NO: 483641 - DNA, 25 bp, Mus musculus
tgccagccccggcttttaacggact

SEQ ID NO: 483642 - DNA, 25 bp, Mus musculus
tgccagcccgctgactgatgtgagg

SEQ ID NO: 483643 - DNA, 25 bp, Mus musculus
tgccagcctagcaatgctgccgacg

SEQ ID NO: 483644 - DNA, 25 bp, Mus musculus
tgccagcctcctcagtcaagagaag

SEQ ID NO: 483645 - DNA, 25 bp, Mus musculus
tgccagcgggccatagaaacatgac

SEQ ID NO: 483646 - DNA, 25 bp, Mus musculus
tgccagcggtggttgctgtcaccag

SEQ ID NO: 483647 - DNA, 25 bp, Mus musculus
tgccagcgtcgccaaggagagtatc

SEQ ID NO: 483648 - DNA, 25 bp, Mus musculus
tgccagcgtgccagaggtaaagtct

SEQ ID NO: 483649 - DNA, 25 bp, Mus musculus
tgccagctacgctaggagccaagct

SEQ ID NO: 483650 - DNA, 25 bp, Mus musculus
tgccagctctacctgaatgagaagg

SEQ ID NO: 483651 - DNA, 25 bp, Mus musculus
tgccagctgagagttgagaccggtt

SEQ ID NO: 483652 - DNA, 25 bp, Mus musculus
tgccagctgagggagtcacaggtat

SEQ ID NO: 483653 - DNA, 25 bp, Mus musculus
tgccagctgcatgtgataaacgacc

SEQ ID NO: 483654 - DNA, 25 bp, Mus musculus
tgccagctggaccagcaacttcggg

SEQ ID NO: 483655 - DNA, 25 bp, Mus musculus
tgccagctgtcagaggcacagaaaa

SEQ ID NO: 483656 - DNA, 25 bp, Mus musculus
tgccaggacacttgtgagcctccct

SEQ ID NO: 483657 - DNA, 25 bp, Mus musculus
tgccaggactctccagtctgagccg

SEQ ID NO: 483658 - DNA, 25 bp, Mus musculus
tgccaggactggaaggactgaaccc

SEQ ID NO: 483659 - DNA, 25 bp, Mus musculus
tgccaggcacaaatcctttcccaga

SEQ ID NO: 483660 - DNA, 25 bp, Mus musculus
tgccaggcagcgcttataaatcaac

SEQ ID NO: 483661 - DNA, 25 bp, Mus musculus
tgccaggcatgagctgaaggacttg

SEQ ID NO: 483662 - DNA, 25 bp, Mus musculus
tgccaggcccattatcgacttcgag

SEQ ID NO: 483663 - DNA, 25 bp, Mus musculus
tgccaggctggcaaaagaagcaagg

SEQ ID NO: 483664 - DNA, 25 bp, Mus musculus
tgccagggagagcactccagatcca

SEQ ID NO: 483665 - DNA, 25 bp, Mus musculus
tgccagggaggctttaccggatctt

SEQ ID NO: 483666 - DNA, 25 bp, Mus musculus
tgccagggcttgtaagataatgaag

SEQ ID NO: 483667 - DNA, 25 bp, Mus musculus
tgccaggtatgggtgagacttgtca

SEQ ID NO: 483668 - DNA, 25 bp, Mus musculus
tgccagtccgcatcccatagtagga

SEQ ID NO: 483669 - DNA, 25 bp, Mus musculus
tgccagtgactggaacgttcaagac

SEQ ID NO: 483670 - DNA, 25 bp, Mus musculus
tgccagtgcagggaccggcactaag

SEQ ID NO: 483671 - DNA, 25 bp, Mus musculus
tgccagtggttatcttagaaagagc

SEQ ID NO: 483672 - DNA, 25 bp, Mus musculus
tgccataaacagatcaaccgccttg

SEQ ID NO: 483673 - DNA, 25 bp, Mus musculus
tgccatcaactaccagggcctgagt

SEQ ID NO: 483674 - DNA, 25 bp, Mus musculus
tgccatcagatttgccgacgagaag

SEQ ID NO: 483675 - DNA, 25 bp, Mus musculus
tgccatcatgcacgagtggaagtcg

SEQ ID NO: 483676 - DNA, 25 bp, Mus musculus
tgccatccacgtgcatgagttcggg

SEQ ID NO: 483677 - DNA, 25 bp, Mus musculus
tgccatccctgtcccgaagagacaa

SEQ ID NO: 483678 - DNA, 25 bp, Mus musculus
tgccatccgccagaagaatcaaggg

SEQ ID NO: 483679 - DNA, 25 bp, Mus musculus
tgccatccgccattgaaagaagtgt

SEQ ID NO: 483680 - DNA, 25 bp, Mus musculus
tgccatcctggacgctcttgaaaac

SEQ ID NO: 483681 - DNA, 25 bp, Mus musculus
tgccatccttgaccagagggaccaa

SEQ ID NO: 483682 - DNA, 25 bp, Mus musculus
tgccatcgaggtagctgacaaagag

SEQ ID NO: 483683 - DNA, 25 bp, Mus musculus
tgccatcgcggtgggaaaggattcc

SEQ ID NO: 483684 - DNA, 25 bp, Mus musculus
tgccatcgttccctgtctcctgaaa

SEQ ID NO: 483685 - DNA, 25 bp, Mus musculus
tgccatctctgctttggtacccaga

SEQ ID NO: 483686 - DNA, 25 bp, Mus musculus
tgccatctggctatctccagtgtta

SEQ ID NO: 483687 - DNA, 25 bp, Mus musculus
tgccatctgggcactgtgcgcttcc

SEQ ID NO: 483688 - DNA, 25 bp, Mus musculus
tgccatcttgctggatgaacagaac

SEQ ID NO: 483689 - DNA, 25 bp, Mus musculus
tgccatcttggaggacacagggacc

SEQ ID NO: 483690 - DNA, 25 bp, Mus musculus
tgccatcttggagtgcagcacaggt

SEQ ID NO: 483691 - DNA, 25 bp, Mus musculus
tgccatgcaaacacaaggatcagcg

SEQ ID NO: 483692 - DNA, 25 bp, Mus musculus
tgccatgcagagaaggacaggagac

SEQ ID NO: 483693 - DNA, 25 bp, Mus musculus
tgccatggccggagagatgtctcag

SEQ ID NO: 483694 - DNA, 25 bp, Mus musculus
tgccatggcgcagttcgtgttcgag

SEQ ID NO: 483695 - DNA, 25 bp, Mus musculus
tgccatgggcccaaagtaatgggac

SEQ ID NO: 483696 - DNA, 25 bp, Mus musculus
tgccatgtatggagagacaacaaag

SEQ ID NO: 483697 - DNA, 25 bp, Mus musculus
tgccattaacatgtctggagtcgac

SEQ ID NO: 483698 - DNA, 25 bp, Mus musculus
tgccattatggctcccacagacagc

SEQ ID NO: 483699 - DNA, 25 bp, Mus musculus
tgccattcagaaacatccacgtgcg

SEQ ID NO: 483700 - DNA, 25 bp, Mus musculus
tgccattcggccagagaagcaggcc

SEQ ID NO: 483701 - DNA, 25 bp, Mus musculus
tgccattgaccagctgggcttcggt

SEQ ID NO: 483702 - DNA, 25 bp, Mus musculus
tgccattgccaatgacgtccatgcc

SEQ ID NO: 483703 - DNA, 25 bp, Mus musculus
tgccattgctgctgtagccggccac

SEQ ID NO: 483704 - DNA, 25 bp, Mus musculus
tgccatttgtgagtttctgccctgt

SEQ ID NO: 483705 - DNA, 25 bp, Mus musculus
tgcccaacaagaagtggccgactgt

SEQ ID NO: 483706 - DNA, 25 bp, Mus musculus
tgcccaagaagagggacatggaaaa

SEQ ID NO: 483707 - DNA, 25 bp, Mus musculus
tgcccaagaggtcgaagccaatgtc

SEQ ID NO: 483708 - DNA, 25 bp, Mus musculus
tgcccaagggctcgatgactgccat

SEQ ID NO: 483709 - DNA, 25 bp, Mus musculus
tgcccaaggtcaacaagaaggctgg

SEQ ID NO: 483710 - DNA, 25 bp, Mus musculus
tgcccaagtctggagcagatagtgc

SEQ ID NO: 483711 - DNA, 25 bp, Mus musculus
tgcccaattggataaagccctagag

SEQ ID NO: 483712 - DNA, 25 bp, Mus musculus
tgcccacatcgaaagcctgcaggag

SEQ ID NO: 483713 - DNA, 25 bp, Mus musculus
tgcccacatggttggttcagccctg

SEQ ID NO: 483714 - DNA, 25 bp, Mus musculus
tgcccaccctcagaggtgcaaatgt

SEQ ID NO: 483715 - DNA, 25 bp, Mus musculus
tgcccacgactgttgctatgagaag

SEQ ID NO: 483716 - DNA, 25 bp, Mus musculus
tgcccacgcattgaagtaatttctt

SEQ ID NO: 483717 - DNA, 25 bp, Mus musculus
tgcccacgctgcaggtttttcaggt

SEQ ID NO: 483718 - DNA, 25 bp, Mus musculus
tgcccacggacccatacagatgcag

SEQ ID NO: 483719 - DNA, 25 bp, Mus musculus
tgcccacggtatcaggaaatgttcc

SEQ ID NO: 483720 - DNA, 25 bp, Mus musculus
tgcccacggtggtgcagtattccaa

SEQ ID NO: 483721 - DNA, 25 bp, Mus musculus
tgcccactggaaggaactagcacct

SEQ ID NO: 483722 - DNA, 25 bp, Mus musculus
tgcccactgggcaaggacacttgaa

SEQ ID NO: 483723 - DNA, 25 bp, Mus musculus
tgcccactgggcagaaatttcacag

SEQ ID NO: 483724 - DNA, 25 bp, Mus musculus
tgcccacttctcttaactcagggtg

SEQ ID NO: 483725 - DNA, 25 bp, Mus musculus
tgcccagaaagctgtgcacgatgat

SEQ ID NO: 483726 - DNA, 25 bp, Mus musculus
tgcccagaaattaaaaagctcatgt

SEQ ID NO: 483727 - DNA, 25 bp, Mus musculus
tgcccagagatcagaacaatggcct

SEQ ID NO: 483728 - DNA, 25 bp, Mus musculus
tgcccagagctagggtcactgaatt

SEQ ID NO: 483729 - DNA, 25 bp, Mus musculus
tgcccagaggagtggttaaccagat

SEQ ID NO: 483730 - DNA, 25 bp, Mus musculus
tgcccagaggcgcatgaagctaatg

SEQ ID NO: 483731 - DNA, 25 bp, Mus musculus
tgcccagagggcacatactcagatg

SEQ ID NO: 483732 - DNA, 25 bp, Mus musculus
tgcccagaggttcgactacacaaga

SEQ ID NO: 483733 - DNA, 25 bp, Mus musculus
tgcccagagtatggttgtgccaccc

SEQ ID NO: 483734 - DNA, 25 bp, Mus musculus
tgcccagcacaatactgtaaataag

SEQ ID NO: 483735 - DNA, 25 bp, Mus musculus
tgcccagcagacttccccataggga

SEQ ID NO: 483736 - DNA, 25 bp, Mus musculus
tgcccagcagcaagaggatgcggac

SEQ ID NO: 483737 - DNA, 25 bp, Mus musculus
tgcccagcccatgatatcagtgaag

SEQ ID NO: 483738 - DNA, 25 bp, Mus musculus
tgcccagcctgtatgacgacattgt

SEQ ID NO: 483739 - DNA, 25 bp, Mus musculus
tgcccagcggatctcactgttgagc

SEQ ID NO: 483740 - DNA, 25 bp, Mus musculus
tgcccagctaattcggactcaggag

SEQ ID NO: 483741 - DNA, 25 bp, Mus musculus
tgcccaggccggagtttaaccagtc

SEQ ID NO: 483742 - DNA, 25 bp, Mus musculus
tgcccaggcgcaatgctcatgtgaa

SEQ ID NO: 483743 - DNA, 25 bp, Mus musculus
tgcccaggctatgagacaggacagt

SEQ ID NO: 483744 - DNA, 25 bp, Mus musculus
tgcccagggtccagaacctagacca

SEQ ID NO: 483745 - DNA, 25 bp, Mus musculus
tgcccagggtgagtgtaacatttac

SEQ ID NO: 483746 - DNA, 25 bp, Mus musculus
tgcccaggtggtttgggtatttaag

SEQ ID NO: 483747 - DNA, 25 bp, Mus musculus
tgcccagtagttatgctcttcagaa

SEQ ID NO: 483748 - DNA, 25 bp, Mus musculus
tgcccagtctaggaaatcgttcagc

SEQ ID NO: 483749 - DNA, 25 bp, Mus musculus
tgcccagtctgaagtcactattttc

SEQ ID NO: 483750 - DNA, 25 bp, Mus musculus
tgcccagtggacacgttgctcacat

SEQ ID NO: 483751 - DNA, 25 bp, Mus musculus
tgcccagtgggagaaagaaccagtc

SEQ ID NO: 483752 - DNA, 25 bp, Mus musculus
tgcccagtgggttgagtcaccacct

SEQ ID NO: 483753 - DNA, 25 bp, Mus musculus
tgcccagtgtgcagcaggacagact

SEQ ID NO: 483754 - DNA, 25 bp, Mus musculus
tgcccagttcatggttagttcacag

SEQ ID NO: 483755 - DNA, 25 bp, Mus musculus
tgcccatacagaggacagtcaagtg

SEQ ID NO: 483756 - DNA, 25 bp, Mus musculus
tgcccatacaggtcatgctggctcc

SEQ ID NO: 483757 - DNA, 25 bp, Mus musculus
tgcccatagcggtgggagcagctct

SEQ ID NO: 483758 - DNA, 25 bp, Mus musculus
tgcccatagtcacaacacaggtaga

SEQ ID NO: 483759 - DNA, 25 bp, Mus musculus
tgcccatcaggttggagagttgttt

SEQ ID NO: 483760 - DNA, 25 bp, Mus musculus
tgcccatccatctggtgaaggagcg

SEQ ID NO: 483761 - DNA, 25 bp, Mus musculus
tgcccatccgatccctttaagggtt

SEQ ID NO: 483762 - DNA, 25 bp, Mus musculus
tgcccatcctgtgagtcagaacaca

SEQ ID NO: 483763 - DNA, 25 bp, Mus musculus
tgcccatcgcagaggttacggtgga

SEQ ID NO: 483764 - DNA, 25 bp, Mus musculus
tgcccatgatgaaaaccgaggagct

SEQ ID NO: 483765 - DNA, 25 bp, Mus musculus
tgcccatgatgtaccgggaagggaa

SEQ ID NO: 483766 - DNA, 25 bp, Mus musculus
tgcccatgtgtcagatttcagtgct

SEQ ID NO: 483767 - DNA, 25 bp, Mus musculus
tgcccattggatttaagaatggcct

SEQ ID NO: 483768 - DNA, 25 bp, Mus musculus
tgcccattgtcgatctggagaccca

SEQ ID NO: 483769 - DNA, 25 bp, Mus musculus
tgcccattgtcggtccggaggccag

SEQ ID NO: 483770 - DNA, 25 bp, Mus musculus
tgccccaacctgaaggagactggta

SEQ ID NO: 483771 - DNA, 25 bp, Mus musculus
tgccccaaggaagctacagagtcaa

SEQ ID NO: 483772 - DNA, 25 bp, Mus musculus
tgccccaagtgcgacaaggaggtgt

SEQ ID NO: 483773 - DNA, 25 bp, Mus musculus
tgccccagattcagagaggagtgtg

SEQ ID NO: 483774 - DNA, 25 bp, Mus musculus
tgcccccaggttaggagacaggcag

SEQ ID NO: 483775 - DNA, 25 bp, Mus musculus
tgccccgagattcctgagcgcggct

SEQ ID NO: 483776 - DNA, 25 bp, Mus musculus
tgccccgagtgctatgaggtgaccc

SEQ ID NO: 483777 - DNA, 25 bp, Mus musculus
tgccccgcagatgaggttccaggtt

SEQ ID NO: 483778 - DNA, 25 bp, Mus musculus
tgccccggaagatcctcagctgagt

SEQ ID NO: 483779 - DNA, 25 bp, Mus musculus
tgccccggactgagcgaatcttcaa

SEQ ID NO: 483780 - DNA, 25 bp, Mus musculus
tgccccgggaattctgaagtactgg

SEQ ID NO: 483781 - DNA, 25 bp, Mus musculus
tgccccgtatcaggccaggttactt

SEQ ID NO: 483782 - DNA, 25 bp, Mus musculus
tgccccgtctgcagggttggtgtcc

SEQ ID NO: 483783 - DNA, 25 bp, Mus musculus
tgcccctaaaggaggtacagataga

SEQ ID NO: 483784 - DNA, 25 bp, Mus musculus
tgcccctaagcgttgatttgctcaa

SEQ ID NO: 483785 - DNA, 25 bp, Mus musculus
tgcccctattgaagttatctcccca

SEQ ID NO: 483786 - DNA, 25 bp, Mus musculus
tgcccctcacagcacagttgatgga

SEQ ID NO: 483787 - DNA, 25 bp, Mus musculus
tgcccctcgctgtccatgaaaatgt

SEQ ID NO: 483788 - DNA, 25 bp, Mus musculus
tgcccctctggaagtccctcgtgtg

SEQ ID NO: 483789 - DNA, 25 bp, Mus musculus
tgcccctctggagtgatacccaggt

SEQ ID NO: 483790 - DNA, 25 bp, Mus musculus
tgcccctctgggatcaactggagaa

SEQ ID NO: 483791 - DNA, 25 bp, Mus musculus
tgcccctgagtgttgagaagaaccg

SEQ ID NO: 483792 - DNA, 25 bp, Mus musculus
tgcccctggcgtcaagagaatcgtc

SEQ ID NO: 483793 - DNA, 25 bp, Mus musculus
tgcccctgggttaattatgcaccat

SEQ ID NO: 483794 - DNA, 25 bp, Mus musculus
tgcccctggtgggtagtctaccgtt

SEQ ID NO: 483795 - DNA, 25 bp, Mus musculus
tgccccttaaaaaggaatattgtag

SEQ ID NO: 483796 - DNA, 25 bp, Mus musculus
tgccccttggatagagtaagttggc

SEQ ID NO: 483797 - DNA, 25 bp, Mus musculus
tgcccgaactcctcccagagtaaaa

SEQ ID NO: 483798 - DNA, 25 bp, Mus musculus
tgcccgaatgaacaagaggatcctt

SEQ ID NO: 483799 - DNA, 25 bp, Mus musculus
tgcccgagagctggtagtgaactgc

SEQ ID NO: 483800 - DNA, 25 bp, Mus musculus
tgcccgaggccctaatgcatgtgta

SEQ ID NO: 483801 - DNA, 25 bp, Mus musculus
tgcccgagggtcatgcccagtgttc

SEQ ID NO: 483802 - DNA, 25 bp, Mus musculus
tgcccgaggtaaagcacttctgccc

SEQ ID NO: 483803 - DNA, 25 bp, Mus musculus
tgcccgaggttcaaggagtaacgtc

SEQ ID NO: 483804 - DNA, 25 bp, Mus musculus
tgcccgagtccgacgctggagttgt

SEQ ID NO: 483805 - DNA, 25 bp, Mus musculus
tgcccgataagatagtaggagccct

SEQ ID NO: 483806 - DNA, 25 bp, Mus musculus
tgcccgcaagcctgaagacagatct

SEQ ID NO: 483807 - DNA, 25 bp, Mus musculus
tgcccgcagagggaaagacaaaagg

SEQ ID NO: 483808 - DNA, 25 bp, Mus musculus
tgcccgcagtcactagaagcagttc

SEQ ID NO: 483809 - DNA, 25 bp, Mus musculus
tgcccgccctgcattttatcaaagg

SEQ ID NO: 483810 - DNA, 25 bp, Mus musculus
tgcccgccctgcgtaaagtgatggc

SEQ ID NO: 483811 - DNA, 25 bp, Mus musculus
tgcccgcctggtcaagtcttatgaa

SEQ ID NO: 483812 - DNA, 25 bp, Mus musculus
tgcccgcgggcaaaatgaaccaccg

SEQ ID NO: 483813 - DNA, 25 bp, Mus musculus
tgcccgctgggagtaataagcctaa

SEQ ID NO: 483814 - DNA, 25 bp, Mus musculus
tgcccgctgtgaacgaggctccgtt

SEQ ID NO: 483815 - DNA, 25 bp, Mus musculus
tgcccggaacattgtgacaaaactg

SEQ ID NO: 483816 - DNA, 25 bp, Mus musculus
tgcccggagccgacatgatgacgat

SEQ ID NO: 483817 - DNA, 25 bp, Mus musculus
tgcccggcaaagtctgcaggcagat

SEQ ID NO: 483818 - DNA, 25 bp, Mus musculus
tgcccggcagggtttcagtgtcaca

SEQ ID NO: 483819 - DNA, 25 bp, Mus musculus
tgcccggccaacaggtgaaattaag

SEQ ID NO: 483820 - DNA, 25 bp, Mus musculus
tgcccggcggtatcacctggaggcc

SEQ ID NO: 483821 - DNA, 25 bp, Mus musculus
tgcccgggactgaacacagtatgcc

SEQ ID NO: 483822 - DNA, 25 bp, Mus musculus
tgcccgggtacaagtgcagcatcaa

SEQ ID NO: 483823 - DNA, 25 bp, Mus musculus
tgcccgggtgtggaagcactttcag

SEQ ID NO: 483824 - DNA, 25 bp, Mus musculus
tgcccggtggattgcagacagaact

SEQ ID NO: 483825 - DNA, 25 bp, Mus musculus
tgcccgtaccacagctttcctggag

SEQ ID NO: 483826 - DNA, 25 bp, Mus musculus
tgcccgtcccgtgaaagaggaagct

SEQ ID NO: 483827 - DNA, 25 bp, Mus musculus
tgcccgtgacggaagccacttaatc

SEQ ID NO: 483828 - DNA, 25 bp, Mus musculus
tgcccgtgggtcatcggcggacagg

SEQ ID NO: 483829 - DNA, 25 bp, Mus musculus
tgcccgtgtctgtgctggcgccctt

SEQ ID NO: 483830 - DNA, 25 bp, Mus musculus
tgcccgtgtgaagaggaaacttcgg

SEQ ID NO: 483831 - DNA, 25 bp, Mus musculus
tgcccgtgtttgtcgcgagccccgg

SEQ ID NO: 483832 - DNA, 25 bp, Mus musculus
tgcccgttactacctgaccgagaag

SEQ ID NO: 483833 - DNA, 25 bp, Mus musculus
tgcccgttttaaaaatggtgcttcg

SEQ ID NO: 483834 - DNA, 25 bp, Mus musculus
tgccctaaccaactgataatgtgct

SEQ ID NO: 483835 - DNA, 25 bp, Mus musculus
tgccctaatagaagcgaagttcctc

SEQ ID NO: 483836 - DNA, 25 bp, Mus musculus
tgccctacaaatagactgaccacgg

SEQ ID NO: 483837 - DNA, 25 bp, Mus musculus
tgccctacaaggagaagcaccggaa

SEQ ID NO: 483838 - DNA, 25 bp, Mus musculus
tgccctacaagtcaactgtctgctg

SEQ ID NO: 483839 - DNA, 25 bp, Mus musculus
tgccctacctcctgagctgggagat

SEQ ID NO: 483840 - DNA, 25 bp, Mus musculus
tgccctactaggagctgtgacagag

SEQ ID NO: 483841 - DNA, 25 bp, Mus musculus
tgccctagaactgcgtgacctctgt

SEQ ID NO: 483842 - DNA, 25 bp, Mus musculus
tgccctagacgctgtgccagaggag

SEQ ID NO: 483843 - DNA, 25 bp, Mus musculus
tgccctagatccttccagtgaccgg

SEQ ID NO: 483844 - DNA, 25 bp, Mus musculus
tgccctaggctgtgacagtatctcc

SEQ ID NO: 483845 - DNA, 25 bp, Mus musculus
tgccctaggctgtgcgagcaatcaa

SEQ ID NO: 483846 - DNA, 25 bp, Mus musculus
tgccctagtgcaaaagccggttacc

SEQ ID NO: 483847 - DNA, 25 bp, Mus musculus
tgccctatcagtgggaatatccgta

SEQ ID NO: 483848 - DNA, 25 bp, Mus musculus
tgccctcaaagaacacctgaaagac

SEQ ID NO: 483849 - DNA, 25 bp, Mus musculus
tgccctcaattccaagctcagcggg

SEQ ID NO: 483850 - DNA, 25 bp, Mus musculus
tgccctcactcactgtcattctgtg

SEQ ID NO: 483851 - DNA, 25 bp, Mus musculus
tgccctcagaggttaagaagtttaa

SEQ ID NO: 483852 - DNA, 25 bp, Mus musculus
tgccctcaggagatgttgccaaaaa

SEQ ID NO: 483853 - DNA, 25 bp, Mus musculus
tgccctcagtacgaagctccagaat

SEQ ID NO: 483854 - DNA, 25 bp, Mus musculus
tgccctcattgatgtcttccaccag

SEQ ID NO: 483855 - DNA, 25 bp, Mus musculus
tgccctcattgtctggttacttgtg

SEQ ID NO: 483856 - DNA, 25 bp, Mus musculus
tgccctccattttccaatcctagga

SEQ ID NO: 483857 - DNA, 25 bp, Mus musculus
tgccctcccggcactgagtgaaaat

SEQ ID NO: 483858 - DNA, 25 bp, Mus musculus
tgccctccctctccgaaagaatgtg

SEQ ID NO: 483859 - DNA, 25 bp, Mus musculus
tgccctcctagaatattgaggcgtg

SEQ ID NO: 483860 - DNA, 25 bp, Mus musculus
tgccctccttgtacagccttaggtg

SEQ ID NO: 483861 - DNA, 25 bp, Mus musculus
tgccctcgcaggtcagaatagtgaa

SEQ ID NO: 483862 - DNA, 25 bp, Mus musculus
tgccctcggacaagctgagcaagat

SEQ ID NO: 483863 - DNA, 25 bp, Mus musculus
tgccctctgggtataaattaaaaat

SEQ ID NO: 483864 - DNA, 25 bp, Mus musculus
tgccctctgtgttcctgatttgcca

SEQ ID NO: 483865 - DNA, 25 bp, Mus musculus
tgccctcttcctctgaaatgttgtc

SEQ ID NO: 483866 - DNA, 25 bp, Mus musculus
tgccctgaaactgagtgagtgctgg

SEQ ID NO: 483867 - DNA, 25 bp, Mus musculus
tgccctgacttgaaggtagacctcg

SEQ ID NO: 483868 - DNA, 25 bp, Mus musculus
tgccctgaggccaggaggcatctgc

SEQ ID NO: 483869 - DNA, 25 bp, Mus musculus
tgccctgcaaactcccgtatgctgt

SEQ ID NO: 483870 - DNA, 25 bp, Mus musculus
tgccctgcagcgttagctttttaaa

SEQ ID NO: 483871 - DNA, 25 bp, Mus musculus
tgccctgcattgaaggagaagccct

SEQ ID NO: 483872 - DNA, 25 bp, Mus musculus
tgccctgccagtcaacgctgaagga

SEQ ID NO: 483873 - DNA, 25 bp, Mus musculus
tgccctgccccagtggaagatttac

SEQ ID NO: 483874 - DNA, 25 bp, Mus musculus
tgccctgcgacgttctagtcagccg

SEQ ID NO: 483875 - DNA, 25 bp, Mus musculus
tgccctgctgactcagaagtccctg

SEQ ID NO: 483876 - DNA, 25 bp, Mus musculus
tgccctggaatgcttttcccttgcc

SEQ ID NO: 483877 - DNA, 25 bp, Mus musculus
tgccctggaggttcttggaagactt

SEQ ID NO: 483878 - DNA, 25 bp, Mus musculus
tgccctggatgatgggaaggccacc

SEQ ID NO: 483879 - DNA, 25 bp, Mus musculus
tgccctggcaagtccagggtcctgg

SEQ ID NO: 483880 - DNA, 25 bp, Mus musculus
tgccctggcattggacctgaagaag

SEQ ID NO: 483881 - DNA, 25 bp, Mus musculus
tgccctgggagttcagccaaaatgt

SEQ ID NO: 483882 - DNA, 25 bp, Mus musculus
tgccctgggccctgtattgattttg

SEQ ID NO: 483883 - DNA, 25 bp, Mus musculus
tgccctggttctgtcatgtttctct

SEQ ID NO: 483884 - DNA, 25 bp, Mus musculus
tgccctggttgctgagtctctagca

SEQ ID NO: 483885 - DNA, 25 bp, Mus musculus
tgccctgtaaaggagagaacacgct

SEQ ID NO: 483886 - DNA, 25 bp, Mus musculus
tgccctgtcaaaacctgagtcccgg

SEQ ID NO: 483887 - DNA, 25 bp, Mus musculus
tgccctgtgcgctgcgggctcttag

SEQ ID NO: 483888 - DNA, 25 bp, Mus musculus
tgccctgtgggtctatgtttgactc

SEQ ID NO: 483889 - DNA, 25 bp, Mus musculus
tgcccttactgacgctgccttgaga

SEQ ID NO: 483890 - DNA, 25 bp, Mus musculus
tgcccttccagcaggagatcaggag

SEQ ID NO: 483891 - DNA, 25 bp, Mus musculus
tgcccttgcagagatgaagtacccc

SEQ ID NO: 483892 - DNA, 25 bp, Mus musculus
tgcccttggtgcagacccgtggcca

SEQ ID NO: 483893 - DNA, 25 bp, Mus musculus
tgcccttgtataggtgactggacac

SEQ ID NO: 483894 - DNA, 25 bp, Mus musculus
tgccctttatgccaggaaattccgg

SEQ ID NO: 483895 - DNA, 25 bp, Mus musculus
tgccctttgacatagactggaacgg

SEQ ID NO: 483896 - DNA, 25 bp, Mus musculus
tgccctttggagcaaacatgtctcc

SEQ ID NO: 483897 - DNA, 25 bp, Mus musculus
tgccctttgtggataaccagcctga

SEQ ID NO: 483898 - DNA, 25 bp, Mus musculus
tgccgaagccttaccagagtgctgg

SEQ ID NO: 483899 - DNA, 25 bp, Mus musculus
tgccgaatgggtacatgacagacct

SEQ ID NO: 483900 - DNA, 25 bp, Mus musculus
tgccgactaagaagacccctaagct

SEQ ID NO: 483901 - DNA, 25 bp, Mus musculus
tgccgagaccccagggcgtgcttgc

SEQ ID NO: 483902 - DNA, 25 bp, Mus musculus
tgccgagatggcaaagtgggcttcc

SEQ ID NO: 483903 - DNA, 25 bp, Mus musculus
tgccgagccctctctaggacactgt

SEQ ID NO: 483904 - DNA, 25 bp, Mus musculus
tgccgaggacgagaagaagaccctt

SEQ ID NO: 483905 - DNA, 25 bp, Mus musculus
tgccgaggccctgatcacaaagatt

SEQ ID NO: 483906 - DNA, 25 bp, Mus musculus
tgccgagggcccaataaaagtgttt

SEQ ID NO: 483907 - DNA, 25 bp, Mus musculus
tgccgagtgtggctgtgcactcctc

SEQ ID NO: 483908 - DNA, 25 bp, Mus musculus
tgccgcaacagtcacggaagcagac

SEQ ID NO: 483909 - DNA, 25 bp, Mus musculus
tgccgcaccacgtgtgctaaccggg

SEQ ID NO: 483910 - DNA, 25 bp, Mus musculus
tgccgcaccagaactcgtagcaggg

SEQ ID NO: 483911 - DNA, 25 bp, Mus musculus
tgccgcagaagcagggtgaaccact

SEQ ID NO: 483912 - DNA, 25 bp, Mus musculus
tgccgcagcgtattttgagaacctt

SEQ ID NO: 483913 - DNA, 25 bp, Mus musculus
tgccgcaggccaagaaagatcgcag

SEQ ID NO: 483914 - DNA, 25 bp, Mus musculus
tgccgcattcatctcagggtcctgc

SEQ ID NO: 483915 - DNA, 25 bp, Mus musculus
tgccgccatgagaataacaccaagg

SEQ ID NO: 483916 - DNA, 25 bp, Mus musculus
tgccgcccgaggatgatcgcgtttc

SEQ ID NO: 483917 - DNA, 25 bp, Mus musculus
tgccgccgataccatgccagttaca

SEQ ID NO: 483918 - DNA, 25 bp, Mus musculus
tgccgccggcgattctacaaggact

SEQ ID NO: 483919 - DNA, 25 bp, Mus musculus
tgccgcctgcccatggtagaaagta

SEQ ID NO: 483920 - DNA, 25 bp, Mus musculus
tgccgcctgtctacagccagagagg

SEQ ID NO: 483921 - DNA, 25 bp, Mus musculus
tgccgcggaagctgtgaaactcaat

SEQ ID NO: 483922 - DNA, 25 bp, Mus musculus
tgccgcggagggaacagatcctgcc

SEQ ID NO: 483923 - DNA, 25 bp, Mus musculus
tgccgcgggactcaaacttcatcag

SEQ ID NO: 483924 - DNA, 25 bp, Mus musculus
tgccgcgggtaccatgaagatctct

SEQ ID NO: 483925 - DNA, 25 bp, Mus musculus
tgccgctccgtaggatgagcccttt

SEQ ID NO: 483926 - DNA, 25 bp, Mus musculus
tgccgctgccgttgtcacttacagg

SEQ ID NO: 483927 - DNA, 25 bp, Mus musculus
tgccgctggagaaagaacatagctg

SEQ ID NO: 483928 - DNA, 25 bp, Mus musculus
tgccgcttgtcgagtacggttgtgt

SEQ ID NO: 483929 - DNA, 25 bp, Mus musculus
tgccggagacgcagtgggtatcttt

SEQ ID NO: 483930 - DNA, 25 bp, Mus musculus
tgccggatatgaccctcccatgaag

SEQ ID NO: 483931 - DNA, 25 bp, Mus musculus
tgccggatgactgactacgactgcg

SEQ ID NO: 483932 - DNA, 25 bp, Mus musculus
tgccggcaagcaggattacaatcag

SEQ ID NO: 483933 - DNA, 25 bp, Mus musculus
tgccggcacaaacctcagtggtggt

SEQ ID NO: 483934 - DNA, 25 bp, Mus musculus
tgccggcacatcacagactacaaga

SEQ ID NO: 483935 - DNA, 25 bp, Mus musculus
tgccggcagcccaagtgtgataaat

SEQ ID NO: 483936 - DNA, 25 bp, Mus musculus
tgccggccgaggtgaatagtttgct

SEQ ID NO: 483937 - DNA, 25 bp, Mus musculus
tgccggccgtttcatccagagagag

SEQ ID NO: 483938 - DNA, 25 bp, Mus musculus
tgccggctacaactggagggacatc

SEQ ID NO: 483939 - DNA, 25 bp, Mus musculus
tgccggctcagtagctctgactgtg

SEQ ID NO: 483940 - DNA, 25 bp, Mus musculus
tgccggctgccagaccttgggcgct

SEQ ID NO: 483941 - DNA, 25 bp, Mus musculus
tgccgggaacaaaattaggatcact

SEQ ID NO: 483942 - DNA, 25 bp, Mus musculus
tgccgggcagctgtagaccctgtca

SEQ ID NO: 483943 - DNA, 25 bp, Mus musculus
tgccgggccccgtctgctattgtct

SEQ ID NO: 483944 - DNA, 25 bp, Mus musculus
tgccgggcgggctggacgacgacga

SEQ ID NO: 483945 - DNA, 25 bp, Mus musculus
tgccggtgacagacatcaacttggg

SEQ ID NO: 483946 - DNA, 25 bp, Mus musculus
tgccggtgagatggttgaagtcttt

SEQ ID NO: 483947 - DNA, 25 bp, Mus musculus
tgccggtgcctactgctatcaaaag

SEQ ID NO: 483948 - DNA, 25 bp, Mus musculus
tgccgtaccgccagcgaagagtgag

SEQ ID NO: 483949 - DNA, 25 bp, Mus musculus
tgccgtagcaaacacctgagaagct

SEQ ID NO: 483950 - DNA, 25 bp, Mus musculus
tgccgtccagccatcgttggaaaac

SEQ ID NO: 483951 - DNA, 25 bp, Mus musculus
tgccgtgcaagtaaatcaagaaggc

SEQ ID NO: 483952 - DNA, 25 bp, Mus musculus
tgccgtgctttcctcgctccgagtt

SEQ ID NO: 483953 - DNA, 25 bp, Mus musculus
tgccgtggagcgaggctatgatccc

SEQ ID NO: 483954 - DNA, 25 bp, Mus musculus
tgccgtggtccagtgtgtacatcat

SEQ ID NO: 483955 - DNA, 25 bp, Mus musculus
tgccgtgtggaggactgctcgcctt

SEQ ID NO: 483956 - DNA, 25 bp, Mus musculus
tgccgtttctaccacagagcaggaa

SEQ ID NO: 483957 - DNA, 25 bp, Mus musculus
tgcctaaacattcttgtcttctgga

SEQ ID NO: 483958 - DNA, 25 bp, Mus musculus
tgcctaaagctgctcggccccgagg

SEQ ID NO: 483959 - DNA, 25 bp, Mus musculus
tgcctaagagcctgtacagcatggt

SEQ ID NO: 483960 - DNA, 25 bp, Mus musculus
tgcctaagcgcaggataccctatct

SEQ ID NO: 483961 - DNA, 25 bp, Mus musculus
tgcctaaggattgctaacagcccct

SEQ ID NO: 483962 - DNA, 25 bp, Mus musculus
tgcctacaaaaaacagagcttcgtg

SEQ ID NO: 483963 - DNA, 25 bp, Mus musculus
tgcctacagcaatgacgggaagacc

SEQ ID NO: 483964 - DNA, 25 bp, Mus musculus
tgcctacaggatggaacatatcatg

SEQ ID NO: 483965 - DNA, 25 bp, Mus musculus
tgcctaccgctgtgcaaagcaagtc

SEQ ID NO: 483966 - DNA, 25 bp, Mus musculus
tgcctaccttatggcgctggtcaca

SEQ ID NO: 483967 - DNA, 25 bp, Mus musculus
tgcctacggaagtatggaaatgcca

SEQ ID NO: 483968 - DNA, 25 bp, Mus musculus
tgcctacgggcaatctgatgggagt

SEQ ID NO: 483969 - DNA, 25 bp, Mus musculus
tgcctacgtaggagggaaccgagta

SEQ ID NO: 483970 - DNA, 25 bp, Mus musculus
tgcctactcggtgctaactctgtgg

SEQ ID NO: 483971 - DNA, 25 bp, Mus musculus
tgcctactgctcctacctcagagat

SEQ ID NO: 483972 - DNA, 25 bp, Mus musculus
tgcctacttcctctgcttgcttaga

SEQ ID NO: 483973 - DNA, 25 bp, Mus musculus
tgcctagattagttctgtgatccgt

SEQ ID NO: 483974 - DNA, 25 bp, Mus musculus
tgcctaggagactcaaaaatcaaca

SEQ ID NO: 483975 - DNA, 25 bp, Mus musculus
tgcctaggctcttggtcaatcatcc

SEQ ID NO: 483976 - DNA, 25 bp, Mus musculus
tgcctagtcccgaagcgaatgtggt

SEQ ID NO: 483977 - DNA, 25 bp, Mus musculus
tgcctagtgtgggaaaccctgaagg

SEQ ID NO: 483978 - DNA, 25 bp, Mus musculus
tgcctataacatgcaaacttgtggg

SEQ ID NO: 483979 - DNA, 25 bp, Mus musculus
tgcctatcgctccatttccacagga

SEQ ID NO: 483980 - DNA, 25 bp, Mus musculus
tgcctatgagctgagaccggaagtg

SEQ ID NO: 483981 - DNA, 25 bp, Mus musculus
tgcctatgctaatctgatggaggag

SEQ ID NO: 483982 - DNA, 25 bp, Mus musculus
tgcctatgctgacttctgccggaga

SEQ ID NO: 483983 - DNA, 25 bp, Mus musculus
tgcctcaaagcaagcagcggtggag

SEQ ID NO: 483984 - DNA, 25 bp, Mus musculus
tgcctcaactatgtggacctggacc

SEQ ID NO: 483985 - DNA, 25 bp, Mus musculus
tgcctcaatacaactcgcggagcgg

SEQ ID NO: 483986 - DNA, 25 bp, Mus musculus
tgcctcagagaaatgagatgtacct

SEQ ID NO: 483987 - DNA, 25 bp, Mus musculus
tgcctcagatcacctccagatttgg

SEQ ID NO: 483988 - DNA, 25 bp, Mus musculus
tgcctcagccatctaggacctgctt

SEQ ID NO: 483989 - DNA, 25 bp, Mus musculus
tgcctcagcgaagcagacaagactg

SEQ ID NO: 483990 - DNA, 25 bp, Mus musculus
tgcctcagcgcgctctttccttttg

SEQ ID NO: 483991 - DNA, 25 bp, Mus musculus
tgcctcagcgtctcaagtactgagt

SEQ ID NO: 483992 - DNA, 25 bp, Mus musculus
tgcctcaggagtatcagcaaagtct

SEQ ID NO: 483993 - DNA, 25 bp, Mus musculus
tgcctcagggattaaggaatctccg

SEQ ID NO: 483994 - DNA, 25 bp, Mus musculus
tgcctcagtagagagcgacttacgg

SEQ ID NO: 483995 - DNA, 25 bp, Mus musculus
tgcctcagtccaagtcccggaagat

SEQ ID NO: 483996 - DNA, 25 bp, Mus musculus
tgcctcataaaatatgttgcaggac

SEQ ID NO: 483997 - DNA, 25 bp, Mus musculus
tgcctcatcacagaagggtgtcgtg

SEQ ID NO: 483998 - DNA, 25 bp, Mus musculus
tgcctcatgacaggatgcctgcctt

SEQ ID NO: 483999 - DNA, 25 bp, Mus musculus
tgcctcatttccctaggtcgtgttc

SEQ ID NO: 484000 - DNA, 25 bp, Mus musculus
tgcctccacccaaggatcagatgag

SEQ ID NO: 484001 - DNA, 25 bp, Mus musculus
tgcctcccctctggatgtgacctgg

SEQ ID NO: 484002 - DNA, 25 bp, Mus musculus
tgcctcccgtaaactcatgctgaag

SEQ ID NO: 484003 - DNA, 25 bp, Mus musculus
tgcctccctgttcagttggctctac

SEQ ID NO: 484004 - DNA, 25 bp, Mus musculus
tgcctcctaccactgggagaattag

SEQ ID NO: 484005 - DNA, 25 bp, Mus musculus
tgcctcctagtgaggccctggagcc

SEQ ID NO: 484006 - DNA, 25 bp, Mus musculus
tgcctcctccaaccagttgtgacgt

SEQ ID NO: 484007 - DNA, 25 bp, Mus musculus
tgcctcctggcctagacagaaacag

SEQ ID NO: 484008 - DNA, 25 bp, Mus musculus
tgcctcctttgggtatcagctggac

SEQ ID NO: 484009 - DNA, 25 bp, Mus musculus
tgcctcgaaaggtagacacagctgc

SEQ ID NO: 484010 - DNA, 25 bp, Mus musculus
tgcctcgcagccagtgaggaggcct

SEQ ID NO: 484011 - DNA, 25 bp, Mus musculus
tgcctcgctagtgtctgtcagaaaa

SEQ ID NO: 484012 - DNA, 25 bp, Mus musculus
tgcctcggagataaagatcccagct

SEQ ID NO: 484013 - DNA, 25 bp, Mus musculus
tgcctcgggatgttcaggaagcctg

SEQ ID NO: 484014 - DNA, 25 bp, Mus musculus
tgcctcgggcacaggatatgtactg

SEQ ID NO: 484015 - DNA, 25 bp, Mus musculus
tgcctcgggcagctaaggcaaccag

SEQ ID NO: 484016 - DNA, 25 bp, Mus musculus
tgcctcgtgagctccagattgtccg

SEQ ID NO: 484017 - DNA, 25 bp, Mus musculus
tgcctcgtggctggacaccgcattt

SEQ ID NO: 484018 - DNA, 25 bp, Mus musculus
tgcctctagggctggtttacccggc

SEQ ID NO: 484019 - DNA, 25 bp, Mus musculus
tgcctctataccaccaccgagaagt

SEQ ID NO: 484020 - DNA, 25 bp, Mus musculus
tgcctctcagagatgacggacgaag

SEQ ID NO: 484021 - DNA, 25 bp, Mus musculus
tgcctctcagcacactggaacagtg

SEQ ID NO: 484022 - DNA, 25 bp, Mus musculus
tgcctctccgaggttaaagctggga

SEQ ID NO: 484023 - DNA, 25 bp, Mus musculus
tgcctctctccaacctatgagcttg

SEQ ID NO: 484024 - DNA, 25 bp, Mus musculus
tgcctctgagaaagctggttccccg

SEQ ID NO: 484025 - DNA, 25 bp, Mus musculus
tgcctctgagcgacatctacaagtt

SEQ ID NO: 484026 - DNA, 25 bp, Mus musculus
tgcctctggctcacatgtttgagag

SEQ ID NO: 484027 - DNA, 25 bp, Mus musculus
tgcctctgggcttctccgagaaaga

SEQ ID NO: 484028 - DNA, 25 bp, Mus musculus
tgcctctgtgacctgagcgtcctgg

SEQ ID NO: 484029 - DNA, 25 bp, Mus musculus
tgcctcttaggaaatcgggccgggt

SEQ ID NO: 484030 - DNA, 25 bp, Mus musculus
tgcctcttataacccagcgagaact

SEQ ID NO: 484031 - DNA, 25 bp, Mus musculus
tgcctcttgaggaacgaacactaat

SEQ ID NO: 484032 - DNA, 25 bp, Mus musculus
tgcctcttgccagtaactaaaatgg

SEQ ID NO: 484033 - DNA, 25 bp, Mus musculus
tgcctcttgggtggtgggtgctgct

SEQ ID NO: 484034 - DNA, 25 bp, Mus musculus
tgcctctttaggagcattctggaag

SEQ ID NO: 484035 - DNA, 25 bp, Mus musculus
tgcctctttgtgagctgcttgcctt

SEQ ID NO: 484036 - DNA, 25 bp, Mus musculus
tgcctgaaccgccagagaagatggt

SEQ ID NO: 484037 - DNA, 25 bp, Mus musculus
tgcctgacaacaaacgtgtaccttg

SEQ ID NO: 484038 - DNA, 25 bp, Mus musculus
tgcctgacaccggtaccatgcgttg

SEQ ID NO: 484039 - DNA, 25 bp, Mus musculus
tgcctgacagtagtcctgctgccgt

SEQ ID NO: 484040 - DNA, 25 bp, Mus musculus
tgcctgaccagtataagatcgtaga

SEQ ID NO: 484041 - DNA, 25 bp, Mus musculus
tgcctgacccaggagaagatcgtgg

SEQ ID NO: 484042 - DNA, 25 bp, Mus musculus
tgcctgactttgcaataccgagagg

SEQ ID NO: 484043 - DNA, 25 bp, Mus musculus
tgcctgagcagcagggaatctgaga

SEQ ID NO: 484044 - DNA, 25 bp, Mus musculus
tgcctgagcatgtccacgttagaat

SEQ ID NO: 484045 - DNA, 25 bp, Mus musculus
tgcctgagctaatgaagcattgacc

SEQ ID NO: 484046 - DNA, 25 bp, Mus musculus
tgcctgagctgactggcatgccata

SEQ ID NO: 484047 - DNA, 25 bp, Mus musculus
tgcctgaggaggaggcgcggacctg

SEQ ID NO: 484048 - DNA, 25 bp, Mus musculus
tgcctgagtggcaaccagactctca

SEQ ID NO: 484049 - DNA, 25 bp, Mus musculus
tgcctgagttttctgtcccaagctg

SEQ ID NO: 484050 - DNA, 25 bp, Mus musculus
tgcctgatgggaaagagatccgtct

SEQ ID NO: 484051 - DNA, 25 bp, Mus musculus
tgcctgattggcacgcttagctcca

SEQ ID NO: 484052 - DNA, 25 bp, Mus musculus
tgcctgcaaactgaactagtagttc

SEQ ID NO: 484053 - DNA, 25 bp, Mus musculus
tgcctgcaagaggacgtcagtacct

SEQ ID NO: 484054 - DNA, 25 bp, Mus musculus
tgcctgcagaaatacaacgtgccgt

SEQ ID NO: 484055 - DNA, 25 bp, Mus musculus
tgcctgcagtgcgatatgaacgact

SEQ ID NO: 484056 - DNA, 25 bp, Mus musculus
tgcctgcatctgaagctggagcact

SEQ ID NO: 484057 - DNA, 25 bp, Mus musculus
tgcctgccaaatactgagagtcctc

SEQ ID NO: 484058 - DNA, 25 bp, Mus musculus
tgcctgccccagaatcctgctgagt

SEQ ID NO: 484059 - DNA, 25 bp, Mus musculus
tgcctgcccctttggagacctgcat

SEQ ID NO: 484060 - DNA, 25 bp, Mus musculus
tgcctgcctggagacgagacattct

SEQ ID NO: 484061 - DNA, 25 bp, Mus musculus
tgcctgcctttgctatcacgctggg

SEQ ID NO: 484062 - DNA, 25 bp, Mus musculus
tgcctgcgaaacgactgggtgactg

SEQ ID NO: 484063 - DNA, 25 bp, Mus musculus
tgcctgcgatacgagatcaaggaca

SEQ ID NO: 484064 - DNA, 25 bp, Mus musculus
tgcctgcggcgctatggctacgact

SEQ ID NO: 484065 - DNA, 25 bp, Mus musculus
tgcctgcgtgggtgataaatagcct

SEQ ID NO: 484066 - DNA, 25 bp, Mus musculus
tgcctgctgattgtccagtgaagcc

SEQ ID NO: 484067 - DNA, 25 bp, Mus musculus
tgcctgctgcctactgattctgcca

SEQ ID NO: 484068 - DNA, 25 bp, Mus musculus
tgcctgctgcttccaagcgggactc

SEQ ID NO: 484069 - DNA, 25 bp, Mus musculus
tgcctgctggtgtggactgtactac

SEQ ID NO: 484070 - DNA, 25 bp, Mus musculus
tgcctgcttgttactaatcctcagc

SEQ ID NO: 484071 - DNA, 25 bp, Mus musculus
tgcctggaaacatagctaaggtgac

SEQ ID NO: 484072 - DNA, 25 bp, Mus musculus
tgcctggaaatcagtgtcctacgga

SEQ ID NO: 484073 - DNA, 25 bp, Mus musculus
tgcctggaacaaagctggactccca

SEQ ID NO: 484074 - DNA, 25 bp, Mus musculus
tgcctggaagaaagaccgaatcgtc

SEQ ID NO: 484075 - DNA, 25 bp, Mus musculus
tgcctggacacatgtgcccgctgtt

SEQ ID NO: 484076 - DNA, 25 bp, Mus musculus
tgcctggagacacacgagggcttca

SEQ ID NO: 484077 - DNA, 25 bp, Mus musculus
tgcctggagtgaacgaaccgcgtgt

SEQ ID NO: 484078 - DNA, 25 bp, Mus musculus
tgcctggcaagagtgataacgaacg

SEQ ID NO: 484079 - DNA, 25 bp, Mus musculus
tgcctggcaatgacaccaagggtgg

SEQ ID NO: 484080 - DNA, 25 bp, Mus musculus
tgcctggcatcgactggctccttga

SEQ ID NO: 484081 - DNA, 25 bp, Mus musculus
tgcctggccgtctcagggctgagac

SEQ ID NO: 484082 - DNA, 25 bp, Mus musculus
tgcctggcctcttctagcaagtagt

SEQ ID NO: 484083 - DNA, 25 bp, Mus musculus
tgcctgggaccaaagtgaatgccga

SEQ ID NO: 484084 - DNA, 25 bp, Mus musculus
tgcctgggacgatacctttgactca

SEQ ID NO: 484085 - DNA, 25 bp, Mus musculus
tgcctgggagcccttactaaaaaga

SEQ ID NO: 484086 - DNA, 25 bp, Mus musculus
tgcctgggattgacctcagatgtaa

SEQ ID NO: 484087 - DNA, 25 bp, Mus musculus
tgcctgggcaaagacatgacacgtg

SEQ ID NO: 484088 - DNA, 25 bp, Mus musculus
tgcctgggtagtccccaaagaacgt

SEQ ID NO: 484089 - DNA, 25 bp, Mus musculus
tgcctgggtgaccatgctttccaaa

SEQ ID NO: 484090 - DNA, 25 bp, Mus musculus
tgcctggtccagactgccactcttg

SEQ ID NO: 484091 - DNA, 25 bp, Mus musculus
tgcctggtggcagctggacagttcc

SEQ ID NO: 484092 - DNA, 25 bp, Mus musculus
tgcctggttcttcgtgtatccttta

SEQ ID NO: 484093 - DNA, 25 bp, Mus musculus
tgcctgtacttactgactggagagc

SEQ ID NO: 484094 - DNA, 25 bp, Mus musculus
tgcctgtatgacctcgctgctgtgg

SEQ ID NO: 484095 - DNA, 25 bp, Mus musculus
tgcctgtcacagagcccgcagctga

SEQ ID NO: 484096 - DNA, 25 bp, Mus musculus
tgcctgtcactaagaaacctgggag

SEQ ID NO: 484097 - DNA, 25 bp, Mus musculus
tgcctgtcaggattccaagcccctt

SEQ ID NO: 484098 - DNA, 25 bp, Mus musculus
tgcctgtccccaaatgaaacgaaac

SEQ ID NO: 484099 - DNA, 25 bp, Mus musculus
tgcctgtccctcaccaggctgtaga

SEQ ID NO: 484100 - DNA, 25 bp, Mus musculus
tgcctgtctcaacagggcagagaag

SEQ ID NO: 484101 - DNA, 25 bp, Mus musculus
tgcctgtgcagaaatcttcctgtgc

SEQ ID NO: 484102 - DNA, 25 bp, Mus musculus
tgcctgtgctcccaaagagggtgtc

SEQ ID NO: 484103 - DNA, 25 bp, Mus musculus
tgcctgtggtgactatatacagagt

SEQ ID NO: 484104 - DNA, 25 bp, Mus musculus
tgcctgtgtccatggcgaaccctct

SEQ ID NO: 484105 - DNA, 25 bp, Mus musculus
tgcctgtgtgaatcttgcatctggc

SEQ ID NO: 484106 - DNA, 25 bp, Mus musculus
tgcctgttccaagggcggagcagaa

SEQ ID NO: 484107 - DNA, 25 bp, Mus musculus
tgcctgttccagtaacagtgaagat

SEQ ID NO: 484108 - DNA, 25 bp, Mus musculus
tgcctgttgaacacttgcagagtgc

SEQ ID NO: 484109 - DNA, 25 bp, Mus musculus
tgcctgttgacttccacttgtaccg

SEQ ID NO: 484110 - DNA, 25 bp, Mus musculus
tgcctgttgcagagaagctatttct

SEQ ID NO: 484111 - DNA, 25 bp, Mus musculus
tgcctgttgtgtgcaagccactgct

SEQ ID NO: 484112 - DNA, 25 bp, Mus musculus
tgcctgtttccagcgtattaacaag

SEQ ID NO: 484113 - DNA, 25 bp, Mus musculus
tgcctgtttctaaattctgctttcc

SEQ ID NO: 484114 - DNA, 25 bp, Mus musculus
tgcctgtttgtctcctgcaacaatg

SEQ ID NO: 484115 - DNA, 25 bp, Mus musculus
tgcctgtttttatcgccccagcaca

SEQ ID NO: 484116 - DNA, 25 bp, Mus musculus
tgccttaaaggacatctcttgtacc

SEQ ID NO: 484117 - DNA, 25 bp, Mus musculus
tgccttaagtctgaaacccctggtg

SEQ ID NO: 484118 - DNA, 25 bp, Mus musculus
tgccttaggctccttgcttcaagaa

SEQ ID NO: 484119 - DNA, 25 bp, Mus musculus
tgccttagggcgcactgtgaaactg

SEQ ID NO: 484120 - DNA, 25 bp, Mus musculus
tgccttataagaccccagtgacctg

SEQ ID NO: 484121 - DNA, 25 bp, Mus musculus
tgccttcaaaatgcggtaaggtctt

SEQ ID NO: 484122 - DNA, 25 bp, Mus musculus
tgccttcaagagagacaaaccccta

SEQ ID NO: 484123 - DNA, 25 bp, Mus musculus
tgccttcacttacgagcagctggtg

SEQ ID NO: 484124 - DNA, 25 bp, Mus musculus
tgccttcagccagcctacgtgtgtg

SEQ ID NO: 484125 - DNA, 25 bp, Mus musculus
tgccttcccaccttgtgagttctct

SEQ ID NO: 484126 - DNA, 25 bp, Mus musculus
tgccttccctcttggttcacattag

SEQ ID NO: 484127 - DNA, 25 bp, Mus musculus
tgccttccgctgacaataaagatgt

SEQ ID NO: 484128 - DNA, 25 bp, Mus musculus
tgccttccgcttgctgaagaccggg

SEQ ID NO: 484129 - DNA, 25 bp, Mus musculus
tgccttccgggtagtaactgtaaca

SEQ ID NO: 484130 - DNA, 25 bp, Mus musculus
tgccttcctgagaggaagtccccat

SEQ ID NO: 484131 - DNA, 25 bp, Mus musculus
tgccttcctgtgtatgctgggatgg

SEQ ID NO: 484132 - DNA, 25 bp, Mus musculus
tgccttcctttgaggactgcctggt

SEQ ID NO: 484133 - DNA, 25 bp, Mus musculus
tgccttcgaagtataccacccgtgt

SEQ ID NO: 484134 - DNA, 25 bp, Mus musculus
tgccttcgagaaagcgttagcctag

SEQ ID NO: 484135 - DNA, 25 bp, Mus musculus
tgccttcgctgatgcactgcctatg

SEQ ID NO: 484136 - DNA, 25 bp, Mus musculus
tgccttcggaaagattgccgctccg

SEQ ID NO: 484137 - DNA, 25 bp, Mus musculus
tgccttctgaaaggtattattccag

SEQ ID NO: 484138 - DNA, 25 bp, Mus musculus
tgccttctgaacaaaaacacagagg

SEQ ID NO: 484139 - DNA, 25 bp, Mus musculus
tgccttctgacctcaagaacacgtg

SEQ ID NO: 484140 - DNA, 25 bp, Mus musculus
tgccttctgactaattgcctgcttg

SEQ ID NO: 484141 - DNA, 25 bp, Mus musculus
tgccttctgcccaggtgccatctgg

SEQ ID NO: 484142 - DNA, 25 bp, Mus musculus
tgccttctgcgttcatagggtcaga

SEQ ID NO: 484143 - DNA, 25 bp, Mus musculus
tgccttctgggtaaagtgcacctag

SEQ ID NO: 484144 - DNA, 25 bp, Mus musculus
tgccttcttcgtggccgacctgggt

SEQ ID NO: 484145 - DNA, 25 bp, Mus musculus
tgccttgagacagtgaccgagtacc

SEQ ID NO: 484146 - DNA, 25 bp, Mus musculus
tgccttgccgcaaaatggataacgt

SEQ ID NO: 484147 - DNA, 25 bp, Mus musculus
tgccttgctgctgcgctgtcaggaa

SEQ ID NO: 484148 - DNA, 25 bp, Mus musculus
tgccttgcttttccgtgggacagtg

SEQ ID NO: 484149 - DNA, 25 bp, Mus musculus
tgccttggcaataggactgggattg

SEQ ID NO: 484150 - DNA, 25 bp, Mus musculus
tgccttggccaagctcagtgaactg

SEQ ID NO: 484151 - DNA, 25 bp, Mus musculus
tgccttgggacaatgaaaatcactc

SEQ ID NO: 484152 - DNA, 25 bp, Mus musculus
tgccttgggagccatgcttcccatg

SEQ ID NO: 484153 - DNA, 25 bp, Mus musculus
tgccttgggattctacctggacgtg

SEQ ID NO: 484154 - DNA, 25 bp, Mus musculus
tgccttgggcctagagtcaatctgt

SEQ ID NO: 484155 - DNA, 25 bp, Mus musculus
tgccttgtcaacatggctgagcact

SEQ ID NO: 484156 - DNA, 25 bp, Mus musculus
tgccttgtgacttccagcaaacggg

SEQ ID NO: 484157 - DNA, 25 bp, Mus musculus
tgccttgtgctaccaatgctgtgac

SEQ ID NO: 484158 - DNA, 25 bp, Mus musculus
tgccttgtggcctacctagcagttg

SEQ ID NO: 484159 - DNA, 25 bp, Mus musculus
tgcctttaggaagagcctggaacct

SEQ ID NO: 484160 - DNA, 25 bp, Mus musculus
tgcctttagggactgtgtagctcaa

SEQ ID NO: 484161 - DNA, 25 bp, Mus musculus
tgcctttagttcacttttcttggga

SEQ ID NO: 484162 - DNA, 25 bp, Mus musculus
tgcctttccctacgatgagctgaga

SEQ ID NO: 484163 - DNA, 25 bp, Mus musculus
tgcctttcctgaaccctgacatctt

SEQ ID NO: 484164 - DNA, 25 bp, Mus musculus
tgcctttccttgctgatagttgatg

SEQ ID NO: 484165 - DNA, 25 bp, Mus musculus
tgcctttcggagatggagataccca

SEQ ID NO: 484166 - DNA, 25 bp, Mus musculus
tgcctttgaaggagagtacacacat

SEQ ID NO: 484167 - DNA, 25 bp, Mus musculus
tgcctttgaattgagtcccagagcc

SEQ ID NO: 484168 - DNA, 25 bp, Mus musculus
tgcctttgagtggaacttacagata

SEQ ID NO: 484169 - DNA, 25 bp, Mus musculus
tgcctttgcccgtgtttgtcgcgag

SEQ ID NO: 484170 - DNA, 25 bp, Mus musculus
tgcgaaaacgtgctgctaagccctg

SEQ ID NO: 484171 - DNA, 25 bp, Mus musculus
tgcgaaaagttctctgcgtggcgga

SEQ ID NO: 484172 - DNA, 25 bp, Mus musculus
tgcgaaaatttatcccgaacaagtg

SEQ ID NO: 484173 - DNA, 25 bp, Mus musculus
tgcgaaaccttaggaagacttgttc

SEQ ID NO: 484174 - DNA, 25 bp, Mus musculus
tgcgaaagtccacttcacacgtcgg

SEQ ID NO: 484175 - DNA, 25 bp, Mus musculus
tgcgaacccgggaaaacctatactg

SEQ ID NO: 484176 - DNA, 25 bp, Mus musculus
tgcgaacctggtagtacggagctct

SEQ ID NO: 484177 - DNA, 25 bp, Mus musculus
tgcgaagggccctatgactacgacg

SEQ ID NO: 484178 - DNA, 25 bp, Mus musculus
tgcgaagtgaccagaagagctaccc

SEQ ID NO: 484179 - DNA, 25 bp, Mus musculus
tgcgaatgaattaacggaggcttct

SEQ ID NO: 484180 - DNA, 25 bp, Mus musculus
tgcgacaaggagttcatgtgggccc

SEQ ID NO: 484181 - DNA, 25 bp, Mus musculus
tgcgaccacagatactcaggcttgc

SEQ ID NO: 484182 - DNA, 25 bp, Mus musculus
tgcgaccacctatcaggattcaacg

SEQ ID NO: 484183 - DNA, 25 bp, Mus musculus
tgcgacgaaacctgcatcggtggcg

SEQ ID NO: 484184 - DNA, 25 bp, Mus musculus
tgcgactacagagagcagcagggct

SEQ ID NO: 484185 - DNA, 25 bp, Mus musculus
tgcgactcaatgacaacccctgggt

SEQ ID NO: 484186 - DNA, 25 bp, Mus musculus
tgcgactctctaaaacccttgccgg

SEQ ID NO: 484187 - DNA, 25 bp, Mus musculus
tgcgactgatgcacaatccagagtg

SEQ ID NO: 484188 - DNA, 25 bp, Mus musculus
tgcgagatcgcagtgttatgccagt

SEQ ID NO: 484189 - DNA, 25 bp, Mus musculus
tgcgagatggcatggagtacccctt

SEQ ID NO: 484190 - DNA, 25 bp, Mus musculus
tgcgagcccctcatgaagatgtata

SEQ ID NO: 484191 - DNA, 25 bp, Mus musculus
tgcgagcgccacaacactctatggg

SEQ ID NO: 484192 - DNA, 25 bp, Mus musculus
tgcgaggacctgcagtcatggaaaa

SEQ ID NO: 484193 - DNA, 25 bp, Mus musculus
tgcgaggcagcaatataaacagatc

SEQ ID NO: 484194 - DNA, 25 bp, Mus musculus
tgcgaggcggtggatcaacatagac

SEQ ID NO: 484195 - DNA, 25 bp, Mus musculus
tgcgaggctcacagactactgggaa

SEQ ID NO: 484196 - DNA, 25 bp, Mus musculus
tgcgagtagaaggatccgagagccc

SEQ ID NO: 484197 - DNA, 25 bp, Mus musculus
tgcgagtccgctaaacgtccgagat

SEQ ID NO: 484198 - DNA, 25 bp, Mus musculus
tgcgataattgaggagcagcccaaa

SEQ ID NO: 484199 - DNA, 25 bp, Mus musculus
tgcgatcacaatccaaagggactgg

SEQ ID NO: 484200 - DNA, 25 bp, Mus musculus
tgcgatcccgtgttcttcagaagcc

SEQ ID NO: 484201 - DNA, 25 bp, Mus musculus
tgcgatgccagttttgtgggtttta

SEQ ID NO: 484202 - DNA, 25 bp, Mus musculus
tgcgatgtagagatcccaggtcagg

SEQ ID NO: 484203 - DNA, 25 bp, Mus musculus
tgcgattacaataatggacccgggt

SEQ ID NO: 484204 - DNA, 25 bp, Mus musculus
tgcgatttcgtcaccaacagggcct

SEQ ID NO: 484205 - DNA, 25 bp, Mus musculus
tgcgattttgttctcccatcacggt

SEQ ID NO: 484206 - DNA, 25 bp, Mus musculus
tgcgcaacgcagacaataaagtagc

SEQ ID NO: 484207 - DNA, 25 bp, Mus musculus
tgcgcaagagccgagataaagccaa

SEQ ID NO: 484208 - DNA, 25 bp, Mus musculus
tgcgcaagtcgctttctcgggcttc

SEQ ID NO: 484209 - DNA, 25 bp, Mus musculus
tgcgcaagtctatccaacaggacgt

SEQ ID NO: 484210 - DNA, 25 bp, Mus musculus
tgcgcactgtcgctctctgggtaag

SEQ ID NO: 484211 - DNA, 25 bp, Mus musculus
tgcgcagaaagctgtaaccgaggcc

SEQ ID NO: 484212 - DNA, 25 bp, Mus musculus
tgcgcagaacttaggacgcgggtct

SEQ ID NO: 484213 - DNA, 25 bp, Mus musculus
tgcgcagagctacagatgggaccaa

SEQ ID NO: 484214 - DNA, 25 bp, Mus musculus
tgcgcagaggctttggttgctcctc

SEQ ID NO: 484215 - DNA, 25 bp, Mus musculus
tgcgcagcatgggacagaagtgttt

SEQ ID NO: 484216 - DNA, 25 bp, Mus musculus
tgcgcagccggagtacacagtgttt

SEQ ID NO: 484217 - DNA, 25 bp, Mus musculus
tgcgcagctcggtggattctgagac

SEQ ID NO: 484218 - DNA, 25 bp, Mus musculus
tgcgcagtgactacgggacgctctt

SEQ ID NO: 484219 - DNA, 25 bp, Mus musculus
tgcgcatgcacaatctggaggactc

SEQ ID NO: 484220 - DNA, 25 bp, Mus musculus
tgcgcatgctagtaacacgggacct

SEQ ID NO: 484221 - DNA, 25 bp, Mus musculus
tgcgcatttgtgcagcgaaagaacc

SEQ ID NO: 484222 - DNA, 25 bp, Mus musculus
tgcgccaagccctagattacgagaa

SEQ ID NO: 484223 - DNA, 25 bp, Mus musculus
tgcgccagccgtgttccatctgtaa

SEQ ID NO: 484224 - DNA, 25 bp, Mus musculus
tgcgccagggacgatatggactcgc

SEQ ID NO: 484225 - DNA, 25 bp, Mus musculus
tgcgccatcaggaagacagactctt

SEQ ID NO: 484226 - DNA, 25 bp, Mus musculus
tgcgccatctctagcccttaagcag

SEQ ID NO: 484227 - DNA, 25 bp, Mus musculus
tgcgcccaatgacgacaaagaatgt

SEQ ID NO: 484228 - DNA, 25 bp, Mus musculus
tgcgcccacttctgaaggcgaactg

SEQ ID NO: 484229 - DNA, 25 bp, Mus musculus
tgcgcccaggagagtatcaaagctg

SEQ ID NO: 484230 - DNA, 25 bp, Mus musculus
tgcgcccatcgtgctaaggagtaag

SEQ ID NO: 484231 - DNA, 25 bp, Mus musculus
tgcgcccgtggcttctcgtatcttc

SEQ ID NO: 484232 - DNA, 25 bp, Mus musculus
tgcgccctggccttaatagtcggaa

SEQ ID NO: 484233 - DNA, 25 bp, Mus musculus
tgcgccctgtgcacgttaccaagaa

SEQ ID NO: 484234 - DNA, 25 bp, Mus musculus
tgcgccgatggaagagcttaaagct

SEQ ID NO: 484235 - DNA, 25 bp, Mus musculus
tgcgccggctccgaacattggtgtt

SEQ ID NO: 484236 - DNA, 25 bp, Mus musculus
tgcgcctgggagaacacaacattga

SEQ ID NO: 484237 - DNA, 25 bp, Mus musculus
tgcgcgaatttacatcacgttccag

SEQ ID NO: 484238 - DNA, 25 bp, Mus musculus
tgcgcgaggtttttgagacggccac

SEQ ID NO: 484239 - DNA, 25 bp, Mus musculus
tgcgcgagtagtcaacgctagtacg

SEQ ID NO: 484240 - DNA, 25 bp, Mus musculus
tgcgcgatgccaagctagacaaggg

SEQ ID NO: 484241 - DNA, 25 bp, Mus musculus
tgcgcgatggaacaaaacgcctcaa

SEQ ID NO: 484242 - DNA, 25 bp, Mus musculus
tgcgcgcaagcaggtgactggcttc

SEQ ID NO: 484243 - DNA, 25 bp, Mus musculus
tgcgcgcggctcttttgagacctaa

SEQ ID NO: 484244 - DNA, 25 bp, Mus musculus
tgcgcgcgtttgtaacgaatttccg

SEQ ID NO: 484245 - DNA, 25 bp, Mus musculus
tgcgcggctctgacgctgagcccaa

SEQ ID NO: 484246 - DNA, 25 bp, Mus musculus
tgcgcgggcttgagagaaatacact

SEQ ID NO: 484247 - DNA, 25 bp, Mus musculus
tgcgcgtcctcagtatttaatgtct

SEQ ID NO: 484248 - DNA, 25 bp, Mus musculus
tgcgcgtgcgtgtgatgctacctca

SEQ ID NO: 484249 - DNA, 25 bp, Mus musculus
tgcgcgtgtgccttaaggagtacca

SEQ ID NO: 484250 - DNA, 25 bp, Mus musculus
tgcgcgtgttgcatcttccccatag

SEQ ID NO: 484251 - DNA, 25 bp, Mus musculus
tgcgcgtttgatggccttgaacaag

SEQ ID NO: 484252 - DNA, 25 bp, Mus musculus
tgcgctaacgggaacattggagtaa

SEQ ID NO: 484253 - DNA, 25 bp, Mus musculus
tgcgctatctgcatggcatcctggg

SEQ ID NO: 484254 - DNA, 25 bp, Mus musculus
tgcgctatcttgatttgttacagca

SEQ ID NO: 484255 - DNA, 25 bp, Mus musculus
tgcgctcaccaaggaagacttcgtg

SEQ ID NO: 484256 - DNA, 25 bp, Mus musculus
tgcgctccatgagggctctgcagaa

SEQ ID NO: 484257 - DNA, 25 bp, Mus musculus
tgcgctcccagaagctaaggacatt

SEQ ID NO: 484258 - DNA, 25 bp, Mus musculus
tgcgctccccgcacttggaagagtt

SEQ ID NO: 484259 - DNA, 25 bp, Mus musculus
tgcgctccggcagaatttacatgaa

SEQ ID NO: 484260 - DNA, 25 bp, Mus musculus
tgcgctccttgcctgagccggaatg

SEQ ID NO: 484261 - DNA, 25 bp, Mus musculus
tgcgctcggtaagggctctgtcagc

SEQ ID NO: 484262 - DNA, 25 bp, Mus musculus
tgcgctctaacgtggtattccattc

SEQ ID NO: 484263 - DNA, 25 bp, Mus musculus
tgcgctctcgtgagataaccctggg

SEQ ID NO: 484264 - DNA, 25 bp, Mus musculus
tgcgctctggcgtcagaatgctcaa

SEQ ID NO: 484265 - DNA, 25 bp, Mus musculus
tgcgctcttggatcgggacacttag

SEQ ID NO: 484266 - DNA, 25 bp, Mus musculus
tgcgctgactccaaagagacctggg

SEQ ID NO: 484267 - DNA, 25 bp, Mus musculus
tgcgctgagcaacaagacactgaac

SEQ ID NO: 484268 - DNA, 25 bp, Mus musculus
tgcgctgagctctgttcgtgcccag

SEQ ID NO: 484269 - DNA, 25 bp, Mus musculus
tgcgctgatccaaagcagaactggg

SEQ ID NO: 484270 - DNA, 25 bp, Mus musculus
tgcgctgcggaagaaaactgcctgg

SEQ ID NO: 484271 - DNA, 25 bp, Mus musculus
tgcgctgcgtgttggaccctcagtg

SEQ ID NO: 484272 - DNA, 25 bp, Mus musculus
tgcgctgtccagattcaggtcctga

SEQ ID NO: 484273 - DNA, 25 bp, Mus musculus
tgcgctgtccagcttacaactatct

SEQ ID NO: 484274 - DNA, 25 bp, Mus musculus
tgcgctgtcgttggttaggtgtccc

SEQ ID NO: 484275 - DNA, 25 bp, Mus musculus
tgcgctgtgaacaaacgcggcctgg

SEQ ID NO: 484276 - DNA, 25 bp, Mus musculus
tgcgctgtgaccagagaaatttctg

SEQ ID NO: 484277 - DNA, 25 bp, Mus musculus
tgcgcttcagcgatgcattctggat

SEQ ID NO: 484278 - DNA, 25 bp, Mus musculus
tgcgcttcgcgggttagagtccccg

SEQ ID NO: 484279 - DNA, 25 bp, Mus musculus
tgcgcttgtcttcttatttcgggaa

SEQ ID NO: 484280 - DNA, 25 bp, Mus musculus
tgcgctttcggacaactacaggact

SEQ ID NO: 484281 - DNA, 25 bp, Mus musculus
tgcgctttgataaggtcctggcaac

SEQ ID NO: 484282 - DNA, 25 bp, Mus musculus
tgcggaaactgtggctcaacgtgac

SEQ ID NO: 484283 - DNA, 25 bp, Mus musculus
tgcggaagcccaccatgtcgtatgt

SEQ ID NO: 484284 - DNA, 25 bp, Mus musculus
tgcggaagcgcaactccatgaggag

SEQ ID NO: 484285 - DNA, 25 bp, Mus musculus
tgcggaagctagaccacatcagtga

SEQ ID NO: 484286 - DNA, 25 bp, Mus musculus
tgcggacaaatcttaccaatgcctg

SEQ ID NO: 484287 - DNA, 25 bp, Mus musculus
tgcggacaccgaaaagtggacaact

SEQ ID NO: 484288 - DNA, 25 bp, Mus musculus
tgcggaccatatgcgaagtgaagat

SEQ ID NO: 484289 - DNA, 25 bp, Mus musculus
tgcggaccccagtgagcacatgtat

SEQ ID NO: 484290 - DNA, 25 bp, Mus musculus
tgcggaccccatagcagtggtttgc

SEQ ID NO: 484291 - DNA, 25 bp, Mus musculus
tgcggacccggaggatgtgatcact

SEQ ID NO: 484292 - DNA, 25 bp, Mus musculus
tgcggaccctcgtaagattcccagc

SEQ ID NO: 484293 - DNA, 25 bp, Mus musculus
tgcggaccggtgctgaaaacctcta

SEQ ID NO: 484294 - DNA, 25 bp, Mus musculus
tgcggacgttggagagaacaccctc

SEQ ID NO: 484295 - DNA, 25 bp, Mus musculus
tgcggactcccagctggatggaaaa

SEQ ID NO: 484296 - DNA, 25 bp, Mus musculus
tgcggagacaacatcgactatggct

SEQ ID NO: 484297 - DNA, 25 bp, Mus musculus
tgcggagacagctcactcaggagcc

SEQ ID NO: 484298 - DNA, 25 bp, Mus musculus
tgcggagatgtggttcgagattctc

SEQ ID NO: 484299 - DNA, 25 bp, Mus musculus
tgcggagctcaacaagtacaagtac

SEQ ID NO: 484300 - DNA, 25 bp, Mus musculus
tgcggagctgcgtttaccagcaaac

SEQ ID NO: 484301 - DNA, 25 bp, Mus musculus
tgcggaggaacctgagctacacgtg

SEQ ID NO: 484302 - DNA, 25 bp, Mus musculus
tgcggagggccgtcggcttatccca

SEQ ID NO: 484303 - DNA, 25 bp, Mus musculus
tgcggatagccgtaagtacctctcg

SEQ ID NO: 484304 - DNA, 25 bp, Mus musculus
tgcggatcccagaatgaacagaact

SEQ ID NO: 484305 - DNA, 25 bp, Mus musculus
tgcggatccccttgccaaggtagct

SEQ ID NO: 484306 - DNA, 25 bp, Mus musculus
tgcggatccctgactaatagcttgg

SEQ ID NO: 484307 - DNA, 25 bp, Mus musculus
tgcggatgacccaagcacaagtgtg

SEQ ID NO: 484308 - DNA, 25 bp, Mus musculus
tgcggatgatgaaacagctaactct

SEQ ID NO: 484309 - DNA, 25 bp, Mus musculus
tgcggatgccgaatgaagtcacaag

SEQ ID NO: 484310 - DNA, 25 bp, Mus musculus
tgcggcaaagcgagagcctcggaaa

SEQ ID NO: 484311 - DNA, 25 bp, Mus musculus
tgcggcaactctagagacacggagg

SEQ ID NO: 484312 - DNA, 25 bp, Mus musculus
tgcggcaagacaaactgaccggctc

SEQ ID NO: 484313 - DNA, 25 bp, Mus musculus
tgcggcaagcacaagcgagttctga

SEQ ID NO: 484314 - DNA, 25 bp, Mus musculus
tgcggcacagtgagaacacgctctt

SEQ ID NO: 484315 - DNA, 25 bp, Mus musculus
tgcggcaccagggaaagatcatgta

SEQ ID NO: 484316 - DNA, 25 bp, Mus musculus
tgcggcacgagacggacatgttcaa

SEQ ID NO: 484317 - DNA, 25 bp, Mus musculus
tgcggcactcgctcttcaaaaaggg

SEQ ID NO: 484318 - DNA, 25 bp, Mus musculus
tgcggcactctagatgagaacgaag

SEQ ID NO: 484319 - DNA, 25 bp, Mus musculus
tgcggcagcacagtaggagtattcc

SEQ ID NO: 484320 - DNA, 25 bp, Mus musculus
tgcggcagccaaacgctctgtggaa

SEQ ID NO: 484321 - DNA, 25 bp, Mus musculus
tgcggcagtggctgatcgaacagat

SEQ ID NO: 484322 - DNA, 25 bp, Mus musculus
tgcggcataccgtcagactgaggtt

SEQ ID NO: 484323 - DNA, 25 bp, Mus musculus
tgcggccagaggttcacaccaaaga

SEQ ID NO: 484324 - DNA, 25 bp, Mus musculus
tgcggccatgatcactgtgcacacg

SEQ ID NO: 484325 - DNA, 25 bp, Mus musculus
tgcggccctaccaatgcgagttctg

SEQ ID NO: 484326 - DNA, 25 bp, Mus musculus
tgcggcctcaacgatgagacctggt

SEQ ID NO: 484327 - DNA, 25 bp, Mus musculus
tgcggcctgcgttgtgtctcctcct

SEQ ID NO: 484328 - DNA, 25 bp, Mus musculus
tgcggcgagcgtgtggtcatcaaca

SEQ ID NO: 484329 - DNA, 25 bp, Mus musculus
tgcggcgcgtcatggagtcctactt

SEQ ID NO: 484330 - DNA, 25 bp, Mus musculus
tgcggcgctcatgtacaagcctata

SEQ ID NO: 484331 - DNA, 25 bp, Mus musculus
tgcggcgtcgaaatccacagatgcg

SEQ ID NO: 484332 - DNA, 25 bp, Mus musculus
tgcggctcctacctcagggtggaaa

SEQ ID NO: 484333 - DNA, 25 bp, Mus musculus
tgcggctgcacaagaccgagttcct

SEQ ID NO: 484334 - DNA, 25 bp, Mus musculus
tgcggctgcagcaagtgcagagctt

SEQ ID NO: 484335 - DNA, 25 bp, Mus musculus
tgcggctgccgttcaaacttgtcag

SEQ ID NO: 484336 - DNA, 25 bp, Mus musculus
tgcggctgctgaaccctgaaataga

SEQ ID NO: 484337 - DNA, 25 bp, Mus musculus
tgcggctggagcatgaacaggcttc

SEQ ID NO: 484338 - DNA, 25 bp, Mus musculus
tgcggctggtgcataagcaggacct

SEQ ID NO: 484339 - DNA, 25 bp, Mus musculus
tgcggcttaactgtagccaagtact

SEQ ID NO: 484340 - DNA, 25 bp, Mus musculus
tgcggcttagccaatcggctttaac

SEQ ID NO: 484341 - DNA, 25 bp, Mus musculus
tgcggcttgcctgttaggttttgtc

SEQ ID NO: 484342 - DNA, 25 bp, Mus musculus
tgcggcttgttcacatcttcacaga

SEQ ID NO: 484343 - DNA, 25 bp, Mus musculus
tgcgggaaaacatcaggcgacactg

SEQ ID NO: 484344 - DNA, 25 bp, Mus musculus
tgcgggaaccggtgccttgaagact

SEQ ID NO: 484345 - DNA, 25 bp, Mus musculus
tgcgggaacctctgcgaggcttgac

SEQ ID NO: 484346 - DNA, 25 bp, Mus musculus
tgcgggaacttcgtgccaatgtgga

SEQ ID NO: 484347 - DNA, 25 bp, Mus musculus
tgcgggaagaggtgactttcatcta

SEQ ID NO: 484348 - DNA, 25 bp, Mus musculus
tgcgggaagcgcttttcactggact

SEQ ID NO: 484349 - DNA, 25 bp, Mus musculus
tgcgggaatcccagaaagttcatca

SEQ ID NO: 484350 - DNA, 25 bp, Mus musculus
tgcgggacactaaggagaaactgcc

SEQ ID NO: 484351 - DNA, 25 bp, Mus musculus
tgcgggactacatgaccaaggactc

SEQ ID NO: 484352 - DNA, 25 bp, Mus musculus
tgcgggactggaggaagcctactac

SEQ ID NO: 484353 - DNA, 25 bp, Mus musculus
tgcgggcacttcacctggagcagta

SEQ ID NO: 484354 - DNA, 25 bp, Mus musculus
tgcgggccaacctcaagtctgtgaa

SEQ ID NO: 484355 - DNA, 25 bp, Mus musculus
tgcgggccgcggtgagaatcaataa

SEQ ID NO: 484356 - DNA, 25 bp, Mus musculus
tgcgggcctccaaaaccggtaatgg

SEQ ID NO: 484357 - DNA, 25 bp, Mus musculus
tgcgggcctcctagatcagtcagca

SEQ ID NO: 484358 - DNA, 25 bp, Mus musculus
tgcgggcctgcagaagaagaatttg

SEQ ID NO: 484359 - DNA, 25 bp, Mus musculus
tgcgggccttgggacaactcatctt

SEQ ID NO: 484360 - DNA, 25 bp, Mus musculus
tgcgggcgaaccagagctcttccag

SEQ ID NO: 484361 - DNA, 25 bp, Mus musculus
tgcgggcgcgctacaacctcagcga

SEQ ID NO: 484362 - DNA, 25 bp, Mus musculus
tgcgggctcttagcgcctgcgtagt

SEQ ID NO: 484363 - DNA, 25 bp, Mus musculus
tgcgggctcttcttccatgggaaag

SEQ ID NO: 484364 - DNA, 25 bp, Mus musculus
tgcgggttacctttctgggccatca

SEQ ID NO: 484365 - DNA, 25 bp, Mus musculus
tgcggtacacactgagcccagagaa

SEQ ID NO: 484366 - DNA, 25 bp, Mus musculus
tgcggtatgaagttgaacctcgact

SEQ ID NO: 484367 - DNA, 25 bp, Mus musculus
tgcggtcacacacggaaacatcctg

SEQ ID NO: 484368 - DNA, 25 bp, Mus musculus
tgcggtcacaggtgcaagtgagcct

SEQ ID NO: 484369 - DNA, 25 bp, Mus musculus
tgcggtcctagaagggccaacccag

SEQ ID NO: 484370 - DNA, 25 bp, Mus musculus
tgcggtgaaatacctcgcttctaag

SEQ ID NO: 484371 - DNA, 25 bp, Mus musculus
tgcggtgagatactccacgttcttc

SEQ ID NO: 484372 - DNA, 25 bp, Mus musculus
tgcggtgctacctctggcattaggt

SEQ ID NO: 484373 - DNA, 25 bp, Mus musculus
tgcggtgggaactactcagccatgg

SEQ ID NO: 484374 - DNA, 25 bp, Mus musculus
tgcggttaaaaccacaaaggtacag

SEQ ID NO: 484375 - DNA, 25 bp, Mus musculus
tgcggttcgaactgctgctgccaat

SEQ ID NO: 484376 - DNA, 25 bp, Mus musculus
tgcggttcgggttttggcagtaaca

SEQ ID NO: 484377 - DNA, 25 bp, Mus musculus
tgcggttgcagaaggcaaagccttt

SEQ ID NO: 484378 - DNA, 25 bp, Mus musculus
tgcggttgtacagcttcaggcagaa

SEQ ID NO: 484379 - DNA, 25 bp, Mus musculus
tgcggtttaagactgcagctgcttc

SEQ ID NO: 484380 - DNA, 25 bp, Mus musculus
tgcggtttccctgcagccggagtta

SEQ ID NO: 484381 - DNA, 25 bp, Mus musculus
tgcggtttgcaaaggcggtacccta

SEQ ID NO: 484382 - DNA, 25 bp, Mus musculus
tgcgtaaccagtcaggtgcttcagg

SEQ ID NO: 484383 - DNA, 25 bp, Mus musculus
tgcgtacacatatcccctgtgatgg

SEQ ID NO: 484384 - DNA, 25 bp, Mus musculus
tgcgtacgccttacaccatgagtta

SEQ ID NO: 484385 - DNA, 25 bp, Mus musculus
tgcgtacgcttctccccttggagct

SEQ ID NO: 484386 - DNA, 25 bp, Mus musculus
tgcgtacggcaagtgaggaccatcg

SEQ ID NO: 484387 - DNA, 25 bp, Mus musculus
tgcgtacttggtcacggcactgtca

SEQ ID NO: 484388 - DNA, 25 bp, Mus musculus
tgcgtagacctagaacatctggaac

SEQ ID NO: 484389 - DNA, 25 bp, Mus musculus
tgcgtagggttaaggaaaatacctg

SEQ ID NO: 484390 - DNA, 25 bp, Mus musculus
tgcgtatcctcgaagagagcagcct

SEQ ID NO: 484391 - DNA, 25 bp, Mus musculus
tgcgtatgcaatgaagcgggacctc

SEQ ID NO: 484392 - DNA, 25 bp, Mus musculus
tgcgtcacagacaaagggaaatctt

SEQ ID NO: 484393 - DNA, 25 bp, Mus musculus
tgcgtccagcagctaaagcgatccg

SEQ ID NO: 484394 - DNA, 25 bp, Mus musculus
tgcgtccatttgaagaacgaccccg

SEQ ID NO: 484395 - DNA, 25 bp, Mus musculus
tgcgtcccaaactcttaagcgattg

SEQ ID NO: 484396 - DNA, 25 bp, Mus musculus
tgcgtcccgtgtcagtttccctggt

SEQ ID NO: 484397 - DNA, 25 bp, Mus musculus
tgcgtccgcagaggaaatcccaata

SEQ ID NO: 484398 - DNA, 25 bp, Mus musculus
tgcgtcgagagatccatcaactggg

SEQ ID NO: 484399 - DNA, 25 bp, Mus musculus
tgcgtctcttttcattcatctccag

SEQ ID NO: 484400 - DNA, 25 bp, Mus musculus
tgcgtctgggctgtggaagctcacc

SEQ ID NO: 484401 - DNA, 25 bp, Mus musculus
tgcgtcttgcaaaaagagacggccg

SEQ ID NO: 484402 - DNA, 25 bp, Mus musculus
tgcgtgaccacgaaaagagggtgca

SEQ ID NO: 484403 - DNA, 25 bp, Mus musculus
tgcgtgactgaaccctcagaagtgg

SEQ ID NO: 484404 - DNA, 25 bp, Mus musculus
tgcgtgagacctacccagcaagcag

SEQ ID NO: 484405 - DNA, 25 bp, Mus musculus
tgcgtgagaggctgcgtgccccaca

SEQ ID NO: 484406 - DNA, 25 bp, Mus musculus
tgcgtgatgcaatgacctgggtcct

SEQ ID NO: 484407 - DNA, 25 bp, Mus musculus
tgcgtgcccggacagaagctttcaa

SEQ ID NO: 484408 - DNA, 25 bp, Mus musculus
tgcgtgccgaaatgacgaccctagt

SEQ ID NO: 484409 - DNA, 25 bp, Mus musculus
tgcgtgccgggagatcaacttaaac

SEQ ID NO: 484410 - DNA, 25 bp, Mus musculus
tgcgtgccggtcatccagcggactc

SEQ ID NO: 484411 - DNA, 25 bp, Mus musculus
tgcgtgcgctccttgcctgagccgg

SEQ ID NO: 484412 - DNA, 25 bp, Mus musculus
tgcgtgcgtcaaggtttttaatcaa

SEQ ID NO: 484413 - DNA, 25 bp, Mus musculus
tgcgtgctcatcacagaaaagctgc

SEQ ID NO: 484414 - DNA, 25 bp, Mus musculus
tgcgtgcttagtgcctgtgaaggtc

SEQ ID NO: 484415 - DNA, 25 bp, Mus musculus
tgcgtggaagagaacagagacatct

SEQ ID NO: 484416 - DNA, 25 bp, Mus musculus
tgcgtggaggccatcgacttcgact

SEQ ID NO: 484417 - DNA, 25 bp, Mus musculus
tgcgtggcagccaactactactggt

SEQ ID NO: 484418 - DNA, 25 bp, Mus musculus
tgcgtggctcagctgaacgatcctg

SEQ ID NO: 484419 - DNA, 25 bp, Mus musculus
tgcgtggctcccagaagcgaaagtg

SEQ ID NO: 484420 - DNA, 25 bp, Mus musculus
tgcgtgggcgtcctatgatcagaca

SEQ ID NO: 484421 - DNA, 25 bp, Mus musculus
tgcgtgtccgacttttgcacatgac

SEQ ID NO: 484422 - DNA, 25 bp, Mus musculus
tgcgtgtcctacaacttttcgggtt

SEQ ID NO: 484423 - DNA, 25 bp, Mus musculus
tgcgtgtgctgttccgatccgggcc

SEQ ID NO: 484424 - DNA, 25 bp, Mus musculus
tgcgtgtgtgcatcccaaggcccct

SEQ ID NO: 484425 - DNA, 25 bp, Mus musculus
tgcgtgtttgttgtttactgtcaca

SEQ ID NO: 484426 - DNA, 25 bp, Mus musculus
tgcgttaccgattccaccggtgtcg

SEQ ID NO: 484427 - DNA, 25 bp, Mus musculus
tgcgttagaggcagacagcagccag

SEQ ID NO: 484428 - DNA, 25 bp, Mus musculus
tgcgttcactgcgaaaccagaggac

SEQ ID NO: 484429 - DNA, 25 bp, Mus musculus
tgcgttcatagggtcagaggtcaag

SEQ ID NO: 484430 - DNA, 25 bp, Mus musculus
tgcgttccgtcaaagtcgtccctga

SEQ ID NO: 484431 - DNA, 25 bp, Mus musculus
tgcgttcctcagtgcggcagaggcc

SEQ ID NO: 484432 - DNA, 25 bp, Mus musculus
tgcgttcctgggagaccaacatcgg

SEQ ID NO: 484433 - DNA, 25 bp, Mus musculus
tgcgttcgagctacccaatgctggg

SEQ ID NO: 484434 - DNA, 25 bp, Mus musculus
tgcgttctaaatggattgactcaac

SEQ ID NO: 484435 - DNA, 25 bp, Mus musculus
tgcgttctcgacaaggccatgtgcc

SEQ ID NO: 484436 - DNA, 25 bp, Mus musculus
tgcgttctgcgctgctgtcttagga

SEQ ID NO: 484437 - DNA, 25 bp, Mus musculus
tgcgttgcaccaagacacgtggatc

SEQ ID NO: 484438 - DNA, 25 bp, Mus musculus
tgcgtttaagtcagaaggtgctcct

SEQ ID NO: 484439 - DNA, 25 bp, Mus musculus
tgcgtttggttaacagctaccggct

SEQ ID NO: 484440 - DNA, 25 bp, Mus musculus
tgcgttttctagagctgatcctgga

SEQ ID NO: 484441 - DNA, 25 bp, Mus musculus
tgcgtttttagagcgcaggccgccg

SEQ ID NO: 484442 - DNA, 25 bp, Mus musculus
tgctaaaaagcagaacggcctgtgt

SEQ ID NO: 484443 - DNA, 25 bp, Mus musculus
tgctaaaaggactcccaaaagggcg

SEQ ID NO: 484444 - DNA, 25 bp, Mus musculus
tgctaaacaaaaccctaacgtggct

SEQ ID NO: 484445 - DNA, 25 bp, Mus musculus
tgctaaacctgatgacacctgactg

SEQ ID NO: 484446 - DNA, 25 bp, Mus musculus
tgctaaactgctctattcatgtggg

SEQ ID NO: 484447 - DNA, 25 bp, Mus musculus
tgctaaagaagatcgaacacgctcg

SEQ ID NO: 484448 - DNA, 25 bp, Mus musculus
tgctaaagccatatctggagacagc

SEQ ID NO: 484449 - DNA, 25 bp, Mus musculus
tgctaaaggcaagggaggctccatg

SEQ ID NO: 484450 - DNA, 25 bp, Mus musculus
tgctaaagggaagggaggtcctcca

SEQ ID NO: 484451 - DNA, 25 bp, Mus musculus
tgctaaataacggagcccaggtcaa

SEQ ID NO: 484452 - DNA, 25 bp, Mus musculus
tgctaaataactaccacagatcgag

SEQ ID NO: 484453 - DNA, 25 bp, Mus musculus
tgctaacagaatctacgggacgagg

SEQ ID NO: 484454 - DNA, 25 bp, Mus musculus
tgctaacattagtggacgatgctcc

SEQ ID NO: 484455 - DNA, 25 bp, Mus musculus
tgctaaccccagagttggcaggcca

SEQ ID NO: 484456 - DNA, 25 bp, Mus musculus
tgctaactctcctggagggcatcgt

SEQ ID NO: 484457 - DNA, 25 bp, Mus musculus
tgctaactgaaaagccaccttgggc

SEQ ID NO: 484458 - DNA, 25 bp, Mus musculus
tgctaagaagtacatcgtgcctgcc

SEQ ID NO: 484459 - DNA, 25 bp, Mus musculus
tgctaagccaccagatcagaagagg

SEQ ID NO: 484460 - DNA, 25 bp, Mus musculus
tgctaagccttggattgcgctgata

SEQ ID NO: 484461 - DNA, 25 bp, Mus musculus
tgctaaggccttccacatttgagtg

SEQ ID NO: 484462 - DNA, 25 bp, Mus musculus
tgctaaggttaaccgtgtatactcc

SEQ ID NO: 484463 - DNA, 25 bp, Mus musculus
tgctaagtgcttcataggaacatct

SEQ ID NO: 484464 - DNA, 25 bp, Mus musculus
tgctaagtggtactttccttctgca

SEQ ID NO: 484465 - DNA, 25 bp, Mus musculus
tgctaagtgtgctcccggaagtcgg

SEQ ID NO: 484466 - DNA, 25 bp, Mus musculus
tgctaataggttgtggtcacgcccc

SEQ ID NO: 484467 - DNA, 25 bp, Mus musculus
tgctaatattaccagcctaattcca

SEQ ID NO: 484468 - DNA, 25 bp, Mus musculus
tgctaatccatcagaaagggcccgc

SEQ ID NO: 484469 - DNA, 25 bp, Mus musculus
tgctaatgacgctgttcccagggag

SEQ ID NO: 484470 - DNA, 25 bp, Mus musculus
tgctaatgcttgatggaatgccggc

SEQ ID NO: 484471 - DNA, 25 bp, Mus musculus
tgctaatggcactgcagagggctct

SEQ ID NO: 484472 - DNA, 25 bp, Mus musculus
tgctaattgaacaaggagaaggctt

SEQ ID NO: 484473 - DNA, 25 bp, Mus musculus
tgctacaagctgagtctaccagggt

SEQ ID NO: 484474 - DNA, 25 bp, Mus musculus
tgctacaattctgtgcggaggaaga

SEQ ID NO: 484475 - DNA, 25 bp, Mus musculus
tgctacagaagttaacccgagacct

SEQ ID NO: 484476 - DNA, 25 bp, Mus musculus
tgctacagactttcagggtgggatg

SEQ ID NO: 484477 - DNA, 25 bp, Mus musculus
tgctacagatgccaacccaagctgg

SEQ ID NO: 484478 - DNA, 25 bp, Mus musculus
tgctacagcactccatacccaaata

SEQ ID NO: 484479 - DNA, 25 bp, Mus musculus
tgctacaggactacgagcgtgctgc

SEQ ID NO: 484480 - DNA, 25 bp, Mus musculus
tgctacagttgttcacggaatccca

SEQ ID NO: 484481 - DNA, 25 bp, Mus musculus
tgctacatgttctacccctgcagat

SEQ ID NO: 484482 - DNA, 25 bp, Mus musculus
tgctaccaacccctgattaggccta

SEQ ID NO: 484483 - DNA, 25 bp, Mus musculus
tgctacccctagtttcagaggcacg

SEQ ID NO: 484484 - DNA, 25 bp, Mus musculus
tgctaccctgaaacacgagctccgt

SEQ ID NO: 484485 - DNA, 25 bp, Mus musculus
tgctaccgtgttctgtctattccaa

SEQ ID NO: 484486 - DNA, 25 bp, Mus musculus
tgctacctgccttcggtggctctgg

SEQ ID NO: 484487 - DNA, 25 bp, Mus musculus
tgctaccttgattcactcttcgtcg

SEQ ID NO: 484488 - DNA, 25 bp, Mus musculus
tgctaccttttagagatgccccagg

SEQ ID NO: 484489 - DNA, 25 bp, Mus musculus
tgctacgctgtcgacactggatcct

SEQ ID NO: 484490 - DNA, 25 bp, Mus musculus
tgctacggaagagcgaggcactatg

SEQ ID NO: 484491 - DNA, 25 bp, Mus musculus
tgctacggacactgtgggctgagaa

SEQ ID NO: 484492 - DNA, 25 bp, Mus musculus
tgctacggagtcactatcctgggcc

SEQ ID NO: 484493 - DNA, 25 bp, Mus musculus
tgctacggcgaacttggacagcgct

SEQ ID NO: 484494 - DNA, 25 bp, Mus musculus
tgctacgtagagaccagagagatgg

SEQ ID NO: 484495 - DNA, 25 bp, Mus musculus
tgctacgtgctgtgccgtgcttgcc

SEQ ID NO: 484496 - DNA, 25 bp, Mus musculus
tgctactacaaaacctacagaatgg

SEQ ID NO: 484497 - DNA, 25 bp, Mus musculus
tgctactaccatgggaaactccggg

SEQ ID NO: 484498 - DNA, 25 bp, Mus musculus
tgctactacgagaggagaatggctg

SEQ ID NO: 484499 - DNA, 25 bp, Mus musculus
tgctactagtactgaagggacggac

SEQ ID NO: 484500 - DNA, 25 bp, Mus musculus
tgctactcaagggtgcacgcatcga

SEQ ID NO: 484501 - DNA, 25 bp, Mus musculus
tgctactccgggacctggtgctgcg

SEQ ID NO: 484502 - DNA, 25 bp, Mus musculus
tgctactcggcgcttcagtcgcggt

SEQ ID NO: 484503 - DNA, 25 bp, Mus musculus
tgctactggtatccggactgggcct

SEQ ID NO: 484504 - DNA, 25 bp, Mus musculus
tgctacttgagacaacctaaacttg

SEQ ID NO: 484505 - DNA, 25 bp, Mus musculus
tgctagaagccactccccttattgt

SEQ ID NO: 484506 - DNA, 25 bp, Mus musculus
tgctagaaggctatcgctgctaccg

SEQ ID NO: 484507 - DNA, 25 bp, Mus musculus
tgctagaatccatgccgctgcgtga

SEQ ID NO: 484508 - DNA, 25 bp, Mus musculus
tgctagaattgtacctggccgggac

SEQ ID NO: 484509 - DNA, 25 bp, Mus musculus
tgctagacaacgtaggctgcaccgg

SEQ ID NO: 484510 - DNA, 25 bp, Mus musculus
tgctagagactgtgcgcatccgacg

SEQ ID NO: 484511 - DNA, 25 bp, Mus musculus
tgctagaggccttgtctgggttccc

SEQ ID NO: 484512 - DNA, 25 bp, Mus musculus
tgctagaggctagagatatcccctg

SEQ ID NO: 484513 - DNA, 25 bp, Mus musculus
tgctagatttcgagctgagccacag

SEQ ID NO: 484514 - DNA, 25 bp, Mus musculus
tgctagcaagcgatggccactcttg

SEQ ID NO: 484515 - DNA, 25 bp, Mus musculus
tgctagcaccacttagatgactcag

SEQ ID NO: 484516 - DNA, 25 bp, Mus musculus
tgctagcactgcgattacaaatgct

SEQ ID NO: 484517 - DNA, 25 bp, Mus musculus
tgctagcagcaacacgacagaagac

SEQ ID NO: 484518 - DNA, 25 bp, Mus musculus
tgctagcagccagttcccaaaggat

SEQ ID NO: 484519 - DNA, 25 bp, Mus musculus
tgctagcagcctcgatcatggcctt

SEQ ID NO: 484520 - DNA, 25 bp, Mus musculus
tgctagccatgcagccaagagtcgg

SEQ ID NO: 484521 - DNA, 25 bp, Mus musculus
tgctagcgaacttggtgcacggcct

SEQ ID NO: 484522 - DNA, 25 bp, Mus musculus
tgctagcgacactagaaccgaccga

SEQ ID NO: 484523 - DNA, 25 bp, Mus musculus
tgctagctacatcgagaaggtccgc

SEQ ID NO: 484524 - DNA, 25 bp, Mus musculus
tgctagctcacgactgtgaccaagg

SEQ ID NO: 484525 - DNA, 25 bp, Mus musculus
tgctaggcaacggtgtggcccagcc

SEQ ID NO: 484526 - DNA, 25 bp, Mus musculus
tgctaggctccaggtagaccctgag

SEQ ID NO: 484527 - DNA, 25 bp, Mus musculus
tgctaggtataccactgaggtgtac

SEQ ID NO: 484528 - DNA, 25 bp, Mus musculus
tgctaggtcttccagagtctcagaa

SEQ ID NO: 484529 - DNA, 25 bp, Mus musculus
tgctagtagaacaaacaagggactc

SEQ ID NO: 484530 - DNA, 25 bp, Mus musculus
tgctagtcagtatgggcacatgcca

SEQ ID NO: 484531 - DNA, 25 bp, Mus musculus
tgctagtcgcttcccctcagttgga

SEQ ID NO: 484532 - DNA, 25 bp, Mus musculus
tgctagtctgtccacctgctgcagg

SEQ ID NO: 484533 - DNA, 25 bp, Mus musculus
tgctagtgcatgaaataagtcccct

SEQ ID NO: 484534 - DNA, 25 bp, Mus musculus
tgctagtggctaaggaaacattccc

SEQ ID NO: 484535 - DNA, 25 bp, Mus musculus
tgctagtgtagttcaatggaggtcc

SEQ ID NO: 484536 - DNA, 25 bp, Mus musculus
tgctagtgtctgatttgagggcctc

SEQ ID NO: 484537 - DNA, 25 bp, Mus musculus
tgctagtgtgtttcttgacacccca

SEQ ID NO: 484538 - DNA, 25 bp, Mus musculus
tgctatagacgcacaaacgaccgcg

SEQ ID NO: 484539 - DNA, 25 bp, Mus musculus
tgctatagtgtctggccaacaggag

SEQ ID NO: 484540 - DNA, 25 bp, Mus musculus
tgctatatgttggtacagagggcct

SEQ ID NO: 484541 - DNA, 25 bp, Mus musculus
tgctatcaccctgtttggaaacctg

SEQ ID NO: 484542 - DNA, 25 bp, Mus musculus
tgctatccccattgtggcggccaag

SEQ ID NO: 484543 - DNA, 25 bp, Mus musculus
tgctatgacgcgacacttggctgtg

SEQ ID NO: 484544 - DNA, 25 bp, Mus musculus
tgctatgatgcaagtgcctccccga

SEQ ID NO: 484545 - DNA, 25 bp, Mus musculus
tgctatgcccctgcaactgtggaat

SEQ ID NO: 484546 - DNA, 25 bp, Mus musculus
tgctatggaaacatccgcaccctgg

SEQ ID NO: 484547 - DNA, 25 bp, Mus musculus
tgctatgtactgactgaagctcgga

SEQ ID NO: 484548 - DNA, 25 bp, Mus musculus
tgctatgtgctggtcgcctatccct

SEQ ID NO: 484549 - DNA, 25 bp, Mus musculus
tgctattcactctcgtgctggcaga

SEQ ID NO: 484550 - DNA, 25 bp, Mus musculus
tgctattgcggtgtcggtggctccc

SEQ ID NO: 484551 - DNA, 25 bp, Mus musculus
tgctatttccatgcaaaaaggccgg

SEQ ID NO: 484552 - DNA, 25 bp, Mus musculus
tgctatttcttctcaggcgcggtcc

SEQ ID NO: 484553 - DNA, 25 bp, Mus musculus
tgctcaaaagcgatgtggccagcct

SEQ ID NO: 484554 - DNA, 25 bp, Mus musculus
tgctcaaactactggaggcctgtcc

SEQ ID NO: 484555 - DNA, 25 bp, Mus musculus
tgctcaacaagaactgccacatggg

SEQ ID NO: 484556 - DNA, 25 bp, Mus musculus
tgctcaacatcatgaaggtctccac

SEQ ID NO: 484557 - DNA, 25 bp, Mus musculus
tgctcaacggatctacgggaaccag

SEQ ID NO: 484558 - DNA, 25 bp, Mus musculus
tgctcaacttccatgcggacacgga

SEQ ID NO: 484559 - DNA, 25 bp, Mus musculus
tgctcaagacaaagtgccaggctac

SEQ ID NO: 484560 - DNA, 25 bp, Mus musculus
tgctcaagattcgagatgacagtga

SEQ ID NO: 484561 - DNA, 25 bp, Mus musculus
tgctcaagcaaagcatgagacacac

SEQ ID NO: 484562 - DNA, 25 bp, Mus musculus
tgctcaagggcactaaagccaagag

SEQ ID NO: 484563 - DNA, 25 bp, Mus musculus
tgctcaagggccctcatcacgtgct

SEQ ID NO: 484564 - DNA, 25 bp, Mus musculus
tgctcaagtctctgcgcttgagccc

SEQ ID NO: 484565 - DNA, 25 bp, Mus musculus
tgctcaatccctcctaaggccagaa

SEQ ID NO: 484566 - DNA, 25 bp, Mus musculus
tgctcaatgacacagaattggcatt

SEQ ID NO: 484567 - DNA, 25 bp, Mus musculus
tgctcacaaaaggaagccgttgccc

SEQ ID NO: 484568 - DNA, 25 bp, Mus musculus
tgctcacaactgtttaacaaatggt

SEQ ID NO: 484569 - DNA, 25 bp, Mus musculus
tgctcacaagcctgacggatgacct

SEQ ID NO: 484570 - DNA, 25 bp, Mus musculus
tgctcacaatgtacatgcatcgtgg

SEQ ID NO: 484571 - DNA, 25 bp, Mus musculus
tgctcacagagcgtggacagtgccg

SEQ ID NO: 484572 - DNA, 25 bp, Mus musculus
tgctcacaggcttcccaggtctgga

SEQ ID NO: 484573 - DNA, 25 bp, Mus musculus
tgctcaccaaggctcatgcatctga

SEQ ID NO: 484574 - DNA, 25 bp, Mus musculus
tgctcaccagagaggatgggctcaa

SEQ ID NO: 484575 - DNA, 25 bp, Mus musculus
tgctcaccagctcaagagggtcctg

SEQ ID NO: 484576 - DNA, 25 bp, Mus musculus
tgctcacggccagtcagaaatggtg

SEQ ID NO: 484577 - DNA, 25 bp, Mus musculus
tgctcacgggcacccatagatggtc

SEQ ID NO: 484578 - DNA, 25 bp, Mus musculus
tgctcactacctagatttctgcagg

SEQ ID NO: 484579 - DNA, 25 bp, Mus musculus
tgctcactcggctaatgggccacct

SEQ ID NO: 484580 - DNA, 25 bp, Mus musculus
tgctcactgaactgatcaccaaggg

SEQ ID NO: 484581 - DNA, 25 bp, Mus musculus
tgctcactgagatcacactgggact

SEQ ID NO: 484582 - DNA, 25 bp, Mus musculus
tgctcactgctgaagattttaaagc

SEQ ID NO: 484583 - DNA, 25 bp, Mus musculus
tgctcagaaaacttaacttggctcc

SEQ ID NO: 484584 - DNA, 25 bp, Mus musculus
tgctcagaaataaaccgtgggatca

SEQ ID NO: 484585 - DNA, 25 bp, Mus musculus
tgctcagaacagcacctcgggatct

SEQ ID NO: 484586 - DNA, 25 bp, Mus musculus
tgctcagaagggaaatactaccaag

SEQ ID NO: 484587 - DNA, 25 bp, Mus musculus
tgctcagacagccagaagaggcgtt

SEQ ID NO: 484588 - DNA, 25 bp, Mus musculus
tgctcagagactcaaggtcaacctt

SEQ ID NO: 484589 - DNA, 25 bp, Mus musculus
tgctcagagcatatggtcccaggcc

SEQ ID NO: 484590 - DNA, 25 bp, Mus musculus
tgctcagaggacgacgacgaattgc

SEQ ID NO: 484591 - DNA, 25 bp, Mus musculus
tgctcagaggatttggagaacggtt

SEQ ID NO: 484592 - DNA, 25 bp, Mus musculus
tgctcagcaacaggaagagtagccc

SEQ ID NO: 484593 - DNA, 25 bp, Mus musculus
tgctcagcaaggtccacagatggag

SEQ ID NO: 484594 - DNA, 25 bp, Mus musculus
tgctcagcgacagaagtgcctctac

SEQ ID NO: 484595 - DNA, 25 bp, Mus musculus
tgctcagcgccaggaaattgctcag

SEQ ID NO: 484596 - DNA, 25 bp, Mus musculus
tgctcagcgtggagcggtgctctct

SEQ ID NO: 484597 - DNA, 25 bp, Mus musculus
tgctcagctacacagacctcgtggg

SEQ ID NO: 484598 - DNA, 25 bp, Mus musculus
tgctcagctacgcagagagagtaac

SEQ ID NO: 484599 - DNA, 25 bp, Mus musculus
tgctcagctgaatggcctcggaagt

SEQ ID NO: 484600 - DNA, 25 bp, Mus musculus
tgctcagctgcgtttgctgcaagag

SEQ ID NO: 484601 - DNA, 25 bp, Mus musculus
tgctcaggctcagacaatgggttcc

SEQ ID NO: 484602 - DNA, 25 bp, Mus musculus
tgctcaggtgactcagggccacttg

SEQ ID NO: 484603 - DNA, 25 bp, Mus musculus
tgctcagtcccaacaggaatcagat

SEQ ID NO: 484604 - DNA, 25 bp, Mus musculus
tgctcagtcggaacataaaggctct

SEQ ID NO: 484605 - DNA, 25 bp, Mus musculus
tgctcagtctcgtgggtgcacaaag

SEQ ID NO: 484606 - DNA, 25 bp, Mus musculus
tgctcagtgcagtggctcggaccgt

SEQ ID NO: 484607 - DNA, 25 bp, Mus musculus
tgctcagttaaagaacccagctggg

SEQ ID NO: 484608 - DNA, 25 bp, Mus musculus
tgctcagttcgggatcatatgagga

SEQ ID NO: 484609 - DNA, 25 bp, Mus musculus
tgctcagttgtttctctctccatag

SEQ ID NO: 484610 - DNA, 25 bp, Mus musculus
tgctcataaggaagaagaccccggc

SEQ ID NO: 484611 - DNA, 25 bp, Mus musculus
tgctcatagcccacaagctgaacga

SEQ ID NO: 484612 - DNA, 25 bp, Mus musculus
tgctcatcagcaaagaaaaaagcct

SEQ ID NO: 484613 - DNA, 25 bp, Mus musculus
tgctcatgccaacaacagggttcct

SEQ ID NO: 484614 - DNA, 25 bp, Mus musculus
tgctcatgcgggaaaactcgggctc

SEQ ID NO: 484615 - DNA, 25 bp, Mus musculus
tgctcatggcagaacccaatcctga

SEQ ID NO: 484616 - DNA, 25 bp, Mus musculus
tgctcatggcgcttactgtgcgttt

SEQ ID NO: 484617 - DNA, 25 bp, Mus musculus
tgctcatgggactggacactgcttc

SEQ ID NO: 484618 - DNA, 25 bp, Mus musculus
tgctcatggtccacgacacggttgc

SEQ ID NO: 484619 - DNA, 25 bp, Mus musculus
tgctcattcttaagtggaccgatgc

SEQ ID NO: 484620 - DNA, 25 bp, Mus musculus
tgctcattgacaacgccaggatggc

SEQ ID NO: 484621 - DNA, 25 bp, Mus musculus
tgctcattgcctttgcagacaacag

SEQ ID NO: 484622 - DNA, 25 bp, Mus musculus
tgctccaagccagacgacgatattc

SEQ ID NO: 484623 - DNA, 25 bp, Mus musculus
tgctccaagtgaccaaagcagtggt

SEQ ID NO: 484624 - DNA, 25 bp, Mus musculus
tgctccacggagcagaacccaactg

SEQ ID NO: 484625 - DNA, 25 bp, Mus musculus
tgctccagactgctcccgggttgga

SEQ ID NO: 484626 - DNA, 25 bp, Mus musculus
tgctccagatggctcagggttcgac

SEQ ID NO: 484627 - DNA, 25 bp, Mus musculus
tgctccagcatcctccagggaggtg

SEQ ID NO: 484628 - DNA, 25 bp, Mus musculus
tgctccagcatgaagaccctgggtg

SEQ ID NO: 484629 - DNA, 25 bp, Mus musculus
tgctccagcgtatgtgtttacacca

SEQ ID NO: 484630 - DNA, 25 bp, Mus musculus
tgctccagctgatggtcccagtgaa

SEQ ID NO: 484631 - DNA, 25 bp, Mus musculus
tgctccaggcactcactttgcaggc

SEQ ID NO: 484632 - DNA, 25 bp, Mus musculus
tgctccaggccataggaacgggaaa

SEQ ID NO: 484633 - DNA, 25 bp, Mus musculus
tgctccaggccatgcagtgcaagtt

SEQ ID NO: 484634 - DNA, 25 bp, Mus musculus
tgctccagggaggtaaaaaggttcg

SEQ ID NO: 484635 - DNA, 25 bp, Mus musculus
tgctccaggtcagttagtctcatcg

SEQ ID NO: 484636 - DNA, 25 bp, Mus musculus
tgctccagtctacacagagtctttg

SEQ ID NO: 484637 - DNA, 25 bp, Mus musculus
tgctcccagatatgcaaagcagaga

SEQ ID NO: 484638 - DNA, 25 bp, Mus musculus
tgctcccagcataccaaatttgtcc

SEQ ID NO: 484639 - DNA, 25 bp, Mus musculus
tgctcccagccctgacatggcaata

SEQ ID NO: 484640 - DNA, 25 bp, Mus musculus
tgctcccaggaaattaacgccatgg

SEQ ID NO: 484641 - DNA, 25 bp, Mus musculus
tgctcccagggagcccacagatggg

SEQ ID NO: 484642 - DNA, 25 bp, Mus musculus
tgctcccattgacttcatgcttttg

SEQ ID NO: 484643 - DNA, 25 bp, Mus musculus
tgctccccagggataaatcgctcta

SEQ ID NO: 484644 - DNA, 25 bp, Mus musculus
tgctccccgacggttgtttacaaag

SEQ ID NO: 484645 - DNA, 25 bp, Mus musculus
tgctccccgtgttgaaagactgtgg

SEQ ID NO: 484646 - DNA, 25 bp, Mus musculus
tgctccctaggaaatgaaccactat

SEQ ID NO: 484647 - DNA, 25 bp, Mus musculus
tgctccctgtatagaaactgacata

SEQ ID NO: 484648 - DNA, 25 bp, Mus musculus
tgctcccttgcaacgacagcgacag

SEQ ID NO: 484649 - DNA, 25 bp, Mus musculus
tgctcccttgggatttgagcccaga

SEQ ID NO: 484650 - DNA, 25 bp, Mus musculus
tgctccgaaagacccaagaagcggc

SEQ ID NO: 484651 - DNA, 25 bp, Mus musculus
tgctccgcgatctagtgtaactggg

SEQ ID NO: 484652 - DNA, 25 bp, Mus musculus
tgctccggcttcgagaaccattggg

SEQ ID NO: 484653 - DNA, 25 bp, Mus musculus
tgctccgggtgctcaagaaggacat

SEQ ID NO: 484654 - DNA, 25 bp, Mus musculus
tgctccgtgggttactatgtccagg

SEQ ID NO: 484655 - DNA, 25 bp, Mus musculus
tgctccgtttttgcaaaaaggcgcc

SEQ ID NO: 484656 - DNA, 25 bp, Mus musculus
tgctcctacctcagagatgagccgc

SEQ ID NO: 484657 - DNA, 25 bp, Mus musculus
tgctcctactacaacccacttggaa

SEQ ID NO: 484658 - DNA, 25 bp, Mus musculus
tgctcctactgaaacacacagaggt

SEQ ID NO: 484659 - DNA, 25 bp, Mus musculus
tgctcctaggttcaaaatttccctc

SEQ ID NO: 484660 - DNA, 25 bp, Mus musculus
tgctcctatgaaggccacttcgagg

SEQ ID NO: 484661 - DNA, 25 bp, Mus musculus
tgctcctcagggtgtgaaaaacccc

SEQ ID NO: 484662 - DNA, 25 bp, Mus musculus
tgctcctccacattctcgatcatag

SEQ ID NO: 484663 - DNA, 25 bp, Mus musculus
tgctcctcccatacccgggatgtta

SEQ ID NO: 484664 - DNA, 25 bp, Mus musculus
tgctcctctagagaacaatccttta

SEQ ID NO: 484665 - DNA, 25 bp, Mus musculus
tgctcctgaacttggtcttaaaagg

SEQ ID NO: 484666 - DNA, 25 bp, Mus musculus
tgctcctgaagatagtcacaccgtg

SEQ ID NO: 484667 - DNA, 25 bp, Mus musculus
tgctcctgacagtaatatcacttgc

SEQ ID NO: 484668 - DNA, 25 bp, Mus musculus
tgctcctgcagtgaatagtagtgat

SEQ ID NO: 484669 - DNA, 25 bp, Mus musculus
tgctcctgcctcctatgacgtctag

SEQ ID NO: 484670 - DNA, 25 bp, Mus musculus
tgctcctgcgagctcagcttcggca

SEQ ID NO: 484671 - DNA, 25 bp, Mus musculus
tgctcctggaccagtgtggctggca

SEQ ID NO: 484672 - DNA, 25 bp, Mus musculus
tgctcctgtacctggcaatgatccc

SEQ ID NO: 484673 - DNA, 25 bp, Mus musculus
tgctcctgtattcctcgcgggtgtg

SEQ ID NO: 484674 - DNA, 25 bp, Mus musculus
tgctcctgtgacaacatcagtggtt

SEQ ID NO: 484675 - DNA, 25 bp, Mus musculus
tgctcctgtggtcgatggataaccc

SEQ ID NO: 484676 - DNA, 25 bp, Mus musculus
tgctccttagcacccattctgctgg

SEQ ID NO: 484677 - DNA, 25 bp, Mus musculus
tgctccttgaaagaagagctctgtc

SEQ ID NO: 484678 - DNA, 25 bp, Mus musculus
tgctccttgggagaagaacctgacc

SEQ ID NO: 484679 - DNA, 25 bp, Mus musculus
tgctcgacctagacaacgatgtgcg

SEQ ID NO: 484680 - DNA, 25 bp, Mus musculus
tgctcgacggagattccaaggccgt

SEQ ID NO: 484681 - DNA, 25 bp, Mus musculus
tgctcgcacagctgataggattagg

SEQ ID NO: 484682 - DNA, 25 bp, Mus musculus
tgctcgcacatggtagacgcaaggt

SEQ ID NO: 484683 - DNA, 25 bp, Mus musculus
tgctcgcaccgccagacagaggtgt

SEQ ID NO: 484684 - DNA, 25 bp, Mus musculus
tgctcgcactgacgctcaacatgga

SEQ ID NO: 484685 - DNA, 25 bp, Mus musculus
tgctcgcactgtgataccatgggag

SEQ ID NO: 484686 - DNA, 25 bp, Mus musculus
tgctcgccgggacgaccactggcat

SEQ ID NO: 484687 - DNA, 25 bp, Mus musculus
tgctcgcctgatctggtgaatcgga

SEQ ID NO: 484688 - DNA, 25 bp, Mus musculus
tgctcgcgttactgaaatctcaaag

SEQ ID NO: 484689 - DNA, 25 bp, Mus musculus
tgctcgctcgcttgtgtacatgcct

SEQ ID NO: 484690 - DNA, 25 bp, Mus musculus
tgctcggaaaatgaaggcgctgctg

SEQ ID NO: 484691 - DNA, 25 bp, Mus musculus
tgctcggagccaaagggagttagac

SEQ ID NO: 484692 - DNA, 25 bp, Mus musculus
tgctcggcagcaaagaggagacctt

SEQ ID NO: 484693 - DNA, 25 bp, Mus musculus
tgctcggccaaacagcatgtctgat

SEQ ID NO: 484694 - DNA, 25 bp, Mus musculus
tgctcggctgctatggcgtgacgct

SEQ ID NO: 484695 - DNA, 25 bp, Mus musculus
tgctcgggcaaagacatgggtaaag

SEQ ID NO: 484696 - DNA, 25 bp, Mus musculus
tgctcggtacccattgacagcctcg

SEQ ID NO: 484697 - DNA, 25 bp, Mus musculus
tgctcgtacagggaagtcagcgcct

SEQ ID NO: 484698 - DNA, 25 bp, Mus musculus
tgctcgtcccagactaggcggagcc

SEQ ID NO: 484699 - DNA, 25 bp, Mus musculus
tgctcgtcgtctgtttagtatggtg

SEQ ID NO: 484700 - DNA, 25 bp, Mus musculus
tgctcgtgttcagtaccagtggtat

SEQ ID NO: 484701 - DNA, 25 bp, Mus musculus
tgctcgttccttggatctgggctgg

SEQ ID NO: 484702 - DNA, 25 bp, Mus musculus
tgctctaagaattcacagggatggt

SEQ ID NO: 484703 - DNA, 25 bp, Mus musculus
tgctctaagcaaaggtcaagggatt

SEQ ID NO: 484704 - DNA, 25 bp, Mus musculus
tgctctacaagagggcacctggaag

SEQ ID NO: 484705 - DNA, 25 bp, Mus musculus
tgctctacagcacacagaatggccg

SEQ ID NO: 484706 - DNA, 25 bp, Mus musculus
tgctctacagtgtaccggacagcgg

SEQ ID NO: 484707 - DNA, 25 bp, Mus musculus
tgctctacgatggagtgggctgcct

SEQ ID NO: 484708 - DNA, 25 bp, Mus musculus
tgctctacgctgaaacaaagtcttc

SEQ ID NO: 484709 - DNA, 25 bp, Mus musculus
tgctctacgtcatggtcaccgggtg

SEQ ID NO: 484710 - DNA, 25 bp, Mus musculus
tgctctactggatcccggtggtgtt

SEQ ID NO: 484711 - DNA, 25 bp, Mus musculus
tgctctactttgaagcctcatctag

SEQ ID NO: 484712 - DNA, 25 bp, Mus musculus
tgctctagaggttcatcagaccctg

SEQ ID NO: 484713 - DNA, 25 bp, Mus musculus
tgctctagagtcaaacttggcaaga

SEQ ID NO: 484714 - DNA, 25 bp, Mus musculus
tgctctagggttcctcaggtgcaga

SEQ ID NO: 484715 - DNA, 25 bp, Mus musculus
tgctctatgaccaggagaacaacgc

SEQ ID NO: 484716 - DNA, 25 bp, Mus musculus
tgctctcagaacagcactctgaggt

SEQ ID NO: 484717 - DNA, 25 bp, Mus musculus
tgctctcagatgtcagaggcggcca

SEQ ID NO: 484718 - DNA, 25 bp, Mus musculus
tgctctcagcaagtggacagtgatc

SEQ ID NO: 484719 - DNA, 25 bp, Mus musculus
tgctctcagctcgaaccacattaag

SEQ ID NO: 484720 - DNA, 25 bp, Mus musculus
tgctctcaggttgacaggtcagaaa

SEQ ID NO: 484721 - DNA, 25 bp, Mus musculus
tgctctcagtcaccaaacagttttg

SEQ ID NO: 484722 - DNA, 25 bp, Mus musculus
tgctctccacaagacagatctaggg

SEQ ID NO: 484723 - DNA, 25 bp, Mus musculus
tgctctccagccagaggaacgacta

SEQ ID NO: 484724 - DNA, 25 bp, Mus musculus
tgctctccatcttcttcctgcgccg

SEQ ID NO: 484725 - DNA, 25 bp, Mus musculus
tgctctcccaggagggattagaccc

SEQ ID NO: 484726 - DNA, 25 bp, Mus musculus
tgctctcccgacatctgcactagtg

SEQ ID NO: 484727 - DNA, 25 bp, Mus musculus
tgctctccggcaggatgaagggccc

SEQ ID NO: 484728 - DNA, 25 bp, Mus musculus
tgctctccgtagtgcgcctggtaga

SEQ ID NO: 484729 - DNA, 25 bp, Mus musculus
tgctctcgggaaacgcagatcctaa

SEQ ID NO: 484730 - DNA, 25 bp, Mus musculus
tgctctctcagttgtgaccatttcc

SEQ ID NO: 484731 - DNA, 25 bp, Mus musculus
tgctctctcctgacaggcatcctgg

SEQ ID NO: 484732 - DNA, 25 bp, Mus musculus
tgctctctgagaatggcgaactgaa

SEQ ID NO: 484733 - DNA, 25 bp, Mus musculus
tgctctctggcacatgatgctcagt

SEQ ID NO: 484734 - DNA, 25 bp, Mus musculus
tgctctgacttaggcaggttcacca

SEQ ID NO: 484735 - DNA, 25 bp, Mus musculus
tgctctgagagcatagaggatgctg

SEQ ID NO: 484736 - DNA, 25 bp, Mus musculus
tgctctgagataagccctgggaacc

SEQ ID NO: 484737 - DNA, 25 bp, Mus musculus
tgctctgagatggtgtctcctagga

SEQ ID NO: 484738 - DNA, 25 bp, Mus musculus
tgctctgaggaggattaccgaccct

SEQ ID NO: 484739 - DNA, 25 bp, Mus musculus
tgctctgcaattatacattcctggg

SEQ ID NO: 484740 - DNA, 25 bp, Mus musculus
tgctctgcagttcgagatgctcaca

SEQ ID NO: 484741 - DNA, 25 bp, Mus musculus
tgctctgccagacagaaaagcaccg

SEQ ID NO: 484742 - DNA, 25 bp, Mus musculus
tgctctgctataacaaaggctgtgg

SEQ ID NO: 484743 - DNA, 25 bp, Mus musculus
tgctctgctgagaaatgcgctggcc

SEQ ID NO: 484744 - DNA, 25 bp, Mus musculus
tgctctgctggacatggaactggac

SEQ ID NO: 484745 - DNA, 25 bp, Mus musculus
tgctctgctgtaggtttggatctcc

SEQ ID NO: 484746 - DNA, 25 bp, Mus musculus
tgctctggagcatgttggtgtctag

SEQ ID NO: 484747 - DNA, 25 bp, Mus musculus
tgctctggatttgaacacaccgggc

SEQ ID NO: 484748 - DNA, 25 bp, Mus musculus
tgctctggcagggtagaaacttcca

SEQ ID NO: 484749 - DNA, 25 bp, Mus musculus
tgctctgggaaatgtgcacgcgcct

SEQ ID NO: 484750 - DNA, 25 bp, Mus musculus
tgctctgggagattcgggattttca

SEQ ID NO: 484751 - DNA, 25 bp, Mus musculus
tgctctgggagtgctggagttcccc

SEQ ID NO: 484752 - DNA, 25 bp, Mus musculus
tgctctgggatccaccggaacatcc

SEQ ID NO: 484753 - DNA, 25 bp, Mus musculus
tgctctgggccatagcccctctgta

SEQ ID NO: 484754 - DNA, 25 bp, Mus musculus
tgctctggtcatcacggtgcaatac

SEQ ID NO: 484755 - DNA, 25 bp, Mus musculus
tgctctgtagggtagaaccaactct

SEQ ID NO: 484756 - DNA, 25 bp, Mus musculus
tgctctgtcacatggaaaactccaa

SEQ ID NO: 484757 - DNA, 25 bp, Mus musculus
tgctctgtcggcaaacaccgtctga

SEQ ID NO: 484758 - DNA, 25 bp, Mus musculus
tgctctgtctctgtttatgtcttgc

SEQ ID NO: 484759 - DNA, 25 bp, Mus musculus
tgctctgtggctgaatatatctgcg

SEQ ID NO: 484760 - DNA, 25 bp, Mus musculus
tgctctgttgccttgggctggcaag

SEQ ID NO: 484761 - DNA, 25 bp, Mus musculus
tgctctgttttcctattaagctcgt

SEQ ID NO: 484762 - DNA, 25 bp, Mus musculus
tgctcttctggagggacccagggac

SEQ ID NO: 484763 - DNA, 25 bp, Mus musculus
tgctcttgcgtaatgtgggcctcct

SEQ ID NO: 484764 - DNA, 25 bp, Mus musculus
tgctcttggcacactctacgcatga

SEQ ID NO: 484765 - DNA, 25 bp, Mus musculus
tgctcttgtgaaaggctgccgctgt

SEQ ID NO: 484766 - DNA, 25 bp, Mus musculus
tgctcttgttgatcagtctataaaa

SEQ ID NO: 484767 - DNA, 25 bp, Mus musculus
tgctctttaccaataatggtcaccg

SEQ ID NO: 484768 - DNA, 25 bp, Mus musculus
tgctctttaccccagtagctatgtg

SEQ ID NO: 484769 - DNA, 25 bp, Mus musculus
tgctctttcaaaaaacggatcccgg

SEQ ID NO: 484770 - DNA, 25 bp, Mus musculus
tgctctttcacaaagatgagggact

SEQ ID NO: 484771 - DNA, 25 bp, Mus musculus
tgctctttgattaccggctggctgg

SEQ ID NO: 484772 - DNA, 25 bp, Mus musculus
tgctgaaaataccacccaacagttt

SEQ ID NO: 484773 - DNA, 25 bp, Mus musculus
tgctgaaaatggaaacacctccgaa

SEQ ID NO: 484774 - DNA, 25 bp, Mus musculus
tgctgaaaccaccaacgctgaactg

SEQ ID NO: 484775 - DNA, 25 bp, Mus musculus
tgctgaaacccggtgtgccttgggc

SEQ ID NO: 484776 - DNA, 25 bp, Mus musculus
tgctgaaactgccacaggtgcttct

SEQ ID NO: 484777 - DNA, 25 bp, Mus musculus
tgctgaaatggagactgtgcactct

SEQ ID NO: 484778 - DNA, 25 bp, Mus musculus
tgctgaaattcgaggtgtgtgccac

SEQ ID NO: 484779 - DNA, 25 bp, Mus musculus
tgctgaaccatcacaaggacctagg

SEQ ID NO: 484780 - DNA, 25 bp, Mus musculus
tgctgaaccgctacgtggaagggaa

SEQ ID NO: 484781 - DNA, 25 bp, Mus musculus
tgctgaacgaagtagtagtggctct

SEQ ID NO: 484782 - DNA, 25 bp, Mus musculus
tgctgaagaacatcccgcatgaggc

SEQ ID NO: 484783 - DNA, 25 bp, Mus musculus
tgctgaagaagactacagaccctgg

SEQ ID NO: 484784 - DNA, 25 bp, Mus musculus
tgctgaagcatgtcagtgatacttc

SEQ ID NO: 484785 - DNA, 25 bp, Mus musculus
tgctgaagctatcccagacacctct

SEQ ID NO: 484786 - DNA, 25 bp, Mus musculus
tgctgaaggcctggagtctaagacc

SEQ ID NO: 484787 - DNA, 25 bp, Mus musculus
tgctgaaggtagtcaaacacccctg

SEQ ID NO: 484788 - DNA, 25 bp, Mus musculus
tgctgaaggtcaccatggctgcaga

SEQ ID NO: 484789 - DNA, 25 bp, Mus musculus
tgctgaaggttctagccgaactggg

SEQ ID NO: 484790 - DNA, 25 bp, Mus musculus
tgctgaagtacaagtgccacacgat

SEQ ID NO: 484791 - DNA, 25 bp, Mus musculus
tgctgaagtacgaccactgtgtggg

SEQ ID NO: 484792 - DNA, 25 bp, Mus musculus
tgctgaagtctaacaagcttctgtg

SEQ ID NO: 484793 - DNA, 25 bp, Mus musculus
tgctgaagtctggaaccatggacct

SEQ ID NO: 484794 - DNA, 25 bp, Mus musculus
tgctgaataaacctggagagccccg

SEQ ID NO: 484795 - DNA, 25 bp, Mus musculus
tgctgaatccccaacaagtagtctg

SEQ ID NO: 484796 - DNA, 25 bp, Mus musculus
tgctgaatctggtgactccaaggat

SEQ ID NO: 484797 - DNA, 25 bp, Mus musculus
tgctgaatgttaaccaaggtgcccc

SEQ ID NO: 484798 - DNA, 25 bp, Mus musculus
tgctgacaatcaagggtcgcctgga

SEQ ID NO: 484799 - DNA, 25 bp, Mus musculus
tgctgacagggaggaggactctcta

SEQ ID NO: 484800 - DNA, 25 bp, Mus musculus
tgctgacatacaagatagaaaaggc

SEQ ID NO: 484801 - DNA, 25 bp, Mus musculus
tgctgacattcctgacgctggagaa

SEQ ID NO: 484802 - DNA, 25 bp, Mus musculus
tgctgaccatatttggacatgcggg

SEQ ID NO: 484803 - DNA, 25 bp, Mus musculus
tgctgaccctcttatcacgtgatgg

SEQ ID NO: 484804 - DNA, 25 bp, Mus musculus
tgctgaccctgcgtgcaaaaatggg

SEQ ID NO: 484805 - DNA, 25 bp, Mus musculus
tgctgacctagagcgggttactgac

SEQ ID NO: 484806 - DNA, 25 bp, Mus musculus
tgctgacgaaccttcatggagcgcc

SEQ ID NO: 484807 - DNA, 25 bp, Mus musculus
tgctgacgacatcaactccagggtg

SEQ ID NO: 484808 - DNA, 25 bp, Mus musculus
tgctgacggcatgtacgaagtctcc

SEQ ID NO: 484809 - DNA, 25 bp, Mus musculus
tgctgacggtcgagcaaggaaatct

SEQ ID NO: 484810 - DNA, 25 bp, Mus musculus
tgctgactgcaaacccacgaattta

SEQ ID NO: 484811 - DNA, 25 bp, Mus musculus
tgctgagaaacgaagaggcgctgaa

SEQ ID NO: 484812 - DNA, 25 bp, Mus musculus
tgctgagaaagctaaagaggcccac

SEQ ID NO: 484813 - DNA, 25 bp, Mus musculus
tgctgagaacatgcgactgggacga

SEQ ID NO: 484814 - DNA, 25 bp, Mus musculus
tgctgagaaccgctactttgaaatg

SEQ ID NO: 484815 - DNA, 25 bp, Mus musculus
tgctgagaagaagaacgcctcggtg

SEQ ID NO: 484816 - DNA, 25 bp, Mus musculus
tgctgagacctcgaaaccagctggg

SEQ ID NO: 484817 - DNA, 25 bp, Mus musculus
tgctgagagcagatggtcacctcca

SEQ ID NO: 484818 - DNA, 25 bp, Mus musculus
tgctgagatagtgggttcgaagtca

SEQ ID NO: 484819 - DNA, 25 bp, Mus musculus
tgctgagcaacgctactagtggcct

SEQ ID NO: 484820 - DNA, 25 bp, Mus musculus
tgctgagcagaagccatcgggagtc

SEQ ID NO: 484821 - DNA, 25 bp, Mus musculus
tgctgagcatagtaacggaaacacg

SEQ ID NO: 484822 - DNA, 25 bp, Mus musculus
tgctgagcatggatctctataactt

SEQ ID NO: 484823 - DNA, 25 bp, Mus musculus
tgctgagccacagcagacaggccaa

SEQ ID NO: 484824 - DNA, 25 bp, Mus musculus
tgctgagccactggccaccgttgta

SEQ ID NO: 484825 - DNA, 25 bp, Mus musculus
tgctgagcccgctaaagccatgtcg

SEQ ID NO: 484826 - DNA, 25 bp, Mus musculus
tgctgagcctttgtcgcggtcgggc

SEQ ID NO: 484827 - DNA, 25 bp, Mus musculus
tgctgagctctgaagaacctctgaa

SEQ ID NO: 484828 - DNA, 25 bp, Mus musculus
tgctgaggacagcaagccactgctt

SEQ ID NO: 484829 - DNA, 25 bp, Mus musculus
tgctgaggcaaagcgcaagatggcc

SEQ ID NO: 484830 - DNA, 25 bp, Mus musculus
tgctgaggttcagaacccttgtttg

SEQ ID NO: 484831 - DNA, 25 bp, Mus musculus
tgctgagtaagacatgggatgctct

SEQ ID NO: 484832 - DNA, 25 bp, Mus musculus
tgctgagtacatcgcgaaaatgacc

SEQ ID NO: 484833 - DNA, 25 bp, Mus musculus
tgctgagtcagaaacaggtatccca

SEQ ID NO: 484834 - DNA, 25 bp, Mus musculus
tgctgagtctcatgagtcttctgac

SEQ ID NO: 484835 - DNA, 25 bp, Mus musculus
tgctgagtgacatcggtaagtccca

SEQ ID NO: 484836 - DNA, 25 bp, Mus musculus
tgctgataagactgtgaaaggccca

SEQ ID NO: 484837 - DNA, 25 bp, Mus musculus
tgctgataagatagcacccacagtg

SEQ ID NO: 484838 - DNA, 25 bp, Mus musculus
tgctgatcaagagtaccaccagaaa

SEQ ID NO: 484839 - DNA, 25 bp, Mus musculus
tgctgatcactgcagccgtcgctga

SEQ ID NO: 484840 - DNA, 25 bp, Mus musculus
tgctgatcatcacccaccgagaggt

SEQ ID NO: 484841 - DNA, 25 bp, Mus musculus
tgctgatccagaagccaaatgggtg

SEQ ID NO: 484842 - DNA, 25 bp, Mus musculus
tgctgatccggcctgtgctgctgct

SEQ ID NO: 484843 - DNA, 25 bp, Mus musculus
tgctgatcctaattctggccatatt

SEQ ID NO: 484844 - DNA, 25 bp, Mus musculus
tgctgatcgcctgctactgaaactg

SEQ ID NO: 484845 - DNA, 25 bp, Mus musculus
tgctgatctgtgcaagcgatgaccg

SEQ ID NO: 484846 - DNA, 25 bp, Mus musculus
tgctgatgcactgccgccgagtgtg

SEQ ID NO: 484847 - DNA, 25 bp, Mus musculus
tgctgatgcagaccattgaccccta

SEQ ID NO: 484848 - DNA, 25 bp, Mus musculus
tgctgatgccacctaagcaccagag

SEQ ID NO: 484849 - DNA, 25 bp, Mus musculus
tgctgatgcctagatgaggcccctg

SEQ ID NO: 484850 - DNA, 25 bp, Mus musculus
tgctgatggaactggaactatagac

SEQ ID NO: 484851 - DNA, 25 bp, Mus musculus
tgctgatggagaacttccgcagggc

SEQ ID NO: 484852 - DNA, 25 bp, Mus musculus
tgctgatgtccatctggtgccccgg

SEQ ID NO: 484853 - DNA, 25 bp, Mus musculus
tgctgattcagtcagagttccccag

SEQ ID NO: 484854 - DNA, 25 bp, Mus musculus
tgctgattgccaacaacagtgtcct

SEQ ID NO: 484855 - DNA, 25 bp, Mus musculus
tgctgattgtccagctcaggctgtt

SEQ ID NO: 484856 - DNA, 25 bp, Mus musculus
tgctgcaaagagaatctgcccagaa

SEQ ID NO: 484857 - DNA, 25 bp, Mus musculus
tgctgcaagactgagaaaggtgaca

SEQ ID NO: 484858 - DNA, 25 bp, Mus musculus
tgctgcacatagtacagatgtgaca

SEQ ID NO: 484859 - DNA, 25 bp, Mus musculus
tgctgcacggcctgcgactttgtca

SEQ ID NO: 484860 - DNA, 25 bp, Mus musculus
tgctgcactcagtacaaaggtgact

SEQ ID NO: 484861 - DNA, 25 bp, Mus musculus
tgctgcagaacaggagtacatatcg

SEQ ID NO: 484862 - DNA, 25 bp, Mus musculus
tgctgcagaacgtgaggccctgttg

SEQ ID NO: 484863 - DNA, 25 bp, Mus musculus
tgctgcagacatgctttcggaacag

SEQ ID NO: 484864 - DNA, 25 bp, Mus musculus
tgctgcagacggctagagaaactgc

SEQ ID NO: 484865 - DNA, 25 bp, Mus musculus
tgctgcagagaaccacatccatgag

SEQ ID NO: 484866 - DNA, 25 bp, Mus musculus
tgctgcagagcaagatcgatgacct

SEQ ID NO: 484867 - DNA, 25 bp, Mus musculus
tgctgcagagcgctaagaacaatct

SEQ ID NO: 484868 - DNA, 25 bp, Mus musculus
tgctgcagagcgtgaaaaattccat

SEQ ID NO: 484869 - DNA, 25 bp, Mus musculus
tgctgcagaggtctttaacaggatt

SEQ ID NO: 484870 - DNA, 25 bp, Mus musculus
tgctgcagcaggaattcttacctgt

SEQ ID NO: 484871 - DNA, 25 bp, Mus musculus
tgctgcagcatgctgttaactgtgg

SEQ ID NO: 484872 - DNA, 25 bp, Mus musculus
tgctgcagccatgtttggaagggac

SEQ ID NO: 484873 - DNA, 25 bp, Mus musculus
tgctgcagccttggtgacccgccag

SEQ ID NO: 484874 - DNA, 25 bp, Mus musculus
tgctgcagctagtccgagagaggct

SEQ ID NO: 484875 - DNA, 25 bp, Mus musculus
tgctgcagtagataccatcgtggcg

SEQ ID NO: 484876 - DNA, 25 bp, Mus musculus
tgctgcagttgtctccacagtgctg

SEQ ID NO: 484877 - DNA, 25 bp, Mus musculus
tgctgcatctccaggcgtgatggtg

SEQ ID NO: 484878 - DNA, 25 bp, Mus musculus
tgctgcatgaagagagaagacctaa

SEQ ID NO: 484879 - DNA, 25 bp, Mus musculus
tgctgcatgctctaccgcggtgatg

SEQ ID NO: 484880 - DNA, 25 bp, Mus musculus
tgctgcatgcttgcaaaccgtgtca

SEQ ID NO: 484881 - DNA, 25 bp, Mus musculus
tgctgccaagcctgctgatgtaagt

SEQ ID NO: 484882 - DNA, 25 bp, Mus musculus
tgctgccaatgctcgaaggccgtgt

SEQ ID NO: 484883 - DNA, 25 bp, Mus musculus
tgctgccacaacagacgttccaggt

SEQ ID NO: 484884 - DNA, 25 bp, Mus musculus
tgctgccacggtgctcagcaggtgc

SEQ ID NO: 484885 - DNA, 25 bp, Mus musculus
tgctgccagccagggtcaagactgt

SEQ ID NO: 484886 - DNA, 25 bp, Mus musculus
tgctgccagctcctctgatcttggg

SEQ ID NO: 484887 - DNA, 25 bp, Mus musculus
tgctgccagctgagagactacctgt

SEQ ID NO: 484888 - DNA, 25 bp, Mus musculus
tgctgcccaggacaaagaggcttgc

SEQ ID NO: 484889 - DNA, 25 bp, Mus musculus
tgctgcccgactgaaggagagctgc

SEQ ID NO: 484890 - DNA, 25 bp, Mus musculus
tgctgccctccgtacactgttgccg

SEQ ID NO: 484891 - DNA, 25 bp, Mus musculus
tgctgccctgaaagtggcaactcgg

SEQ ID NO: 484892 - DNA, 25 bp, Mus musculus
tgctgccctgcaaactgtacctgaa

SEQ ID NO: 484893 - DNA, 25 bp, Mus musculus
tgctgccctgtgaaaactgcggccg

SEQ ID NO: 484894 - DNA, 25 bp, Mus musculus
tgctgccgactggttcgtcttctag

SEQ ID NO: 484895 - DNA, 25 bp, Mus musculus
tgctgccggcctttcggaaacccag

SEQ ID NO: 484896 - DNA, 25 bp, Mus musculus
tgctgccggtcgtgccttcgttgtt

SEQ ID NO: 484897 - DNA, 25 bp, Mus musculus
tgctgccgtgaggttgactgaactc

SEQ ID NO: 484898 - DNA, 25 bp, Mus musculus
tgctgccgttgcctgccatccgagg

SEQ ID NO: 484899 - DNA, 25 bp, Mus musculus
tgctgcctcaagtcttccaggtcta

SEQ ID NO: 484900 - DNA, 25 bp, Mus musculus
tgctgcctccaaagcgcattacatg

SEQ ID NO: 484901 - DNA, 25 bp, Mus musculus
tgctgcctccctacgagaaacgagt

SEQ ID NO: 484902 - DNA, 25 bp, Mus musculus
tgctgcctcttcaaaagtctcttcg

SEQ ID NO: 484903 - DNA, 25 bp, Mus musculus
tgctgcctgcagtcgtctctacatg

SEQ ID NO: 484904 - DNA, 25 bp, Mus musculus
tgctgcctggagaaccgagactatg

SEQ ID NO: 484905 - DNA, 25 bp, Mus musculus
tgctgcctgggagcttgcttcagta

SEQ ID NO: 484906 - DNA, 25 bp, Mus musculus
tgctgcctgtccagaactacacgtg

SEQ ID NO: 484907 - DNA, 25 bp, Mus musculus
tgctgcctgtcggaacgtagcctgg

SEQ ID NO: 484908 - DNA, 25 bp, Mus musculus
tgctgccttttgtcctccgttcttt

SEQ ID NO: 484909 - DNA, 25 bp, Mus musculus
tgctgcgagcctttagctacatggg

SEQ ID NO: 484910 - DNA, 25 bp, Mus musculus
tgctgcgagtgcaaaaccaacctct

SEQ ID NO: 484911 - DNA, 25 bp, Mus musculus
tgctgcgcaggctatgaagttgtct

SEQ ID NO: 484912 - DNA, 25 bp, Mus musculus
tgctgcgcagggagatttcgaagct

SEQ ID NO: 484913 - DNA, 25 bp, Mus musculus
tgctgcgccatgaaaacatccttgg

SEQ ID NO: 484914 - DNA, 25 bp, Mus musculus
tgctgcgcgaaagcatccaggtgct

SEQ ID NO: 484915 - DNA, 25 bp, Mus musculus
tgctgcgggcccaagagttagtgct

SEQ ID NO: 484916 - DNA, 25 bp, Mus musculus
tgctgctaaaaatgcaggctcgcgg

SEQ ID NO: 484917 - DNA, 25 bp, Mus musculus
tgctgctaaagtggcgctcatcaac

SEQ ID NO: 484918 - DNA, 25 bp, Mus musculus
tgctgctaaggctggtacagctggc

SEQ ID NO: 484919 - DNA, 25 bp, Mus musculus
tgctgctagcctggaaagagcctct

SEQ ID NO: 484920 - DNA, 25 bp, Mus musculus
tgctgctatgcatggtgcctgctgc

SEQ ID NO: 484921 - DNA, 25 bp, Mus musculus
tgctgctcataatcgcgcgagtcag

SEQ ID NO: 484922 - DNA, 25 bp, Mus musculus
tgctgctcatagctgtccctgtcag

SEQ ID NO: 484923 - DNA, 25 bp, Mus musculus
tgctgctccgagaagtgggaatcct

SEQ ID NO: 484924 - DNA, 25 bp, Mus musculus
tgctgctcctaaaactgatgagtgc

SEQ ID NO: 484925 - DNA, 25 bp, Mus musculus
tgctgctcctaaagctctacccggt

SEQ ID NO: 484926 - DNA, 25 bp, Mus musculus
tgctgctcctttttctctatattaa

SEQ ID NO: 484927 - DNA, 25 bp, Mus musculus
tgctgctcgagtagggctgcttcca

SEQ ID NO: 484928 - DNA, 25 bp, Mus musculus
tgctgctctgcgaacgcatctcggt

SEQ ID NO: 484929 - DNA, 25 bp, Mus musculus
tgctgctctgctggaaatactgtgc

SEQ ID NO: 484930 - DNA, 25 bp, Mus musculus
tgctgctgaatgaaccctgaggcca

SEQ ID NO: 484931 - DNA, 25 bp, Mus musculus
tgctgctgacagaccttacattgct

SEQ ID NO: 484932 - DNA, 25 bp, Mus musculus
tgctgctgaccaaagaggatttccg

SEQ ID NO: 484933 - DNA, 25 bp, Mus musculus
tgctgctgaccttgaatcgttgcca

SEQ ID NO: 484934 - DNA, 25 bp, Mus musculus
tgctgctgagtgtatcgaggatcct

SEQ ID NO: 484935 - DNA, 25 bp, Mus musculus
tgctgctgatacacaggctccgtcg

SEQ ID NO: 484936 - DNA, 25 bp, Mus musculus
tgctgctgatcagggcccttgcact

SEQ ID NO: 484937 - DNA, 25 bp, Mus musculus
tgctgctgcactgcctggtgcgtca

SEQ ID NO: 484938 - DNA, 25 bp, Mus musculus
tgctgctgcacttacccggatgaga

SEQ ID NO: 484939 - DNA, 25 bp, Mus musculus
tgctgctgcagtagtctaaagcttt

SEQ ID NO: 484940 - DNA, 25 bp, Mus musculus
tgctgctgccaagtgtcgaaacaag

SEQ ID NO: 484941 - DNA, 25 bp, Mus musculus
tgctgctgcctgagaccaagaactt

SEQ ID NO: 484942 - DNA, 25 bp, Mus musculus
tgctgctgctagacagaagggtgtt

SEQ ID NO: 484943 - DNA, 25 bp, Mus musculus
tgctgctggaagcaaccaggtgacc

SEQ ID NO: 484944 - DNA, 25 bp, Mus musculus
tgctgctggtacgtagactgtttaa

SEQ ID NO: 484945 - DNA, 25 bp, Mus musculus
tgctgctgtagtggcgatacgtccc

SEQ ID NO: 484946 - DNA, 25 bp, Mus musculus
tgctgctgtcaccatggacctggcg

SEQ ID NO: 484947 - DNA, 25 bp, Mus musculus
tgctgctgtcataccctggaccaag

SEQ ID NO: 484948 - DNA, 25 bp, Mus musculus
tgctgctgttgctacgccagggcca

SEQ ID NO: 484949 - DNA, 25 bp, Mus musculus
tgctgctgtttagcgggaagagaaa

SEQ ID NO: 484950 - DNA, 25 bp, Mus musculus
tgctgcttaccaaaccccaaagtgg

SEQ ID NO: 484951 - DNA, 25 bp, Mus musculus
tgctgcttccttgctgactgcacgg

SEQ ID NO: 484952 - DNA, 25 bp, Mus musculus
tgctgcttgaagtcagaactgctga

SEQ ID NO: 484953 - DNA, 25 bp, Mus musculus
tgctgcttgcagaaattaggccttt

SEQ ID NO: 484954 - DNA, 25 bp, Mus musculus
tgctgcttgtgctgaagtgtatgcg

SEQ ID NO: 484955 - DNA, 25 bp, Mus musculus
tgctggaaaagctctatcgaaaccg

SEQ ID NO: 484956 - DNA, 25 bp, Mus musculus
tgctggaaagataggtgcatcctat

SEQ ID NO: 484957 - DNA, 25 bp, Mus musculus
tgctggaaccacaggttggcatggc

SEQ ID NO: 484958 - DNA, 25 bp, Mus musculus
tgctggaactgagaccacaagcgcc

SEQ ID NO: 484959 - DNA, 25 bp, Mus musculus
tgctggaagagaagacagcccttca

SEQ ID NO: 484960 - DNA, 25 bp, Mus musculus
tgctggacaacctgaacgtgcggga

SEQ ID NO: 484961 - DNA, 25 bp, Mus musculus
tgctggacagctacgtgaagattgg

SEQ ID NO: 484962 - DNA, 25 bp, Mus musculus
tgctggacattgaagactgcgacct

SEQ ID NO: 484963 - DNA, 25 bp, Mus musculus
tgctggacccttcgtgagaactggc

SEQ ID NO: 484964 - DNA, 25 bp, Mus musculus
tgctggaccgcgtgtttgagagaca

SEQ ID NO: 484965 - DNA, 25 bp, Mus musculus
tgctggactaccacttcgaggaggt

SEQ ID NO: 484966 - DNA, 25 bp, Mus musculus
tgctggactccgtgcaaaagatgca

SEQ ID NO: 484967 - DNA, 25 bp, Mus musculus
tgctggactctcagacctattattc

SEQ ID NO: 484968 - DNA, 25 bp, Mus musculus
tgctggacttagagcagccggtgct

SEQ ID NO: 484969 - DNA, 25 bp, Mus musculus
tgctggagaaggttgcagccactca

SEQ ID NO: 484970 - DNA, 25 bp, Mus musculus
tgctggagacagctctgacacgtgt

SEQ ID NO: 484971 - DNA, 25 bp, Mus musculus
tgctggagatgtatggccggaaccc

SEQ ID NO: 484972 - DNA, 25 bp, Mus musculus
tgctggagcaagactcaagaaaatc

SEQ ID NO: 484973 - DNA, 25 bp, Mus musculus
tgctggagcccgaaaagcaagagag

SEQ ID NO: 484974 - DNA, 25 bp, Mus musculus
tgctggaggccaagaggatctaaac

SEQ ID NO: 484975 - DNA, 25 bp, Mus musculus
tgctggaggccatctgtaaacactg

SEQ ID NO: 484976 - DNA, 25 bp, Mus musculus
tgctggagggccaagaaaatccact

SEQ ID NO: 484977 - DNA, 25 bp, Mus musculus
tgctggaggtcatgctggagtacac

SEQ ID NO: 484978 - DNA, 25 bp, Mus musculus
tgctggagtcctcttcagaaaaggc

SEQ ID NO: 484979 - DNA, 25 bp, Mus musculus
tgctggagtcggattgcccgtcacc

SEQ ID NO: 484980 - DNA, 25 bp, Mus musculus
tgctggatcgttaactttcccgtgg

SEQ ID NO: 484981 - DNA, 25 bp, Mus musculus
tgctggatctgccaccaagagcttc

SEQ ID NO: 484982 - DNA, 25 bp, Mus musculus
tgctggatgaaagcagcgcgtctgt

SEQ ID NO: 484983 - DNA, 25 bp, Mus musculus
tgctggatgcattgagcgccttatc

SEQ ID NO: 484984 - DNA, 25 bp, Mus musculus
tgctggatgtcaagcggaaggctcc

SEQ ID NO: 484985 - DNA, 25 bp, Mus musculus
tgctggatgtccacaacccgaagga

SEQ ID NO: 484986 - DNA, 25 bp, Mus musculus
tgctggatgtttctcactgttgtgc

SEQ ID NO: 484987 - DNA, 25 bp, Mus musculus
tgctggattccaattgtgctctacc

SEQ ID NO: 484988 - DNA, 25 bp, Mus musculus
tgctggcaaagggaaaatccgtttt

SEQ ID NO: 484989 - DNA, 25 bp, Mus musculus
tgctggcaccagactcttcaggttg

SEQ ID NO: 484990 - DNA, 25 bp, Mus musculus
tgctggcactcatggcgattctgta

SEQ ID NO: 484991 - DNA, 25 bp, Mus musculus
tgctggcacttgtgagtcctagggc

SEQ ID NO: 484992 - DNA, 25 bp, Mus musculus
tgctggccaagactccgatctcggg

SEQ ID NO: 484993 - DNA, 25 bp, Mus musculus
tgctggccaccacctgtaaggaccg

SEQ ID NO: 484994 - DNA, 25 bp, Mus musculus
tgctggccagctgacagatacacaa

SEQ ID NO: 484995 - DNA, 25 bp, Mus musculus
tgctggccatcggactcctgcatgt

SEQ ID NO: 484996 - DNA, 25 bp, Mus musculus
tgctggccccgcttatgcagaatgg

SEQ ID NO: 484997 - DNA, 25 bp, Mus musculus
tgctggccgctcaatggaccgattt

SEQ ID NO: 484998 - DNA, 25 bp, Mus musculus
tgctggccggcatcatgaaccgcaa

SEQ ID NO: 484999 - DNA, 25 bp, Mus musculus
tgctggccgttttgaggattcttcc

SEQ ID NO: 485000 - DNA, 25 bp, Mus musculus
tgctggcctacacggactagagacc

SEQ ID NO: 485001 - DNA, 25 bp, Mus musculus
tgctggcgacttagaagaaagcagc

SEQ ID NO: 485002 - DNA, 25 bp, Mus musculus
tgctggcgctcggaatcctggagac

SEQ ID NO: 485003 - DNA, 25 bp, Mus musculus
tgctggcgtagcaggaagtctgacc

SEQ ID NO: 485004 - DNA, 25 bp, Mus musculus
tgctggctccagaagtcaagaggcc

SEQ ID NO: 485005 - DNA, 25 bp, Mus musculus
tgctggctccgatgaacaaggccgg

SEQ ID NO: 485006 - DNA, 25 bp, Mus musculus
tgctggctcctaagcaggttggcca

SEQ ID NO: 485007 - DNA, 25 bp, Mus musculus
tgctggctgatatcttccttatagg

SEQ ID NO: 485008 - DNA, 25 bp, Mus musculus
tgctggctgattttgggccccacgg

SEQ ID NO: 485009 - DNA, 25 bp, Mus musculus
tgctggctgcctctcagcgtttggc

SEQ ID NO: 485010 - DNA, 25 bp, Mus musculus
tgctggctggtagcgtcactatgct

SEQ ID NO: 485011 - DNA, 25 bp, Mus musculus
tgctggctgtggtctcgagcaatcc

SEQ ID NO: 485012 - DNA, 25 bp, Mus musculus
tgctggcttccttgggtgcttgcca

SEQ ID NO: 485013 - DNA, 25 bp, Mus musculus
tgctggcttggtggcaactgtatca

SEQ ID NO: 485014 - DNA, 25 bp, Mus musculus
tgctggcttggttgcgggtactact

SEQ ID NO: 485015 - DNA, 25 bp, Mus musculus
tgctgggaaccgaaaacgcttccgt

SEQ ID NO: 485016 - DNA, 25 bp, Mus musculus
tgctgggacgacatgcaacggctct

SEQ ID NO: 485017 - DNA, 25 bp, Mus musculus
tgctgggagagaaagtccactgagt

SEQ ID NO: 485018 - DNA, 25 bp, Mus musculus
tgctgggagcacatattctaggacc

SEQ ID NO: 485019 - DNA, 25 bp, Mus musculus
tgctgggagcacttacctactactg

SEQ ID NO: 485020 - DNA, 25 bp, Mus musculus
tgctgggatgaaagccatgcgctcc

SEQ ID NO: 485021 - DNA, 25 bp, Mus musculus
tgctgggattatcgccacatctggc

SEQ ID NO: 485022 - DNA, 25 bp, Mus musculus
tgctgggattgacgttcgtctctgc

SEQ ID NO: 485023 - DNA, 25 bp, Mus musculus
tgctgggccagtgaagacaatcaac

SEQ ID NO: 485024 - DNA, 25 bp, Mus musculus
tgctgggccctataccagacaggct

SEQ ID NO: 485025 - DNA, 25 bp, Mus musculus
tgctgggcctcaccgggataagaaa

SEQ ID NO: 485026 - DNA, 25 bp, Mus musculus
tgctgggcctgatccttgttgcgct

SEQ ID NO: 485027 - DNA, 25 bp, Mus musculus
tgctgggcctgatgcacgagtgcaa

SEQ ID NO: 485028 - DNA, 25 bp, Mus musculus
tgctgggctgagaatactggcgctc

SEQ ID NO: 485029 - DNA, 25 bp, Mus musculus
tgctgggcttcgaggagttcgacaa

SEQ ID NO: 485030 - DNA, 25 bp, Mus musculus
tgctgggtgtacaatcaagcgcctc

SEQ ID NO: 485031 - DNA, 25 bp, Mus musculus
tgctgggttacaccaattcggaagg

SEQ ID NO: 485032 - DNA, 25 bp, Mus musculus
tgctgggttgaggtagggtgctttc

SEQ ID NO: 485033 - DNA, 25 bp, Mus musculus
tgctgggttggatactaagacatgt

SEQ ID NO: 485034 - DNA, 25 bp, Mus musculus
tgctggtaacggaattggtgctcac

SEQ ID NO: 485035 - DNA, 25 bp, Mus musculus
tgctggtaactctgcagaaaaattt

SEQ ID NO: 485036 - DNA, 25 bp, Mus musculus
tgctggtaactgacacacaactgga

SEQ ID NO: 485037 - DNA, 25 bp, Mus musculus
tgctggtacccagtgaagcccttgg

SEQ ID NO: 485038 - DNA, 25 bp, Mus musculus
tgctggtatcagaaaagcaactgag

SEQ ID NO: 485039 - DNA, 25 bp, Mus musculus
tgctggtcaacaggagtcgctccct

SEQ ID NO: 485040 - DNA, 25 bp, Mus musculus
tgctggtcagaagccataataaagc

SEQ ID NO: 485041 - DNA, 25 bp, Mus musculus
tgctggtcctaatcactcctgctga

SEQ ID NO: 485042 - DNA, 25 bp, Mus musculus
tgctggtctgagtttgtatgcacct

SEQ ID NO: 485043 - DNA, 25 bp, Mus musculus
tgctggtcttcttcctcatgggcct

SEQ ID NO: 485044 - DNA, 25 bp, Mus musculus
tgctggtgaactacgccaaggacgc

SEQ ID NO: 485045 - DNA, 25 bp, Mus musculus
tgctggtgacctacaaatcgggatc

SEQ ID NO: 485046 - DNA, 25 bp, Mus musculus
tgctggtgcgcggtgcgctgcgctg

SEQ ID NO: 485047 - DNA, 25 bp, Mus musculus
tgctggtggtgctcatcccggtgct

SEQ ID NO: 485048 - DNA, 25 bp, Mus musculus
tgctggtgtccaaatgaggctgtgc

SEQ ID NO: 485049 - DNA, 25 bp, Mus musculus
tgctggtgtgccaatcagggatcct

SEQ ID NO: 485050 - DNA, 25 bp, Mus musculus
tgctggtgtgccttgaagtctcaaa

SEQ ID NO: 485051 - DNA, 25 bp, Mus musculus
tgctggttccatcttctaagtctca

SEQ ID NO: 485052 - DNA, 25 bp, Mus musculus
tgctggtttaagtgcccatcttggc

SEQ ID NO: 485053 - DNA, 25 bp, Mus musculus
tgctgtaaaaggtccttccaaggac

SEQ ID NO: 485054 - DNA, 25 bp, Mus musculus
tgctgtaagagaataccaatccagg

SEQ ID NO: 485055 - DNA, 25 bp, Mus musculus
tgctgtaataccattcctgagtaaa

SEQ ID NO: 485056 - DNA, 25 bp, Mus musculus
tgctgtacactcaatgccatgaggg

SEQ ID NO: 485057 - DNA, 25 bp, Mus musculus
tgctgtacactggactattcgaggg

SEQ ID NO: 485058 - DNA, 25 bp, Mus musculus
tgctgtacagcagaagagctccctg

SEQ ID NO: 485059 - DNA, 25 bp, Mus musculus
tgctgtacccggacgtgaggctgct

SEQ ID NO: 485060 - DNA, 25 bp, Mus musculus
tgctgtacctgcttatagtcactgc

SEQ ID NO: 485061 - DNA, 25 bp, Mus musculus
tgctgtacgcgtggaatgacctagg

SEQ ID NO: 485062 - DNA, 25 bp, Mus musculus
tgctgtagaccagcttcgaactggg

SEQ ID NO: 485063 - DNA, 25 bp, Mus musculus
tgctgtagagccagtgggcccttta

SEQ ID NO: 485064 - DNA, 25 bp, Mus musculus
tgctgtagtcttgtgagatgtcccc

SEQ ID NO: 485065 - DNA, 25 bp, Mus musculus
tgctgtagtgaggaagcacttctgc

SEQ ID NO: 485066 - DNA, 25 bp, Mus musculus
tgctgtatggactgtctgccctggg

SEQ ID NO: 485067 - DNA, 25 bp, Mus musculus
tgctgtattacagggctacacccca

SEQ ID NO: 485068 - DNA, 25 bp, Mus musculus
tgctgtattgctgacctgggcctag

SEQ ID NO: 485069 - DNA, 25 bp, Mus musculus
tgctgtcaaacttgctcatgtggga

SEQ ID NO: 485070 - DNA, 25 bp, Mus musculus
tgctgtcacacaaggagagccctgg

SEQ ID NO: 485071 - DNA, 25 bp, Mus musculus
tgctgtcaccggtctcaactggctg

SEQ ID NO: 485072 - DNA, 25 bp, Mus musculus
tgctgtcagaaatgcaggctaccac

SEQ ID NO: 485073 - DNA, 25 bp, Mus musculus
tgctgtcagccaatgcgactgtgaa

SEQ ID NO: 485074 - DNA, 25 bp, Mus musculus
tgctgtcagccctcaccaatgtggt

SEQ ID NO: 485075 - DNA, 25 bp, Mus musculus
tgctgtcatctacttgggcaacaaa

SEQ ID NO: 485076 - DNA, 25 bp, Mus musculus
tgctgtccacctagtgttaccacta

SEQ ID NO: 485077 - DNA, 25 bp, Mus musculus
tgctgtccagtctcataaagaggac

SEQ ID NO: 485078 - DNA, 25 bp, Mus musculus
tgctgtcccagaagtaggcgagccg

SEQ ID NO: 485079 - DNA, 25 bp, Mus musculus
tgctgtcccctgaagagaactgtgg

SEQ ID NO: 485080 - DNA, 25 bp, Mus musculus
tgctgtccggcctgggcatgatgac

SEQ ID NO: 485081 - DNA, 25 bp, Mus musculus
tgctgtccttcacgcacttctggaa

SEQ ID NO: 485082 - DNA, 25 bp, Mus musculus
tgctgtcgcagatcatggagaaccc

SEQ ID NO: 485083 - DNA, 25 bp, Mus musculus
tgctgtcgccagaagacgtgttcct

SEQ ID NO: 485084 - DNA, 25 bp, Mus musculus
tgctgtcggagctgagagccgtatt

SEQ ID NO: 485085 - DNA, 25 bp, Mus musculus
tgctgtcgggctctacactcttcgg

SEQ ID NO: 485086 - DNA, 25 bp, Mus musculus
tgctgtctccaagccctgaaggtga

SEQ ID NO: 485087 - DNA, 25 bp, Mus musculus
tgctgtctcgggacatggcaggcta

SEQ ID NO: 485088 - DNA, 25 bp, Mus musculus
tgctgtctgccggtttaagttgtgt

SEQ ID NO: 485089 - DNA, 25 bp, Mus musculus
tgctgtctgggttccgagaaccctg

SEQ ID NO: 485090 - DNA, 25 bp, Mus musculus
tgctgtctttccacctggacttggg

SEQ ID NO: 485091 - DNA, 25 bp, Mus musculus
tgctgtgaaacccacaaatactggg

SEQ ID NO: 485092 - DNA, 25 bp, Mus musculus
tgctgtgaaccccatcgagagtctg

SEQ ID NO: 485093 - DNA, 25 bp, Mus musculus
tgctgtgaagtatgccgagaaccgc

SEQ ID NO: 485094 - DNA, 25 bp, Mus musculus
tgctgtgatgatgcaaggaccctgc

SEQ ID NO: 485095 - DNA, 25 bp, Mus musculus
tgctgtgcacccaccaaactgagtg

SEQ ID NO: 485096 - DNA, 25 bp, Mus musculus
tgctgtgcaggttggtaggaagcct

SEQ ID NO: 485097 - DNA, 25 bp, Mus musculus
tgctgtgccagcctttgactacatt

SEQ ID NO: 485098 - DNA, 25 bp, Mus musculus
tgctgtgccagtatcggaacatcgg

SEQ ID NO: 485099 - DNA, 25 bp, Mus musculus
tgctgtgcccggtgttgccgtcctg

SEQ ID NO: 485100 - DNA, 25 bp, Mus musculus
tgctgtgccgactaacattcaagga

SEQ ID NO: 485101 - DNA, 25 bp, Mus musculus
tgctgtgcctgcagtactgtctttc

SEQ ID NO: 485102 - DNA, 25 bp, Mus musculus
tgctgtgcgcctttcccaagctggc

SEQ ID NO: 485103 - DNA, 25 bp, Mus musculus
tgctgtgcggaaactactcattgaa

SEQ ID NO: 485104 - DNA, 25 bp, Mus musculus
tgctgtgcggctgcgacgaagctgg

SEQ ID NO: 485105 - DNA, 25 bp, Mus musculus
tgctgtgcgtgaacgccatcgccgt

SEQ ID NO: 485106 - DNA, 25 bp, Mus musculus
tgctgtgcgtgctgaggattgaact

SEQ ID NO: 485107 - DNA, 25 bp, Mus musculus
tgctgtgggtccagagagtactgac

SEQ ID NO: 485108 - DNA, 25 bp, Mus musculus
tgctgtggtcgcatacactgccgag

SEQ ID NO: 485109 - DNA, 25 bp, Mus musculus
tgctgtggtgacttcctcccttgtg

SEQ ID NO: 485110 - DNA, 25 bp, Mus musculus
tgctgtggtggccttgctactgcac

SEQ ID NO: 485111 - DNA, 25 bp, Mus musculus
tgctgtgtcatgatgcgctgcccct

SEQ ID NO: 485112 - DNA, 25 bp, Mus musculus
tgctgtgtcccaagaaaggcggagc

SEQ ID NO: 485113 - DNA, 25 bp, Mus musculus
tgctgtgtcccacaaacattctgat

SEQ ID NO: 485114 - DNA, 25 bp, Mus musculus
tgctgtgtgaccctttggcgatctc

SEQ ID NO: 485115 - DNA, 25 bp, Mus musculus
tgctgtgttatgtgagtctgcgtac

SEQ ID NO: 485116 - DNA, 25 bp, Mus musculus
tgctgttagaacacccctgagagag

SEQ ID NO: 485117 - DNA, 25 bp, Mus musculus
tgctgttagcctggatcttcgcggg

SEQ ID NO: 485118 - DNA, 25 bp, Mus musculus
tgctgttatgggtgaaactctggga

SEQ ID NO: 485119 - DNA, 25 bp, Mus musculus
tgctgttcacttttgggtccaggaa

SEQ ID NO: 485120 - DNA, 25 bp, Mus musculus
tgctgttcagagaggagctcggatc

SEQ ID NO: 485121 - DNA, 25 bp, Mus musculus
tgctgttcatgtgttacggcttctg

SEQ ID NO: 485122 - DNA, 25 bp, Mus musculus
tgctgttcctggtcccacgagtgga

SEQ ID NO: 485123 - DNA, 25 bp, Mus musculus
tgctgttctcatggatgccctcaac

SEQ ID NO: 485124 - DNA, 25 bp, Mus musculus
tgctgttcttcattcacggagtcgg

SEQ ID NO: 485125 - DNA, 25 bp, Mus musculus
tgctgttgaagaacgtgcggcatcc

SEQ ID NO: 485126 - DNA, 25 bp, Mus musculus
tgctgttgatgagaccacgttcggg

SEQ ID NO: 485127 - DNA, 25 bp, Mus musculus
tgctgttgccaagacagagattgct

SEQ ID NO: 485128 - DNA, 25 bp, Mus musculus
tgctgttgccctgactgatgagcct

SEQ ID NO: 485129 - DNA, 25 bp, Mus musculus
tgctgttgcggctgcttcaggcacc

SEQ ID NO: 485130 - DNA, 25 bp, Mus musculus
tgctgttggcaaatcaagcctggtt

SEQ ID NO: 485131 - DNA, 25 bp, Mus musculus
tgctgttggccgacaaagtgcctga

SEQ ID NO: 485132 - DNA, 25 bp, Mus musculus
tgctgttggcgctctttgcctccgg

SEQ ID NO: 485133 - DNA, 25 bp, Mus musculus
tgctgttgtcctcctgcgctctttc

SEQ ID NO: 485134 - DNA, 25 bp, Mus musculus
tgctgttgtcctggtcctcgaaccg

SEQ ID NO: 485135 - DNA, 25 bp, Mus musculus
tgctgttgtgcaccctggacctatt

SEQ ID NO: 485136 - DNA, 25 bp, Mus musculus
tgctgtttcaggacaagaatccttg

SEQ ID NO: 485137 - DNA, 25 bp, Mus musculus
tgctgtttccactcacatgggtccc

SEQ ID NO: 485138 - DNA, 25 bp, Mus musculus
tgctgtttgagtgagtaatagcctc

SEQ ID NO: 485139 - DNA, 25 bp, Mus musculus
tgctgtttggtcagaagacggctgc

SEQ ID NO: 485140 - DNA, 25 bp, Mus musculus
tgctgttttcagtggctgctccaga

SEQ ID NO: 485141 - DNA, 25 bp, Mus musculus
tgcttaaaaagattacccatagggt

SEQ ID NO: 485142 - DNA, 25 bp, Mus musculus
tgcttaaagacgaaatgcagccgcc

SEQ ID NO: 485143 - DNA, 25 bp, Mus musculus
tgcttaaagttcagctccaggaagc

SEQ ID NO: 485144 - DNA, 25 bp, Mus musculus
tgcttaaggctggatcataaaggct

SEQ ID NO: 485145 - DNA, 25 bp, Mus musculus
tgcttaagggcttgccaattcaggc

SEQ ID NO: 485146 - DNA, 25 bp, Mus musculus
tgcttacaatgtgaactcgtcccag

SEQ ID NO: 485147 - DNA, 25 bp, Mus musculus
tgcttaccgttttgcttcgaaaact

SEQ ID NO: 485148 - DNA, 25 bp, Mus musculus
tgcttactcaacacctcatcttggg

SEQ ID NO: 485149 - DNA, 25 bp, Mus musculus
tgcttactcgttgactggaccactg

SEQ ID NO: 485150 - DNA, 25 bp, Mus musculus
tgcttacttaaaacagagtttcagc

SEQ ID NO: 485151 - DNA, 25 bp, Mus musculus
tgcttagaaggacacttggcgatcg

SEQ ID NO: 485152 - DNA, 25 bp, Mus musculus
tgcttagagtacacgtgggccaggt

SEQ ID NO: 485153 - DNA, 25 bp, Mus musculus
tgcttagataatccatgtcttttaa

SEQ ID NO: 485154 - DNA, 25 bp, Mus musculus
tgcttaggtttgacagttcggcccc

SEQ ID NO: 485155 - DNA, 25 bp, Mus musculus
tgcttatcatggagcggctacaccg

SEQ ID NO: 485156 - DNA, 25 bp, Mus musculus
tgcttatctccaagaggctgccggc

SEQ ID NO: 485157 - DNA, 25 bp, Mus musculus
tgcttatctgccattctcaggagga

SEQ ID NO: 485158 - DNA, 25 bp, Mus musculus
tgcttatgacttcccagaagaactg

SEQ ID NO: 485159 - DNA, 25 bp, Mus musculus
tgcttatgagcagaggatcgagcct

SEQ ID NO: 485160 - DNA, 25 bp, Mus musculus
tgcttatggaacacagacggtgccc

SEQ ID NO: 485161 - DNA, 25 bp, Mus musculus
tgcttatggccacgcatcctgttgg

SEQ ID NO: 485162 - DNA, 25 bp, Mus musculus
tgcttatggtactgaaggtgtgcac

SEQ ID NO: 485163 - DNA, 25 bp, Mus musculus
tgcttcacactaatggaatcctaga

SEQ ID NO: 485164 - DNA, 25 bp, Mus musculus
tgcttcaccaacctcatggctgaga

SEQ ID NO: 485165 - DNA, 25 bp, Mus musculus
tgcttcagccttcaaagggccctat

SEQ ID NO: 485166 - DNA, 25 bp, Mus musculus
tgcttcaggctagaaccttctgtcc

SEQ ID NO: 485167 - DNA, 25 bp, Mus musculus
tgcttcagttacagcgtccccaaca

SEQ ID NO: 485168 - DNA, 25 bp, Mus musculus
tgcttcatagagagggaacgcccaa

SEQ ID NO: 485169 - DNA, 25 bp, Mus musculus
tgcttcatgagcagaggacgtaccc

SEQ ID NO: 485170 - DNA, 25 bp, Mus musculus
tgcttccagccttgcgcctggagac

SEQ ID NO: 485171 - DNA, 25 bp, Mus musculus
tgcttccaggcatcagcggcagtag

SEQ ID NO: 485172 - DNA, 25 bp, Mus musculus
tgcttccatggaaaagggtgactga

SEQ ID NO: 485173 - DNA, 25 bp, Mus musculus
tgcttcccgtggacagttaccagcc

SEQ ID NO: 485174 - DNA, 25 bp, Mus musculus
tgcttccctggccaaaagatgctaa

SEQ ID NO: 485175 - DNA, 25 bp, Mus musculus
tgcttccgaacggtcttagaactgg

SEQ ID NO: 485176 - DNA, 25 bp, Mus musculus
tgcttccgcctctcgagtgatggga

SEQ ID NO: 485177 - DNA, 25 bp, Mus musculus
tgcttccgcggagaagacaaaggaa

SEQ ID NO: 485178 - DNA, 25 bp, Mus musculus
tgcttcctctattaaccaagagttg

SEQ ID NO: 485179 - DNA, 25 bp, Mus musculus
tgcttcctggttaatgttcttccgt

SEQ ID NO: 485180 - DNA, 25 bp, Mus musculus
tgcttcgaaggtggcgatggctcct

SEQ ID NO: 485181 - DNA, 25 bp, Mus musculus
tgcttcgagtcttcatccagaaacg

SEQ ID NO: 485182 - DNA, 25 bp, Mus musculus
tgcttcgcatgctgttaggctgact

SEQ ID NO: 485183 - DNA, 25 bp, Mus musculus
tgcttcggcggctcggctcgtcttg

SEQ ID NO: 485184 - DNA, 25 bp, Mus musculus
tgcttcggctccatgaacggtggtg

SEQ ID NO: 485185 - DNA, 25 bp, Mus musculus
tgcttcgtcagtgatgatgggcccc

SEQ ID NO: 485186 - DNA, 25 bp, Mus musculus
tgcttcgtgaaggtgccacgtgaga

SEQ ID NO: 485187 - DNA, 25 bp, Mus musculus
tgcttctacagatgagcgggccaag

SEQ ID NO: 485188 - DNA, 25 bp, Mus musculus
tgcttctacggatcggaggaggttt

SEQ ID NO: 485189 - DNA, 25 bp, Mus musculus
tgcttctcaggatcaggccactcaa

SEQ ID NO: 485190 - DNA, 25 bp, Mus musculus
tgcttctccgctcggcagaacaaga

SEQ ID NO: 485191 - DNA, 25 bp, Mus musculus
tgcttctctccctccagctgattga

SEQ ID NO: 485192 - DNA, 25 bp, Mus musculus
tgcttctgaactgggtgcttaagga

SEQ ID NO: 485193 - DNA, 25 bp, Mus musculus
tgcttctgagctatggcagccagcg

SEQ ID NO: 485194 - DNA, 25 bp, Mus musculus
tgcttctggagattagtgaccggct

SEQ ID NO: 485195 - DNA, 25 bp, Mus musculus
tgcttctgggtcactgcacggctct

SEQ ID NO: 485196 - DNA, 25 bp, Mus musculus
tgcttctgggttccgccagcgcgta

SEQ ID NO: 485197 - DNA, 25 bp, Mus musculus
tgcttctgtttttcccgaggaaagc

SEQ ID NO: 485198 - DNA, 25 bp, Mus musculus
tgcttcttagggactctgctgatga

SEQ ID NO: 485199 - DNA, 25 bp, Mus musculus
tgcttcttctgtggcgtaaggacat

SEQ ID NO: 485200 - DNA, 25 bp, Mus musculus
tgcttcttctttttaagagagtgcc

SEQ ID NO: 485201 - DNA, 25 bp, Mus musculus
tgcttcttgtagctcggttgacatg

SEQ ID NO: 485202 - DNA, 25 bp, Mus musculus
tgcttgaaaaacacaacccgtggcc

SEQ ID NO: 485203 - DNA, 25 bp, Mus musculus
tgcttgaagactgaaaacctgtgcc

SEQ ID NO: 485204 - DNA, 25 bp, Mus musculus
tgcttgacagccactatgcttggcc

SEQ ID NO: 485205 - DNA, 25 bp, Mus musculus
tgcttgagacggacctgctgggctt

SEQ ID NO: 485206 - DNA, 25 bp, Mus musculus
tgcttgagctgtaggcgtggtcccc

SEQ ID NO: 485207 - DNA, 25 bp, Mus musculus
tgcttgagttcccagaaactgggcg

SEQ ID NO: 485208 - DNA, 25 bp, Mus musculus
tgcttgatgaataacggaggctgcg

SEQ ID NO: 485209 - DNA, 25 bp, Mus musculus
tgcttgcaaaacatggcttggctcc

SEQ ID NO: 485210 - DNA, 25 bp, Mus musculus
tgcttgcacataccacccaggtgtt

SEQ ID NO: 485211 - DNA, 25 bp, Mus musculus
tgcttgcaggcatgggactgtcctg

SEQ ID NO: 485212 - DNA, 25 bp, Mus musculus
tgcttgcagtgtgactccgagcttc

SEQ ID NO: 485213 - DNA, 25 bp, Mus musculus
tgcttgccaattcagccagcgtgcg

SEQ ID NO: 485214 - DNA, 25 bp, Mus musculus
tgcttgccagctgagagttgagacc

SEQ ID NO: 485215 - DNA, 25 bp, Mus musculus
tgcttgccctactggatgcctgtgg

SEQ ID NO: 485216 - DNA, 25 bp, Mus musculus
tgcttgccctatagagaatcccggg

SEQ ID NO: 485217 - DNA, 25 bp, Mus musculus
tgcttgctcaaaaaactggactgga

SEQ ID NO: 485218 - DNA, 25 bp, Mus musculus
tgcttgctcaaacacccaaatcttg

SEQ ID NO: 485219 - DNA, 25 bp, Mus musculus
tgcttgctcgcgattgctagggaca

SEQ ID NO: 485220 - DNA, 25 bp, Mus musculus
tgcttgctttcccttgcctggctgg

SEQ ID NO: 485221 - DNA, 25 bp, Mus musculus
tgcttggaaaaaagtcctgtttggg

SEQ ID NO: 485222 - DNA, 25 bp, Mus musculus
tgcttggaaaatcccagatcaggaa

SEQ ID NO: 485223 - DNA, 25 bp, Mus musculus
tgcttggaaagtaaatgcctcgctc

SEQ ID NO: 485224 - DNA, 25 bp, Mus musculus
tgcttggacagaaggccgtggccta

SEQ ID NO: 485225 - DNA, 25 bp, Mus musculus
tgcttggacgctgggtcttcaacgt

SEQ ID NO: 485226 - DNA, 25 bp, Mus musculus
tgcttggacttagaacctggaaggt

SEQ ID NO: 485227 - DNA, 25 bp, Mus musculus
tgcttggagaacaatggtggctgcc

SEQ ID NO: 485228 - DNA, 25 bp, Mus musculus
tgcttggagcactttctagaccacc

SEQ ID NO: 485229 - DNA, 25 bp, Mus musculus
tgcttggaggaaactactgactgct

SEQ ID NO: 485230 - DNA, 25 bp, Mus musculus
tgcttggcagagacagaacgcaatg

SEQ ID NO: 485231 - DNA, 25 bp, Mus musculus
tgcttgggagtgaagtcctagtcca

SEQ ID NO: 485232 - DNA, 25 bp, Mus musculus
tgcttgggctcagacatacacagtt

SEQ ID NO: 485233 - DNA, 25 bp, Mus musculus
tgcttggtcttaggaatttcgtacc

SEQ ID NO: 485234 - DNA, 25 bp, Mus musculus
tgcttggtgttatgggacgcttgta

SEQ ID NO: 485235 - DNA, 25 bp, Mus musculus
tgcttggttctaaaaatcttgtcag

SEQ ID NO: 485236 - DNA, 25 bp, Mus musculus
tgcttgtaaccgagagagtcatgcc

SEQ ID NO: 485237 - DNA, 25 bp, Mus musculus
tgcttgtaccaatcacagtcttgcc

SEQ ID NO: 485238 - DNA, 25 bp, Mus musculus
tgcttgtcacagagcgctacaggat

SEQ ID NO: 485239 - DNA, 25 bp, Mus musculus
tgcttgtcagcattgccaagtagca

SEQ ID NO: 485240 - DNA, 25 bp, Mus musculus
tgcttgtgataagcccattgggccc

SEQ ID NO: 485241 - DNA, 25 bp, Mus musculus
tgcttgtgtagctacctccatgttg

SEQ ID NO: 485242 - DNA, 25 bp, Mus musculus
tgcttgttctattgccccgggacga

SEQ ID NO: 485243 - DNA, 25 bp, Mus musculus
tgcttgttgagtgggtgccaatctc

SEQ ID NO: 485244 - DNA, 25 bp, Mus musculus
tgcttgttgcagtccagaacggcca

SEQ ID NO: 485245 - DNA, 25 bp, Mus musculus
tgctttaaaagtcagaacggtcaac

SEQ ID NO: 485246 - DNA, 25 bp, Mus musculus
tgctttaatctagaatcactccgta

SEQ ID NO: 485247 - DNA, 25 bp, Mus musculus
tgctttatgtgactaccgttctcca

SEQ ID NO: 485248 - DNA, 25 bp, Mus musculus
tgctttcaaggtcagggtcagcccc

SEQ ID NO: 485249 - DNA, 25 bp, Mus musculus
tgctttcagagaactgcggcccagg

SEQ ID NO: 485250 - DNA, 25 bp, Mus musculus
tgctttcagcatccaagtgtgggcc

SEQ ID NO: 485251 - DNA, 25 bp, Mus musculus
tgctttcagggacactggacaaccg

SEQ ID NO: 485252 - DNA, 25 bp, Mus musculus
tgctttccagtgagcgcggttgtcc

SEQ ID NO: 485253 - DNA, 25 bp, Mus musculus
tgctttccatctccacacgtgaggg

SEQ ID NO: 485254 - DNA, 25 bp, Mus musculus
tgctttcccgagacccagttcatag

SEQ ID NO: 485255 - DNA, 25 bp, Mus musculus
tgctttccctgccagatgctgcctg

SEQ ID NO: 485256 - DNA, 25 bp, Mus musculus
tgctttccgggatgccttttggcca

SEQ ID NO: 485257 - DNA, 25 bp, Mus musculus
tgctttcctgcagggtaactgtcga

SEQ ID NO: 485258 - DNA, 25 bp, Mus musculus
tgctttcggaacaggctgtaggcct

SEQ ID NO: 485259 - DNA, 25 bp, Mus musculus
tgctttcggagatcaggcgtctgca

SEQ ID NO: 485260 - DNA, 25 bp, Mus musculus
tgctttcgtcagaggctgcctgggt

SEQ ID NO: 485261 - DNA, 25 bp, Mus musculus
tgctttctagaggacgccaccattg

SEQ ID NO: 485262 - DNA, 25 bp, Mus musculus
tgctttctcaggagtctcagggacc

SEQ ID NO: 485263 - DNA, 25 bp, Mus musculus
tgctttctctatacctacagtattg

SEQ ID NO: 485264 - DNA, 25 bp, Mus musculus
tgctttctctgtccgccaatgggcg

SEQ ID NO: 485265 - DNA, 25 bp, Mus musculus
tgctttctgaagcacctgcctcgag

SEQ ID NO: 485266 - DNA, 25 bp, Mus musculus
tgctttctgctccaagagtccagca

SEQ ID NO: 485267 - DNA, 25 bp, Mus musculus
tgctttctgctctgctccgccggag

SEQ ID NO: 485268 - DNA, 25 bp, Mus musculus
tgctttcttctggtacatccaacag

SEQ ID NO: 485269 - DNA, 25 bp, Mus musculus
tgctttgaaagtatgggacctacag

SEQ ID NO: 485270 - DNA, 25 bp, Mus musculus
tgctttgaacaaactcccgtgagaa

SEQ ID NO: 485271 - DNA, 25 bp, Mus musculus
tgctttgaatccacagtctggaggt

SEQ ID NO: 485272 - DNA, 25 bp, Mus musculus
tgctttgactaagctgagcgagctg

SEQ ID NO: 485273 - DNA, 25 bp, Mus musculus
tgctttgataggacttaggtgacac

SEQ ID NO: 485274 - DNA, 25 bp, Mus musculus
tgctttgatgtcctgccctggcttc

SEQ ID NO: 485275 - DNA, 25 bp, Mus musculus
tgctttgcaggacatgagaccggaa

SEQ ID NO: 485276 - DNA, 25 bp, Mus musculus
tgctttgcatccgagtccctttggg

SEQ ID NO: 485277 - DNA, 25 bp, Mus musculus
tgctttgcatcctaacgatagtgaa

SEQ ID NO: 485278 - DNA, 25 bp, Mus musculus
tgctttgccagatactttgtcacgg

SEQ ID NO: 485279 - DNA, 25 bp, Mus musculus
tgctttgggaaatgatgacaggccg

SEQ ID NO: 485280 - DNA, 25 bp, Mus musculus
tgctttgggttttagaccacactaa

SEQ ID NO: 485281 - DNA, 25 bp, Mus musculus
tgctttgtgctaaaccttcggtggg

SEQ ID NO: 485282 - DNA, 25 bp, Mus musculus
tgctttgtgtgaaaccccagtcaac

SEQ ID NO: 485283 - DNA, 25 bp, Mus musculus
tgctttgttgactcatccctggata

SEQ ID NO: 485284 - DNA, 25 bp, Mus musculus
tgcttttagaaagcgtactgatggg

SEQ ID NO: 485285 - DNA, 25 bp, Mus musculus
tgcttttatgggaaacctcccagcc

SEQ ID NO: 485286 - DNA, 25 bp, Mus musculus
tgcttttgaacctccatcagattcg

SEQ ID NO: 485287 - DNA, 25 bp, Mus musculus
tgcttttgacagaagcctgccgtgg

SEQ ID NO: 485288 - DNA, 25 bp, Mus musculus
tgcttttgagaggacaccgacggac

SEQ ID NO: 485289 - DNA, 25 bp, Mus musculus
tgcttttgcaaggacagagctgctg

SEQ ID NO: 485290 - DNA, 25 bp, Mus musculus
tgcttttgcctcattgtaagatagg

SEQ ID NO: 485291 - DNA, 25 bp, Mus musculus
tgcttttgcggaacggaacccggtg

SEQ ID NO: 485292 - DNA, 25 bp, Mus musculus
tgcttttggacacctgacattccta

SEQ ID NO: 485293 - DNA, 25 bp, Mus musculus
tgctttttgccttatgctggcctcc

SEQ ID NO: 485294 - DNA, 25 bp, Mus musculus
tggaaaaactgtgcccgcaagctgg

SEQ ID NO: 485295 - DNA, 25 bp, Mus musculus
tggaaaaactttcctaagcaggccg

SEQ ID NO: 485296 - DNA, 25 bp, Mus musculus
tggaaaaaggccatcttgcagcaga

SEQ ID NO: 485297 - DNA, 25 bp, Mus musculus
tggaaaactctctttatactataga

SEQ ID NO: 485298 - DNA, 25 bp, Mus musculus
tggaaaacttcgtggctctggcaac

SEQ ID NO: 485299 - DNA, 25 bp, Mus musculus
tggaaaagataaatgaaggctcacc

SEQ ID NO: 485300 - DNA, 25 bp, Mus musculus
tggaaaagcatctggccgggctgca

SEQ ID NO: 485301 - DNA, 25 bp, Mus musculus
tggaaaagcgtgtcaggaccaccgt

SEQ ID NO: 485302 - DNA, 25 bp, Mus musculus
tggaaaaggatatctccattttacc

SEQ ID NO: 485303 - DNA, 25 bp, Mus musculus
tggaaaaggattcctaccgccgctt

SEQ ID NO: 485304 - DNA, 25 bp, Mus musculus
tggaaaaggatttcagaagtcaccc

SEQ ID NO: 485305 - DNA, 25 bp, Mus musculus
tggaaaagggcagcatcgagtcact

SEQ ID NO: 485306 - DNA, 25 bp, Mus musculus
tggaaaaggtaatcttgtcgtttct

SEQ ID NO: 485307 - DNA, 25 bp, Mus musculus
tggaaaatccacttcagaggcagta

SEQ ID NO: 485308 - DNA, 25 bp, Mus musculus
tggaaaatgtcctccccaagctggg

SEQ ID NO: 485309 - DNA, 25 bp, Mus musculus
tggaaacaaacttgccggctagccg

SEQ ID NO: 485310 - DNA, 25 bp, Mus musculus
tggaaacagaatgcaccaccatgag

SEQ ID NO: 485311 - DNA, 25 bp, Mus musculus
tggaaacagagaccctggtgacccg

SEQ ID NO: 485312 - DNA, 25 bp, Mus musculus
tggaaacatgacagacaaaagcagt

SEQ ID NO: 485313 - DNA, 25 bp, Mus musculus
tggaaaccaaactgaagggcctgca

SEQ ID NO: 485314 - DNA, 25 bp, Mus musculus
tggaaaccagaatcacccgctgtga

SEQ ID NO: 485315 - DNA, 25 bp, Mus musculus
tggaaaccaggccattggtagctgc

SEQ ID NO: 485316 - DNA, 25 bp, Mus musculus
tggaaaccatactatttcgaggaga

SEQ ID NO: 485317 - DNA, 25 bp, Mus musculus
tggaaaccatcctcgtcctgggact

SEQ ID NO: 485318 - DNA, 25 bp, Mus musculus
tggaaaccattcactgtcccgttgg

SEQ ID NO: 485319 - DNA, 25 bp, Mus musculus
tggaaacccaaggatctgacttagc

SEQ ID NO: 485320 - DNA, 25 bp, Mus musculus
tggaaacccagagtagctcatgcct

SEQ ID NO: 485321 - DNA, 25 bp, Mus musculus
tggaaacccagatcatagagaacta

SEQ ID NO: 485322 - DNA, 25 bp, Mus musculus
tggaaaccctatcaacctcagcaga

SEQ ID NO: 485323 - DNA, 25 bp, Mus musculus
tggaaaccctatggagaggcctccc

SEQ ID NO: 485324 - DNA, 25 bp, Mus musculus
tggaaaccttcccttttgatcagag

SEQ ID NO: 485325 - DNA, 25 bp, Mus musculus
tggaaacgcgagttttagcccagcc

SEQ ID NO: 485326 - DNA, 25 bp, Mus musculus
tggaaacggccatgctgaagcacgc

SEQ ID NO: 485327 - DNA, 25 bp, Mus musculus
tggaaacgttgtacccaagacggtg

SEQ ID NO: 485328 - DNA, 25 bp, Mus musculus
tggaaactcctataccctggtggtg

SEQ ID NO: 485329 - DNA, 25 bp, Mus musculus
tggaaactgcacaacggagacctgt

SEQ ID NO: 485330 - DNA, 25 bp, Mus musculus
tggaaacttatctacatgccccgga

SEQ ID NO: 485331 - DNA, 25 bp, Mus musculus
tggaaacttcgagcgctctgcaggc

SEQ ID NO: 485332 - DNA, 25 bp, Mus musculus
tggaaacttttgtccgagaccgaga

SEQ ID NO: 485333 - DNA, 25 bp, Mus musculus
tggaaagacagcaagcactacgttg

SEQ ID NO: 485334 - DNA, 25 bp, Mus musculus
tggaaagaccctcagtggcttaact

SEQ ID NO: 485335 - DNA, 25 bp, Mus musculus
tggaaagactaatggttacatcgcc

SEQ ID NO: 485336 - DNA, 25 bp, Mus musculus
tggaaagactacactgcctacaggt

SEQ ID NO: 485337 - DNA, 25 bp, Mus musculus
tggaaagagagacccgactattgca

SEQ ID NO: 485338 - DNA, 25 bp, Mus musculus
tggaaagagcatgggatgcagaaac

SEQ ID NO: 485339 - DNA, 25 bp, Mus musculus
tggaaagagccacgacaaggactcc

SEQ ID NO: 485340 - DNA, 25 bp, Mus musculus
tggaaagagcgctgtcaaaagtgac

SEQ ID NO: 485341 - DNA, 25 bp, Mus musculus
tggaaagatctgtcccgcatcggga

SEQ ID NO: 485342 - DNA, 25 bp, Mus musculus
tggaaagcaaagttcgccagccagg

SEQ ID NO: 485343 - DNA, 25 bp, Mus musculus
tggaaagcacgacttcatcggcgag

SEQ ID NO: 485344 - DNA, 25 bp, Mus musculus
tggaaagcagatgtctcgccgctct

SEQ ID NO: 485345 - DNA, 25 bp, Mus musculus
tggaaagcatccctagcctgagcca

SEQ ID NO: 485346 - DNA, 25 bp, Mus musculus
tggaaagccccagggacaagctatg

SEQ ID NO: 485347 - DNA, 25 bp, Mus musculus
tggaaagccctaattaccgccgtcg

SEQ ID NO: 485348 - DNA, 25 bp, Mus musculus
tggaaagcctcgattcaccaagtgt

SEQ ID NO: 485349 - DNA, 25 bp, Mus musculus
tggaaagcctggatttggctatggc

SEQ ID NO: 485350 - DNA, 25 bp, Mus musculus
tggaaagcgagcaaccctgagtctg

SEQ ID NO: 485351 - DNA, 25 bp, Mus musculus
tggaaagcgtttctggaatcgctct

SEQ ID NO: 485352 - DNA, 25 bp, Mus musculus
tggaaagctccgtcccctctgtgat

SEQ ID NO: 485353 - DNA, 25 bp, Mus musculus
tggaaagctcggctccatccaggaa

SEQ ID NO: 485354 - DNA, 25 bp, Mus musculus
tggaaaggactctcagtggcgcctg

SEQ ID NO: 485355 - DNA, 25 bp, Mus musculus
tggaaaggcatttacccagtgcaac

SEQ ID NO: 485356 - DNA, 25 bp, Mus musculus
tggaaaggctaagccaccaaggact

SEQ ID NO: 485357 - DNA, 25 bp, Mus musculus
tggaaaggctgacgctgtccactgc

SEQ ID NO: 485358 - DNA, 25 bp, Mus musculus
tggaaagtagtctcctgagccacct

SEQ ID NO: 485359 - DNA, 25 bp, Mus musculus
tggaaagtcctaccaagtccctgag

SEQ ID NO: 485360 - DNA, 25 bp, Mus musculus
tggaaagtcctcagctccctggaga

SEQ ID NO: 485361 - DNA, 25 bp, Mus musculus
tggaaataaaacatccaggcgctgt

SEQ ID NO: 485362 - DNA, 25 bp, Mus musculus
tggaaataaggtcgccccatggagc

SEQ ID NO: 485363 - DNA, 25 bp, Mus musculus
tggaaataatacagtcagcttcatg

SEQ ID NO: 485364 - DNA, 25 bp, Mus musculus
tggaaataccagaagagggctgccc

SEQ ID NO: 485365 - DNA, 25 bp, Mus musculus
tggaaataggtcttcagcggtctac

SEQ ID NO: 485366 - DNA, 25 bp, Mus musculus
tggaaataggtggaaatccagcagc

SEQ ID NO: 485367 - DNA, 25 bp, Mus musculus
tggaaatcagatatggatcaatgcg

SEQ ID NO: 485368 - DNA, 25 bp, Mus musculus
tggaaatccagcatgcagactaaga

SEQ ID NO: 485369 - DNA, 25 bp, Mus musculus
tggaaatcctgcagcgtgtcataga

SEQ ID NO: 485370 - DNA, 25 bp, Mus musculus
tggaaatcgtcaacctgctcaagga

SEQ ID NO: 485371 - DNA, 25 bp, Mus musculus
tggaaatgaaacaccataaaagtca

SEQ ID NO: 485372 - DNA, 25 bp, Mus musculus
tggaaatgaagaacaaatacaccgg

SEQ ID NO: 485373 - DNA, 25 bp, Mus musculus
tggaaatgatcagcatccagctgaa

SEQ ID NO: 485374 - DNA, 25 bp, Mus musculus
tggaaatgccaacgacgctgtcagt

SEQ ID NO: 485375 - DNA, 25 bp, Mus musculus
tggaaatgccacttacctgccatgg

SEQ ID NO: 485376 - DNA, 25 bp, Mus musculus
tggaaatgcctacaactctctggaa

SEQ ID NO: 485377 - DNA, 25 bp, Mus musculus
tggaaatgctagaacgcaagtatgg

SEQ ID NO: 485378 - DNA, 25 bp, Mus musculus
tggaaatggaccaagagggcgctct

SEQ ID NO: 485379 - DNA, 25 bp, Mus musculus
tggaaatggagtcaacaacagcttg

SEQ ID NO: 485380 - DNA, 25 bp, Mus musculus
tggaaattccaagttgctgggatca

SEQ ID NO: 485381 - DNA, 25 bp, Mus musculus
tggaaattgtactgggacccgctgg

SEQ ID NO: 485382 - DNA, 25 bp, Mus musculus
tggaacaaccggcagatggccctgt

SEQ ID NO: 485383 - DNA, 25 bp, Mus musculus
tggaacaagttcatcacagagcaaa

SEQ ID NO: 485384 - DNA, 25 bp, Mus musculus
tggaacaagttgtagagctctcggc

SEQ ID NO: 485385 - DNA, 25 bp, Mus musculus
tggaacaataacaatccccggtgga

SEQ ID NO: 485386 - DNA, 25 bp, Mus musculus
tggaacacagggtagagctcaggct

SEQ ID NO: 485387 - DNA, 25 bp, Mus musculus
tggaacacattacgagcagatcagg

SEQ ID NO: 485388 - DNA, 25 bp, Mus musculus
tggaacaccaccactcaaacatggg

SEQ ID NO: 485389 - DNA, 25 bp, Mus musculus
tggaacactaaatttccttcaaagg

SEQ ID NO: 485390 - DNA, 25 bp, Mus musculus
tggaacactcttggccttcctagag

SEQ ID NO: 485391 - DNA, 25 bp, Mus musculus
tggaacagacgaggacactgaaaac

SEQ ID NO: 485392 - DNA, 25 bp, Mus musculus
tggaacagcctttctatcacgacga

SEQ ID NO: 485393 - DNA, 25 bp, Mus musculus
tggaacagcggttagccgagttccg

SEQ ID NO: 485394 - DNA, 25 bp, Mus musculus
tggaacagctgagccgtgaactgga

SEQ ID NO: 485395 - DNA, 25 bp, Mus musculus
tggaacagtcgcctgacctgcagga

SEQ ID NO: 485396 - DNA, 25 bp, Mus musculus
tggaacagttcagacagcagctggg

SEQ ID NO: 485397 - DNA, 25 bp, Mus musculus
tggaacagtttctacagcaggagct

SEQ ID NO: 485398 - DNA, 25 bp, Mus musculus
tggaacatcacctcgccatgataac

SEQ ID NO: 485399 - DNA, 25 bp, Mus musculus
tggaacatcactggcaactggacgt

SEQ ID NO: 485400 - DNA, 25 bp, Mus musculus
tggaacatccaaagtgcgccctgga

SEQ ID NO: 485401 - DNA, 25 bp, Mus musculus
tggaacatccccaagcaactgttga

SEQ ID NO: 485402 - DNA, 25 bp, Mus musculus
tggaacatcgggaccagcctcccgg

SEQ ID NO: 485403 - DNA, 25 bp, Mus musculus
tggaacatctcaaggcccaggtgga

SEQ ID NO: 485404 - DNA, 25 bp, Mus musculus
tggaacatgtcctgtactgtaagag

SEQ ID NO: 485405 - DNA, 25 bp, Mus musculus
tggaacattaccgaaaacgctggcg

SEQ ID NO: 485406 - DNA, 25 bp, Mus musculus
tggaacattttcagcaaaggaacgc

SEQ ID NO: 485407 - DNA, 25 bp, Mus musculus
tggaaccaaggctccggtttctgga

SEQ ID NO: 485408 - DNA, 25 bp, Mus musculus
tggaaccaagtagaaagtcattagg

SEQ ID NO: 485409 - DNA, 25 bp, Mus musculus
tggaaccaatgagaactccgctgct

SEQ ID NO: 485410 - DNA, 25 bp, Mus musculus
tggaaccacaaaagaggcgtagagg

SEQ ID NO: 485411 - DNA, 25 bp, Mus musculus
tggaaccacgtagcaaagaaggccc

SEQ ID NO: 485412 - DNA, 25 bp, Mus musculus
tggaaccacttctctgccatgcgga

SEQ ID NO: 485413 - DNA, 25 bp, Mus musculus
tggaaccagtccttcgggcgaagcc

SEQ ID NO: 485414 - DNA, 25 bp, Mus musculus
tggaaccatttgcatgtcagtgtgg

SEQ ID NO: 485415 - DNA, 25 bp, Mus musculus
tggaacccaatagaaaccacgtagg

SEQ ID NO: 485416 - DNA, 25 bp, Mus musculus
tggaacccagactcaagcgtagcaa

SEQ ID NO: 485417 - DNA, 25 bp, Mus musculus
tggaacccggagtgctctactgaag

SEQ ID NO: 485418 - DNA, 25 bp, Mus musculus
tggaacccgggaagagcaaaccatc

SEQ ID NO: 485419 - DNA, 25 bp, Mus musculus
tggaaccctccaaacctctagcttg

SEQ ID NO: 485420 - DNA, 25 bp, Mus musculus
tggaaccctgttgtggagatgctga

SEQ ID NO: 485421 - DNA, 25 bp, Mus musculus
tggaaccgatgtagatgacctcaag

SEQ ID NO: 485422 - DNA, 25 bp, Mus musculus
tggaaccgcatcatcgtggagaagc

SEQ ID NO: 485423 - DNA, 25 bp, Mus musculus
tggaaccgggcaccaacttgcgtgt

SEQ ID NO: 485424 - DNA, 25 bp, Mus musculus
tggaacctaagaagcagcagctgct

SEQ ID NO: 485425 - DNA, 25 bp, Mus musculus
tggaacctctccttctggtctgaac

SEQ ID NO: 485426 - DNA, 25 bp, Mus musculus
tggaacctggtacctggaacaaact

SEQ ID NO: 485427 - DNA, 25 bp, Mus musculus
tggaaccttggcctttgtgcagtct

SEQ ID NO: 485428 - DNA, 25 bp, Mus musculus
tggaaccttttcacctgaggcgccc

SEQ ID NO: 485429 - DNA, 25 bp, Mus musculus
tggaaccttttggatgcccacgtcg

SEQ ID NO: 485430 - DNA, 25 bp, Mus musculus
tggaacgacttaccttgacacctgt

SEQ ID NO: 485431 - DNA, 25 bp, Mus musculus
tggaacgcaacatcagctctaaaga

SEQ ID NO: 485432 - DNA, 25 bp, Mus musculus
tggaacgcccacctgtagatggaaa

SEQ ID NO: 485433 - DNA, 25 bp, Mus musculus
tggaacgctgcaatacctcgaggac

SEQ ID NO: 485434 - DNA, 25 bp, Mus musculus
tggaacggcctggtgaaacccagag

SEQ ID NO: 485435 - DNA, 25 bp, Mus musculus
tggaacgggagcaagccctcgcaaa

SEQ ID NO: 485436 - DNA, 25 bp, Mus musculus
tggaacgtaagccatgggtccccta

SEQ ID NO: 485437 - DNA, 25 bp, Mus musculus
tggaacgtgcagtcatccggctgga

SEQ ID NO: 485438 - DNA, 25 bp, Mus musculus
tggaacgttcaagacattactgctg

SEQ ID NO: 485439 - DNA, 25 bp, Mus musculus
tggaactactggtggaactggcttc

SEQ ID NO: 485440 - DNA, 25 bp, Mus musculus
tggaactcagatgtgcaaacctagc

SEQ ID NO: 485441 - DNA, 25 bp, Mus musculus
tggaactcatctgcactgtgctggg

SEQ ID NO: 485442 - DNA, 25 bp, Mus musculus
tggaactcccgcttattggtccccg

SEQ ID NO: 485443 - DNA, 25 bp, Mus musculus
tggaactcgagctcgggttgcaccg

SEQ ID NO: 485444 - DNA, 25 bp, Mus musculus
tggaactcgcaaaaggtggatgccc

SEQ ID NO: 485445 - DNA, 25 bp, Mus musculus
tggaactgattctgtagcggaggat

SEQ ID NO: 485446 - DNA, 25 bp, Mus musculus
tggaactgcctagtagttcacacag

SEQ ID NO: 485447 - DNA, 25 bp, Mus musculus
tggaactgctttgaggaccgctcga

SEQ ID NO: 485448 - DNA, 25 bp, Mus musculus
tggaacttcaggatcaatgcatgct

SEQ ID NO: 485449 - DNA, 25 bp, Mus musculus
tggaacttccagcacatgatgatgt

SEQ ID NO: 485450 - DNA, 25 bp, Mus musculus
tggaacttcgtgaccaagagaaact

SEQ ID NO: 485451 - DNA, 25 bp, Mus musculus
tggaacttgagcgtacctgggagac

SEQ ID NO: 485452 - DNA, 25 bp, Mus musculus
tggaactttggtgtaccccagtggg

SEQ ID NO: 485453 - DNA, 25 bp, Mus musculus
tggaagaagacagcgattcagagac

SEQ ID NO: 485454 - DNA, 25 bp, Mus musculus
tggaagaagggtcttcgccttcctt

SEQ ID NO: 485455 - DNA, 25 bp, Mus musculus
tggaagacaaaaacggcaacaggcc

SEQ ID NO: 485456 - DNA, 25 bp, Mus musculus
tggaagacagcagttcacctcgggt

SEQ ID NO: 485457 - DNA, 25 bp, Mus musculus
tggaagacattcacatcctgttagc

SEQ ID NO: 485458 - DNA, 25 bp, Mus musculus
tggaagacattggactaagcagcct

SEQ ID NO: 485459 - DNA, 25 bp, Mus musculus
tggaagaccagagaacggagagcac

SEQ ID NO: 485460 - DNA, 25 bp, Mus musculus
tggaagaccaggagcgcatcaaagt

SEQ ID NO: 485461 - DNA, 25 bp, Mus musculus
tggaagacccatcagtggcactgct

SEQ ID NO: 485462 - DNA, 25 bp, Mus musculus
tggaagaccccgaaagctacgggct

SEQ ID NO: 485463 - DNA, 25 bp, Mus musculus
tggaagaccctagctggatcacacg

SEQ ID NO: 485464 - DNA, 25 bp, Mus musculus
tggaagacctggcacaggaccacat

SEQ ID NO: 485465 - DNA, 25 bp, Mus musculus
tggaagacgattacgaacctgagct

SEQ ID NO: 485466 - DNA, 25 bp, Mus musculus
tggaagagaaccttaaccggcgcct

SEQ ID NO: 485467 - DNA, 25 bp, Mus musculus
tggaagagccagtgtacgaagcagc

SEQ ID NO: 485468 - DNA, 25 bp, Mus musculus
tggaagagctcagttgactcttgtc

SEQ ID NO: 485469 - DNA, 25 bp, Mus musculus
tggaagagcttgtgaacgtgagctc

SEQ ID NO: 485470 - DNA, 25 bp, Mus musculus
tggaagaggaaagagtggtcccaac

SEQ ID NO: 485471 - DNA, 25 bp, Mus musculus
tggaagaggcagactcatcctcggg

SEQ ID NO: 485472 - DNA, 25 bp, Mus musculus
tggaagaggccaacagagacctgga

SEQ ID NO: 485473 - DNA, 25 bp, Mus musculus
tggaagaggccatcaggtgcaaact

SEQ ID NO: 485474 - DNA, 25 bp, Mus musculus
tggaagagtccgtctggccaagctc

SEQ ID NO: 485475 - DNA, 25 bp, Mus musculus
tggaagatcttctcagtaagcctgc

SEQ ID NO: 485476 - DNA, 25 bp, Mus musculus
tggaagatgccccagaacccttttt

SEQ ID NO: 485477 - DNA, 25 bp, Mus musculus
tggaagattctttctgttccatcca

SEQ ID NO: 485478 - DNA, 25 bp, Mus musculus
tggaagcaaggagtcggcaagcaaa

SEQ ID NO: 485479 - DNA, 25 bp, Mus musculus
tggaagcacacttgaaaagcactgg

SEQ ID NO: 485480 - DNA, 25 bp, Mus musculus
tggaagcacatcctgcctcgggcag

SEQ ID NO: 485481 - DNA, 25 bp, Mus musculus
tggaagcactttgcacaccgtgatg

SEQ ID NO: 485482 - DNA, 25 bp, Mus musculus
tggaagcagcattgcccatgagcct

SEQ ID NO: 485483 - DNA, 25 bp, Mus musculus
tggaagcaggcgacaaccactttgt

SEQ ID NO: 485484 - DNA, 25 bp, Mus musculus
tggaagcagtcaagtgcaaaggaga

SEQ ID NO: 485485 - DNA, 25 bp, Mus musculus
tggaagcatcacctctaatctcatt

SEQ ID NO: 485486 - DNA, 25 bp, Mus musculus
tggaagcatccagaccatgagggcc

SEQ ID NO: 485487 - DNA, 25 bp, Mus musculus
tggaagcatctcctgccaaagcagc

SEQ ID NO: 485488 - DNA, 25 bp, Mus musculus
tggaagcatgaacaccagggacctt

SEQ ID NO: 485489 - DNA, 25 bp, Mus musculus
tggaagcattgcagggatcatctct

SEQ ID NO: 485490 - DNA, 25 bp, Mus musculus
tggaagccacctttcgtgtgcaccg

SEQ ID NO: 485491 - DNA, 25 bp, Mus musculus
tggaagccactggttcaccatgcag

SEQ ID NO: 485492 - DNA, 25 bp, Mus musculus
tggaagccattaagaaaaccagggc

SEQ ID NO: 485493 - DNA, 25 bp, Mus musculus
tggaagcccatggagtgaacacggc

SEQ ID NO: 485494 - DNA, 25 bp, Mus musculus
tggaagccccacatcccgatggatg

SEQ ID NO: 485495 - DNA, 25 bp, Mus musculus
tggaagcccctaatggaacatgcgt

SEQ ID NO: 485496 - DNA, 25 bp, Mus musculus
tggaagccctcaactaccaggtgga

SEQ ID NO: 485497 - DNA, 25 bp, Mus musculus
tggaagccctcgaagtgatccttga

SEQ ID NO: 485498 - DNA, 25 bp, Mus musculus
tggaagccgagggactgccatttgc

SEQ ID NO: 485499 - DNA, 25 bp, Mus musculus
tggaagccgattctcctgtaggaag

SEQ ID NO: 485500 - DNA, 25 bp, Mus musculus
tggaagccggcgcagatcccaacgc

SEQ ID NO: 485501 - DNA, 25 bp, Mus musculus
tggaagcctattgaggcctccttgc

SEQ ID NO: 485502 - DNA, 25 bp, Mus musculus
tggaagcctgaacacatagcgatga

SEQ ID NO: 485503 - DNA, 25 bp, Mus musculus
tggaagcctgaagtcaacccggaca

SEQ ID NO: 485504 - DNA, 25 bp, Mus musculus
tggaagcctgctaccatcaggaacc

SEQ ID NO: 485505 - DNA, 25 bp, Mus musculus
tggaagcctttgaccaagcctggaa

SEQ ID NO: 485506 - DNA, 25 bp, Mus musculus
tggaagcgcctcaaatccctgctga

SEQ ID NO: 485507 - DNA, 25 bp, Mus musculus
tggaagcggatttcgcaaaaaaggg

SEQ ID NO: 485508 - DNA, 25 bp, Mus musculus
tggaagcggttttgttcctctgggc

SEQ ID NO: 485509 - DNA, 25 bp, Mus musculus
tggaagctattttcatccgtcgagc

SEQ ID NO: 485510 - DNA, 25 bp, Mus musculus
tggaagctgagccacccaatgtgct

SEQ ID NO: 485511 - DNA, 25 bp, Mus musculus
tggaagctgcaacctacgtgctgtg

SEQ ID NO: 485512 - DNA, 25 bp, Mus musculus
tggaagctgctgaatactgggcacc

SEQ ID NO: 485513 - DNA, 25 bp, Mus musculus
tggaaggaccataagggcatccctg

SEQ ID NO: 485514 - DNA, 25 bp, Mus musculus
tggaaggactccatgcctgactggc

SEQ ID NO: 485515 - DNA, 25 bp, Mus musculus
tggaaggagctacccgacatactgt

SEQ ID NO: 485516 - DNA, 25 bp, Mus musculus
tggaaggcccacaagaaactctctc

SEQ ID NO: 485517 - DNA, 25 bp, Mus musculus
tggaaggcctcgatatacagctgga

SEQ ID NO: 485518 - DNA, 25 bp, Mus musculus
tggaaggctgtatccctcgaaggag

SEQ ID NO: 485519 - DNA, 25 bp, Mus musculus
tggaagggttgggattctctgacac

SEQ ID NO: 485520 - DNA, 25 bp, Mus musculus
tggaaggtctccaccatcgatggca

SEQ ID NO: 485521 - DNA, 25 bp, Mus musculus
tggaaggtgatcataacgatgccgc

SEQ ID NO: 485522 - DNA, 25 bp, Mus musculus
tggaagtacccaggcaaaaggcgag

SEQ ID NO: 485523 - DNA, 25 bp, Mus musculus
tggaagtcagcacataaacccgtct

SEQ ID NO: 485524 - DNA, 25 bp, Mus musculus
tggaagtccacctgaaggagacgct

SEQ ID NO: 485525 - DNA, 25 bp, Mus musculus
tggaagtccctgttaatatcccact

SEQ ID NO: 485526 - DNA, 25 bp, Mus musculus
tggaagtcgactctcgggctgaggc

SEQ ID NO: 485527 - DNA, 25 bp, Mus musculus
tggaagtcggatgcatcgcaacact

SEQ ID NO: 485528 - DNA, 25 bp, Mus musculus
tggaagtctccccacaggacataga

SEQ ID NO: 485529 - DNA, 25 bp, Mus musculus
tggaagtgctcacaaaccagccaac

SEQ ID NO: 485530 - DNA, 25 bp, Mus musculus
tggaagtggcacaaaagacccagct

SEQ ID NO: 485531 - DNA, 25 bp, Mus musculus
tggaagttctactcgcgtaggcgcc

SEQ ID NO: 485532 - DNA, 25 bp, Mus musculus
tggaagttctcaggccagctagaag

SEQ ID NO: 485533 - DNA, 25 bp, Mus musculus
tggaagttttagtgggaccctggct

SEQ ID NO: 485534 - DNA, 25 bp, Mus musculus
tggaataaagaccagcaagctccct

SEQ ID NO: 485535 - DNA, 25 bp, Mus musculus
tggaataacaacgatgctgctgcct

SEQ ID NO: 485536 - DNA, 25 bp, Mus musculus
tggaatactcggtccctcctgaggt

SEQ ID NO: 485537 - DNA, 25 bp, Mus musculus
tggaatcaagactcagccaaagatg

SEQ ID NO: 485538 - DNA, 25 bp, Mus musculus
tggaatcacataagaactgacgcgc

SEQ ID NO: 485539 - DNA, 25 bp, Mus musculus
tggaatccaaactaggacaattgcc

SEQ ID NO: 485540 - DNA, 25 bp, Mus musculus
tggaatcccacgtgaaacagtgaga

SEQ ID NO: 485541 - DNA, 25 bp, Mus musculus
tggaatcccagtgagttaccttgtt

SEQ ID NO: 485542 - DNA, 25 bp, Mus musculus
tggaatcccattacttagacaatgg

SEQ ID NO: 485543 - DNA, 25 bp, Mus musculus
tggaatccctaaatggcggtaagcc

SEQ ID NO: 485544 - DNA, 25 bp, Mus musculus
tggaatccgccacaggtgcctgaaa

SEQ ID NO: 485545 - DNA, 25 bp, Mus musculus
tggaatccggttgtccttgcctgca

SEQ ID NO: 485546 - DNA, 25 bp, Mus musculus
tggaatcctagcaacagatctctcc

SEQ ID NO: 485547 - DNA, 25 bp, Mus musculus
tggaatcgatactgacccagagctc

SEQ ID NO: 485548 - DNA, 25 bp, Mus musculus
tggaatcgtttgtcccgggtccgcg

SEQ ID NO: 485549 - DNA, 25 bp, Mus musculus
tggaatctcacaaaaagtgcccctg

SEQ ID NO: 485550 - DNA, 25 bp, Mus musculus
tggaatctcagctcagaaacttggg

SEQ ID NO: 485551 - DNA, 25 bp, Mus musculus
tggaatctccacagcaaaggcagtc

SEQ ID NO: 485552 - DNA, 25 bp, Mus musculus
tggaatctgatatgcccagtgctac

SEQ ID NO: 485553 - DNA, 25 bp, Mus musculus
tggaatctgtccagctgggcctgtg

SEQ ID NO: 485554 - DNA, 25 bp, Mus musculus
tggaatgactggatcgtggcacctc

SEQ ID NO: 485555 - DNA, 25 bp, Mus musculus
tggaatgataccaggtggctgcctc

SEQ ID NO: 485556 - DNA, 25 bp, Mus musculus
tggaatgcaatttcggcgccagctc

SEQ ID NO: 485557 - DNA, 25 bp, Mus musculus
tggaatgcagaacactcagctgtgc

SEQ ID NO: 485558 - DNA, 25 bp, Mus musculus
tggaatgccaatgtcagcctcaagc

SEQ ID NO: 485559 - DNA, 25 bp, Mus musculus
tggaatgccattacagtatttagta

SEQ ID NO: 485560 - DNA, 25 bp, Mus musculus
tggaatgcccaggaaaagccgagct

SEQ ID NO: 485561 - DNA, 25 bp, Mus musculus
tggaatgccttggagcagactagca

SEQ ID NO: 485562 - DNA, 25 bp, Mus musculus
tggaatgctccaaccagcatgggag

SEQ ID NO: 485563 - DNA, 25 bp, Mus musculus
tggaatgctcctactgtcactgcga

SEQ ID NO: 485564 - DNA, 25 bp, Mus musculus
tggaatggatcaagaacaacggcgg

SEQ ID NO: 485565 - DNA, 25 bp, Mus musculus
tggaattaaatcagaactccctgtg

SEQ ID NO: 485566 - DNA, 25 bp, Mus musculus
tggaattcagatttctccgaaagac

SEQ ID NO: 485567 - DNA, 25 bp, Mus musculus
tggaattcagcgagatctgcccctc

SEQ ID NO: 485568 - DNA, 25 bp, Mus musculus
tggaattccaaggtgcgctgcgtcg

SEQ ID NO: 485569 - DNA, 25 bp, Mus musculus
tggaattccccattgaggcgcagga

SEQ ID NO: 485570 - DNA, 25 bp, Mus musculus
tggaattctcaaagagcaaactctg

SEQ ID NO: 485571 - DNA, 25 bp, Mus musculus
tggaattctggaaacttcagagagc

SEQ ID NO: 485572 - DNA, 25 bp, Mus musculus
tggaattcttcagcccggaggcatg

SEQ ID NO: 485573 - DNA, 25 bp, Mus musculus
tggaattgagatccccgctcagagg

SEQ ID NO: 485574 - DNA, 25 bp, Mus musculus
tggaattgggacttcacctcggcgc

SEQ ID NO: 485575 - DNA, 25 bp, Mus musculus
tggaatttaagaatgcagcctatct

SEQ ID NO: 485576 - DNA, 25 bp, Mus musculus
tggaatttgggctaaggctggaact

SEQ ID NO: 485577 - DNA, 25 bp, Mus musculus
tggacaaacatcatctgggaagacc

SEQ ID NO: 485578 - DNA, 25 bp, Mus musculus
tggacaaacggaagtgcaacacggc

SEQ ID NO: 485579 - DNA, 25 bp, Mus musculus
tggacaaataatgagagccctggca

SEQ ID NO: 485580 - DNA, 25 bp, Mus musculus
tggacaacaaaagcacggtgattcg

SEQ ID NO: 485581 - DNA, 25 bp, Mus musculus
tggacaacactaacacaggaccctt

SEQ ID NO: 485582 - DNA, 25 bp, Mus musculus
tggacaaccatcagctcagcactgt

SEQ ID NO: 485583 - DNA, 25 bp, Mus musculus
tggacaacccagacaatcagcaaga

SEQ ID NO: 485584 - DNA, 25 bp, Mus musculus
tggacaaccggctcttcaaacagga

SEQ ID NO: 485585 - DNA, 25 bp, Mus musculus
tggacaactctgtggtggacctgga

SEQ ID NO: 485586 - DNA, 25 bp, Mus musculus
tggacaactgaaccccatggaagat

SEQ ID NO: 485587 - DNA, 25 bp, Mus musculus
tggacaacttcagtagcgggcgacg

SEQ ID NO: 485588 - DNA, 25 bp, Mus musculus
tggacaacttcgtgcctaatgacct

SEQ ID NO: 485589 - DNA, 25 bp, Mus musculus
tggacaagcctagcgggagagaaac

SEQ ID NO: 485590 - DNA, 25 bp, Mus musculus
tggacaagcgggttcacatgacgtg

SEQ ID NO: 485591 - DNA, 25 bp, Mus musculus
tggacaaggccataagaagcaaagc

SEQ ID NO: 485592 - DNA, 25 bp, Mus musculus
tggacaagtaactcaaccaaaattg

SEQ ID NO: 485593 - DNA, 25 bp, Mus musculus
tggacaagtatctgtaccccgcggc

SEQ ID NO: 485594 - DNA, 25 bp, Mus musculus
tggacaatcagaaagcaagcctgcc

SEQ ID NO: 485595 - DNA, 25 bp, Mus musculus
tggacaatctaatgcagcgctgcgg

SEQ ID NO: 485596 - DNA, 25 bp, Mus musculus
tggacaatggacaagggagaccctg

SEQ ID NO: 485597 - DNA, 25 bp, Mus musculus
tggacaatgtcttgggtctcccata

SEQ ID NO: 485598 - DNA, 25 bp, Mus musculus
tggacacaagagaaaatcacctgct

SEQ ID NO: 485599 - DNA, 25 bp, Mus musculus
tggacacaagcatgacagaatcgtg

SEQ ID NO: 485600 - DNA, 25 bp, Mus musculus
tggacacacagcttttcatttaatc

SEQ ID NO: 485601 - DNA, 25 bp, Mus musculus
tggacacactgtactaggccctgag

SEQ ID NO: 485602 - DNA, 25 bp, Mus musculus
tggacacaggcagaatgatcaagac

SEQ ID NO: 485603 - DNA, 25 bp, Mus musculus
tggacacatatgtcagggagatgcc

SEQ ID NO: 485604 - DNA, 25 bp, Mus musculus
tggacacattgtcaaatgcctagat

SEQ ID NO: 485605 - DNA, 25 bp, Mus musculus
tggacaccaagtcccgggctgcttg

SEQ ID NO: 485606 - DNA, 25 bp, Mus musculus
tggacacccagtaagtatgcagaca

SEQ ID NO: 485607 - DNA, 25 bp, Mus musculus
tggacaccctgaactcggacggata

SEQ ID NO: 485608 - DNA, 25 bp, Mus musculus
tggacacctcttttgccaggcaagg

SEQ ID NO: 485609 - DNA, 25 bp, Mus musculus
tggacacctgcctgtacatcttcac

SEQ ID NO: 485610 - DNA, 25 bp, Mus musculus
tggacacgcaagaacgcatcaaggc

SEQ ID NO: 485611 - DNA, 25 bp, Mus musculus
tggacacgcctgatgactatgagac

SEQ ID NO: 485612 - DNA, 25 bp, Mus musculus
tggacacgcttgtcgtgctgcaccg

SEQ ID NO: 485613 - DNA, 25 bp, Mus musculus
tggacacggactatgagcgctacac

SEQ ID NO: 485614 - DNA, 25 bp, Mus musculus
tggacactaatacccatggcagcgg

SEQ ID NO: 485615 - DNA, 25 bp, Mus musculus
tggacactcacatggccttccgtgg

SEQ ID NO: 485616 - DNA, 25 bp, Mus musculus
tggacactggtttcggcatccggat

SEQ ID NO: 485617 - DNA, 25 bp, Mus musculus
tggacacttcatatccccgtgagga

SEQ ID NO: 485618 - DNA, 25 bp, Mus musculus
tggacacttggaaataatactgctg

SEQ ID NO: 485619 - DNA, 25 bp, Mus musculus
tggacacttggacggtaagatgacc

SEQ ID NO: 485620 - DNA, 25 bp, Mus musculus
tggacactttgcgagggcttctgct

SEQ ID NO: 485621 - DNA, 25 bp, Mus musculus
tggacagaaaccagcatgtctcagg

SEQ ID NO: 485622 - DNA, 25 bp, Mus musculus
tggacagacccactccagtcatagg

SEQ ID NO: 485623 - DNA, 25 bp, Mus musculus
tggacagagaaatccggcgatggct

SEQ ID NO: 485624 - DNA, 25 bp, Mus musculus
tggacagatctgacaaaatggcttc

SEQ ID NO: 485625 - DNA, 25 bp, Mus musculus
tggacagcaaaatgcccgccatggt

SEQ ID NO: 485626 - DNA, 25 bp, Mus musculus
tggacagcaacaacgagaagggcct

SEQ ID NO: 485627 - DNA, 25 bp, Mus musculus
tggacagcaacagctcctctgggag

SEQ ID NO: 485628 - DNA, 25 bp, Mus musculus
tggacagcaatgagcccaggctgct

SEQ ID NO: 485629 - DNA, 25 bp, Mus musculus
tggacagcaggtatcagacaaacac

SEQ ID NO: 485630 - DNA, 25 bp, Mus musculus
tggacagccccagatctaagcggtg

SEQ ID NO: 485631 - DNA, 25 bp, Mus musculus
tggacagcctcaagatcccatcaga

SEQ ID NO: 485632 - DNA, 25 bp, Mus musculus
tggacagcttgaataccagccggcg

SEQ ID NO: 485633 - DNA, 25 bp, Mus musculus
tggacaggaggtcaaataggcaccc

SEQ ID NO: 485634 - DNA, 25 bp, Mus musculus
tggacaggatgcacccagcaagtgt

SEQ ID NO: 485635 - DNA, 25 bp, Mus musculus
tggacaggccctttgatgagactac

SEQ ID NO: 485636 - DNA, 25 bp, Mus musculus
tggacagggatcagcatggctgact

SEQ ID NO: 485637 - DNA, 25 bp, Mus musculus
tggacaggtacgtttacaatatact

SEQ ID NO: 485638 - DNA, 25 bp, Mus musculus
tggacagtcctcagaagagccgaga

SEQ ID NO: 485639 - DNA, 25 bp, Mus musculus
tggacagtcttcaacagaagggccc

SEQ ID NO: 485640 - DNA, 25 bp, Mus musculus
tggacagtgagacaaaacaggcctt

SEQ ID NO: 485641 - DNA, 25 bp, Mus musculus
tggacagtgggcactcttgccaacg

SEQ ID NO: 485642 - DNA, 25 bp, Mus musculus
tggacagtggttaccggcaggacct

SEQ ID NO: 485643 - DNA, 25 bp, Mus musculus
tggacagttacttaaacagcccgct

SEQ ID NO: 485644 - DNA, 25 bp, Mus musculus
tggacatatatgtggtcaactgtgc

SEQ ID NO: 485645 - DNA, 25 bp, Mus musculus
tggacatattcttacctggcaacgc

SEQ ID NO: 485646 - DNA, 25 bp, Mus musculus
tggacatcagcattccaccttctgc

SEQ ID NO: 485647 - DNA, 25 bp, Mus musculus
tggacatctgctgccggaagggatc

SEQ ID NO: 485648 - DNA, 25 bp, Mus musculus
tggacatgctagtgagctcagactg

SEQ ID NO: 485649 - DNA, 25 bp, Mus musculus
tggacatggacactctttgcgggcc

SEQ ID NO: 485650 - DNA, 25 bp, Mus musculus
tggacattgactaccctcacgtgcg

SEQ ID NO: 485651 - DNA, 25 bp, Mus musculus
tggacattgataccaagttcggctg

SEQ ID NO: 485652 - DNA, 25 bp, Mus musculus
tggacatttgtcactggtagataga

SEQ ID NO: 485653 - DNA, 25 bp, Mus musculus
tggacattttgctctctcgggacaa

SEQ ID NO: 485654 - DNA, 25 bp, Mus musculus
tggaccaaaccataaattgctcctg

SEQ ID NO: 485655 - DNA, 25 bp, Mus musculus
tggaccaacacgatgtgcgcctggt

SEQ ID NO: 485656 - DNA, 25 bp, Mus musculus
tggaccaagactgctgcctgccagg

SEQ ID NO: 485657 - DNA, 25 bp, Mus musculus
tggaccaagcatggacaagctactg

SEQ ID NO: 485658 - DNA, 25 bp, Mus musculus
tggaccaagctatagtaggccggct

SEQ ID NO: 485659 - DNA, 25 bp, Mus musculus
tggaccaaggctcgactgtttgaca

SEQ ID NO: 485660 - DNA, 25 bp, Mus musculus
tggaccaaggctcgctctagctgag

SEQ ID NO: 485661 - DNA, 25 bp, Mus musculus
tggaccaagtcagtgggatccctgg

SEQ ID NO: 485662 - DNA, 25 bp, Mus musculus
tggaccacagttggcattgtcatca

SEQ ID NO: 485663 - DNA, 25 bp, Mus musculus
tggaccacattcatgaaggcccggc

SEQ ID NO: 485664 - DNA, 25 bp, Mus musculus
tggaccacctcatcaataacgaccg

SEQ ID NO: 485665 - DNA, 25 bp, Mus musculus
tggaccacctccgaaacaagacaga

SEQ ID NO: 485666 - DNA, 25 bp, Mus musculus
tggaccactgaagactcgacgatag

SEQ ID NO: 485667 - DNA, 25 bp, Mus musculus
tggaccacttgaaagccacaactga

SEQ ID NO: 485668 - DNA, 25 bp, Mus musculus
tggaccacttggacgtagaaaggcg

SEQ ID NO: 485669 - DNA, 25 bp, Mus musculus
tggaccagacagtagcacaatcctg

SEQ ID NO: 485670 - DNA, 25 bp, Mus musculus
tggaccagacgacttttcctccctg

SEQ ID NO: 485671 - DNA, 25 bp, Mus musculus
tggaccagcctcatagtacctgcgg

SEQ ID NO: 485672 - DNA, 25 bp, Mus musculus
tggaccaggaactcaaacttttcgt

SEQ ID NO: 485673 - DNA, 25 bp, Mus musculus
tggaccaggacaaacaaacagcatg

SEQ ID NO: 485674 - DNA, 25 bp, Mus musculus
tggaccaggcccaacatctgatggg

SEQ ID NO: 485675 - DNA, 25 bp, Mus musculus
tggaccagtagggagcttaccgcct

SEQ ID NO: 485676 - DNA, 25 bp, Mus musculus
tggaccatccgtcagtatgcaggct

SEQ ID NO: 485677 - DNA, 25 bp, Mus musculus
tggaccatcctgagctacgtaataa

SEQ ID NO: 485678 - DNA, 25 bp, Mus musculus
tggaccatcgatccggctagcgagt

SEQ ID NO: 485679 - DNA, 25 bp, Mus musculus
tggaccatgaatctcaggaggagcc

SEQ ID NO: 485680 - DNA, 25 bp, Mus musculus
tggaccatggactgacccttctgac

SEQ ID NO: 485681 - DNA, 25 bp, Mus musculus
tggaccattactgacacctgcaggt

SEQ ID NO: 485682 - DNA, 25 bp, Mus musculus
tggacccacactaggaactagcctc

SEQ ID NO: 485683 - DNA, 25 bp, Mus musculus
tggacccacagaggttcaaagccca

SEQ ID NO: 485684 - DNA, 25 bp, Mus musculus
tggaccccaggaatgagcagattgt

SEQ ID NO: 485685 - DNA, 25 bp, Mus musculus
tggaccccggattgcatcataaagc

SEQ ID NO: 485686 - DNA, 25 bp, Mus musculus
tggaccccggctatgtgactactca

SEQ ID NO: 485687 - DNA, 25 bp, Mus musculus
tggacccctatttgcccggctagtg

SEQ ID NO: 485688 - DNA, 25 bp, Mus musculus
tggacccctctgaacatggtggtgg

SEQ ID NO: 485689 - DNA, 25 bp, Mus musculus
tggacccggaaatagacacaatgtg

SEQ ID NO: 485690 - DNA, 25 bp, Mus musculus
tggaccctaggatcacagtggcttg

SEQ ID NO: 485691 - DNA, 25 bp, Mus musculus
tggaccctcaaactgcaagatgaag

SEQ ID NO: 485692 - DNA, 25 bp, Mus musculus
tggaccctcacattaccacagagct

SEQ ID NO: 485693 - DNA, 25 bp, Mus musculus
tggaccctgagaaataatgcacgct

SEQ ID NO: 485694 - DNA, 25 bp, Mus musculus
tggaccctgccgttatcaaggtgcg

SEQ ID NO: 485695 - DNA, 25 bp, Mus musculus
tggaccctgtcaccgctatggagat

SEQ ID NO: 485696 - DNA, 25 bp, Mus musculus
tggaccctgtgactatggatgaagc

SEQ ID NO: 485697 - DNA, 25 bp, Mus musculus
tggaccctgtgtgctattagactga

SEQ ID NO: 485698 - DNA, 25 bp, Mus musculus
tggaccgacaagcacccagatctgt

SEQ ID NO: 485699 - DNA, 25 bp, Mus musculus
tggaccgagaaggatcacattgaca

SEQ ID NO: 485700 - DNA, 25 bp, Mus musculus
tggaccgcagcttcacagatcagag

SEQ ID NO: 485701 - DNA, 25 bp, Mus musculus
tggaccgccctgcgagctaacctga

SEQ ID NO: 485702 - DNA, 25 bp, Mus musculus
tggaccgcttcagggagagccttac

SEQ ID NO: 485703 - DNA, 25 bp, Mus musculus
tggaccgggaccacactgtctttgg

SEQ ID NO: 485704 - DNA, 25 bp, Mus musculus
tggaccgtaacaaggatcaggaagt

SEQ ID NO: 485705 - DNA, 25 bp, Mus musculus
tggaccgtctacagaggaaagccct

SEQ ID NO: 485706 - DNA, 25 bp, Mus musculus
tggacctaaagacagagctgccccg

SEQ ID NO: 485707 - DNA, 25 bp, Mus musculus
tggacctaatgggaagcagtttaca

SEQ ID NO: 485708 - DNA, 25 bp, Mus musculus
tggacctagaatggtgagccctgcc

SEQ ID NO: 485709 - DNA, 25 bp, Mus musculus
tggacctagtcagcctcagaaagaa

SEQ ID NO: 485710 - DNA, 25 bp, Mus musculus
tggacctcactggacccagttcaga

SEQ ID NO: 485711 - DNA, 25 bp, Mus musculus
tggacctcagaataaacacaagcgg

SEQ ID NO: 485712 - DNA, 25 bp, Mus musculus
tggacctcagtcaagttagcatgct

SEQ ID NO: 485713 - DNA, 25 bp, Mus musculus
tggacctcgatgtcccagacagtgg

SEQ ID NO: 485714 - DNA, 25 bp, Mus musculus
tggacctcggagacatggtctgtac

SEQ ID NO: 485715 - DNA, 25 bp, Mus musculus
tggacctcggcgtactttcagaccc

SEQ ID NO: 485716 - DNA, 25 bp, Mus musculus
tggacctctgagtacgacccattgg

SEQ ID NO: 485717 - DNA, 25 bp, Mus musculus
tggacctctgcccaagaagagggac

SEQ ID NO: 485718 - DNA, 25 bp, Mus musculus
tggacctctgcctaggaaccaggag

SEQ ID NO: 485719 - DNA, 25 bp, Mus musculus
tggacctgagatgtttgcttgcttc

SEQ ID NO: 485720 - DNA, 25 bp, Mus musculus
tggacctggagacccttcaagctct

SEQ ID NO: 485721 - DNA, 25 bp, Mus musculus
tggacctggcgagagagtttctacc

SEQ ID NO: 485722 - DNA, 25 bp, Mus musculus
tggacctgggtgacaaccttcctgc

SEQ ID NO: 485723 - DNA, 25 bp, Mus musculus
tggacctgtacaacgccatggcggt

SEQ ID NO: 485724 - DNA, 25 bp, Mus musculus
tggaccttcgctgcgcgacttcggg

SEQ ID NO: 485725 - DNA, 25 bp, Mus musculus
tggaccttgcccagaaacacttgag

SEQ ID NO: 485726 - DNA, 25 bp, Mus musculus
tggaccttgggcttatctaaatgtg

SEQ ID NO: 485727 - DNA, 25 bp, Mus musculus
tggaccttttcgagggagatgtgaa

SEQ ID NO: 485728 - DNA, 25 bp, Mus musculus
tggacgaaatgcagctggagaactc

SEQ ID NO: 485729 - DNA, 25 bp, Mus musculus
tggacgaacgtcacgtgacacggaa

SEQ ID NO: 485730 - DNA, 25 bp, Mus musculus
tggacgacaccttctacctgagcaa

SEQ ID NO: 485731 - DNA, 25 bp, Mus musculus
tggacgacagtagtgaaaccggctg

SEQ ID NO: 485732 - DNA, 25 bp, Mus musculus
tggacgaccacaagacgatgcctgg

SEQ ID NO: 485733 - DNA, 25 bp, Mus musculus
tggacgaccagagatagagataccc

SEQ ID NO: 485734 - DNA, 25 bp, Mus musculus
tggacgacgcgcagaagaaactgat

SEQ ID NO: 485735 - DNA, 25 bp, Mus musculus
tggacgacttcgaaaccctgatcag

SEQ ID NO: 485736 - DNA, 25 bp, Mus musculus
tggacgagctgaccctgactagagc

SEQ ID NO: 485737 - DNA, 25 bp, Mus musculus
tggacgaggtttgcacgggtctacc

SEQ ID NO: 485738 - DNA, 25 bp, Mus musculus
tggacgataaaagcttcacagagag

SEQ ID NO: 485739 - DNA, 25 bp, Mus musculus
tggacgatctcttcaagctgggcga

SEQ ID NO: 485740 - DNA, 25 bp, Mus musculus
tggacgatgagtttgagcggcccac

SEQ ID NO: 485741 - DNA, 25 bp, Mus musculus
tggacgcaaaggtgagaaactcgct

SEQ ID NO: 485742 - DNA, 25 bp, Mus musculus
tggacgcaggccttgagaacaacct

SEQ ID NO: 485743 - DNA, 25 bp, Mus musculus
tggacgcataacttcaaggaccgct

SEQ ID NO: 485744 - DNA, 25 bp, Mus musculus
tggacgccaagctccctgaaagaga

SEQ ID NO: 485745 - DNA, 25 bp, Mus musculus
tggacgccatagatctcactgacaa

SEQ ID NO: 485746 - DNA, 25 bp, Mus musculus
tggacgccatcaagctcttcgtggg

SEQ ID NO: 485747 - DNA, 25 bp, Mus musculus
tggacgcgatcaagggaaagcagtt

SEQ ID NO: 485748 - DNA, 25 bp, Mus musculus
tggacgcggcgctttgcaaaaccaa

SEQ ID NO: 485749 - DNA, 25 bp, Mus musculus
tggacgctagccaacgggtggaaca

SEQ ID NO: 485750 - DNA, 25 bp, Mus musculus
tggacgctatctgtccccgtggcag

SEQ ID NO: 485751 - DNA, 25 bp, Mus musculus
tggacgctccgttacagtttattca

SEQ ID NO: 485752 - DNA, 25 bp, Mus musculus
tggacgctctgttaacagttataga

SEQ ID NO: 485753 - DNA, 25 bp, Mus musculus
tggacggactctataagctgggctt

SEQ ID NO: 485754 - DNA, 25 bp, Mus musculus
tggacggcattaagaattcaagctg

SEQ ID NO: 485755 - DNA, 25 bp, Mus musculus
tggacggcctacgacatggacatct

SEQ ID NO: 485756 - DNA, 25 bp, Mus musculus
tggacggcctaggtgacccaattaa

SEQ ID NO: 485757 - DNA, 25 bp, Mus musculus
tggacggctgcgtggaaccaaaact

SEQ ID NO: 485758 - DNA, 25 bp, Mus musculus
tggacggtaagatggccaatgccca

SEQ ID NO: 485759 - DNA, 25 bp, Mus musculus
tggacggtcccacaacagatgaggt

SEQ ID NO: 485760 - DNA, 25 bp, Mus musculus
tggacgtcacttagctagacccagg

SEQ ID NO: 485761 - DNA, 25 bp, Mus musculus
tggacgtcaggtgccacaaaagcct

SEQ ID NO: 485762 - DNA, 25 bp, Mus musculus
tggacgtcatcagcccaagtgtcgc

SEQ ID NO: 485763 - DNA, 25 bp, Mus musculus
tggacgtcctgccaaaaataagagg

SEQ ID NO: 485764 - DNA, 25 bp, Mus musculus
tggacgtgaacagcacttggaggac

SEQ ID NO: 485765 - DNA, 25 bp, Mus musculus
tggacgtggaaaagtggccgaggag

SEQ ID NO: 485766 - DNA, 25 bp, Mus musculus
tggacgtggacaaagagactctgca

SEQ ID NO: 485767 - DNA, 25 bp, Mus musculus
tggactaatcaagaacaactgcccg

SEQ ID NO: 485768 - DNA, 25 bp, Mus musculus
tggactaccacctgctgatgatgtt

SEQ ID NO: 485769 - DNA, 25 bp, Mus musculus
tggactacgctgtggagcaggctca

SEQ ID NO: 485770 - DNA, 25 bp, Mus musculus
tggactacgtccgagaacacaagga

SEQ ID NO: 485771 - DNA, 25 bp, Mus musculus
tggactactacctgatggatgctgc

SEQ ID NO: 485772 - DNA, 25 bp, Mus musculus
tggactactcggagggcttgtccgc

SEQ ID NO: 485773 - DNA, 25 bp, Mus musculus
tggactactggaactaaggccctgg

SEQ ID NO: 485774 - DNA, 25 bp, Mus musculus
tggactacttgcagagttcaggagg

SEQ ID NO: 485775 - DNA, 25 bp, Mus musculus
tggactagtgtggaggtttactttt

SEQ ID NO: 485776 - DNA, 25 bp, Mus musculus
tggactatactgagcaggcctggaa

SEQ ID NO: 485777 - DNA, 25 bp, Mus musculus
tggactattaccagggcaggctcag

SEQ ID NO: 485778 - DNA, 25 bp, Mus musculus
tggactcaaagcgtgtgcctcggga

SEQ ID NO: 485779 - DNA, 25 bp, Mus musculus
tggactcaactgcagcgtcgctaga

SEQ ID NO: 485780 - DNA, 25 bp, Mus musculus
tggactcaagcccatgagacccagc

SEQ ID NO: 485781 - DNA, 25 bp, Mus musculus
tggactcaagttttaccccagggct

SEQ ID NO: 485782 - DNA, 25 bp, Mus musculus
tggactcacccaaaagagctgctga

SEQ ID NO: 485783 - DNA, 25 bp, Mus musculus
tggactcacctcctgcacagtagga

SEQ ID NO: 485784 - DNA, 25 bp, Mus musculus
tggactcagacaatgacgggcttgg

SEQ ID NO: 485785 - DNA, 25 bp, Mus musculus
tggactcagctctcctgtcgtggag

SEQ ID NO: 485786 - DNA, 25 bp, Mus musculus
tggactcaggcttccacagcgttga

SEQ ID NO: 485787 - DNA, 25 bp, Mus musculus
tggactcaggtgagagacccagagc

SEQ ID NO: 485788 - DNA, 25 bp, Mus musculus
tggactcatgcacagaacactatgc

SEQ ID NO: 485789 - DNA, 25 bp, Mus musculus
tggactccaccatgcaaatcagaac

SEQ ID NO: 485790 - DNA, 25 bp, Mus musculus
tggactccactacctaagcgactgt

SEQ ID NO: 485791 - DNA, 25 bp, Mus musculus
tggactccagaataagttcaatatg

SEQ ID NO: 485792 - DNA, 25 bp, Mus musculus
tggactcccactagagaacaggcga

SEQ ID NO: 485793 - DNA, 25 bp, Mus musculus
tggactcccggcttcctaacagtga

SEQ ID NO: 485794 - DNA, 25 bp, Mus musculus
tggactcctctgcatcttagcagga

SEQ ID NO: 485795 - DNA, 25 bp, Mus musculus
tggactccttcaacccaaatgaggt

SEQ ID NO: 485796 - DNA, 25 bp, Mus musculus
tggactcctttaactgggctcaaga

SEQ ID NO: 485797 - DNA, 25 bp, Mus musculus
tggactcgctcctccttacagctga

SEQ ID NO: 485798 - DNA, 25 bp, Mus musculus
tggactcgcttcaaacaaggatgct

SEQ ID NO: 485799 - DNA, 25 bp, Mus musculus
tggactcggcctcatctccactgaa

SEQ ID NO: 485800 - DNA, 25 bp, Mus musculus
tggactctatcgatgcccgtgaacg

SEQ ID NO: 485801 - DNA, 25 bp, Mus musculus
tggactctatgccacgccggttgga

SEQ ID NO: 485802 - DNA, 25 bp, Mus musculus
tggactctgaatcccactcggagaa

SEQ ID NO: 485803 - DNA, 25 bp, Mus musculus
tggactctgccctctttgaacggaa

SEQ ID NO: 485804 - DNA, 25 bp, Mus musculus
tggactctgtgaagcaaccctgtgt

SEQ ID NO: 485805 - DNA, 25 bp, Mus musculus
tggactcttctcagctgatcccaag

SEQ ID NO: 485806 - DNA, 25 bp, Mus musculus
tggactcttgcaccagagaggagac

SEQ ID NO: 485807 - DNA, 25 bp, Mus musculus
tggactgaccctcgctctatctctg

SEQ ID NO: 485808 - DNA, 25 bp, Mus musculus
tggactgacgtcatccgacttggca

SEQ ID NO: 485809 - DNA, 25 bp, Mus musculus
tggactgactgactacctttgagca

SEQ ID NO: 485810 - DNA, 25 bp, Mus musculus
tggactgagtatcccacaaggcatc

SEQ ID NO: 485811 - DNA, 25 bp, Mus musculus
tggactgagtcacacttcaccctca

SEQ ID NO: 485812 - DNA, 25 bp, Mus musculus
tggactgagtttccacagtagcttc

SEQ ID NO: 485813 - DNA, 25 bp, Mus musculus
tggactgcatcctggacctgagctg

SEQ ID NO: 485814 - DNA, 25 bp, Mus musculus
tggactgccccgaaacaccgtgatc

SEQ ID NO: 485815 - DNA, 25 bp, Mus musculus
tggactgcctgccaaatactgagag

SEQ ID NO: 485816 - DNA, 25 bp, Mus musculus
tggactgcgttgcactttcctgtaa

SEQ ID NO: 485817 - DNA, 25 bp, Mus musculus
tggactggctgagtaagacatctgg

SEQ ID NO: 485818 - DNA, 25 bp, Mus musculus
tggactgggccaagaacaataagct

SEQ ID NO: 485819 - DNA, 25 bp, Mus musculus
tggactggttttcacctagcagctc

SEQ ID NO: 485820 - DNA, 25 bp, Mus musculus
tggactgtactgagggcgctatcga

SEQ ID NO: 485821 - DNA, 25 bp, Mus musculus
tggactgtggactgggtaaccccgt

SEQ ID NO: 485822 - DNA, 25 bp, Mus musculus
tggacttacagagcccaaccatggg

SEQ ID NO: 485823 - DNA, 25 bp, Mus musculus
tggacttacatactctggcctcaga

SEQ ID NO: 485824 - DNA, 25 bp, Mus musculus
tggacttagctttccaaccccggct

SEQ ID NO: 485825 - DNA, 25 bp, Mus musculus
tggacttcaacatagctagagcctg

SEQ ID NO: 485826 - DNA, 25 bp, Mus musculus
tggacttcaccacttttggagattg

SEQ ID NO: 485827 - DNA, 25 bp, Mus musculus
tggacttccaagacaacaggcattg

SEQ ID NO: 485828 - DNA, 25 bp, Mus musculus
tggacttccacaacaacctcgtggg

SEQ ID NO: 485829 - DNA, 25 bp, Mus musculus
tggacttccagaacgccgtgtgtgc

SEQ ID NO: 485830 - DNA, 25 bp, Mus musculus
tggacttccgaaggctggctacagc

SEQ ID NO: 485831 - DNA, 25 bp, Mus musculus
tggacttccgagaccttcctaggaa

SEQ ID NO: 485832 - DNA, 25 bp, Mus musculus
tggacttcgaggacccctatgagga

SEQ ID NO: 485833 - DNA, 25 bp, Mus musculus
tggacttcgtcatgaagcaagccct

SEQ ID NO: 485834 - DNA, 25 bp, Mus musculus
tggacttgaacatgacccgagcaca

SEQ ID NO: 485835 - DNA, 25 bp, Mus musculus
tggacttgcctgctggctacaaact

SEQ ID NO: 485836 - DNA, 25 bp, Mus musculus
tggacttggtagtgcctgctcttgg

SEQ ID NO: 485837 - DNA, 25 bp, Mus musculus
tggacttggtcagaacccctcagat

SEQ ID NO: 485838 - DNA, 25 bp, Mus musculus
tggacttgtaacacgagactgggtt

SEQ ID NO: 485839 - DNA, 25 bp, Mus musculus
tggactttacatactcacgcctgtt

SEQ ID NO: 485840 - DNA, 25 bp, Mus musculus
tggactttacccagtggctcatggt

SEQ ID NO: 485841 - DNA, 25 bp, Mus musculus
tggactttccatccctgaaggcggt

SEQ ID NO: 485842 - DNA, 25 bp, Mus musculus
tggactttgagcacgtgcagcacgt

SEQ ID NO: 485843 - DNA, 25 bp, Mus musculus
tggactttgatcgagcacagcgggc

SEQ ID NO: 485844 - DNA, 25 bp, Mus musculus
tggagaaaacatgactggagccgct

SEQ ID NO: 485845 - DNA, 25 bp, Mus musculus
tggagaaaagcctggagttctggca

SEQ ID NO: 485846 - DNA, 25 bp, Mus musculus
tggagaaaccgcttcagcctggtgc

SEQ ID NO: 485847 - DNA, 25 bp, Mus musculus
tggagaaacgccacatcactgcgac

SEQ ID NO: 485848 - DNA, 25 bp, Mus musculus
tggagaaagcctgggccagcctgta

SEQ ID NO: 485849 - DNA, 25 bp, Mus musculus
tggagaaataagaggttcaagagct

SEQ ID NO: 485850 - DNA, 25 bp, Mus musculus
tggagaaatcagtcagccgaaggcg

SEQ ID NO: 485851 - DNA, 25 bp, Mus musculus
tggagaaatgcattcaacattggcc

SEQ ID NO: 485852 - DNA, 25 bp, Mus musculus
tggagaacagccctgtccgctccag

SEQ ID NO: 485853 - DNA, 25 bp, Mus musculus
tggagaacagctggctcgaatggaa

SEQ ID NO: 485854 - DNA, 25 bp, Mus musculus
tggagaacatggtgaatccccgaac

SEQ ID NO: 485855 - DNA, 25 bp, Mus musculus
tggagaacccaaaagcaagtagctg

SEQ ID NO: 485856 - DNA, 25 bp, Mus musculus
tggagaacccagcagatccttactg

SEQ ID NO: 485857 - DNA, 25 bp, Mus musculus
tggagaacctgtagaaaagatcacc

SEQ ID NO: 485858 - DNA, 25 bp, Mus musculus
tggagaacgcgctggagcacagcat

SEQ ID NO: 485859 - DNA, 25 bp, Mus musculus
tggagaactattacagcctgccggg

SEQ ID NO: 485860 - DNA, 25 bp, Mus musculus
tggagaactcccaaaatcacagcgg

SEQ ID NO: 485861 - DNA, 25 bp, Mus musculus
tggagaacttctgccctagcagtgc

SEQ ID NO: 485862 - DNA, 25 bp, Mus musculus
tggagaagaagcttccgcccttgcc

SEQ ID NO: 485863 - DNA, 25 bp, Mus musculus
tggagaagactgatcacaggctgaa

SEQ ID NO: 485864 - DNA, 25 bp, Mus musculus
tggagaagcacaagtcgcagctact

SEQ ID NO: 485865 - DNA, 25 bp, Mus musculus
tggagaagccactatggagaccagc

SEQ ID NO: 485866 - DNA, 25 bp, Mus musculus
tggagaagcccaactcatcggtggc

SEQ ID NO: 485867 - DNA, 25 bp, Mus musculus
tggagaagcccacaaatcgcactgg

SEQ ID NO: 485868 - DNA, 25 bp, Mus musculus
tggagaaggaacaggatgtactgcc

SEQ ID NO: 485869 - DNA, 25 bp, Mus musculus
tggagaaggatcattaatacaggtc

SEQ ID NO: 485870 - DNA, 25 bp, Mus musculus
tggagaagtacaaacagcgcgtgtg

SEQ ID NO: 485871 - DNA, 25 bp, Mus musculus
tggagaagtaccctcgaagccgtgc

SEQ ID NO: 485872 - DNA, 25 bp, Mus musculus
tggagaataacccataccggagccg

SEQ ID NO: 485873 - DNA, 25 bp, Mus musculus
tggagaatctcagcggggcacagac

SEQ ID NO: 485874 - DNA, 25 bp, Mus musculus
tggagaatctctactgggcaaagcc

SEQ ID NO: 485875 - DNA, 25 bp, Mus musculus
tggagaatcttcaggaaccactggg

SEQ ID NO: 485876 - DNA, 25 bp, Mus musculus
tggagaatcttgtgatgcagacctg

SEQ ID NO: 485877 - DNA, 25 bp, Mus musculus
tggagaatgaagaccttgccgtagc

SEQ ID NO: 485878 - DNA, 25 bp, Mus musculus
tggagaatgccaacagcagtgtcgc

SEQ ID NO: 485879 - DNA, 25 bp, Mus musculus
tggagaatttcatcaaggtgcagct

SEQ ID NO: 485880 - DNA, 25 bp, Mus musculus
tggagaatttccacagggcagccgt

SEQ ID NO: 485881 - DNA, 25 bp, Mus musculus
tggagacaactcctagctctgtgac

SEQ ID NO: 485882 - DNA, 25 bp, Mus musculus
tggagacaagccagttcagaatgca

SEQ ID NO: 485883 - DNA, 25 bp, Mus musculus
tggagacaattcctcttgtggtagc

SEQ ID NO: 485884 - DNA, 25 bp, Mus musculus
tggagacacccgttacagaacctgg

SEQ ID NO: 485885 - DNA, 25 bp, Mus musculus
tggagacagaatacccagcttctgg

SEQ ID NO: 485886 - DNA, 25 bp, Mus musculus
tggagacagagaccccagataatta

SEQ ID NO: 485887 - DNA, 25 bp, Mus musculus
tggagacagcaccaagagcaacttg

SEQ ID NO: 485888 - DNA, 25 bp, Mus musculus
tggagacagcattaccagtcacggt

SEQ ID NO: 485889 - DNA, 25 bp, Mus musculus
tggagacaggttcataacagccgtg

SEQ ID NO: 485890 - DNA, 25 bp, Mus musculus
tggagacagtgctaacctctagacc

SEQ ID NO: 485891 - DNA, 25 bp, Mus musculus
tggagacatacagtgacctggcagc

SEQ ID NO: 485892 - DNA, 25 bp, Mus musculus
tggagacatgactgacgactacgtg

SEQ ID NO: 485893 - DNA, 25 bp, Mus musculus
tggagaccaaagagcaagaacagaa

SEQ ID NO: 485894 - DNA, 25 bp, Mus musculus
tggagaccaacaggagaagcactac

SEQ ID NO: 485895 - DNA, 25 bp, Mus musculus
tggagaccagctgggagaccaaact

SEQ ID NO: 485896 - DNA, 25 bp, Mus musculus
tggagaccatcctgagaacatctgg

SEQ ID NO: 485897 - DNA, 25 bp, Mus musculus
tggagaccccacgacatatgaagct

SEQ ID NO: 485898 - DNA, 25 bp, Mus musculus
tggagacctgatgttccttctgagt

SEQ ID NO: 485899 - DNA, 25 bp, Mus musculus
tggagacctgcctgctaatgactgt

SEQ ID NO: 485900 - DNA, 25 bp, Mus musculus
tggagacctggttaactgtggaaga

SEQ ID NO: 485901 - DNA, 25 bp, Mus musculus
tggagacgatggacagagacagcaa

SEQ ID NO: 485902 - DNA, 25 bp, Mus musculus
tggagacgccggattcctacgtgtg

SEQ ID NO: 485903 - DNA, 25 bp, Mus musculus
tggagacgcctggaaagtggacctt

SEQ ID NO: 485904 - DNA, 25 bp, Mus musculus
tggagacggcatcctcagctgagaa

SEQ ID NO: 485905 - DNA, 25 bp, Mus musculus
tggagacgggtttgttcttctatgt

SEQ ID NO: 485906 - DNA, 25 bp, Mus musculus
tggagacgttcctcagcctggagaa

SEQ ID NO: 485907 - DNA, 25 bp, Mus musculus
tggagactacacaccagggaggatg

SEQ ID NO: 485908 - DNA, 25 bp, Mus musculus
tggagactacgaagacctgcaaact

SEQ ID NO: 485909 - DNA, 25 bp, Mus musculus
tggagactaggacaacctcagaaac

SEQ ID NO: 485910 - DNA, 25 bp, Mus musculus
tggagactcatcctcagactctacc

SEQ ID NO: 485911 - DNA, 25 bp, Mus musculus
tggagactccttcgtgcaaaaatgg

SEQ ID NO: 485912 - DNA, 25 bp, Mus musculus
tggagactcggatttgcccaccagt

SEQ ID NO: 485913 - DNA, 25 bp, Mus musculus
tggagactctaaggatatccgcctc

SEQ ID NO: 485914 - DNA, 25 bp, Mus musculus
tggagactctggacttggcctctgt

SEQ ID NO: 485915 - DNA, 25 bp, Mus musculus
tggagactgcacacttgaccctggt

SEQ ID NO: 485916 - DNA, 25 bp, Mus musculus
tggagactgcgctgaccgagaataa

SEQ ID NO: 485917 - DNA, 25 bp, Mus musculus
tggagactggagtcacacggcagaa

SEQ ID NO: 485918 - DNA, 25 bp, Mus musculus
tggagactgtttcaaagacggtttt

SEQ ID NO: 485919 - DNA, 25 bp, Mus musculus
tggagacttcttcggagaccctggc

SEQ ID NO: 485920 - DNA, 25 bp, Mus musculus
tggagactttgcagcctgagggcca

SEQ ID NO: 485921 - DNA, 25 bp, Mus musculus
tggagagaaatgtcgaagaaacatg

SEQ ID NO: 485922 - DNA, 25 bp, Mus musculus
tggagagatatatacactggagcac

SEQ ID NO: 485923 - DNA, 25 bp, Mus musculus
tggagagatcaatcccgtgtcggcc

SEQ ID NO: 485924 - DNA, 25 bp, Mus musculus
tggagagcaaggaaagataccagct

SEQ ID NO: 485925 - DNA, 25 bp, Mus musculus
tggagagcatccttcagcacctgga

SEQ ID NO: 485926 - DNA, 25 bp, Mus musculus
tggagagcatgaacccctttaccgg

SEQ ID NO: 485927 - DNA, 25 bp, Mus musculus
tggagagccagtactcatcccttgg

SEQ ID NO: 485928 - DNA, 25 bp, Mus musculus
tggagagccgccacgatgcttcaga

SEQ ID NO: 485929 - DNA, 25 bp, Mus musculus
tggagagcggacagcattaccttgc

SEQ ID NO: 485930 - DNA, 25 bp, Mus musculus
tggagagctgtgcttactgctgtcc

SEQ ID NO: 485931 - DNA, 25 bp, Mus musculus
tggagaggaagtggtcactctaacc

SEQ ID NO: 485932 - DNA, 25 bp, Mus musculus
tggagaggagcttcgccaagactca

SEQ ID NO: 485933 - DNA, 25 bp, Mus musculus
tggagaggattttatcgaacagttc

SEQ ID NO: 485934 - DNA, 25 bp, Mus musculus
tggagaggccctaacacctgaagga

SEQ ID NO: 485935 - DNA, 25 bp, Mus musculus
tggagaggccctccagaccaaaccg

SEQ ID NO: 485936 - DNA, 25 bp, Mus musculus
tggagaggcctacccctaagatgct

SEQ ID NO: 485937 - DNA, 25 bp, Mus musculus
tggagagggctcactggatcccaat

SEQ ID NO: 485938 - DNA, 25 bp, Mus musculus
tggagaggtagaaaaggcacacaaa

SEQ ID NO: 485939 - DNA, 25 bp, Mus musculus
tggagagtccaccagaccaggtaaa

SEQ ID NO: 485940 - DNA, 25 bp, Mus musculus
tggagagtccattaagaatctagac

SEQ ID NO: 485941 - DNA, 25 bp, Mus musculus
tggagagtgtatcacctcatttccg

SEQ ID NO: 485942 - DNA, 25 bp, Mus musculus
tggagagttccacgtgtataggcac

SEQ ID NO: 485943 - DNA, 25 bp, Mus musculus
tggagataccttcaccacctgggca

SEQ ID NO: 485944 - DNA, 25 bp, Mus musculus
tggagataggacaagcacattttgt

SEQ ID NO: 485945 - DNA, 25 bp, Mus musculus
tggagatcatctacaccgagcctgt

SEQ ID NO: 485946 - DNA, 25 bp, Mus musculus
tggagatccgcgagcgcagccatgc

SEQ ID NO: 485947 - DNA, 25 bp, Mus musculus
tggagatctacagggctagcaggcc

SEQ ID NO: 485948 - DNA, 25 bp, Mus musculus
tggagatctctcgagcagcagcaga

SEQ ID NO: 485949 - DNA, 25 bp, Mus musculus
tggagatcttctacagaggccggtg

SEQ ID NO: 485950 - DNA, 25 bp, Mus musculus
tggagatgaaagacgtccgccagct

SEQ ID NO: 485951 - DNA, 25 bp, Mus musculus
tggagatgccgctggttctggacca

SEQ ID NO: 485952 - DNA, 25 bp, Mus musculus
tggagatggtgtttcactgccgccc

SEQ ID NO: 485953 - DNA, 25 bp, Mus musculus
tggagatgtcatggaatagccagga

SEQ ID NO: 485954 - DNA, 25 bp, Mus musculus
tggagattcaccttcagacggatgc

SEQ ID NO: 485955 - DNA, 25 bp, Mus musculus
tggagattggacaccgaccagagga

SEQ ID NO: 485956 - DNA, 25 bp, Mus musculus
tggagatttaagaccagagcagcag

SEQ ID NO: 485957 - DNA, 25 bp, Mus musculus
tggagatttcaatgtggcagctact

SEQ ID NO: 485958 - DNA, 25 bp, Mus musculus
tggagcaaacctcaagccagctgtg

SEQ ID NO: 485959 - DNA, 25 bp, Mus musculus
tggagcaagacagataaagccccgc

SEQ ID NO: 485960 - DNA, 25 bp, Mus musculus
tggagcaagttagaaaagcccctgc

SEQ ID NO: 485961 - DNA, 25 bp, Mus musculus
tggagcaatggcacctacaatgagt

SEQ ID NO: 485962 - DNA, 25 bp, Mus musculus
tggagcacaaaaactggacgaggcc

SEQ ID NO: 485963 - DNA, 25 bp, Mus musculus
tggagcacaaccgacgcggattctg

SEQ ID NO: 485964 - DNA, 25 bp, Mus musculus
tggagcacatcgtgggccagctgga

SEQ ID NO: 485965 - DNA, 25 bp, Mus musculus
tggagcaccgtcaacctggatgagg

SEQ ID NO: 485966 - DNA, 25 bp, Mus musculus
tggagcacgagctgtacctctctcg

SEQ ID NO: 485967 - DNA, 25 bp, Mus musculus
tggagcagaacccactcaaggcaaa

SEQ ID NO: 485968 - DNA, 25 bp, Mus musculus
tggagcagagcaacacttactgtct

SEQ ID NO: 485969 - DNA, 25 bp, Mus musculus
tggagcaggccacacagttcagtgc

SEQ ID NO: 485970 - DNA, 25 bp, Mus musculus
tggagcaggctgtactattaatgac

SEQ ID NO: 485971 - DNA, 25 bp, Mus musculus
tggagcagtacacggcactctttga

SEQ ID NO: 485972 - DNA, 25 bp, Mus musculus
tggagcagttaagcaggacccacag

SEQ ID NO: 485973 - DNA, 25 bp, Mus musculus
tggagcagtttatctcggacacctg

SEQ ID NO: 485974 - DNA, 25 bp, Mus musculus
tggagcatcacaaccttgaacctgg

SEQ ID NO: 485975 - DNA, 25 bp, Mus musculus
tggagcatccactgaatgtcggacc

SEQ ID NO: 485976 - DNA, 25 bp, Mus musculus
tggagcatcccgcaggccttctgtg

SEQ ID NO: 485977 - DNA, 25 bp, Mus musculus
tggagcatcctagcatggtggcaca

SEQ ID NO: 485978 - DNA, 25 bp, Mus musculus
tggagccaaagcaaacactgaacaa

SEQ ID NO: 485979 - DNA, 25 bp, Mus musculus
tggagccaactgcaacctggaagac

SEQ ID NO: 485980 - DNA, 25 bp, Mus musculus
tggagccaagtaccctgcaggaaga

SEQ ID NO: 485981 - DNA, 25 bp, Mus musculus
tggagccaatggacaagtgacctgc

SEQ ID NO: 485982 - DNA, 25 bp, Mus musculus
tggagccaatgtacccaggcgacta

SEQ ID NO: 485983 - DNA, 25 bp, Mus musculus
tggagccacaaagtgagtctagatt

SEQ ID NO: 485984 - DNA, 25 bp, Mus musculus
tggagccacacattaacgcgcagat

SEQ ID NO: 485985 - DNA, 25 bp, Mus musculus
tggagccactgtgaatcggcggcac

SEQ ID NO: 485986 - DNA, 25 bp, Mus musculus
tggagccagcaagaaccccgaggag

SEQ ID NO: 485987 - DNA, 25 bp, Mus musculus
tggagccatctgtgcccgtctggat

SEQ ID NO: 485988 - DNA, 25 bp, Mus musculus
tggagccatgtcatcttgaaagtgc

SEQ ID NO: 485989 - DNA, 25 bp, Mus musculus
tggagccatttcacacatgcacatc

SEQ ID NO: 485990 - DNA, 25 bp, Mus musculus
tggagcccagatcaagcttcgagag

SEQ ID NO: 485991 - DNA, 25 bp, Mus musculus
tggagcccagcaacagaactgcagt

SEQ ID NO: 485992 - DNA, 25 bp, Mus musculus
tggagcccagcgtttctacgacacc

SEQ ID NO: 485993 - DNA, 25 bp, Mus musculus
tggagcccatggagaagcgtcagct

SEQ ID NO: 485994 - DNA, 25 bp, Mus musculus
tggagcccgaaaagggagctgcctc

SEQ ID NO: 485995 - DNA, 25 bp, Mus musculus
tggagcccgagagaaggactgaact

SEQ ID NO: 485996 - DNA, 25 bp, Mus musculus
tggagcccttctaatgtcacgcgag

SEQ ID NO: 485997 - DNA, 25 bp, Mus musculus
tggagccgccccaacatgggctgta

SEQ ID NO: 485998 - DNA, 25 bp, Mus musculus
tggagccggacctgccggccttgag

SEQ ID NO: 485999 - DNA, 25 bp, Mus musculus
tggagccggagaataagtacctgcc

SEQ ID NO: 486000 - DNA, 25 bp, Mus musculus
tggagccgggcatccaaagctgtct

SEQ ID NO: 486001 - DNA, 25 bp, Mus musculus
tggagcctaactgcccagaatctga

SEQ ID NO: 486002 - DNA, 25 bp, Mus musculus
tggagcctcggtttcctcccaagta

SEQ ID NO: 486003 - DNA, 25 bp, Mus musculus
tggagccttcggaaaacgagaaaag

SEQ ID NO: 486004 - DNA, 25 bp, Mus musculus
tggagccttggaacctggagtccct

SEQ ID NO: 486005 - DNA, 25 bp, Mus musculus
tggagcgattgtgataaggctgaca

SEQ ID NO: 486006 - DNA, 25 bp, Mus musculus
tggagcgccgcttcttgcgccagaa

SEQ ID NO: 486007 - DNA, 25 bp, Mus musculus
tggagcgcctctccttggcttactg

SEQ ID NO: 486008 - DNA, 25 bp, Mus musculus
tggagcgcgtcgtgctgcgcctcaa

SEQ ID NO: 486009 - DNA, 25 bp, Mus musculus
tggagcgcttcaccggttcagattt

SEQ ID NO: 486010 - DNA, 25 bp, Mus musculus
tggagcggaaccctacccagtttca

SEQ ID NO: 486011 - DNA, 25 bp, Mus musculus
tggagcggctggtgcatgagttggt

SEQ ID NO: 486012 - DNA, 25 bp, Mus musculus
tggagcgggacgttgtgacatcact

SEQ ID NO: 486013 - DNA, 25 bp, Mus musculus
tggagcgggtactcacagagctgat

SEQ ID NO: 486014 - DNA, 25 bp, Mus musculus
tggagctaggcagtctctagagtct

SEQ ID NO: 486015 - DNA, 25 bp, Mus musculus
tggagctatcccgtgccaaagctgc

SEQ ID NO: 486016 - DNA, 25 bp, Mus musculus
tggagctcaaaaagacacacgctgc

SEQ ID NO: 486017 - DNA, 25 bp, Mus musculus
tggagctcttattttcccactaggc

SEQ ID NO: 486018 - DNA, 25 bp, Mus musculus
tggagctgccccttcatggagacat

SEQ ID NO: 486019 - DNA, 25 bp, Mus musculus
tggagctgcgcaacacgttcaagga

SEQ ID NO: 486020 - DNA, 25 bp, Mus musculus
tggagctggaagtacgtgacctgcc

SEQ ID NO: 486021 - DNA, 25 bp, Mus musculus
tggagctggaccatatgaccaccgg

SEQ ID NO: 486022 - DNA, 25 bp, Mus musculus
tggagctggctcatgctgaccaact

SEQ ID NO: 486023 - DNA, 25 bp, Mus musculus
tggagctgggcaacgaacggcttct

SEQ ID NO: 486024 - DNA, 25 bp, Mus musculus
tggaggaaatagagcacacatgccc

SEQ ID NO: 486025 - DNA, 25 bp, Mus musculus
tggaggaacctgctgacacctttcc

SEQ ID NO: 486026 - DNA, 25 bp, Mus musculus
tggaggaatagggagactgaggaag

SEQ ID NO: 486027 - DNA, 25 bp, Mus musculus
tggaggaatcgtcttcgtcgtcatc

SEQ ID NO: 486028 - DNA, 25 bp, Mus musculus
tggaggacaagataggctttctcct

SEQ ID NO: 486029 - DNA, 25 bp, Mus musculus
tggaggacacttcatgagcacggca

SEQ ID NO: 486030 - DNA, 25 bp, Mus musculus
tggaggaccaagtttgacccgagcc

SEQ ID NO: 486031 - DNA, 25 bp, Mus musculus
tggaggacccaaggacgaaaacgtg

SEQ ID NO: 486032 - DNA, 25 bp, Mus musculus
tggaggacccacaagtggaacaact

SEQ ID NO: 486033 - DNA, 25 bp, Mus musculus
tggaggacccataagactgcggagc

SEQ ID NO: 486034 - DNA, 25 bp, Mus musculus
tggaggacccattccaccaaggtgt

SEQ ID NO: 486035 - DNA, 25 bp, Mus musculus
tggaggactaagaagacagacggct

SEQ ID NO: 486036 - DNA, 25 bp, Mus musculus
tggaggactccaaacctaagtgatg

SEQ ID NO: 486037 - DNA, 25 bp, Mus musculus
tggaggactccggtatctatcagtg

SEQ ID NO: 486038 - DNA, 25 bp, Mus musculus
tggaggacttcaagccccagaatac

SEQ ID NO: 486039 - DNA, 25 bp, Mus musculus
tggaggagaaaaccttcacagagtt

SEQ ID NO: 486040 - DNA, 25 bp, Mus musculus
tggaggagccggttctgaaacactg

SEQ ID NO: 486041 - DNA, 25 bp, Mus musculus
tggaggagcctcaggggtacacacc

SEQ ID NO: 486042 - DNA, 25 bp, Mus musculus
tggaggagcttaacgctgagccctg

SEQ ID NO: 486043 - DNA, 25 bp, Mus musculus
tggaggaggcgagccttccgctact

SEQ ID NO: 486044 - DNA, 25 bp, Mus musculus
tggaggaggtcaccaccaatatgct

SEQ ID NO: 486045 - DNA, 25 bp, Mus musculus
tggaggataagacaccaacagtggc

SEQ ID NO: 486046 - DNA, 25 bp, Mus musculus
tggaggatatcaacaagcgccgaga

SEQ ID NO: 486047 - DNA, 25 bp, Mus musculus
tggaggcaacatcaacgtggagacc

SEQ ID NO: 486048 - DNA, 25 bp, Mus musculus
tggaggcaccaaggaactagccgtg

SEQ ID NO: 486049 - DNA, 25 bp, Mus musculus
tggaggcacctagggcttccctgtc

SEQ ID NO: 486050 - DNA, 25 bp, Mus musculus
tggaggcagaattcaacaacccgtg

SEQ ID NO: 486051 - DNA, 25 bp, Mus musculus
tggaggcagatgtgaaccacgttcc

SEQ ID NO: 486052 - DNA, 25 bp, Mus musculus
tggaggcagctcaccaacatgtgcg

SEQ ID NO: 486053 - DNA, 25 bp, Mus musculus
tggaggcaggcatttcagtagcact

SEQ ID NO: 486054 - DNA, 25 bp, Mus musculus
tggaggcaggctagtttatcactac

SEQ ID NO: 486055 - DNA, 25 bp, Mus musculus
tggaggcatgcctaacagaatgagg

SEQ ID NO: 486056 - DNA, 25 bp, Mus musculus
tggaggccaaggtctgactaaaagc

SEQ ID NO: 486057 - DNA, 25 bp, Mus musculus
tggaggccaatcgtaatgtcaaagc

SEQ ID NO: 486058 - DNA, 25 bp, Mus musculus
tggaggccagcttagaacctggaag

SEQ ID NO: 486059 - DNA, 25 bp, Mus musculus
tggaggcccaggttcataagctgag

SEQ ID NO: 486060 - DNA, 25 bp, Mus musculus
tggaggccctcgatgacgtcttcag

SEQ ID NO: 486061 - DNA, 25 bp, Mus musculus
tggaggccgctatgaaaatcatcac

SEQ ID NO: 486062 - DNA, 25 bp, Mus musculus
tggaggcctgcaaagccgatagcac

SEQ ID NO: 486063 - DNA, 25 bp, Mus musculus
tggaggcgcccttgctggagcctct

SEQ ID NO: 486064 - DNA, 25 bp, Mus musculus
tggaggcgctcatgtccgacaagaa

SEQ ID NO: 486065 - DNA, 25 bp, Mus musculus
tggaggcggtgagtggtcagcgtgg

SEQ ID NO: 486066 - DNA, 25 bp, Mus musculus
tggaggctacaagttgaagagtcaa

SEQ ID NO: 486067 - DNA, 25 bp, Mus musculus
tggaggctgcatcaaccacaaggac

SEQ ID NO: 486068 - DNA, 25 bp, Mus musculus
tggaggcttccagattaaatacgtc

SEQ ID NO: 486069 - DNA, 25 bp, Mus musculus
tggagggaaaacagttgaggtccca

SEQ ID NO: 486070 - DNA, 25 bp, Mus musculus
tggagggaacgaaacactggcgcct

SEQ ID NO: 486071 - DNA, 25 bp, Mus musculus
tggagggccaggtttgcaggagtca

SEQ ID NO: 486072 - DNA, 25 bp, Mus musculus
tggagggccatatcaccacggagat

SEQ ID NO: 486073 - DNA, 25 bp, Mus musculus
tggagggccgatacaaacagaagca

SEQ ID NO: 486074 - DNA, 25 bp, Mus musculus
tggagggctcctctacagccgagaa

SEQ ID NO: 486075 - DNA, 25 bp, Mus musculus
tggagggctgcctagctcagcgctc

SEQ ID NO: 486076 - DNA, 25 bp, Mus musculus
tggaggggaccctcgagtcttcttg

SEQ ID NO: 486077 - DNA, 25 bp, Mus musculus
tggagggttccctcgtagccacttc

SEQ ID NO: 486078 - DNA, 25 bp, Mus musculus
tggagggtttctttgacagtcagct

SEQ ID NO: 486079 - DNA, 25 bp, Mus musculus
tggaggtaaaatgtagatggtaact

SEQ ID NO: 486080 - DNA, 25 bp, Mus musculus
tggaggtacagctggagaacgatca

SEQ ID NO: 486081 - DNA, 25 bp, Mus musculus
tggaggtcaaaagcgccctagtggc

SEQ ID NO: 486082 - DNA, 25 bp, Mus musculus
tggaggtcaccaaaaaagtgggccg

SEQ ID NO: 486083 - DNA, 25 bp, Mus musculus
tggaggtccctatcaacattatgaa

SEQ ID NO: 486084 - DNA, 25 bp, Mus musculus
tggaggtgacctagcattgtacttg

SEQ ID NO: 486085 - DNA, 25 bp, Mus musculus
tggaggtggccgatctcctccgtcg

SEQ ID NO: 486086 - DNA, 25 bp, Mus musculus
tggaggtggtcctgccaagatagaa

SEQ ID NO: 486087 - DNA, 25 bp, Mus musculus
tggaggttgccagaaggtcctcaac

SEQ ID NO: 486088 - DNA, 25 bp, Mus musculus
tggaggttggtctcagcagtaacta

SEQ ID NO: 486089 - DNA, 25 bp, Mus musculus
tggagtacagttaccagagacctgg

SEQ ID NO: 486090 - DNA, 25 bp, Mus musculus
tggagtacctcaaccaagagcaggc

SEQ ID NO: 486091 - DNA, 25 bp, Mus musculus
tggagtacctcaccaaccgcatgaa

SEQ ID NO: 486092 - DNA, 25 bp, Mus musculus
tggagtactgcgacatgaacaatga

SEQ ID NO: 486093 - DNA, 25 bp, Mus musculus
tggagtactgcttcacctgcctggg

SEQ ID NO: 486094 - DNA, 25 bp, Mus musculus
tggagtagctttcgcagtgacacgc

SEQ ID NO: 486095 - DNA, 25 bp, Mus musculus
tggagtatccctatcttcaagctgg

SEQ ID NO: 486096 - DNA, 25 bp, Mus musculus
tggagtatgggcgtgggagaagaac

SEQ ID NO: 486097 - DNA, 25 bp, Mus musculus
tggagtcatccccttgaacgagaag

SEQ ID NO: 486098 - DNA, 25 bp, Mus musculus
tggagtcatctcctctagacagaca

SEQ ID NO: 486099 - DNA, 25 bp, Mus musculus
tggagtcatttgctgccatgcatgt

SEQ ID NO: 486100 - DNA, 25 bp, Mus musculus
tggagtccagtagcccagctgtggt

SEQ ID NO: 486101 - DNA, 25 bp, Mus musculus
tggagtcccggtatctgcaatatga

SEQ ID NO: 486102 - DNA, 25 bp, Mus musculus
tggagtccctgacgcagatcgagct

SEQ ID NO: 486103 - DNA, 25 bp, Mus musculus
tggagtcctcacataacaacaagtt

SEQ ID NO: 486104 - DNA, 25 bp, Mus musculus
tggagtcctcttcagaaaaggcccc

SEQ ID NO: 486105 - DNA, 25 bp, Mus musculus
tggagtccttccttatacagctgtc

SEQ ID NO: 486106 - DNA, 25 bp, Mus musculus
tggagtcgatcttcatgtgcctggc

SEQ ID NO: 486107 - DNA, 25 bp, Mus musculus
tggagtcgctgcatctggtcagccg

SEQ ID NO: 486108 - DNA, 25 bp, Mus musculus
tggagtcggctcagggccatatcct

SEQ ID NO: 486109 - DNA, 25 bp, Mus musculus
tggagtctacgcaacagcaaggaag

SEQ ID NO: 486110 - DNA, 25 bp, Mus musculus
tggagtctatgtgcacactcccgtg

SEQ ID NO: 486111 - DNA, 25 bp, Mus musculus
tggagtctccaaactgcctaactac

SEQ ID NO: 486112 - DNA, 25 bp, Mus musculus
tggagtctctgaacctatagccctg

SEQ ID NO: 486113 - DNA, 25 bp, Mus musculus
tggagtctgaaatcaccatctacct

SEQ ID NO: 486114 - DNA, 25 bp, Mus musculus
tggagtctgactcactgcagaggct

SEQ ID NO: 486115 - DNA, 25 bp, Mus musculus
tggagtctgatcttccttggctcgt

SEQ ID NO: 486116 - DNA, 25 bp, Mus musculus
tggagtctttctcacacagaggcgg

SEQ ID NO: 486117 - DNA, 25 bp, Mus musculus
tggagtgacaggaaaaacagctggc

SEQ ID NO: 486118 - DNA, 25 bp, Mus musculus
tggagtgcaactcacagtgctgacc

SEQ ID NO: 486119 - DNA, 25 bp, Mus musculus
tggagtgccagctccgaaaagaagg

SEQ ID NO: 486120 - DNA, 25 bp, Mus musculus
tggagtgctataactgcctgggagt

SEQ ID NO: 486121 - DNA, 25 bp, Mus musculus
tggagtgctcggctgctctaaccca

SEQ ID NO: 486122 - DNA, 25 bp, Mus musculus
tggagtgctctggaactaagttgtc

SEQ ID NO: 486123 - DNA, 25 bp, Mus musculus
tggagtggaactgccgacaatgaga

SEQ ID NO: 486124 - DNA, 25 bp, Mus musculus
tggagtggcctacgacagcaatgtt

SEQ ID NO: 486125 - DNA, 25 bp, Mus musculus
tggagttagatatgcccagccggac

SEQ ID NO: 486126 - DNA, 25 bp, Mus musculus
tggagttcaacaaagcttctaccct

SEQ ID NO: 486127 - DNA, 25 bp, Mus musculus
tggagttcaagctagcataattcag

SEQ ID NO: 486128 - DNA, 25 bp, Mus musculus
tggagttcactttcaccgggtacac

SEQ ID NO: 486129 - DNA, 25 bp, Mus musculus
tggagttcatctacgcctggagtgg

SEQ ID NO: 486130 - DNA, 25 bp, Mus musculus
tggagttccgacaaatggtgctcaa

SEQ ID NO: 486131 - DNA, 25 bp, Mus musculus
tggagttctgcctcttctgcggctg

SEQ ID NO: 486132 - DNA, 25 bp, Mus musculus
tggagttggccaccacatagtagta

SEQ ID NO: 486133 - DNA, 25 bp, Mus musculus
tggagtttacggaagcagagagcaa

SEQ ID NO: 486134 - DNA, 25 bp, Mus musculus
tggagtttagacctctgtgagccac

SEQ ID NO: 486135 - DNA, 25 bp, Mus musculus
tggagtttataccagagtccccgcc

SEQ ID NO: 486136 - DNA, 25 bp, Mus musculus
tggagtttatctttccccaggccct

SEQ ID NO: 486137 - DNA, 25 bp, Mus musculus
tggagtttcagcatcaagttgagga

SEQ ID NO: 486138 - DNA, 25 bp, Mus musculus
tggagtttgcccctgctcaccagtt

SEQ ID NO: 486139 - DNA, 25 bp, Mus musculus
tggataaaacaaagtacagttcact

SEQ ID NO: 486140 - DNA, 25 bp, Mus musculus
tggataaacagcacgggatatctct

SEQ ID NO: 486141 - DNA, 25 bp, Mus musculus
tggataaagagaagacccaggccct

SEQ ID NO: 486142 - DNA, 25 bp, Mus musculus
tggataaagtgctggcgcaatcgcg

SEQ ID NO: 486143 - DNA, 25 bp, Mus musculus
tggataaatgggtctgtgcacagcc

SEQ ID NO: 486144 - DNA, 25 bp, Mus musculus
tggataacaaaacatctcccaggac

SEQ ID NO: 486145 - DNA, 25 bp, Mus musculus
tggataataaagctcagaggcctgc

SEQ ID NO: 486146 - DNA, 25 bp, Mus musculus
tggataatgccgagaaacgcctaat

SEQ ID NO: 486147 - DNA, 25 bp, Mus musculus
tggatacagcccttgccctggagaa

SEQ ID NO: 486148 - DNA, 25 bp, Mus musculus
tggatacagcctatttccggaagcc

SEQ ID NO: 486149 - DNA, 25 bp, Mus musculus
tggataccctttcaccagcactgga

SEQ ID NO: 486150 - DNA, 25 bp, Mus musculus
tggatactgatagccatgctgcagc

SEQ ID NO: 486151 - DNA, 25 bp, Mus musculus
tggatacttaacacgtaaaccttag

SEQ ID NO: 486152 - DNA, 25 bp, Mus musculus
tggatagagctgacaccaacctctg

SEQ ID NO: 486153 - DNA, 25 bp, Mus musculus
tggataggtgacagtgacttctccc

SEQ ID NO: 486154 - DNA, 25 bp, Mus musculus
tggatatcaaagacactctgctcga

SEQ ID NO: 486155 - DNA, 25 bp, Mus musculus
tggatatcacatggcttacaaggag

SEQ ID NO: 486156 - DNA, 25 bp, Mus musculus
tggatatccaggacccgggtcccga

SEQ ID NO: 486157 - DNA, 25 bp, Mus musculus
tggatatccggatagacactgccca

SEQ ID NO: 486158 - DNA, 25 bp, Mus musculus
tggatatcgcactgaacgaggcctt

SEQ ID NO: 486159 - DNA, 25 bp, Mus musculus
tggatatctactgcccacactacgg

SEQ ID NO: 486160 - DNA, 25 bp, Mus musculus
tggatatggtgaagggcactcccct

SEQ ID NO: 486161 - DNA, 25 bp, Mus musculus
tggatcaaagacactttggcccaaa

SEQ ID NO: 486162 - DNA, 25 bp, Mus musculus
tggatcaacagacaacaccaggcag

SEQ ID NO: 486163 - DNA, 25 bp, Mus musculus
tggatcaactctagcagcactggtt

SEQ ID NO: 486164 - DNA, 25 bp, Mus musculus
tggatcaagcaggaacaccagctga

SEQ ID NO: 486165 - DNA, 25 bp, Mus musculus
tggatcacaagactaaagccctggg

SEQ ID NO: 486166 - DNA, 25 bp, Mus musculus
tggatcacggtagagcacaggagac

SEQ ID NO: 486167 - DNA, 25 bp, Mus musculus
tggatcagcaatgatagaactgggc

SEQ ID NO: 486168 - DNA, 25 bp, Mus musculus
tggatcagcctcagcaaacagcctg

SEQ ID NO: 486169 - DNA, 25 bp, Mus musculus
tggatcataccacaacaccaagtag

SEQ ID NO: 486170 - DNA, 25 bp, Mus musculus
tggatcatacctacagcaaacatgt

SEQ ID NO: 486171 - DNA, 25 bp, Mus musculus
tggatcatggcactgtcaagaaaat

SEQ ID NO: 486172 - DNA, 25 bp, Mus musculus
tggatcatgggttggtgtaccgcaa

SEQ ID NO: 486173 - DNA, 25 bp, Mus musculus
tggatcattgcaacagcagccaccg

SEQ ID NO: 486174 - DNA, 25 bp, Mus musculus
tggatccaatccaagtccctgcggt

SEQ ID NO: 486175 - DNA, 25 bp, Mus musculus
tggatccactagaaaccgaacttgg

SEQ ID NO: 486176 - DNA, 25 bp, Mus musculus
tggatccactattgagtcccgagga

SEQ ID NO: 486177 - DNA, 25 bp, Mus musculus
tggatccaggactgaagaggcacca

SEQ ID NO: 486178 - DNA, 25 bp, Mus musculus
tggatccatgcggtttatacgcctg

SEQ ID NO: 486179 - DNA, 25 bp, Mus musculus
tggatccgaggagaacactaccggt

SEQ ID NO: 486180 - DNA, 25 bp, Mus musculus
tggatccggcgtctctcaaagtcgg

SEQ ID NO: 486181 - DNA, 25 bp, Mus musculus
tggatccggtgctacagtgactctg

SEQ ID NO: 486182 - DNA, 25 bp, Mus musculus
tggatccgttcctagggtacctaag

SEQ ID NO: 486183 - DNA, 25 bp, Mus musculus
tggatcctcaacaccaggcaaagga

SEQ ID NO: 486184 - DNA, 25 bp, Mus musculus
tggatcctctgaaaggattccaagc

SEQ ID NO: 486185 - DNA, 25 bp, Mus musculus
tggatcctgaggacatcgacctgac

SEQ ID NO: 486186 - DNA, 25 bp, Mus musculus
tggatcgcaacgagaagctggacct

SEQ ID NO: 486187 - DNA, 25 bp, Mus musculus
tggatcgccctgaacagcggcccga

SEQ ID NO: 486188 - DNA, 25 bp, Mus musculus
tggatcgtatgagcacctgtgggca

SEQ ID NO: 486189 - DNA, 25 bp, Mus musculus
tggatcgtttctcggctttcaacga

SEQ ID NO: 486190 - DNA, 25 bp, Mus musculus
tggatctcactggaagcctggcaga

SEQ ID NO: 486191 - DNA, 25 bp, Mus musculus
tggatctccagaacttgaagcgtgt

SEQ ID NO: 486192 - DNA, 25 bp, Mus musculus
tggatctcgcacacagcccacggta

SEQ ID NO: 486193 - DNA, 25 bp, Mus musculus
tggatctgacatgaggacacggagc

SEQ ID NO: 486194 - DNA, 25 bp, Mus musculus
tggatctggccaaagaagcccctgg

SEQ ID NO: 486195 - DNA, 25 bp, Mus musculus
tggatctgtccaccgcaaaggactg

SEQ ID NO: 486196 - DNA, 25 bp, Mus musculus
tggatctgtccccaatatgctgcgg

SEQ ID NO: 486197 - DNA, 25 bp, Mus musculus
tggatcttcacaaccagtaccgtgc

SEQ ID NO: 486198 - DNA, 25 bp, Mus musculus
tggatgaaaccagcgccgaagatga

SEQ ID NO: 486199 - DNA, 25 bp, Mus musculus
tggatgaaccgcagcggagcgtcct

SEQ ID NO: 486200 - DNA, 25 bp, Mus musculus
tggatgaatacacagacacggacct

SEQ ID NO: 486201 - DNA, 25 bp, Mus musculus
tggatgaatttggactgccgcagat

SEQ ID NO: 486202 - DNA, 25 bp, Mus musculus
tggatgacaaaacgtctctccggct

SEQ ID NO: 486203 - DNA, 25 bp, Mus musculus
tggatgacaagcgagcaactcagct

SEQ ID NO: 486204 - DNA, 25 bp, Mus musculus
tggatgaccgagacccgctgttagt

SEQ ID NO: 486205 - DNA, 25 bp, Mus musculus
tggatgacctctaaaaaacgcttgg

SEQ ID NO: 486206 - DNA, 25 bp, Mus musculus
tggatgaccttcttccccgagtggc

SEQ ID NO: 486207 - DNA, 25 bp, Mus musculus
tggatgacgagaccctgaatggcct

SEQ ID NO: 486208 - DNA, 25 bp, Mus musculus
tggatgactcccagtgcggtatcac

SEQ ID NO: 486209 - DNA, 25 bp, Mus musculus
tggatgagagagctcccgacaagca

SEQ ID NO: 486210 - DNA, 25 bp, Mus musculus
tggatgagatcaaaacacgcgagtc

SEQ ID NO: 486211 - DNA, 25 bp, Mus musculus
tggatgagatgtacacgagatgcat

SEQ ID NO: 486212 - DNA, 25 bp, Mus musculus
tggatgagccaaaattgtctactgg

SEQ ID NO: 486213 - DNA, 25 bp, Mus musculus
tggatgagctaacccttaataaggc

SEQ ID NO: 486214 - DNA, 25 bp, Mus musculus
tggatgatacgttgccccagggcgt

SEQ ID NO: 486215 - DNA, 25 bp, Mus musculus
tggatgccaagaaaaaccagccttc

SEQ ID NO: 486216 - DNA, 25 bp, Mus musculus
tggatgccaccaggcccagtttaag

SEQ ID NO: 486217 - DNA, 25 bp, Mus musculus
tggatgccactgtgccagagaacgc

SEQ ID NO: 486218 - DNA, 25 bp, Mus musculus
tggatgccagaagacaaacagatgt

SEQ ID NO: 486219 - DNA, 25 bp, Mus musculus
tggatgccagggaatttgggaaact

SEQ ID NO: 486220 - DNA, 25 bp, Mus musculus
tggatgccattctctataccccggc

SEQ ID NO: 486221 - DNA, 25 bp, Mus musculus
tggatgccccaaaggatcagatgga

SEQ ID NO: 486222 - DNA, 25 bp, Mus musculus
tggatgccccaggaaagcgtgcttc

SEQ ID NO: 486223 - DNA, 25 bp, Mus musculus
tggatgccggttgtccatgcccaag

SEQ ID NO: 486224 - DNA, 25 bp, Mus musculus
tggatgcctaatatacagccatggg

SEQ ID NO: 486225 - DNA, 25 bp, Mus musculus
tggatgctcacccaaaggcaaaagt

SEQ ID NO: 486226 - DNA, 25 bp, Mus musculus
tggatgctgtaacctcaagacagtg

SEQ ID NO: 486227 - DNA, 25 bp, Mus musculus
tggatggaggcctcaagaagcccaa

SEQ ID NO: 486228 - DNA, 25 bp, Mus musculus
tggatggccgtgatgtcaagaccct

SEQ ID NO: 486229 - DNA, 25 bp, Mus musculus
tggatggcgtcctggaagcctcact

SEQ ID NO: 486230 - DNA, 25 bp, Mus musculus
tggatggctaagagatgctactgtg

SEQ ID NO: 486231 - DNA, 25 bp, Mus musculus
tggatggctgcaacatgactatggc

SEQ ID NO: 486232 - DNA, 25 bp, Mus musculus
tggatgggatgcaccagaacttgcc

SEQ ID NO: 486233 - DNA, 25 bp, Mus musculus
tggatgggccattgcgaactaccgt

SEQ ID NO: 486234 - DNA, 25 bp, Mus musculus
tggatggtgaagagcgtgccctact

SEQ ID NO: 486235 - DNA, 25 bp, Mus musculus
tggatggtgtaaatgagccaacaga

SEQ ID NO: 486236 - DNA, 25 bp, Mus musculus
tggatggtttcaccctcagcggcaa

SEQ ID NO: 486237 - DNA, 25 bp, Mus musculus
tggatgtagctcagaggttgaaaac

SEQ ID NO: 486238 - DNA, 25 bp, Mus musculus
tggatgtcagcctcttcagacgtca

SEQ ID NO: 486239 - DNA, 25 bp, Mus musculus
tggatgtcgtgcatgcttcgcgagc

SEQ ID NO: 486240 - DNA, 25 bp, Mus musculus
tggatgtcttccacctgcaaggcat

SEQ ID NO: 486241 - DNA, 25 bp, Mus musculus
tggatgtcttgtcacccatggagag

SEQ ID NO: 486242 - DNA, 25 bp, Mus musculus
tggatgtggaaatgtatatgcccct

SEQ ID NO: 486243 - DNA, 25 bp, Mus musculus
tggatgtttgagacacagcccctgg

SEQ ID NO: 486244 - DNA, 25 bp, Mus musculus
tggattacaagacagccgagcagaa

SEQ ID NO: 486245 - DNA, 25 bp, Mus musculus
tggattacacgatggagcccaacgt

SEQ ID NO: 486246 - DNA, 25 bp, Mus musculus
tggattaccaccctaagccaccatg

SEQ ID NO: 486247 - DNA, 25 bp, Mus musculus
tggattagaaatggtggccaccttg

SEQ ID NO: 486248 - DNA, 25 bp, Mus musculus
tggattagcaccaggtaagttgagt

SEQ ID NO: 486249 - DNA, 25 bp, Mus musculus
tggattatagaattcagcttgctga

SEQ ID NO: 486250 - DNA, 25 bp, Mus musculus
tggattattcactgcgcgcctgcgt

SEQ ID NO: 486251 - DNA, 25 bp, Mus musculus
tggattcaagccactcagagacact

SEQ ID NO: 486252 - DNA, 25 bp, Mus musculus
tggattcaagtgtgtgtgcccgccc

SEQ ID NO: 486253 - DNA, 25 bp, Mus musculus
tggattcacccaggccgaatggcag

SEQ ID NO: 486254 - DNA, 25 bp, Mus musculus
tggattccaaagagcaatggcctag

SEQ ID NO: 486255 - DNA, 25 bp, Mus musculus
tggattccacctgtaggccggagct

SEQ ID NO: 486256 - DNA, 25 bp, Mus musculus
tggattccacggagcctcgggctat

SEQ ID NO: 486257 - DNA, 25 bp, Mus musculus
tggattccagaaagagttcaaggtc

SEQ ID NO: 486258 - DNA, 25 bp, Mus musculus
tggattccagattcgcacacgtgtg

SEQ ID NO: 486259 - DNA, 25 bp, Mus musculus
tggattccccaagtcagcatggcag

SEQ ID NO: 486260 - DNA, 25 bp, Mus musculus
tggattccgtagaccctgaaggacg

SEQ ID NO: 486261 - DNA, 25 bp, Mus musculus
tggattcctacctttctctcacaga

SEQ ID NO: 486262 - DNA, 25 bp, Mus musculus
tggattcctctcaaccaccggaagg

SEQ ID NO: 486263 - DNA, 25 bp, Mus musculus
tggattctagactctggcctcctgg

SEQ ID NO: 486264 - DNA, 25 bp, Mus musculus
tggattctctgggtggagacccaca

SEQ ID NO: 486265 - DNA, 25 bp, Mus musculus
tggattcttcccaaccagggcttga

SEQ ID NO: 486266 - DNA, 25 bp, Mus musculus
tggattgcgttaatcctctgtgaag

SEQ ID NO: 486267 - DNA, 25 bp, Mus musculus
tggattgtacccagatgccttcgcc

SEQ ID NO: 486268 - DNA, 25 bp, Mus musculus
tggattgttacttttgagaaactat

SEQ ID NO: 486269 - DNA, 25 bp, Mus musculus
tggatttacacacggacacatggga

SEQ ID NO: 486270 - DNA, 25 bp, Mus musculus
tggatttcagaactacctgtgagga

SEQ ID NO: 486271 - DNA, 25 bp, Mus musculus
tggatttgaggcagaagacttgtat

SEQ ID NO: 486272 - DNA, 25 bp, Mus musculus
tggatttgcttaaccagcgcagcca

SEQ ID NO: 486273 - DNA, 25 bp, Mus musculus
tggatttggtgagcacactgtgacc

SEQ ID NO: 486274 - DNA, 25 bp, Mus musculus
tggatttgtcagctccaaccagcgc

SEQ ID NO: 486275 - DNA, 25 bp, Mus musculus
tggattttaactaggtagcactgac

SEQ ID NO: 486276 - DNA, 25 bp, Mus musculus
tggattttatgtggacgccggccct

SEQ ID NO: 486277 - DNA, 25 bp, Mus musculus
tggattttcgggtacggctccctag

SEQ ID NO: 486278 - DNA, 25 bp, Mus musculus
tggcaaaacaggttcatgacaatct

SEQ ID NO: 486279 - DNA, 25 bp, Mus musculus
tggcaaaagaaacagcaccgtggac

SEQ ID NO: 486280 - DNA, 25 bp, Mus musculus
tggcaaaaggatacgaagcagtcaa

SEQ ID NO: 486281 - DNA, 25 bp, Mus musculus
tggcaaactcggcaaacttggctct

SEQ ID NO: 486282 - DNA, 25 bp, Mus musculus
tggcaaaggagtaaggaaacgcact

SEQ ID NO: 486283 - DNA, 25 bp, Mus musculus
tggcaaaggtgaactcgcagtccct

SEQ ID NO: 486284 - DNA, 25 bp, Mus musculus
tggcaaaggtgcaagaagcgcatct

SEQ ID NO: 486285 - DNA, 25 bp, Mus musculus
tggcaaagtctttgaggcggaaaaa

SEQ ID NO: 486286 - DNA, 25 bp, Mus musculus
tggcaaatacctgggctacctgaag

SEQ ID NO: 486287 - DNA, 25 bp, Mus musculus
tggcaacactgttacatgaaccgcg

SEQ ID NO: 486288 - DNA, 25 bp, Mus musculus
tggcaacagagagagccggatcctc

SEQ ID NO: 486289 - DNA, 25 bp, Mus musculus
tggcaaccaagatcctgatccagag

SEQ ID NO: 486290 - DNA, 25 bp, Mus musculus
tggcaaccaccagcgccttgggtgt

SEQ ID NO: 486291 - DNA, 25 bp, Mus musculus
tggcaacccacgatgggtaggctgt

SEQ ID NO: 486292 - DNA, 25 bp, Mus musculus
tggcaacctgggactctgggaagat

SEQ ID NO: 486293 - DNA, 25 bp, Mus musculus
tggcaacgaggaagagcatcatgaa

SEQ ID NO: 486294 - DNA, 25 bp, Mus musculus
tggcaacgccaaaggagacgaagct

SEQ ID NO: 486295 - DNA, 25 bp, Mus musculus
tggcaactaccatcagccctgggaa

SEQ ID NO: 486296 - DNA, 25 bp, Mus musculus
tggcaactcagtggagcaggctccc

SEQ ID NO: 486297 - DNA, 25 bp, Mus musculus
tggcaactgttttccagtaggagca

SEQ ID NO: 486298 - DNA, 25 bp, Mus musculus
tggcaacttttgatccggtggacaa

SEQ ID NO: 486299 - DNA, 25 bp, Mus musculus
tggcaagagaacacgagcctgggaa

SEQ ID NO: 486300 - DNA, 25 bp, Mus musculus
tggcaagagaagaatcacccgtggc

SEQ ID NO: 486301 - DNA, 25 bp, Mus musculus
tggcaagcgccaattctctgatgtg

SEQ ID NO: 486302 - DNA, 25 bp, Mus musculus
tggcaaggaaaacccagtctgtctg

SEQ ID NO: 486303 - DNA, 25 bp, Mus musculus
tggcaaggagattcttcagcgagca

SEQ ID NO: 486304 - DNA, 25 bp, Mus musculus
tggcaaggtgctgtagcctgagccc

SEQ ID NO: 486305 - DNA, 25 bp, Mus musculus
tggcaagtctttgttccaagccaga

SEQ ID NO: 486306 - DNA, 25 bp, Mus musculus
tggcaagtgcatggaaccaagtaga

SEQ ID NO: 486307 - DNA, 25 bp, Mus musculus
tggcaagtggcattcatcgggatca

SEQ ID NO: 486308 - DNA, 25 bp, Mus musculus
tggcaataagcggactctgggactc

SEQ ID NO: 486309 - DNA, 25 bp, Mus musculus
tggcaattacctactaacaaaccct

SEQ ID NO: 486310 - DNA, 25 bp, Mus musculus
tggcaattatcaaggaaggctatac

SEQ ID NO: 486311 - DNA, 25 bp, Mus musculus
tggcaattgagaacacacagggctt

SEQ ID NO: 486312 - DNA, 25 bp, Mus musculus
tggcaattgccatctgacttgtctg

SEQ ID NO: 486313 - DNA, 25 bp, Mus musculus
tggcaattggaaaaatgaccctggc

SEQ ID NO: 486314 - DNA, 25 bp, Mus musculus
tggcacaaagctacgaactcaagtc

SEQ ID NO: 486315 - DNA, 25 bp, Mus musculus
tggcacaatcctgaacgtggcggcg

SEQ ID NO: 486316 - DNA, 25 bp, Mus musculus
tggcacacagtaggtacactatagc

SEQ ID NO: 486317 - DNA, 25 bp, Mus musculus
tggcacacgcccaggattctgaggg

SEQ ID NO: 486318 - DNA, 25 bp, Mus musculus
tggcacacgcttttctcccggtggt

SEQ ID NO: 486319 - DNA, 25 bp, Mus musculus
tggcacacttcatgaacatcctggg

SEQ ID NO: 486320 - DNA, 25 bp, Mus musculus
tggcacactttgacccacgggtgac

SEQ ID NO: 486321 - DNA, 25 bp, Mus musculus
tggcacagcgctgcatggacaagag

SEQ ID NO: 486322 - DNA, 25 bp, Mus musculus
tggcacagcggtgctgagctgttct

SEQ ID NO: 486323 - DNA, 25 bp, Mus musculus
tggcacagctacattttccaaggct

SEQ ID NO: 486324 - DNA, 25 bp, Mus musculus
tggcacagctggtgaattactaccg

SEQ ID NO: 486325 - DNA, 25 bp, Mus musculus
tggcacatcccagacaaggaaattg

SEQ ID NO: 486326 - DNA, 25 bp, Mus musculus
tggcaccaggagagccgctacctgg

SEQ ID NO: 486327 - DNA, 25 bp, Mus musculus
tggcacccggcctctaggagctgct

SEQ ID NO: 486328 - DNA, 25 bp, Mus musculus
tggcaccgaggaaggcatgttcttt

SEQ ID NO: 486329 - DNA, 25 bp, Mus musculus
tggcacctccaacaagaatccgaag

SEQ ID NO: 486330 - DNA, 25 bp, Mus musculus
tggcacctccagcaacacagatgtt

SEQ ID NO: 486331 - DNA, 25 bp, Mus musculus
tggcacctgggcatagatcttcgca

SEQ ID NO: 486332 - DNA, 25 bp, Mus musculus
tggcacgcggtacaaaggaaaactg

SEQ ID NO: 486333 - DNA, 25 bp, Mus musculus
tggcacgtagccaggactgagacgc

SEQ ID NO: 486334 - DNA, 25 bp, Mus musculus
tggcacgtggctacccaaaggtggt

SEQ ID NO: 486335 - DNA, 25 bp, Mus musculus
tggcactcagaagccttgggcggcc

SEQ ID NO: 486336 - DNA, 25 bp, Mus musculus
tggcactccaactttacaagacagt

SEQ ID NO: 486337 - DNA, 25 bp, Mus musculus
tggcactcgatccttggaaacgggt

SEQ ID NO: 486338 - DNA, 25 bp, Mus musculus
tggcactctatctgggcatttggtc

SEQ ID NO: 486339 - DNA, 25 bp, Mus musculus
tggcactggcctccacagaaagggt

SEQ ID NO: 486340 - DNA, 25 bp, Mus musculus
tggcactgtcaattggccgagcagg

SEQ ID NO: 486341 - DNA, 25 bp, Mus musculus
tggcacttcctcagcgtggcgatca

SEQ ID NO: 486342 - DNA, 25 bp, Mus musculus
tggcacttgctgtataaggcataga

SEQ ID NO: 486343 - DNA, 25 bp, Mus musculus
tggcacttggcctgactacactgag

SEQ ID NO: 486344 - DNA, 25 bp, Mus musculus
tggcagaaaactagtttcttaaaat

SEQ ID NO: 486345 - DNA, 25 bp, Mus musculus
tggcagaacagaaaggacacctcct

SEQ ID NO: 486346 - DNA, 25 bp, Mus musculus
tggcagaacatcttacctacctgga

SEQ ID NO: 486347 - DNA, 25 bp, Mus musculus
tggcagaagtttgcagctaacacgg

SEQ ID NO: 486348 - DNA, 25 bp, Mus musculus
tggcagacgcatccctactgaagaa

SEQ ID NO: 486349 - DNA, 25 bp, Mus musculus
tggcagacggccttcagtgagacaa

SEQ ID NO: 486350 - DNA, 25 bp, Mus musculus
tggcagagaagaaccgcagagatgt

SEQ ID NO: 486351 - DNA, 25 bp, Mus musculus
tggcagagccgttcacaagatcatt

SEQ ID NO: 486352 - DNA, 25 bp, Mus musculus
tggcagagcgtcaccgaaacaagta

SEQ ID NO: 486353 - DNA, 25 bp, Mus musculus
tggcagaggcttaggagaacaccat

SEQ ID NO: 486354 - DNA, 25 bp, Mus musculus
tggcagagtggcatgttcccaaagc

SEQ ID NO: 486355 - DNA, 25 bp, Mus musculus
tggcagatcacctggaaggcctgtc

SEQ ID NO: 486356 - DNA, 25 bp, Mus musculus
tggcagcaccgcatcaaggactatc

SEQ ID NO: 486357 - DNA, 25 bp, Mus musculus
tggcagcactcctagcattgaggaa

SEQ ID NO: 486358 - DNA, 25 bp, Mus musculus
tggcagcagctgcctattctttttt

SEQ ID NO: 486359 - DNA, 25 bp, Mus musculus
tggcagcagcttagacgcagtatat

SEQ ID NO: 486360 - DNA, 25 bp, Mus musculus
tggcagccacccctttggagagagt

SEQ ID NO: 486361 - DNA, 25 bp, Mus musculus
tggcagccagctcatctgacatcag

SEQ ID NO: 486362 - DNA, 25 bp, Mus musculus
tggcagccatcaacagcatttacag

SEQ ID NO: 486363 - DNA, 25 bp, Mus musculus
tggcagccccttccatgaaggaaag

SEQ ID NO: 486364 - DNA, 25 bp, Mus musculus
tggcagcctgttatgcgctcctggg

SEQ ID NO: 486365 - DNA, 25 bp, Mus musculus
tggcagccttcatagcagtccttgg

SEQ ID NO: 486366 - DNA, 25 bp, Mus musculus
tggcagcgcgagtttgcccagcgca

SEQ ID NO: 486367 - DNA, 25 bp, Mus musculus
tggcagcgcgcaaagacgccagccg

SEQ ID NO: 486368 - DNA, 25 bp, Mus musculus
tggcagcgctagcactcggaaactt

SEQ ID NO: 486369 - DNA, 25 bp, Mus musculus
tggcagctactatgaacatgtgaag

SEQ ID NO: 486370 - DNA, 25 bp, Mus musculus
tggcagctcagagaagttctaccca

SEQ ID NO: 486371 - DNA, 25 bp, Mus musculus
tggcagctcagggttcaagtcagtg

SEQ ID NO: 486372 - DNA, 25 bp, Mus musculus
tggcagctcttcaactacgtggcag

SEQ ID NO: 486373 - DNA, 25 bp, Mus musculus
tggcagctgccaaggaaaaacgctt

SEQ ID NO: 486374 - DNA, 25 bp, Mus musculus
tggcagcttcaagagcacggtactc

SEQ ID NO: 486375 - DNA, 25 bp, Mus musculus
tggcaggacatgtgtggcagacacc

SEQ ID NO: 486376 - DNA, 25 bp, Mus musculus
tggcaggagctacacacataggaag

SEQ ID NO: 486377 - DNA, 25 bp, Mus musculus
tggcaggatccctggccaaagctct

SEQ ID NO: 486378 - DNA, 25 bp, Mus musculus
tggcaggctgcgcaacccaaatgtt

SEQ ID NO: 486379 - DNA, 25 bp, Mus musculus
tggcagggagacaccttccataggg

SEQ ID NO: 486380 - DNA, 25 bp, Mus musculus
tggcagggcattgttgctctgagcc

SEQ ID NO: 486381 - DNA, 25 bp, Mus musculus
tggcagggccagtaccagaaagaac

SEQ ID NO: 486382 - DNA, 25 bp, Mus musculus
tggcaggttaactctccttaggcct

SEQ ID NO: 486383 - DNA, 25 bp, Mus musculus
tggcagtacagaccatggacgtcaa

SEQ ID NO: 486384 - DNA, 25 bp, Mus musculus
tggcagtaggcaaagaagtcagtct

SEQ ID NO: 486385 - DNA, 25 bp, Mus musculus
tggcagtattttgtaggcttcatcc

SEQ ID NO: 486386 - DNA, 25 bp, Mus musculus
tggcagtctggcactgaacagtcag

SEQ ID NO: 486387 - DNA, 25 bp, Mus musculus
tggcagtgacagcatatacaaggac

SEQ ID NO: 486388 - DNA, 25 bp, Mus musculus
tggcagtgatcccaaagatggcaac

SEQ ID NO: 486389 - DNA, 25 bp, Mus musculus
tggcagtgccagctgtgttctcctg

SEQ ID NO: 486390 - DNA, 25 bp, Mus musculus
tggcagtgctgtagccttgcaggcc

SEQ ID NO: 486391 - DNA, 25 bp, Mus musculus
tggcagtgttgcctaaattggaaac

SEQ ID NO: 486392 - DNA, 25 bp, Mus musculus
tggcagttcaaagcgaaaccgttga

SEQ ID NO: 486393 - DNA, 25 bp, Mus musculus
tggcagttggcatcagcagatcgtg

SEQ ID NO: 486394 - DNA, 25 bp, Mus musculus
tggcagtttcaaaggatgagaaggt

SEQ ID NO: 486395 - DNA, 25 bp, Mus musculus
tggcagtttctctgctggttccatc

SEQ ID NO: 486396 - DNA, 25 bp, Mus musculus
tggcatagtgacagcacaaggagtc

SEQ ID NO: 486397 - DNA, 25 bp, Mus musculus
tggcatagttaaaccctgagcaagc

SEQ ID NO: 486398 - DNA, 25 bp, Mus musculus
tggcatataccctcatccttgaggc

SEQ ID NO: 486399 - DNA, 25 bp, Mus musculus
tggcatatagaagcacacttgtgac

SEQ ID NO: 486400 - DNA, 25 bp, Mus musculus
tggcatatgacagacagaacccgtg

SEQ ID NO: 486401 - DNA, 25 bp, Mus musculus
tggcatatgcttgccactgcagagg

SEQ ID NO: 486402 - DNA, 25 bp, Mus musculus
tggcatatgtgagcagcgtggccct

SEQ ID NO: 486403 - DNA, 25 bp, Mus musculus
tggcatcaaagtaccatttcccacc

SEQ ID NO: 486404 - DNA, 25 bp, Mus musculus
tggcatcatcgccaccgtcattgtc

SEQ ID NO: 486405 - DNA, 25 bp, Mus musculus
tggcatcatttagtcagatccctgc

SEQ ID NO: 486406 - DNA, 25 bp, Mus musculus
tggcatccaccaggagcctctgaga

SEQ ID NO: 486407 - DNA, 25 bp, Mus musculus
tggcatcctactgtttctggctgtt

SEQ ID NO: 486408 - DNA, 25 bp, Mus musculus
tggcatcctggagaaatcctgcagc

SEQ ID NO: 486409 - DNA, 25 bp, Mus musculus
tggcatctcccaatgatacggcact

SEQ ID NO: 486410 - DNA, 25 bp, Mus musculus
tggcatctctttctcttgaaagaca

SEQ ID NO: 486411 - DNA, 25 bp, Mus musculus
tggcatctgcgcagtgtaggcagct

SEQ ID NO: 486412 - DNA, 25 bp, Mus musculus
tggcatctgtacagacttctgggac

SEQ ID NO: 486413 - DNA, 25 bp, Mus musculus
tggcatcttccaaagtcagagtcct

SEQ ID NO: 486414 - DNA, 25 bp, Mus musculus
tggcatggcatcctaagaacttcac

SEQ ID NO: 486415 - DNA, 25 bp, Mus musculus
tggcatggctccacagctgctagct

SEQ ID NO: 486416 - DNA, 25 bp, Mus musculus
tggcatgggcatcaactatcgactt

SEQ ID NO: 486417 - DNA, 25 bp, Mus musculus
tggcatgtagtagccacaacccaga

SEQ ID NO: 486418 - DNA, 25 bp, Mus musculus
tggcattacaacgagcaatccctgc

SEQ ID NO: 486419 - DNA, 25 bp, Mus musculus
tggcattagaaagcacccaggagag

SEQ ID NO: 486420 - DNA, 25 bp, Mus musculus
tggcattagctgtaatgtactccgc

SEQ ID NO: 486421 - DNA, 25 bp, Mus musculus
tggcattcatcgagccacctactca

SEQ ID NO: 486422 - DNA, 25 bp, Mus musculus
tggcattccacgctggatacggcag

SEQ ID NO: 486423 - DNA, 25 bp, Mus musculus
tggcattgaacgtgtgatcctcctg

SEQ ID NO: 486424 - DNA, 25 bp, Mus musculus
tggcattgagaatctcttggctggg

SEQ ID NO: 486425 - DNA, 25 bp, Mus musculus
tggcattgaggctgatgacaacccc

SEQ ID NO: 486426 - DNA, 25 bp, Mus musculus
tggcattgcgcagaaggcggcggta

SEQ ID NO: 486427 - DNA, 25 bp, Mus musculus
tggcatttacctcaagttgcaaata

SEQ ID NO: 486428 - DNA, 25 bp, Mus musculus
tggcatttgaatgaggagtgagcaa

SEQ ID NO: 486429 - DNA, 25 bp, Mus musculus
tggcatttgctagctgagtttcttg

SEQ ID NO: 486430 - DNA, 25 bp, Mus musculus
tggccaaagcgtgctgccctgtgct

SEQ ID NO: 486431 - DNA, 25 bp, Mus musculus
tggccaaaggtctctacgcaggacg

SEQ ID NO: 486432 - DNA, 25 bp, Mus musculus
tggccaacaggcacaaggatagtct

SEQ ID NO: 486433 - DNA, 25 bp, Mus musculus
tggccaacattcctagagagctgct

SEQ ID NO: 486434 - DNA, 25 bp, Mus musculus
tggccaaccccaaaaagtcgtgcaa

SEQ ID NO: 486435 - DNA, 25 bp, Mus musculus
tggccaaccgtctgggttcctggag

SEQ ID NO: 486436 - DNA, 25 bp, Mus musculus
tggccaacctcaagcgtcatggtcg

SEQ ID NO: 486437 - DNA, 25 bp, Mus musculus
tggccaaccttcctgctgtcaacgg

SEQ ID NO: 486438 - DNA, 25 bp, Mus musculus
tggccaacgacaagtacgagaacgg

SEQ ID NO: 486439 - DNA, 25 bp, Mus musculus
tggccaactgaagaacctcacaggg

SEQ ID NO: 486440 - DNA, 25 bp, Mus musculus
tggccaagagtctgaaggtcgaccc

SEQ ID NO: 486441 - DNA, 25 bp, Mus musculus
tggccaagcgaccaggagtcaagct

SEQ ID NO: 486442 - DNA, 25 bp, Mus musculus
tggccaaggcgctcaaaatgaccga

SEQ ID NO: 486443 - DNA, 25 bp, Mus musculus
tggccaaggtgagcaaaaggatccc

SEQ ID NO: 486444 - DNA, 25 bp, Mus musculus
tggccaaggtttccaccgcttcggt

SEQ ID NO: 486445 - DNA, 25 bp, Mus musculus
tggccaagttccgaagtgcctcgct

SEQ ID NO: 486446 - DNA, 25 bp, Mus musculus
tggccaagttcttaacccttctgtg

SEQ ID NO: 486447 - DNA, 25 bp, Mus musculus
tggccaataaccataacggcagtgt

SEQ ID NO: 486448 - DNA, 25 bp, Mus musculus
tggccaatgaggatcgacaaactca

SEQ ID NO: 486449 - DNA, 25 bp, Mus musculus
tggccaatggagaacacaccacttt

SEQ ID NO: 486450 - DNA, 25 bp, Mus musculus
tggccaatggcatccacctcagatg

SEQ ID NO: 486451 - DNA, 25 bp, Mus musculus
tggccacactagctgctggtgaagc

SEQ ID NO: 486452 - DNA, 25 bp, Mus musculus
tggccacatgtgtacggttccgcgg

SEQ ID NO: 486453 - DNA, 25 bp, Mus musculus
tggccaccagaagaagctcctttca

SEQ ID NO: 486454 - DNA, 25 bp, Mus musculus
tggccaccagtttctggtccctgta

SEQ ID NO: 486455 - DNA, 25 bp, Mus musculus
tggccaccgagtacaatgcactgaa

SEQ ID NO: 486456 - DNA, 25 bp, Mus musculus
tggccaccggctgcactgaagtata

SEQ ID NO: 486457 - DNA, 25 bp, Mus musculus
tggccaccgtgaccccgattgtgga

SEQ ID NO: 486458 - DNA, 25 bp, Mus musculus
tggccacggatatcaacagacagaa

SEQ ID NO: 486459 - DNA, 25 bp, Mus musculus
tggccacgttccctgggctgcattc

SEQ ID NO: 486460 - DNA, 25 bp, Mus musculus
tggccactacatgtgcaaaatgctg

SEQ ID NO: 486461 - DNA, 25 bp, Mus musculus
tggccactccaaacaaagctgaaat

SEQ ID NO: 486462 - DNA, 25 bp, Mus musculus
tggccactgtgccttaccagacaag

SEQ ID NO: 486463 - DNA, 25 bp, Mus musculus
tggccagaccacctaccagggtgtg

SEQ ID NO: 486464 - DNA, 25 bp, Mus musculus
tggccagaccgtgaaactaaagtac

SEQ ID NO: 486465 - DNA, 25 bp, Mus musculus
tggccagagcaggagagggccgaac

SEQ ID NO: 486466 - DNA, 25 bp, Mus musculus
tggccagcaacagtgcgtgcgggtg

SEQ ID NO: 486467 - DNA, 25 bp, Mus musculus
tggccagcacaatcagctccggcag

SEQ ID NO: 486468 - DNA, 25 bp, Mus musculus
tggccagcactgaaaagccacccgt

SEQ ID NO: 486469 - DNA, 25 bp, Mus musculus
tggccagcagtgcaccactggagaa

SEQ ID NO: 486470 - DNA, 25 bp, Mus musculus
tggccagcggacaagagtaccagat

SEQ ID NO: 486471 - DNA, 25 bp, Mus musculus
tggccagctgtctaccacgatgaca

SEQ ID NO: 486472 - DNA, 25 bp, Mus musculus
tggccaggaacagcgacttacaacc

SEQ ID NO: 486473 - DNA, 25 bp, Mus musculus
tggccaggatgctcaaggaacttaa

SEQ ID NO: 486474 - DNA, 25 bp, Mus musculus
tggccaggcaaggagacacgacttt

SEQ ID NO: 486475 - DNA, 25 bp, Mus musculus
tggccaggcaggtagccctatacca

SEQ ID NO: 486476 - DNA, 25 bp, Mus musculus
tggccaggccctatggttgctgctg

SEQ ID NO: 486477 - DNA, 25 bp, Mus musculus
tggccaggttgggagacacataagt

SEQ ID NO: 486478 - DNA, 25 bp, Mus musculus
tggccagtagcctgatccgacagaa

SEQ ID NO: 486479 - DNA, 25 bp, Mus musculus
tggccagtcctgtggaggcatctcc

SEQ ID NO: 486480 - DNA, 25 bp, Mus musculus
tggccagtctcaggacggtccgtaa

SEQ ID NO: 486481 - DNA, 25 bp, Mus musculus
tggccagtggtgcagatctaaatct

SEQ ID NO: 486482 - DNA, 25 bp, Mus musculus
tggccagttaatacttcatgtggag

SEQ ID NO: 486483 - DNA, 25 bp, Mus musculus
tggccagttacaggaagacacatct

SEQ ID NO: 486484 - DNA, 25 bp, Mus musculus
tggccagttgcatgacccagatcat

SEQ ID NO: 486485 - DNA, 25 bp, Mus musculus
tggccataaggcagcctcagtgggc

SEQ ID NO: 486486 - DNA, 25 bp, Mus musculus
tggccataccatgaacccgtggaat

SEQ ID NO: 486487 - DNA, 25 bp, Mus musculus
tggccatcaagcatcgtctaactct

SEQ ID NO: 486488 - DNA, 25 bp, Mus musculus
tggccatcaatacgctctgcaaaga

SEQ ID NO: 486489 - DNA, 25 bp, Mus musculus
tggccatcaccgctggcaatgagga

SEQ ID NO: 486490 - DNA, 25 bp, Mus musculus
tggccatcgtggagcacttggtgac

SEQ ID NO: 486491 - DNA, 25 bp, Mus musculus
tggccatgctgaaatctctccgaag

SEQ ID NO: 486492 - DNA, 25 bp, Mus musculus
tggccatggcggtgatcatctccaa

SEQ ID NO: 486493 - DNA, 25 bp, Mus musculus
tggccatgtgtcaggattctaaggc

SEQ ID NO: 486494 - DNA, 25 bp, Mus musculus
tggccattctagaggagcacgtgac

SEQ ID NO: 486495 - DNA, 25 bp, Mus musculus
tggccattgccatcgacaggtacgt

SEQ ID NO: 486496 - DNA, 25 bp, Mus musculus
tggccattgcccagaaatcacggta

SEQ ID NO: 486497 - DNA, 25 bp, Mus musculus
tggccattggtaagacccgttctgt

SEQ ID NO: 486498 - DNA, 25 bp, Mus musculus
tggcccaaagcaacctgatagtgtg

SEQ ID NO: 486499 - DNA, 25 bp, Mus musculus
tggcccaactgataaaagagtcttt

SEQ ID NO: 486500 - DNA, 25 bp, Mus musculus
tggcccaatggcaggctgaatcccc

SEQ ID NO: 486501 - DNA, 25 bp, Mus musculus
tggcccacactaaactcgcagaggt

SEQ ID NO: 486502 - DNA, 25 bp, Mus musculus
tggcccacagtcgtcctcagggatg

SEQ ID NO: 486503 - DNA, 25 bp, Mus musculus
tggcccacttacactatctgaggac

SEQ ID NO: 486504 - DNA, 25 bp, Mus musculus
tggcccagaaattaaaagcaaacgg

SEQ ID NO: 486505 - DNA, 25 bp, Mus musculus
tggcccagagagacgtgagacagtt

SEQ ID NO: 486506 - DNA, 25 bp, Mus musculus
tggcccagagcattaacagtgacgt

SEQ ID NO: 486507 - DNA, 25 bp, Mus musculus
tggcccagcacctacttctggtgac

SEQ ID NO: 486508 - DNA, 25 bp, Mus musculus
tggcccagcagatcaagcaagaagt

SEQ ID NO: 486509 - DNA, 25 bp, Mus musculus
tggcccagccttgacagagatgact

SEQ ID NO: 486510 - DNA, 25 bp, Mus musculus
tggcccagcgggactctatagatgc

SEQ ID NO: 486511 - DNA, 25 bp, Mus musculus
tggcccaggcaagcttccagatcga

SEQ ID NO: 486512 - DNA, 25 bp, Mus musculus
tggccccaaggaagatgactgtaag

SEQ ID NO: 486513 - DNA, 25 bp, Mus musculus
tggccccactggtagctcaaagcta

SEQ ID NO: 486514 - DNA, 25 bp, Mus musculus
tggccccagagtcgaaattccagat

SEQ ID NO: 486515 - DNA, 25 bp, Mus musculus
tggccccagtactgttgagaatgac

SEQ ID NO: 486516 - DNA, 25 bp, Mus musculus
tggccccatgactacaattgcagac

SEQ ID NO: 486517 - DNA, 25 bp, Mus musculus
tggccccgaaacactcaggagctaa

SEQ ID NO: 486518 - DNA, 25 bp, Mus musculus
tggccccgggaaccacttctgggct

SEQ ID NO: 486519 - DNA, 25 bp, Mus musculus
tggccccgggatagagactcagatc

SEQ ID NO: 486520 - DNA, 25 bp, Mus musculus
tggccccgtagtctgcaatggacaa

SEQ ID NO: 486521 - DNA, 25 bp, Mus musculus
tggcccctgaaaagcactgagatgt

SEQ ID NO: 486522 - DNA, 25 bp, Mus musculus
tggcccgaaacacagtcactcaggt

SEQ ID NO: 486523 - DNA, 25 bp, Mus musculus
tggcccgaaactggttttggaccag

SEQ ID NO: 486524 - DNA, 25 bp, Mus musculus
tggcccgatgcctctgaaattgtga

SEQ ID NO: 486525 - DNA, 25 bp, Mus musculus
tggcccgcaatgctgaacactctct

SEQ ID NO: 486526 - DNA, 25 bp, Mus musculus
tggcccgcggtaaagtgtcctgtag

SEQ ID NO: 486527 - DNA, 25 bp, Mus musculus
tggcccggaaatacaaccgtagcga

SEQ ID NO: 486528 - DNA, 25 bp, Mus musculus
tggcccgggacacgatccagattaa

SEQ ID NO: 486529 - DNA, 25 bp, Mus musculus
tggcccgtcagcagattcgttcttg

SEQ ID NO: 486530 - DNA, 25 bp, Mus musculus
tggcccgtttccctggtacttgtgg

SEQ ID NO: 486531 - DNA, 25 bp, Mus musculus
tggccctaagacagctggtagaagc

SEQ ID NO: 486532 - DNA, 25 bp, Mus musculus
tggccctcactatttgaggctggag

SEQ ID NO: 486533 - DNA, 25 bp, Mus musculus
tggccctcagctagggaaagcttga

SEQ ID NO: 486534 - DNA, 25 bp, Mus musculus
tggccctcattttgccctaggagag

SEQ ID NO: 486535 - DNA, 25 bp, Mus musculus
tggccctcttaataggcaaccagat

SEQ ID NO: 486536 - DNA, 25 bp, Mus musculus
tggccctgactgacatagacgtgca

SEQ ID NO: 486537 - DNA, 25 bp, Mus musculus
tggccctgacttgggttactaaatg

SEQ ID NO: 486538 - DNA, 25 bp, Mus musculus
tggccctgcaacctgggtgacctgt

SEQ ID NO: 486539 - DNA, 25 bp, Mus musculus
tggccctgcagggtaggcaacatga

SEQ ID NO: 486540 - DNA, 25 bp, Mus musculus
tggccctgcctaacaactactgtga

SEQ ID NO: 486541 - DNA, 25 bp, Mus musculus
tggccctgcctttcgaagctggaga

SEQ ID NO: 486542 - DNA, 25 bp, Mus musculus
tggccctggattgcttgctgctctt

SEQ ID NO: 486543 - DNA, 25 bp, Mus musculus
tggccctggcactcagaagccttgg

SEQ ID NO: 486544 - DNA, 25 bp, Mus musculus
tggccctggccacgtataataactc

SEQ ID NO: 486545 - DNA, 25 bp, Mus musculus
tggccctggctatagtgtaatcaag

SEQ ID NO: 486546 - DNA, 25 bp, Mus musculus
tggcccttcctgcatcttcggagct

SEQ ID NO: 486547 - DNA, 25 bp, Mus musculus
tggcccttctcggtgaacatgcaag

SEQ ID NO: 486548 - DNA, 25 bp, Mus musculus
tggccgacagacagagccgcaagct

SEQ ID NO: 486549 - DNA, 25 bp, Mus musculus
tggccgagcagcttcagaacaaccg

SEQ ID NO: 486550 - DNA, 25 bp, Mus musculus
tggccgagctagagtcccagccagg

SEQ ID NO: 486551 - DNA, 25 bp, Mus musculus
tggccgatatgcttacacagactgg

SEQ ID NO: 486552 - DNA, 25 bp, Mus musculus
tggccgatcttgcacaggaacactg

SEQ ID NO: 486553 - DNA, 25 bp, Mus musculus
tggccgccccacttccgttggagtg

SEQ ID NO: 486554 - DNA, 25 bp, Mus musculus
tggccgccgctgtcagacaggccag

SEQ ID NO: 486555 - DNA, 25 bp, Mus musculus
tggccgcctatccagagagctgctt

SEQ ID NO: 486556 - DNA, 25 bp, Mus musculus
tggccgcctgcactgaacttctgtt

SEQ ID NO: 486557 - DNA, 25 bp, Mus musculus
tggccgccttcccatcttaggacag

SEQ ID NO: 486558 - DNA, 25 bp, Mus musculus
tggccgctagaatttaaacacagac

SEQ ID NO: 486559 - DNA, 25 bp, Mus musculus
tggccgctcccctagtgttaaaatg

SEQ ID NO: 486560 - DNA, 25 bp, Mus musculus
tggccgctcctcagcgctttgggaa

SEQ ID NO: 486561 - DNA, 25 bp, Mus musculus
tggccggaatgatgcaaaccttaag

SEQ ID NO: 486562 - DNA, 25 bp, Mus musculus
tggccggcaaagacatcacagagct

SEQ ID NO: 486563 - DNA, 25 bp, Mus musculus
tggccggcacacaggtcattggatc

SEQ ID NO: 486564 - DNA, 25 bp, Mus musculus
tggccggccctttgcacgtgaaggc

SEQ ID NO: 486565 - DNA, 25 bp, Mus musculus
tggccggctagtgtgcaaagaagac

SEQ ID NO: 486566 - DNA, 25 bp, Mus musculus
tggccggctcgcagtagaaacctgt

SEQ ID NO: 486567 - DNA, 25 bp, Mus musculus
tggccgggccctttctagattatct

SEQ ID NO: 486568 - DNA, 25 bp, Mus musculus
tggccggtgactcttctcaactttg

SEQ ID NO: 486569 - DNA, 25 bp, Mus musculus
tggccggtggatcagcagttctact

SEQ ID NO: 486570 - DNA, 25 bp, Mus musculus
tggccggttgccctcacagggacat

SEQ ID NO: 486571 - DNA, 25 bp, Mus musculus
tggccgtgatgtccccatgcctctg

SEQ ID NO: 486572 - DNA, 25 bp, Mus musculus
tggccgtgcacatgtttatcgaccg

SEQ ID NO: 486573 - DNA, 25 bp, Mus musculus
tggccgtgcctaccacaagtacaag

SEQ ID NO: 486574 - DNA, 25 bp, Mus musculus
tggccgtgctcagtgaccagaagga

SEQ ID NO: 486575 - DNA, 25 bp, Mus musculus
tggccgtgggcgtcatcaagaacgt

SEQ ID NO: 486576 - DNA, 25 bp, Mus musculus
tggcctaacatggtactcagcgaga

SEQ ID NO: 486577 - DNA, 25 bp, Mus musculus
tggcctactgtgaagcccacgtgcg

SEQ ID NO: 486578 - DNA, 25 bp, Mus musculus
tggcctagcagcatccggaagtgtt

SEQ ID NO: 486579 - DNA, 25 bp, Mus musculus
tggcctagcctgctggacaaggaaa

SEQ ID NO: 486580 - DNA, 25 bp, Mus musculus
tggcctagggaaaggattaactcca

SEQ ID NO: 486581 - DNA, 25 bp, Mus musculus
tggcctcaacacttgcagcaatcct

SEQ ID NO: 486582 - DNA, 25 bp, Mus musculus
tggcctcaactcctcaaaagtctgg

SEQ ID NO: 486583 - DNA, 25 bp, Mus musculus
tggcctcaagaggaatgtgaccctg

SEQ ID NO: 486584 - DNA, 25 bp, Mus musculus
tggcctcactagcagtatctatcaa

SEQ ID NO: 486585 - DNA, 25 bp, Mus musculus
tggcctcagaaaaaggagatcctca

SEQ ID NO: 486586 - DNA, 25 bp, Mus musculus
tggcctcagcttgtgtaatcagcac

SEQ ID NO: 486587 - DNA, 25 bp, Mus musculus
tggcctcaggagatcaagttgcaga

SEQ ID NO: 486588 - DNA, 25 bp, Mus musculus
tggcctcatactgcaaccaatatgg

SEQ ID NO: 486589 - DNA, 25 bp, Mus musculus
tggcctcatccaaagcagacgctgg

SEQ ID NO: 486590 - DNA, 25 bp, Mus musculus
tggcctccagacaaccgtgagcttg

SEQ ID NO: 486591 - DNA, 25 bp, Mus musculus
tggcctccatcactgtgtgtggtaa

SEQ ID NO: 486592 - DNA, 25 bp, Mus musculus
tggcctcccagatgcaaatggcttg

SEQ ID NO: 486593 - DNA, 25 bp, Mus musculus
tggcctcctaagctcagggaggcaa

SEQ ID NO: 486594 - DNA, 25 bp, Mus musculus
tggcctcctggctaaatgaagaacg

SEQ ID NO: 486595 - DNA, 25 bp, Mus musculus
tggcctccttgcaggttcaccgcta

SEQ ID NO: 486596 - DNA, 25 bp, Mus musculus
tggcctcgtgatttgggaccagcac

SEQ ID NO: 486597 - DNA, 25 bp, Mus musculus
tggcctctagagtggtaacagtact

SEQ ID NO: 486598 - DNA, 25 bp, Mus musculus
tggcctctctacaggctcttagaat

SEQ ID NO: 486599 - DNA, 25 bp, Mus musculus
tggcctctcttcctacggagtttcc

SEQ ID NO: 486600 - DNA, 25 bp, Mus musculus
tggcctctgctttgcgggacttgta

SEQ ID NO: 486601 - DNA, 25 bp, Mus musculus
tggcctctgtagtcaggagtccggg

SEQ ID NO: 486602 - DNA, 25 bp, Mus musculus
tggcctctgtcaccctggagcaaag

SEQ ID NO: 486603 - DNA, 25 bp, Mus musculus
tggcctcttttaatcaatcctgtct

SEQ ID NO: 486604 - DNA, 25 bp, Mus musculus
tggcctgaaacccacactggctctg

SEQ ID NO: 486605 - DNA, 25 bp, Mus musculus
tggcctgcattcctgtgtgcgtcgt

SEQ ID NO: 486606 - DNA, 25 bp, Mus musculus
tggcctgcgttcatcgggcgagcct

SEQ ID NO: 486607 - DNA, 25 bp, Mus musculus
tggcctgctagacatgggcatgcac

SEQ ID NO: 486608 - DNA, 25 bp, Mus musculus
tggcctgctcgggaacagatggact

SEQ ID NO: 486609 - DNA, 25 bp, Mus musculus
tggcctgctgaactggaccacgtga

SEQ ID NO: 486610 - DNA, 25 bp, Mus musculus
tggcctgctgccctatgtctacctg

SEQ ID NO: 486611 - DNA, 25 bp, Mus musculus
tggcctggaaatcattacaatcccc

SEQ ID NO: 486612 - DNA, 25 bp, Mus musculus
tggcctggaacatgcagtaaccttc

SEQ ID NO: 486613 - DNA, 25 bp, Mus musculus
tggcctggcatacatgttcacacct

SEQ ID NO: 486614 - DNA, 25 bp, Mus musculus
tggcctggccaaaaacgccactgag

SEQ ID NO: 486615 - DNA, 25 bp, Mus musculus
tggcctggccttctgcgctatcttg

SEQ ID NO: 486616 - DNA, 25 bp, Mus musculus
tggcctggctgcagtatagtctagc

SEQ ID NO: 486617 - DNA, 25 bp, Mus musculus
tggcctgggctcaatgccacggaca

SEQ ID NO: 486618 - DNA, 25 bp, Mus musculus
tggcctgggtgttagcagacataac

SEQ ID NO: 486619 - DNA, 25 bp, Mus musculus
tggcctggtcctaggtcaaaatcct

SEQ ID NO: 486620 - DNA, 25 bp, Mus musculus
tggcctgtacatgcacaggagatta

SEQ ID NO: 486621 - DNA, 25 bp, Mus musculus
tggcctgtcgcgaggcgggttgcgg

SEQ ID NO: 486622 - DNA, 25 bp, Mus musculus
tggcctgtgccaaaaactgttgtga

SEQ ID NO: 486623 - DNA, 25 bp, Mus musculus
tggccttaaagtcacaaagatcctc

SEQ ID NO: 486624 - DNA, 25 bp, Mus musculus
tggccttaccatggtgtgtccctgc

SEQ ID NO: 486625 - DNA, 25 bp, Mus musculus
tggccttacgtaatgagaggacaac

SEQ ID NO: 486626 - DNA, 25 bp, Mus musculus
tggccttccaaatctggcctaggca

SEQ ID NO: 486627 - DNA, 25 bp, Mus musculus
tggccttcctagagctcactactat

SEQ ID NO: 486628 - DNA, 25 bp, Mus musculus
tggccttcttcaacagcgtggtcaa

SEQ ID NO: 486629 - DNA, 25 bp, Mus musculus
tggccttgaactcctcggcatgacc

SEQ ID NO: 486630 - DNA, 25 bp, Mus musculus
tggccttgaatctacagaaaattgc

SEQ ID NO: 486631 - DNA, 25 bp, Mus musculus
tggccttggcaagccaggacgtagc

SEQ ID NO: 486632 - DNA, 25 bp, Mus musculus
tggccttggcaggttctaagcaccg

SEQ ID NO: 486633 - DNA, 25 bp, Mus musculus
tggcctttaagcagctccagcggtg

SEQ ID NO: 486634 - DNA, 25 bp, Mus musculus
tggcctttatttggagacgggtttg

SEQ ID NO: 486635 - DNA, 25 bp, Mus musculus
tggcctttctcatgaacttgctcca

SEQ ID NO: 486636 - DNA, 25 bp, Mus musculus
tggcctttctgggtagatacacacg

SEQ ID NO: 486637 - DNA, 25 bp, Mus musculus
tggcctttgaggttatctagtacac

SEQ ID NO: 486638 - DNA, 25 bp, Mus musculus
tggcctttgtgctgaactgtcgaac

SEQ ID NO: 486639 - DNA, 25 bp, Mus musculus
tggccttttggacagcagcagctgc

SEQ ID NO: 486640 - DNA, 25 bp, Mus musculus
tggcgaagaagacgtacgacctgct

SEQ ID NO: 486641 - DNA, 25 bp, Mus musculus
tggcgaagaataggcacaacggtgc

SEQ ID NO: 486642 - DNA, 25 bp, Mus musculus
tggcgaaggcacaggcagcgctctt

SEQ ID NO: 486643 - DNA, 25 bp, Mus musculus
tggcgacaaccctagaaaagcggaa

SEQ ID NO: 486644 - DNA, 25 bp, Mus musculus
tggcgacccaatacatgagcttctg

SEQ ID NO: 486645 - DNA, 25 bp, Mus musculus
tggcgacggacaggcaaaacacatt

SEQ ID NO: 486646 - DNA, 25 bp, Mus musculus
tggcgagacacttcgggaccagata

SEQ ID NO: 486647 - DNA, 25 bp, Mus musculus
tggcgagctacaagctctctccttt

SEQ ID NO: 486648 - DNA, 25 bp, Mus musculus
tggcgagctgatcctcaagcgctgt

SEQ ID NO: 486649 - DNA, 25 bp, Mus musculus
tggcgataagcccaggcccgttgtt

SEQ ID NO: 486650 - DNA, 25 bp, Mus musculus
tggcgatagagcaggcagatgtacc

SEQ ID NO: 486651 - DNA, 25 bp, Mus musculus
tggcgatgagcccaggtcctttgtt

SEQ ID NO: 486652 - DNA, 25 bp, Mus musculus
tggcgatggatctaggagtttacca

SEQ ID NO: 486653 - DNA, 25 bp, Mus musculus
tggcgcacggtattccatggagagc

SEQ ID NO: 486654 - DNA, 25 bp, Mus musculus
tggcgccgagaggaaacgcattctg

SEQ ID NO: 486655 - DNA, 25 bp, Mus musculus
tggcgcctgcggaatcagagaactt

SEQ ID NO: 486656 - DNA, 25 bp, Mus musculus
tggcgccttgtcgtagaagccgtct

SEQ ID NO: 486657 - DNA, 25 bp, Mus musculus
tggcgcgcgcgacgaatcttaacgc

SEQ ID NO: 486658 - DNA, 25 bp, Mus musculus
tggcgcgggctgatgactatgaaca

SEQ ID NO: 486659 - DNA, 25 bp, Mus musculus
tggcgctcaagatcgacctcactga

SEQ ID NO: 486660 - DNA, 25 bp, Mus musculus
tggcgctctgataccccagaaatgc

SEQ ID NO: 486661 - DNA, 25 bp, Mus musculus
tggcgctctttattccctggcaggc

SEQ ID NO: 486662 - DNA, 25 bp, Mus musculus
tggcgctgacctggaaggtgacaac

SEQ ID NO: 486663 - DNA, 25 bp, Mus musculus
tggcgctgatcgacttccagaaccg

SEQ ID NO: 486664 - DNA, 25 bp, Mus musculus
tggcgctgcccgaaagtggttctac

SEQ ID NO: 486665 - DNA, 25 bp, Mus musculus
tggcggaaccggcagaaaaataagc

SEQ ID NO: 486666 - DNA, 25 bp, Mus musculus
tggcggatattcagtctctcaggga

SEQ ID NO: 486667 - DNA, 25 bp, Mus musculus
tggcggatgcccagatgacacctgt

SEQ ID NO: 486668 - DNA, 25 bp, Mus musculus
tggcggcacaacagcgggcttcatg

SEQ ID NO: 486669 - DNA, 25 bp, Mus musculus
tggcggcccttatgcagaacaagct

SEQ ID NO: 486670 - DNA, 25 bp, Mus musculus
tggcggcctgtacttttgagaaccc

SEQ ID NO: 486671 - DNA, 25 bp, Mus musculus
tggcggcgagggttactaagaaatc

SEQ ID NO: 486672 - DNA, 25 bp, Mus musculus
tggcggtccacttacgataaaaact

SEQ ID NO: 486673 - DNA, 25 bp, Mus musculus
tggcggtggagatgctcagtcccaa

SEQ ID NO: 486674 - DNA, 25 bp, Mus musculus
tggcggtggcagtcttcggaaacct

SEQ ID NO: 486675 - DNA, 25 bp, Mus musculus
tggcggtgggactcgccgcactttt

SEQ ID NO: 486676 - DNA, 25 bp, Mus musculus
tggcgtaatgcctgcaaactgaact

SEQ ID NO: 486677 - DNA, 25 bp, Mus musculus
tggcgtacatgttgagcctctaccg

SEQ ID NO: 486678 - DNA, 25 bp, Mus musculus
tggcgtagcctagcaacgagagatg

SEQ ID NO: 486679 - DNA, 25 bp, Mus musculus
tggcgtagctcctgaaaacctcggc

SEQ ID NO: 486680 - DNA, 25 bp, Mus musculus
tggcgtcacatgagaacacggcacg

SEQ ID NO: 486681 - DNA, 25 bp, Mus musculus
tggcgtcaccgctgctaaggagaag

SEQ ID NO: 486682 - DNA, 25 bp, Mus musculus
tggcgtcggagaggactgactcatc

SEQ ID NO: 486683 - DNA, 25 bp, Mus musculus
tggcgtcggtcatgcaccacttggg

SEQ ID NO: 486684 - DNA, 25 bp, Mus musculus
tggcgtctactgaaccctggcgaat

SEQ ID NO: 486685 - DNA, 25 bp, Mus musculus
tggcgtctttccagccgccttgcta

SEQ ID NO: 486686 - DNA, 25 bp, Mus musculus
tggcgtgcccagtcgaattacgtac

SEQ ID NO: 486687 - DNA, 25 bp, Mus musculus
tggcgtgcctggttttgaggttttc

SEQ ID NO: 486688 - DNA, 25 bp, Mus musculus
tggcgtgcggcctcattactagcaa

SEQ ID NO: 486689 - DNA, 25 bp, Mus musculus
tggcgtgctttctgctcacctgcct

SEQ ID NO: 486690 - DNA, 25 bp, Mus musculus
tggcgtgtatctgaatatctccccg

SEQ ID NO: 486691 - DNA, 25 bp, Mus musculus
tggcgttcacggaacaggaaatgaa

SEQ ID NO: 486692 - DNA, 25 bp, Mus musculus
tggcgttcctcggtgccgtcatctg

SEQ ID NO: 486693 - DNA, 25 bp, Mus musculus
tggcgttgaaccatggcctagacaa

SEQ ID NO: 486694 - DNA, 25 bp, Mus musculus
tggcgttggccagagtcatctcaga

SEQ ID NO: 486695 - DNA, 25 bp, Mus musculus
tggctaaaacgtgggtgcgctacgc

SEQ ID NO: 486696 - DNA, 25 bp, Mus musculus
tggctaaaagctgactctgggcact

SEQ ID NO: 486697 - DNA, 25 bp, Mus musculus
tggctaacaacagtgacacccttcg

SEQ ID NO: 486698 - DNA, 25 bp, Mus musculus
tggctaacaccgagccgctcaggct

SEQ ID NO: 486699 - DNA, 25 bp, Mus musculus
tggctaacgacagatggcccagctg

SEQ ID NO: 486700 - DNA, 25 bp, Mus musculus
tggctaacggtatcctcagagtgtc

SEQ ID NO: 486701 - DNA, 25 bp, Mus musculus
tggctaatcgagctgctacaacggg

SEQ ID NO: 486702 - DNA, 25 bp, Mus musculus
tggctaatcgaggagcaacaagacc

SEQ ID NO: 486703 - DNA, 25 bp, Mus musculus
tggctaatttggaaagttgagccgg

SEQ ID NO: 486704 - DNA, 25 bp, Mus musculus
tggctacacttttcatggctcagga

SEQ ID NO: 486705 - DNA, 25 bp, Mus musculus
tggctacatggtcacacacagaggt

SEQ ID NO: 486706 - DNA, 25 bp, Mus musculus
tggctaccacagaaacaggacaagg

SEQ ID NO: 486707 - DNA, 25 bp, Mus musculus
tggctaccacccaaagtgggctgca

SEQ ID NO: 486708 - DNA, 25 bp, Mus musculus
tggctacccctgcatgtgttcaaca

SEQ ID NO: 486709 - DNA, 25 bp, Mus musculus
tggctacctacgaaagaactgatgg

SEQ ID NO: 486710 - DNA, 25 bp, Mus musculus
tggctacctgatccgacaaactgag

SEQ ID NO: 486711 - DNA, 25 bp, Mus musculus
tggctacggagaggagagctaccct

SEQ ID NO: 486712 - DNA, 25 bp, Mus musculus
tggctacgtatactaccagatattg

SEQ ID NO: 486713 - DNA, 25 bp, Mus musculus
tggctacgtcaagtcggttccgcat

SEQ ID NO: 486714 - DNA, 25 bp, Mus musculus
tggctactaccaggacgaggagact

SEQ ID NO: 486715 - DNA, 25 bp, Mus musculus
tggctagagatgtggaccagtgaac

SEQ ID NO: 486716 - DNA, 25 bp, Mus musculus
tggctagatcctgggtggacccttc

SEQ ID NO: 486717 - DNA, 25 bp, Mus musculus
tggctagtggctctgtgacgaaaac

SEQ ID NO: 486718 - DNA, 25 bp, Mus musculus
tggctatgaaggtgcgcgtccgttt

SEQ ID NO: 486719 - DNA, 25 bp, Mus musculus
tggctatgacagagaatacttgaat

SEQ ID NO: 486720 - DNA, 25 bp, Mus musculus
tggctatgagaccacaagcagtgct

SEQ ID NO: 486721 - DNA, 25 bp, Mus musculus
tggctatgctctttcacttatctgc

SEQ ID NO: 486722 - DNA, 25 bp, Mus musculus
tggctatggaactcactatccttac

SEQ ID NO: 486723 - DNA, 25 bp, Mus musculus
tggctatggcattgctgtgtggcct

SEQ ID NO: 486724 - DNA, 25 bp, Mus musculus
tggctatgtaaaagagtcataaccc

SEQ ID NO: 486725 - DNA, 25 bp, Mus musculus
tggctattacacatcggcagggacc

SEQ ID NO: 486726 - DNA, 25 bp, Mus musculus
tggctcaaggacaagaacaagggcg

SEQ ID NO: 486727 - DNA, 25 bp, Mus musculus
tggctcagacctgcaaaatgcgggc

SEQ ID NO: 486728 - DNA, 25 bp, Mus musculus
tggctcagaggcaacaggtgcaacg

SEQ ID NO: 486729 - DNA, 25 bp, Mus musculus
tggctcagcacagctcgttgctcag

SEQ ID NO: 486730 - DNA, 25 bp, Mus musculus
tggctcagcttctcggcatggtctg

SEQ ID NO: 486731 - DNA, 25 bp, Mus musculus
tggctcagggatgaaacaggaagta

SEQ ID NO: 486732 - DNA, 25 bp, Mus musculus
tggctcagtgttcaagagtactggt

SEQ ID NO: 486733 - DNA, 25 bp, Mus musculus
tggctcatccgggtgcaagagagaa

SEQ ID NO: 486734 - DNA, 25 bp, Mus musculus
tggctccaaagaggcattttcacaa

SEQ ID NO: 486735 - DNA, 25 bp, Mus musculus
tggctccacattcctcctactttga

SEQ ID NO: 486736 - DNA, 25 bp, Mus musculus
tggctccacgcgtgtcttcttcgag

SEQ ID NO: 486737 - DNA, 25 bp, Mus musculus
tggctccagacaggcctatagggtc

SEQ ID NO: 486738 - DNA, 25 bp, Mus musculus
tggctccaggactacaggctctact

SEQ ID NO: 486739 - DNA, 25 bp, Mus musculus
tggctcccagcggacatatcctggt

SEQ ID NO: 486740 - DNA, 25 bp, Mus musculus
tggctcccgtgaatgttgaacccct

SEQ ID NO: 486741 - DNA, 25 bp, Mus musculus
tggctccctaaatacaagatcaaag

SEQ ID NO: 486742 - DNA, 25 bp, Mus musculus
tggctccctctacaggcagggctcc

SEQ ID NO: 486743 - DNA, 25 bp, Mus musculus
tggctccctgtgtataatcattccg

SEQ ID NO: 486744 - DNA, 25 bp, Mus musculus
tggctcctgggagccaaggctcttg

SEQ ID NO: 486745 - DNA, 25 bp, Mus musculus
tggctccttgcgtgccctgtgcgct

SEQ ID NO: 486746 - DNA, 25 bp, Mus musculus
tggctcgagagaacagcagcatgcg

SEQ ID NO: 486747 - DNA, 25 bp, Mus musculus
tggctcgctaagaagaaatttctgc

SEQ ID NO: 486748 - DNA, 25 bp, Mus musculus
tggctcggcagctcaatctctctga

SEQ ID NO: 486749 - DNA, 25 bp, Mus musculus
tggctcggcatcagcaccaggagct

SEQ ID NO: 486750 - DNA, 25 bp, Mus musculus
tggctctccaagcaaatacaaggtg

SEQ ID NO: 486751 - DNA, 25 bp, Mus musculus
tggctctcggtcttagcaccatctt

SEQ ID NO: 486752 - DNA, 25 bp, Mus musculus
tggctctcttatcctgccgttctca

SEQ ID NO: 486753 - DNA, 25 bp, Mus musculus
tggctctgcggcttctagcatcagg

SEQ ID NO: 486754 - DNA, 25 bp, Mus musculus
tggctcttacaacgactatgcatgg

SEQ ID NO: 486755 - DNA, 25 bp, Mus musculus
tggctgaaaacagactgcccctggg

SEQ ID NO: 486756 - DNA, 25 bp, Mus musculus
tggctgaaaaggaaagatgaaccct

SEQ ID NO: 486757 - DNA, 25 bp, Mus musculus
tggctgaactcaagacacgaaggcg

SEQ ID NO: 486758 - DNA, 25 bp, Mus musculus
tggctgaactctaccacctgggctg

SEQ ID NO: 486759 - DNA, 25 bp, Mus musculus
tggctgaagcccttcccagcacagt

SEQ ID NO: 486760 - DNA, 25 bp, Mus musculus
tggctgacacgcttcctgaaacgga

SEQ ID NO: 486761 - DNA, 25 bp, Mus musculus
tggctgacactgagaacctgctgaa

SEQ ID NO: 486762 - DNA, 25 bp, Mus musculus
tggctgacagtttgacagttgggca

SEQ ID NO: 486763 - DNA, 25 bp, Mus musculus
tggctgactacaacatcaagagtgg

SEQ ID NO: 486764 - DNA, 25 bp, Mus musculus
tggctgaggtcacatacgggtttct

SEQ ID NO: 486765 - DNA, 25 bp, Mus musculus
tggctgagtctgctaccccactagc

SEQ ID NO: 486766 - DNA, 25 bp, Mus musculus
tggctgagtgcctgaagctgaccac

SEQ ID NO: 486767 - DNA, 25 bp, Mus musculus
tggctgatatcttccttataggttc

SEQ ID NO: 486768 - DNA, 25 bp, Mus musculus
tggctgatatgcactcgacccagat

SEQ ID NO: 486769 - DNA, 25 bp, Mus musculus
tggctgatctccactccgcatggaa

SEQ ID NO: 486770 - DNA, 25 bp, Mus musculus
tggctgatgctcaaaagcgggagct

SEQ ID NO: 486771 - DNA, 25 bp, Mus musculus
tggctgattacaccctctggtctgg

SEQ ID NO: 486772 - DNA, 25 bp, Mus musculus
tggctgattgtacccagagtggatc

SEQ ID NO: 486773 - DNA, 25 bp, Mus musculus
tggctgcaaacaagcccaagggtca

SEQ ID NO: 486774 - DNA, 25 bp, Mus musculus
tggctgcaacctgccaaacatgtgg

SEQ ID NO: 486775 - DNA, 25 bp, Mus musculus
tggctgcaattgcatgaaatcccaa

SEQ ID NO: 486776 - DNA, 25 bp, Mus musculus
tggctgcagaatccaaactgcatct

SEQ ID NO: 486777 - DNA, 25 bp, Mus musculus
tggctgcagagctcacccttagatg

SEQ ID NO: 486778 - DNA, 25 bp, Mus musculus
tggctgcagatagaccttaacaagg

SEQ ID NO: 486779 - DNA, 25 bp, Mus musculus
tggctgcagcctagtgaagcctgct

SEQ ID NO: 486780 - DNA, 25 bp, Mus musculus
tggctgcatccaagtcctctaggag

SEQ ID NO: 486781 - DNA, 25 bp, Mus musculus
tggctgcatccttggcgattccctg

SEQ ID NO: 486782 - DNA, 25 bp, Mus musculus
tggctgccaacatacccagggtggt

SEQ ID NO: 486783 - DNA, 25 bp, Mus musculus
tggctgcccaagaagtgttccctgt

SEQ ID NO: 486784 - DNA, 25 bp, Mus musculus
tggctgcccagctggtgctaggact

SEQ ID NO: 486785 - DNA, 25 bp, Mus musculus
tggctgcccctgacgaatgaacatc

SEQ ID NO: 486786 - DNA, 25 bp, Mus musculus
tggctgccgaccacaagaaagatct

SEQ ID NO: 486787 - DNA, 25 bp, Mus musculus
tggctgcctctcagcgtttggcgtg

SEQ ID NO: 486788 - DNA, 25 bp, Mus musculus
tggctgcgcccatgtaacctggatc

SEQ ID NO: 486789 - DNA, 25 bp, Mus musculus
tggctgcggaaaatgacgaacctgc

SEQ ID NO: 486790 - DNA, 25 bp, Mus musculus
tggctgctatggactctgcctggat

SEQ ID NO: 486791 - DNA, 25 bp, Mus musculus
tggctgctcattcctctgatcttcc

SEQ ID NO: 486792 - DNA, 25 bp, Mus musculus
tggctgctccagacatgtgtctctt

SEQ ID NO: 486793 - DNA, 25 bp, Mus musculus
tggctgctcgccaatcaaaaactgg

SEQ ID NO: 486794 - DNA, 25 bp, Mus musculus
tggctgctgacacctacaaagagtt

SEQ ID NO: 486795 - DNA, 25 bp, Mus musculus
tggctgctgacatgaatttctgtca

SEQ ID NO: 486796 - DNA, 25 bp, Mus musculus
tggctgctgcacacatcggtgcgca

SEQ ID NO: 486797 - DNA, 25 bp, Mus musculus
tggctgctgcgcacgcatggcgcac

SEQ ID NO: 486798 - DNA, 25 bp, Mus musculus
tggctgctgggaaaaccatgcttga

SEQ ID NO: 486799 - DNA, 25 bp, Mus musculus
tggctgcttacaacctctggaaatt

SEQ ID NO: 486800 - DNA, 25 bp, Mus musculus
tggctggaacgctcagatcaccctg

SEQ ID NO: 486801 - DNA, 25 bp, Mus musculus
tggctggaccatgacctagctgacc

SEQ ID NO: 486802 - DNA, 25 bp, Mus musculus
tggctggactcattggactggctgt

SEQ ID NO: 486803 - DNA, 25 bp, Mus musculus
tggctggacttctccgcaaaggtgg

SEQ ID NO: 486804 - DNA, 25 bp, Mus musculus
tggctggcctgaccaatcggcgctt

SEQ ID NO: 486805 - DNA, 25 bp, Mus musculus
tggctggctgtctcgggctgtaacc

SEQ ID NO: 486806 - DNA, 25 bp, Mus musculus
tggctgggaaggtgttcacctcaag

SEQ ID NO: 486807 - DNA, 25 bp, Mus musculus
tggctgggaccaaagtgacaaatag

SEQ ID NO: 486808 - DNA, 25 bp, Mus musculus
tggctgggcaggtaaagggtagctg

SEQ ID NO: 486809 - DNA, 25 bp, Mus musculus
tggctgggccagacaggatcttcct

SEQ ID NO: 486810 - DNA, 25 bp, Mus musculus
tggctgggctgaatgctatccagat

SEQ ID NO: 486811 - DNA, 25 bp, Mus musculus
tggctggtaacacaacactaacggg

SEQ ID NO: 486812 - DNA, 25 bp, Mus musculus
tggctggtagcgtcactatgctgag

SEQ ID NO: 486813 - DNA, 25 bp, Mus musculus
tggctggtgcaaggtaagtctattt

SEQ ID NO: 486814 - DNA, 25 bp, Mus musculus
tggctggtggcctagagctgcccat

SEQ ID NO: 486815 - DNA, 25 bp, Mus musculus
tggctgtaaaccgaactctgggaca

SEQ ID NO: 486816 - DNA, 25 bp, Mus musculus
tggctgtatccttcatctataactt

SEQ ID NO: 486817 - DNA, 25 bp, Mus musculus
tggctgtcaacaggccgtggaaatg

SEQ ID NO: 486818 - DNA, 25 bp, Mus musculus
tggctgtcaacttccgaaaacgggt

SEQ ID NO: 486819 - DNA, 25 bp, Mus musculus
tggctgtcaagcagaagagggatct

SEQ ID NO: 486820 - DNA, 25 bp, Mus musculus
tggctgtcagtttttcagattatca

SEQ ID NO: 486821 - DNA, 25 bp, Mus musculus
tggctgtcccagacaagctgtcctt

SEQ ID NO: 486822 - DNA, 25 bp, Mus musculus
tggctgtggcaggagctacttccct

SEQ ID NO: 486823 - DNA, 25 bp, Mus musculus
tggctgtgtcagaactcctatgagt

SEQ ID NO: 486824 - DNA, 25 bp, Mus musculus
tggctgttcatctagagaatctggg

SEQ ID NO: 486825 - DNA, 25 bp, Mus musculus
tggctgttcccctatgaaggacact

SEQ ID NO: 486826 - DNA, 25 bp, Mus musculus
tggctgttcctgtacccctctggta

SEQ ID NO: 486827 - DNA, 25 bp, Mus musculus
tggctgttggcatcccggactctga

SEQ ID NO: 486828 - DNA, 25 bp, Mus musculus
tggcttaccacatgaggagatttgc

SEQ ID NO: 486829 - DNA, 25 bp, Mus musculus
tggcttactcctttcagctccctgt

SEQ ID NO: 486830 - DNA, 25 bp, Mus musculus
tggcttacttgtacggcgcctcgcc

SEQ ID NO: 486831 - DNA, 25 bp, Mus musculus
tggcttaggcaactccgtgattcag

SEQ ID NO: 486832 - DNA, 25 bp, Mus musculus
tggcttatgaacaggagcactcccc

SEQ ID NO: 486833 - DNA, 25 bp, Mus musculus
tggcttcaaggtaccagggctcggt

SEQ ID NO: 486834 - DNA, 25 bp, Mus musculus
tggcttcacgagagaacctgcacgt

SEQ ID NO: 486835 - DNA, 25 bp, Mus musculus
tggcttcagaaaacacaaaggtaag

SEQ ID NO: 486836 - DNA, 25 bp, Mus musculus
tggcttcatcgaggacaattacatc

SEQ ID NO: 486837 - DNA, 25 bp, Mus musculus
tggcttcatgccagaggcagttctg

SEQ ID NO: 486838 - DNA, 25 bp, Mus musculus
tggcttccccaagcctagctttaag

SEQ ID NO: 486839 - DNA, 25 bp, Mus musculus
tggcttccgagcctcttcgaaacgt

SEQ ID NO: 486840 - DNA, 25 bp, Mus musculus
tggcttccgtaggatctgcacctgg

SEQ ID NO: 486841 - DNA, 25 bp, Mus musculus
tggcttccttcatggctatcactga

SEQ ID NO: 486842 - DNA, 25 bp, Mus musculus
tggcttcgagcactatgacctgttc

SEQ ID NO: 486843 - DNA, 25 bp, Mus musculus
tggcttcgcagatgctaggcagacg

SEQ ID NO: 486844 - DNA, 25 bp, Mus musculus
tggcttcgctgaaccagatcttgga

SEQ ID NO: 486845 - DNA, 25 bp, Mus musculus
tggcttctaacccagcagtttctca

SEQ ID NO: 486846 - DNA, 25 bp, Mus musculus
tggcttctcgtatcttcggctccca

SEQ ID NO: 486847 - DNA, 25 bp, Mus musculus
tggcttctctggcatggactagacc

SEQ ID NO: 486848 - DNA, 25 bp, Mus musculus
tggcttcttcatgcaacgtctggtg

SEQ ID NO: 486849 - DNA, 25 bp, Mus musculus
tggcttcttttactctggtgctggg

SEQ ID NO: 486850 - DNA, 25 bp, Mus musculus
tggcttgaacaccaacaaaagaccc

SEQ ID NO: 486851 - DNA, 25 bp, Mus musculus
tggcttgacggttctccctagctgg

SEQ ID NO: 486852 - DNA, 25 bp, Mus musculus
tggcttgactcttgaacctccaggg

SEQ ID NO: 486853 - DNA, 25 bp, Mus musculus
tggcttgatgttgctaacttctgtg

SEQ ID NO: 486854 - DNA, 25 bp, Mus musculus
tggcttgcacagcagcgagaacttc

SEQ ID NO: 486855 - DNA, 25 bp, Mus musculus
tggcttgcgtttgcctcagcggata

SEQ ID NO: 486856 - DNA, 25 bp, Mus musculus
tggcttgcttaggacctctgctgcc

SEQ ID NO: 486857 - DNA, 25 bp, Mus musculus
tggcttggacaacgctggcaaaaca

SEQ ID NO: 486858 - DNA, 25 bp, Mus musculus
tggcttggacgaaggtggcccttct

SEQ ID NO: 486859 - DNA, 25 bp, Mus musculus
tggcttggccggttgccctcacagg

SEQ ID NO: 486860 - DNA, 25 bp, Mus musculus
tggctttagtttattccagaagaaa

SEQ ID NO: 486861 - DNA, 25 bp, Mus musculus
tggctttcactctcaattccctcag

SEQ ID NO: 486862 - DNA, 25 bp, Mus musculus
tggctttcagcaacagggacaacac

SEQ ID NO: 486863 - DNA, 25 bp, Mus musculus
tggctttcggttttctcgtcaggaa

SEQ ID NO: 486864 - DNA, 25 bp, Mus musculus
tggctttgcacatgacacctgggct

SEQ ID NO: 486865 - DNA, 25 bp, Mus musculus
tggctttgcagaggcgccccttttg

SEQ ID NO: 486866 - DNA, 25 bp, Mus musculus
tggctttgggaaagacacacactat

SEQ ID NO: 486867 - DNA, 25 bp, Mus musculus
tggctttgtgacgaccgtggcagcc

SEQ ID NO: 486868 - DNA, 25 bp, Mus musculus
tggctttgtgatctccccgaaggag

SEQ ID NO: 486869 - DNA, 25 bp, Mus musculus
tggctttgtttgaacccttgaagag

SEQ ID NO: 486870 - DNA, 25 bp, Mus musculus
tgggaaaaatccagcaatgggcggc

SEQ ID NO: 486871 - DNA, 25 bp, Mus musculus
tgggaaaactccatgaacaaatttg

SEQ ID NO: 486872 - DNA, 25 bp, Mus musculus
tgggaaaatccgctaaattggcagt

SEQ ID NO: 486873 - DNA, 25 bp, Mus musculus
tgggaaaatgtacaaggcagcccct

SEQ ID NO: 486874 - DNA, 25 bp, Mus musculus
tgggaaaattcttggcgagggctct

SEQ ID NO: 486875 - DNA, 25 bp, Mus musculus
tgggaaacaaagtgcccctttctgc

SEQ ID NO: 486876 - DNA, 25 bp, Mus musculus
tgggaaacaatgactgcctctgctg

SEQ ID NO: 486877 - DNA, 25 bp, Mus musculus
tgggaaacagtgacctctcagagct

SEQ ID NO: 486878 - DNA, 25 bp, Mus musculus
tgggaaacatagtctacatttctgg

SEQ ID NO: 486879 - DNA, 25 bp, Mus musculus
tgggaaactagaatgttccacaacc

SEQ ID NO: 486880 - DNA, 25 bp, Mus musculus
tgggaaatgacacatcgggctctct

SEQ ID NO: 486881 - DNA, 25 bp, Mus musculus
tgggaaatggcacgagagcatctac

SEQ ID NO: 486882 - DNA, 25 bp, Mus musculus
tgggaaattccagaaacgagcaagc

SEQ ID NO: 486883 - DNA, 25 bp, Mus musculus
tgggaaatttttcatattagaagct

SEQ ID NO: 486884 - DNA, 25 bp, Mus musculus
tgggaacaacaacggcacatctgtg

SEQ ID NO: 486885 - DNA, 25 bp, Mus musculus
tgggaacactctctccctggacgag

SEQ ID NO: 486886 - DNA, 25 bp, Mus musculus
tgggaacagcacaagcagggaactg

SEQ ID NO: 486887 - DNA, 25 bp, Mus musculus
tgggaacagcccttccagagcctct

SEQ ID NO: 486888 - DNA, 25 bp, Mus musculus
tgggaacaggatctccaacgtggat

SEQ ID NO: 486889 - DNA, 25 bp, Mus musculus
tgggaacatccacagaagccttaat

SEQ ID NO: 486890 - DNA, 25 bp, Mus musculus
tgggaaccagatatgaagaggcgtt

SEQ ID NO: 486891 - DNA, 25 bp, Mus musculus
tgggaacccatttatttatcctgtg

SEQ ID NO: 486892 - DNA, 25 bp, Mus musculus
tgggaacctcaaggccattctaggc

SEQ ID NO: 486893 - DNA, 25 bp, Mus musculus
tgggaactcagaccgtaatgcatat

SEQ ID NO: 486894 - DNA, 25 bp, Mus musculus
tgggaactcccattctgtagaaagg

SEQ ID NO: 486895 - DNA, 25 bp, Mus musculus
tgggaactctgatcattcttctgtt

SEQ ID NO: 486896 - DNA, 25 bp, Mus musculus
tgggaactgaaaccacatttggagg

SEQ ID NO: 486897 - DNA, 25 bp, Mus musculus
tgggaactgagcgtccatgtcacgg

SEQ ID NO: 486898 - DNA, 25 bp, Mus musculus
tgggaactgtgagatcagccaccgt

SEQ ID NO: 486899 - DNA, 25 bp, Mus musculus
tgggaagaaagaccctcaggatctc

SEQ ID NO: 486900 - DNA, 25 bp, Mus musculus
tgggaagaactacagcctcaaggca

SEQ ID NO: 486901 - DNA, 25 bp, Mus musculus
tgggaagacacatatggaaccgctc

SEQ ID NO: 486902 - DNA, 25 bp, Mus musculus
tgggaagacgattcctgggcactcc

SEQ ID NO: 486903 - DNA, 25 bp, Mus musculus
tgggaagagaccgagctagatcagc

SEQ ID NO: 486904 - DNA, 25 bp, Mus musculus
tgggaagagcaagtgctcgcaacca

SEQ ID NO: 486905 - DNA, 25 bp, Mus musculus
tgggaagagcttctggacagcaaac

SEQ ID NO: 486906 - DNA, 25 bp, Mus musculus
tgggaagattgtcctccagggcacc

SEQ ID NO: 486907 - DNA, 25 bp, Mus musculus
tgggaagcagctctacacgaattac

SEQ ID NO: 486908 - DNA, 25 bp, Mus musculus
tgggaagccgaacatactgaactgc

SEQ ID NO: 486909 - DNA, 25 bp, Mus musculus
tgggaagccgcagtagtacccaggt

SEQ ID NO: 486910 - DNA, 25 bp, Mus musculus
tgggaagcctaccttccagaaggcc

SEQ ID NO: 486911 - DNA, 25 bp, Mus musculus
tgggaagcgcatccggaagaatcac

SEQ ID NO: 486912 - DNA, 25 bp, Mus musculus
tgggaaggagcaaatcactgccctg

SEQ ID NO: 486913 - DNA, 25 bp, Mus musculus
tgggaaggcagaaaggctcaacgct

SEQ ID NO: 486914 - DNA, 25 bp, Mus musculus
tgggaaggcttagcaatctcatatt

SEQ ID NO: 486915 - DNA, 25 bp, Mus musculus
tgggaagtacaccagctggcactcg

SEQ ID NO: 486916 - DNA, 25 bp, Mus musculus
tgggaagtcaccactgaaaagcacg

SEQ ID NO: 486917 - DNA, 25 bp, Mus musculus
tgggaagtcctagccagtctccaga

SEQ ID NO: 486918 - DNA, 25 bp, Mus musculus
tgggaataaggaccttttccaggat

SEQ ID NO: 486919 - DNA, 25 bp, Mus musculus
tgggaatagtgtggcccagagtccc

SEQ ID NO: 486920 - DNA, 25 bp, Mus musculus
tgggaatcaacaacatgggagagct

SEQ ID NO: 486921 - DNA, 25 bp, Mus musculus
tgggaatcaatctgggcaagggctc

SEQ ID NO: 486922 - DNA, 25 bp, Mus musculus
tgggaatcacagcattttctcttgg

SEQ ID NO: 486923 - DNA, 25 bp, Mus musculus
tgggaatcactacattgctgcagac

SEQ ID NO: 486924 - DNA, 25 bp, Mus musculus
tgggaatcaggcaacatggacgatt

SEQ ID NO: 486925 - DNA, 25 bp, Mus musculus
tgggaatcagtgaccatcgcagggc

SEQ ID NO: 486926 - DNA, 25 bp, Mus musculus
tgggaatccctcttttgcacccatt

SEQ ID NO: 486927 - DNA, 25 bp, Mus musculus
tgggaatcctgactgcaaccatgtc

SEQ ID NO: 486928 - DNA, 25 bp, Mus musculus
tgggaatctctggtccctgcggacc

SEQ ID NO: 486929 - DNA, 25 bp, Mus musculus
tgggaatgaccacggagctcagaac

SEQ ID NO: 486930 - DNA, 25 bp, Mus musculus
tgggaatgctaaaacgggactgatg

SEQ ID NO: 486931 - DNA, 25 bp, Mus musculus
tgggaattacactccggccagccgg

SEQ ID NO: 486932 - DNA, 25 bp, Mus musculus
tgggaattcggcaaaagacgctctg

SEQ ID NO: 486933 - DNA, 25 bp, Mus musculus
tgggaattgaacagtgtgcccctcc

SEQ ID NO: 486934 - DNA, 25 bp, Mus musculus
tgggaattgccctttgtaccaggac

SEQ ID NO: 486935 - DNA, 25 bp, Mus musculus
tgggacaacgcacaggtcattctcg

SEQ ID NO: 486936 - DNA, 25 bp, Mus musculus
tgggacaacggagaaagggccatcc

SEQ ID NO: 486937 - DNA, 25 bp, Mus musculus
tgggacaactttcttggtactatac

SEQ ID NO: 486938 - DNA, 25 bp, Mus musculus
tgggacaagtataacgaaccgctgc

SEQ ID NO: 486939 - DNA, 25 bp, Mus musculus
tgggacagagataacgacaattacc

SEQ ID NO: 486940 - DNA, 25 bp, Mus musculus
tgggacagcacttttgaggacaagc

SEQ ID NO: 486941 - DNA, 25 bp, Mus musculus
tgggacagccaacactgaggtcaag

SEQ ID NO: 486942 - DNA, 25 bp, Mus musculus
tgggacatctcactgccttcttggc

SEQ ID NO: 486943 - DNA, 25 bp, Mus musculus
tgggaccacagtgccaactagacgc

SEQ ID NO: 486944 - DNA, 25 bp, Mus musculus
tgggaccaggtacacataacacaga

SEQ ID NO: 486945 - DNA, 25 bp, Mus musculus
tgggaccattggaagcgacataaac

SEQ ID NO: 486946 - DNA, 25 bp, Mus musculus
tgggacccaagagggactggctttc

SEQ ID NO: 486947 - DNA, 25 bp, Mus musculus
tgggaccccgatgttgccagctgaa

SEQ ID NO: 486948 - DNA, 25 bp, Mus musculus
tgggaccctatacgactagctctgt

SEQ ID NO: 486949 - DNA, 25 bp, Mus musculus
tgggaccctctatcatgcaacaatg

SEQ ID NO: 486950 - DNA, 25 bp, Mus musculus
tgggaccctggtgactacgagaatg

SEQ ID NO: 486951 - DNA, 25 bp, Mus musculus
tgggaccgaggaaggaagcactcat

SEQ ID NO: 486952 - DNA, 25 bp, Mus musculus
tgggaccggcctcagatcatgtgca

SEQ ID NO: 486953 - DNA, 25 bp, Mus musculus
tgggacctaaagattatgcacttct

SEQ ID NO: 486954 - DNA, 25 bp, Mus musculus
tgggacctacacaacatccaggatg

SEQ ID NO: 486955 - DNA, 25 bp, Mus musculus
tgggacctcaaccacgaagggacgt

SEQ ID NO: 486956 - DNA, 25 bp, Mus musculus
tgggacctcccagtagcaaagactt

SEQ ID NO: 486957 - DNA, 25 bp, Mus musculus
tgggacctcgtctgttgcggccagt

SEQ ID NO: 486958 - DNA, 25 bp, Mus musculus
tgggacctgcaagatgccgcttgga

SEQ ID NO: 486959 - DNA, 25 bp, Mus musculus
tgggacctgccagctttgagactct

SEQ ID NO: 486960 - DNA, 25 bp, Mus musculus
tgggacctggcttccgtgggataac

SEQ ID NO: 486961 - DNA, 25 bp, Mus musculus
tgggacctttccatacaagcaacag

SEQ ID NO: 486962 - DNA, 25 bp, Mus musculus
tgggacgagtcaaccaactgctgga

SEQ ID NO: 486963 - DNA, 25 bp, Mus musculus
tgggacgcttgtaatgaaagcaagg

SEQ ID NO: 486964 - DNA, 25 bp, Mus musculus
tgggacggctcctcctatgtagggc

SEQ ID NO: 486965 - DNA, 25 bp, Mus musculus
tgggactagaagagcaaccagtact

SEQ ID NO: 486966 - DNA, 25 bp, Mus musculus
tgggactcacctcagacaagcggtt

SEQ ID NO: 486967 - DNA, 25 bp, Mus musculus
tgggactcccaggtccgatatctga

SEQ ID NO: 486968 - DNA, 25 bp, Mus musculus
tgggactccggaaccttaggctctg

SEQ ID NO: 486969 - DNA, 25 bp, Mus musculus
tgggactccgtcatccatgaaggac

SEQ ID NO: 486970 - DNA, 25 bp, Mus musculus
tgggactcgcaccacgattctgaac

SEQ ID NO: 486971 - DNA, 25 bp, Mus musculus
tgggactcgggctaatgagacaaaa

SEQ ID NO: 486972 - DNA, 25 bp, Mus musculus
tgggactcgtggtatggcaacaaac

SEQ ID NO: 486973 - DNA, 25 bp, Mus musculus
tgggactgacggaattacttatgcc

SEQ ID NO: 486974 - DNA, 25 bp, Mus musculus
tgggactgggcctgcataacctgaa

SEQ ID NO: 486975 - DNA, 25 bp, Mus musculus
tgggactgtacagccgctgtagcca

SEQ ID NO: 486976 - DNA, 25 bp, Mus musculus
tgggacttctgaccaaccacggtgg

SEQ ID NO: 486977 - DNA, 25 bp, Mus musculus
tgggacttgccagagatgatcagga

SEQ ID NO: 486978 - DNA, 25 bp, Mus musculus
tgggactttctaaccacttccagcc

SEQ ID NO: 486979 - DNA, 25 bp, Mus musculus
tgggagaaaggataggtcctcacag

SEQ ID NO: 486980 - DNA, 25 bp, Mus musculus
tgggagaaatctgggaacggcaacc

SEQ ID NO: 486981 - DNA, 25 bp, Mus musculus
tgggagaacccgtccagatggagaa

SEQ ID NO: 486982 - DNA, 25 bp, Mus musculus
tgggagaacctgctcaaaatctgtg

SEQ ID NO: 486983 - DNA, 25 bp, Mus musculus
tgggagaatccagaaatggccctct

SEQ ID NO: 486984 - DNA, 25 bp, Mus musculus
tgggagaatttgcaccagcagacac

SEQ ID NO: 486985 - DNA, 25 bp, Mus musculus
tgggagagacccataaagccctggt

SEQ ID NO: 486986 - DNA, 25 bp, Mus musculus
tgggagagcccaacatcctcatctg

SEQ ID NO: 486987 - DNA, 25 bp, Mus musculus
tgggagataactctggacactggca

SEQ ID NO: 486988 - DNA, 25 bp, Mus musculus
tgggagatctctaccacgatgcgtg

SEQ ID NO: 486989 - DNA, 25 bp, Mus musculus
tgggagatgctgtcccggctttttc

SEQ ID NO: 486990 - DNA, 25 bp, Mus musculus
tgggagcaacagttattccagctgc

SEQ ID NO: 486991 - DNA, 25 bp, Mus musculus
tgggagcaagaacccttacacctgc

SEQ ID NO: 486992 - DNA, 25 bp, Mus musculus
tgggagcacgcttactaccttcagt

SEQ ID NO: 486993 - DNA, 25 bp, Mus musculus
tgggagccacgtgagtcactgggct

SEQ ID NO: 486994 - DNA, 25 bp, Mus musculus
tgggagccagccacaatcccagcat

SEQ ID NO: 486995 - DNA, 25 bp, Mus musculus
tgggagccaggacatcaagcagatt

SEQ ID NO: 486996 - DNA, 25 bp, Mus musculus
tgggagcccaaacccacccaggctt

SEQ ID NO: 486997 - DNA, 25 bp, Mus musculus
tgggagcccaccgtgtcattgtgtg

SEQ ID NO: 486998 - DNA, 25 bp, Mus musculus
tgggagcccactgttgccagtactc

SEQ ID NO: 486999 - DNA, 25 bp, Mus musculus
tgggagccgcaccacctaacgctgg

SEQ ID NO: 487000 - DNA, 25 bp, Mus musculus
tgggagcgcttctcgctgtgctgaa

SEQ ID NO: 487001 - DNA, 25 bp, Mus musculus
tgggagctcaggaaattgtccacct

SEQ ID NO: 487002 - DNA, 25 bp, Mus musculus
tgggagctcatcaagacagtcactg

SEQ ID NO: 487003 - DNA, 25 bp, Mus musculus
tgggagctgctcttgagagcctctc

SEQ ID NO: 487004 - DNA, 25 bp, Mus musculus
tgggagcttctgagttattccagcc

SEQ ID NO: 487005 - DNA, 25 bp, Mus musculus
tgggaggagatgcaaccaagtctac

SEQ ID NO: 487006 - DNA, 25 bp, Mus musculus
tgggaggagggcagtttctcttcac

SEQ ID NO: 487007 - DNA, 25 bp, Mus musculus
tgggaggataccagcccttactctg

SEQ ID NO: 487008 - DNA, 25 bp, Mus musculus
tgggaggatctacagccgcaagaac

SEQ ID NO: 487009 - DNA, 25 bp, Mus musculus
tgggaggcccaaacgaatcctgtca

SEQ ID NO: 487010 - DNA, 25 bp, Mus musculus
tgggaggcctgatgcacctgaagct

SEQ ID NO: 487011 - DNA, 25 bp, Mus musculus
tgggaggtcacagagcacactcaca

SEQ ID NO: 487012 - DNA, 25 bp, Mus musculus
tgggaggtccgagttctcgtcccca

SEQ ID NO: 487013 - DNA, 25 bp, Mus musculus
tgggagtcacccatggactggtcac

SEQ ID NO: 487014 - DNA, 25 bp, Mus musculus
tgggagtccttgagaacctggaaga

SEQ ID NO: 487015 - DNA, 25 bp, Mus musculus
tgggagtgatctgcgccatcatcct

SEQ ID NO: 487016 - DNA, 25 bp, Mus musculus
tgggagtggagcagagccttctttc

SEQ ID NO: 487017 - DNA, 25 bp, Mus musculus
tgggagttcatatcttcacaccgaa

SEQ ID NO: 487018 - DNA, 25 bp, Mus musculus
tgggagttgtagttccaggcccggg

SEQ ID NO: 487019 - DNA, 25 bp, Mus musculus
tgggagttttcactttcagagggtc

SEQ ID NO: 487020 - DNA, 25 bp, Mus musculus
tgggatacctctacttcagctacga

SEQ ID NO: 487021 - DNA, 25 bp, Mus musculus
tgggatacggtcagcaatcaagtgc

SEQ ID NO: 487022 - DNA, 25 bp, Mus musculus
tgggatagcctctgcaacatgagcc

SEQ ID NO: 487023 - DNA, 25 bp, Mus musculus
tgggataggaccgtctgtcctctgc

SEQ ID NO: 487024 - DNA, 25 bp, Mus musculus
tgggatatgctacttgagacaacct

SEQ ID NO: 487025 - DNA, 25 bp, Mus musculus
tgggatcacagaagccaagaaactg

SEQ ID NO: 487026 - DNA, 25 bp, Mus musculus
tgggatcagccatagctacagagcc

SEQ ID NO: 487027 - DNA, 25 bp, Mus musculus
tgggatccactacaccttcggcttg

SEQ ID NO: 487028 - DNA, 25 bp, Mus musculus
tgggatcccaacaggccagaaaact

SEQ ID NO: 487029 - DNA, 25 bp, Mus musculus
tgggatccctgactaatgacagttt

SEQ ID NO: 487030 - DNA, 25 bp, Mus musculus
tgggatccgacgtcccgcttgtgtg

SEQ ID NO: 487031 - DNA, 25 bp, Mus musculus
tgggatcctgagataatacctcttg

SEQ ID NO: 487032 - DNA, 25 bp, Mus musculus
tgggatcctggaaagcatatgttct

SEQ ID NO: 487033 - DNA, 25 bp, Mus musculus
tgggatcctggcatcctgaaggctg

SEQ ID NO: 487034 - DNA, 25 bp, Mus musculus
tgggatcctgtgtgcagccatgcaa

SEQ ID NO: 487035 - DNA, 25 bp, Mus musculus
tgggatcctttagtgccaagcctgg

SEQ ID NO: 487036 - DNA, 25 bp, Mus musculus
tgggatcgacaacagtccacttgct

SEQ ID NO: 487037 - DNA, 25 bp, Mus musculus
tgggatctagaccaaagcaccttgc

SEQ ID NO: 487038 - DNA, 25 bp, Mus musculus
tgggatctagctcagaaagcactgg

SEQ ID NO: 487039 - DNA, 25 bp, Mus musculus
tgggatctggacatggctagcctct

SEQ ID NO: 487040 - DNA, 25 bp, Mus musculus
tgggatgacatcctgcagctctctg

SEQ ID NO: 487041 - DNA, 25 bp, Mus musculus
tgggatgacccagtgctctaagcaa

SEQ ID NO: 487042 - DNA, 25 bp, Mus musculus
tgggatgacgtcattctgcggccct

SEQ ID NO: 487043 - DNA, 25 bp, Mus musculus
tgggatgcaacagccacttacatgt

SEQ ID NO: 487044 - DNA, 25 bp, Mus musculus
tgggatgccacagcgatttaaggcc

SEQ ID NO: 487045 - DNA, 25 bp, Mus musculus
tgggatgctcttcacagccacggtg

SEQ ID NO: 487046 - DNA, 25 bp, Mus musculus
tgggatggcgaacagaagactcact

SEQ ID NO: 487047 - DNA, 25 bp, Mus musculus
tgggatgtagaaactagaaaaggca

SEQ ID NO: 487048 - DNA, 25 bp, Mus musculus
tgggatgtcaggagcgtgtcattca

SEQ ID NO: 487049 - DNA, 25 bp, Mus musculus
tgggatgtcctacaaacctatcgcg

SEQ ID NO: 487050 - DNA, 25 bp, Mus musculus
tgggatgtcctctccagcagtaccg

SEQ ID NO: 487051 - DNA, 25 bp, Mus musculus
tgggatgtgcgaataccctttcaac

SEQ ID NO: 487052 - DNA, 25 bp, Mus musculus
tgggatgttacagcacgcagtggac

SEQ ID NO: 487053 - DNA, 25 bp, Mus musculus
tgggattaaccacgctcctgggcac

SEQ ID NO: 487054 - DNA, 25 bp, Mus musculus
tgggattacatgcacccctttcctg

SEQ ID NO: 487055 - DNA, 25 bp, Mus musculus
tgggattcaatgtgtgctaccatgc

SEQ ID NO: 487056 - DNA, 25 bp, Mus musculus
tgggattccaggtccgtatcacctg

SEQ ID NO: 487057 - DNA, 25 bp, Mus musculus
tgggattcctgatcaaaccagcctg

SEQ ID NO: 487058 - DNA, 25 bp, Mus musculus
tgggattccttctgccagctttgca

SEQ ID NO: 487059 - DNA, 25 bp, Mus musculus
tgggattctctgacacacaacactg

SEQ ID NO: 487060 - DNA, 25 bp, Mus musculus
tgggattgcaacctagacagctggt

SEQ ID NO: 487061 - DNA, 25 bp, Mus musculus
tgggattgcaacctggacacgaaag

SEQ ID NO: 487062 - DNA, 25 bp, Mus musculus
tgggatttcactctgtcctcccatc

SEQ ID NO: 487063 - DNA, 25 bp, Mus musculus
tgggatttctcatagcggccgttcc

SEQ ID NO: 487064 - DNA, 25 bp, Mus musculus
tgggatttgcactgaactagaaagc

SEQ ID NO: 487065 - DNA, 25 bp, Mus musculus
tgggatttgctttgacggacttggt

SEQ ID NO: 487066 - DNA, 25 bp, Mus musculus
tgggattttacaggtggtgtcacct

SEQ ID NO: 487067 - DNA, 25 bp, Mus musculus
tgggcaaaagagaaaaccgcttact

SEQ ID NO: 487068 - DNA, 25 bp, Mus musculus
tgggcaaacttctcggccctgaatg

SEQ ID NO: 487069 - DNA, 25 bp, Mus musculus
tgggcaacacgagagcacatacttc

SEQ ID NO: 487070 - DNA, 25 bp, Mus musculus
tgggcaacatccaaacccactgtct

SEQ ID NO: 487071 - DNA, 25 bp, Mus musculus
tgggcaaccactcagcgaagctgga

SEQ ID NO: 487072 - DNA, 25 bp, Mus musculus
tgggcaacctaccagcagtcatcca

SEQ ID NO: 487073 - DNA, 25 bp, Mus musculus
tgggcaacctgctggcttcggaccg

SEQ ID NO: 487074 - DNA, 25 bp, Mus musculus
tgggcaactcgctggtgatctacgt

SEQ ID NO: 487075 - DNA, 25 bp, Mus musculus
tgggcaactggacaactcaactctg

SEQ ID NO: 487076 - DNA, 25 bp, Mus musculus
tgggcaagaactagggacccagact

SEQ ID NO: 487077 - DNA, 25 bp, Mus musculus
tgggcaagaccatcgatcggctcat

SEQ ID NO: 487078 - DNA, 25 bp, Mus musculus
tgggcaagacccgagctcggagtac

SEQ ID NO: 487079 - DNA, 25 bp, Mus musculus
tgggcaagatctacaactcgcgggt

SEQ ID NO: 487080 - DNA, 25 bp, Mus musculus
tgggcaagcagcaaacagtcatggc

SEQ ID NO: 487081 - DNA, 25 bp, Mus musculus
tgggcaagcttgttcactgagacct

SEQ ID NO: 487082 - DNA, 25 bp, Mus musculus
tgggcaatgctcacatcttcttggg

SEQ ID NO: 487083 - DNA, 25 bp, Mus musculus
tgggcaatgtatgctaccactgagc

SEQ ID NO: 487084 - DNA, 25 bp, Mus musculus
tgggcacaaaagtgaggaccaatct

SEQ ID NO: 487085 - DNA, 25 bp, Mus musculus
tgggcacacactgggtggcattcca

SEQ ID NO: 487086 - DNA, 25 bp, Mus musculus
tgggcacagcctgccagtctacaat

SEQ ID NO: 487087 - DNA, 25 bp, Mus musculus
tgggcacatctggaagcgcgcgaac

SEQ ID NO: 487088 - DNA, 25 bp, Mus musculus
tgggcaccaaatgccagaatggtag

SEQ ID NO: 487089 - DNA, 25 bp, Mus musculus
tgggcaccagacaccaatcacagat

SEQ ID NO: 487090 - DNA, 25 bp, Mus musculus
tgggcaccagttgctagcaccaagg

SEQ ID NO: 487091 - DNA, 25 bp, Mus musculus
tgggcaccatagcaacacaaaaagc

SEQ ID NO: 487092 - DNA, 25 bp, Mus musculus
tgggcaccctctacggtaacgtgtt

SEQ ID NO: 487093 - DNA, 25 bp, Mus musculus
tgggcaccggcaactatgatgtcaa

SEQ ID NO: 487094 - DNA, 25 bp, Mus musculus
tgggcaccgggtctaactgatttca

SEQ ID NO: 487095 - DNA, 25 bp, Mus musculus
tgggcaccgtgctcatgatcacagg

SEQ ID NO: 487096 - DNA, 25 bp, Mus musculus
tgggcacctacaggaaggcttcggc

SEQ ID NO: 487097 - DNA, 25 bp, Mus musculus
tgggcacgcctttttctacgcaggg

SEQ ID NO: 487098 - DNA, 25 bp, Mus musculus
tgggcacgttggctaaggtcacccc

SEQ ID NO: 487099 - DNA, 25 bp, Mus musculus
tgggcactcggatacattgcaagac

SEQ ID NO: 487100 - DNA, 25 bp, Mus musculus
tgggcactcttgttgctctggagtc

SEQ ID NO: 487101 - DNA, 25 bp, Mus musculus
tgggcagaactcacaaaggcataaa

SEQ ID NO: 487102 - DNA, 25 bp, Mus musculus
tgggcagaagaatggaagcacctca

SEQ ID NO: 487103 - DNA, 25 bp, Mus musculus
tgggcagaaggcaggtacctcagct

SEQ ID NO: 487104 - DNA, 25 bp, Mus musculus
tgggcagactgtatcaagcgagact

SEQ ID NO: 487105 - DNA, 25 bp, Mus musculus
tgggcagagcatggactgtccttag

SEQ ID NO: 487106 - DNA, 25 bp, Mus musculus
tgggcagagcccaacttaccatgag

SEQ ID NO: 487107 - DNA, 25 bp, Mus musculus
tgggcagcaccatcacgtggagaca

SEQ ID NO: 487108 - DNA, 25 bp, Mus musculus
tgggcagcagcaacatcatcggaat

SEQ ID NO: 487109 - DNA, 25 bp, Mus musculus
tgggcagcctttagagatctctcac

SEQ ID NO: 487110 - DNA, 25 bp, Mus musculus
tgggcagcgcacaataaagacatcc

SEQ ID NO: 487111 - DNA, 25 bp, Mus musculus
tgggcagctgcctccttaggtgtta

SEQ ID NO: 487112 - DNA, 25 bp, Mus musculus
tgggcagctgctcccttagtatgca

SEQ ID NO: 487113 - DNA, 25 bp, Mus musculus
tgggcaggcagatccaatggtctta

SEQ ID NO: 487114 - DNA, 25 bp, Mus musculus
tgggcagggatagcaagactttcac

SEQ ID NO: 487115 - DNA, 25 bp, Mus musculus
tgggcagtcccagaaagaaaagatc

SEQ ID NO: 487116 - DNA, 25 bp, Mus musculus
tgggcagtgtccatacagactccag

SEQ ID NO: 487117 - DNA, 25 bp, Mus musculus
tgggcagttcctgaagaccagggaa

SEQ ID NO: 487118 - DNA, 25 bp, Mus musculus
tgggcagttggcaccatagaggatc

SEQ ID NO: 487119 - DNA, 25 bp, Mus musculus
tgggcataagccaggcccggcagct

SEQ ID NO: 487120 - DNA, 25 bp, Mus musculus
tgggcatactcaaagcctgctgggt

SEQ ID NO: 487121 - DNA, 25 bp, Mus musculus
tgggcatagctcagacacaagtggc

SEQ ID NO: 487122 - DNA, 25 bp, Mus musculus
tgggcatagtctacctccggatcgg

SEQ ID NO: 487123 - DNA, 25 bp, Mus musculus
tgggcatatgccttcttggagagct

SEQ ID NO: 487124 - DNA, 25 bp, Mus musculus
tgggcatcatcagcaaggactcagg

SEQ ID NO: 487125 - DNA, 25 bp, Mus musculus
tgggcatccctgagcaatctggtgg

SEQ ID NO: 487126 - DNA, 25 bp, Mus musculus
tgggcatcggattccacctgcaggt

SEQ ID NO: 487127 - DNA, 25 bp, Mus musculus
tgggcatctctctccgagggtcgcg

SEQ ID NO: 487128 - DNA, 25 bp, Mus musculus
tgggcatcttgcaagctcagggact

SEQ ID NO: 487129 - DNA, 25 bp, Mus musculus
tgggcatgaatgtccaccgtgcact

SEQ ID NO: 487130 - DNA, 25 bp, Mus musculus
tgggcatgcctgtcaactctaagta

SEQ ID NO: 487131 - DNA, 25 bp, Mus musculus
tgggcatgcgccagctaacgtttgc

SEQ ID NO: 487132 - DNA, 25 bp, Mus musculus
tgggcatgctcgttccttggatctg

SEQ ID NO: 487133 - DNA, 25 bp, Mus musculus
tgggcattaaatgaaacgttcagtc

SEQ ID NO: 487134 - DNA, 25 bp, Mus musculus
tgggccaaaatcctcgctgtcgaca

SEQ ID NO: 487135 - DNA, 25 bp, Mus musculus
tgggccaaactctacagcctggtga

SEQ ID NO: 487136 - DNA, 25 bp, Mus musculus
tgggccaaagaggtgtcctattgcc

SEQ ID NO: 487137 - DNA, 25 bp, Mus musculus
tgggccaagtctgtaaaacgctagc

SEQ ID NO: 487138 - DNA, 25 bp, Mus musculus
tgggccacacaaacgcttgttccgg

SEQ ID NO: 487139 - DNA, 25 bp, Mus musculus
tgggccacccgggttcaagatatct

SEQ ID NO: 487140 - DNA, 25 bp, Mus musculus
tgggccaccgttgtgcaaattaaaa

SEQ ID NO: 487141 - DNA, 25 bp, Mus musculus
tgggccacgaagcagatgaatccgc

SEQ ID NO: 487142 - DNA, 25 bp, Mus musculus
tgggccactagcagggattgaaaac

SEQ ID NO: 487143 - DNA, 25 bp, Mus musculus
tgggccagaaacacctaactgagtg

SEQ ID NO: 487144 - DNA, 25 bp, Mus musculus
tgggccagaaacacttcaagtggtg

SEQ ID NO: 487145 - DNA, 25 bp, Mus musculus
tgggccagacccttgtgaggcttca

SEQ ID NO: 487146 - DNA, 25 bp, Mus musculus
tgggccagcggaagcaaaagaagca

SEQ ID NO: 487147 - DNA, 25 bp, Mus musculus
tgggccagctatttccagaataaat

SEQ ID NO: 487148 - DNA, 25 bp, Mus musculus
tgggccagctcgtgtaatactctag

SEQ ID NO: 487149 - DNA, 25 bp, Mus musculus
tgggccagctgacttaggacagacc

SEQ ID NO: 487150 - DNA, 25 bp, Mus musculus
tgggccaggatgagaagcaacaagc

SEQ ID NO: 487151 - DNA, 25 bp, Mus musculus
tgggccaggcatgcaactgtctgct

SEQ ID NO: 487152 - DNA, 25 bp, Mus musculus
tgggccagtaccgaagccgtgaaat

SEQ ID NO: 487153 - DNA, 25 bp, Mus musculus
tgggccagtaggactcagagtgact

SEQ ID NO: 487154 - DNA, 25 bp, Mus musculus
tgggccagtgcaccaaggacatcat

SEQ ID NO: 487155 - DNA, 25 bp, Mus musculus
tgggccatcacgctctttaaacagg

SEQ ID NO: 487156 - DNA, 25 bp, Mus musculus
tgggccatcagcaactcaagacttt

SEQ ID NO: 487157 - DNA, 25 bp, Mus musculus
tgggccatccatccgcattgcttaa

SEQ ID NO: 487158 - DNA, 25 bp, Mus musculus
tgggccattcccaacaggcagatga

SEQ ID NO: 487159 - DNA, 25 bp, Mus musculus
tgggcccaaaacaaaggcagctgtg

SEQ ID NO: 487160 - DNA, 25 bp, Mus musculus
tgggcccagccaattaacaaggact

SEQ ID NO: 487161 - DNA, 25 bp, Mus musculus
tgggcccagctcatcatcaatacag

SEQ ID NO: 487162 - DNA, 25 bp, Mus musculus
tgggcccagggctttgcacatgcta

SEQ ID NO: 487163 - DNA, 25 bp, Mus musculus
tgggccccaattcaataatgatttt

SEQ ID NO: 487164 - DNA, 25 bp, Mus musculus
tgggccccaccaaacgagagaaatt

SEQ ID NO: 487165 - DNA, 25 bp, Mus musculus
tgggccccatcaagtaagctcagtc

SEQ ID NO: 487166 - DNA, 25 bp, Mus musculus
tgggccccatcattgacagagtgtt

SEQ ID NO: 487167 - DNA, 25 bp, Mus musculus
tgggccccatgagttttgcagagaa

SEQ ID NO: 487168 - DNA, 25 bp, Mus musculus
tgggcccctacatgtcttgcaagtg

SEQ ID NO: 487169 - DNA, 25 bp, Mus musculus
tgggcccctggacaacgtctgcatt

SEQ ID NO: 487170 - DNA, 25 bp, Mus musculus
tgggccccttaaacacttggattgg

SEQ ID NO: 487171 - DNA, 25 bp, Mus musculus
tgggcccgaagggtcagttccttat

SEQ ID NO: 487172 - DNA, 25 bp, Mus musculus
tgggcccgagttccggctcctgtca

SEQ ID NO: 487173 - DNA, 25 bp, Mus musculus
tgggccctagctggacttggacatc

SEQ ID NO: 487174 - DNA, 25 bp, Mus musculus
tgggccctgtacaaggtctgaattc

SEQ ID NO: 487175 - DNA, 25 bp, Mus musculus
tgggccctgtcagaggtaagccagt

SEQ ID NO: 487176 - DNA, 25 bp, Mus musculus
tgggccgactcagaccgcgaagagt

SEQ ID NO: 487177 - DNA, 25 bp, Mus musculus
tgggccgagccaacttcacttgcgt

SEQ ID NO: 487178 - DNA, 25 bp, Mus musculus
tgggccgagctcttctcagctgcca

SEQ ID NO: 487179 - DNA, 25 bp, Mus musculus
tgggccgattggagcataccttctg

SEQ ID NO: 487180 - DNA, 25 bp, Mus musculus
tgggccgccgtcctacttacgtgga

SEQ ID NO: 487181 - DNA, 25 bp, Mus musculus
tgggccgctgacatgaatttggaag

SEQ ID NO: 487182 - DNA, 25 bp, Mus musculus
tgggccgtcgttgagttacctttat

SEQ ID NO: 487183 - DNA, 25 bp, Mus musculus
tgggccgtgttctacagactcagag

SEQ ID NO: 487184 - DNA, 25 bp, Mus musculus
tgggcctacacacatgactttattg

SEQ ID NO: 487185 - DNA, 25 bp, Mus musculus
tgggcctcgccatcccttgtggtct

SEQ ID NO: 487186 - DNA, 25 bp, Mus musculus
tgggcctgctacaaggcaagggcat

SEQ ID NO: 487187 - DNA, 25 bp, Mus musculus
tgggcctgctcaccgcaaagagttc

SEQ ID NO: 487188 - DNA, 25 bp, Mus musculus
tgggcctggactttgagatcgctac

SEQ ID NO: 487189 - DNA, 25 bp, Mus musculus
tgggcctgggtgtgttcgaaaactt

SEQ ID NO: 487190 - DNA, 25 bp, Mus musculus
tgggcctgtgcgatagctgtctatt

SEQ ID NO: 487191 - DNA, 25 bp, Mus musculus
tgggccttctattttcagactgtac

SEQ ID NO: 487192 - DNA, 25 bp, Mus musculus
tgggccttgccaccccattgcatgg

SEQ ID NO: 487193 - DNA, 25 bp, Mus musculus
tgggcgaaccaaggctcagaactaa

SEQ ID NO: 487194 - DNA, 25 bp, Mus musculus
tgggcgacaccatcagggagaaaac

SEQ ID NO: 487195 - DNA, 25 bp, Mus musculus
tgggcgacatctcaacagttctggg

SEQ ID NO: 487196 - DNA, 25 bp, Mus musculus
tgggcgaccctgaaaactggcacat

SEQ ID NO: 487197 - DNA, 25 bp, Mus musculus
tgggcgactacaacgaacaggtgct

SEQ ID NO: 487198 - DNA, 25 bp, Mus musculus
tgggcgactgagaaaatctcgcact

SEQ ID NO: 487199 - DNA, 25 bp, Mus musculus
tgggcgagctcaaacggaccattcg

SEQ ID NO: 487200 - DNA, 25 bp, Mus musculus
tgggcgagggcaaaaagacatccta

SEQ ID NO: 487201 - DNA, 25 bp, Mus musculus
tgggcgagtccttccggatataaac

SEQ ID NO: 487202 - DNA, 25 bp, Mus musculus
tgggcgagtcctttacgcatatggc

SEQ ID NO: 487203 - DNA, 25 bp, Mus musculus
tgggcgatgccaaagactgactcct

SEQ ID NO: 487204 - DNA, 25 bp, Mus musculus
tgggcgatgccagcggaaagaatct

SEQ ID NO: 487205 - DNA, 25 bp, Mus musculus
tgggcgcagctggtccaatcagcga

SEQ ID NO: 487206 - DNA, 25 bp, Mus musculus
tgggcgcccctttctcattatcaag

SEQ ID NO: 487207 - DNA, 25 bp, Mus musculus
tgggcgccgtttaagaccgagcttc

SEQ ID NO: 487208 - DNA, 25 bp, Mus musculus
tgggcgcgctggtagtgttccctct

SEQ ID NO: 487209 - DNA, 25 bp, Mus musculus
tgggcgctttggacaggactgtaca

SEQ ID NO: 487210 - DNA, 25 bp, Mus musculus
tgggcggccaagtatattaggaacc

SEQ ID NO: 487211 - DNA, 25 bp, Mus musculus
tgggcggccctggtacttaaagcac

SEQ ID NO: 487212 - DNA, 25 bp, Mus musculus
tgggcggcgaccaccctaggcctag

SEQ ID NO: 487213 - DNA, 25 bp, Mus musculus
tgggcgggtcagttgtgtcatctac

SEQ ID NO: 487214 - DNA, 25 bp, Mus musculus
tgggcggtgtgcttccagggctgcc

SEQ ID NO: 487215 - DNA, 25 bp, Mus musculus
tgggcggtttccagcaggcacagct

SEQ ID NO: 487216 - DNA, 25 bp, Mus musculus
tgggcgtactatgtgtacaggtacc

SEQ ID NO: 487217 - DNA, 25 bp, Mus musculus
tgggcgtcagcctaatcacagatgg

SEQ ID NO: 487218 - DNA, 25 bp, Mus musculus
tgggcgtggcgcttttccaggtact

SEQ ID NO: 487219 - DNA, 25 bp, Mus musculus
tgggctacactgcaagatcctgact

SEQ ID NO: 487220 - DNA, 25 bp, Mus musculus
tgggctacttactaccaggagaaac

SEQ ID NO: 487221 - DNA, 25 bp, Mus musculus
tgggctattacagcgctcctcagca

SEQ ID NO: 487222 - DNA, 25 bp, Mus musculus
tgggctcaagtactacaggatgatg

SEQ ID NO: 487223 - DNA, 25 bp, Mus musculus
tgggctcagcaatcggactccacgt

SEQ ID NO: 487224 - DNA, 25 bp, Mus musculus
tgggctcagccaagtaatcagggtc

SEQ ID NO: 487225 - DNA, 25 bp, Mus musculus
tgggctcaggtctgtctgctctgca

SEQ ID NO: 487226 - DNA, 25 bp, Mus musculus
tgggctccagcgagttgctctacgt

SEQ ID NO: 487227 - DNA, 25 bp, Mus musculus
tgggctcccaaacatggatcctgag

SEQ ID NO: 487228 - DNA, 25 bp, Mus musculus
tgggctccccgaaagggacctgtgc

SEQ ID NO: 487229 - DNA, 25 bp, Mus musculus
tgggctccggaggtctaactgcatg

SEQ ID NO: 487230 - DNA, 25 bp, Mus musculus
tgggctcctaactgatagacagagg

SEQ ID NO: 487231 - DNA, 25 bp, Mus musculus
tgggctcggcactcaagtggccctc

SEQ ID NO: 487232 - DNA, 25 bp, Mus musculus
tgggctcgtgagttcctgcaggtct

SEQ ID NO: 487233 - DNA, 25 bp, Mus musculus
tgggctctagctacagaacagaacg

SEQ ID NO: 487234 - DNA, 25 bp, Mus musculus
tgggctctagggtcacatccccgct

SEQ ID NO: 487235 - DNA, 25 bp, Mus musculus
tgggctctcaaaagtcatctgtgac

SEQ ID NO: 487236 - DNA, 25 bp, Mus musculus
tgggctctcatcctcagattctgag

SEQ ID NO: 487237 - DNA, 25 bp, Mus musculus
tgggctctccagtgagcctggttcc

SEQ ID NO: 487238 - DNA, 25 bp, Mus musculus
tgggctctctctttgcaaaatacac

SEQ ID NO: 487239 - DNA, 25 bp, Mus musculus
tgggctctggaagtcatctgggatt

SEQ ID NO: 487240 - DNA, 25 bp, Mus musculus
tgggctctggactgcaacactgtgc

SEQ ID NO: 487241 - DNA, 25 bp, Mus musculus
tgggctcttcttcaccacgggagac

SEQ ID NO: 487242 - DNA, 25 bp, Mus musculus
tgggctgacagcaaatcctcctgag

SEQ ID NO: 487243 - DNA, 25 bp, Mus musculus
tgggctgacccgctaaccatttgtc

SEQ ID NO: 487244 - DNA, 25 bp, Mus musculus
tgggctgacggaactgcatgatgac

SEQ ID NO: 487245 - DNA, 25 bp, Mus musculus
tgggctgaggccaggaatgactcta

SEQ ID NO: 487246 - DNA, 25 bp, Mus musculus
tgggctgattgaagcaggtttagaa

SEQ ID NO: 487247 - DNA, 25 bp, Mus musculus
tgggctgcaagctgctggccttcct

SEQ ID NO: 487248 - DNA, 25 bp, Mus musculus
tgggctgcagtgtcacccttcaaag

SEQ ID NO: 487249 - DNA, 25 bp, Mus musculus
tgggctgcatgttcccagtgaagga

SEQ ID NO: 487250 - DNA, 25 bp, Mus musculus
tgggctgcccacagttctagagaaa

SEQ ID NO: 487251 - DNA, 25 bp, Mus musculus
tgggctgccgcatctgcttgggcaa

SEQ ID NO: 487252 - DNA, 25 bp, Mus musculus
tgggctgcctctgggaataaacctg

SEQ ID NO: 487253 - DNA, 25 bp, Mus musculus
tgggctgctcctccagttaaaggac

SEQ ID NO: 487254 - DNA, 25 bp, Mus musculus
tgggctggcatcacacaaccatgta

SEQ ID NO: 487255 - DNA, 25 bp, Mus musculus
tgggctggccatattcacacggttc

SEQ ID NO: 487256 - DNA, 25 bp, Mus musculus
tgggctggcgacatagctagtaaat

SEQ ID NO: 487257 - DNA, 25 bp, Mus musculus
tgggctggctcctaaaatctgtgca

SEQ ID NO: 487258 - DNA, 25 bp, Mus musculus
tgggctggctgctcactgtcgaaaa

SEQ ID NO: 487259 - DNA, 25 bp, Mus musculus
tgggctgtagcagactcccaaccga

SEQ ID NO: 487260 - DNA, 25 bp, Mus musculus
tgggctgtcacagacactggtgttt

SEQ ID NO: 487261 - DNA, 25 bp, Mus musculus
tgggctgtgagatacgttaaccact

SEQ ID NO: 487262 - DNA, 25 bp, Mus musculus
tgggctgtgatcctcaaacacggtt

SEQ ID NO: 487263 - DNA, 25 bp, Mus musculus
tgggctgttacagagtgcatctcgg

SEQ ID NO: 487264 - DNA, 25 bp, Mus musculus
tgggcttacacctggcaaagagaag

SEQ ID NO: 487265 - DNA, 25 bp, Mus musculus
tgggcttacctgaacctagagtgca

SEQ ID NO: 487266 - DNA, 25 bp, Mus musculus
tgggcttagcactccagatggctga

SEQ ID NO: 487267 - DNA, 25 bp, Mus musculus
tgggcttagccctgagaatatcgaa

SEQ ID NO: 487268 - DNA, 25 bp, Mus musculus
tgggcttcagaccacaaagtagtag

SEQ ID NO: 487269 - DNA, 25 bp, Mus musculus
tgggcttcagctttgggcaggtcct

SEQ ID NO: 487270 - DNA, 25 bp, Mus musculus
tgggcttcccaagattcttgcctgt

SEQ ID NO: 487271 - DNA, 25 bp, Mus musculus
tgggcttcccagatctctgtcacag

SEQ ID NO: 487272 - DNA, 25 bp, Mus musculus
tgggcttcctcatggcgagcatcag

SEQ ID NO: 487273 - DNA, 25 bp, Mus musculus
tgggcttcctggtcaacatggctgg

SEQ ID NO: 487274 - DNA, 25 bp, Mus musculus
tgggcttgggaaacaatggcaacca

SEQ ID NO: 487275 - DNA, 25 bp, Mus musculus
tgggctttactgcactcttcaagga

SEQ ID NO: 487276 - DNA, 25 bp, Mus musculus
tgggctttcttgtacctgcttggac

SEQ ID NO: 487277 - DNA, 25 bp, Mus musculus
tgggctttgcctgatactgtgttga

SEQ ID NO: 487278 - DNA, 25 bp, Mus musculus
tgggctttgctacccatttagtaga

SEQ ID NO: 487279 - DNA, 25 bp, Mus musculus
tggggcagcattatacctgtcaagt

SEQ ID NO: 487280 - DNA, 25 bp, Mus musculus
tggggctcctctcgcagaccatgac

SEQ ID NO: 487281 - DNA, 25 bp, Mus musculus
tggggtgttcgctcctacaggaagc

SEQ ID NO: 487282 - DNA, 25 bp, Mus musculus
tgggtaaactctgcaggagtctgca

SEQ ID NO: 487283 - DNA, 25 bp, Mus musculus
tgggtaaagagtaaataaggtgact

SEQ ID NO: 487284 - DNA, 25 bp, Mus musculus
tgggtaaaggcactctccaccatcc

SEQ ID NO: 487285 - DNA, 25 bp, Mus musculus
tgggtaacacccactacctactggg

SEQ ID NO: 487286 - DNA, 25 bp, Mus musculus
tgggtaacagatatataccactgct

SEQ ID NO: 487287 - DNA, 25 bp, Mus musculus
tgggtaagcataactcatgggcagc

SEQ ID NO: 487288 - DNA, 25 bp, Mus musculus
tgggtaagccagcactgcaagagcc

SEQ ID NO: 487289 - DNA, 25 bp, Mus musculus
tgggtaaggagagagctcatgacaa

SEQ ID NO: 487290 - DNA, 25 bp, Mus musculus
tgggtaagtcacataacctttttgc

SEQ ID NO: 487291 - DNA, 25 bp, Mus musculus
tgggtacaaaggagggaccaccact

SEQ ID NO: 487292 - DNA, 25 bp, Mus musculus
tgggtacagaccactctcggcaaga

SEQ ID NO: 487293 - DNA, 25 bp, Mus musculus
tgggtacagcctacacagaggtcag

SEQ ID NO: 487294 - DNA, 25 bp, Mus musculus
tgggtaccaagcatgcatatggtgc

SEQ ID NO: 487295 - DNA, 25 bp, Mus musculus
tgggtaccaagctggaccttcgcga

SEQ ID NO: 487296 - DNA, 25 bp, Mus musculus
tgggtaccccagcagtgaattgcac

SEQ ID NO: 487297 - DNA, 25 bp, Mus musculus
tgggtactgtccagcccacactgag

SEQ ID NO: 487298 - DNA, 25 bp, Mus musculus
tgggtacttttagccagcggccgct

SEQ ID NO: 487299 - DNA, 25 bp, Mus musculus
tgggtagaactgatggaccttcccc

SEQ ID NO: 487300 - DNA, 25 bp, Mus musculus
tgggtagcattatattttgccctca

SEQ ID NO: 487301 - DNA, 25 bp, Mus musculus
tgggtagcgaggtatactcaactga

SEQ ID NO: 487302 - DNA, 25 bp, Mus musculus
tgggtagctgaagcctctgtgccca

SEQ ID NO: 487303 - DNA, 25 bp, Mus musculus
tgggtagctggagcttcccaggacc

SEQ ID NO: 487304 - DNA, 25 bp, Mus musculus
tgggtatcccagtataaagacatct

SEQ ID NO: 487305 - DNA, 25 bp, Mus musculus
tgggtatgcacgggttccgcgcacc

SEQ ID NO: 487306 - DNA, 25 bp, Mus musculus
tgggtattagcagcctagttacaga

SEQ ID NO: 487307 - DNA, 25 bp, Mus musculus
tgggtcaacccaatcggaacacgga

SEQ ID NO: 487308 - DNA, 25 bp, Mus musculus
tgggtcaagaatgcaaatgttagtc

SEQ ID NO: 487309 - DNA, 25 bp, Mus musculus
tgggtcaaggattcgtttcaggatc

SEQ ID NO: 487310 - DNA, 25 bp, Mus musculus
tgggtcaaggcttgcagacacagct

SEQ ID NO: 487311 - DNA, 25 bp, Mus musculus
tgggtcacatgctttccttagaact

SEQ ID NO: 487312 - DNA, 25 bp, Mus musculus
tgggtcacgcatactttgtcaatct

SEQ ID NO: 487313 - DNA, 25 bp, Mus musculus
tgggtcagcgcagcatgcaatgcca

SEQ ID NO: 487314 - DNA, 25 bp, Mus musculus
tgggtcaggacgacaataacggtta

SEQ ID NO: 487315 - DNA, 25 bp, Mus musculus
tgggtcagttagaggacaacctgca

SEQ ID NO: 487316 - DNA, 25 bp, Mus musculus
tgggtcatcacagcagtaactcact

SEQ ID NO: 487317 - DNA, 25 bp, Mus musculus
tgggtccaacgtcaccagagaggtc

SEQ ID NO: 487318 - DNA, 25 bp, Mus musculus
tgggtccaccagagcccatgatggc

SEQ ID NO: 487319 - DNA, 25 bp, Mus musculus
tgggtccatggtcctacagtagctg

SEQ ID NO: 487320 - DNA, 25 bp, Mus musculus
tgggtccattgctcagagtccaccg

SEQ ID NO: 487321 - DNA, 25 bp, Mus musculus
tgggtcccacagtagaactcaagga

SEQ ID NO: 487322 - DNA, 25 bp, Mus musculus
tgggtccccgaactcaggcctggct

SEQ ID NO: 487323 - DNA, 25 bp, Mus musculus
tgggtcccgtgttgattgctgagca

SEQ ID NO: 487324 - DNA, 25 bp, Mus musculus
tgggtccctctacacgtggcttacg

SEQ ID NO: 487325 - DNA, 25 bp, Mus musculus
tgggtccctgacaacattttctgtt

SEQ ID NO: 487326 - DNA, 25 bp, Mus musculus
tgggtcccttgcaggtaatgactgt

SEQ ID NO: 487327 - DNA, 25 bp, Mus musculus
tgggtcctagaagccaagtctcctg

SEQ ID NO: 487328 - DNA, 25 bp, Mus musculus
tgggtcctctggttgtcccctggag

SEQ ID NO: 487329 - DNA, 25 bp, Mus musculus
tgggtcctggctaccatcgtgctgg

SEQ ID NO: 487330 - DNA, 25 bp, Mus musculus
tgggtccttataaagcttacgctgt

SEQ ID NO: 487331 - DNA, 25 bp, Mus musculus
tgggtcgggagcttcggcaacattc

SEQ ID NO: 487332 - DNA, 25 bp, Mus musculus
tgggtcgtgcacacaagcagctctg

SEQ ID NO: 487333 - DNA, 25 bp, Mus musculus
tgggtctatcctccatggcacctgg

SEQ ID NO: 487334 - DNA, 25 bp, Mus musculus
tgggtctcagagcacagatgcactc

SEQ ID NO: 487335 - DNA, 25 bp, Mus musculus
tgggtctcaggcctgtacacagtca

SEQ ID NO: 487336 - DNA, 25 bp, Mus musculus
tgggtctccaaccacaagatggcca

SEQ ID NO: 487337 - DNA, 25 bp, Mus musculus
tgggtctccagtggaaatctggccg

SEQ ID NO: 487338 - DNA, 25 bp, Mus musculus
tgggtctcccatagtgctgaggtct

SEQ ID NO: 487339 - DNA, 25 bp, Mus musculus
tgggtctccctgcaaccgtgaagaa

SEQ ID NO: 487340 - DNA, 25 bp, Mus musculus
tgggtctctgaagcgtagccgcacc

SEQ ID NO: 487341 - DNA, 25 bp, Mus musculus
tgggtctcttccaaagatgacaaga

SEQ ID NO: 487342 - DNA, 25 bp, Mus musculus
tgggtctgaatcaggccattgcctt

SEQ ID NO: 487343 - DNA, 25 bp, Mus musculus
tgggtctgacctagatgcgagctgt

SEQ ID NO: 487344 - DNA, 25 bp, Mus musculus
tgggtctgccttgtggcctacctag

SEQ ID NO: 487345 - DNA, 25 bp, Mus musculus
tgggtctgcgccgactcaaggaagc

SEQ ID NO: 487346 - DNA, 25 bp, Mus musculus
tgggtctgctcctccgtgccaggat

SEQ ID NO: 487347 - DNA, 25 bp, Mus musculus
tgggtctggagcgacttgtcaacgc

SEQ ID NO: 487348 - DNA, 25 bp, Mus musculus
tgggtctggctcaacggataccatt

SEQ ID NO: 487349 - DNA, 25 bp, Mus musculus
tgggtctgggcaccatgctaactct

SEQ ID NO: 487350 - DNA, 25 bp, Mus musculus
tgggtcttacctgccggagttgcaa

SEQ ID NO: 487351 - DNA, 25 bp, Mus musculus
tgggtcttcctcaccatgtgactac

SEQ ID NO: 487352 - DNA, 25 bp, Mus musculus
tgggtcttgttagagtttatctggg

SEQ ID NO: 487353 - DNA, 25 bp, Mus musculus
tgggtgacaaccagacctatcgtgg

SEQ ID NO: 487354 - DNA, 25 bp, Mus musculus
tgggtgacacaatcctacagtgcta

SEQ ID NO: 487355 - DNA, 25 bp, Mus musculus
tgggtgactcgccataaatcagccg

SEQ ID NO: 487356 - DNA, 25 bp, Mus musculus
tgggtgagaccttcctcagcctgga

SEQ ID NO: 487357 - DNA, 25 bp, Mus musculus
tgggtgaggtcacagaacacaagct

SEQ ID NO: 487358 - DNA, 25 bp, Mus musculus
tgggtgagttcaccgttcctgagac

SEQ ID NO: 487359 - DNA, 25 bp, Mus musculus
tgggtgataggaaccgcaactcgcc

SEQ ID NO: 487360 - DNA, 25 bp, Mus musculus
tgggtgatcacatacaggctgagac

SEQ ID NO: 487361 - DNA, 25 bp, Mus musculus
tgggtgatgagtgaacatttttcct

SEQ ID NO: 487362 - DNA, 25 bp, Mus musculus
tgggtgcacacaccatctcaggact

SEQ ID NO: 487363 - DNA, 25 bp, Mus musculus
tgggtgcagagcttcggcatgtcct

SEQ ID NO: 487364 - DNA, 25 bp, Mus musculus
tgggtgcagccccatctacatacac

SEQ ID NO: 487365 - DNA, 25 bp, Mus musculus
tgggtgccagcaccttccaactgga

SEQ ID NO: 487366 - DNA, 25 bp, Mus musculus
tgggtgcctacagggagtgtgtgtg

SEQ ID NO: 487367 - DNA, 25 bp, Mus musculus
tgggtgcctcttctggggtactaat

SEQ ID NO: 487368 - DNA, 25 bp, Mus musculus
tgggtgcctgcaaaagacatcagta

SEQ ID NO: 487369 - DNA, 25 bp, Mus musculus
tgggtgcgcccctaccttaaggtgt

SEQ ID NO: 487370 - DNA, 25 bp, Mus musculus
tgggtgctcaccaccacgggttcgc

SEQ ID NO: 487371 - DNA, 25 bp, Mus musculus
tgggtgctcagcaagcactttaacg

SEQ ID NO: 487372 - DNA, 25 bp, Mus musculus
tgggtgctctgcctcttcaagtcag

SEQ ID NO: 487373 - DNA, 25 bp, Mus musculus
tgggtggaccccatctgtcagctgg

SEQ ID NO: 487374 - DNA, 25 bp, Mus musculus
tgggtggagctaggccctcaaagtc

SEQ ID NO: 487375 - DNA, 25 bp, Mus musculus
tgggtggcacaaaaatcgtcgaggt

SEQ ID NO: 487376 - DNA, 25 bp, Mus musculus
tgggtggcatcctgcattcaacagc

SEQ ID NO: 487377 - DNA, 25 bp, Mus musculus
tgggtgggaacagtcgaccttctga

SEQ ID NO: 487378 - DNA, 25 bp, Mus musculus
tgggtgggcgattgatttctgacaa

SEQ ID NO: 487379 - DNA, 25 bp, Mus musculus
tgggtgtccaccaggaatactgtct

SEQ ID NO: 487380 - DNA, 25 bp, Mus musculus
tgggtgtctctccacatgtccagca

SEQ ID NO: 487381 - DNA, 25 bp, Mus musculus
tgggtgtctggaaccatctgggcca

SEQ ID NO: 487382 - DNA, 25 bp, Mus musculus
tgggtgtgcagaaccttacatgcgc

SEQ ID NO: 487383 - DNA, 25 bp, Mus musculus
tgggtgttaatctccagacgtcctg

SEQ ID NO: 487384 - DNA, 25 bp, Mus musculus
tgggtgttactgtgccagagccatc

SEQ ID NO: 487385 - DNA, 25 bp, Mus musculus
tgggtgttcacaaagaagagtgctc

SEQ ID NO: 487386 - DNA, 25 bp, Mus musculus
tgggtgttcacctgccttactggga

SEQ ID NO: 487387 - DNA, 25 bp, Mus musculus
tgggtgttctcatcgtggtcctgac

SEQ ID NO: 487388 - DNA, 25 bp, Mus musculus
tgggttacacagcaacatggcaggt

SEQ ID NO: 487389 - DNA, 25 bp, Mus musculus
tgggttacaggcagccacctatctc

SEQ ID NO: 487390 - DNA, 25 bp, Mus musculus
tgggttacccagacaagatactaca

SEQ ID NO: 487391 - DNA, 25 bp, Mus musculus
tgggttagccacacggacattcgga

SEQ ID NO: 487392 - DNA, 25 bp, Mus musculus
tgggttatccaccaatgccccgggt

SEQ ID NO: 487393 - DNA, 25 bp, Mus musculus
tgggttatgcgcaggaagtccttaa

SEQ ID NO: 487394 - DNA, 25 bp, Mus musculus
tgggttcatcagaccctagtgtcat

SEQ ID NO: 487395 - DNA, 25 bp, Mus musculus
tgggttccatccttgataccaaaca

SEQ ID NO: 487396 - DNA, 25 bp, Mus musculus
tgggttcccaactctcgcatccaga

SEQ ID NO: 487397 - DNA, 25 bp, Mus musculus
tgggttcccaccaagccaaagacgt

SEQ ID NO: 487398 - DNA, 25 bp, Mus musculus
tgggttcccacctgcgagatgctag

SEQ ID NO: 487399 - DNA, 25 bp, Mus musculus
tgggttcccagtatagccctgaatc

SEQ ID NO: 487400 - DNA, 25 bp, Mus musculus
tgggttccctgaagtcctagtcctc

SEQ ID NO: 487401 - DNA, 25 bp, Mus musculus
tgggttcctaaatgccggaccaagc

SEQ ID NO: 487402 - DNA, 25 bp, Mus musculus
tgggttcctcctgaccaccagggaa

SEQ ID NO: 487403 - DNA, 25 bp, Mus musculus
tgggttgcagtcaaacttcattgtg

SEQ ID NO: 487404 - DNA, 25 bp, Mus musculus
tgggttgccaggtgctcactgctga

SEQ ID NO: 487405 - DNA, 25 bp, Mus musculus
tgggttgccctgacccagtggtgca

SEQ ID NO: 487406 - DNA, 25 bp, Mus musculus
tgggttggacccatcagagcacaag

SEQ ID NO: 487407 - DNA, 25 bp, Mus musculus
tgggtttcaccagctaatcagacta

SEQ ID NO: 487408 - DNA, 25 bp, Mus musculus
tgggtttccatgtacaggccgccgt

SEQ ID NO: 487409 - DNA, 25 bp, Mus musculus
tgggtttcctagtgccacaggcagc

SEQ ID NO: 487410 - DNA, 25 bp, Mus musculus
tgggtttccttaggccacctatagg

SEQ ID NO: 487411 - DNA, 25 bp, Mus musculus
tgggtttggacctctgcccaagaag

SEQ ID NO: 487412 - DNA, 25 bp, Mus musculus
tgggtttgtttgacagctgaggaac

SEQ ID NO: 487413 - DNA, 25 bp, Mus musculus
tgggtttttcgagtgctgaccccag

SEQ ID NO: 487414 - DNA, 25 bp, Mus musculus
tggtaaaaccgaactccaggaccag

SEQ ID NO: 487415 - DNA, 25 bp, Mus musculus
tggtaaaaccggtgcccctcttcag

SEQ ID NO: 487416 - DNA, 25 bp, Mus musculus
tggtaaactcttgggcgccagccca

SEQ ID NO: 487417 - DNA, 25 bp, Mus musculus
tggtaaagaagatccagtggcacct

SEQ ID NO: 487418 - DNA, 25 bp, Mus musculus
tggtaaagccttcaagcaaaatgcc

SEQ ID NO: 487419 - DNA, 25 bp, Mus musculus
tggtaaataaatcaggcatggttct

SEQ ID NO: 487420 - DNA, 25 bp, Mus musculus
tggtaaatgtggatgccgcccaggt

SEQ ID NO: 487421 - DNA, 25 bp, Mus musculus
tggtaacggagtgcaccgccagttc

SEQ ID NO: 487422 - DNA, 25 bp, Mus musculus
tggtaactcacacggctaaagaagc

SEQ ID NO: 487423 - DNA, 25 bp, Mus musculus
tggtaactcctgacagagcctggac

SEQ ID NO: 487424 - DNA, 25 bp, Mus musculus
tggtaactgcaactactactgtggg

SEQ ID NO: 487425 - DNA, 25 bp, Mus musculus
tggtaactgccacagaacctcaggc

SEQ ID NO: 487426 - DNA, 25 bp, Mus musculus
tggtaactggctacaaccgagtgat

SEQ ID NO: 487427 - DNA, 25 bp, Mus musculus
tggtaacttcattccagtgctgggt

SEQ ID NO: 487428 - DNA, 25 bp, Mus musculus
tggtaactttcctgtgaccttggtg

SEQ ID NO: 487429 - DNA, 25 bp, Mus musculus
tggtaagaaacacatgcagaggaaa

SEQ ID NO: 487430 - DNA, 25 bp, Mus musculus
tggtaagagtgcaacctccggtggc

SEQ ID NO: 487431 - DNA, 25 bp, Mus musculus
tggtaaggcctggagcatcctgtgc

SEQ ID NO: 487432 - DNA, 25 bp, Mus musculus
tggtaatacccttcctgcttgcagg

SEQ ID NO: 487433 - DNA, 25 bp, Mus musculus
tggtaatgtccaaacaggcccctga

SEQ ID NO: 487434 - DNA, 25 bp, Mus musculus
tggtaattttctcctagcacttgga

SEQ ID NO: 487435 - DNA, 25 bp, Mus musculus
tggtacaaagatgaaaggctcctgg

SEQ ID NO: 487436 - DNA, 25 bp, Mus musculus
tggtacaacacgacagagacatggc

SEQ ID NO: 487437 - DNA, 25 bp, Mus musculus
tggtacactaaactcccagggcagg

SEQ ID NO: 487438 - DNA, 25 bp, Mus musculus
tggtacacttcatcaccactgtggg

SEQ ID NO: 487439 - DNA, 25 bp, Mus musculus
tggtacatgctgaagccttttctcg

SEQ ID NO: 487440 - DNA, 25 bp, Mus musculus
tggtaccaaccacagagggtcagct

SEQ ID NO: 487441 - DNA, 25 bp, Mus musculus
tggtaccacacacagaacctcagtg

SEQ ID NO: 487442 - DNA, 25 bp, Mus musculus
tggtaccagtaaagaccactgtggg

SEQ ID NO: 487443 - DNA, 25 bp, Mus musculus
tggtaccatgtttacttcctgccct

SEQ ID NO: 487444 - DNA, 25 bp, Mus musculus
tggtacccaaaggacagtaaagccg

SEQ ID NO: 487445 - DNA, 25 bp, Mus musculus
tggtacccagcagtctacggtgcct

SEQ ID NO: 487446 - DNA, 25 bp, Mus musculus
tggtacccgggctttgactcaacag

SEQ ID NO: 487447 - DNA, 25 bp, Mus musculus
tggtaccgacccatctacaaggctt

SEQ ID NO: 487448 - DNA, 25 bp, Mus musculus
tggtacctcatgaaaacctgagcgc

SEQ ID NO: 487449 - DNA, 25 bp, Mus musculus
tggtacctgaggattgacaaacgag

SEQ ID NO: 487450 - DNA, 25 bp, Mus musculus
tggtacctggacaaaggcattggag

SEQ ID NO: 487451 - DNA, 25 bp, Mus musculus
tggtacgcgccagagtgcatcaact

SEQ ID NO: 487452 - DNA, 25 bp, Mus musculus
tggtacggctacatctgccctctgt

SEQ ID NO: 487453 - DNA, 25 bp, Mus musculus
tggtactccgttctacctcagactt

SEQ ID NO: 487454 - DNA, 25 bp, Mus musculus
tggtactcggatgcacaaatgcctg

SEQ ID NO: 487455 - DNA, 25 bp, Mus musculus
tggtactcgggaagttcatagatgg

SEQ ID NO: 487456 - DNA, 25 bp, Mus musculus
tggtactggccacggccatcgagat

SEQ ID NO: 487457 - DNA, 25 bp, Mus musculus
tggtactgtgcactgccagacccag

SEQ ID NO: 487458 - DNA, 25 bp, Mus musculus
tggtacttcctggagcaacttggcg

SEQ ID NO: 487459 - DNA, 25 bp, Mus musculus
tggtacttctcaacgccacggtgga

SEQ ID NO: 487460 - DNA, 25 bp, Mus musculus
tggtactttcacttcccgttcttgg

SEQ ID NO: 487461 - DNA, 25 bp, Mus musculus
tggtagaaacactccttccggccgg

SEQ ID NO: 487462 - DNA, 25 bp, Mus musculus
tggtagaacggcttgccagcggcat

SEQ ID NO: 487463 - DNA, 25 bp, Mus musculus
tggtagaagcagacaccaatggcct

SEQ ID NO: 487464 - DNA, 25 bp, Mus musculus
tggtagaagcttgtaatcccttgct

SEQ ID NO: 487465 - DNA, 25 bp, Mus musculus
tggtagacaactgtagcactcctgc

SEQ ID NO: 487466 - DNA, 25 bp, Mus musculus
tggtagacaggacatgttcgccccg

SEQ ID NO: 487467 - DNA, 25 bp, Mus musculus
tggtagacctgcctgaagatgaaga

SEQ ID NO: 487468 - DNA, 25 bp, Mus musculus
tggtagacgacaaactgcctgtgcg

SEQ ID NO: 487469 - DNA, 25 bp, Mus musculus
tggtagagaacaccgacgagaccta

SEQ ID NO: 487470 - DNA, 25 bp, Mus musculus
tggtagagtcagacatcaacggcct

SEQ ID NO: 487471 - DNA, 25 bp, Mus musculus
tggtagatggaaggcagcacatgct

SEQ ID NO: 487472 - DNA, 25 bp, Mus musculus
tggtagcaagcacgttcacccaggg

SEQ ID NO: 487473 - DNA, 25 bp, Mus musculus
tggtagcagaaaatgatagagggtc

SEQ ID NO: 487474 - DNA, 25 bp, Mus musculus
tggtagcagcaacaactcagagagg

SEQ ID NO: 487475 - DNA, 25 bp, Mus musculus
tggtagccacgcttctttgcgcgct

SEQ ID NO: 487476 - DNA, 25 bp, Mus musculus
tggtagccctcaagcaaactatggg

SEQ ID NO: 487477 - DNA, 25 bp, Mus musculus
tggtagcgtcactatgctgagcagc

SEQ ID NO: 487478 - DNA, 25 bp, Mus musculus
tggtagctatcccaatcctggcagt

SEQ ID NO: 487479 - DNA, 25 bp, Mus musculus
tggtagctattccagcaccgacaga

SEQ ID NO: 487480 - DNA, 25 bp, Mus musculus
tggtaggcaaagaccggtcaagttt

SEQ ID NO: 487481 - DNA, 25 bp, Mus musculus
tggtaggcaattagatcagtgatcc

SEQ ID NO: 487482 - DNA, 25 bp, Mus musculus
tggtagggacccacaacagacttgc

SEQ ID NO: 487483 - DNA, 25 bp, Mus musculus
tggtagtacggagctctgccttagg

SEQ ID NO: 487484 - DNA, 25 bp, Mus musculus
tggtagtgtccatagtgcctcaggc

SEQ ID NO: 487485 - DNA, 25 bp, Mus musculus
tggtagtgttctccgttcgatctag

SEQ ID NO: 487486 - DNA, 25 bp, Mus musculus
tggtataaaaacaacagcgccttgg

SEQ ID NO: 487487 - DNA, 25 bp, Mus musculus
tggtataaaaccagggcatctccct

SEQ ID NO: 487488 - DNA, 25 bp, Mus musculus
tggtataccagcttctactgcctgt

SEQ ID NO: 487489 - DNA, 25 bp, Mus musculus
tggtatcacatgagctgttagagct

SEQ ID NO: 487490 - DNA, 25 bp, Mus musculus
tggtatcatgcctgtttgacccaag

SEQ ID NO: 487491 - DNA, 25 bp, Mus musculus
tggtatccagcacttgaagcgggaa

SEQ ID NO: 487492 - DNA, 25 bp, Mus musculus
tggtatccagttttcatccatggga

SEQ ID NO: 487493 - DNA, 25 bp, Mus musculus
tggtatcccaaagagccgaggtcac

SEQ ID NO: 487494 - DNA, 25 bp, Mus musculus
tggtatcctcatgctggctcattgg

SEQ ID NO: 487495 - DNA, 25 bp, Mus musculus
tggtatcctccgcaatgcaagctgg

SEQ ID NO: 487496 - DNA, 25 bp, Mus musculus
tggtatctattttgacagaacagag

SEQ ID NO: 487497 - DNA, 25 bp, Mus musculus
tggtatctgaaatccccagtgggtg

SEQ ID NO: 487498 - DNA, 25 bp, Mus musculus
tggtatctgaagacacctgagggag

SEQ ID NO: 487499 - DNA, 25 bp, Mus musculus
tggtatcttcacaaaatcggcgcgc

SEQ ID NO: 487500 - DNA, 25 bp, Mus musculus
tggtatgaaccctcaaactggagat

SEQ ID NO: 487501 - DNA, 25 bp, Mus musculus
tggtattcctgataacgccctctgg

SEQ ID NO: 487502 - DNA, 25 bp, Mus musculus
tggtatttcttaatggcctggcaca

SEQ ID NO: 487503 - DNA, 25 bp, Mus musculus
tggtatttgccagcacagacaggtc

SEQ ID NO: 487504 - DNA, 25 bp, Mus musculus
tggtcaaagacaactgccggagact

SEQ ID NO: 487505 - DNA, 25 bp, Mus musculus
tggtcaacagcacagaagggaaagt

SEQ ID NO: 487506 - DNA, 25 bp, Mus musculus
tggtcaacatgtccacaggcttggt

SEQ ID NO: 487507 - DNA, 25 bp, Mus musculus
tggtcaaccaaaacaatgtcgctcg

SEQ ID NO: 487508 - DNA, 25 bp, Mus musculus
tggtcaaccaccaatactatctagg

SEQ ID NO: 487509 - DNA, 25 bp, Mus musculus
tggtcaacctagatgatcgcctggc

SEQ ID NO: 487510 - DNA, 25 bp, Mus musculus
tggtcaacgcgcaggtcagtgtgac

SEQ ID NO: 487511 - DNA, 25 bp, Mus musculus
tggtcaacgcgctgcctaagatact

SEQ ID NO: 487512 - DNA, 25 bp, Mus musculus
tggtcaacgtgttcgccgagcaaga

SEQ ID NO: 487513 - DNA, 25 bp, Mus musculus
tggtcaagacacagaatcctagccg

SEQ ID NO: 487514 - DNA, 25 bp, Mus musculus
tggtcaagagatttcacagccaagt

SEQ ID NO: 487515 - DNA, 25 bp, Mus musculus
tggtcaagtatgagctgatgcgccc

SEQ ID NO: 487516 - DNA, 25 bp, Mus musculus
tggtcaataccaagcctgagaaggc

SEQ ID NO: 487517 - DNA, 25 bp, Mus musculus
tggtcaatcattcagcatagccttg

SEQ ID NO: 487518 - DNA, 25 bp, Mus musculus
tggtcaatggaacccagtgccggct

SEQ ID NO: 487519 - DNA, 25 bp, Mus musculus
tggtcaattttggactgagccctgt

SEQ ID NO: 487520 - DNA, 25 bp, Mus musculus
tggtcacacatacacaagggactgt

SEQ ID NO: 487521 - DNA, 25 bp, Mus musculus
tggtcacaggcctcccagaaagtga

SEQ ID NO: 487522 - DNA, 25 bp, Mus musculus
tggtcacataccaggacgcagaagg

SEQ ID NO: 487523 - DNA, 25 bp, Mus musculus
tggtcacatcgcaaaagcagagggc

SEQ ID NO: 487524 - DNA, 25 bp, Mus musculus
tggtcaccagtgatgacatggcctg

SEQ ID NO: 487525 - DNA, 25 bp, Mus musculus
tggtcaccgagagaacatcagaggc

SEQ ID NO: 487526 - DNA, 25 bp, Mus musculus
tggtcacggctggaggaaaaagccc

SEQ ID NO: 487527 - DNA, 25 bp, Mus musculus
tggtcacgggtagcacacaagtgtg

SEQ ID NO: 487528 - DNA, 25 bp, Mus musculus
tggtcactcaataaatggaacagat

SEQ ID NO: 487529 - DNA, 25 bp, Mus musculus
tggtcactggcttcgtgggcaacgc

SEQ ID NO: 487530 - DNA, 25 bp, Mus musculus
tggtcactgtgaggattcagcgcgc

SEQ ID NO: 487531 - DNA, 25 bp, Mus musculus
tggtcagaatcaaatgctaatcaac

SEQ ID NO: 487532 - DNA, 25 bp, Mus musculus
tggtcagcaaatcccatcactgcct

SEQ ID NO: 487533 - DNA, 25 bp, Mus musculus
tggtcagcactatgacttcccgagt

SEQ ID NO: 487534 - DNA, 25 bp, Mus musculus
tggtcagtagggaatggcagcattc

SEQ ID NO: 487535 - DNA, 25 bp, Mus musculus
tggtcagtgacaaagaacaatcgct

SEQ ID NO: 487536 - DNA, 25 bp, Mus musculus
tggtcatacttctgaggccgcgctc

SEQ ID NO: 487537 - DNA, 25 bp, Mus musculus
tggtcatcaccaagcaccgtagagt

SEQ ID NO: 487538 - DNA, 25 bp, Mus musculus
tggtcatcctgacttagaagatcag

SEQ ID NO: 487539 - DNA, 25 bp, Mus musculus
tggtcatgaatataaccgtccctgg

SEQ ID NO: 487540 - DNA, 25 bp, Mus musculus
tggtcatggaacttcacctggtatc

SEQ ID NO: 487541 - DNA, 25 bp, Mus musculus
tggtcatgttgatagccttcccggg

SEQ ID NO: 487542 - DNA, 25 bp, Mus musculus
tggtcattgcaaaggaggacaactc

SEQ ID NO: 487543 - DNA, 25 bp, Mus musculus
tggtcattgcgcttcctcattgaag

SEQ ID NO: 487544 - DNA, 25 bp, Mus musculus
tggtccaacaggtgaagggccacta

SEQ ID NO: 487545 - DNA, 25 bp, Mus musculus
tggtccaacctaatacatcaccggg

SEQ ID NO: 487546 - DNA, 25 bp, Mus musculus
tggtccaagctatggcgcgcagaac

SEQ ID NO: 487547 - DNA, 25 bp, Mus musculus
tggtccacctagtggatcgccagac

SEQ ID NO: 487548 - DNA, 25 bp, Mus musculus
tggtccagacaggagacacgaactc

SEQ ID NO: 487549 - DNA, 25 bp, Mus musculus
tggtccagagaacccctttcagaga

SEQ ID NO: 487550 - DNA, 25 bp, Mus musculus
tggtccagaggagaagcaaactgcg

SEQ ID NO: 487551 - DNA, 25 bp, Mus musculus
tggtccagccagtcatgcagcagga

SEQ ID NO: 487552 - DNA, 25 bp, Mus musculus
tggtccagggcatctggcatgagct

SEQ ID NO: 487553 - DNA, 25 bp, Mus musculus
tggtccatcatagccacagcggtgc

SEQ ID NO: 487554 - DNA, 25 bp, Mus musculus
tggtccatggtacaatacaagcagc

SEQ ID NO: 487555 - DNA, 25 bp, Mus musculus
tggtccatgtgggttctgattcacc

SEQ ID NO: 487556 - DNA, 25 bp, Mus musculus
tggtccatttgcttctacggatcgg

SEQ ID NO: 487557 - DNA, 25 bp, Mus musculus
tggtcccaactgagaagggccggct

SEQ ID NO: 487558 - DNA, 25 bp, Mus musculus
tggtcccaagagaacgtacacaggc

SEQ ID NO: 487559 - DNA, 25 bp, Mus musculus
tggtcccactgagcacacaaaatct

SEQ ID NO: 487560 - DNA, 25 bp, Mus musculus
tggtcccaggcacaggtcattttgc

SEQ ID NO: 487561 - DNA, 25 bp, Mus musculus
tggtcccatacctcttaaagctgct

SEQ ID NO: 487562 - DNA, 25 bp, Mus musculus
tggtccccagaaaacacataatgat

SEQ ID NO: 487563 - DNA, 25 bp, Mus musculus
tggtccctacaatgccaatgaagag

SEQ ID NO: 487564 - DNA, 25 bp, Mus musculus
tggtccctgatagtcctgctggtcg

SEQ ID NO: 487565 - DNA, 25 bp, Mus musculus
tggtccctgatggtctccaaggtac

SEQ ID NO: 487566 - DNA, 25 bp, Mus musculus
tggtccctggtttgtcgcccatgtt

SEQ ID NO: 487567 - DNA, 25 bp, Mus musculus
tggtcccttatatctggcagaatca

SEQ ID NO: 487568 - DNA, 25 bp, Mus musculus
tggtcccttccaaaaagaactatgg

SEQ ID NO: 487569 - DNA, 25 bp, Mus musculus
tggtccgccctgtgatagcattaga

SEQ ID NO: 487570 - DNA, 25 bp, Mus musculus
tggtccgcttaaaggtctcctgcgt

SEQ ID NO: 487571 - DNA, 25 bp, Mus musculus
tggtccgggatcttgtccacaatga

SEQ ID NO: 487572 - DNA, 25 bp, Mus musculus
tggtcctcaaggaaagcccactaga

SEQ ID NO: 487573 - DNA, 25 bp, Mus musculus
tggtcctcagaaaacagataatggc

SEQ ID NO: 487574 - DNA, 25 bp, Mus musculus
tggtcctcatacttgtacagtaagg

SEQ ID NO: 487575 - DNA, 25 bp, Mus musculus
tggtcctccgagtcctagtcggtgt

SEQ ID NO: 487576 - DNA, 25 bp, Mus musculus
tggtcctcgcccaagcttggtgatg

SEQ ID NO: 487577 - DNA, 25 bp, Mus musculus
tggtcctgagtcaggtggccactga

SEQ ID NO: 487578 - DNA, 25 bp, Mus musculus
tggtcctgatggctaaaggtcacct

SEQ ID NO: 487579 - DNA, 25 bp, Mus musculus
tggtcctgccaagcggatgtcctga

SEQ ID NO: 487580 - DNA, 25 bp, Mus musculus
tggtcctgcctgaaacagaaagtct

SEQ ID NO: 487581 - DNA, 25 bp, Mus musculus
tggtcctggacaactactacgtgca

SEQ ID NO: 487582 - DNA, 25 bp, Mus musculus
tggtcctggagctgtacttgccgag

SEQ ID NO: 487583 - DNA, 25 bp, Mus musculus
tggtcctggccatcagtgctgagca

SEQ ID NO: 487584 - DNA, 25 bp, Mus musculus
tggtcctggcttacctcatgctcca

SEQ ID NO: 487585 - DNA, 25 bp, Mus musculus
tggtcctgtttcagcccaagcaagg

SEQ ID NO: 487586 - DNA, 25 bp, Mus musculus
tggtcctttagaaagaacggacagc

SEQ ID NO: 487587 - DNA, 25 bp, Mus musculus
tggtcgcaggctacatgaaagtcac

SEQ ID NO: 487588 - DNA, 25 bp, Mus musculus
tggtcgccaaccgaaacaagatgtt

SEQ ID NO: 487589 - DNA, 25 bp, Mus musculus
tggtcgccagcaacctgaatctcaa

SEQ ID NO: 487590 - DNA, 25 bp, Mus musculus
tggtcgcgcggtgcatccgcggcag

SEQ ID NO: 487591 - DNA, 25 bp, Mus musculus
tggtcgctctttccacaggacaagg

SEQ ID NO: 487592 - DNA, 25 bp, Mus musculus
tggtcgctgggtgatctctgctcgc

SEQ ID NO: 487593 - DNA, 25 bp, Mus musculus
tggtcggaaccctacggagaaagat

SEQ ID NO: 487594 - DNA, 25 bp, Mus musculus
tggtcggagaatctctgagacctcg

SEQ ID NO: 487595 - DNA, 25 bp, Mus musculus
tggtcggcgaacaactcatctatga

SEQ ID NO: 487596 - DNA, 25 bp, Mus musculus
tggtcggcgcccgtggagcgagcga

SEQ ID NO: 487597 - DNA, 25 bp, Mus musculus
tggtcgtgggagcatattagaaacc

SEQ ID NO: 487598 - DNA, 25 bp, Mus musculus
tggtcgttccaatgcagcgcgtgct

SEQ ID NO: 487599 - DNA, 25 bp, Mus musculus
tggtctaagcatgtcactggcccct

SEQ ID NO: 487600 - DNA, 25 bp, Mus musculus
tggtctaagctaccctggccttgag

SEQ ID NO: 487601 - DNA, 25 bp, Mus musculus
tggtctacaatccaacagtgagctg

SEQ ID NO: 487602 - DNA, 25 bp, Mus musculus
tggtctacatgaaggaggcactgca

SEQ ID NO: 487603 - DNA, 25 bp, Mus musculus
tggtctactacatggagggatccgt

SEQ ID NO: 487604 - DNA, 25 bp, Mus musculus
tggtctaggctttgccccacagggc

SEQ ID NO: 487605 - DNA, 25 bp, Mus musculus
tggtctatggccttgtcaagacctc

SEQ ID NO: 487606 - DNA, 25 bp, Mus musculus
tggtctcagcagtaactacccttga

SEQ ID NO: 487607 - DNA, 25 bp, Mus musculus
tggtctcagcatcacaagggcattc

SEQ ID NO: 487608 - DNA, 25 bp, Mus musculus
tggtctcaggctcccatgcatgggt

SEQ ID NO: 487609 - DNA, 25 bp, Mus musculus
tggtctccacccgacagtcgtcacg

SEQ ID NO: 487610 - DNA, 25 bp, Mus musculus
tggtctccatctgtgaagcggccca

SEQ ID NO: 487611 - DNA, 25 bp, Mus musculus
tggtctccctgtccgccaggctatt

SEQ ID NO: 487612 - DNA, 25 bp, Mus musculus
tggtctccgtcgtcacagctgaatg

SEQ ID NO: 487613 - DNA, 25 bp, Mus musculus
tggtctcgcgagatctcatgtttcc

SEQ ID NO: 487614 - DNA, 25 bp, Mus musculus
tggtctcggtggaacgttccggaat

SEQ ID NO: 487615 - DNA, 25 bp, Mus musculus
tggtctcgtacctcttcttgttctg

SEQ ID NO: 487616 - DNA, 25 bp, Mus musculus
tggtctctctgttcggccctcagtt

SEQ ID NO: 487617 - DNA, 25 bp, Mus musculus
tggtctctgatgctcttgcccgctc

SEQ ID NO: 487618 - DNA, 25 bp, Mus musculus
tggtctctgccttcagctaccctgg

SEQ ID NO: 487619 - DNA, 25 bp, Mus musculus
tggtctcttataaacacacgccgaa

SEQ ID NO: 487620 - DNA, 25 bp, Mus musculus
tggtctcttcctatggcactgtccg

SEQ ID NO: 487621 - DNA, 25 bp, Mus musculus
tggtctgagacaactgaggcctcct

SEQ ID NO: 487622 - DNA, 25 bp, Mus musculus
tggtctgcaaacagtggtatcgact

SEQ ID NO: 487623 - DNA, 25 bp, Mus musculus
tggtctgccagaagagaccctcagg

SEQ ID NO: 487624 - DNA, 25 bp, Mus musculus
tggtctgcgctataacaaactctcc

SEQ ID NO: 487625 - DNA, 25 bp, Mus musculus
tggtctgctcttggaaacctggcaa

SEQ ID NO: 487626 - DNA, 25 bp, Mus musculus
tggtctggctcctatcactggttcc

SEQ ID NO: 487627 - DNA, 25 bp, Mus musculus
tggtctgtacccagaaagagctcgt

SEQ ID NO: 487628 - DNA, 25 bp, Mus musculus
tggtctgtctgcacgggagctactt

SEQ ID NO: 487629 - DNA, 25 bp, Mus musculus
tggtctgtgcctcaaatcccgggag

SEQ ID NO: 487630 - DNA, 25 bp, Mus musculus
tggtcttaacttcactcccatgtag

SEQ ID NO: 487631 - DNA, 25 bp, Mus musculus
tggtcttacccaaaccggacaactg

SEQ ID NO: 487632 - DNA, 25 bp, Mus musculus
tggtcttcgaaaccttgggaacacg

SEQ ID NO: 487633 - DNA, 25 bp, Mus musculus
tggtcttcgagatcagcacatggct

SEQ ID NO: 487634 - DNA, 25 bp, Mus musculus
tggtcttcggtgactgttcctgcag

SEQ ID NO: 487635 - DNA, 25 bp, Mus musculus
tggtcttctatctgccctcggagtg

SEQ ID NO: 487636 - DNA, 25 bp, Mus musculus
tggtcttgaccatacacccttaggt

SEQ ID NO: 487637 - DNA, 25 bp, Mus musculus
tggtcttggcccagagcaacgttgc

SEQ ID NO: 487638 - DNA, 25 bp, Mus musculus
tggtcttgtctatccctcccgtaaa

SEQ ID NO: 487639 - DNA, 25 bp, Mus musculus
tggtctttagtggtgctccctggcg

SEQ ID NO: 487640 - DNA, 25 bp, Mus musculus
tggtctttcctcgatgttcctgcgg

SEQ ID NO: 487641 - DNA, 25 bp, Mus musculus
tggtcttttggagggccagagttca

SEQ ID NO: 487642 - DNA, 25 bp, Mus musculus
tggtgaaagcaatccaggtcctgcg

SEQ ID NO: 487643 - DNA, 25 bp, Mus musculus
tggtgaaatctgcagaacccgcgga

SEQ ID NO: 487644 - DNA, 25 bp, Mus musculus
tggtgaacacactgaggcgcatcca

SEQ ID NO: 487645 - DNA, 25 bp, Mus musculus
tggtgaaccaaaaccttcgcctgga

SEQ ID NO: 487646 - DNA, 25 bp, Mus musculus
tggtgaacccgacaacttccgaagt

SEQ ID NO: 487647 - DNA, 25 bp, Mus musculus
tggtgaagacctcattgtgaccccg

SEQ ID NO: 487648 - DNA, 25 bp, Mus musculus
tggtgaagagcaaacccggatcagc

SEQ ID NO: 487649 - DNA, 25 bp, Mus musculus
tggtgaagtgattcccctctgcgcc

SEQ ID NO: 487650 - DNA, 25 bp, Mus musculus
tggtgaatatcgagccaaaaaactc

SEQ ID NO: 487651 - DNA, 25 bp, Mus musculus
tggtgaatcagagcatccgcctgca

SEQ ID NO: 487652 - DNA, 25 bp, Mus musculus
tggtgaatcatgcagtaccgtatca

SEQ ID NO: 487653 - DNA, 25 bp, Mus musculus
tggtgaatgaaggatgacagctacg

SEQ ID NO: 487654 - DNA, 25 bp, Mus musculus
tggtgacaccggaagacgctacagt

SEQ ID NO: 487655 - DNA, 25 bp, Mus musculus
tggtgacagaacacagtcattagca

SEQ ID NO: 487656 - DNA, 25 bp, Mus musculus
tggtgacagaatcagggttcccgtc

SEQ ID NO: 487657 - DNA, 25 bp, Mus musculus
tggtgacagcaagacccttatggtg

SEQ ID NO: 487658 - DNA, 25 bp, Mus musculus
tggtgaccacatacaacctgaggga

SEQ ID NO: 487659 - DNA, 25 bp, Mus musculus
tggtgaccatgctaccctcaagagg

SEQ ID NO: 487660 - DNA, 25 bp, Mus musculus
tggtgaccatgtacagccacgagga

SEQ ID NO: 487661 - DNA, 25 bp, Mus musculus
tggtgacccgagaggctgttacaga

SEQ ID NO: 487662 - DNA, 25 bp, Mus musculus
tggtgaccctgttcaagttggagca

SEQ ID NO: 487663 - DNA, 25 bp, Mus musculus
tggtgacctacgacatcatcaagga

SEQ ID NO: 487664 - DNA, 25 bp, Mus musculus
tggtgacctataccctcctgtggag

SEQ ID NO: 487665 - DNA, 25 bp, Mus musculus
tggtgacctccatttgcaacaaaaa

SEQ ID NO: 487666 - DNA, 25 bp, Mus musculus
tggtgacctgtacaagaagacggtc

SEQ ID NO: 487667 - DNA, 25 bp, Mus musculus
tggtgactaacatgtgccgccgtcg

SEQ ID NO: 487668 - DNA, 25 bp, Mus musculus
tggtgactcacgaccgcctgtcact

SEQ ID NO: 487669 - DNA, 25 bp, Mus musculus
tggtgactctgaggaaagccattcc

SEQ ID NO: 487670 - DNA, 25 bp, Mus musculus
tggtgactgctgacctaaggctcaa

SEQ ID NO: 487671 - DNA, 25 bp, Mus musculus
tggtgacttattaaggtcttaacac

SEQ ID NO: 487672 - DNA, 25 bp, Mus musculus
tggtgagaaacctacccctcacggg

SEQ ID NO: 487673 - DNA, 25 bp, Mus musculus
tggtgagaccagagggaagtacttc

SEQ ID NO: 487674 - DNA, 25 bp, Mus musculus
tggtgagagcactcttcaggcaagc

SEQ ID NO: 487675 - DNA, 25 bp, Mus musculus
tggtgagagccacccaactatgcag

SEQ ID NO: 487676 - DNA, 25 bp, Mus musculus
tggtgagaggccgttagaatccctc

SEQ ID NO: 487677 - DNA, 25 bp, Mus musculus
tggtgagcaataagtagatacagac

SEQ ID NO: 487678 - DNA, 25 bp, Mus musculus
tggtgagcgcttcccagatgagaac

SEQ ID NO: 487679 - DNA, 25 bp, Mus musculus
tggtgaggaactaatctgttctgcc

SEQ ID NO: 487680 - DNA, 25 bp, Mus musculus
tggtgaggaccgacttctgagcaag

SEQ ID NO: 487681 - DNA, 25 bp, Mus musculus
tggtgaggagggtagctcccaaccc

SEQ ID NO: 487682 - DNA, 25 bp, Mus musculus
tggtgaggccaactccacactgctt

SEQ ID NO: 487683 - DNA, 25 bp, Mus musculus
tggtgagttctctgttcccattaga

SEQ ID NO: 487684 - DNA, 25 bp, Mus musculus
tggtgataaaaacaacgacggccgc

SEQ ID NO: 487685 - DNA, 25 bp, Mus musculus
tggtgatacaacaaaagcctcggca

SEQ ID NO: 487686 - DNA, 25 bp, Mus musculus
tggtgatagcatccaaagcagtatg

SEQ ID NO: 487687 - DNA, 25 bp, Mus musculus
tggtgatcacattccacaatgaagc

SEQ ID NO: 487688 - DNA, 25 bp, Mus musculus
tggtgatcagcagtctccaattgag

SEQ ID NO: 487689 - DNA, 25 bp, Mus musculus
tggtgatccaagtacagctaagagc

SEQ ID NO: 487690 - DNA, 25 bp, Mus musculus
tggtgatcctctgcaaagttgtgac

SEQ ID NO: 487691 - DNA, 25 bp, Mus musculus
tggtgatcgggaacaacatccagct

SEQ ID NO: 487692 - DNA, 25 bp, Mus musculus
tggtgatctatgtctcctggaggca

SEQ ID NO: 487693 - DNA, 25 bp, Mus musculus
tggtgatctgacatcttctgctctc

SEQ ID NO: 487694 - DNA, 25 bp, Mus musculus
tggtgatgaaaaagcccgtggaact

SEQ ID NO: 487695 - DNA, 25 bp, Mus musculus
tggtgatgcattgtgggtagccaca

SEQ ID NO: 487696 - DNA, 25 bp, Mus musculus
tggtgatgctataccctgggcagac

SEQ ID NO: 487697 - DNA, 25 bp, Mus musculus
tggtgattgaagaagctgagcgctc

SEQ ID NO: 487698 - DNA, 25 bp, Mus musculus
tggtgcaaacatgtcccggatcgaa

SEQ ID NO: 487699 - DNA, 25 bp, Mus musculus
tggtgcacactcaggactcctcaga

SEQ ID NO: 487700 - DNA, 25 bp, Mus musculus
tggtgcagaactacagacactgtcc

SEQ ID NO: 487701 - DNA, 25 bp, Mus musculus
tggtgcagatgaaacagaagtcgag

SEQ ID NO: 487702 - DNA, 25 bp, Mus musculus
tggtgcagccctacgaggacgtgta

SEQ ID NO: 487703 - DNA, 25 bp, Mus musculus
tggtgcagcctacttacccagtgct

SEQ ID NO: 487704 - DNA, 25 bp, Mus musculus
tggtgcagggccttctcagtatgcc

SEQ ID NO: 487705 - DNA, 25 bp, Mus musculus
tggtgcagttacatctcagaggctg

SEQ ID NO: 487706 - DNA, 25 bp, Mus musculus
tggtgccaaaatatgataaaagggt

SEQ ID NO: 487707 - DNA, 25 bp, Mus musculus
tggtgccaccctacgaggaggtgta

SEQ ID NO: 487708 - DNA, 25 bp, Mus musculus
tggtgccaccggaagtacaagtagg

SEQ ID NO: 487709 - DNA, 25 bp, Mus musculus
tggtgccaccgtaatcagcgcagat

SEQ ID NO: 487710 - DNA, 25 bp, Mus musculus
tggtgccaggacaacatcattagcc

SEQ ID NO: 487711 - DNA, 25 bp, Mus musculus
tggtgccattccttcagacagaacg

SEQ ID NO: 487712 - DNA, 25 bp, Mus musculus
tggtgcccaaagctcacagaggaac

SEQ ID NO: 487713 - DNA, 25 bp, Mus musculus
tggtgcccaacagctgcatcaggat

SEQ ID NO: 487714 - DNA, 25 bp, Mus musculus
tggtgcccagatgcttccgaagcga

SEQ ID NO: 487715 - DNA, 25 bp, Mus musculus
tggtgcccagcccagattggcagac

SEQ ID NO: 487716 - DNA, 25 bp, Mus musculus
tggtgcccagggtctacgagatgat

SEQ ID NO: 487717 - DNA, 25 bp, Mus musculus
tggtgcccatcacagcaaaccggta

SEQ ID NO: 487718 - DNA, 25 bp, Mus musculus
tggtgccccggagctatggtgtcat

SEQ ID NO: 487719 - DNA, 25 bp, Mus musculus
tggtgccctgttctgacatctgctg

SEQ ID NO: 487720 - DNA, 25 bp, Mus musculus
tggtgcctgatagagggcagacact

SEQ ID NO: 487721 - DNA, 25 bp, Mus musculus
tggtgcctggaacatcacaggtccc

SEQ ID NO: 487722 - DNA, 25 bp, Mus musculus
tggtgccttgcctggtgttgctaac

SEQ ID NO: 487723 - DNA, 25 bp, Mus musculus
tggtgccttggtggagttaactgcc

SEQ ID NO: 487724 - DNA, 25 bp, Mus musculus
tggtgcgcataggaggacaaccctt

SEQ ID NO: 487725 - DNA, 25 bp, Mus musculus
tggtgcgcttgctgagtgctgccca

SEQ ID NO: 487726 - DNA, 25 bp, Mus musculus
tggtgctacctctgtgctggtatca

SEQ ID NO: 487727 - DNA, 25 bp, Mus musculus
tggtgctcacgagcatcgctggctg

SEQ ID NO: 487728 - DNA, 25 bp, Mus musculus
tggtgctcagaaccaggaagcaaca

SEQ ID NO: 487729 - DNA, 25 bp, Mus musculus
tggtgctcatacaacacaagaggct

SEQ ID NO: 487730 - DNA, 25 bp, Mus musculus
tggtgctcccgctgtccagaggctc

SEQ ID NO: 487731 - DNA, 25 bp, Mus musculus
tggtgctctagatcacagccatggc

SEQ ID NO: 487732 - DNA, 25 bp, Mus musculus
tggtgctgagccgagaacccttgcg

SEQ ID NO: 487733 - DNA, 25 bp, Mus musculus
tggtgctgaggctaaacctgctggt

SEQ ID NO: 487734 - DNA, 25 bp, Mus musculus
tggtgctgcactattcaaacccgag

SEQ ID NO: 487735 - DNA, 25 bp, Mus musculus
tggtgctgctgctcagattcactga

SEQ ID NO: 487736 - DNA, 25 bp, Mus musculus
tggtgctggacaacagccacatggt

SEQ ID NO: 487737 - DNA, 25 bp, Mus musculus
tggtgctggccgtgttcctcaacga

SEQ ID NO: 487738 - DNA, 25 bp, Mus musculus
tggtgctgtcttgagactgggacca

SEQ ID NO: 487739 - DNA, 25 bp, Mus musculus
tggtgcttatgacatcaccactgct

SEQ ID NO: 487740 - DNA, 25 bp, Mus musculus
tggtgcttcacctggccatcgtggt

SEQ ID NO: 487741 - DNA, 25 bp, Mus musculus
tggtgcttccacagacatctctgcc

SEQ ID NO: 487742 - DNA, 25 bp, Mus musculus
tggtgcttccagtcggtagccggaa

SEQ ID NO: 487743 - DNA, 25 bp, Mus musculus
tggtgcttcccacagcagtaggaat

SEQ ID NO: 487744 - DNA, 25 bp, Mus musculus
tggtgcttcctgatccacgtgcaag

SEQ ID NO: 487745 - DNA, 25 bp, Mus musculus
tggtgcttttagagtccccagcccc

SEQ ID NO: 487746 - DNA, 25 bp, Mus musculus
tggtgcttttgctggtagtttgcag

SEQ ID NO: 487747 - DNA, 25 bp, Mus musculus
tggtggaaaaccctgactgctatta

SEQ ID NO: 487748 - DNA, 25 bp, Mus musculus
tggtggaaacaaactcccaggaccg

SEQ ID NO: 487749 - DNA, 25 bp, Mus musculus
tggtggaaccaaattctagaagagt

SEQ ID NO: 487750 - DNA, 25 bp, Mus musculus
tggtggaagcacagttggcaacctt

SEQ ID NO: 487751 - DNA, 25 bp, Mus musculus
tggtggaattacagcaaaccctggc

SEQ ID NO: 487752 - DNA, 25 bp, Mus musculus
tggtggacaacatcgccctgtggat

SEQ ID NO: 487753 - DNA, 25 bp, Mus musculus
tggtggacagtaagccggtgaacct

SEQ ID NO: 487754 - DNA, 25 bp, Mus musculus
tggtggaccccaatgaacgtgaaga

SEQ ID NO: 487755 - DNA, 25 bp, Mus musculus
tggtggaccctctacctttgctgtg

SEQ ID NO: 487756 - DNA, 25 bp, Mus musculus
tggtggacgagtaccccagacttct

SEQ ID NO: 487757 - DNA, 25 bp, Mus musculus
tggtggactcacacccagacattgc

SEQ ID NO: 487758 - DNA, 25 bp, Mus musculus
tggtggactccctttgtcagcaagg

SEQ ID NO: 487759 - DNA, 25 bp, Mus musculus
tggtggagaaactgcctgacagccc

SEQ ID NO: 487760 - DNA, 25 bp, Mus musculus
tggtggagaacatcgagcgccttca

SEQ ID NO: 487761 - DNA, 25 bp, Mus musculus
tggtggagcaaccactcagggcaac

SEQ ID NO: 487762 - DNA, 25 bp, Mus musculus
tggtggagccactggtgaccagaac

SEQ ID NO: 487763 - DNA, 25 bp, Mus musculus
tggtggaggacataaccgtgtcgcc

SEQ ID NO: 487764 - DNA, 25 bp, Mus musculus
tggtggaggctcttattgccctaac

SEQ ID NO: 487765 - DNA, 25 bp, Mus musculus
tggtggagggacaccgccctgttat

SEQ ID NO: 487766 - DNA, 25 bp, Mus musculus
tggtggagtggcaccccacaactgc

SEQ ID NO: 487767 - DNA, 25 bp, Mus musculus
tggtggatcatcaagcgcatactgg

SEQ ID NO: 487768 - DNA, 25 bp, Mus musculus
tggtggcaaccatttccgaggaacc

SEQ ID NO: 487769 - DNA, 25 bp, Mus musculus
tggtggcacttctgtgtccctaagc

SEQ ID NO: 487770 - DNA, 25 bp, Mus musculus
tggtggcagagttcaatcaaagatg

SEQ ID NO: 487771 - DNA, 25 bp, Mus musculus
tggtggcatctttggctaatctggc

SEQ ID NO: 487772 - DNA, 25 bp, Mus musculus
tggtggcattcaatcagaacaaggc

SEQ ID NO: 487773 - DNA, 25 bp, Mus musculus
tggtggccaaccctagctgttctag

SEQ ID NO: 487774 - DNA, 25 bp, Mus musculus
tggtggccaagggtagcaagcatcc

SEQ ID NO: 487775 - DNA, 25 bp, Mus musculus
tggtggccagcgtatgacatcaagc

SEQ ID NO: 487776 - DNA, 25 bp, Mus musculus
tggtggccagctactctgacatcgg

SEQ ID NO: 487777 - DNA, 25 bp, Mus musculus
tggtggcccagacatatctaggtat

SEQ ID NO: 487778 - DNA, 25 bp, Mus musculus
tggtggcccgctacattcgcataaa

SEQ ID NO: 487779 - DNA, 25 bp, Mus musculus
tggtggcctcaattcatctgactgc

SEQ ID NO: 487780 - DNA, 25 bp, Mus musculus
tggtggcctggtgtcgcttagccac

SEQ ID NO: 487781 - DNA, 25 bp, Mus musculus
tggtggcgccagttgaaagcaagcc

SEQ ID NO: 487782 - DNA, 25 bp, Mus musculus
tggtggctaaagctacgtgtccttg

SEQ ID NO: 487783 - DNA, 25 bp, Mus musculus
tggtggctatctctcgggatctgca

SEQ ID NO: 487784 - DNA, 25 bp, Mus musculus
tggtggctcagccttccgagagaaa

SEQ ID NO: 487785 - DNA, 25 bp, Mus musculus
tggtggctcattcggacttccagaa

SEQ ID NO: 487786 - DNA, 25 bp, Mus musculus
tggtggctccctagatctcaaggaa

SEQ ID NO: 487787 - DNA, 25 bp, Mus musculus
tggtggctctcagaaggactggcct

SEQ ID NO: 487788 - DNA, 25 bp, Mus musculus
tggtggctgactggaaaccgacttc

SEQ ID NO: 487789 - DNA, 25 bp, Mus musculus
tggtggctgccaaggaaacaataac

SEQ ID NO: 487790 - DNA, 25 bp, Mus musculus
tggtggcttatcttgaggaacctgg

SEQ ID NO: 487791 - DNA, 25 bp, Mus musculus
tggtggcttccaacctcgtgagcgg

SEQ ID NO: 487792 - DNA, 25 bp, Mus musculus
tggtgggaaaagtgccgctctgctt

SEQ ID NO: 487793 - DNA, 25 bp, Mus musculus
tggtgggacccaacaagcctgtcta

SEQ ID NO: 487794 - DNA, 25 bp, Mus musculus
tggtgggatcaaagcgcagtgtcct

SEQ ID NO: 487795 - DNA, 25 bp, Mus musculus
tggtgggcaaaagagaaaaccgctt

SEQ ID NO: 487796 - DNA, 25 bp, Mus musculus
tggtgggcaccaagagctgatgaca

SEQ ID NO: 487797 - DNA, 25 bp, Mus musculus
tggtgggcccacgaaatacagaata

SEQ ID NO: 487798 - DNA, 25 bp, Mus musculus
tggtgggcgcaagtacacataccgc

SEQ ID NO: 487799 - DNA, 25 bp, Mus musculus
tggtgggtaacaaccgagccaagat

SEQ ID NO: 487800 - DNA, 25 bp, Mus musculus
tggtgggtaacatctgtctgcagct

SEQ ID NO: 487801 - DNA, 25 bp, Mus musculus
tggtggtaaaactgcatgcgggaca

SEQ ID NO: 487802 - DNA, 25 bp, Mus musculus
tggtggtacacgtgtttaacaggtc

SEQ ID NO: 487803 - DNA, 25 bp, Mus musculus
tggtggtaccttccaacatggcgag

SEQ ID NO: 487804 - DNA, 25 bp, Mus musculus
tggtggtagctacatgccttgtgcc

SEQ ID NO: 487805 - DNA, 25 bp, Mus musculus
tggtggtcaccaaacggaggaagtc

SEQ ID NO: 487806 - DNA, 25 bp, Mus musculus
tggtggtccagaacacgcaggatac

SEQ ID NO: 487807 - DNA, 25 bp, Mus musculus
tggtggtccctgcttattttgtcta

SEQ ID NO: 487808 - DNA, 25 bp, Mus musculus
tggtggtggcgaagtcggaggcccg

SEQ ID NO: 487809 - DNA, 25 bp, Mus musculus
tggtggtggctacgttaccttcaac

SEQ ID NO: 487810 - DNA, 25 bp, Mus musculus
tggtggtgttcctcacagccaacgt

SEQ ID NO: 487811 - DNA, 25 bp, Mus musculus
tggtggttcttatccatcagcttgc

SEQ ID NO: 487812 - DNA, 25 bp, Mus musculus
tggtgtaccaaaaagctgccatgcg

SEQ ID NO: 487813 - DNA, 25 bp, Mus musculus
tggtgtagatcccaaagcctgcagc

SEQ ID NO: 487814 - DNA, 25 bp, Mus musculus
tggtgtagatgcttcagagcacacg

SEQ ID NO: 487815 - DNA, 25 bp, Mus musculus
tggtgtataaggacccagctcggcc

SEQ ID NO: 487816 - DNA, 25 bp, Mus musculus
tggtgtatacctggcactggacgtg

SEQ ID NO: 487817 - DNA, 25 bp, Mus musculus
tggtgtcaaccctgctgtaatatct

SEQ ID NO: 487818 - DNA, 25 bp, Mus musculus
tggtgtcacacaacgcccatgatct

SEQ ID NO: 487819 - DNA, 25 bp, Mus musculus
tggtgtcagactgctcacaggtgct

SEQ ID NO: 487820 - DNA, 25 bp, Mus musculus
tggtgtcagcacgttggtcacagtc

SEQ ID NO: 487821 - DNA, 25 bp, Mus musculus
tggtgtcaggaaagcagcgctctct

SEQ ID NO: 487822 - DNA, 25 bp, Mus musculus
tggtgtcagtacttcatcagcaggc

SEQ ID NO: 487823 - DNA, 25 bp, Mus musculus
tggtgtccccaagaaagggccctgt

SEQ ID NO: 487824 - DNA, 25 bp, Mus musculus
tggtgtccgagagaccttatgcctc

SEQ ID NO: 487825 - DNA, 25 bp, Mus musculus
tggtgtcctacacaggcaaaggcgt

SEQ ID NO: 487826 - DNA, 25 bp, Mus musculus
tggtgtcctgctggtaagcattcac

SEQ ID NO: 487827 - DNA, 25 bp, Mus musculus
tggtgtcgcccatcgaaagtgctga

SEQ ID NO: 487828 - DNA, 25 bp, Mus musculus
tggtgtctcagatcacgaagagccg

SEQ ID NO: 487829 - DNA, 25 bp, Mus musculus
tggtgtctccaagaaaggctggcct

SEQ ID NO: 487830 - DNA, 25 bp, Mus musculus
tggtgtctgtgctcttgaatactag

SEQ ID NO: 487831 - DNA, 25 bp, Mus musculus
tggtgtgaataaacaagggacctgc

SEQ ID NO: 487832 - DNA, 25 bp, Mus musculus
tggtgtgaccactcttaatgctgtg

SEQ ID NO: 487833 - DNA, 25 bp, Mus musculus
tggtgtgcaggaaagctattcagcc

SEQ ID NO: 487834 - DNA, 25 bp, Mus musculus
tggtgtgcgatacctccagaaggct

SEQ ID NO: 487835 - DNA, 25 bp, Mus musculus
tggtgtgcggccatcatgaccaagg

SEQ ID NO: 487836 - DNA, 25 bp, Mus musculus
tggtgtggccaacgcagctacaaaa

SEQ ID NO: 487837 - DNA, 25 bp, Mus musculus
tggtgtggctgcactcaatggctcc

SEQ ID NO: 487838 - DNA, 25 bp, Mus musculus
tggtgtgtaagccatccaagtctgt

SEQ ID NO: 487839 - DNA, 25 bp, Mus musculus
tggtgtgtcacctcctgttacaatg

SEQ ID NO: 487840 - DNA, 25 bp, Mus musculus
tggtgtgtctcttaatgaagaaccg

SEQ ID NO: 487841 - DNA, 25 bp, Mus musculus
tggtgtgtctgctcatcaagaaggg

SEQ ID NO: 487842 - DNA, 25 bp, Mus musculus
tggtgtgtgccctcaaattaagaac

SEQ ID NO: 487843 - DNA, 25 bp, Mus musculus
tggtgttaagcaaagaggccgcatt

SEQ ID NO: 487844 - DNA, 25 bp, Mus musculus
tggtgttcatcatcggcctcctggg

SEQ ID NO: 487845 - DNA, 25 bp, Mus musculus
tggtgttccaccaagcagacattgg

SEQ ID NO: 487846 - DNA, 25 bp, Mus musculus
tggtgttccaccacttggcaaagaa

SEQ ID NO: 487847 - DNA, 25 bp, Mus musculus
tggtgttcgtccttacaggtgtctc

SEQ ID NO: 487848 - DNA, 25 bp, Mus musculus
tggtgttgaagtgatgaacctgatg

SEQ ID NO: 487849 - DNA, 25 bp, Mus musculus
tggtgttgaccgtttctctgtaaaa

SEQ ID NO: 487850 - DNA, 25 bp, Mus musculus
tggtgttgagaagccacgtgtaact

SEQ ID NO: 487851 - DNA, 25 bp, Mus musculus
tggtgttgaggctagaccacactcc

SEQ ID NO: 487852 - DNA, 25 bp, Mus musculus
tggtgtttatattactaacctaggc

SEQ ID NO: 487853 - DNA, 25 bp, Mus musculus
tggtgtttcccaggtgctgtccaca

SEQ ID NO: 487854 - DNA, 25 bp, Mus musculus
tggtgtttccggatggctgcataga

SEQ ID NO: 487855 - DNA, 25 bp, Mus musculus
tggtgtttgcctgccaagggaactg

SEQ ID NO: 487856 - DNA, 25 bp, Mus musculus
tggtgttttatgaagcacttagact

SEQ ID NO: 487857 - DNA, 25 bp, Mus musculus
tggttaaaggcattggctcttcttc

SEQ ID NO: 487858 - DNA, 25 bp, Mus musculus
tggttaacccagcaaataccttggc

SEQ ID NO: 487859 - DNA, 25 bp, Mus musculus
tggttaacgtgttggtataacttgt

SEQ ID NO: 487860 - DNA, 25 bp, Mus musculus
tggttaagaccgagggagccactct

SEQ ID NO: 487861 - DNA, 25 bp, Mus musculus
tggttaagcccctgcgtcttccaac

SEQ ID NO: 487862 - DNA, 25 bp, Mus musculus
tggttaagctctgcatcgatgggca

SEQ ID NO: 487863 - DNA, 25 bp, Mus musculus
tggttaatctcaccagcagaatgtg

SEQ ID NO: 487864 - DNA, 25 bp, Mus musculus
tggttaatgtgccaactatttcagc

SEQ ID NO: 487865 - DNA, 25 bp, Mus musculus
tggttacaaggcacaatgaggcaca

SEQ ID NO: 487866 - DNA, 25 bp, Mus musculus
tggttacacagagcatgcagtccgt

SEQ ID NO: 487867 - DNA, 25 bp, Mus musculus
tggttaccaccatgacaatgctgga

SEQ ID NO: 487868 - DNA, 25 bp, Mus musculus
tggttaccgaaggtccagccaactg

SEQ ID NO: 487869 - DNA, 25 bp, Mus musculus
tggttacgacgactacccgaaggtg

SEQ ID NO: 487870 - DNA, 25 bp, Mus musculus
tggttacgtcatcaacggcgggcca

SEQ ID NO: 487871 - DNA, 25 bp, Mus musculus
tggttacgtggttgccttccggcca

SEQ ID NO: 487872 - DNA, 25 bp, Mus musculus
tggttactgagggtctgtgctcccc

SEQ ID NO: 487873 - DNA, 25 bp, Mus musculus
tggttagacactctgcgcatgcggc

SEQ ID NO: 487874 - DNA, 25 bp, Mus musculus
tggttagttggacagggtcttccta

SEQ ID NO: 487875 - DNA, 25 bp, Mus musculus
tggttatccaggacctcaggctagc

SEQ ID NO: 487876 - DNA, 25 bp, Mus musculus
tggttattacaagaagcaagctact

SEQ ID NO: 487877 - DNA, 25 bp, Mus musculus
tggttattggacagcattctgccac

SEQ ID NO: 487878 - DNA, 25 bp, Mus musculus
tggttcacaagaaaacggagcgcct

SEQ ID NO: 487879 - DNA, 25 bp, Mus musculus
tggttcacattagccatcttgctgg

SEQ ID NO: 487880 - DNA, 25 bp, Mus musculus
tggttcacgggacgctgtccgcatc

SEQ ID NO: 487881 - DNA, 25 bp, Mus musculus
tggttcaggatacaatacacggacg

SEQ ID NO: 487882 - DNA, 25 bp, Mus musculus
tggttcagggcctctaggcagcagc

SEQ ID NO: 487883 - DNA, 25 bp, Mus musculus
tggttcagtgccacacatggtcatg

SEQ ID NO: 487884 - DNA, 25 bp, Mus musculus
tggttcatacaacctgccaggcaga

SEQ ID NO: 487885 - DNA, 25 bp, Mus musculus
tggttccagtgcacaccgttgagga

SEQ ID NO: 487886 - DNA, 25 bp, Mus musculus
tggttccattcaaagcagatctacg

SEQ ID NO: 487887 - DNA, 25 bp, Mus musculus
tggttcccaggcgagagacatgtcc

SEQ ID NO: 487888 - DNA, 25 bp, Mus musculus
tggttccccagtcaagaaatatgtg

SEQ ID NO: 487889 - DNA, 25 bp, Mus musculus
tggttccccgcagctgcagattctg

SEQ ID NO: 487890 - DNA, 25 bp, Mus musculus
tggttcccctcctatactctgtaga

SEQ ID NO: 487891 - DNA, 25 bp, Mus musculus
tggttccctcctgtagatctcctgt

SEQ ID NO: 487892 - DNA, 25 bp, Mus musculus
tggttccctgaggtacggcaccact

SEQ ID NO: 487893 - DNA, 25 bp, Mus musculus
tggttccgagcacccatatgttggc

SEQ ID NO: 487894 - DNA, 25 bp, Mus musculus
tggttccgccggcatgatgtatgcc

SEQ ID NO: 487895 - DNA, 25 bp, Mus musculus
tggttcctgagacccgagagtaccg

SEQ ID NO: 487896 - DNA, 25 bp, Mus musculus
tggttcctgcacctgctcggacaaa

SEQ ID NO: 487897 - DNA, 25 bp, Mus musculus
tggttcctggcccttctgggtctta

SEQ ID NO: 487898 - DNA, 25 bp, Mus musculus
tggttccttgcaaaatacacatggg

SEQ ID NO: 487899 - DNA, 25 bp, Mus musculus
tggttccttgctggcagctcctttc

SEQ ID NO: 487900 - DNA, 25 bp, Mus musculus
tggttcgcgtgcctcagctttgaga

SEQ ID NO: 487901 - DNA, 25 bp, Mus musculus
tggttcggccatgacctcagtacaa

SEQ ID NO: 487902 - DNA, 25 bp, Mus musculus
tggttctacaaagggctccccaagt

SEQ ID NO: 487903 - DNA, 25 bp, Mus musculus
tggttctcagctggcaatggcagtg

SEQ ID NO: 487904 - DNA, 25 bp, Mus musculus
tggttctgagctctttaccaaagtt

SEQ ID NO: 487905 - DNA, 25 bp, Mus musculus
tggttctgcccacaaggaaagaccg

SEQ ID NO: 487906 - DNA, 25 bp, Mus musculus
tggttctggcccctaggagacgcca

SEQ ID NO: 487907 - DNA, 25 bp, Mus musculus
tggttcttgcgcctcatcctgggca

SEQ ID NO: 487908 - DNA, 25 bp, Mus musculus
tggttgaagtaggacccagatgtct

SEQ ID NO: 487909 - DNA, 25 bp, Mus musculus
tggttgagaacttcagtaacttttc

SEQ ID NO: 487910 - DNA, 25 bp, Mus musculus
tggttgagggcagtacacatgtgta

SEQ ID NO: 487911 - DNA, 25 bp, Mus musculus
tggttgaggttccacgctggtccaa

SEQ ID NO: 487912 - DNA, 25 bp, Mus musculus
tggttgcacccggactcagaagact

SEQ ID NO: 487913 - DNA, 25 bp, Mus musculus
tggttgcactgaaaataccgcctag

SEQ ID NO: 487914 - DNA, 25 bp, Mus musculus
tggttgcagccaggaagttcacccg

SEQ ID NO: 487915 - DNA, 25 bp, Mus musculus
tggttgcctgttttgagagggcctc

SEQ ID NO: 487916 - DNA, 25 bp, Mus musculus
tggttgctagtctttccaggaccca

SEQ ID NO: 487917 - DNA, 25 bp, Mus musculus
tggttgctctgaacacaccggtggc

SEQ ID NO: 487918 - DNA, 25 bp, Mus musculus
tggttggaatgtaaaggcggcccct

SEQ ID NO: 487919 - DNA, 25 bp, Mus musculus
tggttggagtctacacctggcccag

SEQ ID NO: 487920 - DNA, 25 bp, Mus musculus
tggttggcccacacctctgcaaata

SEQ ID NO: 487921 - DNA, 25 bp, Mus musculus
tggttggctacagtaacgctgggcc

SEQ ID NO: 487922 - DNA, 25 bp, Mus musculus
tggttggctcctgagcagacagcag

SEQ ID NO: 487923 - DNA, 25 bp, Mus musculus
tggttgggactgttagacttgttac

SEQ ID NO: 487924 - DNA, 25 bp, Mus musculus
tggttgtggcctaagcctttgtaag

SEQ ID NO: 487925 - DNA, 25 bp, Mus musculus
tggtttacaagtgacaggcaaggct

SEQ ID NO: 487926 - DNA, 25 bp, Mus musculus
tggtttacaatattcaagatgacta

SEQ ID NO: 487927 - DNA, 25 bp, Mus musculus
tggtttattaaactcatgtatgaaa

SEQ ID NO: 487928 - DNA, 25 bp, Mus musculus
tggtttccaggttttctccctccag

SEQ ID NO: 487929 - DNA, 25 bp, Mus musculus
tggtttccatcgagactgctgctga

SEQ ID NO: 487930 - DNA, 25 bp, Mus musculus
tggtttcccaggtttcaggtgagga

SEQ ID NO: 487931 - DNA, 25 bp, Mus musculus
tggtttgagaccacccggagagaga

SEQ ID NO: 487932 - DNA, 25 bp, Mus musculus
tggtttgcttttgaccccggctcgg

SEQ ID NO: 487933 - DNA, 25 bp, Mus musculus
tggtttggcaaaagaccctgacatc

SEQ ID NO: 487934 - DNA, 25 bp, Mus musculus
tggtttgtgaacgacccggaggaca

SEQ ID NO: 487935 - DNA, 25 bp, Mus musculus
tggttttagcacagaattctacaag

SEQ ID NO: 487936 - DNA, 25 bp, Mus musculus
tggttttagcagtttggatcatggc

SEQ ID NO: 487937 - DNA, 25 bp, Mus musculus
tggttttattaggaatcactaagtg

SEQ ID NO: 487938 - DNA, 25 bp, Mus musculus
tggttttcactgcagccgattgact

SEQ ID NO: 487939 - DNA, 25 bp, Mus musculus
tggttttcccgtaatttcagcactt

SEQ ID NO: 487940 - DNA, 25 bp, Mus musculus
tggttttgcagaccctacacagcgg

SEQ ID NO: 487941 - DNA, 25 bp, Mus musculus
tggttttggagaatccgccggctgc

SEQ ID NO: 487942 - DNA, 25 bp, Mus musculus
tggttttggctcagtgaagcgagac

SEQ ID NO: 487943 - DNA, 25 bp, Mus musculus
tggttttgggctgtaactgctccag

SEQ ID NO: 487944 - DNA, 25 bp, Mus musculus
tggttttggtattctgttgaacacg

SEQ ID NO: 487945 - DNA, 25 bp, Mus musculus
tgtaaaaaaccccatcagcaggcgg

SEQ ID NO: 487946 - DNA, 25 bp, Mus musculus
tgtaaaacaatgaggacaagagtcc

SEQ ID NO: 487947 - DNA, 25 bp, Mus musculus
tgtaaaacccgactctagaaactgc

SEQ ID NO: 487948 - DNA, 25 bp, Mus musculus
tgtaaaactgactccagtgaggtgg

SEQ ID NO: 487949 - DNA, 25 bp, Mus musculus
tgtaaaactgccacccacgccggaa

SEQ ID NO: 487950 - DNA, 25 bp, Mus musculus
tgtaaaacttcacatcattgctgag

SEQ ID NO: 487951 - DNA, 25 bp, Mus musculus
tgtaaaagccccaagctgctgctgc

SEQ ID NO: 487952 - DNA, 25 bp, Mus musculus
tgtaaaagtacgtgctcacacgagc

SEQ ID NO: 487953 - DNA, 25 bp, Mus musculus
tgtaaaataatctgggaaggctgag

SEQ ID NO: 487954 - DNA, 25 bp, Mus musculus
tgtaaaattctagatacagctgatg

SEQ ID NO: 487955 - DNA, 25 bp, Mus musculus
tgtaaacaccgccactgatgatgac

SEQ ID NO: 487956 - DNA, 25 bp, Mus musculus
tgtaaacagagttgcacagcgccag

SEQ ID NO: 487957 - DNA, 25 bp, Mus musculus
tgtaaacagcactttgacactgtcc

SEQ ID NO: 487958 - DNA, 25 bp, Mus musculus
tgtaaacagtgctccagcacgctgc

SEQ ID NO: 487959 - DNA, 25 bp, Mus musculus
tgtaaacatgccttaagctttgctg

SEQ ID NO: 487960 - DNA, 25 bp, Mus musculus
tgtaaacattcgtgaaaccttccct

SEQ ID NO: 487961 - DNA, 25 bp, Mus musculus
tgtaaaccacccacaattcaagagt

SEQ ID NO: 487962 - DNA, 25 bp, Mus musculus
tgtaaaccagcaggacaacgagggc

SEQ ID NO: 487963 - DNA, 25 bp, Mus musculus
tgtaaacccaagtgagccaatctgg

SEQ ID NO: 487964 - DNA, 25 bp, Mus musculus
tgtaaacccacgatcccaggttatt

SEQ ID NO: 487965 - DNA, 25 bp, Mus musculus
tgtaaacccaggaattccagtgccc

SEQ ID NO: 487966 - DNA, 25 bp, Mus musculus
tgtaaaccccgccagaacttgtcgt

SEQ ID NO: 487967 - DNA, 25 bp, Mus musculus
tgtaaacctctttggcaatgctgcc

SEQ ID NO: 487968 - DNA, 25 bp, Mus musculus
tgtaaacctttgttgccgccgcagg

SEQ ID NO: 487969 - DNA, 25 bp, Mus musculus
tgtaaactcacaaaacgggcaagga

SEQ ID NO: 487970 - DNA, 25 bp, Mus musculus
tgtaaactcgatcatgctcattggc

SEQ ID NO: 487971 - DNA, 25 bp, Mus musculus
tgtaaactctttgacagacagacct

SEQ ID NO: 487972 - DNA, 25 bp, Mus musculus
tgtaaactggtcattccaagccgag

SEQ ID NO: 487973 - DNA, 25 bp, Mus musculus
tgtaaagaagaaactgcggccacct

SEQ ID NO: 487974 - DNA, 25 bp, Mus musculus
tgtaaagaagattcccggcctggtg

SEQ ID NO: 487975 - DNA, 25 bp, Mus musculus
tgtaaagacacatgaagaaatcaat

SEQ ID NO: 487976 - DNA, 25 bp, Mus musculus
tgtaaagacccacccactgatggat

SEQ ID NO: 487977 - DNA, 25 bp, Mus musculus
tgtaaagacgcattgaccagaccct

SEQ ID NO: 487978 - DNA, 25 bp, Mus musculus
tgtaaagattgtggcttcgaaacag

SEQ ID NO: 487979 - DNA, 25 bp, Mus musculus
tgtaaagccccgtatagagcctata

SEQ ID NO: 487980 - DNA, 25 bp, Mus musculus
tgtaaagctcacacggactgtctgg

SEQ ID NO: 487981 - DNA, 25 bp, Mus musculus
tgtaaagctcataattcaaaggtct

SEQ ID NO: 487982 - DNA, 25 bp, Mus musculus
tgtaaagctcatcgtcctggaccgc

SEQ ID NO: 487983 - DNA, 25 bp, Mus musculus
tgtaaagctgccgtctgaccaaggt

SEQ ID NO: 487984 - DNA, 25 bp, Mus musculus
tgtaaagtgcctttactgaacagga

SEQ ID NO: 487985 - DNA, 25 bp, Mus musculus
tgtaaagtgcgttctggtggccagc

SEQ ID NO: 487986 - DNA, 25 bp, Mus musculus
tgtaaataaaattgggccgtggctc

SEQ ID NO: 487987 - DNA, 25 bp, Mus musculus
tgtaaataaggacgatcacgctgtg

SEQ ID NO: 487988 - DNA, 25 bp, Mus musculus
tgtaaatagtgctgggtgtccctgg

SEQ ID NO: 487989 - DNA, 25 bp, Mus musculus
tgtaaatcataattccaaagagaac

SEQ ID NO: 487990 - DNA, 25 bp, Mus musculus
tgtaaatccagaagcttgggaggct

SEQ ID NO: 487991 - DNA, 25 bp, Mus musculus
tgtaaatctctgaaggaaacggact

SEQ ID NO: 487992 - DNA, 25 bp, Mus musculus
tgtaaatctgtactcgtttctcagc

SEQ ID NO: 487993 - DNA, 25 bp, Mus musculus
tgtaaatgacacagaggccctgcgg

SEQ ID NO: 487994 - DNA, 25 bp, Mus musculus
tgtaaatgacttaatccaattccac

SEQ ID NO: 487995 - DNA, 25 bp, Mus musculus
tgtaaatgatcgagttccgtgggct

SEQ ID NO: 487996 - DNA, 25 bp, Mus musculus
tgtaaatgcagaacctgccgctgtg

SEQ ID NO: 487997 - DNA, 25 bp, Mus musculus
tgtaaatgcctctttcagaagtctg

SEQ ID NO: 487998 - DNA, 25 bp, Mus musculus
tgtaaatggaagcagcatactcatc

SEQ ID NO: 487999 - DNA, 25 bp, Mus musculus
tgtaaatgtagtcccaccaagtgcc

SEQ ID NO: 488000 - DNA, 25 bp, Mus musculus
tgtaaatgttaaatgcccgcagagc

SEQ ID NO: 488001 - DNA, 25 bp, Mus musculus
tgtaaattcacctgccactcggagt

SEQ ID NO: 488002 - DNA, 25 bp, Mus musculus
tgtaacaaaatacccgagcctgcga

SEQ ID NO: 488003 - DNA, 25 bp, Mus musculus
tgtaacaaacccagctggatgccag

SEQ ID NO: 488004 - DNA, 25 bp, Mus musculus
tgtaacaaggagtacctcagcctgg

SEQ ID NO: 488005 - DNA, 25 bp, Mus musculus
tgtaacaagtgcctggacggcgtcc

SEQ ID NO: 488006 - DNA, 25 bp, Mus musculus
tgtaacaagtgcttcggccgcagct

SEQ ID NO: 488007 - DNA, 25 bp, Mus musculus
tgtaacaccaagaactagatgtccc

SEQ ID NO: 488008 - DNA, 25 bp, Mus musculus
tgtaacaccagagggccaaacctga

SEQ ID NO: 488009 - DNA, 25 bp, Mus musculus
tgtaacactgaactgtgcaacagtg

SEQ ID NO: 488010 - DNA, 25 bp, Mus musculus
tgtaacacttatgggaaatggactc

SEQ ID NO: 488011 - DNA, 25 bp, Mus musculus
tgtaacagatcgcaagaacctagga

SEQ ID NO: 488012 - DNA, 25 bp, Mus musculus
tgtaacagcatcaacgtgacggagg

SEQ ID NO: 488013 - DNA, 25 bp, Mus musculus
tgtaacagtcaccttcaaatgcatg

SEQ ID NO: 488014 - DNA, 25 bp, Mus musculus
tgtaacataagctggaaggtctccc

SEQ ID NO: 488015 - DNA, 25 bp, Mus musculus
tgtaaccaaggaaccccagagctat

SEQ ID NO: 488016 - DNA, 25 bp, Mus musculus
tgtaaccagacagatcaccacagga

SEQ ID NO: 488017 - DNA, 25 bp, Mus musculus
tgtaaccagatagagcgcctgcctt

SEQ ID NO: 488018 - DNA, 25 bp, Mus musculus
tgtaacccagagactcttaaaaggt

SEQ ID NO: 488019 - DNA, 25 bp, Mus musculus
tgtaacccgcacaccaatttcacgg

SEQ ID NO: 488020 - DNA, 25 bp, Mus musculus
tgtaaccctgtgcagcgcatctcag

SEQ ID NO: 488021 - DNA, 25 bp, Mus musculus
tgtaaccgggtctcaggacatcaag

SEQ ID NO: 488022 - DNA, 25 bp, Mus musculus
tgtaaccgtggttagtaaagccaca

SEQ ID NO: 488023 - DNA, 25 bp, Mus musculus
tgtaacctcactacgccgacaagaa

SEQ ID NO: 488024 - DNA, 25 bp, Mus musculus
tgtaacctgtgttgcgcaaatgccg

SEQ ID NO: 488025 - DNA, 25 bp, Mus musculus
tgtaacgagcgatggctggagccac

SEQ ID NO: 488026 - DNA, 25 bp, Mus musculus
tgtaacgcttcatgaagctcgagcg

SEQ ID NO: 488027 - DNA, 25 bp, Mus musculus
tgtaacggactgttatacgtcacca

SEQ ID NO: 488028 - DNA, 25 bp, Mus musculus
tgtaactagcacttgaaccctgcct

SEQ ID NO: 488029 - DNA, 25 bp, Mus musculus
tgtaactctccaccactaaggcgga

SEQ ID NO: 488030 - DNA, 25 bp, Mus musculus
tgtaactctcgttcccctgtggcct

SEQ ID NO: 488031 - DNA, 25 bp, Mus musculus
tgtaactctgctctgaggaacaggt

SEQ ID NO: 488032 - DNA, 25 bp, Mus musculus
tgtaactgcatactgcacatgtgct

SEQ ID NO: 488033 - DNA, 25 bp, Mus musculus
tgtaactgcccatcagacctgagta

SEQ ID NO: 488034 - DNA, 25 bp, Mus musculus
tgtaactgcgatgctctggatccct

SEQ ID NO: 488035 - DNA, 25 bp, Mus musculus
tgtaactgttaactgtgcccggctg

SEQ ID NO: 488036 - DNA, 25 bp, Mus musculus
tgtaactgttcacctcgcctctagg

SEQ ID NO: 488037 - DNA, 25 bp, Mus musculus
tgtaacttaccctctattgtctgtg

SEQ ID NO: 488038 - DNA, 25 bp, Mus musculus
tgtaacttcagacagaccatcctga

SEQ ID NO: 488039 - DNA, 25 bp, Mus musculus
tgtaacttcttctaaccctgggtgc

SEQ ID NO: 488040 - DNA, 25 bp, Mus musculus
tgtaacttgggagttaagtatccct

SEQ ID NO: 488041 - DNA, 25 bp, Mus musculus
tgtaagaaaatatggccgtcacccc

SEQ ID NO: 488042 - DNA, 25 bp, Mus musculus
tgtaagaaccctcaggtctgcccgt

SEQ ID NO: 488043 - DNA, 25 bp, Mus musculus
tgtaagaatacaaagttgggcctcc

SEQ ID NO: 488044 - DNA, 25 bp, Mus musculus
tgtaagaattctgcaaggtccctgg

SEQ ID NO: 488045 - DNA, 25 bp, Mus musculus
tgtaagagctctttggtcaccgcca

SEQ ID NO: 488046 - DNA, 25 bp, Mus musculus
tgtaagataagaccacgtccaggcc

SEQ ID NO: 488047 - DNA, 25 bp, Mus musculus
tgtaagatgtcaaagggaggcagcc

SEQ ID NO: 488048 - DNA, 25 bp, Mus musculus
tgtaagattgtactccaagccgggc

SEQ ID NO: 488049 - DNA, 25 bp, Mus musculus
tgtaagcaatgtgagcaatgcccgc

SEQ ID NO: 488050 - DNA, 25 bp, Mus musculus
tgtaagcacagttttccactgcgcg

SEQ ID NO: 488051 - DNA, 25 bp, Mus musculus
tgtaagcagctagtaaggaccatag

SEQ ID NO: 488052 - DNA, 25 bp, Mus musculus
tgtaagccagagagtttgcctcatt

SEQ ID NO: 488053 - DNA, 25 bp, Mus musculus
tgtaagccagccagttgaacgtttg

SEQ ID NO: 488054 - DNA, 25 bp, Mus musculus
tgtaagcccacacctgaatgaaggg

SEQ ID NO: 488055 - DNA, 25 bp, Mus musculus
tgtaagcccagtactcccgaagctg

SEQ ID NO: 488056 - DNA, 25 bp, Mus musculus
tgtaagccgctggacctcaaaggcc

SEQ ID NO: 488057 - DNA, 25 bp, Mus musculus
tgtaagcctcaagggagcacagaca

SEQ ID NO: 488058 - DNA, 25 bp, Mus musculus
tgtaagcgctgcttgggcaaggaaa

SEQ ID NO: 488059 - DNA, 25 bp, Mus musculus
tgtaaggaactaacacagactgtgt

SEQ ID NO: 488060 - DNA, 25 bp, Mus musculus
tgtaaggacaagactcacagctgcc

SEQ ID NO: 488061 - DNA, 25 bp, Mus musculus
tgtaaggcaacccagcatgatctag

SEQ ID NO: 488062 - DNA, 25 bp, Mus musculus
tgtaaggcacaaggcagatggcacc

SEQ ID NO: 488063 - DNA, 25 bp, Mus musculus
tgtaaggcatcagggtagacaaggc

SEQ ID NO: 488064 - DNA, 25 bp, Mus musculus
tgtaaggcctacgaggagatcgctg

SEQ ID NO: 488065 - DNA, 25 bp, Mus musculus
tgtaaggtccatgctagcaccaagt

SEQ ID NO: 488066 - DNA, 25 bp, Mus musculus
tgtaaggtcctcctgttggctccct

SEQ ID NO: 488067 - DNA, 25 bp, Mus musculus
tgtaagtaactcagaaccacccatg

SEQ ID NO: 488068 - DNA, 25 bp, Mus musculus
tgtaagtatactggcaacataaaac

SEQ ID NO: 488069 - DNA, 25 bp, Mus musculus
tgtaagtcactccatgcaggtcaga

SEQ ID NO: 488070 - DNA, 25 bp, Mus musculus
tgtaagttaaatgagcaacagtctc

SEQ ID NO: 488071 - DNA, 25 bp, Mus musculus
tgtaagttggagaaacacacacctg

SEQ ID NO: 488072 - DNA, 25 bp, Mus musculus
tgtaatactcacttcccaagctggg

SEQ ID NO: 488073 - DNA, 25 bp, Mus musculus
tgtaatactgaataagtcacagaga

SEQ ID NO: 488074 - DNA, 25 bp, Mus musculus
tgtaatagcacaggtctgtaatccc

SEQ ID NO: 488075 - DNA, 25 bp, Mus musculus
tgtaatagcctaaacatgactcatt

SEQ ID NO: 488076 - DNA, 25 bp, Mus musculus
tgtaatagtaacaagcagacccagc

SEQ ID NO: 488077 - DNA, 25 bp, Mus musculus
tgtaatcagcacacgatagtcctct

SEQ ID NO: 488078 - DNA, 25 bp, Mus musculus
tgtaatcagcatgagcagatggccc

SEQ ID NO: 488079 - DNA, 25 bp, Mus musculus
tgtaatcatgcatccaactgggctg

SEQ ID NO: 488080 - DNA, 25 bp, Mus musculus
tgtaatcatggctcagttagctctc

SEQ ID NO: 488081 - DNA, 25 bp, Mus musculus
tgtaatccatactacagcctgttga

SEQ ID NO: 488082 - DNA, 25 bp, Mus musculus
tgtaatccctcttgtaggcccaggc

SEQ ID NO: 488083 - DNA, 25 bp, Mus musculus
tgtaatcgacgccagacactgaaga

SEQ ID NO: 488084 - DNA, 25 bp, Mus musculus
tgtaatcgccgagtgcaagacgcgc

SEQ ID NO: 488085 - DNA, 25 bp, Mus musculus
tgtaatctaactttgtcactgtgac

SEQ ID NO: 488086 - DNA, 25 bp, Mus musculus
tgtaatctgggactccagaccagta

SEQ ID NO: 488087 - DNA, 25 bp, Mus musculus
tgtaatgaagcagaacccaatggcc

SEQ ID NO: 488088 - DNA, 25 bp, Mus musculus
tgtaatgacccggaagctcggcagg

SEQ ID NO: 488089 - DNA, 25 bp, Mus musculus
tgtaatgagaacgaggcagaccact

SEQ ID NO: 488090 - DNA, 25 bp, Mus musculus
tgtaatgagagcagtatccggaacc

SEQ ID NO: 488091 - DNA, 25 bp, Mus musculus
tgtaatgccccatgaaactgtcctg

SEQ ID NO: 488092 - DNA, 25 bp, Mus musculus
tgtaatgctttactgcggccacgaa

SEQ ID NO: 488093 - DNA, 25 bp, Mus musculus
tgtaatgggacagagcagctggcaa

SEQ ID NO: 488094 - DNA, 25 bp, Mus musculus
tgtaatggtccacctgcagcaggag

SEQ ID NO: 488095 - DNA, 25 bp, Mus musculus
tgtaattacgttcagtcgcagcagg

SEQ ID NO: 488096 - DNA, 25 bp, Mus musculus
tgtaattcagacttccaccgagcag

SEQ ID NO: 488097 - DNA, 25 bp, Mus musculus
tgtaattcgaatggagcagcgctct

SEQ ID NO: 488098 - DNA, 25 bp, Mus musculus
tgtaattcgcatcactctagagacc

SEQ ID NO: 488099 - DNA, 25 bp, Mus musculus
tgtaattcttgtgcccatagggctg

SEQ ID NO: 488100 - DNA, 25 bp, Mus musculus
tgtaattgaccgctgggagctcctg

SEQ ID NO: 488101 - DNA, 25 bp, Mus musculus
tgtaattgcagaatgccccgtggtc

SEQ ID NO: 488102 - DNA, 25 bp, Mus musculus
tgtaattgccaaacgcagccactgc

SEQ ID NO: 488103 - DNA, 25 bp, Mus musculus
tgtaattggtggtaagaggctccca

SEQ ID NO: 488104 - DNA, 25 bp, Mus musculus
tgtaatttaccagctaggccagcaa

SEQ ID NO: 488105 - DNA, 25 bp, Mus musculus
tgtaatttagtagaaaatgggccag

SEQ ID NO: 488106 - DNA, 25 bp, Mus musculus
tgtaatttccctaaagcctcgcagt

SEQ ID NO: 488107 - DNA, 25 bp, Mus musculus
tgtaatttttctcacgccccgctga

SEQ ID NO: 488108 - DNA, 25 bp, Mus musculus
tgtacaaacactcggactcggagag

SEQ ID NO: 488109 - DNA, 25 bp, Mus musculus
tgtacaaagacaatccgctgccagt

SEQ ID NO: 488110 - DNA, 25 bp, Mus musculus
tgtacaaattgcaaaactggcacgt

SEQ ID NO: 488111 - DNA, 25 bp, Mus musculus
tgtacaacacctataaatcgaggaa

SEQ ID NO: 488112 - DNA, 25 bp, Mus musculus
tgtacaacaggatgaagagcagtga

SEQ ID NO: 488113 - DNA, 25 bp, Mus musculus
tgtacaacgatccaaacagcaaccc

SEQ ID NO: 488114 - DNA, 25 bp, Mus musculus
tgtacaacgcccatgacattgggac

SEQ ID NO: 488115 - DNA, 25 bp, Mus musculus
tgtacaacggcttggctccaaaacg

SEQ ID NO: 488116 - DNA, 25 bp, Mus musculus
tgtacaacgggctgcagggctatta

SEQ ID NO: 488117 - DNA, 25 bp, Mus musculus
tgtacaacggtggtggctcacccag

SEQ ID NO: 488118 - DNA, 25 bp, Mus musculus
tgtacaacgtcagtacaggccgggc

SEQ ID NO: 488119 - DNA, 25 bp, Mus musculus
tgtacaacgtcatcagcctcgagtt

SEQ ID NO: 488120 - DNA, 25 bp, Mus musculus
tgtacaagacagacaataatgcggg

SEQ ID NO: 488121 - DNA, 25 bp, Mus musculus
tgtacaagagccgtcagaaggagca

SEQ ID NO: 488122 - DNA, 25 bp, Mus musculus
tgtacaagcagtggcaaaggcctcc

SEQ ID NO: 488123 - DNA, 25 bp, Mus musculus
tgtacaagccaattgaccgagtcac

SEQ ID NO: 488124 - DNA, 25 bp, Mus musculus
tgtacaaggagaaccaagcaacgac

SEQ ID NO: 488125 - DNA, 25 bp, Mus musculus
tgtacaagggcgtgaacagcgacgt

SEQ ID NO: 488126 - DNA, 25 bp, Mus musculus
tgtacaagtacggagaggccgctct

SEQ ID NO: 488127 - DNA, 25 bp, Mus musculus
tgtacaagtcaccaagccagaagga

SEQ ID NO: 488128 - DNA, 25 bp, Mus musculus
tgtacaatcgaaatccaggcagcgt

SEQ ID NO: 488129 - DNA, 25 bp, Mus musculus
tgtacaatgccactaaggaggcccg

SEQ ID NO: 488130 - DNA, 25 bp, Mus musculus
tgtacaatgtcacaaagcagatgcg

SEQ ID NO: 488131 - DNA, 25 bp, Mus musculus
tgtacaattagctaccaacctctgc

SEQ ID NO: 488132 - DNA, 25 bp, Mus musculus
tgtacaatttccagtgcagtgcagc

SEQ ID NO: 488133 - DNA, 25 bp, Mus musculus
tgtacacacactgatggcactgctg

SEQ ID NO: 488134 - DNA, 25 bp, Mus musculus
tgtacacactcagccagcaggtagg

SEQ ID NO: 488135 - DNA, 25 bp, Mus musculus
tgtacacagccttcagagcactggg

SEQ ID NO: 488136 - DNA, 25 bp, Mus musculus
tgtacacaggagtagaacgcagcac

SEQ ID NO: 488137 - DNA, 25 bp, Mus musculus
tgtacacaggctcagaaaggaaaga

SEQ ID NO: 488138 - DNA, 25 bp, Mus musculus
tgtacacagtgctaaaaccccagag

SEQ ID NO: 488139 - DNA, 25 bp, Mus musculus
tgtacaccagccaggttctcattac

SEQ ID NO: 488140 - DNA, 25 bp, Mus musculus
tgtacaccagtatgagatggagcca

SEQ ID NO: 488141 - DNA, 25 bp, Mus musculus
tgtacaccatcaaggcactagaggc

SEQ ID NO: 488142 - DNA, 25 bp, Mus musculus
tgtacaccattagtagccaactaga

SEQ ID NO: 488143 - DNA, 25 bp, Mus musculus
tgtacacccttcaaatttagatcct

SEQ ID NO: 488144 - DNA, 25 bp, Mus musculus
tgtacaccgggaagcaagcgtggct

SEQ ID NO: 488145 - DNA, 25 bp, Mus musculus
tgtacactaagctgaagagactcga

SEQ ID NO: 488146 - DNA, 25 bp, Mus musculus
tgtacactcggagcgacctttggct

SEQ ID NO: 488147 - DNA, 25 bp, Mus musculus
tgtacactcgggtcagcaagttcag

SEQ ID NO: 488148 - DNA, 25 bp, Mus musculus
tgtacactgaaatccacggtttggg

SEQ ID NO: 488149 - DNA, 25 bp, Mus musculus
tgtacactgtcactcactggatggt

SEQ ID NO: 488150 - DNA, 25 bp, Mus musculus
tgtacactttgaacggagggcagat

SEQ ID NO: 488151 - DNA, 25 bp, Mus musculus
tgtacactttgccagagagcagaga

SEQ ID NO: 488152 - DNA, 25 bp, Mus musculus
tgtacagacctgtgcagtgggccct

SEQ ID NO: 488153 - DNA, 25 bp, Mus musculus
tgtacagagtctactcagaccaaca

SEQ ID NO: 488154 - DNA, 25 bp, Mus musculus
tgtacagatgaagtccagggagaaa

SEQ ID NO: 488155 - DNA, 25 bp, Mus musculus
tgtacagcagggattgggaccttca

SEQ ID NO: 488156 - DNA, 25 bp, Mus musculus
tgtacagcatggacctgcggagctc

SEQ ID NO: 488157 - DNA, 25 bp, Mus musculus
tgtacagccatcttcatcgtgtggg

SEQ ID NO: 488158 - DNA, 25 bp, Mus musculus
tgtacagccccatggatatgaccag

SEQ ID NO: 488159 - DNA, 25 bp, Mus musculus
tgtacagcgacagcacagagatggt

SEQ ID NO: 488160 - DNA, 25 bp, Mus musculus
tgtacagcggacacgccgtccacat

SEQ ID NO: 488161 - DNA, 25 bp, Mus musculus
tgtacaggaaccgaatgcagctgcc

SEQ ID NO: 488162 - DNA, 25 bp, Mus musculus
tgtacaggccatggttgagcacgga

SEQ ID NO: 488163 - DNA, 25 bp, Mus musculus
tgtacagggaactccgctcacctgt

SEQ ID NO: 488164 - DNA, 25 bp, Mus musculus
tgtacagtcagaaagccacgcctgg

SEQ ID NO: 488165 - DNA, 25 bp, Mus musculus
tgtacagtcctcaagaaagctcagc

SEQ ID NO: 488166 - DNA, 25 bp, Mus musculus
tgtacagtgctctcggcctgaggga

SEQ ID NO: 488167 - DNA, 25 bp, Mus musculus
tgtacagtggcattacagcgcctga

SEQ ID NO: 488168 - DNA, 25 bp, Mus musculus
tgtacagtggtcatcaagggcgcac

SEQ ID NO: 488169 - DNA, 25 bp, Mus musculus
tgtacagtgtcccagccaatacggg

SEQ ID NO: 488170 - DNA, 25 bp, Mus musculus
tgtacagttatggagaccccaaaga

SEQ ID NO: 488171 - DNA, 25 bp, Mus musculus
tgtacagttgggaaaacgtgcccct

SEQ ID NO: 488172 - DNA, 25 bp, Mus musculus
tgtacatacatgatgacgagcagag

SEQ ID NO: 488173 - DNA, 25 bp, Mus musculus
tgtacatacccacactggactggtg

SEQ ID NO: 488174 - DNA, 25 bp, Mus musculus
tgtacatcacgctcatccgggaaga

SEQ ID NO: 488175 - DNA, 25 bp, Mus musculus
tgtacatcagtatagcaaagtgcct

SEQ ID NO: 488176 - DNA, 25 bp, Mus musculus
tgtacatcatcagctcagagtcctg

SEQ ID NO: 488177 - DNA, 25 bp, Mus musculus
tgtacatccagacacagctcttggg

SEQ ID NO: 488178 - DNA, 25 bp, Mus musculus
tgtacatcctgtcctcgtcgcaggg

SEQ ID NO: 488179 - DNA, 25 bp, Mus musculus
tgtacatcgggacttagctgccagg

SEQ ID NO: 488180 - DNA, 25 bp, Mus musculus
tgtacatcgtggctgtcataggcaa

SEQ ID NO: 488181 - DNA, 25 bp, Mus musculus
tgtacatgccatctgccgctggaga

SEQ ID NO: 488182 - DNA, 25 bp, Mus musculus
tgtacatgctggtgggaactctggc

SEQ ID NO: 488183 - DNA, 25 bp, Mus musculus
tgtacatggaaagcaaggcacaagc

SEQ ID NO: 488184 - DNA, 25 bp, Mus musculus
tgtacatggtccgaatggccgcgta

SEQ ID NO: 488185 - DNA, 25 bp, Mus musculus
tgtacattccaaggctgagcagccg

SEQ ID NO: 488186 - DNA, 25 bp, Mus musculus
tgtacattccacgagcattgccttc

SEQ ID NO: 488187 - DNA, 25 bp, Mus musculus
tgtaccaaacactcacggaaaaagc

SEQ ID NO: 488188 - DNA, 25 bp, Mus musculus
tgtaccaacccagtgcagagagctt

SEQ ID NO: 488189 - DNA, 25 bp, Mus musculus
tgtaccaacgtttcagcacagcctg

SEQ ID NO: 488190 - DNA, 25 bp, Mus musculus
tgtaccaacttcgtatgcggcaccg

SEQ ID NO: 488191 - DNA, 25 bp, Mus musculus
tgtaccaaggagagggtgcctcccg

SEQ ID NO: 488192 - DNA, 25 bp, Mus musculus
tgtaccacaagagacaagcgagtcg

SEQ ID NO: 488193 - DNA, 25 bp, Mus musculus
tgtaccacaccgtgctacagggagg

SEQ ID NO: 488194 - DNA, 25 bp, Mus musculus
tgtaccacatgtatttatgtaagga

SEQ ID NO: 488195 - DNA, 25 bp, Mus musculus
tgtaccactgacatagcgcagcggg

SEQ ID NO: 488196 - DNA, 25 bp, Mus musculus
tgtaccactttgcagagaaagccaa

SEQ ID NO: 488197 - DNA, 25 bp, Mus musculus
tgtaccagaccagacaagaggcagc

SEQ ID NO: 488198 - DNA, 25 bp, Mus musculus
tgtaccagacgtccaggtcagctac

SEQ ID NO: 488199 - DNA, 25 bp, Mus musculus
tgtaccagctcagcgagttctcagc

SEQ ID NO: 488200 - DNA, 25 bp, Mus musculus
tgtaccaggactactagccaggcca

SEQ ID NO: 488201 - DNA, 25 bp, Mus musculus
tgtaccaggagagtctcggactgag

SEQ ID NO: 488202 - DNA, 25 bp, Mus musculus
tgtaccaggcaacagctccagttct

SEQ ID NO: 488203 - DNA, 25 bp, Mus musculus
tgtaccaggtcctgcagagcgacga

SEQ ID NO: 488204 - DNA, 25 bp, Mus musculus
tgtaccatatctacacggccctgga

SEQ ID NO: 488205 - DNA, 25 bp, Mus musculus
tgtaccatattagtcataagcccgg

SEQ ID NO: 488206 - DNA, 25 bp, Mus musculus
tgtaccatgacactctgcaaccaag

SEQ ID NO: 488207 - DNA, 25 bp, Mus musculus
tgtaccattcattccctgggagagg

SEQ ID NO: 488208 - DNA, 25 bp, Mus musculus
tgtacccaaaaagtaaagccagaag

SEQ ID NO: 488209 - DNA, 25 bp, Mus musculus
tgtacccactttagagcagaaactg

SEQ ID NO: 488210 - DNA, 25 bp, Mus musculus
tgtacccagagagtgccaagaacct

SEQ ID NO: 488211 - DNA, 25 bp, Mus musculus
tgtacccagcaccatgctaagtgct

SEQ ID NO: 488212 - DNA, 25 bp, Mus musculus
tgtacccatcacgagagctatgagg

SEQ ID NO: 488213 - DNA, 25 bp, Mus musculus
tgtacccatggaatctagccacttg

SEQ ID NO: 488214 - DNA, 25 bp, Mus musculus
tgtacccattagtgtgaactcaact

SEQ ID NO: 488215 - DNA, 25 bp, Mus musculus
tgtaccccaagcctttcttcaagac

SEQ ID NO: 488216 - DNA, 25 bp, Mus musculus
tgtacccctaggaaaggacgtctgc

SEQ ID NO: 488217 - DNA, 25 bp, Mus musculus
tgtacccgaggacgaacagatcagc

SEQ ID NO: 488218 - DNA, 25 bp, Mus musculus
tgtacccgggctactcgtacggcaa

SEQ ID NO: 488219 - DNA, 25 bp, Mus musculus
tgtaccctacagtgatcctccaagt

SEQ ID NO: 488220 - DNA, 25 bp, Mus musculus
tgtaccctagcaataaggctccggg

SEQ ID NO: 488221 - DNA, 25 bp, Mus musculus
tgtaccctcagtgcagatatatgga

SEQ ID NO: 488222 - DNA, 25 bp, Mus musculus
tgtaccgagatatcacaaagccctg

SEQ ID NO: 488223 - DNA, 25 bp, Mus musculus
tgtaccgagtttgtgaaccagccct

SEQ ID NO: 488224 - DNA, 25 bp, Mus musculus
tgtaccggagggatcttcatggctg

SEQ ID NO: 488225 - DNA, 25 bp, Mus musculus
tgtaccggcatcgactggtctatct

SEQ ID NO: 488226 - DNA, 25 bp, Mus musculus
tgtaccgggctgtggttgcaccagt

SEQ ID NO: 488227 - DNA, 25 bp, Mus musculus
tgtaccgggtagaactggagcagac

SEQ ID NO: 488228 - DNA, 25 bp, Mus musculus
tgtacctatacgcagccatcgcaga

SEQ ID NO: 488229 - DNA, 25 bp, Mus musculus
tgtacctcaagtgatcaaactggct

SEQ ID NO: 488230 - DNA, 25 bp, Mus musculus
tgtacctcaggtgatcgaactggcc

SEQ ID NO: 488231 - DNA, 25 bp, Mus musculus
tgtacctcagtgtcaagcctgcagg

SEQ ID NO: 488232 - DNA, 25 bp, Mus musculus
tgtacctcccaagagaaagccactg

SEQ ID NO: 488233 - DNA, 25 bp, Mus musculus
tgtacctgaatctgtgctgccttgg

SEQ ID NO: 488234 - DNA, 25 bp, Mus musculus
tgtacctgagaaatggaggcccctg

SEQ ID NO: 488235 - DNA, 25 bp, Mus musculus
tgtacctgaggatgtcaagcctgct

SEQ ID NO: 488236 - DNA, 25 bp, Mus musculus
tgtacctgcttggacagaaggccgt

SEQ ID NO: 488237 - DNA, 25 bp, Mus musculus
tgtacctggcaagagaacccattgc

SEQ ID NO: 488238 - DNA, 25 bp, Mus musculus
tgtacctgtcgccagcaccaatgtg

SEQ ID NO: 488239 - DNA, 25 bp, Mus musculus
tgtaccttaggtgaaatgtttgctg

SEQ ID NO: 488240 - DNA, 25 bp, Mus musculus
tgtaccttggccagaataacttcgc

SEQ ID NO: 488241 - DNA, 25 bp, Mus musculus
tgtacgaaaccacggaagactgtcc

SEQ ID NO: 488242 - DNA, 25 bp, Mus musculus
tgtacgaagctgtcaaacaataata

SEQ ID NO: 488243 - DNA, 25 bp, Mus musculus
tgtacgacgtcgaggtggagttccc

SEQ ID NO: 488244 - DNA, 25 bp, Mus musculus
tgtacgagcaccagaacaacttggc

SEQ ID NO: 488245 - DNA, 25 bp, Mus musculus
tgtacgagctcgagcgacgtttcaa

SEQ ID NO: 488246 - DNA, 25 bp, Mus musculus
tgtacgaggtcatatttctgagtgg

SEQ ID NO: 488247 - DNA, 25 bp, Mus musculus
tgtacgagtgcgagaaacacccgag

SEQ ID NO: 488248 - DNA, 25 bp, Mus musculus
tgtacgatattaaccgaaagccctg

SEQ ID NO: 488249 - DNA, 25 bp, Mus musculus
tgtacgatgtcagaagacgaccctg

SEQ ID NO: 488250 - DNA, 25 bp, Mus musculus
tgtacgatttgccttcagcttcctc

SEQ ID NO: 488251 - DNA, 25 bp, Mus musculus
tgtacgcagcaccttacaagtccga

SEQ ID NO: 488252 - DNA, 25 bp, Mus musculus
tgtacgccaagcatagactacctgt

SEQ ID NO: 488253 - DNA, 25 bp, Mus musculus
tgtacgccataagcttgtctccctg

SEQ ID NO: 488254 - DNA, 25 bp, Mus musculus
tgtacgctaataaaatggccttccg

SEQ ID NO: 488255 - DNA, 25 bp, Mus musculus
tgtacggctctttcctgatccagat

SEQ ID NO: 488256 - DNA, 25 bp, Mus musculus
tgtacggctgtctgctaaaggtgcg

SEQ ID NO: 488257 - DNA, 25 bp, Mus musculus
tgtacgtagcctgtagctcctgcta

SEQ ID NO: 488258 - DNA, 25 bp, Mus musculus
tgtacgtcgtggtgagcggcaacct

SEQ ID NO: 488259 - DNA, 25 bp, Mus musculus
tgtacgtgatcgtgggcaagcgctt

SEQ ID NO: 488260 - DNA, 25 bp, Mus musculus
tgtacgtgattacacaagcaagcct

SEQ ID NO: 488261 - DNA, 25 bp, Mus musculus
tgtacgtgcccaccgtgttcgagaa

SEQ ID NO: 488262 - DNA, 25 bp, Mus musculus
tgtacgtgtactctgctctacagcg

SEQ ID NO: 488263 - DNA, 25 bp, Mus musculus
tgtacgtgtcttacaacaagaagga

SEQ ID NO: 488264 - DNA, 25 bp, Mus musculus
tgtactacatgactgccttgccgga

SEQ ID NO: 488265 - DNA, 25 bp, Mus musculus
tgtactacctgaccccacaatggga

SEQ ID NO: 488266 - DNA, 25 bp, Mus musculus
tgtactacttgagttcctaacctgg

SEQ ID NO: 488267 - DNA, 25 bp, Mus musculus
tgtactagagatcataagcccagcc

SEQ ID NO: 488268 - DNA, 25 bp, Mus musculus
tgtactagctcactgccgatggcct

SEQ ID NO: 488269 - DNA, 25 bp, Mus musculus
tgtactagtaggcacacaggcactg

SEQ ID NO: 488270 - DNA, 25 bp, Mus musculus
tgtactatgtaatcagcgccctggg

SEQ ID NO: 488271 - DNA, 25 bp, Mus musculus
tgtactcaacaccaaagcagtccgt

SEQ ID NO: 488272 - DNA, 25 bp, Mus musculus
tgtactcaagccactgtgcgccatg

SEQ ID NO: 488273 - DNA, 25 bp, Mus musculus
tgtactcaggagcacgtcaatccgc

SEQ ID NO: 488274 - DNA, 25 bp, Mus musculus
tgtactcatctctacgtagggaccg

SEQ ID NO: 488275 - DNA, 25 bp, Mus musculus
tgtactccaagggagaagctcgccc

SEQ ID NO: 488276 - DNA, 25 bp, Mus musculus
tgtactccaccttgaaggataagga

SEQ ID NO: 488277 - DNA, 25 bp, Mus musculus
tgtactccatggagacagagacgcc

SEQ ID NO: 488278 - DNA, 25 bp, Mus musculus
tgtactccattcctatgacctcagg

SEQ ID NO: 488279 - DNA, 25 bp, Mus musculus
tgtactccggtgtcaggcacaaggc

SEQ ID NO: 488280 - DNA, 25 bp, Mus musculus
tgtactccgtgccaaataaggtgga

SEQ ID NO: 488281 - DNA, 25 bp, Mus musculus
tgtactcctcttctaaaccagctgg

SEQ ID NO: 488282 - DNA, 25 bp, Mus musculus
tgtactcggctgctatggtcacggc

SEQ ID NO: 488283 - DNA, 25 bp, Mus musculus
tgtactcgtactggcctgggtggct

SEQ ID NO: 488284 - DNA, 25 bp, Mus musculus
tgtactcgtcgctcagcttgtccac

SEQ ID NO: 488285 - DNA, 25 bp, Mus musculus
tgtactctgttgactgggatggacc

SEQ ID NO: 488286 - DNA, 25 bp, Mus musculus
tgtactcttcagaagcgcagcagag

SEQ ID NO: 488287 - DNA, 25 bp, Mus musculus
tgtactgaatctatgggtccgaatc

SEQ ID NO: 488288 - DNA, 25 bp, Mus musculus
tgtactgctgaagagcgacctcacc

SEQ ID NO: 488289 - DNA, 25 bp, Mus musculus
tgtactgggagaaaaggcaattcac

SEQ ID NO: 488290 - DNA, 25 bp, Mus musculus
tgtactgtaaacaactacttctggg

SEQ ID NO: 488291 - DNA, 25 bp, Mus musculus
tgtactgtactcacttgatagctgt

SEQ ID NO: 488292 - DNA, 25 bp, Mus musculus
tgtactgtgatgtgaggcttcgccg

SEQ ID NO: 488293 - DNA, 25 bp, Mus musculus
tgtactgtgctttgggtcttgtccc

SEQ ID NO: 488294 - DNA, 25 bp, Mus musculus
tgtactgttacctgtgattgtcacc

SEQ ID NO: 488295 - DNA, 25 bp, Mus musculus
tgtacttactacgtctcgggtccag

SEQ ID NO: 488296 - DNA, 25 bp, Mus musculus
tgtacttagaagtgtggcccctcct

SEQ ID NO: 488297 - DNA, 25 bp, Mus musculus
tgtacttcccagcttctcgaggtag

SEQ ID NO: 488298 - DNA, 25 bp, Mus musculus
tgtacttccggctccatgcgtccat

SEQ ID NO: 488299 - DNA, 25 bp, Mus musculus
tgtacttcgtggagcacagcaggga

SEQ ID NO: 488300 - DNA, 25 bp, Mus musculus
tgtacttcgtggtcaggaccgtcag

SEQ ID NO: 488301 - DNA, 25 bp, Mus musculus
tgtacttgacatcatccgagcagcg

SEQ ID NO: 488302 - DNA, 25 bp, Mus musculus
tgtacttgatgtttaagaggcaact

SEQ ID NO: 488303 - DNA, 25 bp, Mus musculus
tgtacttgccatgtaagaaaacgtg

SEQ ID NO: 488304 - DNA, 25 bp, Mus musculus
tgtacttgggatagtgtcaggagca

SEQ ID NO: 488305 - DNA, 25 bp, Mus musculus
tgtagaaactccataggcaaccggt

SEQ ID NO: 488306 - DNA, 25 bp, Mus musculus
tgtagaaagagcttgctttgtcccg

SEQ ID NO: 488307 - DNA, 25 bp, Mus musculus
tgtagaaccatgactccaaccaagc

SEQ ID NO: 488308 - DNA, 25 bp, Mus musculus
tgtagaacccgctctaactcagagg

SEQ ID NO: 488309 - DNA, 25 bp, Mus musculus
tgtagaaccttccaaagatggccct

SEQ ID NO: 488310 - DNA, 25 bp, Mus musculus
tgtagaactctacctggactgcgct

SEQ ID NO: 488311 - DNA, 25 bp, Mus musculus
tgtagaagaagatttggagctccca

SEQ ID NO: 488312 - DNA, 25 bp, Mus musculus
tgtagaagacgctcctttggtgcca

SEQ ID NO: 488313 - DNA, 25 bp, Mus musculus
tgtagaagccacatccggaagtagt

SEQ ID NO: 488314 - DNA, 25 bp, Mus musculus
tgtagaagcctctctctgctgggtg

SEQ ID NO: 488315 - DNA, 25 bp, Mus musculus
tgtagaaggccacaccaagagactg

SEQ ID NO: 488316 - DNA, 25 bp, Mus musculus
tgtagaaggtctcactcagctgaag

SEQ ID NO: 488317 - DNA, 25 bp, Mus musculus
tgtagaatcttcttctcttagcctg

SEQ ID NO: 488318 - DNA, 25 bp, Mus musculus
tgtagacacagagccttactaggta

SEQ ID NO: 488319 - DNA, 25 bp, Mus musculus
tgtagacaccgagcctctcactgaa

SEQ ID NO: 488320 - DNA, 25 bp, Mus musculus
tgtagacacgactggcatcagactg

SEQ ID NO: 488321 - DNA, 25 bp, Mus musculus
tgtagacagcgacgacaacatggat

SEQ ID NO: 488322 - DNA, 25 bp, Mus musculus
tgtagacaggacacatcaggattta

SEQ ID NO: 488323 - DNA, 25 bp, Mus musculus
tgtagacaggtctcactgtaggctg

SEQ ID NO: 488324 - DNA, 25 bp, Mus musculus
tgtagacatggcgaaagtaaaaaac

SEQ ID NO: 488325 - DNA, 25 bp, Mus musculus
tgtagacattgtcaccatgtaacgg

SEQ ID NO: 488326 - DNA, 25 bp, Mus musculus
tgtagaccacgtcagccaagtagag

SEQ ID NO: 488327 - DNA, 25 bp, Mus musculus
tgtagacgtccctgaagaggccgat

SEQ ID NO: 488328 - DNA, 25 bp, Mus musculus
tgtagactgcccatcctcggaatgt

SEQ ID NO: 488329 - DNA, 25 bp, Mus musculus
tgtagactgtaaccctgccaagggc

SEQ ID NO: 488330 - DNA, 25 bp, Mus musculus
tgtagactgtccaagggctctgcca

SEQ ID NO: 488331 - DNA, 25 bp, Mus musculus
tgtagacttaaaggcagaaccccgt

SEQ ID NO: 488332 - DNA, 25 bp, Mus musculus
tgtagacttgactctgagcaccaga

SEQ ID NO: 488333 - DNA, 25 bp, Mus musculus
tgtagagaaaggagcaaagcgccca

SEQ ID NO: 488334 - DNA, 25 bp, Mus musculus
tgtagagaatgcaacgcctgcctga

SEQ ID NO: 488335 - DNA, 25 bp, Mus musculus
tgtagagaccaggaccacagtgaag

SEQ ID NO: 488336 - DNA, 25 bp, Mus musculus
tgtagagcagagtttaccgggttcc

SEQ ID NO: 488337 - DNA, 25 bp, Mus musculus
tgtagagcccaacacgaacttcact

SEQ ID NO: 488338 - DNA, 25 bp, Mus musculus
tgtagagcgcatcgatgaacctggc

SEQ ID NO: 488339 - DNA, 25 bp, Mus musculus
tgtagagggttcagccgtgtgcacc

SEQ ID NO: 488340 - DNA, 25 bp, Mus musculus
tgtagaggtccgactcctgcagaga

SEQ ID NO: 488341 - DNA, 25 bp, Mus musculus
tgtagagtattttgagggccagacc

SEQ ID NO: 488342 - DNA, 25 bp, Mus musculus
tgtagagtcaagactgagacctggg

SEQ ID NO: 488343 - DNA, 25 bp, Mus musculus
tgtagagtccaaacgccggcgatat

SEQ ID NO: 488344 - DNA, 25 bp, Mus musculus
tgtagagtggacacccaagtacgcc

SEQ ID NO: 488345 - DNA, 25 bp, Mus musculus
tgtagatcatgagtcagtgccacga

SEQ ID NO: 488346 - DNA, 25 bp, Mus musculus
tgtagatccacgtcttctactagag

SEQ ID NO: 488347 - DNA, 25 bp, Mus musculus
tgtagatcccaaggacctggagcca

SEQ ID NO: 488348 - DNA, 25 bp, Mus musculus
tgtagatgatcttcctcccagtagg

SEQ ID NO: 488349 - DNA, 25 bp, Mus musculus
tgtagattcagccaccttcaggttg

SEQ ID NO: 488350 - DNA, 25 bp, Mus musculus
tgtagattggatttcaccccgggaa

SEQ ID NO: 488351 - DNA, 25 bp, Mus musculus
tgtagcaaaatatgtggcctctgtg

SEQ ID NO: 488352 - DNA, 25 bp, Mus musculus
tgtagcaaacattgaggaggcctcc

SEQ ID NO: 488353 - DNA, 25 bp, Mus musculus
tgtagcaaggtcagccagtcactgc

SEQ ID NO: 488354 - DNA, 25 bp, Mus musculus
tgtagcaaggtgttggtgcttccca

SEQ ID NO: 488355 - DNA, 25 bp, Mus musculus
tgtagcacaattcactagcccgagt

SEQ ID NO: 488356 - DNA, 25 bp, Mus musculus
tgtagcacagctttctcatcgatga

SEQ ID NO: 488357 - DNA, 25 bp, Mus musculus
tgtagcacagtaaagcgtcccgtgt

SEQ ID NO: 488358 - DNA, 25 bp, Mus musculus
tgtagcagaaccaaaagcagaggac

SEQ ID NO: 488359 - DNA, 25 bp, Mus musculus
tgtagcagaagggtagacaccagca

SEQ ID NO: 488360 - DNA, 25 bp, Mus musculus
tgtagcagactgatgcgcccatgtg

SEQ ID NO: 488361 - DNA, 25 bp, Mus musculus
tgtagcagactgtaggaagtgccgc

SEQ ID NO: 488362 - DNA, 25 bp, Mus musculus
tgtagcagcaaatgatcccaaacta

SEQ ID NO: 488363 - DNA, 25 bp, Mus musculus
tgtagcaggtaagaatgtcatcatc

SEQ ID NO: 488364 - DNA, 25 bp, Mus musculus
tgtagcagtgccacgctgggcctga

SEQ ID NO: 488365 - DNA, 25 bp, Mus musculus
tgtagcatgcatctctttgagagaa

SEQ ID NO: 488366 - DNA, 25 bp, Mus musculus
tgtagcattgacttcttaccaaggt

SEQ ID NO: 488367 - DNA, 25 bp, Mus musculus
tgtagccaaatagcctcaagtgacc

SEQ ID NO: 488368 - DNA, 25 bp, Mus musculus
tgtagccacatcatccagcaagagc

SEQ ID NO: 488369 - DNA, 25 bp, Mus musculus
tgtagccaccccagagtattcagac

SEQ ID NO: 488370 - DNA, 25 bp, Mus musculus
tgtagccagaagcacgtactcaggt

SEQ ID NO: 488371 - DNA, 25 bp, Mus musculus
tgtagcccatacaagtccctaatgt

SEQ ID NO: 488372 - DNA, 25 bp, Mus musculus
tgtagccccgaattcccaagtgtga

SEQ ID NO: 488373 - DNA, 25 bp, Mus musculus
tgtagcccgcgaagcggtcgttcag

SEQ ID NO: 488374 - DNA, 25 bp, Mus musculus
tgtagccctagctccctgggatctg

SEQ ID NO: 488375 - DNA, 25 bp, Mus musculus
tgtagccctcagaaccattagtgtt

SEQ ID NO: 488376 - DNA, 25 bp, Mus musculus
tgtagccctgacatctagtaattgt

SEQ ID NO: 488377 - DNA, 25 bp, Mus musculus
tgtagccgctttgagtgccaactgc

SEQ ID NO: 488378 - DNA, 25 bp, Mus musculus
tgtagccgtcggtggtcacagctgt

SEQ ID NO: 488379 - DNA, 25 bp, Mus musculus
tgtagcctacaacccctggatggat

SEQ ID NO: 488380 - DNA, 25 bp, Mus musculus
tgtagcctcggacagtcactagacc

SEQ ID NO: 488381 - DNA, 25 bp, Mus musculus
tgtagcctctcccaccaaaagaaat

SEQ ID NO: 488382 - DNA, 25 bp, Mus musculus
tgtagccttagaccgatgatcaccg

SEQ ID NO: 488383 - DNA, 25 bp, Mus musculus
tgtagcctttctttatctgacccac

SEQ ID NO: 488384 - DNA, 25 bp, Mus musculus
tgtagcctttgcaactacagctgca

SEQ ID NO: 488385 - DNA, 25 bp, Mus musculus
tgtagcgcctgcaatcctgaatgag

SEQ ID NO: 488386 - DNA, 25 bp, Mus musculus
tgtagcgcgcacaataacccagttc

SEQ ID NO: 488387 - DNA, 25 bp, Mus musculus
tgtagcgtcgccagcacagatgtgg

SEQ ID NO: 488388 - DNA, 25 bp, Mus musculus
tgtagcgtctgaacatcctgtgttg

SEQ ID NO: 488389 - DNA, 25 bp, Mus musculus
tgtagctacctccaaagagcgcacg

SEQ ID NO: 488390 - DNA, 25 bp, Mus musculus
tgtagctacctccatgttgcttctg

SEQ ID NO: 488391 - DNA, 25 bp, Mus musculus
tgtagctatcctcggacactgttgg

SEQ ID NO: 488392 - DNA, 25 bp, Mus musculus
tgtagctccggctgctgtggaattt

SEQ ID NO: 488393 - DNA, 25 bp, Mus musculus
tgtagctcctggcaaacgtttccgg

SEQ ID NO: 488394 - DNA, 25 bp, Mus musculus
tgtagctgaggcaaatgcggctgat

SEQ ID NO: 488395 - DNA, 25 bp, Mus musculus
tgtagctgcaatccacttgcagcag

SEQ ID NO: 488396 - DNA, 25 bp, Mus musculus
tgtagctggaatcagcaatttgcta

SEQ ID NO: 488397 - DNA, 25 bp, Mus musculus
tgtagctgtccagataaagacactg

SEQ ID NO: 488398 - DNA, 25 bp, Mus musculus
tgtagctgtccagtaacataatcgg

SEQ ID NO: 488399 - DNA, 25 bp, Mus musculus
tgtagcttccctcccatctgagcat

SEQ ID NO: 488400 - DNA, 25 bp, Mus musculus
tgtagcttgtgcaagctgcgtgtcc

SEQ ID NO: 488401 - DNA, 25 bp, Mus musculus
tgtagctttcgtggacgtttcccgc

SEQ ID NO: 488402 - DNA, 25 bp, Mus musculus
tgtagctttctctttaaagacaggg

SEQ ID NO: 488403 - DNA, 25 bp, Mus musculus
tgtaggaaacatggctaacgccacc

SEQ ID NO: 488404 - DNA, 25 bp, Mus musculus
tgtaggaaacctgacaactgactgg

SEQ ID NO: 488405 - DNA, 25 bp, Mus musculus
tgtaggaaccaacgctatagagctg

SEQ ID NO: 488406 - DNA, 25 bp, Mus musculus
tgtaggacagcacaacctcctggac

SEQ ID NO: 488407 - DNA, 25 bp, Mus musculus
tgtaggacatgagaggtgagacccc

SEQ ID NO: 488408 - DNA, 25 bp, Mus musculus
tgtaggaccctttgcacgaactctg

SEQ ID NO: 488409 - DNA, 25 bp, Mus musculus
tgtaggagagtacaggtccagctct

SEQ ID NO: 488410 - DNA, 25 bp, Mus musculus
tgtaggatacccgtgcagaaggtca

SEQ ID NO: 488411 - DNA, 25 bp, Mus musculus
tgtaggatcatggagatgacgcatc

SEQ ID NO: 488412 - DNA, 25 bp, Mus musculus
tgtaggatgagatctggcccctgct

SEQ ID NO: 488413 - DNA, 25 bp, Mus musculus
tgtaggatgggaataccaacctccg

SEQ ID NO: 488414 - DNA, 25 bp, Mus musculus
tgtaggcactgtccagctgcctcat

SEQ ID NO: 488415 - DNA, 25 bp, Mus musculus
tgtaggcatcgtgtttcctctctca

SEQ ID NO: 488416 - DNA, 25 bp, Mus musculus
tgtaggccacctcggcataggtaag

SEQ ID NO: 488417 - DNA, 25 bp, Mus musculus
tgtaggccagacctgcaagacagca

SEQ ID NO: 488418 - DNA, 25 bp, Mus musculus
tgtaggccagttaaaacacagggat

SEQ ID NO: 488419 - DNA, 25 bp, Mus musculus
tgtaggccatcgttgaaggaaatca

SEQ ID NO: 488420 - DNA, 25 bp, Mus musculus
tgtaggcccagaaccatctgtctcc

SEQ ID NO: 488421 - DNA, 25 bp, Mus musculus
tgtaggccctcaagaatgacgttcc

SEQ ID NO: 488422 - DNA, 25 bp, Mus musculus
tgtaggccggaaaagcatctatact

SEQ ID NO: 488423 - DNA, 25 bp, Mus musculus
tgtaggcctggaccaagacactgag

SEQ ID NO: 488424 - DNA, 25 bp, Mus musculus
tgtaggctccaagtttccagtccgg

SEQ ID NO: 488425 - DNA, 25 bp, Mus musculus
tgtaggctcctaagctgtgtggcct

SEQ ID NO: 488426 - DNA, 25 bp, Mus musculus
tgtaggctccttcaaacaaagaggc

SEQ ID NO: 488427 - DNA, 25 bp, Mus musculus
tgtaggctgccttttccgggcggat

SEQ ID NO: 488428 - DNA, 25 bp, Mus musculus
tgtagggaaattgagtcccgaggac

SEQ ID NO: 488429 - DNA, 25 bp, Mus musculus
tgtagggagcaaccactgtgtagcc

SEQ ID NO: 488430 - DNA, 25 bp, Mus musculus
tgtagggctccctgtgctcaaagag

SEQ ID NO: 488431 - DNA, 25 bp, Mus musculus
tgtagggcttccaaggtgcttcgca

SEQ ID NO: 488432 - DNA, 25 bp, Mus musculus
tgtaggtaacccaaatcagcattca

SEQ ID NO: 488433 - DNA, 25 bp, Mus musculus
tgtaggtacaactccagcaatccag

SEQ ID NO: 488434 - DNA, 25 bp, Mus musculus
tgtaggtagggaaaatgcacttccg

SEQ ID NO: 488435 - DNA, 25 bp, Mus musculus
tgtaggtatgtctgggtacagcacc

SEQ ID NO: 488436 - DNA, 25 bp, Mus musculus
tgtaggtcactagcactctaaagtt

SEQ ID NO: 488437 - DNA, 25 bp, Mus musculus
tgtaggtggccagaagtctctgcgc

SEQ ID NO: 488438 - DNA, 25 bp, Mus musculus
tgtaggttgcccagatcatgtccac

SEQ ID NO: 488439 - DNA, 25 bp, Mus musculus
tgtaggttgggactttatgcttccc

SEQ ID NO: 488440 - DNA, 25 bp, Mus musculus
tgtaggttttccctcatctgacgaa

SEQ ID NO: 488441 - DNA, 25 bp, Mus musculus
tgtagtagccattcctgatcatagg

SEQ ID NO: 488442 - DNA, 25 bp, Mus musculus
tgtagtcacacgagctggaatccag

SEQ ID NO: 488443 - DNA, 25 bp, Mus musculus
tgtagtcactgaggaaaccagacgt

SEQ ID NO: 488444 - DNA, 25 bp, Mus musculus
tgtagtccatgcaaggaccctgtgg

SEQ ID NO: 488445 - DNA, 25 bp, Mus musculus
tgtagtcccaaagctcatcacaagg

SEQ ID NO: 488446 - DNA, 25 bp, Mus musculus
tgtagtcccctattcttcatcaggc

SEQ ID NO: 488447 - DNA, 25 bp, Mus musculus
tgtagtccggaacagccaaggtgtc

SEQ ID NO: 488448 - DNA, 25 bp, Mus musculus
tgtagtcctttacacactgagaagg

SEQ ID NO: 488449 - DNA, 25 bp, Mus musculus
tgtagtcgcgttgctggaccagcct

SEQ ID NO: 488450 - DNA, 25 bp, Mus musculus
tgtagtctctacacttgtctcccat

SEQ ID NO: 488451 - DNA, 25 bp, Mus musculus
tgtagtctcttgcatgttggagtac

SEQ ID NO: 488452 - DNA, 25 bp, Mus musculus
tgtagtctgacactggagtccccaa

SEQ ID NO: 488453 - DNA, 25 bp, Mus musculus
tgtagtgaaacatgccttgcccctg

SEQ ID NO: 488454 - DNA, 25 bp, Mus musculus
tgtagtgatggcacctcagagctgg

SEQ ID NO: 488455 - DNA, 25 bp, Mus musculus
tgtagtgatgggagacagcagactt

SEQ ID NO: 488456 - DNA, 25 bp, Mus musculus
tgtagtgcctcctgtctctccgatt

SEQ ID NO: 488457 - DNA, 25 bp, Mus musculus
tgtagtggaccagatttgcacgtac

SEQ ID NO: 488458 - DNA, 25 bp, Mus musculus
tgtagtggccactgttaagtagcct

SEQ ID NO: 488459 - DNA, 25 bp, Mus musculus
tgtagtggtccctccaagctgtgcc

SEQ ID NO: 488460 - DNA, 25 bp, Mus musculus
tgtagtggtgctggataacccgtcg

SEQ ID NO: 488461 - DNA, 25 bp, Mus musculus
tgtagtgtccagcttcctgtactgt

SEQ ID NO: 488462 - DNA, 25 bp, Mus musculus
tgtagtgtcccaggatggtggcctc

SEQ ID NO: 488463 - DNA, 25 bp, Mus musculus
tgtagtgtcttagtgtcgtccagta

SEQ ID NO: 488464 - DNA, 25 bp, Mus musculus
tgtagtgtgtcacagccagcttgct

SEQ ID NO: 488465 - DNA, 25 bp, Mus musculus
tgtagtgttacacatactagaaaac

SEQ ID NO: 488466 - DNA, 25 bp, Mus musculus
tgtagttcttgtgcacaggtgccac

SEQ ID NO: 488467 - DNA, 25 bp, Mus musculus
tgtagttggtacagctgtattgggt

SEQ ID NO: 488468 - DNA, 25 bp, Mus musculus
tgtagttggtgttgcagaggactca

SEQ ID NO: 488469 - DNA, 25 bp, Mus musculus
tgtagttgtgtaagaaccgggcttc

SEQ ID NO: 488470 - DNA, 25 bp, Mus musculus
tgtagtttatcctcctcaggcaggc

SEQ ID NO: 488471 - DNA, 25 bp, Mus musculus
tgtagttttactgaagccatgcctg

SEQ ID NO: 488472 - DNA, 25 bp, Mus musculus
tgtagttttggagctctgtcgcagg

SEQ ID NO: 488473 - DNA, 25 bp, Mus musculus
tgtataaaataggagccagcgggac

SEQ ID NO: 488474 - DNA, 25 bp, Mus musculus
tgtataaagagagccgggaagcaca

SEQ ID NO: 488475 - DNA, 25 bp, Mus musculus
tgtataaccaccttcgaggcaccgg

SEQ ID NO: 488476 - DNA, 25 bp, Mus musculus
tgtataacgccacggcaaaggcagc

SEQ ID NO: 488477 - DNA, 25 bp, Mus musculus
tgtataaggtacacagcccagagct

SEQ ID NO: 488478 - DNA, 25 bp, Mus musculus
tgtataattcctttgttagccacgc

SEQ ID NO: 488479 - DNA, 25 bp, Mus musculus
tgtatacaggcgagatcagcaccac

SEQ ID NO: 488480 - DNA, 25 bp, Mus musculus
tgtatacagtaagttccgcccagtg

SEQ ID NO: 488481 - DNA, 25 bp, Mus musculus
tgtataccacaagatccagggcgat

SEQ ID NO: 488482 - DNA, 25 bp, Mus musculus
tgtataccagatgtgcccggcaatg

SEQ ID NO: 488483 - DNA, 25 bp, Mus musculus
tgtataccatattcacccacagtgg

SEQ ID NO: 488484 - DNA, 25 bp, Mus musculus
tgtataccctgaaagagcggtgcct

SEQ ID NO: 488485 - DNA, 25 bp, Mus musculus
tgtatactcagctgggcgtatccca

SEQ ID NO: 488486 - DNA, 25 bp, Mus musculus
tgtatactctcatcatgtcccagcg

SEQ ID NO: 488487 - DNA, 25 bp, Mus musculus
tgtatactgtatgcaaccctgttgg

SEQ ID NO: 488488 - DNA, 25 bp, Mus musculus
tgtatactgtcgaagggcagccagc

SEQ ID NO: 488489 - DNA, 25 bp, Mus musculus
tgtatacttgaatgactcactttgc

SEQ ID NO: 488490 - DNA, 25 bp, Mus musculus
tgtatagaataaaacacacacgtat

SEQ ID NO: 488491 - DNA, 25 bp, Mus musculus
tgtatagaatgtggccaaaagtccc

SEQ ID NO: 488492 - DNA, 25 bp, Mus musculus
tgtataggaacaaataaatctggcg

SEQ ID NO: 488493 - DNA, 25 bp, Mus musculus
tgtataggcacctacggcggagaga

SEQ ID NO: 488494 - DNA, 25 bp, Mus musculus
tgtatatacacctttctgttgggag

SEQ ID NO: 488495 - DNA, 25 bp, Mus musculus
tgtatatacactgatggaccactgg

SEQ ID NO: 488496 - DNA, 25 bp, Mus musculus
tgtatatctgagtctggtcttgaac

SEQ ID NO: 488497 - DNA, 25 bp, Mus musculus
tgtatatgagcagaccaacgtgacc

SEQ ID NO: 488498 - DNA, 25 bp, Mus musculus
tgtatatgcctagcacgggagcgct

SEQ ID NO: 488499 - DNA, 25 bp, Mus musculus
tgtatatgggcacatacgcaccttt

SEQ ID NO: 488500 - DNA, 25 bp, Mus musculus
tgtatatggtgttcctgcgcctggg

SEQ ID NO: 488501 - DNA, 25 bp, Mus musculus
tgtatatttgtcacacaggcccaag

SEQ ID NO: 488502 - DNA, 25 bp, Mus musculus
tgtatcaaaacgaggttcggccctg

SEQ ID NO: 488503 - DNA, 25 bp, Mus musculus
tgtatcaaccgtactccagggctgg

SEQ ID NO: 488504 - DNA, 25 bp, Mus musculus
tgtatcaacgtgactcttggtgggt

SEQ ID NO: 488505 - DNA, 25 bp, Mus musculus
tgtatcaaggatgaccgccatgccg

SEQ ID NO: 488506 - DNA, 25 bp, Mus musculus
tgtatcaccctcactcaagagcaga

SEQ ID NO: 488507 - DNA, 25 bp, Mus musculus
tgtatcacttgatgctgggctggag

SEQ ID NO: 488508 - DNA, 25 bp, Mus musculus
tgtatcagacagtgggtcaccatgc

SEQ ID NO: 488509 - DNA, 25 bp, Mus musculus
tgtatcagcaccaaagacctgcagc

SEQ ID NO: 488510 - DNA, 25 bp, Mus musculus
tgtatcagcgccgaccgctatgtgg

SEQ ID NO: 488511 - DNA, 25 bp, Mus musculus
tgtatcaggaaaaatagaggaccca

SEQ ID NO: 488512 - DNA, 25 bp, Mus musculus
tgtatcatctcagcaggcgtccgtg

SEQ ID NO: 488513 - DNA, 25 bp, Mus musculus
tgtatcattaccctgagcgagctgg

SEQ ID NO: 488514 - DNA, 25 bp, Mus musculus
tgtatccaaaaaccagaaggcctgc

SEQ ID NO: 488515 - DNA, 25 bp, Mus musculus
tgtatccaacacatgacgtcagtag

SEQ ID NO: 488516 - DNA, 25 bp, Mus musculus
tgtatccagcatccactcacaagga

SEQ ID NO: 488517 - DNA, 25 bp, Mus musculus
tgtatccagtgtaacaaaatcagcc

SEQ ID NO: 488518 - DNA, 25 bp, Mus musculus
tgtatcccaggagagcgagtacctc

SEQ ID NO: 488519 - DNA, 25 bp, Mus musculus
tgtatccccattacttaaaagcaag

SEQ ID NO: 488520 - DNA, 25 bp, Mus musculus
tgtatcccgcagaggcagtgctgga

SEQ ID NO: 488521 - DNA, 25 bp, Mus musculus
tgtatcccgctgttgccacaatggc

SEQ ID NO: 488522 - DNA, 25 bp, Mus musculus
tgtatccgggaggtcaacgaggtca

SEQ ID NO: 488523 - DNA, 25 bp, Mus musculus
tgtatccggtacactgtcatggtgg

SEQ ID NO: 488524 - DNA, 25 bp, Mus musculus
tgtatccgtggctcgtgattgctcg

SEQ ID NO: 488525 - DNA, 25 bp, Mus musculus
tgtatcctaacatgagcgagcctgt

SEQ ID NO: 488526 - DNA, 25 bp, Mus musculus
tgtatcctgtgaagtggagccacca

SEQ ID NO: 488527 - DNA, 25 bp, Mus musculus
tgtatcctgtgggatgagacagatg

SEQ ID NO: 488528 - DNA, 25 bp, Mus musculus
tgtatccttcagagtcagaggtact

SEQ ID NO: 488529 - DNA, 25 bp, Mus musculus
tgtatcgacaaagaaggccctggag

SEQ ID NO: 488530 - DNA, 25 bp, Mus musculus
tgtatcgacgaaatcagctcccgct

SEQ ID NO: 488531 - DNA, 25 bp, Mus musculus
tgtatcgcccctcagttttgcgaag

SEQ ID NO: 488532 - DNA, 25 bp, Mus musculus
tgtatcggaaagctataactgaggc

SEQ ID NO: 488533 - DNA, 25 bp, Mus musculus
tgtatcgtcaatcccagtcagtaag

SEQ ID NO: 488534 - DNA, 25 bp, Mus musculus
tgtatctaatgcatggcacagctcc

SEQ ID NO: 488535 - DNA, 25 bp, Mus musculus
tgtatctacataaaccagtggcagg

SEQ ID NO: 488536 - DNA, 25 bp, Mus musculus
tgtatctcaaagtaagcctgcaggc

SEQ ID NO: 488537 - DNA, 25 bp, Mus musculus
tgtatctcacgatgctaagcggttg

SEQ ID NO: 488538 - DNA, 25 bp, Mus musculus
tgtatctcccggtgttaagtggtgg

SEQ ID NO: 488539 - DNA, 25 bp, Mus musculus
tgtatctctagttttccctgcctga

SEQ ID NO: 488540 - DNA, 25 bp, Mus musculus
tgtatctgaagaccctgaactgcca

SEQ ID NO: 488541 - DNA, 25 bp, Mus musculus
tgtatctgcacccatttgtctttat

SEQ ID NO: 488542 - DNA, 25 bp, Mus musculus
tgtatgaaacgaagcacttacgtgg

SEQ ID NO: 488543 - DNA, 25 bp, Mus musculus
tgtatgaaaggtcagagagagcacc

SEQ ID NO: 488544 - DNA, 25 bp, Mus musculus
tgtatgaagaagatgccgtgcctgg

SEQ ID NO: 488545 - DNA, 25 bp, Mus musculus
tgtatgacacccaaactcatcgctg

SEQ ID NO: 488546 - DNA, 25 bp, Mus musculus
tgtatgacagtgcacccagtggcag

SEQ ID NO: 488547 - DNA, 25 bp, Mus musculus
tgtatgacatctgtgactacaatgt

SEQ ID NO: 488548 - DNA, 25 bp, Mus musculus
tgtatgacgaaacggtgaggcccct

SEQ ID NO: 488549 - DNA, 25 bp, Mus musculus
tgtatgacggtcgacagcctgtgct

SEQ ID NO: 488550 - DNA, 25 bp, Mus musculus
tgtatgactcactgttggcgctgcc

SEQ ID NO: 488551 - DNA, 25 bp, Mus musculus
tgtatgactccatcaagaactcggg

SEQ ID NO: 488552 - DNA, 25 bp, Mus musculus
tgtatgactctgctagggaactcct

SEQ ID NO: 488553 - DNA, 25 bp, Mus musculus
tgtatgagcggcacaaaaggcgcta

SEQ ID NO: 488554 - DNA, 25 bp, Mus musculus
tgtatgagggcaccagatcctttgg

SEQ ID NO: 488555 - DNA, 25 bp, Mus musculus
tgtatgagtactcctgcctgagaga

SEQ ID NO: 488556 - DNA, 25 bp, Mus musculus
tgtatgagtcagagctaagcagccc

SEQ ID NO: 488557 - DNA, 25 bp, Mus musculus
tgtatgagtgcaaccgttacccctg

SEQ ID NO: 488558 - DNA, 25 bp, Mus musculus
tgtatgatgaatgcccttgtccgag

SEQ ID NO: 488559 - DNA, 25 bp, Mus musculus
tgtatgatgaggacgactcggcgcc

SEQ ID NO: 488560 - DNA, 25 bp, Mus musculus
tgtatgcaaccaatatccaggagcc

SEQ ID NO: 488561 - DNA, 25 bp, Mus musculus
tgtatgcaatctattattcgtcgct

SEQ ID NO: 488562 - DNA, 25 bp, Mus musculus
tgtatgcactgttctctgggcagcc

SEQ ID NO: 488563 - DNA, 25 bp, Mus musculus
tgtatgcaggcaagatggtcacgct

SEQ ID NO: 488564 - DNA, 25 bp, Mus musculus
tgtatgccaacccatacagcatggc

SEQ ID NO: 488565 - DNA, 25 bp, Mus musculus
tgtatgccccgaaccacaagttttc

SEQ ID NO: 488566 - DNA, 25 bp, Mus musculus
tgtatgccctttgcaaccactcggg

SEQ ID NO: 488567 - DNA, 25 bp, Mus musculus
tgtatgcgggaacacatgcctcctc

SEQ ID NO: 488568 - DNA, 25 bp, Mus musculus
tgtatgctaacagacgcccctgctt

SEQ ID NO: 488569 - DNA, 25 bp, Mus musculus
tgtatgctgaaagtgcccaggagga

SEQ ID NO: 488570 - DNA, 25 bp, Mus musculus
tgtatgctgaagcaatggcgctgcc

SEQ ID NO: 488571 - DNA, 25 bp, Mus musculus
tgtatgcttcattcagggccagtca

SEQ ID NO: 488572 - DNA, 25 bp, Mus musculus
tgtatgcttcccagtgctctaccgc

SEQ ID NO: 488573 - DNA, 25 bp, Mus musculus
tgtatggaaccaagaagcacccttt

SEQ ID NO: 488574 - DNA, 25 bp, Mus musculus
tgtatggacactcaacggaaggcct

SEQ ID NO: 488575 - DNA, 25 bp, Mus musculus
tgtatggagaccctcggcaagtgct

SEQ ID NO: 488576 - DNA, 25 bp, Mus musculus
tgtatggagccttgtctgactagag

SEQ ID NO: 488577 - DNA, 25 bp, Mus musculus
tgtatggatccgaacttgacgccga

SEQ ID NO: 488578 - DNA, 25 bp, Mus musculus
tgtatggcaaactcagcaaccagga

SEQ ID NO: 488579 - DNA, 25 bp, Mus musculus
tgtatggcaatatccgagctgtggc

SEQ ID NO: 488580 - DNA, 25 bp, Mus musculus
tgtatggccgcatatacgtggccgc

SEQ ID NO: 488581 - DNA, 25 bp, Mus musculus
tgtatggcctcttcaggaaacggag

SEQ ID NO: 488582 - DNA, 25 bp, Mus musculus
tgtatgggaaggttcgaaaagctgc

SEQ ID NO: 488583 - DNA, 25 bp, Mus musculus
tgtatgggcgcaaacactgttaccg

SEQ ID NO: 488584 - DNA, 25 bp, Mus musculus
tgtatgggtgcttggcctgactata

SEQ ID NO: 488585 - DNA, 25 bp, Mus musculus
tgtatggtagcaacgcagactccca

SEQ ID NO: 488586 - DNA, 25 bp, Mus musculus
tgtatggtagtgcaaccctggtcgc

SEQ ID NO: 488587 - DNA, 25 bp, Mus musculus
tgtatggtgcttaccaaaggctcat

SEQ ID NO: 488588 - DNA, 25 bp, Mus musculus
tgtatggttcaagccctgtgccttc

SEQ ID NO: 488589 - DNA, 25 bp, Mus musculus
tgtatgtaatcctttcagcccgtgg

SEQ ID NO: 488590 - DNA, 25 bp, Mus musculus
tgtatgtagaagtgaccaacgaggc

SEQ ID NO: 488591 - DNA, 25 bp, Mus musculus
tgtatgtagcatgctgtgaagcgcc

SEQ ID NO: 488592 - DNA, 25 bp, Mus musculus
tgtatgtcaacgtcccagagctggt

SEQ ID NO: 488593 - DNA, 25 bp, Mus musculus
tgtatgtcatcggaggctggacccc

SEQ ID NO: 488594 - DNA, 25 bp, Mus musculus
tgtatgtgaaaccatcgtccgcgtc

SEQ ID NO: 488595 - DNA, 25 bp, Mus musculus
tgtatgtgaacaccatcgggcaccg

SEQ ID NO: 488596 - DNA, 25 bp, Mus musculus
tgtatgtgaacgagtcgggcaccct

SEQ ID NO: 488597 - DNA, 25 bp, Mus musculus
tgtatgtgagttcttcagtccccag

SEQ ID NO: 488598 - DNA, 25 bp, Mus musculus
tgtatgtggcttctcagctggaacg

SEQ ID NO: 488599 - DNA, 25 bp, Mus musculus
tgtatgtgggtagggatagaaccca

SEQ ID NO: 488600 - DNA, 25 bp, Mus musculus
tgtatgtgtgtacacccagcttgtg

SEQ ID NO: 488601 - DNA, 25 bp, Mus musculus
tgtatgtgtttactgatgtttagca

SEQ ID NO: 488602 - DNA, 25 bp, Mus musculus
tgtattacactcacaggcgtcgacg

SEQ ID NO: 488603 - DNA, 25 bp, Mus musculus
tgtattaccaaagcagggtccgtgt

SEQ ID NO: 488604 - DNA, 25 bp, Mus musculus
tgtattacgagtccaaggcccacgt

SEQ ID NO: 488605 - DNA, 25 bp, Mus musculus
tgtattagagcctgaccccagcagt

SEQ ID NO: 488606 - DNA, 25 bp, Mus musculus
tgtattattggcagcgaatccggga

SEQ ID NO: 488607 - DNA, 25 bp, Mus musculus
tgtattatttgcactgaagactctt

SEQ ID NO: 488608 - DNA, 25 bp, Mus musculus
tgtattcactgcaccactggctgga

SEQ ID NO: 488609 - DNA, 25 bp, Mus musculus
tgtattcagaaaaccagacgggcgc

SEQ ID NO: 488610 - DNA, 25 bp, Mus musculus
tgtattcaggtcaaaggccaggatc

SEQ ID NO: 488611 - DNA, 25 bp, Mus musculus
tgtattcagtacgtcgtgggcgccg

SEQ ID NO: 488612 - DNA, 25 bp, Mus musculus
tgtattcatgcccagaacggccgca

SEQ ID NO: 488613 - DNA, 25 bp, Mus musculus
tgtattccacaagaccaagtttcac

SEQ ID NO: 488614 - DNA, 25 bp, Mus musculus
tgtattccacagcagacgtcttctg

SEQ ID NO: 488615 - DNA, 25 bp, Mus musculus
tgtattccatgaggcttcagctgcg

SEQ ID NO: 488616 - DNA, 25 bp, Mus musculus
tgtattccccagaaagtctgtttgc

SEQ ID NO: 488617 - DNA, 25 bp, Mus musculus
tgtattctccagagtatccaggacc

SEQ ID NO: 488618 - DNA, 25 bp, Mus musculus
tgtattctgatgtgcaaactccgac

SEQ ID NO: 488619 - DNA, 25 bp, Mus musculus
tgtattcttcgctcacggcactgga

SEQ ID NO: 488620 - DNA, 25 bp, Mus musculus
tgtattgacacacacgtaaagaagc

SEQ ID NO: 488621 - DNA, 25 bp, Mus musculus
tgtattgacacctaacttcctcaga

SEQ ID NO: 488622 - DNA, 25 bp, Mus musculus
tgtattgacatactcgactccctag

SEQ ID NO: 488623 - DNA, 25 bp, Mus musculus
tgtattgagcagctgccaacgtgct

SEQ ID NO: 488624 - DNA, 25 bp, Mus musculus
tgtattgcagcaaagacatgcctcg

SEQ ID NO: 488625 - DNA, 25 bp, Mus musculus
tgtattgctatgagagtatcagacc

SEQ ID NO: 488626 - DNA, 25 bp, Mus musculus
tgtattggcaaggtgacatctcagc

SEQ ID NO: 488627 - DNA, 25 bp, Mus musculus
tgtattggctgcttgacaccggcaa

SEQ ID NO: 488628 - DNA, 25 bp, Mus musculus
tgtattgggtgatggtggcttttcc

SEQ ID NO: 488629 - DNA, 25 bp, Mus musculus
tgtattgtgcaaggaaaaggatcac

SEQ ID NO: 488630 - DNA, 25 bp, Mus musculus
tgtatttaaaaacccgggctggcat

SEQ ID NO: 488631 - DNA, 25 bp, Mus musculus
tgtatttaacgagggctcctggccc

SEQ ID NO: 488632 - DNA, 25 bp, Mus musculus
tgtatttatgagaagcctcgggcct

SEQ ID NO: 488633 - DNA, 25 bp, Mus musculus
tgtatttcaacttcacccagatggg

SEQ ID NO: 488634 - DNA, 25 bp, Mus musculus
tgtatttcacgggaccaggctggga

SEQ ID NO: 488635 - DNA, 25 bp, Mus musculus
tgtatttcagccttctccctagcag

SEQ ID NO: 488636 - DNA, 25 bp, Mus musculus
tgtatttcctgatccatgtcccgga

SEQ ID NO: 488637 - DNA, 25 bp, Mus musculus
tgtatttgaaagcacttgggaagtg

SEQ ID NO: 488638 - DNA, 25 bp, Mus musculus
tgtatttgccatcaccagggcctgt

SEQ ID NO: 488639 - DNA, 25 bp, Mus musculus
tgtatttgttagacaccctgagacc

SEQ ID NO: 488640 - DNA, 25 bp, Mus musculus
tgtattttaagagtcgtactgtcac

SEQ ID NO: 488641 - DNA, 25 bp, Mus musculus
tgtattttcagcaagtcatgagatt

SEQ ID NO: 488642 - DNA, 25 bp, Mus musculus
tgtattttctagatccaggccgttc

SEQ ID NO: 488643 - DNA, 25 bp, Mus musculus
tgtcaaaaccaaggagatctgcggg

SEQ ID NO: 488644 - DNA, 25 bp, Mus musculus
tgtcaaaacctggaaaagctcctgt

SEQ ID NO: 488645 - DNA, 25 bp, Mus musculus
tgtcaaaactctggcgaacgcaaga

SEQ ID NO: 488646 - DNA, 25 bp, Mus musculus
tgtcaaacaataccagcaaggctgc

SEQ ID NO: 488647 - DNA, 25 bp, Mus musculus
tgtcaaacagcatctttgtggtccc

SEQ ID NO: 488648 - DNA, 25 bp, Mus musculus
tgtcaaacatgttactaagtcccct

SEQ ID NO: 488649 - DNA, 25 bp, Mus musculus
tgtcaaacccgagagcgatgcaagc

SEQ ID NO: 488650 - DNA, 25 bp, Mus musculus
tgtcaaacctgctgtagaaaaaggg

SEQ ID NO: 488651 - DNA, 25 bp, Mus musculus
tgtcaaacgatagcaaagatcatct

SEQ ID NO: 488652 - DNA, 25 bp, Mus musculus
tgtcaaacgcggttaaaagccaagc

SEQ ID NO: 488653 - DNA, 25 bp, Mus musculus
tgtcaaacggtacaaggcggatccc

SEQ ID NO: 488654 - DNA, 25 bp, Mus musculus
tgtcaaactattaacatggccagtc

SEQ ID NO: 488655 - DNA, 25 bp, Mus musculus
tgtcaaactgggacgtccatgcggc

SEQ ID NO: 488656 - DNA, 25 bp, Mus musculus
tgtcaaagaagatccactcagggtt

SEQ ID NO: 488657 - DNA, 25 bp, Mus musculus
tgtcaaagacatttcaagatatgag

SEQ ID NO: 488658 - DNA, 25 bp, Mus musculus
tgtcaaagaccgaaaggagatccct

SEQ ID NO: 488659 - DNA, 25 bp, Mus musculus
tgtcaaagactgtagcaaccaggct

SEQ ID NO: 488660 - DNA, 25 bp, Mus musculus
tgtcaaagccaacttactaccaggg

SEQ ID NO: 488661 - DNA, 25 bp, Mus musculus
tgtcaaaggtggatttcaagctctc

SEQ ID NO: 488662 - DNA, 25 bp, Mus musculus
tgtcaaagtcaaaccagtcaaggcc

SEQ ID NO: 488663 - DNA, 25 bp, Mus musculus
tgtcaaattcagtgccatagcgccg

SEQ ID NO: 488664 - DNA, 25 bp, Mus musculus
tgtcaacaacttgtagaaaaaccca

SEQ ID NO: 488665 - DNA, 25 bp, Mus musculus
tgtcaacaagcgtggaccactcggt

SEQ ID NO: 488666 - DNA, 25 bp, Mus musculus
tgtcaacaggcaccatgtcagggct

SEQ ID NO: 488667 - DNA, 25 bp, Mus musculus
tgtcaacatcaccataggcgaccct

SEQ ID NO: 488668 - DNA, 25 bp, Mus musculus
tgtcaacatgaaggaggtctgccgg

SEQ ID NO: 488669 - DNA, 25 bp, Mus musculus
tgtcaacatgcaagatggcggccca

SEQ ID NO: 488670 - DNA, 25 bp, Mus musculus
tgtcaaccacagaatatctctagag

SEQ ID NO: 488671 - DNA, 25 bp, Mus musculus
tgtcaaccactgaaagcttaaggct

SEQ ID NO: 488672 - DNA, 25 bp, Mus musculus
tgtcaacccagtcaaggcccagggt

SEQ ID NO: 488673 - DNA, 25 bp, Mus musculus
tgtcaaccggacactagagggtgga

SEQ ID NO: 488674 - DNA, 25 bp, Mus musculus
tgtcaaccggagctcattaagcccc

SEQ ID NO: 488675 - DNA, 25 bp, Mus musculus
tgtcaacgcgagtatgccagtcagt

SEQ ID NO: 488676 - DNA, 25 bp, Mus musculus
tgtcaacgtgactgaagcaagccaa

SEQ ID NO: 488677 - DNA, 25 bp, Mus musculus
tgtcaacgtgcacagcttcaagccg

SEQ ID NO: 488678 - DNA, 25 bp, Mus musculus
tgtcaactcagtaaggccttggcca

SEQ ID NO: 488679 - DNA, 25 bp, Mus musculus
tgtcaactgtcttggtaggtaacct

SEQ ID NO: 488680 - DNA, 25 bp, Mus musculus
tgtcaagaagaaccacgcctgtgag

SEQ ID NO: 488681 - DNA, 25 bp, Mus musculus
tgtcaagagctgcaaagaccacctg

SEQ ID NO: 488682 - DNA, 25 bp, Mus musculus
tgtcaagcaggtcacaagtcagggt

SEQ ID NO: 488683 - DNA, 25 bp, Mus musculus
tgtcaagccccagcaaggaactgca

SEQ ID NO: 488684 - DNA, 25 bp, Mus musculus
tgtcaagcctctccaggactatggg

SEQ ID NO: 488685 - DNA, 25 bp, Mus musculus
tgtcaagctgcagatacctgctcag

SEQ ID NO: 488686 - DNA, 25 bp, Mus musculus
tgtcaagcttaactcaggatcccag

SEQ ID NO: 488687 - DNA, 25 bp, Mus musculus
tgtcaaggacagataaagcccaccg

SEQ ID NO: 488688 - DNA, 25 bp, Mus musculus
tgtcaaggagatgaacgacgctgcc

SEQ ID NO: 488689 - DNA, 25 bp, Mus musculus
tgtcaaggcacaaaaccagttcacg

SEQ ID NO: 488690 - DNA, 25 bp, Mus musculus
tgtcaagtatgaagaggattgcgag

SEQ ID NO: 488691 - DNA, 25 bp, Mus musculus
tgtcaagtcaggtccaagttcatgg

SEQ ID NO: 488692 - DNA, 25 bp, Mus musculus
tgtcaagtccctccatctacaatgg

SEQ ID NO: 488693 - DNA, 25 bp, Mus musculus
tgtcaagtgccccaaggtatccaag

SEQ ID NO: 488694 - DNA, 25 bp, Mus musculus
tgtcaagtgtacagcagatattttg

SEQ ID NO: 488695 - DNA, 25 bp, Mus musculus
tgtcaagtgtcacgagttcacggcc

SEQ ID NO: 488696 - DNA, 25 bp, Mus musculus
tgtcaagttacagaggcgccagaat

SEQ ID NO: 488697 - DNA, 25 bp, Mus musculus
tgtcaataacattggacgaggccca

SEQ ID NO: 488698 - DNA, 25 bp, Mus musculus
tgtcaatccccacacagacgaaggt

SEQ ID NO: 488699 - DNA, 25 bp, Mus musculus
tgtcaatgaacaacagcccagaggg

SEQ ID NO: 488700 - DNA, 25 bp, Mus musculus
tgtcaatgcactcaccaatggcgtt

SEQ ID NO: 488701 - DNA, 25 bp, Mus musculus
tgtcaatgcccagtgcaccgatgag

SEQ ID NO: 488702 - DNA, 25 bp, Mus musculus
tgtcaatggcaaggagaagctcatg

SEQ ID NO: 488703 - DNA, 25 bp, Mus musculus
tgtcaatgtctgcaactggatcctc

SEQ ID NO: 488704 - DNA, 25 bp, Mus musculus
tgtcaattcacaccggtgggtatat

SEQ ID NO: 488705 - DNA, 25 bp, Mus musculus
tgtcacaaccttccggagggcagag

SEQ ID NO: 488706 - DNA, 25 bp, Mus musculus
tgtcacaagtgccaaacaggatgag

SEQ ID NO: 488707 - DNA, 25 bp, Mus musculus
tgtcacacagcttgatcctaaggag

SEQ ID NO: 488708 - DNA, 25 bp, Mus musculus
tgtcacacaggctctcacgtaggct

SEQ ID NO: 488709 - DNA, 25 bp, Mus musculus
tgtcacacatacaaatgttccagtg

SEQ ID NO: 488710 - DNA, 25 bp, Mus musculus
tgtcacacatttggacccacagagg

SEQ ID NO: 488711 - DNA, 25 bp, Mus musculus
tgtcacacattttagtgtctacctg

SEQ ID NO: 488712 - DNA, 25 bp, Mus musculus
tgtcacacctaaaagctgggctgga

SEQ ID NO: 488713 - DNA, 25 bp, Mus musculus
tgtcacacgaagatatgtgtgctct

SEQ ID NO: 488714 - DNA, 25 bp, Mus musculus
tgtcacagaagtacgagctgggcgc

SEQ ID NO: 488715 - DNA, 25 bp, Mus musculus
tgtcacagctgaagctagggctctc

SEQ ID NO: 488716 - DNA, 25 bp, Mus musculus
tgtcacagtcgtagcaggagtcctc

SEQ ID NO: 488717 - DNA, 25 bp, Mus musculus
tgtcacagtgcaagaacaaaggctt

SEQ ID NO: 488718 - DNA, 25 bp, Mus musculus
tgtcacagtttatgatggcaaaagg

SEQ ID NO: 488719 - DNA, 25 bp, Mus musculus
tgtcaccagtcttctggatgacact

SEQ ID NO: 488720 - DNA, 25 bp, Mus musculus
tgtcaccatactgccagcgtgggtt

SEQ ID NO: 488721 - DNA, 25 bp, Mus musculus
tgtcacccaaacgactgagcacagg

SEQ ID NO: 488722 - DNA, 25 bp, Mus musculus
tgtcacccttcaaagcccctattag

SEQ ID NO: 488723 - DNA, 25 bp, Mus musculus
tgtcaccgaagcctgaatgtaacgc

SEQ ID NO: 488724 - DNA, 25 bp, Mus musculus
tgtcaccgaggagaacacttgtagc

SEQ ID NO: 488725 - DNA, 25 bp, Mus musculus
tgtcaccgctatggagatggtggca

SEQ ID NO: 488726 - DNA, 25 bp, Mus musculus
tgtcaccggaaggagtaaactactg

SEQ ID NO: 488727 - DNA, 25 bp, Mus musculus
tgtcaccggagtcctagcagctctt

SEQ ID NO: 488728 - DNA, 25 bp, Mus musculus
tgtcacctaagctaccagatgtctg

SEQ ID NO: 488729 - DNA, 25 bp, Mus musculus
tgtcacctgacagtgccttggcaga

SEQ ID NO: 488730 - DNA, 25 bp, Mus musculus
tgtcacctgaccgagaagatgtccg

SEQ ID NO: 488731 - DNA, 25 bp, Mus musculus
tgtcacctggccatggttcctgagg

SEQ ID NO: 488732 - DNA, 25 bp, Mus musculus
tgtcacctggcgatactcttgtaaa

SEQ ID NO: 488733 - DNA, 25 bp, Mus musculus
tgtcacctgtaagagactggatggg

SEQ ID NO: 488734 - DNA, 25 bp, Mus musculus
tgtcacctttactcactgggcagaa

SEQ ID NO: 488735 - DNA, 25 bp, Mus musculus
tgtcacgaacgagatagccatggtc

SEQ ID NO: 488736 - DNA, 25 bp, Mus musculus
tgtcacgactgataggcgccatgga

SEQ ID NO: 488737 - DNA, 25 bp, Mus musculus
tgtcacgcaggtcacatgggtccag

SEQ ID NO: 488738 - DNA, 25 bp, Mus musculus
tgtcacgcttgcactgtcctttaga

SEQ ID NO: 488739 - DNA, 25 bp, Mus musculus
tgtcacggagcagcacactggaggt

SEQ ID NO: 488740 - DNA, 25 bp, Mus musculus
tgtcacggaggagatgatcaacccc

SEQ ID NO: 488741 - DNA, 25 bp, Mus musculus
tgtcacggagtgacgtcacaaactc

SEQ ID NO: 488742 - DNA, 25 bp, Mus musculus
tgtcacgtgatgctgtatgcgcccg

SEQ ID NO: 488743 - DNA, 25 bp, Mus musculus
tgtcactaactcaaatgaactctgt

SEQ ID NO: 488744 - DNA, 25 bp, Mus musculus
tgtcactatatctacctgccacggg

SEQ ID NO: 488745 - DNA, 25 bp, Mus musculus
tgtcactatcttttgggacccgagg

SEQ ID NO: 488746 - DNA, 25 bp, Mus musculus
tgtcactcacatcctcgaatgctga

SEQ ID NO: 488747 - DNA, 25 bp, Mus musculus
tgtcactcgacagcttaggaagatc

SEQ ID NO: 488748 - DNA, 25 bp, Mus musculus
tgtcactgagtgattatcttctggg

SEQ ID NO: 488749 - DNA, 25 bp, Mus musculus
tgtcactgcacatcttcctaaaggg

SEQ ID NO: 488750 - DNA, 25 bp, Mus musculus
tgtcactgcagtggaggactctctg

SEQ ID NO: 488751 - DNA, 25 bp, Mus musculus
tgtcacttgtgtggttagcttccag

SEQ ID NO: 488752 - DNA, 25 bp, Mus musculus
tgtcagaaaccaaccaagtgcagag

SEQ ID NO: 488753 - DNA, 25 bp, Mus musculus
tgtcagaaattgagcacgcccaggt

SEQ ID NO: 488754 - DNA, 25 bp, Mus musculus
tgtcagaaccctatcagtacgcgtc

SEQ ID NO: 488755 - DNA, 25 bp, Mus musculus
tgtcagaagaacaggttgaccggcc

SEQ ID NO: 488756 - DNA, 25 bp, Mus musculus
tgtcagaagggaattatggtgaaat

SEQ ID NO: 488757 - DNA, 25 bp, Mus musculus
tgtcagaagtcattgctaccctggg

SEQ ID NO: 488758 - DNA, 25 bp, Mus musculus
tgtcagaatgcttatgcctaggccg

SEQ ID NO: 488759 - DNA, 25 bp, Mus musculus
tgtcagaattggagacccgcctgga

SEQ ID NO: 488760 - DNA, 25 bp, Mus musculus
tgtcagacaagcaggaagctgctcc

SEQ ID NO: 488761 - DNA, 25 bp, Mus musculus
tgtcagacattactgtagccaagcc

SEQ ID NO: 488762 - DNA, 25 bp, Mus musculus
tgtcagagcccgaagaagagttagt

SEQ ID NO: 488763 - DNA, 25 bp, Mus musculus
tgtcagagctgattgtgtccacggc

SEQ ID NO: 488764 - DNA, 25 bp, Mus musculus
tgtcagaggcacagaaaaggtgttg

SEQ ID NO: 488765 - DNA, 25 bp, Mus musculus
tgtcagagggacaaactgcgggtcc

SEQ ID NO: 488766 - DNA, 25 bp, Mus musculus
tgtcagagtaagaaatgcttctccc

SEQ ID NO: 488767 - DNA, 25 bp, Mus musculus
tgtcagagtatcacgagcagggctc

SEQ ID NO: 488768 - DNA, 25 bp, Mus musculus
tgtcagagtgcgcacatttcgcccg

SEQ ID NO: 488769 - DNA, 25 bp, Mus musculus
tgtcagatctgctgtcgaggcccaa

SEQ ID NO: 488770 - DNA, 25 bp, Mus musculus
tgtcagatgacccttgccatgcagg

SEQ ID NO: 488771 - DNA, 25 bp, Mus musculus
tgtcagatgccacgtcttccttggc

SEQ ID NO: 488772 - DNA, 25 bp, Mus musculus
tgtcagcacctgttccaggatccag

SEQ ID NO: 488773 - DNA, 25 bp, Mus musculus
tgtcagcactcagcttcggagcctg

SEQ ID NO: 488774 - DNA, 25 bp, Mus musculus
tgtcagcagttgagaggcacacaaa

SEQ ID NO: 488775 - DNA, 25 bp, Mus musculus
tgtcagcataaaacgacgggactcc

SEQ ID NO: 488776 - DNA, 25 bp, Mus musculus
tgtcagcatcttcgtctcaaagctt

SEQ ID NO: 488777 - DNA, 25 bp, Mus musculus
tgtcagcattcaaagccacctacgg

SEQ ID NO: 488778 - DNA, 25 bp, Mus musculus
tgtcagccaacctatagggcttcgt

SEQ ID NO: 488779 - DNA, 25 bp, Mus musculus
tgtcagccgggaacgggtgactttc

SEQ ID NO: 488780 - DNA, 25 bp, Mus musculus
tgtcagcctccaccacaaggaaaat

SEQ ID NO: 488781 - DNA, 25 bp, Mus musculus
tgtcagcctgagttctcggttgccg

SEQ ID NO: 488782 - DNA, 25 bp, Mus musculus
tgtcagcctgttcccatttggtcac

SEQ ID NO: 488783 - DNA, 25 bp, Mus musculus
tgtcagcgaaaagcagtacaccatc

SEQ ID NO: 488784 - DNA, 25 bp, Mus musculus
tgtcagcgctaaaagtggctcccga

SEQ ID NO: 488785 - DNA, 25 bp, Mus musculus
tgtcagcggccatatgcactactct

SEQ ID NO: 488786 - DNA, 25 bp, Mus musculus
tgtcagcgggactacacacatctgg

SEQ ID NO: 488787 - DNA, 25 bp, Mus musculus
tgtcagctacaacccacagcatgtg

SEQ ID NO: 488788 - DNA, 25 bp, Mus musculus
tgtcagctccgcaaacactgtgagt

SEQ ID NO: 488789 - DNA, 25 bp, Mus musculus
tgtcagctgccctcatatccctggg

SEQ ID NO: 488790 - DNA, 25 bp, Mus musculus
tgtcagctgctatctctacttttcc

SEQ ID NO: 488791 - DNA, 25 bp, Mus musculus
tgtcagctgggatcctgcaacaggg

SEQ ID NO: 488792 - DNA, 25 bp, Mus musculus
tgtcagctgtacatagaagataagt

SEQ ID NO: 488793 - DNA, 25 bp, Mus musculus
tgtcagctgttgaaactacaggcct

SEQ ID NO: 488794 - DNA, 25 bp, Mus musculus
tgtcagcttgaatcgtcggctccgc

SEQ ID NO: 488795 - DNA, 25 bp, Mus musculus
tgtcaggagcgtgtcattcactgca

SEQ ID NO: 488796 - DNA, 25 bp, Mus musculus
tgtcaggagggatcagcatcaggcc

SEQ ID NO: 488797 - DNA, 25 bp, Mus musculus
tgtcaggaggtagcccgagtatgcc

SEQ ID NO: 488798 - DNA, 25 bp, Mus musculus
tgtcaggatccatgcagaataggga

SEQ ID NO: 488799 - DNA, 25 bp, Mus musculus
tgtcaggcaagctgaaggccctgtt

SEQ ID NO: 488800 - DNA, 25 bp, Mus musculus
tgtcaggctgacaggaacatcccct

SEQ ID NO: 488801 - DNA, 25 bp, Mus musculus
tgtcagggcgttggtcatccccaga

SEQ ID NO: 488802 - DNA, 25 bp, Mus musculus
tgtcagggctctgagtcatcctctg

SEQ ID NO: 488803 - DNA, 25 bp, Mus musculus
tgtcagggtatagatccatgcctag

SEQ ID NO: 488804 - DNA, 25 bp, Mus musculus
tgtcaggtgttttgggtgtagaatt

SEQ ID NO: 488805 - DNA, 25 bp, Mus musculus
tgtcagtagtgatccagccatcccc

SEQ ID NO: 488806 - DNA, 25 bp, Mus musculus
tgtcagtcaaggtggagaactctat

SEQ ID NO: 488807 - DNA, 25 bp, Mus musculus
tgtcagtcacagtggagatgaatcc

SEQ ID NO: 488808 - DNA, 25 bp, Mus musculus
tgtcagtcagtgtggagaaacccgg

SEQ ID NO: 488809 - DNA, 25 bp, Mus musculus
tgtcagtcctaaccttaaaaattga

SEQ ID NO: 488810 - DNA, 25 bp, Mus musculus
tgtcagtcctagtcaaaaggccgcc

SEQ ID NO: 488811 - DNA, 25 bp, Mus musculus
tgtcagtgcgggagctaaaccagca

SEQ ID NO: 488812 - DNA, 25 bp, Mus musculus
tgtcagtggaagaacctcgctcagc

SEQ ID NO: 488813 - DNA, 25 bp, Mus musculus
tgtcagtggccagaaaagatgcgct

SEQ ID NO: 488814 - DNA, 25 bp, Mus musculus
tgtcagtggtgggatgacgtcattc

SEQ ID NO: 488815 - DNA, 25 bp, Mus musculus
tgtcagtgtgaacgccttgaaggcc

SEQ ID NO: 488816 - DNA, 25 bp, Mus musculus
tgtcagtgtggaatacctgcctccc

SEQ ID NO: 488817 - DNA, 25 bp, Mus musculus
tgtcagttcaaatctgaaccagaag

SEQ ID NO: 488818 - DNA, 25 bp, Mus musculus
tgtcagtttcccagatcgcagggtt

SEQ ID NO: 488819 - DNA, 25 bp, Mus musculus
tgtcagtttcgtggcagagagttca

SEQ ID NO: 488820 - DNA, 25 bp, Mus musculus
tgtcataaaacttgcagtcagcctt

SEQ ID NO: 488821 - DNA, 25 bp, Mus musculus
tgtcataagaaggtgtcagacccct

SEQ ID NO: 488822 - DNA, 25 bp, Mus musculus
tgtcataatacaatacctgcatgct

SEQ ID NO: 488823 - DNA, 25 bp, Mus musculus
tgtcataatagtccactcctcggct

SEQ ID NO: 488824 - DNA, 25 bp, Mus musculus
tgtcatacagcgtcaacatctggag

SEQ ID NO: 488825 - DNA, 25 bp, Mus musculus
tgtcatagatataggcagagcccag

SEQ ID NO: 488826 - DNA, 25 bp, Mus musculus
tgtcatagccatgctgagagagcca

SEQ ID NO: 488827 - DNA, 25 bp, Mus musculus
tgtcatagcgaggagaagtgtcccc

SEQ ID NO: 488828 - DNA, 25 bp, Mus musculus
tgtcatatggaacagcctcagccgc

SEQ ID NO: 488829 - DNA, 25 bp, Mus musculus
tgtcatatggcaacagcagctggca

SEQ ID NO: 488830 - DNA, 25 bp, Mus musculus
tgtcatcaaactgtaaggctcctcc

SEQ ID NO: 488831 - DNA, 25 bp, Mus musculus
tgtcatcaaggattgagtaatttct

SEQ ID NO: 488832 - DNA, 25 bp, Mus musculus
tgtcatcacggacccagagacgatt

SEQ ID NO: 488833 - DNA, 25 bp, Mus musculus
tgtcatcagcatggcagtggctaat

SEQ ID NO: 488834 - DNA, 25 bp, Mus musculus
tgtcatcagtcacagccacaacact

SEQ ID NO: 488835 - DNA, 25 bp, Mus musculus
tgtcatcatcgtaccacgaaagtgt

SEQ ID NO: 488836 - DNA, 25 bp, Mus musculus
tgtcatcattgtcgactccggcaag

SEQ ID NO: 488837 - DNA, 25 bp, Mus musculus
tgtcatccaaaatctgtttgaaggc

SEQ ID NO: 488838 - DNA, 25 bp, Mus musculus
tgtcatcccctgaaggcactaagga

SEQ ID NO: 488839 - DNA, 25 bp, Mus musculus
tgtcatccctagacctaaagccgca

SEQ ID NO: 488840 - DNA, 25 bp, Mus musculus
tgtcatccctctttgggcccgaagg

SEQ ID NO: 488841 - DNA, 25 bp, Mus musculus
tgtcatccgagatgtggcccagttc

SEQ ID NO: 488842 - DNA, 25 bp, Mus musculus
tgtcatcgatgcatgggcctcagtc

SEQ ID NO: 488843 - DNA, 25 bp, Mus musculus
tgtcatcgggtgagttttgattccc

SEQ ID NO: 488844 - DNA, 25 bp, Mus musculus
tgtcatcgtacagtgccatctaagg

SEQ ID NO: 488845 - DNA, 25 bp, Mus musculus
tgtcatctacatgcgccttaatgtg

SEQ ID NO: 488846 - DNA, 25 bp, Mus musculus
tgtcatctcaggtaccagttcaggt

SEQ ID NO: 488847 - DNA, 25 bp, Mus musculus
tgtcatctccgagccgccaattgga

SEQ ID NO: 488848 - DNA, 25 bp, Mus musculus
tgtcatctgtgattggcagtgcagg

SEQ ID NO: 488849 - DNA, 25 bp, Mus musculus
tgtcatgcaagaacaccgcaaggtg

SEQ ID NO: 488850 - DNA, 25 bp, Mus musculus
tgtcatgcctgaaacgacggccctg

SEQ ID NO: 488851 - DNA, 25 bp, Mus musculus
tgtcatggaatagccaggacccgtg

SEQ ID NO: 488852 - DNA, 25 bp, Mus musculus
tgtcatggagagacaggagcagtca

SEQ ID NO: 488853 - DNA, 25 bp, Mus musculus
tgtcatggatgcttccagccctgga

SEQ ID NO: 488854 - DNA, 25 bp, Mus musculus
tgtcatggtaacagctgccctaagc

SEQ ID NO: 488855 - DNA, 25 bp, Mus musculus
tgtcatgtattatcttttccttcaa

SEQ ID NO: 488856 - DNA, 25 bp, Mus musculus
tgtcatgtgacctccataaattgtc

SEQ ID NO: 488857 - DNA, 25 bp, Mus musculus
tgtcattagcactgaacgcttccta

SEQ ID NO: 488858 - DNA, 25 bp, Mus musculus
tgtcattcaagtcagggaagtcgcc

SEQ ID NO: 488859 - DNA, 25 bp, Mus musculus
tgtcattcactgcagaggccaacgc

SEQ ID NO: 488860 - DNA, 25 bp, Mus musculus
tgtcattcagaacccatgtgagtag

SEQ ID NO: 488861 - DNA, 25 bp, Mus musculus
tgtcattctcacctaggagacattc

SEQ ID NO: 488862 - DNA, 25 bp, Mus musculus
tgtcattgagaggataggcgagccc

SEQ ID NO: 488863 - DNA, 25 bp, Mus musculus
tgtcattgatatctacgcctgtgcg

SEQ ID NO: 488864 - DNA, 25 bp, Mus musculus
tgtcattgcaccctgagtcatgagg

SEQ ID NO: 488865 - DNA, 25 bp, Mus musculus
tgtcattgcagtgaaggctccagag

SEQ ID NO: 488866 - DNA, 25 bp, Mus musculus
tgtcattggccacaggtttcagtcc

SEQ ID NO: 488867 - DNA, 25 bp, Mus musculus
tgtcattggtcattgcccgccagga

SEQ ID NO: 488868 - DNA, 25 bp, Mus musculus
tgtcattgtcacagtctcccctggc

SEQ ID NO: 488869 - DNA, 25 bp, Mus musculus
tgtcatttcaagatgaggctctgac

SEQ ID NO: 488870 - DNA, 25 bp, Mus musculus
tgtcatttccccaggctaggtaggg

SEQ ID NO: 488871 - DNA, 25 bp, Mus musculus
tgtcatttgtcagtgcgcgtgccgg

SEQ ID NO: 488872 - DNA, 25 bp, Mus musculus
tgtcattttcggtcaaaccccaggg

SEQ ID NO: 488873 - DNA, 25 bp, Mus musculus
tgtccaaaatgcgaacatccccgtg

SEQ ID NO: 488874 - DNA, 25 bp, Mus musculus
tgtccaaactggagtcacagcagcc

SEQ ID NO: 488875 - DNA, 25 bp, Mus musculus
tgtccaaatccaaacacatttcagt

SEQ ID NO: 488876 - DNA, 25 bp, Mus musculus
tgtccaaatggatcagccctgctgc

SEQ ID NO: 488877 - DNA, 25 bp, Mus musculus
tgtccaaattcgtggaaagccaagg

SEQ ID NO: 488878 - DNA, 25 bp, Mus musculus
tgtccaacaaggtggaagccgcctc

SEQ ID NO: 488879 - DNA, 25 bp, Mus musculus
tgtccaacaagtgactaaacaggtt

SEQ ID NO: 488880 - DNA, 25 bp, Mus musculus
tgtccaactacagagaaagccttcg

SEQ ID NO: 488881 - DNA, 25 bp, Mus musculus
tgtccaactgagcacgtccatgata

SEQ ID NO: 488882 - DNA, 25 bp, Mus musculus
tgtccaactgggagcagatcctcta

SEQ ID NO: 488883 - DNA, 25 bp, Mus musculus
tgtccaagaacatgctcgagggcgc

SEQ ID NO: 488884 - DNA, 25 bp, Mus musculus
tgtccaagcaagatcaaaccttagt

SEQ ID NO: 488885 - DNA, 25 bp, Mus musculus
tgtccaaggataggccaagactaga

SEQ ID NO: 488886 - DNA, 25 bp, Mus musculus
tgtccaaggcagcagcagacctgat

SEQ ID NO: 488887 - DNA, 25 bp, Mus musculus
tgtccaaggtaatgcagaaatgagc

SEQ ID NO: 488888 - DNA, 25 bp, Mus musculus
tgtccaagtatgtccacatagcaga

SEQ ID NO: 488889 - DNA, 25 bp, Mus musculus
tgtccaagtctacagaacaagccaa

SEQ ID NO: 488890 - DNA, 25 bp, Mus musculus
tgtccaatagatcgttcgggccgcg

SEQ ID NO: 488891 - DNA, 25 bp, Mus musculus
tgtccaatttggagggaagcccttc

SEQ ID NO: 488892 - DNA, 25 bp, Mus musculus
tgtccacaagaagatgaggcccacg

SEQ ID NO: 488893 - DNA, 25 bp, Mus musculus
tgtccacaagaagcacggagaagct

SEQ ID NO: 488894 - DNA, 25 bp, Mus musculus
tgtccacaagaatctcgacgggttg

SEQ ID NO: 488895 - DNA, 25 bp, Mus musculus
tgtccacagatcgtgcagcacttgt

SEQ ID NO: 488896 - DNA, 25 bp, Mus musculus
tgtccaccaggaaaacgaagagatg

SEQ ID NO: 488897 - DNA, 25 bp, Mus musculus
tgtccaccgtcaaggagcagctgat

SEQ ID NO: 488898 - DNA, 25 bp, Mus musculus
tgtccacctcgagggcaagattgaa

SEQ ID NO: 488899 - DNA, 25 bp, Mus musculus
tgtccacgctggacgaagccttcga

SEQ ID NO: 488900 - DNA, 25 bp, Mus musculus
tgtccacggctcagaattcagtcaa

SEQ ID NO: 488901 - DNA, 25 bp, Mus musculus
tgtccacgggtaccatgactggcct

SEQ ID NO: 488902 - DNA, 25 bp, Mus musculus
tgtccacgtgtgagggcgttaccac

SEQ ID NO: 488903 - DNA, 25 bp, Mus musculus
tgtccacgtttcagggagggtccca

SEQ ID NO: 488904 - DNA, 25 bp, Mus musculus
tgtccactgcaccaaggaagaccgg

SEQ ID NO: 488905 - DNA, 25 bp, Mus musculus
tgtccactgctgacgccaagaaaga

SEQ ID NO: 488906 - DNA, 25 bp, Mus musculus
tgtccacttgtggaagttaatcccc

SEQ ID NO: 488907 - DNA, 25 bp, Mus musculus
tgtccagaaatttacagtatagcct

SEQ ID NO: 488908 - DNA, 25 bp, Mus musculus
tgtccagacaaaaaggcaggcttct

SEQ ID NO: 488909 - DNA, 25 bp, Mus musculus
tgtccagagctagcggagatgagcc

SEQ ID NO: 488910 - DNA, 25 bp, Mus musculus
tgtccagagcttgataagacccagg

SEQ ID NO: 488911 - DNA, 25 bp, Mus musculus
tgtccagaggccttcaaatgtttcc

SEQ ID NO: 488912 - DNA, 25 bp, Mus musculus
tgtccagaggctcagacctagctcg

SEQ ID NO: 488913 - DNA, 25 bp, Mus musculus
tgtccagaggtagtcacagcagctg

SEQ ID NO: 488914 - DNA, 25 bp, Mus musculus
tgtccagaggttcccaaagatcttg

SEQ ID NO: 488915 - DNA, 25 bp, Mus musculus
tgtccagagttgtgaagccttcgct

SEQ ID NO: 488916 - DNA, 25 bp, Mus musculus
tgtccagagtttccggttcccagta

SEQ ID NO: 488917 - DNA, 25 bp, Mus musculus
tgtccagatgccctatttaacgagc

SEQ ID NO: 488918 - DNA, 25 bp, Mus musculus
tgtccagcaaaatagagtccctcag

SEQ ID NO: 488919 - DNA, 25 bp, Mus musculus
tgtccagcatctactgcaggtcaga

SEQ ID NO: 488920 - DNA, 25 bp, Mus musculus
tgtccagccacctagacgaagtcgt

SEQ ID NO: 488921 - DNA, 25 bp, Mus musculus
tgtccagccagtgaaccacagatcg

SEQ ID NO: 488922 - DNA, 25 bp, Mus musculus
tgtccagccctagagaaagggacct

SEQ ID NO: 488923 - DNA, 25 bp, Mus musculus
tgtccagccgctttgaggaagagat

SEQ ID NO: 488924 - DNA, 25 bp, Mus musculus
tgtccagcttaatgtcctccgttat

SEQ ID NO: 488925 - DNA, 25 bp, Mus musculus
tgtccagcttcctcaccgacgagga

SEQ ID NO: 488926 - DNA, 25 bp, Mus musculus
tgtccaggaaaactaagttcccaag

SEQ ID NO: 488927 - DNA, 25 bp, Mus musculus
tgtccaggaccttgtagtaaaaggg

SEQ ID NO: 488928 - DNA, 25 bp, Mus musculus
tgtccaggagatgtcgccaaagcct

SEQ ID NO: 488929 - DNA, 25 bp, Mus musculus
tgtccaggagcaccaaaagtccttg

SEQ ID NO: 488930 - DNA, 25 bp, Mus musculus
tgtccagggagtaattgggctcact

SEQ ID NO: 488931 - DNA, 25 bp, Mus musculus
tgtccagggtcagagtaaggctgcc

SEQ ID NO: 488932 - DNA, 25 bp, Mus musculus
tgtccagtaacataatcggcaccat

SEQ ID NO: 488933 - DNA, 25 bp, Mus musculus
tgtccagtaggtttcacagggccca

SEQ ID NO: 488934 - DNA, 25 bp, Mus musculus
tgtccagtcacagaattgcctcagc

SEQ ID NO: 488935 - DNA, 25 bp, Mus musculus
tgtccagtcaggtacgtgcagtgtc

SEQ ID NO: 488936 - DNA, 25 bp, Mus musculus
tgtccagttcaggacactgcctgtg

SEQ ID NO: 488937 - DNA, 25 bp, Mus musculus
tgtccatacttaggcaccattgaag

SEQ ID NO: 488938 - DNA, 25 bp, Mus musculus
tgtccatagatatttcagtgctgtg

SEQ ID NO: 488939 - DNA, 25 bp, Mus musculus
tgtccatatgcatttttactaaagt

SEQ ID NO: 488940 - DNA, 25 bp, Mus musculus
tgtccatatgcgagtcaagaagctg

SEQ ID NO: 488941 - DNA, 25 bp, Mus musculus
tgtccatcagcctatcccttgggct

SEQ ID NO: 488942 - DNA, 25 bp, Mus musculus
tgtccatcagctgagagggttcctg

SEQ ID NO: 488943 - DNA, 25 bp, Mus musculus
tgtccatcggagctaaagcgcagtg

SEQ ID NO: 488944 - DNA, 25 bp, Mus musculus
tgtccatcggccagtcagacagtgt

SEQ ID NO: 488945 - DNA, 25 bp, Mus musculus
tgtccatgaagcagtttctagactt

SEQ ID NO: 488946 - DNA, 25 bp, Mus musculus
tgtccatgagagctgtaaccttcag

SEQ ID NO: 488947 - DNA, 25 bp, Mus musculus
tgtccatgatgattcggccagagcc

SEQ ID NO: 488948 - DNA, 25 bp, Mus musculus
tgtccatggagaacgaggaacttct

SEQ ID NO: 488949 - DNA, 25 bp, Mus musculus
tgtccatgggactccggagaattcc

SEQ ID NO: 488950 - DNA, 25 bp, Mus musculus
tgtccatgtaaaagtcagggttcct

SEQ ID NO: 488951 - DNA, 25 bp, Mus musculus
tgtccatgtatcagtgccagccagg

SEQ ID NO: 488952 - DNA, 25 bp, Mus musculus
tgtccattccaggttccatatcaac

SEQ ID NO: 488953 - DNA, 25 bp, Mus musculus
tgtccattgtctgaaagcttccgag

SEQ ID NO: 488954 - DNA, 25 bp, Mus musculus
tgtccattgtgcctggatagtcaca

SEQ ID NO: 488955 - DNA, 25 bp, Mus musculus
tgtcccaaagtcagatagtcaagag

SEQ ID NO: 488956 - DNA, 25 bp, Mus musculus
tgtcccaacagatagcagtggacct

SEQ ID NO: 488957 - DNA, 25 bp, Mus musculus
tgtcccaacagatatcaactttgcg

SEQ ID NO: 488958 - DNA, 25 bp, Mus musculus
tgtcccaaggaagaagacgccatgt

SEQ ID NO: 488959 - DNA, 25 bp, Mus musculus
tgtcccacagtacaggcaaaggcca

SEQ ID NO: 488960 - DNA, 25 bp, Mus musculus
tgtcccacgagaacagatgtcagcg

SEQ ID NO: 488961 - DNA, 25 bp, Mus musculus
tgtcccactcgggacatgagctgct

SEQ ID NO: 488962 - DNA, 25 bp, Mus musculus
tgtcccagagcttgaaggagaaagc

SEQ ID NO: 488963 - DNA, 25 bp, Mus musculus
tgtcccagaggaagcaaccatagcc

SEQ ID NO: 488964 - DNA, 25 bp, Mus musculus
tgtcccagcacggatccaagtggag

SEQ ID NO: 488965 - DNA, 25 bp, Mus musculus
tgtcccagccttttgagctccagga

SEQ ID NO: 488966 - DNA, 25 bp, Mus musculus
tgtcccaggagggtaaggcaattcc

SEQ ID NO: 488967 - DNA, 25 bp, Mus musculus
tgtcccagggcaagacagccggttt

SEQ ID NO: 488968 - DNA, 25 bp, Mus musculus
tgtcccagtaggagaagaccgtgcc

SEQ ID NO: 488969 - DNA, 25 bp, Mus musculus
tgtcccatggtctccggaaggtgga

SEQ ID NO: 488970 - DNA, 25 bp, Mus musculus
tgtcccattgccacatcactgtgag

SEQ ID NO: 488971 - DNA, 25 bp, Mus musculus
tgtcccatttattatgtagagcaac

SEQ ID NO: 488972 - DNA, 25 bp, Mus musculus
tgtccccaaaggtgaacagtagtcg

SEQ ID NO: 488973 - DNA, 25 bp, Mus musculus
tgtccccaacccctggaatcagatt

SEQ ID NO: 488974 - DNA, 25 bp, Mus musculus
tgtccccaactacgccgcagaagtt

SEQ ID NO: 488975 - DNA, 25 bp, Mus musculus
tgtccccaaggagagtgactacgag

SEQ ID NO: 488976 - DNA, 25 bp, Mus musculus
tgtccccaatagtgccaaagtcatg

SEQ ID NO: 488977 - DNA, 25 bp, Mus musculus
tgtccccacacaatatagagctgga

SEQ ID NO: 488978 - DNA, 25 bp, Mus musculus
tgtccccacatcctcaggtgtctgt

SEQ ID NO: 488979 - DNA, 25 bp, Mus musculus
tgtccccacattctcaaatatcgag

SEQ ID NO: 488980 - DNA, 25 bp, Mus musculus
tgtccccagacaagtagtgatcaac

SEQ ID NO: 488981 - DNA, 25 bp, Mus musculus
tgtccccagaggaagttcagctgcg

SEQ ID NO: 488982 - DNA, 25 bp, Mus musculus
tgtccccatccaggttggctagagg

SEQ ID NO: 488983 - DNA, 25 bp, Mus musculus
tgtccccatgtgaactgccctactt

SEQ ID NO: 488984 - DNA, 25 bp, Mus musculus
tgtccccattacagcacagcagaga

SEQ ID NO: 488985 - DNA, 25 bp, Mus musculus
tgtccccgctgcaggctcaatttga

SEQ ID NO: 488986 - DNA, 25 bp, Mus musculus
tgtccccggacctggctcttcattt

SEQ ID NO: 488987 - DNA, 25 bp, Mus musculus
tgtccccgggagttcagagaggcaa

SEQ ID NO: 488988 - DNA, 25 bp, Mus musculus
tgtccccgttaagaaaatgcagctg

SEQ ID NO: 488989 - DNA, 25 bp, Mus musculus
tgtcccctaacttgggaagctttct

SEQ ID NO: 488990 - DNA, 25 bp, Mus musculus
tgtcccctacactgatgaggcccgg

SEQ ID NO: 488991 - DNA, 25 bp, Mus musculus
tgtcccctggccatgaggaaggaga

SEQ ID NO: 488992 - DNA, 25 bp, Mus musculus
tgtcccctgggagttaggcaccttc

SEQ ID NO: 488993 - DNA, 25 bp, Mus musculus
tgtcccctgggccttagataaagat

SEQ ID NO: 488994 - DNA, 25 bp, Mus musculus
tgtcccctggtttggagactgaaga

SEQ ID NO: 488995 - DNA, 25 bp, Mus musculus
tgtcccctgtgggagcgtcacacaa

SEQ ID NO: 488996 - DNA, 25 bp, Mus musculus
tgtcccctgtgtccttgtggcggct

SEQ ID NO: 488997 - DNA, 25 bp, Mus musculus
tgtcccctttgccagaagttccaga

SEQ ID NO: 488998 - DNA, 25 bp, Mus musculus
tgtcccgaaggctgagcaggtctaa

SEQ ID NO: 488999 - DNA, 25 bp, Mus musculus
tgtcccgaagtgagggatccgagcc

SEQ ID NO: 489000 - DNA, 25 bp, Mus musculus
tgtcccgagcaagcgcacaagtgtt

SEQ ID NO: 489001 - DNA, 25 bp, Mus musculus
tgtcccgatgctgctggtacactgg

SEQ ID NO: 489002 - DNA, 25 bp, Mus musculus
tgtcccgcaggagaaagatggctca

SEQ ID NO: 489003 - DNA, 25 bp, Mus musculus
tgtcccgcccctgaagctttgtaag

SEQ ID NO: 489004 - DNA, 25 bp, Mus musculus
tgtcccgcctgtacatgggcacagc

SEQ ID NO: 489005 - DNA, 25 bp, Mus musculus
tgtcccggaacttacaaataccttg

SEQ ID NO: 489006 - DNA, 25 bp, Mus musculus
tgtcccggcgaaagcagagtaaacc

SEQ ID NO: 489007 - DNA, 25 bp, Mus musculus
tgtcccgggcccattttgaaaagca

SEQ ID NO: 489008 - DNA, 25 bp, Mus musculus
tgtcccgtgaccctgcataataaag

SEQ ID NO: 489009 - DNA, 25 bp, Mus musculus
tgtcccgttggaggcaaaaccatag

SEQ ID NO: 489010 - DNA, 25 bp, Mus musculus
tgtccctaggatacagtagcagctc

SEQ ID NO: 489011 - DNA, 25 bp, Mus musculus
tgtccctgagaagcaaagccttgtg

SEQ ID NO: 489012 - DNA, 25 bp, Mus musculus
tgtccctgagagacgagaagcctgt

SEQ ID NO: 489013 - DNA, 25 bp, Mus musculus
tgtccctgagagtgatcgagcaacg

SEQ ID NO: 489014 - DNA, 25 bp, Mus musculus
tgtccctgatccagccaaagtgtgg

SEQ ID NO: 489015 - DNA, 25 bp, Mus musculus
tgtccctgctggttccagttactcc

SEQ ID NO: 489016 - DNA, 25 bp, Mus musculus
tgtccctggaagaggcactcatgcg

SEQ ID NO: 489017 - DNA, 25 bp, Mus musculus
tgtccctggcctacatcaactgctg

SEQ ID NO: 489018 - DNA, 25 bp, Mus musculus
tgtccctgggaagcgttcagccatc

SEQ ID NO: 489019 - DNA, 25 bp, Mus musculus
tgtccctgtgcaccagaagatgcgg

SEQ ID NO: 489020 - DNA, 25 bp, Mus musculus
tgtccctgtgtgaaaagcaagctgt

SEQ ID NO: 489021 - DNA, 25 bp, Mus musculus
tgtcccttggatggactggacccca

SEQ ID NO: 489022 - DNA, 25 bp, Mus musculus
tgtccctttcgcagactcactgcta

SEQ ID NO: 489023 - DNA, 25 bp, Mus musculus
tgtccctttgggtcgtagtggcttc

SEQ ID NO: 489024 - DNA, 25 bp, Mus musculus
tgtccgaatatggagccacaagccc

SEQ ID NO: 489025 - DNA, 25 bp, Mus musculus
tgtccgagactccatatgcagatga

SEQ ID NO: 489026 - DNA, 25 bp, Mus musculus
tgtccgagattacgaaagaaacgcc

SEQ ID NO: 489027 - DNA, 25 bp, Mus musculus
tgtccgaggacacttacaaggctac

SEQ ID NO: 489028 - DNA, 25 bp, Mus musculus
tgtccgaggagtctctttctcccac

SEQ ID NO: 489029 - DNA, 25 bp, Mus musculus
tgtccgaggcctacactgcatgtgt

SEQ ID NO: 489030 - DNA, 25 bp, Mus musculus
tgtccgaggcgctggaaagtgtcct

SEQ ID NO: 489031 - DNA, 25 bp, Mus musculus
tgtccgagtcgcttctccggaacct

SEQ ID NO: 489032 - DNA, 25 bp, Mus musculus
tgtccgagtttgagacttgtatgtc

SEQ ID NO: 489033 - DNA, 25 bp, Mus musculus
tgtccgcaaggtgatctactacagg

SEQ ID NO: 489034 - DNA, 25 bp, Mus musculus
tgtccgcactgcaatcgaagccatg

SEQ ID NO: 489035 - DNA, 25 bp, Mus musculus
tgtccgccgacaagttcgaaaactt

SEQ ID NO: 489036 - DNA, 25 bp, Mus musculus
tgtccgccggtgaccatgaaggcct

SEQ ID NO: 489037 - DNA, 25 bp, Mus musculus
tgtccggaaagagatcagcttctgc

SEQ ID NO: 489038 - DNA, 25 bp, Mus musculus
tgtccggcccggtctgcagccgaga

SEQ ID NO: 489039 - DNA, 25 bp, Mus musculus
tgtccggcctagaagcatcacagaa

SEQ ID NO: 489040 - DNA, 25 bp, Mus musculus
tgtccggcgaagagacaagaaggcc

SEQ ID NO: 489041 - DNA, 25 bp, Mus musculus
tgtccgtcaggccaggaaagaagct

SEQ ID NO: 489042 - DNA, 25 bp, Mus musculus
tgtccgtgactcagggatgatgtgc

SEQ ID NO: 489043 - DNA, 25 bp, Mus musculus
tgtccgtggtcagcaggaagaaagc

SEQ ID NO: 489044 - DNA, 25 bp, Mus musculus
tgtccgttcagaccaatggcggtta

SEQ ID NO: 489045 - DNA, 25 bp, Mus musculus
tgtccgttcagacctcggcaccatg

SEQ ID NO: 489046 - DNA, 25 bp, Mus musculus
tgtcctaacatgtgtccaccactgc

SEQ ID NO: 489047 - DNA, 25 bp, Mus musculus
tgtcctaacgctggaagacgggttc

SEQ ID NO: 489048 - DNA, 25 bp, Mus musculus
tgtcctacacaaccatcaggccgtg

SEQ ID NO: 489049 - DNA, 25 bp, Mus musculus
tgtcctaccgcctgcagagaggctt

SEQ ID NO: 489050 - DNA, 25 bp, Mus musculus
tgtcctacggacttctccagtagtt

SEQ ID NO: 489051 - DNA, 25 bp, Mus musculus
tgtcctacgttgaatgttcctcccg

SEQ ID NO: 489052 - DNA, 25 bp, Mus musculus
tgtcctagccaagacagtagccttc

SEQ ID NO: 489053 - DNA, 25 bp, Mus musculus
tgtcctagccgctgaaactgactgc

SEQ ID NO: 489054 - DNA, 25 bp, Mus musculus
tgtcctatgaagtacaggctctgct

SEQ ID NO: 489055 - DNA, 25 bp, Mus musculus
tgtcctatgaccctaggcttgaagg

SEQ ID NO: 489056 - DNA, 25 bp, Mus musculus
tgtcctattagcaataccaggtggg

SEQ ID NO: 489057 - DNA, 25 bp, Mus musculus
tgtcctcaatggtgctaggtcacag

SEQ ID NO: 489058 - DNA, 25 bp, Mus musculus
tgtcctcacaggaacgaagtcccta

SEQ ID NO: 489059 - DNA, 25 bp, Mus musculus
tgtcctcagaacagatgatagccgg

SEQ ID NO: 489060 - DNA, 25 bp, Mus musculus
tgtcctcagacagatgtgcatcacc

SEQ ID NO: 489061 - DNA, 25 bp, Mus musculus
tgtcctcagaccaagaagcctcctg

SEQ ID NO: 489062 - DNA, 25 bp, Mus musculus
tgtcctcagagcatgtggtcaccta

SEQ ID NO: 489063 - DNA, 25 bp, Mus musculus
tgtcctcagaggagaaactggcttt

SEQ ID NO: 489064 - DNA, 25 bp, Mus musculus
tgtcctcattccagggtgacatgga

SEQ ID NO: 489065 - DNA, 25 bp, Mus musculus
tgtcctcattcctaccgaaggcggt

SEQ ID NO: 489066 - DNA, 25 bp, Mus musculus
tgtcctcattcgaaaaggtgggcct

SEQ ID NO: 489067 - DNA, 25 bp, Mus musculus
tgtcctccaagggtgcatgcatgaa

SEQ ID NO: 489068 - DNA, 25 bp, Mus musculus
tgtcctccatcagtcctgttgcctt

SEQ ID NO: 489069 - DNA, 25 bp, Mus musculus
tgtcctccatgatcaaaagcagtgg

SEQ ID NO: 489070 - DNA, 25 bp, Mus musculus
tgtcctcccaaaggtaatatgccta

SEQ ID NO: 489071 - DNA, 25 bp, Mus musculus
tgtcctccccttacagcagagaaga

SEQ ID NO: 489072 - DNA, 25 bp, Mus musculus
tgtcctcccgaagaattggcatgtg

SEQ ID NO: 489073 - DNA, 25 bp, Mus musculus
tgtcctccgcgctaaccttagtgac

SEQ ID NO: 489074 - DNA, 25 bp, Mus musculus
tgtcctcgctatacctgactggagc

SEQ ID NO: 489075 - DNA, 25 bp, Mus musculus
tgtcctcgctctgatgttgctgtca

SEQ ID NO: 489076 - DNA, 25 bp, Mus musculus
tgtcctcggactggcctccatgttg

SEQ ID NO: 489077 - DNA, 25 bp, Mus musculus
tgtcctcgggaaaatgccatcctga

SEQ ID NO: 489078 - DNA, 25 bp, Mus musculus
tgtcctctcagcagtagtagatagc

SEQ ID NO: 489079 - DNA, 25 bp, Mus musculus
tgtcctctcggccagttcttgcaaa

SEQ ID NO: 489080 - DNA, 25 bp, Mus musculus
tgtcctctctgtctgaacctgatgg

SEQ ID NO: 489081 - DNA, 25 bp, Mus musculus
tgtcctctcttaagagcagattgaa

SEQ ID NO: 489082 - DNA, 25 bp, Mus musculus
tgtcctctgaggagaccataccagg

SEQ ID NO: 489083 - DNA, 25 bp, Mus musculus
tgtcctctgccttccgctgacaata

SEQ ID NO: 489084 - DNA, 25 bp, Mus musculus
tgtcctgaaacacagaatagcaggg

SEQ ID NO: 489085 - DNA, 25 bp, Mus musculus
tgtcctgaaacggtcaacacgctgt

SEQ ID NO: 489086 - DNA, 25 bp, Mus musculus
tgtcctgaacgaccagagcatggcc

SEQ ID NO: 489087 - DNA, 25 bp, Mus musculus
tgtcctgacattagctcttgagatt

SEQ ID NO: 489088 - DNA, 25 bp, Mus musculus
tgtcctgaccagcatgggccgactc

SEQ ID NO: 489089 - DNA, 25 bp, Mus musculus
tgtcctgactcaagggaatggcttg

SEQ ID NO: 489090 - DNA, 25 bp, Mus musculus
tgtcctgactgacagacatggaccc

SEQ ID NO: 489091 - DNA, 25 bp, Mus musculus
tgtcctgaggatggagacttccagg

SEQ ID NO: 489092 - DNA, 25 bp, Mus musculus
tgtcctgagtggcactgatcctctt

SEQ ID NO: 489093 - DNA, 25 bp, Mus musculus
tgtcctgcagccagtgtatgaccgg

SEQ ID NO: 489094 - DNA, 25 bp, Mus musculus
tgtcctgcagtgaatgatctagcca

SEQ ID NO: 489095 - DNA, 25 bp, Mus musculus
tgtcctgcatgtcctgcatgtcggt

SEQ ID NO: 489096 - DNA, 25 bp, Mus musculus
tgtcctgctgcacggtccagagtct

SEQ ID NO: 489097 - DNA, 25 bp, Mus musculus
tgtcctggaaacatctcaagcctag

SEQ ID NO: 489098 - DNA, 25 bp, Mus musculus
tgtcctggaattcagcgagatctgc

SEQ ID NO: 489099 - DNA, 25 bp, Mus musculus
tgtcctggagaagcatcgggaatca

SEQ ID NO: 489100 - DNA, 25 bp, Mus musculus
tgtcctggaggacggcacacttcat

SEQ ID NO: 489101 - DNA, 25 bp, Mus musculus
tgtcctggagggaacagaacttgca

SEQ ID NO: 489102 - DNA, 25 bp, Mus musculus
tgtcctggatgaaacagatgccccg

SEQ ID NO: 489103 - DNA, 25 bp, Mus musculus
tgtcctggcctcaggtaaagggtga

SEQ ID NO: 489104 - DNA, 25 bp, Mus musculus
tgtcctggcgcctgcatctttgggt

SEQ ID NO: 489105 - DNA, 25 bp, Mus musculus
tgtcctgggacagcaatggatctgc

SEQ ID NO: 489106 - DNA, 25 bp, Mus musculus
tgtcctgggactgccgcttcgcaat

SEQ ID NO: 489107 - DNA, 25 bp, Mus musculus
tgtcctggttactgtgagcccagag

SEQ ID NO: 489108 - DNA, 25 bp, Mus musculus
tgtcctgtagctacacattccaggt

SEQ ID NO: 489109 - DNA, 25 bp, Mus musculus
tgtcctgtcaaaggccagcttccaa

SEQ ID NO: 489110 - DNA, 25 bp, Mus musculus
tgtcctgtctgtttgcactttcggg

SEQ ID NO: 489111 - DNA, 25 bp, Mus musculus
tgtcctgtgcaatgtaagcctgatt

SEQ ID NO: 489112 - DNA, 25 bp, Mus musculus
tgtcctgtgcactaatcgtgctcca

SEQ ID NO: 489113 - DNA, 25 bp, Mus musculus
tgtcctgtggccgtaaatgttaaaa

SEQ ID NO: 489114 - DNA, 25 bp, Mus musculus
tgtcctgtggtagcagattcctccg

SEQ ID NO: 489115 - DNA, 25 bp, Mus musculus
tgtcctgttagctggagagccttcc

SEQ ID NO: 489116 - DNA, 25 bp, Mus musculus
tgtcctgttcggaggtatgtcgctg

SEQ ID NO: 489117 - DNA, 25 bp, Mus musculus
tgtcctgttctgcccaggcaaacag

SEQ ID NO: 489118 - DNA, 25 bp, Mus musculus
tgtccttaaccactcagcccgtgag

SEQ ID NO: 489119 - DNA, 25 bp, Mus musculus
tgtccttactcatcagtcctgtggc

SEQ ID NO: 489120 - DNA, 25 bp, Mus musculus
tgtccttatgattgagatattcttg

SEQ ID NO: 489121 - DNA, 25 bp, Mus musculus
tgtccttcacagcatgatactgagg

SEQ ID NO: 489122 - DNA, 25 bp, Mus musculus
tgtccttcactctgtccgctgcagg

SEQ ID NO: 489123 - DNA, 25 bp, Mus musculus
tgtccttgaactgaacactgcaaag

SEQ ID NO: 489124 - DNA, 25 bp, Mus musculus
tgtccttgagtggttcgcagagcgt

SEQ ID NO: 489125 - DNA, 25 bp, Mus musculus
tgtccttgcccgtgtgtcttcagag

SEQ ID NO: 489126 - DNA, 25 bp, Mus musculus
tgtccttggatcctgctggtcccag

SEQ ID NO: 489127 - DNA, 25 bp, Mus musculus
tgtccttggcctcgaagaagtcccg

SEQ ID NO: 489128 - DNA, 25 bp, Mus musculus
tgtccttggcgaacacttactattg

SEQ ID NO: 489129 - DNA, 25 bp, Mus musculus
tgtccttgtctcaccatatctgctg

SEQ ID NO: 489130 - DNA, 25 bp, Mus musculus
tgtcctttaacaccaacggcagcct

SEQ ID NO: 489131 - DNA, 25 bp, Mus musculus
tgtcctttgaaaaagctacaaggtg

SEQ ID NO: 489132 - DNA, 25 bp, Mus musculus
tgtcctttgaaggagacccagccca

SEQ ID NO: 489133 - DNA, 25 bp, Mus musculus
tgtcctttggagacgccggaagatg

SEQ ID NO: 489134 - DNA, 25 bp, Mus musculus
tgtcctttggcaggtgctgtgctcc

SEQ ID NO: 489135 - DNA, 25 bp, Mus musculus
tgtcctttggcgtgtgcatcggtcc

SEQ ID NO: 489136 - DNA, 25 bp, Mus musculus
tgtcgaaagccaaccatcaggaaga

SEQ ID NO: 489137 - DNA, 25 bp, Mus musculus
tgtcgaagttctaacagaagcaaca

SEQ ID NO: 489138 - DNA, 25 bp, Mus musculus
tgtcgacctgcagtggagtttttca

SEQ ID NO: 489139 - DNA, 25 bp, Mus musculus
tgtcgactagacgatgaagtgccct

SEQ ID NO: 489140 - DNA, 25 bp, Mus musculus
tgtcgagaataatcactgcctgccc

SEQ ID NO: 489141 - DNA, 25 bp, Mus musculus
tgtcgagagctggaattctgcacct

SEQ ID NO: 489142 - DNA, 25 bp, Mus musculus
tgtcgagagctgtactactgtgtga

SEQ ID NO: 489143 - DNA, 25 bp, Mus musculus
tgtcgagagtctcactggaagtgcc

SEQ ID NO: 489144 - DNA, 25 bp, Mus musculus
tgtcgagcagagatgaccagccctt

SEQ ID NO: 489145 - DNA, 25 bp, Mus musculus
tgtcgagttgctgtcccctaaaaaa

SEQ ID NO: 489146 - DNA, 25 bp, Mus musculus
tgtcgatctgcgagagtaagacctc

SEQ ID NO: 489147 - DNA, 25 bp, Mus musculus
tgtcgatgctatccccattgtggcg

SEQ ID NO: 489148 - DNA, 25 bp, Mus musculus
tgtcgatgtggaatagcctctgctc

SEQ ID NO: 489149 - DNA, 25 bp, Mus musculus
tgtcgattgactttcccacagttgg

SEQ ID NO: 489150 - DNA, 25 bp, Mus musculus
tgtcgcacccgcactatgaagatcg

SEQ ID NO: 489151 - DNA, 25 bp, Mus musculus
tgtcgcacggcgtaggcttacagca

SEQ ID NO: 489152 - DNA, 25 bp, Mus musculus
tgtcgcagacgcattctgactcggg

SEQ ID NO: 489153 - DNA, 25 bp, Mus musculus
tgtcgcagagaaacaacaacggcct

SEQ ID NO: 489154 - DNA, 25 bp, Mus musculus
tgtcgcagagatgaaccccaatgta

SEQ ID NO: 489155 - DNA, 25 bp, Mus musculus
tgtcgcctcgtgctcgtcacatctg

SEQ ID NO: 489156 - DNA, 25 bp, Mus musculus
tgtcgcgcggcgtacaacttagtgc

SEQ ID NO: 489157 - DNA, 25 bp, Mus musculus
tgtcgcgtccgcgtgattcccatga

SEQ ID NO: 489158 - DNA, 25 bp, Mus musculus
tgtcgctcggcatcgaaacagctgg

SEQ ID NO: 489159 - DNA, 25 bp, Mus musculus
tgtcgctgaatctgggctgagtccc

SEQ ID NO: 489160 - DNA, 25 bp, Mus musculus
tgtcgctgaccaacacaaagacggg

SEQ ID NO: 489161 - DNA, 25 bp, Mus musculus
tgtcgctgattcctccacaagggtg

SEQ ID NO: 489162 - DNA, 25 bp, Mus musculus
tgtcgctggagaagtaccgtggctc

SEQ ID NO: 489163 - DNA, 25 bp, Mus musculus
tgtcgctgtccttgaaggcactccg

SEQ ID NO: 489164 - DNA, 25 bp, Mus musculus
tgtcggaaaagaagcaacagcgcgc

SEQ ID NO: 489165 - DNA, 25 bp, Mus musculus
tgtcggacacagacaactcagcgga

SEQ ID NO: 489166 - DNA, 25 bp, Mus musculus
tgtcggacagctcaaaagcgaagga

SEQ ID NO: 489167 - DNA, 25 bp, Mus musculus
tgtcggacccatatgagctgaaagc

SEQ ID NO: 489168 - DNA, 25 bp, Mus musculus
tgtcggactgcttgtaaccatctgc

SEQ ID NO: 489169 - DNA, 25 bp, Mus musculus
tgtcggagaacggtatgaacgcact

SEQ ID NO: 489170 - DNA, 25 bp, Mus musculus
tgtcggagaggctaatggacacccc

SEQ ID NO: 489171 - DNA, 25 bp, Mus musculus
tgtcggcaaccatcgagcgggagtt

SEQ ID NO: 489172 - DNA, 25 bp, Mus musculus
tgtcggccatggaagacgccttgga

SEQ ID NO: 489173 - DNA, 25 bp, Mus musculus
tgtcggccttcggatgatacctcag

SEQ ID NO: 489174 - DNA, 25 bp, Mus musculus
tgtcgggccttggtggaacatcaaa

SEQ ID NO: 489175 - DNA, 25 bp, Mus musculus
tgtcgggctttccacgtttcactta

SEQ ID NO: 489176 - DNA, 25 bp, Mus musculus
tgtcggtcacacaagcagatggcga

SEQ ID NO: 489177 - DNA, 25 bp, Mus musculus
tgtcggtgactagagcctcctcgtg

SEQ ID NO: 489178 - DNA, 25 bp, Mus musculus
tgtcggtgcagaatccaaatgcctt

SEQ ID NO: 489179 - DNA, 25 bp, Mus musculus
tgtcggtgctggtcatcctcctggt

SEQ ID NO: 489180 - DNA, 25 bp, Mus musculus
tgtcgtagccttcccagacctgagt

SEQ ID NO: 489181 - DNA, 25 bp, Mus musculus
tgtcgtccattacagcctccctgag

SEQ ID NO: 489182 - DNA, 25 bp, Mus musculus
tgtcgtcctctgtccttcctagttg

SEQ ID NO: 489183 - DNA, 25 bp, Mus musculus
tgtcgtctaggccaacaatgggtgc

SEQ ID NO: 489184 - DNA, 25 bp, Mus musculus
tgtcgtgaagacacatataacctcg

SEQ ID NO: 489185 - DNA, 25 bp, Mus musculus
tgtcgtgagcgcagtcatgtggcca

SEQ ID NO: 489186 - DNA, 25 bp, Mus musculus
tgtcgtgagttcaccacacatgtca

SEQ ID NO: 489187 - DNA, 25 bp, Mus musculus
tgtcgtggaggaaacgcagatgtcc

SEQ ID NO: 489188 - DNA, 25 bp, Mus musculus
tgtcgtggcccagaaaaagctccga

SEQ ID NO: 489189 - DNA, 25 bp, Mus musculus
tgtcgttaaactttcccagctctgg

SEQ ID NO: 489190 - DNA, 25 bp, Mus musculus
tgtcgttggatatcgttaatatgaa

SEQ ID NO: 489191 - DNA, 25 bp, Mus musculus
tgtcgtttcccagtaaaagcctgag

SEQ ID NO: 489192 - DNA, 25 bp, Mus musculus
tgtcgttttccatgaccgccggctg

SEQ ID NO: 489193 - DNA, 25 bp, Mus musculus
tgtctaaaccctgaaaaatagcatc

SEQ ID NO: 489194 - DNA, 25 bp, Mus musculus
tgtctaacctacgaccccagagtga

SEQ ID NO: 489195 - DNA, 25 bp, Mus musculus
tgtctaaggaataagaagccactct

SEQ ID NO: 489196 - DNA, 25 bp, Mus musculus
tgtctacaaaaagggacgattccgg

SEQ ID NO: 489197 - DNA, 25 bp, Mus musculus
tgtctacaaccggtgagtgggcgca

SEQ ID NO: 489198 - DNA, 25 bp, Mus musculus
tgtctacaagcggtacagggccggc

SEQ ID NO: 489199 - DNA, 25 bp, Mus musculus
tgtctacactgggacgaggtgccgc

SEQ ID NO: 489200 - DNA, 25 bp, Mus musculus
tgtctacagcagatgtaaaacctcg

SEQ ID NO: 489201 - DNA, 25 bp, Mus musculus
tgtctacccggaaccataattgcgc

SEQ ID NO: 489202 - DNA, 25 bp, Mus musculus
tgtctaccctcaatagggccccttt

SEQ ID NO: 489203 - DNA, 25 bp, Mus musculus
tgtctacctccagcccaggaataga

SEQ ID NO: 489204 - DNA, 25 bp, Mus musculus
tgtctacctgtagtattgtgaaata

SEQ ID NO: 489205 - DNA, 25 bp, Mus musculus
tgtctacgttcatatgccagtctca

SEQ ID NO: 489206 - DNA, 25 bp, Mus musculus
tgtctactaattaaacaacacggag

SEQ ID NO: 489207 - DNA, 25 bp, Mus musculus
tgtctactaggtgtccctctgagcc

SEQ ID NO: 489208 - DNA, 25 bp, Mus musculus
tgtctagaaatattcacccctgtgg

SEQ ID NO: 489209 - DNA, 25 bp, Mus musculus
tgtctagaaggctggactgaggcca

SEQ ID NO: 489210 - DNA, 25 bp, Mus musculus
tgtctagacaccgaccagataggcc

SEQ ID NO: 489211 - DNA, 25 bp, Mus musculus
tgtctagcccaagcaacaggttctg

SEQ ID NO: 489212 - DNA, 25 bp, Mus musculus
tgtctagctgagaagcagccggttc

SEQ ID NO: 489213 - DNA, 25 bp, Mus musculus
tgtctagctttctctacaacaaggt

SEQ ID NO: 489214 - DNA, 25 bp, Mus musculus
tgtctaggcaactctctttaaacgc

SEQ ID NO: 489215 - DNA, 25 bp, Mus musculus
tgtctaggcatcgtgaccacagtgc

SEQ ID NO: 489216 - DNA, 25 bp, Mus musculus
tgtctagtcaagagcacacgcaagt

SEQ ID NO: 489217 - DNA, 25 bp, Mus musculus
tgtctagtctgcatttagatatgaa

SEQ ID NO: 489218 - DNA, 25 bp, Mus musculus
tgtctagtgacgatgccaatgtgct

SEQ ID NO: 489219 - DNA, 25 bp, Mus musculus
tgtctagtgctgtggccgcttgtga

SEQ ID NO: 489220 - DNA, 25 bp, Mus musculus
tgtctatacaccaaacgatgtccgg

SEQ ID NO: 489221 - DNA, 25 bp, Mus musculus
tgtctatcaaaactacctaataggg

SEQ ID NO: 489222 - DNA, 25 bp, Mus musculus
tgtctatcctgaagggagccagacc

SEQ ID NO: 489223 - DNA, 25 bp, Mus musculus
tgtctatctatatgtgggtgcccaa

SEQ ID NO: 489224 - DNA, 25 bp, Mus musculus
tgtctatggatttgtgtgtatgcgc

SEQ ID NO: 489225 - DNA, 25 bp, Mus musculus
tgtctattcataacaggcatggtaa

SEQ ID NO: 489226 - DNA, 25 bp, Mus musculus
tgtctattggcatcaccttcatggg

SEQ ID NO: 489227 - DNA, 25 bp, Mus musculus
tgtctcaaagcagcctgtccaagtg

SEQ ID NO: 489228 - DNA, 25 bp, Mus musculus
tgtctcaactcttctttgggccggg

SEQ ID NO: 489229 - DNA, 25 bp, Mus musculus
tgtctcaagatcagaggcgaccagg

SEQ ID NO: 489230 - DNA, 25 bp, Mus musculus
tgtctcaccagatctcggaggaggg

SEQ ID NO: 489231 - DNA, 25 bp, Mus musculus
tgtctcagaaagtcaggcggtcgta

SEQ ID NO: 489232 - DNA, 25 bp, Mus musculus
tgtctcagacctactgaaagctgga

SEQ ID NO: 489233 - DNA, 25 bp, Mus musculus
tgtctcagccttccttgtgctgggt

SEQ ID NO: 489234 - DNA, 25 bp, Mus musculus
tgtctcagcgataagagcatatact

SEQ ID NO: 489235 - DNA, 25 bp, Mus musculus
tgtctcaggaaaacgatcaaaatgc

SEQ ID NO: 489236 - DNA, 25 bp, Mus musculus
tgtctcaggacaagggacagcacca

SEQ ID NO: 489237 - DNA, 25 bp, Mus musculus
tgtctcaggcgactcattaccccag

SEQ ID NO: 489238 - DNA, 25 bp, Mus musculus
tgtctcatccatggacccagcagga

SEQ ID NO: 489239 - DNA, 25 bp, Mus musculus
tgtctcatctccagctgttttgcca

SEQ ID NO: 489240 - DNA, 25 bp, Mus musculus
tgtctcatgccccagcttagagtgc

SEQ ID NO: 489241 - DNA, 25 bp, Mus musculus
tgtctcatgcgggacagtgctggcc

SEQ ID NO: 489242 - DNA, 25 bp, Mus musculus
tgtctccaaggaggatcccaaagcc

SEQ ID NO: 489243 - DNA, 25 bp, Mus musculus
tgtctccaaggtatgcagcaagcac

SEQ ID NO: 489244 - DNA, 25 bp, Mus musculus
tgtctccagagcaggtgtacagcgc

SEQ ID NO: 489245 - DNA, 25 bp, Mus musculus
tgtctccagcatcaggcttccagag

SEQ ID NO: 489246 - DNA, 25 bp, Mus musculus
tgtctccagtgtagagtcaggcttc

SEQ ID NO: 489247 - DNA, 25 bp, Mus musculus
tgtctccatggcagaagcaggcctg

SEQ ID NO: 489248 - DNA, 25 bp, Mus musculus
tgtctcccaaggtttccatgcttcc

SEQ ID NO: 489249 - DNA, 25 bp, Mus musculus
tgtctcccagcgtgggtaccaagaa

SEQ ID NO: 489250 - DNA, 25 bp, Mus musculus
tgtctcccagttgggtgcagcagca

SEQ ID NO: 489251 - DNA, 25 bp, Mus musculus
tgtctcccattaaggtcccgtccat

SEQ ID NO: 489252 - DNA, 25 bp, Mus musculus
tgtctcccttaagggtgatggtgag

SEQ ID NO: 489253 - DNA, 25 bp, Mus musculus
tgtctcctagataaaggtaccacct

SEQ ID NO: 489254 - DNA, 25 bp, Mus musculus
tgtctcctcagtgatgaccacggtg

SEQ ID NO: 489255 - DNA, 25 bp, Mus musculus
tgtctccttgccagatggccaaacc

SEQ ID NO: 489256 - DNA, 25 bp, Mus musculus
tgtctcgacattttgatagcctggg

SEQ ID NO: 489257 - DNA, 25 bp, Mus musculus
tgtctcgacctgtgcaactgagcga

SEQ ID NO: 489258 - DNA, 25 bp, Mus musculus
tgtctcggaaagtcatgcagccccg

SEQ ID NO: 489259 - DNA, 25 bp, Mus musculus
tgtctcggtatctgccattctgccc

SEQ ID NO: 489260 - DNA, 25 bp, Mus musculus
tgtctcggtccccatcgtgtttgct

SEQ ID NO: 489261 - DNA, 25 bp, Mus musculus
tgtctcgtgcaatttcagagcctga

SEQ ID NO: 489262 - DNA, 25 bp, Mus musculus
tgtctctaagcgtatgactgctctg

SEQ ID NO: 489263 - DNA, 25 bp, Mus musculus
tgtctctaccggaagcgctgtcgga

SEQ ID NO: 489264 - DNA, 25 bp, Mus musculus
tgtctctaggacagggagcaggctt

SEQ ID NO: 489265 - DNA, 25 bp, Mus musculus
tgtctctaggttggtatactcatat

SEQ ID NO: 489266 - DNA, 25 bp, Mus musculus
tgtctctccccaagtcctattgatg

SEQ ID NO: 489267 - DNA, 25 bp, Mus musculus
tgtctctctagaatccggactctga

SEQ ID NO: 489268 - DNA, 25 bp, Mus musculus
tgtctctgcacacactgaaggatgt

SEQ ID NO: 489269 - DNA, 25 bp, Mus musculus
tgtctctgcccacgcattgaagtaa

SEQ ID NO: 489270 - DNA, 25 bp, Mus musculus
tgtctctgcgctccctggataaagg

SEQ ID NO: 489271 - DNA, 25 bp, Mus musculus
tgtctctgctttggactatctacat

SEQ ID NO: 489272 - DNA, 25 bp, Mus musculus
tgtctctgggtttcaccatgcacaa

SEQ ID NO: 489273 - DNA, 25 bp, Mus musculus
tgtctcttcaaactgcccagggtgg

SEQ ID NO: 489274 - DNA, 25 bp, Mus musculus
tgtctgaaaccgtaaggcctggcac

SEQ ID NO: 489275 - DNA, 25 bp, Mus musculus
tgtctgaacaagtctagcccagtgc

SEQ ID NO: 489276 - DNA, 25 bp, Mus musculus
tgtctgaagaaccactgaaggtcct

SEQ ID NO: 489277 - DNA, 25 bp, Mus musculus
tgtctgaagccaacaactaggctgg

SEQ ID NO: 489278 - DNA, 25 bp, Mus musculus
tgtctgaagcgggaaatgtggcctc

SEQ ID NO: 489279 - DNA, 25 bp, Mus musculus
tgtctgaagctgagatccaccaggg

SEQ ID NO: 489280 - DNA, 25 bp, Mus musculus
tgtctgaaggagcacatggctaccg

SEQ ID NO: 489281 - DNA, 25 bp, Mus musculus
tgtctgaatggctcccagctgctgg

SEQ ID NO: 489282 - DNA, 25 bp, Mus musculus
tgtctgacagaaaggcagttggcct

SEQ ID NO: 489283 - DNA, 25 bp, Mus musculus
tgtctgacagtcagggacaagccag

SEQ ID NO: 489284 - DNA, 25 bp, Mus musculus
tgtctgacagttggcgcgacccgga

SEQ ID NO: 489285 - DNA, 25 bp, Mus musculus
tgtctgaccccggtgcctttttagt

SEQ ID NO: 489286 - DNA, 25 bp, Mus musculus
tgtctgaccgtgactctggagccaa

SEQ ID NO: 489287 - DNA, 25 bp, Mus musculus
tgtctgacctgtagctggtctgagg

SEQ ID NO: 489288 - DNA, 25 bp, Mus musculus
tgtctgacggaactatgaaccctgg

SEQ ID NO: 489289 - DNA, 25 bp, Mus musculus
tgtctgactccctcagtgtttcatg

SEQ ID NO: 489290 - DNA, 25 bp, Mus musculus
tgtctgactcctgcagcggttgcac

SEQ ID NO: 489291 - DNA, 25 bp, Mus musculus
tgtctgagaagcagccagagttgcc

SEQ ID NO: 489292 - DNA, 25 bp, Mus musculus
tgtctgagcagagcaacgtgaactc

SEQ ID NO: 489293 - DNA, 25 bp, Mus musculus
tgtctgagcgggtgtttctgtaact

SEQ ID NO: 489294 - DNA, 25 bp, Mus musculus
tgtctgaggcagaattctaaaaaca

SEQ ID NO: 489295 - DNA, 25 bp, Mus musculus
tgtctgagtgtttccagcacagccg

SEQ ID NO: 489296 - DNA, 25 bp, Mus musculus
tgtctgatgctagcagcgcggtcta

SEQ ID NO: 489297 - DNA, 25 bp, Mus musculus
tgtctgattgcatcgggtgtgatgt

SEQ ID NO: 489298 - DNA, 25 bp, Mus musculus
tgtctgcaagggtactacacagccg

SEQ ID NO: 489299 - DNA, 25 bp, Mus musculus
tgtctgcacatgaagagatttaact

SEQ ID NO: 489300 - DNA, 25 bp, Mus musculus
tgtctgcacccaggaaaagctgtca

SEQ ID NO: 489301 - DNA, 25 bp, Mus musculus
tgtctgcagaagtggtttgagccca

SEQ ID NO: 489302 - DNA, 25 bp, Mus musculus
tgtctgcagaattccagccgctgta

SEQ ID NO: 489303 - DNA, 25 bp, Mus musculus
tgtctgcagatacaagcaagcccag

SEQ ID NO: 489304 - DNA, 25 bp, Mus musculus
tgtctgcatcagctgtacccgtact

SEQ ID NO: 489305 - DNA, 25 bp, Mus musculus
tgtctgccaacaaggctccatgact

SEQ ID NO: 489306 - DNA, 25 bp, Mus musculus
tgtctgccaccgatggtttgcctga

SEQ ID NO: 489307 - DNA, 25 bp, Mus musculus
tgtctgccactgcaatgccggctac

SEQ ID NO: 489308 - DNA, 25 bp, Mus musculus
tgtctgccagtgtgatcgccggtgt

SEQ ID NO: 489309 - DNA, 25 bp, Mus musculus
tgtctgccatagaaccacttcggga

SEQ ID NO: 489310 - DNA, 25 bp, Mus musculus
tgtctgccatgtcacctctttaata

SEQ ID NO: 489311 - DNA, 25 bp, Mus musculus
tgtctgcccactgaatagtaatcac

SEQ ID NO: 489312 - DNA, 25 bp, Mus musculus
tgtctgcccgcctgactgatcttga

SEQ ID NO: 489313 - DNA, 25 bp, Mus musculus
tgtctgccctactctactgctgggt

SEQ ID NO: 489314 - DNA, 25 bp, Mus musculus
tgtctgccgagatcgcttcacgcga

SEQ ID NO: 489315 - DNA, 25 bp, Mus musculus
tgtctgccggtgagacctcatctgt

SEQ ID NO: 489316 - DNA, 25 bp, Mus musculus
tgtctgcctgtgcatgaagccggcc

SEQ ID NO: 489317 - DNA, 25 bp, Mus musculus
tgtctgcgaagctgtgccaggtgcc

SEQ ID NO: 489318 - DNA, 25 bp, Mus musculus
tgtctgcgaatcagtggcgacctcc

SEQ ID NO: 489319 - DNA, 25 bp, Mus musculus
tgtctgcgcccactgttaatgatgg

SEQ ID NO: 489320 - DNA, 25 bp, Mus musculus
tgtctgcggctgtgatcacagcaga

SEQ ID NO: 489321 - DNA, 25 bp, Mus musculus
tgtctgctactgtgctgtgatgtgg

SEQ ID NO: 489322 - DNA, 25 bp, Mus musculus
tgtctgctatgctgaaaccctctgc

SEQ ID NO: 489323 - DNA, 25 bp, Mus musculus
tgtctgctccgtagctggcctgtgc

SEQ ID NO: 489324 - DNA, 25 bp, Mus musculus
tgtctgctctgagcgacctgcatgc

SEQ ID NO: 489325 - DNA, 25 bp, Mus musculus
tgtctgctcttagtacagtgagccc

SEQ ID NO: 489326 - DNA, 25 bp, Mus musculus
tgtctgctgagaagggaaactcttt

SEQ ID NO: 489327 - DNA, 25 bp, Mus musculus
tgtctgctgcaattgatcccgaatc

SEQ ID NO: 489328 - DNA, 25 bp, Mus musculus
tgtctgctgcaggtggtgcatcatc

SEQ ID NO: 489329 - DNA, 25 bp, Mus musculus
tgtctgctgccccatattgaagccg

SEQ ID NO: 489330 - DNA, 25 bp, Mus musculus
tgtctgcttactggaaggctcctgg

SEQ ID NO: 489331 - DNA, 25 bp, Mus musculus
tgtctggaaaaattcaccgtgagtc

SEQ ID NO: 489332 - DNA, 25 bp, Mus musculus
tgtctggaaccagcaaaaccttcag

SEQ ID NO: 489333 - DNA, 25 bp, Mus musculus
tgtctggaactgacaacgtactttg

SEQ ID NO: 489334 - DNA, 25 bp, Mus musculus
tgtctggagcactcaaaacttggtg

SEQ ID NO: 489335 - DNA, 25 bp, Mus musculus
tgtctggagtgcaaagagcagtgcc

SEQ ID NO: 489336 - DNA, 25 bp, Mus musculus
tgtctggatccaagaccagggtggc

SEQ ID NO: 489337 - DNA, 25 bp, Mus musculus
tgtctggcacacagtgcaaatgctt

SEQ ID NO: 489338 - DNA, 25 bp, Mus musculus
tgtctggcactttttccaaaaattt

SEQ ID NO: 489339 - DNA, 25 bp, Mus musculus
tgtctggcagcgagcagaaattcct

SEQ ID NO: 489340 - DNA, 25 bp, Mus musculus
tgtctggccttgagagtaacgcaac

SEQ ID NO: 489341 - DNA, 25 bp, Mus musculus
tgtctgggagataaggatccgcgct

SEQ ID NO: 489342 - DNA, 25 bp, Mus musculus
tgtctggtgctcaaggtgcggcaca

SEQ ID NO: 489343 - DNA, 25 bp, Mus musculus
tgtctgtaacaagcaaggcggcaca

SEQ ID NO: 489344 - DNA, 25 bp, Mus musculus
tgtctgtaccagctgtacctagaag

SEQ ID NO: 489345 - DNA, 25 bp, Mus musculus
tgtctgtaccccagtgaagggaggc

SEQ ID NO: 489346 - DNA, 25 bp, Mus musculus
tgtctgtacggcaaggaggagcacc

SEQ ID NO: 489347 - DNA, 25 bp, Mus musculus
tgtctgtactccactttcattccct

SEQ ID NO: 489348 - DNA, 25 bp, Mus musculus
tgtctgtagtgggttttcagtggat

SEQ ID NO: 489349 - DNA, 25 bp, Mus musculus
tgtctgtatgctgacctacataggt

SEQ ID NO: 489350 - DNA, 25 bp, Mus musculus
tgtctgtcaagtaccagtgatggat

SEQ ID NO: 489351 - DNA, 25 bp, Mus musculus
tgtctgtcaccgatactgggagcgg

SEQ ID NO: 489352 - DNA, 25 bp, Mus musculus
tgtctgtcatcaatagtactactgc

SEQ ID NO: 489353 - DNA, 25 bp, Mus musculus
tgtctgtcatcacggctccaggaag

SEQ ID NO: 489354 - DNA, 25 bp, Mus musculus
tgtctgtcgagtgggacaagccaaa

SEQ ID NO: 489355 - DNA, 25 bp, Mus musculus
tgtctgtctaccgtgtaggtctggg

SEQ ID NO: 489356 - DNA, 25 bp, Mus musculus
tgtctgtctccttgttttctagatg

SEQ ID NO: 489357 - DNA, 25 bp, Mus musculus
tgtctgtctgctgtgggcctcagag

SEQ ID NO: 489358 - DNA, 25 bp, Mus musculus
tgtctgtctgtatgtggatatgagc

SEQ ID NO: 489359 - DNA, 25 bp, Mus musculus
tgtctgtcttgtcttgctagctaag

SEQ ID NO: 489360 - DNA, 25 bp, Mus musculus
tgtctgtgaccaggaaacccgagga

SEQ ID NO: 489361 - DNA, 25 bp, Mus musculus
tgtctgtgcccttcgagaagcattc

SEQ ID NO: 489362 - DNA, 25 bp, Mus musculus
tgtctgtgcgccgaagtcaaggtcc

SEQ ID NO: 489363 - DNA, 25 bp, Mus musculus
tgtctgtggcagagataactagctc

SEQ ID NO: 489364 - DNA, 25 bp, Mus musculus
tgtctgtgttatctgtagcacccaa

SEQ ID NO: 489365 - DNA, 25 bp, Mus musculus
tgtctgtttactctctaggtttgaa

SEQ ID NO: 489366 - DNA, 25 bp, Mus musculus
tgtcttaagactactttccagaggc

SEQ ID NO: 489367 - DNA, 25 bp, Mus musculus
tgtcttaaggcatcgtctctttcaa

SEQ ID NO: 489368 - DNA, 25 bp, Mus musculus
tgtcttacaagagcttcaaccatga

SEQ ID NO: 489369 - DNA, 25 bp, Mus musculus
tgtcttacacagaggccgagtgggc

SEQ ID NO: 489370 - DNA, 25 bp, Mus musculus
tgtcttacatgaggcggcaggcagc

SEQ ID NO: 489371 - DNA, 25 bp, Mus musculus
tgtcttactttcagggccatgttgg

SEQ ID NO: 489372 - DNA, 25 bp, Mus musculus
tgtcttagcatcacagggttcctgt

SEQ ID NO: 489373 - DNA, 25 bp, Mus musculus
tgtcttagcccagatggaccacggt

SEQ ID NO: 489374 - DNA, 25 bp, Mus musculus
tgtcttaggacaccatgagggcact

SEQ ID NO: 489375 - DNA, 25 bp, Mus musculus
tgtcttaggatgtcagccatggagt

SEQ ID NO: 489376 - DNA, 25 bp, Mus musculus
tgtcttatagatgcccttggcgctc

SEQ ID NO: 489377 - DNA, 25 bp, Mus musculus
tgtcttattacagagtacagttgtg

SEQ ID NO: 489378 - DNA, 25 bp, Mus musculus
tgtcttattctgcagtgtcttgtct

SEQ ID NO: 489379 - DNA, 25 bp, Mus musculus
tgtcttattgtctctcacaggaggg

SEQ ID NO: 489380 - DNA, 25 bp, Mus musculus
tgtcttcaaatacagctccttccaa

SEQ ID NO: 489381 - DNA, 25 bp, Mus musculus
tgtcttcaacaccaaagaacaaggc

SEQ ID NO: 489382 - DNA, 25 bp, Mus musculus
tgtcttcaaggatcaaaagtacgcc

SEQ ID NO: 489383 - DNA, 25 bp, Mus musculus
tgtcttcagcctttgcccattacaa

SEQ ID NO: 489384 - DNA, 25 bp, Mus musculus
tgtcttcagcgtcatctacctcttc

SEQ ID NO: 489385 - DNA, 25 bp, Mus musculus
tgtcttcagggagcaaagcctagtg

SEQ ID NO: 489386 - DNA, 25 bp, Mus musculus
tgtcttccagattcgtaagacagaa

SEQ ID NO: 489387 - DNA, 25 bp, Mus musculus
tgtcttccagggtggcacatccaga

SEQ ID NO: 489388 - DNA, 25 bp, Mus musculus
tgtcttccagtatccagtgggctgg

SEQ ID NO: 489389 - DNA, 25 bp, Mus musculus
tgtcttccccacgtttgaattcgct

SEQ ID NO: 489390 - DNA, 25 bp, Mus musculus
tgtcttccgaggcagaacctaaggt

SEQ ID NO: 489391 - DNA, 25 bp, Mus musculus
tgtcttccgattgggcagctggtcc

SEQ ID NO: 489392 - DNA, 25 bp, Mus musculus
tgtcttccgctaatggattaccacc

SEQ ID NO: 489393 - DNA, 25 bp, Mus musculus
tgtcttccgggaaagtgttccccag

SEQ ID NO: 489394 - DNA, 25 bp, Mus musculus
tgtcttccgggctcagagtgcagag

SEQ ID NO: 489395 - DNA, 25 bp, Mus musculus
tgtcttcctcgtaaggcacagtgcc

SEQ ID NO: 489396 - DNA, 25 bp, Mus musculus
tgtcttcctgcataaggagaggaca

SEQ ID NO: 489397 - DNA, 25 bp, Mus musculus
tgtcttcgctgatgctcctttgagg

SEQ ID NO: 489398 - DNA, 25 bp, Mus musculus
tgtcttcgtgaagttccaggccccg

SEQ ID NO: 489399 - DNA, 25 bp, Mus musculus
tgtcttctacttctcaggtggcctc

SEQ ID NO: 489400 - DNA, 25 bp, Mus musculus
tgtcttctcagaatgctccccgggt

SEQ ID NO: 489401 - DNA, 25 bp, Mus musculus
tgtcttctcctgtatcctcctgagt

SEQ ID NO: 489402 - DNA, 25 bp, Mus musculus
tgtcttctcggaacccatatgcagg

SEQ ID NO: 489403 - DNA, 25 bp, Mus musculus
tgtcttcttaccattaaagggaggg

SEQ ID NO: 489404 - DNA, 25 bp, Mus musculus
tgtcttcttctgagggacgtctgct

SEQ ID NO: 489405 - DNA, 25 bp, Mus musculus
tgtcttgagagagtacaaactgccc

SEQ ID NO: 489406 - DNA, 25 bp, Mus musculus
tgtcttgagtggaaaattttgcatc

SEQ ID NO: 489407 - DNA, 25 bp, Mus musculus
tgtcttgatttacaaagataaccct

SEQ ID NO: 489408 - DNA, 25 bp, Mus musculus
tgtcttgcagcagtatagttcctgg

SEQ ID NO: 489409 - DNA, 25 bp, Mus musculus
tgtcttggccgtatgggagccacca

SEQ ID NO: 489410 - DNA, 25 bp, Mus musculus
tgtcttggctatcatggtattcccc

SEQ ID NO: 489411 - DNA, 25 bp, Mus musculus
tgtcttggctctagtcacctgtggg

SEQ ID NO: 489412 - DNA, 25 bp, Mus musculus
tgtcttgggacaaggctcacctggg

SEQ ID NO: 489413 - DNA, 25 bp, Mus musculus
tgtcttgggcggtatggcaacactc

SEQ ID NO: 489414 - DNA, 25 bp, Mus musculus
tgtcttgtctcccaaggtttccatg

SEQ ID NO: 489415 - DNA, 25 bp, Mus musculus
tgtcttgtctgtcttcggagcagaa

SEQ ID NO: 489416 - DNA, 25 bp, Mus musculus
tgtcttgtctttgtagctgtgaaag

SEQ ID NO: 489417 - DNA, 25 bp, Mus musculus
tgtctttaaaaggatcggcctgagg

SEQ ID NO: 489418 - DNA, 25 bp, Mus musculus
tgtctttgctcacaggagggagcct

SEQ ID NO: 489419 - DNA, 25 bp, Mus musculus
tgtctttggcacagcaggcactaga

SEQ ID NO: 489420 - DNA, 25 bp, Mus musculus
tgtctttgtttaggctggtgatagg

SEQ ID NO: 489421 - DNA, 25 bp, Mus musculus
tgtcttttgagcagcagggactctc

SEQ ID NO: 489422 - DNA, 25 bp, Mus musculus
tgtctttttaagcatctctgcctcg

SEQ ID NO: 489423 - DNA, 25 bp, Mus musculus
tgtgaaaaaagtgtgttccctccca

SEQ ID NO: 489424 - DNA, 25 bp, Mus musculus
tgtgaaaacaactactcttgacctg

SEQ ID NO: 489425 - DNA, 25 bp, Mus musculus
tgtgaaaacccagcacagtggtgtg

SEQ ID NO: 489426 - DNA, 25 bp, Mus musculus
tgtgaaaagccgtaaccaggaacca

SEQ ID NO: 489427 - DNA, 25 bp, Mus musculus
tgtgaaaaggctgacctaccctggg

SEQ ID NO: 489428 - DNA, 25 bp, Mus musculus
tgtgaaaatccacaaactttctagc

SEQ ID NO: 489429 - DNA, 25 bp, Mus musculus
tgtgaaacaaacagtgtgggcgtgc

SEQ ID NO: 489430 - DNA, 25 bp, Mus musculus
tgtgaaacaaattgcggctcagctc

SEQ ID NO: 489431 - DNA, 25 bp, Mus musculus
tgtgaaacacagatccatatgagat

SEQ ID NO: 489432 - DNA, 25 bp, Mus musculus
tgtgaaaccccatcttctggacaag

SEQ ID NO: 489433 - DNA, 25 bp, Mus musculus
tgtgaaaccgcaagcagacctgctg

SEQ ID NO: 489434 - DNA, 25 bp, Mus musculus
tgtgaaacgtgtgaaccggaaacgc

SEQ ID NO: 489435 - DNA, 25 bp, Mus musculus
tgtgaaagatcatgtcgcagcagca

SEQ ID NO: 489436 - DNA, 25 bp, Mus musculus
tgtgaaagatgtcaacgaagcccct

SEQ ID NO: 489437 - DNA, 25 bp, Mus musculus
tgtgaaagccccacccagtatagtc

SEQ ID NO: 489438 - DNA, 25 bp, Mus musculus
tgtgaaagccccattgaaccgaaga

SEQ ID NO: 489439 - DNA, 25 bp, Mus musculus
tgtgaaaggctctgacttgtcaagg

SEQ ID NO: 489440 - DNA, 25 bp, Mus musculus
tgtgaaagtgaaggccgtactgctg

SEQ ID NO: 489441 - DNA, 25 bp, Mus musculus
tgtgaaatcatctcgtgcccagagc

SEQ ID NO: 489442 - DNA, 25 bp, Mus musculus
tgtgaaatcgccaacctcgagtgcg

SEQ ID NO: 489443 - DNA, 25 bp, Mus musculus
tgtgaaattaacgtgcgtcccagcc

SEQ ID NO: 489444 - DNA, 25 bp, Mus musculus
tgtgaacaaactctgcaaagcctcg

SEQ ID NO: 489445 - DNA, 25 bp, Mus musculus
tgtgaacaacttccaatgacttttt

SEQ ID NO: 489446 - DNA, 25 bp, Mus musculus
tgtgaacaagatgcgcaggcactcg

SEQ ID NO: 489447 - DNA, 25 bp, Mus musculus
tgtgaacaagcctgacaagtaccag

SEQ ID NO: 489448 - DNA, 25 bp, Mus musculus
tgtgaacaatcctgcctttaccgtg

SEQ ID NO: 489449 - DNA, 25 bp, Mus musculus
tgtgaacacatctcctagaaagcag

SEQ ID NO: 489450 - DNA, 25 bp, Mus musculus
tgtgaacacgagaagactgaacacg

SEQ ID NO: 489451 - DNA, 25 bp, Mus musculus
tgtgaacagcaaagcaaactcctct

SEQ ID NO: 489452 - DNA, 25 bp, Mus musculus
tgtgaacagtgccagccagggtact

SEQ ID NO: 489453 - DNA, 25 bp, Mus musculus
tgtgaacagtgtcaggaagacagac

SEQ ID NO: 489454 - DNA, 25 bp, Mus musculus
tgtgaacatcgacgaggtggaccca

SEQ ID NO: 489455 - DNA, 25 bp, Mus musculus
tgtgaacatggaacccttgagccgt

SEQ ID NO: 489456 - DNA, 25 bp, Mus musculus
tgtgaaccacaaaattgctctccgg

SEQ ID NO: 489457 - DNA, 25 bp, Mus musculus
tgtgaaccacaacaataacccgtat

SEQ ID NO: 489458 - DNA, 25 bp, Mus musculus
tgtgaaccaggaaggcagtgactag

SEQ ID NO: 489459 - DNA, 25 bp, Mus musculus
tgtgaaccaggtgtgagtgatctgc

SEQ ID NO: 489460 - DNA, 25 bp, Mus musculus
tgtgaacccggagagctctcaggaa

SEQ ID NO: 489461 - DNA, 25 bp, Mus musculus
tgtgaaccgaagaagcagaccaggg

SEQ ID NO: 489462 - DNA, 25 bp, Mus musculus
tgtgaaccgctggaatcccaatgtg

SEQ ID NO: 489463 - DNA, 25 bp, Mus musculus
tgtgaacctcaaatctgatccattg

SEQ ID NO: 489464 - DNA, 25 bp, Mus musculus
tgtgaacctgcttcatggcgtgaac

SEQ ID NO: 489465 - DNA, 25 bp, Mus musculus
tgtgaacgcaccttataaaagacgg

SEQ ID NO: 489466 - DNA, 25 bp, Mus musculus
tgtgaacgccttgaaggcctggtct

SEQ ID NO: 489467 - DNA, 25 bp, Mus musculus
tgtgaacggacctctgtcaggagcc

SEQ ID NO: 489468 - DNA, 25 bp, Mus musculus
tgtgaacggtgtcaactatgccagc

SEQ ID NO: 489469 - DNA, 25 bp, Mus musculus
tgtgaactacaactctcatggtgcc

SEQ ID NO: 489470 - DNA, 25 bp, Mus musculus
tgtgaactacaagctgctggatggg

SEQ ID NO: 489471 - DNA, 25 bp, Mus musculus
tgtgaactacattgaccccaaggat

SEQ ID NO: 489472 - DNA, 25 bp, Mus musculus
tgtgaactaccacggccatttgaag

SEQ ID NO: 489473 - DNA, 25 bp, Mus musculus
tgtgaactatgacgaggagcctgac

SEQ ID NO: 489474 - DNA, 25 bp, Mus musculus
tgtgaactatttagcggcagcccgt

SEQ ID NO: 489475 - DNA, 25 bp, Mus musculus
tgtgaactcagaagcaatggctgca

SEQ ID NO: 489476 - DNA, 25 bp, Mus musculus
tgtgaactcctcctgagaaacgtgg

SEQ ID NO: 489477 - DNA, 25 bp, Mus musculus
tgtgaactcggagacaggcactctg

SEQ ID NO: 489478 - DNA, 25 bp, Mus musculus
tgtgaactctcagcggaaacagcag

SEQ ID NO: 489479 - DNA, 25 bp, Mus musculus
tgtgaactcttggaataaactagga

SEQ ID NO: 489480 - DNA, 25 bp, Mus musculus
tgtgaactgagcaccgactatgcgc

SEQ ID NO: 489481 - DNA, 25 bp, Mus musculus
tgtgaactgtaagaaagggcaggtc

SEQ ID NO: 489482 - DNA, 25 bp, Mus musculus
tgtgaactgtccattccaggttcca

SEQ ID NO: 489483 - DNA, 25 bp, Mus musculus
tgtgaacttacaaacccagcggctg

SEQ ID NO: 489484 - DNA, 25 bp, Mus musculus
tgtgaacttaggacccagcttgggc

SEQ ID NO: 489485 - DNA, 25 bp, Mus musculus
tgtgaacttcacaccttacacctca

SEQ ID NO: 489486 - DNA, 25 bp, Mus musculus
tgtgaacttggacaactctgtggtg

SEQ ID NO: 489487 - DNA, 25 bp, Mus musculus
tgtgaagaacatcaacctccctgag

SEQ ID NO: 489488 - DNA, 25 bp, Mus musculus
tgtgaagaacgttcaggtccgctct

SEQ ID NO: 489489 - DNA, 25 bp, Mus musculus
tgtgaagaagctatgcaacacgcgt

SEQ ID NO: 489490 - DNA, 25 bp, Mus musculus
tgtgaagaagtagtcacgacacctt

SEQ ID NO: 489491 - DNA, 25 bp, Mus musculus
tgtgaagaatccagggtcttttgga

SEQ ID NO: 489492 - DNA, 25 bp, Mus musculus
tgtgaagaatgaccaaaatctggag

SEQ ID NO: 489493 - DNA, 25 bp, Mus musculus
tgtgaagaatgttcgaagcacgtgg

SEQ ID NO: 489494 - DNA, 25 bp, Mus musculus
tgtgaagacacctgactggagtgga

SEQ ID NO: 489495 - DNA, 25 bp, Mus musculus
tgtgaagacaggaatggtccccact

SEQ ID NO: 489496 - DNA, 25 bp, Mus musculus
tgtgaagaccaggcctcagggacag

SEQ ID NO: 489497 - DNA, 25 bp, Mus musculus
tgtgaagaccatctcctctgggatc

SEQ ID NO: 489498 - DNA, 25 bp, Mus musculus
tgtgaagaccatggcgatgaacagc

SEQ ID NO: 489499 - DNA, 25 bp, Mus musculus
tgtgaagacttgaacgggcctgcag

SEQ ID NO: 489500 - DNA, 25 bp, Mus musculus
tgtgaagagataccagtgccaggcc

SEQ ID NO: 489501 - DNA, 25 bp, Mus musculus
tgtgaagatacagcagaaggccctg

SEQ ID NO: 489502 - DNA, 25 bp, Mus musculus
tgtgaagatcaaggcctccaagtca

SEQ ID NO: 489503 - DNA, 25 bp, Mus musculus
tgtgaagatcgccaacgccaagttt

SEQ ID NO: 489504 - DNA, 25 bp, Mus musculus
tgtgaagcaagtaactaactgatct

SEQ ID NO: 489505 - DNA, 25 bp, Mus musculus
tgtgaagcagacgatgcaggcacct

SEQ ID NO: 489506 - DNA, 25 bp, Mus musculus
tgtgaagccacctgtccaaagacag

SEQ ID NO: 489507 - DNA, 25 bp, Mus musculus
tgtgaagccatcaacaaagcgggac

SEQ ID NO: 489508 - DNA, 25 bp, Mus musculus
tgtgaagcccaaacactaaaaaagg

SEQ ID NO: 489509 - DNA, 25 bp, Mus musculus
tgtgaagcgggctacctccttcctg

SEQ ID NO: 489510 - DNA, 25 bp, Mus musculus
tgtgaagctagagatgacacctgtg

SEQ ID NO: 489511 - DNA, 25 bp, Mus musculus
tgtgaagctcatcaaggacgccggt

SEQ ID NO: 489512 - DNA, 25 bp, Mus musculus
tgtgaagctccacagtgcagccaga

SEQ ID NO: 489513 - DNA, 25 bp, Mus musculus
tgtgaagctttcaagggccgcctta

SEQ ID NO: 489514 - DNA, 25 bp, Mus musculus
tgtgaaggaggctcttgtggacaaa

SEQ ID NO: 489515 - DNA, 25 bp, Mus musculus
tgtgaaggccccagacatagagtgc

SEQ ID NO: 489516 - DNA, 25 bp, Mus musculus
tgtgaaggctgtcgtggtgcccgct

SEQ ID NO: 489517 - DNA, 25 bp, Mus musculus
tgtgaagggtatagactcttccaag

SEQ ID NO: 489518 - DNA, 25 bp, Mus musculus
tgtgaaggtcactgaactctcggcc

SEQ ID NO: 489519 - DNA, 25 bp, Mus musculus
tgtgaaggtcccagcgcatctgaga

SEQ ID NO: 489520 - DNA, 25 bp, Mus musculus
tgtgaagtcagttgttggtacccaa

SEQ ID NO: 489521 - DNA, 25 bp, Mus musculus
tgtgaagtcctctctggccacacgg

SEQ ID NO: 489522 - DNA, 25 bp, Mus musculus
tgtgaagtctaaaactggcccaggg

SEQ ID NO: 489523 - DNA, 25 bp, Mus musculus
tgtgaagtgaagacatgccgtcgcc

SEQ ID NO: 489524 - DNA, 25 bp, Mus musculus
tgtgaagtttgacccgtacaccctg

SEQ ID NO: 489525 - DNA, 25 bp, Mus musculus
tgtgaatagacttgctaggccaggc

SEQ ID NO: 489526 - DNA, 25 bp, Mus musculus
tgtgaatagttctacccaggactgg

SEQ ID NO: 489527 - DNA, 25 bp, Mus musculus
tgtgaatcaaaccactccgaggctg

SEQ ID NO: 489528 - DNA, 25 bp, Mus musculus
tgtgaatcagtactctggaaggcac

SEQ ID NO: 489529 - DNA, 25 bp, Mus musculus
tgtgaatcccatagaaagctcagga

SEQ ID NO: 489530 - DNA, 25 bp, Mus musculus
tgtgaatcgagctttcccagtgagg

SEQ ID NO: 489531 - DNA, 25 bp, Mus musculus
tgtgaatcgtgatgtccgggacccc

SEQ ID NO: 489532 - DNA, 25 bp, Mus musculus
tgtgaatctcgttcgtggccgcgat

SEQ ID NO: 489533 - DNA, 25 bp, Mus musculus
tgtgaatgacaaaatccagtggcgg

SEQ ID NO: 489534 - DNA, 25 bp, Mus musculus
tgtgaatgacaatgcgccgcgcttc

SEQ ID NO: 489535 - DNA, 25 bp, Mus musculus
tgtgaatgcaaagctctgccaggct

SEQ ID NO: 489536 - DNA, 25 bp, Mus musculus
tgtgaatgcacagccgggtcacgtg

SEQ ID NO: 489537 - DNA, 25 bp, Mus musculus
tgtgaatggctaatccaagctccgg

SEQ ID NO: 489538 - DNA, 25 bp, Mus musculus
tgtgaatgtcttgtgccctctggaa

SEQ ID NO: 489539 - DNA, 25 bp, Mus musculus
tgtgaattagaaatcagcctgggct

SEQ ID NO: 489540 - DNA, 25 bp, Mus musculus
tgtgaattgcaacggaaagaagctg

SEQ ID NO: 489541 - DNA, 25 bp, Mus musculus
tgtgacaaagcagacgaggatgact

SEQ ID NO: 489542 - DNA, 25 bp, Mus musculus
tgtgacaacacactcaacggaggct

SEQ ID NO: 489543 - DNA, 25 bp, Mus musculus
tgtgacaacacactttctgatggct

SEQ ID NO: 489544 - DNA, 25 bp, Mus musculus
tgtgacaaggagtgcactgccctgc

SEQ ID NO: 489545 - DNA, 25 bp, Mus musculus
tgtgacaattagaatgctggctgcc

SEQ ID NO: 489546 - DNA, 25 bp, Mus musculus
tgtgacaattgtggagacgccaccg

SEQ ID NO: 489547 - DNA, 25 bp, Mus musculus
tgtgacacacgtgttcccagtggga

SEQ ID NO: 489548 - DNA, 25 bp, Mus musculus
tgtgacacaggatgactgtcccttg

SEQ ID NO: 489549 - DNA, 25 bp, Mus musculus
tgtgacaccaatgctgtattgcctc

SEQ ID NO: 489550 - DNA, 25 bp, Mus musculus
tgtgacacccgagcagttgactacc

SEQ ID NO: 489551 - DNA, 25 bp, Mus musculus
tgtgacacgcagatggaacttcgag

SEQ ID NO: 489552 - DNA, 25 bp, Mus musculus
tgtgacactgaatgacctcctggaa

SEQ ID NO: 489553 - DNA, 25 bp, Mus musculus
tgtgacacttagaggaccactggtg

SEQ ID NO: 489554 - DNA, 25 bp, Mus musculus
tgtgacagacgagtgcccaattgct

SEQ ID NO: 489555 - DNA, 25 bp, Mus musculus
tgtgacagacgtggaccttcagtgc

SEQ ID NO: 489556 - DNA, 25 bp, Mus musculus
tgtgacagagacaacaccgagtatg

SEQ ID NO: 489557 - DNA, 25 bp, Mus musculus
tgtgacagagacaatgctgacagcc

SEQ ID NO: 489558 - DNA, 25 bp, Mus musculus
tgtgacagagtgaacagtgactggg

SEQ ID NO: 489559 - DNA, 25 bp, Mus musculus
tgtgacagtgtggaagaccagctct

SEQ ID NO: 489560 - DNA, 25 bp, Mus musculus
tgtgacatatggagagaactgttgg

SEQ ID NO: 489561 - DNA, 25 bp, Mus musculus
tgtgacatcaggaaagctggcctct

SEQ ID NO: 489562 - DNA, 25 bp, Mus musculus
tgtgacatcgaaagcaggcagttgt

SEQ ID NO: 489563 - DNA, 25 bp, Mus musculus
tgtgacatgaactgtgcggaccggc

SEQ ID NO: 489564 - DNA, 25 bp, Mus musculus
tgtgacattgaccaagccaaggagc

SEQ ID NO: 489565 - DNA, 25 bp, Mus musculus
tgtgacattgactccagtctactta

SEQ ID NO: 489566 - DNA, 25 bp, Mus musculus
tgtgaccaacaagctagacatcggt

SEQ ID NO: 489567 - DNA, 25 bp, Mus musculus
tgtgaccaaggccttcagcctcggg

SEQ ID NO: 489568 - DNA, 25 bp, Mus musculus
tgtgaccacaagatcctacctgagt

SEQ ID NO: 489569 - DNA, 25 bp, Mus musculus
tgtgaccacccaaggctatatatgg

SEQ ID NO: 489570 - DNA, 25 bp, Mus musculus
tgtgaccacgcggatgagcagaagt

SEQ ID NO: 489571 - DNA, 25 bp, Mus musculus
tgtgaccagtgttcctatgcctgcg

SEQ ID NO: 489572 - DNA, 25 bp, Mus musculus
tgtgacccaccatgtaagacctgaa

SEQ ID NO: 489573 - DNA, 25 bp, Mus musculus
tgtgacccagcatgctctagtgaga

SEQ ID NO: 489574 - DNA, 25 bp, Mus musculus
tgtgacccggtaccagcctgtatgt

SEQ ID NO: 489575 - DNA, 25 bp, Mus musculus
tgtgacccgtaactttgtctcagga

SEQ ID NO: 489576 - DNA, 25 bp, Mus musculus
tgtgaccctacgatatagacactgg

SEQ ID NO: 489577 - DNA, 25 bp, Mus musculus
tgtgaccgagcactccatagctgct

SEQ ID NO: 489578 - DNA, 25 bp, Mus musculus
tgtgaccgagtaccaagattctgag

SEQ ID NO: 489579 - DNA, 25 bp, Mus musculus
tgtgaccgccccagtgaatatagca

SEQ ID NO: 489580 - DNA, 25 bp, Mus musculus
tgtgaccgctgtcgacaagtgcttt

SEQ ID NO: 489581 - DNA, 25 bp, Mus musculus
tgtgaccgggagaagcaaggctact

SEQ ID NO: 489582 - DNA, 25 bp, Mus musculus
tgtgaccgtctgttcacacagaggg

SEQ ID NO: 489583 - DNA, 25 bp, Mus musculus
tgtgacctagaaatgctcacctttt

SEQ ID NO: 489584 - DNA, 25 bp, Mus musculus
tgtgacctgctggaaaagcctagat

SEQ ID NO: 489585 - DNA, 25 bp, Mus musculus
tgtgaccttcctatgtgataaccgc

SEQ ID NO: 489586 - DNA, 25 bp, Mus musculus
tgtgacgaacatctggaatctagac

SEQ ID NO: 489587 - DNA, 25 bp, Mus musculus
tgtgacgacaaggtgaccgggctga

SEQ ID NO: 489588 - DNA, 25 bp, Mus musculus
tgtgacgacgctccagaaggaactg

SEQ ID NO: 489589 - DNA, 25 bp, Mus musculus
tgtgacgagtgcaatatggcctatc

SEQ ID NO: 489590 - DNA, 25 bp, Mus musculus
tgtgacgcagagttcctcctcaggg

SEQ ID NO: 489591 - DNA, 25 bp, Mus musculus
tgtgacgccagggttcttgagccct

SEQ ID NO: 489592 - DNA, 25 bp, Mus musculus
tgtgacgctgtcagagatgacccca

SEQ ID NO: 489593 - DNA, 25 bp, Mus musculus
tgtgacgtaaggagggctacacgca

SEQ ID NO: 489594 - DNA, 25 bp, Mus musculus
tgtgacgtgacaaaagccattccct

SEQ ID NO: 489595 - DNA, 25 bp, Mus musculus
tgtgactacggagatgtcagtcagt

SEQ ID NO: 489596 - DNA, 25 bp, Mus musculus
tgtgactatcaagaccatgctggaa

SEQ ID NO: 489597 - DNA, 25 bp, Mus musculus
tgtgactatcatgcctcagtggaga

SEQ ID NO: 489598 - DNA, 25 bp, Mus musculus
tgtgactcatgatgttgcccaggac

SEQ ID NO: 489599 - DNA, 25 bp, Mus musculus
tgtgactcattcaccaagcgctgtg

SEQ ID NO: 489600 - DNA, 25 bp, Mus musculus
tgtgactccccgagcagatatgaag

SEQ ID NO: 489601 - DNA, 25 bp, Mus musculus
tgtgactcggactggactggctact

SEQ ID NO: 489602 - DNA, 25 bp, Mus musculus
tgtgactctaccagaagactattgt

SEQ ID NO: 489603 - DNA, 25 bp, Mus musculus
tgtgactctctagatctgctgtcga

SEQ ID NO: 489604 - DNA, 25 bp, Mus musculus
tgtgactctgggaaaacgttgctgt

SEQ ID NO: 489605 - DNA, 25 bp, Mus musculus
tgtgactctgggtttaacaaacaga

SEQ ID NO: 489606 - DNA, 25 bp, Mus musculus
tgtgactcttctacctttcctagga

SEQ ID NO: 489607 - DNA, 25 bp, Mus musculus
tgtgactgaaaaccaaaaggatggg

SEQ ID NO: 489608 - DNA, 25 bp, Mus musculus
tgtgactgaagatacacctgaactg

SEQ ID NO: 489609 - DNA, 25 bp, Mus musculus
tgtgactgaatgcagagcctaccct

SEQ ID NO: 489610 - DNA, 25 bp, Mus musculus
tgtgactgctaacacaccaggaggc

SEQ ID NO: 489611 - DNA, 25 bp, Mus musculus
tgtgactgctgtcattcaggcgcca

SEQ ID NO: 489612 - DNA, 25 bp, Mus musculus
tgtgactgcttcagtaggccgctgc

SEQ ID NO: 489613 - DNA, 25 bp, Mus musculus
tgtgactgctttacaatggccaggc

SEQ ID NO: 489614 - DNA, 25 bp, Mus musculus
tgtgactgtaactctggcaaactgc

SEQ ID NO: 489615 - DNA, 25 bp, Mus musculus
tgtgacttccaagacgcctgggaca

SEQ ID NO: 489616 - DNA, 25 bp, Mus musculus
tgtgacttcctagagcagagaacgt

SEQ ID NO: 489617 - DNA, 25 bp, Mus musculus
tgtgacttctaacagtaacactgga

SEQ ID NO: 489618 - DNA, 25 bp, Mus musculus
tgtgacttggcacttcgggctcatc

SEQ ID NO: 489619 - DNA, 25 bp, Mus musculus
tgtgactttgcccaggtcccgtcag

SEQ ID NO: 489620 - DNA, 25 bp, Mus musculus
tgtgagaacaaaggtagacactgac

SEQ ID NO: 489621 - DNA, 25 bp, Mus musculus
tgtgagaacatggtcgcgttcccca

SEQ ID NO: 489622 - DNA, 25 bp, Mus musculus
tgtgagaacgtctgctacgaccgcg

SEQ ID NO: 489623 - DNA, 25 bp, Mus musculus
tgtgagaactttgacctgtgcgtgg

SEQ ID NO: 489624 - DNA, 25 bp, Mus musculus
tgtgagaagagaatccgaatcctgg

SEQ ID NO: 489625 - DNA, 25 bp, Mus musculus
tgtgagaagatgtcagagtccctgg

SEQ ID NO: 489626 - DNA, 25 bp, Mus musculus
tgtgagaagcactagacagactgtg

SEQ ID NO: 489627 - DNA, 25 bp, Mus musculus
tgtgagaagtcgtgtacagccagac

SEQ ID NO: 489628 - DNA, 25 bp, Mus musculus
tgtgagaatcataaccgggagcttc

SEQ ID NO: 489629 - DNA, 25 bp, Mus musculus
tgtgagacagtaacacctgaaggga

SEQ ID NO: 489630 - DNA, 25 bp, Mus musculus
tgtgagacgccaagacacatctgga

SEQ ID NO: 489631 - DNA, 25 bp, Mus musculus
tgtgagactcaagggaaaggcaaga

SEQ ID NO: 489632 - DNA, 25 bp, Mus musculus
tgtgagagcaagaaaccccaggctg

SEQ ID NO: 489633 - DNA, 25 bp, Mus musculus
tgtgagagccttcagcaactggaca

SEQ ID NO: 489634 - DNA, 25 bp, Mus musculus
tgtgagatatctaggagcagttggc

SEQ ID NO: 489635 - DNA, 25 bp, Mus musculus
tgtgagatatggctttctccctgga

SEQ ID NO: 489636 - DNA, 25 bp, Mus musculus
tgtgagatgcacaggtggctaccac

SEQ ID NO: 489637 - DNA, 25 bp, Mus musculus
tgtgagatgtctaatcccctgggca

SEQ ID NO: 489638 - DNA, 25 bp, Mus musculus
tgtgagattgacttgccggactgca

SEQ ID NO: 489639 - DNA, 25 bp, Mus musculus
tgtgagcaacaccatatttgctggt

SEQ ID NO: 489640 - DNA, 25 bp, Mus musculus
tgtgagcaagaaggatgccccagaa

SEQ ID NO: 489641 - DNA, 25 bp, Mus musculus
tgtgagcacaacaccaacttgaagc

SEQ ID NO: 489642 - DNA, 25 bp, Mus musculus
tgtgagcacagcctctggcactgct

SEQ ID NO: 489643 - DNA, 25 bp, Mus musculus
tgtgagcaccccaactgcctataga

SEQ ID NO: 489644 - DNA, 25 bp, Mus musculus
tgtgagcagagtaagcaactggacc

SEQ ID NO: 489645 - DNA, 25 bp, Mus musculus
tgtgagcagcccacggccattaact

SEQ ID NO: 489646 - DNA, 25 bp, Mus musculus
tgtgagcagtgagcttaacagcacc

SEQ ID NO: 489647 - DNA, 25 bp, Mus musculus
tgtgagcatcctacgtacagacttg

SEQ ID NO: 489648 - DNA, 25 bp, Mus musculus
tgtgagcatgaaggcccacaagctg

SEQ ID NO: 489649 - DNA, 25 bp, Mus musculus
tgtgagcattcagcaaaagaggcca

SEQ ID NO: 489650 - DNA, 25 bp, Mus musculus
tgtgagcatttgtgacccctgtgag

SEQ ID NO: 489651 - DNA, 25 bp, Mus musculus
tgtgagccaaaagagcccttccctt

SEQ ID NO: 489652 - DNA, 25 bp, Mus musculus
tgtgagccacggataaaaagcagct

SEQ ID NO: 489653 - DNA, 25 bp, Mus musculus
tgtgagccactccagccatttcggt

SEQ ID NO: 489654 - DNA, 25 bp, Mus musculus
tgtgagccacttgaccagctactca

SEQ ID NO: 489655 - DNA, 25 bp, Mus musculus
tgtgagccactttaccccagatgag

SEQ ID NO: 489656 - DNA, 25 bp, Mus musculus
tgtgagccagtcagtcttggtgctg

SEQ ID NO: 489657 - DNA, 25 bp, Mus musculus
tgtgagccagtcatggcagaaaccc

SEQ ID NO: 489658 - DNA, 25 bp, Mus musculus
tgtgagccccaagtcatcaaacctg

SEQ ID NO: 489659 - DNA, 25 bp, Mus musculus
tgtgagccccagaaaatcccgggtg

SEQ ID NO: 489660 - DNA, 25 bp, Mus musculus
tgtgagccccagaactatcatcagg

SEQ ID NO: 489661 - DNA, 25 bp, Mus musculus
tgtgagccctgttccattttctttg

SEQ ID NO: 489662 - DNA, 25 bp, Mus musculus
tgtgagccctttgcagccggagcca

SEQ ID NO: 489663 - DNA, 25 bp, Mus musculus
tgtgagccgatgaagccgaagcact

SEQ ID NO: 489664 - DNA, 25 bp, Mus musculus
tgtgagccgccatggccgattgtta

SEQ ID NO: 489665 - DNA, 25 bp, Mus musculus
tgtgagcctgctaaccctcgtggtt

SEQ ID NO: 489666 - DNA, 25 bp, Mus musculus
tgtgagcctggtttgggtcctgacc

SEQ ID NO: 489667 - DNA, 25 bp, Mus musculus
tgtgagcctttgcagaatttgaagc

SEQ ID NO: 489668 - DNA, 25 bp, Mus musculus
tgtgagcgaataccagctttacccc

SEQ ID NO: 489669 - DNA, 25 bp, Mus musculus
tgtgagcgcagtctctacagagctg

SEQ ID NO: 489670 - DNA, 25 bp, Mus musculus
tgtgagcggccattgagttctagga

SEQ ID NO: 489671 - DNA, 25 bp, Mus musculus
tgtgagcggctgctctgaacagcaa

SEQ ID NO: 489672 - DNA, 25 bp, Mus musculus
tgtgagctacccagggacatcatcc

SEQ ID NO: 489673 - DNA, 25 bp, Mus musculus
tgtgagctatgtgactctccctgga

SEQ ID NO: 489674 - DNA, 25 bp, Mus musculus
tgtgagctcaccttgcagaatgcca

SEQ ID NO: 489675 - DNA, 25 bp, Mus musculus
tgtgagctctgaatcccaattctgt

SEQ ID NO: 489676 - DNA, 25 bp, Mus musculus
tgtgagctctgacttggccaaggcc

SEQ ID NO: 489677 - DNA, 25 bp, Mus musculus
tgtgagctgccttcctcgggatctg

SEQ ID NO: 489678 - DNA, 25 bp, Mus musculus
tgtgagctggtcaaagagcccggct

SEQ ID NO: 489679 - DNA, 25 bp, Mus musculus
tgtgagctgtgtccccataaagatg

SEQ ID NO: 489680 - DNA, 25 bp, Mus musculus
tgtgaggaaccaccgtcaagcttca

SEQ ID NO: 489681 - DNA, 25 bp, Mus musculus
tgtgaggaatacacgcgagctgcct

SEQ ID NO: 489682 - DNA, 25 bp, Mus musculus
tgtgaggacacttgagcagaacgga

SEQ ID NO: 489683 - DNA, 25 bp, Mus musculus
tgtgaggaccatctctggcattccg

SEQ ID NO: 489684 - DNA, 25 bp, Mus musculus
tgtgaggagctgtcagttcccgcat

SEQ ID NO: 489685 - DNA, 25 bp, Mus musculus
tgtgaggcacactacagcaccaaga

SEQ ID NO: 489686 - DNA, 25 bp, Mus musculus
tgtgaggcaggagctcatggaccct

SEQ ID NO: 489687 - DNA, 25 bp, Mus musculus
tgtgaggctcaagactgctgggaac

SEQ ID NO: 489688 - DNA, 25 bp, Mus musculus
tgtgaggcttcgtggcgtctttcca

SEQ ID NO: 489689 - DNA, 25 bp, Mus musculus
tgtgagggttctagcaccaaagcgc

SEQ ID NO: 489690 - DNA, 25 bp, Mus musculus
tgtgaggtaccactacaacggaacg

SEQ ID NO: 489691 - DNA, 25 bp, Mus musculus
tgtgaggtatgtgtgtcagttactg

SEQ ID NO: 489692 - DNA, 25 bp, Mus musculus
tgtgagtacaggatccatgctgaaa

SEQ ID NO: 489693 - DNA, 25 bp, Mus musculus
tgtgagtaccagagagccaagtgcc

SEQ ID NO: 489694 - DNA, 25 bp, Mus musculus
tgtgagtagtagtcatgccctcctc

SEQ ID NO: 489695 - DNA, 25 bp, Mus musculus
tgtgagtcaagacaacttttccctg

SEQ ID NO: 489696 - DNA, 25 bp, Mus musculus
tgtgagtcactagcctggagcagaa

SEQ ID NO: 489697 - DNA, 25 bp, Mus musculus
tgtgagtcagaacacagagtaactc

SEQ ID NO: 489698 - DNA, 25 bp, Mus musculus
tgtgagtcattaacagtcctaactg

SEQ ID NO: 489699 - DNA, 25 bp, Mus musculus
tgtgagtcccacatccggaagaagt

SEQ ID NO: 489700 - DNA, 25 bp, Mus musculus
tgtgagtctatgaaggagcagctgc

SEQ ID NO: 489701 - DNA, 25 bp, Mus musculus
tgtgagtctttacggcaaccctgtc

SEQ ID NO: 489702 - DNA, 25 bp, Mus musculus
tgtgagtctttgtatcaagtagcac

SEQ ID NO: 489703 - DNA, 25 bp, Mus musculus
tgtgagtgaacaatgagccaccttc

SEQ ID NO: 489704 - DNA, 25 bp, Mus musculus
tgtgagtgacaccacctggcaggaa

SEQ ID NO: 489705 - DNA, 25 bp, Mus musculus
tgtgagtgaccccatatttgctggt

SEQ ID NO: 489706 - DNA, 25 bp, Mus musculus
tgtgagtgactaaccagacggcgag

SEQ ID NO: 489707 - DNA, 25 bp, Mus musculus
tgtgagtgcactgcactgtgtggcc

SEQ ID NO: 489708 - DNA, 25 bp, Mus musculus
tgtgagtgccactccctcaccagta

SEQ ID NO: 489709 - DNA, 25 bp, Mus musculus
tgtgagttatccaagcgtgccagcc

SEQ ID NO: 489710 - DNA, 25 bp, Mus musculus
tgtgagtttgcaacccaggtggccc

SEQ ID NO: 489711 - DNA, 25 bp, Mus musculus
tgtgataacacccaagagccaggaa

SEQ ID NO: 489712 - DNA, 25 bp, Mus musculus
tgtgataaggctgacattgactggg

SEQ ID NO: 489713 - DNA, 25 bp, Mus musculus
tgtgatacaatgttgaacaaagtga

SEQ ID NO: 489714 - DNA, 25 bp, Mus musculus
tgtgatacattactaagagatgctg

SEQ ID NO: 489715 - DNA, 25 bp, Mus musculus
tgtgataccactccaattgccggct

SEQ ID NO: 489716 - DNA, 25 bp, Mus musculus
tgtgatacgcccattcctgaaagag

SEQ ID NO: 489717 - DNA, 25 bp, Mus musculus
tgtgatactccggacaagtgtttgg

SEQ ID NO: 489718 - DNA, 25 bp, Mus musculus
tgtgatagaagtgagcaatagaccc

SEQ ID NO: 489719 - DNA, 25 bp, Mus musculus
tgtgatagccaacaaactgaccgtc

SEQ ID NO: 489720 - DNA, 25 bp, Mus musculus
tgtgatagcccagcattctccattt

SEQ ID NO: 489721 - DNA, 25 bp, Mus musculus
tgtgatatatcatgcatctgtttcg

SEQ ID NO: 489722 - DNA, 25 bp, Mus musculus
tgtgatatcaccagcatatggcatg

SEQ ID NO: 489723 - DNA, 25 bp, Mus musculus
tgtgatcaagatgtgcaccgctaca

SEQ ID NO: 489724 - DNA, 25 bp, Mus musculus
tgtgatcagatcaacaaagagcttg

SEQ ID NO: 489725 - DNA, 25 bp, Mus musculus
tgtgatcagcatcaactccctgggc

SEQ ID NO: 489726 - DNA, 25 bp, Mus musculus
tgtgatcatcacagccaaccgggtg

SEQ ID NO: 489727 - DNA, 25 bp, Mus musculus
tgtgatcatgatccgccttcagaaa

SEQ ID NO: 489728 - DNA, 25 bp, Mus musculus
tgtgatccaaggacatcatttatgg

SEQ ID NO: 489729 - DNA, 25 bp, Mus musculus
tgtgatccaggaccccgagagaatt

SEQ ID NO: 489730 - DNA, 25 bp, Mus musculus
tgtgatcccacctttgagctggagg

SEQ ID NO: 489731 - DNA, 25 bp, Mus musculus
tgtgatccccgtagaaaagaggcag

SEQ ID NO: 489732 - DNA, 25 bp, Mus musculus
tgtgatcccctacggctcagagtga

SEQ ID NO: 489733 - DNA, 25 bp, Mus musculus
tgtgatccgtcatgtgaaagctgcg

SEQ ID NO: 489734 - DNA, 25 bp, Mus musculus
tgtgatccgtttctcatttcagacg

SEQ ID NO: 489735 - DNA, 25 bp, Mus musculus
tgtgatcctcactaaataaaatagc

SEQ ID NO: 489736 - DNA, 25 bp, Mus musculus
tgtgatcctgcgctacgccaagatg

SEQ ID NO: 489737 - DNA, 25 bp, Mus musculus
tgtgatctcacacttaaaaatcaag

SEQ ID NO: 489738 - DNA, 25 bp, Mus musculus
tgtgatctgcactggccacttggca

SEQ ID NO: 489739 - DNA, 25 bp, Mus musculus
tgtgatctgtaaagtctctcaggtg

SEQ ID NO: 489740 - DNA, 25 bp, Mus musculus
tgtgatctgtgacgtgtgcccctgt

SEQ ID NO: 489741 - DNA, 25 bp, Mus musculus
tgtgatcttacaggtgcagcccgct

SEQ ID NO: 489742 - DNA, 25 bp, Mus musculus
tgtgatcttgcctccttagtattgg

SEQ ID NO: 489743 - DNA, 25 bp, Mus musculus
tgtgatgaacatacatccgtgacat

SEQ ID NO: 489744 - DNA, 25 bp, Mus musculus
tgtgatgaacgtagtgcaggtgcca

SEQ ID NO: 489745 - DNA, 25 bp, Mus musculus
tgtgatgaccttcctgataagcagc

SEQ ID NO: 489746 - DNA, 25 bp, Mus musculus
tgtgatgagagaaacgctcgcttgc

SEQ ID NO: 489747 - DNA, 25 bp, Mus musculus
tgtgatgatggcttccatccctgat

SEQ ID NO: 489748 - DNA, 25 bp, Mus musculus
tgtgatgattgtccgctgccggcca

SEQ ID NO: 489749 - DNA, 25 bp, Mus musculus
tgtgatgcaggactaggtgcttccc

SEQ ID NO: 489750 - DNA, 25 bp, Mus musculus
tgtgatgcccgtggagttacaaagc

SEQ ID NO: 489751 - DNA, 25 bp, Mus musculus
tgtgatggaccaacagaccgagata

SEQ ID NO: 489752 - DNA, 25 bp, Mus musculus
tgtgatggaccccaaaaaggacgtc

SEQ ID NO: 489753 - DNA, 25 bp, Mus musculus
tgtgatggctagtattgaccgtcaa

SEQ ID NO: 489754 - DNA, 25 bp, Mus musculus
tgtgatggtaactagaagcaatgca

SEQ ID NO: 489755 - DNA, 25 bp, Mus musculus
tgtgatggtgaacaactaccgcccg

SEQ ID NO: 489756 - DNA, 25 bp, Mus musculus
tgtgatgtacaattccacccagaga

SEQ ID NO: 489757 - DNA, 25 bp, Mus musculus
tgtgatgtcccctaacagggaagat

SEQ ID NO: 489758 - DNA, 25 bp, Mus musculus
tgtgattacctagaccgtgggcagc

SEQ ID NO: 489759 - DNA, 25 bp, Mus musculus
tgtgattagctggaattggcctcca

SEQ ID NO: 489760 - DNA, 25 bp, Mus musculus
tgtgattccagccatgggtgcctca

SEQ ID NO: 489761 - DNA, 25 bp, Mus musculus
tgtgattccagtgagccgacttccc

SEQ ID NO: 489762 - DNA, 25 bp, Mus musculus
tgtgattcgagcacacatgaactgt

SEQ ID NO: 489763 - DNA, 25 bp, Mus musculus
tgtgattgacctgtgcagacgcccc

SEQ ID NO: 489764 - DNA, 25 bp, Mus musculus
tgtgattgctgacctgaggaacgcc

SEQ ID NO: 489765 - DNA, 25 bp, Mus musculus
tgtgattgtacaggagccagcggca

SEQ ID NO: 489766 - DNA, 25 bp, Mus musculus
tgtgatttccatagtggacccctgg

SEQ ID NO: 489767 - DNA, 25 bp, Mus musculus
tgtgcaaagatcaacagacgggctg

SEQ ID NO: 489768 - DNA, 25 bp, Mus musculus
tgtgcaaagctccactcggtgacgc

SEQ ID NO: 489769 - DNA, 25 bp, Mus musculus
tgtgcaaaggaagtgaagccagcca

SEQ ID NO: 489770 - DNA, 25 bp, Mus musculus
tgtgcaaatagtggtgtgcctgccc

SEQ ID NO: 489771 - DNA, 25 bp, Mus musculus
tgtgcaacaggagagcgacacagca

SEQ ID NO: 489772 - DNA, 25 bp, Mus musculus
tgtgcaactggaaacgggaaccttt

SEQ ID NO: 489773 - DNA, 25 bp, Mus musculus
tgtgcaagaggaaagcccagagctc

SEQ ID NO: 489774 - DNA, 25 bp, Mus musculus
tgtgcaagatgtaccagcctgagaa

SEQ ID NO: 489775 - DNA, 25 bp, Mus musculus
tgtgcaagctgcgtgtcccacttgc

SEQ ID NO: 489776 - DNA, 25 bp, Mus musculus
tgtgcaaggacagcaaacagacctc

SEQ ID NO: 489777 - DNA, 25 bp, Mus musculus
tgtgcaagtagaaagccagcctgtg

SEQ ID NO: 489778 - DNA, 25 bp, Mus musculus
tgtgcaagtagcaacctgagcccct

SEQ ID NO: 489779 - DNA, 25 bp, Mus musculus
tgtgcaagtccctgctggtcatcct

SEQ ID NO: 489780 - DNA, 25 bp, Mus musculus
tgtgcaataagagcagcacgggtcc

SEQ ID NO: 489781 - DNA, 25 bp, Mus musculus
tgtgcaatatacagcccagggaggg

SEQ ID NO: 489782 - DNA, 25 bp, Mus musculus
tgtgcaatattccaccctggcagaa

SEQ ID NO: 489783 - DNA, 25 bp, Mus musculus
tgtgcaatcacaagtccttctggag

SEQ ID NO: 489784 - DNA, 25 bp, Mus musculus
tgtgcaatgcagagagtcgagcccg

SEQ ID NO: 489785 - DNA, 25 bp, Mus musculus
tgtgcacacaagctagttttatcta

SEQ ID NO: 489786 - DNA, 25 bp, Mus musculus
tgtgcacagagcatacctagctacc

SEQ ID NO: 489787 - DNA, 25 bp, Mus musculus
tgtgcacagcatggaggaactccca

SEQ ID NO: 489788 - DNA, 25 bp, Mus musculus
tgtgcacaggcagttgcaccagccg

SEQ ID NO: 489789 - DNA, 25 bp, Mus musculus
tgtgcacagtgtcaccactgcagca

SEQ ID NO: 489790 - DNA, 25 bp, Mus musculus
tgtgcacatgctcatatgttcctgc

SEQ ID NO: 489791 - DNA, 25 bp, Mus musculus
tgtgcacattgggaaacgctacctg

SEQ ID NO: 489792 - DNA, 25 bp, Mus musculus
tgtgcaccaagaccaagcctatgat

SEQ ID NO: 489793 - DNA, 25 bp, Mus musculus
tgtgcaccagacaagtgcaagtctt

SEQ ID NO: 489794 - DNA, 25 bp, Mus musculus
tgtgcaccaggaaaacaccaggaaa

SEQ ID NO: 489795 - DNA, 25 bp, Mus musculus
tgtgcaccccgtgggtcatggtgct

SEQ ID NO: 489796 - DNA, 25 bp, Mus musculus
tgtgcaccgtgtagtgggactccaa

SEQ ID NO: 489797 - DNA, 25 bp, Mus musculus
tgtgcacctcggaccctgattggca

SEQ ID NO: 489798 - DNA, 25 bp, Mus musculus
tgtgcacctggcaggtatgagcccc

SEQ ID NO: 489799 - DNA, 25 bp, Mus musculus
tgtgcaccttcacctacctgctggt

SEQ ID NO: 489800 - DNA, 25 bp, Mus musculus
tgtgcacgctaattcttaaccacgt

SEQ ID NO: 489801 - DNA, 25 bp, Mus musculus
tgtgcacggaaaggctagccagcta

SEQ ID NO: 489802 - DNA, 25 bp, Mus musculus
tgtgcacggacaaggatggagccct

SEQ ID NO: 489803 - DNA, 25 bp, Mus musculus
tgtgcacggagctacaacgtctggg

SEQ ID NO: 489804 - DNA, 25 bp, Mus musculus
tgtgcacgtgactaatgatgaccgg

SEQ ID NO: 489805 - DNA, 25 bp, Mus musculus
tgtgcactagatgccgtcaccagag

SEQ ID NO: 489806 - DNA, 25 bp, Mus musculus
tgtgcactcacctgaataaatgtca

SEQ ID NO: 489807 - DNA, 25 bp, Mus musculus
tgtgcactccggaggaggagccagc

SEQ ID NO: 489808 - DNA, 25 bp, Mus musculus
tgtgcactctccattccagctctgt

SEQ ID NO: 489809 - DNA, 25 bp, Mus musculus
tgtgcactgaatacactgactgtcc

SEQ ID NO: 489810 - DNA, 25 bp, Mus musculus
tgtgcactgcaaagagaaggccttc

SEQ ID NO: 489811 - DNA, 25 bp, Mus musculus
tgtgcactgcggctacacccggtgc

SEQ ID NO: 489812 - DNA, 25 bp, Mus musculus
tgtgcactggcaggccaggtgatac

SEQ ID NO: 489813 - DNA, 25 bp, Mus musculus
tgtgcactggcctctgatttcaggt

SEQ ID NO: 489814 - DNA, 25 bp, Mus musculus
tgtgcacttgatgagattcctggct

SEQ ID NO: 489815 - DNA, 25 bp, Mus musculus
tgtgcacttgccttgtccaaactgg

SEQ ID NO: 489816 - DNA, 25 bp, Mus musculus
tgtgcacttttaaaattcacggtga

SEQ ID NO: 489817 - DNA, 25 bp, Mus musculus
tgtgcagaaccttacatgcgcatct

SEQ ID NO: 489818 - DNA, 25 bp, Mus musculus
tgtgcagaaggtcaccgacagcttg

SEQ ID NO: 489819 - DNA, 25 bp, Mus musculus
tgtgcagaagtcaaagcgggaacct

SEQ ID NO: 489820 - DNA, 25 bp, Mus musculus
tgtgcagacagaccagtagtagccc

SEQ ID NO: 489821 - DNA, 25 bp, Mus musculus
tgtgcagaccacagagcaagacctt

SEQ ID NO: 489822 - DNA, 25 bp, Mus musculus
tgtgcagagccaccaaaagggatcc

SEQ ID NO: 489823 - DNA, 25 bp, Mus musculus
tgtgcagaggatttacgaatgcttg

SEQ ID NO: 489824 - DNA, 25 bp, Mus musculus
tgtgcagagggctatatcctcaacg

SEQ ID NO: 489825 - DNA, 25 bp, Mus musculus
tgtgcagagtggaatggatcacaga

SEQ ID NO: 489826 - DNA, 25 bp, Mus musculus
tgtgcagagtggcagaacattgcca

SEQ ID NO: 489827 - DNA, 25 bp, Mus musculus
tgtgcagcacggacagcctggatga

SEQ ID NO: 489828 - DNA, 25 bp, Mus musculus
tgtgcagccgcaccatattggcgtg

SEQ ID NO: 489829 - DNA, 25 bp, Mus musculus
tgtgcagcgctcagacaatgggtcg

SEQ ID NO: 489830 - DNA, 25 bp, Mus musculus
tgtgcagcggagaagtcgctcacca

SEQ ID NO: 489831 - DNA, 25 bp, Mus musculus
tgtgcagcggctacagtctcgagtg

SEQ ID NO: 489832 - DNA, 25 bp, Mus musculus
tgtgcagctccttcttctactgctg

SEQ ID NO: 489833 - DNA, 25 bp, Mus musculus
tgtgcaggacctagacgatgacacc

SEQ ID NO: 489834 - DNA, 25 bp, Mus musculus
tgtgcaggactaaatctacaagtga

SEQ ID NO: 489835 - DNA, 25 bp, Mus musculus
tgtgcaggcgcacagcaaatgatgc

SEQ ID NO: 489836 - DNA, 25 bp, Mus musculus
tgtgcagggtttggccttcaccaac

SEQ ID NO: 489837 - DNA, 25 bp, Mus musculus
tgtgcaggtaccaggagacaggctc

SEQ ID NO: 489838 - DNA, 25 bp, Mus musculus
tgtgcaggtcctctcgatcgcaagg

SEQ ID NO: 489839 - DNA, 25 bp, Mus musculus
tgtgcaggtctggagtccctcagtc

SEQ ID NO: 489840 - DNA, 25 bp, Mus musculus
tgtgcaggtgttgaccatgggcaat

SEQ ID NO: 489841 - DNA, 25 bp, Mus musculus
tgtgcagtaagatgtgactcacgtc

SEQ ID NO: 489842 - DNA, 25 bp, Mus musculus
tgtgcagtaatctggaccacgtggt

SEQ ID NO: 489843 - DNA, 25 bp, Mus musculus
tgtgcagtacaaaaccaagcgggaa

SEQ ID NO: 489844 - DNA, 25 bp, Mus musculus
tgtgcagtatccgaaagagctccag

SEQ ID NO: 489845 - DNA, 25 bp, Mus musculus
tgtgcagtcatagtggtaaagaaac

SEQ ID NO: 489846 - DNA, 25 bp, Mus musculus
tgtgcagtccgatgaacgacttcag

SEQ ID NO: 489847 - DNA, 25 bp, Mus musculus
tgtgcagtctctaaggggccctaag

SEQ ID NO: 489848 - DNA, 25 bp, Mus musculus
tgtgcagtgactgacatggcgccca

SEQ ID NO: 489849 - DNA, 25 bp, Mus musculus
tgtgcagtgtcctctagtagcccag

SEQ ID NO: 489850 - DNA, 25 bp, Mus musculus
tgtgcagttcggtggctctccgcag

SEQ ID NO: 489851 - DNA, 25 bp, Mus musculus
tgtgcagtttgtaagaagttgctcc

SEQ ID NO: 489852 - DNA, 25 bp, Mus musculus
tgtgcataccaaaaggctgtcagct

SEQ ID NO: 489853 - DNA, 25 bp, Mus musculus
tgtgcatagaagttacaccccagag

SEQ ID NO: 489854 - DNA, 25 bp, Mus musculus
tgtgcatatggaagacactggaccc

SEQ ID NO: 489855 - DNA, 25 bp, Mus musculus
tgtgcatcaccaggagaatgtgcgg

SEQ ID NO: 489856 - DNA, 25 bp, Mus musculus
tgtgcatcccaggagaggcctatgg

SEQ ID NO: 489857 - DNA, 25 bp, Mus musculus
tgtgcatctccaaactgccagctgt

SEQ ID NO: 489858 - DNA, 25 bp, Mus musculus
tgtgcatctccttaaccaactctgg

SEQ ID NO: 489859 - DNA, 25 bp, Mus musculus
tgtgcatctttatgctgaccactcc

SEQ ID NO: 489860 - DNA, 25 bp, Mus musculus
tgtgcatgagaaccgcaagtccagg

SEQ ID NO: 489861 - DNA, 25 bp, Mus musculus
tgtgcatgcgagtctttgtgcggcc

SEQ ID NO: 489862 - DNA, 25 bp, Mus musculus
tgtgcatgctatggcttacccagaa

SEQ ID NO: 489863 - DNA, 25 bp, Mus musculus
tgtgcatgtccatgtgtaccaatgc

SEQ ID NO: 489864 - DNA, 25 bp, Mus musculus
tgtgcatgtctcaggcctgatatgg

SEQ ID NO: 489865 - DNA, 25 bp, Mus musculus
tgtgcatgtgaacagcgagcgctct

SEQ ID NO: 489866 - DNA, 25 bp, Mus musculus
tgtgcatgtgcaacaacgagacgcc

SEQ ID NO: 489867 - DNA, 25 bp, Mus musculus
tgtgcatgttcaagcccctgggatt

SEQ ID NO: 489868 - DNA, 25 bp, Mus musculus
tgtgcatgttccaagaggtgtcccc

SEQ ID NO: 489869 - DNA, 25 bp, Mus musculus
tgtgcattagagacctgctgtgtaa

SEQ ID NO: 489870 - DNA, 25 bp, Mus musculus
tgtgcattataacacaaatgtgtgc

SEQ ID NO: 489871 - DNA, 25 bp, Mus musculus
tgtgcatttgatctgctcagcagtg

SEQ ID NO: 489872 - DNA, 25 bp, Mus musculus
tgtgcatttttcctggccatgacgt

SEQ ID NO: 489873 - DNA, 25 bp, Mus musculus
tgtgccaaaaagtaatccacccatc

SEQ ID NO: 489874 - DNA, 25 bp, Mus musculus
tgtgccaacgacagtgacacgctgg

SEQ ID NO: 489875 - DNA, 25 bp, Mus musculus
tgtgccaaggcatggatcacctgga

SEQ ID NO: 489876 - DNA, 25 bp, Mus musculus
tgtgccaaggcgtgttgacctccgt

SEQ ID NO: 489877 - DNA, 25 bp, Mus musculus
tgtgccaatgcccaggaagctcttt

SEQ ID NO: 489878 - DNA, 25 bp, Mus musculus
tgtgccaatggctagtcaagtgagg

SEQ ID NO: 489879 - DNA, 25 bp, Mus musculus
tgtgccacaggagaaagcaactttg

SEQ ID NO: 489880 - DNA, 25 bp, Mus musculus
tgtgccacagtttagctctcagtgt

SEQ ID NO: 489881 - DNA, 25 bp, Mus musculus
tgtgccacatgagagtgtttttaac

SEQ ID NO: 489882 - DNA, 25 bp, Mus musculus
tgtgccaccagcatgagagtgaggc

SEQ ID NO: 489883 - DNA, 25 bp, Mus musculus
tgtgccacccagagcaattgtcctc

SEQ ID NO: 489884 - DNA, 25 bp, Mus musculus
tgtgccaccctagctcttaagcttg

SEQ ID NO: 489885 - DNA, 25 bp, Mus musculus
tgtgccaccgacacccagatgtgat

SEQ ID NO: 489886 - DNA, 25 bp, Mus musculus
tgtgccaccgggactatcaaggtgg

SEQ ID NO: 489887 - DNA, 25 bp, Mus musculus
tgtgccactagactgtgtccccaac

SEQ ID NO: 489888 - DNA, 25 bp, Mus musculus
tgtgccactgtatgacaagcaagcc

SEQ ID NO: 489889 - DNA, 25 bp, Mus musculus
tgtgccactttagatagaaccaggg

SEQ ID NO: 489890 - DNA, 25 bp, Mus musculus
tgtgccagatgtggacctgtccggt

SEQ ID NO: 489891 - DNA, 25 bp, Mus musculus
tgtgccagattttctcagaggagga

SEQ ID NO: 489892 - DNA, 25 bp, Mus musculus
tgtgccagcgatcagcagccaatga

SEQ ID NO: 489893 - DNA, 25 bp, Mus musculus
tgtgccagctggagagactctgcct

SEQ ID NO: 489894 - DNA, 25 bp, Mus musculus
tgtgccaggacagccatacttggag

SEQ ID NO: 489895 - DNA, 25 bp, Mus musculus
tgtgccaggataaactcaagaaaac

SEQ ID NO: 489896 - DNA, 25 bp, Mus musculus
tgtgccaggcaccagctggaatccg

SEQ ID NO: 489897 - DNA, 25 bp, Mus musculus
tgtgccaggcatctctaagctctgc

SEQ ID NO: 489898 - DNA, 25 bp, Mus musculus
tgtgccagggagaaatggaagagac

SEQ ID NO: 489899 - DNA, 25 bp, Mus musculus
tgtgccagtggaagaggaccaacgc

SEQ ID NO: 489900 - DNA, 25 bp, Mus musculus
tgtgccatcagtgttgaaacccgac

SEQ ID NO: 489901 - DNA, 25 bp, Mus musculus
tgtgccatccccatacaagtcagag

SEQ ID NO: 489902 - DNA, 25 bp, Mus musculus
tgtgccatccttgtcgacatctaat

SEQ ID NO: 489903 - DNA, 25 bp, Mus musculus
tgtgccatgaacaaggagtccccac

SEQ ID NO: 489904 - DNA, 25 bp, Mus musculus
tgtgccatgccaggatctcaaggtc

SEQ ID NO: 489905 - DNA, 25 bp, Mus musculus
tgtgccatgccatgccaggtcagtg

SEQ ID NO: 489906 - DNA, 25 bp, Mus musculus
tgtgcccaagttcctgccaagtgta

SEQ ID NO: 489907 - DNA, 25 bp, Mus musculus
tgtgcccacatcctagccattagct

SEQ ID NO: 489908 - DNA, 25 bp, Mus musculus
tgtgcccacccaagtgagtatctga

SEQ ID NO: 489909 - DNA, 25 bp, Mus musculus
tgtgcccacgaggaacttctccgag

SEQ ID NO: 489910 - DNA, 25 bp, Mus musculus
tgtgcccagaccagtcggtaggttt

SEQ ID NO: 489911 - DNA, 25 bp, Mus musculus
tgtgcccagagtagcaagctcaacc

SEQ ID NO: 489912 - DNA, 25 bp, Mus musculus
tgtgcccagatattacccctcaagg

SEQ ID NO: 489913 - DNA, 25 bp, Mus musculus
tgtgcccagtatggtctcagaatca

SEQ ID NO: 489914 - DNA, 25 bp, Mus musculus
tgtgcccatccatttccacctgtgt

SEQ ID NO: 489915 - DNA, 25 bp, Mus musculus
tgtgcccatctgtggtgcgctgtcc

SEQ ID NO: 489916 - DNA, 25 bp, Mus musculus
tgtgccccaagactgaccctgggtg

SEQ ID NO: 489917 - DNA, 25 bp, Mus musculus
tgtgccccgagtggacagtcgtctt

SEQ ID NO: 489918 - DNA, 25 bp, Mus musculus
tgtgccccggaagtggacataccga

SEQ ID NO: 489919 - DNA, 25 bp, Mus musculus
tgtgccccggtgtgtcctctcaggg

SEQ ID NO: 489920 - DNA, 25 bp, Mus musculus
tgtgccccgtgaaaaggtcttccag

SEQ ID NO: 489921 - DNA, 25 bp, Mus musculus
tgtgccccgtttgctagccagataa

SEQ ID NO: 489922 - DNA, 25 bp, Mus musculus
tgtgcccctattaaaaagtgacgct

SEQ ID NO: 489923 - DNA, 25 bp, Mus musculus
tgtgcccctgatacaaaagctgcag

SEQ ID NO: 489924 - DNA, 25 bp, Mus musculus
tgtgcccgaaacatggataatcctg

SEQ ID NO: 489925 - DNA, 25 bp, Mus musculus
tgtgcccgaaactggatcacctgga

SEQ ID NO: 489926 - DNA, 25 bp, Mus musculus
tgtgcccgaggatctgctgagcttg

SEQ ID NO: 489927 - DNA, 25 bp, Mus musculus
tgtgcccgagtccttcataccagta

SEQ ID NO: 489928 - DNA, 25 bp, Mus musculus
tgtgcccggatgagtggcccctgct

SEQ ID NO: 489929 - DNA, 25 bp, Mus musculus
tgtgccctgccctgatggatagtgt

SEQ ID NO: 489930 - DNA, 25 bp, Mus musculus
tgtgccctgccggatacatatggaa

SEQ ID NO: 489931 - DNA, 25 bp, Mus musculus
tgtgccctgggatgaaagaagctga

SEQ ID NO: 489932 - DNA, 25 bp, Mus musculus
tgtgccctggttgtcgaaaacttag

SEQ ID NO: 489933 - DNA, 25 bp, Mus musculus
tgtgccctgtgtgtgacaagcctgc

SEQ ID NO: 489934 - DNA, 25 bp, Mus musculus
tgtgcccttaggaacagtcattgat

SEQ ID NO: 489935 - DNA, 25 bp, Mus musculus
tgtgcccttcgagaagcattccaca

SEQ ID NO: 489936 - DNA, 25 bp, Mus musculus
tgtgccgagaagacagacaggttgt

SEQ ID NO: 489937 - DNA, 25 bp, Mus musculus
tgtgccggatcctcccctgtgctga

SEQ ID NO: 489938 - DNA, 25 bp, Mus musculus
tgtgccgggatggttcgcagaccca

SEQ ID NO: 489939 - DNA, 25 bp, Mus musculus
tgtgccgggcttatacaatgtcaac

SEQ ID NO: 489940 - DNA, 25 bp, Mus musculus
tgtgccggtgtgtctggaagctcca

SEQ ID NO: 489941 - DNA, 25 bp, Mus musculus
tgtgccgtacccaagaaagattctc

SEQ ID NO: 489942 - DNA, 25 bp, Mus musculus
tgtgcctaagggatcctcgggccgt

SEQ ID NO: 489943 - DNA, 25 bp, Mus musculus
tgtgcctacaggaaagcgcatttgt

SEQ ID NO: 489944 - DNA, 25 bp, Mus musculus
tgtgcctataagctggtgaccatca

SEQ ID NO: 489945 - DNA, 25 bp, Mus musculus
tgtgcctcaagtacggcgagagcgc

SEQ ID NO: 489946 - DNA, 25 bp, Mus musculus
tgtgcctcacaactcagagtttttg

SEQ ID NO: 489947 - DNA, 25 bp, Mus musculus
tgtgcctcactgcaagatctcacca

SEQ ID NO: 489948 - DNA, 25 bp, Mus musculus
tgtgcctcagaagccaatgacagga

SEQ ID NO: 489949 - DNA, 25 bp, Mus musculus
tgtgcctccatagaagtagtgacca

SEQ ID NO: 489950 - DNA, 25 bp, Mus musculus
tgtgcctcccacaaggaaccttacg

SEQ ID NO: 489951 - DNA, 25 bp, Mus musculus
tgtgcctctctcaacgaagactaga

SEQ ID NO: 489952 - DNA, 25 bp, Mus musculus
tgtgcctctgctagaaacagaagcg

SEQ ID NO: 489953 - DNA, 25 bp, Mus musculus
tgtgcctcttgggtctatagaaaga

SEQ ID NO: 489954 - DNA, 25 bp, Mus musculus
tgtgcctgagcgagtccctgaattc

SEQ ID NO: 489955 - DNA, 25 bp, Mus musculus
tgtgcctgcattaactccacgctgg

SEQ ID NO: 489956 - DNA, 25 bp, Mus musculus
tgtgcctgcgcttgtacctgaacgg

SEQ ID NO: 489957 - DNA, 25 bp, Mus musculus
tgtgcctggaagaacatgccactgt

SEQ ID NO: 489958 - DNA, 25 bp, Mus musculus
tgtgcctggttcctaacagtctgga

SEQ ID NO: 489959 - DNA, 25 bp, Mus musculus
tgtgcctgtggagaacgcaacagct

SEQ ID NO: 489960 - DNA, 25 bp, Mus musculus
tgtgccttaggatggtttgggcatt

SEQ ID NO: 489961 - DNA, 25 bp, Mus musculus
tgtgccttaggcttagatccggctg

SEQ ID NO: 489962 - DNA, 25 bp, Mus musculus
tgtgccttgcttgtgggaacttaaa

SEQ ID NO: 489963 - DNA, 25 bp, Mus musculus
tgtgccttggacaatccccgtgaga

SEQ ID NO: 489964 - DNA, 25 bp, Mus musculus
tgtgccttttagaattcgctctgcc

SEQ ID NO: 489965 - DNA, 25 bp, Mus musculus
tgtgcgaagttcatcgacgagcagc

SEQ ID NO: 489966 - DNA, 25 bp, Mus musculus
tgtgcgacacctgcggaaaggcatt

SEQ ID NO: 489967 - DNA, 25 bp, Mus musculus
tgtgcgacatacaaagcctgccctg

SEQ ID NO: 489968 - DNA, 25 bp, Mus musculus
tgtgcgaccacaaccaactacgatg

SEQ ID NO: 489969 - DNA, 25 bp, Mus musculus
tgtgcgaccttggaaacccgatgaa

SEQ ID NO: 489970 - DNA, 25 bp, Mus musculus
tgtgcgactactgcgaggatacctt

SEQ ID NO: 489971 - DNA, 25 bp, Mus musculus
tgtgcgagtgttggatgaagacccc

SEQ ID NO: 489972 - DNA, 25 bp, Mus musculus
tgtgcgcacacgacaaatctgagtt

SEQ ID NO: 489973 - DNA, 25 bp, Mus musculus
tgtgcgcaccctgtggttcagctgt

SEQ ID NO: 489974 - DNA, 25 bp, Mus musculus
tgtgcgcactgcagaccatatatgg

SEQ ID NO: 489975 - DNA, 25 bp, Mus musculus
tgtgcgcactggacaaggatttgct

SEQ ID NO: 489976 - DNA, 25 bp, Mus musculus
tgtgcgcagaagcattggcagaccc

SEQ ID NO: 489977 - DNA, 25 bp, Mus musculus
tgtgcgccaaggagttcaagaacgg

SEQ ID NO: 489978 - DNA, 25 bp, Mus musculus
tgtgcgccatagaaccaagaaggag

SEQ ID NO: 489979 - DNA, 25 bp, Mus musculus
tgtgcgcccagtttggaaccagtat

SEQ ID NO: 489980 - DNA, 25 bp, Mus musculus
tgtgcgccgcaaatcgagacaagtt

SEQ ID NO: 489981 - DNA, 25 bp, Mus musculus
tgtgcgcgacaagaggattagatta

SEQ ID NO: 489982 - DNA, 25 bp, Mus musculus
tgtgcgcgctaccaaaattgaaagg

SEQ ID NO: 489983 - DNA, 25 bp, Mus musculus
tgtgcgctactacgagacaccagag

SEQ ID NO: 489984 - DNA, 25 bp, Mus musculus
tgtgcgctcagcaaaacagtgttct

SEQ ID NO: 489985 - DNA, 25 bp, Mus musculus
tgtgcggaaccggaagcttcagtct

SEQ ID NO: 489986 - DNA, 25 bp, Mus musculus
tgtgcggacccagcagccttttaac

SEQ ID NO: 489987 - DNA, 25 bp, Mus musculus
tgtgcggcacgtccagcatgttgtt

SEQ ID NO: 489988 - DNA, 25 bp, Mus musculus
tgtgcgggtgcctacaaaagcaagc

SEQ ID NO: 489989 - DNA, 25 bp, Mus musculus
tgtgcgtatcccaagtggtggccct

SEQ ID NO: 489990 - DNA, 25 bp, Mus musculus
tgtgcgtcccgagcagcgttctggt

SEQ ID NO: 489991 - DNA, 25 bp, Mus musculus
tgtgcgtgtctgctaatgagctcta

SEQ ID NO: 489992 - DNA, 25 bp, Mus musculus
tgtgcgttccccagttgcaggcgta

SEQ ID NO: 489993 - DNA, 25 bp, Mus musculus
tgtgctaaagctgagccgcctagct

SEQ ID NO: 489994 - DNA, 25 bp, Mus musculus
tgtgctaactgagaagagtctgact

SEQ ID NO: 489995 - DNA, 25 bp, Mus musculus
tgtgctaagatcaaggcccctgagt

SEQ ID NO: 489996 - DNA, 25 bp, Mus musculus
tgtgctaagtttgagaacgccaggc

SEQ ID NO: 489997 - DNA, 25 bp, Mus musculus
tgtgctacacaaggaactggtctgt

SEQ ID NO: 489998 - DNA, 25 bp, Mus musculus
tgtgctacactagcctgcagctgcg

SEQ ID NO: 489999 - DNA, 25 bp, Mus musculus
tgtgctacagtccacacatgtgctg

SEQ ID NO: 490000 - DNA, 25 bp, Mus musculus
tgtgctactcctgaaacccgagtct

SEQ ID NO: 490001 - DNA, 25 bp, Mus musculus
tgtgctactggacctgggcttctca

SEQ ID NO: 490002 - DNA, 25 bp, Mus musculus
tgtgctagagaaaactttgaaggaa

SEQ ID NO: 490003 - DNA, 25 bp, Mus musculus
tgtgctaggaatcgaacctcgatcc

SEQ ID NO: 490004 - DNA, 25 bp, Mus musculus
tgtgctagtaagacggcctcctctc

SEQ ID NO: 490005 - DNA, 25 bp, Mus musculus
tgtgctatcagagaacggctttgga

SEQ ID NO: 490006 - DNA, 25 bp, Mus musculus
tgtgctcaagaagcgcagctgcatc

SEQ ID NO: 490007 - DNA, 25 bp, Mus musculus
tgtgctcaagccaggatatcgtccc

SEQ ID NO: 490008 - DNA, 25 bp, Mus musculus
tgtgctcaaggccatgtcaggcttt

SEQ ID NO: 490009 - DNA, 25 bp, Mus musculus
tgtgctcaatgaccagcccaaggct

SEQ ID NO: 490010 - DNA, 25 bp, Mus musculus
tgtgctcacaaggtcaactgccagg

SEQ ID NO: 490011 - DNA, 25 bp, Mus musculus
tgtgctcacacgtatggcagtggtg

SEQ ID NO: 490012 - DNA, 25 bp, Mus musculus
tgtgctcacattaacctacacttga

SEQ ID NO: 490013 - DNA, 25 bp, Mus musculus
tgtgctcaccatccaacagattgag

SEQ ID NO: 490014 - DNA, 25 bp, Mus musculus
tgtgctcacctgctgtcctagctgt

SEQ ID NO: 490015 - DNA, 25 bp, Mus musculus
tgtgctcactgggtaagcagtcccc

SEQ ID NO: 490016 - DNA, 25 bp, Mus musculus
tgtgctcagtaccatggcaatgatc

SEQ ID NO: 490017 - DNA, 25 bp, Mus musculus
tgtgctcagtgaaggcaaagccacc

SEQ ID NO: 490018 - DNA, 25 bp, Mus musculus
tgtgctccagatggcaaaccatgac

SEQ ID NO: 490019 - DNA, 25 bp, Mus musculus
tgtgctccaggctaaagttcactcc

SEQ ID NO: 490020 - DNA, 25 bp, Mus musculus
tgtgctccatctgtaacactgcaag

SEQ ID NO: 490021 - DNA, 25 bp, Mus musculus
tgtgctccgccctctaaaggttatt

SEQ ID NO: 490022 - DNA, 25 bp, Mus musculus
tgtgctccgcctcataaactctcaa

SEQ ID NO: 490023 - DNA, 25 bp, Mus musculus
tgtgctccgtgcatcctctgtgcgc

SEQ ID NO: 490024 - DNA, 25 bp, Mus musculus
tgtgctcctatctagaagtggctgc

SEQ ID NO: 490025 - DNA, 25 bp, Mus musculus
tgtgctcctgatcgcaacctggaca

SEQ ID NO: 490026 - DNA, 25 bp, Mus musculus
tgtgctcctgcccaatgatgtttag

SEQ ID NO: 490027 - DNA, 25 bp, Mus musculus
tgtgctcctgcctcagggtctgccg

SEQ ID NO: 490028 - DNA, 25 bp, Mus musculus
tgtgctccttcgagattccctcagg

SEQ ID NO: 490029 - DNA, 25 bp, Mus musculus
tgtgctcgccagagagactgcctga

SEQ ID NO: 490030 - DNA, 25 bp, Mus musculus
tgtgctcgccctgttcatgaatggt

SEQ ID NO: 490031 - DNA, 25 bp, Mus musculus
tgtgctcggcacatctccttggaag

SEQ ID NO: 490032 - DNA, 25 bp, Mus musculus
tgtgctcgggtgtccctttcctctt

SEQ ID NO: 490033 - DNA, 25 bp, Mus musculus
tgtgctctaagactcgatgctgggt

SEQ ID NO: 490034 - DNA, 25 bp, Mus musculus
tgtgctctacaacgacaccgctgtg

SEQ ID NO: 490035 - DNA, 25 bp, Mus musculus
tgtgctctatgaattaaatggcagc

SEQ ID NO: 490036 - DNA, 25 bp, Mus musculus
tgtgctctgaagctcctgcccaggc

SEQ ID NO: 490037 - DNA, 25 bp, Mus musculus
tgtgctctgctttccagcatctcgg

SEQ ID NO: 490038 - DNA, 25 bp, Mus musculus
tgtgctcttcggatcctctatctcg

SEQ ID NO: 490039 - DNA, 25 bp, Mus musculus
tgtgctcttttcctcagcccctgga

SEQ ID NO: 490040 - DNA, 25 bp, Mus musculus
tgtgctgaaagtggaagccatcctg

SEQ ID NO: 490041 - DNA, 25 bp, Mus musculus
tgtgctgaagccgtctccagagtcc

SEQ ID NO: 490042 - DNA, 25 bp, Mus musculus
tgtgctgacagatagaaaccctttg

SEQ ID NO: 490043 - DNA, 25 bp, Mus musculus
tgtgctgagaaaacagccgactctg

SEQ ID NO: 490044 - DNA, 25 bp, Mus musculus
tgtgctgagcatctacaaggaccca

SEQ ID NO: 490045 - DNA, 25 bp, Mus musculus
tgtgctgagtgccaacctccatggg

SEQ ID NO: 490046 - DNA, 25 bp, Mus musculus
tgtgctgcagatagccaatgacctg

SEQ ID NO: 490047 - DNA, 25 bp, Mus musculus
tgtgctgcattccatctcatcgtag

SEQ ID NO: 490048 - DNA, 25 bp, Mus musculus
tgtgctgcccataaaaaagcctgtc

SEQ ID NO: 490049 - DNA, 25 bp, Mus musculus
tgtgctgcccattacactcccaatg

SEQ ID NO: 490050 - DNA, 25 bp, Mus musculus
tgtgctgcccctgttgctcggttgg

SEQ ID NO: 490051 - DNA, 25 bp, Mus musculus
tgtgctgcccctttcacatcaaaga

SEQ ID NO: 490052 - DNA, 25 bp, Mus musculus
tgtgctgccttgactgaccgagagt

SEQ ID NO: 490053 - DNA, 25 bp, Mus musculus
tgtgctgctgactctgacctcaact

SEQ ID NO: 490054 - DNA, 25 bp, Mus musculus
tgtgctgctgtcctgttaaagcatg

SEQ ID NO: 490055 - DNA, 25 bp, Mus musculus
tgtgctggccaagcaagtgggagct

SEQ ID NO: 490056 - DNA, 25 bp, Mus musculus
tgtgctggctgtgtgtgagctctac

SEQ ID NO: 490057 - DNA, 25 bp, Mus musculus
tgtgctgggactgagccttcttttc

SEQ ID NO: 490058 - DNA, 25 bp, Mus musculus
tgtgctggtctctgtcttaggtctc

SEQ ID NO: 490059 - DNA, 25 bp, Mus musculus
tgtgctggtggacatgaagctcatc

SEQ ID NO: 490060 - DNA, 25 bp, Mus musculus
tgtgctgtcctacggtctttacaag

SEQ ID NO: 490061 - DNA, 25 bp, Mus musculus
tgtgctgtcggaatgaacctctctg

SEQ ID NO: 490062 - DNA, 25 bp, Mus musculus
tgtgctgtgggtaatccatgttacc

SEQ ID NO: 490063 - DNA, 25 bp, Mus musculus
tgtgctgttagtgaccagaggctcc

SEQ ID NO: 490064 - DNA, 25 bp, Mus musculus
tgtgcttagaaactgatgtcctgtg

SEQ ID NO: 490065 - DNA, 25 bp, Mus musculus
tgtgcttatcctaagacctcctcac

SEQ ID NO: 490066 - DNA, 25 bp, Mus musculus
tgtgcttcacattgtccgcgtcccg

SEQ ID NO: 490067 - DNA, 25 bp, Mus musculus
tgtgcttcagcccagcatacagact

SEQ ID NO: 490068 - DNA, 25 bp, Mus musculus
tgtgcttcagcctgaccagggaaat

SEQ ID NO: 490069 - DNA, 25 bp, Mus musculus
tgtgcttccagagagggccttcctg

SEQ ID NO: 490070 - DNA, 25 bp, Mus musculus
tgtgcttccctcatcaggtcacgtg

SEQ ID NO: 490071 - DNA, 25 bp, Mus musculus
tgtgcttcctcgactactccagtaa

SEQ ID NO: 490072 - DNA, 25 bp, Mus musculus
tgtgcttcctgcaagccacgagctc

SEQ ID NO: 490073 - DNA, 25 bp, Mus musculus
tgtgcttcgcagaattccagccttc

SEQ ID NO: 490074 - DNA, 25 bp, Mus musculus
tgtgcttgccgagctaagagcggtc

SEQ ID NO: 490075 - DNA, 25 bp, Mus musculus
tgtgcttgtcagagggtggtacttc

SEQ ID NO: 490076 - DNA, 25 bp, Mus musculus
tgtgctttaggtagtctgtctccag

SEQ ID NO: 490077 - DNA, 25 bp, Mus musculus
tgtgctttgcttaaccctgggaacc

SEQ ID NO: 490078 - DNA, 25 bp, Mus musculus
tgtggaaaccacagtctaccttagg

SEQ ID NO: 490079 - DNA, 25 bp, Mus musculus
tgtggaaaccccaacttctgacggt

SEQ ID NO: 490080 - DNA, 25 bp, Mus musculus
tgtggaaaccgaatcactggatgct

SEQ ID NO: 490081 - DNA, 25 bp, Mus musculus
tgtggaaacctaattgcccaggagg

SEQ ID NO: 490082 - DNA, 25 bp, Mus musculus
tgtggaaacgatggctggcgctctc

SEQ ID NO: 490083 - DNA, 25 bp, Mus musculus
tgtggaaagacagaaggctggcctc

SEQ ID NO: 490084 - DNA, 25 bp, Mus musculus
tgtggaaatggaaaataccttggca

SEQ ID NO: 490085 - DNA, 25 bp, Mus musculus
tgtggaaatgtaatgctctctgtaa

SEQ ID NO: 490086 - DNA, 25 bp, Mus musculus
tgtggaaattcccacggccattggg

SEQ ID NO: 490087 - DNA, 25 bp, Mus musculus
tgtggaaattgactccgagaccgcc

SEQ ID NO: 490088 - DNA, 25 bp, Mus musculus
tgtggaaccactgacctgtacgacc

SEQ ID NO: 490089 - DNA, 25 bp, Mus musculus
tgtggaacccaaacttgcccaggag

SEQ ID NO: 490090 - DNA, 25 bp, Mus musculus
tgtggaaccccagtcaataccgtgt

SEQ ID NO: 490091 - DNA, 25 bp, Mus musculus
tgtggaaccgcaccagggaaaatgc

SEQ ID NO: 490092 - DNA, 25 bp, Mus musculus
tgtggaacgtgctccatcctcggct

SEQ ID NO: 490093 - DNA, 25 bp, Mus musculus
tgtggaactactctacggcatctgg

SEQ ID NO: 490094 - DNA, 25 bp, Mus musculus
tgtggaagcatcctcagtcaagagc

SEQ ID NO: 490095 - DNA, 25 bp, Mus musculus
tgtggaaggcctcagctacaacctg

SEQ ID NO: 490096 - DNA, 25 bp, Mus musculus
tgtggaagtcccatctgcagccgaa

SEQ ID NO: 490097 - DNA, 25 bp, Mus musculus
tgtggaataagcaccggagctcagc

SEQ ID NO: 490098 - DNA, 25 bp, Mus musculus
tgtggaatgccgagctcagtgaaga

SEQ ID NO: 490099 - DNA, 25 bp, Mus musculus
tgtggaatgctagaggctggctgcc

SEQ ID NO: 490100 - DNA, 25 bp, Mus musculus
tgtggaatgtgatgccgaggctacc

SEQ ID NO: 490101 - DNA, 25 bp, Mus musculus
tgtggaatgtgtgccggtcatagaa

SEQ ID NO: 490102 - DNA, 25 bp, Mus musculus
tgtggaattcctgcaagaggcagaa

SEQ ID NO: 490103 - DNA, 25 bp, Mus musculus
tgtggaatttagttttctgatcaga

SEQ ID NO: 490104 - DNA, 25 bp, Mus musculus
tgtggaatttgctaccctgagcagc

SEQ ID NO: 490105 - DNA, 25 bp, Mus musculus
tgtggacaaaataatgaaggacctg

SEQ ID NO: 490106 - DNA, 25 bp, Mus musculus
tgtggacaacctcaccatgcgtctg

SEQ ID NO: 490107 - DNA, 25 bp, Mus musculus
tgtggacaatgcaggaaggcaacac

SEQ ID NO: 490108 - DNA, 25 bp, Mus musculus
tgtggacaatttcaacgaggtgctg

SEQ ID NO: 490109 - DNA, 25 bp, Mus musculus
tgtggacacagatgcggatacccgt

SEQ ID NO: 490110 - DNA, 25 bp, Mus musculus
tgtggacacgtatccctacgggctg

SEQ ID NO: 490111 - DNA, 25 bp, Mus musculus
tgtggacactggaaaatcaaccctg

SEQ ID NO: 490112 - DNA, 25 bp, Mus musculus
tgtggacagcgattcgagcctggac

SEQ ID NO: 490113 - DNA, 25 bp, Mus musculus
tgtggacatccttccctcttggctg

SEQ ID NO: 490114 - DNA, 25 bp, Mus musculus
tgtggaccatgcctgtgttcctgtg

SEQ ID NO: 490115 - DNA, 25 bp, Mus musculus
tgtggacccagatgagcctcagaac

SEQ ID NO: 490116 - DNA, 25 bp, Mus musculus
tgtggaccccatcaagcgtcatgtg

SEQ ID NO: 490117 - DNA, 25 bp, Mus musculus
tgtggaccgccaatacggagcgctt

SEQ ID NO: 490118 - DNA, 25 bp, Mus musculus
tgtggaccgcgtacctcaacgtgtc

SEQ ID NO: 490119 - DNA, 25 bp, Mus musculus
tgtggacctcatctatactacctgt

SEQ ID NO: 490120 - DNA, 25 bp, Mus musculus
tgtggacctgaatgttgacccatcg

SEQ ID NO: 490121 - DNA, 25 bp, Mus musculus
tgtggacctgcttgtcagaaggctg

SEQ ID NO: 490122 - DNA, 25 bp, Mus musculus
tgtggacctgtcactccaactctgc

SEQ ID NO: 490123 - DNA, 25 bp, Mus musculus
tgtggaccttggaaacgaataccct

SEQ ID NO: 490124 - DNA, 25 bp, Mus musculus
tgtggacgactttgcagagcctacc

SEQ ID NO: 490125 - DNA, 25 bp, Mus musculus
tgtggacgccaccatgaaacaagag

SEQ ID NO: 490126 - DNA, 25 bp, Mus musculus
tgtggacgctcgagacaagctcggc

SEQ ID NO: 490127 - DNA, 25 bp, Mus musculus
tgtggacgcttctcctgcgtagtga

SEQ ID NO: 490128 - DNA, 25 bp, Mus musculus
tgtggactacattaatagggaggct

SEQ ID NO: 490129 - DNA, 25 bp, Mus musculus
tgtggactccaagtcagtgttcagc

SEQ ID NO: 490130 - DNA, 25 bp, Mus musculus
tgtggactgcccagcaatcgatggt

SEQ ID NO: 490131 - DNA, 25 bp, Mus musculus
tgtggactgctatgtggaagacccc

SEQ ID NO: 490132 - DNA, 25 bp, Mus musculus
tgtggagaaatacaaagatgaccct

SEQ ID NO: 490133 - DNA, 25 bp, Mus musculus
tgtggagaaggaagaacctgaaccc

SEQ ID NO: 490134 - DNA, 25 bp, Mus musculus
tgtggagacgtctgctaaaacgcgc

SEQ ID NO: 490135 - DNA, 25 bp, Mus musculus
tgtggagacgttacccagggtcctg

SEQ ID NO: 490136 - DNA, 25 bp, Mus musculus
tgtggagagatagctagcatccgcc

SEQ ID NO: 490137 - DNA, 25 bp, Mus musculus
tgtggagagcatcctgcagaccgat

SEQ ID NO: 490138 - DNA, 25 bp, Mus musculus
tgtggagagcctatcgggacaacct

SEQ ID NO: 490139 - DNA, 25 bp, Mus musculus
tgtggagatagaccccgagattcag

SEQ ID NO: 490140 - DNA, 25 bp, Mus musculus
tgtggagcacacgtaatgaaccctt

SEQ ID NO: 490141 - DNA, 25 bp, Mus musculus
tgtggagcacatctcaaccaggagt

SEQ ID NO: 490142 - DNA, 25 bp, Mus musculus
tgtggagcatgaaagcaatgcgcat

SEQ ID NO: 490143 - DNA, 25 bp, Mus musculus
tgtggagccacactccaagaaggcc

SEQ ID NO: 490144 - DNA, 25 bp, Mus musculus
tgtggagcccacagaaacacagcct

SEQ ID NO: 490145 - DNA, 25 bp, Mus musculus
tgtggagccctgtgacttgacggaa

SEQ ID NO: 490146 - DNA, 25 bp, Mus musculus
tgtggaggaatggaacaaccttccg

SEQ ID NO: 490147 - DNA, 25 bp, Mus musculus
tgtggaggcagctatcggaaccagc

SEQ ID NO: 490148 - DNA, 25 bp, Mus musculus
tgtggaggctccctgctcagtccag

SEQ ID NO: 490149 - DNA, 25 bp, Mus musculus
tgtggagggccttccgactctcact

SEQ ID NO: 490150 - DNA, 25 bp, Mus musculus
tgtggagggctcacgctgacatgca

SEQ ID NO: 490151 - DNA, 25 bp, Mus musculus
tgtggagggtcctgaatgagctcat

SEQ ID NO: 490152 - DNA, 25 bp, Mus musculus
tgtggagtacaagaagcagcaggac

SEQ ID NO: 490153 - DNA, 25 bp, Mus musculus
tgtggagtccatacttcaaggtgtc

SEQ ID NO: 490154 - DNA, 25 bp, Mus musculus
tgtggagtcttgagtaacaaaccct

SEQ ID NO: 490155 - DNA, 25 bp, Mus musculus
tgtggagtgcccgatgtacagcatc

SEQ ID NO: 490156 - DNA, 25 bp, Mus musculus
tgtggagtggcctcttcactcactt

SEQ ID NO: 490157 - DNA, 25 bp, Mus musculus
tgtggagtgggaaaacaccactttc

SEQ ID NO: 490158 - DNA, 25 bp, Mus musculus
tgtggataaacccatgtgctcaggt

SEQ ID NO: 490159 - DNA, 25 bp, Mus musculus
tgtggatacccgacaggcaagaagg

SEQ ID NO: 490160 - DNA, 25 bp, Mus musculus
tgtggatagcagctgcaagacccct

SEQ ID NO: 490161 - DNA, 25 bp, Mus musculus
tgtggatccagcttttaccgcccaa

SEQ ID NO: 490162 - DNA, 25 bp, Mus musculus
tgtggatctatagctgcactgggct

SEQ ID NO: 490163 - DNA, 25 bp, Mus musculus
tgtggatctcagtgaagagacccag

SEQ ID NO: 490164 - DNA, 25 bp, Mus musculus
tgtggatctgaccttacctggctgg

SEQ ID NO: 490165 - DNA, 25 bp, Mus musculus
tgtggatgagctgcgtccctttcag

SEQ ID NO: 490166 - DNA, 25 bp, Mus musculus
tgtggatgtagttcccctgcctggc

SEQ ID NO: 490167 - DNA, 25 bp, Mus musculus
tgtggatgtccacacatgcaaggcc

SEQ ID NO: 490168 - DNA, 25 bp, Mus musculus
tgtggattatcgaaccccaaggaat

SEQ ID NO: 490169 - DNA, 25 bp, Mus musculus
tgtggattcatactgctgggctgct

SEQ ID NO: 490170 - DNA, 25 bp, Mus musculus
tgtggattccgcctatggaggctcc

SEQ ID NO: 490171 - DNA, 25 bp, Mus musculus
tgtggattcttcaccgagcacagcg

SEQ ID NO: 490172 - DNA, 25 bp, Mus musculus
tgtggattgccgatcttccccaagg

SEQ ID NO: 490173 - DNA, 25 bp, Mus musculus
tgtggattttgacacaatctcactg

SEQ ID NO: 490174 - DNA, 25 bp, Mus musculus
tgtggcaaagactccaagagcgctt

SEQ ID NO: 490175 - DNA, 25 bp, Mus musculus
tgtggcaaagcacgcgaaaggcaac

SEQ ID NO: 490176 - DNA, 25 bp, Mus musculus
tgtggcaaaggccttgagtcgacca

SEQ ID NO: 490177 - DNA, 25 bp, Mus musculus
tgtggcaaccccatggaaacatact

SEQ ID NO: 490178 - DNA, 25 bp, Mus musculus
tgtggcaacgggacggaacttcgat

SEQ ID NO: 490179 - DNA, 25 bp, Mus musculus
tgtggcaagacagatacctacatcc

SEQ ID NO: 490180 - DNA, 25 bp, Mus musculus
tgtggcaagcacttagcccgtgttc

SEQ ID NO: 490181 - DNA, 25 bp, Mus musculus
tgtggcacacggtcggaatgttttc

SEQ ID NO: 490182 - DNA, 25 bp, Mus musculus
tgtggcacactcctaagcgtacgat

SEQ ID NO: 490183 - DNA, 25 bp, Mus musculus
tgtggcaccaatcattgacgtgtga

SEQ ID NO: 490184 - DNA, 25 bp, Mus musculus
tgtggcactatgtacgcagagaggc

SEQ ID NO: 490185 - DNA, 25 bp, Mus musculus
tgtggcactttcaggatcatcagga

SEQ ID NO: 490186 - DNA, 25 bp, Mus musculus
tgtggcagaaagtggacaaatccca

SEQ ID NO: 490187 - DNA, 25 bp, Mus musculus
tgtggcagacaacaggacctatgat

SEQ ID NO: 490188 - DNA, 25 bp, Mus musculus
tgtggcagagaatccggcgggaatc

SEQ ID NO: 490189 - DNA, 25 bp, Mus musculus
tgtggcagagatctgtgtcacccgc

SEQ ID NO: 490190 - DNA, 25 bp, Mus musculus
tgtggcagagtctctgattgttcct

SEQ ID NO: 490191 - DNA, 25 bp, Mus musculus
tgtggcagctgcctggatatataag

SEQ ID NO: 490192 - DNA, 25 bp, Mus musculus
tgtggcagcttcaggtccgatagac

SEQ ID NO: 490193 - DNA, 25 bp, Mus musculus
tgtggcaggcatgactaaatgatcc

SEQ ID NO: 490194 - DNA, 25 bp, Mus musculus
tgtggcagggacaaactccagtgct

SEQ ID NO: 490195 - DNA, 25 bp, Mus musculus
tgtggcagtcactcctttgtctcag

SEQ ID NO: 490196 - DNA, 25 bp, Mus musculus
tgtggcagtgcttcccgatgaacct

SEQ ID NO: 490197 - DNA, 25 bp, Mus musculus
tgtggcatccgcatcaaggctgtct

SEQ ID NO: 490198 - DNA, 25 bp, Mus musculus
tgtggcatcgccaaaaagcctggaa

SEQ ID NO: 490199 - DNA, 25 bp, Mus musculus
tgtggcatgcacagactccagtgcg

SEQ ID NO: 490200 - DNA, 25 bp, Mus musculus
tgtggcatgccaccatgtaacctgg

SEQ ID NO: 490201 - DNA, 25 bp, Mus musculus
tgtggcatgtcctgatgaaaaatcc

SEQ ID NO: 490202 - DNA, 25 bp, Mus musculus
tgtggccaaagaggtcctggactgc

SEQ ID NO: 490203 - DNA, 25 bp, Mus musculus
tgtggccaacagagtagctgccacg

SEQ ID NO: 490204 - DNA, 25 bp, Mus musculus
tgtggccaagacaggtgatgctcga

SEQ ID NO: 490205 - DNA, 25 bp, Mus musculus
tgtggccaagatgtcactggatcca

SEQ ID NO: 490206 - DNA, 25 bp, Mus musculus
tgtggccacagtgactcatgaagcg

SEQ ID NO: 490207 - DNA, 25 bp, Mus musculus
tgtggccaccatctccaaaggaggt

SEQ ID NO: 490208 - DNA, 25 bp, Mus musculus
tgtggccactcagatcctgggagga

SEQ ID NO: 490209 - DNA, 25 bp, Mus musculus
tgtggccagacaagctcatcggaga

SEQ ID NO: 490210 - DNA, 25 bp, Mus musculus
tgtggccagcagatcagcagatcgg

SEQ ID NO: 490211 - DNA, 25 bp, Mus musculus
tgtggccagcatccgtgtcatcaac

SEQ ID NO: 490212 - DNA, 25 bp, Mus musculus
tgtggccagccccaatgaatctagc

SEQ ID NO: 490213 - DNA, 25 bp, Mus musculus
tgtggccatacaactcttagaagct

SEQ ID NO: 490214 - DNA, 25 bp, Mus musculus
tgtggccatcagcacgggtccgctc

SEQ ID NO: 490215 - DNA, 25 bp, Mus musculus
tgtggccatctgttacccactgaga

SEQ ID NO: 490216 - DNA, 25 bp, Mus musculus
tgtggccatttgtaaacctttgagg

SEQ ID NO: 490217 - DNA, 25 bp, Mus musculus
tgtggccatttgtaaccctttgcgt

SEQ ID NO: 490218 - DNA, 25 bp, Mus musculus
tgtggcccacacaggaaaaggctgt

SEQ ID NO: 490219 - DNA, 25 bp, Mus musculus
tgtggcccacttcccgatagaggac

SEQ ID NO: 490220 - DNA, 25 bp, Mus musculus
tgtggcccaggtgcttcgtgaactc

SEQ ID NO: 490221 - DNA, 25 bp, Mus musculus
tgtggcccagtagagaccttagtgt

SEQ ID NO: 490222 - DNA, 25 bp, Mus musculus
tgtggccccaaagaacccattaagg

SEQ ID NO: 490223 - DNA, 25 bp, Mus musculus
tgtggcccgacttctgcggccctgt

SEQ ID NO: 490224 - DNA, 25 bp, Mus musculus
tgtggccctcgagtaccaggtggtt

SEQ ID NO: 490225 - DNA, 25 bp, Mus musculus
tgtggccctgagaaagatcacgtct

SEQ ID NO: 490226 - DNA, 25 bp, Mus musculus
tgtggccctgggaacctaagcagag

SEQ ID NO: 490227 - DNA, 25 bp, Mus musculus
tgtggccgagggtatgacacaactc

SEQ ID NO: 490228 - DNA, 25 bp, Mus musculus
tgtggccgccctgtacaagagagaa

SEQ ID NO: 490229 - DNA, 25 bp, Mus musculus
tgtggccgtgctaacacacaagtcc

SEQ ID NO: 490230 - DNA, 25 bp, Mus musculus
tgtggccgttattggcgccctctgc

SEQ ID NO: 490231 - DNA, 25 bp, Mus musculus
tgtggcctacaaacaagtcccgagg

SEQ ID NO: 490232 - DNA, 25 bp, Mus musculus
tgtggcctactttctttgtagtaca

SEQ ID NO: 490233 - DNA, 25 bp, Mus musculus
tgtggcctatatcatcgagcaagca

SEQ ID NO: 490234 - DNA, 25 bp, Mus musculus
tgtggcctcagtgataccttcttgc

SEQ ID NO: 490235 - DNA, 25 bp, Mus musculus
tgtggcctcccagagatgtccagtc

SEQ ID NO: 490236 - DNA, 25 bp, Mus musculus
tgtggcctcgattaagcttccccgg

SEQ ID NO: 490237 - DNA, 25 bp, Mus musculus
tgtggcctgagaagaccctttgtgc

SEQ ID NO: 490238 - DNA, 25 bp, Mus musculus
tgtggcctgctcattgggaactcag

SEQ ID NO: 490239 - DNA, 25 bp, Mus musculus
tgtggcctggcgtgtatctgaatat

SEQ ID NO: 490240 - DNA, 25 bp, Mus musculus
tgtggccttccacaaactgaagctg

SEQ ID NO: 490241 - DNA, 25 bp, Mus musculus
tgtggcgaactcttcacttaccgtt

SEQ ID NO: 490242 - DNA, 25 bp, Mus musculus
tgtggcgaaggactacaaagacctg

SEQ ID NO: 490243 - DNA, 25 bp, Mus musculus
tgtggcgcatcaaacaccagcagtt

SEQ ID NO: 490244 - DNA, 25 bp, Mus musculus
tgtggcgccctgatactgttcatca

SEQ ID NO: 490245 - DNA, 25 bp, Mus musculus
tgtggcgcctccacattctcgggct

SEQ ID NO: 490246 - DNA, 25 bp, Mus musculus
tgtggcgctgacatacctgaagtga

SEQ ID NO: 490247 - DNA, 25 bp, Mus musculus
tgtggcgctgggaacagaacaattc

SEQ ID NO: 490248 - DNA, 25 bp, Mus musculus
tgtggcgtaaggatcagaaactatc

SEQ ID NO: 490249 - DNA, 25 bp, Mus musculus
tgtggcgtacgcaaacatgtgtcgg

SEQ ID NO: 490250 - DNA, 25 bp, Mus musculus
tgtggcgtctgatccaacagttaaa

SEQ ID NO: 490251 - DNA, 25 bp, Mus musculus
tgtggctaagaagtccaaagtggcc

SEQ ID NO: 490252 - DNA, 25 bp, Mus musculus
tgtggctaatgagacagggcttaac

SEQ ID NO: 490253 - DNA, 25 bp, Mus musculus
tgtggctacattctacccgctgagt

SEQ ID NO: 490254 - DNA, 25 bp, Mus musculus
tgtggctacccatcccagggctttg

SEQ ID NO: 490255 - DNA, 25 bp, Mus musculus
tgtggctactgcaagaacaagttgg

SEQ ID NO: 490256 - DNA, 25 bp, Mus musculus
tgtggctagcgaggaagctcttctc

SEQ ID NO: 490257 - DNA, 25 bp, Mus musculus
tgtggctaggagaaactaaccctct

SEQ ID NO: 490258 - DNA, 25 bp, Mus musculus
tgtggctatttgtaaacctttgcag

SEQ ID NO: 490259 - DNA, 25 bp, Mus musculus
tgtggctcagaaaacgtcaaggaag

SEQ ID NO: 490260 - DNA, 25 bp, Mus musculus
tgtggctcatgccttgacagaaaaa

SEQ ID NO: 490261 - DNA, 25 bp, Mus musculus
tgtggctctctgcaaatcaccggga

SEQ ID NO: 490262 - DNA, 25 bp, Mus musculus
tgtggctctggtctcaccatctggc

SEQ ID NO: 490263 - DNA, 25 bp, Mus musculus
tgtggctctggtttctgctaggcga

SEQ ID NO: 490264 - DNA, 25 bp, Mus musculus
tgtggctcttggatcctggaaatgg

SEQ ID NO: 490265 - DNA, 25 bp, Mus musculus
tgtggctgaatctctgacctgggaa

SEQ ID NO: 490266 - DNA, 25 bp, Mus musculus
tgtggctgacccaagacaactgtaa

SEQ ID NO: 490267 - DNA, 25 bp, Mus musculus
tgtggctgcatctgagtcagagcct

SEQ ID NO: 490268 - DNA, 25 bp, Mus musculus
tgtggctgcttctaggcctcctggc

SEQ ID NO: 490269 - DNA, 25 bp, Mus musculus
tgtggctggcagagtgtcttctact

SEQ ID NO: 490270 - DNA, 25 bp, Mus musculus
tgtggctgggcattgctatgctaca

SEQ ID NO: 490271 - DNA, 25 bp, Mus musculus
tgtggctgggctatgcaaactctct

SEQ ID NO: 490272 - DNA, 25 bp, Mus musculus
tgtggctgtacccaaagaaaggcct

SEQ ID NO: 490273 - DNA, 25 bp, Mus musculus
tgtggctgtgcaccccgacagcatg

SEQ ID NO: 490274 - DNA, 25 bp, Mus musculus
tgtggctgtgctctgtaagtcacgt

SEQ ID NO: 490275 - DNA, 25 bp, Mus musculus
tgtggcttcccagtgtatcatctgc

SEQ ID NO: 490276 - DNA, 25 bp, Mus musculus
tgtggcttctacaggatttcaacct

SEQ ID NO: 490277 - DNA, 25 bp, Mus musculus
tgtggcttgagcaagtggctcatga

SEQ ID NO: 490278 - DNA, 25 bp, Mus musculus
tgtggcttggtgactagaacaaaag

SEQ ID NO: 490279 - DNA, 25 bp, Mus musculus
tgtggcttttgatgacggcgaacct

SEQ ID NO: 490280 - DNA, 25 bp, Mus musculus
tgtgggaaagcaaagatactgtcga

SEQ ID NO: 490281 - DNA, 25 bp, Mus musculus
tgtgggaacagcaaaccctggcagt

SEQ ID NO: 490282 - DNA, 25 bp, Mus musculus
tgtgggaaccactagcctctttctg

SEQ ID NO: 490283 - DNA, 25 bp, Mus musculus
tgtgggaaccatcaggaactgtgcc

SEQ ID NO: 490284 - DNA, 25 bp, Mus musculus
tgtgggaatatgttgataagttgga

SEQ ID NO: 490285 - DNA, 25 bp, Mus musculus
tgtgggaattatggcaaatcctttc

SEQ ID NO: 490286 - DNA, 25 bp, Mus musculus
tgtgggacagtgtacggaaaagccc

SEQ ID NO: 490287 - DNA, 25 bp, Mus musculus
tgtgggacccaagtggtgaacgtct

SEQ ID NO: 490288 - DNA, 25 bp, Mus musculus
tgtgggacccagcagctcattcaac

SEQ ID NO: 490289 - DNA, 25 bp, Mus musculus
tgtgggaccctaatgaactgtcagg

SEQ ID NO: 490290 - DNA, 25 bp, Mus musculus
tgtgggaccgtgacttcgataaaaa

SEQ ID NO: 490291 - DNA, 25 bp, Mus musculus
tgtgggacgtttaacaacaaaggct

SEQ ID NO: 490292 - DNA, 25 bp, Mus musculus
tgtgggactgcagtaagaactcctg

SEQ ID NO: 490293 - DNA, 25 bp, Mus musculus
tgtgggagacaatacagctgctcta

SEQ ID NO: 490294 - DNA, 25 bp, Mus musculus
tgtgggagccctagagctccatgtg

SEQ ID NO: 490295 - DNA, 25 bp, Mus musculus
tgtgggagcctatcactacatgctg

SEQ ID NO: 490296 - DNA, 25 bp, Mus musculus
tgtgggaggattccctgaaaatgcc

SEQ ID NO: 490297 - DNA, 25 bp, Mus musculus
tgtgggataacaatgcctggacctt

SEQ ID NO: 490298 - DNA, 25 bp, Mus musculus
tgtgggataagcaagagaactacat

SEQ ID NO: 490299 - DNA, 25 bp, Mus musculus
tgtgggcaacataaaatgactgtct

SEQ ID NO: 490300 - DNA, 25 bp, Mus musculus
tgtgggcaaccatgagagcactcct

SEQ ID NO: 490301 - DNA, 25 bp, Mus musculus
tgtgggcaagcagcatccttttgta

SEQ ID NO: 490302 - DNA, 25 bp, Mus musculus
tgtgggcaattctgagtactctagc

SEQ ID NO: 490303 - DNA, 25 bp, Mus musculus
tgtgggcacattcgcctggcagact

SEQ ID NO: 490304 - DNA, 25 bp, Mus musculus
tgtgggcacgcagagagtcctttga

SEQ ID NO: 490305 - DNA, 25 bp, Mus musculus
tgtgggcactgctagtctcgtaccg

SEQ ID NO: 490306 - DNA, 25 bp, Mus musculus
tgtgggcatgaaacccagggctctg

SEQ ID NO: 490307 - DNA, 25 bp, Mus musculus
tgtgggccaacagctctacatcgag

SEQ ID NO: 490308 - DNA, 25 bp, Mus musculus
tgtgggccacaacaggagaccttct

SEQ ID NO: 490309 - DNA, 25 bp, Mus musculus
tgtgggccacttatacctaccggga

SEQ ID NO: 490310 - DNA, 25 bp, Mus musculus
tgtgggccagcaacccaaatcgttc

SEQ ID NO: 490311 - DNA, 25 bp, Mus musculus
tgtgggccatcgtgttactctccgt

SEQ ID NO: 490312 - DNA, 25 bp, Mus musculus
tgtgggcccaagactccttactcag

SEQ ID NO: 490313 - DNA, 25 bp, Mus musculus
tgtgggccccattcaagatccaggc

SEQ ID NO: 490314 - DNA, 25 bp, Mus musculus
tgtgggcctcaagacagacctagtg

SEQ ID NO: 490315 - DNA, 25 bp, Mus musculus
tgtgggcgcaaagtcagtagcgatt

SEQ ID NO: 490316 - DNA, 25 bp, Mus musculus
tgtgggcgccttacaacactgtgct

SEQ ID NO: 490317 - DNA, 25 bp, Mus musculus
tgtgggcgggcattactgacctacg

SEQ ID NO: 490318 - DNA, 25 bp, Mus musculus
tgtgggctacctggatgacactcag

SEQ ID NO: 490319 - DNA, 25 bp, Mus musculus
tgtgggctccacagacagcaaacat

SEQ ID NO: 490320 - DNA, 25 bp, Mus musculus
tgtgggctcccggaagaccactgtt

SEQ ID NO: 490321 - DNA, 25 bp, Mus musculus
tgtgggctctgtgagcctccccagg

SEQ ID NO: 490322 - DNA, 25 bp, Mus musculus
tgtgggctgcagttgggtctcctcc

SEQ ID NO: 490323 - DNA, 25 bp, Mus musculus
tgtgggcttctaacctgaatgactg

SEQ ID NO: 490324 - DNA, 25 bp, Mus musculus
tgtgggcttctcagtctacctggtc

SEQ ID NO: 490325 - DNA, 25 bp, Mus musculus
tgtgggcttctctgacattgagacc

SEQ ID NO: 490326 - DNA, 25 bp, Mus musculus
tgtgggcttgctcactgattcagag

SEQ ID NO: 490327 - DNA, 25 bp, Mus musculus
tgtgggcttggagctctgtagtggg

SEQ ID NO: 490328 - DNA, 25 bp, Mus musculus
tgtggggaacacagaagaaatggaa

SEQ ID NO: 490329 - DNA, 25 bp, Mus musculus
tgtgggtacacagcatcagtcaagt

SEQ ID NO: 490330 - DNA, 25 bp, Mus musculus
tgtgggtacatcaagcagtgctgcc

SEQ ID NO: 490331 - DNA, 25 bp, Mus musculus
tgtgggtaccaggaactgaaccttc

SEQ ID NO: 490332 - DNA, 25 bp, Mus musculus
tgtgggtaccttcatttccagagag

SEQ ID NO: 490333 - DNA, 25 bp, Mus musculus
tgtgggtactccaaccaggacgtgg

SEQ ID NO: 490334 - DNA, 25 bp, Mus musculus
tgtgggtcccaacctaaataggata

SEQ ID NO: 490335 - DNA, 25 bp, Mus musculus
tgtgggtcctgtacctgagaggaac

SEQ ID NO: 490336 - DNA, 25 bp, Mus musculus
tgtgggtctcaaacgacaggactgt

SEQ ID NO: 490337 - DNA, 25 bp, Mus musculus
tgtgggtctggcacacaacacagag

SEQ ID NO: 490338 - DNA, 25 bp, Mus musculus
tgtgggtgaagacaaccattggctc

SEQ ID NO: 490339 - DNA, 25 bp, Mus musculus
tgtgggtgaagggtaacatactctg

SEQ ID NO: 490340 - DNA, 25 bp, Mus musculus
tgtgggtgacgcagcagcattgttc

SEQ ID NO: 490341 - DNA, 25 bp, Mus musculus
tgtgggtgcagtggtgaccatcatc

SEQ ID NO: 490342 - DNA, 25 bp, Mus musculus
tgtgggtgcccaatcaaaggttcag

SEQ ID NO: 490343 - DNA, 25 bp, Mus musculus
tgtgggtgctaggagtttaacttgc

SEQ ID NO: 490344 - DNA, 25 bp, Mus musculus
tgtgggtggagacagtcaacttcat

SEQ ID NO: 490345 - DNA, 25 bp, Mus musculus
tgtgggtttcacaagacagatggcc

SEQ ID NO: 490346 - DNA, 25 bp, Mus musculus
tgtgggtttcaccaagatgagcgcc

SEQ ID NO: 490347 - DNA, 25 bp, Mus musculus
tgtgggtttccacacagcatgggaa

SEQ ID NO: 490348 - DNA, 25 bp, Mus musculus
tgtggtaaagcattgcccagctctc

SEQ ID NO: 490349 - DNA, 25 bp, Mus musculus
tgtggtaaccaagctgcaatcatgg

SEQ ID NO: 490350 - DNA, 25 bp, Mus musculus
tgtggtaagtcaagagcccgtgctg

SEQ ID NO: 490351 - DNA, 25 bp, Mus musculus
tgtggtacaccagaaatgcagcatg

SEQ ID NO: 490352 - DNA, 25 bp, Mus musculus
tgtggtacaccgaccgccattttaa

SEQ ID NO: 490353 - DNA, 25 bp, Mus musculus
tgtggtacatagacacacatacaaa

SEQ ID NO: 490354 - DNA, 25 bp, Mus musculus
tgtggtaccaaagaactgcagccct

SEQ ID NO: 490355 - DNA, 25 bp, Mus musculus
tgtggtacccatgcctacagcagtg

SEQ ID NO: 490356 - DNA, 25 bp, Mus musculus
tgtggtagaaaaagagaccctgacc

SEQ ID NO: 490357 - DNA, 25 bp, Mus musculus
tgtggtagagcttgatcaggccccg

SEQ ID NO: 490358 - DNA, 25 bp, Mus musculus
tgtggtagcacttgttatgtagtca

SEQ ID NO: 490359 - DNA, 25 bp, Mus musculus
tgtggtagctgcaggagcactagcc

SEQ ID NO: 490360 - DNA, 25 bp, Mus musculus
tgtggtagtaggaaatggaacactc

SEQ ID NO: 490361 - DNA, 25 bp, Mus musculus
tgtggtatctggaattatcacccca

SEQ ID NO: 490362 - DNA, 25 bp, Mus musculus
tgtggtatgggagttgatcatgctt

SEQ ID NO: 490363 - DNA, 25 bp, Mus musculus
tgtggtatttctactcagccctgcc

SEQ ID NO: 490364 - DNA, 25 bp, Mus musculus
tgtggtcaacactctaggactgatc

SEQ ID NO: 490365 - DNA, 25 bp, Mus musculus
tgtggtcaagaaagtggctcagtac

SEQ ID NO: 490366 - DNA, 25 bp, Mus musculus
tgtggtcaaggcattccggtccgcc

SEQ ID NO: 490367 - DNA, 25 bp, Mus musculus
tgtggtcaatggagtctgaagatgc

SEQ ID NO: 490368 - DNA, 25 bp, Mus musculus
tgtggtcaccacaagccgtttctct

SEQ ID NO: 490369 - DNA, 25 bp, Mus musculus
tgtggtcaccatccagagtgccaag

SEQ ID NO: 490370 - DNA, 25 bp, Mus musculus
tgtggtcaggctgcccttgaatgct

SEQ ID NO: 490371 - DNA, 25 bp, Mus musculus
tgtggtcagggacgctcccgtttcc

SEQ ID NO: 490372 - DNA, 25 bp, Mus musculus
tgtggtccaatatcagtgctgcccc

SEQ ID NO: 490373 - DNA, 25 bp, Mus musculus
tgtggtccagaataacatagccgct

SEQ ID NO: 490374 - DNA, 25 bp, Mus musculus
tgtggtccagagaagtggcagacac

SEQ ID NO: 490375 - DNA, 25 bp, Mus musculus
tgtggtcccagtaagcgtcatcctg

SEQ ID NO: 490376 - DNA, 25 bp, Mus musculus
tgtggtccgactcaacaaggcagca

SEQ ID NO: 490377 - DNA, 25 bp, Mus musculus
tgtggtccgttaccttcccaaggag

SEQ ID NO: 490378 - DNA, 25 bp, Mus musculus
tgtggtcctaatgagcttgacagct

SEQ ID NO: 490379 - DNA, 25 bp, Mus musculus
tgtggtcctctacagcaacatggcc

SEQ ID NO: 490380 - DNA, 25 bp, Mus musculus
tgtggtccttactctcggtcttcca

SEQ ID NO: 490381 - DNA, 25 bp, Mus musculus
tgtggtcgcccttgttttccagaac

SEQ ID NO: 490382 - DNA, 25 bp, Mus musculus
tgtggtcgggaactcaggcaacctt

SEQ ID NO: 490383 - DNA, 25 bp, Mus musculus
tgtggtctacacagatcatcaacgg

SEQ ID NO: 490384 - DNA, 25 bp, Mus musculus
tgtggtcttcttgctgcccaggaga

SEQ ID NO: 490385 - DNA, 25 bp, Mus musculus
tgtggtcttgtcttccagattcgta

SEQ ID NO: 490386 - DNA, 25 bp, Mus musculus
tgtggtgacacctcagtcagcgatg

SEQ ID NO: 490387 - DNA, 25 bp, Mus musculus
tgtggtgacagcttcctaacgtgtt

SEQ ID NO: 490388 - DNA, 25 bp, Mus musculus
tgtggtgagccatcttaagcaggcc

SEQ ID NO: 490389 - DNA, 25 bp, Mus musculus
tgtggtgcacagacggtatatgcag

SEQ ID NO: 490390 - DNA, 25 bp, Mus musculus
tgtggtgcatcgacccagagtatag

SEQ ID NO: 490391 - DNA, 25 bp, Mus musculus
tgtggtgccaagacacttcaagtta

SEQ ID NO: 490392 - DNA, 25 bp, Mus musculus
tgtggtgccccttgccatagtcctg

SEQ ID NO: 490393 - DNA, 25 bp, Mus musculus
tgtggtgccgctttaccacagagga

SEQ ID NO: 490394 - DNA, 25 bp, Mus musculus
tgtggtgctaaaaatagatgaaccc

SEQ ID NO: 490395 - DNA, 25 bp, Mus musculus
tgtggtgctcccagtaagatggacc

SEQ ID NO: 490396 - DNA, 25 bp, Mus musculus
tgtggtggaccaacagaagactctg

SEQ ID NO: 490397 - DNA, 25 bp, Mus musculus
tgtggtggcatcagcagaacctatg

SEQ ID NO: 490398 - DNA, 25 bp, Mus musculus
tgtggtggcctgattgcttttgcca

SEQ ID NO: 490399 - DNA, 25 bp, Mus musculus
tgtggtggcttcaactgtaggtaac

SEQ ID NO: 490400 - DNA, 25 bp, Mus musculus
tgtggtgtaccctgccacagagaaa

SEQ ID NO: 490401 - DNA, 25 bp, Mus musculus
tgtggttccacacaggcctaggcag

SEQ ID NO: 490402 - DNA, 25 bp, Mus musculus
tgtggttcggcaatgtgggcctcaa

SEQ ID NO: 490403 - DNA, 25 bp, Mus musculus
tgtggttcgtcaatatgcccaagcc

SEQ ID NO: 490404 - DNA, 25 bp, Mus musculus
tgtggttctgaggtgccccttggca

SEQ ID NO: 490405 - DNA, 25 bp, Mus musculus
tgtggttgaccctacaaaccagcag

SEQ ID NO: 490406 - DNA, 25 bp, Mus musculus
tgtggttggccactttgatgacctg

SEQ ID NO: 490407 - DNA, 25 bp, Mus musculus
tgtggtttccaagtgaggcctcagc

SEQ ID NO: 490408 - DNA, 25 bp, Mus musculus
tgtgtaaacccaacttttgccaagc

SEQ ID NO: 490409 - DNA, 25 bp, Mus musculus
tgtgtaaacctttgtgccccttgtg

SEQ ID NO: 490410 - DNA, 25 bp, Mus musculus
tgtgtaaactgagacctgaccttcc

SEQ ID NO: 490411 - DNA, 25 bp, Mus musculus
tgtgtaaagccaagccctggcatgc

SEQ ID NO: 490412 - DNA, 25 bp, Mus musculus
tgtgtaaatatatgtcctcctggcc

SEQ ID NO: 490413 - DNA, 25 bp, Mus musculus
tgtgtaacataagtggtgcccgcca

SEQ ID NO: 490414 - DNA, 25 bp, Mus musculus
tgtgtaacgtggtgttctctctctg

SEQ ID NO: 490415 - DNA, 25 bp, Mus musculus
tgtgtaagaccagcatgcccgtgct

SEQ ID NO: 490416 - DNA, 25 bp, Mus musculus
tgtgtaagacggcaatcggagctct

SEQ ID NO: 490417 - DNA, 25 bp, Mus musculus
tgtgtaagatgttccgtcaaggcct

SEQ ID NO: 490418 - DNA, 25 bp, Mus musculus
tgtgtaagctcctgccatgtccaag

SEQ ID NO: 490419 - DNA, 25 bp, Mus musculus
tgtgtaagtgtgacccatcgcagct

SEQ ID NO: 490420 - DNA, 25 bp, Mus musculus
tgtgtaatagaaaagctctgcccgc

SEQ ID NO: 490421 - DNA, 25 bp, Mus musculus
tgtgtaatccactccctgcattaaa

SEQ ID NO: 490422 - DNA, 25 bp, Mus musculus
tgtgtaatccttccctcagcgagct

SEQ ID NO: 490423 - DNA, 25 bp, Mus musculus
tgtgtaatctctaccaagccctgta

SEQ ID NO: 490424 - DNA, 25 bp, Mus musculus
tgtgtaatgaagaatagctagctcc

SEQ ID NO: 490425 - DNA, 25 bp, Mus musculus
tgtgtaatgtggatccccgaaggcc

SEQ ID NO: 490426 - DNA, 25 bp, Mus musculus
tgtgtacaacctaggcactcagctc

SEQ ID NO: 490427 - DNA, 25 bp, Mus musculus
tgtgtacaacctggcgcctgatgca

SEQ ID NO: 490428 - DNA, 25 bp, Mus musculus
tgtgtacaataaagtgcgtgccctg

SEQ ID NO: 490429 - DNA, 25 bp, Mus musculus
tgtgtacacaaagccacggatgctg

SEQ ID NO: 490430 - DNA, 25 bp, Mus musculus
tgtgtacacattttccaaggctctg

SEQ ID NO: 490431 - DNA, 25 bp, Mus musculus
tgtgtacatcccactgggcgggtcc

SEQ ID NO: 490432 - DNA, 25 bp, Mus musculus
tgtgtacattttcagaggccctggc

SEQ ID NO: 490433 - DNA, 25 bp, Mus musculus
tgtgtaccaccacactgaattgtgc

SEQ ID NO: 490434 - DNA, 25 bp, Mus musculus
tgtgtaccaccattgactggcttca

SEQ ID NO: 490435 - DNA, 25 bp, Mus musculus
tgtgtaccagtcactactatctcaa

SEQ ID NO: 490436 - DNA, 25 bp, Mus musculus
tgtgtaccagtctgaagcccatggc

SEQ ID NO: 490437 - DNA, 25 bp, Mus musculus
tgtgtaccattgtttacccaggccg

SEQ ID NO: 490438 - DNA, 25 bp, Mus musculus
tgtgtacccattgcaaacgcaggag

SEQ ID NO: 490439 - DNA, 25 bp, Mus musculus
tgtgtacccgaatcttccagggatg

SEQ ID NO: 490440 - DNA, 25 bp, Mus musculus
tgtgtaccgtgtccatgcctgatgt

SEQ ID NO: 490441 - DNA, 25 bp, Mus musculus
tgtgtactgagtgcctgggtctgca

SEQ ID NO: 490442 - DNA, 25 bp, Mus musculus
tgtgtactgggcaaagggttatacc

SEQ ID NO: 490443 - DNA, 25 bp, Mus musculus
tgtgtactgtatatgagaccagagt

SEQ ID NO: 490444 - DNA, 25 bp, Mus musculus
tgtgtactttctgtccagttccttg

SEQ ID NO: 490445 - DNA, 25 bp, Mus musculus
tgtgtagaccccacacagaagtggg

SEQ ID NO: 490446 - DNA, 25 bp, Mus musculus
tgtgtagacgaaagcagcctgcgga

SEQ ID NO: 490447 - DNA, 25 bp, Mus musculus
tgtgtagaggtgaaagccttctgtc

SEQ ID NO: 490448 - DNA, 25 bp, Mus musculus
tgtgtagcccaaatggccaccagag

SEQ ID NO: 490449 - DNA, 25 bp, Mus musculus
tgtgtagcccaacagagaatggcct

SEQ ID NO: 490450 - DNA, 25 bp, Mus musculus
tgtgtagctttctgcgtctggtcct

SEQ ID NO: 490451 - DNA, 25 bp, Mus musculus
tgtgtagggctccacataggccaaa

SEQ ID NO: 490452 - DNA, 25 bp, Mus musculus
tgtgtagtaccagctagcacggctc

SEQ ID NO: 490453 - DNA, 25 bp, Mus musculus
tgtgtagtcataggaccagacgggt

SEQ ID NO: 490454 - DNA, 25 bp, Mus musculus
tgtgtagttcacaaatcccagatac

SEQ ID NO: 490455 - DNA, 25 bp, Mus musculus
tgtgtagttcagaggaaggcatccc

SEQ ID NO: 490456 - DNA, 25 bp, Mus musculus
tgtgtataacgctccacacccagga

SEQ ID NO: 490457 - DNA, 25 bp, Mus musculus
tgtgtatactactagcaagctggcc

SEQ ID NO: 490458 - DNA, 25 bp, Mus musculus
tgtgtatcaacaaaatcgaccggct

SEQ ID NO: 490459 - DNA, 25 bp, Mus musculus
tgtgtatcaagtccaaccatcaagg

SEQ ID NO: 490460 - DNA, 25 bp, Mus musculus
tgtgtatcacgtccctgacaacagg

SEQ ID NO: 490461 - DNA, 25 bp, Mus musculus
tgtgtatcagtcaccggaggctcac

SEQ ID NO: 490462 - DNA, 25 bp, Mus musculus
tgtgtatcagttcgagcatcagaca

SEQ ID NO: 490463 - DNA, 25 bp, Mus musculus
tgtgtatccagcttgtctccaggag

SEQ ID NO: 490464 - DNA, 25 bp, Mus musculus
tgtgtatccgtaggcttctttgaga

SEQ ID NO: 490465 - DNA, 25 bp, Mus musculus
tgtgtatccgtcaatcaagctgaga

SEQ ID NO: 490466 - DNA, 25 bp, Mus musculus
tgtgtatgataaactgccgcagccc

SEQ ID NO: 490467 - DNA, 25 bp, Mus musculus
tgtgtatgcacaatgaccaaaggcc

SEQ ID NO: 490468 - DNA, 25 bp, Mus musculus
tgtgtatgccaggatcccaaggcct

SEQ ID NO: 490469 - DNA, 25 bp, Mus musculus
tgtgtattatgtgaacgggcctgcc

SEQ ID NO: 490470 - DNA, 25 bp, Mus musculus
tgtgtattcagaggcccagtgaccg

SEQ ID NO: 490471 - DNA, 25 bp, Mus musculus
tgtgtattcatggagtcggccaggc

SEQ ID NO: 490472 - DNA, 25 bp, Mus musculus
tgtgtattccgagagcggactgcta

SEQ ID NO: 490473 - DNA, 25 bp, Mus musculus
tgtgtattgccaaccagttccctga

SEQ ID NO: 490474 - DNA, 25 bp, Mus musculus
tgtgtcaacaaatacttggaaatga

SEQ ID NO: 490475 - DNA, 25 bp, Mus musculus
tgtgtcaacacatccgtccaagtag

SEQ ID NO: 490476 - DNA, 25 bp, Mus musculus
tgtgtcaacaccaagggcagctacg

SEQ ID NO: 490477 - DNA, 25 bp, Mus musculus
tgtgtcaaggattgcccaggctgcc

SEQ ID NO: 490478 - DNA, 25 bp, Mus musculus
tgtgtcaatcctgaagatgcgctct

SEQ ID NO: 490479 - DNA, 25 bp, Mus musculus
tgtgtcacaatccacccaagacttg

SEQ ID NO: 490480 - DNA, 25 bp, Mus musculus
tgtgtcacacgggaaggtgcagcct

SEQ ID NO: 490481 - DNA, 25 bp, Mus musculus
tgtgtcacagaaatagcagcggcct

SEQ ID NO: 490482 - DNA, 25 bp, Mus musculus
tgtgtcacatcaaacaagttcctgg

SEQ ID NO: 490483 - DNA, 25 bp, Mus musculus
tgtgtcaccagaagggattgccgca

SEQ ID NO: 490484 - DNA, 25 bp, Mus musculus
tgtgtcacctcctgttacaatgaag

SEQ ID NO: 490485 - DNA, 25 bp, Mus musculus
tgtgtcactgcaggaatggaggctc

SEQ ID NO: 490486 - DNA, 25 bp, Mus musculus
tgtgtcagaccgaacaagtgcctct

SEQ ID NO: 490487 - DNA, 25 bp, Mus musculus
tgtgtcagccgcttgcagaagaccc

SEQ ID NO: 490488 - DNA, 25 bp, Mus musculus
tgtgtcaggccatggctgggctcat

SEQ ID NO: 490489 - DNA, 25 bp, Mus musculus
tgtgtcagggactccggcaacctgt

SEQ ID NO: 490490 - DNA, 25 bp, Mus musculus
tgtgtcagtaacaacccagggcctt

SEQ ID NO: 490491 - DNA, 25 bp, Mus musculus
tgtgtcagtgcgataaagccgccgc

SEQ ID NO: 490492 - DNA, 25 bp, Mus musculus
tgtgtcatcaacataggccagggtc

SEQ ID NO: 490493 - DNA, 25 bp, Mus musculus
tgtgtcatcagcatagcctccgttg

SEQ ID NO: 490494 - DNA, 25 bp, Mus musculus
tgtgtcatctgtggtatcatgcctg

SEQ ID NO: 490495 - DNA, 25 bp, Mus musculus
tgtgtcatcttgcagagtgagtgcc

SEQ ID NO: 490496 - DNA, 25 bp, Mus musculus
tgtgtcatggaagtgtcagctcgca

SEQ ID NO: 490497 - DNA, 25 bp, Mus musculus
tgtgtcattaaaggagccccgcgat

SEQ ID NO: 490498 - DNA, 25 bp, Mus musculus
tgtgtccaataccaaaatgcttcag

SEQ ID NO: 490499 - DNA, 25 bp, Mus musculus
tgtgtccaccaagcactaaagggct

SEQ ID NO: 490500 - DNA, 25 bp, Mus musculus
tgtgtccaccaataaaggcaaatgt

SEQ ID NO: 490501 - DNA, 25 bp, Mus musculus
tgtgtccagagaaccaggctgagca

SEQ ID NO: 490502 - DNA, 25 bp, Mus musculus
tgtgtccagtgcataagcggtcctc

SEQ ID NO: 490503 - DNA, 25 bp, Mus musculus
tgtgtccagttagctccatgcagcc

SEQ ID NO: 490504 - DNA, 25 bp, Mus musculus
tgtgtccatggcgaaccctctacat

SEQ ID NO: 490505 - DNA, 25 bp, Mus musculus
tgtgtcccaaggagtcgaccagaga

SEQ ID NO: 490506 - DNA, 25 bp, Mus musculus
tgtgtcccacaaaagccatgtcgtt

SEQ ID NO: 490507 - DNA, 25 bp, Mus musculus
tgtgtcccacgcacattccgggttc

SEQ ID NO: 490508 - DNA, 25 bp, Mus musculus
tgtgtcccactagaagacttcggag

SEQ ID NO: 490509 - DNA, 25 bp, Mus musculus
tgtgtcccagactgctctgcaaaga

SEQ ID NO: 490510 - DNA, 25 bp, Mus musculus
tgtgtccccaggaactgcaggaagt

SEQ ID NO: 490511 - DNA, 25 bp, Mus musculus
tgtgtccccatgtgttgagatgtca

SEQ ID NO: 490512 - DNA, 25 bp, Mus musculus
tgtgtcccctgcaggtaacaaggac

SEQ ID NO: 490513 - DNA, 25 bp, Mus musculus
tgtgtccccttcatgactgcccaag

SEQ ID NO: 490514 - DNA, 25 bp, Mus musculus
tgtgtcccgagtagcccagttgtgc

SEQ ID NO: 490515 - DNA, 25 bp, Mus musculus
tgtgtccctactaggctcttctggg

SEQ ID NO: 490516 - DNA, 25 bp, Mus musculus
tgtgtccctagcataatccacgagg

SEQ ID NO: 490517 - DNA, 25 bp, Mus musculus
tgtgtccctctgtcaggagatcgaa

SEQ ID NO: 490518 - DNA, 25 bp, Mus musculus
tgtgtccctgaagagcaaccttgta

SEQ ID NO: 490519 - DNA, 25 bp, Mus musculus
tgtgtcccttgtacagagctgtcag

SEQ ID NO: 490520 - DNA, 25 bp, Mus musculus
tgtgtccgcctacaagaaagtgagg

SEQ ID NO: 490521 - DNA, 25 bp, Mus musculus
tgtgtccggcctccacaagggacat

SEQ ID NO: 490522 - DNA, 25 bp, Mus musculus
tgtgtccgtcagcactacgatcggt

SEQ ID NO: 490523 - DNA, 25 bp, Mus musculus
tgtgtcctataccaaagcctacggg

SEQ ID NO: 490524 - DNA, 25 bp, Mus musculus
tgtgtcctcaaagtgcagggcgcac

SEQ ID NO: 490525 - DNA, 25 bp, Mus musculus
tgtgtcctcacctacagagatggct

SEQ ID NO: 490526 - DNA, 25 bp, Mus musculus
tgtgtcctccactgtacaaccggtg

SEQ ID NO: 490527 - DNA, 25 bp, Mus musculus
tgtgtcctctgtgcgaataataaag

SEQ ID NO: 490528 - DNA, 25 bp, Mus musculus
tgtgtcctgaccatggtaccactgc

SEQ ID NO: 490529 - DNA, 25 bp, Mus musculus
tgtgtcctgcgtgtatctgtcagcc

SEQ ID NO: 490530 - DNA, 25 bp, Mus musculus
tgtgtcctgtgtggagggtacttca

SEQ ID NO: 490531 - DNA, 25 bp, Mus musculus
tgtgtcctgtttagctcacccatgg

SEQ ID NO: 490532 - DNA, 25 bp, Mus musculus
tgtgtccttaatacacaaagtgggc

SEQ ID NO: 490533 - DNA, 25 bp, Mus musculus
tgtgtcggagtctttcatcccaagc

SEQ ID NO: 490534 - DNA, 25 bp, Mus musculus
tgtgtcgtacagaccacttgtgccg

SEQ ID NO: 490535 - DNA, 25 bp, Mus musculus
tgtgtctaactgtgatagtgacctc

SEQ ID NO: 490536 - DNA, 25 bp, Mus musculus
tgtgtctaccgctcacagctggcag

SEQ ID NO: 490537 - DNA, 25 bp, Mus musculus
tgtgtctagacaagccactgggacc

SEQ ID NO: 490538 - DNA, 25 bp, Mus musculus
tgtgtctcagaacacaacgctggcc

SEQ ID NO: 490539 - DNA, 25 bp, Mus musculus
tgtgtctccacaaatgaagccagtc

SEQ ID NO: 490540 - DNA, 25 bp, Mus musculus
tgtgtctccatccagagcagaggaa

SEQ ID NO: 490541 - DNA, 25 bp, Mus musculus
tgtgtctcgaatttaagctagccct

SEQ ID NO: 490542 - DNA, 25 bp, Mus musculus
tgtgtctctcttcccgagtggtccc

SEQ ID NO: 490543 - DNA, 25 bp, Mus musculus
tgtgtctctggaaacatcccgggac

SEQ ID NO: 490544 - DNA, 25 bp, Mus musculus
tgtgtctgaaactagtgcatccgtg

SEQ ID NO: 490545 - DNA, 25 bp, Mus musculus
tgtgtctgaacaaataaggcttagc

SEQ ID NO: 490546 - DNA, 25 bp, Mus musculus
tgtgtctgacatgagcgctgcagct

SEQ ID NO: 490547 - DNA, 25 bp, Mus musculus
tgtgtctgcactccactgtttcggg

SEQ ID NO: 490548 - DNA, 25 bp, Mus musculus
tgtgtctgccaaatactccgaatga

SEQ ID NO: 490549 - DNA, 25 bp, Mus musculus
tgtgtctggccaattccttggaaag

SEQ ID NO: 490550 - DNA, 25 bp, Mus musculus
tgtgtctggcggtggtacatcctca

SEQ ID NO: 490551 - DNA, 25 bp, Mus musculus
tgtgtctggtgctcagctgatcctg

SEQ ID NO: 490552 - DNA, 25 bp, Mus musculus
tgtgtctgtatgacccacccgaggt

SEQ ID NO: 490553 - DNA, 25 bp, Mus musculus
tgtgtctgtgaagtacgaccgccag

SEQ ID NO: 490554 - DNA, 25 bp, Mus musculus
tgtgtctgtgatacattactaagag

SEQ ID NO: 490555 - DNA, 25 bp, Mus musculus
tgtgtcttcaatgatacccggctgg

SEQ ID NO: 490556 - DNA, 25 bp, Mus musculus
tgtgtcttcacgcatacctgggctg

SEQ ID NO: 490557 - DNA, 25 bp, Mus musculus
tgtgtcttcccaggacgagcgtctg

SEQ ID NO: 490558 - DNA, 25 bp, Mus musculus
tgtgtcttcttcactcatgccctgg

SEQ ID NO: 490559 - DNA, 25 bp, Mus musculus
tgtgtcttttagtacgaccggaagc

SEQ ID NO: 490560 - DNA, 25 bp, Mus musculus
tgtgtgaaaactttgctagggaact

SEQ ID NO: 490561 - DNA, 25 bp, Mus musculus
tgtgtgaaaccatgaaggacgcccc

SEQ ID NO: 490562 - DNA, 25 bp, Mus musculus
tgtgtgaaaggctgggatccactcc

SEQ ID NO: 490563 - DNA, 25 bp, Mus musculus
tgtgtgaacgactccaggctggctt

SEQ ID NO: 490564 - DNA, 25 bp, Mus musculus
tgtgtgaagatcagcctggccaggc

SEQ ID NO: 490565 - DNA, 25 bp, Mus musculus
tgtgtgaagctggagcaagtcctgc

SEQ ID NO: 490566 - DNA, 25 bp, Mus musculus
tgtgtgacaacctagcttatggagt

SEQ ID NO: 490567 - DNA, 25 bp, Mus musculus
tgtgtgacatccctctgtatgacat

SEQ ID NO: 490568 - DNA, 25 bp, Mus musculus
tgtgtgacatgcgtgggatctccct

SEQ ID NO: 490569 - DNA, 25 bp, Mus musculus
tgtgtgaccaagtactaccgctgga

SEQ ID NO: 490570 - DNA, 25 bp, Mus musculus
tgtgtgaccaagtgttccccaaact

SEQ ID NO: 490571 - DNA, 25 bp, Mus musculus
tgtgtgaccacatgctttctgtacc

SEQ ID NO: 490572 - DNA, 25 bp, Mus musculus
tgtgtgaccctgtgaatgtaaaccc

SEQ ID NO: 490573 - DNA, 25 bp, Mus musculus
tgtgtgaccgctgacaagacgcttg

SEQ ID NO: 490574 - DNA, 25 bp, Mus musculus
tgtgtgaccggcaaaaggagtcatc

SEQ ID NO: 490575 - DNA, 25 bp, Mus musculus
tgtgtgacgacaacagtacaaaatc

SEQ ID NO: 490576 - DNA, 25 bp, Mus musculus
tgtgtgacggccagcattgagaccc

SEQ ID NO: 490577 - DNA, 25 bp, Mus musculus
tgtgtgactgaggatagaacactcc

SEQ ID NO: 490578 - DNA, 25 bp, Mus musculus
tgtgtgagcactccaaagagcgctg

SEQ ID NO: 490579 - DNA, 25 bp, Mus musculus
tgtgtgaggtcatcgatcatccaga

SEQ ID NO: 490580 - DNA, 25 bp, Mus musculus
tgtgtgagtgagtacagaccttgtc

SEQ ID NO: 490581 - DNA, 25 bp, Mus musculus
tgtgtgagtgcaggtcaacccaacc

SEQ ID NO: 490582 - DNA, 25 bp, Mus musculus
tgtgtgatacattagtcctgtctgc

SEQ ID NO: 490583 - DNA, 25 bp, Mus musculus
tgtgtgatcaccgactcttcctgga

SEQ ID NO: 490584 - DNA, 25 bp, Mus musculus
tgtgtgatggacaccaggtcctggc

SEQ ID NO: 490585 - DNA, 25 bp, Mus musculus
tgtgtgatgtactagaaacggttaa

SEQ ID NO: 490586 - DNA, 25 bp, Mus musculus
tgtgtgatgtcaggtctatgtccac

SEQ ID NO: 490587 - DNA, 25 bp, Mus musculus
tgtgtgcaacacgtgagtagcagcc

SEQ ID NO: 490588 - DNA, 25 bp, Mus musculus
tgtgtgcaacatagcaacctgaacc

SEQ ID NO: 490589 - DNA, 25 bp, Mus musculus
tgtgtgcaacgtgtcagctccagag

SEQ ID NO: 490590 - DNA, 25 bp, Mus musculus
tgtgtgcaagtttcccagtaacaac

SEQ ID NO: 490591 - DNA, 25 bp, Mus musculus
tgtgtgcacacatgaaaactctggg

SEQ ID NO: 490592 - DNA, 25 bp, Mus musculus
tgtgtgcagtcgcagaacttcgaag

SEQ ID NO: 490593 - DNA, 25 bp, Mus musculus
tgtgtgcatcaagccaagaaggtga

SEQ ID NO: 490594 - DNA, 25 bp, Mus musculus
tgtgtgcatcttccggtgtgtccta

SEQ ID NO: 490595 - DNA, 25 bp, Mus musculus
tgtgtgcatttcaaggtccatagcc

SEQ ID NO: 490596 - DNA, 25 bp, Mus musculus
tgtgtgccacatccttataatgcca

SEQ ID NO: 490597 - DNA, 25 bp, Mus musculus
tgtgtgccaccgactgcctctttag

SEQ ID NO: 490598 - DNA, 25 bp, Mus musculus
tgtgtgcccacaagaagtcgccagt

SEQ ID NO: 490599 - DNA, 25 bp, Mus musculus
tgtgtgcccaccagaggctcattga

SEQ ID NO: 490600 - DNA, 25 bp, Mus musculus
tgtgtgcccaggtatctatccccag

SEQ ID NO: 490601 - DNA, 25 bp, Mus musculus
tgtgtgccccttcgacggttgtaat

SEQ ID NO: 490602 - DNA, 25 bp, Mus musculus
tgtgtgccccttcgaggaatctcag

SEQ ID NO: 490603 - DNA, 25 bp, Mus musculus
tgtgtgccgcaataaccagaagtct

SEQ ID NO: 490604 - DNA, 25 bp, Mus musculus
tgtgtgccggtcatagaatacagct

SEQ ID NO: 490605 - DNA, 25 bp, Mus musculus
tgtgtgccgtgtggtacagaacaac

SEQ ID NO: 490606 - DNA, 25 bp, Mus musculus
tgtgtgcctacaagagctggccgca

SEQ ID NO: 490607 - DNA, 25 bp, Mus musculus
tgtgtgcctcatgacaggatgcctg

SEQ ID NO: 490608 - DNA, 25 bp, Mus musculus
tgtgtgcctcggaccttctgttgct

SEQ ID NO: 490609 - DNA, 25 bp, Mus musculus
tgtgtgccttgcctcctaccaagat

SEQ ID NO: 490610 - DNA, 25 bp, Mus musculus
tgtgtgcgcaacgagagcactggct

SEQ ID NO: 490611 - DNA, 25 bp, Mus musculus
tgtgtgcgcgcatggctctacagaa

SEQ ID NO: 490612 - DNA, 25 bp, Mus musculus
tgtgtgcggagagcgctcactgacc

SEQ ID NO: 490613 - DNA, 25 bp, Mus musculus
tgtgtgctacccttcacctaaagag

SEQ ID NO: 490614 - DNA, 25 bp, Mus musculus
tgtgtgctcctcttgtgcacctact

SEQ ID NO: 490615 - DNA, 25 bp, Mus musculus
tgtgtgctcctgtttcagatcgggc

SEQ ID NO: 490616 - DNA, 25 bp, Mus musculus
tgtgtgctctgggtgaaatatattt

SEQ ID NO: 490617 - DNA, 25 bp, Mus musculus
tgtgtgctcttctgcccggcgacgt

SEQ ID NO: 490618 - DNA, 25 bp, Mus musculus
tgtgtgctctttgcaacgtgcgggt

SEQ ID NO: 490619 - DNA, 25 bp, Mus musculus
tgtgtgctgaccatgaccctagtat

SEQ ID NO: 490620 - DNA, 25 bp, Mus musculus
tgtgtgctgcttctctgattggcct

SEQ ID NO: 490621 - DNA, 25 bp, Mus musculus
tgtgtgcttgaagaccagggctgct

SEQ ID NO: 490622 - DNA, 25 bp, Mus musculus
tgtgtggaaacatgcaggccctggt

SEQ ID NO: 490623 - DNA, 25 bp, Mus musculus
tgtgtggaacagacgggagccttct

SEQ ID NO: 490624 - DNA, 25 bp, Mus musculus
tgtgtggaagtagtgaaagcctctc

SEQ ID NO: 490625 - DNA, 25 bp, Mus musculus
tgtgtggaatccctgttcatggtca

SEQ ID NO: 490626 - DNA, 25 bp, Mus musculus
tgtgtggactacttgcagagttcag

SEQ ID NO: 490627 - DNA, 25 bp, Mus musculus
tgtgtggagggtacttcattgatgc

SEQ ID NO: 490628 - DNA, 25 bp, Mus musculus
tgtgtggcaaaaagatacttgcaag

SEQ ID NO: 490629 - DNA, 25 bp, Mus musculus
tgtgtggcaagcagatacattctac

SEQ ID NO: 490630 - DNA, 25 bp, Mus musculus
tgtgtggccttctgcctcttgggaa

SEQ ID NO: 490631 - DNA, 25 bp, Mus musculus
tgtgtggcgcgccatctgccacaat

SEQ ID NO: 490632 - DNA, 25 bp, Mus musculus
tgtgtggcgtgacttctctcatctc

SEQ ID NO: 490633 - DNA, 25 bp, Mus musculus
tgtgtggctggatgaacactcccca

SEQ ID NO: 490634 - DNA, 25 bp, Mus musculus
tgtgtgggacagatgaactaatgct

SEQ ID NO: 490635 - DNA, 25 bp, Mus musculus
tgtgtgggctacctgcatctcatct

SEQ ID NO: 490636 - DNA, 25 bp, Mus musculus
tgtgtgggctgtagagcctcagctt

SEQ ID NO: 490637 - DNA, 25 bp, Mus musculus
tgtgtgggtatatgcacatgagcac

SEQ ID NO: 490638 - DNA, 25 bp, Mus musculus
tgtgtggtaagaggtcaaaatgatt

SEQ ID NO: 490639 - DNA, 25 bp, Mus musculus
tgtgtggtcagcacagatcctggct

SEQ ID NO: 490640 - DNA, 25 bp, Mus musculus
tgtgtggtcgtcaacaaagtgggcc

SEQ ID NO: 490641 - DNA, 25 bp, Mus musculus
tgtgtggtctatgcagcccttgggc

SEQ ID NO: 490642 - DNA, 25 bp, Mus musculus
tgtgtggtgctcaatctggctgaac

SEQ ID NO: 490643 - DNA, 25 bp, Mus musculus
tgtgtggtgctcacgagcatcgctg

SEQ ID NO: 490644 - DNA, 25 bp, Mus musculus
tgtgtggtggaaactagacatccca

SEQ ID NO: 490645 - DNA, 25 bp, Mus musculus
tgtgtgtaaaaaagtggctgcaggc

SEQ ID NO: 490646 - DNA, 25 bp, Mus musculus
tgtgtgtaactaccctctggcggag

SEQ ID NO: 490647 - DNA, 25 bp, Mus musculus
tgtgtgtaagccagaggaccgcttg

SEQ ID NO: 490648 - DNA, 25 bp, Mus musculus
tgtgtgtaccttcgccatctgctgg

SEQ ID NO: 490649 - DNA, 25 bp, Mus musculus
tgtgtgtactggatggaactagact

SEQ ID NO: 490650 - DNA, 25 bp, Mus musculus
tgtgtgtacttcagacattgagaag

SEQ ID NO: 490651 - DNA, 25 bp, Mus musculus
tgtgtgtacttgtcgtgacgccacg

SEQ ID NO: 490652 - DNA, 25 bp, Mus musculus
tgtgtgtagatatgatgccggcccc

SEQ ID NO: 490653 - DNA, 25 bp, Mus musculus
tgtgtgtatatgcaacgctgcgcta

SEQ ID NO: 490654 - DNA, 25 bp, Mus musculus
tgtgtgtatgctaagtggtactttc

SEQ ID NO: 490655 - DNA, 25 bp, Mus musculus
tgtgtgtcaacaaagagctgtgtag

SEQ ID NO: 490656 - DNA, 25 bp, Mus musculus
tgtgtgtcagaacagccagtgtcgc

SEQ ID NO: 490657 - DNA, 25 bp, Mus musculus
tgtgtgtcaggttccaggccagtga

SEQ ID NO: 490658 - DNA, 25 bp, Mus musculus
tgtgtgtcatcctgttgaacaagag

SEQ ID NO: 490659 - DNA, 25 bp, Mus musculus
tgtgtgtccacaagaagctgcgctc

SEQ ID NO: 490660 - DNA, 25 bp, Mus musculus
tgtgtgtccagctttccgaaacgcc

SEQ ID NO: 490661 - DNA, 25 bp, Mus musculus
tgtgtgtccatcaacagcatcttgg

SEQ ID NO: 490662 - DNA, 25 bp, Mus musculus
tgtgtgtcccactcctaaggtcctg

SEQ ID NO: 490663 - DNA, 25 bp, Mus musculus
tgtgtgtcccagaaggtatatgtac

SEQ ID NO: 490664 - DNA, 25 bp, Mus musculus
tgtgtgtcctaccacctgaggagtg

SEQ ID NO: 490665 - DNA, 25 bp, Mus musculus
tgtgtgtcctggaaccttgaaagca

SEQ ID NO: 490666 - DNA, 25 bp, Mus musculus
tgtgtgtctaatgaacaaaggctct

SEQ ID NO: 490667 - DNA, 25 bp, Mus musculus
tgtgtgtgaaactaaagcaggtacc

SEQ ID NO: 490668 - DNA, 25 bp, Mus musculus
tgtgtgtgaactctcgtggtgatct

SEQ ID NO: 490669 - DNA, 25 bp, Mus musculus
tgtgtgtgacgtgtctaaaaataag

SEQ ID NO: 490670 - DNA, 25 bp, Mus musculus
tgtgtgtgcaccatcaaggacaacc

SEQ ID NO: 490671 - DNA, 25 bp, Mus musculus
tgtgtgtgctgagacgagaacccag

SEQ ID NO: 490672 - DNA, 25 bp, Mus musculus
tgtgtgtggccatccaaatatcacc

SEQ ID NO: 490673 - DNA, 25 bp, Mus musculus
tgtgtgtgtttctaccatcggagcc

SEQ ID NO: 490674 - DNA, 25 bp, Mus musculus
tgtgtgttaagtcccacacggctgg

SEQ ID NO: 490675 - DNA, 25 bp, Mus musculus
tgtgtgttaccctgctgtgatacca

SEQ ID NO: 490676 - DNA, 25 bp, Mus musculus
tgtgtgttattgttaccatctcagc

SEQ ID NO: 490677 - DNA, 25 bp, Mus musculus
tgtgtgttgtctggaactgacaacg

SEQ ID NO: 490678 - DNA, 25 bp, Mus musculus
tgtgtgtttcatttcctacagggaa

SEQ ID NO: 490679 - DNA, 25 bp, Mus musculus
tgtgtgtttgttgtttgaactgtcg

SEQ ID NO: 490680 - DNA, 25 bp, Mus musculus
tgtgttaatatgcttgatgccggcc

SEQ ID NO: 490681 - DNA, 25 bp, Mus musculus
tgtgttacagtatattaccgtcgga

SEQ ID NO: 490682 - DNA, 25 bp, Mus musculus
tgtgttacccagcactgccagacag

SEQ ID NO: 490683 - DNA, 25 bp, Mus musculus
tgtgttacctgttggcctaggccgc

SEQ ID NO: 490684 - DNA, 25 bp, Mus musculus
tgtgttacttgcgtggcctcaaccg

SEQ ID NO: 490685 - DNA, 25 bp, Mus musculus
tgtgttagaagataaaagaagcaat

SEQ ID NO: 490686 - DNA, 25 bp, Mus musculus
tgtgttaggatatacgctccgtgaa

SEQ ID NO: 490687 - DNA, 25 bp, Mus musculus
tgtgttatccatcccatttggcatg

SEQ ID NO: 490688 - DNA, 25 bp, Mus musculus
tgtgttatcttagggccaggccaat

SEQ ID NO: 490689 - DNA, 25 bp, Mus musculus
tgtgttcaacaaagcttgtccccag

SEQ ID NO: 490690 - DNA, 25 bp, Mus musculus
tgtgttcaacacctactacgccctg

SEQ ID NO: 490691 - DNA, 25 bp, Mus musculus
tgtgttcaagcaagtgtgccagcct

SEQ ID NO: 490692 - DNA, 25 bp, Mus musculus
tgtgttcaccacaggaatcatgacc

SEQ ID NO: 490693 - DNA, 25 bp, Mus musculus
tgtgttcactctgcaaaccttgctg

SEQ ID NO: 490694 - DNA, 25 bp, Mus musculus
tgtgttcactgagatccttcaggga

SEQ ID NO: 490695 - DNA, 25 bp, Mus musculus
tgtgttcacttcaatgtagccgtcg

SEQ ID NO: 490696 - DNA, 25 bp, Mus musculus
tgtgttcaggcagccaggagtcaaa

SEQ ID NO: 490697 - DNA, 25 bp, Mus musculus
tgtgttcagtgtgtgcttccaagga

SEQ ID NO: 490698 - DNA, 25 bp, Mus musculus
tgtgttcatgtctcagccaagctct

SEQ ID NO: 490699 - DNA, 25 bp, Mus musculus
tgtgttccagaaaccctatgggagc

SEQ ID NO: 490700 - DNA, 25 bp, Mus musculus
tgtgttccccgtgcaagaggacgac

SEQ ID NO: 490701 - DNA, 25 bp, Mus musculus
tgtgttccgagcacagtacagaagg

SEQ ID NO: 490702 - DNA, 25 bp, Mus musculus
tgtgttccggaagatcagcgacgtg

SEQ ID NO: 490703 - DNA, 25 bp, Mus musculus
tgtgttcctgactgctgttggtcat

SEQ ID NO: 490704 - DNA, 25 bp, Mus musculus
tgtgttctatagatgggtcggccct

SEQ ID NO: 490705 - DNA, 25 bp, Mus musculus
tgtgttctatgcacctgaccgaaga

SEQ ID NO: 490706 - DNA, 25 bp, Mus musculus
tgtgttctcttaccccatgagccag

SEQ ID NO: 490707 - DNA, 25 bp, Mus musculus
tgtgttctggtcacgagcagccaca

SEQ ID NO: 490708 - DNA, 25 bp, Mus musculus
tgtgttgaggcagatgcagtgcttc

SEQ ID NO: 490709 - DNA, 25 bp, Mus musculus
tgtgttgcagcatctcgggatgaca

SEQ ID NO: 490710 - DNA, 25 bp, Mus musculus
tgtgttgcggcttgcctgttaggtt

SEQ ID NO: 490711 - DNA, 25 bp, Mus musculus
tgtgttgctcaaggctaccagcgcg

SEQ ID NO: 490712 - DNA, 25 bp, Mus musculus
tgtgttgcttgcctgggtagtcccc

SEQ ID NO: 490713 - DNA, 25 bp, Mus musculus
tgtgttggaagttcgtgagccccgc

SEQ ID NO: 490714 - DNA, 25 bp, Mus musculus
tgtgttggccaaaattcaatttact

SEQ ID NO: 490715 - DNA, 25 bp, Mus musculus
tgtgttgggcctgttaatgatctcc

SEQ ID NO: 490716 - DNA, 25 bp, Mus musculus
tgtgttggtgctgtgatcatgactc

SEQ ID NO: 490717 - DNA, 25 bp, Mus musculus
tgtgtttaatcagggagtccaggcc

SEQ ID NO: 490718 - DNA, 25 bp, Mus musculus
tgtgtttacctgaatgttgcctgac

SEQ ID NO: 490719 - DNA, 25 bp, Mus musculus
tgtgtttatcttccagcccaacggg

SEQ ID NO: 490720 - DNA, 25 bp, Mus musculus
tgtgtttccaccacaatcttcagga

SEQ ID NO: 490721 - DNA, 25 bp, Mus musculus
tgtgtttccactcatagccaagggt

SEQ ID NO: 490722 - DNA, 25 bp, Mus musculus
tgtgtttccagagcgaatctcagcc

SEQ ID NO: 490723 - DNA, 25 bp, Mus musculus
tgtgtttccataaagggctccgcaa

SEQ ID NO: 490724 - DNA, 25 bp, Mus musculus
tgtgtttcccagcttccagggccac

SEQ ID NO: 490725 - DNA, 25 bp, Mus musculus
tgtgtttcgatctgggaaaggactg

SEQ ID NO: 490726 - DNA, 25 bp, Mus musculus
tgtgtttctataaagagccaagtag

SEQ ID NO: 490727 - DNA, 25 bp, Mus musculus
tgtgtttgaaaagggcgagtaccca

SEQ ID NO: 490728 - DNA, 25 bp, Mus musculus
tgtgtttgaactttgctcagctcag

SEQ ID NO: 490729 - DNA, 25 bp, Mus musculus
tgtgtttgccatggatccccggaat

SEQ ID NO: 490730 - DNA, 25 bp, Mus musculus
tgtgtttggccaccgcacagtgtca

SEQ ID NO: 490731 - DNA, 25 bp, Mus musculus
tgtgtttgtggagttacctctggtc

SEQ ID NO: 490732 - DNA, 25 bp, Mus musculus
tgtgtttgtgggaacatggccccgc

SEQ ID NO: 490733 - DNA, 25 bp, Mus musculus
tgtgttttacaatgcagagagtgga

SEQ ID NO: 490734 - DNA, 25 bp, Mus musculus
tgtgttttaggaccacaccggctgt

SEQ ID NO: 490735 - DNA, 25 bp, Mus musculus
tgtgtttttcactgctgttacccct

SEQ ID NO: 490736 - DNA, 25 bp, Mus musculus
tgtgtttttgcacctggccgcctgg

SEQ ID NO: 490737 - DNA, 25 bp, Mus musculus
tgttaaaaatattcaataggctctt

SEQ ID NO: 490738 - DNA, 25 bp, Mus musculus
tgttaaaaattcagacggtcaagca

SEQ ID NO: 490739 - DNA, 25 bp, Mus musculus
tgttaaaagtgactcccaggtgcca

SEQ ID NO: 490740 - DNA, 25 bp, Mus musculus
tgttaaacattgcttaccttagtgg

SEQ ID NO: 490741 - DNA, 25 bp, Mus musculus
tgttaaaccaataaacgcaccaata

SEQ ID NO: 490742 - DNA, 25 bp, Mus musculus
tgttaaacccctagaccacctggtg

SEQ ID NO: 490743 - DNA, 25 bp, Mus musculus
tgttaaagaatacccactggcatgg

SEQ ID NO: 490744 - DNA, 25 bp, Mus musculus
tgttaaagacagaagcctgcccgag

SEQ ID NO: 490745 - DNA, 25 bp, Mus musculus
tgttaaagagaccatcccagtgatg

SEQ ID NO: 490746 - DNA, 25 bp, Mus musculus
tgttaaagagacgagcacgcacatc

SEQ ID NO: 490747 - DNA, 25 bp, Mus musculus
tgttaaaggcacaggtgtcttccca

SEQ ID NO: 490748 - DNA, 25 bp, Mus musculus
tgttaaagtcatccggctgatcggc

SEQ ID NO: 490749 - DNA, 25 bp, Mus musculus
tgttaaagtggtgtcctgccccaga

SEQ ID NO: 490750 - DNA, 25 bp, Mus musculus
tgttaaataaacacaccgagggcca

SEQ ID NO: 490751 - DNA, 25 bp, Mus musculus
tgttaaatgaccacaagacctttgg

SEQ ID NO: 490752 - DNA, 25 bp, Mus musculus
tgttaacaagcaggaaacctggatg

SEQ ID NO: 490753 - DNA, 25 bp, Mus musculus
tgttaacagcaccatggacctccag

SEQ ID NO: 490754 - DNA, 25 bp, Mus musculus
tgttaacattgtcccaaagaggagc

SEQ ID NO: 490755 - DNA, 25 bp, Mus musculus
tgttaaccccagtaaacgtccgatg

SEQ ID NO: 490756 - DNA, 25 bp, Mus musculus
tgttaactacatccggacgagtgag

SEQ ID NO: 490757 - DNA, 25 bp, Mus musculus
tgttaactcccagggaatccgttct

SEQ ID NO: 490758 - DNA, 25 bp, Mus musculus
tgttaactgatacgctaagtccact

SEQ ID NO: 490759 - DNA, 25 bp, Mus musculus
tgttaactgctaggatgccctacct

SEQ ID NO: 490760 - DNA, 25 bp, Mus musculus
tgttaagagaaagcgggtccaggca

SEQ ID NO: 490761 - DNA, 25 bp, Mus musculus
tgttaagcaaagaggccgcattaga

SEQ ID NO: 490762 - DNA, 25 bp, Mus musculus
tgttaagcatagagcgaggattcca

SEQ ID NO: 490763 - DNA, 25 bp, Mus musculus
tgttaagccctagtgcaggagccac

SEQ ID NO: 490764 - DNA, 25 bp, Mus musculus
tgttaagcggctgccgatgctgctg

SEQ ID NO: 490765 - DNA, 25 bp, Mus musculus
tgttaaggaacatagccgccacagg

SEQ ID NO: 490766 - DNA, 25 bp, Mus musculus
tgttaaggtacatccaaatagccct

SEQ ID NO: 490767 - DNA, 25 bp, Mus musculus
tgttaagtgggaccctcagcctacc

SEQ ID NO: 490768 - DNA, 25 bp, Mus musculus
tgttaataaccacagcagccctagt

SEQ ID NO: 490769 - DNA, 25 bp, Mus musculus
tgttaataactggaggccgccatcc

SEQ ID NO: 490770 - DNA, 25 bp, Mus musculus
tgttaatgatctccaccaggttgtt

SEQ ID NO: 490771 - DNA, 25 bp, Mus musculus
tgttaatgcccgcttactgccgcaa

SEQ ID NO: 490772 - DNA, 25 bp, Mus musculus
tgttaatggaactgagaaaaagacc

SEQ ID NO: 490773 - DNA, 25 bp, Mus musculus
tgttaattctgcacttccatgaggg

SEQ ID NO: 490774 - DNA, 25 bp, Mus musculus
tgttacaactcaggtcgctcttcag

SEQ ID NO: 490775 - DNA, 25 bp, Mus musculus
tgttacaagcagatggtgcctgggc

SEQ ID NO: 490776 - DNA, 25 bp, Mus musculus
tgttacaagctccacatgggcccag

SEQ ID NO: 490777 - DNA, 25 bp, Mus musculus
tgttacagacaggagacccggagtc

SEQ ID NO: 490778 - DNA, 25 bp, Mus musculus
tgttacagagcttccatgggcacgg

SEQ ID NO: 490779 - DNA, 25 bp, Mus musculus
tgttacagcaacttccatcccgagg

SEQ ID NO: 490780 - DNA, 25 bp, Mus musculus
tgttacaggtccagcccactgggag

SEQ ID NO: 490781 - DNA, 25 bp, Mus musculus
tgttacagtcaaacggaaacgtcgg

SEQ ID NO: 490782 - DNA, 25 bp, Mus musculus
tgttacataagagagatttccccgt

SEQ ID NO: 490783 - DNA, 25 bp, Mus musculus
tgttacatctacagctgggagcatg

SEQ ID NO: 490784 - DNA, 25 bp, Mus musculus
tgttacatcttgtcgctcgctcgct

SEQ ID NO: 490785 - DNA, 25 bp, Mus musculus
tgttacatgtttgcttgaaggctgg

SEQ ID NO: 490786 - DNA, 25 bp, Mus musculus
tgttaccactgtttcactgagaaga

SEQ ID NO: 490787 - DNA, 25 bp, Mus musculus
tgttaccagcatacccactcatctg

SEQ ID NO: 490788 - DNA, 25 bp, Mus musculus
tgttaccatagtcttcacgccacgt

SEQ ID NO: 490789 - DNA, 25 bp, Mus musculus
tgttacccctctactgaatcccatt

SEQ ID NO: 490790 - DNA, 25 bp, Mus musculus
tgttaccgatgggttcagggcacca

SEQ ID NO: 490791 - DNA, 25 bp, Mus musculus
tgttaccgccgagtggaaaagctgc

SEQ ID NO: 490792 - DNA, 25 bp, Mus musculus
tgttacctagcagtaagctgacaga

SEQ ID NO: 490793 - DNA, 25 bp, Mus musculus
tgttacctcaccatcgccatattgg

SEQ ID NO: 490794 - DNA, 25 bp, Mus musculus
tgttacctcatgtcggtgcccgctg

SEQ ID NO: 490795 - DNA, 25 bp, Mus musculus
tgttacctgacggaaactgccctct

SEQ ID NO: 490796 - DNA, 25 bp, Mus musculus
tgttacctgcgatgcaatgtcgtgg

SEQ ID NO: 490797 - DNA, 25 bp, Mus musculus
tgttacctgtgattgtcaccccatc

SEQ ID NO: 490798 - DNA, 25 bp, Mus musculus
tgttacgagatcaagcatggagacc

SEQ ID NO: 490799 - DNA, 25 bp, Mus musculus
tgttacgcatctctcacagttgtga

SEQ ID NO: 490800 - DNA, 25 bp, Mus musculus
tgttacggaccaaatgtgggtgccc

SEQ ID NO: 490801 - DNA, 25 bp, Mus musculus
tgttacggccaggaagtggagtcca

SEQ ID NO: 490802 - DNA, 25 bp, Mus musculus
tgttactaatcatgtgagacactgg

SEQ ID NO: 490803 - DNA, 25 bp, Mus musculus
tgttactagtccaagcgccaagagg

SEQ ID NO: 490804 - DNA, 25 bp, Mus musculus
tgttactagtctgcagtggtcccca

SEQ ID NO: 490805 - DNA, 25 bp, Mus musculus
tgttactgaacatctcataaataag

SEQ ID NO: 490806 - DNA, 25 bp, Mus musculus
tgttactgaggtcacaagcctgccc

SEQ ID NO: 490807 - DNA, 25 bp, Mus musculus
tgttactgcaagaaacccacctggt

SEQ ID NO: 490808 - DNA, 25 bp, Mus musculus
tgttactggacctcatctctacagc

SEQ ID NO: 490809 - DNA, 25 bp, Mus musculus
tgttactggcgagagaaggtccctg

SEQ ID NO: 490810 - DNA, 25 bp, Mus musculus
tgttactgtagaagagactgcctca

SEQ ID NO: 490811 - DNA, 25 bp, Mus musculus
tgttacttaccccaaggtgagctgg

SEQ ID NO: 490812 - DNA, 25 bp, Mus musculus
tgttagaactacttggagggcatgg

SEQ ID NO: 490813 - DNA, 25 bp, Mus musculus
tgttagaccgcgatacaaaagctgc

SEQ ID NO: 490814 - DNA, 25 bp, Mus musculus
tgttagactccatccaagctaggga

SEQ ID NO: 490815 - DNA, 25 bp, Mus musculus
tgttagactgtctactttggccata

SEQ ID NO: 490816 - DNA, 25 bp, Mus musculus
tgttagagacattacccatggagta

SEQ ID NO: 490817 - DNA, 25 bp, Mus musculus
tgttagagatggtggcgttgatcca

SEQ ID NO: 490818 - DNA, 25 bp, Mus musculus
tgttagagcagagttcagaggcccc

SEQ ID NO: 490819 - DNA, 25 bp, Mus musculus
tgttagaggccacgcatgctgatgt

SEQ ID NO: 490820 - DNA, 25 bp, Mus musculus
tgttagataacaggcagaagccagg

SEQ ID NO: 490821 - DNA, 25 bp, Mus musculus
tgttagatcacagcatggagtcgtt

SEQ ID NO: 490822 - DNA, 25 bp, Mus musculus
tgttagcacattcatttcatcagag

SEQ ID NO: 490823 - DNA, 25 bp, Mus musculus
tgttagcagttcaaaatgaagtccc

SEQ ID NO: 490824 - DNA, 25 bp, Mus musculus
tgttagcatctatcaaagttagagg

SEQ ID NO: 490825 - DNA, 25 bp, Mus musculus
tgttagcattcaagtcaggaggctc

SEQ ID NO: 490826 - DNA, 25 bp, Mus musculus
tgttagccaacaggtgcacgaatcc

SEQ ID NO: 490827 - DNA, 25 bp, Mus musculus
tgttagccaggcgaccacacttgtc

SEQ ID NO: 490828 - DNA, 25 bp, Mus musculus
tgttagcccaagttgacggaagccc

SEQ ID NO: 490829 - DNA, 25 bp, Mus musculus
tgttagccgaaaaggcaagaactcc

SEQ ID NO: 490830 - DNA, 25 bp, Mus musculus
tgttagcgaaaccatgactgaggag

SEQ ID NO: 490831 - DNA, 25 bp, Mus musculus
tgttagcgcaggattagagctctct

SEQ ID NO: 490832 - DNA, 25 bp, Mus musculus
tgttaggaagcagtgatgcacagga

SEQ ID NO: 490833 - DNA, 25 bp, Mus musculus
tgttaggcgtctatctcaccgtgcg

SEQ ID NO: 490834 - DNA, 25 bp, Mus musculus
tgttaggcttatcagaagaaactct

SEQ ID NO: 490835 - DNA, 25 bp, Mus musculus
tgttagggtcatctgaactgcttcc

SEQ ID NO: 490836 - DNA, 25 bp, Mus musculus
tgttagtcacacagactgatcctgg

SEQ ID NO: 490837 - DNA, 25 bp, Mus musculus
tgttagtcacggagacgcagagacc

SEQ ID NO: 490838 - DNA, 25 bp, Mus musculus
tgttagtcagttactgtagtcagga

SEQ ID NO: 490839 - DNA, 25 bp, Mus musculus
tgttagtgctcaaatggatcggacc

SEQ ID NO: 490840 - DNA, 25 bp, Mus musculus
tgttataacccctaagaagcacgcg

SEQ ID NO: 490841 - DNA, 25 bp, Mus musculus
tgttatacgtcaccaaatgccccac

SEQ ID NO: 490842 - DNA, 25 bp, Mus musculus
tgttatagaagcacacctttacgag

SEQ ID NO: 490843 - DNA, 25 bp, Mus musculus
tgttatagcttagtaaatgcaccta

SEQ ID NO: 490844 - DNA, 25 bp, Mus musculus
tgttatagttcagcgaagagacgcc

SEQ ID NO: 490845 - DNA, 25 bp, Mus musculus
tgttatatcaatcacggagtctgga

SEQ ID NO: 490846 - DNA, 25 bp, Mus musculus
tgttatcaagattgccgtggagccg

SEQ ID NO: 490847 - DNA, 25 bp, Mus musculus
tgttatcactttttggcactggagc

SEQ ID NO: 490848 - DNA, 25 bp, Mus musculus
tgttatcagctcaccacagttggca

SEQ ID NO: 490849 - DNA, 25 bp, Mus musculus
tgttatcagggactggaaactctac

SEQ ID NO: 490850 - DNA, 25 bp, Mus musculus
tgttatccaacagaagaagccggcc

SEQ ID NO: 490851 - DNA, 25 bp, Mus musculus
tgttatcccagatgaggtcctgcag

SEQ ID NO: 490852 - DNA, 25 bp, Mus musculus
tgttatcctttgagaacaggctgac

SEQ ID NO: 490853 - DNA, 25 bp, Mus musculus
tgttatcgaggttcatgacgccagg

SEQ ID NO: 490854 - DNA, 25 bp, Mus musculus
tgttatctacactgaccaggctgga

SEQ ID NO: 490855 - DNA, 25 bp, Mus musculus
tgttatctcgtccaaaagcagagcg

SEQ ID NO: 490856 - DNA, 25 bp, Mus musculus
tgttatctggccctaccagagctag

SEQ ID NO: 490857 - DNA, 25 bp, Mus musculus
tgttatgaaggcaaggatggccctg

SEQ ID NO: 490858 - DNA, 25 bp, Mus musculus
tgttatgcgccacaaaagagccaag

SEQ ID NO: 490859 - DNA, 25 bp, Mus musculus
tgttatgggagacacgacttggcct

SEQ ID NO: 490860 - DNA, 25 bp, Mus musculus
tgttattaagatgagtccagcccct

SEQ ID NO: 490861 - DNA, 25 bp, Mus musculus
tgttattcacagaaccgtgggcacc

SEQ ID NO: 490862 - DNA, 25 bp, Mus musculus
tgttattcttcaaaatccagatgct

SEQ ID NO: 490863 - DNA, 25 bp, Mus musculus
tgttattggaaaagcaagccggtgg

SEQ ID NO: 490864 - DNA, 25 bp, Mus musculus
tgttattggcaccttcctgcacatg

SEQ ID NO: 490865 - DNA, 25 bp, Mus musculus
tgttcaaaaatatggcgagccgacc

SEQ ID NO: 490866 - DNA, 25 bp, Mus musculus
tgttcaaagctggtgaagcggcgcc

SEQ ID NO: 490867 - DNA, 25 bp, Mus musculus
tgttcaaagtgactccagccatggg

SEQ ID NO: 490868 - DNA, 25 bp, Mus musculus
tgttcaaattgagatggcccacggc

SEQ ID NO: 490869 - DNA, 25 bp, Mus musculus
tgttcaacagcccagaaatgcaggc

SEQ ID NO: 490870 - DNA, 25 bp, Mus musculus
tgttcaacccaggatgctatcggcc

SEQ ID NO: 490871 - DNA, 25 bp, Mus musculus
tgttcaacgagaagggcacgagcct

SEQ ID NO: 490872 - DNA, 25 bp, Mus musculus
tgttcaacgtgaaggaccagacagt

SEQ ID NO: 490873 - DNA, 25 bp, Mus musculus
tgttcaagaacacgttccagagtgg

SEQ ID NO: 490874 - DNA, 25 bp, Mus musculus
tgttcaagaaggcaagccccaatgg

SEQ ID NO: 490875 - DNA, 25 bp, Mus musculus
tgttcaagaccgcacataaagcccg

SEQ ID NO: 490876 - DNA, 25 bp, Mus musculus
tgttcaagcaacagattatccagag

SEQ ID NO: 490877 - DNA, 25 bp, Mus musculus
tgttcaagcagggactgtagaccag

SEQ ID NO: 490878 - DNA, 25 bp, Mus musculus
tgttcaagcctggagcctggttcaa

SEQ ID NO: 490879 - DNA, 25 bp, Mus musculus
tgttcaagccttcttcgggtcccag

SEQ ID NO: 490880 - DNA, 25 bp, Mus musculus
tgttcaaggagaggcgctgcaacac

SEQ ID NO: 490881 - DNA, 25 bp, Mus musculus
tgttcaagtacagtcagccacgtca

SEQ ID NO: 490882 - DNA, 25 bp, Mus musculus
tgttcaagtccaaacagcgcggagt

SEQ ID NO: 490883 - DNA, 25 bp, Mus musculus
tgttcaagttcgagatccccagcaa

SEQ ID NO: 490884 - DNA, 25 bp, Mus musculus
tgttcaatgagtccaccggctatcc

SEQ ID NO: 490885 - DNA, 25 bp, Mus musculus
tgttcaatgcaagtgagcctgaccc

SEQ ID NO: 490886 - DNA, 25 bp, Mus musculus
tgttcaatgcctgagttccctggag

SEQ ID NO: 490887 - DNA, 25 bp, Mus musculus
tgttcacaaaaagcgagtctcagcc

SEQ ID NO: 490888 - DNA, 25 bp, Mus musculus
tgttcacaactatccttaactccag

SEQ ID NO: 490889 - DNA, 25 bp, Mus musculus
tgttcacaataatgataaactcacc

SEQ ID NO: 490890 - DNA, 25 bp, Mus musculus
tgttcacaccgcgtctgccgtgttt

SEQ ID NO: 490891 - DNA, 25 bp, Mus musculus
tgttcacacggacctatccaaggga

SEQ ID NO: 490892 - DNA, 25 bp, Mus musculus
tgttcacaggaacctttggccagtg

SEQ ID NO: 490893 - DNA, 25 bp, Mus musculus
tgttcacagtcgaatccgaaacccg

SEQ ID NO: 490894 - DNA, 25 bp, Mus musculus
tgttcacagtgaataaagggcccct

SEQ ID NO: 490895 - DNA, 25 bp, Mus musculus
tgttcacattcctcaaccgggtcaa

SEQ ID NO: 490896 - DNA, 25 bp, Mus musculus
tgttcaccaaccacgatgccagggt

SEQ ID NO: 490897 - DNA, 25 bp, Mus musculus
tgttcaccatcagagtcaaaggccg

SEQ ID NO: 490898 - DNA, 25 bp, Mus musculus
tgttcaccctgaagacgatggctgt

SEQ ID NO: 490899 - DNA, 25 bp, Mus musculus
tgttcaccgccgcaattgcacaggt

SEQ ID NO: 490900 - DNA, 25 bp, Mus musculus
tgttcacctagttcccaggaaggct

SEQ ID NO: 490901 - DNA, 25 bp, Mus musculus
tgttcacctcaagggcatggaagta

SEQ ID NO: 490902 - DNA, 25 bp, Mus musculus
tgttcacgcgagtggagctcccgaa

SEQ ID NO: 490903 - DNA, 25 bp, Mus musculus
tgttcacgcggttcctgatgggcaa

SEQ ID NO: 490904 - DNA, 25 bp, Mus musculus
tgttcactaccttgggactcttaca

SEQ ID NO: 490905 - DNA, 25 bp, Mus musculus
tgttcactagctctcacagaaggag

SEQ ID NO: 490906 - DNA, 25 bp, Mus musculus
tgttcactcagctcctgttggcagg

SEQ ID NO: 490907 - DNA, 25 bp, Mus musculus
tgttcactccatcttcacatctgca

SEQ ID NO: 490908 - DNA, 25 bp, Mus musculus
tgttcactgacttccactgcactga

SEQ ID NO: 490909 - DNA, 25 bp, Mus musculus
tgttcactgcgagttaatgacagag

SEQ ID NO: 490910 - DNA, 25 bp, Mus musculus
tgttcactgggatcttcacggcgga

SEQ ID NO: 490911 - DNA, 25 bp, Mus musculus
tgttcactgtctgctactgtgctgt

SEQ ID NO: 490912 - DNA, 25 bp, Mus musculus
tgttcacttagctcgggatttcggg

SEQ ID NO: 490913 - DNA, 25 bp, Mus musculus
tgttcagaacgcaaccctggctgtg

SEQ ID NO: 490914 - DNA, 25 bp, Mus musculus
tgttcagaagagagagaatcctatg

SEQ ID NO: 490915 - DNA, 25 bp, Mus musculus
tgttcagactcaaaatgggagccca

SEQ ID NO: 490916 - DNA, 25 bp, Mus musculus
tgttcagagatcagttgggaccatt

SEQ ID NO: 490917 - DNA, 25 bp, Mus musculus
tgttcagaggcgctgagacgtaacc

SEQ ID NO: 490918 - DNA, 25 bp, Mus musculus
tgttcagcatcgacaacatcctggc

SEQ ID NO: 490919 - DNA, 25 bp, Mus musculus
tgttcagccctcctggtgcggtcct

SEQ ID NO: 490920 - DNA, 25 bp, Mus musculus
tgttcagcgaacagcacaagcgtgc

SEQ ID NO: 490921 - DNA, 25 bp, Mus musculus
tgttcaggaaacctctaggacatgc

SEQ ID NO: 490922 - DNA, 25 bp, Mus musculus
tgttcaggaatgagagtgtgcgtcc

SEQ ID NO: 490923 - DNA, 25 bp, Mus musculus
tgttcaggacatcgacactccagag

SEQ ID NO: 490924 - DNA, 25 bp, Mus musculus
tgttcaggaccaaacgatctgcgct

SEQ ID NO: 490925 - DNA, 25 bp, Mus musculus
tgttcaggagctgttgtaggtcaga

SEQ ID NO: 490926 - DNA, 25 bp, Mus musculus
tgttcaggcacgcatgttgagctct

SEQ ID NO: 490927 - DNA, 25 bp, Mus musculus
tgttcaggccggttctccattgcct

SEQ ID NO: 490928 - DNA, 25 bp, Mus musculus
tgttcagggaactcgtgggtctact

SEQ ID NO: 490929 - DNA, 25 bp, Mus musculus
tgttcagggcaacctcctgcccagt

SEQ ID NO: 490930 - DNA, 25 bp, Mus musculus
tgttcaggtcacacagctggtagcg

SEQ ID NO: 490931 - DNA, 25 bp, Mus musculus
tgttcagtcctacaaccacaactgc

SEQ ID NO: 490932 - DNA, 25 bp, Mus musculus
tgttcagtctggtggttgctcagga

SEQ ID NO: 490933 - DNA, 25 bp, Mus musculus
tgttcagtcttacgagtgtgctcca

SEQ ID NO: 490934 - DNA, 25 bp, Mus musculus
tgttcagtgatgttgcagccagctc

SEQ ID NO: 490935 - DNA, 25 bp, Mus musculus
tgttcagtggtagatataccgcgct

SEQ ID NO: 490936 - DNA, 25 bp, Mus musculus
tgttcagttggctctactgccttga

SEQ ID NO: 490937 - DNA, 25 bp, Mus musculus
tgttcatacctagtgggccattctc

SEQ ID NO: 490938 - DNA, 25 bp, Mus musculus
tgttcatcaaacacatgccaggctg

SEQ ID NO: 490939 - DNA, 25 bp, Mus musculus
tgttcatcatcaaatctgaactccc

SEQ ID NO: 490940 - DNA, 25 bp, Mus musculus
tgttcatcatggacaagccggtctg

SEQ ID NO: 490941 - DNA, 25 bp, Mus musculus
tgttcatccaacctcacttgagtgt

SEQ ID NO: 490942 - DNA, 25 bp, Mus musculus
tgttcatcctgacagcagatttgtg

SEQ ID NO: 490943 - DNA, 25 bp, Mus musculus
tgttcatcgacgaggtccacatgct

SEQ ID NO: 490944 - DNA, 25 bp, Mus musculus
tgttcatgaatgcatacggttttta

SEQ ID NO: 490945 - DNA, 25 bp, Mus musculus
tgttcatgagaaggcaatgctgtca

SEQ ID NO: 490946 - DNA, 25 bp, Mus musculus
tgttcatgcctatacaaagacaggg

SEQ ID NO: 490947 - DNA, 25 bp, Mus musculus
tgttcatggcatcaagactcagggt

SEQ ID NO: 490948 - DNA, 25 bp, Mus musculus
tgttcatggtgctctggctcaaggg

SEQ ID NO: 490949 - DNA, 25 bp, Mus musculus
tgttcatggtttcccacctagctct

SEQ ID NO: 490950 - DNA, 25 bp, Mus musculus
tgttcatgtcccagtgctacggcaa

SEQ ID NO: 490951 - DNA, 25 bp, Mus musculus
tgttcatgtcccctagtttccagct

SEQ ID NO: 490952 - DNA, 25 bp, Mus musculus
tgttcattacaggaggcagactacg

SEQ ID NO: 490953 - DNA, 25 bp, Mus musculus
tgttcattagctcaccaagcgaggt

SEQ ID NO: 490954 - DNA, 25 bp, Mus musculus
tgttcattgagaacctcacggcccg

SEQ ID NO: 490955 - DNA, 25 bp, Mus musculus
tgttccaaacagtgatgctgttctg

SEQ ID NO: 490956 - DNA, 25 bp, Mus musculus
tgttccaactctacaccatgcggcg

SEQ ID NO: 490957 - DNA, 25 bp, Mus musculus
tgttccaagccagacattgctcgga

SEQ ID NO: 490958 - DNA, 25 bp, Mus musculus
tgttccaagtgacataaattagcca

SEQ ID NO: 490959 - DNA, 25 bp, Mus musculus
tgttccaccgcaaagatagtcccaa

SEQ ID NO: 490960 - DNA, 25 bp, Mus musculus
tgttccacgccacagagccagtatt

SEQ ID NO: 490961 - DNA, 25 bp, Mus musculus
tgttccacttgtgcccgacctggag

SEQ ID NO: 490962 - DNA, 25 bp, Mus musculus
tgttccagaagctcccaagggtggg

SEQ ID NO: 490963 - DNA, 25 bp, Mus musculus
tgttccagacccgtcgaggacagtc

SEQ ID NO: 490964 - DNA, 25 bp, Mus musculus
tgttccagaggatagagggctcgtc

SEQ ID NO: 490965 - DNA, 25 bp, Mus musculus
tgttccagatgtcaaccggttcgtg

SEQ ID NO: 490966 - DNA, 25 bp, Mus musculus
tgttccagcaaaagcgaagagcctg

SEQ ID NO: 490967 - DNA, 25 bp, Mus musculus
tgttccagcaaaaggcggcctcgtt

SEQ ID NO: 490968 - DNA, 25 bp, Mus musculus
tgttccagcttggttaaaaagcctc

SEQ ID NO: 490969 - DNA, 25 bp, Mus musculus
tgttccaggaccagtgtactgtgcc

SEQ ID NO: 490970 - DNA, 25 bp, Mus musculus
tgttccagtcctcagaatggtcctg

SEQ ID NO: 490971 - DNA, 25 bp, Mus musculus
tgttccagtggctcagtaaccatcc

SEQ ID NO: 490972 - DNA, 25 bp, Mus musculus
tgttccatggagaaactgtgactct

SEQ ID NO: 490973 - DNA, 25 bp, Mus musculus
tgttccatgttccagtaagtccttc

SEQ ID NO: 490974 - DNA, 25 bp, Mus musculus
tgttcccaacagcttaagagcagcc

SEQ ID NO: 490975 - DNA, 25 bp, Mus musculus
tgttcccacgggagaatgccacgat

SEQ ID NO: 490976 - DNA, 25 bp, Mus musculus
tgttcccagggagccagattccttg

SEQ ID NO: 490977 - DNA, 25 bp, Mus musculus
tgttcccagtcccagggagatagat

SEQ ID NO: 490978 - DNA, 25 bp, Mus musculus
tgttcccagtgactcaaccaatggt

SEQ ID NO: 490979 - DNA, 25 bp, Mus musculus
tgttcccatatcaagcgtcatctgc

SEQ ID NO: 490980 - DNA, 25 bp, Mus musculus
tgttcccatttgagagctggctcca

SEQ ID NO: 490981 - DNA, 25 bp, Mus musculus
tgttccccaaaaggtcactcagcta

SEQ ID NO: 490982 - DNA, 25 bp, Mus musculus
tgttccccacagcatgatacctatg

SEQ ID NO: 490983 - DNA, 25 bp, Mus musculus
tgttccccaggagctcttgctgctt

SEQ ID NO: 490984 - DNA, 25 bp, Mus musculus
tgttccccaggctccggccattgga

SEQ ID NO: 490985 - DNA, 25 bp, Mus musculus
tgttccccagtcgtgagaggtcagc

SEQ ID NO: 490986 - DNA, 25 bp, Mus musculus
tgttcccctttgacagttggtactg

SEQ ID NO: 490987 - DNA, 25 bp, Mus musculus
tgttcccgactgatattggcctcca

SEQ ID NO: 490988 - DNA, 25 bp, Mus musculus
tgttcccgatcaacacgctcgagtc

SEQ ID NO: 490989 - DNA, 25 bp, Mus musculus
tgttcccgatggagatgctcagcaa

SEQ ID NO: 490990 - DNA, 25 bp, Mus musculus
tgttccctacataccaaagacggag

SEQ ID NO: 490991 - DNA, 25 bp, Mus musculus
tgttccctaggccaaaccagactgt

SEQ ID NO: 490992 - DNA, 25 bp, Mus musculus
tgttccctataattcaagacaatga

SEQ ID NO: 490993 - DNA, 25 bp, Mus musculus
tgttccctgccctatactagtatag

SEQ ID NO: 490994 - DNA, 25 bp, Mus musculus
tgttccctgggacacaaggagagcc

SEQ ID NO: 490995 - DNA, 25 bp, Mus musculus
tgttccctgtgagcttgggttcagt

SEQ ID NO: 490996 - DNA, 25 bp, Mus musculus
tgttccgaacagcagtgtccagcag

SEQ ID NO: 490997 - DNA, 25 bp, Mus musculus
tgttccgcctgcagctgatcctgtt

SEQ ID NO: 490998 - DNA, 25 bp, Mus musculus
tgttccggaaacagagaagccacgc

SEQ ID NO: 490999 - DNA, 25 bp, Mus musculus
tgttccggaggaattttcagccccg

SEQ ID NO: 491000 - DNA, 25 bp, Mus musculus
tgttccggcagcatcagaaagacct

SEQ ID NO: 491001 - DNA, 25 bp, Mus musculus
tgttccgtaatctcaccccaagatg

SEQ ID NO: 491002 - DNA, 25 bp, Mus musculus
tgttcctacaagaaaactaagtgca

SEQ ID NO: 491003 - DNA, 25 bp, Mus musculus
tgttcctacagacatatgcccgagg

SEQ ID NO: 491004 - DNA, 25 bp, Mus musculus
tgttcctcagaggtttagactctat

SEQ ID NO: 491005 - DNA, 25 bp, Mus musculus
tgttcctccgagtgcggcattacgg

SEQ ID NO: 491006 - DNA, 25 bp, Mus musculus
tgttcctcgaagacacgcagacgta

SEQ ID NO: 491007 - DNA, 25 bp, Mus musculus
tgttcctcttgtcagcatcttcgtc

SEQ ID NO: 491008 - DNA, 25 bp, Mus musculus
tgttcctcttgttcctgctggatgt

SEQ ID NO: 491009 - DNA, 25 bp, Mus musculus
tgttcctctttccagatgggtccca

SEQ ID NO: 491010 - DNA, 25 bp, Mus musculus
tgttcctgaatgacaaccagttggt

SEQ ID NO: 491011 - DNA, 25 bp, Mus musculus
tgttcctgaatgctcgtgaggctgc

SEQ ID NO: 491012 - DNA, 25 bp, Mus musculus
tgttcctgactcctaatgagcacag

SEQ ID NO: 491013 - DNA, 25 bp, Mus musculus
tgttcctgacttcataaaccgcggg

SEQ ID NO: 491014 - DNA, 25 bp, Mus musculus
tgttcctgagtactgcaacggttcc

SEQ ID NO: 491015 - DNA, 25 bp, Mus musculus
tgttcctgcaaatatgcgctgtggg

SEQ ID NO: 491016 - DNA, 25 bp, Mus musculus
tgttcctgcatcagagctggcggga

SEQ ID NO: 491017 - DNA, 25 bp, Mus musculus
tgttcctgcctctgtccagtcagag

SEQ ID NO: 491018 - DNA, 25 bp, Mus musculus
tgttcctgcggtgaagtcctatcca

SEQ ID NO: 491019 - DNA, 25 bp, Mus musculus
tgttcctggttgatgtttagctctc

SEQ ID NO: 491020 - DNA, 25 bp, Mus musculus
tgttcctgttagtgaccagacactg

SEQ ID NO: 491021 - DNA, 25 bp, Mus musculus
tgttccttcaaaatctacatcctgg

SEQ ID NO: 491022 - DNA, 25 bp, Mus musculus
tgttccttgcttcccaaaccggtgg

SEQ ID NO: 491023 - DNA, 25 bp, Mus musculus
tgttccttggaaagacgtctagtca

SEQ ID NO: 491024 - DNA, 25 bp, Mus musculus
tgttcctttgcagcccacagtatgt

SEQ ID NO: 491025 - DNA, 25 bp, Mus musculus
tgttcctttggaaacgcgtggctac

SEQ ID NO: 491026 - DNA, 25 bp, Mus musculus
tgttcctttgttctgggccgggcca

SEQ ID NO: 491027 - DNA, 25 bp, Mus musculus
tgttccttttctcgcagattgaccc

SEQ ID NO: 491028 - DNA, 25 bp, Mus musculus
tgttcgaacccacacagatcttgat

SEQ ID NO: 491029 - DNA, 25 bp, Mus musculus
tgttcgaagcacgtggaacccggga

SEQ ID NO: 491030 - DNA, 25 bp, Mus musculus
tgttcgaattcacagacaggcgcct

SEQ ID NO: 491031 - DNA, 25 bp, Mus musculus
tgttcgacagggtctttgtgaacac

SEQ ID NO: 491032 - DNA, 25 bp, Mus musculus
tgttcgacgcactggagtcggagcc

SEQ ID NO: 491033 - DNA, 25 bp, Mus musculus
tgttcgagagcataaccggctggcc

SEQ ID NO: 491034 - DNA, 25 bp, Mus musculus
tgttcgagatgcctgagtcactgac

SEQ ID NO: 491035 - DNA, 25 bp, Mus musculus
tgttcgagcagttcggccgcatcta

SEQ ID NO: 491036 - DNA, 25 bp, Mus musculus
tgttcgagggcagaggacatcttca

SEQ ID NO: 491037 - DNA, 25 bp, Mus musculus
tgttcgagtctccatgcagctacgg

SEQ ID NO: 491038 - DNA, 25 bp, Mus musculus
tgttcgataaggcacagagcgcagt

SEQ ID NO: 491039 - DNA, 25 bp, Mus musculus
tgttcgcccaggtgttccgggcctg

SEQ ID NO: 491040 - DNA, 25 bp, Mus musculus
tgttcgcccctcaagaatggcatga

SEQ ID NO: 491041 - DNA, 25 bp, Mus musculus
tgttcgcgctgctcatcgtgcggga

SEQ ID NO: 491042 - DNA, 25 bp, Mus musculus
tgttcgctatcttggtccgccggag

SEQ ID NO: 491043 - DNA, 25 bp, Mus musculus
tgttcgctatgaaaccactggcccc

SEQ ID NO: 491044 - DNA, 25 bp, Mus musculus
tgttcgctggatgatgacaccattc

SEQ ID NO: 491045 - DNA, 25 bp, Mus musculus
tgttcggaacctgcaccagtctgga

SEQ ID NO: 491046 - DNA, 25 bp, Mus musculus
tgttcggactcctgggcaatggcct

SEQ ID NO: 491047 - DNA, 25 bp, Mus musculus
tgttcggcgccttgcagagcttcaa

SEQ ID NO: 491048 - DNA, 25 bp, Mus musculus
tgttcggcgctatgatcaccactgt

SEQ ID NO: 491049 - DNA, 25 bp, Mus musculus
tgttcggcggcctagacatctgtgc

SEQ ID NO: 491050 - DNA, 25 bp, Mus musculus
tgttcgggacagaacgccaccccga

SEQ ID NO: 491051 - DNA, 25 bp, Mus musculus
tgttcggtgtgtaaagagcatgctc

SEQ ID NO: 491052 - DNA, 25 bp, Mus musculus
tgttcgtacagtgaaacagagactg

SEQ ID NO: 491053 - DNA, 25 bp, Mus musculus
tgttcgtagatgataccaggtgccc

SEQ ID NO: 491054 - DNA, 25 bp, Mus musculus
tgttcgtcaacgatcgactggaccg

SEQ ID NO: 491055 - DNA, 25 bp, Mus musculus
tgttcgtgggctgcagtgtcaccct

SEQ ID NO: 491056 - DNA, 25 bp, Mus musculus
tgttcgtgtacctgctgtgccggga

SEQ ID NO: 491057 - DNA, 25 bp, Mus musculus
tgttctaaaccacgtggacgcgtcg

SEQ ID NO: 491058 - DNA, 25 bp, Mus musculus
tgttctaagagttgccagcctgggc

SEQ ID NO: 491059 - DNA, 25 bp, Mus musculus
tgttctaagatgtctcctgctctga

SEQ ID NO: 491060 - DNA, 25 bp, Mus musculus
tgttctaaggtacacaggagttggc

SEQ ID NO: 491061 - DNA, 25 bp, Mus musculus
tgttctacaaccacacacacggtcg

SEQ ID NO: 491062 - DNA, 25 bp, Mus musculus
tgttctacaaggagtggaggccgac

SEQ ID NO: 491063 - DNA, 25 bp, Mus musculus
tgttctacaggctggaggccattgt

SEQ ID NO: 491064 - DNA, 25 bp, Mus musculus
tgttctacatcagagcaccgcctgg

SEQ ID NO: 491065 - DNA, 25 bp, Mus musculus
tgttctaccgcaaccatcacaagga

SEQ ID NO: 491066 - DNA, 25 bp, Mus musculus
tgttctacggcttgctactggcggc

SEQ ID NO: 491067 - DNA, 25 bp, Mus musculus
tgttctacgtgaagcagcctgtgaa

SEQ ID NO: 491068 - DNA, 25 bp, Mus musculus
tgttctactccaagaagtcgcagcg

SEQ ID NO: 491069 - DNA, 25 bp, Mus musculus
tgttctacttactggccatactggc

SEQ ID NO: 491070 - DNA, 25 bp, Mus musculus
tgttctacttgaaggctagctgccc

SEQ ID NO: 491071 - DNA, 25 bp, Mus musculus
tgttctagaacccacacaagcgctg

SEQ ID NO: 491072 - DNA, 25 bp, Mus musculus
tgttctagaggacacgaatacttct

SEQ ID NO: 491073 - DNA, 25 bp, Mus musculus
tgttctagcacttaccaagagactc

SEQ ID NO: 491074 - DNA, 25 bp, Mus musculus
tgttctagccgaggactccagttgt

SEQ ID NO: 491075 - DNA, 25 bp, Mus musculus
tgttctaggtgctatcaaaggcagc

SEQ ID NO: 491076 - DNA, 25 bp, Mus musculus
tgttctatagttttcaggataagct

SEQ ID NO: 491077 - DNA, 25 bp, Mus musculus
tgttctatgtgctccagattccatg

SEQ ID NO: 491078 - DNA, 25 bp, Mus musculus
tgttctcaacctagacagactggga

SEQ ID NO: 491079 - DNA, 25 bp, Mus musculus
tgttctcaagaagcaacacactaag

SEQ ID NO: 491080 - DNA, 25 bp, Mus musculus
tgttctcaatgtttgtagcacactt

SEQ ID NO: 491081 - DNA, 25 bp, Mus musculus
tgttctcacagaacgacacgcgctg

SEQ ID NO: 491082 - DNA, 25 bp, Mus musculus
tgttctcacgagtgtgtcagggcct

SEQ ID NO: 491083 - DNA, 25 bp, Mus musculus
tgttctcactatacccagacctcag

SEQ ID NO: 491084 - DNA, 25 bp, Mus musculus
tgttctcactgtgagccagtgaccc

SEQ ID NO: 491085 - DNA, 25 bp, Mus musculus
tgttctcagactaagccactctttg

SEQ ID NO: 491086 - DNA, 25 bp, Mus musculus
tgttctcagagaccaaaagagccct

SEQ ID NO: 491087 - DNA, 25 bp, Mus musculus
tgttctcagatcaaggcactgccct

SEQ ID NO: 491088 - DNA, 25 bp, Mus musculus
tgttctcagcggagagcactgcgga

SEQ ID NO: 491089 - DNA, 25 bp, Mus musculus
tgttctcagcgtcacagttgtgttc

SEQ ID NO: 491090 - DNA, 25 bp, Mus musculus
tgttctcatgaagatcacatttgag

SEQ ID NO: 491091 - DNA, 25 bp, Mus musculus
tgttctccaaagctccaaggcatgt

SEQ ID NO: 491092 - DNA, 25 bp, Mus musculus
tgttctccaagtctccaaaggtggt

SEQ ID NO: 491093 - DNA, 25 bp, Mus musculus
tgttctccacaggaaggagaacagc

SEQ ID NO: 491094 - DNA, 25 bp, Mus musculus
tgttctccactcagaatccagtgtg

SEQ ID NO: 491095 - DNA, 25 bp, Mus musculus
tgttctcgatcctgccagggaggca

SEQ ID NO: 491096 - DNA, 25 bp, Mus musculus
tgttctcgcctatgcaagaagcgcg

SEQ ID NO: 491097 - DNA, 25 bp, Mus musculus
tgttctcggagcagcgcatcttcaa

SEQ ID NO: 491098 - DNA, 25 bp, Mus musculus
tgttctcggatacttgggtgccttg

SEQ ID NO: 491099 - DNA, 25 bp, Mus musculus
tgttctcggcagaaaaagctctggg

SEQ ID NO: 491100 - DNA, 25 bp, Mus musculus
tgttctcggtactacagggcaccag

SEQ ID NO: 491101 - DNA, 25 bp, Mus musculus
tgttctcggtttctggcacgcacgg

SEQ ID NO: 491102 - DNA, 25 bp, Mus musculus
tgttctcgtttgaggctggccgccg

SEQ ID NO: 491103 - DNA, 25 bp, Mus musculus
tgttctctcagagcgcaggaggacc

SEQ ID NO: 491104 - DNA, 25 bp, Mus musculus
tgttctctcgaaaccatcggagtcg

SEQ ID NO: 491105 - DNA, 25 bp, Mus musculus
tgttctctgaggaccgcacacgttt

SEQ ID NO: 491106 - DNA, 25 bp, Mus musculus
tgttctctgcagttgagtggccgga

SEQ ID NO: 491107 - DNA, 25 bp, Mus musculus
tgttctctggctgaaaaaatgctcc

SEQ ID NO: 491108 - DNA, 25 bp, Mus musculus
tgttctcttccagctactgttgcag

SEQ ID NO: 491109 - DNA, 25 bp, Mus musculus
tgttctcttgtaggctaacgaggac

SEQ ID NO: 491110 - DNA, 25 bp, Mus musculus
tgttctgaaaaacatgggtccactg

SEQ ID NO: 491111 - DNA, 25 bp, Mus musculus
tgttctgaaccacagctagagagct

SEQ ID NO: 491112 - DNA, 25 bp, Mus musculus
tgttctgacagctaaggagcgagct

SEQ ID NO: 491113 - DNA, 25 bp, Mus musculus
tgttctgagaagacaaccaaccagg

SEQ ID NO: 491114 - DNA, 25 bp, Mus musculus
tgttctgagagcttactctagcggg

SEQ ID NO: 491115 - DNA, 25 bp, Mus musculus
tgttctgagatgagaccctgtgacc

SEQ ID NO: 491116 - DNA, 25 bp, Mus musculus
tgttctgattgggatgaagccgccc

SEQ ID NO: 491117 - DNA, 25 bp, Mus musculus
tgttctgcaacatctgggcggcggt

SEQ ID NO: 491118 - DNA, 25 bp, Mus musculus
tgttctgcacagacaacgggagctg

SEQ ID NO: 491119 - DNA, 25 bp, Mus musculus
tgttctgcagaagggtgtccccaca

SEQ ID NO: 491120 - DNA, 25 bp, Mus musculus
tgttctgcaggagtcagtggaaccc

SEQ ID NO: 491121 - DNA, 25 bp, Mus musculus
tgttctgcccaaaataaaggacctg

SEQ ID NO: 491122 - DNA, 25 bp, Mus musculus
tgttctgcgcgcacaaaagcagcgg

SEQ ID NO: 491123 - DNA, 25 bp, Mus musculus
tgttctgcggtgttgctatgagccc

SEQ ID NO: 491124 - DNA, 25 bp, Mus musculus
tgttctgcgtacttcctttcccttg

SEQ ID NO: 491125 - DNA, 25 bp, Mus musculus
tgttctggaatttgtactgtacacc

SEQ ID NO: 491126 - DNA, 25 bp, Mus musculus
tgttctggagaaccatcacgccgct

SEQ ID NO: 491127 - DNA, 25 bp, Mus musculus
tgttctggatcacgccgtcctggtg

SEQ ID NO: 491128 - DNA, 25 bp, Mus musculus
tgttctggatgaagcggacatgccg

SEQ ID NO: 491129 - DNA, 25 bp, Mus musculus
tgttctgggcagatgacatagccta

SEQ ID NO: 491130 - DNA, 25 bp, Mus musculus
tgttctgtaattctgggaccggcct

SEQ ID NO: 491131 - DNA, 25 bp, Mus musculus
tgttctgtataggagaaaactacac

SEQ ID NO: 491132 - DNA, 25 bp, Mus musculus
tgttctgtcagaagtcaccaaggaa

SEQ ID NO: 491133 - DNA, 25 bp, Mus musculus
tgttctgtcagtgagtcccgggcag

SEQ ID NO: 491134 - DNA, 25 bp, Mus musculus
tgttctgtccaaacggaaatggcca

SEQ ID NO: 491135 - DNA, 25 bp, Mus musculus
tgttctgtccaggagtgaaataact

SEQ ID NO: 491136 - DNA, 25 bp, Mus musculus
tgttctgtcgctatgaccggctgga

SEQ ID NO: 491137 - DNA, 25 bp, Mus musculus
tgttctgtctgtggtcctagcctct

SEQ ID NO: 491138 - DNA, 25 bp, Mus musculus
tgttctgtctttagcccttgagaag

SEQ ID NO: 491139 - DNA, 25 bp, Mus musculus
tgttctgtgacaccgagggcttgtt

SEQ ID NO: 491140 - DNA, 25 bp, Mus musculus
tgttcttaatctccagacccatggg

SEQ ID NO: 491141 - DNA, 25 bp, Mus musculus
tgttcttaatgaggtcagcgccagg

SEQ ID NO: 491142 - DNA, 25 bp, Mus musculus
tgttcttacgtctgagcctgggctg

SEQ ID NO: 491143 - DNA, 25 bp, Mus musculus
tgttcttagcagagtgtgacacagt

SEQ ID NO: 491144 - DNA, 25 bp, Mus musculus
tgttcttagtcatctagggttggag

SEQ ID NO: 491145 - DNA, 25 bp, Mus musculus
tgttcttcaatcaccaaagtgggcg

SEQ ID NO: 491146 - DNA, 25 bp, Mus musculus
tgttcttccaagagacgtgtgcttc

SEQ ID NO: 491147 - DNA, 25 bp, Mus musculus
tgttcttcctgtccagggtccgcaa

SEQ ID NO: 491148 - DNA, 25 bp, Mus musculus
tgttcttcgcttacagtctgagaca

SEQ ID NO: 491149 - DNA, 25 bp, Mus musculus
tgttcttctatgtttaatcctcggg

SEQ ID NO: 491150 - DNA, 25 bp, Mus musculus
tgttcttctcaggagtagagttggg

SEQ ID NO: 491151 - DNA, 25 bp, Mus musculus
tgttcttgagtgtcccagcatccgg

SEQ ID NO: 491152 - DNA, 25 bp, Mus musculus
tgttcttgtaccgagcgcgctcggc

SEQ ID NO: 491153 - DNA, 25 bp, Mus musculus
tgttctttcaacaagtgccccagtg

SEQ ID NO: 491154 - DNA, 25 bp, Mus musculus
tgttctttcagcgaccctgtggtgt

SEQ ID NO: 491155 - DNA, 25 bp, Mus musculus
tgttctttctgaagccaccgggctc

SEQ ID NO: 491156 - DNA, 25 bp, Mus musculus
tgttctttgaagttgacggacccca

SEQ ID NO: 491157 - DNA, 25 bp, Mus musculus
tgttgaaaaaccctgcaagagttgc

SEQ ID NO: 491158 - DNA, 25 bp, Mus musculus
tgttgaaaacattcccgcaggaccg

SEQ ID NO: 491159 - DNA, 25 bp, Mus musculus
tgttgaaaactcatggacacctgat

SEQ ID NO: 491160 - DNA, 25 bp, Mus musculus
tgttgaaagagttatgggcccacca

SEQ ID NO: 491161 - DNA, 25 bp, Mus musculus
tgttgaaagtgaagaaatcaatggg

SEQ ID NO: 491162 - DNA, 25 bp, Mus musculus
tgttgaacaccccaaccagtgagaa

SEQ ID NO: 491163 - DNA, 25 bp, Mus musculus
tgttgaacagcgtgaagactggccc

SEQ ID NO: 491164 - DNA, 25 bp, Mus musculus
tgttgaacaggcatacactttggca

SEQ ID NO: 491165 - DNA, 25 bp, Mus musculus
tgttgaacatgaagccagtgacctg

SEQ ID NO: 491166 - DNA, 25 bp, Mus musculus
tgttgaaccaactgggaagcgcttc

SEQ ID NO: 491167 - DNA, 25 bp, Mus musculus
tgttgaacgagaaggcagtaccgct

SEQ ID NO: 491168 - DNA, 25 bp, Mus musculus
tgttgaacgccgaatgccgggtgct

SEQ ID NO: 491169 - DNA, 25 bp, Mus musculus
tgttgaactgtgatcaggaggccca

SEQ ID NO: 491170 - DNA, 25 bp, Mus musculus
tgttgaagaactcactgacctgcag

SEQ ID NO: 491171 - DNA, 25 bp, Mus musculus
tgttgaagacaacctccaatgagtc

SEQ ID NO: 491172 - DNA, 25 bp, Mus musculus
tgttgaagaccaagcacaaaggcct

SEQ ID NO: 491173 - DNA, 25 bp, Mus musculus
tgttgaagcctttccctctgaagca

SEQ ID NO: 491174 - DNA, 25 bp, Mus musculus
tgttgaagcgctctccgtcctgtac

SEQ ID NO: 491175 - DNA, 25 bp, Mus musculus
tgttgaagctgaacctgtttccggc

SEQ ID NO: 491176 - DNA, 25 bp, Mus musculus
tgttgaagtttctaagcaagccatg

SEQ ID NO: 491177 - DNA, 25 bp, Mus musculus
tgttgaataaaggaaaggctggaag

SEQ ID NO: 491178 - DNA, 25 bp, Mus musculus
tgttgaatccggttgtcagcgcgtg

SEQ ID NO: 491179 - DNA, 25 bp, Mus musculus
tgttgaattgaaaaggcccactggg

SEQ ID NO: 491180 - DNA, 25 bp, Mus musculus
tgttgaattgtagtccgcagcccac

SEQ ID NO: 491181 - DNA, 25 bp, Mus musculus
tgttgacaaggcagacaagctcacc

SEQ ID NO: 491182 - DNA, 25 bp, Mus musculus
tgttgacagcccagatccttgatcg

SEQ ID NO: 491183 - DNA, 25 bp, Mus musculus
tgttgacagcttggagatatcctct

SEQ ID NO: 491184 - DNA, 25 bp, Mus musculus
tgttgacaggagcatccagctgacc

SEQ ID NO: 491185 - DNA, 25 bp, Mus musculus
tgttgaccattgaacccgacggctc

SEQ ID NO: 491186 - DNA, 25 bp, Mus musculus
tgttgacccgccaagtagaccatgt

SEQ ID NO: 491187 - DNA, 25 bp, Mus musculus
tgttgaccgatagggaacgggctct

SEQ ID NO: 491188 - DNA, 25 bp, Mus musculus
tgttgaccgtaccactggccaggtg

SEQ ID NO: 491189 - DNA, 25 bp, Mus musculus
tgttgacgcacaggtagcacaggct

SEQ ID NO: 491190 - DNA, 25 bp, Mus musculus
tgttgacggcctgaccttgcgcagg

SEQ ID NO: 491191 - DNA, 25 bp, Mus musculus
tgttgacgggaacctgaagatgacc

SEQ ID NO: 491192 - DNA, 25 bp, Mus musculus
tgttgactggacaagtaacctgctg

SEQ ID NO: 491193 - DNA, 25 bp, Mus musculus
tgttgacttccacttgtaccggcca

SEQ ID NO: 491194 - DNA, 25 bp, Mus musculus
tgttgagaactcacactgcctgctt

SEQ ID NO: 491195 - DNA, 25 bp, Mus musculus
tgttgagaagctactgaagccctgc

SEQ ID NO: 491196 - DNA, 25 bp, Mus musculus
tgttgagacccctaacctgaaggcc

SEQ ID NO: 491197 - DNA, 25 bp, Mus musculus
tgttgagaccgtcttactatatagc

SEQ ID NO: 491198 - DNA, 25 bp, Mus musculus
tgttgagacgagtttcccaggtgat

SEQ ID NO: 491199 - DNA, 25 bp, Mus musculus
tgttgagagctaaaccacactcccg

SEQ ID NO: 491200 - DNA, 25 bp, Mus musculus
tgttgagatagaaaatctgaaaccg

SEQ ID NO: 491201 - DNA, 25 bp, Mus musculus
tgttgagccactgggccaagttgaa

SEQ ID NO: 491202 - DNA, 25 bp, Mus musculus
tgttgagccattacactgacacttg

SEQ ID NO: 491203 - DNA, 25 bp, Mus musculus
tgttgagccgagtggaagcctcctt

SEQ ID NO: 491204 - DNA, 25 bp, Mus musculus
tgttgagcctcctggaaggaaagga

SEQ ID NO: 491205 - DNA, 25 bp, Mus musculus
tgttgagcctgtgttcttagagcct

SEQ ID NO: 491206 - DNA, 25 bp, Mus musculus
tgttgagctcaagcacttttttgtt

SEQ ID NO: 491207 - DNA, 25 bp, Mus musculus
tgttgaggacgcagattctagcact

SEQ ID NO: 491208 - DNA, 25 bp, Mus musculus
tgttgaggctcttctatgcagggcg

SEQ ID NO: 491209 - DNA, 25 bp, Mus musculus
tgttgagggacatgcttaaagagca

SEQ ID NO: 491210 - DNA, 25 bp, Mus musculus
tgttgagtttaggaagcgcgacccg

SEQ ID NO: 491211 - DNA, 25 bp, Mus musculus
tgttgataccggaagagagctggct

SEQ ID NO: 491212 - DNA, 25 bp, Mus musculus
tgttgatatggtagccagaccgtcc

SEQ ID NO: 491213 - DNA, 25 bp, Mus musculus
tgttgatccatccagcttgccagct

SEQ ID NO: 491214 - DNA, 25 bp, Mus musculus
tgttgatccgtccagagcagttgag

SEQ ID NO: 491215 - DNA, 25 bp, Mus musculus
tgttgatcgatgtgtcctccaggtg

SEQ ID NO: 491216 - DNA, 25 bp, Mus musculus
tgttgatctagcacacaggctccag

SEQ ID NO: 491217 - DNA, 25 bp, Mus musculus
tgttgatgattacaccgtcagagtg

SEQ ID NO: 491218 - DNA, 25 bp, Mus musculus
tgttgatgcgctacccaccaggtgt

SEQ ID NO: 491219 - DNA, 25 bp, Mus musculus
tgttgatggacctacaggagctcct

SEQ ID NO: 491220 - DNA, 25 bp, Mus musculus
tgttgatgtgtcatctagattcccc

SEQ ID NO: 491221 - DNA, 25 bp, Mus musculus
tgttgattcagactgcgcaccagga

SEQ ID NO: 491222 - DNA, 25 bp, Mus musculus
tgttgattctcagcctgtcggtgca

SEQ ID NO: 491223 - DNA, 25 bp, Mus musculus
tgttgcaaaacatagcctagagcca

SEQ ID NO: 491224 - DNA, 25 bp, Mus musculus
tgttgcaagataaataagaagctca

SEQ ID NO: 491225 - DNA, 25 bp, Mus musculus
tgttgcacacgaagctgatcaggga

SEQ ID NO: 491226 - DNA, 25 bp, Mus musculus
tgttgcaccaggctattggcccgca

SEQ ID NO: 491227 - DNA, 25 bp, Mus musculus
tgttgcacgcaccagaaatactgta

SEQ ID NO: 491228 - DNA, 25 bp, Mus musculus
tgttgcacttccaaggcagctgcag

SEQ ID NO: 491229 - DNA, 25 bp, Mus musculus
tgttgcagaacctatcagctgggca

SEQ ID NO: 491230 - DNA, 25 bp, Mus musculus
tgttgcagactgagccccagaacaa

SEQ ID NO: 491231 - DNA, 25 bp, Mus musculus
tgttgcaggcccagctaagtctaga

SEQ ID NO: 491232 - DNA, 25 bp, Mus musculus
tgttgcagggctgttatcacacaag

SEQ ID NO: 491233 - DNA, 25 bp, Mus musculus
tgttgcagtggccataaaaaccctg

SEQ ID NO: 491234 - DNA, 25 bp, Mus musculus
tgttgcagtttttccagccgcagca

SEQ ID NO: 491235 - DNA, 25 bp, Mus musculus
tgttgcatctattcagttccacctt

SEQ ID NO: 491236 - DNA, 25 bp, Mus musculus
tgttgcatgggtcacagtgccaccg

SEQ ID NO: 491237 - DNA, 25 bp, Mus musculus
tgttgccaagggaccaaatgacgtc

SEQ ID NO: 491238 - DNA, 25 bp, Mus musculus
tgttgccacgtgctgctctgtccca

SEQ ID NO: 491239 - DNA, 25 bp, Mus musculus
tgttgccactctcctatcaagatga

SEQ ID NO: 491240 - DNA, 25 bp, Mus musculus
tgttgccactgaggtccagagagtc

SEQ ID NO: 491241 - DNA, 25 bp, Mus musculus
tgttgccactgtcgtcgggtacctg

SEQ ID NO: 491242 - DNA, 25 bp, Mus musculus
tgttgccagcgggagtgggaagccg

SEQ ID NO: 491243 - DNA, 25 bp, Mus musculus
tgttgcccatttccagggccaagag

SEQ ID NO: 491244 - DNA, 25 bp, Mus musculus
tgttgccctgccatctaagacatgc

SEQ ID NO: 491245 - DNA, 25 bp, Mus musculus
tgttgccgttgttgtctgagactcg

SEQ ID NO: 491246 - DNA, 25 bp, Mus musculus
tgttgcctacatatccatcagctga

SEQ ID NO: 491247 - DNA, 25 bp, Mus musculus
tgttgcctccgagagcactgcatac

SEQ ID NO: 491248 - DNA, 25 bp, Mus musculus
tgttgcctctccgatcagtgtgtgc

SEQ ID NO: 491249 - DNA, 25 bp, Mus musculus
tgttgcctctttacatcaaaaccat

SEQ ID NO: 491250 - DNA, 25 bp, Mus musculus
tgttgcctgcctatgtgcctattaa

SEQ ID NO: 491251 - DNA, 25 bp, Mus musculus
tgttgccttcccagacgaaaccatg

SEQ ID NO: 491252 - DNA, 25 bp, Mus musculus
tgttgccttgggaacgatcctcggg

SEQ ID NO: 491253 - DNA, 25 bp, Mus musculus
tgttgcgacagaaccatcaggaggg

SEQ ID NO: 491254 - DNA, 25 bp, Mus musculus
tgttgcgtatgtcctagtacagtgt

SEQ ID NO: 491255 - DNA, 25 bp, Mus musculus
tgttgctaactttcaggcccagagg

SEQ ID NO: 491256 - DNA, 25 bp, Mus musculus
tgttgctaagcgagcgttggcctca

SEQ ID NO: 491257 - DNA, 25 bp, Mus musculus
tgttgctaagtatatactgagcacc

SEQ ID NO: 491258 - DNA, 25 bp, Mus musculus
tgttgctaagttgacatcagacacc

SEQ ID NO: 491259 - DNA, 25 bp, Mus musculus
tgttgctatgtgttcccgggtggct

SEQ ID NO: 491260 - DNA, 25 bp, Mus musculus
tgttgctcacaattcatcatcaaaa

SEQ ID NO: 491261 - DNA, 25 bp, Mus musculus
tgttgctccacacatggatggtagt

SEQ ID NO: 491262 - DNA, 25 bp, Mus musculus
tgttgctcccacaaatgagacttcc

SEQ ID NO: 491263 - DNA, 25 bp, Mus musculus
tgttgctgaagaaaggaaccaccac

SEQ ID NO: 491264 - DNA, 25 bp, Mus musculus
tgttgctgagcaggaatgggtcccc

SEQ ID NO: 491265 - DNA, 25 bp, Mus musculus
tgttgctgatcatcatctgtgtagg

SEQ ID NO: 491266 - DNA, 25 bp, Mus musculus
tgttgctgctgtgaacgatttggga

SEQ ID NO: 491267 - DNA, 25 bp, Mus musculus
tgttgctggtcatcgctctcggctg

SEQ ID NO: 491268 - DNA, 25 bp, Mus musculus
tgttgctgtagaggacaccgtcacg

SEQ ID NO: 491269 - DNA, 25 bp, Mus musculus
tgttgctgtttgactgacaggatgg

SEQ ID NO: 491270 - DNA, 25 bp, Mus musculus
tgttgcttagtcttacctggagtgc

SEQ ID NO: 491271 - DNA, 25 bp, Mus musculus
tgttgcttctcatggtgacatgccg

SEQ ID NO: 491272 - DNA, 25 bp, Mus musculus
tgttggaaagcgttgggaacccatt

SEQ ID NO: 491273 - DNA, 25 bp, Mus musculus
tgttggaaatgtacatcagtataag

SEQ ID NO: 491274 - DNA, 25 bp, Mus musculus
tgttggaacacatctggcatccccg

SEQ ID NO: 491275 - DNA, 25 bp, Mus musculus
tgttggaagtcctcgctccgatgaa

SEQ ID NO: 491276 - DNA, 25 bp, Mus musculus
tgttggacaatgcacccgctttggg

SEQ ID NO: 491277 - DNA, 25 bp, Mus musculus
tgttggaccagtgtcacagagaggc

SEQ ID NO: 491278 - DNA, 25 bp, Mus musculus
tgttggagaaaaacgacctaggttg

SEQ ID NO: 491279 - DNA, 25 bp, Mus musculus
tgttggagatgtgacccaggcctca

SEQ ID NO: 491280 - DNA, 25 bp, Mus musculus
tgttggataaactgacctggagcct

SEQ ID NO: 491281 - DNA, 25 bp, Mus musculus
tgttggatacactagagagccctgg

SEQ ID NO: 491282 - DNA, 25 bp, Mus musculus
tgttggatagatgttctgggcacac

SEQ ID NO: 491283 - DNA, 25 bp, Mus musculus
tgttggatcccaaggccttgaacga

SEQ ID NO: 491284 - DNA, 25 bp, Mus musculus
tgttggatccttgagttggaattcc

SEQ ID NO: 491285 - DNA, 25 bp, Mus musculus
tgttggatgaagtacgctgcaccgg

SEQ ID NO: 491286 - DNA, 25 bp, Mus musculus
tgttggattcccgactgctctcaga

SEQ ID NO: 491287 - DNA, 25 bp, Mus musculus
tgttggcaacaacagggacaccctt

SEQ ID NO: 491288 - DNA, 25 bp, Mus musculus
tgttggcaccaaggtcatctgctgg

SEQ ID NO: 491289 - DNA, 25 bp, Mus musculus
tgttggcaggtcctgcctctactgg

SEQ ID NO: 491290 - DNA, 25 bp, Mus musculus
tgttggcatctcaaccactgcggag

SEQ ID NO: 491291 - DNA, 25 bp, Mus musculus
tgttggcatctgtgacctggctcgc

SEQ ID NO: 491292 - DNA, 25 bp, Mus musculus
tgttggccaggaagagcatcatccc

SEQ ID NO: 491293 - DNA, 25 bp, Mus musculus
tgttggccccttgctggctctgcgg

SEQ ID NO: 491294 - DNA, 25 bp, Mus musculus
tgttggcccggatcaaacatgacag

SEQ ID NO: 491295 - DNA, 25 bp, Mus musculus
tgttggccctgcaggtactagtcca

SEQ ID NO: 491296 - DNA, 25 bp, Mus musculus
tgttggccggacagccagagttgtt

SEQ ID NO: 491297 - DNA, 25 bp, Mus musculus
tgttggcctccctaaagatcatcgg

SEQ ID NO: 491298 - DNA, 25 bp, Mus musculus
tgttggcctcgactgctgcaactgc

SEQ ID NO: 491299 - DNA, 25 bp, Mus musculus
tgttggccttcatcagctcctggaa

SEQ ID NO: 491300 - DNA, 25 bp, Mus musculus
tgttggccttctacagcccagtagg

SEQ ID NO: 491301 - DNA, 25 bp, Mus musculus
tgttggctacaatccgtctccaggg

SEQ ID NO: 491302 - DNA, 25 bp, Mus musculus
tgttggctgccagtgtacagcgcca

SEQ ID NO: 491303 - DNA, 25 bp, Mus musculus
tgttggctgccgttcttgacagaaa

SEQ ID NO: 491304 - DNA, 25 bp, Mus musculus
tgttgggaaaccactcagtcctgag

SEQ ID NO: 491305 - DNA, 25 bp, Mus musculus
tgttgggaagaagcacaagggctac

SEQ ID NO: 491306 - DNA, 25 bp, Mus musculus
tgttgggaataaaacctgtgcaggt

SEQ ID NO: 491307 - DNA, 25 bp, Mus musculus
tgttgggacaaacgagcaatcactg

SEQ ID NO: 491308 - DNA, 25 bp, Mus musculus
tgttgggagtgaacctaggatcatc

SEQ ID NO: 491309 - DNA, 25 bp, Mus musculus
tgttgggcaccggacaacctgagta

SEQ ID NO: 491310 - DNA, 25 bp, Mus musculus
tgttgggcccacagcagtactcttg

SEQ ID NO: 491311 - DNA, 25 bp, Mus musculus
tgttgggctacaaaggtccttagat

SEQ ID NO: 491312 - DNA, 25 bp, Mus musculus
tgttgggctacattcaaaactgtcc

SEQ ID NO: 491313 - DNA, 25 bp, Mus musculus
tgttgggtacagagtgactaaggct

SEQ ID NO: 491314 - DNA, 25 bp, Mus musculus
tgttgggtgttagacccatggagtc

SEQ ID NO: 491315 - DNA, 25 bp, Mus musculus
tgttgggttctaactccaatcccag

SEQ ID NO: 491316 - DNA, 25 bp, Mus musculus
tgttgggttgattggtcaggaatta

SEQ ID NO: 491317 - DNA, 25 bp, Mus musculus
tgttggtacccagcatgtctcaggt

SEQ ID NO: 491318 - DNA, 25 bp, Mus musculus
tgttggtcaccatcgagtcttcagg

SEQ ID NO: 491319 - DNA, 25 bp, Mus musculus
tgttggtccagagatgccgagtacg

SEQ ID NO: 491320 - DNA, 25 bp, Mus musculus
tgttggtcttctcagtcacggatag

SEQ ID NO: 491321 - DNA, 25 bp, Mus musculus
tgttggtgaaaacaaaccagacccg

SEQ ID NO: 491322 - DNA, 25 bp, Mus musculus
tgttggtgaaccatcatctgggtgc

SEQ ID NO: 491323 - DNA, 25 bp, Mus musculus
tgttggtgaagcctttctttgcatg

SEQ ID NO: 491324 - DNA, 25 bp, Mus musculus
tgttggtgacatacatccttgcctc

SEQ ID NO: 491325 - DNA, 25 bp, Mus musculus
tgttggtggagataaatgcgtgcac

SEQ ID NO: 491326 - DNA, 25 bp, Mus musculus
tgttggttccaggtcttcttctggg

SEQ ID NO: 491327 - DNA, 25 bp, Mus musculus
tgttggtttaatggaggccctgctc

SEQ ID NO: 491328 - DNA, 25 bp, Mus musculus
tgttgtaaagcacgtcagctgctcc

SEQ ID NO: 491329 - DNA, 25 bp, Mus musculus
tgttgtaacatcagactcaaagtga

SEQ ID NO: 491330 - DNA, 25 bp, Mus musculus
tgttgtaagactgtgtagccggcct

SEQ ID NO: 491331 - DNA, 25 bp, Mus musculus
tgttgtaatcatttgcattctgcac

SEQ ID NO: 491332 - DNA, 25 bp, Mus musculus
tgttgtactggaccttgggatcctg

SEQ ID NO: 491333 - DNA, 25 bp, Mus musculus
tgttgtaggcccaaaggcccttttg

SEQ ID NO: 491334 - DNA, 25 bp, Mus musculus
tgttgtatttggagaacacagttcc

SEQ ID NO: 491335 - DNA, 25 bp, Mus musculus
tgttgtcaccaacacaattccacaa

SEQ ID NO: 491336 - DNA, 25 bp, Mus musculus
tgttgtcaccgttagtagtcactgg

SEQ ID NO: 491337 - DNA, 25 bp, Mus musculus
tgttgtcactcagcacagccagaga

SEQ ID NO: 491338 - DNA, 25 bp, Mus musculus
tgttgtcagagaacgcaccctgtgt

SEQ ID NO: 491339 - DNA, 25 bp, Mus musculus
tgttgtccaggaaacccaatcgaaa

SEQ ID NO: 491340 - DNA, 25 bp, Mus musculus
tgttgtccccaaggcatgctgtgca

SEQ ID NO: 491341 - DNA, 25 bp, Mus musculus
tgttgtcctgagtgaacgcaccctc

SEQ ID NO: 491342 - DNA, 25 bp, Mus musculus
tgttgtcgcccgacggcctatgagg

SEQ ID NO: 491343 - DNA, 25 bp, Mus musculus
tgttgtcgcctgaaattagcggtga

SEQ ID NO: 491344 - DNA, 25 bp, Mus musculus
tgttgtcgctgcttccatagcgcag

SEQ ID NO: 491345 - DNA, 25 bp, Mus musculus
tgttgtcgtggtgtttggctttagc

SEQ ID NO: 491346 - DNA, 25 bp, Mus musculus
tgttgtctaacctgacctgtttcct

SEQ ID NO: 491347 - DNA, 25 bp, Mus musculus
tgttgtctagccgagcttccgtcgt

SEQ ID NO: 491348 - DNA, 25 bp, Mus musculus
tgttgtctgcatctagaaagagcgc

SEQ ID NO: 491349 - DNA, 25 bp, Mus musculus
tgttgtctgtggaactccgttgttc

SEQ ID NO: 491350 - DNA, 25 bp, Mus musculus
tgttgtgagacaagctacctttcag

SEQ ID NO: 491351 - DNA, 25 bp, Mus musculus
tgttgtgccaactagtgtgaaagat

SEQ ID NO: 491352 - DNA, 25 bp, Mus musculus
tgttgtgcctaaatgagtatgacta

SEQ ID NO: 491353 - DNA, 25 bp, Mus musculus
tgttgtgctgcttcctgcgatctag

SEQ ID NO: 491354 - DNA, 25 bp, Mus musculus
tgttgtggatcctgggacaccaagg

SEQ ID NO: 491355 - DNA, 25 bp, Mus musculus
tgttgtggcgatttccctaatagga

SEQ ID NO: 491356 - DNA, 25 bp, Mus musculus
tgttgtggtgatagaagcctccttc

SEQ ID NO: 491357 - DNA, 25 bp, Mus musculus
tgttgtgtccgctctgcagtccagc

SEQ ID NO: 491358 - DNA, 25 bp, Mus musculus
tgttgtgtgcaagccactgctctaa

SEQ ID NO: 491359 - DNA, 25 bp, Mus musculus
tgttgtgtggccgacagttgtgagg

SEQ ID NO: 491360 - DNA, 25 bp, Mus musculus
tgttgttagaagcacgagaacccct

SEQ ID NO: 491361 - DNA, 25 bp, Mus musculus
tgttgttcaagctatgatcggagac

SEQ ID NO: 491362 - DNA, 25 bp, Mus musculus
tgttgttctgagcaatatgctctgg

SEQ ID NO: 491363 - DNA, 25 bp, Mus musculus
tgttgttctgtaaagggctaaggcc

SEQ ID NO: 491364 - DNA, 25 bp, Mus musculus
tgttgttgccaatccagctgttgca

SEQ ID NO: 491365 - DNA, 25 bp, Mus musculus
tgttgttggcactcaaactccggcg

SEQ ID NO: 491366 - DNA, 25 bp, Mus musculus
tgttgttggtataatagtcatccga

SEQ ID NO: 491367 - DNA, 25 bp, Mus musculus
tgttgttttcctagacctgtactca

SEQ ID NO: 491368 - DNA, 25 bp, Mus musculus
tgttgtttttccttgcacggctgtt

SEQ ID NO: 491369 - DNA, 25 bp, Mus musculus
tgtttaaactacatccccgcagcgg

SEQ ID NO: 491370 - DNA, 25 bp, Mus musculus
tgtttaaacttagacctgcatgtga

SEQ ID NO: 491371 - DNA, 25 bp, Mus musculus
tgtttaaaggactggactcctggcc

SEQ ID NO: 491372 - DNA, 25 bp, Mus musculus
tgtttaacctggaccgggtgactgc

SEQ ID NO: 491373 - DNA, 25 bp, Mus musculus
tgtttaagaacatgacgccatcgcc

SEQ ID NO: 491374 - DNA, 25 bp, Mus musculus
tgtttaagcctgacagagccatctg

SEQ ID NO: 491375 - DNA, 25 bp, Mus musculus
tgtttaagttgcaaaaatagcagca

SEQ ID NO: 491376 - DNA, 25 bp, Mus musculus
tgtttaagttttccgtcatctgacc

SEQ ID NO: 491377 - DNA, 25 bp, Mus musculus
tgtttacaacgtctgcagccaccga

SEQ ID NO: 491378 - DNA, 25 bp, Mus musculus
tgtttacagcctgcgaaggtgactc

SEQ ID NO: 491379 - DNA, 25 bp, Mus musculus
tgtttacccagaagcccagggggct

SEQ ID NO: 491380 - DNA, 25 bp, Mus musculus
tgtttacccctagctaggttctggg

SEQ ID NO: 491381 - DNA, 25 bp, Mus musculus
tgtttacccctgagacttggctcgg

SEQ ID NO: 491382 - DNA, 25 bp, Mus musculus
tgtttaccggtcacttcggaggtgg

SEQ ID NO: 491383 - DNA, 25 bp, Mus musculus
tgtttacctcagtcatgctccctag

SEQ ID NO: 491384 - DNA, 25 bp, Mus musculus
tgtttacctcggcagcacaattggc

SEQ ID NO: 491385 - DNA, 25 bp, Mus musculus
tgtttacctggacccacatgagcgt

SEQ ID NO: 491386 - DNA, 25 bp, Mus musculus
tgtttacgaattctgccatgcagcg

SEQ ID NO: 491387 - DNA, 25 bp, Mus musculus
tgtttacggcttggcacaacaccct

SEQ ID NO: 491388 - DNA, 25 bp, Mus musculus
tgtttactgaagtcccacagctgct

SEQ ID NO: 491389 - DNA, 25 bp, Mus musculus
tgtttactgtccaattaaaagttct

SEQ ID NO: 491390 - DNA, 25 bp, Mus musculus
tgtttactttgacaagtagtgactg

SEQ ID NO: 491391 - DNA, 25 bp, Mus musculus
tgtttagacctagaacacacttagc

SEQ ID NO: 491392 - DNA, 25 bp, Mus musculus
tgtttagcaagatcgcagtcactgg

SEQ ID NO: 491393 - DNA, 25 bp, Mus musculus
tgtttagcacaagcaagaggcaggc

SEQ ID NO: 491394 - DNA, 25 bp, Mus musculus
tgtttaggactgagatgcactcccc

SEQ ID NO: 491395 - DNA, 25 bp, Mus musculus
tgtttaggtctctcgagatggtggt

SEQ ID NO: 491396 - DNA, 25 bp, Mus musculus
tgtttagtccaacaggagtccaagg

SEQ ID NO: 491397 - DNA, 25 bp, Mus musculus
tgtttataaagaggatgatgcaccc

SEQ ID NO: 491398 - DNA, 25 bp, Mus musculus
tgtttatagccccaaccaggtccgt

SEQ ID NO: 491399 - DNA, 25 bp, Mus musculus
tgtttatataagtaggctcagctcc

SEQ ID NO: 491400 - DNA, 25 bp, Mus musculus
tgtttatatcccaggcaagcgttgg

SEQ ID NO: 491401 - DNA, 25 bp, Mus musculus
tgtttatcgaggagacatgcttctg

SEQ ID NO: 491402 - DNA, 25 bp, Mus musculus
tgtttatgacctgccctagcttggg

SEQ ID NO: 491403 - DNA, 25 bp, Mus musculus
tgtttatgcaaaagcctcctgagcg

SEQ ID NO: 491404 - DNA, 25 bp, Mus musculus
tgtttatgtcccttcagcctgcaag

SEQ ID NO: 491405 - DNA, 25 bp, Mus musculus
tgtttattaaacacagggcagtaga

SEQ ID NO: 491406 - DNA, 25 bp, Mus musculus
tgtttattcctcaagcgggcgagcc

SEQ ID NO: 491407 - DNA, 25 bp, Mus musculus
tgtttattgtcttgatgctgctcct

SEQ ID NO: 491408 - DNA, 25 bp, Mus musculus
tgtttcaacatcaacaagcgggctg

SEQ ID NO: 491409 - DNA, 25 bp, Mus musculus
tgtttcaaggccaagaacccagaga

SEQ ID NO: 491410 - DNA, 25 bp, Mus musculus
tgtttcacacgcgtacgatcgagag

SEQ ID NO: 491411 - DNA, 25 bp, Mus musculus
tgtttcacatgtccgcaggttcccg

SEQ ID NO: 491412 - DNA, 25 bp, Mus musculus
tgtttcaccatcaggacagctgcta

SEQ ID NO: 491413 - DNA, 25 bp, Mus musculus
tgtttcaccctttgagtattcagcg

SEQ ID NO: 491414 - DNA, 25 bp, Mus musculus
tgtttcaccgaaaggaccatctgcg

SEQ ID NO: 491415 - DNA, 25 bp, Mus musculus
tgtttcacggactgctgacgcggat

SEQ ID NO: 491416 - DNA, 25 bp, Mus musculus
tgtttcacttagcaagcctggccct

SEQ ID NO: 491417 - DNA, 25 bp, Mus musculus
tgtttcagatctgggacagcaccct

SEQ ID NO: 491418 - DNA, 25 bp, Mus musculus
tgtttcagcccacttgggtggcgca

SEQ ID NO: 491419 - DNA, 25 bp, Mus musculus
tgtttcaggatgacgaaccggcagt

SEQ ID NO: 491420 - DNA, 25 bp, Mus musculus
tgtttcagtgacttcccgatgccgg

SEQ ID NO: 491421 - DNA, 25 bp, Mus musculus
tgtttcatcaacagccagaccgttg

SEQ ID NO: 491422 - DNA, 25 bp, Mus musculus
tgtttcatccggacgccagactgat

SEQ ID NO: 491423 - DNA, 25 bp, Mus musculus
tgtttccaacatggtggcgatccac

SEQ ID NO: 491424 - DNA, 25 bp, Mus musculus
tgtttccaccagttactcccgaggg

SEQ ID NO: 491425 - DNA, 25 bp, Mus musculus
tgtttccactactgataaaataata

SEQ ID NO: 491426 - DNA, 25 bp, Mus musculus
tgtttccagacttgcagaggctctg

SEQ ID NO: 491427 - DNA, 25 bp, Mus musculus
tgtttccaggtgtgagtgcattgca

SEQ ID NO: 491428 - DNA, 25 bp, Mus musculus
tgtttccagtacatgaaccgcggtg

SEQ ID NO: 491429 - DNA, 25 bp, Mus musculus
tgtttccatctaatccactcccgag

SEQ ID NO: 491430 - DNA, 25 bp, Mus musculus
tgtttccatctctgaccacaggagt

SEQ ID NO: 491431 - DNA, 25 bp, Mus musculus
tgtttccatctgcacccagaggtgt

SEQ ID NO: 491432 - DNA, 25 bp, Mus musculus
tgtttcccaaccagtaccgagaggc

SEQ ID NO: 491433 - DNA, 25 bp, Mus musculus
tgtttccccgccatgcaaagcttgg

SEQ ID NO: 491434 - DNA, 25 bp, Mus musculus
tgtttcccgactagaacggcaggct

SEQ ID NO: 491435 - DNA, 25 bp, Mus musculus
tgtttcccgctgttgactccatgct

SEQ ID NO: 491436 - DNA, 25 bp, Mus musculus
tgtttccctgctccgagggttccgg

SEQ ID NO: 491437 - DNA, 25 bp, Mus musculus
tgtttccggcgctcccttagcgaag

SEQ ID NO: 491438 - DNA, 25 bp, Mus musculus
tgtttcctaatgaagcacaatgccc

SEQ ID NO: 491439 - DNA, 25 bp, Mus musculus
tgtttcctctgcaacagaaagcatg

SEQ ID NO: 491440 - DNA, 25 bp, Mus musculus
tgtttccttcaaacgctgccgggcc

SEQ ID NO: 491441 - DNA, 25 bp, Mus musculus
tgtttcgaaaaagcctgccgcatct

SEQ ID NO: 491442 - DNA, 25 bp, Mus musculus
tgtttcgaggcaaggcagctgtcaa

SEQ ID NO: 491443 - DNA, 25 bp, Mus musculus
tgtttcgcacaaggtccagacagag

SEQ ID NO: 491444 - DNA, 25 bp, Mus musculus
tgtttctaagatgccagggagccaa

SEQ ID NO: 491445 - DNA, 25 bp, Mus musculus
tgtttctaagccagaaattgcttgg

SEQ ID NO: 491446 - DNA, 25 bp, Mus musculus
tgtttctacagaggcaccgtggacg

SEQ ID NO: 491447 - DNA, 25 bp, Mus musculus
tgtttctacccatgttcatgaatgc

SEQ ID NO: 491448 - DNA, 25 bp, Mus musculus
tgtttctcaaaaggcgtgtgtcacg

SEQ ID NO: 491449 - DNA, 25 bp, Mus musculus
tgtttctcaagagctgacgggccgc

SEQ ID NO: 491450 - DNA, 25 bp, Mus musculus
tgtttctcagtacttctggcctcca

SEQ ID NO: 491451 - DNA, 25 bp, Mus musculus
tgtttctcatactgtgtgtggccca

SEQ ID NO: 491452 - DNA, 25 bp, Mus musculus
tgtttctccataacaggtccccggt

SEQ ID NO: 491453 - DNA, 25 bp, Mus musculus
tgtttctgacaatgcagagagtgcc

SEQ ID NO: 491454 - DNA, 25 bp, Mus musculus
tgtttctgccaggttgatgcccgtg

SEQ ID NO: 491455 - DNA, 25 bp, Mus musculus
tgtttctgcctttaaagtggctcag

SEQ ID NO: 491456 - DNA, 25 bp, Mus musculus
tgtttctggaaacttgaggccctca

SEQ ID NO: 491457 - DNA, 25 bp, Mus musculus
tgtttctggaattgacctcgccaag

SEQ ID NO: 491458 - DNA, 25 bp, Mus musculus
tgtttctggagtggatgccaacccc

SEQ ID NO: 491459 - DNA, 25 bp, Mus musculus
tgtttcttatcagccaacctgtggg

SEQ ID NO: 491460 - DNA, 25 bp, Mus musculus
tgtttcttcaacttggtgagccctg

SEQ ID NO: 491461 - DNA, 25 bp, Mus musculus
tgtttcttcactctaaagcagccag

SEQ ID NO: 491462 - DNA, 25 bp, Mus musculus
tgtttcttccagagaagccatcctg

SEQ ID NO: 491463 - DNA, 25 bp, Mus musculus
tgtttcttgctataaaactgactga

SEQ ID NO: 491464 - DNA, 25 bp, Mus musculus
tgtttcttgcttctgctcacgtgcg

SEQ ID NO: 491465 - DNA, 25 bp, Mus musculus
tgtttctttctctgatcgtgtacag

SEQ ID NO: 491466 - DNA, 25 bp, Mus musculus
tgtttgaaagaagcaagtccctgag

SEQ ID NO: 491467 - DNA, 25 bp, Mus musculus
tgtttgaaagctacagcccagccag

SEQ ID NO: 491468 - DNA, 25 bp, Mus musculus
tgtttgaaagtcagggttgaccctg

SEQ ID NO: 491469 - DNA, 25 bp, Mus musculus
tgtttgaaattgtaggacaaggccc

SEQ ID NO: 491470 - DNA, 25 bp, Mus musculus
tgtttgaagaaatgggccttggagc

SEQ ID NO: 491471 - DNA, 25 bp, Mus musculus
tgtttgaattagacactacgcgagc

SEQ ID NO: 491472 - DNA, 25 bp, Mus musculus
tgtttgacaaactagccctgcgctt

SEQ ID NO: 491473 - DNA, 25 bp, Mus musculus
tgtttgacaagaccaagtctggccg

SEQ ID NO: 491474 - DNA, 25 bp, Mus musculus
tgtttgaccccgagacagctcaggt

SEQ ID NO: 491475 - DNA, 25 bp, Mus musculus
tgtttgacccggaggcaaagtggcc

SEQ ID NO: 491476 - DNA, 25 bp, Mus musculus
tgtttgaccgacacgaggactgcaa

SEQ ID NO: 491477 - DNA, 25 bp, Mus musculus
tgtttgaccggactccaacgggaga

SEQ ID NO: 491478 - DNA, 25 bp, Mus musculus
tgtttgaccggatgagagtggccct

SEQ ID NO: 491479 - DNA, 25 bp, Mus musculus
tgtttgactccttcctttgccaaga

SEQ ID NO: 491480 - DNA, 25 bp, Mus musculus
tgtttgagaagccaacaggtggacc

SEQ ID NO: 491481 - DNA, 25 bp, Mus musculus
tgtttgagaattctgcaccctgcag

SEQ ID NO: 491482 - DNA, 25 bp, Mus musculus
tgtttgagacatcagccaaggaccc

SEQ ID NO: 491483 - DNA, 25 bp, Mus musculus
tgtttgagcagttccgagagtgacc

SEQ ID NO: 491484 - DNA, 25 bp, Mus musculus
tgtttgagtatcctgaccctgtgca

SEQ ID NO: 491485 - DNA, 25 bp, Mus musculus
tgtttgataacgctgcctacctggc

SEQ ID NO: 491486 - DNA, 25 bp, Mus musculus
tgtttgatcacaccttcctgatggt

SEQ ID NO: 491487 - DNA, 25 bp, Mus musculus
tgtttgatcacttggagcctatgga

SEQ ID NO: 491488 - DNA, 25 bp, Mus musculus
tgtttgattccagagcccgaatcgg

SEQ ID NO: 491489 - DNA, 25 bp, Mus musculus
tgtttgattctagccacagccatgg

SEQ ID NO: 491490 - DNA, 25 bp, Mus musculus
tgtttgcaaaaaccgaggtggtcga

SEQ ID NO: 491491 - DNA, 25 bp, Mus musculus
tgtttgcaaagaaagcgggactatc

SEQ ID NO: 491492 - DNA, 25 bp, Mus musculus
tgtttgcaacaagccagtctcccgt

SEQ ID NO: 491493 - DNA, 25 bp, Mus musculus
tgtttgcaagcataagggaaagaga

SEQ ID NO: 491494 - DNA, 25 bp, Mus musculus
tgtttgcacagaccgttcttgctcc

SEQ ID NO: 491495 - DNA, 25 bp, Mus musculus
tgtttgcacagctgggtctatcctg

SEQ ID NO: 491496 - DNA, 25 bp, Mus musculus
tgtttgcacctctgaatctcggaga

SEQ ID NO: 491497 - DNA, 25 bp, Mus musculus
tgtttgcacttcaaaagcgggaagc

SEQ ID NO: 491498 - DNA, 25 bp, Mus musculus
tgtttgccaagctctcagcagattc

SEQ ID NO: 491499 - DNA, 25 bp, Mus musculus
tgtttgccagaattaagtagacgcc

SEQ ID NO: 491500 - DNA, 25 bp, Mus musculus
tgtttgccctctgcggctctggctg

SEQ ID NO: 491501 - DNA, 25 bp, Mus musculus
tgtttgccctggactagaactgcca

SEQ ID NO: 491502 - DNA, 25 bp, Mus musculus
tgtttgccggcctcccgggatggcc

SEQ ID NO: 491503 - DNA, 25 bp, Mus musculus
tgtttgcctcgtcctctgccaatga

SEQ ID NO: 491504 - DNA, 25 bp, Mus musculus
tgtttgcctgaagtgaatttccaga

SEQ ID NO: 491505 - DNA, 25 bp, Mus musculus
tgtttgcgaagataaagggataccc

SEQ ID NO: 491506 - DNA, 25 bp, Mus musculus
tgtttgcgttctgcaggctggccct

SEQ ID NO: 491507 - DNA, 25 bp, Mus musculus
tgtttgctcaggacccagatctggg

SEQ ID NO: 491508 - DNA, 25 bp, Mus musculus
tgtttgctcgaaccgggccagagcc

SEQ ID NO: 491509 - DNA, 25 bp, Mus musculus
tgtttgctgctcctgacttctatga

SEQ ID NO: 491510 - DNA, 25 bp, Mus musculus
tgtttgctggtgtcataagaaggtg

SEQ ID NO: 491511 - DNA, 25 bp, Mus musculus
tgtttgcttcctgggcgtcctctga

SEQ ID NO: 491512 - DNA, 25 bp, Mus musculus
tgtttgcttctaaatggcccctggg

SEQ ID NO: 491513 - DNA, 25 bp, Mus musculus
tgtttggaaagaagactacgacaaa

SEQ ID NO: 491514 - DNA, 25 bp, Mus musculus
tgtttggaaatcagctgagggcacg

SEQ ID NO: 491515 - DNA, 25 bp, Mus musculus
tgtttggaatcctgctcacctgccg

SEQ ID NO: 491516 - DNA, 25 bp, Mus musculus
tgtttggacaccactcaggaactgt

SEQ ID NO: 491517 - DNA, 25 bp, Mus musculus
tgtttggacatgaaaaccgcgtcag

SEQ ID NO: 491518 - DNA, 25 bp, Mus musculus
tgtttggccaaccaaggagaccttg

SEQ ID NO: 491519 - DNA, 25 bp, Mus musculus
tgtttggcgactttgggcacggctt

SEQ ID NO: 491520 - DNA, 25 bp, Mus musculus
tgtttggcttagaactccgggtgcc

SEQ ID NO: 491521 - DNA, 25 bp, Mus musculus
tgtttgggccgctagaagcacatga

SEQ ID NO: 491522 - DNA, 25 bp, Mus musculus
tgtttggtaagcaagatgcaagcac

SEQ ID NO: 491523 - DNA, 25 bp, Mus musculus
tgtttggtgtcactttgggtacaag

SEQ ID NO: 491524 - DNA, 25 bp, Mus musculus
tgtttgtacaggtttgggcatgccc

SEQ ID NO: 491525 - DNA, 25 bp, Mus musculus
tgtttgtactttttcccaggccctg

SEQ ID NO: 491526 - DNA, 25 bp, Mus musculus
tgtttgtcaacaaccaggaactctg

SEQ ID NO: 491527 - DNA, 25 bp, Mus musculus
tgtttgtcacaagtgtccagaggag

SEQ ID NO: 491528 - DNA, 25 bp, Mus musculus
tgtttgtcctgatgagcgcctgcct

SEQ ID NO: 491529 - DNA, 25 bp, Mus musculus
tgtttgtctacaagtggccagcgga

SEQ ID NO: 491530 - DNA, 25 bp, Mus musculus
tgtttgtgcccatcggcagccagga

SEQ ID NO: 491531 - DNA, 25 bp, Mus musculus
tgtttgttatgtgagctccaggccc

SEQ ID NO: 491532 - DNA, 25 bp, Mus musculus
tgtttgttatttgtgcacgtgtgca

SEQ ID NO: 491533 - DNA, 25 bp, Mus musculus
tgtttgttggagacaccctaggccg

SEQ ID NO: 491534 - DNA, 25 bp, Mus musculus
tgttttaacctacccacagcactgg

SEQ ID NO: 491535 - DNA, 25 bp, Mus musculus
tgttttacctgcaagattttccgcc

SEQ ID NO: 491536 - DNA, 25 bp, Mus musculus
tgttttacttcaagcagccggtggc

SEQ ID NO: 491537 - DNA, 25 bp, Mus musculus
tgttttatatggcatgtcaggtggc

SEQ ID NO: 491538 - DNA, 25 bp, Mus musculus
tgttttatgcccctatacatgcagg

SEQ ID NO: 491539 - DNA, 25 bp, Mus musculus
tgttttcaagtgctcggtgtcccga

SEQ ID NO: 491540 - DNA, 25 bp, Mus musculus
tgttttcaatctacaggtgaccctg

SEQ ID NO: 491541 - DNA, 25 bp, Mus musculus
tgttttcaatgaaggcactgccact

SEQ ID NO: 491542 - DNA, 25 bp, Mus musculus
tgttttcagatcacaaggactctgc

SEQ ID NO: 491543 - DNA, 25 bp, Mus musculus
tgttttcagggctcatcaggcactg

SEQ ID NO: 491544 - DNA, 25 bp, Mus musculus
tgttttcatcttctgctgggcgcct

SEQ ID NO: 491545 - DNA, 25 bp, Mus musculus
tgttttcattgttcctattcagaga

SEQ ID NO: 491546 - DNA, 25 bp, Mus musculus
tgttttccaacagcaggcctacctg

SEQ ID NO: 491547 - DNA, 25 bp, Mus musculus
tgttttccagcagcgtcttgggtgt

SEQ ID NO: 491548 - DNA, 25 bp, Mus musculus
tgttttccagttctgcagcgtcatg

SEQ ID NO: 491549 - DNA, 25 bp, Mus musculus
tgttttcccaccagggtacctgtca

SEQ ID NO: 491550 - DNA, 25 bp, Mus musculus
tgttttcccatcaagtgtcagctgg

SEQ ID NO: 491551 - DNA, 25 bp, Mus musculus
tgttttccggttgtctgtggcccag

SEQ ID NO: 491552 - DNA, 25 bp, Mus musculus
tgttttcctttaggaatcttccgag

SEQ ID NO: 491553 - DNA, 25 bp, Mus musculus
tgttttcgaggttctggaaatccag

SEQ ID NO: 491554 - DNA, 25 bp, Mus musculus
tgttttctcaggtcacagtctcccg

SEQ ID NO: 491555 - DNA, 25 bp, Mus musculus
tgttttctgcacacgtgggagccgt

SEQ ID NO: 491556 - DNA, 25 bp, Mus musculus
tgttttctggtagtcgcacggaggt

SEQ ID NO: 491557 - DNA, 25 bp, Mus musculus
tgttttgaaagaacgtgcatatacg

SEQ ID NO: 491558 - DNA, 25 bp, Mus musculus
tgttttgaacgagtccctactggct

SEQ ID NO: 491559 - DNA, 25 bp, Mus musculus
tgttttgaagcctaccttgaggggc

SEQ ID NO: 491560 - DNA, 25 bp, Mus musculus
tgttttgagaaaatccaggttccac

SEQ ID NO: 491561 - DNA, 25 bp, Mus musculus
tgttttgagtagtcacacaactgtt

SEQ ID NO: 491562 - DNA, 25 bp, Mus musculus
tgttttgataacagaatctaatagt

SEQ ID NO: 491563 - DNA, 25 bp, Mus musculus
tgttttgataggaatgatctccatg

SEQ ID NO: 491564 - DNA, 25 bp, Mus musculus
tgttttgatcatctactgtccaagt

SEQ ID NO: 491565 - DNA, 25 bp, Mus musculus
tgttttgcaagacgagactccactg

SEQ ID NO: 491566 - DNA, 25 bp, Mus musculus
tgttttgcagcagaatttgtcctct

SEQ ID NO: 491567 - DNA, 25 bp, Mus musculus
tgttttgccctaaagacttagcagg

SEQ ID NO: 491568 - DNA, 25 bp, Mus musculus
tgttttgctacgtgagtgtacgcca

SEQ ID NO: 491569 - DNA, 25 bp, Mus musculus
tgttttggaccaaccagatgctgcc

SEQ ID NO: 491570 - DNA, 25 bp, Mus musculus
tgttttggcctgcatcagcccggaa

SEQ ID NO: 491571 - DNA, 25 bp, Mus musculus
tgttttggctgggtcacttatggac

SEQ ID NO: 491572 - DNA, 25 bp, Mus musculus
tgttttgtatgctaacagacgcccc

SEQ ID NO: 491573 - DNA, 25 bp, Mus musculus
tgtttttaataaatgaagactggca

SEQ ID NO: 491574 - DNA, 25 bp, Mus musculus
tgtttttagagacctttgcgggcct

SEQ ID NO: 491575 - DNA, 25 bp, Mus musculus
tgtttttcccctctgtcgtgctctg

SEQ ID NO: 491576 - DNA, 25 bp, Mus musculus
tgtttttgaggagaaactctgtgaa

SEQ ID NO: 491577 - DNA, 25 bp, Mus musculus
tgtttttgcattcactcttagcttc

SEQ ID NO: 491578 - DNA, 25 bp, Mus musculus
tgtttttgctctgtgcaactggata

SEQ ID NO: 491579 - DNA, 25 bp, Mus musculus
tgtttttggcggaactaccgggcag

SEQ ID NO: 491580 - DNA, 25 bp, Mus musculus
tgtttttgtctacccttctggtcag

SEQ ID NO: 491581 - DNA, 25 bp, Mus musculus
tgttttttcactggaggccctgggt

SEQ ID NO: 491582 - DNA, 25 bp, Mus musculus
tgttttttggcctttatggaaggag

SEQ ID NO: 491583 - DNA, 25 bp, Mus musculus
ttaaaaagaggcactggacatttct

SEQ ID NO: 491584 - DNA, 25 bp, Mus musculus
ttaaaaagctcagaatcagtccggg

SEQ ID NO: 491585 - DNA, 25 bp, Mus musculus
ttaaaaatcgaggtgcggtgaggca

SEQ ID NO: 491586 - DNA, 25 bp, Mus musculus
ttaaaaatttcatgtggatcgccca

SEQ ID NO: 491587 - DNA, 25 bp, Mus musculus
ttaaaacagcttcccaaccgtgcca

SEQ ID NO: 491588 - DNA, 25 bp, Mus musculus
ttaaaacatggcacctgtattcctg

SEQ ID NO: 491589 - DNA, 25 bp, Mus musculus
ttaaaaccacttctctgagtatggg

SEQ ID NO: 491590 - DNA, 25 bp, Mus musculus
ttaaaacccgtacctgagatgctcc

SEQ ID NO: 491591 - DNA, 25 bp, Mus musculus
ttaaaactgcactcaggaaacaggc

SEQ ID NO: 491592 - DNA, 25 bp, Mus musculus
ttaaaagaggagttctgtgacccct

SEQ ID NO: 491593 - DNA, 25 bp, Mus musculus
ttaaaagatgaggaaaggtgtttct

SEQ ID NO: 491594 - DNA, 25 bp, Mus musculus
ttaaaagcacgtgccatgtttggcc

SEQ ID NO: 491595 - DNA, 25 bp, Mus musculus
ttaaaagccacgatgggcctcgctg

SEQ ID NO: 491596 - DNA, 25 bp, Mus musculus
ttaaaagctgtttaagcaattgcag

SEQ ID NO: 491597 - DNA, 25 bp, Mus musculus
ttaaaaggtagctgcagtgatgact

SEQ ID NO: 491598 - DNA, 25 bp, Mus musculus
ttaaaatggaaaggaacagtagctc

SEQ ID NO: 491599 - DNA, 25 bp, Mus musculus
ttaaaattaactcggcactctcagg

SEQ ID NO: 491600 - DNA, 25 bp, Mus musculus
ttaaacactgtcaggtgaagacccc

SEQ ID NO: 491601 - DNA, 25 bp, Mus musculus
ttaaaccttgaaaatgccaccttgg

SEQ ID NO: 491602 - DNA, 25 bp, Mus musculus
ttaaacgcctttccagtagcagcca

SEQ ID NO: 491603 - DNA, 25 bp, Mus musculus
ttaaactacacatggaatagagggc

SEQ ID NO: 491604 - DNA, 25 bp, Mus musculus
ttaaactcgtgtcagcccagaatgg

SEQ ID NO: 491605 - DNA, 25 bp, Mus musculus
ttaaactgaagagaggacagcttcc

SEQ ID NO: 491606 - DNA, 25 bp, Mus musculus
ttaaacttgtaaccacctctcggcg

SEQ ID NO: 491607 - DNA, 25 bp, Mus musculus
ttaaactttaacgtggatccgtctg

SEQ ID NO: 491608 - DNA, 25 bp, Mus musculus
ttaaactttcccagctctggcccga

SEQ ID NO: 491609 - DNA, 25 bp, Mus musculus
ttaaagaagctgacggccactgatg

SEQ ID NO: 491610 - DNA, 25 bp, Mus musculus
ttaaagaaggtactaggcttttgca

SEQ ID NO: 491611 - DNA, 25 bp, Mus musculus
ttaaagacagatgagaggatctccc

SEQ ID NO: 491612 - DNA, 25 bp, Mus musculus
ttaaagaccctagggagcccgtgca

SEQ ID NO: 491613 - DNA, 25 bp, Mus musculus
ttaaagacgaactacccgagcggca

SEQ ID NO: 491614 - DNA, 25 bp, Mus musculus
ttaaagagtcttcatcttggtggcc

SEQ ID NO: 491615 - DNA, 25 bp, Mus musculus
ttaaagatccctgtccggtacctcg

SEQ ID NO: 491616 - DNA, 25 bp, Mus musculus
ttaaagcaatacataaggaatctgg

SEQ ID NO: 491617 - DNA, 25 bp, Mus musculus
ttaaagcaccgagctgagatccggg

SEQ ID NO: 491618 - DNA, 25 bp, Mus musculus
ttaaagccgagcactccgtcatggg

SEQ ID NO: 491619 - DNA, 25 bp, Mus musculus
ttaaagctgcttgaaggcgtaggcc

SEQ ID NO: 491620 - DNA, 25 bp, Mus musculus
ttaaaggaagccacaaacacccatt

SEQ ID NO: 491621 - DNA, 25 bp, Mus musculus
ttaaaggccagaggagtggtgccac

SEQ ID NO: 491622 - DNA, 25 bp, Mus musculus
ttaaaggctggctgaacggttccct

SEQ ID NO: 491623 - DNA, 25 bp, Mus musculus
ttaaagggacgccagcaattgctct

SEQ ID NO: 491624 - DNA, 25 bp, Mus musculus
ttaaagtcgagtgccgccactgcct

SEQ ID NO: 491625 - DNA, 25 bp, Mus musculus
ttaaagtctcgcaggcaagttggcc

SEQ ID NO: 491626 - DNA, 25 bp, Mus musculus
ttaaagtgctaccatgccaagccag

SEQ ID NO: 491627 - DNA, 25 bp, Mus musculus
ttaaagttcatccttaaggcctttg

SEQ ID NO: 491628 - DNA, 25 bp, Mus musculus
ttaaagttccaaattcaagtgaggc

SEQ ID NO: 491629 - DNA, 25 bp, Mus musculus
ttaaagttgaagcagacggcagacg

SEQ ID NO: 491630 - DNA, 25 bp, Mus musculus
ttaaataatataatagctcctcatg

SEQ ID NO: 491631 - DNA, 25 bp, Mus musculus
ttaaatctacttagagaaaaaggca

SEQ ID NO: 491632 - DNA, 25 bp, Mus musculus
ttaaatctgccggtaaatccaggac

SEQ ID NO: 491633 - DNA, 25 bp, Mus musculus
ttaaatgcgctgtatccaggctgca

SEQ ID NO: 491634 - DNA, 25 bp, Mus musculus
ttaaattagaccctcgcctggctcg

SEQ ID NO: 491635 - DNA, 25 bp, Mus musculus
ttaaatttgatacagaaacagccca

SEQ ID NO: 491636 - DNA, 25 bp, Mus musculus
ttaacaacagatggagaatgccacg

SEQ ID NO: 491637 - DNA, 25 bp, Mus musculus
ttaacaactttgaagctggagagga

SEQ ID NO: 491638 - DNA, 25 bp, Mus musculus
ttaacaagaatgagtcggtgctgcg

SEQ ID NO: 491639 - DNA, 25 bp, Mus musculus
ttaacaccttgtgtaggatacctgc

SEQ ID NO: 491640 - DNA, 25 bp, Mus musculus
ttaacactattctgggaagggccca

SEQ ID NO: 491641 - DNA, 25 bp, Mus musculus
ttaacactcccagtaacaaaagttg

SEQ ID NO: 491642 - DNA, 25 bp, Mus musculus
ttaacactgtgcactacgactcgga

SEQ ID NO: 491643 - DNA, 25 bp, Mus musculus
ttaacagagtatgtggcctggtgcc

SEQ ID NO: 491644 - DNA, 25 bp, Mus musculus
ttaacaggatggtagcggtagtgct

SEQ ID NO: 491645 - DNA, 25 bp, Mus musculus
ttaacaggatttacaggcagaagcc

SEQ ID NO: 491646 - DNA, 25 bp, Mus musculus
ttaacatttggaactgaagccgagg

SEQ ID NO: 491647 - DNA, 25 bp, Mus musculus
ttaaccacaactgggtcaatggctg

SEQ ID NO: 491648 - DNA, 25 bp, Mus musculus
ttaaccagtggatcaagcagccgct

SEQ ID NO: 491649 - DNA, 25 bp, Mus musculus
ttaaccatgaagacaggaaccctgt

SEQ ID NO: 491650 - DNA, 25 bp, Mus musculus
ttaacccagcgtgcacaggtatccg

SEQ ID NO: 491651 - DNA, 25 bp, Mus musculus
ttaacccaggcctgatccgaagatg

SEQ ID NO: 491652 - DNA, 25 bp, Mus musculus
ttaaccccggagagcagagtgatgg

SEQ ID NO: 491653 - DNA, 25 bp, Mus musculus
ttaaccctaagacggcccagagtgt

SEQ ID NO: 491654 - DNA, 25 bp, Mus musculus
ttaaccctgcagaataagaagtgcc

SEQ ID NO: 491655 - DNA, 25 bp, Mus musculus
ttaaccctggcctttctgccctgag

SEQ ID NO: 491656 - DNA, 25 bp, Mus musculus
ttaaccctttaccttgtgatcgctg

SEQ ID NO: 491657 - DNA, 25 bp, Mus musculus
ttaaccgcaaggtcacagtccagtg

SEQ ID NO: 491658 - DNA, 25 bp, Mus musculus
ttaaccgtgtatactcccacgccgg

SEQ ID NO: 491659 - DNA, 25 bp, Mus musculus
ttaacctggctttctggtattggcg

SEQ ID NO: 491660 - DNA, 25 bp, Mus musculus
ttaacctttaggctctcggagaaca

SEQ ID NO: 491661 - DNA, 25 bp, Mus musculus
ttaaccttttatccccagtgctggg

SEQ ID NO: 491662 - DNA, 25 bp, Mus musculus
ttaacgagccatagagcacatgact

SEQ ID NO: 491663 - DNA, 25 bp, Mus musculus
ttaacgagctggtaaaatcccgagc

SEQ ID NO: 491664 - DNA, 25 bp, Mus musculus
ttaacgccatcaagagtttgctgac

SEQ ID NO: 491665 - DNA, 25 bp, Mus musculus
ttaacggacatcttgcagagctgcc

SEQ ID NO: 491666 - DNA, 25 bp, Mus musculus
ttaacggtggtttctgagggcatcc

SEQ ID NO: 491667 - DNA, 25 bp, Mus musculus
ttaactaatgagagacgaaccagcg

SEQ ID NO: 491668 - DNA, 25 bp, Mus musculus
ttaactacctgatgggaacgtggcc

SEQ ID NO: 491669 - DNA, 25 bp, Mus musculus
ttaactccctgtctgcatgagcatg

SEQ ID NO: 491670 - DNA, 25 bp, Mus musculus
ttaactcctgggttccactggctgc

SEQ ID NO: 491671 - DNA, 25 bp, Mus musculus
ttaactcggtggtgcctgatagagg

SEQ ID NO: 491672 - DNA, 25 bp, Mus musculus
ttaactcttcgggaaggcagaggcg

SEQ ID NO: 491673 - DNA, 25 bp, Mus musculus
ttaactgaaagtccgttactttgcg

SEQ ID NO: 491674 - DNA, 25 bp, Mus musculus
ttaactgcagcggagaggcacatcg

SEQ ID NO: 491675 - DNA, 25 bp, Mus musculus
ttaactgctggatgcacgctggcca

SEQ ID NO: 491676 - DNA, 25 bp, Mus musculus
ttaactggaactgggccaggactgg

SEQ ID NO: 491677 - DNA, 25 bp, Mus musculus
ttaactgggtactggccctgggcca

SEQ ID NO: 491678 - DNA, 25 bp, Mus musculus
ttaactggtgttccagaagagcaca

SEQ ID NO: 491679 - DNA, 25 bp, Mus musculus
ttaacttgacatcgcaagcccggca

SEQ ID NO: 491680 - DNA, 25 bp, Mus musculus
ttaacttgcaagagaggttgtgctc

SEQ ID NO: 491681 - DNA, 25 bp, Mus musculus
ttaacttggcctgcgggtacgctgc

SEQ ID NO: 491682 - DNA, 25 bp, Mus musculus
ttaactttggccatagctgtgctca

SEQ ID NO: 491683 - DNA, 25 bp, Mus musculus
ttaagaaacaaagtcgatacatacg

SEQ ID NO: 491684 - DNA, 25 bp, Mus musculus
ttaagaaagctagacgctaccccag

SEQ ID NO: 491685 - DNA, 25 bp, Mus musculus
ttaagaaagtacgagctcccctgag

SEQ ID NO: 491686 - DNA, 25 bp, Mus musculus
ttaagaagaaatcaagcgaccaggc

SEQ ID NO: 491687 - DNA, 25 bp, Mus musculus
ttaagaagccatagtgtagattggg

SEQ ID NO: 491688 - DNA, 25 bp, Mus musculus
ttaagacaggaacccaaagagccag

SEQ ID NO: 491689 - DNA, 25 bp, Mus musculus
ttaagacaggctgctaggtcaggcc

SEQ ID NO: 491690 - DNA, 25 bp, Mus musculus
ttaagacgagggaggacccctcttg

SEQ ID NO: 491691 - DNA, 25 bp, Mus musculus
ttaagacgatgagccgcaggaagct

SEQ ID NO: 491692 - DNA, 25 bp, Mus musculus
ttaagactaaatgccagagcgcagc

SEQ ID NO: 491693 - DNA, 25 bp, Mus musculus
ttaagactaatctggccgggcgtgg

SEQ ID NO: 491694 - DNA, 25 bp, Mus musculus
ttaagactacgctacagaaaccctg

SEQ ID NO: 491695 - DNA, 25 bp, Mus musculus
ttaagactgcagctgcttcctgact

SEQ ID NO: 491696 - DNA, 25 bp, Mus musculus
ttaagacttctagactcccagggcc

SEQ ID NO: 491697 - DNA, 25 bp, Mus musculus
ttaagagaaacaagccaccggagga

SEQ ID NO: 491698 - DNA, 25 bp, Mus musculus
ttaagaggttgctatggccacggcg

SEQ ID NO: 491699 - DNA, 25 bp, Mus musculus
ttaagagtgatagggaagccagcgc

SEQ ID NO: 491700 - DNA, 25 bp, Mus musculus
ttaagatctacccttcctgctgcag

SEQ ID NO: 491701 - DNA, 25 bp, Mus musculus
ttaagatgccggcttggagcacaca

SEQ ID NO: 491702 - DNA, 25 bp, Mus musculus
ttaagatttaacatttgcctctggg

SEQ ID NO: 491703 - DNA, 25 bp, Mus musculus
ttaagcaaatgaagactccagaggc

SEQ ID NO: 491704 - DNA, 25 bp, Mus musculus
ttaagcacccctggacatggacatg

SEQ ID NO: 491705 - DNA, 25 bp, Mus musculus
ttaagcacgtggtttggcacccgag

SEQ ID NO: 491706 - DNA, 25 bp, Mus musculus
ttaagcctcagagaaacgtgtcctg

SEQ ID NO: 491707 - DNA, 25 bp, Mus musculus
ttaagcctcgagacctggattccag

SEQ ID NO: 491708 - DNA, 25 bp, Mus musculus
ttaagcctgccaacaatggattttc

SEQ ID NO: 491709 - DNA, 25 bp, Mus musculus
ttaagcctttgactctccctggtgg

SEQ ID NO: 491710 - DNA, 25 bp, Mus musculus
ttaagcggcccaagtaaacgtagcg

SEQ ID NO: 491711 - DNA, 25 bp, Mus musculus
ttaagctgcaagtttcccggagaaa

SEQ ID NO: 491712 - DNA, 25 bp, Mus musculus
ttaagcttgagaagccacaatgccg

SEQ ID NO: 491713 - DNA, 25 bp, Mus musculus
ttaaggacagcaagccctttccttc

SEQ ID NO: 491714 - DNA, 25 bp, Mus musculus
ttaaggacagctcaggacaccacct

SEQ ID NO: 491715 - DNA, 25 bp, Mus musculus
ttaaggacagtacggcacagaatgc

SEQ ID NO: 491716 - DNA, 25 bp, Mus musculus
ttaaggacgaggttcctggagctgc

SEQ ID NO: 491717 - DNA, 25 bp, Mus musculus
ttaaggacgtcccactttgccagca

SEQ ID NO: 491718 - DNA, 25 bp, Mus musculus
ttaaggagaaccaggacatgccact

SEQ ID NO: 491719 - DNA, 25 bp, Mus musculus
ttaaggagccaagctgagaaagcac

SEQ ID NO: 491720 - DNA, 25 bp, Mus musculus
ttaaggagtcgtcctccgaaggccg

SEQ ID NO: 491721 - DNA, 25 bp, Mus musculus
ttaaggagtcttacatgcagcatgc

SEQ ID NO: 491722 - DNA, 25 bp, Mus musculus
ttaaggcgagcctcaaaagccggag

SEQ ID NO: 491723 - DNA, 25 bp, Mus musculus
ttaaggcgtctaagatcaagaagcc

SEQ ID NO: 491724 - DNA, 25 bp, Mus musculus
ttaaggcgtggtgtgtccgcagaca

SEQ ID NO: 491725 - DNA, 25 bp, Mus musculus
ttaaggctgaacatgagaagcggct

SEQ ID NO: 491726 - DNA, 25 bp, Mus musculus
ttaagggcacgcatccgctgcttcc

SEQ ID NO: 491727 - DNA, 25 bp, Mus musculus
ttaaggtccgataccccactgtgga

SEQ ID NO: 491728 - DNA, 25 bp, Mus musculus
ttaaggtggaaatgaatctgcagcc

SEQ ID NO: 491729 - DNA, 25 bp, Mus musculus
ttaaggtgggcctcaaagaagtcgg

SEQ ID NO: 491730 - DNA, 25 bp, Mus musculus
ttaagtattagaattgtggtcaggg

SEQ ID NO: 491731 - DNA, 25 bp, Mus musculus
ttaagtcaaagatgacgtctctaag

SEQ ID NO: 491732 - DNA, 25 bp, Mus musculus
ttaagtcacctttgttttccatctg

SEQ ID NO: 491733 - DNA, 25 bp, Mus musculus
ttaagtctcactcaagatcccgtgg

SEQ ID NO: 491734 - DNA, 25 bp, Mus musculus
ttaagtctttctgcttcacctgggc

SEQ ID NO: 491735 - DNA, 25 bp, Mus musculus
ttaagtgacagtccacgtgcctggc

SEQ ID NO: 491736 - DNA, 25 bp, Mus musculus
ttaagtgcacgtatgtacacatgcg

SEQ ID NO: 491737 - DNA, 25 bp, Mus musculus
ttaagtgctgtgaagagccggctcc

SEQ ID NO: 491738 - DNA, 25 bp, Mus musculus
ttaagtggcagactctcttttcccc

SEQ ID NO: 491739 - DNA, 25 bp, Mus musculus
ttaagtgtccctcggaacaagcgga

SEQ ID NO: 491740 - DNA, 25 bp, Mus musculus
ttaagttgacaacctgcctggctgc

SEQ ID NO: 491741 - DNA, 25 bp, Mus musculus
ttaataaaaggaaggcatctgggct

SEQ ID NO: 491742 - DNA, 25 bp, Mus musculus
ttaataaagaaggtaagtggagctc

SEQ ID NO: 491743 - DNA, 25 bp, Mus musculus
ttaataaagcaagttcggagacacg

SEQ ID NO: 491744 - DNA, 25 bp, Mus musculus
ttaataataaacgactgaactttgc

SEQ ID NO: 491745 - DNA, 25 bp, Mus musculus
ttaatactagaaaaacttgctaagg

SEQ ID NO: 491746 - DNA, 25 bp, Mus musculus
ttaatactgagaagatccgcgtgcc

SEQ ID NO: 491747 - DNA, 25 bp, Mus musculus
ttaatagaaactggaagaaacgcta

SEQ ID NO: 491748 - DNA, 25 bp, Mus musculus
ttaatagcagagacacaaactgtcc

SEQ ID NO: 491749 - DNA, 25 bp, Mus musculus
ttaatagcggaaacatcgacgtgcc

SEQ ID NO: 491750 - DNA, 25 bp, Mus musculus
ttaataggaccatgagccagctctc

SEQ ID NO: 491751 - DNA, 25 bp, Mus musculus
ttaataggcttctcctggtgcaagg

SEQ ID NO: 491752 - DNA, 25 bp, Mus musculus
ttaatcaactagcatcgtgggactg

SEQ ID NO: 491753 - DNA, 25 bp, Mus musculus
ttaatcagggaaagcacccagttaa

SEQ ID NO: 491754 - DNA, 25 bp, Mus musculus
ttaatcagggaaggatggactctgc

SEQ ID NO: 491755 - DNA, 25 bp, Mus musculus
ttaatccagagctagaggccgtgcc

SEQ ID NO: 491756 - DNA, 25 bp, Mus musculus
ttaatcccggagcagtaaagcccaa

SEQ ID NO: 491757 - DNA, 25 bp, Mus musculus
ttaatcctgggcttgcaaatggtga

SEQ ID NO: 491758 - DNA, 25 bp, Mus musculus
ttaatcggcacacaagacaggcggc

SEQ ID NO: 491759 - DNA, 25 bp, Mus musculus
ttaatctccgatttcagcgagcttt

SEQ ID NO: 491760 - DNA, 25 bp, Mus musculus
ttaatctgtagtcctcgagtgggca

SEQ ID NO: 491761 - DNA, 25 bp, Mus musculus
ttaatcttcacacttgggctgagga

SEQ ID NO: 491762 - DNA, 25 bp, Mus musculus
ttaatgaactcctggaagcgccgct

SEQ ID NO: 491763 - DNA, 25 bp, Mus musculus
ttaatgagtgcagccagaaccctgg

SEQ ID NO: 491764 - DNA, 25 bp, Mus musculus
ttaatgataactccaagggcctcca

SEQ ID NO: 491765 - DNA, 25 bp, Mus musculus
ttaatgctagaaacgtggcccctgc

SEQ ID NO: 491766 - DNA, 25 bp, Mus musculus
ttaatggaaagatgagagtacaccc

SEQ ID NO: 491767 - DNA, 25 bp, Mus musculus
ttaatggtgtgttctacaggctgga

SEQ ID NO: 491768 - DNA, 25 bp, Mus musculus
ttaatgtccggagagaatcagcgtg

SEQ ID NO: 491769 - DNA, 25 bp, Mus musculus
ttaatgtgtgactttgcaggctgtg

SEQ ID NO: 491770 - DNA, 25 bp, Mus musculus
ttaatgttcgggatcgcgaggccgc

SEQ ID NO: 491771 - DNA, 25 bp, Mus musculus
ttaatgtttggcagagggagacagc

SEQ ID NO: 491772 - DNA, 25 bp, Mus musculus
ttaattaccagtctctacagagcgg

SEQ ID NO: 491773 - DNA, 25 bp, Mus musculus
ttaattaggtgccagcgtgtgtctg

SEQ ID NO: 491774 - DNA, 25 bp, Mus musculus
ttaattctagaaacacggcccaagc

SEQ ID NO: 491775 - DNA, 25 bp, Mus musculus
ttaatttctgagtgatgcctgtgtg

SEQ ID NO: 491776 - DNA, 25 bp, Mus musculus
ttacaaagaggcctcagaaacaggg

SEQ ID NO: 491777 - DNA, 25 bp, Mus musculus
ttacaacacagtgatagggcagctg

SEQ ID NO: 491778 - DNA, 25 bp, Mus musculus
ttacaaccaagagaagactgcatgc

SEQ ID NO: 491779 - DNA, 25 bp, Mus musculus
ttacaagaacccacttcgcagcctg

SEQ ID NO: 491780 - DNA, 25 bp, Mus musculus
ttacaagacagtgcaaaccaagcag

SEQ ID NO: 491781 - DNA, 25 bp, Mus musculus
ttacaagacgctgtaagcatccact

SEQ ID NO: 491782 - DNA, 25 bp, Mus musculus
ttacaagagcaacatcgaccggctg

SEQ ID NO: 491783 - DNA, 25 bp, Mus musculus
ttacaagcaagaagagaactaaacc

SEQ ID NO: 491784 - DNA, 25 bp, Mus musculus
ttacaaggacaacagcgacttcggg

SEQ ID NO: 491785 - DNA, 25 bp, Mus musculus
ttacaaggccaagagactgaagtcc

SEQ ID NO: 491786 - DNA, 25 bp, Mus musculus
ttacaagtgtctcccggttttaatg

SEQ ID NO: 491787 - DNA, 25 bp, Mus musculus
ttacaataaatgtcacccagtggcc

SEQ ID NO: 491788 - DNA, 25 bp, Mus musculus
ttacaatactttagggaccacccag

SEQ ID NO: 491789 - DNA, 25 bp, Mus musculus
ttacaattccccagagacgggcaac

SEQ ID NO: 491790 - DNA, 25 bp, Mus musculus
ttacacaagggtatccaggcaccgt

SEQ ID NO: 491791 - DNA, 25 bp, Mus musculus
ttacacagtcatccaaagagccgag

SEQ ID NO: 491792 - DNA, 25 bp, Mus musculus
ttacacatgaagactggcccggaga

SEQ ID NO: 491793 - DNA, 25 bp, Mus musculus
ttacaccaaccaaaagatcctgtgg

SEQ ID NO: 491794 - DNA, 25 bp, Mus musculus
ttacaccagtccctagaaagagccg

SEQ ID NO: 491795 - DNA, 25 bp, Mus musculus
ttacacgaagcaccagacgctggag

SEQ ID NO: 491796 - DNA, 25 bp, Mus musculus
ttacacgcatcctcaagtcgctggg

SEQ ID NO: 491797 - DNA, 25 bp, Mus musculus
ttacacggagctactatagaggagc

SEQ ID NO: 491798 - DNA, 25 bp, Mus musculus
ttacagaacagactactcagggcgg

SEQ ID NO: 491799 - DNA, 25 bp, Mus musculus
ttacagagagaagggctgaggccat

SEQ ID NO: 491800 - DNA, 25 bp, Mus musculus
ttacagaggctacattagtgcctgg

SEQ ID NO: 491801 - DNA, 25 bp, Mus musculus
ttacagagggacttagagcaggccc

SEQ ID NO: 491802 - DNA, 25 bp, Mus musculus
ttacagagttcagcgcttggttccc

SEQ ID NO: 491803 - DNA, 25 bp, Mus musculus
ttacagatacaaggcagagcttaga

SEQ ID NO: 491804 - DNA, 25 bp, Mus musculus
ttacagcagagtgcctgccgtgtgg

SEQ ID NO: 491805 - DNA, 25 bp, Mus musculus
ttacagcccagttatgcttgtggcc

SEQ ID NO: 491806 - DNA, 25 bp, Mus musculus
ttacagcgcgagagagcatctggct

SEQ ID NO: 491807 - DNA, 25 bp, Mus musculus
ttacagcgttgcatgtcacccagtg

SEQ ID NO: 491808 - DNA, 25 bp, Mus musculus
ttacagctaaggaaagcccctccag

SEQ ID NO: 491809 - DNA, 25 bp, Mus musculus
ttacagctctggagggacgagacac

SEQ ID NO: 491810 - DNA, 25 bp, Mus musculus
ttacagctgatcatagaaggttgag

SEQ ID NO: 491811 - DNA, 25 bp, Mus musculus
ttacaggaaaacaggcagctctctc

SEQ ID NO: 491812 - DNA, 25 bp, Mus musculus
ttacaggaacctgaaactccccagg

SEQ ID NO: 491813 - DNA, 25 bp, Mus musculus
ttacaggcgggcttaagtggctggc

SEQ ID NO: 491814 - DNA, 25 bp, Mus musculus
ttacaggctgatactctccgggcag

SEQ ID NO: 491815 - DNA, 25 bp, Mus musculus
ttacagggtctgtggagtaccagcc

SEQ ID NO: 491816 - DNA, 25 bp, Mus musculus
ttacagggtgttcctccagaggcaa

SEQ ID NO: 491817 - DNA, 25 bp, Mus musculus
ttacaggtcagctaagggcacgtcg

SEQ ID NO: 491818 - DNA, 25 bp, Mus musculus
ttacaggtgctagcgaaagactgct

SEQ ID NO: 491819 - DNA, 25 bp, Mus musculus
ttacagtcctaaatgcaagccccag

SEQ ID NO: 491820 - DNA, 25 bp, Mus musculus
ttacagtcctgtcggcagtgtctgg

SEQ ID NO: 491821 - DNA, 25 bp, Mus musculus
ttacagttggaacgagtcgcaggcc

SEQ ID NO: 491822 - DNA, 25 bp, Mus musculus
ttacagttgtgatcctaccccaggg

SEQ ID NO: 491823 - DNA, 25 bp, Mus musculus
ttacataaagcgattccgggcgggc

SEQ ID NO: 491824 - DNA, 25 bp, Mus musculus
ttacatacaacatgccacagtgtgc

SEQ ID NO: 491825 - DNA, 25 bp, Mus musculus
ttacatacactttagctgtgccagc

SEQ ID NO: 491826 - DNA, 25 bp, Mus musculus
ttacatagcggtgcaacggccgttc

SEQ ID NO: 491827 - DNA, 25 bp, Mus musculus
ttacatcgcacaaagcaaaacagct

SEQ ID NO: 491828 - DNA, 25 bp, Mus musculus
ttacatctcagaggctggcgatgga

SEQ ID NO: 491829 - DNA, 25 bp, Mus musculus
ttacattcagccttctccacaagag

SEQ ID NO: 491830 - DNA, 25 bp, Mus musculus
ttacattggtagaggaggactcaga

SEQ ID NO: 491831 - DNA, 25 bp, Mus musculus
ttacatttcagactcagtccgctag

SEQ ID NO: 491832 - DNA, 25 bp, Mus musculus
ttacatttggcttgcgggaagacgc

SEQ ID NO: 491833 - DNA, 25 bp, Mus musculus
ttacattttcagtgactcataagtc

SEQ ID NO: 491834 - DNA, 25 bp, Mus musculus
ttaccaactttgatgatggcaggcc

SEQ ID NO: 491835 - DNA, 25 bp, Mus musculus
ttaccaaggaagtggacatagcgcc

SEQ ID NO: 491836 - DNA, 25 bp, Mus musculus
ttaccaaggatctgaattttctctg

SEQ ID NO: 491837 - DNA, 25 bp, Mus musculus
ttaccacctgcctgggcatttggcc

SEQ ID NO: 491838 - DNA, 25 bp, Mus musculus
ttaccagacctgtgcacgacgcagc

SEQ ID NO: 491839 - DNA, 25 bp, Mus musculus
ttaccagctaagtgactgccacgcg

SEQ ID NO: 491840 - DNA, 25 bp, Mus musculus
ttaccaggacaccatgcggaacagc

SEQ ID NO: 491841 - DNA, 25 bp, Mus musculus
ttaccaggcaaaagctccgtgagcg

SEQ ID NO: 491842 - DNA, 25 bp, Mus musculus
ttaccatacaagcaaaagataagcg

SEQ ID NO: 491843 - DNA, 25 bp, Mus musculus
ttacccacaatgcagaggtccccag

SEQ ID NO: 491844 - DNA, 25 bp, Mus musculus
ttacccactcaaaaggcaagtggcc

SEQ ID NO: 491845 - DNA, 25 bp, Mus musculus
ttacccagaattcctagcctttgag

SEQ ID NO: 491846 - DNA, 25 bp, Mus musculus
ttacccagctccaatgtcctactag

SEQ ID NO: 491847 - DNA, 25 bp, Mus musculus
ttacccagtcgggacaaggcagaag

SEQ ID NO: 491848 - DNA, 25 bp, Mus musculus
ttacccatgccatgcaaacacaagg

SEQ ID NO: 491849 - DNA, 25 bp, Mus musculus
ttacccgagctgttttgggaacact

SEQ ID NO: 491850 - DNA, 25 bp, Mus musculus
ttacccgcaagtcctggctgtggca

SEQ ID NO: 491851 - DNA, 25 bp, Mus musculus
ttacccggaagcgtatgtgccagac

SEQ ID NO: 491852 - DNA, 25 bp, Mus musculus
ttacccggatgagagctgagagcac

SEQ ID NO: 491853 - DNA, 25 bp, Mus musculus
ttaccctgctactcgcgggagcggc

SEQ ID NO: 491854 - DNA, 25 bp, Mus musculus
ttaccctggagaacacacgcgtggt

SEQ ID NO: 491855 - DNA, 25 bp, Mus musculus
ttaccctggtgagcaccggagggca

SEQ ID NO: 491856 - DNA, 25 bp, Mus musculus
ttaccgaagtgcatgtttgggattt

SEQ ID NO: 491857 - DNA, 25 bp, Mus musculus
ttaccgagggtttgagagccttgcc

SEQ ID NO: 491858 - DNA, 25 bp, Mus musculus
ttaccgagtggaacagtgatgagca

SEQ ID NO: 491859 - DNA, 25 bp, Mus musculus
ttaccgcaacggctcagaagatggc

SEQ ID NO: 491860 - DNA, 25 bp, Mus musculus
ttaccgcagccaagacatgtctagc

SEQ ID NO: 491861 - DNA, 25 bp, Mus musculus
ttaccgccaacgacaagggagcaag

SEQ ID NO: 491862 - DNA, 25 bp, Mus musculus
ttaccgccatgccttcggacttctt

SEQ ID NO: 491863 - DNA, 25 bp, Mus musculus
ttaccgccgaatgggaagacctgat

SEQ ID NO: 491864 - DNA, 25 bp, Mus musculus
ttaccggagagccatgtagagccag

SEQ ID NO: 491865 - DNA, 25 bp, Mus musculus
ttaccgtggcaacggaaggctccag

SEQ ID NO: 491866 - DNA, 25 bp, Mus musculus
ttacctcagccccttcagtactagg

SEQ ID NO: 491867 - DNA, 25 bp, Mus musculus
ttacctcgaggtgagaagcccaacc

SEQ ID NO: 491868 - DNA, 25 bp, Mus musculus
ttacctcgctaaatccggccacaaa

SEQ ID NO: 491869 - DNA, 25 bp, Mus musculus
ttacctcggttaacaagatttgtag

SEQ ID NO: 491870 - DNA, 25 bp, Mus musculus
ttacctgaagtaccagcgtgtgccc

SEQ ID NO: 491871 - DNA, 25 bp, Mus musculus
ttacctgatgttgcgtccacctgag

SEQ ID NO: 491872 - DNA, 25 bp, Mus musculus
ttacctgggaaagctcaaggactcc

SEQ ID NO: 491873 - DNA, 25 bp, Mus musculus
ttacctggtggtcctttaccttcag

SEQ ID NO: 491874 - DNA, 25 bp, Mus musculus
ttacctgtacaattggaagtgcccg

SEQ ID NO: 491875 - DNA, 25 bp, Mus musculus
ttacctgtagcacccggaagtagcc

SEQ ID NO: 491876 - DNA, 25 bp, Mus musculus
ttaccttagtaggaggcaggcccca

SEQ ID NO: 491877 - DNA, 25 bp, Mus musculus
ttacgaaccccgagggatgctcact

SEQ ID NO: 491878 - DNA, 25 bp, Mus musculus
ttacgatggcaacagcagagagctc

SEQ ID NO: 491879 - DNA, 25 bp, Mus musculus
ttacggcagaacctggaagctcccg

SEQ ID NO: 491880 - DNA, 25 bp, Mus musculus
ttacggcgcttacggctacggctac

SEQ ID NO: 491881 - DNA, 25 bp, Mus musculus
ttacggctccaagaatgcactcgag

SEQ ID NO: 491882 - DNA, 25 bp, Mus musculus
ttacggctctcttccagttgtcaca

SEQ ID NO: 491883 - DNA, 25 bp, Mus musculus
ttacgggccggcaacaaagaagcca

SEQ ID NO: 491884 - DNA, 25 bp, Mus musculus
ttacgtaagctctcagcatgcccca

SEQ ID NO: 491885 - DNA, 25 bp, Mus musculus
ttacgtcaggcctggacaaccatgg

SEQ ID NO: 491886 - DNA, 25 bp, Mus musculus
ttacgtgatcactggaggtaatcag

SEQ ID NO: 491887 - DNA, 25 bp, Mus musculus
ttacgtgccaaccatcgagaggagc

SEQ ID NO: 491888 - DNA, 25 bp, Mus musculus
ttactaaactgaatttctgggtggg

SEQ ID NO: 491889 - DNA, 25 bp, Mus musculus
ttactacacagcagagcttttacta

SEQ ID NO: 491890 - DNA, 25 bp, Mus musculus
ttactaccgcaacgtgcatgccgtg

SEQ ID NO: 491891 - DNA, 25 bp, Mus musculus
ttactactgtctcccgggctgggcg

SEQ ID NO: 491892 - DNA, 25 bp, Mus musculus
ttactagtaacaggagactgcagca

SEQ ID NO: 491893 - DNA, 25 bp, Mus musculus
ttactccaggtgtttactgtactgc

SEQ ID NO: 491894 - DNA, 25 bp, Mus musculus
ttactccgggtgactgtggaccaca

SEQ ID NO: 491895 - DNA, 25 bp, Mus musculus
ttactcctgcacgacctggtgtgac

SEQ ID NO: 491896 - DNA, 25 bp, Mus musculus
ttactcgccgagcagtgggaacaga

SEQ ID NO: 491897 - DNA, 25 bp, Mus musculus
ttactctcggtcttccagcctgcag

SEQ ID NO: 491898 - DNA, 25 bp, Mus musculus
ttactctggagattctggaccgccg

SEQ ID NO: 491899 - DNA, 25 bp, Mus musculus
ttactctttttctctagcctttcct

SEQ ID NO: 491900 - DNA, 25 bp, Mus musculus
ttactgacccatattggtttgaaga

SEQ ID NO: 491901 - DNA, 25 bp, Mus musculus
ttactgatgttcgtgctggctgccc

SEQ ID NO: 491902 - DNA, 25 bp, Mus musculus
ttactgcataactcctccacttgtg

SEQ ID NO: 491903 - DNA, 25 bp, Mus musculus
ttactgcgagacaacgtggacctgc

SEQ ID NO: 491904 - DNA, 25 bp, Mus musculus
ttactgcgggagaggactggcactc

SEQ ID NO: 491905 - DNA, 25 bp, Mus musculus
ttactgctggaaggttatctttgtc

SEQ ID NO: 491906 - DNA, 25 bp, Mus musculus
ttactggagacatgccgtggcctgg

SEQ ID NO: 491907 - DNA, 25 bp, Mus musculus
ttactggagtcacagaacctctgcc

SEQ ID NO: 491908 - DNA, 25 bp, Mus musculus
ttactggatgaacccgaaaacctgg

SEQ ID NO: 491909 - DNA, 25 bp, Mus musculus
ttactggtggctgaacgctctgtcc

SEQ ID NO: 491910 - DNA, 25 bp, Mus musculus
ttactggtgtgaagcaatgactgcc

SEQ ID NO: 491911 - DNA, 25 bp, Mus musculus
ttactgtagccagtgccataaacag

SEQ ID NO: 491912 - DNA, 25 bp, Mus musculus
ttactgtgaggctggttggcatggc

SEQ ID NO: 491913 - DNA, 25 bp, Mus musculus
ttacttagataggacagggcagccc

SEQ ID NO: 491914 - DNA, 25 bp, Mus musculus
ttacttaggagtgctctactttgaa

SEQ ID NO: 491915 - DNA, 25 bp, Mus musculus
ttacttcaatggcactggcaccgtg

SEQ ID NO: 491916 - DNA, 25 bp, Mus musculus
ttacttcaccgagctgaaggatgac

SEQ ID NO: 491917 - DNA, 25 bp, Mus musculus
ttacttcagagctggccaatgcccg

SEQ ID NO: 491918 - DNA, 25 bp, Mus musculus
ttacttgctgttatggtgctcttcc

SEQ ID NO: 491919 - DNA, 25 bp, Mus musculus
ttacttggcttaacgttgtgtgagc

SEQ ID NO: 491920 - DNA, 25 bp, Mus musculus
ttactttgaagaccggcaggagccc

SEQ ID NO: 491921 - DNA, 25 bp, Mus musculus
ttagaaataagatgccacacagggc

SEQ ID NO: 491922 - DNA, 25 bp, Mus musculus
ttagaaccatggctgtaacgtggcg

SEQ ID NO: 491923 - DNA, 25 bp, Mus musculus
ttagaaccttatggcggtgcgtgcg

SEQ ID NO: 491924 - DNA, 25 bp, Mus musculus
ttagaactcatcaacacctgggtgg

SEQ ID NO: 491925 - DNA, 25 bp, Mus musculus
ttagaactggaggtgctaggaactg

SEQ ID NO: 491926 - DNA, 25 bp, Mus musculus
ttagaagaaattgccatcactgtgg

SEQ ID NO: 491927 - DNA, 25 bp, Mus musculus
ttagaagctggatcagggactggat

SEQ ID NO: 491928 - DNA, 25 bp, Mus musculus
ttagaaggaagcacatggaagtcaa

SEQ ID NO: 491929 - DNA, 25 bp, Mus musculus
ttagaagtcctcagcatacactgtg

SEQ ID NO: 491930 - DNA, 25 bp, Mus musculus
ttagaataaccacaaagccaagagc

SEQ ID NO: 491931 - DNA, 25 bp, Mus musculus
ttagaatacaacgagcagaaggctg

SEQ ID NO: 491932 - DNA, 25 bp, Mus musculus
ttagacaaacctctggaggcagcat

SEQ ID NO: 491933 - DNA, 25 bp, Mus musculus
ttagacaagccactcttcgaccagg

SEQ ID NO: 491934 - DNA, 25 bp, Mus musculus
ttagacagcgcgaaagagttgtggt

SEQ ID NO: 491935 - DNA, 25 bp, Mus musculus
ttagaccagaggaggatagacttct

SEQ ID NO: 491936 - DNA, 25 bp, Mus musculus
ttagaccccaggagtgatgaggccg

SEQ ID NO: 491937 - DNA, 25 bp, Mus musculus
ttagacccccttgcctgtttgtttg

SEQ ID NO: 491938 - DNA, 25 bp, Mus musculus
ttagaccgcgaggaagaagccgttc

SEQ ID NO: 491939 - DNA, 25 bp, Mus musculus
ttagacctctacttggacttgcttc

SEQ ID NO: 491940 - DNA, 25 bp, Mus musculus
ttagacctgccacaacacatcctgt

SEQ ID NO: 491941 - DNA, 25 bp, Mus musculus
ttagacctggaatgccccgaagagg

SEQ ID NO: 491942 - DNA, 25 bp, Mus musculus
ttagacgacatcaaacaattctgtg

SEQ ID NO: 491943 - DNA, 25 bp, Mus musculus
ttagactccgtgcagagcagcaggt

SEQ ID NO: 491944 - DNA, 25 bp, Mus musculus
ttagactggtttttcatcaggaaag

SEQ ID NO: 491945 - DNA, 25 bp, Mus musculus
ttagagaactggctgtacctggtcc

SEQ ID NO: 491946 - DNA, 25 bp, Mus musculus
ttagagaagccacgagagactcacg

SEQ ID NO: 491947 - DNA, 25 bp, Mus musculus
ttagagaagtccactgatcccgcag

SEQ ID NO: 491948 - DNA, 25 bp, Mus musculus
ttagagacctacagagcaggccacg

SEQ ID NO: 491949 - DNA, 25 bp, Mus musculus
ttagagactctagcctcggatccca

SEQ ID NO: 491950 - DNA, 25 bp, Mus musculus
ttagagagacacacatcaggagctg

SEQ ID NO: 491951 - DNA, 25 bp, Mus musculus
ttagagatggcaaccatggaggccc

SEQ ID NO: 491952 - DNA, 25 bp, Mus musculus
ttagagctggaaggtgcagcgtttc

SEQ ID NO: 491953 - DNA, 25 bp, Mus musculus
ttagaggaactgaccgagctgcctg

SEQ ID NO: 491954 - DNA, 25 bp, Mus musculus
ttagaggacaattaactgctcagcc

SEQ ID NO: 491955 - DNA, 25 bp, Mus musculus
ttagaggacgcccttcaggcaacga

SEQ ID NO: 491956 - DNA, 25 bp, Mus musculus
ttagaggatacccacatgccagtcc

SEQ ID NO: 491957 - DNA, 25 bp, Mus musculus
ttagaggctccatcttcaacaccgt

SEQ ID NO: 491958 - DNA, 25 bp, Mus musculus
ttagagggcctgtaagaaagaagag

SEQ ID NO: 491959 - DNA, 25 bp, Mus musculus
ttagaggtacccacaaattgccccg

SEQ ID NO: 491960 - DNA, 25 bp, Mus musculus
ttagaggtgaacacacaaccagggc

SEQ ID NO: 491961 - DNA, 25 bp, Mus musculus
ttagaggttcctgaagaatttggcc

SEQ ID NO: 491962 - DNA, 25 bp, Mus musculus
ttagaggtttagagaacaacgggct

SEQ ID NO: 491963 - DNA, 25 bp, Mus musculus
ttagagtccaagtctttagcagtgg

SEQ ID NO: 491964 - DNA, 25 bp, Mus musculus
ttagagtccccgtgtcagagaagct

SEQ ID NO: 491965 - DNA, 25 bp, Mus musculus
ttagagtgattttgaacatgacacc

SEQ ID NO: 491966 - DNA, 25 bp, Mus musculus
ttagagtgctttcccagcaggcagc

SEQ ID NO: 491967 - DNA, 25 bp, Mus musculus
ttagagttgaatccatgagagagtc

SEQ ID NO: 491968 - DNA, 25 bp, Mus musculus
ttagatagatgtgcaggccatgggc

SEQ ID NO: 491969 - DNA, 25 bp, Mus musculus
ttagatatgaaagacatacaacatg

SEQ ID NO: 491970 - DNA, 25 bp, Mus musculus
ttagatatgctgaccccgactgaga

SEQ ID NO: 491971 - DNA, 25 bp, Mus musculus
ttagatcacagcttttaaggacggg

SEQ ID NO: 491972 - DNA, 25 bp, Mus musculus
ttagatccggagctcactctccaga

SEQ ID NO: 491973 - DNA, 25 bp, Mus musculus
ttagatcctgggtgaaagcttccca

SEQ ID NO: 491974 - DNA, 25 bp, Mus musculus
ttagatgagcctggagatactgcct

SEQ ID NO: 491975 - DNA, 25 bp, Mus musculus
ttagatggatctccccaagagaaga

SEQ ID NO: 491976 - DNA, 25 bp, Mus musculus
ttagatgtcccaagctggtccccag

SEQ ID NO: 491977 - DNA, 25 bp, Mus musculus
ttagattagccttgtttagagaaac

SEQ ID NO: 491978 - DNA, 25 bp, Mus musculus
ttagattcccggcacagaccttggt

SEQ ID NO: 491979 - DNA, 25 bp, Mus musculus
ttagattcctcccagtgcgtgacgg

SEQ ID NO: 491980 - DNA, 25 bp, Mus musculus
ttagcaaaggaactggtacgtatca

SEQ ID NO: 491981 - DNA, 25 bp, Mus musculus
ttagcaacaaaaggtcacaagcagt

SEQ ID NO: 491982 - DNA, 25 bp, Mus musculus
ttagcaaccacgcagaaattccgga

SEQ ID NO: 491983 - DNA, 25 bp, Mus musculus
ttagcaactacaactctgcagcctg

SEQ ID NO: 491984 - DNA, 25 bp, Mus musculus
ttagcaagaagcaggagctcctccg

SEQ ID NO: 491985 - DNA, 25 bp, Mus musculus
ttagcaagtccaagagaaagcccac

SEQ ID NO: 491986 - DNA, 25 bp, Mus musculus
ttagcaagtgaacttccatgtctgc

SEQ ID NO: 491987 - DNA, 25 bp, Mus musculus
ttagcacatttaggccacaggctgg

SEQ ID NO: 491988 - DNA, 25 bp, Mus musculus
ttagcaccctgaaaaaagaatcgag

SEQ ID NO: 491989 - DNA, 25 bp, Mus musculus
ttagcaccgaagtacctgcgaccgt

SEQ ID NO: 491990 - DNA, 25 bp, Mus musculus
ttagcactgacagggtacccgaggc

SEQ ID NO: 491991 - DNA, 25 bp, Mus musculus
ttagcagccgcggtgcttcaggtgc

SEQ ID NO: 491992 - DNA, 25 bp, Mus musculus
ttagcaggacgaatgggagaagcca

SEQ ID NO: 491993 - DNA, 25 bp, Mus musculus
ttagcaggctacctaccctgtgcgg

SEQ ID NO: 491994 - DNA, 25 bp, Mus musculus
ttagcagtactaaacccgtcaggca

SEQ ID NO: 491995 - DNA, 25 bp, Mus musculus
ttagcatcaagaaccaatggagttt

SEQ ID NO: 491996 - DNA, 25 bp, Mus musculus
ttagccagaggatcgtgtaacggac

SEQ ID NO: 491997 - DNA, 25 bp, Mus musculus
ttagccaggccggaagtggagaccc

SEQ ID NO: 491998 - DNA, 25 bp, Mus musculus
ttagccatacaagggaagttgccag

SEQ ID NO: 491999 - DNA, 25 bp, Mus musculus
ttagcccacctacagggaggctcct

SEQ ID NO: 492000 - DNA, 25 bp, Mus musculus
ttagcccagtaagggaagatgcgcc

SEQ ID NO: 492001 - DNA, 25 bp, Mus musculus
ttagcccggcttgtcttggaactca

SEQ ID NO: 492002 - DNA, 25 bp, Mus musculus
ttagccctgggaagacctcatgcca

SEQ ID NO: 492003 - DNA, 25 bp, Mus musculus
ttagccgagagagtgcagaagacct

SEQ ID NO: 492004 - DNA, 25 bp, Mus musculus
ttagccgagctaagaagaccattgg

SEQ ID NO: 492005 - DNA, 25 bp, Mus musculus
ttagccgggaatccgaagcacctca

SEQ ID NO: 492006 - DNA, 25 bp, Mus musculus
ttagcctaaggacccctgggacagt

SEQ ID NO: 492007 - DNA, 25 bp, Mus musculus
ttagcctcaagtgaaactgactggg

SEQ ID NO: 492008 - DNA, 25 bp, Mus musculus
ttagccttcaagacgggccttcggg

SEQ ID NO: 492009 - DNA, 25 bp, Mus musculus
ttagccttgtgagggatggaattac

SEQ ID NO: 492010 - DNA, 25 bp, Mus musculus
ttagcgcagggtgggctcgcgcctt

SEQ ID NO: 492011 - DNA, 25 bp, Mus musculus
ttagcgcccgactctgtgaacattt

SEQ ID NO: 492012 - DNA, 25 bp, Mus musculus
ttagcgcctagactactatcagagc

SEQ ID NO: 492013 - DNA, 25 bp, Mus musculus
ttagcgctgaccttagacctcgtag

SEQ ID NO: 492014 - DNA, 25 bp, Mus musculus
ttagcggaagcagacaagacggacg

SEQ ID NO: 492015 - DNA, 25 bp, Mus musculus
ttagcggtatacagcaagatgcagg

SEQ ID NO: 492016 - DNA, 25 bp, Mus musculus
ttagcgtgatgtgcaagttcctatg

SEQ ID NO: 492017 - DNA, 25 bp, Mus musculus
ttagcgtgcatctacccaagtggta

SEQ ID NO: 492018 - DNA, 25 bp, Mus musculus
ttagcgttggaatgtgctgctgtct

SEQ ID NO: 492019 - DNA, 25 bp, Mus musculus
ttagctagcagagggaaaaatcccc

SEQ ID NO: 492020 - DNA, 25 bp, Mus musculus
ttagctagctagtttgtaatttccc

SEQ ID NO: 492021 - DNA, 25 bp, Mus musculus
ttagctaggctcttaaagggatctg

SEQ ID NO: 492022 - DNA, 25 bp, Mus musculus
ttagctcaccagtgggcgccgcagg

SEQ ID NO: 492023 - DNA, 25 bp, Mus musculus
ttagctccacagcaatgagtgctcc

SEQ ID NO: 492024 - DNA, 25 bp, Mus musculus
ttagctccatgtcgcctcgtgctcg

SEQ ID NO: 492025 - DNA, 25 bp, Mus musculus
ttagctcccgagaaagtgtgccaga

SEQ ID NO: 492026 - DNA, 25 bp, Mus musculus
ttagctgcctctctttgcttctagg

SEQ ID NO: 492027 - DNA, 25 bp, Mus musculus
ttagctggccgagctagagtcccag

SEQ ID NO: 492028 - DNA, 25 bp, Mus musculus
ttagctgtggatgagagcggcctct

SEQ ID NO: 492029 - DNA, 25 bp, Mus musculus
ttagcttaaacaatctgttcgtggg

SEQ ID NO: 492030 - DNA, 25 bp, Mus musculus
ttagcttcccgttttgcttcaaggc

SEQ ID NO: 492031 - DNA, 25 bp, Mus musculus
ttagcttctacaccaaagggcgggc

SEQ ID NO: 492032 - DNA, 25 bp, Mus musculus
ttaggaaaagatgactcctggttgg

SEQ ID NO: 492033 - DNA, 25 bp, Mus musculus
ttaggaaagccttctctgagcccgc

SEQ ID NO: 492034 - DNA, 25 bp, Mus musculus
ttaggaacagacaacgggcctgggc

SEQ ID NO: 492035 - DNA, 25 bp, Mus musculus
ttaggaagtcaggacgcaactgggc

SEQ ID NO: 492036 - DNA, 25 bp, Mus musculus
ttaggaatacagtccaggcaggctg

SEQ ID NO: 492037 - DNA, 25 bp, Mus musculus
ttaggaatactaaccatagcttggt

SEQ ID NO: 492038 - DNA, 25 bp, Mus musculus
ttaggaatcagcatcgtgggcggca

SEQ ID NO: 492039 - DNA, 25 bp, Mus musculus
ttaggagggcacttataaatggcac

SEQ ID NO: 492040 - DNA, 25 bp, Mus musculus
ttaggagtgtctgattgaaaaacca

SEQ ID NO: 492041 - DNA, 25 bp, Mus musculus
ttaggcagcggagtatccacctcag

SEQ ID NO: 492042 - DNA, 25 bp, Mus musculus
ttaggccgcttttcccagggacaag

SEQ ID NO: 492043 - DNA, 25 bp, Mus musculus
ttaggcctaagaaaccccaggtcag

SEQ ID NO: 492044 - DNA, 25 bp, Mus musculus
ttaggcctttctgaccctgtgtggg

SEQ ID NO: 492045 - DNA, 25 bp, Mus musculus
ttaggctacccatctgacactgcag

SEQ ID NO: 492046 - DNA, 25 bp, Mus musculus
ttagggactctagctgaggcagcca

SEQ ID NO: 492047 - DNA, 25 bp, Mus musculus
ttagggcagcgctcttagaagacag

SEQ ID NO: 492048 - DNA, 25 bp, Mus musculus
ttagggcataatcaaaacaccgctg

SEQ ID NO: 492049 - DNA, 25 bp, Mus musculus
ttagggcccaaggagacaatgagag

SEQ ID NO: 492050 - DNA, 25 bp, Mus musculus
ttagggctcagtagtgcaggatgca

SEQ ID NO: 492051 - DNA, 25 bp, Mus musculus
ttagggtctaggtgggcatgacccc

SEQ ID NO: 492052 - DNA, 25 bp, Mus musculus
ttagggtctccgacagggcttcctg

SEQ ID NO: 492053 - DNA, 25 bp, Mus musculus
ttaggtagccaggtatgggagctca

SEQ ID NO: 492054 - DNA, 25 bp, Mus musculus
ttaggtcaaaaagctctacccaggc

SEQ ID NO: 492055 - DNA, 25 bp, Mus musculus
ttaggtcccaccagcaacagtagca

SEQ ID NO: 492056 - DNA, 25 bp, Mus musculus
ttaggtcccggatacaggcggtgac

SEQ ID NO: 492057 - DNA, 25 bp, Mus musculus
ttaggtcgagcagagccaaagcccc

SEQ ID NO: 492058 - DNA, 25 bp, Mus musculus
ttaggtgaaggaacacgctccatgc

SEQ ID NO: 492059 - DNA, 25 bp, Mus musculus
ttaggtgacgtgtagccctcttccg

SEQ ID NO: 492060 - DNA, 25 bp, Mus musculus
ttaggtgcagtcagtgaaaggtgat

SEQ ID NO: 492061 - DNA, 25 bp, Mus musculus
ttaggttcgccttcacacagctgtg

SEQ ID NO: 492062 - DNA, 25 bp, Mus musculus
ttaggttttcggtactcagtcaagg

SEQ ID NO: 492063 - DNA, 25 bp, Mus musculus
ttagtaccgaagtctgaatgcccag

SEQ ID NO: 492064 - DNA, 25 bp, Mus musculus
ttagtaccgtcctgtctcaggcagg

SEQ ID NO: 492065 - DNA, 25 bp, Mus musculus
ttagtagctctcttccccaagcagg

SEQ ID NO: 492066 - DNA, 25 bp, Mus musculus
ttagtagggcagaagagcacatggc

SEQ ID NO: 492067 - DNA, 25 bp, Mus musculus
ttagtagtccaagcatgagccccag

SEQ ID NO: 492068 - DNA, 25 bp, Mus musculus
ttagtatgcacgagcgtgggtttga

SEQ ID NO: 492069 - DNA, 25 bp, Mus musculus
ttagtatggtggtcttggcccctcc

SEQ ID NO: 492070 - DNA, 25 bp, Mus musculus
ttagtcactcctggttaattagcca

SEQ ID NO: 492071 - DNA, 25 bp, Mus musculus
ttagtcagtgatactgtagctctga

SEQ ID NO: 492072 - DNA, 25 bp, Mus musculus
ttagtccagtctcacagggcgcttg

SEQ ID NO: 492073 - DNA, 25 bp, Mus musculus
ttagtcctaagaagtagtgtcaggg

SEQ ID NO: 492074 - DNA, 25 bp, Mus musculus
ttagtcctggttaatgcagacagac

SEQ ID NO: 492075 - DNA, 25 bp, Mus musculus
ttagtcggatcacgctggatgccca

SEQ ID NO: 492076 - DNA, 25 bp, Mus musculus
ttagtcttcctgttactccctgtca

SEQ ID NO: 492077 - DNA, 25 bp, Mus musculus
ttagtgaccactccagacatcctgg

SEQ ID NO: 492078 - DNA, 25 bp, Mus musculus
ttagtgaccatggaagcgagagaga

SEQ ID NO: 492079 - DNA, 25 bp, Mus musculus
ttagtggccccaggttaaacatatt

SEQ ID NO: 492080 - DNA, 25 bp, Mus musculus
ttagtgggccgtgtcctgcatttca

SEQ ID NO: 492081 - DNA, 25 bp, Mus musculus
ttagtgtgcaatacgctcagcggcc

SEQ ID NO: 492082 - DNA, 25 bp, Mus musculus
ttagtgtgcaggcttttccaacggc

SEQ ID NO: 492083 - DNA, 25 bp, Mus musculus
ttagtgtgcccaagaagagtgtatg

SEQ ID NO: 492084 - DNA, 25 bp, Mus musculus
ttagtgtgtctagggcagagccaga

SEQ ID NO: 492085 - DNA, 25 bp, Mus musculus
ttagtgttccaactgccagctccca

SEQ ID NO: 492086 - DNA, 25 bp, Mus musculus
ttagttatctaagccatccgaggtc

SEQ ID NO: 492087 - DNA, 25 bp, Mus musculus
ttagttctgtgtctccgccgagacg

SEQ ID NO: 492088 - DNA, 25 bp, Mus musculus
ttagttggagacttgtgccgagccc

SEQ ID NO: 492089 - DNA, 25 bp, Mus musculus
ttagtttgcttttctcgttacagta

SEQ ID NO: 492090 - DNA, 25 bp, Mus musculus
ttataaaacggccaaggcagctcga

SEQ ID NO: 492091 - DNA, 25 bp, Mus musculus
ttataaacactcatggcccctgggc

SEQ ID NO: 492092 - DNA, 25 bp, Mus musculus
ttataaacttcaaaatggcatcctc

SEQ ID NO: 492093 - DNA, 25 bp, Mus musculus
ttataacagtgaaaacctacccatg

SEQ ID NO: 492094 - DNA, 25 bp, Mus musculus
ttataaccgtctggatgaatctgtc

SEQ ID NO: 492095 - DNA, 25 bp, Mus musculus
ttataacctcgcaagctgcctgcac

SEQ ID NO: 492096 - DNA, 25 bp, Mus musculus
ttataactgggcaaaccaagtcggt

SEQ ID NO: 492097 - DNA, 25 bp, Mus musculus
ttataagaccatcgaggagctccgg

SEQ ID NO: 492098 - DNA, 25 bp, Mus musculus
ttataagagttgctgaagcacggtg

SEQ ID NO: 492099 - DNA, 25 bp, Mus musculus
ttataagatgactggaagccctgca

SEQ ID NO: 492100 - DNA, 25 bp, Mus musculus
ttataagatgcagattgaatttggc

SEQ ID NO: 492101 - DNA, 25 bp, Mus musculus
ttataagggcaaatggaagcctcca

SEQ ID NO: 492102 - DNA, 25 bp, Mus musculus
ttatacaaaggtactggaacaaaag

SEQ ID NO: 492103 - DNA, 25 bp, Mus musculus
ttatacagctgtcccttgactcact

SEQ ID NO: 492104 - DNA, 25 bp, Mus musculus
ttataccagaagatgaagtccactc

SEQ ID NO: 492105 - DNA, 25 bp, Mus musculus
ttatacgcctgtggactctctggtg

SEQ ID NO: 492106 - DNA, 25 bp, Mus musculus
ttatacggaagacgacctaatgctg

SEQ ID NO: 492107 - DNA, 25 bp, Mus musculus
ttatactcattggacatcatttcag

SEQ ID NO: 492108 - DNA, 25 bp, Mus musculus
ttatacttttaattaggtgccagcg

SEQ ID NO: 492109 - DNA, 25 bp, Mus musculus
ttatagaataaagggagatccaagc

SEQ ID NO: 492110 - DNA, 25 bp, Mus musculus
ttatagactggaccgagggcatagc

SEQ ID NO: 492111 - DNA, 25 bp, Mus musculus
ttatagatgacagccgaacacgagg

SEQ ID NO: 492112 - DNA, 25 bp, Mus musculus
ttatagcagcgccttaaagcctagg

SEQ ID NO: 492113 - DNA, 25 bp, Mus musculus
ttatagcagtcatgagctgctcaac

SEQ ID NO: 492114 - DNA, 25 bp, Mus musculus
ttatagcgtaagtgcaatgcctgcc

SEQ ID NO: 492115 - DNA, 25 bp, Mus musculus
ttatagtcactgagggtgaaccctg

SEQ ID NO: 492116 - DNA, 25 bp, Mus musculus
ttatagtcctcatggccacgggtgg

SEQ ID NO: 492117 - DNA, 25 bp, Mus musculus
ttatagtggcacagaggaggtcgcc

SEQ ID NO: 492118 - DNA, 25 bp, Mus musculus
ttatatcatgacaacgccggaagag

SEQ ID NO: 492119 - DNA, 25 bp, Mus musculus
ttatatggagcttagacccagccag

SEQ ID NO: 492120 - DNA, 25 bp, Mus musculus
ttatatgggccatacctatggaggg

SEQ ID NO: 492121 - DNA, 25 bp, Mus musculus
ttatatggtaatgccagcagcgagc

SEQ ID NO: 492122 - DNA, 25 bp, Mus musculus
ttatattcgtgaaacaagcatgtct

SEQ ID NO: 492123 - DNA, 25 bp, Mus musculus
ttatatttggatctcccgggcagct

SEQ ID NO: 492124 - DNA, 25 bp, Mus musculus
ttatcaaaagcaaacccaggagcag

SEQ ID NO: 492125 - DNA, 25 bp, Mus musculus
ttatcaaaagccagaaccgtccgca

SEQ ID NO: 492126 - DNA, 25 bp, Mus musculus
ttatcaaaaggcatccaccccgaag

SEQ ID NO: 492127 - DNA, 25 bp, Mus musculus
ttatcaaataatcaggacccctgtg

SEQ ID NO: 492128 - DNA, 25 bp, Mus musculus
ttatcaacccgctggacttcgaggc

SEQ ID NO: 492129 - DNA, 25 bp, Mus musculus
ttatcaagcggcgttccaccagtgt

SEQ ID NO: 492130 - DNA, 25 bp, Mus musculus
ttatcacaaccacgtaaacacaggg

SEQ ID NO: 492131 - DNA, 25 bp, Mus musculus
ttatcacccggctggaccaggtgcg

SEQ ID NO: 492132 - DNA, 25 bp, Mus musculus
ttatcagactctgcacggaaggccc

SEQ ID NO: 492133 - DNA, 25 bp, Mus musculus
ttatcagcaaggtggtaccagcccc

SEQ ID NO: 492134 - DNA, 25 bp, Mus musculus
ttatcagcaggattacacagggcct

SEQ ID NO: 492135 - DNA, 25 bp, Mus musculus
ttatcaggatggtctagaagccctc

SEQ ID NO: 492136 - DNA, 25 bp, Mus musculus
ttatcagttcttcctgcggttcggg

SEQ ID NO: 492137 - DNA, 25 bp, Mus musculus
ttatcataggtcattaaaggctgcc

SEQ ID NO: 492138 - DNA, 25 bp, Mus musculus
ttatcatcataccaagacgcagagc

SEQ ID NO: 492139 - DNA, 25 bp, Mus musculus
ttatcatgtcagaaaacgatctttg

SEQ ID NO: 492140 - DNA, 25 bp, Mus musculus
ttatccaaaacctgggcggccagcg

SEQ ID NO: 492141 - DNA, 25 bp, Mus musculus
ttatccagcacctgaacaatggccg

SEQ ID NO: 492142 - DNA, 25 bp, Mus musculus
ttatcccagccaaacgactcggttg

SEQ ID NO: 492143 - DNA, 25 bp, Mus musculus
ttatccccgggcacaggggttgttg

SEQ ID NO: 492144 - DNA, 25 bp, Mus musculus
ttatcccctttggagacatcacaga

SEQ ID NO: 492145 - DNA, 25 bp, Mus musculus
ttatcccgggcctcgcgtgtagctt

SEQ ID NO: 492146 - DNA, 25 bp, Mus musculus
ttatccgagggtgctgagagctgcc

SEQ ID NO: 492147 - DNA, 25 bp, Mus musculus
ttatccgcaagagtgcaagctcccg

SEQ ID NO: 492148 - DNA, 25 bp, Mus musculus
ttatccgtcacaatccaacccagag

SEQ ID NO: 492149 - DNA, 25 bp, Mus musculus
ttatcctacagccatcttgttcttc

SEQ ID NO: 492150 - DNA, 25 bp, Mus musculus
ttatcgacaagcaaagctgcaggcc

SEQ ID NO: 492151 - DNA, 25 bp, Mus musculus
ttatcgaccgccacaaacagctgcg

SEQ ID NO: 492152 - DNA, 25 bp, Mus musculus
ttatcgacctgacggagaactgcag

SEQ ID NO: 492153 - DNA, 25 bp, Mus musculus
ttatcgacgtgaagccaaaggacct

SEQ ID NO: 492154 - DNA, 25 bp, Mus musculus
ttatcgattaattgggcaacgcccc

SEQ ID NO: 492155 - DNA, 25 bp, Mus musculus
ttatcggcgcaggaagaggaagccc

SEQ ID NO: 492156 - DNA, 25 bp, Mus musculus
ttatcgggacagaccgcgtagcctg

SEQ ID NO: 492157 - DNA, 25 bp, Mus musculus
ttatcgtgacagatgggaggccgca

SEQ ID NO: 492158 - DNA, 25 bp, Mus musculus
ttatcgtgaggagaagcgcctggac

SEQ ID NO: 492159 - DNA, 25 bp, Mus musculus
ttatctatctgcaggctgaacccag

SEQ ID NO: 492160 - DNA, 25 bp, Mus musculus
ttatctccacgaaatcacgggctgg

SEQ ID NO: 492161 - DNA, 25 bp, Mus musculus
ttatctcccagctgcatagacattc

SEQ ID NO: 492162 - DNA, 25 bp, Mus musculus
ttatctctacgctttgtattctgca

SEQ ID NO: 492163 - DNA, 25 bp, Mus musculus
ttatctgcaataccagcaacctggg

SEQ ID NO: 492164 - DNA, 25 bp, Mus musculus
ttatctgcgagagacaacgccacag

SEQ ID NO: 492165 - DNA, 25 bp, Mus musculus
ttatctggacatgggatccaagcca

SEQ ID NO: 492166 - DNA, 25 bp, Mus musculus
ttatctgtaacatcgaaggccgccc

SEQ ID NO: 492167 - DNA, 25 bp, Mus musculus
ttatctgtagtgagatccgacgccc

SEQ ID NO: 492168 - DNA, 25 bp, Mus musculus
ttatctgtggaccaacgtgcctcgg

SEQ ID NO: 492169 - DNA, 25 bp, Mus musculus
ttatcttcctgaaccagcttcctgg

SEQ ID NO: 492170 - DNA, 25 bp, Mus musculus
ttatcttgaagatgctgcccagtgc

SEQ ID NO: 492171 - DNA, 25 bp, Mus musculus
ttatcttttagcacgcatttttgtt

SEQ ID NO: 492172 - DNA, 25 bp, Mus musculus
ttatgaaattaagcccaagagcccc

SEQ ID NO: 492173 - DNA, 25 bp, Mus musculus
ttatgacatagacccaaacgccggg

SEQ ID NO: 492174 - DNA, 25 bp, Mus musculus
ttatgacatcatcgcctgggactgg

SEQ ID NO: 492175 - DNA, 25 bp, Mus musculus
ttatgactgcccaagcgcggccggg

SEQ ID NO: 492176 - DNA, 25 bp, Mus musculus
ttatgagaacccaggtgtaccgccc

SEQ ID NO: 492177 - DNA, 25 bp, Mus musculus
ttatgagatgctcaccaacccggtg

SEQ ID NO: 492178 - DNA, 25 bp, Mus musculus
ttatgagtatcgagaagaggtccac

SEQ ID NO: 492179 - DNA, 25 bp, Mus musculus
ttatgagtgtttgcgttcgtgtcca

SEQ ID NO: 492180 - DNA, 25 bp, Mus musculus
ttatgataatagctacgtgacccca

SEQ ID NO: 492181 - DNA, 25 bp, Mus musculus
ttatgatagaggtacgaacctggac

SEQ ID NO: 492182 - DNA, 25 bp, Mus musculus
ttatgatctagaacagtaaatactg

SEQ ID NO: 492183 - DNA, 25 bp, Mus musculus
ttatgatgaggaacaagagcagggc

SEQ ID NO: 492184 - DNA, 25 bp, Mus musculus
ttatgatgccggcaaagccctgcag

SEQ ID NO: 492185 - DNA, 25 bp, Mus musculus
ttatgattacgtgcctgctgagcca

SEQ ID NO: 492186 - DNA, 25 bp, Mus musculus
ttatgattcccagcagaccaacgac

SEQ ID NO: 492187 - DNA, 25 bp, Mus musculus
ttatgcaaagcacggaacgagagat

SEQ ID NO: 492188 - DNA, 25 bp, Mus musculus
ttatgcaacagtgtccctcgtgggc

SEQ ID NO: 492189 - DNA, 25 bp, Mus musculus
ttatgcacaggaggcaagcacagat

SEQ ID NO: 492190 - DNA, 25 bp, Mus musculus
ttatgccacactcgaaaagctgatg

SEQ ID NO: 492191 - DNA, 25 bp, Mus musculus
ttatgccacattgcgggacctgaag

SEQ ID NO: 492192 - DNA, 25 bp, Mus musculus
ttatgcccagcgtagagaaggagcg

SEQ ID NO: 492193 - DNA, 25 bp, Mus musculus
ttatgcctatgaaacaaatgctttg

SEQ ID NO: 492194 - DNA, 25 bp, Mus musculus
ttatgcctctctaaaggctggaggg

SEQ ID NO: 492195 - DNA, 25 bp, Mus musculus
ttatgcctggcaactggtgtccgag

SEQ ID NO: 492196 - DNA, 25 bp, Mus musculus
ttatgcggagagattcccacacccg

SEQ ID NO: 492197 - DNA, 25 bp, Mus musculus
ttatgctaaaacttgcagtctggca

SEQ ID NO: 492198 - DNA, 25 bp, Mus musculus
ttatgctataatcggaggctccttg

SEQ ID NO: 492199 - DNA, 25 bp, Mus musculus
ttatgctcagaccaaaacctcagtg

SEQ ID NO: 492200 - DNA, 25 bp, Mus musculus
ttatgctgaacggtaccaaacgccc

SEQ ID NO: 492201 - DNA, 25 bp, Mus musculus
ttatgctgcatggaaaactgaaggg

SEQ ID NO: 492202 - DNA, 25 bp, Mus musculus
ttatggaaagcgagggtacccgcca

SEQ ID NO: 492203 - DNA, 25 bp, Mus musculus
ttatggaagaagtattgctcctggg

SEQ ID NO: 492204 - DNA, 25 bp, Mus musculus
ttatggaatgaaggcatggctcccc

SEQ ID NO: 492205 - DNA, 25 bp, Mus musculus
ttatggagaaattggtgccacttcc

SEQ ID NO: 492206 - DNA, 25 bp, Mus musculus
ttatggccaaagcaatagccgaccg

SEQ ID NO: 492207 - DNA, 25 bp, Mus musculus
ttatggcgtccatccagtaccgcag

SEQ ID NO: 492208 - DNA, 25 bp, Mus musculus
ttatgggcagggacaaatcggccac

SEQ ID NO: 492209 - DNA, 25 bp, Mus musculus
ttatgggcatggactcagcgaggac

SEQ ID NO: 492210 - DNA, 25 bp, Mus musculus
ttatggtaccagacagcacagctca

SEQ ID NO: 492211 - DNA, 25 bp, Mus musculus
ttatggtgctttgagcccctgggcc

SEQ ID NO: 492212 - DNA, 25 bp, Mus musculus
ttatggtggaacagcaaccggtgcc

SEQ ID NO: 492213 - DNA, 25 bp, Mus musculus
ttatggtgtacgaggtacctgggca

SEQ ID NO: 492214 - DNA, 25 bp, Mus musculus
ttatggtttgattactaagagaccc

SEQ ID NO: 492215 - DNA, 25 bp, Mus musculus
ttatgtaaacatcctggatctaggg

SEQ ID NO: 492216 - DNA, 25 bp, Mus musculus
ttatgtacaaagttgcagggccagc

SEQ ID NO: 492217 - DNA, 25 bp, Mus musculus
ttatgtagcaacatcttaggagacc

SEQ ID NO: 492218 - DNA, 25 bp, Mus musculus
ttatgtatgggataccatcttgttt

SEQ ID NO: 492219 - DNA, 25 bp, Mus musculus
ttatgtcagacatggtctcgtgtgg

SEQ ID NO: 492220 - DNA, 25 bp, Mus musculus
ttatgtccgggagtaaaggtggcca

SEQ ID NO: 492221 - DNA, 25 bp, Mus musculus
ttatgtcgcgagtactttgccaggg

SEQ ID NO: 492222 - DNA, 25 bp, Mus musculus
ttatgtgagtagaggcccgatcgcc

SEQ ID NO: 492223 - DNA, 25 bp, Mus musculus
ttatgtgcctgccaagcagtgagca

SEQ ID NO: 492224 - DNA, 25 bp, Mus musculus
ttatgtgggcaattctgagtactct

SEQ ID NO: 492225 - DNA, 25 bp, Mus musculus
ttatgtgtccaaactgggcagccgg

SEQ ID NO: 492226 - DNA, 25 bp, Mus musculus
ttatgtgtctcagtgacctctcggg

SEQ ID NO: 492227 - DNA, 25 bp, Mus musculus
ttatgttagtatgcacgagcgtggg

SEQ ID NO: 492228 - DNA, 25 bp, Mus musculus
ttatgtttcatctgaccccggtgtc

SEQ ID NO: 492229 - DNA, 25 bp, Mus musculus
ttattaaccccgacgacaggcaagg

SEQ ID NO: 492230 - DNA, 25 bp, Mus musculus
ttattaagccgcagctgtggtcctg

SEQ ID NO: 492231 - DNA, 25 bp, Mus musculus
ttattaatgctaagggctggcccag

SEQ ID NO: 492232 - DNA, 25 bp, Mus musculus
ttattacaacctagagctgccctgc

SEQ ID NO: 492233 - DNA, 25 bp, Mus musculus
ttattacataaaagacaagcctggc

SEQ ID NO: 492234 - DNA, 25 bp, Mus musculus
ttattacgccgcagaccctcagact

SEQ ID NO: 492235 - DNA, 25 bp, Mus musculus
ttattactcatggaggaacccaggg

SEQ ID NO: 492236 - DNA, 25 bp, Mus musculus
ttattactgaagctacggagtgctc

SEQ ID NO: 492237 - DNA, 25 bp, Mus musculus
ttattagcacagaagtagggttcct

SEQ ID NO: 492238 - DNA, 25 bp, Mus musculus
ttattatcctccatcagtacagccc

SEQ ID NO: 492239 - DNA, 25 bp, Mus musculus
ttattatgacgaagtggaggctgag

SEQ ID NO: 492240 - DNA, 25 bp, Mus musculus
ttattatggccctcagtgcaggcgg

SEQ ID NO: 492241 - DNA, 25 bp, Mus musculus
ttattcacactttacaacgggtggg

SEQ ID NO: 492242 - DNA, 25 bp, Mus musculus
ttattccagtctgtaatctctggaa

SEQ ID NO: 492243 - DNA, 25 bp, Mus musculus
ttattccgagctgggagagctccct

SEQ ID NO: 492244 - DNA, 25 bp, Mus musculus
ttattctaacccagactgagcatca

SEQ ID NO: 492245 - DNA, 25 bp, Mus musculus
ttattctgatgaacccggagggccg

SEQ ID NO: 492246 - DNA, 25 bp, Mus musculus
ttattctgggaaccttgggccgcca

SEQ ID NO: 492247 - DNA, 25 bp, Mus musculus
ttattgaagaaatcgaacgcctcgg

SEQ ID NO: 492248 - DNA, 25 bp, Mus musculus
ttattgaccaatcaaaactgcatgc

SEQ ID NO: 492249 - DNA, 25 bp, Mus musculus
ttattgagaccagacccctaagcct

SEQ ID NO: 492250 - DNA, 25 bp, Mus musculus
ttattgagaccttagtccctgaagt

SEQ ID NO: 492251 - DNA, 25 bp, Mus musculus
ttattgatatccctcctgtgcccag

SEQ ID NO: 492252 - DNA, 25 bp, Mus musculus
ttattgcccagcttgagaatgtcct

SEQ ID NO: 492253 - DNA, 25 bp, Mus musculus
ttattgcctgtgagaatggtttgcc

SEQ ID NO: 492254 - DNA, 25 bp, Mus musculus
ttattgctgtgcgtcgttccctacg

SEQ ID NO: 492255 - DNA, 25 bp, Mus musculus
ttattggaaaagtttcctcctcaga

SEQ ID NO: 492256 - DNA, 25 bp, Mus musculus
ttattggcggagttcccagcaacgg

SEQ ID NO: 492257 - DNA, 25 bp, Mus musculus
ttattgggaagaacctcaccccagg

SEQ ID NO: 492258 - DNA, 25 bp, Mus musculus
ttattgtgtctctgcacctgggcta

SEQ ID NO: 492259 - DNA, 25 bp, Mus musculus
ttatttattgctgcatgcctgccgg

SEQ ID NO: 492260 - DNA, 25 bp, Mus musculus
ttatttattttggagctgccccgcc

SEQ ID NO: 492261 - DNA, 25 bp, Mus musculus
ttatttcagcatagagcaagctgcg

SEQ ID NO: 492262 - DNA, 25 bp, Mus musculus
ttatttccaggagccaatgcgagac

SEQ ID NO: 492263 - DNA, 25 bp, Mus musculus
ttatttctgtcctgctccacttggg

SEQ ID NO: 492264 - DNA, 25 bp, Mus musculus
ttatttgactatggcactaaccacc

SEQ ID NO: 492265 - DNA, 25 bp, Mus musculus
ttatttgctgcatgggagcccacag

SEQ ID NO: 492266 - DNA, 25 bp, Mus musculus
ttattttcatcatctgtggaccagg

SEQ ID NO: 492267 - DNA, 25 bp, Mus musculus
ttattttggaatggagcccacccag

SEQ ID NO: 492268 - DNA, 25 bp, Mus musculus
ttatttttgcctgaggacctcccgc

SEQ ID NO: 492269 - DNA, 25 bp, Mus musculus
ttcaaaaagccacattgcagtctga

SEQ ID NO: 492270 - DNA, 25 bp, Mus musculus
ttcaaaatagcacaccaagggatca

SEQ ID NO: 492271 - DNA, 25 bp, Mus musculus
ttcaaaattctgtcattagccgggt

SEQ ID NO: 492272 - DNA, 25 bp, Mus musculus
ttcaaaccccgaaaacagcgaagag

SEQ ID NO: 492273 - DNA, 25 bp, Mus musculus
ttcaaaccgacgcacgctgctgggc

SEQ ID NO: 492274 - DNA, 25 bp, Mus musculus
ttcaaacctggtagccaaggcccag

SEQ ID NO: 492275 - DNA, 25 bp, Mus musculus
ttcaaacgcaccagacaaaggaggg

SEQ ID NO: 492276 - DNA, 25 bp, Mus musculus
ttcaaagagtctggctgcaagcaca

SEQ ID NO: 492277 - DNA, 25 bp, Mus musculus
ttcaaagcaagcagggtagagcggc

SEQ ID NO: 492278 - DNA, 25 bp, Mus musculus
ttcaaaggcataaagtccgtgactg

SEQ ID NO: 492279 - DNA, 25 bp, Mus musculus
ttcaaaggcctttccgtcgctgggt

SEQ ID NO: 492280 - DNA, 25 bp, Mus musculus
ttcaaaggcgatgaaggagctcact

SEQ ID NO: 492281 - DNA, 25 bp, Mus musculus
ttcaaaggcggtgacgggtctcact

SEQ ID NO: 492282 - DNA, 25 bp, Mus musculus
ttcaaagtcatgctcccagtggccc

SEQ ID NO: 492283 - DNA, 25 bp, Mus musculus
ttcaaagtcctaaaacgcgcggccg

SEQ ID NO: 492284 - DNA, 25 bp, Mus musculus
ttcaaattggccttctgcacaccgg

SEQ ID NO: 492285 - DNA, 25 bp, Mus musculus
ttcaaattgtgaagaacccacggtc

SEQ ID NO: 492286 - DNA, 25 bp, Mus musculus
ttcaacacacatcagggaaggcccc

SEQ ID NO: 492287 - DNA, 25 bp, Mus musculus
ttcaacacaggataattcacacagg

SEQ ID NO: 492288 - DNA, 25 bp, Mus musculus
ttcaacacagtcgagaaaaagcact

SEQ ID NO: 492289 - DNA, 25 bp, Mus musculus
ttcaacacatgtgcttgcctccagg

SEQ ID NO: 492290 - DNA, 25 bp, Mus musculus
ttcaacatgatgtccccaacgggtg

SEQ ID NO: 492291 - DNA, 25 bp, Mus musculus
ttcaacatgtacgaccaggacggcg

SEQ ID NO: 492292 - DNA, 25 bp, Mus musculus
ttcaacccaaatgaggtggccccta

SEQ ID NO: 492293 - DNA, 25 bp, Mus musculus
ttcaacctatcggaactgcgccagg

SEQ ID NO: 492294 - DNA, 25 bp, Mus musculus
ttcaacgacctggaggtgcctcggg

SEQ ID NO: 492295 - DNA, 25 bp, Mus musculus
ttcaacgatgcttgcagggaccctc

SEQ ID NO: 492296 - DNA, 25 bp, Mus musculus
ttcaacggcgtggacttcgagggca

SEQ ID NO: 492297 - DNA, 25 bp, Mus musculus
ttcaacgttccatgctgcctggtgc

SEQ ID NO: 492298 - DNA, 25 bp, Mus musculus
ttcaactggcgctccatcaagcagc

SEQ ID NO: 492299 - DNA, 25 bp, Mus musculus
ttcaactgtgcctgagtcctgctcg

SEQ ID NO: 492300 - DNA, 25 bp, Mus musculus
ttcaacttcaacaaactggtgctgg

SEQ ID NO: 492301 - DNA, 25 bp, Mus musculus
ttcaactttgcaggacagatcccgg

SEQ ID NO: 492302 - DNA, 25 bp, Mus musculus
ttcaagaaaatttcccggctggctg

SEQ ID NO: 492303 - DNA, 25 bp, Mus musculus
ttcaagaacaagataagccaaagct

SEQ ID NO: 492304 - DNA, 25 bp, Mus musculus
ttcaagaacgaagaaggcatgagct

SEQ ID NO: 492305 - DNA, 25 bp, Mus musculus
ttcaagaagacgagatacgggagcc

SEQ ID NO: 492306 - DNA, 25 bp, Mus musculus
ttcaagacacagaagctccaggcac

SEQ ID NO: 492307 - DNA, 25 bp, Mus musculus
ttcaagacctctgggcagtggcagg

SEQ ID NO: 492308 - DNA, 25 bp, Mus musculus
ttcaagacgaaaaccaacagcacgt

SEQ ID NO: 492309 - DNA, 25 bp, Mus musculus
ttcaagacggagaacaggctgtgca

SEQ ID NO: 492310 - DNA, 25 bp, Mus musculus
ttcaagagcagatgcggagaacgca

SEQ ID NO: 492311 - DNA, 25 bp, Mus musculus
ttcaagatcatcacagaggtccagc

SEQ ID NO: 492312 - DNA, 25 bp, Mus musculus
ttcaagatcgcagtaatgttgggtc

SEQ ID NO: 492313 - DNA, 25 bp, Mus musculus
ttcaagatgccgtacctcaggatgg

SEQ ID NO: 492314 - DNA, 25 bp, Mus musculus
ttcaagatggcgagaaagtcctact

SEQ ID NO: 492315 - DNA, 25 bp, Mus musculus
ttcaagcacatgagccacggaggac

SEQ ID NO: 492316 - DNA, 25 bp, Mus musculus
ttcaagcacgacaaactgagccggt

SEQ ID NO: 492317 - DNA, 25 bp, Mus musculus
ttcaagcagcttctcatgacccagg

SEQ ID NO: 492318 - DNA, 25 bp, Mus musculus
ttcaagcaggaaagggatggacacc

SEQ ID NO: 492319 - DNA, 25 bp, Mus musculus
ttcaagcaggtttgtccaggaatac

SEQ ID NO: 492320 - DNA, 25 bp, Mus musculus
ttcaagcagtagacaagcagcatcc

SEQ ID NO: 492321 - DNA, 25 bp, Mus musculus
ttcaagcataccacgagggcaacgg

SEQ ID NO: 492322 - DNA, 25 bp, Mus musculus
ttcaagccctatgcatggagcggtc

SEQ ID NO: 492323 - DNA, 25 bp, Mus musculus
ttcaagcctactgggatcgagggcc

SEQ ID NO: 492324 - DNA, 25 bp, Mus musculus
ttcaagcgcagcgtgcggaggaacc

SEQ ID NO: 492325 - DNA, 25 bp, Mus musculus
ttcaagcgtgatgcgcaaggccagc

SEQ ID NO: 492326 - DNA, 25 bp, Mus musculus
ttcaagctcacacaagccagtgggt

SEQ ID NO: 492327 - DNA, 25 bp, Mus musculus
ttcaagctgaagcactacgggcctg

SEQ ID NO: 492328 - DNA, 25 bp, Mus musculus
ttcaagctggcctcaacacttgcag

SEQ ID NO: 492329 - DNA, 25 bp, Mus musculus
ttcaaggacaagacgttgccaggcc

SEQ ID NO: 492330 - DNA, 25 bp, Mus musculus
ttcaaggactgagcgccagccgcgt

SEQ ID NO: 492331 - DNA, 25 bp, Mus musculus
ttcaaggagcctagccagagtctgc

SEQ ID NO: 492332 - DNA, 25 bp, Mus musculus
ttcaaggagctcaaactgactgact

SEQ ID NO: 492333 - DNA, 25 bp, Mus musculus
ttcaaggcacggacagatgaggagc

SEQ ID NO: 492334 - DNA, 25 bp, Mus musculus
ttcaaggcagatcaggcaaaggcaa

SEQ ID NO: 492335 - DNA, 25 bp, Mus musculus
ttcaaggccgtgttcgcagagttcc

SEQ ID NO: 492336 - DNA, 25 bp, Mus musculus
ttcaaggcgcacagaatgcgcacgg

SEQ ID NO: 492337 - DNA, 25 bp, Mus musculus
ttcaaggctggctgggcacaaaagt

SEQ ID NO: 492338 - DNA, 25 bp, Mus musculus
ttcaagggatagaatagaaacgacc

SEQ ID NO: 492339 - DNA, 25 bp, Mus musculus
ttcaagggcacctatggcagccacg

SEQ ID NO: 492340 - DNA, 25 bp, Mus musculus
ttcaagggtgtgagaacatgtgccc

SEQ ID NO: 492341 - DNA, 25 bp, Mus musculus
ttcaaggtcaacacagagctcaaga

SEQ ID NO: 492342 - DNA, 25 bp, Mus musculus
ttcaaggtcaccctacagccgtagg

SEQ ID NO: 492343 - DNA, 25 bp, Mus musculus
ttcaaggtgtacatgggccacggcg

SEQ ID NO: 492344 - DNA, 25 bp, Mus musculus
ttcaagtactccagttcagacccac

SEQ ID NO: 492345 - DNA, 25 bp, Mus musculus
ttcaagtactgtgccagcctgcgga

SEQ ID NO: 492346 - DNA, 25 bp, Mus musculus
ttcaagtctgtcttcgaggtggcct

SEQ ID NO: 492347 - DNA, 25 bp, Mus musculus
ttcaagtgaataaaagcataggctc

SEQ ID NO: 492348 - DNA, 25 bp, Mus musculus
ttcaagtgtaagatctgcggccggg

SEQ ID NO: 492349 - DNA, 25 bp, Mus musculus
ttcaataccttccactactgtagac

SEQ ID NO: 492350 - DNA, 25 bp, Mus musculus
ttcaatatcctgacagcctgccggc

SEQ ID NO: 492351 - DNA, 25 bp, Mus musculus
ttcaatcacctagagctgcacgagc

SEQ ID NO: 492352 - DNA, 25 bp, Mus musculus
ttcaatcagatggtaaaacggccag

SEQ ID NO: 492353 - DNA, 25 bp, Mus musculus
ttcaatcccgggagaatatcctggt

SEQ ID NO: 492354 - DNA, 25 bp, Mus musculus
ttcaatctcaatgggctcgcaggca

SEQ ID NO: 492355 - DNA, 25 bp, Mus musculus
ttcaatgaaagttcctagagcaggc

SEQ ID NO: 492356 - DNA, 25 bp, Mus musculus
ttcaatgagataggaaacctgggcc

SEQ ID NO: 492357 - DNA, 25 bp, Mus musculus
ttcaatgcaggagatggtgtttccc

SEQ ID NO: 492358 - DNA, 25 bp, Mus musculus
ttcaatggctgggagatcagatcca

SEQ ID NO: 492359 - DNA, 25 bp, Mus musculus
ttcaatgtaagcaggcggtttggct

SEQ ID NO: 492360 - DNA, 25 bp, Mus musculus
ttcaattatgaacgccaggagacgc

SEQ ID NO: 492361 - DNA, 25 bp, Mus musculus
ttcaatttatttccctgtgatcagc

SEQ ID NO: 492362 - DNA, 25 bp, Mus musculus
ttcacaagagaattagcccgtcgct

SEQ ID NO: 492363 - DNA, 25 bp, Mus musculus
ttcacaagtgaagcagtagtcccag

SEQ ID NO: 492364 - DNA, 25 bp, Mus musculus
ttcacaatggaagcaaagcctggcc

SEQ ID NO: 492365 - DNA, 25 bp, Mus musculus
ttcacaattggagaaaacagggctc

SEQ ID NO: 492366 - DNA, 25 bp, Mus musculus
ttcacacacggaccagagctggagg

SEQ ID NO: 492367 - DNA, 25 bp, Mus musculus
ttcacaccagcagacacagtggcta

SEQ ID NO: 492368 - DNA, 25 bp, Mus musculus
ttcacacccgggaagccacacaatg

SEQ ID NO: 492369 - DNA, 25 bp, Mus musculus
ttcacacctgcatctcagtaggagg

SEQ ID NO: 492370 - DNA, 25 bp, Mus musculus
ttcacactgaacttggagggaggcc

SEQ ID NO: 492371 - DNA, 25 bp, Mus musculus
ttcacactgggtccaagcaatgctc

SEQ ID NO: 492372 - DNA, 25 bp, Mus musculus
ttcacagaagaacaaggcttcaggg

SEQ ID NO: 492373 - DNA, 25 bp, Mus musculus
ttcacagaagaccaaacggatgcga

SEQ ID NO: 492374 - DNA, 25 bp, Mus musculus
ttcacagacagaacactggcctggg

SEQ ID NO: 492375 - DNA, 25 bp, Mus musculus
ttcacagacagctacagggacgact

SEQ ID NO: 492376 - DNA, 25 bp, Mus musculus
ttcacagcaaatgatgacacctcag

SEQ ID NO: 492377 - DNA, 25 bp, Mus musculus
ttcacaggcggacccgatgctgtct

SEQ ID NO: 492378 - DNA, 25 bp, Mus musculus
ttcacagggaaacgtacttactctc

SEQ ID NO: 492379 - DNA, 25 bp, Mus musculus
ttcacaggtctatgtacagaaaata

SEQ ID NO: 492380 - DNA, 25 bp, Mus musculus
ttcacaggtctggagggcataccac

SEQ ID NO: 492381 - DNA, 25 bp, Mus musculus
ttcacagtggcaggagccaaaaccg

SEQ ID NO: 492382 - DNA, 25 bp, Mus musculus
ttcacatgcaaagtagggaccgggt

SEQ ID NO: 492383 - DNA, 25 bp, Mus musculus
ttcacatggctagtcctacagagag

SEQ ID NO: 492384 - DNA, 25 bp, Mus musculus
ttcacattggaaacggcagcacgga

SEQ ID NO: 492385 - DNA, 25 bp, Mus musculus
ttcacattggcatcagacagacagg

SEQ ID NO: 492386 - DNA, 25 bp, Mus musculus
ttcaccaaaggacggcatgtactcg

SEQ ID NO: 492387 - DNA, 25 bp, Mus musculus
ttcaccacgggatcagatgacgcca

SEQ ID NO: 492388 - DNA, 25 bp, Mus musculus
ttcaccatggaaggcgttcgagcag

SEQ ID NO: 492389 - DNA, 25 bp, Mus musculus
ttcaccatgggacagcaaatttcgg

SEQ ID NO: 492390 - DNA, 25 bp, Mus musculus
ttcacccacaagcttagaaccattg

SEQ ID NO: 492391 - DNA, 25 bp, Mus musculus
ttcacccactgagttaccacttggg

SEQ ID NO: 492392 - DNA, 25 bp, Mus musculus
ttcacccgccaaactaaaggagagt

SEQ ID NO: 492393 - DNA, 25 bp, Mus musculus
ttcaccgaaatagacgaggccagcg

SEQ ID NO: 492394 - DNA, 25 bp, Mus musculus
ttcaccgcgattggaggcaacctgg

SEQ ID NO: 492395 - DNA, 25 bp, Mus musculus
ttcacctactgaagggagcgcgggc

SEQ ID NO: 492396 - DNA, 25 bp, Mus musculus
ttcacctccaattcaaaagatctgc

SEQ ID NO: 492397 - DNA, 25 bp, Mus musculus
ttcacctgccgcagcggcgagtgca

SEQ ID NO: 492398 - DNA, 25 bp, Mus musculus
ttcacctgggcacaacctggttcca

SEQ ID NO: 492399 - DNA, 25 bp, Mus musculus
ttcaccttcctcacaatggactggg

SEQ ID NO: 492400 - DNA, 25 bp, Mus musculus
ttcacgatgtggagcgagcagagca

SEQ ID NO: 492401 - DNA, 25 bp, Mus musculus
ttcacgccttcactctggtacacat

SEQ ID NO: 492402 - DNA, 25 bp, Mus musculus
ttcacgcgactgtggagacagccag

SEQ ID NO: 492403 - DNA, 25 bp, Mus musculus
ttcacgctgtactccctgatgcagg

SEQ ID NO: 492404 - DNA, 25 bp, Mus musculus
ttcacgtacaagacagaggccaagg

SEQ ID NO: 492405 - DNA, 25 bp, Mus musculus
ttcactaatagtggcaactttcgag

SEQ ID NO: 492406 - DNA, 25 bp, Mus musculus
ttcactacccgggagaagctgtcgc

SEQ ID NO: 492407 - DNA, 25 bp, Mus musculus
ttcactagactcaaagctggcccgg

SEQ ID NO: 492408 - DNA, 25 bp, Mus musculus
ttcactatcagcatggcaccgggca

SEQ ID NO: 492409 - DNA, 25 bp, Mus musculus
ttcactcacacttgcaccattcaga

SEQ ID NO: 492410 - DNA, 25 bp, Mus musculus
ttcactcggagacccatatgatggc

SEQ ID NO: 492411 - DNA, 25 bp, Mus musculus
ttcactcgtcttccgcgtgatttgc

SEQ ID NO: 492412 - DNA, 25 bp, Mus musculus
ttcactgaaccatcccgggtgggct

SEQ ID NO: 492413 - DNA, 25 bp, Mus musculus
ttcactgaaggcgagatcacgtctc

SEQ ID NO: 492414 - DNA, 25 bp, Mus musculus
ttcactgagtgcaccagcaacgtgg

SEQ ID NO: 492415 - DNA, 25 bp, Mus musculus
ttcactgctccgcttgcttctgagg

SEQ ID NO: 492416 - DNA, 25 bp, Mus musculus
ttcactggaggcacccttttagggc

SEQ ID NO: 492417 - DNA, 25 bp, Mus musculus
ttcactgtgggcgttgctgcgccac

SEQ ID NO: 492418 - DNA, 25 bp, Mus musculus
ttcactgtggtttggatataatccc

SEQ ID NO: 492419 - DNA, 25 bp, Mus musculus
ttcacttccgaaggctatgctcata

SEQ ID NO: 492420 - DNA, 25 bp, Mus musculus
ttcacttgcaaacatggctcagagc

SEQ ID NO: 492421 - DNA, 25 bp, Mus musculus
ttcacttggagacaaagcttgtgcc

SEQ ID NO: 492422 - DNA, 25 bp, Mus musculus
ttcactttggccaggaatctgggtg

SEQ ID NO: 492423 - DNA, 25 bp, Mus musculus
ttcacttttcttgggaacttggagg

SEQ ID NO: 492424 - DNA, 25 bp, Mus musculus
ttcagaaaaagatgacggtccggcc

SEQ ID NO: 492425 - DNA, 25 bp, Mus musculus
ttcagaaaatgaagcgccacaggcg

SEQ ID NO: 492426 - DNA, 25 bp, Mus musculus
ttcagaaaggtctggtagattcccc

SEQ ID NO: 492427 - DNA, 25 bp, Mus musculus
ttcagaaaggttgccggctctcacc

SEQ ID NO: 492428 - DNA, 25 bp, Mus musculus
ttcagaacataacctggccgcagtt

SEQ ID NO: 492429 - DNA, 25 bp, Mus musculus
ttcagaagaactgtgacattgtgac

SEQ ID NO: 492430 - DNA, 25 bp, Mus musculus
ttcagaagaccaaagtcgaggcccc

SEQ ID NO: 492431 - DNA, 25 bp, Mus musculus
ttcagaagctctgtgttaaaggagg

SEQ ID NO: 492432 - DNA, 25 bp, Mus musculus
ttcagaaggcaagcaggcgttcacc

SEQ ID NO: 492433 - DNA, 25 bp, Mus musculus
ttcagaaggctatcaacgaccggca

SEQ ID NO: 492434 - DNA, 25 bp, Mus musculus
ttcagaagtatgagaggcttacccc

SEQ ID NO: 492435 - DNA, 25 bp, Mus musculus
ttcagaatcataagcccctggaggg

SEQ ID NO: 492436 - DNA, 25 bp, Mus musculus
ttcagacacagacgacaatagggct

SEQ ID NO: 492437 - DNA, 25 bp, Mus musculus
ttcagacaccagagtggacgcgatc

SEQ ID NO: 492438 - DNA, 25 bp, Mus musculus
ttcagactcgacctcccaagtactg

SEQ ID NO: 492439 - DNA, 25 bp, Mus musculus
ttcagagacgaatgatcacagcccg

SEQ ID NO: 492440 - DNA, 25 bp, Mus musculus
ttcagagagttgttccggcctagct

SEQ ID NO: 492441 - DNA, 25 bp, Mus musculus
ttcagagcaacttggtggttcaccg

SEQ ID NO: 492442 - DNA, 25 bp, Mus musculus
ttcagagcagattcacagcccttcc

SEQ ID NO: 492443 - DNA, 25 bp, Mus musculus
ttcagagccagacatgatcaagcag

SEQ ID NO: 492444 - DNA, 25 bp, Mus musculus
ttcagagcccggtgggttcaagcca

SEQ ID NO: 492445 - DNA, 25 bp, Mus musculus
ttcagaggccccacttagcacaggg

SEQ ID NO: 492446 - DNA, 25 bp, Mus musculus
ttcagaggctgaacgcatggagctc

SEQ ID NO: 492447 - DNA, 25 bp, Mus musculus
ttcagaggttgaaaagcgacaagta

SEQ ID NO: 492448 - DNA, 25 bp, Mus musculus
ttcagagtcgtgtgcacaggcagcc

SEQ ID NO: 492449 - DNA, 25 bp, Mus musculus
ttcagagtgtgggaggaccttcaac

SEQ ID NO: 492450 - DNA, 25 bp, Mus musculus
ttcagatccccagcggacaaggttg

SEQ ID NO: 492451 - DNA, 25 bp, Mus musculus
ttcagatctcacagtgtccccatgg

SEQ ID NO: 492452 - DNA, 25 bp, Mus musculus
ttcagatgagaacacggaggaccct

SEQ ID NO: 492453 - DNA, 25 bp, Mus musculus
ttcagatgggaagtcacgtggccga

SEQ ID NO: 492454 - DNA, 25 bp, Mus musculus
ttcagatgtaagaagctgcgctccc

SEQ ID NO: 492455 - DNA, 25 bp, Mus musculus
ttcagcacggactatgagacgcacg

SEQ ID NO: 492456 - DNA, 25 bp, Mus musculus
ttcagcagagagtaatagagctcat

SEQ ID NO: 492457 - DNA, 25 bp, Mus musculus
ttcagcatcagtgtagtcccagcct

SEQ ID NO: 492458 - DNA, 25 bp, Mus musculus
ttcagccacaaaaccagcaacagct

SEQ ID NO: 492459 - DNA, 25 bp, Mus musculus
ttcagcccaggagtggaacgaagcc

SEQ ID NO: 492460 - DNA, 25 bp, Mus musculus
ttcagcccgagtgccgttatgatgg

SEQ ID NO: 492461 - DNA, 25 bp, Mus musculus
ttcagcctcagtaccctaaagacgg

SEQ ID NO: 492462 - DNA, 25 bp, Mus musculus
ttcagcctcgagaaaccacagagct

SEQ ID NO: 492463 - DNA, 25 bp, Mus musculus
ttcagcgaatacgtggagaccggga

SEQ ID NO: 492464 - DNA, 25 bp, Mus musculus
ttcagcgactccattcgttcctgct

SEQ ID NO: 492465 - DNA, 25 bp, Mus musculus
ttcagcggtggtaagctgcggttcc

SEQ ID NO: 492466 - DNA, 25 bp, Mus musculus
ttcagcgtgcttacagacggtaccg

SEQ ID NO: 492467 - DNA, 25 bp, Mus musculus
ttcagctcccagtggagcaacagcc

SEQ ID NO: 492468 - DNA, 25 bp, Mus musculus
ttcagctccccgtgtggagataagt

SEQ ID NO: 492469 - DNA, 25 bp, Mus musculus
ttcagctccctctgctagcaatctg

SEQ ID NO: 492470 - DNA, 25 bp, Mus musculus
ttcagctgtagcaaaatatgtggcc

SEQ ID NO: 492471 - DNA, 25 bp, Mus musculus
ttcagcttcctcaagcctctttggg

SEQ ID NO: 492472 - DNA, 25 bp, Mus musculus
ttcagcttgtacagccgagtccagg

SEQ ID NO: 492473 - DNA, 25 bp, Mus musculus
ttcaggaaacctctccttcacgtgt

SEQ ID NO: 492474 - DNA, 25 bp, Mus musculus
ttcaggaagccttcgggcttatctg

SEQ ID NO: 492475 - DNA, 25 bp, Mus musculus
ttcaggaccagtcagcaaaagctgt

SEQ ID NO: 492476 - DNA, 25 bp, Mus musculus
ttcaggaccctgcaaacactgtggg

SEQ ID NO: 492477 - DNA, 25 bp, Mus musculus
ttcaggacggcacgcagataaatcg

SEQ ID NO: 492478 - DNA, 25 bp, Mus musculus
ttcaggactttggtcacttcaggcc

SEQ ID NO: 492479 - DNA, 25 bp, Mus musculus
ttcaggagacgtcggaaccaggatc

SEQ ID NO: 492480 - DNA, 25 bp, Mus musculus
ttcaggaggcaatagcagacagagc

SEQ ID NO: 492481 - DNA, 25 bp, Mus musculus
ttcaggaggtaaactctacagtcag

SEQ ID NO: 492482 - DNA, 25 bp, Mus musculus
ttcaggatgcagagcgaggtaacgc

SEQ ID NO: 492483 - DNA, 25 bp, Mus musculus
ttcaggcaacattggcgaaggaccc

SEQ ID NO: 492484 - DNA, 25 bp, Mus musculus
ttcaggcaagtcacagtcctagggc

SEQ ID NO: 492485 - DNA, 25 bp, Mus musculus
ttcaggcagatggattggcagtcct

SEQ ID NO: 492486 - DNA, 25 bp, Mus musculus
ttcaggcagttgtcgctgggctcca

SEQ ID NO: 492487 - DNA, 25 bp, Mus musculus
ttcaggcccatggagattacaacgg

SEQ ID NO: 492488 - DNA, 25 bp, Mus musculus
ttcaggcgcagcattcggaagagtc

SEQ ID NO: 492489 - DNA, 25 bp, Mus musculus
ttcaggcgcgtctacaagaggccgc

SEQ ID NO: 492490 - DNA, 25 bp, Mus musculus
ttcaggctaccatggcactgctcag

SEQ ID NO: 492491 - DNA, 25 bp, Mus musculus
ttcaggctagttagtgcaggaccat

SEQ ID NO: 492492 - DNA, 25 bp, Mus musculus
ttcagggaaagggagacgcctgcct

SEQ ID NO: 492493 - DNA, 25 bp, Mus musculus
ttcagggaacgagcgagcacattct

SEQ ID NO: 492494 - DNA, 25 bp, Mus musculus
ttcagggccacgcactttgaccact

SEQ ID NO: 492495 - DNA, 25 bp, Mus musculus
ttcagggccctcgtttgccagcaaa

SEQ ID NO: 492496 - DNA, 25 bp, Mus musculus
ttcagggccctgaagaagactgctg

SEQ ID NO: 492497 - DNA, 25 bp, Mus musculus
ttcagggtgctgtgcgccggcggtc

SEQ ID NO: 492498 - DNA, 25 bp, Mus musculus
ttcagggtggacagagacggactcc

SEQ ID NO: 492499 - DNA, 25 bp, Mus musculus
ttcaggtactgggacattaggttct

SEQ ID NO: 492500 - DNA, 25 bp, Mus musculus
ttcagtaaggctgacatcaggagct

SEQ ID NO: 492501 - DNA, 25 bp, Mus musculus
ttcagtaataacatgggctcccgga

SEQ ID NO: 492502 - DNA, 25 bp, Mus musculus
ttcagtaccgcctgctagacaggaa

SEQ ID NO: 492503 - DNA, 25 bp, Mus musculus
ttcagtacctggtgggcgacaagcg

SEQ ID NO: 492504 - DNA, 25 bp, Mus musculus
ttcagtaggacagagtgatttgggc

SEQ ID NO: 492505 - DNA, 25 bp, Mus musculus
ttcagtatgaaagcagcgagccagc

SEQ ID NO: 492506 - DNA, 25 bp, Mus musculus
ttcagtcaactggtgggcatccctt

SEQ ID NO: 492507 - DNA, 25 bp, Mus musculus
ttcagtcaagaccaagagaggaccc

SEQ ID NO: 492508 - DNA, 25 bp, Mus musculus
ttcagtcaccagctagagcgcagct

SEQ ID NO: 492509 - DNA, 25 bp, Mus musculus
ttcagtccagcaagagcgaggtcac

SEQ ID NO: 492510 - DNA, 25 bp, Mus musculus
ttcagtccagtgtgagatcagcctg

SEQ ID NO: 492511 - DNA, 25 bp, Mus musculus
ttcagtgacccaagatagcctagtc

SEQ ID NO: 492512 - DNA, 25 bp, Mus musculus
ttcagtgatccagtccctcatggcg

SEQ ID NO: 492513 - DNA, 25 bp, Mus musculus
ttcagtgcgccccaggaattgaact

SEQ ID NO: 492514 - DNA, 25 bp, Mus musculus
ttcagtgtcagtccccaaatcagtg

SEQ ID NO: 492515 - DNA, 25 bp, Mus musculus
ttcagtgtccggtggtcgaagcctc

SEQ ID NO: 492516 - DNA, 25 bp, Mus musculus
ttcagtgtgatgaccccaagccagt

SEQ ID NO: 492517 - DNA, 25 bp, Mus musculus
ttcagtgttcctcataggcacaggg

SEQ ID NO: 492518 - DNA, 25 bp, Mus musculus
ttcagttaagagatagagatcatcc

SEQ ID NO: 492519 - DNA, 25 bp, Mus musculus
ttcagttggctgcagaaggctctcc

SEQ ID NO: 492520 - DNA, 25 bp, Mus musculus
ttcataaagagagggacaagagctg

SEQ ID NO: 492521 - DNA, 25 bp, Mus musculus
ttcataaaggcaggccagaggccca

SEQ ID NO: 492522 - DNA, 25 bp, Mus musculus
ttcataacaaatcagactgccaggg

SEQ ID NO: 492523 - DNA, 25 bp, Mus musculus
ttcataactgaatgtcccgcaacag

SEQ ID NO: 492524 - DNA, 25 bp, Mus musculus
ttcataatgtagaaggaagccttgc

SEQ ID NO: 492525 - DNA, 25 bp, Mus musculus
ttcataattatctctagggagaaaa

SEQ ID NO: 492526 - DNA, 25 bp, Mus musculus
ttcatactgacaaaatccccaagga

SEQ ID NO: 492527 - DNA, 25 bp, Mus musculus
ttcatagctctaggccatctcctgg

SEQ ID NO: 492528 - DNA, 25 bp, Mus musculus
ttcatataggaagcacgcactgccc

SEQ ID NO: 492529 - DNA, 25 bp, Mus musculus
ttcatatcagcacggtgggtcctcc

SEQ ID NO: 492530 - DNA, 25 bp, Mus musculus
ttcatcaaattagaccagaagctag

SEQ ID NO: 492531 - DNA, 25 bp, Mus musculus
ttcatcaacccctattgagcagtcc

SEQ ID NO: 492532 - DNA, 25 bp, Mus musculus
ttcatcaagcaaggccggaagctgg

SEQ ID NO: 492533 - DNA, 25 bp, Mus musculus
ttcatcactgtggacgccgtcggtt

SEQ ID NO: 492534 - DNA, 25 bp, Mus musculus
ttcatcaggaatcgcctcaagaggg

SEQ ID NO: 492535 - DNA, 25 bp, Mus musculus
ttcatcatatacagacgcacgcgtc

SEQ ID NO: 492536 - DNA, 25 bp, Mus musculus
ttcatcatcttcagccagcgtcggg

SEQ ID NO: 492537 - DNA, 25 bp, Mus musculus
ttcatcatggtatcccctacgctga

SEQ ID NO: 492538 - DNA, 25 bp, Mus musculus
ttcatccaaagaaagctcctctcca

SEQ ID NO: 492539 - DNA, 25 bp, Mus musculus
ttcatcccaggacaagagtgctacc

SEQ ID NO: 492540 - DNA, 25 bp, Mus musculus
ttcatccgcaagaggaacgagcgag

SEQ ID NO: 492541 - DNA, 25 bp, Mus musculus
ttcatcctcagtgtgcccgggaact

SEQ ID NO: 492542 - DNA, 25 bp, Mus musculus
ttcatcgagcacttcgcgcagctgg

SEQ ID NO: 492543 - DNA, 25 bp, Mus musculus
ttcatcgcgctcgtcagcctgtggg

SEQ ID NO: 492544 - DNA, 25 bp, Mus musculus
ttcatcggccgctatgtcctgctgg

SEQ ID NO: 492545 - DNA, 25 bp, Mus musculus
ttcatcggcctctccatgatgctca

SEQ ID NO: 492546 - DNA, 25 bp, Mus musculus
ttcatcgtgaatggctgcgccgcgg

SEQ ID NO: 492547 - DNA, 25 bp, Mus musculus
ttcatctcagggtcctgcctcctag

SEQ ID NO: 492548 - DNA, 25 bp, Mus musculus
ttcatctggagaggtgggtcccctg

SEQ ID NO: 492549 - DNA, 25 bp, Mus musculus
ttcatcttctgctgacactcgccag

SEQ ID NO: 492550 - DNA, 25 bp, Mus musculus
ttcatgacaagagtagccctgcagg

SEQ ID NO: 492551 - DNA, 25 bp, Mus musculus
ttcatgaccggatgcgagttcccct

SEQ ID NO: 492552 - DNA, 25 bp, Mus musculus
ttcatgagcacagcagagcgggttc

SEQ ID NO: 492553 - DNA, 25 bp, Mus musculus
ttcatgcaatacaacagcacgcggg

SEQ ID NO: 492554 - DNA, 25 bp, Mus musculus
ttcatgccagtggagaccttctcgg

SEQ ID NO: 492555 - DNA, 25 bp, Mus musculus
ttcatgccgactgtggagcctgacc

SEQ ID NO: 492556 - DNA, 25 bp, Mus musculus
ttcatgcctaggacaacacagctgc

SEQ ID NO: 492557 - DNA, 25 bp, Mus musculus
ttcatgctgcatttatcccctttgg

SEQ ID NO: 492558 - DNA, 25 bp, Mus musculus
ttcatgctgggagcaaagcggccct

SEQ ID NO: 492559 - DNA, 25 bp, Mus musculus
ttcatggaaaatccttcccattaaa

SEQ ID NO: 492560 - DNA, 25 bp, Mus musculus
ttcatggaactctttttgtgggtac

SEQ ID NO: 492561 - DNA, 25 bp, Mus musculus
ttcatggagatcaggaaagccgtcg

SEQ ID NO: 492562 - DNA, 25 bp, Mus musculus
ttcatggagcatgggagcacaacct

SEQ ID NO: 492563 - DNA, 25 bp, Mus musculus
ttcatggagtgtgtgccgtcagcgc

SEQ ID NO: 492564 - DNA, 25 bp, Mus musculus
ttcatggccagcgtggagactcaca

SEQ ID NO: 492565 - DNA, 25 bp, Mus musculus
ttcatgggtcaccacgacaaggcca

SEQ ID NO: 492566 - DNA, 25 bp, Mus musculus
ttcatggtggactcgactgaccggc

SEQ ID NO: 492567 - DNA, 25 bp, Mus musculus
ttcatgtagccaaagagctccctca

SEQ ID NO: 492568 - DNA, 25 bp, Mus musculus
ttcatgtgaagagcaccaagccgtc

SEQ ID NO: 492569 - DNA, 25 bp, Mus musculus
ttcatgtgcggagtggaggacctgc

SEQ ID NO: 492570 - DNA, 25 bp, Mus musculus
ttcatgttcagaaagggcccggcgt

SEQ ID NO: 492571 - DNA, 25 bp, Mus musculus
ttcatgttcggtgctcgtgggccca

SEQ ID NO: 492572 - DNA, 25 bp, Mus musculus
ttcattacccaagagcggattgtct

SEQ ID NO: 492573 - DNA, 25 bp, Mus musculus
ttcattaccgaaccagcaaggtgcg

SEQ ID NO: 492574 - DNA, 25 bp, Mus musculus
ttcattattgtctcttccggacgct

SEQ ID NO: 492575 - DNA, 25 bp, Mus musculus
ttcattcgggccaacaaagctcgtg

SEQ ID NO: 492576 - DNA, 25 bp, Mus musculus
ttcattctgaaagagtaagccgtag

SEQ ID NO: 492577 - DNA, 25 bp, Mus musculus
ttcattcttagaccggagcaggcag

SEQ ID NO: 492578 - DNA, 25 bp, Mus musculus
ttcattgagattggagagccccgtc

SEQ ID NO: 492579 - DNA, 25 bp, Mus musculus
ttcattggagagactcgggtgcccc

SEQ ID NO: 492580 - DNA, 25 bp, Mus musculus
ttcattgtgttctgagggcctggca

SEQ ID NO: 492581 - DNA, 25 bp, Mus musculus
ttcatttcccgacctacgtatgcgc

SEQ ID NO: 492582 - DNA, 25 bp, Mus musculus
ttcatttgggttccccaataattgg

SEQ ID NO: 492583 - DNA, 25 bp, Mus musculus
ttcatttttagacaagatccccaag

SEQ ID NO: 492584 - DNA, 25 bp, Mus musculus
ttccaaaatgacacagggagccggt

SEQ ID NO: 492585 - DNA, 25 bp, Mus musculus
ttccaaaggagggagcagtaagccc

SEQ ID NO: 492586 - DNA, 25 bp, Mus musculus
ttccaaatagaagaaacggatccag

SEQ ID NO: 492587 - DNA, 25 bp, Mus musculus
ttccaaatgagcatcgacatgggct

SEQ ID NO: 492588 - DNA, 25 bp, Mus musculus
ttccaacaaggcaagacagggtgcc

SEQ ID NO: 492589 - DNA, 25 bp, Mus musculus
ttccaacccagaaagagcatgcagg

SEQ ID NO: 492590 - DNA, 25 bp, Mus musculus
ttccaacgggaaaaacaggtcatca

SEQ ID NO: 492591 - DNA, 25 bp, Mus musculus
ttccaagagggtcggttcgtgttcg

SEQ ID NO: 492592 - DNA, 25 bp, Mus musculus
ttccaagcgggactctactggccca

SEQ ID NO: 492593 - DNA, 25 bp, Mus musculus
ttccaagcttctataggtcatccaa

SEQ ID NO: 492594 - DNA, 25 bp, Mus musculus
ttccaagtacggagagggtcaccaa

SEQ ID NO: 492595 - DNA, 25 bp, Mus musculus
ttccaagtgatctccaagtgggacc

SEQ ID NO: 492596 - DNA, 25 bp, Mus musculus
ttccaagttcgatgggcaacccctg

SEQ ID NO: 492597 - DNA, 25 bp, Mus musculus
ttccaatggaatgtaacgcgatctc

SEQ ID NO: 492598 - DNA, 25 bp, Mus musculus
ttccaattacgtggcggaggaccgg

SEQ ID NO: 492599 - DNA, 25 bp, Mus musculus
ttccaattgcagatgagggcgcggc

SEQ ID NO: 492600 - DNA, 25 bp, Mus musculus
ttccacacgtggtgcggtacagcgc

SEQ ID NO: 492601 - DNA, 25 bp, Mus musculus
ttccacactatttaatctggtcccc

SEQ ID NO: 492602 - DNA, 25 bp, Mus musculus
ttccacactgggtggagctggagct

SEQ ID NO: 492603 - DNA, 25 bp, Mus musculus
ttccacaggacaggcagctgggtga

SEQ ID NO: 492604 - DNA, 25 bp, Mus musculus
ttccaccaagagaacgtacacaggc

SEQ ID NO: 492605 - DNA, 25 bp, Mus musculus
ttccaccagaagtttgctctcagtc

SEQ ID NO: 492606 - DNA, 25 bp, Mus musculus
ttccaccagtactccgggcgagagg

SEQ ID NO: 492607 - DNA, 25 bp, Mus musculus
ttccaccagtggcaagacagcctga

SEQ ID NO: 492608 - DNA, 25 bp, Mus musculus
ttccacgactatagcaaaatgcctg

SEQ ID NO: 492609 - DNA, 25 bp, Mus musculus
ttccacgagcttggtgcagtacaaa

SEQ ID NO: 492610 - DNA, 25 bp, Mus musculus
ttccacgtcaagaagatccgcgagg

SEQ ID NO: 492611 - DNA, 25 bp, Mus musculus
ttccactgaggaaggcaagtccacc

SEQ ID NO: 492612 - DNA, 25 bp, Mus musculus
ttccactgggagaagacgaggcttg

SEQ ID NO: 492613 - DNA, 25 bp, Mus musculus
ttccactgtaagcagggccagaatg

SEQ ID NO: 492614 - DNA, 25 bp, Mus musculus
ttccacttttgggatgaggtactcc

SEQ ID NO: 492615 - DNA, 25 bp, Mus musculus
ttccagaaaacaacggcccaggagg

SEQ ID NO: 492616 - DNA, 25 bp, Mus musculus
ttccagaacgccgtgtgtgcgcagc

SEQ ID NO: 492617 - DNA, 25 bp, Mus musculus
ttccagaagtatggctaccaagcgc

SEQ ID NO: 492618 - DNA, 25 bp, Mus musculus
ttccagacaggctacaagacgctga

SEQ ID NO: 492619 - DNA, 25 bp, Mus musculus
ttccagacagtgtgactcctcctca

SEQ ID NO: 492620 - DNA, 25 bp, Mus musculus
ttccagacccaccagggacaagatg

SEQ ID NO: 492621 - DNA, 25 bp, Mus musculus
ttccagagccttctacacgcatgta

SEQ ID NO: 492622 - DNA, 25 bp, Mus musculus
ttccagaggatgatcgccgaggtgc

SEQ ID NO: 492623 - DNA, 25 bp, Mus musculus
ttccagagtctacagttccggctgc

SEQ ID NO: 492624 - DNA, 25 bp, Mus musculus
ttccagatatctcccctgtgagcgc

SEQ ID NO: 492625 - DNA, 25 bp, Mus musculus
ttccagatcgtgtgcaagacccctt

SEQ ID NO: 492626 - DNA, 25 bp, Mus musculus
ttccagcaatgacccaagaccagtg

SEQ ID NO: 492627 - DNA, 25 bp, Mus musculus
ttccagcaccagcaaagtaacgggc

SEQ ID NO: 492628 - DNA, 25 bp, Mus musculus
ttccagcaccgagagggctgtgtac

SEQ ID NO: 492629 - DNA, 25 bp, Mus musculus
ttccagcaggtggattagatgggct

SEQ ID NO: 492630 - DNA, 25 bp, Mus musculus
ttccagccagaagaacgacgttttc

SEQ ID NO: 492631 - DNA, 25 bp, Mus musculus
ttccagccgaactggccagcgcagg

SEQ ID NO: 492632 - DNA, 25 bp, Mus musculus
ttccagccgctgcagaaagaatgcc

SEQ ID NO: 492633 - DNA, 25 bp, Mus musculus
ttccagcgcgctgtagcaaggtgtt

SEQ ID NO: 492634 - DNA, 25 bp, Mus musculus
ttccagcgctcaggaagaggtagaa

SEQ ID NO: 492635 - DNA, 25 bp, Mus musculus
ttccaggaagcaaggtcaaaggcgt

SEQ ID NO: 492636 - DNA, 25 bp, Mus musculus
ttccaggagacgaagtacccagacg

SEQ ID NO: 492637 - DNA, 25 bp, Mus musculus
ttccaggagcattcacataacagtc

SEQ ID NO: 492638 - DNA, 25 bp, Mus musculus
ttccaggatacaccgagaaacctcg

SEQ ID NO: 492639 - DNA, 25 bp, Mus musculus
ttccaggatcaaagtgaagagccag

SEQ ID NO: 492640 - DNA, 25 bp, Mus musculus
ttccaggcctccgaggagactgcat

SEQ ID NO: 492641 - DNA, 25 bp, Mus musculus
ttccaggctcctacgccactggagg

SEQ ID NO: 492642 - DNA, 25 bp, Mus musculus
ttccagtatgttgcggtaggttccc

SEQ ID NO: 492643 - DNA, 25 bp, Mus musculus
ttccagtcacgactggagactaaag

SEQ ID NO: 492644 - DNA, 25 bp, Mus musculus
ttccagtgccttcggaaagattgcc

SEQ ID NO: 492645 - DNA, 25 bp, Mus musculus
ttccagttctgtgagggaccctgtc

SEQ ID NO: 492646 - DNA, 25 bp, Mus musculus
ttccatagagactgcacttccagct

SEQ ID NO: 492647 - DNA, 25 bp, Mus musculus
ttccatccctgatagtccgtctgag

SEQ ID NO: 492648 - DNA, 25 bp, Mus musculus
ttccatcgagatgggcttcggttcc

SEQ ID NO: 492649 - DNA, 25 bp, Mus musculus
ttccatctggaaaggcaggtcctgc

SEQ ID NO: 492650 - DNA, 25 bp, Mus musculus
ttccatggatacaagctgcagggcc

SEQ ID NO: 492651 - DNA, 25 bp, Mus musculus
ttccatggcttcttgcagttctcag

SEQ ID NO: 492652 - DNA, 25 bp, Mus musculus
ttccatgggaggagggcagtttctc

SEQ ID NO: 492653 - DNA, 25 bp, Mus musculus
ttccatgtcatttgcatgcttgtca

SEQ ID NO: 492654 - DNA, 25 bp, Mus musculus
ttccattgagaaaagctgagcggcg

SEQ ID NO: 492655 - DNA, 25 bp, Mus musculus
ttccattggcaacgtcacaggcagt

SEQ ID NO: 492656 - DNA, 25 bp, Mus musculus
ttccattggtgaggagacagactcc

SEQ ID NO: 492657 - DNA, 25 bp, Mus musculus
ttcccaaaatttcaagagtctggag

SEQ ID NO: 492658 - DNA, 25 bp, Mus musculus
ttcccaaagaagaaagcggctccct

SEQ ID NO: 492659 - DNA, 25 bp, Mus musculus
ttcccaaagacgaggacatcctggt

SEQ ID NO: 492660 - DNA, 25 bp, Mus musculus
ttcccaaaggaaacgcagaggcttt

SEQ ID NO: 492661 - DNA, 25 bp, Mus musculus
ttcccaaataattgagatagagacc

SEQ ID NO: 492662 - DNA, 25 bp, Mus musculus
ttcccaagaacgtcagcatcagctc

SEQ ID NO: 492663 - DNA, 25 bp, Mus musculus
ttcccaagctgctctcggtcgtggt

SEQ ID NO: 492664 - DNA, 25 bp, Mus musculus
ttcccaccagggtacctgtcaacta

SEQ ID NO: 492665 - DNA, 25 bp, Mus musculus
ttcccacccatgagaagattaaagc

SEQ ID NO: 492666 - DNA, 25 bp, Mus musculus
ttcccaccggaagcatgcaatgaga

SEQ ID NO: 492667 - DNA, 25 bp, Mus musculus
ttcccagaagatggttggctaggca

SEQ ID NO: 492668 - DNA, 25 bp, Mus musculus
ttcccagagctgtatcaactcctag

SEQ ID NO: 492669 - DNA, 25 bp, Mus musculus
ttcccagaggcagagaatagaaagt

SEQ ID NO: 492670 - DNA, 25 bp, Mus musculus
ttcccagatgtaaatctctgaagga

SEQ ID NO: 492671 - DNA, 25 bp, Mus musculus
ttcccagattgcgaagggcacctgc

SEQ ID NO: 492672 - DNA, 25 bp, Mus musculus
ttcccagcagaggaatcgggagcgc

SEQ ID NO: 492673 - DNA, 25 bp, Mus musculus
ttcccagcgtgagccagtggagccg

SEQ ID NO: 492674 - DNA, 25 bp, Mus musculus
ttcccaggactagagacaaagacag

SEQ ID NO: 492675 - DNA, 25 bp, Mus musculus
ttcccaggatgctaggcacaaggcc

SEQ ID NO: 492676 - DNA, 25 bp, Mus musculus
ttcccaggccctagcttgtatgttg

SEQ ID NO: 492677 - DNA, 25 bp, Mus musculus
ttcccagggccagggatgagatgcc

SEQ ID NO: 492678 - DNA, 25 bp, Mus musculus
ttcccagggcggtcatgccaggctg

SEQ ID NO: 492679 - DNA, 25 bp, Mus musculus
ttcccagggtatgagggcaggtcca

SEQ ID NO: 492680 - DNA, 25 bp, Mus musculus
ttcccagtcgtaacttggccctcgg

SEQ ID NO: 492681 - DNA, 25 bp, Mus musculus
ttcccatcggaaatcacgttaaagg

SEQ ID NO: 492682 - DNA, 25 bp, Mus musculus
ttcccatctctctgcaagaaggcag

SEQ ID NO: 492683 - DNA, 25 bp, Mus musculus
ttcccatggattgcatggttgacag

SEQ ID NO: 492684 - DNA, 25 bp, Mus musculus
ttcccattagatagatgtgcaggcc

SEQ ID NO: 492685 - DNA, 25 bp, Mus musculus
ttcccattgtgggaacctggtatgg

SEQ ID NO: 492686 - DNA, 25 bp, Mus musculus
ttccccaatgctacagggcacaggg

SEQ ID NO: 492687 - DNA, 25 bp, Mus musculus
ttccccacctgaggacaacaaagag

SEQ ID NO: 492688 - DNA, 25 bp, Mus musculus
ttccccactttgatcagtaccctgt

SEQ ID NO: 492689 - DNA, 25 bp, Mus musculus
ttccccagacccaggctggtgggca

SEQ ID NO: 492690 - DNA, 25 bp, Mus musculus
ttccccagccggagaagctggtgag

SEQ ID NO: 492691 - DNA, 25 bp, Mus musculus
ttccccaggagtgataggcaatgca

SEQ ID NO: 492692 - DNA, 25 bp, Mus musculus
ttccccaggtcagggcaaaggttgc

SEQ ID NO: 492693 - DNA, 25 bp, Mus musculus
ttccccagtggagacagaacaggtg

SEQ ID NO: 492694 - DNA, 25 bp, Mus musculus
ttccccatggaaaagagcagcattg

SEQ ID NO: 492695 - DNA, 25 bp, Mus musculus
ttccccgacggatggagactgcact

SEQ ID NO: 492696 - DNA, 25 bp, Mus musculus
ttccccgagggagccaagaatgtag

SEQ ID NO: 492697 - DNA, 25 bp, Mus musculus
ttcccctagatgctggagaaagcct

SEQ ID NO: 492698 - DNA, 25 bp, Mus musculus
ttcccctgaggagtatgccgtggcc

SEQ ID NO: 492699 - DNA, 25 bp, Mus musculus
ttcccctgcggatgagagactggct

SEQ ID NO: 492700 - DNA, 25 bp, Mus musculus
ttcccctgtgctggtacggctacat

SEQ ID NO: 492701 - DNA, 25 bp, Mus musculus
ttccccttgaagagttagaccccag

SEQ ID NO: 492702 - DNA, 25 bp, Mus musculus
ttcccgactggagatgacaacgctg

SEQ ID NO: 492703 - DNA, 25 bp, Mus musculus
ttcccgactgtgagggtatgcgaag

SEQ ID NO: 492704 - DNA, 25 bp, Mus musculus
ttcccgagcaatggcaaggcgaagc

SEQ ID NO: 492705 - DNA, 25 bp, Mus musculus
ttcccgaggcgtagaagaaactccg

SEQ ID NO: 492706 - DNA, 25 bp, Mus musculus
ttcccgcggacggtgaacgactaca

SEQ ID NO: 492707 - DNA, 25 bp, Mus musculus
ttcccgcgggcttccaggtctgcgg

SEQ ID NO: 492708 - DNA, 25 bp, Mus musculus
ttcccggaactagccagagagcagt

SEQ ID NO: 492709 - DNA, 25 bp, Mus musculus
ttcccggattctccagtctgcgagg

SEQ ID NO: 492710 - DNA, 25 bp, Mus musculus
ttcccggcgataggcaggtggtcat

SEQ ID NO: 492711 - DNA, 25 bp, Mus musculus
ttcccggctgggtttccagggcctg

SEQ ID NO: 492712 - DNA, 25 bp, Mus musculus
ttcccggtcagtcttccctctggga

SEQ ID NO: 492713 - DNA, 25 bp, Mus musculus
ttcccgtatccagggtcacagtgca

SEQ ID NO: 492714 - DNA, 25 bp, Mus musculus
ttcccgttcctgctctgcatatcag

SEQ ID NO: 492715 - DNA, 25 bp, Mus musculus
ttccctaaggcccaacaggagcctg

SEQ ID NO: 492716 - DNA, 25 bp, Mus musculus
ttccctactacacagctgctagaag

SEQ ID NO: 492717 - DNA, 25 bp, Mus musculus
ttccctatggactgaaagctcggcc

SEQ ID NO: 492718 - DNA, 25 bp, Mus musculus
ttccctcaaagcctgaccacagagt

SEQ ID NO: 492719 - DNA, 25 bp, Mus musculus
ttccctcagacctgtcaaggtgccg

SEQ ID NO: 492720 - DNA, 25 bp, Mus musculus
ttccctcagatactaaagggaaaga

SEQ ID NO: 492721 - DNA, 25 bp, Mus musculus
ttccctcagggaaccgggactctgc

SEQ ID NO: 492722 - DNA, 25 bp, Mus musculus
ttccctcatgcaggcacttggctag

SEQ ID NO: 492723 - DNA, 25 bp, Mus musculus
ttccctccctgtcttgttcattttg

SEQ ID NO: 492724 - DNA, 25 bp, Mus musculus
ttccctgcagatcctagcccgatgt

SEQ ID NO: 492725 - DNA, 25 bp, Mus musculus
ttccctggagctaccgtgacaagac

SEQ ID NO: 492726 - DNA, 25 bp, Mus musculus
ttccctggatggagagtaaccgcag

SEQ ID NO: 492727 - DNA, 25 bp, Mus musculus
ttccctgggatgtacaatgtcttca

SEQ ID NO: 492728 - DNA, 25 bp, Mus musculus
ttccctgggccagcgtcaagaggct

SEQ ID NO: 492729 - DNA, 25 bp, Mus musculus
ttccctgggtccctgtctcctggcc

SEQ ID NO: 492730 - DNA, 25 bp, Mus musculus
ttccctgggtgagaagctgaagacc

SEQ ID NO: 492731 - DNA, 25 bp, Mus musculus
ttccctggtggtttcggtagcgact

SEQ ID NO: 492732 - DNA, 25 bp, Mus musculus
ttcccttgggattgaaatttttatg

SEQ ID NO: 492733 - DNA, 25 bp, Mus musculus
ttccgaaagcctcgccagctcggtg

SEQ ID NO: 492734 - DNA, 25 bp, Mus musculus
ttccgaagcggagtctttgttccct

SEQ ID NO: 492735 - DNA, 25 bp, Mus musculus
ttccgaaggaaatgccaggcgctca

SEQ ID NO: 492736 - DNA, 25 bp, Mus musculus
ttccgaatgattaagttagctggtc

SEQ ID NO: 492737 - DNA, 25 bp, Mus musculus
ttccgacagggttatggcggccgct

SEQ ID NO: 492738 - DNA, 25 bp, Mus musculus
ttccgacgcgcctttgtaagttggg

SEQ ID NO: 492739 - DNA, 25 bp, Mus musculus
ttccgagaagggatcgacaagccag

SEQ ID NO: 492740 - DNA, 25 bp, Mus musculus
ttccgagagcactgggaacgcacct

SEQ ID NO: 492741 - DNA, 25 bp, Mus musculus
ttccgaggcaagatcagggctttcc

SEQ ID NO: 492742 - DNA, 25 bp, Mus musculus
ttccgaggcgtggagaagcacatcc

SEQ ID NO: 492743 - DNA, 25 bp, Mus musculus
ttccgaggcgtgtgcaagaaaatcg

SEQ ID NO: 492744 - DNA, 25 bp, Mus musculus
ttccgagtatgggagagtgccacgc

SEQ ID NO: 492745 - DNA, 25 bp, Mus musculus
ttccgagtcagggagaacaggcctc

SEQ ID NO: 492746 - DNA, 25 bp, Mus musculus
ttccgattggaaggcaccatttgcc

SEQ ID NO: 492747 - DNA, 25 bp, Mus musculus
ttccgcaacggccagtacgccgagg

SEQ ID NO: 492748 - DNA, 25 bp, Mus musculus
ttccgccaaggaggtagtgctgcag

SEQ ID NO: 492749 - DNA, 25 bp, Mus musculus
ttccgcgcgatggagaccggatgct

SEQ ID NO: 492750 - DNA, 25 bp, Mus musculus
ttccgcgcgggaattcgcgcctgga

SEQ ID NO: 492751 - DNA, 25 bp, Mus musculus
ttccggcttaggagggctgactgct

SEQ ID NO: 492752 - DNA, 25 bp, Mus musculus
ttccgggacctatatgctgagctgc

SEQ ID NO: 492753 - DNA, 25 bp, Mus musculus
ttccgggcgatgtcttggtttcgag

SEQ ID NO: 492754 - DNA, 25 bp, Mus musculus
ttccggtcagtaccaaccgtcagct

SEQ ID NO: 492755 - DNA, 25 bp, Mus musculus
ttccggtgtgtcctctcagagacga

SEQ ID NO: 492756 - DNA, 25 bp, Mus musculus
ttccggtgtttcagtacgtgggcga

SEQ ID NO: 492757 - DNA, 25 bp, Mus musculus
ttccggttccggttgtccagtgctc

SEQ ID NO: 492758 - DNA, 25 bp, Mus musculus
ttccgtaaggcctgcaacgtggtgc

SEQ ID NO: 492759 - DNA, 25 bp, Mus musculus
ttccgtacttcgagcaacagccaag

SEQ ID NO: 492760 - DNA, 25 bp, Mus musculus
ttccgtaggagaaagaggacgctcc

SEQ ID NO: 492761 - DNA, 25 bp, Mus musculus
ttccgtcggacagcactgcatcggg

SEQ ID NO: 492762 - DNA, 25 bp, Mus musculus
ttccgtgtccaaatatacctgtgtc

SEQ ID NO: 492763 - DNA, 25 bp, Mus musculus
ttccgtttgagtccccagcttctgc

SEQ ID NO: 492764 - DNA, 25 bp, Mus musculus
ttccgtttgccatggtgcagctccg

SEQ ID NO: 492765 - DNA, 25 bp, Mus musculus
ttcctaacagtctggataatgatgc

SEQ ID NO: 492766 - DNA, 25 bp, Mus musculus
ttcctaaccgggagactgaacgcag

SEQ ID NO: 492767 - DNA, 25 bp, Mus musculus
ttcctacgccagagcatttgcagtg

SEQ ID NO: 492768 - DNA, 25 bp, Mus musculus
ttcctagacaagtggaaggttgggt

SEQ ID NO: 492769 - DNA, 25 bp, Mus musculus
ttcctagagttcgaaggtgacagca

SEQ ID NO: 492770 - DNA, 25 bp, Mus musculus
ttcctagccgagttggcggtccctt

SEQ ID NO: 492771 - DNA, 25 bp, Mus musculus
ttcctagtgaaggaccggaggccgt

SEQ ID NO: 492772 - DNA, 25 bp, Mus musculus
ttcctagtgggtgcgcacttggctc

SEQ ID NO: 492773 - DNA, 25 bp, Mus musculus
ttcctcaaacaagagcgagcggttc

SEQ ID NO: 492774 - DNA, 25 bp, Mus musculus
ttcctcaaaggacaagggatgcccc

SEQ ID NO: 492775 - DNA, 25 bp, Mus musculus
ttcctcaacatgacctgattccgtg

SEQ ID NO: 492776 - DNA, 25 bp, Mus musculus
ttcctcaacggcaacggcagtggtg

SEQ ID NO: 492777 - DNA, 25 bp, Mus musculus
ttcctcaagggcagagtggcctcat

SEQ ID NO: 492778 - DNA, 25 bp, Mus musculus
ttcctcacatactgcgccagggact

SEQ ID NO: 492779 - DNA, 25 bp, Mus musculus
ttcctcagtcatagccgcaacggag

SEQ ID NO: 492780 - DNA, 25 bp, Mus musculus
ttcctcatagtaagcacagacggtg

SEQ ID NO: 492781 - DNA, 25 bp, Mus musculus
ttcctccaaggtcacagagacaaag

SEQ ID NO: 492782 - DNA, 25 bp, Mus musculus
ttcctccaatgtagatgccgccttg

SEQ ID NO: 492783 - DNA, 25 bp, Mus musculus
ttcctcccaagaatgtcctgccagc

SEQ ID NO: 492784 - DNA, 25 bp, Mus musculus
ttcctccgaggctgaggactgcagc

SEQ ID NO: 492785 - DNA, 25 bp, Mus musculus
ttcctccgaggtcccgagcaagaga

SEQ ID NO: 492786 - DNA, 25 bp, Mus musculus
ttcctcctctagcaacgacagtggg

SEQ ID NO: 492787 - DNA, 25 bp, Mus musculus
ttcctccttatacccatgtccaggt

SEQ ID NO: 492788 - DNA, 25 bp, Mus musculus
ttcctcgagaccacccagagagtta

SEQ ID NO: 492789 - DNA, 25 bp, Mus musculus
ttcctcgcagagataaaaacacatt

SEQ ID NO: 492790 - DNA, 25 bp, Mus musculus
ttcctcggcggagtggcatgctgta

SEQ ID NO: 492791 - DNA, 25 bp, Mus musculus
ttcctcttacaactgttttctccag

SEQ ID NO: 492792 - DNA, 25 bp, Mus musculus
ttcctcttcacctggacgaggaggg

SEQ ID NO: 492793 - DNA, 25 bp, Mus musculus
ttcctgaaacggagtcccgcagtgg

SEQ ID NO: 492794 - DNA, 25 bp, Mus musculus
ttcctgaatcagtctctcaaacagc

SEQ ID NO: 492795 - DNA, 25 bp, Mus musculus
ttcctgaccaaaagaggcagacaga

SEQ ID NO: 492796 - DNA, 25 bp, Mus musculus
ttcctgacggtgcaggcaaaccgat

SEQ ID NO: 492797 - DNA, 25 bp, Mus musculus
ttcctgactgttcgcaggccctatg

SEQ ID NO: 492798 - DNA, 25 bp, Mus musculus
ttcctgaggcaaagaatggtatctg

SEQ ID NO: 492799 - DNA, 25 bp, Mus musculus
ttcctgaggcattcgagacgctggc

SEQ ID NO: 492800 - DNA, 25 bp, Mus musculus
ttcctgaggcctgatacttagggtc

SEQ ID NO: 492801 - DNA, 25 bp, Mus musculus
ttcctgagggcatgagaaatccaca

SEQ ID NO: 492802 - DNA, 25 bp, Mus musculus
ttcctgcacctcagtaaccgctgct

SEQ ID NO: 492803 - DNA, 25 bp, Mus musculus
ttcctgcacttgagggcagccttgg

SEQ ID NO: 492804 - DNA, 25 bp, Mus musculus
ttcctgcagagataagagaccttgt

SEQ ID NO: 492805 - DNA, 25 bp, Mus musculus
ttcctgcagtaaaatgggagacaga

SEQ ID NO: 492806 - DNA, 25 bp, Mus musculus
ttcctgcagtcttctgagcctgagt

SEQ ID NO: 492807 - DNA, 25 bp, Mus musculus
ttcctgcatgctagccgagacttcg

SEQ ID NO: 492808 - DNA, 25 bp, Mus musculus
ttcctgcgcacgaagaatggtgtca

SEQ ID NO: 492809 - DNA, 25 bp, Mus musculus
ttcctgctaagaaacggagccaatg

SEQ ID NO: 492810 - DNA, 25 bp, Mus musculus
ttcctgctccagtaatttgatcaat

SEQ ID NO: 492811 - DNA, 25 bp, Mus musculus
ttcctggagggcatcgagtacgctg

SEQ ID NO: 492812 - DNA, 25 bp, Mus musculus
ttcctggaggtgtgccaagtgcccg

SEQ ID NO: 492813 - DNA, 25 bp, Mus musculus
ttcctggcggaaggctcatggcgtc

SEQ ID NO: 492814 - DNA, 25 bp, Mus musculus
ttcctgggagacgaagagacggttc

SEQ ID NO: 492815 - DNA, 25 bp, Mus musculus
ttcctgggcccacaatcatagaggg

SEQ ID NO: 492816 - DNA, 25 bp, Mus musculus
ttcctgggctccgtgcgtgtctttg

SEQ ID NO: 492817 - DNA, 25 bp, Mus musculus
ttcctggtacattttgacaactggg

SEQ ID NO: 492818 - DNA, 25 bp, Mus musculus
ttcctggtcgcagagaaaggtgccc

SEQ ID NO: 492819 - DNA, 25 bp, Mus musculus
ttcctgtaacttaaaggctgcaccg

SEQ ID NO: 492820 - DNA, 25 bp, Mus musculus
ttcctgtcccaggtcattgcagagt

SEQ ID NO: 492821 - DNA, 25 bp, Mus musculus
ttcctgtgagacctacgagtacccg

SEQ ID NO: 492822 - DNA, 25 bp, Mus musculus
ttcctgtggcgcctcctggcgttag

SEQ ID NO: 492823 - DNA, 25 bp, Mus musculus
ttccttacagagacctgtgggtcta

SEQ ID NO: 492824 - DNA, 25 bp, Mus musculus
ttccttattcctccacgcgatgcct

SEQ ID NO: 492825 - DNA, 25 bp, Mus musculus
ttccttatttgagccagcgcagccg

SEQ ID NO: 492826 - DNA, 25 bp, Mus musculus
ttccttcaggaacacgccacaggtg

SEQ ID NO: 492827 - DNA, 25 bp, Mus musculus
ttccttgaatgtagagcctgcccag

SEQ ID NO: 492828 - DNA, 25 bp, Mus musculus
ttccttgatcggagccaggcttgga

SEQ ID NO: 492829 - DNA, 25 bp, Mus musculus
ttccttgatctggacagtactcttc

SEQ ID NO: 492830 - DNA, 25 bp, Mus musculus
ttccttgccatgctggcgggcacag

SEQ ID NO: 492831 - DNA, 25 bp, Mus musculus
ttccttggaaagaaggaggctcaca

SEQ ID NO: 492832 - DNA, 25 bp, Mus musculus
ttccttggcctgttcttctctcctg

SEQ ID NO: 492833 - DNA, 25 bp, Mus musculus
ttccttgggtcatggcgcacagtct

SEQ ID NO: 492834 - DNA, 25 bp, Mus musculus
ttcctttccccagatggcgtccacg

SEQ ID NO: 492835 - DNA, 25 bp, Mus musculus
ttcctttctcagacatgggttcctc

SEQ ID NO: 492836 - DNA, 25 bp, Mus musculus
ttcctttgaggtgggattgagacaa

SEQ ID NO: 492837 - DNA, 25 bp, Mus musculus
ttccttttaggttcagacccagttg

SEQ ID NO: 492838 - DNA, 25 bp, Mus musculus
ttccttttgaaagcgcggcggcaga

SEQ ID NO: 492839 - DNA, 25 bp, Mus musculus
ttcgaaaaagcctgccgcatcttat

SEQ ID NO: 492840 - DNA, 25 bp, Mus musculus
ttcgaaacagacacctgggaatcct

SEQ ID NO: 492841 - DNA, 25 bp, Mus musculus
ttcgaagcaactagccccaggcggt

SEQ ID NO: 492842 - DNA, 25 bp, Mus musculus
ttcgaagcacaccaggacatcagtg

SEQ ID NO: 492843 - DNA, 25 bp, Mus musculus
ttcgaaggctggataaagggaaccg

SEQ ID NO: 492844 - DNA, 25 bp, Mus musculus
ttcgaagtcagtgagggtgcacaag

SEQ ID NO: 492845 - DNA, 25 bp, Mus musculus
ttcgaccagcggaaaagagcaaacg

SEQ ID NO: 492846 - DNA, 25 bp, Mus musculus
ttcgaccggttcctgcacgagaaga

SEQ ID NO: 492847 - DNA, 25 bp, Mus musculus
ttcgactacctggtgatcggcggcg

SEQ ID NO: 492848 - DNA, 25 bp, Mus musculus
ttcgactgcgaggaccgctcggatg

SEQ ID NO: 492849 - DNA, 25 bp, Mus musculus
ttcgagaactatgtggcggacatcg

SEQ ID NO: 492850 - DNA, 25 bp, Mus musculus
ttcgagaagcttaaaatcccttggc

SEQ ID NO: 492851 - DNA, 25 bp, Mus musculus
ttcgagaggcccgatagtttcgtgc

SEQ ID NO: 492852 - DNA, 25 bp, Mus musculus
ttcgagaggcttacgagaacgacgt

SEQ ID NO: 492853 - DNA, 25 bp, Mus musculus
ttcgagatgttccttgcttcccaaa

SEQ ID NO: 492854 - DNA, 25 bp, Mus musculus
ttcgagcccgaactgtgacttttgc

SEQ ID NO: 492855 - DNA, 25 bp, Mus musculus
ttcgaggtccagttgcacttccgcg

SEQ ID NO: 492856 - DNA, 25 bp, Mus musculus
ttcgagtctatctttccagtgggca

SEQ ID NO: 492857 - DNA, 25 bp, Mus musculus
ttcgagttggaacagtgggcacccc

SEQ ID NO: 492858 - DNA, 25 bp, Mus musculus
ttcgatacgatggaaggcacctggt

SEQ ID NO: 492859 - DNA, 25 bp, Mus musculus
ttcgatagcaggctttttgttgcca

SEQ ID NO: 492860 - DNA, 25 bp, Mus musculus
ttcgatcctgagctccgcatcatgg

SEQ ID NO: 492861 - DNA, 25 bp, Mus musculus
ttcgatctctgggacctgtgtagag

SEQ ID NO: 492862 - DNA, 25 bp, Mus musculus
ttcgatgatgagtcagcaactgtgg

SEQ ID NO: 492863 - DNA, 25 bp, Mus musculus
ttcgatgatggctgatcaaggctct

SEQ ID NO: 492864 - DNA, 25 bp, Mus musculus
ttcgattggccatcacgacactgga

SEQ ID NO: 492865 - DNA, 25 bp, Mus musculus
ttcgcaagtagagcaagcagggttc

SEQ ID NO: 492866 - DNA, 25 bp, Mus musculus
ttcgcagagcggaatccgggacaga

SEQ ID NO: 492867 - DNA, 25 bp, Mus musculus
ttcgcaggagaatttccagcccaga

SEQ ID NO: 492868 - DNA, 25 bp, Mus musculus
ttcgcatggtgaacggcaagcccaa

SEQ ID NO: 492869 - DNA, 25 bp, Mus musculus
ttcgccaatgcacgaggagcagctt

SEQ ID NO: 492870 - DNA, 25 bp, Mus musculus
ttcgccagaacctcttttagctccg

SEQ ID NO: 492871 - DNA, 25 bp, Mus musculus
ttcgcccaagaaaggatacccaggt

SEQ ID NO: 492872 - DNA, 25 bp, Mus musculus
ttcgccccttaggtgttttggccag

SEQ ID NO: 492873 - DNA, 25 bp, Mus musculus
ttcgcccgcatcaaagccgtggagt

SEQ ID NO: 492874 - DNA, 25 bp, Mus musculus
ttcgccctggaacagagctgcgctc

SEQ ID NO: 492875 - DNA, 25 bp, Mus musculus
ttcgccggcgaggtatcgattgcca

SEQ ID NO: 492876 - DNA, 25 bp, Mus musculus
ttcgccggtgggaactgtcatagcc

SEQ ID NO: 492877 - DNA, 25 bp, Mus musculus
ttcgccgttccgaatccgccatggg

SEQ ID NO: 492878 - DNA, 25 bp, Mus musculus
ttcgcctgaaggtgcagtaccgcca

SEQ ID NO: 492879 - DNA, 25 bp, Mus musculus
ttcgcctggatgagttacgtgagca

SEQ ID NO: 492880 - DNA, 25 bp, Mus musculus
ttcgcgctacgtcttagggaacccg

SEQ ID NO: 492881 - DNA, 25 bp, Mus musculus
ttcgcgggtcccagaaacccttgcg

SEQ ID NO: 492882 - DNA, 25 bp, Mus musculus
ttcgcggtggcctccacaagaagca

SEQ ID NO: 492883 - DNA, 25 bp, Mus musculus
ttcgctcgctggttgacagtgcgcc

SEQ ID NO: 492884 - DNA, 25 bp, Mus musculus
ttcgctgagggcaccttgggtcctg

SEQ ID NO: 492885 - DNA, 25 bp, Mus musculus
ttcgcttccttgtagtaactcaaaa

SEQ ID NO: 492886 - DNA, 25 bp, Mus musculus
ttcgcttcgctttcaggcagggcca

SEQ ID NO: 492887 - DNA, 25 bp, Mus musculus
ttcgctttagccatggcggagacag

SEQ ID NO: 492888 - DNA, 25 bp, Mus musculus
ttcggaaaacagctccaagggcgct

SEQ ID NO: 492889 - DNA, 25 bp, Mus musculus
ttcggaaagattgccgctccgtagg

SEQ ID NO: 492890 - DNA, 25 bp, Mus musculus
ttcggaacacgtggggacagtcgcc

SEQ ID NO: 492891 - DNA, 25 bp, Mus musculus
ttcggaatgagccaaaaggtcggcc

SEQ ID NO: 492892 - DNA, 25 bp, Mus musculus
ttcggaccagcttcagtgacccggg

SEQ ID NO: 492893 - DNA, 25 bp, Mus musculus
ttcggaccctctcaggagcacagtg

SEQ ID NO: 492894 - DNA, 25 bp, Mus musculus
ttcggaccgattgtcaacgagggct

SEQ ID NO: 492895 - DNA, 25 bp, Mus musculus
ttcggactgagaatcgagagcccct

SEQ ID NO: 492896 - DNA, 25 bp, Mus musculus
ttcggagactccagacaatcgcctt

SEQ ID NO: 492897 - DNA, 25 bp, Mus musculus
ttcggagcctcatccagggttcgag

SEQ ID NO: 492898 - DNA, 25 bp, Mus musculus
ttcggagggcgttgcaagagttccc

SEQ ID NO: 492899 - DNA, 25 bp, Mus musculus
ttcggatccgcaccgaactgtacgg

SEQ ID NO: 492900 - DNA, 25 bp, Mus musculus
ttcggatgaggctctcaaactaagc

SEQ ID NO: 492901 - DNA, 25 bp, Mus musculus
ttcggatgcgacaagtgcggtgcct

SEQ ID NO: 492902 - DNA, 25 bp, Mus musculus
ttcggattcagacgccgattcgccc

SEQ ID NO: 492903 - DNA, 25 bp, Mus musculus
ttcggcaagatcaaagaggacaaga

SEQ ID NO: 492904 - DNA, 25 bp, Mus musculus
ttcggcacctggaactggatctggc

SEQ ID NO: 492905 - DNA, 25 bp, Mus musculus
ttcggcagcccatcgctcactatag

SEQ ID NO: 492906 - DNA, 25 bp, Mus musculus
ttcggccagtttgcaagccagggct

SEQ ID NO: 492907 - DNA, 25 bp, Mus musculus
ttcggcctgtagtagagaagcccag

SEQ ID NO: 492908 - DNA, 25 bp, Mus musculus
ttcggcgtgtgagctctgcggcttc

SEQ ID NO: 492909 - DNA, 25 bp, Mus musculus
ttcggctaaaatgctggccccaggc

SEQ ID NO: 492910 - DNA, 25 bp, Mus musculus
ttcgggaaatgtcactcccacagcc

SEQ ID NO: 492911 - DNA, 25 bp, Mus musculus
ttcgggaacccggaactgagcacgg

SEQ ID NO: 492912 - DNA, 25 bp, Mus musculus
ttcgggaaggtgagatccaggccca

SEQ ID NO: 492913 - DNA, 25 bp, Mus musculus
ttcgggaccccagaagagtatgtta

SEQ ID NO: 492914 - DNA, 25 bp, Mus musculus
ttcgggacctcgagcggcagtcaga

SEQ ID NO: 492915 - DNA, 25 bp, Mus musculus
ttcgggaggatgtaccaccaggctt

SEQ ID NO: 492916 - DNA, 25 bp, Mus musculus
ttcgggccgctccagataagagtgt

SEQ ID NO: 492917 - DNA, 25 bp, Mus musculus
ttcgggtaaggctccagacagggcc

SEQ ID NO: 492918 - DNA, 25 bp, Mus musculus
ttcgggtacggctccctagtgtgga

SEQ ID NO: 492919 - DNA, 25 bp, Mus musculus
ttcgggttttcactggaatgaacat

SEQ ID NO: 492920 - DNA, 25 bp, Mus musculus
ttcggtagcgactgattctcagagc

SEQ ID NO: 492921 - DNA, 25 bp, Mus musculus
ttcggtccccagcttttctactatg

SEQ ID NO: 492922 - DNA, 25 bp, Mus musculus
ttcggtgccccaatatcgaaggaag

SEQ ID NO: 492923 - DNA, 25 bp, Mus musculus
ttcggtggcacagaaaccgtgggca

SEQ ID NO: 492924 - DNA, 25 bp, Mus musculus
ttcggtggccataggattcaggtct

SEQ ID NO: 492925 - DNA, 25 bp, Mus musculus
ttcggtgtcctggaaggctgctcgc

SEQ ID NO: 492926 - DNA, 25 bp, Mus musculus
ttcgtaaaatcgctgggaaagtcct

SEQ ID NO: 492927 - DNA, 25 bp, Mus musculus
ttcgtcctgagagaaacacgctggt

SEQ ID NO: 492928 - DNA, 25 bp, Mus musculus
ttcgtcgagggctcaatcgtccgca

SEQ ID NO: 492929 - DNA, 25 bp, Mus musculus
ttcgtcgggactggtacttcatgcc

SEQ ID NO: 492930 - DNA, 25 bp, Mus musculus
ttcgtctcaaagcttcttacacaga

SEQ ID NO: 492931 - DNA, 25 bp, Mus musculus
ttcgtgaaagaagccatcatgaaag

SEQ ID NO: 492932 - DNA, 25 bp, Mus musculus
ttcgtgaagtccttaaatgaagagg

SEQ ID NO: 492933 - DNA, 25 bp, Mus musculus
ttcgtgaattgagacggctccgcct

SEQ ID NO: 492934 - DNA, 25 bp, Mus musculus
ttcgtgacaaaaccccagacaggct

SEQ ID NO: 492935 - DNA, 25 bp, Mus musculus
ttcgtgacaaggctgaccagctggt

SEQ ID NO: 492936 - DNA, 25 bp, Mus musculus
ttcgtgactcacgtctcagactggg

SEQ ID NO: 492937 - DNA, 25 bp, Mus musculus
ttcgtgactgcatgtacggcatggg

SEQ ID NO: 492938 - DNA, 25 bp, Mus musculus
ttcgtgatgaaacaagccctgggag

SEQ ID NO: 492939 - DNA, 25 bp, Mus musculus
ttcgtgcgcgcatcgcgtacctaca

SEQ ID NO: 492940 - DNA, 25 bp, Mus musculus
ttcgtgctaggcaaggatctctacc

SEQ ID NO: 492941 - DNA, 25 bp, Mus musculus
ttcgtgctggagaggaatcctgtga

SEQ ID NO: 492942 - DNA, 25 bp, Mus musculus
ttcgtggaaccccagtgagaggctc

SEQ ID NO: 492943 - DNA, 25 bp, Mus musculus
ttcgtggacaagaacggccggtgca

SEQ ID NO: 492944 - DNA, 25 bp, Mus musculus
ttcgtggcgcgcacttctcggcgtt

SEQ ID NO: 492945 - DNA, 25 bp, Mus musculus
ttcgtgggccctcagatcagtgact

SEQ ID NO: 492946 - DNA, 25 bp, Mus musculus
ttcgtggtaaaacaagccagggcca

SEQ ID NO: 492947 - DNA, 25 bp, Mus musculus
ttcgtggtatacaagctgccggctc

SEQ ID NO: 492948 - DNA, 25 bp, Mus musculus
ttcgtggtggacgagcaaactccct

SEQ ID NO: 492949 - DNA, 25 bp, Mus musculus
ttcgtgtcccttaggcaactcccta

SEQ ID NO: 492950 - DNA, 25 bp, Mus musculus
ttcgtgtcgtctgcgagcagcccag

SEQ ID NO: 492951 - DNA, 25 bp, Mus musculus
ttcgtgttcggaacagggccaggct

SEQ ID NO: 492952 - DNA, 25 bp, Mus musculus
ttcgtgttctgctccaggccatgga

SEQ ID NO: 492953 - DNA, 25 bp, Mus musculus
ttcgttaccgagagcgcatcaccat

SEQ ID NO: 492954 - DNA, 25 bp, Mus musculus
ttcgttgacacctgagaaagcagct

SEQ ID NO: 492955 - DNA, 25 bp, Mus musculus
ttcgttgactgagtgaaccagccag

SEQ ID NO: 492956 - DNA, 25 bp, Mus musculus
ttcgttgcaacgagaaagccggagc

SEQ ID NO: 492957 - DNA, 25 bp, Mus musculus
ttcgttgcctgctaaattgcctgga

SEQ ID NO: 492958 - DNA, 25 bp, Mus musculus
ttctaaaaccaagatccccaggact

SEQ ID NO: 492959 - DNA, 25 bp, Mus musculus
ttctaaaatggagggctgacagtcc

SEQ ID NO: 492960 - DNA, 25 bp, Mus musculus
ttctaaacctgcttgcgtgcctggc

SEQ ID NO: 492961 - DNA, 25 bp, Mus musculus
ttctaaatgcaggagggatcacact

SEQ ID NO: 492962 - DNA, 25 bp, Mus musculus
ttctaacaacctggcgctctacggg

SEQ ID NO: 492963 - DNA, 25 bp, Mus musculus
ttctaacgatggtcacgcgatggcc

SEQ ID NO: 492964 - DNA, 25 bp, Mus musculus
ttctaactcaagtcctttgctaagt

SEQ ID NO: 492965 - DNA, 25 bp, Mus musculus
ttctaagatcccagatgaagaggcc

SEQ ID NO: 492966 - DNA, 25 bp, Mus musculus
ttctaaggctactgtcttagccagg

SEQ ID NO: 492967 - DNA, 25 bp, Mus musculus
ttctaagtggcctgcgagtcctggg

SEQ ID NO: 492968 - DNA, 25 bp, Mus musculus
ttctaattggaagcctgggtgcagc

SEQ ID NO: 492969 - DNA, 25 bp, Mus musculus
ttctacaacgagtgggacatccagg

SEQ ID NO: 492970 - DNA, 25 bp, Mus musculus
ttctacaatatcaaccagggccgct

SEQ ID NO: 492971 - DNA, 25 bp, Mus musculus
ttctacaatgaaggctggaaagacc

SEQ ID NO: 492972 - DNA, 25 bp, Mus musculus
ttctacactaaggagcagccgggtc

SEQ ID NO: 492973 - DNA, 25 bp, Mus musculus
ttctacactccctccaaaggacgat

SEQ ID NO: 492974 - DNA, 25 bp, Mus musculus
ttctacactgcagaggtggcgagcg

SEQ ID NO: 492975 - DNA, 25 bp, Mus musculus
ttctacagtagcagccgagaggcct

SEQ ID NO: 492976 - DNA, 25 bp, Mus musculus
ttctaccaaagtcggccgcagtggc

SEQ ID NO: 492977 - DNA, 25 bp, Mus musculus
ttctaccaactagcaggagagtggc

SEQ ID NO: 492978 - DNA, 25 bp, Mus musculus
ttctaccagtgtgacaggctctcgg

SEQ ID NO: 492979 - DNA, 25 bp, Mus musculus
ttctacccagcaaaagggacttggc

SEQ ID NO: 492980 - DNA, 25 bp, Mus musculus
ttctaccgacagtcgtcagggccgc

SEQ ID NO: 492981 - DNA, 25 bp, Mus musculus
ttctaccgggattgggtgtgcccca

SEQ ID NO: 492982 - DNA, 25 bp, Mus musculus
ttctacctgctgagtactccctgga

SEQ ID NO: 492983 - DNA, 25 bp, Mus musculus
ttctacctggccatggaacgtctcg

SEQ ID NO: 492984 - DNA, 25 bp, Mus musculus
ttctaccttatggaggatggccggc

SEQ ID NO: 492985 - DNA, 25 bp, Mus musculus
ttctacgacaggctgcaggactcag

SEQ ID NO: 492986 - DNA, 25 bp, Mus musculus
ttctacgggagcatccagaccagag

SEQ ID NO: 492987 - DNA, 25 bp, Mus musculus
ttctactcgctggagagtgctcgcg

SEQ ID NO: 492988 - DNA, 25 bp, Mus musculus
ttctacttccggagaccaagggcgt

SEQ ID NO: 492989 - DNA, 25 bp, Mus musculus
ttctagaaatctagggtggacccct

SEQ ID NO: 492990 - DNA, 25 bp, Mus musculus
ttctagacacaggtgctctcctccc

SEQ ID NO: 492991 - DNA, 25 bp, Mus musculus
ttctagaccaatccaaggccagtgc

SEQ ID NO: 492992 - DNA, 25 bp, Mus musculus
ttctagaccttatgagcgacgccct

SEQ ID NO: 492993 - DNA, 25 bp, Mus musculus
ttctagagagtcaccagtgggccca

SEQ ID NO: 492994 - DNA, 25 bp, Mus musculus
ttctagatgctaacagcctcgccgg

SEQ ID NO: 492995 - DNA, 25 bp, Mus musculus
ttctagcagcggagggcaagccttt

SEQ ID NO: 492996 - DNA, 25 bp, Mus musculus
ttctagcaggttatgaaaggccatg

SEQ ID NO: 492997 - DNA, 25 bp, Mus musculus
ttctagcatcaggtaagttgttccc

SEQ ID NO: 492998 - DNA, 25 bp, Mus musculus
ttctagcgcaggctcatccgcctag

SEQ ID NO: 492999 - DNA, 25 bp, Mus musculus
ttctagcgtagtccctgcagtggcg

SEQ ID NO: 493000 - DNA, 25 bp, Mus musculus
ttctagctggttgggtcactctgct

SEQ ID NO: 493001 - DNA, 25 bp, Mus musculus
ttctagcttagagagatgtcccgga

SEQ ID NO: 493002 - DNA, 25 bp, Mus musculus
ttctaggaacacaacgatatggagg

SEQ ID NO: 493003 - DNA, 25 bp, Mus musculus
ttctaggaagatggcgaaggtcact

SEQ ID NO: 493004 - DNA, 25 bp, Mus musculus
ttctaggacccccaggaggacgcgc

SEQ ID NO: 493005 - DNA, 25 bp, Mus musculus
ttctaggaggccataaaggcagggc

SEQ ID NO: 493006 - DNA, 25 bp, Mus musculus
ttctaggatatatgtggtggcccac

SEQ ID NO: 493007 - DNA, 25 bp, Mus musculus
ttctaggcatgagcccgaagtccag

SEQ ID NO: 493008 - DNA, 25 bp, Mus musculus
ttctagggaagaaccaaggcagcca

SEQ ID NO: 493009 - DNA, 25 bp, Mus musculus
ttctagggatgctggaaagataggt

SEQ ID NO: 493010 - DNA, 25 bp, Mus musculus
ttctagggctgaacggcaattccgg

SEQ ID NO: 493011 - DNA, 25 bp, Mus musculus
ttctaggtataaaaacgtggcgcac

SEQ ID NO: 493012 - DNA, 25 bp, Mus musculus
ttctagtaaatcaaacgcctgaggg

SEQ ID NO: 493013 - DNA, 25 bp, Mus musculus
ttctagttcaggtcaccatcagtgg

SEQ ID NO: 493014 - DNA, 25 bp, Mus musculus
ttctataaaagggaggctggcatca

SEQ ID NO: 493015 - DNA, 25 bp, Mus musculus
ttctataactacctaggccccgagg

SEQ ID NO: 493016 - DNA, 25 bp, Mus musculus
ttctatacagatacaaccccagcac

SEQ ID NO: 493017 - DNA, 25 bp, Mus musculus
ttctataccggtgctgacagcaggc

SEQ ID NO: 493018 - DNA, 25 bp, Mus musculus
ttctatcagcgtgcggacatggcca

SEQ ID NO: 493019 - DNA, 25 bp, Mus musculus
ttctatcgtgtgtgtagtgggcctc

SEQ ID NO: 493020 - DNA, 25 bp, Mus musculus
ttctatctcacactgctggctggcg

SEQ ID NO: 493021 - DNA, 25 bp, Mus musculus
ttctatgaacaggtggtccaggcca

SEQ ID NO: 493022 - DNA, 25 bp, Mus musculus
ttctatgagggccacagcaacacag

SEQ ID NO: 493023 - DNA, 25 bp, Mus musculus
ttctatggccgagtggagcacacca

SEQ ID NO: 493024 - DNA, 25 bp, Mus musculus
ttctatgggctctcccctctagcat

SEQ ID NO: 493025 - DNA, 25 bp, Mus musculus
ttctattagcagtcaccagtgggtc

SEQ ID NO: 493026 - DNA, 25 bp, Mus musculus
ttctattgaagtccggagcgatcca

SEQ ID NO: 493027 - DNA, 25 bp, Mus musculus
ttctattggagcatcaacctgggtg

SEQ ID NO: 493028 - DNA, 25 bp, Mus musculus
ttctatttgaggctcactctttgcc

SEQ ID NO: 493029 - DNA, 25 bp, Mus musculus
ttctcaaaacgattaagctcagtgg

SEQ ID NO: 493030 - DNA, 25 bp, Mus musculus
ttctcaaacgcgttttgcaggtcgc

SEQ ID NO: 493031 - DNA, 25 bp, Mus musculus
ttctcaactgtagcgcaggcatggg

SEQ ID NO: 493032 - DNA, 25 bp, Mus musculus
ttctcaagaggccaacgaggttgcc

SEQ ID NO: 493033 - DNA, 25 bp, Mus musculus
ttctcaaggaaacaggttgtgttta

SEQ ID NO: 493034 - DNA, 25 bp, Mus musculus
ttctcacaataaaggctgacccacg

SEQ ID NO: 493035 - DNA, 25 bp, Mus musculus
ttctcacggaggaaaaatggcggcg

SEQ ID NO: 493036 - DNA, 25 bp, Mus musculus
ttctcacggcgtggtgcatttgggc

SEQ ID NO: 493037 - DNA, 25 bp, Mus musculus
ttctcacgggaaacacagtcatctt

SEQ ID NO: 493038 - DNA, 25 bp, Mus musculus
ttctcacgggcgtgggtgccaccca

SEQ ID NO: 493039 - DNA, 25 bp, Mus musculus
ttctcactcctttgacaaaaatcgc

SEQ ID NO: 493040 - DNA, 25 bp, Mus musculus
ttctcactgcgggaagacctcaggg

SEQ ID NO: 493041 - DNA, 25 bp, Mus musculus
ttctcagaactgacaccctcccgga

SEQ ID NO: 493042 - DNA, 25 bp, Mus musculus
ttctcagaagactcagccacgctgc

SEQ ID NO: 493043 - DNA, 25 bp, Mus musculus
ttctcagacaggaaggactcttggc

SEQ ID NO: 493044 - DNA, 25 bp, Mus musculus
ttctcagacgacagaggaagctcca

SEQ ID NO: 493045 - DNA, 25 bp, Mus musculus
ttctcagaggcttgactgtcggtgc

SEQ ID NO: 493046 - DNA, 25 bp, Mus musculus
ttctcagcatgaaagtgaagggtct

SEQ ID NO: 493047 - DNA, 25 bp, Mus musculus
ttctcagccccgatggtatccggag

SEQ ID NO: 493048 - DNA, 25 bp, Mus musculus
ttctcaggtctgtaccaggcgcacg

SEQ ID NO: 493049 - DNA, 25 bp, Mus musculus
ttctcagtagaggaggagcgctttt

SEQ ID NO: 493050 - DNA, 25 bp, Mus musculus
ttctcagtccgagctgggtacgctg

SEQ ID NO: 493051 - DNA, 25 bp, Mus musculus
ttctcagttctagttcttgtaccac

SEQ ID NO: 493052 - DNA, 25 bp, Mus musculus
ttctcatagtacctcatctcccagg

SEQ ID NO: 493053 - DNA, 25 bp, Mus musculus
ttctcatatctgttgactgctctga

SEQ ID NO: 493054 - DNA, 25 bp, Mus musculus
ttctcatcatgttgagcctcctgcc

SEQ ID NO: 493055 - DNA, 25 bp, Mus musculus
ttctcatcgcgctggctgccaagtg

SEQ ID NO: 493056 - DNA, 25 bp, Mus musculus
ttctcatctatgtgaccagaggccc

SEQ ID NO: 493057 - DNA, 25 bp, Mus musculus
ttctcatctgagagcctggccaatc

SEQ ID NO: 493058 - DNA, 25 bp, Mus musculus
ttctcatgaggcaaaaatgcactcc

SEQ ID NO: 493059 - DNA, 25 bp, Mus musculus
ttctcattgtgagccaaggcctctg

SEQ ID NO: 493060 - DNA, 25 bp, Mus musculus
ttctccacagttgtccaaaatagga

SEQ ID NO: 493061 - DNA, 25 bp, Mus musculus
ttctccagccaacaagcgaaaactc

SEQ ID NO: 493062 - DNA, 25 bp, Mus musculus
ttctccagcgccaccaagaggctga

SEQ ID NO: 493063 - DNA, 25 bp, Mus musculus
ttctccaggaaggtgacggaggctg

SEQ ID NO: 493064 - DNA, 25 bp, Mus musculus
ttctcccagataagctccagcaatg

SEQ ID NO: 493065 - DNA, 25 bp, Mus musculus
ttctcccatggagcagtaaaccagg

SEQ ID NO: 493066 - DNA, 25 bp, Mus musculus
ttctcccctaagtcacataggctag

SEQ ID NO: 493067 - DNA, 25 bp, Mus musculus
ttctccctagtctcggcggcgttag

SEQ ID NO: 493068 - DNA, 25 bp, Mus musculus
ttctccgagaaagtagagccagccg

SEQ ID NO: 493069 - DNA, 25 bp, Mus musculus
ttctccgaggccctggcgagtcgct

SEQ ID NO: 493070 - DNA, 25 bp, Mus musculus
ttctccgaggcgtacaagcgtctag

SEQ ID NO: 493071 - DNA, 25 bp, Mus musculus
ttctccgagggcttggcccaaggca

SEQ ID NO: 493072 - DNA, 25 bp, Mus musculus
ttctccggcatgaagggctgaggct

SEQ ID NO: 493073 - DNA, 25 bp, Mus musculus
ttctccggcgcctattaaatatctg

SEQ ID NO: 493074 - DNA, 25 bp, Mus musculus
ttctccgggaaatccagagcgtgct

SEQ ID NO: 493075 - DNA, 25 bp, Mus musculus
ttctccgtgaaaatggttgaagaca

SEQ ID NO: 493076 - DNA, 25 bp, Mus musculus
ttctcctacaacacaagaaaccagg

SEQ ID NO: 493077 - DNA, 25 bp, Mus musculus
ttctcctacatccaggtggctgcga

SEQ ID NO: 493078 - DNA, 25 bp, Mus musculus
ttctcctaggagtatctcctcacca

SEQ ID NO: 493079 - DNA, 25 bp, Mus musculus
ttctcctcacggagcctgatctctt

SEQ ID NO: 493080 - DNA, 25 bp, Mus musculus
ttctcctccggaagcagctacagca

SEQ ID NO: 493081 - DNA, 25 bp, Mus musculus
ttctcctgaggaagcgcagctctgg

SEQ ID NO: 493082 - DNA, 25 bp, Mus musculus
ttctcctggttgcttcatgaggccc

SEQ ID NO: 493083 - DNA, 25 bp, Mus musculus
ttctcgagaggttcccagcggagca

SEQ ID NO: 493084 - DNA, 25 bp, Mus musculus
ttctcgattaatagagcctgctgcc

SEQ ID NO: 493085 - DNA, 25 bp, Mus musculus
ttctcgccactaccttcttcattgt

SEQ ID NO: 493086 - DNA, 25 bp, Mus musculus
ttctcgctctaaggctgtgaccgag

SEQ ID NO: 493087 - DNA, 25 bp, Mus musculus
ttctcggactgtggccatcacaaca

SEQ ID NO: 493088 - DNA, 25 bp, Mus musculus
ttctcggcacgcctcgcatcgattt

SEQ ID NO: 493089 - DNA, 25 bp, Mus musculus
ttctcggctcctgaagacccggtga

SEQ ID NO: 493090 - DNA, 25 bp, Mus musculus
ttctcggtctgaagcacgcactggg

SEQ ID NO: 493091 - DNA, 25 bp, Mus musculus
ttctcggttgtggacgacggctccg

SEQ ID NO: 493092 - DNA, 25 bp, Mus musculus
ttctcgtcagtaaagtgggtttgga

SEQ ID NO: 493093 - DNA, 25 bp, Mus musculus
ttctcgtccaagcacaaggaggcgc

SEQ ID NO: 493094 - DNA, 25 bp, Mus musculus
ttctcgtccccagtgagctagtgga

SEQ ID NO: 493095 - DNA, 25 bp, Mus musculus
ttctcgtgtgccctgatcttcaggc

SEQ ID NO: 493096 - DNA, 25 bp, Mus musculus
ttctctacaaatcctgggcaactgg

SEQ ID NO: 493097 - DNA, 25 bp, Mus musculus
ttctctacagaaacactgtgcccca

SEQ ID NO: 493098 - DNA, 25 bp, Mus musculus
ttctctagggaaaacaactacttgg

SEQ ID NO: 493099 - DNA, 25 bp, Mus musculus
ttctctagtgtatcgggaaatgctc

SEQ ID NO: 493100 - DNA, 25 bp, Mus musculus
ttctctatcttccaaaaactgttat

SEQ ID NO: 493101 - DNA, 25 bp, Mus musculus
ttctctcaagaagggagctgcagcc

SEQ ID NO: 493102 - DNA, 25 bp, Mus musculus
ttctctcaggatgggcgatgcactc

SEQ ID NO: 493103 - DNA, 25 bp, Mus musculus
ttctctccacaacccaggctgggaa

SEQ ID NO: 493104 - DNA, 25 bp, Mus musculus
ttctctcgcgggacaagtgacttgg

SEQ ID NO: 493105 - DNA, 25 bp, Mus musculus
ttctctcgtggatcgccctgaacag

SEQ ID NO: 493106 - DNA, 25 bp, Mus musculus
ttctctctaagcaccgtgggccaag

SEQ ID NO: 493107 - DNA, 25 bp, Mus musculus
ttctctctctgttgaagcgctctcc

SEQ ID NO: 493108 - DNA, 25 bp, Mus musculus
ttctctgaaaactaagacagaagca

SEQ ID NO: 493109 - DNA, 25 bp, Mus musculus
ttctctgcacaccaccgcgagtgga

SEQ ID NO: 493110 - DNA, 25 bp, Mus musculus
ttctctgcctgggactgcggagtac

SEQ ID NO: 493111 - DNA, 25 bp, Mus musculus
ttctctgggatagcttgcacaaccg

SEQ ID NO: 493112 - DNA, 25 bp, Mus musculus
ttctctgggccaagaaaccagcggc

SEQ ID NO: 493113 - DNA, 25 bp, Mus musculus
ttctctgggccagctatttccagaa

SEQ ID NO: 493114 - DNA, 25 bp, Mus musculus
ttctctgggtggtcaagtcaacggc

SEQ ID NO: 493115 - DNA, 25 bp, Mus musculus
ttctctgtatatagcgctcgctggt

SEQ ID NO: 493116 - DNA, 25 bp, Mus musculus
ttctctgtgctctgcgaatcagcgc

SEQ ID NO: 493117 - DNA, 25 bp, Mus musculus
ttctcttagtcactacagtaccagg

SEQ ID NO: 493118 - DNA, 25 bp, Mus musculus
ttctcttatgagcagaagctgtgga

SEQ ID NO: 493119 - DNA, 25 bp, Mus musculus
ttctcttcaagggacaaggctgccc

SEQ ID NO: 493120 - DNA, 25 bp, Mus musculus
ttctcttcaccaggacaaaacaggc

SEQ ID NO: 493121 - DNA, 25 bp, Mus musculus
ttctcttgacagctttcctcctgac

SEQ ID NO: 493122 - DNA, 25 bp, Mus musculus
ttctcttggagaactagtggtgact

SEQ ID NO: 493123 - DNA, 25 bp, Mus musculus
ttctctttgcttccctcaggcgttt

SEQ ID NO: 493124 - DNA, 25 bp, Mus musculus
ttctctttgtgagccagtgaactgt

SEQ ID NO: 493125 - DNA, 25 bp, Mus musculus
ttctgaaactaccagcaagggtgga

SEQ ID NO: 493126 - DNA, 25 bp, Mus musculus
ttctgaaactagacacggaggccca

SEQ ID NO: 493127 - DNA, 25 bp, Mus musculus
ttctgaaactccacatgctggaaat

SEQ ID NO: 493128 - DNA, 25 bp, Mus musculus
ttctgaaccctgcataagactgagg

SEQ ID NO: 493129 - DNA, 25 bp, Mus musculus
ttctgaagagcaaggacgcactgcc

SEQ ID NO: 493130 - DNA, 25 bp, Mus musculus
ttctgaagcacaagatccggagccg

SEQ ID NO: 493131 - DNA, 25 bp, Mus musculus
ttctgaagcaggaggctggaccgaa

SEQ ID NO: 493132 - DNA, 25 bp, Mus musculus
ttctgaagctgatcccattgatgcc

SEQ ID NO: 493133 - DNA, 25 bp, Mus musculus
ttctgaaggcttccccaaaattcta

SEQ ID NO: 493134 - DNA, 25 bp, Mus musculus
ttctgaagtttcagccagtggatga

SEQ ID NO: 493135 - DNA, 25 bp, Mus musculus
ttctgacagccagtatgacacggcc

SEQ ID NO: 493136 - DNA, 25 bp, Mus musculus
ttctgacaggactgtgtgacagaca

SEQ ID NO: 493137 - DNA, 25 bp, Mus musculus
ttctgacattttgccatagtagtgg

SEQ ID NO: 493138 - DNA, 25 bp, Mus musculus
ttctgaccaccagcaaatagtgaaa

SEQ ID NO: 493139 - DNA, 25 bp, Mus musculus
ttctgaccagatgggcaagccaaca

SEQ ID NO: 493140 - DNA, 25 bp, Mus musculus
ttctgaccaggaacaccctcaatgt

SEQ ID NO: 493141 - DNA, 25 bp, Mus musculus
ttctgactacggacggtgctgctct

SEQ ID NO: 493142 - DNA, 25 bp, Mus musculus
ttctgactcagtggtggagccggcc

SEQ ID NO: 493143 - DNA, 25 bp, Mus musculus
ttctgactccttcctccaacacaca

SEQ ID NO: 493144 - DNA, 25 bp, Mus musculus
ttctgactgcagtaggctgtgggct

SEQ ID NO: 493145 - DNA, 25 bp, Mus musculus
ttctgactgcatatcccaagctgga

SEQ ID NO: 493146 - DNA, 25 bp, Mus musculus
ttctgactggaaagatcgccgaggg

SEQ ID NO: 493147 - DNA, 25 bp, Mus musculus
ttctgactttccttgcctggtggca

SEQ ID NO: 493148 - DNA, 25 bp, Mus musculus
ttctgagaactacctgtcggcctgc

SEQ ID NO: 493149 - DNA, 25 bp, Mus musculus
ttctgagaccctccgaaaagctggc

SEQ ID NO: 493150 - DNA, 25 bp, Mus musculus
ttctgagatcctgggagctgtcaca

SEQ ID NO: 493151 - DNA, 25 bp, Mus musculus
ttctgaggaccatgactttgacccc

SEQ ID NO: 493152 - DNA, 25 bp, Mus musculus
ttctgaggactgctgccagggttcc

SEQ ID NO: 493153 - DNA, 25 bp, Mus musculus
ttctgagggagtattagacagtcaa

SEQ ID NO: 493154 - DNA, 25 bp, Mus musculus
ttctgagggcagaatgggttcttcc

SEQ ID NO: 493155 - DNA, 25 bp, Mus musculus
ttctgagggccgatctggagtcccc

SEQ ID NO: 493156 - DNA, 25 bp, Mus musculus
ttctgagtcttccagcagtgcgggc

SEQ ID NO: 493157 - DNA, 25 bp, Mus musculus
ttctgagtggcagtggagaccctcc

SEQ ID NO: 493158 - DNA, 25 bp, Mus musculus
ttctgatcaaggaaccccagctgca

SEQ ID NO: 493159 - DNA, 25 bp, Mus musculus
ttctgatccgcgaatgctcggaggt

SEQ ID NO: 493160 - DNA, 25 bp, Mus musculus
ttctgatctcaacaaagctgctagt

SEQ ID NO: 493161 - DNA, 25 bp, Mus musculus
ttctgatcttgaagtacgaggcccc

SEQ ID NO: 493162 - DNA, 25 bp, Mus musculus
ttctgatgaatcctggaacatgtcc

SEQ ID NO: 493163 - DNA, 25 bp, Mus musculus
ttctgatgacctggaattggttgca

SEQ ID NO: 493164 - DNA, 25 bp, Mus musculus
ttctgattcagataaactggttagc

SEQ ID NO: 493165 - DNA, 25 bp, Mus musculus
ttctgattgagctcacccaggctgg

SEQ ID NO: 493166 - DNA, 25 bp, Mus musculus
ttctgcaagactgcccttgcgaggc

SEQ ID NO: 493167 - DNA, 25 bp, Mus musculus
ttctgcaaggctaatgacactcgtt

SEQ ID NO: 493168 - DNA, 25 bp, Mus musculus
ttctgcacaaggaagaaagcctggg

SEQ ID NO: 493169 - DNA, 25 bp, Mus musculus
ttctgcacacaagcatactgttgag

SEQ ID NO: 493170 - DNA, 25 bp, Mus musculus
ttctgcaccctccagacctgtggga

SEQ ID NO: 493171 - DNA, 25 bp, Mus musculus
ttctgcacggctgcgctcggtaagg

SEQ ID NO: 493172 - DNA, 25 bp, Mus musculus
ttctgcagatcaaggaaatgaccct

SEQ ID NO: 493173 - DNA, 25 bp, Mus musculus
ttctgcagcgggtccccggagtttg

SEQ ID NO: 493174 - DNA, 25 bp, Mus musculus
ttctgcattagtgcggctggctctg

SEQ ID NO: 493175 - DNA, 25 bp, Mus musculus
ttctgccaaagaccatgacgtgtgt

SEQ ID NO: 493176 - DNA, 25 bp, Mus musculus
ttctgccaacctccaggtccatggt

SEQ ID NO: 493177 - DNA, 25 bp, Mus musculus
ttctgccacctcaaccctgagattg

SEQ ID NO: 493178 - DNA, 25 bp, Mus musculus
ttctgccagggacccatggtcctag

SEQ ID NO: 493179 - DNA, 25 bp, Mus musculus
ttctgcctgagtccaagagacacag

SEQ ID NO: 493180 - DNA, 25 bp, Mus musculus
ttctgcgtcccacggcagaaggaga

SEQ ID NO: 493181 - DNA, 25 bp, Mus musculus
ttctgctaagcatgctaggaaacag

SEQ ID NO: 493182 - DNA, 25 bp, Mus musculus
ttctgctggaacaagcgggtgctga

SEQ ID NO: 493183 - DNA, 25 bp, Mus musculus
ttctgctggagaacgccaaactggc

SEQ ID NO: 493184 - DNA, 25 bp, Mus musculus
ttctgctggttccacaggaaggcaa

SEQ ID NO: 493185 - DNA, 25 bp, Mus musculus
ttctgctgtgggtcaggaggcctct

SEQ ID NO: 493186 - DNA, 25 bp, Mus musculus
ttctgcttaggcacggaactgggca

SEQ ID NO: 493187 - DNA, 25 bp, Mus musculus
ttctgctttcccagccggccaggga

SEQ ID NO: 493188 - DNA, 25 bp, Mus musculus
ttctggaaacgtccgaaatcggctc

SEQ ID NO: 493189 - DNA, 25 bp, Mus musculus
ttctggaaaggaacctgccccgaag

SEQ ID NO: 493190 - DNA, 25 bp, Mus musculus
ttctggaaatggagcgactggaccc

SEQ ID NO: 493191 - DNA, 25 bp, Mus musculus
ttctggaaattcaagcacactgtgc

SEQ ID NO: 493192 - DNA, 25 bp, Mus musculus
ttctggaaccctgttgtggagatgc

SEQ ID NO: 493193 - DNA, 25 bp, Mus musculus
ttctggaagacaggctctccggtgc

SEQ ID NO: 493194 - DNA, 25 bp, Mus musculus
ttctggaagccgtgcaagacctgct

SEQ ID NO: 493195 - DNA, 25 bp, Mus musculus
ttctggaagctttagcgcaagggct

SEQ ID NO: 493196 - DNA, 25 bp, Mus musculus
ttctggacatggtagttataaactg

SEQ ID NO: 493197 - DNA, 25 bp, Mus musculus
ttctggacgaaaaacaatggctcac

SEQ ID NO: 493198 - DNA, 25 bp, Mus musculus
ttctggagaacatcgtgcggcggtc

SEQ ID NO: 493199 - DNA, 25 bp, Mus musculus
ttctggagactaacttgggaaagca

SEQ ID NO: 493200 - DNA, 25 bp, Mus musculus
ttctggagccagcacggcggcacct

SEQ ID NO: 493201 - DNA, 25 bp, Mus musculus
ttctggaggccaaagagcaagtgtg

SEQ ID NO: 493202 - DNA, 25 bp, Mus musculus
ttctggaggctcaaaagatgcaaag

SEQ ID NO: 493203 - DNA, 25 bp, Mus musculus
ttctggagggcgagaacctgaccct

SEQ ID NO: 493204 - DNA, 25 bp, Mus musculus
ttctggatagagacgcagctcgcct

SEQ ID NO: 493205 - DNA, 25 bp, Mus musculus
ttctggatagcagcttcagactcag

SEQ ID NO: 493206 - DNA, 25 bp, Mus musculus
ttctggataggagtacaggatctcc

SEQ ID NO: 493207 - DNA, 25 bp, Mus musculus
ttctggatgaagctagtggcactct

SEQ ID NO: 493208 - DNA, 25 bp, Mus musculus
ttctggatgtcctaaaacccttggg

SEQ ID NO: 493209 - DNA, 25 bp, Mus musculus
ttctggcagtgaactctccacaggg

SEQ ID NO: 493210 - DNA, 25 bp, Mus musculus
ttctggcccaatccggaagtggaca

SEQ ID NO: 493211 - DNA, 25 bp, Mus musculus
ttctggccccgaggatgacaacatc

SEQ ID NO: 493212 - DNA, 25 bp, Mus musculus
ttctggccgaggtgcctgcgtttag

SEQ ID NO: 493213 - DNA, 25 bp, Mus musculus
ttctggcggccctcggacctgagct

SEQ ID NO: 493214 - DNA, 25 bp, Mus musculus
ttctggctcacgctccgactaaagg

SEQ ID NO: 493215 - DNA, 25 bp, Mus musculus
ttctggctgagacccttgagctcca

SEQ ID NO: 493216 - DNA, 25 bp, Mus musculus
ttctggctgcagttcgctgcgctca

SEQ ID NO: 493217 - DNA, 25 bp, Mus musculus
ttctgggaacagagagctcctgacc

SEQ ID NO: 493218 - DNA, 25 bp, Mus musculus
ttctgggactgctgggtagtttgaa

SEQ ID NO: 493219 - DNA, 25 bp, Mus musculus
ttctgggaggagtaccccgcagact

SEQ ID NO: 493220 - DNA, 25 bp, Mus musculus
ttctgggagttgttacccaagggat

SEQ ID NO: 493221 - DNA, 25 bp, Mus musculus
ttctgggataacaggtgtgagtcac

SEQ ID NO: 493222 - DNA, 25 bp, Mus musculus
ttctgggatggtttgttgtccctgg

SEQ ID NO: 493223 - DNA, 25 bp, Mus musculus
ttctgggcatcaacgccaagggcga

SEQ ID NO: 493224 - DNA, 25 bp, Mus musculus
ttctgggcccatcaaagagtttgct

SEQ ID NO: 493225 - DNA, 25 bp, Mus musculus
ttctgggcctgtgcgatagctgtct

SEQ ID NO: 493226 - DNA, 25 bp, Mus musculus
ttctgggcgctgcaaatcatcttcg

SEQ ID NO: 493227 - DNA, 25 bp, Mus musculus
ttctgggctccaacgcagctccgag

SEQ ID NO: 493228 - DNA, 25 bp, Mus musculus
ttctgggctgccatgagggctgtca

SEQ ID NO: 493229 - DNA, 25 bp, Mus musculus
ttctgggtgggcacagtgggacacg

SEQ ID NO: 493230 - DNA, 25 bp, Mus musculus
ttctggtcagcgtggctctgagcca

SEQ ID NO: 493231 - DNA, 25 bp, Mus musculus
ttctggtcctggtcggccgagttcc

SEQ ID NO: 493232 - DNA, 25 bp, Mus musculus
ttctggtggacttgcagaggaccaa

SEQ ID NO: 493233 - DNA, 25 bp, Mus musculus
ttctggtggagaacagagccaatgt

SEQ ID NO: 493234 - DNA, 25 bp, Mus musculus
ttctggtggcatggagaggaccctt

SEQ ID NO: 493235 - DNA, 25 bp, Mus musculus
ttctggtgttgcaaggcacaggtgt

SEQ ID NO: 493236 - DNA, 25 bp, Mus musculus
ttctggttaaccaaacggagctgtt

SEQ ID NO: 493237 - DNA, 25 bp, Mus musculus
ttctgtacgcccttgaatcctatcc

SEQ ID NO: 493238 - DNA, 25 bp, Mus musculus
ttctgtatgtacaagtaaaactaca

SEQ ID NO: 493239 - DNA, 25 bp, Mus musculus
ttctgtcagaatgtcccaggcttgc

SEQ ID NO: 493240 - DNA, 25 bp, Mus musculus
ttctgtcccgctttcctgtctgttg

SEQ ID NO: 493241 - DNA, 25 bp, Mus musculus
ttctgtcccgtgtgcctgagagcct

SEQ ID NO: 493242 - DNA, 25 bp, Mus musculus
ttctgtccgctcaggtgagaagggc

SEQ ID NO: 493243 - DNA, 25 bp, Mus musculus
ttctgtcgctgtggttaaaacgccg

SEQ ID NO: 493244 - DNA, 25 bp, Mus musculus
ttctgtctagaacccaaagtccgag

SEQ ID NO: 493245 - DNA, 25 bp, Mus musculus
ttctgtctccgcagggagtggcacc

SEQ ID NO: 493246 - DNA, 25 bp, Mus musculus
ttctgtgagtagcaaatccctggag

SEQ ID NO: 493247 - DNA, 25 bp, Mus musculus
ttctgtgatcggcagagataagcag

SEQ ID NO: 493248 - DNA, 25 bp, Mus musculus
ttctgtgccactgcatgaagcctgg

SEQ ID NO: 493249 - DNA, 25 bp, Mus musculus
ttctgtgcgctgtgccccggtgtgt

SEQ ID NO: 493250 - DNA, 25 bp, Mus musculus
ttctgtggacaaagaaagtcaccta

SEQ ID NO: 493251 - DNA, 25 bp, Mus musculus
ttctgtggcgtaaggacatccgcag

SEQ ID NO: 493252 - DNA, 25 bp, Mus musculus
ttctgtgggagtctctgtcgccgcc

SEQ ID NO: 493253 - DNA, 25 bp, Mus musculus
ttctgtgtgtaggaactgaatgagt

SEQ ID NO: 493254 - DNA, 25 bp, Mus musculus
ttctgtgtgtcaagccggaggtcca

SEQ ID NO: 493255 - DNA, 25 bp, Mus musculus
ttctgtgttggtacggtagccttgg

SEQ ID NO: 493256 - DNA, 25 bp, Mus musculus
ttctgttctgggacactcgggaggc

SEQ ID NO: 493257 - DNA, 25 bp, Mus musculus
ttctgttggcgtgccacctggaaga

SEQ ID NO: 493258 - DNA, 25 bp, Mus musculus
ttcttaaagggccagcccgccggag

SEQ ID NO: 493259 - DNA, 25 bp, Mus musculus
ttcttaactggagatcactgactgc

SEQ ID NO: 493260 - DNA, 25 bp, Mus musculus
ttcttaccaggagaggagtgagcct

SEQ ID NO: 493261 - DNA, 25 bp, Mus musculus
ttcttacctgcagaacgcaagcggc

SEQ ID NO: 493262 - DNA, 25 bp, Mus musculus
ttcttacgccgtcccggaacaggat

SEQ ID NO: 493263 - DNA, 25 bp, Mus musculus
ttcttagatgctaaccctgggccct

SEQ ID NO: 493264 - DNA, 25 bp, Mus musculus
ttcttagctcctggttagaccacca

SEQ ID NO: 493265 - DNA, 25 bp, Mus musculus
ttcttagtacagaccgtggccaggc

SEQ ID NO: 493266 - DNA, 25 bp, Mus musculus
ttcttagtagaaggcctggactcgc

SEQ ID NO: 493267 - DNA, 25 bp, Mus musculus
ttcttatccccatcggtattacagg

SEQ ID NO: 493268 - DNA, 25 bp, Mus musculus
ttcttcaagaggagaggctggcgca

SEQ ID NO: 493269 - DNA, 25 bp, Mus musculus
ttcttcagcaagagaccccaggaga

SEQ ID NO: 493270 - DNA, 25 bp, Mus musculus
ttcttcagcaagatacggacctagc

SEQ ID NO: 493271 - DNA, 25 bp, Mus musculus
ttcttcagcagagtggactttgcca

SEQ ID NO: 493272 - DNA, 25 bp, Mus musculus
ttcttcagggacgactatgagggct

SEQ ID NO: 493273 - DNA, 25 bp, Mus musculus
ttcttcatccaagcatgtcgtggag

SEQ ID NO: 493274 - DNA, 25 bp, Mus musculus
ttcttccacaataaggaaatggagg

SEQ ID NO: 493275 - DNA, 25 bp, Mus musculus
ttcttccagaagtcaatgggcaccg

SEQ ID NO: 493276 - DNA, 25 bp, Mus musculus
ttcttccgaagagaccaaggccgat

SEQ ID NO: 493277 - DNA, 25 bp, Mus musculus
ttcttccgcagcttccccaggaaag

SEQ ID NO: 493278 - DNA, 25 bp, Mus musculus
ttcttcctaattgttcactcaaaag

SEQ ID NO: 493279 - DNA, 25 bp, Mus musculus
ttcttcctggatgtagccaccctgg

SEQ ID NO: 493280 - DNA, 25 bp, Mus musculus
ttcttccttttttgtgaggcgaggt

SEQ ID NO: 493281 - DNA, 25 bp, Mus musculus
ttcttcgcgttagtggttgccctgc

SEQ ID NO: 493282 - DNA, 25 bp, Mus musculus
ttcttcgtgatctccaaatctgggc

SEQ ID NO: 493283 - DNA, 25 bp, Mus musculus
ttcttcgtggccatgagcagcaggg

SEQ ID NO: 493284 - DNA, 25 bp, Mus musculus
ttcttctactacaacaaagagaggg

SEQ ID NO: 493285 - DNA, 25 bp, Mus musculus
ttcttctatttacaatggccccgag

SEQ ID NO: 493286 - DNA, 25 bp, Mus musculus
ttcttctccgacattaaacaggctt

SEQ ID NO: 493287 - DNA, 25 bp, Mus musculus
ttcttctgaaacatgaacatgctca

SEQ ID NO: 493288 - DNA, 25 bp, Mus musculus
ttcttctgggttgggattagagcgt

SEQ ID NO: 493289 - DNA, 25 bp, Mus musculus
ttcttcttcagacgccatgggacgc

SEQ ID NO: 493290 - DNA, 25 bp, Mus musculus
ttcttgaaaagtggtggtctgcccc

SEQ ID NO: 493291 - DNA, 25 bp, Mus musculus
ttcttgaacaaggattataagcaag

SEQ ID NO: 493292 - DNA, 25 bp, Mus musculus
ttcttgaaggcaaagcacagggcag

SEQ ID NO: 493293 - DNA, 25 bp, Mus musculus
ttcttgacagaaagggagcatgccc

SEQ ID NO: 493294 - DNA, 25 bp, Mus musculus
ttcttgcaagatcgctaccgcctgg

SEQ ID NO: 493295 - DNA, 25 bp, Mus musculus
ttcttgccccagaagtcctaacaga

SEQ ID NO: 493296 - DNA, 25 bp, Mus musculus
ttcttgccccgcctgatgtgcggct

SEQ ID NO: 493297 - DNA, 25 bp, Mus musculus
ttcttgcttggagctcagacaacaa

SEQ ID NO: 493298 - DNA, 25 bp, Mus musculus
ttcttggacaggatcccctcaggcc

SEQ ID NO: 493299 - DNA, 25 bp, Mus musculus
ttcttggccacaagggtagtgtcgg

SEQ ID NO: 493300 - DNA, 25 bp, Mus musculus
ttcttggccacacgaaccaggaaga

SEQ ID NO: 493301 - DNA, 25 bp, Mus musculus
ttcttggccccaggtactttggact

SEQ ID NO: 493302 - DNA, 25 bp, Mus musculus
ttcttggcgattacaggcgggatcc

SEQ ID NO: 493303 - DNA, 25 bp, Mus musculus
ttcttgggtacaaaaaaggccagca

SEQ ID NO: 493304 - DNA, 25 bp, Mus musculus
ttcttggtcaaatccggctacgcct

SEQ ID NO: 493305 - DNA, 25 bp, Mus musculus
ttcttggtcctagggaggctgcgtc

SEQ ID NO: 493306 - DNA, 25 bp, Mus musculus
ttcttggtgaagttcgtgcgatccc

SEQ ID NO: 493307 - DNA, 25 bp, Mus musculus
ttcttggttagaacccagaaaggct

SEQ ID NO: 493308 - DNA, 25 bp, Mus musculus
ttcttgtagcctgggaaccatgact

SEQ ID NO: 493309 - DNA, 25 bp, Mus musculus
ttcttgtcgtcttaaccatggtggg

SEQ ID NO: 493310 - DNA, 25 bp, Mus musculus
ttcttgtggatggactgctgctgca

SEQ ID NO: 493311 - DNA, 25 bp, Mus musculus
ttctttaaaaccacacccagtccag

SEQ ID NO: 493312 - DNA, 25 bp, Mus musculus
ttctttaaatgtgggcaaatacaca

SEQ ID NO: 493313 - DNA, 25 bp, Mus musculus
ttctttatccggagcaccttggcca

SEQ ID NO: 493314 - DNA, 25 bp, Mus musculus
ttctttatctgacccacactcgatg

SEQ ID NO: 493315 - DNA, 25 bp, Mus musculus
ttctttcaagtggagccagccggcc

SEQ ID NO: 493316 - DNA, 25 bp, Mus musculus
ttctttcagctggaggacttgccca

SEQ ID NO: 493317 - DNA, 25 bp, Mus musculus
ttctttccccacaataactcctatg

SEQ ID NO: 493318 - DNA, 25 bp, Mus musculus
ttctttccgggacctaacagcggcg

SEQ ID NO: 493319 - DNA, 25 bp, Mus musculus
ttctttctgccctgctggtgtgcca

SEQ ID NO: 493320 - DNA, 25 bp, Mus musculus
ttctttctgtgttgacagggtggaa

SEQ ID NO: 493321 - DNA, 25 bp, Mus musculus
ttctttctgtgttggtacggtagcc

SEQ ID NO: 493322 - DNA, 25 bp, Mus musculus
ttctttgaaggaccccgttcatgtc

SEQ ID NO: 493323 - DNA, 25 bp, Mus musculus
ttctttggaagaagcccagccgcag

SEQ ID NO: 493324 - DNA, 25 bp, Mus musculus
ttctttggcccatcctgtttcttgt

SEQ ID NO: 493325 - DNA, 25 bp, Mus musculus
ttctttgggtagtctcggagcacgc

SEQ ID NO: 493326 - DNA, 25 bp, Mus musculus
ttcttttcttcctgtaaggccccag

SEQ ID NO: 493327 - DNA, 25 bp, Mus musculus
ttcttttggagcaacgacccgcctt

SEQ ID NO: 493328 - DNA, 25 bp, Mus musculus
ttctttttcagtggcattgaaccag

SEQ ID NO: 493329 - DNA, 25 bp, Mus musculus
ttgaaaaaatgggtcaaggagctga

SEQ ID NO: 493330 - DNA, 25 bp, Mus musculus
ttgaaaaagcctacgacatcctccg

SEQ ID NO: 493331 - DNA, 25 bp, Mus musculus
ttgaaaaaggccaccgagtacgtgc

SEQ ID NO: 493332 - DNA, 25 bp, Mus musculus
ttgaaaaatgttcacccgatacatg

SEQ ID NO: 493333 - DNA, 25 bp, Mus musculus
ttgaaaacaaggttccagagaaaca

SEQ ID NO: 493334 - DNA, 25 bp, Mus musculus
ttgaaaacctagatggaccagcttg

SEQ ID NO: 493335 - DNA, 25 bp, Mus musculus
ttgaaaagcaggacgctaggaggcc

SEQ ID NO: 493336 - DNA, 25 bp, Mus musculus
ttgaaaagcgccagcagatcctgac

SEQ ID NO: 493337 - DNA, 25 bp, Mus musculus
ttgaaaatgatgactgccacctgcc

SEQ ID NO: 493338 - DNA, 25 bp, Mus musculus
ttgaaaatggctgcatccggcgacc

SEQ ID NO: 493339 - DNA, 25 bp, Mus musculus
ttgaaaattacaccggagcacgctg

SEQ ID NO: 493340 - DNA, 25 bp, Mus musculus
ttgaaaccaacagggcaggtgaggc

SEQ ID NO: 493341 - DNA, 25 bp, Mus musculus
ttgaaaccagtgtcggctaaggcct

SEQ ID NO: 493342 - DNA, 25 bp, Mus musculus
ttgaaacgaaagaagaccccacgct

SEQ ID NO: 493343 - DNA, 25 bp, Mus musculus
ttgaaacggaacgtaacagcccacg

SEQ ID NO: 493344 - DNA, 25 bp, Mus musculus
ttgaaacttgcaccccgcatggagg

SEQ ID NO: 493345 - DNA, 25 bp, Mus musculus
ttgaaagactggtggaaatcctgtg

SEQ ID NO: 493346 - DNA, 25 bp, Mus musculus
ttgaaagagaccatgggcagagcct

SEQ ID NO: 493347 - DNA, 25 bp, Mus musculus
ttgaaagagcagactcatagcaccc

SEQ ID NO: 493348 - DNA, 25 bp, Mus musculus
ttgaaagccacaactgactgtggcc

SEQ ID NO: 493349 - DNA, 25 bp, Mus musculus
ttgaaagcgcaaaactccgagctgg

SEQ ID NO: 493350 - DNA, 25 bp, Mus musculus
ttgaaaggcatctccaaggcgctgg

SEQ ID NO: 493351 - DNA, 25 bp, Mus musculus
ttgaaagggaagactcctacctggg

SEQ ID NO: 493352 - DNA, 25 bp, Mus musculus
ttgaaagggaccttggccaccctgg

SEQ ID NO: 493353 - DNA, 25 bp, Mus musculus
ttgaaaggtggccacatggaccgac

SEQ ID NO: 493354 - DNA, 25 bp, Mus musculus
ttgaaatcataaagacccatcgtcc

SEQ ID NO: 493355 - DNA, 25 bp, Mus musculus
ttgaaatgaagcttcgccgcgcaaa

SEQ ID NO: 493356 - DNA, 25 bp, Mus musculus
ttgaaatgctggacatgaaatatcc

SEQ ID NO: 493357 - DNA, 25 bp, Mus musculus
ttgaaatggtgctcctcaacccgga

SEQ ID NO: 493358 - DNA, 25 bp, Mus musculus
ttgaaatgtatgtctcgggccgagg

SEQ ID NO: 493359 - DNA, 25 bp, Mus musculus
ttgaacaagatctccaaccggacgg

SEQ ID NO: 493360 - DNA, 25 bp, Mus musculus
ttgaacaagcctagcctgacagcac

SEQ ID NO: 493361 - DNA, 25 bp, Mus musculus
ttgaacacaggatccagctccattt

SEQ ID NO: 493362 - DNA, 25 bp, Mus musculus
ttgaacaccgtgcagagtcccggga

SEQ ID NO: 493363 - DNA, 25 bp, Mus musculus
ttgaacacctctttacaatcccagg

SEQ ID NO: 493364 - DNA, 25 bp, Mus musculus
ttgaacatggcagtgcaagtggccg

SEQ ID NO: 493365 - DNA, 25 bp, Mus musculus
ttgaacattgaccagacagccacct

SEQ ID NO: 493366 - DNA, 25 bp, Mus musculus
ttgaaccctttggacggtgacccag

SEQ ID NO: 493367 - DNA, 25 bp, Mus musculus
ttgaaccgacagagcatggaggcgc

SEQ ID NO: 493368 - DNA, 25 bp, Mus musculus
ttgaacctccgcaacgtgtcgtggg

SEQ ID NO: 493369 - DNA, 25 bp, Mus musculus
ttgaacctggactgcagaaggcccc

SEQ ID NO: 493370 - DNA, 25 bp, Mus musculus
ttgaacctttcaaagcccaggctgg

SEQ ID NO: 493371 - DNA, 25 bp, Mus musculus
ttgaacgatacctcagtgcgggccc

SEQ ID NO: 493372 - DNA, 25 bp, Mus musculus
ttgaacgcacgctctccaatcctga

SEQ ID NO: 493373 - DNA, 25 bp, Mus musculus
ttgaactttccaaaacctagcgagg

SEQ ID NO: 493374 - DNA, 25 bp, Mus musculus
ttgaactttgaatcctctgcctcgt

SEQ ID NO: 493375 - DNA, 25 bp, Mus musculus
ttgaagaaaaagtcccagtcagtgg

SEQ ID NO: 493376 - DNA, 25 bp, Mus musculus
ttgaagaaaacagggccgtcgttgg

SEQ ID NO: 493377 - DNA, 25 bp, Mus musculus
ttgaagaacagctaaccctcgaggg

SEQ ID NO: 493378 - DNA, 25 bp, Mus musculus
ttgaagaaccgaccctcgcggcagc

SEQ ID NO: 493379 - DNA, 25 bp, Mus musculus
ttgaagacccaaccggtgctccggt

SEQ ID NO: 493380 - DNA, 25 bp, Mus musculus
ttgaagacggccagcagaggtgcta

SEQ ID NO: 493381 - DNA, 25 bp, Mus musculus
ttgaagactgctgcctgggttacca

SEQ ID NO: 493382 - DNA, 25 bp, Mus musculus
ttgaagagaccactgcagacaaccg

SEQ ID NO: 493383 - DNA, 25 bp, Mus musculus
ttgaagaggcaccacatcacggagg

SEQ ID NO: 493384 - DNA, 25 bp, Mus musculus
ttgaagatgccctgagaaaccagcc

SEQ ID NO: 493385 - DNA, 25 bp, Mus musculus
ttgaagcaggaccaactggccttcc

SEQ ID NO: 493386 - DNA, 25 bp, Mus musculus
ttgaagccccacatgtacctcgagg

SEQ ID NO: 493387 - DNA, 25 bp, Mus musculus
ttgaagctctggtcaaagcaggcct

SEQ ID NO: 493388 - DNA, 25 bp, Mus musculus
ttgaagctgcccctgatcttttcag

SEQ ID NO: 493389 - DNA, 25 bp, Mus musculus
ttgaaggagaccaccagtaagcgca

SEQ ID NO: 493390 - DNA, 25 bp, Mus musculus
ttgaaggccttacccaacaccagag

SEQ ID NO: 493391 - DNA, 25 bp, Mus musculus
ttgaagggattttctggctacccgg

SEQ ID NO: 493392 - DNA, 25 bp, Mus musculus
ttgaagggtctcagaaaccgagccg

SEQ ID NO: 493393 - DNA, 25 bp, Mus musculus
ttgaagtatcctccaagccctgcag

SEQ ID NO: 493394 - DNA, 25 bp, Mus musculus
ttgaagtcacggagaaagagacccc

SEQ ID NO: 493395 - DNA, 25 bp, Mus musculus
ttgaagtggtcaaggctggagacct

SEQ ID NO: 493396 - DNA, 25 bp, Mus musculus
ttgaagtgtgaaccagatgagcctc

SEQ ID NO: 493397 - DNA, 25 bp, Mus musculus
ttgaagttcctctgaatcacaaacg

SEQ ID NO: 493398 - DNA, 25 bp, Mus musculus
ttgaagttcgcccaggagaccgcgt

SEQ ID NO: 493399 - DNA, 25 bp, Mus musculus
ttgaagttgccttgatcgcctgccc

SEQ ID NO: 493400 - DNA, 25 bp, Mus musculus
ttgaataatccttgcctgccttggg

SEQ ID NO: 493401 - DNA, 25 bp, Mus musculus
ttgaatactaactgccaaggccagg

SEQ ID NO: 493402 - DNA, 25 bp, Mus musculus
ttgaatacttttgggaagacaccct

SEQ ID NO: 493403 - DNA, 25 bp, Mus musculus
ttgaatatcatagtcctgggtttgg

SEQ ID NO: 493404 - DNA, 25 bp, Mus musculus
ttgaatccaaagcaaaccacctggg

SEQ ID NO: 493405 - DNA, 25 bp, Mus musculus
ttgaatccgcacatttagaaggcag

SEQ ID NO: 493406 - DNA, 25 bp, Mus musculus
ttgaatggcaattcccaaggatgga

SEQ ID NO: 493407 - DNA, 25 bp, Mus musculus
ttgaatggccctgtgaggcaacccc

SEQ ID NO: 493408 - DNA, 25 bp, Mus musculus
ttgaatggctgttgacccagggcac

SEQ ID NO: 493409 - DNA, 25 bp, Mus musculus
ttgaatgtgccatgaccctctccct

SEQ ID NO: 493410 - DNA, 25 bp, Mus musculus
ttgaattgcacccacgccactcatt

SEQ ID NO: 493411 - DNA, 25 bp, Mus musculus
ttgaattggcaatcacgcaactggc

SEQ ID NO: 493412 - DNA, 25 bp, Mus musculus
ttgacaaaaagatttcccggctgga

SEQ ID NO: 493413 - DNA, 25 bp, Mus musculus
ttgacaagagatccctcaaggagga

SEQ ID NO: 493414 - DNA, 25 bp, Mus musculus
ttgacaagatcgctgctcaaggccg

SEQ ID NO: 493415 - DNA, 25 bp, Mus musculus
ttgacaagtgctccggagccttgcc

SEQ ID NO: 493416 - DNA, 25 bp, Mus musculus
ttgacacagcaatccaggaaatcct

SEQ ID NO: 493417 - DNA, 25 bp, Mus musculus
ttgacaccactttatacactgacag

SEQ ID NO: 493418 - DNA, 25 bp, Mus musculus
ttgacagaagcctgccgtggagcga

SEQ ID NO: 493419 - DNA, 25 bp, Mus musculus
ttgacagagcccaaagcattgctgg

SEQ ID NO: 493420 - DNA, 25 bp, Mus musculus
ttgacagagtcccacgatcgacagg

SEQ ID NO: 493421 - DNA, 25 bp, Mus musculus
ttgacaggaccaggagcggctcttt

SEQ ID NO: 493422 - DNA, 25 bp, Mus musculus
ttgacagggctgtttatctgctcag

SEQ ID NO: 493423 - DNA, 25 bp, Mus musculus
ttgacagtcaaaacatgactgtgtg

SEQ ID NO: 493424 - DNA, 25 bp, Mus musculus
ttgacatcatcttccaccagacctg

SEQ ID NO: 493425 - DNA, 25 bp, Mus musculus
ttgacatcgtcagagcgaacacgtt

SEQ ID NO: 493426 - DNA, 25 bp, Mus musculus
ttgacatctttaggcttccagaaca

SEQ ID NO: 493427 - DNA, 25 bp, Mus musculus
ttgacattgtccttgtaaaaccaca

SEQ ID NO: 493428 - DNA, 25 bp, Mus musculus
ttgaccacagaggagagactgacct

SEQ ID NO: 493429 - DNA, 25 bp, Mus musculus
ttgaccactggatgctagacacccc

SEQ ID NO: 493430 - DNA, 25 bp, Mus musculus
ttgaccagggcagaaccatcctgag

SEQ ID NO: 493431 - DNA, 25 bp, Mus musculus
ttgaccccagcgattggataggact

SEQ ID NO: 493432 - DNA, 25 bp, Mus musculus
ttgaccctcaaagaagtagattact

SEQ ID NO: 493433 - DNA, 25 bp, Mus musculus
ttgaccctggtgaacgtgacgagcg

SEQ ID NO: 493434 - DNA, 25 bp, Mus musculus
ttgaccgagcttagcttcctgagag

SEQ ID NO: 493435 - DNA, 25 bp, Mus musculus
ttgaccggccccatgaatgagaacc

SEQ ID NO: 493436 - DNA, 25 bp, Mus musculus
ttgacctaccgattggatcccagcg

SEQ ID NO: 493437 - DNA, 25 bp, Mus musculus
ttgacctcgccaagaaggacatatt

SEQ ID NO: 493438 - DNA, 25 bp, Mus musculus
ttgacctcgggttggacacacctgc

SEQ ID NO: 493439 - DNA, 25 bp, Mus musculus
ttgacctgagtgctgggtccagctt

SEQ ID NO: 493440 - DNA, 25 bp, Mus musculus
ttgacctggaccgtggagtgcttcg

SEQ ID NO: 493441 - DNA, 25 bp, Mus musculus
ttgaccttctagacattgctctgaa

SEQ ID NO: 493442 - DNA, 25 bp, Mus musculus
ttgacctttggtgcacacacgccgt

SEQ ID NO: 493443 - DNA, 25 bp, Mus musculus
ttgacgaagacaaaacaagcccgcg

SEQ ID NO: 493444 - DNA, 25 bp, Mus musculus
ttgacgaccattccttaaaagagca

SEQ ID NO: 493445 - DNA, 25 bp, Mus musculus
ttgacggaaggtttcgatccctcgg

SEQ ID NO: 493446 - DNA, 25 bp, Mus musculus
ttgacggacccgcaagcctaatcac

SEQ ID NO: 493447 - DNA, 25 bp, Mus musculus
ttgacggagcacaagcagatccatg

SEQ ID NO: 493448 - DNA, 25 bp, Mus musculus
ttgacgtctgctacaattggctgac

SEQ ID NO: 493449 - DNA, 25 bp, Mus musculus
ttgactaaaacagggagcaccaggc

SEQ ID NO: 493450 - DNA, 25 bp, Mus musculus
ttgactatatgattaaactgtacca

SEQ ID NO: 493451 - DNA, 25 bp, Mus musculus
ttgactcaacaataaagggacatcg

SEQ ID NO: 493452 - DNA, 25 bp, Mus musculus
ttgactcaacagctcctgcgggagg

SEQ ID NO: 493453 - DNA, 25 bp, Mus musculus
ttgactcacattcctggtctctggg

SEQ ID NO: 493454 - DNA, 25 bp, Mus musculus
ttgactcaggaaagcttagccacag

SEQ ID NO: 493455 - DNA, 25 bp, Mus musculus
ttgactcgctggacaagcactcggg

SEQ ID NO: 493456 - DNA, 25 bp, Mus musculus
ttgactcgtgctgagcgtgaggttt

SEQ ID NO: 493457 - DNA, 25 bp, Mus musculus
ttgactctgcaccttcagaatggcg

SEQ ID NO: 493458 - DNA, 25 bp, Mus musculus
ttgactctgccctgtgtgaacctgg

SEQ ID NO: 493459 - DNA, 25 bp, Mus musculus
ttgactctgctgattgccctggctg

SEQ ID NO: 493460 - DNA, 25 bp, Mus musculus
ttgactgaactcacaggctggctgg

SEQ ID NO: 493461 - DNA, 25 bp, Mus musculus
ttgactgggtacattactgagggcc

SEQ ID NO: 493462 - DNA, 25 bp, Mus musculus
ttgactgtggagttgacgtcaatga

SEQ ID NO: 493463 - DNA, 25 bp, Mus musculus
ttgacttcacagaggctcagatccg

SEQ ID NO: 493464 - DNA, 25 bp, Mus musculus
ttgacttccttctccgtgacacgcg

SEQ ID NO: 493465 - DNA, 25 bp, Mus musculus
ttgacttttgtatgacagaacctgg

SEQ ID NO: 493466 - DNA, 25 bp, Mus musculus
ttgagaaacagaaaatgctggaaag

SEQ ID NO: 493467 - DNA, 25 bp, Mus musculus
ttgagaaaggccacccaaacgatcc

SEQ ID NO: 493468 - DNA, 25 bp, Mus musculus
ttgagaacaatgatagatgaccagc

SEQ ID NO: 493469 - DNA, 25 bp, Mus musculus
ttgagaaccgctggcctagagctgt

SEQ ID NO: 493470 - DNA, 25 bp, Mus musculus
ttgagaacgtagaaggactgcctgc

SEQ ID NO: 493471 - DNA, 25 bp, Mus musculus
ttgagaactgtaaaatcaaccagtg

SEQ ID NO: 493472 - DNA, 25 bp, Mus musculus
ttgagaagcgccattcaggtgccca

SEQ ID NO: 493473 - DNA, 25 bp, Mus musculus
ttgagaaggagcgtcattcccagcc

SEQ ID NO: 493474 - DNA, 25 bp, Mus musculus
ttgagaaggcactgaccaccatggt

SEQ ID NO: 493475 - DNA, 25 bp, Mus musculus
ttgagaatcagacccaagtcctgga

SEQ ID NO: 493476 - DNA, 25 bp, Mus musculus
ttgagaatgccacccagctgagatg

SEQ ID NO: 493477 - DNA, 25 bp, Mus musculus
ttgagacaccagctctaaagccagg

SEQ ID NO: 493478 - DNA, 25 bp, Mus musculus
ttgagaccaacttgagttaagtggg

SEQ ID NO: 493479 - DNA, 25 bp, Mus musculus
ttgagacctcgtgcctaaaagagac

SEQ ID NO: 493480 - DNA, 25 bp, Mus musculus
ttgagacgaacaggggggatcccac

SEQ ID NO: 493481 - DNA, 25 bp, Mus musculus
ttgagacggccatgcggttcatccc

SEQ ID NO: 493482 - DNA, 25 bp, Mus musculus
ttgagactctctaaggcagggcgac

SEQ ID NO: 493483 - DNA, 25 bp, Mus musculus
ttgagacttttctatgagcagtgac

SEQ ID NO: 493484 - DNA, 25 bp, Mus musculus
ttgagagcaccatggaccaaagtgg

SEQ ID NO: 493485 - DNA, 25 bp, Mus musculus
ttgagagctcgtgtccccgggctcg

SEQ ID NO: 493486 - DNA, 25 bp, Mus musculus
ttgagaggatcttcgagctggcccg

SEQ ID NO: 493487 - DNA, 25 bp, Mus musculus
ttgagatcggcaacctggcgctgat

SEQ ID NO: 493488 - DNA, 25 bp, Mus musculus
ttgagatgccccagcactgatcggg

SEQ ID NO: 493489 - DNA, 25 bp, Mus musculus
ttgagatgtacaggaaacaactcgc

SEQ ID NO: 493490 - DNA, 25 bp, Mus musculus
ttgagattaacgctagcctggccgc

SEQ ID NO: 493491 - DNA, 25 bp, Mus musculus
ttgagcagctacacatcagaccggg

SEQ ID NO: 493492 - DNA, 25 bp, Mus musculus
ttgagcatcagtctagagccagggc

SEQ ID NO: 493493 - DNA, 25 bp, Mus musculus
ttgagccctctctcttgatcgtaaa

SEQ ID NO: 493494 - DNA, 25 bp, Mus musculus
ttgagccggccagcaagagcttctc

SEQ ID NO: 493495 - DNA, 25 bp, Mus musculus
ttgagcctgcccctccaaattgacg

SEQ ID NO: 493496 - DNA, 25 bp, Mus musculus
ttgagctgaaagagaaccttctggc

SEQ ID NO: 493497 - DNA, 25 bp, Mus musculus
ttgagctggtctgcccatagggagc

SEQ ID NO: 493498 - DNA, 25 bp, Mus musculus
ttgagcttacgtttgttagcaggcg

SEQ ID NO: 493499 - DNA, 25 bp, Mus musculus
ttgaggagagtaacttaacttttcg

SEQ ID NO: 493500 - DNA, 25 bp, Mus musculus
ttgaggagcgccgaaaacttcaccg

SEQ ID NO: 493501 - DNA, 25 bp, Mus musculus
ttgaggcaaaaaagggaggccagcc

SEQ ID NO: 493502 - DNA, 25 bp, Mus musculus
ttgaggcacaacagaaagaggaggc

SEQ ID NO: 493503 - DNA, 25 bp, Mus musculus
ttgaggcactgctcagggagccaga

SEQ ID NO: 493504 - DNA, 25 bp, Mus musculus
ttgaggcgcttgaaaattctcctgg

SEQ ID NO: 493505 - DNA, 25 bp, Mus musculus
ttgaggcgggcatctccaagaacgg

SEQ ID NO: 493506 - DNA, 25 bp, Mus musculus
ttgaggctaactgggctggctgctt

SEQ ID NO: 493507 - DNA, 25 bp, Mus musculus
ttgaggctactctgaagcgacccag

SEQ ID NO: 493508 - DNA, 25 bp, Mus musculus
ttgagggccacatcagcaacatgcg

SEQ ID NO: 493509 - DNA, 25 bp, Mus musculus
ttgagggcctccgaaagaccttgga

SEQ ID NO: 493510 - DNA, 25 bp, Mus musculus
ttgagggtcatgacactacagccag

SEQ ID NO: 493511 - DNA, 25 bp, Mus musculus
ttgagggttcaagccaccctgtggg

SEQ ID NO: 493512 - DNA, 25 bp, Mus musculus
ttgaggtcctgctatcttagttgcc

SEQ ID NO: 493513 - DNA, 25 bp, Mus musculus
ttgaggtcgttctctgtgttgtcca

SEQ ID NO: 493514 - DNA, 25 bp, Mus musculus
ttgagtacttgcttcgcctggccgc

SEQ ID NO: 493515 - DNA, 25 bp, Mus musculus
ttgagtatgtcagatggagccccgc

SEQ ID NO: 493516 - DNA, 25 bp, Mus musculus
ttgagtcagtcctttgcgcccagaa

SEQ ID NO: 493517 - DNA, 25 bp, Mus musculus
ttgagtctcgcaaaagagctgctgc

SEQ ID NO: 493518 - DNA, 25 bp, Mus musculus
ttgagtcttttgcctgggcacagcc

SEQ ID NO: 493519 - DNA, 25 bp, Mus musculus
ttgagtgctcctccgggctcccagt

SEQ ID NO: 493520 - DNA, 25 bp, Mus musculus
ttgagtggaggcaaccagggtaccc

SEQ ID NO: 493521 - DNA, 25 bp, Mus musculus
ttgagtggcacataagcagacctgg

SEQ ID NO: 493522 - DNA, 25 bp, Mus musculus
ttgagtggcccagacacccttggat

SEQ ID NO: 493523 - DNA, 25 bp, Mus musculus
ttgagtttactgtcagaggcgggtc

SEQ ID NO: 493524 - DNA, 25 bp, Mus musculus
ttgataacagcggaaatgataggac

SEQ ID NO: 493525 - DNA, 25 bp, Mus musculus
ttgataaggccatcctgcacagcgt

SEQ ID NO: 493526 - DNA, 25 bp, Mus musculus
ttgatactacaccaggctccggcta

SEQ ID NO: 493527 - DNA, 25 bp, Mus musculus
ttgatagacgccaggaccctaagct

SEQ ID NO: 493528 - DNA, 25 bp, Mus musculus
ttgatagcacaactaaagacagcgc

SEQ ID NO: 493529 - DNA, 25 bp, Mus musculus
ttgatataacaaccaggctggcctg

SEQ ID NO: 493530 - DNA, 25 bp, Mus musculus
ttgatcaagaacatgccaactccca

SEQ ID NO: 493531 - DNA, 25 bp, Mus musculus
ttgatcgcagaggttccggtgaggc

SEQ ID NO: 493532 - DNA, 25 bp, Mus musculus
ttgatctcgtcccagggccggtgct

SEQ ID NO: 493533 - DNA, 25 bp, Mus musculus
ttgatctgacggtgcccttggctgg

SEQ ID NO: 493534 - DNA, 25 bp, Mus musculus
ttgatgaccatcagaaccctcgcct

SEQ ID NO: 493535 - DNA, 25 bp, Mus musculus
ttgatgataccaaccacgagcggga

SEQ ID NO: 493536 - DNA, 25 bp, Mus musculus
ttgatgcaactatcagccaggctga

SEQ ID NO: 493537 - DNA, 25 bp, Mus musculus
ttgatgcgacggacaaaggacaccc

SEQ ID NO: 493538 - DNA, 25 bp, Mus musculus
ttgatggaagctccaccagtgggcc

SEQ ID NO: 493539 - DNA, 25 bp, Mus musculus
ttgatggccaccaaaactagtttga

SEQ ID NO: 493540 - DNA, 25 bp, Mus musculus
ttgatggcccaagaacagaaactgc

SEQ ID NO: 493541 - DNA, 25 bp, Mus musculus
ttgatggcttcttcacacgtgtgca

SEQ ID NO: 493542 - DNA, 25 bp, Mus musculus
ttgatgtcaagagagccctaggagc

SEQ ID NO: 493543 - DNA, 25 bp, Mus musculus
ttgatgtgaccaagatgcggccagg

SEQ ID NO: 493544 - DNA, 25 bp, Mus musculus
ttgattacttaccagctctcgtcag

SEQ ID NO: 493545 - DNA, 25 bp, Mus musculus
ttgattatgaatgaccctccttggc

SEQ ID NO: 493546 - DNA, 25 bp, Mus musculus
ttgattctggagctcaactggcagc

SEQ ID NO: 493547 - DNA, 25 bp, Mus musculus
ttgattgggcttcccctgattggcc

SEQ ID NO: 493548 - DNA, 25 bp, Mus musculus
ttgcaaacccgctgaggtccctgca

SEQ ID NO: 493549 - DNA, 25 bp, Mus musculus
ttgcaaaccgcaagaacatggacct

SEQ ID NO: 493550 - DNA, 25 bp, Mus musculus
ttgcaaacgtcttcgggagaacggt

SEQ ID NO: 493551 - DNA, 25 bp, Mus musculus
ttgcaaagacgtgcgctaggtgccc

SEQ ID NO: 493552 - DNA, 25 bp, Mus musculus
ttgcaaatctgctactgagtcactc

SEQ ID NO: 493553 - DNA, 25 bp, Mus musculus
ttgcaaatgccccaacggagactct

SEQ ID NO: 493554 - DNA, 25 bp, Mus musculus
ttgcaacatttgtggcataatagct

SEQ ID NO: 493555 - DNA, 25 bp, Mus musculus
ttgcaagatggacctgaaccgctct

SEQ ID NO: 493556 - DNA, 25 bp, Mus musculus
ttgcaagctaaaggaaggccacttt

SEQ ID NO: 493557 - DNA, 25 bp, Mus musculus
ttgcaaggccatcaacgtgctaggg

SEQ ID NO: 493558 - DNA, 25 bp, Mus musculus
ttgcaatgcagaaacgggaatccct

SEQ ID NO: 493559 - DNA, 25 bp, Mus musculus
ttgcaatgccttgctgggctttggg

SEQ ID NO: 493560 - DNA, 25 bp, Mus musculus
ttgcacaggcagactcgagatggac

SEQ ID NO: 493561 - DNA, 25 bp, Mus musculus
ttgcaccggagaagacagatgccct

SEQ ID NO: 493562 - DNA, 25 bp, Mus musculus
ttgcacctccaaaaagcatcgatgg

SEQ ID NO: 493563 - DNA, 25 bp, Mus musculus
ttgcacgcccaccttcggtagagca

SEQ ID NO: 493564 - DNA, 25 bp, Mus musculus
ttgcacggctgttacttctgttcca

SEQ ID NO: 493565 - DNA, 25 bp, Mus musculus
ttgcacgggctcgtgtctacagggc

SEQ ID NO: 493566 - DNA, 25 bp, Mus musculus
ttgcactctcgtctattcctgcctg

SEQ ID NO: 493567 - DNA, 25 bp, Mus musculus
ttgcactgatgctcggctgaagacg

SEQ ID NO: 493568 - DNA, 25 bp, Mus musculus
ttgcagagccggtttaaatatgatc

SEQ ID NO: 493569 - DNA, 25 bp, Mus musculus
ttgcagcaatttggccgccctggca

SEQ ID NO: 493570 - DNA, 25 bp, Mus musculus
ttgcagcacccatggcacagtctgt

SEQ ID NO: 493571 - DNA, 25 bp, Mus musculus
ttgcagccagcacggagtcagatgc

SEQ ID NO: 493572 - DNA, 25 bp, Mus musculus
ttgcagcccgggagcttagggtctc

SEQ ID NO: 493573 - DNA, 25 bp, Mus musculus
ttgcagctagggtggccaacgcctt

SEQ ID NO: 493574 - DNA, 25 bp, Mus musculus
ttgcaggcccacgagctgtacttgc

SEQ ID NO: 493575 - DNA, 25 bp, Mus musculus
ttgcaggtgcacaggcagaagtcct

SEQ ID NO: 493576 - DNA, 25 bp, Mus musculus
ttgcaggttccaggtgaaacggact

SEQ ID NO: 493577 - DNA, 25 bp, Mus musculus
ttgcagttcagctctggcggagttt

SEQ ID NO: 493578 - DNA, 25 bp, Mus musculus
ttgcatatctacacaagttccttgg

SEQ ID NO: 493579 - DNA, 25 bp, Mus musculus
ttgcatcagtgacaacacctcagtg

SEQ ID NO: 493580 - DNA, 25 bp, Mus musculus
ttgcatgaggctaaatctgagaacc

SEQ ID NO: 493581 - DNA, 25 bp, Mus musculus
ttgcatgcgagtctgtctcagctgg

SEQ ID NO: 493582 - DNA, 25 bp, Mus musculus
ttgcatggtacttgggacgatcgcc

SEQ ID NO: 493583 - DNA, 25 bp, Mus musculus
ttgcatgtgcaaacagacattgtgc

SEQ ID NO: 493584 - DNA, 25 bp, Mus musculus
ttgcattcttctttacagtctctca

SEQ ID NO: 493585 - DNA, 25 bp, Mus musculus
ttgccaaacccgagaggaatgtccg

SEQ ID NO: 493586 - DNA, 25 bp, Mus musculus
ttgccaaaccgatttgatatgaacg

SEQ ID NO: 493587 - DNA, 25 bp, Mus musculus
ttgccaacacggagaaccctgagct

SEQ ID NO: 493588 - DNA, 25 bp, Mus musculus
ttgccaacagcaacgagcggaggcg

SEQ ID NO: 493589 - DNA, 25 bp, Mus musculus
ttgccaaccggagcaagaagtcgcg

SEQ ID NO: 493590 - DNA, 25 bp, Mus musculus
ttgccaagaaagcaaccaccgactg

SEQ ID NO: 493591 - DNA, 25 bp, Mus musculus
ttgccaattcgatgggaggccccga

SEQ ID NO: 493592 - DNA, 25 bp, Mus musculus
ttgccacaaattcgaagctaacggg

SEQ ID NO: 493593 - DNA, 25 bp, Mus musculus
ttgccacattgtaccagagatgcac

SEQ ID NO: 493594 - DNA, 25 bp, Mus musculus
ttgccacggaacatcaggaaccagg

SEQ ID NO: 493595 - DNA, 25 bp, Mus musculus
ttgccacggagtcgtttctacgcga

SEQ ID NO: 493596 - DNA, 25 bp, Mus musculus
ttgccagaaagtgccgctctgagcc

SEQ ID NO: 493597 - DNA, 25 bp, Mus musculus
ttgccaggaccaccaggaatatcag

SEQ ID NO: 493598 - DNA, 25 bp, Mus musculus
ttgccaggagcctgtttggcgcgac

SEQ ID NO: 493599 - DNA, 25 bp, Mus musculus
ttgccaggctcattaacatgcatgg

SEQ ID NO: 493600 - DNA, 25 bp, Mus musculus
ttgccagtcgcttgcccttcctggg

SEQ ID NO: 493601 - DNA, 25 bp, Mus musculus
ttgcccagctgcgtagcctgcaaga

SEQ ID NO: 493602 - DNA, 25 bp, Mus musculus
ttgcccatcaaggtgtcaggccctg

SEQ ID NO: 493603 - DNA, 25 bp, Mus musculus
ttgccccaggaagctctcgtgagag

SEQ ID NO: 493604 - DNA, 25 bp, Mus musculus
ttgccccagtacctaccctttctgt

SEQ ID NO: 493605 - DNA, 25 bp, Mus musculus
ttgcccctaagcaagatggctgcca

SEQ ID NO: 493606 - DNA, 25 bp, Mus musculus
ttgcccctgggaatccaaggagcca

SEQ ID NO: 493607 - DNA, 25 bp, Mus musculus
ttgcccgcagtagatagatatttag

SEQ ID NO: 493608 - DNA, 25 bp, Mus musculus
ttgccctcaggaccgtgcaggcagc

SEQ ID NO: 493609 - DNA, 25 bp, Mus musculus
ttgccctccacatcctagaagctgt

SEQ ID NO: 493610 - DNA, 25 bp, Mus musculus
ttgccctctgggtcactgtgtatct

SEQ ID NO: 493611 - DNA, 25 bp, Mus musculus
ttgccctggagctgcgtaatccgag

SEQ ID NO: 493612 - DNA, 25 bp, Mus musculus
ttgccgagagctgcaaccacagtca

SEQ ID NO: 493613 - DNA, 25 bp, Mus musculus
ttgccgagggtttcggtcccaactg

SEQ ID NO: 493614 - DNA, 25 bp, Mus musculus
ttgccgcagcccggttctgtgtgga

SEQ ID NO: 493615 - DNA, 25 bp, Mus musculus
ttgccggcatgtgaccagcctgact

SEQ ID NO: 493616 - DNA, 25 bp, Mus musculus
ttgccgtggctgcttgaatgaatcc

SEQ ID NO: 493617 - DNA, 25 bp, Mus musculus
ttgcctagaaactcggaaatcccag

SEQ ID NO: 493618 - DNA, 25 bp, Mus musculus
ttgcctagacaacgagccctgggtc

SEQ ID NO: 493619 - DNA, 25 bp, Mus musculus
ttgcctagcacgatgaatccccgag

SEQ ID NO: 493620 - DNA, 25 bp, Mus musculus
ttgcctcagctgtgggacctggatg

SEQ ID NO: 493621 - DNA, 25 bp, Mus musculus
ttgcctctgtgagcaccgtgctgac

SEQ ID NO: 493622 - DNA, 25 bp, Mus musculus
ttgcctgagccggaatgcacaagtg

SEQ ID NO: 493623 - DNA, 25 bp, Mus musculus
ttgcctgcacccagcagcagttctg

SEQ ID NO: 493624 - DNA, 25 bp, Mus musculus
ttgcctgcgtgcatgttagtgcctg

SEQ ID NO: 493625 - DNA, 25 bp, Mus musculus
ttgcctggcccctcccgtgtgcatt

SEQ ID NO: 493626 - DNA, 25 bp, Mus musculus
ttgcctgggcctacgcttctcctgg

SEQ ID NO: 493627 - DNA, 25 bp, Mus musculus
ttgcctgggcctacggataggccta

SEQ ID NO: 493628 - DNA, 25 bp, Mus musculus
ttgcctgtaggtatgtctgggtaca

SEQ ID NO: 493629 - DNA, 25 bp, Mus musculus
ttgccttccaggagccacataaggg

SEQ ID NO: 493630 - DNA, 25 bp, Mus musculus
ttgcgaatttacatggaccacggtg

SEQ ID NO: 493631 - DNA, 25 bp, Mus musculus
ttgcgacagcgcagaaagccagtgt

SEQ ID NO: 493632 - DNA, 25 bp, Mus musculus
ttgcgactctccttgtctagttcag

SEQ ID NO: 493633 - DNA, 25 bp, Mus musculus
ttgcgcaagtaagtaaactaaagac

SEQ ID NO: 493634 - DNA, 25 bp, Mus musculus
ttgcgccgaggtcagccgaggtggc

SEQ ID NO: 493635 - DNA, 25 bp, Mus musculus
ttgcgcgctctcctccagctaggtt

SEQ ID NO: 493636 - DNA, 25 bp, Mus musculus
ttgcgcgctctgttgcggcctcctg

SEQ ID NO: 493637 - DNA, 25 bp, Mus musculus
ttgcgcgtcaactctatggctccgg

SEQ ID NO: 493638 - DNA, 25 bp, Mus musculus
ttgcgcgtcatgtaccgcggccgct

SEQ ID NO: 493639 - DNA, 25 bp, Mus musculus
ttgcgcttgtctgtgtcatctgcac

SEQ ID NO: 493640 - DNA, 25 bp, Mus musculus
ttgcgggatcacgtggaaaaggcct

SEQ ID NO: 493641 - DNA, 25 bp, Mus musculus
ttgcggtagagtgtagaaatacccc

SEQ ID NO: 493642 - DNA, 25 bp, Mus musculus
ttgcggtccgactctcgccatgaag

SEQ ID NO: 493643 - DNA, 25 bp, Mus musculus
ttgcggtcgacttcccatcctgtga

SEQ ID NO: 493644 - DNA, 25 bp, Mus musculus
ttgcggtggtaaatcttctcccaga

SEQ ID NO: 493645 - DNA, 25 bp, Mus musculus
ttgcgtactgtacggctactgtagg

SEQ ID NO: 493646 - DNA, 25 bp, Mus musculus
ttgcgtgaagctcccgcaaaggaaa

SEQ ID NO: 493647 - DNA, 25 bp, Mus musculus
ttgcgtttcaacatccagcgaggga

SEQ ID NO: 493648 - DNA, 25 bp, Mus musculus
ttgctaacgccatttctgaagtgaa

SEQ ID NO: 493649 - DNA, 25 bp, Mus musculus
ttgctaacggtagggcgagcctgct

SEQ ID NO: 493650 - DNA, 25 bp, Mus musculus
ttgctaagaaatcatggctggcccc

SEQ ID NO: 493651 - DNA, 25 bp, Mus musculus
ttgctaagaaggtaggatgccccac

SEQ ID NO: 493652 - DNA, 25 bp, Mus musculus
ttgctaagacatggcccaggaccag

SEQ ID NO: 493653 - DNA, 25 bp, Mus musculus
ttgctaagaccgagggaaacgtgga

SEQ ID NO: 493654 - DNA, 25 bp, Mus musculus
ttgctagagctgagctgggcgccct

SEQ ID NO: 493655 - DNA, 25 bp, Mus musculus
ttgctagctggtgcacacgcccttt

SEQ ID NO: 493656 - DNA, 25 bp, Mus musculus
ttgctaggaggttctccccaactcc

SEQ ID NO: 493657 - DNA, 25 bp, Mus musculus
ttgctatgccgtgggctggacctca

SEQ ID NO: 493658 - DNA, 25 bp, Mus musculus
ttgctcaaacctggacagacagtcg

SEQ ID NO: 493659 - DNA, 25 bp, Mus musculus
ttgctcaaccaaggccaagtgctcg

SEQ ID NO: 493660 - DNA, 25 bp, Mus musculus
ttgctcaagaccaagcggccagtca

SEQ ID NO: 493661 - DNA, 25 bp, Mus musculus
ttgctcaagtcaaaatcagctttcg

SEQ ID NO: 493662 - DNA, 25 bp, Mus musculus
ttgctcaggacccaaacacatgtga

SEQ ID NO: 493663 - DNA, 25 bp, Mus musculus
ttgctcagtagctgtcatggacctg

SEQ ID NO: 493664 - DNA, 25 bp, Mus musculus
ttgctcatctggattacctcacgtt

SEQ ID NO: 493665 - DNA, 25 bp, Mus musculus
ttgctccaccccagacaactgttgt

SEQ ID NO: 493666 - DNA, 25 bp, Mus musculus
ttgctcccatgccaatatctggaca

SEQ ID NO: 493667 - DNA, 25 bp, Mus musculus
ttgctccttaagacagacaccttgg

SEQ ID NO: 493668 - DNA, 25 bp, Mus musculus
ttgctgaggcctacccaagtggccc

SEQ ID NO: 493669 - DNA, 25 bp, Mus musculus
ttgctgcaactcctggcagccttgg

SEQ ID NO: 493670 - DNA, 25 bp, Mus musculus
ttgctgcaagagctttcagcctttg

SEQ ID NO: 493671 - DNA, 25 bp, Mus musculus
ttgctgcacagcatggaggtggccc

SEQ ID NO: 493672 - DNA, 25 bp, Mus musculus
ttgctgcaggtgttcgccaaggacg

SEQ ID NO: 493673 - DNA, 25 bp, Mus musculus
ttgctgccagggagaaagaatgtcg

SEQ ID NO: 493674 - DNA, 25 bp, Mus musculus
ttgctgcctgaggatcaatatgtag

SEQ ID NO: 493675 - DNA, 25 bp, Mus musculus
ttgctgctaagatagccacccatcc

SEQ ID NO: 493676 - DNA, 25 bp, Mus musculus
ttgctgctctaagccatacgtgtgg

SEQ ID NO: 493677 - DNA, 25 bp, Mus musculus
ttgctgctgggctggtcctactacg

SEQ ID NO: 493678 - DNA, 25 bp, Mus musculus
ttgctgcttgggtccatcttcactt

SEQ ID NO: 493679 - DNA, 25 bp, Mus musculus
ttgctggcttcctccgcgatcagca

SEQ ID NO: 493680 - DNA, 25 bp, Mus musculus
ttgctgtacttcatccggcgaggga

SEQ ID NO: 493681 - DNA, 25 bp, Mus musculus
ttgctgtagcactgcggctctcgtg

SEQ ID NO: 493682 - DNA, 25 bp, Mus musculus
ttgctgtttgatatggccctgacca

SEQ ID NO: 493683 - DNA, 25 bp, Mus musculus
ttgcttcactagtggcctcttcaca

SEQ ID NO: 493684 - DNA, 25 bp, Mus musculus
ttgcttccttatggcgaatgtgggc

SEQ ID NO: 493685 - DNA, 25 bp, Mus musculus
ttgcttcgaggggagaacctggtct

SEQ ID NO: 493686 - DNA, 25 bp, Mus musculus
ttgcttctagaccatggccaaagtt

SEQ ID NO: 493687 - DNA, 25 bp, Mus musculus
ttgcttctccgttctgtcctcacat

SEQ ID NO: 493688 - DNA, 25 bp, Mus musculus
ttgcttgacagaacggtggagactc

SEQ ID NO: 493689 - DNA, 25 bp, Mus musculus
ttgcttgagatgtagaaactaggac

SEQ ID NO: 493690 - DNA, 25 bp, Mus musculus
ttgcttggcttagggcagccctggt

SEQ ID NO: 493691 - DNA, 25 bp, Mus musculus
ttgcttgggtttcacagaagagtct

SEQ ID NO: 493692 - DNA, 25 bp, Mus musculus
ttgctttagcctggcggtcgagctg

SEQ ID NO: 493693 - DNA, 25 bp, Mus musculus
ttgctttgatcaagccgagcgggct

SEQ ID NO: 493694 - DNA, 25 bp, Mus musculus
ttgcttttaacagccagccaggaga

SEQ ID NO: 493695 - DNA, 25 bp, Mus musculus
ttggaaaaccgcaagcagaggcagc

SEQ ID NO: 493696 - DNA, 25 bp, Mus musculus
ttggaaacccatggctcaaagctca

SEQ ID NO: 493697 - DNA, 25 bp, Mus musculus
ttggaaacccggatgaagcagctct

SEQ ID NO: 493698 - DNA, 25 bp, Mus musculus
ttggaaacctcaacacacgggactc

SEQ ID NO: 493699 - DNA, 25 bp, Mus musculus
ttggaaagcaggtcaaagggagccc

SEQ ID NO: 493700 - DNA, 25 bp, Mus musculus
ttggaaagcctgtaagatagacagc

SEQ ID NO: 493701 - DNA, 25 bp, Mus musculus
ttggaaagcgggaagctggccatct

SEQ ID NO: 493702 - DNA, 25 bp, Mus musculus
ttggaaagctatgcccacaccgagt

SEQ ID NO: 493703 - DNA, 25 bp, Mus musculus
ttggaacaacttcgcccagtcacag

SEQ ID NO: 493704 - DNA, 25 bp, Mus musculus
ttggaacacctcaagactcaccgga

SEQ ID NO: 493705 - DNA, 25 bp, Mus musculus
ttggaacagaaggaccacacgtggg

SEQ ID NO: 493706 - DNA, 25 bp, Mus musculus
ttggaacagggtgcaaaagcctcgg

SEQ ID NO: 493707 - DNA, 25 bp, Mus musculus
ttggaacccaccgagctgctgatga

SEQ ID NO: 493708 - DNA, 25 bp, Mus musculus
ttggaactcacttggcagtcaggct

SEQ ID NO: 493709 - DNA, 25 bp, Mus musculus
ttggaactctgacccatggatggag

SEQ ID NO: 493710 - DNA, 25 bp, Mus musculus
ttggaacttccaacgagagcaccga

SEQ ID NO: 493711 - DNA, 25 bp, Mus musculus
ttggaagctgacgtatgaagtcgtc

SEQ ID NO: 493712 - DNA, 25 bp, Mus musculus
ttggaagtgtctgctgcagggcatc

SEQ ID NO: 493713 - DNA, 25 bp, Mus musculus
ttggaagttgtatttcctgcttggc

SEQ ID NO: 493714 - DNA, 25 bp, Mus musculus
ttggaatctggaacattggaatgat

SEQ ID NO: 493715 - DNA, 25 bp, Mus musculus
ttggaatgaagccaaagactggaga

SEQ ID NO: 493716 - DNA, 25 bp, Mus musculus
ttggaatgtaaaggcggcccctgtg

SEQ ID NO: 493717 - DNA, 25 bp, Mus musculus
ttggaattatgtggcccttgacaac

SEQ ID NO: 493718 - DNA, 25 bp, Mus musculus
ttggaattccagacaacggtgagct

SEQ ID NO: 493719 - DNA, 25 bp, Mus musculus
ttggaattccttgcccatcagcagg

SEQ ID NO: 493720 - DNA, 25 bp, Mus musculus
ttggaatttttcctctccagtgggt

SEQ ID NO: 493721 - DNA, 25 bp, Mus musculus
ttggacaaacgctgaacaatgcaag

SEQ ID NO: 493722 - DNA, 25 bp, Mus musculus
ttggacaaccagtagctaagacttg

SEQ ID NO: 493723 - DNA, 25 bp, Mus musculus
ttggacagtgaagaggaaagatgcc

SEQ ID NO: 493724 - DNA, 25 bp, Mus musculus
ttggacatcaagagcctggcaggcg

SEQ ID NO: 493725 - DNA, 25 bp, Mus musculus
ttggacatccaaccatagagactgt

SEQ ID NO: 493726 - DNA, 25 bp, Mus musculus
ttggacattgcgtcaccatgggaag

SEQ ID NO: 493727 - DNA, 25 bp, Mus musculus
ttggaccgcgggagcctctcgaaca

SEQ ID NO: 493728 - DNA, 25 bp, Mus musculus
ttggaccgtgaagacatgggctgcc

SEQ ID NO: 493729 - DNA, 25 bp, Mus musculus
ttggaccgtggtgcgaacctatgcc

SEQ ID NO: 493730 - DNA, 25 bp, Mus musculus
ttggacctggttaatctcctgctga

SEQ ID NO: 493731 - DNA, 25 bp, Mus musculus
ttggacgatgctggccttgccgttt

SEQ ID NO: 493732 - DNA, 25 bp, Mus musculus
ttggactaatccttctactgagagc

SEQ ID NO: 493733 - DNA, 25 bp, Mus musculus
ttggactcaggcgatgcttcttcag

SEQ ID NO: 493734 - DNA, 25 bp, Mus musculus
ttggactccagttcagtacagtgtg

SEQ ID NO: 493735 - DNA, 25 bp, Mus musculus
ttggactcgccgagccctgcgtgag

SEQ ID NO: 493736 - DNA, 25 bp, Mus musculus
ttggactctgaagacacatcctggg

SEQ ID NO: 493737 - DNA, 25 bp, Mus musculus
ttggagaacaagctgatcgccctgg

SEQ ID NO: 493738 - DNA, 25 bp, Mus musculus
ttggagaatattctggcacagctgg

SEQ ID NO: 493739 - DNA, 25 bp, Mus musculus
ttggagacgcgccagatcacatgga

SEQ ID NO: 493740 - DNA, 25 bp, Mus musculus
ttggagatcacattcactggaggac

SEQ ID NO: 493741 - DNA, 25 bp, Mus musculus
ttggagatccactacaaggctgagc

SEQ ID NO: 493742 - DNA, 25 bp, Mus musculus
ttggagatctagagacaagtggact

SEQ ID NO: 493743 - DNA, 25 bp, Mus musculus
ttggagatgccaaaatgaccagcct

SEQ ID NO: 493744 - DNA, 25 bp, Mus musculus
ttggagatgcccctcgagaactgcg

SEQ ID NO: 493745 - DNA, 25 bp, Mus musculus
ttggagatggacaccctacagccac

SEQ ID NO: 493746 - DNA, 25 bp, Mus musculus
ttggagcacaaaagccgatatgagg

SEQ ID NO: 493747 - DNA, 25 bp, Mus musculus
ttggagcacaaagaccgggacgatt

SEQ ID NO: 493748 - DNA, 25 bp, Mus musculus
ttggagcagctcctcaccgagggca

SEQ ID NO: 493749 - DNA, 25 bp, Mus musculus
ttggagcattggtctggccgctgac

SEQ ID NO: 493750 - DNA, 25 bp, Mus musculus
ttggagccaagaaactacggaagct

SEQ ID NO: 493751 - DNA, 25 bp, Mus musculus
ttggagccaagaccagctcacaggg

SEQ ID NO: 493752 - DNA, 25 bp, Mus musculus
ttggagccagagactgactctcggg

SEQ ID NO: 493753 - DNA, 25 bp, Mus musculus
ttggagccagtcaagagcatcagca

SEQ ID NO: 493754 - DNA, 25 bp, Mus musculus
ttggagccgacagcgcaaacgtctt

SEQ ID NO: 493755 - DNA, 25 bp, Mus musculus
ttggagcgcacaggagatcaacgcc

SEQ ID NO: 493756 - DNA, 25 bp, Mus musculus
ttggagctgataggaaaatggctgc

SEQ ID NO: 493757 - DNA, 25 bp, Mus musculus
ttggagctgctgttttcagtggctg

SEQ ID NO: 493758 - DNA, 25 bp, Mus musculus
ttggaggagccaagcaacgagtcat

SEQ ID NO: 493759 - DNA, 25 bp, Mus musculus
ttggaggcggcctttcgctccggca

SEQ ID NO: 493760 - DNA, 25 bp, Mus musculus
ttggagggttgaagacttcgtgtca

SEQ ID NO: 493761 - DNA, 25 bp, Mus musculus
ttggaggtccccactgatcccaggg

SEQ ID NO: 493762 - DNA, 25 bp, Mus musculus
ttggagtactccaacaagcaagtgt

SEQ ID NO: 493763 - DNA, 25 bp, Mus musculus
ttggagtcacccctatgttcgccgt

SEQ ID NO: 493764 - DNA, 25 bp, Mus musculus
ttggagtccaacctatgatgtgtct

SEQ ID NO: 493765 - DNA, 25 bp, Mus musculus
ttggagtgctaaggagattcagcca

SEQ ID NO: 493766 - DNA, 25 bp, Mus musculus
ttggagttagagaccgagaccagcg

SEQ ID NO: 493767 - DNA, 25 bp, Mus musculus
ttggagttctacatgggccggacac

SEQ ID NO: 493768 - DNA, 25 bp, Mus musculus
ttggagttgacatcaagggtgaaaa

SEQ ID NO: 493769 - DNA, 25 bp, Mus musculus
ttggagttgagatgccactggccct

SEQ ID NO: 493770 - DNA, 25 bp, Mus musculus
ttggataccacaggagtgagcctca

SEQ ID NO: 493771 - DNA, 25 bp, Mus musculus
ttggatagcatagaccctgtggcca

SEQ ID NO: 493772 - DNA, 25 bp, Mus musculus
ttggatccagctcgagtcaacgtgc

SEQ ID NO: 493773 - DNA, 25 bp, Mus musculus
ttggatgagcacaaagactttctga

SEQ ID NO: 493774 - DNA, 25 bp, Mus musculus
ttggatgagccaactgtcaaacgcg

SEQ ID NO: 493775 - DNA, 25 bp, Mus musculus
ttggattcaggaagaggcagcgact

SEQ ID NO: 493776 - DNA, 25 bp, Mus musculus
ttggattcccaaaaaagagcagtag

SEQ ID NO: 493777 - DNA, 25 bp, Mus musculus
ttggattcccctgaaccctggcagg

SEQ ID NO: 493778 - DNA, 25 bp, Mus musculus
ttggattgcaaggaaagaggcctct

SEQ ID NO: 493779 - DNA, 25 bp, Mus musculus
ttggattgttcccattcaaggacag

SEQ ID NO: 493780 - DNA, 25 bp, Mus musculus
ttggcaagccaggacgtagctgacg

SEQ ID NO: 493781 - DNA, 25 bp, Mus musculus
ttggcacaggttggcatctttactg

SEQ ID NO: 493782 - DNA, 25 bp, Mus musculus
ttggcacatttttatctctgtgtga

SEQ ID NO: 493783 - DNA, 25 bp, Mus musculus
ttggcaccaacccacagtgatctgg

SEQ ID NO: 493784 - DNA, 25 bp, Mus musculus
ttggcaccccggttgtcccgggctg

SEQ ID NO: 493785 - DNA, 25 bp, Mus musculus
ttggcaccctgtacggcaacgtgtt

SEQ ID NO: 493786 - DNA, 25 bp, Mus musculus
ttggcaccgactcttagcaagcttt

SEQ ID NO: 493787 - DNA, 25 bp, Mus musculus
ttggcaccgtcgagggcagtgacct

SEQ ID NO: 493788 - DNA, 25 bp, Mus musculus
ttggcaccttgtagagcaaatcagc

SEQ ID NO: 493789 - DNA, 25 bp, Mus musculus
ttggcacgggaaggatggaacataa

SEQ ID NO: 493790 - DNA, 25 bp, Mus musculus
ttggcactgatagaatccaggccct

SEQ ID NO: 493791 - DNA, 25 bp, Mus musculus
ttggcactgtcagatacaccgtggg

SEQ ID NO: 493792 - DNA, 25 bp, Mus musculus
ttggcagactatccagccggactct

SEQ ID NO: 493793 - DNA, 25 bp, Mus musculus
ttggcagatcacaggaagccgggct

SEQ ID NO: 493794 - DNA, 25 bp, Mus musculus
ttggcaggccttggtcaaaaagcat

SEQ ID NO: 493795 - DNA, 25 bp, Mus musculus
ttggcagggacagcagcccttcttg

SEQ ID NO: 493796 - DNA, 25 bp, Mus musculus
ttggcagtacgcgagagcggcttct

SEQ ID NO: 493797 - DNA, 25 bp, Mus musculus
ttggcatctctaccagccttactgc

SEQ ID NO: 493798 - DNA, 25 bp, Mus musculus
ttggcatggcgataaatgcgagttc

SEQ ID NO: 493799 - DNA, 25 bp, Mus musculus
ttggcatgggtactgctggctcacc

SEQ ID NO: 493800 - DNA, 25 bp, Mus musculus
ttggcatgtcctcacgaagcagagc

SEQ ID NO: 493801 - DNA, 25 bp, Mus musculus
ttggcattctcacaagtcttggacg

SEQ ID NO: 493802 - DNA, 25 bp, Mus musculus
ttggccaaacgggaaactggcacct

SEQ ID NO: 493803 - DNA, 25 bp, Mus musculus
ttggccaacaatgcagaaatcgacg

SEQ ID NO: 493804 - DNA, 25 bp, Mus musculus
ttggccaagattctgcagtgaagca

SEQ ID NO: 493805 - DNA, 25 bp, Mus musculus
ttggccaagcagaggtaagtctttg

SEQ ID NO: 493806 - DNA, 25 bp, Mus musculus
ttggccaagcctcagccgcgtctgg

SEQ ID NO: 493807 - DNA, 25 bp, Mus musculus
ttggccacacgagcaagggagcgtt

SEQ ID NO: 493808 - DNA, 25 bp, Mus musculus
ttggccacattcgtgcggagcgtga

SEQ ID NO: 493809 - DNA, 25 bp, Mus musculus
ttggccagagtcatctcagaggaaa

SEQ ID NO: 493810 - DNA, 25 bp, Mus musculus
ttggccagtacaaagcacacctctg

SEQ ID NO: 493811 - DNA, 25 bp, Mus musculus
ttggccagtggagcgaatggtcccc

SEQ ID NO: 493812 - DNA, 25 bp, Mus musculus
ttggcccatgtaggcccagaaccat

SEQ ID NO: 493813 - DNA, 25 bp, Mus musculus
ttggccccaagtagccaggacctgg

SEQ ID NO: 493814 - DNA, 25 bp, Mus musculus
ttggccccactatcagaatgcagga

SEQ ID NO: 493815 - DNA, 25 bp, Mus musculus
ttggcccggctcatagaagacaacg

SEQ ID NO: 493816 - DNA, 25 bp, Mus musculus
ttggccctaggtaactaagaccctg

SEQ ID NO: 493817 - DNA, 25 bp, Mus musculus
ttggccctatcagtcgctgctgcag

SEQ ID NO: 493818 - DNA, 25 bp, Mus musculus
ttggccctcatccaacgcggtggag

SEQ ID NO: 493819 - DNA, 25 bp, Mus musculus
ttggccctccacactgacctgatgg

SEQ ID NO: 493820 - DNA, 25 bp, Mus musculus
ttggcccttcaatcaacaagtcctg

SEQ ID NO: 493821 - DNA, 25 bp, Mus musculus
ttggcctcagagaggcccacgggac

SEQ ID NO: 493822 - DNA, 25 bp, Mus musculus
ttggcctgccggagcatcccagagt

SEQ ID NO: 493823 - DNA, 25 bp, Mus musculus
ttggcctggtgcactagatcccggg

SEQ ID NO: 493824 - DNA, 25 bp, Mus musculus
ttggcctgtccaaaatacaagctgg

SEQ ID NO: 493825 - DNA, 25 bp, Mus musculus
ttggcgaacgaacctggaactatgg

SEQ ID NO: 493826 - DNA, 25 bp, Mus musculus
ttggcgaggttgtagccccaaggct

SEQ ID NO: 493827 - DNA, 25 bp, Mus musculus
ttggcgcacagaaggctaaactcgg

SEQ ID NO: 493828 - DNA, 25 bp, Mus musculus
ttggcgggcagaggaaaatcagacc

SEQ ID NO: 493829 - DNA, 25 bp, Mus musculus
ttggcgtagccaagtccgtgccctt

SEQ ID NO: 493830 - DNA, 25 bp, Mus musculus
ttggctaactgatgcccggacactg

SEQ ID NO: 493831 - DNA, 25 bp, Mus musculus
ttggctaataggaaacaagacctgt

SEQ ID NO: 493832 - DNA, 25 bp, Mus musculus
ttggctagcagtcgcctgggatcac

SEQ ID NO: 493833 - DNA, 25 bp, Mus musculus
ttggctccatcaaagtcaggcaggg

SEQ ID NO: 493834 - DNA, 25 bp, Mus musculus
ttggctccgaccagagaattggccg

SEQ ID NO: 493835 - DNA, 25 bp, Mus musculus
ttggctccttcaccttggtctcggt

SEQ ID NO: 493836 - DNA, 25 bp, Mus musculus
ttggctcggacaacccagaacgtat

SEQ ID NO: 493837 - DNA, 25 bp, Mus musculus
ttggctctcattttatgcctagagg

SEQ ID NO: 493838 - DNA, 25 bp, Mus musculus
ttggctctccggaaggtgcactgct

SEQ ID NO: 493839 - DNA, 25 bp, Mus musculus
ttggctcttcccagctggcgaaccg

SEQ ID NO: 493840 - DNA, 25 bp, Mus musculus
ttggctggcattgcatgttatgcta

SEQ ID NO: 493841 - DNA, 25 bp, Mus musculus
ttggctggcttgcttaggacctctg

SEQ ID NO: 493842 - DNA, 25 bp, Mus musculus
ttggctgggtcaacgccctggtgtc

SEQ ID NO: 493843 - DNA, 25 bp, Mus musculus
ttggctgtgctcagccaagtagagc

SEQ ID NO: 493844 - DNA, 25 bp, Mus musculus
ttggcttcctgcactagagattacg

SEQ ID NO: 493845 - DNA, 25 bp, Mus musculus
ttggcttcgtcaggcacaatggctc

SEQ ID NO: 493846 - DNA, 25 bp, Mus musculus
ttggcttgggaatagaaacatgact

SEQ ID NO: 493847 - DNA, 25 bp, Mus musculus
ttggcttgtgcacacgtccgtctcg

SEQ ID NO: 493848 - DNA, 25 bp, Mus musculus
ttggcttttccatacattgtgtgac

SEQ ID NO: 493849 - DNA, 25 bp, Mus musculus
ttgggaaaacctggctgggtctctg

SEQ ID NO: 493850 - DNA, 25 bp, Mus musculus
ttgggaaaattctggccccatgtct

SEQ ID NO: 493851 - DNA, 25 bp, Mus musculus
ttgggaagagtggtaggtaaccatt

SEQ ID NO: 493852 - DNA, 25 bp, Mus musculus
ttgggaagccttaagccgaggagct

SEQ ID NO: 493853 - DNA, 25 bp, Mus musculus
ttgggaaggctggtcagcgctccac

SEQ ID NO: 493854 - DNA, 25 bp, Mus musculus
ttgggacaagaacaaccttcaggct

SEQ ID NO: 493855 - DNA, 25 bp, Mus musculus
ttgggaccgacttcgtccaccaggg

SEQ ID NO: 493856 - DNA, 25 bp, Mus musculus
ttgggactgcgtgacagaggctccc

SEQ ID NO: 493857 - DNA, 25 bp, Mus musculus
ttgggagaactgactgccttgtggc

SEQ ID NO: 493858 - DNA, 25 bp, Mus musculus
ttgggagtcacacagcactaaggca

SEQ ID NO: 493859 - DNA, 25 bp, Mus musculus
ttgggatgcgcatactggtgaagcc

SEQ ID NO: 493860 - DNA, 25 bp, Mus musculus
ttgggatgtgcacttatgcatttgt

SEQ ID NO: 493861 - DNA, 25 bp, Mus musculus
ttgggcaaagaaggttcaatttact

SEQ ID NO: 493862 - DNA, 25 bp, Mus musculus
ttgggcaggtacaaaagggcattcc

SEQ ID NO: 493863 - DNA, 25 bp, Mus musculus
ttgggcatcctatcttaaatcctct

SEQ ID NO: 493864 - DNA, 25 bp, Mus musculus
ttgggccagcaaatccgaatgaacc

SEQ ID NO: 493865 - DNA, 25 bp, Mus musculus
ttgggccccgaagccaaatgaagat

SEQ ID NO: 493866 - DNA, 25 bp, Mus musculus
ttgggccctttggacactctgctgg

SEQ ID NO: 493867 - DNA, 25 bp, Mus musculus
ttgggccgagcagaaacacaccggc

SEQ ID NO: 493868 - DNA, 25 bp, Mus musculus
ttgggcctacaaagccgagtcgtcg

SEQ ID NO: 493869 - DNA, 25 bp, Mus musculus
ttgggcgaggttgtcggtactccgg

SEQ ID NO: 493870 - DNA, 25 bp, Mus musculus
ttgggcgcccctactcatgcttgag

SEQ ID NO: 493871 - DNA, 25 bp, Mus musculus
ttgggcgccgactggaaactgctga

SEQ ID NO: 493872 - DNA, 25 bp, Mus musculus
ttgggcggcacactggcaaggaaga

SEQ ID NO: 493873 - DNA, 25 bp, Mus musculus
ttgggctgggatctgaggctaggct

SEQ ID NO: 493874 - DNA, 25 bp, Mus musculus
ttgggtcacaagagaacaaagatcc

SEQ ID NO: 493875 - DNA, 25 bp, Mus musculus
ttgggtccctatgataacagagcct

SEQ ID NO: 493876 - DNA, 25 bp, Mus musculus
ttgggtctgggtgaccctgacccct

SEQ ID NO: 493877 - DNA, 25 bp, Mus musculus
ttgggtgagcacaggaccaaccgag

SEQ ID NO: 493878 - DNA, 25 bp, Mus musculus
ttgggttctgtacgcccttgaatcc

SEQ ID NO: 493879 - DNA, 25 bp, Mus musculus
ttgggttggaggaagccacgttggt

SEQ ID NO: 493880 - DNA, 25 bp, Mus musculus
ttgggtttcccactccctgtcagac

SEQ ID NO: 493881 - DNA, 25 bp, Mus musculus
ttgggtttcgtctgggctgactgac

SEQ ID NO: 493882 - DNA, 25 bp, Mus musculus
ttggtaaaccgtaggaagcaggcgc

SEQ ID NO: 493883 - DNA, 25 bp, Mus musculus
ttggtaacaaggtgcagagtctgga

SEQ ID NO: 493884 - DNA, 25 bp, Mus musculus
ttggtaaccacttggagcagggctg

SEQ ID NO: 493885 - DNA, 25 bp, Mus musculus
ttggtaggtgaaaagagccagtcct

SEQ ID NO: 493886 - DNA, 25 bp, Mus musculus
ttggtatcttggaccccagggccag

SEQ ID NO: 493887 - DNA, 25 bp, Mus musculus
ttggtattccatgtgcccttgagca

SEQ ID NO: 493888 - DNA, 25 bp, Mus musculus
ttggtcagcctgtcggcctgcgggc

SEQ ID NO: 493889 - DNA, 25 bp, Mus musculus
ttggtcgggtgcactactcggagct

SEQ ID NO: 493890 - DNA, 25 bp, Mus musculus
ttggtgaagccatcagtcagcatgc

SEQ ID NO: 493891 - DNA, 25 bp, Mus musculus
ttggtgaccctacatgaagaaagca

SEQ ID NO: 493892 - DNA, 25 bp, Mus musculus
ttggtgactcccacatcagtgaagg

SEQ ID NO: 493893 - DNA, 25 bp, Mus musculus
ttggtgagccacctactgaggagca

SEQ ID NO: 493894 - DNA, 25 bp, Mus musculus
ttggtgaggaatgcccaagccccaa

SEQ ID NO: 493895 - DNA, 25 bp, Mus musculus
ttggtgagttgagcagaagacccag

SEQ ID NO: 493896 - DNA, 25 bp, Mus musculus
ttggtgatgatgaaaattagtgaag

SEQ ID NO: 493897 - DNA, 25 bp, Mus musculus
ttggtgcagggaacttgtgtctctt

SEQ ID NO: 493898 - DNA, 25 bp, Mus musculus
ttggtgcccctacaattagtactgg

SEQ ID NO: 493899 - DNA, 25 bp, Mus musculus
ttggtgcggctgtcctaaaccctga

SEQ ID NO: 493900 - DNA, 25 bp, Mus musculus
ttggtgctccatgcgaagctgcagc

SEQ ID NO: 493901 - DNA, 25 bp, Mus musculus
ttggtgctcggaacttgctgaagtc

SEQ ID NO: 493902 - DNA, 25 bp, Mus musculus
ttggtgctgcacatcgaacagaagc

SEQ ID NO: 493903 - DNA, 25 bp, Mus musculus
ttggtgctgtctgctctccaggctg

SEQ ID NO: 493904 - DNA, 25 bp, Mus musculus
ttggtggcctgttcacagctgcgaa

SEQ ID NO: 493905 - DNA, 25 bp, Mus musculus
ttggtgggaccagcccagattggcc

SEQ ID NO: 493906 - DNA, 25 bp, Mus musculus
ttggtggtaccacccttcctcggag

SEQ ID NO: 493907 - DNA, 25 bp, Mus musculus
ttggtgtaccgcaatcccgtggtgg

SEQ ID NO: 493908 - DNA, 25 bp, Mus musculus
ttggtgtcattttcaggcgggcccc

SEQ ID NO: 493909 - DNA, 25 bp, Mus musculus
ttggtgtcctggtaggcaaagaccg

SEQ ID NO: 493910 - DNA, 25 bp, Mus musculus
ttggtgtggagaccctcgagccttc

SEQ ID NO: 493911 - DNA, 25 bp, Mus musculus
ttggtgttatgtgaagaccatcggg

SEQ ID NO: 493912 - DNA, 25 bp, Mus musculus
ttggtgttcacatcagagcaggccc

SEQ ID NO: 493913 - DNA, 25 bp, Mus musculus
ttggttagcccctatgacatagaga

SEQ ID NO: 493914 - DNA, 25 bp, Mus musculus
ttggttagtatggacaataaaagcc

SEQ ID NO: 493915 - DNA, 25 bp, Mus musculus
ttggttcacagcactcgtatcgggt

SEQ ID NO: 493916 - DNA, 25 bp, Mus musculus
ttggttcacttcaatttgggagtac

SEQ ID NO: 493917 - DNA, 25 bp, Mus musculus
ttggttccaccaagaagagttactg

SEQ ID NO: 493918 - DNA, 25 bp, Mus musculus
ttggttgagccaacagacccgctgg

SEQ ID NO: 493919 - DNA, 25 bp, Mus musculus
ttggtttcgagcggctccggagaac

SEQ ID NO: 493920 - DNA, 25 bp, Mus musculus
ttggtttgggaagagcggatccttc

SEQ ID NO: 493921 - DNA, 25 bp, Mus musculus
ttggttttctcttgaggtagcagac

SEQ ID NO: 493922 - DNA, 25 bp, Mus musculus
ttggttttgctagcaaaattttcac

SEQ ID NO: 493923 - DNA, 25 bp, Mus musculus
ttgtaaaaaagcagccacggagggc

SEQ ID NO: 493924 - DNA, 25 bp, Mus musculus
ttgtaaacacagctccccagggtgg

SEQ ID NO: 493925 - DNA, 25 bp, Mus musculus
ttgtaaagttccagccccgcagctg

SEQ ID NO: 493926 - DNA, 25 bp, Mus musculus
ttgtaacaccaatgcatgcccggag

SEQ ID NO: 493927 - DNA, 25 bp, Mus musculus
ttgtaacgggcaccaagaaaggcac

SEQ ID NO: 493928 - DNA, 25 bp, Mus musculus
ttgtaactgatttgcgcttccaccg

SEQ ID NO: 493929 - DNA, 25 bp, Mus musculus
ttgtacaaggccagtactccacacg

SEQ ID NO: 493930 - DNA, 25 bp, Mus musculus
ttgtacagcttcaggcagaagcagc

SEQ ID NO: 493931 - DNA, 25 bp, Mus musculus
ttgtacataacatgaatgcccagtg

SEQ ID NO: 493932 - DNA, 25 bp, Mus musculus
ttgtaccaactgaacccgaatgccg

SEQ ID NO: 493933 - DNA, 25 bp, Mus musculus
ttgtaccagagatgcaccaagccct

SEQ ID NO: 493934 - DNA, 25 bp, Mus musculus
ttgtaccgctatggttacacccggg

SEQ ID NO: 493935 - DNA, 25 bp, Mus musculus
ttgtacctcagccagagtagtaggc

SEQ ID NO: 493936 - DNA, 25 bp, Mus musculus
ttgtaccttccctggacagcacagt

SEQ ID NO: 493937 - DNA, 25 bp, Mus musculus
ttgtacggcttcgacagcggttgaa

SEQ ID NO: 493938 - DNA, 25 bp, Mus musculus
ttgtactctgggacatagctgagtg

SEQ ID NO: 493939 - DNA, 25 bp, Mus musculus
ttgtagaacgccgacaaggagccct

SEQ ID NO: 493940 - DNA, 25 bp, Mus musculus
ttgtagagagccacaccaagtgtcc

SEQ ID NO: 493941 - DNA, 25 bp, Mus musculus
ttgtagagcgcgaaagtcattcacg

SEQ ID NO: 493942 - DNA, 25 bp, Mus musculus
ttgtagaggtgaattgccagggcat

SEQ ID NO: 493943 - DNA, 25 bp, Mus musculus
ttgtagccaagcagaaggaggacct

SEQ ID NO: 493944 - DNA, 25 bp, Mus musculus
ttgtaggccactataacccttgagg

SEQ ID NO: 493945 - DNA, 25 bp, Mus musculus
ttgtaggtttggaacttcgtgacca

SEQ ID NO: 493946 - DNA, 25 bp, Mus musculus
ttgtagtctacacctggtcccaggc

SEQ ID NO: 493947 - DNA, 25 bp, Mus musculus
ttgtagttaccgacccagcgcttga

SEQ ID NO: 493948 - DNA, 25 bp, Mus musculus
ttgtatagactaaacccaattgcta

SEQ ID NO: 493949 - DNA, 25 bp, Mus musculus
ttgtatctgcatggacgggcgagct

SEQ ID NO: 493950 - DNA, 25 bp, Mus musculus
ttgtatttacccagaattcctagcc

SEQ ID NO: 493951 - DNA, 25 bp, Mus musculus
ttgtcaacagcccagaaagagagcc

SEQ ID NO: 493952 - DNA, 25 bp, Mus musculus
ttgtcaacctcttcgtgtcccggga

SEQ ID NO: 493953 - DNA, 25 bp, Mus musculus
ttgtcaacgcgctgtgcacgccgag

SEQ ID NO: 493954 - DNA, 25 bp, Mus musculus
ttgtcaatcttatgcggaataaact

SEQ ID NO: 493955 - DNA, 25 bp, Mus musculus
ttgtcaattccaagaggcgtcggcc

SEQ ID NO: 493956 - DNA, 25 bp, Mus musculus
ttgtcacaagttaaagccaatctga

SEQ ID NO: 493957 - DNA, 25 bp, Mus musculus
ttgtcaccaaaagcgatgtccagga

SEQ ID NO: 493958 - DNA, 25 bp, Mus musculus
ttgtcaccttctccgttatccttag

SEQ ID NO: 493959 - DNA, 25 bp, Mus musculus
ttgtcacggagaaaagcacagtccc

SEQ ID NO: 493960 - DNA, 25 bp, Mus musculus
ttgtcactatgacggaagttcagct

SEQ ID NO: 493961 - DNA, 25 bp, Mus musculus
ttgtcactcctgtagggaaccggga

SEQ ID NO: 493962 - DNA, 25 bp, Mus musculus
ttgtcagaacacacttcagaggagc

SEQ ID NO: 493963 - DNA, 25 bp, Mus musculus
ttgtcagccacgtggaaggcagtca

SEQ ID NO: 493964 - DNA, 25 bp, Mus musculus
ttgtcagccatatccagggcctgca

SEQ ID NO: 493965 - DNA, 25 bp, Mus musculus
ttgtcagcccttggaaaccttctgg

SEQ ID NO: 493966 - DNA, 25 bp, Mus musculus
ttgtcaggtgtcttgtcagcccagg

SEQ ID NO: 493967 - DNA, 25 bp, Mus musculus
ttgtcagtcaactcgtgccagcagc

SEQ ID NO: 493968 - DNA, 25 bp, Mus musculus
ttgtcattgactcccaccatagcca

SEQ ID NO: 493969 - DNA, 25 bp, Mus musculus
ttgtccaaaaaagatgcctgcaccc

SEQ ID NO: 493970 - DNA, 25 bp, Mus musculus
ttgtccaacccctgggccttgaggg

SEQ ID NO: 493971 - DNA, 25 bp, Mus musculus
ttgtccaccgtcttcttggccttgg

SEQ ID NO: 493972 - DNA, 25 bp, Mus musculus
ttgtccagccttgtagagcgccgag

SEQ ID NO: 493973 - DNA, 25 bp, Mus musculus
ttgtccaggtagtggctcagagccc

SEQ ID NO: 493974 - DNA, 25 bp, Mus musculus
ttgtcccagtccagaggcgaagagc

SEQ ID NO: 493975 - DNA, 25 bp, Mus musculus
ttgtcccgatggatcggttccccag

SEQ ID NO: 493976 - DNA, 25 bp, Mus musculus
ttgtccctgaactgctgggctccag

SEQ ID NO: 493977 - DNA, 25 bp, Mus musculus
ttgtccctggccttgtccggagtcg

SEQ ID NO: 493978 - DNA, 25 bp, Mus musculus
ttgtccctggtgttgagcctcctgg

SEQ ID NO: 493979 - DNA, 25 bp, Mus musculus
ttgtccgctgaaaccaccatgctgc

SEQ ID NO: 493980 - DNA, 25 bp, Mus musculus
ttgtcctgcctaattctccaaaggg

SEQ ID NO: 493981 - DNA, 25 bp, Mus musculus
ttgtcctgctctgggctgacattcc

SEQ ID NO: 493982 - DNA, 25 bp, Mus musculus
ttgtccttagcaaacccgaattggg

SEQ ID NO: 493983 - DNA, 25 bp, Mus musculus
ttgtccttgcctcctaccagctggt

SEQ ID NO: 493984 - DNA, 25 bp, Mus musculus
ttgtcgaaacatgtggagtcccgtg

SEQ ID NO: 493985 - DNA, 25 bp, Mus musculus
ttgtcgctacttcctcgtccgggat

SEQ ID NO: 493986 - DNA, 25 bp, Mus musculus
ttgtcgctcagagaaggtggcactc

SEQ ID NO: 493987 - DNA, 25 bp, Mus musculus
ttgtcggatatccaccagggccagg

SEQ ID NO: 493988 - DNA, 25 bp, Mus musculus
ttgtctaaagaacgcacccagcagg

SEQ ID NO: 493989 - DNA, 25 bp, Mus musculus
ttgtctaaggagtccgaggcagccc

SEQ ID NO: 493990 - DNA, 25 bp, Mus musculus
ttgtctactactgtgcgagggtcca

SEQ ID NO: 493991 - DNA, 25 bp, Mus musculus
ttgtctccagatcggaggccctgct

SEQ ID NO: 493992 - DNA, 25 bp, Mus musculus
ttgtctccccacttgggcaaacttc

SEQ ID NO: 493993 - DNA, 25 bp, Mus musculus
ttgtctcctgcaacaatgagaatgc

SEQ ID NO: 493994 - DNA, 25 bp, Mus musculus
ttgtctctggtaaggcaatttacac

SEQ ID NO: 493995 - DNA, 25 bp, Mus musculus
ttgtctgactagaggaccttctggg

SEQ ID NO: 493996 - DNA, 25 bp, Mus musculus
ttgtctgcccattccacatctctag

SEQ ID NO: 493997 - DNA, 25 bp, Mus musculus
ttgtctgggcaacgatagagtcctg

SEQ ID NO: 493998 - DNA, 25 bp, Mus musculus
ttgtctgtagtccttccgaggttgg

SEQ ID NO: 493999 - DNA, 25 bp, Mus musculus
ttgtcttgcaaacccaatagctggt

SEQ ID NO: 494000 - DNA, 25 bp, Mus musculus
ttgtgaaacccgacaacccatggga

SEQ ID NO: 494001 - DNA, 25 bp, Mus musculus
ttgtgaaatactaaaatcttccggg

SEQ ID NO: 494002 - DNA, 25 bp, Mus musculus
ttgtgaacagctgtacccaggccag

SEQ ID NO: 494003 - DNA, 25 bp, Mus musculus
ttgtgaaggactaccaagccctgat

SEQ ID NO: 494004 - DNA, 25 bp, Mus musculus
ttgtgaatgagacccagctggacca

SEQ ID NO: 494005 - DNA, 25 bp, Mus musculus
ttgtgacagctcgttcccagctggg

SEQ ID NO: 494006 - DNA, 25 bp, Mus musculus
ttgtgaccctgtcagccactctggg

SEQ ID NO: 494007 - DNA, 25 bp, Mus musculus
ttgtgaccgcgtggagctgcacgcc

SEQ ID NO: 494008 - DNA, 25 bp, Mus musculus
ttgtgagcaactggaacgagcacca

SEQ ID NO: 494009 - DNA, 25 bp, Mus musculus
ttgtgagcagtgtacctctcctccc

SEQ ID NO: 494010 - DNA, 25 bp, Mus musculus
ttgtgaggacctcaccccgagctgt

SEQ ID NO: 494011 - DNA, 25 bp, Mus musculus
ttgtgatcacagtacccaggtcgct

SEQ ID NO: 494012 - DNA, 25 bp, Mus musculus
ttgtgatccgtgactcgttcgtggg

SEQ ID NO: 494013 - DNA, 25 bp, Mus musculus
ttgtgatcgactggcaggagcccta

SEQ ID NO: 494014 - DNA, 25 bp, Mus musculus
ttgtgatcgctagcctcccagagct

SEQ ID NO: 494015 - DNA, 25 bp, Mus musculus
ttgtgatctcacgaaagcgcttggg

SEQ ID NO: 494016 - DNA, 25 bp, Mus musculus
ttgtgatggctactataatacggac

SEQ ID NO: 494017 - DNA, 25 bp, Mus musculus
ttgtgattcagggacagaagggctc

SEQ ID NO: 494018 - DNA, 25 bp, Mus musculus
ttgtgcaagtgcaaacagagttgac

SEQ ID NO: 494019 - DNA, 25 bp, Mus musculus
ttgtgcaagtgtgcactcacctgaa

SEQ ID NO: 494020 - DNA, 25 bp, Mus musculus
ttgtgcacagcaaccagactcctgc

SEQ ID NO: 494021 - DNA, 25 bp, Mus musculus
ttgtgcactacagcgggaacagggc

SEQ ID NO: 494022 - DNA, 25 bp, Mus musculus
ttgtgcacttgaagcagtcccggct

SEQ ID NO: 494023 - DNA, 25 bp, Mus musculus
ttgtgcaggaccatggagcacagac

SEQ ID NO: 494024 - DNA, 25 bp, Mus musculus
ttgtgcatctcgaggccaggactgt

SEQ ID NO: 494025 - DNA, 25 bp, Mus musculus
ttgtgccaagccagcctaactgcag

SEQ ID NO: 494026 - DNA, 25 bp, Mus musculus
ttgtgccaggcactccaggaacggt

SEQ ID NO: 494027 - DNA, 25 bp, Mus musculus
ttgtgccatttaagggcccctctgg

SEQ ID NO: 494028 - DNA, 25 bp, Mus musculus
ttgtgcccagcggtaacggaagtgc

SEQ ID NO: 494029 - DNA, 25 bp, Mus musculus
ttgtgcctgagatctgagtgagccc

SEQ ID NO: 494030 - DNA, 25 bp, Mus musculus
ttgtgcgaccgtggctcgagcctgc

SEQ ID NO: 494031 - DNA, 25 bp, Mus musculus
ttgtgcgaggcaacgaaggcgtctt

SEQ ID NO: 494032 - DNA, 25 bp, Mus musculus
ttgtgcggctggaaaatctgactgg

SEQ ID NO: 494033 - DNA, 25 bp, Mus musculus
ttgtgctacggaagagcgaggcact

SEQ ID NO: 494034 - DNA, 25 bp, Mus musculus
ttgtgctagggacctgagaaagaaa

SEQ ID NO: 494035 - DNA, 25 bp, Mus musculus
ttgtgctgaactccagaaaccggcg

SEQ ID NO: 494036 - DNA, 25 bp, Mus musculus
ttgtgctgctgtgctgattccagca

SEQ ID NO: 494037 - DNA, 25 bp, Mus musculus
ttgtgctgtgacactctcgactctg

SEQ ID NO: 494038 - DNA, 25 bp, Mus musculus
ttgtgcttttgtcccgtacagtggc

SEQ ID NO: 494039 - DNA, 25 bp, Mus musculus
ttgtggaacagaagaatgggcccct

SEQ ID NO: 494040 - DNA, 25 bp, Mus musculus
ttgtggacagcaaaagagcccggga

SEQ ID NO: 494041 - DNA, 25 bp, Mus musculus
ttgtggaccagcacaggcaagcact

SEQ ID NO: 494042 - DNA, 25 bp, Mus musculus
ttgtggatgacaacggactggtgcc

SEQ ID NO: 494043 - DNA, 25 bp, Mus musculus
ttgtggattattcatgaggcttaac

SEQ ID NO: 494044 - DNA, 25 bp, Mus musculus
ttgtggattccccaaggagagctct

SEQ ID NO: 494045 - DNA, 25 bp, Mus musculus
ttgtggatttcctgactgttcgcag

SEQ ID NO: 494046 - DNA, 25 bp, Mus musculus
ttgtggccaatgcaggagactctcg

SEQ ID NO: 494047 - DNA, 25 bp, Mus musculus
ttgtgggacccatcgaagagagcat

SEQ ID NO: 494048 - DNA, 25 bp, Mus musculus
ttgtgggacccttcctgcatctgca

SEQ ID NO: 494049 - DNA, 25 bp, Mus musculus
ttgtgggaccctttgaacttactat

SEQ ID NO: 494050 - DNA, 25 bp, Mus musculus
ttgtgggcactgctgccatagccag

SEQ ID NO: 494051 - DNA, 25 bp, Mus musculus
ttgtgggcccaatgctcatattctg

SEQ ID NO: 494052 - DNA, 25 bp, Mus musculus
ttgtgggtagccacaatactgtggc

SEQ ID NO: 494053 - DNA, 25 bp, Mus musculus
ttgtgtaagcatgagtaccagagtt

SEQ ID NO: 494054 - DNA, 25 bp, Mus musculus
ttgtgtactgggacacttcctcggg

SEQ ID NO: 494055 - DNA, 25 bp, Mus musculus
ttgtgtacttggtcaggtgcgcgct

SEQ ID NO: 494056 - DNA, 25 bp, Mus musculus
ttgtgtaggatcaggcttggtaatg

SEQ ID NO: 494057 - DNA, 25 bp, Mus musculus
ttgtgtcacaagactcaacgatcgg

SEQ ID NO: 494058 - DNA, 25 bp, Mus musculus
ttgtgtccctgcactcggtggctcc

SEQ ID NO: 494059 - DNA, 25 bp, Mus musculus
ttgtgtccgaaccagcagaggtccc

SEQ ID NO: 494060 - DNA, 25 bp, Mus musculus
ttgtgtcctacaatcatgagagtcg

SEQ ID NO: 494061 - DNA, 25 bp, Mus musculus
ttgtgtcctccttgggctgcaacac

SEQ ID NO: 494062 - DNA, 25 bp, Mus musculus
ttgtgtcctggttctagggcgcgct

SEQ ID NO: 494063 - DNA, 25 bp, Mus musculus
ttgtgtcctttaaactctcgtctgc

SEQ ID NO: 494064 - DNA, 25 bp, Mus musculus
ttgtgtgactacacagacatggctg

SEQ ID NO: 494065 - DNA, 25 bp, Mus musculus
ttgtgtgtgtgctcaaaagtatgcc

SEQ ID NO: 494066 - DNA, 25 bp, Mus musculus
ttgtgttacacccaagcagtgcttg

SEQ ID NO: 494067 - DNA, 25 bp, Mus musculus
ttgtgttagctgcagaattctcccc

SEQ ID NO: 494068 - DNA, 25 bp, Mus musculus
ttgtgttctcatgcccagccaagga

SEQ ID NO: 494069 - DNA, 25 bp, Mus musculus
ttgttaaaaagtgtggcctccccag

SEQ ID NO: 494070 - DNA, 25 bp, Mus musculus
ttgttaagtcccaatcccacaggca

SEQ ID NO: 494071 - DNA, 25 bp, Mus musculus
ttgttacactgtgcggaatgccgct

SEQ ID NO: 494072 - DNA, 25 bp, Mus musculus
ttgttacccaaatcaggtatagccg

SEQ ID NO: 494073 - DNA, 25 bp, Mus musculus
ttgttagcacctgggacttgccgca

SEQ ID NO: 494074 - DNA, 25 bp, Mus musculus
ttgttagggtaaagaagcgctctgg

SEQ ID NO: 494075 - DNA, 25 bp, Mus musculus
ttgttatggttgtgggctagtcacc

SEQ ID NO: 494076 - DNA, 25 bp, Mus musculus
ttgttattaggaagtgtggagtccc

SEQ ID NO: 494077 - DNA, 25 bp, Mus musculus
ttgttattctaagggtttctgacca

SEQ ID NO: 494078 - DNA, 25 bp, Mus musculus
ttgttcaggcattcatcctgccggg

SEQ ID NO: 494079 - DNA, 25 bp, Mus musculus
ttgttcaggctgtggattatctttg

SEQ ID NO: 494080 - DNA, 25 bp, Mus musculus
ttgttcagtgccatcctcctttggg

SEQ ID NO: 494081 - DNA, 25 bp, Mus musculus
ttgttcattcagatccagaggcacc

SEQ ID NO: 494082 - DNA, 25 bp, Mus musculus
ttgttcccagagtccaacctagagg

SEQ ID NO: 494083 - DNA, 25 bp, Mus musculus
ttgttcctggatgccggtattggct

SEQ ID NO: 494084 - DNA, 25 bp, Mus musculus
ttgttcggcaaaaccagtctggcag

SEQ ID NO: 494085 - DNA, 25 bp, Mus musculus
ttgttctgggctggagatccgcacc

SEQ ID NO: 494086 - DNA, 25 bp, Mus musculus
ttgttgccatattacacggaaagcc

SEQ ID NO: 494087 - DNA, 25 bp, Mus musculus
ttgttgcgggccttggtcgaccttg

SEQ ID NO: 494088 - DNA, 25 bp, Mus musculus
ttgttgggacactgaggtgacttcc

SEQ ID NO: 494089 - DNA, 25 bp, Mus musculus
ttgttgtaagtttccagccagccaa

SEQ ID NO: 494090 - DNA, 25 bp, Mus musculus
ttgttgtggcgcagagcgagaccca

SEQ ID NO: 494091 - DNA, 25 bp, Mus musculus
ttgtttaaggcccattcactggtgt

SEQ ID NO: 494092 - DNA, 25 bp, Mus musculus
ttgtttacgaccaagaaaagcgctt

SEQ ID NO: 494093 - DNA, 25 bp, Mus musculus
ttgtttcaggaaactgggaggctgc

SEQ ID NO: 494094 - DNA, 25 bp, Mus musculus
ttgtttcatgtagcctcacttagcc

SEQ ID NO: 494095 - DNA, 25 bp, Mus musculus
ttgtttccaaatgtgcacccctgtg

SEQ ID NO: 494096 - DNA, 25 bp, Mus musculus
ttgtttccagaagaatcatatcaga

SEQ ID NO: 494097 - DNA, 25 bp, Mus musculus
ttgtttccattgagccctgtccatg

SEQ ID NO: 494098 - DNA, 25 bp, Mus musculus
ttgtttcctgctgttgcagaaagcc

SEQ ID NO: 494099 - DNA, 25 bp, Mus musculus
ttgtttcctgtagcccaactgtacc

SEQ ID NO: 494100 - DNA, 25 bp, Mus musculus
ttgtttctacaccaagttcacctgg

SEQ ID NO: 494101 - DNA, 25 bp, Mus musculus
ttgttttaaagaggcagactgacac

SEQ ID NO: 494102 - DNA, 25 bp, Mus musculus
ttgttttagccctgcaggcccctct

SEQ ID NO: 494103 - DNA, 25 bp, Mus musculus
ttgtttttatgactgatggtacccc

SEQ ID NO: 494104 - DNA, 25 bp, Mus musculus
tttaaaaaggaagtgagcccctgtg

SEQ ID NO: 494105 - DNA, 25 bp, Mus musculus
tttaaaaattgctaacatggagggc

SEQ ID NO: 494106 - DNA, 25 bp, Mus musculus
tttaaaagagaggttgccaccgtcg

SEQ ID NO: 494107 - DNA, 25 bp, Mus musculus
tttaaaaggaaaagagagcctgccg

SEQ ID NO: 494108 - DNA, 25 bp, Mus musculus
tttaaaatacaggagggcgggcgct

SEQ ID NO: 494109 - DNA, 25 bp, Mus musculus
tttaaaatgatgcaaggactggact

SEQ ID NO: 494110 - DNA, 25 bp, Mus musculus
tttaaacaatttgatgtaaccagct

SEQ ID NO: 494111 - DNA, 25 bp, Mus musculus
tttaaaccagcagaatatggcccag

SEQ ID NO: 494112 - DNA, 25 bp, Mus musculus
tttaaacccaagaacagggcgctgg

SEQ ID NO: 494113 - DNA, 25 bp, Mus musculus
tttaaactagccagcgagacagagg

SEQ ID NO: 494114 - DNA, 25 bp, Mus musculus
tttaaactgaagaaacgctaccgca

SEQ ID NO: 494115 - DNA, 25 bp, Mus musculus
tttaaactgtggaggggactcagcc

SEQ ID NO: 494116 - DNA, 25 bp, Mus musculus
tttaaacttacctgccgcttgggag

SEQ ID NO: 494117 - DNA, 25 bp, Mus musculus
tttaaagacggatctcccggaccag

SEQ ID NO: 494118 - DNA, 25 bp, Mus musculus
tttaaagcatctacttgtggttggg

SEQ ID NO: 494119 - DNA, 25 bp, Mus musculus
tttaaagctaactaactaggatgcc

SEQ ID NO: 494120 - DNA, 25 bp, Mus musculus
tttaaaggatgctcaggagaagctg

SEQ ID NO: 494121 - DNA, 25 bp, Mus musculus
tttaaagtcccggatgcgagccctg

SEQ ID NO: 494122 - DNA, 25 bp, Mus musculus
tttaaagtgaacaaagcgtccagct

SEQ ID NO: 494123 - DNA, 25 bp, Mus musculus
tttaaatacagttgctttgtgctgg

SEQ ID NO: 494124 - DNA, 25 bp, Mus musculus
tttaaatatcctacagtcctgcccg

SEQ ID NO: 494125 - DNA, 25 bp, Mus musculus
tttaaatgacaaaatccatgcaggt

SEQ ID NO: 494126 - DNA, 25 bp, Mus musculus
tttaacaacaagaatcagtaactgg

SEQ ID NO: 494127 - DNA, 25 bp, Mus musculus
tttaacaagccccttctgaatccac

SEQ ID NO: 494128 - DNA, 25 bp, Mus musculus
tttaacaagtttggctcctgggagc

SEQ ID NO: 494129 - DNA, 25 bp, Mus musculus
tttaacaataggcaagagacactgc

SEQ ID NO: 494130 - DNA, 25 bp, Mus musculus
tttaacaatggcgtaaggaccggct

SEQ ID NO: 494131 - DNA, 25 bp, Mus musculus
tttaacacagtgacagacgccattg

SEQ ID NO: 494132 - DNA, 25 bp, Mus musculus
tttaacagacgagcgtacatgagtc

SEQ ID NO: 494133 - DNA, 25 bp, Mus musculus
tttaacagatctgcctccaaggctg

SEQ ID NO: 494134 - DNA, 25 bp, Mus musculus
tttaacaggctgtgaaaatgccagt

SEQ ID NO: 494135 - DNA, 25 bp, Mus musculus
tttaacagggtatcaacgtggagac

SEQ ID NO: 494136 - DNA, 25 bp, Mus musculus
tttaacaggtatctgaccaggcgcc

SEQ ID NO: 494137 - DNA, 25 bp, Mus musculus
tttaacataataacaaaggatctgg

SEQ ID NO: 494138 - DNA, 25 bp, Mus musculus
tttaaccagaagtggtggctcccct

SEQ ID NO: 494139 - DNA, 25 bp, Mus musculus
tttaaccagtacgtgagggaccagg

SEQ ID NO: 494140 - DNA, 25 bp, Mus musculus
tttaaccgaggtcctgcctacggct

SEQ ID NO: 494141 - DNA, 25 bp, Mus musculus
tttaacctaggagcatgctaccgtg

SEQ ID NO: 494142 - DNA, 25 bp, Mus musculus
tttaacctgatgtgggcaggctgca

SEQ ID NO: 494143 - DNA, 25 bp, Mus musculus
tttaaccttcaaatccatcagcggg

SEQ ID NO: 494144 - DNA, 25 bp, Mus musculus
tttaacgaagatgagctacagtggt

SEQ ID NO: 494145 - DNA, 25 bp, Mus musculus
tttaactaaaccaaatcgcaggcgc

SEQ ID NO: 494146 - DNA, 25 bp, Mus musculus
tttaactcaggcaagactcgaccgc

SEQ ID NO: 494147 - DNA, 25 bp, Mus musculus
tttaactcccttggcgcaaaagtga

SEQ ID NO: 494148 - DNA, 25 bp, Mus musculus
tttaactctggtgcggtatccccgg

SEQ ID NO: 494149 - DNA, 25 bp, Mus musculus
tttaactggacttcaaaggctgagc

SEQ ID NO: 494150 - DNA, 25 bp, Mus musculus
tttaactgtaactgagactgagatc

SEQ ID NO: 494151 - DNA, 25 bp, Mus musculus
tttaagaaacccatcgtggtagcca

SEQ ID NO: 494152 - DNA, 25 bp, Mus musculus
tttaagaagccgagacagatagtac

SEQ ID NO: 494153 - DNA, 25 bp, Mus musculus
tttaagaagcgatgcgaagatagag

SEQ ID NO: 494154 - DNA, 25 bp, Mus musculus
tttaagaataagcaagtctcacttc

SEQ ID NO: 494155 - DNA, 25 bp, Mus musculus
tttaagaatcagaagaggttggctc

SEQ ID NO: 494156 - DNA, 25 bp, Mus musculus
tttaagaccagccttcccagggatt

SEQ ID NO: 494157 - DNA, 25 bp, Mus musculus
tttaagaccatcgaggacttgcgcg

SEQ ID NO: 494158 - DNA, 25 bp, Mus musculus
tttaagactgacaaggccggtggtg

SEQ ID NO: 494159 - DNA, 25 bp, Mus musculus
tttaagagctcctgcccaatggaca

SEQ ID NO: 494160 - DNA, 25 bp, Mus musculus
tttaagaggtctggcattagttggc

SEQ ID NO: 494161 - DNA, 25 bp, Mus musculus
tttaagatcaggagggctgcggcca

SEQ ID NO: 494162 - DNA, 25 bp, Mus musculus
tttaagatcgccagggagcaagcca

SEQ ID NO: 494163 - DNA, 25 bp, Mus musculus
tttaagatgtgagtgaacgtgtccc

SEQ ID NO: 494164 - DNA, 25 bp, Mus musculus
tttaagcacacccatgacaaggcgg

SEQ ID NO: 494165 - DNA, 25 bp, Mus musculus
tttaagcagaattcagagcactggg

SEQ ID NO: 494166 - DNA, 25 bp, Mus musculus
tttaagcaggtttccgaagcctacg

SEQ ID NO: 494167 - DNA, 25 bp, Mus musculus
tttaagccgatttacagaattagcg

SEQ ID NO: 494168 - DNA, 25 bp, Mus musculus
tttaagcctatatattggaatgcca

SEQ ID NO: 494169 - DNA, 25 bp, Mus musculus
tttaagctacagaacaccagcctgg

SEQ ID NO: 494170 - DNA, 25 bp, Mus musculus
tttaagctcgactacagccgggacc

SEQ ID NO: 494171 - DNA, 25 bp, Mus musculus
tttaagctgctgtctagaggccggg

SEQ ID NO: 494172 - DNA, 25 bp, Mus musculus
tttaaggcagtctcacaaacttttg

SEQ ID NO: 494173 - DNA, 25 bp, Mus musculus
tttaaggcctacaaagccggcaggt

SEQ ID NO: 494174 - DNA, 25 bp, Mus musculus
tttaaggctcaataaacccacgtgg

SEQ ID NO: 494175 - DNA, 25 bp, Mus musculus
tttaagtatagatgcccggtggccc

SEQ ID NO: 494176 - DNA, 25 bp, Mus musculus
tttaagtcatctccccagtggctgg

SEQ ID NO: 494177 - DNA, 25 bp, Mus musculus
tttaagtctgcttaagacgggcagc

SEQ ID NO: 494178 - DNA, 25 bp, Mus musculus
tttaagtgcactgagcctgtagccc

SEQ ID NO: 494179 - DNA, 25 bp, Mus musculus
tttaagtggtgtccgtcctggtgcc

SEQ ID NO: 494180 - DNA, 25 bp, Mus musculus
tttaagttcagggagcagtttgttc

SEQ ID NO: 494181 - DNA, 25 bp, Mus musculus
tttaagttgacgtccagagaggcag

SEQ ID NO: 494182 - DNA, 25 bp, Mus musculus
tttaagttgcctggcacactggatg

SEQ ID NO: 494183 - DNA, 25 bp, Mus musculus
tttaagttgtgtgctcgggtgtccc

SEQ ID NO: 494184 - DNA, 25 bp, Mus musculus
tttaatacacaaacccattgtcctg

SEQ ID NO: 494185 - DNA, 25 bp, Mus musculus
tttaatagactggtgccgcccaaga

SEQ ID NO: 494186 - DNA, 25 bp, Mus musculus
tttaatagcagacggacagccagtg

SEQ ID NO: 494187 - DNA, 25 bp, Mus musculus
tttaatcatgaagaaaacgccaggg

SEQ ID NO: 494188 - DNA, 25 bp, Mus musculus
tttaatcccgcagaagcatcacctt

SEQ ID NO: 494189 - DNA, 25 bp, Mus musculus
tttaatcgggcacgcagaagcacaa

SEQ ID NO: 494190 - DNA, 25 bp, Mus musculus
tttaatcttcttgttggcggctccg

SEQ ID NO: 494191 - DNA, 25 bp, Mus musculus
tttaatgacaagcaggagacgcctg

SEQ ID NO: 494192 - DNA, 25 bp, Mus musculus
tttaatgacccgtttgtggtgagcc

SEQ ID NO: 494193 - DNA, 25 bp, Mus musculus
tttaatgcaccaacaggtgtggccg

SEQ ID NO: 494194 - DNA, 25 bp, Mus musculus
tttaatggaaatgtagctggtgttg

SEQ ID NO: 494195 - DNA, 25 bp, Mus musculus
tttaatggcagaaccaagaggaccc

SEQ ID NO: 494196 - DNA, 25 bp, Mus musculus
tttaatggtggcttctctcaggaaa

SEQ ID NO: 494197 - DNA, 25 bp, Mus musculus
tttaatgtctctgtgttcgcccggc

SEQ ID NO: 494198 - DNA, 25 bp, Mus musculus
tttacaaaggcgatccgaaagcggt

SEQ ID NO: 494199 - DNA, 25 bp, Mus musculus
tttacaagagccaccctttgcagca

SEQ ID NO: 494200 - DNA, 25 bp, Mus musculus
tttacaagaggaaaagacaatgcac

SEQ ID NO: 494201 - DNA, 25 bp, Mus musculus
tttacaagcatgaataccccgaggg

SEQ ID NO: 494202 - DNA, 25 bp, Mus musculus
tttacaagccagtggacgcggaggc

SEQ ID NO: 494203 - DNA, 25 bp, Mus musculus
tttacaagtgaagcaggtgtcacct

SEQ ID NO: 494204 - DNA, 25 bp, Mus musculus
tttacaagtggctggcatactcggc

SEQ ID NO: 494205 - DNA, 25 bp, Mus musculus
tttacaatcctagacggactgggcc

SEQ ID NO: 494206 - DNA, 25 bp, Mus musculus
tttacacacgggacatggctggcct

SEQ ID NO: 494207 - DNA, 25 bp, Mus musculus
tttacacactggaatgccgacatgc

SEQ ID NO: 494208 - DNA, 25 bp, Mus musculus
tttacaccgggaagtctgcggcctg

SEQ ID NO: 494209 - DNA, 25 bp, Mus musculus
tttacacctagatgctccgagagct

SEQ ID NO: 494210 - DNA, 25 bp, Mus musculus
tttacactccagaggagccttggca

SEQ ID NO: 494211 - DNA, 25 bp, Mus musculus
tttacactcgcgaggaactggcgct

SEQ ID NO: 494212 - DNA, 25 bp, Mus musculus
tttacagaaaaagctccagcatgtg

SEQ ID NO: 494213 - DNA, 25 bp, Mus musculus
tttacagaacaggagcgggttacca

SEQ ID NO: 494214 - DNA, 25 bp, Mus musculus
tttacagaccaaagtgtgatctcac

SEQ ID NO: 494215 - DNA, 25 bp, Mus musculus
tttacagagcacttagccggcctgg

SEQ ID NO: 494216 - DNA, 25 bp, Mus musculus
tttacagcagatggagaacgacttg

SEQ ID NO: 494217 - DNA, 25 bp, Mus musculus
tttacaggagggaattcgggcccag

SEQ ID NO: 494218 - DNA, 25 bp, Mus musculus
tttacaggcctacatcgggacgcag

SEQ ID NO: 494219 - DNA, 25 bp, Mus musculus
tttacagggcggctggagacctctt

SEQ ID NO: 494220 - DNA, 25 bp, Mus musculus
tttacagtcaggtgcatcagagccc

SEQ ID NO: 494221 - DNA, 25 bp, Mus musculus
tttacagtcgtccaggcagctgcag

SEQ ID NO: 494222 - DNA, 25 bp, Mus musculus
tttacagtgctgtgaagagctcccg

SEQ ID NO: 494223 - DNA, 25 bp, Mus musculus
tttacataaagcactgtccgcaggg

SEQ ID NO: 494224 - DNA, 25 bp, Mus musculus
tttacataatagaaaggcctggacc

SEQ ID NO: 494225 - DNA, 25 bp, Mus musculus
tttacatataacactgggctctaag

SEQ ID NO: 494226 - DNA, 25 bp, Mus musculus
tttacatgcaacactcaaagctgag

SEQ ID NO: 494227 - DNA, 25 bp, Mus musculus
tttacatgcccagaagaaggaacct

SEQ ID NO: 494228 - DNA, 25 bp, Mus musculus
tttacatgtcttcattgagagccaa

SEQ ID NO: 494229 - DNA, 25 bp, Mus musculus
tttaccaaacgggaactcagctggc

SEQ ID NO: 494230 - DNA, 25 bp, Mus musculus
tttaccaacaagagatgagagcctg

SEQ ID NO: 494231 - DNA, 25 bp, Mus musculus
tttaccacagaggaaccgtgcaggc

SEQ ID NO: 494232 - DNA, 25 bp, Mus musculus
tttaccaggcacgagaacggcatag

SEQ ID NO: 494233 - DNA, 25 bp, Mus musculus
tttaccatgggagaaacctcagcag

SEQ ID NO: 494234 - DNA, 25 bp, Mus musculus
tttacccgagagattggtcagctcc

SEQ ID NO: 494235 - DNA, 25 bp, Mus musculus
tttacccggagcaagaaaaccactg

SEQ ID NO: 494236 - DNA, 25 bp, Mus musculus
tttacccggagcacggaatttgctg

SEQ ID NO: 494237 - DNA, 25 bp, Mus musculus
tttacccgggccagcgagcggcctt

SEQ ID NO: 494238 - DNA, 25 bp, Mus musculus
tttaccctcggaagctcagcagctg

SEQ ID NO: 494239 - DNA, 25 bp, Mus musculus
tttaccgagttctagcatcttcagc

SEQ ID NO: 494240 - DNA, 25 bp, Mus musculus
tttaccgcagcaaaacaccatctga

SEQ ID NO: 494241 - DNA, 25 bp, Mus musculus
tttaccgctcggcttctggagaaga

SEQ ID NO: 494242 - DNA, 25 bp, Mus musculus
tttacctactatgtcaccacaatgg

SEQ ID NO: 494243 - DNA, 25 bp, Mus musculus
tttacctcagaagcagtgacagccg

SEQ ID NO: 494244 - DNA, 25 bp, Mus musculus
tttacctgcaagagtgggacatccc

SEQ ID NO: 494245 - DNA, 25 bp, Mus musculus
tttacctgcggaggcaggagccttg

SEQ ID NO: 494246 - DNA, 25 bp, Mus musculus
tttaccttggagaaatacgaactat

SEQ ID NO: 494247 - DNA, 25 bp, Mus musculus
tttaccttgtagctagggctcagcc

SEQ ID NO: 494248 - DNA, 25 bp, Mus musculus
tttacgagagagatctggagcctcc

SEQ ID NO: 494249 - DNA, 25 bp, Mus musculus
tttacgatcaatgtgagcctggacc

SEQ ID NO: 494250 - DNA, 25 bp, Mus musculus
tttacgcacacaggcggactgggtg

SEQ ID NO: 494251 - DNA, 25 bp, Mus musculus
tttacgcagagttgccagggctcgc

SEQ ID NO: 494252 - DNA, 25 bp, Mus musculus
tttacggcagcagaccatggcagtg

SEQ ID NO: 494253 - DNA, 25 bp, Mus musculus
tttacggcgcccctgaagaatcgcg

SEQ ID NO: 494254 - DNA, 25 bp, Mus musculus
tttacgggcatggtgaagctcggcc

SEQ ID NO: 494255 - DNA, 25 bp, Mus musculus
tttactaaaatgaacgtgcctgctc

SEQ ID NO: 494256 - DNA, 25 bp, Mus musculus
tttactaagtaaacaggtctggcag

SEQ ID NO: 494257 - DNA, 25 bp, Mus musculus
tttactacgagaaacgctgattggg

SEQ ID NO: 494258 - DNA, 25 bp, Mus musculus
tttactagaaggaggcttgctccgg

SEQ ID NO: 494259 - DNA, 25 bp, Mus musculus
tttactataacgaaactgactcatg

SEQ ID NO: 494260 - DNA, 25 bp, Mus musculus
tttactatgagaaggcactgaggct

SEQ ID NO: 494261 - DNA, 25 bp, Mus musculus
tttactcaaaggacactgtggcagc

SEQ ID NO: 494262 - DNA, 25 bp, Mus musculus
tttactccgctgcagaaagacccag

SEQ ID NO: 494263 - DNA, 25 bp, Mus musculus
tttactctcgctcggagggtcctgg

SEQ ID NO: 494264 - DNA, 25 bp, Mus musculus
tttactctggccctcggccaaggga

SEQ ID NO: 494265 - DNA, 25 bp, Mus musculus
tttactgaacaggaatgctgaagcc

SEQ ID NO: 494266 - DNA, 25 bp, Mus musculus
tttactgcaataggacctgggacgg

SEQ ID NO: 494267 - DNA, 25 bp, Mus musculus
tttactggccacgaagaactggaca

SEQ ID NO: 494268 - DNA, 25 bp, Mus musculus
tttactgggttctagcagccacacc

SEQ ID NO: 494269 - DNA, 25 bp, Mus musculus
tttacttagagggaacagcacaccc

SEQ ID NO: 494270 - DNA, 25 bp, Mus musculus
tttacttattgttcggtgcccaggc

SEQ ID NO: 494271 - DNA, 25 bp, Mus musculus
tttacttcctggtgacaagtgagca

SEQ ID NO: 494272 - DNA, 25 bp, Mus musculus
tttacttctggagatggaaagaaag

SEQ ID NO: 494273 - DNA, 25 bp, Mus musculus
tttacttcttctggctggtcctgca

SEQ ID NO: 494274 - DNA, 25 bp, Mus musculus
tttacttgtgctagccagttacccc

SEQ ID NO: 494275 - DNA, 25 bp, Mus musculus
tttagaaaagataaaagcccttgat

SEQ ID NO: 494276 - DNA, 25 bp, Mus musculus
tttagaaacaaaagccgcaggcctg

SEQ ID NO: 494277 - DNA, 25 bp, Mus musculus
tttagaaatcgctgaagctgccgtc

SEQ ID NO: 494278 - DNA, 25 bp, Mus musculus
tttagaactagctgcctggagcccc

SEQ ID NO: 494279 - DNA, 25 bp, Mus musculus
tttagaactcatggactggtccacc

SEQ ID NO: 494280 - DNA, 25 bp, Mus musculus
tttagaagataagagccaagcgacg

SEQ ID NO: 494281 - DNA, 25 bp, Mus musculus
tttagaagccaaactgactgaggag

SEQ ID NO: 494282 - DNA, 25 bp, Mus musculus
tttagaagggacagagagacatgtc

SEQ ID NO: 494283 - DNA, 25 bp, Mus musculus
tttagaatacgcaccgcgaggctgc

SEQ ID NO: 494284 - DNA, 25 bp, Mus musculus
tttagaatggcctgcaggaacccct

SEQ ID NO: 494285 - DNA, 25 bp, Mus musculus
tttagaccaaaaggcatttcccagg

SEQ ID NO: 494286 - DNA, 25 bp, Mus musculus
tttagaccccgtgctactggtgagg

SEQ ID NO: 494287 - DNA, 25 bp, Mus musculus
tttagactggtatgccgaacaacgg

SEQ ID NO: 494288 - DNA, 25 bp, Mus musculus
tttagactggtgagaaagagcagcc

SEQ ID NO: 494289 - DNA, 25 bp, Mus musculus
tttagacttccattcaggaggaagc

SEQ ID NO: 494290 - DNA, 25 bp, Mus musculus
tttagagaaacccaacactggcagc

SEQ ID NO: 494291 - DNA, 25 bp, Mus musculus
tttagagaactgtgtgctagcgggc

SEQ ID NO: 494292 - DNA, 25 bp, Mus musculus
tttagagctgcggaacaggacgccc

SEQ ID NO: 494293 - DNA, 25 bp, Mus musculus
tttagaggctaaataagtatcccat

SEQ ID NO: 494294 - DNA, 25 bp, Mus musculus
tttagaggtccaccgagaagccgag

SEQ ID NO: 494295 - DNA, 25 bp, Mus musculus
tttagagtgaactgctaccctggca

SEQ ID NO: 494296 - DNA, 25 bp, Mus musculus
tttagagtgatagaatttcaagggc

SEQ ID NO: 494297 - DNA, 25 bp, Mus musculus
tttagagtgcctgaagtaggagcga

SEQ ID NO: 494298 - DNA, 25 bp, Mus musculus
tttagatatgtaaggtacgaaaccg

SEQ ID NO: 494299 - DNA, 25 bp, Mus musculus
tttagcaggtcacagcttggagtcc

SEQ ID NO: 494300 - DNA, 25 bp, Mus musculus
tttagccacgtagtgcggcgactgg

SEQ ID NO: 494301 - DNA, 25 bp, Mus musculus
tttagccagattcagtaaaccggcc

SEQ ID NO: 494302 - DNA, 25 bp, Mus musculus
tttagcccagcgcaaagaagaacgt

SEQ ID NO: 494303 - DNA, 25 bp, Mus musculus
tttagccccaggtttgaacatagcg

SEQ ID NO: 494304 - DNA, 25 bp, Mus musculus
tttagccgttaggagatgtggtgat

SEQ ID NO: 494305 - DNA, 25 bp, Mus musculus
tttagcgacaagcatggcctcacag

SEQ ID NO: 494306 - DNA, 25 bp, Mus musculus
tttagcgggcgagtgaagacgaacc

SEQ ID NO: 494307 - DNA, 25 bp, Mus musculus
tttagcgtcctctatacacccagct

SEQ ID NO: 494308 - DNA, 25 bp, Mus musculus
tttagctccactttctgagaatcag

SEQ ID NO: 494309 - DNA, 25 bp, Mus musculus
tttagctgaggtttccatagggtgg

SEQ ID NO: 494310 - DNA, 25 bp, Mus musculus
tttagctggtctccaaggtaacggc

SEQ ID NO: 494311 - DNA, 25 bp, Mus musculus
tttagcttggaagagggcgcctcct

SEQ ID NO: 494312 - DNA, 25 bp, Mus musculus
tttaggaaccaagccgaatgcacga

SEQ ID NO: 494313 - DNA, 25 bp, Mus musculus
tttaggagctagagtccgcagaccg

SEQ ID NO: 494314 - DNA, 25 bp, Mus musculus
tttaggaggacacactgcaagccgt

SEQ ID NO: 494315 - DNA, 25 bp, Mus musculus
tttaggatccttgaaatcaagcccc

SEQ ID NO: 494316 - DNA, 25 bp, Mus musculus
tttaggatgaagacagctctgctcg

SEQ ID NO: 494317 - DNA, 25 bp, Mus musculus
tttaggatgggcaggcgctctctct

SEQ ID NO: 494318 - DNA, 25 bp, Mus musculus
tttaggccacgaggagagtcagacc

SEQ ID NO: 494319 - DNA, 25 bp, Mus musculus
tttaggctgtaagaccacccgtgag

SEQ ID NO: 494320 - DNA, 25 bp, Mus musculus
tttagggcacagaaaacttagggca

SEQ ID NO: 494321 - DNA, 25 bp, Mus musculus
tttaggggtgtcaccctggctcccg

SEQ ID NO: 494322 - DNA, 25 bp, Mus musculus
tttagggtgggcatcttgctggatc

SEQ ID NO: 494323 - DNA, 25 bp, Mus musculus
tttagggttcagcaagacacacagc

SEQ ID NO: 494324 - DNA, 25 bp, Mus musculus
tttaggtacaactgccgaagccacg

SEQ ID NO: 494325 - DNA, 25 bp, Mus musculus
tttaggtagcagtagtgatcccaca

SEQ ID NO: 494326 - DNA, 25 bp, Mus musculus
tttaggttacaagaagcatctcacc

SEQ ID NO: 494327 - DNA, 25 bp, Mus musculus
tttagtagtgaagtgaaggaggcca

SEQ ID NO: 494328 - DNA, 25 bp, Mus musculus
tttagtcccctgtaatgctggctgc

SEQ ID NO: 494329 - DNA, 25 bp, Mus musculus
tttagtcccctgttcagcatcagcc

SEQ ID NO: 494330 - DNA, 25 bp, Mus musculus
tttagtcccgctctcactggtctgc

SEQ ID NO: 494331 - DNA, 25 bp, Mus musculus
tttagtctacatgttggcagccacc

SEQ ID NO: 494332 - DNA, 25 bp, Mus musculus
tttagtctcattacggaagatcggg

SEQ ID NO: 494333 - DNA, 25 bp, Mus musculus
tttagtctggccacgatgctcatgc

SEQ ID NO: 494334 - DNA, 25 bp, Mus musculus
tttagtgtgtctcgcctgaaggcca

SEQ ID NO: 494335 - DNA, 25 bp, Mus musculus
tttagttacaggcaaaggacccact

SEQ ID NO: 494336 - DNA, 25 bp, Mus musculus
tttagttctgtgttgtccgggctgc

SEQ ID NO: 494337 - DNA, 25 bp, Mus musculus
tttataacggccatgaggatcagca

SEQ ID NO: 494338 - DNA, 25 bp, Mus musculus
tttataaggacaagggaaaccatcg

SEQ ID NO: 494339 - DNA, 25 bp, Mus musculus
tttataagtctttgggaatcagaaa

SEQ ID NO: 494340 - DNA, 25 bp, Mus musculus
tttataccccttccctttgagacag

SEQ ID NO: 494341 - DNA, 25 bp, Mus musculus
tttatagaaacatactcaggcctgg

SEQ ID NO: 494342 - DNA, 25 bp, Mus musculus
tttatagacggtggcaaacagctca

SEQ ID NO: 494343 - DNA, 25 bp, Mus musculus
tttatagcgacgtcgccagctgccg

SEQ ID NO: 494344 - DNA, 25 bp, Mus musculus
tttatatacttaggaaagggcttga

SEQ ID NO: 494345 - DNA, 25 bp, Mus musculus
tttatatatatagacctgccctggg

SEQ ID NO: 494346 - DNA, 25 bp, Mus musculus
tttatatcctaccacagagatagct

SEQ ID NO: 494347 - DNA, 25 bp, Mus musculus
tttatcaagtacctccccgaatgga

SEQ ID NO: 494348 - DNA, 25 bp, Mus musculus
tttatcagaacctcaggaacatcgg

SEQ ID NO: 494349 - DNA, 25 bp, Mus musculus
tttatcagctttcaccgccgggagg

SEQ ID NO: 494350 - DNA, 25 bp, Mus musculus
tttatcagtaaactaccaccgtctc

SEQ ID NO: 494351 - DNA, 25 bp, Mus musculus
tttatccaaacatgaggccaggagg

SEQ ID NO: 494352 - DNA, 25 bp, Mus musculus
tttatccatctttccacgctgccag

SEQ ID NO: 494353 - DNA, 25 bp, Mus musculus
tttatcccaaacaatgaggttgacc

SEQ ID NO: 494354 - DNA, 25 bp, Mus musculus
tttatcgacgaatcgaggcagccag

SEQ ID NO: 494355 - DNA, 25 bp, Mus musculus
tttatcgacgagttcaacgggctcc

SEQ ID NO: 494356 - DNA, 25 bp, Mus musculus
tttatctattcatcatgctggagga

SEQ ID NO: 494357 - DNA, 25 bp, Mus musculus
tttatctgctctgtaaaagtgcctt

SEQ ID NO: 494358 - DNA, 25 bp, Mus musculus
tttatctgggctggctggaagtcac

SEQ ID NO: 494359 - DNA, 25 bp, Mus musculus
tttatctttccccaggccctacaga

SEQ ID NO: 494360 - DNA, 25 bp, Mus musculus
tttatgaaaaggcatgggtgaccca

SEQ ID NO: 494361 - DNA, 25 bp, Mus musculus
tttatgcaggtcttttggtgaggaa

SEQ ID NO: 494362 - DNA, 25 bp, Mus musculus
tttatgctgaagatgcggacccacc

SEQ ID NO: 494363 - DNA, 25 bp, Mus musculus
tttatgctgccaaagtaactcgccc

SEQ ID NO: 494364 - DNA, 25 bp, Mus musculus
tttatggagaacaagcagcctgagg

SEQ ID NO: 494365 - DNA, 25 bp, Mus musculus
tttatggatcagaagctgaggcccc

SEQ ID NO: 494366 - DNA, 25 bp, Mus musculus
tttatggatcagtgcaggaacgtgc

SEQ ID NO: 494367 - DNA, 25 bp, Mus musculus
tttatggcagaactaagatgacgtt

SEQ ID NO: 494368 - DNA, 25 bp, Mus musculus
tttatgggatgttccacacccgccg

SEQ ID NO: 494369 - DNA, 25 bp, Mus musculus
tttatgtagggagctccaggagagc

SEQ ID NO: 494370 - DNA, 25 bp, Mus musculus
tttattcagatgcaaatagtagcac

SEQ ID NO: 494371 - DNA, 25 bp, Mus musculus
tttattgatacaggaagactcggct

SEQ ID NO: 494372 - DNA, 25 bp, Mus musculus
tttattgcacgaaaccctgccgaga

SEQ ID NO: 494373 - DNA, 25 bp, Mus musculus
tttattgtcggctcgctatgtggcg

SEQ ID NO: 494374 - DNA, 25 bp, Mus musculus
tttattttaaatgccatggccggag

SEQ ID NO: 494375 - DNA, 25 bp, Mus musculus
tttcaaaacttaaggctcggctgtc

SEQ ID NO: 494376 - DNA, 25 bp, Mus musculus
tttcaaacaaatggcaagaatcggt

SEQ ID NO: 494377 - DNA, 25 bp, Mus musculus
tttcaaaccatgaccgaagtagccg

SEQ ID NO: 494378 - DNA, 25 bp, Mus musculus
tttcaaacgccatggagcagaagtg

SEQ ID NO: 494379 - DNA, 25 bp, Mus musculus
tttcaaactaatgcatgggtcaggg

SEQ ID NO: 494380 - DNA, 25 bp, Mus musculus
tttcaaagacgtcaggtccacggcc

SEQ ID NO: 494381 - DNA, 25 bp, Mus musculus
tttcaaagcagagaaggctaacggg

SEQ ID NO: 494382 - DNA, 25 bp, Mus musculus
tttcaaagcgcagtcagaagctcgg

SEQ ID NO: 494383 - DNA, 25 bp, Mus musculus
tttcaacagagaaaggccgctgctc

SEQ ID NO: 494384 - DNA, 25 bp, Mus musculus
tttcaaccgtgacatatcatgcggc

SEQ ID NO: 494385 - DNA, 25 bp, Mus musculus
tttcaaccgtgcatggatcagaggg

SEQ ID NO: 494386 - DNA, 25 bp, Mus musculus
tttcaacttctccaaggcggtcagg

SEQ ID NO: 494387 - DNA, 25 bp, Mus musculus
tttcaagaaagcgttgccagccctc

SEQ ID NO: 494388 - DNA, 25 bp, Mus musculus
tttcaagacccaacggcaatgatgc

SEQ ID NO: 494389 - DNA, 25 bp, Mus musculus
tttcaagacctcaagaacgagggcg

SEQ ID NO: 494390 - DNA, 25 bp, Mus musculus
tttcaagagcgcagagaagtggagc

SEQ ID NO: 494391 - DNA, 25 bp, Mus musculus
tttcaagagcgttttgcagcggccc

SEQ ID NO: 494392 - DNA, 25 bp, Mus musculus
tttcaagagtgaccgctacagtggc

SEQ ID NO: 494393 - DNA, 25 bp, Mus musculus
tttcaagattttagaggctgccctc

SEQ ID NO: 494394 - DNA, 25 bp, Mus musculus
tttcaagcagaatgtaacagatgtc

SEQ ID NO: 494395 - DNA, 25 bp, Mus musculus
tttcaaggaaaagctacaagatgtc

SEQ ID NO: 494396 - DNA, 25 bp, Mus musculus
tttcaaggcatatgatgagcttccg

SEQ ID NO: 494397 - DNA, 25 bp, Mus musculus
tttcaaggccagaaagaccggcttt

SEQ ID NO: 494398 - DNA, 25 bp, Mus musculus
tttcaagtgactatctccagagccg

SEQ ID NO: 494399 - DNA, 25 bp, Mus musculus
tttcaagtgcaagtgcggctccagc

SEQ ID NO: 494400 - DNA, 25 bp, Mus musculus
tttcaagttcttggctcctttacaa

SEQ ID NO: 494401 - DNA, 25 bp, Mus musculus
tttcaatctttaaggaactgtagac

SEQ ID NO: 494402 - DNA, 25 bp, Mus musculus
tttcaatggaggagaagcccggcca

SEQ ID NO: 494403 - DNA, 25 bp, Mus musculus
tttcaatgtaggatttggcacatac

SEQ ID NO: 494404 - DNA, 25 bp, Mus musculus
tttcaatttgaaagcggaggcttca

SEQ ID NO: 494405 - DNA, 25 bp, Mus musculus
tttcaatttgaaagtgaccaatggg

SEQ ID NO: 494406 - DNA, 25 bp, Mus musculus
tttcacaaagatgagggactgacct

SEQ ID NO: 494407 - DNA, 25 bp, Mus musculus
tttcacaagaaatgggctcaggagg

SEQ ID NO: 494408 - DNA, 25 bp, Mus musculus
tttcacacgcgggaagtcggcgctg

SEQ ID NO: 494409 - DNA, 25 bp, Mus musculus
tttcacacttatgcgggatgagcgc

SEQ ID NO: 494410 - DNA, 25 bp, Mus musculus
tttcacagagcagtcttgatgcggg

SEQ ID NO: 494411 - DNA, 25 bp, Mus musculus
tttcacagagggtacacagagcagg

SEQ ID NO: 494412 - DNA, 25 bp, Mus musculus
tttcacagtctaagccgaaccgaac

SEQ ID NO: 494413 - DNA, 25 bp, Mus musculus
tttcacatccttattcgcggccgga

SEQ ID NO: 494414 - DNA, 25 bp, Mus musculus
tttcacatgcaagtacggcctcgag

SEQ ID NO: 494415 - DNA, 25 bp, Mus musculus
tttcaccaacctgggccaacagagg

SEQ ID NO: 494416 - DNA, 25 bp, Mus musculus
tttcaccaagcttgcatcagctaca

SEQ ID NO: 494417 - DNA, 25 bp, Mus musculus
tttcaccagagtagtgcgatgggcc

SEQ ID NO: 494418 - DNA, 25 bp, Mus musculus
tttcaccccagcactcgagacgtag

SEQ ID NO: 494419 - DNA, 25 bp, Mus musculus
tttcacccctccaggcacctgaagc

SEQ ID NO: 494420 - DNA, 25 bp, Mus musculus
tttcaccggaggcaaaagtccacag

SEQ ID NO: 494421 - DNA, 25 bp, Mus musculus
tttcacctttgggagtaagtgggag

SEQ ID NO: 494422 - DNA, 25 bp, Mus musculus
tttcacggccacaccagaggatttc

SEQ ID NO: 494423 - DNA, 25 bp, Mus musculus
tttcactcagtaagttgaccaggct

SEQ ID NO: 494424 - DNA, 25 bp, Mus musculus
tttcagaaccgcagggcaaagtgga

SEQ ID NO: 494425 - DNA, 25 bp, Mus musculus
tttcagaactcacaaacagcacgga

SEQ ID NO: 494426 - DNA, 25 bp, Mus musculus
tttcagaagtagacaaagaggccac

SEQ ID NO: 494427 - DNA, 25 bp, Mus musculus
tttcagacacagatgctctgctggc

SEQ ID NO: 494428 - DNA, 25 bp, Mus musculus
tttcagacagacctgagtggctacc

SEQ ID NO: 494429 - DNA, 25 bp, Mus musculus
tttcagacgacagtgggagcatgga

SEQ ID NO: 494430 - DNA, 25 bp, Mus musculus
tttcagactctgattagcaggcccc

SEQ ID NO: 494431 - DNA, 25 bp, Mus musculus
tttcagactgtctcatggtggtgca

SEQ ID NO: 494432 - DNA, 25 bp, Mus musculus
tttcagagcccaagcaagccaaggt

SEQ ID NO: 494433 - DNA, 25 bp, Mus musculus
tttcagaggctggagggatcactgc

SEQ ID NO: 494434 - DNA, 25 bp, Mus musculus
tttcagagtctgatgcgagccctac

SEQ ID NO: 494435 - DNA, 25 bp, Mus musculus
tttcagattcttggctctatcacag

SEQ ID NO: 494436 - DNA, 25 bp, Mus musculus
tttcagcaaactcttaagagagttt

SEQ ID NO: 494437 - DNA, 25 bp, Mus musculus
tttcagcacccctatgataaagcat

SEQ ID NO: 494438 - DNA, 25 bp, Mus musculus
tttcagccctcttgtgcaggaccat

SEQ ID NO: 494439 - DNA, 25 bp, Mus musculus
tttcagcccttatcctcaaggcggg

SEQ ID NO: 494440 - DNA, 25 bp, Mus musculus
tttcagcggcagcacatggatccag

SEQ ID NO: 494441 - DNA, 25 bp, Mus musculus
tttcagctgagagcaggctgtgact

SEQ ID NO: 494442 - DNA, 25 bp, Mus musculus
tttcagctgatattgccatggccac

SEQ ID NO: 494443 - DNA, 25 bp, Mus musculus
tttcagctgccagggaagaggtccc

SEQ ID NO: 494444 - DNA, 25 bp, Mus musculus
tttcagctggctcacatgggtgtcc

SEQ ID NO: 494445 - DNA, 25 bp, Mus musculus
tttcaggaagaggaccctcccgatg

SEQ ID NO: 494446 - DNA, 25 bp, Mus musculus
tttcaggacagggacaacaatagct

SEQ ID NO: 494447 - DNA, 25 bp, Mus musculus
tttcaggatctctactaaggcggcc

SEQ ID NO: 494448 - DNA, 25 bp, Mus musculus
tttcaggatcttagccagctgcagg

SEQ ID NO: 494449 - DNA, 25 bp, Mus musculus
tttcaggcagagaaaaggacctttt

SEQ ID NO: 494450 - DNA, 25 bp, Mus musculus
tttcaggcatggagggaagaaccaa

SEQ ID NO: 494451 - DNA, 25 bp, Mus musculus
tttcaggccaacaaagtatacgcgg

SEQ ID NO: 494452 - DNA, 25 bp, Mus musculus
tttcaggcgcaaaacagtgatgtcc

SEQ ID NO: 494453 - DNA, 25 bp, Mus musculus
tttcaggtccctgcttgagcgtgca

SEQ ID NO: 494454 - DNA, 25 bp, Mus musculus
tttcaggtgtgttactatcatttca

SEQ ID NO: 494455 - DNA, 25 bp, Mus musculus
tttcagtaaggaaggaagccaccac

SEQ ID NO: 494456 - DNA, 25 bp, Mus musculus
tttcagtagtgcctcaagcctcggg

SEQ ID NO: 494457 - DNA, 25 bp, Mus musculus
tttcagtcaactctagcacagcggg

SEQ ID NO: 494458 - DNA, 25 bp, Mus musculus
tttcagtccctagacaaactttagc

SEQ ID NO: 494459 - DNA, 25 bp, Mus musculus
tttcagtggatgtggtggcatcagc

SEQ ID NO: 494460 - DNA, 25 bp, Mus musculus
tttcagtgggaacaaagggctccgc

SEQ ID NO: 494461 - DNA, 25 bp, Mus musculus
tttcataatggaagcttgtgagcct

SEQ ID NO: 494462 - DNA, 25 bp, Mus musculus
tttcataatggtgtggctgccggcc

SEQ ID NO: 494463 - DNA, 25 bp, Mus musculus
tttcataggacacagaagaccagag

SEQ ID NO: 494464 - DNA, 25 bp, Mus musculus
tttcatcaagactcgtggtggcacg

SEQ ID NO: 494465 - DNA, 25 bp, Mus musculus
tttcatcaagatccctcggaggccg

SEQ ID NO: 494466 - DNA, 25 bp, Mus musculus
tttcatcagacgacaacggccagga

SEQ ID NO: 494467 - DNA, 25 bp, Mus musculus
tttcatcatgccctgaccctcggga

SEQ ID NO: 494468 - DNA, 25 bp, Mus musculus
tttcatccaggatcgagcagggagg

SEQ ID NO: 494469 - DNA, 25 bp, Mus musculus
tttcatctgcttggttttctaccga

SEQ ID NO: 494470 - DNA, 25 bp, Mus musculus
tttcatgaggctcctgatggatgcg

SEQ ID NO: 494471 - DNA, 25 bp, Mus musculus
tttcatgattaagagtcccagagcc

SEQ ID NO: 494472 - DNA, 25 bp, Mus musculus
tttcatgctggagtgtgtacggctc

SEQ ID NO: 494473 - DNA, 25 bp, Mus musculus
tttcatggaatgagactgtcaggca

SEQ ID NO: 494474 - DNA, 25 bp, Mus musculus
tttcatggcaaatcatgggcagccc

SEQ ID NO: 494475 - DNA, 25 bp, Mus musculus
tttcatgtgtaagtgtgacccatcg

SEQ ID NO: 494476 - DNA, 25 bp, Mus musculus
tttcatgtttgctagcctgtgcccc

SEQ ID NO: 494477 - DNA, 25 bp, Mus musculus
tttcattcctgagcccgtgtgctgc

SEQ ID NO: 494478 - DNA, 25 bp, Mus musculus
tttccaaaatggcatcgggcatccc

SEQ ID NO: 494479 - DNA, 25 bp, Mus musculus
tttccaaaggcaacagctaggaggc

SEQ ID NO: 494480 - DNA, 25 bp, Mus musculus
tttccaaagtgggacacagcctgtc

SEQ ID NO: 494481 - DNA, 25 bp, Mus musculus
tttccaaatggcagaaggatcgtct

SEQ ID NO: 494482 - DNA, 25 bp, Mus musculus
tttccaaccaacataaactcccatt

SEQ ID NO: 494483 - DNA, 25 bp, Mus musculus
tttccaacctgagagccaatggcag

SEQ ID NO: 494484 - DNA, 25 bp, Mus musculus
tttccaactggcaatgggatccgga

SEQ ID NO: 494485 - DNA, 25 bp, Mus musculus
tttccaactggttcggtaacaagcg

SEQ ID NO: 494486 - DNA, 25 bp, Mus musculus
tttccaacttggacgaggagagtcg

SEQ ID NO: 494487 - DNA, 25 bp, Mus musculus
tttccaagacggcagagctcagcct

SEQ ID NO: 494488 - DNA, 25 bp, Mus musculus
tttccaagagctagaaggacccagg

SEQ ID NO: 494489 - DNA, 25 bp, Mus musculus
tttccaagctgattcctgaggccct

SEQ ID NO: 494490 - DNA, 25 bp, Mus musculus
tttccaaggaagttacagagccggc

SEQ ID NO: 494491 - DNA, 25 bp, Mus musculus
tttccaaggtagtgagcagacagcc

SEQ ID NO: 494492 - DNA, 25 bp, Mus musculus
tttccaagtgcacccaaagtctcgg

SEQ ID NO: 494493 - DNA, 25 bp, Mus musculus
tttccaatgcaaaagccacaggtgg

SEQ ID NO: 494494 - DNA, 25 bp, Mus musculus
tttccacaaaaatgacacgggatgg

SEQ ID NO: 494495 - DNA, 25 bp, Mus musculus
tttccacagacagaatctatactag

SEQ ID NO: 494496 - DNA, 25 bp, Mus musculus
tttccacatcgcaggaacgggcagg

SEQ ID NO: 494497 - DNA, 25 bp, Mus musculus
tttccaccacgtgggagctcttgct

SEQ ID NO: 494498 - DNA, 25 bp, Mus musculus
tttccacctggacaagtacagggca

SEQ ID NO: 494499 - DNA, 25 bp, Mus musculus
tttccacgctcacagacgaggaggc

SEQ ID NO: 494500 - DNA, 25 bp, Mus musculus
tttccactggtgattttaaattgat

SEQ ID NO: 494501 - DNA, 25 bp, Mus musculus
tttccactgtggtagtgacagccct

SEQ ID NO: 494502 - DNA, 25 bp, Mus musculus
tttccagacagacaatatgagccct

SEQ ID NO: 494503 - DNA, 25 bp, Mus musculus
tttccagactggtacatgttatcac

SEQ ID NO: 494504 - DNA, 25 bp, Mus musculus
tttccagagctcaggaccaaaggat

SEQ ID NO: 494505 - DNA, 25 bp, Mus musculus
tttccagaggatctgcaggtaccgc

SEQ ID NO: 494506 - DNA, 25 bp, Mus musculus
tttccagatgatgagacagacccag

SEQ ID NO: 494507 - DNA, 25 bp, Mus musculus
tttccagcagctaaacaccaggctc

SEQ ID NO: 494508 - DNA, 25 bp, Mus musculus
tttccagcggcaggtccatgagagc

SEQ ID NO: 494509 - DNA, 25 bp, Mus musculus
tttccaggaccacgacagactcttt

SEQ ID NO: 494510 - DNA, 25 bp, Mus musculus
tttccaggacgagaacagcacctca

SEQ ID NO: 494511 - DNA, 25 bp, Mus musculus
tttccaggatacgatggaggctccc

SEQ ID NO: 494512 - DNA, 25 bp, Mus musculus
tttccaggcggaaccaaaactgtgc

SEQ ID NO: 494513 - DNA, 25 bp, Mus musculus
tttccaggcgtctgcagagtaccag

SEQ ID NO: 494514 - DNA, 25 bp, Mus musculus
tttccagggcgagaagatcgagtct

SEQ ID NO: 494515 - DNA, 25 bp, Mus musculus
tttccaggttaagtaaaggcgatct

SEQ ID NO: 494516 - DNA, 25 bp, Mus musculus
tttccagtatgtgggcgcctctgct

SEQ ID NO: 494517 - DNA, 25 bp, Mus musculus
tttccataactgagacctcgcgccg

SEQ ID NO: 494518 - DNA, 25 bp, Mus musculus
tttccataatgcaacaatgtgacag

SEQ ID NO: 494519 - DNA, 25 bp, Mus musculus
tttccatagagacggagacatcctg

SEQ ID NO: 494520 - DNA, 25 bp, Mus musculus
tttccatctctgaccacaggagtgg

SEQ ID NO: 494521 - DNA, 25 bp, Mus musculus
tttccatgacaatgcctcccttcag

SEQ ID NO: 494522 - DNA, 25 bp, Mus musculus
tttccatgcgcgctccttcggttca

SEQ ID NO: 494523 - DNA, 25 bp, Mus musculus
tttccatggcaaccaaagacaggcg

SEQ ID NO: 494524 - DNA, 25 bp, Mus musculus
tttccatggcagcaagaagcggagc

SEQ ID NO: 494525 - DNA, 25 bp, Mus musculus
tttccattgtcagccatatccaggg

SEQ ID NO: 494526 - DNA, 25 bp, Mus musculus
tttcccaaaacctcgtgagctcgca

SEQ ID NO: 494527 - DNA, 25 bp, Mus musculus
tttcccaaacgtagtccaaagtctg

SEQ ID NO: 494528 - DNA, 25 bp, Mus musculus
tttcccaaagagtaccgggtgccag

SEQ ID NO: 494529 - DNA, 25 bp, Mus musculus
tttcccacacgtcagggctttcctg

SEQ ID NO: 494530 - DNA, 25 bp, Mus musculus
tttcccacagcattgaagcatccag

SEQ ID NO: 494531 - DNA, 25 bp, Mus musculus
tttcccagagaggaggagtgagccc

SEQ ID NO: 494532 - DNA, 25 bp, Mus musculus
tttcccagcaatgtctaagagtttc

SEQ ID NO: 494533 - DNA, 25 bp, Mus musculus
tttcccagcagagcctacaaaaggt

SEQ ID NO: 494534 - DNA, 25 bp, Mus musculus
tttcccaggaaaggagaccattagc

SEQ ID NO: 494535 - DNA, 25 bp, Mus musculus
tttcccatgagggtgctagcgccag

SEQ ID NO: 494536 - DNA, 25 bp, Mus musculus
tttcccatggagacctgaggcaagg

SEQ ID NO: 494537 - DNA, 25 bp, Mus musculus
tttcccattagctgtgggaggaagc

SEQ ID NO: 494538 - DNA, 25 bp, Mus musculus
tttccccaggttttcagtgccaagg

SEQ ID NO: 494539 - DNA, 25 bp, Mus musculus
tttccccgtaagaagcagtgctagt

SEQ ID NO: 494540 - DNA, 25 bp, Mus musculus
tttcccctggatggagagcagtcgc

SEQ ID NO: 494541 - DNA, 25 bp, Mus musculus
tttcccctgtgaagctataagggca

SEQ ID NO: 494542 - DNA, 25 bp, Mus musculus
tttcccctgtggagcagtactggcc

SEQ ID NO: 494543 - DNA, 25 bp, Mus musculus
tttccccttccctagtttgcaggct

SEQ ID NO: 494544 - DNA, 25 bp, Mus musculus
tttcccgagggcatgactgggtcct

SEQ ID NO: 494545 - DNA, 25 bp, Mus musculus
tttcccgcgaggacaggtagggtca

SEQ ID NO: 494546 - DNA, 25 bp, Mus musculus
tttcccggaagtgctagaagacacc

SEQ ID NO: 494547 - DNA, 25 bp, Mus musculus
tttcccggatgcacgttgaccagcg

SEQ ID NO: 494548 - DNA, 25 bp, Mus musculus
tttcccgggataagtagcgttagcg

SEQ ID NO: 494549 - DNA, 25 bp, Mus musculus
tttcccgggtgctaggctccaggta

SEQ ID NO: 494550 - DNA, 25 bp, Mus musculus
tttcccgtggttggagatgtctcag

SEQ ID NO: 494551 - DNA, 25 bp, Mus musculus
tttccctccgggtgcgtgactcttc

SEQ ID NO: 494552 - DNA, 25 bp, Mus musculus
tttccctgatgtatggcaagagccc

SEQ ID NO: 494553 - DNA, 25 bp, Mus musculus
tttccctgcttctaagtggccgccg

SEQ ID NO: 494554 - DNA, 25 bp, Mus musculus
tttccctgggtatcaagtggcttct

SEQ ID NO: 494555 - DNA, 25 bp, Mus musculus
tttccctgtgcagtcggtggacctg

SEQ ID NO: 494556 - DNA, 25 bp, Mus musculus
tttccgaaaggagcgcattgagggc

SEQ ID NO: 494557 - DNA, 25 bp, Mus musculus
tttccgagaggcgttaaggcccact

SEQ ID NO: 494558 - DNA, 25 bp, Mus musculus
tttccgagatgtatgacctgtcagc

SEQ ID NO: 494559 - DNA, 25 bp, Mus musculus
tttccgagggcttgacatcagggtc

SEQ ID NO: 494560 - DNA, 25 bp, Mus musculus
tttccgaggtgctgtgcccggttcg

SEQ ID NO: 494561 - DNA, 25 bp, Mus musculus
tttccgcacagcgaggatcggcagt

SEQ ID NO: 494562 - DNA, 25 bp, Mus musculus
tttccgcagacacagcaggctgatg

SEQ ID NO: 494563 - DNA, 25 bp, Mus musculus
tttccgctgcggtcttaaagacgct

SEQ ID NO: 494564 - DNA, 25 bp, Mus musculus
tttccggacgttaaggtgtgatccg

SEQ ID NO: 494565 - DNA, 25 bp, Mus musculus
tttccgggaaatgccacggtgcgct

SEQ ID NO: 494566 - DNA, 25 bp, Mus musculus
tttccggtgacaagtacagcgtgcg

SEQ ID NO: 494567 - DNA, 25 bp, Mus musculus
tttccgtcactcacaatccgaaggg

SEQ ID NO: 494568 - DNA, 25 bp, Mus musculus
tttccgttaccgatcagacctgagg

SEQ ID NO: 494569 - DNA, 25 bp, Mus musculus
tttcctaaaagcacaatttgtcaag

SEQ ID NO: 494570 - DNA, 25 bp, Mus musculus
tttcctagacctgcatatgacccgt

SEQ ID NO: 494571 - DNA, 25 bp, Mus musculus
tttcctagctaggactacaggttcc

SEQ ID NO: 494572 - DNA, 25 bp, Mus musculus
tttcctagctgagcaagcgcagccg

SEQ ID NO: 494573 - DNA, 25 bp, Mus musculus
tttcctatagctaaaccggacagcc

SEQ ID NO: 494574 - DNA, 25 bp, Mus musculus
tttcctatcagctctctgcgacgca

SEQ ID NO: 494575 - DNA, 25 bp, Mus musculus
tttcctatgtgaccaaagagacggg

SEQ ID NO: 494576 - DNA, 25 bp, Mus musculus
tttcctcaacgacgcggacatggtc

SEQ ID NO: 494577 - DNA, 25 bp, Mus musculus
tttcctcaatcaagcgggtcagagg

SEQ ID NO: 494578 - DNA, 25 bp, Mus musculus
tttcctcagatatcccgcagctctt

SEQ ID NO: 494579 - DNA, 25 bp, Mus musculus
tttcctcagtatcagaactctatct

SEQ ID NO: 494580 - DNA, 25 bp, Mus musculus
tttcctcatgcgctgtgcgtgccgc

SEQ ID NO: 494581 - DNA, 25 bp, Mus musculus
tttcctcattgggatgaagaagctg

SEQ ID NO: 494582 - DNA, 25 bp, Mus musculus
tttcctccagaaagacaagcaacgg

SEQ ID NO: 494583 - DNA, 25 bp, Mus musculus
tttcctcccagatgcagctgtagcc

SEQ ID NO: 494584 - DNA, 25 bp, Mus musculus
tttcctccgagaggacagtctgcgg

SEQ ID NO: 494585 - DNA, 25 bp, Mus musculus
tttcctctcccctgtagctttgcag

SEQ ID NO: 494586 - DNA, 25 bp, Mus musculus
tttcctctcttaaacctagaattgt

SEQ ID NO: 494587 - DNA, 25 bp, Mus musculus
tttcctgactaagagaaaccggcag

SEQ ID NO: 494588 - DNA, 25 bp, Mus musculus
tttcctgagaaatagaattagagcc

SEQ ID NO: 494589 - DNA, 25 bp, Mus musculus
tttcctgcacaactgacaagcctgg

SEQ ID NO: 494590 - DNA, 25 bp, Mus musculus
tttcctgcagaagtcacacgtgggc

SEQ ID NO: 494591 - DNA, 25 bp, Mus musculus
tttcctgccattcttctgagaggcg

SEQ ID NO: 494592 - DNA, 25 bp, Mus musculus
tttcctggagctgcatcgggttccc

SEQ ID NO: 494593 - DNA, 25 bp, Mus musculus
tttcctgggcattcctccgagatct

SEQ ID NO: 494594 - DNA, 25 bp, Mus musculus
tttcctggtgatgcccgaatgcctg

SEQ ID NO: 494595 - DNA, 25 bp, Mus musculus
tttccttcacctataagcttttttg

SEQ ID NO: 494596 - DNA, 25 bp, Mus musculus
tttccttcagggagtatgccagacc

SEQ ID NO: 494597 - DNA, 25 bp, Mus musculus
tttccttcatgaccgagctcctgca

SEQ ID NO: 494598 - DNA, 25 bp, Mus musculus
tttccttctctcctgcctcaaagag

SEQ ID NO: 494599 - DNA, 25 bp, Mus musculus
tttccttctgaagttcatctaaggc

SEQ ID NO: 494600 - DNA, 25 bp, Mus musculus
tttccttctgtgttggctgccgttc

SEQ ID NO: 494601 - DNA, 25 bp, Mus musculus
tttccttgtatgaactccctggaag

SEQ ID NO: 494602 - DNA, 25 bp, Mus musculus
tttcctttcccattcctagattttg

SEQ ID NO: 494603 - DNA, 25 bp, Mus musculus
tttcctttgctcactctgctttgga

SEQ ID NO: 494604 - DNA, 25 bp, Mus musculus
tttcctttggcacagtctgcgggtg

SEQ ID NO: 494605 - DNA, 25 bp, Mus musculus
tttccttttactgcgcctgcgtgcg

SEQ ID NO: 494606 - DNA, 25 bp, Mus musculus
tttcgaaatacaatcccggcctctg

SEQ ID NO: 494607 - DNA, 25 bp, Mus musculus
tttcgaagaggctcaggacaccctg

SEQ ID NO: 494608 - DNA, 25 bp, Mus musculus
tttcgaagcaataaatccgggccgg

SEQ ID NO: 494609 - DNA, 25 bp, Mus musculus
tttcgaagcgaaactgggtgcagac

SEQ ID NO: 494610 - DNA, 25 bp, Mus musculus
tttcgacagattggcaattgtggcc

SEQ ID NO: 494611 - DNA, 25 bp, Mus musculus
tttcgaccctggaaagaaggtggag

SEQ ID NO: 494612 - DNA, 25 bp, Mus musculus
tttcgacggaaaaacaaggcagcgg

SEQ ID NO: 494613 - DNA, 25 bp, Mus musculus
tttcgactgcgcagagaagatcggg

SEQ ID NO: 494614 - DNA, 25 bp, Mus musculus
tttcgactggcgtctggagaagccg

SEQ ID NO: 494615 - DNA, 25 bp, Mus musculus
tttcgagacgctcaagaggtgcacc

SEQ ID NO: 494616 - DNA, 25 bp, Mus musculus
tttcgagtcaggaaacgatgtgtct

SEQ ID NO: 494617 - DNA, 25 bp, Mus musculus
tttcgatctgaagcgctacctgagc

SEQ ID NO: 494618 - DNA, 25 bp, Mus musculus
tttcgcagagggagcatagagcacg

SEQ ID NO: 494619 - DNA, 25 bp, Mus musculus
tttcgcagtgttagaagcgtcttgc

SEQ ID NO: 494620 - DNA, 25 bp, Mus musculus
tttcgccagcgcttccggcagtttc

SEQ ID NO: 494621 - DNA, 25 bp, Mus musculus
tttcgccccggtagcggtgccatgg

SEQ ID NO: 494622 - DNA, 25 bp, Mus musculus
tttcgcctgctcagtggtccacgag

SEQ ID NO: 494623 - DNA, 25 bp, Mus musculus
tttcgctaatgcaagaggagcagcc

SEQ ID NO: 494624 - DNA, 25 bp, Mus musculus
tttcgctccggcacgcctagggacg

SEQ ID NO: 494625 - DNA, 25 bp, Mus musculus
tttcgctgtcgcagctattgccccg

SEQ ID NO: 494626 - DNA, 25 bp, Mus musculus
tttcggaaagacctgtttgtggcca

SEQ ID NO: 494627 - DNA, 25 bp, Mus musculus
tttcggaacagggaagacaccacca

SEQ ID NO: 494628 - DNA, 25 bp, Mus musculus
tttcggatcaaaggttcccaggcct

SEQ ID NO: 494629 - DNA, 25 bp, Mus musculus
tttcggcagaggcacaaatcagtgc

SEQ ID NO: 494630 - DNA, 25 bp, Mus musculus
tttcggccaggacaacttcccagtg

SEQ ID NO: 494631 - DNA, 25 bp, Mus musculus
tttcggcttcgtcactttcatggac

SEQ ID NO: 494632 - DNA, 25 bp, Mus musculus
tttcgggaaacttcgactctgttgg

SEQ ID NO: 494633 - DNA, 25 bp, Mus musculus
tttcgggaatggtccaaaagccagc

SEQ ID NO: 494634 - DNA, 25 bp, Mus musculus
tttcggtccaaggtagagctcccgc

SEQ ID NO: 494635 - DNA, 25 bp, Mus musculus
tttcggtcccaaagcctcaacagag

SEQ ID NO: 494636 - DNA, 25 bp, Mus musculus
tttcgtcaaggtgccgcgcgagccg

SEQ ID NO: 494637 - DNA, 25 bp, Mus musculus
tttcgtcgacaaaagccaacatgga

SEQ ID NO: 494638 - DNA, 25 bp, Mus musculus
tttcgttgccaaggatgatcgcctg

SEQ ID NO: 494639 - DNA, 25 bp, Mus musculus
tttcgttgttccactggctgatggc

SEQ ID NO: 494640 - DNA, 25 bp, Mus musculus
tttctaacctcgagtggacagcgtc

SEQ ID NO: 494641 - DNA, 25 bp, Mus musculus
tttctaactgactgccttggagcca

SEQ ID NO: 494642 - DNA, 25 bp, Mus musculus
tttctaagacatggccgtgcgcgtc

SEQ ID NO: 494643 - DNA, 25 bp, Mus musculus
tttctaatcttcagatggaaggcct

SEQ ID NO: 494644 - DNA, 25 bp, Mus musculus
tttctaatggaaacgccagggctca

SEQ ID NO: 494645 - DNA, 25 bp, Mus musculus
tttctacaagaagcgaccactggcc

SEQ ID NO: 494646 - DNA, 25 bp, Mus musculus
tttctacaggttccatggcagctgc

SEQ ID NO: 494647 - DNA, 25 bp, Mus musculus
tttctacagtatgaagcctacactg

SEQ ID NO: 494648 - DNA, 25 bp, Mus musculus
tttctaccacatgtacggagcaggg

SEQ ID NO: 494649 - DNA, 25 bp, Mus musculus
tttctaccagaacctaggcccaggg

SEQ ID NO: 494650 - DNA, 25 bp, Mus musculus
tttctaccatgagggactggaccct

SEQ ID NO: 494651 - DNA, 25 bp, Mus musculus
tttctacctacacaacgagctgggc

SEQ ID NO: 494652 - DNA, 25 bp, Mus musculus
tttctactgacaagactgacactgt

SEQ ID NO: 494653 - DNA, 25 bp, Mus musculus
tttctactggccctcactgttgtgc

SEQ ID NO: 494654 - DNA, 25 bp, Mus musculus
tttctagacgcaattgaccggaggg

SEQ ID NO: 494655 - DNA, 25 bp, Mus musculus
tttctaggaaagatggctaagagcc

SEQ ID NO: 494656 - DNA, 25 bp, Mus musculus
tttctaggagctccggttctgtcgg

SEQ ID NO: 494657 - DNA, 25 bp, Mus musculus
tttctagtatggaaggctgcctgcc

SEQ ID NO: 494658 - DNA, 25 bp, Mus musculus
tttctataataatccaccccagtgg

SEQ ID NO: 494659 - DNA, 25 bp, Mus musculus
tttctatgagaaagcctatggagcc

SEQ ID NO: 494660 - DNA, 25 bp, Mus musculus
tttctatgagcagcacaaccgaccg

SEQ ID NO: 494661 - DNA, 25 bp, Mus musculus
tttctatgggccactctggactggc

SEQ ID NO: 494662 - DNA, 25 bp, Mus musculus
tttctatgtgtcttttctaaaagac

SEQ ID NO: 494663 - DNA, 25 bp, Mus musculus
tttctattaaccacaactgggtcaa

SEQ ID NO: 494664 - DNA, 25 bp, Mus musculus
tttctcaagttaatggcagtgtacc

SEQ ID NO: 494665 - DNA, 25 bp, Mus musculus
tttctcagacggcttctccagtggc

SEQ ID NO: 494666 - DNA, 25 bp, Mus musculus
tttctcaggtaggactgtgaaggga

SEQ ID NO: 494667 - DNA, 25 bp, Mus musculus
tttctccatcatgctaatgccaggc

SEQ ID NO: 494668 - DNA, 25 bp, Mus musculus
tttctccctgtagagggaaggaggc

SEQ ID NO: 494669 - DNA, 25 bp, Mus musculus
tttctcctggactcaacactgcctg

SEQ ID NO: 494670 - DNA, 25 bp, Mus musculus
tttctcctggtaacaatgactggca

SEQ ID NO: 494671 - DNA, 25 bp, Mus musculus
tttctcgcagattgaccccaaggtg

SEQ ID NO: 494672 - DNA, 25 bp, Mus musculus
tttctcgccaacgacgtcaaatggg

SEQ ID NO: 494673 - DNA, 25 bp, Mus musculus
tttctcgcgcccctaggagactacg

SEQ ID NO: 494674 - DNA, 25 bp, Mus musculus
tttctcgtgacaagaagccgtggcg

SEQ ID NO: 494675 - DNA, 25 bp, Mus musculus
tttctctcaggatcttcaagcgggt

SEQ ID NO: 494676 - DNA, 25 bp, Mus musculus
tttctctcgctgaagggactgaggg

SEQ ID NO: 494677 - DNA, 25 bp, Mus musculus
tttctctctaatgggcagggcttcg

SEQ ID NO: 494678 - DNA, 25 bp, Mus musculus
tttctctgccatcaggagcaccaac

SEQ ID NO: 494679 - DNA, 25 bp, Mus musculus
tttctctgctttgtggagccccgag

SEQ ID NO: 494680 - DNA, 25 bp, Mus musculus
tttctctgtggaccacctcggcggt

SEQ ID NO: 494681 - DNA, 25 bp, Mus musculus
tttctcttatcaccctgtctctatc

SEQ ID NO: 494682 - DNA, 25 bp, Mus musculus
tttctcttcgaaagggtgctgccca

SEQ ID NO: 494683 - DNA, 25 bp, Mus musculus
tttctcttggcatgaatggtcaagc

SEQ ID NO: 494684 - DNA, 25 bp, Mus musculus
tttctgaaacccaagcgaactgagg

SEQ ID NO: 494685 - DNA, 25 bp, Mus musculus
tttctgaaagctggactctctctgc

SEQ ID NO: 494686 - DNA, 25 bp, Mus musculus
tttctgaactaaaagccaagtgatg

SEQ ID NO: 494687 - DNA, 25 bp, Mus musculus
tttctgaactgtaccggtggccgga

SEQ ID NO: 494688 - DNA, 25 bp, Mus musculus
tttctgaagacacttcgggctggcc

SEQ ID NO: 494689 - DNA, 25 bp, Mus musculus
tttctgaagagtgagtataaccctg

SEQ ID NO: 494690 - DNA, 25 bp, Mus musculus
tttctgaagctaaccggaccgtcac

SEQ ID NO: 494691 - DNA, 25 bp, Mus musculus
tttctgaaggcttacgggcagcgcg

SEQ ID NO: 494692 - DNA, 25 bp, Mus musculus
tttctgaccagaatgcggataacgc

SEQ ID NO: 494693 - DNA, 25 bp, Mus musculus
tttctgactggcacaaccacaggag

SEQ ID NO: 494694 - DNA, 25 bp, Mus musculus
tttctgaggagcaccagggcgtgaa

SEQ ID NO: 494695 - DNA, 25 bp, Mus musculus
tttctgaggcacatgttggactact

SEQ ID NO: 494696 - DNA, 25 bp, Mus musculus
tttctgaggctagcaagggcatcgg

SEQ ID NO: 494697 - DNA, 25 bp, Mus musculus
tttctgatccctctgggtctcggcg

SEQ ID NO: 494698 - DNA, 25 bp, Mus musculus
tttctgcaaaatggagcccttcccg

SEQ ID NO: 494699 - DNA, 25 bp, Mus musculus
tttctgcaaagctggagtcaagggc

SEQ ID NO: 494700 - DNA, 25 bp, Mus musculus
tttctgcaagccaacagcatgagtg

SEQ ID NO: 494701 - DNA, 25 bp, Mus musculus
tttctgcactcttcgggaaccggct

SEQ ID NO: 494702 - DNA, 25 bp, Mus musculus
tttctgccaaaacccgagattaagt

SEQ ID NO: 494703 - DNA, 25 bp, Mus musculus
tttctgccagacatgaagaggcgcc

SEQ ID NO: 494704 - DNA, 25 bp, Mus musculus
tttctgccccagtcagctcatctgt

SEQ ID NO: 494705 - DNA, 25 bp, Mus musculus
tttctgccttggagttgggcaccct

SEQ ID NO: 494706 - DNA, 25 bp, Mus musculus
tttctgcgtcctccgcgatgaggcg

SEQ ID NO: 494707 - DNA, 25 bp, Mus musculus
tttctgctgaacgtactagaccgcg

SEQ ID NO: 494708 - DNA, 25 bp, Mus musculus
tttctgctggccataccggtccttg

SEQ ID NO: 494709 - DNA, 25 bp, Mus musculus
tttctgctggtggattctaaaaggc

SEQ ID NO: 494710 - DNA, 25 bp, Mus musculus
tttctggagccttgagctgggtccc

SEQ ID NO: 494711 - DNA, 25 bp, Mus musculus
tttctggaggaacttaacacgacca

SEQ ID NO: 494712 - DNA, 25 bp, Mus musculus
tttctggatagtggccacaggtcct

SEQ ID NO: 494713 - DNA, 25 bp, Mus musculus
tttctggatcatgaggccgaggctg

SEQ ID NO: 494714 - DNA, 25 bp, Mus musculus
tttctggatgcgttaccacgggccc

SEQ ID NO: 494715 - DNA, 25 bp, Mus musculus
tttctggcacaagtcaggctgagct

SEQ ID NO: 494716 - DNA, 25 bp, Mus musculus
tttctggcaccctaggaaccagtgg

SEQ ID NO: 494717 - DNA, 25 bp, Mus musculus
tttctggctaaaggagagatctcga

SEQ ID NO: 494718 - DNA, 25 bp, Mus musculus
tttctgggcagctttgaaagctaag

SEQ ID NO: 494719 - DNA, 25 bp, Mus musculus
tttctgggccactcacacttctttg

SEQ ID NO: 494720 - DNA, 25 bp, Mus musculus
tttctggtactgtcacttacctggc

SEQ ID NO: 494721 - DNA, 25 bp, Mus musculus
tttctgtaaaagtgcgtccatcccc

SEQ ID NO: 494722 - DNA, 25 bp, Mus musculus
tttctgtaaaccaagcgccatgctg

SEQ ID NO: 494723 - DNA, 25 bp, Mus musculus
tttctgtaagtctgccgtgctttcc

SEQ ID NO: 494724 - DNA, 25 bp, Mus musculus
tttctgtactttcccagctagaagt

SEQ ID NO: 494725 - DNA, 25 bp, Mus musculus
tttctgtccagaggataccacatgg

SEQ ID NO: 494726 - DNA, 25 bp, Mus musculus
tttctgtggaagaccgaccgatgcc

SEQ ID NO: 494727 - DNA, 25 bp, Mus musculus
tttctgttaagcacgcgagctggag

SEQ ID NO: 494728 - DNA, 25 bp, Mus musculus
tttctgttagcagattttccacccc

SEQ ID NO: 494729 - DNA, 25 bp, Mus musculus
tttctgttgagagaggtattcaaag

SEQ ID NO: 494730 - DNA, 25 bp, Mus musculus
tttctgtttgcacagaccgttcttg

SEQ ID NO: 494731 - DNA, 25 bp, Mus musculus
tttctgtttggactgaacgagtaac

SEQ ID NO: 494732 - DNA, 25 bp, Mus musculus
tttcttacagctcctgggtctacct

SEQ ID NO: 494733 - DNA, 25 bp, Mus musculus
tttcttaccaaggtgtattgtgcgg

SEQ ID NO: 494734 - DNA, 25 bp, Mus musculus
tttcttagacacactggcaccacgg

SEQ ID NO: 494735 - DNA, 25 bp, Mus musculus
tttcttccccagcaagagccctgag

SEQ ID NO: 494736 - DNA, 25 bp, Mus musculus
tttcttcctccgtgctggtggctcc

SEQ ID NO: 494737 - DNA, 25 bp, Mus musculus
tttcttctctgccattgccacgtga

SEQ ID NO: 494738 - DNA, 25 bp, Mus musculus
tttcttctctgctagttgattcctg

SEQ ID NO: 494739 - DNA, 25 bp, Mus musculus
tttcttctgcagttcggccggtact

SEQ ID NO: 494740 - DNA, 25 bp, Mus musculus
tttcttctgctcaagggcccatacg

SEQ ID NO: 494741 - DNA, 25 bp, Mus musculus
tttcttcttaaacgtgcctgccggc

SEQ ID NO: 494742 - DNA, 25 bp, Mus musculus
tttcttgaaataccccaggaatggc

SEQ ID NO: 494743 - DNA, 25 bp, Mus musculus
tttcttgacatagagccagccagca

SEQ ID NO: 494744 - DNA, 25 bp, Mus musculus
tttcttgagcagaccagaggacgcg

SEQ ID NO: 494745 - DNA, 25 bp, Mus musculus
tttcttgcgcagaggatcagcagca

SEQ ID NO: 494746 - DNA, 25 bp, Mus musculus
tttcttgctcggagatgaacggccg

SEQ ID NO: 494747 - DNA, 25 bp, Mus musculus
tttcttggaacgcagcagcacacac

SEQ ID NO: 494748 - DNA, 25 bp, Mus musculus
tttcttggggtcagaggatccctaa

SEQ ID NO: 494749 - DNA, 25 bp, Mus musculus
tttctttcaaaccagggtgggcctg

SEQ ID NO: 494750 - DNA, 25 bp, Mus musculus
tttctttcaggtacgtgctggcccg

SEQ ID NO: 494751 - DNA, 25 bp, Mus musculus
tttctttgcaggagcgacagctgag

SEQ ID NO: 494752 - DNA, 25 bp, Mus musculus
tttgaaaaaccccaggcatggtgct

SEQ ID NO: 494753 - DNA, 25 bp, Mus musculus
tttgaaaacctgaacatagtcgctg

SEQ ID NO: 494754 - DNA, 25 bp, Mus musculus
tttgaaaaggatcgctgcctcggcc

SEQ ID NO: 494755 - DNA, 25 bp, Mus musculus
tttgaaaatgtgcaggtgttgacca

SEQ ID NO: 494756 - DNA, 25 bp, Mus musculus
tttgaaacagggtcagttatctgcc

SEQ ID NO: 494757 - DNA, 25 bp, Mus musculus
tttgaaaccaccatgacatcctggg

SEQ ID NO: 494758 - DNA, 25 bp, Mus musculus
tttgaaaccaggatgaaggcccagg

SEQ ID NO: 494759 - DNA, 25 bp, Mus musculus
tttgaaaccatttacctacagtgac

SEQ ID NO: 494760 - DNA, 25 bp, Mus musculus
tttgaaagcaaaacactgcagcccc

SEQ ID NO: 494761 - DNA, 25 bp, Mus musculus
tttgaaagcagcaatgactcattct

SEQ ID NO: 494762 - DNA, 25 bp, Mus musculus
tttgaaaggctgacccgagagctgg

SEQ ID NO: 494763 - DNA, 25 bp, Mus musculus
tttgaaagtctggaccaggcccaca

SEQ ID NO: 494764 - DNA, 25 bp, Mus musculus
tttgaaagtgggtgagactgagcat

SEQ ID NO: 494765 - DNA, 25 bp, Mus musculus
tttgaaatcaagatgacagccggct

SEQ ID NO: 494766 - DNA, 25 bp, Mus musculus
tttgaaatctccctgttggatcatc

SEQ ID NO: 494767 - DNA, 25 bp, Mus musculus
tttgaaatgttctcgctcagcggca

SEQ ID NO: 494768 - DNA, 25 bp, Mus musculus
tttgaaattataaagtcacctcctc

SEQ ID NO: 494769 - DNA, 25 bp, Mus musculus
tttgaaattgaacccagagcccaag

SEQ ID NO: 494770 - DNA, 25 bp, Mus musculus
tttgaacaaaatggcccctataggc

SEQ ID NO: 494771 - DNA, 25 bp, Mus musculus
tttgaacagcaaggagatgtggtcc

SEQ ID NO: 494772 - DNA, 25 bp, Mus musculus
tttgaaccagcgcaaccaagaactg

SEQ ID NO: 494773 - DNA, 25 bp, Mus musculus
tttgaacccgcccatctgagaggtg

SEQ ID NO: 494774 - DNA, 25 bp, Mus musculus
tttgaacctacagaccccatgcttg

SEQ ID NO: 494775 - DNA, 25 bp, Mus musculus
tttgaacctggagctccgactggga

SEQ ID NO: 494776 - DNA, 25 bp, Mus musculus
tttgaacgtgatagcacaagcctgg

SEQ ID NO: 494777 - DNA, 25 bp, Mus musculus
tttgaacgtttaaaatatgtgtctc

SEQ ID NO: 494778 - DNA, 25 bp, Mus musculus
tttgaactagtgagagacagcgcat

SEQ ID NO: 494779 - DNA, 25 bp, Mus musculus
tttgaagaaagtagcccgggagcag

SEQ ID NO: 494780 - DNA, 25 bp, Mus musculus
tttgaagaagtgactgaccggtccc

SEQ ID NO: 494781 - DNA, 25 bp, Mus musculus
tttgaagacacagctcagtaccggg

SEQ ID NO: 494782 - DNA, 25 bp, Mus musculus
tttgaagagaaaaccctcctcccag

SEQ ID NO: 494783 - DNA, 25 bp, Mus musculus
tttgaagagaggaacgcagccctac

SEQ ID NO: 494784 - DNA, 25 bp, Mus musculus
tttgaagagtcgagatgcagctgcc

SEQ ID NO: 494785 - DNA, 25 bp, Mus musculus
tttgaagcttgaacatgagtggaca

SEQ ID NO: 494786 - DNA, 25 bp, Mus musculus
tttgaaggagatcaacctgaggccc

SEQ ID NO: 494787 - DNA, 25 bp, Mus musculus
tttgaaggcacaaaccacattgagc

SEQ ID NO: 494788 - DNA, 25 bp, Mus musculus
tttgaaggcaccaatctggacgtgg

SEQ ID NO: 494789 - DNA, 25 bp, Mus musculus
tttgaaggctgggaatctagggacc

SEQ ID NO: 494790 - DNA, 25 bp, Mus musculus
tttgaagtcagccacactgggcctg

SEQ ID NO: 494791 - DNA, 25 bp, Mus musculus
tttgaagtgctcctcatcgccacag

SEQ ID NO: 494792 - DNA, 25 bp, Mus musculus
tttgaagttatgtgcgccaggcccc

SEQ ID NO: 494793 - DNA, 25 bp, Mus musculus
tttgaagttatgtggtgcactggca

SEQ ID NO: 494794 - DNA, 25 bp, Mus musculus
tttgaatccaagagcaacggacagc

SEQ ID NO: 494795 - DNA, 25 bp, Mus musculus
tttgaatggccaactcatgacatag

SEQ ID NO: 494796 - DNA, 25 bp, Mus musculus
tttgaatgtaaagctctggagacct

SEQ ID NO: 494797 - DNA, 25 bp, Mus musculus
tttgacaaatgcagcagtatgtgcg

SEQ ID NO: 494798 - DNA, 25 bp, Mus musculus
tttgacaacatggatcccctgctgg

SEQ ID NO: 494799 - DNA, 25 bp, Mus musculus
tttgacaagtgcaagacaagcagcc

SEQ ID NO: 494800 - DNA, 25 bp, Mus musculus
tttgacaagttacaggaagccagcg

SEQ ID NO: 494801 - DNA, 25 bp, Mus musculus
tttgacaatcgtaatggcccaggag

SEQ ID NO: 494802 - DNA, 25 bp, Mus musculus
tttgacacaataagagagcccatcc

SEQ ID NO: 494803 - DNA, 25 bp, Mus musculus
tttgacacacattcccaagggagcg

SEQ ID NO: 494804 - DNA, 25 bp, Mus musculus
tttgacacatacattgggcagggct

SEQ ID NO: 494805 - DNA, 25 bp, Mus musculus
tttgacagcaccaatgcgtccgagg

SEQ ID NO: 494806 - DNA, 25 bp, Mus musculus
tttgacagctgaggaacatggatgg

SEQ ID NO: 494807 - DNA, 25 bp, Mus musculus
tttgacaggcgttctcaggacaagg

SEQ ID NO: 494808 - DNA, 25 bp, Mus musculus
tttgacaggtagtgatcggattccc

SEQ ID NO: 494809 - DNA, 25 bp, Mus musculus
tttgacatcgaactgctggagcttg

SEQ ID NO: 494810 - DNA, 25 bp, Mus musculus
tttgacatgtttgcccagaccagag

SEQ ID NO: 494811 - DNA, 25 bp, Mus musculus
tttgaccaatttcacagacacttcc

SEQ ID NO: 494812 - DNA, 25 bp, Mus musculus
tttgaccaggcccagagatcggtgc

SEQ ID NO: 494813 - DNA, 25 bp, Mus musculus
tttgaccataaagcccaaggcggcg

SEQ ID NO: 494814 - DNA, 25 bp, Mus musculus
tttgacccagagttcacccaggaag

SEQ ID NO: 494815 - DNA, 25 bp, Mus musculus
tttgacccctacgaacagagcagca

SEQ ID NO: 494816 - DNA, 25 bp, Mus musculus
tttgaccctcatgtgcactccatgg

SEQ ID NO: 494817 - DNA, 25 bp, Mus musculus
tttgaccgacaggagggacacaagc

SEQ ID NO: 494818 - DNA, 25 bp, Mus musculus
tttgaccggtacagagatagctttg

SEQ ID NO: 494819 - DNA, 25 bp, Mus musculus
tttgacctggcaagagctgacttcc

SEQ ID NO: 494820 - DNA, 25 bp, Mus musculus
tttgacctgtcgaatgtggagccca

SEQ ID NO: 494821 - DNA, 25 bp, Mus musculus
tttgaccttggtgcactcctacgag

SEQ ID NO: 494822 - DNA, 25 bp, Mus musculus
tttgacgaacacacaaagggcctgg

SEQ ID NO: 494823 - DNA, 25 bp, Mus musculus
tttgacgaggaagcggacgagtctc

SEQ ID NO: 494824 - DNA, 25 bp, Mus musculus
tttgacgccaacatgcgcagcgacg

SEQ ID NO: 494825 - DNA, 25 bp, Mus musculus
tttgacggaacacccacagagcagt

SEQ ID NO: 494826 - DNA, 25 bp, Mus musculus
tttgacggagctacacgagatgatg

SEQ ID NO: 494827 - DNA, 25 bp, Mus musculus
tttgacgtgtgtgacaccaatgctg

SEQ ID NO: 494828 - DNA, 25 bp, Mus musculus
tttgactctcactatgcctagccct

SEQ ID NO: 494829 - DNA, 25 bp, Mus musculus
tttgactgaagctctgggaagagag

SEQ ID NO: 494830 - DNA, 25 bp, Mus musculus
tttgactttaaaggcgatccgctgg

SEQ ID NO: 494831 - DNA, 25 bp, Mus musculus
tttgagaaccgaactgactgctggg

SEQ ID NO: 494832 - DNA, 25 bp, Mus musculus
tttgagaacctcatgcagctggtgg

SEQ ID NO: 494833 - DNA, 25 bp, Mus musculus
tttgagaacgagatggccacagctg

SEQ ID NO: 494834 - DNA, 25 bp, Mus musculus
tttgagaactcacagcatcgggact

SEQ ID NO: 494835 - DNA, 25 bp, Mus musculus
tttgagaacttcacctatgcgggca

SEQ ID NO: 494836 - DNA, 25 bp, Mus musculus
tttgagaatgaagatgccacctggg

SEQ ID NO: 494837 - DNA, 25 bp, Mus musculus
tttgagacaacctcatatagccagg

SEQ ID NO: 494838 - DNA, 25 bp, Mus musculus
tttgagactttggagaggaattagc

SEQ ID NO: 494839 - DNA, 25 bp, Mus musculus
tttgagatacgccacctgctcaggc

SEQ ID NO: 494840 - DNA, 25 bp, Mus musculus
tttgagatcaaagcctgcatgtgtg

SEQ ID NO: 494841 - DNA, 25 bp, Mus musculus
tttgagatgagccaagacagagccc

SEQ ID NO: 494842 - DNA, 25 bp, Mus musculus
tttgagattgctgagtcacgtcact

SEQ ID NO: 494843 - DNA, 25 bp, Mus musculus
tttgagcaaggtgtgtccagtgttg

SEQ ID NO: 494844 - DNA, 25 bp, Mus musculus
tttgagcaccgggacttacactggg

SEQ ID NO: 494845 - DNA, 25 bp, Mus musculus
tttgagcagatcaggaagagcccgg

SEQ ID NO: 494846 - DNA, 25 bp, Mus musculus
tttgagcagcgaaactgaggcaacc

SEQ ID NO: 494847 - DNA, 25 bp, Mus musculus
tttgagcagcttccagacgatgtgg

SEQ ID NO: 494848 - DNA, 25 bp, Mus musculus
tttgagcagggtacatttggagcac

SEQ ID NO: 494849 - DNA, 25 bp, Mus musculus
tttgagccaagagtagcagccttcg

SEQ ID NO: 494850 - DNA, 25 bp, Mus musculus
tttgagccgcatcaggaggccgact

SEQ ID NO: 494851 - DNA, 25 bp, Mus musculus
tttgagcctatttgtcaggaatcac

SEQ ID NO: 494852 - DNA, 25 bp, Mus musculus
tttgagcctcccagtgagacagagg

SEQ ID NO: 494853 - DNA, 25 bp, Mus musculus
tttgagcctcgtacgccatgtgcag

SEQ ID NO: 494854 - DNA, 25 bp, Mus musculus
tttgagcgcttctccccacgatgtg

SEQ ID NO: 494855 - DNA, 25 bp, Mus musculus
tttgagcgggcgacaaacagtagct

SEQ ID NO: 494856 - DNA, 25 bp, Mus musculus
tttgagctcctgattccccgaggcg

SEQ ID NO: 494857 - DNA, 25 bp, Mus musculus
tttgagctcgcattagaaaactgcc

SEQ ID NO: 494858 - DNA, 25 bp, Mus musculus
tttgaggaagaacgagccagagcca

SEQ ID NO: 494859 - DNA, 25 bp, Mus musculus
tttgaggaagtcttggcacagctgc

SEQ ID NO: 494860 - DNA, 25 bp, Mus musculus
tttgaggacatgatcgccaaggccc

SEQ ID NO: 494861 - DNA, 25 bp, Mus musculus
tttgaggactcggtgttcgagcaga

SEQ ID NO: 494862 - DNA, 25 bp, Mus musculus
tttgaggacttggaggtgaccgtac

SEQ ID NO: 494863 - DNA, 25 bp, Mus musculus
tttgaggagctctatagaaatgcat

SEQ ID NO: 494864 - DNA, 25 bp, Mus musculus
tttgaggaggataacaaaggcctgg

SEQ ID NO: 494865 - DNA, 25 bp, Mus musculus
tttgaggagtcagtagaagacgccc

SEQ ID NO: 494866 - DNA, 25 bp, Mus musculus
tttgaggcgacctacctggagctgg

SEQ ID NO: 494867 - DNA, 25 bp, Mus musculus
tttgagggacctgacgacttgcctg

SEQ ID NO: 494868 - DNA, 25 bp, Mus musculus
tttgagggtcatcggaacagaactg

SEQ ID NO: 494869 - DNA, 25 bp, Mus musculus
tttgaggtaggctccattgcatgtg

SEQ ID NO: 494870 - DNA, 25 bp, Mus musculus
tttgagtaccggcagcagaacctgg

SEQ ID NO: 494871 - DNA, 25 bp, Mus musculus
tttgagtaggctttctgcaccagcg

SEQ ID NO: 494872 - DNA, 25 bp, Mus musculus
tttgagtagtttcgaatgtctgctg

SEQ ID NO: 494873 - DNA, 25 bp, Mus musculus
tttgagtgaagagagacatactatg

SEQ ID NO: 494874 - DNA, 25 bp, Mus musculus
tttgagtgacagaatgacggacgcc

SEQ ID NO: 494875 - DNA, 25 bp, Mus musculus
tttgagtgcccagatccttgtgagg

SEQ ID NO: 494876 - DNA, 25 bp, Mus musculus
tttgagtgttcaaagatgaggccac

SEQ ID NO: 494877 - DNA, 25 bp, Mus musculus
tttgagttcgaaacacgacacggca

SEQ ID NO: 494878 - DNA, 25 bp, Mus musculus
tttgagtttaggaggtggcaccatc

SEQ ID NO: 494879 - DNA, 25 bp, Mus musculus
tttgatacagtgcagagtccctcca

SEQ ID NO: 494880 - DNA, 25 bp, Mus musculus
tttgatatctttgtcctgggcgcgg

SEQ ID NO: 494881 - DNA, 25 bp, Mus musculus
tttgatcagcgtgctaagggaggcc

SEQ ID NO: 494882 - DNA, 25 bp, Mus musculus
tttgatcagttctacgaggcggcgc

SEQ ID NO: 494883 - DNA, 25 bp, Mus musculus
tttgatccccagcaatgatgccccg

SEQ ID NO: 494884 - DNA, 25 bp, Mus musculus
tttgatcctgggaggccatgaccac

SEQ ID NO: 494885 - DNA, 25 bp, Mus musculus
tttgatcgctttcccaccagaggtg

SEQ ID NO: 494886 - DNA, 25 bp, Mus musculus
tttgatcggatgaagaaccagaacc

SEQ ID NO: 494887 - DNA, 25 bp, Mus musculus
tttgatgaaagcagctgctcctcca

SEQ ID NO: 494888 - DNA, 25 bp, Mus musculus
tttgatgaaatcacggcgaagtggg

SEQ ID NO: 494889 - DNA, 25 bp, Mus musculus
tttgatgaactgaacaagctccgag

SEQ ID NO: 494890 - DNA, 25 bp, Mus musculus
tttgatgaccgagccactgtggaga

SEQ ID NO: 494891 - DNA, 25 bp, Mus musculus
tttgatgactgggaggacgactacg

SEQ ID NO: 494892 - DNA, 25 bp, Mus musculus
tttgatgaggacgacgagcaggaca

SEQ ID NO: 494893 - DNA, 25 bp, Mus musculus
tttgatgagtatagcggaacaccga

SEQ ID NO: 494894 - DNA, 25 bp, Mus musculus
tttgatgagttccagattgccacca

SEQ ID NO: 494895 - DNA, 25 bp, Mus musculus
tttgatgatgatgagctgtggaccc

SEQ ID NO: 494896 - DNA, 25 bp, Mus musculus
tttgatgcaaccaacttatgacctg

SEQ ID NO: 494897 - DNA, 25 bp, Mus musculus
tttgatgcgacagaatcctactgag

SEQ ID NO: 494898 - DNA, 25 bp, Mus musculus
tttgatgctaagaatgcctgcgacc

SEQ ID NO: 494899 - DNA, 25 bp, Mus musculus
tttgatggcggcgaccccgggactc

SEQ ID NO: 494900 - DNA, 25 bp, Mus musculus
tttgatggctggttcaagacccggc

SEQ ID NO: 494901 - DNA, 25 bp, Mus musculus
tttgatgggcactcacgattgtagc

SEQ ID NO: 494902 - DNA, 25 bp, Mus musculus
tttgatgtacaaatgggagctgcct

SEQ ID NO: 494903 - DNA, 25 bp, Mus musculus
tttgattcgagccaactactggcag

SEQ ID NO: 494904 - DNA, 25 bp, Mus musculus
tttgattcgggatgtctgcatagcc

SEQ ID NO: 494905 - DNA, 25 bp, Mus musculus
tttgattgagttggcggctcagcag

SEQ ID NO: 494906 - DNA, 25 bp, Mus musculus
tttgatttggcaggccatggaggcc

SEQ ID NO: 494907 - DNA, 25 bp, Mus musculus
tttgcaaactacagcgcttagacgg

SEQ ID NO: 494908 - DNA, 25 bp, Mus musculus
tttgcaaagaagaggatttccccag

SEQ ID NO: 494909 - DNA, 25 bp, Mus musculus
tttgcaaagcccaatgccatccagg

SEQ ID NO: 494910 - DNA, 25 bp, Mus musculus
tttgcaaaggcccaagctggactct

SEQ ID NO: 494911 - DNA, 25 bp, Mus musculus
tttgcaagcctggagaacaagggcc

SEQ ID NO: 494912 - DNA, 25 bp, Mus musculus
tttgcaagggcgaccattggaccac

SEQ ID NO: 494913 - DNA, 25 bp, Mus musculus
tttgcaagtacatgtctgagaccag

SEQ ID NO: 494914 - DNA, 25 bp, Mus musculus
tttgcaagtctaggctgcacccggg

SEQ ID NO: 494915 - DNA, 25 bp, Mus musculus
tttgcaagtgaaagccaacagtaga

SEQ ID NO: 494916 - DNA, 25 bp, Mus musculus
tttgcaatgaagtagtcgacacctg

SEQ ID NO: 494917 - DNA, 25 bp, Mus musculus
tttgcaatgcagtccttagagccac

SEQ ID NO: 494918 - DNA, 25 bp, Mus musculus
tttgcacaatgacggacagaagccc

SEQ ID NO: 494919 - DNA, 25 bp, Mus musculus
tttgcacaccggttggtcctcagcc

SEQ ID NO: 494920 - DNA, 25 bp, Mus musculus
tttgcacagcaggatttacgggagc

SEQ ID NO: 494921 - DNA, 25 bp, Mus musculus
tttgcacagcttttgaagccggtcc

SEQ ID NO: 494922 - DNA, 25 bp, Mus musculus
tttgcacaggcactgaaactcaaca

SEQ ID NO: 494923 - DNA, 25 bp, Mus musculus
tttgcacagtaccagagccagatcg

SEQ ID NO: 494924 - DNA, 25 bp, Mus musculus
tttgcacatctaacgggagaccgac

SEQ ID NO: 494925 - DNA, 25 bp, Mus musculus
tttgcacatgtggtggagcagcgct

SEQ ID NO: 494926 - DNA, 25 bp, Mus musculus
tttgcaccaagatgaacacagctgg

SEQ ID NO: 494927 - DNA, 25 bp, Mus musculus
tttgcaccacaggaaaaggcgatcg

SEQ ID NO: 494928 - DNA, 25 bp, Mus musculus
tttgcaccatgtttcatattatagg

SEQ ID NO: 494929 - DNA, 25 bp, Mus musculus
tttgcacctgcatgagaaccctgac

SEQ ID NO: 494930 - DNA, 25 bp, Mus musculus
tttgcacctgtagcagacaccatag

SEQ ID NO: 494931 - DNA, 25 bp, Mus musculus
tttgcactgcaaggccaagtacggc

SEQ ID NO: 494932 - DNA, 25 bp, Mus musculus
tttgcactgtaaggcagtccctgtg

SEQ ID NO: 494933 - DNA, 25 bp, Mus musculus
tttgcacttggacctgaagccagcg

SEQ ID NO: 494934 - DNA, 25 bp, Mus musculus
tttgcagaaaaaagtcaggagcggc

SEQ ID NO: 494935 - DNA, 25 bp, Mus musculus
tttgcagaatacagggcccaagctg

SEQ ID NO: 494936 - DNA, 25 bp, Mus musculus
tttgcagagacatcagcgtttatcc

SEQ ID NO: 494937 - DNA, 25 bp, Mus musculus
tttgcagagatgacagcgcctggcc

SEQ ID NO: 494938 - DNA, 25 bp, Mus musculus
tttgcagagctacagacggacatcc

SEQ ID NO: 494939 - DNA, 25 bp, Mus musculus
tttgcagaggacaccgataggagat

SEQ ID NO: 494940 - DNA, 25 bp, Mus musculus
tttgcagaggcggatgaacccacta

SEQ ID NO: 494941 - DNA, 25 bp, Mus musculus
tttgcagagtacctaaaatacatgg

SEQ ID NO: 494942 - DNA, 25 bp, Mus musculus
tttgcagcactctgtcgccatgagc

SEQ ID NO: 494943 - DNA, 25 bp, Mus musculus
tttgcagccaaaaagcggagctcca

SEQ ID NO: 494944 - DNA, 25 bp, Mus musculus
tttgcagccgcctgaatttgcacag

SEQ ID NO: 494945 - DNA, 25 bp, Mus musculus
tttgcagcctgggcgtcggtgctca

SEQ ID NO: 494946 - DNA, 25 bp, Mus musculus
tttgcagctgagacccttgtactgg

SEQ ID NO: 494947 - DNA, 25 bp, Mus musculus
tttgcagggatcttcaactgggccg

SEQ ID NO: 494948 - DNA, 25 bp, Mus musculus
tttgcaggtggagacgctaaaggca

SEQ ID NO: 494949 - DNA, 25 bp, Mus musculus
tttgcaggtttttaatctctccggc

SEQ ID NO: 494950 - DNA, 25 bp, Mus musculus
tttgcagtctctgcaggaaaaagag

SEQ ID NO: 494951 - DNA, 25 bp, Mus musculus
tttgcagtgataggcactaaggagt

SEQ ID NO: 494952 - DNA, 25 bp, Mus musculus
tttgcataaagtatcactctccagc

SEQ ID NO: 494953 - DNA, 25 bp, Mus musculus
tttgcatcagagtcacccaagaggc

SEQ ID NO: 494954 - DNA, 25 bp, Mus musculus
tttgcatgcctggtgaatctgcagg

SEQ ID NO: 494955 - DNA, 25 bp, Mus musculus
tttgcattgtggtatctgtgggtcg

SEQ ID NO: 494956 - DNA, 25 bp, Mus musculus
tttgccaacagccagatggagctct

SEQ ID NO: 494957 - DNA, 25 bp, Mus musculus
tttgccaagaatacaccggacaggg

SEQ ID NO: 494958 - DNA, 25 bp, Mus musculus
tttgccaagccaacataccagcatg

SEQ ID NO: 494959 - DNA, 25 bp, Mus musculus
tttgccaagctgaggaaacttatcc

SEQ ID NO: 494960 - DNA, 25 bp, Mus musculus
tttgccacggtgacatcagtagacc

SEQ ID NO: 494961 - DNA, 25 bp, Mus musculus
tttgccactaaacagtggcctgcta

SEQ ID NO: 494962 - DNA, 25 bp, Mus musculus
tttgccactgccgagcgtgggcacg

SEQ ID NO: 494963 - DNA, 25 bp, Mus musculus
tttgccagagaaagcgtcagaatcc

SEQ ID NO: 494964 - DNA, 25 bp, Mus musculus
tttgccagcaagacgaaacagacgg

SEQ ID NO: 494965 - DNA, 25 bp, Mus musculus
tttgccaggaagctcaaggagcgcc

SEQ ID NO: 494966 - DNA, 25 bp, Mus musculus
tttgccagggcaagctctgagcacc

SEQ ID NO: 494967 - DNA, 25 bp, Mus musculus
tttgccagtaagtctcaaccaggga

SEQ ID NO: 494968 - DNA, 25 bp, Mus musculus
tttgccatccgcttgtctccaggag

SEQ ID NO: 494969 - DNA, 25 bp, Mus musculus
tttgccatcgtggtctctccaggag

SEQ ID NO: 494970 - DNA, 25 bp, Mus musculus
tttgccatgtctacgtccggagcga

SEQ ID NO: 494971 - DNA, 25 bp, Mus musculus
tttgccatttgagatatactgctga

SEQ ID NO: 494972 - DNA, 25 bp, Mus musculus
tttgcccaaggcgacacagagggtt

SEQ ID NO: 494973 - DNA, 25 bp, Mus musculus
tttgcccaagggagacactacctag

SEQ ID NO: 494974 - DNA, 25 bp, Mus musculus
tttgcccagagtagagaggactcct

SEQ ID NO: 494975 - DNA, 25 bp, Mus musculus
tttgcccaggtgctaaaagacgaca

SEQ ID NO: 494976 - DNA, 25 bp, Mus musculus
tttgcccagtttcccacatccgtgg

SEQ ID NO: 494977 - DNA, 25 bp, Mus musculus
tttgccccagactgccgctcgatta

SEQ ID NO: 494978 - DNA, 25 bp, Mus musculus
tttgccccttggaagtggaagtgtc

SEQ ID NO: 494979 - DNA, 25 bp, Mus musculus
tttgcccggagaacaagagaagccc

SEQ ID NO: 494980 - DNA, 25 bp, Mus musculus
tttgccctgacagtggaagcgctgc

SEQ ID NO: 494981 - DNA, 25 bp, Mus musculus
tttgccctgccttgacccaactatg

SEQ ID NO: 494982 - DNA, 25 bp, Mus musculus
tttgccctgctacaagtggacagcg

SEQ ID NO: 494983 - DNA, 25 bp, Mus musculus
tttgccctgctgacgctcactgtgt

SEQ ID NO: 494984 - DNA, 25 bp, Mus musculus
tttgcccttgacaaagatggctcct

SEQ ID NO: 494985 - DNA, 25 bp, Mus musculus
tttgccggaggagacgcgagtgggc

SEQ ID NO: 494986 - DNA, 25 bp, Mus musculus
tttgccggcccttttggaagcagat

SEQ ID NO: 494987 - DNA, 25 bp, Mus musculus
tttgccgggacttcaagctaccact

SEQ ID NO: 494988 - DNA, 25 bp, Mus musculus
tttgccggtgaaagaagatgctcct

SEQ ID NO: 494989 - DNA, 25 bp, Mus musculus
tttgcctccttggactgggacctgc

SEQ ID NO: 494990 - DNA, 25 bp, Mus musculus
tttgcctgccaagggaactggactg

SEQ ID NO: 494991 - DNA, 25 bp, Mus musculus
tttgcctgctctgtcggaaatggag

SEQ ID NO: 494992 - DNA, 25 bp, Mus musculus
tttgccttacactaaaagcattgcc

SEQ ID NO: 494993 - DNA, 25 bp, Mus musculus
tttgccttagggaagcgcgtgccat

SEQ ID NO: 494994 - DNA, 25 bp, Mus musculus
tttgcgaacagacctgactgaggcc

SEQ ID NO: 494995 - DNA, 25 bp, Mus musculus
tttgcgaggtgccattgccttcgcc

SEQ ID NO: 494996 - DNA, 25 bp, Mus musculus
tttgcgcgcccggagggaagccctt

SEQ ID NO: 494997 - DNA, 25 bp, Mus musculus
tttgcggcaacagtttcggctgcgg

SEQ ID NO: 494998 - DNA, 25 bp, Mus musculus
tttgcgggagtagaagccaaaggcc

SEQ ID NO: 494999 - DNA, 25 bp, Mus musculus
tttgcgggcctttccatggccagtt

SEQ ID NO: 495000 - DNA, 25 bp, Mus musculus
tttgcggttgaagatgtgaggcctc

SEQ ID NO: 495001 - DNA, 25 bp, Mus musculus
tttgcgtagaaaaagcacagctctg

SEQ ID NO: 495002 - DNA, 25 bp, Mus musculus
tttgcgtccacgatgagcagcatga

SEQ ID NO: 495003 - DNA, 25 bp, Mus musculus
tttgcgtgatccacagacgccatcg

SEQ ID NO: 495004 - DNA, 25 bp, Mus musculus
tttgctatcctcagtccggggggac

SEQ ID NO: 495005 - DNA, 25 bp, Mus musculus
tttgctcaaagggtccgcagtggag

SEQ ID NO: 495006 - DNA, 25 bp, Mus musculus
tttgctcacaagagaacggcgccat

SEQ ID NO: 495007 - DNA, 25 bp, Mus musculus
tttgctcagcagacagaatcatgac

SEQ ID NO: 495008 - DNA, 25 bp, Mus musculus
tttgctcgaaggctcggtctcctga

SEQ ID NO: 495009 - DNA, 25 bp, Mus musculus
tttgctcgatagaaaggcagcctct

SEQ ID NO: 495010 - DNA, 25 bp, Mus musculus
tttgctcggctagtctggtatggga

SEQ ID NO: 495011 - DNA, 25 bp, Mus musculus
tttgctctcatgtaggtgctaaaga

SEQ ID NO: 495012 - DNA, 25 bp, Mus musculus
tttgctctccccactgtacatcagg

SEQ ID NO: 495013 - DNA, 25 bp, Mus musculus
tttgctctgacctgcctgacgctca

SEQ ID NO: 495014 - DNA, 25 bp, Mus musculus
tttgctctgagagaacctggtgagg

SEQ ID NO: 495015 - DNA, 25 bp, Mus musculus
tttgctctgtcgtctgctgctcccg

SEQ ID NO: 495016 - DNA, 25 bp, Mus musculus
tttgctctttggacgaccacaggga

SEQ ID NO: 495017 - DNA, 25 bp, Mus musculus
tttgctgacgagacatcaagcccgc

SEQ ID NO: 495018 - DNA, 25 bp, Mus musculus
tttgctgacgcggacctactatggg

SEQ ID NO: 495019 - DNA, 25 bp, Mus musculus
tttgctgccatgaaaaagtactgca

SEQ ID NO: 495020 - DNA, 25 bp, Mus musculus
tttgctgcctcgacaatctctcctg

SEQ ID NO: 495021 - DNA, 25 bp, Mus musculus
tttgctgctcagataccagccctca

SEQ ID NO: 495022 - DNA, 25 bp, Mus musculus
tttgctggcgtgagtcagcactgcc

SEQ ID NO: 495023 - DNA, 25 bp, Mus musculus
tttgctgtctaagctcaaggtgccc

SEQ ID NO: 495024 - DNA, 25 bp, Mus musculus
tttgcttcagaacactccagtaagg

SEQ ID NO: 495025 - DNA, 25 bp, Mus musculus
tttgcttcagatcacagggaatccc

SEQ ID NO: 495026 - DNA, 25 bp, Mus musculus
tttgcttgaagccaggacccctgag

SEQ ID NO: 495027 - DNA, 25 bp, Mus musculus
tttgcttgaccgagatgtgacccca

SEQ ID NO: 495028 - DNA, 25 bp, Mus musculus
tttgctttactgtagggtcgccctc

SEQ ID NO: 495029 - DNA, 25 bp, Mus musculus
tttgctttcctgaccatcggcatgg

SEQ ID NO: 495030 - DNA, 25 bp, Mus musculus
tttggaaaacttagacagcgcggca

SEQ ID NO: 495031 - DNA, 25 bp, Mus musculus
tttggaaaagcagatccgcatcccg

SEQ ID NO: 495032 - DNA, 25 bp, Mus musculus
tttggaaacaaacatcaggcccctg

SEQ ID NO: 495033 - DNA, 25 bp, Mus musculus
tttggaaacctctccagcctcgtgg

SEQ ID NO: 495034 - DNA, 25 bp, Mus musculus
tttggaaccgaggacagaccggagc

SEQ ID NO: 495035 - DNA, 25 bp, Mus musculus
tttggaaggaggtttctgagcacgc

SEQ ID NO: 495036 - DNA, 25 bp, Mus musculus
tttggaagggaccacttgtgactgg

SEQ ID NO: 495037 - DNA, 25 bp, Mus musculus
tttggaagtgctacccaatggtgcc

SEQ ID NO: 495038 - DNA, 25 bp, Mus musculus
tttggaataggagtgttaggatgac

SEQ ID NO: 495039 - DNA, 25 bp, Mus musculus
tttggaatcaagtttcccagccggc

SEQ ID NO: 495040 - DNA, 25 bp, Mus musculus
tttggaatccagacagctccctgtg

SEQ ID NO: 495041 - DNA, 25 bp, Mus musculus
tttggaatcccaggcctgagaaggc

SEQ ID NO: 495042 - DNA, 25 bp, Mus musculus
tttggaatcccttgtgagaaccgag

SEQ ID NO: 495043 - DNA, 25 bp, Mus musculus
tttggaatccgtagggcagtcgctc

SEQ ID NO: 495044 - DNA, 25 bp, Mus musculus
tttggaatgagaaaaatggcatcgt

SEQ ID NO: 495045 - DNA, 25 bp, Mus musculus
tttggaatgtagaaacagatctgcc

SEQ ID NO: 495046 - DNA, 25 bp, Mus musculus
tttggaatgtggaagggacctgttc

SEQ ID NO: 495047 - DNA, 25 bp, Mus musculus
tttggacaaatgctcaccaggtgta

SEQ ID NO: 495048 - DNA, 25 bp, Mus musculus
tttggacacataccattcccctgcg

SEQ ID NO: 495049 - DNA, 25 bp, Mus musculus
tttggacaccaagtactaggttggg

SEQ ID NO: 495050 - DNA, 25 bp, Mus musculus
tttggacagggaggatcaagccagc

SEQ ID NO: 495051 - DNA, 25 bp, Mus musculus
tttggacagtccctcaattgagact

SEQ ID NO: 495052 - DNA, 25 bp, Mus musculus
tttggaccagccgttaacccaggca

SEQ ID NO: 495053 - DNA, 25 bp, Mus musculus
tttggaccatgctgagacatcctgg

SEQ ID NO: 495054 - DNA, 25 bp, Mus musculus
tttggacccaacttactcgaccttg

SEQ ID NO: 495055 - DNA, 25 bp, Mus musculus
tttggaccgccttcgacgtgatgtg

SEQ ID NO: 495056 - DNA, 25 bp, Mus musculus
tttggaccggcacctaatcctgatg

SEQ ID NO: 495057 - DNA, 25 bp, Mus musculus
tttggacctaagagacggacctgga

SEQ ID NO: 495058 - DNA, 25 bp, Mus musculus
tttggaccttagtgggccggatgat

SEQ ID NO: 495059 - DNA, 25 bp, Mus musculus
tttggactcaaggatgggaagcgcc

SEQ ID NO: 495060 - DNA, 25 bp, Mus musculus
tttggactctggcaactggatggac

SEQ ID NO: 495061 - DNA, 25 bp, Mus musculus
tttggactgctaggaaactccctgg

SEQ ID NO: 495062 - DNA, 25 bp, Mus musculus
tttggacttagaggagagcttcatc

SEQ ID NO: 495063 - DNA, 25 bp, Mus musculus
tttggagaattgacaaccacctagt

SEQ ID NO: 495064 - DNA, 25 bp, Mus musculus
tttggagaccaagaacccgtgcaag

SEQ ID NO: 495065 - DNA, 25 bp, Mus musculus
tttggagaccccaccaagttcgcca

SEQ ID NO: 495066 - DNA, 25 bp, Mus musculus
tttggagagctagttctgcctaggc

SEQ ID NO: 495067 - DNA, 25 bp, Mus musculus
tttggagcaaagaaacaggatttgg

SEQ ID NO: 495068 - DNA, 25 bp, Mus musculus
tttggagcagctggcatcagtccgg

SEQ ID NO: 495069 - DNA, 25 bp, Mus musculus
tttggagcgagcaagaaggaaaacc

SEQ ID NO: 495070 - DNA, 25 bp, Mus musculus
tttggaggagactacaatgagctgt

SEQ ID NO: 495071 - DNA, 25 bp, Mus musculus
tttggagtaaattgggaccacccag

SEQ ID NO: 495072 - DNA, 25 bp, Mus musculus
tttggagtcaaaaggcagctggcct

SEQ ID NO: 495073 - DNA, 25 bp, Mus musculus
tttggagtggccctcaggtgcccaa

SEQ ID NO: 495074 - DNA, 25 bp, Mus musculus
tttggataatttggcccagggctgc

SEQ ID NO: 495075 - DNA, 25 bp, Mus musculus
tttggatccagggtggtcaacgttg

SEQ ID NO: 495076 - DNA, 25 bp, Mus musculus
tttggatcccaagaaacggctgact

SEQ ID NO: 495077 - DNA, 25 bp, Mus musculus
tttggatccgatagtgagaggcctc

SEQ ID NO: 495078 - DNA, 25 bp, Mus musculus
tttggatcgagagacaacagctgac

SEQ ID NO: 495079 - DNA, 25 bp, Mus musculus
tttggatgacaacccacttcctggg

SEQ ID NO: 495080 - DNA, 25 bp, Mus musculus
tttggatggtgcctatcattgctct

SEQ ID NO: 495081 - DNA, 25 bp, Mus musculus
tttggattgcaaaggccacgtcaga

SEQ ID NO: 495082 - DNA, 25 bp, Mus musculus
tttggcaaagaagacagcgacgcgc

SEQ ID NO: 495083 - DNA, 25 bp, Mus musculus
tttggcaaccctcatctgcacactg

SEQ ID NO: 495084 - DNA, 25 bp, Mus musculus
tttggcaacggaaaagaatctgagc

SEQ ID NO: 495085 - DNA, 25 bp, Mus musculus
tttggcaactcccaggaacgctgtg

SEQ ID NO: 495086 - DNA, 25 bp, Mus musculus
tttggcaagggctggaaagcaagca

SEQ ID NO: 495087 - DNA, 25 bp, Mus musculus
tttggcacctaagaggcaggcggca

SEQ ID NO: 495088 - DNA, 25 bp, Mus musculus
tttggcacggtacctaatggcagca

SEQ ID NO: 495089 - DNA, 25 bp, Mus musculus
tttggcacgtttcgcacaggccggt

SEQ ID NO: 495090 - DNA, 25 bp, Mus musculus
tttggcagatgcaccaccagagtcg

SEQ ID NO: 495091 - DNA, 25 bp, Mus musculus
tttggcaggaatttggacccctctg

SEQ ID NO: 495092 - DNA, 25 bp, Mus musculus
tttggcattataggaagcaggctgg

SEQ ID NO: 495093 - DNA, 25 bp, Mus musculus
tttggccaaaggaccatacctcagg

SEQ ID NO: 495094 - DNA, 25 bp, Mus musculus
tttggccaagcacctggacaagctg

SEQ ID NO: 495095 - DNA, 25 bp, Mus musculus
tttggccaccaggtacagacaagcg

SEQ ID NO: 495096 - DNA, 25 bp, Mus musculus
tttggccagagagcctaacagaagg

SEQ ID NO: 495097 - DNA, 25 bp, Mus musculus
tttggccatgtgaactattaggagc

SEQ ID NO: 495098 - DNA, 25 bp, Mus musculus
tttggcccaggaataaactcttctt

SEQ ID NO: 495099 - DNA, 25 bp, Mus musculus
tttggcccgaaaagaaggatcatct

SEQ ID NO: 495100 - DNA, 25 bp, Mus musculus
tttggccgttgctcttgcaaagcag

SEQ ID NO: 495101 - DNA, 25 bp, Mus musculus
tttggcctcgacaactaccagtgtg

SEQ ID NO: 495102 - DNA, 25 bp, Mus musculus
tttggcctctaagctaacagcaggg

SEQ ID NO: 495103 - DNA, 25 bp, Mus musculus
tttggcctgcggagaaacgcggtca

SEQ ID NO: 495104 - DNA, 25 bp, Mus musculus
tttggcctggcaacagaccatctgg

SEQ ID NO: 495105 - DNA, 25 bp, Mus musculus
tttggcctttacacgcactgtcttg

SEQ ID NO: 495106 - DNA, 25 bp, Mus musculus
tttggcgagcatctgaaaagtcacg

SEQ ID NO: 495107 - DNA, 25 bp, Mus musculus
tttggcgatgggattctcgggtctt

SEQ ID NO: 495108 - DNA, 25 bp, Mus musculus
tttggcgccgagttccgaaggttct

SEQ ID NO: 495109 - DNA, 25 bp, Mus musculus
tttggcgtcatctcatcggtgcgga

SEQ ID NO: 495110 - DNA, 25 bp, Mus musculus
tttggctagtcacttcggcaatgaa

SEQ ID NO: 495111 - DNA, 25 bp, Mus musculus
tttggctcaagctgcagagagtcag

SEQ ID NO: 495112 - DNA, 25 bp, Mus musculus
tttggctcagaagcagctgcgctac

SEQ ID NO: 495113 - DNA, 25 bp, Mus musculus
tttggctgccatgaaccgaaggaaa

SEQ ID NO: 495114 - DNA, 25 bp, Mus musculus
tttgggaaccttgaccctaagcctg

SEQ ID NO: 495115 - DNA, 25 bp, Mus musculus
tttgggaagaagtagcatcgtcagc

SEQ ID NO: 495116 - DNA, 25 bp, Mus musculus
tttgggaaggctcctatggcccctg

SEQ ID NO: 495117 - DNA, 25 bp, Mus musculus
tttgggacaagaagcgctcgacgtt

SEQ ID NO: 495118 - DNA, 25 bp, Mus musculus
tttgggaccggtgtgatagagcact

SEQ ID NO: 495119 - DNA, 25 bp, Mus musculus
tttgggagaacaacagccagaagcc

SEQ ID NO: 495120 - DNA, 25 bp, Mus musculus
tttgggagccggtgctctccttccg

SEQ ID NO: 495121 - DNA, 25 bp, Mus musculus
tttgggaggacaacgatagctaacc

SEQ ID NO: 495122 - DNA, 25 bp, Mus musculus
tttgggaggctcgtcaaactgcagc

SEQ ID NO: 495123 - DNA, 25 bp, Mus musculus
tttgggagtaccatgcactagccag

SEQ ID NO: 495124 - DNA, 25 bp, Mus musculus
tttgggatacattcagctgcgggtc

SEQ ID NO: 495125 - DNA, 25 bp, Mus musculus
tttgggatccggaatgtcacacaca

SEQ ID NO: 495126 - DNA, 25 bp, Mus musculus
tttgggatcttaggctctggagaca

SEQ ID NO: 495127 - DNA, 25 bp, Mus musculus
tttgggattcggagtccaggcacct

SEQ ID NO: 495128 - DNA, 25 bp, Mus musculus
tttgggcacacctcagaatactgga

SEQ ID NO: 495129 - DNA, 25 bp, Mus musculus
tttgggcagccgtagttaccgagtg

SEQ ID NO: 495130 - DNA, 25 bp, Mus musculus
tttgggccaagccaacaccttgcat

SEQ ID NO: 495131 - DNA, 25 bp, Mus musculus
tttgggcctttctttcgcacggagc

SEQ ID NO: 495132 - DNA, 25 bp, Mus musculus
tttgggcggcttccaggtacctgaa

SEQ ID NO: 495133 - DNA, 25 bp, Mus musculus
tttgggctccctgtctagcagatgg

SEQ ID NO: 495134 - DNA, 25 bp, Mus musculus
tttgggctgatctccagtctccgag

SEQ ID NO: 495135 - DNA, 25 bp, Mus musculus
tttgggctgcacatatgaacttcgc

SEQ ID NO: 495136 - DNA, 25 bp, Mus musculus
tttgggtaccaaagggactactgca

SEQ ID NO: 495137 - DNA, 25 bp, Mus musculus
tttgggtaccgctatacacggctgc

SEQ ID NO: 495138 - DNA, 25 bp, Mus musculus
tttgggtagtgagagaaggaagccc

SEQ ID NO: 495139 - DNA, 25 bp, Mus musculus
tttgggtgcccctggaatgaagtac

SEQ ID NO: 495140 - DNA, 25 bp, Mus musculus
tttgggttcaccacagcgaagtctc

SEQ ID NO: 495141 - DNA, 25 bp, Mus musculus
tttggtaaccaaagcagccgtggga

SEQ ID NO: 495142 - DNA, 25 bp, Mus musculus
tttggtacaactggcgaaggcggcc

SEQ ID NO: 495143 - DNA, 25 bp, Mus musculus
tttggtacccctcaacctggacagg

SEQ ID NO: 495144 - DNA, 25 bp, Mus musculus
tttggtagaactcgaagcggccttc

SEQ ID NO: 495145 - DNA, 25 bp, Mus musculus
tttggtatcacatgccgagactgga

SEQ ID NO: 495146 - DNA, 25 bp, Mus musculus
tttggtcaaggccagaaagcaccca

SEQ ID NO: 495147 - DNA, 25 bp, Mus musculus
tttggtcccgtctctcttctgcatc

SEQ ID NO: 495148 - DNA, 25 bp, Mus musculus
tttggtccgactccagccctaggat

SEQ ID NO: 495149 - DNA, 25 bp, Mus musculus
tttggtcggctgcaagctctaggac

SEQ ID NO: 495150 - DNA, 25 bp, Mus musculus
tttggtctcaacagttccgccggtg

SEQ ID NO: 495151 - DNA, 25 bp, Mus musculus
tttggtctgggcattggcaccctgg

SEQ ID NO: 495152 - DNA, 25 bp, Mus musculus
tttggtcttggagcacaccgaggac

SEQ ID NO: 495153 - DNA, 25 bp, Mus musculus
tttggtcttgtatgaactgattgcg

SEQ ID NO: 495154 - DNA, 25 bp, Mus musculus
tttggtgagacagacaggccatcag

SEQ ID NO: 495155 - DNA, 25 bp, Mus musculus
tttggtgagcacactgtgaccggac

SEQ ID NO: 495156 - DNA, 25 bp, Mus musculus
tttggtgcaccagaacatactccgg

SEQ ID NO: 495157 - DNA, 25 bp, Mus musculus
tttggtgcacgagaacaacacgcat

SEQ ID NO: 495158 - DNA, 25 bp, Mus musculus
tttggtgctcatccctgtctgctgg

SEQ ID NO: 495159 - DNA, 25 bp, Mus musculus
tttggtgtatgaggcttgggtcaac

SEQ ID NO: 495160 - DNA, 25 bp, Mus musculus
tttggttccgtgaggccgagcttct

SEQ ID NO: 495161 - DNA, 25 bp, Mus musculus
tttggttgggcaagaccgagtacct

SEQ ID NO: 495162 - DNA, 25 bp, Mus musculus
tttgtaaagcttccagaccctctca

SEQ ID NO: 495163 - DNA, 25 bp, Mus musculus
tttgtaacggactgaggaatgcttg

SEQ ID NO: 495164 - DNA, 25 bp, Mus musculus
tttgtaaggatgacaatctgctcca

SEQ ID NO: 495165 - DNA, 25 bp, Mus musculus
tttgtaatcgctggcgtgccccgcg

SEQ ID NO: 495166 - DNA, 25 bp, Mus musculus
tttgtaatcttggagctgaaaccca

SEQ ID NO: 495167 - DNA, 25 bp, Mus musculus
tttgtacaagcagccaaacagctgc

SEQ ID NO: 495168 - DNA, 25 bp, Mus musculus
tttgtacaaggataaacacctggtg

SEQ ID NO: 495169 - DNA, 25 bp, Mus musculus
tttgtaccaataacagggagtctcc

SEQ ID NO: 495170 - DNA, 25 bp, Mus musculus
tttgtaccaggcctacgaccggcaa

SEQ ID NO: 495171 - DNA, 25 bp, Mus musculus
tttgtaccagggacagggactgccc

SEQ ID NO: 495172 - DNA, 25 bp, Mus musculus
tttgtaccagtactccagccgcatg

SEQ ID NO: 495173 - DNA, 25 bp, Mus musculus
tttgtacccaagaagcatcctcatc

SEQ ID NO: 495174 - DNA, 25 bp, Mus musculus
tttgtacccacagcccgcgttttgg

SEQ ID NO: 495175 - DNA, 25 bp, Mus musculus
tttgtagaacacagaacggaggact

SEQ ID NO: 495176 - DNA, 25 bp, Mus musculus
tttgtagagcactcacccgagggag

SEQ ID NO: 495177 - DNA, 25 bp, Mus musculus
tttgtagccgcgatgacacacctag

SEQ ID NO: 495178 - DNA, 25 bp, Mus musculus
tttgtagctgagaacgtggaacccc

SEQ ID NO: 495179 - DNA, 25 bp, Mus musculus
tttgtagctttagttcattaaggca

SEQ ID NO: 495180 - DNA, 25 bp, Mus musculus
tttgtaggagcgtctcagaaacaac

SEQ ID NO: 495181 - DNA, 25 bp, Mus musculus
tttgtagggctctgtagcttgtgca

SEQ ID NO: 495182 - DNA, 25 bp, Mus musculus
tttgtagtagaaacccagccctgca

SEQ ID NO: 495183 - DNA, 25 bp, Mus musculus
tttgtagtatcccagaagtcctgcc

SEQ ID NO: 495184 - DNA, 25 bp, Mus musculus
tttgtatacggaacaggcagctgcg

SEQ ID NO: 495185 - DNA, 25 bp, Mus musculus
tttgtatagtaaacacgggcagcga

SEQ ID NO: 495186 - DNA, 25 bp, Mus musculus
tttgtatcagcaatccagccatcgt

SEQ ID NO: 495187 - DNA, 25 bp, Mus musculus
tttgtatcttcgcttgtctgagaga

SEQ ID NO: 495188 - DNA, 25 bp, Mus musculus
tttgtattaagggatgagcatgcac

SEQ ID NO: 495189 - DNA, 25 bp, Mus musculus
tttgtattcggctgactgtgagccc

SEQ ID NO: 495190 - DNA, 25 bp, Mus musculus
tttgtatttggaacagcagctccca

SEQ ID NO: 495191 - DNA, 25 bp, Mus musculus
tttgtcaagaaccagtagaactcag

SEQ ID NO: 495192 - DNA, 25 bp, Mus musculus
tttgtcacacaagctgcattcccag

SEQ ID NO: 495193 - DNA, 25 bp, Mus musculus
tttgtcacacagaagattatgccag

SEQ ID NO: 495194 - DNA, 25 bp, Mus musculus
tttgtcacaggtgttgatgctcatg

SEQ ID NO: 495195 - DNA, 25 bp, Mus musculus
tttgtcacagtaacaagcttgcgct

SEQ ID NO: 495196 - DNA, 25 bp, Mus musculus
tttgtcaccatgacagcgctgccgg

SEQ ID NO: 495197 - DNA, 25 bp, Mus musculus
tttgtcaccctagatcagacttcgg

SEQ ID NO: 495198 - DNA, 25 bp, Mus musculus
tttgtcacttcctgcgagagcccag

SEQ ID NO: 495199 - DNA, 25 bp, Mus musculus
tttgtcagctcaatcccaaggatgt

SEQ ID NO: 495200 - DNA, 25 bp, Mus musculus
tttgtcatgcgtgcccagaagagcg

SEQ ID NO: 495201 - DNA, 25 bp, Mus musculus
tttgtccagactaccataccagcca

SEQ ID NO: 495202 - DNA, 25 bp, Mus musculus
tttgtccagtccatagccgggtgca

SEQ ID NO: 495203 - DNA, 25 bp, Mus musculus
tttgtccattatctgaatccctgag

SEQ ID NO: 495204 - DNA, 25 bp, Mus musculus
tttgtccctgttcacgaggccggtg

SEQ ID NO: 495205 - DNA, 25 bp, Mus musculus
tttgtccgctggcaggtcatcacgg

SEQ ID NO: 495206 - DNA, 25 bp, Mus musculus
tttgtccgggaagaactgggctgcc

SEQ ID NO: 495207 - DNA, 25 bp, Mus musculus
tttgtcctagccaaccatggccagc

SEQ ID NO: 495208 - DNA, 25 bp, Mus musculus
tttgtcctctaagattctacctggg

SEQ ID NO: 495209 - DNA, 25 bp, Mus musculus
tttgtcctggatcccgcgtccgctg

SEQ ID NO: 495210 - DNA, 25 bp, Mus musculus
tttgtcctggatgtcaagaagcgca

SEQ ID NO: 495211 - DNA, 25 bp, Mus musculus
tttgtcctggtgaccggctgtgcca

SEQ ID NO: 495212 - DNA, 25 bp, Mus musculus
tttgtccttggcgagtggcagcccc

SEQ ID NO: 495213 - DNA, 25 bp, Mus musculus
tttgtcgttacggtgcactgcgcgg

SEQ ID NO: 495214 - DNA, 25 bp, Mus musculus
tttgtctcagttctcagatgcattg

SEQ ID NO: 495215 - DNA, 25 bp, Mus musculus
tttgtctctctgttgcaacctctgg

SEQ ID NO: 495216 - DNA, 25 bp, Mus musculus
tttgtctttgacaggcccacaagcg

SEQ ID NO: 495217 - DNA, 25 bp, Mus musculus
tttgtgaacccggatggaacgcctg

SEQ ID NO: 495218 - DNA, 25 bp, Mus musculus
tttgtgagtagagctgaggttgacc

SEQ ID NO: 495219 - DNA, 25 bp, Mus musculus
tttgtgatttgccagagggagctca

SEQ ID NO: 495220 - DNA, 25 bp, Mus musculus
tttgtgccaaatccctaagtgccat

SEQ ID NO: 495221 - DNA, 25 bp, Mus musculus
tttgtgcggcacaactaggaggtgc

SEQ ID NO: 495222 - DNA, 25 bp, Mus musculus
tttgtgctctcctcacagtacctca

SEQ ID NO: 495223 - DNA, 25 bp, Mus musculus
tttgtgctggacaccgaagcctcag

SEQ ID NO: 495224 - DNA, 25 bp, Mus musculus
tttgtgctggctcttcccggcgtag

SEQ ID NO: 495225 - DNA, 25 bp, Mus musculus
tttgtggaaaaaggacagaagttct

SEQ ID NO: 495226 - DNA, 25 bp, Mus musculus
tttgtggacacagatctggctcacg

SEQ ID NO: 495227 - DNA, 25 bp, Mus musculus
tttgtggacctcaaaggcgaccctt

SEQ ID NO: 495228 - DNA, 25 bp, Mus musculus
tttgtggacctgaaccctgacagcg

SEQ ID NO: 495229 - DNA, 25 bp, Mus musculus
tttgtggagttaggtcggcccctag

SEQ ID NO: 495230 - DNA, 25 bp, Mus musculus
tttgtggatgccttggaggacagcc

SEQ ID NO: 495231 - DNA, 25 bp, Mus musculus
tttgtggccaatgtgcagtccttcc

SEQ ID NO: 495232 - DNA, 25 bp, Mus musculus
tttgtggctaatgctcacagagagg

SEQ ID NO: 495233 - DNA, 25 bp, Mus musculus
tttgtggctaattggaatatctaac

SEQ ID NO: 495234 - DNA, 25 bp, Mus musculus
tttgtggctcccactgtctctccag

SEQ ID NO: 495235 - DNA, 25 bp, Mus musculus
tttgtggctgccaataccctgggag

SEQ ID NO: 495236 - DNA, 25 bp, Mus musculus
tttgtggtagcatggaacgtgccca

SEQ ID NO: 495237 - DNA, 25 bp, Mus musculus
tttgtgtaccgctgggaacgtcgcc

SEQ ID NO: 495238 - DNA, 25 bp, Mus musculus
tttgtgtactccgagcgcagtggcc

SEQ ID NO: 495239 - DNA, 25 bp, Mus musculus
tttgtgtagcaaacagctgtggcga

SEQ ID NO: 495240 - DNA, 25 bp, Mus musculus
tttgtgtaggtctgggtcctctcac

SEQ ID NO: 495241 - DNA, 25 bp, Mus musculus
tttgtgtcatagtcaggaaaaaaca

SEQ ID NO: 495242 - DNA, 25 bp, Mus musculus
tttgtgtcggcagcgggccaactgt

SEQ ID NO: 495243 - DNA, 25 bp, Mus musculus
tttgtgtgcaaagccgacagctgcg

SEQ ID NO: 495244 - DNA, 25 bp, Mus musculus
tttgtgtgccccttacacatgcgtg

SEQ ID NO: 495245 - DNA, 25 bp, Mus musculus
tttgtgtgtggctctttcgggccgc

SEQ ID NO: 495246 - DNA, 25 bp, Mus musculus
tttgtgttactgcatagcctgggcc

SEQ ID NO: 495247 - DNA, 25 bp, Mus musculus
tttgtgttcaaagagaccccgtggc

SEQ ID NO: 495248 - DNA, 25 bp, Mus musculus
tttgtgttgccctcaaggctagagc

SEQ ID NO: 495249 - DNA, 25 bp, Mus musculus
tttgtgttggtagcatccagttggc

SEQ ID NO: 495250 - DNA, 25 bp, Mus musculus
tttgtgtttccagacctttgccggt

SEQ ID NO: 495251 - DNA, 25 bp, Mus musculus
tttgttaaccggcagaacgcattgc

SEQ ID NO: 495252 - DNA, 25 bp, Mus musculus
tttgttagctccaagaagacgccct

SEQ ID NO: 495253 - DNA, 25 bp, Mus musculus
tttgttcaggacttggctaccaggg

SEQ ID NO: 495254 - DNA, 25 bp, Mus musculus
tttgttcatcagctattcataactg

SEQ ID NO: 495255 - DNA, 25 bp, Mus musculus
tttgttccaccgcaaaaggctgtcc

SEQ ID NO: 495256 - DNA, 25 bp, Mus musculus
tttgttccaggacgtgtaattccct

SEQ ID NO: 495257 - DNA, 25 bp, Mus musculus
tttgttccggaagccaccgaggagg

SEQ ID NO: 495258 - DNA, 25 bp, Mus musculus
tttgttccgtttgtaaagcttccag

SEQ ID NO: 495259 - DNA, 25 bp, Mus musculus
tttgttctgagtgtggtaccgccca

SEQ ID NO: 495260 - DNA, 25 bp, Mus musculus
tttgttgacccggatgactgcaccc

SEQ ID NO: 495261 - DNA, 25 bp, Mus musculus
tttgttgcatttaggatgctgcagc

SEQ ID NO: 495262 - DNA, 25 bp, Mus musculus
tttgttgctctgtacacctgtgtgc

SEQ ID NO: 495263 - DNA, 25 bp, Mus musculus
tttgttgtgattgcctggtgtgtgc

SEQ ID NO: 495264 - DNA, 25 bp, Mus musculus
tttgtttcagaacaagggccattca

SEQ ID NO: 495265 - DNA, 25 bp, Mus musculus
tttgtttccctttgcttcccggcat

SEQ ID NO: 495266 - DNA, 25 bp, Mus musculus
tttgtttcctgcaagccccatggtg

SEQ ID NO: 495267 - DNA, 25 bp, Mus musculus
tttgtttcgttgtttcaagacagac

SEQ ID NO: 495268 - DNA, 25 bp, Mus musculus
tttgtttgaaacaggagtcgctcgg

SEQ ID NO: 495269 - DNA, 25 bp, Mus musculus
tttgttttcaacagtcaataaagtg

SEQ ID NO: 495270 - DNA, 25 bp, Mus musculus
tttgtttttcctaaagagctctgaa

SEQ ID NO: 495271 - DNA, 25 bp, Mus musculus
ttttaaaaaagggatgtgctgagca

SEQ ID NO: 495272 - DNA, 25 bp, Mus musculus
ttttaaaaactggaggtgagagtgg

SEQ ID NO: 495273 - DNA, 25 bp, Mus musculus
ttttaaaaagcctagcaccgccagg

SEQ ID NO: 495274 - DNA, 25 bp, Mus musculus
ttttaaaccagcaaacatttggcag

SEQ ID NO: 495275 - DNA, 25 bp, Mus musculus
ttttaaacctgctcggcagacggag

SEQ ID NO: 495276 - DNA, 25 bp, Mus musculus
ttttaaactactgttggcctgggtg

SEQ ID NO: 495277 - DNA, 25 bp, Mus musculus
ttttaaacttaataaagatcaggct

SEQ ID NO: 495278 - DNA, 25 bp, Mus musculus
ttttaaagcccaggccacggagagc

SEQ ID NO: 495279 - DNA, 25 bp, Mus musculus
ttttaaagtcaggtagttcaagcct

SEQ ID NO: 495280 - DNA, 25 bp, Mus musculus
ttttaacaaggatgcacagtggacc

SEQ ID NO: 495281 - DNA, 25 bp, Mus musculus
ttttaacaagggtggctattgctcc

SEQ ID NO: 495282 - DNA, 25 bp, Mus musculus
ttttaacttactggagccctgccac

SEQ ID NO: 495283 - DNA, 25 bp, Mus musculus
ttttaagaacaacgtggacatccgg

SEQ ID NO: 495284 - DNA, 25 bp, Mus musculus
ttttaagaagacaaccatggcatcc

SEQ ID NO: 495285 - DNA, 25 bp, Mus musculus
ttttaagaatcacaatgtaactacc

SEQ ID NO: 495286 - DNA, 25 bp, Mus musculus
ttttaagacggtgcctgagattggg

SEQ ID NO: 495287 - DNA, 25 bp, Mus musculus
ttttaagagcttcaaacgtgtccgg

SEQ ID NO: 495288 - DNA, 25 bp, Mus musculus
ttttaagatcgagggacgtgcggtt

SEQ ID NO: 495289 - DNA, 25 bp, Mus musculus
ttttaagcccggaagagacgcgaag

SEQ ID NO: 495290 - DNA, 25 bp, Mus musculus
ttttaagctgtagtttggcggtctg

SEQ ID NO: 495291 - DNA, 25 bp, Mus musculus
ttttaagctgtggtagagtgcgtgc

SEQ ID NO: 495292 - DNA, 25 bp, Mus musculus
ttttaaggactaacaaagggcatat

SEQ ID NO: 495293 - DNA, 25 bp, Mus musculus
ttttaatatagaaagggcctgccag

SEQ ID NO: 495294 - DNA, 25 bp, Mus musculus
ttttaatctcgctggctgtctgggc

SEQ ID NO: 495295 - DNA, 25 bp, Mus musculus
ttttacaagcctgggaagagcctct

SEQ ID NO: 495296 - DNA, 25 bp, Mus musculus
ttttacaataggagctgcaggagcg

SEQ ID NO: 495297 - DNA, 25 bp, Mus musculus
ttttacagaggcagcgacgacgtca

SEQ ID NO: 495298 - DNA, 25 bp, Mus musculus
ttttacagagggaaatgactggctc

SEQ ID NO: 495299 - DNA, 25 bp, Mus musculus
ttttacagtggaggtcaccaaggcc

SEQ ID NO: 495300 - DNA, 25 bp, Mus musculus
ttttacatgtcaggcactggaggtg

SEQ ID NO: 495301 - DNA, 25 bp, Mus musculus
ttttaccaagccgacgagaagttcg

SEQ ID NO: 495302 - DNA, 25 bp, Mus musculus
ttttaccaccatggagctgatgcgc

SEQ ID NO: 495303 - DNA, 25 bp, Mus musculus
ttttaccagccagacctatccagga

SEQ ID NO: 495304 - DNA, 25 bp, Mus musculus
ttttaccaggaagcgccaaagggct

SEQ ID NO: 495305 - DNA, 25 bp, Mus musculus
ttttaccagtgagaaaactgaggcc

SEQ ID NO: 495306 - DNA, 25 bp, Mus musculus
ttttacccactagttcaggattttg

SEQ ID NO: 495307 - DNA, 25 bp, Mus musculus
ttttacccctgcgaggaatgtgcgg

SEQ ID NO: 495308 - DNA, 25 bp, Mus musculus
ttttacccggaacgttgttgctgct

SEQ ID NO: 495309 - DNA, 25 bp, Mus musculus
ttttaccctagtgtggagagagtga

SEQ ID NO: 495310 - DNA, 25 bp, Mus musculus
ttttaccgaaaggaatggccactgc

SEQ ID NO: 495311 - DNA, 25 bp, Mus musculus
ttttaccgcgaccaagtgctgcgag

SEQ ID NO: 495312 - DNA, 25 bp, Mus musculus
ttttacctcaggtgcgggtcgatga

SEQ ID NO: 495313 - DNA, 25 bp, Mus musculus
ttttacctggtagaagtgatgcccc

SEQ ID NO: 495314 - DNA, 25 bp, Mus musculus
ttttacgaagacaatggacagctgg

SEQ ID NO: 495315 - DNA, 25 bp, Mus musculus
ttttactcccctgctccaaggtagg

SEQ ID NO: 495316 - DNA, 25 bp, Mus musculus
ttttagaaaagcaagacgcatttgg

SEQ ID NO: 495317 - DNA, 25 bp, Mus musculus
ttttagaagaaagtgagacaacacc

SEQ ID NO: 495318 - DNA, 25 bp, Mus musculus
ttttagaaggtctgagttaacattc

SEQ ID NO: 495319 - DNA, 25 bp, Mus musculus
ttttagacgggcaccttgtcgcggc

SEQ ID NO: 495320 - DNA, 25 bp, Mus musculus
ttttagagaattaatctagtctcat

SEQ ID NO: 495321 - DNA, 25 bp, Mus musculus
ttttagagggcacttggcaccggaa

SEQ ID NO: 495322 - DNA, 25 bp, Mus musculus
ttttagcaataagggtacactctgg

SEQ ID NO: 495323 - DNA, 25 bp, Mus musculus
ttttagccacgaagaatttagacag

SEQ ID NO: 495324 - DNA, 25 bp, Mus musculus
ttttagctactgaatcgtcaaggcg

SEQ ID NO: 495325 - DNA, 25 bp, Mus musculus
ttttagctggacactggccttgccg

SEQ ID NO: 495326 - DNA, 25 bp, Mus musculus
ttttaggcgtagcacagccaggcag

SEQ ID NO: 495327 - DNA, 25 bp, Mus musculus
ttttaggcttgacagcaccacctgg

SEQ ID NO: 495328 - DNA, 25 bp, Mus musculus
ttttagggacgcttccaagagctgc

SEQ ID NO: 495329 - DNA, 25 bp, Mus musculus
ttttagggttgcagacaaattgaac

SEQ ID NO: 495330 - DNA, 25 bp, Mus musculus
ttttagtccgactcacagggctgtc

SEQ ID NO: 495331 - DNA, 25 bp, Mus musculus
ttttagtctcctacctgtggagtgt

SEQ ID NO: 495332 - DNA, 25 bp, Mus musculus
ttttagtgggcgcagactccgatca

SEQ ID NO: 495333 - DNA, 25 bp, Mus musculus
ttttataatgtaaccactgtcggag

SEQ ID NO: 495334 - DNA, 25 bp, Mus musculus
ttttatacagcggacagcgcacgga

SEQ ID NO: 495335 - DNA, 25 bp, Mus musculus
ttttatatgccatctccaagctggg

SEQ ID NO: 495336 - DNA, 25 bp, Mus musculus
ttttatcagtcagttgttcatgcag

SEQ ID NO: 495337 - DNA, 25 bp, Mus musculus
ttttatccaagagactgaggctgcc

SEQ ID NO: 495338 - DNA, 25 bp, Mus musculus
ttttatccccaaacagaagccagcg

SEQ ID NO: 495339 - DNA, 25 bp, Mus musculus
ttttatcctgatagactcctatgct

SEQ ID NO: 495340 - DNA, 25 bp, Mus musculus
ttttatcgaagagatgatgcctgag

SEQ ID NO: 495341 - DNA, 25 bp, Mus musculus
ttttatctactgcagaggtgccgcg

SEQ ID NO: 495342 - DNA, 25 bp, Mus musculus
ttttatgagcaagcttaccgcggca

SEQ ID NO: 495343 - DNA, 25 bp, Mus musculus
ttttatgcgtgaacacagcggttcc

SEQ ID NO: 495344 - DNA, 25 bp, Mus musculus
ttttatgggccagccaaccagggac

SEQ ID NO: 495345 - DNA, 25 bp, Mus musculus
ttttatgggtagaaggacagatgtg

SEQ ID NO: 495346 - DNA, 25 bp, Mus musculus
ttttattaagatcccgctcaaggtc

SEQ ID NO: 495347 - DNA, 25 bp, Mus musculus
ttttattactcagcgcacactgggc

SEQ ID NO: 495348 - DNA, 25 bp, Mus musculus
ttttattgcttgaggacagacgggc

SEQ ID NO: 495349 - DNA, 25 bp, Mus musculus
ttttatttaagcgtccgtggcaccg

SEQ ID NO: 495350 - DNA, 25 bp, Mus musculus
ttttcaaaattgacattctcagatt

SEQ ID NO: 495351 - DNA, 25 bp, Mus musculus
ttttcaaacacgagacggagaggcc

SEQ ID NO: 495352 - DNA, 25 bp, Mus musculus
ttttcaaagaaagagaacctataga

SEQ ID NO: 495353 - DNA, 25 bp, Mus musculus
ttttcaagaaagcaggatggaccat

SEQ ID NO: 495354 - DNA, 25 bp, Mus musculus
ttttcaagaccacgtcctgagtgtg

SEQ ID NO: 495355 - DNA, 25 bp, Mus musculus
ttttcaagacgaccagaccctgatt

SEQ ID NO: 495356 - DNA, 25 bp, Mus musculus
ttttcaagccttcgagggcactgca

SEQ ID NO: 495357 - DNA, 25 bp, Mus musculus
ttttcaatcatggaggtcacggaca

SEQ ID NO: 495358 - DNA, 25 bp, Mus musculus
ttttcaatgaatgccagtaccgtgg

SEQ ID NO: 495359 - DNA, 25 bp, Mus musculus
ttttcacaactaccccgggagcact

SEQ ID NO: 495360 - DNA, 25 bp, Mus musculus
ttttcacaagtattccattagagct

SEQ ID NO: 495361 - DNA, 25 bp, Mus musculus
ttttcacaccaccatgaagagatgg

SEQ ID NO: 495362 - DNA, 25 bp, Mus musculus
ttttcacagaaacattcctccaatg

SEQ ID NO: 495363 - DNA, 25 bp, Mus musculus
ttttcacagaggcagcttaccctga

SEQ ID NO: 495364 - DNA, 25 bp, Mus musculus
ttttcacagcagagcggcgatggta

SEQ ID NO: 495365 - DNA, 25 bp, Mus musculus
ttttcacatctggaggaagactgga

SEQ ID NO: 495366 - DNA, 25 bp, Mus musculus
ttttcaccaagaacttccgcaggga

SEQ ID NO: 495367 - DNA, 25 bp, Mus musculus
ttttcaccaagacacgtgagtctcc

SEQ ID NO: 495368 - DNA, 25 bp, Mus musculus
ttttcaccacgtggcaccagaggtt

SEQ ID NO: 495369 - DNA, 25 bp, Mus musculus
ttttcacccataccagcctttggag

SEQ ID NO: 495370 - DNA, 25 bp, Mus musculus
ttttcaccgatggagacgaccctga

SEQ ID NO: 495371 - DNA, 25 bp, Mus musculus
ttttcacgaggagatgcgggttccg

SEQ ID NO: 495372 - DNA, 25 bp, Mus musculus
ttttcacgcaaggaaactgtgtcag

SEQ ID NO: 495373 - DNA, 25 bp, Mus musculus
ttttcactagacttgaagatacggt

SEQ ID NO: 495374 - DNA, 25 bp, Mus musculus
ttttcactgaagtgggctggatgtc

SEQ ID NO: 495375 - DNA, 25 bp, Mus musculus
ttttcagagccaccttccaagctca

SEQ ID NO: 495376 - DNA, 25 bp, Mus musculus
ttttcagagctgtcccgcaagtgca

SEQ ID NO: 495377 - DNA, 25 bp, Mus musculus
ttttcagagtcattccaggatccca

SEQ ID NO: 495378 - DNA, 25 bp, Mus musculus
ttttcagatctacctagggaagtcc

SEQ ID NO: 495379 - DNA, 25 bp, Mus musculus
ttttcagcaggcacaagtcaggcac

SEQ ID NO: 495380 - DNA, 25 bp, Mus musculus
ttttcagccaccaccatctcagact

SEQ ID NO: 495381 - DNA, 25 bp, Mus musculus
ttttcagctgagcagattgcccggt

SEQ ID NO: 495382 - DNA, 25 bp, Mus musculus
ttttcaggagccttgcagcggagca

SEQ ID NO: 495383 - DNA, 25 bp, Mus musculus
ttttcagggccaccaacatggaaaa

SEQ ID NO: 495384 - DNA, 25 bp, Mus musculus
ttttcagtgaaaaagtagatcaggc

SEQ ID NO: 495385 - DNA, 25 bp, Mus musculus
ttttcagtggccaaacggtcagctg

SEQ ID NO: 495386 - DNA, 25 bp, Mus musculus
ttttcagtgggcaacatccaaaccc

SEQ ID NO: 495387 - DNA, 25 bp, Mus musculus
ttttcataaaactaggctcggctgg

SEQ ID NO: 495388 - DNA, 25 bp, Mus musculus
ttttcatcagcggtccattcccaag

SEQ ID NO: 495389 - DNA, 25 bp, Mus musculus
ttttcatcatggcagagaaacttgg

SEQ ID NO: 495390 - DNA, 25 bp, Mus musculus
ttttcatctgacttgacactgcctg

SEQ ID NO: 495391 - DNA, 25 bp, Mus musculus
ttttcatgcaatcacaacgccgggt

SEQ ID NO: 495392 - DNA, 25 bp, Mus musculus
ttttcatgcggctcacagcgaaggc

SEQ ID NO: 495393 - DNA, 25 bp, Mus musculus
ttttcatgtagagagagcgctgcgg

SEQ ID NO: 495394 - DNA, 25 bp, Mus musculus
ttttcatgtagcagtgtgacacccg

SEQ ID NO: 495395 - DNA, 25 bp, Mus musculus
ttttcattatccagagcgagagcct

SEQ ID NO: 495396 - DNA, 25 bp, Mus musculus
ttttcattcacaccgccacagtagg

SEQ ID NO: 495397 - DNA, 25 bp, Mus musculus
ttttcattctgagcccagggaccag

SEQ ID NO: 495398 - DNA, 25 bp, Mus musculus
ttttccaacaccgaagggaggcaga

SEQ ID NO: 495399 - DNA, 25 bp, Mus musculus
ttttccaacggctgagagcgcctgg

SEQ ID NO: 495400 - DNA, 25 bp, Mus musculus
ttttccaagtaggtgagaggcgacc

SEQ ID NO: 495401 - DNA, 25 bp, Mus musculus
ttttccaatgacaagccctgggcag

SEQ ID NO: 495402 - DNA, 25 bp, Mus musculus
ttttccagcagcatctgtacagcta

SEQ ID NO: 495403 - DNA, 25 bp, Mus musculus
ttttccaggacagggaagtagcaga

SEQ ID NO: 495404 - DNA, 25 bp, Mus musculus
ttttccagttggagcggaagcccac

SEQ ID NO: 495405 - DNA, 25 bp, Mus musculus
ttttcccagggagagggcatccttc

SEQ ID NO: 495406 - DNA, 25 bp, Mus musculus
ttttccccggattcagagagcgtgt

SEQ ID NO: 495407 - DNA, 25 bp, Mus musculus
ttttcccctcagtgttcctccgagt

SEQ ID NO: 495408 - DNA, 25 bp, Mus musculus
ttttcccgagtccaggtgagaacct

SEQ ID NO: 495409 - DNA, 25 bp, Mus musculus
ttttcccgctcgcaggtgctggagc

SEQ ID NO: 495410 - DNA, 25 bp, Mus musculus
ttttccctgcagactaatgcctact

SEQ ID NO: 495411 - DNA, 25 bp, Mus musculus
ttttccctggttcagcctgaactat

SEQ ID NO: 495412 - DNA, 25 bp, Mus musculus
ttttccctgtcatcagagggcgagg

SEQ ID NO: 495413 - DNA, 25 bp, Mus musculus
ttttccggaatggacggaagctgac

SEQ ID NO: 495414 - DNA, 25 bp, Mus musculus
ttttccggcaaacaacatcgtgaag

SEQ ID NO: 495415 - DNA, 25 bp, Mus musculus
ttttccgggaagcacgagaggctcc

SEQ ID NO: 495416 - DNA, 25 bp, Mus musculus
ttttccgtcatctgaccttggaaag

SEQ ID NO: 495417 - DNA, 25 bp, Mus musculus
ttttcctaggcaacaggcacagctg

SEQ ID NO: 495418 - DNA, 25 bp, Mus musculus
ttttcctccgccttcaggctgagca

SEQ ID NO: 495419 - DNA, 25 bp, Mus musculus
ttttcctctaatggccttgactcgg

SEQ ID NO: 495420 - DNA, 25 bp, Mus musculus
ttttcctgaagttaaatgctgggcc

SEQ ID NO: 495421 - DNA, 25 bp, Mus musculus
ttttcctgacctctgttgtgacctg

SEQ ID NO: 495422 - DNA, 25 bp, Mus musculus
ttttcctgagggagtagcccagagc

SEQ ID NO: 495423 - DNA, 25 bp, Mus musculus
ttttcctgcggatgagcctagagct

SEQ ID NO: 495424 - DNA, 25 bp, Mus musculus
ttttccttccattaatagatccgag

SEQ ID NO: 495425 - DNA, 25 bp, Mus musculus
ttttccttctactgcgcatgtctga

SEQ ID NO: 495426 - DNA, 25 bp, Mus musculus
ttttccttgggctaagctgtagggc

SEQ ID NO: 495427 - DNA, 25 bp, Mus musculus
ttttcgagcctgacgcctggccagg

SEQ ID NO: 495428 - DNA, 25 bp, Mus musculus
ttttcgagcggctaccatgagtgcg

SEQ ID NO: 495429 - DNA, 25 bp, Mus musculus
ttttcgcatatgagttggacggccc

SEQ ID NO: 495430 - DNA, 25 bp, Mus musculus
ttttcgccatttcaaagatactacc

SEQ ID NO: 495431 - DNA, 25 bp, Mus musculus
ttttcggaaagaagttgggcagcac

SEQ ID NO: 495432 - DNA, 25 bp, Mus musculus
ttttcggcacaagagtcaactgcgg

SEQ ID NO: 495433 - DNA, 25 bp, Mus musculus
ttttcgtatctcgacactctgcaag

SEQ ID NO: 495434 - DNA, 25 bp, Mus musculus
ttttcgtggaccctagagctctgga

SEQ ID NO: 495435 - DNA, 25 bp, Mus musculus
ttttcgttgcaggatatattagtca

SEQ ID NO: 495436 - DNA, 25 bp, Mus musculus
ttttctaaaacccagcggtggccag

SEQ ID NO: 495437 - DNA, 25 bp, Mus musculus
ttttctaccgacagaaggtggcgtt

SEQ ID NO: 495438 - DNA, 25 bp, Mus musculus
ttttctagctcagccattccacagg

SEQ ID NO: 495439 - DNA, 25 bp, Mus musculus
ttttctaggaatggagcaggtactc

SEQ ID NO: 495440 - DNA, 25 bp, Mus musculus
ttttctcatacccaggaccatatgc

SEQ ID NO: 495441 - DNA, 25 bp, Mus musculus
ttttctccaaggatccgagcgtgcg

SEQ ID NO: 495442 - DNA, 25 bp, Mus musculus
ttttctccagcaaagtctgccacat

SEQ ID NO: 495443 - DNA, 25 bp, Mus musculus
ttttctccaggcaacaaccaggcct

SEQ ID NO: 495444 - DNA, 25 bp, Mus musculus
ttttctccggaaggtgaaaggcgcg

SEQ ID NO: 495445 - DNA, 25 bp, Mus musculus
ttttctccgtgttgctttggctgtc

SEQ ID NO: 495446 - DNA, 25 bp, Mus musculus
ttttctcgcgggatacggattggac

SEQ ID NO: 495447 - DNA, 25 bp, Mus musculus
ttttctctcataattggcacctggg

SEQ ID NO: 495448 - DNA, 25 bp, Mus musculus
ttttctgaaacctgcaactggatgg

SEQ ID NO: 495449 - DNA, 25 bp, Mus musculus
ttttctgagattatatcatttctgc

SEQ ID NO: 495450 - DNA, 25 bp, Mus musculus
ttttctgatcgctctccatccaggg

SEQ ID NO: 495451 - DNA, 25 bp, Mus musculus
ttttctgattcctattaagtgggca

SEQ ID NO: 495452 - DNA, 25 bp, Mus musculus
ttttctgccaagctgggaacgcgcc

SEQ ID NO: 495453 - DNA, 25 bp, Mus musculus
ttttctggcccgatgcatgaaggca

SEQ ID NO: 495454 - DNA, 25 bp, Mus musculus
ttttctgtcccagcgaggatgcctg

SEQ ID NO: 495455 - DNA, 25 bp, Mus musculus
ttttctgtgcaatacgagacccggc

SEQ ID NO: 495456 - DNA, 25 bp, Mus musculus
ttttctgtgcccaggctttgaaggc

SEQ ID NO: 495457 - DNA, 25 bp, Mus musculus
ttttctgtggaagaggactttgaag

SEQ ID NO: 495458 - DNA, 25 bp, Mus musculus
ttttctgttcgacaactggcggtga

SEQ ID NO: 495459 - DNA, 25 bp, Mus musculus
ttttcttaaaacacaggagcagctg

SEQ ID NO: 495460 - DNA, 25 bp, Mus musculus
ttttcttcagattcggaggtcgcca

SEQ ID NO: 495461 - DNA, 25 bp, Mus musculus
ttttcttgggcagcggagtctagct

SEQ ID NO: 495462 - DNA, 25 bp, Mus musculus
ttttctttcagtctgcaactgtgtc

SEQ ID NO: 495463 - DNA, 25 bp, Mus musculus
ttttgaaaagagtacccgcctcgtg

SEQ ID NO: 495464 - DNA, 25 bp, Mus musculus
ttttgaaacagagagaacgccacga

SEQ ID NO: 495465 - DNA, 25 bp, Mus musculus
ttttgaaacgtaagtgcattcctgc

SEQ ID NO: 495466 - DNA, 25 bp, Mus musculus
ttttgaaacgtacagcgcctgggcc

SEQ ID NO: 495467 - DNA, 25 bp, Mus musculus
ttttgaaatacttgactgctgccag

SEQ ID NO: 495468 - DNA, 25 bp, Mus musculus
ttttgaaatcacatcataagaacca

SEQ ID NO: 495469 - DNA, 25 bp, Mus musculus
ttttgaacttcatgagacagctttg

SEQ ID NO: 495470 - DNA, 25 bp, Mus musculus
ttttgaagacatagagaggtacacc

SEQ ID NO: 495471 - DNA, 25 bp, Mus musculus
ttttgaagcccagctgagcgacgtg

SEQ ID NO: 495472 - DNA, 25 bp, Mus musculus
ttttgaagctctgcacagatcaggg

SEQ ID NO: 495473 - DNA, 25 bp, Mus musculus
ttttgaataagacgtggatccaggc

SEQ ID NO: 495474 - DNA, 25 bp, Mus musculus
ttttgaatgacaccctggcctgagc

SEQ ID NO: 495475 - DNA, 25 bp, Mus musculus
ttttgacactacttccagttccagc

SEQ ID NO: 495476 - DNA, 25 bp, Mus musculus
ttttgacactcatgacctgggaagc

SEQ ID NO: 495477 - DNA, 25 bp, Mus musculus
ttttgacacttacaggagggcctcc

SEQ ID NO: 495478 - DNA, 25 bp, Mus musculus
ttttgacagcaaaggaacccagcag

SEQ ID NO: 495479 - DNA, 25 bp, Mus musculus
ttttgaccacagatgaccctaaggg

SEQ ID NO: 495480 - DNA, 25 bp, Mus musculus
ttttgacgtgaatgaccaggacccc

SEQ ID NO: 495481 - DNA, 25 bp, Mus musculus
ttttgactatcacctaaatgctgca

SEQ ID NO: 495482 - DNA, 25 bp, Mus musculus
ttttgactcaaggaagcggccatcc

SEQ ID NO: 495483 - DNA, 25 bp, Mus musculus
ttttgactcgggaagccctcagatg

SEQ ID NO: 495484 - DNA, 25 bp, Mus musculus
ttttgactttgcacagggcttactg

SEQ ID NO: 495485 - DNA, 25 bp, Mus musculus
ttttgagcagaggacgcagctgccc

SEQ ID NO: 495486 - DNA, 25 bp, Mus musculus
ttttgagcagcaccggaaggcttgc

SEQ ID NO: 495487 - DNA, 25 bp, Mus musculus
ttttgagctgatcaaggacaactgc

SEQ ID NO: 495488 - DNA, 25 bp, Mus musculus
ttttgaggacgccaagacacaggtc

SEQ ID NO: 495489 - DNA, 25 bp, Mus musculus
ttttgagtacaacctgtggtctctg

SEQ ID NO: 495490 - DNA, 25 bp, Mus musculus
ttttgagtagatagcctagactggc

SEQ ID NO: 495491 - DNA, 25 bp, Mus musculus
ttttgataaggaaaccgaaggccag

SEQ ID NO: 495492 - DNA, 25 bp, Mus musculus
ttttgataaggacgcaaagcctctg

SEQ ID NO: 495493 - DNA, 25 bp, Mus musculus
ttttgatcatatgacccgcacgggt

SEQ ID NO: 495494 - DNA, 25 bp, Mus musculus
ttttgatccgagagatcacccggcg

SEQ ID NO: 495495 - DNA, 25 bp, Mus musculus
ttttgatcggcgtacaggcagaacc

SEQ ID NO: 495496 - DNA, 25 bp, Mus musculus
ttttgatggacagagaaggcggcca

SEQ ID NO: 495497 - DNA, 25 bp, Mus musculus
ttttgatggctgtgaggacgactac

SEQ ID NO: 495498 - DNA, 25 bp, Mus musculus
ttttgattcagcatacggagcggca

SEQ ID NO: 495499 - DNA, 25 bp, Mus musculus
ttttgattgccagaatggagcccag

SEQ ID NO: 495500 - DNA, 25 bp, Mus musculus
ttttgcaaatacagcagcgcggcca

SEQ ID NO: 495501 - DNA, 25 bp, Mus musculus
ttttgcaaatgcacctactgggtgg

SEQ ID NO: 495502 - DNA, 25 bp, Mus musculus
ttttgcaacccaaaggcgagaggcg

SEQ ID NO: 495503 - DNA, 25 bp, Mus musculus
ttttgcaagcaaagcctcaggtaga

SEQ ID NO: 495504 - DNA, 25 bp, Mus musculus
ttttgcaccatagaattcatacggg

SEQ ID NO: 495505 - DNA, 25 bp, Mus musculus
ttttgcacccttgtaaaacgcaggc

SEQ ID NO: 495506 - DNA, 25 bp, Mus musculus
ttttgcagcctaaggaacattttcc

SEQ ID NO: 495507 - DNA, 25 bp, Mus musculus
ttttgcaggtcgctagcacggctcc

SEQ ID NO: 495508 - DNA, 25 bp, Mus musculus
ttttgcagtatgattcaaagcatga

SEQ ID NO: 495509 - DNA, 25 bp, Mus musculus
ttttgccacccgcaagatcgcagtg

SEQ ID NO: 495510 - DNA, 25 bp, Mus musculus
ttttgccactgaccctaacagcgag

SEQ ID NO: 495511 - DNA, 25 bp, Mus musculus
ttttgccaggtaaatgcattgttac

SEQ ID NO: 495512 - DNA, 25 bp, Mus musculus
ttttgcccaagagacctggtgccgg

SEQ ID NO: 495513 - DNA, 25 bp, Mus musculus
ttttgcccgacggatggaagccctt

SEQ ID NO: 495514 - DNA, 25 bp, Mus musculus
ttttgcccgggcacataatagctgc

SEQ ID NO: 495515 - DNA, 25 bp, Mus musculus
ttttgccctgaccttctcttatgag

SEQ ID NO: 495516 - DNA, 25 bp, Mus musculus
ttttgccgggaaagtcgctacatgg

SEQ ID NO: 495517 - DNA, 25 bp, Mus musculus
ttttgcctccagctgaagcgtgccg

SEQ ID NO: 495518 - DNA, 25 bp, Mus musculus
ttttgcctgcaggtagtgggcagca

SEQ ID NO: 495519 - DNA, 25 bp, Mus musculus
ttttgcctttccacgaatatataga

SEQ ID NO: 495520 - DNA, 25 bp, Mus musculus
ttttgcggattgttctggcttccag

SEQ ID NO: 495521 - DNA, 25 bp, Mus musculus
ttttgcgggacctcacaaggctgca

SEQ ID NO: 495522 - DNA, 25 bp, Mus musculus
ttttgcgggcgaagtacgcgtgcct

SEQ ID NO: 495523 - DNA, 25 bp, Mus musculus
ttttgctaattgtagtgtgcaaggg

SEQ ID NO: 495524 - DNA, 25 bp, Mus musculus
ttttgctaccgcacaagagcaggag

SEQ ID NO: 495525 - DNA, 25 bp, Mus musculus
ttttgctcctgacagacccggttga

SEQ ID NO: 495526 - DNA, 25 bp, Mus musculus
ttttgctgagacatagccgcaccct

SEQ ID NO: 495527 - DNA, 25 bp, Mus musculus
ttttgctgaggctacccggatcttc

SEQ ID NO: 495528 - DNA, 25 bp, Mus musculus
ttttgctgatggtacatggtgcccc

SEQ ID NO: 495529 - DNA, 25 bp, Mus musculus
ttttgctgcatccactttgctggtg

SEQ ID NO: 495530 - DNA, 25 bp, Mus musculus
ttttgctgcctggagaggcgacccg

SEQ ID NO: 495531 - DNA, 25 bp, Mus musculus
ttttgctggtgcagggatcataccc

SEQ ID NO: 495532 - DNA, 25 bp, Mus musculus
ttttgcttctactgagcgggtccac

SEQ ID NO: 495533 - DNA, 25 bp, Mus musculus
ttttgcttgaattgatggaacgccc

SEQ ID NO: 495534 - DNA, 25 bp, Mus musculus
ttttggaacttgtgatgaacgatgc

SEQ ID NO: 495535 - DNA, 25 bp, Mus musculus
ttttggaagaactcctctaattaag

SEQ ID NO: 495536 - DNA, 25 bp, Mus musculus
ttttggaagagggtagcactccgcc

SEQ ID NO: 495537 - DNA, 25 bp, Mus musculus
ttttggaatccccagacggaggctc

SEQ ID NO: 495538 - DNA, 25 bp, Mus musculus
ttttggacaaagtatcccagcaggg

SEQ ID NO: 495539 - DNA, 25 bp, Mus musculus
ttttggacaacacttacccctgagc

SEQ ID NO: 495540 - DNA, 25 bp, Mus musculus
ttttggacacacagaagttcagcct

SEQ ID NO: 495541 - DNA, 25 bp, Mus musculus
ttttggacagttcacctagctcatg

SEQ ID NO: 495542 - DNA, 25 bp, Mus musculus
ttttggagcactctcagcccgtttg

SEQ ID NO: 495543 - DNA, 25 bp, Mus musculus
ttttggaggatatcaagccactcgg

SEQ ID NO: 495544 - DNA, 25 bp, Mus musculus
ttttggaggccagcatgcatctgtg

SEQ ID NO: 495545 - DNA, 25 bp, Mus musculus
ttttggagggccagagttcactccc

SEQ ID NO: 495546 - DNA, 25 bp, Mus musculus
ttttggagtccgagagaggcaagcc

SEQ ID NO: 495547 - DNA, 25 bp, Mus musculus
ttttggatccagctaaacgcgggtt

SEQ ID NO: 495548 - DNA, 25 bp, Mus musculus
ttttggcaggtaaatccgagctcgc

SEQ ID NO: 495549 - DNA, 25 bp, Mus musculus
ttttggcccaaactcctgatgaagg

SEQ ID NO: 495550 - DNA, 25 bp, Mus musculus
ttttggcccaagtcaaagacaccta

SEQ ID NO: 495551 - DNA, 25 bp, Mus musculus
ttttggcccgcaactgtggtcgaga

SEQ ID NO: 495552 - DNA, 25 bp, Mus musculus
ttttggccgccaccgatgggtcatc

SEQ ID NO: 495553 - DNA, 25 bp, Mus musculus
ttttggcctagagctggaactgtac

SEQ ID NO: 495554 - DNA, 25 bp, Mus musculus
ttttggcgggcggttggcattgcgc

SEQ ID NO: 495555 - DNA, 25 bp, Mus musculus
ttttggctctgaaggtggcacgtac

SEQ ID NO: 495556 - DNA, 25 bp, Mus musculus
ttttggctgccgagcaggacatccg

SEQ ID NO: 495557 - DNA, 25 bp, Mus musculus
ttttggctggctacctcgagggcta

SEQ ID NO: 495558 - DNA, 25 bp, Mus musculus
ttttggctgtgaaacgtagtccggg

SEQ ID NO: 495559 - DNA, 25 bp, Mus musculus
ttttgggaaccacacgacagtctga

SEQ ID NO: 495560 - DNA, 25 bp, Mus musculus
ttttgggacaaggtagggactgact

SEQ ID NO: 495561 - DNA, 25 bp, Mus musculus
ttttgggaggatcaagtgagcttac

SEQ ID NO: 495562 - DNA, 25 bp, Mus musculus
ttttgggatggaattggacacagcc

SEQ ID NO: 495563 - DNA, 25 bp, Mus musculus
ttttgggcccaagcaggttcagtct

SEQ ID NO: 495564 - DNA, 25 bp, Mus musculus
ttttgggctcccacatggttgcagg

SEQ ID NO: 495565 - DNA, 25 bp, Mus musculus
ttttggtacagcaggcaactcagcc

SEQ ID NO: 495566 - DNA, 25 bp, Mus musculus
ttttggtacaggtaactggacccag

SEQ ID NO: 495567 - DNA, 25 bp, Mus musculus
ttttggtatccagttcagtgacctc

SEQ ID NO: 495568 - DNA, 25 bp, Mus musculus
ttttggtcatggagcccgaggtcct

SEQ ID NO: 495569 - DNA, 25 bp, Mus musculus
ttttggtggtactaggatggagccc

SEQ ID NO: 495570 - DNA, 25 bp, Mus musculus
ttttggtggtgttgagctactggtc

SEQ ID NO: 495571 - DNA, 25 bp, Mus musculus
ttttggttgctctctcccggtggtg

SEQ ID NO: 495572 - DNA, 25 bp, Mus musculus
ttttgtaaagtgtggcgggctagac

SEQ ID NO: 495573 - DNA, 25 bp, Mus musculus
ttttgtaacgaaaggcgggtctgcg

SEQ ID NO: 495574 - DNA, 25 bp, Mus musculus
ttttgtaacgtgatccctattccct

SEQ ID NO: 495575 - DNA, 25 bp, Mus musculus
ttttgtacccatacaggccgggcca

SEQ ID NO: 495576 - DNA, 25 bp, Mus musculus
ttttgtacctactcagggcagttac

SEQ ID NO: 495577 - DNA, 25 bp, Mus musculus
ttttgtactaagaggacgacgagcc

SEQ ID NO: 495578 - DNA, 25 bp, Mus musculus
ttttgtagctgggtgagttttccca

SEQ ID NO: 495579 - DNA, 25 bp, Mus musculus
ttttgtcacaatctggcccggtcca

SEQ ID NO: 495580 - DNA, 25 bp, Mus musculus
ttttgtcagcaaagactggcgccag

SEQ ID NO: 495581 - DNA, 25 bp, Mus musculus
ttttgtcccactgcgagggcaggcc

SEQ ID NO: 495582 - DNA, 25 bp, Mus musculus
ttttgtccgtcagctgccggaagcg

SEQ ID NO: 495583 - DNA, 25 bp, Mus musculus
ttttgtcctgtagagatggtcccca

SEQ ID NO: 495584 - DNA, 25 bp, Mus musculus
ttttgtctgcatggccaacctggta

SEQ ID NO: 495585 - DNA, 25 bp, Mus musculus
ttttgtctgtgggttcgctcccggg

SEQ ID NO: 495586 - DNA, 25 bp, Mus musculus
ttttgtgacctcctgggctctgtga

SEQ ID NO: 495587 - DNA, 25 bp, Mus musculus
ttttgtgcaaaaagacgcggtagcc

SEQ ID NO: 495588 - DNA, 25 bp, Mus musculus
ttttgtgcaagacgcaacactctgg

SEQ ID NO: 495589 - DNA, 25 bp, Mus musculus
ttttgtgcccaaagaaaggtgctga

SEQ ID NO: 495590 - DNA, 25 bp, Mus musculus
ttttgtggacgagcatgagcctgcg

SEQ ID NO: 495591 - DNA, 25 bp, Mus musculus
ttttgtggacgatcgtagccccagc

SEQ ID NO: 495592 - DNA, 25 bp, Mus musculus
ttttgtggctcgagaaacgctgcgg

SEQ ID NO: 495593 - DNA, 25 bp, Mus musculus
ttttgtggttggtgagttcctcagc

SEQ ID NO: 495594 - DNA, 25 bp, Mus musculus
ttttgtgtaaagtgagccagaggcc

SEQ ID NO: 495595 - DNA, 25 bp, Mus musculus
ttttgtgtcaaggtgctgccccgct

SEQ ID NO: 495596 - DNA, 25 bp, Mus musculus
ttttgtgtcctctcctagtgtcccc

SEQ ID NO: 495597 - DNA, 25 bp, Mus musculus
ttttgttgctgttgcctaggaggga

SEQ ID NO: 495598 - DNA, 25 bp, Mus musculus
ttttgtttagaggttggtcctgatg

SEQ ID NO: 495599 - DNA, 25 bp, Mus musculus
tttttaaaaatcgaggtgcggtgag

SEQ ID NO: 495600 - DNA, 25 bp, Mus musculus
tttttaaactgaggccacccgagct

SEQ ID NO: 495601 - DNA, 25 bp, Mus musculus
tttttaaatcagagccggcaggcac

SEQ ID NO: 495602 - DNA, 25 bp, Mus musculus
tttttaaggctacctgaatgtagac

SEQ ID NO: 495603 - DNA, 25 bp, Mus musculus
tttttaataaaactgcccaagagct

SEQ ID NO: 495604 - DNA, 25 bp, Mus musculus
tttttacagagacatggacattgcc

SEQ ID NO: 495605 - DNA, 25 bp, Mus musculus
tttttacagcaaggaagctcgccat

SEQ ID NO: 495606 - DNA, 25 bp, Mus musculus
tttttagacacttccaaacaagcca

SEQ ID NO: 495607 - DNA, 25 bp, Mus musculus
tttttagctccaagtcctggcaggg

SEQ ID NO: 495608 - DNA, 25 bp, Mus musculus
tttttataggccttgtgagagctgg

SEQ ID NO: 495609 - DNA, 25 bp, Mus musculus
tttttatcaagcagagcacccaggg

SEQ ID NO: 495610 - DNA, 25 bp, Mus musculus
tttttattcctgtaacagaagagat

SEQ ID NO: 495611 - DNA, 25 bp, Mus musculus
tttttattggtgttcttgttgggat

SEQ ID NO: 495612 - DNA, 25 bp, Mus musculus
tttttcaccactcgaaaggtgagcc

SEQ ID NO: 495613 - DNA, 25 bp, Mus musculus
tttttcacgaaaagccacagggttg

SEQ ID NO: 495614 - DNA, 25 bp, Mus musculus
tttttcagatagtggtgaccttccc

SEQ ID NO: 495615 - DNA, 25 bp, Mus musculus
tttttcagtaaagctcccacccagg

SEQ ID NO: 495616 - DNA, 25 bp, Mus musculus
tttttccaaacaaacgtgagcccag

SEQ ID NO: 495617 - DNA, 25 bp, Mus musculus
tttttccccagtgaagcaccgtgtg

SEQ ID NO: 495618 - DNA, 25 bp, Mus musculus
tttttcccgggaattagcacaggca

SEQ ID NO: 495619 - DNA, 25 bp, Mus musculus
tttttccctgaattcttaggagcac

SEQ ID NO: 495620 - DNA, 25 bp, Mus musculus
tttttctcagtcattctcactcctt

SEQ ID NO: 495621 - DNA, 25 bp, Mus musculus
tttttctctacagagctgggtcgac

SEQ ID NO: 495622 - DNA, 25 bp, Mus musculus
tttttctgacacctgccagcctgga

SEQ ID NO: 495623 - DNA, 25 bp, Mus musculus
tttttctggacacaagtacggccct

SEQ ID NO: 495624 - DNA, 25 bp, Mus musculus
tttttctggatgcaacggtatggct

SEQ ID NO: 495625 - DNA, 25 bp, Mus musculus
tttttctgggcttcacgagcaggcg

SEQ ID NO: 495626 - DNA, 25 bp, Mus musculus
tttttcttggaagggcacacagcag

SEQ ID NO: 495627 - DNA, 25 bp, Mus musculus
tttttcttttaatcccgcagaagca

SEQ ID NO: 495628 - DNA, 25 bp, Mus musculus
tttttgaagaaccagattccgggct

SEQ ID NO: 495629 - DNA, 25 bp, Mus musculus
tttttgaagatgcaacaagtgccct

SEQ ID NO: 495630 - DNA, 25 bp, Mus musculus
tttttgacaagacacaccttcatgg

SEQ ID NO: 495631 - DNA, 25 bp, Mus musculus
tttttgagaagtgcgagctggcgac

SEQ ID NO: 495632 - DNA, 25 bp, Mus musculus
tttttgaggacagagctgcccgagg

SEQ ID NO: 495633 - DNA, 25 bp, Mus musculus
tttttgatcgtcacggagccgggcc

SEQ ID NO: 495634 - DNA, 25 bp, Mus musculus
tttttgcaaaaaggcgcctgtgtct

SEQ ID NO: 495635 - DNA, 25 bp, Mus musculus
tttttgcaaagatgagcgcccgtcc

SEQ ID NO: 495636 - DNA, 25 bp, Mus musculus
tttttgcagccaatcggcgggcgcg

SEQ ID NO: 495637 - DNA, 25 bp, Mus musculus
tttttgctcaaaatcttgggaagag

SEQ ID NO: 495638 - DNA, 25 bp, Mus musculus
tttttgctgagttaccggcgaccca

SEQ ID NO: 495639 - DNA, 25 bp, Mus musculus
tttttgctggaggaccgagtagcct

SEQ ID NO: 495640 - DNA, 25 bp, Mus musculus
tttttggacactgtacccatctttg

SEQ ID NO: 495641 - DNA, 25 bp, Mus musculus
tttttggagacttccggcacgccag

SEQ ID NO: 495642 - DNA, 25 bp, Mus musculus
tttttggccatagctgcccgggtct

SEQ ID NO: 495643 - DNA, 25 bp, Mus musculus
tttttggcccatgaagatccactgg

SEQ ID NO: 495644 - DNA, 25 bp, Mus musculus
tttttggcggcttccaagtggtgcc

SEQ ID NO: 495645 - DNA, 25 bp, Mus musculus
tttttggctcgtaaaatccacgcag

SEQ ID NO: 495646 - DNA, 25 bp, Mus musculus
tttttgggatagaaacgcgcgtgga

SEQ ID NO: 495647 - DNA, 25 bp, Mus musculus
tttttgggcaaacctaagagcatcc

SEQ ID NO: 495648 - DNA, 25 bp, Mus musculus
tttttggtgtcacgcttgcccggga

SEQ ID NO: 495649 - DNA, 25 bp, Mus musculus
tttttgtagatcctcacggccctgg

SEQ ID NO: 495650 - DNA, 25 bp, Mus musculus
tttttgtcaccgaggaagtcattcc

SEQ ID NO: 495651 - DNA, 25 bp, Mus musculus
tttttgtcctaaacatgccgggcca

SEQ ID NO: 495652 - DNA, 25 bp, Mus musculus
tttttgtgactgtctcctacccaag

SEQ ID NO: 495653 - DNA, 25 bp, Mus musculus
tttttgtgcctgactcatatagtcc

SEQ ID NO: 495654 - DNA, 25 bp, Mus musculus
tttttgtggtaccaaatgcactgcc

SEQ ID NO: 495655 - DNA, 25 bp, Mus musculus
ttttttaggtgaagtcaatccaact

SEQ ID NO: 495656 - DNA, 25 bp, Mus musculus
ttttttcaaggagaaatgtgttgca

SEQ ID NO: 495657 - DNA, 25 bp, Mus musculus
ttttttcacatggtagggcaggcct

SEQ ID NO: 495658 - DNA, 25 bp, Mus musculus
ttttttcagtcagtcagagcatctc

SEQ ID NO: 495659 - DNA, 25 bp, Mus musculus
ttttttcatctctaacgtcaccacc

SEQ ID NO: 495660 - DNA, 25 bp, Mus musculus
ttttttcattctcatcggatgcatc

SEQ ID NO: 495661 - DNA, 25 bp, Mus musculus
ttttttccaatatgttccaataaca

SEQ ID NO: 495662 - DNA, 25 bp, Mus musculus
ttttttccctagtcagagcagccag

SEQ ID NO: 495663 - DNA, 25 bp, Mus musculus
ttttttcgcccagagccgtcaggga

SEQ ID NO: 495664 - DNA, 25 bp, Mus musculus
ttttttctagcttgctcgcctgacc

SEQ ID NO: 495665 - DNA, 25 bp, Mus musculus
ttttttgaccacttgatttacctgc

SEQ ID NO: 495666 - DNA, 25 bp, Mus musculus
ttttttgagaccaagtgccgagcct

SEQ ID NO: 495667 - DNA, 25 bp, Mus musculus
ttttttgagatagatggagccctgg

SEQ ID NO: 495668 - DNA, 25 bp, Mus musculus
ttttttgatacatacgccgcagcgt

SEQ ID NO: 495669 - DNA, 25 bp, Mus musculus
ttttttgccaacagttcacatagga

SEQ ID NO: 495670 - DNA, 25 bp, Mus musculus
ttttttgccaagtcagtgctgtgtc

SEQ ID NO: 495671 - DNA, 25 bp, Mus musculus
ttttttggaagtccagtgtgcagcc

SEQ ID NO: 495672 - DNA, 25 bp, Mus musculus
ttttttggccatggctatgcccgcc

SEQ ID NO: 495673 - DNA, 25 bp, Mus musculus
ttttttgtacccagtaaccactcag

SEQ ID NO: 495674 - DNA, 25 bp, Mus musculus
aaaaaacaacatctataatgctacc

SEQ ID NO: 495675 - DNA, 25 bp, Mus musculus
aaaaaacaacatgtataatgctacc

SEQ ID NO: 495676 - DNA, 25 bp, Mus musculus
aaaaaacagatacaccgcctgtggc

SEQ ID NO: 495677 - DNA, 25 bp, Mus musculus
aaaaaacagatagaccgcctgtggc

SEQ ID NO: 495678 - DNA, 25 bp, Mus musculus
aaaaaacagggacaagcgatgaagc

SEQ ID NO: 495679 - DNA, 25 bp, Mus musculus
aaaaaacagggagaagcgatgaagc

SEQ ID NO: 495680 - DNA, 25 bp, Mus musculus
aaaaaacagtggcacgcacattcta

SEQ ID NO: 495681 - DNA, 25 bp, Mus musculus
aaaaaacagtgggacgcacattcta

SEQ ID NO: 495682 - DNA, 25 bp, Mus musculus
aaaaaaccagatcaaggccgagccg

SEQ ID NO: 495683 - DNA, 25 bp, Mus musculus
aaaaaaccagatgaaggccgagccg

SEQ ID NO: 495684 - DNA, 25 bp, Mus musculus
aaaaaacccactagctgctgaggct

SEQ ID NO: 495685 - DNA, 25 bp, Mus musculus
aaaaaacccacttgctgctgaggct

SEQ ID NO: 495686 - DNA, 25 bp, Mus musculus
aaaaaactttgacatacgccacctg

SEQ ID NO: 495687 - DNA, 25 bp, Mus musculus
aaaaaactttgagatacgccacctg

SEQ ID NO: 495688 - DNA, 25 bp, Mus musculus
aaaaaagaatcgctgtttcatgtgc

SEQ ID NO: 495689 - DNA, 25 bp, Mus musculus
aaaaaagaatcggtgtttcatgtgc

SEQ ID NO: 495690 - DNA, 25 bp, Mus musculus
aaaaaagaatgcctaagcctcaggg

SEQ ID NO: 495691 - DNA, 25 bp, Mus musculus
aaaaaagaatgcgtaagcctcaggg

SEQ ID NO: 495692 - DNA, 25 bp, Mus musculus
aaaaaagagcggcagaagcgcagcc

SEQ ID NO: 495693 - DNA, 25 bp, Mus musculus
aaaaaagagcgggagaagcgcagcc

SEQ ID NO: 495694 - DNA, 25 bp, Mus musculus
aaaaaagcagatagagaagcagaga

SEQ ID NO: 495695 - DNA, 25 bp, Mus musculus
aaaaaagcagattgagaagcagaga

SEQ ID NO: 495696 - DNA, 25 bp, Mus musculus
aaaaaagctcatcagatccttcctg

SEQ ID NO: 495697 - DNA, 25 bp, Mus musculus
aaaaaagctcatgagatccttcctg

SEQ ID NO: 495698 - DNA, 25 bp, Mus musculus
aaaaaaggatttctcttgtgcagac

SEQ ID NO: 495699 - DNA, 25 bp, Mus musculus
aaaaaaggatttgtcttgtgcagac

SEQ ID NO: 495700 - DNA, 25 bp, Mus musculus
aaaaaaggccccactgtcatgggag

SEQ ID NO: 495701 - DNA, 25 bp, Mus musculus
aaaaaaggcccctctgtcatgggag

SEQ ID NO: 495702 - DNA, 25 bp, Mus musculus
aaaaaagggaacagactgcccatag

SEQ ID NO: 495703 - DNA, 25 bp, Mus musculus
aaaaaagggaactgactgcccatag

SEQ ID NO: 495704 - DNA, 25 bp, Mus musculus
aaaaaagtctgaagacacggagaaa

SEQ ID NO: 495705 - DNA, 25 bp, Mus musculus
aaaaaagtctgatgacacggagaaa

SEQ ID NO: 495706 - DNA, 25 bp, Mus musculus
aaaaaagttgatacggtgcatgaaa

SEQ ID NO: 495707 - DNA, 25 bp, Mus musculus
aaaaaagttgattcggtgcatgaaa

SEQ ID NO: 495708 - DNA, 25 bp, Mus musculus
aaaaaataatgaagttctcagacag

SEQ ID NO: 495709 - DNA, 25 bp, Mus musculus
aaaaaataatgatgttctcagacag

SEQ ID NO: 495710 - DNA, 25 bp, Mus musculus
aaaaaatacaggcatcaattcacag

SEQ ID NO: 495711 - DNA, 25 bp, Mus musculus
aaaaaatacagggatcaattcacag

SEQ ID NO: 495712 - DNA, 25 bp, Mus musculus
aaaaaatacatgaaatccagatacg

SEQ ID NO: 495713 - DNA, 25 bp, Mus musculus
aaaaaatacatgtaatccagatacg

SEQ ID NO: 495714 - DNA, 25 bp, Mus musculus
aaaaaatagccaccctcagctatgg

SEQ ID NO: 495715 - DNA, 25 bp, Mus musculus
aaaaaatagccagcctcagctatgg

SEQ ID NO: 495716 - DNA, 25 bp, Mus musculus
aaaaaatattgtcgttggcttcgca

SEQ ID NO: 495717 - DNA, 25 bp, Mus musculus
aaaaaatattgtggttggcttcgca

SEQ ID NO: 495718 - DNA, 25 bp, Mus musculus
aaaaaatcctgacatccctggaagg

SEQ ID NO: 495719 - DNA, 25 bp, Mus musculus
aaaaaatcctgagatccctggaagg

SEQ ID NO: 495720 - DNA, 25 bp, Mus musculus
aaaaaatctgtcagctctgcccgag

SEQ ID NO: 495721 - DNA, 25 bp, Mus musculus
aaaaaatctgtctgctctgcccgag

SEQ ID NO: 495722 - DNA, 25 bp, Mus musculus
aaaaaatgagaaattggctgccaac

SEQ ID NO: 495723 - DNA, 25 bp, Mus musculus
aaaaaatgagaatttggctgccaac

SEQ ID NO: 495724 - DNA, 25 bp, Mus musculus
aaaaaatggcatatcgtgagtacac

SEQ ID NO: 495725 - DNA, 25 bp, Mus musculus
aaaaaatggcatttcgtgagtacac

SEQ ID NO: 495726 - DNA, 25 bp, Mus musculus
aaaaaatgttcccaagcttggtgat

SEQ ID NO: 495727 - DNA, 25 bp, Mus musculus
aaaaaatgttccgaagcttggtgat

SEQ ID NO: 495728 - DNA, 25 bp, Mus musculus
aaaaaattagaacccttgcttcagg

SEQ ID NO: 495729 - DNA, 25 bp, Mus musculus
aaaaaattagaagccttgcttcagg

SEQ ID NO: 495730 - DNA, 25 bp, Mus musculus
aaaaaattccagaagcaatttggag

SEQ ID NO: 495731 - DNA, 25 bp, Mus musculus
aaaaaattccagtagcaatttggag

SEQ ID NO: 495732 - DNA, 25 bp, Mus musculus
aaaaaattgcttacatcctagacgc

SEQ ID NO: 495733 - DNA, 25 bp, Mus musculus
aaaaaattgctttcatcctagacgc

SEQ ID NO: 495734 - DNA, 25 bp, Mus musculus
aaaaacaaagtgactatggctccag

SEQ ID NO: 495735 - DNA, 25 bp, Mus musculus
aaaaacaaagtgtctatggctccag

SEQ ID NO: 495736 - DNA, 25 bp, Mus musculus
aaaaacaagtagacactgaagaggc

SEQ ID NO: 495737 - DNA, 25 bp, Mus musculus
aaaaacaagtagtcactgaagaggc

SEQ ID NO: 495738 - DNA, 25 bp, Mus musculus
aaaaacatatctctgggtaaaatgg

SEQ ID NO: 495739 - DNA, 25 bp, Mus musculus
aaaaacatatctgtgggtaaaatgg

SEQ ID NO: 495740 - DNA, 25 bp, Mus musculus
aaaaacatggcccatctccagctca

SEQ ID NO: 495741 - DNA, 25 bp, Mus musculus
aaaaacatggccgatctccagctca

SEQ ID NO: 495742 - DNA, 25 bp, Mus musculus
aaaaacattcaactggtcgagctcc

SEQ ID NO: 495743 - DNA, 25 bp, Mus musculus
aaaaacattcaagtggtcgagctcc

SEQ ID NO: 495744 - DNA, 25 bp, Mus musculus
aaaaacattcccagcgtcagaggcc

SEQ ID NO: 495745 - DNA, 25 bp, Mus musculus
aaaaacattccctgcgtcagaggcc

SEQ ID NO: 495746 - DNA, 25 bp, Mus musculus
aaaaacattgccctaatccaggata

SEQ ID NO: 495747 - DNA, 25 bp, Mus musculus
aaaaacattgccgtaatccaggata

SEQ ID NO: 495748 - DNA, 25 bp, Mus musculus
aaaaaccaccatcaaagctgaacca

SEQ ID NO: 495749 - DNA, 25 bp, Mus musculus
aaaaaccaccatgaaagctgaacca

SEQ ID NO: 495750 - DNA, 25 bp, Mus musculus
aaaaaccaggcgctagtggagctgc

SEQ ID NO: 495751 - DNA, 25 bp, Mus musculus
aaaaaccaggcggtagtggagctgc

SEQ ID NO: 495752 - DNA, 25 bp, Mus musculus
aaaaacccagcactttttcgatgag

SEQ ID NO: 495753 - DNA, 25 bp, Mus musculus
aaaaacccagcagtttttcgatgag

SEQ ID NO: 495754 - DNA, 25 bp, Mus musculus
aaaaaccctgatcgacacatggatg

SEQ ID NO: 495755 - DNA, 25 bp, Mus musculus
aaaaaccctgatggacacatggatg

SEQ ID NO: 495756 - DNA, 25 bp, Mus musculus
aaaaacctctctatcaacatcactg

SEQ ID NO: 495757 - DNA, 25 bp, Mus musculus
aaaaacctctctttcaacatcactg

SEQ ID NO: 495758 - DNA, 25 bp, Mus musculus
aaaaacctctgcagtagacagtggg

SEQ ID NO: 495759 - DNA, 25 bp, Mus musculus
aaaaacctctgctgtagacagtggg

SEQ ID NO: 495760 - DNA, 25 bp, Mus musculus
aaaaacctttccctgagatacagcg

SEQ ID NO: 495761 - DNA, 25 bp, Mus musculus
aaaaacctttccgtgagatacagcg

SEQ ID NO: 495762 - DNA, 25 bp, Mus musculus
aaaaacggcctacctgtgttagccg

SEQ ID NO: 495763 - DNA, 25 bp, Mus musculus
aaaaacggcctagctgtgttagccg

SEQ ID NO: 495764 - DNA, 25 bp, Mus musculus
aaaaacgtctgaattccctgtgtgt

SEQ ID NO: 495765 - DNA, 25 bp, Mus musculus
aaaaacgtctgatttccctgtgtgt

SEQ ID NO: 495766 - DNA, 25 bp, Mus musculus
aaaaactcgactctatatggatgac

SEQ ID NO: 495767 - DNA, 25 bp, Mus musculus
aaaaactcgactgtatatggatgac

SEQ ID NO: 495768 - DNA, 25 bp, Mus musculus
aaaaactctctacttaatcatggaa

SEQ ID NO: 495769 - DNA, 25 bp, Mus musculus
aaaaactctctagttaatcatggaa

SEQ ID NO: 495770 - DNA, 25 bp, Mus musculus
aaaaactgcactccactgggccgct

SEQ ID NO: 495771 - DNA, 25 bp, Mus musculus
aaaaactgcactgcactgggccgct

SEQ ID NO: 495772 - DNA, 25 bp, Mus musculus
aaaaacttgcgccagagaaacacaa

SEQ ID NO: 495773 - DNA, 25 bp, Mus musculus
aaaaacttgcgcgagagaaacacaa

SEQ ID NO: 495774 - DNA, 25 bp, Mus musculus
aaaaagaatcgactggtgctggcca

SEQ ID NO: 495775 - DNA, 25 bp, Mus musculus
aaaaagaatcgagtggtgctggcca

SEQ ID NO: 495776 - DNA, 25 bp, Mus musculus
aaaaagacactaaggacgtatggtg

SEQ ID NO: 495777 - DNA, 25 bp, Mus musculus
aaaaagacactatggacgtatggtg

SEQ ID NO: 495778 - DNA, 25 bp, Mus musculus
aaaaagacgtggacgctgatgagga

SEQ ID NO: 495779 - DNA, 25 bp, Mus musculus
aaaaagacgtggtcgctgatgagga

SEQ ID NO: 495780 - DNA, 25 bp, Mus musculus
aaaaagagcaaaaggaacgagatgg

SEQ ID NO: 495781 - DNA, 25 bp, Mus musculus
aaaaagagcaaatggaacgagatgg

SEQ ID NO: 495782 - DNA, 25 bp, Mus musculus
aaaaagaggctgaatatcatcattg

SEQ ID NO: 495783 - DNA, 25 bp, Mus musculus
aaaaagaggctgtatatcatcattg

SEQ ID NO: 495784 - DNA, 25 bp, Mus musculus
aaaaagcacactcaggatgtgacca

SEQ ID NO: 495785 - DNA, 25 bp, Mus musculus
aaaaagcacactgaggatgtgacca

SEQ ID NO: 495786 - DNA, 25 bp, Mus musculus
aaaaagccaagaagcaggaaccaag

SEQ ID NO: 495787 - DNA, 25 bp, Mus musculus
aaaaagccaagatgcaggaaccaag

SEQ ID NO: 495788 - DNA, 25 bp, Mus musculus
aaaaagccagttctgtgacttggaa

SEQ ID NO: 495789 - DNA, 25 bp, Mus musculus
aaaaagccagttgtgtgacttggaa

SEQ ID NO: 495790 - DNA, 25 bp, Mus musculus
aaaaagcgagcaccgagcttctgtc

SEQ ID NO: 495791 - DNA, 25 bp, Mus musculus
aaaaagcgagcagcgagcttctgtc

SEQ ID NO: 495792 - DNA, 25 bp, Mus musculus
aaaaagctggtgatcaacggtggca

SEQ ID NO: 495793 - DNA, 25 bp, Mus musculus
aaaaagctggtgttcaacggtggca

SEQ ID NO: 495794 - DNA, 25 bp, Mus musculus
aaaaagctgtcacgctctgatcgga

SEQ ID NO: 495795 - DNA, 25 bp, Mus musculus
aaaaagctgtcaggctctgatcgga

SEQ ID NO: 495796 - DNA, 25 bp, Mus musculus
aaaaaggaagaaaagctgtaggctc

SEQ ID NO: 495797 - DNA, 25 bp, Mus musculus
aaaaaggaagaatagctgtaggctc

SEQ ID NO: 495798 - DNA, 25 bp, Mus musculus
aaaaaggagatgcagccgacacacc

SEQ ID NO: 495799 - DNA, 25 bp, Mus musculus
aaaaaggagatggagccgacacacc

SEQ ID NO: 495800 - DNA, 25 bp, Mus musculus
aaaaaggagccgcacttatctgaag

SEQ ID NO: 495801 - DNA, 25 bp, Mus musculus
aaaaaggagccggacttatctgaag

SEQ ID NO: 495802 - DNA, 25 bp, Mus musculus
aaaaaggatttcacttgtgcagacc

SEQ ID NO: 495803 - DNA, 25 bp, Mus musculus
aaaaaggatttctcttgtgcagacc

SEQ ID NO: 495804 - DNA, 25 bp, Mus musculus
aaaaaggccgttactctcctgccat

SEQ ID NO: 495805 - DNA, 25 bp, Mus musculus
aaaaaggccgtttctctcctgccat

SEQ ID NO: 495806 - DNA, 25 bp, Mus musculus
aaaaaggccttcagcgacttgccag

SEQ ID NO: 495807 - DNA, 25 bp, Mus musculus
aaaaaggccttctgcgacttgccag

SEQ ID NO: 495808 - DNA, 25 bp, Mus musculus
aaaaaggcgggcactattcagagct

SEQ ID NO: 495809 - DNA, 25 bp, Mus musculus
aaaaaggcgggctctattcagagct

SEQ ID NO: 495810 - DNA, 25 bp, Mus musculus
aaaaaggtccaacgagctgaatctc

SEQ ID NO: 495811 - DNA, 25 bp, Mus musculus
aaaaaggtccaaggagctgaatctc

SEQ ID NO: 495812 - DNA, 25 bp, Mus musculus
aaaaaggttgcacttatctgtccag

SEQ ID NO: 495813 - DNA, 25 bp, Mus musculus
aaaaaggttgcagttatctgtccag

SEQ ID NO: 495814 - DNA, 25 bp, Mus musculus
aaaaagtaaggcaggctagtggatc

SEQ ID NO: 495815 - DNA, 25 bp, Mus musculus
aaaaagtaaggctggctagtggatc

SEQ ID NO: 495816 - DNA, 25 bp, Mus musculus
aaaaagtaatgtcaacatccgttag

SEQ ID NO: 495817 - DNA, 25 bp, Mus musculus
aaaaagtaatgtgaacatccgttag

SEQ ID NO: 495818 - DNA, 25 bp, Mus musculus
aaaaagtcagagatggctcctgccc

SEQ ID NO: 495819 - DNA, 25 bp, Mus musculus
aaaaagtcagagttggctcctgccc

SEQ ID NO: 495820 - DNA, 25 bp, Mus musculus
aaaaagtcgccgagattcagggcca

SEQ ID NO: 495821 - DNA, 25 bp, Mus musculus
aaaaagtcgccgtgattcagggcca

SEQ ID NO: 495822 - DNA, 25 bp, Mus musculus
aaaaagtgacgacttgggactccag

SEQ ID NO: 495823 - DNA, 25 bp, Mus musculus
aaaaagtgacgagttgggactccag

SEQ ID NO: 495824 - DNA, 25 bp, Mus musculus
aaaaagtgactgacccgagtgttgc

SEQ ID NO: 495825 - DNA, 25 bp, Mus musculus
aaaaagtgactgtcccgagtgttgc

SEQ ID NO: 495826 - DNA, 25 bp, Mus musculus
aaaaagtgcactccctcaatacact

SEQ ID NO: 495827 - DNA, 25 bp, Mus musculus
aaaaagtgcactgcctcaatacact

SEQ ID NO: 495828 - DNA, 25 bp, Mus musculus
aaaaagtgccaaccttcccaaatgg

SEQ ID NO: 495829 - DNA, 25 bp, Mus musculus
aaaaagtgccaagcttcccaaatgg

SEQ ID NO: 495830 - DNA, 25 bp, Mus musculus
aaaaagtggctccaagagagattgg

SEQ ID NO: 495831 - DNA, 25 bp, Mus musculus
aaaaagtggctcgaagagagattgg

SEQ ID NO: 495832 - DNA, 25 bp, Mus musculus
aaaaagtggtcgaacggaccagatg

SEQ ID NO: 495833 - DNA, 25 bp, Mus musculus
aaaaagtggtcgtacggaccagatg

SEQ ID NO: 495834 - DNA, 25 bp, Mus musculus
aaaaagttccgacatgaggccaaga

SEQ ID NO: 495835 - DNA, 25 bp, Mus musculus
aaaaagttccgagatgaggccaaga

SEQ ID NO: 495836 - DNA, 25 bp, Mus musculus
aaaaagttgatgagagcctgactga

SEQ ID NO: 495837 - DNA, 25 bp, Mus musculus
aaaaagttgatgtgagcctgactga

SEQ ID NO: 495838 - DNA, 25 bp, Mus musculus
aaaaagttgggcctcagataggatc

SEQ ID NO: 495839 - DNA, 25 bp, Mus musculus
aaaaagttgggcgtcagataggatc

SEQ ID NO: 495840 - DNA, 25 bp, Mus musculus
aaaaataatctgcagccccaggtgg

SEQ ID NO: 495841 - DNA, 25 bp, Mus musculus
aaaaataatctggagccccaggtgg

SEQ ID NO: 495842 - DNA, 25 bp, Mus musculus
aaaaataatgatcttctcagacagc

SEQ ID NO: 495843 - DNA, 25 bp, Mus musculus
aaaaataatgatgttctcagacagc

SEQ ID NO: 495844 - DNA, 25 bp, Mus musculus
aaaaataatggacacattgagctcg

SEQ ID NO: 495845 - DNA, 25 bp, Mus musculus
aaaaataatggagacattgagctcg

SEQ ID NO: 495846 - DNA, 25 bp, Mus musculus
aaaaataccttcattaagtgcacag

SEQ ID NO: 495847 - DNA, 25 bp, Mus musculus
aaaaataccttctttaagtgcacag

SEQ ID NO: 495848 - DNA, 25 bp, Mus musculus
aaaaatactatgaaaatgcaagaga

SEQ ID NO: 495849 - DNA, 25 bp, Mus musculus
aaaaatactatgtaaatgcaagaga

SEQ ID NO: 495850 - DNA, 25 bp, Mus musculus
aaaaataggcttcaacacctggcaa

SEQ ID NO: 495851 - DNA, 25 bp, Mus musculus
aaaaataggcttgaacacctggcaa

SEQ ID NO: 495852 - DNA, 25 bp, Mus musculus
aaaaatatatatacccaagatgggc

SEQ ID NO: 495853 - DNA, 25 bp, Mus musculus
aaaaatatatattcccaagatgggc

SEQ ID NO: 495854 - DNA, 25 bp, Mus musculus
aaaaatatcttgaaaggcctggaag

SEQ ID NO: 495855 - DNA, 25 bp, Mus musculus
aaaaatatcttgtaaggcctggaag

SEQ ID NO: 495856 - DNA, 25 bp, Mus musculus
aaaaatatggtgcagaagtgattcc

SEQ ID NO: 495857 - DNA, 25 bp, Mus musculus
aaaaatatggtggagaagtgattcc

SEQ ID NO: 495858 - DNA, 25 bp, Mus musculus
aaaaatattacacctttgggtccag

SEQ ID NO: 495859 - DNA, 25 bp, Mus musculus
aaaaatattacagctttgggtccag

SEQ ID NO: 495860 - DNA, 25 bp, Mus musculus
aaaaatcaaatgactctgcctttgg

SEQ ID NO: 495861 - DNA, 25 bp, Mus musculus
aaaaatcaaatgtctctgcctttgg

SEQ ID NO: 495862 - DNA, 25 bp, Mus musculus
aaaaatccagatcttcaggttcatc

SEQ ID NO: 495863 - DNA, 25 bp, Mus musculus
aaaaatccagatgttcaggttcatc

SEQ ID NO: 495864 - DNA, 25 bp, Mus musculus
aaaaatcgagcgcaggtatcccagc

SEQ ID NO: 495865 - DNA, 25 bp, Mus musculus
aaaaatcgagcggaggtatcccagc

SEQ ID NO: 495866 - DNA, 25 bp, Mus musculus
aaaaatctaagaactcctgattgag

SEQ ID NO: 495867 - DNA, 25 bp, Mus musculus
aaaaatctaagatctcctgattgag

SEQ ID NO: 495868 - DNA, 25 bp, Mus musculus
aaaaatctaagcacttggtcccaca

SEQ ID NO: 495869 - DNA, 25 bp, Mus musculus
aaaaatctaagctcttggtcccaca

SEQ ID NO: 495870 - DNA, 25 bp, Mus musculus
aaaaatctccggagtttctctgcgc

SEQ ID NO: 495871 - DNA, 25 bp, Mus musculus
aaaaatctccggtgtttctctgcgc

SEQ ID NO: 495872 - DNA, 25 bp, Mus musculus
aaaaatctgatgcaagatggcctcc

SEQ ID NO: 495873 - DNA, 25 bp, Mus musculus
aaaaatctgatggaagatggcctcc

SEQ ID NO: 495874 - DNA, 25 bp, Mus musculus
aaaaatctgtctcctgaggaaaagc

SEQ ID NO: 495875 - DNA, 25 bp, Mus musculus
aaaaatctgtctgctgaggaaaagc

SEQ ID NO: 495876 - DNA, 25 bp, Mus musculus
aaaaatctttgcagacctgatagtc

SEQ ID NO: 495877 - DNA, 25 bp, Mus musculus
aaaaatctttgctgacctgatagtc

SEQ ID NO: 495878 - DNA, 25 bp, Mus musculus
aaaaatgacattactgcatggcaag

SEQ ID NO: 495879 - DNA, 25 bp, Mus musculus
aaaaatgacatttctgcatggcaag

SEQ ID NO: 495880 - DNA, 25 bp, Mus musculus
aaaaatgactgcattggaggccaaa

SEQ ID NO: 495881 - DNA, 25 bp, Mus musculus
aaaaatgactgctttggaggccaaa

SEQ ID NO: 495882 - DNA, 25 bp, Mus musculus
aaaaatgatcttcctgttgtggatg

SEQ ID NO: 495883 - DNA, 25 bp, Mus musculus
aaaaatgatcttgctgttgtggatg

SEQ ID NO: 495884 - DNA, 25 bp, Mus musculus
aaaaatgcagatcagctagtcaaac

SEQ ID NO: 495885 - DNA, 25 bp, Mus musculus
aaaaatgcagatgagctagtcaaac

SEQ ID NO: 495886 - DNA, 25 bp, Mus musculus
aaaaatgccagaacatccataagtc

SEQ ID NO: 495887 - DNA, 25 bp, Mus musculus
aaaaatgccagatcatccataagtc

SEQ ID NO: 495888 - DNA, 25 bp, Mus musculus
aaaaatggaccgcattactgacttt

SEQ ID NO: 495889 - DNA, 25 bp, Mus musculus
aaaaatggaccggattactgacttt

SEQ ID NO: 495890 - DNA, 25 bp, Mus musculus
aaaaatggcaaacatgaggctcccc

SEQ ID NO: 495891 - DNA, 25 bp, Mus musculus
aaaaatggcaaagatgaggctcccc

SEQ ID NO: 495892 - DNA, 25 bp, Mus musculus
aaaaatggcatcaggacaaggacca

SEQ ID NO: 495893 - DNA, 25 bp, Mus musculus
aaaaatggcatctggacaaggacca

SEQ ID NO: 495894 - DNA, 25 bp, Mus musculus
aaaaatggccacctcgaatccagtg

SEQ ID NO: 495895 - DNA, 25 bp, Mus musculus
aaaaatggccacgtcgaatccagtg

SEQ ID NO: 495896 - DNA, 25 bp, Mus musculus
aaaaatggcccaataccatgacaac

SEQ ID NO: 495897 - DNA, 25 bp, Mus musculus
aaaaatggcccattaccatgacaac

SEQ ID NO: 495898 - DNA, 25 bp, Mus musculus
aaaaatggctacaaactttctagcg

SEQ ID NO: 495899 - DNA, 25 bp, Mus musculus
aaaaatggctactaactttctagcg

SEQ ID NO: 495900 - DNA, 25 bp, Mus musculus
aaaaatgggctaagtcctctcctgc

SEQ ID NO: 495901 - DNA, 25 bp, Mus musculus
aaaaatgggctatgtcctctcctgc

SEQ ID NO: 495902 - DNA, 25 bp, Mus musculus
aaaaatggtttgacactgattgagc

SEQ ID NO: 495903 - DNA, 25 bp, Mus musculus
aaaaatggtttgtcactgattgagc

SEQ ID NO: 495904 - DNA, 25 bp, Mus musculus
aaaaatgtgaagcagcacgctgatc

SEQ ID NO: 495905 - DNA, 25 bp, Mus musculus
aaaaatgtgaaggagcacgctgatc

SEQ ID NO: 495906 - DNA, 25 bp, Mus musculus
aaaaatgtgtctccaaaggctatgt

SEQ ID NO: 495907 - DNA, 25 bp, Mus musculus
aaaaatgtgtctgcaaaggctatgt

SEQ ID NO: 495908 - DNA, 25 bp, Mus musculus
aaaaatgttcgtaggtggtctgagc

SEQ ID NO: 495909 - DNA, 25 bp, Mus musculus
aaaaatgttcgttggtggtctgagc

SEQ ID NO: 495910 - DNA, 25 bp, Mus musculus
aaaaattatttgcactggagcaaca

SEQ ID NO: 495911 - DNA, 25 bp, Mus musculus
aaaaattatttggactggagcaaca

SEQ ID NO: 495912 - DNA, 25 bp, Mus musculus
aaaaattgcttgaaccactggaggc

SEQ ID NO: 495913 - DNA, 25 bp, Mus musculus
aaaaattgcttgtaccactggaggc

SEQ ID NO: 495914 - DNA, 25 bp, Mus musculus
aaaaattgctttcatcctagacgca

SEQ ID NO: 495915 - DNA, 25 bp, Mus musculus
aaaaattgctttgatcctagacgca

SEQ ID NO: 495916 - DNA, 25 bp, Mus musculus
aaaaatttgtagagctttagatggg

SEQ ID NO: 495917 - DNA, 25 bp, Mus musculus
aaaaatttgtagtgctttagatggg

SEQ ID NO: 495918 - DNA, 25 bp, Mus musculus
aaaacaaaaatgaagggcaggatgc

SEQ ID NO: 495919 - DNA, 25 bp, Mus musculus
aaaacaaaaatgtagggcaggatgc

SEQ ID NO: 495920 - DNA, 25 bp, Mus musculus
aaaacaaaactactgacctcaggca

SEQ ID NO: 495921 - DNA, 25 bp, Mus musculus
aaaacaaaactagtgacctcaggca

SEQ ID NO: 495922 - DNA, 25 bp, Mus musculus
aaaacaaaatcccaagcacgctgaa

SEQ ID NO: 495923 - DNA, 25 bp, Mus musculus
aaaacaaaatccgaagcacgctgaa

SEQ ID NO: 495924 - DNA, 25 bp, Mus musculus
aaaacaaatacacaagcccaggctc

SEQ ID NO: 495925 - DNA, 25 bp, Mus musculus
aaaacaaatacagaagcccaggctc

SEQ ID NO: 495926 - DNA, 25 bp, Mus musculus
aaaacaacagctatggccaagaccg

SEQ ID NO: 495927 - DNA, 25 bp, Mus musculus
aaaacaacagctttggccaagaccg

SEQ ID NO: 495928 - DNA, 25 bp, Mus musculus
aaaacaacatccagaaggagagggc

SEQ ID NO: 495929 - DNA, 25 bp, Mus musculus
aaaacaacatcctgaaggagagggc

SEQ ID NO: 495930 - DNA, 25 bp, Mus musculus
aaaacaaccactccgctggagaagg

SEQ ID NO: 495931 - DNA, 25 bp, Mus musculus
aaaacaaccactgcgctggagaagg

SEQ ID NO: 495932 - DNA, 25 bp, Mus musculus
aaaacaactgccctggagattgact

SEQ ID NO: 495933 - DNA, 25 bp, Mus musculus
aaaacaactgccgtggagattgact

SEQ ID NO: 495934 - DNA, 25 bp, Mus musculus
aaaacaagatggctgaattcaccaa

SEQ ID NO: 495935 - DNA, 25 bp, Mus musculus
aaaacaagatgggtgaattcaccaa

SEQ ID NO: 495936 - DNA, 25 bp, Mus musculus
aaaacaagcgcgattaccacaagca

SEQ ID NO: 495937 - DNA, 25 bp, Mus musculus
aaaacaagcgcgtttaccacaagca

SEQ ID NO: 495938 - DNA, 25 bp, Mus musculus
aaaacaaggaagaagacatgactgg

SEQ ID NO: 495939 - DNA, 25 bp, Mus musculus
aaaacaaggaagtagacatgactgg

SEQ ID NO: 495940 - DNA, 25 bp, Mus musculus
aaaacaagttgaagatcgaaaggaa

SEQ ID NO: 495941 - DNA, 25 bp, Mus musculus
aaaacaagttgatgatcgaaaggaa

SEQ ID NO: 495942 - DNA, 25 bp, Mus musculus
aaaacaatgatccttcatgatgatg

SEQ ID NO: 495943 - DNA, 25 bp, Mus musculus
aaaacaatgatcgttcatgatgatg

SEQ ID NO: 495944 - DNA, 25 bp, Mus musculus
aaaacaatgtgacgcctgatggaga

SEQ ID NO: 495945 - DNA, 25 bp, Mus musculus
aaaacaatgtgaggcctgatggaga

SEQ ID NO: 495946 - DNA, 25 bp, Mus musculus
aaaacacaaatacaacaagtcaggg

SEQ ID NO: 495947 - DNA, 25 bp, Mus musculus
aaaacacaaatagaacaagtcaggg

SEQ ID NO: 495948 - DNA, 25 bp, Mus musculus
aaaacacatgaacaatcagttgaag

SEQ ID NO: 495949 - DNA, 25 bp, Mus musculus
aaaacacatgaagaatcagttgaag

SEQ ID NO: 495950 - DNA, 25 bp, Mus musculus
aaaacaccaactcagattagggaag

SEQ ID NO: 495951 - DNA, 25 bp, Mus musculus
aaaacaccaactgagattagggaag

SEQ ID NO: 495952 - DNA, 25 bp, Mus musculus
aaaacacccgtaatcgccactgtga

SEQ ID NO: 495953 - DNA, 25 bp, Mus musculus
aaaacacccgtattcgccactgtga

SEQ ID NO: 495954 - DNA, 25 bp, Mus musculus
aaaacacctgtccacggtgggcctg

SEQ ID NO: 495955 - DNA, 25 bp, Mus musculus
aaaacacctgtcgacggtgggcctg

SEQ ID NO: 495956 - DNA, 25 bp, Mus musculus
aaaacacggcatcttaacatcctgc

SEQ ID NO: 495957 - DNA, 25 bp, Mus musculus
aaaacacggcatgttaacatcctgc

SEQ ID NO: 495958 - DNA, 25 bp, Mus musculus
aaaacactcccgagaaccatccaga

SEQ ID NO: 495959 - DNA, 25 bp, Mus musculus
aaaacactcccgtgaaccatccaga

SEQ ID NO: 495960 - DNA, 25 bp, Mus musculus
aaaacagaaatgatcttgttgggag

SEQ ID NO: 495961 - DNA, 25 bp, Mus musculus
aaaacagaaatgttcttgttgggag

SEQ ID NO: 495962 - DNA, 25 bp, Mus musculus
aaaacagaccgacacaagagccaga

SEQ ID NO: 495963 - DNA, 25 bp, Mus musculus
aaaacagaccgagacaagagccaga

SEQ ID NO: 495964 - DNA, 25 bp, Mus musculus
aaaacagccaacaacaatgtggtgc

SEQ ID NO: 495965 - DNA, 25 bp, Mus musculus
aaaacagccaactacaatgtggtgc

SEQ ID NO: 495966 - DNA, 25 bp, Mus musculus
aaaacagcccacactttcgagcagg

SEQ ID NO: 495967 - DNA, 25 bp, Mus musculus
aaaacagcccactctttcgagcagg

SEQ ID NO: 495968 - DNA, 25 bp, Mus musculus
aaaacagcgcctcgcttgggaaggc

SEQ ID NO: 495969 - DNA, 25 bp, Mus musculus
aaaacagcgcctggcttgggaaggc

SEQ ID NO: 495970 - DNA, 25 bp, Mus musculus
aaaacagcgggcacaagtggcattt

SEQ ID NO: 495971 - DNA, 25 bp, Mus musculus
aaaacagcgggctcaagtggcattt

SEQ ID NO: 495972 - DNA, 25 bp, Mus musculus
aaaacagctacaacacgagaagcgg

SEQ ID NO: 495973 - DNA, 25 bp, Mus musculus
aaaacagctacatcacgagaagcgg

SEQ ID NO: 495974 - DNA, 25 bp, Mus musculus
aaaacagctgttaaggctggaggtc

SEQ ID NO: 495975 - DNA, 25 bp, Mus musculus
aaaacagctgtttaggctggaggtc

SEQ ID NO: 495976 - DNA, 25 bp, Mus musculus
aaaacagcttcgctggtgagcctct

SEQ ID NO: 495977 - DNA, 25 bp, Mus musculus
aaaacagcttcggtggtgagcctct

SEQ ID NO: 495978 - DNA, 25 bp, Mus musculus
aaaacaggctcaaggtgacttccag

SEQ ID NO: 495979 - DNA, 25 bp, Mus musculus
aaaacaggctcatggtgacttccag

SEQ ID NO: 495980 - DNA, 25 bp, Mus musculus
aaaacaggctttcaaagaactgcta

SEQ ID NO: 495981 - DNA, 25 bp, Mus musculus
aaaacaggctttgaaagaactgcta

SEQ ID NO: 495982 - DNA, 25 bp, Mus musculus
aaaacagtctgccaccctttgtggc

SEQ ID NO: 495983 - DNA, 25 bp, Mus musculus
aaaacagtctgcgaccctttgtggc

SEQ ID NO: 495984 - DNA, 25 bp, Mus musculus
aaaacagtgaagacttttctggctg

SEQ ID NO: 495985 - DNA, 25 bp, Mus musculus
aaaacagtgaagtcttttctggctg

SEQ ID NO: 495986 - DNA, 25 bp, Mus musculus
aaaacagttacactcaatgacaaac

SEQ ID NO: 495987 - DNA, 25 bp, Mus musculus
aaaacagttacagtcaatgacaaac

SEQ ID NO: 495988 - DNA, 25 bp, Mus musculus
aaaacagttacccatggatctgcct

SEQ ID NO: 495989 - DNA, 25 bp, Mus musculus
aaaacagttaccgatggatctgcct

SEQ ID NO: 495990 - DNA, 25 bp, Mus musculus
aaaacagttgtgagtcagggtacca

SEQ ID NO: 495991 - DNA, 25 bp, Mus musculus
aaaacagttgtgtgtcagggtacca

SEQ ID NO: 495992 - DNA, 25 bp, Mus musculus
aaaacatacctgcttccagataccc

SEQ ID NO: 495993 - DNA, 25 bp, Mus musculus
aaaacatacctggttccagataccc

SEQ ID NO: 495994 - DNA, 25 bp, Mus musculus
aaaacatagtcaacctctgcccctg

SEQ ID NO: 495995 - DNA, 25 bp, Mus musculus
aaaacatagtcatcctctgcccctg

SEQ ID NO: 495996 - DNA, 25 bp, Mus musculus
aaaacatcatccagaaacttccttg

SEQ ID NO: 495997 - DNA, 25 bp, Mus musculus
aaaacatcatcctgaaacttccttg

SEQ ID NO: 495998 - DNA, 25 bp, Mus musculus
aaaacatccaaaatgtcttccgaag

SEQ ID NO: 495999 - DNA, 25 bp, Mus musculus
aaaacatccaaattgtcttccgaag

SEQ ID NO: 496000 - DNA, 25 bp, Mus musculus
aaaacatccctacagtgggcttggg

SEQ ID NO: 496001 - DNA, 25 bp, Mus musculus
aaaacatccctagagtgggcttggg

SEQ ID NO: 496002 - DNA, 25 bp, Mus musculus
aaaacatcggaccagtgtgggacca

SEQ ID NO: 496003 - DNA, 25 bp, Mus musculus
aaaacatcggacgagtgtgggacca

SEQ ID NO: 496004 - DNA, 25 bp, Mus musculus
aaaacatcgtgccacctcagctcag

SEQ ID NO: 496005 - DNA, 25 bp, Mus musculus
aaaacatcgtgcgacctcagctcag

SEQ ID NO: 496006 - DNA, 25 bp, Mus musculus
aaaacatcttcaatttcggtgatcc

SEQ ID NO: 496007 - DNA, 25 bp, Mus musculus
aaaacatcttcattttcggtgatcc

SEQ ID NO: 496008 - DNA, 25 bp, Mus musculus
aaaacatgaccgctgagcccatgag

SEQ ID NO: 496009 - DNA, 25 bp, Mus musculus
aaaacatgaccggtgagcccatgag

SEQ ID NO: 496010 - DNA, 25 bp, Mus musculus
aaaacatggcatccacatgcagcac

SEQ ID NO: 496011 - DNA, 25 bp, Mus musculus
aaaacatggcatgcacatgcagcac

SEQ ID NO: 496012 - DNA, 25 bp, Mus musculus
aaaacatggctcacctctcgcagct

SEQ ID NO: 496013 - DNA, 25 bp, Mus musculus
aaaacatggctctcctctcgcagct

SEQ ID NO: 496014 - DNA, 25 bp, Mus musculus
aaaacatgtcatctgcacttgctta

SEQ ID NO: 496015 - DNA, 25 bp, Mus musculus
aaaacatgtcatgtgcacttgctta

SEQ ID NO: 496016 - DNA, 25 bp, Mus musculus
aaaacattacgacgattcttgcatt

SEQ ID NO: 496017 - DNA, 25 bp, Mus musculus
aaaacattacgaggattcttgcatt

SEQ ID NO: 496018 - DNA, 25 bp, Mus musculus
aaaacattaggacggtatatcattg

SEQ ID NO: 496019 - DNA, 25 bp, Mus musculus
aaaacattaggagggtatatcattg

SEQ ID NO: 496020 - DNA, 25 bp, Mus musculus
aaaacattataaacgactgctcagg

SEQ ID NO: 496021 - DNA, 25 bp, Mus musculus
aaaacattataatcgactgctcagg

SEQ ID NO: 496022 - DNA, 25 bp, Mus musculus
aaaacattcactctttggagaagtg

SEQ ID NO: 496023 - DNA, 25 bp, Mus musculus
aaaacattcactgtttggagaagtg

SEQ ID NO: 496024 - DNA, 25 bp, Mus musculus
aaaacattttgcagctgattacctc

SEQ ID NO: 496025 - DNA, 25 bp, Mus musculus
aaaacattttgctgctgattacctc

SEQ ID NO: 496026 - DNA, 25 bp, Mus musculus
aaaaccaaagccagcagacacggct

SEQ ID NO: 496027 - DNA, 25 bp, Mus musculus
aaaaccaaagcctgcagacacggct

SEQ ID NO: 496028 - DNA, 25 bp, Mus musculus
aaaaccaacactagcaatcatcggc

SEQ ID NO: 496029 - DNA, 25 bp, Mus musculus
aaaaccaacacttgcaatcatcggc

SEQ ID NO: 496030 - DNA, 25 bp, Mus musculus
aaaaccaagaacacattctcgggat

SEQ ID NO: 496031 - DNA, 25 bp, Mus musculus
aaaaccaagaactcattctcgggat

SEQ ID NO: 496032 - DNA, 25 bp, Mus musculus
aaaaccaccatcaaagctgaaccag

SEQ ID NO: 496033 - DNA, 25 bp, Mus musculus
aaaaccaccatctaagctgaaccag

SEQ ID NO: 496034 - DNA, 25 bp, Mus musculus
aaaaccactctgagcgcgcgtggga

SEQ ID NO: 496035 - DNA, 25 bp, Mus musculus
aaaaccactctgtgcgcgcgtggga

SEQ ID NO: 496036 - DNA, 25 bp, Mus musculus
aaaaccagatccacacccgagatgc

SEQ ID NO: 496037 - DNA, 25 bp, Mus musculus
aaaaccagatcctcacccgagatgc

SEQ ID NO: 496038 - DNA, 25 bp, Mus musculus
aaaaccagctatatctttgcatcca

SEQ ID NO: 496039 - DNA, 25 bp, Mus musculus
aaaaccagctatttctttgcatcca

SEQ ID NO: 496040 - DNA, 25 bp, Mus musculus
aaaaccaggcacactgctgaatcag

SEQ ID NO: 496041 - DNA, 25 bp, Mus musculus
aaaaccaggcactctgctgaatcag

SEQ ID NO: 496042 - DNA, 25 bp, Mus musculus
aaaaccagtatacaattgttagaat

SEQ ID NO: 496043 - DNA, 25 bp, Mus musculus
aaaaccagtatagaattgttagaat

SEQ ID NO: 496044 - DNA, 25 bp, Mus musculus
aaaaccatcgatcctcatggcctga

SEQ ID NO: 496045 - DNA, 25 bp, Mus musculus
aaaaccatcgatgctcatggcctga

SEQ ID NO: 496046 - DNA, 25 bp, Mus musculus
aaaaccatgagaatgttccctgcag

SEQ ID NO: 496047 - DNA, 25 bp, Mus musculus
aaaaccatgagattgttccctgcag

SEQ ID NO: 496048 - DNA, 25 bp, Mus musculus
aaaaccattcagatggtgcggtccc

SEQ ID NO: 496049 - DNA, 25 bp, Mus musculus
aaaaccattcagttggtgcggtccc

SEQ ID NO: 496050 - DNA, 25 bp, Mus musculus
aaaacccaagcaactgctgccatgg

SEQ ID NO: 496051 - DNA, 25 bp, Mus musculus
aaaacccaagcatctgctgccatgg

SEQ ID NO: 496052 - DNA, 25 bp, Mus musculus
aaaacccgcggaccctgactctgaa

SEQ ID NO: 496053 - DNA, 25 bp, Mus musculus
aaaacccgcggagcctgactctgaa

SEQ ID NO: 496054 - DNA, 25 bp, Mus musculus
aaaacccgtgcgcttgacgcatttg

SEQ ID NO: 496055 - DNA, 25 bp, Mus musculus
aaaacccgtgcggttgacgcatttg

SEQ ID NO: 496056 - DNA, 25 bp, Mus musculus
aaaaccctacgacataaacctgatg

SEQ ID NO: 496057 - DNA, 25 bp, Mus musculus
aaaaccctacgagataaacctgatg

SEQ ID NO: 496058 - DNA, 25 bp, Mus musculus
aaaacccttgcacaacacaaggagc

SEQ ID NO: 496059 - DNA, 25 bp, Mus musculus
aaaacccttgcagaacacaaggagc

SEQ ID NO: 496060 - DNA, 25 bp, Mus musculus
aaaaccgcctgtcgaagctgctgtc

SEQ ID NO: 496061 - DNA, 25 bp, Mus musculus
aaaaccgcctgtggaagctgctgtc

SEQ ID NO: 496062 - DNA, 25 bp, Mus musculus
aaaaccgcgggtccgcagttgcgaa

SEQ ID NO: 496063 - DNA, 25 bp, Mus musculus
aaaaccgcgggtgcgcagttgcgaa

SEQ ID NO: 496064 - DNA, 25 bp, Mus musculus
aaaaccgctacaacatcatgcggag

SEQ ID NO: 496065 - DNA, 25 bp, Mus musculus
aaaaccgctacatcatcatgcggag

SEQ ID NO: 496066 - DNA, 25 bp, Mus musculus
aaaaccgtcgggatgtagaggcctg

SEQ ID NO: 496067 - DNA, 25 bp, Mus musculus
aaaaccgtcgggttgtagaggcctg

SEQ ID NO: 496068 - DNA, 25 bp, Mus musculus
aaaaccgtgctcagcgcaggcagct

SEQ ID NO: 496069 - DNA, 25 bp, Mus musculus
aaaaccgtgctctgcgcaggcagct

SEQ ID NO: 496070 - DNA, 25 bp, Mus musculus
aaaacctcagctccagtcaagaaag

SEQ ID NO: 496071 - DNA, 25 bp, Mus musculus
aaaacctcagctgcagtcaagaaag

SEQ ID NO: 496072 - DNA, 25 bp, Mus musculus
aaaacctcatttcgctcactgaagg

SEQ ID NO: 496073 - DNA, 25 bp, Mus musculus
aaaacctcatttggctcactgaagg

SEQ ID NO: 496074 - DNA, 25 bp, Mus musculus
aaaacctctcttacaacatcactga

SEQ ID NO: 496075 - DNA, 25 bp, Mus musculus
aaaacctctctttcaacatcactga

SEQ ID NO: 496076 - DNA, 25 bp, Mus musculus
aaaaccttcactctgagcagctcag

SEQ ID NO: 496077 - DNA, 25 bp, Mus musculus
aaaaccttcactgtgagcagctcag

SEQ ID NO: 496078 - DNA, 25 bp, Mus musculus
aaaaccttccatcacctagttagag

SEQ ID NO: 496079 - DNA, 25 bp, Mus musculus
aaaaccttccatgacctagttagag

SEQ ID NO: 496080 - DNA, 25 bp, Mus musculus
aaaaccttctccctgtgtgagatca

SEQ ID NO: 496081 - DNA, 25 bp, Mus musculus
aaaaccttctccgtgtgtgagatca

SEQ ID NO: 496082 - DNA, 25 bp, Mus musculus
aaaaccttgctgcaacttgtgattg

SEQ ID NO: 496083 - DNA, 25 bp, Mus musculus
aaaaccttgctggaacttgtgattg

SEQ ID NO: 496084 - DNA, 25 bp, Mus musculus
aaaaccttgtacagatcgtgtataa

SEQ ID NO: 496085 - DNA, 25 bp, Mus musculus
aaaaccttgtactgatcgtgtataa

SEQ ID NO: 496086 - DNA, 25 bp, Mus musculus
aaaacgaactggctctctccacaga

SEQ ID NO: 496087 - DNA, 25 bp, Mus musculus
aaaacgaactgggtctctccacaga

SEQ ID NO: 496088 - DNA, 25 bp, Mus musculus
aaaacgaagagaaggccacgaagga

SEQ ID NO: 496089 - DNA, 25 bp, Mus musculus
aaaacgaagagatggccacgaagga

SEQ ID NO: 496090 - DNA, 25 bp, Mus musculus
aaaacgaggcatatgagccttggag

SEQ ID NO: 496091 - DNA, 25 bp, Mus musculus
aaaacgaggcatttgagccttggag

SEQ ID NO: 496092 - DNA, 25 bp, Mus musculus
aaaacgagtatgaccggctgacctg

SEQ ID NO: 496093 - DNA, 25 bp, Mus musculus
aaaacgagtatgtccggctgacctg

SEQ ID NO: 496094 - DNA, 25 bp, Mus musculus
aaaacgcaatggcactagctccagt

SEQ ID NO: 496095 - DNA, 25 bp, Mus musculus
aaaacgcaatgggactagctccagt

SEQ ID NO: 496096 - DNA, 25 bp, Mus musculus
aaaacgcctccaccgggaggctctg

SEQ ID NO: 496097 - DNA, 25 bp, Mus musculus
aaaacgcctccagcgggaggctctg

SEQ ID NO: 496098 - DNA, 25 bp, Mus musculus
aaaacgcgaggtcccgacaagcgca

SEQ ID NO: 496099 - DNA, 25 bp, Mus musculus
aaaacgcgaggtgccgacaagcgca

SEQ ID NO: 496100 - DNA, 25 bp, Mus musculus
aaaacgcgctaacccggcggagcat

SEQ ID NO: 496101 - DNA, 25 bp, Mus musculus
aaaacgcgctaagccggcggagcat

SEQ ID NO: 496102 - DNA, 25 bp, Mus musculus
aaaacggaggcaaatatgaaggagt

SEQ ID NO: 496103 - DNA, 25 bp, Mus musculus
aaaacggaggcatatatgaaggagt

SEQ ID NO: 496104 - DNA, 25 bp, Mus musculus
aaaacggataatcgtgactttgcct

SEQ ID NO: 496105 - DNA, 25 bp, Mus musculus
aaaacggataatggtgactttgcct

SEQ ID NO: 496106 - DNA, 25 bp, Mus musculus
aaaacggtctcacaggatggtcatc

SEQ ID NO: 496107 - DNA, 25 bp, Mus musculus
aaaacggtctcagaggatggtcatc

SEQ ID NO: 496108 - DNA, 25 bp, Mus musculus
aaaacggttctaactgaaggaagtg

SEQ ID NO: 496109 - DNA, 25 bp, Mus musculus
aaaacggttctatctgaaggaagtg

SEQ ID NO: 496110 - DNA, 25 bp, Mus musculus
aaaacgtatctaaggaggacaatga

SEQ ID NO: 496111 - DNA, 25 bp, Mus musculus
aaaacgtatctatggaggacaatga

SEQ ID NO: 496112 - DNA, 25 bp, Mus musculus
aaaacgtattgcagagagggaacgt

SEQ ID NO: 496113 - DNA, 25 bp, Mus musculus
aaaacgtattgctgagagggaacgt

SEQ ID NO: 496114 - DNA, 25 bp, Mus musculus
aaaacgtcgtctcctgctattcaaa

SEQ ID NO: 496115 - DNA, 25 bp, Mus musculus
aaaacgtcgtctgctgctattcaaa

SEQ ID NO: 496116 - DNA, 25 bp, Mus musculus
aaaacgtctgcgatgtctgcactga

SEQ ID NO: 496117 - DNA, 25 bp, Mus musculus
aaaacgtctgcgttgtctgcactga

SEQ ID NO: 496118 - DNA, 25 bp, Mus musculus
aaaacgtgctcaaattctctatgag

SEQ ID NO: 496119 - DNA, 25 bp, Mus musculus
aaaacgtgctcatattctctatgag

SEQ ID NO: 496120 - DNA, 25 bp, Mus musculus
aaaactaaggcacactctggacgca

SEQ ID NO: 496121 - DNA, 25 bp, Mus musculus
aaaactaaggcagactctggacgca

SEQ ID NO: 496122 - DNA, 25 bp, Mus musculus
aaaactaccacccaaagatcaggat

SEQ ID NO: 496123 - DNA, 25 bp, Mus musculus
aaaactaccaccgaaagatcaggat

SEQ ID NO: 496124 - DNA, 25 bp, Mus musculus
aaaactactctgaagacttgccgcg

SEQ ID NO: 496125 - DNA, 25 bp, Mus musculus
aaaactactctgtagacttgccgcg

SEQ ID NO: 496126 - DNA, 25 bp, Mus musculus
aaaactcacagacttggctgtgggc

SEQ ID NO: 496127 - DNA, 25 bp, Mus musculus
aaaactcacagagttggctgtgggc

SEQ ID NO: 496128 - DNA, 25 bp, Mus musculus
aaaactcaggctctggagtggagac

SEQ ID NO: 496129 - DNA, 25 bp, Mus musculus
aaaactcaggctgtggagtggagac

SEQ ID NO: 496130 - DNA, 25 bp, Mus musculus
aaaactccgccacatctggaacctg

SEQ ID NO: 496131 - DNA, 25 bp, Mus musculus
aaaactccgccagatctggaacctg

SEQ ID NO: 496132 - DNA, 25 bp, Mus musculus
aaaactcgggatcacctggcaaggt

SEQ ID NO: 496133 - DNA, 25 bp, Mus musculus
aaaactcgggatgacctggcaaggt

SEQ ID NO: 496134 - DNA, 25 bp, Mus musculus
aaaactcgtgaacggaatgtgcgtg

SEQ ID NO: 496135 - DNA, 25 bp, Mus musculus
aaaactcgtgaagggaatgtgcgtg

SEQ ID NO: 496136 - DNA, 25 bp, Mus musculus
aaaactctgagtctgcttggatccc

SEQ ID NO: 496137 - DNA, 25 bp, Mus musculus
aaaactctgagtgtgcttggatccc

SEQ ID NO: 496138 - DNA, 25 bp, Mus musculus
aaaactcttatcattaccagtcagg

SEQ ID NO: 496139 - DNA, 25 bp, Mus musculus
aaaactcttatctttaccagtcagg

SEQ ID NO: 496140 - DNA, 25 bp, Mus musculus
aaaactcttcgtaatgggaagatca

SEQ ID NO: 496141 - DNA, 25 bp, Mus musculus
aaaactcttcgttatgggaagatca

SEQ ID NO: 496142 - DNA, 25 bp, Mus musculus
aaaactgaaaatcacatgactgtct

SEQ ID NO: 496143 - DNA, 25 bp, Mus musculus
aaaactgaaaatgacatgactgtct

SEQ ID NO: 496144 - DNA, 25 bp, Mus musculus
aaaactgaacagcaccactcacttg

SEQ ID NO: 496145 - DNA, 25 bp, Mus musculus
aaaactgaacaggaccactcacttg

SEQ ID NO: 496146 - DNA, 25 bp, Mus musculus
aaaactgaccccaaagagctttgca

SEQ ID NO: 496147 - DNA, 25 bp, Mus musculus
aaaactgacccctaagagctttgca

SEQ ID NO: 496148 - DNA, 25 bp, Mus musculus
aaaactgcaattatggagcaactcc

SEQ ID NO: 496149 - DNA, 25 bp, Mus musculus
aaaactgcaattttggagcaactcc

SEQ ID NO: 496150 - DNA, 25 bp, Mus musculus
aaaactgcactaccgatggatggtc

SEQ ID NO: 496151 - DNA, 25 bp, Mus musculus
aaaactgcactagcgatggatggtc

SEQ ID NO: 496152 - DNA, 25 bp, Mus musculus
aaaactgccaccagattgagggcct

SEQ ID NO: 496153 - DNA, 25 bp, Mus musculus
aaaactgccacctgattgagggcct

SEQ ID NO: 496154 - DNA, 25 bp, Mus musculus
aaaactgcctgcagcccgacgacaa

SEQ ID NO: 496155 - DNA, 25 bp, Mus musculus
aaaactgcctgctgcccgacgacaa

SEQ ID NO: 496156 - DNA, 25 bp, Mus musculus
aaaactggacacctcatagatgatg

SEQ ID NO: 496157 - DNA, 25 bp, Mus musculus
aaaactggacacgtcatagatgatg

SEQ ID NO: 496158 - DNA, 25 bp, Mus musculus
aaaactggataaaatggaagaatcg

SEQ ID NO: 496159 - DNA, 25 bp, Mus musculus
aaaactggataatatggaagaatcg

SEQ ID NO: 496160 - DNA, 25 bp, Mus musculus
aaaactggatttatgccctatcacg

SEQ ID NO: 496161 - DNA, 25 bp, Mus musculus
aaaactggatttttgccctatcacg

SEQ ID NO: 496162 - DNA, 25 bp, Mus musculus
aaaactggtcagaaggcagagccgg

SEQ ID NO: 496163 - DNA, 25 bp, Mus musculus
aaaactggtcagtaggcagagccgg

SEQ ID NO: 496164 - DNA, 25 bp, Mus musculus
aaaactgtttctaatgggctgcgag

SEQ ID NO: 496165 - DNA, 25 bp, Mus musculus
aaaactgtttcttatgggctgcgag

SEQ ID NO: 496166 - DNA, 25 bp, Mus musculus
aaaacttccagacttggagtctagc

SEQ ID NO: 496167 - DNA, 25 bp, Mus musculus
aaaacttccagagttggagtctagc

SEQ ID NO: 496168 - DNA, 25 bp, Mus musculus
aaaacttgactgacccatctgtaat

SEQ ID NO: 496169 - DNA, 25 bp, Mus musculus
aaaacttgactgtcccatctgtaat

SEQ ID NO: 496170 - DNA, 25 bp, Mus musculus
aaaacttgggctagtccaggcttga

SEQ ID NO: 496171 - DNA, 25 bp, Mus musculus
aaaacttgggcttgtccaggcttga

SEQ ID NO: 496172 - DNA, 25 bp, Mus musculus
aaaagaaacagaactccactatgga

SEQ ID NO: 496173 - DNA, 25 bp, Mus musculus
aaaagaaacagatctccactatgga

SEQ ID NO: 496174 - DNA, 25 bp, Mus musculus
aaaagaaacagtcgtgagccagagt

SEQ ID NO: 496175 - DNA, 25 bp, Mus musculus
aaaagaaacagtggtgagccagagt

SEQ ID NO: 496176 - DNA, 25 bp, Mus musculus
aaaagaaacctgctgttggcgtatt

SEQ ID NO: 496177 - DNA, 25 bp, Mus musculus
aaaagaaacctggtgttggcgtatt

SEQ ID NO: 496178 - DNA, 25 bp, Mus musculus
aaaagaaaggctccagctgtcccca

SEQ ID NO: 496179 - DNA, 25 bp, Mus musculus
aaaagaaaggctgcagctgtcccca

SEQ ID NO: 496180 - DNA, 25 bp, Mus musculus
aaaagaacaagacagagttcgccaa

SEQ ID NO: 496181 - DNA, 25 bp, Mus musculus
aaaagaacaagagagagttcgccaa

SEQ ID NO: 496182 - DNA, 25 bp, Mus musculus
aaaagaacagcgatctctcctacct

SEQ ID NO: 496183 - DNA, 25 bp, Mus musculus
aaaagaacagcgttctctcctacct

SEQ ID NO: 496184 - DNA, 25 bp, Mus musculus
aaaagaaccgctctctccagtagcc

SEQ ID NO: 496185 - DNA, 25 bp, Mus musculus
aaaagaaccgctgtctccagtagcc

SEQ ID NO: 496186 - DNA, 25 bp, Mus musculus
aaaagaactcagactgccatccttc

SEQ ID NO: 496187 - DNA, 25 bp, Mus musculus
aaaagaactcagtctgccatccttc

SEQ ID NO: 496188 - DNA, 25 bp, Mus musculus
aaaagaagagataacacagctgaag

SEQ ID NO: 496189 - DNA, 25 bp, Mus musculus
aaaagaagagattacacagctgaag

SEQ ID NO: 496190 - DNA, 25 bp, Mus musculus
aaaagaagcagtacttgtgcccatc

SEQ ID NO: 496191 - DNA, 25 bp, Mus musculus
aaaagaagcagttcttgtgcccatc

SEQ ID NO: 496192 - DNA, 25 bp, Mus musculus
aaaagaagcgagagaaggcgtacct

SEQ ID NO: 496193 - DNA, 25 bp, Mus musculus
aaaagaagcgagtgaaggcgtacct

SEQ ID NO: 496194 - DNA, 25 bp, Mus musculus
aaaagaagctcgagccaaatttcgc

SEQ ID NO: 496195 - DNA, 25 bp, Mus musculus
aaaagaagctcgtgccaaatttcgc

SEQ ID NO: 496196 - DNA, 25 bp, Mus musculus
aaaagaagctctctgctctctatgg

SEQ ID NO: 496197 - DNA, 25 bp, Mus musculus
aaaagaagctctgtgctctctatgg

SEQ ID NO: 496198 - DNA, 25 bp, Mus musculus
aaaagaaggccacaggtaccaggcg

SEQ ID NO: 496199 - DNA, 25 bp, Mus musculus
aaaagaaggccagaggtaccaggcg

SEQ ID NO: 496200 - DNA, 25 bp, Mus musculus
aaaagaaggtctcctccacaaagag

SEQ ID NO: 496201 - DNA, 25 bp, Mus musculus
aaaagaaggtctgctccacaaagag

SEQ ID NO: 496202 - DNA, 25 bp, Mus musculus
aaaagaatcagcatgggaaatgaca

SEQ ID NO: 496203 - DNA, 25 bp, Mus musculus
aaaagaatcagcttgggaaatgaca

SEQ ID NO: 496204 - DNA, 25 bp, Mus musculus
aaaagaatccagatatggttgctgg

SEQ ID NO: 496205 - DNA, 25 bp, Mus musculus
aaaagaatccagttatggttgctgg

SEQ ID NO: 496206 - DNA, 25 bp, Mus musculus
aaaagaatcgctctttcatgtgcag

SEQ ID NO: 496207 - DNA, 25 bp, Mus musculus
aaaagaatcgctgtttcatgtgcag

SEQ ID NO: 496208 - DNA, 25 bp, Mus musculus
aaaagaatgactccggacagtggta

SEQ ID NO: 496209 - DNA, 25 bp, Mus musculus
aaaagaatgactgcggacagtggta

SEQ ID NO: 496210 - DNA, 25 bp, Mus musculus
aaaagacactatcgacgtatggtgc

SEQ ID NO: 496211 - DNA, 25 bp, Mus musculus
aaaagacactatggacgtatggtgc

SEQ ID NO: 496212 - DNA, 25 bp, Mus musculus
aaaagacatctgctaaaagcccagg

SEQ ID NO: 496213 - DNA, 25 bp, Mus musculus
aaaagacatctggtaaaagcccagg

SEQ ID NO: 496214 - DNA, 25 bp, Mus musculus
aaaagacctcgtacagcatataaca

SEQ ID NO: 496215 - DNA, 25 bp, Mus musculus
aaaagacctcgttcagcatataaca

SEQ ID NO: 496216 - DNA, 25 bp, Mus musculus
aaaagacggcgcattaaggttcaag

SEQ ID NO: 496217 - DNA, 25 bp, Mus musculus
aaaagacggcgctttaaggttcaag

SEQ ID NO: 496218 - DNA, 25 bp, Mus musculus
aaaagacgttgacagaagttggaag

SEQ ID NO: 496219 - DNA, 25 bp, Mus musculus
aaaagacgttgagagaagttggaag

SEQ ID NO: 496220 - DNA, 25 bp, Mus musculus
aaaagactgggtaccctggcagatg

SEQ ID NO: 496221 - DNA, 25 bp, Mus musculus
aaaagactgggttccctggcagatg

SEQ ID NO: 496222 - DNA, 25 bp, Mus musculus
aaaagacttggtaaatttgcatgtc

SEQ ID NO: 496223 - DNA, 25 bp, Mus musculus
aaaagacttggttaatttgcatgtc

SEQ ID NO: 496224 - DNA, 25 bp, Mus musculus
aaaagagactgacggcttccgccgc

SEQ ID NO: 496225 - DNA, 25 bp, Mus musculus
aaaagagactgagggcttccgccgc

SEQ ID NO: 496226 - DNA, 25 bp, Mus musculus
aaaagagagggtcccatctccgaca

SEQ ID NO: 496227 - DNA, 25 bp, Mus musculus
aaaagagagggtgccatctccgaca

SEQ ID NO: 496228 - DNA, 25 bp, Mus musculus
aaaagagcctgcaatttcatcacag

SEQ ID NO: 496229 - DNA, 25 bp, Mus musculus
aaaagagcctgctatttcatcacag

SEQ ID NO: 496230 - DNA, 25 bp, Mus musculus
aaaagagcttccaggttgccttgga

SEQ ID NO: 496231 - DNA, 25 bp, Mus musculus
aaaagagcttcctggttgccttgga

SEQ ID NO: 496232 - DNA, 25 bp, Mus musculus
aaaagagcttgacacccaggcaatg

SEQ ID NO: 496233 - DNA, 25 bp, Mus musculus
aaaagagcttgagacccaggcaatg

SEQ ID NO: 496234 - DNA, 25 bp, Mus musculus
aaaagaggatcaagtgtctggaatc

SEQ ID NO: 496235 - DNA, 25 bp, Mus musculus
aaaagaggatcatgtgtctggaatc

SEQ ID NO: 496236 - DNA, 25 bp, Mus musculus
aaaagagggccgacagcttgccagt

SEQ ID NO: 496237 - DNA, 25 bp, Mus musculus
aaaagagggccgtcagcttgccagt

SEQ ID NO: 496238 - DNA, 25 bp, Mus musculus
aaaagaggtcataaagtcaaatgtc

SEQ ID NO: 496239 - DNA, 25 bp, Mus musculus
aaaagaggtcattaagtcaaatgtc

SEQ ID NO: 496240 - DNA, 25 bp, Mus musculus
aaaagagtatatctggctactgatg

SEQ ID NO: 496241 - DNA, 25 bp, Mus musculus
aaaagagtatatgtggctactgatg

SEQ ID NO: 496242 - DNA, 25 bp, Mus musculus
aaaagagtgagcatatcctggacat

SEQ ID NO: 496243 - DNA, 25 bp, Mus musculus
aaaagagtgagcttatcctggacat

SEQ ID NO: 496244 - DNA, 25 bp, Mus musculus
aaaagagtgtacagaccaccaagaa

SEQ ID NO: 496245 - DNA, 25 bp, Mus musculus
aaaagagtgtactgaccaccaagaa

SEQ ID NO: 496246 - DNA, 25 bp, Mus musculus
aaaagagtgtgtcaactttgcctcc

SEQ ID NO: 496247 - DNA, 25 bp, Mus musculus
aaaagagtgtgtgaactttgcctcc

SEQ ID NO: 496248 - DNA, 25 bp, Mus musculus
aaaagataggcaatgtgggacgaac

SEQ ID NO: 496249 - DNA, 25 bp, Mus musculus
aaaagataggcattgtgggacgaac

SEQ ID NO: 496250 - DNA, 25 bp, Mus musculus
aaaagatatccaaagactcggactg

SEQ ID NO: 496251 - DNA, 25 bp, Mus musculus
aaaagatatccatagactcggactg

SEQ ID NO: 496252 - DNA, 25 bp, Mus musculus
aaaagatgaataaggtaaagtgccc

SEQ ID NO: 496253 - DNA, 25 bp, Mus musculus
aaaagatgaatatggtaaagtgccc

SEQ ID NO: 496254 - DNA, 25 bp, Mus musculus
aaaagatgacataaacaaaaaggct

SEQ ID NO: 496255 - DNA, 25 bp, Mus musculus
aaaagatgacattaacaaaaaggct

SEQ ID NO: 496256 - DNA, 25 bp, Mus musculus
aaaagatgcaacaccataccctgct

SEQ ID NO: 496257 - DNA, 25 bp, Mus musculus
aaaagatgcaactccataccctgct

SEQ ID NO: 496258 - DNA, 25 bp, Mus musculus
aaaagatggaacctttgctgcagga

SEQ ID NO: 496259 - DNA, 25 bp, Mus musculus
aaaagatggaacgtttgctgcagga

SEQ ID NO: 496260 - DNA, 25 bp, Mus musculus
aaaagattccatatatagacaccct

SEQ ID NO: 496261 - DNA, 25 bp, Mus musculus
aaaagattccatttatagacaccct

SEQ ID NO: 496262 - DNA, 25 bp, Mus musculus
aaaagattcgacaggaggtggacaa

SEQ ID NO: 496263 - DNA, 25 bp, Mus musculus
aaaagattcgactggaggtggacaa

SEQ ID NO: 496264 - DNA, 25 bp, Mus musculus
aaaagatttcctcattcctattgga

SEQ ID NO: 496265 - DNA, 25 bp, Mus musculus
aaaagatttcctgattcctattgga

SEQ ID NO: 496266 - DNA, 25 bp, Mus musculus
aaaagcaaagagcagcccgcaagaa

SEQ ID NO: 496267 - DNA, 25 bp, Mus musculus
aaaagcaaagaggagcccgcaagaa

SEQ ID NO: 496268 - DNA, 25 bp, Mus musculus
aaaagcaacagaagggcgcagacgg

SEQ ID NO: 496269 - DNA, 25 bp, Mus musculus
aaaagcaacagatgggcgcagacgg

SEQ ID NO: 496270 - DNA, 25 bp, Mus musculus
aaaagcaagaaaacaccgattggtt

SEQ ID NO: 496271 - DNA, 25 bp, Mus musculus
aaaagcaagaaatcaccgattggtt

SEQ ID NO: 496272 - DNA, 25 bp, Mus musculus
aaaagcaagctaacttgacttctgc

SEQ ID NO: 496273 - DNA, 25 bp, Mus musculus
aaaagcaagctatcttgacttctgc

SEQ ID NO: 496274 - DNA, 25 bp, Mus musculus
aaaagcaaggacagcttccgaaact

SEQ ID NO: 496275 - DNA, 25 bp, Mus musculus
aaaagcaaggactgcttccgaaact

SEQ ID NO: 496276 - DNA, 25 bp, Mus musculus
aaaagcaagtatcaggacctcaaca

SEQ ID NO: 496277 - DNA, 25 bp, Mus musculus
aaaagcaagtatgaggacctcaaca

SEQ ID NO: 496278 - DNA, 25 bp, Mus musculus
aaaagcaataagcagaaggttgctc

SEQ ID NO: 496279 - DNA, 25 bp, Mus musculus
aaaagcaataaggagaaggttgctc

SEQ ID NO: 496280 - DNA, 25 bp, Mus musculus
aaaagcacaacaatcgtctcatggg

SEQ ID NO: 496281 - DNA, 25 bp, Mus musculus
aaaagcacaacattcgtctcatggg

SEQ ID NO: 496282 - DNA, 25 bp, Mus musculus
aaaagcaccccacacattgtatggg

SEQ ID NO: 496283 - DNA, 25 bp, Mus musculus
aaaagcaccccagacattgtatggg

SEQ ID NO: 496284 - DNA, 25 bp, Mus musculus
aaaagcacgcagacaaggaagacct

SEQ ID NO: 496285 - DNA, 25 bp, Mus musculus
aaaagcacgcagtcaaggaagacct

SEQ ID NO: 496286 - DNA, 25 bp, Mus musculus
aaaagcacgtgcaagcggctgtggc

SEQ ID NO: 496287 - DNA, 25 bp, Mus musculus
aaaagcacgtgctagcggctgtggc

SEQ ID NO: 496288 - DNA, 25 bp, Mus musculus
aaaagcactattcaggagaaagcaa

SEQ ID NO: 496289 - DNA, 25 bp, Mus musculus
aaaagcactattgaggagaaagcaa

SEQ ID NO: 496290 - DNA, 25 bp, Mus musculus
aaaagcagaacacagccacgagggc

SEQ ID NO: 496291 - DNA, 25 bp, Mus musculus
aaaagcagaacagagccacgagggc

SEQ ID NO: 496292 - DNA, 25 bp, Mus musculus
aaaagcagcaagcagcctgctctgc

SEQ ID NO: 496293 - DNA, 25 bp, Mus musculus
aaaagcagcaaggagcctgctctgc

SEQ ID NO: 496294 - DNA, 25 bp, Mus musculus
aaaagcagccctcttctgacgatga

SEQ ID NO: 496295 - DNA, 25 bp, Mus musculus
aaaagcagccctgttctgacgatga

SEQ ID NO: 496296 - DNA, 25 bp, Mus musculus
aaaagcaggtgaacgtggcctccgg

SEQ ID NO: 496297 - DNA, 25 bp, Mus musculus
aaaagcaggtgaagagccgaggacc

SEQ ID NO: 496298 - DNA, 25 bp, Mus musculus
aaaagcaggtgatcgtggcctccgg

SEQ ID NO: 496299 - DNA, 25 bp, Mus musculus
aaaagcaggtgatgagccgaggacc

SEQ ID NO: 496300 - DNA, 25 bp, Mus musculus
aaaagcatacatagtttgcaaaacc

SEQ ID NO: 496301 - DNA, 25 bp, Mus musculus
aaaagcatacattgtttgcaaaacc

SEQ ID NO: 496302 - DNA, 25 bp, Mus musculus
aaaagcatcagcaagaaggaaaact

SEQ ID NO: 496303 - DNA, 25 bp, Mus musculus
aaaagcatcagctagaaggaaaact

SEQ ID NO: 496304 - DNA, 25 bp, Mus musculus
aaaagcatgaacattgacaatcctg

SEQ ID NO: 496305 - DNA, 25 bp, Mus musculus
aaaagcatgaactttgacaatcctg

SEQ ID NO: 496306 - DNA, 25 bp, Mus musculus
aaaagcattgccaacggcagcgatg

SEQ ID NO: 496307 - DNA, 25 bp, Mus musculus
aaaagcattgcctacggcagcgatg

SEQ ID NO: 496308 - DNA, 25 bp, Mus musculus
aaaagccaaccacagtcacagtggg

SEQ ID NO: 496309 - DNA, 25 bp, Mus musculus
aaaagccaaccagagtcacagtggg

SEQ ID NO: 496310 - DNA, 25 bp, Mus musculus
aaaagccaagatccaggaaccaaga

SEQ ID NO: 496311 - DNA, 25 bp, Mus musculus
aaaagccaagatgcaggaaccaaga

SEQ ID NO: 496312 - DNA, 25 bp, Mus musculus
aaaagccagaaaacattcttcaaga

SEQ ID NO: 496313 - DNA, 25 bp, Mus musculus
aaaagccagaaatcattcttcaaga

SEQ ID NO: 496314 - DNA, 25 bp, Mus musculus
aaaagccagacaccttactcgacaa

SEQ ID NO: 496315 - DNA, 25 bp, Mus musculus
aaaagccagacagcttactcgacaa

SEQ ID NO: 496316 - DNA, 25 bp, Mus musculus
aaaagcccagaacataatgcagtcc

SEQ ID NO: 496317 - DNA, 25 bp, Mus musculus
aaaagcccagaagataatgcagtcc

SEQ ID NO: 496318 - DNA, 25 bp, Mus musculus
aaaagccccggaagttgaactgaag

SEQ ID NO: 496319 - DNA, 25 bp, Mus musculus
aaaagccccggatgttgaactgaag

SEQ ID NO: 496320 - DNA, 25 bp, Mus musculus
aaaagcccggagcagagagccacag

SEQ ID NO: 496321 - DNA, 25 bp, Mus musculus
aaaagcccggaggagagagccacag

SEQ ID NO: 496322 - DNA, 25 bp, Mus musculus
aaaagccctcctcatcgtctctgag

SEQ ID NO: 496323 - DNA, 25 bp, Mus musculus
aaaagccctcctgatcgtctctgag

SEQ ID NO: 496324 - DNA, 25 bp, Mus musculus
aaaagcctccaaaccaatatgtccg

SEQ ID NO: 496325 - DNA, 25 bp, Mus musculus
aaaagcctccaatccaatatgtccg

SEQ ID NO: 496326 - DNA, 25 bp, Mus musculus
aaaagcctctatcccctgacattca

SEQ ID NO: 496327 - DNA, 25 bp, Mus musculus
aaaagcctctatgccctgacattca

SEQ ID NO: 496328 - DNA, 25 bp, Mus musculus
aaaagcctgctaacttcactgaggg

SEQ ID NO: 496329 - DNA, 25 bp, Mus musculus
aaaagcctgctatcttcactgaggg

SEQ ID NO: 496330 - DNA, 25 bp, Mus musculus
aaaagcctgttccagcaagtagatc

SEQ ID NO: 496331 - DNA, 25 bp, Mus musculus
aaaagcctgttcgagcaagtagatc

SEQ ID NO: 496332 - DNA, 25 bp, Mus musculus
aaaagccttcatcacaagtactcgg

SEQ ID NO: 496333 - DNA, 25 bp, Mus musculus
aaaagccttcatgacaagtactcgg

SEQ ID NO: 496334 - DNA, 25 bp, Mus musculus
aaaagcgaatttatatcccattgcc

SEQ ID NO: 496335 - DNA, 25 bp, Mus musculus
aaaagcgaatttttatcccattgcc

SEQ ID NO: 496336 - DNA, 25 bp, Mus musculus
aaaagcgactctccagtgattggag

SEQ ID NO: 496337 - DNA, 25 bp, Mus musculus
aaaagcgactctgcagtgattggag

SEQ ID NO: 496338 - DNA, 25 bp, Mus musculus
aaaagcgagctgattgactatacgg

SEQ ID NO: 496339 - DNA, 25 bp, Mus musculus
aaaagcgagctgtttgactatacgg

SEQ ID NO: 496340 - DNA, 25 bp, Mus musculus
aaaagcgagggtactggtactgaga

SEQ ID NO: 496341 - DNA, 25 bp, Mus musculus
aaaagcgagggttctggtactgaga

SEQ ID NO: 496342 - DNA, 25 bp, Mus musculus
aaaagcgccctcaactctgagtcgg

SEQ ID NO: 496343 - DNA, 25 bp, Mus musculus
aaaagcgccctctactctgagtcgg

SEQ ID NO: 496344 - DNA, 25 bp, Mus musculus
aaaagcgccttcacctgcgtcctag

SEQ ID NO: 496345 - DNA, 25 bp, Mus musculus
aaaagcgccttctcctgcgtcctag

SEQ ID NO: 496346 - DNA, 25 bp, Mus musculus
aaaagcggcagccagaccgtatggt

SEQ ID NO: 496347 - DNA, 25 bp, Mus musculus
aaaagcggcagcgagaccgtatggt

SEQ ID NO: 496348 - DNA, 25 bp, Mus musculus
aaaagcgtctgaatccctgcaagca

SEQ ID NO: 496349 - DNA, 25 bp, Mus musculus
aaaagcgtctgattccctgcaagca

SEQ ID NO: 496350 - DNA, 25 bp, Mus musculus
aaaagcgtgccacccatcatgagag

SEQ ID NO: 496351 - DNA, 25 bp, Mus musculus
aaaagcgtgccagccatcatgagag

SEQ ID NO: 496352 - DNA, 25 bp, Mus musculus
aaaagctacctgacaaaggaaggtg

SEQ ID NO: 496353 - DNA, 25 bp, Mus musculus
aaaagctacctgtcaaaggaaggtg

SEQ ID NO: 496354 - DNA, 25 bp, Mus musculus
aaaagctactttagcctgcgttgga

SEQ ID NO: 496355 - DNA, 25 bp, Mus musculus
aaaagctacttttgcctgcgttgga

SEQ ID NO: 496356 - DNA, 25 bp, Mus musculus
aaaagctccaacaatttgtgagcag

SEQ ID NO: 496357 - DNA, 25 bp, Mus musculus
aaaagctccaactatttgtgagcag

SEQ ID NO: 496358 - DNA, 25 bp, Mus musculus
aaaagctcgaagaagagagcaggcc

SEQ ID NO: 496359 - DNA, 25 bp, Mus musculus
aaaagctcgaagtagagagcaggcc

SEQ ID NO: 496360 - DNA, 25 bp, Mus musculus
aaaagctctggtccgctgcttctct

SEQ ID NO: 496361 - DNA, 25 bp, Mus musculus
aaaagctctggtgcgctgcttctct

SEQ ID NO: 496362 - DNA, 25 bp, Mus musculus
aaaagctgaataccggaacttccag

SEQ ID NO: 496363 - DNA, 25 bp, Mus musculus
aaaagctgaatagcggaacttccag

SEQ ID NO: 496364 - DNA, 25 bp, Mus musculus
aaaagctgagtcagtccaaggagga

SEQ ID NO: 496365 - DNA, 25 bp, Mus musculus
aaaagctgagtctgtccaaggagga

SEQ ID NO: 496366 - DNA, 25 bp, Mus musculus
aaaagctgagttaacttctccgcca

SEQ ID NO: 496367 - DNA, 25 bp, Mus musculus
aaaagctgagtttacttctccgcca

SEQ ID NO: 496368 - DNA, 25 bp, Mus musculus
aaaagctgcctcaaagatgctgctg

SEQ ID NO: 496369 - DNA, 25 bp, Mus musculus
aaaagctgcctctaagatgctgctg

SEQ ID NO: 496370 - DNA, 25 bp, Mus musculus
aaaagctggaacatgtgaagggcca

SEQ ID NO: 496371 - DNA, 25 bp, Mus musculus
aaaagctggaacctcaaggccctca

SEQ ID NO: 496372 - DNA, 25 bp, Mus musculus
aaaagctggaacgtcaaggccctca

SEQ ID NO: 496373 - DNA, 25 bp, Mus musculus
aaaagctggaacttgtgaagggcca

SEQ ID NO: 496374 - DNA, 25 bp, Mus musculus
aaaagcttcaggagcggagacacct

SEQ ID NO: 496375 - DNA, 25 bp, Mus musculus
aaaagcttcaggtgcggagacacct

SEQ ID NO: 496376 - DNA, 25 bp, Mus musculus
aaaagcttgaaacccttcagaactc

SEQ ID NO: 496377 - DNA, 25 bp, Mus musculus
aaaagcttgaaagccttcagaactc

SEQ ID NO: 496378 - DNA, 25 bp, Mus musculus
aaaagcttgttgcagacccgcttgc

SEQ ID NO: 496379 - DNA, 25 bp, Mus musculus
aaaagcttgttggagacccgcttgc

SEQ ID NO: 496380 - DNA, 25 bp, Mus musculus
aaaagctttgctaaagggttgcata

SEQ ID NO: 496381 - DNA, 25 bp, Mus musculus
aaaagctttgcttaagggttgcata

SEQ ID NO: 496382 - DNA, 25 bp, Mus musculus
aaaagcttttggactgctgaaggcc

SEQ ID NO: 496383 - DNA, 25 bp, Mus musculus
aaaagcttttggtctgctgaaggcc

SEQ ID NO: 496384 - DNA, 25 bp, Mus musculus
aaaaggaagtgcacctcggagcctg

SEQ ID NO: 496385 - DNA, 25 bp, Mus musculus
aaaaggaagtgctcctcggagcctg

SEQ ID NO: 496386 - DNA, 25 bp, Mus musculus
aaaaggactctgcaaagtggcgcca

SEQ ID NO: 496387 - DNA, 25 bp, Mus musculus
aaaaggactctggaaagtggcgcca

SEQ ID NO: 496388 - DNA, 25 bp, Mus musculus
aaaaggagatccacagacttgccaa

SEQ ID NO: 496389 - DNA, 25 bp, Mus musculus
aaaaggagatcctcagacttgccaa

SEQ ID NO: 496390 - DNA, 25 bp, Mus musculus
aaaaggagcagaagctccgggagaa

SEQ ID NO: 496391 - DNA, 25 bp, Mus musculus
aaaaggagcagatgctccgggagaa

SEQ ID NO: 496392 - DNA, 25 bp, Mus musculus
aaaaggatccatcccagaaacaagc

SEQ ID NO: 496393 - DNA, 25 bp, Mus musculus
aaaaggatccatgccagaaacaagc

SEQ ID NO: 496394 - DNA, 25 bp, Mus musculus
aaaaggatgctaagctcatgttcta

SEQ ID NO: 496395 - DNA, 25 bp, Mus musculus
aaaaggatgctatgctcatgttcta

SEQ ID NO: 496396 - DNA, 25 bp, Mus musculus
aaaaggatttccagcccgactcaga

SEQ ID NO: 496397 - DNA, 25 bp, Mus musculus
aaaaggatttcctgcccgactcaga

SEQ ID NO: 496398 - DNA, 25 bp, Mus musculus
aaaaggatttctcttgtgcagaccg

SEQ ID NO: 496399 - DNA, 25 bp, Mus musculus
aaaaggatttctgttgtgcagaccg

SEQ ID NO: 496400 - DNA, 25 bp, Mus musculus
aaaaggcaaattcaaggcagctggc

SEQ ID NO: 496401 - DNA, 25 bp, Mus musculus
aaaaggcaaattgaaggcagctggc

SEQ ID NO: 496402 - DNA, 25 bp, Mus musculus
aaaaggcctgtgctatcctggagca

SEQ ID NO: 496403 - DNA, 25 bp, Mus musculus
aaaaggcctgtggtatcctggagca

SEQ ID NO: 496404 - DNA, 25 bp, Mus musculus
aaaaggcgataaaggagctggaaga

SEQ ID NO: 496405 - DNA, 25 bp, Mus musculus
aaaaggcgataatggagctggaaga

SEQ ID NO: 496406 - DNA, 25 bp, Mus musculus
aaaaggcgcagacacgacacagcgt

SEQ ID NO: 496407 - DNA, 25 bp, Mus musculus
aaaaggcgcagagacgacacagcgt

SEQ ID NO: 496408 - DNA, 25 bp, Mus musculus
aaaaggcgtgacctgaaggtgttca

SEQ ID NO: 496409 - DNA, 25 bp, Mus musculus
aaaaggcgtgacgtgaaggtgttca

SEQ ID NO: 496410 - DNA, 25 bp, Mus musculus
aaaaggctatggagctgagacccca

SEQ ID NO: 496411 - DNA, 25 bp, Mus musculus
aaaaggctatggtgctgagacccca

SEQ ID NO: 496412 - DNA, 25 bp, Mus musculus
aaaaggctccagagcggtcggcctc

SEQ ID NO: 496413 - DNA, 25 bp, Mus musculus
aaaaggctccagtgcggtcggcctc

SEQ ID NO: 496414 - DNA, 25 bp, Mus musculus
aaaaggctgtggagcttctcctggc

SEQ ID NO: 496415 - DNA, 25 bp, Mus musculus
aaaaggctgtggtgcttctcctggc

SEQ ID NO: 496416 - DNA, 25 bp, Mus musculus
aaaagggactccaggccagattggc

SEQ ID NO: 496417 - DNA, 25 bp, Mus musculus
aaaagggactcctggccagattggc

SEQ ID NO: 496418 - DNA, 25 bp, Mus musculus
aaaagggccacaagctactgacgga

SEQ ID NO: 496419 - DNA, 25 bp, Mus musculus
aaaagggccacatgctactgacgga

SEQ ID NO: 496420 - DNA, 25 bp, Mus musculus
aaaagggccagccagacaacccagc

SEQ ID NO: 496421 - DNA, 25 bp, Mus musculus
aaaagggccagcgagacaacccagc

SEQ ID NO: 496422 - DNA, 25 bp, Mus musculus
aaaagggcctttatgcacacatggt

SEQ ID NO: 496423 - DNA, 25 bp, Mus musculus
aaaagggcctttttgcacacatggt

SEQ ID NO: 496424 - DNA, 25 bp, Mus musculus
aaaagggtaagcctctatcaagctg

SEQ ID NO: 496425 - DNA, 25 bp, Mus musculus
aaaagggtaagcgtctatcaagctg

SEQ ID NO: 496426 - DNA, 25 bp, Mus musculus
aaaagggtgggcagacagatacaaa

SEQ ID NO: 496427 - DNA, 25 bp, Mus musculus
aaaagggtgggctgacagatacaaa

SEQ ID NO: 496428 - DNA, 25 bp, Mus musculus
aaaaggtcacggatcgcctacagtg

SEQ ID NO: 496429 - DNA, 25 bp, Mus musculus
aaaaggtcacggttcgcctacagtg

SEQ ID NO: 496430 - DNA, 25 bp, Mus musculus
aaaaggtgtggcatccgcaataccg

SEQ ID NO: 496431 - DNA, 25 bp, Mus musculus
aaaaggtgtggcttccgcaataccg

SEQ ID NO: 496432 - DNA, 25 bp, Mus musculus
aaaaggttgaacagcggactctgcc

SEQ ID NO: 496433 - DNA, 25 bp, Mus musculus
aaaaggttgaactgcggactctgcc

SEQ ID NO: 496434 - DNA, 25 bp, Mus musculus
aaaaggtttatcaatgcttcagctg

SEQ ID NO: 496435 - DNA, 25 bp, Mus musculus
aaaaggtttatctatgcttcagctg

SEQ ID NO: 496436 - DNA, 25 bp, Mus musculus
aaaagtaacaatacaaccaggcagt

SEQ ID NO: 496437 - DNA, 25 bp, Mus musculus
aaaagtaacaattcaaccaggcagt

SEQ ID NO: 496438 - DNA, 25 bp, Mus musculus
aaaagtaccaatcctgctgtcagag

SEQ ID NO: 496439 - DNA, 25 bp, Mus musculus
aaaagtaccaatgctgctgtcagag

SEQ ID NO: 496440 - DNA, 25 bp, Mus musculus
aaaagtagcattagattgcctagag

SEQ ID NO: 496441 - DNA, 25 bp, Mus musculus
aaaagtagcatttgattgcctagag

SEQ ID NO: 496442 - DNA, 25 bp, Mus musculus
aaaagtatggcaacaacacagatcc

SEQ ID NO: 496443 - DNA, 25 bp, Mus musculus
aaaagtatggcatcaacacagatcc

SEQ ID NO: 496444 - DNA, 25 bp, Mus musculus
aaaagtcaaaatcgaataatacagc

SEQ ID NO: 496445 - DNA, 25 bp, Mus musculus
aaaagtcaaaatggaataatacagc

SEQ ID NO: 496446 - DNA, 25 bp, Mus musculus
aaaagtcaagtaaaagtctgtatgc

SEQ ID NO: 496447 - DNA, 25 bp, Mus musculus
aaaagtcaagtataagtctgtatgc

SEQ ID NO: 496448 - DNA, 25 bp, Mus musculus
aaaagtcagcacattttgaagtgtc

SEQ ID NO: 496449 - DNA, 25 bp, Mus musculus
aaaagtcagcactttttgaagtgtc

SEQ ID NO: 496450 - DNA, 25 bp, Mus musculus
aaaagtcagggcagcgcctcttgac

SEQ ID NO: 496451 - DNA, 25 bp, Mus musculus
aaaagtcagggctgcgcctcttgac

SEQ ID NO: 496452 - DNA, 25 bp, Mus musculus
aaaagtcagtgaccggattcagggc

SEQ ID NO: 496453 - DNA, 25 bp, Mus musculus
aaaagtcagtgagcggattcagggc

SEQ ID NO: 496454 - DNA, 25 bp, Mus musculus
aaaagtcatttaatctttctgagcc

SEQ ID NO: 496455 - DNA, 25 bp, Mus musculus
aaaagtcatttattctttctgagcc

SEQ ID NO: 496456 - DNA, 25 bp, Mus musculus
aaaagtcgtgttactgtgtctccag

SEQ ID NO: 496457 - DNA, 25 bp, Mus musculus
aaaagtcgtgtttctgtgtctccag

SEQ ID NO: 496458 - DNA, 25 bp, Mus musculus
aaaagtctcaggatagcatgtatct

SEQ ID NO: 496459 - DNA, 25 bp, Mus musculus
aaaagtctcaggttagcatgtatct

SEQ ID NO: 496460 - DNA, 25 bp, Mus musculus
aaaagtctgcaacttgtcaaaggcc

SEQ ID NO: 496461 - DNA, 25 bp, Mus musculus
aaaagtctgcaagttgtcaaaggcc

SEQ ID NO: 496462 - DNA, 25 bp, Mus musculus
aaaagtctgggcagatcaagtccga

SEQ ID NO: 496463 - DNA, 25 bp, Mus musculus
aaaagtctgggctgatcaagtccga

SEQ ID NO: 496464 - DNA, 25 bp, Mus musculus
aaaagtctgtctactgccgaatcag

SEQ ID NO: 496465 - DNA, 25 bp, Mus musculus
aaaagtctgtcttctgccgaatcag

SEQ ID NO: 496466 - DNA, 25 bp, Mus musculus
aaaagtctttatatcactcaagtag

SEQ ID NO: 496467 - DNA, 25 bp, Mus musculus
aaaagtctttatttcactcaagtag

SEQ ID NO: 496468 - DNA, 25 bp, Mus musculus
aaaagtctttcgcagcagctggtga

SEQ ID NO: 496469 - DNA, 25 bp, Mus musculus
aaaagtctttcggagcagctggtga

SEQ ID NO: 496470 - DNA, 25 bp, Mus musculus
aaaagtgaatttagaccagggtcag

SEQ ID NO: 496471 - DNA, 25 bp, Mus musculus
aaaagtgaattttgaccagggtcag

SEQ ID NO: 496472 - DNA, 25 bp, Mus musculus
aaaagtgcaaggcaccaacttggga

SEQ ID NO: 496473 - DNA, 25 bp, Mus musculus
aaaagtgcaagggaccaacttggga

SEQ ID NO: 496474 - DNA, 25 bp, Mus musculus
aaaagtgcactgcagctgcaagaac

SEQ ID NO: 496475 - DNA, 25 bp, Mus musculus
aaaagtgcactggagctgcaagaac

SEQ ID NO: 496476 - DNA, 25 bp, Mus musculus
aaaagtggctgacccgcggttcatt

SEQ ID NO: 496477 - DNA, 25 bp, Mus musculus
aaaagtggctgagccgcggttcatt

SEQ ID NO: 496478 - DNA, 25 bp, Mus musculus
aaaagtgggagaaagatccatcaga

SEQ ID NO: 496479 - DNA, 25 bp, Mus musculus
aaaagtgggagatagatccatcaga

SEQ ID NO: 496480 - DNA, 25 bp, Mus musculus
aaaagtggtataataccgagcgctg

SEQ ID NO: 496481 - DNA, 25 bp, Mus musculus
aaaagtggtatattaccgagcgctg

SEQ ID NO: 496482 - DNA, 25 bp, Mus musculus
aaaagtgtatgtagtaggctgatga

SEQ ID NO: 496483 - DNA, 25 bp, Mus musculus
aaaagtgtatgttgtaggctgatga

SEQ ID NO: 496484 - DNA, 25 bp, Mus musculus
aaaagtgtccacacccctagcctat

SEQ ID NO: 496485 - DNA, 25 bp, Mus musculus
aaaagtgtccactcccctagcctat

SEQ ID NO: 496486 - DNA, 25 bp, Mus musculus
aaaagtgtgagaatgcgctggagaa

SEQ ID NO: 496487 - DNA, 25 bp, Mus musculus
aaaagtgtgagattgcgctggagaa

SEQ ID NO: 496488 - DNA, 25 bp, Mus musculus
aaaagtgtgttactcatgcctcccg

SEQ ID NO: 496489 - DNA, 25 bp, Mus musculus
aaaagtgtgttagtcatgcctcccg

SEQ ID NO: 496490 - DNA, 25 bp, Mus musculus
aaaagttaccttatccaaatgagag

SEQ ID NO: 496491 - DNA, 25 bp, Mus musculus
aaaagttaccttttccaaatgagag

SEQ ID NO: 496492 - DNA, 25 bp, Mus musculus
aaaagttattggaggagatgatctc

SEQ ID NO: 496493 - DNA, 25 bp, Mus musculus
aaaagttattggtggagatgatctc

SEQ ID NO: 496494 - DNA, 25 bp, Mus musculus
aaaagttcaccccactcagtgacgg

SEQ ID NO: 496495 - DNA, 25 bp, Mus musculus
aaaagttcacccgactcagtgacgg

SEQ ID NO: 496496 - DNA, 25 bp, Mus musculus
aaaagttcacttatattgaggactg

SEQ ID NO: 496497 - DNA, 25 bp, Mus musculus
aaaagttcacttttattgaggactg

SEQ ID NO: 496498 - DNA, 25 bp, Mus musculus
aaaagttgaaagctgtcagcaggac

SEQ ID NO: 496499 - DNA, 25 bp, Mus musculus
aaaagttgaaaggtgtcagcaggac

SEQ ID NO: 496500 - DNA, 25 bp, Mus musculus
aaaagttgctcgcaagtgcgacgtc

SEQ ID NO: 496501 - DNA, 25 bp, Mus musculus
aaaagttgctcggaagtgcgacgtc

SEQ ID NO: 496502 - DNA, 25 bp, Mus musculus
aaaagttgttccaatgaaagccaag

SEQ ID NO: 496503 - DNA, 25 bp, Mus musculus
aaaagttgttcctatgaaagccaag

SEQ ID NO: 496504 - DNA, 25 bp, Mus musculus
aaaagttgttctagtagcctctggc

SEQ ID NO: 496505 - DNA, 25 bp, Mus musculus
aaaagttgttcttgtagcctctggc

SEQ ID NO: 496506 - DNA, 25 bp, Mus musculus
aaaagtttcgatcccagtaagcctg

SEQ ID NO: 496507 - DNA, 25 bp, Mus musculus
aaaagtttcgatgccagtaagcctg

SEQ ID NO: 496508 - DNA, 25 bp, Mus musculus
aaaataaaattaagccgtcgcgagg

SEQ ID NO: 496509 - DNA, 25 bp, Mus musculus
aaaataaaattatgccgtcgcgagg

SEQ ID NO: 496510 - DNA, 25 bp, Mus musculus
aaaataaagatgctgtcgttaccat

SEQ ID NO: 496511 - DNA, 25 bp, Mus musculus
aaaataaagatggtgtcgttaccat

SEQ ID NO: 496512 - DNA, 25 bp, Mus musculus
aaaataactcgtcctcccattaatg

SEQ ID NO: 496513 - DNA, 25 bp, Mus musculus
aaaataactcgtgctcccattaatg

SEQ ID NO: 496514 - DNA, 25 bp, Mus musculus
aaaataaggagacccgcctcaccaa

SEQ ID NO: 496515 - DNA, 25 bp, Mus musculus
aaaataaggagagccgcctcaccaa

SEQ ID NO: 496516 - DNA, 25 bp, Mus musculus
aaaataatgatgatctcagacagca

SEQ ID NO: 496517 - DNA, 25 bp, Mus musculus
aaaataatgatgttctcagacagca

SEQ ID NO: 496518 - DNA, 25 bp, Mus musculus
aaaatacaaattctacctgagggcg

SEQ ID NO: 496519 - DNA, 25 bp, Mus musculus
aaaatacaaattgtacctgagggcg

SEQ ID NO: 496520 - DNA, 25 bp, Mus musculus
aaaatacaacacattgccagtgtag

SEQ ID NO: 496521 - DNA, 25 bp, Mus musculus
aaaatacaacactttgccagtgtag

SEQ ID NO: 496522 - DNA, 25 bp, Mus musculus
aaaataccagaaaatcaaactgcag

SEQ ID NO: 496523 - DNA, 25 bp, Mus musculus
aaaataccagaatatcaaactgcag

SEQ ID NO: 496524 - DNA, 25 bp, Mus musculus
aaaatacctaacattgaacacagag

SEQ ID NO: 496525 - DNA, 25 bp, Mus musculus
aaaatacctaactttgaacacagag

SEQ ID NO: 496526 - DNA, 25 bp, Mus musculus
aaaataccttagctttgctgagccg

SEQ ID NO: 496527 - DNA, 25 bp, Mus musculus
aaaataccttaggtttgctgagccg

SEQ ID NO: 496528 - DNA, 25 bp, Mus musculus
aaaatagtcataagtgggctgggca

SEQ ID NO: 496529 - DNA, 25 bp, Mus musculus
aaaatagtcatatgtgggctgggca

SEQ ID NO: 496530 - DNA, 25 bp, Mus musculus
aaaatagtgcaaaaacgtagctggg

SEQ ID NO: 496531 - DNA, 25 bp, Mus musculus
aaaatagtgcaataacgtagctggg

SEQ ID NO: 496532 - DNA, 25 bp, Mus musculus
aaaatataactgagctgtttctcca

SEQ ID NO: 496533 - DNA, 25 bp, Mus musculus
aaaatataactgtgctgtttctcca

SEQ ID NO: 496534 - DNA, 25 bp, Mus musculus
aaaatatacagcaaagtcaagtcca

SEQ ID NO: 496535 - DNA, 25 bp, Mus musculus
aaaatatacagctaagtcaagtcca

SEQ ID NO: 496536 - DNA, 25 bp, Mus musculus
aaaatatagtaaccttgccaaaagc

SEQ ID NO: 496537 - DNA, 25 bp, Mus musculus
aaaatatagtaagcttgccaaaagc

SEQ ID NO: 496538 - DNA, 25 bp, Mus musculus
aaaatatatcaacgagaggaactac

SEQ ID NO: 496539 - DNA, 25 bp, Mus musculus
aaaatatatcaaggagaggaactac

SEQ ID NO: 496540 - DNA, 25 bp, Mus musculus
aaaatatcttgaaaggcctggaaga

SEQ ID NO: 496541 - DNA, 25 bp, Mus musculus
aaaatatcttgataggcctggaaga

SEQ ID NO: 496542 - DNA, 25 bp, Mus musculus
aaaatatgctcactgcagccgcgtg

SEQ ID NO: 496543 - DNA, 25 bp, Mus musculus
aaaatatgctcagtgcagccgcgtg

SEQ ID NO: 496544 - DNA, 25 bp, Mus musculus
aaaatattagatctggaagctgagc

SEQ ID NO: 496545 - DNA, 25 bp, Mus musculus
aaaatattagatgtggaagctgagc

SEQ ID NO: 496546 - DNA, 25 bp, Mus musculus
aaaatattagtgatactcagcaact

SEQ ID NO: 496547 - DNA, 25 bp, Mus musculus
aaaatattagtgttactcagcaact

SEQ ID NO: 496548 - DNA, 25 bp, Mus musculus
aaaatcaaagagatagctgtgactg

SEQ ID NO: 496549 - DNA, 25 bp, Mus musculus
aaaatcaaagagttagctgtgactg

SEQ ID NO: 496550 - DNA, 25 bp, Mus musculus
aaaatcaaatgactctgcctttggg

SEQ ID NO: 496551 - DNA, 25 bp, Mus musculus
aaaatcaaatgagtctgcctttggg

SEQ ID NO: 496552 - DNA, 25 bp, Mus musculus
aaaatcaacactcccatccaggaca

SEQ ID NO: 496553 - DNA, 25 bp, Mus musculus
aaaatcaacactgccatccaggaca

SEQ ID NO: 496554 - DNA, 25 bp, Mus musculus
aaaatcaagcttagcttgttcctgc

SEQ ID NO: 496555 - DNA, 25 bp, Mus musculus
aaaatcaagctttgcttgttcctgc

SEQ ID NO: 496556 - DNA, 25 bp, Mus musculus
aaaatcacactgatgggcatttggg

SEQ ID NO: 496557 - DNA, 25 bp, Mus musculus
aaaatcacactgttgggcatttggg

SEQ ID NO: 496558 - DNA, 25 bp, Mus musculus
aaaatcacatcaaggtgctcctgcg

SEQ ID NO: 496559 - DNA, 25 bp, Mus musculus
aaaatcacatcatggtgctcctgcg

SEQ ID NO: 496560 - DNA, 25 bp, Mus musculus
aaaatcaccgtgctgattgggaagc

SEQ ID NO: 496561 - DNA, 25 bp, Mus musculus
aaaatcaccgtggtgattgggaagc

SEQ ID NO: 496562 - DNA, 25 bp, Mus musculus
aaaatcagcagacgctacccgggtt

SEQ ID NO: 496563 - DNA, 25 bp, Mus musculus
aaaatcagcagaggctacccgggtt

SEQ ID NO: 496564 - DNA, 25 bp, Mus musculus
aaaatcagcgtgagaagcgggagct

SEQ ID NO: 496565 - DNA, 25 bp, Mus musculus
aaaatcagcgtgtgaagcgggagct

SEQ ID NO: 496566 - DNA, 25 bp, Mus musculus
aaaatcaggacaccatccacccaag

SEQ ID NO: 496567 - DNA, 25 bp, Mus musculus
aaaatcaggacagcatccacccaag

SEQ ID NO: 496568 - DNA, 25 bp, Mus musculus
aaaatcagtgaacaaactcaaccag

SEQ ID NO: 496569 - DNA, 25 bp, Mus musculus
aaaatcagtgaagaaactcaaccag

SEQ ID NO: 496570 - DNA, 25 bp, Mus musculus
aaaatcatcaggcactctactccga

SEQ ID NO: 496571 - DNA, 25 bp, Mus musculus
aaaatcatcagggactctactccga

SEQ ID NO: 496572 - DNA, 25 bp, Mus musculus
aaaatcatccagcagacttggaaca

SEQ ID NO: 496573 - DNA, 25 bp, Mus musculus
aaaatcatccaggagacttggaaca

SEQ ID NO: 496574 - DNA, 25 bp, Mus musculus
aaaatcatctttcctctcacgcgag

SEQ ID NO: 496575 - DNA, 25 bp, Mus musculus
aaaatcatctttgctctcacgcgag

SEQ ID NO: 496576 - DNA, 25 bp, Mus musculus
aaaatcatgcgtcccagagctaagg

SEQ ID NO: 496577 - DNA, 25 bp, Mus musculus
aaaatcatgcgtgccagagctaagg

SEQ ID NO: 496578 - DNA, 25 bp, Mus musculus
aaaatcattcgtcgtttctgtcact

SEQ ID NO: 496579 - DNA, 25 bp, Mus musculus
aaaatcattcgtggtttctgtcact

SEQ ID NO: 496580 - DNA, 25 bp, Mus musculus
aaaatccacccaccagccttgaaag

SEQ ID NO: 496581 - DNA, 25 bp, Mus musculus
aaaatccacccagcagccttgaaag

SEQ ID NO: 496582 - DNA, 25 bp, Mus musculus
aaaatccagatcatcaggttcatca

SEQ ID NO: 496583 - DNA, 25 bp, Mus musculus
aaaatccagatcttcaggttcatca

SEQ ID NO: 496584 - DNA, 25 bp, Mus musculus
aaaatccagggcaggaccatcccca

SEQ ID NO: 496585 - DNA, 25 bp, Mus musculus
aaaatccagggccagaacaaggaga

SEQ ID NO: 496586 - DNA, 25 bp, Mus musculus
aaaatccagggcgagaacaaggaga

SEQ ID NO: 496587 - DNA, 25 bp, Mus musculus
aaaatccagggctggaccatcccca

SEQ ID NO: 496588 - DNA, 25 bp, Mus musculus
aaaatccattgacgaagctgcagcc

SEQ ID NO: 496589 - DNA, 25 bp, Mus musculus
aaaatccattgaggaagctgcagcc

SEQ ID NO: 496590 - DNA, 25 bp, Mus musculus
aaaatccgtgagctatcatcactac

SEQ ID NO: 496591 - DNA, 25 bp, Mus musculus
aaaatccgtgaggtatcatcactac

SEQ ID NO: 496592 - DNA, 25 bp, Mus musculus
aaaatcgaataaaacagcagcccgg

SEQ ID NO: 496593 - DNA, 25 bp, Mus musculus
aaaatcgaataatacagcagcccgg

SEQ ID NO: 496594 - DNA, 25 bp, Mus musculus
aaaatcgagcctcgattgtatgaac

SEQ ID NO: 496595 - DNA, 25 bp, Mus musculus
aaaatcgagcctggattgtatgaac

SEQ ID NO: 496596 - DNA, 25 bp, Mus musculus
aaaatcggcagtcctattcaacggc

SEQ ID NO: 496597 - DNA, 25 bp, Mus musculus
aaaatcggcagtgctattcaacggc

SEQ ID NO: 496598 - DNA, 25 bp, Mus musculus
aaaatcgggctcaaaaagatgaaga

SEQ ID NO: 496599 - DNA, 25 bp, Mus musculus
aaaatcgggctctaaaagatgaaga

SEQ ID NO: 496600 - DNA, 25 bp, Mus musculus
aaaatcgtgttgagtttgacaatgc

SEQ ID NO: 496601 - DNA, 25 bp, Mus musculus
aaaatcgtgttgtgtttgacaatgc

SEQ ID NO: 496602 - DNA, 25 bp, Mus musculus
aaaatctactccctgaaggcaaaat

SEQ ID NO: 496603 - DNA, 25 bp, Mus musculus
aaaatctactccgtgaaggcaaaat

SEQ ID NO: 496604 - DNA, 25 bp, Mus musculus
aaaatctcagttctgtgcctgggca

SEQ ID NO: 496605 - DNA, 25 bp, Mus musculus
aaaatctcagttgtgtgcctgggca

SEQ ID NO: 496606 - DNA, 25 bp, Mus musculus
aaaatctctccccaaaggcagatac

SEQ ID NO: 496607 - DNA, 25 bp, Mus musculus
aaaatctctcccgaaaggcagatac

SEQ ID NO: 496608 - DNA, 25 bp, Mus musculus
aaaatctggcatccaaaagcggttg

SEQ ID NO: 496609 - DNA, 25 bp, Mus musculus
aaaatctggcatgcaaaagcggttg

SEQ ID NO: 496610 - DNA, 25 bp, Mus musculus
aaaatctggccaaaattgaggctct

SEQ ID NO: 496611 - DNA, 25 bp, Mus musculus
aaaatctggccataattgaggctct

SEQ ID NO: 496612 - DNA, 25 bp, Mus musculus
aaaatctggcttcggctccgcgggc

SEQ ID NO: 496613 - DNA, 25 bp, Mus musculus
aaaatctggcttgggctccgcgggc

SEQ ID NO: 496614 - DNA, 25 bp, Mus musculus
aaaatctgtggtactggacttaatt

SEQ ID NO: 496615 - DNA, 25 bp, Mus musculus
aaaatctgtggttctggacttaatt

SEQ ID NO: 496616 - DNA, 25 bp, Mus musculus
aaaatcttgcagctttatacacgga

SEQ ID NO: 496617 - DNA, 25 bp, Mus musculus
aaaatcttgcaggtttatacacgga

SEQ ID NO: 496618 - DNA, 25 bp, Mus musculus
aaaatctttgcacacctgatagtct

SEQ ID NO: 496619 - DNA, 25 bp, Mus musculus
aaaatctttgcagacctgatagtct

SEQ ID NO: 496620 - DNA, 25 bp, Mus musculus
aaaatgaacaggatgaaaagccaag

SEQ ID NO: 496621 - DNA, 25 bp, Mus musculus
aaaatgaacaggttgaaaagccaag

SEQ ID NO: 496622 - DNA, 25 bp, Mus musculus
aaaatgaactgaagtatggagttgc

SEQ ID NO: 496623 - DNA, 25 bp, Mus musculus
aaaatgaactgatgtatggagttgc

SEQ ID NO: 496624 - DNA, 25 bp, Mus musculus
aaaatgaagttcagaagtacaagtc

SEQ ID NO: 496625 - DNA, 25 bp, Mus musculus
aaaatgaagttctgaagtacaagtc

SEQ ID NO: 496626 - DNA, 25 bp, Mus musculus
aaaatgacaaagaggcgtcctctga

SEQ ID NO: 496627 - DNA, 25 bp, Mus musculus
aaaatgacaaagtggcgtcctctga

SEQ ID NO: 496628 - DNA, 25 bp, Mus musculus
aaaatgacagagctctaccagtctt

SEQ ID NO: 496629 - DNA, 25 bp, Mus musculus
aaaatgacagaggtctaccagtctt

SEQ ID NO: 496630 - DNA, 25 bp, Mus musculus
aaaatgacccgcacagctgtgttga

SEQ ID NO: 496631 - DNA, 25 bp, Mus musculus
aaaatgacccgctcagctgtgttga

SEQ ID NO: 496632 - DNA, 25 bp, Mus musculus
aaaatgacgaggaagaatacgaggc

SEQ ID NO: 496633 - DNA, 25 bp, Mus musculus
aaaatgacgaggtagaatacgaggc

SEQ ID NO: 496634 - DNA, 25 bp, Mus musculus
aaaatgagagtgaagccgctcgtag

SEQ ID NO: 496635 - DNA, 25 bp, Mus musculus
aaaatgagagtgtagccgctcgtag

SEQ ID NO: 496636 - DNA, 25 bp, Mus musculus
aaaatgagcaccagatggaagacta

SEQ ID NO: 496637 - DNA, 25 bp, Mus musculus
aaaatgagcacctgatggaagacta

SEQ ID NO: 496638 - DNA, 25 bp, Mus musculus
aaaatgagcaggcagctattgtcgc

SEQ ID NO: 496639 - DNA, 25 bp, Mus musculus
aaaatgagcagggagctattgtcgc

SEQ ID NO: 496640 - DNA, 25 bp, Mus musculus
aaaatgagccttaccacctatggtg

SEQ ID NO: 496641 - DNA, 25 bp, Mus musculus
aaaatgagcctttccacctatggtg

SEQ ID NO: 496642 - DNA, 25 bp, Mus musculus
aaaatgaggtatactgggacttaag

SEQ ID NO: 496643 - DNA, 25 bp, Mus musculus
aaaatgaggtattctgggacttaag

SEQ ID NO: 496644 - DNA, 25 bp, Mus musculus
aaaatgatatttccaaagtttgcag

SEQ ID NO: 496645 - DNA, 25 bp, Mus musculus
aaaatgatatttgcaaagtttgcag

SEQ ID NO: 496646 - DNA, 25 bp, Mus musculus
aaaatgatcgacaagaacctgcggg

SEQ ID NO: 496647 - DNA, 25 bp, Mus musculus
aaaatgatcgactagaacctgcggg

SEQ ID NO: 496648 - DNA, 25 bp, Mus musculus
aaaatgatgagaagaccatgttccg

SEQ ID NO: 496649 - DNA, 25 bp, Mus musculus
aaaatgatgagatgaccatgttccg

SEQ ID NO: 496650 - DNA, 25 bp, Mus musculus
aaaatgattttgcagccatttctgc

SEQ ID NO: 496651 - DNA, 25 bp, Mus musculus
aaaatgattttggagccatttctgc

SEQ ID NO: 496652 - DNA, 25 bp, Mus musculus
aaaatgcaatttacacagattcaga

SEQ ID NO: 496653 - DNA, 25 bp, Mus musculus
aaaatgcaattttcacagattcaga

SEQ ID NO: 496654 - DNA, 25 bp, Mus musculus
aaaatgcaccgacgttgtggaccag

SEQ ID NO: 496655 - DNA, 25 bp, Mus musculus
aaaatgcaccgaggttgtggaccag

SEQ ID NO: 496656 - DNA, 25 bp, Mus musculus
aaaatgcagtgcctgggtaaccagc

SEQ ID NO: 496657 - DNA, 25 bp, Mus musculus
aaaatgcagtgcgtgggtaaccagc

SEQ ID NO: 496658 - DNA, 25 bp, Mus musculus
aaaatgcatcgcaagcaagtgggtg

SEQ ID NO: 496659 - DNA, 25 bp, Mus musculus
aaaatgcatcgctagcaagtgggtg

SEQ ID NO: 496660 - DNA, 25 bp, Mus musculus
aaaatgccagaacatccataagtct

SEQ ID NO: 496661 - DNA, 25 bp, Mus musculus
aaaatgccagaagatccataagtct

SEQ ID NO: 496662 - DNA, 25 bp, Mus musculus
aaaatgccagcacggataactcagt

SEQ ID NO: 496663 - DNA, 25 bp, Mus musculus
aaaatgccagcagggataactcagt

SEQ ID NO: 496664 - DNA, 25 bp, Mus musculus
aaaatgccattcaataaggaaccaa

SEQ ID NO: 496665 - DNA, 25 bp, Mus musculus
aaaatgccattcagcagatgggtgg

SEQ ID NO: 496666 - DNA, 25 bp, Mus musculus
aaaatgccattctataaggaaccaa

SEQ ID NO: 496667 - DNA, 25 bp, Mus musculus
aaaatgccattctgcagatgggtgg

SEQ ID NO: 496668 - DNA, 25 bp, Mus musculus
aaaatgccctaacaggtgagagctg

SEQ ID NO: 496669 - DNA, 25 bp, Mus musculus
aaaatgccctaagaggtgagagctg

SEQ ID NO: 496670 - DNA, 25 bp, Mus musculus
aaaatgcctgtgaaagaacgtcctt

SEQ ID NO: 496671 - DNA, 25 bp, Mus musculus
aaaatgcctgtgtaagaacgtcctt

SEQ ID NO: 496672 - DNA, 25 bp, Mus musculus
aaaatgcgaagcagtaattggtcat

SEQ ID NO: 496673 - DNA, 25 bp, Mus musculus
aaaatgcgaagctgtaattggtcat

SEQ ID NO: 496674 - DNA, 25 bp, Mus musculus
aaaatgcgggcaaggactggttcct

SEQ ID NO: 496675 - DNA, 25 bp, Mus musculus
aaaatgcgggcatggactggttcct

SEQ ID NO: 496676 - DNA, 25 bp, Mus musculus
aaaatgctgcagagccggagctgcc

SEQ ID NO: 496677 - DNA, 25 bp, Mus musculus
aaaatgctgcagtgccggagctgcc

SEQ ID NO: 496678 - DNA, 25 bp, Mus musculus
aaaatgctggtacatccacgatttc

SEQ ID NO: 496679 - DNA, 25 bp, Mus musculus
aaaatgctggtagatccacgatttc

SEQ ID NO: 496680 - DNA, 25 bp, Mus musculus
aaaatggacaaaccacaggcaccaa

SEQ ID NO: 496681 - DNA, 25 bp, Mus musculus
aaaatggacaaagcacaggcaccaa

SEQ ID NO: 496682 - DNA, 25 bp, Mus musculus
aaaatggaccgcattactgactttt

SEQ ID NO: 496683 - DNA, 25 bp, Mus musculus
aaaatggaccgctttactgactttt

SEQ ID NO: 496684 - DNA, 25 bp, Mus musculus
aaaatggagcatacctagcagagga

SEQ ID NO: 496685 - DNA, 25 bp, Mus musculus
aaaatggagcattcctagcagagga

SEQ ID NO: 496686 - DNA, 25 bp, Mus musculus
aaaatggagctgaagtggaaagaac

SEQ ID NO: 496687 - DNA, 25 bp, Mus musculus
aaaatggagctgtagtggaaagaac

SEQ ID NO: 496688 - DNA, 25 bp, Mus musculus
aaaatggaggttctgattctcctgc

SEQ ID NO: 496689 - DNA, 25 bp, Mus musculus
aaaatggaggttgtgattctcctgc

SEQ ID NO: 496690 - DNA, 25 bp, Mus musculus
aaaatggagtatctctttgaactgg

SEQ ID NO: 496691 - DNA, 25 bp, Mus musculus
aaaatggagtatgtctttgaactgg

SEQ ID NO: 496692 - DNA, 25 bp, Mus musculus
aaaatggatcagattggaaatggac

SEQ ID NO: 496693 - DNA, 25 bp, Mus musculus
aaaatggatcagtttggaaatggac

SEQ ID NO: 496694 - DNA, 25 bp, Mus musculus
aaaatggatcccaacactggacgat

SEQ ID NO: 496695 - DNA, 25 bp, Mus musculus
aaaatggatccctacactggacgat

SEQ ID NO: 496696 - DNA, 25 bp, Mus musculus
aaaatggattgcctgatatattagc

SEQ ID NO: 496697 - DNA, 25 bp, Mus musculus
aaaatggattgcgtgatatattagc

SEQ ID NO: 496698 - DNA, 25 bp, Mus musculus
aaaatggccgctacagtatctcccg

SEQ ID NO: 496699 - DNA, 25 bp, Mus musculus
aaaatggccgcttcagtatctcccg

SEQ ID NO: 496700 - DNA, 25 bp, Mus musculus
aaaatggcctcgcttctgtgggaag

SEQ ID NO: 496701 - DNA, 25 bp, Mus musculus
aaaatggcctcggttctgtgggaag

SEQ ID NO: 496702 - DNA, 25 bp, Mus musculus
aaaatggcgcaacaggagacacaag

SEQ ID NO: 496703 - DNA, 25 bp, Mus musculus
aaaatggcgcaagaggagacacaag

SEQ ID NO: 496704 - DNA, 25 bp, Mus musculus
aaaatggctacgcattttgcagaga

SEQ ID NO: 496705 - DNA, 25 bp, Mus musculus
aaaatggctacggattttgcagaga

SEQ ID NO: 496706 - DNA, 25 bp, Mus musculus
aaaatggcttatcaatatgcagatg

SEQ ID NO: 496707 - DNA, 25 bp, Mus musculus
aaaatggcttatgaatatgcagatg

SEQ ID NO: 496708 - DNA, 25 bp, Mus musculus
aaaatgggcagtcccctccagagga

SEQ ID NO: 496709 - DNA, 25 bp, Mus musculus
aaaatgggcagtgccctccagagga

SEQ ID NO: 496710 - DNA, 25 bp, Mus musculus
aaaatgggctggactttctattgga

SEQ ID NO: 496711 - DNA, 25 bp, Mus musculus
aaaatgggctggtctttctattgga

SEQ ID NO: 496712 - DNA, 25 bp, Mus musculus
aaaatgggttacacagacgagagac

SEQ ID NO: 496713 - DNA, 25 bp, Mus musculus
aaaatgggttactcagacgagagac

SEQ ID NO: 496714 - DNA, 25 bp, Mus musculus
aaaatggtgccaattgcactgactg

SEQ ID NO: 496715 - DNA, 25 bp, Mus musculus
aaaatggtgccatttgcactgactg

SEQ ID NO: 496716 - DNA, 25 bp, Mus musculus
aaaatggttccaccaccgcaagctg

SEQ ID NO: 496717 - DNA, 25 bp, Mus musculus
aaaatggttccagcaccgcaagctg

SEQ ID NO: 496718 - DNA, 25 bp, Mus musculus
aaaatggttcctacagaagctgaag

SEQ ID NO: 496719 - DNA, 25 bp, Mus musculus
aaaatggttccttcagaagctgaag

SEQ ID NO: 496720 - DNA, 25 bp, Mus musculus
aaaatgtagtatcgctcacatgaag

SEQ ID NO: 496721 - DNA, 25 bp, Mus musculus
aaaatgtagtatggctcacatgaag

SEQ ID NO: 496722 - DNA, 25 bp, Mus musculus
aaaatgtatagccatgccttcctaa

SEQ ID NO: 496723 - DNA, 25 bp, Mus musculus
aaaatgtatagcgatgccttcctaa

SEQ ID NO: 496724 - DNA, 25 bp, Mus musculus
aaaatgtcaacactttgagaggaat

SEQ ID NO: 496725 - DNA, 25 bp, Mus musculus
aaaatgtcaacagtttgagaggaat

SEQ ID NO: 496726 - DNA, 25 bp, Mus musculus
aaaatgtccaagacctgccccgatt

SEQ ID NO: 496727 - DNA, 25 bp, Mus musculus
aaaatgtccaagtcctgccccgatt

SEQ ID NO: 496728 - DNA, 25 bp, Mus musculus
aaaatgtgagatcccgctagagtgt

SEQ ID NO: 496729 - DNA, 25 bp, Mus musculus
aaaatgtgagatgccgctagagtgt

SEQ ID NO: 496730 - DNA, 25 bp, Mus musculus
aaaatgtgctcaaaccttttagaga

SEQ ID NO: 496731 - DNA, 25 bp, Mus musculus
aaaatgtgctcataccttttagaga

SEQ ID NO: 496732 - DNA, 25 bp, Mus musculus
aaaatgttatcaatcacacggatga

SEQ ID NO: 496733 - DNA, 25 bp, Mus musculus
aaaatgttatcattcacacggatga

SEQ ID NO: 496734 - DNA, 25 bp, Mus musculus
aaaatgttcccaagcttggtgatat

SEQ ID NO: 496735 - DNA, 25 bp, Mus musculus
aaaatgttcccatgcttggtgatat

SEQ ID NO: 496736 - DNA, 25 bp, Mus musculus
aaaatgtttggaaggttggctgttc

SEQ ID NO: 496737 - DNA, 25 bp, Mus musculus
aaaatgtttggatggttggctgttc

SEQ ID NO: 496738 - DNA, 25 bp, Mus musculus
aaaattaaaagccagactaagtcag

SEQ ID NO: 496739 - DNA, 25 bp, Mus musculus
aaaattaaaagcgagactaagtcag

SEQ ID NO: 496740 - DNA, 25 bp, Mus musculus
aaaattaaatttcaagctggagaga

SEQ ID NO: 496741 - DNA, 25 bp, Mus musculus
aaaattaaatttgaagctggagaga

SEQ ID NO: 496742 - DNA, 25 bp, Mus musculus
aaaattaacctgacactgtcggcgc

SEQ ID NO: 496743 - DNA, 25 bp, Mus musculus
aaaattaacctgtcactgtcggcgc

SEQ ID NO: 496744 - DNA, 25 bp, Mus musculus
aaaattaagcaactgcgagaacaag

SEQ ID NO: 496745 - DNA, 25 bp, Mus musculus
aaaattaagcaagtgcgagaacaag

SEQ ID NO: 496746 - DNA, 25 bp, Mus musculus
aaaattacaagcaggtagctgcacc

SEQ ID NO: 496747 - DNA, 25 bp, Mus musculus
aaaattacaagctggtagctgcacc

SEQ ID NO: 496748 - DNA, 25 bp, Mus musculus
aaaattacacctatcgacggagaca

SEQ ID NO: 496749 - DNA, 25 bp, Mus musculus
aaaattacacctttcgacggagaca

SEQ ID NO: 496750 - DNA, 25 bp, Mus musculus
aaaattagaagccttgcttcagggt

SEQ ID NO: 496751 - DNA, 25 bp, Mus musculus
aaaattagaagcgttgcttcagggt

SEQ ID NO: 496752 - DNA, 25 bp, Mus musculus
aaaattagatgtcttctgcacggac

SEQ ID NO: 496753 - DNA, 25 bp, Mus musculus
aaaattagatgtgttctgcacggac

SEQ ID NO: 496754 - DNA, 25 bp, Mus musculus
aaaattcctgtaagacatgtcctgc

SEQ ID NO: 496755 - DNA, 25 bp, Mus musculus
aaaattcctgtatgacatgtcctgc

SEQ ID NO: 496756 - DNA, 25 bp, Mus musculus
aaaattccttggcatgtcaattggg

SEQ ID NO: 496757 - DNA, 25 bp, Mus musculus
aaaattccttgggatgtcaattggg

SEQ ID NO: 496758 - DNA, 25 bp, Mus musculus
aaaattcttctcattcgccacgaca

SEQ ID NO: 496759 - DNA, 25 bp, Mus musculus
aaaattcttctctttcgccacgaca

SEQ ID NO: 496760 - DNA, 25 bp, Mus musculus
aaaattgacaacagccaggtggagt

SEQ ID NO: 496761 - DNA, 25 bp, Mus musculus
aaaattgacaactgccaggtggagt

SEQ ID NO: 496762 - DNA, 25 bp, Mus musculus
aaaattgccatcctgacttacggag

SEQ ID NO: 496763 - DNA, 25 bp, Mus musculus
aaaattgccatcgtgacttacggag

SEQ ID NO: 496764 - DNA, 25 bp, Mus musculus
aaaattgcctcaatggcccctggag

SEQ ID NO: 496765 - DNA, 25 bp, Mus musculus
aaaattgcctcattggcccctggag

SEQ ID NO: 496766 - DNA, 25 bp, Mus musculus
aaaattgctttcatcctagacgcaa

SEQ ID NO: 496767 - DNA, 25 bp, Mus musculus
aaaattgctttcttcctagacgcaa

SEQ ID NO: 496768 - DNA, 25 bp, Mus musculus
aaaattgggctcagacttaagtcaa

SEQ ID NO: 496769 - DNA, 25 bp, Mus musculus
aaaattgggctctgacttaagtcaa

SEQ ID NO: 496770 - DNA, 25 bp, Mus musculus
aaaattgtctgaacctgccaactgg

SEQ ID NO: 496771 - DNA, 25 bp, Mus musculus
aaaattgtctgatcctgccaactgg

SEQ ID NO: 496772 - DNA, 25 bp, Mus musculus
aaaattgtgccaaagcctacataca

SEQ ID NO: 496773 - DNA, 25 bp, Mus musculus
aaaattgtgccatagcctacataca

SEQ ID NO: 496774 - DNA, 25 bp, Mus musculus
aaaatttaaagaatgccactccatg

SEQ ID NO: 496775 - DNA, 25 bp, Mus musculus
aaaatttaaagattgccactccatg

SEQ ID NO: 496776 - DNA, 25 bp, Mus musculus
aaaatttcgtccaaatactggatgc

SEQ ID NO: 496777 - DNA, 25 bp, Mus musculus
aaaatttcgtcctaatactggatgc

SEQ ID NO: 496778 - DNA, 25 bp, Mus musculus
aaaatttctattccagatgcctttg

SEQ ID NO: 496779 - DNA, 25 bp, Mus musculus
aaaatttctattgcagatgcctttg

SEQ ID NO: 496780 - DNA, 25 bp, Mus musculus
aaaatttgatggatgtcactgtgac

SEQ ID NO: 496781 - DNA, 25 bp, Mus musculus
aaaatttgatggttgtcactgtgac

SEQ ID NO: 496782 - DNA, 25 bp, Mus musculus
aaaatttgttcacgacagacataga

SEQ ID NO: 496783 - DNA, 25 bp, Mus musculus
aaaatttgttcaggacagacataga

SEQ ID NO: 496784 - DNA, 25 bp, Mus musculus
aaaattttcctaaaggcaagtgtca

SEQ ID NO: 496785 - DNA, 25 bp, Mus musculus
aaaattttcctataggcaagtgtca

SEQ ID NO: 496786 - DNA, 25 bp, Mus musculus
aaacaaaaccagcaatcaagaagct

SEQ ID NO: 496787 - DNA, 25 bp, Mus musculus
aaacaaaaccaggaatcaagaagct

SEQ ID NO: 496788 - DNA, 25 bp, Mus musculus
aaacaaacagcccacatcactggaa

SEQ ID NO: 496789 - DNA, 25 bp, Mus musculus
aaacaaacagccgacatcactggaa

SEQ ID NO: 496790 - DNA, 25 bp, Mus musculus
aaacaaactgttccctgagtcagtc

SEQ ID NO: 496791 - DNA, 25 bp, Mus musculus
aaacaaactgttcggctactggaca

SEQ ID NO: 496792 - DNA, 25 bp, Mus musculus
aaacaaactgttgcctgagtcagtc

SEQ ID NO: 496793 - DNA, 25 bp, Mus musculus
aaacaaactgttgggctactggaca

SEQ ID NO: 496794 - DNA, 25 bp, Mus musculus
aaacaaagaaatcggctgtggagcg

SEQ ID NO: 496795 - DNA, 25 bp, Mus musculus
aaacaaagaaatgggctgtggagcg

SEQ ID NO: 496796 - DNA, 25 bp, Mus musculus
aaacaaaggacaacgtcaacgggct

SEQ ID NO: 496797 - DNA, 25 bp, Mus musculus
aaacaaaggacatcgtcaacgggct

SEQ ID NO: 496798 - DNA, 25 bp, Mus musculus
aaacaaaggctgacccaagctgggc

SEQ ID NO: 496799 - DNA, 25 bp, Mus musculus
aaacaaaggctgtcccaagctgggc

SEQ ID NO: 496800 - DNA, 25 bp, Mus musculus
aaacaaatccgcagcaatgccatca

SEQ ID NO: 496801 - DNA, 25 bp, Mus musculus
aaacaaatccgctgcaatgccatca

SEQ ID NO: 496802 - DNA, 25 bp, Mus musculus
aaacaaatcctcagggaactagatt

SEQ ID NO: 496803 - DNA, 25 bp, Mus musculus
aaacaaatcctctgggaactagatt

SEQ ID NO: 496804 - DNA, 25 bp, Mus musculus
aaacaaatgatcctcctccgcatca

SEQ ID NO: 496805 - DNA, 25 bp, Mus musculus
aaacaaatgatcgtcctccgcatca

SEQ ID NO: 496806 - DNA, 25 bp, Mus musculus
aaacaacacgtaagctgaaccccaa

SEQ ID NO: 496807 - DNA, 25 bp, Mus musculus
aaacaacacgtatgctgaaccccaa

SEQ ID NO: 496808 - DNA, 25 bp, Mus musculus
aaacaacccaaaccagacttatgat

SEQ ID NO: 496809 - DNA, 25 bp, Mus musculus
aaacaacccaaagcagacttatgat

SEQ ID NO: 496810 - DNA, 25 bp, Mus musculus
aaacaacctccaattgaagctgtgc

SEQ ID NO: 496811 - DNA, 25 bp, Mus musculus
aaacaacctccatttgaagctgtgc

SEQ ID NO: 496812 - DNA, 25 bp, Mus musculus
aaacaacctctcatctcaactggca

SEQ ID NO: 496813 - DNA, 25 bp, Mus musculus
aaacaacctctcttctcaactggca

SEQ ID NO: 496814 - DNA, 25 bp, Mus musculus
aaacaacgccgtcgactcctattgg

SEQ ID NO: 496815 - DNA, 25 bp, Mus musculus
aaacaacgccgtggactcctattgg

SEQ ID NO: 496816 - DNA, 25 bp, Mus musculus
aaacaactcctaagaggatgccggg

SEQ ID NO: 496817 - DNA, 25 bp, Mus musculus
aaacaactcctatgaggatgccggg

SEQ ID NO: 496818 - DNA, 25 bp, Mus musculus
aaacaactcctgagttgggcagaac

SEQ ID NO: 496819 - DNA, 25 bp, Mus musculus
aaacaactcctgtgttgggcagaac

SEQ ID NO: 496820 - DNA, 25 bp, Mus musculus
aaacaagaaaggaggctgacggctc

SEQ ID NO: 496821 - DNA, 25 bp, Mus musculus
aaacaagaaaggtggctgacggctc

SEQ ID NO: 496822 - DNA, 25 bp, Mus musculus
aaacaagaagcgatccctgggagtc

SEQ ID NO: 496823 - DNA, 25 bp, Mus musculus
aaacaagaagcgttccctgggagtc

SEQ ID NO: 496824 - DNA, 25 bp, Mus musculus
aaacaagacaggcacatcgcacttc

SEQ ID NO: 496825 - DNA, 25 bp, Mus musculus
aaacaagacagggacatcgcacttc

SEQ ID NO: 496826 - DNA, 25 bp, Mus musculus
aaacaagacggccagttcagggtga

SEQ ID NO: 496827 - DNA, 25 bp, Mus musculus
aaacaagacggcgagttcagggtga

SEQ ID NO: 496828 - DNA, 25 bp, Mus musculus
aaacaagagcgtaaaggatgccatg

SEQ ID NO: 496829 - DNA, 25 bp, Mus musculus
aaacaagagcgttaaggatgccatg

SEQ ID NO: 496830 - DNA, 25 bp, Mus musculus
aaacaagatgccctcgggtttccag

SEQ ID NO: 496831 - DNA, 25 bp, Mus musculus
aaacaagatgccgtcgggtttccag

SEQ ID NO: 496832 - DNA, 25 bp, Mus musculus
aaacaagcccgtcagtgtcaaggtg

SEQ ID NO: 496833 - DNA, 25 bp, Mus musculus
aaacaagcccgtgagtgtcaaggtg

SEQ ID NO: 496834 - DNA, 25 bp, Mus musculus
aaacaagccctaagatgtgtttggc

SEQ ID NO: 496835 - DNA, 25 bp, Mus musculus
aaacaagccctatgatgtgtttggc

SEQ ID NO: 496836 - DNA, 25 bp, Mus musculus
aaacaagcccttcaccaggccagag

SEQ ID NO: 496837 - DNA, 25 bp, Mus musculus
aaacaagcccttgaccaggccagag

SEQ ID NO: 496838 - DNA, 25 bp, Mus musculus
aaacaagccttcaccgatgtggcca

SEQ ID NO: 496839 - DNA, 25 bp, Mus musculus
aaacaagccttctccgatgtggcca

SEQ ID NO: 496840 - DNA, 25 bp, Mus musculus
aaacaagcggatcgactattcactg

SEQ ID NO: 496841 - DNA, 25 bp, Mus musculus
aaacaagcggatggactattcactg

SEQ ID NO: 496842 - DNA, 25 bp, Mus musculus
aaacaagctaagaagttctggtcct

SEQ ID NO: 496843 - DNA, 25 bp, Mus musculus
aaacaagctaagtagttctggtcct

SEQ ID NO: 496844 - DNA, 25 bp, Mus musculus
aaacaaggtccaaccaatccaatgt

SEQ ID NO: 496845 - DNA, 25 bp, Mus musculus
aaacaaggtccatccaatccaatgt

SEQ ID NO: 496846 - DNA, 25 bp, Mus musculus
aaacaagtccatatcctcagggagc

SEQ ID NO: 496847 - DNA, 25 bp, Mus musculus
aaacaagtccatttcctcagggagc

SEQ ID NO: 496848 - DNA, 25 bp, Mus musculus
aaacaagtctccatgtggctaagag

SEQ ID NO: 496849 - DNA, 25 bp, Mus musculus
aaacaagtctccttgtggctaagag

SEQ ID NO: 496850 - DNA, 25 bp, Mus musculus
aaacaagtgttacgacctgaggatc

SEQ ID NO: 496851 - DNA, 25 bp, Mus musculus
aaacaagtgttaggacctgaggatc

SEQ ID NO: 496852 - DNA, 25 bp, Mus musculus
aaacaataaccaacagccgagtgga

SEQ ID NO: 496853 - DNA, 25 bp, Mus musculus
aaacaataaccatcagccgagtgga

SEQ ID NO: 496854 - DNA, 25 bp, Mus musculus
aaacaatacatgagtggcgtgggca

SEQ ID NO: 496855 - DNA, 25 bp, Mus musculus
aaacaatacatgtgtggcgtgggca

SEQ ID NO: 496856 - DNA, 25 bp, Mus musculus
aaacaatccctcacagaccacagaa

SEQ ID NO: 496857 - DNA, 25 bp, Mus musculus
aaacaatccctctcagaccacagaa

SEQ ID NO: 496858 - DNA, 25 bp, Mus musculus
aaacaatgcattagaagtggctgag

SEQ ID NO: 496859 - DNA, 25 bp, Mus musculus
aaacaatgcatttgaagtggctgag

SEQ ID NO: 496860 - DNA, 25 bp, Mus musculus
aaacaattgcctcgagcggcagcca

SEQ ID NO: 496861 - DNA, 25 bp, Mus musculus
aaacaattgcctggagcggcagcca

SEQ ID NO: 496862 - DNA, 25 bp, Mus musculus
aaacacaacccgagccacaaaggag

SEQ ID NO: 496863 - DNA, 25 bp, Mus musculus
aaacacaacccgtgccacaaaggag

SEQ ID NO: 496864 - DNA, 25 bp, Mus musculus
aaacacaagaagcataagaaacaca

SEQ ID NO: 496865 - DNA, 25 bp, Mus musculus
aaacacaagaaggataagaaacaca

SEQ ID NO: 496866 - DNA, 25 bp, Mus musculus
aaacacaaggcgcttctcactcacg

SEQ ID NO: 496867 - DNA, 25 bp, Mus musculus
aaacacaaggcggttctcactcacg

SEQ ID NO: 496868 - DNA, 25 bp, Mus musculus
aaacacaattagaaggcattattcc

SEQ ID NO: 496869 - DNA, 25 bp, Mus musculus
aaacacaattagtaggcattattcc

SEQ ID NO: 496870 - DNA, 25 bp, Mus musculus
aaacacacacttcgcgagaacatcg

SEQ ID NO: 496871 - DNA, 25 bp, Mus musculus
aaacacacacttggcgagaacatcg

SEQ ID NO: 496872 - DNA, 25 bp, Mus musculus
aaacacacagagatgatcacaaccc

SEQ ID NO: 496873 - DNA, 25 bp, Mus musculus
aaacacacagagttgatcacaaccc

SEQ ID NO: 496874 - DNA, 25 bp, Mus musculus
aaacacaccttcatgcagcgacact

SEQ ID NO: 496875 - DNA, 25 bp, Mus musculus
aaacacaccttcttgcagcgacact

SEQ ID NO: 496876 - DNA, 25 bp, Mus musculus
aaacacacgcttcttgccaaaaatg

SEQ ID NO: 496877 - DNA, 25 bp, Mus musculus
aaacacacgcttgttgccaaaaatg

SEQ ID NO: 496878 - DNA, 25 bp, Mus musculus
aaacacagaaagacgggaagggatg

SEQ ID NO: 496879 - DNA, 25 bp, Mus musculus
aaacacagaaagtcgggaagggatg

SEQ ID NO: 496880 - DNA, 25 bp, Mus musculus
aaacacagatacagagatcaatgca

SEQ ID NO: 496881 - DNA, 25 bp, Mus musculus
aaacacagatactgagatcaatgca

SEQ ID NO: 496882 - DNA, 25 bp, Mus musculus
aaacacagctggagcggacagaagc

SEQ ID NO: 496883 - DNA, 25 bp, Mus musculus
aaacacagctggtgcggacagaagc

SEQ ID NO: 496884 - DNA, 25 bp, Mus musculus
aaacacagttgtcagagtccatgat

SEQ ID NO: 496885 - DNA, 25 bp, Mus musculus
aaacacagttgtgagagtccatgat

SEQ ID NO: 496886 - DNA, 25 bp, Mus musculus
aaacacatggaaacctttgatcaga

SEQ ID NO: 496887 - DNA, 25 bp, Mus musculus
aaacacatggaatcctttgatcaga

SEQ ID NO: 496888 - DNA, 25 bp, Mus musculus
aaacacatggccaaagctagggccg

SEQ ID NO: 496889 - DNA, 25 bp, Mus musculus
aaacacatggcctaagctagggccg

SEQ ID NO: 496890 - DNA, 25 bp, Mus musculus
aaacacattgtgattgtgggctcca

SEQ ID NO: 496891 - DNA, 25 bp, Mus musculus
aaacacattgtgtttgtgggctcca

SEQ ID NO: 496892 - DNA, 25 bp, Mus musculus
aaacaccaactgagattagggaaga

SEQ ID NO: 496893 - DNA, 25 bp, Mus musculus
aaacaccaactgtgattagggaaga

SEQ ID NO: 496894 - DNA, 25 bp, Mus musculus
aaacaccaccaccattgttctgaag

SEQ ID NO: 496895 - DNA, 25 bp, Mus musculus
aaacaccaccacgattgttctgaag

SEQ ID NO: 496896 - DNA, 25 bp, Mus musculus
aaacaccaccggcaagcagctcttt

SEQ ID NO: 496897 - DNA, 25 bp, Mus musculus
aaacaccaccgggaagcagctcttt

SEQ ID NO: 496898 - DNA, 25 bp, Mus musculus
aaacaccagcgaaagtgggtctgcc

SEQ ID NO: 496899 - DNA, 25 bp, Mus musculus
aaacaccagcgatagtgggtctgcc

SEQ ID NO: 496900 - DNA, 25 bp, Mus musculus
aaacaccatcgcaagcgttcacact

SEQ ID NO: 496901 - DNA, 25 bp, Mus musculus
aaacaccatcgctagcgttcacact

SEQ ID NO: 496902 - DNA, 25 bp, Mus musculus
aaacacccaaccaggtgtcctggag

SEQ ID NO: 496903 - DNA, 25 bp, Mus musculus
aaacacccaacctggtgtcctggag

SEQ ID NO: 496904 - DNA, 25 bp, Mus musculus
aaacaccctgtcatttcgctgctca

SEQ ID NO: 496905 - DNA, 25 bp, Mus musculus
aaacaccctgtcttttcgctgctca

SEQ ID NO: 496906 - DNA, 25 bp, Mus musculus
aaacacccttcaactgctggtgcgg

SEQ ID NO: 496907 - DNA, 25 bp, Mus musculus
aaacacccttcatctgctggtgcgg

SEQ ID NO: 496908 - DNA, 25 bp, Mus musculus
aaacaccgctgaagatggcgagccc

SEQ ID NO: 496909 - DNA, 25 bp, Mus musculus
aaacaccgctgatgatggcgagccc

SEQ ID NO: 496910 - DNA, 25 bp, Mus musculus
aaacacctgcaacaaggccggctct

SEQ ID NO: 496911 - DNA, 25 bp, Mus musculus
aaacacctgcaagaaggccggctct

SEQ ID NO: 496912 - DNA, 25 bp, Mus musculus
aaacacctgtccacggtgggcctgg

SEQ ID NO: 496913 - DNA, 25 bp, Mus musculus
aaacacctgtcctcggtgggcctgg

SEQ ID NO: 496914 - DNA, 25 bp, Mus musculus
aaacacgagtgtccgggctgccttt

SEQ ID NO: 496915 - DNA, 25 bp, Mus musculus
aaacacgagtgtgcgggctgccttt

SEQ ID NO: 496916 - DNA, 25 bp, Mus musculus
aaacacgccattaacgcggtgcagg

SEQ ID NO: 496917 - DNA, 25 bp, Mus musculus
aaacacgccatttacgcggtgcagg

SEQ ID NO: 496918 - DNA, 25 bp, Mus musculus
aaacacgcctgcaggcctacaggga

SEQ ID NO: 496919 - DNA, 25 bp, Mus musculus
aaacacgcctgctggcctacaggga

SEQ ID NO: 496920 - DNA, 25 bp, Mus musculus
aaacacggagagagcgtcgggccaa

SEQ ID NO: 496921 - DNA, 25 bp, Mus musculus
aaacacggagagtgcgtcgggccaa

SEQ ID NO: 496922 - DNA, 25 bp, Mus musculus
aaacactctcacactggccactgtg

SEQ ID NO: 496923 - DNA, 25 bp, Mus musculus
aaacactctcactctggccactgtg

SEQ ID NO: 496924 - DNA, 25 bp, Mus musculus
aaacactcttggcacgagctgttgc

SEQ ID NO: 496925 - DNA, 25 bp, Mus musculus
aaacactcttgggacgagctgttgc

SEQ ID NO: 496926 - DNA, 25 bp, Mus musculus
aaacactgcacgaagttaagctgac

SEQ ID NO: 496927 - DNA, 25 bp, Mus musculus
aaacactgcacgtagttaagctgac

SEQ ID NO: 496928 - DNA, 25 bp, Mus musculus
aaacactgcctcattgccttcagag

SEQ ID NO: 496929 - DNA, 25 bp, Mus musculus
aaacactgcctctttgccttcagag

SEQ ID NO: 496930 - DNA, 25 bp, Mus musculus
aaacactgtcctcgagcgggtggaa

SEQ ID NO: 496931 - DNA, 25 bp, Mus musculus
aaacactgtcctggagcgggtggaa

SEQ ID NO: 496932 - DNA, 25 bp, Mus musculus
aaacacttccttcaagcgatggctg

SEQ ID NO: 496933 - DNA, 25 bp, Mus musculus
aaacacttccttgaagcgatggctg

SEQ ID NO: 496934 - DNA, 25 bp, Mus musculus
aaacactttcttccaaggatgagtg

SEQ ID NO: 496935 - DNA, 25 bp, Mus musculus
aaacactttcttgcaaggatgagtg

SEQ ID NO: 496936 - DNA, 25 bp, Mus musculus
aaacagaaacggctgcaggcatgat

SEQ ID NO: 496937 - DNA, 25 bp, Mus musculus
aaacagaaacgggtgcaggcatgat

SEQ ID NO: 496938 - DNA, 25 bp, Mus musculus
aaacagaacagcatggatgaagacc

SEQ ID NO: 496939 - DNA, 25 bp, Mus musculus
aaacagaacagcttggatgaagacc

SEQ ID NO: 496940 - DNA, 25 bp, Mus musculus
aaacagaacatgcaggtgagcacag

SEQ ID NO: 496941 - DNA, 25 bp, Mus musculus
aaacagaacatggaggtgagcacag

SEQ ID NO: 496942 - DNA, 25 bp, Mus musculus
aaacagaagactaaaatagggcaca

SEQ ID NO: 496943 - DNA, 25 bp, Mus musculus
aaacagaagacttaaatagggcaca

SEQ ID NO: 496944 - DNA, 25 bp, Mus musculus
aaacagaagggcagcgcaggctgca

SEQ ID NO: 496945 - DNA, 25 bp, Mus musculus
aaacagaagggctgcgcaggctgca

SEQ ID NO: 496946 - DNA, 25 bp, Mus musculus
aaacagaaggtacccgagaggagaa

SEQ ID NO: 496947 - DNA, 25 bp, Mus musculus
aaacagaaggtagccgagaggagaa

SEQ ID NO: 496948 - DNA, 25 bp, Mus musculus
aaacagaaggttatccctgtgctgt

SEQ ID NO: 496949 - DNA, 25 bp, Mus musculus
aaacagaaggttttccctgtgctgt

SEQ ID NO: 496950 - DNA, 25 bp, Mus musculus
aaacagaagtcactttgtcagatga

SEQ ID NO: 496951 - DNA, 25 bp, Mus musculus
aaacagaagtcagtttgtcagatga

SEQ ID NO: 496952 - DNA, 25 bp, Mus musculus
aaacagaagtgtccggctgtcctgg

SEQ ID NO: 496953 - DNA, 25 bp, Mus musculus
aaacagaagtgtgcggctgtcctgg

SEQ ID NO: 496954 - DNA, 25 bp, Mus musculus
aaacagacatgtaggctcaggcccc

SEQ ID NO: 496955 - DNA, 25 bp, Mus musculus
aaacagacatgttggctcaggcccc

SEQ ID NO: 496956 - DNA, 25 bp, Mus musculus
aaacagaccaacaaggtgccccatc

SEQ ID NO: 496957 - DNA, 25 bp, Mus musculus
aaacagaccaactaggtgccccatc

SEQ ID NO: 496958 - DNA, 25 bp, Mus musculus
aaacagacctgactttgtgaacatc

SEQ ID NO: 496959 - DNA, 25 bp, Mus musculus
aaacagacctgagtttgtgaacatc

SEQ ID NO: 496960 - DNA, 25 bp, Mus musculus
aaacagactcgccaacttagaaatc

SEQ ID NO: 496961 - DNA, 25 bp, Mus musculus
aaacagactcgcgaacttagaaatc

SEQ ID NO: 496962 - DNA, 25 bp, Mus musculus
aaacagagagttctacagttgttcc

SEQ ID NO: 496963 - DNA, 25 bp, Mus musculus
aaacagagagttgtacagttgttcc

SEQ ID NO: 496964 - DNA, 25 bp, Mus musculus
aaacagagcaacctctcagagccag

SEQ ID NO: 496965 - DNA, 25 bp, Mus musculus
aaacagagcaacgtctcagagccag

SEQ ID NO: 496966 - DNA, 25 bp, Mus musculus
aaacagagcagcagtgcagtgccac

SEQ ID NO: 496967 - DNA, 25 bp, Mus musculus
aaacagagcagctgtgcagtgccac

SEQ ID NO: 496968 - DNA, 25 bp, Mus musculus
aaacagagctggaagccgaccttcg

SEQ ID NO: 496969 - DNA, 25 bp, Mus musculus
aaacagagctggtagccgaccttcg

SEQ ID NO: 496970 - DNA, 25 bp, Mus musculus
aaacagatacaaaggaaaattcagg

SEQ ID NO: 496971 - DNA, 25 bp, Mus musculus
aaacagatacaatggaaaattcagg

SEQ ID NO: 496972 - DNA, 25 bp, Mus musculus
aaacagatcactacctatcctgcta

SEQ ID NO: 496973 - DNA, 25 bp, Mus musculus
aaacagatcacttcctatcctgcta

SEQ ID NO: 496974 - DNA, 25 bp, Mus musculus
aaacagatgggactgaaacgccgga

SEQ ID NO: 496975 - DNA, 25 bp, Mus musculus
aaacagatgggactgtacagcttag

SEQ ID NO: 496976 - DNA, 25 bp, Mus musculus
aaacagatgggagtgaaacgccgga

SEQ ID NO: 496977 - DNA, 25 bp, Mus musculus
aaacagatgggagtgtacagcttag

SEQ ID NO: 496978 - DNA, 25 bp, Mus musculus
aaacagatgtcaatattctacaaga

SEQ ID NO: 496979 - DNA, 25 bp, Mus musculus
aaacagatgtcattattctacaaga

SEQ ID NO: 496980 - DNA, 25 bp, Mus musculus
aaacagatgtgcaaggtgttcacga

SEQ ID NO: 496981 - DNA, 25 bp, Mus musculus
aaacagatgtgctaggtgttcacga

SEQ ID NO: 496982 - DNA, 25 bp, Mus musculus
aaacagattgttaattgcattggcg

SEQ ID NO: 496983 - DNA, 25 bp, Mus musculus
aaacagattgtttattgcattggcg

SEQ ID NO: 496984 - DNA, 25 bp, Mus musculus
aaacagcaatccactgggtactgga

SEQ ID NO: 496985 - DNA, 25 bp, Mus musculus
aaacagcaatcctctgggtactgga

SEQ ID NO: 496986 - DNA, 25 bp, Mus musculus
aaacagcagccacggttctcagagg

SEQ ID NO: 496987 - DNA, 25 bp, Mus musculus
aaacagcagccagggttctcagagg

SEQ ID NO: 496988 - DNA, 25 bp, Mus musculus
aaacagcagtgtatgtcctggccac

SEQ ID NO: 496989 - DNA, 25 bp, Mus musculus
aaacagcagtgtttgtcctggccac

SEQ ID NO: 496990 - DNA, 25 bp, Mus musculus
aaacagccaacaacaatgtggtgca

SEQ ID NO: 496991 - DNA, 25 bp, Mus musculus
aaacagccaacatcaatgtggtgca

SEQ ID NO: 496992 - DNA, 25 bp, Mus musculus
aaacagcccagacgtaaatgtgcct

SEQ ID NO: 496993 - DNA, 25 bp, Mus musculus
aaacagcccagaggtaaatgtgcct

SEQ ID NO: 496994 - DNA, 25 bp, Mus musculus
aaacagcctacgctaatgacaaaag

SEQ ID NO: 496995 - DNA, 25 bp, Mus musculus
aaacagcctacggtaatgacaaaag

SEQ ID NO: 496996 - DNA, 25 bp, Mus musculus
aaacagcctggtctagccactgcgg

SEQ ID NO: 496997 - DNA, 25 bp, Mus musculus
aaacagcctggtgtagccactgcgg

SEQ ID NO: 496998 - DNA, 25 bp, Mus musculus
aaacagcgactcacattgaagacat

SEQ ID NO: 496999 - DNA, 25 bp, Mus musculus
aaacagcgactctcattgaagacat

SEQ ID NO: 497000 - DNA, 25 bp, Mus musculus
aaacagcgcattctgtcctgggctc

SEQ ID NO: 497001 - DNA, 25 bp, Mus musculus
aaacagcgcattgtgtcctgggctc

SEQ ID NO: 497002 - DNA, 25 bp, Mus musculus
aaacagctagagaccatcgaccagc

SEQ ID NO: 497003 - DNA, 25 bp, Mus musculus
aaacagctagagtccatcgaccagc

SEQ ID NO: 497004 - DNA, 25 bp, Mus musculus
aaacagctggcgcaacgaagcctcc

SEQ ID NO: 497005 - DNA, 25 bp, Mus musculus
aaacagctggcggaacgaagcctcc

SEQ ID NO: 497006 - DNA, 25 bp, Mus musculus
aaacagcttataattgagctcacag

SEQ ID NO: 497007 - DNA, 25 bp, Mus musculus
aaacagcttatatttgagctcacag

SEQ ID NO: 497008 - DNA, 25 bp, Mus musculus
aaacaggacaacattcaacagcagc

SEQ ID NO: 497009 - DNA, 25 bp, Mus musculus
aaacaggacaactttcaacagcagc

SEQ ID NO: 497010 - DNA, 25 bp, Mus musculus
aaacaggagacaatcacctttgcct

SEQ ID NO: 497011 - DNA, 25 bp, Mus musculus
aaacaggagacattcacctttgcct

SEQ ID NO: 497012 - DNA, 25 bp, Mus musculus
aaacaggccaggctccagggcagta

SEQ ID NO: 497013 - DNA, 25 bp, Mus musculus
aaacaggccagggtccagggcagta

SEQ ID NO: 497014 - DNA, 25 bp, Mus musculus
aaacaggcgctcagccctgacatgc

SEQ ID NO: 497015 - DNA, 25 bp, Mus musculus
aaacaggcgctctgccctgacatgc

SEQ ID NO: 497016 - DNA, 25 bp, Mus musculus
aaacaggctttcacaatcagtcaaa

SEQ ID NO: 497017 - DNA, 25 bp, Mus musculus
aaacaggctttctcaatcagtcaaa

SEQ ID NO: 497018 - DNA, 25 bp, Mus musculus
aaacagggaagaaactctggcaagg

SEQ ID NO: 497019 - DNA, 25 bp, Mus musculus
aaacagggaagatactctggcaagg

SEQ ID NO: 497020 - DNA, 25 bp, Mus musculus
aaacaggtaattccaaccacagttc

SEQ ID NO: 497021 - DNA, 25 bp, Mus musculus
aaacaggtaattgcaaccacagttc

SEQ ID NO: 497022 - DNA, 25 bp, Mus musculus
aaacagtccttaccggacaactcta

SEQ ID NO: 497023 - DNA, 25 bp, Mus musculus
aaacagtccttagcggacaactcta

SEQ ID NO: 497024 - DNA, 25 bp, Mus musculus
aaacagtcttatctgcgtgcagccc

SEQ ID NO: 497025 - DNA, 25 bp, Mus musculus
aaacagtcttatgtgcgtgcagccc

SEQ ID NO: 497026 - DNA, 25 bp, Mus musculus
aaacagtgacagaggagtcttgtca

SEQ ID NO: 497027 - DNA, 25 bp, Mus musculus
aaacagtgacagtggagtcttgtca

SEQ ID NO: 497028 - DNA, 25 bp, Mus musculus
aaacagttctatcgtgaccttgagg

SEQ ID NO: 497029 - DNA, 25 bp, Mus musculus
aaacagttctatggtgaccttgagg

SEQ ID NO: 497030 - DNA, 25 bp, Mus musculus
aaacagttgagaatctatttggagc

SEQ ID NO: 497031 - DNA, 25 bp, Mus musculus
aaacagttgagattctatttggagc

SEQ ID NO: 497032 - DNA, 25 bp, Mus musculus
aaacataagcctcagtgagctggta

SEQ ID NO: 497033 - DNA, 25 bp, Mus musculus
aaacataagcctgagtgagctggta

SEQ ID NO: 497034 - DNA, 25 bp, Mus musculus
aaacatacaagaaatgcccattcct

SEQ ID NO: 497035 - DNA, 25 bp, Mus musculus
aaacatacaagatatgcccattcct

SEQ ID NO: 497036 - DNA, 25 bp, Mus musculus
aaacatacctgcatccagataccca

SEQ ID NO: 497037 - DNA, 25 bp, Mus musculus
aaacatacctgcttccagataccca

SEQ ID NO: 497038 - DNA, 25 bp, Mus musculus
aaacatactgcacaaacaatcgtga

SEQ ID NO: 497039 - DNA, 25 bp, Mus musculus
aaacatactgcagaaacaatcgtga

SEQ ID NO: 497040 - DNA, 25 bp, Mus musculus
aaacatacttgaacagcctgccggg

SEQ ID NO: 497041 - DNA, 25 bp, Mus musculus
aaacatacttgatcagcctgccggg

SEQ ID NO: 497042 - DNA, 25 bp, Mus musculus
aaacataggactagaatgtgacaga

SEQ ID NO: 497043 - DNA, 25 bp, Mus musculus
aaacataggacttgaatgtgacaga

SEQ ID NO: 497044 - DNA, 25 bp, Mus musculus
aaacatcaatggattctcgacttca

SEQ ID NO: 497045 - DNA, 25 bp, Mus musculus
aaacatcaatggtttctcgacttca

SEQ ID NO: 497046 - DNA, 25 bp, Mus musculus
aaacatcatccaagactgagccagt

SEQ ID NO: 497047 - DNA, 25 bp, Mus musculus
aaacatcatccatgactgagccagt

SEQ ID NO: 497048 - DNA, 25 bp, Mus musculus
aaacatccaaagagctccgtggaga

SEQ ID NO: 497049 - DNA, 25 bp, Mus musculus
aaacatccaaagtgctccgtggaga

SEQ ID NO: 497050 - DNA, 25 bp, Mus musculus
aaacatccaggtcggagacctcatc

SEQ ID NO: 497051 - DNA, 25 bp, Mus musculus
aaacatccaggtgggagacctcatc

SEQ ID NO: 497052 - DNA, 25 bp, Mus musculus
aaacatccctggcaaaaacatttct

SEQ ID NO: 497053 - DNA, 25 bp, Mus musculus
aaacatccctgggaaaaacatttct

SEQ ID NO: 497054 - DNA, 25 bp, Mus musculus
aaacatctccttccatttttattgg

SEQ ID NO: 497055 - DNA, 25 bp, Mus musculus
aaacatctccttgcatttttattgg

SEQ ID NO: 497056 - DNA, 25 bp, Mus musculus
aaacatctggtgatgggtgacattc

SEQ ID NO: 497057 - DNA, 25 bp, Mus musculus
aaacatctggtgttgggtgacattc

SEQ ID NO: 497058 - DNA, 25 bp, Mus musculus
aaacatgagttcagagttcctgcgc

SEQ ID NO: 497059 - DNA, 25 bp, Mus musculus
aaacatgagttctgagttcctgcgc

SEQ ID NO: 497060 - DNA, 25 bp, Mus musculus
aaacatgcccttagcgcaggctacc

SEQ ID NO: 497061 - DNA, 25 bp, Mus musculus
aaacatgccctttgcgcaggctacc

SEQ ID NO: 497062 - DNA, 25 bp, Mus musculus
aaacatgccgtcagctgaagccaaa

SEQ ID NO: 497063 - DNA, 25 bp, Mus musculus
aaacatgccgtctgctgaagccaaa

SEQ ID NO: 497064 - DNA, 25 bp, Mus musculus
aaacatgcctgaaatcctgcaccat

SEQ ID NO: 497065 - DNA, 25 bp, Mus musculus
aaacatgcctgatatcctgcaccat

SEQ ID NO: 497066 - DNA, 25 bp, Mus musculus
aaacatgcgcacacagcaattgtgg

SEQ ID NO: 497067 - DNA, 25 bp, Mus musculus
aaacatgcgcactcagcaattgtgg

SEQ ID NO: 497068 - DNA, 25 bp, Mus musculus
aaacatggaagtatcccagctctgg

SEQ ID NO: 497069 - DNA, 25 bp, Mus musculus
aaacatggaagtttcccagctctgg

SEQ ID NO: 497070 - DNA, 25 bp, Mus musculus
aaacatggagaaaatggagccaata

SEQ ID NO: 497071 - DNA, 25 bp, Mus musculus
aaacatggagaatatggagccaata

SEQ ID NO: 497072 - DNA, 25 bp, Mus musculus
aaacatggctcgcaccttggagggc

SEQ ID NO: 497073 - DNA, 25 bp, Mus musculus
aaacatggctcggaccttggagggc

SEQ ID NO: 497074 - DNA, 25 bp, Mus musculus
aaacatggggaacactatgctggag

SEQ ID NO: 497075 - DNA, 25 bp, Mus musculus
aaacatggggaagactatgctggag

SEQ ID NO: 497076 - DNA, 25 bp, Mus musculus
aaacatgtaagcagccttatcgacg

SEQ ID NO: 497077 - DNA, 25 bp, Mus musculus
aaacatgtaagctgccttatcgacg

SEQ ID NO: 497078 - DNA, 25 bp, Mus musculus
aaacatgtctcaatccatagaagtc

SEQ ID NO: 497079 - DNA, 25 bp, Mus musculus
aaacatgtctcattccatagaagtc

SEQ ID NO: 497080 - DNA, 25 bp, Mus musculus
aaacatgtgggtcctgctggatata

SEQ ID NO: 497081 - DNA, 25 bp, Mus musculus
aaacatgtgggtgctgctggatata

SEQ ID NO: 497082 - DNA, 25 bp, Mus musculus
aaacattcactcattggagaagtga

SEQ ID NO: 497083 - DNA, 25 bp, Mus musculus
aaacattcactctttggagaagtga

SEQ ID NO: 497084 - DNA, 25 bp, Mus musculus
aaacattcctgacaagtggacccca

SEQ ID NO: 497085 - DNA, 25 bp, Mus musculus
aaacattcctgagaagtggacccca

SEQ ID NO: 497086 - DNA, 25 bp, Mus musculus
aaacattctaagcttttcaggacag

SEQ ID NO: 497087 - DNA, 25 bp, Mus musculus
aaacattctaaggttttcaggacag

SEQ ID NO: 497088 - DNA, 25 bp, Mus musculus
aaacattgaccacgccaagaagtcc

SEQ ID NO: 497089 - DNA, 25 bp, Mus musculus
aaacattgaccaggccaagaagtcc

SEQ ID NO: 497090 - DNA, 25 bp, Mus musculus
aaacattgcaaaagaagacatgctc

SEQ ID NO: 497091 - DNA, 25 bp, Mus musculus
aaacattgcaaatgaagacatgctc

SEQ ID NO: 497092 - DNA, 25 bp, Mus musculus
aaacattgcagactcgctagttgca

SEQ ID NO: 497093 - DNA, 25 bp, Mus musculus
aaacattgcagagtcgctagttgca

SEQ ID NO: 497094 - DNA, 25 bp, Mus musculus
aaacatttcagtccactagagggac

SEQ ID NO: 497095 - DNA, 25 bp, Mus musculus
aaacatttcagtgcactagagggac

SEQ ID NO: 497096 - DNA, 25 bp, Mus musculus
aaacattttcagctgccccttcctg

SEQ ID NO: 497097 - DNA, 25 bp, Mus musculus
aaacattttcaggtgccccttcctg

SEQ ID NO: 497098 - DNA, 25 bp, Mus musculus
aaacattttgaaaccttcaaacgcg

SEQ ID NO: 497099 - DNA, 25 bp, Mus musculus
aaacattttgaatccttcaaacgcg

SEQ ID NO: 497100 - DNA, 25 bp, Mus musculus
aaacattttgcacctgattacctca

SEQ ID NO: 497101 - DNA, 25 bp, Mus musculus
aaacattttgcagctgattacctca

SEQ ID NO: 497102 - DNA, 25 bp, Mus musculus
aaaccaaaccggagctgatcttcaa

SEQ ID NO: 497103 - DNA, 25 bp, Mus musculus
aaaccaaaccggtgctgatcttcaa

SEQ ID NO: 497104 - DNA, 25 bp, Mus musculus
aaaccaaatgcacagagtttgtgcc

SEQ ID NO: 497105 - DNA, 25 bp, Mus musculus
aaaccaaatgcagagagtttgtgcc

SEQ ID NO: 497106 - DNA, 25 bp, Mus musculus
aaaccaacagggaaaaagcagcact

SEQ ID NO: 497107 - DNA, 25 bp, Mus musculus
aaaccaacagggtaaaagcagcact

SEQ ID NO: 497108 - DNA, 25 bp, Mus musculus
aaaccaacatgcctccgaatcgggc

SEQ ID NO: 497109 - DNA, 25 bp, Mus musculus
aaaccaacatgcgtccgaatcgggc

SEQ ID NO: 497110 - DNA, 25 bp, Mus musculus
aaaccaacctgtatatccgaggact

SEQ ID NO: 497111 - DNA, 25 bp, Mus musculus
aaaccaacctgtttatccgaggact

SEQ ID NO: 497112 - DNA, 25 bp, Mus musculus
aaaccaacttgtagacaagatgaac

SEQ ID NO: 497113 - DNA, 25 bp, Mus musculus
aaaccaacttgttgacaagatgaac

SEQ ID NO: 497114 - DNA, 25 bp, Mus musculus
aaaccaagaaggaactgggcctgca

SEQ ID NO: 497115 - DNA, 25 bp, Mus musculus
aaaccaagaaggtactgggcctgca

SEQ ID NO: 497116 - DNA, 25 bp, Mus musculus
aaaccaagagcacaattcccattaa

SEQ ID NO: 497117 - DNA, 25 bp, Mus musculus
aaaccaagagcagaattcccattaa

SEQ ID NO: 497118 - DNA, 25 bp, Mus musculus
aaaccaagcaggcactgggctggaa

SEQ ID NO: 497119 - DNA, 25 bp, Mus musculus
aaaccaagcagggactgggctggaa

SEQ ID NO: 497120 - DNA, 25 bp, Mus musculus
aaaccaagtgcaaagtctatctatg

SEQ ID NO: 497121 - DNA, 25 bp, Mus musculus
aaaccaagtgcatagtctatctatg

SEQ ID NO: 497122 - DNA, 25 bp, Mus musculus
aaaccaagtgccattagctaaaggc

SEQ ID NO: 497123 - DNA, 25 bp, Mus musculus
aaaccaagtgcctttagctaaaggc

SEQ ID NO: 497124 - DNA, 25 bp, Mus musculus
aaaccaataaatcatctatggagag

SEQ ID NO: 497125 - DNA, 25 bp, Mus musculus
aaaccaataaatgatctatggagag

SEQ ID NO: 497126 - DNA, 25 bp, Mus musculus
aaaccaattaatctatctaccagac

SEQ ID NO: 497127 - DNA, 25 bp, Mus musculus
aaaccaattaatgtatctaccagac

SEQ ID NO: 497128 - DNA, 25 bp, Mus musculus
aaaccacacgtgaacctcactgcag

SEQ ID NO: 497129 - DNA, 25 bp, Mus musculus
aaaccacacgtgtacctcactgcag

SEQ ID NO: 497130 - DNA, 25 bp, Mus musculus
aaaccaccatcaaagctgaaccagg

SEQ ID NO: 497131 - DNA, 25 bp, Mus musculus
aaaccaccatcatagctgaaccagg

SEQ ID NO: 497132 - DNA, 25 bp, Mus musculus
aaaccaccatctctcgctttgaagc

SEQ ID NO: 497133 - DNA, 25 bp, Mus musculus
aaaccaccatctgtcgctttgaagc

SEQ ID NO: 497134 - DNA, 25 bp, Mus musculus
aaaccacgaagtaagctttcacgag

SEQ ID NO: 497135 - DNA, 25 bp, Mus musculus
aaaccacgaagttagctttcacgag

SEQ ID NO: 497136 - DNA, 25 bp, Mus musculus
aaaccactagatcactgccagaaac

SEQ ID NO: 497137 - DNA, 25 bp, Mus musculus
aaaccactagatgactgccagaaac

SEQ ID NO: 497138 - DNA, 25 bp, Mus musculus
aaaccagagaatccgtgtgaaccca

SEQ ID NO: 497139 - DNA, 25 bp, Mus musculus
aaaccagagaatgcgtgtgaaccca

SEQ ID NO: 497140 - DNA, 25 bp, Mus musculus
aaaccagatcccagacacaagctac

SEQ ID NO: 497141 - DNA, 25 bp, Mus musculus
aaaccagatccctgacacaagctac

SEQ ID NO: 497142 - DNA, 25 bp, Mus musculus
aaaccagccggccaatcagaatgca

SEQ ID NO: 497143 - DNA, 25 bp, Mus musculus
aaaccagccggcgaatcagaatgca

SEQ ID NO: 497144 - DNA, 25 bp, Mus musculus
aaaccagctctcattggaaatgaat

SEQ ID NO: 497145 - DNA, 25 bp, Mus musculus
aaaccagctctctttggaaatgaat

SEQ ID NO: 497146 - DNA, 25 bp, Mus musculus
aaaccagctctgaatagacggccag

SEQ ID NO: 497147 - DNA, 25 bp, Mus musculus
aaaccagctctgtatagacggccag

SEQ ID NO: 497148 - DNA, 25 bp, Mus musculus
aaaccagcttggacacgcccttgtc

SEQ ID NO: 497149 - DNA, 25 bp, Mus musculus
aaaccagcttggtcacgcccttgtc

SEQ ID NO: 497150 - DNA, 25 bp, Mus musculus
aaaccaggaagacatcattgacacc

SEQ ID NO: 497151 - DNA, 25 bp, Mus musculus
aaaccaggaagagatcattgacacc

SEQ ID NO: 497152 - DNA, 25 bp, Mus musculus
aaaccagggctgacagtagctctga

SEQ ID NO: 497153 - DNA, 25 bp, Mus musculus
aaaccagggctgtcagtagctctga

SEQ ID NO: 497154 - DNA, 25 bp, Mus musculus
aaaccaggtcataaccacgtggcag

SEQ ID NO: 497155 - DNA, 25 bp, Mus musculus
aaaccaggtcattaccacgtggcag

SEQ ID NO: 497156 - DNA, 25 bp, Mus musculus
aaaccagtgaccaccagatgaacca

SEQ ID NO: 497157 - DNA, 25 bp, Mus musculus
aaaccagtgacctccagatgaacca

SEQ ID NO: 497158 - DNA, 25 bp, Mus musculus
aaaccagtgagcacaaggaggctat

SEQ ID NO: 497159 - DNA, 25 bp, Mus musculus
aaaccagtgagctcaaggaggctat

SEQ ID NO: 497160 - DNA, 25 bp, Mus musculus
aaaccatcacggaaacacatttggt

SEQ ID NO: 497161 - DNA, 25 bp, Mus musculus
aaaccatcacggtaacacatttggt

SEQ ID NO: 497162 - DNA, 25 bp, Mus musculus
aaaccatccttgctacagcctagaa

SEQ ID NO: 497163 - DNA, 25 bp, Mus musculus
aaaccatccttggtacagcctagaa

SEQ ID NO: 497164 - DNA, 25 bp, Mus musculus
aaaccatctccaccaaatggctgtg

SEQ ID NO: 497165 - DNA, 25 bp, Mus musculus
aaaccatctccagcaaatggctgtg

SEQ ID NO: 497166 - DNA, 25 bp, Mus musculus
aaaccatgcttgcacattctgggca

SEQ ID NO: 497167 - DNA, 25 bp, Mus musculus
aaaccatgcttggacattctgggca

SEQ ID NO: 497168 - DNA, 25 bp, Mus musculus
aaaccatggaaaatgttcctgcagg

SEQ ID NO: 497169 - DNA, 25 bp, Mus musculus
aaaccatggaaattgttcctgcagg

SEQ ID NO: 497170 - DNA, 25 bp, Mus musculus
aaaccattcccaacgacggcgactt

SEQ ID NO: 497171 - DNA, 25 bp, Mus musculus
aaaccattcccatcgacggcgactt

SEQ ID NO: 497172 - DNA, 25 bp, Mus musculus
aaaccatttgtacggcttagagctg

SEQ ID NO: 497173 - DNA, 25 bp, Mus musculus
aaaccatttgtagggcttagagctg

SEQ ID NO: 497174 - DNA, 25 bp, Mus musculus
aaaccattttggaggatgagaaccg

SEQ ID NO: 497175 - DNA, 25 bp, Mus musculus
aaaccattttggtggatgagaaccg

SEQ ID NO: 497176 - DNA, 25 bp, Mus musculus
aaacccaaaccacatccattcaaag

SEQ ID NO: 497177 - DNA, 25 bp, Mus musculus
aaacccaaaccagatccattcaaag

SEQ ID NO: 497178 - DNA, 25 bp, Mus musculus
aaacccagaagactttcctgactga

SEQ ID NO: 497179 - DNA, 25 bp, Mus musculus
aaacccagaagagtttcctgactga

SEQ ID NO: 497180 - DNA, 25 bp, Mus musculus
aaacccagcacaatccacatggtct

SEQ ID NO: 497181 - DNA, 25 bp, Mus musculus
aaacccagcacattccacatggtct

SEQ ID NO: 497182 - DNA, 25 bp, Mus musculus
aaacccagcacgatcggtggtgacg

SEQ ID NO: 497183 - DNA, 25 bp, Mus musculus
aaacccagcacgttcggtggtgacg

SEQ ID NO: 497184 - DNA, 25 bp, Mus musculus
aaacccagtccgacgcagggctgga

SEQ ID NO: 497185 - DNA, 25 bp, Mus musculus
aaacccagtccgtcgcagggctgga

SEQ ID NO: 497186 - DNA, 25 bp, Mus musculus
aaacccagtcttcaataatccggcg

SEQ ID NO: 497187 - DNA, 25 bp, Mus musculus
aaacccagtcttgaataatccggcg

SEQ ID NO: 497188 - DNA, 25 bp, Mus musculus
aaacccatttgtcgaggacgacatg

SEQ ID NO: 497189 - DNA, 25 bp, Mus musculus
aaacccatttgtggaggacgacatg

SEQ ID NO: 497190 - DNA, 25 bp, Mus musculus
aaaccccagtccagaggaacataca

SEQ ID NO: 497191 - DNA, 25 bp, Mus musculus
aaaccccagtcctgaggaacataca

SEQ ID NO: 497192 - DNA, 25 bp, Mus musculus
aaacccctcaggatacagcctacaa

SEQ ID NO: 497193 - DNA, 25 bp, Mus musculus
aaacccctcaggttacagcctacaa

SEQ ID NO: 497194 - DNA, 25 bp, Mus musculus
aaacccctctgtactttagcaatag

SEQ ID NO: 497195 - DNA, 25 bp, Mus musculus
aaacccctctgttctttagcaatag

SEQ ID NO: 497196 - DNA, 25 bp, Mus musculus
aaacccctgagtcggtattctatgg

SEQ ID NO: 497197 - DNA, 25 bp, Mus musculus
aaacccctgagtgggtattctatgg

SEQ ID NO: 497198 - DNA, 25 bp, Mus musculus
aaacccgtgaagcacatgctggctg

SEQ ID NO: 497199 - DNA, 25 bp, Mus musculus
aaacccgtgaaggacatgctggctg

SEQ ID NO: 497200 - DNA, 25 bp, Mus musculus
aaacccgtgcggatgacgcatttgg

SEQ ID NO: 497201 - DNA, 25 bp, Mus musculus
aaacccgtgcggttgacgcatttgg

SEQ ID NO: 497202 - DNA, 25 bp, Mus musculus
aaaccctatatgctggactctgccg

SEQ ID NO: 497203 - DNA, 25 bp, Mus musculus
aaaccctatatggtggactctgccg

SEQ ID NO: 497204 - DNA, 25 bp, Mus musculus
aaaccctgagccacgcagggcagaa

SEQ ID NO: 497205 - DNA, 25 bp, Mus musculus
aaaccctgagcctcgcagggcagaa

SEQ ID NO: 497206 - DNA, 25 bp, Mus musculus
aaaccctggcgcattgggactcgct

SEQ ID NO: 497207 - DNA, 25 bp, Mus musculus
aaaccctggcgctttgggactcgct

SEQ ID NO: 497208 - DNA, 25 bp, Mus musculus
aaacccttgcagaacacaaggagct

SEQ ID NO: 497209 - DNA, 25 bp, Mus musculus
aaacccttgcagtacacaaggagct

SEQ ID NO: 497210 - DNA, 25 bp, Mus musculus
aaaccgaaagccagtgagtggcatg

SEQ ID NO: 497211 - DNA, 25 bp, Mus musculus
aaaccgaaagcctgtgagtggcatg

SEQ ID NO: 497212 - DNA, 25 bp, Mus musculus
aaaccgaatactccatgagtacaag

SEQ ID NO: 497213 - DNA, 25 bp, Mus musculus
aaaccgaatactgcatgagtacaag

SEQ ID NO: 497214 - DNA, 25 bp, Mus musculus
aaaccgaatagaccgagccactggc

SEQ ID NO: 497215 - DNA, 25 bp, Mus musculus
aaaccgaatagagcgagccactggc

SEQ ID NO: 497216 - DNA, 25 bp, Mus musculus
aaaccgacgccacaactttgaaatg

SEQ ID NO: 497217 - DNA, 25 bp, Mus musculus
aaaccgacgccagaactttgaaatg

SEQ ID NO: 497218 - DNA, 25 bp, Mus musculus
aaaccgagaagaagaggcgagagac

SEQ ID NO: 497219 - DNA, 25 bp, Mus musculus
aaaccgagaagatgaggcgagagac

SEQ ID NO: 497220 - DNA, 25 bp, Mus musculus
aaaccgagctttcatgctccagagc

SEQ ID NO: 497221 - DNA, 25 bp, Mus musculus
aaaccgagctttgatgctccagagc

SEQ ID NO: 497222 - DNA, 25 bp, Mus musculus
aaaccgaggcttcgacatgaaatcc

SEQ ID NO: 497223 - DNA, 25 bp, Mus musculus
aaaccgaggcttggacatgaaatcc

SEQ ID NO: 497224 - DNA, 25 bp, Mus musculus
aaaccgatacttctcacagctgaag

SEQ ID NO: 497225 - DNA, 25 bp, Mus musculus
aaaccgatacttgtcacagctgaag

SEQ ID NO: 497226 - DNA, 25 bp, Mus musculus
aaaccgattcgtcagtgttggacca

SEQ ID NO: 497227 - DNA, 25 bp, Mus musculus
aaaccgattcgtgagtgttggacca

SEQ ID NO: 497228 - DNA, 25 bp, Mus musculus
aaaccgcataccctgtgacttctgg

SEQ ID NO: 497229 - DNA, 25 bp, Mus musculus
aaaccgcataccgtgtgacttctgg

SEQ ID NO: 497230 - DNA, 25 bp, Mus musculus
aaaccgcccagaatacttagatctt

SEQ ID NO: 497231 - DNA, 25 bp, Mus musculus
aaaccgcccagattacttagatctt

SEQ ID NO: 497232 - DNA, 25 bp, Mus musculus
aaaccgcctggacgtgtcccagaat

SEQ ID NO: 497233 - DNA, 25 bp, Mus musculus
aaaccgcctggaggtgtcccagaat

SEQ ID NO: 497234 - DNA, 25 bp, Mus musculus
aaaccgccttcactgcttgctggct

SEQ ID NO: 497235 - DNA, 25 bp, Mus musculus
aaaccgccttcagtgcttgctggct

SEQ ID NO: 497236 - DNA, 25 bp, Mus musculus
aaaccgctgtttagcttagcatgga

SEQ ID NO: 497237 - DNA, 25 bp, Mus musculus
aaaccgctgttttgcttagcatgga

SEQ ID NO: 497238 - DNA, 25 bp, Mus musculus
aaaccgctttttcatgcgggccagg

SEQ ID NO: 497239 - DNA, 25 bp, Mus musculus
aaaccgctttttgatgcgggccagg

SEQ ID NO: 497240 - DNA, 25 bp, Mus musculus
aaaccggacatcaattgcttcatga

SEQ ID NO: 497241 - DNA, 25 bp, Mus musculus
aaaccggacatctattgcttcatga

SEQ ID NO: 497242 - DNA, 25 bp, Mus musculus
aaaccggagctgatcttcaatttgg

SEQ ID NO: 497243 - DNA, 25 bp, Mus musculus
aaaccggagctgttcttcaatttgg

SEQ ID NO: 497244 - DNA, 25 bp, Mus musculus
aaaccggcagttcccgatcgcgaat

SEQ ID NO: 497245 - DNA, 25 bp, Mus musculus
aaaccggcagttgccgatcgcgaat

SEQ ID NO: 497246 - DNA, 25 bp, Mus musculus
aaaccggccaccatggaggcgcagg

SEQ ID NO: 497247 - DNA, 25 bp, Mus musculus
aaaccggccaccttggaggcgcagg

SEQ ID NO: 497248 - DNA, 25 bp, Mus musculus
aaaccggctcttcgtgggccgcaag

SEQ ID NO: 497249 - DNA, 25 bp, Mus musculus
aaaccggctcttggtgggccgcaag

SEQ ID NO: 497250 - DNA, 25 bp, Mus musculus
aaaccggtaagaacaagtgcctatt

SEQ ID NO: 497251 - DNA, 25 bp, Mus musculus
aaaccggtaagatcaagtgcctatt

SEQ ID NO: 497252 - DNA, 25 bp, Mus musculus
aaaccgtgccttctggaaatgaact

SEQ ID NO: 497253 - DNA, 25 bp, Mus musculus
aaaccgtgccttgtggaaatgaact

SEQ ID NO: 497254 - DNA, 25 bp, Mus musculus
aaaccgtgggcaccagactgggtca

SEQ ID NO: 497255 - DNA, 25 bp, Mus musculus
aaaccgtgggcagcagactgggtca

SEQ ID NO: 497256 - DNA, 25 bp, Mus musculus
aaaccgtggtcaccgaacagtgcaa

SEQ ID NO: 497257 - DNA, 25 bp, Mus musculus
aaaccgtggtcagcgaacagtgcaa

SEQ ID NO: 497258 - DNA, 25 bp, Mus musculus
aaacctaaaggaactcagcggcggg

SEQ ID NO: 497259 - DNA, 25 bp, Mus musculus
aaacctaaaggatctcagcggcggg

SEQ ID NO: 497260 - DNA, 25 bp, Mus musculus
aaacctaaatcccaacctgcagaga

SEQ ID NO: 497261 - DNA, 25 bp, Mus musculus
aaacctaaatccgaacctgcagaga

SEQ ID NO: 497262 - DNA, 25 bp, Mus musculus
aaacctaatgtgaatgccacccggg

SEQ ID NO: 497263 - DNA, 25 bp, Mus musculus
aaacctaatgtgtatgccacccggg

SEQ ID NO: 497264 - DNA, 25 bp, Mus musculus
aaacctacagatagctgcctcttct

SEQ ID NO: 497265 - DNA, 25 bp, Mus musculus
aaacctacagattgctgcctcttct

SEQ ID NO: 497266 - DNA, 25 bp, Mus musculus
aaacctagcacccagaagaccaggg

SEQ ID NO: 497267 - DNA, 25 bp, Mus musculus
aaacctagcaccgagaagaccaggg

SEQ ID NO: 497268 - DNA, 25 bp, Mus musculus
aaacctatctaccatcaggaatccc

SEQ ID NO: 497269 - DNA, 25 bp, Mus musculus
aaacctatctacgatcaggaatccc

SEQ ID NO: 497270 - DNA, 25 bp, Mus musculus
aaacctcagacactgctcagcgttg

SEQ ID NO: 497271 - DNA, 25 bp, Mus musculus
aaacctcagacagtgctcagcgttg

SEQ ID NO: 497272 - DNA, 25 bp, Mus musculus
aaacctcagcgacctgatagaccgg

SEQ ID NO: 497273 - DNA, 25 bp, Mus musculus
aaacctcagcgagctgatagaccgg

SEQ ID NO: 497274 - DNA, 25 bp, Mus musculus
aaacctcaggatccacattttcagc

SEQ ID NO: 497275 - DNA, 25 bp, Mus musculus
aaacctcaggatgcacattttcagc

SEQ ID NO: 497276 - DNA, 25 bp, Mus musculus
aaacctcgtaggacagaagtgctcg

SEQ ID NO: 497277 - DNA, 25 bp, Mus musculus
aaacctcgtaggtcagaagtgctcg

SEQ ID NO: 497278 - DNA, 25 bp, Mus musculus
aaacctctaagactttaagctcaga

SEQ ID NO: 497279 - DNA, 25 bp, Mus musculus
aaacctctaagagtttaagctcaga

SEQ ID NO: 497280 - DNA, 25 bp, Mus musculus
aaacctctctttcaacatcactgag

SEQ ID NO: 497281 - DNA, 25 bp, Mus musculus
aaacctctctttgaacatcactgag

SEQ ID NO: 497282 - DNA, 25 bp, Mus musculus
aaacctctgatacctcttcaaaaag

SEQ ID NO: 497283 - DNA, 25 bp, Mus musculus
aaacctctgatagctcttcaaaaag

SEQ ID NO: 497284 - DNA, 25 bp, Mus musculus
aaacctgatattccctcccatagag

SEQ ID NO: 497285 - DNA, 25 bp, Mus musculus
aaacctgatattgcctcccatagag

SEQ ID NO: 497286 - DNA, 25 bp, Mus musculus
aaacctgattgtctgtgcgcaagtc

SEQ ID NO: 497287 - DNA, 25 bp, Mus musculus
aaacctgattgtgtgtgcgcaagtc

SEQ ID NO: 497288 - DNA, 25 bp, Mus musculus
aaacctgccagacttatgaacgccc

SEQ ID NO: 497289 - DNA, 25 bp, Mus musculus
aaacctgccagagttatgaacgccc

SEQ ID NO: 497290 - DNA, 25 bp, Mus musculus
aaacctgccccgatgactgatgaaa

SEQ ID NO: 497291 - DNA, 25 bp, Mus musculus
aaacctgccccgttgactgatgaaa

SEQ ID NO: 497292 - DNA, 25 bp, Mus musculus
aaacctgcccttccatatcttgatg

SEQ ID NO: 497293 - DNA, 25 bp, Mus musculus
aaacctgcccttgcatatcttgatg

SEQ ID NO: 497294 - DNA, 25 bp, Mus musculus
aaacctgcgaggatgacatcaatga

SEQ ID NO: 497295 - DNA, 25 bp, Mus musculus
aaacctgcgaggttgacatcaatga

SEQ ID NO: 497296 - DNA, 25 bp, Mus musculus
aaacctgctgttcgcgtatttggga

SEQ ID NO: 497297 - DNA, 25 bp, Mus musculus
aaacctgctgttggcgtatttggga

SEQ ID NO: 497298 - DNA, 25 bp, Mus musculus
aaacctggcaggcaacttcttagag

SEQ ID NO: 497299 - DNA, 25 bp, Mus musculus
aaacctggcagggaacttcttagag

SEQ ID NO: 497300 - DNA, 25 bp, Mus musculus
aaacctgggtctaccgcaggattgc

SEQ ID NO: 497301 - DNA, 25 bp, Mus musculus
aaacctgggtcttccgcaggattgc

SEQ ID NO: 497302 - DNA, 25 bp, Mus musculus
aaacctgggtgcctcaccaaattat

SEQ ID NO: 497303 - DNA, 25 bp, Mus musculus
aaacctgggtgcgtcaccaaattat

SEQ ID NO: 497304 - DNA, 25 bp, Mus musculus
aaacctgtgctgaatggagtggacc

SEQ ID NO: 497305 - DNA, 25 bp, Mus musculus
aaacctgtgctgtatggagtggacc

SEQ ID NO: 497306 - DNA, 25 bp, Mus musculus
aaacctgtggtccagataacactgc

SEQ ID NO: 497307 - DNA, 25 bp, Mus musculus
aaacctgtggtcgagataacactgc

SEQ ID NO: 497308 - DNA, 25 bp, Mus musculus
aaaccttgcacaatatgtgccttgg

SEQ ID NO: 497309 - DNA, 25 bp, Mus musculus
aaaccttgcacattatgtgccttgg

SEQ ID NO: 497310 - DNA, 25 bp, Mus musculus
aaaccttgcaccacgggccgcagtt

SEQ ID NO: 497311 - DNA, 25 bp, Mus musculus
aaaccttgcacctcgggccgcagtt

SEQ ID NO: 497312 - DNA, 25 bp, Mus musculus
aaaccttgctggaacttgtgattga

SEQ ID NO: 497313 - DNA, 25 bp, Mus musculus
aaaccttgctggtacttgtgattga

SEQ ID NO: 497314 - DNA, 25 bp, Mus musculus
aaaccttggcgcctctgctgtacat

SEQ ID NO: 497315 - DNA, 25 bp, Mus musculus
aaaccttggcgcgtctgctgtacat

SEQ ID NO: 497316 - DNA, 25 bp, Mus musculus
aaaccttgtcacacctgccgtgggt

SEQ ID NO: 497317 - DNA, 25 bp, Mus musculus
aaaccttgtcactcctgccgtgggt

SEQ ID NO: 497318 - DNA, 25 bp, Mus musculus
aaaccttgtctccaagaggcacctc

SEQ ID NO: 497319 - DNA, 25 bp, Mus musculus
aaaccttgtctcgaagaggcacctc

SEQ ID NO: 497320 - DNA, 25 bp, Mus musculus
aaacctttcacccttacactgtgcg

SEQ ID NO: 497321 - DNA, 25 bp, Mus musculus
aaacctttcaccgttacactgtgcg

SEQ ID NO: 497322 - DNA, 25 bp, Mus musculus
aaacctttctggagggcaatgtgga

SEQ ID NO: 497323 - DNA, 25 bp, Mus musculus
aaacctttctggtgggcaatgtgga

SEQ ID NO: 497324 - DNA, 25 bp, Mus musculus
aaaccttttaaaagggcagctcagc

SEQ ID NO: 497325 - DNA, 25 bp, Mus musculus
aaaccttttaaatgggcagctcagc

SEQ ID NO: 497326 - DNA, 25 bp, Mus musculus
aaacgaagccttccaccaagagtta

SEQ ID NO: 497327 - DNA, 25 bp, Mus musculus
aaacgaagccttgcaccaagagtta

SEQ ID NO: 497328 - DNA, 25 bp, Mus musculus
aaacgaagcttcatgggaaacagca

SEQ ID NO: 497329 - DNA, 25 bp, Mus musculus
aaacgaagcttcttgggaaacagca

SEQ ID NO: 497330 - DNA, 25 bp, Mus musculus
aaacgaataggaagacttgaagtgc

SEQ ID NO: 497331 - DNA, 25 bp, Mus musculus
aaacgaataggatgacttgaagtgc

SEQ ID NO: 497332 - DNA, 25 bp, Mus musculus
aaacgaatgtgactttctgggagga

SEQ ID NO: 497333 - DNA, 25 bp, Mus musculus
aaacgaatgtgagtttctgggagga

SEQ ID NO: 497334 - DNA, 25 bp, Mus musculus
aaacgacagtatcacgagagccatg

SEQ ID NO: 497335 - DNA, 25 bp, Mus musculus
aaacgacagtatgacgagagccatg

SEQ ID NO: 497336 - DNA, 25 bp, Mus musculus
aaacgaccacagcatcccctggtgg

SEQ ID NO: 497337 - DNA, 25 bp, Mus musculus
aaacgaccacaggatcccctggtgg

SEQ ID NO: 497338 - DNA, 25 bp, Mus musculus
aaacgaccactgatcctccgcagga

SEQ ID NO: 497339 - DNA, 25 bp, Mus musculus
aaacgaccactgttcctccgcagga

SEQ ID NO: 497340 - DNA, 25 bp, Mus musculus
aaacgaccggcacctggagtcttca

SEQ ID NO: 497341 - DNA, 25 bp, Mus musculus
aaacgaccggcagctggagtcttca

SEQ ID NO: 497342 - DNA, 25 bp, Mus musculus
aaacgacgggaaacagcctccagct

SEQ ID NO: 497343 - DNA, 25 bp, Mus musculus
aaacgacgggaatcagcctccagct

SEQ ID NO: 497344 - DNA, 25 bp, Mus musculus
aaacgactcagaagatccgcgcacg

SEQ ID NO: 497345 - DNA, 25 bp, Mus musculus
aaacgactcagatgatccgcgcacg

SEQ ID NO: 497346 - DNA, 25 bp, Mus musculus
aaacgagagaggaaatgactgggac

SEQ ID NO: 497347 - DNA, 25 bp, Mus musculus
aaacgagagaggtaatgactgggac

SEQ ID NO: 497348 - DNA, 25 bp, Mus musculus
aaacgagatgggaagaggcgcaccc

SEQ ID NO: 497349 - DNA, 25 bp, Mus musculus
aaacgagatgggtagaggcgcaccc

SEQ ID NO: 497350 - DNA, 25 bp, Mus musculus
aaacgagccactcccggcagaagcg

SEQ ID NO: 497351 - DNA, 25 bp, Mus musculus
aaacgagccactgccggcagaagcg

SEQ ID NO: 497352 - DNA, 25 bp, Mus musculus
aaacgaggcgccatccaccttgcag

SEQ ID NO: 497353 - DNA, 25 bp, Mus musculus
aaacgaggcgccttccaccttgcag

SEQ ID NO: 497354 - DNA, 25 bp, Mus musculus
aaacgaggctcactgcgactttgtg

SEQ ID NO: 497355 - DNA, 25 bp, Mus musculus
aaacgaggctcagtgcgactttgtg

SEQ ID NO: 497356 - DNA, 25 bp, Mus musculus
aaacgagtgtagaaggtatggaact

SEQ ID NO: 497357 - DNA, 25 bp, Mus musculus
aaacgagtgtagtaggtatggaact

SEQ ID NO: 497358 - DNA, 25 bp, Mus musculus
aaacgatacccacgctttatgcgag

SEQ ID NO: 497359 - DNA, 25 bp, Mus musculus
aaacgatacccaggctttatgcgag

SEQ ID NO: 497360 - DNA, 25 bp, Mus musculus
aaacgatcaatcattcctttaacag

SEQ ID NO: 497361 - DNA, 25 bp, Mus musculus
aaacgatcaatctttcctttaacag

SEQ ID NO: 497362 - DNA, 25 bp, Mus musculus
aaacgatgaccaccttgccttggcc

SEQ ID NO: 497363 - DNA, 25 bp, Mus musculus
aaacgatgaccagcttgccttggcc

SEQ ID NO: 497364 - DNA, 25 bp, Mus musculus
aaacgatgcaatcgcagcaggccct

SEQ ID NO: 497365 - DNA, 25 bp, Mus musculus
aaacgatgcaatggcagcaggccct

SEQ ID NO: 497366 - DNA, 25 bp, Mus musculus
aaacgatgctgtcctctgtgcggtg

SEQ ID NO: 497367 - DNA, 25 bp, Mus musculus
aaacgatgctgtgctctgtgcggtg

SEQ ID NO: 497368 - DNA, 25 bp, Mus musculus
aaacgatggaggacggagccagaac

SEQ ID NO: 497369 - DNA, 25 bp, Mus musculus
aaacgatggaggtcggagccagaac

SEQ ID NO: 497370 - DNA, 25 bp, Mus musculus
aaacgattagatatgttggtctctg

SEQ ID NO: 497371 - DNA, 25 bp, Mus musculus
aaacgattagatttgttggtctctg

SEQ ID NO: 497372 - DNA, 25 bp, Mus musculus
aaacgcagagttctagacacagaga

SEQ ID NO: 497373 - DNA, 25 bp, Mus musculus
aaacgcagagttgtagacacagaga

SEQ ID NO: 497374 - DNA, 25 bp, Mus musculus
aaacgccagagcaggattgtgggtg

SEQ ID NO: 497375 - DNA, 25 bp, Mus musculus
aaacgccagagcagggactatgacg

SEQ ID NO: 497376 - DNA, 25 bp, Mus musculus
aaacgccagagctggattgtgggtg

SEQ ID NO: 497377 - DNA, 25 bp, Mus musculus
aaacgccagagctgggactatgacg

SEQ ID NO: 497378 - DNA, 25 bp, Mus musculus
aaacgccagccaatctgaaaggata

SEQ ID NO: 497379 - DNA, 25 bp, Mus musculus
aaacgccagccattctgaaaggata

SEQ ID NO: 497380 - DNA, 25 bp, Mus musculus
aaacgccatccacattggtcacggg

SEQ ID NO: 497381 - DNA, 25 bp, Mus musculus
aaacgccatccagattggtcacggg

SEQ ID NO: 497382 - DNA, 25 bp, Mus musculus
aaacgctacgaacgccctctctgga

SEQ ID NO: 497383 - DNA, 25 bp, Mus musculus
aaacgctacgaaggccctctctgga

SEQ ID NO: 497384 - DNA, 25 bp, Mus musculus
aaacgctactttcaatgccaggcca

SEQ ID NO: 497385 - DNA, 25 bp, Mus musculus
aaacgctactttgaatgccaggcca

SEQ ID NO: 497386 - DNA, 25 bp, Mus musculus
aaacgctgcattcgcacagcagcgg

SEQ ID NO: 497387 - DNA, 25 bp, Mus musculus
aaacgctgcattggcacagcagcgg

SEQ ID NO: 497388 - DNA, 25 bp, Mus musculus
aaacgctgcgttaatgtacccacca

SEQ ID NO: 497389 - DNA, 25 bp, Mus musculus
aaacgctgcgtttatgtacccacca

SEQ ID NO: 497390 - DNA, 25 bp, Mus musculus
aaacgctgtcctctggtatggtctc

SEQ ID NO: 497391 - DNA, 25 bp, Mus musculus
aaacgctgtcctgtggtatggtctc

SEQ ID NO: 497392 - DNA, 25 bp, Mus musculus
aaacgcttggagattgggaagccag

SEQ ID NO: 497393 - DNA, 25 bp, Mus musculus
aaacgcttggagtttgggaagccag

SEQ ID NO: 497394 - DNA, 25 bp, Mus musculus
aaacggaactcacggcagaccaaca

SEQ ID NO: 497395 - DNA, 25 bp, Mus musculus
aaacggaactcagggcagaccaaca

SEQ ID NO: 497396 - DNA, 25 bp, Mus musculus
aaacggaagcgtccccgcaaggagc

SEQ ID NO: 497397 - DNA, 25 bp, Mus musculus
aaacggaagcgtgcccgcaaggagc

SEQ ID NO: 497398 - DNA, 25 bp, Mus musculus
aaacggacaactcggatacatgggc

SEQ ID NO: 497399 - DNA, 25 bp, Mus musculus
aaacggacaactgggatacatgggc

SEQ ID NO: 497400 - DNA, 25 bp, Mus musculus
aaacggaccatacccggagaacagc

SEQ ID NO: 497401 - DNA, 25 bp, Mus musculus
aaacggaccatagccggagaacagc

SEQ ID NO: 497402 - DNA, 25 bp, Mus musculus
aaacggagcagcaggtggtcttgcc

SEQ ID NO: 497403 - DNA, 25 bp, Mus musculus
aaacggagcagctggtggtcttgcc

SEQ ID NO: 497404 - DNA, 25 bp, Mus musculus
aaacggagccgacaccttggagctg

SEQ ID NO: 497405 - DNA, 25 bp, Mus musculus
aaacggagccgagaccttggagctg

SEQ ID NO: 497406 - DNA, 25 bp, Mus musculus
aaacggagctgtcagacctgccagg

SEQ ID NO: 497407 - DNA, 25 bp, Mus musculus
aaacggagctgtgagacctgccagg

SEQ ID NO: 497408 - DNA, 25 bp, Mus musculus
aaacggaggagcctgcattgctgcc

SEQ ID NO: 497409 - DNA, 25 bp, Mus musculus
aaacggaggagcgtgcattgctgcc

SEQ ID NO: 497410 - DNA, 25 bp, Mus musculus
aaacggaggcgcaagtcctgtcagg

SEQ ID NO: 497411 - DNA, 25 bp, Mus musculus
aaacggaggcgctagtcctgtcagg

SEQ ID NO: 497412 - DNA, 25 bp, Mus musculus
aaacggaggctgacagcacagctgc

SEQ ID NO: 497413 - DNA, 25 bp, Mus musculus
aaacggaggctgtcagcacagctgc

SEQ ID NO: 497414 - DNA, 25 bp, Mus musculus
aaacggagtaagcatgcataaattc

SEQ ID NO: 497415 - DNA, 25 bp, Mus musculus
aaacggagtaaggatgcataaattc

SEQ ID NO: 497416 - DNA, 25 bp, Mus musculus
aaacggatatacactgaacactggg

SEQ ID NO: 497417 - DNA, 25 bp, Mus musculus
aaacggatatactctgaacactggg

SEQ ID NO: 497418 - DNA, 25 bp, Mus musculus
aaacggattgttcacagagacctca

SEQ ID NO: 497419 - DNA, 25 bp, Mus musculus
aaacggattgttgacagagacctca

SEQ ID NO: 497420 - DNA, 25 bp, Mus musculus
aaacggattttcaggtattggccag

SEQ ID NO: 497421 - DNA, 25 bp, Mus musculus
aaacggattttctggtattggccag

SEQ ID NO: 497422 - DNA, 25 bp, Mus musculus
aaacggccatcgatcaagcaaatca

SEQ ID NO: 497423 - DNA, 25 bp, Mus musculus
aaacggccatcgttcaagcaaatca

SEQ ID NO: 497424 - DNA, 25 bp, Mus musculus
aaacggccgagcatttcagcagtgg

SEQ ID NO: 497425 - DNA, 25 bp, Mus musculus
aaacggccgagcttttcagcagtgg

SEQ ID NO: 497426 - DNA, 25 bp, Mus musculus
aaacggcctaggatcaggctgcctg

SEQ ID NO: 497427 - DNA, 25 bp, Mus musculus
aaacggcctaggttcaggctgcctg

SEQ ID NO: 497428 - DNA, 25 bp, Mus musculus
aaacggcgcgctcgctactcttgag

SEQ ID NO: 497429 - DNA, 25 bp, Mus musculus
aaacggcgcgctggctactcttgag

SEQ ID NO: 497430 - DNA, 25 bp, Mus musculus
aaacggcggagtcctaagaagatga

SEQ ID NO: 497431 - DNA, 25 bp, Mus musculus
aaacggcggagtgctaagaagatga

SEQ ID NO: 497432 - DNA, 25 bp, Mus musculus
aaacggcggcctatgccgcatccgg

SEQ ID NO: 497433 - DNA, 25 bp, Mus musculus
aaacggcggcctttgccgcatccgg

SEQ ID NO: 497434 - DNA, 25 bp, Mus musculus
aaacggctaaagaaagagcgaccag

SEQ ID NO: 497435 - DNA, 25 bp, Mus musculus
aaacggctaaagtaagagcgaccag

SEQ ID NO: 497436 - DNA, 25 bp, Mus musculus
aaacggctgaagaattacaacatgc

SEQ ID NO: 497437 - DNA, 25 bp, Mus musculus
aaacggctgaagtattacaacatgc

SEQ ID NO: 497438 - DNA, 25 bp, Mus musculus
aaacgggagatcaatgaccgctatg

SEQ ID NO: 497439 - DNA, 25 bp, Mus musculus
aaacgggagatctatgaccgctatg

SEQ ID NO: 497440 - DNA, 25 bp, Mus musculus
aaacgggccgcaagaccaagatcat

SEQ ID NO: 497441 - DNA, 25 bp, Mus musculus
aaacgggccgcatgaccaagatcat

SEQ ID NO: 497442 - DNA, 25 bp, Mus musculus
aaacggtcgcaacgtgaaatcatgg

SEQ ID NO: 497443 - DNA, 25 bp, Mus musculus
aaacggtcgcaaggtgaaatcatgg

SEQ ID NO: 497444 - DNA, 25 bp, Mus musculus
aaacggtggttcctgctgacgcaca

SEQ ID NO: 497445 - DNA, 25 bp, Mus musculus
aaacggtggttcgtgctgacgcaca

SEQ ID NO: 497446 - DNA, 25 bp, Mus musculus
aaacggttctatctgaaggaagtga

SEQ ID NO: 497447 - DNA, 25 bp, Mus musculus
aaacggttctatgtgaaggaagtga

SEQ ID NO: 497448 - DNA, 25 bp, Mus musculus
aaacgtcagctgattcttaggctgc

SEQ ID NO: 497449 - DNA, 25 bp, Mus musculus
aaacgtcagctgtttcttaggctgc

SEQ ID NO: 497450 - DNA, 25 bp, Mus musculus
aaacgtctgcatcgccttgatgaag

SEQ ID NO: 497451 - DNA, 25 bp, Mus musculus
aaacgtctgcatggccttgatgaag

SEQ ID NO: 497452 - DNA, 25 bp, Mus musculus
aaacgtgaatgcagtactcaccgaa

SEQ ID NO: 497453 - DNA, 25 bp, Mus musculus
aaacgtgaatgctgtactcaccgaa

SEQ ID NO: 497454 - DNA, 25 bp, Mus musculus
aaacgtgccaggatagcgaaagagc

SEQ ID NO: 497455 - DNA, 25 bp, Mus musculus
aaacgtgccaggttagcgaaagagc

SEQ ID NO: 497456 - DNA, 25 bp, Mus musculus
aaacgtgcccacaatcgacatccat

SEQ ID NO: 497457 - DNA, 25 bp, Mus musculus
aaacgtgcccactatcgacatccat

SEQ ID NO: 497458 - DNA, 25 bp, Mus musculus
aaacgtgcctgccagttcaaccgga

SEQ ID NO: 497459 - DNA, 25 bp, Mus musculus
aaacgtgcctgcgagttcaaccgga

SEQ ID NO: 497460 - DNA, 25 bp, Mus musculus
aaacgtgctcaaagatggtcctgcc

SEQ ID NO: 497461 - DNA, 25 bp, Mus musculus
aaacgtgctcaatgatggtcctgcc

SEQ ID NO: 497462 - DNA, 25 bp, Mus musculus
aaacgtggccctcaattccgctgtc

SEQ ID NO: 497463 - DNA, 25 bp, Mus musculus
aaacgtggccctgaattccgctgtc

SEQ ID NO: 497464 - DNA, 25 bp, Mus musculus
aaacgtggtatcacatctgaagaag

SEQ ID NO: 497465 - DNA, 25 bp, Mus musculus
aaacgtggtatctcatctgaagaag

SEQ ID NO: 497466 - DNA, 25 bp, Mus musculus
aaacgtggtggcatgtgagagcatt

SEQ ID NO: 497467 - DNA, 25 bp, Mus musculus
aaacgtggtggcttgtgagagcatt

SEQ ID NO: 497468 - DNA, 25 bp, Mus musculus
aaacgtgtccccacctggtgctctt

SEQ ID NO: 497469 - DNA, 25 bp, Mus musculus
aaacgtgtcccctcctggtgctctt

SEQ ID NO: 497470 - DNA, 25 bp, Mus musculus
aaactaagtgttctggatcaagaaa

SEQ ID NO: 497471 - DNA, 25 bp, Mus musculus
aaactaagtgttgtggatcaagaaa

SEQ ID NO: 497472 - DNA, 25 bp, Mus musculus
aaactaatccaacaagctcagcggg

SEQ ID NO: 497473 - DNA, 25 bp, Mus musculus
aaactaatccaagaagctcagcggg

SEQ ID NO: 497474 - DNA, 25 bp, Mus musculus
aaactaatgaagatggtggatcaaa

SEQ ID NO: 497475 - DNA, 25 bp, Mus musculus
aaactaatgaagttggtggatcaaa

SEQ ID NO: 497476 - DNA, 25 bp, Mus musculus
aaactaatgacccagttgtggcaca

SEQ ID NO: 497477 - DNA, 25 bp, Mus musculus
aaactaatgaccgagttgtggcaca

SEQ ID NO: 497478 - DNA, 25 bp, Mus musculus
aaactaccccaaaggatgcagacag

SEQ ID NO: 497479 - DNA, 25 bp, Mus musculus
aaactaccccaatggatgcagacag

SEQ ID NO: 497480 - DNA, 25 bp, Mus musculus
aaactacgggcgactcttcttcacg

SEQ ID NO: 497481 - DNA, 25 bp, Mus musculus
aaactacgggcgtctcttcttcacg

SEQ ID NO: 497482 - DNA, 25 bp, Mus musculus
aaactactgcccactctgatgctgg

SEQ ID NO: 497483 - DNA, 25 bp, Mus musculus
aaactactgccctctctgatgctgg

SEQ ID NO: 497484 - DNA, 25 bp, Mus musculus
aaactacttttcaggatctgtaaga

SEQ ID NO: 497485 - DNA, 25 bp, Mus musculus
aaactacttttctggatctgtaaga

SEQ ID NO: 497486 - DNA, 25 bp, Mus musculus
aaactagagacgcttccagaggaaa

SEQ ID NO: 497487 - DNA, 25 bp, Mus musculus
aaactagagacggttccagaggaaa

SEQ ID NO: 497488 - DNA, 25 bp, Mus musculus
aaactagagagaagcattctgagac

SEQ ID NO: 497489 - DNA, 25 bp, Mus musculus
aaactagagagatgcattctgagac

SEQ ID NO: 497490 - DNA, 25 bp, Mus musculus
aaactagagcgtcccacagcagctg

SEQ ID NO: 497491 - DNA, 25 bp, Mus musculus
aaactagagcgtgccacagcagctg

SEQ ID NO: 497492 - DNA, 25 bp, Mus musculus
aaactaggatcactgtgccgtagga

SEQ ID NO: 497493 - DNA, 25 bp, Mus musculus
aaactaggatcagtgtgccgtagga

SEQ ID NO: 497494 - DNA, 25 bp, Mus musculus
aaactagtaaagacagctctggcac

SEQ ID NO: 497495 - DNA, 25 bp, Mus musculus
aaactagtaaagtcagctctggcac

SEQ ID NO: 497496 - DNA, 25 bp, Mus musculus
aaactcaaagaccagggctgccggg

SEQ ID NO: 497497 - DNA, 25 bp, Mus musculus
aaactcaaagacgagggctgccggg

SEQ ID NO: 497498 - DNA, 25 bp, Mus musculus
aaactcaaattgatgataggaacaa

SEQ ID NO: 497499 - DNA, 25 bp, Mus musculus
aaactcaaattgttgataggaacaa

SEQ ID NO: 497500 - DNA, 25 bp, Mus musculus
aaactcaaggaccaggtgctgttgg

SEQ ID NO: 497501 - DNA, 25 bp, Mus musculus
aaactcaaggacgaggtgctgttgg

SEQ ID NO: 497502 - DNA, 25 bp, Mus musculus
aaactcaatgtgaaaggatcacctg

SEQ ID NO: 497503 - DNA, 25 bp, Mus musculus
aaactcaatgtgtaaggatcacctg

SEQ ID NO: 497504 - DNA, 25 bp, Mus musculus
aaactcacatccagctggtgctggc

SEQ ID NO: 497505 - DNA, 25 bp, Mus musculus
aaactcacatcctgctggtgctggc

SEQ ID NO: 497506 - DNA, 25 bp, Mus musculus
aaactcactgcacaagaatttatcc

SEQ ID NO: 497507 - DNA, 25 bp, Mus musculus
aaactcactgcagaagaatttatcc

SEQ ID NO: 497508 - DNA, 25 bp, Mus musculus
aaactcagagagattaaggacctcc

SEQ ID NO: 497509 - DNA, 25 bp, Mus musculus
aaactcagagagtttaaggacctcc

SEQ ID NO: 497510 - DNA, 25 bp, Mus musculus
aaactcagccagcttctgcagttga

SEQ ID NO: 497511 - DNA, 25 bp, Mus musculus
aaactcagccagcttgtcaggtctc

SEQ ID NO: 497512 - DNA, 25 bp, Mus musculus
aaactcagccaggttctgcagttga

SEQ ID NO: 497513 - DNA, 25 bp, Mus musculus
aaactcagccaggttgtcaggtctc

SEQ ID NO: 497514 - DNA, 25 bp, Mus musculus
aaactcagtatcaccaagtccccgg

SEQ ID NO: 497515 - DNA, 25 bp, Mus musculus
aaactcagtatctccaagtccccgg

SEQ ID NO: 497516 - DNA, 25 bp, Mus musculus
aaactcagtgccaagcgggcccacg

SEQ ID NO: 497517 - DNA, 25 bp, Mus musculus
aaactcagtgcccaacttgttgcgt

SEQ ID NO: 497518 - DNA, 25 bp, Mus musculus
aaactcagtgccgaacttgttgcgt

SEQ ID NO: 497519 - DNA, 25 bp, Mus musculus
aaactcagtgcctagcgggcccacg

SEQ ID NO: 497520 - DNA, 25 bp, Mus musculus
aaactcattgctcgtaccctgggcc

SEQ ID NO: 497521 - DNA, 25 bp, Mus musculus
aaactcattgctggtaccctgggcc

SEQ ID NO: 497522 - DNA, 25 bp, Mus musculus
aaactccagcttatggaaaagcacc

SEQ ID NO: 497523 - DNA, 25 bp, Mus musculus
aaactccagcttttggaaaagcacc

SEQ ID NO: 497524 - DNA, 25 bp, Mus musculus
aaactcccatctagactatcccaaa

SEQ ID NO: 497525 - DNA, 25 bp, Mus musculus
aaactcccatcttgactatcccaaa

SEQ ID NO: 497526 - DNA, 25 bp, Mus musculus
aaactccgccacatctggaacctga

SEQ ID NO: 497527 - DNA, 25 bp, Mus musculus
aaactccgccacttctggaacctga

SEQ ID NO: 497528 - DNA, 25 bp, Mus musculus
aaactccgggtcctggctcctgcgg

SEQ ID NO: 497529 - DNA, 25 bp, Mus musculus
aaactccgggtcgtggctcctgcgg

SEQ ID NO: 497530 - DNA, 25 bp, Mus musculus
aaactccgtcggatgccagaggtgc

SEQ ID NO: 497531 - DNA, 25 bp, Mus musculus
aaactccgtcggttgccagaggtgc

SEQ ID NO: 497532 - DNA, 25 bp, Mus musculus
aaactcctcgatcttgtccatcctg

SEQ ID NO: 497533 - DNA, 25 bp, Mus musculus
aaactcctcgatgttgtccatcctg

SEQ ID NO: 497534 - DNA, 25 bp, Mus musculus
aaactcctcgtcaagatgggctatg

SEQ ID NO: 497535 - DNA, 25 bp, Mus musculus
aaactcctcgtctagatgggctatg

SEQ ID NO: 497536 - DNA, 25 bp, Mus musculus
aaactcctctgtacatgtcgtcatg

SEQ ID NO: 497537 - DNA, 25 bp, Mus musculus
aaactcctctgttcatgtcgtcatg

SEQ ID NO: 497538 - DNA, 25 bp, Mus musculus
aaactcctggcgcagacggcagata

SEQ ID NO: 497539 - DNA, 25 bp, Mus musculus
aaactcctggcggagacggcagata

SEQ ID NO: 497540 - DNA, 25 bp, Mus musculus
aaactccttacgcactgcaactcag

SEQ ID NO: 497541 - DNA, 25 bp, Mus musculus
aaactccttacggactgcaactcag

SEQ ID NO: 497542 - DNA, 25 bp, Mus musculus
aaactcgggatgacctggcaaggtt

SEQ ID NO: 497543 - DNA, 25 bp, Mus musculus
aaactcgggatgtcctggcaaggtt

SEQ ID NO: 497544 - DNA, 25 bp, Mus musculus
aaactctaaaatccacctgccagtg

SEQ ID NO: 497545 - DNA, 25 bp, Mus musculus
aaactctaaaatgcacctgccagtg

SEQ ID NO: 497546 - DNA, 25 bp, Mus musculus
aaactctagaggctcagtgcacaca

SEQ ID NO: 497547 - DNA, 25 bp, Mus musculus
aaactctagagggtcagtgcacaca

SEQ ID NO: 497548 - DNA, 25 bp, Mus musculus
aaactctgatctccaccctatgcga

SEQ ID NO: 497549 - DNA, 25 bp, Mus musculus
aaactctgatctgcaccctatgcga

SEQ ID NO: 497550 - DNA, 25 bp, Mus musculus
aaactctgtgatcggcttgaactag

SEQ ID NO: 497551 - DNA, 25 bp, Mus musculus
aaactctgtgatgggcttgaactag

SEQ ID NO: 497552 - DNA, 25 bp, Mus musculus
aaactctgtggaatgggtcctggaa

SEQ ID NO: 497553 - DNA, 25 bp, Mus musculus
aaactctgtggattgggtcctggaa

SEQ ID NO: 497554 - DNA, 25 bp, Mus musculus
aaactcttcagcattagagcctatg

SEQ ID NO: 497555 - DNA, 25 bp, Mus musculus
aaactcttcagctttagagcctatg

SEQ ID NO: 497556 - DNA, 25 bp, Mus musculus
aaactcttccggctccggatgcaag

SEQ ID NO: 497557 - DNA, 25 bp, Mus musculus
aaactcttccgggtccggatgcaag

SEQ ID NO: 497558 - DNA, 25 bp, Mus musculus
aaactgaagaatagcctccagttgc

SEQ ID NO: 497559 - DNA, 25 bp, Mus musculus
aaactgaagaattgcctccagttgc

SEQ ID NO: 497560 - DNA, 25 bp, Mus musculus
aaactgaagagcaattacactgacc

SEQ ID NO: 497561 - DNA, 25 bp, Mus musculus
aaactgaagagctattacactgacc

SEQ ID NO: 497562 - DNA, 25 bp, Mus musculus
aaactgacagtgagcaccaactgaa

SEQ ID NO: 497563 - DNA, 25 bp, Mus musculus
aaactgacagtgtgcaccaactgaa

SEQ ID NO: 497564 - DNA, 25 bp, Mus musculus
aaactgacctggctttctcgggatt

SEQ ID NO: 497565 - DNA, 25 bp, Mus musculus
aaactgacctgggtttctcgggatt

SEQ ID NO: 497566 - DNA, 25 bp, Mus musculus
aaactgactcacctacaacaactgg

SEQ ID NO: 497567 - DNA, 25 bp, Mus musculus
aaactgactcacgtacaacaactgg

SEQ ID NO: 497568 - DNA, 25 bp, Mus musculus
aaactgaggcaaaaatgatggttgc

SEQ ID NO: 497569 - DNA, 25 bp, Mus musculus
aaactgaggcaataatgatggttgc

SEQ ID NO: 497570 - DNA, 25 bp, Mus musculus
aaactgaggccgaatggagccccag

SEQ ID NO: 497571 - DNA, 25 bp, Mus musculus
aaactgaggccgtatggagccccag

SEQ ID NO: 497572 - DNA, 25 bp, Mus musculus
aaactgaggctccttgaggagcttg

SEQ ID NO: 497573 - DNA, 25 bp, Mus musculus
aaactgaggctcgttgaggagcttg

SEQ ID NO: 497574 - DNA, 25 bp, Mus musculus
aaactgagtttacaaggagatacca

SEQ ID NO: 497575 - DNA, 25 bp, Mus musculus
aaactgagtttagaaggagatacca

SEQ ID NO: 497576 - DNA, 25 bp, Mus musculus
aaactgataggcctgtgcacacaaa

SEQ ID NO: 497577 - DNA, 25 bp, Mus musculus
aaactgataggcgtgtgcacacaaa

SEQ ID NO: 497578 - DNA, 25 bp, Mus musculus
aaactgatcccaaagatagagtacc

SEQ ID NO: 497579 - DNA, 25 bp, Mus musculus
aaactgatcccatagatagagtacc

SEQ ID NO: 497580 - DNA, 25 bp, Mus musculus
aaactgatgaagcaaattggtgtga

SEQ ID NO: 497581 - DNA, 25 bp, Mus musculus
aaactgatgaaggaaattggtgtga

SEQ ID NO: 497582 - DNA, 25 bp, Mus musculus
aaactgatgagaatttcccaaatac

SEQ ID NO: 497583 - DNA, 25 bp, Mus musculus
aaactgatgagattttcccaaatac

SEQ ID NO: 497584 - DNA, 25 bp, Mus musculus
aaactgattgacatcatggcatctc

SEQ ID NO: 497585 - DNA, 25 bp, Mus musculus
aaactgattgacttcatggcatctc

SEQ ID NO: 497586 - DNA, 25 bp, Mus musculus
aaactgcaagatcccagcagatcag

SEQ ID NO: 497587 - DNA, 25 bp, Mus musculus
aaactgcaagatgccagcagatcag

SEQ ID NO: 497588 - DNA, 25 bp, Mus musculus
aaactgcaggcgcttttctgcctcc

SEQ ID NO: 497589 - DNA, 25 bp, Mus musculus
aaactgcaggcggttttctgcctcc

SEQ ID NO: 497590 - DNA, 25 bp, Mus musculus
aaactgccccgtcgcctgagagcat

SEQ ID NO: 497591 - DNA, 25 bp, Mus musculus
aaactgccccgtggcctgagagcat

SEQ ID NO: 497592 - DNA, 25 bp, Mus musculus
aaactgccccttatcacagaggctc

SEQ ID NO: 497593 - DNA, 25 bp, Mus musculus
aaactgccccttttcacagaggctc

SEQ ID NO: 497594 - DNA, 25 bp, Mus musculus
aaactgcgtggtccggatcaagcca

SEQ ID NO: 497595 - DNA, 25 bp, Mus musculus
aaactgcgtggtgcggatcaagcca

SEQ ID NO: 497596 - DNA, 25 bp, Mus musculus
aaactgctcttcattgagacccagg

SEQ ID NO: 497597 - DNA, 25 bp, Mus musculus
aaactgctcttctttgagacccagg

SEQ ID NO: 497598 - DNA, 25 bp, Mus musculus
aaactgctgtcaatcagagatgtgg

SEQ ID NO: 497599 - DNA, 25 bp, Mus musculus
aaactgctgtcattcagagatgtgg

SEQ ID NO: 497600 - DNA, 25 bp, Mus musculus
aaactgcttattctgccaatcccgc

SEQ ID NO: 497601 - DNA, 25 bp, Mus musculus
aaactgcttattgtgccaatcccgc

SEQ ID NO: 497602 - DNA, 25 bp, Mus musculus
aaactgctttatcccagtcccttgg

SEQ ID NO: 497603 - DNA, 25 bp, Mus musculus
aaactgctttatgccagtcccttgg

SEQ ID NO: 497604 - DNA, 25 bp, Mus musculus
aaactgctttttcaatgaaggtata

SEQ ID NO: 497605 - DNA, 25 bp, Mus musculus
aaactgctttttgaatgaaggtata

SEQ ID NO: 497606 - DNA, 25 bp, Mus musculus
aaactggaaagaccgagaagtgtgc

SEQ ID NO: 497607 - DNA, 25 bp, Mus musculus
aaactggaaagagcgagaagtgtgc

SEQ ID NO: 497608 - DNA, 25 bp, Mus musculus
aaactggacacgagcttcaagatcc

SEQ ID NO: 497609 - DNA, 25 bp, Mus musculus
aaactggacacgtgcttcaagatcc

SEQ ID NO: 497610 - DNA, 25 bp, Mus musculus
aaactggactctccagtttacaaga

SEQ ID NO: 497611 - DNA, 25 bp, Mus musculus
aaactggactctgcagtttacaaga

SEQ ID NO: 497612 - DNA, 25 bp, Mus musculus
aaactggagcgacatttaaagcggc

SEQ ID NO: 497613 - DNA, 25 bp, Mus musculus
aaactggagcgagatttaaagcggc

SEQ ID NO: 497614 - DNA, 25 bp, Mus musculus
aaactggagtttcgaagcttctggg

SEQ ID NO: 497615 - DNA, 25 bp, Mus musculus
aaactggagtttggaagcttctggg

SEQ ID NO: 497616 - DNA, 25 bp, Mus musculus
aaactggatcttcggacacctaggc

SEQ ID NO: 497617 - DNA, 25 bp, Mus musculus
aaactggatcttgggacacctaggc

SEQ ID NO: 497618 - DNA, 25 bp, Mus musculus
aaactggcccgtcctgacagtgacg

SEQ ID NO: 497619 - DNA, 25 bp, Mus musculus
aaactggcccgtgctgacagtgacg

SEQ ID NO: 497620 - DNA, 25 bp, Mus musculus
aaactggcgtgtcagtaactgaata

SEQ ID NO: 497621 - DNA, 25 bp, Mus musculus
aaactggcgtgtgagtaactgaata

SEQ ID NO: 497622 - DNA, 25 bp, Mus musculus
aaactggcttctcatttgtcttccg

SEQ ID NO: 497623 - DNA, 25 bp, Mus musculus
aaactggcttctgatttgtcttccg

SEQ ID NO: 497624 - DNA, 25 bp, Mus musculus
aaactgggaaagcttcaatattcac

SEQ ID NO: 497625 - DNA, 25 bp, Mus musculus
aaactgggaaaggttcaatattcac

SEQ ID NO: 497626 - DNA, 25 bp, Mus musculus
aaactgggctcacctggaccaactg

SEQ ID NO: 497627 - DNA, 25 bp, Mus musculus
aaactgggctcagctggaccaactg

SEQ ID NO: 497628 - DNA, 25 bp, Mus musculus
aaactggtaatcagcctaggtgacg

SEQ ID NO: 497629 - DNA, 25 bp, Mus musculus
aaactggtaatctgcctaggtgacg

SEQ ID NO: 497630 - DNA, 25 bp, Mus musculus
aaactggtctgcacggcaagtgtga

SEQ ID NO: 497631 - DNA, 25 bp, Mus musculus
aaactggtctgctcggcaagtgtga

SEQ ID NO: 497632 - DNA, 25 bp, Mus musculus
aaactggtgtgcctcttcttgttcg

SEQ ID NO: 497633 - DNA, 25 bp, Mus musculus
aaactggtgtgcgtcttcttgttcg

SEQ ID NO: 497634 - DNA, 25 bp, Mus musculus
aaactgtagaggactccccacctct

SEQ ID NO: 497635 - DNA, 25 bp, Mus musculus
aaactgtagaggtctccccacctct

SEQ ID NO: 497636 - DNA, 25 bp, Mus musculus
aaactgtagggcaatttgctacgcc

SEQ ID NO: 497637 - DNA, 25 bp, Mus musculus
aaactgtagggctatttgctacgcc

SEQ ID NO: 497638 - DNA, 25 bp, Mus musculus
aaactgtatataacttgctctctga

SEQ ID NO: 497639 - DNA, 25 bp, Mus musculus
aaactgtatatatcttgctctctga

SEQ ID NO: 497640 - DNA, 25 bp, Mus musculus
aaactgtcccgtcagtgttggcgac

SEQ ID NO: 497641 - DNA, 25 bp, Mus musculus
aaactgtcccgtgagtgttggcgac

SEQ ID NO: 497642 - DNA, 25 bp, Mus musculus
aaactgtcccttagggtggcctgag

SEQ ID NO: 497643 - DNA, 25 bp, Mus musculus
aaactgtccctttgggtggcctgag

SEQ ID NO: 497644 - DNA, 25 bp, Mus musculus
aaactgtgaccgcaacggcaacttc

SEQ ID NO: 497645 - DNA, 25 bp, Mus musculus
aaactgtgaccggaacggcaacttc

SEQ ID NO: 497646 - DNA, 25 bp, Mus musculus
aaactgtgagtgactgttccccaca

SEQ ID NO: 497647 - DNA, 25 bp, Mus musculus
aaactgtgagtgtctgttccccaca

SEQ ID NO: 497648 - DNA, 25 bp, Mus musculus
aaactgtgcgcaaggcagccatcaa

SEQ ID NO: 497649 - DNA, 25 bp, Mus musculus
aaactgtgcgcatggcagccatcaa

SEQ ID NO: 497650 - DNA, 25 bp, Mus musculus
aaactgtgctcaacttggcttatgc

SEQ ID NO: 497651 - DNA, 25 bp, Mus musculus
aaactgtgctcatcttggcttatgc

SEQ ID NO: 497652 - DNA, 25 bp, Mus musculus
aaactgtggtagaggtgccacaagt

SEQ ID NO: 497653 - DNA, 25 bp, Mus musculus
aaactgtggtagtggtgccacaagt

SEQ ID NO: 497654 - DNA, 25 bp, Mus musculus
aaactgtgtaacatattcagcacca

SEQ ID NO: 497655 - DNA, 25 bp, Mus musculus
aaactgtgtaacttattcagcacca

SEQ ID NO: 497656 - DNA, 25 bp, Mus musculus
aaactgtgttccctcacaggtatgg

SEQ ID NO: 497657 - DNA, 25 bp, Mus musculus
aaactgtgttccgtcacaggtatgg

SEQ ID NO: 497658 - DNA, 25 bp, Mus musculus
aaactgttagaaagcagataccatc

SEQ ID NO: 497659 - DNA, 25 bp, Mus musculus
aaactgttagaatgcagataccatc

SEQ ID NO: 497660 - DNA, 25 bp, Mus musculus
aaactgttccctcagtcagtcatca

SEQ ID NO: 497661 - DNA, 25 bp, Mus musculus
aaactgttccctgagtcagtcatca

SEQ ID NO: 497662 - DNA, 25 bp, Mus musculus
aaactgttgcagcagcacgacattg

SEQ ID NO: 497663 - DNA, 25 bp, Mus musculus
aaactgttgcaggagcacgacattg

SEQ ID NO: 497664 - DNA, 25 bp, Mus musculus
aaactgttggccaacagggcctggc

SEQ ID NO: 497665 - DNA, 25 bp, Mus musculus
aaactgttggcctacagggcctggc

SEQ ID NO: 497666 - DNA, 25 bp, Mus musculus
aaactgtttgtgctccctacggatg

SEQ ID NO: 497667 - DNA, 25 bp, Mus musculus
aaactgtttgtggtccctacggatg

SEQ ID NO: 497668 - DNA, 25 bp, Mus musculus
aaacttacaagtagcaggagcgttc

SEQ ID NO: 497669 - DNA, 25 bp, Mus musculus
aaacttacaagttgcaggagcgttc

SEQ ID NO: 497670 - DNA, 25 bp, Mus musculus
aaacttacctggaagcccactggat

SEQ ID NO: 497671 - DNA, 25 bp, Mus musculus
aaacttacctggtagcccactggat

SEQ ID NO: 497672 - DNA, 25 bp, Mus musculus
aaacttatctacagctcacggaccg

SEQ ID NO: 497673 - DNA, 25 bp, Mus musculus
aaacttatctactgctcacggaccg

SEQ ID NO: 497674 - DNA, 25 bp, Mus musculus
aaacttcaaagtcccagggcggtgg

SEQ ID NO: 497675 - DNA, 25 bp, Mus musculus
aaacttcaaagtgccagggcggtgg

SEQ ID NO: 497676 - DNA, 25 bp, Mus musculus
aaacttcaacatctgcctggagcgg

SEQ ID NO: 497677 - DNA, 25 bp, Mus musculus
aaacttcaacatgtgcctggagcgg

SEQ ID NO: 497678 - DNA, 25 bp, Mus musculus
aaacttcacctgagcaaggagaatg

SEQ ID NO: 497679 - DNA, 25 bp, Mus musculus
aaacttcacctgtgcaaggagaatg

SEQ ID NO: 497680 - DNA, 25 bp, Mus musculus
aaacttcaggatatcaggtgtcgac

SEQ ID NO: 497681 - DNA, 25 bp, Mus musculus
aaacttcaggatttcaggtgtcgac

SEQ ID NO: 497682 - DNA, 25 bp, Mus musculus
aaacttcagtcaactgatctgagag

SEQ ID NO: 497683 - DNA, 25 bp, Mus musculus
aaacttcagtcatctgatctgagag

SEQ ID NO: 497684 - DNA, 25 bp, Mus musculus
aaacttcattctccctaggaggcgc

SEQ ID NO: 497685 - DNA, 25 bp, Mus musculus
aaacttcattctgcctaggaggcgc

SEQ ID NO: 497686 - DNA, 25 bp, Mus musculus
aaacttccagagaccctagaggacg

SEQ ID NO: 497687 - DNA, 25 bp, Mus musculus
aaacttccagagtccctagaggacg

SEQ ID NO: 497688 - DNA, 25 bp, Mus musculus
aaacttccatggagaatacccagcc

SEQ ID NO: 497689 - DNA, 25 bp, Mus musculus
aaacttccatggtgaatacccagcc

SEQ ID NO: 497690 - DNA, 25 bp, Mus musculus
aaacttccgagtcctctctgcaaag

SEQ ID NO: 497691 - DNA, 25 bp, Mus musculus
aaacttccgagtgctctctgcaaag

SEQ ID NO: 497692 - DNA, 25 bp, Mus musculus
aaacttcgttctcgtgttcgctggg

SEQ ID NO: 497693 - DNA, 25 bp, Mus musculus
aaacttcgttctggtgttcgctggg

SEQ ID NO: 497694 - DNA, 25 bp, Mus musculus
aaacttctaagaagagaggctacac

SEQ ID NO: 497695 - DNA, 25 bp, Mus musculus
aaacttctaagatgagaggctacac

SEQ ID NO: 497696 - DNA, 25 bp, Mus musculus
aaacttctcatcaggagtaggcacc

SEQ ID NO: 497697 - DNA, 25 bp, Mus musculus
aaacttctcatctggagtaggcacc

SEQ ID NO: 497698 - DNA, 25 bp, Mus musculus
aaacttctctatagccgaaaagaag

SEQ ID NO: 497699 - DNA, 25 bp, Mus musculus
aaacttctctattgccgaaaagaag

SEQ ID NO: 497700 - DNA, 25 bp, Mus musculus
aaacttgactgacccatctgtaata

SEQ ID NO: 497701 - DNA, 25 bp, Mus musculus
aaacttgactgagccatctgtaata

SEQ ID NO: 497702 - DNA, 25 bp, Mus musculus
aaacttgcacaaactaatggctggg

SEQ ID NO: 497703 - DNA, 25 bp, Mus musculus
aaacttgcacaatctaatggctggg

SEQ ID NO: 497704 - DNA, 25 bp, Mus musculus
aaacttgcgccacagaaacacaaat

SEQ ID NO: 497705 - DNA, 25 bp, Mus musculus
aaacttgcgccagagaaacacaaat

SEQ ID NO: 497706 - DNA, 25 bp, Mus musculus
aaacttggacgtattgccttgggct

SEQ ID NO: 497707 - DNA, 25 bp, Mus musculus
aaacttggacgttttgccttgggct

SEQ ID NO: 497708 - DNA, 25 bp, Mus musculus
aaacttggccgcaaagatgctgaga

SEQ ID NO: 497709 - DNA, 25 bp, Mus musculus
aaacttggccgctaagatgctgaga

SEQ ID NO: 497710 - DNA, 25 bp, Mus musculus
aaacttggcctcctcgccttgatca

SEQ ID NO: 497711 - DNA, 25 bp, Mus musculus
aaacttggcctcgtcgccttgatca

SEQ ID NO: 497712 - DNA, 25 bp, Mus musculus
aaacttgggccacggtgtcatggtc

SEQ ID NO: 497713 - DNA, 25 bp, Mus musculus
aaacttgggccagggtgtcatggtc

SEQ ID NO: 497714 - DNA, 25 bp, Mus musculus
aaacttggtccactgagttacaaag

SEQ ID NO: 497715 - DNA, 25 bp, Mus musculus
aaacttggtccagtgagttacaaag

SEQ ID NO: 497716 - DNA, 25 bp, Mus musculus
aaacttgtcatgaagaactatggtc

SEQ ID NO: 497717 - DNA, 25 bp, Mus musculus
aaacttgtcatgtagaactatggtc

SEQ ID NO: 497718 - DNA, 25 bp, Mus musculus
aaacttgtccgaagcgccacccttg

SEQ ID NO: 497719 - DNA, 25 bp, Mus musculus
aaacttgtccgatgcgccacccttg

SEQ ID NO: 497720 - DNA, 25 bp, Mus musculus
aaactttaaagcaagacctggccag

SEQ ID NO: 497721 - DNA, 25 bp, Mus musculus
aaactttaaagctagacctggccag

SEQ ID NO: 497722 - DNA, 25 bp, Mus musculus
aaactttgatccacgaacagctcag

SEQ ID NO: 497723 - DNA, 25 bp, Mus musculus
aaactttgatcctcgaacagctcag

SEQ ID NO: 497724 - DNA, 25 bp, Mus musculus
aaagaaaaactgcacactattgcta

SEQ ID NO: 497725 - DNA, 25 bp, Mus musculus
aaagaaaaactggacactattgcta

SEQ ID NO: 497726 - DNA, 25 bp, Mus musculus
aaagaaaagaaacctgctgttggcg

SEQ ID NO: 497727 - DNA, 25 bp, Mus musculus
aaagaaaagaaagctgctgttggcg

SEQ ID NO: 497728 - DNA, 25 bp, Mus musculus
aaagaaaagctcaacgcagtcaacg

SEQ ID NO: 497729 - DNA, 25 bp, Mus musculus
aaagaaaagctctacgcagtcaacg

SEQ ID NO: 497730 - DNA, 25 bp, Mus musculus
aaagaaacaagcagtgcggacctgg

SEQ ID NO: 497731 - DNA, 25 bp, Mus musculus
aaagaaacaagctgtgcggacctgg

SEQ ID NO: 497732 - DNA, 25 bp, Mus musculus
aaagaaaccccacttactgatgtgc

SEQ ID NO: 497733 - DNA, 25 bp, Mus musculus
aaagaaaccccagttactgatgtgc

SEQ ID NO: 497734 - DNA, 25 bp, Mus musculus
aaagaaacttggcagctccttggac

SEQ ID NO: 497735 - DNA, 25 bp, Mus musculus
aaagaaacttgggagctccttggac

SEQ ID NO: 497736 - DNA, 25 bp, Mus musculus
aaagaaagagcccttcagccggcgc

SEQ ID NO: 497737 - DNA, 25 bp, Mus musculus
aaagaaagagccgttcagccggcgc

SEQ ID NO: 497738 - DNA, 25 bp, Mus musculus
aaagaaagccacactgttggtgtag

SEQ ID NO: 497739 - DNA, 25 bp, Mus musculus
aaagaaagccactctgttggtgtag

SEQ ID NO: 497740 - DNA, 25 bp, Mus musculus
aaagaaagcccgctgagtgacagag

SEQ ID NO: 497741 - DNA, 25 bp, Mus musculus
aaagaaagcccggtgagtgacagag

SEQ ID NO: 497742 - DNA, 25 bp, Mus musculus
aaagaaaggtgtctcctcagtgcct

SEQ ID NO: 497743 - DNA, 25 bp, Mus musculus
aaagaaaggtgtgtcctcagtgcct

SEQ ID NO: 497744 - DNA, 25 bp, Mus musculus
aaagaaagtctactctaggctcagg

SEQ ID NO: 497745 - DNA, 25 bp, Mus musculus
aaagaaagtctagtctaggctcagg

SEQ ID NO: 497746 - DNA, 25 bp, Mus musculus
aaagaaataaatcgtctggcttcat

SEQ ID NO: 497747 - DNA, 25 bp, Mus musculus
aaagaaataaatggtctggcttcat

SEQ ID NO: 497748 - DNA, 25 bp, Mus musculus
aaagaaatcctgagcttggccctga

SEQ ID NO: 497749 - DNA, 25 bp, Mus musculus
aaagaaatcctgtgcttggccctga

SEQ ID NO: 497750 - DNA, 25 bp, Mus musculus
aaagaaatgaccaatcagttgcctg

SEQ ID NO: 497751 - DNA, 25 bp, Mus musculus
aaagaaatgacctatcagttgcctg

SEQ ID NO: 497752 - DNA, 25 bp, Mus musculus
aaagaaattgatcagctgacccgga

SEQ ID NO: 497753 - DNA, 25 bp, Mus musculus
aaagaaattgatgagctgacccgga

SEQ ID NO: 497754 - DNA, 25 bp, Mus musculus
aaagaacaccccattctggattcta

SEQ ID NO: 497755 - DNA, 25 bp, Mus musculus
aaagaacacccctttctggattcta

SEQ ID NO: 497756 - DNA, 25 bp, Mus musculus
aaagaacagcgtactctcctaccta

SEQ ID NO: 497757 - DNA, 25 bp, Mus musculus
aaagaacagcgttctctcctaccta

SEQ ID NO: 497758 - DNA, 25 bp, Mus musculus
aaagaacatggactggcctctcagg

SEQ ID NO: 497759 - DNA, 25 bp, Mus musculus
aaagaacatggagtggcctctcagg

SEQ ID NO: 497760 - DNA, 25 bp, Mus musculus
aaagaacatttacccagccttcctg

SEQ ID NO: 497761 - DNA, 25 bp, Mus musculus
aaagaacatttagccagccttcctg

SEQ ID NO: 497762 - DNA, 25 bp, Mus musculus
aaagaaccagaaagaccagtgcagc

SEQ ID NO: 497763 - DNA, 25 bp, Mus musculus
aaagaaccagaatgaccagtgcagc

SEQ ID NO: 497764 - DNA, 25 bp, Mus musculus
aaagaaccagataataaaggcagag

SEQ ID NO: 497765 - DNA, 25 bp, Mus musculus
aaagaaccagattataaaggcagag

SEQ ID NO: 497766 - DNA, 25 bp, Mus musculus
aaagaaccagttatcggagtgatcg

SEQ ID NO: 497767 - DNA, 25 bp, Mus musculus
aaagaaccagttttcggagtgatcg

SEQ ID NO: 497768 - DNA, 25 bp, Mus musculus
aaagaacctgaacagccggcacaag

SEQ ID NO: 497769 - DNA, 25 bp, Mus musculus
aaagaacctgaagagccggcacaag

SEQ ID NO: 497770 - DNA, 25 bp, Mus musculus
aaagaacctgtgcattcatcccgag

SEQ ID NO: 497771 - DNA, 25 bp, Mus musculus
aaagaacctgtggattcatcccgag

SEQ ID NO: 497772 - DNA, 25 bp, Mus musculus
aaagaaccttgcctctaggatctac

SEQ ID NO: 497773 - DNA, 25 bp, Mus musculus
aaagaaccttgcgtctaggatctac

SEQ ID NO: 497774 - DNA, 25 bp, Mus musculus
aaagaacgcttcactgtggaggtga

SEQ ID NO: 497775 - DNA, 25 bp, Mus musculus
aaagaacgcttctctgtggaggtga

SEQ ID NO: 497776 - DNA, 25 bp, Mus musculus
aaagaacggcgaaggtacgaagcgc

SEQ ID NO: 497777 - DNA, 25 bp, Mus musculus
aaagaacggcgatggtacgaagcgc

SEQ ID NO: 497778 - DNA, 25 bp, Mus musculus
aaagaactgccccacacaggatggc

SEQ ID NO: 497779 - DNA, 25 bp, Mus musculus
aaagaactgcccgacacaggatggc

SEQ ID NO: 497780 - DNA, 25 bp, Mus musculus
aaagaacttgagcaatatgtggaaa

SEQ ID NO: 497781 - DNA, 25 bp, Mus musculus
aaagaacttgaggaatatgtggaaa

SEQ ID NO: 497782 - DNA, 25 bp, Mus musculus
aaagaacttgccaggaggtccaagg

SEQ ID NO: 497783 - DNA, 25 bp, Mus musculus
aaagaacttgcctggaggtccaagg

SEQ ID NO: 497784 - DNA, 25 bp, Mus musculus
aaagaagaagtaaacgaatgtggtg

SEQ ID NO: 497785 - DNA, 25 bp, Mus musculus
aaagaagaagtatacgaatgtggtg

SEQ ID NO: 497786 - DNA, 25 bp, Mus musculus
aaagaagacaccaagtggccacctg

SEQ ID NO: 497787 - DNA, 25 bp, Mus musculus
aaagaagacacctagtggccacctg

SEQ ID NO: 497788 - DNA, 25 bp, Mus musculus
aaagaagacatgatgcttgaagtca

SEQ ID NO: 497789 - DNA, 25 bp, Mus musculus
aaagaagacatgttgcttgaagtca

SEQ ID NO: 497790 - DNA, 25 bp, Mus musculus
aaagaagacattcgcttccgctgtc

SEQ ID NO: 497791 - DNA, 25 bp, Mus musculus
aaagaagacattggcttccgctgtc

SEQ ID NO: 497792 - DNA, 25 bp, Mus musculus
aaagaagactctcaacatctgattc

SEQ ID NO: 497793 - DNA, 25 bp, Mus musculus
aaagaagactctgaacatctgattc

SEQ ID NO: 497794 - DNA, 25 bp, Mus musculus
aaagaagagactcgcttcacggaag

SEQ ID NO: 497795 - DNA, 25 bp, Mus musculus
aaagaagagactggcttcacggaag

SEQ ID NO: 497796 - DNA, 25 bp, Mus musculus
aaagaagagagtaggacagccaatg

SEQ ID NO: 497797 - DNA, 25 bp, Mus musculus
aaagaagagagttggacagccaatg

SEQ ID NO: 497798 - DNA, 25 bp, Mus musculus
aaagaagagcggcacagagaacgac

SEQ ID NO: 497799 - DNA, 25 bp, Mus musculus
aaagaagagcgggacagagaacgac

SEQ ID NO: 497800 - DNA, 25 bp, Mus musculus
aaagaagaggctaggcagatcaaga

SEQ ID NO: 497801 - DNA, 25 bp, Mus musculus
aaagaagaggcttggcagatcaaga

SEQ ID NO: 497802 - DNA, 25 bp, Mus musculus
aaagaagagtacaggaaacttactg

SEQ ID NO: 497803 - DNA, 25 bp, Mus musculus
aaagaagagtactggaaacttactg

SEQ ID NO: 497804 - DNA, 25 bp, Mus musculus
aaagaagagtggcatccggatagca

SEQ ID NO: 497805 - DNA, 25 bp, Mus musculus
aaagaagagtgggatccggatagca

SEQ ID NO: 497806 - DNA, 25 bp, Mus musculus
aaagaagatggcatcagcgccgcca

SEQ ID NO: 497807 - DNA, 25 bp, Mus musculus
aaagaagatggcttcagcgccgcca

SEQ ID NO: 497808 - DNA, 25 bp, Mus musculus
aaagaagattccatatgtggactcc

SEQ ID NO: 497809 - DNA, 25 bp, Mus musculus
aaagaagattccttatgtggactcc

SEQ ID NO: 497810 - DNA, 25 bp, Mus musculus
aaagaagcctgaagatgaattatgc

SEQ ID NO: 497811 - DNA, 25 bp, Mus musculus
aaagaagcctgatgatgaattatgc

SEQ ID NO: 497812 - DNA, 25 bp, Mus musculus
aaagaagcctttctgcgtctgccca

SEQ ID NO: 497813 - DNA, 25 bp, Mus musculus
aaagaagcctttgtgcgtctgccca

SEQ ID NO: 497814 - DNA, 25 bp, Mus musculus
aaagaagcgctgacgggctactgac

SEQ ID NO: 497815 - DNA, 25 bp, Mus musculus
aaagaagcgctgtcgggctactgac

SEQ ID NO: 497816 - DNA, 25 bp, Mus musculus
aaagaagctatcaaataccctgaag

SEQ ID NO: 497817 - DNA, 25 bp, Mus musculus
aaagaagctatctaataccctgaag

SEQ ID NO: 497818 - DNA, 25 bp, Mus musculus
aaagaagctcgacccaaatttcgcc

SEQ ID NO: 497819 - DNA, 25 bp, Mus musculus
aaagaagctcgagccaaatttcgcc

SEQ ID NO: 497820 - DNA, 25 bp, Mus musculus
aaagaagctggacatcggaaacgca

SEQ ID NO: 497821 - DNA, 25 bp, Mus musculus
aaagaagctggagatcggaaacgca

SEQ ID NO: 497822 - DNA, 25 bp, Mus musculus
aaagaaggacttagattttcagatg

SEQ ID NO: 497823 - DNA, 25 bp, Mus musculus
aaagaaggactttgattttcagatg

SEQ ID NO: 497824 - DNA, 25 bp, Mus musculus
aaagaaggcaaaagtgaagaccagc

SEQ ID NO: 497825 - DNA, 25 bp, Mus musculus
aaagaaggcaaatgtgaagaccagc

SEQ ID NO: 497826 - DNA, 25 bp, Mus musculus
aaagaaggccagaggtaccaggcgc

SEQ ID NO: 497827 - DNA, 25 bp, Mus musculus
aaagaaggccagtggtaccaggcgc

SEQ ID NO: 497828 - DNA, 25 bp, Mus musculus
aaagaaggcctaccgcaagctggcc

SEQ ID NO: 497829 - DNA, 25 bp, Mus musculus
aaagaaggcctagcgcaagctggcc

SEQ ID NO: 497830 - DNA, 25 bp, Mus musculus
aaagaaggtcatcggtgttctggac

SEQ ID NO: 497831 - DNA, 25 bp, Mus musculus
aaagaaggtcatgggtgttctggac

SEQ ID NO: 497832 - DNA, 25 bp, Mus musculus
aaagaagtctgcaggctatgggtgt

SEQ ID NO: 497833 - DNA, 25 bp, Mus musculus
aaagaagtctgctggctatgggtgt

SEQ ID NO: 497834 - DNA, 25 bp, Mus musculus
aaagaagtcttcagactagccactc

SEQ ID NO: 497835 - DNA, 25 bp, Mus musculus
aaagaagtcttctgactagccactc

SEQ ID NO: 497836 - DNA, 25 bp, Mus musculus
aaagaagtgcgaagaagtgatttgc

SEQ ID NO: 497837 - DNA, 25 bp, Mus musculus
aaagaagtgcgatgaagtgatttgc

SEQ ID NO: 497838 - DNA, 25 bp, Mus musculus
aaagaagtggagcagtccttggaga

SEQ ID NO: 497839 - DNA, 25 bp, Mus musculus
aaagaagtggaggagtccttggaga

SEQ ID NO: 497840 - DNA, 25 bp, Mus musculus
aaagaagtgggaacagctggccaga

SEQ ID NO: 497841 - DNA, 25 bp, Mus musculus
aaagaagtgggatcagctggccaga

SEQ ID NO: 497842 - DNA, 25 bp, Mus musculus
aaagaagtgtttatccaggaactgg

SEQ ID NO: 497843 - DNA, 25 bp, Mus musculus
aaagaagtgtttttccaggaactgg

SEQ ID NO: 497844 - DNA, 25 bp, Mus musculus
aaagaagttactcgtgttcacagcg

SEQ ID NO: 497845 - DNA, 25 bp, Mus musculus
aaagaagttactggtgttcacagcg

SEQ ID NO: 497846 - DNA, 25 bp, Mus musculus
aaagaagttatcagagagaatgacc

SEQ ID NO: 497847 - DNA, 25 bp, Mus musculus
aaagaagttatctgagagaatgacc

SEQ ID NO: 497848 - DNA, 25 bp, Mus musculus
aaagaatatatcatccccagccctg

SEQ ID NO: 497849 - DNA, 25 bp, Mus musculus
aaagaatatatcttccccagccctg

SEQ ID NO: 497850 - DNA, 25 bp, Mus musculus
aaagaatccagaaatggttgctgga

SEQ ID NO: 497851 - DNA, 25 bp, Mus musculus
aaagaatccagatatggttgctgga

SEQ ID NO: 497852 - DNA, 25 bp, Mus musculus
aaagaatcctgaaggcccctggcca

SEQ ID NO: 497853 - DNA, 25 bp, Mus musculus
aaagaatcctgatggcccctggcca

SEQ ID NO: 497854 - DNA, 25 bp, Mus musculus
aaagaatcgctgattcatgtgcagg

SEQ ID NO: 497855 - DNA, 25 bp, Mus musculus
aaagaatcgctgtttcatgtgcagg

SEQ ID NO: 497856 - DNA, 25 bp, Mus musculus
aaagaatgacttcttggttctgggc

SEQ ID NO: 497857 - DNA, 25 bp, Mus musculus
aaagaatgacttgttggttctgggc

SEQ ID NO: 497858 - DNA, 25 bp, Mus musculus
aaagaatgtaaactactcattttct

SEQ ID NO: 497859 - DNA, 25 bp, Mus musculus
aaagaatgtaaagtactcattttct

SEQ ID NO: 497860 - DNA, 25 bp, Mus musculus
aaagaatgtttccatagccatcgag

SEQ ID NO: 497861 - DNA, 25 bp, Mus musculus
aaagaatgtttcgatagccatcgag

SEQ ID NO: 497862 - DNA, 25 bp, Mus musculus
aaagaattgggcaaggcatgatttt

SEQ ID NO: 497863 - DNA, 25 bp, Mus musculus
aaagaattgggctaggcatgatttt

SEQ ID NO: 497864 - DNA, 25 bp, Mus musculus
aaagacaaagtgcttcctctggaca

SEQ ID NO: 497865 - DNA, 25 bp, Mus musculus
aaagacaaagtggttcctctggaca

SEQ ID NO: 497866 - DNA, 25 bp, Mus musculus
aaagacaacgataaagaagaacaca

SEQ ID NO: 497867 - DNA, 25 bp, Mus musculus
aaagacaacgattaagaagaacaca

SEQ ID NO: 497868 - DNA, 25 bp, Mus musculus
aaagacaactgccagcccttaggga

SEQ ID NO: 497869 - DNA, 25 bp, Mus musculus
aaagacaactgcgagcccttaggga

SEQ ID NO: 497870 - DNA, 25 bp, Mus musculus
aaagacaccacactcaaatctggag

SEQ ID NO: 497871 - DNA, 25 bp, Mus musculus
aaagacaccacagtcaaatctggag

SEQ ID NO: 497872 - DNA, 25 bp, Mus musculus
aaagacaccagtatgacttactggc

SEQ ID NO: 497873 - DNA, 25 bp, Mus musculus
aaagacaccagtttgacttactggc

SEQ ID NO: 497874 - DNA, 25 bp, Mus musculus
aaagacaccttgaagaggcaccaca

SEQ ID NO: 497875 - DNA, 25 bp, Mus musculus
aaagacaccttgtagaggcaccaca

SEQ ID NO: 497876 - DNA, 25 bp, Mus musculus
aaagacactatgcacgtatggtgca

SEQ ID NO: 497877 - DNA, 25 bp, Mus musculus
aaagacactatggacgtatggtgca

SEQ ID NO: 497878 - DNA, 25 bp, Mus musculus
aaagacactgccaccttatcctggg

SEQ ID NO: 497879 - DNA, 25 bp, Mus musculus
aaagacactgcctccttatcctggg

SEQ ID NO: 497880 - DNA, 25 bp, Mus musculus
aaagacacttataaccatgaggtga

SEQ ID NO: 497881 - DNA, 25 bp, Mus musculus
aaagacacttattaccatgaggtga

SEQ ID NO: 497882 - DNA, 25 bp, Mus musculus
aaagacagacctcggcattcatttg

SEQ ID NO: 497883 - DNA, 25 bp, Mus musculus
aaagacagacctgggcattcatttg

SEQ ID NO: 497884 - DNA, 25 bp, Mus musculus
aaagacagatctagtaccaccactt

SEQ ID NO: 497885 - DNA, 25 bp, Mus musculus
aaagacagatcttgtaccaccactt

SEQ ID NO: 497886 - DNA, 25 bp, Mus musculus
aaagacagccgactcctacaagttg

SEQ ID NO: 497887 - DNA, 25 bp, Mus musculus
aaagacagccgagtcctacaagttg

SEQ ID NO: 497888 - DNA, 25 bp, Mus musculus
aaagacagcctcattggccaaggca

SEQ ID NO: 497889 - DNA, 25 bp, Mus musculus
aaagacagcctctttggccaaggca

SEQ ID NO: 497890 - DNA, 25 bp, Mus musculus
aaagacagctctcgcaccaagccgg

SEQ ID NO: 497891 - DNA, 25 bp, Mus musculus
aaagacagctctggcaccaagccgg

SEQ ID NO: 497892 - DNA, 25 bp, Mus musculus
aaagacagggcacctagtgagtcgc

SEQ ID NO: 497893 - DNA, 25 bp, Mus musculus
aaagacagggcagctagtgagtcgc

SEQ ID NO: 497894 - DNA, 25 bp, Mus musculus
aaagacatcaggagaagccaaaagt

SEQ ID NO: 497895 - DNA, 25 bp, Mus musculus
aaagacatcaggtgaagccaaaagt

SEQ ID NO: 497896 - DNA, 25 bp, Mus musculus
aaagacatctgccaacatgaaagcc

SEQ ID NO: 497897 - DNA, 25 bp, Mus musculus
aaagacatctgcgaacatgaaagcc

SEQ ID NO: 497898 - DNA, 25 bp, Mus musculus
aaagacatgctcacctccttatatt

SEQ ID NO: 497899 - DNA, 25 bp, Mus musculus
aaagacatgctctcctccttatatt

SEQ ID NO: 497900 - DNA, 25 bp, Mus musculus
aaagacatgtctcgcaatgggagca

SEQ ID NO: 497901 - DNA, 25 bp, Mus musculus
aaagacatgtctggcaatgggagca

SEQ ID NO: 497902 - DNA, 25 bp, Mus musculus
aaagaccaaccacattggccacact

SEQ ID NO: 497903 - DNA, 25 bp, Mus musculus
aaagaccaaccagattggccacact

SEQ ID NO: 497904 - DNA, 25 bp, Mus musculus
aaagaccaatcacatcaccttcctt

SEQ ID NO: 497905 - DNA, 25 bp, Mus musculus
aaagaccaatcagatcaccttcctt

SEQ ID NO: 497906 - DNA, 25 bp, Mus musculus
aaagaccacagtagcctccttgctg

SEQ ID NO: 497907 - DNA, 25 bp, Mus musculus
aaagaccacagttgcctccttgctg

SEQ ID NO: 497908 - DNA, 25 bp, Mus musculus
aaagaccactccaccaagtccagag

SEQ ID NO: 497909 - DNA, 25 bp, Mus musculus
aaagaccactcctccaagtccagag

SEQ ID NO: 497910 - DNA, 25 bp, Mus musculus
aaagaccatggacgctgtggctgct

SEQ ID NO: 497911 - DNA, 25 bp, Mus musculus
aaagaccatggaggctgtggctgct

SEQ ID NO: 497912 - DNA, 25 bp, Mus musculus
aaagacccgagtcccgtgcacacag

SEQ ID NO: 497913 - DNA, 25 bp, Mus musculus
aaagacccgagtgccgtgcacacag

SEQ ID NO: 497914 - DNA, 25 bp, Mus musculus
aaagacccgcgccaatgtggacaag

SEQ ID NO: 497915 - DNA, 25 bp, Mus musculus
aaagacccgcgcgaatgtggacaag

SEQ ID NO: 497916 - DNA, 25 bp, Mus musculus
aaagaccggcgcctcggatgagccc

SEQ ID NO: 497917 - DNA, 25 bp, Mus musculus
aaagaccggcgcgtcggatgagccc

SEQ ID NO: 497918 - DNA, 25 bp, Mus musculus
aaagacctatagagctggctgtggg

SEQ ID NO: 497919 - DNA, 25 bp, Mus musculus
aaagacctatagtgctggctgtggg

SEQ ID NO: 497920 - DNA, 25 bp, Mus musculus
aaagacctctggagcgcccagtctg

SEQ ID NO: 497921 - DNA, 25 bp, Mus musculus
aaagacctctggtgcgcccagtctg

SEQ ID NO: 497922 - DNA, 25 bp, Mus musculus
aaagacctgaccaacacctgccgag

SEQ ID NO: 497923 - DNA, 25 bp, Mus musculus
aaagacctgacctacacctgccgag

SEQ ID NO: 497924 - DNA, 25 bp, Mus musculus
aaagacctttctactagggctagat

SEQ ID NO: 497925 - DNA, 25 bp, Mus musculus
aaagacctttcttctagggctagat

SEQ ID NO: 497926 - DNA, 25 bp, Mus musculus
aaagacgaagctcatgcggatctca

SEQ ID NO: 497927 - DNA, 25 bp, Mus musculus
aaagacgaagctgatgcggatctca

SEQ ID NO: 497928 - DNA, 25 bp, Mus musculus
aaagacgactaccacagcttgctgt

SEQ ID NO: 497929 - DNA, 25 bp, Mus musculus
aaagacgactacgacagcttgctgt

SEQ ID NO: 497930 - DNA, 25 bp, Mus musculus
aaagacgcagaaatggcaaactctg

SEQ ID NO: 497931 - DNA, 25 bp, Mus musculus
aaagacgcagaattggcaaactctg

SEQ ID NO: 497932 - DNA, 25 bp, Mus musculus
aaagacggcatgaccattgccaagg

SEQ ID NO: 497933 - DNA, 25 bp, Mus musculus
aaagacggcatgtccattgccaagg

SEQ ID NO: 497934 - DNA, 25 bp, Mus musculus
aaagacggtgcacgacagaactagc

SEQ ID NO: 497935 - DNA, 25 bp, Mus musculus
aaagacggtgcaggacagaactagc

SEQ ID NO: 497936 - DNA, 25 bp, Mus musculus
aaagacgtgcgacacatccttaccc

SEQ ID NO: 497937 - DNA, 25 bp, Mus musculus
aaagacgtgcgagacatccttaccc

SEQ ID NO: 497938 - DNA, 25 bp, Mus musculus
aaagacgtgcgcaaggtgccctagg

SEQ ID NO: 497939 - DNA, 25 bp, Mus musculus
aaagacgtgcgctaggtgccctagg

SEQ ID NO: 497940 - DNA, 25 bp, Mus musculus
aaagacgtggctcgagactggcact

SEQ ID NO: 497941 - DNA, 25 bp, Mus musculus
aaagacgtggctggagactggcact

SEQ ID NO: 497942 - DNA, 25 bp, Mus musculus
aaagactagataatgacacctcgca

SEQ ID NO: 497943 - DNA, 25 bp, Mus musculus
aaagactagatattgacacctcgca

SEQ ID NO: 497944 - DNA, 25 bp, Mus musculus
aaagactccattcacggtggcccag

SEQ ID NO: 497945 - DNA, 25 bp, Mus musculus
aaagactccattgacggtggcccag

SEQ ID NO: 497946 - DNA, 25 bp, Mus musculus
aaagactcctttcttgcttgttggg

SEQ ID NO: 497947 - DNA, 25 bp, Mus musculus
aaagactcctttgttgcttgttggg

SEQ ID NO: 497948 - DNA, 25 bp, Mus musculus
aaagactcgctgctggacaaccgat

SEQ ID NO: 497949 - DNA, 25 bp, Mus musculus
aaagactcgctggtggacaaccgat

SEQ ID NO: 497950 - DNA, 25 bp, Mus musculus
aaagactcggacagccgggctgttg

SEQ ID NO: 497951 - DNA, 25 bp, Mus musculus
aaagactcggactgccgggctgttg

SEQ ID NO: 497952 - DNA, 25 bp, Mus musculus
aaagactctgccatccgtgccgttg

SEQ ID NO: 497953 - DNA, 25 bp, Mus musculus
aaagactctgccttccgtgccgttg

SEQ ID NO: 497954 - DNA, 25 bp, Mus musculus
aaagactgcactatgaggcctcccc

SEQ ID NO: 497955 - DNA, 25 bp, Mus musculus
aaagactgcactttgaggcctcccc

SEQ ID NO: 497956 - DNA, 25 bp, Mus musculus
aaagactgtcagaacacgtcccatg

SEQ ID NO: 497957 - DNA, 25 bp, Mus musculus
aaagactgtcagtacacgtcccatg

SEQ ID NO: 497958 - DNA, 25 bp, Mus musculus
aaagacttgcaactttcttcaggag

SEQ ID NO: 497959 - DNA, 25 bp, Mus musculus
aaagacttgcaagtttcttcaggag

SEQ ID NO: 497960 - DNA, 25 bp, Mus musculus
aaagacttggctatcgttgagcccg

SEQ ID NO: 497961 - DNA, 25 bp, Mus musculus
aaagacttggctttcgttgagcccg

SEQ ID NO: 497962 - DNA, 25 bp, Mus musculus
aaagactttctgcatcctagtaggg

SEQ ID NO: 497963 - DNA, 25 bp, Mus musculus
aaagactttctggatcctagtaggg

SEQ ID NO: 497964 - DNA, 25 bp, Mus musculus
aaagagaacgggatcgacatcatcc

SEQ ID NO: 497965 - DNA, 25 bp, Mus musculus
aaagagaacgggttcgacatcatcc

SEQ ID NO: 497966 - DNA, 25 bp, Mus musculus
aaagagaagctaatagacctgcttg

SEQ ID NO: 497967 - DNA, 25 bp, Mus musculus
aaagagaagctattagacctgcttg

SEQ ID NO: 497968 - DNA, 25 bp, Mus musculus
aaagagaagctgacctcctccgtgc

SEQ ID NO: 497969 - DNA, 25 bp, Mus musculus
aaagagaagctgtcctcctccgtgc

SEQ ID NO: 497970 - DNA, 25 bp, Mus musculus
aaagagaaggacaaactcagcaccg

SEQ ID NO: 497971 - DNA, 25 bp, Mus musculus
aaagagaaggactaactcagcaccg

SEQ ID NO: 497972 - DNA, 25 bp, Mus musculus
aaagagaagtcgctgcttcagggca

SEQ ID NO: 497973 - DNA, 25 bp, Mus musculus
aaagagaagtcggtgcttcagggca

SEQ ID NO: 497974 - DNA, 25 bp, Mus musculus
aaagagaatcctattcatctcactg

SEQ ID NO: 497975 - DNA, 25 bp, Mus musculus
aaagagaatccttttcatctcactg

SEQ ID NO: 497976 - DNA, 25 bp, Mus musculus
aaagagaccatccagaagtgtgaca

SEQ ID NO: 497977 - DNA, 25 bp, Mus musculus
aaagagaccatcgagaagtgtgaca

SEQ ID NO: 497978 - DNA, 25 bp, Mus musculus
aaagagagcattcgactccccagga

SEQ ID NO: 497979 - DNA, 25 bp, Mus musculus
aaagagagcattggactccccagga

SEQ ID NO: 497980 - DNA, 25 bp, Mus musculus
aaagagagctcaacctgtcctccga

SEQ ID NO: 497981 - DNA, 25 bp, Mus musculus
aaagagagctcatcctgtcctccga

SEQ ID NO: 497982 - DNA, 25 bp, Mus musculus
aaagagagcttccagtacgcaaacc

SEQ ID NO: 497983 - DNA, 25 bp, Mus musculus
aaagagagcttcgagtacgcaaacc

SEQ ID NO: 497984 - DNA, 25 bp, Mus musculus
aaagagagctttactgttgctagcc

SEQ ID NO: 497985 - DNA, 25 bp, Mus musculus
aaagagagcttttctgttgctagcc

SEQ ID NO: 497986 - DNA, 25 bp, Mus musculus
aaagagagggccatcaagcgccagt

SEQ ID NO: 497987 - DNA, 25 bp, Mus musculus
aaagagagggccttcaagcgccagt

SEQ ID NO: 497988 - DNA, 25 bp, Mus musculus
aaagagagtcaacatggccttctac

SEQ ID NO: 497989 - DNA, 25 bp, Mus musculus
aaagagagtcaagatggccttctac

SEQ ID NO: 497990 - DNA, 25 bp, Mus musculus
aaagagatcctgacctgtgcccatg

SEQ ID NO: 497991 - DNA, 25 bp, Mus musculus
aaagagatcctgtcctgtgcccatg

SEQ ID NO: 497992 - DNA, 25 bp, Mus musculus
aaagagatgcatcttctggaacagc

SEQ ID NO: 497993 - DNA, 25 bp, Mus musculus
aaagagatgcatgttctggaacagc

SEQ ID NO: 497994 - DNA, 25 bp, Mus musculus
aaagagatgtcaattctgacagccc

SEQ ID NO: 497995 - DNA, 25 bp, Mus musculus
aaagagatgtcatttctgacagccc

SEQ ID NO: 497996 - DNA, 25 bp, Mus musculus
aaagagcaaggcaggtactacgacc

SEQ ID NO: 497997 - DNA, 25 bp, Mus musculus
aaagagcaaggctggtactacgacc

SEQ ID NO: 497998 - DNA, 25 bp, Mus musculus
aaagagcagcgtcttcatagcagcg

SEQ ID NO: 497999 - DNA, 25 bp, Mus musculus
aaagagcagcgtgttcatagcagcg

SEQ ID NO: 498000 - DNA, 25 bp, Mus musculus
aaagagcagcttacattttctgtga

SEQ ID NO: 498001 - DNA, 25 bp, Mus musculus
aaagagcagctttcattttctgtga

SEQ ID NO: 498002 - DNA, 25 bp, Mus musculus
aaagagccaatgaagtgacaacccc

SEQ ID NO: 498003 - DNA, 25 bp, Mus musculus
aaagagccaatgtagtgacaacccc

SEQ ID NO: 498004 - DNA, 25 bp, Mus musculus
aaagagccagatcccaagacatgga

SEQ ID NO: 498005 - DNA, 25 bp, Mus musculus
aaagagccagatgccaagacatgga

SEQ ID NO: 498006 - DNA, 25 bp, Mus musculus
aaagagccagccctctacctgtgga

SEQ ID NO: 498007 - DNA, 25 bp, Mus musculus
aaagagccagccgtctacctgtgga

SEQ ID NO: 498008 - DNA, 25 bp, Mus musculus
aaagagccatccattgacaattggg

SEQ ID NO: 498009 - DNA, 25 bp, Mus musculus
aaagagccatcctttgacaattggg

SEQ ID NO: 498010 - DNA, 25 bp, Mus musculus
aaagagccccgcagtgtcccgctat

SEQ ID NO: 498011 - DNA, 25 bp, Mus musculus
aaagagccccgctgtgtcccgctat

SEQ ID NO: 498012 - DNA, 25 bp, Mus musculus
aaagagcctcccatgaaatcagaac

SEQ ID NO: 498013 - DNA, 25 bp, Mus musculus
aaagagcctcccttgaaatcagaac

SEQ ID NO: 498014 - DNA, 25 bp, Mus musculus
aaagagcggaccatctccttctgtg

SEQ ID NO: 498015 - DNA, 25 bp, Mus musculus
aaagagcggaccttctccttctgtg

SEQ ID NO: 498016 - DNA, 25 bp, Mus musculus
aaagagcgtgtgctacagaccccaa

SEQ ID NO: 498017 - DNA, 25 bp, Mus musculus
aaagagcgtgtggtacagaccccaa

SEQ ID NO: 498018 - DNA, 25 bp, Mus musculus
aaagagcgttccattcctgccgctg

SEQ ID NO: 498019 - DNA, 25 bp, Mus musculus
aaagagcgttcctttcctgccgctg

SEQ ID NO: 498020 - DNA, 25 bp, Mus musculus
aaagagcgttgaagccggctgtagc

SEQ ID NO: 498021 - DNA, 25 bp, Mus musculus
aaagagcgttgatgccggctgtagc

SEQ ID NO: 498022 - DNA, 25 bp, Mus musculus
aaagagctaagcacctctgctgaga

SEQ ID NO: 498023 - DNA, 25 bp, Mus musculus
aaagagctaagctcctctgctgaga

SEQ ID NO: 498024 - DNA, 25 bp, Mus musculus
aaagagctcatcatagccggcaagg

SEQ ID NO: 498025 - DNA, 25 bp, Mus musculus
aaagagctcatcttagccggcaagg

SEQ ID NO: 498026 - DNA, 25 bp, Mus musculus
aaagaggaacacattcatatctcca

SEQ ID NO: 498027 - DNA, 25 bp, Mus musculus
aaagaggaacactttcatatctcca

SEQ ID NO: 498028 - DNA, 25 bp, Mus musculus
aaagaggaaggtctccctgttccag

SEQ ID NO: 498029 - DNA, 25 bp, Mus musculus
aaagaggaaggtgtccctgttccag

SEQ ID NO: 498030 - DNA, 25 bp, Mus musculus
aaagaggagctgaatgcagtgcgca

SEQ ID NO: 498031 - DNA, 25 bp, Mus musculus
aaagaggagctgtatgcagtgcgca

SEQ ID NO: 498032 - DNA, 25 bp, Mus musculus
aaagaggaggctcactataaacggc

SEQ ID NO: 498033 - DNA, 25 bp, Mus musculus
aaagaggaggctgactataaacggc

SEQ ID NO: 498034 - DNA, 25 bp, Mus musculus
aaagaggatacgaatgggactggaa

SEQ ID NO: 498035 - DNA, 25 bp, Mus musculus
aaagaggatacgtatgggactggaa

SEQ ID NO: 498036 - DNA, 25 bp, Mus musculus
aaagaggatcaactgtctggaatca

SEQ ID NO: 498037 - DNA, 25 bp, Mus musculus
aaagaggatcaagtgtctggaatca

SEQ ID NO: 498038 - DNA, 25 bp, Mus musculus
aaagaggatctaagccactccccac

SEQ ID NO: 498039 - DNA, 25 bp, Mus musculus
aaagaggatctatgccactccccac

SEQ ID NO: 498040 - DNA, 25 bp, Mus musculus
aaagaggccaaacatctgacagagc

SEQ ID NO: 498041 - DNA, 25 bp, Mus musculus
aaagaggccaaagatctgacagagc

SEQ ID NO: 498042 - DNA, 25 bp, Mus musculus
aaagaggcccctcccaatacagatc

SEQ ID NO: 498043 - DNA, 25 bp, Mus musculus
aaagaggcccctgccaatacagatc

SEQ ID NO: 498044 - DNA, 25 bp, Mus musculus
aaagaggcgcgacctagtcgtctcc

SEQ ID NO: 498045 - DNA, 25 bp, Mus musculus
aaagaggcgcgagctagtcgtctcc

SEQ ID NO: 498046 - DNA, 25 bp, Mus musculus
aaagagggacacaggatggacaagc

SEQ ID NO: 498047 - DNA, 25 bp, Mus musculus
aaagagggacactggatggacaagc

SEQ ID NO: 498048 - DNA, 25 bp, Mus musculus
aaagagggatcccaacaagctcaga

SEQ ID NO: 498049 - DNA, 25 bp, Mus musculus
aaagagggatccgaacaagctcaga

SEQ ID NO: 498050 - DNA, 25 bp, Mus musculus
aaagagggcctgaagttcgagaacg

SEQ ID NO: 498051 - DNA, 25 bp, Mus musculus
aaagagggcctgtagttcgagaacg

SEQ ID NO: 498052 - DNA, 25 bp, Mus musculus
aaagagggctctcccaggacctagt

SEQ ID NO: 498053 - DNA, 25 bp, Mus musculus
aaagagggctctgccaggacctagt

SEQ ID NO: 498054 - DNA, 25 bp, Mus musculus
aaagagggtgatcacgcaatatgcc

SEQ ID NO: 498055 - DNA, 25 bp, Mus musculus
aaagagggtgatgacgcaatatgcc

SEQ ID NO: 498056 - DNA, 25 bp, Mus musculus
aaagaggtggcccttcaaagctgga

SEQ ID NO: 498057 - DNA, 25 bp, Mus musculus
aaagaggtggccgttcaaagctgga

SEQ ID NO: 498058 - DNA, 25 bp, Mus musculus
aaagagtccatcagatctgtggaag

SEQ ID NO: 498059 - DNA, 25 bp, Mus musculus
aaagagtccatctgatctgtggaag

SEQ ID NO: 498060 - DNA, 25 bp, Mus musculus
aaagagtcctgtacacaccagtccg

SEQ ID NO: 498061 - DNA, 25 bp, Mus musculus
aaagagtcctgttcacaccagtccg

SEQ ID NO: 498062 - DNA, 25 bp, Mus musculus
aaagagtctgccaatcgcttcaggg

SEQ ID NO: 498063 - DNA, 25 bp, Mus musculus
aaagagtctgcctatcgcttcaggg

SEQ ID NO: 498064 - DNA, 25 bp, Mus musculus
aaagagtctgtgaggtctgaggcca

SEQ ID NO: 498065 - DNA, 25 bp, Mus musculus
aaagagtctgtgtggtctgaggcca

SEQ ID NO: 498066 - DNA, 25 bp, Mus musculus
aaagagtgactaaggtttttgctca

SEQ ID NO: 498067 - DNA, 25 bp, Mus musculus
aaagagtgactatggtttttgctca

SEQ ID NO: 498068 - DNA, 25 bp, Mus musculus
aaagagttaatgaaggcacagagtc

SEQ ID NO: 498069 - DNA, 25 bp, Mus musculus
aaagagttaatgtaggcacagagtc

SEQ ID NO: 498070 - DNA, 25 bp, Mus musculus
aaagagttgtacaggtagagcgaga

SEQ ID NO: 498071 - DNA, 25 bp, Mus musculus
aaagagttgtactggtagagcgaga

SEQ ID NO: 498072 - DNA, 25 bp, Mus musculus
aaagagtttgtcattttcagaggac

SEQ ID NO: 498073 - DNA, 25 bp, Mus musculus
aaagagtttgtctttttcagaggac

SEQ ID NO: 498074 - DNA, 25 bp, Mus musculus
aaagagttttttcaatgcgccagtg

SEQ ID NO: 498075 - DNA, 25 bp, Mus musculus
aaagagttttttgaatgcgccagtg

SEQ ID NO: 498076 - DNA, 25 bp, Mus musculus
aaagataacacacacccaggacaac

SEQ ID NO: 498077 - DNA, 25 bp, Mus musculus
aaagataacacagacccaggacaac

SEQ ID NO: 498078 - DNA, 25 bp, Mus musculus
aaagatacacgtcgactactgtcag

SEQ ID NO: 498079 - DNA, 25 bp, Mus musculus
aaagatacacgtggactactgtcag

SEQ ID NO: 498080 - DNA, 25 bp, Mus musculus
aaagataggaaaaaagaagcgacag

SEQ ID NO: 498081 - DNA, 25 bp, Mus musculus
aaagataggaaataagaagcgacag

SEQ ID NO: 498082 - DNA, 25 bp, Mus musculus
aaagataggaagagacgtctgggcc

SEQ ID NO: 498083 - DNA, 25 bp, Mus musculus
aaagataggaagtgacgtctgggcc

SEQ ID NO: 498084 - DNA, 25 bp, Mus musculus
aaagatatccgacccgagtaccgag

SEQ ID NO: 498085 - DNA, 25 bp, Mus musculus
aaagatatccgagccgagtaccgag

SEQ ID NO: 498086 - DNA, 25 bp, Mus musculus
aaagatatgccaacattggagcaga

SEQ ID NO: 498087 - DNA, 25 bp, Mus musculus
aaagatatgccatcattggagcaga

SEQ ID NO: 498088 - DNA, 25 bp, Mus musculus
aaagatcaacagacgggctgattcc

SEQ ID NO: 498089 - DNA, 25 bp, Mus musculus
aaagatcaacagtcgggctgattcc

SEQ ID NO: 498090 - DNA, 25 bp, Mus musculus
aaagatcaagacagggaggatgcgc

SEQ ID NO: 498091 - DNA, 25 bp, Mus musculus
aaagatcaagactgggaggatgcgc

SEQ ID NO: 498092 - DNA, 25 bp, Mus musculus
aaagatcaagatactctgagtcagc

SEQ ID NO: 498093 - DNA, 25 bp, Mus musculus
aaagatcaagattctctgagtcagc

SEQ ID NO: 498094 - DNA, 25 bp, Mus musculus
aaagatcactgacatactatgtgtg

SEQ ID NO: 498095 - DNA, 25 bp, Mus musculus
aaagatcactgagatactatgtgtg

SEQ ID NO: 498096 - DNA, 25 bp, Mus musculus
aaagatcagagaatacttcggccag

SEQ ID NO: 498097 - DNA, 25 bp, Mus musculus
aaagatcagagattacttcggccag

SEQ ID NO: 498098 - DNA, 25 bp, Mus musculus
aaagatcagattccgcctgtccgtc

SEQ ID NO: 498099 - DNA, 25 bp, Mus musculus
aaagatcagattgcgcctgtccgtc

SEQ ID NO: 498100 - DNA, 25 bp, Mus musculus
aaagatcaggatcatcactcagatg

SEQ ID NO: 498101 - DNA, 25 bp, Mus musculus
aaagatcaggatgatcactcagatg

SEQ ID NO: 498102 - DNA, 25 bp, Mus musculus
aaagatccaaaaccaagaggcaaaa

SEQ ID NO: 498103 - DNA, 25 bp, Mus musculus
aaagatccaaaagcaagaggcaaaa

SEQ ID NO: 498104 - DNA, 25 bp, Mus musculus
aaagatcctaacctcatccgtgcag

SEQ ID NO: 498105 - DNA, 25 bp, Mus musculus
aaagatcctaacgtcatccgtgcag

SEQ ID NO: 498106 - DNA, 25 bp, Mus musculus
aaagatcctcatagttattttccca

SEQ ID NO: 498107 - DNA, 25 bp, Mus musculus
aaagatcctcattgttattttccca

SEQ ID NO: 498108 - DNA, 25 bp, Mus musculus
aaagatcctccaatttgagctctgg

SEQ ID NO: 498109 - DNA, 25 bp, Mus musculus
aaagatcctccattttgagctctgg

SEQ ID NO: 498110 - DNA, 25 bp, Mus musculus
aaagatctagtaccagcctagcacc

SEQ ID NO: 498111 - DNA, 25 bp, Mus musculus
aaagatctagtagcagcctagcacc

SEQ ID NO: 498112 - DNA, 25 bp, Mus musculus
aaagatctcagtacagtagaagcgc

SEQ ID NO: 498113 - DNA, 25 bp, Mus musculus
aaagatctcagttcagtagaagcgc

SEQ ID NO: 498114 - DNA, 25 bp, Mus musculus
aaagatctgaatcacctggctcagg

SEQ ID NO: 498115 - DNA, 25 bp, Mus musculus
aaagatctgaatgacctggctcagg

SEQ ID NO: 498116 - DNA, 25 bp, Mus musculus
aaagatgaactgcagcgtgtggcca

SEQ ID NO: 498117 - DNA, 25 bp, Mus musculus
aaagatgaactggagcgtgtggcca

SEQ ID NO: 498118 - DNA, 25 bp, Mus musculus
aaagatgaagtcctgaatcactggc

SEQ ID NO: 498119 - DNA, 25 bp, Mus musculus
aaagatgaagtcgtgaatcactggc

SEQ ID NO: 498120 - DNA, 25 bp, Mus musculus
aaagatgaattcagtgatgatggac

SEQ ID NO: 498121 - DNA, 25 bp, Mus musculus
aaagatgaattctgtgatgatggac

SEQ ID NO: 498122 - DNA, 25 bp, Mus musculus
aaagatgacaggaaacgtctgctcg

SEQ ID NO: 498123 - DNA, 25 bp, Mus musculus
aaagatgacaggtaacgtctgctcg

SEQ ID NO: 498124 - DNA, 25 bp, Mus musculus
aaagatgactacaaacataggatgt

SEQ ID NO: 498125 - DNA, 25 bp, Mus musculus
aaagatgactactaacataggatgt

SEQ ID NO: 498126 - DNA, 25 bp, Mus musculus
aaagatgattttaaagggcctgaat

SEQ ID NO: 498127 - DNA, 25 bp, Mus musculus
aaagatgatttttaagggcctgaat

SEQ ID NO: 498128 - DNA, 25 bp, Mus musculus
aaagatgcagatccccttccagaag

SEQ ID NO: 498129 - DNA, 25 bp, Mus musculus
aaagatgcagatgcccttccagaag

SEQ ID NO: 498130 - DNA, 25 bp, Mus musculus
aaagatgcaggtctgccctgccgct

SEQ ID NO: 498131 - DNA, 25 bp, Mus musculus
aaagatgcaggtgtgccctgccgct

SEQ ID NO: 498132 - DNA, 25 bp, Mus musculus
aaagatgccaccctcctgatacatg

SEQ ID NO: 498133 - DNA, 25 bp, Mus musculus
aaagatgccaccgtcctgatacatg

SEQ ID NO: 498134 - DNA, 25 bp, Mus musculus
aaagatgcccacagacaggtctggc

SEQ ID NO: 498135 - DNA, 25 bp, Mus musculus
aaagatgcccactgacaggtctggc

SEQ ID NO: 498136 - DNA, 25 bp, Mus musculus
aaagatgcctgtacaagcttctagc

SEQ ID NO: 498137 - DNA, 25 bp, Mus musculus
aaagatgcctgttcaagcttctagc

SEQ ID NO: 498138 - DNA, 25 bp, Mus musculus
aaagatgcggtgattgatggctcca

SEQ ID NO: 498139 - DNA, 25 bp, Mus musculus
aaagatgcggtgtttgatggctcca

SEQ ID NO: 498140 - DNA, 25 bp, Mus musculus
aaagatgctattcttcgagcaacgg

SEQ ID NO: 498141 - DNA, 25 bp, Mus musculus
aaagatgctattgttcgagcaacgg

SEQ ID NO: 498142 - DNA, 25 bp, Mus musculus
aaagatgctggactcaccgtcacgc

SEQ ID NO: 498143 - DNA, 25 bp, Mus musculus
aaagatgctggagtcaccgtcacgc

SEQ ID NO: 498144 - DNA, 25 bp, Mus musculus
aaagatggacaaaaaggcatatttc

SEQ ID NO: 498145 - DNA, 25 bp, Mus musculus
aaagatggacaataaggcatatttc

SEQ ID NO: 498146 - DNA, 25 bp, Mus musculus
aaagatggatctagggaccggccga

SEQ ID NO: 498147 - DNA, 25 bp, Mus musculus
aaagatggatcttgggaccggccga

SEQ ID NO: 498148 - DNA, 25 bp, Mus musculus
aaagatggcggcaggaaccagcaat

SEQ ID NO: 498149 - DNA, 25 bp, Mus musculus
aaagatggcggctggaaccagcaat

SEQ ID NO: 498150 - DNA, 25 bp, Mus musculus
aaagatggcgtaccagagcctccgg

SEQ ID NO: 498151 - DNA, 25 bp, Mus musculus
aaagatggcgtagcagagcctccgg

SEQ ID NO: 498152 - DNA, 25 bp, Mus musculus
aaagatgggattctcctggccaccg

SEQ ID NO: 498153 - DNA, 25 bp, Mus musculus
aaagatgggattgtcctggccaccg

SEQ ID NO: 498154 - DNA, 25 bp, Mus musculus
aaagatggttctagacctgacccct

SEQ ID NO: 498155 - DNA, 25 bp, Mus musculus
aaagatggttcttgacctgacccct

SEQ ID NO: 498156 - DNA, 25 bp, Mus musculus
aaagatgtagcgacagtggtgagca

SEQ ID NO: 498157 - DNA, 25 bp, Mus musculus
aaagatgtagcgtcagtggtgagca

SEQ ID NO: 498158 - DNA, 25 bp, Mus musculus
aaagatgtccaccaagactccctca

SEQ ID NO: 498159 - DNA, 25 bp, Mus musculus
aaagatgtccacgaagactccctca

SEQ ID NO: 498160 - DNA, 25 bp, Mus musculus
aaagatgtcctcaccagcacgtacg

SEQ ID NO: 498161 - DNA, 25 bp, Mus musculus
aaagatgtcctctccagcacgtacg

SEQ ID NO: 498162 - DNA, 25 bp, Mus musculus
aaagatgtctcacctgttaagtgca

SEQ ID NO: 498163 - DNA, 25 bp, Mus musculus
aaagatgtctcagctgttaagtgca

SEQ ID NO: 498164 - DNA, 25 bp, Mus musculus
aaagatgtgggacggaagcctccta

SEQ ID NO: 498165 - DNA, 25 bp, Mus musculus
aaagatgtgggagggaagcctccta

SEQ ID NO: 498166 - DNA, 25 bp, Mus musculus
aaagatgtttctcctcctggctcgg

SEQ ID NO: 498167 - DNA, 25 bp, Mus musculus
aaagatgtttctgctcctggctcgg

SEQ ID NO: 498168 - DNA, 25 bp, Mus musculus
aaagatgtttggatttcacaagcca

SEQ ID NO: 498169 - DNA, 25 bp, Mus musculus
aaagatgtttggttttcacaagcca

SEQ ID NO: 498170 - DNA, 25 bp, Mus musculus
aaagattatgcccaaagtgagaaaa

SEQ ID NO: 498171 - DNA, 25 bp, Mus musculus
aaagattatgccgaaagtgagaaaa

SEQ ID NO: 498172 - DNA, 25 bp, Mus musculus
aaagattctccaagcaaaccaaggg

SEQ ID NO: 498173 - DNA, 25 bp, Mus musculus
aaagattctccatgcaaaccaaggg

SEQ ID NO: 498174 - DNA, 25 bp, Mus musculus
aaagcaaaataaacccctaagagag

SEQ ID NO: 498175 - DNA, 25 bp, Mus musculus
aaagcaaaataatcccctaagagag

SEQ ID NO: 498176 - DNA, 25 bp, Mus musculus
aaagcaaaccagatcttcagcgcct

SEQ ID NO: 498177 - DNA, 25 bp, Mus musculus
aaagcaaaccagttcttcagcgcct

SEQ ID NO: 498178 - DNA, 25 bp, Mus musculus
aaagcaaagacccagtggagacgct

SEQ ID NO: 498179 - DNA, 25 bp, Mus musculus
aaagcaaagaccgagtggagacgct

SEQ ID NO: 498180 - DNA, 25 bp, Mus musculus
aaagcaaagggacaacaagcaggtg

SEQ ID NO: 498181 - DNA, 25 bp, Mus musculus
aaagcaaagggagaacaagcaggtg

SEQ ID NO: 498182 - DNA, 25 bp, Mus musculus
aaagcaaagtgtacgaggctaatga

SEQ ID NO: 498183 - DNA, 25 bp, Mus musculus
aaagcaaagtgttcgaggctaatga

SEQ ID NO: 498184 - DNA, 25 bp, Mus musculus
aaagcaaatatgaagttctcacagg

SEQ ID NO: 498185 - DNA, 25 bp, Mus musculus
aaagcaaatatgtagttctcacagg

SEQ ID NO: 498186 - DNA, 25 bp, Mus musculus
aaagcaacaaatcgaccaagatacg

SEQ ID NO: 498187 - DNA, 25 bp, Mus musculus
aaagcaacaaatggaccaagatacg

SEQ ID NO: 498188 - DNA, 25 bp, Mus musculus
aaagcaacaccgcagcctccagtag

SEQ ID NO: 498189 - DNA, 25 bp, Mus musculus
aaagcaacaccggagcctccagtag

SEQ ID NO: 498190 - DNA, 25 bp, Mus musculus
aaagcaaccagcaatgccacggtgg

SEQ ID NO: 498191 - DNA, 25 bp, Mus musculus
aaagcaaccagctatgccacggtgg

SEQ ID NO: 498192 - DNA, 25 bp, Mus musculus
aaagcaactggcaggaatgatcacc

SEQ ID NO: 498193 - DNA, 25 bp, Mus musculus
aaagcaactggctggaatgatcacc

SEQ ID NO: 498194 - DNA, 25 bp, Mus musculus
aaagcaagaacgactgtgacgagga

SEQ ID NO: 498195 - DNA, 25 bp, Mus musculus
aaagcaagaacgtctgtgacgagga

SEQ ID NO: 498196 - DNA, 25 bp, Mus musculus
aaagcaagaataatcctggaggaga

SEQ ID NO: 498197 - DNA, 25 bp, Mus musculus
aaagcaagaatattcctggaggaga

SEQ ID NO: 498198 - DNA, 25 bp, Mus musculus
aaagcaagcacgatgcagccacctg

SEQ ID NO: 498199 - DNA, 25 bp, Mus musculus
aaagcaagcacgttgcagccacctg

SEQ ID NO: 498200 - DNA, 25 bp, Mus musculus
aaagcaagcctgaacagtgcctgac

SEQ ID NO: 498201 - DNA, 25 bp, Mus musculus
aaagcaagcctgtacagtgcctgac

SEQ ID NO: 498202 - DNA, 25 bp, Mus musculus
aaagcaagctctagctgctaaaaga

SEQ ID NO: 498203 - DNA, 25 bp, Mus musculus
aaagcaagctcttgctgctaaaaga

SEQ ID NO: 498204 - DNA, 25 bp, Mus musculus
aaagcaagctgaactttacatttct

SEQ ID NO: 498205 - DNA, 25 bp, Mus musculus
aaagcaagctgatctttacatttct

SEQ ID NO: 498206 - DNA, 25 bp, Mus musculus
aaagcaaggtgccaacatagtttct

SEQ ID NO: 498207 - DNA, 25 bp, Mus musculus
aaagcaaggtgcgaacatagtttct

SEQ ID NO: 498208 - DNA, 25 bp, Mus musculus
aaagcaaggtggattcctgccaggg

SEQ ID NO: 498209 - DNA, 25 bp, Mus musculus
aaagcaaggtggtttcctgccaggg

SEQ ID NO: 498210 - DNA, 25 bp, Mus musculus
aaagcaataaggagaaggttgctca

SEQ ID NO: 498211 - DNA, 25 bp, Mus musculus
aaagcaataaggtgaaggttgctca

SEQ ID NO: 498212 - DNA, 25 bp, Mus musculus
aaagcaatcttgaaagcacgtggat

SEQ ID NO: 498213 - DNA, 25 bp, Mus musculus
aaagcaatcttgtaagcacgtggat

SEQ ID NO: 498214 - DNA, 25 bp, Mus musculus
aaagcaattcgccaggccctcatgc

SEQ ID NO: 498215 - DNA, 25 bp, Mus musculus
aaagcaattcgcgaggccctcatgc

SEQ ID NO: 498216 - DNA, 25 bp, Mus musculus
aaagcacacagaagaactcatacag

SEQ ID NO: 498217 - DNA, 25 bp, Mus musculus
aaagcacacagatgaactcatacag

SEQ ID NO: 498218 - DNA, 25 bp, Mus musculus
aaagcacactcacgatgtgaccatc

SEQ ID NO: 498219 - DNA, 25 bp, Mus musculus
aaagcacactcaggatgtgaccatc

SEQ ID NO: 498220 - DNA, 25 bp, Mus musculus
aaagcacagcatcccaccgtgtgac

SEQ ID NO: 498221 - DNA, 25 bp, Mus musculus
aaagcacagcatgccaccgtgtgac

SEQ ID NO: 498222 - DNA, 25 bp, Mus musculus
aaagcacagggacgcaggctgtact

SEQ ID NO: 498223 - DNA, 25 bp, Mus musculus
aaagcacagggaggcaggctgtact

SEQ ID NO: 498224 - DNA, 25 bp, Mus musculus
aaagcaccaatcagacttgagaaag

SEQ ID NO: 498225 - DNA, 25 bp, Mus musculus
aaagcaccaatctgacttgagaaag

SEQ ID NO: 498226 - DNA, 25 bp, Mus musculus
aaagcaccattcattgcagagagaa

SEQ ID NO: 498227 - DNA, 25 bp, Mus musculus
aaagcaccattctttgcagagagaa

SEQ ID NO: 498228 - DNA, 25 bp, Mus musculus
aaagcacgcgcacctttgtgcctgg

SEQ ID NO: 498229 - DNA, 25 bp, Mus musculus
aaagcacgcgcagctttgtgcctgg

SEQ ID NO: 498230 - DNA, 25 bp, Mus musculus
aaagcactattgcttgccggcatcc

SEQ ID NO: 498231 - DNA, 25 bp, Mus musculus
aaagcactattggttgccggcatcc

SEQ ID NO: 498232 - DNA, 25 bp, Mus musculus
aaagcactcccaccacactgaagaa

SEQ ID NO: 498233 - DNA, 25 bp, Mus musculus
aaagcactcccagcacactgaagaa

SEQ ID NO: 498234 - DNA, 25 bp, Mus musculus
aaagcactgaaacgctacgaaggcc

SEQ ID NO: 498235 - DNA, 25 bp, Mus musculus
aaagcactgaaaggctacgaaggcc

SEQ ID NO: 498236 - DNA, 25 bp, Mus musculus
aaagcactgaagctggctgctgcgc

SEQ ID NO: 498237 - DNA, 25 bp, Mus musculus
aaagcactgaaggtggctgctgcgc

SEQ ID NO: 498238 - DNA, 25 bp, Mus musculus
aaagcactggtgcaccagagggagc

SEQ ID NO: 498239 - DNA, 25 bp, Mus musculus
aaagcactggtggaccagagggagc

SEQ ID NO: 498240 - DNA, 25 bp, Mus musculus
aaagcacttcgtacctgacctataa

SEQ ID NO: 498241 - DNA, 25 bp, Mus musculus
aaagcacttcgttcctgacctataa

SEQ ID NO: 498242 - DNA, 25 bp, Mus musculus
aaagcagactgaaatcccgggttct

SEQ ID NO: 498243 - DNA, 25 bp, Mus musculus
aaagcagactgatatcccgggttct

SEQ ID NO: 498244 - DNA, 25 bp, Mus musculus
aaagcagagaccaccctgattccca

SEQ ID NO: 498245 - DNA, 25 bp, Mus musculus
aaagcagagacctccctgattccca

SEQ ID NO: 498246 - DNA, 25 bp, Mus musculus
aaagcagagcaaagtggaagctaaa

SEQ ID NO: 498247 - DNA, 25 bp, Mus musculus
aaagcagagcaatgtggaagctaaa

SEQ ID NO: 498248 - DNA, 25 bp, Mus musculus
aaagcagagtgacagatcagccgcc

SEQ ID NO: 498249 - DNA, 25 bp, Mus musculus
aaagcagagtgagagatcagccgcc

SEQ ID NO: 498250 - DNA, 25 bp, Mus musculus
aaagcagatcgaccacactctgaat

SEQ ID NO: 498251 - DNA, 25 bp, Mus musculus
aaagcagatcgagcacactctgaat

SEQ ID NO: 498252 - DNA, 25 bp, Mus musculus
aaagcagatgctaccttcagactga

SEQ ID NO: 498253 - DNA, 25 bp, Mus musculus
aaagcagatgcttccttcagactga

SEQ ID NO: 498254 - DNA, 25 bp, Mus musculus
aaagcagcaacaatctttggatgca

SEQ ID NO: 498255 - DNA, 25 bp, Mus musculus
aaagcagcaacattctttggatgca

SEQ ID NO: 498256 - DNA, 25 bp, Mus musculus
aaagcagcaggcacctcattacctc

SEQ ID NO: 498257 - DNA, 25 bp, Mus musculus
aaagcagcaggctcctcattacctc

SEQ ID NO: 498258 - DNA, 25 bp, Mus musculus
aaagcagcagggacaccagaaacca

SEQ ID NO: 498259 - DNA, 25 bp, Mus musculus
aaagcagcagggtcaccagaaacca

SEQ ID NO: 498260 - DNA, 25 bp, Mus musculus
aaagcagccctgatctgacgatgat

SEQ ID NO: 498261 - DNA, 25 bp, Mus musculus
aaagcagccctgttctgacgatgat

SEQ ID NO: 498262 - DNA, 25 bp, Mus musculus
aaagcagctgaaccggcggccgagt

SEQ ID NO: 498263 - DNA, 25 bp, Mus musculus
aaagcagctgaagcggcggccgagt

SEQ ID NO: 498264 - DNA, 25 bp, Mus musculus
aaagcagctggtatcaaagatcctc

SEQ ID NO: 498265 - DNA, 25 bp, Mus musculus
aaagcagctggtttcaaagatcctc

SEQ ID NO: 498266 - DNA, 25 bp, Mus musculus
aaagcagcttgaccgatttcaccac

SEQ ID NO: 498267 - DNA, 25 bp, Mus musculus
aaagcagcttgagcgatttcaccac

SEQ ID NO: 498268 - DNA, 25 bp, Mus musculus
aaagcaggaaagcatgacgcagaga

SEQ ID NO: 498269 - DNA, 25 bp, Mus musculus
aaagcaggaaaggatgacgcagaga

SEQ ID NO: 498270 - DNA, 25 bp, Mus musculus
aaagcaggaagtcgctagctggacc

SEQ ID NO: 498271 - DNA, 25 bp, Mus musculus
aaagcaggaagtggctagctggacc

SEQ ID NO: 498272 - DNA, 25 bp, Mus musculus
aaagcaggatctcttggaattaacc

SEQ ID NO: 498273 - DNA, 25 bp, Mus musculus
aaagcaggatctgttggaattaacc

SEQ ID NO: 498274 - DNA, 25 bp, Mus musculus
aaagcaggatgaacaagtgggcctt

SEQ ID NO: 498275 - DNA, 25 bp, Mus musculus
aaagcaggatgatcaagtgggcctt

SEQ ID NO: 498276 - DNA, 25 bp, Mus musculus
aaagcagggctacaattggaactca

SEQ ID NO: 498277 - DNA, 25 bp, Mus musculus
aaagcagggctagaattggaactca

SEQ ID NO: 498278 - DNA, 25 bp, Mus musculus
aaagcagtcctgcagaataatttag

SEQ ID NO: 498279 - DNA, 25 bp, Mus musculus
aaagcagtcctggagaataatttag

SEQ ID NO: 498280 - DNA, 25 bp, Mus musculus
aaagcagtcggccatcctcctgaga

SEQ ID NO: 498281 - DNA, 25 bp, Mus musculus
aaagcagtcggcgatcctcctgaga

SEQ ID NO: 498282 - DNA, 25 bp, Mus musculus
aaagcagtctctcgcgccatcgtag

SEQ ID NO: 498283 - DNA, 25 bp, Mus musculus
aaagcagtctctggcgccatcgtag

SEQ ID NO: 498284 - DNA, 25 bp, Mus musculus
aaagcagttcaccttcgatggcgcc

SEQ ID NO: 498285 - DNA, 25 bp, Mus musculus
aaagcagttcacgttcgatggcgcc

SEQ ID NO: 498286 - DNA, 25 bp, Mus musculus
aaagcagtttgacaaaatcctcgag

SEQ ID NO: 498287 - DNA, 25 bp, Mus musculus
aaagcagtttgagaaaatcctcgag

SEQ ID NO: 498288 - DNA, 25 bp, Mus musculus
aaagcatcagttcttcagagagtgg

SEQ ID NO: 498289 - DNA, 25 bp, Mus musculus
aaagcatcagttgttcagagagtgg

SEQ ID NO: 498290 - DNA, 25 bp, Mus musculus
aaagcatgatggcttgcctcctgtc

SEQ ID NO: 498291 - DNA, 25 bp, Mus musculus
aaagcatgatgggttgcctcctgtc

SEQ ID NO: 498292 - DNA, 25 bp, Mus musculus
aaagcatgctagagattcaagttca

SEQ ID NO: 498293 - DNA, 25 bp, Mus musculus
aaagcatgctagtgattcaagttca

SEQ ID NO: 498294 - DNA, 25 bp, Mus musculus
aaagcatggaaaccagaccgggcag

SEQ ID NO: 498295 - DNA, 25 bp, Mus musculus
aaagcatggaaagcagaccgggcag

SEQ ID NO: 498296 - DNA, 25 bp, Mus musculus
aaagcatgtggaaggaccggaacct

SEQ ID NO: 498297 - DNA, 25 bp, Mus musculus
aaagcatgtggatggaccggaacct

SEQ ID NO: 498298 - DNA, 25 bp, Mus musculus
aaagcattccgcaccaaagctggga

SEQ ID NO: 498299 - DNA, 25 bp, Mus musculus
aaagcattccgctccaaagctggga

SEQ ID NO: 498300 - DNA, 25 bp, Mus musculus
aaagcattcgaactatgctggccac

SEQ ID NO: 498301 - DNA, 25 bp, Mus musculus
aaagcattcgaagtatgctggccac

SEQ ID NO: 498302 - DNA, 25 bp, Mus musculus
aaagcattcttcatggtgctcaggc

SEQ ID NO: 498303 - DNA, 25 bp, Mus musculus
aaagcattcttcttggtgctcaggc

SEQ ID NO: 498304 - DNA, 25 bp, Mus musculus
aaagcattgctcaccagtgatgaca

SEQ ID NO: 498305 - DNA, 25 bp, Mus musculus
aaagcattgctctccagtgatgaca

SEQ ID NO: 498306 - DNA, 25 bp, Mus musculus
aaagccaaagagactccctctgtga

SEQ ID NO: 498307 - DNA, 25 bp, Mus musculus
aaagccaaagagtctccctctgtga

SEQ ID NO: 498308 - DNA, 25 bp, Mus musculus
aaagccaacaccaggaagcgccaca

SEQ ID NO: 498309 - DNA, 25 bp, Mus musculus
aaagccaacacctggaagcgccaca

SEQ ID NO: 498310 - DNA, 25 bp, Mus musculus
aaagccaagacacaccatggagcag

SEQ ID NO: 498311 - DNA, 25 bp, Mus musculus
aaagccaagacagaccatggagcag

SEQ ID NO: 498312 - DNA, 25 bp, Mus musculus
aaagccaagataccagagcgctgcc

SEQ ID NO: 498313 - DNA, 25 bp, Mus musculus
aaagccaagatagcagagcgctgcc

SEQ ID NO: 498314 - DNA, 25 bp, Mus musculus
aaagccaagatgcaggaaccaagag

SEQ ID NO: 498315 - DNA, 25 bp, Mus musculus
aaagccaagatggaggaaccaagag

SEQ ID NO: 498316 - DNA, 25 bp, Mus musculus
aaagccaagggtaatccagcacaca

SEQ ID NO: 498317 - DNA, 25 bp, Mus musculus
aaagccaagggtacattcatcgcag

SEQ ID NO: 498318 - DNA, 25 bp, Mus musculus
aaagccaagggttatccagcacaca

SEQ ID NO: 498319 - DNA, 25 bp, Mus musculus
aaagccaagggttcattcatcgcag

SEQ ID NO: 498320 - DNA, 25 bp, Mus musculus
aaagccaagtgtagagacacacact

SEQ ID NO: 498321 - DNA, 25 bp, Mus musculus
aaagccaagtgttgagacacacact

SEQ ID NO: 498322 - DNA, 25 bp, Mus musculus
aaagccacagaacaggataaagcca

SEQ ID NO: 498323 - DNA, 25 bp, Mus musculus
aaagccacagaagaggataaagcca

SEQ ID NO: 498324 - DNA, 25 bp, Mus musculus
aaagccacaggtactgcgatcgtgt

SEQ ID NO: 498325 - DNA, 25 bp, Mus musculus
aaagccacaggttctgcgatcgtgt

SEQ ID NO: 498326 - DNA, 25 bp, Mus musculus
aaagccacagtcagtgggaactaca

SEQ ID NO: 498327 - DNA, 25 bp, Mus musculus
aaagccacagtctgtgggaactaca

SEQ ID NO: 498328 - DNA, 25 bp, Mus musculus
aaagccaccagccagcttctgttgg

SEQ ID NO: 498329 - DNA, 25 bp, Mus musculus
aaagccaccagcgagcttctgttgg

SEQ ID NO: 498330 - DNA, 25 bp, Mus musculus
aaagccaccatgcaaacaacccaga

SEQ ID NO: 498331 - DNA, 25 bp, Mus musculus
aaagccaccatggaaacaacccaga

SEQ ID NO: 498332 - DNA, 25 bp, Mus musculus
aaagccacgtggcatgcaagaaatg

SEQ ID NO: 498333 - DNA, 25 bp, Mus musculus
aaagccacgtgggatgcaagaaatg

SEQ ID NO: 498334 - DNA, 25 bp, Mus musculus
aaagccactgtgacatcgatgagcg

SEQ ID NO: 498335 - DNA, 25 bp, Mus musculus
aaagccactgtgtcatcgatgagcg

SEQ ID NO: 498336 - DNA, 25 bp, Mus musculus
aaagccacttggcacctggttgcct

SEQ ID NO: 498337 - DNA, 25 bp, Mus musculus
aaagccacttgggacctggttgcct

SEQ ID NO: 498338 - DNA, 25 bp, Mus musculus
aaagccagacaccttactcgacaac

SEQ ID NO: 498339 - DNA, 25 bp, Mus musculus
aaagccagacacgttactcgacaac

SEQ ID NO: 498340 - DNA, 25 bp, Mus musculus
aaagccagaccacaccttccggcgg

SEQ ID NO: 498341 - DNA, 25 bp, Mus musculus
aaagccagaccagaccttccggcgg

SEQ ID NO: 498342 - DNA, 25 bp, Mus musculus
aaagccagagaacatcctatgtgag

SEQ ID NO: 498343 - DNA, 25 bp, Mus musculus
aaagccagagaagatcctatgtgag

SEQ ID NO: 498344 - DNA, 25 bp, Mus musculus
aaagccatcgatctggtgacaaaag

SEQ ID NO: 498345 - DNA, 25 bp, Mus musculus
aaagccatcgatgtggtgacaaaag

SEQ ID NO: 498346 - DNA, 25 bp, Mus musculus
aaagccattcgacgagttgtcttcg

SEQ ID NO: 498347 - DNA, 25 bp, Mus musculus
aaagccattcgaggagttgtcttcg

SEQ ID NO: 498348 - DNA, 25 bp, Mus musculus
aaagccattggcctggagattaagc

SEQ ID NO: 498349 - DNA, 25 bp, Mus musculus
aaagccattggcgtggagattaagc

SEQ ID NO: 498350 - DNA, 25 bp, Mus musculus
aaagcccacatgctaaccctggact

SEQ ID NO: 498351 - DNA, 25 bp, Mus musculus
aaagcccacatggtaaccctggact

SEQ ID NO: 498352 - DNA, 25 bp, Mus musculus
aaagcccaccatacgtttccagttg

SEQ ID NO: 498353 - DNA, 25 bp, Mus musculus
aaagcccaccattcgtttccagttg

SEQ ID NO: 498354 - DNA, 25 bp, Mus musculus
aaagcccagaaactgagcatggctc

SEQ ID NO: 498355 - DNA, 25 bp, Mus musculus
aaagcccagaaagtgagcatggctc

SEQ ID NO: 498356 - DNA, 25 bp, Mus musculus
aaagcccagcaacctagctgtgaac

SEQ ID NO: 498357 - DNA, 25 bp, Mus musculus
aaagcccagcaagctagctgtgaac

SEQ ID NO: 498358 - DNA, 25 bp, Mus musculus
aaagcccagcgtcaatgcggttgcc

SEQ ID NO: 498359 - DNA, 25 bp, Mus musculus
aaagcccagcgtgaatgcggttgcc

SEQ ID NO: 498360 - DNA, 25 bp, Mus musculus
aaagcccaggcccttaatgtggcca

SEQ ID NO: 498361 - DNA, 25 bp, Mus musculus
aaagcccaggccgttaatgtggcca

SEQ ID NO: 498362 - DNA, 25 bp, Mus musculus
aaagcccatgggagaagtcagatag

SEQ ID NO: 498363 - DNA, 25 bp, Mus musculus
aaagcccatgggtgaagtcagatag

SEQ ID NO: 498364 - DNA, 25 bp, Mus musculus
aaagccccatgtcccttgtccagga

SEQ ID NO: 498365 - DNA, 25 bp, Mus musculus
aaagccccatgtgccttgtccagga

SEQ ID NO: 498366 - DNA, 25 bp, Mus musculus
aaagcccctcctaactgtgacatca

SEQ ID NO: 498367 - DNA, 25 bp, Mus musculus
aaagcccctccttactgtgacatca

SEQ ID NO: 498368 - DNA, 25 bp, Mus musculus
aaagcccctgcaacgctgaagagca

SEQ ID NO: 498369 - DNA, 25 bp, Mus musculus
aaagcccctgcatcgctgaagagca

SEQ ID NO: 498370 - DNA, 25 bp, Mus musculus
aaagcccctggtagaagtgtctgtc

SEQ ID NO: 498371 - DNA, 25 bp, Mus musculus
aaagcccctggttgaagtgtctgtc

SEQ ID NO: 498372 - DNA, 25 bp, Mus musculus
aaagcccgaaatccttatctcaata

SEQ ID NO: 498373 - DNA, 25 bp, Mus musculus
aaagcccgaaatgcttatctcaata

SEQ ID NO: 498374 - DNA, 25 bp, Mus musculus
aaagcccggattcaggatccccaag

SEQ ID NO: 498375 - DNA, 25 bp, Mus musculus
aaagcccggattgaggatccccaag

SEQ ID NO: 498376 - DNA, 25 bp, Mus musculus
aaagcccgtgaacaatgcttctgga

SEQ ID NO: 498377 - DNA, 25 bp, Mus musculus
aaagcccgtgaagaatgcttctgga

SEQ ID NO: 498378 - DNA, 25 bp, Mus musculus
aaagccctcatgaaggctgtggcga

SEQ ID NO: 498379 - DNA, 25 bp, Mus musculus
aaagccctcatgtaggctgtggcga

SEQ ID NO: 498380 - DNA, 25 bp, Mus musculus
aaagccctcgtgagcgcgggaccca

SEQ ID NO: 498381 - DNA, 25 bp, Mus musculus
aaagccctcgtgtgcgcgggaccca

SEQ ID NO: 498382 - DNA, 25 bp, Mus musculus
aaagccctgcagcaatactccagta

SEQ ID NO: 498383 - DNA, 25 bp, Mus musculus
aaagccctgcaggaatactccagta

SEQ ID NO: 498384 - DNA, 25 bp, Mus musculus
aaagccctggagaatgaccccgact

SEQ ID NO: 498385 - DNA, 25 bp, Mus musculus
aaagccctggagtatgaccccgact

SEQ ID NO: 498386 - DNA, 25 bp, Mus musculus
aaagccctggctctcgctctgagct

SEQ ID NO: 498387 - DNA, 25 bp, Mus musculus
aaagccctggctgtcgctctgagct

SEQ ID NO: 498388 - DNA, 25 bp, Mus musculus
aaagccctgggcatgtccaacttca

SEQ ID NO: 498389 - DNA, 25 bp, Mus musculus
aaagccctgggcttgtccaacttca

SEQ ID NO: 498390 - DNA, 25 bp, Mus musculus
aaagccctggtcaagattgtgcccg

SEQ ID NO: 498391 - DNA, 25 bp, Mus musculus
aaagccctggtctagattgtgcccg

SEQ ID NO: 498392 - DNA, 25 bp, Mus musculus
aaagcccttcagcaccaggtggcct

SEQ ID NO: 498393 - DNA, 25 bp, Mus musculus
aaagcccttcaggaccaggtggcct

SEQ ID NO: 498394 - DNA, 25 bp, Mus musculus
aaagccgacagaagctgagcttgtc

SEQ ID NO: 498395 - DNA, 25 bp, Mus musculus
aaagccgacagatgctgagcttgtc

SEQ ID NO: 498396 - DNA, 25 bp, Mus musculus
aaagccgagaccacctttcgcaggt

SEQ ID NO: 498397 - DNA, 25 bp, Mus musculus
aaagccgagacctcctttcgcaggt

SEQ ID NO: 498398 - DNA, 25 bp, Mus musculus
aaagccgagcccaaaaagatgaaga

SEQ ID NO: 498399 - DNA, 25 bp, Mus musculus
aaagccgagccctaaaagatgaaga

SEQ ID NO: 498400 - DNA, 25 bp, Mus musculus
aaagccgcctctcctggctctgtgg

SEQ ID NO: 498401 - DNA, 25 bp, Mus musculus
aaagccgcctctgctggctctgtgg

SEQ ID NO: 498402 - DNA, 25 bp, Mus musculus
aaagccggacagaggcagtgaaaca

SEQ ID NO: 498403 - DNA, 25 bp, Mus musculus
aaagccggacagtggcagtgaaaca

SEQ ID NO: 498404 - DNA, 25 bp, Mus musculus
aaagccggctggacctgatagccca

SEQ ID NO: 498405 - DNA, 25 bp, Mus musculus
aaagccggctggtcctgatagccca

SEQ ID NO: 498406 - DNA, 25 bp, Mus musculus
aaagccgggcccctgctgtctgtga

SEQ ID NO: 498407 - DNA, 25 bp, Mus musculus
aaagccgggcccgtgctgtctgtga

SEQ ID NO: 498408 - DNA, 25 bp, Mus musculus
aaagccgggcgtctatacccgagtg

SEQ ID NO: 498409 - DNA, 25 bp, Mus musculus
aaagccgggcgtgtatacccgagtg

SEQ ID NO: 498410 - DNA, 25 bp, Mus musculus
aaagccgtcacaaccgcgacagctt

SEQ ID NO: 498411 - DNA, 25 bp, Mus musculus
aaagccgtcacatccgcgacagctt

SEQ ID NO: 498412 - DNA, 25 bp, Mus musculus
aaagccgtgcaacacttctacagtg

SEQ ID NO: 498413 - DNA, 25 bp, Mus musculus
aaagccgtgcaagacttctacagtg

SEQ ID NO: 498414 - DNA, 25 bp, Mus musculus
aaagccgttgctactctcaagccca

SEQ ID NO: 498415 - DNA, 25 bp, Mus musculus
aaagccgttgcttctctcaagccca

SEQ ID NO: 498416 - DNA, 25 bp, Mus musculus
aaagcctaggaaccgactctggcca

SEQ ID NO: 498417 - DNA, 25 bp, Mus musculus
aaagcctaggaagcgactctggcca

SEQ ID NO: 498418 - DNA, 25 bp, Mus musculus
aaagcctataggctcaggagctcaa

SEQ ID NO: 498419 - DNA, 25 bp, Mus musculus
aaagcctatagggtcaggagctcaa

SEQ ID NO: 498420 - DNA, 25 bp, Mus musculus
aaagcctatgcaaccctgaagcagg

SEQ ID NO: 498421 - DNA, 25 bp, Mus musculus
aaagcctatgcatccctgaagcagg

SEQ ID NO: 498422 - DNA, 25 bp, Mus musculus
aaagcctcagagacgttcctcctcg

SEQ ID NO: 498423 - DNA, 25 bp, Mus musculus
aaagcctcagagtcgttcctcctcg

SEQ ID NO: 498424 - DNA, 25 bp, Mus musculus
aaagcctccgaaagcagctaggcca

SEQ ID NO: 498425 - DNA, 25 bp, Mus musculus
aaagcctccgaatgcagctaggcca

SEQ ID NO: 498426 - DNA, 25 bp, Mus musculus
aaagcctcgtggagttccagggccg

SEQ ID NO: 498427 - DNA, 25 bp, Mus musculus
aaagcctcgtggtgttccagggccg

SEQ ID NO: 498428 - DNA, 25 bp, Mus musculus
aaagcctctaacctcaaagcaatgg

SEQ ID NO: 498429 - DNA, 25 bp, Mus musculus
aaagcctctaacgtcaaagcaatgg

SEQ ID NO: 498430 - DNA, 25 bp, Mus musculus
aaagcctgacctccgtgcatcagag

SEQ ID NO: 498431 - DNA, 25 bp, Mus musculus
aaagcctgacctgcgtgcatcagag

SEQ ID NO: 498432 - DNA, 25 bp, Mus musculus
aaagcctgcggcaatgggaattcca

SEQ ID NO: 498433 - DNA, 25 bp, Mus musculus
aaagcctgcggctatgggaattcca

SEQ ID NO: 498434 - DNA, 25 bp, Mus musculus
aaagcctgctggcacatgtcatcgc

SEQ ID NO: 498435 - DNA, 25 bp, Mus musculus
aaagcctgctgggacatgtcatcgc

SEQ ID NO: 498436 - DNA, 25 bp, Mus musculus
aaagcctggctaaggaactagcacg

SEQ ID NO: 498437 - DNA, 25 bp, Mus musculus
aaagcctggctatggaactagcacg

SEQ ID NO: 498438 - DNA, 25 bp, Mus musculus
aaagcctgggctcaggtgggaacaa

SEQ ID NO: 498439 - DNA, 25 bp, Mus musculus
aaagcctgggctgaggtgggaacaa

SEQ ID NO: 498440 - DNA, 25 bp, Mus musculus
aaagcctgggtgagcgtgcgctccc

SEQ ID NO: 498441 - DNA, 25 bp, Mus musculus
aaagcctgggtgtgcgtgcgctccc

SEQ ID NO: 498442 - DNA, 25 bp, Mus musculus
aaagccttaagtcacttcctcctca

SEQ ID NO: 498443 - DNA, 25 bp, Mus musculus
aaagccttaagtgacttcctcctca

SEQ ID NO: 498444 - DNA, 25 bp, Mus musculus
aaagccttcggcatccgttttgaca

SEQ ID NO: 498445 - DNA, 25 bp, Mus musculus
aaagccttcggcttccgttttgaca

SEQ ID NO: 498446 - DNA, 25 bp, Mus musculus
aaagccttgcccaggaagtccaaag

SEQ ID NO: 498447 - DNA, 25 bp, Mus musculus
aaagccttgccctggaagtccaaag

SEQ ID NO: 498448 - DNA, 25 bp, Mus musculus
aaagccttggatatggattgttgcc

SEQ ID NO: 498449 - DNA, 25 bp, Mus musculus
aaagccttggatttggattgttgcc

SEQ ID NO: 498450 - DNA, 25 bp, Mus musculus
aaagcctttgctcagctctttcctc

SEQ ID NO: 498451 - DNA, 25 bp, Mus musculus
aaagcctttgctgagctctttcctc

SEQ ID NO: 498452 - DNA, 25 bp, Mus musculus
aaagcgacagcgctccctctactga

SEQ ID NO: 498453 - DNA, 25 bp, Mus musculus
aaagcgacagcggtccctctactga

SEQ ID NO: 498454 - DNA, 25 bp, Mus musculus
aaagcgaccgcgctgtcaaggctcg

SEQ ID NO: 498455 - DNA, 25 bp, Mus musculus
aaagcgaccgcggtgtcaaggctcg

SEQ ID NO: 498456 - DNA, 25 bp, Mus musculus
aaagcgagcacccagcttctgtcgc

SEQ ID NO: 498457 - DNA, 25 bp, Mus musculus
aaagcgagcaccgagcttctgtcgc

SEQ ID NO: 498458 - DNA, 25 bp, Mus musculus
aaagcgagcagtacgtctcggcgac

SEQ ID NO: 498459 - DNA, 25 bp, Mus musculus
aaagcgagcagttcgtctcggcgac

SEQ ID NO: 498460 - DNA, 25 bp, Mus musculus
aaagcgagctgcacgagcggtacat

SEQ ID NO: 498461 - DNA, 25 bp, Mus musculus
aaagcgagctgctcgagcggtacat

SEQ ID NO: 498462 - DNA, 25 bp, Mus musculus
aaagcgatggcactcaccagtgact

SEQ ID NO: 498463 - DNA, 25 bp, Mus musculus
aaagcgatggcagtcaccagtgact

SEQ ID NO: 498464 - DNA, 25 bp, Mus musculus
aaagcgcaataacatgtccactagg

SEQ ID NO: 498465 - DNA, 25 bp, Mus musculus
aaagcgcaataagatgtccactagg

SEQ ID NO: 498466 - DNA, 25 bp, Mus musculus
aaagcgcacagtcggcgaatcccca

SEQ ID NO: 498467 - DNA, 25 bp, Mus musculus
aaagcgcacagtgggcgaatcccca

SEQ ID NO: 498468 - DNA, 25 bp, Mus musculus
aaagcgcagagtaggccctgtggca

SEQ ID NO: 498469 - DNA, 25 bp, Mus musculus
aaagcgcagagttggccctgtggca

SEQ ID NO: 498470 - DNA, 25 bp, Mus musculus
aaagcgcagcatctctggattccag

SEQ ID NO: 498471 - DNA, 25 bp, Mus musculus
aaagcgcagcatgtctggattccag

SEQ ID NO: 498472 - DNA, 25 bp, Mus musculus
aaagcgccagatagggtggtttcca

SEQ ID NO: 498473 - DNA, 25 bp, Mus musculus
aaagcgccagattgggtggtttcca

SEQ ID NO: 498474 - DNA, 25 bp, Mus musculus
aaagcgcctgctagcctctgtgtca

SEQ ID NO: 498475 - DNA, 25 bp, Mus musculus
aaagcgcctgcttgcctctgtgtca

SEQ ID NO: 498476 - DNA, 25 bp, Mus musculus
aaagcgcgtagccagaacccaggca

SEQ ID NO: 498477 - DNA, 25 bp, Mus musculus
aaagcgcgtagcgagaacccaggca

SEQ ID NO: 498478 - DNA, 25 bp, Mus musculus
aaagcgcttgctcgaggccagtgca

SEQ ID NO: 498479 - DNA, 25 bp, Mus musculus
aaagcgcttgctggaggccagtgca

SEQ ID NO: 498480 - DNA, 25 bp, Mus musculus
aaagcggatcctccttgctcaagtg

SEQ ID NO: 498481 - DNA, 25 bp, Mus musculus
aaagcggatcctgcttgctcaagtg

SEQ ID NO: 498482 - DNA, 25 bp, Mus musculus
aaagcggctggcagctgcacggaca

SEQ ID NO: 498483 - DNA, 25 bp, Mus musculus
aaagcggctggctgctgcacggaca

SEQ ID NO: 498484 - DNA, 25 bp, Mus musculus
aaagcgggctgaattctccactaca

SEQ ID NO: 498485 - DNA, 25 bp, Mus musculus
aaagcgggctgatttctccactaca

SEQ ID NO: 498486 - DNA, 25 bp, Mus musculus
aaagcgggtctgcagtaaacaacag

SEQ ID NO: 498487 - DNA, 25 bp, Mus musculus
aaagcgggtctggagtaaacaacag

SEQ ID NO: 498488 - DNA, 25 bp, Mus musculus
aaagcggtacttacactgggcacaa

SEQ ID NO: 498489 - DNA, 25 bp, Mus musculus
aaagcggtactttcactgggcacaa

SEQ ID NO: 498490 - DNA, 25 bp, Mus musculus
aaagcggttttcatcccatcacagg

SEQ ID NO: 498491 - DNA, 25 bp, Mus musculus
aaagcggttttcttcccatcacagg

SEQ ID NO: 498492 - DNA, 25 bp, Mus musculus
aaagcgtgcagcctgaataaggacc

SEQ ID NO: 498493 - DNA, 25 bp, Mus musculus
aaagcgtgcagcgtgaataaggacc

SEQ ID NO: 498494 - DNA, 25 bp, Mus musculus
aaagcgtgtaccatcatcaagtcca

SEQ ID NO: 498495 - DNA, 25 bp, Mus musculus
aaagcgtgtaccttcatcaagtcca

SEQ ID NO: 498496 - DNA, 25 bp, Mus musculus
aaagcgtgtgcccatgcgactcttt

SEQ ID NO: 498497 - DNA, 25 bp, Mus musculus
aaagcgtgtgccgatgcgactcttt

SEQ ID NO: 498498 - DNA, 25 bp, Mus musculus
aaagctacctgacaaaggaaggtgg

SEQ ID NO: 498499 - DNA, 25 bp, Mus musculus
aaagctacctgagaaaggaaggtgg

SEQ ID NO: 498500 - DNA, 25 bp, Mus musculus
aaagctacctttcggtcttgctcag

SEQ ID NO: 498501 - DNA, 25 bp, Mus musculus
aaagctacctttgggtcttgctcag

SEQ ID NO: 498502 - DNA, 25 bp, Mus musculus
aaagctactcctacctgagagagac

SEQ ID NO: 498503 - DNA, 25 bp, Mus musculus
aaagctactccttcctgagagagac

SEQ ID NO: 498504 - DNA, 25 bp, Mus musculus
aaagctactggtctccgtcctggag

SEQ ID NO: 498505 - DNA, 25 bp, Mus musculus
aaagctactggtgtccgtcctggag

SEQ ID NO: 498506 - DNA, 25 bp, Mus musculus
aaagctacttcaatcccgtggcctg

SEQ ID NO: 498507 - DNA, 25 bp, Mus musculus
aaagctacttcattcccgtggcctg

SEQ ID NO: 498508 - DNA, 25 bp, Mus musculus
aaagctagctttatagagggaacag

SEQ ID NO: 498509 - DNA, 25 bp, Mus musculus
aaagctagctttttagagggaacag

SEQ ID NO: 498510 - DNA, 25 bp, Mus musculus
aaagctatcggtctcctgaccagcg

SEQ ID NO: 498511 - DNA, 25 bp, Mus musculus
aaagctatcggtgtcctgaccagcg

SEQ ID NO: 498512 - DNA, 25 bp, Mus musculus
aaagctatgaaaatgggaagatgga

SEQ ID NO: 498513 - DNA, 25 bp, Mus musculus
aaagctatgaaattgggaagatgga

SEQ ID NO: 498514 - DNA, 25 bp, Mus musculus
aaagctatgtgtcctggtgcatccc

SEQ ID NO: 498515 - DNA, 25 bp, Mus musculus
aaagctatgtgtgctggtgcatccc

SEQ ID NO: 498516 - DNA, 25 bp, Mus musculus
aaagctcacaccattcaccattcag

SEQ ID NO: 498517 - DNA, 25 bp, Mus musculus
aaagctcacacctttcaccattcag

SEQ ID NO: 498518 - DNA, 25 bp, Mus musculus
aaagctcaggtgacatcattgctcg

SEQ ID NO: 498519 - DNA, 25 bp, Mus musculus
aaagctcaggtgtcatcattgctcg

SEQ ID NO: 498520 - DNA, 25 bp, Mus musculus
aaagctcagttcctatcaagaaccc

SEQ ID NO: 498521 - DNA, 25 bp, Mus musculus
aaagctcagttcgtatcaagaaccc

SEQ ID NO: 498522 - DNA, 25 bp, Mus musculus
aaagctccacccatctcctgaatag

SEQ ID NO: 498523 - DNA, 25 bp, Mus musculus
aaagctccacccttctcctgaatag

SEQ ID NO: 498524 - DNA, 25 bp, Mus musculus
aaagctccatggagatatgttggaa

SEQ ID NO: 498525 - DNA, 25 bp, Mus musculus
aaagctccatggtgatatgttggaa

SEQ ID NO: 498526 - DNA, 25 bp, Mus musculus
aaagctcctgccagtgtttgtatgg

SEQ ID NO: 498527 - DNA, 25 bp, Mus musculus
aaagctcctgcctgtgtttgtatgg

SEQ ID NO: 498528 - DNA, 25 bp, Mus musculus
aaagctccttgacccagtacatgag

SEQ ID NO: 498529 - DNA, 25 bp, Mus musculus
aaagctccttgagccagtacatgag

SEQ ID NO: 498530 - DNA, 25 bp, Mus musculus
aaagctcgaaacctcaaagccatgg

SEQ ID NO: 498531 - DNA, 25 bp, Mus musculus
aaagctcgaaacgtcaaagccatgg

SEQ ID NO: 498532 - DNA, 25 bp, Mus musculus
aaagctcgaagaagagagcaggcct

SEQ ID NO: 498533 - DNA, 25 bp, Mus musculus
aaagctcgaagatgagagcaggcct

SEQ ID NO: 498534 - DNA, 25 bp, Mus musculus
aaagctctacaacaatgctcgggag

SEQ ID NO: 498535 - DNA, 25 bp, Mus musculus
aaagctctacaagaatgctcgggag

SEQ ID NO: 498536 - DNA, 25 bp, Mus musculus
aaagctctagtcacccgtgggaggg

SEQ ID NO: 498537 - DNA, 25 bp, Mus musculus
aaagctctagtctcccgtgggaggg

SEQ ID NO: 498538 - DNA, 25 bp, Mus musculus
aaagctctctaccaagcgctgaaag

SEQ ID NO: 498539 - DNA, 25 bp, Mus musculus
aaagctctctacgaagcgctgaaag

SEQ ID NO: 498540 - DNA, 25 bp, Mus musculus
aaagctctggccctaggtgccacag

SEQ ID NO: 498541 - DNA, 25 bp, Mus musculus
aaagctctggccgtaggtgccacag

SEQ ID NO: 498542 - DNA, 25 bp, Mus musculus
aaagctctgggcatttgatgcagca

SEQ ID NO: 498543 - DNA, 25 bp, Mus musculus
aaagctctgggcttttgatgcagca

SEQ ID NO: 498544 - DNA, 25 bp, Mus musculus
aaagctctgggtatgtctgcctctg

SEQ ID NO: 498545 - DNA, 25 bp, Mus musculus
aaagctctgggtttgtctgcctctg

SEQ ID NO: 498546 - DNA, 25 bp, Mus musculus
aaagctcttcacagtttcacagcag

SEQ ID NO: 498547 - DNA, 25 bp, Mus musculus
aaagctcttcactgtttcacagcag

SEQ ID NO: 498548 - DNA, 25 bp, Mus musculus
aaagctcttggcagaggccttgaac

SEQ ID NO: 498549 - DNA, 25 bp, Mus musculus
aaagctcttggctgaggccttgaac

SEQ ID NO: 498550 - DNA, 25 bp, Mus musculus
aaagctgaagccaggagacctggtg

SEQ ID NO: 498551 - DNA, 25 bp, Mus musculus
aaagctgaagcctggagacctggtg

SEQ ID NO: 498552 - DNA, 25 bp, Mus musculus
aaagctgaatggaaggtaggtagcc

SEQ ID NO: 498553 - DNA, 25 bp, Mus musculus
aaagctgaatggtaggtaggtagcc

SEQ ID NO: 498554 - DNA, 25 bp, Mus musculus
aaagctgacaaacaggccgtggtac

SEQ ID NO: 498555 - DNA, 25 bp, Mus musculus
aaagctgacaaagaggccgtggtac

SEQ ID NO: 498556 - DNA, 25 bp, Mus musculus
aaagctgactcaaacgaaaaactgg

SEQ ID NO: 498557 - DNA, 25 bp, Mus musculus
aaagctgactcatacgaaaaactgg

SEQ ID NO: 498558 - DNA, 25 bp, Mus musculus
aaagctgactctcggcacttcaaaa

SEQ ID NO: 498559 - DNA, 25 bp, Mus musculus
aaagctgactctgggcacttcaaaa

SEQ ID NO: 498560 - DNA, 25 bp, Mus musculus
aaagctgaggctatgatggcggcaa

SEQ ID NO: 498561 - DNA, 25 bp, Mus musculus
aaagctgaggctttgatggcggcaa

SEQ ID NO: 498562 - DNA, 25 bp, Mus musculus
aaagctgatgccattgtcaagatgc

SEQ ID NO: 498563 - DNA, 25 bp, Mus musculus
aaagctgatgcctttgtcaagatgc

SEQ ID NO: 498564 - DNA, 25 bp, Mus musculus
aaagctgatggacaagcagaccttc

SEQ ID NO: 498565 - DNA, 25 bp, Mus musculus
aaagctgatggagaagcagaccttc

SEQ ID NO: 498566 - DNA, 25 bp, Mus musculus
aaagctgatggtatgtgttttaact

SEQ ID NO: 498567 - DNA, 25 bp, Mus musculus
aaagctgatggtttgtgttttaact

SEQ ID NO: 498568 - DNA, 25 bp, Mus musculus
aaagctgcactgctgaggaacaaca

SEQ ID NO: 498569 - DNA, 25 bp, Mus musculus
aaagctgcactggtgaggaacaaca

SEQ ID NO: 498570 - DNA, 25 bp, Mus musculus
aaagctgccctgctcaagtccctaa

SEQ ID NO: 498571 - DNA, 25 bp, Mus musculus
aaagctgccctggtcaagtccctaa

SEQ ID NO: 498572 - DNA, 25 bp, Mus musculus
aaagctgctactagaagagatctac

SEQ ID NO: 498573 - DNA, 25 bp, Mus musculus
aaagctgctacttgaagagatctac

SEQ ID NO: 498574 - DNA, 25 bp, Mus musculus
aaagctggaaccacaaggccctcag

SEQ ID NO: 498575 - DNA, 25 bp, Mus musculus
aaagctggaacctcaaggccctcag

SEQ ID NO: 498576 - DNA, 25 bp, Mus musculus
aaagctggagacactctgatggtta

SEQ ID NO: 498577 - DNA, 25 bp, Mus musculus
aaagctggagactctctgatggtta

SEQ ID NO: 498578 - DNA, 25 bp, Mus musculus
aaagctggcacgcaggaaacaatcc

SEQ ID NO: 498579 - DNA, 25 bp, Mus musculus
aaagctggcacggaggaaacaatcc

SEQ ID NO: 498580 - DNA, 25 bp, Mus musculus
aaagctgggcgacaccaacgaacga

SEQ ID NO: 498581 - DNA, 25 bp, Mus musculus
aaagctgggcgagaccaacgaacga

SEQ ID NO: 498582 - DNA, 25 bp, Mus musculus
aaagctggtccccaggccaggcagt

SEQ ID NO: 498583 - DNA, 25 bp, Mus musculus
aaagctggtcccgaggccaggcagt

SEQ ID NO: 498584 - DNA, 25 bp, Mus musculus
aaagctgtagtacaagagcgtcgac

SEQ ID NO: 498585 - DNA, 25 bp, Mus musculus
aaagctgtagtagaagagcgtcgac

SEQ ID NO: 498586 - DNA, 25 bp, Mus musculus
aaagctgttccactgaatgcatcca

SEQ ID NO: 498587 - DNA, 25 bp, Mus musculus
aaagctgttccagtgaatgcatcca

SEQ ID NO: 498588 - DNA, 25 bp, Mus musculus
aaagcttaaggtaatttgcttggtg

SEQ ID NO: 498589 - DNA, 25 bp, Mus musculus
aaagcttaaggttatttgcttggtg

SEQ ID NO: 498590 - DNA, 25 bp, Mus musculus
aaagcttacaggctggtacagaagc

SEQ ID NO: 498591 - DNA, 25 bp, Mus musculus
aaagcttacagggtggtacagaagc

SEQ ID NO: 498592 - DNA, 25 bp, Mus musculus
aaagcttcaacaaatcttcatcgaa

SEQ ID NO: 498593 - DNA, 25 bp, Mus musculus
aaagcttcaacatatcttcatcgaa

SEQ ID NO: 498594 - DNA, 25 bp, Mus musculus
aaagcttcaataatcactggactat

SEQ ID NO: 498595 - DNA, 25 bp, Mus musculus
aaagcttcaatattcactggactat

SEQ ID NO: 498596 - DNA, 25 bp, Mus musculus
aaagcttccaggaggcaaaggatga

SEQ ID NO: 498597 - DNA, 25 bp, Mus musculus
aaagcttccaggtggcaaaggatga

SEQ ID NO: 498598 - DNA, 25 bp, Mus musculus
aaagcttcgattaaagataggaggc

SEQ ID NO: 498599 - DNA, 25 bp, Mus musculus
aaagcttcgatttaagataggaggc

SEQ ID NO: 498600 - DNA, 25 bp, Mus musculus
aaagcttgagacctagcccctagga

SEQ ID NO: 498601 - DNA, 25 bp, Mus musculus
aaagcttgagacgtagcccctagga

SEQ ID NO: 498602 - DNA, 25 bp, Mus musculus
aaagcttgccacaggcgctgcctgc

SEQ ID NO: 498603 - DNA, 25 bp, Mus musculus
aaagcttgccactggcgctgcctgc

SEQ ID NO: 498604 - DNA, 25 bp, Mus musculus
aaagcttgcctccatccccagagaa

SEQ ID NO: 498605 - DNA, 25 bp, Mus musculus
aaagcttgcctcgatccccagagaa

SEQ ID NO: 498606 - DNA, 25 bp, Mus musculus
aaagcttgctgtacatggaaacctc

SEQ ID NO: 498607 - DNA, 25 bp, Mus musculus
aaagcttgctgttcatggaaacctc

SEQ ID NO: 498608 - DNA, 25 bp, Mus musculus
aaagcttgttggagacccgcttgca

SEQ ID NO: 498609 - DNA, 25 bp, Mus musculus
aaagcttgttggtgacccgcttgca

SEQ ID NO: 498610 - DNA, 25 bp, Mus musculus
aaagctttcacccacggtgtcgcca

SEQ ID NO: 498611 - DNA, 25 bp, Mus musculus
aaagctttcaccgacggtgtcgcca

SEQ ID NO: 498612 - DNA, 25 bp, Mus musculus
aaagctttctgaagtagcaaaggag

SEQ ID NO: 498613 - DNA, 25 bp, Mus musculus
aaagctttctgatgtagcaaaggag

SEQ ID NO: 498614 - DNA, 25 bp, Mus musculus
aaagctttggacacgagggactcgg

SEQ ID NO: 498615 - DNA, 25 bp, Mus musculus
aaagctttggacatggagttgctcc

SEQ ID NO: 498616 - DNA, 25 bp, Mus musculus
aaagctttggactcgagggactcgg

SEQ ID NO: 498617 - DNA, 25 bp, Mus musculus
aaagctttggacttggagttgctcc

SEQ ID NO: 498618 - DNA, 25 bp, Mus musculus
aaagcttttggactgctgaaggccc

SEQ ID NO: 498619 - DNA, 25 bp, Mus musculus
aaagcttttggagtgctgaaggccc

SEQ ID NO: 498620 - DNA, 25 bp, Mus musculus
aaaggaaagctacgcagactgctcg

SEQ ID NO: 498621 - DNA, 25 bp, Mus musculus
aaaggaaagctaggcagactgctcg

SEQ ID NO: 498622 - DNA, 25 bp, Mus musculus
aaaggaaatgcaccaatcagctgct

SEQ ID NO: 498623 - DNA, 25 bp, Mus musculus
aaaggaaatgcagcaatcagctgct

SEQ ID NO: 498624 - DNA, 25 bp, Mus musculus
aaaggaaattgcaagagaaagggcg

SEQ ID NO: 498625 - DNA, 25 bp, Mus musculus
aaaggaaattgctagagaaagggcg

SEQ ID NO: 498626 - DNA, 25 bp, Mus musculus
aaaggaacccttcagttacagtgtg

SEQ ID NO: 498627 - DNA, 25 bp, Mus musculus
aaaggaacccttgagttacagtgtg

SEQ ID NO: 498628 - DNA, 25 bp, Mus musculus
aaaggaagagtacactgtctacagg

SEQ ID NO: 498629 - DNA, 25 bp, Mus musculus
aaaggaagagtagactgtctacagg

SEQ ID NO: 498630 - DNA, 25 bp, Mus musculus
aaaggaagatttacacccagatcca

SEQ ID NO: 498631 - DNA, 25 bp, Mus musculus
aaaggaagattttcacccagatcca

SEQ ID NO: 498632 - DNA, 25 bp, Mus musculus
aaaggaagggccaccgcagtctagg

SEQ ID NO: 498633 - DNA, 25 bp, Mus musculus
aaaggaagggcctccgcagtctagg

SEQ ID NO: 498634 - DNA, 25 bp, Mus musculus
aaaggaaggtacagtgagaatgatg

SEQ ID NO: 498635 - DNA, 25 bp, Mus musculus
aaaggaaggtactgtgagaatgatg

SEQ ID NO: 498636 - DNA, 25 bp, Mus musculus
aaaggaagtttaagatgatgtcctc

SEQ ID NO: 498637 - DNA, 25 bp, Mus musculus
aaaggaagtttatgatgatgtcctc

SEQ ID NO: 498638 - DNA, 25 bp, Mus musculus
aaaggaatccaacaagccaccagct

SEQ ID NO: 498639 - DNA, 25 bp, Mus musculus
aaaggaatccaagaagccaccagct

SEQ ID NO: 498640 - DNA, 25 bp, Mus musculus
aaaggaatttcgagcagatgctcgg

SEQ ID NO: 498641 - DNA, 25 bp, Mus musculus
aaaggaatttcgtgcagatgctcgg

SEQ ID NO: 498642 - DNA, 25 bp, Mus musculus
aaaggacagaagctcaacgaggcca

SEQ ID NO: 498643 - DNA, 25 bp, Mus musculus
aaaggacagaaggtcaacgaggcca

SEQ ID NO: 498644 - DNA, 25 bp, Mus musculus
aaaggacagaggacctgacatactg

SEQ ID NO: 498645 - DNA, 25 bp, Mus musculus
aaaggacagaggtcctgacatactg

SEQ ID NO: 498646 - DNA, 25 bp, Mus musculus
aaaggacagagtatgctggagcaaa

SEQ ID NO: 498647 - DNA, 25 bp, Mus musculus
aaaggacagagtttgctggagcaaa

SEQ ID NO: 498648 - DNA, 25 bp, Mus musculus
aaaggacagtgacattgcccgcctg

SEQ ID NO: 498649 - DNA, 25 bp, Mus musculus
aaaggacagtgagattgcccgcctg

SEQ ID NO: 498650 - DNA, 25 bp, Mus musculus
aaaggacatactccgcgtgcgccag

SEQ ID NO: 498651 - DNA, 25 bp, Mus musculus
aaaggacatactgcgcgtgcgccag

SEQ ID NO: 498652 - DNA, 25 bp, Mus musculus
aaaggaccacagacgccaaatcaga

SEQ ID NO: 498653 - DNA, 25 bp, Mus musculus
aaaggaccacagtcgccaaatcaga

SEQ ID NO: 498654 - DNA, 25 bp, Mus musculus
aaaggaccacgtcttcattcttgac

SEQ ID NO: 498655 - DNA, 25 bp, Mus musculus
aaaggaccacgtgttcattcttgac

SEQ ID NO: 498656 - DNA, 25 bp, Mus musculus
aaaggaccacttaactcagtagaag

SEQ ID NO: 498657 - DNA, 25 bp, Mus musculus
aaaggaccactttactcagtagaag

SEQ ID NO: 498658 - DNA, 25 bp, Mus musculus
aaaggaccctttatgacgatgctgc

SEQ ID NO: 498659 - DNA, 25 bp, Mus musculus
aaaggaccctttttgacgatgctgc

SEQ ID NO: 498660 - DNA, 25 bp, Mus musculus
aaaggaccgcttacagtgacagcta

SEQ ID NO: 498661 - DNA, 25 bp, Mus musculus
aaaggaccgctttcagtgacagcta

SEQ ID NO: 498662 - DNA, 25 bp, Mus musculus
aaaggacctccaagctatctgtggc

SEQ ID NO: 498663 - DNA, 25 bp, Mus musculus
aaaggacctccatgctatctgtggc

SEQ ID NO: 498664 - DNA, 25 bp, Mus musculus
aaaggacctctccaagtgttggata

SEQ ID NO: 498665 - DNA, 25 bp, Mus musculus
aaaggacctctcgaagtgttggata

SEQ ID NO: 498666 - DNA, 25 bp, Mus musculus
aaaggacgactaaactgcccgtctc

SEQ ID NO: 498667 - DNA, 25 bp, Mus musculus
aaaggacgactatactgcccgtctc

SEQ ID NO: 498668 - DNA, 25 bp, Mus musculus
aaaggacgagtacctatgtggaaaa

SEQ ID NO: 498669 - DNA, 25 bp, Mus musculus
aaaggacgagtagctatgtggaaaa

SEQ ID NO: 498670 - DNA, 25 bp, Mus musculus
aaaggactgcagatcttcgcaaagg

SEQ ID NO: 498671 - DNA, 25 bp, Mus musculus
aaaggactgcagttcttcgcaaagg

SEQ ID NO: 498672 - DNA, 25 bp, Mus musculus
aaaggactgcatctccaggagcctg

SEQ ID NO: 498673 - DNA, 25 bp, Mus musculus
aaaggactgcatgtccaggagcctg

SEQ ID NO: 498674 - DNA, 25 bp, Mus musculus
aaaggactgccaccacaaggctggg

SEQ ID NO: 498675 - DNA, 25 bp, Mus musculus
aaaggactgccagcacaaggctggg

SEQ ID NO: 498676 - DNA, 25 bp, Mus musculus
aaaggactgcgaatcacccgtctcc

SEQ ID NO: 498677 - DNA, 25 bp, Mus musculus
aaaggactgcgattcacccgtctcc

SEQ ID NO: 498678 - DNA, 25 bp, Mus musculus
aaaggactttccctgcgctcagtgc

SEQ ID NO: 498679 - DNA, 25 bp, Mus musculus
aaaggactttccgtgcgctcagtgc

SEQ ID NO: 498680 - DNA, 25 bp, Mus musculus
aaaggagaaagcagaaattgaacgc

SEQ ID NO: 498681 - DNA, 25 bp, Mus musculus
aaaggagaaagctgaaattgaacgc

SEQ ID NO: 498682 - DNA, 25 bp, Mus musculus
aaaggagaacttcaaagctcagatc

SEQ ID NO: 498683 - DNA, 25 bp, Mus musculus
aaaggagaacttgaaagctcagatc

SEQ ID NO: 498684 - DNA, 25 bp, Mus musculus
aaaggagaagctaccagaatggagc

SEQ ID NO: 498685 - DNA, 25 bp, Mus musculus
aaaggagaagcttccagaatggagc

SEQ ID NO: 498686 - DNA, 25 bp, Mus musculus
aaaggagacatcaaatacgcagaca

SEQ ID NO: 498687 - DNA, 25 bp, Mus musculus
aaaggagacatctaatacgcagaca

SEQ ID NO: 498688 - DNA, 25 bp, Mus musculus
aaaggagacggcactgtgacgacct

SEQ ID NO: 498689 - DNA, 25 bp, Mus musculus
aaaggagacggctctgtgacgacct

SEQ ID NO: 498690 - DNA, 25 bp, Mus musculus
aaaggagagtgcatcacagacaaga

SEQ ID NO: 498691 - DNA, 25 bp, Mus musculus
aaaggagagtgcttcacagacaaga

SEQ ID NO: 498692 - DNA, 25 bp, Mus musculus
aaaggagatagaagcctcttaaggc

SEQ ID NO: 498693 - DNA, 25 bp, Mus musculus
aaaggagatagatgcctcttaaggc

SEQ ID NO: 498694 - DNA, 25 bp, Mus musculus
aaaggagatattcgcttcatgggtc

SEQ ID NO: 498695 - DNA, 25 bp, Mus musculus
aaaggagatattggcttcatgggtc

SEQ ID NO: 498696 - DNA, 25 bp, Mus musculus
aaaggagcacatcaaaaagagtctg

SEQ ID NO: 498697 - DNA, 25 bp, Mus musculus
aaaggagcacatgaaaaagagtctg

SEQ ID NO: 498698 - DNA, 25 bp, Mus musculus
aaaggagcatgtcccaaccacgtca

SEQ ID NO: 498699 - DNA, 25 bp, Mus musculus
aaaggagcatgtgccaaccacgtca

SEQ ID NO: 498700 - DNA, 25 bp, Mus musculus
aaaggagcccttactactggtgcag

SEQ ID NO: 498701 - DNA, 25 bp, Mus musculus
aaaggagccctttctactggtgcag

SEQ ID NO: 498702 - DNA, 25 bp, Mus musculus
aaaggagccgcacttatctgaagcc

SEQ ID NO: 498703 - DNA, 25 bp, Mus musculus
aaaggagccgcagttatctgaagcc

SEQ ID NO: 498704 - DNA, 25 bp, Mus musculus
aaaggagcgctccattatccctgga

SEQ ID NO: 498705 - DNA, 25 bp, Mus musculus
aaaggagcgctcgattatccctgga

SEQ ID NO: 498706 - DNA, 25 bp, Mus musculus
aaaggagctcccagggaatgagaag

SEQ ID NO: 498707 - DNA, 25 bp, Mus musculus
aaaggagctccctgggaatgagaag

SEQ ID NO: 498708 - DNA, 25 bp, Mus musculus
aaaggagctcgtaacctgcatggac

SEQ ID NO: 498709 - DNA, 25 bp, Mus musculus
aaaggagctcgttacctgcatggac

SEQ ID NO: 498710 - DNA, 25 bp, Mus musculus
aaaggagcttgaacgcagcctcagc

SEQ ID NO: 498711 - DNA, 25 bp, Mus musculus
aaaggagcttgatcgcagcctcagc

SEQ ID NO: 498712 - DNA, 25 bp, Mus musculus
aaaggaggaaccagcttgctgcctt

SEQ ID NO: 498713 - DNA, 25 bp, Mus musculus
aaaggaggaacctgcttgctgcctt

SEQ ID NO: 498714 - DNA, 25 bp, Mus musculus
aaaggaggacatccttcatcctcag

SEQ ID NO: 498715 - DNA, 25 bp, Mus musculus
aaaggaggacatgcttcatcctcag

SEQ ID NO: 498716 - DNA, 25 bp, Mus musculus
aaaggaggtagcacagcccacggag

SEQ ID NO: 498717 - DNA, 25 bp, Mus musculus
aaaggaggtagctcagcccacggag

SEQ ID NO: 498718 - DNA, 25 bp, Mus musculus
aaaggagtgaggataatggacagcc

SEQ ID NO: 498719 - DNA, 25 bp, Mus musculus
aaaggagtgaggttaatggacagcc

SEQ ID NO: 498720 - DNA, 25 bp, Mus musculus
aaaggagttcaccaatgtttacatc

SEQ ID NO: 498721 - DNA, 25 bp, Mus musculus
aaaggagttcacgaatgtttacatc

SEQ ID NO: 498722 - DNA, 25 bp, Mus musculus
aaaggagttggtcgcatcagccaca

SEQ ID NO: 498723 - DNA, 25 bp, Mus musculus
aaaggagttggtggcatcagccaca

SEQ ID NO: 498724 - DNA, 25 bp, Mus musculus
aaaggatagtgaccggagcctatga

SEQ ID NO: 498725 - DNA, 25 bp, Mus musculus
aaaggatagtgagcggagcctatga

SEQ ID NO: 498726 - DNA, 25 bp, Mus musculus
aaaggatattatcaacccggacaag

SEQ ID NO: 498727 - DNA, 25 bp, Mus musculus
aaaggatattatgaacccggacaag

SEQ ID NO: 498728 - DNA, 25 bp, Mus musculus
aaaggatccagaacttggatttagc

SEQ ID NO: 498729 - DNA, 25 bp, Mus musculus
aaaggatccagatcttggatttagc

SEQ ID NO: 498730 - DNA, 25 bp, Mus musculus
aaaggatgagacaaatgctcgagat

SEQ ID NO: 498731 - DNA, 25 bp, Mus musculus
aaaggatgagactaatgctcgagat

SEQ ID NO: 498732 - DNA, 25 bp, Mus musculus
aaaggatgagccagcagagctggac

SEQ ID NO: 498733 - DNA, 25 bp, Mus musculus
aaaggatgagcctgcagagctggac

SEQ ID NO: 498734 - DNA, 25 bp, Mus musculus
aaaggatgagcgcagcaaatacttg

SEQ ID NO: 498735 - DNA, 25 bp, Mus musculus
aaaggatgagcggagcaaatacttg

SEQ ID NO: 498736 - DNA, 25 bp, Mus musculus
aaaggatgctatcctcatgttctag

SEQ ID NO: 498737 - DNA, 25 bp, Mus musculus
aaaggatgctatgctcatgttctag

SEQ ID NO: 498738 - DNA, 25 bp, Mus musculus
aaaggatggacgaagtcctaacaag

SEQ ID NO: 498739 - DNA, 25 bp, Mus musculus
aaaggatggacgtagtcctaacaag

SEQ ID NO: 498740 - DNA, 25 bp, Mus musculus
aaaggatgttgaagtccagattgac

SEQ ID NO: 498741 - DNA, 25 bp, Mus musculus
aaaggatgttgatgtccagattgac

SEQ ID NO: 498742 - DNA, 25 bp, Mus musculus
aaaggattacaacgatcgagacagt

SEQ ID NO: 498743 - DNA, 25 bp, Mus musculus
aaaggattacaaggatcgagacagt

SEQ ID NO: 498744 - DNA, 25 bp, Mus musculus
aaaggattccagcagattttagcag

SEQ ID NO: 498745 - DNA, 25 bp, Mus musculus
aaaggattccaggagattttagcag

SEQ ID NO: 498746 - DNA, 25 bp, Mus musculus
aaaggattctgtcagtctaggaccc

SEQ ID NO: 498747 - DNA, 25 bp, Mus musculus
aaaggattctgtgagtctaggaccc

SEQ ID NO: 498748 - DNA, 25 bp, Mus musculus
aaaggattgctgaaattggagcagg

SEQ ID NO: 498749 - DNA, 25 bp, Mus musculus
aaaggattgctgtaattggagcagg

SEQ ID NO: 498750 - DNA, 25 bp, Mus musculus
aaaggattgcttactgttgatatga

SEQ ID NO: 498751 - DNA, 25 bp, Mus musculus
aaaggattgctttctgttgatatga

SEQ ID NO: 498752 - DNA, 25 bp, Mus musculus
aaaggatttctcatgtgcagaccgc

SEQ ID NO: 498753 - DNA, 25 bp, Mus musculus
aaaggatttctcttgtgcagaccgc

SEQ ID NO: 498754 - DNA, 25 bp, Mus musculus
aaaggcaaatgtccctatgacccca

SEQ ID NO: 498755 - DNA, 25 bp, Mus musculus
aaaggcaaatgtgcctatgacccca

SEQ ID NO: 498756 - DNA, 25 bp, Mus musculus
aaaggcaacattcgcctgggcaagc

SEQ ID NO: 498757 - DNA, 25 bp, Mus musculus
aaaggcaacattggcctgggcaagc

SEQ ID NO: 498758 - DNA, 25 bp, Mus musculus
aaaggcacaatcatgggcatactgc

SEQ ID NO: 498759 - DNA, 25 bp, Mus musculus
aaaggcacaatcttgggcatactgc

SEQ ID NO: 498760 - DNA, 25 bp, Mus musculus
aaaggcacacatccactagtgagag

SEQ ID NO: 498761 - DNA, 25 bp, Mus musculus
aaaggcacacatgcactagtgagag

SEQ ID NO: 498762 - DNA, 25 bp, Mus musculus
aaaggcacaccaattggttgctcag

SEQ ID NO: 498763 - DNA, 25 bp, Mus musculus
aaaggcacaccatttggttgctcag

SEQ ID NO: 498764 - DNA, 25 bp, Mus musculus
aaaggcacagatcaattcctcaatg

SEQ ID NO: 498765 - DNA, 25 bp, Mus musculus
aaaggcacagatgaattcctcaatg

SEQ ID NO: 498766 - DNA, 25 bp, Mus musculus
aaaggcacagccaaggacggctctg

SEQ ID NO: 498767 - DNA, 25 bp, Mus musculus
aaaggcacagcctaggacggctctg

SEQ ID NO: 498768 - DNA, 25 bp, Mus musculus
aaaggcacagctctacgcaaaagcg

SEQ ID NO: 498769 - DNA, 25 bp, Mus musculus
aaaggcacagctgtacgcaaaagcg

SEQ ID NO: 498770 - DNA, 25 bp, Mus musculus
aaaggcagatacaccctgacaccac

SEQ ID NO: 498771 - DNA, 25 bp, Mus musculus
aaaggcagatactccctgacaccac

SEQ ID NO: 498772 - DNA, 25 bp, Mus musculus
aaaggcagatgtcgtgccaaagact

SEQ ID NO: 498773 - DNA, 25 bp, Mus musculus
aaaggcagatgtggtgccaaagact

SEQ ID NO: 498774 - DNA, 25 bp, Mus musculus
aaaggcagcactccaactgatctct

SEQ ID NO: 498775 - DNA, 25 bp, Mus musculus
aaaggcagcactgcaactgatctct

SEQ ID NO: 498776 - DNA, 25 bp, Mus musculus
aaaggcagccgacctaattctgaag

SEQ ID NO: 498777 - DNA, 25 bp, Mus musculus
aaaggcagccgagctaattctgaag

SEQ ID NO: 498778 - DNA, 25 bp, Mus musculus
aaaggcagggcgacattcagcctcg

SEQ ID NO: 498779 - DNA, 25 bp, Mus musculus
aaaggcagggcgtcattcagcctcg

SEQ ID NO: 498780 - DNA, 25 bp, Mus musculus
aaaggcagttgcaaccaggtgtggc

SEQ ID NO: 498781 - DNA, 25 bp, Mus musculus
aaaggcagttgctaccaggtgtggc

SEQ ID NO: 498782 - DNA, 25 bp, Mus musculus
aaaggcatctgcacatgcttctgag

SEQ ID NO: 498783 - DNA, 25 bp, Mus musculus
aaaggcatctgctcatgcttctgag

SEQ ID NO: 498784 - DNA, 25 bp, Mus musculus
aaaggcattgctctgcacccggaat

SEQ ID NO: 498785 - DNA, 25 bp, Mus musculus
aaaggcattgctgtgcacccggaat

SEQ ID NO: 498786 - DNA, 25 bp, Mus musculus
aaaggccaacatcagaaagaagctg

SEQ ID NO: 498787 - DNA, 25 bp, Mus musculus
aaaggccaacatgagaaagaagctg

SEQ ID NO: 498788 - DNA, 25 bp, Mus musculus
aaaggccacaataccggagagcagc

SEQ ID NO: 498789 - DNA, 25 bp, Mus musculus
aaaggccacaattccggagagcagc

SEQ ID NO: 498790 - DNA, 25 bp, Mus musculus
aaaggccaggccaccgccatggagc

SEQ ID NO: 498791 - DNA, 25 bp, Mus musculus
aaaggccaggcctccgccatggagc

SEQ ID NO: 498792 - DNA, 25 bp, Mus musculus
aaaggccagtaccaatgctcctgca

SEQ ID NO: 498793 - DNA, 25 bp, Mus musculus
aaaggccagtacgaatgctcctgca

SEQ ID NO: 498794 - DNA, 25 bp, Mus musculus
aaaggccataatatttctgaaggac

SEQ ID NO: 498795 - DNA, 25 bp, Mus musculus
aaaggccataatttttctgaaggac

SEQ ID NO: 498796 - DNA, 25 bp, Mus musculus
aaaggccatccacgagggtcctgga

SEQ ID NO: 498797 - DNA, 25 bp, Mus musculus
aaaggccatccaggagggtcctgga

SEQ ID NO: 498798 - DNA, 25 bp, Mus musculus
aaaggcccaggcagtttcagaagag

SEQ ID NO: 498799 - DNA, 25 bp, Mus musculus
aaaggcccaggctgtttcagaagag

SEQ ID NO: 498800 - DNA, 25 bp, Mus musculus
aaaggcccatctcttaacattttgg

SEQ ID NO: 498801 - DNA, 25 bp, Mus musculus
aaaggcccatctgttaacattttgg

SEQ ID NO: 498802 - DNA, 25 bp, Mus musculus
aaaggccctagaaatttctcaccag

SEQ ID NO: 498803 - DNA, 25 bp, Mus musculus
aaaggccctagatatttctcaccag

SEQ ID NO: 498804 - DNA, 25 bp, Mus musculus
aaaggccctcggctagtctgatcct

SEQ ID NO: 498805 - DNA, 25 bp, Mus musculus
aaaggccctcgggtagtctgatcct

SEQ ID NO: 498806 - DNA, 25 bp, Mus musculus
aaaggccgcctcctgctggccgagt

SEQ ID NO: 498807 - DNA, 25 bp, Mus musculus
aaaggccgcctcgtgctggccgagt

SEQ ID NO: 498808 - DNA, 25 bp, Mus musculus
aaaggcctatcaatccccagacggc

SEQ ID NO: 498809 - DNA, 25 bp, Mus musculus
aaaggcctatcattccccagacggc

SEQ ID NO: 498810 - DNA, 25 bp, Mus musculus
aaaggcctgggtaaatggcttcagc

SEQ ID NO: 498811 - DNA, 25 bp, Mus musculus
aaaggcctgggttaatggcttcagc

SEQ ID NO: 498812 - DNA, 25 bp, Mus musculus
aaaggcctggtcattatccagcttc

SEQ ID NO: 498813 - DNA, 25 bp, Mus musculus
aaaggcctggtctttatccagcttc

SEQ ID NO: 498814 - DNA, 25 bp, Mus musculus
aaaggcgagggcaaccagtagaagc

SEQ ID NO: 498815 - DNA, 25 bp, Mus musculus
aaaggcgagggctaccagtagaagc

SEQ ID NO: 498816 - DNA, 25 bp, Mus musculus
aaaggcgcaggcacttccaaaggtg

SEQ ID NO: 498817 - DNA, 25 bp, Mus musculus
aaaggcgcaggctcttccaaaggtg

SEQ ID NO: 498818 - DNA, 25 bp, Mus musculus
aaaggcgccgatccccagacctggt

SEQ ID NO: 498819 - DNA, 25 bp, Mus musculus
aaaggcgccgatgcccagacctggt

SEQ ID NO: 498820 - DNA, 25 bp, Mus musculus
aaaggcggacacctactgtgcatag

SEQ ID NO: 498821 - DNA, 25 bp, Mus musculus
aaaggcggacacgtactgtgcatag

SEQ ID NO: 498822 - DNA, 25 bp, Mus musculus
aaaggcggatacatggaccagcgag

SEQ ID NO: 498823 - DNA, 25 bp, Mus musculus
aaaggcggatacttggaccagcgag

SEQ ID NO: 498824 - DNA, 25 bp, Mus musculus
aaaggcggccccagtgaagaccagg

SEQ ID NO: 498825 - DNA, 25 bp, Mus musculus
aaaggcggcccctgtgaagaccagg

SEQ ID NO: 498826 - DNA, 25 bp, Mus musculus
aaaggcgggcatataacagtgtaga

SEQ ID NO: 498827 - DNA, 25 bp, Mus musculus
aaaggcgggcatttaacagtgtaga

SEQ ID NO: 498828 - DNA, 25 bp, Mus musculus
aaaggcgtgacgagaaggtgttcaa

SEQ ID NO: 498829 - DNA, 25 bp, Mus musculus
aaaggcgtgacgtgaaggtgttcaa

SEQ ID NO: 498830 - DNA, 25 bp, Mus musculus
aaaggcgtgcctctaacttgggagt

SEQ ID NO: 498831 - DNA, 25 bp, Mus musculus
aaaggcgtgcctgtaacttgggagt

SEQ ID NO: 498832 - DNA, 25 bp, Mus musculus
aaaggcgttctgatggtatggagac

SEQ ID NO: 498833 - DNA, 25 bp, Mus musculus
aaaggcgttctgttggtatggagac

SEQ ID NO: 498834 - DNA, 25 bp, Mus musculus
aaaggctacttgaaagacccagcaa

SEQ ID NO: 498835 - DNA, 25 bp, Mus musculus
aaaggctacttgtaagacccagcaa

SEQ ID NO: 498836 - DNA, 25 bp, Mus musculus
aaaggctagaaaacatcaatgaaga

SEQ ID NO: 498837 - DNA, 25 bp, Mus musculus
aaaggctagaaatcatcaatgaaga

SEQ ID NO: 498838 - DNA, 25 bp, Mus musculus
aaaggctagcttcgtaaccatcaga

SEQ ID NO: 498839 - DNA, 25 bp, Mus musculus
aaaggctagcttggtaaccatcaga

SEQ ID NO: 498840 - DNA, 25 bp, Mus musculus
aaaggctatggtcttggcactccca

SEQ ID NO: 498841 - DNA, 25 bp, Mus musculus
aaaggctatggtgttggcactccca

SEQ ID NO: 498842 - DNA, 25 bp, Mus musculus
aaaggctcaaccacttctgaggaaa

SEQ ID NO: 498843 - DNA, 25 bp, Mus musculus
aaaggctcaacctcttctgaggaaa

SEQ ID NO: 498844 - DNA, 25 bp, Mus musculus
aaaggctctaagagatcaggcagaa

SEQ ID NO: 498845 - DNA, 25 bp, Mus musculus
aaaggctctaagtgatcaggcagaa

SEQ ID NO: 498846 - DNA, 25 bp, Mus musculus
aaaggctctgatccaccctcgtccc

SEQ ID NO: 498847 - DNA, 25 bp, Mus musculus
aaaggctctgatgcaccctcgtccc

SEQ ID NO: 498848 - DNA, 25 bp, Mus musculus
aaaggctctgttctccttgaccacg

SEQ ID NO: 498849 - DNA, 25 bp, Mus musculus
aaaggctctgttgtccttgaccacg

SEQ ID NO: 498850 - DNA, 25 bp, Mus musculus
aaaggctcttctctggttctcaagt

SEQ ID NO: 498851 - DNA, 25 bp, Mus musculus
aaaggctcttctgtggttctcaagt

SEQ ID NO: 498852 - DNA, 25 bp, Mus musculus
aaaggctgaatcacttatacactgc

SEQ ID NO: 498853 - DNA, 25 bp, Mus musculus
aaaggctgaatctcttatacactgc

SEQ ID NO: 498854 - DNA, 25 bp, Mus musculus
aaaggctgcgtgagccccacaccgt

SEQ ID NO: 498855 - DNA, 25 bp, Mus musculus
aaaggctgcgtgtgccccacaccgt

SEQ ID NO: 498856 - DNA, 25 bp, Mus musculus
aaaggctgcttacggtgtcacggct

SEQ ID NO: 498857 - DNA, 25 bp, Mus musculus
aaaggctgcttagggtgtcacggct

SEQ ID NO: 498858 - DNA, 25 bp, Mus musculus
aaaggctggattagggaagtaatga

SEQ ID NO: 498859 - DNA, 25 bp, Mus musculus
aaaggctggatttgggaagtaatga

SEQ ID NO: 498860 - DNA, 25 bp, Mus musculus
aaaggctggtccagcggctgagcct

SEQ ID NO: 498861 - DNA, 25 bp, Mus musculus
aaaggctggtcctgcggctgagcct

SEQ ID NO: 498862 - DNA, 25 bp, Mus musculus
aaaggcttaattatgctatcacccg

SEQ ID NO: 498863 - DNA, 25 bp, Mus musculus
aaaggcttaattttgctatcacccg

SEQ ID NO: 498864 - DNA, 25 bp, Mus musculus
aaaggcttcagcaggccatggagat

SEQ ID NO: 498865 - DNA, 25 bp, Mus musculus
aaaggcttcagctggccatggagat

SEQ ID NO: 498866 - DNA, 25 bp, Mus musculus
aaaggcttctggagtcagctgctgg

SEQ ID NO: 498867 - DNA, 25 bp, Mus musculus
aaaggcttctggtgtcagctgctgg

SEQ ID NO: 498868 - DNA, 25 bp, Mus musculus
aaaggcttgctgatcaattttatcc

SEQ ID NO: 498869 - DNA, 25 bp, Mus musculus
aaaggcttgctgttcaattttatcc

SEQ ID NO: 498870 - DNA, 25 bp, Mus musculus
aaaggcttgtgtcgcctgtgccgca

SEQ ID NO: 498871 - DNA, 25 bp, Mus musculus
aaaggcttgtgtggcctgtgccgca

SEQ ID NO: 498872 - DNA, 25 bp, Mus musculus
aaagggaaactgctgattggcactg

SEQ ID NO: 498873 - DNA, 25 bp, Mus musculus
aaagggaaactggtgattggcactg

SEQ ID NO: 498874 - DNA, 25 bp, Mus musculus
aaagggaaatttagaagctgctgtg

SEQ ID NO: 498875 - DNA, 25 bp, Mus musculus
aaagggaaattttgaagctgctgtg

SEQ ID NO: 498876 - DNA, 25 bp, Mus musculus
aaagggaagccaccaaatattacag

SEQ ID NO: 498877 - DNA, 25 bp, Mus musculus
aaagggaagccagcaaatattacag

SEQ ID NO: 498878 - DNA, 25 bp, Mus musculus
aaagggaagttccaggtcattgcca

SEQ ID NO: 498879 - DNA, 25 bp, Mus musculus
aaagggaagttcgaggtcattgcca

SEQ ID NO: 498880 - DNA, 25 bp, Mus musculus
aaagggacaagcaatggctggagca

SEQ ID NO: 498881 - DNA, 25 bp, Mus musculus
aaagggacaagctatggctggagca

SEQ ID NO: 498882 - DNA, 25 bp, Mus musculus
aaagggacagctccacagtgtaaag

SEQ ID NO: 498883 - DNA, 25 bp, Mus musculus
aaagggacagctgcacagtgtaaag

SEQ ID NO: 498884 - DNA, 25 bp, Mus musculus
aaagggacaggactgatcctctggc

SEQ ID NO: 498885 - DNA, 25 bp, Mus musculus
aaagggacaggagtgatcctctggc

SEQ ID NO: 498886 - DNA, 25 bp, Mus musculus
aaagggacctgtccggcgcccagca

SEQ ID NO: 498887 - DNA, 25 bp, Mus musculus
aaagggacctgtgcggcgcccagca

SEQ ID NO: 498888 - DNA, 25 bp, Mus musculus
aaagggactgtccagctctcctggc

SEQ ID NO: 498889 - DNA, 25 bp, Mus musculus
aaagggactgtcgagctctcctggc

SEQ ID NO: 498890 - DNA, 25 bp, Mus musculus
aaagggagcacaccatcgaagaatg

SEQ ID NO: 498891 - DNA, 25 bp, Mus musculus
aaagggagcacagcatcgaagaatg

SEQ ID NO: 498892 - DNA, 25 bp, Mus musculus
aaagggagctccagaattttgtctg

SEQ ID NO: 498893 - DNA, 25 bp, Mus musculus
aaagggagctcctgaattttgtctg

SEQ ID NO: 498894 - DNA, 25 bp, Mus musculus
aaagggatctacaagagttcatgcc

SEQ ID NO: 498895 - DNA, 25 bp, Mus musculus
aaagggatctactagagttcatgcc

SEQ ID NO: 498896 - DNA, 25 bp, Mus musculus
aaagggatggacatcattttggaga

SEQ ID NO: 498897 - DNA, 25 bp, Mus musculus
aaagggatggacttcattttggaga

SEQ ID NO: 498898 - DNA, 25 bp, Mus musculus
aaagggcaagaaacaccatcgcaag

SEQ ID NO: 498899 - DNA, 25 bp, Mus musculus
aaagggcaagaatcaccatcgcaag

SEQ ID NO: 498900 - DNA, 25 bp, Mus musculus
aaagggcaatctccagggaagccca

SEQ ID NO: 498901 - DNA, 25 bp, Mus musculus
aaagggcaatctgcagggaagccca

SEQ ID NO: 498902 - DNA, 25 bp, Mus musculus
aaagggcaatgtccaccacctctgt

SEQ ID NO: 498903 - DNA, 25 bp, Mus musculus
aaagggcaatgtgcaccacctctgt

SEQ ID NO: 498904 - DNA, 25 bp, Mus musculus
aaagggcagctccagctgggcacaa

SEQ ID NO: 498905 - DNA, 25 bp, Mus musculus
aaagggcagctcgagctgggcacaa

SEQ ID NO: 498906 - DNA, 25 bp, Mus musculus
aaagggcaggagagtcgaagtcaaa

SEQ ID NO: 498907 - DNA, 25 bp, Mus musculus
aaagggcaggagtgtcgaagtcaaa

SEQ ID NO: 498908 - DNA, 25 bp, Mus musculus
aaagggcatcggagccctccaaggg

SEQ ID NO: 498909 - DNA, 25 bp, Mus musculus
aaagggcatcggtgccctccaaggg

SEQ ID NO: 498910 - DNA, 25 bp, Mus musculus
aaagggccaactcgagttgcagcag

SEQ ID NO: 498911 - DNA, 25 bp, Mus musculus
aaagggccaactggagttgcagcag

SEQ ID NO: 498912 - DNA, 25 bp, Mus musculus
aaagggccacctccagagctcttag

SEQ ID NO: 498913 - DNA, 25 bp, Mus musculus
aaagggccacctgcagagctcttag

SEQ ID NO: 498914 - DNA, 25 bp, Mus musculus
aaagggccagccacattctagaagt

SEQ ID NO: 498915 - DNA, 25 bp, Mus musculus
aaagggccagcctcattctagaagt

SEQ ID NO: 498916 - DNA, 25 bp, Mus musculus
aaagggccctgacattagagtcaat

SEQ ID NO: 498917 - DNA, 25 bp, Mus musculus
aaagggccctgagattagagtcaat

SEQ ID NO: 498918 - DNA, 25 bp, Mus musculus
aaagggcggctacatgttctggtca

SEQ ID NO: 498919 - DNA, 25 bp, Mus musculus
aaagggcggctagatgttctggtca

SEQ ID NO: 498920 - DNA, 25 bp, Mus musculus
aaagggctaaatcacaggccacagt

SEQ ID NO: 498921 - DNA, 25 bp, Mus musculus
aaagggctaaatgacaggccacagt

SEQ ID NO: 498922 - DNA, 25 bp, Mus musculus
aaagggctataacatggacgctccg

SEQ ID NO: 498923 - DNA, 25 bp, Mus musculus
aaagggctataagatggacgctccg

SEQ ID NO: 498924 - DNA, 25 bp, Mus musculus
aaaggggacgacaagctggtgatca

SEQ ID NO: 498925 - DNA, 25 bp, Mus musculus
aaaggggacgactagctggtgatca

SEQ ID NO: 498926 - DNA, 25 bp, Mus musculus
aaagggtaagccactatcaagctga

SEQ ID NO: 498927 - DNA, 25 bp, Mus musculus
aaagggtaagcctctatcaagctga

SEQ ID NO: 498928 - DNA, 25 bp, Mus musculus
aaagggtataagaaaactggcagag

SEQ ID NO: 498929 - DNA, 25 bp, Mus musculus
aaagggtataagtaaactggcagag

SEQ ID NO: 498930 - DNA, 25 bp, Mus musculus
aaagggtcacacatctgtggttcga

SEQ ID NO: 498931 - DNA, 25 bp, Mus musculus
aaagggtcacacttctgtggttcga

SEQ ID NO: 498932 - DNA, 25 bp, Mus musculus
aaagggtcacctcctgttggctgcc

SEQ ID NO: 498933 - DNA, 25 bp, Mus musculus
aaagggtcacctgctgttggctgcc

SEQ ID NO: 498934 - DNA, 25 bp, Mus musculus
aaagggtctgtgaggaattctacag

SEQ ID NO: 498935 - DNA, 25 bp, Mus musculus
aaagggtctgtgtggaattctacag

SEQ ID NO: 498936 - DNA, 25 bp, Mus musculus
aaagggtgaagccaaacagagcaac

SEQ ID NO: 498937 - DNA, 25 bp, Mus musculus
aaagggtgaagcgaaacagagcaac

SEQ ID NO: 498938 - DNA, 25 bp, Mus musculus
aaagggtgatcccttctgaagatgg

SEQ ID NO: 498939 - DNA, 25 bp, Mus musculus
aaagggtgatccgttctgaagatgg

SEQ ID NO: 498940 - DNA, 25 bp, Mus musculus
aaagggtgcccgctccttgcgtgct

SEQ ID NO: 498941 - DNA, 25 bp, Mus musculus
aaagggtgcccggtccttgcgtgct

SEQ ID NO: 498942 - DNA, 25 bp, Mus musculus
aaaggtacactgaggaatgagatag

SEQ ID NO: 498943 - DNA, 25 bp, Mus musculus
aaaggtacactgtggaatgagatag

SEQ ID NO: 498944 - DNA, 25 bp, Mus musculus
aaaggtaggtgcattaaggaatgcc

SEQ ID NO: 498945 - DNA, 25 bp, Mus musculus
aaaggtaggtgctttaaggaatgcc

SEQ ID NO: 498946 - DNA, 25 bp, Mus musculus
aaaggtatatttcatgactatagcc

SEQ ID NO: 498947 - DNA, 25 bp, Mus musculus
aaaggtatatttgatgactatagcc

SEQ ID NO: 498948 - DNA, 25 bp, Mus musculus
aaaggtcacagaactgccactatgg

SEQ ID NO: 498949 - DNA, 25 bp, Mus musculus
aaaggtcacagatctgccactatgg

SEQ ID NO: 498950 - DNA, 25 bp, Mus musculus
aaaggtccaacgagctgaatctcag

SEQ ID NO: 498951 - DNA, 25 bp, Mus musculus
aaaggtccaacgtgctgaatctcag

SEQ ID NO: 498952 - DNA, 25 bp, Mus musculus
aaaggtcctactagagccacaggcc

SEQ ID NO: 498953 - DNA, 25 bp, Mus musculus
aaaggtcctacttgagccacaggcc

SEQ ID NO: 498954 - DNA, 25 bp, Mus musculus
aaaggtctggtgacatcggaggact

SEQ ID NO: 498955 - DNA, 25 bp, Mus musculus
aaaggtctggtgtcatcggaggact

SEQ ID NO: 498956 - DNA, 25 bp, Mus musculus
aaaggtctttccattttgcttcgag

SEQ ID NO: 498957 - DNA, 25 bp, Mus musculus
aaaggtctttcctttttgcttcgag

SEQ ID NO: 498958 - DNA, 25 bp, Mus musculus
aaaggtgaaccaccctgcctccaga

SEQ ID NO: 498959 - DNA, 25 bp, Mus musculus
aaaggtgaaccagcctgcctccaga

SEQ ID NO: 498960 - DNA, 25 bp, Mus musculus
aaaggtgaatagatgtggcggtcac

SEQ ID NO: 498961 - DNA, 25 bp, Mus musculus
aaaggtgaatagttgtggcggtcac

SEQ ID NO: 498962 - DNA, 25 bp, Mus musculus
aaaggtgagtacagcctggctcgct

SEQ ID NO: 498963 - DNA, 25 bp, Mus musculus
aaaggtgagtactgcctggctcgct

SEQ ID NO: 498964 - DNA, 25 bp, Mus musculus
aaaggtgcacatctgaatgctgtca

SEQ ID NO: 498965 - DNA, 25 bp, Mus musculus
aaaggtgcacatgtgaatgctgtca

SEQ ID NO: 498966 - DNA, 25 bp, Mus musculus
aaaggtgcaccgagggacgctctct

SEQ ID NO: 498967 - DNA, 25 bp, Mus musculus
aaaggtgcaccgtgggacgctctct

SEQ ID NO: 498968 - DNA, 25 bp, Mus musculus
aaaggtgcacttcaaggaaacccag

SEQ ID NO: 498969 - DNA, 25 bp, Mus musculus
aaaggtgcacttgaaggaaacccag

SEQ ID NO: 498970 - DNA, 25 bp, Mus musculus
aaaggtgcagagatacacgtgccat

SEQ ID NO: 498971 - DNA, 25 bp, Mus musculus
aaaggtgcagagttacacgtgccat

SEQ ID NO: 498972 - DNA, 25 bp, Mus musculus
aaaggtgcagcccttccggtcgaat

SEQ ID NO: 498973 - DNA, 25 bp, Mus musculus
aaaggtgcagccgttccggtcgaat

SEQ ID NO: 498974 - DNA, 25 bp, Mus musculus
aaaggtgcatgcaactaattctggc

SEQ ID NO: 498975 - DNA, 25 bp, Mus musculus
aaaggtgcatgctactaattctggc

SEQ ID NO: 498976 - DNA, 25 bp, Mus musculus
aaaggtgccccaccttcggaggaga

SEQ ID NO: 498977 - DNA, 25 bp, Mus musculus
aaaggtgccccagcttcggaggaga

SEQ ID NO: 498978 - DNA, 25 bp, Mus musculus
aaaggtgcccgtatcttgcctggct

SEQ ID NO: 498979 - DNA, 25 bp, Mus musculus
aaaggtgcccgtttcttgcctggct

SEQ ID NO: 498980 - DNA, 25 bp, Mus musculus
aaaggtggacgcacgaatggagcct

SEQ ID NO: 498981 - DNA, 25 bp, Mus musculus
aaaggtggacgctcgaatggagcct

SEQ ID NO: 498982 - DNA, 25 bp, Mus musculus
aaaggtggcaatcggaccatctgtg

SEQ ID NO: 498983 - DNA, 25 bp, Mus musculus
aaaggtggcaatgggaccatctgtg

SEQ ID NO: 498984 - DNA, 25 bp, Mus musculus
aaaggtggccttcagaaggttcgct

SEQ ID NO: 498985 - DNA, 25 bp, Mus musculus
aaaggtggccttgagaaggttcgct

SEQ ID NO: 498986 - DNA, 25 bp, Mus musculus
aaaggtggtatcataccaagcctca

SEQ ID NO: 498987 - DNA, 25 bp, Mus musculus
aaaggtggtatcttaccaagcctca

SEQ ID NO: 498988 - DNA, 25 bp, Mus musculus
aaaggtggtcgtcaccacgcccctg

SEQ ID NO: 498989 - DNA, 25 bp, Mus musculus
aaaggtggtcgtgaccacgcccctg

SEQ ID NO: 498990 - DNA, 25 bp, Mus musculus
aaaggtgtaagcaggagtccgcact

SEQ ID NO: 498991 - DNA, 25 bp, Mus musculus
aaaggtgtaagctggagtccgcact

SEQ ID NO: 498992 - DNA, 25 bp, Mus musculus
aaaggtgttccacgcctcaactcaa

SEQ ID NO: 498993 - DNA, 25 bp, Mus musculus
aaaggtgttccaggcctcaactcaa

SEQ ID NO: 498994 - DNA, 25 bp, Mus musculus
aaaggtgtttgtaccgtgactgtag

SEQ ID NO: 498995 - DNA, 25 bp, Mus musculus
aaaggtgtttgttccgtgactgtag

SEQ ID NO: 498996 - DNA, 25 bp, Mus musculus
aaaggttatcctcattggccagctc

SEQ ID NO: 498997 - DNA, 25 bp, Mus musculus
aaaggttatcctgattggccagctc

SEQ ID NO: 498998 - DNA, 25 bp, Mus musculus
aaaggttccgaaacctgcctgctgg

SEQ ID NO: 498999 - DNA, 25 bp, Mus musculus
aaaggttccgaatcctgcctgctgg

SEQ ID NO: 499000 - DNA, 25 bp, Mus musculus
aaaggttccgttccataccacagag

SEQ ID NO: 499001 - DNA, 25 bp, Mus musculus
aaaggttccgttgcataccacagag

SEQ ID NO: 499002 - DNA, 25 bp, Mus musculus
aaaggttgcagtaatctgtccagaa

SEQ ID NO: 499003 - DNA, 25 bp, Mus musculus
aaaggttgcagttatctgtccagaa

SEQ ID NO: 499004 - DNA, 25 bp, Mus musculus
aaaggttgccgccacaaaaagccag

SEQ ID NO: 499005 - DNA, 25 bp, Mus musculus
aaaggttgccgcgacaaaaagccag

SEQ ID NO: 499006 - DNA, 25 bp, Mus musculus
aaaggttgtggaactgctggcccca

SEQ ID NO: 499007 - DNA, 25 bp, Mus musculus
aaaggttgtggatctgctggcccca

SEQ ID NO: 499008 - DNA, 25 bp, Mus musculus
aaaggttgttctccagctctttcct

SEQ ID NO: 499009 - DNA, 25 bp, Mus musculus
aaaggttgttctgcagctctttcct

SEQ ID NO: 499010 - DNA, 25 bp, Mus musculus
aaagtaaacaaaagatcctcctccg

SEQ ID NO: 499011 - DNA, 25 bp, Mus musculus
aaagtaaacaaatgatcctcctccg

SEQ ID NO: 499012 - DNA, 25 bp, Mus musculus
aaagtaaagaacaaggctatggcaa

SEQ ID NO: 499013 - DNA, 25 bp, Mus musculus
aaagtaaagaactaggctatggcaa

SEQ ID NO: 499014 - DNA, 25 bp, Mus musculus
aaagtaacaatacaaccaggcagtg

SEQ ID NO: 499015 - DNA, 25 bp, Mus musculus
aaagtaacaatagaaccaggcagtg

SEQ ID NO: 499016 - DNA, 25 bp, Mus musculus
aaagtaattattcgccactggcaag

SEQ ID NO: 499017 - DNA, 25 bp, Mus musculus
aaagtaattattggccactggcaag

SEQ ID NO: 499018 - DNA, 25 bp, Mus musculus
aaagtacaccgacgagctgaaagtg

SEQ ID NO: 499019 - DNA, 25 bp, Mus musculus
aaagtacaccgaggagctgaaagtg

SEQ ID NO: 499020 - DNA, 25 bp, Mus musculus
aaagtacagtgtcatggtttacaaa

SEQ ID NO: 499021 - DNA, 25 bp, Mus musculus
aaagtacagtgtgatggtttacaaa

SEQ ID NO: 499022 - DNA, 25 bp, Mus musculus
aaagtacatccaagagaattacacc

SEQ ID NO: 499023 - DNA, 25 bp, Mus musculus
aaagtacatccatgagaattacacc

SEQ ID NO: 499024 - DNA, 25 bp, Mus musculus
aaagtacatgtaacaccaaccaggg

SEQ ID NO: 499025 - DNA, 25 bp, Mus musculus
aaagtacatgtatcaccaaccaggg

SEQ ID NO: 499026 - DNA, 25 bp, Mus musculus
aaagtaccaagacactgccttggcg

SEQ ID NO: 499027 - DNA, 25 bp, Mus musculus
aaagtaccaagagactgccttggcg

SEQ ID NO: 499028 - DNA, 25 bp, Mus musculus
aaagtaccaggcactaggtcggcgc

SEQ ID NO: 499029 - DNA, 25 bp, Mus musculus
aaagtaccaggctctaggtcggcgc

SEQ ID NO: 499030 - DNA, 25 bp, Mus musculus
aaagtaccgtctcccaaggaaagag

SEQ ID NO: 499031 - DNA, 25 bp, Mus musculus
aaagtaccgtctgccaaggaaagag

SEQ ID NO: 499032 - DNA, 25 bp, Mus musculus
aaagtactacgccacacagaaactc

SEQ ID NO: 499033 - DNA, 25 bp, Mus musculus
aaagtactacgcgacacagaaactc

SEQ ID NO: 499034 - DNA, 25 bp, Mus musculus
aaagtactatcacctgggatgttgg

SEQ ID NO: 499035 - DNA, 25 bp, Mus musculus
aaagtactatcagctgggatgttgg

SEQ ID NO: 499036 - DNA, 25 bp, Mus musculus
aaagtacttcagaccacatctgaca

SEQ ID NO: 499037 - DNA, 25 bp, Mus musculus
aaagtacttcagtccacatctgaca

SEQ ID NO: 499038 - DNA, 25 bp, Mus musculus
aaagtacttggacaagatcgcagag

SEQ ID NO: 499039 - DNA, 25 bp, Mus musculus
aaagtacttggagaagatcgcagag

SEQ ID NO: 499040 - DNA, 25 bp, Mus musculus
aaagtacttggcaaaggcagctttg

SEQ ID NO: 499041 - DNA, 25 bp, Mus musculus
aaagtacttggctaaggcagctttg

SEQ ID NO: 499042 - DNA, 25 bp, Mus musculus
aaagtagacaaacgatccgccgagg

SEQ ID NO: 499043 - DNA, 25 bp, Mus musculus
aaagtagacaaaggatccgccgagg

SEQ ID NO: 499044 - DNA, 25 bp, Mus musculus
aaagtagactatctgagctccctgg

SEQ ID NO: 499045 - DNA, 25 bp, Mus musculus
aaagtagactatgtgagctccctgg

SEQ ID NO: 499046 - DNA, 25 bp, Mus musculus
aaagtagttcaactggtggcccctg

SEQ ID NO: 499047 - DNA, 25 bp, Mus musculus
aaagtagttcaagtggtggcccctg

SEQ ID NO: 499048 - DNA, 25 bp, Mus musculus
aaagtatacctgctgggaggtctag

SEQ ID NO: 499049 - DNA, 25 bp, Mus musculus
aaagtatacctggtgggaggtctag

SEQ ID NO: 499050 - DNA, 25 bp, Mus musculus
aaagtatatggtaaagcttcacctc

SEQ ID NO: 499051 - DNA, 25 bp, Mus musculus
aaagtatatggttaagcttcacctc

SEQ ID NO: 499052 - DNA, 25 bp, Mus musculus
aaagtatcatctatgtggccacggg

SEQ ID NO: 499053 - DNA, 25 bp, Mus musculus
aaagtatcatctttgtggccacggg

SEQ ID NO: 499054 - DNA, 25 bp, Mus musculus
aaagtatccagtctagccagctcag

SEQ ID NO: 499055 - DNA, 25 bp, Mus musculus
aaagtatccagtgtagccagctcag

SEQ ID NO: 499056 - DNA, 25 bp, Mus musculus
aaagtatctctgagaccaagatcac

SEQ ID NO: 499057 - DNA, 25 bp, Mus musculus
aaagtatctctgtgaccaagatcac

SEQ ID NO: 499058 - DNA, 25 bp, Mus musculus
aaagtatcttctaccgtgccagcca

SEQ ID NO: 499059 - DNA, 25 bp, Mus musculus
aaagtatcttcttccgtgccagcca

SEQ ID NO: 499060 - DNA, 25 bp, Mus musculus
aaagtatcttgtccagactcgctgc

SEQ ID NO: 499061 - DNA, 25 bp, Mus musculus
aaagtatcttgtgcagactcgctgc

SEQ ID NO: 499062 - DNA, 25 bp, Mus musculus
aaagtatgccttagtcaactggata

SEQ ID NO: 499063 - DNA, 25 bp, Mus musculus
aaagtatgcctttgtcaactggata

SEQ ID NO: 499064 - DNA, 25 bp, Mus musculus
aaagtatggcatctgaagaacacag

SEQ ID NO: 499065 - DNA, 25 bp, Mus musculus
aaagtatggcatgtgaagaacacag

SEQ ID NO: 499066 - DNA, 25 bp, Mus musculus
aaagtcaagggccaagggaggagca

SEQ ID NO: 499067 - DNA, 25 bp, Mus musculus
aaagtcaagggcgaagggaggagca

SEQ ID NO: 499068 - DNA, 25 bp, Mus musculus
aaagtcacagctcagttaagaggct

SEQ ID NO: 499069 - DNA, 25 bp, Mus musculus
aaagtcacagctgagttaagaggct

SEQ ID NO: 499070 - DNA, 25 bp, Mus musculus
aaagtcacagttattccatcccaag

SEQ ID NO: 499071 - DNA, 25 bp, Mus musculus
aaagtcacagtttttccatcccaag

SEQ ID NO: 499072 - DNA, 25 bp, Mus musculus
aaagtcaccaatcatgtgtgcagcc

SEQ ID NO: 499073 - DNA, 25 bp, Mus musculus
aaagtcaccaatgatgtgtgcagcc

SEQ ID NO: 499074 - DNA, 25 bp, Mus musculus
aaagtcaccttccagattgcccaga

SEQ ID NO: 499075 - DNA, 25 bp, Mus musculus
aaagtcaccttcgagattgcccaga

SEQ ID NO: 499076 - DNA, 25 bp, Mus musculus
aaagtcagagatcgctcctgcccag

SEQ ID NO: 499077 - DNA, 25 bp, Mus musculus
aaagtcagagatggctcctgcccag

SEQ ID NO: 499078 - DNA, 25 bp, Mus musculus
aaagtcagaggaccaaacctgtggg

SEQ ID NO: 499079 - DNA, 25 bp, Mus musculus
aaagtcagaggagcaaacctgtggg

SEQ ID NO: 499080 - DNA, 25 bp, Mus musculus
aaagtcatctcacttggtgttcacc

SEQ ID NO: 499081 - DNA, 25 bp, Mus musculus
aaagtcatctcagttggtgttcacc

SEQ ID NO: 499082 - DNA, 25 bp, Mus musculus
aaagtcattcaacctgtactcgccg

SEQ ID NO: 499083 - DNA, 25 bp, Mus musculus
aaagtcattcaagctgtactcgccg

SEQ ID NO: 499084 - DNA, 25 bp, Mus musculus
aaagtccaagtccagccgagacact

SEQ ID NO: 499085 - DNA, 25 bp, Mus musculus
aaagtccaagtcgagccgagacact

SEQ ID NO: 499086 - DNA, 25 bp, Mus musculus
aaagtccacagcaggcgggcctagg

SEQ ID NO: 499087 - DNA, 25 bp, Mus musculus
aaagtccacagctggcgggcctagg

SEQ ID NO: 499088 - DNA, 25 bp, Mus musculus
aaagtccacatcagcaagcaggtgc

SEQ ID NO: 499089 - DNA, 25 bp, Mus musculus
aaagtccacatctgcaagcaggtgc

SEQ ID NO: 499090 - DNA, 25 bp, Mus musculus
aaagtccacgcacgtggcccttgag

SEQ ID NO: 499091 - DNA, 25 bp, Mus musculus
aaagtccacgcaggtggcccttgag

SEQ ID NO: 499092 - DNA, 25 bp, Mus musculus
aaagtccagaaaagagtggcaagtg

SEQ ID NO: 499093 - DNA, 25 bp, Mus musculus
aaagtccagaaatgagtggcaagtg

SEQ ID NO: 499094 - DNA, 25 bp, Mus musculus
aaagtccatggcagacaaaggctca

SEQ ID NO: 499095 - DNA, 25 bp, Mus musculus
aaagtccatggctgacaaaggctca

SEQ ID NO: 499096 - DNA, 25 bp, Mus musculus
aaagtcccagagagagcagaacagg

SEQ ID NO: 499097 - DNA, 25 bp, Mus musculus
aaagtcccagagtgagcagaacagg

SEQ ID NO: 499098 - DNA, 25 bp, Mus musculus
aaagtccccacaacaaatacatctg

SEQ ID NO: 499099 - DNA, 25 bp, Mus musculus
aaagtccccacatcaaatacatctg

SEQ ID NO: 499100 - DNA, 25 bp, Mus musculus
aaagtccccgagagacccctggcag

SEQ ID NO: 499101 - DNA, 25 bp, Mus musculus
aaagtccccgagtgacccctggcag

SEQ ID NO: 499102 - DNA, 25 bp, Mus musculus
aaagtcccgggaaaccgacagacat

SEQ ID NO: 499103 - DNA, 25 bp, Mus musculus
aaagtcccgggataccgacagacat

SEQ ID NO: 499104 - DNA, 25 bp, Mus musculus
aaagtccctggaaatctcggtgtgg

SEQ ID NO: 499105 - DNA, 25 bp, Mus musculus
aaagtccctggatatctcggtgtgg

SEQ ID NO: 499106 - DNA, 25 bp, Mus musculus
aaagtccgggacataccattgccag

SEQ ID NO: 499107 - DNA, 25 bp, Mus musculus
aaagtccgggacttaccattgccag

SEQ ID NO: 499108 - DNA, 25 bp, Mus musculus
aaagtcctccggaggagacacatgc

SEQ ID NO: 499109 - DNA, 25 bp, Mus musculus
aaagtcctccggtggagacacatgc

SEQ ID NO: 499110 - DNA, 25 bp, Mus musculus
aaagtcctcgatcacctgaataaaa

SEQ ID NO: 499111 - DNA, 25 bp, Mus musculus
aaagtcctcgatgacctgaataaaa

SEQ ID NO: 499112 - DNA, 25 bp, Mus musculus
aaagtcctctgaagcagatcggtgg

SEQ ID NO: 499113 - DNA, 25 bp, Mus musculus
aaagtcctctgatgcagatcggtgg

SEQ ID NO: 499114 - DNA, 25 bp, Mus musculus
aaagtcctgcctccgagctgttcct

SEQ ID NO: 499115 - DNA, 25 bp, Mus musculus
aaagtcctgcctgcgagctgttcct

SEQ ID NO: 499116 - DNA, 25 bp, Mus musculus
aaagtcctgggcctcgtgcagcaca

SEQ ID NO: 499117 - DNA, 25 bp, Mus musculus
aaagtcctgggcgtcgtgcagcaca

SEQ ID NO: 499118 - DNA, 25 bp, Mus musculus
aaagtcctgtggctggtccacctca

SEQ ID NO: 499119 - DNA, 25 bp, Mus musculus
aaagtcctgtgggtggtccacctca

SEQ ID NO: 499120 - DNA, 25 bp, Mus musculus
aaagtcgaacatcgtgcgaccgtcg

SEQ ID NO: 499121 - DNA, 25 bp, Mus musculus
aaagtcgaacatggtgcgaccgtcg

SEQ ID NO: 499122 - DNA, 25 bp, Mus musculus
aaagtcgaggtgacagtgtttgacc

SEQ ID NO: 499123 - DNA, 25 bp, Mus musculus
aaagtcgaggtgtcagtgtttgacc

SEQ ID NO: 499124 - DNA, 25 bp, Mus musculus
aaagtcgccaccaaccctagctttg

SEQ ID NO: 499125 - DNA, 25 bp, Mus musculus
aaagtcgccacctaccctagctttg

SEQ ID NO: 499126 - DNA, 25 bp, Mus musculus
aaagtcggtactcggatcttcaaca

SEQ ID NO: 499127 - DNA, 25 bp, Mus musculus
aaagtcggtactgggatcttcaaca

SEQ ID NO: 499128 - DNA, 25 bp, Mus musculus
aaagtctactcccaaaagtcagcga

SEQ ID NO: 499129 - DNA, 25 bp, Mus musculus
aaagtctactccgaaaagtcagcga

SEQ ID NO: 499130 - DNA, 25 bp, Mus musculus
aaagtctcagagcaacggacgaaca

SEQ ID NO: 499131 - DNA, 25 bp, Mus musculus
aaagtctcagaggaacggacgaaca

SEQ ID NO: 499132 - DNA, 25 bp, Mus musculus
aaagtctcaggaaagcatgtatctc

SEQ ID NO: 499133 - DNA, 25 bp, Mus musculus
aaagtctcaggatagcatgtatctc

SEQ ID NO: 499134 - DNA, 25 bp, Mus musculus
aaagtctcgcctcgtttcccaggag

SEQ ID NO: 499135 - DNA, 25 bp, Mus musculus
aaagtctcgcctggtttcccaggag

SEQ ID NO: 499136 - DNA, 25 bp, Mus musculus
aaagtctgaggtctatccgtgagga

SEQ ID NO: 499137 - DNA, 25 bp, Mus musculus
aaagtctgaggtgtatccgtgagga

SEQ ID NO: 499138 - DNA, 25 bp, Mus musculus
aaagtctgcaagatgtcaaaggcca

SEQ ID NO: 499139 - DNA, 25 bp, Mus musculus
aaagtctgcaagttgtcaaaggcca

SEQ ID NO: 499140 - DNA, 25 bp, Mus musculus
aaagtctgtatgacgcctggtcagg

SEQ ID NO: 499141 - DNA, 25 bp, Mus musculus
aaagtctgtatgtcgcctggtcagg

SEQ ID NO: 499142 - DNA, 25 bp, Mus musculus
aaagtcttaaggcatggcatttacc

SEQ ID NO: 499143 - DNA, 25 bp, Mus musculus
aaagtcttaagggatggcatttacc

SEQ ID NO: 499144 - DNA, 25 bp, Mus musculus
aaagtcttcagccagaggtccggtc

SEQ ID NO: 499145 - DNA, 25 bp, Mus musculus
aaagtcttcagcgagaggtccggtc

SEQ ID NO: 499146 - DNA, 25 bp, Mus musculus
aaagtctttcggagcagctggtgaa

SEQ ID NO: 499147 - DNA, 25 bp, Mus musculus
aaagtctttcggtgcagctggtgaa

SEQ ID NO: 499148 - DNA, 25 bp, Mus musculus
aaagtgaaaggaattggaggcgcca

SEQ ID NO: 499149 - DNA, 25 bp, Mus musculus
aaagtgaaaggatttggaggcgcca

SEQ ID NO: 499150 - DNA, 25 bp, Mus musculus
aaagtgaacgagctatgaagccaag

SEQ ID NO: 499151 - DNA, 25 bp, Mus musculus
aaagtgaacgaggtatgaagccaag

SEQ ID NO: 499152 - DNA, 25 bp, Mus musculus
aaagtgaagcacaccggccagatct

SEQ ID NO: 499153 - DNA, 25 bp, Mus musculus
aaagtgaagcactccggccagatct

SEQ ID NO: 499154 - DNA, 25 bp, Mus musculus
aaagtgacgtgcagctgcgggcact

SEQ ID NO: 499155 - DNA, 25 bp, Mus musculus
aaagtgacgtgctgctgcgggcact

SEQ ID NO: 499156 - DNA, 25 bp, Mus musculus
aaagtgactcgccactgggcctcta

SEQ ID NO: 499157 - DNA, 25 bp, Mus musculus
aaagtgactcgcgactgggcctcta

SEQ ID NO: 499158 - DNA, 25 bp, Mus musculus
aaagtgagtgcgacccttgcagcca

SEQ ID NO: 499159 - DNA, 25 bp, Mus musculus
aaagtgagtgcgtcccttgcagcca

SEQ ID NO: 499160 - DNA, 25 bp, Mus musculus
aaagtgatgatgaaatcagatatga

SEQ ID NO: 499161 - DNA, 25 bp, Mus musculus
aaagtgatgatgtaatcagatatga

SEQ ID NO: 499162 - DNA, 25 bp, Mus musculus
aaagtgcaagaaacttcaatctgcc

SEQ ID NO: 499163 - DNA, 25 bp, Mus musculus
aaagtgcaagaatcttcaatctgcc

SEQ ID NO: 499164 - DNA, 25 bp, Mus musculus
aaagtgcactacagcccattccagt

SEQ ID NO: 499165 - DNA, 25 bp, Mus musculus
aaagtgcactactgcccattccagt

SEQ ID NO: 499166 - DNA, 25 bp, Mus musculus
aaagtgcactgcagctgcaagaacc

SEQ ID NO: 499167 - DNA, 25 bp, Mus musculus
aaagtgcactgctgctgcaagaacc

SEQ ID NO: 499168 - DNA, 25 bp, Mus musculus
aaagtgcagcagacccgggaggtca

SEQ ID NO: 499169 - DNA, 25 bp, Mus musculus
aaagtgcagcagtcccgggaggtca

SEQ ID NO: 499170 - DNA, 25 bp, Mus musculus
aaagtgcagctaactgggtctgagg

SEQ ID NO: 499171 - DNA, 25 bp, Mus musculus
aaagtgcagctatctgggtctgagg

SEQ ID NO: 499172 - DNA, 25 bp, Mus musculus
aaagtgccttcactgctcgattcag

SEQ ID NO: 499173 - DNA, 25 bp, Mus musculus
aaagtgccttcagtgctcgattcag

SEQ ID NO: 499174 - DNA, 25 bp, Mus musculus
aaagtgctctgtctcttgcctgtag

SEQ ID NO: 499175 - DNA, 25 bp, Mus musculus
aaagtgctctgtgtcttgcctgtag

SEQ ID NO: 499176 - DNA, 25 bp, Mus musculus
aaagtgcttaggaagacgacagggc

SEQ ID NO: 499177 - DNA, 25 bp, Mus musculus
aaagtgcttaggtagacgacagggc

SEQ ID NO: 499178 - DNA, 25 bp, Mus musculus
aaagtggaccggacaccactgcaca

SEQ ID NO: 499179 - DNA, 25 bp, Mus musculus
aaagtggaccggtcaccactgcaca

SEQ ID NO: 499180 - DNA, 25 bp, Mus musculus
aaagtggatccaagagtacctggag

SEQ ID NO: 499181 - DNA, 25 bp, Mus musculus
aaagtggatccatgagtacctggag

SEQ ID NO: 499182 - DNA, 25 bp, Mus musculus
aaagtggatgcacctgccaatcagg

SEQ ID NO: 499183 - DNA, 25 bp, Mus musculus
aaagtggatgcagctgccaatcagg

SEQ ID NO: 499184 - DNA, 25 bp, Mus musculus
aaagtggattctaccaatggcttcc

SEQ ID NO: 499185 - DNA, 25 bp, Mus musculus
aaagtggattcttccaatggcttcc

SEQ ID NO: 499186 - DNA, 25 bp, Mus musculus
aaagtggcagtgagctgtggcatca

SEQ ID NO: 499187 - DNA, 25 bp, Mus musculus
aaagtggcagtgtgctgtggcatca

SEQ ID NO: 499188 - DNA, 25 bp, Mus musculus
aaagtggcccaccagcctccatata

SEQ ID NO: 499189 - DNA, 25 bp, Mus musculus
aaagtggcccacgagcctccatata

SEQ ID NO: 499190 - DNA, 25 bp, Mus musculus
aaagtggccccaagcagcgcagcca

SEQ ID NO: 499191 - DNA, 25 bp, Mus musculus
aaagtggccccatgcagcgcagcca

SEQ ID NO: 499192 - DNA, 25 bp, Mus musculus
aaagtggctgagcattacgtcagtg

SEQ ID NO: 499193 - DNA, 25 bp, Mus musculus
aaagtggctgaggattacgtcagtg

SEQ ID NO: 499194 - DNA, 25 bp, Mus musculus
aaagtgggaggacctaactagagtc

SEQ ID NO: 499195 - DNA, 25 bp, Mus musculus
aaagtgggaggagctaactagagtc

SEQ ID NO: 499196 - DNA, 25 bp, Mus musculus
aaagtggtatgcagaggctatgccc

SEQ ID NO: 499197 - DNA, 25 bp, Mus musculus
aaagtggtatgctgaggctatgccc

SEQ ID NO: 499198 - DNA, 25 bp, Mus musculus
aaagtggtcatcacagacttcgggc

SEQ ID NO: 499199 - DNA, 25 bp, Mus musculus
aaagtggtcatctcagacttcgggc

SEQ ID NO: 499200 - DNA, 25 bp, Mus musculus
aaagtggtctctatacatcgcatgg

SEQ ID NO: 499201 - DNA, 25 bp, Mus musculus
aaagtggtctctttacatcgcatgg

SEQ ID NO: 499202 - DNA, 25 bp, Mus musculus
aaagtggtggtgatctcagccatcc

SEQ ID NO: 499203 - DNA, 25 bp, Mus musculus
aaagtggtggtgttctcagccatcc

SEQ ID NO: 499204 - DNA, 25 bp, Mus musculus
aaagtgtacaagaatgaccgcgcct

SEQ ID NO: 499205 - DNA, 25 bp, Mus musculus
aaagtgtacaagtatgaccgcgcct

SEQ ID NO: 499206 - DNA, 25 bp, Mus musculus
aaagtgtcaacaatggtcccaagtg

SEQ ID NO: 499207 - DNA, 25 bp, Mus musculus
aaagtgtcaacattggtcccaagtg

SEQ ID NO: 499208 - DNA, 25 bp, Mus musculus
aaagtgtcagaaccccgagactgct

SEQ ID NO: 499209 - DNA, 25 bp, Mus musculus
aaagtgtcagaagcccgagactgct

SEQ ID NO: 499210 - DNA, 25 bp, Mus musculus
aaagtgtcagatccagactgtggca

SEQ ID NO: 499211 - DNA, 25 bp, Mus musculus
aaagtgtcagatgcagactgtggca

SEQ ID NO: 499212 - DNA, 25 bp, Mus musculus
aaagtgtccaccatcccagagggta

SEQ ID NO: 499213 - DNA, 25 bp, Mus musculus
aaagtgtccaccttcccagagggta

SEQ ID NO: 499214 - DNA, 25 bp, Mus musculus
aaagtgtccagacgccggtatcacc

SEQ ID NO: 499215 - DNA, 25 bp, Mus musculus
aaagtgtccagaggccggtatcacc

SEQ ID NO: 499216 - DNA, 25 bp, Mus musculus
aaagtgtccattctccccgacgtgg

SEQ ID NO: 499217 - DNA, 25 bp, Mus musculus
aaagtgtccattgtccccgacgtgg

SEQ ID NO: 499218 - DNA, 25 bp, Mus musculus
aaagtgtcccaaccactgtttgcaa

SEQ ID NO: 499219 - DNA, 25 bp, Mus musculus
aaagtgtcccaagcactgtttgcaa

SEQ ID NO: 499220 - DNA, 25 bp, Mus musculus
aaagtgtcggacatgatcttgacca

SEQ ID NO: 499221 - DNA, 25 bp, Mus musculus
aaagtgtcggacttgatcttgacca

SEQ ID NO: 499222 - DNA, 25 bp, Mus musculus
aaagtgtgaacaaccggtggtccag

SEQ ID NO: 499223 - DNA, 25 bp, Mus musculus
aaagtgtgaacatccggtggtccag

SEQ ID NO: 499224 - DNA, 25 bp, Mus musculus
aaagtgtgatgtcacccagagccag

SEQ ID NO: 499225 - DNA, 25 bp, Mus musculus
aaagtgtgatgtgacccagagccag

SEQ ID NO: 499226 - DNA, 25 bp, Mus musculus
aaagtgtgccaacatggcatctgca

SEQ ID NO: 499227 - DNA, 25 bp, Mus musculus
aaagtgtgccaagatggcatctgca

SEQ ID NO: 499228 - DNA, 25 bp, Mus musculus
aaagtgttcatcaagaccagcctgg

SEQ ID NO: 499229 - DNA, 25 bp, Mus musculus
aaagtgttcatctagaccagcctgg

SEQ ID NO: 499230 - DNA, 25 bp, Mus musculus
aaagtgttgccgacagaccgaacga

SEQ ID NO: 499231 - DNA, 25 bp, Mus musculus
aaagtgttgccgtcagaccgaacga

SEQ ID NO: 499232 - DNA, 25 bp, Mus musculus
aaagtgttggaacactctgatctga

SEQ ID NO: 499233 - DNA, 25 bp, Mus musculus
aaagtgttggaagactctgatctga

SEQ ID NO: 499234 - DNA, 25 bp, Mus musculus
aaagtgttggtacccttgaagcacc

SEQ ID NO: 499235 - DNA, 25 bp, Mus musculus
aaagtgttggtagccttgaagcacc

SEQ ID NO: 499236 - DNA, 25 bp, Mus musculus
aaagtgtttatgaactctcagccca

SEQ ID NO: 499237 - DNA, 25 bp, Mus musculus
aaagtgtttatgtactctcagccca

SEQ ID NO: 499238 - DNA, 25 bp, Mus musculus
aaagtgtttattcctcatggactga

SEQ ID NO: 499239 - DNA, 25 bp, Mus musculus
aaagtgtttattgctcatggactga

SEQ ID NO: 499240 - DNA, 25 bp, Mus musculus
aaagttacagacattctggcccata

SEQ ID NO: 499241 - DNA, 25 bp, Mus musculus
aaagttacagactttctggcccata

SEQ ID NO: 499242 - DNA, 25 bp, Mus musculus
aaagttatgacactttgccccattg

SEQ ID NO: 499243 - DNA, 25 bp, Mus musculus
aaagttatgacagtttgccccattg

SEQ ID NO: 499244 - DNA, 25 bp, Mus musculus
aaagttcagagaagggcaacagccc

SEQ ID NO: 499245 - DNA, 25 bp, Mus musculus
aaagttcagagatgggcaacagccc

SEQ ID NO: 499246 - DNA, 25 bp, Mus musculus
aaagttccatggctataattccctg

SEQ ID NO: 499247 - DNA, 25 bp, Mus musculus
aaagttccatgggtataattccctg

SEQ ID NO: 499248 - DNA, 25 bp, Mus musculus
aaagttcccagtcgctagctccaac

SEQ ID NO: 499249 - DNA, 25 bp, Mus musculus
aaagttcccagtggctagctccaac

SEQ ID NO: 499250 - DNA, 25 bp, Mus musculus
aaagttctgttgctctctcaggccc

SEQ ID NO: 499251 - DNA, 25 bp, Mus musculus
aaagttctgttggtctctcaggccc

SEQ ID NO: 499252 - DNA, 25 bp, Mus musculus
aaagttcttgatccccaatgcttcg

SEQ ID NO: 499253 - DNA, 25 bp, Mus musculus
aaagttcttgatgcccaatgcttcg

SEQ ID NO: 499254 - DNA, 25 bp, Mus musculus
aaagttgaaagcagtcagcaggacg

SEQ ID NO: 499255 - DNA, 25 bp, Mus musculus
aaagttgaaagctgtcagcaggacg

SEQ ID NO: 499256 - DNA, 25 bp, Mus musculus
aaagttgacaagatcatgattgagc

SEQ ID NO: 499257 - DNA, 25 bp, Mus musculus
aaagttgacaagttcatgattgagc

SEQ ID NO: 499258 - DNA, 25 bp, Mus musculus
aaagttgacgaaattgtgaccggca

SEQ ID NO: 499259 - DNA, 25 bp, Mus musculus
aaagttgacgaatttgtgaccggca

SEQ ID NO: 499260 - DNA, 25 bp, Mus musculus
aaagttgattcgctgcatgaaagca

SEQ ID NO: 499261 - DNA, 25 bp, Mus musculus
aaagttgattcggtgcatgaaagca

SEQ ID NO: 499262 - DNA, 25 bp, Mus musculus
aaagttgccacaaaatatctggaag

SEQ ID NO: 499263 - DNA, 25 bp, Mus musculus
aaagttgccacataatatctggaag

SEQ ID NO: 499264 - DNA, 25 bp, Mus musculus
aaagttgccccacctggctttgact

SEQ ID NO: 499265 - DNA, 25 bp, Mus musculus
aaagttgccccagctggctttgact

SEQ ID NO: 499266 - DNA, 25 bp, Mus musculus
aaagttggcgcactccggtgagcca

SEQ ID NO: 499267 - DNA, 25 bp, Mus musculus
aaagttggcgcagtccggtgagcca

SEQ ID NO: 499268 - DNA, 25 bp, Mus musculus
aaagttgggtacacacgtggactgc

SEQ ID NO: 499269 - DNA, 25 bp, Mus musculus
aaagttgggtactcacgtggactgc

SEQ ID NO: 499270 - DNA, 25 bp, Mus musculus
aaagttgtacttcccagccagcctg

SEQ ID NO: 499271 - DNA, 25 bp, Mus musculus
aaagttgtacttgccagccagcctg

SEQ ID NO: 499272 - DNA, 25 bp, Mus musculus
aaagttgtccaactctcccaggata

SEQ ID NO: 499273 - DNA, 25 bp, Mus musculus
aaagttgtccaagtctcccaggata

SEQ ID NO: 499274 - DNA, 25 bp, Mus musculus
aaagttgtgaatcccatttggttcc

SEQ ID NO: 499275 - DNA, 25 bp, Mus musculus
aaagttgtgaatgccatttggttcc

SEQ ID NO: 499276 - DNA, 25 bp, Mus musculus
aaagttgttcctatgaaagccaaga

SEQ ID NO: 499277 - DNA, 25 bp, Mus musculus
aaagttgttcctttgaaagccaaga

SEQ ID NO: 499278 - DNA, 25 bp, Mus musculus
aaagtttaaccgagccaagctcctg

SEQ ID NO: 499279 - DNA, 25 bp, Mus musculus
aaagtttaaccgtgccaagctcctg

SEQ ID NO: 499280 - DNA, 25 bp, Mus musculus
aaagtttccctgagcccggcagcgc

SEQ ID NO: 499281 - DNA, 25 bp, Mus musculus
aaagtttccctgtgcccggcagcgc

SEQ ID NO: 499282 - DNA, 25 bp, Mus musculus
aaagtttgatgccaacacggcgtgc

SEQ ID NO: 499283 - DNA, 25 bp, Mus musculus
aaagtttgatgcgaacacggcgtgc

SEQ ID NO: 499284 - DNA, 25 bp, Mus musculus
aaagtttgccgtcgacgcttgcggc

SEQ ID NO: 499285 - DNA, 25 bp, Mus musculus
aaagtttgccgtggacgcttgcggc

SEQ ID NO: 499286 - DNA, 25 bp, Mus musculus
aaagtttgcgttcgactatgccacc

SEQ ID NO: 499287 - DNA, 25 bp, Mus musculus
aaagtttgcgttggactatgccacc

SEQ ID NO: 499288 - DNA, 25 bp, Mus musculus
aaagtttgtgctaccagctccctgc

SEQ ID NO: 499289 - DNA, 25 bp, Mus musculus
aaagtttgtgcttccagctccctgc

SEQ ID NO: 499290 - DNA, 25 bp, Mus musculus
aaagttttcatcacccgcaagtcac

SEQ ID NO: 499291 - DNA, 25 bp, Mus musculus
aaagttttcatctcccgcaagtcac

SEQ ID NO: 499292 - DNA, 25 bp, Mus musculus
aaagttttccttcccgagtgctaca

SEQ ID NO: 499293 - DNA, 25 bp, Mus musculus
aaagttttccttgccgagtgctaca

SEQ ID NO: 499294 - DNA, 25 bp, Mus musculus
aaataaaatgatagggaagagagcc

SEQ ID NO: 499295 - DNA, 25 bp, Mus musculus
aaataaaatgattgggaagagagcc

SEQ ID NO: 499296 - DNA, 25 bp, Mus musculus
aaataaaatgccatccttgtcaccg

SEQ ID NO: 499297 - DNA, 25 bp, Mus musculus
aaataaaatgccttccttgtcaccg

SEQ ID NO: 499298 - DNA, 25 bp, Mus musculus
aaataaagtcacctgtctagagcat

SEQ ID NO: 499299 - DNA, 25 bp, Mus musculus
aaataaagtcacgtgtctagagcat

SEQ ID NO: 499300 - DNA, 25 bp, Mus musculus
aaataaatggagacagacttctggc

SEQ ID NO: 499301 - DNA, 25 bp, Mus musculus
aaataaatggagtcagacttctggc

SEQ ID NO: 499302 - DNA, 25 bp, Mus musculus
aaataaatggcacaggtttgccaaa

SEQ ID NO: 499303 - DNA, 25 bp, Mus musculus
aaataaatggcagaggtttgccaaa

SEQ ID NO: 499304 - DNA, 25 bp, Mus musculus
aaataacaaggactggccgattcga

SEQ ID NO: 499305 - DNA, 25 bp, Mus musculus
aaataacaaggagtggccgattcga

SEQ ID NO: 499306 - DNA, 25 bp, Mus musculus
aaataacagtagcatgacatacgag

SEQ ID NO: 499307 - DNA, 25 bp, Mus musculus
aaataacagtaggatgacatacgag

SEQ ID NO: 499308 - DNA, 25 bp, Mus musculus
aaataaccacctcggacttggagct

SEQ ID NO: 499309 - DNA, 25 bp, Mus musculus
aaataaccacctgggacttggagct

SEQ ID NO: 499310 - DNA, 25 bp, Mus musculus
aaataagcggccagaggaagagaca

SEQ ID NO: 499311 - DNA, 25 bp, Mus musculus
aaataagcggcctgaggaagagaca

SEQ ID NO: 499312 - DNA, 25 bp, Mus musculus
aaataaggatgtaggagacctcacc

SEQ ID NO: 499313 - DNA, 25 bp, Mus musculus
aaataaggatgttggagacctcacc

SEQ ID NO: 499314 - DNA, 25 bp, Mus musculus
aaataaggctcgagaggaaatggca

SEQ ID NO: 499315 - DNA, 25 bp, Mus musculus
aaataaggctcgtgaggaaatggca

SEQ ID NO: 499316 - DNA, 25 bp, Mus musculus
aaataagtacagctataagtgtgac

SEQ ID NO: 499317 - DNA, 25 bp, Mus musculus
aaataagtacaggtataagtgtgac

SEQ ID NO: 499318 - DNA, 25 bp, Mus musculus
aaataataacctacctaccagtgtg

SEQ ID NO: 499319 - DNA, 25 bp, Mus musculus
aaataataaccttcctaccagtgtg

SEQ ID NO: 499320 - DNA, 25 bp, Mus musculus
aaataatcgcctcttagatgaactg

SEQ ID NO: 499321 - DNA, 25 bp, Mus musculus
aaataatcgcctgttagatgaactg

SEQ ID NO: 499322 - DNA, 25 bp, Mus musculus
aaataatgaagaaaatgttctggcc

SEQ ID NO: 499323 - DNA, 25 bp, Mus musculus
aaataatgaagataatgttctggcc

SEQ ID NO: 499324 - DNA, 25 bp, Mus musculus
aaataattgagacccgggtggaatg

SEQ ID NO: 499325 - DNA, 25 bp, Mus musculus
aaataattgagagccgggtggaatg

SEQ ID NO: 499326 - DNA, 25 bp, Mus musculus
aaatacaaacgtcggcaagaagaat

SEQ ID NO: 499327 - DNA, 25 bp, Mus musculus
aaatacaaacgtgggcaagaagaat

SEQ ID NO: 499328 - DNA, 25 bp, Mus musculus
aaatacaaatgcacagtttctctag

SEQ ID NO: 499329 - DNA, 25 bp, Mus musculus
aaatacaaatgctcagtttctctag

SEQ ID NO: 499330 - DNA, 25 bp, Mus musculus
aaatacacagaacagatcaccaacg

SEQ ID NO: 499331 - DNA, 25 bp, Mus musculus
aaatacacagaagagatcaccaacg

SEQ ID NO: 499332 - DNA, 25 bp, Mus musculus
aaatacacagatcccagaggccagc

SEQ ID NO: 499333 - DNA, 25 bp, Mus musculus
aaatacacagatgccagaggccagc

SEQ ID NO: 499334 - DNA, 25 bp, Mus musculus
aaatacagaccaatgaagctcaacg

SEQ ID NO: 499335 - DNA, 25 bp, Mus musculus
aaatacagaccattgaagctcaacg

SEQ ID NO: 499336 - DNA, 25 bp, Mus musculus
aaatacaggacgaagtagccacgtc

SEQ ID NO: 499337 - DNA, 25 bp, Mus musculus
aaatacaggacgtagtagccacgtc

SEQ ID NO: 499338 - DNA, 25 bp, Mus musculus
aaatacatggcacatatggatgagc

SEQ ID NO: 499339 - DNA, 25 bp, Mus musculus
aaatacatggcagatatggatgagc

SEQ ID NO: 499340 - DNA, 25 bp, Mus musculus
aaataccagatcctgctctacaacg

SEQ ID NO: 499341 - DNA, 25 bp, Mus musculus
aaataccagatcgtgctctacaacg

SEQ ID NO: 499342 - DNA, 25 bp, Mus musculus
aaataccagttcaacctctatccag

SEQ ID NO: 499343 - DNA, 25 bp, Mus musculus
aaataccagttctacctctatccag

SEQ ID NO: 499344 - DNA, 25 bp, Mus musculus
aaatacccaaggagtgaaccggctg

SEQ ID NO: 499345 - DNA, 25 bp, Mus musculus
aaatacccaaggtgtgaaccggctg

SEQ ID NO: 499346 - DNA, 25 bp, Mus musculus
aaataccctgccatacacaaaccag

SEQ ID NO: 499347 - DNA, 25 bp, Mus musculus
aaataccctgccttacacaaaccag

SEQ ID NO: 499348 - DNA, 25 bp, Mus musculus
aaatacctgcgcagcaagatcaaag

SEQ ID NO: 499349 - DNA, 25 bp, Mus musculus
aaatacctgcgctgcaagatcaaag

SEQ ID NO: 499350 - DNA, 25 bp, Mus musculus
aaatacctgcttccttgccaagaag

SEQ ID NO: 499351 - DNA, 25 bp, Mus musculus
aaatacctgcttgcttgccaagaag

SEQ ID NO: 499352 - DNA, 25 bp, Mus musculus
aaatacctggatcctgagtacattg

SEQ ID NO: 499353 - DNA, 25 bp, Mus musculus
aaatacctggatgctgagtacattg

SEQ ID NO: 499354 - DNA, 25 bp, Mus musculus
aaatacctggcccactggctgagca

SEQ ID NO: 499355 - DNA, 25 bp, Mus musculus
aaatacctggccgactggctgagca

SEQ ID NO: 499356 - DNA, 25 bp, Mus musculus
aaataccttcttaaagtgcacagtg

SEQ ID NO: 499357 - DNA, 25 bp, Mus musculus
aaataccttctttaagtgcacagtg

SEQ ID NO: 499358 - DNA, 25 bp, Mus musculus
aaatacctttccatctcctccagag

SEQ ID NO: 499359 - DNA, 25 bp, Mus musculus
aaatacctttccttctcctccagag

SEQ ID NO: 499360 - DNA, 25 bp, Mus musculus
aaatactagtccacaggagagccag

SEQ ID NO: 499361 - DNA, 25 bp, Mus musculus
aaatactagtcctcaggagagccag

SEQ ID NO: 499362 - DNA, 25 bp, Mus musculus
aaatactccagactaccccagcaga

SEQ ID NO: 499363 - DNA, 25 bp, Mus musculus
aaatactccagagtaccccagcaga

SEQ ID NO: 499364 - DNA, 25 bp, Mus musculus
aaatactccagtaggtatgtggcac

SEQ ID NO: 499365 - DNA, 25 bp, Mus musculus
aaatactccagttggtatgtggcac

SEQ ID NO: 499366 - DNA, 25 bp, Mus musculus
aaatactgcccaagcttacaggtgc

SEQ ID NO: 499367 - DNA, 25 bp, Mus musculus
aaatactgcccatgcttacaggtgc

SEQ ID NO: 499368 - DNA, 25 bp, Mus musculus
aaatactggcgcagtttgcggttga

SEQ ID NO: 499369 - DNA, 25 bp, Mus musculus
aaatactggcgctgtttgcggttga

SEQ ID NO: 499370 - DNA, 25 bp, Mus musculus
aaatactgtagaatctgctgtccgc

SEQ ID NO: 499371 - DNA, 25 bp, Mus musculus
aaatactgtagattctgctgtccgc

SEQ ID NO: 499372 - DNA, 25 bp, Mus musculus
aaatactgtctgcagaactggtgcc

SEQ ID NO: 499373 - DNA, 25 bp, Mus musculus
aaatactgtctggagaactggtgcc

SEQ ID NO: 499374 - DNA, 25 bp, Mus musculus
aaatactgtgaacctgtagttaaag

SEQ ID NO: 499375 - DNA, 25 bp, Mus musculus
aaatactgtgaagctgtagttaaag

SEQ ID NO: 499376 - DNA, 25 bp, Mus musculus
aaatacttgattcttcttcggccca

SEQ ID NO: 499377 - DNA, 25 bp, Mus musculus
aaatacttgattgttcttcggccca

SEQ ID NO: 499378 - DNA, 25 bp, Mus musculus
aaatacttgggtcttatcacattgg

SEQ ID NO: 499379 - DNA, 25 bp, Mus musculus
aaatacttgggtgttatcacattgg

SEQ ID NO: 499380 - DNA, 25 bp, Mus musculus
aaatagaaaaccactgtgctatggg

SEQ ID NO: 499381 - DNA, 25 bp, Mus musculus
aaatagaaaacctctgtgctatggg

SEQ ID NO: 499382 - DNA, 25 bp, Mus musculus
aaatagacacccagcatcttagtgc

SEQ ID NO: 499383 - DNA, 25 bp, Mus musculus
aaatagacaccctgcatcttagtgc

SEQ ID NO: 499384 - DNA, 25 bp, Mus musculus
aaatagagtgggagtaaaaagcatg

SEQ ID NO: 499385 - DNA, 25 bp, Mus musculus
aaatagagtgggtgtaaaaagcatg

SEQ ID NO: 499386 - DNA, 25 bp, Mus musculus
aaatagatcgtcagttgagaggctc

SEQ ID NO: 499387 - DNA, 25 bp, Mus musculus
aaatagatcgtctgttgagaggctc

SEQ ID NO: 499388 - DNA, 25 bp, Mus musculus
aaatagatgaagaccggatccccaa

SEQ ID NO: 499389 - DNA, 25 bp, Mus musculus
aaatagatgaagtccggatccccaa

SEQ ID NO: 499390 - DNA, 25 bp, Mus musculus
aaatagatgggcaggagccggacac

SEQ ID NO: 499391 - DNA, 25 bp, Mus musculus
aaatagatgggctggagccggacac

SEQ ID NO: 499392 - DNA, 25 bp, Mus musculus
aaatagatgtggaaggtcaactcaa

SEQ ID NO: 499393 - DNA, 25 bp, Mus musculus
aaatagatgtggtaggtcaactcaa

SEQ ID NO: 499394 - DNA, 25 bp, Mus musculus
aaatagccaaaaaggcgcaggctct

SEQ ID NO: 499395 - DNA, 25 bp, Mus musculus
aaatagccaaaatggcgcaggctct

SEQ ID NO: 499396 - DNA, 25 bp, Mus musculus
aaatagctttcgctggagagatgga

SEQ ID NO: 499397 - DNA, 25 bp, Mus musculus
aaatagctttcggtggagagatgga

SEQ ID NO: 499398 - DNA, 25 bp, Mus musculus
aaatagggaagaagtgagcctcagc

SEQ ID NO: 499399 - DNA, 25 bp, Mus musculus
aaatagggaagatgtgagcctcagc

SEQ ID NO: 499400 - DNA, 25 bp, Mus musculus
aaatagggcacactggctggaaaag

SEQ ID NO: 499401 - DNA, 25 bp, Mus musculus
aaatagggcacagtggctggaaaag

SEQ ID NO: 499402 - DNA, 25 bp, Mus musculus
aaatagggctggactgccatgcagg

SEQ ID NO: 499403 - DNA, 25 bp, Mus musculus
aaatagggctggtctgccatgcagg

SEQ ID NO: 499404 - DNA, 25 bp, Mus musculus
aaataggtgaacaccttctcctgaa

SEQ ID NO: 499405 - DNA, 25 bp, Mus musculus
aaataggtgaactccttctcctgaa

SEQ ID NO: 499406 - DNA, 25 bp, Mus musculus
aaatagtcgcctatgcaggcggctg

SEQ ID NO: 499407 - DNA, 25 bp, Mus musculus
aaatagtcgcctttgcaggcggctg

SEQ ID NO: 499408 - DNA, 25 bp, Mus musculus
aaatagtctacaagccggtggacct

SEQ ID NO: 499409 - DNA, 25 bp, Mus musculus
aaatagtctacatgccggtggacct

SEQ ID NO: 499410 - DNA, 25 bp, Mus musculus
aaatagtctcttctaccccaggctg

SEQ ID NO: 499411 - DNA, 25 bp, Mus musculus
aaatagtctcttgtaccccaggctg

SEQ ID NO: 499412 - DNA, 25 bp, Mus musculus
aaatagtgggatatgcttagcatac

SEQ ID NO: 499413 - DNA, 25 bp, Mus musculus
aaatagtgggatttgcttagcatac

SEQ ID NO: 499414 - DNA, 25 bp, Mus musculus
aaatataaaaagcagtgcactgagg

SEQ ID NO: 499415 - DNA, 25 bp, Mus musculus
aaatataaaaaggagtgcactgagg

SEQ ID NO: 499416 - DNA, 25 bp, Mus musculus
aaatataaagaacccttagcgaaag

SEQ ID NO: 499417 - DNA, 25 bp, Mus musculus
aaatataaagaagccttagcgaaag

SEQ ID NO: 499418 - DNA, 25 bp, Mus musculus
aaatatacaggcctgcaaggagctt

SEQ ID NO: 499419 - DNA, 25 bp, Mus musculus
aaatatacaggcgtgcaaggagctt

SEQ ID NO: 499420 - DNA, 25 bp, Mus musculus
aaatatactctaaacttcgtgctcc

SEQ ID NO: 499421 - DNA, 25 bp, Mus musculus
aaatatactctatacttcgtgctcc

SEQ ID NO: 499422 - DNA, 25 bp, Mus musculus
aaatatagagaacttgaggttggcg

SEQ ID NO: 499423 - DNA, 25 bp, Mus musculus
aaatatagagaagttgaggttggcg

SEQ ID NO: 499424 - DNA, 25 bp, Mus musculus
aaatatatcaagcagaggaactacc

SEQ ID NO: 499425 - DNA, 25 bp, Mus musculus
aaatatatcaaggagaggaactacc

SEQ ID NO: 499426 - DNA, 25 bp, Mus musculus
aaatatatccagatcgcttgcagag

SEQ ID NO: 499427 - DNA, 25 bp, Mus musculus
aaatatatccagttcgcttgcagag

SEQ ID NO: 499428 - DNA, 25 bp, Mus musculus
aaatatcacacactgaattcgagac

SEQ ID NO: 499429 - DNA, 25 bp, Mus musculus
aaatatcacacagtgaattcgagac

SEQ ID NO: 499430 - DNA, 25 bp, Mus musculus
aaatatccaaagagtagctgcaggg

SEQ ID NO: 499431 - DNA, 25 bp, Mus musculus
aaatatccaaagtgtagctgcaggg

SEQ ID NO: 499432 - DNA, 25 bp, Mus musculus
aaatatccttcacatcaatgtgaag

SEQ ID NO: 499433 - DNA, 25 bp, Mus musculus
aaatatccttcagatcaatgtgaag

SEQ ID NO: 499434 - DNA, 25 bp, Mus musculus
aaatatcgagcccagacctcgctta

SEQ ID NO: 499435 - DNA, 25 bp, Mus musculus
aaatatcgagccgagacctcgctta

SEQ ID NO: 499436 - DNA, 25 bp, Mus musculus
aaatatctcattctcaatgccaccc

SEQ ID NO: 499437 - DNA, 25 bp, Mus musculus
aaatatctcattgtcaatgccaccc

SEQ ID NO: 499438 - DNA, 25 bp, Mus musculus
aaatatctgtcacccaattccaaga

SEQ ID NO: 499439 - DNA, 25 bp, Mus musculus
aaatatctgtcagccaattccaaga

SEQ ID NO: 499440 - DNA, 25 bp, Mus musculus
aaatatcttccactaaataccaggc

SEQ ID NO: 499441 - DNA, 25 bp, Mus musculus
aaatatcttccagtaaataccaggc

SEQ ID NO: 499442 - DNA, 25 bp, Mus musculus
aaatatgaatatcgctatgccttct

SEQ ID NO: 499443 - DNA, 25 bp, Mus musculus
aaatatgaatatggctatgccttct

SEQ ID NO: 499444 - DNA, 25 bp, Mus musculus
aaatatgaggacatcccagctgccc

SEQ ID NO: 499445 - DNA, 25 bp, Mus musculus
aaatatgaggacttcccagctgccc

SEQ ID NO: 499446 - DNA, 25 bp, Mus musculus
aaatatgaggccatagatgtccccg

SEQ ID NO: 499447 - DNA, 25 bp, Mus musculus
aaatatgaggccttagatgtccccg

SEQ ID NO: 499448 - DNA, 25 bp, Mus musculus
aaatatgatcttattgagcagggaa

SEQ ID NO: 499449 - DNA, 25 bp, Mus musculus
aaatatgatctttttgagcagggaa

SEQ ID NO: 499450 - DNA, 25 bp, Mus musculus
aaatatgcaatgcagcagagcatca

SEQ ID NO: 499451 - DNA, 25 bp, Mus musculus
aaatatgcaatggagcagagcatca

SEQ ID NO: 499452 - DNA, 25 bp, Mus musculus
aaatatgcgaagaggtatacaggag

SEQ ID NO: 499453 - DNA, 25 bp, Mus musculus
aaatatgcgaagtggtatacaggag

SEQ ID NO: 499454 - DNA, 25 bp, Mus musculus
aaatatggccctagtcacctaggag

SEQ ID NO: 499455 - DNA, 25 bp, Mus musculus
aaatatggcccttgtcacctaggag

SEQ ID NO: 499456 - DNA, 25 bp, Mus musculus
aaatatgggtccacaggaaagcctg

SEQ ID NO: 499457 - DNA, 25 bp, Mus musculus
aaatatgggtcctcaggaaagcctg

SEQ ID NO: 499458 - DNA, 25 bp, Mus musculus
aaatatgtaggaaggactcttcacg

SEQ ID NO: 499459 - DNA, 25 bp, Mus musculus
aaatatgtaggatggactcttcacg

SEQ ID NO: 499460 - DNA, 25 bp, Mus musculus
aaatatgtcaacaagctggcactgg

SEQ ID NO: 499461 - DNA, 25 bp, Mus musculus
aaatatgtcaactagctggcactgg

SEQ ID NO: 499462 - DNA, 25 bp, Mus musculus
aaatattaatgtcctttccgtttgc

SEQ ID NO: 499463 - DNA, 25 bp, Mus musculus
aaatattaatgtgctttccgtttgc

SEQ ID NO: 499464 - DNA, 25 bp, Mus musculus
aaatattacctcattcaagggctgg

SEQ ID NO: 499465 - DNA, 25 bp, Mus musculus
aaatattacctctttcaagggctgg

SEQ ID NO: 499466 - DNA, 25 bp, Mus musculus
aaatattgagctacccatggataca

SEQ ID NO: 499467 - DNA, 25 bp, Mus musculus
aaatattgagcttcccatggataca

SEQ ID NO: 499468 - DNA, 25 bp, Mus musculus
aaatattgcctgctgtcgtcgacgc

SEQ ID NO: 499469 - DNA, 25 bp, Mus musculus
aaatattgcctggtgtcgtcgacgc

SEQ ID NO: 499470 - DNA, 25 bp, Mus musculus
aaatatttcataagcgggatacctg

SEQ ID NO: 499471 - DNA, 25 bp, Mus musculus
aaatatttcatatgcgggatacctg

SEQ ID NO: 499472 - DNA, 25 bp, Mus musculus
aaatattttctgctccattgaaagg

SEQ ID NO: 499473 - DNA, 25 bp, Mus musculus
aaatattttctggtccattgaaagg

SEQ ID NO: 499474 - DNA, 25 bp, Mus musculus
aaatcaaaaggcaaagctctatagt

SEQ ID NO: 499475 - DNA, 25 bp, Mus musculus
aaatcaaaaggctaagctctatagt

SEQ ID NO: 499476 - DNA, 25 bp, Mus musculus
aaatcaaagactagttcctccaggg

SEQ ID NO: 499477 - DNA, 25 bp, Mus musculus
aaatcaaagacttgttcctccaggg

SEQ ID NO: 499478 - DNA, 25 bp, Mus musculus
aaatcaaagagaaagctgtgactgt

SEQ ID NO: 499479 - DNA, 25 bp, Mus musculus
aaatcaaagagatagctgtgactgt

SEQ ID NO: 499480 - DNA, 25 bp, Mus musculus
aaatcaaatccgactccaaggctgg

SEQ ID NO: 499481 - DNA, 25 bp, Mus musculus
aaatcaaatccgtctccaaggctgg

SEQ ID NO: 499482 - DNA, 25 bp, Mus musculus
aaatcaacgtatcctccttctggac

SEQ ID NO: 499483 - DNA, 25 bp, Mus musculus
aaatcaacgtatgctccttctggac

SEQ ID NO: 499484 - DNA, 25 bp, Mus musculus
aaatcaagagttatcttgctgtgcc

SEQ ID NO: 499485 - DNA, 25 bp, Mus musculus
aaatcaagagttttcttgctgtgcc

SEQ ID NO: 499486 - DNA, 25 bp, Mus musculus
aaatcaagcggaacagaggaatggc

SEQ ID NO: 499487 - DNA, 25 bp, Mus musculus
aaatcaagcggatcagaggaatggc

SEQ ID NO: 499488 - DNA, 25 bp, Mus musculus
aaatcaagctttccttgttcctgca

SEQ ID NO: 499489 - DNA, 25 bp, Mus musculus
aaatcaagctttgcttgttcctgca

SEQ ID NO: 499490 - DNA, 25 bp, Mus musculus
aaatcaaggataacaaagacaaagc

SEQ ID NO: 499491 - DNA, 25 bp, Mus musculus
aaatcaaggatatcaaagacaaagc

SEQ ID NO: 499492 - DNA, 25 bp, Mus musculus
aaatcaagttggattctgtaactag

SEQ ID NO: 499493 - DNA, 25 bp, Mus musculus
aaatcaagttggtttctgtaactag

SEQ ID NO: 499494 - DNA, 25 bp, Mus musculus
aaatcaatgtacagaaagaaacaca

SEQ ID NO: 499495 - DNA, 25 bp, Mus musculus
aaatcaatgtactgaaagaaacaca

SEQ ID NO: 499496 - DNA, 25 bp, Mus musculus
aaatcaccaactacagcaccgacat

SEQ ID NO: 499497 - DNA, 25 bp, Mus musculus
aaatcaccaacttcagcaccgacat

SEQ ID NO: 499498 - DNA, 25 bp, Mus musculus
aaatcacgttctacatgaagggagc

SEQ ID NO: 499499 - DNA, 25 bp, Mus musculus
aaatcacgttcttcatgaagggagc

SEQ ID NO: 499500 - DNA, 25 bp, Mus musculus
aaatcactgtggatggaagtggaga

SEQ ID NO: 499501 - DNA, 25 bp, Mus musculus
aaatcactgtggttggaagtggaga

SEQ ID NO: 499502 - DNA, 25 bp, Mus musculus
aaatcagaaccaattgggccacacg

SEQ ID NO: 499503 - DNA, 25 bp, Mus musculus
aaatcagaaccatttgggccacacg

SEQ ID NO: 499504 - DNA, 25 bp, Mus musculus
aaatcagatgcacagtgagcattcg

SEQ ID NO: 499505 - DNA, 25 bp, Mus musculus
aaatcagatgcagagtgagcattcg

SEQ ID NO: 499506 - DNA, 25 bp, Mus musculus
aaatcagattcgactattggcacag

SEQ ID NO: 499507 - DNA, 25 bp, Mus musculus
aaatcagattcgtctattggcacag

SEQ ID NO: 499508 - DNA, 25 bp, Mus musculus
aaatcagcaaaaaggagatgcagcc

SEQ ID NO: 499509 - DNA, 25 bp, Mus musculus
aaatcagcaaaatggagatgcagcc

SEQ ID NO: 499510 - DNA, 25 bp, Mus musculus
aaatcaggaaaacgcgtgacgtgaa

SEQ ID NO: 499511 - DNA, 25 bp, Mus musculus
aaatcaggaaaaggcgtgacgtgaa

SEQ ID NO: 499512 - DNA, 25 bp, Mus musculus
aaatcagggagaactatggcgagaa

SEQ ID NO: 499513 - DNA, 25 bp, Mus musculus
aaatcagggagatctatggcgagaa

SEQ ID NO: 499514 - DNA, 25 bp, Mus musculus
aaatcagtccagaggcattcaaacc

SEQ ID NO: 499515 - DNA, 25 bp, Mus musculus
aaatcagtccagtggcattcaaacc

SEQ ID NO: 499516 - DNA, 25 bp, Mus musculus
aaatcagtgcatcgacccctctcta

SEQ ID NO: 499517 - DNA, 25 bp, Mus musculus
aaatcagtgcatggacccctctcta

SEQ ID NO: 499518 - DNA, 25 bp, Mus musculus
aaatcagtgctgcatcttcatgggc

SEQ ID NO: 499519 - DNA, 25 bp, Mus musculus
aaatcagtgctggatcttcatgggc

SEQ ID NO: 499520 - DNA, 25 bp, Mus musculus
aaatcagtgtcacgtagtcccagtg

SEQ ID NO: 499521 - DNA, 25 bp, Mus musculus
aaatcagtgtcaggtagtcccagtg

SEQ ID NO: 499522 - DNA, 25 bp, Mus musculus
aaatcagttgagatcaccacaggag

SEQ ID NO: 499523 - DNA, 25 bp, Mus musculus
aaatcagttgagttcaccacaggag

SEQ ID NO: 499524 - DNA, 25 bp, Mus musculus
aaatcatagtgaaatagaacggcgg

SEQ ID NO: 499525 - DNA, 25 bp, Mus musculus
aaatcatagtgatatagaacggcgg

SEQ ID NO: 499526 - DNA, 25 bp, Mus musculus
aaatcatcagacagcataaaatcag

SEQ ID NO: 499527 - DNA, 25 bp, Mus musculus
aaatcatcagactgcataaaatcag

SEQ ID NO: 499528 - DNA, 25 bp, Mus musculus
aaatcatccagcagacttggaacag

SEQ ID NO: 499529 - DNA, 25 bp, Mus musculus
aaatcatccagctgacttggaacag

SEQ ID NO: 499530 - DNA, 25 bp, Mus musculus
aaatcatgagcaaattggctggtga

SEQ ID NO: 499531 - DNA, 25 bp, Mus musculus
aaatcatgagcatattggctggtga

SEQ ID NO: 499532 - DNA, 25 bp, Mus musculus
aaatcatgccaaacaccgtttttgt

SEQ ID NO: 499533 - DNA, 25 bp, Mus musculus
aaatcatgccaatcaccgtttttgt

SEQ ID NO: 499534 - DNA, 25 bp, Mus musculus
aaatcatggaaacccctcccaatgg

SEQ ID NO: 499535 - DNA, 25 bp, Mus musculus
aaatcatggaaagccctcccaatgg

SEQ ID NO: 499536 - DNA, 25 bp, Mus musculus
aaatcatggagaaatgtacactacc

SEQ ID NO: 499537 - DNA, 25 bp, Mus musculus
aaatcatggagatatgtacactacc

SEQ ID NO: 499538 - DNA, 25 bp, Mus musculus
aaatcatgtgaacctggccataacc

SEQ ID NO: 499539 - DNA, 25 bp, Mus musculus
aaatcatgtgaagctggccataacc

SEQ ID NO: 499540 - DNA, 25 bp, Mus musculus
aaatcatgttttagtaccggctgga

SEQ ID NO: 499541 - DNA, 25 bp, Mus musculus
aaatcatgtttttgtaccggctgga

SEQ ID NO: 499542 - DNA, 25 bp, Mus musculus
aaatccaaacatccgggagcagcta

SEQ ID NO: 499543 - DNA, 25 bp, Mus musculus
aaatccaaacatgcgggagcagcta

SEQ ID NO: 499544 - DNA, 25 bp, Mus musculus
aaatccaacgaacccaacagtggca

SEQ ID NO: 499545 - DNA, 25 bp, Mus musculus
aaatccaacgaagccaacagtggca

SEQ ID NO: 499546 - DNA, 25 bp, Mus musculus
aaatccaactatcggcccctggtct

SEQ ID NO: 499547 - DNA, 25 bp, Mus musculus
aaatccaactatgggcccctggtct

SEQ ID NO: 499548 - DNA, 25 bp, Mus musculus
aaatccaactggctccatggctggg

SEQ ID NO: 499549 - DNA, 25 bp, Mus musculus
aaatccaactgggtccatggctggg

SEQ ID NO: 499550 - DNA, 25 bp, Mus musculus
aaatccaccttccaaagaagtgcct

SEQ ID NO: 499551 - DNA, 25 bp, Mus musculus
aaatccaccttcgaaagaagtgcct

SEQ ID NO: 499552 - DNA, 25 bp, Mus musculus
aaatccacgagacgacttgtgcccg

SEQ ID NO: 499553 - DNA, 25 bp, Mus musculus
aaatccacgagaggacttgtgcccg

SEQ ID NO: 499554 - DNA, 25 bp, Mus musculus
aaatccacgcttctgttgagctctg

SEQ ID NO: 499555 - DNA, 25 bp, Mus musculus
aaatccacgcttgtgttgagctctg

SEQ ID NO: 499556 - DNA, 25 bp, Mus musculus
aaatccagaaataggcagagcagtt

SEQ ID NO: 499557 - DNA, 25 bp, Mus musculus
aaatccagaaattggcagagcagtt

SEQ ID NO: 499558 - DNA, 25 bp, Mus musculus
aaatccagactcatggtcctccagc

SEQ ID NO: 499559 - DNA, 25 bp, Mus musculus
aaatccagactcttggtcctccagc

SEQ ID NO: 499560 - DNA, 25 bp, Mus musculus
aaatccagaggcagtttctgagctg

SEQ ID NO: 499561 - DNA, 25 bp, Mus musculus
aaatccagaggctgtttctgagctg

SEQ ID NO: 499562 - DNA, 25 bp, Mus musculus
aaatccagatctacaggttcatcaa

SEQ ID NO: 499563 - DNA, 25 bp, Mus musculus
aaatccagatcttcaggttcatcaa

SEQ ID NO: 499564 - DNA, 25 bp, Mus musculus
aaatccagccagcatagcgacactc

SEQ ID NO: 499565 - DNA, 25 bp, Mus musculus
aaatccagccaggatagcgacactc

SEQ ID NO: 499566 - DNA, 25 bp, Mus musculus
aaatccaggaagaaagaagtaagag

SEQ ID NO: 499567 - DNA, 25 bp, Mus musculus
aaatccaggaagtaagaagtaagag

SEQ ID NO: 499568 - DNA, 25 bp, Mus musculus
aaatccaggatccacgtgctggtag

SEQ ID NO: 499569 - DNA, 25 bp, Mus musculus
aaatccaggatcgacgtgctggtag

SEQ ID NO: 499570 - DNA, 25 bp, Mus musculus
aaatccaggcgtcctcctgggcggc

SEQ ID NO: 499571 - DNA, 25 bp, Mus musculus
aaatccaggcgtgctcctgggcggc

SEQ ID NO: 499572 - DNA, 25 bp, Mus musculus
aaatccatatggaaccacgttgtcc

SEQ ID NO: 499573 - DNA, 25 bp, Mus musculus
aaatccatatggtaccacgttgtcc

SEQ ID NO: 499574 - DNA, 25 bp, Mus musculus
aaatccatccagagtctgaccgtgc

SEQ ID NO: 499575 - DNA, 25 bp, Mus musculus
aaatccatccagtgtctgaccgtgc

SEQ ID NO: 499576 - DNA, 25 bp, Mus musculus
aaatccatcgaaacagaaactgtgc

SEQ ID NO: 499577 - DNA, 25 bp, Mus musculus
aaatccatcgaatcagaaactgtgc

SEQ ID NO: 499578 - DNA, 25 bp, Mus musculus
aaatccatggaacgaaatgataggc

SEQ ID NO: 499579 - DNA, 25 bp, Mus musculus
aaatccatggaaggaaatgataggc

SEQ ID NO: 499580 - DNA, 25 bp, Mus musculus
aaatccattcaaacaacagaccatg

SEQ ID NO: 499581 - DNA, 25 bp, Mus musculus
aaatccattcaatcaacagaccatg

SEQ ID NO: 499582 - DNA, 25 bp, Mus musculus
aaatcccaagatatagtggacacag

SEQ ID NO: 499583 - DNA, 25 bp, Mus musculus
aaatcccaagatttagtggacacag

SEQ ID NO: 499584 - DNA, 25 bp, Mus musculus
aaatcccagggcagatctggatcaa

SEQ ID NO: 499585 - DNA, 25 bp, Mus musculus
aaatcccagggctgatctggatcaa

SEQ ID NO: 499586 - DNA, 25 bp, Mus musculus
aaatccccaactatgatgtgcgtga

SEQ ID NO: 499587 - DNA, 25 bp, Mus musculus
aaatccccaactttgatgtgcgtga

SEQ ID NO: 499588 - DNA, 25 bp, Mus musculus
aaatcccgaggcagtattatctgca

SEQ ID NO: 499589 - DNA, 25 bp, Mus musculus
aaatcccgaggctgtattatctgca

SEQ ID NO: 499590 - DNA, 25 bp, Mus musculus
aaatccctggatagaagcgcaaagc

SEQ ID NO: 499591 - DNA, 25 bp, Mus musculus
aaatccctggattgaagcgcaaagc

SEQ ID NO: 499592 - DNA, 25 bp, Mus musculus
aaatcccttcaacgactggcctgga

SEQ ID NO: 499593 - DNA, 25 bp, Mus musculus
aaatcccttcaaggactggcctgga

SEQ ID NO: 499594 - DNA, 25 bp, Mus musculus
aaatcccttcgaccattcccagatg

SEQ ID NO: 499595 - DNA, 25 bp, Mus musculus
aaatcccttcgagcattcccagatg

SEQ ID NO: 499596 - DNA, 25 bp, Mus musculus
aaatccgagaggaggaacgtcggat

SEQ ID NO: 499597 - DNA, 25 bp, Mus musculus
aaatccgagaggtggaacgtcggat

SEQ ID NO: 499598 - DNA, 25 bp, Mus musculus
aaatccgcaagcatgacaatggtgg

SEQ ID NO: 499599 - DNA, 25 bp, Mus musculus
aaatccgcaagcttgacaatggtgg

SEQ ID NO: 499600 - DNA, 25 bp, Mus musculus
aaatccgggcccctcatgcactggt

SEQ ID NO: 499601 - DNA, 25 bp, Mus musculus
aaatccgggcccgtcatgcactggt

SEQ ID NO: 499602 - DNA, 25 bp, Mus musculus
aaatccggtacgatgctgtgacaat

SEQ ID NO: 499603 - DNA, 25 bp, Mus musculus
aaatccggtacgttgctgtgacaat

SEQ ID NO: 499604 - DNA, 25 bp, Mus musculus
aaatccgtcgaaccagcacaacagg

SEQ ID NO: 499605 - DNA, 25 bp, Mus musculus
aaatccgtcgaagcagcacaacagg

SEQ ID NO: 499606 - DNA, 25 bp, Mus musculus
aaatccgtgaggaatcatcactaca

SEQ ID NO: 499607 - DNA, 25 bp, Mus musculus
aaatccgtgaggtatcatcactaca

SEQ ID NO: 499608 - DNA, 25 bp, Mus musculus
aaatcctaagtgcactgcagctggg

SEQ ID NO: 499609 - DNA, 25 bp, Mus musculus
aaatcctaagtggactgcagctggg

SEQ ID NO: 499610 - DNA, 25 bp, Mus musculus
aaatcctcaacactccaaactgtgc

SEQ ID NO: 499611 - DNA, 25 bp, Mus musculus
aaatcctcaacagtccaaactgtgc

SEQ ID NO: 499612 - DNA, 25 bp, Mus musculus
aaatcctccatacaaccacacaatg

SEQ ID NO: 499613 - DNA, 25 bp, Mus musculus
aaatcctccatagaaccacacaatg

SEQ ID NO: 499614 - DNA, 25 bp, Mus musculus
aaatcctcctctcctggcaaagagt

SEQ ID NO: 499615 - DNA, 25 bp, Mus musculus
aaatcctcctctgctggcaaagagt

SEQ ID NO: 499616 - DNA, 25 bp, Mus musculus
aaatcctgaggccttgcagagaacg

SEQ ID NO: 499617 - DNA, 25 bp, Mus musculus
aaatcctgaggcgttgcagagaacg

SEQ ID NO: 499618 - DNA, 25 bp, Mus musculus
aaatcctgccaacgttcactatctg

SEQ ID NO: 499619 - DNA, 25 bp, Mus musculus
aaatcctgccaaggttcactatctg

SEQ ID NO: 499620 - DNA, 25 bp, Mus musculus
aaatcctgcttcagtgatgtccgca

SEQ ID NO: 499621 - DNA, 25 bp, Mus musculus
aaatcctgcttctgtgatgtccgca

SEQ ID NO: 499622 - DNA, 25 bp, Mus musculus
aaatcctgctttctagaggacgcca

SEQ ID NO: 499623 - DNA, 25 bp, Mus musculus
aaatcctgctttgtagaggacgcca

SEQ ID NO: 499624 - DNA, 25 bp, Mus musculus
aaatcctggaccagcagtgggtagg

SEQ ID NO: 499625 - DNA, 25 bp, Mus musculus
aaatcctggacctgcagtgggtagg

SEQ ID NO: 499626 - DNA, 25 bp, Mus musculus
aaatcctggagtcctccagctgagg

SEQ ID NO: 499627 - DNA, 25 bp, Mus musculus
aaatcctggagtgctccagctgagg

SEQ ID NO: 499628 - DNA, 25 bp, Mus musculus
aaatcctgtaagactcccggacaag

SEQ ID NO: 499629 - DNA, 25 bp, Mus musculus
aaatcctgtaagtctcccggacaag

SEQ ID NO: 499630 - DNA, 25 bp, Mus musculus
aaatcctgtcttaacctgggtagcg

SEQ ID NO: 499631 - DNA, 25 bp, Mus musculus
aaatcctgtctttacctgggtagcg

SEQ ID NO: 499632 - DNA, 25 bp, Mus musculus
aaatccttctggcagaacaagtgca

SEQ ID NO: 499633 - DNA, 25 bp, Mus musculus
aaatccttctgggagaacaagtgca

SEQ ID NO: 499634 - DNA, 25 bp, Mus musculus
aaatccttttctctgtgcgtgtcac

SEQ ID NO: 499635 - DNA, 25 bp, Mus musculus
aaatccttttctgtgtgcgtgtcac

SEQ ID NO: 499636 - DNA, 25 bp, Mus musculus
aaatcgaataatacagcagcccggg

SEQ ID NO: 499637 - DNA, 25 bp, Mus musculus
aaatcgaataattcagcagcccggg

SEQ ID NO: 499638 - DNA, 25 bp, Mus musculus
aaatcgacctccatgatcggaagga

SEQ ID NO: 499639 - DNA, 25 bp, Mus musculus
aaatcgacctccttgatcggaagga

SEQ ID NO: 499640 - DNA, 25 bp, Mus musculus
aaatcgagaaagactgcagctggca

SEQ ID NO: 499641 - DNA, 25 bp, Mus musculus
aaatcgagaaagtctgcagctggca

SEQ ID NO: 499642 - DNA, 25 bp, Mus musculus
aaatcgagcgaacatggcagcccga

SEQ ID NO: 499643 - DNA, 25 bp, Mus musculus
aaatcgagcgaagatggcagcccga

SEQ ID NO: 499644 - DNA, 25 bp, Mus musculus
aaatcgatggctagaagttagtggc

SEQ ID NO: 499645 - DNA, 25 bp, Mus musculus
aaatcgatggcttgaagttagtggc

SEQ ID NO: 499646 - DNA, 25 bp, Mus musculus
aaatcgatttgtctggttctcccta

SEQ ID NO: 499647 - DNA, 25 bp, Mus musculus
aaatcgatttgtgtggttctcccta

SEQ ID NO: 499648 - DNA, 25 bp, Mus musculus
aaatcgcaatcgagggaaccgaggc

SEQ ID NO: 499649 - DNA, 25 bp, Mus musculus
aaatcgcaatcgtgggaaccgaggc

SEQ ID NO: 499650 - DNA, 25 bp, Mus musculus
aaatcgctactaagtcccttatggg

SEQ ID NO: 499651 - DNA, 25 bp, Mus musculus
aaatcgctactatgtcccttatggg

SEQ ID NO: 499652 - DNA, 25 bp, Mus musculus
aaatcgctgtgtaatgacatctcgc

SEQ ID NO: 499653 - DNA, 25 bp, Mus musculus
aaatcgctgtgtatagccctcgccc

SEQ ID NO: 499654 - DNA, 25 bp, Mus musculus
aaatcgctgtgttatgacatctcgc

SEQ ID NO: 499655 - DNA, 25 bp, Mus musculus
aaatcgctgtgtttagccctcgccc

SEQ ID NO: 499656 - DNA, 25 bp, Mus musculus
aaatcggactcccagatctgcgagg

SEQ ID NO: 499657 - DNA, 25 bp, Mus musculus
aaatcggactccgagatctgcgagg

SEQ ID NO: 499658 - DNA, 25 bp, Mus musculus
aaatcggagaatcccacgtcacagg

SEQ ID NO: 499659 - DNA, 25 bp, Mus musculus
aaatcggagaatgccacgtcacagg

SEQ ID NO: 499660 - DNA, 25 bp, Mus musculus
aaatcggcccctccgtatgtggatg

SEQ ID NO: 499661 - DNA, 25 bp, Mus musculus
aaatcggcccctgcgtatgtggatg

SEQ ID NO: 499662 - DNA, 25 bp, Mus musculus
aaatcggcgactcaagcggcctggc

SEQ ID NO: 499663 - DNA, 25 bp, Mus musculus
aaatcggcgactgaagcggcctggc

SEQ ID NO: 499664 - DNA, 25 bp, Mus musculus
aaatcgggtataccttccaactggg

SEQ ID NO: 499665 - DNA, 25 bp, Mus musculus
aaatcgggtatagcttccaactggg

SEQ ID NO: 499666 - DNA, 25 bp, Mus musculus
aaatcgtggagacgtcttcgctcca

SEQ ID NO: 499667 - DNA, 25 bp, Mus musculus
aaatcgtggagaggtcttcgctcca

SEQ ID NO: 499668 - DNA, 25 bp, Mus musculus
aaatcgtgtcttacatgatttccga

SEQ ID NO: 499669 - DNA, 25 bp, Mus musculus
aaatcgtgtctttcatgatttccga

SEQ ID NO: 499670 - DNA, 25 bp, Mus musculus
aaatcgtgtgttccaggcggaaatt

SEQ ID NO: 499671 - DNA, 25 bp, Mus musculus
aaatcgtgtgttgcaggcggaaatt

SEQ ID NO: 499672 - DNA, 25 bp, Mus musculus
aaatcgtttgtcacctgttttctag

SEQ ID NO: 499673 - DNA, 25 bp, Mus musculus
aaatcgtttgtctcctgttttctag

SEQ ID NO: 499674 - DNA, 25 bp, Mus musculus
aaatctaaaagcatggatgccatca

SEQ ID NO: 499675 - DNA, 25 bp, Mus musculus
aaatctaaaagcttggatgccatca

SEQ ID NO: 499676 - DNA, 25 bp, Mus musculus
aaatctaacatcatggcctcgctgg

SEQ ID NO: 499677 - DNA, 25 bp, Mus musculus
aaatctaacatcttggcctcgctgg

SEQ ID NO: 499678 - DNA, 25 bp, Mus musculus
aaatctacactacccagaaacaaga

SEQ ID NO: 499679 - DNA, 25 bp, Mus musculus
aaatctacactagccagaaacaaga

SEQ ID NO: 499680 - DNA, 25 bp, Mus musculus
aaatctaccctcatccacatatgta

SEQ ID NO: 499681 - DNA, 25 bp, Mus musculus
aaatctaccctcttccacatatgta

SEQ ID NO: 499682 - DNA, 25 bp, Mus musculus
aaatctacctctcctaggtgggcgg

SEQ ID NO: 499683 - DNA, 25 bp, Mus musculus
aaatctacctctgctaggtgggcgg

SEQ ID NO: 499684 - DNA, 25 bp, Mus musculus
aaatctactcccagaaggcaaaatg

SEQ ID NO: 499685 - DNA, 25 bp, Mus musculus
aaatctactccctgaaggcaaaatg

SEQ ID NO: 499686 - DNA, 25 bp, Mus musculus
aaatctactctgagttccgtgagat

SEQ ID NO: 499687 - DNA, 25 bp, Mus musculus
aaatctactctgtgttccgtgagat

SEQ ID NO: 499688 - DNA, 25 bp, Mus musculus
aaatctactgtgaggcttgtcagga

SEQ ID NO: 499689 - DNA, 25 bp, Mus musculus
aaatctactgtgtggcttgtcagga

SEQ ID NO: 499690 - DNA, 25 bp, Mus musculus
aaatctagcaagcatatggagagtc

SEQ ID NO: 499691 - DNA, 25 bp, Mus musculus
aaatctagcaaggatatggagagtc

SEQ ID NO: 499692 - DNA, 25 bp, Mus musculus
aaatctagctccatacaacgctccg

SEQ ID NO: 499693 - DNA, 25 bp, Mus musculus
aaatctagctccttacaacgctccg

SEQ ID NO: 499694 - DNA, 25 bp, Mus musculus
aaatctatccctctccagtctacag

SEQ ID NO: 499695 - DNA, 25 bp, Mus musculus
aaatctatccctgtccagtctacag

SEQ ID NO: 499696 - DNA, 25 bp, Mus musculus
aaatctattcctacgggcgagtgcc

SEQ ID NO: 499697 - DNA, 25 bp, Mus musculus
aaatctattccttcgggcgagtgcc

SEQ ID NO: 499698 - DNA, 25 bp, Mus musculus
aaatctcaacggaaccctccacgag

SEQ ID NO: 499699 - DNA, 25 bp, Mus musculus
aaatctcaacggtaccctccacgag

SEQ ID NO: 499700 - DNA, 25 bp, Mus musculus
aaatctcaacttccaacagtttgtg

SEQ ID NO: 499701 - DNA, 25 bp, Mus musculus
aaatctcaacttgcaacagtttgtg

SEQ ID NO: 499702 - DNA, 25 bp, Mus musculus
aaatctcagaaaacaaagaggaggg

SEQ ID NO: 499703 - DNA, 25 bp, Mus musculus
aaatctcagaaatcaaagaggaggg

SEQ ID NO: 499704 - DNA, 25 bp, Mus musculus
aaatctcatgcaaaatcttggtggg

SEQ ID NO: 499705 - DNA, 25 bp, Mus musculus
aaatctcatgcataatcttggtggg

SEQ ID NO: 499706 - DNA, 25 bp, Mus musculus
aaatctcccagcagctgtccttgct

SEQ ID NO: 499707 - DNA, 25 bp, Mus musculus
aaatctcccagctgctgtccttgct

SEQ ID NO: 499708 - DNA, 25 bp, Mus musculus
aaatctcccggaaatgggagcttgg

SEQ ID NO: 499709 - DNA, 25 bp, Mus musculus
aaatctcccggatatgggagcttgg

SEQ ID NO: 499710 - DNA, 25 bp, Mus musculus
aaatctccggtgattctctgcgcca

SEQ ID NO: 499711 - DNA, 25 bp, Mus musculus
aaatctccggtgtttctctgcgcca

SEQ ID NO: 499712 - DNA, 25 bp, Mus musculus
aaatctccttgcctgtgatcctcat

SEQ ID NO: 499713 - DNA, 25 bp, Mus musculus
aaatctccttgcgtgtgatcctcat

SEQ ID NO: 499714 - DNA, 25 bp, Mus musculus
aaatctccttttcggcttctggtga

SEQ ID NO: 499715 - DNA, 25 bp, Mus musculus
aaatctccttttgggcttctggtga

SEQ ID NO: 499716 - DNA, 25 bp, Mus musculus
aaatctcgctctcgccctgcagtga

SEQ ID NO: 499717 - DNA, 25 bp, Mus musculus
aaatctcgctctggccctgcagtga

SEQ ID NO: 499718 - DNA, 25 bp, Mus musculus
aaatctcgggaacggctgtctgctg

SEQ ID NO: 499719 - DNA, 25 bp, Mus musculus
aaatctcgggaagggctgtctgctg

SEQ ID NO: 499720 - DNA, 25 bp, Mus musculus
aaatctctcagcagactgccgggag

SEQ ID NO: 499721 - DNA, 25 bp, Mus musculus
aaatctctcagctgactgccgggag

SEQ ID NO: 499722 - DNA, 25 bp, Mus musculus
aaatctctccagcacatcattgcca

SEQ ID NO: 499723 - DNA, 25 bp, Mus musculus
aaatctctccaggacatcattgcca

SEQ ID NO: 499724 - DNA, 25 bp, Mus musculus
aaatctctccccatttggcagtgcc

SEQ ID NO: 499725 - DNA, 25 bp, Mus musculus
aaatctctccccttttggcagtgcc

SEQ ID NO: 499726 - DNA, 25 bp, Mus musculus
aaatctcttgctcaacagagacagc

SEQ ID NO: 499727 - DNA, 25 bp, Mus musculus
aaatctcttgctgaacagagacagc

SEQ ID NO: 499728 - DNA, 25 bp, Mus musculus
aaatctgacaatccgcagagaagcc

SEQ ID NO: 499729 - DNA, 25 bp, Mus musculus
aaatctgacaatgcgcagagaagcc

SEQ ID NO: 499730 - DNA, 25 bp, Mus musculus
aaatctgactgacggcctgtgagcc

SEQ ID NO: 499731 - DNA, 25 bp, Mus musculus
aaatctgactgagggcctgtgagcc

SEQ ID NO: 499732 - DNA, 25 bp, Mus musculus
aaatctgcacccagacgtgactgtg

SEQ ID NO: 499733 - DNA, 25 bp, Mus musculus
aaatctgcaccctgacgtgactgtg

SEQ ID NO: 499734 - DNA, 25 bp, Mus musculus
aaatctgcagcgaaggtggtagccg

SEQ ID NO: 499735 - DNA, 25 bp, Mus musculus
aaatctgcagcgtaggtggtagccg

SEQ ID NO: 499736 - DNA, 25 bp, Mus musculus
aaatctggaagtcccgatcgtgtgc

SEQ ID NO: 499737 - DNA, 25 bp, Mus musculus
aaatctggaagtgccgatcgtgtgc

SEQ ID NO: 499738 - DNA, 25 bp, Mus musculus
aaatctggatgtctgtggtctcggc

SEQ ID NO: 499739 - DNA, 25 bp, Mus musculus
aaatctggatgtgtgtggtctcggc

SEQ ID NO: 499740 - DNA, 25 bp, Mus musculus
aaatctggccataattgaggctctg

SEQ ID NO: 499741 - DNA, 25 bp, Mus musculus
aaatctggccattattgaggctctg

SEQ ID NO: 499742 - DNA, 25 bp, Mus musculus
aaatctggctggctatttatccaac

SEQ ID NO: 499743 - DNA, 25 bp, Mus musculus
aaatctggctgggtatttatccaac

SEQ ID NO: 499744 - DNA, 25 bp, Mus musculus
aaatctggtgtgcttcgagtaagaa

SEQ ID NO: 499745 - DNA, 25 bp, Mus musculus
aaatctggtgtggttcgagtaagaa

SEQ ID NO: 499746 - DNA, 25 bp, Mus musculus
aaatctgtacttcttgcaatgccat

SEQ ID NO: 499747 - DNA, 25 bp, Mus musculus
aaatctgtacttgttgcaatgccat

SEQ ID NO: 499748 - DNA, 25 bp, Mus musculus
aaatctgtctttcaggtttgccaga

SEQ ID NO: 499749 - DNA, 25 bp, Mus musculus
aaatctgtctttgaggtttgccaga

SEQ ID NO: 499750 - DNA, 25 bp, Mus musculus
aaatctgtgaatctttagaagcacc

SEQ ID NO: 499751 - DNA, 25 bp, Mus musculus
aaatctgtgaatgtttagaagcacc

SEQ ID NO: 499752 - DNA, 25 bp, Mus musculus
aaatctgtggttctggacttaattc

SEQ ID NO: 499753 - DNA, 25 bp, Mus musculus
aaatctgtggttgtggacttaattc

SEQ ID NO: 499754 - DNA, 25 bp, Mus musculus
aaatcttcaagaagatacgcaggaa

SEQ ID NO: 499755 - DNA, 25 bp, Mus musculus
aaatcttcaagatgatacgcaggaa

SEQ ID NO: 499756 - DNA, 25 bp, Mus musculus
aaatcttcaggcaaatgagatcatg

SEQ ID NO: 499757 - DNA, 25 bp, Mus musculus
aaatcttcaggctaatgagatcatg

SEQ ID NO: 499758 - DNA, 25 bp, Mus musculus
aaatcttcatcgaacttaccctcaa

SEQ ID NO: 499759 - DNA, 25 bp, Mus musculus
aaatcttcatcgtacttaccctcaa

SEQ ID NO: 499760 - DNA, 25 bp, Mus musculus
aaatcttcatgaacaagccgcaccg

SEQ ID NO: 499761 - DNA, 25 bp, Mus musculus
aaatcttcatgatcaagccgcaccg

SEQ ID NO: 499762 - DNA, 25 bp, Mus musculus
aaatcttcgagtacgagacccagag

SEQ ID NO: 499763 - DNA, 25 bp, Mus musculus
aaatcttcgagttcgagacccagag

SEQ ID NO: 499764 - DNA, 25 bp, Mus musculus
aaatcttgcagcattatacacggaa

SEQ ID NO: 499765 - DNA, 25 bp, Mus musculus
aaatcttgcagctttatacacggaa

SEQ ID NO: 499766 - DNA, 25 bp, Mus musculus
aaatcttggtagaagagagcaacgt

SEQ ID NO: 499767 - DNA, 25 bp, Mus musculus
aaatcttggtagtagagagcaacgt

SEQ ID NO: 499768 - DNA, 25 bp, Mus musculus
aaatcttttgccagggctccttagg

SEQ ID NO: 499769 - DNA, 25 bp, Mus musculus
aaatcttttgcctgggctccttagg

SEQ ID NO: 499770 - DNA, 25 bp, Mus musculus
aaatgaaaaacgcttctatctgaag

SEQ ID NO: 499771 - DNA, 25 bp, Mus musculus
aaatgaaaaacggttctatctgaag

SEQ ID NO: 499772 - DNA, 25 bp, Mus musculus
aaatgaaaaggtcccgcagcgggaa

SEQ ID NO: 499773 - DNA, 25 bp, Mus musculus
aaatgaaaaggtgccgcagcgggaa

SEQ ID NO: 499774 - DNA, 25 bp, Mus musculus
aaatgaaactgtcgccactggcaaa

SEQ ID NO: 499775 - DNA, 25 bp, Mus musculus
aaatgaaactgtggccactggcaaa

SEQ ID NO: 499776 - DNA, 25 bp, Mus musculus
aaatgaaatgcaatagctgtctgcc

SEQ ID NO: 499777 - DNA, 25 bp, Mus musculus
aaatgaaatgcattagctgtctgcc

SEQ ID NO: 499778 - DNA, 25 bp, Mus musculus
aaatgaagagatcgaagtcatggag

SEQ ID NO: 499779 - DNA, 25 bp, Mus musculus
aaatgaagagatggaagtcatggag

SEQ ID NO: 499780 - DNA, 25 bp, Mus musculus
aaatgaagcagtctacggtgccaat

SEQ ID NO: 499781 - DNA, 25 bp, Mus musculus
aaatgaagcagtgtacggtgccaat

SEQ ID NO: 499782 - DNA, 25 bp, Mus musculus
aaatgaagctgtagtctggccaagc

SEQ ID NO: 499783 - DNA, 25 bp, Mus musculus
aaatgaagctgttgtctggccaagc

SEQ ID NO: 499784 - DNA, 25 bp, Mus musculus
aaatgaagttttagctgcttagcac

SEQ ID NO: 499785 - DNA, 25 bp, Mus musculus
aaatgaagtttttgctgcttagcac

SEQ ID NO: 499786 - DNA, 25 bp, Mus musculus
aaatgaatgaggaaacggccagtct

SEQ ID NO: 499787 - DNA, 25 bp, Mus musculus
aaatgaatgaggtaacggccagtct

SEQ ID NO: 499788 - DNA, 25 bp, Mus musculus
aaatgaatttgaccgctttccaggg

SEQ ID NO: 499789 - DNA, 25 bp, Mus musculus
aaatgaatttgagcgctttccaggg

SEQ ID NO: 499790 - DNA, 25 bp, Mus musculus
aaatgacaaagacgcgtcctctgac

SEQ ID NO: 499791 - DNA, 25 bp, Mus musculus
aaatgacaaagaggcgtcctctgac

SEQ ID NO: 499792 - DNA, 25 bp, Mus musculus
aaatgacaatgaactgcccatggag

SEQ ID NO: 499793 - DNA, 25 bp, Mus musculus
aaatgacaatgatctgcccatggag

SEQ ID NO: 499794 - DNA, 25 bp, Mus musculus
aaatgaccaagacccatgtggatgg

SEQ ID NO: 499795 - DNA, 25 bp, Mus musculus
aaatgaccaagagccatgtggatgg

SEQ ID NO: 499796 - DNA, 25 bp, Mus musculus
aaatgaccacacacaagtctgatgc

SEQ ID NO: 499797 - DNA, 25 bp, Mus musculus
aaatgaccacactcaagtctgatgc

SEQ ID NO: 499798 - DNA, 25 bp, Mus musculus
aaatgaccagcgcttttaaactcca

SEQ ID NO: 499799 - DNA, 25 bp, Mus musculus
aaatgaccagcggttttaaactcca

SEQ ID NO: 499800 - DNA, 25 bp, Mus musculus
aaatgacccatactgttttgtggag

SEQ ID NO: 499801 - DNA, 25 bp, Mus musculus
aaatgacccatagtgttttgtggag

SEQ ID NO: 499802 - DNA, 25 bp, Mus musculus
aaatgaccgtgaaaagcccctggct

SEQ ID NO: 499803 - DNA, 25 bp, Mus musculus
aaatgaccgtgataagcccctggct

SEQ ID NO: 499804 - DNA, 25 bp, Mus musculus
aaatgacgaaaaacaagatggtgtc

SEQ ID NO: 499805 - DNA, 25 bp, Mus musculus
aaatgacgaaaatcaagatggtgtc

SEQ ID NO: 499806 - DNA, 25 bp, Mus musculus
aaatgacgaggaagaatacgaggca

SEQ ID NO: 499807 - DNA, 25 bp, Mus musculus
aaatgacgaggatgaatacgaggca

SEQ ID NO: 499808 - DNA, 25 bp, Mus musculus
aaatgacgtggacttctttgacatc

SEQ ID NO: 499809 - DNA, 25 bp, Mus musculus
aaatgacgtggagttctttgacatc

SEQ ID NO: 499810 - DNA, 25 bp, Mus musculus
aaatgactgccaatgtttctctgcc

SEQ ID NO: 499811 - DNA, 25 bp, Mus musculus
aaatgactgccattgtttctctgcc

SEQ ID NO: 499812 - DNA, 25 bp, Mus musculus
aaatgactgggacgctctggtcccc

SEQ ID NO: 499813 - DNA, 25 bp, Mus musculus
aaatgactgggaggctctggtcccc

SEQ ID NO: 499814 - DNA, 25 bp, Mus musculus
aaatgacttctccagaaaacgacag

SEQ ID NO: 499815 - DNA, 25 bp, Mus musculus
aaatgacttctcgagaaaacgacag

SEQ ID NO: 499816 - DNA, 25 bp, Mus musculus
aaatgacttgccacagattctggat

SEQ ID NO: 499817 - DNA, 25 bp, Mus musculus
aaatgacttgcctcagattctggat

SEQ ID NO: 499818 - DNA, 25 bp, Mus musculus
aaatgagccaggacataatcaaata

SEQ ID NO: 499819 - DNA, 25 bp, Mus musculus
aaatgagccaggtcataatcaaata

SEQ ID NO: 499820 - DNA, 25 bp, Mus musculus
aaatgagccattagatgttggttgc

SEQ ID NO: 499821 - DNA, 25 bp, Mus musculus
aaatgagccatttgatgttggttgc

SEQ ID NO: 499822 - DNA, 25 bp, Mus musculus
aaatgagcctataccccagcctatg

SEQ ID NO: 499823 - DNA, 25 bp, Mus musculus
aaatgagcctattccccagcctatg

SEQ ID NO: 499824 - DNA, 25 bp, Mus musculus
aaatgaggagatcgcccaggtacac

SEQ ID NO: 499825 - DNA, 25 bp, Mus musculus
aaatgaggagatggcccaggtacac

SEQ ID NO: 499826 - DNA, 25 bp, Mus musculus
aaatgaggcgctcgccgttttccga

SEQ ID NO: 499827 - DNA, 25 bp, Mus musculus
aaatgaggcgctggccgttttccga

SEQ ID NO: 499828 - DNA, 25 bp, Mus musculus
aaatgagggctaaccattgacagaa

SEQ ID NO: 499829 - DNA, 25 bp, Mus musculus
aaatgagggctatccattgacagaa

SEQ ID NO: 499830 - DNA, 25 bp, Mus musculus
aaatgagtctctccagaatagtggc

SEQ ID NO: 499831 - DNA, 25 bp, Mus musculus
aaatgagtctctgcagaatagtggc

SEQ ID NO: 499832 - DNA, 25 bp, Mus musculus
aaatgagtgagaacccgagtgatcc

SEQ ID NO: 499833 - DNA, 25 bp, Mus musculus
aaatgagtgagatcccgagtgatcc

SEQ ID NO: 499834 - DNA, 25 bp, Mus musculus
aaatgatagcatctctcctaatgag

SEQ ID NO: 499835 - DNA, 25 bp, Mus musculus
aaatgatagcatgtctcctaatgag

SEQ ID NO: 499836 - DNA, 25 bp, Mus musculus
aaatgatatttccaaagtttgcagg

SEQ ID NO: 499837 - DNA, 25 bp, Mus musculus
aaatgatatttcgaaagtttgcagg

SEQ ID NO: 499838 - DNA, 25 bp, Mus musculus
aaatgatcccagagtccttggagcc

SEQ ID NO: 499839 - DNA, 25 bp, Mus musculus
aaatgatcccagtgtccttggagcc

SEQ ID NO: 499840 - DNA, 25 bp, Mus musculus
aaatgatcgacaagaacctgcggga

SEQ ID NO: 499841 - DNA, 25 bp, Mus musculus
aaatgatcgacatgaacctgcggga

SEQ ID NO: 499842 - DNA, 25 bp, Mus musculus
aaatgatcttgcagttgtggatgtc

SEQ ID NO: 499843 - DNA, 25 bp, Mus musculus
aaatgatcttgctgttgtggatgtc

SEQ ID NO: 499844 - DNA, 25 bp, Mus musculus
aaatgatgatagagaattgaccaag

SEQ ID NO: 499845 - DNA, 25 bp, Mus musculus
aaatgatgatagtgaattgaccaag

SEQ ID NO: 499846 - DNA, 25 bp, Mus musculus
aaatgatgcaaaacaacctgactgg

SEQ ID NO: 499847 - DNA, 25 bp, Mus musculus
aaatgatgcaaatcaacctgactgg

SEQ ID NO: 499848 - DNA, 25 bp, Mus musculus
aaatgatggaaaaccgacagctggc

SEQ ID NO: 499849 - DNA, 25 bp, Mus musculus
aaatgatggaaaccaaggtggacct

SEQ ID NO: 499850 - DNA, 25 bp, Mus musculus
aaatgatggaaagcaaggtggacct

SEQ ID NO: 499851 - DNA, 25 bp, Mus musculus
aaatgatggaaatccgacagctggc

SEQ ID NO: 499852 - DNA, 25 bp, Mus musculus
aaatgatggcctccaccaaaggctg

SEQ ID NO: 499853 - DNA, 25 bp, Mus musculus
aaatgatggcctgcaccaaaggctg

SEQ ID NO: 499854 - DNA, 25 bp, Mus musculus
aaatgatgggaaagaaccacctcct

SEQ ID NO: 499855 - DNA, 25 bp, Mus musculus
aaatgatgggaatgaaccacctcct

SEQ ID NO: 499856 - DNA, 25 bp, Mus musculus
aaatgatggtttctatctgtgaaca

SEQ ID NO: 499857 - DNA, 25 bp, Mus musculus
aaatgatggtttgtatctgtgaaca

SEQ ID NO: 499858 - DNA, 25 bp, Mus musculus
aaatgatgtgcactgccctgagccc

SEQ ID NO: 499859 - DNA, 25 bp, Mus musculus
aaatgatgtgcagtgccctgagccc

SEQ ID NO: 499860 - DNA, 25 bp, Mus musculus
aaatgattctgcagcttccaaggcc

SEQ ID NO: 499861 - DNA, 25 bp, Mus musculus
aaatgattctgctgcttccaaggcc

SEQ ID NO: 499862 - DNA, 25 bp, Mus musculus
aaatgattctgtacctgagactgcc

SEQ ID NO: 499863 - DNA, 25 bp, Mus musculus
aaatgattctgttcctgagactgcc

SEQ ID NO: 499864 - DNA, 25 bp, Mus musculus
aaatgattgccaagtttcaagagga

SEQ ID NO: 499865 - DNA, 25 bp, Mus musculus
aaatgattgccatgtttcaagagga

SEQ ID NO: 499866 - DNA, 25 bp, Mus musculus
aaatgcaaatgcaagttcagacaga

SEQ ID NO: 499867 - DNA, 25 bp, Mus musculus
aaatgcaaatgctagttcagacaga

SEQ ID NO: 499868 - DNA, 25 bp, Mus musculus
aaatgcaacaatccgaatggccacg

SEQ ID NO: 499869 - DNA, 25 bp, Mus musculus
aaatgcaacaatgcgaatggccacg

SEQ ID NO: 499870 - DNA, 25 bp, Mus musculus
aaatgcaagtccatccaaccttgta

SEQ ID NO: 499871 - DNA, 25 bp, Mus musculus
aaatgcaagtccttccaaccttgta

SEQ ID NO: 499872 - DNA, 25 bp, Mus musculus
aaatgcaagtggatgctccatccga

SEQ ID NO: 499873 - DNA, 25 bp, Mus musculus
aaatgcaagtggttgctccatccga

SEQ ID NO: 499874 - DNA, 25 bp, Mus musculus
aaatgcaagttcagacagaaaccca

SEQ ID NO: 499875 - DNA, 25 bp, Mus musculus
aaatgcaagttctgacagaaaccca

SEQ ID NO: 499876 - DNA, 25 bp, Mus musculus
aaatgcacatacctgctgggcacca

SEQ ID NO: 499877 - DNA, 25 bp, Mus musculus
aaatgcacatacgtgctgggcacca

SEQ ID NO: 499878 - DNA, 25 bp, Mus musculus
aaatgcaccaccagcagcgcatgtt

SEQ ID NO: 499879 - DNA, 25 bp, Mus musculus
aaatgcaccacctgcagcgcatgtt

SEQ ID NO: 499880 - DNA, 25 bp, Mus musculus
aaatgcaccaggctttcggcctcag

SEQ ID NO: 499881 - DNA, 25 bp, Mus musculus
aaatgcaccagggtttcggcctcag

SEQ ID NO: 499882 - DNA, 25 bp, Mus musculus
aaatgcacttatacttattacaggc

SEQ ID NO: 499883 - DNA, 25 bp, Mus musculus
aaatgcacttattcttattacaggc

SEQ ID NO: 499884 - DNA, 25 bp, Mus musculus
aaatgcaggcgtaagtcttccctgt

SEQ ID NO: 499885 - DNA, 25 bp, Mus musculus
aaatgcaggcgttagtcttccctgt

SEQ ID NO: 499886 - DNA, 25 bp, Mus musculus
aaatgcagtggccagttctcataac

SEQ ID NO: 499887 - DNA, 25 bp, Mus musculus
aaatgcagtggcgagttctcataac

SEQ ID NO: 499888 - DNA, 25 bp, Mus musculus
aaatgcatctgtccgcgctacagaa

SEQ ID NO: 499889 - DNA, 25 bp, Mus musculus
aaatgcatctgtgcgcgctacagaa

SEQ ID NO: 499890 - DNA, 25 bp, Mus musculus
aaatgcattgcactcgttacagaag

SEQ ID NO: 499891 - DNA, 25 bp, Mus musculus
aaatgcattgcagtcgttacagaag

SEQ ID NO: 499892 - DNA, 25 bp, Mus musculus
aaatgccaatttcccagtggaccca

SEQ ID NO: 499893 - DNA, 25 bp, Mus musculus
aaatgccaatttgccagtggaccca

SEQ ID NO: 499894 - DNA, 25 bp, Mus musculus
aaatgccaccagatggcgggttagg

SEQ ID NO: 499895 - DNA, 25 bp, Mus musculus
aaatgccaccagttggcgggttagg

SEQ ID NO: 499896 - DNA, 25 bp, Mus musculus
aaatgccagaacatccataagtctc

SEQ ID NO: 499897 - DNA, 25 bp, Mus musculus
aaatgccagaacttccataagtctc

SEQ ID NO: 499898 - DNA, 25 bp, Mus musculus
aaatgccagcacagataacactgtc

SEQ ID NO: 499899 - DNA, 25 bp, Mus musculus
aaatgccagcactgataacactgtc

SEQ ID NO: 499900 - DNA, 25 bp, Mus musculus
aaatgccaggctctgtcggaccagg

SEQ ID NO: 499901 - DNA, 25 bp, Mus musculus
aaatgccaggctgtgtcggaccagg

SEQ ID NO: 499902 - DNA, 25 bp, Mus musculus
aaatgccattcaccagatgggtggc

SEQ ID NO: 499903 - DNA, 25 bp, Mus musculus
aaatgccattcagcagatgggtggc

SEQ ID NO: 499904 - DNA, 25 bp, Mus musculus
aaatgcccaggcaattgctgacctc

SEQ ID NO: 499905 - DNA, 25 bp, Mus musculus
aaatgcccaggctattgctgacctc

SEQ ID NO: 499906 - DNA, 25 bp, Mus musculus
aaatgccctgaaactccaaaagctc

SEQ ID NO: 499907 - DNA, 25 bp, Mus musculus
aaatgccctgaaaggaatgctgcgg

SEQ ID NO: 499908 - DNA, 25 bp, Mus musculus
aaatgccctgaacccaagtgtttca

SEQ ID NO: 499909 - DNA, 25 bp, Mus musculus
aaatgccctgaagccaagtgtttca

SEQ ID NO: 499910 - DNA, 25 bp, Mus musculus
aaatgccctgaatctccaaaagctc

SEQ ID NO: 499911 - DNA, 25 bp, Mus musculus
aaatgccctgaatggaatgctgcgg

SEQ ID NO: 499912 - DNA, 25 bp, Mus musculus
aaatgccgtcgtcggaagcagcgct

SEQ ID NO: 499913 - DNA, 25 bp, Mus musculus
aaatgccgtcgtgggaagcagcgct

SEQ ID NO: 499914 - DNA, 25 bp, Mus musculus
aaatgcctaagaaggtgcctggaac

SEQ ID NO: 499915 - DNA, 25 bp, Mus musculus
aaatgcctaagatggtgcctggaac

SEQ ID NO: 499916 - DNA, 25 bp, Mus musculus
aaatgcctacccctgcagctcggag

SEQ ID NO: 499917 - DNA, 25 bp, Mus musculus
aaatgcctacccgtgcagctcggag

SEQ ID NO: 499918 - DNA, 25 bp, Mus musculus
aaatgcctatcacgtaggtagcccc

SEQ ID NO: 499919 - DNA, 25 bp, Mus musculus
aaatgcctatcaggtaggtagcccc

SEQ ID NO: 499920 - DNA, 25 bp, Mus musculus
aaatgcctcgagacctgggagtggc

SEQ ID NO: 499921 - DNA, 25 bp, Mus musculus
aaatgcctcgagtcctgggagtggc

SEQ ID NO: 499922 - DNA, 25 bp, Mus musculus
aaatgcctctatcaccatcgaccag

SEQ ID NO: 499923 - DNA, 25 bp, Mus musculus
aaatgcctctatgaccatcgaccag

SEQ ID NO: 499924 - DNA, 25 bp, Mus musculus
aaatgcctgagccaagattcatgta

SEQ ID NO: 499925 - DNA, 25 bp, Mus musculus
aaatgcctgagcgaagattcatgta

SEQ ID NO: 499926 - DNA, 25 bp, Mus musculus
aaatgccttcctagtcaccgataga

SEQ ID NO: 499927 - DNA, 25 bp, Mus musculus
aaatgccttccttgtcaccgataga

SEQ ID NO: 499928 - DNA, 25 bp, Mus musculus
aaatgcctttcgacctagcactaag

SEQ ID NO: 499929 - DNA, 25 bp, Mus musculus
aaatgcctttcgtcctagcactaag

SEQ ID NO: 499930 - DNA, 25 bp, Mus musculus
aaatgcgaacaacgcgcacgctgcg

SEQ ID NO: 499931 - DNA, 25 bp, Mus musculus
aaatgcgaacaaggcgcacgctgcg

SEQ ID NO: 499932 - DNA, 25 bp, Mus musculus
aaatgcgatgaacaaagcacacgtg

SEQ ID NO: 499933 - DNA, 25 bp, Mus musculus
aaatgcgatgaagaaagcacacgtg

SEQ ID NO: 499934 - DNA, 25 bp, Mus musculus
aaatgcgctctcatgctaacaggag

SEQ ID NO: 499935 - DNA, 25 bp, Mus musculus
aaatgcgctctcttgctaacaggag

SEQ ID NO: 499936 - DNA, 25 bp, Mus musculus
aaatgcggattgattaatgcaagag

SEQ ID NO: 499937 - DNA, 25 bp, Mus musculus
aaatgcggattgtttaatgcaagag

SEQ ID NO: 499938 - DNA, 25 bp, Mus musculus
aaatgcgggaagagcggcaagaccg

SEQ ID NO: 499939 - DNA, 25 bp, Mus musculus
aaatgcgggaagtgcggcaagaccg

SEQ ID NO: 499940 - DNA, 25 bp, Mus musculus
aaatgcgtatcacatggaagccgag

SEQ ID NO: 499941 - DNA, 25 bp, Mus musculus
aaatgcgtatcagatggaagccgag

SEQ ID NO: 499942 - DNA, 25 bp, Mus musculus
aaatgcgtttggctctccagtcatt

SEQ ID NO: 499943 - DNA, 25 bp, Mus musculus
aaatgcgtttgggtctccagtcatt

SEQ ID NO: 499944 - DNA, 25 bp, Mus musculus
aaatgctaagcaaccaaatgggcgt

SEQ ID NO: 499945 - DNA, 25 bp, Mus musculus
aaatgctaagcatccaaatgggcgt

SEQ ID NO: 499946 - DNA, 25 bp, Mus musculus
aaatgctagcagacctcaaagaggc

SEQ ID NO: 499947 - DNA, 25 bp, Mus musculus
aaatgctagcagtcctcaaagaggc

SEQ ID NO: 499948 - DNA, 25 bp, Mus musculus
aaatgctcagacatcgttgtggtac

SEQ ID NO: 499949 - DNA, 25 bp, Mus musculus
aaatgctcagacttcgttgtggtac

SEQ ID NO: 499950 - DNA, 25 bp, Mus musculus
aaatgctgagacatacatgcagcct

SEQ ID NO: 499951 - DNA, 25 bp, Mus musculus
aaatgctgagacttacatgcagcct

SEQ ID NO: 499952 - DNA, 25 bp, Mus musculus
aaatgctgcagtcccggagctgcct

SEQ ID NO: 499953 - DNA, 25 bp, Mus musculus
aaatgctgcagtgccggagctgcct

SEQ ID NO: 499954 - DNA, 25 bp, Mus musculus
aaatgctgctcaaggattctccctt

SEQ ID NO: 499955 - DNA, 25 bp, Mus musculus
aaatgctgctcatggattctccctt

SEQ ID NO: 499956 - DNA, 25 bp, Mus musculus
aaatgctggattcgcccatgaatca

SEQ ID NO: 499957 - DNA, 25 bp, Mus musculus
aaatgctggattggcccatgaatca

SEQ ID NO: 499958 - DNA, 25 bp, Mus musculus
aaatgctgggaacaaaagtttgaga

SEQ ID NO: 499959 - DNA, 25 bp, Mus musculus
aaatgctgggaagaaaagtttgaga

SEQ ID NO: 499960 - DNA, 25 bp, Mus musculus
aaatgctgtggcagtggctgttaca

SEQ ID NO: 499961 - DNA, 25 bp, Mus musculus
aaatgctgtggctgtggctgttaca

SEQ ID NO: 499962 - DNA, 25 bp, Mus musculus
aaatgcttcttgcaactgaatggac

SEQ ID NO: 499963 - DNA, 25 bp, Mus musculus
aaatgcttcttggaactgaatggac

SEQ ID NO: 499964 - DNA, 25 bp, Mus musculus
aaatgcttgctgctttgctggaaac

SEQ ID NO: 499965 - DNA, 25 bp, Mus musculus
aaatgcttgctggtttgctggaaac

SEQ ID NO: 499966 - DNA, 25 bp, Mus musculus
aaatggaacagcaggcctcttgcct

SEQ ID NO: 499967 - DNA, 25 bp, Mus musculus
aaatggaacagctggcctcttgcct

SEQ ID NO: 499968 - DNA, 25 bp, Mus musculus
aaatggaacctgatgtattgcagac

SEQ ID NO: 499969 - DNA, 25 bp, Mus musculus
aaatggaacctgttgtattgcagac

SEQ ID NO: 499970 - DNA, 25 bp, Mus musculus
aaatggaagcaactgacgatcgacc

SEQ ID NO: 499971 - DNA, 25 bp, Mus musculus
aaatggaagcaagtgacgatcgacc

SEQ ID NO: 499972 - DNA, 25 bp, Mus musculus
aaatggaagtggagcggactcctag

SEQ ID NO: 499973 - DNA, 25 bp, Mus musculus
aaatggaagtggtgcggactcctag

SEQ ID NO: 499974 - DNA, 25 bp, Mus musculus
aaatggaattgcaagaggagacact

SEQ ID NO: 499975 - DNA, 25 bp, Mus musculus
aaatggaattgctagaggagacact

SEQ ID NO: 499976 - DNA, 25 bp, Mus musculus
aaatggacaaagcacaggcaccaag

SEQ ID NO: 499977 - DNA, 25 bp, Mus musculus
aaatggacaaaggacaggcaccaag

SEQ ID NO: 499978 - DNA, 25 bp, Mus musculus
aaatggacagtcctggtgaagaacc

SEQ ID NO: 499979 - DNA, 25 bp, Mus musculus
aaatggacagtcgtggtgaagaacc

SEQ ID NO: 499980 - DNA, 25 bp, Mus musculus
aaatggacttgcagtcaaacttcag

SEQ ID NO: 499981 - DNA, 25 bp, Mus musculus
aaatggacttgctgtcaaacttcag

SEQ ID NO: 499982 - DNA, 25 bp, Mus musculus
aaatggagaccgcagtgaggaagct

SEQ ID NO: 499983 - DNA, 25 bp, Mus musculus
aaatggagaccggagtgaggaagct

SEQ ID NO: 499984 - DNA, 25 bp, Mus musculus
aaatggagattgaggaccatgcgct

SEQ ID NO: 499985 - DNA, 25 bp, Mus musculus
aaatggagattgtggaccatgcgct

SEQ ID NO: 499986 - DNA, 25 bp, Mus musculus
aaatggagcagacccgcctcagcga

SEQ ID NO: 499987 - DNA, 25 bp, Mus musculus
aaatggagcagagccgcctcagcga

SEQ ID NO: 499988 - DNA, 25 bp, Mus musculus
aaatggagccaaaaaacactttgca

SEQ ID NO: 499989 - DNA, 25 bp, Mus musculus
aaatggagccaataaacactttgca

SEQ ID NO: 499990 - DNA, 25 bp, Mus musculus
aaatggagcctcattggaccacgac

SEQ ID NO: 499991 - DNA, 25 bp, Mus musculus
aaatggagcctctttggaccacgac

SEQ ID NO: 499992 - DNA, 25 bp, Mus musculus
aaatggagccttaggtgggacaagt

SEQ ID NO: 499993 - DNA, 25 bp, Mus musculus
aaatggagcctttggtgggacaagt

SEQ ID NO: 499994 - DNA, 25 bp, Mus musculus
aaatggagcgcacattccacgagct

SEQ ID NO: 499995 - DNA, 25 bp, Mus musculus
aaatggagcgcagattccacgagct

SEQ ID NO: 499996 - DNA, 25 bp, Mus musculus
aaatggaggtgacagtttcacagct

SEQ ID NO: 499997 - DNA, 25 bp, Mus musculus
aaatggaggtgagagtttcacagct

SEQ ID NO: 499998 - DNA, 25 bp, Mus musculus
aaatggagtatgactttgaactgga

SEQ ID NO: 499999 - DNA, 25 bp, Mus musculus
aaatggagtatgtctttgaactgga

SEQ ID NO: 500000 - DNA, 25 bp, Mus musculus
aaatggatattcattcttcaagctc

SEQ ID NO: 500001 - DNA, 25 bp, Mus musculus
aaatggatattctttcttcaagctc

SEQ ID NO: 500002 - DNA, 25 bp, Mus musculus
aaatggatgcccatgcaggcaagtc

SEQ ID NO: 500003 - DNA, 25 bp, Mus musculus
aaatggatgcccttgcaggcaagtc

SEQ ID NO: 500004 - DNA, 25 bp, Mus musculus
aaatggcaaatgctggcgatcagaa

SEQ ID NO: 500005 - DNA, 25 bp, Mus musculus
aaatggcaaatggtggcgatcagaa

SEQ ID NO: 500006 - DNA, 25 bp, Mus musculus
aaatggcaagtgcaacgatgtcccc

SEQ ID NO: 500007 - DNA, 25 bp, Mus musculus
aaatggcaagtggaacgatgtcccc

SEQ ID NO: 500008 - DNA, 25 bp, Mus musculus
aaatggcagagaagcgacctccatt

SEQ ID NO: 500009 - DNA, 25 bp, Mus musculus
aaatggcagagatgcgacctccatt

SEQ ID NO: 500010 - DNA, 25 bp, Mus musculus
aaatggcagaggcataagtgacacc

SEQ ID NO: 500011 - DNA, 25 bp, Mus musculus
aaatggcagagggataagtgacacc

SEQ ID NO: 500012 - DNA, 25 bp, Mus musculus
aaatggcagagtacacccacagtgc

SEQ ID NO: 500013 - DNA, 25 bp, Mus musculus
aaatggcagagttcacccacagtgc

SEQ ID NO: 500014 - DNA, 25 bp, Mus musculus
aaatggcagcatattactgaagaac

SEQ ID NO: 500015 - DNA, 25 bp, Mus musculus
aaatggcagcattttactgaagaac

SEQ ID NO: 500016 - DNA, 25 bp, Mus musculus
aaatggcagttcaaccaacgtcgac

SEQ ID NO: 500017 - DNA, 25 bp, Mus musculus
aaatggcagttctaccaacgtcgac

SEQ ID NO: 500018 - DNA, 25 bp, Mus musculus
aaatggcatataaatcctaacgggc

SEQ ID NO: 500019 - DNA, 25 bp, Mus musculus
aaatggcatatatatcctaacgggc

SEQ ID NO: 500020 - DNA, 25 bp, Mus musculus
aaatggcccataccgtcagctcttc

SEQ ID NO: 500021 - DNA, 25 bp, Mus musculus
aaatggcccatagcgtcagctcttc

SEQ ID NO: 500022 - DNA, 25 bp, Mus musculus
aaatggccgctgcattaccctgctg

SEQ ID NO: 500023 - DNA, 25 bp, Mus musculus
aaatggccgctggattaccctgctg

SEQ ID NO: 500024 - DNA, 25 bp, Mus musculus
aaatggcctcggagctccagtccgg

SEQ ID NO: 500025 - DNA, 25 bp, Mus musculus
aaatggcctcggatctgtgggaagt

SEQ ID NO: 500026 - DNA, 25 bp, Mus musculus
aaatggcctcggtgctccagtccgg

SEQ ID NO: 500027 - DNA, 25 bp, Mus musculus
aaatggcctcggttctgtgggaagt

SEQ ID NO: 500028 - DNA, 25 bp, Mus musculus
aaatggccttgcattacttcagacc

SEQ ID NO: 500029 - DNA, 25 bp, Mus musculus
aaatggccttgctttacttcagacc

SEQ ID NO: 500030 - DNA, 25 bp, Mus musculus
aaatggcgatctccaagacggtgtc

SEQ ID NO: 500031 - DNA, 25 bp, Mus musculus
aaatggcgatctgcaagacggtgtc

SEQ ID NO: 500032 - DNA, 25 bp, Mus musculus
aaatggcggagaaggcaaagcaaat

SEQ ID NO: 500033 - DNA, 25 bp, Mus musculus
aaatggcggagatggcaaagcaaat

SEQ ID NO: 500034 - DNA, 25 bp, Mus musculus
aaatggcgtcggcataggccttgct

SEQ ID NO: 500035 - DNA, 25 bp, Mus musculus
aaatggcgtcgggataggccttgct

SEQ ID NO: 500036 - DNA, 25 bp, Mus musculus
aaatggctacaaactttctagcgca

SEQ ID NO: 500037 - DNA, 25 bp, Mus musculus
aaatggctacaatctttctagcgca

SEQ ID NO: 500038 - DNA, 25 bp, Mus musculus
aaatggctcctgatttgcctgaata

SEQ ID NO: 500039 - DNA, 25 bp, Mus musculus
aaatggctcctgttttgcctgaata

SEQ ID NO: 500040 - DNA, 25 bp, Mus musculus
aaatggctgcagctgattctgtgca

SEQ ID NO: 500041 - DNA, 25 bp, Mus musculus
aaatggctgcaggtgattctgtgca

SEQ ID NO: 500042 - DNA, 25 bp, Mus musculus
aaatggctgtttctgagctccctgg

SEQ ID NO: 500043 - DNA, 25 bp, Mus musculus
aaatggctgtttgtgagctccctgg

SEQ ID NO: 500044 - DNA, 25 bp, Mus musculus
aaatggcttccgcagtcaataccag

SEQ ID NO: 500045 - DNA, 25 bp, Mus musculus
aaatggcttccggagtcaataccag

SEQ ID NO: 500046 - DNA, 25 bp, Mus musculus
aaatgggaacaacatcagcatcctc

SEQ ID NO: 500047 - DNA, 25 bp, Mus musculus
aaatgggaacaagatcagcatcctc

SEQ ID NO: 500048 - DNA, 25 bp, Mus musculus
aaatgggctaatccagctgcggagc

SEQ ID NO: 500049 - DNA, 25 bp, Mus musculus
aaatgggctaatgcagctgcggagc

SEQ ID NO: 500050 - DNA, 25 bp, Mus musculus
aaatgggctggactttctattggac

SEQ ID NO: 500051 - DNA, 25 bp, Mus musculus
aaatgggctggagtttctattggac

SEQ ID NO: 500052 - DNA, 25 bp, Mus musculus
aaatgggcttcactaggagcctggt

SEQ ID NO: 500053 - DNA, 25 bp, Mus musculus
aaatgggcttcagtaggagcctggt

SEQ ID NO: 500054 - DNA, 25 bp, Mus musculus
aaatgggtacgaccggaagatctca

SEQ ID NO: 500055 - DNA, 25 bp, Mus musculus
aaatgggtacgagcggaagatctca

SEQ ID NO: 500056 - DNA, 25 bp, Mus musculus
aaatgggtcgacattgccagaggag

SEQ ID NO: 500057 - DNA, 25 bp, Mus musculus
aaatgggtcgactttgccagaggag

SEQ ID NO: 500058 - DNA, 25 bp, Mus musculus
aaatggtacccgctgatctgaacgc

SEQ ID NO: 500059 - DNA, 25 bp, Mus musculus
aaatggtacccggtgatctgaacgc

SEQ ID NO: 500060 - DNA, 25 bp, Mus musculus
aaatggtcatcaatcgcctggagaa

SEQ ID NO: 500061 - DNA, 25 bp, Mus musculus
aaatggtcatcacgtaagcagtctg

SEQ ID NO: 500062 - DNA, 25 bp, Mus musculus
aaatggtcatcaggtaagcagtctg

SEQ ID NO: 500063 - DNA, 25 bp, Mus musculus
aaatggtcatcattcgcctggagaa

SEQ ID NO: 500064 - DNA, 25 bp, Mus musculus
aaatggtctactatgccatctcaga

SEQ ID NO: 500065 - DNA, 25 bp, Mus musculus
aaatggtctactttgccatctcaga

SEQ ID NO: 500066 - DNA, 25 bp, Mus musculus
aaatggtctggcatcatatttggaa

SEQ ID NO: 500067 - DNA, 25 bp, Mus musculus
aaatggtctggcttcatatttggaa

SEQ ID NO: 500068 - DNA, 25 bp, Mus musculus
aaatggtctgtgatcctagccaggc

SEQ ID NO: 500069 - DNA, 25 bp, Mus musculus
aaatggtctgtgttcctagccaggc

SEQ ID NO: 500070 - DNA, 25 bp, Mus musculus
aaatggtgaggtatgagcccacgtg

SEQ ID NO: 500071 - DNA, 25 bp, Mus musculus
aaatggtgaggtttgagcccacgtg

SEQ ID NO: 500072 - DNA, 25 bp, Mus musculus
aaatggtgcccaacaacctagcaag

SEQ ID NO: 500073 - DNA, 25 bp, Mus musculus
aaatggtgcccatcaacctagcaag

SEQ ID NO: 500074 - DNA, 25 bp, Mus musculus
aaatggtgcgggacttaaagagcgt

SEQ ID NO: 500075 - DNA, 25 bp, Mus musculus
aaatggtgcgggtcttaaagagcgt

SEQ ID NO: 500076 - DNA, 25 bp, Mus musculus
aaatggtgtcacagcagcactggct

SEQ ID NO: 500077 - DNA, 25 bp, Mus musculus
aaatggtgtcactgcagcactggct

SEQ ID NO: 500078 - DNA, 25 bp, Mus musculus
aaatggttatttatgaagctgcttc

SEQ ID NO: 500079 - DNA, 25 bp, Mus musculus
aaatggttatttttgaagctgcttc

SEQ ID NO: 500080 - DNA, 25 bp, Mus musculus
aaatggttgccgagtcatgttaatt

SEQ ID NO: 500081 - DNA, 25 bp, Mus musculus
aaatggttgccgtgtcatgttaatt

SEQ ID NO: 500082 - DNA, 25 bp, Mus musculus
aaatggtttgacactgattgagctc

SEQ ID NO: 500083 - DNA, 25 bp, Mus musculus
aaatggtttgactctgattgagctc

SEQ ID NO: 500084 - DNA, 25 bp, Mus musculus
aaatggtttttcatgggtgcagctt

SEQ ID NO: 500085 - DNA, 25 bp, Mus musculus
aaatggtttttcattggtgcggctg

SEQ ID NO: 500086 - DNA, 25 bp, Mus musculus
aaatggtttttcttgggtgcagctt

SEQ ID NO: 500087 - DNA, 25 bp, Mus musculus
aaatggtttttctttggtgcggctg

SEQ ID NO: 500088 - DNA, 25 bp, Mus musculus
aaatgtaactgaaagcaagatacag

SEQ ID NO: 500089 - DNA, 25 bp, Mus musculus
aaatgtaactgatagcaagatacag

SEQ ID NO: 500090 - DNA, 25 bp, Mus musculus
aaatgtacatttatcccagacaaaa

SEQ ID NO: 500091 - DNA, 25 bp, Mus musculus
aaatgtacatttttcccagacaaaa

SEQ ID NO: 500092 - DNA, 25 bp, Mus musculus
aaatgtacgacacggctgcagaggt

SEQ ID NO: 500093 - DNA, 25 bp, Mus musculus
aaatgtacgacagggctgcagaggt

SEQ ID NO: 500094 - DNA, 25 bp, Mus musculus
aaatgtacgctcacctttcccggtg

SEQ ID NO: 500095 - DNA, 25 bp, Mus musculus
aaatgtacgctctcctttcccggtg

SEQ ID NO: 500096 - DNA, 25 bp, Mus musculus
aaatgtactcaaattttgttctcac

SEQ ID NO: 500097 - DNA, 25 bp, Mus musculus
aaatgtactcaatttttgttctcac

SEQ ID NO: 500098 - DNA, 25 bp, Mus musculus
aaatgtagacgaagccataaatttc

SEQ ID NO: 500099 - DNA, 25 bp, Mus musculus
aaatgtagacgatgccataaatttc

SEQ ID NO: 500100 - DNA, 25 bp, Mus musculus
aaatgtagggagaccagcagtgcag

SEQ ID NO: 500101 - DNA, 25 bp, Mus musculus
aaatgtagggagtccagcagtgcag

SEQ ID NO: 500102 - DNA, 25 bp, Mus musculus
aaatgtatctctcccaggacctggc

SEQ ID NO: 500103 - DNA, 25 bp, Mus musculus
aaatgtatctctgccaggacctggc

SEQ ID NO: 500104 - DNA, 25 bp, Mus musculus
aaatgtcacataagttaggtgatcc

SEQ ID NO: 500105 - DNA, 25 bp, Mus musculus
aaatgtcacatatgttaggtgatcc

SEQ ID NO: 500106 - DNA, 25 bp, Mus musculus
aaatgtcaccaacaggatgatgctc

SEQ ID NO: 500107 - DNA, 25 bp, Mus musculus
aaatgtcaccaagaggatgatgctc

SEQ ID NO: 500108 - DNA, 25 bp, Mus musculus
aaatgtcacctgctctacctgcaga

SEQ ID NO: 500109 - DNA, 25 bp, Mus musculus
aaatgtcacctggtctacctgcaga

SEQ ID NO: 500110 - DNA, 25 bp, Mus musculus
aaatgtcagcggaacgtgggagttc

SEQ ID NO: 500111 - DNA, 25 bp, Mus musculus
aaatgtcagcggtacgtgggagttc

SEQ ID NO: 500112 - DNA, 25 bp, Mus musculus
aaatgtccatatagcccaatggaac

SEQ ID NO: 500113 - DNA, 25 bp, Mus musculus
aaatgtccatattgcccaatggaac

SEQ ID NO: 500114 - DNA, 25 bp, Mus musculus
aaatgtcccaggaggagatctctcc

SEQ ID NO: 500115 - DNA, 25 bp, Mus musculus
aaatgtcccaggtggagatctctcc

SEQ ID NO: 500116 - DNA, 25 bp, Mus musculus
aaatgtccctatcaccccaagctgg

SEQ ID NO: 500117 - DNA, 25 bp, Mus musculus
aaatgtccctatgaccccaagctgg

SEQ ID NO: 500118 - DNA, 25 bp, Mus musculus
aaatgtcctggtcaccttgtacgag

SEQ ID NO: 500119 - DNA, 25 bp, Mus musculus
aaatgtcctggtgaccttgtacgag

SEQ ID NO: 500120 - DNA, 25 bp, Mus musculus
aaatgtcgagtgctcccgttgccga

SEQ ID NO: 500121 - DNA, 25 bp, Mus musculus
aaatgtcgagtggtcccgttgccga

SEQ ID NO: 500122 - DNA, 25 bp, Mus musculus
aaatgtcgggttaggtgatcttcac

SEQ ID NO: 500123 - DNA, 25 bp, Mus musculus
aaatgtcgggtttggtgatcttcac

SEQ ID NO: 500124 - DNA, 25 bp, Mus musculus
aaatgtgaagttcgagttcctcgga

SEQ ID NO: 500125 - DNA, 25 bp, Mus musculus
aaatgtgaagttggagttcctcgga

SEQ ID NO: 500126 - DNA, 25 bp, Mus musculus
aaatgtgacagaagagacacgctgc

SEQ ID NO: 500127 - DNA, 25 bp, Mus musculus
aaatgtgacagatgagacacgctgc

SEQ ID NO: 500128 - DNA, 25 bp, Mus musculus
aaatgtgacctgaccacaaagaaag

SEQ ID NO: 500129 - DNA, 25 bp, Mus musculus
aaatgtgacctgtccacaaagaaag

SEQ ID NO: 500130 - DNA, 25 bp, Mus musculus
aaatgtgaccttcatcggctagaag

SEQ ID NO: 500131 - DNA, 25 bp, Mus musculus
aaatgtgaccttgatcggctagaag

SEQ ID NO: 500132 - DNA, 25 bp, Mus musculus
aaatgtgagcgtcttctcctggccc

SEQ ID NO: 500133 - DNA, 25 bp, Mus musculus
aaatgtgagcgtgttctcctggccc

SEQ ID NO: 500134 - DNA, 25 bp, Mus musculus
aaatgtgcagagctgctaagcagcc

SEQ ID NO: 500135 - DNA, 25 bp, Mus musculus
aaatgtgcagaggtgctaagcagcc

SEQ ID NO: 500136 - DNA, 25 bp, Mus musculus
aaatgtgccattacccaggttgcca

SEQ ID NO: 500137 - DNA, 25 bp, Mus musculus
aaatgtgccatttcccaggttgcca

SEQ ID NO: 500138 - DNA, 25 bp, Mus musculus
aaatgtgccgtgatgtatgtgagca

SEQ ID NO: 500139 - DNA, 25 bp, Mus musculus
aaatgtgccgtgttgtatgtgagca

SEQ ID NO: 500140 - DNA, 25 bp, Mus musculus
aaatgtgctatgcaaggcctgtgcc

SEQ ID NO: 500141 - DNA, 25 bp, Mus musculus
aaatgtgctatggaaggcctgtgcc

SEQ ID NO: 500142 - DNA, 25 bp, Mus musculus
aaatgtggatcaccagtttcctggg

SEQ ID NO: 500143 - DNA, 25 bp, Mus musculus
aaatgtggatcagcagtttcctggg

SEQ ID NO: 500144 - DNA, 25 bp, Mus musculus
aaatgtggcagtctgatgctcaagc

SEQ ID NO: 500145 - DNA, 25 bp, Mus musculus
aaatgtggcagtgtgatgctcaagc

SEQ ID NO: 500146 - DNA, 25 bp, Mus musculus
aaatgtggccttcttcggactggtc

SEQ ID NO: 500147 - DNA, 25 bp, Mus musculus
aaatgtggccttgttcggactggtc

SEQ ID NO: 500148 - DNA, 25 bp, Mus musculus
aaatgtgggacaccatgcaagaagg

SEQ ID NO: 500149 - DNA, 25 bp, Mus musculus
aaatgtgggacagcatgcaagaagg

SEQ ID NO: 500150 - DNA, 25 bp, Mus musculus
aaatgtgtcgggatgccgccctcct

SEQ ID NO: 500151 - DNA, 25 bp, Mus musculus
aaatgtgtcgggttgccgccctcct

SEQ ID NO: 500152 - DNA, 25 bp, Mus musculus
aaatgtgtctcacgcccctcactta

SEQ ID NO: 500153 - DNA, 25 bp, Mus musculus
aaatgtgtctcaggcccctcactta

SEQ ID NO: 500154 - DNA, 25 bp, Mus musculus
aaatgtgttctgactggaccaccac

SEQ ID NO: 500155 - DNA, 25 bp, Mus musculus
aaatgtgttctgtctggaccaccac

SEQ ID NO: 500156 - DNA, 25 bp, Mus musculus
aaatgttaaggactgggagctgcca

SEQ ID NO: 500157 - DNA, 25 bp, Mus musculus
aaatgttaaggagtgggagctgcca

SEQ ID NO: 500158 - DNA, 25 bp, Mus musculus
aaatgttcctgcaggacctgaggaa

SEQ ID NO: 500159 - DNA, 25 bp, Mus musculus
aaatgttcctgctggacctgaggaa

SEQ ID NO: 500160 - DNA, 25 bp, Mus musculus
aaatgttcttcaaccaagcatgtcg

SEQ ID NO: 500161 - DNA, 25 bp, Mus musculus
aaatgttcttcatccaagcatgtcg

SEQ ID NO: 500162 - DNA, 25 bp, Mus musculus
aaatgttgaagacgactaccaaaat

SEQ ID NO: 500163 - DNA, 25 bp, Mus musculus
aaatgttgaagaggactaccaaaat

SEQ ID NO: 500164 - DNA, 25 bp, Mus musculus
aaatgttgcaatcaagaagctcagc

SEQ ID NO: 500165 - DNA, 25 bp, Mus musculus
aaatgttgcaatgaagaagctcagc

SEQ ID NO: 500166 - DNA, 25 bp, Mus musculus
aaatgttggcataaagaaagctatc

SEQ ID NO: 500167 - DNA, 25 bp, Mus musculus
aaatgttggcattaagaaagctatc

SEQ ID NO: 500168 - DNA, 25 bp, Mus musculus
aaatgtttaattatgccagggacca

SEQ ID NO: 500169 - DNA, 25 bp, Mus musculus
aaatgtttaattttgccagggacca

SEQ ID NO: 500170 - DNA, 25 bp, Mus musculus
aaatgtttggaacctttagcacagc

SEQ ID NO: 500171 - DNA, 25 bp, Mus musculus
aaatgtttggaagctttagcacagc

SEQ ID NO: 500172 - DNA, 25 bp, Mus musculus
aaatgttttaggagcatcaagccaa

SEQ ID NO: 500173 - DNA, 25 bp, Mus musculus
aaatgttttaggtgcatcaagccaa

SEQ ID NO: 500174 - DNA, 25 bp, Mus musculus
aaattaaagtgtcggatcttatggc

SEQ ID NO: 500175 - DNA, 25 bp, Mus musculus
aaattaaagtgtgggatcttatggc

SEQ ID NO: 500176 - DNA, 25 bp, Mus musculus
aaattaagattcagagtgtaggcgg

SEQ ID NO: 500177 - DNA, 25 bp, Mus musculus
aaattaagattctgagtgtaggcgg

SEQ ID NO: 500178 - DNA, 25 bp, Mus musculus
aaattaaggcatctcaattagcacc

SEQ ID NO: 500179 - DNA, 25 bp, Mus musculus
aaattaaggcatgtcaattagcacc

SEQ ID NO: 500180 - DNA, 25 bp, Mus musculus
aaattacaccacactccgtatgcag

SEQ ID NO: 500181 - DNA, 25 bp, Mus musculus
aaattacaccactctccgtatgcag

SEQ ID NO: 500182 - DNA, 25 bp, Mus musculus
aaattacacttgagactcctaagcc

SEQ ID NO: 500183 - DNA, 25 bp, Mus musculus
aaattacacttgtgactcctaagcc

SEQ ID NO: 500184 - DNA, 25 bp, Mus musculus
aaattacatgccattggctttttcg

SEQ ID NO: 500185 - DNA, 25 bp, Mus musculus
aaattacatgcctttggctttttcg

SEQ ID NO: 500186 - DNA, 25 bp, Mus musculus
aaattacctcctcccgatcctggtg

SEQ ID NO: 500187 - DNA, 25 bp, Mus musculus
aaattacctcctgccgatcctggtg

SEQ ID NO: 500188 - DNA, 25 bp, Mus musculus
aaattacctggtacctggacatgcc

SEQ ID NO: 500189 - DNA, 25 bp, Mus musculus
aaattacctggttcctggacatgcc

SEQ ID NO: 500190 - DNA, 25 bp, Mus musculus
aaattactgcaaaggcaaatcggac

SEQ ID NO: 500191 - DNA, 25 bp, Mus musculus
aaattactgcaatggcaaatcggac

SEQ ID NO: 500192 - DNA, 25 bp, Mus musculus
aaattagaagccatgcttcagggtg

SEQ ID NO: 500193 - DNA, 25 bp, Mus musculus
aaattagaagccttgcttcagggtg

SEQ ID NO: 500194 - DNA, 25 bp, Mus musculus
aaattagggaagatgaggagcctcc

SEQ ID NO: 500195 - DNA, 25 bp, Mus musculus
aaattagggaagttgaggagcctcc

SEQ ID NO: 500196 - DNA, 25 bp, Mus musculus
aaattatatggaaatgacttcagcc

SEQ ID NO: 500197 - DNA, 25 bp, Mus musculus
aaattatatggatatgacttcagcc

SEQ ID NO: 500198 - DNA, 25 bp, Mus musculus
aaattatttcatcttgggctggaga

SEQ ID NO: 500199 - DNA, 25 bp, Mus musculus
aaattatttcatgttgggctggaga

SEQ ID NO: 500200 - DNA, 25 bp, Mus musculus
aaattatttgcactggagcaacaag

SEQ ID NO: 500201 - DNA, 25 bp, Mus musculus
aaattatttgcagtggagcaacaag

SEQ ID NO: 500202 - DNA, 25 bp, Mus musculus
aaattattttgtacagcctgtgacc

SEQ ID NO: 500203 - DNA, 25 bp, Mus musculus
aaattattttgttcagcctgtgacc

SEQ ID NO: 500204 - DNA, 25 bp, Mus musculus
aaattcaaagagagtatggatgcca

SEQ ID NO: 500205 - DNA, 25 bp, Mus musculus
aaattcaaagagtgtatggatgcca

SEQ ID NO: 500206 - DNA, 25 bp, Mus musculus
aaattcaagctgctgttcctgggag

SEQ ID NO: 500207 - DNA, 25 bp, Mus musculus
aaattcaagctggtgttcctgggag

SEQ ID NO: 500208 - DNA, 25 bp, Mus musculus
aaattcacagctctctttgcctcac

SEQ ID NO: 500209 - DNA, 25 bp, Mus musculus
aaattcacagctgtctttgcctcac

SEQ ID NO: 500210 - DNA, 25 bp, Mus musculus
aaattcactctccttgcccgagctt

SEQ ID NO: 500211 - DNA, 25 bp, Mus musculus
aaattcactctcgttgcccgagctt

SEQ ID NO: 500212 - DNA, 25 bp, Mus musculus
aaattcagctgtctccagggaggcc

SEQ ID NO: 500213 - DNA, 25 bp, Mus musculus
aaattcagctgtgtccagggaggcc

SEQ ID NO: 500214 - DNA, 25 bp, Mus musculus
aaattcaggaagattggagactata

SEQ ID NO: 500215 - DNA, 25 bp, Mus musculus
aaattcaggaagtttggagactata

SEQ ID NO: 500216 - DNA, 25 bp, Mus musculus
aaattcatcacccacctcttcaagt

SEQ ID NO: 500217 - DNA, 25 bp, Mus musculus
aaattcatcaccgacctcttcaagt

SEQ ID NO: 500218 - DNA, 25 bp, Mus musculus
aaattcatccgcagagattttctct

SEQ ID NO: 500219 - DNA, 25 bp, Mus musculus
aaattcatccgctgagattttctct

SEQ ID NO: 500220 - DNA, 25 bp, Mus musculus
aaattccagcttcaacattgatgga

SEQ ID NO: 500221 - DNA, 25 bp, Mus musculus
aaattccagcttgaacattgatgga

SEQ ID NO: 500222 - DNA, 25 bp, Mus musculus
aaattccagtgcaaaaggtattggc

SEQ ID NO: 500223 - DNA, 25 bp, Mus musculus
aaattccagtgctaaaggtattggc

SEQ ID NO: 500224 - DNA, 25 bp, Mus musculus
aaattccagttgcatcatctgagcg

SEQ ID NO: 500225 - DNA, 25 bp, Mus musculus
aaattccagttggatcatctgagcg

SEQ ID NO: 500226 - DNA, 25 bp, Mus musculus
aaattccatcacctcagctaaccag

SEQ ID NO: 500227 - DNA, 25 bp, Mus musculus
aaattccatcacgtcagctaaccag

SEQ ID NO: 500228 - DNA, 25 bp, Mus musculus
aaattcccagctcacggagatcaca

SEQ ID NO: 500229 - DNA, 25 bp, Mus musculus
aaattcccagctgacggagatcaca

SEQ ID NO: 500230 - DNA, 25 bp, Mus musculus
aaattcccagtaatccagcattgaa

SEQ ID NO: 500231 - DNA, 25 bp, Mus musculus
aaattcccagtattccagcattgaa

SEQ ID NO: 500232 - DNA, 25 bp, Mus musculus
aaattccccagccagtgtttctctt

SEQ ID NO: 500233 - DNA, 25 bp, Mus musculus
aaattccccagcgagtgtttctctt

SEQ ID NO: 500234 - DNA, 25 bp, Mus musculus
aaattcctaagcattctctgttccc

SEQ ID NO: 500235 - DNA, 25 bp, Mus musculus
aaattcctaagctttctctgttccc

SEQ ID NO: 500236 - DNA, 25 bp, Mus musculus
aaattcctctacagtgtcctagcag

SEQ ID NO: 500237 - DNA, 25 bp, Mus musculus
aaattcctctactgtgtcctagcag

SEQ ID NO: 500238 - DNA, 25 bp, Mus musculus
aaattcctgtctccgttgtgaggca

SEQ ID NO: 500239 - DNA, 25 bp, Mus musculus
aaattcctgtctgcgttgtgaggca

SEQ ID NO: 500240 - DNA, 25 bp, Mus musculus
aaattcgagtctacccagataaagg

SEQ ID NO: 500241 - DNA, 25 bp, Mus musculus
aaattcgagtcttcccagataaagg

SEQ ID NO: 500242 - DNA, 25 bp, Mus musculus
aaattctaacctcctgacctgccat

SEQ ID NO: 500243 - DNA, 25 bp, Mus musculus
aaattctaacctgctgacctgccat

SEQ ID NO: 500244 - DNA, 25 bp, Mus musculus
aaattctacctgagggcgtgcacct

SEQ ID NO: 500245 - DNA, 25 bp, Mus musculus
aaattctacctgtgggcgtgcacct

SEQ ID NO: 500246 - DNA, 25 bp, Mus musculus
aaattctactgcaaatataacaggc

SEQ ID NO: 500247 - DNA, 25 bp, Mus musculus
aaattctactgctaatataacaggc

SEQ ID NO: 500248 - DNA, 25 bp, Mus musculus
aaattctcatcccaggaatcagctg

SEQ ID NO: 500249 - DNA, 25 bp, Mus musculus
aaattctcatccgaggaatcagctg

SEQ ID NO: 500250 - DNA, 25 bp, Mus musculus
aaattctgcctactggccattggca

SEQ ID NO: 500251 - DNA, 25 bp, Mus musculus
aaattctgcctagtggccattggca

SEQ ID NO: 500252 - DNA, 25 bp, Mus musculus
aaattctgctgacacctggagcgtc

SEQ ID NO: 500253 - DNA, 25 bp, Mus musculus
aaattctgctgagacctggagcgtc

SEQ ID NO: 500254 - DNA, 25 bp, Mus musculus
aaattctgggcacgtattacgagac

SEQ ID NO: 500255 - DNA, 25 bp, Mus musculus
aaattctgggcaggtattacgagac

SEQ ID NO: 500256 - DNA, 25 bp, Mus musculus
aaattctggtgacccctggctcaac

SEQ ID NO: 500257 - DNA, 25 bp, Mus musculus
aaattctggtgagccctggctcaac

SEQ ID NO: 500258 - DNA, 25 bp, Mus musculus
aaattcttatgacgcctaccatctc

SEQ ID NO: 500259 - DNA, 25 bp, Mus musculus
aaattcttatgaggcctaccatctc

SEQ ID NO: 500260 - DNA, 25 bp, Mus musculus
aaattcttggccctcatgagagaag

SEQ ID NO: 500261 - DNA, 25 bp, Mus musculus
aaattcttggccgtcatgagagaag

SEQ ID NO: 500262 - DNA, 25 bp, Mus musculus
aaattctttggactcatctggagct

SEQ ID NO: 500263 - DNA, 25 bp, Mus musculus
aaattctttggagtcatctggagct

SEQ ID NO: 500264 - DNA, 25 bp, Mus musculus
aaattgaaagagctccaggtgaggt

SEQ ID NO: 500265 - DNA, 25 bp, Mus musculus
aaattgaaagaggtccaggtgaggt

SEQ ID NO: 500266 - DNA, 25 bp, Mus musculus
aaattgaaagccagggatccacaga

SEQ ID NO: 500267 - DNA, 25 bp, Mus musculus
aaattgaaagcctgggatccacaga

SEQ ID NO: 500268 - DNA, 25 bp, Mus musculus
aaattgaacccaatgatgtagaaga

SEQ ID NO: 500269 - DNA, 25 bp, Mus musculus
aaattgaacccattgatgtagaaga

SEQ ID NO: 500270 - DNA, 25 bp, Mus musculus
aaattgacaaagagctgataaaccg

SEQ ID NO: 500271 - DNA, 25 bp, Mus musculus
aaattgacaaagtgctgataaaccg

SEQ ID NO: 500272 - DNA, 25 bp, Mus musculus
aaattgactttgacccagtccagcc

SEQ ID NO: 500273 - DNA, 25 bp, Mus musculus
aaattgactttgtcccagtccagcc

SEQ ID NO: 500274 - DNA, 25 bp, Mus musculus
aaattgagatcgacgggactgagaa

SEQ ID NO: 500275 - DNA, 25 bp, Mus musculus
aaattgagatcgtcgggactgagaa

SEQ ID NO: 500276 - DNA, 25 bp, Mus musculus
aaattgagtcatcaaactgtaacca

SEQ ID NO: 500277 - DNA, 25 bp, Mus musculus
aaattgagtcatgaaactgtaacca

SEQ ID NO: 500278 - DNA, 25 bp, Mus musculus
aaattgatggcaaaccgcggtgacc

SEQ ID NO: 500279 - DNA, 25 bp, Mus musculus
aaattgatggcataccgcggtgacc

SEQ ID NO: 500280 - DNA, 25 bp, Mus musculus
aaattgatgtgaccctgccccgggt

SEQ ID NO: 500281 - DNA, 25 bp, Mus musculus
aaattgatgtgagcctgccccgggt

SEQ ID NO: 500282 - DNA, 25 bp, Mus musculus
aaattgatttcccagctcgtagtat

SEQ ID NO: 500283 - DNA, 25 bp, Mus musculus
aaattgatttccgagctcgtagtat

SEQ ID NO: 500284 - DNA, 25 bp, Mus musculus
aaattgcagggaaagtgaaggactt

SEQ ID NO: 500285 - DNA, 25 bp, Mus musculus
aaattgcagggatagtgaaggactt

SEQ ID NO: 500286 - DNA, 25 bp, Mus musculus
aaattgcatattcactgttgtacag

SEQ ID NO: 500287 - DNA, 25 bp, Mus musculus
aaattgcatattgactgttgtacag

SEQ ID NO: 500288 - DNA, 25 bp, Mus musculus
aaattgcatcgtcggacagaacgta

SEQ ID NO: 500289 - DNA, 25 bp, Mus musculus
aaattgcatcgtgggacagaacgta

SEQ ID NO: 500290 - DNA, 25 bp, Mus musculus
aaattgcccaggatattgcttccta

SEQ ID NO: 500291 - DNA, 25 bp, Mus musculus
aaattgcccaggttattgcttccta

SEQ ID NO: 500292 - DNA, 25 bp, Mus musculus
aaattgccctgacttctacccttgg

SEQ ID NO: 500293 - DNA, 25 bp, Mus musculus
aaattgccctgagttctacccttgg

SEQ ID NO: 500294 - DNA, 25 bp, Mus musculus
aaattgcggttactaaatgtggcag

SEQ ID NO: 500295 - DNA, 25 bp, Mus musculus
aaattgcggttagtaaatgtggcag

SEQ ID NO: 500296 - DNA, 25 bp, Mus musculus
aaattgctagagaaagggcgggtct

SEQ ID NO: 500297 - DNA, 25 bp, Mus musculus
aaattgctagagtaagggcgggtct

SEQ ID NO: 500298 - DNA, 25 bp, Mus musculus
aaattgctttcaacctagacgcaaa

SEQ ID NO: 500299 - DNA, 25 bp, Mus musculus
aaattgctttcatcctagacgcaaa

SEQ ID NO: 500300 - DNA, 25 bp, Mus musculus
aaattggagacgatgggcattggcc

SEQ ID NO: 500301 - DNA, 25 bp, Mus musculus
aaattggagacgttgggcattggcc

SEQ ID NO: 500302 - DNA, 25 bp, Mus musculus
aaattggagatcaccatgctgtccc

SEQ ID NO: 500303 - DNA, 25 bp, Mus musculus
aaattggagatctccatgctgtccc

SEQ ID NO: 500304 - DNA, 25 bp, Mus musculus
aaattggagctccttggaacagtgg

SEQ ID NO: 500305 - DNA, 25 bp, Mus musculus
aaattggagctcgttggaacagtgg

SEQ ID NO: 500306 - DNA, 25 bp, Mus musculus
aaattggatgaaccttcgggatgcc

SEQ ID NO: 500307 - DNA, 25 bp, Mus musculus
aaattggatgaagcttcgggatgcc

SEQ ID NO: 500308 - DNA, 25 bp, Mus musculus
aaattggccatcaagaccttacctg

SEQ ID NO: 500309 - DNA, 25 bp, Mus musculus
aaattggccatctagaccttacctg

SEQ ID NO: 500310 - DNA, 25 bp, Mus musculus
aaattggcttgtccgtgatggaacg

SEQ ID NO: 500311 - DNA, 25 bp, Mus musculus
aaattggcttgtgcgtgatggaacg

SEQ ID NO: 500312 - DNA, 25 bp, Mus musculus
aaattggtgtgtcagatccggaaaa

SEQ ID NO: 500313 - DNA, 25 bp, Mus musculus
aaattggtgtgtgagatccggaaaa

SEQ ID NO: 500314 - DNA, 25 bp, Mus musculus
aaattgtcagcaccaagcgctttgg

SEQ ID NO: 500315 - DNA, 25 bp, Mus musculus
aaattgtcagcagcaagcgctttgg

SEQ ID NO: 500316 - DNA, 25 bp, Mus musculus
aaattgtgaagacgctgaatgggat

SEQ ID NO: 500317 - DNA, 25 bp, Mus musculus
aaattgtgaagaggctgaatgggat

SEQ ID NO: 500318 - DNA, 25 bp, Mus musculus
aaattgtgccaaagcctacatacat

SEQ ID NO: 500319 - DNA, 25 bp, Mus musculus
aaattgtgccaatgcctacatacat

SEQ ID NO: 500320 - DNA, 25 bp, Mus musculus
aaattgtggctgaaaatgttcctcc

SEQ ID NO: 500321 - DNA, 25 bp, Mus musculus
aaattgtggctgtaaatgttcctcc

SEQ ID NO: 500322 - DNA, 25 bp, Mus musculus
aaattgtgtgtcaggcaaggcagtc

SEQ ID NO: 500323 - DNA, 25 bp, Mus musculus
aaattgtgtgtctggcaaggcagtc

SEQ ID NO: 500324 - DNA, 25 bp, Mus musculus
aaattgttgacgatattcctgaccg

SEQ ID NO: 500325 - DNA, 25 bp, Mus musculus
aaattgttgacgttattcctgaccg

SEQ ID NO: 500326 - DNA, 25 bp, Mus musculus
aaattgtttgaacggagtgcgctgc

SEQ ID NO: 500327 - DNA, 25 bp, Mus musculus
aaattgtttgaagggagtgcgctgc

SEQ ID NO: 500328 - DNA, 25 bp, Mus musculus
aaatttaagcttccaacaaagaatg

SEQ ID NO: 500329 - DNA, 25 bp, Mus musculus
aaatttaagcttgcaacaaagaatg

SEQ ID NO: 500330 - DNA, 25 bp, Mus musculus
aaatttatcagtacctgggagagcc

SEQ ID NO: 500331 - DNA, 25 bp, Mus musculus
aaatttatcagttcctgggagagcc

SEQ ID NO: 500332 - DNA, 25 bp, Mus musculus
aaatttcacacgaaacaagctgacg

SEQ ID NO: 500333 - DNA, 25 bp, Mus musculus
aaatttcacacgtaacaagctgacg

SEQ ID NO: 500334 - DNA, 25 bp, Mus musculus
aaatttcagctgagaggtgccaggc

SEQ ID NO: 500335 - DNA, 25 bp, Mus musculus
aaatttcagctgtgaggtgccaggc

SEQ ID NO: 500336 - DNA, 25 bp, Mus musculus
aaatttcatactctcagtggaagca

SEQ ID NO: 500337 - DNA, 25 bp, Mus musculus
aaatttcatactgtcagtggaagca

SEQ ID NO: 500338 - DNA, 25 bp, Mus musculus
aaatttccaggccaaccaatccaca

SEQ ID NO: 500339 - DNA, 25 bp, Mus musculus
aaatttccaggcgaaccaatccaca

SEQ ID NO: 500340 - DNA, 25 bp, Mus musculus
aaatttctatggcacacccaagcct

SEQ ID NO: 500341 - DNA, 25 bp, Mus musculus
aaatttctatgggacacccaagcct

SEQ ID NO: 500342 - DNA, 25 bp, Mus musculus
aaatttgatcaaacctttagtgcag

SEQ ID NO: 500343 - DNA, 25 bp, Mus musculus
aaatttgatcaatcctttagtgcag

SEQ ID NO: 500344 - DNA, 25 bp, Mus musculus
aaatttgcactaatggaatagctcc

SEQ ID NO: 500345 - DNA, 25 bp, Mus musculus
aaatttgcactattggaatagctcc

SEQ ID NO: 500346 - DNA, 25 bp, Mus musculus
aaatttgcgagtagaccagcatcga

SEQ ID NO: 500347 - DNA, 25 bp, Mus musculus
aaatttgcgagttgaccagcatcga

SEQ ID NO: 500348 - DNA, 25 bp, Mus musculus
aaatttgctagaactgtaatccctg

SEQ ID NO: 500349 - DNA, 25 bp, Mus musculus
aaatttgctagatctgtaatccctg

SEQ ID NO: 500350 - DNA, 25 bp, Mus musculus
aaatttggaatcaagagtttggcag

SEQ ID NO: 500351 - DNA, 25 bp, Mus musculus
aaatttggaatctagagtttggcag

SEQ ID NO: 500352 - DNA, 25 bp, Mus musculus
aaatttggagtcaacgtgcgctcgg

SEQ ID NO: 500353 - DNA, 25 bp, Mus musculus
aaatttggagtctacgtgcgctcgg

SEQ ID NO: 500354 - DNA, 25 bp, Mus musculus
aaatttggagttccatgaattcgtc

SEQ ID NO: 500355 - DNA, 25 bp, Mus musculus
aaatttggagttgcatgaattcgtc

SEQ ID NO: 500356 - DNA, 25 bp, Mus musculus
aaatttgttatgaaacctccacagg

SEQ ID NO: 500357 - DNA, 25 bp, Mus musculus
aaatttgttatgtaacctccacagg

SEQ ID NO: 500358 - DNA, 25 bp, Mus musculus
aaattttgcactactggcattgatg

SEQ ID NO: 500359 - DNA, 25 bp, Mus musculus
aaattttgcacttctggcattgatg

SEQ ID NO: 500360 - DNA, 25 bp, Mus musculus
aaattttgcatcatgtcaagctgga

SEQ ID NO: 500361 - DNA, 25 bp, Mus musculus
aaattttgcatcttgtcaagctgga

SEQ ID NO: 500362 - DNA, 25 bp, Mus musculus
aaattttggccccacaggcattggg

SEQ ID NO: 500363 - DNA, 25 bp, Mus musculus
aaattttggcccgacaggcattggg

SEQ ID NO: 500364 - DNA, 25 bp, Mus musculus
aaattttgtaccatctgtcccaggc

SEQ ID NO: 500365 - DNA, 25 bp, Mus musculus
aaattttgtaccttctgtcccaggc

SEQ ID NO: 500366 - DNA, 25 bp, Mus musculus
aaattttgtgccaggaaaacacact

SEQ ID NO: 500367 - DNA, 25 bp, Mus musculus
aaattttgtgcctggaaaacacact

SEQ ID NO: 500368 - DNA, 25 bp, Mus musculus
aaatttttcagcattatagaaggct

SEQ ID NO: 500369 - DNA, 25 bp, Mus musculus
aaatttttcagctttatagaaggct

SEQ ID NO: 500370 - DNA, 25 bp, Mus musculus
aacaaaaatactcggccggtggcat

SEQ ID NO: 500371 - DNA, 25 bp, Mus musculus
aacaaaaatactgggccggtggcat

SEQ ID NO: 500372 - DNA, 25 bp, Mus musculus
aacaaaaatcagatgcagagtgagc

SEQ ID NO: 500373 - DNA, 25 bp, Mus musculus
aacaaaaatcagttgcagagtgagc

SEQ ID NO: 500374 - DNA, 25 bp, Mus musculus
aacaaaacagaaactggcacgggat

SEQ ID NO: 500375 - DNA, 25 bp, Mus musculus
aacaaaacagaatctggcacgggat

SEQ ID NO: 500376 - DNA, 25 bp, Mus musculus
aacaaaagaggaaacgaatgggact

SEQ ID NO: 500377 - DNA, 25 bp, Mus musculus
aacaaaagaggatacgaatgggact

SEQ ID NO: 500378 - DNA, 25 bp, Mus musculus
aacaaaagatggacaaaaaggcata

SEQ ID NO: 500379 - DNA, 25 bp, Mus musculus
aacaaaagatggtcaaaaaggcata

SEQ ID NO: 500380 - DNA, 25 bp, Mus musculus
aacaaaataactcggaagaagctgc

SEQ ID NO: 500381 - DNA, 25 bp, Mus musculus
aacaaaataactgggaagaagctgc

SEQ ID NO: 500382 - DNA, 25 bp, Mus musculus
aacaaaatcgctctgtatagtgacg

SEQ ID NO: 500383 - DNA, 25 bp, Mus musculus
aacaaaatcgctgtgtatagtgacg

SEQ ID NO: 500384 - DNA, 25 bp, Mus musculus
aacaaaatgaacagcatgaacaagc

SEQ ID NO: 500385 - DNA, 25 bp, Mus musculus
aacaaaatgaactgcatgaacaagc

SEQ ID NO: 500386 - DNA, 25 bp, Mus musculus
aacaaaatgccactgccttccttca

SEQ ID NO: 500387 - DNA, 25 bp, Mus musculus
aacaaaatgccagtgccttccttca

SEQ ID NO: 500388 - DNA, 25 bp, Mus musculus
aacaaaatggtacatctgattgcag

SEQ ID NO: 500389 - DNA, 25 bp, Mus musculus
aacaaaatggtagatctgattgcag

SEQ ID NO: 500390 - DNA, 25 bp, Mus musculus
aacaaacacacgaagccagctgctg

SEQ ID NO: 500391 - DNA, 25 bp, Mus musculus
aacaaacacacgtagccagctgctg

SEQ ID NO: 500392 - DNA, 25 bp, Mus musculus
aacaaacacgagcacggctacgctg

SEQ ID NO: 500393 - DNA, 25 bp, Mus musculus
aacaaacacgaggacggctacgctg

SEQ ID NO: 500394 - DNA, 25 bp, Mus musculus
aacaaacaggtaagcacttgttggc

SEQ ID NO: 500395 - DNA, 25 bp, Mus musculus
aacaaacaggtacccatgggcagaa

SEQ ID NO: 500396 - DNA, 25 bp, Mus musculus
aacaaacaggtagccatgggcagaa

SEQ ID NO: 500397 - DNA, 25 bp, Mus musculus
aacaaacaggtatgcacttgttggc

SEQ ID NO: 500398 - DNA, 25 bp, Mus musculus
aacaaacagtgtcggcgtgcactga

SEQ ID NO: 500399 - DNA, 25 bp, Mus musculus
aacaaacagtgtgggcgtgcactga

SEQ ID NO: 500400 - DNA, 25 bp, Mus musculus
aacaaacatgtaagcagccttatcg

SEQ ID NO: 500401 - DNA, 25 bp, Mus musculus
aacaaacatgtatgcagccttatcg

SEQ ID NO: 500402 - DNA, 25 bp, Mus musculus
aacaaaccggatcagcgtggcttca

SEQ ID NO: 500403 - DNA, 25 bp, Mus musculus
aacaaaccggatgagcgtggcttca

SEQ ID NO: 500404 - DNA, 25 bp, Mus musculus
aacaaacggaagctggcgacagcct

SEQ ID NO: 500405 - DNA, 25 bp, Mus musculus
aacaaacggaaggtggcgacagcct

SEQ ID NO: 500406 - DNA, 25 bp, Mus musculus
aacaaactgctcatcattgagaccc

SEQ ID NO: 500407 - DNA, 25 bp, Mus musculus
aacaaactgctcttcattgagaccc

SEQ ID NO: 500408 - DNA, 25 bp, Mus musculus
aacaaagaagagaacgggaagccag

SEQ ID NO: 500409 - DNA, 25 bp, Mus musculus
aacaaagaagagtacgggaagccag

SEQ ID NO: 500410 - DNA, 25 bp, Mus musculus
aacaaagacccacagtgtgtaaaca

SEQ ID NO: 500411 - DNA, 25 bp, Mus musculus
aacaaagacccagagtgtgtaaaca

SEQ ID NO: 500412 - DNA, 25 bp, Mus musculus
aacaaagccaagagggatgcatgga

SEQ ID NO: 500413 - DNA, 25 bp, Mus musculus
aacaaagccaagtgggatgcatgga

SEQ ID NO: 500414 - DNA, 25 bp, Mus musculus
aacaaagccagtcaaagtccatctg

SEQ ID NO: 500415 - DNA, 25 bp, Mus musculus
aacaaagccagtgaaagtccatctg

SEQ ID NO: 500416 - DNA, 25 bp, Mus musculus
aacaaagcccacatggtaaccctgg

SEQ ID NO: 500417 - DNA, 25 bp, Mus musculus
aacaaagcccacttggtaaccctgg

SEQ ID NO: 500418 - DNA, 25 bp, Mus musculus
aacaaagccgccctagccggcttag

SEQ ID NO: 500419 - DNA, 25 bp, Mus musculus
aacaaagccgccgtagccggcttag

SEQ ID NO: 500420 - DNA, 25 bp, Mus musculus
aacaaaggagtgagattctgtctgc

SEQ ID NO: 500421 - DNA, 25 bp, Mus musculus
aacaaaggagtgtgattctgtctgc

SEQ ID NO: 500422 - DNA, 25 bp, Mus musculus
aacaaaggctggcagttcttactgc

SEQ ID NO: 500423 - DNA, 25 bp, Mus musculus
aacaaaggctgggagttcttactgc

SEQ ID NO: 500424 - DNA, 25 bp, Mus musculus
aacaaagggagacacgagagcgcct

SEQ ID NO: 500425 - DNA, 25 bp, Mus musculus
aacaaagggagagacgagagcgcct

SEQ ID NO: 500426 - DNA, 25 bp, Mus musculus
aacaaataaactccgaagtgactga

SEQ ID NO: 500427 - DNA, 25 bp, Mus musculus
aacaaataaactgcgaagtgactga

SEQ ID NO: 500428 - DNA, 25 bp, Mus musculus
aacaaataggtgaacaccttctcct

SEQ ID NO: 500429 - DNA, 25 bp, Mus musculus
aacaaataggtgtacaccttctcct

SEQ ID NO: 500430 - DNA, 25 bp, Mus musculus
aacaaatccggcacgggcaccatga

SEQ ID NO: 500431 - DNA, 25 bp, Mus musculus
aacaaatccggctcgggcaccatga

SEQ ID NO: 500432 - DNA, 25 bp, Mus musculus
aacaaatgccccaggaagcactgtg

SEQ ID NO: 500433 - DNA, 25 bp, Mus musculus
aacaaatgcccctggaagcactgtg

SEQ ID NO: 500434 - DNA, 25 bp, Mus musculus
aacaaattactccagcactaccaag

SEQ ID NO: 500435 - DNA, 25 bp, Mus musculus
aacaaattactcgagcactaccaag

SEQ ID NO: 500436 - DNA, 25 bp, Mus musculus
aacaacaagcttatttatgtccatg

SEQ ID NO: 500437 - DNA, 25 bp, Mus musculus
aacaacaagcttttttatgtccatg

SEQ ID NO: 500438 - DNA, 25 bp, Mus musculus
aacaacacattcaaggccagtcccg

SEQ ID NO: 500439 - DNA, 25 bp, Mus musculus
aacaacacattctaggccagtcccg

SEQ ID NO: 500440 - DNA, 25 bp, Mus musculus
aacaacacggagatctgtgctttgc

SEQ ID NO: 500441 - DNA, 25 bp, Mus musculus
aacaacacggagttctgtgctttgc

SEQ ID NO: 500442 - DNA, 25 bp, Mus musculus
aacaacacgtatcctgaaccccaat

SEQ ID NO: 500443 - DNA, 25 bp, Mus musculus
aacaacacgtatgctgaaccccaat

SEQ ID NO: 500444 - DNA, 25 bp, Mus musculus
aacaacagcaagcttaccgggatgc

SEQ ID NO: 500445 - DNA, 25 bp, Mus musculus
aacaacagcaaggttaccgggatgc

SEQ ID NO: 500446 - DNA, 25 bp, Mus musculus
aacaacagtttcatgccatcaatgg

SEQ ID NO: 500447 - DNA, 25 bp, Mus musculus
aacaacagtttcttgccatcaatgg

SEQ ID NO: 500448 - DNA, 25 bp, Mus musculus
aacaacatatacagcacatccaaag

SEQ ID NO: 500449 - DNA, 25 bp, Mus musculus
aacaacatatactgcacatccaaag

SEQ ID NO: 500450 - DNA, 25 bp, Mus musculus
aacaacatcaacagtgtcctggagt

SEQ ID NO: 500451 - DNA, 25 bp, Mus musculus
aacaacatcaactgtgtcctggagt

SEQ ID NO: 500452 - DNA, 25 bp, Mus musculus
aacaacatcctgaaggagagggctg

SEQ ID NO: 500453 - DNA, 25 bp, Mus musculus
aacaacatcctgtaggagagggctg

SEQ ID NO: 500454 - DNA, 25 bp, Mus musculus
aacaacatgaagcagttcatccgct

SEQ ID NO: 500455 - DNA, 25 bp, Mus musculus
aacaacatgaaggagttcatccgct

SEQ ID NO: 500456 - DNA, 25 bp, Mus musculus
aacaacatgattcaccgctttgatg

SEQ ID NO: 500457 - DNA, 25 bp, Mus musculus
aacaacatgattgaccgctttgatg

SEQ ID NO: 500458 - DNA, 25 bp, Mus musculus
aacaaccaaaagcaaacagtgccag

SEQ ID NO: 500459 - DNA, 25 bp, Mus musculus
aacaaccaaaaggaaacagtgccag

SEQ ID NO: 500460 - DNA, 25 bp, Mus musculus
aacaaccatagcagttgggatgttg

SEQ ID NO: 500461 - DNA, 25 bp, Mus musculus
aacaaccatagctgttgggatgttg

SEQ ID NO: 500462 - DNA, 25 bp, Mus musculus
aacaaccccacactggatgccatga

SEQ ID NO: 500463 - DNA, 25 bp, Mus musculus
aacaaccccacagtggatgccatga

SEQ ID NO: 500464 - DNA, 25 bp, Mus musculus
aacaacccgataccctggtgcctat

SEQ ID NO: 500465 - DNA, 25 bp, Mus musculus
aacaacccgatagcctggtgcctat

SEQ ID NO: 500466 - DNA, 25 bp, Mus musculus
aacaaccctggcacttatcgctgtg

SEQ ID NO: 500467 - DNA, 25 bp, Mus musculus
aacaaccctggctcttatcgctgtg

SEQ ID NO: 500468 - DNA, 25 bp, Mus musculus
aacaacccttcgctgacctgattgg

SEQ ID NO: 500469 - DNA, 25 bp, Mus musculus
aacaacccttcggtgacctgattgg

SEQ ID NO: 500470 - DNA, 25 bp, Mus musculus
aacaaccggattcatctttccagag

SEQ ID NO: 500471 - DNA, 25 bp, Mus musculus
aacaaccggattgatctttccagag

SEQ ID NO: 500472 - DNA, 25 bp, Mus musculus
aacaaccgtccgcatccggtatggc

SEQ ID NO: 500473 - DNA, 25 bp, Mus musculus
aacaaccgtccggatccggtatggc

SEQ ID NO: 500474 - DNA, 25 bp, Mus musculus
aacaacctgagccacaccgtcaagg

SEQ ID NO: 500475 - DNA, 25 bp, Mus musculus
aacaacctgagcgacaccgtcaagg

SEQ ID NO: 500476 - DNA, 25 bp, Mus musculus
aacaacctgttgaaatttaatcctg

SEQ ID NO: 500477 - DNA, 25 bp, Mus musculus
aacaacctgttgtaatttaatcctg

SEQ ID NO: 500478 - DNA, 25 bp, Mus musculus
aacaacgaggagaggactgtagaca

SEQ ID NO: 500479 - DNA, 25 bp, Mus musculus
aacaacgaggagtggactgtagaca

SEQ ID NO: 500480 - DNA, 25 bp, Mus musculus
aacaacggccttcctgtgcacattt

SEQ ID NO: 500481 - DNA, 25 bp, Mus musculus
aacaacggccttgctgtgcacattt

SEQ ID NO: 500482 - DNA, 25 bp, Mus musculus
aacaacgggaccaatggcaagatct

SEQ ID NO: 500483 - DNA, 25 bp, Mus musculus
aacaacgggacctatggcaagatct

SEQ ID NO: 500484 - DNA, 25 bp, Mus musculus
aacaacgtgcttccggtctttgaca

SEQ ID NO: 500485 - DNA, 25 bp, Mus musculus
aacaacgtgcttgcggtctttgaca

SEQ ID NO: 500486 - DNA, 25 bp, Mus musculus
aacaacgtgggcatgtcatacgagt

SEQ ID NO: 500487 - DNA, 25 bp, Mus musculus
aacaacgtgggcttgtcatacgagt

SEQ ID NO: 500488 - DNA, 25 bp, Mus musculus
aacaacgttactcagatacagggca

SEQ ID NO: 500489 - DNA, 25 bp, Mus musculus
aacaacgttactgagatacagggca

SEQ ID NO: 500490 - DNA, 25 bp, Mus musculus
aacaactaatgcctcagactttttc

SEQ ID NO: 500491 - DNA, 25 bp, Mus musculus
aacaactaatgcgtcagactttttc

SEQ ID NO: 500492 - DNA, 25 bp, Mus musculus
aacaactatgtgaaagggacccagc

SEQ ID NO: 500493 - DNA, 25 bp, Mus musculus
aacaactatgtgtaagggacccagc

SEQ ID NO: 500494 - DNA, 25 bp, Mus musculus
aacaactattggctactgctacacc

SEQ ID NO: 500495 - DNA, 25 bp, Mus musculus
aacaactattgggtactgctacacc

SEQ ID NO: 500496 - DNA, 25 bp, Mus musculus
aacaactccttccactttctgcggg

SEQ ID NO: 500497 - DNA, 25 bp, Mus musculus
aacaactccttcgactttctgcggg

SEQ ID NO: 500498 - DNA, 25 bp, Mus musculus
aacaactctacaaagcatcgcgcag

SEQ ID NO: 500499 - DNA, 25 bp, Mus musculus
aacaactctacatagcatcgcgcag

SEQ ID NO: 500500 - DNA, 25 bp, Mus musculus
aacaactggcatcgtagaaacccac

SEQ ID NO: 500501 - DNA, 25 bp, Mus musculus
aacaactggcatggtagaaacccac

SEQ ID NO: 500502 - DNA, 25 bp, Mus musculus
aacaactgttacaacgtggtggtca

SEQ ID NO: 500503 - DNA, 25 bp, Mus musculus
aacaactgttactacgtggtggtca

SEQ ID NO: 500504 - DNA, 25 bp, Mus musculus
aacaacttctaacagacagctttca

SEQ ID NO: 500505 - DNA, 25 bp, Mus musculus
aacaacttctaagagacagctttca

SEQ ID NO: 500506 - DNA, 25 bp, Mus musculus
aacaacttgaagacactggaggctc

SEQ ID NO: 500507 - DNA, 25 bp, Mus musculus
aacaacttgaagtcactggaggctc

SEQ ID NO: 500508 - DNA, 25 bp, Mus musculus
aacaagaaattaacagtgcagaaac

SEQ ID NO: 500509 - DNA, 25 bp, Mus musculus
aacaagaaattatcagtgcagaaac

SEQ ID NO: 500510 - DNA, 25 bp, Mus musculus
aacaagaacccaagcagcgagcgct

SEQ ID NO: 500511 - DNA, 25 bp, Mus musculus
aacaagaacccatgcagcgagcgct

SEQ ID NO: 500512 - DNA, 25 bp, Mus musculus
aacaagaactacaattgtggaatga

SEQ ID NO: 500513 - DNA, 25 bp, Mus musculus
aacaagaactactattgtggaatga

SEQ ID NO: 500514 - DNA, 25 bp, Mus musculus
aacaagaagccaccctgggttcctg

SEQ ID NO: 500515 - DNA, 25 bp, Mus musculus
aacaagaagccacttacagagccat

SEQ ID NO: 500516 - DNA, 25 bp, Mus musculus
aacaagaagccagcctgggttcctg

SEQ ID NO: 500517 - DNA, 25 bp, Mus musculus
aacaagaagccagttacagagccat

SEQ ID NO: 500518 - DNA, 25 bp, Mus musculus
aacaagaaggaacgcgaagtctgtg

SEQ ID NO: 500519 - DNA, 25 bp, Mus musculus
aacaagaaggaaggcgaagtctgtg

SEQ ID NO: 500520 - DNA, 25 bp, Mus musculus
aacaagaaggacatggatgccgacc

SEQ ID NO: 500521 - DNA, 25 bp, Mus musculus
aacaagaaggacttggatgccgacc

SEQ ID NO: 500522 - DNA, 25 bp, Mus musculus
aacaagaagtcgcacgtccctgcca

SEQ ID NO: 500523 - DNA, 25 bp, Mus musculus
aacaagaagtcggacgtccctgcca

SEQ ID NO: 500524 - DNA, 25 bp, Mus musculus
aacaagaagtgtacagctgtaaaac

SEQ ID NO: 500525 - DNA, 25 bp, Mus musculus
aacaagaagtgttcagctgtaaaac

SEQ ID NO: 500526 - DNA, 25 bp, Mus musculus
aacaagaatgccctagagtctgtgc

SEQ ID NO: 500527 - DNA, 25 bp, Mus musculus
aacaagaatgccgtagagtctgtgc

SEQ ID NO: 500528 - DNA, 25 bp, Mus musculus
aacaagaatgtaagaggcccaccct

SEQ ID NO: 500529 - DNA, 25 bp, Mus musculus
aacaagaatgtatgaggcccaccct

SEQ ID NO: 500530 - DNA, 25 bp, Mus musculus
aacaagacatgtcccgacgatatgg

SEQ ID NO: 500531 - DNA, 25 bp, Mus musculus
aacaagacatgtgccgacgatatgg

SEQ ID NO: 500532 - DNA, 25 bp, Mus musculus
aacaagaccatgagccaagctcagg

SEQ ID NO: 500533 - DNA, 25 bp, Mus musculus
aacaagaccatgtgccaagctcagg

SEQ ID NO: 500534 - DNA, 25 bp, Mus musculus
aacaagacgtccagagctagaagct

SEQ ID NO: 500535 - DNA, 25 bp, Mus musculus
aacaagacgtcctgagctagaagct

SEQ ID NO: 500536 - DNA, 25 bp, Mus musculus
aacaagactctacgtcctgctctgc

SEQ ID NO: 500537 - DNA, 25 bp, Mus musculus
aacaagactctaggtcctgctctgc

SEQ ID NO: 500538 - DNA, 25 bp, Mus musculus
aacaagagaatactgggctgcatct

SEQ ID NO: 500539 - DNA, 25 bp, Mus musculus
aacaagagaatagtgggctgcatct

SEQ ID NO: 500540 - DNA, 25 bp, Mus musculus
aacaagagctcaacacattaaagca

SEQ ID NO: 500541 - DNA, 25 bp, Mus musculus
aacaagagctcatcacattaaagca

SEQ ID NO: 500542 - DNA, 25 bp, Mus musculus
aacaagaggcccagtttgagaagct

SEQ ID NO: 500543 - DNA, 25 bp, Mus musculus
aacaagaggccctgtttgagaagct

SEQ ID NO: 500544 - DNA, 25 bp, Mus musculus
aacaagagtgacctggtgcgctctc

SEQ ID NO: 500545 - DNA, 25 bp, Mus musculus
aacaagagtgacgtggtgcgctctc

SEQ ID NO: 500546 - DNA, 25 bp, Mus musculus
aacaagagtggacaactccttgcga

SEQ ID NO: 500547 - DNA, 25 bp, Mus musculus
aacaagagtggagaactccttgcga

SEQ ID NO: 500548 - DNA, 25 bp, Mus musculus
aacaagatccggcagaagtgccggc

SEQ ID NO: 500549 - DNA, 25 bp, Mus musculus
aacaagatccgggagaagtgccggc

SEQ ID NO: 500550 - DNA, 25 bp, Mus musculus
aacaagatgccaattgaacttaagg

SEQ ID NO: 500551 - DNA, 25 bp, Mus musculus
aacaagatgccatttgaacttaagg

SEQ ID NO: 500552 - DNA, 25 bp, Mus musculus
aacaagatgccgacgggtttccagc

SEQ ID NO: 500553 - DNA, 25 bp, Mus musculus
aacaagatgccgtcgggtttccagc

SEQ ID NO: 500554 - DNA, 25 bp, Mus musculus
aacaagattctgacacagcgcctct

SEQ ID NO: 500555 - DNA, 25 bp, Mus musculus
aacaagattctgtcacagcgcctct

SEQ ID NO: 500556 - DNA, 25 bp, Mus musculus
aacaagattgccatctccgggtgga

SEQ ID NO: 500557 - DNA, 25 bp, Mus musculus
aacaagattgccttctccgggtgga

SEQ ID NO: 500558 - DNA, 25 bp, Mus musculus
aacaagcaaggcaacaaatgcaggc

SEQ ID NO: 500559 - DNA, 25 bp, Mus musculus
aacaagcaaggctacaaatgcaggc

SEQ ID NO: 500560 - DNA, 25 bp, Mus musculus
aacaagcagctacccgtgaaaggca

SEQ ID NO: 500561 - DNA, 25 bp, Mus musculus
aacaagcagctagccgtgaaaggca

SEQ ID NO: 500562 - DNA, 25 bp, Mus musculus
aacaagcattcgcagcagccagagc

SEQ ID NO: 500563 - DNA, 25 bp, Mus musculus
aacaagcattcggagcagccagagc

SEQ ID NO: 500564 - DNA, 25 bp, Mus musculus
aacaagccatccagtgtctcaatgg

SEQ ID NO: 500565 - DNA, 25 bp, Mus musculus
aacaagccatcctgtgtctcaatgg

SEQ ID NO: 500566 - DNA, 25 bp, Mus musculus
aacaagccattaccatcggcgggca

SEQ ID NO: 500567 - DNA, 25 bp, Mus musculus
aacaagccattagcatcggcgggca

SEQ ID NO: 500568 - DNA, 25 bp, Mus musculus
aacaagccccgcacgcgtgatttcg

SEQ ID NO: 500569 - DNA, 25 bp, Mus musculus
aacaagccccgctcgcgtgatttcg

SEQ ID NO: 500570 - DNA, 25 bp, Mus musculus
aacaagcccgtgagtgtcaaggtgt

SEQ ID NO: 500571 - DNA, 25 bp, Mus musculus
aacaagcccgtgtgtgtcaaggtgt

SEQ ID NO: 500572 - DNA, 25 bp, Mus musculus
aacaagccggccattgtagaagctg

SEQ ID NO: 500573 - DNA, 25 bp, Mus musculus
aacaagccggcctttgtagaagctg

SEQ ID NO: 500574 - DNA, 25 bp, Mus musculus
aacaagcctggcactttcttctgcc

SEQ ID NO: 500575 - DNA, 25 bp, Mus musculus
aacaagcctggctctttcttctgcc

SEQ ID NO: 500576 - DNA, 25 bp, Mus musculus
aacaagcctggtcccactgtcagac

SEQ ID NO: 500577 - DNA, 25 bp, Mus musculus
aacaagcctggtgccactgtcagac

SEQ ID NO: 500578 - DNA, 25 bp, Mus musculus
aacaagccttcaccgatgtggccac

SEQ ID NO: 500579 - DNA, 25 bp, Mus musculus
aacaagccttcagcgatgtggccac

SEQ ID NO: 500580 - DNA, 25 bp, Mus musculus
aacaagcgaatgagcgccttccact

SEQ ID NO: 500581 - DNA, 25 bp, Mus musculus
aacaagcgaatgtgcgccttccact

SEQ ID NO: 500582 - DNA, 25 bp, Mus musculus
aacaagcggaatattttctctctca

SEQ ID NO: 500583 - DNA, 25 bp, Mus musculus
aacaagcggaattttttctctctca

SEQ ID NO: 500584 - DNA, 25 bp, Mus musculus
aacaagcggatccactattcactgt

SEQ ID NO: 500585 - DNA, 25 bp, Mus musculus
aacaagcggatcgactattcactgt

SEQ ID NO: 500586 - DNA, 25 bp, Mus musculus
aacaagctgaagcatcttaccatcg

SEQ ID NO: 500587 - DNA, 25 bp, Mus musculus
aacaagctgaaggatcttaccatcg

SEQ ID NO: 500588 - DNA, 25 bp, Mus musculus
aacaagctgagtcgaggcggcgggc

SEQ ID NO: 500589 - DNA, 25 bp, Mus musculus
aacaagctgagtggaggcggcgggc

SEQ ID NO: 500590 - DNA, 25 bp, Mus musculus
aacaagctgatgcatgctctgaagc

SEQ ID NO: 500591 - DNA, 25 bp, Mus musculus
aacaagctgatggatgctctgaagc

SEQ ID NO: 500592 - DNA, 25 bp, Mus musculus
aacaagctggccaactataccaacc

SEQ ID NO: 500593 - DNA, 25 bp, Mus musculus
aacaagctggcctactataccaacc

SEQ ID NO: 500594 - DNA, 25 bp, Mus musculus
aacaagctgttgcaggcactgggca

SEQ ID NO: 500595 - DNA, 25 bp, Mus musculus
aacaagctgttggaggcactgggca

SEQ ID NO: 500596 - DNA, 25 bp, Mus musculus
aacaaggaagtgctgtatgagctca

SEQ ID NO: 500597 - DNA, 25 bp, Mus musculus
aacaaggaagtggtgtatgagctca

SEQ ID NO: 500598 - DNA, 25 bp, Mus musculus
aacaaggacaacactggctggagaa

SEQ ID NO: 500599 - DNA, 25 bp, Mus musculus
aacaaggacaactctggctggagaa

SEQ ID NO: 500600 - DNA, 25 bp, Mus musculus
aacaaggacctgaattcacaccttc

SEQ ID NO: 500601 - DNA, 25 bp, Mus musculus
aacaaggacctgctggccaccttgc

SEQ ID NO: 500602 - DNA, 25 bp, Mus musculus
aacaaggacctggtggccaccttgc

SEQ ID NO: 500603 - DNA, 25 bp, Mus musculus
aacaaggacctgtattcacaccttc

SEQ ID NO: 500604 - DNA, 25 bp, Mus musculus
aacaaggatgacaagaatgggccaa

SEQ ID NO: 500605 - DNA, 25 bp, Mus musculus
aacaaggatgactagaatgggccaa

SEQ ID NO: 500606 - DNA, 25 bp, Mus musculus
aacaaggatggcaggccgactccac

SEQ ID NO: 500607 - DNA, 25 bp, Mus musculus
aacaaggatggctggccgactccac

SEQ ID NO: 500608 - DNA, 25 bp, Mus musculus
aacaaggcaaccagccaagacacac

SEQ ID NO: 500609 - DNA, 25 bp, Mus musculus
aacaaggcaacctgccaagacacac

SEQ ID NO: 500610 - DNA, 25 bp, Mus musculus
aacaaggcacccacagtgggttttg

SEQ ID NO: 500611 - DNA, 25 bp, Mus musculus
aacaaggcaccctcagtgggttttg

SEQ ID NO: 500612 - DNA, 25 bp, Mus musculus
aacaaggctctcatctgacggagga

SEQ ID NO: 500613 - DNA, 25 bp, Mus musculus
aacaaggctctcttctgacggagga

SEQ ID NO: 500614 - DNA, 25 bp, Mus musculus
aacaaggctgcccacgctgtcaaca

SEQ ID NO: 500615 - DNA, 25 bp, Mus musculus
aacaaggctgccgacgctgtcaaca

SEQ ID NO: 500616 - DNA, 25 bp, Mus musculus
aacaaggctgttccagagtgtggac

SEQ ID NO: 500617 - DNA, 25 bp, Mus musculus
aacaaggctgttgcagagtgtggac

SEQ ID NO: 500618 - DNA, 25 bp, Mus musculus
aacaagggcgacaatttctggtggc

SEQ ID NO: 500619 - DNA, 25 bp, Mus musculus
aacaagggcgactatttctggtggc

SEQ ID NO: 500620 - DNA, 25 bp, Mus musculus
aacaaggtcttgagaagttgacaga

SEQ ID NO: 500621 - DNA, 25 bp, Mus musculus
aacaaggtcttgtgaagttgacaga

SEQ ID NO: 500622 - DNA, 25 bp, Mus musculus
aacaaggtgtttccagttcagcagg

SEQ ID NO: 500623 - DNA, 25 bp, Mus musculus
aacaaggtgtttgcagttcagcagg

SEQ ID NO: 500624 - DNA, 25 bp, Mus musculus
aacaagtacctgacagccgaggcgt

SEQ ID NO: 500625 - DNA, 25 bp, Mus musculus
aacaagtacctgtcagccgaggcgt

SEQ ID NO: 500626 - DNA, 25 bp, Mus musculus
aacaagtcagagatggaacgtcttc

SEQ ID NO: 500627 - DNA, 25 bp, Mus musculus
aacaagtcagagttggaacgtcttc

SEQ ID NO: 500628 - DNA, 25 bp, Mus musculus
aacaagtctggaacgatcccttcgg

SEQ ID NO: 500629 - DNA, 25 bp, Mus musculus
aacaagtctggatcgatcccttcgg

SEQ ID NO: 500630 - DNA, 25 bp, Mus musculus
aacaagtgcacaaaggaagctcccg

SEQ ID NO: 500631 - DNA, 25 bp, Mus musculus
aacaagtgcacataggaagctcccg

SEQ ID NO: 500632 - DNA, 25 bp, Mus musculus
aacaagtggtctcggccagtagcca

SEQ ID NO: 500633 - DNA, 25 bp, Mus musculus
aacaagtggtctgggccagtagcca

SEQ ID NO: 500634 - DNA, 25 bp, Mus musculus
aacaagttcatacctgacatctaca

SEQ ID NO: 500635 - DNA, 25 bp, Mus musculus
aacaagttcatagctgacatctaca

SEQ ID NO: 500636 - DNA, 25 bp, Mus musculus
aacaagttctcacccaatcatcggg

SEQ ID NO: 500637 - DNA, 25 bp, Mus musculus
aacaagttctcagccaatcatcggg

SEQ ID NO: 500638 - DNA, 25 bp, Mus musculus
aacaagttgaagaagacacccctag

SEQ ID NO: 500639 - DNA, 25 bp, Mus musculus
aacaagttgaagtagacacccctag

SEQ ID NO: 500640 - DNA, 25 bp, Mus musculus
aacaagttgacacatacggacctca

SEQ ID NO: 500641 - DNA, 25 bp, Mus musculus
aacaagttgacagatacggacctca

SEQ ID NO: 500642 - DNA, 25 bp, Mus musculus
aacaagttgatgatcgaaaggaatg

SEQ ID NO: 500643 - DNA, 25 bp, Mus musculus
aacaagttgatgttcgaaaggaatg

SEQ ID NO: 500644 - DNA, 25 bp, Mus musculus
aacaagttgggcagtcgctcctatg

SEQ ID NO: 500645 - DNA, 25 bp, Mus musculus
aacaagttgggctgtcgctcctatg

SEQ ID NO: 500646 - DNA, 25 bp, Mus musculus
aacaataatgtgacttccagtgagc

SEQ ID NO: 500647 - DNA, 25 bp, Mus musculus
aacaataatgtgtcttccagtgagc

SEQ ID NO: 500648 - DNA, 25 bp, Mus musculus
aacaatacaggtacgactcgcaccg

SEQ ID NO: 500649 - DNA, 25 bp, Mus musculus
aacaatacaggttcgactcgcaccg

SEQ ID NO: 500650 - DNA, 25 bp, Mus musculus
aacaatactgatacatgtttgccag

SEQ ID NO: 500651 - DNA, 25 bp, Mus musculus
aacaatactgattcatgtttgccag

SEQ ID NO: 500652 - DNA, 25 bp, Mus musculus
aacaatagccgccaagcaagtcctt

SEQ ID NO: 500653 - DNA, 25 bp, Mus musculus
aacaatagccgcgaagcaagtcctt

SEQ ID NO: 500654 - DNA, 25 bp, Mus musculus
aacaatagcgccatcgacagcggga

SEQ ID NO: 500655 - DNA, 25 bp, Mus musculus
aacaatagcgccttcgacagcggga

SEQ ID NO: 500656 - DNA, 25 bp, Mus musculus
aacaatataaacagcctgtggccag

SEQ ID NO: 500657 - DNA, 25 bp, Mus musculus
aacaatataaactgcctgtggccag

SEQ ID NO: 500658 - DNA, 25 bp, Mus musculus
aacaatatttggagcagtaacgtac

SEQ ID NO: 500659 - DNA, 25 bp, Mus musculus
aacaatatttggtgcagtaacgtac

SEQ ID NO: 500660 - DNA, 25 bp, Mus musculus
aacaatcaggctcgagttgcaagga

SEQ ID NO: 500661 - DNA, 25 bp, Mus musculus
aacaatcaggctggagttgcaagga

SEQ ID NO: 500662 - DNA, 25 bp, Mus musculus
aacaatcagtaacctccagctaggg

SEQ ID NO: 500663 - DNA, 25 bp, Mus musculus
aacaatcagtaagctccagctaggg

SEQ ID NO: 500664 - DNA, 25 bp, Mus musculus
aacaatccctccagtaagtgctaca

SEQ ID NO: 500665 - DNA, 25 bp, Mus musculus
aacaatccctcctgtaagtgctaca

SEQ ID NO: 500666 - DNA, 25 bp, Mus musculus
aacaatcgagagcacatcacccaca

SEQ ID NO: 500667 - DNA, 25 bp, Mus musculus
aacaatcgagaggacatcacccaca

SEQ ID NO: 500668 - DNA, 25 bp, Mus musculus
aacaatcggaaccacgggctggact

SEQ ID NO: 500669 - DNA, 25 bp, Mus musculus
aacaatcggaacgacgggctggact

SEQ ID NO: 500670 - DNA, 25 bp, Mus musculus
aacaatgaataccaccccaggcaca

SEQ ID NO: 500671 - DNA, 25 bp, Mus musculus
aacaatgaatacgaccccaggcaca

SEQ ID NO: 500672 - DNA, 25 bp, Mus musculus
aacaatgaccttatgcagattcccc

SEQ ID NO: 500673 - DNA, 25 bp, Mus musculus
aacaatgaccttttgcagattcccc

SEQ ID NO: 500674 - DNA, 25 bp, Mus musculus
aacaatgagatgctctcccctgaag

SEQ ID NO: 500675 - DNA, 25 bp, Mus musculus
aacaatgagatggtctcccctgaag

SEQ ID NO: 500676 - DNA, 25 bp, Mus musculus
aacaatgaggtcatcttcatggcct

SEQ ID NO: 500677 - DNA, 25 bp, Mus musculus
aacaatgaggtcttcttcatggcct

SEQ ID NO: 500678 - DNA, 25 bp, Mus musculus
aacaatgagtggcacgacgccgtca

SEQ ID NO: 500679 - DNA, 25 bp, Mus musculus
aacaatgagtgggacgacgccgtca

SEQ ID NO: 500680 - DNA, 25 bp, Mus musculus
aacaatgccgctctggtccatggaa

SEQ ID NO: 500681 - DNA, 25 bp, Mus musculus
aacaatgccgctgtggtccatggaa

SEQ ID NO: 500682 - DNA, 25 bp, Mus musculus
aacaatgccttccaccaataccgag

SEQ ID NO: 500683 - DNA, 25 bp, Mus musculus
aacaatgccttcgaccaataccgag

SEQ ID NO: 500684 - DNA, 25 bp, Mus musculus
aacaatggagcacgctactttttgg

SEQ ID NO: 500685 - DNA, 25 bp, Mus musculus
aacaatggagcaggctactttttgg

SEQ ID NO: 500686 - DNA, 25 bp, Mus musculus
aacaatgtacttcgaggatagaacc

SEQ ID NO: 500687 - DNA, 25 bp, Mus musculus
aacaatgtacttggaggatagaacc

SEQ ID NO: 500688 - DNA, 25 bp, Mus musculus
aacaatgtgcctcgcactgacttca

SEQ ID NO: 500689 - DNA, 25 bp, Mus musculus
aacaatgtgcctggcactgacttca

SEQ ID NO: 500690 - DNA, 25 bp, Mus musculus
aacaattaggcgagttcattttggc

SEQ ID NO: 500691 - DNA, 25 bp, Mus musculus
aacaattaggcgtgttcattttggc

SEQ ID NO: 500692 - DNA, 25 bp, Mus musculus
aacaattgccagaccagggaagccc

SEQ ID NO: 500693 - DNA, 25 bp, Mus musculus
aacaattgccagtccagggaagccc

SEQ ID NO: 500694 - DNA, 25 bp, Mus musculus
aacaatttaaagacagcaggctaaa

SEQ ID NO: 500695 - DNA, 25 bp, Mus musculus
aacaatttaaagtcagcaggctaaa

SEQ ID NO: 500696 - DNA, 25 bp, Mus musculus
aacaatttgaaacggtcacagagcc

SEQ ID NO: 500697 - DNA, 25 bp, Mus musculus
aacaatttgaaagggtcacagagcc

SEQ ID NO: 500698 - DNA, 25 bp, Mus musculus
aacacaaacccgacggaggtgctag

SEQ ID NO: 500699 - DNA, 25 bp, Mus musculus
aacacaaacccgtcggaggtgctag

SEQ ID NO: 500700 - DNA, 25 bp, Mus musculus
aacacaaactggatggcaaattgat

SEQ ID NO: 500701 - DNA, 25 bp, Mus musculus
aacacaaactggttggcaaattgat

SEQ ID NO: 500702 - DNA, 25 bp, Mus musculus
aacacaaattctctggagaatcttc

SEQ ID NO: 500703 - DNA, 25 bp, Mus musculus
aacacaaattctgtggagaatcttc

SEQ ID NO: 500704 - DNA, 25 bp, Mus musculus
aacacaagaaggataagaaacacaa

SEQ ID NO: 500705 - DNA, 25 bp, Mus musculus
aacacaagaaggttaagaaacacaa

SEQ ID NO: 500706 - DNA, 25 bp, Mus musculus
aacacaagaattccccagcctggtg

SEQ ID NO: 500707 - DNA, 25 bp, Mus musculus
aacacaagaattgcccagcctggtg

SEQ ID NO: 500708 - DNA, 25 bp, Mus musculus
aacacaagccctacacatacagcga

SEQ ID NO: 500709 - DNA, 25 bp, Mus musculus
aacacaagccctactttcacagttg

SEQ ID NO: 500710 - DNA, 25 bp, Mus musculus
aacacaagcccttcacatacagcga

SEQ ID NO: 500711 - DNA, 25 bp, Mus musculus
aacacaagcccttctttcacagttg

SEQ ID NO: 500712 - DNA, 25 bp, Mus musculus
aacacaagccgtcgtcttggcccag

SEQ ID NO: 500713 - DNA, 25 bp, Mus musculus
aacacaagccgtggtcttggcccag

SEQ ID NO: 500714 - DNA, 25 bp, Mus musculus
aacacaagctcaccagggaccagtg

SEQ ID NO: 500715 - DNA, 25 bp, Mus musculus
aacacaagctcagcagggaccagtg

SEQ ID NO: 500716 - DNA, 25 bp, Mus musculus
aacacaaggcgcatctcactcacga

SEQ ID NO: 500717 - DNA, 25 bp, Mus musculus
aacacaaggcgcttctcactcacga

SEQ ID NO: 500718 - DNA, 25 bp, Mus musculus
aacacaattactagatagctcaggg

SEQ ID NO: 500719 - DNA, 25 bp, Mus musculus
aacacaattacttgatagctcaggg

SEQ ID NO: 500720 - DNA, 25 bp, Mus musculus
aacacacaactaagaccgagaccgg

SEQ ID NO: 500721 - DNA, 25 bp, Mus musculus
aacacacaactatgaccgagaccgg

SEQ ID NO: 500722 - DNA, 25 bp, Mus musculus
aacacacacggccgctacaactgtg

SEQ ID NO: 500723 - DNA, 25 bp, Mus musculus
aacacacacggcggctacaactgtg

SEQ ID NO: 500724 - DNA, 25 bp, Mus musculus
aacacacacgggaaaggacttcctg

SEQ ID NO: 500725 - DNA, 25 bp, Mus musculus
aacacacacgggtaaggacttcctg

SEQ ID NO: 500726 - DNA, 25 bp, Mus musculus
aacacacagggcctagtgccaggca

SEQ ID NO: 500727 - DNA, 25 bp, Mus musculus
aacacacagggcgtagtgccaggca

SEQ ID NO: 500728 - DNA, 25 bp, Mus musculus
aacacacatgcgaagagtcccaggg

SEQ ID NO: 500729 - DNA, 25 bp, Mus musculus
aacacacatgcgtagagtcccaggg

SEQ ID NO: 500730 - DNA, 25 bp, Mus musculus
aacacaccatgaacgaaggcgagcc

SEQ ID NO: 500731 - DNA, 25 bp, Mus musculus
aacacaccatgatcgaaggcgagcc

SEQ ID NO: 500732 - DNA, 25 bp, Mus musculus
aacacacctgtaagtgtgtgggacc

SEQ ID NO: 500733 - DNA, 25 bp, Mus musculus
aacacacctgtatgtgtgtgggacc

SEQ ID NO: 500734 - DNA, 25 bp, Mus musculus
aacacactggctagtctcaacctgg

SEQ ID NO: 500735 - DNA, 25 bp, Mus musculus
aacacactggcttgtctcaacctgg

SEQ ID NO: 500736 - DNA, 25 bp, Mus musculus
aacacagaaggcaccttccattgcc

SEQ ID NO: 500737 - DNA, 25 bp, Mus musculus
aacacagaaggctccttccattgcc

SEQ ID NO: 500738 - DNA, 25 bp, Mus musculus
aacacagaaggtacctaccaatgcc

SEQ ID NO: 500739 - DNA, 25 bp, Mus musculus
aacacagaaggttcctaccaatgcc

SEQ ID NO: 500740 - DNA, 25 bp, Mus musculus
aacacagaccatctgaccgtggtgc

SEQ ID NO: 500741 - DNA, 25 bp, Mus musculus
aacacagaccatgtgaccgtggtgc

SEQ ID NO: 500742 - DNA, 25 bp, Mus musculus
aacacagaccccatcaagtttgaga

SEQ ID NO: 500743 - DNA, 25 bp, Mus musculus
aacacagaccccttcaagtttgaga

SEQ ID NO: 500744 - DNA, 25 bp, Mus musculus
aacacagagagaaccgtctggcagt

SEQ ID NO: 500745 - DNA, 25 bp, Mus musculus
aacacagagagatccgtctggcagt

SEQ ID NO: 500746 - DNA, 25 bp, Mus musculus
aacacagagcttcgagaaactacag

SEQ ID NO: 500747 - DNA, 25 bp, Mus musculus
aacacagagcttggagaaactacag

SEQ ID NO: 500748 - DNA, 25 bp, Mus musculus
aacacagagggcaccttcagctgtc

SEQ ID NO: 500749 - DNA, 25 bp, Mus musculus
aacacagagggctccttcagctgtc

SEQ ID NO: 500750 - DNA, 25 bp, Mus musculus
aacacagcagtcaccccaggatgag

SEQ ID NO: 500751 - DNA, 25 bp, Mus musculus
aacacagcagtctccccaggatgag

SEQ ID NO: 500752 - DNA, 25 bp, Mus musculus
aacacagcatttcaggacttcgccc

SEQ ID NO: 500753 - DNA, 25 bp, Mus musculus
aacacagcatttgaggacttcgccc

SEQ ID NO: 500754 - DNA, 25 bp, Mus musculus
aacacagctggaccggacagaagcc

SEQ ID NO: 500755 - DNA, 25 bp, Mus musculus
aacacagctggagcggacagaagcc

SEQ ID NO: 500756 - DNA, 25 bp, Mus musculus
aacacagctggcagctttcactgtg

SEQ ID NO: 500757 - DNA, 25 bp, Mus musculus
aacacagctggctgctttcactgtg

SEQ ID NO: 500758 - DNA, 25 bp, Mus musculus
aacacaggccagcagtgggacttcc

SEQ ID NO: 500759 - DNA, 25 bp, Mus musculus
aacacaggccaggagtgggacttcc

SEQ ID NO: 500760 - DNA, 25 bp, Mus musculus
aacacaggctgtaggatcgcggatc

SEQ ID NO: 500761 - DNA, 25 bp, Mus musculus
aacacaggctgttggatcgcggatc

SEQ ID NO: 500762 - DNA, 25 bp, Mus musculus
aacacagggaagcaggtgctcttca

SEQ ID NO: 500763 - DNA, 25 bp, Mus musculus
aacacagggaaggaggtgctcttca

SEQ ID NO: 500764 - DNA, 25 bp, Mus musculus
aacacaggtacacaacgagtggatg

SEQ ID NO: 500765 - DNA, 25 bp, Mus musculus
aacacaggtacagaacgagtggatg

SEQ ID NO: 500766 - DNA, 25 bp, Mus musculus
aacacagtctgtatgattcatgtaa

SEQ ID NO: 500767 - DNA, 25 bp, Mus musculus
aacacagtctgtttgattcatgtaa

SEQ ID NO: 500768 - DNA, 25 bp, Mus musculus
aacacagtgggtagctacgaatgtc

SEQ ID NO: 500769 - DNA, 25 bp, Mus musculus
aacacagtgggttgctacgaatgtc

SEQ ID NO: 500770 - DNA, 25 bp, Mus musculus
aacacagtgtcaacctgccttagcc

SEQ ID NO: 500771 - DNA, 25 bp, Mus musculus
aacacagtgtcatcctgccttagcc

SEQ ID NO: 500772 - DNA, 25 bp, Mus musculus
aacacagttgtcagagtccatgatt

SEQ ID NO: 500773 - DNA, 25 bp, Mus musculus
aacacagttgtctgagtccatgatt

SEQ ID NO: 500774 - DNA, 25 bp, Mus musculus
aacacatagcagatccttcctcctg

SEQ ID NO: 500775 - DNA, 25 bp, Mus musculus
aacacatagcagctaaatgagaagc

SEQ ID NO: 500776 - DNA, 25 bp, Mus musculus
aacacatagcaggtaaatgagaagc

SEQ ID NO: 500777 - DNA, 25 bp, Mus musculus
aacacatagcagttccttcctcctg

SEQ ID NO: 500778 - DNA, 25 bp, Mus musculus
aacacatcgtcacgaagttccgagg

SEQ ID NO: 500779 - DNA, 25 bp, Mus musculus
aacacatcgtcaggaagttccgagg

SEQ ID NO: 500780 - DNA, 25 bp, Mus musculus
aacacatctgccacttcccgaaaga

SEQ ID NO: 500781 - DNA, 25 bp, Mus musculus
aacacatctgcctcttcccgaaaga

SEQ ID NO: 500782 - DNA, 25 bp, Mus musculus
aacacatgaaagaatatgcctggtc

SEQ ID NO: 500783 - DNA, 25 bp, Mus musculus
aacacatgaaagtatatgcctggtc

SEQ ID NO: 500784 - DNA, 25 bp, Mus musculus
aacacatgaccgcaagtcggaagac

SEQ ID NO: 500785 - DNA, 25 bp, Mus musculus
aacacatgaccggaagtcggaagac

SEQ ID NO: 500786 - DNA, 25 bp, Mus musculus
aacacatggccaaagctagggccgc

SEQ ID NO: 500787 - DNA, 25 bp, Mus musculus
aacacatggccatagctagggccgc

SEQ ID NO: 500788 - DNA, 25 bp, Mus musculus
aacaccaaaaagagactctgagctg

SEQ ID NO: 500789 - DNA, 25 bp, Mus musculus
aacaccaaaaagtgactctgagctg

SEQ ID NO: 500790 - DNA, 25 bp, Mus musculus
aacaccaactgtaacgtttgtgcca

SEQ ID NO: 500791 - DNA, 25 bp, Mus musculus
aacaccaactgttacgtttgtgcca

SEQ ID NO: 500792 - DNA, 25 bp, Mus musculus
aacaccaaggccctgtcattcattg

SEQ ID NO: 500793 - DNA, 25 bp, Mus musculus
aacaccaaggccgtgtcattcattg

SEQ ID NO: 500794 - DNA, 25 bp, Mus musculus
aacaccaagggcagctacgagtgtg

SEQ ID NO: 500795 - DNA, 25 bp, Mus musculus
aacaccaagggctgctacgagtgtg

SEQ ID NO: 500796 - DNA, 25 bp, Mus musculus
aacaccaagtccatcgaggacatcc

SEQ ID NO: 500797 - DNA, 25 bp, Mus musculus
aacaccaagtccttcgaggacatcc

SEQ ID NO: 500798 - DNA, 25 bp, Mus musculus
aacaccacagaaagtggaactgccc

SEQ ID NO: 500799 - DNA, 25 bp, Mus musculus
aacaccacagaatgtggaactgccc

SEQ ID NO: 500800 - DNA, 25 bp, Mus musculus
aacaccacagctctggttggcagcg

SEQ ID NO: 500801 - DNA, 25 bp, Mus musculus
aacaccacagctgtggttggcagcg

SEQ ID NO: 500802 - DNA, 25 bp, Mus musculus
aacaccacatctccttgttcttgga

SEQ ID NO: 500803 - DNA, 25 bp, Mus musculus
aacaccacatctgcttgttcttgga

SEQ ID NO: 500804 - DNA, 25 bp, Mus musculus
aacaccacggtactgtctggacaga

SEQ ID NO: 500805 - DNA, 25 bp, Mus musculus
aacaccacggtagtgtctggacaga

SEQ ID NO: 500806 - DNA, 25 bp, Mus musculus
aacaccagccaccagcaggatgctt

SEQ ID NO: 500807 - DNA, 25 bp, Mus musculus
aacaccagccacgagcaggatgctt

SEQ ID NO: 500808 - DNA, 25 bp, Mus musculus
aacaccaggttccactggagtcagg

SEQ ID NO: 500809 - DNA, 25 bp, Mus musculus
aacaccaggttcgactggagtcagg

SEQ ID NO: 500810 - DNA, 25 bp, Mus musculus
aacaccagtggtctcctgtgggccg

SEQ ID NO: 500811 - DNA, 25 bp, Mus musculus
aacaccagtggtgtcctgtgggccg

SEQ ID NO: 500812 - DNA, 25 bp, Mus musculus
aacaccagtttaaaggcattggaat

SEQ ID NO: 500813 - DNA, 25 bp, Mus musculus
aacaccagtttataggcattggaat

SEQ ID NO: 500814 - DNA, 25 bp, Mus musculus
aacaccatacccagctcttattaag

SEQ ID NO: 500815 - DNA, 25 bp, Mus musculus
aacaccataccctgctcttattaag

SEQ ID NO: 500816 - DNA, 25 bp, Mus musculus
aacaccatactacatgtcacccgag

SEQ ID NO: 500817 - DNA, 25 bp, Mus musculus
aacaccatactagatgtcacccgag

SEQ ID NO: 500818 - DNA, 25 bp, Mus musculus
aacaccatttctcatcggttccggg

SEQ ID NO: 500819 - DNA, 25 bp, Mus musculus
aacaccatttctgatcggttccggg

SEQ ID NO: 500820 - DNA, 25 bp, Mus musculus
aacacccagagacggctgatgccaa

SEQ ID NO: 500821 - DNA, 25 bp, Mus musculus
aacacccagagagggctgatgccaa

SEQ ID NO: 500822 - DNA, 25 bp, Mus musculus
aacacccagtatagtaggcaatatt

SEQ ID NO: 500823 - DNA, 25 bp, Mus musculus
aacacccagtattgtaggcaatatt

SEQ ID NO: 500824 - DNA, 25 bp, Mus musculus
aacacccatcagcactttaggcact

SEQ ID NO: 500825 - DNA, 25 bp, Mus musculus
aacacccatcaggactttaggcact

SEQ ID NO: 500826 - DNA, 25 bp, Mus musculus
aacacccatcggctgcgactgcaag

SEQ ID NO: 500827 - DNA, 25 bp, Mus musculus
aacacccatcgggtgcgactgcaag

SEQ ID NO: 500828 - DNA, 25 bp, Mus musculus
aacaccctgtggatgcacgctagga

SEQ ID NO: 500829 - DNA, 25 bp, Mus musculus
aacaccctgtggttgcacgctagga

SEQ ID NO: 500830 - DNA, 25 bp, Mus musculus
aacacccttcatctgctggtgcggg

SEQ ID NO: 500831 - DNA, 25 bp, Mus musculus
aacacccttcatgtgctggtgcggg

SEQ ID NO: 500832 - DNA, 25 bp, Mus musculus
aacacccttggtcctgcaatgctgg

SEQ ID NO: 500833 - DNA, 25 bp, Mus musculus
aacacccttggtgctgcaatgctgg

SEQ ID NO: 500834 - DNA, 25 bp, Mus musculus
aacaccgagactccttttacctctg

SEQ ID NO: 500835 - DNA, 25 bp, Mus musculus
aacaccgagactgcttttacctctg

SEQ ID NO: 500836 - DNA, 25 bp, Mus musculus
aacaccgagcgtctctacggctgct

SEQ ID NO: 500837 - DNA, 25 bp, Mus musculus
aacaccgagcgtgtctacggctgct

SEQ ID NO: 500838 - DNA, 25 bp, Mus musculus
aacaccggccgcacgaggtgggctc

SEQ ID NO: 500839 - DNA, 25 bp, Mus musculus
aacaccggccgctcgaggtgggctc

SEQ ID NO: 500840 - DNA, 25 bp, Mus musculus
aacacctacaccctggcactaaggt

SEQ ID NO: 500841 - DNA, 25 bp, Mus musculus
aacacctacaccgtggcactaaggt

SEQ ID NO: 500842 - DNA, 25 bp, Mus musculus
aacacctagcaaaagcccagtatct

SEQ ID NO: 500843 - DNA, 25 bp, Mus musculus
aacacctagcaatagcccagtatct

SEQ ID NO: 500844 - DNA, 25 bp, Mus musculus
aacacctagcttcgaagttctgtgg

SEQ ID NO: 500845 - DNA, 25 bp, Mus musculus
aacacctagcttggaagttctgtgg

SEQ ID NO: 500846 - DNA, 25 bp, Mus musculus
aacacctatgatctgaagaggctgc

SEQ ID NO: 500847 - DNA, 25 bp, Mus musculus
aacacctatgatgtgaagaggctgc

SEQ ID NO: 500848 - DNA, 25 bp, Mus musculus
aacacctcacagaagaacttataag

SEQ ID NO: 500849 - DNA, 25 bp, Mus musculus
aacacctcacagtagaacttataag

SEQ ID NO: 500850 - DNA, 25 bp, Mus musculus
aacacctgccagatatcacttgaag

SEQ ID NO: 500851 - DNA, 25 bp, Mus musculus
aacacctgccagttatcacttgaag

SEQ ID NO: 500852 - DNA, 25 bp, Mus musculus
aacacctgctaacaccacaaatact

SEQ ID NO: 500853 - DNA, 25 bp, Mus musculus
aacacctgctaagaccacaaatact

SEQ ID NO: 500854 - DNA, 25 bp, Mus musculus
aacacctggagacgatccctccaat

SEQ ID NO: 500855 - DNA, 25 bp, Mus musculus
aacacctggagaggatccctccaat

SEQ ID NO: 500856 - DNA, 25 bp, Mus musculus
aacacctggtacctactcaatggac

SEQ ID NO: 500857 - DNA, 25 bp, Mus musculus
aacacctggtacgtactcaatggac

SEQ ID NO: 500858 - DNA, 25 bp, Mus musculus
aacacctgtccacggtgggcctgga

SEQ ID NO: 500859 - DNA, 25 bp, Mus musculus
aacacctgtccagggtgggcctgga

SEQ ID NO: 500860 - DNA, 25 bp, Mus musculus
aacacctgtcccagcgacaaggagg

SEQ ID NO: 500861 - DNA, 25 bp, Mus musculus
aacacctgtccctgcgacaaggagg

SEQ ID NO: 500862 - DNA, 25 bp, Mus musculus
aacacctgtgtcagctgcagcaaga

SEQ ID NO: 500863 - DNA, 25 bp, Mus musculus
aacacctgtgtctgctgcagcaaga

SEQ ID NO: 500864 - DNA, 25 bp, Mus musculus
aacacgaagcagaacggacagtggg

SEQ ID NO: 500865 - DNA, 25 bp, Mus musculus
aacacgaagcagtacggacagtggg

SEQ ID NO: 500866 - DNA, 25 bp, Mus musculus
aacacgactctgaagctaaacaagc

SEQ ID NO: 500867 - DNA, 25 bp, Mus musculus
aacacgactctgtagctaaacaagc

SEQ ID NO: 500868 - DNA, 25 bp, Mus musculus
aacacgagaaagattggaacccaga

SEQ ID NO: 500869 - DNA, 25 bp, Mus musculus
aacacgagaaagtttggaacccaga

SEQ ID NO: 500870 - DNA, 25 bp, Mus musculus
aacacgcactctcgagcgtcgtgca

SEQ ID NO: 500871 - DNA, 25 bp, Mus musculus
aacacgcactctggagcgtcgtgca

SEQ ID NO: 500872 - DNA, 25 bp, Mus musculus
aacacgcattttctgtcacagaacc

SEQ ID NO: 500873 - DNA, 25 bp, Mus musculus
aacacgcattttgtgtcacagaacc

SEQ ID NO: 500874 - DNA, 25 bp, Mus musculus
aacacgcccatgattgctggccttg

SEQ ID NO: 500875 - DNA, 25 bp, Mus musculus
aacacgcccatgtttgctggccttg

SEQ ID NO: 500876 - DNA, 25 bp, Mus musculus
aacacgccccgtcagcgggtagagc

SEQ ID NO: 500877 - DNA, 25 bp, Mus musculus
aacacgccccgtgagcgggtagagc

SEQ ID NO: 500878 - DNA, 25 bp, Mus musculus
aacacgcttaggcactggattggaa

SEQ ID NO: 500879 - DNA, 25 bp, Mus musculus
aacacgcttagggactggattggaa

SEQ ID NO: 500880 - DNA, 25 bp, Mus musculus
aacacgctttttcgtaccttccatg

SEQ ID NO: 500881 - DNA, 25 bp, Mus musculus
aacacgctttttggtaccttccatg

SEQ ID NO: 500882 - DNA, 25 bp, Mus musculus
aacacggaatcgctcccacagctgg

SEQ ID NO: 500883 - DNA, 25 bp, Mus musculus
aacacggaatcggtcccacagctgg

SEQ ID NO: 500884 - DNA, 25 bp, Mus musculus
aacacggagggcaccttcacctgct

SEQ ID NO: 500885 - DNA, 25 bp, Mus musculus
aacacggagggcacgtaccactgcg

SEQ ID NO: 500886 - DNA, 25 bp, Mus musculus
aacacggagggctccttcacctgct

SEQ ID NO: 500887 - DNA, 25 bp, Mus musculus
aacacggagggctcgtaccactgcg

SEQ ID NO: 500888 - DNA, 25 bp, Mus musculus
aacacggatgagagcgccagcagcc

SEQ ID NO: 500889 - DNA, 25 bp, Mus musculus
aacacggatgagtgcgccagcagcc

SEQ ID NO: 500890 - DNA, 25 bp, Mus musculus
aacacggccacgctgatttccacag

SEQ ID NO: 500891 - DNA, 25 bp, Mus musculus
aacacggccacggtgatttccacag

SEQ ID NO: 500892 - DNA, 25 bp, Mus musculus
aacacgggagtacccagtgcctggt

SEQ ID NO: 500893 - DNA, 25 bp, Mus musculus
aacacgggagtagccagtgcctggt

SEQ ID NO: 500894 - DNA, 25 bp, Mus musculus
aacacgggcctcaatctgctgacag

SEQ ID NO: 500895 - DNA, 25 bp, Mus musculus
aacacgggcctctatctgctgacag

SEQ ID NO: 500896 - DNA, 25 bp, Mus musculus
aacacgtcgggaattgaatcccaga

SEQ ID NO: 500897 - DNA, 25 bp, Mus musculus
aacacgtcgggatttgaatcccaga

SEQ ID NO: 500898 - DNA, 25 bp, Mus musculus
aacacgtggcgtcccttcgatggcc

SEQ ID NO: 500899 - DNA, 25 bp, Mus musculus
aacacgtggcgtgccttcgatggcc

SEQ ID NO: 500900 - DNA, 25 bp, Mus musculus
aacacgttggtcagtttcatcagca

SEQ ID NO: 500901 - DNA, 25 bp, Mus musculus
aacacgttggtctgtttcatcagca

SEQ ID NO: 500902 - DNA, 25 bp, Mus musculus
aacacgtttctaccttatgcccagt

SEQ ID NO: 500903 - DNA, 25 bp, Mus musculus
aacacgtttctagcttatgcccagt

SEQ ID NO: 500904 - DNA, 25 bp, Mus musculus
aacacgtttggtcagagccatggca

SEQ ID NO: 500905 - DNA, 25 bp, Mus musculus
aacacgtttggtgagagccatggca

SEQ ID NO: 500906 - DNA, 25 bp, Mus musculus
aacactaagctcatagaatggctgc

SEQ ID NO: 500907 - DNA, 25 bp, Mus musculus
aacactaagctcttagaatggctgc

SEQ ID NO: 500908 - DNA, 25 bp, Mus musculus
aacactaatgagctatgaagttccg

SEQ ID NO: 500909 - DNA, 25 bp, Mus musculus
aacactaatgaggtatgaagttccg

SEQ ID NO: 500910 - DNA, 25 bp, Mus musculus
aacactacatgaaggtattgtttca

SEQ ID NO: 500911 - DNA, 25 bp, Mus musculus
aacactacatgatggtattgtttca

SEQ ID NO: 500912 - DNA, 25 bp, Mus musculus
aacactaccggtccggctacagtgc

SEQ ID NO: 500913 - DNA, 25 bp, Mus musculus
aacactaccggtgcggctacagtgc

SEQ ID NO: 500914 - DNA, 25 bp, Mus musculus
aacactagcttaatccgtccacgaa

SEQ ID NO: 500915 - DNA, 25 bp, Mus musculus
aacactagcttattccgtccacgaa

SEQ ID NO: 500916 - DNA, 25 bp, Mus musculus
aacactaggcggcatattggaaaag

SEQ ID NO: 500917 - DNA, 25 bp, Mus musculus
aacactaggcgggatattggaaaag

SEQ ID NO: 500918 - DNA, 25 bp, Mus musculus
aacactcagtgcctgctcaacgtgg

SEQ ID NO: 500919 - DNA, 25 bp, Mus musculus
aacactcagtgcgtgctcaacgtgg

SEQ ID NO: 500920 - DNA, 25 bp, Mus musculus
aacactccatctacttcggagggcg

SEQ ID NO: 500921 - DNA, 25 bp, Mus musculus
aacactccatcttcttcggagggcg

SEQ ID NO: 500922 - DNA, 25 bp, Mus musculus
aacactccttcgctgcagctggtga

SEQ ID NO: 500923 - DNA, 25 bp, Mus musculus
aacactccttcggtgcagctggtga

SEQ ID NO: 500924 - DNA, 25 bp, Mus musculus
aacactcggctcatcaaggtcgttg

SEQ ID NO: 500925 - DNA, 25 bp, Mus musculus
aacactcggctcttcaaggtcgttg

SEQ ID NO: 500926 - DNA, 25 bp, Mus musculus
aacactcggtccagacaggagatgg

SEQ ID NO: 500927 - DNA, 25 bp, Mus musculus
aacactcggtcctgacaggagatgg

SEQ ID NO: 500928 - DNA, 25 bp, Mus musculus
aacactctgcttcaggggttcacag

SEQ ID NO: 500929 - DNA, 25 bp, Mus musculus
aacactctgcttgaggggttcacag

SEQ ID NO: 500930 - DNA, 25 bp, Mus musculus
aacactctttggctgtccttgctgt

SEQ ID NO: 500931 - DNA, 25 bp, Mus musculus
aacactctttgggtgtccttgctgt

SEQ ID NO: 500932 - DNA, 25 bp, Mus musculus
aacactgcattgagttgctacagat

SEQ ID NO: 500933 - DNA, 25 bp, Mus musculus
aacactgcattgtgttgctacagat

SEQ ID NO: 500934 - DNA, 25 bp, Mus musculus
aacactgccactctgacacggttga

SEQ ID NO: 500935 - DNA, 25 bp, Mus musculus
aacactgccactgtgacacggttga

SEQ ID NO: 500936 - DNA, 25 bp, Mus musculus
aacactgcgagcagtggagcacact

SEQ ID NO: 500937 - DNA, 25 bp, Mus musculus
aacactgcgagctgtggagcacact

SEQ ID NO: 500938 - DNA, 25 bp, Mus musculus
aacactgctagtctcaactcccggg

SEQ ID NO: 500939 - DNA, 25 bp, Mus musculus
aacactgctagtgtcaactcccggg

SEQ ID NO: 500940 - DNA, 25 bp, Mus musculus
aacactgctgcacgtctgaagaggg

SEQ ID NO: 500941 - DNA, 25 bp, Mus musculus
aacactgctgcaggtctgaagaggg

SEQ ID NO: 500942 - DNA, 25 bp, Mus musculus
aacactggcaggaatcgtcatgacc

SEQ ID NO: 500943 - DNA, 25 bp, Mus musculus
aacactggcaggtatcgtcatgacc

SEQ ID NO: 500944 - DNA, 25 bp, Mus musculus
aacactggccgacgtaaggccccag

SEQ ID NO: 500945 - DNA, 25 bp, Mus musculus
aacactggccgaggtaaggccccag

SEQ ID NO: 500946 - DNA, 25 bp, Mus musculus
aacactgggattagcatggctccaa

SEQ ID NO: 500947 - DNA, 25 bp, Mus musculus
aacactgggatttgcatggctccaa

SEQ ID NO: 500948 - DNA, 25 bp, Mus musculus
aacactggtagtaagccagccctga

SEQ ID NO: 500949 - DNA, 25 bp, Mus musculus
aacactggtagttagccagccctga

SEQ ID NO: 500950 - DNA, 25 bp, Mus musculus
aacactggtcctagctgtattctca

SEQ ID NO: 500951 - DNA, 25 bp, Mus musculus
aacactggtccttgctgtattctca

SEQ ID NO: 500952 - DNA, 25 bp, Mus musculus
aacactggtgaacattggtatgtgc

SEQ ID NO: 500953 - DNA, 25 bp, Mus musculus
aacactggtgaagattggtatgtgc

SEQ ID NO: 500954 - DNA, 25 bp, Mus musculus
aacactggtggacagtcggtcctcg

SEQ ID NO: 500955 - DNA, 25 bp, Mus musculus
aacactggtggagagtcggtcctcg

SEQ ID NO: 500956 - DNA, 25 bp, Mus musculus
aacactggtgttcgattgtctacta

SEQ ID NO: 500957 - DNA, 25 bp, Mus musculus
aacactggtgttggattgtctacta

SEQ ID NO: 500958 - DNA, 25 bp, Mus musculus
aacactgtactcctgcctgtcactg

SEQ ID NO: 500959 - DNA, 25 bp, Mus musculus
aacactgtactcgtgcctgtcactg

SEQ ID NO: 500960 - DNA, 25 bp, Mus musculus
aacactgtatgacgtgcctcgcgag

SEQ ID NO: 500961 - DNA, 25 bp, Mus musculus
aacactgtatgaggtgcctcgcgag

SEQ ID NO: 500962 - DNA, 25 bp, Mus musculus
aacactgtcctcatagtccagatcc

SEQ ID NO: 500963 - DNA, 25 bp, Mus musculus
aacactgtcctcttagtccagatcc

SEQ ID NO: 500964 - DNA, 25 bp, Mus musculus
aacactgtcgctcatccagggcctg

SEQ ID NO: 500965 - DNA, 25 bp, Mus musculus
aacactgtcgctgatccagggcctg

SEQ ID NO: 500966 - DNA, 25 bp, Mus musculus
aacactgtctttctagacaccaaga

SEQ ID NO: 500967 - DNA, 25 bp, Mus musculus
aacactgtctttgtagacaccaaga

SEQ ID NO: 500968 - DNA, 25 bp, Mus musculus
aacactgtgccccagtactggccaa

SEQ ID NO: 500969 - DNA, 25 bp, Mus musculus
aacactgtgcccgagtactggccaa

SEQ ID NO: 500970 - DNA, 25 bp, Mus musculus
aacactgttcttagctgctggctcc

SEQ ID NO: 500971 - DNA, 25 bp, Mus musculus
aacactgttctttgctgctggctcc

SEQ ID NO: 500972 - DNA, 25 bp, Mus musculus
aacactgttgacatggagggcccac

SEQ ID NO: 500973 - DNA, 25 bp, Mus musculus
aacactgttgacttggagggcccac

SEQ ID NO: 500974 - DNA, 25 bp, Mus musculus
aacacttaagaaacatgtctctgca

SEQ ID NO: 500975 - DNA, 25 bp, Mus musculus
aacacttaagaatcatgtctctgca

SEQ ID NO: 500976 - DNA, 25 bp, Mus musculus
aacacttactacagcgacatcattt

SEQ ID NO: 500977 - DNA, 25 bp, Mus musculus
aacacttactactgcgacatcattt

SEQ ID NO: 500978 - DNA, 25 bp, Mus musculus
aacacttccgggacagggagcgtga

SEQ ID NO: 500979 - DNA, 25 bp, Mus musculus
aacacttccgggtcagggagcgtga

SEQ ID NO: 500980 - DNA, 25 bp, Mus musculus
aacacttgaaagcttactcccctct

SEQ ID NO: 500981 - DNA, 25 bp, Mus musculus
aacacttgaaaggttactcccctct

SEQ ID NO: 500982 - DNA, 25 bp, Mus musculus
aacacttgccttagcagactcagtt

SEQ ID NO: 500983 - DNA, 25 bp, Mus musculus
aacacttgcctttgcagactcagtt

SEQ ID NO: 500984 - DNA, 25 bp, Mus musculus
aacacttgggttatcagcgatgcac

SEQ ID NO: 500985 - DNA, 25 bp, Mus musculus
aacacttgggttttcagcgatgcac

SEQ ID NO: 500986 - DNA, 25 bp, Mus musculus
aacacttgtgaacatttgcctggaa

SEQ ID NO: 500987 - DNA, 25 bp, Mus musculus
aacacttgtgaagatttgcctggaa

SEQ ID NO: 500988 - DNA, 25 bp, Mus musculus
aacacttgtgagcacatcgcccagt

SEQ ID NO: 500989 - DNA, 25 bp, Mus musculus
aacacttgtgaggacatcgcccagt

SEQ ID NO: 500990 - DNA, 25 bp, Mus musculus
aacactttaggaccgcgagtgtgac

SEQ ID NO: 500991 - DNA, 25 bp, Mus musculus
aacactttaggagcgcgagtgtgac

SEQ ID NO: 500992 - DNA, 25 bp, Mus musculus
aacacttttctcacagtctcgcaca

SEQ ID NO: 500993 - DNA, 25 bp, Mus musculus
aacacttttctctcagtctcgcaca

SEQ ID NO: 500994 - DNA, 25 bp, Mus musculus
aacagaaaagcccttgcttgggcct

SEQ ID NO: 500995 - DNA, 25 bp, Mus musculus
aacagaaaagccgttgcttgggcct

SEQ ID NO: 500996 - DNA, 25 bp, Mus musculus
aacagaaaatctaggctgctcttaa

SEQ ID NO: 500997 - DNA, 25 bp, Mus musculus
aacagaaaatcttggctgctcttaa

SEQ ID NO: 500998 - DNA, 25 bp, Mus musculus
aacagaaaccagactatcaaagcca

SEQ ID NO: 500999 - DNA, 25 bp, Mus musculus
aacagaaaccagtctatcaaagcca

SEQ ID NO: 501000 - DNA, 25 bp, Mus musculus
aacagaaactggcacgggatactga

SEQ ID NO: 501001 - DNA, 25 bp, Mus musculus
aacagaaactgggacgggatactga

SEQ ID NO: 501002 - DNA, 25 bp, Mus musculus
aacagaaatggtcaaggagtttatg

SEQ ID NO: 501003 - DNA, 25 bp, Mus musculus
aacagaaatggtgaaggagtttatg

SEQ ID NO: 501004 - DNA, 25 bp, Mus musculus
aacagaacaaagaagatggcacatt

SEQ ID NO: 501005 - DNA, 25 bp, Mus musculus
aacagaacaaagtagatggcacatt

SEQ ID NO: 501006 - DNA, 25 bp, Mus musculus
aacagaacagtcaatttactccaaa

SEQ ID NO: 501007 - DNA, 25 bp, Mus musculus
aacagaacagtctatttactccaaa

SEQ ID NO: 501008 - DNA, 25 bp, Mus musculus
aacagaacggaacacaaacctggat

SEQ ID NO: 501009 - DNA, 25 bp, Mus musculus
aacagaacggaagacaaacctggat

SEQ ID NO: 501010 - DNA, 25 bp, Mus musculus
aacagaactgttcaggagctgcacg

SEQ ID NO: 501011 - DNA, 25 bp, Mus musculus
aacagaactgttgaggagctgcacg

SEQ ID NO: 501012 - DNA, 25 bp, Mus musculus
aacagaacttcccagccattgctat

SEQ ID NO: 501013 - DNA, 25 bp, Mus musculus
aacagaacttccgagccattgctat

SEQ ID NO: 501014 - DNA, 25 bp, Mus musculus
aacagaagagaacggatgctattaa

SEQ ID NO: 501015 - DNA, 25 bp, Mus musculus
aacagaagagaagggatgctattaa

SEQ ID NO: 501016 - DNA, 25 bp, Mus musculus
aacagaaggtcacgtttgccaaagg

SEQ ID NO: 501017 - DNA, 25 bp, Mus musculus
aacagaaggtcaggtttgccaaagg

SEQ ID NO: 501018 - DNA, 25 bp, Mus musculus
aacagaagtcagattgtcagatgaa

SEQ ID NO: 501019 - DNA, 25 bp, Mus musculus
aacagaagtcagtttgtcagatgaa

SEQ ID NO: 501020 - DNA, 25 bp, Mus musculus
aacagaataccacccggaacagagg

SEQ ID NO: 501021 - DNA, 25 bp, Mus musculus
aacagaataccagccggaacagagg

SEQ ID NO: 501022 - DNA, 25 bp, Mus musculus
aacagaatccgcctgtgtgttcatc

SEQ ID NO: 501023 - DNA, 25 bp, Mus musculus
aacagaatccgcgtgtgtgttcatc

SEQ ID NO: 501024 - DNA, 25 bp, Mus musculus
aacagaatcctgaaatgttcaagca

SEQ ID NO: 501025 - DNA, 25 bp, Mus musculus
aacagaatcctgtaatgttcaagca

SEQ ID NO: 501026 - DNA, 25 bp, Mus musculus
aacagacaaatgatgccctgcttgg

SEQ ID NO: 501027 - DNA, 25 bp, Mus musculus
aacagacaaatgttgccctgcttgg

SEQ ID NO: 501028 - DNA, 25 bp, Mus musculus
aacagacaattgaaatacatggtac

SEQ ID NO: 501029 - DNA, 25 bp, Mus musculus
aacagacaattgtaatacatggtac

SEQ ID NO: 501030 - DNA, 25 bp, Mus musculus
aacagacaccttcaaactgcactgc

SEQ ID NO: 501031 - DNA, 25 bp, Mus musculus
aacagacaccttgaaactgcactgc

SEQ ID NO: 501032 - DNA, 25 bp, Mus musculus
aacagacacggcctcccagcaggag

SEQ ID NO: 501033 - DNA, 25 bp, Mus musculus
aacagacacggcgtcccagcaggag

SEQ ID NO: 501034 - DNA, 25 bp, Mus musculus
aacagacccctgactatgaagaaag

SEQ ID NO: 501035 - DNA, 25 bp, Mus musculus
aacagacccctgtctatgaagaaag

SEQ ID NO: 501036 - DNA, 25 bp, Mus musculus
aacagacctgacattgtgaacatcc

SEQ ID NO: 501037 - DNA, 25 bp, Mus musculus
aacagacctgactttgtgaacatcc

SEQ ID NO: 501038 - DNA, 25 bp, Mus musculus
aacagacgacgacatctatgacgga

SEQ ID NO: 501039 - DNA, 25 bp, Mus musculus
aacagacgacgagatctatgacgga

SEQ ID NO: 501040 - DNA, 25 bp, Mus musculus
aacagacgtccaattttaatcatcg

SEQ ID NO: 501041 - DNA, 25 bp, Mus musculus
aacagacgtccatttttaatcatcg

SEQ ID NO: 501042 - DNA, 25 bp, Mus musculus
aacagactatacacccgtttggtgc

SEQ ID NO: 501043 - DNA, 25 bp, Mus musculus
aacagactatactcccgtttggtgc

SEQ ID NO: 501044 - DNA, 25 bp, Mus musculus
aacagactcgccaacttagaaatct

SEQ ID NO: 501045 - DNA, 25 bp, Mus musculus
aacagactcgcctacttagaaatct

SEQ ID NO: 501046 - DNA, 25 bp, Mus musculus
aacagacttcacattcatggtgaag

SEQ ID NO: 501047 - DNA, 25 bp, Mus musculus
aacagacttcactttcatggtgaag

SEQ ID NO: 501048 - DNA, 25 bp, Mus musculus
aacagagacaggacccgattctgag

SEQ ID NO: 501049 - DNA, 25 bp, Mus musculus
aacagagacaggtcccgattctgag

SEQ ID NO: 501050 - DNA, 25 bp, Mus musculus
aacagagacgctccagcccgactta

SEQ ID NO: 501051 - DNA, 25 bp, Mus musculus
aacagagacgctgcagcccgactta

SEQ ID NO: 501052 - DNA, 25 bp, Mus musculus
aacagagagtgaccttatgagagcc

SEQ ID NO: 501053 - DNA, 25 bp, Mus musculus
aacagagagtgagcttatgagagcc

SEQ ID NO: 501054 - DNA, 25 bp, Mus musculus
aacagagatgttcctgaatgaaagc

SEQ ID NO: 501055 - DNA, 25 bp, Mus musculus
aacagagatgttgctgaatgaaagc

SEQ ID NO: 501056 - DNA, 25 bp, Mus musculus
aacagagcagctagatcttacacgg

SEQ ID NO: 501057 - DNA, 25 bp, Mus musculus
aacagagcagcttgatcttacacgg

SEQ ID NO: 501058 - DNA, 25 bp, Mus musculus
aacagagcattaagtctgagacatc

SEQ ID NO: 501059 - DNA, 25 bp, Mus musculus
aacagagcattatgtctgagacatc

SEQ ID NO: 501060 - DNA, 25 bp, Mus musculus
aacagagccccaagattcccgctgg

SEQ ID NO: 501061 - DNA, 25 bp, Mus musculus
aacagagccccatgattcccgctgg

SEQ ID NO: 501062 - DNA, 25 bp, Mus musculus
aacagagcccgtctcgtagagttgg

SEQ ID NO: 501063 - DNA, 25 bp, Mus musculus
aacagagcccgtgtcgtagagttgg

SEQ ID NO: 501064 - DNA, 25 bp, Mus musculus
aacagagcgtcaaggcctaccgggt

SEQ ID NO: 501065 - DNA, 25 bp, Mus musculus
aacagagcgtcatggcctaccgggt

SEQ ID NO: 501066 - DNA, 25 bp, Mus musculus
aacagagctcaccatttgaatcata

SEQ ID NO: 501067 - DNA, 25 bp, Mus musculus
aacagagctcacgatttgaatcata

SEQ ID NO: 501068 - DNA, 25 bp, Mus musculus
aacagaggccttcaggtccttccca

SEQ ID NO: 501069 - DNA, 25 bp, Mus musculus
aacagaggccttgaggtccttccca

SEQ ID NO: 501070 - DNA, 25 bp, Mus musculus
aacagaggctggatcgcgaagccaa

SEQ ID NO: 501071 - DNA, 25 bp, Mus musculus
aacagaggctggttcgcgaagccaa

SEQ ID NO: 501072 - DNA, 25 bp, Mus musculus
aacagagggactctttgactcagaa

SEQ ID NO: 501073 - DNA, 25 bp, Mus musculus
aacagagggactgtttgactcagaa

SEQ ID NO: 501074 - DNA, 25 bp, Mus musculus
aacagaggtgcacaaaacagaggcc

SEQ ID NO: 501075 - DNA, 25 bp, Mus musculus
aacagaggtgcagaaaacagaggcc

SEQ ID NO: 501076 - DNA, 25 bp, Mus musculus
aacagagtccagcagatgccaaaca

SEQ ID NO: 501077 - DNA, 25 bp, Mus musculus
aacagagtccaggagatgccaaaca

SEQ ID NO: 501078 - DNA, 25 bp, Mus musculus
aacagagtgagtctgtgaacacagc

SEQ ID NO: 501079 - DNA, 25 bp, Mus musculus
aacagagtgagtgtgtgaacacagc

SEQ ID NO: 501080 - DNA, 25 bp, Mus musculus
aacagagttcctcccgctgctcagt

SEQ ID NO: 501081 - DNA, 25 bp, Mus musculus
aacagagttcctgccgctgctcagt

SEQ ID NO: 501082 - DNA, 25 bp, Mus musculus
aacagatcaaataggatgaaggctg

SEQ ID NO: 501083 - DNA, 25 bp, Mus musculus
aacagatcaaattggatgaaggctg

SEQ ID NO: 501084 - DNA, 25 bp, Mus musculus
aacagatcagtgcaggacaggaatt

SEQ ID NO: 501085 - DNA, 25 bp, Mus musculus
aacagatcagtggaggacaggaatt

SEQ ID NO: 501086 - DNA, 25 bp, Mus musculus
aacagatcccctagtagcagctgca

SEQ ID NO: 501087 - DNA, 25 bp, Mus musculus
aacagatccccttgtagcagctgca

SEQ ID NO: 501088 - DNA, 25 bp, Mus musculus
aacagatcttggctacttgccctga

SEQ ID NO: 501089 - DNA, 25 bp, Mus musculus
aacagatcttgggtacttgccctga

SEQ ID NO: 501090 - DNA, 25 bp, Mus musculus
aacagatggattaggaagttcgaga

SEQ ID NO: 501091 - DNA, 25 bp, Mus musculus
aacagatggatttggaagttcgaga

SEQ ID NO: 501092 - DNA, 25 bp, Mus musculus
aacagatggcagagttccggaagca

SEQ ID NO: 501093 - DNA, 25 bp, Mus musculus
aacagatggcagtgttccggaagca

SEQ ID NO: 501094 - DNA, 25 bp, Mus musculus
aacagatgtgctaggtgttcacgaa

SEQ ID NO: 501095 - DNA, 25 bp, Mus musculus
aacagatgtgcttggtgttcacgaa

SEQ ID NO: 501096 - DNA, 25 bp, Mus musculus
aacagattgataagaaatgccgggc

SEQ ID NO: 501097 - DNA, 25 bp, Mus musculus
aacagattgatatgaaatgccgggc

SEQ ID NO: 501098 - DNA, 25 bp, Mus musculus
aacagatttatcaggaccgagacca

SEQ ID NO: 501099 - DNA, 25 bp, Mus musculus
aacagatttatctggaccgagacca

SEQ ID NO: 501100 - DNA, 25 bp, Mus musculus
aacagcaacctgcagtgcaccatca

SEQ ID NO: 501101 - DNA, 25 bp, Mus musculus
aacagcaacctggagtgcaccatca

SEQ ID NO: 501102 - DNA, 25 bp, Mus musculus
aacagcaaggttaccgggatgctgc

SEQ ID NO: 501103 - DNA, 25 bp, Mus musculus
aacagcaaggtttccgggatgctgc

SEQ ID NO: 501104 - DNA, 25 bp, Mus musculus
aacagcaagtgaaggctgcagccca

SEQ ID NO: 501105 - DNA, 25 bp, Mus musculus
aacagcaagtgatggctgcagccca

SEQ ID NO: 501106 - DNA, 25 bp, Mus musculus
aacagcacagtgaatcaagggaaca

SEQ ID NO: 501107 - DNA, 25 bp, Mus musculus
aacagcacagtgtatcaagggaaca

SEQ ID NO: 501108 - DNA, 25 bp, Mus musculus
aacagcaccccgatggccgctggaa

SEQ ID NO: 501109 - DNA, 25 bp, Mus musculus
aacagcaccccgttggccgctggaa

SEQ ID NO: 501110 - DNA, 25 bp, Mus musculus
aacagcactggcagtatttgggaag

SEQ ID NO: 501111 - DNA, 25 bp, Mus musculus
aacagcactggctgtatttgggaag

SEQ ID NO: 501112 - DNA, 25 bp, Mus musculus
aacagcacttgaccagataaagaaa

SEQ ID NO: 501113 - DNA, 25 bp, Mus musculus
aacagcacttgagcagataaagaaa

SEQ ID NO: 501114 - DNA, 25 bp, Mus musculus
aacagcagaccacctgagtatgaat

SEQ ID NO: 501115 - DNA, 25 bp, Mus musculus
aacagcagaccagctgagtatgaat

SEQ ID NO: 501116 - DNA, 25 bp, Mus musculus
aacagcagcgaactgcatctgcagt

SEQ ID NO: 501117 - DNA, 25 bp, Mus musculus
aacagcagcgaagtgcatctgcagt

SEQ ID NO: 501118 - DNA, 25 bp, Mus musculus
aacagcagctaccagaacccagtca

SEQ ID NO: 501119 - DNA, 25 bp, Mus musculus
aacagcagctacgagaacccagtca

SEQ ID NO: 501120 - DNA, 25 bp, Mus musculus
aacagcagctccactacttctggcg

SEQ ID NO: 501121 - DNA, 25 bp, Mus musculus
aacagcagctcctctacttctggcg

SEQ ID NO: 501122 - DNA, 25 bp, Mus musculus
aacagcagctgcctcggaggaatga

SEQ ID NO: 501123 - DNA, 25 bp, Mus musculus
aacagcagctgcgtcggaggaatga

SEQ ID NO: 501124 - DNA, 25 bp, Mus musculus
aacagcagcttaataaaaggcatca

SEQ ID NO: 501125 - DNA, 25 bp, Mus musculus
aacagcagcttattaaaaggcatca

SEQ ID NO: 501126 - DNA, 25 bp, Mus musculus
aacagcaggaggactttgccggcaa

SEQ ID NO: 501127 - DNA, 25 bp, Mus musculus
aacagcaggaggtctttgccggcaa

SEQ ID NO: 501128 - DNA, 25 bp, Mus musculus
aacagcaggcagcaccagtggacga

SEQ ID NO: 501129 - DNA, 25 bp, Mus musculus
aacagcaggcaggaccagtggacga

SEQ ID NO: 501130 - DNA, 25 bp, Mus musculus
aacagcagggagaagcactgcctgg

SEQ ID NO: 501131 - DNA, 25 bp, Mus musculus
aacagcagggagtagcactgcctgg

SEQ ID NO: 501132 - DNA, 25 bp, Mus musculus
aacagcaggtagacgtcttcgatgg

SEQ ID NO: 501133 - DNA, 25 bp, Mus musculus
aacagcaggtagtcgtcttcgatgg

SEQ ID NO: 501134 - DNA, 25 bp, Mus musculus
aacagcagtcatctcgggccgcaca

SEQ ID NO: 501135 - DNA, 25 bp, Mus musculus
aacagcagtcatgtcgggccgcaca

SEQ ID NO: 501136 - DNA, 25 bp, Mus musculus
aacagcagtgagacgacctagcaga

SEQ ID NO: 501137 - DNA, 25 bp, Mus musculus
aacagcagtgagtcgacctagcaga

SEQ ID NO: 501138 - DNA, 25 bp, Mus musculus
aacagcagtggcagcttcgaagcca

SEQ ID NO: 501139 - DNA, 25 bp, Mus musculus
aacagcagtggctgcttcgaagcca

SEQ ID NO: 501140 - DNA, 25 bp, Mus musculus
aacagcagtggtcaaccgcgtgttc

SEQ ID NO: 501141 - DNA, 25 bp, Mus musculus
aacagcagtggtgaaccgcgtgttc

SEQ ID NO: 501142 - DNA, 25 bp, Mus musculus
aacagcataaacattgacaacccag

SEQ ID NO: 501143 - DNA, 25 bp, Mus musculus
aacagcataaactttgacaacccag

SEQ ID NO: 501144 - DNA, 25 bp, Mus musculus
aacagcatgcgaagtggtacccagg

SEQ ID NO: 501145 - DNA, 25 bp, Mus musculus
aacagcatgcgatgtggtacccagg

SEQ ID NO: 501146 - DNA, 25 bp, Mus musculus
aacagcatggatcccaccagtgaga

SEQ ID NO: 501147 - DNA, 25 bp, Mus musculus
aacagcatggatgccaccagtgaga

SEQ ID NO: 501148 - DNA, 25 bp, Mus musculus
aacagcattcacacagcatcaccga

SEQ ID NO: 501149 - DNA, 25 bp, Mus musculus
aacagcattcactcagcatcaccga

SEQ ID NO: 501150 - DNA, 25 bp, Mus musculus
aacagccaacaacaatgtggtgcag

SEQ ID NO: 501151 - DNA, 25 bp, Mus musculus
aacagccaacaagaatgtggtgcag

SEQ ID NO: 501152 - DNA, 25 bp, Mus musculus
aacagccacttgacttctggaagtg

SEQ ID NO: 501153 - DNA, 25 bp, Mus musculus
aacagccacttgtcttctggaagtg

SEQ ID NO: 501154 - DNA, 25 bp, Mus musculus
aacagccagggaccggatcagtctt

SEQ ID NO: 501155 - DNA, 25 bp, Mus musculus
aacagccagggagcggatcagtctt

SEQ ID NO: 501156 - DNA, 25 bp, Mus musculus
aacagccagtagagagtacaagaaa

SEQ ID NO: 501157 - DNA, 25 bp, Mus musculus
aacagccagtagtgagtacaagaaa

SEQ ID NO: 501158 - DNA, 25 bp, Mus musculus
aacagccatggcaacgatgttgcca

SEQ ID NO: 501159 - DNA, 25 bp, Mus musculus
aacagccatggctacgatgttgcca

SEQ ID NO: 501160 - DNA, 25 bp, Mus musculus
aacagcccgctgaaaacgtaagagg

SEQ ID NO: 501161 - DNA, 25 bp, Mus musculus
aacagcccgctgtaaacgtaagagg

SEQ ID NO: 501162 - DNA, 25 bp, Mus musculus
aacagccctttcatcaataatgtgg

SEQ ID NO: 501163 - DNA, 25 bp, Mus musculus
aacagccctttcttcaataatgtgg

SEQ ID NO: 501164 - DNA, 25 bp, Mus musculus
aacagccgctgcctccattggagga

SEQ ID NO: 501165 - DNA, 25 bp, Mus musculus
aacagccgctgcgtccattggagga

SEQ ID NO: 501166 - DNA, 25 bp, Mus musculus
aacagccggccgagcacttacagct

SEQ ID NO: 501167 - DNA, 25 bp, Mus musculus
aacagccggccgtgcacttacagct

SEQ ID NO: 501168 - DNA, 25 bp, Mus musculus
aacagcctgggcacagcttactcca

SEQ ID NO: 501169 - DNA, 25 bp, Mus musculus
aacagcctgggcctcagtgccctgt

SEQ ID NO: 501170 - DNA, 25 bp, Mus musculus
aacagcctgggcgtcagtgccctgt

SEQ ID NO: 501171 - DNA, 25 bp, Mus musculus
aacagcctgggctcagcttactcca

SEQ ID NO: 501172 - DNA, 25 bp, Mus musculus
aacagcctgtggatcggatacgatg

SEQ ID NO: 501173 - DNA, 25 bp, Mus musculus
aacagcctgtggttcggatacgatg

SEQ ID NO: 501174 - DNA, 25 bp, Mus musculus
aacagcggcacgctctgcgagaaca

SEQ ID NO: 501175 - DNA, 25 bp, Mus musculus
aacagcggcacggtctgcgagaaca

SEQ ID NO: 501176 - DNA, 25 bp, Mus musculus
aacagctatcttccagtcacgtctg

SEQ ID NO: 501177 - DNA, 25 bp, Mus musculus
aacagctatcttgcagtcacgtctg

SEQ ID NO: 501178 - DNA, 25 bp, Mus musculus
aacagctcatctcgatttgactgca

SEQ ID NO: 501179 - DNA, 25 bp, Mus musculus
aacagctcatctggatttgactgca

SEQ ID NO: 501180 - DNA, 25 bp, Mus musculus
aacagctccatcacccgggaagaat

SEQ ID NO: 501181 - DNA, 25 bp, Mus musculus
aacagctccatctcccgggaagaat

SEQ ID NO: 501182 - DNA, 25 bp, Mus musculus
aacagctcccagaccagatttcctt

SEQ ID NO: 501183 - DNA, 25 bp, Mus musculus
aacagctcccagtccagatttcctt

SEQ ID NO: 501184 - DNA, 25 bp, Mus musculus
aacagctcccgaactcgattctaca

SEQ ID NO: 501185 - DNA, 25 bp, Mus musculus
aacagctcccgatctcgattctaca

SEQ ID NO: 501186 - DNA, 25 bp, Mus musculus
aacagctcgctactggactccaaca

SEQ ID NO: 501187 - DNA, 25 bp, Mus musculus
aacagctcgctagtggactccaaca

SEQ ID NO: 501188 - DNA, 25 bp, Mus musculus
aacagctgaggcaaataacctggca

SEQ ID NO: 501189 - DNA, 25 bp, Mus musculus
aacagctgaggctaataacctggca

SEQ ID NO: 501190 - DNA, 25 bp, Mus musculus
aacagctgccggcctgcctgttgtt

SEQ ID NO: 501191 - DNA, 25 bp, Mus musculus
aacagctgccgggctgcctgttgtt

SEQ ID NO: 501192 - DNA, 25 bp, Mus musculus
aacagctgcgagaggctgctctgat

SEQ ID NO: 501193 - DNA, 25 bp, Mus musculus
aacagctgcgagtggctgctctgat

SEQ ID NO: 501194 - DNA, 25 bp, Mus musculus
aacagctgctgtccaccgactgcta

SEQ ID NO: 501195 - DNA, 25 bp, Mus musculus
aacagctgctgtgcaccgactgcta

SEQ ID NO: 501196 - DNA, 25 bp, Mus musculus
aacagcttcaagcttagccgcgtcc

SEQ ID NO: 501197 - DNA, 25 bp, Mus musculus
aacagcttcaaggttagccgcgtcc

SEQ ID NO: 501198 - DNA, 25 bp, Mus musculus
aacagcttcgagcagtttattatta

SEQ ID NO: 501199 - DNA, 25 bp, Mus musculus
aacagcttcgaggagtttattatta

SEQ ID NO: 501200 - DNA, 25 bp, Mus musculus
aacagcttgcccagtttcttgaggc

SEQ ID NO: 501201 - DNA, 25 bp, Mus musculus
aacagcttgccctgtttcttgaggc

SEQ ID NO: 501202 - DNA, 25 bp, Mus musculus
aacagcttgttgagggcacttctca

SEQ ID NO: 501203 - DNA, 25 bp, Mus musculus
aacagcttgttgtgggcacttctca

SEQ ID NO: 501204 - DNA, 25 bp, Mus musculus
aacagctttaagatcgacatcatgc

SEQ ID NO: 501205 - DNA, 25 bp, Mus musculus
aacagctttaagttcgacatcatgc

SEQ ID NO: 501206 - DNA, 25 bp, Mus musculus
aacaggaacagactcgaggcgcttt

SEQ ID NO: 501207 - DNA, 25 bp, Mus musculus
aacaggaacagagtcgaggcgcttt

SEQ ID NO: 501208 - DNA, 25 bp, Mus musculus
aacaggaagcagagtggcgatgaca

SEQ ID NO: 501209 - DNA, 25 bp, Mus musculus
aacaggaagcagtgtggcgatgaca

SEQ ID NO: 501210 - DNA, 25 bp, Mus musculus
aacaggaagcgacagcagtgtagac

SEQ ID NO: 501211 - DNA, 25 bp, Mus musculus
aacaggaagcgagagcagtgtagac

SEQ ID NO: 501212 - DNA, 25 bp, Mus musculus
aacaggaaggcacttgtacagctca

SEQ ID NO: 501213 - DNA, 25 bp, Mus musculus
aacaggaaggcagttgtacagctca

SEQ ID NO: 501214 - DNA, 25 bp, Mus musculus
aacaggacacgccttcctttcagac

SEQ ID NO: 501215 - DNA, 25 bp, Mus musculus
aacaggacacgcgttcctttcagac

SEQ ID NO: 501216 - DNA, 25 bp, Mus musculus
aacaggacattacgagtcttcccac

SEQ ID NO: 501217 - DNA, 25 bp, Mus musculus
aacaggacattaggagtcttcccac

SEQ ID NO: 501218 - DNA, 25 bp, Mus musculus
aacaggaccagaccaccgactggag

SEQ ID NO: 501219 - DNA, 25 bp, Mus musculus
aacaggaccagagcaccgactggag

SEQ ID NO: 501220 - DNA, 25 bp, Mus musculus
aacaggacctgaaggatcccctggc

SEQ ID NO: 501221 - DNA, 25 bp, Mus musculus
aacaggacctgatggatcccctggc

SEQ ID NO: 501222 - DNA, 25 bp, Mus musculus
aacaggacgactcgacctttcacta

SEQ ID NO: 501223 - DNA, 25 bp, Mus musculus
aacaggacgactggacctttcacta

SEQ ID NO: 501224 - DNA, 25 bp, Mus musculus
aacaggagaggacaccaagcaggca

SEQ ID NO: 501225 - DNA, 25 bp, Mus musculus
aacaggagaggagaccaagcaggca

SEQ ID NO: 501226 - DNA, 25 bp, Mus musculus
aacaggagagtgcagtgaacccatc

SEQ ID NO: 501227 - DNA, 25 bp, Mus musculus
aacaggagagtggagtgaacccatc

SEQ ID NO: 501228 - DNA, 25 bp, Mus musculus
aacaggagcagtccgaccccaagag

SEQ ID NO: 501229 - DNA, 25 bp, Mus musculus
aacaggagcagtgcgaccccaagag

SEQ ID NO: 501230 - DNA, 25 bp, Mus musculus
aacaggagctcacggcgcctacgac

SEQ ID NO: 501231 - DNA, 25 bp, Mus musculus
aacaggagctcagggcgcctacgac

SEQ ID NO: 501232 - DNA, 25 bp, Mus musculus
aacaggaggagaacctaaggcccga

SEQ ID NO: 501233 - DNA, 25 bp, Mus musculus
aacaggaggagatcctaaggcccga

SEQ ID NO: 501234 - DNA, 25 bp, Mus musculus
aacaggagggctagggacttgctca

SEQ ID NO: 501235 - DNA, 25 bp, Mus musculus
aacaggagggcttgggacttgctca

SEQ ID NO: 501236 - DNA, 25 bp, Mus musculus
aacaggagggtgaccgggcatccca

SEQ ID NO: 501237 - DNA, 25 bp, Mus musculus
aacaggagggtgtccgggcatccca

SEQ ID NO: 501238 - DNA, 25 bp, Mus musculus
aacaggaggtatactacctaattcg

SEQ ID NO: 501239 - DNA, 25 bp, Mus musculus
aacaggaggtattctacctaattcg

SEQ ID NO: 501240 - DNA, 25 bp, Mus musculus
aacaggagtcttcgacgtcacacca

SEQ ID NO: 501241 - DNA, 25 bp, Mus musculus
aacaggagtcttggacgtcacacca

SEQ ID NO: 501242 - DNA, 25 bp, Mus musculus
aacaggataggaacatgggctgctg

SEQ ID NO: 501243 - DNA, 25 bp, Mus musculus
aacaggataggatcatgggctgctg

SEQ ID NO: 501244 - DNA, 25 bp, Mus musculus
aacaggatatcaaggcgtcctctcc

SEQ ID NO: 501245 - DNA, 25 bp, Mus musculus
aacaggatatcatggcgtcctctcc

SEQ ID NO: 501246 - DNA, 25 bp, Mus musculus
aacaggatgctgatctaatcgtggc

SEQ ID NO: 501247 - DNA, 25 bp, Mus musculus
aacaggatgctgttctaatcgtggc

SEQ ID NO: 501248 - DNA, 25 bp, Mus musculus
aacaggcaccccagatttggagagc

SEQ ID NO: 501249 - DNA, 25 bp, Mus musculus
aacaggcacccctgatttggagagc

SEQ ID NO: 501250 - DNA, 25 bp, Mus musculus
aacaggcactggcaccagccaaaca

SEQ ID NO: 501251 - DNA, 25 bp, Mus musculus
aacaggcactgggaccagccaaaca

SEQ ID NO: 501252 - DNA, 25 bp, Mus musculus
aacaggcatgatctgttttctatgc

SEQ ID NO: 501253 - DNA, 25 bp, Mus musculus
aacaggcatgatgtgttttctatgc

SEQ ID NO: 501254 - DNA, 25 bp, Mus musculus
aacaggccatgaagatggtagtcac

SEQ ID NO: 501255 - DNA, 25 bp, Mus musculus
aacaggccatgatgatggtagtcac

SEQ ID NO: 501256 - DNA, 25 bp, Mus musculus
aacaggcggcagctctcagcctaga

SEQ ID NO: 501257 - DNA, 25 bp, Mus musculus
aacaggcggcaggtctcagcctaga

SEQ ID NO: 501258 - DNA, 25 bp, Mus musculus
aacaggcggtgcagtttttcagcgc

SEQ ID NO: 501259 - DNA, 25 bp, Mus musculus
aacaggcggtgctgtttttcagcgc

SEQ ID NO: 501260 - DNA, 25 bp, Mus musculus
aacaggctatccctgtgcggcagca

SEQ ID NO: 501261 - DNA, 25 bp, Mus musculus
aacaggctatccgtgtgcggcagca

SEQ ID NO: 501262 - DNA, 25 bp, Mus musculus
aacaggctcagtcccaaacagtcat

SEQ ID NO: 501263 - DNA, 25 bp, Mus musculus
aacaggctcagtgccaaacagtcat

SEQ ID NO: 501264 - DNA, 25 bp, Mus musculus
aacaggctggagatgttgcccatcc

SEQ ID NO: 501265 - DNA, 25 bp, Mus musculus
aacaggctggagttgttgcccatcc

SEQ ID NO: 501266 - DNA, 25 bp, Mus musculus
aacaggctggccagcccgcttcaag

SEQ ID NO: 501267 - DNA, 25 bp, Mus musculus
aacaggctggccagcgtgggctggc

SEQ ID NO: 501268 - DNA, 25 bp, Mus musculus
aacaggctggcctgcccgcttcaag

SEQ ID NO: 501269 - DNA, 25 bp, Mus musculus
aacaggctggcctgcgtgggctggc

SEQ ID NO: 501270 - DNA, 25 bp, Mus musculus
aacaggctggtcacagcccaaaacc

SEQ ID NO: 501271 - DNA, 25 bp, Mus musculus
aacaggctggtctcagcccaaaacc

SEQ ID NO: 501272 - DNA, 25 bp, Mus musculus
aacaggctggttctaccaggtctca

SEQ ID NO: 501273 - DNA, 25 bp, Mus musculus
aacaggctggttgtaccaggtctca

SEQ ID NO: 501274 - DNA, 25 bp, Mus musculus
aacaggctttgaaaacatacccagt

SEQ ID NO: 501275 - DNA, 25 bp, Mus musculus
aacaggctttgataacatacccagt

SEQ ID NO: 501276 - DNA, 25 bp, Mus musculus
aacagggacatccattccttctacc

SEQ ID NO: 501277 - DNA, 25 bp, Mus musculus
aacagggacatcgattccttctacc

SEQ ID NO: 501278 - DNA, 25 bp, Mus musculus
aacagggaccctcgtagaacattct

SEQ ID NO: 501279 - DNA, 25 bp, Mus musculus
aacagggaccctggtagaacattct

SEQ ID NO: 501280 - DNA, 25 bp, Mus musculus
aacagggatcaaaacatactgtgtg

SEQ ID NO: 501281 - DNA, 25 bp, Mus musculus
aacagggatcaatacatactgtgtg

SEQ ID NO: 501282 - DNA, 25 bp, Mus musculus
aacagggctgttcaaccaaaactca

SEQ ID NO: 501283 - DNA, 25 bp, Mus musculus
aacagggctgttgaaccaaaactca

SEQ ID NO: 501284 - DNA, 25 bp, Mus musculus
aacagggtctctaggtgtgaggccc

SEQ ID NO: 501285 - DNA, 25 bp, Mus musculus
aacagggtctcttggtgtgaggccc

SEQ ID NO: 501286 - DNA, 25 bp, Mus musculus
aacagggtgactatgagccaagaaa

SEQ ID NO: 501287 - DNA, 25 bp, Mus musculus
aacagggtgactttgagccaagaaa

SEQ ID NO: 501288 - DNA, 25 bp, Mus musculus
aacaggtaattgcaaccacagttct

SEQ ID NO: 501289 - DNA, 25 bp, Mus musculus
aacaggtaattggaaccacagttct

SEQ ID NO: 501290 - DNA, 25 bp, Mus musculus
aacaggtacaaccacattaccgcca

SEQ ID NO: 501291 - DNA, 25 bp, Mus musculus
aacaggtacaacgacattaccgcca

SEQ ID NO: 501292 - DNA, 25 bp, Mus musculus
aacaggtagccaagggcagaaagaa

SEQ ID NO: 501293 - DNA, 25 bp, Mus musculus
aacaggtagccatgggcagaaagaa

SEQ ID NO: 501294 - DNA, 25 bp, Mus musculus
aacaggtagctgctttcgtgaagga

SEQ ID NO: 501295 - DNA, 25 bp, Mus musculus
aacaggtagctggtttcgtgaagga

SEQ ID NO: 501296 - DNA, 25 bp, Mus musculus
aacaggtcctacacctgtggctgga

SEQ ID NO: 501297 - DNA, 25 bp, Mus musculus
aacaggtcctactcctgtggctgga

SEQ ID NO: 501298 - DNA, 25 bp, Mus musculus
aacaggtctggtcgatgccaagcaa

SEQ ID NO: 501299 - DNA, 25 bp, Mus musculus
aacaggtctggtggatgccaagcaa

SEQ ID NO: 501300 - DNA, 25 bp, Mus musculus
aacaggtgctgtagatctctccgat

SEQ ID NO: 501301 - DNA, 25 bp, Mus musculus
aacaggtgctgttgatctctccgat

SEQ ID NO: 501302 - DNA, 25 bp, Mus musculus
aacaggtggcgaactttgaaccttc

SEQ ID NO: 501303 - DNA, 25 bp, Mus musculus
aacaggtggcgatctttgaaccttc

SEQ ID NO: 501304 - DNA, 25 bp, Mus musculus
aacaggttctacatccaatggcaca

SEQ ID NO: 501305 - DNA, 25 bp, Mus musculus
aacaggttctacttccaatggcaca

SEQ ID NO: 501306 - DNA, 25 bp, Mus musculus
aacagtaatagcaggtggctcctga

SEQ ID NO: 501307 - DNA, 25 bp, Mus musculus
aacagtaatagctggtggctcctga

SEQ ID NO: 501308 - DNA, 25 bp, Mus musculus
aacagtacacggacttctaagaggg

SEQ ID NO: 501309 - DNA, 25 bp, Mus musculus
aacagtacacggtcttctaagaggg

SEQ ID NO: 501310 - DNA, 25 bp, Mus musculus
aacagtacagtcaactcctctcagg

SEQ ID NO: 501311 - DNA, 25 bp, Mus musculus
aacagtacagtctactcctctcagg

SEQ ID NO: 501312 - DNA, 25 bp, Mus musculus
aacagtactacaagggagcggaggc

SEQ ID NO: 501313 - DNA, 25 bp, Mus musculus
aacagtactacatgggagcggaggc

SEQ ID NO: 501314 - DNA, 25 bp, Mus musculus
aacagtactctgatcatcagcaaca

SEQ ID NO: 501315 - DNA, 25 bp, Mus musculus
aacagtactctgttcatcagcaaca

SEQ ID NO: 501316 - DNA, 25 bp, Mus musculus
aacagtagtaataggctcaggttta

SEQ ID NO: 501317 - DNA, 25 bp, Mus musculus
aacagtagtaattggctcaggttta

SEQ ID NO: 501318 - DNA, 25 bp, Mus musculus
aacagtatctgcagtccatcgagga

SEQ ID NO: 501319 - DNA, 25 bp, Mus musculus
aacagtatctgctgtccatcgagga

SEQ ID NO: 501320 - DNA, 25 bp, Mus musculus
aacagtatgcagacgtttcgggagc

SEQ ID NO: 501321 - DNA, 25 bp, Mus musculus
aacagtatgcagtcgtttcgggagc

SEQ ID NO: 501322 - DNA, 25 bp, Mus musculus
aacagtcactatatgacatgagtac

SEQ ID NO: 501323 - DNA, 25 bp, Mus musculus
aacagtcactatttgacatgagtac

SEQ ID NO: 501324 - DNA, 25 bp, Mus musculus
aacagtcctttccacgtctctcagt

SEQ ID NO: 501325 - DNA, 25 bp, Mus musculus
aacagtcctttcgacgtctctcagt

SEQ ID NO: 501326 - DNA, 25 bp, Mus musculus
aacagtcggcagattgatgatgtcc

SEQ ID NO: 501327 - DNA, 25 bp, Mus musculus
aacagtcggcagtttgatgatgtcc

SEQ ID NO: 501328 - DNA, 25 bp, Mus musculus
aacagtcggtggcaaacaaaagcat

SEQ ID NO: 501329 - DNA, 25 bp, Mus musculus
aacagtcggtgggaaacaaaagcat

SEQ ID NO: 501330 - DNA, 25 bp, Mus musculus
aacagtcgtcctccggagaaaggtc

SEQ ID NO: 501331 - DNA, 25 bp, Mus musculus
aacagtcgtcctgcggagaaaggtc

SEQ ID NO: 501332 - DNA, 25 bp, Mus musculus
aacagtcgttctcgccgctttgctg

SEQ ID NO: 501333 - DNA, 25 bp, Mus musculus
aacagtcgttctggccgctttgctg

SEQ ID NO: 501334 - DNA, 25 bp, Mus musculus
aacagtctatttactccaaaggatt

SEQ ID NO: 501335 - DNA, 25 bp, Mus musculus
aacagtctatttcggcgaatcttga

SEQ ID NO: 501336 - DNA, 25 bp, Mus musculus
aacagtctatttgggcgaatcttga

SEQ ID NO: 501337 - DNA, 25 bp, Mus musculus
aacagtctattttctccaaaggatt

SEQ ID NO: 501338 - DNA, 25 bp, Mus musculus
aacagtctgcacacagcacaccgtg

SEQ ID NO: 501339 - DNA, 25 bp, Mus musculus
aacagtctgcactcagcacaccgtg

SEQ ID NO: 501340 - DNA, 25 bp, Mus musculus
aacagtctggaacctagtcctcggc

SEQ ID NO: 501341 - DNA, 25 bp, Mus musculus
aacagtctggaagctagtcctcggc

SEQ ID NO: 501342 - DNA, 25 bp, Mus musculus
aacagtctgggcacggtaaaggatt

SEQ ID NO: 501343 - DNA, 25 bp, Mus musculus
aacagtctgggctcggtaaaggatt

SEQ ID NO: 501344 - DNA, 25 bp, Mus musculus
aacagtgagtaaccacgtgtacctg

SEQ ID NO: 501345 - DNA, 25 bp, Mus musculus
aacagtgagtaagcacgtgtacctg

SEQ ID NO: 501346 - DNA, 25 bp, Mus musculus
aacagtgccggtacggtgcgtaaca

SEQ ID NO: 501347 - DNA, 25 bp, Mus musculus
aacagtgccggttcggtgcgtaaca

SEQ ID NO: 501348 - DNA, 25 bp, Mus musculus
aacagtggcgaacactcagatctca

SEQ ID NO: 501349 - DNA, 25 bp, Mus musculus
aacagtggcgaagactcagatctca

SEQ ID NO: 501350 - DNA, 25 bp, Mus musculus
aacagtggcgcaacattcaagtgca

SEQ ID NO: 501351 - DNA, 25 bp, Mus musculus
aacagtggcgcatcattcaagtgca

SEQ ID NO: 501352 - DNA, 25 bp, Mus musculus
aacagtggctgcctcaggtcacaac

SEQ ID NO: 501353 - DNA, 25 bp, Mus musculus
aacagtggctgcgtcaggtcacaac

SEQ ID NO: 501354 - DNA, 25 bp, Mus musculus
aacagtgggtgtcaacagttactac

SEQ ID NO: 501355 - DNA, 25 bp, Mus musculus
aacagtgggtgtgaacagttactac

SEQ ID NO: 501356 - DNA, 25 bp, Mus musculus
aacagtgtaacaattgtggctgagc

SEQ ID NO: 501357 - DNA, 25 bp, Mus musculus
aacagtgtaacatttgtggctgagc

SEQ ID NO: 501358 - DNA, 25 bp, Mus musculus
aacagtgtctctcagtgggtccaac

SEQ ID NO: 501359 - DNA, 25 bp, Mus musculus
aacagtgtctctgagtgggtccaac

SEQ ID NO: 501360 - DNA, 25 bp, Mus musculus
aacagtgtggcaaccgccctggaag

SEQ ID NO: 501361 - DNA, 25 bp, Mus musculus
aacagtgtggcatccgccctggaag

SEQ ID NO: 501362 - DNA, 25 bp, Mus musculus
aacagtgtggctagcagcctggcag

SEQ ID NO: 501363 - DNA, 25 bp, Mus musculus
aacagtgtggcttgcagcctggcag

SEQ ID NO: 501364 - DNA, 25 bp, Mus musculus
aacagtgtgtcaaccgcatcattac

SEQ ID NO: 501365 - DNA, 25 bp, Mus musculus
aacagtgtgtcatccgcatcattac

SEQ ID NO: 501366 - DNA, 25 bp, Mus musculus
aacagttagcatagccaggaccagc

SEQ ID NO: 501367 - DNA, 25 bp, Mus musculus
aacagttagcattgccaggaccagc

SEQ ID NO: 501368 - DNA, 25 bp, Mus musculus
aacagttccaagcagtagtgcagca

SEQ ID NO: 501369 - DNA, 25 bp, Mus musculus
aacagttccaaggagtagtgcagca

SEQ ID NO: 501370 - DNA, 25 bp, Mus musculus
aacagttctgcacgtcaccacggga

SEQ ID NO: 501371 - DNA, 25 bp, Mus musculus
aacagttctgcaggtcaccacggga

SEQ ID NO: 501372 - DNA, 25 bp, Mus musculus
aacagttcttcaagcccttagtgag

SEQ ID NO: 501373 - DNA, 25 bp, Mus musculus
aacagttcttcatgcccttagtgag

SEQ ID NO: 501374 - DNA, 25 bp, Mus musculus
aacagttgactgctatgtggctgtc

SEQ ID NO: 501375 - DNA, 25 bp, Mus musculus
aacagttgactggtatgtggctgtc

SEQ ID NO: 501376 - DNA, 25 bp, Mus musculus
aacagttggctccacaggcactaga

SEQ ID NO: 501377 - DNA, 25 bp, Mus musculus
aacagttggctcgacaggcactaga

SEQ ID NO: 501378 - DNA, 25 bp, Mus musculus
aacagtttgagccactggagcagga

SEQ ID NO: 501379 - DNA, 25 bp, Mus musculus
aacagtttgagcgactggagcagga

SEQ ID NO: 501380 - DNA, 25 bp, Mus musculus
aacagtttgataaaactccgtggca

SEQ ID NO: 501381 - DNA, 25 bp, Mus musculus
aacagtttgatataactccgtggca

SEQ ID NO: 501382 - DNA, 25 bp, Mus musculus
aacagtttggatcccagcgagaagg

SEQ ID NO: 501383 - DNA, 25 bp, Mus musculus
aacagtttggatgccagcgagaagg

SEQ ID NO: 501384 - DNA, 25 bp, Mus musculus
aacagtttgggcagattgaagcagg

SEQ ID NO: 501385 - DNA, 25 bp, Mus musculus
aacagtttgggctgattgaagcagg

SEQ ID NO: 501386 - DNA, 25 bp, Mus musculus
aacagtttgtagctggagaccgcgc

SEQ ID NO: 501387 - DNA, 25 bp, Mus musculus
aacagtttgtaggtggagaccgcgc

SEQ ID NO: 501388 - DNA, 25 bp, Mus musculus
aacataagcataatagtcccgatga

SEQ ID NO: 501389 - DNA, 25 bp, Mus musculus
aacataagcatattagtcccgatga

SEQ ID NO: 501390 - DNA, 25 bp, Mus musculus
aacataaggatgactaaccaggcca

SEQ ID NO: 501391 - DNA, 25 bp, Mus musculus
aacataaggatgtctaaccaggcca

SEQ ID NO: 501392 - DNA, 25 bp, Mus musculus
aacataagtgtacggacagagttgt

SEQ ID NO: 501393 - DNA, 25 bp, Mus musculus
aacataagtgtagggacagagttgt

SEQ ID NO: 501394 - DNA, 25 bp, Mus musculus
aacataatgtgcacgctgacccctg

SEQ ID NO: 501395 - DNA, 25 bp, Mus musculus
aacataatgtgctcgctgacccctg

SEQ ID NO: 501396 - DNA, 25 bp, Mus musculus
aacatacccagtaaatactcctgaa

SEQ ID NO: 501397 - DNA, 25 bp, Mus musculus
aacatacccagttaatactcctgaa

SEQ ID NO: 501398 - DNA, 25 bp, Mus musculus
aacatactggtgcatgctgtcagcc

SEQ ID NO: 501399 - DNA, 25 bp, Mus musculus
aacatactggtggatgctgtcagcc

SEQ ID NO: 501400 - DNA, 25 bp, Mus musculus
aacatagaatcgcagcccctggagt

SEQ ID NO: 501401 - DNA, 25 bp, Mus musculus
aacatagaatcggagcccctggagt

SEQ ID NO: 501402 - DNA, 25 bp, Mus musculus
aacatagagaagcacattgctgcct

SEQ ID NO: 501403 - DNA, 25 bp, Mus musculus
aacatagagaaggacattgctgcct

SEQ ID NO: 501404 - DNA, 25 bp, Mus musculus
aacatagcagttaccagtggagccc

SEQ ID NO: 501405 - DNA, 25 bp, Mus musculus
aacatagcagtttccagtggagccc

SEQ ID NO: 501406 - DNA, 25 bp, Mus musculus
aacataggacttcaatgtgacagag

SEQ ID NO: 501407 - DNA, 25 bp, Mus musculus
aacataggacttgaatgtgacagag

SEQ ID NO: 501408 - DNA, 25 bp, Mus musculus
aacataggatgtattggcgagagat

SEQ ID NO: 501409 - DNA, 25 bp, Mus musculus
aacataggatgttttggcgagagat

SEQ ID NO: 501410 - DNA, 25 bp, Mus musculus
aacatagtgtcgacgtttctttctg

SEQ ID NO: 501411 - DNA, 25 bp, Mus musculus
aacatagtgtcgtcgtttctttctg

SEQ ID NO: 501412 - DNA, 25 bp, Mus musculus
aacatatactgcaccgcccagatac

SEQ ID NO: 501413 - DNA, 25 bp, Mus musculus
aacatatactgctccgcccagatac

SEQ ID NO: 501414 - DNA, 25 bp, Mus musculus
aacatatcgcgtacataatggacgg

SEQ ID NO: 501415 - DNA, 25 bp, Mus musculus
aacatatcgcgttcataatggacgg

SEQ ID NO: 501416 - DNA, 25 bp, Mus musculus
aacatatcgttgacggagtttgaaa

SEQ ID NO: 501417 - DNA, 25 bp, Mus musculus
aacatatcgttgtcggagtttgaaa

SEQ ID NO: 501418 - DNA, 25 bp, Mus musculus
aacatatgagctcgcattacaaact

SEQ ID NO: 501419 - DNA, 25 bp, Mus musculus
aacatatgagctggcattacaaact

SEQ ID NO: 501420 - DNA, 25 bp, Mus musculus
aacatatgctcaactgatggctccc

SEQ ID NO: 501421 - DNA, 25 bp, Mus musculus
aacatatgctcatctgatggctccc

SEQ ID NO: 501422 - DNA, 25 bp, Mus musculus
aacatattgggtaccgcttgacaac

SEQ ID NO: 501423 - DNA, 25 bp, Mus musculus
aacatattgggttccgcttgacaac

SEQ ID NO: 501424 - DNA, 25 bp, Mus musculus
aacatcaacgaaagtgcctccaacc

SEQ ID NO: 501425 - DNA, 25 bp, Mus musculus
aacatcaacgaatgtgcctccaacc

SEQ ID NO: 501426 - DNA, 25 bp, Mus musculus
aacatcacagtgcacattggacagc

SEQ ID NO: 501427 - DNA, 25 bp, Mus musculus
aacatcacagtggacattggacagc

SEQ ID NO: 501428 - DNA, 25 bp, Mus musculus
aacatcacatgcaggcgcccggcag

SEQ ID NO: 501429 - DNA, 25 bp, Mus musculus
aacatcacatgctggcgcccggcag

SEQ ID NO: 501430 - DNA, 25 bp, Mus musculus
aacatcaccatcatccgcattggca

SEQ ID NO: 501431 - DNA, 25 bp, Mus musculus
aacatcaccatcttccgcattggca

SEQ ID NO: 501432 - DNA, 25 bp, Mus musculus
aacatcacgtggactgagctcagcg

SEQ ID NO: 501433 - DNA, 25 bp, Mus musculus
aacatcacgtggtctgagctcagcg

SEQ ID NO: 501434 - DNA, 25 bp, Mus musculus
aacatcactgcgctgggcaggaccc

SEQ ID NO: 501435 - DNA, 25 bp, Mus musculus
aacatcactgcggtgggcaggaccc

SEQ ID NO: 501436 - DNA, 25 bp, Mus musculus
aacatcagaaccagggtgggcctca

SEQ ID NO: 501437 - DNA, 25 bp, Mus musculus
aacatcagaacctgggtgggcctca

SEQ ID NO: 501438 - DNA, 25 bp, Mus musculus
aacatcagattcaagtcagaccttt

SEQ ID NO: 501439 - DNA, 25 bp, Mus musculus
aacatcagattctagtcagaccttt

SEQ ID NO: 501440 - DNA, 25 bp, Mus musculus
aacatcagcctaactcctgaggagg

SEQ ID NO: 501441 - DNA, 25 bp, Mus musculus
aacatcagcctatctcctgaggagg

SEQ ID NO: 501442 - DNA, 25 bp, Mus musculus
aacatcagctctcgatacagaaagt

SEQ ID NO: 501443 - DNA, 25 bp, Mus musculus
aacatcagctctggatacagaaagt

SEQ ID NO: 501444 - DNA, 25 bp, Mus musculus
aacatcagggagataaattcaactc

SEQ ID NO: 501445 - DNA, 25 bp, Mus musculus
aacatcagggagttaaattcaactc

SEQ ID NO: 501446 - DNA, 25 bp, Mus musculus
aacatcatcatgaccgacgctgaca

SEQ ID NO: 501447 - DNA, 25 bp, Mus musculus
aacatcatcatgtccgacgctgaca

SEQ ID NO: 501448 - DNA, 25 bp, Mus musculus
aacatcatccaacactgagccagtc

SEQ ID NO: 501449 - DNA, 25 bp, Mus musculus
aacatcatccaagactgagccagtc

SEQ ID NO: 501450 - DNA, 25 bp, Mus musculus
aacatcatccagaaacttccttgga

SEQ ID NO: 501451 - DNA, 25 bp, Mus musculus
aacatcatccagtaacttccttgga

SEQ ID NO: 501452 - DNA, 25 bp, Mus musculus
aacatcatcccaatgagaaccccag

SEQ ID NO: 501453 - DNA, 25 bp, Mus musculus
aacatcatcccattgagaaccccag

SEQ ID NO: 501454 - DNA, 25 bp, Mus musculus
aacatcatctttacccagaagcgcc

SEQ ID NO: 501455 - DNA, 25 bp, Mus musculus
aacatcatcttttcccagaagcgcc

SEQ ID NO: 501456 - DNA, 25 bp, Mus musculus
aacatcatgaatccttcagctgatg

SEQ ID NO: 501457 - DNA, 25 bp, Mus musculus
aacatcatgaatgcttcagctgatg

SEQ ID NO: 501458 - DNA, 25 bp, Mus musculus
aacatcatgaggcagagtggctact

SEQ ID NO: 501459 - DNA, 25 bp, Mus musculus
aacatcatgagggagagtggctact

SEQ ID NO: 501460 - DNA, 25 bp, Mus musculus
aacatcatgcgacgctgtttggcca

SEQ ID NO: 501461 - DNA, 25 bp, Mus musculus
aacatcatgcgaggctgtttggcca

SEQ ID NO: 501462 - DNA, 25 bp, Mus musculus
aacatcatgtttcgtgaggggcccc

SEQ ID NO: 501463 - DNA, 25 bp, Mus musculus
aacatcatgtttggtgaggggcccc

SEQ ID NO: 501464 - DNA, 25 bp, Mus musculus
aacatcattcgccttggagaagaac

SEQ ID NO: 501465 - DNA, 25 bp, Mus musculus
aacatcattcgcgttggagaagaac

SEQ ID NO: 501466 - DNA, 25 bp, Mus musculus
aacatcattttcaccaacggtgacc

SEQ ID NO: 501467 - DNA, 25 bp, Mus musculus
aacatcattttctccaacggtgacc

SEQ ID NO: 501468 - DNA, 25 bp, Mus musculus
aacatccaaagtcctccgtggagac

SEQ ID NO: 501469 - DNA, 25 bp, Mus musculus
aacatccaaagtgctccgtggagac

SEQ ID NO: 501470 - DNA, 25 bp, Mus musculus
aacatccacatcagccttatgggag

SEQ ID NO: 501471 - DNA, 25 bp, Mus musculus
aacatccacatctgccttatgggag

SEQ ID NO: 501472 - DNA, 25 bp, Mus musculus
aacatccagataccacacagtttgt

SEQ ID NO: 501473 - DNA, 25 bp, Mus musculus
aacatccagatagcacacagtttgt

SEQ ID NO: 501474 - DNA, 25 bp, Mus musculus
aacatccagctgacatgccactctg

SEQ ID NO: 501475 - DNA, 25 bp, Mus musculus
aacatccagctgtcatgccactctg

SEQ ID NO: 501476 - DNA, 25 bp, Mus musculus
aacatcccaacccttggcagtgtgg

SEQ ID NO: 501477 - DNA, 25 bp, Mus musculus
aacatcccaaccgttggcagtgtgg

SEQ ID NO: 501478 - DNA, 25 bp, Mus musculus
aacatccccaagctgaaggctggct

SEQ ID NO: 501479 - DNA, 25 bp, Mus musculus
aacatccccaaggtgaaggctggct

SEQ ID NO: 501480 - DNA, 25 bp, Mus musculus
aacatccccatcatcttgcagtctg

SEQ ID NO: 501481 - DNA, 25 bp, Mus musculus
aacatccccatcttcttgcagtctg

SEQ ID NO: 501482 - DNA, 25 bp, Mus musculus
aacatccctcatcggcctattgtgg

SEQ ID NO: 501483 - DNA, 25 bp, Mus musculus
aacatccctcatgggcctattgtgg

SEQ ID NO: 501484 - DNA, 25 bp, Mus musculus
aacatccctccaaaagtcaagcctg

SEQ ID NO: 501485 - DNA, 25 bp, Mus musculus
aacatccctccataagtcaagcctg

SEQ ID NO: 501486 - DNA, 25 bp, Mus musculus
aacatccgaggtcgccgtgatgccc

SEQ ID NO: 501487 - DNA, 25 bp, Mus musculus
aacatccgaggtggccgtgatgccc

SEQ ID NO: 501488 - DNA, 25 bp, Mus musculus
aacatccggcaactgctgcacaact

SEQ ID NO: 501489 - DNA, 25 bp, Mus musculus
aacatccggcaagtgctgcacaact

SEQ ID NO: 501490 - DNA, 25 bp, Mus musculus
aacatccgtggtactttcggagtgc

SEQ ID NO: 501491 - DNA, 25 bp, Mus musculus
aacatccgtggttctttcggagtgc

SEQ ID NO: 501492 - DNA, 25 bp, Mus musculus
aacatccgtgttagacaatagcatc

SEQ ID NO: 501493 - DNA, 25 bp, Mus musculus
aacatccgtgtttgacaatagcatc

SEQ ID NO: 501494 - DNA, 25 bp, Mus musculus
aacatcctcttccatctctacgtga

SEQ ID NO: 501495 - DNA, 25 bp, Mus musculus
aacatcctcttcgatctctacgtga

SEQ ID NO: 501496 - DNA, 25 bp, Mus musculus
aacatccttagaaaattcctccagg

SEQ ID NO: 501497 - DNA, 25 bp, Mus musculus
aacatccttagataattcctccagg

SEQ ID NO: 501498 - DNA, 25 bp, Mus musculus
aacatcgaaatcctgtctttcatga

SEQ ID NO: 501499 - DNA, 25 bp, Mus musculus
aacatcgaaatcgtgtctttcatga

SEQ ID NO: 501500 - DNA, 25 bp, Mus musculus
aacatcgaagatccttacgttgcag

SEQ ID NO: 501501 - DNA, 25 bp, Mus musculus
aacatcgaagatgcttacgttgcag

SEQ ID NO: 501502 - DNA, 25 bp, Mus musculus
aacatcgactatcgctaccgcttcg

SEQ ID NO: 501503 - DNA, 25 bp, Mus musculus
aacatcgactatggctaccgcttcg

SEQ ID NO: 501504 - DNA, 25 bp, Mus musculus
aacatcgagatcacgcgccaggagc

SEQ ID NO: 501505 - DNA, 25 bp, Mus musculus
aacatcgagatctcgcgccaggagc

SEQ ID NO: 501506 - DNA, 25 bp, Mus musculus
aacatcgatcgacagactagccacg

SEQ ID NO: 501507 - DNA, 25 bp, Mus musculus
aacatcgatcgagagactagccacg

SEQ ID NO: 501508 - DNA, 25 bp, Mus musculus
aacatcgatgttcttttcccgcaca

SEQ ID NO: 501509 - DNA, 25 bp, Mus musculus
aacatcgatgttgttttcccgcaca

SEQ ID NO: 501510 - DNA, 25 bp, Mus musculus
aacatcgccaagacccatgatctgt

SEQ ID NO: 501511 - DNA, 25 bp, Mus musculus
aacatcgccaagtcccatgatctgt

SEQ ID NO: 501512 - DNA, 25 bp, Mus musculus
aacatcggaaccactgtcaccaaca

SEQ ID NO: 501513 - DNA, 25 bp, Mus musculus
aacatcggaacctctgtcaccaaca

SEQ ID NO: 501514 - DNA, 25 bp, Mus musculus
aacatcggagatcgtagtactggcc

SEQ ID NO: 501515 - DNA, 25 bp, Mus musculus
aacatcggagatggtagtactggcc

SEQ ID NO: 501516 - DNA, 25 bp, Mus musculus
aacatcgggaagcatcgagagctgc

SEQ ID NO: 501517 - DNA, 25 bp, Mus musculus
aacatcgggaaggatcgagagctgc

SEQ ID NO: 501518 - DNA, 25 bp, Mus musculus
aacatcgtcttccacactaagcctt

SEQ ID NO: 501519 - DNA, 25 bp, Mus musculus
aacatcgtcttcgacactaagcctt

SEQ ID NO: 501520 - DNA, 25 bp, Mus musculus
aacatcgtggcccaattgggatcga

SEQ ID NO: 501521 - DNA, 25 bp, Mus musculus
aacatcgtggccgaattgggatcga

SEQ ID NO: 501522 - DNA, 25 bp, Mus musculus
aacatctacagtcctaccaaaatcg

SEQ ID NO: 501523 - DNA, 25 bp, Mus musculus
aacatctacagtgctaccaaaatcg

SEQ ID NO: 501524 - DNA, 25 bp, Mus musculus
aacatctactataaggttgggctgc

SEQ ID NO: 501525 - DNA, 25 bp, Mus musculus
aacatctactattaggttgggctgc

SEQ ID NO: 501526 - DNA, 25 bp, Mus musculus
aacatctccttgcatttttattggc

SEQ ID NO: 501527 - DNA, 25 bp, Mus musculus
aacatctccttggatttttattggc

SEQ ID NO: 501528 - DNA, 25 bp, Mus musculus
aacatctctgctcactcagactggg

SEQ ID NO: 501529 - DNA, 25 bp, Mus musculus
aacatctctgctgactcagactggg

SEQ ID NO: 501530 - DNA, 25 bp, Mus musculus
aacatctctttcaacgacaagaagt

SEQ ID NO: 501531 - DNA, 25 bp, Mus musculus
aacatctctttctacgacaagaagt

SEQ ID NO: 501532 - DNA, 25 bp, Mus musculus
aacatctgaaggaatggcattcagc

SEQ ID NO: 501533 - DNA, 25 bp, Mus musculus
aacatctgaaggtatggcattcagc

SEQ ID NO: 501534 - DNA, 25 bp, Mus musculus
aacatctgggccctccgacagatcg

SEQ ID NO: 501535 - DNA, 25 bp, Mus musculus
aacatctgggccgtccgacagatcg

SEQ ID NO: 501536 - DNA, 25 bp, Mus musculus
aacatctgtctcaaagggatgggcc

SEQ ID NO: 501537 - DNA, 25 bp, Mus musculus
aacatctgtctctaagggatgggcc

SEQ ID NO: 501538 - DNA, 25 bp, Mus musculus
aacatctgtggcatctcctgtgaca

SEQ ID NO: 501539 - DNA, 25 bp, Mus musculus
aacatctgtggcttctcctgtgaca

SEQ ID NO: 501540 - DNA, 25 bp, Mus musculus
aacatcttagatcgcggtgcacctt

SEQ ID NO: 501541 - DNA, 25 bp, Mus musculus
aacatcttagatggcggtgcacctt

SEQ ID NO: 501542 - DNA, 25 bp, Mus musculus
aacatcttgaatcaggtctccaagc

SEQ ID NO: 501543 - DNA, 25 bp, Mus musculus
aacatcttgaatgaggtctccaagc

SEQ ID NO: 501544 - DNA, 25 bp, Mus musculus
aacatgaagagcacccggagcggtg

SEQ ID NO: 501545 - DNA, 25 bp, Mus musculus
aacatgaagagctcccggagcggtg

SEQ ID NO: 501546 - DNA, 25 bp, Mus musculus
aacatgaagcagatcatccgctacc

SEQ ID NO: 501547 - DNA, 25 bp, Mus musculus
aacatgaagcagttcatccgctacc

SEQ ID NO: 501548 - DNA, 25 bp, Mus musculus
aacatgaagtgacaggtgtgagcct

SEQ ID NO: 501549 - DNA, 25 bp, Mus musculus
aacatgaagtgagaggtgtgagcct

SEQ ID NO: 501550 - DNA, 25 bp, Mus musculus
aacatgacacacaacatcaagcacc

SEQ ID NO: 501551 - DNA, 25 bp, Mus musculus
aacatgacacactacatcaagcacc

SEQ ID NO: 501552 - DNA, 25 bp, Mus musculus
aacatgagaatgaggtgaacctaat

SEQ ID NO: 501553 - DNA, 25 bp, Mus musculus
aacatgagaatgtggtgaacctaat

SEQ ID NO: 501554 - DNA, 25 bp, Mus musculus
aacatgagccggcaacccttcagca

SEQ ID NO: 501555 - DNA, 25 bp, Mus musculus
aacatgagccgggaacccttcagca

SEQ ID NO: 501556 - DNA, 25 bp, Mus musculus
aacatgagcctcctcataatccaca

SEQ ID NO: 501557 - DNA, 25 bp, Mus musculus
aacatgagcctcgtcataatccaca

SEQ ID NO: 501558 - DNA, 25 bp, Mus musculus
aacatgagttctcagttcctgcgct

SEQ ID NO: 501559 - DNA, 25 bp, Mus musculus
aacatgagttctgagttcctgcgct

SEQ ID NO: 501560 - DNA, 25 bp, Mus musculus
aacatgataattcggatttaactcc

SEQ ID NO: 501561 - DNA, 25 bp, Mus musculus
aacatgataattgggatttaactcc

SEQ ID NO: 501562 - DNA, 25 bp, Mus musculus
aacatgatgagtctctcacaaacca

SEQ ID NO: 501563 - DNA, 25 bp, Mus musculus
aacatgatgagtgtctcacaaacca

SEQ ID NO: 501564 - DNA, 25 bp, Mus musculus
aacatgatgggcctggactcggaca

SEQ ID NO: 501565 - DNA, 25 bp, Mus musculus
aacatgatgggcgtggactcggaca

SEQ ID NO: 501566 - DNA, 25 bp, Mus musculus
aacatgatgtgacaggaaatgcccg

SEQ ID NO: 501567 - DNA, 25 bp, Mus musculus
aacatgatgtgagaggaaatgcccg

SEQ ID NO: 501568 - DNA, 25 bp, Mus musculus
aacatgattggtaactgagggagcc

SEQ ID NO: 501569 - DNA, 25 bp, Mus musculus
aacatgattggttactgagggagcc

SEQ ID NO: 501570 - DNA, 25 bp, Mus musculus
aacatgcactgtagagcggcgcaga

SEQ ID NO: 501571 - DNA, 25 bp, Mus musculus
aacatgcactgttgagcggcgcaga

SEQ ID NO: 501572 - DNA, 25 bp, Mus musculus
aacatgcaggtgaaggttcagagcg

SEQ ID NO: 501573 - DNA, 25 bp, Mus musculus
aacatgcaggtgtaggttcagagcg

SEQ ID NO: 501574 - DNA, 25 bp, Mus musculus
aacatgcccaagaggaacttccacc

SEQ ID NO: 501575 - DNA, 25 bp, Mus musculus
aacatgcccaagtggaacttccacc

SEQ ID NO: 501576 - DNA, 25 bp, Mus musculus
aacatgccttacctcatgatcccag

SEQ ID NO: 501577 - DNA, 25 bp, Mus musculus
aacatgccttacgtcatgatcccag

SEQ ID NO: 501578 - DNA, 25 bp, Mus musculus
aacatgcggaacctgtctcttctgc

SEQ ID NO: 501579 - DNA, 25 bp, Mus musculus
aacatgcggaacgtgtctcttctgc

SEQ ID NO: 501580 - DNA, 25 bp, Mus musculus
aacatgctctgtcccggctacttcg

SEQ ID NO: 501581 - DNA, 25 bp, Mus musculus
aacatgctctgtgccggctacttcg

SEQ ID NO: 501582 - DNA, 25 bp, Mus musculus
aacatgctggtccacattttcttgg

SEQ ID NO: 501583 - DNA, 25 bp, Mus musculus
aacatgctggtcgacattttcttgg

SEQ ID NO: 501584 - DNA, 25 bp, Mus musculus
aacatggatgtgatccctgtgttgc

SEQ ID NO: 501585 - DNA, 25 bp, Mus musculus
aacatggatgtgttccctgtgttgc

SEQ ID NO: 501586 - DNA, 25 bp, Mus musculus
aacatggcagagctctttgccgtgg

SEQ ID NO: 501587 - DNA, 25 bp, Mus musculus
aacatggcagaggtctttgccgtgg

SEQ ID NO: 501588 - DNA, 25 bp, Mus musculus
aacatggccgaactcggcgaggaca

SEQ ID NO: 501589 - DNA, 25 bp, Mus musculus
aacatggccgaagtcggcgaggaca

SEQ ID NO: 501590 - DNA, 25 bp, Mus musculus
aacatggccgctccctgatagaaga

SEQ ID NO: 501591 - DNA, 25 bp, Mus musculus
aacatggccgctgcctgatagaaga

SEQ ID NO: 501592 - DNA, 25 bp, Mus musculus
aacatggcggctccgacactcagct

SEQ ID NO: 501593 - DNA, 25 bp, Mus musculus
aacatggcggctgcgacactcagct

SEQ ID NO: 501594 - DNA, 25 bp, Mus musculus
aacatggctcttaatgccgacgtta

SEQ ID NO: 501595 - DNA, 25 bp, Mus musculus
aacatggctctttatgccgacgtta

SEQ ID NO: 501596 - DNA, 25 bp, Mus musculus
aacatgggaaaccacctgccgcttc

SEQ ID NO: 501597 - DNA, 25 bp, Mus musculus
aacatgggaaacgacctgccgcttc

SEQ ID NO: 501598 - DNA, 25 bp, Mus musculus
aacatgggaccacatcaggcaagcg

SEQ ID NO: 501599 - DNA, 25 bp, Mus musculus
aacatgggaccagatcaggcaagcg

SEQ ID NO: 501600 - DNA, 25 bp, Mus musculus
aacatgggcagtccccgaccaaaga

SEQ ID NO: 501601 - DNA, 25 bp, Mus musculus
aacatgggcagtgcccgaccaaaga

SEQ ID NO: 501602 - DNA, 25 bp, Mus musculus
aacatgggcctgctgaagcagtgcc

SEQ ID NO: 501603 - DNA, 25 bp, Mus musculus
aacatgggcctggtgaagcagtgcc

SEQ ID NO: 501604 - DNA, 25 bp, Mus musculus
aacatgggtaaaccgggagatagat

SEQ ID NO: 501605 - DNA, 25 bp, Mus musculus
aacatgggtaaagcgggagatagat

SEQ ID NO: 501606 - DNA, 25 bp, Mus musculus
aacatggtcctcctcgtgactgcgg

SEQ ID NO: 501607 - DNA, 25 bp, Mus musculus
aacatggtcctcgtcgtgactgcgg

SEQ ID NO: 501608 - DNA, 25 bp, Mus musculus
aacatggtgccaatctggcctccag

SEQ ID NO: 501609 - DNA, 25 bp, Mus musculus
aacatggtgccattctggcctccag

SEQ ID NO: 501610 - DNA, 25 bp, Mus musculus
aacatggtgcctatatctgagagac

SEQ ID NO: 501611 - DNA, 25 bp, Mus musculus
aacatggtgcctttatctgagagac

SEQ ID NO: 501612 - DNA, 25 bp, Mus musculus
aacatgtaagcacccttatcgacgc

SEQ ID NO: 501613 - DNA, 25 bp, Mus musculus
aacatgtaagcagccttatcgacgc

SEQ ID NO: 501614 - DNA, 25 bp, Mus musculus
aacatgtacagtagtgaaaaatgca

SEQ ID NO: 501615 - DNA, 25 bp, Mus musculus
aacatgtacagttgtgaaaaatgca

SEQ ID NO: 501616 - DNA, 25 bp, Mus musculus
aacatgtacctgaactttgccgaga

SEQ ID NO: 501617 - DNA, 25 bp, Mus musculus
aacatgtacctgtactttgccgaga

SEQ ID NO: 501618 - DNA, 25 bp, Mus musculus
aacatgtacgtcactggcagcaagg

SEQ ID NO: 501619 - DNA, 25 bp, Mus musculus
aacatgtacgtctctggcagcaagg

SEQ ID NO: 501620 - DNA, 25 bp, Mus musculus
aacatgtcaagtccgagccaaacct

SEQ ID NO: 501621 - DNA, 25 bp, Mus musculus
aacatgtcaagtgcgagccaaacct

SEQ ID NO: 501622 - DNA, 25 bp, Mus musculus
aacatgtctcctcatctacgacagg

SEQ ID NO: 501623 - DNA, 25 bp, Mus musculus
aacatgtctcctgatctacgacagg

SEQ ID NO: 501624 - DNA, 25 bp, Mus musculus
aacatgtgggcaaggagcctctgca

SEQ ID NO: 501625 - DNA, 25 bp, Mus musculus
aacatgtgggcatggagcctctgca

SEQ ID NO: 501626 - DNA, 25 bp, Mus musculus
aacatgttccagaccctcaagtacc

SEQ ID NO: 501627 - DNA, 25 bp, Mus musculus
aacatgttccagtccctcaagtacc

SEQ ID NO: 501628 - DNA, 25 bp, Mus musculus
aacatgttgaggcaagcaaagccca

SEQ ID NO: 501629 - DNA, 25 bp, Mus musculus
aacatgttgagggaagcaaagccca

SEQ ID NO: 501630 - DNA, 25 bp, Mus musculus
aacattacccggagtgggctgtcca

SEQ ID NO: 501631 - DNA, 25 bp, Mus musculus
aacattacccggtgtgggctgtcca

SEQ ID NO: 501632 - DNA, 25 bp, Mus musculus
aacattaggctgcatgcgaccttca

SEQ ID NO: 501633 - DNA, 25 bp, Mus musculus
aacattaggctggatgcgaccttca

SEQ ID NO: 501634 - DNA, 25 bp, Mus musculus
aacattaggtgtatctgcatggtcc

SEQ ID NO: 501635 - DNA, 25 bp, Mus musculus
aacattaggtgtttctgcatggtcc

SEQ ID NO: 501636 - DNA, 25 bp, Mus musculus
aacattagtgacactgaaagctggg

SEQ ID NO: 501637 - DNA, 25 bp, Mus musculus
aacattagtgactctgaaagctggg

SEQ ID NO: 501638 - DNA, 25 bp, Mus musculus
aacattataaaccactgctcaggtt

SEQ ID NO: 501639 - DNA, 25 bp, Mus musculus
aacattataaacgactgctcaggtt

SEQ ID NO: 501640 - DNA, 25 bp, Mus musculus
aacattataagcatgattggcatcg

SEQ ID NO: 501641 - DNA, 25 bp, Mus musculus
aacattataagcttgattggcatcg

SEQ ID NO: 501642 - DNA, 25 bp, Mus musculus
aacattatcaagaagaaggacaagg

SEQ ID NO: 501643 - DNA, 25 bp, Mus musculus
aacattatcaagtagaaggacaagg

SEQ ID NO: 501644 - DNA, 25 bp, Mus musculus
aacattatctgtcgtatcacatctg

SEQ ID NO: 501645 - DNA, 25 bp, Mus musculus
aacattatctgtggtatcacatctg

SEQ ID NO: 501646 - DNA, 25 bp, Mus musculus
aacattcaagctagccacctcccta

SEQ ID NO: 501647 - DNA, 25 bp, Mus musculus
aacattcaagcttgccacctcccta

SEQ ID NO: 501648 - DNA, 25 bp, Mus musculus
aacattcacgagctggcccgcaaga

SEQ ID NO: 501649 - DNA, 25 bp, Mus musculus
aacattcacgaggtggcccgcaaga

SEQ ID NO: 501650 - DNA, 25 bp, Mus musculus
aacattcactctatggagaagtgaa

SEQ ID NO: 501651 - DNA, 25 bp, Mus musculus
aacattcactctttggagaagtgaa

SEQ ID NO: 501652 - DNA, 25 bp, Mus musculus
aacattcagagcaaggacacccagc

SEQ ID NO: 501653 - DNA, 25 bp, Mus musculus
aacattcagagctaggacacccagc

SEQ ID NO: 501654 - DNA, 25 bp, Mus musculus
aacattccacggagaaggagaccaa

SEQ ID NO: 501655 - DNA, 25 bp, Mus musculus
aacattccacggtgaaggagaccaa

SEQ ID NO: 501656 - DNA, 25 bp, Mus musculus
aacattcccatcatcacggaactcg

SEQ ID NO: 501657 - DNA, 25 bp, Mus musculus
aacattcccatcttcacggaactcg

SEQ ID NO: 501658 - DNA, 25 bp, Mus musculus
aacattcgaaatcccaattccctgg

SEQ ID NO: 501659 - DNA, 25 bp, Mus musculus
aacattcgaaatgccaattccctgg

SEQ ID NO: 501660 - DNA, 25 bp, Mus musculus
aacattgacctgcactctcagagga

SEQ ID NO: 501661 - DNA, 25 bp, Mus musculus
aacattgacctggactctcagagga

SEQ ID NO: 501662 - DNA, 25 bp, Mus musculus
aacattgacgatcttgtgaacaaaa

SEQ ID NO: 501663 - DNA, 25 bp, Mus musculus
aacattgacgatgttgtgaacaaaa

SEQ ID NO: 501664 - DNA, 25 bp, Mus musculus
aacattgagccgagtgtcaggagct

SEQ ID NO: 501665 - DNA, 25 bp, Mus musculus
aacattgagccgtgtgtcaggagct

SEQ ID NO: 501666 - DNA, 25 bp, Mus musculus
aacattgaggctcaccatgacagca

SEQ ID NO: 501667 - DNA, 25 bp, Mus musculus
aacattgaggctgaccatgacagca

SEQ ID NO: 501668 - DNA, 25 bp, Mus musculus
aacattgagtcccttatggatccca

SEQ ID NO: 501669 - DNA, 25 bp, Mus musculus
aacattgagtccgttatggatccca

SEQ ID NO: 501670 - DNA, 25 bp, Mus musculus
aacattgagtgtaacgtctgcgggc

SEQ ID NO: 501671 - DNA, 25 bp, Mus musculus
aacattgagtgttacgtctgcgggc

SEQ ID NO: 501672 - DNA, 25 bp, Mus musculus
aacattgatgtcactgttgatctga

SEQ ID NO: 501673 - DNA, 25 bp, Mus musculus
aacattgatgtctctgttgatctga

SEQ ID NO: 501674 - DNA, 25 bp, Mus musculus
aacattgcaaatcaagacatgctca

SEQ ID NO: 501675 - DNA, 25 bp, Mus musculus
aacattgcaaatgaagacatgctca

SEQ ID NO: 501676 - DNA, 25 bp, Mus musculus
aacattgcaggcatggcccgccgct

SEQ ID NO: 501677 - DNA, 25 bp, Mus musculus
aacattgcaggcttggcccgccgct

SEQ ID NO: 501678 - DNA, 25 bp, Mus musculus
aacattgccggccacctgaaggacg

SEQ ID NO: 501679 - DNA, 25 bp, Mus musculus
aacattgccggcgacctgaaggacg

SEQ ID NO: 501680 - DNA, 25 bp, Mus musculus
aacattgcgctgaatgcgggcattg

SEQ ID NO: 501681 - DNA, 25 bp, Mus musculus
aacattgcgctgtatgcgggcattg

SEQ ID NO: 501682 - DNA, 25 bp, Mus musculus
aacattggcaaaagccaccagggcc

SEQ ID NO: 501683 - DNA, 25 bp, Mus musculus
aacattggcaaatgccaccagggcc

SEQ ID NO: 501684 - DNA, 25 bp, Mus musculus
aacattggcactaccactacagcca

SEQ ID NO: 501685 - DNA, 25 bp, Mus musculus
aacattggcacttccactacagcca

SEQ ID NO: 501686 - DNA, 25 bp, Mus musculus
aacattggtctgcttcacttcacag

SEQ ID NO: 501687 - DNA, 25 bp, Mus musculus
aacattggtctggttcacttcacag

SEQ ID NO: 501688 - DNA, 25 bp, Mus musculus
aacattgtacaactcaccaagccag

SEQ ID NO: 501689 - DNA, 25 bp, Mus musculus
aacattgtacaagtcaccaagccag

SEQ ID NO: 501690 - DNA, 25 bp, Mus musculus
aacattgtgaacaatggcattcctg

SEQ ID NO: 501691 - DNA, 25 bp, Mus musculus
aacattgtgaactatggcattcctg

SEQ ID NO: 501692 - DNA, 25 bp, Mus musculus
aacattgtgcacatggaagatcttt

SEQ ID NO: 501693 - DNA, 25 bp, Mus musculus
aacattgtgcacttggaagatcttt

SEQ ID NO: 501694 - DNA, 25 bp, Mus musculus
aacattgtggcaccgtataagatag

SEQ ID NO: 501695 - DNA, 25 bp, Mus musculus
aacattgtggcagcgtataagatag

SEQ ID NO: 501696 - DNA, 25 bp, Mus musculus
aacattttcctgacacccttgagca

SEQ ID NO: 501697 - DNA, 25 bp, Mus musculus
aacattttcctgtcacccttgagca

SEQ ID NO: 501698 - DNA, 25 bp, Mus musculus
aacattttcgaactcctcttctggg

SEQ ID NO: 501699 - DNA, 25 bp, Mus musculus
aacattttcgaagtcctcttctggg

SEQ ID NO: 501700 - DNA, 25 bp, Mus musculus
aacattttgcagctgattacctcag

SEQ ID NO: 501701 - DNA, 25 bp, Mus musculus
aacattttgcaggtgattacctcag

SEQ ID NO: 501702 - DNA, 25 bp, Mus musculus
aaccaaaaagacctcgttcagcata

SEQ ID NO: 501703 - DNA, 25 bp, Mus musculus
aaccaaaaagacgtcgttcagcata

SEQ ID NO: 501704 - DNA, 25 bp, Mus musculus
aaccaaaacgaaagatccatcactg

SEQ ID NO: 501705 - DNA, 25 bp, Mus musculus
aaccaaaacgaatgatccatcactg

SEQ ID NO: 501706 - DNA, 25 bp, Mus musculus
aaccaaacctgacgcctctgtggat

SEQ ID NO: 501707 - DNA, 25 bp, Mus musculus
aaccaaacctgaggcctctgtggat

SEQ ID NO: 501708 - DNA, 25 bp, Mus musculus
aaccaaaggcagcatcctcaccgtg

SEQ ID NO: 501709 - DNA, 25 bp, Mus musculus
aaccaaaggcaggatcctcaccgtg

SEQ ID NO: 501710 - DNA, 25 bp, Mus musculus
aaccaaatcatcaagagcctcaaag

SEQ ID NO: 501711 - DNA, 25 bp, Mus musculus
aaccaaatcatctagagcctcaaag

SEQ ID NO: 501712 - DNA, 25 bp, Mus musculus
aaccaaatgacacaggcacacaagc

SEQ ID NO: 501713 - DNA, 25 bp, Mus musculus
aaccaaatgacagaggcacacaagc

SEQ ID NO: 501714 - DNA, 25 bp, Mus musculus
aaccaaatgcatagtaattgttgac

SEQ ID NO: 501715 - DNA, 25 bp, Mus musculus
aaccaaatgcattgtaattgttgac

SEQ ID NO: 501716 - DNA, 25 bp, Mus musculus
aaccaacatgtcagagtgggagtcc

SEQ ID NO: 501717 - DNA, 25 bp, Mus musculus
aaccaacatgtctgagtgggagtcc

SEQ ID NO: 501718 - DNA, 25 bp, Mus musculus
aaccaacctgtaaatccgaggactg

SEQ ID NO: 501719 - DNA, 25 bp, Mus musculus
aaccaacctgtatatccgaggactg

SEQ ID NO: 501720 - DNA, 25 bp, Mus musculus
aaccaaccttctctgttctgcgtgg

SEQ ID NO: 501721 - DNA, 25 bp, Mus musculus
aaccaaccttctgtgttctgcgtgg

SEQ ID NO: 501722 - DNA, 25 bp, Mus musculus
aaccaactggccatcgtcattggca

SEQ ID NO: 501723 - DNA, 25 bp, Mus musculus
aaccaactggccttcgtcattggca

SEQ ID NO: 501724 - DNA, 25 bp, Mus musculus
aaccaagaattgacaccagtgaaga

SEQ ID NO: 501725 - DNA, 25 bp, Mus musculus
aaccaagaattgtcaccagtgaaga

SEQ ID NO: 501726 - DNA, 25 bp, Mus musculus
aaccaagaccccatgggcaagcagg

SEQ ID NO: 501727 - DNA, 25 bp, Mus musculus
aaccaagaccccttgggcaagcagg

SEQ ID NO: 501728 - DNA, 25 bp, Mus musculus
aaccaagatatccatgttttccgac

SEQ ID NO: 501729 - DNA, 25 bp, Mus musculus
aaccaagatatcgatgttttccgac

SEQ ID NO: 501730 - DNA, 25 bp, Mus musculus
aaccaagcacggaggacactgggac

SEQ ID NO: 501731 - DNA, 25 bp, Mus musculus
aaccaagcacggtggacactgggac

SEQ ID NO: 501732 - DNA, 25 bp, Mus musculus
aaccaagccaagacatatagagcag

SEQ ID NO: 501733 - DNA, 25 bp, Mus musculus
aaccaagccaagtcatatagagcag

SEQ ID NO: 501734 - DNA, 25 bp, Mus musculus
aaccaagcgatgataaataagctgg

SEQ ID NO: 501735 - DNA, 25 bp, Mus musculus
aaccaagcgatgttaaataagctgg

SEQ ID NO: 501736 - DNA, 25 bp, Mus musculus
aaccaaggaactcgggaccgtcatg

SEQ ID NO: 501737 - DNA, 25 bp, Mus musculus
aaccaaggaactggggaccgtcatg

SEQ ID NO: 501738 - DNA, 25 bp, Mus musculus
aaccaaggacctatgcgtacagaag

SEQ ID NO: 501739 - DNA, 25 bp, Mus musculus
aaccaaggacctttgcgtacagaag

SEQ ID NO: 501740 - DNA, 25 bp, Mus musculus
aaccaaggagatacagactcctgag

SEQ ID NO: 501741 - DNA, 25 bp, Mus musculus
aaccaaggagattcagactcctgag

SEQ ID NO: 501742 - DNA, 25 bp, Mus musculus
aaccaaggcaccacgctggcgtgga

SEQ ID NO: 501743 - DNA, 25 bp, Mus musculus
aaccaaggcacctcgctggcgtgga

SEQ ID NO: 501744 - DNA, 25 bp, Mus musculus
aaccaagggtacctagaagagcatc

SEQ ID NO: 501745 - DNA, 25 bp, Mus musculus
aaccaagggtacgtagaagagcatc

SEQ ID NO: 501746 - DNA, 25 bp, Mus musculus
aaccaagggtggactggcctctgga

SEQ ID NO: 501747 - DNA, 25 bp, Mus musculus
aaccaagggtggtctggcctctgga

SEQ ID NO: 501748 - DNA, 25 bp, Mus musculus
aaccaagtctagaggcaaaagaact

SEQ ID NO: 501749 - DNA, 25 bp, Mus musculus
aaccaagtctagagtgggcctaggg

SEQ ID NO: 501750 - DNA, 25 bp, Mus musculus
aaccaagtctagtggcaaaagaact

SEQ ID NO: 501751 - DNA, 25 bp, Mus musculus
aaccaagtctagtgtgggcctaggg

SEQ ID NO: 501752 - DNA, 25 bp, Mus musculus
aaccaagtgtttcaggccaagtgcc

SEQ ID NO: 501753 - DNA, 25 bp, Mus musculus
aaccaagtgtttgaggccaagtgcc

SEQ ID NO: 501754 - DNA, 25 bp, Mus musculus
aaccaagttgtgatactagatacac

SEQ ID NO: 501755 - DNA, 25 bp, Mus musculus
aaccaagttgtgttactagatacac

SEQ ID NO: 501756 - DNA, 25 bp, Mus musculus
aaccaatctcttccggagtcccaga

SEQ ID NO: 501757 - DNA, 25 bp, Mus musculus
aaccaatctcttgcggagtcccaga

SEQ ID NO: 501758 - DNA, 25 bp, Mus musculus
aaccaatctgcaccctatgtctcag

SEQ ID NO: 501759 - DNA, 25 bp, Mus musculus
aaccaatctgcagcctatgtctcag

SEQ ID NO: 501760 - DNA, 25 bp, Mus musculus
aaccaatgacttcaagaacctgaga

SEQ ID NO: 501761 - DNA, 25 bp, Mus musculus
aaccaatgacttgaagaacctgaga

SEQ ID NO: 501762 - DNA, 25 bp, Mus musculus
aaccaatgatgtagggttcacctac

SEQ ID NO: 501763 - DNA, 25 bp, Mus musculus
aaccaatgatgttgggttcacctac

SEQ ID NO: 501764 - DNA, 25 bp, Mus musculus
aaccaatggtctcgactttcagaaa

SEQ ID NO: 501765 - DNA, 25 bp, Mus musculus
aaccaatggtctggactttcagaaa

SEQ ID NO: 501766 - DNA, 25 bp, Mus musculus
aaccaatggttcacgaattgaaatc

SEQ ID NO: 501767 - DNA, 25 bp, Mus musculus
aaccaatggttctcgaattgaaatc

SEQ ID NO: 501768 - DNA, 25 bp, Mus musculus
aaccaatttctcctgcaaaccaggg

SEQ ID NO: 501769 - DNA, 25 bp, Mus musculus
aaccaatttctcgtgcaaaccaggg

SEQ ID NO: 501770 - DNA, 25 bp, Mus musculus
aaccacaaaagcaggccttcttgag

SEQ ID NO: 501771 - DNA, 25 bp, Mus musculus
aaccacaaaagctggccttcttgag

SEQ ID NO: 501772 - DNA, 25 bp, Mus musculus
aaccacacaatgcaagtggaaatag

SEQ ID NO: 501773 - DNA, 25 bp, Mus musculus
aaccacacaatggaagtggaaatag

SEQ ID NO: 501774 - DNA, 25 bp, Mus musculus
aaccacactgtgaaccgcatctcag

SEQ ID NO: 501775 - DNA, 25 bp, Mus musculus
aaccacactgtgagtgatgtgccaa

SEQ ID NO: 501776 - DNA, 25 bp, Mus musculus
aaccacactgtgtaccgcatctcag

SEQ ID NO: 501777 - DNA, 25 bp, Mus musculus
aaccacactgtgtgtgatgtgccaa

SEQ ID NO: 501778 - DNA, 25 bp, Mus musculus
aaccacagaaaacctaaaggagtca

SEQ ID NO: 501779 - DNA, 25 bp, Mus musculus
aaccacagaaaagctaaaggagtca

SEQ ID NO: 501780 - DNA, 25 bp, Mus musculus
aaccacataggaagacatccaactg

SEQ ID NO: 501781 - DNA, 25 bp, Mus musculus
aaccacataggatgacatccaactg

SEQ ID NO: 501782 - DNA, 25 bp, Mus musculus
aaccacatcaacagaaggaggtgca

SEQ ID NO: 501783 - DNA, 25 bp, Mus musculus
aaccacatcaactgaaggaggtgca

SEQ ID NO: 501784 - DNA, 25 bp, Mus musculus
aaccacatctctcggactctgaagg

SEQ ID NO: 501785 - DNA, 25 bp, Mus musculus
aaccacatctctgggactctgaagg

SEQ ID NO: 501786 - DNA, 25 bp, Mus musculus
aaccaccaacccagaaccatggaag

SEQ ID NO: 501787 - DNA, 25 bp, Mus musculus
aaccaccaaccctgaaccatggaag

SEQ ID NO: 501788 - DNA, 25 bp, Mus musculus
aaccaccacttcctgtgatgccagg

SEQ ID NO: 501789 - DNA, 25 bp, Mus musculus
aaccaccacttcgtgtgatgccagg

SEQ ID NO: 501790 - DNA, 25 bp, Mus musculus
aaccaccaggctaaagtgtctcagc

SEQ ID NO: 501791 - DNA, 25 bp, Mus musculus
aaccaccaggcttaagtgtctcagc

SEQ ID NO: 501792 - DNA, 25 bp, Mus musculus
aaccaccagtctagcatggatgacc

SEQ ID NO: 501793 - DNA, 25 bp, Mus musculus
aaccaccagtcttgcatggatgacc

SEQ ID NO: 501794 - DNA, 25 bp, Mus musculus
aaccaccatcaaagctgaaccaggc

SEQ ID NO: 501795 - DNA, 25 bp, Mus musculus
aaccaccatcaatgctgaaccaggc

SEQ ID NO: 501796 - DNA, 25 bp, Mus musculus
aaccaccctgggaggaaggcacacg

SEQ ID NO: 501797 - DNA, 25 bp, Mus musculus
aaccaccctgggtggaaggcacacg

SEQ ID NO: 501798 - DNA, 25 bp, Mus musculus
aaccacctgcgcagtgagaagctca

SEQ ID NO: 501799 - DNA, 25 bp, Mus musculus
aaccacctgcgctgtgagaagctca

SEQ ID NO: 501800 - DNA, 25 bp, Mus musculus
aaccacgaaatgactaatcaggagt

SEQ ID NO: 501801 - DNA, 25 bp, Mus musculus
aaccacgaaatgtctaatcaggagt

SEQ ID NO: 501802 - DNA, 25 bp, Mus musculus
aaccacgaagtaagctttcacgagt

SEQ ID NO: 501803 - DNA, 25 bp, Mus musculus
aaccacgaagtatgctttcacgagt

SEQ ID NO: 501804 - DNA, 25 bp, Mus musculus
aaccacgagttccatgccaagtgtg

SEQ ID NO: 501805 - DNA, 25 bp, Mus musculus
aaccacgagttcgatgccaagtgtg

SEQ ID NO: 501806 - DNA, 25 bp, Mus musculus
aaccacgccacgacacaagcaggag

SEQ ID NO: 501807 - DNA, 25 bp, Mus musculus
aaccacgccacgtcacaagcaggag

SEQ ID NO: 501808 - DNA, 25 bp, Mus musculus
aaccacgccctacaagagtcaacat

SEQ ID NO: 501809 - DNA, 25 bp, Mus musculus
aaccacgccctagaagagtcaacat

SEQ ID NO: 501810 - DNA, 25 bp, Mus musculus
aaccacgcctgactggcgcagggct

SEQ ID NO: 501811 - DNA, 25 bp, Mus musculus
aaccacgcctgagtggcgcagggct

SEQ ID NO: 501812 - DNA, 25 bp, Mus musculus
aaccacgtcaaaatgacaacccaga

SEQ ID NO: 501813 - DNA, 25 bp, Mus musculus
aaccacgtcaaattgacaacccaga

SEQ ID NO: 501814 - DNA, 25 bp, Mus musculus
aaccactagatgactgccagaaact

SEQ ID NO: 501815 - DNA, 25 bp, Mus musculus
aaccactagatgtctgccagaaact

SEQ ID NO: 501816 - DNA, 25 bp, Mus musculus
aaccactcctagatgcagtcctggc

SEQ ID NO: 501817 - DNA, 25 bp, Mus musculus
aaccactcctagttgcagtcctggc

SEQ ID NO: 501818 - DNA, 25 bp, Mus musculus
aaccactggaggctgaaattcagca

SEQ ID NO: 501819 - DNA, 25 bp, Mus musculus
aaccactggagggtgaaattcagca

SEQ ID NO: 501820 - DNA, 25 bp, Mus musculus
aaccactgtggacttgccaccgcgg

SEQ ID NO: 501821 - DNA, 25 bp, Mus musculus
aaccactgtggagttgccaccgcgg

SEQ ID NO: 501822 - DNA, 25 bp, Mus musculus
aaccacttggcgagggctgcttcgg

SEQ ID NO: 501823 - DNA, 25 bp, Mus musculus
aaccacttggcgtgggctgcttcgg

SEQ ID NO: 501824 - DNA, 25 bp, Mus musculus
aaccagaaaagtatgtgaacagagc

SEQ ID NO: 501825 - DNA, 25 bp, Mus musculus
aaccagaaaagtttgtgaacagagc

SEQ ID NO: 501826 - DNA, 25 bp, Mus musculus
aaccagaagctacagcgcctgggcc

SEQ ID NO: 501827 - DNA, 25 bp, Mus musculus
aaccagaagctacggctctctccta

SEQ ID NO: 501828 - DNA, 25 bp, Mus musculus
aaccagaagctagagcgcctgggcc

SEQ ID NO: 501829 - DNA, 25 bp, Mus musculus
aaccagaagctagggctctctccta

SEQ ID NO: 501830 - DNA, 25 bp, Mus musculus
aaccagaccgaacgcctattgaggc

SEQ ID NO: 501831 - DNA, 25 bp, Mus musculus
aaccagaccgaaggcctattgaggc

SEQ ID NO: 501832 - DNA, 25 bp, Mus musculus
aaccagactagcatctctcagtggg

SEQ ID NO: 501833 - DNA, 25 bp, Mus musculus
aaccagactagcttctctcagtggg

SEQ ID NO: 501834 - DNA, 25 bp, Mus musculus
aaccagactggcctgtttcctgcca

SEQ ID NO: 501835 - DNA, 25 bp, Mus musculus
aaccagactggcgtgtttcctgcca

SEQ ID NO: 501836 - DNA, 25 bp, Mus musculus
aaccagagaaccaggacattgactg

SEQ ID NO: 501837 - DNA, 25 bp, Mus musculus
aaccagagaacctggacattgactg

SEQ ID NO: 501838 - DNA, 25 bp, Mus musculus
aaccagagccatctaagtaagcccc

SEQ ID NO: 501839 - DNA, 25 bp, Mus musculus
aaccagagccatgtaagtaagcccc

SEQ ID NO: 501840 - DNA, 25 bp, Mus musculus
aaccagagcgtgcaggctgccttgc

SEQ ID NO: 501841 - DNA, 25 bp, Mus musculus
aaccagagcgtggaggctgccttgc

SEQ ID NO: 501842 - DNA, 25 bp, Mus musculus
aaccagagctatcagggcagcagcg

SEQ ID NO: 501843 - DNA, 25 bp, Mus musculus
aaccagagctatgagggcagcagcg

SEQ ID NO: 501844 - DNA, 25 bp, Mus musculus
aaccagagctgccagtggtgccaga

SEQ ID NO: 501845 - DNA, 25 bp, Mus musculus
aaccagagctgcgagtggtgccaga

SEQ ID NO: 501846 - DNA, 25 bp, Mus musculus
aaccagaggaagacatcccatcccg

SEQ ID NO: 501847 - DNA, 25 bp, Mus musculus
aaccagaggaagtcatcccatcccg

SEQ ID NO: 501848 - DNA, 25 bp, Mus musculus
aaccagaggactagcaatatgacag

SEQ ID NO: 501849 - DNA, 25 bp, Mus musculus
aaccagaggactatccaacctccta

SEQ ID NO: 501850 - DNA, 25 bp, Mus musculus
aaccagaggacttgcaatatgacag

SEQ ID NO: 501851 - DNA, 25 bp, Mus musculus
aaccagaggactttccaacctccta

SEQ ID NO: 501852 - DNA, 25 bp, Mus musculus
aaccagagtccacagtgcctgagac

SEQ ID NO: 501853 - DNA, 25 bp, Mus musculus
aaccagagtccaccgattgtccaag

SEQ ID NO: 501854 - DNA, 25 bp, Mus musculus
aaccagagtccagagtgcctgagac

SEQ ID NO: 501855 - DNA, 25 bp, Mus musculus
aaccagagtccagcgattgtccaag

SEQ ID NO: 501856 - DNA, 25 bp, Mus musculus
aaccagatcaatcactcactacaac

SEQ ID NO: 501857 - DNA, 25 bp, Mus musculus
aaccagatcaatgactcactacaac

SEQ ID NO: 501858 - DNA, 25 bp, Mus musculus
aaccagatgtggactgcctagaacc

SEQ ID NO: 501859 - DNA, 25 bp, Mus musculus
aaccagatgtggtctgcctagaacc

SEQ ID NO: 501860 - DNA, 25 bp, Mus musculus
aaccagatttctcatcagccgaaag

SEQ ID NO: 501861 - DNA, 25 bp, Mus musculus
aaccagatttctgatcagccgaaag

SEQ ID NO: 501862 - DNA, 25 bp, Mus musculus
aaccagattttaacatgccgcggga

SEQ ID NO: 501863 - DNA, 25 bp, Mus musculus
aaccagattttatcatgccgcggga

SEQ ID NO: 501864 - DNA, 25 bp, Mus musculus
aaccagcaccgacctgttgatcaag

SEQ ID NO: 501865 - DNA, 25 bp, Mus musculus
aaccagcaccgagctgttgatcaag

SEQ ID NO: 501866 - DNA, 25 bp, Mus musculus
aaccagcacctgataagaccatgac

SEQ ID NO: 501867 - DNA, 25 bp, Mus musculus
aaccagcacctgttaagaccatgac

SEQ ID NO: 501868 - DNA, 25 bp, Mus musculus
aaccagcacgccagaggaccttgag

SEQ ID NO: 501869 - DNA, 25 bp, Mus musculus
aaccagcacgcctgaggaccttgag

SEQ ID NO: 501870 - DNA, 25 bp, Mus musculus
aaccagcacttacgtagtcatggag

SEQ ID NO: 501871 - DNA, 25 bp, Mus musculus
aaccagcacttaggtagtcatggag

SEQ ID NO: 501872 - DNA, 25 bp, Mus musculus
aaccagcagaccagcttctcggact

SEQ ID NO: 501873 - DNA, 25 bp, Mus musculus
aaccagcagacctgcttctcggact

SEQ ID NO: 501874 - DNA, 25 bp, Mus musculus
aaccagcaggctagtgcagtcccag

SEQ ID NO: 501875 - DNA, 25 bp, Mus musculus
aaccagcaggcttgtgcagtcccag

SEQ ID NO: 501876 - DNA, 25 bp, Mus musculus
aaccagcatcttcgagtcggctggg

SEQ ID NO: 501877 - DNA, 25 bp, Mus musculus
aaccagcatcttggagtcggctggg

SEQ ID NO: 501878 - DNA, 25 bp, Mus musculus
aaccagcattttcacggttttgtgg

SEQ ID NO: 501879 - DNA, 25 bp, Mus musculus
aaccagcattttgacggttttgtgg

SEQ ID NO: 501880 - DNA, 25 bp, Mus musculus
aaccagccagacactccgcaagaaa

SEQ ID NO: 501881 - DNA, 25 bp, Mus musculus
aaccagccagactctccgcaagaaa

SEQ ID NO: 501882 - DNA, 25 bp, Mus musculus
aaccagccagtcaccctgcagaaga

SEQ ID NO: 501883 - DNA, 25 bp, Mus musculus
aaccagccagtctccctgcagaaga

SEQ ID NO: 501884 - DNA, 25 bp, Mus musculus
aaccagccctatcagtggatttcct

SEQ ID NO: 501885 - DNA, 25 bp, Mus musculus
aaccagccctatgagtggatttcct

SEQ ID NO: 501886 - DNA, 25 bp, Mus musculus
aaccagccgggcacatacttctgct

SEQ ID NO: 501887 - DNA, 25 bp, Mus musculus
aaccagccgggctcatacttctgct

SEQ ID NO: 501888 - DNA, 25 bp, Mus musculus
aaccagcctgcaagaactggcacat

SEQ ID NO: 501889 - DNA, 25 bp, Mus musculus
aaccagcctgcatgaactggcacat

SEQ ID NO: 501890 - DNA, 25 bp, Mus musculus
aaccagcgtgaacctctaaatcgag

SEQ ID NO: 501891 - DNA, 25 bp, Mus musculus
aaccagcgtgaagctctaaatcgag

SEQ ID NO: 501892 - DNA, 25 bp, Mus musculus
aaccagctgaagctgactcctgggt

SEQ ID NO: 501893 - DNA, 25 bp, Mus musculus
aaccagctgaaggtgactcctgggt

SEQ ID NO: 501894 - DNA, 25 bp, Mus musculus
aaccagctgagtcagatggtgcagc

SEQ ID NO: 501895 - DNA, 25 bp, Mus musculus
aaccagctgagtgagatggtgcagc

SEQ ID NO: 501896 - DNA, 25 bp, Mus musculus
aaccagctggacctctgctacgaca

SEQ ID NO: 501897 - DNA, 25 bp, Mus musculus
aaccagctggacgtctgctacgaca

SEQ ID NO: 501898 - DNA, 25 bp, Mus musculus
aaccaggaccaccagaagctgttcg

SEQ ID NO: 501899 - DNA, 25 bp, Mus musculus
aaccaggaccacgagaagctgttcg

SEQ ID NO: 501900 - DNA, 25 bp, Mus musculus
aaccaggagtccagcccacctggga

SEQ ID NO: 501901 - DNA, 25 bp, Mus musculus
aaccaggagtcctgcccacctggga

SEQ ID NO: 501902 - DNA, 25 bp, Mus musculus
aaccaggccagacggtggagtctca

SEQ ID NO: 501903 - DNA, 25 bp, Mus musculus
aaccaggccagagggtggagtctca

SEQ ID NO: 501904 - DNA, 25 bp, Mus musculus
aaccaggccgaccatgataaagatg

SEQ ID NO: 501905 - DNA, 25 bp, Mus musculus
aaccaggccgacgatgataaagatg

SEQ ID NO: 501906 - DNA, 25 bp, Mus musculus
aaccaggcgggtcattacaatccaa

SEQ ID NO: 501907 - DNA, 25 bp, Mus musculus
aaccaggcgggtgattacaatccaa

SEQ ID NO: 501908 - DNA, 25 bp, Mus musculus
aaccaggctaccagccaggtggaaa

SEQ ID NO: 501909 - DNA, 25 bp, Mus musculus
aaccaggctacctgccaggtggaaa

SEQ ID NO: 501910 - DNA, 25 bp, Mus musculus
aaccagggctatatccgaaagcagt

SEQ ID NO: 501911 - DNA, 25 bp, Mus musculus
aaccagggctatttccgaaagcagt

SEQ ID NO: 501912 - DNA, 25 bp, Mus musculus
aaccagggggaaagtctagaaggct

SEQ ID NO: 501913 - DNA, 25 bp, Mus musculus
aaccagggggaatgtctagaaggct

SEQ ID NO: 501914 - DNA, 25 bp, Mus musculus
aaccaggtcgaactgaagactgtga

SEQ ID NO: 501915 - DNA, 25 bp, Mus musculus
aaccaggtcgaagtgaagactgtga

SEQ ID NO: 501916 - DNA, 25 bp, Mus musculus
aaccaggtgaaactcttgaagaagg

SEQ ID NO: 501917 - DNA, 25 bp, Mus musculus
aaccaggtgaaagtcttgaagaagg

SEQ ID NO: 501918 - DNA, 25 bp, Mus musculus
aaccagtcctctattgacaacatca

SEQ ID NO: 501919 - DNA, 25 bp, Mus musculus
aaccagtcctcttttgacaacatca

SEQ ID NO: 501920 - DNA, 25 bp, Mus musculus
aaccagtcgcctcatcaaagtaaga

SEQ ID NO: 501921 - DNA, 25 bp, Mus musculus
aaccagtcgcctgatcaaagtaaga

SEQ ID NO: 501922 - DNA, 25 bp, Mus musculus
aaccagtctatcaaagccatactta

SEQ ID NO: 501923 - DNA, 25 bp, Mus musculus
aaccagtctatctaagccatactta

SEQ ID NO: 501924 - DNA, 25 bp, Mus musculus
aaccagtctttgctgaggatgcccc

SEQ ID NO: 501925 - DNA, 25 bp, Mus musculus
aaccagtctttggtgaggatgcccc

SEQ ID NO: 501926 - DNA, 25 bp, Mus musculus
aaccagtgctaaagacgtctcacat

SEQ ID NO: 501927 - DNA, 25 bp, Mus musculus
aaccagtgctaatgacgtctcacat

SEQ ID NO: 501928 - DNA, 25 bp, Mus musculus
aaccagtgctttcacctggccagga

SEQ ID NO: 501929 - DNA, 25 bp, Mus musculus
aaccagtgctttgacctggccagga

SEQ ID NO: 501930 - DNA, 25 bp, Mus musculus
aaccagtggctaattccagtgcacc

SEQ ID NO: 501931 - DNA, 25 bp, Mus musculus
aaccagtggctatttccagtgcacc

SEQ ID NO: 501932 - DNA, 25 bp, Mus musculus
aaccagtgggctcacatctgtgaca

SEQ ID NO: 501933 - DNA, 25 bp, Mus musculus
aaccagtgggctgacatctgtgaca

SEQ ID NO: 501934 - DNA, 25 bp, Mus musculus
aaccagtggtctcagctgtaagact

SEQ ID NO: 501935 - DNA, 25 bp, Mus musculus
aaccagtggtctgagctgtaagact

SEQ ID NO: 501936 - DNA, 25 bp, Mus musculus
aaccagtgtgtcattggtactgctc

SEQ ID NO: 501937 - DNA, 25 bp, Mus musculus
aaccagtgtgtctttggtactgctc

SEQ ID NO: 501938 - DNA, 25 bp, Mus musculus
aaccagtgttccctactacgtcgag

SEQ ID NO: 501939 - DNA, 25 bp, Mus musculus
aaccagtgttccgtactacgtcgag

SEQ ID NO: 501940 - DNA, 25 bp, Mus musculus
aaccagttactaagagaatgtgatc

SEQ ID NO: 501941 - DNA, 25 bp, Mus musculus
aaccagttactatgagaatgtgatc

SEQ ID NO: 501942 - DNA, 25 bp, Mus musculus
aaccagttgagcacgcttcccagag

SEQ ID NO: 501943 - DNA, 25 bp, Mus musculus
aaccagttgagctcgcttcccagag

SEQ ID NO: 501944 - DNA, 25 bp, Mus musculus
aaccagttttgcctctattgagcga

SEQ ID NO: 501945 - DNA, 25 bp, Mus musculus
aaccagttttgcgtctattgagcga

SEQ ID NO: 501946 - DNA, 25 bp, Mus musculus
aaccatagagatctgtaatgccctc

SEQ ID NO: 501947 - DNA, 25 bp, Mus musculus
aaccatagagatgtgtaatgccctc

SEQ ID NO: 501948 - DNA, 25 bp, Mus musculus
aaccatagtacccagttgtcgggca

SEQ ID NO: 501949 - DNA, 25 bp, Mus musculus
aaccatagtaccgagttgtcgggca

SEQ ID NO: 501950 - DNA, 25 bp, Mus musculus
aaccatagttggacatgaagatcaa

SEQ ID NO: 501951 - DNA, 25 bp, Mus musculus
aaccatagttggtcatgaagatcaa

SEQ ID NO: 501952 - DNA, 25 bp, Mus musculus
aaccatcacagtcggtgtgtcccca

SEQ ID NO: 501953 - DNA, 25 bp, Mus musculus
aaccatcacagtgggtgtgtcccca

SEQ ID NO: 501954 - DNA, 25 bp, Mus musculus
aaccatcatggcagtggagtttgac

SEQ ID NO: 501955 - DNA, 25 bp, Mus musculus
aaccatcatggctgtggagtttgac

SEQ ID NO: 501956 - DNA, 25 bp, Mus musculus
aaccatccatccagagtggcatggg

SEQ ID NO: 501957 - DNA, 25 bp, Mus musculus
aaccatccatcctgagtggcatggg

SEQ ID NO: 501958 - DNA, 25 bp, Mus musculus
aaccatccgaggacaccgtatccat

SEQ ID NO: 501959 - DNA, 25 bp, Mus musculus
aaccatccgaggtcaccgtatccat

SEQ ID NO: 501960 - DNA, 25 bp, Mus musculus
aaccatccttgcaacagcctagaac

SEQ ID NO: 501961 - DNA, 25 bp, Mus musculus
aaccatccttgctacagcctagaac

SEQ ID NO: 501962 - DNA, 25 bp, Mus musculus
aaccatccttggaaatcctgccacg

SEQ ID NO: 501963 - DNA, 25 bp, Mus musculus
aaccatccttggtaatcctgccacg

SEQ ID NO: 501964 - DNA, 25 bp, Mus musculus
aaccatcttcttaatggtaaccgag

SEQ ID NO: 501965 - DNA, 25 bp, Mus musculus
aaccatcttctttatggtaaccgag

SEQ ID NO: 501966 - DNA, 25 bp, Mus musculus
aaccatgaatagactgacccagctg

SEQ ID NO: 501967 - DNA, 25 bp, Mus musculus
aaccatgaatagtctgacccagctg

SEQ ID NO: 501968 - DNA, 25 bp, Mus musculus
aaccatgaccgtcagcagtctggca

SEQ ID NO: 501969 - DNA, 25 bp, Mus musculus
aaccatgaccgtgagcagtctggca

SEQ ID NO: 501970 - DNA, 25 bp, Mus musculus
aaccatgatcctcaccaatttgact

SEQ ID NO: 501971 - DNA, 25 bp, Mus musculus
aaccatgatcctgaccaatttgact

SEQ ID NO: 501972 - DNA, 25 bp, Mus musculus
aaccatgatgagatcttgaagtcca

SEQ ID NO: 501973 - DNA, 25 bp, Mus musculus
aaccatgatgagttcttgaagtcca

SEQ ID NO: 501974 - DNA, 25 bp, Mus musculus
aaccatgcatccagcttctgtccag

SEQ ID NO: 501975 - DNA, 25 bp, Mus musculus
aaccatgcatcctgcttctgtccag

SEQ ID NO: 501976 - DNA, 25 bp, Mus musculus
aaccatgccagtctgtgggcatctg

SEQ ID NO: 501977 - DNA, 25 bp, Mus musculus
aaccatgccagtgtgtgggcatctg

SEQ ID NO: 501978 - DNA, 25 bp, Mus musculus
aaccatgcccgtcagctggtgcagg

SEQ ID NO: 501979 - DNA, 25 bp, Mus musculus
aaccatgcccgtgagctggtgcagg

SEQ ID NO: 501980 - DNA, 25 bp, Mus musculus
aaccatggaaaacatccctacagtg

SEQ ID NO: 501981 - DNA, 25 bp, Mus musculus
aaccatggaaaagatccctacagtg

SEQ ID NO: 501982 - DNA, 25 bp, Mus musculus
aaccatggcatgaagctgggaggcc

SEQ ID NO: 501983 - DNA, 25 bp, Mus musculus
aaccatggcatgtagctgggaggcc

SEQ ID NO: 501984 - DNA, 25 bp, Mus musculus
aaccatggcgtcaggagatgacagt

SEQ ID NO: 501985 - DNA, 25 bp, Mus musculus
aaccatggcgtctggagatgacagt

SEQ ID NO: 501986 - DNA, 25 bp, Mus musculus
aaccatgggaggaagagggtgcaga

SEQ ID NO: 501987 - DNA, 25 bp, Mus musculus
aaccatgggaggtagagggtgcaga

SEQ ID NO: 501988 - DNA, 25 bp, Mus musculus
aaccatggttgcacagtcacaagtg

SEQ ID NO: 501989 - DNA, 25 bp, Mus musculus
aaccatggttgctcagtcacaagtg

SEQ ID NO: 501990 - DNA, 25 bp, Mus musculus
aaccatgtcaggacagctgtgccca

SEQ ID NO: 501991 - DNA, 25 bp, Mus musculus
aaccatgtcaggtcagctgtgccca

SEQ ID NO: 501992 - DNA, 25 bp, Mus musculus
aaccatgtgagcatcgtgtatgagg

SEQ ID NO: 501993 - DNA, 25 bp, Mus musculus
aaccatgtgagcttcgtgtatgagg

SEQ ID NO: 501994 - DNA, 25 bp, Mus musculus
aaccatgtggagccccaggttgtct

SEQ ID NO: 501995 - DNA, 25 bp, Mus musculus
aaccatgtggaggcccaggttgtct

SEQ ID NO: 501996 - DNA, 25 bp, Mus musculus
aaccatgtgtggctcggcactgaga

SEQ ID NO: 501997 - DNA, 25 bp, Mus musculus
aaccatgtgtgggtcggcactgaga

SEQ ID NO: 501998 - DNA, 25 bp, Mus musculus
aaccatgtttttcacttgtggccca

SEQ ID NO: 501999 - DNA, 25 bp, Mus musculus
aaccatgtttttgacttgtggccca

SEQ ID NO: 502000 - DNA, 25 bp, Mus musculus
aaccattccaagcagcttacctgga

SEQ ID NO: 502001 - DNA, 25 bp, Mus musculus
aaccattccaaggagcttacctgga

SEQ ID NO: 502002 - DNA, 25 bp, Mus musculus
aaccattccctgaaccgcacatttg

SEQ ID NO: 502003 - DNA, 25 bp, Mus musculus
aaccattccctgtaccgcacatttg

SEQ ID NO: 502004 - DNA, 25 bp, Mus musculus
aaccattcgaagagaaattatagct

SEQ ID NO: 502005 - DNA, 25 bp, Mus musculus
aaccattcgaagtgaaattatagct

SEQ ID NO: 502006 - DNA, 25 bp, Mus musculus
aaccatttgtatccgtgccaggtgc

SEQ ID NO: 502007 - DNA, 25 bp, Mus musculus
aaccatttgtatgcgtgccaggtgc

SEQ ID NO: 502008 - DNA, 25 bp, Mus musculus
aacccaaagaggagtacaggcagca

SEQ ID NO: 502009 - DNA, 25 bp, Mus musculus
aacccaaagaggtgtacaggcagca

SEQ ID NO: 502010 - DNA, 25 bp, Mus musculus
aacccaaatagtcctgtcttcctgc

SEQ ID NO: 502011 - DNA, 25 bp, Mus musculus
aacccaaatagtgctgtcttcctgc

SEQ ID NO: 502012 - DNA, 25 bp, Mus musculus
aacccaactcgactgaagtcagcct

SEQ ID NO: 502013 - DNA, 25 bp, Mus musculus
aacccaactcgagtgaagtcagcct

SEQ ID NO: 502014 - DNA, 25 bp, Mus musculus
aacccaagagatcaagggtctcctc

SEQ ID NO: 502015 - DNA, 25 bp, Mus musculus
aacccaagagatgaagggtctcctc

SEQ ID NO: 502016 - DNA, 25 bp, Mus musculus
aacccaagcaacagctgccatggcg

SEQ ID NO: 502017 - DNA, 25 bp, Mus musculus
aacccaagcaactgctgccatggcg

SEQ ID NO: 502018 - DNA, 25 bp, Mus musculus
aacccaatagttactactacttatg

SEQ ID NO: 502019 - DNA, 25 bp, Mus musculus
aacccaatagtttctactacttatg

SEQ ID NO: 502020 - DNA, 25 bp, Mus musculus
aacccaatatggcatcttgcatgag

SEQ ID NO: 502021 - DNA, 25 bp, Mus musculus
aacccaatatgggatcttgcatgag

SEQ ID NO: 502022 - DNA, 25 bp, Mus musculus
aacccacaacatcgtggtgaatgga

SEQ ID NO: 502023 - DNA, 25 bp, Mus musculus
aacccacaacatggtggtgaatgga

SEQ ID NO: 502024 - DNA, 25 bp, Mus musculus
aacccacacatgaggaggacctcac

SEQ ID NO: 502025 - DNA, 25 bp, Mus musculus
aacccacacatgtggaggacctcac

SEQ ID NO: 502026 - DNA, 25 bp, Mus musculus
aacccacacccacgagacttgattg

SEQ ID NO: 502027 - DNA, 25 bp, Mus musculus
aacccacacccaggagacttgattg

SEQ ID NO: 502028 - DNA, 25 bp, Mus musculus
aacccacacttgactatgttttagg

SEQ ID NO: 502029 - DNA, 25 bp, Mus musculus
aacccacacttgtctatgttttagg

SEQ ID NO: 502030 - DNA, 25 bp, Mus musculus
aacccacagtccaagtactgtccat

SEQ ID NO: 502031 - DNA, 25 bp, Mus musculus
aacccacagtcctagtactgtccat

SEQ ID NO: 502032 - DNA, 25 bp, Mus musculus
aacccacagtttcggagaactagca

SEQ ID NO: 502033 - DNA, 25 bp, Mus musculus
aacccacagtttgggagaactagca

SEQ ID NO: 502034 - DNA, 25 bp, Mus musculus
aacccaccatggatgacagtgacgt

SEQ ID NO: 502035 - DNA, 25 bp, Mus musculus
aacccaccatggttgacagtgacgt

SEQ ID NO: 502036 - DNA, 25 bp, Mus musculus
aacccactgatgattacgttctggg

SEQ ID NO: 502037 - DNA, 25 bp, Mus musculus
aacccactgatgtttacgttctggg

SEQ ID NO: 502038 - DNA, 25 bp, Mus musculus
aacccagaagacattcctgactgag

SEQ ID NO: 502039 - DNA, 25 bp, Mus musculus
aacccagaagactttcctgactgag

SEQ ID NO: 502040 - DNA, 25 bp, Mus musculus
aacccagagagtcccacagtggtgt

SEQ ID NO: 502041 - DNA, 25 bp, Mus musculus
aacccagagagtgccacagtggtgt

SEQ ID NO: 502042 - DNA, 25 bp, Mus musculus
aacccagatgccagtgatgagaagc

SEQ ID NO: 502043 - DNA, 25 bp, Mus musculus
aacccagatgcctgtgatgagaagc

SEQ ID NO: 502044 - DNA, 25 bp, Mus musculus
aacccagatgcgaaggaccattacg

SEQ ID NO: 502045 - DNA, 25 bp, Mus musculus
aacccagatgcgtaggaccattacg

SEQ ID NO: 502046 - DNA, 25 bp, Mus musculus
aacccagccctcagagacaaaagaa

SEQ ID NO: 502047 - DNA, 25 bp, Mus musculus
aacccagccctctgagacaaaagaa

SEQ ID NO: 502048 - DNA, 25 bp, Mus musculus
aacccagctttactatgaaggcgtg

SEQ ID NO: 502049 - DNA, 25 bp, Mus musculus
aacccagctttagtatgaaggcgtg

SEQ ID NO: 502050 - DNA, 25 bp, Mus musculus
aacccaggcgttagccgcggcggat

SEQ ID NO: 502051 - DNA, 25 bp, Mus musculus
aacccaggcgtttgccgcggcggat

SEQ ID NO: 502052 - DNA, 25 bp, Mus musculus
aacccagggcttagatgcagtctct

SEQ ID NO: 502053 - DNA, 25 bp, Mus musculus
aacccagggcttcctagccagatcg

SEQ ID NO: 502054 - DNA, 25 bp, Mus musculus
aacccagggcttgctagccagatcg

SEQ ID NO: 502055 - DNA, 25 bp, Mus musculus
aacccagggctttgatgcagtctct

SEQ ID NO: 502056 - DNA, 25 bp, Mus musculus
aacccaggtcacactggtggctgtt

SEQ ID NO: 502057 - DNA, 25 bp, Mus musculus
aacccaggtcactctggtggctgtt

SEQ ID NO: 502058 - DNA, 25 bp, Mus musculus
aacccaggtgtgagctaagccagtg

SEQ ID NO: 502059 - DNA, 25 bp, Mus musculus
aacccaggtgtgtgctaagccagtg

SEQ ID NO: 502060 - DNA, 25 bp, Mus musculus
aacccagtaacaatgtagtcaagtc

SEQ ID NO: 502061 - DNA, 25 bp, Mus musculus
aacccagtaacattgtagtcaagtc

SEQ ID NO: 502062 - DNA, 25 bp, Mus musculus
aacccagtatgcaggacaaagatgc

SEQ ID NO: 502063 - DNA, 25 bp, Mus musculus
aacccagtatgctggacaaagatgc

SEQ ID NO: 502064 - DNA, 25 bp, Mus musculus
aacccagtgtccagcaagaattgcc

SEQ ID NO: 502065 - DNA, 25 bp, Mus musculus
aacccagtgtcctgcaagaattgcc

SEQ ID NO: 502066 - DNA, 25 bp, Mus musculus
aacccagttcccaccagtagaatca

SEQ ID NO: 502067 - DNA, 25 bp, Mus musculus
aacccagttccctccagtagaatca

SEQ ID NO: 502068 - DNA, 25 bp, Mus musculus
aacccagtttgacctcagagtcttg

SEQ ID NO: 502069 - DNA, 25 bp, Mus musculus
aacccagtttgagctcagagtcttg

SEQ ID NO: 502070 - DNA, 25 bp, Mus musculus
aacccatacttcatccaggaggctg

SEQ ID NO: 502071 - DNA, 25 bp, Mus musculus
aacccatacttcttccaggaggctg

SEQ ID NO: 502072 - DNA, 25 bp, Mus musculus
aacccatcagtgctagatccttcag

SEQ ID NO: 502073 - DNA, 25 bp, Mus musculus
aacccatcagtggtagatccttcag

SEQ ID NO: 502074 - DNA, 25 bp, Mus musculus
aacccatttgacatcgctagtcggt

SEQ ID NO: 502075 - DNA, 25 bp, Mus musculus
aacccatttgacttcgctagtcggt

SEQ ID NO: 502076 - DNA, 25 bp, Mus musculus
aacccatttgtgcaggacgacatgg

SEQ ID NO: 502077 - DNA, 25 bp, Mus musculus
aacccatttgtggaggacgacatgg

SEQ ID NO: 502078 - DNA, 25 bp, Mus musculus
aaccccaagtatcaactgatcatcg

SEQ ID NO: 502079 - DNA, 25 bp, Mus musculus
aaccccaagtatgaactgatcatcg

SEQ ID NO: 502080 - DNA, 25 bp, Mus musculus
aaccccaagtttcaagaactgcaga

SEQ ID NO: 502081 - DNA, 25 bp, Mus musculus
aaccccaagtttgaagaactgcaga

SEQ ID NO: 502082 - DNA, 25 bp, Mus musculus
aaccccacgcagaaagtgccagtca

SEQ ID NO: 502083 - DNA, 25 bp, Mus musculus
aaccccacgcagtaagtgccagtca

SEQ ID NO: 502084 - DNA, 25 bp, Mus musculus
aaccccagactccaggtcagggcaa

SEQ ID NO: 502085 - DNA, 25 bp, Mus musculus
aaccccagactcgaggtcagggcaa

SEQ ID NO: 502086 - DNA, 25 bp, Mus musculus
aaccccagacttcgtgcaatggact

SEQ ID NO: 502087 - DNA, 25 bp, Mus musculus
aaccccagacttggtgcaatggact

SEQ ID NO: 502088 - DNA, 25 bp, Mus musculus
aaccccagagcaaggaggcagaaga

SEQ ID NO: 502089 - DNA, 25 bp, Mus musculus
aaccccagagcatggaggcagaaga

SEQ ID NO: 502090 - DNA, 25 bp, Mus musculus
aaccccagatgcatatcgcccagtg

SEQ ID NO: 502091 - DNA, 25 bp, Mus musculus
aaccccagatgcttatcgcccagtg

SEQ ID NO: 502092 - DNA, 25 bp, Mus musculus
aaccccagcagcacctatgtgtcag

SEQ ID NO: 502093 - DNA, 25 bp, Mus musculus
aaccccagcagctcctatgtgtcag

SEQ ID NO: 502094 - DNA, 25 bp, Mus musculus
aaccccagggtgaccaacaacagag

SEQ ID NO: 502095 - DNA, 25 bp, Mus musculus
aaccccagggtgtccaacaacagag

SEQ ID NO: 502096 - DNA, 25 bp, Mus musculus
aaccccatagaactgatgtgtccac

SEQ ID NO: 502097 - DNA, 25 bp, Mus musculus
aaccccatagaagtgatgtgtccac

SEQ ID NO: 502098 - DNA, 25 bp, Mus musculus
aacccccgagccagtcactggtggg

SEQ ID NO: 502099 - DNA, 25 bp, Mus musculus
aacccccgagcctgtcactggtggg

SEQ ID NO: 502100 - DNA, 25 bp, Mus musculus
aaccccctgggcaacagatgcgaag

SEQ ID NO: 502101 - DNA, 25 bp, Mus musculus
aaccccctgggctacagatgcgaag

SEQ ID NO: 502102 - DNA, 25 bp, Mus musculus
aaccccgagaacacggtcttcgatg

SEQ ID NO: 502103 - DNA, 25 bp, Mus musculus
aaccccgagaactcggtcttcgatg

SEQ ID NO: 502104 - DNA, 25 bp, Mus musculus
aaccccgaggatccgctgaaacgtg

SEQ ID NO: 502105 - DNA, 25 bp, Mus musculus
aaccccgaggatgcgctgaaacgtg

SEQ ID NO: 502106 - DNA, 25 bp, Mus musculus
aaccccgaggtgaagaagtcatgct

SEQ ID NO: 502107 - DNA, 25 bp, Mus musculus
aaccccgaggtgtagaagtcatgct

SEQ ID NO: 502108 - DNA, 25 bp, Mus musculus
aaccccggcggaacatcgtaggctg

SEQ ID NO: 502109 - DNA, 25 bp, Mus musculus
aaccccggcggatcatcgtaggctg

SEQ ID NO: 502110 - DNA, 25 bp, Mus musculus
aaccccgtgtctccggagcggctgt

SEQ ID NO: 502111 - DNA, 25 bp, Mus musculus
aaccccgtgtctgcggagcggctgt

SEQ ID NO: 502112 - DNA, 25 bp, Mus musculus
aacccctgaaatcagcaaagccagg

SEQ ID NO: 502113 - DNA, 25 bp, Mus musculus
aacccctgaaatgagcaaagccagg

SEQ ID NO: 502114 - DNA, 25 bp, Mus musculus
aacccctgacggagtctgagctgct

SEQ ID NO: 502115 - DNA, 25 bp, Mus musculus
aacccctgacggtgtctgagctgct

SEQ ID NO: 502116 - DNA, 25 bp, Mus musculus
aacccctttctgctgtatcagcttc

SEQ ID NO: 502117 - DNA, 25 bp, Mus musculus
aacccctttctggtgtatcagcttc

SEQ ID NO: 502118 - DNA, 25 bp, Mus musculus
aacccgaaccgaacgctggcgattg

SEQ ID NO: 502119 - DNA, 25 bp, Mus musculus
aacccgaaccgatcgctggcgattg

SEQ ID NO: 502120 - DNA, 25 bp, Mus musculus
aacccgaagatcatgcgataatttg

SEQ ID NO: 502121 - DNA, 25 bp, Mus musculus
aacccgaagatcttgcgataatttg

SEQ ID NO: 502122 - DNA, 25 bp, Mus musculus
aacccgacgggactagcgtgacagt

SEQ ID NO: 502123 - DNA, 25 bp, Mus musculus
aacccgacgggagtagcgtgacagt

SEQ ID NO: 502124 - DNA, 25 bp, Mus musculus
aacccgagagccacttctagtaagc

SEQ ID NO: 502125 - DNA, 25 bp, Mus musculus
aacccgagagcctcttctagtaagc

SEQ ID NO: 502126 - DNA, 25 bp, Mus musculus
aacccgaggccaagtcccatgaaaa

SEQ ID NO: 502127 - DNA, 25 bp, Mus musculus
aacccgaggccatgtcccatgaaaa

SEQ ID NO: 502128 - DNA, 25 bp, Mus musculus
aacccgagtgatccagtgtctcccg

SEQ ID NO: 502129 - DNA, 25 bp, Mus musculus
aacccgagtgatgcagtgtctcccg

SEQ ID NO: 502130 - DNA, 25 bp, Mus musculus
aacccgagtgctatcctttgacgag

SEQ ID NO: 502131 - DNA, 25 bp, Mus musculus
aacccgagtgctttcctttgacgag

SEQ ID NO: 502132 - DNA, 25 bp, Mus musculus
aacccgcacggtcccaggaggatca

SEQ ID NO: 502133 - DNA, 25 bp, Mus musculus
aacccgcacggtgccaggaggatca

SEQ ID NO: 502134 - DNA, 25 bp, Mus musculus
aacccgccatcaagtccagcgagga

SEQ ID NO: 502135 - DNA, 25 bp, Mus musculus
aacccgccatcatgtccagcgagga

SEQ ID NO: 502136 - DNA, 25 bp, Mus musculus
aacccgctcagtagtgtaagtcaga

SEQ ID NO: 502137 - DNA, 25 bp, Mus musculus
aacccgctcagttgtgtaagtcaga

SEQ ID NO: 502138 - DNA, 25 bp, Mus musculus
aacccgctcccaaaaggctttggct

SEQ ID NO: 502139 - DNA, 25 bp, Mus musculus
aacccgctcccataaggctttggct

SEQ ID NO: 502140 - DNA, 25 bp, Mus musculus
aacccgctcgtgaacttggacgtgg

SEQ ID NO: 502141 - DNA, 25 bp, Mus musculus
aacccgctcgtgtacttggacgtgg

SEQ ID NO: 502142 - DNA, 25 bp, Mus musculus
aacccgctcttccttcgttggctga

SEQ ID NO: 502143 - DNA, 25 bp, Mus musculus
aacccgctcttcgttcgttggctga

SEQ ID NO: 502144 - DNA, 25 bp, Mus musculus
aacccggaaagcctggcattcctgg

SEQ ID NO: 502145 - DNA, 25 bp, Mus musculus
aacccggaaagcgtggcattcctgg

SEQ ID NO: 502146 - DNA, 25 bp, Mus musculus
aacccggaggagaactaatgcttgg

SEQ ID NO: 502147 - DNA, 25 bp, Mus musculus
aacccggaggagtactaatgcttgg

SEQ ID NO: 502148 - DNA, 25 bp, Mus musculus
aacccggcagacagcgtgaacagtc

SEQ ID NO: 502149 - DNA, 25 bp, Mus musculus
aacccggcagactgcgtgaacagtc

SEQ ID NO: 502150 - DNA, 25 bp, Mus musculus
aacccggccttcacgtgggccagat

SEQ ID NO: 502151 - DNA, 25 bp, Mus musculus
aacccggccttctcgtgggccagat

SEQ ID NO: 502152 - DNA, 25 bp, Mus musculus
aacccggctacgcttcagccatgat

SEQ ID NO: 502153 - DNA, 25 bp, Mus musculus
aacccggctacggttcagccatgat

SEQ ID NO: 502154 - DNA, 25 bp, Mus musculus
aacccgggctgtaggtctgcctcag

SEQ ID NO: 502155 - DNA, 25 bp, Mus musculus
aacccgggctgttggtctgcctcag

SEQ ID NO: 502156 - DNA, 25 bp, Mus musculus
aacccggtcctgcagcgattcatct

SEQ ID NO: 502157 - DNA, 25 bp, Mus musculus
aacccggtcctggagcgattcatct

SEQ ID NO: 502158 - DNA, 25 bp, Mus musculus
aacccgtgatctcctctaccttggg

SEQ ID NO: 502159 - DNA, 25 bp, Mus musculus
aacccgtgatctgctctaccttggg

SEQ ID NO: 502160 - DNA, 25 bp, Mus musculus
aacccgtgcatcctgtgtgcagatg

SEQ ID NO: 502161 - DNA, 25 bp, Mus musculus
aacccgtgcatcgtgtgtgcagatg

SEQ ID NO: 502162 - DNA, 25 bp, Mus musculus
aacccgtgcggtagacgcatttggc

SEQ ID NO: 502163 - DNA, 25 bp, Mus musculus
aacccgtgcggttgacgcatttggc

SEQ ID NO: 502164 - DNA, 25 bp, Mus musculus
aacccgtggtgcaccagttcatgga

SEQ ID NO: 502165 - DNA, 25 bp, Mus musculus
aacccgtggtgctccagttcatgga

SEQ ID NO: 502166 - DNA, 25 bp, Mus musculus
aacccgttcattaaagtattcagca

SEQ ID NO: 502167 - DNA, 25 bp, Mus musculus
aacccgttcatttaagtattcagca

SEQ ID NO: 502168 - DNA, 25 bp, Mus musculus
aaccctacgagaaaaacctgatgga

SEQ ID NO: 502169 - DNA, 25 bp, Mus musculus
aaccctacgagataaacctgatgga

SEQ ID NO: 502170 - DNA, 25 bp, Mus musculus
aaccctagagccagttaagcctcca

SEQ ID NO: 502171 - DNA, 25 bp, Mus musculus
aaccctagagcctgttaagcctcca

SEQ ID NO: 502172 - DNA, 25 bp, Mus musculus
aaccctagcgttatgattgatgatc

SEQ ID NO: 502173 - DNA, 25 bp, Mus musculus
aaccctagcgttttgattgatgatc

SEQ ID NO: 502174 - DNA, 25 bp, Mus musculus
aaccctagctttcatggacgactga

SEQ ID NO: 502175 - DNA, 25 bp, Mus musculus
aaccctagctttgatggacgactga

SEQ ID NO: 502176 - DNA, 25 bp, Mus musculus
aaccctagtgccacgggtagcgcca

SEQ ID NO: 502177 - DNA, 25 bp, Mus musculus
aaccctagtgcctcgggtagcgcca

SEQ ID NO: 502178 - DNA, 25 bp, Mus musculus
aaccctcagagcatgggtctgggcg

SEQ ID NO: 502179 - DNA, 25 bp, Mus musculus
aaccctcagagcttgggtctgggcg

SEQ ID NO: 502180 - DNA, 25 bp, Mus musculus
aaccctctgagacgagtcttaagag

SEQ ID NO: 502181 - DNA, 25 bp, Mus musculus
aaccctctgagaggagtcttaagag

SEQ ID NO: 502182 - DNA, 25 bp, Mus musculus
aaccctctgggccaggcctctccag

SEQ ID NO: 502183 - DNA, 25 bp, Mus musculus
aaccctctgggcgaggcctctccag

SEQ ID NO: 502184 - DNA, 25 bp, Mus musculus
aaccctctttgtcgtccattgtcgc

SEQ ID NO: 502185 - DNA, 25 bp, Mus musculus
aaccctctttgtggtccattgtcgc

SEQ ID NO: 502186 - DNA, 25 bp, Mus musculus
aaccctgaatccaccagaaggaatc

SEQ ID NO: 502187 - DNA, 25 bp, Mus musculus
aaccctgaatcctccagaaggaatc

SEQ ID NO: 502188 - DNA, 25 bp, Mus musculus
aaccctgagacccttgactggtggc

SEQ ID NO: 502189 - DNA, 25 bp, Mus musculus
aaccctgagaccgttgactggtggc

SEQ ID NO: 502190 - DNA, 25 bp, Mus musculus
aaccctgagcccatgggcaagcagg

SEQ ID NO: 502191 - DNA, 25 bp, Mus musculus
aaccctgagcccttgggcaagcagg

SEQ ID NO: 502192 - DNA, 25 bp, Mus musculus
aaccctgagcttagcatatttttgc

SEQ ID NO: 502193 - DNA, 25 bp, Mus musculus
aaccctgagctttgcatatttttgc

SEQ ID NO: 502194 - DNA, 25 bp, Mus musculus
aaccctgatcacagggaaatgggag

SEQ ID NO: 502195 - DNA, 25 bp, Mus musculus
aaccctgatcactgggaaatgggag

SEQ ID NO: 502196 - DNA, 25 bp, Mus musculus
aaccctgctattcctgatatctaca

SEQ ID NO: 502197 - DNA, 25 bp, Mus musculus
aaccctgctattgctgatatctaca

SEQ ID NO: 502198 - DNA, 25 bp, Mus musculus
aaccctgctccaatggaggatcctg

SEQ ID NO: 502199 - DNA, 25 bp, Mus musculus
aaccctgctccattggaggatcctg

SEQ ID NO: 502200 - DNA, 25 bp, Mus musculus
aaccctgctcttcgaggtgtcaagc

SEQ ID NO: 502201 - DNA, 25 bp, Mus musculus
aaccctgctcttggaggtgtcaagc

SEQ ID NO: 502202 - DNA, 25 bp, Mus musculus
aaccctgctgaacagctctggtttc

SEQ ID NO: 502203 - DNA, 25 bp, Mus musculus
aaccctgctgaagagctctggtttc

SEQ ID NO: 502204 - DNA, 25 bp, Mus musculus
aaccctggacctcggattcaaggtg

SEQ ID NO: 502205 - DNA, 25 bp, Mus musculus
aaccctggacctgggattcaaggtg

SEQ ID NO: 502206 - DNA, 25 bp, Mus musculus
aaccctggagacaccaatgccttag

SEQ ID NO: 502207 - DNA, 25 bp, Mus musculus
aaccctggagactccaatgccttag

SEQ ID NO: 502208 - DNA, 25 bp, Mus musculus
aaccctggccaacaggacaatgacc

SEQ ID NO: 502209 - DNA, 25 bp, Mus musculus
aaccctggccaagaggacaatgacc

SEQ ID NO: 502210 - DNA, 25 bp, Mus musculus
aaccctggctctatgaccattgtca

SEQ ID NO: 502211 - DNA, 25 bp, Mus musculus
aaccctggctctttgaccattgtca

SEQ ID NO: 502212 - DNA, 25 bp, Mus musculus
aaccctggctgtctggtgattgatg

SEQ ID NO: 502213 - DNA, 25 bp, Mus musculus
aaccctggctgtgtggtgattgatg

SEQ ID NO: 502214 - DNA, 25 bp, Mus musculus
aaccctgggcatctgtgcattacag

SEQ ID NO: 502215 - DNA, 25 bp, Mus musculus
aaccctgggcatgtgtgcattacag

SEQ ID NO: 502216 - DNA, 25 bp, Mus musculus
aaccctgtacctagctcaagacgag

SEQ ID NO: 502217 - DNA, 25 bp, Mus musculus
aaccctgtaccttgctcaagacgag

SEQ ID NO: 502218 - DNA, 25 bp, Mus musculus
aaccctgtgatcctgcctggtcaga

SEQ ID NO: 502219 - DNA, 25 bp, Mus musculus
aaccctgtgatcgtgcctggtcaga

SEQ ID NO: 502220 - DNA, 25 bp, Mus musculus
aaccctgtggaacctaggagatcaa

SEQ ID NO: 502221 - DNA, 25 bp, Mus musculus
aaccctgtggaagctaggagatcaa

SEQ ID NO: 502222 - DNA, 25 bp, Mus musculus
aacccttaccagattgatgtgctcg

SEQ ID NO: 502223 - DNA, 25 bp, Mus musculus
aacccttaccagtttgatgtgctcg

SEQ ID NO: 502224 - DNA, 25 bp, Mus musculus
aacccttacgacaccgacaagatgg

SEQ ID NO: 502225 - DNA, 25 bp, Mus musculus
aacccttacgactccgacaagatgg

SEQ ID NO: 502226 - DNA, 25 bp, Mus musculus
aacccttcagatattgaattggctg

SEQ ID NO: 502227 - DNA, 25 bp, Mus musculus
aacccttcagattttgaattggctg

SEQ ID NO: 502228 - DNA, 25 bp, Mus musculus
aacccttcgctgacctgattggtta

SEQ ID NO: 502229 - DNA, 25 bp, Mus musculus
aacccttcgctgtcctgattggtta

SEQ ID NO: 502230 - DNA, 25 bp, Mus musculus
aacccttgccggcatggatatggcc

SEQ ID NO: 502231 - DNA, 25 bp, Mus musculus
aacccttgccgggatggatatggcc

SEQ ID NO: 502232 - DNA, 25 bp, Mus musculus
aacccttgcggcacacacaaagcag

SEQ ID NO: 502233 - DNA, 25 bp, Mus musculus
aacccttgcggctcacacaaagcag

SEQ ID NO: 502234 - DNA, 25 bp, Mus musculus
aacccttggagacagaatacccagc

SEQ ID NO: 502235 - DNA, 25 bp, Mus musculus
aacccttggagagagaatacccagc

SEQ ID NO: 502236 - DNA, 25 bp, Mus musculus
aacccttgtcatattggctgtcagc

SEQ ID NO: 502237 - DNA, 25 bp, Mus musculus
aacccttgtcattttggctgtcagc

SEQ ID NO: 502238 - DNA, 25 bp, Mus musculus
aaccctttggagagatcgttcgtag

SEQ ID NO: 502239 - DNA, 25 bp, Mus musculus
aaccctttggagtgatcgttcgtag

SEQ ID NO: 502240 - DNA, 25 bp, Mus musculus
aaccgaatatatctggcctctgtac

SEQ ID NO: 502241 - DNA, 25 bp, Mus musculus
aaccgaatatatgtggcctctgtac

SEQ ID NO: 502242 - DNA, 25 bp, Mus musculus
aaccgacaaggtcactgacttgcta

SEQ ID NO: 502243 - DNA, 25 bp, Mus musculus
aaccgacaaggtgactgacttgcta

SEQ ID NO: 502244 - DNA, 25 bp, Mus musculus
aaccgacagcgaacttaggaagtga

SEQ ID NO: 502245 - DNA, 25 bp, Mus musculus
aaccgacagcgatcttaggaagtga

SEQ ID NO: 502246 - DNA, 25 bp, Mus musculus
aaccgacctggactgcatttttgga

SEQ ID NO: 502247 - DNA, 25 bp, Mus musculus
aaccgacctggagtgcatttttgga

SEQ ID NO: 502248 - DNA, 25 bp, Mus musculus
aaccgagcgagccacgttaagaggc

SEQ ID NO: 502249 - DNA, 25 bp, Mus musculus
aaccgagcgagcgacgttaagaggc

SEQ ID NO: 502250 - DNA, 25 bp, Mus musculus
aaccgagctctcagttttcttcgta

SEQ ID NO: 502251 - DNA, 25 bp, Mus musculus
aaccgagctctctgttttcttcgta

SEQ ID NO: 502252 - DNA, 25 bp, Mus musculus
aaccgaggaagtaactgtggcagaa

SEQ ID NO: 502253 - DNA, 25 bp, Mus musculus
aaccgaggaagttactgtggcagaa

SEQ ID NO: 502254 - DNA, 25 bp, Mus musculus
aaccgagtagtgaggcagaatcccg

SEQ ID NO: 502255 - DNA, 25 bp, Mus musculus
aaccgagtagtgtggcagaatcccg

SEQ ID NO: 502256 - DNA, 25 bp, Mus musculus
aaccgagtctgcctgacctgctaca

SEQ ID NO: 502257 - DNA, 25 bp, Mus musculus
aaccgagtctgcgtgacctgctaca

SEQ ID NO: 502258 - DNA, 25 bp, Mus musculus
aaccgagttctgagagtctacagca

SEQ ID NO: 502259 - DNA, 25 bp, Mus musculus
aaccgagttctgtgagtctacagca

SEQ ID NO: 502260 - DNA, 25 bp, Mus musculus
aaccgatctcggcagtatcagctca

SEQ ID NO: 502261 - DNA, 25 bp, Mus musculus
aaccgatctcgggagtatcagctca

SEQ ID NO: 502262 - DNA, 25 bp, Mus musculus
aaccgcaagggcctgttcgtgaagc

SEQ ID NO: 502263 - DNA, 25 bp, Mus musculus
aaccgcaagggcgtgttcgtgaagc

SEQ ID NO: 502264 - DNA, 25 bp, Mus musculus
aaccgcacagaccagcaatgccagt

SEQ ID NO: 502265 - DNA, 25 bp, Mus musculus
aaccgcacagacgagcaatgccagt

SEQ ID NO: 502266 - DNA, 25 bp, Mus musculus
aaccgcagatgccatcgccaggaaa

SEQ ID NO: 502267 - DNA, 25 bp, Mus musculus
aaccgcagatgcgatcgccaggaaa

SEQ ID NO: 502268 - DNA, 25 bp, Mus musculus
aaccgcatgctcaggactcacaact

SEQ ID NO: 502269 - DNA, 25 bp, Mus musculus
aaccgcatgctctggactcacaact

SEQ ID NO: 502270 - DNA, 25 bp, Mus musculus
aaccgcctctatcaggccattcaga

SEQ ID NO: 502271 - DNA, 25 bp, Mus musculus
aaccgcctctatgaggccattcaga

SEQ ID NO: 502272 - DNA, 25 bp, Mus musculus
aaccgcctgctgaagggacagaagg

SEQ ID NO: 502273 - DNA, 25 bp, Mus musculus
aaccgcctgctgtagggacagaagg

SEQ ID NO: 502274 - DNA, 25 bp, Mus musculus
aaccgcctgtggaagctgctgtccc

SEQ ID NO: 502275 - DNA, 25 bp, Mus musculus
aaccgcctgtggtagctgctgtccc

SEQ ID NO: 502276 - DNA, 25 bp, Mus musculus
aaccgcgggcttagcaatggcaacc

SEQ ID NO: 502277 - DNA, 25 bp, Mus musculus
aaccgcgggctttgcaatggcaacc

SEQ ID NO: 502278 - DNA, 25 bp, Mus musculus
aaccgcgtagccatccggtggcgca

SEQ ID NO: 502279 - DNA, 25 bp, Mus musculus
aaccgcgtagccttccggtggcgca

SEQ ID NO: 502280 - DNA, 25 bp, Mus musculus
aaccgcgtgtgccacctgctgaagg

SEQ ID NO: 502281 - DNA, 25 bp, Mus musculus
aaccgcgtgtgcgacctgctgaagg

SEQ ID NO: 502282 - DNA, 25 bp, Mus musculus
aaccgctcatagaactgttgcttca

SEQ ID NO: 502283 - DNA, 25 bp, Mus musculus
aaccgctcatagtactgttgcttca

SEQ ID NO: 502284 - DNA, 25 bp, Mus musculus
aaccgctctgtgctagctgaccaga

SEQ ID NO: 502285 - DNA, 25 bp, Mus musculus
aaccgctctgtggtagctgaccaga

SEQ ID NO: 502286 - DNA, 25 bp, Mus musculus
aaccgctggaggagcgcaccgcagc

SEQ ID NO: 502287 - DNA, 25 bp, Mus musculus
aaccgctggaggtgcgcaccgcagc

SEQ ID NO: 502288 - DNA, 25 bp, Mus musculus
aaccgctgggatccgtctgcctcgg

SEQ ID NO: 502289 - DNA, 25 bp, Mus musculus
aaccgctgggatgcgtctgcctcgg

SEQ ID NO: 502290 - DNA, 25 bp, Mus musculus
aaccgctggtggcagccattgctgc

SEQ ID NO: 502291 - DNA, 25 bp, Mus musculus
aaccgctggtgggagccattgctgc

SEQ ID NO: 502292 - DNA, 25 bp, Mus musculus
aaccgcttgggtctcatgattgacc

SEQ ID NO: 502293 - DNA, 25 bp, Mus musculus
aaccgcttgggtgtcatgattgacc

SEQ ID NO: 502294 - DNA, 25 bp, Mus musculus
aaccgctttgacagtgtcatggtgc

SEQ ID NO: 502295 - DNA, 25 bp, Mus musculus
aaccgctttgactgtgtcatggtgc

SEQ ID NO: 502296 - DNA, 25 bp, Mus musculus
aaccgctttggcagccggcctgtca

SEQ ID NO: 502297 - DNA, 25 bp, Mus musculus
aaccgctttggctgccggcctgtca

SEQ ID NO: 502298 - DNA, 25 bp, Mus musculus
aaccggaagcgaacgccttcgggca

SEQ ID NO: 502299 - DNA, 25 bp, Mus musculus
aaccggaagcgatcgccttcgggca

SEQ ID NO: 502300 - DNA, 25 bp, Mus musculus
aaccggaggtggacgagaccacaag

SEQ ID NO: 502301 - DNA, 25 bp, Mus musculus
aaccggaggtggtcgagaccacaag

SEQ ID NO: 502302 - DNA, 25 bp, Mus musculus
aaccggatgggcacctctcatgtgt

SEQ ID NO: 502303 - DNA, 25 bp, Mus musculus
aaccggatgggctcctctcatgtgt

SEQ ID NO: 502304 - DNA, 25 bp, Mus musculus
aaccggcaacgtcggaatgaggtct

SEQ ID NO: 502305 - DNA, 25 bp, Mus musculus
aaccggcaacgtgggaatgaggtct

SEQ ID NO: 502306 - DNA, 25 bp, Mus musculus
aaccggccatgacacacctaggaga

SEQ ID NO: 502307 - DNA, 25 bp, Mus musculus
aaccggccatgagacacctaggaga

SEQ ID NO: 502308 - DNA, 25 bp, Mus musculus
aaccggctgctaccagaactgccag

SEQ ID NO: 502309 - DNA, 25 bp, Mus musculus
aaccggctgctagcagaactgccag

SEQ ID NO: 502310 - DNA, 25 bp, Mus musculus
aaccggctggtcagctgtgagaagt

SEQ ID NO: 502311 - DNA, 25 bp, Mus musculus
aaccggctggtctgctgtgagaagt

SEQ ID NO: 502312 - DNA, 25 bp, Mus musculus
aaccgggagcgcatggaagaaagaa

SEQ ID NO: 502313 - DNA, 25 bp, Mus musculus
aaccgggagcgcttggaagaaagaa

SEQ ID NO: 502314 - DNA, 25 bp, Mus musculus
aaccgggtcgacatagcgcgaagcc

SEQ ID NO: 502315 - DNA, 25 bp, Mus musculus
aaccgggtcgacttagcgcgaagcc

SEQ ID NO: 502316 - DNA, 25 bp, Mus musculus
aaccggtaccttcctatgaaggaag

SEQ ID NO: 502317 - DNA, 25 bp, Mus musculus
aaccggtaccttgctatgaaggaag

SEQ ID NO: 502318 - DNA, 25 bp, Mus musculus
aaccgtccgcatccggtatggctct

SEQ ID NO: 502319 - DNA, 25 bp, Mus musculus
aaccgtccgcatgcggtatggctct

SEQ ID NO: 502320 - DNA, 25 bp, Mus musculus
aaccgtctgataaggccaccctgct

SEQ ID NO: 502321 - DNA, 25 bp, Mus musculus
aaccgtctgatatggccaccctgct

SEQ ID NO: 502322 - DNA, 25 bp, Mus musculus
aaccgtctggcactaccactttcgg

SEQ ID NO: 502323 - DNA, 25 bp, Mus musculus
aaccgtctggcagtaccactttcgg

SEQ ID NO: 502324 - DNA, 25 bp, Mus musculus
aaccgtctgttacttcaggtccagg

SEQ ID NO: 502325 - DNA, 25 bp, Mus musculus
aaccgtctgttagttcaggtccagg

SEQ ID NO: 502326 - DNA, 25 bp, Mus musculus
aaccgtggagccacgtaaagtcgct

SEQ ID NO: 502327 - DNA, 25 bp, Mus musculus
aaccgtggagcctcgtaaagtcgct

SEQ ID NO: 502328 - DNA, 25 bp, Mus musculus
aaccgtggctgcagagctaacctgg

SEQ ID NO: 502329 - DNA, 25 bp, Mus musculus
aaccgtggctgctgagctaacctgg

SEQ ID NO: 502330 - DNA, 25 bp, Mus musculus
aaccgttacgatcggcaggtagctg

SEQ ID NO: 502331 - DNA, 25 bp, Mus musculus
aaccgttacgatgggcaggtagctg

SEQ ID NO: 502332 - DNA, 25 bp, Mus musculus
aacctaacccagatatatctgaatg

SEQ ID NO: 502333 - DNA, 25 bp, Mus musculus
aacctaacccagttatatctgaatg

SEQ ID NO: 502334 - DNA, 25 bp, Mus musculus
aacctaagcagacgcacgagcacag

SEQ ID NO: 502335 - DNA, 25 bp, Mus musculus
aacctaagcagaggcacgagcacag

SEQ ID NO: 502336 - DNA, 25 bp, Mus musculus
aacctacaaggcctcacaatgcacg

SEQ ID NO: 502337 - DNA, 25 bp, Mus musculus
aacctacaaggcgtcacaatgcacg

SEQ ID NO: 502338 - DNA, 25 bp, Mus musculus
aacctacagcccacgctcgagagag

SEQ ID NO: 502339 - DNA, 25 bp, Mus musculus
aacctacagccctcgctcgagagag

SEQ ID NO: 502340 - DNA, 25 bp, Mus musculus
aacctacaggtgacacccatgcctt

SEQ ID NO: 502341 - DNA, 25 bp, Mus musculus
aacctacaggtgtcacccatgcctt

SEQ ID NO: 502342 - DNA, 25 bp, Mus musculus
aacctaccactcacagcatggtcta

SEQ ID NO: 502343 - DNA, 25 bp, Mus musculus
aacctaccactctcagcatggtcta

SEQ ID NO: 502344 - DNA, 25 bp, Mus musculus
aacctacgtagcagaaagtggcttt

SEQ ID NO: 502345 - DNA, 25 bp, Mus musculus
aacctacgtagctgaaagtggcttt

SEQ ID NO: 502346 - DNA, 25 bp, Mus musculus
aacctactcactaccgcttcttgaa

SEQ ID NO: 502347 - DNA, 25 bp, Mus musculus
aacctactcacttccgcttcttgaa

SEQ ID NO: 502348 - DNA, 25 bp, Mus musculus
aacctaggagaactagccatcttgc

SEQ ID NO: 502349 - DNA, 25 bp, Mus musculus
aacctaggagaagtagccatcttgc

SEQ ID NO: 502350 - DNA, 25 bp, Mus musculus
aacctaggctatcccaaaggccgga

SEQ ID NO: 502351 - DNA, 25 bp, Mus musculus
aacctaggctatgccaaaggccgga

SEQ ID NO: 502352 - DNA, 25 bp, Mus musculus
aacctagttgatcaactcaaaggga

SEQ ID NO: 502353 - DNA, 25 bp, Mus musculus
aacctagttgatgaactcaaaggga

SEQ ID NO: 502354 - DNA, 25 bp, Mus musculus
aacctatccgtgatctaagaaagcc

SEQ ID NO: 502355 - DNA, 25 bp, Mus musculus
aacctatccgtgttctaagaaagcc

SEQ ID NO: 502356 - DNA, 25 bp, Mus musculus
aacctatcgactatacagttctgga

SEQ ID NO: 502357 - DNA, 25 bp, Mus musculus
aacctatcgactttacagttctgga

SEQ ID NO: 502358 - DNA, 25 bp, Mus musculus
aacctatgaaggattgctgagaaga

SEQ ID NO: 502359 - DNA, 25 bp, Mus musculus
aacctatgaaggtttgctgagaaga

SEQ ID NO: 502360 - DNA, 25 bp, Mus musculus
aacctatgaggacatcagagatacc

SEQ ID NO: 502361 - DNA, 25 bp, Mus musculus
aacctatgaggagatcagagatacc

SEQ ID NO: 502362 - DNA, 25 bp, Mus musculus
aacctatttggtaattccagcactc

SEQ ID NO: 502363 - DNA, 25 bp, Mus musculus
aacctatttggttattccagcactc

SEQ ID NO: 502364 - DNA, 25 bp, Mus musculus
aacctcaaagcaatggacctcactg

SEQ ID NO: 502365 - DNA, 25 bp, Mus musculus
aacctcaaagcattggacctcactg

SEQ ID NO: 502366 - DNA, 25 bp, Mus musculus
aacctcaacagtcgctccagtggag

SEQ ID NO: 502367 - DNA, 25 bp, Mus musculus
aacctcaacagtggctccagtggag

SEQ ID NO: 502368 - DNA, 25 bp, Mus musculus
aacctcaagaagaggagtttctcca

SEQ ID NO: 502369 - DNA, 25 bp, Mus musculus
aacctcaagaagtggagtttctcca

SEQ ID NO: 502370 - DNA, 25 bp, Mus musculus
aacctcaaggccctcaggaccattg

SEQ ID NO: 502371 - DNA, 25 bp, Mus musculus
aacctcaaggccgtcaggaccattg

SEQ ID NO: 502372 - DNA, 25 bp, Mus musculus
aacctcagcactagcacacacgatt

SEQ ID NO: 502373 - DNA, 25 bp, Mus musculus
aacctcagcacttgcacacacgatt

SEQ ID NO: 502374 - DNA, 25 bp, Mus musculus
aacctcagctggaggacacaagcca

SEQ ID NO: 502375 - DNA, 25 bp, Mus musculus
aacctcagctggtggacacaagcca

SEQ ID NO: 502376 - DNA, 25 bp, Mus musculus
aacctcagtgcaatgggtacttcag

SEQ ID NO: 502377 - DNA, 25 bp, Mus musculus
aacctcagtgcattgggtacttcag

SEQ ID NO: 502378 - DNA, 25 bp, Mus musculus
aacctcatccagctcgctgcaggtg

SEQ ID NO: 502379 - DNA, 25 bp, Mus musculus
aacctcatccaggtcgctgcaggtg

SEQ ID NO: 502380 - DNA, 25 bp, Mus musculus
aacctcatcctgagccggcgtgact

SEQ ID NO: 502381 - DNA, 25 bp, Mus musculus
aacctcatcctgtgccggcgtgact

SEQ ID NO: 502382 - DNA, 25 bp, Mus musculus
aacctcatgaacctgattgccacca

SEQ ID NO: 502383 - DNA, 25 bp, Mus musculus
aacctcatgaacgtgattgccacca

SEQ ID NO: 502384 - DNA, 25 bp, Mus musculus
aacctccaggtcagcgtgggcagtc

SEQ ID NO: 502385 - DNA, 25 bp, Mus musculus
aacctccaggtctgcgtgggcagtc

SEQ ID NO: 502386 - DNA, 25 bp, Mus musculus
aacctccgcagacacaaagatcgga

SEQ ID NO: 502387 - DNA, 25 bp, Mus musculus
aacctccgcagagacaaagatcgga

SEQ ID NO: 502388 - DNA, 25 bp, Mus musculus
aacctcctgaaaagggcagccagca

SEQ ID NO: 502389 - DNA, 25 bp, Mus musculus
aacctcctgaaatgggcagccagca

SEQ ID NO: 502390 - DNA, 25 bp, Mus musculus
aacctcggtcttcggaatctaggag

SEQ ID NO: 502391 - DNA, 25 bp, Mus musculus
aacctcggtcttgggaatctaggag

SEQ ID NO: 502392 - DNA, 25 bp, Mus musculus
aacctcgtccagctgctgggtgtga

SEQ ID NO: 502393 - DNA, 25 bp, Mus musculus
aacctcgtccaggtgctgggtgtga

SEQ ID NO: 502394 - DNA, 25 bp, Mus musculus
aacctctactcaaactgttaccaga

SEQ ID NO: 502395 - DNA, 25 bp, Mus musculus
aacctctactcatactgttaccaga

SEQ ID NO: 502396 - DNA, 25 bp, Mus musculus
aacctctataaacatgtggacaccg

SEQ ID NO: 502397 - DNA, 25 bp, Mus musculus
aacctctataaagatgtggacaccg

SEQ ID NO: 502398 - DNA, 25 bp, Mus musculus
aacctctatcggctctgctatagtc

SEQ ID NO: 502399 - DNA, 25 bp, Mus musculus
aacctctatcgggtctgctatagtc

SEQ ID NO: 502400 - DNA, 25 bp, Mus musculus
aacctctctcgacccagcagtgatg

SEQ ID NO: 502401 - DNA, 25 bp, Mus musculus
aacctctctcgagccagcagtgatg

SEQ ID NO: 502402 - DNA, 25 bp, Mus musculus
aacctctctgtacaggagcaccgag

SEQ ID NO: 502403 - DNA, 25 bp, Mus musculus
aacctctctgtagaggagcaccgag

SEQ ID NO: 502404 - DNA, 25 bp, Mus musculus
aacctctcttgccacagtgccatgg

SEQ ID NO: 502405 - DNA, 25 bp, Mus musculus
aacctctcttgcgacagtgccatgg

SEQ ID NO: 502406 - DNA, 25 bp, Mus musculus
aacctctctttcaacatcactgagg

SEQ ID NO: 502407 - DNA, 25 bp, Mus musculus
aacctctctttctacatcactgagg

SEQ ID NO: 502408 - DNA, 25 bp, Mus musculus
aacctctgaggcctttggtgctccg

SEQ ID NO: 502409 - DNA, 25 bp, Mus musculus
aacctctgaggcgtttggtgctccg

SEQ ID NO: 502410 - DNA, 25 bp, Mus musculus
aacctctgcgggagataccacttaa

SEQ ID NO: 502411 - DNA, 25 bp, Mus musculus
aacctctgcgggtgataccacttaa

SEQ ID NO: 502412 - DNA, 25 bp, Mus musculus
aacctctggcagaacagcaagctcc

SEQ ID NO: 502413 - DNA, 25 bp, Mus musculus
aacctctggcagtacagcaagctcc

SEQ ID NO: 502414 - DNA, 25 bp, Mus musculus
aacctctgtgcgcagtgtccttcac

SEQ ID NO: 502415 - DNA, 25 bp, Mus musculus
aacctctgtgcggagtgtccttcac

SEQ ID NO: 502416 - DNA, 25 bp, Mus musculus
aacctcttacatatggcagggatcg

SEQ ID NO: 502417 - DNA, 25 bp, Mus musculus
aacctcttacatttggcagggatcg

SEQ ID NO: 502418 - DNA, 25 bp, Mus musculus
aacctgaacaccaataagcgtcttg

SEQ ID NO: 502419 - DNA, 25 bp, Mus musculus
aacctgaacacctataagcgtcttg

SEQ ID NO: 502420 - DNA, 25 bp, Mus musculus
aacctgaacccacaccatcgggagg

SEQ ID NO: 502421 - DNA, 25 bp, Mus musculus
aacctgaacccagaccatcgggagg

SEQ ID NO: 502422 - DNA, 25 bp, Mus musculus
aacctgaacttcatcctgccgtgtg

SEQ ID NO: 502423 - DNA, 25 bp, Mus musculus
aacctgaacttcttcctgccgtgtg

SEQ ID NO: 502424 - DNA, 25 bp, Mus musculus
aacctgacagacatgcggtgtcgga

SEQ ID NO: 502425 - DNA, 25 bp, Mus musculus
aacctgacagacttgcggtgtcgga

SEQ ID NO: 502426 - DNA, 25 bp, Mus musculus
aacctgacccgcaacaacaaagagc

SEQ ID NO: 502427 - DNA, 25 bp, Mus musculus
aacctgacccgctacaacaaagagc

SEQ ID NO: 502428 - DNA, 25 bp, Mus musculus
aacctgagacctcgggacctcttgg

SEQ ID NO: 502429 - DNA, 25 bp, Mus musculus
aacctgagacctggggacctcttgg

SEQ ID NO: 502430 - DNA, 25 bp, Mus musculus
aacctgagcggcaggaaaccggaag

SEQ ID NO: 502431 - DNA, 25 bp, Mus musculus
aacctgagcggcctcagtgccaagt

SEQ ID NO: 502432 - DNA, 25 bp, Mus musculus
aacctgagcggcgtcagtgccaagt

SEQ ID NO: 502433 - DNA, 25 bp, Mus musculus
aacctgagcggctggaaaccggaag

SEQ ID NO: 502434 - DNA, 25 bp, Mus musculus
aacctgaggaagcagtggcatgcca

SEQ ID NO: 502435 - DNA, 25 bp, Mus musculus
aacctgaggaaggagtggcatgcca

SEQ ID NO: 502436 - DNA, 25 bp, Mus musculus
aacctgaggacccacggaagtgaca

SEQ ID NO: 502437 - DNA, 25 bp, Mus musculus
aacctgaggaccgacggaagtgaca

SEQ ID NO: 502438 - DNA, 25 bp, Mus musculus
aacctgagggaaccaccgcaaggaa

SEQ ID NO: 502439 - DNA, 25 bp, Mus musculus
aacctgagggaacccagcggtcttg

SEQ ID NO: 502440 - DNA, 25 bp, Mus musculus
aacctgagggaagcaccgcaaggaa

SEQ ID NO: 502441 - DNA, 25 bp, Mus musculus
aacctgagggaagccagcggtcttg

SEQ ID NO: 502442 - DNA, 25 bp, Mus musculus
aacctgagtacaacagtcattgctg

SEQ ID NO: 502443 - DNA, 25 bp, Mus musculus
aacctgagtacatcagtcattgctg

SEQ ID NO: 502444 - DNA, 25 bp, Mus musculus
aacctgagttcaagctctggaaccc

SEQ ID NO: 502445 - DNA, 25 bp, Mus musculus
aacctgagttcatgctctggaaccc

SEQ ID NO: 502446 - DNA, 25 bp, Mus musculus
aacctgatggccacaggtgatctgg

SEQ ID NO: 502447 - DNA, 25 bp, Mus musculus
aacctgatggcctcaggtgatctgg

SEQ ID NO: 502448 - DNA, 25 bp, Mus musculus
aacctgcaaatcactggagtcccag

SEQ ID NO: 502449 - DNA, 25 bp, Mus musculus
aacctgcaaatctctggagtcccag

SEQ ID NO: 502450 - DNA, 25 bp, Mus musculus
aacctgcaagaactgagccggatcc

SEQ ID NO: 502451 - DNA, 25 bp, Mus musculus
aacctgcaagaagtgagccggatcc

SEQ ID NO: 502452 - DNA, 25 bp, Mus musculus
aacctgcacgcgattcgggctctgt

SEQ ID NO: 502453 - DNA, 25 bp, Mus musculus
aacctgcacgcgtttcgggctctgt

SEQ ID NO: 502454 - DNA, 25 bp, Mus musculus
aacctgcagacccagcgctatctag

SEQ ID NO: 502455 - DNA, 25 bp, Mus musculus
aacctgcagaccgagcgctatctag

SEQ ID NO: 502456 - DNA, 25 bp, Mus musculus
aacctgcagcagaattgagtcaccc

SEQ ID NO: 502457 - DNA, 25 bp, Mus musculus
aacctgcagcagtattgagtcaccc

SEQ ID NO: 502458 - DNA, 25 bp, Mus musculus
aacctgcaggcacgctctgggaggc

SEQ ID NO: 502459 - DNA, 25 bp, Mus musculus
aacctgcaggcaggctctgggaggc

SEQ ID NO: 502460 - DNA, 25 bp, Mus musculus
aacctgcagggccaggttcccggca

SEQ ID NO: 502461 - DNA, 25 bp, Mus musculus
aacctgcagggcgaggttcccggca

SEQ ID NO: 502462 - DNA, 25 bp, Mus musculus
aacctgcatgccaacctgtgcacag

SEQ ID NO: 502463 - DNA, 25 bp, Mus musculus
aacctgcatgcctacctgtgcacag

SEQ ID NO: 502464 - DNA, 25 bp, Mus musculus
aacctgccctatcgtgttttctcca

SEQ ID NO: 502465 - DNA, 25 bp, Mus musculus
aacctgccctatggtgttttctcca

SEQ ID NO: 502466 - DNA, 25 bp, Mus musculus
aacctgccctgtatgcaagcctcag

SEQ ID NO: 502467 - DNA, 25 bp, Mus musculus
aacctgccctgtttgcaagcctcag

SEQ ID NO: 502468 - DNA, 25 bp, Mus musculus
aacctgcctcttcttggtggcgtgt

SEQ ID NO: 502469 - DNA, 25 bp, Mus musculus
aacctgcctcttgttggtggcgtgt

SEQ ID NO: 502470 - DNA, 25 bp, Mus musculus
aacctgccttcacgatcgtcacggg

SEQ ID NO: 502471 - DNA, 25 bp, Mus musculus
aacctgccttcaggatcgtcacggg

SEQ ID NO: 502472 - DNA, 25 bp, Mus musculus
aacctgcgagatcaccttcttcagc

SEQ ID NO: 502473 - DNA, 25 bp, Mus musculus
aacctgcgagatgaccttcttcagc

SEQ ID NO: 502474 - DNA, 25 bp, Mus musculus
aacctgcgcagccacaagattcaga

SEQ ID NO: 502475 - DNA, 25 bp, Mus musculus
aacctgcgcagcgacaagattcaga

SEQ ID NO: 502476 - DNA, 25 bp, Mus musculus
aacctgcgcatactggtgattgacc

SEQ ID NO: 502477 - DNA, 25 bp, Mus musculus
aacctgcgcatagtggtgattgacc

SEQ ID NO: 502478 - DNA, 25 bp, Mus musculus
aacctgcgtgtgagggagcaccctc

SEQ ID NO: 502479 - DNA, 25 bp, Mus musculus
aacctgcgtgtgtgggagcaccctc

SEQ ID NO: 502480 - DNA, 25 bp, Mus musculus
aacctgctaccccattggaagtggc

SEQ ID NO: 502481 - DNA, 25 bp, Mus musculus
aacctgctacccgattggaagtggc

SEQ ID NO: 502482 - DNA, 25 bp, Mus musculus
aacctgctcatcctcgagaaggcca

SEQ ID NO: 502483 - DNA, 25 bp, Mus musculus
aacctgctcatcgtcgagaaggcca

SEQ ID NO: 502484 - DNA, 25 bp, Mus musculus
aacctgctcggtctgggccagcaga

SEQ ID NO: 502485 - DNA, 25 bp, Mus musculus
aacctgctcggtgtgggccagcaga

SEQ ID NO: 502486 - DNA, 25 bp, Mus musculus
aacctgctggacacgaagtccctga

SEQ ID NO: 502487 - DNA, 25 bp, Mus musculus
aacctgctggactcgaagtccctga

SEQ ID NO: 502488 - DNA, 25 bp, Mus musculus
aacctgctgggtcccgcctgcattt

SEQ ID NO: 502489 - DNA, 25 bp, Mus musculus
aacctgctgggtgccgcctgcattt

SEQ ID NO: 502490 - DNA, 25 bp, Mus musculus
aacctgctgtcgctacaggagctgc

SEQ ID NO: 502491 - DNA, 25 bp, Mus musculus
aacctgctgtcggtacaggagctgc

SEQ ID NO: 502492 - DNA, 25 bp, Mus musculus
aacctggaataacgcgggacttctg

SEQ ID NO: 502493 - DNA, 25 bp, Mus musculus
aacctggaataaggcgggacttctg

SEQ ID NO: 502494 - DNA, 25 bp, Mus musculus
aacctggaccagaagtaagggtgag

SEQ ID NO: 502495 - DNA, 25 bp, Mus musculus
aacctggaccagtagtaagggtgag

SEQ ID NO: 502496 - DNA, 25 bp, Mus musculus
aacctggaccatctatgaaagggcc

SEQ ID NO: 502497 - DNA, 25 bp, Mus musculus
aacctggaccatgtatgaaagggcc

SEQ ID NO: 502498 - DNA, 25 bp, Mus musculus
aacctggaggaccaagagcagatgc

SEQ ID NO: 502499 - DNA, 25 bp, Mus musculus
aacctggaggacgaagagcagatgc

SEQ ID NO: 502500 - DNA, 25 bp, Mus musculus
aacctggagtcccttggctggctga

SEQ ID NO: 502501 - DNA, 25 bp, Mus musculus
aacctggagtccgttggctggctga

SEQ ID NO: 502502 - DNA, 25 bp, Mus musculus
aacctggatgtgcacttctggaaag

SEQ ID NO: 502503 - DNA, 25 bp, Mus musculus
aacctggatgtggacttctggaaag

SEQ ID NO: 502504 - DNA, 25 bp, Mus musculus
aacctggcggccaatccagcctgaa

SEQ ID NO: 502505 - DNA, 25 bp, Mus musculus
aacctggcggcctatccagcctgaa

SEQ ID NO: 502506 - DNA, 25 bp, Mus musculus
aacctggctgacaccaccgaggagg

SEQ ID NO: 502507 - DNA, 25 bp, Mus musculus
aacctggctgactccaccgaggagg

SEQ ID NO: 502508 - DNA, 25 bp, Mus musculus
aacctggctgccagagtgtcgtgga

SEQ ID NO: 502509 - DNA, 25 bp, Mus musculus
aacctggctgcctgagtgtcgtgga

SEQ ID NO: 502510 - DNA, 25 bp, Mus musculus
aacctgggaggcagcctaaccagac

SEQ ID NO: 502511 - DNA, 25 bp, Mus musculus
aacctgggaggccacttctggaact

SEQ ID NO: 502512 - DNA, 25 bp, Mus musculus
aacctgggaggcgacttctggaact

SEQ ID NO: 502513 - DNA, 25 bp, Mus musculus
aacctgggaggctgcctaaccagac

SEQ ID NO: 502514 - DNA, 25 bp, Mus musculus
aacctgggctatccctgcaaccatg

SEQ ID NO: 502515 - DNA, 25 bp, Mus musculus
aacctgggctatgcctgcaaccatg

SEQ ID NO: 502516 - DNA, 25 bp, Mus musculus
aacctggggctcctgaacagcatgg

SEQ ID NO: 502517 - DNA, 25 bp, Mus musculus
aacctggggctcgtgaacagcatgg

SEQ ID NO: 502518 - DNA, 25 bp, Mus musculus
aacctgggtcctcagcgcatcgggc

SEQ ID NO: 502519 - DNA, 25 bp, Mus musculus
aacctgggtcctgagcgcatcgggc

SEQ ID NO: 502520 - DNA, 25 bp, Mus musculus
aacctgggtcttccgcaggattgcg

SEQ ID NO: 502521 - DNA, 25 bp, Mus musculus
aacctgggtcttgcgcaggattgcg

SEQ ID NO: 502522 - DNA, 25 bp, Mus musculus
aacctgggtgaaaactggatcgagg

SEQ ID NO: 502523 - DNA, 25 bp, Mus musculus
aacctgggtgaatactggatcgagg

SEQ ID NO: 502524 - DNA, 25 bp, Mus musculus
aacctggtacgccacctggatgcct

SEQ ID NO: 502525 - DNA, 25 bp, Mus musculus
aacctggtacgcgacctggatgcct

SEQ ID NO: 502526 - DNA, 25 bp, Mus musculus
aacctggtccctcagtgtcttgatc

SEQ ID NO: 502527 - DNA, 25 bp, Mus musculus
aacctggtccctgagtgtcttgatc

SEQ ID NO: 502528 - DNA, 25 bp, Mus musculus
aacctggtctatagaaggcattcca

SEQ ID NO: 502529 - DNA, 25 bp, Mus musculus
aacctggtctattgaaggcattcca

SEQ ID NO: 502530 - DNA, 25 bp, Mus musculus
aacctggtggacagggtgcttagca

SEQ ID NO: 502531 - DNA, 25 bp, Mus musculus
aacctggtggactgggtgcttagca

SEQ ID NO: 502532 - DNA, 25 bp, Mus musculus
aacctggttctccattcctgagaag

SEQ ID NO: 502533 - DNA, 25 bp, Mus musculus
aacctggttctcgattcctgagaag

SEQ ID NO: 502534 - DNA, 25 bp, Mus musculus
aacctggttggtctggagccagcaa

SEQ ID NO: 502535 - DNA, 25 bp, Mus musculus
aacctggttggtgtggagccagcaa

SEQ ID NO: 502536 - DNA, 25 bp, Mus musculus
aacctgtacggcctcactgaagcta

SEQ ID NO: 502537 - DNA, 25 bp, Mus musculus
aacctgtacggcgtcactgaagcta

SEQ ID NO: 502538 - DNA, 25 bp, Mus musculus
aacctgtagaagatgtcctagacga

SEQ ID NO: 502539 - DNA, 25 bp, Mus musculus
aacctgtagaagttgtcctagacga

SEQ ID NO: 502540 - DNA, 25 bp, Mus musculus
aacctgtcactgagcagttgcccct

SEQ ID NO: 502541 - DNA, 25 bp, Mus musculus
aacctgtcactgtgcagttgcccct

SEQ ID NO: 502542 - DNA, 25 bp, Mus musculus
aacctgtcatgacctgccaatcaga

SEQ ID NO: 502543 - DNA, 25 bp, Mus musculus
aacctgtcatgagctgccaatcaga

SEQ ID NO: 502544 - DNA, 25 bp, Mus musculus
aacctgtctctaaaaggcagagaca

SEQ ID NO: 502545 - DNA, 25 bp, Mus musculus
aacctgtctctataaggcagagaca

SEQ ID NO: 502546 - DNA, 25 bp, Mus musculus
aacctgtctgcaccgttcattagcc

SEQ ID NO: 502547 - DNA, 25 bp, Mus musculus
aacctgtctgcagcgttcattagcc

SEQ ID NO: 502548 - DNA, 25 bp, Mus musculus
aacctgtgcacactgcgagagggca

SEQ ID NO: 502549 - DNA, 25 bp, Mus musculus
aacctgtgcacagtgcgagagggca

SEQ ID NO: 502550 - DNA, 25 bp, Mus musculus
aacctgtgccctaccgcttctggag

SEQ ID NO: 502551 - DNA, 25 bp, Mus musculus
aacctgtgcccttccgcttctggag

SEQ ID NO: 502552 - DNA, 25 bp, Mus musculus
aacctgtgcgccagggtactgggat

SEQ ID NO: 502553 - DNA, 25 bp, Mus musculus
aacctgtgcgcctgggtactgggat

SEQ ID NO: 502554 - DNA, 25 bp, Mus musculus
aacctgtgggaacaacaccgaggca

SEQ ID NO: 502555 - DNA, 25 bp, Mus musculus
aacctgtgggaagaacaccgaggca

SEQ ID NO: 502556 - DNA, 25 bp, Mus musculus
aacctgtgtctgagaaggttgacat

SEQ ID NO: 502557 - DNA, 25 bp, Mus musculus
aacctgtgtctgtgaaggttgacat

SEQ ID NO: 502558 - DNA, 25 bp, Mus musculus
aacctgtgtgatacactagaagggt

SEQ ID NO: 502559 - DNA, 25 bp, Mus musculus
aacctgtgtgattcactagaagggt

SEQ ID NO: 502560 - DNA, 25 bp, Mus musculus
aacctgtttgaaatcgtgacgacat

SEQ ID NO: 502561 - DNA, 25 bp, Mus musculus
aacctgtttgaattcgtgacgacat

SEQ ID NO: 502562 - DNA, 25 bp, Mus musculus
aaccttagcgctcgatcccgaacta

SEQ ID NO: 502563 - DNA, 25 bp, Mus musculus
aaccttagcgctggatcccgaacta

SEQ ID NO: 502564 - DNA, 25 bp, Mus musculus
aaccttcaaggccagaatcctgtgc

SEQ ID NO: 502565 - DNA, 25 bp, Mus musculus
aaccttcaaggcgagaatcctgtgc

SEQ ID NO: 502566 - DNA, 25 bp, Mus musculus
aaccttcatattacgctgagagact

SEQ ID NO: 502567 - DNA, 25 bp, Mus musculus
aaccttcatatttcgctgagagact

SEQ ID NO: 502568 - DNA, 25 bp, Mus musculus
aaccttccaagcctgaaagccgaga

SEQ ID NO: 502569 - DNA, 25 bp, Mus musculus
aaccttccaagcgtgaaagccgaga

SEQ ID NO: 502570 - DNA, 25 bp, Mus musculus
aaccttccagacaggctacaagacg

SEQ ID NO: 502571 - DNA, 25 bp, Mus musculus
aaccttccagactggctacaagacg

SEQ ID NO: 502572 - DNA, 25 bp, Mus musculus
aaccttccctgaagtggctcccaga

SEQ ID NO: 502573 - DNA, 25 bp, Mus musculus
aaccttccctgatgtggctcccaga

SEQ ID NO: 502574 - DNA, 25 bp, Mus musculus
aaccttcctgctctacaaccaaggg

SEQ ID NO: 502575 - DNA, 25 bp, Mus musculus
aaccttcctgctgtacaaccaaggg

SEQ ID NO: 502576 - DNA, 25 bp, Mus musculus
aaccttctccgtctgtgagatcatg

SEQ ID NO: 502577 - DNA, 25 bp, Mus musculus
aaccttctccgtgtgtgagatcatg

SEQ ID NO: 502578 - DNA, 25 bp, Mus musculus
aaccttctgcaaagggcttgcaagt

SEQ ID NO: 502579 - DNA, 25 bp, Mus musculus
aaccttctgcaatgggcttgcaagt

SEQ ID NO: 502580 - DNA, 25 bp, Mus musculus
aaccttgaccatcgccgggctggaa

SEQ ID NO: 502581 - DNA, 25 bp, Mus musculus
aaccttgaccatggccgggctggaa

SEQ ID NO: 502582 - DNA, 25 bp, Mus musculus
aaccttgacgcccaggatgagcctg

SEQ ID NO: 502583 - DNA, 25 bp, Mus musculus
aaccttgacgccgaggatgagcctg

SEQ ID NO: 502584 - DNA, 25 bp, Mus musculus
aaccttgagttcagggttgcctgtg

SEQ ID NO: 502585 - DNA, 25 bp, Mus musculus
aaccttgagttctgggttgcctgtg

SEQ ID NO: 502586 - DNA, 25 bp, Mus musculus
aaccttgatactcggctgcccagga

SEQ ID NO: 502587 - DNA, 25 bp, Mus musculus
aaccttgatactgggctgcccagga

SEQ ID NO: 502588 - DNA, 25 bp, Mus musculus
aaccttggcgcgactgctgtacatg

SEQ ID NO: 502589 - DNA, 25 bp, Mus musculus
aaccttggcgcgtctgctgtacatg

SEQ ID NO: 502590 - DNA, 25 bp, Mus musculus
aaccttggcggccttgggagaccat

SEQ ID NO: 502591 - DNA, 25 bp, Mus musculus
aaccttggcggcgttgggagaccat

SEQ ID NO: 502592 - DNA, 25 bp, Mus musculus
aaccttgggtcgaggtcattttgca

SEQ ID NO: 502593 - DNA, 25 bp, Mus musculus
aaccttgggtcgtggtcattttgca

SEQ ID NO: 502594 - DNA, 25 bp, Mus musculus
aaccttgtaaacactgcagcaggtg

SEQ ID NO: 502595 - DNA, 25 bp, Mus musculus
aaccttgtaaactctgcagcaggtg

SEQ ID NO: 502596 - DNA, 25 bp, Mus musculus
aaccttgtgcgcaggtgcgactcgg

SEQ ID NO: 502597 - DNA, 25 bp, Mus musculus
aaccttgtgcgctggtgcgactcgg

SEQ ID NO: 502598 - DNA, 25 bp, Mus musculus
aaccttgttcacaccgcgcagtatg

SEQ ID NO: 502599 - DNA, 25 bp, Mus musculus
aaccttgttcactccgcgcagtatg

SEQ ID NO: 502600 - DNA, 25 bp, Mus musculus
aaccttgttgctctggtaactctca

SEQ ID NO: 502601 - DNA, 25 bp, Mus musculus
aaccttgttgctgtggtaactctca

SEQ ID NO: 502602 - DNA, 25 bp, Mus musculus
aacctttatgtgattgtcttcccgc

SEQ ID NO: 502603 - DNA, 25 bp, Mus musculus
aacctttatgtgtttgtcttcccgc

SEQ ID NO: 502604 - DNA, 25 bp, Mus musculus
aacctttctcgacatgtgacagaag

SEQ ID NO: 502605 - DNA, 25 bp, Mus musculus
aacctttctcgagatgtgacagaag

SEQ ID NO: 502606 - DNA, 25 bp, Mus musculus
aacctttgaaggaccccagcgagct

SEQ ID NO: 502607 - DNA, 25 bp, Mus musculus
aacctttgaaggtccccagcgagct

SEQ ID NO: 502608 - DNA, 25 bp, Mus musculus
aacctttgacatcgagacgtccagc

SEQ ID NO: 502609 - DNA, 25 bp, Mus musculus
aacctttgacatggagacgtccagc

SEQ ID NO: 502610 - DNA, 25 bp, Mus musculus
aacctttgatacaggctgactgcag

SEQ ID NO: 502611 - DNA, 25 bp, Mus musculus
aacctttgatactggctgactgcag

SEQ ID NO: 502612 - DNA, 25 bp, Mus musculus
aacctttgcttaagtgcccagccca

SEQ ID NO: 502613 - DNA, 25 bp, Mus musculus
aacctttgcttatgtgcccagccca

SEQ ID NO: 502614 - DNA, 25 bp, Mus musculus
aaccttttagagaaaatcagcaaag

SEQ ID NO: 502615 - DNA, 25 bp, Mus musculus
aaccttttagagtaaatcagcaaag

SEQ ID NO: 502616 - DNA, 25 bp, Mus musculus
aaccttttattgcagagatgagcaa

SEQ ID NO: 502617 - DNA, 25 bp, Mus musculus
aaccttttattggagagatgagcaa

SEQ ID NO: 502618 - DNA, 25 bp, Mus musculus
aaccttttggttctcagctttgtca

SEQ ID NO: 502619 - DNA, 25 bp, Mus musculus
aaccttttggttgtcagctttgtca

SEQ ID NO: 502620 - DNA, 25 bp, Mus musculus
aacgaaatcgttcacagcctttcag

SEQ ID NO: 502621 - DNA, 25 bp, Mus musculus
aacgaaatcgttgacagcctttcag

SEQ ID NO: 502622 - DNA, 25 bp, Mus musculus
aacgaagatggcactgcctgtgaag

SEQ ID NO: 502623 - DNA, 25 bp, Mus musculus
aacgaagatggctctgcctgtgaag

SEQ ID NO: 502624 - DNA, 25 bp, Mus musculus
aacgaagcctcacgatgaggtgaag

SEQ ID NO: 502625 - DNA, 25 bp, Mus musculus
aacgaagcctcaggatgaggtgaag

SEQ ID NO: 502626 - DNA, 25 bp, Mus musculus
aacgaagctccccactcggaggagg

SEQ ID NO: 502627 - DNA, 25 bp, Mus musculus
aacgaagctcccgactcggaggagg

SEQ ID NO: 502628 - DNA, 25 bp, Mus musculus
aacgaagtgactatccatgaatgcc

SEQ ID NO: 502629 - DNA, 25 bp, Mus musculus
aacgaagtgactttccatgaatgcc

SEQ ID NO: 502630 - DNA, 25 bp, Mus musculus
aacgaatcatggattagtgccctgc

SEQ ID NO: 502631 - DNA, 25 bp, Mus musculus
aacgaatcatggtttagtgccctgc

SEQ ID NO: 502632 - DNA, 25 bp, Mus musculus
aacgaatgagctagtgtttcacaca

SEQ ID NO: 502633 - DNA, 25 bp, Mus musculus
aacgaatgagcttgtgtttcacaca

SEQ ID NO: 502634 - DNA, 25 bp, Mus musculus
aacgaatgatccatcactgagcaga

SEQ ID NO: 502635 - DNA, 25 bp, Mus musculus
aacgaatgatccttcactgagcaga

SEQ ID NO: 502636 - DNA, 25 bp, Mus musculus
aacgaatgatctcctcatatgtggg

SEQ ID NO: 502637 - DNA, 25 bp, Mus musculus
aacgaatgatctgctcatatgtggg

SEQ ID NO: 502638 - DNA, 25 bp, Mus musculus
aacgaatgctggctctcgccgggcc

SEQ ID NO: 502639 - DNA, 25 bp, Mus musculus
aacgaatgctgggtctcgccgggcc

SEQ ID NO: 502640 - DNA, 25 bp, Mus musculus
aacgaatgtgcactcctcaaggcca

SEQ ID NO: 502641 - DNA, 25 bp, Mus musculus
aacgaatgtgcagtcctcaaggcca

SEQ ID NO: 502642 - DNA, 25 bp, Mus musculus
aacgaatgtggtagggcaaatcccg

SEQ ID NO: 502643 - DNA, 25 bp, Mus musculus
aacgaatgtggttgggcaaatcccg

SEQ ID NO: 502644 - DNA, 25 bp, Mus musculus
aacgacaacatgacctactctgtgg

SEQ ID NO: 502645 - DNA, 25 bp, Mus musculus
aacgacaacatgtcctactctgtgg

SEQ ID NO: 502646 - DNA, 25 bp, Mus musculus
aacgacaactccctggtctactttg

SEQ ID NO: 502647 - DNA, 25 bp, Mus musculus
aacgacaactccgtggtctactttg

SEQ ID NO: 502648 - DNA, 25 bp, Mus musculus
aacgacacagtgcatgataccgaca

SEQ ID NO: 502649 - DNA, 25 bp, Mus musculus
aacgacacagtggatgataccgaca

SEQ ID NO: 502650 - DNA, 25 bp, Mus musculus
aacgacagaaccatgcccgtgagct

SEQ ID NO: 502651 - DNA, 25 bp, Mus musculus
aacgacagaaccttgcccgtgagct

SEQ ID NO: 502652 - DNA, 25 bp, Mus musculus
aacgacagaagcacactaccagtga

SEQ ID NO: 502653 - DNA, 25 bp, Mus musculus
aacgacagaagctcactaccagtga

SEQ ID NO: 502654 - DNA, 25 bp, Mus musculus
aacgacagcgagacactgaccatga

SEQ ID NO: 502655 - DNA, 25 bp, Mus musculus
aacgacagcgagtcactgaccatga

SEQ ID NO: 502656 - DNA, 25 bp, Mus musculus
aacgacagggctctgtgcagctgca

SEQ ID NO: 502657 - DNA, 25 bp, Mus musculus
aacgacagggctgtgtgcagctgca

SEQ ID NO: 502658 - DNA, 25 bp, Mus musculus
aacgacagtaaaacaatccagaaag

SEQ ID NO: 502659 - DNA, 25 bp, Mus musculus
aacgacagtaaatcaatccagaaag

SEQ ID NO: 502660 - DNA, 25 bp, Mus musculus
aacgacagtgggatgatgactttcc

SEQ ID NO: 502661 - DNA, 25 bp, Mus musculus
aacgacagtgggttgatgactttcc

SEQ ID NO: 502662 - DNA, 25 bp, Mus musculus
aacgacatgtggacaattggcctcc

SEQ ID NO: 502663 - DNA, 25 bp, Mus musculus
aacgacatgtggtcaattggcctcc

SEQ ID NO: 502664 - DNA, 25 bp, Mus musculus
aacgaccagttcaacaatgccatca

SEQ ID NO: 502665 - DNA, 25 bp, Mus musculus
aacgaccagttctacaatgccatca

SEQ ID NO: 502666 - DNA, 25 bp, Mus musculus
aacgacccaatcctgagctccatag

SEQ ID NO: 502667 - DNA, 25 bp, Mus musculus
aacgacccaatcgtgagctccatag

SEQ ID NO: 502668 - DNA, 25 bp, Mus musculus
aacgacccctcgaagcaatgcatgc

SEQ ID NO: 502669 - DNA, 25 bp, Mus musculus
aacgacccctcgtagcaatgcatgc

SEQ ID NO: 502670 - DNA, 25 bp, Mus musculus
aacgaccggcagaacgactctcggg

SEQ ID NO: 502671 - DNA, 25 bp, Mus musculus
aacgaccggcagtacgactctcggg

SEQ ID NO: 502672 - DNA, 25 bp, Mus musculus
aacgacctggtgcaggccttgaaga

SEQ ID NO: 502673 - DNA, 25 bp, Mus musculus
aacgacctggtggaggccttgaaga

SEQ ID NO: 502674 - DNA, 25 bp, Mus musculus
aacgacgctgagctcctattgctca

SEQ ID NO: 502675 - DNA, 25 bp, Mus musculus
aacgacgctgaggtcctattgctca

SEQ ID NO: 502676 - DNA, 25 bp, Mus musculus
aacgacgggcctcctctcaagaagg

SEQ ID NO: 502677 - DNA, 25 bp, Mus musculus
aacgacgggcctgctctcaagaagg

SEQ ID NO: 502678 - DNA, 25 bp, Mus musculus
aacgactacggccgtgcagtggact

SEQ ID NO: 502679 - DNA, 25 bp, Mus musculus
aacgactacggcggtgcagtggact

SEQ ID NO: 502680 - DNA, 25 bp, Mus musculus
aacgacttccatcggcttgtgcaga

SEQ ID NO: 502681 - DNA, 25 bp, Mus musculus
aacgacttccatgggcttgtgcaga

SEQ ID NO: 502682 - DNA, 25 bp, Mus musculus
aacgagaaagctcacagtgccggtg

SEQ ID NO: 502683 - DNA, 25 bp, Mus musculus
aacgagaaagctgacagtgccggtg

SEQ ID NO: 502684 - DNA, 25 bp, Mus musculus
aacgagaccaggagtcagtacgagg

SEQ ID NO: 502685 - DNA, 25 bp, Mus musculus
aacgagaccaggtgtcagtacgagg

SEQ ID NO: 502686 - DNA, 25 bp, Mus musculus
aacgagaggaacctgtccacgcgcc

SEQ ID NO: 502687 - DNA, 25 bp, Mus musculus
aacgagaggaacgtgtccacgcgcc

SEQ ID NO: 502688 - DNA, 25 bp, Mus musculus
aacgagatgtgaacctgcgggagat

SEQ ID NO: 502689 - DNA, 25 bp, Mus musculus
aacgagatgtgatcctgcgggagat

SEQ ID NO: 502690 - DNA, 25 bp, Mus musculus
aacgagcaccgccttacagttaagt

SEQ ID NO: 502691 - DNA, 25 bp, Mus musculus
aacgagcaccgcgttacagttaagt

SEQ ID NO: 502692 - DNA, 25 bp, Mus musculus
aacgagcctgccctacaagtgggtg

SEQ ID NO: 502693 - DNA, 25 bp, Mus musculus
aacgagcctgccgtacaagtgggtg

SEQ ID NO: 502694 - DNA, 25 bp, Mus musculus
aacgagcgacataagccagagcatc

SEQ ID NO: 502695 - DNA, 25 bp, Mus musculus
aacgagcgacattagccagagcatc

SEQ ID NO: 502696 - DNA, 25 bp, Mus musculus
aacgagctcaaacaagcactctcag

SEQ ID NO: 502697 - DNA, 25 bp, Mus musculus
aacgagctcaaagaagcactctcag

SEQ ID NO: 502698 - DNA, 25 bp, Mus musculus
aacgagctcgaacgcgcagagaaga

SEQ ID NO: 502699 - DNA, 25 bp, Mus musculus
aacgagctcgaaggcgcagagaaga

SEQ ID NO: 502700 - DNA, 25 bp, Mus musculus
aacgagctcttacaggaacactcca

SEQ ID NO: 502701 - DNA, 25 bp, Mus musculus
aacgagctcttagaggaacactcca

SEQ ID NO: 502702 - DNA, 25 bp, Mus musculus
aacgagctgctgatcgcctccttct

SEQ ID NO: 502703 - DNA, 25 bp, Mus musculus
aacgagctgctgttcgcctccttct

SEQ ID NO: 502704 - DNA, 25 bp, Mus musculus
aacgaggacaatcgagctcaagtcc

SEQ ID NO: 502705 - DNA, 25 bp, Mus musculus
aacgaggacaatggagctcaagtcc

SEQ ID NO: 502706 - DNA, 25 bp, Mus musculus
aacgaggacaggatggccacaagct

SEQ ID NO: 502707 - DNA, 25 bp, Mus musculus
aacgaggacaggttggccacaagct

SEQ ID NO: 502708 - DNA, 25 bp, Mus musculus
aacgaggagctcatgggctttacca

SEQ ID NO: 502709 - DNA, 25 bp, Mus musculus
aacgaggagctcttgggctttacca

SEQ ID NO: 502710 - DNA, 25 bp, Mus musculus
aacgaggcatcgatccgactgtaca

SEQ ID NO: 502711 - DNA, 25 bp, Mus musculus
aacgaggcatcgttccgactgtaca

SEQ ID NO: 502712 - DNA, 25 bp, Mus musculus
aacgaggccaagacaggtgctgaca

SEQ ID NO: 502713 - DNA, 25 bp, Mus musculus
aacgaggccaagtcaggtgctgaca

SEQ ID NO: 502714 - DNA, 25 bp, Mus musculus
aacgagggcgaaatggaccaagtga

SEQ ID NO: 502715 - DNA, 25 bp, Mus musculus
aacgagggcgaattggaccaagtga

SEQ ID NO: 502716 - DNA, 25 bp, Mus musculus
aacgagggtcgacagttctatatgc

SEQ ID NO: 502717 - DNA, 25 bp, Mus musculus
aacgagggtcgagagttctatatgc

SEQ ID NO: 502718 - DNA, 25 bp, Mus musculus
aacgaggtggagaccaccagcagtg

SEQ ID NO: 502719 - DNA, 25 bp, Mus musculus
aacgaggtggagtccaccagcagtg

SEQ ID NO: 502720 - DNA, 25 bp, Mus musculus
aacgaggttaccagagcatcttcca

SEQ ID NO: 502721 - DNA, 25 bp, Mus musculus
aacgaggttacctgagcatcttcca

SEQ ID NO: 502722 - DNA, 25 bp, Mus musculus
aacgagtatagccaccgctgcacgc

SEQ ID NO: 502723 - DNA, 25 bp, Mus musculus
aacgagtatagcgaccgctgcacgc

SEQ ID NO: 502724 - DNA, 25 bp, Mus musculus
aacgagtccttcagcttcgagatcc

SEQ ID NO: 502725 - DNA, 25 bp, Mus musculus
aacgagtccttctgcttcgagatcc

SEQ ID NO: 502726 - DNA, 25 bp, Mus musculus
aacgagtgactgacagtgaaagtgg

SEQ ID NO: 502727 - DNA, 25 bp, Mus musculus
aacgagtgactgtcagtgaaagtgg

SEQ ID NO: 502728 - DNA, 25 bp, Mus musculus
aacgagtgcaccaagcctcacctgt

SEQ ID NO: 502729 - DNA, 25 bp, Mus musculus
aacgagtgcacctagcctcacctgt

SEQ ID NO: 502730 - DNA, 25 bp, Mus musculus
aacgagtgcgagactcggcgctgca

SEQ ID NO: 502731 - DNA, 25 bp, Mus musculus
aacgagtgcgagtctcggcgctgca

SEQ ID NO: 502732 - DNA, 25 bp, Mus musculus
aacgagtggtggaaatgccttcaac

SEQ ID NO: 502733 - DNA, 25 bp, Mus musculus
aacgagtggtggtaatgccttcaac

SEQ ID NO: 502734 - DNA, 25 bp, Mus musculus
aacgagtgtgacatctgcgtgacag

SEQ ID NO: 502735 - DNA, 25 bp, Mus musculus
aacgagtgtgacttctgcgtgacag

SEQ ID NO: 502736 - DNA, 25 bp, Mus musculus
aacgagtgttccctagtgctgctca

SEQ ID NO: 502737 - DNA, 25 bp, Mus musculus
aacgagtgttccgtagtgctgctca

SEQ ID NO: 502738 - DNA, 25 bp, Mus musculus
aacgagtttgagaacctgaagctac

SEQ ID NO: 502739 - DNA, 25 bp, Mus musculus
aacgagtttgagtacctgaagctac

SEQ ID NO: 502740 - DNA, 25 bp, Mus musculus
aacgataccaacacccagacacaga

SEQ ID NO: 502741 - DNA, 25 bp, Mus musculus
aacgataccaactcccagacacaga

SEQ ID NO: 502742 - DNA, 25 bp, Mus musculus
aacgatagcattattcaagatgtaa

SEQ ID NO: 502743 - DNA, 25 bp, Mus musculus
aacgatagcatttttcaagatgtaa

SEQ ID NO: 502744 - DNA, 25 bp, Mus musculus
aacgatgaccaccttgccttggccg

SEQ ID NO: 502745 - DNA, 25 bp, Mus musculus
aacgatgaccacgttgccttggccg

SEQ ID NO: 502746 - DNA, 25 bp, Mus musculus
aacgatgaccagacctttcatgctg

SEQ ID NO: 502747 - DNA, 25 bp, Mus musculus
aacgatgaccagtcctttcatgctg

SEQ ID NO: 502748 - DNA, 25 bp, Mus musculus
aacgatgacggtcgccattgctgcc

SEQ ID NO: 502749 - DNA, 25 bp, Mus musculus
aacgatgacggtggccattgctgcc

SEQ ID NO: 502750 - DNA, 25 bp, Mus musculus
aacgatgcagcgactattttaagag

SEQ ID NO: 502751 - DNA, 25 bp, Mus musculus
aacgatgcagcgtctattttaagag

SEQ ID NO: 502752 - DNA, 25 bp, Mus musculus
aacgatgcctttctgctgaaaaccc

SEQ ID NO: 502753 - DNA, 25 bp, Mus musculus
aacgatgcctttgtgctgaaaaccc

SEQ ID NO: 502754 - DNA, 25 bp, Mus musculus
aacgatggacgacagagagcctctc

SEQ ID NO: 502755 - DNA, 25 bp, Mus musculus
aacgatggacgagagagagcctctc

SEQ ID NO: 502756 - DNA, 25 bp, Mus musculus
aacgatggcaacatgacctgctaag

SEQ ID NO: 502757 - DNA, 25 bp, Mus musculus
aacgatggcaacttgacctgctaag

SEQ ID NO: 502758 - DNA, 25 bp, Mus musculus
aacgatggccacagagtctacagcc

SEQ ID NO: 502759 - DNA, 25 bp, Mus musculus
aacgatggccactgagtctacagcc

SEQ ID NO: 502760 - DNA, 25 bp, Mus musculus
aacgatgggacactgtcggtcagcc

SEQ ID NO: 502761 - DNA, 25 bp, Mus musculus
aacgatgggacagtgtcggtcagcc

SEQ ID NO: 502762 - DNA, 25 bp, Mus musculus
aacgattccgggatttgctactgcc

SEQ ID NO: 502763 - DNA, 25 bp, Mus musculus
aacgattccgggttttgctactgcc

SEQ ID NO: 502764 - DNA, 25 bp, Mus musculus
aacgcaaggaatctcccgaccagct

SEQ ID NO: 502765 - DNA, 25 bp, Mus musculus
aacgcaaggaatgtcccgaccagct

SEQ ID NO: 502766 - DNA, 25 bp, Mus musculus
aacgcaccacaaatgctcagcaagt

SEQ ID NO: 502767 - DNA, 25 bp, Mus musculus
aacgcaccacaattgctcagcaagt

SEQ ID NO: 502768 - DNA, 25 bp, Mus musculus
aacgcacggaggagtccgctcccgg

SEQ ID NO: 502769 - DNA, 25 bp, Mus musculus
aacgcacggaggtgtccgctcccgg

SEQ ID NO: 502770 - DNA, 25 bp, Mus musculus
aacgcactccttcgcgaggcatact

SEQ ID NO: 502771 - DNA, 25 bp, Mus musculus
aacgcactccttggcgaggcatact

SEQ ID NO: 502772 - DNA, 25 bp, Mus musculus
aacgcactgtcgagggagtattgcc

SEQ ID NO: 502773 - DNA, 25 bp, Mus musculus
aacgcactgtcgtgggagtattgcc

SEQ ID NO: 502774 - DNA, 25 bp, Mus musculus
aacgcagaaaataagcggcctgagg

SEQ ID NO: 502775 - DNA, 25 bp, Mus musculus
aacgcagaaaattagcggcctgagg

SEQ ID NO: 502776 - DNA, 25 bp, Mus musculus
aacgcagaggccaccaagcgctgct

SEQ ID NO: 502777 - DNA, 25 bp, Mus musculus
aacgcagaggcctccaagcgctgct

SEQ ID NO: 502778 - DNA, 25 bp, Mus musculus
aacgcagcactcataagtctcgaag

SEQ ID NO: 502779 - DNA, 25 bp, Mus musculus
aacgcagcactcttaagtctcgaag

SEQ ID NO: 502780 - DNA, 25 bp, Mus musculus
aacgcagcactgctcagcaactatg

SEQ ID NO: 502781 - DNA, 25 bp, Mus musculus
aacgcagcactggtcagcaactatg

SEQ ID NO: 502782 - DNA, 25 bp, Mus musculus
aacgcaggatgaacctgcctacggg

SEQ ID NO: 502783 - DNA, 25 bp, Mus musculus
aacgcaggatgatcctgcctacggg

SEQ ID NO: 502784 - DNA, 25 bp, Mus musculus
aacgcagggtccacaacgggagtcg

SEQ ID NO: 502785 - DNA, 25 bp, Mus musculus
aacgcagggtcctcaacgggagtcg

SEQ ID NO: 502786 - DNA, 25 bp, Mus musculus
aacgcatcctggacgggtaacctca

SEQ ID NO: 502787 - DNA, 25 bp, Mus musculus
aacgcatcctggtcgggtaacctca

SEQ ID NO: 502788 - DNA, 25 bp, Mus musculus
aacgcatcgtgtccgtcatgggccc

SEQ ID NO: 502789 - DNA, 25 bp, Mus musculus
aacgcatcgtgtgcgtcatgggccc

SEQ ID NO: 502790 - DNA, 25 bp, Mus musculus
aacgcatgtggtcggctttcttggc

SEQ ID NO: 502791 - DNA, 25 bp, Mus musculus
aacgcatgtggtgggctttcttggc

SEQ ID NO: 502792 - DNA, 25 bp, Mus musculus
aacgccaaagccaatcctatagcgg

SEQ ID NO: 502793 - DNA, 25 bp, Mus musculus
aacgccaaagcctatcctatagcgg

SEQ ID NO: 502794 - DNA, 25 bp, Mus musculus
aacgccatggcgatcgctgcaggcg

SEQ ID NO: 502795 - DNA, 25 bp, Mus musculus
aacgccatggcgttcgctgcaggcg

SEQ ID NO: 502796 - DNA, 25 bp, Mus musculus
aacgcccaggtacctttggctctca

SEQ ID NO: 502797 - DNA, 25 bp, Mus musculus
aacgcccaggtagctttggctctca

SEQ ID NO: 502798 - DNA, 25 bp, Mus musculus
aacgccgacgccaggaacatgggcg

SEQ ID NO: 502799 - DNA, 25 bp, Mus musculus
aacgccgacgcctggaacatgggcg

SEQ ID NO: 502800 - DNA, 25 bp, Mus musculus
aacgccgtcatcaccaggatcatca

SEQ ID NO: 502801 - DNA, 25 bp, Mus musculus
aacgccgtcatctccaggatcatca

SEQ ID NO: 502802 - DNA, 25 bp, Mus musculus
aacgccgtggaccagattctcacag

SEQ ID NO: 502803 - DNA, 25 bp, Mus musculus
aacgccgtggacgagattctcacag

SEQ ID NO: 502804 - DNA, 25 bp, Mus musculus
aacgcctccgatcatgatgtcgcca

SEQ ID NO: 502805 - DNA, 25 bp, Mus musculus
aacgcctccgatgatgatgtcgcca

SEQ ID NO: 502806 - DNA, 25 bp, Mus musculus
aacgcctcctagacctcttggaagg

SEQ ID NO: 502807 - DNA, 25 bp, Mus musculus
aacgcctcctagtcctcttggaagg

SEQ ID NO: 502808 - DNA, 25 bp, Mus musculus
aacgcctggagcctgtgatcatgga

SEQ ID NO: 502809 - DNA, 25 bp, Mus musculus
aacgcctggagcgtgtgatcatgga

SEQ ID NO: 502810 - DNA, 25 bp, Mus musculus
aacgccttcgcccagatgctgcggt

SEQ ID NO: 502811 - DNA, 25 bp, Mus musculus
aacgccttcgccgagatgctgcggt

SEQ ID NO: 502812 - DNA, 25 bp, Mus musculus
aacgcgaagtctctggtgcgcttgc

SEQ ID NO: 502813 - DNA, 25 bp, Mus musculus
aacgcgaagtctgtggtgcgcttgc

SEQ ID NO: 502814 - DNA, 25 bp, Mus musculus
aacgcgagcaagaaccagcaggatg

SEQ ID NO: 502815 - DNA, 25 bp, Mus musculus
aacgcgagcaagtaccagcaggatg

SEQ ID NO: 502816 - DNA, 25 bp, Mus musculus
aacgcgagcgtgcaaggagacacct

SEQ ID NO: 502817 - DNA, 25 bp, Mus musculus
aacgcgagcgtggaaggagacacct

SEQ ID NO: 502818 - DNA, 25 bp, Mus musculus
aacgcgcaggccagatgggtccagc

SEQ ID NO: 502819 - DNA, 25 bp, Mus musculus
aacgcgcaggccctggcttgtcgta

SEQ ID NO: 502820 - DNA, 25 bp, Mus musculus
aacgcgcaggccgtggcttgtcgta

SEQ ID NO: 502821 - DNA, 25 bp, Mus musculus
aacgcgcaggcctgatgggtccagc

SEQ ID NO: 502822 - DNA, 25 bp, Mus musculus
aacgcggagcgtatgctggaaactg

SEQ ID NO: 502823 - DNA, 25 bp, Mus musculus
aacgcggagcgtttgctggaaactg

SEQ ID NO: 502824 - DNA, 25 bp, Mus musculus
aacgcggtaaatacaaggaggcaga

SEQ ID NO: 502825 - DNA, 25 bp, Mus musculus
aacgcggtaaattcaaggaggcaga

SEQ ID NO: 502826 - DNA, 25 bp, Mus musculus
aacgcgtgctggacgctttcggcca

SEQ ID NO: 502827 - DNA, 25 bp, Mus musculus
aacgcgtgctggtcgctttcggcca

SEQ ID NO: 502828 - DNA, 25 bp, Mus musculus
aacgctaactgtaaagattgtgatc

SEQ ID NO: 502829 - DNA, 25 bp, Mus musculus
aacgctaactgttaagattgtgatc

SEQ ID NO: 502830 - DNA, 25 bp, Mus musculus
aacgctacaagaattccttggagac

SEQ ID NO: 502831 - DNA, 25 bp, Mus musculus
aacgctacaagatttccttggagac

SEQ ID NO: 502832 - DNA, 25 bp, Mus musculus
aacgctacagcgagaaggacgatga

SEQ ID NO: 502833 - DNA, 25 bp, Mus musculus
aacgctacagcgtgaaggacgatga

SEQ ID NO: 502834 - DNA, 25 bp, Mus musculus
aacgctatggccagggctctgcacc

SEQ ID NO: 502835 - DNA, 25 bp, Mus musculus
aacgctatggcctgggctctgcacc

SEQ ID NO: 502836 - DNA, 25 bp, Mus musculus
aacgctctctgccatagttgaagaa

SEQ ID NO: 502837 - DNA, 25 bp, Mus musculus
aacgctctctgcgatagttgaagaa

SEQ ID NO: 502838 - DNA, 25 bp, Mus musculus
aacgctgaagccaacatcctgaatg

SEQ ID NO: 502839 - DNA, 25 bp, Mus musculus
aacgctgaagcctacatcctgaatg

SEQ ID NO: 502840 - DNA, 25 bp, Mus musculus
aacgctgaatagaagtggtgaacac

SEQ ID NO: 502841 - DNA, 25 bp, Mus musculus
aacgctgaatagtagtggtgaacac

SEQ ID NO: 502842 - DNA, 25 bp, Mus musculus
aacgctgagcccaggctatatccga

SEQ ID NO: 502843 - DNA, 25 bp, Mus musculus
aacgctgagccctggctatatccga

SEQ ID NO: 502844 - DNA, 25 bp, Mus musculus
aacgctgaggcgcatgtgctacctc

SEQ ID NO: 502845 - DNA, 25 bp, Mus musculus
aacgctgaggcggatgtgctacctc

SEQ ID NO: 502846 - DNA, 25 bp, Mus musculus
aacgctgcagagattctcatcctgg

SEQ ID NO: 502847 - DNA, 25 bp, Mus musculus
aacgctgcagagtttctcatcctgg

SEQ ID NO: 502848 - DNA, 25 bp, Mus musculus
aacgctgcagtaatgtcaatgtgac

SEQ ID NO: 502849 - DNA, 25 bp, Mus musculus
aacgctgcagtattgtcaatgtgac

SEQ ID NO: 502850 - DNA, 25 bp, Mus musculus
aacgctgctcagcacgtccgggctt

SEQ ID NO: 502851 - DNA, 25 bp, Mus musculus
aacgctgctcaggacgtccgggctt

SEQ ID NO: 502852 - DNA, 25 bp, Mus musculus
aacgctgctcgcctggacttcaagg

SEQ ID NO: 502853 - DNA, 25 bp, Mus musculus
aacgctgctcgcgtggacttcaagg

SEQ ID NO: 502854 - DNA, 25 bp, Mus musculus
aacgctgttgctcagaagcaggcag

SEQ ID NO: 502855 - DNA, 25 bp, Mus musculus
aacgctgttgctgagaagcaggcag

SEQ ID NO: 502856 - DNA, 25 bp, Mus musculus
aacgcttccgaacaggccagactgc

SEQ ID NO: 502857 - DNA, 25 bp, Mus musculus
aacgcttccgaagaggccagactgc

SEQ ID NO: 502858 - DNA, 25 bp, Mus musculus
aacgctttaccgagtacagctctaa

SEQ ID NO: 502859 - DNA, 25 bp, Mus musculus
aacgctttaccgtgtacagctctaa

SEQ ID NO: 502860 - DNA, 25 bp, Mus musculus
aacgctttgcagacatcgtcccaac

SEQ ID NO: 502861 - DNA, 25 bp, Mus musculus
aacgctttgcagtcatcgtcccaac

SEQ ID NO: 502862 - DNA, 25 bp, Mus musculus
aacgcttttagcctctgcactttgg

SEQ ID NO: 502863 - DNA, 25 bp, Mus musculus
aacgcttttagcgtctgcactttgg

SEQ ID NO: 502864 - DNA, 25 bp, Mus musculus
aacggaactgacaagggaactggca

SEQ ID NO: 502865 - DNA, 25 bp, Mus musculus
aacggaactgactagggaactggca

SEQ ID NO: 502866 - DNA, 25 bp, Mus musculus
aacggaactggactaaatctactct

SEQ ID NO: 502867 - DNA, 25 bp, Mus musculus
aacggaactggagtaaatctactct

SEQ ID NO: 502868 - DNA, 25 bp, Mus musculus
aacggaagtcgtactctgagcaggc

SEQ ID NO: 502869 - DNA, 25 bp, Mus musculus
aacggaagtcgttctctgagcaggc

SEQ ID NO: 502870 - DNA, 25 bp, Mus musculus
aacggaatccctcttggtgtatcac

SEQ ID NO: 502871 - DNA, 25 bp, Mus musculus
aacggaatccctgttggtgtatcac

SEQ ID NO: 502872 - DNA, 25 bp, Mus musculus
aacggaccagaactgagctcctgcc

SEQ ID NO: 502873 - DNA, 25 bp, Mus musculus
aacggaccagaagtgagctcctgcc

SEQ ID NO: 502874 - DNA, 25 bp, Mus musculus
aacggaccagatctgaagaccaggt

SEQ ID NO: 502875 - DNA, 25 bp, Mus musculus
aacggaccagatgtgaagaccaggt

SEQ ID NO: 502876 - DNA, 25 bp, Mus musculus
aacggacccacgactgccatgtctt

SEQ ID NO: 502877 - DNA, 25 bp, Mus musculus
aacggacccacgtctgccatgtctt

SEQ ID NO: 502878 - DNA, 25 bp, Mus musculus
aacggactcctgagccccagagata

SEQ ID NO: 502879 - DNA, 25 bp, Mus musculus
aacggactcctgtgccccagagata

SEQ ID NO: 502880 - DNA, 25 bp, Mus musculus
aacggactgttgagatctgtgaaaa

SEQ ID NO: 502881 - DNA, 25 bp, Mus musculus
aacggactgttgtgatctgtgaaaa

SEQ ID NO: 502882 - DNA, 25 bp, Mus musculus
aacggagactgtccatgcatctgca

SEQ ID NO: 502883 - DNA, 25 bp, Mus musculus
aacggagactgtgcatgcatctgca

SEQ ID NO: 502884 - DNA, 25 bp, Mus musculus
aacggagatccccagatgatgagct

SEQ ID NO: 502885 - DNA, 25 bp, Mus musculus
aacggagatcccgagatgatgagct

SEQ ID NO: 502886 - DNA, 25 bp, Mus musculus
aacggagatggtataaatgtgaaac

SEQ ID NO: 502887 - DNA, 25 bp, Mus musculus
aacggagatggtttaaatgtgaaac

SEQ ID NO: 502888 - DNA, 25 bp, Mus musculus
aacggagcatgcctgttagcgagcc

SEQ ID NO: 502889 - DNA, 25 bp, Mus musculus
aacggagcatgcgtgttagcgagcc

SEQ ID NO: 502890 - DNA, 25 bp, Mus musculus
aacggagctgtgagacctgccagga

SEQ ID NO: 502891 - DNA, 25 bp, Mus musculus
aacggagctgtgtgacctgccagga

SEQ ID NO: 502892 - DNA, 25 bp, Mus musculus
aacggaggcgtgagcctggccacat

SEQ ID NO: 502893 - DNA, 25 bp, Mus musculus
aacggaggcgtgtgcctggccacat

SEQ ID NO: 502894 - DNA, 25 bp, Mus musculus
aacggaggtgtgcaaagcaacagcc

SEQ ID NO: 502895 - DNA, 25 bp, Mus musculus
aacggaggtgtggaaagcaacagcc

SEQ ID NO: 502896 - DNA, 25 bp, Mus musculus
aacggatacatcagctgcaatgagc

SEQ ID NO: 502897 - DNA, 25 bp, Mus musculus
aacggatacatctgctgcaatgagc

SEQ ID NO: 502898 - DNA, 25 bp, Mus musculus
aacggatcctatcacactgacatca

SEQ ID NO: 502899 - DNA, 25 bp, Mus musculus
aacggatcctatgacactgacatca

SEQ ID NO: 502900 - DNA, 25 bp, Mus musculus
aacggatgcaaaacgtctgcatggc

SEQ ID NO: 502901 - DNA, 25 bp, Mus musculus
aacggatgcaaatcgtctgcatggc

SEQ ID NO: 502902 - DNA, 25 bp, Mus musculus
aacggattctaacggaagacactga

SEQ ID NO: 502903 - DNA, 25 bp, Mus musculus
aacggattctaagggaagacactga

SEQ ID NO: 502904 - DNA, 25 bp, Mus musculus
aacggatttgcccaaggtcaccgag

SEQ ID NO: 502905 - DNA, 25 bp, Mus musculus
aacggatttgccgaaggtcaccgag

SEQ ID NO: 502906 - DNA, 25 bp, Mus musculus
aacggcaaatctaaatgacaggtgg

SEQ ID NO: 502907 - DNA, 25 bp, Mus musculus
aacggcaaatcttaatgacaggtgg

SEQ ID NO: 502908 - DNA, 25 bp, Mus musculus
aacggcaactatccattgaaaaata

SEQ ID NO: 502909 - DNA, 25 bp, Mus musculus
aacggcaactatgcattgaaaaata

SEQ ID NO: 502910 - DNA, 25 bp, Mus musculus
aacggcacatgcatcgcttcagcag

SEQ ID NO: 502911 - DNA, 25 bp, Mus musculus
aacggcacatgcttcgcttcagcag

SEQ ID NO: 502912 - DNA, 25 bp, Mus musculus
aacggcactctcagttcaggcttcc

SEQ ID NO: 502913 - DNA, 25 bp, Mus musculus
aacggcactctctgttcaggcttcc

SEQ ID NO: 502914 - DNA, 25 bp, Mus musculus
aacggcagatgcctctggagcaaca

SEQ ID NO: 502915 - DNA, 25 bp, Mus musculus
aacggcagatgcgtctggagcaaca

SEQ ID NO: 502916 - DNA, 25 bp, Mus musculus
aacggcagcgatcacggtgcccagc

SEQ ID NO: 502917 - DNA, 25 bp, Mus musculus
aacggcagcgatgacggtgcccagc

SEQ ID NO: 502918 - DNA, 25 bp, Mus musculus
aacggccaactacctggttatctgg

SEQ ID NO: 502919 - DNA, 25 bp, Mus musculus
aacggccaactagctggttatctgg

SEQ ID NO: 502920 - DNA, 25 bp, Mus musculus
aacggccacctgcactcctatgaga

SEQ ID NO: 502921 - DNA, 25 bp, Mus musculus
aacggccacctggactcctatgaga

SEQ ID NO: 502922 - DNA, 25 bp, Mus musculus
aacggccagagaagttgagtgagca

SEQ ID NO: 502923 - DNA, 25 bp, Mus musculus
aacggccagagatgttgagtgagca

SEQ ID NO: 502924 - DNA, 25 bp, Mus musculus
aacggccagtctactcttgaggagg

SEQ ID NO: 502925 - DNA, 25 bp, Mus musculus
aacggccagtcttctcttgaggagg

SEQ ID NO: 502926 - DNA, 25 bp, Mus musculus
aacggccatggcactggcctcctga

SEQ ID NO: 502927 - DNA, 25 bp, Mus musculus
aacggccatggctctggcctcctga

SEQ ID NO: 502928 - DNA, 25 bp, Mus musculus
aacggccgctgccaggtcctgtata

SEQ ID NO: 502929 - DNA, 25 bp, Mus musculus
aacggccgctgcgaggtcctgtata

SEQ ID NO: 502930 - DNA, 25 bp, Mus musculus
aacggcctcaggcttactgtgtact

SEQ ID NO: 502931 - DNA, 25 bp, Mus musculus
aacggcctcagggttactgtgtact

SEQ ID NO: 502932 - DNA, 25 bp, Mus musculus
aacggcctgcgaaggatcttggatg

SEQ ID NO: 502933 - DNA, 25 bp, Mus musculus
aacggcctgcgatggatcttggatg

SEQ ID NO: 502934 - DNA, 25 bp, Mus musculus
aacggcgcatccaccaggagagtga

SEQ ID NO: 502935 - DNA, 25 bp, Mus musculus
aacggcgcatcctccaggagagtga

SEQ ID NO: 502936 - DNA, 25 bp, Mus musculus
aacggcggcggaaccgctcagccat

SEQ ID NO: 502937 - DNA, 25 bp, Mus musculus
aacggcggcggatccgctcagccat

SEQ ID NO: 502938 - DNA, 25 bp, Mus musculus
aacggcgttcatattcgcgacatac

SEQ ID NO: 502939 - DNA, 25 bp, Mus musculus
aacggcgttcattttcgcgacatac

SEQ ID NO: 502940 - DNA, 25 bp, Mus musculus
aacggctaccgtcgtgtctgcatca

SEQ ID NO: 502941 - DNA, 25 bp, Mus musculus
aacggctaccgtggtgtctgcatca

SEQ ID NO: 502942 - DNA, 25 bp, Mus musculus
aacggctgcactccactccattatg

SEQ ID NO: 502943 - DNA, 25 bp, Mus musculus
aacggctgcactgcactccattatg

SEQ ID NO: 502944 - DNA, 25 bp, Mus musculus
aacggctggatcctcttcctggcga

SEQ ID NO: 502945 - DNA, 25 bp, Mus musculus
aacggctggatcgtcttcctggcga

SEQ ID NO: 502946 - DNA, 25 bp, Mus musculus
aacggctgtttcctcttatccaagc

SEQ ID NO: 502947 - DNA, 25 bp, Mus musculus
aacggctgtttcgtcttatccaagc

SEQ ID NO: 502948 - DNA, 25 bp, Mus musculus
aacggctttgacctggaccgccagt

SEQ ID NO: 502949 - DNA, 25 bp, Mus musculus
aacggctttgacgtggaccgccagt

SEQ ID NO: 502950 - DNA, 25 bp, Mus musculus
aacgggaacttcattccaggctctg

SEQ ID NO: 502951 - DNA, 25 bp, Mus musculus
aacgggaacttctttccaggctctg

SEQ ID NO: 502952 - DNA, 25 bp, Mus musculus
aacgggacagcacgctttgaatgcc

SEQ ID NO: 502953 - DNA, 25 bp, Mus musculus
aacgggacagcaggctttgaatgcc

SEQ ID NO: 502954 - DNA, 25 bp, Mus musculus
aacgggaccatccagtgcgagactc

SEQ ID NO: 502955 - DNA, 25 bp, Mus musculus
aacgggaccatcgagtgcgagactc

SEQ ID NO: 502956 - DNA, 25 bp, Mus musculus
aacgggagatctatgaccgctatgg

SEQ ID NO: 502957 - DNA, 25 bp, Mus musculus
aacgggagatctttgaccgctatgg

SEQ ID NO: 502958 - DNA, 25 bp, Mus musculus
aacgggagcctcatcccagctgcag

SEQ ID NO: 502959 - DNA, 25 bp, Mus musculus
aacgggagcctcttcccagctgcag

SEQ ID NO: 502960 - DNA, 25 bp, Mus musculus
aacgggagtaagatcgggccagaca

SEQ ID NO: 502961 - DNA, 25 bp, Mus musculus
aacgggagtaagttcgggccagaca

SEQ ID NO: 502962 - DNA, 25 bp, Mus musculus
aacgggatcgacatcatcctggccg

SEQ ID NO: 502963 - DNA, 25 bp, Mus musculus
aacgggatcgacttcatcctggccg

SEQ ID NO: 502964 - DNA, 25 bp, Mus musculus
aacgggcatgttaaaggaactctgg

SEQ ID NO: 502965 - DNA, 25 bp, Mus musculus
aacgggcatgtttaaggaactctgg

SEQ ID NO: 502966 - DNA, 25 bp, Mus musculus
aacgggctcctgagcggccgcgaca

SEQ ID NO: 502967 - DNA, 25 bp, Mus musculus
aacgggctcctgtgcggccgcgaca

SEQ ID NO: 502968 - DNA, 25 bp, Mus musculus
aacgggctcgggactgtccagagaa

SEQ ID NO: 502969 - DNA, 25 bp, Mus musculus
aacgggctcgggtctgtccagagaa

SEQ ID NO: 502970 - DNA, 25 bp, Mus musculus
aacgggctgggcatctactgtggca

SEQ ID NO: 502971 - DNA, 25 bp, Mus musculus
aacgggctgggcttctactgtggca

SEQ ID NO: 502972 - DNA, 25 bp, Mus musculus
aacgggcttgtaaactggccattcg

SEQ ID NO: 502973 - DNA, 25 bp, Mus musculus
aacgggcttgtatactggccattcg

SEQ ID NO: 502974 - DNA, 25 bp, Mus musculus
aacggggtgctcaccaatggcgaca

SEQ ID NO: 502975 - DNA, 25 bp, Mus musculus
aacggggtgctctccaatggcgaca

SEQ ID NO: 502976 - DNA, 25 bp, Mus musculus
aacggtaagaatcccaagaaggaag

SEQ ID NO: 502977 - DNA, 25 bp, Mus musculus
aacggtaagaatgccaagaaggaag

SEQ ID NO: 502978 - DNA, 25 bp, Mus musculus
aacggtacccgcaaccattgcgcag

SEQ ID NO: 502979 - DNA, 25 bp, Mus musculus
aacggtacccgctaccattgcgcag

SEQ ID NO: 502980 - DNA, 25 bp, Mus musculus
aacggtactggcctctgtcgaccct

SEQ ID NO: 502981 - DNA, 25 bp, Mus musculus
aacggtactggcgtctgtcgaccct

SEQ ID NO: 502982 - DNA, 25 bp, Mus musculus
aacggtacttacagatggcctggac

SEQ ID NO: 502983 - DNA, 25 bp, Mus musculus
aacggtacttactgatggcctggac

SEQ ID NO: 502984 - DNA, 25 bp, Mus musculus
aacggtagagaaagacattgatcag

SEQ ID NO: 502985 - DNA, 25 bp, Mus musculus
aacggtagagaatgacattgatcag

SEQ ID NO: 502986 - DNA, 25 bp, Mus musculus
aacggtctaaaaagcatctgccgcc

SEQ ID NO: 502987 - DNA, 25 bp, Mus musculus
aacggtctaaaatgcatctgccgcc

SEQ ID NO: 502988 - DNA, 25 bp, Mus musculus
aacggtctttctctacccatggtag

SEQ ID NO: 502989 - DNA, 25 bp, Mus musculus
aacggtctttctgtacccatggtag

SEQ ID NO: 502990 - DNA, 25 bp, Mus musculus
aacggtgacctacacccctgggcag

SEQ ID NO: 502991 - DNA, 25 bp, Mus musculus
aacggtgacctagacccctgggcag

SEQ ID NO: 502992 - DNA, 25 bp, Mus musculus
aacggtgacgaacaacttgaagtca

SEQ ID NO: 502993 - DNA, 25 bp, Mus musculus
aacggtgacgaagaacttgaagtca

SEQ ID NO: 502994 - DNA, 25 bp, Mus musculus
aacggtgagtgcagccagctgtcag

SEQ ID NO: 502995 - DNA, 25 bp, Mus musculus
aacggtgagtgctgccagctgtcag

SEQ ID NO: 502996 - DNA, 25 bp, Mus musculus
aacggtgagtgtctgaacacagaag

SEQ ID NO: 502997 - DNA, 25 bp, Mus musculus
aacggtgagtgtgtgaacacagaag

SEQ ID NO: 502998 - DNA, 25 bp, Mus musculus
aacggtgcctgccttttccgagcgt

SEQ ID NO: 502999 - DNA, 25 bp, Mus musculus
aacggtgcctgcgttttccgagcgt

SEQ ID NO: 503000 - DNA, 25 bp, Mus musculus
aacggtgcgatcaagaagctgtcgg

SEQ ID NO: 503001 - DNA, 25 bp, Mus musculus
aacggtgcgatctagaagctgtcgg

SEQ ID NO: 503002 - DNA, 25 bp, Mus musculus
aacggtgctggacccaggccagtcc

SEQ ID NO: 503003 - DNA, 25 bp, Mus musculus
aacggtgctggagccaggccagtcc

SEQ ID NO: 503004 - DNA, 25 bp, Mus musculus
aacggtggacgcatatattacctgc

SEQ ID NO: 503005 - DNA, 25 bp, Mus musculus
aacggtggacgcttatattacctgc

SEQ ID NO: 503006 - DNA, 25 bp, Mus musculus
aacggtggcaatccagccagcgcag

SEQ ID NO: 503007 - DNA, 25 bp, Mus musculus
aacggtggcaatgcagccagcgcag

SEQ ID NO: 503008 - DNA, 25 bp, Mus musculus
aacggtggtacaagcatctcgggcc

SEQ ID NO: 503009 - DNA, 25 bp, Mus musculus
aacggtggtacatgcatctcgggcc

SEQ ID NO: 503010 - DNA, 25 bp, Mus musculus
aacggtgtggaacgactgattgatc

SEQ ID NO: 503011 - DNA, 25 bp, Mus musculus
aacggtgtggaaggactgattgatc

SEQ ID NO: 503012 - DNA, 25 bp, Mus musculus
aacggtgtggacctcctaatgaagt

SEQ ID NO: 503013 - DNA, 25 bp, Mus musculus
aacggtgtggacgtcctaatgaagt

SEQ ID NO: 503014 - DNA, 25 bp, Mus musculus
aacgtaattagtaccaagatctggc

SEQ ID NO: 503015 - DNA, 25 bp, Mus musculus
aacgtaattagttccaagatctggc

SEQ ID NO: 503016 - DNA, 25 bp, Mus musculus
aacgtacaatagaatccctgatgga

SEQ ID NO: 503017 - DNA, 25 bp, Mus musculus
aacgtacaatagtatccctgatgga

SEQ ID NO: 503018 - DNA, 25 bp, Mus musculus
aacgtacctgcaagcctacaaagag

SEQ ID NO: 503019 - DNA, 25 bp, Mus musculus
aacgtacctgcatgcctacaaagag

SEQ ID NO: 503020 - DNA, 25 bp, Mus musculus
aacgtacgtgcacgagcattctgta

SEQ ID NO: 503021 - DNA, 25 bp, Mus musculus
aacgtacgtgcaggagcattctgta

SEQ ID NO: 503022 - DNA, 25 bp, Mus musculus
aacgtcaaagaaagtgccgcccatg

SEQ ID NO: 503023 - DNA, 25 bp, Mus musculus
aacgtcaaagaatgtgccgcccatg

SEQ ID NO: 503024 - DNA, 25 bp, Mus musculus
aacgtcaagggcaggtcacccctgg

SEQ ID NO: 503025 - DNA, 25 bp, Mus musculus
aacgtcaagggctggtcacccctgg

SEQ ID NO: 503026 - DNA, 25 bp, Mus musculus
aacgtcagctacaaaaagaccctgc

SEQ ID NO: 503027 - DNA, 25 bp, Mus musculus
aacgtcagctactaaaagaccctgc

SEQ ID NO: 503028 - DNA, 25 bp, Mus musculus
aacgtcatctagaggaatttgcccc

SEQ ID NO: 503029 - DNA, 25 bp, Mus musculus
aacgtcatctagtggaatttgcccc

SEQ ID NO: 503030 - DNA, 25 bp, Mus musculus
aacgtcattgctagttcacaggatg

SEQ ID NO: 503031 - DNA, 25 bp, Mus musculus
aacgtcattgcttgttcacaggatg

SEQ ID NO: 503032 - DNA, 25 bp, Mus musculus
aacgtccaggtgcaagtcatccaca

SEQ ID NO: 503033 - DNA, 25 bp, Mus musculus
aacgtccaggtggaagtcatccaca

SEQ ID NO: 503034 - DNA, 25 bp, Mus musculus
aacgtcctctgacgtgaacctggca

SEQ ID NO: 503035 - DNA, 25 bp, Mus musculus
aacgtcctctgaggtgaacctggca

SEQ ID NO: 503036 - DNA, 25 bp, Mus musculus
aacgtcggcgacagaagcagatgaa

SEQ ID NO: 503037 - DNA, 25 bp, Mus musculus
aacgtcggcgactgaagcagatgaa

SEQ ID NO: 503038 - DNA, 25 bp, Mus musculus
aacgtcgtgcacatgacagagaaaa

SEQ ID NO: 503039 - DNA, 25 bp, Mus musculus
aacgtcgtgcacttgacagagaaaa

SEQ ID NO: 503040 - DNA, 25 bp, Mus musculus
aacgtctagattccgactggtaccg

SEQ ID NO: 503041 - DNA, 25 bp, Mus musculus
aacgtctagattgcgactggtaccg

SEQ ID NO: 503042 - DNA, 25 bp, Mus musculus
aacgtctctcctatcagccttctgg

SEQ ID NO: 503043 - DNA, 25 bp, Mus musculus
aacgtctctcctttcagccttctgg

SEQ ID NO: 503044 - DNA, 25 bp, Mus musculus
aacgtctgcagaatgatgagcagct

SEQ ID NO: 503045 - DNA, 25 bp, Mus musculus
aacgtctgcagattgatgagcagct

SEQ ID NO: 503046 - DNA, 25 bp, Mus musculus
aacgtctgcggtcattggtgagcca

SEQ ID NO: 503047 - DNA, 25 bp, Mus musculus
aacgtctgcggtgattggtgagcca

SEQ ID NO: 503048 - DNA, 25 bp, Mus musculus
aacgtcttagccaaaggttacagtg

SEQ ID NO: 503049 - DNA, 25 bp, Mus musculus
aacgtcttagcctaaggttacagtg

SEQ ID NO: 503050 - DNA, 25 bp, Mus musculus
aacgtctttacgactcatggacctg

SEQ ID NO: 503051 - DNA, 25 bp, Mus musculus
aacgtctttacgtctcatggacctg

SEQ ID NO: 503052 - DNA, 25 bp, Mus musculus
aacgtgaaaacgctgccagaggagc

SEQ ID NO: 503053 - DNA, 25 bp, Mus musculus
aacgtgaaaacggtgccagaggagc

SEQ ID NO: 503054 - DNA, 25 bp, Mus musculus
aacgtgaaagggagaaattgagaga

SEQ ID NO: 503055 - DNA, 25 bp, Mus musculus
aacgtgaaagggtgaaattgagaga

SEQ ID NO: 503056 - DNA, 25 bp, Mus musculus
aacgtgaagacacgcatcgccaaca

SEQ ID NO: 503057 - DNA, 25 bp, Mus musculus
aacgtgaagacaggcatcgccaaca

SEQ ID NO: 503058 - DNA, 25 bp, Mus musculus
aacgtgaagccccaatgtctggatg

SEQ ID NO: 503059 - DNA, 25 bp, Mus musculus
aacgtgaagcccgaatgtctggatg

SEQ ID NO: 503060 - DNA, 25 bp, Mus musculus
aacgtgaccatccacaaccgctgta

SEQ ID NO: 503061 - DNA, 25 bp, Mus musculus
aacgtgaccatcgacaaccgctgta

SEQ ID NO: 503062 - DNA, 25 bp, Mus musculus
aacgtgaccccacctcctatagagg

SEQ ID NO: 503063 - DNA, 25 bp, Mus musculus
aacgtgaccccagctcctatagagg

SEQ ID NO: 503064 - DNA, 25 bp, Mus musculus
aacgtgaccctccaagtggccaatg

SEQ ID NO: 503065 - DNA, 25 bp, Mus musculus
aacgtgaccctcgaagtggccaatg

SEQ ID NO: 503066 - DNA, 25 bp, Mus musculus
aacgtgagctggaaccacaatggca

SEQ ID NO: 503067 - DNA, 25 bp, Mus musculus
aacgtgagctggtaccacaatggca

SEQ ID NO: 503068 - DNA, 25 bp, Mus musculus
aacgtgagtgcacccctgcggagca

SEQ ID NO: 503069 - DNA, 25 bp, Mus musculus
aacgtgagtgcagccctgcggagca

SEQ ID NO: 503070 - DNA, 25 bp, Mus musculus
aacgtgatcgccaccctcatttatg

SEQ ID NO: 503071 - DNA, 25 bp, Mus musculus
aacgtgatcgcctccctcatttatg

SEQ ID NO: 503072 - DNA, 25 bp, Mus musculus
aacgtgcagtgtagccgaattcaca

SEQ ID NO: 503073 - DNA, 25 bp, Mus musculus
aacgtgcagtgttgccgaattcaca

SEQ ID NO: 503074 - DNA, 25 bp, Mus musculus
aacgtgccagtgagtaagatggcga

SEQ ID NO: 503075 - DNA, 25 bp, Mus musculus
aacgtgccagtgtgtaagatggcga

SEQ ID NO: 503076 - DNA, 25 bp, Mus musculus
aacgtgcctgtcattggcggccacg

SEQ ID NO: 503077 - DNA, 25 bp, Mus musculus
aacgtgcctgtctttggcggccacg

SEQ ID NO: 503078 - DNA, 25 bp, Mus musculus
aacgtgctccgtaatcctgctagat

SEQ ID NO: 503079 - DNA, 25 bp, Mus musculus
aacgtgctccgttatcctgctagat

SEQ ID NO: 503080 - DNA, 25 bp, Mus musculus
aacgtgctgaagatccgaaggcgaa

SEQ ID NO: 503081 - DNA, 25 bp, Mus musculus
aacgtgctgaagttccgaaggcgaa

SEQ ID NO: 503082 - DNA, 25 bp, Mus musculus
aacgtgctgcccagctaccacgaaa

SEQ ID NO: 503083 - DNA, 25 bp, Mus musculus
aacgtgctgccctgctaccacgaaa

SEQ ID NO: 503084 - DNA, 25 bp, Mus musculus
aacgtgctgcggcacgacattgata

SEQ ID NO: 503085 - DNA, 25 bp, Mus musculus
aacgtgctgcgggacgacattgata

SEQ ID NO: 503086 - DNA, 25 bp, Mus musculus
aacgtgctggccagggatcaggaaa

SEQ ID NO: 503087 - DNA, 25 bp, Mus musculus
aacgtgctggcctgggatcaggaaa

SEQ ID NO: 503088 - DNA, 25 bp, Mus musculus
aacgtggaccagagggacacggaca

SEQ ID NO: 503089 - DNA, 25 bp, Mus musculus
aacgtggaccagtgggacacggaca

SEQ ID NO: 503090 - DNA, 25 bp, Mus musculus
aacgtggagccacatggcacaggcc

SEQ ID NO: 503091 - DNA, 25 bp, Mus musculus
aacgtggagccagatggcacaggcc

SEQ ID NO: 503092 - DNA, 25 bp, Mus musculus
aacgtggaggatctcctgtatttct

SEQ ID NO: 503093 - DNA, 25 bp, Mus musculus
aacgtggaggatgtcctgtatttct

SEQ ID NO: 503094 - DNA, 25 bp, Mus musculus
aacgtggccaccattccatagttgg

SEQ ID NO: 503095 - DNA, 25 bp, Mus musculus
aacgtggccacctttccatagttgg

SEQ ID NO: 503096 - DNA, 25 bp, Mus musculus
aacgtggctgggaaggcaaggtcct

SEQ ID NO: 503097 - DNA, 25 bp, Mus musculus
aacgtggctgggtaggcaaggtcct

SEQ ID NO: 503098 - DNA, 25 bp, Mus musculus
aacgtgggaatgaggtctcagctct

SEQ ID NO: 503099 - DNA, 25 bp, Mus musculus
aacgtgggaatgtggtctcagctct

SEQ ID NO: 503100 - DNA, 25 bp, Mus musculus
aacgtgggtctcagcatcgcagtgg

SEQ ID NO: 503101 - DNA, 25 bp, Mus musculus
aacgtgggtctctgcatcgcagtgg

SEQ ID NO: 503102 - DNA, 25 bp, Mus musculus
aacgtggtagaacgcattgagctga

SEQ ID NO: 503103 - DNA, 25 bp, Mus musculus
aacgtggtagaaggcattgagctga

SEQ ID NO: 503104 - DNA, 25 bp, Mus musculus
aacgtggtatctcatctgaagaaga

SEQ ID NO: 503105 - DNA, 25 bp, Mus musculus
aacgtggtatctgatctgaagaaga

SEQ ID NO: 503106 - DNA, 25 bp, Mus musculus
aacgtggtccacaccgtcaacactg

SEQ ID NO: 503107 - DNA, 25 bp, Mus musculus
aacgtggtccactccgtcaacactg

SEQ ID NO: 503108 - DNA, 25 bp, Mus musculus
aacgtggtggcgctgatcgtggcct

SEQ ID NO: 503109 - DNA, 25 bp, Mus musculus
aacgtggtggcggtgatcgtggcct

SEQ ID NO: 503110 - DNA, 25 bp, Mus musculus
aacgtggtttggatgaatgggtctc

SEQ ID NO: 503111 - DNA, 25 bp, Mus musculus
aacgtggtttggttgaatgggtctc

SEQ ID NO: 503112 - DNA, 25 bp, Mus musculus
aacgtgtaggtgatccgtctacaat

SEQ ID NO: 503113 - DNA, 25 bp, Mus musculus
aacgtgtaggtgttccgtctacaat

SEQ ID NO: 503114 - DNA, 25 bp, Mus musculus
aacgtgtatggcatcctgcgggccc

SEQ ID NO: 503115 - DNA, 25 bp, Mus musculus
aacgtgtatggcttcctgcgggccc

SEQ ID NO: 503116 - DNA, 25 bp, Mus musculus
aacgtgtcagtgagtgtgaacgacc

SEQ ID NO: 503117 - DNA, 25 bp, Mus musculus
aacgtgtcagtgtgtgtgaacgacc

SEQ ID NO: 503118 - DNA, 25 bp, Mus musculus
aacgtgtccaccacggaggtggaag

SEQ ID NO: 503119 - DNA, 25 bp, Mus musculus
aacgtgtccacctcggaggtggaag

SEQ ID NO: 503120 - DNA, 25 bp, Mus musculus
aacgtgtgaaatagcttaaggaact

SEQ ID NO: 503121 - DNA, 25 bp, Mus musculus
aacgtgtgaaattgcttaaggaact

SEQ ID NO: 503122 - DNA, 25 bp, Mus musculus
aacgtgtgaagcatgaagggaaaga

SEQ ID NO: 503123 - DNA, 25 bp, Mus musculus
aacgtgtgaagcttgaagggaaaga

SEQ ID NO: 503124 - DNA, 25 bp, Mus musculus
aacgtgtgcgagaccattagtggca

SEQ ID NO: 503125 - DNA, 25 bp, Mus musculus
aacgtgtgcgagtccattagtggca

SEQ ID NO: 503126 - DNA, 25 bp, Mus musculus
aacgtgtgcgccagctagggcatgc

SEQ ID NO: 503127 - DNA, 25 bp, Mus musculus
aacgtgtgcgcctgctagggcatgc

SEQ ID NO: 503128 - DNA, 25 bp, Mus musculus
aacgtgtggctaccttcaacggcaa

SEQ ID NO: 503129 - DNA, 25 bp, Mus musculus
aacgtgtggctagcttcaacggcaa

SEQ ID NO: 503130 - DNA, 25 bp, Mus musculus
aacgtgttcatcacagctacgggca

SEQ ID NO: 503131 - DNA, 25 bp, Mus musculus
aacgtgttcatctcagctacgggca

SEQ ID NO: 503132 - DNA, 25 bp, Mus musculus
aacgtgttgacacaatgtgcccgca

SEQ ID NO: 503133 - DNA, 25 bp, Mus musculus
aacgtgttgacagaatgtgcccgca

SEQ ID NO: 503134 - DNA, 25 bp, Mus musculus
aacgtgttggtaacagaaaacaatg

SEQ ID NO: 503135 - DNA, 25 bp, Mus musculus
aacgtgttggtatcagaaaacaatg

SEQ ID NO: 503136 - DNA, 25 bp, Mus musculus
aacgtgtttactagtagcagctgca

SEQ ID NO: 503137 - DNA, 25 bp, Mus musculus
aacgtgtttacttgtagcagctgca

SEQ ID NO: 503138 - DNA, 25 bp, Mus musculus
aacgttacctacatctcgtcgtgtc

SEQ ID NO: 503139 - DNA, 25 bp, Mus musculus
aacgttacctacttctcgtcgtgtc

SEQ ID NO: 503140 - DNA, 25 bp, Mus musculus
aacgttcccttgatcgatgaagcca

SEQ ID NO: 503141 - DNA, 25 bp, Mus musculus
aacgttcccttgttcgatgaagcca

SEQ ID NO: 503142 - DNA, 25 bp, Mus musculus
aacgttcgtagcagtgtggtggaca

SEQ ID NO: 503143 - DNA, 25 bp, Mus musculus
aacgttcgtagctgtgtggtggaca

SEQ ID NO: 503144 - DNA, 25 bp, Mus musculus
aacgttgaaacgcaaattggaccag

SEQ ID NO: 503145 - DNA, 25 bp, Mus musculus
aacgttgaaacggaaattggaccag

SEQ ID NO: 503146 - DNA, 25 bp, Mus musculus
aacgttgagggtacccctgctgagg

SEQ ID NO: 503147 - DNA, 25 bp, Mus musculus
aacgttgagggttcccctgctgagg

SEQ ID NO: 503148 - DNA, 25 bp, Mus musculus
aacgttgtaggaccccgtaggtcat

SEQ ID NO: 503149 - DNA, 25 bp, Mus musculus
aacgttgtaggagcccgtaggtcat

SEQ ID NO: 503150 - DNA, 25 bp, Mus musculus
aacgttgtgtgcatcaccaggcatg

SEQ ID NO: 503151 - DNA, 25 bp, Mus musculus
aacgttgtgtgcttcaccaggcatg

SEQ ID NO: 503152 - DNA, 25 bp, Mus musculus
aacgtttcatacaccattcagccaa

SEQ ID NO: 503153 - DNA, 25 bp, Mus musculus
aacgtttcatactccattcagccaa

SEQ ID NO: 503154 - DNA, 25 bp, Mus musculus
aacgtttccgtgctgagcggcaaga

SEQ ID NO: 503155 - DNA, 25 bp, Mus musculus
aacgtttccgtggtgagcggcaaga

SEQ ID NO: 503156 - DNA, 25 bp, Mus musculus
aacgtttgcgcaagttcaaggtcag

SEQ ID NO: 503157 - DNA, 25 bp, Mus musculus
aacgtttgcgcatgttcaaggtcag

SEQ ID NO: 503158 - DNA, 25 bp, Mus musculus
aactaaacaatccaatgcatcgtct

SEQ ID NO: 503159 - DNA, 25 bp, Mus musculus
aactaaacaatcgaatgcatcgtct

SEQ ID NO: 503160 - DNA, 25 bp, Mus musculus
aactaaacagaacctcaacatcgag

SEQ ID NO: 503161 - DNA, 25 bp, Mus musculus
aactaaacagaagctcaacatcgag

SEQ ID NO: 503162 - DNA, 25 bp, Mus musculus
aactaaaccgtacattcaagttgat

SEQ ID NO: 503163 - DNA, 25 bp, Mus musculus
aactaaaccgtagattcaagttgat

SEQ ID NO: 503164 - DNA, 25 bp, Mus musculus
aactaaagaagacgctgaacttgag

SEQ ID NO: 503165 - DNA, 25 bp, Mus musculus
aactaaagaagaggctgaacttgag

SEQ ID NO: 503166 - DNA, 25 bp, Mus musculus
aactaaagcagcacgtggagccctt

SEQ ID NO: 503167 - DNA, 25 bp, Mus musculus
aactaaagcagctcgtggagccctt

SEQ ID NO: 503168 - DNA, 25 bp, Mus musculus
aactaaatggacatgctgtcaaact

SEQ ID NO: 503169 - DNA, 25 bp, Mus musculus
aactaaatggacttgctgtcaaact

SEQ ID NO: 503170 - DNA, 25 bp, Mus musculus
aactaacaggcccaatggaggaagc

SEQ ID NO: 503171 - DNA, 25 bp, Mus musculus
aactaacaggccgaatggaggaagc

SEQ ID NO: 503172 - DNA, 25 bp, Mus musculus
aactaacagtgtatccccgaggagg

SEQ ID NO: 503173 - DNA, 25 bp, Mus musculus
aactaacagtgtttccccgaggagg

SEQ ID NO: 503174 - DNA, 25 bp, Mus musculus
aactaactggctaatgaactggtcg

SEQ ID NO: 503175 - DNA, 25 bp, Mus musculus
aactaactggcttatgaactggtcg

SEQ ID NO: 503176 - DNA, 25 bp, Mus musculus
aactaacttattatgcccagctggg

SEQ ID NO: 503177 - DNA, 25 bp, Mus musculus
aactaacttattttgcccagctggg

SEQ ID NO: 503178 - DNA, 25 bp, Mus musculus
aactaagaatgaaacaaccgtgtct

SEQ ID NO: 503179 - DNA, 25 bp, Mus musculus
aactaagaatgatacaaccgtgtct

SEQ ID NO: 503180 - DNA, 25 bp, Mus musculus
aactaagacctgacagagcagaagc

SEQ ID NO: 503181 - DNA, 25 bp, Mus musculus
aactaagacctgtcagagcagaagc

SEQ ID NO: 503182 - DNA, 25 bp, Mus musculus
aactaaggcacactctggacgcatg

SEQ ID NO: 503183 - DNA, 25 bp, Mus musculus
aactaaggcacagtctggacgcatg

SEQ ID NO: 503184 - DNA, 25 bp, Mus musculus
aactaagtatatcctccgtatgtag

SEQ ID NO: 503185 - DNA, 25 bp, Mus musculus
aactaagtatatgctccgtatgtag

SEQ ID NO: 503186 - DNA, 25 bp, Mus musculus
aactaagtggaaaagagtgactatg

SEQ ID NO: 503187 - DNA, 25 bp, Mus musculus
aactaagtggaatagagtgactatg

SEQ ID NO: 503188 - DNA, 25 bp, Mus musculus
aactacaacaagatttattgcacat

SEQ ID NO: 503189 - DNA, 25 bp, Mus musculus
aactacaacaagttttattgcacat

SEQ ID NO: 503190 - DNA, 25 bp, Mus musculus
aactacaacagcacccgatctcgat

SEQ ID NO: 503191 - DNA, 25 bp, Mus musculus
aactacaacagctcccgatctcgat

SEQ ID NO: 503192 - DNA, 25 bp, Mus musculus
aactacaagctacggttcacagtgg

SEQ ID NO: 503193 - DNA, 25 bp, Mus musculus
aactacaagctagggttcacagtgg

SEQ ID NO: 503194 - DNA, 25 bp, Mus musculus
aactacaaggccatcgaaatgccct

SEQ ID NO: 503195 - DNA, 25 bp, Mus musculus
aactacaaggccttcgaaatgccct

SEQ ID NO: 503196 - DNA, 25 bp, Mus musculus
aactacaagtccattggtgacacca

SEQ ID NO: 503197 - DNA, 25 bp, Mus musculus
aactacaagtcctttggtgacacca

SEQ ID NO: 503198 - DNA, 25 bp, Mus musculus
aactacacatctaagtttggtcctg

SEQ ID NO: 503199 - DNA, 25 bp, Mus musculus
aactacacatcttagtttggtcctg

SEQ ID NO: 503200 - DNA, 25 bp, Mus musculus
aactacacattccagggaggttctg

SEQ ID NO: 503201 - DNA, 25 bp, Mus musculus
aactacacattcgagggaggttctg

SEQ ID NO: 503202 - DNA, 25 bp, Mus musculus
aactacacccggcaggagctgaagg

SEQ ID NO: 503203 - DNA, 25 bp, Mus musculus
aactacacccgggaggagctgaagg

SEQ ID NO: 503204 - DNA, 25 bp, Mus musculus
aactacaccgttcaggcgacagaca

SEQ ID NO: 503205 - DNA, 25 bp, Mus musculus
aactacaccgttgaggcgacagaca

SEQ ID NO: 503206 - DNA, 25 bp, Mus musculus
aactacactttgcaagagcggttag

SEQ ID NO: 503207 - DNA, 25 bp, Mus musculus
aactacactttggaagagcggttag

SEQ ID NO: 503208 - DNA, 25 bp, Mus musculus
aactacagcccgaatccgggatact

SEQ ID NO: 503209 - DNA, 25 bp, Mus musculus
aactacagcccgtatccgggatact

SEQ ID NO: 503210 - DNA, 25 bp, Mus musculus
aactacagcgacactcagccagaaa

SEQ ID NO: 503211 - DNA, 25 bp, Mus musculus
aactacagcgactctcagccagaaa

SEQ ID NO: 503212 - DNA, 25 bp, Mus musculus
aactacaggtgcacctgctttgatg

SEQ ID NO: 503213 - DNA, 25 bp, Mus musculus
aactacaggtgctcctgctttgatg

SEQ ID NO: 503214 - DNA, 25 bp, Mus musculus
aactacagtatgcttaagggtcacc

SEQ ID NO: 503215 - DNA, 25 bp, Mus musculus
aactacagtatggttaagggtcacc

SEQ ID NO: 503216 - DNA, 25 bp, Mus musculus
aactacatgggtcgccgtggtctcg

SEQ ID NO: 503217 - DNA, 25 bp, Mus musculus
aactacatgggtggccgtggtctcg

SEQ ID NO: 503218 - DNA, 25 bp, Mus musculus
aactaccacccaaagatcaggatca

SEQ ID NO: 503219 - DNA, 25 bp, Mus musculus
aactaccacccatagatcaggatca

SEQ ID NO: 503220 - DNA, 25 bp, Mus musculus
aactaccagaacacctcaactgatg

SEQ ID NO: 503221 - DNA, 25 bp, Mus musculus
aactaccagaactcctcaactgatg

SEQ ID NO: 503222 - DNA, 25 bp, Mus musculus
aactaccagggccagaatgcgtggt

SEQ ID NO: 503223 - DNA, 25 bp, Mus musculus
aactaccagggcgagaatgcgtggt

SEQ ID NO: 503224 - DNA, 25 bp, Mus musculus
aactacccatgtctccctaggtctt

SEQ ID NO: 503225 - DNA, 25 bp, Mus musculus
aactacccatgtgtccctaggtctt

SEQ ID NO: 503226 - DNA, 25 bp, Mus musculus
aactacccctgccacagtgatggat

SEQ ID NO: 503227 - DNA, 25 bp, Mus musculus
aactacccctgcgacagtgatggat

SEQ ID NO: 503228 - DNA, 25 bp, Mus musculus
aactaccgcacacattgttgtcaag

SEQ ID NO: 503229 - DNA, 25 bp, Mus musculus
aactaccgcacagattgttgtcaag

SEQ ID NO: 503230 - DNA, 25 bp, Mus musculus
aactacctgaagacgcaagcctaca

SEQ ID NO: 503231 - DNA, 25 bp, Mus musculus
aactacctgaagtcgcaagcctaca

SEQ ID NO: 503232 - DNA, 25 bp, Mus musculus
aactacgtcaatcggaatatggaga

SEQ ID NO: 503233 - DNA, 25 bp, Mus musculus
aactacgtcaatgggaatatggaga

SEQ ID NO: 503234 - DNA, 25 bp, Mus musculus
aactacgtggcaagcttacgcagcc

SEQ ID NO: 503235 - DNA, 25 bp, Mus musculus
aactacgtggcatgcttacgcagcc

SEQ ID NO: 503236 - DNA, 25 bp, Mus musculus
aactacgttgccatacacacccttg

SEQ ID NO: 503237 - DNA, 25 bp, Mus musculus
aactacgttgccttacacacccttg

SEQ ID NO: 503238 - DNA, 25 bp, Mus musculus
aactactatgtccacacagctgtgc

SEQ ID NO: 503239 - DNA, 25 bp, Mus musculus
aactactatgtcgacacagctgtgc

SEQ ID NO: 503240 - DNA, 25 bp, Mus musculus
aactactgggttcagatattttcta

SEQ ID NO: 503241 - DNA, 25 bp, Mus musculus
aactactgggttgagatattttcta

SEQ ID NO: 503242 - DNA, 25 bp, Mus musculus
aactactttgagagctacctggcag

SEQ ID NO: 503243 - DNA, 25 bp, Mus musculus
aactactttgagtgctacctggcag

SEQ ID NO: 503244 - DNA, 25 bp, Mus musculus
aactactttgcacaagtcgactgca

SEQ ID NO: 503245 - DNA, 25 bp, Mus musculus
aactactttgcagaagtcgactgca

SEQ ID NO: 503246 - DNA, 25 bp, Mus musculus
aactagaacgatccctggttgaagg

SEQ ID NO: 503247 - DNA, 25 bp, Mus musculus
aactagaacgatgcctggttgaagg

SEQ ID NO: 503248 - DNA, 25 bp, Mus musculus
aactagaagtacagtaccagggcaa

SEQ ID NO: 503249 - DNA, 25 bp, Mus musculus
aactagaagtactgtaccagggcaa

SEQ ID NO: 503250 - DNA, 25 bp, Mus musculus
aactagacacccagagtggcaggaa

SEQ ID NO: 503251 - DNA, 25 bp, Mus musculus
aactagacaccctgagtggcaggaa

SEQ ID NO: 503252 - DNA, 25 bp, Mus musculus
aactagagcgagaaacagagcttcg

SEQ ID NO: 503253 - DNA, 25 bp, Mus musculus
aactagagcgagtaacagagcttcg

SEQ ID NO: 503254 - DNA, 25 bp, Mus musculus
aactagagctaactttggccctggg

SEQ ID NO: 503255 - DNA, 25 bp, Mus musculus
aactagagctaagtttggccctggg

SEQ ID NO: 503256 - DNA, 25 bp, Mus musculus
aactagataatgaccactgggcacc

SEQ ID NO: 503257 - DNA, 25 bp, Mus musculus
aactagataatgtccactgggcacc

SEQ ID NO: 503258 - DNA, 25 bp, Mus musculus
aactagatggtcacagcccctcctt

SEQ ID NO: 503259 - DNA, 25 bp, Mus musculus
aactagatggtctcagcccctcctt

SEQ ID NO: 503260 - DNA, 25 bp, Mus musculus
aactagggtagtactggaagcgaag

SEQ ID NO: 503261 - DNA, 25 bp, Mus musculus
aactagggtagttctggaagcgaag

SEQ ID NO: 503262 - DNA, 25 bp, Mus musculus
aactagtaaagacagctctggcacc

SEQ ID NO: 503263 - DNA, 25 bp, Mus musculus
aactagtaaagagagctctggcacc

SEQ ID NO: 503264 - DNA, 25 bp, Mus musculus
aactagtagcggaatggaggctgct

SEQ ID NO: 503265 - DNA, 25 bp, Mus musculus
aactagtagcggtatggaggctgct

SEQ ID NO: 503266 - DNA, 25 bp, Mus musculus
aactagttacggaggcttcagagca

SEQ ID NO: 503267 - DNA, 25 bp, Mus musculus
aactagttacggtggcttcagagca

SEQ ID NO: 503268 - DNA, 25 bp, Mus musculus
aactagttgcccctgcttgtaggcc

SEQ ID NO: 503269 - DNA, 25 bp, Mus musculus
aactagttgcccgtgcttgtaggcc

SEQ ID NO: 503270 - DNA, 25 bp, Mus musculus
aactatagagttagatgggaaaaca

SEQ ID NO: 503271 - DNA, 25 bp, Mus musculus
aactatagagtttgatgggaaaaca

SEQ ID NO: 503272 - DNA, 25 bp, Mus musculus
aactatatccagaccttgggccgtg

SEQ ID NO: 503273 - DNA, 25 bp, Mus musculus
aactatatccagtccttgggccgtg

SEQ ID NO: 503274 - DNA, 25 bp, Mus musculus
aactatatggaaaaacagatgaacc

SEQ ID NO: 503275 - DNA, 25 bp, Mus musculus
aactatatggaataacagatgaacc

SEQ ID NO: 503276 - DNA, 25 bp, Mus musculus
aactatcacaatcagaccagcacgg

SEQ ID NO: 503277 - DNA, 25 bp, Mus musculus
aactatcacaatgagaccagcacgg

SEQ ID NO: 503278 - DNA, 25 bp, Mus musculus
aactatccattgaaaaataggcttg

SEQ ID NO: 503279 - DNA, 25 bp, Mus musculus
aactatccattgtaaaataggcttg

SEQ ID NO: 503280 - DNA, 25 bp, Mus musculus
aactatctgagtctggactctgcta

SEQ ID NO: 503281 - DNA, 25 bp, Mus musculus
aactatctgagtgtggactctgcta

SEQ ID NO: 503282 - DNA, 25 bp, Mus musculus
aactatcttcttccatttggaagac

SEQ ID NO: 503283 - DNA, 25 bp, Mus musculus
aactatcttcttgcatttggaagac

SEQ ID NO: 503284 - DNA, 25 bp, Mus musculus
aactatgaacggctcttgtaccttt

SEQ ID NO: 503285 - DNA, 25 bp, Mus musculus
aactatgaacgggtcttgtaccttt

SEQ ID NO: 503286 - DNA, 25 bp, Mus musculus
aactatgaagaacctgcaatggcca

SEQ ID NO: 503287 - DNA, 25 bp, Mus musculus
aactatgaagaagctgcaatggcca

SEQ ID NO: 503288 - DNA, 25 bp, Mus musculus
aactatgaccgacaccgggcctggg

SEQ ID NO: 503289 - DNA, 25 bp, Mus musculus
aactatgaccgagaccgggcctggg

SEQ ID NO: 503290 - DNA, 25 bp, Mus musculus
aactatgagccacttggcttggagg

SEQ ID NO: 503291 - DNA, 25 bp, Mus musculus
aactatgagccagttggcttggagg

SEQ ID NO: 503292 - DNA, 25 bp, Mus musculus
aactatgagtctcggggttgtccgc

SEQ ID NO: 503293 - DNA, 25 bp, Mus musculus
aactatgagtctgggggttgtccgc

SEQ ID NO: 503294 - DNA, 25 bp, Mus musculus
aactatgatagcacggtgaggccgg

SEQ ID NO: 503295 - DNA, 25 bp, Mus musculus
aactatgatagctcggtgaggccgg

SEQ ID NO: 503296 - DNA, 25 bp, Mus musculus
aactatgccgagaggctacaggaat

SEQ ID NO: 503297 - DNA, 25 bp, Mus musculus
aactatgccgagtggctacaggaat

SEQ ID NO: 503298 - DNA, 25 bp, Mus musculus
aactatggcattcctgcccaccgtg

SEQ ID NO: 503299 - DNA, 25 bp, Mus musculus
aactatggcattgctgcccaccgtg

SEQ ID NO: 503300 - DNA, 25 bp, Mus musculus
aactatgggagcatctgggcagaca

SEQ ID NO: 503301 - DNA, 25 bp, Mus musculus
aactatgggagcttctgggcagaca

SEQ ID NO: 503302 - DNA, 25 bp, Mus musculus
aactatgtgtttctctatcacctgc

SEQ ID NO: 503303 - DNA, 25 bp, Mus musculus
aactatgtgtttgtctatcacctgc

SEQ ID NO: 503304 - DNA, 25 bp, Mus musculus
aactattaccccaacagcttcagcg

SEQ ID NO: 503305 - DNA, 25 bp, Mus musculus
aactattacccctacagcttcagcg

SEQ ID NO: 503306 - DNA, 25 bp, Mus musculus
aactattccacactgaatgagagag

SEQ ID NO: 503307 - DNA, 25 bp, Mus musculus
aactattccacagtgaatgagagag

SEQ ID NO: 503308 - DNA, 25 bp, Mus musculus
aactattggttaacccagagggata

SEQ ID NO: 503309 - DNA, 25 bp, Mus musculus
aactattggttatcccagagggata

SEQ ID NO: 503310 - DNA, 25 bp, Mus musculus
aactattttggtatgctttagacca

SEQ ID NO: 503311 - DNA, 25 bp, Mus musculus
aactattttggtttgctttagacca

SEQ ID NO: 503312 - DNA, 25 bp, Mus musculus
aactcaaaagttcaaagctgtcagc

SEQ ID NO: 503313 - DNA, 25 bp, Mus musculus
aactcaaaagttgaaagctgtcagc

SEQ ID NO: 503314 - DNA, 25 bp, Mus musculus
aactcaaagcagatgtacagtggca

SEQ ID NO: 503315 - DNA, 25 bp, Mus musculus
aactcaaagcagttgtacagtggca

SEQ ID NO: 503316 - DNA, 25 bp, Mus musculus
aactcaaagccaaagttggcaagcc

SEQ ID NO: 503317 - DNA, 25 bp, Mus musculus
aactcaaagccatagttggcaagcc

SEQ ID NO: 503318 - DNA, 25 bp, Mus musculus
aactcaaaggccctgagcacttagg

SEQ ID NO: 503319 - DNA, 25 bp, Mus musculus
aactcaaaggccgtgagcacttagg

SEQ ID NO: 503320 - DNA, 25 bp, Mus musculus
aactcaaagtggcatctcagacgac

SEQ ID NO: 503321 - DNA, 25 bp, Mus musculus
aactcaaagtgggatctcagacgac

SEQ ID NO: 503322 - DNA, 25 bp, Mus musculus
aactcaaggcttatggatgaaggcc

SEQ ID NO: 503323 - DNA, 25 bp, Mus musculus
aactcaaggcttttggatgaaggcc

SEQ ID NO: 503324 - DNA, 25 bp, Mus musculus
aactcaaggtgtcgatgtggacctg

SEQ ID NO: 503325 - DNA, 25 bp, Mus musculus
aactcaaggtgtggatgtggacctg

SEQ ID NO: 503326 - DNA, 25 bp, Mus musculus
aactcaatcagtagatgcccagaga

SEQ ID NO: 503327 - DNA, 25 bp, Mus musculus
aactcaatcagttgatgcccagaga

SEQ ID NO: 503328 - DNA, 25 bp, Mus musculus
aactcaatgagacctgggaggagaa

SEQ ID NO: 503329 - DNA, 25 bp, Mus musculus
aactcaatgagagctgggaggagaa

SEQ ID NO: 503330 - DNA, 25 bp, Mus musculus
aactcacagctgacagcagtcccgt

SEQ ID NO: 503331 - DNA, 25 bp, Mus musculus
aactcacagctgtcagcagtcccgt

SEQ ID NO: 503332 - DNA, 25 bp, Mus musculus
aactcacatgctcacgtcaatgccg

SEQ ID NO: 503333 - DNA, 25 bp, Mus musculus
aactcacatgctgacgtcaatgccg

SEQ ID NO: 503334 - DNA, 25 bp, Mus musculus
aactcaccaaagagccccgagtgtg

SEQ ID NO: 503335 - DNA, 25 bp, Mus musculus
aactcaccaaagtgccccgagtgtg

SEQ ID NO: 503336 - DNA, 25 bp, Mus musculus
aactcaccacctagcagcagtctga

SEQ ID NO: 503337 - DNA, 25 bp, Mus musculus
aactcaccaccttgcagcagtctga

SEQ ID NO: 503338 - DNA, 25 bp, Mus musculus
aactcacctcagacctatgtcacag

SEQ ID NO: 503339 - DNA, 25 bp, Mus musculus
aactcacctcagtcctatgtcacag

SEQ ID NO: 503340 - DNA, 25 bp, Mus musculus
aactcacggatgagacctttgccct

SEQ ID NO: 503341 - DNA, 25 bp, Mus musculus
aactcacggatgtgacctttgccct

SEQ ID NO: 503342 - DNA, 25 bp, Mus musculus
aactcacggcctatagaatgggaca

SEQ ID NO: 503343 - DNA, 25 bp, Mus musculus
aactcacggcctttagaatgggaca

SEQ ID NO: 503344 - DNA, 25 bp, Mus musculus
aactcactataaagagacctggaag

SEQ ID NO: 503345 - DNA, 25 bp, Mus musculus
aactcactataatgagacctggaag

SEQ ID NO: 503346 - DNA, 25 bp, Mus musculus
aactcactcttgctttgatttggaa

SEQ ID NO: 503347 - DNA, 25 bp, Mus musculus
aactcactcttggtttgatttggaa

SEQ ID NO: 503348 - DNA, 25 bp, Mus musculus
aactcagaccttagtatctctggag

SEQ ID NO: 503349 - DNA, 25 bp, Mus musculus
aactcagacctttgtatctctggag

SEQ ID NO: 503350 - DNA, 25 bp, Mus musculus
aactcagactcgctcattgccaaga

SEQ ID NO: 503351 - DNA, 25 bp, Mus musculus
aactcagactcggtcattgccaaga

SEQ ID NO: 503352 - DNA, 25 bp, Mus musculus
aactcagactgtccctatgaccgga

SEQ ID NO: 503353 - DNA, 25 bp, Mus musculus
aactcagactgtgcctatgaccgga

SEQ ID NO: 503354 - DNA, 25 bp, Mus musculus
aactcagagacaccatccagacaga

SEQ ID NO: 503355 - DNA, 25 bp, Mus musculus
aactcagagacagcatccagacaga

SEQ ID NO: 503356 - DNA, 25 bp, Mus musculus
aactcagagtgcacctggaccatca

SEQ ID NO: 503357 - DNA, 25 bp, Mus musculus
aactcagagtgctcctggaccatca

SEQ ID NO: 503358 - DNA, 25 bp, Mus musculus
aactcagatcaaaacatactcttgg

SEQ ID NO: 503359 - DNA, 25 bp, Mus musculus
aactcagatcaatacatactcttgg

SEQ ID NO: 503360 - DNA, 25 bp, Mus musculus
aactcagccaatagacaagtctgct

SEQ ID NO: 503361 - DNA, 25 bp, Mus musculus
aactcagccaattgacaagtctgct

SEQ ID NO: 503362 - DNA, 25 bp, Mus musculus
aactcagccaccatcaagtcatttg

SEQ ID NO: 503363 - DNA, 25 bp, Mus musculus
aactcagccaccttcaagtcatttg

SEQ ID NO: 503364 - DNA, 25 bp, Mus musculus
aactcagctctcagaactccgaggg

SEQ ID NO: 503365 - DNA, 25 bp, Mus musculus
aactcagctctctgaactccgaggg

SEQ ID NO: 503366 - DNA, 25 bp, Mus musculus
aactcagggactacgctgcgaaagg

SEQ ID NO: 503367 - DNA, 25 bp, Mus musculus
aactcagggacttcgctgcgaaagg

SEQ ID NO: 503368 - DNA, 25 bp, Mus musculus
aactcaggtcatcaggcttgccgac

SEQ ID NO: 503369 - DNA, 25 bp, Mus musculus
aactcaggtcatgaggcttgccgac

SEQ ID NO: 503370 - DNA, 25 bp, Mus musculus
aactcagtaaaacaggttcttgtgc

SEQ ID NO: 503371 - DNA, 25 bp, Mus musculus
aactcagtaaaagaggttcttgtgc

SEQ ID NO: 503372 - DNA, 25 bp, Mus musculus
aactcagtaaccacacacggcctgt

SEQ ID NO: 503373 - DNA, 25 bp, Mus musculus
aactcagtaacctcacacggcctgt

SEQ ID NO: 503374 - DNA, 25 bp, Mus musculus
aactcagtactacgcatatgtaacg

SEQ ID NO: 503375 - DNA, 25 bp, Mus musculus
aactcagtactaggcatatgtaacg

SEQ ID NO: 503376 - DNA, 25 bp, Mus musculus
aactcagtcgctaccaaacaaaatt

SEQ ID NO: 503377 - DNA, 25 bp, Mus musculus
aactcagtcgcttccaaacaaaatt

SEQ ID NO: 503378 - DNA, 25 bp, Mus musculus
aactcagtgcccaacttgttgcgtg

SEQ ID NO: 503379 - DNA, 25 bp, Mus musculus
aactcagtgccctacttgttgcgtg

SEQ ID NO: 503380 - DNA, 25 bp, Mus musculus
aactcagtgctgaatagctgctgcc

SEQ ID NO: 503381 - DNA, 25 bp, Mus musculus
aactcagtgctgtatagctgctgcc

SEQ ID NO: 503382 - DNA, 25 bp, Mus musculus
aactcagtgtatcagatcgccatgg

SEQ ID NO: 503383 - DNA, 25 bp, Mus musculus
aactcagtgtatgagatcgccatgg

SEQ ID NO: 503384 - DNA, 25 bp, Mus musculus
aactcatagcctagctgctggaggc

SEQ ID NO: 503385 - DNA, 25 bp, Mus musculus
aactcatagccttgctgctggaggc

SEQ ID NO: 503386 - DNA, 25 bp, Mus musculus
aactcatcagatccaaagcgatccg

SEQ ID NO: 503387 - DNA, 25 bp, Mus musculus
aactcatcagatgcaaagcgatccg

SEQ ID NO: 503388 - DNA, 25 bp, Mus musculus
aactcatcagcacctctggctgagg

SEQ ID NO: 503389 - DNA, 25 bp, Mus musculus
aactcatcagcagctctggctgagg

SEQ ID NO: 503390 - DNA, 25 bp, Mus musculus
aactcatcctttaaccaaacacaga

SEQ ID NO: 503391 - DNA, 25 bp, Mus musculus
aactcatccttttaccaaacacaga

SEQ ID NO: 503392 - DNA, 25 bp, Mus musculus
aactcatcggtgaagctgcagggaa

SEQ ID NO: 503393 - DNA, 25 bp, Mus musculus
aactcatcggtgtagctgcagggaa

SEQ ID NO: 503394 - DNA, 25 bp, Mus musculus
aactcatctatcacctatgaccggc

SEQ ID NO: 503395 - DNA, 25 bp, Mus musculus
aactcatctatctcctatgaccggc

SEQ ID NO: 503396 - DNA, 25 bp, Mus musculus
aactcatgaagcatgagaccctgag

SEQ ID NO: 503397 - DNA, 25 bp, Mus musculus
aactcatgaagcttgagaccctgag

SEQ ID NO: 503398 - DNA, 25 bp, Mus musculus
aactcatgactgcacttcgggagct

SEQ ID NO: 503399 - DNA, 25 bp, Mus musculus
aactcatgactggacttcgggagct

SEQ ID NO: 503400 - DNA, 25 bp, Mus musculus
aactcattgtggctgatcagagcgg

SEQ ID NO: 503401 - DNA, 25 bp, Mus musculus
aactcattgtgggtgatcagagcgg

SEQ ID NO: 503402 - DNA, 25 bp, Mus musculus
aactccaagtgtccgctcctgaagg

SEQ ID NO: 503403 - DNA, 25 bp, Mus musculus
aactccaagtgtgcgctcctgaagg

SEQ ID NO: 503404 - DNA, 25 bp, Mus musculus
aactccacactcaaggtaccgagcg

SEQ ID NO: 503405 - DNA, 25 bp, Mus musculus
aactccacactctaggtaccgagcg

SEQ ID NO: 503406 - DNA, 25 bp, Mus musculus
aactccacagagagagtactacact

SEQ ID NO: 503407 - DNA, 25 bp, Mus musculus
aactccacagagtgagtactacact

SEQ ID NO: 503408 - DNA, 25 bp, Mus musculus
aactccacaggcagtaagcccaatg

SEQ ID NO: 503409 - DNA, 25 bp, Mus musculus
aactccacaggctgtaagcccaatg

SEQ ID NO: 503410 - DNA, 25 bp, Mus musculus
aactccacaggtcctgggcccatgg

SEQ ID NO: 503411 - DNA, 25 bp, Mus musculus
aactccacaggtgctgggcccatgg

SEQ ID NO: 503412 - DNA, 25 bp, Mus musculus
aactccacgactcggcaaacctaag

SEQ ID NO: 503413 - DNA, 25 bp, Mus musculus
aactccacgactgggcaaacctaag

SEQ ID NO: 503414 - DNA, 25 bp, Mus musculus
aactccactggaataaaaaagactg

SEQ ID NO: 503415 - DNA, 25 bp, Mus musculus
aactccactggattaaaaaagactg

SEQ ID NO: 503416 - DNA, 25 bp, Mus musculus
aactccacttctccgttgggattgg

SEQ ID NO: 503417 - DNA, 25 bp, Mus musculus
aactccacttctgcgttgggattgg

SEQ ID NO: 503418 - DNA, 25 bp, Mus musculus
aactccagattcaagaacttagaga

SEQ ID NO: 503419 - DNA, 25 bp, Mus musculus
aactccagattctagaacttagaga

SEQ ID NO: 503420 - DNA, 25 bp, Mus musculus
aactccagcgagaatatgtacacca

SEQ ID NO: 503421 - DNA, 25 bp, Mus musculus
aactccagcgagtatatgtacacca

SEQ ID NO: 503422 - DNA, 25 bp, Mus musculus
aactccagctttaggtcatgatcca

SEQ ID NO: 503423 - DNA, 25 bp, Mus musculus
aactccagcttttggtcatgatcca

SEQ ID NO: 503424 - DNA, 25 bp, Mus musculus
aactccaggctgagcgcatgtttgc

SEQ ID NO: 503425 - DNA, 25 bp, Mus musculus
aactccaggctgtgcgcatgtttgc

SEQ ID NO: 503426 - DNA, 25 bp, Mus musculus
aactccatcatcctgaacatcatca

SEQ ID NO: 503427 - DNA, 25 bp, Mus musculus
aactccatcatcgtgaacatcatca

SEQ ID NO: 503428 - DNA, 25 bp, Mus musculus
aactccatcgtcaccgtcaagaagg

SEQ ID NO: 503429 - DNA, 25 bp, Mus musculus
aactccatcgtctccgtcaagaagg

SEQ ID NO: 503430 - DNA, 25 bp, Mus musculus
aactccattcagcaatacatacgac

SEQ ID NO: 503431 - DNA, 25 bp, Mus musculus
aactccattcaggaatacatacgac

SEQ ID NO: 503432 - DNA, 25 bp, Mus musculus
aactcccagtacctgaagctgctca

SEQ ID NO: 503433 - DNA, 25 bp, Mus musculus
aactcccagtacgtgaagctgctca

SEQ ID NO: 503434 - DNA, 25 bp, Mus musculus
aactcccatggtcgctgctagtccg

SEQ ID NO: 503435 - DNA, 25 bp, Mus musculus
aactcccatggtggctgctagtccg

SEQ ID NO: 503436 - DNA, 25 bp, Mus musculus
aactccccaaccctgattgtgatgg

SEQ ID NO: 503437 - DNA, 25 bp, Mus musculus
aactccccaaccgtgattgtgatgg

SEQ ID NO: 503438 - DNA, 25 bp, Mus musculus
aactcccggaagaaacaagctctga

SEQ ID NO: 503439 - DNA, 25 bp, Mus musculus
aactcccggaagtaacaagctctga

SEQ ID NO: 503440 - DNA, 25 bp, Mus musculus
aactcccgggagacataatgtgtac

SEQ ID NO: 503441 - DNA, 25 bp, Mus musculus
aactcccgggagtcataatgtgtac

SEQ ID NO: 503442 - DNA, 25 bp, Mus musculus
aactccctccaaaggatctaagaat

SEQ ID NO: 503443 - DNA, 25 bp, Mus musculus
aactccctccaatggatctaagaat

SEQ ID NO: 503444 - DNA, 25 bp, Mus musculus
aactccctgcccagttggccagtgg

SEQ ID NO: 503445 - DNA, 25 bp, Mus musculus
aactccctgccctgttggccagtgg

SEQ ID NO: 503446 - DNA, 25 bp, Mus musculus
aactccctggtcaactttgcctact

SEQ ID NO: 503447 - DNA, 25 bp, Mus musculus
aactccctggtctactttgcctact

SEQ ID NO: 503448 - DNA, 25 bp, Mus musculus
aactcccttaccagcgagatgctca

SEQ ID NO: 503449 - DNA, 25 bp, Mus musculus
aactcccttacctgcgagatgctca

SEQ ID NO: 503450 - DNA, 25 bp, Mus musculus
aactcccttgatcacgcagtgtgtg

SEQ ID NO: 503451 - DNA, 25 bp, Mus musculus
aactcccttgatgacgcagtgtgtg

SEQ ID NO: 503452 - DNA, 25 bp, Mus musculus
aactccgaagctcgatagagggact

SEQ ID NO: 503453 - DNA, 25 bp, Mus musculus
aactccgaagctggatagagggact

SEQ ID NO: 503454 - DNA, 25 bp, Mus musculus
aactccgagggcagtccacaggctc

SEQ ID NO: 503455 - DNA, 25 bp, Mus musculus
aactccgagggctgtccacaggctc

SEQ ID NO: 503456 - DNA, 25 bp, Mus musculus
aactccgccacaactggaacctgaa

SEQ ID NO: 503457 - DNA, 25 bp, Mus musculus
aactccgccacatctggaacctgaa

SEQ ID NO: 503458 - DNA, 25 bp, Mus musculus
aactccggctccactggaggaggcc

SEQ ID NO: 503459 - DNA, 25 bp, Mus musculus
aactccggctcctctggaggaggcc

SEQ ID NO: 503460 - DNA, 25 bp, Mus musculus
aactccggtccaaggcacgcagggc

SEQ ID NO: 503461 - DNA, 25 bp, Mus musculus
aactccggtccatggcacgcagggc

SEQ ID NO: 503462 - DNA, 25 bp, Mus musculus
aactccgtgcgcaagtccatgagca

SEQ ID NO: 503463 - DNA, 25 bp, Mus musculus
aactccgtgcgctagtccatgagca

SEQ ID NO: 503464 - DNA, 25 bp, Mus musculus
aactcctacaccaagcctgtctgga

SEQ ID NO: 503465 - DNA, 25 bp, Mus musculus
aactcctacacctagcctgtctgga

SEQ ID NO: 503466 - DNA, 25 bp, Mus musculus
aactcctcagggagcctgctgggct

SEQ ID NO: 503467 - DNA, 25 bp, Mus musculus
aactcctcagggtgcctgctgggct

SEQ ID NO: 503468 - DNA, 25 bp, Mus musculus
aactcctcagttatgtgatggatca

SEQ ID NO: 503469 - DNA, 25 bp, Mus musculus
aactcctcagttttgtgatggatca

SEQ ID NO: 503470 - DNA, 25 bp, Mus musculus
aactcctcccagagagtcgagctac

SEQ ID NO: 503471 - DNA, 25 bp, Mus musculus
aactcctcccagtgagtcgagctac

SEQ ID NO: 503472 - DNA, 25 bp, Mus musculus
aactcctctcagcatgtttccttgg

SEQ ID NO: 503473 - DNA, 25 bp, Mus musculus
aactcctctcaggatgtttccttgg

SEQ ID NO: 503474 - DNA, 25 bp, Mus musculus
aactcctgaggaacttgatgctgca

SEQ ID NO: 503475 - DNA, 25 bp, Mus musculus
aactcctgaggatcttgatgctgca

SEQ ID NO: 503476 - DNA, 25 bp, Mus musculus
aactcctggcctaacacgaagcgtg

SEQ ID NO: 503477 - DNA, 25 bp, Mus musculus
aactcctggccttacacgaagcgtg

SEQ ID NO: 503478 - DNA, 25 bp, Mus musculus
aactcctggctgacattgacattgt

SEQ ID NO: 503479 - DNA, 25 bp, Mus musculus
aactcctggctgtcattgacattgt

SEQ ID NO: 503480 - DNA, 25 bp, Mus musculus
aactccttccaactgggctcacaag

SEQ ID NO: 503481 - DNA, 25 bp, Mus musculus
aactccttccaagtgggctcacaag

SEQ ID NO: 503482 - DNA, 25 bp, Mus musculus
aactccttgcgaagaacttgtccca

SEQ ID NO: 503483 - DNA, 25 bp, Mus musculus
aactccttgcgatgaacttgtccca

SEQ ID NO: 503484 - DNA, 25 bp, Mus musculus
aactcctttgatctgatcagtgatg

SEQ ID NO: 503485 - DNA, 25 bp, Mus musculus
aactcctttgatgtgatcagtgatg

SEQ ID NO: 503486 - DNA, 25 bp, Mus musculus
aactcctttgtacgctagaacctgg

SEQ ID NO: 503487 - DNA, 25 bp, Mus musculus
aactcctttgtaggctagaacctgg

SEQ ID NO: 503488 - DNA, 25 bp, Mus musculus
aactcgaaatgaatggctttaagaa

SEQ ID NO: 503489 - DNA, 25 bp, Mus musculus
aactcgaaatgattggctttaagaa

SEQ ID NO: 503490 - DNA, 25 bp, Mus musculus
aactcgacagatactggagaaggca

SEQ ID NO: 503491 - DNA, 25 bp, Mus musculus
aactcgacagattctggagaaggca

SEQ ID NO: 503492 - DNA, 25 bp, Mus musculus
aactcgagaaataaaggccacagaa

SEQ ID NO: 503493 - DNA, 25 bp, Mus musculus
aactcgagaaattaaggccacagaa

SEQ ID NO: 503494 - DNA, 25 bp, Mus musculus
aactcgagaattagaggatagagac

SEQ ID NO: 503495 - DNA, 25 bp, Mus musculus
aactcgagaatttgaggatagagac

SEQ ID NO: 503496 - DNA, 25 bp, Mus musculus
aactcgcacaatagcagcagcctca

SEQ ID NO: 503497 - DNA, 25 bp, Mus musculus
aactcgcacaattgcagcagcctca

SEQ ID NO: 503498 - DNA, 25 bp, Mus musculus
aactcgcgcgttctcctggagattg

SEQ ID NO: 503499 - DNA, 25 bp, Mus musculus
aactcgcgcgttgtcctggagattg

SEQ ID NO: 503500 - DNA, 25 bp, Mus musculus
aactcgctgagtcgtaagaaataca

SEQ ID NO: 503501 - DNA, 25 bp, Mus musculus
aactcgctgagtggtaagaaataca

SEQ ID NO: 503502 - DNA, 25 bp, Mus musculus
aactcggaggcgagcctgattctag

SEQ ID NO: 503503 - DNA, 25 bp, Mus musculus
aactcggaggcgtgcctgattctag

SEQ ID NO: 503504 - DNA, 25 bp, Mus musculus
aactcggctgctccaggtcatgaag

SEQ ID NO: 503505 - DNA, 25 bp, Mus musculus
aactcggctgctgcaggtcatgaag

SEQ ID NO: 503506 - DNA, 25 bp, Mus musculus
aactcgggctgactttgcagagaga

SEQ ID NO: 503507 - DNA, 25 bp, Mus musculus
aactcgggctgagtttgcagagaga

SEQ ID NO: 503508 - DNA, 25 bp, Mus musculus
aactcgggctgccagaagcctgaga

SEQ ID NO: 503509 - DNA, 25 bp, Mus musculus
aactcgggctgcgagaagcctgaga

SEQ ID NO: 503510 - DNA, 25 bp, Mus musculus
aactcggtcagaactaacaagagcc

SEQ ID NO: 503511 - DNA, 25 bp, Mus musculus
aactcggtcagatctaacaagagcc

SEQ ID NO: 503512 - DNA, 25 bp, Mus musculus
aactcggtgctgatcatgtgttacg

SEQ ID NO: 503513 - DNA, 25 bp, Mus musculus
aactcggtgctgttcatgtgttacg

SEQ ID NO: 503514 - DNA, 25 bp, Mus musculus
aactcgtacgggactgcttggaaca

SEQ ID NO: 503515 - DNA, 25 bp, Mus musculus
aactcgtacgggtctgcttggaaca

SEQ ID NO: 503516 - DNA, 25 bp, Mus musculus
aactcgtagtgcagatgaaccaatg

SEQ ID NO: 503517 - DNA, 25 bp, Mus musculus
aactcgtagtgctgatgaaccaatg

SEQ ID NO: 503518 - DNA, 25 bp, Mus musculus
aactcgtccaggctaattccccagc

SEQ ID NO: 503519 - DNA, 25 bp, Mus musculus
aactcgtccagggtaattccccagc

SEQ ID NO: 503520 - DNA, 25 bp, Mus musculus
aactcgtggaccagtgattagggtg

SEQ ID NO: 503521 - DNA, 25 bp, Mus musculus
aactcgtggacctgtgattagggtg

SEQ ID NO: 503522 - DNA, 25 bp, Mus musculus
aactcgttcgagaggccctgaaggc

SEQ ID NO: 503523 - DNA, 25 bp, Mus musculus
aactcgttcgagtggccctgaaggc

SEQ ID NO: 503524 - DNA, 25 bp, Mus musculus
aactctaacgtgcacggagacgcca

SEQ ID NO: 503525 - DNA, 25 bp, Mus musculus
aactctaacgtggacggagacgcca

SEQ ID NO: 503526 - DNA, 25 bp, Mus musculus
aactctaagtgccatcccaaggaca

SEQ ID NO: 503527 - DNA, 25 bp, Mus musculus
aactctaagtgcgatcccaaggaca

SEQ ID NO: 503528 - DNA, 25 bp, Mus musculus
aactctacatagcatcgcgcagcgc

SEQ ID NO: 503529 - DNA, 25 bp, Mus musculus
aactctacataggatcgcgcagcgc

SEQ ID NO: 503530 - DNA, 25 bp, Mus musculus
aactctactggaatagctacaacaa

SEQ ID NO: 503531 - DNA, 25 bp, Mus musculus
aactctactggattagctacaacaa

SEQ ID NO: 503532 - DNA, 25 bp, Mus musculus
aactctagtggcaggaaggaagaag

SEQ ID NO: 503533 - DNA, 25 bp, Mus musculus
aactctagtggctggaaggaagaag

SEQ ID NO: 503534 - DNA, 25 bp, Mus musculus
aactctatggaactggaggccctcc

SEQ ID NO: 503535 - DNA, 25 bp, Mus musculus
aactctatggaagtggaggccctcc

SEQ ID NO: 503536 - DNA, 25 bp, Mus musculus
aactctattcgtcacaacctttctc

SEQ ID NO: 503537 - DNA, 25 bp, Mus musculus
aactctattcgtgacaacctttctc

SEQ ID NO: 503538 - DNA, 25 bp, Mus musculus
aactctcaagtacggaggtacctgg

SEQ ID NO: 503539 - DNA, 25 bp, Mus musculus
aactctcaagtagggaggtacctgg

SEQ ID NO: 503540 - DNA, 25 bp, Mus musculus
aactctccagaaagatgaggacatc

SEQ ID NO: 503541 - DNA, 25 bp, Mus musculus
aactctccagaatgatgaggacatc

SEQ ID NO: 503542 - DNA, 25 bp, Mus musculus
aactctccatagacgtttctctggg

SEQ ID NO: 503543 - DNA, 25 bp, Mus musculus
aactctccatagtcgtttctctggg

SEQ ID NO: 503544 - DNA, 25 bp, Mus musculus
aactctcgggatcgtgaagctggcc

SEQ ID NO: 503545 - DNA, 25 bp, Mus musculus
aactctcgggatggtgaagctggcc

SEQ ID NO: 503546 - DNA, 25 bp, Mus musculus
aactctcgtgtcagtttcagaatga

SEQ ID NO: 503547 - DNA, 25 bp, Mus musculus
aactctcgtgtctgtttcagaatga

SEQ ID NO: 503548 - DNA, 25 bp, Mus musculus
aactctctactgcaagcaatgggaa

SEQ ID NO: 503549 - DNA, 25 bp, Mus musculus
aactctctactggaagcaatgggaa

SEQ ID NO: 503550 - DNA, 25 bp, Mus musculus
aactctctcctgctgaatcgtgtca

SEQ ID NO: 503551 - DNA, 25 bp, Mus musculus
aactctctcctggtgaatcgtgtca

SEQ ID NO: 503552 - DNA, 25 bp, Mus musculus
aactctctgaaacataagccccaaa

SEQ ID NO: 503553 - DNA, 25 bp, Mus musculus
aactctctgaaagataagccccaaa

SEQ ID NO: 503554 - DNA, 25 bp, Mus musculus
aactctcttcacaattcctaggagg

SEQ ID NO: 503555 - DNA, 25 bp, Mus musculus
aactctcttcactattcctaggagg

SEQ ID NO: 503556 - DNA, 25 bp, Mus musculus
aactctgaaagacacgaccattagg

SEQ ID NO: 503557 - DNA, 25 bp, Mus musculus
aactctgaaagagacgaccattagg

SEQ ID NO: 503558 - DNA, 25 bp, Mus musculus
aactctgaacgtcagctacagcatg

SEQ ID NO: 503559 - DNA, 25 bp, Mus musculus
aactctgaacgtgagctacagcatg

SEQ ID NO: 503560 - DNA, 25 bp, Mus musculus
aactctgaaggcatgacggtttgag

SEQ ID NO: 503561 - DNA, 25 bp, Mus musculus
aactctgaaggcttgacggtttgag

SEQ ID NO: 503562 - DNA, 25 bp, Mus musculus
aactctgagttgacctaccgtgaga

SEQ ID NO: 503563 - DNA, 25 bp, Mus musculus
aactctgagttgtcctaccgtgaga

SEQ ID NO: 503564 - DNA, 25 bp, Mus musculus
aactctgcagcacgtgttgaagacc

SEQ ID NO: 503565 - DNA, 25 bp, Mus musculus
aactctgcagcaggtgttgaagacc

SEQ ID NO: 503566 - DNA, 25 bp, Mus musculus
aactctgcaggactattggcgctcc

SEQ ID NO: 503567 - DNA, 25 bp, Mus musculus
aactctgcaggagtattggcgctcc

SEQ ID NO: 503568 - DNA, 25 bp, Mus musculus
aactctgccaaaatccagactccaa

SEQ ID NO: 503569 - DNA, 25 bp, Mus musculus
aactctgccaaattccagactccaa

SEQ ID NO: 503570 - DNA, 25 bp, Mus musculus
aactctgccgagattgcagatgcct

SEQ ID NO: 503571 - DNA, 25 bp, Mus musculus
aactctgccgagtttgcagatgcct

SEQ ID NO: 503572 - DNA, 25 bp, Mus musculus
aactctgctcagatccatcaacaag

SEQ ID NO: 503573 - DNA, 25 bp, Mus musculus
aactctgctcagttccatcaacaag

SEQ ID NO: 503574 - DNA, 25 bp, Mus musculus
aactctgctgttagctgcatgctgc

SEQ ID NO: 503575 - DNA, 25 bp, Mus musculus
aactctgctgtttgctgcatgctgc

SEQ ID NO: 503576 - DNA, 25 bp, Mus musculus
aactctggatctcacggacggtacc

SEQ ID NO: 503577 - DNA, 25 bp, Mus musculus
aactctggatctgacggacggtacc

SEQ ID NO: 503578 - DNA, 25 bp, Mus musculus
aactctggcagcaatctcggtgtca

SEQ ID NO: 503579 - DNA, 25 bp, Mus musculus
aactctggcagctatctcggtgtca

SEQ ID NO: 503580 - DNA, 25 bp, Mus musculus
aactctggcctaattcgaggaagga

SEQ ID NO: 503581 - DNA, 25 bp, Mus musculus
aactctggcctatttcgaggaagga

SEQ ID NO: 503582 - DNA, 25 bp, Mus musculus
aactctggcctgcagtaatatcgcc

SEQ ID NO: 503583 - DNA, 25 bp, Mus musculus
aactctggcctggagtaatatcgcc

SEQ ID NO: 503584 - DNA, 25 bp, Mus musculus
aactctgggactcagggcgtatgcc

SEQ ID NO: 503585 - DNA, 25 bp, Mus musculus
aactctgggactgagggcgtatgcc

SEQ ID NO: 503586 - DNA, 25 bp, Mus musculus
aactctgggattcaaaacggagcct

SEQ ID NO: 503587 - DNA, 25 bp, Mus musculus
aactctgggattgaaaacggagcct

SEQ ID NO: 503588 - DNA, 25 bp, Mus musculus
aactctgtagacagaatcaggtgcc

SEQ ID NO: 503589 - DNA, 25 bp, Mus musculus
aactctgtagactgaatcaggtgcc

SEQ ID NO: 503590 - DNA, 25 bp, Mus musculus
aactcttcactcaatccgtccttgg

SEQ ID NO: 503591 - DNA, 25 bp, Mus musculus
aactcttcactctatccgtccttgg

SEQ ID NO: 503592 - DNA, 25 bp, Mus musculus
aactcttcaggcagttttcactttg

SEQ ID NO: 503593 - DNA, 25 bp, Mus musculus
aactcttcaggctgttttcactttg

SEQ ID NO: 503594 - DNA, 25 bp, Mus musculus
aactcttccacaacaggcactggca

SEQ ID NO: 503595 - DNA, 25 bp, Mus musculus
aactcttccacatcaggcactggca

SEQ ID NO: 503596 - DNA, 25 bp, Mus musculus
aactcttccaggaaatgaacataga

SEQ ID NO: 503597 - DNA, 25 bp, Mus musculus
aactcttccaggtaatgaacataga

SEQ ID NO: 503598 - DNA, 25 bp, Mus musculus
aactcttcctaaagatgtaccacca

SEQ ID NO: 503599 - DNA, 25 bp, Mus musculus
aactcttcctaatgatgtaccacca

SEQ ID NO: 503600 - DNA, 25 bp, Mus musculus
aactcttctataaaccctggcgcca

SEQ ID NO: 503601 - DNA, 25 bp, Mus musculus
aactcttctatataccctggcgcca

SEQ ID NO: 503602 - DNA, 25 bp, Mus musculus
aactcttgcagcagatccgacttgc

SEQ ID NO: 503603 - DNA, 25 bp, Mus musculus
aactcttgcagctgatccgacttgc

SEQ ID NO: 503604 - DNA, 25 bp, Mus musculus
aactctttcacacgctggacagaaa

SEQ ID NO: 503605 - DNA, 25 bp, Mus musculus
aactctttcacaggctggacagaaa

SEQ ID NO: 503606 - DNA, 25 bp, Mus musculus
aactgaaacattagatcttggaggc

SEQ ID NO: 503607 - DNA, 25 bp, Mus musculus
aactgaaacatttgatcttggaggc

SEQ ID NO: 503608 - DNA, 25 bp, Mus musculus
aactgaaaccctccgaggtggcctg

SEQ ID NO: 503609 - DNA, 25 bp, Mus musculus
aactgaaaccctgcgaggtggcctg

SEQ ID NO: 503610 - DNA, 25 bp, Mus musculus
aactgaaagaccagctacaaactga

SEQ ID NO: 503611 - DNA, 25 bp, Mus musculus
aactgaaagacctgctacaaactga

SEQ ID NO: 503612 - DNA, 25 bp, Mus musculus
aactgaaataccctgcagggaggca

SEQ ID NO: 503613 - DNA, 25 bp, Mus musculus
aactgaaataccgtgcagggaggca

SEQ ID NO: 503614 - DNA, 25 bp, Mus musculus
aactgaaatcaacagggactatgaa

SEQ ID NO: 503615 - DNA, 25 bp, Mus musculus
aactgaaatcaagagggactatgaa

SEQ ID NO: 503616 - DNA, 25 bp, Mus musculus
aactgaacatcgaggctggatatgg

SEQ ID NO: 503617 - DNA, 25 bp, Mus musculus
aactgaacatcgtggctggatatgg

SEQ ID NO: 503618 - DNA, 25 bp, Mus musculus
aactgaaccagtatccgagcagaag

SEQ ID NO: 503619 - DNA, 25 bp, Mus musculus
aactgaaccagtttccgagcagaag

SEQ ID NO: 503620 - DNA, 25 bp, Mus musculus
aactgaaccggtctcctttgtcaag

SEQ ID NO: 503621 - DNA, 25 bp, Mus musculus
aactgaaccggtgtcctttgtcaag

SEQ ID NO: 503622 - DNA, 25 bp, Mus musculus
aactgaagaaggacccacactctca

SEQ ID NO: 503623 - DNA, 25 bp, Mus musculus
aactgaagaaggtcccacactctca

SEQ ID NO: 503624 - DNA, 25 bp, Mus musculus
aactgaagagggagatgtctaactt

SEQ ID NO: 503625 - DNA, 25 bp, Mus musculus
aactgaagagggtgatgtctaactt

SEQ ID NO: 503626 - DNA, 25 bp, Mus musculus
aactgaagatcaacatcgatgttct

SEQ ID NO: 503627 - DNA, 25 bp, Mus musculus
aactgaagatcatcatcgatgttct

SEQ ID NO: 503628 - DNA, 25 bp, Mus musculus
aactgaagcgccaggaagcccagca

SEQ ID NO: 503629 - DNA, 25 bp, Mus musculus
aactgaagcgcctggaagcccagca

SEQ ID NO: 503630 - DNA, 25 bp, Mus musculus
aactgaagcttaccttataacagca

SEQ ID NO: 503631 - DNA, 25 bp, Mus musculus
aactgaagcttagcttataacagca

SEQ ID NO: 503632 - DNA, 25 bp, Mus musculus
aactgaaggcgcctatgatttaccc

SEQ ID NO: 503633 - DNA, 25 bp, Mus musculus
aactgaaggcgcgtatgatttaccc

SEQ ID NO: 503634 - DNA, 25 bp, Mus musculus
aactgaagtagtagagcgccttggc

SEQ ID NO: 503635 - DNA, 25 bp, Mus musculus
aactgaagtagttgagcgccttggc

SEQ ID NO: 503636 - DNA, 25 bp, Mus musculus
aactgaatatgacaggaacgggaga

SEQ ID NO: 503637 - DNA, 25 bp, Mus musculus
aactgaatatgagaggaacgggaga

SEQ ID NO: 503638 - DNA, 25 bp, Mus musculus
aactgaatccagaaagcctatgatg

SEQ ID NO: 503639 - DNA, 25 bp, Mus musculus
aactgaatccagtaagcctatgatg

SEQ ID NO: 503640 - DNA, 25 bp, Mus musculus
aactgaattcagacccagtagcagg

SEQ ID NO: 503641 - DNA, 25 bp, Mus musculus
aactgaattcagtcccagtagcagg

SEQ ID NO: 503642 - DNA, 25 bp, Mus musculus
aactgacaagcacctttctcctgat

SEQ ID NO: 503643 - DNA, 25 bp, Mus musculus
aactgacaagcagctttctcctgat

SEQ ID NO: 503644 - DNA, 25 bp, Mus musculus
aactgacaagggaactggcaagagc

SEQ ID NO: 503645 - DNA, 25 bp, Mus musculus
aactgacaagggtactggcaagagc

SEQ ID NO: 503646 - DNA, 25 bp, Mus musculus
aactgacattgtaggtggtgtgccc

SEQ ID NO: 503647 - DNA, 25 bp, Mus musculus
aactgacattgttggtggtgtgccc

SEQ ID NO: 503648 - DNA, 25 bp, Mus musculus
aactgaccctagagagatccgtgca

SEQ ID NO: 503649 - DNA, 25 bp, Mus musculus
aactgaccctagtgagatccgtgca

SEQ ID NO: 503650 - DNA, 25 bp, Mus musculus
aactgacctcagaacatgccgatct

SEQ ID NO: 503651 - DNA, 25 bp, Mus musculus
aactgacctcagtacatgccgatct

SEQ ID NO: 503652 - DNA, 25 bp, Mus musculus
aactgacctgcactgaggagatggc

SEQ ID NO: 503653 - DNA, 25 bp, Mus musculus
aactgacctgcagtgaggagatggc

SEQ ID NO: 503654 - DNA, 25 bp, Mus musculus
aactgacctggcattctcgggattt

SEQ ID NO: 503655 - DNA, 25 bp, Mus musculus
aactgacctggctttctcgggattt

SEQ ID NO: 503656 - DNA, 25 bp, Mus musculus
aactgacgactaagaggcaatcaag

SEQ ID NO: 503657 - DNA, 25 bp, Mus musculus
aactgacgactatgaggcaatcaag

SEQ ID NO: 503658 - DNA, 25 bp, Mus musculus
aactgacgagttccgggtacctgaa

SEQ ID NO: 503659 - DNA, 25 bp, Mus musculus
aactgacgagttgcgggtacctgaa

SEQ ID NO: 503660 - DNA, 25 bp, Mus musculus
aactgacgctcacacagtagcgagg

SEQ ID NO: 503661 - DNA, 25 bp, Mus musculus
aactgacgctcagacagtagcgagg

SEQ ID NO: 503662 - DNA, 25 bp, Mus musculus
aactgactctaaacaaaggccaggc

SEQ ID NO: 503663 - DNA, 25 bp, Mus musculus
aactgactctaatcaaaggccaggc

SEQ ID NO: 503664 - DNA, 25 bp, Mus musculus
aactgactgattacagagggatccc

SEQ ID NO: 503665 - DNA, 25 bp, Mus musculus
aactgactgatttcagagggatccc

SEQ ID NO: 503666 - DNA, 25 bp, Mus musculus
aactgacttgaaagcagcaaaaagt

SEQ ID NO: 503667 - DNA, 25 bp, Mus musculus
aactgacttgaatgcagcaaaaagt

SEQ ID NO: 503668 - DNA, 25 bp, Mus musculus
aactgactttggagctaggagcccc

SEQ ID NO: 503669 - DNA, 25 bp, Mus musculus
aactgactttggtgctaggagcccc

SEQ ID NO: 503670 - DNA, 25 bp, Mus musculus
aactgagaatctatcttgatgaaag

SEQ ID NO: 503671 - DNA, 25 bp, Mus musculus
aactgagaatctttcttgatgaaag

SEQ ID NO: 503672 - DNA, 25 bp, Mus musculus
aactgagatggtatgtgcctccagc

SEQ ID NO: 503673 - DNA, 25 bp, Mus musculus
aactgagatggtttgtgcctccagc

SEQ ID NO: 503674 - DNA, 25 bp, Mus musculus
aactgagatttcagcccggcagcct

SEQ ID NO: 503675 - DNA, 25 bp, Mus musculus
aactgagatttctgcccggcagcct

SEQ ID NO: 503676 - DNA, 25 bp, Mus musculus
aactgagcagagcatccaagccgct

SEQ ID NO: 503677 - DNA, 25 bp, Mus musculus
aactgagcagaggatccaagccgct

SEQ ID NO: 503678 - DNA, 25 bp, Mus musculus
aactgagcagcactttgagaaggcc

SEQ ID NO: 503679 - DNA, 25 bp, Mus musculus
aactgagcagcagtttgagaaggcc

SEQ ID NO: 503680 - DNA, 25 bp, Mus musculus
aactgagcgtgcactgcaaggctgt

SEQ ID NO: 503681 - DNA, 25 bp, Mus musculus
aactgagcgtgctctgcaaggctgt

SEQ ID NO: 503682 - DNA, 25 bp, Mus musculus
aactgagctacccaagaccgcagtg

SEQ ID NO: 503683 - DNA, 25 bp, Mus musculus
aactgagctaccgaagaccgcagtg

SEQ ID NO: 503684 - DNA, 25 bp, Mus musculus
aactgaggcattatgagaagtctac

SEQ ID NO: 503685 - DNA, 25 bp, Mus musculus
aactgaggcattttgagaagtctac

SEQ ID NO: 503686 - DNA, 25 bp, Mus musculus
aactgaggcgctcgcttctccatgg

SEQ ID NO: 503687 - DNA, 25 bp, Mus musculus
aactgaggcgctggcttctccatgg

SEQ ID NO: 503688 - DNA, 25 bp, Mus musculus
aactgaggtggcatacgaagtgacg

SEQ ID NO: 503689 - DNA, 25 bp, Mus musculus
aactgaggtggcttacgaagtgacg

SEQ ID NO: 503690 - DNA, 25 bp, Mus musculus
aactgagtccatccagagctctctg

SEQ ID NO: 503691 - DNA, 25 bp, Mus musculus
aactgagtccatgcagagctctctg

SEQ ID NO: 503692 - DNA, 25 bp, Mus musculus
aactgagtttacaaggagataccaa

SEQ ID NO: 503693 - DNA, 25 bp, Mus musculus
aactgagtttactaggagataccaa

SEQ ID NO: 503694 - DNA, 25 bp, Mus musculus
aactgatatacaaggaggtaatgga

SEQ ID NO: 503695 - DNA, 25 bp, Mus musculus
aactgatatacatggaggtaatgga

SEQ ID NO: 503696 - DNA, 25 bp, Mus musculus
aactgatccccgagctcagggcagt

SEQ ID NO: 503697 - DNA, 25 bp, Mus musculus
aactgatccccgtgctcagggcagt

SEQ ID NO: 503698 - DNA, 25 bp, Mus musculus
aactgatcgttaagaagtccaagga

SEQ ID NO: 503699 - DNA, 25 bp, Mus musculus
aactgatcgttatgaagtccaagga

SEQ ID NO: 503700 - DNA, 25 bp, Mus musculus
aactgatgaggcaggcagcgtgtac

SEQ ID NO: 503701 - DNA, 25 bp, Mus musculus
aactgatgaggctggcagcgtgtac

SEQ ID NO: 503702 - DNA, 25 bp, Mus musculus
aactgattgagtactttgaggagga

SEQ ID NO: 503703 - DNA, 25 bp, Mus musculus
aactgattgagttctttgaggagga

SEQ ID NO: 503704 - DNA, 25 bp, Mus musculus
aactgatttgtcatataaaggccac

SEQ ID NO: 503705 - DNA, 25 bp, Mus musculus
aactgatttgtcttataaaggccac

SEQ ID NO: 503706 - DNA, 25 bp, Mus musculus
aactgcaaggaaaggaagtcggtgt

SEQ ID NO: 503707 - DNA, 25 bp, Mus musculus
aactgcaaggaatggaagtcggtgt

SEQ ID NO: 503708 - DNA, 25 bp, Mus musculus
aactgcaattttcgagcaactcctt

SEQ ID NO: 503709 - DNA, 25 bp, Mus musculus
aactgcaattttggagcaactcctt

SEQ ID NO: 503710 - DNA, 25 bp, Mus musculus
aactgcacctaccctgatctgctgg

SEQ ID NO: 503711 - DNA, 25 bp, Mus musculus
aactgcacctacgctgatctgctgg

SEQ ID NO: 503712 - DNA, 25 bp, Mus musculus
aactgcacggccaggatgcgttgct

SEQ ID NO: 503713 - DNA, 25 bp, Mus musculus
aactgcacggcctggatgcgttgct

SEQ ID NO: 503714 - DNA, 25 bp, Mus musculus
aactgcagaaggaatttaaacgcca

SEQ ID NO: 503715 - DNA, 25 bp, Mus musculus
aactgcagaaggtatttaaacgcca

SEQ ID NO: 503716 - DNA, 25 bp, Mus musculus
aactgcagacctcaaatctctgggc

SEQ ID NO: 503717 - DNA, 25 bp, Mus musculus
aactgcagacctgaaatctctgggc

SEQ ID NO: 503718 - DNA, 25 bp, Mus musculus
aactgcagccaccagctctggaagg

SEQ ID NO: 503719 - DNA, 25 bp, Mus musculus
aactgcagccacgagctctggaagg

SEQ ID NO: 503720 - DNA, 25 bp, Mus musculus
aactgcaggctaagaccacacggtg

SEQ ID NO: 503721 - DNA, 25 bp, Mus musculus
aactgcaggctatgaccacacggtg

SEQ ID NO: 503722 - DNA, 25 bp, Mus musculus
aactgcagtagcactgttgtcacac

SEQ ID NO: 503723 - DNA, 25 bp, Mus musculus
aactgcagtagctctgttgtcacac

SEQ ID NO: 503724 - DNA, 25 bp, Mus musculus
aactgcagtgtgagggacgctctga

SEQ ID NO: 503725 - DNA, 25 bp, Mus musculus
aactgcagtgtgtgggacgctctga

SEQ ID NO: 503726 - DNA, 25 bp, Mus musculus
aactgcagttgtaccgaggtgacac

SEQ ID NO: 503727 - DNA, 25 bp, Mus musculus
aactgcagttgttccgaggtgacac

SEQ ID NO: 503728 - DNA, 25 bp, Mus musculus
aactgcatacccagcggacgtgcta

SEQ ID NO: 503729 - DNA, 25 bp, Mus musculus
aactgcataccctgcggacgtgcta

SEQ ID NO: 503730 - DNA, 25 bp, Mus musculus
aactgcatgagtcagttcatgggcc

SEQ ID NO: 503731 - DNA, 25 bp, Mus musculus
aactgcatgagtgagttcatgggcc

SEQ ID NO: 503732 - DNA, 25 bp, Mus musculus
aactgcattgttcaccgggacctga

SEQ ID NO: 503733 - DNA, 25 bp, Mus musculus
aactgcattgttgaccgggacctga

SEQ ID NO: 503734 - DNA, 25 bp, Mus musculus
aactgcatttatatagccatctcag

SEQ ID NO: 503735 - DNA, 25 bp, Mus musculus
aactgcatttatttagccatctcag

SEQ ID NO: 503736 - DNA, 25 bp, Mus musculus
aactgccacgtgcagctcatcaggc

SEQ ID NO: 503737 - DNA, 25 bp, Mus musculus
aactgccacgtggagctcatcaggc

SEQ ID NO: 503738 - DNA, 25 bp, Mus musculus
aactgccactcgaacctgtccggat

SEQ ID NO: 503739 - DNA, 25 bp, Mus musculus
aactgccactcgtacctgtccggat

SEQ ID NO: 503740 - DNA, 25 bp, Mus musculus
aactgccactgacatttctgctaag

SEQ ID NO: 503741 - DNA, 25 bp, Mus musculus
aactgccactgagatttctgctaag

SEQ ID NO: 503742 - DNA, 25 bp, Mus musculus
aactgccagccgctggttttggtgc

SEQ ID NO: 503743 - DNA, 25 bp, Mus musculus
aactgccagccggtggttttggtgc

SEQ ID NO: 503744 - DNA, 25 bp, Mus musculus
aactgccaggagacgatgtgctcct

SEQ ID NO: 503745 - DNA, 25 bp, Mus musculus
aactgccaggagtcgatgtgctcct

SEQ ID NO: 503746 - DNA, 25 bp, Mus musculus
aactgccatgcacggttctttctga

SEQ ID NO: 503747 - DNA, 25 bp, Mus musculus
aactgccatgcagggttctttctga

SEQ ID NO: 503748 - DNA, 25 bp, Mus musculus
aactgccattgtccgaatcaccgct

SEQ ID NO: 503749 - DNA, 25 bp, Mus musculus
aactgccattgtgcgaatcaccgct

SEQ ID NO: 503750 - DNA, 25 bp, Mus musculus
aactgcccaagcaccggaccctgga

SEQ ID NO: 503751 - DNA, 25 bp, Mus musculus
aactgcccaagctccggaccctgga

SEQ ID NO: 503752 - DNA, 25 bp, Mus musculus
aactgcccactaaacgtcaccaagg

SEQ ID NO: 503753 - DNA, 25 bp, Mus musculus
aactgcccactatacgtcaccaagg

SEQ ID NO: 503754 - DNA, 25 bp, Mus musculus
aactgcccagctacttcaaattgcc

SEQ ID NO: 503755 - DNA, 25 bp, Mus musculus
aactgcccagcttcttcaaattgcc

SEQ ID NO: 503756 - DNA, 25 bp, Mus musculus
aactgcccatggacagttgccctgt

SEQ ID NO: 503757 - DNA, 25 bp, Mus musculus
aactgcccatggtcagttgccctgt

SEQ ID NO: 503758 - DNA, 25 bp, Mus musculus
aactgccccatccagaaagacaagg

SEQ ID NO: 503759 - DNA, 25 bp, Mus musculus
aactgccccatcgagaaagacaagg

SEQ ID NO: 503760 - DNA, 25 bp, Mus musculus
aactgcccggccaccaatgaatgtg

SEQ ID NO: 503761 - DNA, 25 bp, Mus musculus
aactgcccggcctccaatgaatgtg

SEQ ID NO: 503762 - DNA, 25 bp, Mus musculus
aactgcccggtcaatgtggtgactg

SEQ ID NO: 503763 - DNA, 25 bp, Mus musculus
aactgcccggtctatgtggtgactg

SEQ ID NO: 503764 - DNA, 25 bp, Mus musculus
aactgccctgagactcctaatgcca

SEQ ID NO: 503765 - DNA, 25 bp, Mus musculus
aactgccctgagtctcctaatgcca

SEQ ID NO: 503766 - DNA, 25 bp, Mus musculus
aactgccctgcgagagttcccagaa

SEQ ID NO: 503767 - DNA, 25 bp, Mus musculus
aactgccctgcgtgagttcccagaa

SEQ ID NO: 503768 - DNA, 25 bp, Mus musculus
aactgcccttgaatgaaatcgaggc

SEQ ID NO: 503769 - DNA, 25 bp, Mus musculus
aactgcccttgattgaaatcgaggc

SEQ ID NO: 503770 - DNA, 25 bp, Mus musculus
aactgcctcgtcatgtatgtcatcc

SEQ ID NO: 503771 - DNA, 25 bp, Mus musculus
aactgcctcgtcttgtatgtcatcc

SEQ ID NO: 503772 - DNA, 25 bp, Mus musculus
aactgcctgcatacagcaccttcat

SEQ ID NO: 503773 - DNA, 25 bp, Mus musculus
aactgcctgcattcagcaccttcat

SEQ ID NO: 503774 - DNA, 25 bp, Mus musculus
aactgccttcaaaagagggtcctga

SEQ ID NO: 503775 - DNA, 25 bp, Mus musculus
aactgccttcaatagagggtcctga

SEQ ID NO: 503776 - DNA, 25 bp, Mus musculus
aactgccttctcctgtcaggccggg

SEQ ID NO: 503777 - DNA, 25 bp, Mus musculus
aactgccttctcgtgtcaggccggg

SEQ ID NO: 503778 - DNA, 25 bp, Mus musculus
aactgcgagactaatgaggcccaca

SEQ ID NO: 503779 - DNA, 25 bp, Mus musculus
aactgcgagacttatgaggcccaca

SEQ ID NO: 503780 - DNA, 25 bp, Mus musculus
aactgcgagccaaggcccgaaagat

SEQ ID NO: 503781 - DNA, 25 bp, Mus musculus
aactgcgagccatggcccgaaagat

SEQ ID NO: 503782 - DNA, 25 bp, Mus musculus
aactgcgcaggacaacaaggcgtcg

SEQ ID NO: 503783 - DNA, 25 bp, Mus musculus
aactgcgcaggagaacaaggcgtcg

SEQ ID NO: 503784 - DNA, 25 bp, Mus musculus
aactgcgctcacagactggcctcat

SEQ ID NO: 503785 - DNA, 25 bp, Mus musculus
aactgcgctcactgactggcctcat

SEQ ID NO: 503786 - DNA, 25 bp, Mus musculus
aactgcgctgggaccctggtgacta

SEQ ID NO: 503787 - DNA, 25 bp, Mus musculus
aactgcgctgggtccctggtgacta

SEQ ID NO: 503788 - DNA, 25 bp, Mus musculus
aactgcggatcacctgaggctttga

SEQ ID NO: 503789 - DNA, 25 bp, Mus musculus
aactgcggatcagctgaggctttga

SEQ ID NO: 503790 - DNA, 25 bp, Mus musculus
aactgcgtgacgctgcccaattcgg

SEQ ID NO: 503791 - DNA, 25 bp, Mus musculus
aactgcgtgacggtgcccaattcgg

SEQ ID NO: 503792 - DNA, 25 bp, Mus musculus
aactgctacaccagtgttgggaggc

SEQ ID NO: 503793 - DNA, 25 bp, Mus musculus
aactgctacacctgtgttgggaggc

SEQ ID NO: 503794 - DNA, 25 bp, Mus musculus
aactgctaccaaatagctgtgaacc

SEQ ID NO: 503795 - DNA, 25 bp, Mus musculus
aactgctaccaattagctgtgaacc

SEQ ID NO: 503796 - DNA, 25 bp, Mus musculus
aactgctatctcctggagcctcatg

SEQ ID NO: 503797 - DNA, 25 bp, Mus musculus
aactgctatctcgtggagcctcatg

SEQ ID NO: 503798 - DNA, 25 bp, Mus musculus
aactgctcttaccttggcttgctgt

SEQ ID NO: 503799 - DNA, 25 bp, Mus musculus
aactgctcttacgttggcttgctgt

SEQ ID NO: 503800 - DNA, 25 bp, Mus musculus
aactgctcttcaatgagacccagga

SEQ ID NO: 503801 - DNA, 25 bp, Mus musculus
aactgctcttcattgagacccagga

SEQ ID NO: 503802 - DNA, 25 bp, Mus musculus
aactgctcttggctcatggagctga

SEQ ID NO: 503803 - DNA, 25 bp, Mus musculus
aactgctcttgggtcatggagctga

SEQ ID NO: 503804 - DNA, 25 bp, Mus musculus
aactgctggagtaggccaatgttca

SEQ ID NO: 503805 - DNA, 25 bp, Mus musculus
aactgctggagttggccaatgttca

SEQ ID NO: 503806 - DNA, 25 bp, Mus musculus
aactgcttctcaaacctgggctgct

SEQ ID NO: 503807 - DNA, 25 bp, Mus musculus
aactgcttctcatacctgggctgct

SEQ ID NO: 503808 - DNA, 25 bp, Mus musculus
aactgcttgctaccccagtggagcc

SEQ ID NO: 503809 - DNA, 25 bp, Mus musculus
aactgcttgctagcccagtggagcc

SEQ ID NO: 503810 - DNA, 25 bp, Mus musculus
aactgcttgggcatcgtaaccaaat

SEQ ID NO: 503811 - DNA, 25 bp, Mus musculus
aactgcttgggcttcgtaaccaaat

SEQ ID NO: 503812 - DNA, 25 bp, Mus musculus
aactggaaaaatataactgtgctgt

SEQ ID NO: 503813 - DNA, 25 bp, Mus musculus
aactggaaaaatttaactgtgctgt

SEQ ID NO: 503814 - DNA, 25 bp, Mus musculus
aactggaaagcactggccatcggaa

SEQ ID NO: 503815 - DNA, 25 bp, Mus musculus
aactggaaagcagtggccatcggaa

SEQ ID NO: 503816 - DNA, 25 bp, Mus musculus
aactggaacgttcttgctcgcgccg

SEQ ID NO: 503817 - DNA, 25 bp, Mus musculus
aactggaacgttgttgctcgcgccg

SEQ ID NO: 503818 - DNA, 25 bp, Mus musculus
aactggaagattccttctttacggc

SEQ ID NO: 503819 - DNA, 25 bp, Mus musculus
aactggaagattgcttctttacggc

SEQ ID NO: 503820 - DNA, 25 bp, Mus musculus
aactggaagcggatttgttcctctg

SEQ ID NO: 503821 - DNA, 25 bp, Mus musculus
aactggaagcggttttgttcctctg

SEQ ID NO: 503822 - DNA, 25 bp, Mus musculus
aactggaagtggacacagagagttg

SEQ ID NO: 503823 - DNA, 25 bp, Mus musculus
aactggaagtggtcacagagagttg

SEQ ID NO: 503824 - DNA, 25 bp, Mus musculus
aactggacagagaccgaggtcagag

SEQ ID NO: 503825 - DNA, 25 bp, Mus musculus
aactggacagagtccgaggtcagag

SEQ ID NO: 503826 - DNA, 25 bp, Mus musculus
aactggaccccgagaggatgggctc

SEQ ID NO: 503827 - DNA, 25 bp, Mus musculus
aactggaccccgtgaggatgggctc

SEQ ID NO: 503828 - DNA, 25 bp, Mus musculus
aactggacctgcagcagggacagga

SEQ ID NO: 503829 - DNA, 25 bp, Mus musculus
aactggacctgctgcagggacagga

SEQ ID NO: 503830 - DNA, 25 bp, Mus musculus
aactggacggtcatcccactgaaca

SEQ ID NO: 503831 - DNA, 25 bp, Mus musculus
aactggacggtcttcccactgaaca

SEQ ID NO: 503832 - DNA, 25 bp, Mus musculus
aactggactagaagggaagctggcc

SEQ ID NO: 503833 - DNA, 25 bp, Mus musculus
aactggactagatgggaagctggcc

SEQ ID NO: 503834 - DNA, 25 bp, Mus musculus
aactggagaaatagcccatacacaa

SEQ ID NO: 503835 - DNA, 25 bp, Mus musculus
aactggagaaattgcccatacacaa

SEQ ID NO: 503836 - DNA, 25 bp, Mus musculus
aactggagacaaaatggaccgaggg

SEQ ID NO: 503837 - DNA, 25 bp, Mus musculus
aactggagacaatatggaccgaggg

SEQ ID NO: 503838 - DNA, 25 bp, Mus musculus
aactggagagcgcatatgccttgca

SEQ ID NO: 503839 - DNA, 25 bp, Mus musculus
aactggagagcggatatgccttgca

SEQ ID NO: 503840 - DNA, 25 bp, Mus musculus
aactggagcaacacaacctgcctga

SEQ ID NO: 503841 - DNA, 25 bp, Mus musculus
aactggagcaactcaacctgcctga

SEQ ID NO: 503842 - DNA, 25 bp, Mus musculus
aactggaggatgaccgaagacagct

SEQ ID NO: 503843 - DNA, 25 bp, Mus musculus
aactggaggatgtccgaagacagct

SEQ ID NO: 503844 - DNA, 25 bp, Mus musculus
aactggaggtccattttgtgccttg

SEQ ID NO: 503845 - DNA, 25 bp, Mus musculus
aactggaggtcccacagacttcctg

SEQ ID NO: 503846 - DNA, 25 bp, Mus musculus
aactggaggtccgacagacttcctg

SEQ ID NO: 503847 - DNA, 25 bp, Mus musculus
aactggaggtcctttttgtgccttg

SEQ ID NO: 503848 - DNA, 25 bp, Mus musculus
aactggagtaggacgtgtacttgga

SEQ ID NO: 503849 - DNA, 25 bp, Mus musculus
aactggagtaggtcgtgtacttgga

SEQ ID NO: 503850 - DNA, 25 bp, Mus musculus
aactggatcaaaaccattggcggtg

SEQ ID NO: 503851 - DNA, 25 bp, Mus musculus
aactggatcaaatccattggcggtg

SEQ ID NO: 503852 - DNA, 25 bp, Mus musculus
aactggatcagcctctctttagccg

SEQ ID NO: 503853 - DNA, 25 bp, Mus musculus
aactggatcagcgtctctttagccg

SEQ ID NO: 503854 - DNA, 25 bp, Mus musculus
aactggatcctgagtctgcatagaa

SEQ ID NO: 503855 - DNA, 25 bp, Mus musculus
aactggatcctgcagtcccagaata

SEQ ID NO: 503856 - DNA, 25 bp, Mus musculus
aactggatcctggagtcccagaata

SEQ ID NO: 503857 - DNA, 25 bp, Mus musculus
aactggatcctgtgtctgcatagaa

SEQ ID NO: 503858 - DNA, 25 bp, Mus musculus
aactggatcttacattttggactgc

SEQ ID NO: 503859 - DNA, 25 bp, Mus musculus
aactggatcttagattttggactgc

SEQ ID NO: 503860 - DNA, 25 bp, Mus musculus
aactggatgatgagaagcccgagga

SEQ ID NO: 503861 - DNA, 25 bp, Mus musculus
aactggatgatgtgaagcccgagga

SEQ ID NO: 503862 - DNA, 25 bp, Mus musculus
aactggatgcggaccccaagaggaa

SEQ ID NO: 503863 - DNA, 25 bp, Mus musculus
aactggatgcggtccccaagaggaa

SEQ ID NO: 503864 - DNA, 25 bp, Mus musculus
aactggatgctcatttggaacagca

SEQ ID NO: 503865 - DNA, 25 bp, Mus musculus
aactggatgctcttttggaacagca

SEQ ID NO: 503866 - DNA, 25 bp, Mus musculus
aactggatggcaaattgatagaccc

SEQ ID NO: 503867 - DNA, 25 bp, Mus musculus
aactggatggcatattgatagaccc

SEQ ID NO: 503868 - DNA, 25 bp, Mus musculus
aactggcaacacatctactgatggc

SEQ ID NO: 503869 - DNA, 25 bp, Mus musculus
aactggcaacacttctactgatggc

SEQ ID NO: 503870 - DNA, 25 bp, Mus musculus
aactggcaagacaacgagggccgca

SEQ ID NO: 503871 - DNA, 25 bp, Mus musculus
aactggcaagactacgagggccgca

SEQ ID NO: 503872 - DNA, 25 bp, Mus musculus
aactggcaagcacaagggctatggt

SEQ ID NO: 503873 - DNA, 25 bp, Mus musculus
aactggcaagcagaagggctatggt

SEQ ID NO: 503874 - DNA, 25 bp, Mus musculus
aactggcaccggcactctgctgata

SEQ ID NO: 503875 - DNA, 25 bp, Mus musculus
aactggcaccgggactctgctgata

SEQ ID NO: 503876 - DNA, 25 bp, Mus musculus
aactggcacgggatactgaaaggac

SEQ ID NO: 503877 - DNA, 25 bp, Mus musculus
aactggcacgggttactgaaaggac

SEQ ID NO: 503878 - DNA, 25 bp, Mus musculus
aactggcactgaccaaggctattga

SEQ ID NO: 503879 - DNA, 25 bp, Mus musculus
aactggcactgagcaaggctattga

SEQ ID NO: 503880 - DNA, 25 bp, Mus musculus
aactggcaggacattctcaaggaca

SEQ ID NO: 503881 - DNA, 25 bp, Mus musculus
aactggcaggactttctcaaggaca

SEQ ID NO: 503882 - DNA, 25 bp, Mus musculus
aactggcattgcataagcaggaact

SEQ ID NO: 503883 - DNA, 25 bp, Mus musculus
aactggcattgcttaagcaggaact

SEQ ID NO: 503884 - DNA, 25 bp, Mus musculus
aactggccaaggagtggtgcttcaa

SEQ ID NO: 503885 - DNA, 25 bp, Mus musculus
aactggccaaggtgtggtgcttcaa

SEQ ID NO: 503886 - DNA, 25 bp, Mus musculus
aactggccagaaacttgaatgggtc

SEQ ID NO: 503887 - DNA, 25 bp, Mus musculus
aactggccagaatcttgaatgggtc

SEQ ID NO: 503888 - DNA, 25 bp, Mus musculus
aactggccagttcagaaagaacgga

SEQ ID NO: 503889 - DNA, 25 bp, Mus musculus
aactggccagttgagaaagaacgga

SEQ ID NO: 503890 - DNA, 25 bp, Mus musculus
aactggcccgcaaggaaaggcagct

SEQ ID NO: 503891 - DNA, 25 bp, Mus musculus
aactggcccgcatggaaaggcagct

SEQ ID NO: 503892 - DNA, 25 bp, Mus musculus
aactggcgtgacaggcgaaaagccc

SEQ ID NO: 503893 - DNA, 25 bp, Mus musculus
aactggcgtgactggcgaaaagccc

SEQ ID NO: 503894 - DNA, 25 bp, Mus musculus
aactggcgtgtgagtaactgaataa

SEQ ID NO: 503895 - DNA, 25 bp, Mus musculus
aactggcgtgtgtgtaactgaataa

SEQ ID NO: 503896 - DNA, 25 bp, Mus musculus
aactggctataaaaaccaggctggc

SEQ ID NO: 503897 - DNA, 25 bp, Mus musculus
aactggctataataaccaggctggc

SEQ ID NO: 503898 - DNA, 25 bp, Mus musculus
aactggctatgcactctatccggga

SEQ ID NO: 503899 - DNA, 25 bp, Mus musculus
aactggctatgctctctatccggga

SEQ ID NO: 503900 - DNA, 25 bp, Mus musculus
aactggctcacactattggtattgc

SEQ ID NO: 503901 - DNA, 25 bp, Mus musculus
aactggctcacagtattggtattgc

SEQ ID NO: 503902 - DNA, 25 bp, Mus musculus
aactggctcagcctttccaatatca

SEQ ID NO: 503903 - DNA, 25 bp, Mus musculus
aactggctcagcgtttccaatatca

SEQ ID NO: 503904 - DNA, 25 bp, Mus musculus
aactggctccatcgctgggactgga

SEQ ID NO: 503905 - DNA, 25 bp, Mus musculus
aactggctccatggctgggactgga

SEQ ID NO: 503906 - DNA, 25 bp, Mus musculus
aactggctgagcaggctgagcgcta

SEQ ID NO: 503907 - DNA, 25 bp, Mus musculus
aactggctgagctggctgagcgcta

SEQ ID NO: 503908 - DNA, 25 bp, Mus musculus
aactggctgagtccataggctccgg

SEQ ID NO: 503909 - DNA, 25 bp, Mus musculus
aactggctgagtgcataggctccgg

SEQ ID NO: 503910 - DNA, 25 bp, Mus musculus
aactggctgttcctactgatgctaa

SEQ ID NO: 503911 - DNA, 25 bp, Mus musculus
aactggctgttcgtactgatgctaa

SEQ ID NO: 503912 - DNA, 25 bp, Mus musculus
aactggcttttgagaccagcgtagg

SEQ ID NO: 503913 - DNA, 25 bp, Mus musculus
aactggcttttgtgaccagcgtagg

SEQ ID NO: 503914 - DNA, 25 bp, Mus musculus
aactgggaacgcatccgtgccttgg

SEQ ID NO: 503915 - DNA, 25 bp, Mus musculus
aactgggaacgcttccgtgccttgg

SEQ ID NO: 503916 - DNA, 25 bp, Mus musculus
aactgggaagcacgcctgatgctag

SEQ ID NO: 503917 - DNA, 25 bp, Mus musculus
aactgggaagcaggcctgatgctag

SEQ ID NO: 503918 - DNA, 25 bp, Mus musculus
aactgggaagtacctgccacgtagg

SEQ ID NO: 503919 - DNA, 25 bp, Mus musculus
aactgggaagtagctgccacgtagg

SEQ ID NO: 503920 - DNA, 25 bp, Mus musculus
aactgggcaacaacaccaagtagcc

SEQ ID NO: 503921 - DNA, 25 bp, Mus musculus
aactgggcaacatcaccaagtagcc

SEQ ID NO: 503922 - DNA, 25 bp, Mus musculus
aactgggcagtaaaaactcggatcc

SEQ ID NO: 503923 - DNA, 25 bp, Mus musculus
aactgggcagtataaactcggatcc

SEQ ID NO: 503924 - DNA, 25 bp, Mus musculus
aactgggccaacatcctgtatgatg

SEQ ID NO: 503925 - DNA, 25 bp, Mus musculus
aactgggccaacttcctgtatgatg

SEQ ID NO: 503926 - DNA, 25 bp, Mus musculus
aactgggccactcggtgacgacgcc

SEQ ID NO: 503927 - DNA, 25 bp, Mus musculus
aactgggccactgggtgacgacgcc

SEQ ID NO: 503928 - DNA, 25 bp, Mus musculus
aactgggccagcagatccaggctgt

SEQ ID NO: 503929 - DNA, 25 bp, Mus musculus
aactgggccagctgatccaggctgt

SEQ ID NO: 503930 - DNA, 25 bp, Mus musculus
aactgggccagtatcagcttttcag

SEQ ID NO: 503931 - DNA, 25 bp, Mus musculus
aactgggccagtttcagcttttcag

SEQ ID NO: 503932 - DNA, 25 bp, Mus musculus
aactgggccattctggctgacatcc

SEQ ID NO: 503933 - DNA, 25 bp, Mus musculus
aactgggccattgtggctgacatcc

SEQ ID NO: 503934 - DNA, 25 bp, Mus musculus
aactgggcctctactgtctttgatg

SEQ ID NO: 503935 - DNA, 25 bp, Mus musculus
aactgggcctcttctgtctttgatg

SEQ ID NO: 503936 - DNA, 25 bp, Mus musculus
aactgggcgattcctctggcattgg

SEQ ID NO: 503937 - DNA, 25 bp, Mus musculus
aactgggcgattgctctggcattgg

SEQ ID NO: 503938 - DNA, 25 bp, Mus musculus
aactgggcttgcattgttggcaaga

SEQ ID NO: 503939 - DNA, 25 bp, Mus musculus
aactgggcttgctttgttggcaaga

SEQ ID NO: 503940 - DNA, 25 bp, Mus musculus
aactgggttattaattgactcgcaa

SEQ ID NO: 503941 - DNA, 25 bp, Mus musculus
aactgggttatttattgactcgcaa

SEQ ID NO: 503942 - DNA, 25 bp, Mus musculus
aactggtacttccttgtcgctgaca

SEQ ID NO: 503943 - DNA, 25 bp, Mus musculus
aactggtacttcgttgtcgctgaca

SEQ ID NO: 503944 - DNA, 25 bp, Mus musculus
aactggtccctcctggagaagcgga

SEQ ID NO: 503945 - DNA, 25 bp, Mus musculus
aactggtccctcgtggagaagcgga

SEQ ID NO: 503946 - DNA, 25 bp, Mus musculus
aactggtgcagaaagcccggctggc

SEQ ID NO: 503947 - DNA, 25 bp, Mus musculus
aactggtgcagatagcccggctggc

SEQ ID NO: 503948 - DNA, 25 bp, Mus musculus
aactggtgcatcaagcgacggtcac

SEQ ID NO: 503949 - DNA, 25 bp, Mus musculus
aactggtgcatctagcgacggtcac

SEQ ID NO: 503950 - DNA, 25 bp, Mus musculus
aactggtgtagcctagctggtctga

SEQ ID NO: 503951 - DNA, 25 bp, Mus musculus
aactggtgtagcgtagctggtctga

SEQ ID NO: 503952 - DNA, 25 bp, Mus musculus
aactggttttcacgtcacttgggca

SEQ ID NO: 503953 - DNA, 25 bp, Mus musculus
aactggttttcaggtcacttgggca

SEQ ID NO: 503954 - DNA, 25 bp, Mus musculus
aactggttttcccagaggccggcag

SEQ ID NO: 503955 - DNA, 25 bp, Mus musculus
aactggttttccgagaggccggcag

SEQ ID NO: 503956 - DNA, 25 bp, Mus musculus
aactgtaagcccatggtgggatctc

SEQ ID NO: 503957 - DNA, 25 bp, Mus musculus
aactgtaagcccttggtgggatctc

SEQ ID NO: 503958 - DNA, 25 bp, Mus musculus
aactgtaatcccagccaataagcta

SEQ ID NO: 503959 - DNA, 25 bp, Mus musculus
aactgtaatccctgccaataagcta

SEQ ID NO: 503960 - DNA, 25 bp, Mus musculus
aactgtactgccatggccagcaagc

SEQ ID NO: 503961 - DNA, 25 bp, Mus musculus
aactgtactgccttggccagcaagc

SEQ ID NO: 503962 - DNA, 25 bp, Mus musculus
aactgtagacttcttgggcatatta

SEQ ID NO: 503963 - DNA, 25 bp, Mus musculus
aactgtagacttgttgggcatatta

SEQ ID NO: 503964 - DNA, 25 bp, Mus musculus
aactgtaggagcaggttcagaggac

SEQ ID NO: 503965 - DNA, 25 bp, Mus musculus
aactgtaggagctggttcagaggac

SEQ ID NO: 503966 - DNA, 25 bp, Mus musculus
aactgtagtgcaatctgtactgggc

SEQ ID NO: 503967 - DNA, 25 bp, Mus musculus
aactgtagtgcattctgtactgggc

SEQ ID NO: 503968 - DNA, 25 bp, Mus musculus
aactgtcagacaaggtacctacatg

SEQ ID NO: 503969 - DNA, 25 bp, Mus musculus
aactgtcagacatggtacctacatg

SEQ ID NO: 503970 - DNA, 25 bp, Mus musculus
aactgtcaggatcggcacttagtgg

SEQ ID NO: 503971 - DNA, 25 bp, Mus musculus
aactgtcaggatgggcacttagtgg

SEQ ID NO: 503972 - DNA, 25 bp, Mus musculus
aactgtccaggccactgcagatgac

SEQ ID NO: 503973 - DNA, 25 bp, Mus musculus
aactgtccaggcgactgcagatgac

SEQ ID NO: 503974 - DNA, 25 bp, Mus musculus
aactgtctaagtcagttctccctcg

SEQ ID NO: 503975 - DNA, 25 bp, Mus musculus
aactgtctaagtgagttctccctcg

SEQ ID NO: 503976 - DNA, 25 bp, Mus musculus
aactgtctgatgagagcaattgaga

SEQ ID NO: 503977 - DNA, 25 bp, Mus musculus
aactgtctgatgtgagcaattgaga

SEQ ID NO: 503978 - DNA, 25 bp, Mus musculus
aactgtctggccattagcgcttcat

SEQ ID NO: 503979 - DNA, 25 bp, Mus musculus
aactgtctggcctttagcgcttcat

SEQ ID NO: 503980 - DNA, 25 bp, Mus musculus
aactgtctgggcatcaccttgagag

SEQ ID NO: 503981 - DNA, 25 bp, Mus musculus
aactgtctgggcttcaccttgagag

SEQ ID NO: 503982 - DNA, 25 bp, Mus musculus
aactgtgaaaatataggtctcaatg

SEQ ID NO: 503983 - DNA, 25 bp, Mus musculus
aactgtgaaaatttaggtctcaatg

SEQ ID NO: 503984 - DNA, 25 bp, Mus musculus
aactgtgacttcagtgttcacggca

SEQ ID NO: 503985 - DNA, 25 bp, Mus musculus
aactgtgacttctgtgttcacggca

SEQ ID NO: 503986 - DNA, 25 bp, Mus musculus
aactgtgagtttctaatatcttttc

SEQ ID NO: 503987 - DNA, 25 bp, Mus musculus
aactgtgagtttgtaatatcttttc

SEQ ID NO: 503988 - DNA, 25 bp, Mus musculus
aactgtgatatgacccttgtgaatg

SEQ ID NO: 503989 - DNA, 25 bp, Mus musculus
aactgtgatatgtcccttgtgaatg

SEQ ID NO: 503990 - DNA, 25 bp, Mus musculus
aactgtgcagacattggtgtcctaa

SEQ ID NO: 503991 - DNA, 25 bp, Mus musculus
aactgtgcagactttggtgtcctaa

SEQ ID NO: 503992 - DNA, 25 bp, Mus musculus
aactgtgccggaacaatgaggatca

SEQ ID NO: 503993 - DNA, 25 bp, Mus musculus
aactgtgccggatcaatgaggatca

SEQ ID NO: 503994 - DNA, 25 bp, Mus musculus
aactgtgcggtcatgcacaacctgc

SEQ ID NO: 503995 - DNA, 25 bp, Mus musculus
aactgtgcggtcttgcacaacctgc

SEQ ID NO: 503996 - DNA, 25 bp, Mus musculus
aactgtgcgttgatcctgcaggccc

SEQ ID NO: 503997 - DNA, 25 bp, Mus musculus
aactgtgcgttgttcctgcaggccc

SEQ ID NO: 503998 - DNA, 25 bp, Mus musculus
aactgtgctcaacttggcttatgcc

SEQ ID NO: 503999 - DNA, 25 bp, Mus musculus
aactgtgctcaagttggcttatgcc

SEQ ID NO: 504000 - DNA, 25 bp, Mus musculus
aactgtgggaatctatgatttgcca

SEQ ID NO: 504001 - DNA, 25 bp, Mus musculus
aactgtgggaatgtatgatttgcca

SEQ ID NO: 504002 - DNA, 25 bp, Mus musculus
aactgtgggacaacgtggtgcctac

SEQ ID NO: 504003 - DNA, 25 bp, Mus musculus
aactgtgggacatcgtggtgcctac

SEQ ID NO: 504004 - DNA, 25 bp, Mus musculus
aactgtgggtttacagccattacct

SEQ ID NO: 504005 - DNA, 25 bp, Mus musculus
aactgtgggttttcagccattacct

SEQ ID NO: 504006 - DNA, 25 bp, Mus musculus
aactgttagaaaccagataccatca

SEQ ID NO: 504007 - DNA, 25 bp, Mus musculus
aactgttagaaagcagataccatca

SEQ ID NO: 504008 - DNA, 25 bp, Mus musculus
aactgttagctacatttaggtgtgc

SEQ ID NO: 504009 - DNA, 25 bp, Mus musculus
aactgttagctagatttaggtgtgc

SEQ ID NO: 504010 - DNA, 25 bp, Mus musculus
aactgttcatttccgagggacctgg

SEQ ID NO: 504011 - DNA, 25 bp, Mus musculus
aactgttcatttgcgagggacctgg

SEQ ID NO: 504012 - DNA, 25 bp, Mus musculus
aactgttccctgagtcagtcatcag

SEQ ID NO: 504013 - DNA, 25 bp, Mus musculus
aactgttccctgtgtcagtcatcag

SEQ ID NO: 504014 - DNA, 25 bp, Mus musculus
aactgttctgatcagtttgtctgaa

SEQ ID NO: 504015 - DNA, 25 bp, Mus musculus
aactgttctgatgagtttgtctgaa

SEQ ID NO: 504016 - DNA, 25 bp, Mus musculus
aactgttgcgtcatggagtaccacc

SEQ ID NO: 504017 - DNA, 25 bp, Mus musculus
aactgttgcgtcttggagtaccacc

SEQ ID NO: 504018 - DNA, 25 bp, Mus musculus
aactgttggccacagattctgataa

SEQ ID NO: 504019 - DNA, 25 bp, Mus musculus
aactgttggccagagattctgataa

SEQ ID NO: 504020 - DNA, 25 bp, Mus musculus
aactgtttctcaacagcctgtccca

SEQ ID NO: 504021 - DNA, 25 bp, Mus musculus
aactgtttctcatcagcctgtccca

SEQ ID NO: 504022 - DNA, 25 bp, Mus musculus
aactgtttggatcgtgcaacggatt

SEQ ID NO: 504023 - DNA, 25 bp, Mus musculus
aactgtttggatggtgcaacggatt

SEQ ID NO: 504024 - DNA, 25 bp, Mus musculus
aactgtttggtcagttctgcctgcg

SEQ ID NO: 504025 - DNA, 25 bp, Mus musculus
aactgtttggtctgttctgcctgcg

SEQ ID NO: 504026 - DNA, 25 bp, Mus musculus
aacttaaatgagatggcctggcgcc

SEQ ID NO: 504027 - DNA, 25 bp, Mus musculus
aacttaaatgagttggcctggcgcc

SEQ ID NO: 504028 - DNA, 25 bp, Mus musculus
aacttaatatcaagaccgcggggtc

SEQ ID NO: 504029 - DNA, 25 bp, Mus musculus
aacttaatatcatgaccgcggggtc

SEQ ID NO: 504030 - DNA, 25 bp, Mus musculus
aacttacgattgatccagggactga

SEQ ID NO: 504031 - DNA, 25 bp, Mus musculus
aacttacgattgttccagggactga

SEQ ID NO: 504032 - DNA, 25 bp, Mus musculus
aacttacggaagcacccacgatgga

SEQ ID NO: 504033 - DNA, 25 bp, Mus musculus
aacttacggaaggacccacgatgga

SEQ ID NO: 504034 - DNA, 25 bp, Mus musculus
aacttactacagcatgtgatttcag

SEQ ID NO: 504035 - DNA, 25 bp, Mus musculus
aacttactacaggatgtgatttcag

SEQ ID NO: 504036 - DNA, 25 bp, Mus musculus
aacttactagagctaaaaatgacct

SEQ ID NO: 504037 - DNA, 25 bp, Mus musculus
aacttactagaggtaaaaatgacct

SEQ ID NO: 504038 - DNA, 25 bp, Mus musculus
aacttactgccaaatcatactggtg

SEQ ID NO: 504039 - DNA, 25 bp, Mus musculus
aacttactgccatatcatactggtg

SEQ ID NO: 504040 - DNA, 25 bp, Mus musculus
aacttactgccgataagagactgca

SEQ ID NO: 504041 - DNA, 25 bp, Mus musculus
aacttactgccgttaagagactgca

SEQ ID NO: 504042 - DNA, 25 bp, Mus musculus
aacttagaagaaagtgggtcaggac

SEQ ID NO: 504043 - DNA, 25 bp, Mus musculus
aacttagaagaatgtgggtcaggac

SEQ ID NO: 504044 - DNA, 25 bp, Mus musculus
aacttagatgccaggagccgggaac

SEQ ID NO: 504045 - DNA, 25 bp, Mus musculus
aacttagatgcctggagccgggaac

SEQ ID NO: 504046 - DNA, 25 bp, Mus musculus
aacttaggagaaaagctaacagatg

SEQ ID NO: 504047 - DNA, 25 bp, Mus musculus
aacttaggagaatagctaacagatg

SEQ ID NO: 504048 - DNA, 25 bp, Mus musculus
aacttagtccgtacccattcttcag

SEQ ID NO: 504049 - DNA, 25 bp, Mus musculus
aacttagtccgttcccattcttcag

SEQ ID NO: 504050 - DNA, 25 bp, Mus musculus
aacttatccaaacctgtggctggta

SEQ ID NO: 504051 - DNA, 25 bp, Mus musculus
aacttatccaaagctgtggctggta

SEQ ID NO: 504052 - DNA, 25 bp, Mus musculus
aacttatcgctcagaaagttcgagg

SEQ ID NO: 504053 - DNA, 25 bp, Mus musculus
aacttatcgctctgaaagttcgagg

SEQ ID NO: 504054 - DNA, 25 bp, Mus musculus
aacttatgaggacgacccagccatg

SEQ ID NO: 504055 - DNA, 25 bp, Mus musculus
aacttatgaggaggacccagccatg

SEQ ID NO: 504056 - DNA, 25 bp, Mus musculus
aacttatggagaacattggagcaat

SEQ ID NO: 504057 - DNA, 25 bp, Mus musculus
aacttatggagatcattggagcaat

SEQ ID NO: 504058 - DNA, 25 bp, Mus musculus
aacttcaaacgtaccaagagtgagg

SEQ ID NO: 504059 - DNA, 25 bp, Mus musculus
aacttcaaacgttccaagagtgagg

SEQ ID NO: 504060 - DNA, 25 bp, Mus musculus
aacttcaagcacatcgtcacgcggg

SEQ ID NO: 504061 - DNA, 25 bp, Mus musculus
aacttcaagcacttcgtcacgcggg

SEQ ID NO: 504062 - DNA, 25 bp, Mus musculus
aacttcaagcagctggatgacctgg

SEQ ID NO: 504063 - DNA, 25 bp, Mus musculus
aacttcaagcaggtggatgacctgg

SEQ ID NO: 504064 - DNA, 25 bp, Mus musculus
aacttcaatgagagtgtcatgtacc

SEQ ID NO: 504065 - DNA, 25 bp, Mus musculus
aacttcaatgagtgtgtcatgtacc

SEQ ID NO: 504066 - DNA, 25 bp, Mus musculus
aacttcaattttctgggtatgcaca

SEQ ID NO: 504067 - DNA, 25 bp, Mus musculus
aacttcaattttgtgggtatgcaca

SEQ ID NO: 504068 - DNA, 25 bp, Mus musculus
aacttcacactgatccccgagggag

SEQ ID NO: 504069 - DNA, 25 bp, Mus musculus
aacttcacactgttccccgagggag

SEQ ID NO: 504070 - DNA, 25 bp, Mus musculus
aacttcacagtaagagacaacagag

SEQ ID NO: 504071 - DNA, 25 bp, Mus musculus
aacttcacagtatgagacaacagag

SEQ ID NO: 504072 - DNA, 25 bp, Mus musculus
aacttcaccacgacctggcgcaatg

SEQ ID NO: 504073 - DNA, 25 bp, Mus musculus
aacttcaccacgtcctggcgcaatg

SEQ ID NO: 504074 - DNA, 25 bp, Mus musculus
aacttcacccacatcatcgtggtca

SEQ ID NO: 504075 - DNA, 25 bp, Mus musculus
aacttcacccacttcatcgtggtca

SEQ ID NO: 504076 - DNA, 25 bp, Mus musculus
aacttcacccggattctggagtacg

SEQ ID NO: 504077 - DNA, 25 bp, Mus musculus
aacttcacccggtttctggagtacg

SEQ ID NO: 504078 - DNA, 25 bp, Mus musculus
aacttcaccgtactcatcaagaata

SEQ ID NO: 504079 - DNA, 25 bp, Mus musculus
aacttcaccgtagtcatcaagaata

SEQ ID NO: 504080 - DNA, 25 bp, Mus musculus
aacttcacggtgagccaccctacag

SEQ ID NO: 504081 - DNA, 25 bp, Mus musculus
aacttcacggtgtgccaccctacag

SEQ ID NO: 504082 - DNA, 25 bp, Mus musculus
aacttcactgccacgggagaggcag

SEQ ID NO: 504083 - DNA, 25 bp, Mus musculus
aacttcactgcctcgggagaggcag

SEQ ID NO: 504084 - DNA, 25 bp, Mus musculus
aacttcagagcacagtgtccaatct

SEQ ID NO: 504085 - DNA, 25 bp, Mus musculus
aacttcagagcagagtgtccaatct

SEQ ID NO: 504086 - DNA, 25 bp, Mus musculus
aacttcagagccaaacatcactgta

SEQ ID NO: 504087 - DNA, 25 bp, Mus musculus
aacttcagagccctatgcactggtg

SEQ ID NO: 504088 - DNA, 25 bp, Mus musculus
aacttcagagccgtatgcactggtg

SEQ ID NO: 504089 - DNA, 25 bp, Mus musculus
aacttcagagcctaacatcactgta

SEQ ID NO: 504090 - DNA, 25 bp, Mus musculus
aacttcagcaaaaatcagctgtgcg

SEQ ID NO: 504091 - DNA, 25 bp, Mus musculus
aacttcagcaaatatcagctgtgcg

SEQ ID NO: 504092 - DNA, 25 bp, Mus musculus
aacttcagcaacagcagccgacagg

SEQ ID NO: 504093 - DNA, 25 bp, Mus musculus
aacttcagcaactgcagccgacagg

SEQ ID NO: 504094 - DNA, 25 bp, Mus musculus
aacttcaggagcagttgaagacaac

SEQ ID NO: 504095 - DNA, 25 bp, Mus musculus
aacttcaggagctgttgaagacaac

SEQ ID NO: 504096 - DNA, 25 bp, Mus musculus
aacttcatagctccctgcacagaga

SEQ ID NO: 504097 - DNA, 25 bp, Mus musculus
aacttcatagctgcctgcacagaga

SEQ ID NO: 504098 - DNA, 25 bp, Mus musculus
aacttcatcatgcaaggtggagcca

SEQ ID NO: 504099 - DNA, 25 bp, Mus musculus
aacttcatcatggaaggtggagcca

SEQ ID NO: 504100 - DNA, 25 bp, Mus musculus
aacttcatgcctccatcctacattg

SEQ ID NO: 504101 - DNA, 25 bp, Mus musculus
aacttcatgcctgcatcctacattg

SEQ ID NO: 504102 - DNA, 25 bp, Mus musculus
aacttcatgggccatgagtggtttg

SEQ ID NO: 504103 - DNA, 25 bp, Mus musculus
aacttcatgggcgatgagtggtttg

SEQ ID NO: 504104 - DNA, 25 bp, Mus musculus
aacttccagactctgtgaatgcccg

SEQ ID NO: 504105 - DNA, 25 bp, Mus musculus
aacttccagactgtgtgaatgcccg

SEQ ID NO: 504106 - DNA, 25 bp, Mus musculus
aacttccaggtaatgaaagggtgat

SEQ ID NO: 504107 - DNA, 25 bp, Mus musculus
aacttccaggtattgaaagggtgat

SEQ ID NO: 504108 - DNA, 25 bp, Mus musculus
aacttccatggtcaatacccagcca

SEQ ID NO: 504109 - DNA, 25 bp, Mus musculus
aacttccatggtgaatacccagcca

SEQ ID NO: 504110 - DNA, 25 bp, Mus musculus
aacttccctggtcactacaaatgca

SEQ ID NO: 504111 - DNA, 25 bp, Mus musculus
aacttccctggtgactacaaatgca

SEQ ID NO: 504112 - DNA, 25 bp, Mus musculus
aacttcctattgaggatggccttga

SEQ ID NO: 504113 - DNA, 25 bp, Mus musculus
aacttcctattgtggatggccttga

SEQ ID NO: 504114 - DNA, 25 bp, Mus musculus
aacttcctcaagacccttcacgaga

SEQ ID NO: 504115 - DNA, 25 bp, Mus musculus
aacttcctcaagtcccttcacgaga

SEQ ID NO: 504116 - DNA, 25 bp, Mus musculus
aacttcctcagcaacgtggtcatga

SEQ ID NO: 504117 - DNA, 25 bp, Mus musculus
aacttcctcagctacgtggtcatga

SEQ ID NO: 504118 - DNA, 25 bp, Mus musculus
aacttcctgggcatgccaaagggca

SEQ ID NO: 504119 - DNA, 25 bp, Mus musculus
aacttcctgggcttgccaaagggca

SEQ ID NO: 504120 - DNA, 25 bp, Mus musculus
aacttccttcgcctgggccgtctgg

SEQ ID NO: 504121 - DNA, 25 bp, Mus musculus
aacttccttcgcgtgggccgtctgg

SEQ ID NO: 504122 - DNA, 25 bp, Mus musculus
aacttcgacactcacaagaagtggg

SEQ ID NO: 504123 - DNA, 25 bp, Mus musculus
aacttcgacactgacaagaagtggg

SEQ ID NO: 504124 - DNA, 25 bp, Mus musculus
aacttcgactcgcaggagcggagta

SEQ ID NO: 504125 - DNA, 25 bp, Mus musculus
aacttcgactcggaggagcggagta

SEQ ID NO: 504126 - DNA, 25 bp, Mus musculus
aacttcgcctgcagtgggatctgct

SEQ ID NO: 504127 - DNA, 25 bp, Mus musculus
aacttcgcctgctgtgggatctgct

SEQ ID NO: 504128 - DNA, 25 bp, Mus musculus
aacttcgcctttagatgttggctcg

SEQ ID NO: 504129 - DNA, 25 bp, Mus musculus
aacttcgccttttgatgttggctcg

SEQ ID NO: 504130 - DNA, 25 bp, Mus musculus
aacttcggcatccttctgggcgtgt

SEQ ID NO: 504131 - DNA, 25 bp, Mus musculus
aacttcggcatcgttctgggcgtgt

SEQ ID NO: 504132 - DNA, 25 bp, Mus musculus
aacttcggcctcatgtatgatttga

SEQ ID NO: 504133 - DNA, 25 bp, Mus musculus
aacttcggcctcttgtatgatttga

SEQ ID NO: 504134 - DNA, 25 bp, Mus musculus
aacttcgtctggcagcgcgttcgga

SEQ ID NO: 504135 - DNA, 25 bp, Mus musculus
aacttcgtctgggagcgcgttcgga

SEQ ID NO: 504136 - DNA, 25 bp, Mus musculus
aacttcgtgaagctgctgcacacct

SEQ ID NO: 504137 - DNA, 25 bp, Mus musculus
aacttcgtgaaggtgctgcacacct

SEQ ID NO: 504138 - DNA, 25 bp, Mus musculus
aacttcgttagacgctctcagcagg

SEQ ID NO: 504139 - DNA, 25 bp, Mus musculus
aacttcgttagaggctctcagcagg

SEQ ID NO: 504140 - DNA, 25 bp, Mus musculus
aacttctatgaactgagccctcaca

SEQ ID NO: 504141 - DNA, 25 bp, Mus musculus
aacttctatgaagtgagccctcaca

SEQ ID NO: 504142 - DNA, 25 bp, Mus musculus
aacttctatggacgcaacggcatcg

SEQ ID NO: 504143 - DNA, 25 bp, Mus musculus
aacttctatggaggcaacggcatcg

SEQ ID NO: 504144 - DNA, 25 bp, Mus musculus
aacttctctatacccgaaaagaagg

SEQ ID NO: 504145 - DNA, 25 bp, Mus musculus
aacttctctatagccgaaaagaagg

SEQ ID NO: 504146 - DNA, 25 bp, Mus musculus
aacttctctccgaagagcgtagcga

SEQ ID NO: 504147 - DNA, 25 bp, Mus musculus
aacttctctccgtagagcgtagcga

SEQ ID NO: 504148 - DNA, 25 bp, Mus musculus
aacttctgcaatagcaacaaacggg

SEQ ID NO: 504149 - DNA, 25 bp, Mus musculus
aacttctgcaattgcaacaaacggg

SEQ ID NO: 504150 - DNA, 25 bp, Mus musculus
aacttctgcaggagtgactgaactc

SEQ ID NO: 504151 - DNA, 25 bp, Mus musculus
aacttctgcaggtgtgactgaactc

SEQ ID NO: 504152 - DNA, 25 bp, Mus musculus
aacttctggagaccgcctattgcca

SEQ ID NO: 504153 - DNA, 25 bp, Mus musculus
aacttctggagagcgcctattgcca

SEQ ID NO: 504154 - DNA, 25 bp, Mus musculus
aacttcttcactcgcgaggtgggcg

SEQ ID NO: 504155 - DNA, 25 bp, Mus musculus
aacttcttcactggcgaggtgggcg

SEQ ID NO: 504156 - DNA, 25 bp, Mus musculus
aacttcttcgggactattctgctga

SEQ ID NO: 504157 - DNA, 25 bp, Mus musculus
aacttcttcgggtctattctgctga

SEQ ID NO: 504158 - DNA, 25 bp, Mus musculus
aacttcttgagtagagaggataaaa

SEQ ID NO: 504159 - DNA, 25 bp, Mus musculus
aacttcttgagttgagaggataaaa

SEQ ID NO: 504160 - DNA, 25 bp, Mus musculus
aacttcttgcgccagcggctggtcc

SEQ ID NO: 504161 - DNA, 25 bp, Mus musculus
aacttcttgcgcgagcggctggtcc

SEQ ID NO: 504162 - DNA, 25 bp, Mus musculus
aacttgaaagtgagctgtctcaggc

SEQ ID NO: 504163 - DNA, 25 bp, Mus musculus
aacttgaaagtgtgctgtctcaggc

SEQ ID NO: 504164 - DNA, 25 bp, Mus musculus
aacttgaagatcatcccatactgaa

SEQ ID NO: 504165 - DNA, 25 bp, Mus musculus
aacttgaagatcttcccatactgaa

SEQ ID NO: 504166 - DNA, 25 bp, Mus musculus
aacttgacgggcatcgtggcctaca

SEQ ID NO: 504167 - DNA, 25 bp, Mus musculus
aacttgacgggcttcgtggcctaca

SEQ ID NO: 504168 - DNA, 25 bp, Mus musculus
aacttgacttctcctaccacggaga

SEQ ID NO: 504169 - DNA, 25 bp, Mus musculus
aacttgacttctgctaccacggaga

SEQ ID NO: 504170 - DNA, 25 bp, Mus musculus
aacttgagacaaagtcgatgctagc

SEQ ID NO: 504171 - DNA, 25 bp, Mus musculus
aacttgagacaatgtcgatgctagc

SEQ ID NO: 504172 - DNA, 25 bp, Mus musculus
aacttgaggcgtaacaatgaagcca

SEQ ID NO: 504173 - DNA, 25 bp, Mus musculus
aacttgaggcgttacaatgaagcca

SEQ ID NO: 504174 - DNA, 25 bp, Mus musculus
aacttgataaatcacacgatggagc

SEQ ID NO: 504175 - DNA, 25 bp, Mus musculus
aacttgataaatgacacgatggagc

SEQ ID NO: 504176 - DNA, 25 bp, Mus musculus
aacttgatgggaccttgcgtctttg

SEQ ID NO: 504177 - DNA, 25 bp, Mus musculus
aacttgatgggagcttgcgtctttg

SEQ ID NO: 504178 - DNA, 25 bp, Mus musculus
aacttgatgtgccatggctgctgcc

SEQ ID NO: 504179 - DNA, 25 bp, Mus musculus
aacttgatgtgcgatggctgctgcc

SEQ ID NO: 504180 - DNA, 25 bp, Mus musculus
aacttgcacagtcacatcatctggg

SEQ ID NO: 504181 - DNA, 25 bp, Mus musculus
aacttgcacagtgacatcatctggg

SEQ ID NO: 504182 - DNA, 25 bp, Mus musculus
aacttgcactgaaggcagaaaaaga

SEQ ID NO: 504183 - DNA, 25 bp, Mus musculus
aacttgcactgatggcagaaaaaga

SEQ ID NO: 504184 - DNA, 25 bp, Mus musculus
aacttgcagaagagccttggaccca

SEQ ID NO: 504185 - DNA, 25 bp, Mus musculus
aacttgcagaagtgccttggaccca

SEQ ID NO: 504186 - DNA, 25 bp, Mus musculus
aacttgcagagtagttgggatagtc

SEQ ID NO: 504187 - DNA, 25 bp, Mus musculus
aacttgcagagttgttgggatagtc

SEQ ID NO: 504188 - DNA, 25 bp, Mus musculus
aacttgcaggtgaaaatgaataagc

SEQ ID NO: 504189 - DNA, 25 bp, Mus musculus
aacttgcaggtgtaaatgaataagc

SEQ ID NO: 504190 - DNA, 25 bp, Mus musculus
aacttgcagtgtcagcgtatcttcc

SEQ ID NO: 504191 - DNA, 25 bp, Mus musculus
aacttgcagtgtgagcgtatcttcc

SEQ ID NO: 504192 - DNA, 25 bp, Mus musculus
aacttgcatcgtcgcagtcattgag

SEQ ID NO: 504193 - DNA, 25 bp, Mus musculus
aacttgcatcgtggcagtcattgag

SEQ ID NO: 504194 - DNA, 25 bp, Mus musculus
aacttgccagcgctgcttctgcagc

SEQ ID NO: 504195 - DNA, 25 bp, Mus musculus
aacttgccagcggtgcttctgcagc

SEQ ID NO: 504196 - DNA, 25 bp, Mus musculus
aacttgcccctgagaagaagggagg

SEQ ID NO: 504197 - DNA, 25 bp, Mus musculus
aacttgcccctgtgaagaagggagg

SEQ ID NO: 504198 - DNA, 25 bp, Mus musculus
aacttgcctgggatatgctggattt

SEQ ID NO: 504199 - DNA, 25 bp, Mus musculus
aacttgcctgggttatgctggattt

SEQ ID NO: 504200 - DNA, 25 bp, Mus musculus
aacttgcgatgtagctaagggatgg

SEQ ID NO: 504201 - DNA, 25 bp, Mus musculus
aacttgcgatgttgctaagggatgg

SEQ ID NO: 504202 - DNA, 25 bp, Mus musculus
aacttgctctgcatgggcccagagc

SEQ ID NO: 504203 - DNA, 25 bp, Mus musculus
aacttgctctgcttgggcccagagc

SEQ ID NO: 504204 - DNA, 25 bp, Mus musculus
aacttgctgatgatgggagaccctg

SEQ ID NO: 504205 - DNA, 25 bp, Mus musculus
aacttgctgatgttgggagaccctg

SEQ ID NO: 504206 - DNA, 25 bp, Mus musculus
aacttgctgtgcaagtcggttccaa

SEQ ID NO: 504207 - DNA, 25 bp, Mus musculus
aacttgctgtgctagtcggttccaa

SEQ ID NO: 504208 - DNA, 25 bp, Mus musculus
aacttgctttagagaagagcatgca

SEQ ID NO: 504209 - DNA, 25 bp, Mus musculus
aacttgctttagtgaagagcatgca

SEQ ID NO: 504210 - DNA, 25 bp, Mus musculus
aacttgcttttcagtgtccctccaa

SEQ ID NO: 504211 - DNA, 25 bp, Mus musculus
aacttgcttttctgtgtccctccaa

SEQ ID NO: 504212 - DNA, 25 bp, Mus musculus
aacttggaactcagggacaaataga

SEQ ID NO: 504213 - DNA, 25 bp, Mus musculus
aacttggaactctgggacaaataga

SEQ ID NO: 504214 - DNA, 25 bp, Mus musculus
aacttggaagtgaggcgaagcctca

SEQ ID NO: 504215 - DNA, 25 bp, Mus musculus
aacttggaagtgtggcgaagcctca

SEQ ID NO: 504216 - DNA, 25 bp, Mus musculus
aacttggaccctactcactgcagca

SEQ ID NO: 504217 - DNA, 25 bp, Mus musculus
aacttggacccttctcactgcagca

SEQ ID NO: 504218 - DNA, 25 bp, Mus musculus
aacttggacgtaatgccttgggctc

SEQ ID NO: 504219 - DNA, 25 bp, Mus musculus
aacttggacgtattgccttgggctc

SEQ ID NO: 504220 - DNA, 25 bp, Mus musculus
aacttggagaaccacctgcttctgc

SEQ ID NO: 504221 - DNA, 25 bp, Mus musculus
aacttggagaacgacctgcttctgc

SEQ ID NO: 504222 - DNA, 25 bp, Mus musculus
aacttggagcagagaagggcctcct

SEQ ID NO: 504223 - DNA, 25 bp, Mus musculus
aacttggagcagtgaagggcctcct

SEQ ID NO: 504224 - DNA, 25 bp, Mus musculus
aacttggatatcagcccacagcggc

SEQ ID NO: 504225 - DNA, 25 bp, Mus musculus
aacttggatatctgcccacagcggc

SEQ ID NO: 504226 - DNA, 25 bp, Mus musculus
aacttggcagagctgttcaagggca

SEQ ID NO: 504227 - DNA, 25 bp, Mus musculus
aacttggcagaggtgttcaagggca

SEQ ID NO: 504228 - DNA, 25 bp, Mus musculus
aacttggcagctccttggactggga

SEQ ID NO: 504229 - DNA, 25 bp, Mus musculus
aacttggcagctgcttggactggga

SEQ ID NO: 504230 - DNA, 25 bp, Mus musculus
aacttggcctccacgccttgatcaa

SEQ ID NO: 504231 - DNA, 25 bp, Mus musculus
aacttggcctcctcgccttgatcaa

SEQ ID NO: 504232 - DNA, 25 bp, Mus musculus
aacttggcgctgatgagttccccag

SEQ ID NO: 504233 - DNA, 25 bp, Mus musculus
aacttggcgctgttgagttccccag

SEQ ID NO: 504234 - DNA, 25 bp, Mus musculus
aacttggcttgtcccttgcaaacat

SEQ ID NO: 504235 - DNA, 25 bp, Mus musculus
aacttggcttgtgccttgcaaacat

SEQ ID NO: 504236 - DNA, 25 bp, Mus musculus
aacttgggcaagctcaagcataagc

SEQ ID NO: 504237 - DNA, 25 bp, Mus musculus
aacttgggcaaggtcaagcataagc

SEQ ID NO: 504238 - DNA, 25 bp, Mus musculus
aacttgggcttcacgggcaagttct

SEQ ID NO: 504239 - DNA, 25 bp, Mus musculus
aacttgggcttctcgggcaagttct

SEQ ID NO: 504240 - DNA, 25 bp, Mus musculus
aacttgggtactccgtgtgtgtgcc

SEQ ID NO: 504241 - DNA, 25 bp, Mus musculus
aacttgggtactgcgtgtgtgtgcc

SEQ ID NO: 504242 - DNA, 25 bp, Mus musculus
aacttgggtgctcctcagtctgtga

SEQ ID NO: 504243 - DNA, 25 bp, Mus musculus
aacttgggtgctgctcagtctgtga

SEQ ID NO: 504244 - DNA, 25 bp, Mus musculus
aacttggtcttcatggatctggtgg

SEQ ID NO: 504245 - DNA, 25 bp, Mus musculus
aacttggtcttcttggatctggtgg

SEQ ID NO: 504246 - DNA, 25 bp, Mus musculus
aacttggtgcctaagcctgcaccac

SEQ ID NO: 504247 - DNA, 25 bp, Mus musculus
aacttggtgccttagcctgcaccac

SEQ ID NO: 504248 - DNA, 25 bp, Mus musculus
aacttgtaaatcacatccgcgtgca

SEQ ID NO: 504249 - DNA, 25 bp, Mus musculus
aacttgtaaatctcatccgcgtgca

SEQ ID NO: 504250 - DNA, 25 bp, Mus musculus
aacttgtaccaccagctgatgaagc

SEQ ID NO: 504251 - DNA, 25 bp, Mus musculus
aacttgtaccacgagctgatgaagc

SEQ ID NO: 504252 - DNA, 25 bp, Mus musculus
aacttgtataaaagcctgagtgaag

SEQ ID NO: 504253 - DNA, 25 bp, Mus musculus
aacttgtataaatgcctgagtgaag

SEQ ID NO: 504254 - DNA, 25 bp, Mus musculus
aacttgtattacctgtccctgggca

SEQ ID NO: 504255 - DNA, 25 bp, Mus musculus
aacttgtattacgtgtccctgggca

SEQ ID NO: 504256 - DNA, 25 bp, Mus musculus
aacttgtcacaaacgccagtgctta

SEQ ID NO: 504257 - DNA, 25 bp, Mus musculus
aacttgtcacaatcgccagtgctta

SEQ ID NO: 504258 - DNA, 25 bp, Mus musculus
aacttgtcagaaaaccttacacgaa

SEQ ID NO: 504259 - DNA, 25 bp, Mus musculus
aacttgtcagaataccttacacgaa

SEQ ID NO: 504260 - DNA, 25 bp, Mus musculus
aacttgtgaccaacattcgcagcgg

SEQ ID NO: 504261 - DNA, 25 bp, Mus musculus
aacttgtgaccatcattcgcagcgg

SEQ ID NO: 504262 - DNA, 25 bp, Mus musculus
aacttgttcctaccgttctgcatca

SEQ ID NO: 504263 - DNA, 25 bp, Mus musculus
aacttgttcctagcgttctgcatca

SEQ ID NO: 504264 - DNA, 25 bp, Mus musculus
aactttagcaaaacagcaccactgg

SEQ ID NO: 504265 - DNA, 25 bp, Mus musculus
aactttagcaaatcagcaccactgg

SEQ ID NO: 504266 - DNA, 25 bp, Mus musculus
aactttatgaggatgtatgatgcct

SEQ ID NO: 504267 - DNA, 25 bp, Mus musculus
aactttatgaggttgtatgatgcct

SEQ ID NO: 504268 - DNA, 25 bp, Mus musculus
aactttattgctacctggacaccga

SEQ ID NO: 504269 - DNA, 25 bp, Mus musculus
aactttattgcttcctggacaccga

SEQ ID NO: 504270 - DNA, 25 bp, Mus musculus
aactttcaaggacatttactcacag

SEQ ID NO: 504271 - DNA, 25 bp, Mus musculus
aactttcaaggagatttactcacag

SEQ ID NO: 504272 - DNA, 25 bp, Mus musculus
aactttcacaggctgccaatggctg

SEQ ID NO: 504273 - DNA, 25 bp, Mus musculus
aactttcacagggtgccaatggctg

SEQ ID NO: 504274 - DNA, 25 bp, Mus musculus
aactttccagaacgctcggtgggtg

SEQ ID NO: 504275 - DNA, 25 bp, Mus musculus
aactttccagaaggctcggtgggtg

SEQ ID NO: 504276 - DNA, 25 bp, Mus musculus
aactttcggctaaggtacatctatc

SEQ ID NO: 504277 - DNA, 25 bp, Mus musculus
aactttcggctatggtacatctatc

SEQ ID NO: 504278 - DNA, 25 bp, Mus musculus
aactttctggaactcgactagacct

SEQ ID NO: 504279 - DNA, 25 bp, Mus musculus
aactttctggaagtcgactagacct

SEQ ID NO: 504280 - DNA, 25 bp, Mus musculus
aactttctgtgcctttgggacagtt

SEQ ID NO: 504281 - DNA, 25 bp, Mus musculus
aactttctgtgcgtttgggacagtt

SEQ ID NO: 504282 - DNA, 25 bp, Mus musculus
aactttgacaccagtctgccaacct

SEQ ID NO: 504283 - DNA, 25 bp, Mus musculus
aactttgacacccttgtggataaca

SEQ ID NO: 504284 - DNA, 25 bp, Mus musculus
aactttgacaccgttgtggataaca

SEQ ID NO: 504285 - DNA, 25 bp, Mus musculus
aactttgacacctgtctgccaacct

SEQ ID NO: 504286 - DNA, 25 bp, Mus musculus
aactttgacagaagctaggagtcca

SEQ ID NO: 504287 - DNA, 25 bp, Mus musculus
aactttgacagatgctaggagtcca

SEQ ID NO: 504288 - DNA, 25 bp, Mus musculus
aactttgactatcatgttctgcatg

SEQ ID NO: 504289 - DNA, 25 bp, Mus musculus
aactttgactatgatgttctgcatg

SEQ ID NO: 504290 - DNA, 25 bp, Mus musculus
aactttgactccatctacatctgcc

SEQ ID NO: 504291 - DNA, 25 bp, Mus musculus
aactttgactccttctacatctgcc

SEQ ID NO: 504292 - DNA, 25 bp, Mus musculus
aactttgagaaaatggggatcggcg

SEQ ID NO: 504293 - DNA, 25 bp, Mus musculus
aactttgagaaattggggatcggcg

SEQ ID NO: 504294 - DNA, 25 bp, Mus musculus
aactttgagcggcccgcggaactgc

SEQ ID NO: 504295 - DNA, 25 bp, Mus musculus
aactttgagcgggccgcggaactgc

SEQ ID NO: 504296 - DNA, 25 bp, Mus musculus
aactttgagtgtcccctgtctatgt

SEQ ID NO: 504297 - DNA, 25 bp, Mus musculus
aactttgagtgtgccctgtctatgt

SEQ ID NO: 504298 - DNA, 25 bp, Mus musculus
aactttgatgatcagatattctggg

SEQ ID NO: 504299 - DNA, 25 bp, Mus musculus
aactttgatgatgagatattctggg

SEQ ID NO: 504300 - DNA, 25 bp, Mus musculus
aactttgcaaggatttgtgcctatg

SEQ ID NO: 504301 - DNA, 25 bp, Mus musculus
aactttgcaaggttttgtgcctatg

SEQ ID NO: 504302 - DNA, 25 bp, Mus musculus
aactttggagagcagggcatcaccg

SEQ ID NO: 504303 - DNA, 25 bp, Mus musculus
aactttggagaggagggcatcaccg

SEQ ID NO: 504304 - DNA, 25 bp, Mus musculus
aactttgggcctctttggaggcagc

SEQ ID NO: 504305 - DNA, 25 bp, Mus musculus
aactttgggcctgtttggaggcagc

SEQ ID NO: 504306 - DNA, 25 bp, Mus musculus
aactttgtgacactcccaccaggag

SEQ ID NO: 504307 - DNA, 25 bp, Mus musculus
aactttgtgacagtcccaccaggag

SEQ ID NO: 504308 - DNA, 25 bp, Mus musculus
aactttgtgtcaccgtgcagtccat

SEQ ID NO: 504309 - DNA, 25 bp, Mus musculus
aactttgtgtcagcgtgcagtccat

SEQ ID NO: 504310 - DNA, 25 bp, Mus musculus
aactttgtttgtctggcacaaggac

SEQ ID NO: 504311 - DNA, 25 bp, Mus musculus
aactttgtttgtgtggcacaaggac

SEQ ID NO: 504312 - DNA, 25 bp, Mus musculus
aacttttaatgcatctctagtacag

SEQ ID NO: 504313 - DNA, 25 bp, Mus musculus
aacttttaatgcttctctagtacag

SEQ ID NO: 504314 - DNA, 25 bp, Mus musculus
aacttttcagtgaactacagtgaag

SEQ ID NO: 504315 - DNA, 25 bp, Mus musculus
aacttttcagtgtactacagtgaag

SEQ ID NO: 504316 - DNA, 25 bp, Mus musculus
aacttttcgaggatattctcagcag

SEQ ID NO: 504317 - DNA, 25 bp, Mus musculus
aacttttcgaggttattctcagcag

SEQ ID NO: 504318 - DNA, 25 bp, Mus musculus
aacttttgcggcagaggctccctgc

SEQ ID NO: 504319 - DNA, 25 bp, Mus musculus
aacttttgcggctgaggctccctgc

SEQ ID NO: 504320 - DNA, 25 bp, Mus musculus
aacttttggcaaaagagctgataaa

SEQ ID NO: 504321 - DNA, 25 bp, Mus musculus
aacttttggcaatagagctgataaa

SEQ ID NO: 504322 - DNA, 25 bp, Mus musculus
aacttttgtcacagaagccaaaggg

SEQ ID NO: 504323 - DNA, 25 bp, Mus musculus
aacttttgtcactgaagccaaaggg

SEQ ID NO: 504324 - DNA, 25 bp, Mus musculus
aactttttcaccatcggctgcctct

SEQ ID NO: 504325 - DNA, 25 bp, Mus musculus
aactttttcaccttcggctgcctct

SEQ ID NO: 504326 - DNA, 25 bp, Mus musculus
aagaaaaactggacactattgctaa

SEQ ID NO: 504327 - DNA, 25 bp, Mus musculus
aagaaaaactggtcactattgctaa

SEQ ID NO: 504328 - DNA, 25 bp, Mus musculus
aagaaaaagaaccacatctgtcagc

SEQ ID NO: 504329 - DNA, 25 bp, Mus musculus
aagaaaaagaacgacatctgtcagc

SEQ ID NO: 504330 - DNA, 25 bp, Mus musculus
aagaaaaaggtcagggtcagagaga

SEQ ID NO: 504331 - DNA, 25 bp, Mus musculus
aagaaaaaggtctgggtcagagaga

SEQ ID NO: 504332 - DNA, 25 bp, Mus musculus
aagaaaaatgccagttgctcagtca

SEQ ID NO: 504333 - DNA, 25 bp, Mus musculus
aagaaaaatgcctgttgctcagtca

SEQ ID NO: 504334 - DNA, 25 bp, Mus musculus
aagaaaacaagtcaccccaatagag

SEQ ID NO: 504335 - DNA, 25 bp, Mus musculus
aagaaaacaagtgaccccaatagag

SEQ ID NO: 504336 - DNA, 25 bp, Mus musculus
aagaaaaccaaaccagcagctcatt

SEQ ID NO: 504337 - DNA, 25 bp, Mus musculus
aagaaaaccaaagcagcagctcatt

SEQ ID NO: 504338 - DNA, 25 bp, Mus musculus
aagaaaacgcgacgtgccgacaagc

SEQ ID NO: 504339 - DNA, 25 bp, Mus musculus
aagaaaacgcgaggtgccgacaagc

SEQ ID NO: 504340 - DNA, 25 bp, Mus musculus
aagaaaagaaacctgctgttggcgt

SEQ ID NO: 504341 - DNA, 25 bp, Mus musculus
aagaaaagaaacgtgctgttggcgt

SEQ ID NO: 504342 - DNA, 25 bp, Mus musculus
aagaaaagccccacgtgtgccagtt

SEQ ID NO: 504343 - DNA, 25 bp, Mus musculus
aagaaaagcccctcgtgtgccagtt

SEQ ID NO: 504344 - DNA, 25 bp, Mus musculus
aagaaaaggccgaagcctgtgccag

SEQ ID NO: 504345 - DNA, 25 bp, Mus musculus
aagaaaaggccgagcagcggaagaa

SEQ ID NO: 504346 - DNA, 25 bp, Mus musculus
aagaaaaggccgtagcctgtgccag

SEQ ID NO: 504347 - DNA, 25 bp, Mus musculus
aagaaaaggccgtgcagcggaagaa

SEQ ID NO: 504348 - DNA, 25 bp, Mus musculus
aagaaaagtttgctatggtggcacc

SEQ ID NO: 504349 - DNA, 25 bp, Mus musculus
aagaaaagtttggtatggtggcacc

SEQ ID NO: 504350 - DNA, 25 bp, Mus musculus
aagaaaatgggcctatgtgggctac

SEQ ID NO: 504351 - DNA, 25 bp, Mus musculus
aagaaaatgggcgtatgtgggctac

SEQ ID NO: 504352 - DNA, 25 bp, Mus musculus
aagaaaattgagaaacggcgtcagg

SEQ ID NO: 504353 - DNA, 25 bp, Mus musculus
aagaaaattgagtaacggcgtcagg

SEQ ID NO: 504354 - DNA, 25 bp, Mus musculus
aagaaacaaaaccagactgagctta

SEQ ID NO: 504355 - DNA, 25 bp, Mus musculus
aagaaacaaaacgagactgagctta

SEQ ID NO: 504356 - DNA, 25 bp, Mus musculus
aagaaacaagtcaggaacgatccct

SEQ ID NO: 504357 - DNA, 25 bp, Mus musculus
aagaaacaagtctggaacgatccct

SEQ ID NO: 504358 - DNA, 25 bp, Mus musculus
aagaaacagcctcagcctccaggtg

SEQ ID NO: 504359 - DNA, 25 bp, Mus musculus
aagaaacagcctgagcctccaggtg

SEQ ID NO: 504360 - DNA, 25 bp, Mus musculus
aagaaacatgtgaacctgggtgaca

SEQ ID NO: 504361 - DNA, 25 bp, Mus musculus
aagaaacatgtgtacctgggtgaca

SEQ ID NO: 504362 - DNA, 25 bp, Mus musculus
aagaaaccaagcaggcactgggctg

SEQ ID NO: 504363 - DNA, 25 bp, Mus musculus
aagaaaccaagctggcactgggctg

SEQ ID NO: 504364 - DNA, 25 bp, Mus musculus
aagaaaccacaaaggctccatgctg

SEQ ID NO: 504365 - DNA, 25 bp, Mus musculus
aagaaaccacaatggctccatgctg

SEQ ID NO: 504366 - DNA, 25 bp, Mus musculus
aagaaaccatgccaaagaagccgga

SEQ ID NO: 504367 - DNA, 25 bp, Mus musculus
aagaaaccatgcgaaagaagccgga

SEQ ID NO: 504368 - DNA, 25 bp, Mus musculus
aagaaacctccaagtgccacacgta

SEQ ID NO: 504369 - DNA, 25 bp, Mus musculus
aagaaacctccatgtgccacacgta

SEQ ID NO: 504370 - DNA, 25 bp, Mus musculus
aagaaacctcgaaaatctccaggag

SEQ ID NO: 504371 - DNA, 25 bp, Mus musculus
aagaaacctcgataatctccaggag

SEQ ID NO: 504372 - DNA, 25 bp, Mus musculus
aagaaacctgctcttggcgtatttg

SEQ ID NO: 504373 - DNA, 25 bp, Mus musculus
aagaaacctgctgttggcgtatttg

SEQ ID NO: 504374 - DNA, 25 bp, Mus musculus
aagaaacgcagacttgtagacacag

SEQ ID NO: 504375 - DNA, 25 bp, Mus musculus
aagaaacgcagagttgtagacacag

SEQ ID NO: 504376 - DNA, 25 bp, Mus musculus
aagaaacgctttagatgtgatcggg

SEQ ID NO: 504377 - DNA, 25 bp, Mus musculus
aagaaacgcttttgatgtgatcggg

SEQ ID NO: 504378 - DNA, 25 bp, Mus musculus
aagaaacgtcgcctgtccgggcctg

SEQ ID NO: 504379 - DNA, 25 bp, Mus musculus
aagaaacgtcgcgtgtccgggcctg

SEQ ID NO: 504380 - DNA, 25 bp, Mus musculus
aagaaacgttctatgtcggagctgc

SEQ ID NO: 504381 - DNA, 25 bp, Mus musculus
aagaaacgttctttgtcggagctgc

SEQ ID NO: 504382 - DNA, 25 bp, Mus musculus
aagaaactcaaacatgccattgaag

SEQ ID NO: 504383 - DNA, 25 bp, Mus musculus
aagaaactcaaagatgccattgaag

SEQ ID NO: 504384 - DNA, 25 bp, Mus musculus
aagaaactctgaaatccatcgtacc

SEQ ID NO: 504385 - DNA, 25 bp, Mus musculus
aagaaactctgatatccatcgtacc

SEQ ID NO: 504386 - DNA, 25 bp, Mus musculus
aagaaactgacgctcagacagtagc

SEQ ID NO: 504387 - DNA, 25 bp, Mus musculus
aagaaactgacggtcagacagtagc

SEQ ID NO: 504388 - DNA, 25 bp, Mus musculus
aagaaactgcaccaggaagagaaga

SEQ ID NO: 504389 - DNA, 25 bp, Mus musculus
aagaaactgcacgaggaagagaaga

SEQ ID NO: 504390 - DNA, 25 bp, Mus musculus
aagaaactgcatccggtgcccgctg

SEQ ID NO: 504391 - DNA, 25 bp, Mus musculus
aagaaactgcatgcggtgcccgctg

SEQ ID NO: 504392 - DNA, 25 bp, Mus musculus
aagaaactggcgcacatgtacggcg

SEQ ID NO: 504393 - DNA, 25 bp, Mus musculus
aagaaactggcggacatgtacggcg

SEQ ID NO: 504394 - DNA, 25 bp, Mus musculus
aagaaactggctccttccttgatgg

SEQ ID NO: 504395 - DNA, 25 bp, Mus musculus
aagaaactggctgcttccttgatgg

SEQ ID NO: 504396 - DNA, 25 bp, Mus musculus
aagaaactgttacaaagcagatacc

SEQ ID NO: 504397 - DNA, 25 bp, Mus musculus
aagaaactgttagaaagcagatacc

SEQ ID NO: 504398 - DNA, 25 bp, Mus musculus
aagaaacttcaaactgccaatgtgc

SEQ ID NO: 504399 - DNA, 25 bp, Mus musculus
aagaaacttcaatctgccaatgtgc

SEQ ID NO: 504400 - DNA, 25 bp, Mus musculus
aagaaacttgcaaaagtgtctcaca

SEQ ID NO: 504401 - DNA, 25 bp, Mus musculus
aagaaacttgcataagtgtctcaca

SEQ ID NO: 504402 - DNA, 25 bp, Mus musculus
aagaaacttggtccactgagttaca

SEQ ID NO: 504403 - DNA, 25 bp, Mus musculus
aagaaacttggtgcactgagttaca

SEQ ID NO: 504404 - DNA, 25 bp, Mus musculus
aagaaagactccaaccagcctgtgt

SEQ ID NO: 504405 - DNA, 25 bp, Mus musculus
aagaaagactcctaccagcctgtgt

SEQ ID NO: 504406 - DNA, 25 bp, Mus musculus
aagaaagagaagcaccttgacctgg

SEQ ID NO: 504407 - DNA, 25 bp, Mus musculus
aagaaagagaaggaccttgacctgg

SEQ ID NO: 504408 - DNA, 25 bp, Mus musculus
aagaaagaggacaccacctttgatg

SEQ ID NO: 504409 - DNA, 25 bp, Mus musculus
aagaaagaggactccacctttgatg

SEQ ID NO: 504410 - DNA, 25 bp, Mus musculus
aagaaagatgaacgctcttcacatg

SEQ ID NO: 504411 - DNA, 25 bp, Mus musculus
aagaaagatgaaggctcttcacatg

SEQ ID NO: 504412 - DNA, 25 bp, Mus musculus
aagaaagatgctctgcaccggtgcc

SEQ ID NO: 504413 - DNA, 25 bp, Mus musculus
aagaaagatgctgtgcaccggtgcc

SEQ ID NO: 504414 - DNA, 25 bp, Mus musculus
aagaaagcactgaccaccggagata

SEQ ID NO: 504415 - DNA, 25 bp, Mus musculus
aagaaagcactgtccaccggagata

SEQ ID NO: 504416 - DNA, 25 bp, Mus musculus
aagaaagcatctacccgcaacgtga

SEQ ID NO: 504417 - DNA, 25 bp, Mus musculus
aagaaagcatcttcccgcaacgtga

SEQ ID NO: 504418 - DNA, 25 bp, Mus musculus
aagaaagccactctgttggtgtagg

SEQ ID NO: 504419 - DNA, 25 bp, Mus musculus
aagaaagccactgtgttggtgtagg

SEQ ID NO: 504420 - DNA, 25 bp, Mus musculus
aagaaaggtctacctcccgaggtgg

SEQ ID NO: 504421 - DNA, 25 bp, Mus musculus
aagaaaggtctagctcccgaggtgg

SEQ ID NO: 504422 - DNA, 25 bp, Mus musculus
aagaaagtattcctggagaagctga

SEQ ID NO: 504423 - DNA, 25 bp, Mus musculus
aagaaagtattcgtggagaagctga

SEQ ID NO: 504424 - DNA, 25 bp, Mus musculus
aagaaagttcctacacagactgttt

SEQ ID NO: 504425 - DNA, 25 bp, Mus musculus
aagaaagttccttcacagactgttt

SEQ ID NO: 504426 - DNA, 25 bp, Mus musculus
aagaaataaatgctctggcttcata

SEQ ID NO: 504427 - DNA, 25 bp, Mus musculus
aagaaataaatggtctggcttcata

SEQ ID NO: 504428 - DNA, 25 bp, Mus musculus
aagaaatcaggaaaaggcgtgacgt

SEQ ID NO: 504429 - DNA, 25 bp, Mus musculus
aagaaatcaggataaggcgtgacgt

SEQ ID NO: 504430 - DNA, 25 bp, Mus musculus
aagaaatccagaaattggcagagca

SEQ ID NO: 504431 - DNA, 25 bp, Mus musculus
aagaaatccagatattggcagagca

SEQ ID NO: 504432 - DNA, 25 bp, Mus musculus
aagaaatccccacaaccagtcagat

SEQ ID NO: 504433 - DNA, 25 bp, Mus musculus
aagaaatccccagaaccagtcagat

SEQ ID NO: 504434 - DNA, 25 bp, Mus musculus
aagaaatccttcagctcaattgaag

SEQ ID NO: 504435 - DNA, 25 bp, Mus musculus
aagaaatccttctgctcaattgaag

SEQ ID NO: 504436 - DNA, 25 bp, Mus musculus
aagaaatctcctattgggcttctgg

SEQ ID NO: 504437 - DNA, 25 bp, Mus musculus
aagaaatctccttttgggcttctgg

SEQ ID NO: 504438 - DNA, 25 bp, Mus musculus
aagaaatgaagaaacataaccaggg

SEQ ID NO: 504439 - DNA, 25 bp, Mus musculus
aagaaatgaagatacataaccaggg

SEQ ID NO: 504440 - DNA, 25 bp, Mus musculus
aagaaatgcaggcattaaccttatt

SEQ ID NO: 504441 - DNA, 25 bp, Mus musculus
aagaaatgcagggattaaccttatt

SEQ ID NO: 504442 - DNA, 25 bp, Mus musculus
aagaaatgccttcctagagagtgag

SEQ ID NO: 504443 - DNA, 25 bp, Mus musculus
aagaaatgccttgctagagagtgag

SEQ ID NO: 504444 - DNA, 25 bp, Mus musculus
aagaaatggagcagttacccacatc

SEQ ID NO: 504445 - DNA, 25 bp, Mus musculus
aagaaatggagctgttacccacatc

SEQ ID NO: 504446 - DNA, 25 bp, Mus musculus
aagaaatggcggcaaccgtagccag

SEQ ID NO: 504447 - DNA, 25 bp, Mus musculus
aagaaatggcgggaaccgtagccag

SEQ ID NO: 504448 - DNA, 25 bp, Mus musculus
aagaaatgggctctggagcgaaccc

SEQ ID NO: 504449 - DNA, 25 bp, Mus musculus
aagaaatgggctgtggagcgaaccc

SEQ ID NO: 504450 - DNA, 25 bp, Mus musculus
aagaaatgtgaactcaatctacagc

SEQ ID NO: 504451 - DNA, 25 bp, Mus musculus
aagaaatgtgaagtcaatctacagc

SEQ ID NO: 504452 - DNA, 25 bp, Mus musculus
aagaaattcccaaagagcctccgag

SEQ ID NO: 504453 - DNA, 25 bp, Mus musculus
aagaaattcccatagagcctccgag

SEQ ID NO: 504454 - DNA, 25 bp, Mus musculus
aagaaattcgagctggtgccgtcgc

SEQ ID NO: 504455 - DNA, 25 bp, Mus musculus
aagaaattcgaggtggtgccgtcgc

SEQ ID NO: 504456 - DNA, 25 bp, Mus musculus
aagaaattgtcactctgcgccaggt

SEQ ID NO: 504457 - DNA, 25 bp, Mus musculus
aagaaattgtcagtctgcgccaggt

SEQ ID NO: 504458 - DNA, 25 bp, Mus musculus
aagaaatttggactctacgtgcgct

SEQ ID NO: 504459 - DNA, 25 bp, Mus musculus
aagaaatttggagtctacgtgcgct

SEQ ID NO: 504460 - DNA, 25 bp, Mus musculus
aagaacaaactacaggcgattgcca

SEQ ID NO: 504461 - DNA, 25 bp, Mus musculus
aagaacaaactagaggcgattgcca

SEQ ID NO: 504462 - DNA, 25 bp, Mus musculus
aagaacaacctgaaggactgtggcc

SEQ ID NO: 504463 - DNA, 25 bp, Mus musculus
aagaacaacctgtaggactgtggcc

SEQ ID NO: 504464 - DNA, 25 bp, Mus musculus
aagaacaagactctacgctatggag

SEQ ID NO: 504465 - DNA, 25 bp, Mus musculus
aagaacaagactgtacgctatggag

SEQ ID NO: 504466 - DNA, 25 bp, Mus musculus
aagaacaagcatacggagcagccag

SEQ ID NO: 504467 - DNA, 25 bp, Mus musculus
aagaacaagcattcggagcagccag

SEQ ID NO: 504468 - DNA, 25 bp, Mus musculus
aagaacaagtgtcacgccaggacct

SEQ ID NO: 504469 - DNA, 25 bp, Mus musculus
aagaacaagtgtgacgccaggacct

SEQ ID NO: 504470 - DNA, 25 bp, Mus musculus
aagaacaatattaggaagctcacga

SEQ ID NO: 504471 - DNA, 25 bp, Mus musculus
aagaacaatatttggaagctcacga

SEQ ID NO: 504472 - DNA, 25 bp, Mus musculus
aagaacacaagtagtctggtgatgg

SEQ ID NO: 504473 - DNA, 25 bp, Mus musculus
aagaacacaagttgtctggtgatgg

SEQ ID NO: 504474 - DNA, 25 bp, Mus musculus
aagaacacacccagcatcagcgagg

SEQ ID NO: 504475 - DNA, 25 bp, Mus musculus
aagaacacaccctgcatcagcgagg

SEQ ID NO: 504476 - DNA, 25 bp, Mus musculus
aagaacacagtgcactctgaaatgg

SEQ ID NO: 504477 - DNA, 25 bp, Mus musculus
aagaacacagtggactctgaaatgg

SEQ ID NO: 504478 - DNA, 25 bp, Mus musculus
aagaacaccccaatctggattctag

SEQ ID NO: 504479 - DNA, 25 bp, Mus musculus
aagaacaccccattctggattctag

SEQ ID NO: 504480 - DNA, 25 bp, Mus musculus
aagaacaccggcaagatttccttag

SEQ ID NO: 504481 - DNA, 25 bp, Mus musculus
aagaacaccggctagatttccttag

SEQ ID NO: 504482 - DNA, 25 bp, Mus musculus
aagaacacggtgacgtcggcccgct

SEQ ID NO: 504483 - DNA, 25 bp, Mus musculus
aagaacacggtgtcgtcggcccgct

SEQ ID NO: 504484 - DNA, 25 bp, Mus musculus
aagaacactattcttcagagagcag

SEQ ID NO: 504485 - DNA, 25 bp, Mus musculus
aagaacactattgttcagagagcag

SEQ ID NO: 504486 - DNA, 25 bp, Mus musculus
aagaacactccgcatacagcactca

SEQ ID NO: 504487 - DNA, 25 bp, Mus musculus
aagaacactccggatacagcactca

SEQ ID NO: 504488 - DNA, 25 bp, Mus musculus
aagaacagaataccagccggaacag

SEQ ID NO: 504489 - DNA, 25 bp, Mus musculus
aagaacagaatagcagccggaacag

SEQ ID NO: 504490 - DNA, 25 bp, Mus musculus
aagaacagacttaggcttaagagac

SEQ ID NO: 504491 - DNA, 25 bp, Mus musculus
aagaacagactttggcttaagagac

SEQ ID NO: 504492 - DNA, 25 bp, Mus musculus
aagaacagcactagagcagataaag

SEQ ID NO: 504493 - DNA, 25 bp, Mus musculus
aagaacagcactcgctcactgacca

SEQ ID NO: 504494 - DNA, 25 bp, Mus musculus
aagaacagcactggctcactgacca

SEQ ID NO: 504495 - DNA, 25 bp, Mus musculus
aagaacagcacttgagcagataaag

SEQ ID NO: 504496 - DNA, 25 bp, Mus musculus
aagaacagcagccattggctggcca

SEQ ID NO: 504497 - DNA, 25 bp, Mus musculus
aagaacagcagcgattggctggcca

SEQ ID NO: 504498 - DNA, 25 bp, Mus musculus
aagaacagcgttctctcctacctac

SEQ ID NO: 504499 - DNA, 25 bp, Mus musculus
aagaacagcgttgtctcctacctac

SEQ ID NO: 504500 - DNA, 25 bp, Mus musculus
aagaacagtcaacagtcccagggca

SEQ ID NO: 504501 - DNA, 25 bp, Mus musculus
aagaacagtcaagagtcccagggca

SEQ ID NO: 504502 - DNA, 25 bp, Mus musculus
aagaacagtccgaagatgtcctccc

SEQ ID NO: 504503 - DNA, 25 bp, Mus musculus
aagaacagtccgtagatgtcctccc

SEQ ID NO: 504504 - DNA, 25 bp, Mus musculus
aagaacagtgtcaggtgcttccaga

SEQ ID NO: 504505 - DNA, 25 bp, Mus musculus
aagaacagtgtctggtgcttccaga

SEQ ID NO: 504506 - DNA, 25 bp, Mus musculus
aagaacagttgtcggatccttggca

SEQ ID NO: 504507 - DNA, 25 bp, Mus musculus
aagaacagttgtgggatccttggca

SEQ ID NO: 504508 - DNA, 25 bp, Mus musculus
aagaacatcagtctcccggtggcat

SEQ ID NO: 504509 - DNA, 25 bp, Mus musculus
aagaacatcagtgtcccggtggcat

SEQ ID NO: 504510 - DNA, 25 bp, Mus musculus
aagaacatcgacaccaacccttacg

SEQ ID NO: 504511 - DNA, 25 bp, Mus musculus
aagaacatcgactccaacccttacg

SEQ ID NO: 504512 - DNA, 25 bp, Mus musculus
aagaacatcgatccccggcagaatg

SEQ ID NO: 504513 - DNA, 25 bp, Mus musculus
aagaacatcgatgcccggcagaatg

SEQ ID NO: 504514 - DNA, 25 bp, Mus musculus
aagaacatgcagcttacagctggat

SEQ ID NO: 504515 - DNA, 25 bp, Mus musculus
aagaacatgcaggttacagctggat

SEQ ID NO: 504516 - DNA, 25 bp, Mus musculus
aagaacatggagaggcctctcaggc

SEQ ID NO: 504517 - DNA, 25 bp, Mus musculus
aagaacatggagtggcctctcaggc

SEQ ID NO: 504518 - DNA, 25 bp, Mus musculus
aagaacatggccctcatgacgaaca

SEQ ID NO: 504519 - DNA, 25 bp, Mus musculus
aagaacatggccgtcatgacgaaca

SEQ ID NO: 504520 - DNA, 25 bp, Mus musculus
aagaacatgtcgcagcgcatcggag

SEQ ID NO: 504521 - DNA, 25 bp, Mus musculus
aagaacatgtcggagcgcatcggag

SEQ ID NO: 504522 - DNA, 25 bp, Mus musculus
aagaacatgtttcgttctatggccg

SEQ ID NO: 504523 - DNA, 25 bp, Mus musculus
aagaacatgtttggttctatggccg

SEQ ID NO: 504524 - DNA, 25 bp, Mus musculus
aagaacattttacagcatctcgagc

SEQ ID NO: 504525 - DNA, 25 bp, Mus musculus
aagaacattttagagcatctcgagc

SEQ ID NO: 504526 - DNA, 25 bp, Mus musculus
aagaaccaagtacgtccaccaggag

SEQ ID NO: 504527 - DNA, 25 bp, Mus musculus
aagaaccaagtaggtccaccaggag

SEQ ID NO: 504528 - DNA, 25 bp, Mus musculus
aagaaccacgagattatcgccacct

SEQ ID NO: 504529 - DNA, 25 bp, Mus musculus
aagaaccacgagtttatcgccacct

SEQ ID NO: 504530 - DNA, 25 bp, Mus musculus
aagaacccaagcagcgagcgctgga

SEQ ID NO: 504531 - DNA, 25 bp, Mus musculus
aagaacccaagctgcgagcgctgga

SEQ ID NO: 504532 - DNA, 25 bp, Mus musculus
aagaaccccgttctgaacagacgtg

SEQ ID NO: 504533 - DNA, 25 bp, Mus musculus
aagaaccccgttgtgaacagacgtg

SEQ ID NO: 504534 - DNA, 25 bp, Mus musculus
aagaacccgagtctcccgagagcgt

SEQ ID NO: 504535 - DNA, 25 bp, Mus musculus
aagaacccgagtgtcccgagagcgt

SEQ ID NO: 504536 - DNA, 25 bp, Mus musculus
aagaacccggacaccattgagcagt

SEQ ID NO: 504537 - DNA, 25 bp, Mus musculus
aagaacccggactccattgagcagt

SEQ ID NO: 504538 - DNA, 25 bp, Mus musculus
aagaaccctgataccgtcctctgct

SEQ ID NO: 504539 - DNA, 25 bp, Mus musculus
aagaaccctgattccgtcctctgct

SEQ ID NO: 504540 - DNA, 25 bp, Mus musculus
aagaacctcagccatctgatcgacc

SEQ ID NO: 504541 - DNA, 25 bp, Mus musculus
aagaacctcagcgatctgatcgacc

SEQ ID NO: 504542 - DNA, 25 bp, Mus musculus
aagaacctttaactgcttccatgtt

SEQ ID NO: 504543 - DNA, 25 bp, Mus musculus
aagaacctttaagtgcttccatgtt

SEQ ID NO: 504544 - DNA, 25 bp, Mus musculus
aagaacgagaagctgaagcattgaa

SEQ ID NO: 504545 - DNA, 25 bp, Mus musculus
aagaacgagaaggtgaagcattgaa

SEQ ID NO: 504546 - DNA, 25 bp, Mus musculus
aagaacgccctcaagaacatgatgg

SEQ ID NO: 504547 - DNA, 25 bp, Mus musculus
aagaacgccctctagaacatgatgg

SEQ ID NO: 504548 - DNA, 25 bp, Mus musculus
aagaacggcagtaaatacgggcctg

SEQ ID NO: 504549 - DNA, 25 bp, Mus musculus
aagaacggcagttaatacgggcctg

SEQ ID NO: 504550 - DNA, 25 bp, Mus musculus
aagaacggcgatcgtacgaagcgcc

SEQ ID NO: 504551 - DNA, 25 bp, Mus musculus
aagaacggcgatggtacgaagcgcc

SEQ ID NO: 504552 - DNA, 25 bp, Mus musculus
aagaacggcggcatcttcctgcgca

SEQ ID NO: 504553 - DNA, 25 bp, Mus musculus
aagaacggcggcttcttcctgcgca

SEQ ID NO: 504554 - DNA, 25 bp, Mus musculus
aagaacggtaagaatgccaagaagg

SEQ ID NO: 504555 - DNA, 25 bp, Mus musculus
aagaacggtaagtatgccaagaagg

SEQ ID NO: 504556 - DNA, 25 bp, Mus musculus
aagaactatgtgcatctcgtatcca

SEQ ID NO: 504557 - DNA, 25 bp, Mus musculus
aagaactatgtggatctcgtatcca

SEQ ID NO: 504558 - DNA, 25 bp, Mus musculus
aagaactattatccacagaccagag

SEQ ID NO: 504559 - DNA, 25 bp, Mus musculus
aagaactattatgcacagaccagag

SEQ ID NO: 504560 - DNA, 25 bp, Mus musculus
aagaactcaagaccagaggctaatg

SEQ ID NO: 504561 - DNA, 25 bp, Mus musculus
aagaactcaagagcagaggctaatg

SEQ ID NO: 504562 - DNA, 25 bp, Mus musculus
aagaactcctgactgccctgctgag

SEQ ID NO: 504563 - DNA, 25 bp, Mus musculus
aagaactcctgagtgccctgctgag

SEQ ID NO: 504564 - DNA, 25 bp, Mus musculus
aagaactcgcagaccttcttctccg

SEQ ID NO: 504565 - DNA, 25 bp, Mus musculus
aagaactcgcagtccttcttctccg

SEQ ID NO: 504566 - DNA, 25 bp, Mus musculus
aagaactgacagacgaggagaagga

SEQ ID NO: 504567 - DNA, 25 bp, Mus musculus
aagaactgacagtcgaggagaagga

SEQ ID NO: 504568 - DNA, 25 bp, Mus musculus
aagaactgattgaagagtggcagcc

SEQ ID NO: 504569 - DNA, 25 bp, Mus musculus
aagaactgattgtagagtggcagcc

SEQ ID NO: 504570 - DNA, 25 bp, Mus musculus
aagaactgccagcagtcgatgtgct

SEQ ID NO: 504571 - DNA, 25 bp, Mus musculus
aagaactgccaggagtcgatgtgct

SEQ ID NO: 504572 - DNA, 25 bp, Mus musculus
aagaactgcccacacatcgtcgtgg

SEQ ID NO: 504573 - DNA, 25 bp, Mus musculus
aagaactgcccagacatcgtcgtgg

SEQ ID NO: 504574 - DNA, 25 bp, Mus musculus
aagaactggaagaggtcacagagag

SEQ ID NO: 504575 - DNA, 25 bp, Mus musculus
aagaactggaagtggtcacagagag

SEQ ID NO: 504576 - DNA, 25 bp, Mus musculus
aagaactggatgctcttttggaaca

SEQ ID NO: 504577 - DNA, 25 bp, Mus musculus
aagaactggatggtcttttggaaca

SEQ ID NO: 504578 - DNA, 25 bp, Mus musculus
aagaactgggatctcagattgagga

SEQ ID NO: 504579 - DNA, 25 bp, Mus musculus
aagaactgggatgtcagattgagga

SEQ ID NO: 504580 - DNA, 25 bp, Mus musculus
aagaacttcatccagaactatcccg

SEQ ID NO: 504581 - DNA, 25 bp, Mus musculus
aagaacttcatcgagaactatcccg

SEQ ID NO: 504582 - DNA, 25 bp, Mus musculus
aagaacttccagatagtgcacccgg

SEQ ID NO: 504583 - DNA, 25 bp, Mus musculus
aagaacttccagttagtgcacccgg

SEQ ID NO: 504584 - DNA, 25 bp, Mus musculus
aagaacttcgtaagtgttgtgctcg

SEQ ID NO: 504585 - DNA, 25 bp, Mus musculus
aagaacttcgtatgtgttgtgctcg

SEQ ID NO: 504586 - DNA, 25 bp, Mus musculus
aagaacttctgcaggtattctggct

SEQ ID NO: 504587 - DNA, 25 bp, Mus musculus
aagaacttctgctggtattctggct

SEQ ID NO: 504588 - DNA, 25 bp, Mus musculus
aagaagaaagatcaactggagcgtg

SEQ ID NO: 504589 - DNA, 25 bp, Mus musculus
aagaagaaagatgaactggagcgtg

SEQ ID NO: 504590 - DNA, 25 bp, Mus musculus
aagaagaaatggcacattgtgacag

SEQ ID NO: 504591 - DNA, 25 bp, Mus musculus
aagaagaaatgggacattgtgacag

SEQ ID NO: 504592 - DNA, 25 bp, Mus musculus
aagaagaaattgacactctgcgcca

SEQ ID NO: 504593 - DNA, 25 bp, Mus musculus
aagaagaaattgtcactctgcgcca

SEQ ID NO: 504594 - DNA, 25 bp, Mus musculus
aagaagaacaaaccatcccacggct

SEQ ID NO: 504595 - DNA, 25 bp, Mus musculus
aagaagaacaaagcatcccacggct

SEQ ID NO: 504596 - DNA, 25 bp, Mus musculus
aagaagaacacactgaaccccacgt

SEQ ID NO: 504597 - DNA, 25 bp, Mus musculus
aagaagaacacagtgaaccccacgt

SEQ ID NO: 504598 - DNA, 25 bp, Mus musculus
aagaagaacatgaatggtttattcc

SEQ ID NO: 504599 - DNA, 25 bp, Mus musculus
aagaagaacatgtatggtttattcc

SEQ ID NO: 504600 - DNA, 25 bp, Mus musculus
aagaagaaccccatggtggagacgc

SEQ ID NO: 504601 - DNA, 25 bp, Mus musculus
aagaagaaccccttggtggagacgc

SEQ ID NO: 504602 - DNA, 25 bp, Mus musculus
aagaagaactgcaggacaggctggt

SEQ ID NO: 504603 - DNA, 25 bp, Mus musculus
aagaagaactgctggacaggctggt

SEQ ID NO: 504604 - DNA, 25 bp, Mus musculus
aagaagaactggcatctcagattga

SEQ ID NO: 504605 - DNA, 25 bp, Mus musculus
aagaagaactgggatctcagattga

SEQ ID NO: 504606 - DNA, 25 bp, Mus musculus
aagaagaactgtcgaagcacatcca

SEQ ID NO: 504607 - DNA, 25 bp, Mus musculus
aagaagaactgtggaagcacatcca

SEQ ID NO: 504608 - DNA, 25 bp, Mus musculus
aagaagaagcccctgtggcttgagt

SEQ ID NO: 504609 - DNA, 25 bp, Mus musculus
aagaagaagcccgtgtggcttgagt

SEQ ID NO: 504610 - DNA, 25 bp, Mus musculus
aagaagaaggccagaaagacgaaga

SEQ ID NO: 504611 - DNA, 25 bp, Mus musculus
aagaagaaggcctgaaagacgaaga

SEQ ID NO: 504612 - DNA, 25 bp, Mus musculus
aagaagaagggaaacacagttgggt

SEQ ID NO: 504613 - DNA, 25 bp, Mus musculus
aagaagaagggatacacagttgggt

SEQ ID NO: 504614 - DNA, 25 bp, Mus musculus
aagaagaagggcaatgcagacctgt

SEQ ID NO: 504615 - DNA, 25 bp, Mus musculus
aagaagaagggctatgcagacctgt

SEQ ID NO: 504616 - DNA, 25 bp, Mus musculus
aagaagaaggtacctgagcaaacag

SEQ ID NO: 504617 - DNA, 25 bp, Mus musculus
aagaagaaggtagctgagcaaacag

SEQ ID NO: 504618 - DNA, 25 bp, Mus musculus
aagaagaagttgatcaagcgccgca

SEQ ID NO: 504619 - DNA, 25 bp, Mus musculus
aagaagaagttgttcaagcgccgca

SEQ ID NO: 504620 - DNA, 25 bp, Mus musculus
aagaagaatcacataaagtattggg

SEQ ID NO: 504621 - DNA, 25 bp, Mus musculus
aagaagaatcacttaaagtattggg

SEQ ID NO: 504622 - DNA, 25 bp, Mus musculus
aagaagaatccacgtggccttgtac

SEQ ID NO: 504623 - DNA, 25 bp, Mus musculus
aagaagaatccaggtggccttgtac

SEQ ID NO: 504624 - DNA, 25 bp, Mus musculus
aagaagaatgcgctcatccggaggc

SEQ ID NO: 504625 - DNA, 25 bp, Mus musculus
aagaagaatgcggtcatccggaggc

SEQ ID NO: 504626 - DNA, 25 bp, Mus musculus
aagaagacagtcagcgttgcctcaa

SEQ ID NO: 504627 - DNA, 25 bp, Mus musculus
aagaagacagtctgcgttgcctcaa

SEQ ID NO: 504628 - DNA, 25 bp, Mus musculus
aagaagaccactcgagcagctcaag

SEQ ID NO: 504629 - DNA, 25 bp, Mus musculus
aagaagaccactggagcagctcaag

SEQ ID NO: 504630 - DNA, 25 bp, Mus musculus
aagaagacccgactcttacagaaga

SEQ ID NO: 504631 - DNA, 25 bp, Mus musculus
aagaagacccgagtcttacagaaga

SEQ ID NO: 504632 - DNA, 25 bp, Mus musculus
aagaagacgcctaactttaccagag

SEQ ID NO: 504633 - DNA, 25 bp, Mus musculus
aagaagacgccttactttaccagag

SEQ ID NO: 504634 - DNA, 25 bp, Mus musculus
aagaagacgtaacgctacaggccct

SEQ ID NO: 504635 - DNA, 25 bp, Mus musculus
aagaagacgtaaggctacaggccct

SEQ ID NO: 504636 - DNA, 25 bp, Mus musculus
aagaagactctgaacatctgattcg

SEQ ID NO: 504637 - DNA, 25 bp, Mus musculus
aagaagactctgtacatctgattcg

SEQ ID NO: 504638 - DNA, 25 bp, Mus musculus
aagaagactgctcaggacatgaacc

SEQ ID NO: 504639 - DNA, 25 bp, Mus musculus
aagaagactgctgaggacatgaacc

SEQ ID NO: 504640 - DNA, 25 bp, Mus musculus
aagaagagacccaagacccgtcaca

SEQ ID NO: 504641 - DNA, 25 bp, Mus musculus
aagaagagaccctagacccgtcaca

SEQ ID NO: 504642 - DNA, 25 bp, Mus musculus
aagaagagcgctatctcttcccagt

SEQ ID NO: 504643 - DNA, 25 bp, Mus musculus
aagaagagcgctttctcttcccagt

SEQ ID NO: 504644 - DNA, 25 bp, Mus musculus
aagaagaggaacctgaaccccatct

SEQ ID NO: 504645 - DNA, 25 bp, Mus musculus
aagaagaggaacgtgaaccccatct

SEQ ID NO: 504646 - DNA, 25 bp, Mus musculus
aagaagaggctacgcagatcaagaa

SEQ ID NO: 504647 - DNA, 25 bp, Mus musculus
aagaagaggctaggcagatcaagaa

SEQ ID NO: 504648 - DNA, 25 bp, Mus musculus
aagaagagggcaagcagaagggtta

SEQ ID NO: 504649 - DNA, 25 bp, Mus musculus
aagaagagggcatgcagaagggtta

SEQ ID NO: 504650 - DNA, 25 bp, Mus musculus
aagaagagtcagagaggaagcttct

SEQ ID NO: 504651 - DNA, 25 bp, Mus musculus
aagaagagtcagtgaggaagcttct

SEQ ID NO: 504652 - DNA, 25 bp, Mus musculus
aagaagatacggcttcaggtgtcaa

SEQ ID NO: 504653 - DNA, 25 bp, Mus musculus
aagaagatacgggttcaggtgtcaa

SEQ ID NO: 504654 - DNA, 25 bp, Mus musculus
aagaagatcgtgattgtgacgggaa

SEQ ID NO: 504655 - DNA, 25 bp, Mus musculus
aagaagatcgtgtttgtgacgggaa

SEQ ID NO: 504656 - DNA, 25 bp, Mus musculus
aagaagatgacccagtcatacagga

SEQ ID NO: 504657 - DNA, 25 bp, Mus musculus
aagaagatgaccgagtcatacagga

SEQ ID NO: 504658 - DNA, 25 bp, Mus musculus
aagaagatgatacaatgtatccagc

SEQ ID NO: 504659 - DNA, 25 bp, Mus musculus
aagaagatgatagaatgtatccagc

SEQ ID NO: 504660 - DNA, 25 bp, Mus musculus
aagaagatgattctgtcctccctca

SEQ ID NO: 504661 - DNA, 25 bp, Mus musculus
aagaagatgattgtgtcctccctca

SEQ ID NO: 504662 - DNA, 25 bp, Mus musculus
aagaagatggcgagcacactgtgga

SEQ ID NO: 504663 - DNA, 25 bp, Mus musculus
aagaagatggcgtgcacactgtgga

SEQ ID NO: 504664 - DNA, 25 bp, Mus musculus
aagaagatgttcagcggaggcttcc

SEQ ID NO: 504665 - DNA, 25 bp, Mus musculus
aagaagatgttctgcggaggcttcc

SEQ ID NO: 504666 - DNA, 25 bp, Mus musculus
aagaagattcatcatccactgagtt

SEQ ID NO: 504667 - DNA, 25 bp, Mus musculus
aagaagattcatgatccactgagtt

SEQ ID NO: 504668 - DNA, 25 bp, Mus musculus
aagaagattctcattgaggagtgga

SEQ ID NO: 504669 - DNA, 25 bp, Mus musculus
aagaagattctctttgaggagtgga

SEQ ID NO: 504670 - DNA, 25 bp, Mus musculus
aagaagattgccagcgccacccaca

SEQ ID NO: 504671 - DNA, 25 bp, Mus musculus
aagaagattgcctgcgccacccaca

SEQ ID NO: 504672 - DNA, 25 bp, Mus musculus
aagaagcaaatcacatgcaccttgg

SEQ ID NO: 504673 - DNA, 25 bp, Mus musculus
aagaagcaaatctcatgcaccttgg

SEQ ID NO: 504674 - DNA, 25 bp, Mus musculus
aagaagcaaatgcttgccaatgtgg

SEQ ID NO: 504675 - DNA, 25 bp, Mus musculus
aagaagcaaatggttgccaatgtgg

SEQ ID NO: 504676 - DNA, 25 bp, Mus musculus
aagaagcagcgcaggaaacgccagg

SEQ ID NO: 504677 - DNA, 25 bp, Mus musculus
aagaagcagcgctggaaacgccagg

SEQ ID NO: 504678 - DNA, 25 bp, Mus musculus
aagaagcagcttagcccctatgctg

SEQ ID NO: 504679 - DNA, 25 bp, Mus musculus
aagaagcagctttgcccctatgctg

SEQ ID NO: 504680 - DNA, 25 bp, Mus musculus
aagaagcaggcaacggagacacccc

SEQ ID NO: 504681 - DNA, 25 bp, Mus musculus
aagaagcaggcatcggagacacccc

SEQ ID NO: 504682 - DNA, 25 bp, Mus musculus
aagaagcagttcaagtatgggaccc

SEQ ID NO: 504683 - DNA, 25 bp, Mus musculus
aagaagcagttctagtatgggaccc

SEQ ID NO: 504684 - DNA, 25 bp, Mus musculus
aagaagcatcagatccaggatcggg

SEQ ID NO: 504685 - DNA, 25 bp, Mus musculus
aagaagcatcagttccaggatcggg

SEQ ID NO: 504686 - DNA, 25 bp, Mus musculus
aagaagcatccaacccaattgtcaa

SEQ ID NO: 504687 - DNA, 25 bp, Mus musculus
aagaagcatccatcccaattgtcaa

SEQ ID NO: 504688 - DNA, 25 bp, Mus musculus
aagaagccacccagggttcctgtag

SEQ ID NO: 504689 - DNA, 25 bp, Mus musculus
aagaagccaccctgggttcctgtag

SEQ ID NO: 504690 - DNA, 25 bp, Mus musculus
aagaagccagacatcagcagccagc

SEQ ID NO: 504691 - DNA, 25 bp, Mus musculus
aagaagccagacttcagcagccagc

SEQ ID NO: 504692 - DNA, 25 bp, Mus musculus
aagaagccagtaacctgaaattgtc

SEQ ID NO: 504693 - DNA, 25 bp, Mus musculus
aagaagccagtatcctgaaattgtc

SEQ ID NO: 504694 - DNA, 25 bp, Mus musculus
aagaagccatcaattactcgtatgg

SEQ ID NO: 504695 - DNA, 25 bp, Mus musculus
aagaagccatcatttactcgtatgg

SEQ ID NO: 504696 - DNA, 25 bp, Mus musculus
aagaagccatttccctttagccttg

SEQ ID NO: 504697 - DNA, 25 bp, Mus musculus
aagaagccatttgcctttagccttg

SEQ ID NO: 504698 - DNA, 25 bp, Mus musculus
aagaagcccttcacggccatcctat

SEQ ID NO: 504699 - DNA, 25 bp, Mus musculus
aagaagcccttctcggccatcctat

SEQ ID NO: 504700 - DNA, 25 bp, Mus musculus
aagaagccgtctctatgagcacagc

SEQ ID NO: 504701 - DNA, 25 bp, Mus musculus
aagaagccgtctgtatgagcacagc

SEQ ID NO: 504702 - DNA, 25 bp, Mus musculus
aagaagcctgagatcctgtggttca

SEQ ID NO: 504703 - DNA, 25 bp, Mus musculus
aagaagcctgagttcctgtggttca

SEQ ID NO: 504704 - DNA, 25 bp, Mus musculus
aagaagcgatgacgtcactgacccc

SEQ ID NO: 504705 - DNA, 25 bp, Mus musculus
aagaagcgatgaggtcactgacccc

SEQ ID NO: 504706 - DNA, 25 bp, Mus musculus
aagaagcgtccgatgacatcccgag

SEQ ID NO: 504707 - DNA, 25 bp, Mus musculus
aagaagcgtccgttgacatcccgag

SEQ ID NO: 504708 - DNA, 25 bp, Mus musculus
aagaagctaaatatggtgccagacg

SEQ ID NO: 504709 - DNA, 25 bp, Mus musculus
aagaagctaaatttggtgccagacg

SEQ ID NO: 504710 - DNA, 25 bp, Mus musculus
aagaagctactaaggaggaaactgg

SEQ ID NO: 504711 - DNA, 25 bp, Mus musculus
aagaagctactatggaggaaactgg

SEQ ID NO: 504712 - DNA, 25 bp, Mus musculus
aagaagctacttcagcggatccgcc

SEQ ID NO: 504713 - DNA, 25 bp, Mus musculus
aagaagctacttgagcggatccgcc

SEQ ID NO: 504714 - DNA, 25 bp, Mus musculus
aagaagctatggcagccttccagga

SEQ ID NO: 504715 - DNA, 25 bp, Mus musculus
aagaagctatgggagccttccagga

SEQ ID NO: 504716 - DNA, 25 bp, Mus musculus
aagaagctcctcaggacttgacgca

SEQ ID NO: 504717 - DNA, 25 bp, Mus musculus
aagaagctcctctggacttgacgca

SEQ ID NO: 504718 - DNA, 25 bp, Mus musculus
aagaagctctggcatattaacccca

SEQ ID NO: 504719 - DNA, 25 bp, Mus musculus
aagaagctctgggatattaacccca

SEQ ID NO: 504720 - DNA, 25 bp, Mus musculus
aagaagctcttgctgccctgtgcac

SEQ ID NO: 504721 - DNA, 25 bp, Mus musculus
aagaagctcttggtgccctgtgcac

SEQ ID NO: 504722 - DNA, 25 bp, Mus musculus
aagaagctgccccacggccttggga

SEQ ID NO: 504723 - DNA, 25 bp, Mus musculus
aagaagctgcccgacggccttggga

SEQ ID NO: 504724 - DNA, 25 bp, Mus musculus
aagaagctgcgaatggcgggtgacc

SEQ ID NO: 504725 - DNA, 25 bp, Mus musculus
aagaagctgcgattggcgggtgacc

SEQ ID NO: 504726 - DNA, 25 bp, Mus musculus
aagaagctggagatcggaaacgcaa

SEQ ID NO: 504727 - DNA, 25 bp, Mus musculus
aagaagctggagttcggaaacgcaa

SEQ ID NO: 504728 - DNA, 25 bp, Mus musculus
aagaagctggcccaccaagaggagt

SEQ ID NO: 504729 - DNA, 25 bp, Mus musculus
aagaagctggccgaccaagaggagt

SEQ ID NO: 504730 - DNA, 25 bp, Mus musculus
aagaagctggctcgcctggtagagg

SEQ ID NO: 504731 - DNA, 25 bp, Mus musculus
aagaagctggctggcctggtagagg

SEQ ID NO: 504732 - DNA, 25 bp, Mus musculus
aagaagctgggcaatgatactgggc

SEQ ID NO: 504733 - DNA, 25 bp, Mus musculus
aagaagctgggcatgagccactggc

SEQ ID NO: 504734 - DNA, 25 bp, Mus musculus
aagaagctgggctatgatactgggc

SEQ ID NO: 504735 - DNA, 25 bp, Mus musculus
aagaagctgggcttgagccactggc

SEQ ID NO: 504736 - DNA, 25 bp, Mus musculus
aagaagcttaaaccccaccgacctg

SEQ ID NO: 504737 - DNA, 25 bp, Mus musculus
aagaagcttaaagcccaccgacctg

SEQ ID NO: 504738 - DNA, 25 bp, Mus musculus
aagaagcttccaagatcctgtccaa

SEQ ID NO: 504739 - DNA, 25 bp, Mus musculus
aagaagcttccatgatcctgtccaa

SEQ ID NO: 504740 - DNA, 25 bp, Mus musculus
aagaagcttttacaagcggcacgag

SEQ ID NO: 504741 - DNA, 25 bp, Mus musculus
aagaagcttttagaagcggcacgag

SEQ ID NO: 504742 - DNA, 25 bp, Mus musculus
aagaaggacccacactctcagacaa

SEQ ID NO: 504743 - DNA, 25 bp, Mus musculus
aagaaggacccagactctcagacaa

SEQ ID NO: 504744 - DNA, 25 bp, Mus musculus
aagaaggacctccatggcctgctgt

SEQ ID NO: 504745 - DNA, 25 bp, Mus musculus
aagaaggacctcgatggcctgctgt

SEQ ID NO: 504746 - DNA, 25 bp, Mus musculus
aagaaggacctgatagcccgagtag

SEQ ID NO: 504747 - DNA, 25 bp, Mus musculus
aagaaggacctgttagcccgagtag

SEQ ID NO: 504748 - DNA, 25 bp, Mus musculus
aagaaggagaagacggctaagctca

SEQ ID NO: 504749 - DNA, 25 bp, Mus musculus
aagaaggagaagtcggctaagctca

SEQ ID NO: 504750 - DNA, 25 bp, Mus musculus
aagaaggagtatatgcaggagcagc

SEQ ID NO: 504751 - DNA, 25 bp, Mus musculus
aagaaggagtatttgcaggagcagc

SEQ ID NO: 504752 - DNA, 25 bp, Mus musculus
aagaaggatcacaccaacaccggaa

SEQ ID NO: 504753 - DNA, 25 bp, Mus musculus
aagaaggatcactccaacaccggaa

SEQ ID NO: 504754 - DNA, 25 bp, Mus musculus
aagaaggatgagctgtgcaaacaaa

SEQ ID NO: 504755 - DNA, 25 bp, Mus musculus
aagaaggatgaggtgtgcaaacaaa

SEQ ID NO: 504756 - DNA, 25 bp, Mus musculus
aagaaggcatccagacccgaaaccg

SEQ ID NO: 504757 - DNA, 25 bp, Mus musculus
aagaaggcatcctgacccgaaaccg

SEQ ID NO: 504758 - DNA, 25 bp, Mus musculus
aagaaggcggtcagcaacaagctcc

SEQ ID NO: 504759 - DNA, 25 bp, Mus musculus
aagaaggcggtctgcaacaagctcc

SEQ ID NO: 504760 - DNA, 25 bp, Mus musculus
aagaaggctctgcagtggcacccag

SEQ ID NO: 504761 - DNA, 25 bp, Mus musculus
aagaaggctctggagtggcacccag

SEQ ID NO: 504762 - DNA, 25 bp, Mus musculus
aagaaggcttccatcggctacacct

SEQ ID NO: 504763 - DNA, 25 bp, Mus musculus
aagaaggcttccttcggctacacct

SEQ ID NO: 504764 - DNA, 25 bp, Mus musculus
aagaagggaaacacgacggtgtatg

SEQ ID NO: 504765 - DNA, 25 bp, Mus musculus
aagaagggaaactcgacggtgtatg

SEQ ID NO: 504766 - DNA, 25 bp, Mus musculus
aagaagggatacctgcatttcctgg

SEQ ID NO: 504767 - DNA, 25 bp, Mus musculus
aagaagggatacgtgcatttcctgg

SEQ ID NO: 504768 - DNA, 25 bp, Mus musculus
aagaagggcaacaactcctccaaca

SEQ ID NO: 504769 - DNA, 25 bp, Mus musculus
aagaagggcaactactcctccaaca

SEQ ID NO: 504770 - DNA, 25 bp, Mus musculus
aagaagggcaagaagcctcttggcc

SEQ ID NO: 504771 - DNA, 25 bp, Mus musculus
aagaagggcaagtagcctcttggcc

SEQ ID NO: 504772 - DNA, 25 bp, Mus musculus
aagaagggcacgacctgaagctggc

SEQ ID NO: 504773 - DNA, 25 bp, Mus musculus
aagaagggcacgtcctgaagctggc

SEQ ID NO: 504774 - DNA, 25 bp, Mus musculus
aagaagggccacaagctccacctgg

SEQ ID NO: 504775 - DNA, 25 bp, Mus musculus
aagaagggccactagctccacctgg

SEQ ID NO: 504776 - DNA, 25 bp, Mus musculus
aagaagggctgcattgcacggtctg

SEQ ID NO: 504777 - DNA, 25 bp, Mus musculus
aagaagggctgctttgcacggtctg

SEQ ID NO: 504778 - DNA, 25 bp, Mus musculus
aagaaggtgcctatatcgtgagaga

SEQ ID NO: 504779 - DNA, 25 bp, Mus musculus
aagaaggtgcctttatcgtgagaga

SEQ ID NO: 504780 - DNA, 25 bp, Mus musculus
aagaaggtggcactggtccgcactc

SEQ ID NO: 504781 - DNA, 25 bp, Mus musculus
aagaaggtggcagtggtccgcactc

SEQ ID NO: 504782 - DNA, 25 bp, Mus musculus
aagaaggtggtgctcaacgggcgag

SEQ ID NO: 504783 - DNA, 25 bp, Mus musculus
aagaaggtggtggtcaacgggcgag

SEQ ID NO: 504784 - DNA, 25 bp, Mus musculus
aagaaggtgtctcagacccggagac

SEQ ID NO: 504785 - DNA, 25 bp, Mus musculus
aagaaggtgtctgagacccggagac

SEQ ID NO: 504786 - DNA, 25 bp, Mus musculus
aagaaggtgtgcatctggccactgt

SEQ ID NO: 504787 - DNA, 25 bp, Mus musculus
aagaaggtgtgcttctggccactgt

SEQ ID NO: 504788 - DNA, 25 bp, Mus musculus
aagaagtactcgaacaagactgtcc

SEQ ID NO: 504789 - DNA, 25 bp, Mus musculus
aagaagtactcgtacaagactgtcc

SEQ ID NO: 504790 - DNA, 25 bp, Mus musculus
aagaagtcagctctggcggataagc

SEQ ID NO: 504791 - DNA, 25 bp, Mus musculus
aagaagtcagctgtggcggataagc

SEQ ID NO: 504792 - DNA, 25 bp, Mus musculus
aagaagtccagactgtgctcccctg

SEQ ID NO: 504793 - DNA, 25 bp, Mus musculus
aagaagtccagagtgtgctcccctg

SEQ ID NO: 504794 - DNA, 25 bp, Mus musculus
aagaagtcgactctcaagagatttg

SEQ ID NO: 504795 - DNA, 25 bp, Mus musculus
aagaagtcgactgtcaagagatttg

SEQ ID NO: 504796 - DNA, 25 bp, Mus musculus
aagaagtgctacagggtggtgcttt

SEQ ID NO: 504797 - DNA, 25 bp, Mus musculus
aagaagtgctactgggtggtgcttt

SEQ ID NO: 504798 - DNA, 25 bp, Mus musculus
aagaagttccagaaagtgaaaggat

SEQ ID NO: 504799 - DNA, 25 bp, Mus musculus
aagaagttccagtaagtgaaaggat

SEQ ID NO: 504800 - DNA, 25 bp, Mus musculus
aagaagttctaaaatacctgcgcag

SEQ ID NO: 504801 - DNA, 25 bp, Mus musculus
aagaagttctaatatacctgcgcag

SEQ ID NO: 504802 - DNA, 25 bp, Mus musculus
aagaagttctcaattgctgctctcc

SEQ ID NO: 504803 - DNA, 25 bp, Mus musculus
aagaagttctcatttgctgctctcc

SEQ ID NO: 504804 - DNA, 25 bp, Mus musculus
aagaagttgtgaatcatccctggcc

SEQ ID NO: 504805 - DNA, 25 bp, Mus musculus
aagaagttgtgattcatccctggcc

SEQ ID NO: 504806 - DNA, 25 bp, Mus musculus
aagaagtttggcatgaaccccagca

SEQ ID NO: 504807 - DNA, 25 bp, Mus musculus
aagaagtttggcttgaaccccagca

SEQ ID NO: 504808 - DNA, 25 bp, Mus musculus
aagaagtttgtcattaagcccatcg

SEQ ID NO: 504809 - DNA, 25 bp, Mus musculus
aagaagtttgtctttaagcccatcg

SEQ ID NO: 504810 - DNA, 25 bp, Mus musculus
aagaagttttgcacctctacccaca

SEQ ID NO: 504811 - DNA, 25 bp, Mus musculus
aagaagttttgctcctctacccaca

SEQ ID NO: 504812 - DNA, 25 bp, Mus musculus
aagaataagaacacttacactgacc

SEQ ID NO: 504813 - DNA, 25 bp, Mus musculus
aagaataagaactcttacactgacc

SEQ ID NO: 504814 - DNA, 25 bp, Mus musculus
aagaataagcttcgacatctgtcag

SEQ ID NO: 504815 - DNA, 25 bp, Mus musculus
aagaataagcttggacatctgtcag

SEQ ID NO: 504816 - DNA, 25 bp, Mus musculus
aagaataatgtgatgaggcggcctc

SEQ ID NO: 504817 - DNA, 25 bp, Mus musculus
aagaataatgtgttgaggcggcctc

SEQ ID NO: 504818 - DNA, 25 bp, Mus musculus
aagaatacgaggcatggaaagtccg

SEQ ID NO: 504819 - DNA, 25 bp, Mus musculus
aagaatacgagggatggaaagtccg

SEQ ID NO: 504820 - DNA, 25 bp, Mus musculus
aagaatatgacgacgagcagcgcgc

SEQ ID NO: 504821 - DNA, 25 bp, Mus musculus
aagaatatgacgtcgagcagcgcgc

SEQ ID NO: 504822 - DNA, 25 bp, Mus musculus
aagaatatgcctcgtcttgtgactt

SEQ ID NO: 504823 - DNA, 25 bp, Mus musculus
aagaatatgcctggtcttgtgactt

SEQ ID NO: 504824 - DNA, 25 bp, Mus musculus
aagaatcagcagaggagggaccctg

SEQ ID NO: 504825 - DNA, 25 bp, Mus musculus
aagaatcagcagtggagggaccctg

SEQ ID NO: 504826 - DNA, 25 bp, Mus musculus
aagaatcagggcattggaagaaagg

SEQ ID NO: 504827 - DNA, 25 bp, Mus musculus
aagaatcagggctttggaagaaagg

SEQ ID NO: 504828 - DNA, 25 bp, Mus musculus
aagaatcatctgaagcaaaactagg

SEQ ID NO: 504829 - DNA, 25 bp, Mus musculus
aagaatcatctgtagcaaaactagg

SEQ ID NO: 504830 - DNA, 25 bp, Mus musculus
aagaatcatttgagggctctgttcg

SEQ ID NO: 504831 - DNA, 25 bp, Mus musculus
aagaatcatttgtgggctctgttcg

SEQ ID NO: 504832 - DNA, 25 bp, Mus musculus
aagaatccagatatggttgctggag

SEQ ID NO: 504833 - DNA, 25 bp, Mus musculus
aagaatccagatttggttgctggag

SEQ ID NO: 504834 - DNA, 25 bp, Mus musculus
aagaatcccagcaaggaagagaggg

SEQ ID NO: 504835 - DNA, 25 bp, Mus musculus
aagaatcccagctaggaagagaggg

SEQ ID NO: 504836 - DNA, 25 bp, Mus musculus
aagaatcccgcgctacgaactgctg

SEQ ID NO: 504837 - DNA, 25 bp, Mus musculus
aagaatcccgcggtacgaactgctg

SEQ ID NO: 504838 - DNA, 25 bp, Mus musculus
aagaatccggcccagctggaagaga

SEQ ID NO: 504839 - DNA, 25 bp, Mus musculus
aagaatccggccgagctggaagaga

SEQ ID NO: 504840 - DNA, 25 bp, Mus musculus
aagaatcgctgtatcatgtgcagga

SEQ ID NO: 504841 - DNA, 25 bp, Mus musculus
aagaatcgctgtttcatgtgcagga

SEQ ID NO: 504842 - DNA, 25 bp, Mus musculus
aagaatctaaaacattgagccctgg

SEQ ID NO: 504843 - DNA, 25 bp, Mus musculus
aagaatctaaaagattgagccctgg

SEQ ID NO: 504844 - DNA, 25 bp, Mus musculus
aagaatctatttcaaaatggctccc

SEQ ID NO: 504845 - DNA, 25 bp, Mus musculus
aagaatctatttgaaaatggctccc

SEQ ID NO: 504846 - DNA, 25 bp, Mus musculus
aagaatctgcagagaggaggtgaaa

SEQ ID NO: 504847 - DNA, 25 bp, Mus musculus
aagaatctgcagtgaggaggtgaaa

SEQ ID NO: 504848 - DNA, 25 bp, Mus musculus
aagaatctgtatacaaatgagtacg

SEQ ID NO: 504849 - DNA, 25 bp, Mus musculus
aagaatctgtattcaaatgagtacg

SEQ ID NO: 504850 - DNA, 25 bp, Mus musculus
aagaatgaaggcagccaggtgtacg

SEQ ID NO: 504851 - DNA, 25 bp, Mus musculus
aagaatgaaggctgccaggtgtacg

SEQ ID NO: 504852 - DNA, 25 bp, Mus musculus
aagaatgaccacaacctcttcagtg

SEQ ID NO: 504853 - DNA, 25 bp, Mus musculus
aagaatgaccactacctcttcagtg

SEQ ID NO: 504854 - DNA, 25 bp, Mus musculus
aagaatgaggccagtgctttttggc

SEQ ID NO: 504855 - DNA, 25 bp, Mus musculus
aagaatgaggcctgtgctttttggc

SEQ ID NO: 504856 - DNA, 25 bp, Mus musculus
aagaatgagtatctcagcaatgggc

SEQ ID NO: 504857 - DNA, 25 bp, Mus musculus
aagaatgagtatgtcagcaatgggc

SEQ ID NO: 504858 - DNA, 25 bp, Mus musculus
aagaatgatgagactaaagccctca

SEQ ID NO: 504859 - DNA, 25 bp, Mus musculus
aagaatgatgagtctaaagccctca

SEQ ID NO: 504860 - DNA, 25 bp, Mus musculus
aagaatgatgtcagccgtccagggc

SEQ ID NO: 504861 - DNA, 25 bp, Mus musculus
aagaatgatgtctgccgtccagggc

SEQ ID NO: 504862 - DNA, 25 bp, Mus musculus
aagaatgcagagaagtcaactggtg

SEQ ID NO: 504863 - DNA, 25 bp, Mus musculus
aagaatgcagagtagtcaactggtg

SEQ ID NO: 504864 - DNA, 25 bp, Mus musculus
aagaatgccactccatgttggacat

SEQ ID NO: 504865 - DNA, 25 bp, Mus musculus
aagaatgccactgcatgttggacat

SEQ ID NO: 504866 - DNA, 25 bp, Mus musculus
aagaatggaactcagcgcccaagaa

SEQ ID NO: 504867 - DNA, 25 bp, Mus musculus
aagaatggaactgagcgcccaagaa

SEQ ID NO: 504868 - DNA, 25 bp, Mus musculus
aagaatggacagaattgccctggct

SEQ ID NO: 504869 - DNA, 25 bp, Mus musculus
aagaatggacagtattgccctggct

SEQ ID NO: 504870 - DNA, 25 bp, Mus musculus
aagaatggagccaatccggtggctc

SEQ ID NO: 504871 - DNA, 25 bp, Mus musculus
aagaatggagcctatccggtggctc

SEQ ID NO: 504872 - DNA, 25 bp, Mus musculus
aagaatggagtgcatctatcatggc

SEQ ID NO: 504873 - DNA, 25 bp, Mus musculus
aagaatggagtggatctatcatggc

SEQ ID NO: 504874 - DNA, 25 bp, Mus musculus
aagaatggcattccttctaacagga

SEQ ID NO: 504875 - DNA, 25 bp, Mus musculus
aagaatggcattgcttctaacagga

SEQ ID NO: 504876 - DNA, 25 bp, Mus musculus
aagaatggctgcagaatgaaatccg

SEQ ID NO: 504877 - DNA, 25 bp, Mus musculus
aagaatggctgctgaatgaaatccg

SEQ ID NO: 504878 - DNA, 25 bp, Mus musculus
aagaatggcttcaaggaatgcttgg

SEQ ID NO: 504879 - DNA, 25 bp, Mus musculus
aagaatggcttctaggaatgcttgg

SEQ ID NO: 504880 - DNA, 25 bp, Mus musculus
aagaatgtcctcactatgcccattg

SEQ ID NO: 504881 - DNA, 25 bp, Mus musculus
aagaatgtcctctctatgcccattg

SEQ ID NO: 504882 - DNA, 25 bp, Mus musculus
aagaatgtgagcctgtctttcccgc

SEQ ID NO: 504883 - DNA, 25 bp, Mus musculus
aagaatgtgagcgtgtctttcccgc

SEQ ID NO: 504884 - DNA, 25 bp, Mus musculus
aagaatgtgcccatccaagcagcct

SEQ ID NO: 504885 - DNA, 25 bp, Mus musculus
aagaatgtgcccttccaagcagcct

SEQ ID NO: 504886 - DNA, 25 bp, Mus musculus
aagaatgtgtaacgaaactgacctg

SEQ ID NO: 504887 - DNA, 25 bp, Mus musculus
aagaatgtgtaaggaaactgacctg

SEQ ID NO: 504888 - DNA, 25 bp, Mus musculus
aagaatgttgagctgtttgccgaga

SEQ ID NO: 504889 - DNA, 25 bp, Mus musculus
aagaatgttgaggtgtttgccgaga

SEQ ID NO: 504890 - DNA, 25 bp, Mus musculus
aagaatgttttcattcaaagctcct

SEQ ID NO: 504891 - DNA, 25 bp, Mus musculus
aagaatgttttctttcaaagctcct

SEQ ID NO: 504892 - DNA, 25 bp, Mus musculus
aagaattatctaccagttcatcagc

SEQ ID NO: 504893 - DNA, 25 bp, Mus musculus
aagaattatctagcagttcatcagc

SEQ ID NO: 504894 - DNA, 25 bp, Mus musculus
aagaattccaggcagcaagaaagag

SEQ ID NO: 504895 - DNA, 25 bp, Mus musculus
aagaattccagggagcaagaaagag

SEQ ID NO: 504896 - DNA, 25 bp, Mus musculus
aagaattgccttccccaaacctacg

SEQ ID NO: 504897 - DNA, 25 bp, Mus musculus
aagaattgccttgcccaaacctacg

SEQ ID NO: 504898 - DNA, 25 bp, Mus musculus
aagaattgggaaacagagtgaagaa

SEQ ID NO: 504899 - DNA, 25 bp, Mus musculus
aagaattgggaatcagagtgaagaa

SEQ ID NO: 504900 - DNA, 25 bp, Mus musculus
aagaatttcactacagtggctcagg

SEQ ID NO: 504901 - DNA, 25 bp, Mus musculus
aagaatttcacttcagtggctcagg

SEQ ID NO: 504902 - DNA, 25 bp, Mus musculus
aagaatttctaccagacttgagaga

SEQ ID NO: 504903 - DNA, 25 bp, Mus musculus
aagaatttctacgagacttgagaga

SEQ ID NO: 504904 - DNA, 25 bp, Mus musculus
aagaatttcttaagacttgcattgg

SEQ ID NO: 504905 - DNA, 25 bp, Mus musculus
aagaatttcttatgacttgcattgg

SEQ ID NO: 504906 - DNA, 25 bp, Mus musculus
aagaatttgaaaatggcctggaaat

SEQ ID NO: 504907 - DNA, 25 bp, Mus musculus
aagaatttgaaattggcctggaaat

SEQ ID NO: 504908 - DNA, 25 bp, Mus musculus
aagaatttgcgaacgtgcccttgca

SEQ ID NO: 504909 - DNA, 25 bp, Mus musculus
aagaatttgcgatcgtgcccttgca

SEQ ID NO: 504910 - DNA, 25 bp, Mus musculus
aagaatttgcgtccgccttcttcac

SEQ ID NO: 504911 - DNA, 25 bp, Mus musculus
aagaatttgcgtgcgccttcttcac

SEQ ID NO: 504912 - DNA, 25 bp, Mus musculus
aagaattttggacggtctggtcgca

SEQ ID NO: 504913 - DNA, 25 bp, Mus musculus
aagaattttggagggtctggtcgca

SEQ ID NO: 504914 - DNA, 25 bp, Mus musculus
aagaattttgtgatggaaagtcaga

SEQ ID NO: 504915 - DNA, 25 bp, Mus musculus
aagaattttgtgttggaaagtcaga

SEQ ID NO: 504916 - DNA, 25 bp, Mus musculus
aagacaaacctgagggctcttcacc

SEQ ID NO: 504917 - DNA, 25 bp, Mus musculus
aagacaaacctgtgggctcttcacc

SEQ ID NO: 504918 - DNA, 25 bp, Mus musculus
aagacaaagaagaccccaggttcag

SEQ ID NO: 504919 - DNA, 25 bp, Mus musculus
aagacaaagaagtccccaggttcag

SEQ ID NO: 504920 - DNA, 25 bp, Mus musculus
aagacaacactgagaaccccgacct

SEQ ID NO: 504921 - DNA, 25 bp, Mus musculus
aagacaacactgtgaaccccgacct

SEQ ID NO: 504922 - DNA, 25 bp, Mus musculus
aagacaacgacactgagttcagact

SEQ ID NO: 504923 - DNA, 25 bp, Mus musculus
aagacaacgacagtgagttcagact

SEQ ID NO: 504924 - DNA, 25 bp, Mus musculus
aagacaagatcaagttctggttgga

SEQ ID NO: 504925 - DNA, 25 bp, Mus musculus
aagacaagatcatgttctggttgga

SEQ ID NO: 504926 - DNA, 25 bp, Mus musculus
aagacaagtgtaaagggacagggtc

SEQ ID NO: 504927 - DNA, 25 bp, Mus musculus
aagacaagtgtatagggacagggtc

SEQ ID NO: 504928 - DNA, 25 bp, Mus musculus
aagacaatgttgactgtagccagcc

SEQ ID NO: 504929 - DNA, 25 bp, Mus musculus
aagacaatgttgtctgtagccagcc

SEQ ID NO: 504930 - DNA, 25 bp, Mus musculus
aagacaatttttccctccgcagact

SEQ ID NO: 504931 - DNA, 25 bp, Mus musculus
aagacaatttttgcctccgcagact

SEQ ID NO: 504932 - DNA, 25 bp, Mus musculus
aagacacaaaatcctgaaaactggg

SEQ ID NO: 504933 - DNA, 25 bp, Mus musculus
aagacacaaaatgctgaaaactggg

SEQ ID NO: 504934 - DNA, 25 bp, Mus musculus
aagacacaaactaggctggacagca

SEQ ID NO: 504935 - DNA, 25 bp, Mus musculus
aagacacaaacttggctggacagca

SEQ ID NO: 504936 - DNA, 25 bp, Mus musculus
aagacacaaggtcggcacgtgtaca

SEQ ID NO: 504937 - DNA, 25 bp, Mus musculus
aagacacaaggtgggcacgtgtaca

SEQ ID NO: 504938 - DNA, 25 bp, Mus musculus
aagacacacactcgatggtgctgca

SEQ ID NO: 504939 - DNA, 25 bp, Mus musculus
aagacacacactggatggtgctgca

SEQ ID NO: 504940 - DNA, 25 bp, Mus musculus
aagacacaccctagccttatgagga

SEQ ID NO: 504941 - DNA, 25 bp, Mus musculus
aagacacacccttgccttatgagga

SEQ ID NO: 504942 - DNA, 25 bp, Mus musculus
aagacacacctgaggagctatggag

SEQ ID NO: 504943 - DNA, 25 bp, Mus musculus
aagacacacctgtggagctatggag

SEQ ID NO: 504944 - DNA, 25 bp, Mus musculus
aagacacagaagatgggaaattcaa

SEQ ID NO: 504945 - DNA, 25 bp, Mus musculus
aagacacagaagttgggaaattcaa

SEQ ID NO: 504946 - DNA, 25 bp, Mus musculus
aagacacagcaactggtcattccag

SEQ ID NO: 504947 - DNA, 25 bp, Mus musculus
aagacacagcaagtggtcattccag

SEQ ID NO: 504948 - DNA, 25 bp, Mus musculus
aagacaccggccaagtgtgaggcca

SEQ ID NO: 504949 - DNA, 25 bp, Mus musculus
aagacaccggcctagtgtgaggcca

SEQ ID NO: 504950 - DNA, 25 bp, Mus musculus
aagacacggttccaggaatctgaag

SEQ ID NO: 504951 - DNA, 25 bp, Mus musculus
aagacacggttcgaggaatctgaag

SEQ ID NO: 504952 - DNA, 25 bp, Mus musculus
aagacacggtttccaagacttgccc

SEQ ID NO: 504953 - DNA, 25 bp, Mus musculus
aagacacggtttgcaagacttgccc

SEQ ID NO: 504954 - DNA, 25 bp, Mus musculus
aagacactaaacaggagcgcagccg

SEQ ID NO: 504955 - DNA, 25 bp, Mus musculus
aagacactaaactggagcgcagccg

SEQ ID NO: 504956 - DNA, 25 bp, Mus musculus
aagacactatggacgtatggtgcaa

SEQ ID NO: 504957 - DNA, 25 bp, Mus musculus
aagacactatggtcgtatggtgcaa

SEQ ID NO: 504958 - DNA, 25 bp, Mus musculus
aagacactcagcagctcctcgagtg

SEQ ID NO: 504959 - DNA, 25 bp, Mus musculus
aagacactcagctgctcctcgagtg

SEQ ID NO: 504960 - DNA, 25 bp, Mus musculus
aagacactgaggctaacactcctct

SEQ ID NO: 504961 - DNA, 25 bp, Mus musculus
aagacactgagggtaacactcctct

SEQ ID NO: 504962 - DNA, 25 bp, Mus musculus
aagacactgcagctcctcaatgacc

SEQ ID NO: 504963 - DNA, 25 bp, Mus musculus
aagacactgcaggtcctcaatgacc

SEQ ID NO: 504964 - DNA, 25 bp, Mus musculus
aagacagaagagctgcgggtcccac

SEQ ID NO: 504965 - DNA, 25 bp, Mus musculus
aagacagaagaggtgcgggtcccac

SEQ ID NO: 504966 - DNA, 25 bp, Mus musculus
aagacagaagatagaaatgtgggac

SEQ ID NO: 504967 - DNA, 25 bp, Mus musculus
aagacagaagattgaaatgtgggac

SEQ ID NO: 504968 - DNA, 25 bp, Mus musculus
aagacagacagtaggaggattcgga

SEQ ID NO: 504969 - DNA, 25 bp, Mus musculus
aagacagacagttggaggattcgga

SEQ ID NO: 504970 - DNA, 25 bp, Mus musculus
aagacagagaatcaccacatcaacc

SEQ ID NO: 504971 - DNA, 25 bp, Mus musculus
aagacagagaatgaccacatcaacc

SEQ ID NO: 504972 - DNA, 25 bp, Mus musculus
aagacagagactcgacaggcccagt

SEQ ID NO: 504973 - DNA, 25 bp, Mus musculus
aagacagagactggacaggcccagt

SEQ ID NO: 504974 - DNA, 25 bp, Mus musculus
aagacagagcggcatgaatccagtg

SEQ ID NO: 504975 - DNA, 25 bp, Mus musculus
aagacagagcgggatgaatccagtg

SEQ ID NO: 504976 - DNA, 25 bp, Mus musculus
aagacagaggcgcagattgcccaca

SEQ ID NO: 504977 - DNA, 25 bp, Mus musculus
aagacagaggcggagattgcccaca

SEQ ID NO: 504978 - DNA, 25 bp, Mus musculus
aagacagagtcgctgcagtatgacc

SEQ ID NO: 504979 - DNA, 25 bp, Mus musculus
aagacagagtcggtgcagtatgacc

SEQ ID NO: 504980 - DNA, 25 bp, Mus musculus
aagacagatccgcaaccaacaagcc

SEQ ID NO: 504981 - DNA, 25 bp, Mus musculus
aagacagatccggaaccaacaagcc

SEQ ID NO: 504982 - DNA, 25 bp, Mus musculus
aagacagatcttctaccaccacttc

SEQ ID NO: 504983 - DNA, 25 bp, Mus musculus
aagacagatcttgtaccaccacttc

SEQ ID NO: 504984 - DNA, 25 bp, Mus musculus
aagacagatttgaccgctgtgccag

SEQ ID NO: 504985 - DNA, 25 bp, Mus musculus
aagacagatttgtccgctgtgccag

SEQ ID NO: 504986 - DNA, 25 bp, Mus musculus
aagacagcattcactggccatcagc

SEQ ID NO: 504987 - DNA, 25 bp, Mus musculus
aagacagcattctctggccatcagc

SEQ ID NO: 504988 - DNA, 25 bp, Mus musculus
aagacagccacacgccgcttcaaag

SEQ ID NO: 504989 - DNA, 25 bp, Mus musculus
aagacagccacaggccgcttcaaag

SEQ ID NO: 504990 - DNA, 25 bp, Mus musculus
aagacagcccttagcggccaatgcc

SEQ ID NO: 504991 - DNA, 25 bp, Mus musculus
aagacagccctttgcggccaatgcc

SEQ ID NO: 504992 - DNA, 25 bp, Mus musculus
aagacagctactaatgttcctgcca

SEQ ID NO: 504993 - DNA, 25 bp, Mus musculus
aagacagctacttatgttcctgcca

SEQ ID NO: 504994 - DNA, 25 bp, Mus musculus
aagacagcttgtacaaacatcgaag

SEQ ID NO: 504995 - DNA, 25 bp, Mus musculus
aagacagcttgttcaaacatcgaag

SEQ ID NO: 504996 - DNA, 25 bp, Mus musculus
aagacagctttgcactccatgcagc

SEQ ID NO: 504997 - DNA, 25 bp, Mus musculus
aagacagctttggactccatgcagc

SEQ ID NO: 504998 - DNA, 25 bp, Mus musculus
aagacaggagtgcagtgatttcaga

SEQ ID NO: 504999 - DNA, 25 bp, Mus musculus
aagacaggagtggagtgatttcaga

SEQ ID NO: 505000 - DNA, 25 bp, Mus musculus
aagacaggcaaactggaaatgagct

SEQ ID NO: 505001 - DNA, 25 bp, Mus musculus
aagacaggcaaagtggaaatgagct

SEQ ID NO: 505002 - DNA, 25 bp, Mus musculus
aagacaggccagcaacactcctagt

SEQ ID NO: 505003 - DNA, 25 bp, Mus musculus
aagacaggccaggaacactcctagt

SEQ ID NO: 505004 - DNA, 25 bp, Mus musculus
aagacagggacaacgcacttctgga

SEQ ID NO: 505005 - DNA, 25 bp, Mus musculus
aagacagggacatcgcacttctgga

SEQ ID NO: 505006 - DNA, 25 bp, Mus musculus
aagacaggtgctcacaccacggcag

SEQ ID NO: 505007 - DNA, 25 bp, Mus musculus
aagacaggtgctgacaccacggcag

SEQ ID NO: 505008 - DNA, 25 bp, Mus musculus
aagacagtgaccctccgatcagtga

SEQ ID NO: 505009 - DNA, 25 bp, Mus musculus
aagacagtgaccgtccgatcagtga

SEQ ID NO: 505010 - DNA, 25 bp, Mus musculus
aagacagtgtccctattggccctga

SEQ ID NO: 505011 - DNA, 25 bp, Mus musculus
aagacagtgtccgtattggccctga

SEQ ID NO: 505012 - DNA, 25 bp, Mus musculus
aagacataaattcctcagtgcagaa

SEQ ID NO: 505013 - DNA, 25 bp, Mus musculus
aagacataaattgctcagtgcagaa

SEQ ID NO: 505014 - DNA, 25 bp, Mus musculus
aagacataaggaatggcgaccccag

SEQ ID NO: 505015 - DNA, 25 bp, Mus musculus
aagacataaggattggcgaccccag

SEQ ID NO: 505016 - DNA, 25 bp, Mus musculus
aagacatagttccagatggcaggct

SEQ ID NO: 505017 - DNA, 25 bp, Mus musculus
aagacatagttcgagatggcaggct

SEQ ID NO: 505018 - DNA, 25 bp, Mus musculus
aagacatattgtaagcggctccagg

SEQ ID NO: 505019 - DNA, 25 bp, Mus musculus
aagacatattgttagcggctccagg

SEQ ID NO: 505020 - DNA, 25 bp, Mus musculus
aagacatccaccatccgcatggtga

SEQ ID NO: 505021 - DNA, 25 bp, Mus musculus
aagacatccaccttccgcatggtga

SEQ ID NO: 505022 - DNA, 25 bp, Mus musculus
aagacatccgggagaatgggatgaa

SEQ ID NO: 505023 - DNA, 25 bp, Mus musculus
aagacatccgggtgaatgggatgaa

SEQ ID NO: 505024 - DNA, 25 bp, Mus musculus
aagacatcgccacccctgtagaagg

SEQ ID NO: 505025 - DNA, 25 bp, Mus musculus
aagacatcgccagccctgtagaagg

SEQ ID NO: 505026 - DNA, 25 bp, Mus musculus
aagacatctgacaggctggagacag

SEQ ID NO: 505027 - DNA, 25 bp, Mus musculus
aagacatctgactggctggagacag

SEQ ID NO: 505028 - DNA, 25 bp, Mus musculus
aagacatgctcaaccagtgcaccct

SEQ ID NO: 505029 - DNA, 25 bp, Mus musculus
aagacatgctcatccagtgcaccct

SEQ ID NO: 505030 - DNA, 25 bp, Mus musculus
aagacatggacgagtgtagcagcac

SEQ ID NO: 505031 - DNA, 25 bp, Mus musculus
aagacatggacgtgtgtagcagcac

SEQ ID NO: 505032 - DNA, 25 bp, Mus musculus
aagacatggatgataaggaggaaga

SEQ ID NO: 505033 - DNA, 25 bp, Mus musculus
aagacatggatgttaaggaggaaga

SEQ ID NO: 505034 - DNA, 25 bp, Mus musculus
aagacatggcttaccatttagccat

SEQ ID NO: 505035 - DNA, 25 bp, Mus musculus
aagacatggctttccatttagccat

SEQ ID NO: 505036 - DNA, 25 bp, Mus musculus
aagacatgggcaacgtctccaaggg

SEQ ID NO: 505037 - DNA, 25 bp, Mus musculus
aagacatgggcatcgtctccaaggg

SEQ ID NO: 505038 - DNA, 25 bp, Mus musculus
aagacatgtaccatcatcctccgtg

SEQ ID NO: 505039 - DNA, 25 bp, Mus musculus
aagacatgtaccttcatcctccgtg

SEQ ID NO: 505040 - DNA, 25 bp, Mus musculus
aagacatgttgcatgaagtcaacag

SEQ ID NO: 505041 - DNA, 25 bp, Mus musculus
aagacatgttgcttgaagtcaacag

SEQ ID NO: 505042 - DNA, 25 bp, Mus musculus
aagaccaagactcccgcagcgtgag

SEQ ID NO: 505043 - DNA, 25 bp, Mus musculus
aagaccaagactgccgcagcgtgag

SEQ ID NO: 505044 - DNA, 25 bp, Mus musculus
aagaccaagagcaacggtgcagacc

SEQ ID NO: 505045 - DNA, 25 bp, Mus musculus
aagaccaagagctacggtgcagacc

SEQ ID NO: 505046 - DNA, 25 bp, Mus musculus
aagaccaagcagaccggctcgcggc

SEQ ID NO: 505047 - DNA, 25 bp, Mus musculus
aagaccaagcagtccggctcgcggc

SEQ ID NO: 505048 - DNA, 25 bp, Mus musculus
aagaccaagtttaaagagaccatcg

SEQ ID NO: 505049 - DNA, 25 bp, Mus musculus
aagaccaagttttaagagaccatcg

SEQ ID NO: 505050 - DNA, 25 bp, Mus musculus
aagaccaatggtatgccagtgcaga

SEQ ID NO: 505051 - DNA, 25 bp, Mus musculus
aagaccaatggtttgccagtgcaga

SEQ ID NO: 505052 - DNA, 25 bp, Mus musculus
aagaccacagttccctccttgctgg

SEQ ID NO: 505053 - DNA, 25 bp, Mus musculus
aagaccacagttgcctccttgctgg

SEQ ID NO: 505054 - DNA, 25 bp, Mus musculus
aagaccacatctactacccgcaggg

SEQ ID NO: 505055 - DNA, 25 bp, Mus musculus
aagaccacatcttctacccgcaggg

SEQ ID NO: 505056 - DNA, 25 bp, Mus musculus
aagaccacctgtagctgggccacac

SEQ ID NO: 505057 - DNA, 25 bp, Mus musculus
aagaccacctgttgctgggccacac

SEQ ID NO: 505058 - DNA, 25 bp, Mus musculus
aagaccaggaagaagcccaacgaga

SEQ ID NO: 505059 - DNA, 25 bp, Mus musculus
aagaccaggaagtagcccaacgaga

SEQ ID NO: 505060 - DNA, 25 bp, Mus musculus
aagaccagggctcagctagagagaa

SEQ ID NO: 505061 - DNA, 25 bp, Mus musculus
aagaccagggctgagctagagagaa

SEQ ID NO: 505062 - DNA, 25 bp, Mus musculus
aagaccatcaggagggctactggcc

SEQ ID NO: 505063 - DNA, 25 bp, Mus musculus
aagaccatcaggtgggctactggcc

SEQ ID NO: 505064 - DNA, 25 bp, Mus musculus
aagaccatcgcccagtgccttgcag

SEQ ID NO: 505065 - DNA, 25 bp, Mus musculus
aagaccatcgccgagtgccttgcag

SEQ ID NO: 505066 - DNA, 25 bp, Mus musculus
aagaccatcgtcataggaacccctg

SEQ ID NO: 505067 - DNA, 25 bp, Mus musculus
aagaccatcgtcttaggaacccctg

SEQ ID NO: 505068 - DNA, 25 bp, Mus musculus
aagacccacatccaggagtgcaaac

SEQ ID NO: 505069 - DNA, 25 bp, Mus musculus
aagacccacatcgaggagtgcaaac

SEQ ID NO: 505070 - DNA, 25 bp, Mus musculus
aagacccacggcctgagtgatgagc

SEQ ID NO: 505071 - DNA, 25 bp, Mus musculus
aagacccacggcgtgagtgatgagc

SEQ ID NO: 505072 - DNA, 25 bp, Mus musculus
aagacccagacaatggagaaaatgg

SEQ ID NO: 505073 - DNA, 25 bp, Mus musculus
aagacccagacattggagaaaatgg

SEQ ID NO: 505074 - DNA, 25 bp, Mus musculus
aagacccagaggctcctcggagctg

SEQ ID NO: 505075 - DNA, 25 bp, Mus musculus
aagacccagagggtcctcggagctg

SEQ ID NO: 505076 - DNA, 25 bp, Mus musculus
aagacccagggaagctccatgtcgg

SEQ ID NO: 505077 - DNA, 25 bp, Mus musculus
aagacccagggatgctccatgtcgg

SEQ ID NO: 505078 - DNA, 25 bp, Mus musculus
aagaccccaaccagtcatctgcagg

SEQ ID NO: 505079 - DNA, 25 bp, Mus musculus
aagaccccaacctgtcatctgcagg

SEQ ID NO: 505080 - DNA, 25 bp, Mus musculus
aagaccccaaggatgccctgcttcg

SEQ ID NO: 505081 - DNA, 25 bp, Mus musculus
aagaccccaaggttgccctgcttcg

SEQ ID NO: 505082 - DNA, 25 bp, Mus musculus
aagaccccactgaaggagcgtgtat

SEQ ID NO: 505083 - DNA, 25 bp, Mus musculus
aagaccccactgtaggagcgtgtat

SEQ ID NO: 505084 - DNA, 25 bp, Mus musculus
aagaccccgctcagttcctgcaggt

SEQ ID NO: 505085 - DNA, 25 bp, Mus musculus
aagaccccgctctgttcctgcaggt

SEQ ID NO: 505086 - DNA, 25 bp, Mus musculus
aagaccctaaccctatcatcgatgg

SEQ ID NO: 505087 - DNA, 25 bp, Mus musculus
aagaccctaaccgtatcatcgatgg

SEQ ID NO: 505088 - DNA, 25 bp, Mus musculus
aagaccctaagtctcaaggtgatga

SEQ ID NO: 505089 - DNA, 25 bp, Mus musculus
aagaccctaagtgtcaaggtgatga

SEQ ID NO: 505090 - DNA, 25 bp, Mus musculus
aagaccctgcaaaagtgtgagattg

SEQ ID NO: 505091 - DNA, 25 bp, Mus musculus
aagaccctgcaatagtgtgagattg

SEQ ID NO: 505092 - DNA, 25 bp, Mus musculus
aagaccctgcggctcacgtcggagc

SEQ ID NO: 505093 - DNA, 25 bp, Mus musculus
aagaccctgcgggtcacgtcggagc

SEQ ID NO: 505094 - DNA, 25 bp, Mus musculus
aagaccctgtccaagagaagctcgc

SEQ ID NO: 505095 - DNA, 25 bp, Mus musculus
aagaccctgtcctagagaagctcgc

SEQ ID NO: 505096 - DNA, 25 bp, Mus musculus
aagaccctttgcagttccaagaacg

SEQ ID NO: 505097 - DNA, 25 bp, Mus musculus
aagaccctttgctgttccaagaacg

SEQ ID NO: 505098 - DNA, 25 bp, Mus musculus
aagaccgacactacgggagcaaaca

SEQ ID NO: 505099 - DNA, 25 bp, Mus musculus
aagaccgacacttcgggagcaaaca

SEQ ID NO: 505100 - DNA, 25 bp, Mus musculus
aagaccgagctgctgtggcctcact

SEQ ID NO: 505101 - DNA, 25 bp, Mus musculus
aagaccgagctggtgtggcctcact

SEQ ID NO: 505102 - DNA, 25 bp, Mus musculus
aagaccgcagagacctgcaattcag

SEQ ID NO: 505103 - DNA, 25 bp, Mus musculus
aagaccgcagagtcctgcaattcag

SEQ ID NO: 505104 - DNA, 25 bp, Mus musculus
aagaccgcctatcgcatgaaggaca

SEQ ID NO: 505105 - DNA, 25 bp, Mus musculus
aagaccgcctatggcatgaaggaca

SEQ ID NO: 505106 - DNA, 25 bp, Mus musculus
aagaccgctggaatgttttacaaga

SEQ ID NO: 505107 - DNA, 25 bp, Mus musculus
aagaccgctggattgttttacaaga

SEQ ID NO: 505108 - DNA, 25 bp, Mus musculus
aagaccggcccgacagagacaatga

SEQ ID NO: 505109 - DNA, 25 bp, Mus musculus
aagaccggcccgtcagagacaatga

SEQ ID NO: 505110 - DNA, 25 bp, Mus musculus
aagaccggcctgaagtcggacaagc

SEQ ID NO: 505111 - DNA, 25 bp, Mus musculus
aagaccggcctgtagtcggacaagc

SEQ ID NO: 505112 - DNA, 25 bp, Mus musculus
aagaccggctgcatgatcgccagcg

SEQ ID NO: 505113 - DNA, 25 bp, Mus musculus
aagaccggctgcttgatcgccagcg

SEQ ID NO: 505114 - DNA, 25 bp, Mus musculus
aagaccgttccaacgctgtgtggga

SEQ ID NO: 505115 - DNA, 25 bp, Mus musculus
aagaccgttccatcgctgtgtggga

SEQ ID NO: 505116 - DNA, 25 bp, Mus musculus
aagacctaaggaagcagcggctgga

SEQ ID NO: 505117 - DNA, 25 bp, Mus musculus
aagacctaaggatgcagcggctgga

SEQ ID NO: 505118 - DNA, 25 bp, Mus musculus
aagacctcacttcctaaggcgcaga

SEQ ID NO: 505119 - DNA, 25 bp, Mus musculus
aagacctcacttgctaaggcgcaga

SEQ ID NO: 505120 - DNA, 25 bp, Mus musculus
aagacctcagtactgttcaacaagc

SEQ ID NO: 505121 - DNA, 25 bp, Mus musculus
aagacctcagtagtgttcaacaagc

SEQ ID NO: 505122 - DNA, 25 bp, Mus musculus
aagacctcagtgagttctaccctgg

SEQ ID NO: 505123 - DNA, 25 bp, Mus musculus
aagacctcagtgtgttctaccctgg

SEQ ID NO: 505124 - DNA, 25 bp, Mus musculus
aagacctcgcgcactcaggctctgg

SEQ ID NO: 505125 - DNA, 25 bp, Mus musculus
aagacctcgcgctctcaggctctgg

SEQ ID NO: 505126 - DNA, 25 bp, Mus musculus
aagacctcttctctcgaatcaacga

SEQ ID NO: 505127 - DNA, 25 bp, Mus musculus
aagacctcttctgtcgaatcaacga

SEQ ID NO: 505128 - DNA, 25 bp, Mus musculus
aagacctgaagaagggcctgcatct

SEQ ID NO: 505129 - DNA, 25 bp, Mus musculus
aagacctgaagatgggcctgcatct

SEQ ID NO: 505130 - DNA, 25 bp, Mus musculus
aagacctgcttcaggtagacacggc

SEQ ID NO: 505131 - DNA, 25 bp, Mus musculus
aagacctgcttctggtagacacggc

SEQ ID NO: 505132 - DNA, 25 bp, Mus musculus
aagacctggaataccgctctggagg

SEQ ID NO: 505133 - DNA, 25 bp, Mus musculus
aagacctggaattccgctctggagg

SEQ ID NO: 505134 - DNA, 25 bp, Mus musculus
aagacctggagaagaggaatctcag

SEQ ID NO: 505135 - DNA, 25 bp, Mus musculus
aagacctggagatgaggaatctcag

SEQ ID NO: 505136 - DNA, 25 bp, Mus musculus
aagacctgggctacgagacttgtgg

SEQ ID NO: 505137 - DNA, 25 bp, Mus musculus
aagacctgggcttcgagacttgtgg

SEQ ID NO: 505138 - DNA, 25 bp, Mus musculus
aagacctggttgaccatgtcaacga

SEQ ID NO: 505139 - DNA, 25 bp, Mus musculus
aagacctggttgtccatgtcaacga

SEQ ID NO: 505140 - DNA, 25 bp, Mus musculus
aagacctgtgcccactcagatgcag

SEQ ID NO: 505141 - DNA, 25 bp, Mus musculus
aagacctgtgccgactcagatgcag

SEQ ID NO: 505142 - DNA, 25 bp, Mus musculus
aagaccttctggatccagacccagg

SEQ ID NO: 505143 - DNA, 25 bp, Mus musculus
aagaccttctggttccagacccagg

SEQ ID NO: 505144 - DNA, 25 bp, Mus musculus
aagaccttgcagaccgactcctaag

SEQ ID NO: 505145 - DNA, 25 bp, Mus musculus
aagaccttgcagtccgactcctaag

SEQ ID NO: 505146 - DNA, 25 bp, Mus musculus
aagaccttgccactcagatctgcaa

SEQ ID NO: 505147 - DNA, 25 bp, Mus musculus
aagaccttgccagtcagatctgcaa

SEQ ID NO: 505148 - DNA, 25 bp, Mus musculus
aagaccttgggtaatggagcagaga

SEQ ID NO: 505149 - DNA, 25 bp, Mus musculus
aagaccttgggttatggagcagaga

SEQ ID NO: 505150 - DNA, 25 bp, Mus musculus
aagaccttttacagattgtccaggg

SEQ ID NO: 505151 - DNA, 25 bp, Mus musculus
aagaccttttactgattgtccaggg

SEQ ID NO: 505152 - DNA, 25 bp, Mus musculus
aagacgaagacgatcaagagggtga

SEQ ID NO: 505153 - DNA, 25 bp, Mus musculus
aagacgaagacgttcaagagggtga

SEQ ID NO: 505154 - DNA, 25 bp, Mus musculus
aagacgaagctgatgcggatctcat

SEQ ID NO: 505155 - DNA, 25 bp, Mus musculus
aagacgaagctgttgcggatctcat

SEQ ID NO: 505156 - DNA, 25 bp, Mus musculus
aagacgacggacagccccggactct

SEQ ID NO: 505157 - DNA, 25 bp, Mus musculus
aagacgacggactgccccggactct

SEQ ID NO: 505158 - DNA, 25 bp, Mus musculus
aagacgatgctcaatgatcttctgc

SEQ ID NO: 505159 - DNA, 25 bp, Mus musculus
aagacgatgctctatgatcttctgc

SEQ ID NO: 505160 - DNA, 25 bp, Mus musculus
aagacgcaattcaggtgcctcaact

SEQ ID NO: 505161 - DNA, 25 bp, Mus musculus
aagacgcaattctggtgcctcaact

SEQ ID NO: 505162 - DNA, 25 bp, Mus musculus
aagacgcagaagctttcttccagga

SEQ ID NO: 505163 - DNA, 25 bp, Mus musculus
aagacgcagaaggtttcttccagga

SEQ ID NO: 505164 - DNA, 25 bp, Mus musculus
aagacgcagaataggcaaactctgt

SEQ ID NO: 505165 - DNA, 25 bp, Mus musculus
aagacgcagaattggcaaactctgt

SEQ ID NO: 505166 - DNA, 25 bp, Mus musculus
aagacgctaattctgccaaggctgc

SEQ ID NO: 505167 - DNA, 25 bp, Mus musculus
aagacgctaattgtgccaaggctgc

SEQ ID NO: 505168 - DNA, 25 bp, Mus musculus
aagacgctcggactatctcagaacg

SEQ ID NO: 505169 - DNA, 25 bp, Mus musculus
aagacgctcggagtatctcagaacg

SEQ ID NO: 505170 - DNA, 25 bp, Mus musculus
aagacgctgcctcccaggattgaaa

SEQ ID NO: 505171 - DNA, 25 bp, Mus musculus
aagacgctgcctgccaggattgaaa

SEQ ID NO: 505172 - DNA, 25 bp, Mus musculus
aagacgctgcgtctcctggcctcag

SEQ ID NO: 505173 - DNA, 25 bp, Mus musculus
aagacgctgcgtgtcctggcctcag

SEQ ID NO: 505174 - DNA, 25 bp, Mus musculus
aagacgctggtgctcagagaccgca

SEQ ID NO: 505175 - DNA, 25 bp, Mus musculus
aagacgctggtggtcagagaccgca

SEQ ID NO: 505176 - DNA, 25 bp, Mus musculus
aagacggacatccatggaaagttcc

SEQ ID NO: 505177 - DNA, 25 bp, Mus musculus
aagacggacatcgatggaaagttcc

SEQ ID NO: 505178 - DNA, 25 bp, Mus musculus
aagacggcgggcaagtctactatca

SEQ ID NO: 505179 - DNA, 25 bp, Mus musculus
aagacggcgggctagtctactatca

SEQ ID NO: 505180 - DNA, 25 bp, Mus musculus
aagacggtggcccaaatgcccccag

SEQ ID NO: 505181 - DNA, 25 bp, Mus musculus
aagacggtggccgaaatgcccccag

SEQ ID NO: 505182 - DNA, 25 bp, Mus musculus
aagacgtagtacacatggtgggcat

SEQ ID NO: 505183 - DNA, 25 bp, Mus musculus
aagacgtagtactcatggtgggcat

SEQ ID NO: 505184 - DNA, 25 bp, Mus musculus
aagacgtcgcaaatacaaagatgga

SEQ ID NO: 505185 - DNA, 25 bp, Mus musculus
aagacgtcgcaattacaaagatgga

SEQ ID NO: 505186 - DNA, 25 bp, Mus musculus
aagacgtctcaaaccttcatccttg

SEQ ID NO: 505187 - DNA, 25 bp, Mus musculus
aagacgtctcaatccttcatccttg

SEQ ID NO: 505188 - DNA, 25 bp, Mus musculus
aagacgtgagagagctgttgcgaca

SEQ ID NO: 505189 - DNA, 25 bp, Mus musculus
aagacgtgagagtgctgttgcgaca

SEQ ID NO: 505190 - DNA, 25 bp, Mus musculus
aagacgtgctgacacctctggaaca

SEQ ID NO: 505191 - DNA, 25 bp, Mus musculus
aagacgtgctgagacctctggaaca

SEQ ID NO: 505192 - DNA, 25 bp, Mus musculus
aagacgtgtgctcagtctgacttcg

SEQ ID NO: 505193 - DNA, 25 bp, Mus musculus
aagacgtgtgctgagtctgacttcg

SEQ ID NO: 505194 - DNA, 25 bp, Mus musculus
aagacgttcgagctgctccctatga

SEQ ID NO: 505195 - DNA, 25 bp, Mus musculus
aagacgttcgaggtgctccctatga

SEQ ID NO: 505196 - DNA, 25 bp, Mus musculus
aagactaaaatacggcacagtggct

SEQ ID NO: 505197 - DNA, 25 bp, Mus musculus
aagactaaaatagggcacagtggct

SEQ ID NO: 505198 - DNA, 25 bp, Mus musculus
aagactaaaggtaccagatggtgcc

SEQ ID NO: 505199 - DNA, 25 bp, Mus musculus
aagactaaaggttccagatggtgcc

SEQ ID NO: 505200 - DNA, 25 bp, Mus musculus
aagactacgacacccacattaagag

SEQ ID NO: 505201 - DNA, 25 bp, Mus musculus
aagactacgacagccacattaagag

SEQ ID NO: 505202 - DNA, 25 bp, Mus musculus
aagactacttctacaaggcggccct

SEQ ID NO: 505203 - DNA, 25 bp, Mus musculus
aagactacttcttcaaggcggccct

SEQ ID NO: 505204 - DNA, 25 bp, Mus musculus
aagactataagcatcctctcctggg

SEQ ID NO: 505205 - DNA, 25 bp, Mus musculus
aagactataagcttcctctcctggg

SEQ ID NO: 505206 - DNA, 25 bp, Mus musculus
aagactatgatgaagaaagctcaga

SEQ ID NO: 505207 - DNA, 25 bp, Mus musculus
aagactatgatgtagaaagctcaga

SEQ ID NO: 505208 - DNA, 25 bp, Mus musculus
aagactcaaattcagcagggaggcc

SEQ ID NO: 505209 - DNA, 25 bp, Mus musculus
aagactcaaattgagcagggaggcc

SEQ ID NO: 505210 - DNA, 25 bp, Mus musculus
aagactcagcacaaagtcatccagt

SEQ ID NO: 505211 - DNA, 25 bp, Mus musculus
aagactcagcactaagtcatccagt

SEQ ID NO: 505212 - DNA, 25 bp, Mus musculus
aagactcaggccagctccgggtccg

SEQ ID NO: 505213 - DNA, 25 bp, Mus musculus
aagactcaggcctgctccgggtccg

SEQ ID NO: 505214 - DNA, 25 bp, Mus musculus
aagactcagggccaggaaaagcagc

SEQ ID NO: 505215 - DNA, 25 bp, Mus musculus
aagactcagggcgaggaaaagcagc

SEQ ID NO: 505216 - DNA, 25 bp, Mus musculus
aagactcaggttagggtgttttgct

SEQ ID NO: 505217 - DNA, 25 bp, Mus musculus
aagactcaggtttgggtgttttgct

SEQ ID NO: 505218 - DNA, 25 bp, Mus musculus
aagactcatcataccagggcacgga

SEQ ID NO: 505219 - DNA, 25 bp, Mus musculus
aagactcatcattccagggcacgga

SEQ ID NO: 505220 - DNA, 25 bp, Mus musculus
aagactcatgcaccaggaacgagtt

SEQ ID NO: 505221 - DNA, 25 bp, Mus musculus
aagactcatgcagcaggaacgagtt

SEQ ID NO: 505222 - DNA, 25 bp, Mus musculus
aagactcccaaaaacctgacctctg

SEQ ID NO: 505223 - DNA, 25 bp, Mus musculus
aagactcccaaatacctgacctctg

SEQ ID NO: 505224 - DNA, 25 bp, Mus musculus
aagactcctaccagcctgtgtgcaa

SEQ ID NO: 505225 - DNA, 25 bp, Mus musculus
aagactcctacctgcctgtgtgcaa

SEQ ID NO: 505226 - DNA, 25 bp, Mus musculus
aagactcctgatattgagtctacag

SEQ ID NO: 505227 - DNA, 25 bp, Mus musculus
aagactcctgattttgagtctacag

SEQ ID NO: 505228 - DNA, 25 bp, Mus musculus
aagactcctgtcacattccaagaaa

SEQ ID NO: 505229 - DNA, 25 bp, Mus musculus
aagactcctgtctcattccaagaaa

SEQ ID NO: 505230 - DNA, 25 bp, Mus musculus
aagactcctttcatgcttgttggga

SEQ ID NO: 505231 - DNA, 25 bp, Mus musculus
aagactcctttcttgcttgttggga

SEQ ID NO: 505232 - DNA, 25 bp, Mus musculus
aagactcgagtgcagtgccacagca

SEQ ID NO: 505233 - DNA, 25 bp, Mus musculus
aagactcgagtggagtgccacagca

SEQ ID NO: 505234 - DNA, 25 bp, Mus musculus
aagactcggtgtcgaagtttgccca

SEQ ID NO: 505235 - DNA, 25 bp, Mus musculus
aagactcggtgtggaagtttgccca

SEQ ID NO: 505236 - DNA, 25 bp, Mus musculus
aagactctagcaagactgttgtgga

SEQ ID NO: 505237 - DNA, 25 bp, Mus musculus
aagactctagcatgactgttgtgga

SEQ ID NO: 505238 - DNA, 25 bp, Mus musculus
aagactctgagaaggactgtaactg

SEQ ID NO: 505239 - DNA, 25 bp, Mus musculus
aagactctgagatggactgtaactg

SEQ ID NO: 505240 - DNA, 25 bp, Mus musculus
aagactctgaggcagaaaatgaaga

SEQ ID NO: 505241 - DNA, 25 bp, Mus musculus
aagactctgagggagaaaatgaaga

SEQ ID NO: 505242 - DNA, 25 bp, Mus musculus
aagactctgcttccccgagcctgtg

SEQ ID NO: 505243 - DNA, 25 bp, Mus musculus
aagactctgcttgcccgagcctgtg

SEQ ID NO: 505244 - DNA, 25 bp, Mus musculus
aagactctggtactggctgttgtca

SEQ ID NO: 505245 - DNA, 25 bp, Mus musculus
aagactctggtagtggctgttgtca

SEQ ID NO: 505246 - DNA, 25 bp, Mus musculus
aagactcttcaaacagctcatcaag

SEQ ID NO: 505247 - DNA, 25 bp, Mus musculus
aagactcttcaatcagctcatcaag

SEQ ID NO: 505248 - DNA, 25 bp, Mus musculus
aagactcttctgctatcgatccaca

SEQ ID NO: 505249 - DNA, 25 bp, Mus musculus
aagactcttctggtatcgatccaca

SEQ ID NO: 505250 - DNA, 25 bp, Mus musculus
aagactgaacgaatttcgaaggacg

SEQ ID NO: 505251 - DNA, 25 bp, Mus musculus
aagactgaacgattttcgaaggacg

SEQ ID NO: 505252 - DNA, 25 bp, Mus musculus
aagactgaacttactcctcggcccg

SEQ ID NO: 505253 - DNA, 25 bp, Mus musculus
aagactgaactttctcctcggcccg

SEQ ID NO: 505254 - DNA, 25 bp, Mus musculus
aagactgaccttcgacacatcctag

SEQ ID NO: 505255 - DNA, 25 bp, Mus musculus
aagactgaccttggacacatcctag

SEQ ID NO: 505256 - DNA, 25 bp, Mus musculus
aagactgactccctccacacttttt

SEQ ID NO: 505257 - DNA, 25 bp, Mus musculus
aagactgactccgtccacacttttt

SEQ ID NO: 505258 - DNA, 25 bp, Mus musculus
aagactgactgcaggctacggcctg

SEQ ID NO: 505259 - DNA, 25 bp, Mus musculus
aagactgactgctggctacggcctg

SEQ ID NO: 505260 - DNA, 25 bp, Mus musculus
aagactgagaccaggataccgggag

SEQ ID NO: 505261 - DNA, 25 bp, Mus musculus
aagactgagacctggataccgggag

SEQ ID NO: 505262 - DNA, 25 bp, Mus musculus
aagactgagaggacatagggaatac

SEQ ID NO: 505263 - DNA, 25 bp, Mus musculus
aagactgagaggtcatagggaatac

SEQ ID NO: 505264 - DNA, 25 bp, Mus musculus
aagactgatggaagccctgttccct

SEQ ID NO: 505265 - DNA, 25 bp, Mus musculus
aagactgatggatgccctgttccct

SEQ ID NO: 505266 - DNA, 25 bp, Mus musculus
aagactgcaactcagcagaagccat

SEQ ID NO: 505267 - DNA, 25 bp, Mus musculus
aagactgcaactgagcagaagccat

SEQ ID NO: 505268 - DNA, 25 bp, Mus musculus
aagactgcagttcatcttgagccat

SEQ ID NO: 505269 - DNA, 25 bp, Mus musculus
aagactgcagttgatcttgagccat

SEQ ID NO: 505270 - DNA, 25 bp, Mus musculus
aagactgcctatactgaaccagcca

SEQ ID NO: 505271 - DNA, 25 bp, Mus musculus
aagactgcctattctgaaccagcca

SEQ ID NO: 505272 - DNA, 25 bp, Mus musculus
aagactgccttacggctggccaggc

SEQ ID NO: 505273 - DNA, 25 bp, Mus musculus
aagactgccttagggctggccaggc

SEQ ID NO: 505274 - DNA, 25 bp, Mus musculus
aagactgctagcaactttgggacaa

SEQ ID NO: 505275 - DNA, 25 bp, Mus musculus
aagactgctagctactttgggacaa

SEQ ID NO: 505276 - DNA, 25 bp, Mus musculus
aagactgctgagagtgtgggtaatc

SEQ ID NO: 505277 - DNA, 25 bp, Mus musculus
aagactgctgagtgtgtgggtaatc

SEQ ID NO: 505278 - DNA, 25 bp, Mus musculus
aagactggaccgatattgattgagc

SEQ ID NO: 505279 - DNA, 25 bp, Mus musculus
aagactggaccgttattgattgagc

SEQ ID NO: 505280 - DNA, 25 bp, Mus musculus
aagactggtgctccctgccgttcag

SEQ ID NO: 505281 - DNA, 25 bp, Mus musculus
aagactggtgctgcctgccgttcag

SEQ ID NO: 505282 - DNA, 25 bp, Mus musculus
aagactggttctcatcttttctgcg

SEQ ID NO: 505283 - DNA, 25 bp, Mus musculus
aagactggttctgatcttttctgcg

SEQ ID NO: 505284 - DNA, 25 bp, Mus musculus
aagactgtcaccctcgtgctcgtcg

SEQ ID NO: 505285 - DNA, 25 bp, Mus musculus
aagactgtcaccgtcgtgctcgtcg

SEQ ID NO: 505286 - DNA, 25 bp, Mus musculus
aagactgtgcggatggcagcgacga

SEQ ID NO: 505287 - DNA, 25 bp, Mus musculus
aagactgtgcggttggcagcgacga

SEQ ID NO: 505288 - DNA, 25 bp, Mus musculus
aagacttactatatgtccgctggcc

SEQ ID NO: 505289 - DNA, 25 bp, Mus musculus
aagacttactatttgtccgctggcc

SEQ ID NO: 505290 - DNA, 25 bp, Mus musculus
aagacttagagtagagaagggagcc

SEQ ID NO: 505291 - DNA, 25 bp, Mus musculus
aagacttagagttgagaagggagcc

SEQ ID NO: 505292 - DNA, 25 bp, Mus musculus
aagacttcagcaacccaagcacgca

SEQ ID NO: 505293 - DNA, 25 bp, Mus musculus
aagacttcagcatcccaagcacgca

SEQ ID NO: 505294 - DNA, 25 bp, Mus musculus
aagacttcatagacgtcctgatgta

SEQ ID NO: 505295 - DNA, 25 bp, Mus musculus
aagacttcatagtcgtcctgatgta

SEQ ID NO: 505296 - DNA, 25 bp, Mus musculus
aagacttctgacagtactttccttg

SEQ ID NO: 505297 - DNA, 25 bp, Mus musculus
aagacttctgactgtactttccttg

SEQ ID NO: 505298 - DNA, 25 bp, Mus musculus
aagacttgcagacccacatgatcaa

SEQ ID NO: 505299 - DNA, 25 bp, Mus musculus
aagacttgcagagccacatgatcaa

SEQ ID NO: 505300 - DNA, 25 bp, Mus musculus
aagacttgcctgactcgcaacagca

SEQ ID NO: 505301 - DNA, 25 bp, Mus musculus
aagacttgcctgtctcgcaacagca

SEQ ID NO: 505302 - DNA, 25 bp, Mus musculus
aagacttgctctctcttcatgcgca

SEQ ID NO: 505303 - DNA, 25 bp, Mus musculus
aagacttgctctgtcttcatgcgca

SEQ ID NO: 505304 - DNA, 25 bp, Mus musculus
aagacttggaaacagatggcttaac

SEQ ID NO: 505305 - DNA, 25 bp, Mus musculus
aagacttggaaagagatggcttaac

SEQ ID NO: 505306 - DNA, 25 bp, Mus musculus
aagacttggacccattccaggaggc

SEQ ID NO: 505307 - DNA, 25 bp, Mus musculus
aagacttggaccgattccaggaggc

SEQ ID NO: 505308 - DNA, 25 bp, Mus musculus
aagacttgtgttagagcttgggctg

SEQ ID NO: 505309 - DNA, 25 bp, Mus musculus
aagacttgtgtttgagcttgggctg

SEQ ID NO: 505310 - DNA, 25 bp, Mus musculus
aagactttgagcagcgtttgaatca

SEQ ID NO: 505311 - DNA, 25 bp, Mus musculus
aagactttgagctgcgtttgaatca

SEQ ID NO: 505312 - DNA, 25 bp, Mus musculus
aagactttgctgctaacgtgtacga

SEQ ID NO: 505313 - DNA, 25 bp, Mus musculus
aagactttgctggtaacgtgtacga

SEQ ID NO: 505314 - DNA, 25 bp, Mus musculus
aagactttgtagagtacatgacaca

SEQ ID NO: 505315 - DNA, 25 bp, Mus musculus
aagactttgtagtgtacatgacaca

SEQ ID NO: 505316 - DNA, 25 bp, Mus musculus
aagacttttaagaagatacccatgg

SEQ ID NO: 505317 - DNA, 25 bp, Mus musculus
aagacttttaagtagatacccatgg

SEQ ID NO: 505318 - DNA, 25 bp, Mus musculus
aagagaaaaagtagtagaagccacg

SEQ ID NO: 505319 - DNA, 25 bp, Mus musculus
aagagaaaaagttgtagaagccacg

SEQ ID NO: 505320 - DNA, 25 bp, Mus musculus
aagagaaaccagagtggccgctgag

SEQ ID NO: 505321 - DNA, 25 bp, Mus musculus
aagagaaaccagtgtggccgctgag

SEQ ID NO: 505322 - DNA, 25 bp, Mus musculus
aagagaaagaggagtttgcccatga

SEQ ID NO: 505323 - DNA, 25 bp, Mus musculus
aagagaaagaggtgtttgcccatga

SEQ ID NO: 505324 - DNA, 25 bp, Mus musculus
aagagaacagagagctggtcagtga

SEQ ID NO: 505325 - DNA, 25 bp, Mus musculus
aagagaacagagtgctggtcagtga

SEQ ID NO: 505326 - DNA, 25 bp, Mus musculus
aagagaacagcccaacttcagggct

SEQ ID NO: 505327 - DNA, 25 bp, Mus musculus
aagagaacagccgaacttcagggct

SEQ ID NO: 505328 - DNA, 25 bp, Mus musculus
aagagaaccacaccaatcagccctt

SEQ ID NO: 505329 - DNA, 25 bp, Mus musculus
aagagaaccacagcaatcagccctt

SEQ ID NO: 505330 - DNA, 25 bp, Mus musculus
aagagaacgaccacctgcgagagga

SEQ ID NO: 505331 - DNA, 25 bp, Mus musculus
aagagaacgacctcctgcgagagga

SEQ ID NO: 505332 - DNA, 25 bp, Mus musculus
aagagaacttcgagtgagctgcagc

SEQ ID NO: 505333 - DNA, 25 bp, Mus musculus
aagagaacttcgtgtgagctgcagc

SEQ ID NO: 505334 - DNA, 25 bp, Mus musculus
aagagaacttctcgccctggtgaag

SEQ ID NO: 505335 - DNA, 25 bp, Mus musculus
aagagaacttctggccctggtgaag

SEQ ID NO: 505336 - DNA, 25 bp, Mus musculus
aagagaagagatcgagagcaaaaag

SEQ ID NO: 505337 - DNA, 25 bp, Mus musculus
aagagaagagatggagagcaaaaag

SEQ ID NO: 505338 - DNA, 25 bp, Mus musculus
aagagaagcaccatgacctggagcg

SEQ ID NO: 505339 - DNA, 25 bp, Mus musculus
aagagaagcaccttgacctggagcg

SEQ ID NO: 505340 - DNA, 25 bp, Mus musculus
aagagaagcatcagcgattcaatcc

SEQ ID NO: 505341 - DNA, 25 bp, Mus musculus
aagagaagcatctgcgattcaatcc

SEQ ID NO: 505342 - DNA, 25 bp, Mus musculus
aagagaagctcgaggccagcgaact

SEQ ID NO: 505343 - DNA, 25 bp, Mus musculus
aagagaagctcgtggccagcgaact

SEQ ID NO: 505344 - DNA, 25 bp, Mus musculus
aagagaagctgacctcctccgtgcc

SEQ ID NO: 505345 - DNA, 25 bp, Mus musculus
aagagaagctgagctcctccgtgcc

SEQ ID NO: 505346 - DNA, 25 bp, Mus musculus
aagagaaggacaaactcagcaccgc

SEQ ID NO: 505347 - DNA, 25 bp, Mus musculus
aagagaaggacatactcagcaccgc

SEQ ID NO: 505348 - DNA, 25 bp, Mus musculus
aagagaaggatacagtaaccccagc

SEQ ID NO: 505349 - DNA, 25 bp, Mus musculus
aagagaaggatagagtaaccccagc

SEQ ID NO: 505350 - DNA, 25 bp, Mus musculus
aagagaaggttcaggtgaccaccaa

SEQ ID NO: 505351 - DNA, 25 bp, Mus musculus
aagagaaggttctggtgaccaccaa

SEQ ID NO: 505352 - DNA, 25 bp, Mus musculus
aagagaagtcacagtccatctccat

SEQ ID NO: 505353 - DNA, 25 bp, Mus musculus
aagagaagtcactgtccatctccat

SEQ ID NO: 505354 - DNA, 25 bp, Mus musculus
aagagaagtcgacgcagctgcaaca

SEQ ID NO: 505355 - DNA, 25 bp, Mus musculus
aagagaagtcgaggcagctgcaaca

SEQ ID NO: 505356 - DNA, 25 bp, Mus musculus
aagagacacctgagcagctaacaaa

SEQ ID NO: 505357 - DNA, 25 bp, Mus musculus
aagagacacctgtgcagctaacaaa

SEQ ID NO: 505358 - DNA, 25 bp, Mus musculus
aagagacacgctccatggctcggaa

SEQ ID NO: 505359 - DNA, 25 bp, Mus musculus
aagagacacgctgcatggctcggaa

SEQ ID NO: 505360 - DNA, 25 bp, Mus musculus
aagagacagtagagcgagacaaggc

SEQ ID NO: 505361 - DNA, 25 bp, Mus musculus
aagagacagtagtgcgagacaaggc

SEQ ID NO: 505362 - DNA, 25 bp, Mus musculus
aagagacccaaaatggaggagagag

SEQ ID NO: 505363 - DNA, 25 bp, Mus musculus
aagagacccaaattggaggagagag

SEQ ID NO: 505364 - DNA, 25 bp, Mus musculus
aagagaccgactcctcggagcagga

SEQ ID NO: 505365 - DNA, 25 bp, Mus musculus
aagagaccgactgctcggagcagga

SEQ ID NO: 505366 - DNA, 25 bp, Mus musculus
aagagacgatggacttccgatcagg

SEQ ID NO: 505367 - DNA, 25 bp, Mus musculus
aagagacgatggtcttccgatcagg

SEQ ID NO: 505368 - DNA, 25 bp, Mus musculus
aagagacgtctcaacctggttctgg

SEQ ID NO: 505369 - DNA, 25 bp, Mus musculus
aagagacgtctctacctggttctgg

SEQ ID NO: 505370 - DNA, 25 bp, Mus musculus
aagagactacaaacagccctgttgt

SEQ ID NO: 505371 - DNA, 25 bp, Mus musculus
aagagactacaatcagccctgttgt

SEQ ID NO: 505372 - DNA, 25 bp, Mus musculus
aagagactcctgcagaatccgaaag

SEQ ID NO: 505373 - DNA, 25 bp, Mus musculus
aagagactcctggagaatccgaaag

SEQ ID NO: 505374 - DNA, 25 bp, Mus musculus
aagagactcggcagctgctatccag

SEQ ID NO: 505375 - DNA, 25 bp, Mus musculus
aagagactcggctgctgctatccag

SEQ ID NO: 505376 - DNA, 25 bp, Mus musculus
aagagactctggaaccgggcctcga

SEQ ID NO: 505377 - DNA, 25 bp, Mus musculus
aagagactctggtaccgggcctcga

SEQ ID NO: 505378 - DNA, 25 bp, Mus musculus
aagagagaaccccagcatactgaca

SEQ ID NO: 505379 - DNA, 25 bp, Mus musculus
aagagagaacccgagcatactgaca

SEQ ID NO: 505380 - DNA, 25 bp, Mus musculus
aagagagaactgcaaagaccagcac

SEQ ID NO: 505381 - DNA, 25 bp, Mus musculus
aagagagaactggaaagaccagcac

SEQ ID NO: 505382 - DNA, 25 bp, Mus musculus
aagagagactggataggatgctacg

SEQ ID NO: 505383 - DNA, 25 bp, Mus musculus
aagagagactggttaggatgctacg

SEQ ID NO: 505384 - DNA, 25 bp, Mus musculus
aagagagagaaactgacagagttga

SEQ ID NO: 505385 - DNA, 25 bp, Mus musculus
aagagagagaaagtgacagagttga

SEQ ID NO: 505386 - DNA, 25 bp, Mus musculus
aagagagagccaagccggaaatgca

SEQ ID NO: 505387 - DNA, 25 bp, Mus musculus
aagagagagccatgccggaaatgca

SEQ ID NO: 505388 - DNA, 25 bp, Mus musculus
aagagagcagttcagatcaccggca

SEQ ID NO: 505389 - DNA, 25 bp, Mus musculus
aagagagcagttgagatcaccggca

SEQ ID NO: 505390 - DNA, 25 bp, Mus musculus
aagagagcattgcactccccaggac

SEQ ID NO: 505391 - DNA, 25 bp, Mus musculus
aagagagcattggactccccaggac

SEQ ID NO: 505392 - DNA, 25 bp, Mus musculus
aagagagccacaaccactgggagca

SEQ ID NO: 505393 - DNA, 25 bp, Mus musculus
aagagagccacatccactgggagca

SEQ ID NO: 505394 - DNA, 25 bp, Mus musculus
aagagagctgcaagaggtacctgca

SEQ ID NO: 505395 - DNA, 25 bp, Mus musculus
aagagagctgcatgaggtacctgca

SEQ ID NO: 505396 - DNA, 25 bp, Mus musculus
aagagagctgcgaccccggctctgc

SEQ ID NO: 505397 - DNA, 25 bp, Mus musculus
aagagagctgcgtccccggctctgc

SEQ ID NO: 505398 - DNA, 25 bp, Mus musculus
aagagagcttgaccctcttcaaggc

SEQ ID NO: 505399 - DNA, 25 bp, Mus musculus
aagagagcttgagcctcttcaaggc

SEQ ID NO: 505400 - DNA, 25 bp, Mus musculus
aagagaggatctacaggtattggta

SEQ ID NO: 505401 - DNA, 25 bp, Mus musculus
aagagaggatcttcaggtattggta

SEQ ID NO: 505402 - DNA, 25 bp, Mus musculus
aagagaggccggaaaaagaagcgct

SEQ ID NO: 505403 - DNA, 25 bp, Mus musculus
aagagaggccggtaaaagaagcgct

SEQ ID NO: 505404 - DNA, 25 bp, Mus musculus
aagagaggctgtcaaagaggcccct

SEQ ID NO: 505405 - DNA, 25 bp, Mus musculus
aagagaggctgtgaaagaggcccct

SEQ ID NO: 505406 - DNA, 25 bp, Mus musculus
aagagaggcttacaagggtccttcg

SEQ ID NO: 505407 - DNA, 25 bp, Mus musculus
aagagaggcttagaagggtccttcg

SEQ ID NO: 505408 - DNA, 25 bp, Mus musculus
aagagagggaagcaattaaatcgtc

SEQ ID NO: 505409 - DNA, 25 bp, Mus musculus
aagagagggaaggaattaaatcgtc

SEQ ID NO: 505410 - DNA, 25 bp, Mus musculus
aagagaggtactcctcccggagcct

SEQ ID NO: 505411 - DNA, 25 bp, Mus musculus
aagagaggtactgctcccggagcct

SEQ ID NO: 505412 - DNA, 25 bp, Mus musculus
aagagagtcaggccatcgctggaca

SEQ ID NO: 505413 - DNA, 25 bp, Mus musculus
aagagagtcagggcatcgctggaca

SEQ ID NO: 505414 - DNA, 25 bp, Mus musculus
aagagagtcttcattggagtgggca

SEQ ID NO: 505415 - DNA, 25 bp, Mus musculus
aagagagtcttctttggagtgggca

SEQ ID NO: 505416 - DNA, 25 bp, Mus musculus
aagagagtgagaaatgcacccaggg

SEQ ID NO: 505417 - DNA, 25 bp, Mus musculus
aagagagtgagatatgcacccaggg

SEQ ID NO: 505418 - DNA, 25 bp, Mus musculus
aagagagttcctaattttactgtga

SEQ ID NO: 505419 - DNA, 25 bp, Mus musculus
aagagagttccttattttactgtga

SEQ ID NO: 505420 - DNA, 25 bp, Mus musculus
aagagataagtgcatcgaaagtcac

SEQ ID NO: 505421 - DNA, 25 bp, Mus musculus
aagagataagtggatcgaaagtcac

SEQ ID NO: 505422 - DNA, 25 bp, Mus musculus
aagagatacaagactgaatggcttc

SEQ ID NO: 505423 - DNA, 25 bp, Mus musculus
aagagatacaagtctgaatggcttc

SEQ ID NO: 505424 - DNA, 25 bp, Mus musculus
aagagatccgcccagtctgccgcaa

SEQ ID NO: 505425 - DNA, 25 bp, Mus musculus
aagagatccgccgagtctgccgcaa

SEQ ID NO: 505426 - DNA, 25 bp, Mus musculus
aagagatctacaagcctctgcattc

SEQ ID NO: 505427 - DNA, 25 bp, Mus musculus
aagagatctacatgcctctgcattc

SEQ ID NO: 505428 - DNA, 25 bp, Mus musculus
aagagatgaaggctctcctcacact

SEQ ID NO: 505429 - DNA, 25 bp, Mus musculus
aagagatgaagggtctcctcacact

SEQ ID NO: 505430 - DNA, 25 bp, Mus musculus
aagagatgagacatacaagccccac

SEQ ID NO: 505431 - DNA, 25 bp, Mus musculus
aagagatgagacttacaagccccac

SEQ ID NO: 505432 - DNA, 25 bp, Mus musculus
aagagatggaataccttgccttcag

SEQ ID NO: 505433 - DNA, 25 bp, Mus musculus
aagagatggaattccttgccttcag

SEQ ID NO: 505434 - DNA, 25 bp, Mus musculus
aagagatggacaccaaccccatggt

SEQ ID NO: 505435 - DNA, 25 bp, Mus musculus
aagagatggacagcaaccccatggt

SEQ ID NO: 505436 - DNA, 25 bp, Mus musculus
aagagatggtggcacttctattggc

SEQ ID NO: 505437 - DNA, 25 bp, Mus musculus
aagagatggtgggacttctattggc

SEQ ID NO: 505438 - DNA, 25 bp, Mus musculus
aagagatgtcgaagcaaattcaacc

SEQ ID NO: 505439 - DNA, 25 bp, Mus musculus
aagagatgtcgatgcaaattcaacc

SEQ ID NO: 505440 - DNA, 25 bp, Mus musculus
aagagattatatcaggtatgccatt

SEQ ID NO: 505441 - DNA, 25 bp, Mus musculus
aagagattatatgaggtatgccatt

SEQ ID NO: 505442 - DNA, 25 bp, Mus musculus
aagagattctgacgattagagaggc

SEQ ID NO: 505443 - DNA, 25 bp, Mus musculus
aagagattctgaggattagagaggc

SEQ ID NO: 505444 - DNA, 25 bp, Mus musculus
aagagattgcctacaaagacctgga

SEQ ID NO: 505445 - DNA, 25 bp, Mus musculus
aagagattgccttcaaagacctgga

SEQ ID NO: 505446 - DNA, 25 bp, Mus musculus
aagagcaaaacgaccaactacctgg

SEQ ID NO: 505447 - DNA, 25 bp, Mus musculus
aagagcaaaacgtccaactacctgg

SEQ ID NO: 505448 - DNA, 25 bp, Mus musculus
aagagcaaactcatccgttctcaga

SEQ ID NO: 505449 - DNA, 25 bp, Mus musculus
aagagcaaactcttccgttctcaga

SEQ ID NO: 505450 - DNA, 25 bp, Mus musculus
aagagcaacccgaactgtgaggtga

SEQ ID NO: 505451 - DNA, 25 bp, Mus musculus
aagagcaacccgtactgtgaggtga

SEQ ID NO: 505452 - DNA, 25 bp, Mus musculus
aagagcagggccattgagaccacgc

SEQ ID NO: 505453 - DNA, 25 bp, Mus musculus
aagagcagggcctttgagaccacgc

SEQ ID NO: 505454 - DNA, 25 bp, Mus musculus
aagagcaggtcacccgtgccaacca

SEQ ID NO: 505455 - DNA, 25 bp, Mus musculus
aagagcaggtcagccgtgccaacca

SEQ ID NO: 505456 - DNA, 25 bp, Mus musculus
aagagcatccttacagaacttactg

SEQ ID NO: 505457 - DNA, 25 bp, Mus musculus
aagagcatcctttcagaacttactg

SEQ ID NO: 505458 - DNA, 25 bp, Mus musculus
aagagcatcgtccatgcggtgcaag

SEQ ID NO: 505459 - DNA, 25 bp, Mus musculus
aagagcatcgtcgatgcggtgcaag

SEQ ID NO: 505460 - DNA, 25 bp, Mus musculus
aagagcatgtttcctggtgtcccaa

SEQ ID NO: 505461 - DNA, 25 bp, Mus musculus
aagagcatgtttgctggtgtcccaa

SEQ ID NO: 505462 - DNA, 25 bp, Mus musculus
aagagcattggccaagccttaggct

SEQ ID NO: 505463 - DNA, 25 bp, Mus musculus
aagagcattggcgaagccttaggct

SEQ ID NO: 505464 - DNA, 25 bp, Mus musculus
aagagccagaggcaacgtcccttct

SEQ ID NO: 505465 - DNA, 25 bp, Mus musculus
aagagccagagggaacgtcccttct

SEQ ID NO: 505466 - DNA, 25 bp, Mus musculus
aagagccatgacagcccttacatcg

SEQ ID NO: 505467 - DNA, 25 bp, Mus musculus
aagagccatgactgcccttacatcg

SEQ ID NO: 505468 - DNA, 25 bp, Mus musculus
aagagcccaaccaagtaccctcaga

SEQ ID NO: 505469 - DNA, 25 bp, Mus musculus
aagagcccaacctagtaccctcaga

SEQ ID NO: 505470 - DNA, 25 bp, Mus musculus
aagagcccactcaccctggaaggaa

SEQ ID NO: 505471 - DNA, 25 bp, Mus musculus
aagagcccactctccctggaaggaa

SEQ ID NO: 505472 - DNA, 25 bp, Mus musculus
aagagccctctgcttcattgcctga

SEQ ID NO: 505473 - DNA, 25 bp, Mus musculus
aagagccctctggttcattgcctga

SEQ ID NO: 505474 - DNA, 25 bp, Mus musculus
aagagccctgctccgtcactgtaag

SEQ ID NO: 505475 - DNA, 25 bp, Mus musculus
aagagccctgctgcgtcactgtaag

SEQ ID NO: 505476 - DNA, 25 bp, Mus musculus
aagagccctttgcacctgatcttga

SEQ ID NO: 505477 - DNA, 25 bp, Mus musculus
aagagccctttggacctgatcttga

SEQ ID NO: 505478 - DNA, 25 bp, Mus musculus
aagagccgcaacatccagttcgagg

SEQ ID NO: 505479 - DNA, 25 bp, Mus musculus
aagagccgcaacttccagttcgagg

SEQ ID NO: 505480 - DNA, 25 bp, Mus musculus
aagagccggctcacatgtttacagg

SEQ ID NO: 505481 - DNA, 25 bp, Mus musculus
aagagccggctctcatgtttacagg

SEQ ID NO: 505482 - DNA, 25 bp, Mus musculus
aagagccgtattcctttacactttg

SEQ ID NO: 505483 - DNA, 25 bp, Mus musculus
aagagccgtattgctttacactttg

SEQ ID NO: 505484 - DNA, 25 bp, Mus musculus
aagagcctatttagacttacagaca

SEQ ID NO: 505485 - DNA, 25 bp, Mus musculus
aagagcctattttgacttacagaca

SEQ ID NO: 505486 - DNA, 25 bp, Mus musculus
aagagcctgaggaacgacattggtg

SEQ ID NO: 505487 - DNA, 25 bp, Mus musculus
aagagcctgaggtacgacattggtg

SEQ ID NO: 505488 - DNA, 25 bp, Mus musculus
aagagcctgcaaattcatcacagaa

SEQ ID NO: 505489 - DNA, 25 bp, Mus musculus
aagagcctgcaatttcatcacagaa

SEQ ID NO: 505490 - DNA, 25 bp, Mus musculus
aagagcctggataggagaccctgcc

SEQ ID NO: 505491 - DNA, 25 bp, Mus musculus
aagagcctggattggagaccctgcc

SEQ ID NO: 505492 - DNA, 25 bp, Mus musculus
aagagcctgtatctggcagaatacc

SEQ ID NO: 505493 - DNA, 25 bp, Mus musculus
aagagcctgtatgtggcagaatacc

SEQ ID NO: 505494 - DNA, 25 bp, Mus musculus
aagagccttaatcccttcaacgtgg

SEQ ID NO: 505495 - DNA, 25 bp, Mus musculus
aagagccttaatgccttcaacgtgg

SEQ ID NO: 505496 - DNA, 25 bp, Mus musculus
aagagccttacgatcgagcagtgga

SEQ ID NO: 505497 - DNA, 25 bp, Mus musculus
aagagccttacgttcgagcagtgga

SEQ ID NO: 505498 - DNA, 25 bp, Mus musculus
aagagcgcacccagactgtgactga

SEQ ID NO: 505499 - DNA, 25 bp, Mus musculus
aagagcgcaccctgactgtgactga

SEQ ID NO: 505500 - DNA, 25 bp, Mus musculus
aagagcgcagacctcgcttgctgca

SEQ ID NO: 505501 - DNA, 25 bp, Mus musculus
aagagcgcagacgtcgcttgctgca

SEQ ID NO: 505502 - DNA, 25 bp, Mus musculus
aagagcgcagcacgaagtaccatgc

SEQ ID NO: 505503 - DNA, 25 bp, Mus musculus
aagagcgcagcaggaagtaccatgc

SEQ ID NO: 505504 - DNA, 25 bp, Mus musculus
aagagcgctcatccgggcacctatg

SEQ ID NO: 505505 - DNA, 25 bp, Mus musculus
aagagcgctcatgcgggcacctatg

SEQ ID NO: 505506 - DNA, 25 bp, Mus musculus
aagagcgctgtacttttatgagcag

SEQ ID NO: 505507 - DNA, 25 bp, Mus musculus
aagagcgctgtagttttatgagcag

SEQ ID NO: 505508 - DNA, 25 bp, Mus musculus
aagagcggaccactgcctagcgccg

SEQ ID NO: 505509 - DNA, 25 bp, Mus musculus
aagagcggaccagtgcctagcgccg

SEQ ID NO: 505510 - DNA, 25 bp, Mus musculus
aagagcggcaccaagaagagcgact

SEQ ID NO: 505511 - DNA, 25 bp, Mus musculus
aagagcggcacctagaagagcgact

SEQ ID NO: 505512 - DNA, 25 bp, Mus musculus
aagagcgtagcgacccctgaacaga

SEQ ID NO: 505513 - DNA, 25 bp, Mus musculus
aagagcgtagcgtcccctgaacaga

SEQ ID NO: 505514 - DNA, 25 bp, Mus musculus
aagagcgttcctatcctgccgctgc

SEQ ID NO: 505515 - DNA, 25 bp, Mus musculus
aagagcgttcctttcctgccgctgc

SEQ ID NO: 505516 - DNA, 25 bp, Mus musculus
aagagcgtttgccaagtccaggaac

SEQ ID NO: 505517 - DNA, 25 bp, Mus musculus
aagagcgtttgcgaagtccaggaac

SEQ ID NO: 505518 - DNA, 25 bp, Mus musculus
aagagctaagcaaacaggaggtgga

SEQ ID NO: 505519 - DNA, 25 bp, Mus musculus
aagagctaagcatacaggaggtgga

SEQ ID NO: 505520 - DNA, 25 bp, Mus musculus
aagagctcaacaccgggaaggtgat

SEQ ID NO: 505521 - DNA, 25 bp, Mus musculus
aagagctcaacagcgggaaggtgat

SEQ ID NO: 505522 - DNA, 25 bp, Mus musculus
aagagctcaaggagaccaccatgtg

SEQ ID NO: 505523 - DNA, 25 bp, Mus musculus
aagagctcaaggtgaccaccatgtg

SEQ ID NO: 505524 - DNA, 25 bp, Mus musculus
aagagctccaccaaccctggctgta

SEQ ID NO: 505525 - DNA, 25 bp, Mus musculus
aagagctccacctaccctggctgta

SEQ ID NO: 505526 - DNA, 25 bp, Mus musculus
aagagctcgtacatctgactgtggc

SEQ ID NO: 505527 - DNA, 25 bp, Mus musculus
aagagctcgtacttctgactgtggc

SEQ ID NO: 505528 - DNA, 25 bp, Mus musculus
aagagctctccccaggtgtcgagca

SEQ ID NO: 505529 - DNA, 25 bp, Mus musculus
aagagctctcccgaggtgtcgagca

SEQ ID NO: 505530 - DNA, 25 bp, Mus musculus
aagagctgaagaatgtgagcgtgtc

SEQ ID NO: 505531 - DNA, 25 bp, Mus musculus
aagagctgaagattgtgagcgtgtc

SEQ ID NO: 505532 - DNA, 25 bp, Mus musculus
aagagctgaaggataccgatctggg

SEQ ID NO: 505533 - DNA, 25 bp, Mus musculus
aagagctgaaggttaccgatctggg

SEQ ID NO: 505534 - DNA, 25 bp, Mus musculus
aagagctgaccactttgccaatgag

SEQ ID NO: 505535 - DNA, 25 bp, Mus musculus
aagagctgaccagtttgccaatgag

SEQ ID NO: 505536 - DNA, 25 bp, Mus musculus
aagagctgacttaaggcccaaggct

SEQ ID NO: 505537 - DNA, 25 bp, Mus musculus
aagagctgactttaggcccaaggct

SEQ ID NO: 505538 - DNA, 25 bp, Mus musculus
aagagctgagtactctccatgggca

SEQ ID NO: 505539 - DNA, 25 bp, Mus musculus
aagagctgagtagtctccatgggca

SEQ ID NO: 505540 - DNA, 25 bp, Mus musculus
aagagctgcggcacctcgtgtgcgg

SEQ ID NO: 505541 - DNA, 25 bp, Mus musculus
aagagctgcggctcctcgtgtgcgg

SEQ ID NO: 505542 - DNA, 25 bp, Mus musculus
aagagctgcggtccatgttcacgcg

SEQ ID NO: 505543 - DNA, 25 bp, Mus musculus
aagagctgcggtgcatgttcacgcg

SEQ ID NO: 505544 - DNA, 25 bp, Mus musculus
aagagctggagaagatggtgccctc

SEQ ID NO: 505545 - DNA, 25 bp, Mus musculus
aagagctggagatgatggtgccctc

SEQ ID NO: 505546 - DNA, 25 bp, Mus musculus
aagagctggccgacaagtgctcccc

SEQ ID NO: 505547 - DNA, 25 bp, Mus musculus
aagagctggccgtcaagtgctcccc

SEQ ID NO: 505548 - DNA, 25 bp, Mus musculus
aagagctggcgaagtgcttcttgca

SEQ ID NO: 505549 - DNA, 25 bp, Mus musculus
aagagctggcgatgtgcttcttgca

SEQ ID NO: 505550 - DNA, 25 bp, Mus musculus
aagagctgtcggcttggatccaaag

SEQ ID NO: 505551 - DNA, 25 bp, Mus musculus
aagagctgtcgggttggatccaaag

SEQ ID NO: 505552 - DNA, 25 bp, Mus musculus
aagagcttaagaatattcccatgac

SEQ ID NO: 505553 - DNA, 25 bp, Mus musculus
aagagcttaagattattcccatgac

SEQ ID NO: 505554 - DNA, 25 bp, Mus musculus
aagagcttcagaatctttacagagg

SEQ ID NO: 505555 - DNA, 25 bp, Mus musculus
aagagcttcagattctttacagagg

SEQ ID NO: 505556 - DNA, 25 bp, Mus musculus
aagagcttccctcaggactctagag

SEQ ID NO: 505557 - DNA, 25 bp, Mus musculus
aagagcttccctgaggactctagag

SEQ ID NO: 505558 - DNA, 25 bp, Mus musculus
aagagcttgtgacatgcacgtggcc

SEQ ID NO: 505559 - DNA, 25 bp, Mus musculus
aagagcttgtgagatgcacgtggcc

SEQ ID NO: 505560 - DNA, 25 bp, Mus musculus
aagagctttgttatggttgtgggct

SEQ ID NO: 505561 - DNA, 25 bp, Mus musculus
aagagctttgttttggttgtgggct

SEQ ID NO: 505562 - DNA, 25 bp, Mus musculus
aagaggaaaagccaccagtgttgcc

SEQ ID NO: 505563 - DNA, 25 bp, Mus musculus
aagaggaaaagcgaccagtgttgcc

SEQ ID NO: 505564 - DNA, 25 bp, Mus musculus
aagaggaaaccaagcagtgcgcctg

SEQ ID NO: 505565 - DNA, 25 bp, Mus musculus
aagaggaaaccatgcagtgcgcctg

SEQ ID NO: 505566 - DNA, 25 bp, Mus musculus
aagaggaacttcctctctattccat

SEQ ID NO: 505567 - DNA, 25 bp, Mus musculus
aagaggaacttcgtctctattccat

SEQ ID NO: 505568 - DNA, 25 bp, Mus musculus
aagaggaaggccatgatagccagga

SEQ ID NO: 505569 - DNA, 25 bp, Mus musculus
aagaggaaggccttgatagccagga

SEQ ID NO: 505570 - DNA, 25 bp, Mus musculus
aagaggaagtatcttgcagtggtcc

SEQ ID NO: 505571 - DNA, 25 bp, Mus musculus
aagaggaagtatgttgcagtggtcc

SEQ ID NO: 505572 - DNA, 25 bp, Mus musculus
aagaggaagttgctgccctggccaa

SEQ ID NO: 505573 - DNA, 25 bp, Mus musculus
aagaggaagttggtgccctggccaa

SEQ ID NO: 505574 - DNA, 25 bp, Mus musculus
aagaggacagtacgcaaagacctga

SEQ ID NO: 505575 - DNA, 25 bp, Mus musculus
aagaggacagtaggcaaagacctga

SEQ ID NO: 505576 - DNA, 25 bp, Mus musculus
aagaggacatatccccagacccagc

SEQ ID NO: 505577 - DNA, 25 bp, Mus musculus
aagaggacatatgcccagacccagc

SEQ ID NO: 505578 - DNA, 25 bp, Mus musculus
aagaggaccccaagactgcatccca

SEQ ID NO: 505579 - DNA, 25 bp, Mus musculus
aagaggaccccatgactgcatccca

SEQ ID NO: 505580 - DNA, 25 bp, Mus musculus
aagaggacccctattgccgttcgat

SEQ ID NO: 505581 - DNA, 25 bp, Mus musculus
aagaggaccccttttgccgttcgat

SEQ ID NO: 505582 - DNA, 25 bp, Mus musculus
aagaggacctctaccttcacagcct

SEQ ID NO: 505583 - DNA, 25 bp, Mus musculus
aagaggacctcttccttcacagcct

SEQ ID NO: 505584 - DNA, 25 bp, Mus musculus
aagaggacgatgatgactacgttga

SEQ ID NO: 505585 - DNA, 25 bp, Mus musculus
aagaggacgatgttgactacgttga

SEQ ID NO: 505586 - DNA, 25 bp, Mus musculus
aagaggacgctccacttatcctgtg

SEQ ID NO: 505587 - DNA, 25 bp, Mus musculus
aagaggacgctcgacttatcctgtg

SEQ ID NO: 505588 - DNA, 25 bp, Mus musculus
aagaggacttgcagccactggatga

SEQ ID NO: 505589 - DNA, 25 bp, Mus musculus
aagaggacttgctgccactggatga

SEQ ID NO: 505590 - DNA, 25 bp, Mus musculus
aagaggagaaatagcaggacctcca

SEQ ID NO: 505591 - DNA, 25 bp, Mus musculus
aagaggagaaattgcaggacctcca

SEQ ID NO: 505592 - DNA, 25 bp, Mus musculus
aagaggagattgaccgtgcggccat

SEQ ID NO: 505593 - DNA, 25 bp, Mus musculus
aagaggagattgtccgtgcggccat

SEQ ID NO: 505594 - DNA, 25 bp, Mus musculus
aagaggagcactccatcttccggag

SEQ ID NO: 505595 - DNA, 25 bp, Mus musculus
aagaggagcactgcatcttccggag

SEQ ID NO: 505596 - DNA, 25 bp, Mus musculus
aagaggagctgcatggccccacctc

SEQ ID NO: 505597 - DNA, 25 bp, Mus musculus
aagaggagctgcttggccccacctc

SEQ ID NO: 505598 - DNA, 25 bp, Mus musculus
aagaggaggaatatcgtcgcctggc

SEQ ID NO: 505599 - DNA, 25 bp, Mus musculus
aagaggaggaatttcgtcgcctggc

SEQ ID NO: 505600 - DNA, 25 bp, Mus musculus
aagaggaggagcaacagctggctct

SEQ ID NO: 505601 - DNA, 25 bp, Mus musculus
aagaggaggagctacagctggctct

SEQ ID NO: 505602 - DNA, 25 bp, Mus musculus
aagaggagggaactttccgcagctc

SEQ ID NO: 505603 - DNA, 25 bp, Mus musculus
aagaggagggaagtttccgcagctc

SEQ ID NO: 505604 - DNA, 25 bp, Mus musculus
aagaggagtagactcccgtggaact

SEQ ID NO: 505605 - DNA, 25 bp, Mus musculus
aagaggagtagagtcccgtggaact

SEQ ID NO: 505606 - DNA, 25 bp, Mus musculus
aagaggagtgtcagaaatatggacc

SEQ ID NO: 505607 - DNA, 25 bp, Mus musculus
aagaggagtgtctgaaatatggacc

SEQ ID NO: 505608 - DNA, 25 bp, Mus musculus
aagaggataccacctgctataaagt

SEQ ID NO: 505609 - DNA, 25 bp, Mus musculus
aagaggataccagctgctataaagt

SEQ ID NO: 505610 - DNA, 25 bp, Mus musculus
aagaggataggaatcgatgtcgtca

SEQ ID NO: 505611 - DNA, 25 bp, Mus musculus
aagaggataggattcgatgtcgtca

SEQ ID NO: 505612 - DNA, 25 bp, Mus musculus
aagaggatcaagagtctggaatcac

SEQ ID NO: 505613 - DNA, 25 bp, Mus musculus
aagaggatcaagtgtctggaatcac

SEQ ID NO: 505614 - DNA, 25 bp, Mus musculus
aagaggatcttcaccacccgacaca

SEQ ID NO: 505615 - DNA, 25 bp, Mus musculus
aagaggatcttctccacccgacaca

SEQ ID NO: 505616 - DNA, 25 bp, Mus musculus
aagaggatgagtatgagccaccaat

SEQ ID NO: 505617 - DNA, 25 bp, Mus musculus
aagaggatgagtttgagccaccaat

SEQ ID NO: 505618 - DNA, 25 bp, Mus musculus
aagaggatggacaactgaagtcagt

SEQ ID NO: 505619 - DNA, 25 bp, Mus musculus
aagaggatggactactgaagtcagt

SEQ ID NO: 505620 - DNA, 25 bp, Mus musculus
aagaggcagaatcccggcgctccac

SEQ ID NO: 505621 - DNA, 25 bp, Mus musculus
aagaggcagaatgccggcgctccac

SEQ ID NO: 505622 - DNA, 25 bp, Mus musculus
aagaggcaggcaaacatgcctctca

SEQ ID NO: 505623 - DNA, 25 bp, Mus musculus
aagaggcaggcatacatgcctctca

SEQ ID NO: 505624 - DNA, 25 bp, Mus musculus
aagaggcagtgcactccgcagagag

SEQ ID NO: 505625 - DNA, 25 bp, Mus musculus
aagaggcagtgctctccgcagagag

SEQ ID NO: 505626 - DNA, 25 bp, Mus musculus
aagaggccagctctgttgccttctc

SEQ ID NO: 505627 - DNA, 25 bp, Mus musculus
aagaggccagctgtgttgccttctc

SEQ ID NO: 505628 - DNA, 25 bp, Mus musculus
aagaggccattactgaggaacttcc

SEQ ID NO: 505629 - DNA, 25 bp, Mus musculus
aagaggccattagtgaggaacttcc

SEQ ID NO: 505630 - DNA, 25 bp, Mus musculus
aagaggcccagaaagccattcagca

SEQ ID NO: 505631 - DNA, 25 bp, Mus musculus
aagaggcccagaagatgggtcgaaa

SEQ ID NO: 505632 - DNA, 25 bp, Mus musculus
aagaggcccagatagccattcagca

SEQ ID NO: 505633 - DNA, 25 bp, Mus musculus
aagaggcccagatgatgggtcgaaa

SEQ ID NO: 505634 - DNA, 25 bp, Mus musculus
aagaggccggctacagatccagagc

SEQ ID NO: 505635 - DNA, 25 bp, Mus musculus
aagaggccggcttcagatccagagc

SEQ ID NO: 505636 - DNA, 25 bp, Mus musculus
aagaggccggttacaccattgagca

SEQ ID NO: 505637 - DNA, 25 bp, Mus musculus
aagaggccggtttcaccattgagca

SEQ ID NO: 505638 - DNA, 25 bp, Mus musculus
aagaggcctgtaaaaactattggca

SEQ ID NO: 505639 - DNA, 25 bp, Mus musculus
aagaggcctgtataaactattggca

SEQ ID NO: 505640 - DNA, 25 bp, Mus musculus
aagaggcctgttccagcatccggga

SEQ ID NO: 505641 - DNA, 25 bp, Mus musculus
aagaggcctgttgcagcatccggga

SEQ ID NO: 505642 - DNA, 25 bp, Mus musculus
aagaggcgaccaaagctgtcaccga

SEQ ID NO: 505643 - DNA, 25 bp, Mus musculus
aagaggcgaccatagctgtcaccga

SEQ ID NO: 505644 - DNA, 25 bp, Mus musculus
aagaggcgagtgcatgtcgaagacc

SEQ ID NO: 505645 - DNA, 25 bp, Mus musculus
aagaggcgagtggatgtcgaagacc

SEQ ID NO: 505646 - DNA, 25 bp, Mus musculus
aagaggcggactagtcctcgcttgc

SEQ ID NO: 505647 - DNA, 25 bp, Mus musculus
aagaggcggacttgtcctcgcttgc

SEQ ID NO: 505648 - DNA, 25 bp, Mus musculus
aagaggcggcctagaagctggatct

SEQ ID NO: 505649 - DNA, 25 bp, Mus musculus
aagaggcggccttgaagctggatct

SEQ ID NO: 505650 - DNA, 25 bp, Mus musculus
aagaggcggcgaacctcgctggatt

SEQ ID NO: 505651 - DNA, 25 bp, Mus musculus
aagaggcggcgatcctcgctggatt

SEQ ID NO: 505652 - DNA, 25 bp, Mus musculus
aagaggcgtctccaggaactggaaa

SEQ ID NO: 505653 - DNA, 25 bp, Mus musculus
aagaggcgtctcgaggaactggaaa

SEQ ID NO: 505654 - DNA, 25 bp, Mus musculus
aagaggctaggcagatcaagaactt

SEQ ID NO: 505655 - DNA, 25 bp, Mus musculus
aagaggctaggctgatcaagaactt

SEQ ID NO: 505656 - DNA, 25 bp, Mus musculus
aagaggctccgacacgaatcaggga

SEQ ID NO: 505657 - DNA, 25 bp, Mus musculus
aagaggctccgagacgaatcaggga

SEQ ID NO: 505658 - DNA, 25 bp, Mus musculus
aagaggctgaatcggatttgcgccc

SEQ ID NO: 505659 - DNA, 25 bp, Mus musculus
aagaggctgaatgggatttgcgccc

SEQ ID NO: 505660 - DNA, 25 bp, Mus musculus
aagaggctgcacatgtagctgtacc

SEQ ID NO: 505661 - DNA, 25 bp, Mus musculus
aagaggctgcacttgtagctgtacc

SEQ ID NO: 505662 - DNA, 25 bp, Mus musculus
aagaggctgctacagtgacgtcata

SEQ ID NO: 505663 - DNA, 25 bp, Mus musculus
aagaggctgctagagtgacgtcata

SEQ ID NO: 505664 - DNA, 25 bp, Mus musculus
aagaggcttactctgtcacctgtgg

SEQ ID NO: 505665 - DNA, 25 bp, Mus musculus
aagaggcttactgtgtcacctgtgg

SEQ ID NO: 505666 - DNA, 25 bp, Mus musculus
aagagggaacccaatttctgttcag

SEQ ID NO: 505667 - DNA, 25 bp, Mus musculus
aagagggaaccctatttctgttcag

SEQ ID NO: 505668 - DNA, 25 bp, Mus musculus
aagagggagatgactaacttacacc

SEQ ID NO: 505669 - DNA, 25 bp, Mus musculus
aagagggagatgtctaacttacacc

SEQ ID NO: 505670 - DNA, 25 bp, Mus musculus
aagagggccggcccatctcctctaa

SEQ ID NO: 505671 - DNA, 25 bp, Mus musculus
aagagggccggcgcatctcctctaa

SEQ ID NO: 505672 - DNA, 25 bp, Mus musculus
aagagggcggccagcctgtgcttcc

SEQ ID NO: 505673 - DNA, 25 bp, Mus musculus
aagagggcggcctgcctgtgcttcc

SEQ ID NO: 505674 - DNA, 25 bp, Mus musculus
aagagggtgtctcaaaccaggtgaa

SEQ ID NO: 505675 - DNA, 25 bp, Mus musculus
aagagggtgtctgaaaccaggtgaa

SEQ ID NO: 505676 - DNA, 25 bp, Mus musculus
aagagggttcccagagatgctggac

SEQ ID NO: 505677 - DNA, 25 bp, Mus musculus
aagagggttccctgagatgctggac

SEQ ID NO: 505678 - DNA, 25 bp, Mus musculus
aagagggttgctaatgtctgttttc

SEQ ID NO: 505679 - DNA, 25 bp, Mus musculus
aagagggttgcttatgtctgttttc

SEQ ID NO: 505680 - DNA, 25 bp, Mus musculus
aagaggtacatgctatggcccagcc

SEQ ID NO: 505681 - DNA, 25 bp, Mus musculus
aagaggtacatggtatggcccagcc

SEQ ID NO: 505682 - DNA, 25 bp, Mus musculus
aagaggtccactcgatgacacacca

SEQ ID NO: 505683 - DNA, 25 bp, Mus musculus
aagaggtccactggatgacacacca

SEQ ID NO: 505684 - DNA, 25 bp, Mus musculus
aagaggtcctgcacgccttcctgct

SEQ ID NO: 505685 - DNA, 25 bp, Mus musculus
aagaggtcctgctcgccttcctgct

SEQ ID NO: 505686 - DNA, 25 bp, Mus musculus
aagaggtcgtacaggagagaatttg

SEQ ID NO: 505687 - DNA, 25 bp, Mus musculus
aagaggtcgtactggagagaatttg

SEQ ID NO: 505688 - DNA, 25 bp, Mus musculus
aagaggtgagtcaaatggcgaattt

SEQ ID NO: 505689 - DNA, 25 bp, Mus musculus
aagaggtgagtctaatggcgaattt

SEQ ID NO: 505690 - DNA, 25 bp, Mus musculus
aagaggtgtcaactctgaaattgta

SEQ ID NO: 505691 - DNA, 25 bp, Mus musculus
aagaggtgtcaagtctgaaattgta

SEQ ID NO: 505692 - DNA, 25 bp, Mus musculus
aagaggttcttcagcagcttcaggc

SEQ ID NO: 505693 - DNA, 25 bp, Mus musculus
aagaggttcttctgcagcttcaggc

SEQ ID NO: 505694 - DNA, 25 bp, Mus musculus
aagaggttgcatatcccttatctcg

SEQ ID NO: 505695 - DNA, 25 bp, Mus musculus
aagaggttgcatttcccttatctcg

SEQ ID NO: 505696 - DNA, 25 bp, Mus musculus
aagaggtttatgaccactgtttgtc

SEQ ID NO: 505697 - DNA, 25 bp, Mus musculus
aagaggtttatgtccactgtttgtc

SEQ ID NO: 505698 - DNA, 25 bp, Mus musculus
aagagtaagcccctccactagctgt

SEQ ID NO: 505699 - DNA, 25 bp, Mus musculus
aagagtaagcccgtccactagctgt

SEQ ID NO: 505700 - DNA, 25 bp, Mus musculus
aagagtaaggcaattttctggtgta

SEQ ID NO: 505701 - DNA, 25 bp, Mus musculus
aagagtaaggcatttttctggtgta

SEQ ID NO: 505702 - DNA, 25 bp, Mus musculus
aagagtaatgctaagtcagtggcag

SEQ ID NO: 505703 - DNA, 25 bp, Mus musculus
aagagtaatgcttagtcagtggcag

SEQ ID NO: 505704 - DNA, 25 bp, Mus musculus
aagagtaccgtgagaagatcgaggc

SEQ ID NO: 505705 - DNA, 25 bp, Mus musculus
aagagtaccgtgtgaagatcgaggc

SEQ ID NO: 505706 - DNA, 25 bp, Mus musculus
aagagtacgcggagctggtgtccta

SEQ ID NO: 505707 - DNA, 25 bp, Mus musculus
aagagtacgcggtgctggtgtccta

SEQ ID NO: 505708 - DNA, 25 bp, Mus musculus
aagagtactgatcctttgaaatcaa

SEQ ID NO: 505709 - DNA, 25 bp, Mus musculus
aagagtactgatgctttgaaatcaa

SEQ ID NO: 505710 - DNA, 25 bp, Mus musculus
aagagtactgtgcagtccctggtga

SEQ ID NO: 505711 - DNA, 25 bp, Mus musculus
aagagtactgtggagtccctggtga

SEQ ID NO: 505712 - DNA, 25 bp, Mus musculus
aagagtatgagaaacttgaatccag

SEQ ID NO: 505713 - DNA, 25 bp, Mus musculus
aagagtatgagatacttgaatccag

SEQ ID NO: 505714 - DNA, 25 bp, Mus musculus
aagagtatgccccaatcaacaggag

SEQ ID NO: 505715 - DNA, 25 bp, Mus musculus
aagagtatgcccgaatcaacaggag

SEQ ID NO: 505716 - DNA, 25 bp, Mus musculus
aagagtatggaaaagccctgccctg

SEQ ID NO: 505717 - DNA, 25 bp, Mus musculus
aagagtatggaatagccctgccctg

SEQ ID NO: 505718 - DNA, 25 bp, Mus musculus
aagagtcacctaaagttcggcggca

SEQ ID NO: 505719 - DNA, 25 bp, Mus musculus
aagagtcacctatagttcggcggca

SEQ ID NO: 505720 - DNA, 25 bp, Mus musculus
aagagtcagagacgaagcttcttga

SEQ ID NO: 505721 - DNA, 25 bp, Mus musculus
aagagtcagagaggaagcttcttga

SEQ ID NO: 505722 - DNA, 25 bp, Mus musculus
aagagtcagcgaccctctgggctca

SEQ ID NO: 505723 - DNA, 25 bp, Mus musculus
aagagtcagcgagcctctgggctca

SEQ ID NO: 505724 - DNA, 25 bp, Mus musculus
aagagtcagtgacgacgtccctggc

SEQ ID NO: 505725 - DNA, 25 bp, Mus musculus
aagagtcagtgaggacgtccctggc

SEQ ID NO: 505726 - DNA, 25 bp, Mus musculus
aagagtcatcaaaccaagagccttt

SEQ ID NO: 505727 - DNA, 25 bp, Mus musculus
aagagtcatcaatccaagagccttt

SEQ ID NO: 505728 - DNA, 25 bp, Mus musculus
aagagtcatctgacccaggccacca

SEQ ID NO: 505729 - DNA, 25 bp, Mus musculus
aagagtcatctgtcccaggccacca

SEQ ID NO: 505730 - DNA, 25 bp, Mus musculus
aagagtccagagaagcaggttgcca

SEQ ID NO: 505731 - DNA, 25 bp, Mus musculus
aagagtccagagtagcaggttgcca

SEQ ID NO: 505732 - DNA, 25 bp, Mus musculus
aagagtccagggagatccaccgagt

SEQ ID NO: 505733 - DNA, 25 bp, Mus musculus
aagagtccagggtgatccaccgagt

SEQ ID NO: 505734 - DNA, 25 bp, Mus musculus
aagagtccatccaaaggctcgtcgg

SEQ ID NO: 505735 - DNA, 25 bp, Mus musculus
aagagtccatcctaaggctcgtcgg

SEQ ID NO: 505736 - DNA, 25 bp, Mus musculus
aagagtccggcgcttccagatcgcc

SEQ ID NO: 505737 - DNA, 25 bp, Mus musculus
aagagtccggcggttccagatcgcc

SEQ ID NO: 505738 - DNA, 25 bp, Mus musculus
aagagtccgtgtattagaagaacag

SEQ ID NO: 505739 - DNA, 25 bp, Mus musculus
aagagtccgtgttttagaagaacag

SEQ ID NO: 505740 - DNA, 25 bp, Mus musculus
aagagtcctataccctcctaaggaa

SEQ ID NO: 505741 - DNA, 25 bp, Mus musculus
aagagtcctatagcctcctaaggaa

SEQ ID NO: 505742 - DNA, 25 bp, Mus musculus
aagagtcgcgctctaagaagcaaca

SEQ ID NO: 505743 - DNA, 25 bp, Mus musculus
aagagtcgcgctgtaagaagcaaca

SEQ ID NO: 505744 - DNA, 25 bp, Mus musculus
aagagtcgggagattcgcagcagtc

SEQ ID NO: 505745 - DNA, 25 bp, Mus musculus
aagagtcgggagtttcgcagcagtc

SEQ ID NO: 505746 - DNA, 25 bp, Mus musculus
aagagtctaaggctctcctggaagg

SEQ ID NO: 505747 - DNA, 25 bp, Mus musculus
aagagtctaagggtctcctggaagg

SEQ ID NO: 505748 - DNA, 25 bp, Mus musculus
aagagtctgaaacaatatagctggc

SEQ ID NO: 505749 - DNA, 25 bp, Mus musculus
aagagtctgaaagaatatagctggc

SEQ ID NO: 505750 - DNA, 25 bp, Mus musculus
aagagtctgctgatgaacaatgagc

SEQ ID NO: 505751 - DNA, 25 bp, Mus musculus
aagagtctgctgttgaacaatgagc

SEQ ID NO: 505752 - DNA, 25 bp, Mus musculus
aagagtgaccttcgccggaagatca

SEQ ID NO: 505753 - DNA, 25 bp, Mus musculus
aagagtgaccttggccggaagatca

SEQ ID NO: 505754 - DNA, 25 bp, Mus musculus
aagagtgagcttatcctggacatgt

SEQ ID NO: 505755 - DNA, 25 bp, Mus musculus
aagagtgagcttttcctggacatgt

SEQ ID NO: 505756 - DNA, 25 bp, Mus musculus
aagagtggttgtatactggaaatgc

SEQ ID NO: 505757 - DNA, 25 bp, Mus musculus
aagagtggttgtttactggaaatgc

SEQ ID NO: 505758 - DNA, 25 bp, Mus musculus
aagagtgtactgaccaccaagaaac

SEQ ID NO: 505759 - DNA, 25 bp, Mus musculus
aagagtgtactgtccaccaagaaac

SEQ ID NO: 505760 - DNA, 25 bp, Mus musculus
aagagtgtggagagtgtcccaaagc

SEQ ID NO: 505761 - DNA, 25 bp, Mus musculus
aagagtgtggagtgtgtcccaaagc

SEQ ID NO: 505762 - DNA, 25 bp, Mus musculus
aagagtgtgtgcagcacttgagaca

SEQ ID NO: 505763 - DNA, 25 bp, Mus musculus
aagagtgtgtgctgcacttgagaca

SEQ ID NO: 505764 - DNA, 25 bp, Mus musculus
aagagtgttgcaccaccggccggct

SEQ ID NO: 505765 - DNA, 25 bp, Mus musculus
aagagtgttgcagcaccggccggct

SEQ ID NO: 505766 - DNA, 25 bp, Mus musculus
aagagtgtttgaagagtggcaccag

SEQ ID NO: 505767 - DNA, 25 bp, Mus musculus
aagagtgtttgatgagtggcaccag

SEQ ID NO: 505768 - DNA, 25 bp, Mus musculus
aagagttacagtagattcgtcaggc

SEQ ID NO: 505769 - DNA, 25 bp, Mus musculus
aagagttacagttgattcgtcaggc

SEQ ID NO: 505770 - DNA, 25 bp, Mus musculus
aagagttatgccatcaacagcatca

SEQ ID NO: 505771 - DNA, 25 bp, Mus musculus
aagagttatgccttcaacagcatca

SEQ ID NO: 505772 - DNA, 25 bp, Mus musculus
aagagttcccacaatctggcagtac

SEQ ID NO: 505773 - DNA, 25 bp, Mus musculus
aagagttcccactatctggcagtac

SEQ ID NO: 505774 - DNA, 25 bp, Mus musculus
aagagttccgctcttgcctgagagg

SEQ ID NO: 505775 - DNA, 25 bp, Mus musculus
aagagttccgctgttgcctgagagg

SEQ ID NO: 505776 - DNA, 25 bp, Mus musculus
aagagttgccccagcgccagggaat

SEQ ID NO: 505777 - DNA, 25 bp, Mus musculus
aagagttgcccctgcgccagggaat

SEQ ID NO: 505778 - DNA, 25 bp, Mus musculus
aagagtttccgacagtcaggcgcac

SEQ ID NO: 505779 - DNA, 25 bp, Mus musculus
aagagtttccgagagtcaggcgcac

SEQ ID NO: 505780 - DNA, 25 bp, Mus musculus
aagagtttccttagaccaggcatgg

SEQ ID NO: 505781 - DNA, 25 bp, Mus musculus
aagagtttcctttgaccaggcatgg

SEQ ID NO: 505782 - DNA, 25 bp, Mus musculus
aagagtttgctacccagaatcctga

SEQ ID NO: 505783 - DNA, 25 bp, Mus musculus
aagagtttgctagccagaatcctga

SEQ ID NO: 505784 - DNA, 25 bp, Mus musculus
aagataaagagacaccacgaggcta

SEQ ID NO: 505785 - DNA, 25 bp, Mus musculus
aagataaagagagaccacgaggcta

SEQ ID NO: 505786 - DNA, 25 bp, Mus musculus
aagataacacagacccaggacaact

SEQ ID NO: 505787 - DNA, 25 bp, Mus musculus
aagataacacagtcccaggacaact

SEQ ID NO: 505788 - DNA, 25 bp, Mus musculus
aagataaccaaaagtgccgtgatgt

SEQ ID NO: 505789 - DNA, 25 bp, Mus musculus
aagataaccaaatgtgccgtgatgt

SEQ ID NO: 505790 - DNA, 25 bp, Mus musculus
aagataaggaggctgcccgactacg

SEQ ID NO: 505791 - DNA, 25 bp, Mus musculus
aagataaggagggtgcccgactacg

SEQ ID NO: 505792 - DNA, 25 bp, Mus musculus
aagataatgagcaccccttggttgc

SEQ ID NO: 505793 - DNA, 25 bp, Mus musculus
aagataatgagctccccttggttgc

SEQ ID NO: 505794 - DNA, 25 bp, Mus musculus
aagatacactgaagctttgtccacg

SEQ ID NO: 505795 - DNA, 25 bp, Mus musculus
aagatacactgatgctttgtccacg

SEQ ID NO: 505796 - DNA, 25 bp, Mus musculus
aagatacagtgcacgcccactcact

SEQ ID NO: 505797 - DNA, 25 bp, Mus musculus
aagatacagtgctcgcccactcact

SEQ ID NO: 505798 - DNA, 25 bp, Mus musculus
aagataccccagctctcgcttcagt

SEQ ID NO: 505799 - DNA, 25 bp, Mus musculus
aagataccccaggtctcgcttcagt

SEQ ID NO: 505800 - DNA, 25 bp, Mus musculus
aagatacccgctcatcattaaaaac

SEQ ID NO: 505801 - DNA, 25 bp, Mus musculus
aagatacccgctgatcattaaaaac

SEQ ID NO: 505802 - DNA, 25 bp, Mus musculus
aagatacctcaaccggaactactgg

SEQ ID NO: 505803 - DNA, 25 bp, Mus musculus
aagatacctcaagcggaactactgg

SEQ ID NO: 505804 - DNA, 25 bp, Mus musculus
aagatacgaccccttaccaagtgct

SEQ ID NO: 505805 - DNA, 25 bp, Mus musculus
aagatacgacccgttaccaagtgct

SEQ ID NO: 505806 - DNA, 25 bp, Mus musculus
aagatacgggttcaggtgtcaaagc

SEQ ID NO: 505807 - DNA, 25 bp, Mus musculus
aagatacgggttgaggtgtcaaagc

SEQ ID NO: 505808 - DNA, 25 bp, Mus musculus
aagatactccacattctttggcatg

SEQ ID NO: 505809 - DNA, 25 bp, Mus musculus
aagatactccactttctttggcatg

SEQ ID NO: 505810 - DNA, 25 bp, Mus musculus
aagatactgtgcctcgagctgcgga

SEQ ID NO: 505811 - DNA, 25 bp, Mus musculus
aagatactgtgcgtcgagctgcgga

SEQ ID NO: 505812 - DNA, 25 bp, Mus musculus
aagatacttgcaagtcagagaagtg

SEQ ID NO: 505813 - DNA, 25 bp, Mus musculus
aagatacttgcatgtcagagaagtg

SEQ ID NO: 505814 - DNA, 25 bp, Mus musculus
aagatagaaaacatctcctaccagg

SEQ ID NO: 505815 - DNA, 25 bp, Mus musculus
aagatagaaaacttctcctaccagg

SEQ ID NO: 505816 - DNA, 25 bp, Mus musculus
aagatagacagacctaatggagatg

SEQ ID NO: 505817 - DNA, 25 bp, Mus musculus
aagatagacagagctaatggagatg

SEQ ID NO: 505818 - DNA, 25 bp, Mus musculus
aagataggaaaaaagaagcgacaga

SEQ ID NO: 505819 - DNA, 25 bp, Mus musculus
aagataggaaaatagaagcgacaga

SEQ ID NO: 505820 - DNA, 25 bp, Mus musculus
aagatagtactgaggccgaggtaga

SEQ ID NO: 505821 - DNA, 25 bp, Mus musculus
aagatagtactgtggccgaggtaga

SEQ ID NO: 505822 - DNA, 25 bp, Mus musculus
aagatagtctgaaactgctgttggc

SEQ ID NO: 505823 - DNA, 25 bp, Mus musculus
aagatagtctgatactgctgttggc

SEQ ID NO: 505824 - DNA, 25 bp, Mus musculus
aagatagtgactagcactgggagac

SEQ ID NO: 505825 - DNA, 25 bp, Mus musculus
aagatagtgacttgcactgggagac

SEQ ID NO: 505826 - DNA, 25 bp, Mus musculus
aagatatcccttaggatcgcaatgg

SEQ ID NO: 505827 - DNA, 25 bp, Mus musculus
aagatatccctttggatcgcaatgg

SEQ ID NO: 505828 - DNA, 25 bp, Mus musculus
aagatatcctgtagcggcctgagct

SEQ ID NO: 505829 - DNA, 25 bp, Mus musculus
aagatatcctgttgcggcctgagct

SEQ ID NO: 505830 - DNA, 25 bp, Mus musculus
aagatatgctgaagagactccctaa

SEQ ID NO: 505831 - DNA, 25 bp, Mus musculus
aagatatgctgatgagactccctaa

SEQ ID NO: 505832 - DNA, 25 bp, Mus musculus
aagatcaagcaacagcagtattcag

SEQ ID NO: 505833 - DNA, 25 bp, Mus musculus
aagatcaagcaagagcagtattcag

SEQ ID NO: 505834 - DNA, 25 bp, Mus musculus
aagatcaagcgacctgtgctgcagt

SEQ ID NO: 505835 - DNA, 25 bp, Mus musculus
aagatcaagcgagctgtgctgcagt

SEQ ID NO: 505836 - DNA, 25 bp, Mus musculus
aagatcacacagagctccctgacca

SEQ ID NO: 505837 - DNA, 25 bp, Mus musculus
aagatcacacagtgctccctgacca

SEQ ID NO: 505838 - DNA, 25 bp, Mus musculus
aagatcacactaccggacttcagcg

SEQ ID NO: 505839 - DNA, 25 bp, Mus musculus
aagatcacactagcggacttcagcg

SEQ ID NO: 505840 - DNA, 25 bp, Mus musculus
aagatcacaggaagagaccaaagta

SEQ ID NO: 505841 - DNA, 25 bp, Mus musculus
aagatcacaggatgagaccaaagta

SEQ ID NO: 505842 - DNA, 25 bp, Mus musculus
aagatcacgttcaatcggcccacca

SEQ ID NO: 505843 - DNA, 25 bp, Mus musculus
aagatcacgttctatcggcccacca

SEQ ID NO: 505844 - DNA, 25 bp, Mus musculus
aagatcagtggcatcaagggaggcg

SEQ ID NO: 505845 - DNA, 25 bp, Mus musculus
aagatcagtggcttcaagggaggcg

SEQ ID NO: 505846 - DNA, 25 bp, Mus musculus
aagatcagttccctcagggacccca

SEQ ID NO: 505847 - DNA, 25 bp, Mus musculus
aagatcagttccgtcagggacccca

SEQ ID NO: 505848 - DNA, 25 bp, Mus musculus
aagatcatgacgcagaaggagctcc

SEQ ID NO: 505849 - DNA, 25 bp, Mus musculus
aagatcatgacggagaaggagctcc

SEQ ID NO: 505850 - DNA, 25 bp, Mus musculus
aagatccaaggacagtacacgctca

SEQ ID NO: 505851 - DNA, 25 bp, Mus musculus
aagatccaaggagagtacacgctca

SEQ ID NO: 505852 - DNA, 25 bp, Mus musculus
aagatccaccgaaggacatctaggg

SEQ ID NO: 505853 - DNA, 25 bp, Mus musculus
aagatccaccgatggacatctaggg

SEQ ID NO: 505854 - DNA, 25 bp, Mus musculus
aagatccacggccagcgcaacgtct

SEQ ID NO: 505855 - DNA, 25 bp, Mus musculus
aagatccacggcgagcgcaacgtct

SEQ ID NO: 505856 - DNA, 25 bp, Mus musculus
aagatccagacgctcaagctggccg

SEQ ID NO: 505857 - DNA, 25 bp, Mus musculus
aagatccagacggtcaagctggccg

SEQ ID NO: 505858 - DNA, 25 bp, Mus musculus
aagatccatgtcatccgtggaagat

SEQ ID NO: 505859 - DNA, 25 bp, Mus musculus
aagatccatgtcttccgtggaagat

SEQ ID NO: 505860 - DNA, 25 bp, Mus musculus
aagatcccagcccatacacgctatg

SEQ ID NO: 505861 - DNA, 25 bp, Mus musculus
aagatcccagccgatacacgctatg

SEQ ID NO: 505862 - DNA, 25 bp, Mus musculus
aagatcccagtacgttctcctgccg

SEQ ID NO: 505863 - DNA, 25 bp, Mus musculus
aagatcccagtaggttctcctgccg

SEQ ID NO: 505864 - DNA, 25 bp, Mus musculus
aagatccccagcaagacgtcagcca

SEQ ID NO: 505865 - DNA, 25 bp, Mus musculus
aagatccccagctagacgtcagcca

SEQ ID NO: 505866 - DNA, 25 bp, Mus musculus
aagatcccggacaagcagttagatg

SEQ ID NO: 505867 - DNA, 25 bp, Mus musculus
aagatcccggactagcagttagatg

SEQ ID NO: 505868 - DNA, 25 bp, Mus musculus
aagatccctggcatcatcatttcag

SEQ ID NO: 505869 - DNA, 25 bp, Mus musculus
aagatccctggcttcatcatttcag

SEQ ID NO: 505870 - DNA, 25 bp, Mus musculus
aagatccgcgcacgctcggaaggaa

SEQ ID NO: 505871 - DNA, 25 bp, Mus musculus
aagatccgcgcaggctcggaaggaa

SEQ ID NO: 505872 - DNA, 25 bp, Mus musculus
aagatccgggatctgcttcgtagga

SEQ ID NO: 505873 - DNA, 25 bp, Mus musculus
aagatccgggatgtgcttcgtagga

SEQ ID NO: 505874 - DNA, 25 bp, Mus musculus
aagatccgtgaacggcgcttctccc

SEQ ID NO: 505875 - DNA, 25 bp, Mus musculus
aagatccgtgaagggcgcttctccc

SEQ ID NO: 505876 - DNA, 25 bp, Mus musculus
aagatccgtgccaaacagaacaggg

SEQ ID NO: 505877 - DNA, 25 bp, Mus musculus
aagatccgtgcctaacagaacaggg

SEQ ID NO: 505878 - DNA, 25 bp, Mus musculus
aagatcctaggaccgcggctagaga

SEQ ID NO: 505879 - DNA, 25 bp, Mus musculus
aagatcctaggagcgcggctagaga

SEQ ID NO: 505880 - DNA, 25 bp, Mus musculus
aagatcctcatgaaagttggacaag

SEQ ID NO: 505881 - DNA, 25 bp, Mus musculus
aagatcctcatgtaagttggacaag

SEQ ID NO: 505882 - DNA, 25 bp, Mus musculus
aagatcctgggccagtggtggtacg

SEQ ID NO: 505883 - DNA, 25 bp, Mus musculus
aagatcctgggcgagtggtggtacg

SEQ ID NO: 505884 - DNA, 25 bp, Mus musculus
aagatcctgtcccatgatcatcctc

SEQ ID NO: 505885 - DNA, 25 bp, Mus musculus
aagatcctgtccgatgatcatcctc

SEQ ID NO: 505886 - DNA, 25 bp, Mus musculus
aagatcctgtgtaccgggcgagacg

SEQ ID NO: 505887 - DNA, 25 bp, Mus musculus
aagatcctgtgttccgggcgagacg

SEQ ID NO: 505888 - DNA, 25 bp, Mus musculus
aagatcctgtttcgtgcgctggtgg

SEQ ID NO: 505889 - DNA, 25 bp, Mus musculus
aagatcctgtttggtgcgctggtgg

SEQ ID NO: 505890 - DNA, 25 bp, Mus musculus
aagatccttggaaagctaactacag

SEQ ID NO: 505891 - DNA, 25 bp, Mus musculus
aagatccttggatagctaactacag

SEQ ID NO: 505892 - DNA, 25 bp, Mus musculus
aagatccttggccaccgtaacagag

SEQ ID NO: 505893 - DNA, 25 bp, Mus musculus
aagatccttggcgaccgtaacagag

SEQ ID NO: 505894 - DNA, 25 bp, Mus musculus
aagatcgagatgctccgagcctacc

SEQ ID NO: 505895 - DNA, 25 bp, Mus musculus
aagatcgagatggtccgagcctacc

SEQ ID NO: 505896 - DNA, 25 bp, Mus musculus
aagatcgcggccctccgcatgtaca

SEQ ID NO: 505897 - DNA, 25 bp, Mus musculus
aagatcgcggccgtccgcatgtaca

SEQ ID NO: 505898 - DNA, 25 bp, Mus musculus
aagatcggatgcctgagctctgtga

SEQ ID NO: 505899 - DNA, 25 bp, Mus musculus
aagatcggatgcgtgagctctgtga

SEQ ID NO: 505900 - DNA, 25 bp, Mus musculus
aagatcggcatcacccatgtgacgg

SEQ ID NO: 505901 - DNA, 25 bp, Mus musculus
aagatcggcatctcccatgtgacgg

SEQ ID NO: 505902 - DNA, 25 bp, Mus musculus
aagatcgtcgagagccaggtggtta

SEQ ID NO: 505903 - DNA, 25 bp, Mus musculus
aagatcgtcgagtgccaggtggtta

SEQ ID NO: 505904 - DNA, 25 bp, Mus musculus
aagatctagaacaggagcaggtcag

SEQ ID NO: 505905 - DNA, 25 bp, Mus musculus
aagatctagaactggagcaggtcag

SEQ ID NO: 505906 - DNA, 25 bp, Mus musculus
aagatctgaaagacaactattgtcg

SEQ ID NO: 505907 - DNA, 25 bp, Mus musculus
aagatctgaaagtcaactattgtcg

SEQ ID NO: 505908 - DNA, 25 bp, Mus musculus
aagatctgactgaatatttgtctcg

SEQ ID NO: 505909 - DNA, 25 bp, Mus musculus
aagatctgactgtatatttgtctcg

SEQ ID NO: 505910 - DNA, 25 bp, Mus musculus
aagatctgccgcatggcttcctgag

SEQ ID NO: 505911 - DNA, 25 bp, Mus musculus
aagatctgccgcttggcttcctgag

SEQ ID NO: 505912 - DNA, 25 bp, Mus musculus
aagatctggatgcagcctgtgaccc

SEQ ID NO: 505913 - DNA, 25 bp, Mus musculus
aagatctggatggagcctgtgaccc

SEQ ID NO: 505914 - DNA, 25 bp, Mus musculus
aagatctggctaccagtatctccgt

SEQ ID NO: 505915 - DNA, 25 bp, Mus musculus
aagatctggctagcagtatctccgt

SEQ ID NO: 505916 - DNA, 25 bp, Mus musculus
aagatctggtaaaccttggtgccca

SEQ ID NO: 505917 - DNA, 25 bp, Mus musculus
aagatctggtaatccttggtgccca

SEQ ID NO: 505918 - DNA, 25 bp, Mus musculus
aagatctggtgaagcttccgactcc

SEQ ID NO: 505919 - DNA, 25 bp, Mus musculus
aagatctggtgatgcttccgactcc

SEQ ID NO: 505920 - DNA, 25 bp, Mus musculus
aagatcttagaacaggatgcagctg

SEQ ID NO: 505921 - DNA, 25 bp, Mus musculus
aagatcttagaagaggatgcagctg

SEQ ID NO: 505922 - DNA, 25 bp, Mus musculus
aagatcttcaaaccacgaagtaagc

SEQ ID NO: 505923 - DNA, 25 bp, Mus musculus
aagatcttcaaagcacgaagtaagc

SEQ ID NO: 505924 - DNA, 25 bp, Mus musculus
aagatcttgaagcttactgctgatg

SEQ ID NO: 505925 - DNA, 25 bp, Mus musculus
aagatcttgaaggttactgctgatg

SEQ ID NO: 505926 - DNA, 25 bp, Mus musculus
aagatcttgagtcacgatgttccca

SEQ ID NO: 505927 - DNA, 25 bp, Mus musculus
aagatcttgagtgacgatgttccca

SEQ ID NO: 505928 - DNA, 25 bp, Mus musculus
aagatcttgcatcggctgctgcacg

SEQ ID NO: 505929 - DNA, 25 bp, Mus musculus
aagatcttgcatgggctgctgcacg

SEQ ID NO: 505930 - DNA, 25 bp, Mus musculus
aagatcttttcgcaggtaattgtca

SEQ ID NO: 505931 - DNA, 25 bp, Mus musculus
aagatcttttcggaggtaattgtca

SEQ ID NO: 505932 - DNA, 25 bp, Mus musculus
aagatgaaacttatggtgaatacag

SEQ ID NO: 505933 - DNA, 25 bp, Mus musculus
aagatgaaacttttggtgaatacag

SEQ ID NO: 505934 - DNA, 25 bp, Mus musculus
aagatgaaaggtaatcctcattggc

SEQ ID NO: 505935 - DNA, 25 bp, Mus musculus
aagatgaaaggttatcctcattggc

SEQ ID NO: 505936 - DNA, 25 bp, Mus musculus
aagatgaacaaaaaactgaaatagc

SEQ ID NO: 505937 - DNA, 25 bp, Mus musculus
aagatgaacaaataactgaaatagc

SEQ ID NO: 505938 - DNA, 25 bp, Mus musculus
aagatgaacagtagtgggcctcgcc

SEQ ID NO: 505939 - DNA, 25 bp, Mus musculus
aagatgaacagttgtgggcctcgcc

SEQ ID NO: 505940 - DNA, 25 bp, Mus musculus
aagatgaactgacatgaggacccct

SEQ ID NO: 505941 - DNA, 25 bp, Mus musculus
aagatgaactgagatgaggacccct

SEQ ID NO: 505942 - DNA, 25 bp, Mus musculus
aagatgaactggatgtgcttttaca

SEQ ID NO: 505943 - DNA, 25 bp, Mus musculus
aagatgaactggttgtgcttttaca

SEQ ID NO: 505944 - DNA, 25 bp, Mus musculus
aagatgaagaataagaccccatgga

SEQ ID NO: 505945 - DNA, 25 bp, Mus musculus
aagatgaagaattagaccccatgga

SEQ ID NO: 505946 - DNA, 25 bp, Mus musculus
aagatgaaggccagcgaccggtact

SEQ ID NO: 505947 - DNA, 25 bp, Mus musculus
aagatgaaggcctgcgaccggtact

SEQ ID NO: 505948 - DNA, 25 bp, Mus musculus
aagatgaatcggcaaaggctacgac

SEQ ID NO: 505949 - DNA, 25 bp, Mus musculus
aagatgaatcgggaaaggctacgac

SEQ ID NO: 505950 - DNA, 25 bp, Mus musculus
aagatgacaaagagtgacgatgatg

SEQ ID NO: 505951 - DNA, 25 bp, Mus musculus
aagatgacaaagtgtgacgatgatg

SEQ ID NO: 505952 - DNA, 25 bp, Mus musculus
aagatgacaaggaccacacccacca

SEQ ID NO: 505953 - DNA, 25 bp, Mus musculus
aagatgacaaggtccacacccacca

SEQ ID NO: 505954 - DNA, 25 bp, Mus musculus
aagatgacagatcggagccacaggc

SEQ ID NO: 505955 - DNA, 25 bp, Mus musculus
aagatgacagatgggagccacaggc

SEQ ID NO: 505956 - DNA, 25 bp, Mus musculus
aagatgaccaggatgtctatgatga

SEQ ID NO: 505957 - DNA, 25 bp, Mus musculus
aagatgaccaggttgtctatgatga

SEQ ID NO: 505958 - DNA, 25 bp, Mus musculus
aagatgaccctgcaccgcagcgagt

SEQ ID NO: 505959 - DNA, 25 bp, Mus musculus
aagatgaccctggaccgcagcgagt

SEQ ID NO: 505960 - DNA, 25 bp, Mus musculus
aagatgacctcacgaatcccagtgg

SEQ ID NO: 505961 - DNA, 25 bp, Mus musculus
aagatgacctcaggaatcccagtgg

SEQ ID NO: 505962 - DNA, 25 bp, Mus musculus
aagatgacgacgacgaacaagagga

SEQ ID NO: 505963 - DNA, 25 bp, Mus musculus
aagatgacgacgtcgaacaagagga

SEQ ID NO: 505964 - DNA, 25 bp, Mus musculus
aagatgacgtctcccagctggtcta

SEQ ID NO: 505965 - DNA, 25 bp, Mus musculus
aagatgacgtctgccagctggtcta

SEQ ID NO: 505966 - DNA, 25 bp, Mus musculus
aagatgacgttgaagcttacgtggg

SEQ ID NO: 505967 - DNA, 25 bp, Mus musculus
aagatgacgttgtagcttacgtggg

SEQ ID NO: 505968 - DNA, 25 bp, Mus musculus
aagatgagagcaaccggcccttcaa

SEQ ID NO: 505969 - DNA, 25 bp, Mus musculus
aagatgagagcatccggcccttcaa

SEQ ID NO: 505970 - DNA, 25 bp, Mus musculus
aagatgagatgcctatcgcctctgc

SEQ ID NO: 505971 - DNA, 25 bp, Mus musculus
aagatgagatgcgtatcgcctctgc

SEQ ID NO: 505972 - DNA, 25 bp, Mus musculus
aagatgagcgccaagaacgaggcct

SEQ ID NO: 505973 - DNA, 25 bp, Mus musculus
aagatgagcgcctagaacgaggcct

SEQ ID NO: 505974 - DNA, 25 bp, Mus musculus
aagatgagctcactcaacagcggcc

SEQ ID NO: 505975 - DNA, 25 bp, Mus musculus
aagatgagctcagtcaacagcggcc

SEQ ID NO: 505976 - DNA, 25 bp, Mus musculus
aagatgagctcccagatgctgttct

SEQ ID NO: 505977 - DNA, 25 bp, Mus musculus
aagatgagctccgagatgctgttct

SEQ ID NO: 505978 - DNA, 25 bp, Mus musculus
aagatgaggcccacatgaacctgct

SEQ ID NO: 505979 - DNA, 25 bp, Mus musculus
aagatgaggccctcatgaacctgct

SEQ ID NO: 505980 - DNA, 25 bp, Mus musculus
aagatgaggtttcgtgagcagttcc

SEQ ID NO: 505981 - DNA, 25 bp, Mus musculus
aagatgaggtttggtgagcagttcc

SEQ ID NO: 505982 - DNA, 25 bp, Mus musculus
aagatgagtgccagtgaccccaact

SEQ ID NO: 505983 - DNA, 25 bp, Mus musculus
aagatgagtgcctgtgaccccaact

SEQ ID NO: 505984 - DNA, 25 bp, Mus musculus
aagatgagttctcacgggctgggcc

SEQ ID NO: 505985 - DNA, 25 bp, Mus musculus
aagatgagttctgacgggctgggcc

SEQ ID NO: 505986 - DNA, 25 bp, Mus musculus
aagatgatagaaagtatccagcagc

SEQ ID NO: 505987 - DNA, 25 bp, Mus musculus
aagatgatagaatgtatccagcagc

SEQ ID NO: 505988 - DNA, 25 bp, Mus musculus
aagatgataggtcgaaagccccagg

SEQ ID NO: 505989 - DNA, 25 bp, Mus musculus
aagatgataggtggaaagccccagg

SEQ ID NO: 505990 - DNA, 25 bp, Mus musculus
aagatgatcaagcagacaatggaca

SEQ ID NO: 505991 - DNA, 25 bp, Mus musculus
aagatgatcaaggagacaatggaca

SEQ ID NO: 505992 - DNA, 25 bp, Mus musculus
aagatgatctccctgttgcaacaag

SEQ ID NO: 505993 - DNA, 25 bp, Mus musculus
aagatgatctccgtgttgcaacaag

SEQ ID NO: 505994 - DNA, 25 bp, Mus musculus
aagatgatgaagcacctgtggattt

SEQ ID NO: 505995 - DNA, 25 bp, Mus musculus
aagatgatgaaggacctgtggattt

SEQ ID NO: 505996 - DNA, 25 bp, Mus musculus
aagatgatggcgacctacaaggaga

SEQ ID NO: 505997 - DNA, 25 bp, Mus musculus
aagatgatggcgtcctacaaggaga

SEQ ID NO: 505998 - DNA, 25 bp, Mus musculus
aagatgcacttgctatctgtataca

SEQ ID NO: 505999 - DNA, 25 bp, Mus musculus
aagatgcacttggtatctgtataca

SEQ ID NO: 506000 - DNA, 25 bp, Mus musculus
aagatgcagggactgcctttaaaac

SEQ ID NO: 506001 - DNA, 25 bp, Mus musculus
aagatgcagggagtgcctttaaaac

SEQ ID NO: 506002 - DNA, 25 bp, Mus musculus
aagatgcagtccaacaagatccctg

SEQ ID NO: 506003 - DNA, 25 bp, Mus musculus
aagatgcagtcctacaagatccctg

SEQ ID NO: 506004 - DNA, 25 bp, Mus musculus
aagatgccacccacctgatacatga

SEQ ID NO: 506005 - DNA, 25 bp, Mus musculus
aagatgccaccctcctgatacatga

SEQ ID NO: 506006 - DNA, 25 bp, Mus musculus
aagatgccatttcccatcgaccaag

SEQ ID NO: 506007 - DNA, 25 bp, Mus musculus
aagatgccatttgccatcgaccaag

SEQ ID NO: 506008 - DNA, 25 bp, Mus musculus
aagatgcccgctataccaacggcca

SEQ ID NO: 506009 - DNA, 25 bp, Mus musculus
aagatgcccgctttaccaacggcca

SEQ ID NO: 506010 - DNA, 25 bp, Mus musculus
aagatgccctatcctcggcctggca

SEQ ID NO: 506011 - DNA, 25 bp, Mus musculus
aagatgccctatgctcggcctggca

SEQ ID NO: 506012 - DNA, 25 bp, Mus musculus
aagatgcccttcagggccggctgcc

SEQ ID NO: 506013 - DNA, 25 bp, Mus musculus
aagatgcccttcatcagcatccctg

SEQ ID NO: 506014 - DNA, 25 bp, Mus musculus
aagatgcccttctgggccggctgcc

SEQ ID NO: 506015 - DNA, 25 bp, Mus musculus
aagatgcccttcttcagcatccctg

SEQ ID NO: 506016 - DNA, 25 bp, Mus musculus
aagatgccgcccaatgatgaggaga

SEQ ID NO: 506017 - DNA, 25 bp, Mus musculus
aagatgccgccctatgatgaggaga

SEQ ID NO: 506018 - DNA, 25 bp, Mus musculus
aagatgccgcgcacaagcagaactc

SEQ ID NO: 506019 - DNA, 25 bp, Mus musculus
aagatgccgcgctcaagcagaactc

SEQ ID NO: 506020 - DNA, 25 bp, Mus musculus
aagatgcgagtgcacaagatcaaca

SEQ ID NO: 506021 - DNA, 25 bp, Mus musculus
aagatgcgagtggacaagatcaaca

SEQ ID NO: 506022 - DNA, 25 bp, Mus musculus
aagatgctaagcaggcccaggactt

SEQ ID NO: 506023 - DNA, 25 bp, Mus musculus
aagatgctaagctggcccaggactt

SEQ ID NO: 506024 - DNA, 25 bp, Mus musculus
aagatgctagaaccttttgccaagc

SEQ ID NO: 506025 - DNA, 25 bp, Mus musculus
aagatgctagaagcttttgccaagc

SEQ ID NO: 506026 - DNA, 25 bp, Mus musculus
aagatgctattcatcgagcaacggc

SEQ ID NO: 506027 - DNA, 25 bp, Mus musculus
aagatgctattcttcgagcaacggc

SEQ ID NO: 506028 - DNA, 25 bp, Mus musculus
aagatgctcagcaaacagtgtccga

SEQ ID NO: 506029 - DNA, 25 bp, Mus musculus
aagatgctcagcctggtgtccacgc

SEQ ID NO: 506030 - DNA, 25 bp, Mus musculus
aagatgctcagcgtggtgtccacgc

SEQ ID NO: 506031 - DNA, 25 bp, Mus musculus
aagatgctcagctaacagtgtccga

SEQ ID NO: 506032 - DNA, 25 bp, Mus musculus
aagatgctcggaatggcgaagcaga

SEQ ID NO: 506033 - DNA, 25 bp, Mus musculus
aagatgctcggattggcgaagcaga

SEQ ID NO: 506034 - DNA, 25 bp, Mus musculus
aagatgctcggcatcagagactcag

SEQ ID NO: 506035 - DNA, 25 bp, Mus musculus
aagatgctcggcttcagagactcag

SEQ ID NO: 506036 - DNA, 25 bp, Mus musculus
aagatgctgataaggaccgagagga

SEQ ID NO: 506037 - DNA, 25 bp, Mus musculus
aagatgctgatatggaccgagagga

SEQ ID NO: 506038 - DNA, 25 bp, Mus musculus
aagatgctgatcaagaagtgtctcc

SEQ ID NO: 506039 - DNA, 25 bp, Mus musculus
aagatgctgatctagaagtgtctcc

SEQ ID NO: 506040 - DNA, 25 bp, Mus musculus
aagatgctgtgacacctgaggaccc

SEQ ID NO: 506041 - DNA, 25 bp, Mus musculus
aagatgctgtgagacctgaggaccc

SEQ ID NO: 506042 - DNA, 25 bp, Mus musculus
aagatgcttataaaacccaggtgag

SEQ ID NO: 506043 - DNA, 25 bp, Mus musculus
aagatgcttataagatccggatccg

SEQ ID NO: 506044 - DNA, 25 bp, Mus musculus
aagatgcttatataacccaggtgag

SEQ ID NO: 506045 - DNA, 25 bp, Mus musculus
aagatgcttatatgatccggatccg

SEQ ID NO: 506046 - DNA, 25 bp, Mus musculus
aagatgcttatcatttctttagccc

SEQ ID NO: 506047 - DNA, 25 bp, Mus musculus
aagatgcttatcttttctttagccc

SEQ ID NO: 506048 - DNA, 25 bp, Mus musculus
aagatgcttgcaaatcttgacaaag

SEQ ID NO: 506049 - DNA, 25 bp, Mus musculus
aagatgcttgcatatcttgacaaag

SEQ ID NO: 506050 - DNA, 25 bp, Mus musculus
aagatggaacctatgctgcaggagg

SEQ ID NO: 506051 - DNA, 25 bp, Mus musculus
aagatggaacctttgctgcaggagg

SEQ ID NO: 506052 - DNA, 25 bp, Mus musculus
aagatggaactcagcgcatgtgccc

SEQ ID NO: 506053 - DNA, 25 bp, Mus musculus
aagatggaactctgcgcatgtgccc

SEQ ID NO: 506054 - DNA, 25 bp, Mus musculus
aagatggaagccacagcctggatgg

SEQ ID NO: 506055 - DNA, 25 bp, Mus musculus
aagatggaagcctcagcctggatgg

SEQ ID NO: 506056 - DNA, 25 bp, Mus musculus
aagatggaatctaactatgtacctg

SEQ ID NO: 506057 - DNA, 25 bp, Mus musculus
aagatggaatcttactatgtacctg

SEQ ID NO: 506058 - DNA, 25 bp, Mus musculus
aagatggacaaaatggtgcagaaaa

SEQ ID NO: 506059 - DNA, 25 bp, Mus musculus
aagatggacaaattggtgcagaaaa

SEQ ID NO: 506060 - DNA, 25 bp, Mus musculus
aagatggacgagactccgacgagga

SEQ ID NO: 506061 - DNA, 25 bp, Mus musculus
aagatggacgagtctccgacgagga

SEQ ID NO: 506062 - DNA, 25 bp, Mus musculus
aagatggacttcatgggatcgtgag

SEQ ID NO: 506063 - DNA, 25 bp, Mus musculus
aagatggacttcttgggatcgtgag

SEQ ID NO: 506064 - DNA, 25 bp, Mus musculus
aagatggagactccctctgaactgg

SEQ ID NO: 506065 - DNA, 25 bp, Mus musculus
aagatggagactgcctctgaactgg

SEQ ID NO: 506066 - DNA, 25 bp, Mus musculus
aagatggagcctccctgtaagagtc

SEQ ID NO: 506067 - DNA, 25 bp, Mus musculus
aagatggagcctgcctgtaagagtc

SEQ ID NO: 506068 - DNA, 25 bp, Mus musculus
aagatggaggaaagcctgaaacgcc

SEQ ID NO: 506069 - DNA, 25 bp, Mus musculus
aagatggaggaatgcctgaaacgcc

SEQ ID NO: 506070 - DNA, 25 bp, Mus musculus
aagatggatcttcggaccggccgat

SEQ ID NO: 506071 - DNA, 25 bp, Mus musculus
aagatggatcttgggaccggccgat

SEQ ID NO: 506072 - DNA, 25 bp, Mus musculus
aagatggcagacatgcccagtggcg

SEQ ID NO: 506073 - DNA, 25 bp, Mus musculus
aagatggcagacttgcccagtggcg

SEQ ID NO: 506074 - DNA, 25 bp, Mus musculus
aagatggcagctccggacgagccca

SEQ ID NO: 506075 - DNA, 25 bp, Mus musculus
aagatggcagctgcggacgagccca

SEQ ID NO: 506076 - DNA, 25 bp, Mus musculus
aagatggcatgaattattggctcaa

SEQ ID NO: 506077 - DNA, 25 bp, Mus musculus
aagatggcatgatttattggctcaa

SEQ ID NO: 506078 - DNA, 25 bp, Mus musculus
aagatggcccctagggtccttggct

SEQ ID NO: 506079 - DNA, 25 bp, Mus musculus
aagatggccccttgggtccttggct

SEQ ID NO: 506080 - DNA, 25 bp, Mus musculus
aagatggcgaaccactctcccgcga

SEQ ID NO: 506081 - DNA, 25 bp, Mus musculus
aagatggcgaacgactctcccgcga

SEQ ID NO: 506082 - DNA, 25 bp, Mus musculus
aagatggcggcacgaaccagcaatt

SEQ ID NO: 506083 - DNA, 25 bp, Mus musculus
aagatggcggcaggaaccagcaatt

SEQ ID NO: 506084 - DNA, 25 bp, Mus musculus
aagatggcggtcatcctgtggcagc

SEQ ID NO: 506085 - DNA, 25 bp, Mus musculus
aagatggcggtcttcctgtggcagc

SEQ ID NO: 506086 - DNA, 25 bp, Mus musculus
aagatggcggtgcagatttccaaga

SEQ ID NO: 506087 - DNA, 25 bp, Mus musculus
aagatggcggtggagatttccaaga

SEQ ID NO: 506088 - DNA, 25 bp, Mus musculus
aagatggcgtaccagagcctccggc

SEQ ID NO: 506089 - DNA, 25 bp, Mus musculus
aagatggcgtacgagagcctccggc

SEQ ID NO: 506090 - DNA, 25 bp, Mus musculus
aagatggcgtcgacctgttcgcgga

SEQ ID NO: 506091 - DNA, 25 bp, Mus musculus
aagatggcgtcgtcctgttcgcgga

SEQ ID NO: 506092 - DNA, 25 bp, Mus musculus
aagatggcgtgcacactgtggaaga

SEQ ID NO: 506093 - DNA, 25 bp, Mus musculus
aagatggcgtgctcactgtggaaga

SEQ ID NO: 506094 - DNA, 25 bp, Mus musculus
aagatggctcaacaggctcacttgt

SEQ ID NO: 506095 - DNA, 25 bp, Mus musculus
aagatggctcaagaggctcacttgt

SEQ ID NO: 506096 - DNA, 25 bp, Mus musculus
aagatggctgacctctcagcagaag

SEQ ID NO: 506097 - DNA, 25 bp, Mus musculus
aagatggctgacgtctcagcagaag

SEQ ID NO: 506098 - DNA, 25 bp, Mus musculus
aagatggctgcaccgatacctgccc

SEQ ID NO: 506099 - DNA, 25 bp, Mus musculus
aagatggctgcagcgatacctgccc

SEQ ID NO: 506100 - DNA, 25 bp, Mus musculus
aagatgggagaaacttcattggcac

SEQ ID NO: 506101 - DNA, 25 bp, Mus musculus
aagatgggagaatcttcattggcac

SEQ ID NO: 506102 - DNA, 25 bp, Mus musculus
aagatgggcataatctgctcagtaa

SEQ ID NO: 506103 - DNA, 25 bp, Mus musculus
aagatgggcatattctgctcagtaa

SEQ ID NO: 506104 - DNA, 25 bp, Mus musculus
aagatgggctccagtgcacagggat

SEQ ID NO: 506105 - DNA, 25 bp, Mus musculus
aagatgggctcctgtgcacagggat

SEQ ID NO: 506106 - DNA, 25 bp, Mus musculus
aagatgggggctactacagctgtgt

SEQ ID NO: 506107 - DNA, 25 bp, Mus musculus
aagatgggggcttctacagctgtgt

SEQ ID NO: 506108 - DNA, 25 bp, Mus musculus
aagatgggtccacttcatgaaagaa

SEQ ID NO: 506109 - DNA, 25 bp, Mus musculus
aagatgggtccagttcatgaaagaa

SEQ ID NO: 506110 - DNA, 25 bp, Mus musculus
aagatgggtgacaagatgacctgta

SEQ ID NO: 506111 - DNA, 25 bp, Mus musculus
aagatgggtgactagatgacctgta

SEQ ID NO: 506112 - DNA, 25 bp, Mus musculus
aagatggtaggcaccgtgctgctga

SEQ ID NO: 506113 - DNA, 25 bp, Mus musculus
aagatggtaggctccgtgctgctga

SEQ ID NO: 506114 - DNA, 25 bp, Mus musculus
aagatggtagtaaatctttgcctcc

SEQ ID NO: 506115 - DNA, 25 bp, Mus musculus
aagatggtagtatatctttgcctcc

SEQ ID NO: 506116 - DNA, 25 bp, Mus musculus
aagatggtcactctccacaggatgg

SEQ ID NO: 506117 - DNA, 25 bp, Mus musculus
aagatggtcactgtccacaggatgg

SEQ ID NO: 506118 - DNA, 25 bp, Mus musculus
aagatggtcccactctgtgacatga

SEQ ID NO: 506119 - DNA, 25 bp, Mus musculus
aagatggtcccagtctgtgacatga

SEQ ID NO: 506120 - DNA, 25 bp, Mus musculus
aagatggtgtctcgcaggaagaaac

SEQ ID NO: 506121 - DNA, 25 bp, Mus musculus
aagatggtgtctggcaggaagaaac

SEQ ID NO: 506122 - DNA, 25 bp, Mus musculus
aagatgtagtaaaccagtcaagtcc

SEQ ID NO: 506123 - DNA, 25 bp, Mus musculus
aagatgtagtaatccagtcaagtcc

SEQ ID NO: 506124 - DNA, 25 bp, Mus musculus
aagatgtatacccaggcccagccat

SEQ ID NO: 506125 - DNA, 25 bp, Mus musculus
aagatgtataccgaggcccagccat

SEQ ID NO: 506126 - DNA, 25 bp, Mus musculus
aagatgtcactcaagatccggaagt

SEQ ID NO: 506127 - DNA, 25 bp, Mus musculus
aagatgtcactctagatccggaagt

SEQ ID NO: 506128 - DNA, 25 bp, Mus musculus
aagatgtcaggtccagacctactaa

SEQ ID NO: 506129 - DNA, 25 bp, Mus musculus
aagatgtcaggtgcagacctactaa

SEQ ID NO: 506130 - DNA, 25 bp, Mus musculus
aagatgtcagtaatatgcggtatca

SEQ ID NO: 506131 - DNA, 25 bp, Mus musculus
aagatgtcagtattatgcggtatca

SEQ ID NO: 506132 - DNA, 25 bp, Mus musculus
aagatgtccctgcagcccaatgaaa

SEQ ID NO: 506133 - DNA, 25 bp, Mus musculus
aagatgtccctggagcccaatgaaa

SEQ ID NO: 506134 - DNA, 25 bp, Mus musculus
aagatgtccgccacgggaaccctat

SEQ ID NO: 506135 - DNA, 25 bp, Mus musculus
aagatgtccgcctcgggaaccctat

SEQ ID NO: 506136 - DNA, 25 bp, Mus musculus
aagatgtcctcaccagcacgtacgg

SEQ ID NO: 506137 - DNA, 25 bp, Mus musculus
aagatgtcctcacttcggttcatgg

SEQ ID NO: 506138 - DNA, 25 bp, Mus musculus
aagatgtcctcagcagcacgtacgg

SEQ ID NO: 506139 - DNA, 25 bp, Mus musculus
aagatgtcctcagttcggttcatgg

SEQ ID NO: 506140 - DNA, 25 bp, Mus musculus
aagatgtcgagaaggcaattttaac

SEQ ID NO: 506141 - DNA, 25 bp, Mus musculus
aagatgtcgagatggcaattttaac

SEQ ID NO: 506142 - DNA, 25 bp, Mus musculus
aagatgtctcagctgttaagtgcac

SEQ ID NO: 506143 - DNA, 25 bp, Mus musculus
aagatgtctcaggtgttaagtgcac

SEQ ID NO: 506144 - DNA, 25 bp, Mus musculus
aagatgtgaagaaggcgctgctgct

SEQ ID NO: 506145 - DNA, 25 bp, Mus musculus
aagatgtgaagatggcgctgctgct

SEQ ID NO: 506146 - DNA, 25 bp, Mus musculus
aagatgtgcaacatctgccacggcc

SEQ ID NO: 506147 - DNA, 25 bp, Mus musculus
aagatgtgcaacttctgccacggcc

SEQ ID NO: 506148 - DNA, 25 bp, Mus musculus
aagatgtgcgggaggcctatcgccg

SEQ ID NO: 506149 - DNA, 25 bp, Mus musculus
aagatgtgcgggtggcctatcgccg

SEQ ID NO: 506150 - DNA, 25 bp, Mus musculus
aagatgtggcttctgatgacaatgg

SEQ ID NO: 506151 - DNA, 25 bp, Mus musculus
aagatgtggcttgtgatgacaatgg

SEQ ID NO: 506152 - DNA, 25 bp, Mus musculus
aagatgttccagatcgacagcggaa

SEQ ID NO: 506153 - DNA, 25 bp, Mus musculus
aagatgttccagttcgacagcggaa

SEQ ID NO: 506154 - DNA, 25 bp, Mus musculus
aagatgtttggtattcacaagccaa

SEQ ID NO: 506155 - DNA, 25 bp, Mus musculus
aagatgtttggttttcacaagccaa

SEQ ID NO: 506156 - DNA, 25 bp, Mus musculus
aagatgtttgtgcacaaggagaaga

SEQ ID NO: 506157 - DNA, 25 bp, Mus musculus
aagatgtttgtggacaaggagaaga

SEQ ID NO: 506158 - DNA, 25 bp, Mus musculus
aagattacggtgctgccgtctgcca

SEQ ID NO: 506159 - DNA, 25 bp, Mus musculus
aagattacggtggtgccgtctgcca

SEQ ID NO: 506160 - DNA, 25 bp, Mus musculus
aagattagaacgactccgcaaagag

SEQ ID NO: 506161 - DNA, 25 bp, Mus musculus
aagattagaacgtctccgcaaagag

SEQ ID NO: 506162 - DNA, 25 bp, Mus musculus
aagattcaagcaattgatgccaccg

SEQ ID NO: 506163 - DNA, 25 bp, Mus musculus
aagattcaagcatttgatgccaccg

SEQ ID NO: 506164 - DNA, 25 bp, Mus musculus
aagattcatttaagccaccagggag

SEQ ID NO: 506165 - DNA, 25 bp, Mus musculus
aagattcatttatgccaccagggag

SEQ ID NO: 506166 - DNA, 25 bp, Mus musculus
aagattccagaaaatgaggttccca

SEQ ID NO: 506167 - DNA, 25 bp, Mus musculus
aagattccagaatatgaggttccca

SEQ ID NO: 506168 - DNA, 25 bp, Mus musculus
aagattcccaaaccaagaggcagac

SEQ ID NO: 506169 - DNA, 25 bp, Mus musculus
aagattcccaaagcaagaggcagac

SEQ ID NO: 506170 - DNA, 25 bp, Mus musculus
aagattcctttgcagctcaccattg

SEQ ID NO: 506171 - DNA, 25 bp, Mus musculus
aagattcctttggagctcaccattg

SEQ ID NO: 506172 - DNA, 25 bp, Mus musculus
aagattcggcccctctggagacact

SEQ ID NO: 506173 - DNA, 25 bp, Mus musculus
aagattcggcccgtctggagacact

SEQ ID NO: 506174 - DNA, 25 bp, Mus musculus
aagattctggaacccgagcttgctg

SEQ ID NO: 506175 - DNA, 25 bp, Mus musculus
aagattctggaagccgagcttgctg

SEQ ID NO: 506176 - DNA, 25 bp, Mus musculus
aagattctggtcactggatcctctg

SEQ ID NO: 506177 - DNA, 25 bp, Mus musculus
aagattctggtctctggatcctctg

SEQ ID NO: 506178 - DNA, 25 bp, Mus musculus
aagattgcccacagcgttttccgaa

SEQ ID NO: 506179 - DNA, 25 bp, Mus musculus
aagattgcccactgcgttttccgaa

SEQ ID NO: 506180 - DNA, 25 bp, Mus musculus
aagattgcccgcctggagcagaacg

SEQ ID NO: 506181 - DNA, 25 bp, Mus musculus
aagattgcccgcgtggagcagaacg

SEQ ID NO: 506182 - DNA, 25 bp, Mus musculus
aagattgccctcataaatgttgagc

SEQ ID NO: 506183 - DNA, 25 bp, Mus musculus
aagattgccctcttaaatgttgagc

SEQ ID NO: 506184 - DNA, 25 bp, Mus musculus
aagattgtaggcacgcgtgtagaca

SEQ ID NO: 506185 - DNA, 25 bp, Mus musculus
aagattgtaggctcgcgtgtagaca

SEQ ID NO: 506186 - DNA, 25 bp, Mus musculus
aagattgtcactcccctggacgagc

SEQ ID NO: 506187 - DNA, 25 bp, Mus musculus
aagattgtcactgccctggacgagc

SEQ ID NO: 506188 - DNA, 25 bp, Mus musculus
aagattgtcctgatcagcaggtccc

SEQ ID NO: 506189 - DNA, 25 bp, Mus musculus
aagattgtcctgttcagcaggtccc

SEQ ID NO: 506190 - DNA, 25 bp, Mus musculus
aagattgtgtgacaggcagctagcc

SEQ ID NO: 506191 - DNA, 25 bp, Mus musculus
aagattgtgtgagaggcagctagcc

SEQ ID NO: 506192 - DNA, 25 bp, Mus musculus
aagatttacacccagatccagaagt

SEQ ID NO: 506193 - DNA, 25 bp, Mus musculus
aagatttacaccgagatccagaagt

SEQ ID NO: 506194 - DNA, 25 bp, Mus musculus
aagatttcccctatagcgtgcttgc

SEQ ID NO: 506195 - DNA, 25 bp, Mus musculus
aagatttcccctttagcgtgcttgc

SEQ ID NO: 506196 - DNA, 25 bp, Mus musculus
aagatttcctctccttactgctgga

SEQ ID NO: 506197 - DNA, 25 bp, Mus musculus
aagatttcctctgcttactgctgga

SEQ ID NO: 506198 - DNA, 25 bp, Mus musculus
aagatttctgacatcagctggaatc

SEQ ID NO: 506199 - DNA, 25 bp, Mus musculus
aagatttctgacttcagctggaatc

SEQ ID NO: 506200 - DNA, 25 bp, Mus musculus
aagatttgagggatagagtcccaga

SEQ ID NO: 506201 - DNA, 25 bp, Mus musculus
aagatttgagggttagagtcccaga

SEQ ID NO: 506202 - DNA, 25 bp, Mus musculus
aagatttgcaatctcgggaggagac

SEQ ID NO: 506203 - DNA, 25 bp, Mus musculus
aagatttgcaatgtcgggaggagac

SEQ ID NO: 506204 - DNA, 25 bp, Mus musculus
aagatttggctaccctagtctctgg

SEQ ID NO: 506205 - DNA, 25 bp, Mus musculus
aagatttggctagcctagtctctgg

SEQ ID NO: 506206 - DNA, 25 bp, Mus musculus
aagattttggagatactacgcccag

SEQ ID NO: 506207 - DNA, 25 bp, Mus musculus
aagattttggagttactacgcccag

SEQ ID NO: 506208 - DNA, 25 bp, Mus musculus
aagattttggcgagcactgcaaaca

SEQ ID NO: 506209 - DNA, 25 bp, Mus musculus
aagattttggcgtgcactgcaaaca

SEQ ID NO: 506210 - DNA, 25 bp, Mus musculus
aagattttttctagatatggcttca

SEQ ID NO: 506211 - DNA, 25 bp, Mus musculus
aagattttttcttgatatggcttca

SEQ ID NO: 506212 - DNA, 25 bp, Mus musculus
aagcaaaaacctagtacagatcgtg

SEQ ID NO: 506213 - DNA, 25 bp, Mus musculus
aagcaaaaaccttgtacagatcgtg

SEQ ID NO: 506214 - DNA, 25 bp, Mus musculus
aagcaaaaagggagtgaggccatag

SEQ ID NO: 506215 - DNA, 25 bp, Mus musculus
aagcaaaaagggtgtgaggccatag

SEQ ID NO: 506216 - DNA, 25 bp, Mus musculus
aagcaaaacctgatgaattaatgga

SEQ ID NO: 506217 - DNA, 25 bp, Mus musculus
aagcaaaacctgttgaattaatgga

SEQ ID NO: 506218 - DNA, 25 bp, Mus musculus
aagcaaaagagtccatcagatctgt

SEQ ID NO: 506219 - DNA, 25 bp, Mus musculus
aagcaaaagagtgcatcagatctgt

SEQ ID NO: 506220 - DNA, 25 bp, Mus musculus
aagcaaacccaaagcatcggctgag

SEQ ID NO: 506221 - DNA, 25 bp, Mus musculus
aagcaaacccaatgcatcggctgag

SEQ ID NO: 506222 - DNA, 25 bp, Mus musculus
aagcaaagaactccaggcagccttc

SEQ ID NO: 506223 - DNA, 25 bp, Mus musculus
aagcaaagaactgcaggcagccttc

SEQ ID NO: 506224 - DNA, 25 bp, Mus musculus
aagcaaagagcaccccgcaagaaca

SEQ ID NO: 506225 - DNA, 25 bp, Mus musculus
aagcaaagagcagcccgcaagaaca

SEQ ID NO: 506226 - DNA, 25 bp, Mus musculus
aagcaaagcctacaacatgctggac

SEQ ID NO: 506227 - DNA, 25 bp, Mus musculus
aagcaaagcctagaacatgctggac

SEQ ID NO: 506228 - DNA, 25 bp, Mus musculus
aagcaaatctctagtgtggcagaaa

SEQ ID NO: 506229 - DNA, 25 bp, Mus musculus
aagcaaatctcttgtgtggcagaaa

SEQ ID NO: 506230 - DNA, 25 bp, Mus musculus
aagcaacacaccatccgtttgcgca

SEQ ID NO: 506231 - DNA, 25 bp, Mus musculus
aagcaacacaccttccgtttgcgca

SEQ ID NO: 506232 - DNA, 25 bp, Mus musculus
aagcaacacagccaaccagcaagca

SEQ ID NO: 506233 - DNA, 25 bp, Mus musculus
aagcaacacagcgaaccagcaagca

SEQ ID NO: 506234 - DNA, 25 bp, Mus musculus
aagcaacatttgctgtccactttaa

SEQ ID NO: 506235 - DNA, 25 bp, Mus musculus
aagcaacatttggtgtccactttaa

SEQ ID NO: 506236 - DNA, 25 bp, Mus musculus
aagcaaccagagataggcagccaat

SEQ ID NO: 506237 - DNA, 25 bp, Mus musculus
aagcaaccagagttaggcagccaat

SEQ ID NO: 506238 - DNA, 25 bp, Mus musculus
aagcaacccatcagcacttcgggaa

SEQ ID NO: 506239 - DNA, 25 bp, Mus musculus
aagcaacccatctgcacttcgggaa

SEQ ID NO: 506240 - DNA, 25 bp, Mus musculus
aagcaacccctgcttatcatcggga

SEQ ID NO: 506241 - DNA, 25 bp, Mus musculus
aagcaacccctggttatcatcggga

SEQ ID NO: 506242 - DNA, 25 bp, Mus musculus
aagcaacgacgcaccagtgaccagg

SEQ ID NO: 506243 - DNA, 25 bp, Mus musculus
aagcaacgacgctccagtgaccagg

SEQ ID NO: 506244 - DNA, 25 bp, Mus musculus
aagcaactagtaccggaatggaggc

SEQ ID NO: 506245 - DNA, 25 bp, Mus musculus
aagcaactagtagcggaatggaggc

SEQ ID NO: 506246 - DNA, 25 bp, Mus musculus
aagcaactcactcaaccagaaacct

SEQ ID NO: 506247 - DNA, 25 bp, Mus musculus
aagcaactcactgaaccagaaacct

SEQ ID NO: 506248 - DNA, 25 bp, Mus musculus
aagcaagaaatcaccgattggttac

SEQ ID NO: 506249 - DNA, 25 bp, Mus musculus
aagcaagaaatctccgattggttac

SEQ ID NO: 506250 - DNA, 25 bp, Mus musculus
aagcaagaagttatcagcaccagca

SEQ ID NO: 506251 - DNA, 25 bp, Mus musculus
aagcaagaagttttcagcaccagca

SEQ ID NO: 506252 - DNA, 25 bp, Mus musculus
aagcaagaatatacctggaggagag

SEQ ID NO: 506253 - DNA, 25 bp, Mus musculus
aagcaagaatattcctggaggagag

SEQ ID NO: 506254 - DNA, 25 bp, Mus musculus
aagcaagaatgtcgctggcttctgc

SEQ ID NO: 506255 - DNA, 25 bp, Mus musculus
aagcaagaatgtggctggcttctgc

SEQ ID NO: 506256 - DNA, 25 bp, Mus musculus
aagcaagataggatcaccagatatc

SEQ ID NO: 506257 - DNA, 25 bp, Mus musculus
aagcaagataggttcaccagatatc

SEQ ID NO: 506258 - DNA, 25 bp, Mus musculus
aagcaagatgcccttcagggccggc

SEQ ID NO: 506259 - DNA, 25 bp, Mus musculus
aagcaagatgccgttcagggccggc

SEQ ID NO: 506260 - DNA, 25 bp, Mus musculus
aagcaagcaggtatttcttgtgttg

SEQ ID NO: 506261 - DNA, 25 bp, Mus musculus
aagcaagcaggtttttcttgtgttg

SEQ ID NO: 506262 - DNA, 25 bp, Mus musculus
aagcaagccgctattattcagaccc

SEQ ID NO: 506263 - DNA, 25 bp, Mus musculus
aagcaagccgcttttattcagaccc

SEQ ID NO: 506264 - DNA, 25 bp, Mus musculus
aagcaagcctgaacagtgcctgact

SEQ ID NO: 506265 - DNA, 25 bp, Mus musculus
aagcaagcctgatcagtgcctgact

SEQ ID NO: 506266 - DNA, 25 bp, Mus musculus
aagcaaggccgtaccagcccagtga

SEQ ID NO: 506267 - DNA, 25 bp, Mus musculus
aagcaaggccgttccagcccagtga

SEQ ID NO: 506268 - DNA, 25 bp, Mus musculus
aagcaaggcggcacaagcatcctct

SEQ ID NO: 506269 - DNA, 25 bp, Mus musculus
aagcaaggcggctcaagcatcctct

SEQ ID NO: 506270 - DNA, 25 bp, Mus musculus
aagcaagggcagacccgactgtcta

SEQ ID NO: 506271 - DNA, 25 bp, Mus musculus
aagcaagggcagtcccgactgtcta

SEQ ID NO: 506272 - DNA, 25 bp, Mus musculus
aagcaaggggcaactcatggcagaa

SEQ ID NO: 506273 - DNA, 25 bp, Mus musculus
aagcaaggggcatctcatggcagaa

SEQ ID NO: 506274 - DNA, 25 bp, Mus musculus
aagcaagtgtgtcacgatccccagg

SEQ ID NO: 506275 - DNA, 25 bp, Mus musculus
aagcaagtgtgtgacgatccccagg

SEQ ID NO: 506276 - DNA, 25 bp, Mus musculus
aagcaataaggacaaggttgctcaa

SEQ ID NO: 506277 - DNA, 25 bp, Mus musculus
aagcaataaggagaaggttgctcaa

SEQ ID NO: 506278 - DNA, 25 bp, Mus musculus
aagcaatcatctacttggaccaaag

SEQ ID NO: 506279 - DNA, 25 bp, Mus musculus
aagcaatcatcttcttggaccaaag

SEQ ID NO: 506280 - DNA, 25 bp, Mus musculus
aagcaatccgggagctcttgcgcca

SEQ ID NO: 506281 - DNA, 25 bp, Mus musculus
aagcaatccgggtgctcttgcgcca

SEQ ID NO: 506282 - DNA, 25 bp, Mus musculus
aagcaatgaggaatggcatatcccc

SEQ ID NO: 506283 - DNA, 25 bp, Mus musculus
aagcaatgaggattggcatatcccc

SEQ ID NO: 506284 - DNA, 25 bp, Mus musculus
aagcaatgtggccacggagaccacc

SEQ ID NO: 506285 - DNA, 25 bp, Mus musculus
aagcaatgtggcgacggagaccacc

SEQ ID NO: 506286 - DNA, 25 bp, Mus musculus
aagcacaagaaacgcgagggcaacc

SEQ ID NO: 506287 - DNA, 25 bp, Mus musculus
aagcacaagaaaggcgagggcaacc

SEQ ID NO: 506288 - DNA, 25 bp, Mus musculus
aagcacaagcacctagccagcctga

SEQ ID NO: 506289 - DNA, 25 bp, Mus musculus
aagcacaagcacgtagccagcctga

SEQ ID NO: 506290 - DNA, 25 bp, Mus musculus
aagcacaagggcaatggttttatcg

SEQ ID NO: 506291 - DNA, 25 bp, Mus musculus
aagcacaagggctatggttttatcg

SEQ ID NO: 506292 - DNA, 25 bp, Mus musculus
aagcacaagtcacaggcagtcgatg

SEQ ID NO: 506293 - DNA, 25 bp, Mus musculus
aagcacaagtcagaggcagtcgatg

SEQ ID NO: 506294 - DNA, 25 bp, Mus musculus
aagcacaatgggacctccagaaaaa

SEQ ID NO: 506295 - DNA, 25 bp, Mus musculus
aagcacaatgggtcctccagaaaaa

SEQ ID NO: 506296 - DNA, 25 bp, Mus musculus
aagcacagcccgcatactagagcta

SEQ ID NO: 506297 - DNA, 25 bp, Mus musculus
aagcacagcccggatactagagcta

SEQ ID NO: 506298 - DNA, 25 bp, Mus musculus
aagcacaggcacaatgtttcttggc

SEQ ID NO: 506299 - DNA, 25 bp, Mus musculus
aagcacaggcactatgtttcttggc

SEQ ID NO: 506300 - DNA, 25 bp, Mus musculus
aagcacaggtggaagagttttctcc

SEQ ID NO: 506301 - DNA, 25 bp, Mus musculus
aagcacaggtggtagagttttctcc

SEQ ID NO: 506302 - DNA, 25 bp, Mus musculus
aagcacatctctcagcagaggacag

SEQ ID NO: 506303 - DNA, 25 bp, Mus musculus
aagcacatctctgagcagaggacag

SEQ ID NO: 506304 - DNA, 25 bp, Mus musculus
aagcacatgcagattcgagtgaatg

SEQ ID NO: 506305 - DNA, 25 bp, Mus musculus
aagcacatgcagtttcgagtgaatg

SEQ ID NO: 506306 - DNA, 25 bp, Mus musculus
aagcacattcgcctcctttcctgag

SEQ ID NO: 506307 - DNA, 25 bp, Mus musculus
aagcacattcgcgtcctttcctgag

SEQ ID NO: 506308 - DNA, 25 bp, Mus musculus
aagcaccaagagactggctgctccg

SEQ ID NO: 506309 - DNA, 25 bp, Mus musculus
aagcaccaagagtctggctgctccg

SEQ ID NO: 506310 - DNA, 25 bp, Mus musculus
aagcaccaccacaggcgatggaagg

SEQ ID NO: 506311 - DNA, 25 bp, Mus musculus
aagcaccaccactggcgatggaagg

SEQ ID NO: 506312 - DNA, 25 bp, Mus musculus
aagcaccagaatccattccagcttc

SEQ ID NO: 506313 - DNA, 25 bp, Mus musculus
aagcaccagaatgcattccagcttc

SEQ ID NO: 506314 - DNA, 25 bp, Mus musculus
aagcaccaggagctgcacgtgcacg

SEQ ID NO: 506315 - DNA, 25 bp, Mus musculus
aagcaccaggaggtgcacgtgcacg

SEQ ID NO: 506316 - DNA, 25 bp, Mus musculus
aagcaccaggccagcatcaatgaaa

SEQ ID NO: 506317 - DNA, 25 bp, Mus musculus
aagcaccaggcctgcatcaatgaaa

SEQ ID NO: 506318 - DNA, 25 bp, Mus musculus
aagcaccagtgtaggctattggcca

SEQ ID NO: 506319 - DNA, 25 bp, Mus musculus
aagcaccagtgttggctattggcca

SEQ ID NO: 506320 - DNA, 25 bp, Mus musculus
aagcaccatctccacggagttggcc

SEQ ID NO: 506321 - DNA, 25 bp, Mus musculus
aagcaccatctcgacggagttggcc

SEQ ID NO: 506322 - DNA, 25 bp, Mus musculus
aagcaccatgagaggcccctgctgc

SEQ ID NO: 506323 - DNA, 25 bp, Mus musculus
aagcaccatgagtggcccctgctgc

SEQ ID NO: 506324 - DNA, 25 bp, Mus musculus
aagcaccatggccatgatcaccaac

SEQ ID NO: 506325 - DNA, 25 bp, Mus musculus
aagcaccatggcgatgatcaccaac

SEQ ID NO: 506326 - DNA, 25 bp, Mus musculus
aagcaccattcaatgcagagagaat

SEQ ID NO: 506327 - DNA, 25 bp, Mus musculus
aagcaccattcattgcagagagaat

SEQ ID NO: 506328 - DNA, 25 bp, Mus musculus
aagcacccacgaaggaccccagatg

SEQ ID NO: 506329 - DNA, 25 bp, Mus musculus
aagcacccacgatggaccccagatg

SEQ ID NO: 506330 - DNA, 25 bp, Mus musculus
aagcacccatgacttcctgcatgaa

SEQ ID NO: 506331 - DNA, 25 bp, Mus musculus
aagcacccatgagttcctgcatgaa

SEQ ID NO: 506332 - DNA, 25 bp, Mus musculus
aagcacccttccaggtcacactgca

SEQ ID NO: 506333 - DNA, 25 bp, Mus musculus
aagcacccttcctggtcacactgca

SEQ ID NO: 506334 - DNA, 25 bp, Mus musculus
aagcaccgcaggactgagcagccct

SEQ ID NO: 506335 - DNA, 25 bp, Mus musculus
aagcaccgcaggtctgagcagccct

SEQ ID NO: 506336 - DNA, 25 bp, Mus musculus
aagcaccgcggaattctccctcgtg

SEQ ID NO: 506337 - DNA, 25 bp, Mus musculus
aagcaccgcggatttctccctcgtg

SEQ ID NO: 506338 - DNA, 25 bp, Mus musculus
aagcaccgtcagacgggccagaagg

SEQ ID NO: 506339 - DNA, 25 bp, Mus musculus
aagcaccgtcagtcgggccagaagg

SEQ ID NO: 506340 - DNA, 25 bp, Mus musculus
aagcacctagccaagacagcacaga

SEQ ID NO: 506341 - DNA, 25 bp, Mus musculus
aagcacctagcctagacagcacaga

SEQ ID NO: 506342 - DNA, 25 bp, Mus musculus
aagcacctatccacggaaggcagtg

SEQ ID NO: 506343 - DNA, 25 bp, Mus musculus
aagcacctatcctcggaaggcagtg

SEQ ID NO: 506344 - DNA, 25 bp, Mus musculus
aagcacctatgcattgctccactgg

SEQ ID NO: 506345 - DNA, 25 bp, Mus musculus
aagcacctatgctttgctccactgg

SEQ ID NO: 506346 - DNA, 25 bp, Mus musculus
aagcacctccttccaggatgtaggg

SEQ ID NO: 506347 - DNA, 25 bp, Mus musculus
aagcacctccttgcaggatgtaggg

SEQ ID NO: 506348 - DNA, 25 bp, Mus musculus
aagcacctggacacaattcctgaag

SEQ ID NO: 506349 - DNA, 25 bp, Mus musculus
aagcacctggactcaattcctgaag

SEQ ID NO: 506350 - DNA, 25 bp, Mus musculus
aagcacctttctcctgatggccagt

SEQ ID NO: 506351 - DNA, 25 bp, Mus musculus
aagcacctttctgctgatggccagt

SEQ ID NO: 506352 - DNA, 25 bp, Mus musculus
aagcacgatgcacccacctgctttg

SEQ ID NO: 506353 - DNA, 25 bp, Mus musculus
aagcacgatgcagccacctgctttg

SEQ ID NO: 506354 - DNA, 25 bp, Mus musculus
aagcacgtcaccatcaaccaagtga

SEQ ID NO: 506355 - DNA, 25 bp, Mus musculus
aagcacgtcaccttcaaccaagtga

SEQ ID NO: 506356 - DNA, 25 bp, Mus musculus
aagcacgttgccatgtggaggaact

SEQ ID NO: 506357 - DNA, 25 bp, Mus musculus
aagcacgttgccttgtggaggaact

SEQ ID NO: 506358 - DNA, 25 bp, Mus musculus
aagcactcagctattgactttacgg

SEQ ID NO: 506359 - DNA, 25 bp, Mus musculus
aagcactcagcttttgactttacgg

SEQ ID NO: 506360 - DNA, 25 bp, Mus musculus
aagcactccattatgggacagtgga

SEQ ID NO: 506361 - DNA, 25 bp, Mus musculus
aagcactccattttgggacagtgga

SEQ ID NO: 506362 - DNA, 25 bp, Mus musculus
aagcactgcagtcttcccattactc

SEQ ID NO: 506363 - DNA, 25 bp, Mus musculus
aagcactgcagtgttcccattactc

SEQ ID NO: 506364 - DNA, 25 bp, Mus musculus
aagcacttctccatggaaacataac

SEQ ID NO: 506365 - DNA, 25 bp, Mus musculus
aagcacttctccttggaaacataac

SEQ ID NO: 506366 - DNA, 25 bp, Mus musculus
aagcacttgcatagcagagtgtgag

SEQ ID NO: 506367 - DNA, 25 bp, Mus musculus
aagcacttgcattgcagagtgtgag

SEQ ID NO: 506368 - DNA, 25 bp, Mus musculus
aagcacttgctcaggaagggagagc

SEQ ID NO: 506369 - DNA, 25 bp, Mus musculus
aagcacttgctctggaagggagagc

SEQ ID NO: 506370 - DNA, 25 bp, Mus musculus
aagcagaaaccaagaccgtcagcag

SEQ ID NO: 506371 - DNA, 25 bp, Mus musculus
aagcagaaaccatgaccgtcagcag

SEQ ID NO: 506372 - DNA, 25 bp, Mus musculus
aagcagaaattcatctcccgagagt

SEQ ID NO: 506373 - DNA, 25 bp, Mus musculus
aagcagaaattcttctcccgagagt

SEQ ID NO: 506374 - DNA, 25 bp, Mus musculus
aagcagaaattgaacgcatgagaaa

SEQ ID NO: 506375 - DNA, 25 bp, Mus musculus
aagcagaaattgtacgcatgagaaa

SEQ ID NO: 506376 - DNA, 25 bp, Mus musculus
aagcagaacagacccacgagggcac

SEQ ID NO: 506377 - DNA, 25 bp, Mus musculus
aagcagaacagagccacgagggcac

SEQ ID NO: 506378 - DNA, 25 bp, Mus musculus
aagcagaactcccaagctggataga

SEQ ID NO: 506379 - DNA, 25 bp, Mus musculus
aagcagaactccgaagctggataga

SEQ ID NO: 506380 - DNA, 25 bp, Mus musculus
aagcagaagacccttcggtttggct

SEQ ID NO: 506381 - DNA, 25 bp, Mus musculus
aagcagaagaccgttcggtttggct

SEQ ID NO: 506382 - DNA, 25 bp, Mus musculus
aagcagaagactcaatatagagttt

SEQ ID NO: 506383 - DNA, 25 bp, Mus musculus
aagcagaagactgaatatagagttt

SEQ ID NO: 506384 - DNA, 25 bp, Mus musculus
aagcagaccctgcagcatttcctgg

SEQ ID NO: 506385 - DNA, 25 bp, Mus musculus
aagcagaccctggagcatttcctgg

SEQ ID NO: 506386 - DNA, 25 bp, Mus musculus
aagcagaccgccatgattgtagaca

SEQ ID NO: 506387 - DNA, 25 bp, Mus musculus
aagcagaccgccttgattgtagaca

SEQ ID NO: 506388 - DNA, 25 bp, Mus musculus
aagcagagaagcagactgtccaggc

SEQ ID NO: 506389 - DNA, 25 bp, Mus musculus
aagcagagaagctgactgtccaggc

SEQ ID NO: 506390 - DNA, 25 bp, Mus musculus
aagcagagactcagtaaggtggtaa

SEQ ID NO: 506391 - DNA, 25 bp, Mus musculus
aagcagagactctgtaaggtggtaa

SEQ ID NO: 506392 - DNA, 25 bp, Mus musculus
aagcagagcaaactggaagctaaat

SEQ ID NO: 506393 - DNA, 25 bp, Mus musculus
aagcagagcaaagtggaagctaaat

SEQ ID NO: 506394 - DNA, 25 bp, Mus musculus
aagcagagctgcagtcaatgttgga

SEQ ID NO: 506395 - DNA, 25 bp, Mus musculus
aagcagagctgctgtcaatgttgga

SEQ ID NO: 506396 - DNA, 25 bp, Mus musculus
aagcagagcttcagaatagcccatc

SEQ ID NO: 506397 - DNA, 25 bp, Mus musculus
aagcagagcttctgaatagcccatc

SEQ ID NO: 506398 - DNA, 25 bp, Mus musculus
aagcagaggatgctgaccgtatttc

SEQ ID NO: 506399 - DNA, 25 bp, Mus musculus
aagcagaggatggtgaccgtatttc

SEQ ID NO: 506400 - DNA, 25 bp, Mus musculus
aagcagaggcctcgagacagctgct

SEQ ID NO: 506401 - DNA, 25 bp, Mus musculus
aagcagaggcctggagacagctgct

SEQ ID NO: 506402 - DNA, 25 bp, Mus musculus
aagcagagtggccatgacagcttcg

SEQ ID NO: 506403 - DNA, 25 bp, Mus musculus
aagcagagtggcgatgacagcttcg

SEQ ID NO: 506404 - DNA, 25 bp, Mus musculus
aagcagatctggacgctggagcaac

SEQ ID NO: 506405 - DNA, 25 bp, Mus musculus
aagcagatctggtcgctggagcaac

SEQ ID NO: 506406 - DNA, 25 bp, Mus musculus
aagcagatgatgacaaggaacagat

SEQ ID NO: 506407 - DNA, 25 bp, Mus musculus
aagcagatgatgcttctggtaggaa

SEQ ID NO: 506408 - DNA, 25 bp, Mus musculus
aagcagatgatggttctggtaggaa

SEQ ID NO: 506409 - DNA, 25 bp, Mus musculus
aagcagatgatgtcaaggaacagat

SEQ ID NO: 506410 - DNA, 25 bp, Mus musculus
aagcagatgtacagtggcatccctg

SEQ ID NO: 506411 - DNA, 25 bp, Mus musculus
aagcagatgtactgtggcatccctg

SEQ ID NO: 506412 - DNA, 25 bp, Mus musculus
aagcagatgtttcgaccacaagtgc

SEQ ID NO: 506413 - DNA, 25 bp, Mus musculus
aagcagatgtttggaccacaagtgc

SEQ ID NO: 506414 - DNA, 25 bp, Mus musculus
aagcagcaacatcggaagacagtgg

SEQ ID NO: 506415 - DNA, 25 bp, Mus musculus
aagcagcaacatgggaagacagtgg

SEQ ID NO: 506416 - DNA, 25 bp, Mus musculus
aagcagcagcagaaagccaccttct

SEQ ID NO: 506417 - DNA, 25 bp, Mus musculus
aagcagcagcagtaagccaccttct

SEQ ID NO: 506418 - DNA, 25 bp, Mus musculus
aagcagccaagcctattcactgagg

SEQ ID NO: 506419 - DNA, 25 bp, Mus musculus
aagcagccaagcgtattcactgagg

SEQ ID NO: 506420 - DNA, 25 bp, Mus musculus
aagcagccagtcagggtctttctaa

SEQ ID NO: 506421 - DNA, 25 bp, Mus musculus
aagcagccagtctgggtctttctaa

SEQ ID NO: 506422 - DNA, 25 bp, Mus musculus
aagcagccagtgaccccgggaagct

SEQ ID NO: 506423 - DNA, 25 bp, Mus musculus
aagcagccagtgtccccgggaagct

SEQ ID NO: 506424 - DNA, 25 bp, Mus musculus
aagcagccattccaagagccggtct

SEQ ID NO: 506425 - DNA, 25 bp, Mus musculus
aagcagccattcgaagagccggtct

SEQ ID NO: 506426 - DNA, 25 bp, Mus musculus
aagcagccctagacccagatggaac

SEQ ID NO: 506427 - DNA, 25 bp, Mus musculus
aagcagccctagtcccagatggaac

SEQ ID NO: 506428 - DNA, 25 bp, Mus musculus
aagcagccctcacagacgggctcga

SEQ ID NO: 506429 - DNA, 25 bp, Mus musculus
aagcagccctcagagacgggctcga

SEQ ID NO: 506430 - DNA, 25 bp, Mus musculus
aagcagccctctatccggcaatact

SEQ ID NO: 506431 - DNA, 25 bp, Mus musculus
aagcagccctctttccggcaatact

SEQ ID NO: 506432 - DNA, 25 bp, Mus musculus
aagcagccctgtactgacgatgatg

SEQ ID NO: 506433 - DNA, 25 bp, Mus musculus
aagcagccctgttctgacgatgatg

SEQ ID NO: 506434 - DNA, 25 bp, Mus musculus
aagcagccgatgactatgcattcgg

SEQ ID NO: 506435 - DNA, 25 bp, Mus musculus
aagcagccgatgtctatgcattcgg

SEQ ID NO: 506436 - DNA, 25 bp, Mus musculus
aagcagcctcttacatccatgtgtc

SEQ ID NO: 506437 - DNA, 25 bp, Mus musculus
aagcagcctctttcatccatgtgtc

SEQ ID NO: 506438 - DNA, 25 bp, Mus musculus
aagcagcggagaaacaggacaacat

SEQ ID NO: 506439 - DNA, 25 bp, Mus musculus
aagcagcggagatacaggacaacat

SEQ ID NO: 506440 - DNA, 25 bp, Mus musculus
aagcagctatacaacatctacgcca

SEQ ID NO: 506441 - DNA, 25 bp, Mus musculus
aagcagctatactacatctacgcca

SEQ ID NO: 506442 - DNA, 25 bp, Mus musculus
aagcagctgagcaccctaagctgca

SEQ ID NO: 506443 - DNA, 25 bp, Mus musculus
aagcagctgagctccctaagctgca

SEQ ID NO: 506444 - DNA, 25 bp, Mus musculus
aagcagctgcttcactgtatggcct

SEQ ID NO: 506445 - DNA, 25 bp, Mus musculus
aagcagctgcttgactgtatggcct

SEQ ID NO: 506446 - DNA, 25 bp, Mus musculus
aagcagctggcgaaacagctcccgg

SEQ ID NO: 506447 - DNA, 25 bp, Mus musculus
aagcagctggcgtaacagctcccgg

SEQ ID NO: 506448 - DNA, 25 bp, Mus musculus
aagcaggaagatcccgaagctcaca

SEQ ID NO: 506449 - DNA, 25 bp, Mus musculus
aagcaggaagatgccgaagctcaca

SEQ ID NO: 506450 - DNA, 25 bp, Mus musculus
aagcaggaagggattggagctttcc

SEQ ID NO: 506451 - DNA, 25 bp, Mus musculus
aagcaggaagggtttggagctttcc

SEQ ID NO: 506452 - DNA, 25 bp, Mus musculus
aagcaggacattactgacaaaaagg

SEQ ID NO: 506453 - DNA, 25 bp, Mus musculus
aagcaggacatttctgacaaaaagg

SEQ ID NO: 506454 - DNA, 25 bp, Mus musculus
aagcaggagaagacacagtgactgg

SEQ ID NO: 506455 - DNA, 25 bp, Mus musculus
aagcaggagaagtcacagtgactgg

SEQ ID NO: 506456 - DNA, 25 bp, Mus musculus
aagcaggagaggattagccggtacc

SEQ ID NO: 506457 - DNA, 25 bp, Mus musculus
aagcaggagaggtttagccggtacc

SEQ ID NO: 506458 - DNA, 25 bp, Mus musculus
aagcaggagctgcagccatatgata

SEQ ID NO: 506459 - DNA, 25 bp, Mus musculus
aagcaggagctggagccatatgata

SEQ ID NO: 506460 - DNA, 25 bp, Mus musculus
aagcaggcagacatccaggctgcgc

SEQ ID NO: 506461 - DNA, 25 bp, Mus musculus
aagcaggcagacttccaggctgcgc

SEQ ID NO: 506462 - DNA, 25 bp, Mus musculus
aagcaggcatcgcagacaccccgaa

SEQ ID NO: 506463 - DNA, 25 bp, Mus musculus
aagcaggcatcggagacaccccgaa

SEQ ID NO: 506464 - DNA, 25 bp, Mus musculus
aagcaggccaacagcccactatacg

SEQ ID NO: 506465 - DNA, 25 bp, Mus musculus
aagcaggccaactgcccactatacg

SEQ ID NO: 506466 - DNA, 25 bp, Mus musculus
aagcaggccatacacagggccctgg

SEQ ID NO: 506467 - DNA, 25 bp, Mus musculus
aagcaggccatagacagggccctgg

SEQ ID NO: 506468 - DNA, 25 bp, Mus musculus
aagcaggccgacctgcaaacgctga

SEQ ID NO: 506469 - DNA, 25 bp, Mus musculus
aagcaggccgacgtgcaaacgctga

SEQ ID NO: 506470 - DNA, 25 bp, Mus musculus
aagcaggccgcaccttctgccatga

SEQ ID NO: 506471 - DNA, 25 bp, Mus musculus
aagcaggccgcagcttctgccatga

SEQ ID NO: 506472 - DNA, 25 bp, Mus musculus
aagcaggtcccgatcacaagagtcg

SEQ ID NO: 506473 - DNA, 25 bp, Mus musculus
aagcaggtcccgttcacaagagtcg

SEQ ID NO: 506474 - DNA, 25 bp, Mus musculus
aagcaggtcgtcacccaatcggaga

SEQ ID NO: 506475 - DNA, 25 bp, Mus musculus
aagcaggtcgtctcccaatcggaga

SEQ ID NO: 506476 - DNA, 25 bp, Mus musculus
aagcaggtgaccagtgctctggccg

SEQ ID NO: 506477 - DNA, 25 bp, Mus musculus
aagcaggtgacctgtgctctggccg

SEQ ID NO: 506478 - DNA, 25 bp, Mus musculus
aagcaggtgcgacatgcatacatcc

SEQ ID NO: 506479 - DNA, 25 bp, Mus musculus
aagcaggtgcgagatgcatacatcc

SEQ ID NO: 506480 - DNA, 25 bp, Mus musculus
aagcaggtgtcaagatgttgtccgc

SEQ ID NO: 506481 - DNA, 25 bp, Mus musculus
aagcaggtgtcatgatgttgtccgc

SEQ ID NO: 506482 - DNA, 25 bp, Mus musculus
aagcaggtttgcatgagagtcgtgc

SEQ ID NO: 506483 - DNA, 25 bp, Mus musculus
aagcaggtttgcttgagagtcgtgc

SEQ ID NO: 506484 - DNA, 25 bp, Mus musculus
aagcagtcagacacacagccggcct

SEQ ID NO: 506485 - DNA, 25 bp, Mus musculus
aagcagtcagactcacagccggcct

SEQ ID NO: 506486 - DNA, 25 bp, Mus musculus
aagcagtcagcgcagtcagtgtcca

SEQ ID NO: 506487 - DNA, 25 bp, Mus musculus
aagcagtcagcggagtcagtgtcca

SEQ ID NO: 506488 - DNA, 25 bp, Mus musculus
aagcagtcagctcgccttggtcctg

SEQ ID NO: 506489 - DNA, 25 bp, Mus musculus
aagcagtcagctggccttggtcctg

SEQ ID NO: 506490 - DNA, 25 bp, Mus musculus
aagcagtcatacctgcaggtggcct

SEQ ID NO: 506491 - DNA, 25 bp, Mus musculus
aagcagtcatacgtgcaggtggcct

SEQ ID NO: 506492 - DNA, 25 bp, Mus musculus
aagcagtcgcagctgttggctttga

SEQ ID NO: 506493 - DNA, 25 bp, Mus musculus
aagcagtcgcaggtgttggctttga

SEQ ID NO: 506494 - DNA, 25 bp, Mus musculus
aagcagtgccgtcagcgctggcaca

SEQ ID NO: 506495 - DNA, 25 bp, Mus musculus
aagcagtgccgtgagcgctggcaca

SEQ ID NO: 506496 - DNA, 25 bp, Mus musculus
aagcagtgcctccagccttttcagc

SEQ ID NO: 506497 - DNA, 25 bp, Mus musculus
aagcagtgcctcgagccttttcagc

SEQ ID NO: 506498 - DNA, 25 bp, Mus musculus
aagcagtgcgtgcagcggaagtgcc

SEQ ID NO: 506499 - DNA, 25 bp, Mus musculus
aagcagtgcgtggagcggaagtgcc

SEQ ID NO: 506500 - DNA, 25 bp, Mus musculus
aagcagtgcgttaataacttctcag

SEQ ID NO: 506501 - DNA, 25 bp, Mus musculus
aagcagtgcgtttataacttctcag

SEQ ID NO: 506502 - DNA, 25 bp, Mus musculus
aagcagtggaagcagcagcgggcct

SEQ ID NO: 506503 - DNA, 25 bp, Mus musculus
aagcagtggaaggagcagcgggcct

SEQ ID NO: 506504 - DNA, 25 bp, Mus musculus
aagcagtggtgaatgccgcaattcc

SEQ ID NO: 506505 - DNA, 25 bp, Mus musculus
aagcagtggtgattgccgcaattcc

SEQ ID NO: 506506 - DNA, 25 bp, Mus musculus
aagcagtgtggccatttaatcacag

SEQ ID NO: 506507 - DNA, 25 bp, Mus musculus
aagcagtgtggcgatttaatcacag

SEQ ID NO: 506508 - DNA, 25 bp, Mus musculus
aagcagttaggacaggctgaaattc

SEQ ID NO: 506509 - DNA, 25 bp, Mus musculus
aagcagttaggagaggctgaaattc

SEQ ID NO: 506510 - DNA, 25 bp, Mus musculus
aagcagttgagaccccgttgagagc

SEQ ID NO: 506511 - DNA, 25 bp, Mus musculus
aagcagttgagagcccgttgagagc

SEQ ID NO: 506512 - DNA, 25 bp, Mus musculus
aagcagttggatcttttctacaaaa

SEQ ID NO: 506513 - DNA, 25 bp, Mus musculus
aagcagttggatgttttctacaaaa

SEQ ID NO: 506514 - DNA, 25 bp, Mus musculus
aagcagttggtgagattttccttgg

SEQ ID NO: 506515 - DNA, 25 bp, Mus musculus
aagcagttggtgcaagacctggacc

SEQ ID NO: 506516 - DNA, 25 bp, Mus musculus
aagcagttggtggaagacctggacc

SEQ ID NO: 506517 - DNA, 25 bp, Mus musculus
aagcagttggtgtgattttccttgg

SEQ ID NO: 506518 - DNA, 25 bp, Mus musculus
aagcataaagtgaagatagggctgg

SEQ ID NO: 506519 - DNA, 25 bp, Mus musculus
aagcataaagtgtagatagggctgg

SEQ ID NO: 506520 - DNA, 25 bp, Mus musculus
aagcatacagatccctccgtgatca

SEQ ID NO: 506521 - DNA, 25 bp, Mus musculus
aagcatacagatgcctccgtgatca

SEQ ID NO: 506522 - DNA, 25 bp, Mus musculus
aagcatatcttactgtcggagcagc

SEQ ID NO: 506523 - DNA, 25 bp, Mus musculus
aagcatatcttagtgtcggagcagc

SEQ ID NO: 506524 - DNA, 25 bp, Mus musculus
aagcatcagcaacacgcgaggcgcg

SEQ ID NO: 506525 - DNA, 25 bp, Mus musculus
aagcatcagcaagacgcgaggcgcg

SEQ ID NO: 506526 - DNA, 25 bp, Mus musculus
aagcatcgtggcacaccggtgtccc

SEQ ID NO: 506527 - DNA, 25 bp, Mus musculus
aagcatcgtggctcaccggtgtccc

SEQ ID NO: 506528 - DNA, 25 bp, Mus musculus
aagcatctgaaaagggtctcatcca

SEQ ID NO: 506529 - DNA, 25 bp, Mus musculus
aagcatctgaaatgggtctcatcca

SEQ ID NO: 506530 - DNA, 25 bp, Mus musculus
aagcatctgagtagggtgacggtcc

SEQ ID NO: 506531 - DNA, 25 bp, Mus musculus
aagcatctgagttgggtgacggtcc

SEQ ID NO: 506532 - DNA, 25 bp, Mus musculus
aagcatctgcagctggtcagcggcc

SEQ ID NO: 506533 - DNA, 25 bp, Mus musculus
aagcatctgcaggtggtcagcggcc

SEQ ID NO: 506534 - DNA, 25 bp, Mus musculus
aagcatgaagaaaaccaccggcctt

SEQ ID NO: 506535 - DNA, 25 bp, Mus musculus
aagcatgaagaataccaccggcctt

SEQ ID NO: 506536 - DNA, 25 bp, Mus musculus
aagcatgaagctatggagaatgact

SEQ ID NO: 506537 - DNA, 25 bp, Mus musculus
aagcatgaagctttggagaatgact

SEQ ID NO: 506538 - DNA, 25 bp, Mus musculus
aagcatgagcggaaacttcgaggca

SEQ ID NO: 506539 - DNA, 25 bp, Mus musculus
aagcatgagcggtaacttcgaggca

SEQ ID NO: 506540 - DNA, 25 bp, Mus musculus
aagcatgcattcaagtggagggctc

SEQ ID NO: 506541 - DNA, 25 bp, Mus musculus
aagcatgcattctagtggagggctc

SEQ ID NO: 506542 - DNA, 25 bp, Mus musculus
aagcatgctagtcattcaagttcat

SEQ ID NO: 506543 - DNA, 25 bp, Mus musculus
aagcatgctagtgattcaagttcat

SEQ ID NO: 506544 - DNA, 25 bp, Mus musculus
aagcatggacccagggtatgggaca

SEQ ID NO: 506545 - DNA, 25 bp, Mus musculus
aagcatggaccctgggtatgggaca

SEQ ID NO: 506546 - DNA, 25 bp, Mus musculus
aagcatggtccacagccaggaggca

SEQ ID NO: 506547 - DNA, 25 bp, Mus musculus
aagcatggtccagagccaggaggca

SEQ ID NO: 506548 - DNA, 25 bp, Mus musculus
aagcatgttctccacatgttggaaa

SEQ ID NO: 506549 - DNA, 25 bp, Mus musculus
aagcatgttctcgacatgttggaaa

SEQ ID NO: 506550 - DNA, 25 bp, Mus musculus
aagcatgttgcaaaagcttctggag

SEQ ID NO: 506551 - DNA, 25 bp, Mus musculus
aagcatgttgcataagcttctggag

SEQ ID NO: 506552 - DNA, 25 bp, Mus musculus
aagcattaccatcaaaacatcgccg

SEQ ID NO: 506553 - DNA, 25 bp, Mus musculus
aagcattaccatgaaaacatcgccg

SEQ ID NO: 506554 - DNA, 25 bp, Mus musculus
aagcattcagttagacgagcaaacc

SEQ ID NO: 506555 - DNA, 25 bp, Mus musculus
aagcattcagtttgacgagcaaacc

SEQ ID NO: 506556 - DNA, 25 bp, Mus musculus
aagcattccaataacaaggccatga

SEQ ID NO: 506557 - DNA, 25 bp, Mus musculus
aagcattccaattacaaggccatga

SEQ ID NO: 506558 - DNA, 25 bp, Mus musculus
aagcattcggagcagccagagcctg

SEQ ID NO: 506559 - DNA, 25 bp, Mus musculus
aagcattcggaggagccagagcctg

SEQ ID NO: 506560 - DNA, 25 bp, Mus musculus
aagcattgcctgctactccccagaa

SEQ ID NO: 506561 - DNA, 25 bp, Mus musculus
aagcattgcctggtactccccagaa

SEQ ID NO: 506562 - DNA, 25 bp, Mus musculus
aagcatttccttcgcagggtaccaa

SEQ ID NO: 506563 - DNA, 25 bp, Mus musculus
aagcatttccttggcagggtaccaa

SEQ ID NO: 506564 - DNA, 25 bp, Mus musculus
aagcattttaataatgacatctgcc

SEQ ID NO: 506565 - DNA, 25 bp, Mus musculus
aagcattttaattatgacatctgcc

SEQ ID NO: 506566 - DNA, 25 bp, Mus musculus
aagcattttgggagaaaacattcag

SEQ ID NO: 506567 - DNA, 25 bp, Mus musculus
aagcattttgggtgaaaacattcag

SEQ ID NO: 506568 - DNA, 25 bp, Mus musculus
aagccaaaaatgatcttcatccaag

SEQ ID NO: 506569 - DNA, 25 bp, Mus musculus
aagccaaaaatgttcttcatccaag

SEQ ID NO: 506570 - DNA, 25 bp, Mus musculus
aagccaaacactctcgtgattggat

SEQ ID NO: 506571 - DNA, 25 bp, Mus musculus
aagccaaacactgtcgtgattggat

SEQ ID NO: 506572 - DNA, 25 bp, Mus musculus
aagccaaagatgacaagtccaaact

SEQ ID NO: 506573 - DNA, 25 bp, Mus musculus
aagccaaagatgtcaagtccaaact

SEQ ID NO: 506574 - DNA, 25 bp, Mus musculus
aagccaaagggaacggttcagacca

SEQ ID NO: 506575 - DNA, 25 bp, Mus musculus
aagccaaagggatcggttcagacca

SEQ ID NO: 506576 - DNA, 25 bp, Mus musculus
aagccaaataaaagcaaatgttgtg

SEQ ID NO: 506577 - DNA, 25 bp, Mus musculus
aagccaaataaatgcaaatgttgtg

SEQ ID NO: 506578 - DNA, 25 bp, Mus musculus
aagccaaatgtgatagctcccagtt

SEQ ID NO: 506579 - DNA, 25 bp, Mus musculus
aagccaaatgtgttagctcccagtt

SEQ ID NO: 506580 - DNA, 25 bp, Mus musculus
aagccaacacatccctggctgcagt

SEQ ID NO: 506581 - DNA, 25 bp, Mus musculus
aagccaacacatgcctggctgcagt

SEQ ID NO: 506582 - DNA, 25 bp, Mus musculus
aagccaacattgaggctcaccatga

SEQ ID NO: 506583 - DNA, 25 bp, Mus musculus
aagccaacattgtggctcaccatga

SEQ ID NO: 506584 - DNA, 25 bp, Mus musculus
aagccaacctggactggctgcgcgc

SEQ ID NO: 506585 - DNA, 25 bp, Mus musculus
aagccaacctggtctggctgcgcgc

SEQ ID NO: 506586 - DNA, 25 bp, Mus musculus
aagccaacgagacggagtgtcccat

SEQ ID NO: 506587 - DNA, 25 bp, Mus musculus
aagccaacgagagggagtgtcccat

SEQ ID NO: 506588 - DNA, 25 bp, Mus musculus
aagccaagaaccaggaactggccga

SEQ ID NO: 506589 - DNA, 25 bp, Mus musculus
aagccaagaacctggaactggccga

SEQ ID NO: 506590 - DNA, 25 bp, Mus musculus
aagccaagagctactgctctgtaag

SEQ ID NO: 506591 - DNA, 25 bp, Mus musculus
aagccaagagcttctgctctgtaag

SEQ ID NO: 506592 - DNA, 25 bp, Mus musculus
aagccaagccggacatccatgagca

SEQ ID NO: 506593 - DNA, 25 bp, Mus musculus
aagccaagccggtcatccatgagca

SEQ ID NO: 506594 - DNA, 25 bp, Mus musculus
aagccaagctggataaaccagatgt

SEQ ID NO: 506595 - DNA, 25 bp, Mus musculus
aagccaagctggttaaaccagatgt

SEQ ID NO: 506596 - DNA, 25 bp, Mus musculus
aagccaaggacgatgatgagacccc

SEQ ID NO: 506597 - DNA, 25 bp, Mus musculus
aagccaaggacgttgatgagacccc

SEQ ID NO: 506598 - DNA, 25 bp, Mus musculus
aagccaaggagaagacacagtcact

SEQ ID NO: 506599 - DNA, 25 bp, Mus musculus
aagccaaggagatgacacagtcact

SEQ ID NO: 506600 - DNA, 25 bp, Mus musculus
aagccaaggctcctcgtaacagtca

SEQ ID NO: 506601 - DNA, 25 bp, Mus musculus
aagccaaggctcgtcgtaacagtca

SEQ ID NO: 506602 - DNA, 25 bp, Mus musculus
aagccaagtagacctccgggaacaa

SEQ ID NO: 506603 - DNA, 25 bp, Mus musculus
aagccaagtagagctccgggaacaa

SEQ ID NO: 506604 - DNA, 25 bp, Mus musculus
aagccaagtggactgtcggccgcct

SEQ ID NO: 506605 - DNA, 25 bp, Mus musculus
aagccaagtggagtgtcggccgcct

SEQ ID NO: 506606 - DNA, 25 bp, Mus musculus
aagccaatctgccaaagtccccagt

SEQ ID NO: 506607 - DNA, 25 bp, Mus musculus
aagccaatctgcgaaagtccccagt

SEQ ID NO: 506608 - DNA, 25 bp, Mus musculus
aagccaatgccgatcaacaaaatga

SEQ ID NO: 506609 - DNA, 25 bp, Mus musculus
aagccaatgccgttcaacaaaatga

SEQ ID NO: 506610 - DNA, 25 bp, Mus musculus
aagccaatgtcgagggcatccatgt

SEQ ID NO: 506611 - DNA, 25 bp, Mus musculus
aagccaatgtcgtgggcatccatgt

SEQ ID NO: 506612 - DNA, 25 bp, Mus musculus
aagccaattaccagtcccaagctct

SEQ ID NO: 506613 - DNA, 25 bp, Mus musculus
aagccaattacctgtcccaagctct

SEQ ID NO: 506614 - DNA, 25 bp, Mus musculus
aagccacacaagactcgtagccgga

SEQ ID NO: 506615 - DNA, 25 bp, Mus musculus
aagccacacaagagccacctgtgcg

SEQ ID NO: 506616 - DNA, 25 bp, Mus musculus
aagccacacaagtctcgtagccgga

SEQ ID NO: 506617 - DNA, 25 bp, Mus musculus
aagccacacaagtgccacctgtgcg

SEQ ID NO: 506618 - DNA, 25 bp, Mus musculus
aagccacagaagaggtgtccttgga

SEQ ID NO: 506619 - DNA, 25 bp, Mus musculus
aagccacagaagtggtgtccttgga

SEQ ID NO: 506620 - DNA, 25 bp, Mus musculus
aagccacagctcattatttcgaagg

SEQ ID NO: 506621 - DNA, 25 bp, Mus musculus
aagccacagctctttatttcgaagg

SEQ ID NO: 506622 - DNA, 25 bp, Mus musculus
aagccacaggacctgtgtactgccc

SEQ ID NO: 506623 - DNA, 25 bp, Mus musculus
aagccacaggacgtgtgtactgccc

SEQ ID NO: 506624 - DNA, 25 bp, Mus musculus
aagccacagtcactgggaactacaa

SEQ ID NO: 506625 - DNA, 25 bp, Mus musculus
aagccacagtcagtgggaactacaa

SEQ ID NO: 506626 - DNA, 25 bp, Mus musculus
aagccacagttgctatggagctcgc

SEQ ID NO: 506627 - DNA, 25 bp, Mus musculus
aagccacagttggtatggagctcgc

SEQ ID NO: 506628 - DNA, 25 bp, Mus musculus
aagccaccatgcaaacaacccagag

SEQ ID NO: 506629 - DNA, 25 bp, Mus musculus
aagccaccatgctaacaacccagag

SEQ ID NO: 506630 - DNA, 25 bp, Mus musculus
aagccaccctttcttgtgagtcgca

SEQ ID NO: 506631 - DNA, 25 bp, Mus musculus
aagccaccctttgttgtgagtcgca

SEQ ID NO: 506632 - DNA, 25 bp, Mus musculus
aagccaccgagccagtgaatgacag

SEQ ID NO: 506633 - DNA, 25 bp, Mus musculus
aagccaccgagcgagtgaatgacag

SEQ ID NO: 506634 - DNA, 25 bp, Mus musculus
aagccacctacgacatcgaggtcaa

SEQ ID NO: 506635 - DNA, 25 bp, Mus musculus
aagccacctacgtcatcgaggtcaa

SEQ ID NO: 506636 - DNA, 25 bp, Mus musculus
aagccacgctatcagatccgatgga

SEQ ID NO: 506637 - DNA, 25 bp, Mus musculus
aagccacgctatgagatccgatgga

SEQ ID NO: 506638 - DNA, 25 bp, Mus musculus
aagccacggattcgtgtagccatcg

SEQ ID NO: 506639 - DNA, 25 bp, Mus musculus
aagccacggattggtgtagccatcg

SEQ ID NO: 506640 - DNA, 25 bp, Mus musculus
aagccactctgtccctcggacggga

SEQ ID NO: 506641 - DNA, 25 bp, Mus musculus
aagccactctgtgcctcggacggga

SEQ ID NO: 506642 - DNA, 25 bp, Mus musculus
aagccactgggaagtcactcgttag

SEQ ID NO: 506643 - DNA, 25 bp, Mus musculus
aagccactgggatgtcactcgttag

SEQ ID NO: 506644 - DNA, 25 bp, Mus musculus
aagccactgtggaatgacatatata

SEQ ID NO: 506645 - DNA, 25 bp, Mus musculus
aagccactgtggtatgacatatata

SEQ ID NO: 506646 - DNA, 25 bp, Mus musculus
aagccactgtttagaatccatctga

SEQ ID NO: 506647 - DNA, 25 bp, Mus musculus
aagccactgttttgaatccatctga

SEQ ID NO: 506648 - DNA, 25 bp, Mus musculus
aagccagaaaaacccaaactcttat

SEQ ID NO: 506649 - DNA, 25 bp, Mus musculus
aagccagaaaaagccaaactcttat

SEQ ID NO: 506650 - DNA, 25 bp, Mus musculus
aagccagaaaacattctcttggact

SEQ ID NO: 506651 - DNA, 25 bp, Mus musculus
aagccagaaaactttctcttggact

SEQ ID NO: 506652 - DNA, 25 bp, Mus musculus
aagccagacaccatactcgacaact

SEQ ID NO: 506653 - DNA, 25 bp, Mus musculus
aagccagacaccttactcgacaact

SEQ ID NO: 506654 - DNA, 25 bp, Mus musculus
aagccagacgctacaagacttgccc

SEQ ID NO: 506655 - DNA, 25 bp, Mus musculus
aagccagacgcttcaagacttgccc

SEQ ID NO: 506656 - DNA, 25 bp, Mus musculus
aagccagagaacatcctatgtgagc

SEQ ID NO: 506657 - DNA, 25 bp, Mus musculus
aagccagagaacttcctatgtgagc

SEQ ID NO: 506658 - DNA, 25 bp, Mus musculus
aagccagagggcactccgggtcagt

SEQ ID NO: 506659 - DNA, 25 bp, Mus musculus
aagccagagggctctccgggtcagt

SEQ ID NO: 506660 - DNA, 25 bp, Mus musculus
aagccagaggtgatcttcaaattgg

SEQ ID NO: 506661 - DNA, 25 bp, Mus musculus
aagccagaggtgttcttcaaattgg

SEQ ID NO: 506662 - DNA, 25 bp, Mus musculus
aagccagatcttcgtctttggccca

SEQ ID NO: 506663 - DNA, 25 bp, Mus musculus
aagccagatcttggtctttggccca

SEQ ID NO: 506664 - DNA, 25 bp, Mus musculus
aagccagcccagagaggacgctgag

SEQ ID NO: 506665 - DNA, 25 bp, Mus musculus
aagccagcccagtgaggacgctgag

SEQ ID NO: 506666 - DNA, 25 bp, Mus musculus
aagccagcctttatggtctggcagg

SEQ ID NO: 506667 - DNA, 25 bp, Mus musculus
aagccagcctttttggtctggcagg

SEQ ID NO: 506668 - DNA, 25 bp, Mus musculus
aagccagcgaacatcctgctggatg

SEQ ID NO: 506669 - DNA, 25 bp, Mus musculus
aagccagcgaacttcctgctggatg

SEQ ID NO: 506670 - DNA, 25 bp, Mus musculus
aagccagcgacgaccatcaggtggt

SEQ ID NO: 506671 - DNA, 25 bp, Mus musculus
aagccagcgacgtccatcaggtggt

SEQ ID NO: 506672 - DNA, 25 bp, Mus musculus
aagccagcgagtctgcgtcgccagc

SEQ ID NO: 506673 - DNA, 25 bp, Mus musculus
aagccagcgagtgtgcgtcgccagc

SEQ ID NO: 506674 - DNA, 25 bp, Mus musculus
aagccagcgttcatcctgagctcca

SEQ ID NO: 506675 - DNA, 25 bp, Mus musculus
aagccagcgttcttcctgagctcca

SEQ ID NO: 506676 - DNA, 25 bp, Mus musculus
aagccagctcgaaaaacctctgcag

SEQ ID NO: 506677 - DNA, 25 bp, Mus musculus
aagccagctcgataaacctctgcag

SEQ ID NO: 506678 - DNA, 25 bp, Mus musculus
aagccaggaggcattgatgtatccg

SEQ ID NO: 506679 - DNA, 25 bp, Mus musculus
aagccaggaggctttgatgtatccg

SEQ ID NO: 506680 - DNA, 25 bp, Mus musculus
aagccaggatccacttgatcaagct

SEQ ID NO: 506681 - DNA, 25 bp, Mus musculus
aagccaggatcctcttgatcaagct

SEQ ID NO: 506682 - DNA, 25 bp, Mus musculus
aagccaggcctgactagccaccagg

SEQ ID NO: 506683 - DNA, 25 bp, Mus musculus
aagccaggcctgtctagccaccagg

SEQ ID NO: 506684 - DNA, 25 bp, Mus musculus
aagccagggtacctggagcaactcc

SEQ ID NO: 506685 - DNA, 25 bp, Mus musculus
aagccagggtacgtggagcaactcc

SEQ ID NO: 506686 - DNA, 25 bp, Mus musculus
aagccagtcaaacagaaccagagtg

SEQ ID NO: 506687 - DNA, 25 bp, Mus musculus
aagccagtcaaagagaaccagagtg

SEQ ID NO: 506688 - DNA, 25 bp, Mus musculus
aagccagtccttcattactttgatg

SEQ ID NO: 506689 - DNA, 25 bp, Mus musculus
aagccagtccttgattactttgatg

SEQ ID NO: 506690 - DNA, 25 bp, Mus musculus
aagccagtgcccatatcgaccgacc

SEQ ID NO: 506691 - DNA, 25 bp, Mus musculus
aagccagtgcccttatcgaccgacc

SEQ ID NO: 506692 - DNA, 25 bp, Mus musculus
aagccagtgtcacccatggagccca

SEQ ID NO: 506693 - DNA, 25 bp, Mus musculus
aagccagtgtcagccatggagccca

SEQ ID NO: 506694 - DNA, 25 bp, Mus musculus
aagccagtgtcccatttcttctgcc

SEQ ID NO: 506695 - DNA, 25 bp, Mus musculus
aagccagtgtccgatttcttctgcc

SEQ ID NO: 506696 - DNA, 25 bp, Mus musculus
aagccagttacaagcagccagtctg

SEQ ID NO: 506697 - DNA, 25 bp, Mus musculus
aagccagttacatgcagccagtctg

SEQ ID NO: 506698 - DNA, 25 bp, Mus musculus
aagccagtttctatgcttggcagca

SEQ ID NO: 506699 - DNA, 25 bp, Mus musculus
aagccagtttctttgcttggcagca

SEQ ID NO: 506700 - DNA, 25 bp, Mus musculus
aagccagttttcatgatcagtccca

SEQ ID NO: 506701 - DNA, 25 bp, Mus musculus
aagccagttttcttgatcagtccca

SEQ ID NO: 506702 - DNA, 25 bp, Mus musculus
aagccatagaacaacctgggcagcg

SEQ ID NO: 506703 - DNA, 25 bp, Mus musculus
aagccatagaactacctgggcagcg

SEQ ID NO: 506704 - DNA, 25 bp, Mus musculus
aagccatagaggaattgctaaagga

SEQ ID NO: 506705 - DNA, 25 bp, Mus musculus
aagccatagaggtattgctaaagga

SEQ ID NO: 506706 - DNA, 25 bp, Mus musculus
aagccatagctgacatggccgccta

SEQ ID NO: 506707 - DNA, 25 bp, Mus musculus
aagccatagctgtcatggccgccta

SEQ ID NO: 506708 - DNA, 25 bp, Mus musculus
aagccataggctatgtccctgtagc

SEQ ID NO: 506709 - DNA, 25 bp, Mus musculus
aagccataggctttgtccctgtagc

SEQ ID NO: 506710 - DNA, 25 bp, Mus musculus
aagccatatttcaacaacccagagg

SEQ ID NO: 506711 - DNA, 25 bp, Mus musculus
aagccatatttctacaacccagagg

SEQ ID NO: 506712 - DNA, 25 bp, Mus musculus
aagccatcaatcaactaggctccag

SEQ ID NO: 506713 - DNA, 25 bp, Mus musculus
aagccatcaatctactaggctccag

SEQ ID NO: 506714 - DNA, 25 bp, Mus musculus
aagccatcagggagcatcagatggc

SEQ ID NO: 506715 - DNA, 25 bp, Mus musculus
aagccatcagggtgcatcagatggc

SEQ ID NO: 506716 - DNA, 25 bp, Mus musculus
aagccatcaggtacgagccacctct

SEQ ID NO: 506717 - DNA, 25 bp, Mus musculus
aagccatcaggttcgagccacctct

SEQ ID NO: 506718 - DNA, 25 bp, Mus musculus
aagccatcatcacccactttaatgg

SEQ ID NO: 506719 - DNA, 25 bp, Mus musculus
aagccatcatcagccactttaatgg

SEQ ID NO: 506720 - DNA, 25 bp, Mus musculus
aagccatccgtcactccagttctat

SEQ ID NO: 506721 - DNA, 25 bp, Mus musculus
aagccatccgtctctccagttctat

SEQ ID NO: 506722 - DNA, 25 bp, Mus musculus
aagccatcctagctgcccgttctag

SEQ ID NO: 506723 - DNA, 25 bp, Mus musculus
aagccatcctaggtgcccgttctag

SEQ ID NO: 506724 - DNA, 25 bp, Mus musculus
aagccatgcgcaacggcgctgaggt

SEQ ID NO: 506725 - DNA, 25 bp, Mus musculus
aagccatgcgcatcggcgctgaggt

SEQ ID NO: 506726 - DNA, 25 bp, Mus musculus
aagccatgctggatgctcttgtcct

SEQ ID NO: 506727 - DNA, 25 bp, Mus musculus
aagccatgctggttgctcttgtcct

SEQ ID NO: 506728 - DNA, 25 bp, Mus musculus
aagccatggatgagaccacaacctc

SEQ ID NO: 506729 - DNA, 25 bp, Mus musculus
aagccatggatgtgaccacaacctc

SEQ ID NO: 506730 - DNA, 25 bp, Mus musculus
aagccatgggatacactggaccttt

SEQ ID NO: 506731 - DNA, 25 bp, Mus musculus
aagccatgggattcactggaccttt

SEQ ID NO: 506732 - DNA, 25 bp, Mus musculus
aagccatgggccacccacgcgtagg

SEQ ID NO: 506733 - DNA, 25 bp, Mus musculus
aagccatgggcctcccacgcgtagg

SEQ ID NO: 506734 - DNA, 25 bp, Mus musculus
aagccattatctacacagcccaggg

SEQ ID NO: 506735 - DNA, 25 bp, Mus musculus
aagccattatcttcacagcccaggg

SEQ ID NO: 506736 - DNA, 25 bp, Mus musculus
aagccattctgtctcatcttgccgg

SEQ ID NO: 506737 - DNA, 25 bp, Mus musculus
aagccattctgtgtcatcttgccgg

SEQ ID NO: 506738 - DNA, 25 bp, Mus musculus
aagccattgacgaacaacttctctg

SEQ ID NO: 506739 - DNA, 25 bp, Mus musculus
aagccattgacgtacaacttctctg

SEQ ID NO: 506740 - DNA, 25 bp, Mus musculus
aagccattgctaatgaatgccaggc

SEQ ID NO: 506741 - DNA, 25 bp, Mus musculus
aagccattgctattgaatgccaggc

SEQ ID NO: 506742 - DNA, 25 bp, Mus musculus
aagccattgtacactggacagagct

SEQ ID NO: 506743 - DNA, 25 bp, Mus musculus
aagccattgtactctggacagagct

SEQ ID NO: 506744 - DNA, 25 bp, Mus musculus
aagccattgtctagcctatgaacca

SEQ ID NO: 506745 - DNA, 25 bp, Mus musculus
aagccattgtcttgcctatgaacca

SEQ ID NO: 506746 - DNA, 25 bp, Mus musculus
aagccatttctcaaggtttccggct

SEQ ID NO: 506747 - DNA, 25 bp, Mus musculus
aagccatttctcacagcactggccg

SEQ ID NO: 506748 - DNA, 25 bp, Mus musculus
aagccatttctctaggtttccggct

SEQ ID NO: 506749 - DNA, 25 bp, Mus musculus
aagccatttctctcagcactggccg

SEQ ID NO: 506750 - DNA, 25 bp, Mus musculus
aagccattttgcctgtggcacgcca

SEQ ID NO: 506751 - DNA, 25 bp, Mus musculus
aagccattttgcgtgtggcacgcca

SEQ ID NO: 506752 - DNA, 25 bp, Mus musculus
aagcccaaaaagctcaaggtggaag

SEQ ID NO: 506753 - DNA, 25 bp, Mus musculus
aagcccaaaaaggtcaaggtggaag

SEQ ID NO: 506754 - DNA, 25 bp, Mus musculus
aagcccaactcgatgaaacatccag

SEQ ID NO: 506755 - DNA, 25 bp, Mus musculus
aagcccaactcgttgaaacatccag

SEQ ID NO: 506756 - DNA, 25 bp, Mus musculus
aagcccaagagaccttgaaaaatgc

SEQ ID NO: 506757 - DNA, 25 bp, Mus musculus
aagcccaagagagcttgaaaaatgc

SEQ ID NO: 506758 - DNA, 25 bp, Mus musculus
aagcccaaggtacctgagctgccca

SEQ ID NO: 506759 - DNA, 25 bp, Mus musculus
aagcccaaggtagctgagctgccca

SEQ ID NO: 506760 - DNA, 25 bp, Mus musculus
aagcccaaggtgatcattattcagg

SEQ ID NO: 506761 - DNA, 25 bp, Mus musculus
aagcccaaggtgttcattattcagg

SEQ ID NO: 506762 - DNA, 25 bp, Mus musculus
aagcccaatgctcatccccagccct

SEQ ID NO: 506763 - DNA, 25 bp, Mus musculus
aagcccaatgctgatccccagccct

SEQ ID NO: 506764 - DNA, 25 bp, Mus musculus
aagcccacaagcctatctgctagag

SEQ ID NO: 506765 - DNA, 25 bp, Mus musculus
aagcccacaagcgtatctgctagag

SEQ ID NO: 506766 - DNA, 25 bp, Mus musculus
aagcccacagacattgaggagctgg

SEQ ID NO: 506767 - DNA, 25 bp, Mus musculus
aagcccacagactttgaggagctgg

SEQ ID NO: 506768 - DNA, 25 bp, Mus musculus
aagcccacatccatttttacagcgg

SEQ ID NO: 506769 - DNA, 25 bp, Mus musculus
aagcccacatccttttttacagcgg

SEQ ID NO: 506770 - DNA, 25 bp, Mus musculus
aagcccacggtgatgctgaagaagc

SEQ ID NO: 506771 - DNA, 25 bp, Mus musculus
aagcccacggtgttgctgaagaagc

SEQ ID NO: 506772 - DNA, 25 bp, Mus musculus
aagcccagcaacctagctgtgaacg

SEQ ID NO: 506773 - DNA, 25 bp, Mus musculus
aagcccagcaacgtagctgtgaacg

SEQ ID NO: 506774 - DNA, 25 bp, Mus musculus
aagcccagcccaccttagcatgtat

SEQ ID NO: 506775 - DNA, 25 bp, Mus musculus
aagcccagcccagcttagcatgtat

SEQ ID NO: 506776 - DNA, 25 bp, Mus musculus
aagcccagcctgaagaaggtgagaa

SEQ ID NO: 506777 - DNA, 25 bp, Mus musculus
aagcccagcctgtagaaggtgagaa

SEQ ID NO: 506778 - DNA, 25 bp, Mus musculus
aagcccaggctgataataaatgtga

SEQ ID NO: 506779 - DNA, 25 bp, Mus musculus
aagcccaggctgttaataaatgtga

SEQ ID NO: 506780 - DNA, 25 bp, Mus musculus
aagcccaggtgcagcgttatgtggc

SEQ ID NO: 506781 - DNA, 25 bp, Mus musculus
aagcccaggtgctgcgttatgtggc

SEQ ID NO: 506782 - DNA, 25 bp, Mus musculus
aagcccagtgacagcggccgaagaa

SEQ ID NO: 506783 - DNA, 25 bp, Mus musculus
aagcccagtgactgcggccgaagaa

SEQ ID NO: 506784 - DNA, 25 bp, Mus musculus
aagcccatgattctgaggagggcct

SEQ ID NO: 506785 - DNA, 25 bp, Mus musculus
aagcccatgattgtgaggagggcct

SEQ ID NO: 506786 - DNA, 25 bp, Mus musculus
aagcccatggcacacgaatctgacg

SEQ ID NO: 506787 - DNA, 25 bp, Mus musculus
aagcccatggcagacgaatctgacg

SEQ ID NO: 506788 - DNA, 25 bp, Mus musculus
aagcccattggaatattaagcccgg

SEQ ID NO: 506789 - DNA, 25 bp, Mus musculus
aagcccattggattattaagcccgg

SEQ ID NO: 506790 - DNA, 25 bp, Mus musculus
aagccccacaacaatcacaatacgt

SEQ ID NO: 506791 - DNA, 25 bp, Mus musculus
aagccccacaactatcacaatacgt

SEQ ID NO: 506792 - DNA, 25 bp, Mus musculus
aagccccagaggaaccaactattca

SEQ ID NO: 506793 - DNA, 25 bp, Mus musculus
aagccccagaggtaccaactattca

SEQ ID NO: 506794 - DNA, 25 bp, Mus musculus
aagccccaggatcgtgcccgatgct

SEQ ID NO: 506795 - DNA, 25 bp, Mus musculus
aagccccaggatggtgcccgatgct

SEQ ID NO: 506796 - DNA, 25 bp, Mus musculus
aagcccccagttcaatgcattctgc

SEQ ID NO: 506797 - DNA, 25 bp, Mus musculus
aagcccccagttgaatgcattctgc

SEQ ID NO: 506798 - DNA, 25 bp, Mus musculus
aagccccggaaacaagctctcagct

SEQ ID NO: 506799 - DNA, 25 bp, Mus musculus
aagccccggaaagaagctctcagct

SEQ ID NO: 506800 - DNA, 25 bp, Mus musculus
aagccccggcctacagctgatctaa

SEQ ID NO: 506801 - DNA, 25 bp, Mus musculus
aagccccggccttcagctgatctaa

SEQ ID NO: 506802 - DNA, 25 bp, Mus musculus
aagccccgtcggagctattctgttg

SEQ ID NO: 506803 - DNA, 25 bp, Mus musculus
aagccccgtcggtgctattctgttg

SEQ ID NO: 506804 - DNA, 25 bp, Mus musculus
aagcccctcgagagcggtctgatct

SEQ ID NO: 506805 - DNA, 25 bp, Mus musculus
aagcccctcgagtgcggtctgatct

SEQ ID NO: 506806 - DNA, 25 bp, Mus musculus
aagcccctctgtacgaactccgtgg

SEQ ID NO: 506807 - DNA, 25 bp, Mus musculus
aagcccctctgttcgaactccgtgg

SEQ ID NO: 506808 - DNA, 25 bp, Mus musculus
aagcccctgaagaaccgtgatgtca

SEQ ID NO: 506809 - DNA, 25 bp, Mus musculus
aagcccctgaagtaccgtgatgtca

SEQ ID NO: 506810 - DNA, 25 bp, Mus musculus
aagcccctgcggagcatcaagcgca

SEQ ID NO: 506811 - DNA, 25 bp, Mus musculus
aagcccctgcggtgcatcaagcgca

SEQ ID NO: 506812 - DNA, 25 bp, Mus musculus
aagcccgaaaagatgctgaagaagg

SEQ ID NO: 506813 - DNA, 25 bp, Mus musculus
aagcccgaaaagttgctgaagaagg

SEQ ID NO: 506814 - DNA, 25 bp, Mus musculus
aagcccgacggcagtgccatctgct

SEQ ID NO: 506815 - DNA, 25 bp, Mus musculus
aagcccgacggctgtgccatctgct

SEQ ID NO: 506816 - DNA, 25 bp, Mus musculus
aagcccgacttgctcctgctgctga

SEQ ID NO: 506817 - DNA, 25 bp, Mus musculus
aagcccgacttggtcctgctgctga

SEQ ID NO: 506818 - DNA, 25 bp, Mus musculus
aagcccgaggcactctgagagctgc

SEQ ID NO: 506819 - DNA, 25 bp, Mus musculus
aagcccgaggcagtctgagagctgc

SEQ ID NO: 506820 - DNA, 25 bp, Mus musculus
aagcccggagccaaacgctagatcg

SEQ ID NO: 506821 - DNA, 25 bp, Mus musculus
aagcccggagcctaacgctagatcg

SEQ ID NO: 506822 - DNA, 25 bp, Mus musculus
aagcccggaggcaacagcgtatccg

SEQ ID NO: 506823 - DNA, 25 bp, Mus musculus
aagcccggaggcagctgtatgccgc

SEQ ID NO: 506824 - DNA, 25 bp, Mus musculus
aagcccggaggctacagcgtatccg

SEQ ID NO: 506825 - DNA, 25 bp, Mus musculus
aagcccggaggctgctgtatgccgc

SEQ ID NO: 506826 - DNA, 25 bp, Mus musculus
aagcccggattcaggatccccaaga

SEQ ID NO: 506827 - DNA, 25 bp, Mus musculus
aagcccggattctggatccccaaga

SEQ ID NO: 506828 - DNA, 25 bp, Mus musculus
aagcccggcttcagctcggagaagg

SEQ ID NO: 506829 - DNA, 25 bp, Mus musculus
aagcccggcttctgctcggagaagg

SEQ ID NO: 506830 - DNA, 25 bp, Mus musculus
aagcccgggagcaggaatccctcca

SEQ ID NO: 506831 - DNA, 25 bp, Mus musculus
aagcccgggagctggaatccctcca

SEQ ID NO: 506832 - DNA, 25 bp, Mus musculus
aagcccggtcagatgggaagttcag

SEQ ID NO: 506833 - DNA, 25 bp, Mus musculus
aagcccggtcagttgggaagttcag

SEQ ID NO: 506834 - DNA, 25 bp, Mus musculus
aagcccgtattcaccgagagaggaa

SEQ ID NO: 506835 - DNA, 25 bp, Mus musculus
aagcccgtattctccgagagaggaa

SEQ ID NO: 506836 - DNA, 25 bp, Mus musculus
aagcccgtgagtctcaaggtgtatg

SEQ ID NO: 506837 - DNA, 25 bp, Mus musculus
aagcccgtgagtgtcaaggtgtatg

SEQ ID NO: 506838 - DNA, 25 bp, Mus musculus
aagccctatgtcagggtgactatgg

SEQ ID NO: 506839 - DNA, 25 bp, Mus musculus
aagccctatgtctgggtgactatgg

SEQ ID NO: 506840 - DNA, 25 bp, Mus musculus
aagccctcggagctggtgggtggga

SEQ ID NO: 506841 - DNA, 25 bp, Mus musculus
aagccctcggaggtggtgggtggga

SEQ ID NO: 506842 - DNA, 25 bp, Mus musculus
aagccctgaaccagatccgggctgc

SEQ ID NO: 506843 - DNA, 25 bp, Mus musculus
aagccctgaacctgatccgggctgc

SEQ ID NO: 506844 - DNA, 25 bp, Mus musculus
aagccctgaagacgtaccggtcagg

SEQ ID NO: 506845 - DNA, 25 bp, Mus musculus
aagccctgaagaggtaccggtcagg

SEQ ID NO: 506846 - DNA, 25 bp, Mus musculus
aagccctgagccagaacatggttct

SEQ ID NO: 506847 - DNA, 25 bp, Mus musculus
aagccctgagcctgaacatggttct

SEQ ID NO: 506848 - DNA, 25 bp, Mus musculus
aagccctgaggtcccgtgtcatcaa

SEQ ID NO: 506849 - DNA, 25 bp, Mus musculus
aagccctgaggtgccgtgtcatcaa

SEQ ID NO: 506850 - DNA, 25 bp, Mus musculus
aagccctgcgatcccaaggtggaca

SEQ ID NO: 506851 - DNA, 25 bp, Mus musculus
aagccctgcgatgccaaggtggaca

SEQ ID NO: 506852 - DNA, 25 bp, Mus musculus
aagccctgctccacaagggaggtgt

SEQ ID NO: 506853 - DNA, 25 bp, Mus musculus
aagccctgctcctcaagggaggtgt

SEQ ID NO: 506854 - DNA, 25 bp, Mus musculus
aagccctggcatagcggcgagccag

SEQ ID NO: 506855 - DNA, 25 bp, Mus musculus
aagccctggcattgcggcgagccag

SEQ ID NO: 506856 - DNA, 25 bp, Mus musculus
aagccctgggtcaggttctaggcat

SEQ ID NO: 506857 - DNA, 25 bp, Mus musculus
aagccctgggtctggttctaggcat

SEQ ID NO: 506858 - DNA, 25 bp, Mus musculus
aagcccttctggaagcaggccaggc

SEQ ID NO: 506859 - DNA, 25 bp, Mus musculus
aagcccttctggtagcaggccaggc

SEQ ID NO: 506860 - DNA, 25 bp, Mus musculus
aagcccttgttacattgacagagac

SEQ ID NO: 506861 - DNA, 25 bp, Mus musculus
aagcccttgttagattgacagagac

SEQ ID NO: 506862 - DNA, 25 bp, Mus musculus
aagccgaaagagataccagcctggc

SEQ ID NO: 506863 - DNA, 25 bp, Mus musculus
aagccgaaagagttaccagcctggc

SEQ ID NO: 506864 - DNA, 25 bp, Mus musculus
aagccgactgcgaggaggacagcat

SEQ ID NO: 506865 - DNA, 25 bp, Mus musculus
aagccgactgcgtggaggacagcat

SEQ ID NO: 506866 - DNA, 25 bp, Mus musculus
aagccgagacctcctttcgcaggtg

SEQ ID NO: 506867 - DNA, 25 bp, Mus musculus
aagccgagacctgctttcgcaggtg

SEQ ID NO: 506868 - DNA, 25 bp, Mus musculus
aagccgagattaagggctgggacca

SEQ ID NO: 506869 - DNA, 25 bp, Mus musculus
aagccgagattatgggctgggacca

SEQ ID NO: 506870 - DNA, 25 bp, Mus musculus
aagccgagcaggagtcccaactccg

SEQ ID NO: 506871 - DNA, 25 bp, Mus musculus
aagccgagcaggtgtcccaactccg

SEQ ID NO: 506872 - DNA, 25 bp, Mus musculus
aagccgaggctgatgtgttgacgct

SEQ ID NO: 506873 - DNA, 25 bp, Mus musculus
aagccgaggctgttgtgttgacgct

SEQ ID NO: 506874 - DNA, 25 bp, Mus musculus
aagccgatctggatgcatgctgagg

SEQ ID NO: 506875 - DNA, 25 bp, Mus musculus
aagccgatctggttgcatgctgagg

SEQ ID NO: 506876 - DNA, 25 bp, Mus musculus
aagccgcacttacctagcggcgaca

SEQ ID NO: 506877 - DNA, 25 bp, Mus musculus
aagccgcacttagctagcggcgaca

SEQ ID NO: 506878 - DNA, 25 bp, Mus musculus
aagccgcagttaatgaacttcccac

SEQ ID NO: 506879 - DNA, 25 bp, Mus musculus
aagccgcagttattgaacttcccac

SEQ ID NO: 506880 - DNA, 25 bp, Mus musculus
aagccgccctttccagcagatgtgg

SEQ ID NO: 506881 - DNA, 25 bp, Mus musculus
aagccgccctttgcagcagatgtgg

SEQ ID NO: 506882 - DNA, 25 bp, Mus musculus
aagccgcgcggacagtcctcggtgg

SEQ ID NO: 506883 - DNA, 25 bp, Mus musculus
aagccgcgcggagagtcctcggtgg

SEQ ID NO: 506884 - DNA, 25 bp, Mus musculus
aagccgctcatcacgaggaccatga

SEQ ID NO: 506885 - DNA, 25 bp, Mus musculus
aagccgctcatctcgaggaccatga

SEQ ID NO: 506886 - DNA, 25 bp, Mus musculus
aagccgctggagctcaggacatgaa

SEQ ID NO: 506887 - DNA, 25 bp, Mus musculus
aagccgctggaggtcaggacatgaa

SEQ ID NO: 506888 - DNA, 25 bp, Mus musculus
aagccgctgggtagatccagcccct

SEQ ID NO: 506889 - DNA, 25 bp, Mus musculus
aagccgctgggttgatccagcccct

SEQ ID NO: 506890 - DNA, 25 bp, Mus musculus
aagccgcttgcaatatctccgtggg

SEQ ID NO: 506891 - DNA, 25 bp, Mus musculus
aagccgcttgcattatctccgtggg

SEQ ID NO: 506892 - DNA, 25 bp, Mus musculus
aagccggaacctcttagtggactga

SEQ ID NO: 506893 - DNA, 25 bp, Mus musculus
aagccggaacctgttagtggactga

SEQ ID NO: 506894 - DNA, 25 bp, Mus musculus
aagccggacaagagggccagcctca

SEQ ID NO: 506895 - DNA, 25 bp, Mus musculus
aagccggacaagtgggccagcctca

SEQ ID NO: 506896 - DNA, 25 bp, Mus musculus
aagccggacagtcgcagtgaaacag

SEQ ID NO: 506897 - DNA, 25 bp, Mus musculus
aagccggacagtggcagtgaaacag

SEQ ID NO: 506898 - DNA, 25 bp, Mus musculus
aagccggagtggaagcagtaaaagc

SEQ ID NO: 506899 - DNA, 25 bp, Mus musculus
aagccggagtggtagcagtaaaagc

SEQ ID NO: 506900 - DNA, 25 bp, Mus musculus
aagccggatgtacggataaagactc

SEQ ID NO: 506901 - DNA, 25 bp, Mus musculus
aagccggatgtagggataaagactc

SEQ ID NO: 506902 - DNA, 25 bp, Mus musculus
aagccggattctccaagacttcaag

SEQ ID NO: 506903 - DNA, 25 bp, Mus musculus
aagccggattctgcaagacttcaag

SEQ ID NO: 506904 - DNA, 25 bp, Mus musculus
aagccggccagcaagcggcccatgt

SEQ ID NO: 506905 - DNA, 25 bp, Mus musculus
aagccggccagctagcggcccatgt

SEQ ID NO: 506906 - DNA, 25 bp, Mus musculus
aagccggcggccagatttaccagtg

SEQ ID NO: 506907 - DNA, 25 bp, Mus musculus
aagccggcggcctgatttaccagtg

SEQ ID NO: 506908 - DNA, 25 bp, Mus musculus
aagccggctggacctgatagcccag

SEQ ID NO: 506909 - DNA, 25 bp, Mus musculus
aagccggctggagctgatagcccag

SEQ ID NO: 506910 - DNA, 25 bp, Mus musculus
aagccgggaagcctaagtttggcat

SEQ ID NO: 506911 - DNA, 25 bp, Mus musculus
aagccgggaagcgtaagtttggcat

SEQ ID NO: 506912 - DNA, 25 bp, Mus musculus
aagccgggaccaagagcccagcggt

SEQ ID NO: 506913 - DNA, 25 bp, Mus musculus
aagccgggaccatgagcccagcggt

SEQ ID NO: 506914 - DNA, 25 bp, Mus musculus
aagccgggttctaactgctcccctg

SEQ ID NO: 506915 - DNA, 25 bp, Mus musculus
aagccgggttcttactgctcccctg

SEQ ID NO: 506916 - DNA, 25 bp, Mus musculus
aagccggtctgaagccatttgaaca

SEQ ID NO: 506917 - DNA, 25 bp, Mus musculus
aagccggtctgatgccatttgaaca

SEQ ID NO: 506918 - DNA, 25 bp, Mus musculus
aagccgtctcagagcgctggagacc

SEQ ID NO: 506919 - DNA, 25 bp, Mus musculus
aagccgtctcagtgcgctggagacc

SEQ ID NO: 506920 - DNA, 25 bp, Mus musculus
aagccgtgctgacccgcctactggg

SEQ ID NO: 506921 - DNA, 25 bp, Mus musculus
aagccgtgctgagccgcctactggg

SEQ ID NO: 506922 - DNA, 25 bp, Mus musculus
aagccgtggcaccttccagaggaag

SEQ ID NO: 506923 - DNA, 25 bp, Mus musculus
aagccgtggcacgttccagaggaag

SEQ ID NO: 506924 - DNA, 25 bp, Mus musculus
aagccgtgtcatatcagcaatttgc

SEQ ID NO: 506925 - DNA, 25 bp, Mus musculus
aagccgtgtcatttcagcaatttgc

SEQ ID NO: 506926 - DNA, 25 bp, Mus musculus
aagccgttcgagagccccgctgcaa

SEQ ID NO: 506927 - DNA, 25 bp, Mus musculus
aagccgttcgagtgccccgctgcaa

SEQ ID NO: 506928 - DNA, 25 bp, Mus musculus
aagcctacccagaggacgttccctg

SEQ ID NO: 506929 - DNA, 25 bp, Mus musculus
aagcctacccagtggacgttccctg

SEQ ID NO: 506930 - DNA, 25 bp, Mus musculus
aagcctacgaggacgcagctgaaga

SEQ ID NO: 506931 - DNA, 25 bp, Mus musculus
aagcctacgaggtcgcagctgaaga

SEQ ID NO: 506932 - DNA, 25 bp, Mus musculus
aagcctagcgggagtcaccaagagt

SEQ ID NO: 506933 - DNA, 25 bp, Mus musculus
aagcctagcgggtgtcaccaagagt

SEQ ID NO: 506934 - DNA, 25 bp, Mus musculus
aagcctagtggtcaagcagaacctg

SEQ ID NO: 506935 - DNA, 25 bp, Mus musculus
aagcctagtggtgaagcagaacctg

SEQ ID NO: 506936 - DNA, 25 bp, Mus musculus
aagcctatctgcaagaggagacaga

SEQ ID NO: 506937 - DNA, 25 bp, Mus musculus
aagcctatctgctagaggagacaga

SEQ ID NO: 506938 - DNA, 25 bp, Mus musculus
aagcctccaaggatggtcagctcta

SEQ ID NO: 506939 - DNA, 25 bp, Mus musculus
aagcctccaaggttggtcagctcta

SEQ ID NO: 506940 - DNA, 25 bp, Mus musculus
aagcctccagctccgagggcagcat

SEQ ID NO: 506941 - DNA, 25 bp, Mus musculus
aagcctccagctgcgagggcagcat

SEQ ID NO: 506942 - DNA, 25 bp, Mus musculus
aagcctccgggcacagtttgaccac

SEQ ID NO: 506943 - DNA, 25 bp, Mus musculus
aagcctccgggctcagtttgaccac

SEQ ID NO: 506944 - DNA, 25 bp, Mus musculus
aagcctcggcccaacaaaatggcgt

SEQ ID NO: 506945 - DNA, 25 bp, Mus musculus
aagcctcggcccagtaagcacaggt

SEQ ID NO: 506946 - DNA, 25 bp, Mus musculus
aagcctcggccctacaaaatggcgt

SEQ ID NO: 506947 - DNA, 25 bp, Mus musculus
aagcctcggccctgtaagcacaggt

SEQ ID NO: 506948 - DNA, 25 bp, Mus musculus
aagcctcggcgcagtacgagcgcgc

SEQ ID NO: 506949 - DNA, 25 bp, Mus musculus
aagcctcggcgctgtacgagcgcgc

SEQ ID NO: 506950 - DNA, 25 bp, Mus musculus
aagcctcgggcacgtggaaatgacc

SEQ ID NO: 506951 - DNA, 25 bp, Mus musculus
aagcctcgggcaggtggaaatgacc

SEQ ID NO: 506952 - DNA, 25 bp, Mus musculus
aagcctctcttccatgccgtgatca

SEQ ID NO: 506953 - DNA, 25 bp, Mus musculus
aagcctctcttcgatgccgtgatca

SEQ ID NO: 506954 - DNA, 25 bp, Mus musculus
aagcctctgactcagtgcatccgcg

SEQ ID NO: 506955 - DNA, 25 bp, Mus musculus
aagcctctgactgagtgcatccgcg

SEQ ID NO: 506956 - DNA, 25 bp, Mus musculus
aagcctctggacagcatttggaaga

SEQ ID NO: 506957 - DNA, 25 bp, Mus musculus
aagcctctggactgcatttggaaga

SEQ ID NO: 506958 - DNA, 25 bp, Mus musculus
aagcctctgtggatatgcccacaag

SEQ ID NO: 506959 - DNA, 25 bp, Mus musculus
aagcctctgtggttatgcccacaag

SEQ ID NO: 506960 - DNA, 25 bp, Mus musculus
aagcctgaaaaacctcgcctcagag

SEQ ID NO: 506961 - DNA, 25 bp, Mus musculus
aagcctgaaaaagctcgcctcagag

SEQ ID NO: 506962 - DNA, 25 bp, Mus musculus
aagcctgcagaaaggacgagagaag

SEQ ID NO: 506963 - DNA, 25 bp, Mus musculus
aagcctgcagaatggacgagagaag

SEQ ID NO: 506964 - DNA, 25 bp, Mus musculus
aagcctgcccgactgtatgggacag

SEQ ID NO: 506965 - DNA, 25 bp, Mus musculus
aagcctgcccgagtgtatgggacag

SEQ ID NO: 506966 - DNA, 25 bp, Mus musculus
aagcctgccgttaaaaagagcctgg

SEQ ID NO: 506967 - DNA, 25 bp, Mus musculus
aagcctgccgtttaaaagagcctgg

SEQ ID NO: 506968 - DNA, 25 bp, Mus musculus
aagcctgcgcaaataaaaggagcac

SEQ ID NO: 506969 - DNA, 25 bp, Mus musculus
aagcctgcgcaattaaaaggagcac

SEQ ID NO: 506970 - DNA, 25 bp, Mus musculus
aagcctgcggcaatgggaattccag

SEQ ID NO: 506971 - DNA, 25 bp, Mus musculus
aagcctgcggcattgggaattccag

SEQ ID NO: 506972 - DNA, 25 bp, Mus musculus
aagcctgcgggacaaccgtgaatgt

SEQ ID NO: 506973 - DNA, 25 bp, Mus musculus
aagcctgcgggagaaccgtgaatgt

SEQ ID NO: 506974 - DNA, 25 bp, Mus musculus
aagcctgcgttcacccctgttggat

SEQ ID NO: 506975 - DNA, 25 bp, Mus musculus
aagcctgcgttctcccctgttggat

SEQ ID NO: 506976 - DNA, 25 bp, Mus musculus
aagcctgctagaccggtggactcgc

SEQ ID NO: 506977 - DNA, 25 bp, Mus musculus
aagcctgctagagcggtggactcgc

SEQ ID NO: 506978 - DNA, 25 bp, Mus musculus
aagcctggaggaagctgttaccttc

SEQ ID NO: 506979 - DNA, 25 bp, Mus musculus
aagcctggaggatgctgttaccttc

SEQ ID NO: 506980 - DNA, 25 bp, Mus musculus
aagcctggagtcagagcagacgcca

SEQ ID NO: 506981 - DNA, 25 bp, Mus musculus
aagcctggagtctgagcagacgcca

SEQ ID NO: 506982 - DNA, 25 bp, Mus musculus
aagcctggcattcctggactcccag

SEQ ID NO: 506983 - DNA, 25 bp, Mus musculus
aagcctggcattgctggactcccag

SEQ ID NO: 506984 - DNA, 25 bp, Mus musculus
aagcctggccctcatccctattgga

SEQ ID NO: 506985 - DNA, 25 bp, Mus musculus
aagcctggccctgatccctattgga

SEQ ID NO: 506986 - DNA, 25 bp, Mus musculus
aagcctggcgctactagaggagcag

SEQ ID NO: 506987 - DNA, 25 bp, Mus musculus
aagcctggcgcttctagaggagcag

SEQ ID NO: 506988 - DNA, 25 bp, Mus musculus
aagcctggctacaccgggaatggaa

SEQ ID NO: 506989 - DNA, 25 bp, Mus musculus
aagcctggctactccgggaatggaa

SEQ ID NO: 506990 - DNA, 25 bp, Mus musculus
aagcctgggcgtcaccgcttggatc

SEQ ID NO: 506991 - DNA, 25 bp, Mus musculus
aagcctgggcgtgaccgcttggatc

SEQ ID NO: 506992 - DNA, 25 bp, Mus musculus
aagcctgtctacatgctcctggagc

SEQ ID NO: 506993 - DNA, 25 bp, Mus musculus
aagcctgtctacttgctcctggagc

SEQ ID NO: 506994 - DNA, 25 bp, Mus musculus
aagcctgtggtgaggttctggatcc

SEQ ID NO: 506995 - DNA, 25 bp, Mus musculus
aagcctgtggtgtggttctggatcc

SEQ ID NO: 506996 - DNA, 25 bp, Mus musculus
aagcctgtgttgatgcctctgactg

SEQ ID NO: 506997 - DNA, 25 bp, Mus musculus
aagcctgtgttgttgcctctgactg

SEQ ID NO: 506998 - DNA, 25 bp, Mus musculus
aagccttatctaaatcagtgcctgc

SEQ ID NO: 506999 - DNA, 25 bp, Mus musculus
aagccttatctatatcagtgcctgc

SEQ ID NO: 507000 - DNA, 25 bp, Mus musculus
aagccttatgtcatctcgtacctgg

SEQ ID NO: 507001 - DNA, 25 bp, Mus musculus
aagccttatgtcttctcgtacctgg

SEQ ID NO: 507002 - DNA, 25 bp, Mus musculus
aagccttattgcagcctatccctga

SEQ ID NO: 507003 - DNA, 25 bp, Mus musculus
aagccttattgctgcctatccctga

SEQ ID NO: 507004 - DNA, 25 bp, Mus musculus
aagccttcaccgatgtggccactgg

SEQ ID NO: 507005 - DNA, 25 bp, Mus musculus
aagccttcaccgttgtggccactgg

SEQ ID NO: 507006 - DNA, 25 bp, Mus musculus
aagccttcagggagatctgccctgc

SEQ ID NO: 507007 - DNA, 25 bp, Mus musculus
aagccttcagggtgatctgccctgc

SEQ ID NO: 507008 - DNA, 25 bp, Mus musculus
aagccttcctcaaccgcttcagaga

SEQ ID NO: 507009 - DNA, 25 bp, Mus musculus
aagccttcctcatccgcttcagaga

SEQ ID NO: 507010 - DNA, 25 bp, Mus musculus
aagccttcgccaactgcttatccag

SEQ ID NO: 507011 - DNA, 25 bp, Mus musculus
aagccttcgccatctgcttatccag

SEQ ID NO: 507012 - DNA, 25 bp, Mus musculus
aagccttctaccacactgaccgggt

SEQ ID NO: 507013 - DNA, 25 bp, Mus musculus
aagccttctacctcactgaccgggt

SEQ ID NO: 507014 - DNA, 25 bp, Mus musculus
aagccttgctcccagcagttcatcg

SEQ ID NO: 507015 - DNA, 25 bp, Mus musculus
aagccttgctccgagcagttcatcg

SEQ ID NO: 507016 - DNA, 25 bp, Mus musculus
aagcctttaaggacagcgtgagccc

SEQ ID NO: 507017 - DNA, 25 bp, Mus musculus
aagcctttaaggtcagcgtgagccc

SEQ ID NO: 507018 - DNA, 25 bp, Mus musculus
aagcctttcgcacagggaccactgg

SEQ ID NO: 507019 - DNA, 25 bp, Mus musculus
aagcctttcgcagagggaccactgg

SEQ ID NO: 507020 - DNA, 25 bp, Mus musculus
aagcctttgacaccttgcagccatc

SEQ ID NO: 507021 - DNA, 25 bp, Mus musculus
aagcctttgacagcttgcagccatc

SEQ ID NO: 507022 - DNA, 25 bp, Mus musculus
aagcctttgcgtctccatactgttg

SEQ ID NO: 507023 - DNA, 25 bp, Mus musculus
aagcctttgcgtgtccatactgttg

SEQ ID NO: 507024 - DNA, 25 bp, Mus musculus
aagcctttggcaagatcaagtcttg

SEQ ID NO: 507025 - DNA, 25 bp, Mus musculus
aagcctttggcatgatcaagtcttg

SEQ ID NO: 507026 - DNA, 25 bp, Mus musculus
aagcctttgtctcagtctgggtcca

SEQ ID NO: 507027 - DNA, 25 bp, Mus musculus
aagcctttgtctgagtctgggtcca

SEQ ID NO: 507028 - DNA, 25 bp, Mus musculus
aagcgaagggcaacaccatctccac

SEQ ID NO: 507029 - DNA, 25 bp, Mus musculus
aagcgaagggcatcaccatctccac

SEQ ID NO: 507030 - DNA, 25 bp, Mus musculus
aagcgaatttatatcccattgccag

SEQ ID NO: 507031 - DNA, 25 bp, Mus musculus
aagcgaatttatttcccattgccag

SEQ ID NO: 507032 - DNA, 25 bp, Mus musculus
aagcgacagagcacacagagggcgt

SEQ ID NO: 507033 - DNA, 25 bp, Mus musculus
aagcgacagagctcacagagggcgt

SEQ ID NO: 507034 - DNA, 25 bp, Mus musculus
aagcgagaagtgaaggttgcccagt

SEQ ID NO: 507035 - DNA, 25 bp, Mus musculus
aagcgagaagtgtaggttgcccagt

SEQ ID NO: 507036 - DNA, 25 bp, Mus musculus
aagcgagagctcaggtttccttcca

SEQ ID NO: 507037 - DNA, 25 bp, Mus musculus
aagcgagagctctggtttccttcca

SEQ ID NO: 507038 - DNA, 25 bp, Mus musculus
aagcgagcagttcgtctcggcgacc

SEQ ID NO: 507039 - DNA, 25 bp, Mus musculus
aagcgagcagttggtctcggcgacc

SEQ ID NO: 507040 - DNA, 25 bp, Mus musculus
aagcgagggcctctgctacagagac

SEQ ID NO: 507041 - DNA, 25 bp, Mus musculus
aagcgagggcctgtgctacagagac

SEQ ID NO: 507042 - DNA, 25 bp, Mus musculus
aagcgagtaccacctggtggtgaac

SEQ ID NO: 507043 - DNA, 25 bp, Mus musculus
aagcgagtaccagctggtggtgaac

SEQ ID NO: 507044 - DNA, 25 bp, Mus musculus
aagcgagtgcagcttgatgtcaaga

SEQ ID NO: 507045 - DNA, 25 bp, Mus musculus
aagcgagtgcaggttgatgtcaaga

SEQ ID NO: 507046 - DNA, 25 bp, Mus musculus
aagcgagtgtcaacctcagaaaact

SEQ ID NO: 507047 - DNA, 25 bp, Mus musculus
aagcgagtgtcatcctcagaaaact

SEQ ID NO: 507048 - DNA, 25 bp, Mus musculus
aagcgagttgtgacacctaaagagc

SEQ ID NO: 507049 - DNA, 25 bp, Mus musculus
aagcgagttgtgtcacctaaagagc

SEQ ID NO: 507050 - DNA, 25 bp, Mus musculus
aagcgatggcagacaccagtgacta

SEQ ID NO: 507051 - DNA, 25 bp, Mus musculus
aagcgatggcagtcaccagtgacta

SEQ ID NO: 507052 - DNA, 25 bp, Mus musculus
aagcgcaaactcagtgcctagcggg

SEQ ID NO: 507053 - DNA, 25 bp, Mus musculus
aagcgcaaactctgtgcctagcggg

SEQ ID NO: 507054 - DNA, 25 bp, Mus musculus
aagcgcacattgcagggcgagctcc

SEQ ID NO: 507055 - DNA, 25 bp, Mus musculus
aagcgcacattggagggcgagctcc

SEQ ID NO: 507056 - DNA, 25 bp, Mus musculus
aagcgcactgccacgactcagtgcg

SEQ ID NO: 507057 - DNA, 25 bp, Mus musculus
aagcgcactgcctcgactcagtgcg

SEQ ID NO: 507058 - DNA, 25 bp, Mus musculus
aagcgcagaccaagccatagtgagc

SEQ ID NO: 507059 - DNA, 25 bp, Mus musculus
aagcgcagaccatgccatagtgagc

SEQ ID NO: 507060 - DNA, 25 bp, Mus musculus
aagcgcagcctgaccatgtggcacg

SEQ ID NO: 507061 - DNA, 25 bp, Mus musculus
aagcgcagcctgtccatgtggcacg

SEQ ID NO: 507062 - DNA, 25 bp, Mus musculus
aagcgcatctggcttaaggcaggcc

SEQ ID NO: 507063 - DNA, 25 bp, Mus musculus
aagcgcatctgggttaaggcaggcc

SEQ ID NO: 507064 - DNA, 25 bp, Mus musculus
aagcgccacaagcaagaacctggcc

SEQ ID NO: 507065 - DNA, 25 bp, Mus musculus
aagcgccacaaggaagaacctggcc

SEQ ID NO: 507066 - DNA, 25 bp, Mus musculus
aagcgccacgcaccggaagagctgt

SEQ ID NO: 507067 - DNA, 25 bp, Mus musculus
aagcgccacgcagcggaagagctgt

SEQ ID NO: 507068 - DNA, 25 bp, Mus musculus
aagcgccatcgcacacggtccaaag

SEQ ID NO: 507069 - DNA, 25 bp, Mus musculus
aagcgccatcgctcacggtccaaag

SEQ ID NO: 507070 - DNA, 25 bp, Mus musculus
aagcgcccagctatgcctgagatca

SEQ ID NO: 507071 - DNA, 25 bp, Mus musculus
aagcgcccagctttgcctgagatca

SEQ ID NO: 507072 - DNA, 25 bp, Mus musculus
aagcgccgcgtccatttctagcact

SEQ ID NO: 507073 - DNA, 25 bp, Mus musculus
aagcgccgcgtcgatttctagcact

SEQ ID NO: 507074 - DNA, 25 bp, Mus musculus
aagcgccgggtgatcatcattgaga

SEQ ID NO: 507075 - DNA, 25 bp, Mus musculus
aagcgccgggtgttcatcattgaga

SEQ ID NO: 507076 - DNA, 25 bp, Mus musculus
aagcgcctactactagtcggtgggc

SEQ ID NO: 507077 - DNA, 25 bp, Mus musculus
aagcgcctactagtagtcggtgggc

SEQ ID NO: 507078 - DNA, 25 bp, Mus musculus
aagcgcctcgaacggagtctgcgac

SEQ ID NO: 507079 - DNA, 25 bp, Mus musculus
aagcgcctcgaagggagtctgcgac

SEQ ID NO: 507080 - DNA, 25 bp, Mus musculus
aagcgcctgctgaaaggcctcttcc

SEQ ID NO: 507081 - DNA, 25 bp, Mus musculus
aagcgcctgctgtaaggcctcttcc

SEQ ID NO: 507082 - DNA, 25 bp, Mus musculus
aagcgcgagaaaagcgcctgtgtgc

SEQ ID NO: 507083 - DNA, 25 bp, Mus musculus
aagcgcgagaaatgcgcctgtgtgc

SEQ ID NO: 507084 - DNA, 25 bp, Mus musculus
aagcgcgcagatatcgtcgccggag

SEQ ID NO: 507085 - DNA, 25 bp, Mus musculus
aagcgcgcagatttcgtcgccggag

SEQ ID NO: 507086 - DNA, 25 bp, Mus musculus
aagcgcgcggcacctaaacgtcact

SEQ ID NO: 507087 - DNA, 25 bp, Mus musculus
aagcgcgcggcagctaaacgtcact

SEQ ID NO: 507088 - DNA, 25 bp, Mus musculus
aagcgcggctcaactaccatggccg

SEQ ID NO: 507089 - DNA, 25 bp, Mus musculus
aagcgcggctcatctaccatggccg

SEQ ID NO: 507090 - DNA, 25 bp, Mus musculus
aagcgcgtccagaccgcggaggaac

SEQ ID NO: 507091 - DNA, 25 bp, Mus musculus
aagcgcgtccagtccgcggaggaac

SEQ ID NO: 507092 - DNA, 25 bp, Mus musculus
aagcgctccaggctatctgccagtc

SEQ ID NO: 507093 - DNA, 25 bp, Mus musculus
aagcgctccagggtatctgccagtc

SEQ ID NO: 507094 - DNA, 25 bp, Mus musculus
aagcgctccccgaaaagttggctgg

SEQ ID NO: 507095 - DNA, 25 bp, Mus musculus
aagcgctccccgtaaagttggctgg

SEQ ID NO: 507096 - DNA, 25 bp, Mus musculus
aagcgctcgctaccgctggacctga

SEQ ID NO: 507097 - DNA, 25 bp, Mus musculus
aagcgctcgctagcgctggacctga

SEQ ID NO: 507098 - DNA, 25 bp, Mus musculus
aagcgctgatggacccgcagggaaa

SEQ ID NO: 507099 - DNA, 25 bp, Mus musculus
aagcgctgatggtcccgcagggaaa

SEQ ID NO: 507100 - DNA, 25 bp, Mus musculus
aagcgcttcagcatgagcttcaacc

SEQ ID NO: 507101 - DNA, 25 bp, Mus musculus
aagcgcttcagcttgagcttcaacc

SEQ ID NO: 507102 - DNA, 25 bp, Mus musculus
aagcgcttcctgctgctgaacccag

SEQ ID NO: 507103 - DNA, 25 bp, Mus musculus
aagcgcttcctggtgctgaacccag

SEQ ID NO: 507104 - DNA, 25 bp, Mus musculus
aagcgcttgagcagtcactgaagtg

SEQ ID NO: 507105 - DNA, 25 bp, Mus musculus
aagcgcttgagctgtcactgaagtg

SEQ ID NO: 507106 - DNA, 25 bp, Mus musculus
aagcgcttgaggctatcttcctgtg

SEQ ID NO: 507107 - DNA, 25 bp, Mus musculus
aagcgcttgagggtatcttcctgtg

SEQ ID NO: 507108 - DNA, 25 bp, Mus musculus
aagcgctttacgataacagcgctcg

SEQ ID NO: 507109 - DNA, 25 bp, Mus musculus
aagcgctttacgttaacagcgctcg

SEQ ID NO: 507110 - DNA, 25 bp, Mus musculus
aagcggaaccccactcagcgaattg

SEQ ID NO: 507111 - DNA, 25 bp, Mus musculus
aagcggaacccctctcagcgaattg

SEQ ID NO: 507112 - DNA, 25 bp, Mus musculus
aagcggaacccgatccttcgctaca

SEQ ID NO: 507113 - DNA, 25 bp, Mus musculus
aagcggaacccgttccttcgctaca

SEQ ID NO: 507114 - DNA, 25 bp, Mus musculus
aagcggaagcgcatggaccggatga

SEQ ID NO: 507115 - DNA, 25 bp, Mus musculus
aagcggaagcgcttggaccggatga

SEQ ID NO: 507116 - DNA, 25 bp, Mus musculus
aagcggaattttatctctctcagca

SEQ ID NO: 507117 - DNA, 25 bp, Mus musculus
aagcggaattttttctctctcagca

SEQ ID NO: 507118 - DNA, 25 bp, Mus musculus
aagcggagcgcaaggtgaagaactc

SEQ ID NO: 507119 - DNA, 25 bp, Mus musculus
aagcggagcgcatggtgaagaactc

SEQ ID NO: 507120 - DNA, 25 bp, Mus musculus
aagcggagtgagaccttcaaggctg

SEQ ID NO: 507121 - DNA, 25 bp, Mus musculus
aagcggagtgagtccttcaaggctg

SEQ ID NO: 507122 - DNA, 25 bp, Mus musculus
aagcggagtttcacccagagccatc

SEQ ID NO: 507123 - DNA, 25 bp, Mus musculus
aagcggagtttctcccagagccatc

SEQ ID NO: 507124 - DNA, 25 bp, Mus musculus
aagcggattctcacgggccacacgg

SEQ ID NO: 507125 - DNA, 25 bp, Mus musculus
aagcggattctctcgggccacacgg

SEQ ID NO: 507126 - DNA, 25 bp, Mus musculus
aagcggcaaggcaacatccatgaac

SEQ ID NO: 507127 - DNA, 25 bp, Mus musculus
aagcggcaaggctacatccatgaac

SEQ ID NO: 507128 - DNA, 25 bp, Mus musculus
aagcggcagccaatcctggatgcca

SEQ ID NO: 507129 - DNA, 25 bp, Mus musculus
aagcggcagccattcctggatgcca

SEQ ID NO: 507130 - DNA, 25 bp, Mus musculus
aagcggcatgtacagactccccagc

SEQ ID NO: 507131 - DNA, 25 bp, Mus musculus
aagcggcatgtagagactccccagc

SEQ ID NO: 507132 - DNA, 25 bp, Mus musculus
aagcggccacgcagccggaagcttc

SEQ ID NO: 507133 - DNA, 25 bp, Mus musculus
aagcggccacgctgccggaagcttc

SEQ ID NO: 507134 - DNA, 25 bp, Mus musculus
aagcggccgtccctacagatgagta

SEQ ID NO: 507135 - DNA, 25 bp, Mus musculus
aagcggccgtccgtacagatgagta

SEQ ID NO: 507136 - DNA, 25 bp, Mus musculus
aagcggcggctgaaccaagcggact

SEQ ID NO: 507137 - DNA, 25 bp, Mus musculus
aagcggcggctgtaccaagcggact

SEQ ID NO: 507138 - DNA, 25 bp, Mus musculus
aagcggctcaagatccgggcccacg

SEQ ID NO: 507139 - DNA, 25 bp, Mus musculus
aagcggctcaagttccgggcccacg

SEQ ID NO: 507140 - DNA, 25 bp, Mus musculus
aagcggctcccacggatggccatgt

SEQ ID NO: 507141 - DNA, 25 bp, Mus musculus
aagcggctcccagggatggccatgt

SEQ ID NO: 507142 - DNA, 25 bp, Mus musculus
aagcggctctacagcaagaacggcg

SEQ ID NO: 507143 - DNA, 25 bp, Mus musculus
aagcggctctactgcaagaacggcg

SEQ ID NO: 507144 - DNA, 25 bp, Mus musculus
aagcggctcttcctgcacaaagcca

SEQ ID NO: 507145 - DNA, 25 bp, Mus musculus
aagcggctcttcgtgcacaaagcca

SEQ ID NO: 507146 - DNA, 25 bp, Mus musculus
aagcggctgagacgccgcaagatca

SEQ ID NO: 507147 - DNA, 25 bp, Mus musculus
aagcggctgagaggccgcaagatca

SEQ ID NO: 507148 - DNA, 25 bp, Mus musculus
aagcggctgtggcacatttaccaaa

SEQ ID NO: 507149 - DNA, 25 bp, Mus musculus
aagcggctgtgggacatttaccaaa

SEQ ID NO: 507150 - DNA, 25 bp, Mus musculus
aagcggctttcactcgagctgacca

SEQ ID NO: 507151 - DNA, 25 bp, Mus musculus
aagcggctttcagtcgagctgacca

SEQ ID NO: 507152 - DNA, 25 bp, Mus musculus
aagcgggaacccacagatgctgcac

SEQ ID NO: 507153 - DNA, 25 bp, Mus musculus
aagcgggaaccctcagatgctgcac

SEQ ID NO: 507154 - DNA, 25 bp, Mus musculus
aagcgggccgccaagttccagtttg

SEQ ID NO: 507155 - DNA, 25 bp, Mus musculus
aagcgggccgcctagttccagtttg

SEQ ID NO: 507156 - DNA, 25 bp, Mus musculus
aagcgggcggccacgctgaactact

SEQ ID NO: 507157 - DNA, 25 bp, Mus musculus
aagcgggcggcctcgctgaactact

SEQ ID NO: 507158 - DNA, 25 bp, Mus musculus
aagcgggtctcactagatcccggag

SEQ ID NO: 507159 - DNA, 25 bp, Mus musculus
aagcgggtctcagtagatcccggag

SEQ ID NO: 507160 - DNA, 25 bp, Mus musculus
aagcgggtctggagtaaacaacagg

SEQ ID NO: 507161 - DNA, 25 bp, Mus musculus
aagcgggtctggtgtaaacaacagg

SEQ ID NO: 507162 - DNA, 25 bp, Mus musculus
aagcgggtgagtcgatccctgccca

SEQ ID NO: 507163 - DNA, 25 bp, Mus musculus
aagcgggtgagtggatccctgccca

SEQ ID NO: 507164 - DNA, 25 bp, Mus musculus
aagcgggtgggcatccctgtggccc

SEQ ID NO: 507165 - DNA, 25 bp, Mus musculus
aagcgggtgggcttccctgtggccc

SEQ ID NO: 507166 - DNA, 25 bp, Mus musculus
aagcggtaacgaccagcaccctgct

SEQ ID NO: 507167 - DNA, 25 bp, Mus musculus
aagcggtaacgagcagcaccctgct

SEQ ID NO: 507168 - DNA, 25 bp, Mus musculus
aagcggtccgccagatgctgtccac

SEQ ID NO: 507169 - DNA, 25 bp, Mus musculus
aagcggtccgcctgatgctgtccac

SEQ ID NO: 507170 - DNA, 25 bp, Mus musculus
aagcggtgagttcactagagcctca

SEQ ID NO: 507171 - DNA, 25 bp, Mus musculus
aagcggtgagttgactagagcctca

SEQ ID NO: 507172 - DNA, 25 bp, Mus musculus
aagcggtggctgactatttaacgag

SEQ ID NO: 507173 - DNA, 25 bp, Mus musculus
aagcggtggctgtctatttaacgag

SEQ ID NO: 507174 - DNA, 25 bp, Mus musculus
aagcggtggtgtcacctcaggctca

SEQ ID NO: 507175 - DNA, 25 bp, Mus musculus
aagcggtggtgtgacctcaggctca

SEQ ID NO: 507176 - DNA, 25 bp, Mus musculus
aagcggttacggctgtacagaaaca

SEQ ID NO: 507177 - DNA, 25 bp, Mus musculus
aagcggttacgggtgtacagaaaca

SEQ ID NO: 507178 - DNA, 25 bp, Mus musculus
aagcggttcccaccttttggcttcg

SEQ ID NO: 507179 - DNA, 25 bp, Mus musculus
aagcggttcccagcttttggcttcg

SEQ ID NO: 507180 - DNA, 25 bp, Mus musculus
aagcgtaagcgcctgcgtcgactcc

SEQ ID NO: 507181 - DNA, 25 bp, Mus musculus
aagcgtaagcgcgtgcgtcgactcc

SEQ ID NO: 507182 - DNA, 25 bp, Mus musculus
aagcgtaagctgatagcgccagcga

SEQ ID NO: 507183 - DNA, 25 bp, Mus musculus
aagcgtaagctgttagcgccagcga

SEQ ID NO: 507184 - DNA, 25 bp, Mus musculus
aagcgtagcaagcccgtcctgggca

SEQ ID NO: 507185 - DNA, 25 bp, Mus musculus
aagcgtagcaaggccgtcctgggca

SEQ ID NO: 507186 - DNA, 25 bp, Mus musculus
aagcgtatctatatctttgtgccag

SEQ ID NO: 507187 - DNA, 25 bp, Mus musculus
aagcgtatctatttctttgtgccag

SEQ ID NO: 507188 - DNA, 25 bp, Mus musculus
aagcgtcaacaacctcaggtacccg

SEQ ID NO: 507189 - DNA, 25 bp, Mus musculus
aagcgtcaacaagctcaggtacccg

SEQ ID NO: 507190 - DNA, 25 bp, Mus musculus
aagcgtcgcctgagtcgcctggaga

SEQ ID NO: 507191 - DNA, 25 bp, Mus musculus
aagcgtcgcctgtgtcgcctggaga

SEQ ID NO: 507192 - DNA, 25 bp, Mus musculus
aagcgtctcatcatctctgaccggg

SEQ ID NO: 507193 - DNA, 25 bp, Mus musculus
aagcgtctcatcttctctgaccggg

SEQ ID NO: 507194 - DNA, 25 bp, Mus musculus
aagcgtgaaccaagagacttctgga

SEQ ID NO: 507195 - DNA, 25 bp, Mus musculus
aagcgtgaaccatgagacttctgga

SEQ ID NO: 507196 - DNA, 25 bp, Mus musculus
aagcgtggcagcagcgagccttcat

SEQ ID NO: 507197 - DNA, 25 bp, Mus musculus
aagcgtggcagctgcgagccttcat

SEQ ID NO: 507198 - DNA, 25 bp, Mus musculus
aagcgtgggcggatgcgattcccca

SEQ ID NO: 507199 - DNA, 25 bp, Mus musculus
aagcgtgggcggttgcgattcccca

SEQ ID NO: 507200 - DNA, 25 bp, Mus musculus
aagcgtgtgaaacgccgtacttgga

SEQ ID NO: 507201 - DNA, 25 bp, Mus musculus
aagcgtgtgaaaggccgtacttgga

SEQ ID NO: 507202 - DNA, 25 bp, Mus musculus
aagcgtgtgccgatgcgactctttc

SEQ ID NO: 507203 - DNA, 25 bp, Mus musculus
aagcgtgtgccgttgcgactctttc

SEQ ID NO: 507204 - DNA, 25 bp, Mus musculus
aagcgtgtggaacaagagcttgatc

SEQ ID NO: 507205 - DNA, 25 bp, Mus musculus
aagcgtgtggaagaagagcttgatc

SEQ ID NO: 507206 - DNA, 25 bp, Mus musculus
aagcgtttgttccagtcatgcctac

SEQ ID NO: 507207 - DNA, 25 bp, Mus musculus
aagcgtttgttcgagtcatgcctac

SEQ ID NO: 507208 - DNA, 25 bp, Mus musculus
aagcgttttctgcttgctcgccgca

SEQ ID NO: 507209 - DNA, 25 bp, Mus musculus
aagcgttttctggttgctcgccgca

SEQ ID NO: 507210 - DNA, 25 bp, Mus musculus
aagctaaagcagatcgagcacactc

SEQ ID NO: 507211 - DNA, 25 bp, Mus musculus
aagctaaagcagttcgagcacactc

SEQ ID NO: 507212 - DNA, 25 bp, Mus musculus
aagctaacagccagggagcggatca

SEQ ID NO: 507213 - DNA, 25 bp, Mus musculus
aagctaacagcctgggagcggatca

SEQ ID NO: 507214 - DNA, 25 bp, Mus musculus
aagctaatgagcctgtgaaggatgc

SEQ ID NO: 507215 - DNA, 25 bp, Mus musculus
aagctaatgagcgtgtgaaggatgc

SEQ ID NO: 507216 - DNA, 25 bp, Mus musculus
aagctaatgatgaacctcctccgag

SEQ ID NO: 507217 - DNA, 25 bp, Mus musculus
aagctaatgatgtacctcctccgag

SEQ ID NO: 507218 - DNA, 25 bp, Mus musculus
aagctacaccatcccgtgagcaggc

SEQ ID NO: 507219 - DNA, 25 bp, Mus musculus
aagctacaccatgccgtgagcaggc

SEQ ID NO: 507220 - DNA, 25 bp, Mus musculus
aagctacacttgagtcgcccacaga

SEQ ID NO: 507221 - DNA, 25 bp, Mus musculus
aagctacacttgtgtcgcccacaga

SEQ ID NO: 507222 - DNA, 25 bp, Mus musculus
aagctacagtgccactggccttcct

SEQ ID NO: 507223 - DNA, 25 bp, Mus musculus
aagctacagtgcgactggccttcct

SEQ ID NO: 507224 - DNA, 25 bp, Mus musculus
aagctacccagcactgtgggtcaga

SEQ ID NO: 507225 - DNA, 25 bp, Mus musculus
aagctacccagctctgtgggtcaga

SEQ ID NO: 507226 - DNA, 25 bp, Mus musculus
aagctacctagtctacaacattctg

SEQ ID NO: 507227 - DNA, 25 bp, Mus musculus
aagctacctagtgtacaacattctg

SEQ ID NO: 507228 - DNA, 25 bp, Mus musculus
aagctacggttcacagtggataaat

SEQ ID NO: 507229 - DNA, 25 bp, Mus musculus
aagctacggttctcagtggataaat

SEQ ID NO: 507230 - DNA, 25 bp, Mus musculus
aagctacgtgatctctaccgtaaag

SEQ ID NO: 507231 - DNA, 25 bp, Mus musculus
aagctacgtgatgtctaccgtaaag

SEQ ID NO: 507232 - DNA, 25 bp, Mus musculus
aagctacgtgcacaaggacctcaag

SEQ ID NO: 507233 - DNA, 25 bp, Mus musculus
aagctacgtgcagaaggacctcaag

SEQ ID NO: 507234 - DNA, 25 bp, Mus musculus
aagctacgtggaccccggctcaagt

SEQ ID NO: 507235 - DNA, 25 bp, Mus musculus
aagctacgtggagcccggctcaagt

SEQ ID NO: 507236 - DNA, 25 bp, Mus musculus
aagctactacagaggtgcagctggg

SEQ ID NO: 507237 - DNA, 25 bp, Mus musculus
aagctactacagtggtgcagctggg

SEQ ID NO: 507238 - DNA, 25 bp, Mus musculus
aagctactatggaggaaactgggcc

SEQ ID NO: 507239 - DNA, 25 bp, Mus musculus
aagctactatggtggaaactgggcc

SEQ ID NO: 507240 - DNA, 25 bp, Mus musculus
aagctactccgtaacggagcggtgg

SEQ ID NO: 507241 - DNA, 25 bp, Mus musculus
aagctactccgttacggagcggtgg

SEQ ID NO: 507242 - DNA, 25 bp, Mus musculus
aagctacttagtcccagccatgagg

SEQ ID NO: 507243 - DNA, 25 bp, Mus musculus
aagctacttagtgccagccatgagg

SEQ ID NO: 507244 - DNA, 25 bp, Mus musculus
aagctacttatgatggcaaccacga

SEQ ID NO: 507245 - DNA, 25 bp, Mus musculus
aagctacttatgttggcaaccacga

SEQ ID NO: 507246 - DNA, 25 bp, Mus musculus
aagctacttcggctgctcgaccggg

SEQ ID NO: 507247 - DNA, 25 bp, Mus musculus
aagctacttcgggtgctcgaccggg

SEQ ID NO: 507248 - DNA, 25 bp, Mus musculus
aagctagccttcagctgagggccgc

SEQ ID NO: 507249 - DNA, 25 bp, Mus musculus
aagctagccttctgctgagggccgc

SEQ ID NO: 507250 - DNA, 25 bp, Mus musculus
aagctagcttatcctgttcgaggca

SEQ ID NO: 507251 - DNA, 25 bp, Mus musculus
aagctagcttatgctgttcgaggca

SEQ ID NO: 507252 - DNA, 25 bp, Mus musculus
aagctagcttttaagagggaacagc

SEQ ID NO: 507253 - DNA, 25 bp, Mus musculus
aagctagctttttagagggaacagc

SEQ ID NO: 507254 - DNA, 25 bp, Mus musculus
aagctagggacacaactggctcggc

SEQ ID NO: 507255 - DNA, 25 bp, Mus musculus
aagctagggacagaactggctcggc

SEQ ID NO: 507256 - DNA, 25 bp, Mus musculus
aagctagtgggcaccatttcctgat

SEQ ID NO: 507257 - DNA, 25 bp, Mus musculus
aagctagtgggctccatttcctgat

SEQ ID NO: 507258 - DNA, 25 bp, Mus musculus
aagctagtttctctctagaagacac

SEQ ID NO: 507259 - DNA, 25 bp, Mus musculus
aagctagtttctgtctagaagacac

SEQ ID NO: 507260 - DNA, 25 bp, Mus musculus
aagctatccgcgctcttccgatttg

SEQ ID NO: 507261 - DNA, 25 bp, Mus musculus
aagctatccgcggtcttccgatttg

SEQ ID NO: 507262 - DNA, 25 bp, Mus musculus
aagctatctgatctcagggcaataa

SEQ ID NO: 507263 - DNA, 25 bp, Mus musculus
aagctatctgatgtcagggcaataa

SEQ ID NO: 507264 - DNA, 25 bp, Mus musculus
aagctatgatgtcgttaaacgatgg

SEQ ID NO: 507265 - DNA, 25 bp, Mus musculus
aagctatgatgtggttaaacgatgg

SEQ ID NO: 507266 - DNA, 25 bp, Mus musculus
aagctatgggctaaggcaagggaaa

SEQ ID NO: 507267 - DNA, 25 bp, Mus musculus
aagctatgggcttaggcaagggaaa

SEQ ID NO: 507268 - DNA, 25 bp, Mus musculus
aagctcaactgaaaagtcagatggg

SEQ ID NO: 507269 - DNA, 25 bp, Mus musculus
aagctcaactgataagtcagatggg

SEQ ID NO: 507270 - DNA, 25 bp, Mus musculus
aagctcaagggcaccgtggaagtcc

SEQ ID NO: 507271 - DNA, 25 bp, Mus musculus
aagctcaagggctccgtggaagtcc

SEQ ID NO: 507272 - DNA, 25 bp, Mus musculus
aagctcaatgacaacctccaggtgg

SEQ ID NO: 507273 - DNA, 25 bp, Mus musculus
aagctcaatgactacctccaggtgg

SEQ ID NO: 507274 - DNA, 25 bp, Mus musculus
aagctcacgttcatggaggaggaag

SEQ ID NO: 507275 - DNA, 25 bp, Mus musculus
aagctcacgttcttggaggaggaag

SEQ ID NO: 507276 - DNA, 25 bp, Mus musculus
aagctcagaaatacatctcagaaag

SEQ ID NO: 507277 - DNA, 25 bp, Mus musculus
aagctcagaaattcatctcagaaag

SEQ ID NO: 507278 - DNA, 25 bp, Mus musculus
aagctcagcacgatgacacggcctt

SEQ ID NO: 507279 - DNA, 25 bp, Mus musculus
aagctcagcacgttgacacggcctt

SEQ ID NO: 507280 - DNA, 25 bp, Mus musculus
aagctcagccagacttactactcac

SEQ ID NO: 507281 - DNA, 25 bp, Mus musculus
aagctcagccagtcttactactcac

SEQ ID NO: 507282 - DNA, 25 bp, Mus musculus
aagctcatcctgatctttctgttcc

SEQ ID NO: 507283 - DNA, 25 bp, Mus musculus
aagctcatcctgttctttctgttcc

SEQ ID NO: 507284 - DNA, 25 bp, Mus musculus
aagctcatcgagaggatggtcagga

SEQ ID NO: 507285 - DNA, 25 bp, Mus musculus
aagctcatcgagtggatggtcagga

SEQ ID NO: 507286 - DNA, 25 bp, Mus musculus
aagctcatctctctccgggactgga

SEQ ID NO: 507287 - DNA, 25 bp, Mus musculus
aagctcatctctgtccgggactgga

SEQ ID NO: 507288 - DNA, 25 bp, Mus musculus
aagctcattttaagactcgttggaa

SEQ ID NO: 507289 - DNA, 25 bp, Mus musculus
aagctcattttatgactcgttggaa

SEQ ID NO: 507290 - DNA, 25 bp, Mus musculus
aagctccacaggaaccggatccatt

SEQ ID NO: 507291 - DNA, 25 bp, Mus musculus
aagctccacaggtaccggatccatt

SEQ ID NO: 507292 - DNA, 25 bp, Mus musculus
aagctccagagaagtgggtccccac

SEQ ID NO: 507293 - DNA, 25 bp, Mus musculus
aagctccagagatgtgggtccccac

SEQ ID NO: 507294 - DNA, 25 bp, Mus musculus
aagctccctccaaacctgggtctga

SEQ ID NO: 507295 - DNA, 25 bp, Mus musculus
aagctccctccatacctgggtctga

SEQ ID NO: 507296 - DNA, 25 bp, Mus musculus
aagctccgcgcgagtcctcgtcggt

SEQ ID NO: 507297 - DNA, 25 bp, Mus musculus
aagctccgcgcgtgtcctcgtcggt

SEQ ID NO: 507298 - DNA, 25 bp, Mus musculus
aagctcctggcgaggggatatgaac

SEQ ID NO: 507299 - DNA, 25 bp, Mus musculus
aagctcctggcgtggggatatgaac

SEQ ID NO: 507300 - DNA, 25 bp, Mus musculus
aagctcctggtacagcagttctcgg

SEQ ID NO: 507301 - DNA, 25 bp, Mus musculus
aagctcctggtagagcagttctcgg

SEQ ID NO: 507302 - DNA, 25 bp, Mus musculus
aagctcgactacagccgggaccgct

SEQ ID NO: 507303 - DNA, 25 bp, Mus musculus
aagctcgactactgccgggaccgct

SEQ ID NO: 507304 - DNA, 25 bp, Mus musculus
aagctcgaggccagcgaactcttca

SEQ ID NO: 507305 - DNA, 25 bp, Mus musculus
aagctcgaggcctgcgaactcttca

SEQ ID NO: 507306 - DNA, 25 bp, Mus musculus
aagctcgcctgcatgtagtgggcac

SEQ ID NO: 507307 - DNA, 25 bp, Mus musculus
aagctcgcctgcttgtagtgggcac

SEQ ID NO: 507308 - DNA, 25 bp, Mus musculus
aagctcgtagctatcaacaaacacg

SEQ ID NO: 507309 - DNA, 25 bp, Mus musculus
aagctcgtagctttcaacaaacacg

SEQ ID NO: 507310 - DNA, 25 bp, Mus musculus
aagctcgttgtgagggcctcagacc

SEQ ID NO: 507311 - DNA, 25 bp, Mus musculus
aagctcgttgtgtgggcctcagacc

SEQ ID NO: 507312 - DNA, 25 bp, Mus musculus
aagctctacaagaatgctcgggagc

SEQ ID NO: 507313 - DNA, 25 bp, Mus musculus
aagctctacaagtatgctcgggagc

SEQ ID NO: 507314 - DNA, 25 bp, Mus musculus
aagctctaggcaagaacttcagtgg

SEQ ID NO: 507315 - DNA, 25 bp, Mus musculus
aagctctaggcatgaacttcagtgg

SEQ ID NO: 507316 - DNA, 25 bp, Mus musculus
aagctctcaaaaatctggcatccaa

SEQ ID NO: 507317 - DNA, 25 bp, Mus musculus
aagctctcaaaattctggcatccaa

SEQ ID NO: 507318 - DNA, 25 bp, Mus musculus
aagctctcagctcaggtaagaaggc

SEQ ID NO: 507319 - DNA, 25 bp, Mus musculus
aagctctcagctgaggtaagaaggc

SEQ ID NO: 507320 - DNA, 25 bp, Mus musculus
aagctctcgcgccagaagctggacc

SEQ ID NO: 507321 - DNA, 25 bp, Mus musculus
aagctctcgcgcgagaagctggacc

SEQ ID NO: 507322 - DNA, 25 bp, Mus musculus
aagctctctacgaagcgctgaaaga

SEQ ID NO: 507323 - DNA, 25 bp, Mus musculus
aagctctctacgtagcgctgaaaga

SEQ ID NO: 507324 - DNA, 25 bp, Mus musculus
aagctctctagactccaagagtgag

SEQ ID NO: 507325 - DNA, 25 bp, Mus musculus
aagctctctagagtccaagagtgag

SEQ ID NO: 507326 - DNA, 25 bp, Mus musculus
aagctctctgtgaggatacggagtt

SEQ ID NO: 507327 - DNA, 25 bp, Mus musculus
aagctctctgtgtggatacggagtt

SEQ ID NO: 507328 - DNA, 25 bp, Mus musculus
aagctctgcgataggtggtcgctcg

SEQ ID NO: 507329 - DNA, 25 bp, Mus musculus
aagctctgcgattggtggtcgctcg

SEQ ID NO: 507330 - DNA, 25 bp, Mus musculus
aagctctgcggtcgttcaaccggga

SEQ ID NO: 507331 - DNA, 25 bp, Mus musculus
aagctctgcggtggttcaaccggga

SEQ ID NO: 507332 - DNA, 25 bp, Mus musculus
aagctctgtaggaagattgagaaag

SEQ ID NO: 507333 - DNA, 25 bp, Mus musculus
aagctctgtaggtagattgagaaag

SEQ ID NO: 507334 - DNA, 25 bp, Mus musculus
aagctcttcctgacacggaggaggt

SEQ ID NO: 507335 - DNA, 25 bp, Mus musculus
aagctcttcctgtcacggaggaggt

SEQ ID NO: 507336 - DNA, 25 bp, Mus musculus
aagctcttggtcaggagagcgctca

SEQ ID NO: 507337 - DNA, 25 bp, Mus musculus
aagctcttggtctggagagcgctca

SEQ ID NO: 507338 - DNA, 25 bp, Mus musculus
aagctctttgccactcctgccacag

SEQ ID NO: 507339 - DNA, 25 bp, Mus musculus
aagctctttgcctctcctgccacag

SEQ ID NO: 507340 - DNA, 25 bp, Mus musculus
aagctgaaacagaatggcttatctg

SEQ ID NO: 507341 - DNA, 25 bp, Mus musculus
aagctgaaacagtatggcttatctg

SEQ ID NO: 507342 - DNA, 25 bp, Mus musculus
aagctgaacattaccaagccagccc

SEQ ID NO: 507343 - DNA, 25 bp, Mus musculus
aagctgaacatttccaagccagccc

SEQ ID NO: 507344 - DNA, 25 bp, Mus musculus
aagctgaagacgcacatgcgctgcc

SEQ ID NO: 507345 - DNA, 25 bp, Mus musculus
aagctgaagacggacatgcgctgcc

SEQ ID NO: 507346 - DNA, 25 bp, Mus musculus
aagctgaagcagacgcagctgttgg

SEQ ID NO: 507347 - DNA, 25 bp, Mus musculus
aagctgaagcagtcgcagctgttgg

SEQ ID NO: 507348 - DNA, 25 bp, Mus musculus
aagctgaagctgagcagaaacaggc

SEQ ID NO: 507349 - DNA, 25 bp, Mus musculus
aagctgaagctgtgcagaaacaggc

SEQ ID NO: 507350 - DNA, 25 bp, Mus musculus
aagctgaagttcattgaccccaaga

SEQ ID NO: 507351 - DNA, 25 bp, Mus musculus
aagctgaagttctttgaccccaaga

SEQ ID NO: 507352 - DNA, 25 bp, Mus musculus
aagctgaatgcaagaaggagatgct

SEQ ID NO: 507353 - DNA, 25 bp, Mus musculus
aagctgaatgcatgaaggagatgct

SEQ ID NO: 507354 - DNA, 25 bp, Mus musculus
aagctgaatgtcagaagcccctctg

SEQ ID NO: 507355 - DNA, 25 bp, Mus musculus
aagctgaatgtctgaagcccctctg

SEQ ID NO: 507356 - DNA, 25 bp, Mus musculus
aagctgaatgtgagctcaggcaacg

SEQ ID NO: 507357 - DNA, 25 bp, Mus musculus
aagctgaatgtgtgctcaggcaacg

SEQ ID NO: 507358 - DNA, 25 bp, Mus musculus
aagctgacaatcacaaaaaacgcgg

SEQ ID NO: 507359 - DNA, 25 bp, Mus musculus
aagctgacaatctcaaaaaacgcgg

SEQ ID NO: 507360 - DNA, 25 bp, Mus musculus
aagctgagcagacccttatctcaga

SEQ ID NO: 507361 - DNA, 25 bp, Mus musculus
aagctgagcagagccttatctcaga

SEQ ID NO: 507362 - DNA, 25 bp, Mus musculus
aagctgagccgcacgctgcgatact

SEQ ID NO: 507363 - DNA, 25 bp, Mus musculus
aagctgagccgctcgctgcgatact

SEQ ID NO: 507364 - DNA, 25 bp, Mus musculus
aagctgagcctccagaaagatctgg

SEQ ID NO: 507365 - DNA, 25 bp, Mus musculus
aagctgagcctcgagaaagatctgg

SEQ ID NO: 507366 - DNA, 25 bp, Mus musculus
aagctgagctggctgaattaccact

SEQ ID NO: 507367 - DNA, 25 bp, Mus musculus
aagctgagctgggtgaattaccact

SEQ ID NO: 507368 - DNA, 25 bp, Mus musculus
aagctgaggagccaactaagggccc

SEQ ID NO: 507369 - DNA, 25 bp, Mus musculus
aagctgaggagcgaactaagggccc

SEQ ID NO: 507370 - DNA, 25 bp, Mus musculus
aagctgaggctcaacaagttctaca

SEQ ID NO: 507371 - DNA, 25 bp, Mus musculus
aagctgaggctctacaagttctaca

SEQ ID NO: 507372 - DNA, 25 bp, Mus musculus
aagctgagggagaccacgatcatca

SEQ ID NO: 507373 - DNA, 25 bp, Mus musculus
aagctgagggagtccacgatcatca

SEQ ID NO: 507374 - DNA, 25 bp, Mus musculus
aagctgagtggtagcattcatttat

SEQ ID NO: 507375 - DNA, 25 bp, Mus musculus
aagctgagtggttgcattcatttat

SEQ ID NO: 507376 - DNA, 25 bp, Mus musculus
aagctgatcagaagcaatcttgtgg

SEQ ID NO: 507377 - DNA, 25 bp, Mus musculus
aagctgatcagatgcaatcttgtgg

SEQ ID NO: 507378 - DNA, 25 bp, Mus musculus
aagctgatccgacggctcgccatgg

SEQ ID NO: 507379 - DNA, 25 bp, Mus musculus
aagctgatccgagggctcgccatgg

SEQ ID NO: 507380 - DNA, 25 bp, Mus musculus
aagctgatcctcaagttcctgtccg

SEQ ID NO: 507381 - DNA, 25 bp, Mus musculus
aagctgatcctctagttcctgtccg

SEQ ID NO: 507382 - DNA, 25 bp, Mus musculus
aagctgatctgtctgtaggtccagg

SEQ ID NO: 507383 - DNA, 25 bp, Mus musculus
aagctgatctgtgtgtaggtccagg

SEQ ID NO: 507384 - DNA, 25 bp, Mus musculus
aagctgatgcggatctcatcaatgc

SEQ ID NO: 507385 - DNA, 25 bp, Mus musculus
aagctgatgcggttctcatcaatgc

SEQ ID NO: 507386 - DNA, 25 bp, Mus musculus
aagctgattctacacaaaatcctgg

SEQ ID NO: 507387 - DNA, 25 bp, Mus musculus
aagctgattctagacaaaatcctgg

SEQ ID NO: 507388 - DNA, 25 bp, Mus musculus
aagctgattgctatgcacccgctca

SEQ ID NO: 507389 - DNA, 25 bp, Mus musculus
aagctgattgctttgcacccgctca

SEQ ID NO: 507390 - DNA, 25 bp, Mus musculus
aagctgattggcagacgagcagaga

SEQ ID NO: 507391 - DNA, 25 bp, Mus musculus
aagctgattggcctccgatccacca

SEQ ID NO: 507392 - DNA, 25 bp, Mus musculus
aagctgattggcgtccgatccacca

SEQ ID NO: 507393 - DNA, 25 bp, Mus musculus
aagctgattggctgacgagcagaga

SEQ ID NO: 507394 - DNA, 25 bp, Mus musculus
aagctgcaattcatcaggaccctgg

SEQ ID NO: 507395 - DNA, 25 bp, Mus musculus
aagctgcaattcttcaggaccctgg

SEQ ID NO: 507396 - DNA, 25 bp, Mus musculus
aagctgcactgcacaaggaactaca

SEQ ID NO: 507397 - DNA, 25 bp, Mus musculus
aagctgcactgctcaaggaactaca

SEQ ID NO: 507398 - DNA, 25 bp, Mus musculus
aagctgcagaggctactgaaagtgc

SEQ ID NO: 507399 - DNA, 25 bp, Mus musculus
aagctgcagagggtactgaaagtgc

SEQ ID NO: 507400 - DNA, 25 bp, Mus musculus
aagctgcagccaagggacctttggc

SEQ ID NO: 507401 - DNA, 25 bp, Mus musculus
aagctgcagccatgggacctttggc

SEQ ID NO: 507402 - DNA, 25 bp, Mus musculus
aagctgcagcgcagcaaggagaagt

SEQ ID NO: 507403 - DNA, 25 bp, Mus musculus
aagctgcagcgctgcaaggagaagt

SEQ ID NO: 507404 - DNA, 25 bp, Mus musculus
aagctgcaggcaccccagttcatgc

SEQ ID NO: 507405 - DNA, 25 bp, Mus musculus
aagctgcaggcagcccagttcatgc

SEQ ID NO: 507406 - DNA, 25 bp, Mus musculus
aagctgcagggaagctacacacagg

SEQ ID NO: 507407 - DNA, 25 bp, Mus musculus
aagctgcagggatgctacacacagg

SEQ ID NO: 507408 - DNA, 25 bp, Mus musculus
aagctgccaaaacctagaagaacat

SEQ ID NO: 507409 - DNA, 25 bp, Mus musculus
aagctgccaaaagctagaagaacat

SEQ ID NO: 507410 - DNA, 25 bp, Mus musculus
aagctgccacttatgctagagagca

SEQ ID NO: 507411 - DNA, 25 bp, Mus musculus
aagctgccacttttgctagagagca

SEQ ID NO: 507412 - DNA, 25 bp, Mus musculus
aagctgccatttcacacgtgtacgg

SEQ ID NO: 507413 - DNA, 25 bp, Mus musculus
aagctgccatttgacacgtgtacgg

SEQ ID NO: 507414 - DNA, 25 bp, Mus musculus
aagctgccgagcagagggctcctga

SEQ ID NO: 507415 - DNA, 25 bp, Mus musculus
aagctgccgagctgagggctcctga

SEQ ID NO: 507416 - DNA, 25 bp, Mus musculus
aagctgccgccaaggaagaggagca

SEQ ID NO: 507417 - DNA, 25 bp, Mus musculus
aagctgccgccatggaagaggagca

SEQ ID NO: 507418 - DNA, 25 bp, Mus musculus
aagctgccttccagctcacacggtg

SEQ ID NO: 507419 - DNA, 25 bp, Mus musculus
aagctgccttcccacaggtccaagg

SEQ ID NO: 507420 - DNA, 25 bp, Mus musculus
aagctgccttccgacaggtccaagg

SEQ ID NO: 507421 - DNA, 25 bp, Mus musculus
aagctgccttcctgctcacacggtg

SEQ ID NO: 507422 - DNA, 25 bp, Mus musculus
aagctgcgcagcacgctttggagca

SEQ ID NO: 507423 - DNA, 25 bp, Mus musculus
aagctgcgcagctcgctttggagca

SEQ ID NO: 507424 - DNA, 25 bp, Mus musculus
aagctgcgctataaggtggatcacg

SEQ ID NO: 507425 - DNA, 25 bp, Mus musculus
aagctgcgctattaggtggatcacg

SEQ ID NO: 507426 - DNA, 25 bp, Mus musculus
aagctgcggcggacagaagccatcc

SEQ ID NO: 507427 - DNA, 25 bp, Mus musculus
aagctgcggcggtcagaagccatcc

SEQ ID NO: 507428 - DNA, 25 bp, Mus musculus
aagctgcggtcactctagcgagaca

SEQ ID NO: 507429 - DNA, 25 bp, Mus musculus
aagctgcggtcagtctagcgagaca

SEQ ID NO: 507430 - DNA, 25 bp, Mus musculus
aagctgcgtagcagtgcactgtgtg

SEQ ID NO: 507431 - DNA, 25 bp, Mus musculus
aagctgcgtagctgtgcactgtgtg

SEQ ID NO: 507432 - DNA, 25 bp, Mus musculus
aagctgcgttctcccagacgcctta

SEQ ID NO: 507433 - DNA, 25 bp, Mus musculus
aagctgcgttctgccagacgcctta

SEQ ID NO: 507434 - DNA, 25 bp, Mus musculus
aagctgctcctgaggtctctgcctc

SEQ ID NO: 507435 - DNA, 25 bp, Mus musculus
aagctgctcctgtggtctctgcctc

SEQ ID NO: 507436 - DNA, 25 bp, Mus musculus
aagctgctcgagaaggacatgaaga

SEQ ID NO: 507437 - DNA, 25 bp, Mus musculus
aagctgctcgagtaggacatgaaga

SEQ ID NO: 507438 - DNA, 25 bp, Mus musculus
aagctgctcgcactgattgaggagc

SEQ ID NO: 507439 - DNA, 25 bp, Mus musculus
aagctgctcgcagtgattgaggagc

SEQ ID NO: 507440 - DNA, 25 bp, Mus musculus
aagctgctcggcatgcaaaggagaa

SEQ ID NO: 507441 - DNA, 25 bp, Mus musculus
aagctgctcggcttgcaaaggagaa

SEQ ID NO: 507442 - DNA, 25 bp, Mus musculus
aagctgctgcctcggcggcacatgc

SEQ ID NO: 507443 - DNA, 25 bp, Mus musculus
aagctgctgcctgggcggcacatgc

SEQ ID NO: 507444 - DNA, 25 bp, Mus musculus
aagctgctggtgctctggaataatc

SEQ ID NO: 507445 - DNA, 25 bp, Mus musculus
aagctgctggtggtctggaataatc

SEQ ID NO: 507446 - DNA, 25 bp, Mus musculus
aagctgctgtggcaactagtgttga

SEQ ID NO: 507447 - DNA, 25 bp, Mus musculus
aagctgctgtgggaactagtgttga

SEQ ID NO: 507448 - DNA, 25 bp, Mus musculus
aagctgcttcaacctgtggcccagt

SEQ ID NO: 507449 - DNA, 25 bp, Mus musculus
aagctgcttcaagctgtggcccagt

SEQ ID NO: 507450 - DNA, 25 bp, Mus musculus
aagctggaaacactgacacagaggg

SEQ ID NO: 507451 - DNA, 25 bp, Mus musculus
aagctggaaacagtgacacagaggg

SEQ ID NO: 507452 - DNA, 25 bp, Mus musculus
aagctggaaataagggaggacctaa

SEQ ID NO: 507453 - DNA, 25 bp, Mus musculus
aagctggaaatatgggaggacctaa

SEQ ID NO: 507454 - DNA, 25 bp, Mus musculus
aagctggaagtccagttcttcccgt

SEQ ID NO: 507455 - DNA, 25 bp, Mus musculus
aagctggaagtcgagttcttcccgt

SEQ ID NO: 507456 - DNA, 25 bp, Mus musculus
aagctggaatatctagtttttacac

SEQ ID NO: 507457 - DNA, 25 bp, Mus musculus
aagctggaatatgtagtttttacac

SEQ ID NO: 507458 - DNA, 25 bp, Mus musculus
aagctggacagcaagaagctgcttg

SEQ ID NO: 507459 - DNA, 25 bp, Mus musculus
aagctggacagctagaagctgcttg

SEQ ID NO: 507460 - DNA, 25 bp, Mus musculus
aagctggaccaacccttggtggcag

SEQ ID NO: 507461 - DNA, 25 bp, Mus musculus
aagctggaccaagccttggtggcag

SEQ ID NO: 507462 - DNA, 25 bp, Mus musculus
aagctggaccacctgtggactgaca

SEQ ID NO: 507463 - DNA, 25 bp, Mus musculus
aagctggaccacgtgtggactgaca

SEQ ID NO: 507464 - DNA, 25 bp, Mus musculus
aagctggagacacagtaaaagctgg

SEQ ID NO: 507465 - DNA, 25 bp, Mus musculus
aagctggagacagagtaaaagctgg

SEQ ID NO: 507466 - DNA, 25 bp, Mus musculus
aagctggagcatccgaaccggcacc

SEQ ID NO: 507467 - DNA, 25 bp, Mus musculus
aagctggagcatgcgaaccggcacc

SEQ ID NO: 507468 - DNA, 25 bp, Mus musculus
aagctggagccccaccgaagtagca

SEQ ID NO: 507469 - DNA, 25 bp, Mus musculus
aagctggagcccgaccgaagtagca

SEQ ID NO: 507470 - DNA, 25 bp, Mus musculus
aagctggagcgtccacgggatctct

SEQ ID NO: 507471 - DNA, 25 bp, Mus musculus
aagctggagcgtgcacgggatctct

SEQ ID NO: 507472 - DNA, 25 bp, Mus musculus
aagctggagtctaccgagagccgga

SEQ ID NO: 507473 - DNA, 25 bp, Mus musculus
aagctggagtcttccgagagccgga

SEQ ID NO: 507474 - DNA, 25 bp, Mus musculus
aagctggagttcaacaaggcggaga

SEQ ID NO: 507475 - DNA, 25 bp, Mus musculus
aagctggagttctacaaggcggaga

SEQ ID NO: 507476 - DNA, 25 bp, Mus musculus
aagctggatgctaccgatgaagagg

SEQ ID NO: 507477 - DNA, 25 bp, Mus musculus
aagctggatgcttccgatgaagagg

SEQ ID NO: 507478 - DNA, 25 bp, Mus musculus
aagctggatggcagcaacatgacta

SEQ ID NO: 507479 - DNA, 25 bp, Mus musculus
aagctggatggctgcaacatgacta

SEQ ID NO: 507480 - DNA, 25 bp, Mus musculus
aagctggcagtcactacctttctgg

SEQ ID NO: 507481 - DNA, 25 bp, Mus musculus
aagctggcagtcagacagaccggtg

SEQ ID NO: 507482 - DNA, 25 bp, Mus musculus
aagctggcagtctctacctttctgg

SEQ ID NO: 507483 - DNA, 25 bp, Mus musculus
aagctggcagtctgacagaccggtg

SEQ ID NO: 507484 - DNA, 25 bp, Mus musculus
aagctggccatacaagcgagcggct

SEQ ID NO: 507485 - DNA, 25 bp, Mus musculus
aagctggccatagaagcgagcggct

SEQ ID NO: 507486 - DNA, 25 bp, Mus musculus
aagctggcccagcactttctggact

SEQ ID NO: 507487 - DNA, 25 bp, Mus musculus
aagctggcccaggactttctggact

SEQ ID NO: 507488 - DNA, 25 bp, Mus musculus
aagctggccccgattctgaaaatgt

SEQ ID NO: 507489 - DNA, 25 bp, Mus musculus
aagctggccccgtttctgaaaatgt

SEQ ID NO: 507490 - DNA, 25 bp, Mus musculus
aagctggccggcagcacgaaggcca

SEQ ID NO: 507491 - DNA, 25 bp, Mus musculus
aagctggccggctgcacgaaggcca

SEQ ID NO: 507492 - DNA, 25 bp, Mus musculus
aagctggccgtgctcatcaccaact

SEQ ID NO: 507493 - DNA, 25 bp, Mus musculus
aagctggccgtggtcatcaccaact

SEQ ID NO: 507494 - DNA, 25 bp, Mus musculus
aagctggcctctaggacatgaggga

SEQ ID NO: 507495 - DNA, 25 bp, Mus musculus
aagctggcctcttggacatgaggga

SEQ ID NO: 507496 - DNA, 25 bp, Mus musculus
aagctggcgactaggagcctgtgac

SEQ ID NO: 507497 - DNA, 25 bp, Mus musculus
aagctggcgacttggagcctgtgac

SEQ ID NO: 507498 - DNA, 25 bp, Mus musculus
aagctggctccacaagggacacggt

SEQ ID NO: 507499 - DNA, 25 bp, Mus musculus
aagctggctccagaagggacacggt

SEQ ID NO: 507500 - DNA, 25 bp, Mus musculus
aagctggctccgcagaaagtgcacg

SEQ ID NO: 507501 - DNA, 25 bp, Mus musculus
aagctggctccggagaaagtgcacg

SEQ ID NO: 507502 - DNA, 25 bp, Mus musculus
aagctggctgccatttgcgtactga

SEQ ID NO: 507503 - DNA, 25 bp, Mus musculus
aagctggctgccttttgcgtactga

SEQ ID NO: 507504 - DNA, 25 bp, Mus musculus
aagctgggaacgatactgaaagaac

SEQ ID NO: 507505 - DNA, 25 bp, Mus musculus
aagctgggaacgttactgaaagaac

SEQ ID NO: 507506 - DNA, 25 bp, Mus musculus
aagctgggcttgagccactggccct

SEQ ID NO: 507507 - DNA, 25 bp, Mus musculus
aagctgggcttgtgccactggccct

SEQ ID NO: 507508 - DNA, 25 bp, Mus musculus
aagctgggtgacacgcctggtgttt

SEQ ID NO: 507509 - DNA, 25 bp, Mus musculus
aagctgggtgactcgcctggtgttt

SEQ ID NO: 507510 - DNA, 25 bp, Mus musculus
aagctgggtgtgcatactatcgcca

SEQ ID NO: 507511 - DNA, 25 bp, Mus musculus
aagctgggtgtggatactatcgcca

SEQ ID NO: 507512 - DNA, 25 bp, Mus musculus
aagctggtattgagatcaaccgcca

SEQ ID NO: 507513 - DNA, 25 bp, Mus musculus
aagctggtattgtgatcaaccgcca

SEQ ID NO: 507514 - DNA, 25 bp, Mus musculus
aagctggtcaccactgagcctgcca

SEQ ID NO: 507515 - DNA, 25 bp, Mus musculus
aagctggtcacctctgagcctgcca

SEQ ID NO: 507516 - DNA, 25 bp, Mus musculus
aagctggtccccaggcccttagagg

SEQ ID NO: 507517 - DNA, 25 bp, Mus musculus
aagctggtcccctggcccttagagg

SEQ ID NO: 507518 - DNA, 25 bp, Mus musculus
aagctggtctacagcctgcggagaa

SEQ ID NO: 507519 - DNA, 25 bp, Mus musculus
aagctggtctactgcctgcggagaa

SEQ ID NO: 507520 - DNA, 25 bp, Mus musculus
aagctggtgactataaggaaggaga

SEQ ID NO: 507521 - DNA, 25 bp, Mus musculus
aagctggtgactttaaggaaggaga

SEQ ID NO: 507522 - DNA, 25 bp, Mus musculus
aagctggtgcaccactacatgccgc

SEQ ID NO: 507523 - DNA, 25 bp, Mus musculus
aagctggtgcacgactacatgccgc

SEQ ID NO: 507524 - DNA, 25 bp, Mus musculus
aagctggtgcgcacactgaccatgg

SEQ ID NO: 507525 - DNA, 25 bp, Mus musculus
aagctggtgcgctcactgaccatgg

SEQ ID NO: 507526 - DNA, 25 bp, Mus musculus
aagctggtggctctaaaggtgatcc

SEQ ID NO: 507527 - DNA, 25 bp, Mus musculus
aagctggtggctgtaaaggtgatcc

SEQ ID NO: 507528 - DNA, 25 bp, Mus musculus
aagctggttttcctggtcgccctgg

SEQ ID NO: 507529 - DNA, 25 bp, Mus musculus
aagctggttttcgtggtcgccctgg

SEQ ID NO: 507530 - DNA, 25 bp, Mus musculus
aagctgtaaccaagatgccgctgcc

SEQ ID NO: 507531 - DNA, 25 bp, Mus musculus
aagctgtaaccatgatgccgctgcc

SEQ ID NO: 507532 - DNA, 25 bp, Mus musculus
aagctgtaacggcagcctggccaac

SEQ ID NO: 507533 - DNA, 25 bp, Mus musculus
aagctgtaacgggagcctggccaac

SEQ ID NO: 507534 - DNA, 25 bp, Mus musculus
aagctgtacaaacgatcttaggaag

SEQ ID NO: 507535 - DNA, 25 bp, Mus musculus
aagctgtacaaaggatcttaggaag

SEQ ID NO: 507536 - DNA, 25 bp, Mus musculus
aagctgtcaccgagatgaatggacg

SEQ ID NO: 507537 - DNA, 25 bp, Mus musculus
aagctgtcaccgtgatgaatggacg

SEQ ID NO: 507538 - DNA, 25 bp, Mus musculus
aagctgtcagagcagttaaagcact

SEQ ID NO: 507539 - DNA, 25 bp, Mus musculus
aagctgtcagaggagttaaagcact

SEQ ID NO: 507540 - DNA, 25 bp, Mus musculus
aagctgtcaggcactgatcggaagg

SEQ ID NO: 507541 - DNA, 25 bp, Mus musculus
aagctgtcaggctctgatcggaagg

SEQ ID NO: 507542 - DNA, 25 bp, Mus musculus
aagctgtcccgcctggaagccaagc

SEQ ID NO: 507543 - DNA, 25 bp, Mus musculus
aagctgtcccgcgtggaagccaagc

SEQ ID NO: 507544 - DNA, 25 bp, Mus musculus
aagctgtcctgcacatgccaggtgc

SEQ ID NO: 507545 - DNA, 25 bp, Mus musculus
aagctgtcctgctcatgccaggtgc

SEQ ID NO: 507546 - DNA, 25 bp, Mus musculus
aagctgtcgggcagcaatccctaca

SEQ ID NO: 507547 - DNA, 25 bp, Mus musculus
aagctgtcgggctgcaatccctaca

SEQ ID NO: 507548 - DNA, 25 bp, Mus musculus
aagctgtctccccagggtctacgac

SEQ ID NO: 507549 - DNA, 25 bp, Mus musculus
aagctgtctcccgagggtctacgac

SEQ ID NO: 507550 - DNA, 25 bp, Mus musculus
aagctgtgaccgacactggcaagat

SEQ ID NO: 507551 - DNA, 25 bp, Mus musculus
aagctgtgaccgtcactggcaagat

SEQ ID NO: 507552 - DNA, 25 bp, Mus musculus
aagctgtgagtgagatcgacgccct

SEQ ID NO: 507553 - DNA, 25 bp, Mus musculus
aagctgtgagtgtgatcgacgccct

SEQ ID NO: 507554 - DNA, 25 bp, Mus musculus
aagctgtgcgatctagaccagctca

SEQ ID NO: 507555 - DNA, 25 bp, Mus musculus
aagctgtgcgatgtagaccagctca

SEQ ID NO: 507556 - DNA, 25 bp, Mus musculus
aagctgtgctctctcgaagtcccag

SEQ ID NO: 507557 - DNA, 25 bp, Mus musculus
aagctgtgctctgtcgaagtcccag

SEQ ID NO: 507558 - DNA, 25 bp, Mus musculus
aagctgtgtgagatcaactgcaaca

SEQ ID NO: 507559 - DNA, 25 bp, Mus musculus
aagctgtgtgagttcaactgcaaca

SEQ ID NO: 507560 - DNA, 25 bp, Mus musculus
aagctgttctcccaggtggagaaca

SEQ ID NO: 507561 - DNA, 25 bp, Mus musculus
aagctgttctccgaggtggagaaca

SEQ ID NO: 507562 - DNA, 25 bp, Mus musculus
aagctgttggatcagtgcgagaacc

SEQ ID NO: 507563 - DNA, 25 bp, Mus musculus
aagctgttggatgagtgcgagaacc

SEQ ID NO: 507564 - DNA, 25 bp, Mus musculus
aagcttaccttaaaacagcatgaag

SEQ ID NO: 507565 - DNA, 25 bp, Mus musculus
aagcttaccttataacagcatgaag

SEQ ID NO: 507566 - DNA, 25 bp, Mus musculus
aagcttactcctccgctctaagcgt

SEQ ID NO: 507567 - DNA, 25 bp, Mus musculus
aagcttactcctgcgctctaagcgt

SEQ ID NO: 507568 - DNA, 25 bp, Mus musculus
aagcttactgctcatgccaagtttg

SEQ ID NO: 507569 - DNA, 25 bp, Mus musculus
aagcttactgctgatgccaagtttg

SEQ ID NO: 507570 - DNA, 25 bp, Mus musculus
aagcttagtcggcagaactttccag

SEQ ID NO: 507571 - DNA, 25 bp, Mus musculus
aagcttagtcgggagaactttccag

SEQ ID NO: 507572 - DNA, 25 bp, Mus musculus
aagcttatacctccatcatcgcaga

SEQ ID NO: 507573 - DNA, 25 bp, Mus musculus
aagcttatacctgcatcatcgcaga

SEQ ID NO: 507574 - DNA, 25 bp, Mus musculus
aagcttatggagatttaacctatgg

SEQ ID NO: 507575 - DNA, 25 bp, Mus musculus
aagcttatggagttttaacctatgg

SEQ ID NO: 507576 - DNA, 25 bp, Mus musculus
aagcttcagcttcgaaaagaaaaga

SEQ ID NO: 507577 - DNA, 25 bp, Mus musculus
aagcttcagcttggaaaagaaaaga

SEQ ID NO: 507578 - DNA, 25 bp, Mus musculus
aagcttcccgcgagggcaaagagaa

SEQ ID NO: 507579 - DNA, 25 bp, Mus musculus
aagcttcccgcgtgggcaaagagaa

SEQ ID NO: 507580 - DNA, 25 bp, Mus musculus
aagcttccggtgaagaatgaatacc

SEQ ID NO: 507581 - DNA, 25 bp, Mus musculus
aagcttccggtgtagaatgaatacc

SEQ ID NO: 507582 - DNA, 25 bp, Mus musculus
aagcttcgggagaccaatgcgggcc

SEQ ID NO: 507583 - DNA, 25 bp, Mus musculus
aagcttcgggagtccaatgcgggcc

SEQ ID NO: 507584 - DNA, 25 bp, Mus musculus
aagcttcgtacaaagaccctgcgca

SEQ ID NO: 507585 - DNA, 25 bp, Mus musculus
aagcttcgtacatagaccctgcgca

SEQ ID NO: 507586 - DNA, 25 bp, Mus musculus
aagcttcgtgtcagacaagagaccc

SEQ ID NO: 507587 - DNA, 25 bp, Mus musculus
aagcttcgtgtctgacaagagaccc

SEQ ID NO: 507588 - DNA, 25 bp, Mus musculus
aagcttctccagagttccccaaaga

SEQ ID NO: 507589 - DNA, 25 bp, Mus musculus
aagcttctccagtgttccccaaaga

SEQ ID NO: 507590 - DNA, 25 bp, Mus musculus
aagcttctcttacaagaagatgacc

SEQ ID NO: 507591 - DNA, 25 bp, Mus musculus
aagcttctcttagaagaagatgacc

SEQ ID NO: 507592 - DNA, 25 bp, Mus musculus
aagcttctgccccattgtccaattc

SEQ ID NO: 507593 - DNA, 25 bp, Mus musculus
aagcttctgcccgattgtccaattc

SEQ ID NO: 507594 - DNA, 25 bp, Mus musculus
aagcttcttgcgcttctctcgcgag

SEQ ID NO: 507595 - DNA, 25 bp, Mus musculus
aagcttcttgcggttctctcgcgag

SEQ ID NO: 507596 - DNA, 25 bp, Mus musculus
aagcttgcacttatcccaggtgaca

SEQ ID NO: 507597 - DNA, 25 bp, Mus musculus
aagcttgcacttttcccaggtgaca

SEQ ID NO: 507598 - DNA, 25 bp, Mus musculus
aagcttgctgttcgaaacatgtgac

SEQ ID NO: 507599 - DNA, 25 bp, Mus musculus
aagcttgctgttggaaacatgtgac

SEQ ID NO: 507600 - DNA, 25 bp, Mus musculus
aagcttggaagaccttccacctagg

SEQ ID NO: 507601 - DNA, 25 bp, Mus musculus
aagcttggaagagcttccacctagg

SEQ ID NO: 507602 - DNA, 25 bp, Mus musculus
aagcttggacagctggagtcaacac

SEQ ID NO: 507603 - DNA, 25 bp, Mus musculus
aagcttggacaggtggagtcaacac

SEQ ID NO: 507604 - DNA, 25 bp, Mus musculus
aagcttggctgaaagaggccctgcc

SEQ ID NO: 507605 - DNA, 25 bp, Mus musculus
aagcttggctgatagaggccctgcc

SEQ ID NO: 507606 - DNA, 25 bp, Mus musculus
aagcttgtcatcatctggagcccaa

SEQ ID NO: 507607 - DNA, 25 bp, Mus musculus
aagcttgtcatcttctggagcccaa

SEQ ID NO: 507608 - DNA, 25 bp, Mus musculus
aagcttgttacacatgaatgtcgaa

SEQ ID NO: 507609 - DNA, 25 bp, Mus musculus
aagcttgttacagatgaatgtcgaa

SEQ ID NO: 507610 - DNA, 25 bp, Mus musculus
aagctttatacacatccaagacaag

SEQ ID NO: 507611 - DNA, 25 bp, Mus musculus
aagctttatacagatccaagacaag

SEQ ID NO: 507612 - DNA, 25 bp, Mus musculus
aagctttgcagacgtatttccctgg

SEQ ID NO: 507613 - DNA, 25 bp, Mus musculus
aagctttgcagaggtatttccctgg

SEQ ID NO: 507614 - DNA, 25 bp, Mus musculus
aagctttgcagcatccacacgagct

SEQ ID NO: 507615 - DNA, 25 bp, Mus musculus
aagctttgcagcttccacacgagct

SEQ ID NO: 507616 - DNA, 25 bp, Mus musculus
aagctttgctctcttcgggccgccg

SEQ ID NO: 507617 - DNA, 25 bp, Mus musculus
aagctttgctctgttcgggccgccg

SEQ ID NO: 507618 - DNA, 25 bp, Mus musculus
aagctttgctggctctgtcagccca

SEQ ID NO: 507619 - DNA, 25 bp, Mus musculus
aagctttgctgggtctgtcagccca

SEQ ID NO: 507620 - DNA, 25 bp, Mus musculus
aagctttgtgcaagggtaaacccat

SEQ ID NO: 507621 - DNA, 25 bp, Mus musculus
aagctttgtgcatgggtaaacccat

SEQ ID NO: 507622 - DNA, 25 bp, Mus musculus
aagcttttagaaccggcacgagccg

SEQ ID NO: 507623 - DNA, 25 bp, Mus musculus
aagcttttagaagcggcacgagccg

SEQ ID NO: 507624 - DNA, 25 bp, Mus musculus
aagcttttgccccatggattttgaa

SEQ ID NO: 507625 - DNA, 25 bp, Mus musculus
aagcttttgcccgatggattttgaa

SEQ ID NO: 507626 - DNA, 25 bp, Mus musculus
aagcttttgctaatgatcttcttga

SEQ ID NO: 507627 - DNA, 25 bp, Mus musculus
aagcttttgctattgatcttcttga

SEQ ID NO: 507628 - DNA, 25 bp, Mus musculus
aagcttttggacagctgaaggccca

SEQ ID NO: 507629 - DNA, 25 bp, Mus musculus
aagcttttggactgctgaaggccca

SEQ ID NO: 507630 - DNA, 25 bp, Mus musculus
aaggaaacgccaaggccagatccgg

SEQ ID NO: 507631 - DNA, 25 bp, Mus musculus
aaggaaacgccatggccagatccgg

SEQ ID NO: 507632 - DNA, 25 bp, Mus musculus
aaggaaagacgcatcacctcgcctg

SEQ ID NO: 507633 - DNA, 25 bp, Mus musculus
aaggaaagacgcttcacctcgcctg

SEQ ID NO: 507634 - DNA, 25 bp, Mus musculus
aaggaaaggctgaatcacttataca

SEQ ID NO: 507635 - DNA, 25 bp, Mus musculus
aaggaaaggctgtatcacttataca

SEQ ID NO: 507636 - DNA, 25 bp, Mus musculus
aaggaaagggcaatgtccaccacct

SEQ ID NO: 507637 - DNA, 25 bp, Mus musculus
aaggaaagggcattgtccaccacct

SEQ ID NO: 507638 - DNA, 25 bp, Mus musculus
aaggaaagtgcaatctgtatcaacc

SEQ ID NO: 507639 - DNA, 25 bp, Mus musculus
aaggaaagtgcattctgtatcaacc

SEQ ID NO: 507640 - DNA, 25 bp, Mus musculus
aaggaaatcctcaaagaaccattcg

SEQ ID NO: 507641 - DNA, 25 bp, Mus musculus
aaggaaatcctctaagaaccattcg

SEQ ID NO: 507642 - DNA, 25 bp, Mus musculus
aaggaaatgaggaaaatccccacag

SEQ ID NO: 507643 - DNA, 25 bp, Mus musculus
aaggaaatgaggtaaatccccacag

SEQ ID NO: 507644 - DNA, 25 bp, Mus musculus
aaggaacagttcaggctccccagta

SEQ ID NO: 507645 - DNA, 25 bp, Mus musculus
aaggaacagttctggctccccagta

SEQ ID NO: 507646 - DNA, 25 bp, Mus musculus
aaggaaccaggcatgattgcagccc

SEQ ID NO: 507647 - DNA, 25 bp, Mus musculus
aaggaaccaggcttgattgcagccc

SEQ ID NO: 507648 - DNA, 25 bp, Mus musculus
aaggaacctggaactagctctctcg

SEQ ID NO: 507649 - DNA, 25 bp, Mus musculus
aaggaacctggatctagctctctcg

SEQ ID NO: 507650 - DNA, 25 bp, Mus musculus
aaggaacctgttacacacagcggtg

SEQ ID NO: 507651 - DNA, 25 bp, Mus musculus
aaggaacctgtttcacacagcggtg

SEQ ID NO: 507652 - DNA, 25 bp, Mus musculus
aaggaacgggcaccagccagagaca

SEQ ID NO: 507653 - DNA, 25 bp, Mus musculus
aaggaacgggcagcagccagagaca

SEQ ID NO: 507654 - DNA, 25 bp, Mus musculus
aaggaacttgaaactctgaccacca

SEQ ID NO: 507655 - DNA, 25 bp, Mus musculus
aaggaacttgaatctctgaccacca

SEQ ID NO: 507656 - DNA, 25 bp, Mus musculus
aaggaacttgctctgctagtcggtt

SEQ ID NO: 507657 - DNA, 25 bp, Mus musculus
aaggaacttgctgtgctagtcggtt

SEQ ID NO: 507658 - DNA, 25 bp, Mus musculus
aaggaactttgcattgatgatgaac

SEQ ID NO: 507659 - DNA, 25 bp, Mus musculus
aaggaactttgctttgatgatgaac

SEQ ID NO: 507660 - DNA, 25 bp, Mus musculus
aaggaagaagagaaccgccgcctgg

SEQ ID NO: 507661 - DNA, 25 bp, Mus musculus
aaggaagaagagtaccgccgcctgg

SEQ ID NO: 507662 - DNA, 25 bp, Mus musculus
aaggaagacacgctgacactgacat

SEQ ID NO: 507663 - DNA, 25 bp, Mus musculus
aaggaagacacggtgacactgacat

SEQ ID NO: 507664 - DNA, 25 bp, Mus musculus
aaggaagagctccacgtgtccgtga

SEQ ID NO: 507665 - DNA, 25 bp, Mus musculus
aaggaagagctcgacgtgtccgtga

SEQ ID NO: 507666 - DNA, 25 bp, Mus musculus
aaggaagatccccattaaatgtttg

SEQ ID NO: 507667 - DNA, 25 bp, Mus musculus
aaggaagatcccgattaaatgtttg

SEQ ID NO: 507668 - DNA, 25 bp, Mus musculus
aaggaagatttacacccagatccag

SEQ ID NO: 507669 - DNA, 25 bp, Mus musculus
aaggaagatttagacccagatccag

SEQ ID NO: 507670 - DNA, 25 bp, Mus musculus
aaggaagcaaagatacaaacagatc

SEQ ID NO: 507671 - DNA, 25 bp, Mus musculus
aaggaagcaaagttacaaacagatc

SEQ ID NO: 507672 - DNA, 25 bp, Mus musculus
aaggaagcaagacagcgatgaaatg

SEQ ID NO: 507673 - DNA, 25 bp, Mus musculus
aaggaagcaagagagcgatgaaatg

SEQ ID NO: 507674 - DNA, 25 bp, Mus musculus
aaggaagcaggactcgccgcccagt

SEQ ID NO: 507675 - DNA, 25 bp, Mus musculus
aaggaagcaggagtcgccgcccagt

SEQ ID NO: 507676 - DNA, 25 bp, Mus musculus
aaggaagcctatctacatctagctg

SEQ ID NO: 507677 - DNA, 25 bp, Mus musculus
aaggaagcctatgtacatctagctg

SEQ ID NO: 507678 - DNA, 25 bp, Mus musculus
aaggaagccttgatggacgtcatgc

SEQ ID NO: 507679 - DNA, 25 bp, Mus musculus
aaggaagccttgttggacgtcatgc

SEQ ID NO: 507680 - DNA, 25 bp, Mus musculus
aaggaagctaaacacctcagctatc

SEQ ID NO: 507681 - DNA, 25 bp, Mus musculus
aaggaagctaaagacctcagctatc

SEQ ID NO: 507682 - DNA, 25 bp, Mus musculus
aaggaaggaagcctatgtacatcta

SEQ ID NO: 507683 - DNA, 25 bp, Mus musculus
aaggaaggaagcgtatgtacatcta

SEQ ID NO: 507684 - DNA, 25 bp, Mus musculus
aaggaaggccgcaacgtgtgcatgc

SEQ ID NO: 507685 - DNA, 25 bp, Mus musculus
aaggaaggccgctacgtgtgcatgc

SEQ ID NO: 507686 - DNA, 25 bp, Mus musculus
aaggaaggtgccagtagccctgtga

SEQ ID NO: 507687 - DNA, 25 bp, Mus musculus
aaggaaggtgcctgtagccctgtga

SEQ ID NO: 507688 - DNA, 25 bp, Mus musculus
aaggaaggtgtcaaagtcggagatc

SEQ ID NO: 507689 - DNA, 25 bp, Mus musculus
aaggaaggtgtctaagtcggagatc

SEQ ID NO: 507690 - DNA, 25 bp, Mus musculus
aaggaagtctttcatggcagtggcc

SEQ ID NO: 507691 - DNA, 25 bp, Mus musculus
aaggaagtctttgatggcagtggcc

SEQ ID NO: 507692 - DNA, 25 bp, Mus musculus
aaggaagttggcaaagacgtgtcag

SEQ ID NO: 507693 - DNA, 25 bp, Mus musculus
aaggaagttggctaagacgtgtcag

SEQ ID NO: 507694 - DNA, 25 bp, Mus musculus
aaggaatactaccagcccatgcacg

SEQ ID NO: 507695 - DNA, 25 bp, Mus musculus
aaggaatactacgagcccatgcacg

SEQ ID NO: 507696 - DNA, 25 bp, Mus musculus
aaggaatctaagcaggtcactgtcc

SEQ ID NO: 507697 - DNA, 25 bp, Mus musculus
aaggaatctaaggaggtcactgtcc

SEQ ID NO: 507698 - DNA, 25 bp, Mus musculus
aaggaatctgatcaccctggttcat

SEQ ID NO: 507699 - DNA, 25 bp, Mus musculus
aaggaatctgatgaccctggttcat

SEQ ID NO: 507700 - DNA, 25 bp, Mus musculus
aaggaatgagccaggcggctaccat

SEQ ID NO: 507701 - DNA, 25 bp, Mus musculus
aaggaatgagcctggcggctaccat

SEQ ID NO: 507702 - DNA, 25 bp, Mus musculus
aaggaatgcatcatggcgtcactca

SEQ ID NO: 507703 - DNA, 25 bp, Mus musculus
aaggaatgcatcttggcgtcactca

SEQ ID NO: 507704 - DNA, 25 bp, Mus musculus
aaggaatgtccccaccagctcggac

SEQ ID NO: 507705 - DNA, 25 bp, Mus musculus
aaggaatgtcccgaccagctcggac

SEQ ID NO: 507706 - DNA, 25 bp, Mus musculus
aaggaatgtcctctcactggccaag

SEQ ID NO: 507707 - DNA, 25 bp, Mus musculus
aaggaatgtcctgtcactggccaag

SEQ ID NO: 507708 - DNA, 25 bp, Mus musculus
aaggaattcgccaactggctgaaag

SEQ ID NO: 507709 - DNA, 25 bp, Mus musculus
aaggaattcgcctactggctgaaag

SEQ ID NO: 507710 - DNA, 25 bp, Mus musculus
aaggaattggagcagtttaactcag

SEQ ID NO: 507711 - DNA, 25 bp, Mus musculus
aaggaattggaggagtttaactcag

SEQ ID NO: 507712 - DNA, 25 bp, Mus musculus
aaggaattggtcaatatgcgttgct

SEQ ID NO: 507713 - DNA, 25 bp, Mus musculus
aaggaattggtctatatgcgttgct

SEQ ID NO: 507714 - DNA, 25 bp, Mus musculus
aaggacaaagcacccacgaaagcca

SEQ ID NO: 507715 - DNA, 25 bp, Mus musculus
aaggacaaagcagccacgaaagcca

SEQ ID NO: 507716 - DNA, 25 bp, Mus musculus
aaggacaacaccagtgacatcatgc

SEQ ID NO: 507717 - DNA, 25 bp, Mus musculus
aaggacaacacctgtgacatcatgc

SEQ ID NO: 507718 - DNA, 25 bp, Mus musculus
aaggacaactccaattctctacaga

SEQ ID NO: 507719 - DNA, 25 bp, Mus musculus
aaggacaactcctattctctacaga

SEQ ID NO: 507720 - DNA, 25 bp, Mus musculus
aaggacaagaagatggatgcccatc

SEQ ID NO: 507721 - DNA, 25 bp, Mus musculus
aaggacaagaagttggatgcccatc

SEQ ID NO: 507722 - DNA, 25 bp, Mus musculus
aaggacaagcagactgcaggcctca

SEQ ID NO: 507723 - DNA, 25 bp, Mus musculus
aaggacaagcagtctgcaggcctca

SEQ ID NO: 507724 - DNA, 25 bp, Mus musculus
aaggacaagtgcctctcaccagagc

SEQ ID NO: 507725 - DNA, 25 bp, Mus musculus
aaggacaagtgcgtctcaccagagc

SEQ ID NO: 507726 - DNA, 25 bp, Mus musculus
aaggacacacggaaccccagacttg

SEQ ID NO: 507727 - DNA, 25 bp, Mus musculus
aaggacacacggtaccccagacttg

SEQ ID NO: 507728 - DNA, 25 bp, Mus musculus
aaggacacagcccatacccgggctg

SEQ ID NO: 507729 - DNA, 25 bp, Mus musculus
aaggacacagccgatacccgggctg

SEQ ID NO: 507730 - DNA, 25 bp, Mus musculus
aaggacaccaagatgtggaagccgc

SEQ ID NO: 507731 - DNA, 25 bp, Mus musculus
aaggacaccaagttgtggaagccgc

SEQ ID NO: 507732 - DNA, 25 bp, Mus musculus
aaggacacgtccacaggcgtccact

SEQ ID NO: 507733 - DNA, 25 bp, Mus musculus
aaggacacgtcctcaggcgtccact

SEQ ID NO: 507734 - DNA, 25 bp, Mus musculus
aaggacagagggatcaagaccagca

SEQ ID NO: 507735 - DNA, 25 bp, Mus musculus
aaggacagagggttcaagaccagca

SEQ ID NO: 507736 - DNA, 25 bp, Mus musculus
aaggacagaggtcctgacatactgt

SEQ ID NO: 507737 - DNA, 25 bp, Mus musculus
aaggacagaggtgctgacatactgt

SEQ ID NO: 507738 - DNA, 25 bp, Mus musculus
aaggacagatagagaagcagccgcc

SEQ ID NO: 507739 - DNA, 25 bp, Mus musculus
aaggacagatagtgaagcagccgcc

SEQ ID NO: 507740 - DNA, 25 bp, Mus musculus
aaggacagcctcactgagcaaccaa

SEQ ID NO: 507741 - DNA, 25 bp, Mus musculus
aaggacagcctctctgagcaaccaa

SEQ ID NO: 507742 - DNA, 25 bp, Mus musculus
aaggacagcgtgctctactccagct

SEQ ID NO: 507743 - DNA, 25 bp, Mus musculus
aaggacagcgtggtctactccagct

SEQ ID NO: 507744 - DNA, 25 bp, Mus musculus
aaggacagggtcagaatgtaggcca

SEQ ID NO: 507745 - DNA, 25 bp, Mus musculus
aaggacagggtctgaatgtaggcca

SEQ ID NO: 507746 - DNA, 25 bp, Mus musculus
aaggacaggtggatcaatgcaggcc

SEQ ID NO: 507747 - DNA, 25 bp, Mus musculus
aaggacaggtggttcaatgcaggcc

SEQ ID NO: 507748 - DNA, 25 bp, Mus musculus
aaggacatcctgaagcctactgtgc

SEQ ID NO: 507749 - DNA, 25 bp, Mus musculus
aaggacatcctgtagcctactgtgc

SEQ ID NO: 507750 - DNA, 25 bp, Mus musculus
aaggacatctccagtcccaagacaa

SEQ ID NO: 507751 - DNA, 25 bp, Mus musculus
aaggacatctcctgtcccaagacaa

SEQ ID NO: 507752 - DNA, 25 bp, Mus musculus
aaggacatgccaaccaggctgggaa

SEQ ID NO: 507753 - DNA, 25 bp, Mus musculus
aaggacatgccatccaggctgggaa

SEQ ID NO: 507754 - DNA, 25 bp, Mus musculus
aaggacatgcggagctgcctcacag

SEQ ID NO: 507755 - DNA, 25 bp, Mus musculus
aaggacatgcggtgctgcctcacag

SEQ ID NO: 507756 - DNA, 25 bp, Mus musculus
aaggacatggttagtctatcacacc

SEQ ID NO: 507757 - DNA, 25 bp, Mus musculus
aaggacatggtttgtctatcacacc

SEQ ID NO: 507758 - DNA, 25 bp, Mus musculus
aaggacatgttcagccattcggcaa

SEQ ID NO: 507759 - DNA, 25 bp, Mus musculus
aaggacatgttctgccattcggcaa

SEQ ID NO: 507760 - DNA, 25 bp, Mus musculus
aaggaccaccccacaaatgacctgg

SEQ ID NO: 507761 - DNA, 25 bp, Mus musculus
aaggaccacccctcaaatgacctgg

SEQ ID NO: 507762 - DNA, 25 bp, Mus musculus
aaggaccacgagagcaagctctgtg

SEQ ID NO: 507763 - DNA, 25 bp, Mus musculus
aaggaccacgagtgcaagctctgtg

SEQ ID NO: 507764 - DNA, 25 bp, Mus musculus
aaggaccagtctcactgcatggagc

SEQ ID NO: 507765 - DNA, 25 bp, Mus musculus
aaggaccagtctgactgcatggagc

SEQ ID NO: 507766 - DNA, 25 bp, Mus musculus
aaggaccatccccatgtttgtgcca

SEQ ID NO: 507767 - DNA, 25 bp, Mus musculus
aaggaccatcccgatgtttgtgcca

SEQ ID NO: 507768 - DNA, 25 bp, Mus musculus
aaggaccattgcagtcgacttttca

SEQ ID NO: 507769 - DNA, 25 bp, Mus musculus
aaggaccattgctgtcgacttttca

SEQ ID NO: 507770 - DNA, 25 bp, Mus musculus
aaggacccaaacaggagacattcac

SEQ ID NO: 507771 - DNA, 25 bp, Mus musculus
aaggacccaaactggagacattcac

SEQ ID NO: 507772 - DNA, 25 bp, Mus musculus
aaggacccacacactcagacaagaa

SEQ ID NO: 507773 - DNA, 25 bp, Mus musculus
aaggacccacactctcagacaagaa

SEQ ID NO: 507774 - DNA, 25 bp, Mus musculus
aaggaccccaaacagatcctggctg

SEQ ID NO: 507775 - DNA, 25 bp, Mus musculus
aaggaccccaaagagatcctggctg

SEQ ID NO: 507776 - DNA, 25 bp, Mus musculus
aaggacccgaagctggagattcgtt

SEQ ID NO: 507777 - DNA, 25 bp, Mus musculus
aaggacccgaaggtggagattcgtt

SEQ ID NO: 507778 - DNA, 25 bp, Mus musculus
aaggacccgcccacactattggatc

SEQ ID NO: 507779 - DNA, 25 bp, Mus musculus
aaggacccgccctcactattggatc

SEQ ID NO: 507780 - DNA, 25 bp, Mus musculus
aaggacccgcttatctcacatggca

SEQ ID NO: 507781 - DNA, 25 bp, Mus musculus
aaggacccgcttttctcacatggca

SEQ ID NO: 507782 - DNA, 25 bp, Mus musculus
aaggaccctgtaatatgcctaagcc

SEQ ID NO: 507783 - DNA, 25 bp, Mus musculus
aaggaccctgtattatgcctaagcc

SEQ ID NO: 507784 - DNA, 25 bp, Mus musculus
aaggaccgagccaggctgccaaagc

SEQ ID NO: 507785 - DNA, 25 bp, Mus musculus
aaggaccgagcctggctgccaaagc

SEQ ID NO: 507786 - DNA, 25 bp, Mus musculus
aaggaccgaggcagcacgctgagcc

SEQ ID NO: 507787 - DNA, 25 bp, Mus musculus
aaggaccgaggctgcacgctgagcc

SEQ ID NO: 507788 - DNA, 25 bp, Mus musculus
aaggaccgtctgaaggcctacgtgc

SEQ ID NO: 507789 - DNA, 25 bp, Mus musculus
aaggaccgtctgtaggcctacgtgc

SEQ ID NO: 507790 - DNA, 25 bp, Mus musculus
aaggacctccccagatgtggcactt

SEQ ID NO: 507791 - DNA, 25 bp, Mus musculus
aaggacctcccctgatgtggcactt

SEQ ID NO: 507792 - DNA, 25 bp, Mus musculus
aaggacctctcgaagtgttggatac

SEQ ID NO: 507793 - DNA, 25 bp, Mus musculus
aaggacctctcgtagtgttggatac

SEQ ID NO: 507794 - DNA, 25 bp, Mus musculus
aaggacctcttccactgggtggcag

SEQ ID NO: 507795 - DNA, 25 bp, Mus musculus
aaggacctcttcgactgggtggcag

SEQ ID NO: 507796 - DNA, 25 bp, Mus musculus
aaggacctgactcagctctttgggt

SEQ ID NO: 507797 - DNA, 25 bp, Mus musculus
aaggacctgactgagctctttgggt

SEQ ID NO: 507798 - DNA, 25 bp, Mus musculus
aaggacctgagaccccagcctgata

SEQ ID NO: 507799 - DNA, 25 bp, Mus musculus
aaggacctgagagcccagcctgata

SEQ ID NO: 507800 - DNA, 25 bp, Mus musculus
aaggacctgataccccgagtagtga

SEQ ID NO: 507801 - DNA, 25 bp, Mus musculus
aaggacctgatagcccgagtagtga

SEQ ID NO: 507802 - DNA, 25 bp, Mus musculus
aaggacctgtccctggaatatgact

SEQ ID NO: 507803 - DNA, 25 bp, Mus musculus
aaggacctgtccgtggaatatgact

SEQ ID NO: 507804 - DNA, 25 bp, Mus musculus
aaggacctgtcgcacctggtatctg

SEQ ID NO: 507805 - DNA, 25 bp, Mus musculus
aaggacctgtcgcatctgatctcgg

SEQ ID NO: 507806 - DNA, 25 bp, Mus musculus
aaggacctgtcggacctggtatctg

SEQ ID NO: 507807 - DNA, 25 bp, Mus musculus
aaggacctgtcggatctgatctcgg

SEQ ID NO: 507808 - DNA, 25 bp, Mus musculus
aaggacctgtctcatctggtatcag

SEQ ID NO: 507809 - DNA, 25 bp, Mus musculus
aaggacctgtctgatctggtatcag

SEQ ID NO: 507810 - DNA, 25 bp, Mus musculus
aaggaccttgtgcaagaccagaact

SEQ ID NO: 507811 - DNA, 25 bp, Mus musculus
aaggaccttgtggaagaccagaact

SEQ ID NO: 507812 - DNA, 25 bp, Mus musculus
aaggacgaggctaggaataagcacg

SEQ ID NO: 507813 - DNA, 25 bp, Mus musculus
aaggacgaggcttggaataagcacg

SEQ ID NO: 507814 - DNA, 25 bp, Mus musculus
aaggacgctgtgctctactctggct

SEQ ID NO: 507815 - DNA, 25 bp, Mus musculus
aaggacgctgtggtctactctggct

SEQ ID NO: 507816 - DNA, 25 bp, Mus musculus
aaggacggagagctgcttacatcag

SEQ ID NO: 507817 - DNA, 25 bp, Mus musculus
aaggacggagaggtgcttacatcag

SEQ ID NO: 507818 - DNA, 25 bp, Mus musculus
aaggacggaggcctcgccatcatcg

SEQ ID NO: 507819 - DNA, 25 bp, Mus musculus
aaggacggaggcgtcgccatcatcg

SEQ ID NO: 507820 - DNA, 25 bp, Mus musculus
aaggacggtggacttcaagcctgct

SEQ ID NO: 507821 - DNA, 25 bp, Mus musculus
aaggacggtggagttcaagcctgct

SEQ ID NO: 507822 - DNA, 25 bp, Mus musculus
aaggactaaagcacgccaacatcgt

SEQ ID NO: 507823 - DNA, 25 bp, Mus musculus
aaggactaaagctcgccaacatcgt

SEQ ID NO: 507824 - DNA, 25 bp, Mus musculus
aaggactcagatctcaatgtcatgc

SEQ ID NO: 507825 - DNA, 25 bp, Mus musculus
aaggactcagatgtcaatgtcatgc

SEQ ID NO: 507826 - DNA, 25 bp, Mus musculus
aaggactccatgaatatcaaggccc

SEQ ID NO: 507827 - DNA, 25 bp, Mus musculus
aaggactccatgtatatcaaggccc

SEQ ID NO: 507828 - DNA, 25 bp, Mus musculus
aaggactcctcccaggacgagcaga

SEQ ID NO: 507829 - DNA, 25 bp, Mus musculus
aaggactcctccgaggacgagcaga

SEQ ID NO: 507830 - DNA, 25 bp, Mus musculus
aaggactcggagagcgtgaacacca

SEQ ID NO: 507831 - DNA, 25 bp, Mus musculus
aaggactcggagtgcgtgaacacca

SEQ ID NO: 507832 - DNA, 25 bp, Mus musculus
aaggactcgtggagcactgcaaact

SEQ ID NO: 507833 - DNA, 25 bp, Mus musculus
aaggactcgtggtgcactgcaaact

SEQ ID NO: 507834 - DNA, 25 bp, Mus musculus
aaggactctacgcttttcgagctca

SEQ ID NO: 507835 - DNA, 25 bp, Mus musculus
aaggactctacggttttcgagctca

SEQ ID NO: 507836 - DNA, 25 bp, Mus musculus
aaggactctcacagcagatccccat

SEQ ID NO: 507837 - DNA, 25 bp, Mus musculus
aaggactctcactgcagatccccat

SEQ ID NO: 507838 - DNA, 25 bp, Mus musculus
aaggactgaatcatggcagagtggc

SEQ ID NO: 507839 - DNA, 25 bp, Mus musculus
aaggactgaatcttggcagagtggc

SEQ ID NO: 507840 - DNA, 25 bp, Mus musculus
aaggactgaggcaggaagccgaacc

SEQ ID NO: 507841 - DNA, 25 bp, Mus musculus
aaggactgaggctggaagccgaacc

SEQ ID NO: 507842 - DNA, 25 bp, Mus musculus
aaggactggagcacacggcgctgtt

SEQ ID NO: 507843 - DNA, 25 bp, Mus musculus
aaggactggagctcacggcgctgtt

SEQ ID NO: 507844 - DNA, 25 bp, Mus musculus
aaggactggtccatgagaaggcccg

SEQ ID NO: 507845 - DNA, 25 bp, Mus musculus
aaggactggtccttgagaaggcccg

SEQ ID NO: 507846 - DNA, 25 bp, Mus musculus
aaggactggtggatcccaagctggt

SEQ ID NO: 507847 - DNA, 25 bp, Mus musculus
aaggactggtggttcccaagctggt

SEQ ID NO: 507848 - DNA, 25 bp, Mus musculus
aaggactgtacccaggctataaaag

SEQ ID NO: 507849 - DNA, 25 bp, Mus musculus
aaggactgtaccgaggctataaaag

SEQ ID NO: 507850 - DNA, 25 bp, Mus musculus
aaggactgttggaaggccatgcccc

SEQ ID NO: 507851 - DNA, 25 bp, Mus musculus
aaggactgttggtaggccatgcccc

SEQ ID NO: 507852 - DNA, 25 bp, Mus musculus
aaggacttaagtaagatgaagagcc

SEQ ID NO: 507853 - DNA, 25 bp, Mus musculus
aaggacttaagttagatgaagagcc

SEQ ID NO: 507854 - DNA, 25 bp, Mus musculus
aaggacttcacccaggaaaagtctg

SEQ ID NO: 507855 - DNA, 25 bp, Mus musculus
aaggacttcaccgaggaaaagtctg

SEQ ID NO: 507856 - DNA, 25 bp, Mus musculus
aaggactttgagcttcggcacggca

SEQ ID NO: 507857 - DNA, 25 bp, Mus musculus
aaggactttgaggttcggcacggca

SEQ ID NO: 507858 - DNA, 25 bp, Mus musculus
aaggagaaaaccagtgatcgactcc

SEQ ID NO: 507859 - DNA, 25 bp, Mus musculus
aaggagaaaacctgtgatcgactcc

SEQ ID NO: 507860 - DNA, 25 bp, Mus musculus
aaggagaaaaggagacgccgtctgg

SEQ ID NO: 507861 - DNA, 25 bp, Mus musculus
aaggagaaaaggtgacgccgtctgg

SEQ ID NO: 507862 - DNA, 25 bp, Mus musculus
aaggagaaacggaagcgtgcccgca

SEQ ID NO: 507863 - DNA, 25 bp, Mus musculus
aaggagaaacggtagcgtgcccgca

SEQ ID NO: 507864 - DNA, 25 bp, Mus musculus
aaggagaacaaacttgccatcattg

SEQ ID NO: 507865 - DNA, 25 bp, Mus musculus
aaggagaacaaagttgccatcattg

SEQ ID NO: 507866 - DNA, 25 bp, Mus musculus
aaggagaaccaccaagacctgcaag

SEQ ID NO: 507867 - DNA, 25 bp, Mus musculus
aaggagaaccacgaagacctgcaag

SEQ ID NO: 507868 - DNA, 25 bp, Mus musculus
aaggagaacgtgctcctccaggaag

SEQ ID NO: 507869 - DNA, 25 bp, Mus musculus
aaggagaacgtggtcctccaggaag

SEQ ID NO: 507870 - DNA, 25 bp, Mus musculus
aaggagaagaccctgatcctggtga

SEQ ID NO: 507871 - DNA, 25 bp, Mus musculus
aaggagaagaccgtgatcctggtga

SEQ ID NO: 507872 - DNA, 25 bp, Mus musculus
aaggagaaggaacctaaacacctca

SEQ ID NO: 507873 - DNA, 25 bp, Mus musculus
aaggagaaggaagctaaacacctca

SEQ ID NO: 507874 - DNA, 25 bp, Mus musculus
aaggagaattgtcacctggagcaga

SEQ ID NO: 507875 - DNA, 25 bp, Mus musculus
aaggagaattgtgacctggagcaga

SEQ ID NO: 507876 - DNA, 25 bp, Mus musculus
aaggagacaatgactacttcacttg

SEQ ID NO: 507877 - DNA, 25 bp, Mus musculus
aaggagacaatgtctacttcacttg

SEQ ID NO: 507878 - DNA, 25 bp, Mus musculus
aaggagacagccactctaaattgtc

SEQ ID NO: 507879 - DNA, 25 bp, Mus musculus
aaggagacagcctctctaaattgtc

SEQ ID NO: 507880 - DNA, 25 bp, Mus musculus
aaggagacatccagagaatccggga

SEQ ID NO: 507881 - DNA, 25 bp, Mus musculus
aaggagacatcctgagaatccggga

SEQ ID NO: 507882 - DNA, 25 bp, Mus musculus
aaggagacccctccctgtgactgag

SEQ ID NO: 507883 - DNA, 25 bp, Mus musculus
aaggagacccctgcctgtgactgag

SEQ ID NO: 507884 - DNA, 25 bp, Mus musculus
aaggagacctatatccgtgaactct

SEQ ID NO: 507885 - DNA, 25 bp, Mus musculus
aaggagacctatttccgtgaactct

SEQ ID NO: 507886 - DNA, 25 bp, Mus musculus
aaggagacgcgcctttgccctggtc

SEQ ID NO: 507887 - DNA, 25 bp, Mus musculus
aaggagacgcgcgtttgccctggtc

SEQ ID NO: 507888 - DNA, 25 bp, Mus musculus
aaggagacgctgaccctgtgtttga

SEQ ID NO: 507889 - DNA, 25 bp, Mus musculus
aaggagacgctgtccctgtgtttga

SEQ ID NO: 507890 - DNA, 25 bp, Mus musculus
aaggagagacgcattcagaggacca

SEQ ID NO: 507891 - DNA, 25 bp, Mus musculus
aaggagagacgctttcagaggacca

SEQ ID NO: 507892 - DNA, 25 bp, Mus musculus
aaggagagcctacggctgcatcctc

SEQ ID NO: 507893 - DNA, 25 bp, Mus musculus
aaggagagcctagggctgcatcctc

SEQ ID NO: 507894 - DNA, 25 bp, Mus musculus
aaggagagcctgctcgacctggttc

SEQ ID NO: 507895 - DNA, 25 bp, Mus musculus
aaggagagcctggtcgacctggttc

SEQ ID NO: 507896 - DNA, 25 bp, Mus musculus
aaggagatagttctgactcttccga

SEQ ID NO: 507897 - DNA, 25 bp, Mus musculus
aaggagatagttgtgactcttccga

SEQ ID NO: 507898 - DNA, 25 bp, Mus musculus
aaggagatcatgaagatcacaggga

SEQ ID NO: 507899 - DNA, 25 bp, Mus musculus
aaggagatcatgtagatcacaggga

SEQ ID NO: 507900 - DNA, 25 bp, Mus musculus
aaggagatgctacatgtgaagttca

SEQ ID NO: 507901 - DNA, 25 bp, Mus musculus
aaggagatgctagatgtgaagttca

SEQ ID NO: 507902 - DNA, 25 bp, Mus musculus
aaggagatgtctcctcaccagtacc

SEQ ID NO: 507903 - DNA, 25 bp, Mus musculus
aaggagatgtctgctcaccagtacc

SEQ ID NO: 507904 - DNA, 25 bp, Mus musculus
aaggagattcctctgctcaatgagc

SEQ ID NO: 507905 - DNA, 25 bp, Mus musculus
aaggagattcctgtgctcaatgagc

SEQ ID NO: 507906 - DNA, 25 bp, Mus musculus
aaggagattgagatagacatcgaac

SEQ ID NO: 507907 - DNA, 25 bp, Mus musculus
aaggagattgagttagacatcgaac

SEQ ID NO: 507908 - DNA, 25 bp, Mus musculus
aaggagattggaaactgcacacaga

SEQ ID NO: 507909 - DNA, 25 bp, Mus musculus
aaggagattggatactgcacacaga

SEQ ID NO: 507910 - DNA, 25 bp, Mus musculus
aaggagcaagacaacaaagatgtta

SEQ ID NO: 507911 - DNA, 25 bp, Mus musculus
aaggagcaagactacaaagatgtta

SEQ ID NO: 507912 - DNA, 25 bp, Mus musculus
aaggagcacaaccagcgggaccgca

SEQ ID NO: 507913 - DNA, 25 bp, Mus musculus
aaggagcacaacgagcgggaccgca

SEQ ID NO: 507914 - DNA, 25 bp, Mus musculus
aaggagcacagtccctgctgacgga

SEQ ID NO: 507915 - DNA, 25 bp, Mus musculus
aaggagcacagtgcctgctgacgga

SEQ ID NO: 507916 - DNA, 25 bp, Mus musculus
aaggagcactatcacctctgcgacg

SEQ ID NO: 507917 - DNA, 25 bp, Mus musculus
aaggagcactatgacctctgcgacg

SEQ ID NO: 507918 - DNA, 25 bp, Mus musculus
aaggagcactggaatgccaccaagg

SEQ ID NO: 507919 - DNA, 25 bp, Mus musculus
aaggagcactggtatgccaccaagg

SEQ ID NO: 507920 - DNA, 25 bp, Mus musculus
aaggagcagaaactttctacattgc

SEQ ID NO: 507921 - DNA, 25 bp, Mus musculus
aaggagcagaaagtttctacattgc

SEQ ID NO: 507922 - DNA, 25 bp, Mus musculus
aaggagcagtttctgccaggtccaa

SEQ ID NO: 507923 - DNA, 25 bp, Mus musculus
aaggagcagtttgtgccaggtccaa

SEQ ID NO: 507924 - DNA, 25 bp, Mus musculus
aaggagccacgccacttcatggcca

SEQ ID NO: 507925 - DNA, 25 bp, Mus musculus
aaggagccacgcgacttcatggcca

SEQ ID NO: 507926 - DNA, 25 bp, Mus musculus
aaggagccgcatcaatccctcggga

SEQ ID NO: 507927 - DNA, 25 bp, Mus musculus
aaggagccgcatgaatccctcggga

SEQ ID NO: 507928 - DNA, 25 bp, Mus musculus
aaggagcgagctcaagccaccgagc

SEQ ID NO: 507929 - DNA, 25 bp, Mus musculus
aaggagcgagctgaagccaccgagc

SEQ ID NO: 507930 - DNA, 25 bp, Mus musculus
aaggagcgcctcatctcttcaccat

SEQ ID NO: 507931 - DNA, 25 bp, Mus musculus
aaggagcgcctcttctcttcaccat

SEQ ID NO: 507932 - DNA, 25 bp, Mus musculus
aaggagctaatgctgcgtatttgca

SEQ ID NO: 507933 - DNA, 25 bp, Mus musculus
aaggagctaatggtgcgtatttgca

SEQ ID NO: 507934 - DNA, 25 bp, Mus musculus
aaggagctcctgaagcacaaattca

SEQ ID NO: 507935 - DNA, 25 bp, Mus musculus
aaggagctcctgctacacatccgaa

SEQ ID NO: 507936 - DNA, 25 bp, Mus musculus
aaggagctcctggtacacatccgaa

SEQ ID NO: 507937 - DNA, 25 bp, Mus musculus
aaggagctcctgtagcacaaattca

SEQ ID NO: 507938 - DNA, 25 bp, Mus musculus
aaggagctggaaacacacagctcat

SEQ ID NO: 507939 - DNA, 25 bp, Mus musculus
aaggagctggaatcacacagctcat

SEQ ID NO: 507940 - DNA, 25 bp, Mus musculus
aaggagctgtatcaccatgccgaag

SEQ ID NO: 507941 - DNA, 25 bp, Mus musculus
aaggagctgtatgaccatgccgaag

SEQ ID NO: 507942 - DNA, 25 bp, Mus musculus
aaggagcttaccatccaggaggaat

SEQ ID NO: 507943 - DNA, 25 bp, Mus musculus
aaggagcttaccttccaggaggaat

SEQ ID NO: 507944 - DNA, 25 bp, Mus musculus
aaggagcttgtgcacccatctggac

SEQ ID NO: 507945 - DNA, 25 bp, Mus musculus
aaggagcttgtggacccatctggac

SEQ ID NO: 507946 - DNA, 25 bp, Mus musculus
aaggaggaaccaaaacatgctgagc

SEQ ID NO: 507947 - DNA, 25 bp, Mus musculus
aaggaggaaccataacatgctgagc

SEQ ID NO: 507948 - DNA, 25 bp, Mus musculus
aaggaggaaccgagaaagctgcttc

SEQ ID NO: 507949 - DNA, 25 bp, Mus musculus
aaggaggaaccgtgaaagctgcttc

SEQ ID NO: 507950 - DNA, 25 bp, Mus musculus
aaggaggaactcctgactcagcagc

SEQ ID NO: 507951 - DNA, 25 bp, Mus musculus
aaggaggaactcgtgactcagcagc

SEQ ID NO: 507952 - DNA, 25 bp, Mus musculus
aaggaggaccccacagtgactccta

SEQ ID NO: 507953 - DNA, 25 bp, Mus musculus
aaggaggacccctcagtgactccta

SEQ ID NO: 507954 - DNA, 25 bp, Mus musculus
aaggaggacgtgaagaaaaagctga

SEQ ID NO: 507955 - DNA, 25 bp, Mus musculus
aaggaggacgtgtagaaaaagctga

SEQ ID NO: 507956 - DNA, 25 bp, Mus musculus
aaggaggactggaaatacgtggcca

SEQ ID NO: 507957 - DNA, 25 bp, Mus musculus
aaggaggactggtaatacgtggcca

SEQ ID NO: 507958 - DNA, 25 bp, Mus musculus
aaggaggagaataccttatagtctg

SEQ ID NO: 507959 - DNA, 25 bp, Mus musculus
aaggaggagaattccttatagtctg

SEQ ID NO: 507960 - DNA, 25 bp, Mus musculus
aaggaggagcttcacttccagaaga

SEQ ID NO: 507961 - DNA, 25 bp, Mus musculus
aaggaggagcttgacttccagaaga

SEQ ID NO: 507962 - DNA, 25 bp, Mus musculus
aaggaggcagcgatcctaaccatcg

SEQ ID NO: 507963 - DNA, 25 bp, Mus musculus
aaggaggcagcgttcctaaccatcg

SEQ ID NO: 507964 - DNA, 25 bp, Mus musculus
aaggaggccatgcatatcttaagga

SEQ ID NO: 507965 - DNA, 25 bp, Mus musculus
aaggaggccatggatatcttaagga

SEQ ID NO: 507966 - DNA, 25 bp, Mus musculus
aaggaggcccatcctcacaagcctg

SEQ ID NO: 507967 - DNA, 25 bp, Mus musculus
aaggaggcccatgctcacaagcctg

SEQ ID NO: 507968 - DNA, 25 bp, Mus musculus
aaggaggcgtccctcctcaggcctg

SEQ ID NO: 507969 - DNA, 25 bp, Mus musculus
aaggaggcgtccgtcctcaggcctg

SEQ ID NO: 507970 - DNA, 25 bp, Mus musculus
aaggaggctaggctgcacccttccc

SEQ ID NO: 507971 - DNA, 25 bp, Mus musculus
aaggaggctagggtgcacccttccc

SEQ ID NO: 507972 - DNA, 25 bp, Mus musculus
aaggaggcttcaccgaggaatccca

SEQ ID NO: 507973 - DNA, 25 bp, Mus musculus
aaggaggcttcagcgaggaatccca

SEQ ID NO: 507974 - DNA, 25 bp, Mus musculus
aaggagggaaagatacacgtggact

SEQ ID NO: 507975 - DNA, 25 bp, Mus musculus
aaggagggaaagttacacgtggact

SEQ ID NO: 507976 - DNA, 25 bp, Mus musculus
aaggagggaacaagctgtggctatc

SEQ ID NO: 507977 - DNA, 25 bp, Mus musculus
aaggagggaacatgctgtggctatc

SEQ ID NO: 507978 - DNA, 25 bp, Mus musculus
aaggagggacatctatcaacacccc

SEQ ID NO: 507979 - DNA, 25 bp, Mus musculus
aaggagggacatgtatcaacacccc

SEQ ID NO: 507980 - DNA, 25 bp, Mus musculus
aaggagggcatcagcctcagtgcat

SEQ ID NO: 507981 - DNA, 25 bp, Mus musculus
aaggagggcatctgcctcagtgcat

SEQ ID NO: 507982 - DNA, 25 bp, Mus musculus
aaggagggtatgaggtttgcaacac

SEQ ID NO: 507983 - DNA, 25 bp, Mus musculus
aaggagggtatgtggtttgcaacac

SEQ ID NO: 507984 - DNA, 25 bp, Mus musculus
aaggaggtgcccatccaccgagttg

SEQ ID NO: 507985 - DNA, 25 bp, Mus musculus
aaggaggtgcccttccaccgagttg

SEQ ID NO: 507986 - DNA, 25 bp, Mus musculus
aaggaggtggcaaataaaagctgta

SEQ ID NO: 507987 - DNA, 25 bp, Mus musculus
aaggaggtggcatataaaagctgta

SEQ ID NO: 507988 - DNA, 25 bp, Mus musculus
aaggaggtgtatatcatgggcctca

SEQ ID NO: 507989 - DNA, 25 bp, Mus musculus
aaggaggtgtatttcatgggcctca

SEQ ID NO: 507990 - DNA, 25 bp, Mus musculus
aaggaggtgtcccacatcacagcag

SEQ ID NO: 507991 - DNA, 25 bp, Mus musculus
aaggaggtgtccgacatcacagcag

SEQ ID NO: 507992 - DNA, 25 bp, Mus musculus
aaggaggttacacgctgcgagaaaa

SEQ ID NO: 507993 - DNA, 25 bp, Mus musculus
aaggaggttacaggctgcgagaaaa

SEQ ID NO: 507994 - DNA, 25 bp, Mus musculus
aaggagtaacgaagcgtttggcaga

SEQ ID NO: 507995 - DNA, 25 bp, Mus musculus
aaggagtaacgatgcgtttggcaga

SEQ ID NO: 507996 - DNA, 25 bp, Mus musculus
aaggagtacaacatggggctgttca

SEQ ID NO: 507997 - DNA, 25 bp, Mus musculus
aaggagtacaacttggggctgttca

SEQ ID NO: 507998 - DNA, 25 bp, Mus musculus
aaggagtcccgacagatgcgcctac

SEQ ID NO: 507999 - DNA, 25 bp, Mus musculus
aaggagtcccgagagatgcgcctac

SEQ ID NO: 508000 - DNA, 25 bp, Mus musculus
aaggagtgccacctactcagagagc

SEQ ID NO: 508001 - DNA, 25 bp, Mus musculus
aaggagtgccacgtactcagagagc

SEQ ID NO: 508002 - DNA, 25 bp, Mus musculus
aaggagtggataacatattctcaca

SEQ ID NO: 508003 - DNA, 25 bp, Mus musculus
aaggagtggatatcatattctcaca

SEQ ID NO: 508004 - DNA, 25 bp, Mus musculus
aaggagtggtggaggcccattacca

SEQ ID NO: 508005 - DNA, 25 bp, Mus musculus
aaggagtggtggtggcccattacca

SEQ ID NO: 508006 - DNA, 25 bp, Mus musculus
aaggagttacgcctacgaatgttag

SEQ ID NO: 508007 - DNA, 25 bp, Mus musculus
aaggagttacgcgtacgaatgttag

SEQ ID NO: 508008 - DNA, 25 bp, Mus musculus
aaggagttgaatacttctggtgtag

SEQ ID NO: 508009 - DNA, 25 bp, Mus musculus
aaggagttgaattcttctggtgtag

SEQ ID NO: 508010 - DNA, 25 bp, Mus musculus
aaggagttgttgaccaatgtggacc

SEQ ID NO: 508011 - DNA, 25 bp, Mus musculus
aaggagttgttgtccaatgtggacc

SEQ ID NO: 508012 - DNA, 25 bp, Mus musculus
aaggataaagttcaagaatgtgccc

SEQ ID NO: 508013 - DNA, 25 bp, Mus musculus
aaggataaagttgaagaatgtgccc

SEQ ID NO: 508014 - DNA, 25 bp, Mus musculus
aaggataactcacaagagtcttgtc

SEQ ID NO: 508015 - DNA, 25 bp, Mus musculus
aaggataactcagaagagtcttgtc

SEQ ID NO: 508016 - DNA, 25 bp, Mus musculus
aaggataccgatctgggctatctag

SEQ ID NO: 508017 - DNA, 25 bp, Mus musculus
aaggataccgatgtgggctatctag

SEQ ID NO: 508018 - DNA, 25 bp, Mus musculus
aaggatatgcttatcaaccagctga

SEQ ID NO: 508019 - DNA, 25 bp, Mus musculus
aaggatatgcttttcaaccagctga

SEQ ID NO: 508020 - DNA, 25 bp, Mus musculus
aaggatatggaaattataatagtgc

SEQ ID NO: 508021 - DNA, 25 bp, Mus musculus
aaggatatggaatttataatagtgc

SEQ ID NO: 508022 - DNA, 25 bp, Mus musculus
aaggatatggctcccttcaacgagc

SEQ ID NO: 508023 - DNA, 25 bp, Mus musculus
aaggatatggctgccttcaacgagc

SEQ ID NO: 508024 - DNA, 25 bp, Mus musculus
aaggatcacagcaccgatcccgcgt

SEQ ID NO: 508025 - DNA, 25 bp, Mus musculus
aaggatcacagctccgatcccgcgt

SEQ ID NO: 508026 - DNA, 25 bp, Mus musculus
aaggatcagatgacagcttcatctg

SEQ ID NO: 508027 - DNA, 25 bp, Mus musculus
aaggatcagatgtcagcttcatctg

SEQ ID NO: 508028 - DNA, 25 bp, Mus musculus
aaggatcaggtgagtgagtcccagt

SEQ ID NO: 508029 - DNA, 25 bp, Mus musculus
aaggatcaggtgtgtgagtcccagt

SEQ ID NO: 508030 - DNA, 25 bp, Mus musculus
aaggatccagttatgctagcagagg

SEQ ID NO: 508031 - DNA, 25 bp, Mus musculus
aaggatccagttttgctagcagagg

SEQ ID NO: 508032 - DNA, 25 bp, Mus musculus
aaggatccatgccagaaacaagcct

SEQ ID NO: 508033 - DNA, 25 bp, Mus musculus
aaggatccatgcgagaaacaagcct

SEQ ID NO: 508034 - DNA, 25 bp, Mus musculus
aaggatccgcgcatatcggtgggaa

SEQ ID NO: 508035 - DNA, 25 bp, Mus musculus
aaggatccgcgcttatcggtgggaa

SEQ ID NO: 508036 - DNA, 25 bp, Mus musculus
aaggatcctcgaaacgtgggctgga

SEQ ID NO: 508037 - DNA, 25 bp, Mus musculus
aaggatcctcgatacgtgggctgga

SEQ ID NO: 508038 - DNA, 25 bp, Mus musculus
aaggatcgatccaaacatggagagc

SEQ ID NO: 508039 - DNA, 25 bp, Mus musculus
aaggatcgatcctaacatggagagc

SEQ ID NO: 508040 - DNA, 25 bp, Mus musculus
aaggatctagtgacctgtgcctacc

SEQ ID NO: 508041 - DNA, 25 bp, Mus musculus
aaggatctagtgtcctgtgcctacc

SEQ ID NO: 508042 - DNA, 25 bp, Mus musculus
aaggatctccctctcccacgatttg

SEQ ID NO: 508043 - DNA, 25 bp, Mus musculus
aaggatctccctgtcccacgatttg

SEQ ID NO: 508044 - DNA, 25 bp, Mus musculus
aaggatctgcccagtcacgcgaggg

SEQ ID NO: 508045 - DNA, 25 bp, Mus musculus
aaggatctgccctgtcacgcgaggg

SEQ ID NO: 508046 - DNA, 25 bp, Mus musculus
aaggatctgcttcaacgcctacccg

SEQ ID NO: 508047 - DNA, 25 bp, Mus musculus
aaggatctgcttgaacgcctacccg

SEQ ID NO: 508048 - DNA, 25 bp, Mus musculus
aaggatcttatgcaacagtgtacaa

SEQ ID NO: 508049 - DNA, 25 bp, Mus musculus
aaggatcttatggaacagtgtacaa

SEQ ID NO: 508050 - DNA, 25 bp, Mus musculus
aaggatcttcccagggcccactgca

SEQ ID NO: 508051 - DNA, 25 bp, Mus musculus
aaggatcttccctgggcccactgca

SEQ ID NO: 508052 - DNA, 25 bp, Mus musculus
aaggatgaaactcctaccacagcgg

SEQ ID NO: 508053 - DNA, 25 bp, Mus musculus
aaggatgaaactgctaccacagcgg

SEQ ID NO: 508054 - DNA, 25 bp, Mus musculus
aaggatgaatgtcgtggtctccgcc

SEQ ID NO: 508055 - DNA, 25 bp, Mus musculus
aaggatgaatgtggtggtctccgcc

SEQ ID NO: 508056 - DNA, 25 bp, Mus musculus
aaggatgactatacaccaaagatgg

SEQ ID NO: 508057 - DNA, 25 bp, Mus musculus
aaggatgactattcaccaaagatgg

SEQ ID NO: 508058 - DNA, 25 bp, Mus musculus
aaggatgacttcaaaggcctccagc

SEQ ID NO: 508059 - DNA, 25 bp, Mus musculus
aaggatgacttctaaggcctccagc

SEQ ID NO: 508060 - DNA, 25 bp, Mus musculus
aaggatgagtcccaggagggcaagc

SEQ ID NO: 508061 - DNA, 25 bp, Mus musculus
aaggatgagtccgaggagggcaagc

SEQ ID NO: 508062 - DNA, 25 bp, Mus musculus
aaggatgcaaacacctgactcaagc

SEQ ID NO: 508063 - DNA, 25 bp, Mus musculus
aaggatgcaaactcctgactcaagc

SEQ ID NO: 508064 - DNA, 25 bp, Mus musculus
aaggatgcagagagcaagcccggaa

SEQ ID NO: 508065 - DNA, 25 bp, Mus musculus
aaggatgcagagtgcaagcccggaa

SEQ ID NO: 508066 - DNA, 25 bp, Mus musculus
aaggatgcccggctaccgaggagca

SEQ ID NO: 508067 - DNA, 25 bp, Mus musculus
aaggatgcccgggtaccgaggagca

SEQ ID NO: 508068 - DNA, 25 bp, Mus musculus
aaggatgctgaaccgccatcctgag

SEQ ID NO: 508069 - DNA, 25 bp, Mus musculus
aaggatgctgaagcgccatcctgag

SEQ ID NO: 508070 - DNA, 25 bp, Mus musculus
aaggatggaggcactaccacggctg

SEQ ID NO: 508071 - DNA, 25 bp, Mus musculus
aaggatggaggctctaccacggctg

SEQ ID NO: 508072 - DNA, 25 bp, Mus musculus
aaggatgtactcatgatctccctga

SEQ ID NO: 508073 - DNA, 25 bp, Mus musculus
aaggatgtactcttgatctccctga

SEQ ID NO: 508074 - DNA, 25 bp, Mus musculus
aaggatgtcgtcattcacaaaggcc

SEQ ID NO: 508075 - DNA, 25 bp, Mus musculus
aaggatgtcgtctttcacaaaggcc

SEQ ID NO: 508076 - DNA, 25 bp, Mus musculus
aaggatgtctctcttctgagcactg

SEQ ID NO: 508077 - DNA, 25 bp, Mus musculus
aaggatgtctctgttctgagcactg

SEQ ID NO: 508078 - DNA, 25 bp, Mus musculus
aaggatgtgcccaccggcagcaggc

SEQ ID NO: 508079 - DNA, 25 bp, Mus musculus
aaggatgtgccctccggcagcaggc

SEQ ID NO: 508080 - DNA, 25 bp, Mus musculus
aaggatgtgcctaccttttgataca

SEQ ID NO: 508081 - DNA, 25 bp, Mus musculus
aaggatgtgccttccttttgataca

SEQ ID NO: 508082 - DNA, 25 bp, Mus musculus
aaggatgttggacacctcacccagg

SEQ ID NO: 508083 - DNA, 25 bp, Mus musculus
aaggatgttggagacctcacccagg

SEQ ID NO: 508084 - DNA, 25 bp, Mus musculus
aaggattcgaaacccttctctgctg

SEQ ID NO: 508085 - DNA, 25 bp, Mus musculus
aaggattcgaaagccttctctgctg

SEQ ID NO: 508086 - DNA, 25 bp, Mus musculus
aaggattctgccaattggtggtggc

SEQ ID NO: 508087 - DNA, 25 bp, Mus musculus
aaggattctgcctattggtggtggc

SEQ ID NO: 508088 - DNA, 25 bp, Mus musculus
aaggattggctaacctgatgacatc

SEQ ID NO: 508089 - DNA, 25 bp, Mus musculus
aaggattggctatcctgatgacatc

SEQ ID NO: 508090 - DNA, 25 bp, Mus musculus
aaggattgtcacagacatctcaaga

SEQ ID NO: 508091 - DNA, 25 bp, Mus musculus
aaggattgtcactgacatctcaaga

SEQ ID NO: 508092 - DNA, 25 bp, Mus musculus
aaggatttctctagtgcagaccgcc

SEQ ID NO: 508093 - DNA, 25 bp, Mus musculus
aaggatttctcttgtgcagaccgcc

SEQ ID NO: 508094 - DNA, 25 bp, Mus musculus
aaggatttgaatagctgtattcggg

SEQ ID NO: 508095 - DNA, 25 bp, Mus musculus
aaggatttgaattgctgtattcggg

SEQ ID NO: 508096 - DNA, 25 bp, Mus musculus
aaggatttggacaatagccaccagt

SEQ ID NO: 508097 - DNA, 25 bp, Mus musculus
aaggatttggactatagccaccagt

SEQ ID NO: 508098 - DNA, 25 bp, Mus musculus
aaggatttggcaacacccagcgacc

SEQ ID NO: 508099 - DNA, 25 bp, Mus musculus
aaggatttggcatcacccagcgacc

SEQ ID NO: 508100 - DNA, 25 bp, Mus musculus
aaggcaaagaagcaggccaaaaagc

SEQ ID NO: 508101 - DNA, 25 bp, Mus musculus
aaggcaaagaaggaggccaaaaagc

SEQ ID NO: 508102 - DNA, 25 bp, Mus musculus
aaggcaaatccgctaagcctggagg

SEQ ID NO: 508103 - DNA, 25 bp, Mus musculus
aaggcaaatccggtaagcctggagg

SEQ ID NO: 508104 - DNA, 25 bp, Mus musculus
aaggcaacacaacttgacggacccg

SEQ ID NO: 508105 - DNA, 25 bp, Mus musculus
aaggcaacacaagttgacggacccg

SEQ ID NO: 508106 - DNA, 25 bp, Mus musculus
aaggcaagatgtacacaggactgtg

SEQ ID NO: 508107 - DNA, 25 bp, Mus musculus
aaggcaagatgttcacaggactgtg

SEQ ID NO: 508108 - DNA, 25 bp, Mus musculus
aaggcaagcagaaccacacagggag

SEQ ID NO: 508109 - DNA, 25 bp, Mus musculus
aaggcaagcagatccacacagggag

SEQ ID NO: 508110 - DNA, 25 bp, Mus musculus
aaggcaagcatgctccagagccagg

SEQ ID NO: 508111 - DNA, 25 bp, Mus musculus
aaggcaagcatggtccagagccagg

SEQ ID NO: 508112 - DNA, 25 bp, Mus musculus
aaggcaagctgcacatgatgaagga

SEQ ID NO: 508113 - DNA, 25 bp, Mus musculus
aaggcaagctgctcatgatgaagga

SEQ ID NO: 508114 - DNA, 25 bp, Mus musculus
aaggcaatgcagactgtgtatctca

SEQ ID NO: 508115 - DNA, 25 bp, Mus musculus
aaggcaatgcagtctgtgtatctca

SEQ ID NO: 508116 - DNA, 25 bp, Mus musculus
aaggcacacggcattctttctctgt

SEQ ID NO: 508117 - DNA, 25 bp, Mus musculus
aaggcacacggctttctttctctgt

SEQ ID NO: 508118 - DNA, 25 bp, Mus musculus
aaggcacactctcgacgcatgcgca

SEQ ID NO: 508119 - DNA, 25 bp, Mus musculus
aaggcacactctggacgcatgcgca

SEQ ID NO: 508120 - DNA, 25 bp, Mus musculus
aaggcacagaagcactgcaaaccga

SEQ ID NO: 508121 - DNA, 25 bp, Mus musculus
aaggcacagaaggactgcaaaccga

SEQ ID NO: 508122 - DNA, 25 bp, Mus musculus
aaggcacagataagggacacagcag

SEQ ID NO: 508123 - DNA, 25 bp, Mus musculus
aaggcacagatatgggacacagcag

SEQ ID NO: 508124 - DNA, 25 bp, Mus musculus
aaggcacagatcaattcctcaatga

SEQ ID NO: 508125 - DNA, 25 bp, Mus musculus
aaggcacagatctattcctcaatga

SEQ ID NO: 508126 - DNA, 25 bp, Mus musculus
aaggcacaggcaccgctcttggaaa

SEQ ID NO: 508127 - DNA, 25 bp, Mus musculus
aaggcacaggcagcgctcttggaaa

SEQ ID NO: 508128 - DNA, 25 bp, Mus musculus
aaggcacatagaaatgactcttcag

SEQ ID NO: 508129 - DNA, 25 bp, Mus musculus
aaggcacatagatatgactcttcag

SEQ ID NO: 508130 - DNA, 25 bp, Mus musculus
aaggcaccagggatctgagcatggt

SEQ ID NO: 508131 - DNA, 25 bp, Mus musculus
aaggcaccagggttctgagcatggt

SEQ ID NO: 508132 - DNA, 25 bp, Mus musculus
aaggcacgccagctggaagcaagaa

SEQ ID NO: 508133 - DNA, 25 bp, Mus musculus
aaggcacgccaggtggaagcaagaa

SEQ ID NO: 508134 - DNA, 25 bp, Mus musculus
aaggcacgggagactgggctccctt

SEQ ID NO: 508135 - DNA, 25 bp, Mus musculus
aaggcacgggagtctgggctccctt

SEQ ID NO: 508136 - DNA, 25 bp, Mus musculus
aaggcactgcggctcttacagaaaa

SEQ ID NO: 508137 - DNA, 25 bp, Mus musculus
aaggcactgcgggtcttacagaaaa

SEQ ID NO: 508138 - DNA, 25 bp, Mus musculus
aaggcactggtgatcttgagcaacc

SEQ ID NO: 508139 - DNA, 25 bp, Mus musculus
aaggcactggtgttcttgagcaacc

SEQ ID NO: 508140 - DNA, 25 bp, Mus musculus
aaggcactgtatcacactttctctg

SEQ ID NO: 508141 - DNA, 25 bp, Mus musculus
aaggcactgtatgacactttctctg

SEQ ID NO: 508142 - DNA, 25 bp, Mus musculus
aaggcagaagggaaggcttcctcta

SEQ ID NO: 508143 - DNA, 25 bp, Mus musculus
aaggcagaagggtaggcttcctcta

SEQ ID NO: 508144 - DNA, 25 bp, Mus musculus
aaggcagacatgaggaaacaaaacc

SEQ ID NO: 508145 - DNA, 25 bp, Mus musculus
aaggcagacatgtggaaacaaaacc

SEQ ID NO: 508146 - DNA, 25 bp, Mus musculus
aaggcagactcaatcaaaatttgcc

SEQ ID NO: 508147 - DNA, 25 bp, Mus musculus
aaggcagactcattcaaaatttgcc

SEQ ID NO: 508148 - DNA, 25 bp, Mus musculus
aaggcagagattagacccctggagg

SEQ ID NO: 508149 - DNA, 25 bp, Mus musculus
aaggcagagatttgacccctggagg

SEQ ID NO: 508150 - DNA, 25 bp, Mus musculus
aaggcagagccaccccagtgtacct

SEQ ID NO: 508151 - DNA, 25 bp, Mus musculus
aaggcagagccagcccagtgtacct

SEQ ID NO: 508152 - DNA, 25 bp, Mus musculus
aaggcagagcccacgcccttggctt

SEQ ID NO: 508153 - DNA, 25 bp, Mus musculus
aaggcagagccctcgcccttggctt

SEQ ID NO: 508154 - DNA, 25 bp, Mus musculus
aaggcagataccagagggtccttga

SEQ ID NO: 508155 - DNA, 25 bp, Mus musculus
aaggcagatacctgagggtccttga

SEQ ID NO: 508156 - DNA, 25 bp, Mus musculus
aaggcagatgtcctgccaaagactg

SEQ ID NO: 508157 - DNA, 25 bp, Mus musculus
aaggcagatgtcgtgccaaagactg

SEQ ID NO: 508158 - DNA, 25 bp, Mus musculus
aaggcagcccgcacagatatctggt

SEQ ID NO: 508159 - DNA, 25 bp, Mus musculus
aaggcagcccgctcagatatctggt

SEQ ID NO: 508160 - DNA, 25 bp, Mus musculus
aaggcagcgagaagcagcggccaac

SEQ ID NO: 508161 - DNA, 25 bp, Mus musculus
aaggcagcgagatgcagcggccaac

SEQ ID NO: 508162 - DNA, 25 bp, Mus musculus
aaggcaggaaacagagcgagcagac

SEQ ID NO: 508163 - DNA, 25 bp, Mus musculus
aaggcaggaaactgagcgagcagac

SEQ ID NO: 508164 - DNA, 25 bp, Mus musculus
aaggcaggaatccttgctttcccgt

SEQ ID NO: 508165 - DNA, 25 bp, Mus musculus
aaggcaggaatcgttgctttcccgt

SEQ ID NO: 508166 - DNA, 25 bp, Mus musculus
aaggcaggacatctctcaccttctg

SEQ ID NO: 508167 - DNA, 25 bp, Mus musculus
aaggcaggacatgtctcaccttctg

SEQ ID NO: 508168 - DNA, 25 bp, Mus musculus
aaggcaggatccacaccgtggagga

SEQ ID NO: 508169 - DNA, 25 bp, Mus musculus
aaggcaggatcctcaccgtggagga

SEQ ID NO: 508170 - DNA, 25 bp, Mus musculus
aaggcaggcacaaactgcagccacg

SEQ ID NO: 508171 - DNA, 25 bp, Mus musculus
aaggcaggcacatactgcagccacg

SEQ ID NO: 508172 - DNA, 25 bp, Mus musculus
aaggcaggcaccaaaatcaaggaga

SEQ ID NO: 508173 - DNA, 25 bp, Mus musculus
aaggcaggcacctaaatcaaggaga

SEQ ID NO: 508174 - DNA, 25 bp, Mus musculus
aaggcaggccagaacttcatgagta

SEQ ID NO: 508175 - DNA, 25 bp, Mus musculus
aaggcaggccagtacttcatgagta

SEQ ID NO: 508176 - DNA, 25 bp, Mus musculus
aaggcaggcccgagaacgtctgtgt

SEQ ID NO: 508177 - DNA, 25 bp, Mus musculus
aaggcaggcccgtgaacgtctgtgt

SEQ ID NO: 508178 - DNA, 25 bp, Mus musculus
aaggcaggcgatcatggcaaaccag

SEQ ID NO: 508179 - DNA, 25 bp, Mus musculus
aaggcaggcgatgatggcaaaccag

SEQ ID NO: 508180 - DNA, 25 bp, Mus musculus
aaggcagtatggcttatcttctttg

SEQ ID NO: 508181 - DNA, 25 bp, Mus musculus
aaggcagtatgggttatcttctttg

SEQ ID NO: 508182 - DNA, 25 bp, Mus musculus
aaggcagtattgaagttggcattcc

SEQ ID NO: 508183 - DNA, 25 bp, Mus musculus
aaggcagtattgtagttggcattcc

SEQ ID NO: 508184 - DNA, 25 bp, Mus musculus
aaggcagtcgcccatcgacgtgaag

SEQ ID NO: 508185 - DNA, 25 bp, Mus musculus
aaggcagtcgccgatcgacgtgaag

SEQ ID NO: 508186 - DNA, 25 bp, Mus musculus
aaggcagtcgggacggactctgctc

SEQ ID NO: 508187 - DNA, 25 bp, Mus musculus
aaggcagtcgggtcggactctgctc

SEQ ID NO: 508188 - DNA, 25 bp, Mus musculus
aaggcagtgaacagcctcttttcca

SEQ ID NO: 508189 - DNA, 25 bp, Mus musculus
aaggcagtgaactgcctcttttcca

SEQ ID NO: 508190 - DNA, 25 bp, Mus musculus
aaggcagtgacgaagacattgagac

SEQ ID NO: 508191 - DNA, 25 bp, Mus musculus
aaggcagtgacgtagacattgagac

SEQ ID NO: 508192 - DNA, 25 bp, Mus musculus
aaggcagtgcggcacctcacggcca

SEQ ID NO: 508193 - DNA, 25 bp, Mus musculus
aaggcagtgcgggacctcacggcca

SEQ ID NO: 508194 - DNA, 25 bp, Mus musculus
aaggcagtggtcagcaaggcctgct

SEQ ID NO: 508195 - DNA, 25 bp, Mus musculus
aaggcagtggtctgcaaggcctgct

SEQ ID NO: 508196 - DNA, 25 bp, Mus musculus
aaggcagtggtgaacggacccatgc

SEQ ID NO: 508197 - DNA, 25 bp, Mus musculus
aaggcagtggtgtacggacccatgc

SEQ ID NO: 508198 - DNA, 25 bp, Mus musculus
aaggcagttgcaaccaggtgtggca

SEQ ID NO: 508199 - DNA, 25 bp, Mus musculus
aaggcagttgcatccaggtgtggca

SEQ ID NO: 508200 - DNA, 25 bp, Mus musculus
aaggcatcactgctcctgagggcca

SEQ ID NO: 508201 - DNA, 25 bp, Mus musculus
aaggcatcactggtcctgagggcca

SEQ ID NO: 508202 - DNA, 25 bp, Mus musculus
aaggcatccactcctacagctgagc

SEQ ID NO: 508203 - DNA, 25 bp, Mus musculus
aaggcatccactgctacagctgagc

SEQ ID NO: 508204 - DNA, 25 bp, Mus musculus
aaggcatctcccctctacctggata

SEQ ID NO: 508205 - DNA, 25 bp, Mus musculus
aaggcatctcccgtctacctggata

SEQ ID NO: 508206 - DNA, 25 bp, Mus musculus
aaggcatggcgcagactagaggtac

SEQ ID NO: 508207 - DNA, 25 bp, Mus musculus
aaggcatggcgctgactagaggtac

SEQ ID NO: 508208 - DNA, 25 bp, Mus musculus
aaggcatgggttacaccgagttctc

SEQ ID NO: 508209 - DNA, 25 bp, Mus musculus
aaggcatgggtttcaccgagttctc

SEQ ID NO: 508210 - DNA, 25 bp, Mus musculus
aaggcatgtctaaatcacgtccaaa

SEQ ID NO: 508211 - DNA, 25 bp, Mus musculus
aaggcatgtctacacaccatctaca

SEQ ID NO: 508212 - DNA, 25 bp, Mus musculus
aaggcatgtctagacaccatctaca

SEQ ID NO: 508213 - DNA, 25 bp, Mus musculus
aaggcatgtctatatcacgtccaaa

SEQ ID NO: 508214 - DNA, 25 bp, Mus musculus
aaggcattcttcagctccaaggcta

SEQ ID NO: 508215 - DNA, 25 bp, Mus musculus
aaggcattcttctgctccaaggcta

SEQ ID NO: 508216 - DNA, 25 bp, Mus musculus
aaggcattgagcagaagccctgtcg

SEQ ID NO: 508217 - DNA, 25 bp, Mus musculus
aaggcattgagctgaagccctgtcg

SEQ ID NO: 508218 - DNA, 25 bp, Mus musculus
aaggcatttggactcctcagcgaga

SEQ ID NO: 508219 - DNA, 25 bp, Mus musculus
aaggcatttggagtcctcagcgaga

SEQ ID NO: 508220 - DNA, 25 bp, Mus musculus
aaggccaagccgctgtactgaggat

SEQ ID NO: 508221 - DNA, 25 bp, Mus musculus
aaggccaagccggtgtactgaggat

SEQ ID NO: 508222 - DNA, 25 bp, Mus musculus
aaggccaagtgcagacgctgtgtcc

SEQ ID NO: 508223 - DNA, 25 bp, Mus musculus
aaggccaagtgctgacgctgtgtcc

SEQ ID NO: 508224 - DNA, 25 bp, Mus musculus
aaggccacaataccggagagcagcc

SEQ ID NO: 508225 - DNA, 25 bp, Mus musculus
aaggccacaatagcggagagcagcc

SEQ ID NO: 508226 - DNA, 25 bp, Mus musculus
aaggccactacaaattctgtgagct

SEQ ID NO: 508227 - DNA, 25 bp, Mus musculus
aaggccactacatattctgtgagct

SEQ ID NO: 508228 - DNA, 25 bp, Mus musculus
aaggccagaagcagttgttacattg

SEQ ID NO: 508229 - DNA, 25 bp, Mus musculus
aaggccagaagctgttgttacattg

SEQ ID NO: 508230 - DNA, 25 bp, Mus musculus
aaggccagaggcctgcttgctgctc

SEQ ID NO: 508231 - DNA, 25 bp, Mus musculus
aaggccagaggcgtgcttgctgctc

SEQ ID NO: 508232 - DNA, 25 bp, Mus musculus
aaggccagaggtaccaggcgctgaa

SEQ ID NO: 508233 - DNA, 25 bp, Mus musculus
aaggccagaggttccaggcgctgaa

SEQ ID NO: 508234 - DNA, 25 bp, Mus musculus
aaggccagcttcagaaggcgctgct

SEQ ID NO: 508235 - DNA, 25 bp, Mus musculus
aaggccagcttccagcacgtggacc

SEQ ID NO: 508236 - DNA, 25 bp, Mus musculus
aaggccagcttcgagcacgtggacc

SEQ ID NO: 508237 - DNA, 25 bp, Mus musculus
aaggccagcttctgaaggcgctgct

SEQ ID NO: 508238 - DNA, 25 bp, Mus musculus
aaggccaggagcacctactgggtca

SEQ ID NO: 508239 - DNA, 25 bp, Mus musculus
aaggccaggagctcctactgggtca

SEQ ID NO: 508240 - DNA, 25 bp, Mus musculus
aaggccaggcccagggctgttctag

SEQ ID NO: 508241 - DNA, 25 bp, Mus musculus
aaggccaggccctgggctgttctag

SEQ ID NO: 508242 - DNA, 25 bp, Mus musculus
aaggccaggcctcagcagctgctca

SEQ ID NO: 508243 - DNA, 25 bp, Mus musculus
aaggccaggcctgagcagctgctca

SEQ ID NO: 508244 - DNA, 25 bp, Mus musculus
aaggccagggttccccatttcaaat

SEQ ID NO: 508245 - DNA, 25 bp, Mus musculus
aaggccagggttgcccatttcaaat

SEQ ID NO: 508246 - DNA, 25 bp, Mus musculus
aaggccataataattctgaaggaca

SEQ ID NO: 508247 - DNA, 25 bp, Mus musculus
aaggccataatatttctgaaggaca

SEQ ID NO: 508248 - DNA, 25 bp, Mus musculus
aaggccatagtcctgttcacctcag

SEQ ID NO: 508249 - DNA, 25 bp, Mus musculus
aaggccatagtcgtgttcacctcag

SEQ ID NO: 508250 - DNA, 25 bp, Mus musculus
aaggccatcaccacgcagaacgtga

SEQ ID NO: 508251 - DNA, 25 bp, Mus musculus
aaggccatcacctcgcagaacgtga

SEQ ID NO: 508252 - DNA, 25 bp, Mus musculus
aaggccatgcggatcctggcctcag

SEQ ID NO: 508253 - DNA, 25 bp, Mus musculus
aaggccatgcggttcctggcctcag

SEQ ID NO: 508254 - DNA, 25 bp, Mus musculus
aaggccattgaacttctgatggaaa

SEQ ID NO: 508255 - DNA, 25 bp, Mus musculus
aaggccattgaagttctgatggaaa

SEQ ID NO: 508256 - DNA, 25 bp, Mus musculus
aaggccattggactgctgaccagcg

SEQ ID NO: 508257 - DNA, 25 bp, Mus musculus
aaggccattggagtgctgaccagcg

SEQ ID NO: 508258 - DNA, 25 bp, Mus musculus
aaggccattggccatcgaaactacc

SEQ ID NO: 508259 - DNA, 25 bp, Mus musculus
aaggccattggcgatcgaaactacc

SEQ ID NO: 508260 - DNA, 25 bp, Mus musculus
aaggcccacatgctaacgcacagca

SEQ ID NO: 508261 - DNA, 25 bp, Mus musculus
aaggcccacatggtaacgcacagca

SEQ ID NO: 508262 - DNA, 25 bp, Mus musculus
aaggcccactgtcgaagccgctgga

SEQ ID NO: 508263 - DNA, 25 bp, Mus musculus
aaggcccactgtggaagccgctgga

SEQ ID NO: 508264 - DNA, 25 bp, Mus musculus
aaggcccagagacgccactgtccag

SEQ ID NO: 508265 - DNA, 25 bp, Mus musculus
aaggcccagagaggccactgtccag

SEQ ID NO: 508266 - DNA, 25 bp, Mus musculus
aaggcccagattcttcggctgctcc

SEQ ID NO: 508267 - DNA, 25 bp, Mus musculus
aaggcccagattgttcggctgctcc

SEQ ID NO: 508268 - DNA, 25 bp, Mus musculus
aaggcccaggtaactacagcgccac

SEQ ID NO: 508269 - DNA, 25 bp, Mus musculus
aaggcccaggtatctacagcgccac

SEQ ID NO: 508270 - DNA, 25 bp, Mus musculus
aaggcccatctcataacattttggg

SEQ ID NO: 508271 - DNA, 25 bp, Mus musculus
aaggcccatctcttaacattttggg

SEQ ID NO: 508272 - DNA, 25 bp, Mus musculus
aaggcccatgtgcagacagatttca

SEQ ID NO: 508273 - DNA, 25 bp, Mus musculus
aaggcccatgtggagacagatttca

SEQ ID NO: 508274 - DNA, 25 bp, Mus musculus
aaggcccctgtgctgaaggctaaag

SEQ ID NO: 508275 - DNA, 25 bp, Mus musculus
aaggcccctgtggtgaaggctaaag

SEQ ID NO: 508276 - DNA, 25 bp, Mus musculus
aaggcccgagcaaagggcctgctcc

SEQ ID NO: 508277 - DNA, 25 bp, Mus musculus
aaggcccgagcatagggcctgctcc

SEQ ID NO: 508278 - DNA, 25 bp, Mus musculus
aaggcccgattgcaagagagcactc

SEQ ID NO: 508279 - DNA, 25 bp, Mus musculus
aaggcccgattggaagagagcactc

SEQ ID NO: 508280 - DNA, 25 bp, Mus musculus
aaggcccgtcttcaaggctaatggc

SEQ ID NO: 508281 - DNA, 25 bp, Mus musculus
aaggcccgtcttgaaggctaatggc

SEQ ID NO: 508282 - DNA, 25 bp, Mus musculus
aaggcccgtgggagaacatcttcat

SEQ ID NO: 508283 - DNA, 25 bp, Mus musculus
aaggcccgtgggtgaacatcttcat

SEQ ID NO: 508284 - DNA, 25 bp, Mus musculus
aaggcccgtgtgactcggcggttca

SEQ ID NO: 508285 - DNA, 25 bp, Mus musculus
aaggcccgtgtgtctcggcggttca

SEQ ID NO: 508286 - DNA, 25 bp, Mus musculus
aaggccctcaaactcattattcgtc

SEQ ID NO: 508287 - DNA, 25 bp, Mus musculus
aaggccctcaaagtcattattcgtc

SEQ ID NO: 508288 - DNA, 25 bp, Mus musculus
aaggccctggagctcttccggaatg

SEQ ID NO: 508289 - DNA, 25 bp, Mus musculus
aaggccctggaggtcttccggaatg

SEQ ID NO: 508290 - DNA, 25 bp, Mus musculus
aaggccctggctctgtcattccacg

SEQ ID NO: 508291 - DNA, 25 bp, Mus musculus
aaggccctggctgtgtcattccacg

SEQ ID NO: 508292 - DNA, 25 bp, Mus musculus
aaggccctgggcaagaggcctgcca

SEQ ID NO: 508293 - DNA, 25 bp, Mus musculus
aaggccctgggctagaggcctgcca

SEQ ID NO: 508294 - DNA, 25 bp, Mus musculus
aaggccctgtgcaccgaattccagg

SEQ ID NO: 508295 - DNA, 25 bp, Mus musculus
aaggccctgtgctccgaattccagg

SEQ ID NO: 508296 - DNA, 25 bp, Mus musculus
aaggccgacgccagctcgcaggcat

SEQ ID NO: 508297 - DNA, 25 bp, Mus musculus
aaggccgacgcctgctcgcaggcat

SEQ ID NO: 508298 - DNA, 25 bp, Mus musculus
aaggccgccacaacaacagcgcttt

SEQ ID NO: 508299 - DNA, 25 bp, Mus musculus
aaggccgccacatcaacagcgcttt

SEQ ID NO: 508300 - DNA, 25 bp, Mus musculus
aaggccgctcggatggttaccgctg

SEQ ID NO: 508301 - DNA, 25 bp, Mus musculus
aaggccgctcggttggttaccgctg

SEQ ID NO: 508302 - DNA, 25 bp, Mus musculus
aaggccggatggaggtgctatccct

SEQ ID NO: 508303 - DNA, 25 bp, Mus musculus
aaggccggatggtggtgctatccct

SEQ ID NO: 508304 - DNA, 25 bp, Mus musculus
aaggccggccaacactacatgaaaa

SEQ ID NO: 508305 - DNA, 25 bp, Mus musculus
aaggccggccaagactacatgaaaa

SEQ ID NO: 508306 - DNA, 25 bp, Mus musculus
aaggccggctctcacccgtgctctg

SEQ ID NO: 508307 - DNA, 25 bp, Mus musculus
aaggccggctctgacccgtgctctg

SEQ ID NO: 508308 - DNA, 25 bp, Mus musculus
aaggccgtctggatggcgccctctg

SEQ ID NO: 508309 - DNA, 25 bp, Mus musculus
aaggccgtctggttggcgccctctg

SEQ ID NO: 508310 - DNA, 25 bp, Mus musculus
aaggccgtgtatcaccgaatcctgg

SEQ ID NO: 508311 - DNA, 25 bp, Mus musculus
aaggccgtgtatgaccgaatcctgg

SEQ ID NO: 508312 - DNA, 25 bp, Mus musculus
aaggccgttgagcttctggactgac

SEQ ID NO: 508313 - DNA, 25 bp, Mus musculus
aaggccgttgaggttctggactgac

SEQ ID NO: 508314 - DNA, 25 bp, Mus musculus
aaggcctacaccacccgtgtgggca

SEQ ID NO: 508315 - DNA, 25 bp, Mus musculus
aaggcctacacctcccgtgtgggca

SEQ ID NO: 508316 - DNA, 25 bp, Mus musculus
aaggcctatatccacttgggccacc

SEQ ID NO: 508317 - DNA, 25 bp, Mus musculus
aaggcctatatcgacttgggccacc

SEQ ID NO: 508318 - DNA, 25 bp, Mus musculus
aaggcctcatccaggagcaaatgaa

SEQ ID NO: 508319 - DNA, 25 bp, Mus musculus
aaggcctcatcctggagcaaatgaa

SEQ ID NO: 508320 - DNA, 25 bp, Mus musculus
aaggcctccggcataactcagtgaa

SEQ ID NO: 508321 - DNA, 25 bp, Mus musculus
aaggcctccggcttaactcagtgaa

SEQ ID NO: 508322 - DNA, 25 bp, Mus musculus
aaggcctctgtgcactacatccgga

SEQ ID NO: 508323 - DNA, 25 bp, Mus musculus
aaggcctctgtggactacatccgga

SEQ ID NO: 508324 - DNA, 25 bp, Mus musculus
aaggcctcttgtctgccgctttggg

SEQ ID NO: 508325 - DNA, 25 bp, Mus musculus
aaggcctcttgtgtgccgctttggg

SEQ ID NO: 508326 - DNA, 25 bp, Mus musculus
aaggcctgagctctatgaacaagga

SEQ ID NO: 508327 - DNA, 25 bp, Mus musculus
aaggcctgagctgtatgaacaagga

SEQ ID NO: 508328 - DNA, 25 bp, Mus musculus
aaggcctgcaatcatgccacgctgg

SEQ ID NO: 508329 - DNA, 25 bp, Mus musculus
aaggcctgcaatgatgccacgctgg

SEQ ID NO: 508330 - DNA, 25 bp, Mus musculus
aaggcctgcagtcagtcggtctgcc

SEQ ID NO: 508331 - DNA, 25 bp, Mus musculus
aaggcctgcagtgagtcggtctgcc

SEQ ID NO: 508332 - DNA, 25 bp, Mus musculus
aaggcctggatgactcactactgag

SEQ ID NO: 508333 - DNA, 25 bp, Mus musculus
aaggcctggatgtctcactactgag

SEQ ID NO: 508334 - DNA, 25 bp, Mus musculus
aaggcctggattatctgcactcaga

SEQ ID NO: 508335 - DNA, 25 bp, Mus musculus
aaggcctggattttctgcactcaga

SEQ ID NO: 508336 - DNA, 25 bp, Mus musculus
aaggcctgtactacatttgcctgga

SEQ ID NO: 508337 - DNA, 25 bp, Mus musculus
aaggcctgtacttcatttgcctgga

SEQ ID NO: 508338 - DNA, 25 bp, Mus musculus
aaggccttgaacaacccatgctggg

SEQ ID NO: 508339 - DNA, 25 bp, Mus musculus
aaggccttgaactacccatgctggg

SEQ ID NO: 508340 - DNA, 25 bp, Mus musculus
aaggccttggagctcactggtttaa

SEQ ID NO: 508341 - DNA, 25 bp, Mus musculus
aaggccttggaggtcactggtttaa

SEQ ID NO: 508342 - DNA, 25 bp, Mus musculus
aaggccttgtgcagacccaccagca

SEQ ID NO: 508343 - DNA, 25 bp, Mus musculus
aaggccttgtgctgacccaccagca

SEQ ID NO: 508344 - DNA, 25 bp, Mus musculus
aaggcgaaaagaagacaaaagtccg

SEQ ID NO: 508345 - DNA, 25 bp, Mus musculus
aaggcgaaaagatgacaaaagtccg

SEQ ID NO: 508346 - DNA, 25 bp, Mus musculus
aaggcgaaggtcaccttctccagcc

SEQ ID NO: 508347 - DNA, 25 bp, Mus musculus
aaggcgaaggtctccttctccagcc

SEQ ID NO: 508348 - DNA, 25 bp, Mus musculus
aaggcgaatggactccaggctcaga

SEQ ID NO: 508349 - DNA, 25 bp, Mus musculus
aaggcgaatggagtccaggctcaga

SEQ ID NO: 508350 - DNA, 25 bp, Mus musculus
aaggcgacagtgatcctagctggcc

SEQ ID NO: 508351 - DNA, 25 bp, Mus musculus
aaggcgacagtgttcctagctggcc

SEQ ID NO: 508352 - DNA, 25 bp, Mus musculus
aaggcgaccacacagtccctggcat

SEQ ID NO: 508353 - DNA, 25 bp, Mus musculus
aaggcgaccacagagtccctggcat

SEQ ID NO: 508354 - DNA, 25 bp, Mus musculus
aaggcgactatcaggatgactggac

SEQ ID NO: 508355 - DNA, 25 bp, Mus musculus
aaggcgactatctggatgactggac

SEQ ID NO: 508356 - DNA, 25 bp, Mus musculus
aaggcgaggcttccgcccagcactg

SEQ ID NO: 508357 - DNA, 25 bp, Mus musculus
aaggcgaggcttgcgcccagcactg

SEQ ID NO: 508358 - DNA, 25 bp, Mus musculus
aaggcgatcagcagaaaaacagggt

SEQ ID NO: 508359 - DNA, 25 bp, Mus musculus
aaggcgatcagctgaaaaacagggt

SEQ ID NO: 508360 - DNA, 25 bp, Mus musculus
aaggcgatcattattagcctttgag

SEQ ID NO: 508361 - DNA, 25 bp, Mus musculus
aaggcgatcatttttagcctttgag

SEQ ID NO: 508362 - DNA, 25 bp, Mus musculus
aaggcgattttgcataaggccacca

SEQ ID NO: 508363 - DNA, 25 bp, Mus musculus
aaggcgattttggataaggccacca

SEQ ID NO: 508364 - DNA, 25 bp, Mus musculus
aaggcgccctctccttggactggtg

SEQ ID NO: 508365 - DNA, 25 bp, Mus musculus
aaggcgccctctgcttggactggtg

SEQ ID NO: 508366 - DNA, 25 bp, Mus musculus
aaggcgcctgagagtcgccgctgcc

SEQ ID NO: 508367 - DNA, 25 bp, Mus musculus
aaggcgcctgagtgtcgccgctgcc

SEQ ID NO: 508368 - DNA, 25 bp, Mus musculus
aaggcgcggcttctgtgctcagtac

SEQ ID NO: 508369 - DNA, 25 bp, Mus musculus
aaggcgcggcttgtgtgctcagtac

SEQ ID NO: 508370 - DNA, 25 bp, Mus musculus
aaggcgcgtcatcggtgctaccaag

SEQ ID NO: 508371 - DNA, 25 bp, Mus musculus
aaggcgcgtcatgggtgctaccaag

SEQ ID NO: 508372 - DNA, 25 bp, Mus musculus
aaggcgctcagccatctctgatcca

SEQ ID NO: 508373 - DNA, 25 bp, Mus musculus
aaggcgctcagcgatctctgatcca

SEQ ID NO: 508374 - DNA, 25 bp, Mus musculus
aaggcgcttcagcactatcgcaaga

SEQ ID NO: 508375 - DNA, 25 bp, Mus musculus
aaggcgcttcaggactatcgcaaga

SEQ ID NO: 508376 - DNA, 25 bp, Mus musculus
aaggcgcttctcactcacgactctg

SEQ ID NO: 508377 - DNA, 25 bp, Mus musculus
aaggcgcttctctctcacgactctg

SEQ ID NO: 508378 - DNA, 25 bp, Mus musculus
aaggcggaagctcatgcttattgac

SEQ ID NO: 508379 - DNA, 25 bp, Mus musculus
aaggcggaagctgatgcttattgac

SEQ ID NO: 508380 - DNA, 25 bp, Mus musculus
aaggcggatactaggaccagcgagt

SEQ ID NO: 508381 - DNA, 25 bp, Mus musculus
aaggcggatacttggaccagcgagt

SEQ ID NO: 508382 - DNA, 25 bp, Mus musculus
aaggcggcccctctgaagaccaggc

SEQ ID NO: 508383 - DNA, 25 bp, Mus musculus
aaggcggcccctgtgaagaccaggc

SEQ ID NO: 508384 - DNA, 25 bp, Mus musculus
aaggcggcgtctcagctctacatag

SEQ ID NO: 508385 - DNA, 25 bp, Mus musculus
aaggcggcgtctgagctctacatag

SEQ ID NO: 508386 - DNA, 25 bp, Mus musculus
aaggcgggacttctgtcgtcattgc

SEQ ID NO: 508387 - DNA, 25 bp, Mus musculus
aaggcgggacttgtgtcgtcattgc

SEQ ID NO: 508388 - DNA, 25 bp, Mus musculus
aaggcgggcttccagaactagtatc

SEQ ID NO: 508389 - DNA, 25 bp, Mus musculus
aaggcgggcttcgagaactagtatc

SEQ ID NO: 508390 - DNA, 25 bp, Mus musculus
aaggcgtacagactgactcctaaac

SEQ ID NO: 508391 - DNA, 25 bp, Mus musculus
aaggcgtacagagtgactcctaaac

SEQ ID NO: 508392 - DNA, 25 bp, Mus musculus
aaggcgtacatcaaggactgtgtca

SEQ ID NO: 508393 - DNA, 25 bp, Mus musculus
aaggcgtacatctaggactgtgtca

SEQ ID NO: 508394 - DNA, 25 bp, Mus musculus
aaggcgtccaaccacttatgcagga

SEQ ID NO: 508395 - DNA, 25 bp, Mus musculus
aaggcgtccaacgacttatgcagga

SEQ ID NO: 508396 - DNA, 25 bp, Mus musculus
aaggcgtcttcacccacacagtgta

SEQ ID NO: 508397 - DNA, 25 bp, Mus musculus
aaggcgtcttcagccacacagtgta

SEQ ID NO: 508398 - DNA, 25 bp, Mus musculus
aaggcgtgacgtcaaggtgttcaat

SEQ ID NO: 508399 - DNA, 25 bp, Mus musculus
aaggcgtgacgtgaaggtgttcaat

SEQ ID NO: 508400 - DNA, 25 bp, Mus musculus
aaggcgtgaggacacaaagccgtca

SEQ ID NO: 508401 - DNA, 25 bp, Mus musculus
aaggcgtgaggagacaaagccgtca

SEQ ID NO: 508402 - DNA, 25 bp, Mus musculus
aaggcgttagaaactatttcttctg

SEQ ID NO: 508403 - DNA, 25 bp, Mus musculus
aaggcgttagaatctatttcttctg

SEQ ID NO: 508404 - DNA, 25 bp, Mus musculus
aaggcgtttgccatccaggcgagcc

SEQ ID NO: 508405 - DNA, 25 bp, Mus musculus
aaggcgtttgccttccaggcgagcc

SEQ ID NO: 508406 - DNA, 25 bp, Mus musculus
aaggctacactcaggacaacaacat

SEQ ID NO: 508407 - DNA, 25 bp, Mus musculus
aaggctacactctggacaacaacat

SEQ ID NO: 508408 - DNA, 25 bp, Mus musculus
aaggctacctggctaaagtcaagtc

SEQ ID NO: 508409 - DNA, 25 bp, Mus musculus
aaggctacctgggtaaagtcaagtc

SEQ ID NO: 508410 - DNA, 25 bp, Mus musculus
aaggctactgtaatgatcttctacg

SEQ ID NO: 508411 - DNA, 25 bp, Mus musculus
aaggctactgtattgatcttctacg

SEQ ID NO: 508412 - DNA, 25 bp, Mus musculus
aaggctacttgaaagacccagcaag

SEQ ID NO: 508413 - DNA, 25 bp, Mus musculus
aaggctacttgatagacccagcaag

SEQ ID NO: 508414 - DNA, 25 bp, Mus musculus
aaggctatggtgatggcactcccat

SEQ ID NO: 508415 - DNA, 25 bp, Mus musculus
aaggctatggtgttggcactcccat

SEQ ID NO: 508416 - DNA, 25 bp, Mus musculus
aaggctattgagagtggagacactg

SEQ ID NO: 508417 - DNA, 25 bp, Mus musculus
aaggctattgagtgtggagacactg

SEQ ID NO: 508418 - DNA, 25 bp, Mus musculus
aaggctcaccttccaatgcctggag

SEQ ID NO: 508419 - DNA, 25 bp, Mus musculus
aaggctcaccttgcaatgcctggag

SEQ ID NO: 508420 - DNA, 25 bp, Mus musculus
aaggctcatcaacatggtggcaggt

SEQ ID NO: 508421 - DNA, 25 bp, Mus musculus
aaggctcatcaagatggtggcaggt

SEQ ID NO: 508422 - DNA, 25 bp, Mus musculus
aaggctccaccaaggagctcctgcg

SEQ ID NO: 508423 - DNA, 25 bp, Mus musculus
aaggctccaccaagttctcgcgggc

SEQ ID NO: 508424 - DNA, 25 bp, Mus musculus
aaggctccaccatggagctcctgcg

SEQ ID NO: 508425 - DNA, 25 bp, Mus musculus
aaggctccaccatgttctcgcgggc

SEQ ID NO: 508426 - DNA, 25 bp, Mus musculus
aaggctccagacaaagatgctattc

SEQ ID NO: 508427 - DNA, 25 bp, Mus musculus
aaggctccagactaagatgctattc

SEQ ID NO: 508428 - DNA, 25 bp, Mus musculus
aaggctcccaagacaagtgctgaac

SEQ ID NO: 508429 - DNA, 25 bp, Mus musculus
aaggctcccaagtcaagtgctgaac

SEQ ID NO: 508430 - DNA, 25 bp, Mus musculus
aaggctcccacgatctcagcatctg

SEQ ID NO: 508431 - DNA, 25 bp, Mus musculus
aaggctcccacgttctcagcatctg

SEQ ID NO: 508432 - DNA, 25 bp, Mus musculus
aaggctcccttgagtaccccatcga

SEQ ID NO: 508433 - DNA, 25 bp, Mus musculus
aaggctcccttgtgtaccccatcga

SEQ ID NO: 508434 - DNA, 25 bp, Mus musculus
aaggctccggttccctttgctccga

SEQ ID NO: 508435 - DNA, 25 bp, Mus musculus
aaggctccggttgcctttgctccga

SEQ ID NO: 508436 - DNA, 25 bp, Mus musculus
aaggctcctagcacttgcagttgca

SEQ ID NO: 508437 - DNA, 25 bp, Mus musculus
aaggctcctagctcttgcagttgca

SEQ ID NO: 508438 - DNA, 25 bp, Mus musculus
aaggctcgagagcaaatggcaaaaa

SEQ ID NO: 508439 - DNA, 25 bp, Mus musculus
aaggctcgagaggaaatggcaaaaa

SEQ ID NO: 508440 - DNA, 25 bp, Mus musculus
aaggctcgagtccagcaagttcagg

SEQ ID NO: 508441 - DNA, 25 bp, Mus musculus
aaggctcgagtcgagcaagttcagg

SEQ ID NO: 508442 - DNA, 25 bp, Mus musculus
aaggctctgcagaggcacccagaca

SEQ ID NO: 508443 - DNA, 25 bp, Mus musculus
aaggctctgcagtggcacccagaca

SEQ ID NO: 508444 - DNA, 25 bp, Mus musculus
aaggctctgctcaacgtggtggaca

SEQ ID NO: 508445 - DNA, 25 bp, Mus musculus
aaggctctgctctacgtggtggaca

SEQ ID NO: 508446 - DNA, 25 bp, Mus musculus
aaggctctgggcatccagttccact

SEQ ID NO: 508447 - DNA, 25 bp, Mus musculus
aaggctctgggcttccagttccact

SEQ ID NO: 508448 - DNA, 25 bp, Mus musculus
aaggctcttaacagcttccgcggaa

SEQ ID NO: 508449 - DNA, 25 bp, Mus musculus
aaggctcttaactgcttccgcggaa

SEQ ID NO: 508450 - DNA, 25 bp, Mus musculus
aaggctcttcacagcagcattcgtt

SEQ ID NO: 508451 - DNA, 25 bp, Mus musculus
aaggctcttcactgcagcattcgtt

SEQ ID NO: 508452 - DNA, 25 bp, Mus musculus
aaggctctttctagtggatatatca

SEQ ID NO: 508453 - DNA, 25 bp, Mus musculus
aaggctctttcttgtggatatatca

SEQ ID NO: 508454 - DNA, 25 bp, Mus musculus
aaggctgaaatgacccatatcccac

SEQ ID NO: 508455 - DNA, 25 bp, Mus musculus
aaggctgaaatgtcccatatcccac

SEQ ID NO: 508456 - DNA, 25 bp, Mus musculus
aaggctgacactaacggaccaaggc

SEQ ID NO: 508457 - DNA, 25 bp, Mus musculus
aaggctgacacttacggaccaaggc

SEQ ID NO: 508458 - DNA, 25 bp, Mus musculus
aaggctgaggagaaccagacacccg

SEQ ID NO: 508459 - DNA, 25 bp, Mus musculus
aaggctgaggagtaccagacacccg

SEQ ID NO: 508460 - DNA, 25 bp, Mus musculus
aaggctgcacaaaggaattcctcac

SEQ ID NO: 508461 - DNA, 25 bp, Mus musculus
aaggctgcacaatggaattcctcac

SEQ ID NO: 508462 - DNA, 25 bp, Mus musculus
aaggctgcacgtcgaagttcgctcg

SEQ ID NO: 508463 - DNA, 25 bp, Mus musculus
aaggctgcacgtggaagttcgctcg

SEQ ID NO: 508464 - DNA, 25 bp, Mus musculus
aaggctgcatgacagcacttgtggc

SEQ ID NO: 508465 - DNA, 25 bp, Mus musculus
aaggctgcatgagagcacttgtggc

SEQ ID NO: 508466 - DNA, 25 bp, Mus musculus
aaggctgctcttcctcttctttctg

SEQ ID NO: 508467 - DNA, 25 bp, Mus musculus
aaggctgctcttgctcttctttctg

SEQ ID NO: 508468 - DNA, 25 bp, Mus musculus
aaggctgcttccattgctcccggtg

SEQ ID NO: 508469 - DNA, 25 bp, Mus musculus
aaggctgcttcctttgctcccggtg

SEQ ID NO: 508470 - DNA, 25 bp, Mus musculus
aaggctgctttgcacaggtggtcat

SEQ ID NO: 508471 - DNA, 25 bp, Mus musculus
aaggctgctttggacaggtggtcat

SEQ ID NO: 508472 - DNA, 25 bp, Mus musculus
aaggctgcttttccagctggctgac

SEQ ID NO: 508473 - DNA, 25 bp, Mus musculus
aaggctgcttttgcagctggctgac

SEQ ID NO: 508474 - DNA, 25 bp, Mus musculus
aaggctggaagacacctgctgtacc

SEQ ID NO: 508475 - DNA, 25 bp, Mus musculus
aaggctggaagagacctgctgtacc

SEQ ID NO: 508476 - DNA, 25 bp, Mus musculus
aaggctggacacatacctgtcaaca

SEQ ID NO: 508477 - DNA, 25 bp, Mus musculus
aaggctggacacttacctgtcaaca

SEQ ID NO: 508478 - DNA, 25 bp, Mus musculus
aaggctggacgtcctcatccacaat

SEQ ID NO: 508479 - DNA, 25 bp, Mus musculus
aaggctggacgtgctcatccacaat

SEQ ID NO: 508480 - DNA, 25 bp, Mus musculus
aaggctggactccaggtggcatcca

SEQ ID NO: 508481 - DNA, 25 bp, Mus musculus
aaggctggactcgaggtggcatcca

SEQ ID NO: 508482 - DNA, 25 bp, Mus musculus
aaggctggagccacaaatatcgggc

SEQ ID NO: 508483 - DNA, 25 bp, Mus musculus
aaggctggagccacgctggacatcc

SEQ ID NO: 508484 - DNA, 25 bp, Mus musculus
aaggctggagcctcaaatatcgggc

SEQ ID NO: 508485 - DNA, 25 bp, Mus musculus
aaggctggagcctcgctggacatcc

SEQ ID NO: 508486 - DNA, 25 bp, Mus musculus
aaggctggcacaaggggaacagtct

SEQ ID NO: 508487 - DNA, 25 bp, Mus musculus
aaggctggcacatggggaacagtct

SEQ ID NO: 508488 - DNA, 25 bp, Mus musculus
aaggctggctccacccagaggacag

SEQ ID NO: 508489 - DNA, 25 bp, Mus musculus
aaggctggctcctcccagaggacag

SEQ ID NO: 508490 - DNA, 25 bp, Mus musculus
aaggctgggactcgacctctgctct

SEQ ID NO: 508491 - DNA, 25 bp, Mus musculus
aaggctgggactggacctctgctct

SEQ ID NO: 508492 - DNA, 25 bp, Mus musculus
aaggctgggcccagcgtgatcaatg

SEQ ID NO: 508493 - DNA, 25 bp, Mus musculus
aaggctgggccctgcgtgatcaatg

SEQ ID NO: 508494 - DNA, 25 bp, Mus musculus
aaggctggtgtcagcacttgggcct

SEQ ID NO: 508495 - DNA, 25 bp, Mus musculus
aaggctggtgtctgcacttgggcct

SEQ ID NO: 508496 - DNA, 25 bp, Mus musculus
aaggctgtaaagcagccatcagaga

SEQ ID NO: 508497 - DNA, 25 bp, Mus musculus
aaggctgtaaaggagccatcagaga

SEQ ID NO: 508498 - DNA, 25 bp, Mus musculus
aaggctgtccgtctcttgcccgatc

SEQ ID NO: 508499 - DNA, 25 bp, Mus musculus
aaggctgtccgtgtcttgcccgatc

SEQ ID NO: 508500 - DNA, 25 bp, Mus musculus
aaggctgtcgaacccttgtatacag

SEQ ID NO: 508501 - DNA, 25 bp, Mus musculus
aaggctgtcgaagccttgtatacag

SEQ ID NO: 508502 - DNA, 25 bp, Mus musculus
aaggctgtctggcttcctctttcaa

SEQ ID NO: 508503 - DNA, 25 bp, Mus musculus
aaggctgtctgggttcctctttcaa

SEQ ID NO: 508504 - DNA, 25 bp, Mus musculus
aaggctgtgaatacagccccagtgc

SEQ ID NO: 508505 - DNA, 25 bp, Mus musculus
aaggctgtgaattcagccccagtgc

SEQ ID NO: 508506 - DNA, 25 bp, Mus musculus
aaggctgtgcgcctgcttctcaaca

SEQ ID NO: 508507 - DNA, 25 bp, Mus musculus
aaggctgtgcgcgtgcttctcaaca

SEQ ID NO: 508508 - DNA, 25 bp, Mus musculus
aaggctgtgcttcgcgtcttcggat

SEQ ID NO: 508509 - DNA, 25 bp, Mus musculus
aaggctgtgcttggcgtcttcggat

SEQ ID NO: 508510 - DNA, 25 bp, Mus musculus
aaggctgtggccctccgaagcctct

SEQ ID NO: 508511 - DNA, 25 bp, Mus musculus
aaggctgtggccgtccgaagcctct

SEQ ID NO: 508512 - DNA, 25 bp, Mus musculus
aaggctgtggtcaaactcgagcccc

SEQ ID NO: 508513 - DNA, 25 bp, Mus musculus
aaggctgtggtctaactcgagcccc

SEQ ID NO: 508514 - DNA, 25 bp, Mus musculus
aaggcttatcagcttggtcacaatc

SEQ ID NO: 508515 - DNA, 25 bp, Mus musculus
aaggcttatcaggttggtcacaatc

SEQ ID NO: 508516 - DNA, 25 bp, Mus musculus
aaggcttcacggcacccagctgtga

SEQ ID NO: 508517 - DNA, 25 bp, Mus musculus
aaggcttcacgggacccagctgtga

SEQ ID NO: 508518 - DNA, 25 bp, Mus musculus
aaggcttcagcacgccatggagatg

SEQ ID NO: 508519 - DNA, 25 bp, Mus musculus
aaggcttcagcaggccatggagatg

SEQ ID NO: 508520 - DNA, 25 bp, Mus musculus
aaggcttccatccacgaggcctgga

SEQ ID NO: 508521 - DNA, 25 bp, Mus musculus
aaggcttccatcgacgaggcctgga

SEQ ID NO: 508522 - DNA, 25 bp, Mus musculus
aaggcttcctccctgtggcggtgca

SEQ ID NO: 508523 - DNA, 25 bp, Mus musculus
aaggcttcctccgtgtggcggtgca

SEQ ID NO: 508524 - DNA, 25 bp, Mus musculus
aaggcttcgacacataccgctgcga

SEQ ID NO: 508525 - DNA, 25 bp, Mus musculus
aaggcttcgacagataccgctgcga

SEQ ID NO: 508526 - DNA, 25 bp, Mus musculus
aaggcttctaacaggtccactatag

SEQ ID NO: 508527 - DNA, 25 bp, Mus musculus
aaggcttctaactggtccactatag

SEQ ID NO: 508528 - DNA, 25 bp, Mus musculus
aaggcttctgtgaatggccagcaag

SEQ ID NO: 508529 - DNA, 25 bp, Mus musculus
aaggcttctgtgtatggccagcaag

SEQ ID NO: 508530 - DNA, 25 bp, Mus musculus
aaggcttgaaatcccctttgctgac

SEQ ID NO: 508531 - DNA, 25 bp, Mus musculus
aaggcttgaaatgccctttgctgac

SEQ ID NO: 508532 - DNA, 25 bp, Mus musculus
aaggcttgacgcagagcgacgccga

SEQ ID NO: 508533 - DNA, 25 bp, Mus musculus
aaggcttgacgctgagcgacgccga

SEQ ID NO: 508534 - DNA, 25 bp, Mus musculus
aaggcttgctaaaggatgggactga

SEQ ID NO: 508535 - DNA, 25 bp, Mus musculus
aaggcttgctaatggatgggactga

SEQ ID NO: 508536 - DNA, 25 bp, Mus musculus
aaggcttgctgaacaattttatcca

SEQ ID NO: 508537 - DNA, 25 bp, Mus musculus
aaggcttgctgatcaattttatcca

SEQ ID NO: 508538 - DNA, 25 bp, Mus musculus
aaggcttgttttcctcagggtccga

SEQ ID NO: 508539 - DNA, 25 bp, Mus musculus
aaggcttgttttgctcagggtccga

SEQ ID NO: 508540 - DNA, 25 bp, Mus musculus
aaggctttaagaatgtatcgctggg

SEQ ID NO: 508541 - DNA, 25 bp, Mus musculus
aaggctttaagattgtatcgctggg

SEQ ID NO: 508542 - DNA, 25 bp, Mus musculus
aaggctttcatgatggtgaccacaa

SEQ ID NO: 508543 - DNA, 25 bp, Mus musculus
aaggctttcatgttggtgaccacaa

SEQ ID NO: 508544 - DNA, 25 bp, Mus musculus
aaggctttgcctcacgaatttaagg

SEQ ID NO: 508545 - DNA, 25 bp, Mus musculus
aaggctttgcctgacgaatttaagg

SEQ ID NO: 508546 - DNA, 25 bp, Mus musculus
aaggcttttaccaggctccatctca

SEQ ID NO: 508547 - DNA, 25 bp, Mus musculus
aaggcttttacctggctccatctca

SEQ ID NO: 508548 - DNA, 25 bp, Mus musculus
aaggcttttggtaggaaatcactgc

SEQ ID NO: 508549 - DNA, 25 bp, Mus musculus
aaggcttttggttggaaatcactgc

SEQ ID NO: 508550 - DNA, 25 bp, Mus musculus
aagggaaactcgacggtgtatgagt

SEQ ID NO: 508551 - DNA, 25 bp, Mus musculus
aagggaaactcgtcggtgtatgagt

SEQ ID NO: 508552 - DNA, 25 bp, Mus musculus
aagggaaattttcaagctgctgtga

SEQ ID NO: 508553 - DNA, 25 bp, Mus musculus
aagggaaattttgaagctgctgtga

SEQ ID NO: 508554 - DNA, 25 bp, Mus musculus
aagggaaccccaacaactgcaaggc

SEQ ID NO: 508555 - DNA, 25 bp, Mus musculus
aagggaaccccatcaactgcaaggc

SEQ ID NO: 508556 - DNA, 25 bp, Mus musculus
aagggaaccgccagctttcggctgc

SEQ ID NO: 508557 - DNA, 25 bp, Mus musculus
aagggaaccgcctgctttcggctgc

SEQ ID NO: 508558 - DNA, 25 bp, Mus musculus
aagggaactataagataaaggaggg

SEQ ID NO: 508559 - DNA, 25 bp, Mus musculus
aagggaactatatgataaaggaggg

SEQ ID NO: 508560 - DNA, 25 bp, Mus musculus
aagggaagagcacacaagaacttct

SEQ ID NO: 508561 - DNA, 25 bp, Mus musculus
aagggaagagcagacaagaacttct

SEQ ID NO: 508562 - DNA, 25 bp, Mus musculus
aagggaagcacactttgggacaaca

SEQ ID NO: 508563 - DNA, 25 bp, Mus musculus
aagggaagcacagtttgggacaaca

SEQ ID NO: 508564 - DNA, 25 bp, Mus musculus
aagggaaggcttcctctaccactga

SEQ ID NO: 508565 - DNA, 25 bp, Mus musculus
aagggaaggcttgctctaccactga

SEQ ID NO: 508566 - DNA, 25 bp, Mus musculus
aagggaatcaacaggagtgctgact

SEQ ID NO: 508567 - DNA, 25 bp, Mus musculus
aagggaatcaactggagtgctgact

SEQ ID NO: 508568 - DNA, 25 bp, Mus musculus
aagggaatccatctgccgcagctgg

SEQ ID NO: 508569 - DNA, 25 bp, Mus musculus
aagggaatccatgtgccgcagctgg

SEQ ID NO: 508570 - DNA, 25 bp, Mus musculus
aagggacaacctaacatcgatgagg

SEQ ID NO: 508571 - DNA, 25 bp, Mus musculus
aagggacaaccttacatcgatgagg

SEQ ID NO: 508572 - DNA, 25 bp, Mus musculus
aagggaccatggaccaaagaggaag

SEQ ID NO: 508573 - DNA, 25 bp, Mus musculus
aagggaccatggtccaaagaggaag

SEQ ID NO: 508574 - DNA, 25 bp, Mus musculus
aagggacccaccagctaggcctgag

SEQ ID NO: 508575 - DNA, 25 bp, Mus musculus
aagggacccacctgctaggcctgag

SEQ ID NO: 508576 - DNA, 25 bp, Mus musculus
aagggaccggacacctacaggcctg

SEQ ID NO: 508577 - DNA, 25 bp, Mus musculus
aagggaccggactcctacaggcctg

SEQ ID NO: 508578 - DNA, 25 bp, Mus musculus
aagggacggcttaattgacctgatg

SEQ ID NO: 508579 - DNA, 25 bp, Mus musculus
aagggacggctttattgacctgatg

SEQ ID NO: 508580 - DNA, 25 bp, Mus musculus
aagggactagctagcatctcagcac

SEQ ID NO: 508581 - DNA, 25 bp, Mus musculus
aagggactagcttgcatctcagcac

SEQ ID NO: 508582 - DNA, 25 bp, Mus musculus
aagggactcagccttctcgaacaga

SEQ ID NO: 508583 - DNA, 25 bp, Mus musculus
aagggactcagcgttctcgaacaga

SEQ ID NO: 508584 - DNA, 25 bp, Mus musculus
aagggactcctgaaccagggcctct

SEQ ID NO: 508585 - DNA, 25 bp, Mus musculus
aagggactcctgtaccagggcctct

SEQ ID NO: 508586 - DNA, 25 bp, Mus musculus
aagggactctggacactgtctctgc

SEQ ID NO: 508587 - DNA, 25 bp, Mus musculus
aagggactctggtcactgtctctgc

SEQ ID NO: 508588 - DNA, 25 bp, Mus musculus
aagggactgtccacgttcatgcgcg

SEQ ID NO: 508589 - DNA, 25 bp, Mus musculus
aagggactgtcctcgttcatgcgcg

SEQ ID NO: 508590 - DNA, 25 bp, Mus musculus
aagggagaatacagggtgagctaca

SEQ ID NO: 508591 - DNA, 25 bp, Mus musculus
aagggagaatactgggtgagctaca

SEQ ID NO: 508592 - DNA, 25 bp, Mus musculus
aagggagaatctcatgggatcagta

SEQ ID NO: 508593 - DNA, 25 bp, Mus musculus
aagggagaatctgatgggatcagta

SEQ ID NO: 508594 - DNA, 25 bp, Mus musculus
aagggagagcctccatcaggcaaaa

SEQ ID NO: 508595 - DNA, 25 bp, Mus musculus
aagggagagcctgcatcaggcaaaa

SEQ ID NO: 508596 - DNA, 25 bp, Mus musculus
aagggagagctaatatcttctgtga

SEQ ID NO: 508597 - DNA, 25 bp, Mus musculus
aagggagagctattatcttctgtga

SEQ ID NO: 508598 - DNA, 25 bp, Mus musculus
aagggagagcttatccaacagagag

SEQ ID NO: 508599 - DNA, 25 bp, Mus musculus
aagggagagcttttccaacagagag

SEQ ID NO: 508600 - DNA, 25 bp, Mus musculus
aagggagagtttactggctatcatc

SEQ ID NO: 508601 - DNA, 25 bp, Mus musculus
aagggagagttttctggctatcatc

SEQ ID NO: 508602 - DNA, 25 bp, Mus musculus
aagggagattttatgacctgtacag

SEQ ID NO: 508603 - DNA, 25 bp, Mus musculus
aagggagattttttgacctgtacag

SEQ ID NO: 508604 - DNA, 25 bp, Mus musculus
aagggagcagacagagcagagcact

SEQ ID NO: 508605 - DNA, 25 bp, Mus musculus
aagggagcagactgagcagagcact

SEQ ID NO: 508606 - DNA, 25 bp, Mus musculus
aagggagccagcaaagggccacctg

SEQ ID NO: 508607 - DNA, 25 bp, Mus musculus
aagggagccagctaagggccacctg

SEQ ID NO: 508608 - DNA, 25 bp, Mus musculus
aagggagcctgcacttggacctggc

SEQ ID NO: 508609 - DNA, 25 bp, Mus musculus
aagggagcctgctcttggacctggc

SEQ ID NO: 508610 - DNA, 25 bp, Mus musculus
aagggagcgtaacctgcattcccgg

SEQ ID NO: 508611 - DNA, 25 bp, Mus musculus
aagggagcgtaagctgcattcccgg

SEQ ID NO: 508612 - DNA, 25 bp, Mus musculus
aagggagctgccactccagctaagg

SEQ ID NO: 508613 - DNA, 25 bp, Mus musculus
aagggagctgcctctccagctaagg

SEQ ID NO: 508614 - DNA, 25 bp, Mus musculus
aagggagctgtacaagatctagttc

SEQ ID NO: 508615 - DNA, 25 bp, Mus musculus
aagggagctgtagaagatctagttc

SEQ ID NO: 508616 - DNA, 25 bp, Mus musculus
aagggagcttctacaaacaggccaa

SEQ ID NO: 508617 - DNA, 25 bp, Mus musculus
aagggagcttcttcaaacaggccaa

SEQ ID NO: 508618 - DNA, 25 bp, Mus musculus
aagggagtgacccacatcagagtcg

SEQ ID NO: 508619 - DNA, 25 bp, Mus musculus
aagggagtgaccgacatcagagtcg

SEQ ID NO: 508620 - DNA, 25 bp, Mus musculus
aagggatcgcctagggaaagagcct

SEQ ID NO: 508621 - DNA, 25 bp, Mus musculus
aagggatcgccttgggaaagagcct

SEQ ID NO: 508622 - DNA, 25 bp, Mus musculus
aagggattctccctggcgctgctac

SEQ ID NO: 508623 - DNA, 25 bp, Mus musculus
aagggattctccgtggcgctgctac

SEQ ID NO: 508624 - DNA, 25 bp, Mus musculus
aagggcaagtgtccggtgatcaaaa

SEQ ID NO: 508625 - DNA, 25 bp, Mus musculus
aagggcaagtgtgcggtgatcaaaa

SEQ ID NO: 508626 - DNA, 25 bp, Mus musculus
aagggcaatctcaaccgctgcattg

SEQ ID NO: 508627 - DNA, 25 bp, Mus musculus
aagggcaatctctaccgctgcattg

SEQ ID NO: 508628 - DNA, 25 bp, Mus musculus
aagggcacagtgcagatcaagacac

SEQ ID NO: 508629 - DNA, 25 bp, Mus musculus
aagggcacagtggagatcaagacac

SEQ ID NO: 508630 - DNA, 25 bp, Mus musculus
aagggcaccaagcagccactgctgg

SEQ ID NO: 508631 - DNA, 25 bp, Mus musculus
aagggcaccaaggagccactgctgg

SEQ ID NO: 508632 - DNA, 25 bp, Mus musculus
aagggcaccaccaaagccttcgata

SEQ ID NO: 508633 - DNA, 25 bp, Mus musculus
aagggcaccacctaagccttcgata

SEQ ID NO: 508634 - DNA, 25 bp, Mus musculus
aagggcacgtggaacaacatgcaga

SEQ ID NO: 508635 - DNA, 25 bp, Mus musculus
aagggcacgtggtacaacatgcaga

SEQ ID NO: 508636 - DNA, 25 bp, Mus musculus
aagggcagcagccatgctaatcaag

SEQ ID NO: 508637 - DNA, 25 bp, Mus musculus
aagggcagcagcgatgctaatcaag

SEQ ID NO: 508638 - DNA, 25 bp, Mus musculus
aagggcatgtctagcttactgacca

SEQ ID NO: 508639 - DNA, 25 bp, Mus musculus
aagggcatgtcttgcttactgacca

SEQ ID NO: 508640 - DNA, 25 bp, Mus musculus
aagggccaagcaagaccagcagttc

SEQ ID NO: 508641 - DNA, 25 bp, Mus musculus
aagggccaagcatgaccagcagttc

SEQ ID NO: 508642 - DNA, 25 bp, Mus musculus
aagggccaagtgcccaatgtcatcc

SEQ ID NO: 508643 - DNA, 25 bp, Mus musculus
aagggccaagtggccaatgtcatcc

SEQ ID NO: 508644 - DNA, 25 bp, Mus musculus
aagggccacctgagcaagtccagga

SEQ ID NO: 508645 - DNA, 25 bp, Mus musculus
aagggccacctgtgcaagtccagga

SEQ ID NO: 508646 - DNA, 25 bp, Mus musculus
aagggccagccacattctagaagtg

SEQ ID NO: 508647 - DNA, 25 bp, Mus musculus
aagggccagccagattctagaagtg

SEQ ID NO: 508648 - DNA, 25 bp, Mus musculus
aagggccagggaactgtaagcctca

SEQ ID NO: 508649 - DNA, 25 bp, Mus musculus
aagggccagggatctgtaagcctca

SEQ ID NO: 508650 - DNA, 25 bp, Mus musculus
aagggccaggtcatctcttgtatcc

SEQ ID NO: 508651 - DNA, 25 bp, Mus musculus
aagggccaggtcttctcttgtatcc

SEQ ID NO: 508652 - DNA, 25 bp, Mus musculus
aagggccatcacctgccttgtgtgg

SEQ ID NO: 508653 - DNA, 25 bp, Mus musculus
aagggccatcacgtgccttgtgtgg

SEQ ID NO: 508654 - DNA, 25 bp, Mus musculus
aagggccatgataggacacaccgac

SEQ ID NO: 508655 - DNA, 25 bp, Mus musculus
aagggccatgattggacacaccgac

SEQ ID NO: 508656 - DNA, 25 bp, Mus musculus
aagggcccagcgaggcgctcaccgt

SEQ ID NO: 508657 - DNA, 25 bp, Mus musculus
aagggcccagcgtggcgctcaccgt

SEQ ID NO: 508658 - DNA, 25 bp, Mus musculus
aagggcccttgaccctgcttcaggg

SEQ ID NO: 508659 - DNA, 25 bp, Mus musculus
aagggcccttgagcctgcttcaggg

SEQ ID NO: 508660 - DNA, 25 bp, Mus musculus
aagggccgaaacagcttctacacac

SEQ ID NO: 508661 - DNA, 25 bp, Mus musculus
aagggccgaaactgcttctacacac

SEQ ID NO: 508662 - DNA, 25 bp, Mus musculus
aagggccgctgcactcagggtttca

SEQ ID NO: 508663 - DNA, 25 bp, Mus musculus
aagggccgctgctctcagggtttca

SEQ ID NO: 508664 - DNA, 25 bp, Mus musculus
aagggcctcccacatcagctgaaac

SEQ ID NO: 508665 - DNA, 25 bp, Mus musculus
aagggcctcccagatcagctgaaac

SEQ ID NO: 508666 - DNA, 25 bp, Mus musculus
aagggcctgagactgtagagcctct

SEQ ID NO: 508667 - DNA, 25 bp, Mus musculus
aagggcctgagagtgtagagcctct

SEQ ID NO: 508668 - DNA, 25 bp, Mus musculus
aagggcctgcctatgtcacgtggca

SEQ ID NO: 508669 - DNA, 25 bp, Mus musculus
aagggcctgcctttgtcacgtggca

SEQ ID NO: 508670 - DNA, 25 bp, Mus musculus
aagggcctgggcactgtacatatct

SEQ ID NO: 508671 - DNA, 25 bp, Mus musculus
aagggcctgggctctgtacatatct

SEQ ID NO: 508672 - DNA, 25 bp, Mus musculus
aagggcgggtctacagaaccaggat

SEQ ID NO: 508673 - DNA, 25 bp, Mus musculus
aagggcgggtcttcagaaccaggat

SEQ ID NO: 508674 - DNA, 25 bp, Mus musculus
aagggcgtgactagcgacaagtgac

SEQ ID NO: 508675 - DNA, 25 bp, Mus musculus
aagggcgtgacttgcgacaagtgac

SEQ ID NO: 508676 - DNA, 25 bp, Mus musculus
aagggctaaatgacaggccacagtg

SEQ ID NO: 508677 - DNA, 25 bp, Mus musculus
aagggctaaatgtcaggccacagtg

SEQ ID NO: 508678 - DNA, 25 bp, Mus musculus
aagggctatggaattgtacactttg

SEQ ID NO: 508679 - DNA, 25 bp, Mus musculus
aagggctatggatttgtacactttg

SEQ ID NO: 508680 - DNA, 25 bp, Mus musculus
aagggctcagagactaaagttcctg

SEQ ID NO: 508681 - DNA, 25 bp, Mus musculus
aagggctcagagtctaaagttcctg

SEQ ID NO: 508682 - DNA, 25 bp, Mus musculus
aagggctcccggaccagtatgcaga

SEQ ID NO: 508683 - DNA, 25 bp, Mus musculus
aagggctcccggtccagtatgcaga

SEQ ID NO: 508684 - DNA, 25 bp, Mus musculus
aagggctcgatgactgccatgctga

SEQ ID NO: 508685 - DNA, 25 bp, Mus musculus
aagggctcgatgtctgccatgctga

SEQ ID NO: 508686 - DNA, 25 bp, Mus musculus
aagggctctgacctctaacatcaca

SEQ ID NO: 508687 - DNA, 25 bp, Mus musculus
aagggctctgacgtctaacatcaca

SEQ ID NO: 508688 - DNA, 25 bp, Mus musculus
aagggctctgctactaaggcaacaa

SEQ ID NO: 508689 - DNA, 25 bp, Mus musculus
aagggctctgcttctaaggcaacaa

SEQ ID NO: 508690 - DNA, 25 bp, Mus musculus
aagggctgactacgaagcaccacct

SEQ ID NO: 508691 - DNA, 25 bp, Mus musculus
aagggctgactaggaagcaccacct

SEQ ID NO: 508692 - DNA, 25 bp, Mus musculus
aagggctgatgacgaccctggacaa

SEQ ID NO: 508693 - DNA, 25 bp, Mus musculus
aagggctgatgaggaccctggacaa

SEQ ID NO: 508694 - DNA, 25 bp, Mus musculus
aagggctggaacagcctctgcgtac

SEQ ID NO: 508695 - DNA, 25 bp, Mus musculus
aagggctggaactgcctctgcgtac

SEQ ID NO: 508696 - DNA, 25 bp, Mus musculus
aagggctggcatcccatggtggcct

SEQ ID NO: 508697 - DNA, 25 bp, Mus musculus
aagggctggcatgccatggtggcct

SEQ ID NO: 508698 - DNA, 25 bp, Mus musculus
aagggcttatggcagggactttcct

SEQ ID NO: 508699 - DNA, 25 bp, Mus musculus
aagggcttatgggagggactttcct

SEQ ID NO: 508700 - DNA, 25 bp, Mus musculus
aagggcttctttcggcaggccatca

SEQ ID NO: 508701 - DNA, 25 bp, Mus musculus
aagggcttctttgggcaggccatca

SEQ ID NO: 508702 - DNA, 25 bp, Mus musculus
aagggcttgcagaacaccttaaagg

SEQ ID NO: 508703 - DNA, 25 bp, Mus musculus
aagggcttgcagtacaccttaaagg

SEQ ID NO: 508704 - DNA, 25 bp, Mus musculus
aagggctttaccacggcagtccagt

SEQ ID NO: 508705 - DNA, 25 bp, Mus musculus
aagggctttacctcggcagtccagt

SEQ ID NO: 508706 - DNA, 25 bp, Mus musculus
aagggctttccacgtgtcgccgccg

SEQ ID NO: 508707 - DNA, 25 bp, Mus musculus
aagggctttccaggtgtcgccgccg

SEQ ID NO: 508708 - DNA, 25 bp, Mus musculus
aagggtaagcctctatcaagctgac

SEQ ID NO: 508709 - DNA, 25 bp, Mus musculus
aagggtaagcctgtatcaagctgac

SEQ ID NO: 508710 - DNA, 25 bp, Mus musculus
aagggtatgctgcaaaactttctgg

SEQ ID NO: 508711 - DNA, 25 bp, Mus musculus
aagggtatgctggaaaactttctgg

SEQ ID NO: 508712 - DNA, 25 bp, Mus musculus
aagggtatgggcagtagccaattac

SEQ ID NO: 508713 - DNA, 25 bp, Mus musculus
aagggtatgggctgtagccaattac

SEQ ID NO: 508714 - DNA, 25 bp, Mus musculus
aagggtcaccacactacaccatcta

SEQ ID NO: 508715 - DNA, 25 bp, Mus musculus
aagggtcaccactctacaccatcta

SEQ ID NO: 508716 - DNA, 25 bp, Mus musculus
aagggtcatggactgcctaaagaag

SEQ ID NO: 508717 - DNA, 25 bp, Mus musculus
aagggtcatggagtgcctaaagaag

SEQ ID NO: 508718 - DNA, 25 bp, Mus musculus
aagggtcccaagacggagccaatgt

SEQ ID NO: 508719 - DNA, 25 bp, Mus musculus
aagggtcccaagtcggagccaatgt

SEQ ID NO: 508720 - DNA, 25 bp, Mus musculus
aagggtcccctgagcaaacgagagg

SEQ ID NO: 508721 - DNA, 25 bp, Mus musculus
aagggtcccctgtgcaaacgagagg

SEQ ID NO: 508722 - DNA, 25 bp, Mus musculus
aagggtcgtctaatccagctgggca

SEQ ID NO: 508723 - DNA, 25 bp, Mus musculus
aagggtcgtctattccagctgggca

SEQ ID NO: 508724 - DNA, 25 bp, Mus musculus
aagggtctcacaccattgctcagtg

SEQ ID NO: 508725 - DNA, 25 bp, Mus musculus
aagggtctcacagcattgctcagtg

SEQ ID NO: 508726 - DNA, 25 bp, Mus musculus
aagggtgaccgcctgactaggactt

SEQ ID NO: 508727 - DNA, 25 bp, Mus musculus
aagggtgaccgcgtgactaggactt

SEQ ID NO: 508728 - DNA, 25 bp, Mus musculus
aagggtgatccgatctgaagatgga

SEQ ID NO: 508729 - DNA, 25 bp, Mus musculus
aagggtgatccgttctgaagatgga

SEQ ID NO: 508730 - DNA, 25 bp, Mus musculus
aagggtgcctggagtccacctttgg

SEQ ID NO: 508731 - DNA, 25 bp, Mus musculus
aagggtgcctggtgtccacctttgg

SEQ ID NO: 508732 - DNA, 25 bp, Mus musculus
aagggtgcgtgtcctgcctgcacat

SEQ ID NO: 508733 - DNA, 25 bp, Mus musculus
aagggtgcgtgtgctgcctgcacat

SEQ ID NO: 508734 - DNA, 25 bp, Mus musculus
aagggtgggctcaacatcgtcacag

SEQ ID NO: 508735 - DNA, 25 bp, Mus musculus
aagggtgggctctacatcgtcacag

SEQ ID NO: 508736 - DNA, 25 bp, Mus musculus
aagggttacttcagttcatccaaga

SEQ ID NO: 508737 - DNA, 25 bp, Mus musculus
aagggttacttctgttcatccaaga

SEQ ID NO: 508738 - DNA, 25 bp, Mus musculus
aagggttagcaacgccagattttca

SEQ ID NO: 508739 - DNA, 25 bp, Mus musculus
aagggttagcaaggccagattttca

SEQ ID NO: 508740 - DNA, 25 bp, Mus musculus
aagggttatctgatacactgccagc

SEQ ID NO: 508741 - DNA, 25 bp, Mus musculus
aagggttatctgttacactgccagc

SEQ ID NO: 508742 - DNA, 25 bp, Mus musculus
aagggttcaaatccccacgagcaag

SEQ ID NO: 508743 - DNA, 25 bp, Mus musculus
aagggttcaaatgcccacgagcaag

SEQ ID NO: 508744 - DNA, 25 bp, Mus musculus
aagggttcaagcactcaggactctg

SEQ ID NO: 508745 - DNA, 25 bp, Mus musculus
aagggttcaagctctcaggactctg

SEQ ID NO: 508746 - DNA, 25 bp, Mus musculus
aagggttcagctatccagcgtgcac

SEQ ID NO: 508747 - DNA, 25 bp, Mus musculus
aagggttcagctttccagcgtgcac

SEQ ID NO: 508748 - DNA, 25 bp, Mus musculus
aagggttccatgacgccatcctcct

SEQ ID NO: 508749 - DNA, 25 bp, Mus musculus
aagggttccatgtcgccatcctcct

SEQ ID NO: 508750 - DNA, 25 bp, Mus musculus
aagggttgaggtcctggacaatact

SEQ ID NO: 508751 - DNA, 25 bp, Mus musculus
aagggttgaggtgctggacaatact

SEQ ID NO: 508752 - DNA, 25 bp, Mus musculus
aagggttggcggagctcaacagttc

SEQ ID NO: 508753 - DNA, 25 bp, Mus musculus
aagggttggcggtgctcaacagttc

SEQ ID NO: 508754 - DNA, 25 bp, Mus musculus
aagggtttcaagagccctatgtcac

SEQ ID NO: 508755 - DNA, 25 bp, Mus musculus
aagggtttcaagtgccctatgtcac

SEQ ID NO: 508756 - DNA, 25 bp, Mus musculus
aagggtttccggcatgcttcatccg

SEQ ID NO: 508757 - DNA, 25 bp, Mus musculus
aagggtttccgggatgcttcatccg

SEQ ID NO: 508758 - DNA, 25 bp, Mus musculus
aaggtaaatcaacatgaatatccag

SEQ ID NO: 508759 - DNA, 25 bp, Mus musculus
aaggtaaatcaagatgaatatccag

SEQ ID NO: 508760 - DNA, 25 bp, Mus musculus
aaggtaatctacactggctatgcca

SEQ ID NO: 508761 - DNA, 25 bp, Mus musculus
aaggtaatctactctggctatgcca

SEQ ID NO: 508762 - DNA, 25 bp, Mus musculus
aaggtaatgccacgatgatggcacc

SEQ ID NO: 508763 - DNA, 25 bp, Mus musculus
aaggtaatgccaggatgatggcacc

SEQ ID NO: 508764 - DNA, 25 bp, Mus musculus
aaggtaatggcaattggagttctct

SEQ ID NO: 508765 - DNA, 25 bp, Mus musculus
aaggtaatggcatttggagttctct

SEQ ID NO: 508766 - DNA, 25 bp, Mus musculus
aaggtacgcttgcatcctccctgca

SEQ ID NO: 508767 - DNA, 25 bp, Mus musculus
aaggtacgcttggatcctccctgca

SEQ ID NO: 508768 - DNA, 25 bp, Mus musculus
aaggtactggcacaaagcctggcag

SEQ ID NO: 508769 - DNA, 25 bp, Mus musculus
aaggtactggcagaaagcctggcag

SEQ ID NO: 508770 - DNA, 25 bp, Mus musculus
aaggtactgggcacctttagctggg

SEQ ID NO: 508771 - DNA, 25 bp, Mus musculus
aaggtactgggctcctttagctggg

SEQ ID NO: 508772 - DNA, 25 bp, Mus musculus
aaggtacttgctctactagcctaga

SEQ ID NO: 508773 - DNA, 25 bp, Mus musculus
aaggtacttgctgtactagcctaga

SEQ ID NO: 508774 - DNA, 25 bp, Mus musculus
aaggtagacatgctacaccagaagc

SEQ ID NO: 508775 - DNA, 25 bp, Mus musculus
aaggtagacatggtacaccagaagc

SEQ ID NO: 508776 - DNA, 25 bp, Mus musculus
aaggtagtggccatcagtccggtca

SEQ ID NO: 508777 - DNA, 25 bp, Mus musculus
aaggtagtggccttcagtccggtca

SEQ ID NO: 508778 - DNA, 25 bp, Mus musculus
aaggtatcccttatcctgtcggcat

SEQ ID NO: 508779 - DNA, 25 bp, Mus musculus
aaggtatcccttttcctgtcggcat

SEQ ID NO: 508780 - DNA, 25 bp, Mus musculus
aaggtattagatatcttggaactgg

SEQ ID NO: 508781 - DNA, 25 bp, Mus musculus
aaggtattagatttcttggaactgg

SEQ ID NO: 508782 - DNA, 25 bp, Mus musculus
aaggtattcacaccgcctctgcctg

SEQ ID NO: 508783 - DNA, 25 bp, Mus musculus
aaggtattcacagcgcctctgcctg

SEQ ID NO: 508784 - DNA, 25 bp, Mus musculus
aaggtattggcaagagacagtttct

SEQ ID NO: 508785 - DNA, 25 bp, Mus musculus
aaggtattggcatgagacagtttct

SEQ ID NO: 508786 - DNA, 25 bp, Mus musculus
aaggtattgggtcccttcagctggg

SEQ ID NO: 508787 - DNA, 25 bp, Mus musculus
aaggtattgggtgccttcagctggg

SEQ ID NO: 508788 - DNA, 25 bp, Mus musculus
aaggtatttgccctctgggagtctg

SEQ ID NO: 508789 - DNA, 25 bp, Mus musculus
aaggtatttgccgtctgggagtctg

SEQ ID NO: 508790 - DNA, 25 bp, Mus musculus
aaggtattttgccaagcatccccga

SEQ ID NO: 508791 - DNA, 25 bp, Mus musculus
aaggtattttgcgaagcatccccga

SEQ ID NO: 508792 - DNA, 25 bp, Mus musculus
aaggtcaaagcgagtgtcatcctca

SEQ ID NO: 508793 - DNA, 25 bp, Mus musculus
aaggtcaaagcgtgtgtcatcctca

SEQ ID NO: 508794 - DNA, 25 bp, Mus musculus
aaggtcacaaagctgccatcacctc

SEQ ID NO: 508795 - DNA, 25 bp, Mus musculus
aaggtcacaaaggtgccatcacctc

SEQ ID NO: 508796 - DNA, 25 bp, Mus musculus
aaggtcacagccctccataaagcca

SEQ ID NO: 508797 - DNA, 25 bp, Mus musculus
aaggtcacagccgtccataaagcca

SEQ ID NO: 508798 - DNA, 25 bp, Mus musculus
aaggtcacctacagacagttgaaga

SEQ ID NO: 508799 - DNA, 25 bp, Mus musculus
aaggtcacctactgacagttgaaga

SEQ ID NO: 508800 - DNA, 25 bp, Mus musculus
aaggtcacgggcactctggatgcca

SEQ ID NO: 508801 - DNA, 25 bp, Mus musculus
aaggtcacgggctctctggatgcca

SEQ ID NO: 508802 - DNA, 25 bp, Mus musculus
aaggtcagagatatcctcactggag

SEQ ID NO: 508803 - DNA, 25 bp, Mus musculus
aaggtcagagatttcctcactggag

SEQ ID NO: 508804 - DNA, 25 bp, Mus musculus
aaggtcaggacccagtgtccatgct

SEQ ID NO: 508805 - DNA, 25 bp, Mus musculus
aaggtcaggaccgagtgtccatgct

SEQ ID NO: 508806 - DNA, 25 bp, Mus musculus
aaggtcatgagaagcgctgtttgcc

SEQ ID NO: 508807 - DNA, 25 bp, Mus musculus
aaggtcatgagatgcgctgtttgcc

SEQ ID NO: 508808 - DNA, 25 bp, Mus musculus
aaggtcattgctcagtgcacactca

SEQ ID NO: 508809 - DNA, 25 bp, Mus musculus
aaggtcattgctgagtgcacactca

SEQ ID NO: 508810 - DNA, 25 bp, Mus musculus
aaggtccaacgacctgaatctcagc

SEQ ID NO: 508811 - DNA, 25 bp, Mus musculus
aaggtccaacgagctgaatctcagc

SEQ ID NO: 508812 - DNA, 25 bp, Mus musculus
aaggtccacttcactgctgagcgca

SEQ ID NO: 508813 - DNA, 25 bp, Mus musculus
aaggtccacttctctgctgagcgca

SEQ ID NO: 508814 - DNA, 25 bp, Mus musculus
aaggtccagcccacgtctaggaggg

SEQ ID NO: 508815 - DNA, 25 bp, Mus musculus
aaggtccagccctcgtctaggaggg

SEQ ID NO: 508816 - DNA, 25 bp, Mus musculus
aaggtccaggagcagtcaaaatgat

SEQ ID NO: 508817 - DNA, 25 bp, Mus musculus
aaggtccaggagctagctcacgagc

SEQ ID NO: 508818 - DNA, 25 bp, Mus musculus
aaggtccaggaggagtcaaaatgat

SEQ ID NO: 508819 - DNA, 25 bp, Mus musculus
aaggtccaggaggtagctcacgagc

SEQ ID NO: 508820 - DNA, 25 bp, Mus musculus
aaggtcccagtgcttgtccacacta

SEQ ID NO: 508821 - DNA, 25 bp, Mus musculus
aaggtcccagtggttgtccacacta

SEQ ID NO: 508822 - DNA, 25 bp, Mus musculus
aaggtccccagtcatgcaaataagc

SEQ ID NO: 508823 - DNA, 25 bp, Mus musculus
aaggtccccagtccaagctcaggaa

SEQ ID NO: 508824 - DNA, 25 bp, Mus musculus
aaggtccccagtgatgcaaataagc

SEQ ID NO: 508825 - DNA, 25 bp, Mus musculus
aaggtccccagtgcaagctcaggaa

SEQ ID NO: 508826 - DNA, 25 bp, Mus musculus
aaggtccggaggatacagcttcgct

SEQ ID NO: 508827 - DNA, 25 bp, Mus musculus
aaggtccggaggttacagcttcgct

SEQ ID NO: 508828 - DNA, 25 bp, Mus musculus
aaggtcctacctctacacaggacgg

SEQ ID NO: 508829 - DNA, 25 bp, Mus musculus
aaggtcctacctgtacacaggacgg

SEQ ID NO: 508830 - DNA, 25 bp, Mus musculus
aaggtcctggatctcatgccgctga

SEQ ID NO: 508831 - DNA, 25 bp, Mus musculus
aaggtcctggatgtcatgccgctga

SEQ ID NO: 508832 - DNA, 25 bp, Mus musculus
aaggtcgccttgagcaaacgcaaag

SEQ ID NO: 508833 - DNA, 25 bp, Mus musculus
aaggtcgccttgtgcaaacgcaaag

SEQ ID NO: 508834 - DNA, 25 bp, Mus musculus
aaggtcgtctcgcagactagaggct

SEQ ID NO: 508835 - DNA, 25 bp, Mus musculus
aaggtcgtctcggagactagaggct

SEQ ID NO: 508836 - DNA, 25 bp, Mus musculus
aaggtctaccaccagcagtaccagg

SEQ ID NO: 508837 - DNA, 25 bp, Mus musculus
aaggtctaccacgagcagtaccagg

SEQ ID NO: 508838 - DNA, 25 bp, Mus musculus
aaggtctagttgattgtgatggaaa

SEQ ID NO: 508839 - DNA, 25 bp, Mus musculus
aaggtctagttgtttgtgatggaaa

SEQ ID NO: 508840 - DNA, 25 bp, Mus musculus
aaggtctcccatctgctaagtctgc

SEQ ID NO: 508841 - DNA, 25 bp, Mus musculus
aaggtctcccatgtgctaagtctgc

SEQ ID NO: 508842 - DNA, 25 bp, Mus musculus
aaggtctcggagagtcacgaggaaa

SEQ ID NO: 508843 - DNA, 25 bp, Mus musculus
aaggtctcggagtgtcacgaggaaa

SEQ ID NO: 508844 - DNA, 25 bp, Mus musculus
aaggtctctcgcatcccgcttaagc

SEQ ID NO: 508845 - DNA, 25 bp, Mus musculus
aaggtctctcgcttcccgcttaagc

SEQ ID NO: 508846 - DNA, 25 bp, Mus musculus
aaggtctgagcaaactcagcccctc

SEQ ID NO: 508847 - DNA, 25 bp, Mus musculus
aaggtctgagcatactcagcccctc

SEQ ID NO: 508848 - DNA, 25 bp, Mus musculus
aaggtctgcactcagaagattcaag

SEQ ID NO: 508849 - DNA, 25 bp, Mus musculus
aaggtctgcactgagaagattcaag

SEQ ID NO: 508850 - DNA, 25 bp, Mus musculus
aaggtctggatcatggagcctggca

SEQ ID NO: 508851 - DNA, 25 bp, Mus musculus
aaggtctggatcttggagcctggca

SEQ ID NO: 508852 - DNA, 25 bp, Mus musculus
aaggtctggccacactaaccggagc

SEQ ID NO: 508853 - DNA, 25 bp, Mus musculus
aaggtctggccagactaaccggagc

SEQ ID NO: 508854 - DNA, 25 bp, Mus musculus
aaggtcttacccacagctggatagg

SEQ ID NO: 508855 - DNA, 25 bp, Mus musculus
aaggtcttaccctcagctggatagg

SEQ ID NO: 508856 - DNA, 25 bp, Mus musculus
aaggtcttagccctgagtcaacaca

SEQ ID NO: 508857 - DNA, 25 bp, Mus musculus
aaggtcttagccgtgagtcaacaca

SEQ ID NO: 508858 - DNA, 25 bp, Mus musculus
aaggtcttccagctgctccccagct

SEQ ID NO: 508859 - DNA, 25 bp, Mus musculus
aaggtcttccaggtgctccccagct

SEQ ID NO: 508860 - DNA, 25 bp, Mus musculus
aaggtcttccatctgcaggctgcgt

SEQ ID NO: 508861 - DNA, 25 bp, Mus musculus
aaggtcttccatgtgcaggctgcgt

SEQ ID NO: 508862 - DNA, 25 bp, Mus musculus
aaggtcttccccactagccctagtg

SEQ ID NO: 508863 - DNA, 25 bp, Mus musculus
aaggtcttcccctctagccctagtg

SEQ ID NO: 508864 - DNA, 25 bp, Mus musculus
aaggtcttctttatcggcagtgtac

SEQ ID NO: 508865 - DNA, 25 bp, Mus musculus
aaggtcttctttttcggcagtgtac

SEQ ID NO: 508866 - DNA, 25 bp, Mus musculus
aaggtcttgagcatccccgtgcaga

SEQ ID NO: 508867 - DNA, 25 bp, Mus musculus
aaggtcttgagcttccccgtgcaga

SEQ ID NO: 508868 - DNA, 25 bp, Mus musculus
aaggtctttgggagcaagttcacac

SEQ ID NO: 508869 - DNA, 25 bp, Mus musculus
aaggtctttgggtgcaagttcacac

SEQ ID NO: 508870 - DNA, 25 bp, Mus musculus
aaggtgaaattactacattctcaga

SEQ ID NO: 508871 - DNA, 25 bp, Mus musculus
aaggtgaaattagtacattctcaga

SEQ ID NO: 508872 - DNA, 25 bp, Mus musculus
aaggtgaagcagattgacttcctct

SEQ ID NO: 508873 - DNA, 25 bp, Mus musculus
aaggtgaagcagtttgacttcctct

SEQ ID NO: 508874 - DNA, 25 bp, Mus musculus
aaggtgaaggcgactatctggatga

SEQ ID NO: 508875 - DNA, 25 bp, Mus musculus
aaggtgaaggcgtctatctggatga

SEQ ID NO: 508876 - DNA, 25 bp, Mus musculus
aaggtgaatagtagtggcggtcaca

SEQ ID NO: 508877 - DNA, 25 bp, Mus musculus
aaggtgaatagttgtggcggtcaca

SEQ ID NO: 508878 - DNA, 25 bp, Mus musculus
aaggtgaatgatagctgcccgtccc

SEQ ID NO: 508879 - DNA, 25 bp, Mus musculus
aaggtgaatgattgctgcccgtccc

SEQ ID NO: 508880 - DNA, 25 bp, Mus musculus
aaggtgaatggaatctctaacaact

SEQ ID NO: 508881 - DNA, 25 bp, Mus musculus
aaggtgaatggattctctaacaact

SEQ ID NO: 508882 - DNA, 25 bp, Mus musculus
aaggtgaccatcacctttgccactg

SEQ ID NO: 508883 - DNA, 25 bp, Mus musculus
aaggtgaccatctcctttgccactg

SEQ ID NO: 508884 - DNA, 25 bp, Mus musculus
aaggtgaccgcgctagccagcactc

SEQ ID NO: 508885 - DNA, 25 bp, Mus musculus
aaggtgaccgcggtagccagcactc

SEQ ID NO: 508886 - DNA, 25 bp, Mus musculus
aaggtgactccaagaatgtggcaga

SEQ ID NO: 508887 - DNA, 25 bp, Mus musculus
aaggtgactccatgaatgtggcaga

SEQ ID NO: 508888 - DNA, 25 bp, Mus musculus
aaggtgactctgattctcatagctg

SEQ ID NO: 508889 - DNA, 25 bp, Mus musculus
aaggtgactctgtttctcatagctg

SEQ ID NO: 508890 - DNA, 25 bp, Mus musculus
aaggtgagatgaaccgacagcccag

SEQ ID NO: 508891 - DNA, 25 bp, Mus musculus
aaggtgagatgatccgacagcccag

SEQ ID NO: 508892 - DNA, 25 bp, Mus musculus
aaggtgatcattattcaggcatgcc

SEQ ID NO: 508893 - DNA, 25 bp, Mus musculus
aaggtgatcatttttcaggcatgcc

SEQ ID NO: 508894 - DNA, 25 bp, Mus musculus
aaggtgattgaaaatcgggctctaa

SEQ ID NO: 508895 - DNA, 25 bp, Mus musculus
aaggtgattgaatatcgggctctaa

SEQ ID NO: 508896 - DNA, 25 bp, Mus musculus
aaggtgcaaaccagggacatatccc

SEQ ID NO: 508897 - DNA, 25 bp, Mus musculus
aaggtgcaaacctgggacatatccc

SEQ ID NO: 508898 - DNA, 25 bp, Mus musculus
aaggtgcaacctattaatgtgacaa

SEQ ID NO: 508899 - DNA, 25 bp, Mus musculus
aaggtgcaaccttttaatgtgacaa

SEQ ID NO: 508900 - DNA, 25 bp, Mus musculus
aaggtgcaccatatctcattggaca

SEQ ID NO: 508901 - DNA, 25 bp, Mus musculus
aaggtgcaccatttctcattggaca

SEQ ID NO: 508902 - DNA, 25 bp, Mus musculus
aaggtgcagagtaacacgtgccatg

SEQ ID NO: 508903 - DNA, 25 bp, Mus musculus
aaggtgcagagttacacgtgccatg

SEQ ID NO: 508904 - DNA, 25 bp, Mus musculus
aaggtgcagccacttaggcagaagt

SEQ ID NO: 508905 - DNA, 25 bp, Mus musculus
aaggtgcagccagttaggcagaagt

SEQ ID NO: 508906 - DNA, 25 bp, Mus musculus
aaggtgccaacaaagtttctctgcc

SEQ ID NO: 508907 - DNA, 25 bp, Mus musculus
aaggtgccaacatagtttctctgcc

SEQ ID NO: 508908 - DNA, 25 bp, Mus musculus
aaggtgccacacctagagactccgg

SEQ ID NO: 508909 - DNA, 25 bp, Mus musculus
aaggtgccacacgtagagactccgg

SEQ ID NO: 508910 - DNA, 25 bp, Mus musculus
aaggtgcccgacagaggaagatcaa

SEQ ID NO: 508911 - DNA, 25 bp, Mus musculus
aaggtgcccgactgaggaagatcaa

SEQ ID NO: 508912 - DNA, 25 bp, Mus musculus
aaggtgcctctgatgctggctttcc

SEQ ID NO: 508913 - DNA, 25 bp, Mus musculus
aaggtgcctctgttgctggctttcc

SEQ ID NO: 508914 - DNA, 25 bp, Mus musculus
aaggtgctcaccacagcattgcttc

SEQ ID NO: 508915 - DNA, 25 bp, Mus musculus
aaggtgctcacctcagcattgcttc

SEQ ID NO: 508916 - DNA, 25 bp, Mus musculus
aaggtgctcacgctcgtgtgcagac

SEQ ID NO: 508917 - DNA, 25 bp, Mus musculus
aaggtgctcacggtcgtgtgcagac

SEQ ID NO: 508918 - DNA, 25 bp, Mus musculus
aaggtgctttcaactttgacaagga

SEQ ID NO: 508919 - DNA, 25 bp, Mus musculus
aaggtgctttcatctttgacaagga

SEQ ID NO: 508920 - DNA, 25 bp, Mus musculus
aaggtggaacggaacagagatagaa

SEQ ID NO: 508921 - DNA, 25 bp, Mus musculus
aaggtggaacggtacagagatagaa

SEQ ID NO: 508922 - DNA, 25 bp, Mus musculus
aaggtggactccacacgtgaccaag

SEQ ID NO: 508923 - DNA, 25 bp, Mus musculus
aaggtggactcctcacgtgaccaag

SEQ ID NO: 508924 - DNA, 25 bp, Mus musculus
aaggtggagataaagaggcacaatc

SEQ ID NO: 508925 - DNA, 25 bp, Mus musculus
aaggtggagatatagaggcacaatc

SEQ ID NO: 508926 - DNA, 25 bp, Mus musculus
aaggtggagatgcatgctctgatct

SEQ ID NO: 508927 - DNA, 25 bp, Mus musculus
aaggtggagatggatgctctgatct

SEQ ID NO: 508928 - DNA, 25 bp, Mus musculus
aaggtggcaatcagcaatccccctc

SEQ ID NO: 508929 - DNA, 25 bp, Mus musculus
aaggtggcaatctgcaatccccctc

SEQ ID NO: 508930 - DNA, 25 bp, Mus musculus
aaggtggccctcaccatcaagggag

SEQ ID NO: 508931 - DNA, 25 bp, Mus musculus
aaggtggccctctccatcaagggag

SEQ ID NO: 508932 - DNA, 25 bp, Mus musculus
aaggtggcctgcacagaccagagcg

SEQ ID NO: 508933 - DNA, 25 bp, Mus musculus
aaggtggcctgctcagaccagagcg

SEQ ID NO: 508934 - DNA, 25 bp, Mus musculus
aaggtggctctgaagaaagtgttga

SEQ ID NO: 508935 - DNA, 25 bp, Mus musculus
aaggtggctctgtagaaagtgttga

SEQ ID NO: 508936 - DNA, 25 bp, Mus musculus
aaggtggctggcaacgccgcacagc

SEQ ID NO: 508937 - DNA, 25 bp, Mus musculus
aaggtggctggctacgccgcacagc

SEQ ID NO: 508938 - DNA, 25 bp, Mus musculus
aaggtgggccttacgtctcatcagg

SEQ ID NO: 508939 - DNA, 25 bp, Mus musculus
aaggtgggcctttcgtctcatcagg

SEQ ID NO: 508940 - DNA, 25 bp, Mus musculus
aaggtggtgcccacagtgtacatga

SEQ ID NO: 508941 - DNA, 25 bp, Mus musculus
aaggtggtgccctcagtgtacatga

SEQ ID NO: 508942 - DNA, 25 bp, Mus musculus
aaggtgtacagccatgcacagccac

SEQ ID NO: 508943 - DNA, 25 bp, Mus musculus
aaggtgtacagcgatgcacagccac

SEQ ID NO: 508944 - DNA, 25 bp, Mus musculus
aaggtgtaccacctgggctcccaca

SEQ ID NO: 508945 - DNA, 25 bp, Mus musculus
aaggtgtaccacgtgggctcccaca

SEQ ID NO: 508946 - DNA, 25 bp, Mus musculus
aaggtgtagccgctctacgctgaga

SEQ ID NO: 508947 - DNA, 25 bp, Mus musculus
aaggtgtagccggtctacgctgaga

SEQ ID NO: 508948 - DNA, 25 bp, Mus musculus
aaggtgtcaaagacggagatctgtt

SEQ ID NO: 508949 - DNA, 25 bp, Mus musculus
aaggtgtcaaagtcggagatctgtt

SEQ ID NO: 508950 - DNA, 25 bp, Mus musculus
aaggtgtccagcatccctaggcaaa

SEQ ID NO: 508951 - DNA, 25 bp, Mus musculus
aaggtgtccagcttccctaggcaaa

SEQ ID NO: 508952 - DNA, 25 bp, Mus musculus
aaggtgtcggacaatgtgcaggaca

SEQ ID NO: 508953 - DNA, 25 bp, Mus musculus
aaggtgtcggactatgtgcaggaca

SEQ ID NO: 508954 - DNA, 25 bp, Mus musculus
aaggtgtctccgcttccatccagga

SEQ ID NO: 508955 - DNA, 25 bp, Mus musculus
aaggtgtctccggttccatccagga

SEQ ID NO: 508956 - DNA, 25 bp, Mus musculus
aaggtgtgatcaatgactggcgccg

SEQ ID NO: 508957 - DNA, 25 bp, Mus musculus
aaggtgtgatcattgactggcgccg

SEQ ID NO: 508958 - DNA, 25 bp, Mus musculus
aaggtgtgcgacaccgcccgcgact

SEQ ID NO: 508959 - DNA, 25 bp, Mus musculus
aaggtgtgcgactccgcccgcgact

SEQ ID NO: 508960 - DNA, 25 bp, Mus musculus
aaggtgtggaacaaccaattccttg

SEQ ID NO: 508961 - DNA, 25 bp, Mus musculus
aaggtgtggaactaccaattccttg

SEQ ID NO: 508962 - DNA, 25 bp, Mus musculus
aaggtgtggaccacctagtgctgac

SEQ ID NO: 508963 - DNA, 25 bp, Mus musculus
aaggtgtggacctcctagtgctgac

SEQ ID NO: 508964 - DNA, 25 bp, Mus musculus
aaggtgtggcttcaaagtacttggc

SEQ ID NO: 508965 - DNA, 25 bp, Mus musculus
aaggtgtggcttccgcaataccgaa

SEQ ID NO: 508966 - DNA, 25 bp, Mus musculus
aaggtgtggcttgaaagtacttggc

SEQ ID NO: 508967 - DNA, 25 bp, Mus musculus
aaggtgtggcttgcgcaataccgaa

SEQ ID NO: 508968 - DNA, 25 bp, Mus musculus
aaggtgtggtccatgcttgccgact

SEQ ID NO: 508969 - DNA, 25 bp, Mus musculus
aaggtgtggtccttgcttgccgact

SEQ ID NO: 508970 - DNA, 25 bp, Mus musculus
aaggtgtgtccaatgtgcagcgagc

SEQ ID NO: 508971 - DNA, 25 bp, Mus musculus
aaggtgtgtccattgtgcagcgagc

SEQ ID NO: 508972 - DNA, 25 bp, Mus musculus
aaggtgttcaaaccagagcttctga

SEQ ID NO: 508973 - DNA, 25 bp, Mus musculus
aaggtgttcaaagcagagcttctga

SEQ ID NO: 508974 - DNA, 25 bp, Mus musculus
aaggtgttgactcggaacacatcag

SEQ ID NO: 508975 - DNA, 25 bp, Mus musculus
aaggtgttgactgggaacacatcag

SEQ ID NO: 508976 - DNA, 25 bp, Mus musculus
aaggttacagttagaggcttgtgga

SEQ ID NO: 508977 - DNA, 25 bp, Mus musculus
aaggttacagtttgaggcttgtgga

SEQ ID NO: 508978 - DNA, 25 bp, Mus musculus
aaggttaccgggatgctgcatccag

SEQ ID NO: 508979 - DNA, 25 bp, Mus musculus
aaggttaccgggttgctgcatccag

SEQ ID NO: 508980 - DNA, 25 bp, Mus musculus
aaggttatcctcattggccagctcg

SEQ ID NO: 508981 - DNA, 25 bp, Mus musculus
aaggttatcctctttggccagctcg

SEQ ID NO: 508982 - DNA, 25 bp, Mus musculus
aaggttcaagcgattgttcgagtca

SEQ ID NO: 508983 - DNA, 25 bp, Mus musculus
aaggttcaagcgtttgttcgagtca

SEQ ID NO: 508984 - DNA, 25 bp, Mus musculus
aaggttcacctgcattctgcagttg

SEQ ID NO: 508985 - DNA, 25 bp, Mus musculus
aaggttcacctggattctgcagttg

SEQ ID NO: 508986 - DNA, 25 bp, Mus musculus
aaggttccctcacccaagctcttgg

SEQ ID NO: 508987 - DNA, 25 bp, Mus musculus
aaggttccctcagccaagctcttgg

SEQ ID NO: 508988 - DNA, 25 bp, Mus musculus
aaggttctacagatggtgtctgtag

SEQ ID NO: 508989 - DNA, 25 bp, Mus musculus
aaggttctacagttggtgtctgtag

SEQ ID NO: 508990 - DNA, 25 bp, Mus musculus
aaggttctccttcgaccgccacaag

SEQ ID NO: 508991 - DNA, 25 bp, Mus musculus
aaggttctccttggaccgccacaag

SEQ ID NO: 508992 - DNA, 25 bp, Mus musculus
aaggttctgcgcagagctggcactc

SEQ ID NO: 508993 - DNA, 25 bp, Mus musculus
aaggttctgcgctgagctggcactc

SEQ ID NO: 508994 - DNA, 25 bp, Mus musculus
aaggttctgggcctgtccccatgac

SEQ ID NO: 508995 - DNA, 25 bp, Mus musculus
aaggttctgggcgtgtccccatgac

SEQ ID NO: 508996 - DNA, 25 bp, Mus musculus
aaggttcttgcaacctatgctcggc

SEQ ID NO: 508997 - DNA, 25 bp, Mus musculus
aaggttcttgcatcctatgctcggc

SEQ ID NO: 508998 - DNA, 25 bp, Mus musculus
aaggttgacaagacatctggggaca

SEQ ID NO: 508999 - DNA, 25 bp, Mus musculus
aaggttgacaagtcatctggggaca

SEQ ID NO: 509000 - DNA, 25 bp, Mus musculus
aaggttgcagctaggtgcccacaga

SEQ ID NO: 509001 - DNA, 25 bp, Mus musculus
aaggttgcagcttggtgcccacaga

SEQ ID NO: 509002 - DNA, 25 bp, Mus musculus
aaggttggctcccttagcctcagag

SEQ ID NO: 509003 - DNA, 25 bp, Mus musculus
aaggttggctccgttagcctcagag

SEQ ID NO: 509004 - DNA, 25 bp, Mus musculus
aaggttgggtttctttgcctgtctg

SEQ ID NO: 509005 - DNA, 25 bp, Mus musculus
aaggttgggtttgtttgcctgtctg

SEQ ID NO: 509006 - DNA, 25 bp, Mus musculus
aaggttggtcagactggctgagaca

SEQ ID NO: 509007 - DNA, 25 bp, Mus musculus
aaggttggtcagtctggctgagaca

SEQ ID NO: 509008 - DNA, 25 bp, Mus musculus
aaggttgtggatctgctggccccat

SEQ ID NO: 509009 - DNA, 25 bp, Mus musculus
aaggttgtggatgtgctggccccat

SEQ ID NO: 509010 - DNA, 25 bp, Mus musculus
aaggttgttggccttactggcaagc

SEQ ID NO: 509011 - DNA, 25 bp, Mus musculus
aaggttgttggcgttactggcaagc

SEQ ID NO: 509012 - DNA, 25 bp, Mus musculus
aaggtttactgtagcactcgggagc

SEQ ID NO: 509013 - DNA, 25 bp, Mus musculus
aaggtttactgttgcactcgggagc

SEQ ID NO: 509014 - DNA, 25 bp, Mus musculus
aaggtttatctaagcttcagctgtt

SEQ ID NO: 509015 - DNA, 25 bp, Mus musculus
aaggtttatctatgcttcagctgtt

SEQ ID NO: 509016 - DNA, 25 bp, Mus musculus
aaggtttccggcagtatcgtcctca

SEQ ID NO: 509017 - DNA, 25 bp, Mus musculus
aaggtttccggctgtatcgtcctca

SEQ ID NO: 509018 - DNA, 25 bp, Mus musculus
aaggtttcctctcgatgctgccata

SEQ ID NO: 509019 - DNA, 25 bp, Mus musculus
aaggtttcctctggatgctgccata

SEQ ID NO: 509020 - DNA, 25 bp, Mus musculus
aaggtttctcctcaaaccctctgca

SEQ ID NO: 509021 - DNA, 25 bp, Mus musculus
aaggtttctcctgaaaccctctgca

SEQ ID NO: 509022 - DNA, 25 bp, Mus musculus
aaggtttggccaaggacatgctgga

SEQ ID NO: 509023 - DNA, 25 bp, Mus musculus
aaggtttggccatggacatgctgga

SEQ ID NO: 509024 - DNA, 25 bp, Mus musculus
aaggttttgtgcctatgaaaattgc

SEQ ID NO: 509025 - DNA, 25 bp, Mus musculus
aaggttttgtgcgtatgaaaattgc

SEQ ID NO: 509026 - DNA, 25 bp, Mus musculus
aagtaaacaaatcatcctcctccgc

SEQ ID NO: 509027 - DNA, 25 bp, Mus musculus
aagtaaacaaatgatcctcctccgc

SEQ ID NO: 509028 - DNA, 25 bp, Mus musculus
aagtaaacatgacttctgagttcct

SEQ ID NO: 509029 - DNA, 25 bp, Mus musculus
aagtaaacatgagttctgagttcct

SEQ ID NO: 509030 - DNA, 25 bp, Mus musculus
aagtaaacgaatctggtgagagtct

SEQ ID NO: 509031 - DNA, 25 bp, Mus musculus
aagtaaacgaatgtggtgagagtct

SEQ ID NO: 509032 - DNA, 25 bp, Mus musculus
aagtaaacgaccacttcagccgcaa

SEQ ID NO: 509033 - DNA, 25 bp, Mus musculus
aagtaaacgacctcttcagccgcaa

SEQ ID NO: 509034 - DNA, 25 bp, Mus musculus
aagtaaactcttcacacctgtcagc

SEQ ID NO: 509035 - DNA, 25 bp, Mus musculus
aagtaaactcttgacacctgtcagc

SEQ ID NO: 509036 - DNA, 25 bp, Mus musculus
aagtaaagctctacaagaatgctcg

SEQ ID NO: 509037 - DNA, 25 bp, Mus musculus
aagtaaagctcttcaagaatgctcg

SEQ ID NO: 509038 - DNA, 25 bp, Mus musculus
aagtaaatggtgacactgcagcact

SEQ ID NO: 509039 - DNA, 25 bp, Mus musculus
aagtaaatggtgtcactgcagcact

SEQ ID NO: 509040 - DNA, 25 bp, Mus musculus
aagtaacaacgtcgatgtaatgatg

SEQ ID NO: 509041 - DNA, 25 bp, Mus musculus
aagtaacaacgtggatgtaatgatg

SEQ ID NO: 509042 - DNA, 25 bp, Mus musculus
aagtaacaatacaaccaggcagtgg

SEQ ID NO: 509043 - DNA, 25 bp, Mus musculus
aagtaacaatactaccaggcagtgg

SEQ ID NO: 509044 - DNA, 25 bp, Mus musculus
aagtaacagttaacaagcagctcag

SEQ ID NO: 509045 - DNA, 25 bp, Mus musculus
aagtaacagttatcaagcagctcag

SEQ ID NO: 509046 - DNA, 25 bp, Mus musculus
aagtaacctttcctacagtgcaaca

SEQ ID NO: 509047 - DNA, 25 bp, Mus musculus
aagtaacctttcgtacagtgcaaca

SEQ ID NO: 509048 - DNA, 25 bp, Mus musculus
aagtaacgttgaagtccctcctcga

SEQ ID NO: 509049 - DNA, 25 bp, Mus musculus
aagtaacgttgatgtccctcctcga

SEQ ID NO: 509050 - DNA, 25 bp, Mus musculus
aagtaactctcaaatagctgcccag

SEQ ID NO: 509051 - DNA, 25 bp, Mus musculus
aagtaactctcatatagctgcccag

SEQ ID NO: 509052 - DNA, 25 bp, Mus musculus
aagtaactttagctggaagatgcca

SEQ ID NO: 509053 - DNA, 25 bp, Mus musculus
aagtaactttaggtggaagatgcca

SEQ ID NO: 509054 - DNA, 25 bp, Mus musculus
aagtaagaaagtcacccgtagcaag

SEQ ID NO: 509055 - DNA, 25 bp, Mus musculus
aagtaagaaagtgacccgtagcaag

SEQ ID NO: 509056 - DNA, 25 bp, Mus musculus
aagtaagctgaacccaggaaccaga

SEQ ID NO: 509057 - DNA, 25 bp, Mus musculus
aagtaagctgaagccaggaaccaga

SEQ ID NO: 509058 - DNA, 25 bp, Mus musculus
aagtaaggcgccacactggataaac

SEQ ID NO: 509059 - DNA, 25 bp, Mus musculus
aagtaaggcgcctcactggataaac

SEQ ID NO: 509060 - DNA, 25 bp, Mus musculus
aagtaagtatcgctgaggtcgctga

SEQ ID NO: 509061 - DNA, 25 bp, Mus musculus
aagtaagtatcggtgaggtcgctga

SEQ ID NO: 509062 - DNA, 25 bp, Mus musculus
aagtaagtccctctgtcattgggat

SEQ ID NO: 509063 - DNA, 25 bp, Mus musculus
aagtaagtccctgtgtcattgggat

SEQ ID NO: 509064 - DNA, 25 bp, Mus musculus
aagtaatgatggcttcgtccccacg

SEQ ID NO: 509065 - DNA, 25 bp, Mus musculus
aagtaatgatgggttcgtccccacg

SEQ ID NO: 509066 - DNA, 25 bp, Mus musculus
aagtacaaagacactaacctgctaa

SEQ ID NO: 509067 - DNA, 25 bp, Mus musculus
aagtacaaagactctaacctgctaa

SEQ ID NO: 509068 - DNA, 25 bp, Mus musculus
aagtacaacaagcagagagagattt

SEQ ID NO: 509069 - DNA, 25 bp, Mus musculus
aagtacaacaaggagagagagattt

SEQ ID NO: 509070 - DNA, 25 bp, Mus musculus
aagtacaacgtcaagcacaagaggg

SEQ ID NO: 509071 - DNA, 25 bp, Mus musculus
aagtacaacgtctagcacaagaggg

SEQ ID NO: 509072 - DNA, 25 bp, Mus musculus
aagtacaacttcaattccaatctcc

SEQ ID NO: 509073 - DNA, 25 bp, Mus musculus
aagtacaacttctattccaatctcc

SEQ ID NO: 509074 - DNA, 25 bp, Mus musculus
aagtacaagaggcatatggctttgg

SEQ ID NO: 509075 - DNA, 25 bp, Mus musculus
aagtacaagagggatatggctttgg

SEQ ID NO: 509076 - DNA, 25 bp, Mus musculus
aagtacacagcacaacccattgatg

SEQ ID NO: 509077 - DNA, 25 bp, Mus musculus
aagtacacagcagaacccattgatg

SEQ ID NO: 509078 - DNA, 25 bp, Mus musculus
aagtacacatttccagcccacatgg

SEQ ID NO: 509079 - DNA, 25 bp, Mus musculus
aagtacacatttgcagcccacatgg

SEQ ID NO: 509080 - DNA, 25 bp, Mus musculus
aagtacactctcatagacaaaaatg

SEQ ID NO: 509081 - DNA, 25 bp, Mus musculus
aagtacactctcttagacaaaaatg

SEQ ID NO: 509082 - DNA, 25 bp, Mus musculus
aagtacagtcagagtcgcttagcgg

SEQ ID NO: 509083 - DNA, 25 bp, Mus musculus
aagtacagtcagtgtcgcttagcgg

SEQ ID NO: 509084 - DNA, 25 bp, Mus musculus
aagtacagtgagagcctcttgtgta

SEQ ID NO: 509085 - DNA, 25 bp, Mus musculus
aagtacagtgagtgcctcttgtgta

SEQ ID NO: 509086 - DNA, 25 bp, Mus musculus
aagtacatatcacggagcagcaggc

SEQ ID NO: 509087 - DNA, 25 bp, Mus musculus
aagtacatatcagggagcagcaggc

SEQ ID NO: 509088 - DNA, 25 bp, Mus musculus
aagtacatcgttactgcctctggag

SEQ ID NO: 509089 - DNA, 25 bp, Mus musculus
aagtacatcgtttctgcctctggag

SEQ ID NO: 509090 - DNA, 25 bp, Mus musculus
aagtacatgattcgccgtcttcgac

SEQ ID NO: 509091 - DNA, 25 bp, Mus musculus
aagtacatgattggccgtcttcgac

SEQ ID NO: 509092 - DNA, 25 bp, Mus musculus
aagtacatggagattgatctgaatg

SEQ ID NO: 509093 - DNA, 25 bp, Mus musculus
aagtacatggagtttgatctgaatg

SEQ ID NO: 509094 - DNA, 25 bp, Mus musculus
aagtacatggtgaggtcagatgaga

SEQ ID NO: 509095 - DNA, 25 bp, Mus musculus
aagtacatggtgtggtcagatgaga

SEQ ID NO: 509096 - DNA, 25 bp, Mus musculus
aagtaccaggacagcattcgacgca

SEQ ID NO: 509097 - DNA, 25 bp, Mus musculus
aagtaccaggactgcattcgacgca

SEQ ID NO: 509098 - DNA, 25 bp, Mus musculus
aagtacccagaactgctcctcgtgc

SEQ ID NO: 509099 - DNA, 25 bp, Mus musculus
aagtacccagaagtgctcctcgtgc

SEQ ID NO: 509100 - DNA, 25 bp, Mus musculus
aagtacccaggcaaaaggcgagagg

SEQ ID NO: 509101 - DNA, 25 bp, Mus musculus
aagtacccaggctaaaggcgagagg

SEQ ID NO: 509102 - DNA, 25 bp, Mus musculus
aagtaccctctgaggctcatcgaca

SEQ ID NO: 509103 - DNA, 25 bp, Mus musculus
aagtaccctctgtggctcatcgaca

SEQ ID NO: 509104 - DNA, 25 bp, Mus musculus
aagtaccggctgcacctgtcagtgg

SEQ ID NO: 509105 - DNA, 25 bp, Mus musculus
aagtaccggctggacctgtcagtgg

SEQ ID NO: 509106 - DNA, 25 bp, Mus musculus
aagtacctagccacctcgcaggtgt

SEQ ID NO: 509107 - DNA, 25 bp, Mus musculus
aagtacctagcctcctcgcaggtgt

SEQ ID NO: 509108 - DNA, 25 bp, Mus musculus
aagtacctcatgatcgccttcaacc

SEQ ID NO: 509109 - DNA, 25 bp, Mus musculus
aagtacctcatgttcgccttcaacc

SEQ ID NO: 509110 - DNA, 25 bp, Mus musculus
aagtaccttctaatccttacacgag

SEQ ID NO: 509111 - DNA, 25 bp, Mus musculus
aagtaccttctattccttacacgag

SEQ ID NO: 509112 - DNA, 25 bp, Mus musculus
aagtacgcaacgcaagaggccctga

SEQ ID NO: 509113 - DNA, 25 bp, Mus musculus
aagtacgcaacggaagaggccctga

SEQ ID NO: 509114 - DNA, 25 bp, Mus musculus
aagtacggccgcatccgcgagatcg

SEQ ID NO: 509115 - DNA, 25 bp, Mus musculus
aagtacggccgcttccgcgagatcg

SEQ ID NO: 509116 - DNA, 25 bp, Mus musculus
aagtactcagaaaggacagtgccag

SEQ ID NO: 509117 - DNA, 25 bp, Mus musculus
aagtactcagaatggacagtgccag

SEQ ID NO: 509118 - DNA, 25 bp, Mus musculus
aagtactggacactgacggcgaccg

SEQ ID NO: 509119 - DNA, 25 bp, Mus musculus
aagtactggacagtgacggcgaccg

SEQ ID NO: 509120 - DNA, 25 bp, Mus musculus
aagtacttacagcagcgtccagcgt

SEQ ID NO: 509121 - DNA, 25 bp, Mus musculus
aagtacttacaggagcgtccagcgt

SEQ ID NO: 509122 - DNA, 25 bp, Mus musculus
aagtacttagcaccctcggagcaga

SEQ ID NO: 509123 - DNA, 25 bp, Mus musculus
aagtacttagcagcctcggagcaga

SEQ ID NO: 509124 - DNA, 25 bp, Mus musculus
aagtacttcctgcaaggcatgggct

SEQ ID NO: 509125 - DNA, 25 bp, Mus musculus
aagtacttcctggaaggcatgggct

SEQ ID NO: 509126 - DNA, 25 bp, Mus musculus
aagtacttgctgctcaacaaccagg

SEQ ID NO: 509127 - DNA, 25 bp, Mus musculus
aagtacttgctggtcaacaaccagg

SEQ ID NO: 509128 - DNA, 25 bp, Mus musculus
aagtactttccacggactcctgtga

SEQ ID NO: 509129 - DNA, 25 bp, Mus musculus
aagtactttccagggactcctgtga

SEQ ID NO: 509130 - DNA, 25 bp, Mus musculus
aagtacttttatcaccaatgtccag

SEQ ID NO: 509131 - DNA, 25 bp, Mus musculus
aagtacttttatgaccaatgtccag

SEQ ID NO: 509132 - DNA, 25 bp, Mus musculus
aagtactttttgcagggaatgggct

SEQ ID NO: 509133 - DNA, 25 bp, Mus musculus
aagtactttttggagggaatgggct

SEQ ID NO: 509134 - DNA, 25 bp, Mus musculus
aagtagacgcccagttcggcggtgt

SEQ ID NO: 509135 - DNA, 25 bp, Mus musculus
aagtagacgccctgttcggcggtgt

SEQ ID NO: 509136 - DNA, 25 bp, Mus musculus
aagtagaggtggcagatgaaacaaa

SEQ ID NO: 509137 - DNA, 25 bp, Mus musculus
aagtagaggtgggagatgaaacaaa

SEQ ID NO: 509138 - DNA, 25 bp, Mus musculus
aagtagcagcatcataacagcgtga

SEQ ID NO: 509139 - DNA, 25 bp, Mus musculus
aagtagcagcatgataacagcgtga

SEQ ID NO: 509140 - DNA, 25 bp, Mus musculus
aagtagccaatcctaagacctgaag

SEQ ID NO: 509141 - DNA, 25 bp, Mus musculus
aagtagccaatcgtaagacctgaag

SEQ ID NO: 509142 - DNA, 25 bp, Mus musculus
aagtagcgagaaccaagccttaatg

SEQ ID NO: 509143 - DNA, 25 bp, Mus musculus
aagtagcgagaagcaagccttaatg

SEQ ID NO: 509144 - DNA, 25 bp, Mus musculus
aagtagcgtctcatcagtgggtgcc

SEQ ID NO: 509145 - DNA, 25 bp, Mus musculus
aagtagcgtctcttcagtgggtgcc

SEQ ID NO: 509146 - DNA, 25 bp, Mus musculus
aagtagctgcccagttgctctcgaa

SEQ ID NO: 509147 - DNA, 25 bp, Mus musculus
aagtagctgccctgttgctctcgaa

SEQ ID NO: 509148 - DNA, 25 bp, Mus musculus
aagtagctgccgagcagatctcccc

SEQ ID NO: 509149 - DNA, 25 bp, Mus musculus
aagtagctgccgtgcagatctcccc

SEQ ID NO: 509150 - DNA, 25 bp, Mus musculus
aagtagctggccatgacatcaacta

SEQ ID NO: 509151 - DNA, 25 bp, Mus musculus
aagtagctggccttgacatcaacta

SEQ ID NO: 509152 - DNA, 25 bp, Mus musculus
aagtaggcattgcacttgttagtcc

SEQ ID NO: 509153 - DNA, 25 bp, Mus musculus
aagtaggcattggacttgttagtcc

SEQ ID NO: 509154 - DNA, 25 bp, Mus musculus
aagtaggctccaataaggagagata

SEQ ID NO: 509155 - DNA, 25 bp, Mus musculus
aagtaggctccattaaggagagata

SEQ ID NO: 509156 - DNA, 25 bp, Mus musculus
aagtagtagctgagaccggaaggat

SEQ ID NO: 509157 - DNA, 25 bp, Mus musculus
aagtagtagctgtgaccggaaggat

SEQ ID NO: 509158 - DNA, 25 bp, Mus musculus
aagtatacctatccccttgtgcgcg

SEQ ID NO: 509159 - DNA, 25 bp, Mus musculus
aagtatacctatgcccttgtgcgcg

SEQ ID NO: 509160 - DNA, 25 bp, Mus musculus
aagtatccgtaactggagagaagag

SEQ ID NO: 509161 - DNA, 25 bp, Mus musculus
aagtatccgtaagtggagagaagag

SEQ ID NO: 509162 - DNA, 25 bp, Mus musculus
aagtatctggacaccttcatcgaag

SEQ ID NO: 509163 - DNA, 25 bp, Mus musculus
aagtatctggactccttcatcgaag

SEQ ID NO: 509164 - DNA, 25 bp, Mus musculus
aagtatcttcacagccccaaaggag

SEQ ID NO: 509165 - DNA, 25 bp, Mus musculus
aagtatcttcactgccccaaaggag

SEQ ID NO: 509166 - DNA, 25 bp, Mus musculus
aagtatgaagacaacttcggcctca

SEQ ID NO: 509167 - DNA, 25 bp, Mus musculus
aagtatgaagactacttcggcctca

SEQ ID NO: 509168 - DNA, 25 bp, Mus musculus
aagtatgaggagctcttcccggcct

SEQ ID NO: 509169 - DNA, 25 bp, Mus musculus
aagtatgaggaggtcttcccggcct

SEQ ID NO: 509170 - DNA, 25 bp, Mus musculus
aagtatgcagcactgactacccggg

SEQ ID NO: 509171 - DNA, 25 bp, Mus musculus
aagtatgcagcagtgactacccggg

SEQ ID NO: 509172 - DNA, 25 bp, Mus musculus
aagtatgcccctcggtacaatgccg

SEQ ID NO: 509173 - DNA, 25 bp, Mus musculus
aagtatgcccctgggtacaatgccg

SEQ ID NO: 509174 - DNA, 25 bp, Mus musculus
aagtatgccttacgcgagggcttcc

SEQ ID NO: 509175 - DNA, 25 bp, Mus musculus
aagtatgccttaggcgagggcttcc

SEQ ID NO: 509176 - DNA, 25 bp, Mus musculus
aagtatgcctttctcaactggataa

SEQ ID NO: 509177 - DNA, 25 bp, Mus musculus
aagtatgcctttgtcaactggataa

SEQ ID NO: 509178 - DNA, 25 bp, Mus musculus
aagtatgcgcccacttagggttggc

SEQ ID NO: 509179 - DNA, 25 bp, Mus musculus
aagtatgcgccctcttagggttggc

SEQ ID NO: 509180 - DNA, 25 bp, Mus musculus
aagtatgtgggcacacgccccatca

SEQ ID NO: 509181 - DNA, 25 bp, Mus musculus
aagtatgtgggctcacgccccatca

SEQ ID NO: 509182 - DNA, 25 bp, Mus musculus
aagtattcgagaagccggtgcaggt

SEQ ID NO: 509183 - DNA, 25 bp, Mus musculus
aagtattcgagatgccggtgcaggt

SEQ ID NO: 509184 - DNA, 25 bp, Mus musculus
aagtattctaggctctacagttatg

SEQ ID NO: 509185 - DNA, 25 bp, Mus musculus
aagtattctagggtctacagttatg

SEQ ID NO: 509186 - DNA, 25 bp, Mus musculus
aagtatttgactatttggttgcaca

SEQ ID NO: 509187 - DNA, 25 bp, Mus musculus
aagtatttgactttttggttgcaca

SEQ ID NO: 509188 - DNA, 25 bp, Mus musculus
aagtatttgcaaactagaatcttta

SEQ ID NO: 509189 - DNA, 25 bp, Mus musculus
aagtatttgcaatctagaatcttta

SEQ ID NO: 509190 - DNA, 25 bp, Mus musculus
aagtattttcggcacacatcacaat

SEQ ID NO: 509191 - DNA, 25 bp, Mus musculus
aagtattttcgggacacatcacaat

SEQ ID NO: 509192 - DNA, 25 bp, Mus musculus
aagtcaaaagcaaggtccatcccca

SEQ ID NO: 509193 - DNA, 25 bp, Mus musculus
aagtcaaaagcatggtccatcccca

SEQ ID NO: 509194 - DNA, 25 bp, Mus musculus
aagtcaaaagtcagggcagcgcctc

SEQ ID NO: 509195 - DNA, 25 bp, Mus musculus
aagtcaaaagtctgggcagcgcctc

SEQ ID NO: 509196 - DNA, 25 bp, Mus musculus
aagtcaaaatcgaataatacagcag

SEQ ID NO: 509197 - DNA, 25 bp, Mus musculus
aagtcaaaatcgtataatacagcag

SEQ ID NO: 509198 - DNA, 25 bp, Mus musculus
aagtcaaagcagcagtcgtgagcag

SEQ ID NO: 509199 - DNA, 25 bp, Mus musculus
aagtcaaagcaggagtcgtgagcag

SEQ ID NO: 509200 - DNA, 25 bp, Mus musculus
aagtcaaaggcaagtgaaggtggca

SEQ ID NO: 509201 - DNA, 25 bp, Mus musculus
aagtcaaaggcatgtgaaggtggca

SEQ ID NO: 509202 - DNA, 25 bp, Mus musculus
aagtcaaatttgcaagtggtggaag

SEQ ID NO: 509203 - DNA, 25 bp, Mus musculus
aagtcaaatttggaagtggtggaag

SEQ ID NO: 509204 - DNA, 25 bp, Mus musculus
aagtcaacaaaacgctctgttgtcc

SEQ ID NO: 509205 - DNA, 25 bp, Mus musculus
aagtcaacaaaaggctctgttgtcc

SEQ ID NO: 509206 - DNA, 25 bp, Mus musculus
aagtcaaccggcagtacaaagagaa

SEQ ID NO: 509207 - DNA, 25 bp, Mus musculus
aagtcaaccggctgtacaaagagaa

SEQ ID NO: 509208 - DNA, 25 bp, Mus musculus
aagtcaacggtcctgctgagcaggt

SEQ ID NO: 509209 - DNA, 25 bp, Mus musculus
aagtcaacggtcgtgctgagcaggt

SEQ ID NO: 509210 - DNA, 25 bp, Mus musculus
aagtcaactgaaatgaactggcccc

SEQ ID NO: 509211 - DNA, 25 bp, Mus musculus
aagtcaactgaattgaactggcccc

SEQ ID NO: 509212 - DNA, 25 bp, Mus musculus
aagtcaagtactctagctcaaaccg

SEQ ID NO: 509213 - DNA, 25 bp, Mus musculus
aagtcaagtactgtagctcaaaccg

SEQ ID NO: 509214 - DNA, 25 bp, Mus musculus
aagtcacaatggagaatgctgaccc

SEQ ID NO: 509215 - DNA, 25 bp, Mus musculus
aagtcacaatggtgaatgctgaccc

SEQ ID NO: 509216 - DNA, 25 bp, Mus musculus
aagtcacacaggacgccactgccag

SEQ ID NO: 509217 - DNA, 25 bp, Mus musculus
aagtcacacaggtcgccactgccag

SEQ ID NO: 509218 - DNA, 25 bp, Mus musculus
aagtcacagacaccagacttgcttg

SEQ ID NO: 509219 - DNA, 25 bp, Mus musculus
aagtcacagacagcagacttgcttg

SEQ ID NO: 509220 - DNA, 25 bp, Mus musculus
aagtcacagaggatgatagttctgg

SEQ ID NO: 509221 - DNA, 25 bp, Mus musculus
aagtcacagaggttgatagttctgg

SEQ ID NO: 509222 - DNA, 25 bp, Mus musculus
aagtcaccaagccagaaggagtcta

SEQ ID NO: 509223 - DNA, 25 bp, Mus musculus
aagtcaccaagcgagaaggagtcta

SEQ ID NO: 509224 - DNA, 25 bp, Mus musculus
aagtcaccagcaagacatttaaaac

SEQ ID NO: 509225 - DNA, 25 bp, Mus musculus
aagtcaccagcatgacatttaaaac

SEQ ID NO: 509226 - DNA, 25 bp, Mus musculus
aagtcaccgtctcggccagtgagaa

SEQ ID NO: 509227 - DNA, 25 bp, Mus musculus
aagtcaccgtctgggccagtgagaa

SEQ ID NO: 509228 - DNA, 25 bp, Mus musculus
aagtcaccttccactgaatttaggc

SEQ ID NO: 509229 - DNA, 25 bp, Mus musculus
aagtcaccttcctctgaatttaggc

SEQ ID NO: 509230 - DNA, 25 bp, Mus musculus
aagtcacgaagcactggcatccagc

SEQ ID NO: 509231 - DNA, 25 bp, Mus musculus
aagtcacgaagctctggcatccagc

SEQ ID NO: 509232 - DNA, 25 bp, Mus musculus
aagtcacgcaccaaaaagcccacag

SEQ ID NO: 509233 - DNA, 25 bp, Mus musculus
aagtcacgcacctaaaagcccacag

SEQ ID NO: 509234 - DNA, 25 bp, Mus musculus
aagtcacggtataactcaaatccag

SEQ ID NO: 509235 - DNA, 25 bp, Mus musculus
aagtcacggtattactcaaatccag

SEQ ID NO: 509236 - DNA, 25 bp, Mus musculus
aagtcactccgtcaggcagtggcga

SEQ ID NO: 509237 - DNA, 25 bp, Mus musculus
aagtcactccgtgaggcagtggcga

SEQ ID NO: 509238 - DNA, 25 bp, Mus musculus
aagtcactcgtacaagcgcagcctt

SEQ ID NO: 509239 - DNA, 25 bp, Mus musculus
aagtcactcgtagaagcgcagcctt

SEQ ID NO: 509240 - DNA, 25 bp, Mus musculus
aagtcactgaagaggacccctgtga

SEQ ID NO: 509241 - DNA, 25 bp, Mus musculus
aagtcactgaagtggacccctgtga

SEQ ID NO: 509242 - DNA, 25 bp, Mus musculus
aagtcactgcgtagaacctgagaag

SEQ ID NO: 509243 - DNA, 25 bp, Mus musculus
aagtcactgcgttgaacctgagaag

SEQ ID NO: 509244 - DNA, 25 bp, Mus musculus
aagtcagaacttagagaagccctcg

SEQ ID NO: 509245 - DNA, 25 bp, Mus musculus
aagtcagaactttgagaagccctcg

SEQ ID NO: 509246 - DNA, 25 bp, Mus musculus
aagtcagaaggccaagtgcagacgc

SEQ ID NO: 509247 - DNA, 25 bp, Mus musculus
aagtcagaaggcgaagtgcagacgc

SEQ ID NO: 509248 - DNA, 25 bp, Mus musculus
aagtcagacacccaccgttttgagg

SEQ ID NO: 509249 - DNA, 25 bp, Mus musculus
aagtcagacaccgaccgttttgagg

SEQ ID NO: 509250 - DNA, 25 bp, Mus musculus
aagtcagaccttataatgcgttgaa

SEQ ID NO: 509251 - DNA, 25 bp, Mus musculus
aagtcagaccttttaatgcgttgaa

SEQ ID NO: 509252 - DNA, 25 bp, Mus musculus
aagtcagagatgcagaggcattacg

SEQ ID NO: 509253 - DNA, 25 bp, Mus musculus
aagtcagagatggagaggcattacg

SEQ ID NO: 509254 - DNA, 25 bp, Mus musculus
aagtcagaggaccaaacctgtgggc

SEQ ID NO: 509255 - DNA, 25 bp, Mus musculus
aagtcagaggacgaaacctgtgggc

SEQ ID NO: 509256 - DNA, 25 bp, Mus musculus
aagtcagatggcaatggcaggacgt

SEQ ID NO: 509257 - DNA, 25 bp, Mus musculus
aagtcagatggctatggcaggacgt

SEQ ID NO: 509258 - DNA, 25 bp, Mus musculus
aagtcagcatgaaccacagactgcg

SEQ ID NO: 509259 - DNA, 25 bp, Mus musculus
aagtcagcatgatccacagactgcg

SEQ ID NO: 509260 - DNA, 25 bp, Mus musculus
aagtcagcgccaacgatccccaagg

SEQ ID NO: 509261 - DNA, 25 bp, Mus musculus
aagtcagcgccatcgatccccaagg

SEQ ID NO: 509262 - DNA, 25 bp, Mus musculus
aagtcaggagatccatccgctggtc

SEQ ID NO: 509263 - DNA, 25 bp, Mus musculus
aagtcaggagatgcatccgctggtc

SEQ ID NO: 509264 - DNA, 25 bp, Mus musculus
aagtcagggccaacaagggcagcaa

SEQ ID NO: 509265 - DNA, 25 bp, Mus musculus
aagtcagggccatcaagggcagcaa

SEQ ID NO: 509266 - DNA, 25 bp, Mus musculus
aagtcaggtcctccctatcagctga

SEQ ID NO: 509267 - DNA, 25 bp, Mus musculus
aagtcaggtcctgcctatcagctga

SEQ ID NO: 509268 - DNA, 25 bp, Mus musculus
aagtcagtaaacagtatatgctcag

SEQ ID NO: 509269 - DNA, 25 bp, Mus musculus
aagtcagtaaactgtatatgctcag

SEQ ID NO: 509270 - DNA, 25 bp, Mus musculus
aagtcagtcacaaggctcatcaaga

SEQ ID NO: 509271 - DNA, 25 bp, Mus musculus
aagtcagtcacatggctcatcaaga

SEQ ID NO: 509272 - DNA, 25 bp, Mus musculus
aagtcatcaaagactggaattcaag

SEQ ID NO: 509273 - DNA, 25 bp, Mus musculus
aagtcatcaaagtctggaattcaag

SEQ ID NO: 509274 - DNA, 25 bp, Mus musculus
aagtcatcaagccattctgtgtcat

SEQ ID NO: 509275 - DNA, 25 bp, Mus musculus
aagtcatcaagcgattctgtgtcat

SEQ ID NO: 509276 - DNA, 25 bp, Mus musculus
aagtcatcgattatatcctccacgg

SEQ ID NO: 509277 - DNA, 25 bp, Mus musculus
aagtcatcgattttatcctccacgg

SEQ ID NO: 509278 - DNA, 25 bp, Mus musculus
aagtcatcgtggacaaccaggtcaa

SEQ ID NO: 509279 - DNA, 25 bp, Mus musculus
aagtcatcgtggtcaaccaggtcaa

SEQ ID NO: 509280 - DNA, 25 bp, Mus musculus
aagtcatctgctacgcttcgctgag

SEQ ID NO: 509281 - DNA, 25 bp, Mus musculus
aagtcatctgcttcgcttcgctgag

SEQ ID NO: 509282 - DNA, 25 bp, Mus musculus
aagtcatcttctcctatgtgcttgg

SEQ ID NO: 509283 - DNA, 25 bp, Mus musculus
aagtcatcttctgctatgtgcttgg

SEQ ID NO: 509284 - DNA, 25 bp, Mus musculus
aagtcatgattgaaccttcaggtcc

SEQ ID NO: 509285 - DNA, 25 bp, Mus musculus
aagtcatgattgtaccttcaggtcc

SEQ ID NO: 509286 - DNA, 25 bp, Mus musculus
aagtcatgcctcagagtgggaccca

SEQ ID NO: 509287 - DNA, 25 bp, Mus musculus
aagtcatgcctctgagtgggaccca

SEQ ID NO: 509288 - DNA, 25 bp, Mus musculus
aagtcatgggaactgctgtagccca

SEQ ID NO: 509289 - DNA, 25 bp, Mus musculus
aagtcatgggaagtgctgtagccca

SEQ ID NO: 509290 - DNA, 25 bp, Mus musculus
aagtcattacagagccacacaagat

SEQ ID NO: 509291 - DNA, 25 bp, Mus musculus
aagtcattacagtgccacacaagat

SEQ ID NO: 509292 - DNA, 25 bp, Mus musculus
aagtcattccgaaggtaagagacca

SEQ ID NO: 509293 - DNA, 25 bp, Mus musculus
aagtcattccgatggtaagagacca

SEQ ID NO: 509294 - DNA, 25 bp, Mus musculus
aagtcattctttctccattctctgc

SEQ ID NO: 509295 - DNA, 25 bp, Mus musculus
aagtcattctttgtccattctctgc

SEQ ID NO: 509296 - DNA, 25 bp, Mus musculus
aagtcattgaaacccgagcccaaaa

SEQ ID NO: 509297 - DNA, 25 bp, Mus musculus
aagtcattgaaagccgagcccaaaa

SEQ ID NO: 509298 - DNA, 25 bp, Mus musculus
aagtcattgtcccagtttagaagtg

SEQ ID NO: 509299 - DNA, 25 bp, Mus musculus
aagtcattgtccgagtttagaagtg

SEQ ID NO: 509300 - DNA, 25 bp, Mus musculus
aagtcattgtgaagccaagcatatc

SEQ ID NO: 509301 - DNA, 25 bp, Mus musculus
aagtcattgtgatgccaagcatatc

SEQ ID NO: 509302 - DNA, 25 bp, Mus musculus
aagtcatttggaaagggactcgctt

SEQ ID NO: 509303 - DNA, 25 bp, Mus musculus
aagtcatttggatagggactcgctt

SEQ ID NO: 509304 - DNA, 25 bp, Mus musculus
aagtccaacattaccatcctgcgtg

SEQ ID NO: 509305 - DNA, 25 bp, Mus musculus
aagtccaacatttccatcctgcgtg

SEQ ID NO: 509306 - DNA, 25 bp, Mus musculus
aagtccaatgaacggaacagtgccc

SEQ ID NO: 509307 - DNA, 25 bp, Mus musculus
aagtccaatgaagggaacagtgccc

SEQ ID NO: 509308 - DNA, 25 bp, Mus musculus
aagtccacgaatacctgggctggca

SEQ ID NO: 509309 - DNA, 25 bp, Mus musculus
aagtccacgaattcctgggctggca

SEQ ID NO: 509310 - DNA, 25 bp, Mus musculus
aagtccacgctcatggataccctgt

SEQ ID NO: 509311 - DNA, 25 bp, Mus musculus
aagtccacgctcttggataccctgt

SEQ ID NO: 509312 - DNA, 25 bp, Mus musculus
aagtccactcttagatttcattgag

SEQ ID NO: 509313 - DNA, 25 bp, Mus musculus
aagtccactctttgatttcattgag

SEQ ID NO: 509314 - DNA, 25 bp, Mus musculus
aagtccagcaagaaggcaccagaag

SEQ ID NO: 509315 - DNA, 25 bp, Mus musculus
aagtccagcaagtaggcaccagaag

SEQ ID NO: 509316 - DNA, 25 bp, Mus musculus
aagtccagggtcagaggtgttgtcc

SEQ ID NO: 509317 - DNA, 25 bp, Mus musculus
aagtccagggtctgaggtgttgtcc

SEQ ID NO: 509318 - DNA, 25 bp, Mus musculus
aagtccaggtgtatggtgatcacca

SEQ ID NO: 509319 - DNA, 25 bp, Mus musculus
aagtccaggtgtttggtgatcacca

SEQ ID NO: 509320 - DNA, 25 bp, Mus musculus
aagtccagtggaaagcattacggcg

SEQ ID NO: 509321 - DNA, 25 bp, Mus musculus
aagtccagtggatagcattacggcg

SEQ ID NO: 509322 - DNA, 25 bp, Mus musculus
aagtccagttctctgcaggtagcag

SEQ ID NO: 509323 - DNA, 25 bp, Mus musculus
aagtccagttctgtgcaggtagcag

SEQ ID NO: 509324 - DNA, 25 bp, Mus musculus
aagtccatactcagctttctcccgg

SEQ ID NO: 509325 - DNA, 25 bp, Mus musculus
aagtccatactctgctttctcccgg

SEQ ID NO: 509326 - DNA, 25 bp, Mus musculus
aagtccatcgcaaatactggcgcag

SEQ ID NO: 509327 - DNA, 25 bp, Mus musculus
aagtccatcgcatatactggcgcag

SEQ ID NO: 509328 - DNA, 25 bp, Mus musculus
aagtccatggctcgctactaccagg

SEQ ID NO: 509329 - DNA, 25 bp, Mus musculus
aagtccatggctggctactaccagg

SEQ ID NO: 509330 - DNA, 25 bp, Mus musculus
aagtccatttccacagggagccgcc

SEQ ID NO: 509331 - DNA, 25 bp, Mus musculus
aagtccatttcctcagggagccgcc

SEQ ID NO: 509332 - DNA, 25 bp, Mus musculus
aagtcccacacaccagcttggtgca

SEQ ID NO: 509333 - DNA, 25 bp, Mus musculus
aagtcccacacagcagcttggtgca

SEQ ID NO: 509334 - DNA, 25 bp, Mus musculus
aagtcccagactcttgactgaggtg

SEQ ID NO: 509335 - DNA, 25 bp, Mus musculus
aagtcccagactgttgactgaggtg

SEQ ID NO: 509336 - DNA, 25 bp, Mus musculus
aagtcccagcccagtgaagtacaga

SEQ ID NO: 509337 - DNA, 25 bp, Mus musculus
aagtcccagccctgtgaagtacaga

SEQ ID NO: 509338 - DNA, 25 bp, Mus musculus
aagtcccatggacgcacaagcagaa

SEQ ID NO: 509339 - DNA, 25 bp, Mus musculus
aagtcccatggaggcacaagcagaa

SEQ ID NO: 509340 - DNA, 25 bp, Mus musculus
aagtcccattccaggttgagcacgg

SEQ ID NO: 509341 - DNA, 25 bp, Mus musculus
aagtcccattcctggttgagcacgg

SEQ ID NO: 509342 - DNA, 25 bp, Mus musculus
aagtcccctgtgcatagtactcaca

SEQ ID NO: 509343 - DNA, 25 bp, Mus musculus
aagtcccctgtggatagtactcaca

SEQ ID NO: 509344 - DNA, 25 bp, Mus musculus
aagtccctcacacatttgctgtcca

SEQ ID NO: 509345 - DNA, 25 bp, Mus musculus
aagtccctcacagatttgctgtcca

SEQ ID NO: 509346 - DNA, 25 bp, Mus musculus
aagtccctcccacagatatggtaga

SEQ ID NO: 509347 - DNA, 25 bp, Mus musculus
aagtccctcccagagatatggtaga

SEQ ID NO: 509348 - DNA, 25 bp, Mus musculus
aagtccgctaacctgacctgtctgg

SEQ ID NO: 509349 - DNA, 25 bp, Mus musculus
aagtccgctaacgtgacctgtctgg

SEQ ID NO: 509350 - DNA, 25 bp, Mus musculus
aagtccgggacaatctttgacaatt

SEQ ID NO: 509351 - DNA, 25 bp, Mus musculus
aagtccgggacattctttgacaatt

SEQ ID NO: 509352 - DNA, 25 bp, Mus musculus
aagtccggttacaccttgccagaga

SEQ ID NO: 509353 - DNA, 25 bp, Mus musculus
aagtccggttactccttgccagaga

SEQ ID NO: 509354 - DNA, 25 bp, Mus musculus
aagtccgtgggcattgtgactacca

SEQ ID NO: 509355 - DNA, 25 bp, Mus musculus
aagtccgtgggctttgtgactacca

SEQ ID NO: 509356 - DNA, 25 bp, Mus musculus
aagtcctcagctaccccgagaggtc

SEQ ID NO: 509357 - DNA, 25 bp, Mus musculus
aagtcctcagcttccccgagaggtc

SEQ ID NO: 509358 - DNA, 25 bp, Mus musculus
aagtcctcgatgacctgaataaaaa

SEQ ID NO: 509359 - DNA, 25 bp, Mus musculus
aagtcctcgatgtcctgaataaaaa

SEQ ID NO: 509360 - DNA, 25 bp, Mus musculus
aagtcctctgacatggtatcagcca

SEQ ID NO: 509361 - DNA, 25 bp, Mus musculus
aagtcctctgacttggtatcagcca

SEQ ID NO: 509362 - DNA, 25 bp, Mus musculus
aagtcctgccatatgttcttcttga

SEQ ID NO: 509363 - DNA, 25 bp, Mus musculus
aagtcctgccatttgttcttcttga

SEQ ID NO: 509364 - DNA, 25 bp, Mus musculus
aagtcctgcttaccccagctgggag

SEQ ID NO: 509365 - DNA, 25 bp, Mus musculus
aagtcctgcttagcccagctgggag

SEQ ID NO: 509366 - DNA, 25 bp, Mus musculus
aagtcctggcataactacatgtgta

SEQ ID NO: 509367 - DNA, 25 bp, Mus musculus
aagtcctggcattactacatgtgta

SEQ ID NO: 509368 - DNA, 25 bp, Mus musculus
aagtcctgggcaccgggtcatctgt

SEQ ID NO: 509369 - DNA, 25 bp, Mus musculus
aagtcctgggcagcgggtcatctgt

SEQ ID NO: 509370 - DNA, 25 bp, Mus musculus
aagtcctgggcccacggtgctttga

SEQ ID NO: 509371 - DNA, 25 bp, Mus musculus
aagtcctgggccgacggtgctttga

SEQ ID NO: 509372 - DNA, 25 bp, Mus musculus
aagtccttccgactcctgggcgatc

SEQ ID NO: 509373 - DNA, 25 bp, Mus musculus
aagtccttccgagtcctgggcgatc

SEQ ID NO: 509374 - DNA, 25 bp, Mus musculus
aagtccttcgtgaaacattccatgg

SEQ ID NO: 509375 - DNA, 25 bp, Mus musculus
aagtccttcgtgtaacattccatgg

SEQ ID NO: 509376 - DNA, 25 bp, Mus musculus
aagtccttctggacagtgtggttcc

SEQ ID NO: 509377 - DNA, 25 bp, Mus musculus
aagtccttctggtcagtgtggttcc

SEQ ID NO: 509378 - DNA, 25 bp, Mus musculus
aagtccttgaagcactgcattccat

SEQ ID NO: 509379 - DNA, 25 bp, Mus musculus
aagtccttgaaggactgcattccat

SEQ ID NO: 509380 - DNA, 25 bp, Mus musculus
aagtccttgcagagggattttgcag

SEQ ID NO: 509381 - DNA, 25 bp, Mus musculus
aagtccttgcagtgggattttgcag

SEQ ID NO: 509382 - DNA, 25 bp, Mus musculus
aagtcgacgtgcaccggcaaattag

SEQ ID NO: 509383 - DNA, 25 bp, Mus musculus
aagtcgacgtgctccggcaaattag

SEQ ID NO: 509384 - DNA, 25 bp, Mus musculus
aagtcgactgtcaagagatttggta

SEQ ID NO: 509385 - DNA, 25 bp, Mus musculus
aagtcgactgtctagagatttggta

SEQ ID NO: 509386 - DNA, 25 bp, Mus musculus
aagtcgatgagaatgtggttctcag

SEQ ID NO: 509387 - DNA, 25 bp, Mus musculus
aagtcgatgagattgtggttctcag

SEQ ID NO: 509388 - DNA, 25 bp, Mus musculus
aagtcgcagcagaactagcccaagc

SEQ ID NO: 509389 - DNA, 25 bp, Mus musculus
aagtcgcagcagtactagcccaagc

SEQ ID NO: 509390 - DNA, 25 bp, Mus musculus
aagtcgcgcctccttaatcagcaag

SEQ ID NO: 509391 - DNA, 25 bp, Mus musculus
aagtcgcgcctcgttaatcagcaag

SEQ ID NO: 509392 - DNA, 25 bp, Mus musculus
aagtcgcggtgacctactttgtagc

SEQ ID NO: 509393 - DNA, 25 bp, Mus musculus
aagtcgcggtgagctactttgtagc

SEQ ID NO: 509394 - DNA, 25 bp, Mus musculus
aagtcgctcgctaggacaacatctt

SEQ ID NO: 509395 - DNA, 25 bp, Mus musculus
aagtcgctcgcttggacaacatctt

SEQ ID NO: 509396 - DNA, 25 bp, Mus musculus
aagtcggaagacaaacttgccaaag

SEQ ID NO: 509397 - DNA, 25 bp, Mus musculus
aagtcggaagactaacttgccaaag

SEQ ID NO: 509398 - DNA, 25 bp, Mus musculus
aagtcggaagagcactggaagacaa

SEQ ID NO: 509399 - DNA, 25 bp, Mus musculus
aagtcggaagaggactggaagacaa

SEQ ID NO: 509400 - DNA, 25 bp, Mus musculus
aagtcggacggacccttctacgccg

SEQ ID NO: 509401 - DNA, 25 bp, Mus musculus
aagtcggacggagccttctacgccg

SEQ ID NO: 509402 - DNA, 25 bp, Mus musculus
aagtcggattagagagaatatccag

SEQ ID NO: 509403 - DNA, 25 bp, Mus musculus
aagtcggattagtgagaatatccag

SEQ ID NO: 509404 - DNA, 25 bp, Mus musculus
aagtcggcaaaacgctgtagctctg

SEQ ID NO: 509405 - DNA, 25 bp, Mus musculus
aagtcggcaaaaggctgtagctctg

SEQ ID NO: 509406 - DNA, 25 bp, Mus musculus
aagtcggcaggtctcacgctacgga

SEQ ID NO: 509407 - DNA, 25 bp, Mus musculus
aagtcggcaggtgtcacgctacgga

SEQ ID NO: 509408 - DNA, 25 bp, Mus musculus
aagtcggcgcagaccttcctgtctg

SEQ ID NO: 509409 - DNA, 25 bp, Mus musculus
aagtcggcgcagtccttcctgtctg

SEQ ID NO: 509410 - DNA, 25 bp, Mus musculus
aagtcggcgcgtaaccgaggccagt

SEQ ID NO: 509411 - DNA, 25 bp, Mus musculus
aagtcggcgcgttaccgaggccagt

SEQ ID NO: 509412 - DNA, 25 bp, Mus musculus
aagtcggtcaggaagtcggcaagat

SEQ ID NO: 509413 - DNA, 25 bp, Mus musculus
aagtcggtcaggtagtcggcaagat

SEQ ID NO: 509414 - DNA, 25 bp, Mus musculus
aagtcggtgcttcagggcaagctca

SEQ ID NO: 509415 - DNA, 25 bp, Mus musculus
aagtcggtgcttgagggcaagctca

SEQ ID NO: 509416 - DNA, 25 bp, Mus musculus
aagtcgtctactcgggggataccat

SEQ ID NO: 509417 - DNA, 25 bp, Mus musculus
aagtcgtctactggggggataccat

SEQ ID NO: 509418 - DNA, 25 bp, Mus musculus
aagtcgtggccaacgctgctcagga

SEQ ID NO: 509419 - DNA, 25 bp, Mus musculus
aagtcgtggccatcgctgctcagga

SEQ ID NO: 509420 - DNA, 25 bp, Mus musculus
aagtcgtgtttcagtgtctccagga

SEQ ID NO: 509421 - DNA, 25 bp, Mus musculus
aagtcgtgtttctgtgtctccagga

SEQ ID NO: 509422 - DNA, 25 bp, Mus musculus
aagtctatgcatcggcaccgaagcc

SEQ ID NO: 509423 - DNA, 25 bp, Mus musculus
aagtctatgcatgggcaccgaagcc

SEQ ID NO: 509424 - DNA, 25 bp, Mus musculus
aagtctattcccaatggctgcctgg

SEQ ID NO: 509425 - DNA, 25 bp, Mus musculus
aagtctattcccattgggaccatcc

SEQ ID NO: 509426 - DNA, 25 bp, Mus musculus
aagtctattccctatggctgcctgg

SEQ ID NO: 509427 - DNA, 25 bp, Mus musculus
aagtctattccctttgggaccatcc

SEQ ID NO: 509428 - DNA, 25 bp, Mus musculus
aagtctcaactgaactgccttctcc

SEQ ID NO: 509429 - DNA, 25 bp, Mus musculus
aagtctcaactgtactgccttctcc

SEQ ID NO: 509430 - DNA, 25 bp, Mus musculus
aagtctcagaccctacgcttctacg

SEQ ID NO: 509431 - DNA, 25 bp, Mus musculus
aagtctcagaccgtacgcttctacg

SEQ ID NO: 509432 - DNA, 25 bp, Mus musculus
aagtctcatgaaccaaagctggttt

SEQ ID NO: 509433 - DNA, 25 bp, Mus musculus
aagtctcatgaagcaaagctggttt

SEQ ID NO: 509434 - DNA, 25 bp, Mus musculus
aagtctccaagtcctggcataacta

SEQ ID NO: 509435 - DNA, 25 bp, Mus musculus
aagtctccaagtgctggcataacta

SEQ ID NO: 509436 - DNA, 25 bp, Mus musculus
aagtctccatgtcgctaagagtgtt

SEQ ID NO: 509437 - DNA, 25 bp, Mus musculus
aagtctccatgtggctaagagtgtt

SEQ ID NO: 509438 - DNA, 25 bp, Mus musculus
aagtctccctttctcggtgtgtgag

SEQ ID NO: 509439 - DNA, 25 bp, Mus musculus
aagtctccctttgtcggtgtgtgag

SEQ ID NO: 509440 - DNA, 25 bp, Mus musculus
aagtctcctcccaggtgaccagatg

SEQ ID NO: 509441 - DNA, 25 bp, Mus musculus
aagtctcctccctggtgaccagatg

SEQ ID NO: 509442 - DNA, 25 bp, Mus musculus
aagtctcgcctgctttcccaggaga

SEQ ID NO: 509443 - DNA, 25 bp, Mus musculus
aagtctcgcctggtttcccaggaga

SEQ ID NO: 509444 - DNA, 25 bp, Mus musculus
aagtctctaagacctacattacaga

SEQ ID NO: 509445 - DNA, 25 bp, Mus musculus
aagtctctaagagctacattacaga

SEQ ID NO: 509446 - DNA, 25 bp, Mus musculus
aagtctctcatcaaatcctggaaaa

SEQ ID NO: 509447 - DNA, 25 bp, Mus musculus
aagtctctcatctaatcctggaaaa

SEQ ID NO: 509448 - DNA, 25 bp, Mus musculus
aagtctctctctctggtaaatgtac

SEQ ID NO: 509449 - DNA, 25 bp, Mus musculus
aagtctctctctgtggtaaatgtac

SEQ ID NO: 509450 - DNA, 25 bp, Mus musculus
aagtctctctgacggccgtgaagca

SEQ ID NO: 509451 - DNA, 25 bp, Mus musculus
aagtctctctgagggccgtgaagca

SEQ ID NO: 509452 - DNA, 25 bp, Mus musculus
aagtctcttcttcaccgtgatttga

SEQ ID NO: 509453 - DNA, 25 bp, Mus musculus
aagtctcttcttgaccgtgatttga

SEQ ID NO: 509454 - DNA, 25 bp, Mus musculus
aagtctgacaccagactgcatgagc

SEQ ID NO: 509455 - DNA, 25 bp, Mus musculus
aagtctgacacctgactgcatgagc

SEQ ID NO: 509456 - DNA, 25 bp, Mus musculus
aagtctgagctaccctgaggtctgt

SEQ ID NO: 509457 - DNA, 25 bp, Mus musculus
aagtctgagctagcctgaggtctgt

SEQ ID NO: 509458 - DNA, 25 bp, Mus musculus
aagtctgatgacacggagaaaaaag

SEQ ID NO: 509459 - DNA, 25 bp, Mus musculus
aagtctgatgactcggagaaaaaag

SEQ ID NO: 509460 - DNA, 25 bp, Mus musculus
aagtctggaacgatcccttcggaca

SEQ ID NO: 509461 - DNA, 25 bp, Mus musculus
aagtctggaacgttcccttcggaca

SEQ ID NO: 509462 - DNA, 25 bp, Mus musculus
aagtctggaattcaagatctcgagg

SEQ ID NO: 509463 - DNA, 25 bp, Mus musculus
aagtctggaattgaagatctcgagg

SEQ ID NO: 509464 - DNA, 25 bp, Mus musculus
aagtctggccctcatcctgagatca

SEQ ID NO: 509465 - DNA, 25 bp, Mus musculus
aagtctggccctgatcctgagatca

SEQ ID NO: 509466 - DNA, 25 bp, Mus musculus
aagtctggtgctctgaactccaacg

SEQ ID NO: 509467 - DNA, 25 bp, Mus musculus
aagtctggtgctgtgaactccaacg

SEQ ID NO: 509468 - DNA, 25 bp, Mus musculus
aagtctgtgaccctttcctgcagtg

SEQ ID NO: 509469 - DNA, 25 bp, Mus musculus
aagtctgtgaccgtttcctgcagtg

SEQ ID NO: 509470 - DNA, 25 bp, Mus musculus
aagtcttaactcattttgtctctgc

SEQ ID NO: 509471 - DNA, 25 bp, Mus musculus
aagtcttaactctttttgtctctgc

SEQ ID NO: 509472 - DNA, 25 bp, Mus musculus
aagtcttacccgctggtgcatgtgg

SEQ ID NO: 509473 - DNA, 25 bp, Mus musculus
aagtcttacccggtggtgcatgtgg

SEQ ID NO: 509474 - DNA, 25 bp, Mus musculus
aagtcttccgttccctgcttctgac

SEQ ID NO: 509475 - DNA, 25 bp, Mus musculus
aagtcttccgttgcctgcttctgac

SEQ ID NO: 509476 - DNA, 25 bp, Mus musculus
aagtcttgctgtactggcctgtgtc

SEQ ID NO: 509477 - DNA, 25 bp, Mus musculus
aagtcttgctgttctggcctgtgtc

SEQ ID NO: 509478 - DNA, 25 bp, Mus musculus
aagtcttggacacgcgaactcagag

SEQ ID NO: 509479 - DNA, 25 bp, Mus musculus
aagtcttggacaggcgaactcagag

SEQ ID NO: 509480 - DNA, 25 bp, Mus musculus
aagtcttggcgtcttcgctacatgg

SEQ ID NO: 509481 - DNA, 25 bp, Mus musculus
aagtcttggcgtgttcgctacatgg

SEQ ID NO: 509482 - DNA, 25 bp, Mus musculus
aagtcttgtactcctccttcgcctt

SEQ ID NO: 509483 - DNA, 25 bp, Mus musculus
aagtcttgtactgctccttcgcctt

SEQ ID NO: 509484 - DNA, 25 bp, Mus musculus
aagtcttgtttgagagccctgaaca

SEQ ID NO: 509485 - DNA, 25 bp, Mus musculus
aagtcttgtttgtgagccctgaaca

SEQ ID NO: 509486 - DNA, 25 bp, Mus musculus
aagtctttcggaccagctggtgaaa

SEQ ID NO: 509487 - DNA, 25 bp, Mus musculus
aagtctttcggagcagctggtgaaa

SEQ ID NO: 509488 - DNA, 25 bp, Mus musculus
aagtctttgctgcagttagtttctg

SEQ ID NO: 509489 - DNA, 25 bp, Mus musculus
aagtctttgctggagttagtttctg

SEQ ID NO: 509490 - DNA, 25 bp, Mus musculus
aagtctttgggcctatacatgagag

SEQ ID NO: 509491 - DNA, 25 bp, Mus musculus
aagtctttgggcgtatacatgagag

SEQ ID NO: 509492 - DNA, 25 bp, Mus musculus
aagtctttggtgaccattacttcaa

SEQ ID NO: 509493 - DNA, 25 bp, Mus musculus
aagtctttggtgtccattacttcaa

SEQ ID NO: 509494 - DNA, 25 bp, Mus musculus
aagtcttttgttcatcagctgggac

SEQ ID NO: 509495 - DNA, 25 bp, Mus musculus
aagtcttttgttgatcagctgggac

SEQ ID NO: 509496 - DNA, 25 bp, Mus musculus
aagtgaaaaacgcaggcatatatga

SEQ ID NO: 509497 - DNA, 25 bp, Mus musculus
aagtgaaaaacggaggcatatatga

SEQ ID NO: 509498 - DNA, 25 bp, Mus musculus
aagtgaaaatggaggactacggccg

SEQ ID NO: 509499 - DNA, 25 bp, Mus musculus
aagtgaaaatggtggactacggccg

SEQ ID NO: 509500 - DNA, 25 bp, Mus musculus
aagtgaaaatgtcgtgccccgagag

SEQ ID NO: 509501 - DNA, 25 bp, Mus musculus
aagtgaaaatgtggtgccccgagag

SEQ ID NO: 509502 - DNA, 25 bp, Mus musculus
aagtgaaaggcaagagtttgccagg

SEQ ID NO: 509503 - DNA, 25 bp, Mus musculus
aagtgaaaggcatgagtttgccagg

SEQ ID NO: 509504 - DNA, 25 bp, Mus musculus
aagtgaacgcccaggtgcctgtgct

SEQ ID NO: 509505 - DNA, 25 bp, Mus musculus
aagtgaacgccctggtgcctgtgct

SEQ ID NO: 509506 - DNA, 25 bp, Mus musculus
aagtgaagggctacccgcccactag

SEQ ID NO: 509507 - DNA, 25 bp, Mus musculus
aagtgaagggcttcccgcccactag

SEQ ID NO: 509508 - DNA, 25 bp, Mus musculus
aagtgaataatccaggtggctgcag

SEQ ID NO: 509509 - DNA, 25 bp, Mus musculus
aagtgaataatcgaggtggctgcag

SEQ ID NO: 509510 - DNA, 25 bp, Mus musculus
aagtgaataccaagggcttttgctc

SEQ ID NO: 509511 - DNA, 25 bp, Mus musculus
aagtgaataccatgggcttttgctc

SEQ ID NO: 509512 - DNA, 25 bp, Mus musculus
aagtgaatcccgactgaaacatctg

SEQ ID NO: 509513 - DNA, 25 bp, Mus musculus
aagtgaatcccgtctgaaacatctg

SEQ ID NO: 509514 - DNA, 25 bp, Mus musculus
aagtgacacaagcaagaactcaact

SEQ ID NO: 509515 - DNA, 25 bp, Mus musculus
aagtgacacaaggaagaactcaact

SEQ ID NO: 509516 - DNA, 25 bp, Mus musculus
aagtgaccagaccaaaatccttgtg

SEQ ID NO: 509517 - DNA, 25 bp, Mus musculus
aagtgaccagacgaaaatccttgtg

SEQ ID NO: 509518 - DNA, 25 bp, Mus musculus
aagtgaccagagagcgagctgcctt

SEQ ID NO: 509519 - DNA, 25 bp, Mus musculus
aagtgaccagagtgcgagctgcctt

SEQ ID NO: 509520 - DNA, 25 bp, Mus musculus
aagtgacccacgacatgatccgctg

SEQ ID NO: 509521 - DNA, 25 bp, Mus musculus
aagtgacccacgtcatgatccgctg

SEQ ID NO: 509522 - DNA, 25 bp, Mus musculus
aagtgacccatccatttctgcccag

SEQ ID NO: 509523 - DNA, 25 bp, Mus musculus
aagtgacccatcgatttctgcccag

SEQ ID NO: 509524 - DNA, 25 bp, Mus musculus
aagtgacccggacccaagcggcctt

SEQ ID NO: 509525 - DNA, 25 bp, Mus musculus
aagtgacccggagccaagcggcctt

SEQ ID NO: 509526 - DNA, 25 bp, Mus musculus
aagtgacctccacaaccaagttttg

SEQ ID NO: 509527 - DNA, 25 bp, Mus musculus
aagtgacctccagaaccaagttttg

SEQ ID NO: 509528 - DNA, 25 bp, Mus musculus
aagtgacgcagacccaaccagagaa

SEQ ID NO: 509529 - DNA, 25 bp, Mus musculus
aagtgacgcagagccaaccagagaa

SEQ ID NO: 509530 - DNA, 25 bp, Mus musculus
aagtgactctccatcgtggctggca

SEQ ID NO: 509531 - DNA, 25 bp, Mus musculus
aagtgactctccttcgtggctggca

SEQ ID NO: 509532 - DNA, 25 bp, Mus musculus
aagtgactgactctggcttcttggg

SEQ ID NO: 509533 - DNA, 25 bp, Mus musculus
aagtgactgactgtggcttcttggg

SEQ ID NO: 509534 - DNA, 25 bp, Mus musculus
aagtgactgatgcagttaagttggc

SEQ ID NO: 509535 - DNA, 25 bp, Mus musculus
aagtgactgatggagttaagttggc

SEQ ID NO: 509536 - DNA, 25 bp, Mus musculus
aagtgacttggccacagtcacaagc

SEQ ID NO: 509537 - DNA, 25 bp, Mus musculus
aagtgacttggcgacagtcacaagc

SEQ ID NO: 509538 - DNA, 25 bp, Mus musculus
aagtgagaaagtagccggcgtcccg

SEQ ID NO: 509539 - DNA, 25 bp, Mus musculus
aagtgagaaagttgccggcgtcccg

SEQ ID NO: 509540 - DNA, 25 bp, Mus musculus
aagtgagccggaacctgaaacaagt

SEQ ID NO: 509541 - DNA, 25 bp, Mus musculus
aagtgagccggatcctgaaacaagt

SEQ ID NO: 509542 - DNA, 25 bp, Mus musculus
aagtgagcctcaccaatgctctgcc

SEQ ID NO: 509543 - DNA, 25 bp, Mus musculus
aagtgagcctcagcaatgctctgcc

SEQ ID NO: 509544 - DNA, 25 bp, Mus musculus
aagtgagctacacgcaaccaaaccg

SEQ ID NO: 509545 - DNA, 25 bp, Mus musculus
aagtgagctacaggcaaccaaaccg

SEQ ID NO: 509546 - DNA, 25 bp, Mus musculus
aagtgagctgttccgtactgtatca

SEQ ID NO: 509547 - DNA, 25 bp, Mus musculus
aagtgagctgttgcgtactgtatca

SEQ ID NO: 509548 - DNA, 25 bp, Mus musculus
aagtgagggaaaactacgacaagca

SEQ ID NO: 509549 - DNA, 25 bp, Mus musculus
aagtgagggaaatctacgacaagca

SEQ ID NO: 509550 - DNA, 25 bp, Mus musculus
aagtgagggccaagagcaagctgct

SEQ ID NO: 509551 - DNA, 25 bp, Mus musculus
aagtgagggccatgagcaagctgct

SEQ ID NO: 509552 - DNA, 25 bp, Mus musculus
aagtgagtatcgctcagcaaaacct

SEQ ID NO: 509553 - DNA, 25 bp, Mus musculus
aagtgagtatcggtcagcaaaacct

SEQ ID NO: 509554 - DNA, 25 bp, Mus musculus
aagtgagtcttcctcagggcactga

SEQ ID NO: 509555 - DNA, 25 bp, Mus musculus
aagtgagtcttcgtcagggcactga

SEQ ID NO: 509556 - DNA, 25 bp, Mus musculus
aagtgagtgaacctctctcccggcc

SEQ ID NO: 509557 - DNA, 25 bp, Mus musculus
aagtgagtgaacgtctctcccggcc

SEQ ID NO: 509558 - DNA, 25 bp, Mus musculus
aagtgagtttgccaacggagcagct

SEQ ID NO: 509559 - DNA, 25 bp, Mus musculus
aagtgagtttgcgaacggagcagct

SEQ ID NO: 509560 - DNA, 25 bp, Mus musculus
aagtgataccgcacagcccagggtt

SEQ ID NO: 509561 - DNA, 25 bp, Mus musculus
aagtgataccgctcagcccagggtt

SEQ ID NO: 509562 - DNA, 25 bp, Mus musculus
aagtgatctatgcatcctgtgcggg

SEQ ID NO: 509563 - DNA, 25 bp, Mus musculus
aagtgatctatggatcctgtgcggg

SEQ ID NO: 509564 - DNA, 25 bp, Mus musculus
aagtgatctcagaccccaaaggcag

SEQ ID NO: 509565 - DNA, 25 bp, Mus musculus
aagtgatctcagtccccaaaggcag

SEQ ID NO: 509566 - DNA, 25 bp, Mus musculus
aagtgatctctgctgggcccaatgc

SEQ ID NO: 509567 - DNA, 25 bp, Mus musculus
aagtgatctctggtgggcccaatgc

SEQ ID NO: 509568 - DNA, 25 bp, Mus musculus
aagtgatgccatcttcgctgctgaa

SEQ ID NO: 509569 - DNA, 25 bp, Mus musculus
aagtgatgccatgttcgctgctgaa

SEQ ID NO: 509570 - DNA, 25 bp, Mus musculus
aagtgatgttaacgacagtgtgcca

SEQ ID NO: 509571 - DNA, 25 bp, Mus musculus
aagtgatgttaaggacagtgtgcca

SEQ ID NO: 509572 - DNA, 25 bp, Mus musculus
aagtgattgtcactggggccagcaa

SEQ ID NO: 509573 - DNA, 25 bp, Mus musculus
aagtgattgtcagtggggccagcaa

SEQ ID NO: 509574 - DNA, 25 bp, Mus musculus
aagtgattgtgtctccaggttggtt

SEQ ID NO: 509575 - DNA, 25 bp, Mus musculus
aagtgattgtgtgtccaggttggtt

SEQ ID NO: 509576 - DNA, 25 bp, Mus musculus
aagtgcaaaaagctgcatgacgcgc

SEQ ID NO: 509577 - DNA, 25 bp, Mus musculus
aagtgcaaaaaggtgcatgacgcgc

SEQ ID NO: 509578 - DNA, 25 bp, Mus musculus
aagtgcaaaccccttgcttcgagtc

SEQ ID NO: 509579 - DNA, 25 bp, Mus musculus
aagtgcaaacccgttgcttcgagtc

SEQ ID NO: 509580 - DNA, 25 bp, Mus musculus
aagtgcaaggaacgagtgactgaca

SEQ ID NO: 509581 - DNA, 25 bp, Mus musculus
aagtgcaaggaaggagtgactgaca

SEQ ID NO: 509582 - DNA, 25 bp, Mus musculus
aagtgcaaggcaccaacttgggaaa

SEQ ID NO: 509583 - DNA, 25 bp, Mus musculus
aagtgcaaggcagcaacttgggaaa

SEQ ID NO: 509584 - DNA, 25 bp, Mus musculus
aagtgcacaaagcaagctcccgcct

SEQ ID NO: 509585 - DNA, 25 bp, Mus musculus
aagtgcacaaaggaagctcccgcct

SEQ ID NO: 509586 - DNA, 25 bp, Mus musculus
aagtgcacagtcacttccggcgaca

SEQ ID NO: 509587 - DNA, 25 bp, Mus musculus
aagtgcacagtctcttccggcgaca

SEQ ID NO: 509588 - DNA, 25 bp, Mus musculus
aagtgcaccctgcagggcaccaaga

SEQ ID NO: 509589 - DNA, 25 bp, Mus musculus
aagtgcaccctggagggcaccaaga

SEQ ID NO: 509590 - DNA, 25 bp, Mus musculus
aagtgcactgcacctgcaagaacct

SEQ ID NO: 509591 - DNA, 25 bp, Mus musculus
aagtgcactgcagctgcaagaacct

SEQ ID NO: 509592 - DNA, 25 bp, Mus musculus
aagtgcagagcgactttcccctggg

SEQ ID NO: 509593 - DNA, 25 bp, Mus musculus
aagtgcagagcgtctttcccctggg

SEQ ID NO: 509594 - DNA, 25 bp, Mus musculus
aagtgcagcaggagccttccccgga

SEQ ID NO: 509595 - DNA, 25 bp, Mus musculus
aagtgcagcaggtgccttccccgga

SEQ ID NO: 509596 - DNA, 25 bp, Mus musculus
aagtgcagccccagcgccacgaagt

SEQ ID NO: 509597 - DNA, 25 bp, Mus musculus
aagtgcagccccaggtgcagcaggt

SEQ ID NO: 509598 - DNA, 25 bp, Mus musculus
aagtgcagcccctgcgccacgaagt

SEQ ID NO: 509599 - DNA, 25 bp, Mus musculus
aagtgcagcccctggtgcagcaggt

SEQ ID NO: 509600 - DNA, 25 bp, Mus musculus
aagtgcagcctgacgggcctccgtc

SEQ ID NO: 509601 - DNA, 25 bp, Mus musculus
aagtgcagcctgtcgggcctccgtc

SEQ ID NO: 509602 - DNA, 25 bp, Mus musculus
aagtgcagtcgcactgaaatgcaag

SEQ ID NO: 509603 - DNA, 25 bp, Mus musculus
aagtgcagtcgctctgaaatgcaag

SEQ ID NO: 509604 - DNA, 25 bp, Mus musculus
aagtgcatcattacacagagcccag

SEQ ID NO: 509605 - DNA, 25 bp, Mus musculus
aagtgcatcatttcacagagcccag

SEQ ID NO: 509606 - DNA, 25 bp, Mus musculus
aagtgccaatcgctacttgacattg

SEQ ID NO: 509607 - DNA, 25 bp, Mus musculus
aagtgccaatcggtacttgacattg

SEQ ID NO: 509608 - DNA, 25 bp, Mus musculus
aagtgccaatttacatgatgtgacc

SEQ ID NO: 509609 - DNA, 25 bp, Mus musculus
aagtgccaattttcatgatgtgacc

SEQ ID NO: 509610 - DNA, 25 bp, Mus musculus
aagtgccacgagctgcccttctacg

SEQ ID NO: 509611 - DNA, 25 bp, Mus musculus
aagtgccacgaggtgcccttctacg

SEQ ID NO: 509612 - DNA, 25 bp, Mus musculus
aagtgccagtgcagtaccacgtaga

SEQ ID NO: 509613 - DNA, 25 bp, Mus musculus
aagtgccagtgctgtaccacgtaga

SEQ ID NO: 509614 - DNA, 25 bp, Mus musculus
aagtgcccatggaagagatcgacgg

SEQ ID NO: 509615 - DNA, 25 bp, Mus musculus
aagtgcccatggtagagatcgacgg

SEQ ID NO: 509616 - DNA, 25 bp, Mus musculus
aagtgccccagtcccatggtgacag

SEQ ID NO: 509617 - DNA, 25 bp, Mus musculus
aagtgccccagtgccatggtgacag

SEQ ID NO: 509618 - DNA, 25 bp, Mus musculus
aagtgcccctggagaccccacgtgt

SEQ ID NO: 509619 - DNA, 25 bp, Mus musculus
aagtgcccctggtgaccccacgtgt

SEQ ID NO: 509620 - DNA, 25 bp, Mus musculus
aagtgcccgtggaatcggacctgca

SEQ ID NO: 509621 - DNA, 25 bp, Mus musculus
aagtgcccgtggtatcggacctgca

SEQ ID NO: 509622 - DNA, 25 bp, Mus musculus
aagtgccctgacctaccggatgtgg

SEQ ID NO: 509623 - DNA, 25 bp, Mus musculus
aagtgccctgacgtaccggatgtgg

SEQ ID NO: 509624 - DNA, 25 bp, Mus musculus
aagtgcccttaaccaatgaatcacc

SEQ ID NO: 509625 - DNA, 25 bp, Mus musculus
aagtgcccttaagcaatgaatcacc

SEQ ID NO: 509626 - DNA, 25 bp, Mus musculus
aagtgccggctcagcccagcgtgct

SEQ ID NO: 509627 - DNA, 25 bp, Mus musculus
aagtgccggctctgcccagcgtgct

SEQ ID NO: 509628 - DNA, 25 bp, Mus musculus
aagtgccggcttcgtcagtgtcagc

SEQ ID NO: 509629 - DNA, 25 bp, Mus musculus
aagtgccggcttggtcagtgtcagc

SEQ ID NO: 509630 - DNA, 25 bp, Mus musculus
aagtgcctggatcggcccaacacct

SEQ ID NO: 509631 - DNA, 25 bp, Mus musculus
aagtgcctggatgggcccaacacct

SEQ ID NO: 509632 - DNA, 25 bp, Mus musculus
aagtgcctggcaatttattatcctg

SEQ ID NO: 509633 - DNA, 25 bp, Mus musculus
aagtgcctggcattttattatcctg

SEQ ID NO: 509634 - DNA, 25 bp, Mus musculus
aagtgcgagccaccagctctggagc

SEQ ID NO: 509635 - DNA, 25 bp, Mus musculus
aagtgcgagccagcagctctggagc

SEQ ID NO: 509636 - DNA, 25 bp, Mus musculus
aagtgcgccacaaggccttccagct

SEQ ID NO: 509637 - DNA, 25 bp, Mus musculus
aagtgcgccacatggccttccagct

SEQ ID NO: 509638 - DNA, 25 bp, Mus musculus
aagtgcgcggcgatttctttggaac

SEQ ID NO: 509639 - DNA, 25 bp, Mus musculus
aagtgcgcggcgttttctttggaac

SEQ ID NO: 509640 - DNA, 25 bp, Mus musculus
aagtgcggaatacctgtggcacctg

SEQ ID NO: 509641 - DNA, 25 bp, Mus musculus
aagtgcggaatagctgtggcacctg

SEQ ID NO: 509642 - DNA, 25 bp, Mus musculus
aagtgcgggcgaagtgtatataaag

SEQ ID NO: 509643 - DNA, 25 bp, Mus musculus
aagtgcgggcgatgtgtatataaag

SEQ ID NO: 509644 - DNA, 25 bp, Mus musculus
aagtgcgttgctccctgtttcccag

SEQ ID NO: 509645 - DNA, 25 bp, Mus musculus
aagtgcgttgctgcctgtttcccag

SEQ ID NO: 509646 - DNA, 25 bp, Mus musculus
aagtgctaaaacagttaacagaaga

SEQ ID NO: 509647 - DNA, 25 bp, Mus musculus
aagtgctaaaactgttaacagaaga

SEQ ID NO: 509648 - DNA, 25 bp, Mus musculus
aagtgctcacagatctgcactacag

SEQ ID NO: 509649 - DNA, 25 bp, Mus musculus
aagtgctcacagttctgcactacag

SEQ ID NO: 509650 - DNA, 25 bp, Mus musculus
aagtgctcagtcacccggtctcagg

SEQ ID NO: 509651 - DNA, 25 bp, Mus musculus
aagtgctcagtctcccggtctcagg

SEQ ID NO: 509652 - DNA, 25 bp, Mus musculus
aagtgctcgcccagtctgcacgtcg

SEQ ID NO: 509653 - DNA, 25 bp, Mus musculus
aagtgctcgccctgtctgcacgtcg

SEQ ID NO: 509654 - DNA, 25 bp, Mus musculus
aagtgctgaacaaatctcttgctga

SEQ ID NO: 509655 - DNA, 25 bp, Mus musculus
aagtgctgaacatatctcttgctga

SEQ ID NO: 509656 - DNA, 25 bp, Mus musculus
aagtgctgaaccctatagaagacag

SEQ ID NO: 509657 - DNA, 25 bp, Mus musculus
aagtgctgaaccgtatagaagacag

SEQ ID NO: 509658 - DNA, 25 bp, Mus musculus
aagtgctgtcccagagccagcttcc

SEQ ID NO: 509659 - DNA, 25 bp, Mus musculus
aagtgctgtccctgagccagcttcc

SEQ ID NO: 509660 - DNA, 25 bp, Mus musculus
aagtgctgtgacagttatgttcgac

SEQ ID NO: 509661 - DNA, 25 bp, Mus musculus
aagtgctgtgactgttatgttcgac

SEQ ID NO: 509662 - DNA, 25 bp, Mus musculus
aagtgctgttcccagactagcacgt

SEQ ID NO: 509663 - DNA, 25 bp, Mus musculus
aagtgctgttccgagactagcacgt

SEQ ID NO: 509664 - DNA, 25 bp, Mus musculus
aagtgctgtttgcaaatcctcctag

SEQ ID NO: 509665 - DNA, 25 bp, Mus musculus
aagtgctgtttggaaatcctcctag

SEQ ID NO: 509666 - DNA, 25 bp, Mus musculus
aagtgcttgcttcggaattctgtcc

SEQ ID NO: 509667 - DNA, 25 bp, Mus musculus
aagtgcttgcttgggaattctgtcc

SEQ ID NO: 509668 - DNA, 25 bp, Mus musculus
aagtgcttgtgaagggacgacagcc

SEQ ID NO: 509669 - DNA, 25 bp, Mus musculus
aagtgcttgtgatgggacgacagcc

SEQ ID NO: 509670 - DNA, 25 bp, Mus musculus
aagtgcttgttcagctcgtggctca

SEQ ID NO: 509671 - DNA, 25 bp, Mus musculus
aagtgcttgttctgctcgtggctca

SEQ ID NO: 509672 - DNA, 25 bp, Mus musculus
aagtgcttttctcctgccccgtgag

SEQ ID NO: 509673 - DNA, 25 bp, Mus musculus
aagtgcttttctgctgccccgtgag

SEQ ID NO: 509674 - DNA, 25 bp, Mus musculus
aagtggacagagcacctcatcttgc

SEQ ID NO: 509675 - DNA, 25 bp, Mus musculus
aagtggacagaggacctcatcttgc

SEQ ID NO: 509676 - DNA, 25 bp, Mus musculus
aagtggacctttccacacttgtggg

SEQ ID NO: 509677 - DNA, 25 bp, Mus musculus
aagtggacctttgcacacttgtggg

SEQ ID NO: 509678 - DNA, 25 bp, Mus musculus
aagtggacttggagcgcgtgcgggt

SEQ ID NO: 509679 - DNA, 25 bp, Mus musculus
aagtggacttggtgcgcgtgcgggt

SEQ ID NO: 509680 - DNA, 25 bp, Mus musculus
aagtggagaaccagaaccttcgagg

SEQ ID NO: 509681 - DNA, 25 bp, Mus musculus
aagtggagaacctgaaccttcgagg

SEQ ID NO: 509682 - DNA, 25 bp, Mus musculus
aagtggagaccaatctgcttaaaat

SEQ ID NO: 509683 - DNA, 25 bp, Mus musculus
aagtggagaccattctgcttaaaat

SEQ ID NO: 509684 - DNA, 25 bp, Mus musculus
aagtggagatccaccggcagtacgt

SEQ ID NO: 509685 - DNA, 25 bp, Mus musculus
aagtggagatcctccggcagtacgt

SEQ ID NO: 509686 - DNA, 25 bp, Mus musculus
aagtggagccctcaggcatcacgtg

SEQ ID NO: 509687 - DNA, 25 bp, Mus musculus
aagtggagccctgaggcatcacgtg

SEQ ID NO: 509688 - DNA, 25 bp, Mus musculus
aagtggatatcaaagcaacacagca

SEQ ID NO: 509689 - DNA, 25 bp, Mus musculus
aagtggatatcatagcaacacagca

SEQ ID NO: 509690 - DNA, 25 bp, Mus musculus
aagtggatcaggacaaggaaggcaa

SEQ ID NO: 509691 - DNA, 25 bp, Mus musculus
aagtggatcaggtcaaggaaggcaa

SEQ ID NO: 509692 - DNA, 25 bp, Mus musculus
aagtggatcgatagcagtcagagcc

SEQ ID NO: 509693 - DNA, 25 bp, Mus musculus
aagtggatcgattgcagtcagagcc

SEQ ID NO: 509694 - DNA, 25 bp, Mus musculus
aagtggatcgtgatctggccctgca

SEQ ID NO: 509695 - DNA, 25 bp, Mus musculus
aagtggatcgtgttctggccctgca

SEQ ID NO: 509696 - DNA, 25 bp, Mus musculus
aagtggatgagacccgcaagtgcta

SEQ ID NO: 509697 - DNA, 25 bp, Mus musculus
aagtggatgagagccgcaagtgcta

SEQ ID NO: 509698 - DNA, 25 bp, Mus musculus
aagtggatttctccattggccgtga

SEQ ID NO: 509699 - DNA, 25 bp, Mus musculus
aagtggatttctgcattggccgtga

SEQ ID NO: 509700 - DNA, 25 bp, Mus musculus
aagtggcactgtatgtggacctgga

SEQ ID NO: 509701 - DNA, 25 bp, Mus musculus
aagtggcactgtttgtggacctgga

SEQ ID NO: 509702 - DNA, 25 bp, Mus musculus
aagtggcattgcacagccttggatg

SEQ ID NO: 509703 - DNA, 25 bp, Mus musculus
aagtggcattgctcagccttggatg

SEQ ID NO: 509704 - DNA, 25 bp, Mus musculus
aagtggccacaacaggtctgtgtgc

SEQ ID NO: 509705 - DNA, 25 bp, Mus musculus
aagtggccacaagaggtctgtgtgc

SEQ ID NO: 509706 - DNA, 25 bp, Mus musculus
aagtggccacacacgagaaggagtg

SEQ ID NO: 509707 - DNA, 25 bp, Mus musculus
aagtggccacactcgagaaggagtg

SEQ ID NO: 509708 - DNA, 25 bp, Mus musculus
aagtggccggctccccgctttgagc

SEQ ID NO: 509709 - DNA, 25 bp, Mus musculus
aagtggccggctgcccgctttgagc

SEQ ID NO: 509710 - DNA, 25 bp, Mus musculus
aagtggccgtggacctcctggaaag

SEQ ID NO: 509711 - DNA, 25 bp, Mus musculus
aagtggccgtggtcctcctggaaag

SEQ ID NO: 509712 - DNA, 25 bp, Mus musculus
aagtggcctcccagcttctctgtcg

SEQ ID NO: 509713 - DNA, 25 bp, Mus musculus
aagtggcctccctgcttctctgtcg

SEQ ID NO: 509714 - DNA, 25 bp, Mus musculus
aagtggcctggactaaagatgagct

SEQ ID NO: 509715 - DNA, 25 bp, Mus musculus
aagtggcctggagtaaagatgagct

SEQ ID NO: 509716 - DNA, 25 bp, Mus musculus
aagtggccttcgacagctctgccgg

SEQ ID NO: 509717 - DNA, 25 bp, Mus musculus
aagtggccttcgtcagctctgccgg

SEQ ID NO: 509718 - DNA, 25 bp, Mus musculus
aagtggcgagagacagtgttccgta

SEQ ID NO: 509719 - DNA, 25 bp, Mus musculus
aagtggcgagagtcagtgttccgta

SEQ ID NO: 509720 - DNA, 25 bp, Mus musculus
aagtggctatgtcctctcagtggca

SEQ ID NO: 509721 - DNA, 25 bp, Mus musculus
aagtggctatgtgctctcagtggca

SEQ ID NO: 509722 - DNA, 25 bp, Mus musculus
aagtggctccaaaaggagatgaaga

SEQ ID NO: 509723 - DNA, 25 bp, Mus musculus
aagtggctccaataggagatgaaga

SEQ ID NO: 509724 - DNA, 25 bp, Mus musculus
aagtggctgacgaactgctctttga

SEQ ID NO: 509725 - DNA, 25 bp, Mus musculus
aagtggctgacgtactgctctttga

SEQ ID NO: 509726 - DNA, 25 bp, Mus musculus
aagtggctgaggattacgtcagtgt

SEQ ID NO: 509727 - DNA, 25 bp, Mus musculus
aagtggctgaggtttacgtcagtgt

SEQ ID NO: 509728 - DNA, 25 bp, Mus musculus
aagtggctgatgctctatgctgtgt

SEQ ID NO: 509729 - DNA, 25 bp, Mus musculus
aagtggctgatggtctatgctgtgt

SEQ ID NO: 509730 - DNA, 25 bp, Mus musculus
aagtggctgctcagcattgggtcca

SEQ ID NO: 509731 - DNA, 25 bp, Mus musculus
aagtggctgctctgcattgggtcca

SEQ ID NO: 509732 - DNA, 25 bp, Mus musculus
aagtggctgcttctcgcactgagcg

SEQ ID NO: 509733 - DNA, 25 bp, Mus musculus
aagtggctgcttgtcgcactgagcg

SEQ ID NO: 509734 - DNA, 25 bp, Mus musculus
aagtgggaaatgacgttgaactccg

SEQ ID NO: 509735 - DNA, 25 bp, Mus musculus
aagtgggaaatgtcgttgaactccg

SEQ ID NO: 509736 - DNA, 25 bp, Mus musculus
aagtgggaagccaagcctttctgca

SEQ ID NO: 509737 - DNA, 25 bp, Mus musculus
aagtgggaagcctagcctttctgca

SEQ ID NO: 509738 - DNA, 25 bp, Mus musculus
aagtgggacaggcaaatcctcaaag

SEQ ID NO: 509739 - DNA, 25 bp, Mus musculus
aagtgggacagggaaatcctcaaag

SEQ ID NO: 509740 - DNA, 25 bp, Mus musculus
aagtgggactacactgcccagcagg

SEQ ID NO: 509741 - DNA, 25 bp, Mus musculus
aagtgggactactctgcccagcagg

SEQ ID NO: 509742 - DNA, 25 bp, Mus musculus
aagtgggaggccagcccatctgtgt

SEQ ID NO: 509743 - DNA, 25 bp, Mus musculus
aagtgggaggcctgcccatctgtgt

SEQ ID NO: 509744 - DNA, 25 bp, Mus musculus
aagtgggcaaccaggcccgtgaccg

SEQ ID NO: 509745 - DNA, 25 bp, Mus musculus
aagtgggcaacctggcccgtgaccg

SEQ ID NO: 509746 - DNA, 25 bp, Mus musculus
aagtgggcagctcagtacttgaaag

SEQ ID NO: 509747 - DNA, 25 bp, Mus musculus
aagtgggcagctgagtacttgaaag

SEQ ID NO: 509748 - DNA, 25 bp, Mus musculus
aagtgggcgactatggtcgctttca

SEQ ID NO: 509749 - DNA, 25 bp, Mus musculus
aagtgggcgactttggtcgctttca

SEQ ID NO: 509750 - DNA, 25 bp, Mus musculus
aagtgggctagtctgagcaacccgc

SEQ ID NO: 509751 - DNA, 25 bp, Mus musculus
aagtgggctagtgtgagcaacccgc

SEQ ID NO: 509752 - DNA, 25 bp, Mus musculus
aagtgggtctgcctattggcttctc

SEQ ID NO: 509753 - DNA, 25 bp, Mus musculus
aagtgggtctgcgtattggcttctc

SEQ ID NO: 509754 - DNA, 25 bp, Mus musculus
aagtggtaaagcagccttgtccttc

SEQ ID NO: 509755 - DNA, 25 bp, Mus musculus
aagtggtaaagctgccttgtccttc

SEQ ID NO: 509756 - DNA, 25 bp, Mus musculus
aagtggtacacacctcagggctgcg

SEQ ID NO: 509757 - DNA, 25 bp, Mus musculus
aagtggtacacagctcagggctgcg

SEQ ID NO: 509758 - DNA, 25 bp, Mus musculus
aagtggtagactccacaattaaaac

SEQ ID NO: 509759 - DNA, 25 bp, Mus musculus
aagtggtagactgcacaattaaaac

SEQ ID NO: 509760 - DNA, 25 bp, Mus musculus
aagtggtccccacttgagaacaagt

SEQ ID NO: 509761 - DNA, 25 bp, Mus musculus
aagtggtccccagttgagaacaagt

SEQ ID NO: 509762 - DNA, 25 bp, Mus musculus
aagtggtgcaccaacggcccgtccg

SEQ ID NO: 509763 - DNA, 25 bp, Mus musculus
aagtggtgcacctacggcccgtccg

SEQ ID NO: 509764 - DNA, 25 bp, Mus musculus
aagtggtggcgacgcaatggctgcc

SEQ ID NO: 509765 - DNA, 25 bp, Mus musculus
aagtggtggcgaggcaatggctgcc

SEQ ID NO: 509766 - DNA, 25 bp, Mus musculus
aagtggtggtcaccatggagcactc

SEQ ID NO: 509767 - DNA, 25 bp, Mus musculus
aagtggtggtcagcatggagcactc

SEQ ID NO: 509768 - DNA, 25 bp, Mus musculus
aagtggtgtttgatgctgagccaga

SEQ ID NO: 509769 - DNA, 25 bp, Mus musculus
aagtggtgtttgttgctgagccaga

SEQ ID NO: 509770 - DNA, 25 bp, Mus musculus
aagtggttactgactgctgtgcccc

SEQ ID NO: 509771 - DNA, 25 bp, Mus musculus
aagtggttactgtctgctgtgcccc

SEQ ID NO: 509772 - DNA, 25 bp, Mus musculus
aagtgtaaccagagcggcaaagcct

SEQ ID NO: 509773 - DNA, 25 bp, Mus musculus
aagtgtaaccagtgcggcaaagcct

SEQ ID NO: 509774 - DNA, 25 bp, Mus musculus
aagtgtaagccgatcagcatggtgg

SEQ ID NO: 509775 - DNA, 25 bp, Mus musculus
aagtgtaagccgttcagcatggtgg

SEQ ID NO: 509776 - DNA, 25 bp, Mus musculus
aagtgtaaggacagagaaaggcaca

SEQ ID NO: 509777 - DNA, 25 bp, Mus musculus
aagtgtaaggactgagaaaggcaca

SEQ ID NO: 509778 - DNA, 25 bp, Mus musculus
aagtgtacagacaaaggctgcgaca

SEQ ID NO: 509779 - DNA, 25 bp, Mus musculus
aagtgtacagactaaggctgcgaca

SEQ ID NO: 509780 - DNA, 25 bp, Mus musculus
aagtgtacttctctaggcaccccag

SEQ ID NO: 509781 - DNA, 25 bp, Mus musculus
aagtgtacttctgtaggcaccccag

SEQ ID NO: 509782 - DNA, 25 bp, Mus musculus
aagtgtagacgtcgcaaatgatttg

SEQ ID NO: 509783 - DNA, 25 bp, Mus musculus
aagtgtagacgtggcaaatgatttg

SEQ ID NO: 509784 - DNA, 25 bp, Mus musculus
aagtgtaggtctcacgtggcactga

SEQ ID NO: 509785 - DNA, 25 bp, Mus musculus
aagtgtaggtctgacgtggcactga

SEQ ID NO: 509786 - DNA, 25 bp, Mus musculus
aagtgtatggaaacccacaacagta

SEQ ID NO: 509787 - DNA, 25 bp, Mus musculus
aagtgtatggaatcccacaacagta

SEQ ID NO: 509788 - DNA, 25 bp, Mus musculus
aagtgtcaaggtcatgagagactcc

SEQ ID NO: 509789 - DNA, 25 bp, Mus musculus
aagtgtcaaggtgatgagagactcc

SEQ ID NO: 509790 - DNA, 25 bp, Mus musculus
aagtgtcacagcctaacggcgtcgt

SEQ ID NO: 509791 - DNA, 25 bp, Mus musculus
aagtgtcacagcgtaacggcgtcgt

SEQ ID NO: 509792 - DNA, 25 bp, Mus musculus
aagtgtcaggaaacggagctcatga

SEQ ID NO: 509793 - DNA, 25 bp, Mus musculus
aagtgtcaggaatcggagctcatga

SEQ ID NO: 509794 - DNA, 25 bp, Mus musculus
aagtgtcaggatccccccctggatg

SEQ ID NO: 509795 - DNA, 25 bp, Mus musculus
aagtgtcaggatgcccccctggatg

SEQ ID NO: 509796 - DNA, 25 bp, Mus musculus
aagtgtcagtgtcacgagctttgca

SEQ ID NO: 509797 - DNA, 25 bp, Mus musculus
aagtgtcagtgtgacgagctttgca

SEQ ID NO: 509798 - DNA, 25 bp, Mus musculus
aagtgtcatgtcaccacctgagctg

SEQ ID NO: 509799 - DNA, 25 bp, Mus musculus
aagtgtcatgtctccacctgagctg

SEQ ID NO: 509800 - DNA, 25 bp, Mus musculus
aagtgtccactgaacacccagcctt

SEQ ID NO: 509801 - DNA, 25 bp, Mus musculus
aagtgtccactgtacacccagcctt

SEQ ID NO: 509802 - DNA, 25 bp, Mus musculus
aagtgtccagacattgccatacagc

SEQ ID NO: 509803 - DNA, 25 bp, Mus musculus
aagtgtccagactttgccatacagc

SEQ ID NO: 509804 - DNA, 25 bp, Mus musculus
aagtgtccatgcagacgtgtctggc

SEQ ID NO: 509805 - DNA, 25 bp, Mus musculus
aagtgtccatgctgacgtgtctggc

SEQ ID NO: 509806 - DNA, 25 bp, Mus musculus
aagtgtccgcaaatccagccaggat

SEQ ID NO: 509807 - DNA, 25 bp, Mus musculus
aagtgtccgcaattccagccaggat

SEQ ID NO: 509808 - DNA, 25 bp, Mus musculus
aagtgtcctgagagcacggccatcg

SEQ ID NO: 509809 - DNA, 25 bp, Mus musculus
aagtgtcctgagtgcacggccatcg

SEQ ID NO: 509810 - DNA, 25 bp, Mus musculus
aagtgtcgcctcctgaagaacatga

SEQ ID NO: 509811 - DNA, 25 bp, Mus musculus
aagtgtcgcctcgtgaagaacatga

SEQ ID NO: 509812 - DNA, 25 bp, Mus musculus
aagtgtctcgaaatgtgggcaaatc

SEQ ID NO: 509813 - DNA, 25 bp, Mus musculus
aagtgtctcgaattgtgggcaaatc

SEQ ID NO: 509814 - DNA, 25 bp, Mus musculus
aagtgtctcttccttggcctcatct

SEQ ID NO: 509815 - DNA, 25 bp, Mus musculus
aagtgtctcttcgttggcctcatct

SEQ ID NO: 509816 - DNA, 25 bp, Mus musculus
aagtgtctgagtcctgctgaagaaa

SEQ ID NO: 509817 - DNA, 25 bp, Mus musculus
aagtgtctgagtgctgctgaagaaa

SEQ ID NO: 509818 - DNA, 25 bp, Mus musculus
aagtgtctgctgatcttggccccgg

SEQ ID NO: 509819 - DNA, 25 bp, Mus musculus
aagtgtctgctgttcttggccccgg

SEQ ID NO: 509820 - DNA, 25 bp, Mus musculus
aagtgtctgcttccttggccaagca

SEQ ID NO: 509821 - DNA, 25 bp, Mus musculus
aagtgtctgcttgcttggccaagca

SEQ ID NO: 509822 - DNA, 25 bp, Mus musculus
aagtgtgaagagctgagtagtctcc

SEQ ID NO: 509823 - DNA, 25 bp, Mus musculus
aagtgtgaagaggtgagtagtctcc

SEQ ID NO: 509824 - DNA, 25 bp, Mus musculus
aagtgtgaatgtagtcgtggctatc

SEQ ID NO: 509825 - DNA, 25 bp, Mus musculus
aagtgtgaatgttgtcgtggctatc

SEQ ID NO: 509826 - DNA, 25 bp, Mus musculus
aagtgtgagctgaactgcattccca

SEQ ID NO: 509827 - DNA, 25 bp, Mus musculus
aagtgtgagctgtactgcattccca

SEQ ID NO: 509828 - DNA, 25 bp, Mus musculus
aagtgtgcaaacaacagggtgtggc

SEQ ID NO: 509829 - DNA, 25 bp, Mus musculus
aagtgtgcaaactacagggtgtggc

SEQ ID NO: 509830 - DNA, 25 bp, Mus musculus
aagtgtgcgatgacagccctgagct

SEQ ID NO: 509831 - DNA, 25 bp, Mus musculus
aagtgtgcgatgtcagccctgagct

SEQ ID NO: 509832 - DNA, 25 bp, Mus musculus
aagtgtgctcctctggcggatagcc

SEQ ID NO: 509833 - DNA, 25 bp, Mus musculus
aagtgtgctcctgtggcggatagcc

SEQ ID NO: 509834 - DNA, 25 bp, Mus musculus
aagtgtggccccacacgggcctcag

SEQ ID NO: 509835 - DNA, 25 bp, Mus musculus
aagtgtggcccctcacgggcctcag

SEQ ID NO: 509836 - DNA, 25 bp, Mus musculus
aagtgtggtaccagggcagctgaac

SEQ ID NO: 509837 - DNA, 25 bp, Mus musculus
aagtgtggtacctgggcagctgaac

SEQ ID NO: 509838 - DNA, 25 bp, Mus musculus
aagtgtggtactacggcctccagta

SEQ ID NO: 509839 - DNA, 25 bp, Mus musculus
aagtgtggtacttcggcctccagta

SEQ ID NO: 509840 - DNA, 25 bp, Mus musculus
aagtgtgtaataatccccagtgtgg

SEQ ID NO: 509841 - DNA, 25 bp, Mus musculus
aagtgtgtaatattccccagtgtgg

SEQ ID NO: 509842 - DNA, 25 bp, Mus musculus
aagtgtgtccccaatctgcatgctg

SEQ ID NO: 509843 - DNA, 25 bp, Mus musculus
aagtgtgtcccctatctgcatgctg

SEQ ID NO: 509844 - DNA, 25 bp, Mus musculus
aagtgtgtctctctttgctagagct

SEQ ID NO: 509845 - DNA, 25 bp, Mus musculus
aagtgtgtctctgtttgctagagct

SEQ ID NO: 509846 - DNA, 25 bp, Mus musculus
aagtgtgtgacacagcctagaagcc

SEQ ID NO: 509847 - DNA, 25 bp, Mus musculus
aagtgtgtgacagagcctagaagcc

SEQ ID NO: 509848 - DNA, 25 bp, Mus musculus
aagtgttaactcaggcttctgggcc

SEQ ID NO: 509849 - DNA, 25 bp, Mus musculus
aagtgttaactctggcttctgggcc

SEQ ID NO: 509850 - DNA, 25 bp, Mus musculus
aagtgttacacaaccaccagcctgc

SEQ ID NO: 509851 - DNA, 25 bp, Mus musculus
aagtgttacacatccaccagcctgc

SEQ ID NO: 509852 - DNA, 25 bp, Mus musculus
aagtgttctgtactccaaccgtgca

SEQ ID NO: 509853 - DNA, 25 bp, Mus musculus
aagtgttctgtagtccaaccgtgca

SEQ ID NO: 509854 - DNA, 25 bp, Mus musculus
aagtgtttcctgaagttctgtatcg

SEQ ID NO: 509855 - DNA, 25 bp, Mus musculus
aagtgtttcctgtagttctgtatcg

SEQ ID NO: 509856 - DNA, 25 bp, Mus musculus
aagtgtttgatcaccctgtccactg

SEQ ID NO: 509857 - DNA, 25 bp, Mus musculus
aagtgtttgatctccctgtccactg

SEQ ID NO: 509858 - DNA, 25 bp, Mus musculus
aagtgttttctaagtcgctgcgccg

SEQ ID NO: 509859 - DNA, 25 bp, Mus musculus
aagtgttttctatgtcgctgcgccg

SEQ ID NO: 509860 - DNA, 25 bp, Mus musculus
aagttaaagtctcacacggccgctg

SEQ ID NO: 509861 - DNA, 25 bp, Mus musculus
aagttaaagtctgacacggccgctg

SEQ ID NO: 509862 - DNA, 25 bp, Mus musculus
aagttaaagtgtaggaaagatggcg

SEQ ID NO: 509863 - DNA, 25 bp, Mus musculus
aagttaaagtgttggaaagatggcg

SEQ ID NO: 509864 - DNA, 25 bp, Mus musculus
aagttaatcgggatggaggccatgc

SEQ ID NO: 509865 - DNA, 25 bp, Mus musculus
aagttaatcgggttggaggccatgc

SEQ ID NO: 509866 - DNA, 25 bp, Mus musculus
aagttaatgacgaaggatacacgcc

SEQ ID NO: 509867 - DNA, 25 bp, Mus musculus
aagttaatgacgtaggatacacgcc

SEQ ID NO: 509868 - DNA, 25 bp, Mus musculus
aagttacagaaacaatgcgttccag

SEQ ID NO: 509869 - DNA, 25 bp, Mus musculus
aagttacagaaagaatgcgttccag

SEQ ID NO: 509870 - DNA, 25 bp, Mus musculus
aagttacagctcaacttgaacacca

SEQ ID NO: 509871 - DNA, 25 bp, Mus musculus
aagttacagctctacttgaacacca

SEQ ID NO: 509872 - DNA, 25 bp, Mus musculus
aagttacatggcacctcaattctgg

SEQ ID NO: 509873 - DNA, 25 bp, Mus musculus
aagttacatggctcctcaattctgg

SEQ ID NO: 509874 - DNA, 25 bp, Mus musculus
aagttacgagacaacatctggaaca

SEQ ID NO: 509875 - DNA, 25 bp, Mus musculus
aagttacgagactacatctggaaca

SEQ ID NO: 509876 - DNA, 25 bp, Mus musculus
aagttactactacatgttgcccatg

SEQ ID NO: 509877 - DNA, 25 bp, Mus musculus
aagttactactagatgttgcccatg

SEQ ID NO: 509878 - DNA, 25 bp, Mus musculus
aagttactcaagacagctttccagc

SEQ ID NO: 509879 - DNA, 25 bp, Mus musculus
aagttactcaagtcagctttccagc

SEQ ID NO: 509880 - DNA, 25 bp, Mus musculus
aagttacttctgattggcgattctg

SEQ ID NO: 509881 - DNA, 25 bp, Mus musculus
aagttacttctgtttggcgattctg

SEQ ID NO: 509882 - DNA, 25 bp, Mus musculus
aagttagtgaagcttagcgctgtac

SEQ ID NO: 509883 - DNA, 25 bp, Mus musculus
aagttagtgaaggttagcgctgtac

SEQ ID NO: 509884 - DNA, 25 bp, Mus musculus
aagttatctcaaactaatgaccgag

SEQ ID NO: 509885 - DNA, 25 bp, Mus musculus
aagttatctcaatctaatgaccgag

SEQ ID NO: 509886 - DNA, 25 bp, Mus musculus
aagttatgacacattgccccattga

SEQ ID NO: 509887 - DNA, 25 bp, Mus musculus
aagttatgacactttgccccattga

SEQ ID NO: 509888 - DNA, 25 bp, Mus musculus
aagttatgagatccggcactacgga

SEQ ID NO: 509889 - DNA, 25 bp, Mus musculus
aagttatgagatgcggcactacgga

SEQ ID NO: 509890 - DNA, 25 bp, Mus musculus
aagttatggaatactctgggtgtct

SEQ ID NO: 509891 - DNA, 25 bp, Mus musculus
aagttatggaattctctgggtgtct

SEQ ID NO: 509892 - DNA, 25 bp, Mus musculus
aagttatgggatctcgtggctgtct

SEQ ID NO: 509893 - DNA, 25 bp, Mus musculus
aagttatgggatgtcgtggctgtct

SEQ ID NO: 509894 - DNA, 25 bp, Mus musculus
aagttattgggcctcttgagaccat

SEQ ID NO: 509895 - DNA, 25 bp, Mus musculus
aagttattgggcgtcttgagaccat

SEQ ID NO: 509896 - DNA, 25 bp, Mus musculus
aagttattggtgcagatgatctctc

SEQ ID NO: 509897 - DNA, 25 bp, Mus musculus
aagttattggtggagatgatctctc

SEQ ID NO: 509898 - DNA, 25 bp, Mus musculus
aagttcaactttatcatcaggagcc

SEQ ID NO: 509899 - DNA, 25 bp, Mus musculus
aagttcaactttttcatcaggagcc

SEQ ID NO: 509900 - DNA, 25 bp, Mus musculus
aagttcaagaatctgcccatccaag

SEQ ID NO: 509901 - DNA, 25 bp, Mus musculus
aagttcaagaatgtgcccatccaag

SEQ ID NO: 509902 - DNA, 25 bp, Mus musculus
aagttcaaggccctgccttccctgt

SEQ ID NO: 509903 - DNA, 25 bp, Mus musculus
aagttcaaggccgtgccttccctgt

SEQ ID NO: 509904 - DNA, 25 bp, Mus musculus
aagttcaaggctatcacttttgatg

SEQ ID NO: 509905 - DNA, 25 bp, Mus musculus
aagttcaaggctttcacttttgatg

SEQ ID NO: 509906 - DNA, 25 bp, Mus musculus
aagttcaagtgccatgatgtcgtca

SEQ ID NO: 509907 - DNA, 25 bp, Mus musculus
aagttcaagtgcgatgatgtcgtca

SEQ ID NO: 509908 - DNA, 25 bp, Mus musculus
aagttcaagttcaccatcctgaatg

SEQ ID NO: 509909 - DNA, 25 bp, Mus musculus
aagttcaagttctccatcctgaatg

SEQ ID NO: 509910 - DNA, 25 bp, Mus musculus
aagttcacaactagttacagttggg

SEQ ID NO: 509911 - DNA, 25 bp, Mus musculus
aagttcacaacttgttacagttggg

SEQ ID NO: 509912 - DNA, 25 bp, Mus musculus
aagttcacacagagccgatgggtgg

SEQ ID NO: 509913 - DNA, 25 bp, Mus musculus
aagttcacacagtgccgatgggtgg

SEQ ID NO: 509914 - DNA, 25 bp, Mus musculus
aagttcaccggcatatccaaggagg

SEQ ID NO: 509915 - DNA, 25 bp, Mus musculus
aagttcaccggcttatccaaggagg

SEQ ID NO: 509916 - DNA, 25 bp, Mus musculus
aagttcacctccaagtttgtccgca

SEQ ID NO: 509917 - DNA, 25 bp, Mus musculus
aagttcacctcctagtttgtccgca

SEQ ID NO: 509918 - DNA, 25 bp, Mus musculus
aagttcaggcgtcatactgctttcc

SEQ ID NO: 509919 - DNA, 25 bp, Mus musculus
aagttcaggcgtgatactgctttcc

SEQ ID NO: 509920 - DNA, 25 bp, Mus musculus
aagttcagtgggactccagatggca

SEQ ID NO: 509921 - DNA, 25 bp, Mus musculus
aagttcagtgggtctccagatggca

SEQ ID NO: 509922 - DNA, 25 bp, Mus musculus
aagttcatgcaacatgtaaataccc

SEQ ID NO: 509923 - DNA, 25 bp, Mus musculus
aagttcatgcaagatgtaaataccc

SEQ ID NO: 509924 - DNA, 25 bp, Mus musculus
aagttcattccccagggatcccaga

SEQ ID NO: 509925 - DNA, 25 bp, Mus musculus
aagttcattcccgagggatcccaga

SEQ ID NO: 509926 - DNA, 25 bp, Mus musculus
aagttccattgacagactgtagaag

SEQ ID NO: 509927 - DNA, 25 bp, Mus musculus
aagttccattgagagactgtagaag

SEQ ID NO: 509928 - DNA, 25 bp, Mus musculus
aagttcccacaaagtcagtgtccag

SEQ ID NO: 509929 - DNA, 25 bp, Mus musculus
aagttcccacaatgtcagtgtccag

SEQ ID NO: 509930 - DNA, 25 bp, Mus musculus
aagttccgtcgtcgcagtggctcag

SEQ ID NO: 509931 - DNA, 25 bp, Mus musculus
aagttccgtcgtggcagtggctcag

SEQ ID NO: 509932 - DNA, 25 bp, Mus musculus
aagttcctatccctgggtcttcaga

SEQ ID NO: 509933 - DNA, 25 bp, Mus musculus
aagttcctatccgtgggtcttcaga

SEQ ID NO: 509934 - DNA, 25 bp, Mus musculus
aagttcctcattctacgaacgaggg

SEQ ID NO: 509935 - DNA, 25 bp, Mus musculus
aagttcctcattgtacgaacgaggg

SEQ ID NO: 509936 - DNA, 25 bp, Mus musculus
aagttcctctttaaaagctggcagt

SEQ ID NO: 509937 - DNA, 25 bp, Mus musculus
aagttcctcttttaaagctggcagt

SEQ ID NO: 509938 - DNA, 25 bp, Mus musculus
aagttcctgctgatattagattgac

SEQ ID NO: 509939 - DNA, 25 bp, Mus musculus
aagttcctgctgttattagattgac

SEQ ID NO: 509940 - DNA, 25 bp, Mus musculus
aagttccttgctacgctgggcagcc

SEQ ID NO: 509941 - DNA, 25 bp, Mus musculus
aagttccttgcttcgctgggcagcc

SEQ ID NO: 509942 - DNA, 25 bp, Mus musculus
aagttcgacagcaggaagaacagtt

SEQ ID NO: 509943 - DNA, 25 bp, Mus musculus
aagttcgacagctggaagaacagtt

SEQ ID NO: 509944 - DNA, 25 bp, Mus musculus
aagttcgactttactcattttgcaa

SEQ ID NO: 509945 - DNA, 25 bp, Mus musculus
aagttcgacttttctcattttgcaa

SEQ ID NO: 509946 - DNA, 25 bp, Mus musculus
aagttcgcccgcctctctcagatgg

SEQ ID NO: 509947 - DNA, 25 bp, Mus musculus
aagttcgcccgcgtctctcagatgg

SEQ ID NO: 509948 - DNA, 25 bp, Mus musculus
aagttcgtgcggctgcgcaacaagt

SEQ ID NO: 509949 - DNA, 25 bp, Mus musculus
aagttcgtgcgggtgcgcaacaagt

SEQ ID NO: 509950 - DNA, 25 bp, Mus musculus
aagttctaaaatacctgcgcagcaa

SEQ ID NO: 509951 - DNA, 25 bp, Mus musculus
aagttctaaaattcctgcgcagcaa

SEQ ID NO: 509952 - DNA, 25 bp, Mus musculus
aagttctagcaaagtcaggctggag

SEQ ID NO: 509953 - DNA, 25 bp, Mus musculus
aagttctagcaatgtcaggctggag

SEQ ID NO: 509954 - DNA, 25 bp, Mus musculus
aagttctaggcactttcccaaagag

SEQ ID NO: 509955 - DNA, 25 bp, Mus musculus
aagttctaggcagtttcccaaagag

SEQ ID NO: 509956 - DNA, 25 bp, Mus musculus
aagttctcaaacaatagatctggcg

SEQ ID NO: 509957 - DNA, 25 bp, Mus musculus
aagttctcaaactatagatctggcg

SEQ ID NO: 509958 - DNA, 25 bp, Mus musculus
aagttctcagaaacacacgccgacc

SEQ ID NO: 509959 - DNA, 25 bp, Mus musculus
aagttctcagaatcacacgccgacc

SEQ ID NO: 509960 - DNA, 25 bp, Mus musculus
aagttctcagatcctatcagggatc

SEQ ID NO: 509961 - DNA, 25 bp, Mus musculus
aagttctcagatgctatcagggatc

SEQ ID NO: 509962 - DNA, 25 bp, Mus musculus
aagttctcaggcctcccacaagatg

SEQ ID NO: 509963 - DNA, 25 bp, Mus musculus
aagttctcaggcgtcccacaagatg

SEQ ID NO: 509964 - DNA, 25 bp, Mus musculus
aagttctccaccaggaccaagtcag

SEQ ID NO: 509965 - DNA, 25 bp, Mus musculus
aagttctccacctggaccaagtcag

SEQ ID NO: 509966 - DNA, 25 bp, Mus musculus
aagttctccgagcacttcagcatcc

SEQ ID NO: 509967 - DNA, 25 bp, Mus musculus
aagttctccgaggacttcagcatcc

SEQ ID NO: 509968 - DNA, 25 bp, Mus musculus
aagttctgccatctgggattggtca

SEQ ID NO: 509969 - DNA, 25 bp, Mus musculus
aagttctgccatgtgggattggtca

SEQ ID NO: 509970 - DNA, 25 bp, Mus musculus
aagttctgccttacttcccatctgg

SEQ ID NO: 509971 - DNA, 25 bp, Mus musculus
aagttctgcctttcttcccatctgg

SEQ ID NO: 509972 - DNA, 25 bp, Mus musculus
aagttctggatcaccaatggccctg

SEQ ID NO: 509973 - DNA, 25 bp, Mus musculus
aagttctggatcagtcagcccgggc

SEQ ID NO: 509974 - DNA, 25 bp, Mus musculus
aagttctggatctccaatggccctg

SEQ ID NO: 509975 - DNA, 25 bp, Mus musculus
aagttctggatctgtcagcccgggc

SEQ ID NO: 509976 - DNA, 25 bp, Mus musculus
aagttctgggatagaatgacgagac

SEQ ID NO: 509977 - DNA, 25 bp, Mus musculus
aagttctgggattgaatgacgagac

SEQ ID NO: 509978 - DNA, 25 bp, Mus musculus
aagttctgggttaaggagctgcgca

SEQ ID NO: 509979 - DNA, 25 bp, Mus musculus
aagttctgggtttaggagctgcgca

SEQ ID NO: 509980 - DNA, 25 bp, Mus musculus
aagttctgtgtgctgtctgcgcctg

SEQ ID NO: 509981 - DNA, 25 bp, Mus musculus
aagttctgtgtggtgtctgcgcctg

SEQ ID NO: 509982 - DNA, 25 bp, Mus musculus
aagttcttcatactacagcatgagt

SEQ ID NO: 509983 - DNA, 25 bp, Mus musculus
aagttcttcatagtacagcatgagt

SEQ ID NO: 509984 - DNA, 25 bp, Mus musculus
aagttcttcctcctctgaatttgat

SEQ ID NO: 509985 - DNA, 25 bp, Mus musculus
aagttcttcctcgtctgaatttgat

SEQ ID NO: 509986 - DNA, 25 bp, Mus musculus
aagttgaaagctctcagcaggacgt

SEQ ID NO: 509987 - DNA, 25 bp, Mus musculus
aagttgaaagctgtcagcaggacgt

SEQ ID NO: 509988 - DNA, 25 bp, Mus musculus
aagttgaacagaaggcttttgaccc

SEQ ID NO: 509989 - DNA, 25 bp, Mus musculus
aagttgaacagatggcttttgaccc

SEQ ID NO: 509990 - DNA, 25 bp, Mus musculus
aagttgaaccacacttacctagtca

SEQ ID NO: 509991 - DNA, 25 bp, Mus musculus
aagttgaaccactcttacctagtca

SEQ ID NO: 509992 - DNA, 25 bp, Mus musculus
aagttgaatatcatgctggtggctc

SEQ ID NO: 509993 - DNA, 25 bp, Mus musculus
aagttgaatatcttgctggtggctc

SEQ ID NO: 509994 - DNA, 25 bp, Mus musculus
aagttgacagagaaaggcaaggata

SEQ ID NO: 509995 - DNA, 25 bp, Mus musculus
aagttgacagagtaaggcaaggata

SEQ ID NO: 509996 - DNA, 25 bp, Mus musculus
aagttgacatggatccgctcagagc

SEQ ID NO: 509997 - DNA, 25 bp, Mus musculus
aagttgacatggttccgctcagagc

SEQ ID NO: 509998 - DNA, 25 bp, Mus musculus
aagttgagagcacctcgtggcccca

SEQ ID NO: 509999 - DNA, 25 bp, Mus musculus
aagttgagagcagctcgtggcccca

SEQ ID NO: 510000 - DNA, 25 bp, Mus musculus
aagttgagcgatattctgacaagga

SEQ ID NO: 510001 - DNA, 25 bp, Mus musculus
aagttgagcgattttctgacaagga

SEQ ID NO: 510002 - DNA, 25 bp, Mus musculus
aagttgaggatcaaagccgccagcc

SEQ ID NO: 510003 - DNA, 25 bp, Mus musculus
aagttgaggatctaagccgccagcc

SEQ ID NO: 510004 - DNA, 25 bp, Mus musculus
aagttgaggttaacaatgcccgtga

SEQ ID NO: 510005 - DNA, 25 bp, Mus musculus
aagttgaggttatcaatgcccgtga

SEQ ID NO: 510006 - DNA, 25 bp, Mus musculus
aagttgataaagacactgccacctt

SEQ ID NO: 510007 - DNA, 25 bp, Mus musculus
aagttgataaagtcactgccacctt

SEQ ID NO: 510008 - DNA, 25 bp, Mus musculus
aagttgataagcagacggcattact

SEQ ID NO: 510009 - DNA, 25 bp, Mus musculus
aagttgataagctgacggcattact

SEQ ID NO: 510010 - DNA, 25 bp, Mus musculus
aagttgatcaaactcttccaccggg

SEQ ID NO: 510011 - DNA, 25 bp, Mus musculus
aagttgatcaaagtcttccaccggg

SEQ ID NO: 510012 - DNA, 25 bp, Mus musculus
aagttgatctttcaccggcatccgg

SEQ ID NO: 510013 - DNA, 25 bp, Mus musculus
aagttgatctttgaccggcatccgg

SEQ ID NO: 510014 - DNA, 25 bp, Mus musculus
aagttgatgcacaagagccctggcc

SEQ ID NO: 510015 - DNA, 25 bp, Mus musculus
aagttgatgcactagagccctggcc

SEQ ID NO: 510016 - DNA, 25 bp, Mus musculus
aagttgcacatgctctctagtgtgg

SEQ ID NO: 510017 - DNA, 25 bp, Mus musculus
aagttgcacatggtctctagtgtgg

SEQ ID NO: 510018 - DNA, 25 bp, Mus musculus
aagttgcagatgaacctcccacact

SEQ ID NO: 510019 - DNA, 25 bp, Mus musculus
aagttgcagatgtacctcccacact

SEQ ID NO: 510020 - DNA, 25 bp, Mus musculus
aagttgcagtcaagtgcatcaagaa

SEQ ID NO: 510021 - DNA, 25 bp, Mus musculus
aagttgcagtcatgtgcatcaagaa

SEQ ID NO: 510022 - DNA, 25 bp, Mus musculus
aagttgcatccgcagaaaataaaca

SEQ ID NO: 510023 - DNA, 25 bp, Mus musculus
aagttgcatccggagaaaataaaca

SEQ ID NO: 510024 - DNA, 25 bp, Mus musculus
aagttgcgccaacctgaggtgatca

SEQ ID NO: 510025 - DNA, 25 bp, Mus musculus
aagttgcgccaagctgaggtgatca

SEQ ID NO: 510026 - DNA, 25 bp, Mus musculus
aagttgctgagcagttagagctgga

SEQ ID NO: 510027 - DNA, 25 bp, Mus musculus
aagttgctgagctgttagagctgga

SEQ ID NO: 510028 - DNA, 25 bp, Mus musculus
aagttgctgtggagtacttccgaga

SEQ ID NO: 510029 - DNA, 25 bp, Mus musculus
aagttgctgtggtgtacttccgaga

SEQ ID NO: 510030 - DNA, 25 bp, Mus musculus
aagttggaacgtcggactttgacat

SEQ ID NO: 510031 - DNA, 25 bp, Mus musculus
aagttggaacgtgggactttgacat

SEQ ID NO: 510032 - DNA, 25 bp, Mus musculus
aagttggagaagctaccgagactgc

SEQ ID NO: 510033 - DNA, 25 bp, Mus musculus
aagttggagaaggtaccgagactgc

SEQ ID NO: 510034 - DNA, 25 bp, Mus musculus
aagttggattcacaaggcaaatata

SEQ ID NO: 510035 - DNA, 25 bp, Mus musculus
aagttggattcagaaggcaaatata

SEQ ID NO: 510036 - DNA, 25 bp, Mus musculus
aagttggcaactatcgtgactcaag

SEQ ID NO: 510037 - DNA, 25 bp, Mus musculus
aagttggcaactttcgtgactcaag

SEQ ID NO: 510038 - DNA, 25 bp, Mus musculus
aagttggcattccagtgcccaagta

SEQ ID NO: 510039 - DNA, 25 bp, Mus musculus
aagttggcattcgagtgcccaagta

SEQ ID NO: 510040 - DNA, 25 bp, Mus musculus
aagttggccaggcattctgaaagga

SEQ ID NO: 510041 - DNA, 25 bp, Mus musculus
aagttggccagggattctgaaagga

SEQ ID NO: 510042 - DNA, 25 bp, Mus musculus
aagttggcgctcatgtttttgacat

SEQ ID NO: 510043 - DNA, 25 bp, Mus musculus
aagttggcgctcttgtttttgacat

SEQ ID NO: 510044 - DNA, 25 bp, Mus musculus
aagttggctgatcatgacgattaca

SEQ ID NO: 510045 - DNA, 25 bp, Mus musculus
aagttggctgatgatgacgattaca

SEQ ID NO: 510046 - DNA, 25 bp, Mus musculus
aagttgggaattctcctccagaagc

SEQ ID NO: 510047 - DNA, 25 bp, Mus musculus
aagttgggaattgtcctccagaagc

SEQ ID NO: 510048 - DNA, 25 bp, Mus musculus
aagttgtgaccccttgagccaccac

SEQ ID NO: 510049 - DNA, 25 bp, Mus musculus
aagttgtgacccgttgagccaccac

SEQ ID NO: 510050 - DNA, 25 bp, Mus musculus
aagttgtgattcatccctggcctcg

SEQ ID NO: 510051 - DNA, 25 bp, Mus musculus
aagttgtgattcttccctggcctcg

SEQ ID NO: 510052 - DNA, 25 bp, Mus musculus
aagttgtgcctacctcctccgcttg

SEQ ID NO: 510053 - DNA, 25 bp, Mus musculus
aagttgtgcctagctcctccgcttg

SEQ ID NO: 510054 - DNA, 25 bp, Mus musculus
aagttgttgagccaagtgctgaaca

SEQ ID NO: 510055 - DNA, 25 bp, Mus musculus
aagttgttgagcgaagtgctgaaca

SEQ ID NO: 510056 - DNA, 25 bp, Mus musculus
aagttgttgcagcacagcagcctga

SEQ ID NO: 510057 - DNA, 25 bp, Mus musculus
aagttgttgcaggacagcagcctga

SEQ ID NO: 510058 - DNA, 25 bp, Mus musculus
aagttgtttgaactgatcgagactg

SEQ ID NO: 510059 - DNA, 25 bp, Mus musculus
aagttgtttgaagtgatcgagactg

SEQ ID NO: 510060 - DNA, 25 bp, Mus musculus
aagtttaccccacgctcagctggct

SEQ ID NO: 510061 - DNA, 25 bp, Mus musculus
aagtttaccccaggctcagctggct

SEQ ID NO: 510062 - DNA, 25 bp, Mus musculus
aagtttacgatgatgtggatgcctc

SEQ ID NO: 510063 - DNA, 25 bp, Mus musculus
aagtttacgatgttgtggatgcctc

SEQ ID NO: 510064 - DNA, 25 bp, Mus musculus
aagtttacttcaaaggacaatgcct

SEQ ID NO: 510065 - DNA, 25 bp, Mus musculus
aagtttacttcataggacaatgcct

SEQ ID NO: 510066 - DNA, 25 bp, Mus musculus
aagtttatgaagaccgaagaagcca

SEQ ID NO: 510067 - DNA, 25 bp, Mus musculus
aagtttatgaagtccgaagaagcca

SEQ ID NO: 510068 - DNA, 25 bp, Mus musculus
aagtttattggcatctcatcgtacc

SEQ ID NO: 510069 - DNA, 25 bp, Mus musculus
aagtttattggcttctcatcgtacc

SEQ ID NO: 510070 - DNA, 25 bp, Mus musculus
aagtttattgtaatgtattcccagc

SEQ ID NO: 510071 - DNA, 25 bp, Mus musculus
aagtttattgtattgtattcccagc

SEQ ID NO: 510072 - DNA, 25 bp, Mus musculus
aagtttcaggaaattaaggaagctg

SEQ ID NO: 510073 - DNA, 25 bp, Mus musculus
aagtttcaggaatttaaggaagctg

SEQ ID NO: 510074 - DNA, 25 bp, Mus musculus
aagtttctggaccagttcctgctca

SEQ ID NO: 510075 - DNA, 25 bp, Mus musculus
aagtttctggacgagttcctgctca

SEQ ID NO: 510076 - DNA, 25 bp, Mus musculus
aagtttcttcagcatatcctctggg

SEQ ID NO: 510077 - DNA, 25 bp, Mus musculus
aagtttcttcaggatatcctctggg

SEQ ID NO: 510078 - DNA, 25 bp, Mus musculus
aagtttgaactgcaaatcagtcctc

SEQ ID NO: 510079 - DNA, 25 bp, Mus musculus
aagtttgaactggaaatcagtcctc

SEQ ID NO: 510080 - DNA, 25 bp, Mus musculus
aagtttgacccgcagctgctgttcc

SEQ ID NO: 510081 - DNA, 25 bp, Mus musculus
aagtttgacccggagctgctgttcc

SEQ ID NO: 510082 - DNA, 25 bp, Mus musculus
aagtttgacctgcaccagttgataa

SEQ ID NO: 510083 - DNA, 25 bp, Mus musculus
aagtttgacctggaccagttgataa

SEQ ID NO: 510084 - DNA, 25 bp, Mus musculus
aagtttgactacctttttgatagag

SEQ ID NO: 510085 - DNA, 25 bp, Mus musculus
aagtttgactacgtttttgatagag

SEQ ID NO: 510086 - DNA, 25 bp, Mus musculus
aagtttgactctcgtgagtacctcg

SEQ ID NO: 510087 - DNA, 25 bp, Mus musculus
aagtttgactctggtgagtacctcg

SEQ ID NO: 510088 - DNA, 25 bp, Mus musculus
aagtttgagcaacgcttcatcacag

SEQ ID NO: 510089 - DNA, 25 bp, Mus musculus
aagtttgagcaaggcttcatcacag

SEQ ID NO: 510090 - DNA, 25 bp, Mus musculus
aagtttgcagccaatcccaaccaga

SEQ ID NO: 510091 - DNA, 25 bp, Mus musculus
aagtttgcagcctatcccaaccaga

SEQ ID NO: 510092 - DNA, 25 bp, Mus musculus
aagtttgcccagaaggtggtcccag

SEQ ID NO: 510093 - DNA, 25 bp, Mus musculus
aagtttgcccagtaggtggtcccag

SEQ ID NO: 510094 - DNA, 25 bp, Mus musculus
aagtttgcctccaacctgaccttca

SEQ ID NO: 510095 - DNA, 25 bp, Mus musculus
aagtttgcctcctacctgaccttca

SEQ ID NO: 510096 - DNA, 25 bp, Mus musculus
aagtttgctgaaccgtttgaagcga

SEQ ID NO: 510097 - DNA, 25 bp, Mus musculus
aagtttgctgaagcgtttgaagcga

SEQ ID NO: 510098 - DNA, 25 bp, Mus musculus
aagtttggcaagaactctagtggct

SEQ ID NO: 510099 - DNA, 25 bp, Mus musculus
aagtttggcaagtactctagtggct

SEQ ID NO: 510100 - DNA, 25 bp, Mus musculus
aagtttggccaaagggctgatagcc

SEQ ID NO: 510101 - DNA, 25 bp, Mus musculus
aagtttggccaatgggctgatagcc

SEQ ID NO: 510102 - DNA, 25 bp, Mus musculus
aagtttgggcctcactgacacccga

SEQ ID NO: 510103 - DNA, 25 bp, Mus musculus
aagtttgggcctgactgacacccga

SEQ ID NO: 510104 - DNA, 25 bp, Mus musculus
aagtttgtcacacagtgctgtcagg

SEQ ID NO: 510105 - DNA, 25 bp, Mus musculus
aagtttgtcacagagtgctgtcagg

SEQ ID NO: 510106 - DNA, 25 bp, Mus musculus
aagtttgtggatcgtctgatgattc

SEQ ID NO: 510107 - DNA, 25 bp, Mus musculus
aagtttgtggatggtctgatgattc

SEQ ID NO: 510108 - DNA, 25 bp, Mus musculus
aagttttcagcgctggtcaaataca

SEQ ID NO: 510109 - DNA, 25 bp, Mus musculus
aagttttcagcggtggtcaaataca

SEQ ID NO: 510110 - DNA, 25 bp, Mus musculus
aagttttcatcacccgcaagtcact

SEQ ID NO: 510111 - DNA, 25 bp, Mus musculus
aagttttcatcagccgcaagtcact

SEQ ID NO: 510112 - DNA, 25 bp, Mus musculus
aagttttgggaaacagatgaatcca

SEQ ID NO: 510113 - DNA, 25 bp, Mus musculus
aagttttgggaatcagatgaatcca

SEQ ID NO: 510114 - DNA, 25 bp, Mus musculus
aagttttgggagagtgtatcgagcc

SEQ ID NO: 510115 - DNA, 25 bp, Mus musculus
aagttttgggagtgtgtatcgagcc

SEQ ID NO: 510116 - DNA, 25 bp, Mus musculus
aagttttggtagcaaccaatgtggc

SEQ ID NO: 510117 - DNA, 25 bp, Mus musculus
aagttttggtaggaaccaatgtggc

SEQ ID NO: 510118 - DNA, 25 bp, Mus musculus
aagtttttcattcatacctccatca

SEQ ID NO: 510119 - DNA, 25 bp, Mus musculus
aagtttttcattgatacctccatca

SEQ ID NO: 510120 - DNA, 25 bp, Mus musculus
aataaaaaggtcacttcagctcttc

SEQ ID NO: 510121 - DNA, 25 bp, Mus musculus
aataaaaaggtctcttcagctcttc

SEQ ID NO: 510122 - DNA, 25 bp, Mus musculus
aataaaagaccgcatacagagaagg

SEQ ID NO: 510123 - DNA, 25 bp, Mus musculus
aataaaagaccggatacagagaagg

SEQ ID NO: 510124 - DNA, 25 bp, Mus musculus
aataaaagagcactgaccgccgcac

SEQ ID NO: 510125 - DNA, 25 bp, Mus musculus
aataaaagagcagtgaccgccgcac

SEQ ID NO: 510126 - DNA, 25 bp, Mus musculus
aataaaagctgtagtctctgtcaga

SEQ ID NO: 510127 - DNA, 25 bp, Mus musculus
aataaaagctgttgtctctgtcaga

SEQ ID NO: 510128 - DNA, 25 bp, Mus musculus
aataaaagtgcccacacgagctttc

SEQ ID NO: 510129 - DNA, 25 bp, Mus musculus
aataaaagtgccgacacgagctttc

SEQ ID NO: 510130 - DNA, 25 bp, Mus musculus
aataaaattgccacacccgcctggt

SEQ ID NO: 510131 - DNA, 25 bp, Mus musculus
aataaaattgcctcacccgcctggt

SEQ ID NO: 510132 - DNA, 25 bp, Mus musculus
aataaacaaactatcagaccaggca

SEQ ID NO: 510133 - DNA, 25 bp, Mus musculus
aataaacaaactttcagaccaggca

SEQ ID NO: 510134 - DNA, 25 bp, Mus musculus
aataaacaagatatcgggagccacc

SEQ ID NO: 510135 - DNA, 25 bp, Mus musculus
aataaacaagatttcgggagccacc

SEQ ID NO: 510136 - DNA, 25 bp, Mus musculus
aataaacactggagccactctgtgc

SEQ ID NO: 510137 - DNA, 25 bp, Mus musculus
aataaacactggtgccactctgtgc

SEQ ID NO: 510138 - DNA, 25 bp, Mus musculus
aataaacacttcaatgggccgccgc

SEQ ID NO: 510139 - DNA, 25 bp, Mus musculus
aataaacacttctatgggccgccgc

SEQ ID NO: 510140 - DNA, 25 bp, Mus musculus
aataaagaaatcagttaacaggcca

SEQ ID NO: 510141 - DNA, 25 bp, Mus musculus
aataaagaaatctgttaacaggcca

SEQ ID NO: 510142 - DNA, 25 bp, Mus musculus
aataaagacactaatttctctggag

SEQ ID NO: 510143 - DNA, 25 bp, Mus musculus
aataaagacacttatttctctggag

SEQ ID NO: 510144 - DNA, 25 bp, Mus musculus
aataaagcgcacagtgggcgaatcc

SEQ ID NO: 510145 - DNA, 25 bp, Mus musculus
aataaagcgcactgtgggcgaatcc

SEQ ID NO: 510146 - DNA, 25 bp, Mus musculus
aataaaggatctcccctgtcacgcg

SEQ ID NO: 510147 - DNA, 25 bp, Mus musculus
aataaaggatctgccctgtcacgcg

SEQ ID NO: 510148 - DNA, 25 bp, Mus musculus
aataaagtgaaacacagtggcctcc

SEQ ID NO: 510149 - DNA, 25 bp, Mus musculus
aataaagtgaaagacagtggcctcc

SEQ ID NO: 510150 - DNA, 25 bp, Mus musculus
aataaatattggcttgtcaagaaca

SEQ ID NO: 510151 - DNA, 25 bp, Mus musculus
aataaatattgggttgtcaagaaca

SEQ ID NO: 510152 - DNA, 25 bp, Mus musculus
aataaatcatctatggagagtgaag

SEQ ID NO: 510153 - DNA, 25 bp, Mus musculus
aataaatcatctttggagagtgaag

SEQ ID NO: 510154 - DNA, 25 bp, Mus musculus
aataaatgaaaacgtgccgcagcgg

SEQ ID NO: 510155 - DNA, 25 bp, Mus musculus
aataaatgaaaaggtgccgcagcgg

SEQ ID NO: 510156 - DNA, 25 bp, Mus musculus
aataaattgaaacagttggctcgac

SEQ ID NO: 510157 - DNA, 25 bp, Mus musculus
aataaattgaaagagttggctcgac

SEQ ID NO: 510158 - DNA, 25 bp, Mus musculus
aataacaacaggatgtgcaaccaca

SEQ ID NO: 510159 - DNA, 25 bp, Mus musculus
aataacaacaggttgtgcaaccaca

SEQ ID NO: 510160 - DNA, 25 bp, Mus musculus
aataacacttggcttgtcacagaag

SEQ ID NO: 510161 - DNA, 25 bp, Mus musculus
aataacacttgggttgtcacagaag

SEQ ID NO: 510162 - DNA, 25 bp, Mus musculus
aataacattaacaccttcctcacag

SEQ ID NO: 510163 - DNA, 25 bp, Mus musculus
aataacattaactccttcctcacag

SEQ ID NO: 510164 - DNA, 25 bp, Mus musculus
aataaccaagataatgagcacccct

SEQ ID NO: 510165 - DNA, 25 bp, Mus musculus
aataaccaagattatgagcacccct

SEQ ID NO: 510166 - DNA, 25 bp, Mus musculus
aataaccaatggatctcgaattgaa

SEQ ID NO: 510167 - DNA, 25 bp, Mus musculus
aataaccaatggttctcgaattgaa

SEQ ID NO: 510168 - DNA, 25 bp, Mus musculus
aataaccacacaccaaacgcctagg

SEQ ID NO: 510169 - DNA, 25 bp, Mus musculus
aataaccacacagcaaacgcctagg

SEQ ID NO: 510170 - DNA, 25 bp, Mus musculus
aataaccagcatacacagactctgc

SEQ ID NO: 510171 - DNA, 25 bp, Mus musculus
aataaccagcattcacagactctgc

SEQ ID NO: 510172 - DNA, 25 bp, Mus musculus
aataaccagcctccaagaactggca

SEQ ID NO: 510173 - DNA, 25 bp, Mus musculus
aataaccagcctgcaagaactggca

SEQ ID NO: 510174 - DNA, 25 bp, Mus musculus
aataacccggagaggatagctggcc

SEQ ID NO: 510175 - DNA, 25 bp, Mus musculus
aataacccggagtggatagctggcc

SEQ ID NO: 510176 - DNA, 25 bp, Mus musculus
aataaccgtgagattatcacaatgg

SEQ ID NO: 510177 - DNA, 25 bp, Mus musculus
aataaccgtgagtttatcacaatgg

SEQ ID NO: 510178 - DNA, 25 bp, Mus musculus
aataacgctgctcccactccaagga

SEQ ID NO: 510179 - DNA, 25 bp, Mus musculus
aataacgctgctgccactccaagga

SEQ ID NO: 510180 - DNA, 25 bp, Mus musculus
aataacgtcctccaggccgagcgcg

SEQ ID NO: 510181 - DNA, 25 bp, Mus musculus
aataacgtcctcgaggccgagcgcg

SEQ ID NO: 510182 - DNA, 25 bp, Mus musculus
aataactatggcagccggcctgtgg

SEQ ID NO: 510183 - DNA, 25 bp, Mus musculus
aataactatggctgccggcctgtgg

SEQ ID NO: 510184 - DNA, 25 bp, Mus musculus
aataactccgtaccatcagccactg

SEQ ID NO: 510185 - DNA, 25 bp, Mus musculus
aataactccgtagcatcagccactg

SEQ ID NO: 510186 - DNA, 25 bp, Mus musculus
aataacttcctccagtggttgtgac

SEQ ID NO: 510187 - DNA, 25 bp, Mus musculus
aataacttcctcgagtggttgtgac

SEQ ID NO: 510188 - DNA, 25 bp, Mus musculus
aataagaaattgctgactcggcctc

SEQ ID NO: 510189 - DNA, 25 bp, Mus musculus
aataagaaattggtgactcggcctc

SEQ ID NO: 510190 - DNA, 25 bp, Mus musculus
aataagaagattcccagcgccaccc

SEQ ID NO: 510191 - DNA, 25 bp, Mus musculus
aataagaagattgccagcgccaccc

SEQ ID NO: 510192 - DNA, 25 bp, Mus musculus
aataagaatttccatgaggtcatgc

SEQ ID NO: 510193 - DNA, 25 bp, Mus musculus
aataagaatttcgatgaggtcatgc

SEQ ID NO: 510194 - DNA, 25 bp, Mus musculus
aataagaccgtgagatgaggccagc

SEQ ID NO: 510195 - DNA, 25 bp, Mus musculus
aataagaccgtgtgatgaggccagc

SEQ ID NO: 510196 - DNA, 25 bp, Mus musculus
aataagacgtggatccaggctgaca

SEQ ID NO: 510197 - DNA, 25 bp, Mus musculus
aataagacgtggttccaggctgaca

SEQ ID NO: 510198 - DNA, 25 bp, Mus musculus
aataagactaggcagatcgcccagg

SEQ ID NO: 510199 - DNA, 25 bp, Mus musculus
aataagactagggagatcgcccagg

SEQ ID NO: 510200 - DNA, 25 bp, Mus musculus
aataagagagccacggacaactgcg

SEQ ID NO: 510201 - DNA, 25 bp, Mus musculus
aataagagagcctcggacaactgcg

SEQ ID NO: 510202 - DNA, 25 bp, Mus musculus
aataagcacaccagctacatctcag

SEQ ID NO: 510203 - DNA, 25 bp, Mus musculus
aataagcacacctgctacatctcag

SEQ ID NO: 510204 - DNA, 25 bp, Mus musculus
aataagcagccaaacccaagaaaga

SEQ ID NO: 510205 - DNA, 25 bp, Mus musculus
aataagcagccatacccaagaaaga

SEQ ID NO: 510206 - DNA, 25 bp, Mus musculus
aataagctctggctgcggatgcagc

SEQ ID NO: 510207 - DNA, 25 bp, Mus musculus
aataagctctgggtgcggatgcagc

SEQ ID NO: 510208 - DNA, 25 bp, Mus musculus
aataagctggaaaccatgctgggct

SEQ ID NO: 510209 - DNA, 25 bp, Mus musculus
aataagctggaatccatgctgggct

SEQ ID NO: 510210 - DNA, 25 bp, Mus musculus
aataaggaccagagcaaagaagagg

SEQ ID NO: 510211 - DNA, 25 bp, Mus musculus
aataaggaccagtgcaaagaagagg

SEQ ID NO: 510212 - DNA, 25 bp, Mus musculus
aataaggagtcactcccagcaagaa

SEQ ID NO: 510213 - DNA, 25 bp, Mus musculus
aataaggagtcagtcccagcaagaa

SEQ ID NO: 510214 - DNA, 25 bp, Mus musculus
aataaggatgttcgagacctcaccc

SEQ ID NO: 510215 - DNA, 25 bp, Mus musculus
aataaggatgttggagacctcaccc

SEQ ID NO: 510216 - DNA, 25 bp, Mus musculus
aataaggctcgacaggaaatggcaa

SEQ ID NO: 510217 - DNA, 25 bp, Mus musculus
aataaggctcgagaggaaatggcaa

SEQ ID NO: 510218 - DNA, 25 bp, Mus musculus
aataaggtagtgaacagactccggc

SEQ ID NO: 510219 - DNA, 25 bp, Mus musculus
aataaggtagtgtacagactccggc

SEQ ID NO: 510220 - DNA, 25 bp, Mus musculus
aataaggtggacatggagcactaca

SEQ ID NO: 510221 - DNA, 25 bp, Mus musculus
aataaggtggacttggagcactaca

SEQ ID NO: 510222 - DNA, 25 bp, Mus musculus
aataaggtggccctggtcacagcct

SEQ ID NO: 510223 - DNA, 25 bp, Mus musculus
aataaggtggccgtggtcacagcct

SEQ ID NO: 510224 - DNA, 25 bp, Mus musculus
aataagtcatctcagttcctggccc

SEQ ID NO: 510225 - DNA, 25 bp, Mus musculus
aataagtcatctgagttcctggccc

SEQ ID NO: 510226 - DNA, 25 bp, Mus musculus
aataagtccgagaacttcttaggct

SEQ ID NO: 510227 - DNA, 25 bp, Mus musculus
aataagtccgagtacttcttaggct

SEQ ID NO: 510228 - DNA, 25 bp, Mus musculus
aataagtcctccagaaatgtaacgc

SEQ ID NO: 510229 - DNA, 25 bp, Mus musculus
aataagtcctcctgaaatgtaacgc

SEQ ID NO: 510230 - DNA, 25 bp, Mus musculus
aataagtcgggcaatctgagataca

SEQ ID NO: 510231 - DNA, 25 bp, Mus musculus
aataagtcgggctatctgagataca

SEQ ID NO: 510232 - DNA, 25 bp, Mus musculus
aataagtgggcgctaagtcgtggga

SEQ ID NO: 510233 - DNA, 25 bp, Mus musculus
aataagtgggcggtaagtcgtggga

SEQ ID NO: 510234 - DNA, 25 bp, Mus musculus
aataagtgttgcactggttcaaggc

SEQ ID NO: 510235 - DNA, 25 bp, Mus musculus
aataagtgttgctctggttcaaggc

SEQ ID NO: 510236 - DNA, 25 bp, Mus musculus
aataatagacctaaagcagaaagtc

SEQ ID NO: 510237 - DNA, 25 bp, Mus musculus
aataatagaccttaagcagaaagtc

SEQ ID NO: 510238 - DNA, 25 bp, Mus musculus
aataatctgcatctgggctcccagc

SEQ ID NO: 510239 - DNA, 25 bp, Mus musculus
aataatctgcatgtgggctcccagc

SEQ ID NO: 510240 - DNA, 25 bp, Mus musculus
aataatgacacccacacgcaagagc

SEQ ID NO: 510241 - DNA, 25 bp, Mus musculus
aataatgacaccgacacgcaagagc

SEQ ID NO: 510242 - DNA, 25 bp, Mus musculus
aataatggaaatacgagtcttccca

SEQ ID NO: 510243 - DNA, 25 bp, Mus musculus
aataatggaaattcgagtcttccca

SEQ ID NO: 510244 - DNA, 25 bp, Mus musculus
aataattaaattagccaccctcctg

SEQ ID NO: 510245 - DNA, 25 bp, Mus musculus
aataattaaatttgccaccctcctg

SEQ ID NO: 510246 - DNA, 25 bp, Mus musculus
aataattactggcaggtgatttaca

SEQ ID NO: 510247 - DNA, 25 bp, Mus musculus
aataattactgggaggtgatttaca

SEQ ID NO: 510248 - DNA, 25 bp, Mus musculus
aataattacttgcaatgccaacggg

SEQ ID NO: 510249 - DNA, 25 bp, Mus musculus
aataattacttggaatgccaacggg

SEQ ID NO: 510250 - DNA, 25 bp, Mus musculus
aataattaggaaaggctgtggagga

SEQ ID NO: 510251 - DNA, 25 bp, Mus musculus
aataattaggaatggctgtggagga

SEQ ID NO: 510252 - DNA, 25 bp, Mus musculus
aataattggaaacaagctgacactg

SEQ ID NO: 510253 - DNA, 25 bp, Mus musculus
aataattggaaagaagctgacactg

SEQ ID NO: 510254 - DNA, 25 bp, Mus musculus
aataattgtgttacctgcccgggca

SEQ ID NO: 510255 - DNA, 25 bp, Mus musculus
aataattgtgtttcctgcccgggca

SEQ ID NO: 510256 - DNA, 25 bp, Mus musculus
aataatttagtaatccactctatgg

SEQ ID NO: 510257 - DNA, 25 bp, Mus musculus
aataatttagtattccactctatgg

SEQ ID NO: 510258 - DNA, 25 bp, Mus musculus
aatacaaagtgcatcttcagctgcg

SEQ ID NO: 510259 - DNA, 25 bp, Mus musculus
aatacaaagtgcttcttcagctgcg

SEQ ID NO: 510260 - DNA, 25 bp, Mus musculus
aatacaaatttgcaactggccagtg

SEQ ID NO: 510261 - DNA, 25 bp, Mus musculus
aatacaaatttggaactggccagtg

SEQ ID NO: 510262 - DNA, 25 bp, Mus musculus
aatacaacaacacagagcagcacaa

SEQ ID NO: 510263 - DNA, 25 bp, Mus musculus
aatacaacaacagagagcagcacaa

SEQ ID NO: 510264 - DNA, 25 bp, Mus musculus
aatacaacacgtacatgcgcaacac

SEQ ID NO: 510265 - DNA, 25 bp, Mus musculus
aatacaacacgttcatgcgcaacac

SEQ ID NO: 510266 - DNA, 25 bp, Mus musculus
aatacaaccatcctggtgcccaagc

SEQ ID NO: 510267 - DNA, 25 bp, Mus musculus
aatacaaccatcgtggtgcccaagc

SEQ ID NO: 510268 - DNA, 25 bp, Mus musculus
aatacaagacctatcaagagaggct

SEQ ID NO: 510269 - DNA, 25 bp, Mus musculus
aatacaagacctttcaagagaggct

SEQ ID NO: 510270 - DNA, 25 bp, Mus musculus
aatacaaggcgacctttgcaacccg

SEQ ID NO: 510271 - DNA, 25 bp, Mus musculus
aatacaaggcgagctttgcaacccg

SEQ ID NO: 510272 - DNA, 25 bp, Mus musculus
aatacaaggtggatccacgcctggc

SEQ ID NO: 510273 - DNA, 25 bp, Mus musculus
aatacaaggtggttccacgcctggc

SEQ ID NO: 510274 - DNA, 25 bp, Mus musculus
aatacaagtaatcactcaggagtgg

SEQ ID NO: 510275 - DNA, 25 bp, Mus musculus
aatacaagtaatgactcaggagtgg

SEQ ID NO: 510276 - DNA, 25 bp, Mus musculus
aatacaatgcagacaagtttgggct

SEQ ID NO: 510277 - DNA, 25 bp, Mus musculus
aatacaatgcagtcaagtttgggct

SEQ ID NO: 510278 - DNA, 25 bp, Mus musculus
aatacacagaaacaggctatgaaga

SEQ ID NO: 510279 - DNA, 25 bp, Mus musculus
aatacacagaaagaggctatgaaga

SEQ ID NO: 510280 - DNA, 25 bp, Mus musculus
aatacacccaggagcttcggttgga

SEQ ID NO: 510281 - DNA, 25 bp, Mus musculus
aatacacccaggtgcttcggttgga

SEQ ID NO: 510282 - DNA, 25 bp, Mus musculus
aatacaccgtttctgtatgacctgg

SEQ ID NO: 510283 - DNA, 25 bp, Mus musculus
aatacaccgtttgtgtatgacctgg

SEQ ID NO: 510284 - DNA, 25 bp, Mus musculus
aatacacgccacaatgtccgactgc

SEQ ID NO: 510285 - DNA, 25 bp, Mus musculus
aatacacgccactatgtccgactgc

SEQ ID NO: 510286 - DNA, 25 bp, Mus musculus
aatacagacaggattggccagaact

SEQ ID NO: 510287 - DNA, 25 bp, Mus musculus
aatacagacaggtttggccagaact

SEQ ID NO: 510288 - DNA, 25 bp, Mus musculus
aatacagaggccctcagctgcagtc

SEQ ID NO: 510289 - DNA, 25 bp, Mus musculus
aatacagaggccgtcagctgcagtc

SEQ ID NO: 510290 - DNA, 25 bp, Mus musculus
aatacagcaatgatgaggatctgcc

SEQ ID NO: 510291 - DNA, 25 bp, Mus musculus
aatacagcaatgttgaggatctgcc

SEQ ID NO: 510292 - DNA, 25 bp, Mus musculus
aatacagcagctcaagttctctcag

SEQ ID NO: 510293 - DNA, 25 bp, Mus musculus
aatacagcagctgaagttctctcag

SEQ ID NO: 510294 - DNA, 25 bp, Mus musculus
aatacagctggacagtcttagcctg

SEQ ID NO: 510295 - DNA, 25 bp, Mus musculus
aatacagctggagagtcttagcctg

SEQ ID NO: 510296 - DNA, 25 bp, Mus musculus
aatacaggccgacggtcaccgtgtg

SEQ ID NO: 510297 - DNA, 25 bp, Mus musculus
aatacaggccgagggtcaccgtgtg

SEQ ID NO: 510298 - DNA, 25 bp, Mus musculus
aatacagggcatacctcatcttttg

SEQ ID NO: 510299 - DNA, 25 bp, Mus musculus
aatacagggcattcctcatcttttg

SEQ ID NO: 510300 - DNA, 25 bp, Mus musculus
aatacagggtgacctacagaatttc

SEQ ID NO: 510301 - DNA, 25 bp, Mus musculus
aatacagggtgagctacagaatttc

SEQ ID NO: 510302 - DNA, 25 bp, Mus musculus
aatacagtagcaagtctgatgtctg

SEQ ID NO: 510303 - DNA, 25 bp, Mus musculus
aatacagtagcatgtctgatgtctg

SEQ ID NO: 510304 - DNA, 25 bp, Mus musculus
aatacagtccctagttcaacagaga

SEQ ID NO: 510305 - DNA, 25 bp, Mus musculus
aatacagtcccttgttcaacagaga

SEQ ID NO: 510306 - DNA, 25 bp, Mus musculus
aatacatctgttactgtcttctgca

SEQ ID NO: 510307 - DNA, 25 bp, Mus musculus
aatacatctgtttctgtcttctgca

SEQ ID NO: 510308 - DNA, 25 bp, Mus musculus
aatacatgcctcagctggctggaca

SEQ ID NO: 510309 - DNA, 25 bp, Mus musculus
aatacatgcctctgctggctggaca

SEQ ID NO: 510310 - DNA, 25 bp, Mus musculus
aatacatgcttgagtaacgtgcccc

SEQ ID NO: 510311 - DNA, 25 bp, Mus musculus
aatacatgcttgtgtaacgtgcccc

SEQ ID NO: 510312 - DNA, 25 bp, Mus musculus
aatacatggcagatatggatgagct

SEQ ID NO: 510313 - DNA, 25 bp, Mus musculus
aatacatggcagttatggatgagct

SEQ ID NO: 510314 - DNA, 25 bp, Mus musculus
aatacatgggaaacccacagatccg

SEQ ID NO: 510315 - DNA, 25 bp, Mus musculus
aatacatgggaatcccacagatccg

SEQ ID NO: 510316 - DNA, 25 bp, Mus musculus
aatacatgttaactcatctgcaggg

SEQ ID NO: 510317 - DNA, 25 bp, Mus musculus
aatacatgttaagtcatctgcaggg

SEQ ID NO: 510318 - DNA, 25 bp, Mus musculus
aatacattagggaactggaacaagc

SEQ ID NO: 510319 - DNA, 25 bp, Mus musculus
aatacattagggtactggaacaagc

SEQ ID NO: 510320 - DNA, 25 bp, Mus musculus
aataccaaagcacccctcaaagctg

SEQ ID NO: 510321 - DNA, 25 bp, Mus musculus
aataccaaagcagccctcaaagctg

SEQ ID NO: 510322 - DNA, 25 bp, Mus musculus
aataccaacgcccagaatcagtggg

SEQ ID NO: 510323 - DNA, 25 bp, Mus musculus
aataccaacgccgagaatcagtggg

SEQ ID NO: 510324 - DNA, 25 bp, Mus musculus
aataccacaaggatcattaagaagg

SEQ ID NO: 510325 - DNA, 25 bp, Mus musculus
aataccacaaggttcattaagaagg

SEQ ID NO: 510326 - DNA, 25 bp, Mus musculus
aataccacttctaagccgagccatt

SEQ ID NO: 510327 - DNA, 25 bp, Mus musculus
aataccacttcttagccgagccatt

SEQ ID NO: 510328 - DNA, 25 bp, Mus musculus
aataccactttcctgctcatggctg

SEQ ID NO: 510329 - DNA, 25 bp, Mus musculus
aataccactttcgtgctcatggctg

SEQ ID NO: 510330 - DNA, 25 bp, Mus musculus
aataccagagagaagtaacttcaag

SEQ ID NO: 510331 - DNA, 25 bp, Mus musculus
aataccagagagtagtaacttcaag

SEQ ID NO: 510332 - DNA, 25 bp, Mus musculus
aataccagagtccttccgtgggtca

SEQ ID NO: 510333 - DNA, 25 bp, Mus musculus
aataccagagtcgttccgtgggtca

SEQ ID NO: 510334 - DNA, 25 bp, Mus musculus
aataccagcctgagatggcccagtg

SEQ ID NO: 510335 - DNA, 25 bp, Mus musculus
aataccagcctgtgatggcccagtg

SEQ ID NO: 510336 - DNA, 25 bp, Mus musculus
aataccaggaatccccgggacaaag

SEQ ID NO: 510337 - DNA, 25 bp, Mus musculus
aataccaggaatgcccgggacaaag

SEQ ID NO: 510338 - DNA, 25 bp, Mus musculus
aataccaggctgagagtgtctactc

SEQ ID NO: 510339 - DNA, 25 bp, Mus musculus
aataccaggctgtgagtgtctactc

SEQ ID NO: 510340 - DNA, 25 bp, Mus musculus
aataccagggccactgggcaaagcc

SEQ ID NO: 510341 - DNA, 25 bp, Mus musculus
aataccagggcctctgggcaaagcc

SEQ ID NO: 510342 - DNA, 25 bp, Mus musculus
aataccaggtgtcctggcatacgcc

SEQ ID NO: 510343 - DNA, 25 bp, Mus musculus
aataccaggtgtgctggcatacgcc

SEQ ID NO: 510344 - DNA, 25 bp, Mus musculus
aataccagttgtacttcacgcagcc

SEQ ID NO: 510345 - DNA, 25 bp, Mus musculus
aataccagttgtagatgaaggagcg

SEQ ID NO: 510346 - DNA, 25 bp, Mus musculus
aataccagttgttcttcacgcagcc

SEQ ID NO: 510347 - DNA, 25 bp, Mus musculus
aataccagttgttgatgaaggagcg

SEQ ID NO: 510348 - DNA, 25 bp, Mus musculus
aataccatggaaagcgagggcctct

SEQ ID NO: 510349 - DNA, 25 bp, Mus musculus
aataccatggaatgcgagggcctct

SEQ ID NO: 510350 - DNA, 25 bp, Mus musculus
aatacccagaggaagacacggatcg

SEQ ID NO: 510351 - DNA, 25 bp, Mus musculus
aatacccagaggtagacacggatcg

SEQ ID NO: 510352 - DNA, 25 bp, Mus musculus
aatacccctggaaaacacctgtgca

SEQ ID NO: 510353 - DNA, 25 bp, Mus musculus
aatacccctggataacacctgtgca

SEQ ID NO: 510354 - DNA, 25 bp, Mus musculus
aataccctgggaactgaggcctggc

SEQ ID NO: 510355 - DNA, 25 bp, Mus musculus
aataccctgggatctgaggcctggc

SEQ ID NO: 510356 - DNA, 25 bp, Mus musculus
aataccgacggcagaaccagcagtc

SEQ ID NO: 510357 - DNA, 25 bp, Mus musculus
aataccgacggctgaaccagcagtc

SEQ ID NO: 510358 - DNA, 25 bp, Mus musculus
aataccgctcctcgttggcggagag

SEQ ID NO: 510359 - DNA, 25 bp, Mus musculus
aataccgctcctggttggcggagag

SEQ ID NO: 510360 - DNA, 25 bp, Mus musculus
aataccgctgtgacgcaaaattccg

SEQ ID NO: 510361 - DNA, 25 bp, Mus musculus
aataccgctgtgtcgcaaaattccg

SEQ ID NO: 510362 - DNA, 25 bp, Mus musculus
aatacctagggtagaaactgagatg

SEQ ID NO: 510363 - DNA, 25 bp, Mus musculus
aatacctagggttgaaactgagatg

SEQ ID NO: 510364 - DNA, 25 bp, Mus musculus
aatacctcatgaagctcatgccgcc

SEQ ID NO: 510365 - DNA, 25 bp, Mus musculus
aatacctcatgatgctcatgccgcc

SEQ ID NO: 510366 - DNA, 25 bp, Mus musculus
aatacctcctccaaaccaagctggg

SEQ ID NO: 510367 - DNA, 25 bp, Mus musculus
aatacctcctcctaaccaagctggg

SEQ ID NO: 510368 - DNA, 25 bp, Mus musculus
aatacctgcgtacagaggccagagg

SEQ ID NO: 510369 - DNA, 25 bp, Mus musculus
aatacctgcgtagagaggccagagg

SEQ ID NO: 510370 - DNA, 25 bp, Mus musculus
aatacctgctctctgtttgggcctg

SEQ ID NO: 510371 - DNA, 25 bp, Mus musculus
aatacctgctctgtgtttgggcctg

SEQ ID NO: 510372 - DNA, 25 bp, Mus musculus
aatacctgcttccttgccaagaaga

SEQ ID NO: 510373 - DNA, 25 bp, Mus musculus
aatacctgcttcgttgccaagaaga

SEQ ID NO: 510374 - DNA, 25 bp, Mus musculus
aatacctggccaccggagccataga

SEQ ID NO: 510375 - DNA, 25 bp, Mus musculus
aatacctggccagcggagccataga

SEQ ID NO: 510376 - DNA, 25 bp, Mus musculus
aatacctgggctacctgaaggttga

SEQ ID NO: 510377 - DNA, 25 bp, Mus musculus
aatacctgggcttcctgaaggttga

SEQ ID NO: 510378 - DNA, 25 bp, Mus musculus
aatacctgtgtcagcgtgagtactc

SEQ ID NO: 510379 - DNA, 25 bp, Mus musculus
aatacctgtgtctgcgtgagtactc

SEQ ID NO: 510380 - DNA, 25 bp, Mus musculus
aataccttccacaacattgctctgg

SEQ ID NO: 510381 - DNA, 25 bp, Mus musculus
aataccttccactacattgctctgg

SEQ ID NO: 510382 - DNA, 25 bp, Mus musculus
aataccttctttaagtgcacagtgg

SEQ ID NO: 510383 - DNA, 25 bp, Mus musculus
aataccttcttttagtgcacagtgg

SEQ ID NO: 510384 - DNA, 25 bp, Mus musculus
aatacgaaagccaacaaagacgaag

SEQ ID NO: 510385 - DNA, 25 bp, Mus musculus
aatacgaaagcctacaaagacgaag

SEQ ID NO: 510386 - DNA, 25 bp, Mus musculus
aatacgaactgcctgacagcctcca

SEQ ID NO: 510387 - DNA, 25 bp, Mus musculus
aatacgaactgcgtgacagcctcca

SEQ ID NO: 510388 - DNA, 25 bp, Mus musculus
aatacgaatcccagccaaaccagga

SEQ ID NO: 510389 - DNA, 25 bp, Mus musculus
aatacgaatccctgccaaaccagga

SEQ ID NO: 510390 - DNA, 25 bp, Mus musculus
aatacgacgggcatcgcatctgggt

SEQ ID NO: 510391 - DNA, 25 bp, Mus musculus
aatacgacgggcttcgcatctgggt

SEQ ID NO: 510392 - DNA, 25 bp, Mus musculus
aatacgaggagtattcagcaacaaa

SEQ ID NO: 510393 - DNA, 25 bp, Mus musculus
aatacgaggagttttcagcaacaaa

SEQ ID NO: 510394 - DNA, 25 bp, Mus musculus
aatacgaggtgcatcggacgctgca

SEQ ID NO: 510395 - DNA, 25 bp, Mus musculus
aatacgaggtgcttcggacgctgca

SEQ ID NO: 510396 - DNA, 25 bp, Mus musculus
aatacgcctggaaaatcctctctgg

SEQ ID NO: 510397 - DNA, 25 bp, Mus musculus
aatacgcctggataatcctctctgg

SEQ ID NO: 510398 - DNA, 25 bp, Mus musculus
aatacgggtccaacaaccacaccta

SEQ ID NO: 510399 - DNA, 25 bp, Mus musculus
aatacgggtccatcaaccacaccta

SEQ ID NO: 510400 - DNA, 25 bp, Mus musculus
aatacggtgacaagaggatcatcga

SEQ ID NO: 510401 - DNA, 25 bp, Mus musculus
aatacggtgacatgaggatcatcga

SEQ ID NO: 510402 - DNA, 25 bp, Mus musculus
aatacggtgatgcaatgtgatgctt

SEQ ID NO: 510403 - DNA, 25 bp, Mus musculus
aatacggtgatggaatgtgatgctt

SEQ ID NO: 510404 - DNA, 25 bp, Mus musculus
aatactacctgtctgctggctacca

SEQ ID NO: 510405 - DNA, 25 bp, Mus musculus
aatactacctgtgtgctggctacca

SEQ ID NO: 510406 - DNA, 25 bp, Mus musculus
aatactacttgaaatgttccctgtc

SEQ ID NO: 510407 - DNA, 25 bp, Mus musculus
aatactacttgatatgttccctgtc

SEQ ID NO: 510408 - DNA, 25 bp, Mus musculus
aatactcacaggaacaacagttagc

SEQ ID NO: 510409 - DNA, 25 bp, Mus musculus
aatactcacaggtacaacagttagc

SEQ ID NO: 510410 - DNA, 25 bp, Mus musculus
aatactccagacaaccccagcagaa

SEQ ID NO: 510411 - DNA, 25 bp, Mus musculus
aatactccagactaccccagcagaa

SEQ ID NO: 510412 - DNA, 25 bp, Mus musculus
aatactccgaggctctcaaagatgc

SEQ ID NO: 510413 - DNA, 25 bp, Mus musculus
aatactccgagggtctcaaagatgc

SEQ ID NO: 510414 - DNA, 25 bp, Mus musculus
aatactcggcgcagaacgcacgcat

SEQ ID NO: 510415 - DNA, 25 bp, Mus musculus
aatactcggcgctgaacgcacgcat

SEQ ID NO: 510416 - DNA, 25 bp, Mus musculus
aatactctgggtctctgcaagtaca

SEQ ID NO: 510417 - DNA, 25 bp, Mus musculus
aatactctgggtgtctgcaagtaca

SEQ ID NO: 510418 - DNA, 25 bp, Mus musculus
aatactgaatgaagtatcccaagcc

SEQ ID NO: 510419 - DNA, 25 bp, Mus musculus
aatactgaatgatgtatcccaagcc

SEQ ID NO: 510420 - DNA, 25 bp, Mus musculus
aatactgcccatccttacaggtgct

SEQ ID NO: 510421 - DNA, 25 bp, Mus musculus
aatactgcccatgcttacaggtgct

SEQ ID NO: 510422 - DNA, 25 bp, Mus musculus
aatactgggactaaatgaattcatc

SEQ ID NO: 510423 - DNA, 25 bp, Mus musculus
aatactgggacttaatgaattcatc

SEQ ID NO: 510424 - DNA, 25 bp, Mus musculus
aatactgtgtgaaaaggaggaggct

SEQ ID NO: 510425 - DNA, 25 bp, Mus musculus
aatactgtgtgataaggaggaggct

SEQ ID NO: 510426 - DNA, 25 bp, Mus musculus
aatactgttgttattcgaccccagg

SEQ ID NO: 510427 - DNA, 25 bp, Mus musculus
aatactgttgtttttcgaccccagg

SEQ ID NO: 510428 - DNA, 25 bp, Mus musculus
aatacttacagtctcaaaatgaggg

SEQ ID NO: 510429 - DNA, 25 bp, Mus musculus
aatacttacagtgtcaaaatgaggg

SEQ ID NO: 510430 - DNA, 25 bp, Mus musculus
aatacttatccaatgcggagcgcgc

SEQ ID NO: 510431 - DNA, 25 bp, Mus musculus
aatacttatccattgcggagcgcgc

SEQ ID NO: 510432 - DNA, 25 bp, Mus musculus
aatacttcgagtactttgccccaga

SEQ ID NO: 510433 - DNA, 25 bp, Mus musculus
aatacttcgagttctttgccccaga

SEQ ID NO: 510434 - DNA, 25 bp, Mus musculus
aatacttggccaagcccggcggcag

SEQ ID NO: 510435 - DNA, 25 bp, Mus musculus
aatacttggccatgcccggcggcag

SEQ ID NO: 510436 - DNA, 25 bp, Mus musculus
aatacttgttatatgaacgcggcgc

SEQ ID NO: 510437 - DNA, 25 bp, Mus musculus
aatacttgttatttgaacgcggcgc

SEQ ID NO: 510438 - DNA, 25 bp, Mus musculus
aatacttttagactggcttttagag

SEQ ID NO: 510439 - DNA, 25 bp, Mus musculus
aatacttttagagtggcttttagag

SEQ ID NO: 510440 - DNA, 25 bp, Mus musculus
aatagaaaaagcaggaatgaatgga

SEQ ID NO: 510441 - DNA, 25 bp, Mus musculus
aatagaaaaagctggaatgaatgga

SEQ ID NO: 510442 - DNA, 25 bp, Mus musculus
aatagaaaaatgagtctccaaaggc

SEQ ID NO: 510443 - DNA, 25 bp, Mus musculus
aatagaaaaatgtgtctccaaaggc

SEQ ID NO: 510444 - DNA, 25 bp, Mus musculus
aatagaactattaaagcgacagcag

SEQ ID NO: 510445 - DNA, 25 bp, Mus musculus
aatagaactatttaagcgacagcag

SEQ ID NO: 510446 - DNA, 25 bp, Mus musculus
aatagaagatttaggcgtgcactgc

SEQ ID NO: 510447 - DNA, 25 bp, Mus musculus
aatagaagattttggcgtgcactgc

SEQ ID NO: 510448 - DNA, 25 bp, Mus musculus
aatagaaggttcagctaatggtact

SEQ ID NO: 510449 - DNA, 25 bp, Mus musculus
aatagaaggttctgctaatggtact

SEQ ID NO: 510450 - DNA, 25 bp, Mus musculus
aatagacccaacagcattgacccag

SEQ ID NO: 510451 - DNA, 25 bp, Mus musculus
aatagacccaactgcattgacccag

SEQ ID NO: 510452 - DNA, 25 bp, Mus musculus
aatagacctgggagcctccttggtg

SEQ ID NO: 510453 - DNA, 25 bp, Mus musculus
aatagacctgggtgcctccttggtg

SEQ ID NO: 510454 - DNA, 25 bp, Mus musculus
aatagactgacccagctggaaaggc

SEQ ID NO: 510455 - DNA, 25 bp, Mus musculus
aatagactgaccgagctggaaaggc

SEQ ID NO: 510456 - DNA, 25 bp, Mus musculus
aatagactgagcattttgaggaaca

SEQ ID NO: 510457 - DNA, 25 bp, Mus musculus
aatagactgagctttttgaggaaca

SEQ ID NO: 510458 - DNA, 25 bp, Mus musculus
aatagagaagaaccgcaccgtggta

SEQ ID NO: 510459 - DNA, 25 bp, Mus musculus
aatagagaagaagcgcaccgtggta

SEQ ID NO: 510460 - DNA, 25 bp, Mus musculus
aatagagtctgcatactaccagcaa

SEQ ID NO: 510461 - DNA, 25 bp, Mus musculus
aatagagtctgcttactaccagcaa

SEQ ID NO: 510462 - DNA, 25 bp, Mus musculus
aatagatctgatatgtatctgagac

SEQ ID NO: 510463 - DNA, 25 bp, Mus musculus
aatagatctgatttgtatctgagac

SEQ ID NO: 510464 - DNA, 25 bp, Mus musculus
aatagatcttgaaaatccacaggag

SEQ ID NO: 510465 - DNA, 25 bp, Mus musculus
aatagatcttgataatccacaggag

SEQ ID NO: 510466 - DNA, 25 bp, Mus musculus
aatagatgaagaccggatccccaac

SEQ ID NO: 510467 - DNA, 25 bp, Mus musculus
aatagatgaagagcggatccccaac

SEQ ID NO: 510468 - DNA, 25 bp, Mus musculus
aatagcaaactaatgatcctgactg

SEQ ID NO: 510469 - DNA, 25 bp, Mus musculus
aatagcaaactattgatcctgactg

SEQ ID NO: 510470 - DNA, 25 bp, Mus musculus
aatagcaaatcactgcatggacccc

SEQ ID NO: 510471 - DNA, 25 bp, Mus musculus
aatagcaaatcagtgcatggacccc

SEQ ID NO: 510472 - DNA, 25 bp, Mus musculus
aatagcacgtcacaaatatctttgg

SEQ ID NO: 510473 - DNA, 25 bp, Mus musculus
aatagcacgtcagaaatatctttgg

SEQ ID NO: 510474 - DNA, 25 bp, Mus musculus
aatagcagcgttaacggcctcacag

SEQ ID NO: 510475 - DNA, 25 bp, Mus musculus
aatagcagcgtttacggcctcacag

SEQ ID NO: 510476 - DNA, 25 bp, Mus musculus
aatagccaggacaaggctccacaag

SEQ ID NO: 510477 - DNA, 25 bp, Mus musculus
aatagccaggactaggctccacaag

SEQ ID NO: 510478 - DNA, 25 bp, Mus musculus
aatagcctcttcattccgagactca

SEQ ID NO: 510479 - DNA, 25 bp, Mus musculus
aatagcctcttctttccgagactca

SEQ ID NO: 510480 - DNA, 25 bp, Mus musculus
aatagcctggagctagctctgggca

SEQ ID NO: 510481 - DNA, 25 bp, Mus musculus
aatagcctggaggtagctctgggca

SEQ ID NO: 510482 - DNA, 25 bp, Mus musculus
aatagctagtctcgatgcttaagcg

SEQ ID NO: 510483 - DNA, 25 bp, Mus musculus
aatagctagtctggatgcttaagcg

SEQ ID NO: 510484 - DNA, 25 bp, Mus musculus
aatagctctgatctccaaccccaag

SEQ ID NO: 510485 - DNA, 25 bp, Mus musculus
aatagctctgatgtccaaccccaag

SEQ ID NO: 510486 - DNA, 25 bp, Mus musculus
aatagctcttccattgttcagagcc

SEQ ID NO: 510487 - DNA, 25 bp, Mus musculus
aatagctcttcctttgttcagagcc

SEQ ID NO: 510488 - DNA, 25 bp, Mus musculus
aatagctgtgtacattagactgaca

SEQ ID NO: 510489 - DNA, 25 bp, Mus musculus
aatagctgtgtagattagactgaca

SEQ ID NO: 510490 - DNA, 25 bp, Mus musculus
aatagcttaaaacgcccagatacca

SEQ ID NO: 510491 - DNA, 25 bp, Mus musculus
aatagcttaaaaggcccagatacca

SEQ ID NO: 510492 - DNA, 25 bp, Mus musculus
aataggagagctctacgtggtacac

SEQ ID NO: 510493 - DNA, 25 bp, Mus musculus
aataggagagctgtacgtggtacac

SEQ ID NO: 510494 - DNA, 25 bp, Mus musculus
aataggagtacaccgtcttggacca

SEQ ID NO: 510495 - DNA, 25 bp, Mus musculus
aataggagtacagcgtcttggacca

SEQ ID NO: 510496 - DNA, 25 bp, Mus musculus
aataggagttgtcaatgttacagac

SEQ ID NO: 510497 - DNA, 25 bp, Mus musculus
aataggagttgtgaatgttacagac

SEQ ID NO: 510498 - DNA, 25 bp, Mus musculus
aataggctacttcaaatctgaactg

SEQ ID NO: 510499 - DNA, 25 bp, Mus musculus
aataggctacttgaaatctgaactg

SEQ ID NO: 510500 - DNA, 25 bp, Mus musculus
aatagggataccagggcatctacgc

SEQ ID NO: 510501 - DNA, 25 bp, Mus musculus
aatagggatacctgggcatctacgc

SEQ ID NO: 510502 - DNA, 25 bp, Mus musculus
aataggtctgagctggaagttaagc

SEQ ID NO: 510503 - DNA, 25 bp, Mus musculus
aataggtctgaggtggaagttaagc

SEQ ID NO: 510504 - DNA, 25 bp, Mus musculus
aataggtgaacaccttctcctgaaa

SEQ ID NO: 510505 - DNA, 25 bp, Mus musculus
aataggtgaacagcttctcctgaaa

SEQ ID NO: 510506 - DNA, 25 bp, Mus musculus
aataggtgagatcgtccttgtgagc

SEQ ID NO: 510507 - DNA, 25 bp, Mus musculus
aataggtgagatggtccttgtgagc

SEQ ID NO: 510508 - DNA, 25 bp, Mus musculus
aatagtaaatctcccaagcactctg

SEQ ID NO: 510509 - DNA, 25 bp, Mus musculus
aatagtaaatctgccaagcactctg

SEQ ID NO: 510510 - DNA, 25 bp, Mus musculus
aatagtatccagctggaatcggaag

SEQ ID NO: 510511 - DNA, 25 bp, Mus musculus
aatagtatccaggtggaatcggaag

SEQ ID NO: 510512 - DNA, 25 bp, Mus musculus
aatagtatcttcacagttggtgggc

SEQ ID NO: 510513 - DNA, 25 bp, Mus musculus
aatagtatcttctcagttggtgggc

SEQ ID NO: 510514 - DNA, 25 bp, Mus musculus
aatagtcactgaacgggaaactggt

SEQ ID NO: 510515 - DNA, 25 bp, Mus musculus
aatagtcactgatcgggaaactggt

SEQ ID NO: 510516 - DNA, 25 bp, Mus musculus
aatagtccaattagttaaagccaag

SEQ ID NO: 510517 - DNA, 25 bp, Mus musculus
aatagtccaatttgttaaagccaag

SEQ ID NO: 510518 - DNA, 25 bp, Mus musculus
aatagtccacggcattatgcacctg

SEQ ID NO: 510519 - DNA, 25 bp, Mus musculus
aatagtccacgggattatgcacctg

SEQ ID NO: 510520 - DNA, 25 bp, Mus musculus
aatagtccgtgccttgccttggagg

SEQ ID NO: 510521 - DNA, 25 bp, Mus musculus
aatagtccgtgcgttgccttggagg

SEQ ID NO: 510522 - DNA, 25 bp, Mus musculus
aatagtcgccttagcaggcggctga

SEQ ID NO: 510523 - DNA, 25 bp, Mus musculus
aatagtcgcctttgcaggcggctga

SEQ ID NO: 510524 - DNA, 25 bp, Mus musculus
aatagtcttaggcagggcatactcc

SEQ ID NO: 510525 - DNA, 25 bp, Mus musculus
aatagtcttagggagggcatactcc

SEQ ID NO: 510526 - DNA, 25 bp, Mus musculus
aatagtgattgacggagcttacctg

SEQ ID NO: 510527 - DNA, 25 bp, Mus musculus
aatagtgattgagggagcttacctg

SEQ ID NO: 510528 - DNA, 25 bp, Mus musculus
aatagtgctgccaaaggacctgcag

SEQ ID NO: 510529 - DNA, 25 bp, Mus musculus
aatagtgctgcctaaggacctgcag

SEQ ID NO: 510530 - DNA, 25 bp, Mus musculus
aatagtgtctttagcagccctggcc

SEQ ID NO: 510531 - DNA, 25 bp, Mus musculus
aatagtgtcttttgcagccctggcc

SEQ ID NO: 510532 - DNA, 25 bp, Mus musculus
aatagtgtgaacagatatgtctgtc

SEQ ID NO: 510533 - DNA, 25 bp, Mus musculus
aatagtgtgaactgatatgtctgtc

SEQ ID NO: 510534 - DNA, 25 bp, Mus musculus
aatagttatgacactgatgaagcaa

SEQ ID NO: 510535 - DNA, 25 bp, Mus musculus
aatagttatgactctgatgaagcaa

SEQ ID NO: 510536 - DNA, 25 bp, Mus musculus
aatagttgcatcagcgctcctagcc

SEQ ID NO: 510537 - DNA, 25 bp, Mus musculus
aatagttgcatctgcgctcctagcc

SEQ ID NO: 510538 - DNA, 25 bp, Mus musculus
aatataaaaagcagtgcactgaggc

SEQ ID NO: 510539 - DNA, 25 bp, Mus musculus
aatataaaaagctgtgcactgaggc

SEQ ID NO: 510540 - DNA, 25 bp, Mus musculus
aatataaactgaagaatgttgctgc

SEQ ID NO: 510541 - DNA, 25 bp, Mus musculus
aatataaactgatgaatgttgctgc

SEQ ID NO: 510542 - DNA, 25 bp, Mus musculus
aatataattgttcgcgcagattcag

SEQ ID NO: 510543 - DNA, 25 bp, Mus musculus
aatataattgttggcgcagattcag

SEQ ID NO: 510544 - DNA, 25 bp, Mus musculus
aatataatttcacattgagattcag

SEQ ID NO: 510545 - DNA, 25 bp, Mus musculus
aatataatttcagattgagattcag

SEQ ID NO: 510546 - DNA, 25 bp, Mus musculus
aatatacatttcactccttaaggag

SEQ ID NO: 510547 - DNA, 25 bp, Mus musculus
aatatacatttctctccttaaggag

SEQ ID NO: 510548 - DNA, 25 bp, Mus musculus
aatatagaccttctgatttgctgtg

SEQ ID NO: 510549 - DNA, 25 bp, Mus musculus
aatatagaccttgtgatttgctgtg

SEQ ID NO: 510550 - DNA, 25 bp, Mus musculus
aatatagacgtgacccagaagtgcc

SEQ ID NO: 510551 - DNA, 25 bp, Mus musculus
aatatagacgtgtcccagaagtgcc

SEQ ID NO: 510552 - DNA, 25 bp, Mus musculus
aatatagggctaagtgtggtcaaca

SEQ ID NO: 510553 - DNA, 25 bp, Mus musculus
aatatagggctatgtgtggtcaaca

SEQ ID NO: 510554 - DNA, 25 bp, Mus musculus
aatatagtagaacagatgtgctgta

SEQ ID NO: 510555 - DNA, 25 bp, Mus musculus
aatatagtagaagagatgtgctgta

SEQ ID NO: 510556 - DNA, 25 bp, Mus musculus
aatatagtatcgactgcattccagc

SEQ ID NO: 510557 - DNA, 25 bp, Mus musculus
aatatagtatcgtctgcattccagc

SEQ ID NO: 510558 - DNA, 25 bp, Mus musculus
aatatagtcaagctagcagagcagt

SEQ ID NO: 510559 - DNA, 25 bp, Mus musculus
aatatagtcaaggtagcagagcagt

SEQ ID NO: 510560 - DNA, 25 bp, Mus musculus
aatatatcaaggagaggaactacca

SEQ ID NO: 510561 - DNA, 25 bp, Mus musculus
aatatatcaaggtgaggaactacca

SEQ ID NO: 510562 - DNA, 25 bp, Mus musculus
aatatatgccatcaaggtcttaagg

SEQ ID NO: 510563 - DNA, 25 bp, Mus musculus
aatatatgccatgaaggtcttaagg

SEQ ID NO: 510564 - DNA, 25 bp, Mus musculus
aatatcacagccaaacgttcacggg

SEQ ID NO: 510565 - DNA, 25 bp, Mus musculus
aatatcacagcctaacgttcacggg

SEQ ID NO: 510566 - DNA, 25 bp, Mus musculus
aatatcacttttcgtcaccctgtgg

SEQ ID NO: 510567 - DNA, 25 bp, Mus musculus
aatatcacttttggtcaccctgtgg

SEQ ID NO: 510568 - DNA, 25 bp, Mus musculus
aatatcagatggatggacctagggc

SEQ ID NO: 510569 - DNA, 25 bp, Mus musculus
aatatcagatggttggacctagggc

SEQ ID NO: 510570 - DNA, 25 bp, Mus musculus
aatatcatgctgctggctctacgca

SEQ ID NO: 510571 - DNA, 25 bp, Mus musculus
aatatcatgctggtggctctacgca

SEQ ID NO: 510572 - DNA, 25 bp, Mus musculus
aatatccaactaccgcacacattgt

SEQ ID NO: 510573 - DNA, 25 bp, Mus musculus
aatatccaactagcgcacacattgt

SEQ ID NO: 510574 - DNA, 25 bp, Mus musculus
aatatccacatccagctgagaagag

SEQ ID NO: 510575 - DNA, 25 bp, Mus musculus
aatatccacatcgagctgagaagag

SEQ ID NO: 510576 - DNA, 25 bp, Mus musculus
aatatccaggtgagaggaagaaggc

SEQ ID NO: 510577 - DNA, 25 bp, Mus musculus
aatatccaggtgtgaggaagaaggc

SEQ ID NO: 510578 - DNA, 25 bp, Mus musculus
aatatccattccctgactgcccagg

SEQ ID NO: 510579 - DNA, 25 bp, Mus musculus
aatatccattccgtgactgcccagg

SEQ ID NO: 510580 - DNA, 25 bp, Mus musculus
aatatccctgacctgcaaaacccag

SEQ ID NO: 510581 - DNA, 25 bp, Mus musculus
aatatccctgacgtgcaaaacccag

SEQ ID NO: 510582 - DNA, 25 bp, Mus musculus
aatatccctttgatttctgtcgctg

SEQ ID NO: 510583 - DNA, 25 bp, Mus musculus
aatatccctttgttttctgtcgctg

SEQ ID NO: 510584 - DNA, 25 bp, Mus musculus
aatatccggtctctgatgagtgcag

SEQ ID NO: 510585 - DNA, 25 bp, Mus musculus
aatatccggtctgtgatgagtgcag

SEQ ID NO: 510586 - DNA, 25 bp, Mus musculus
aatatccggtggaattctgttcagg

SEQ ID NO: 510587 - DNA, 25 bp, Mus musculus
aatatccggtggtattctgttcagg

SEQ ID NO: 510588 - DNA, 25 bp, Mus musculus
aatatcctgaagcagattgacatcc

SEQ ID NO: 510589 - DNA, 25 bp, Mus musculus
aatatcctgaaggagattgacatcc

SEQ ID NO: 510590 - DNA, 25 bp, Mus musculus
aatatcgagtctccgctgagctgcc

SEQ ID NO: 510591 - DNA, 25 bp, Mus musculus
aatatcgagtctgcgctgagctgcc

SEQ ID NO: 510592 - DNA, 25 bp, Mus musculus
aatatcgccaagctgcagctacatg

SEQ ID NO: 510593 - DNA, 25 bp, Mus musculus
aatatcgccaaggtgcagctacatg

SEQ ID NO: 510594 - DNA, 25 bp, Mus musculus
aatatcgggccaagagccagtacca

SEQ ID NO: 510595 - DNA, 25 bp, Mus musculus
aatatcgggccatgagccagtacca

SEQ ID NO: 510596 - DNA, 25 bp, Mus musculus
aatatctgaagacccacgtgggacc

SEQ ID NO: 510597 - DNA, 25 bp, Mus musculus
aatatctgaagagccacgtgggacc

SEQ ID NO: 510598 - DNA, 25 bp, Mus musculus
aatatctgatccaggagctccgaag

SEQ ID NO: 510599 - DNA, 25 bp, Mus musculus
aatatctgatcctggagctccgaag

SEQ ID NO: 510600 - DNA, 25 bp, Mus musculus
aatatctggaacaattcctcatgga

SEQ ID NO: 510601 - DNA, 25 bp, Mus musculus
aatatctggaactattcctcatgga

SEQ ID NO: 510602 - DNA, 25 bp, Mus musculus
aatatcttatctacggagcaggagc

SEQ ID NO: 510603 - DNA, 25 bp, Mus musculus
aatatcttatcttcggagcaggagc

SEQ ID NO: 510604 - DNA, 25 bp, Mus musculus
aatatcttgagcctcatcaatgagt

SEQ ID NO: 510605 - DNA, 25 bp, Mus musculus
aatatcttgagcgtcatcaatgagt

SEQ ID NO: 510606 - DNA, 25 bp, Mus musculus
aatatgaaggcacacccctgaaatg

SEQ ID NO: 510607 - DNA, 25 bp, Mus musculus
aatatgaaggcagacccctgaaatg

SEQ ID NO: 510608 - DNA, 25 bp, Mus musculus
aatatgacaggacggcatccctttg

SEQ ID NO: 510609 - DNA, 25 bp, Mus musculus
aatatgacaggagggcatccctttg

SEQ ID NO: 510610 - DNA, 25 bp, Mus musculus
aatatgacggcgagttttctgcaga

SEQ ID NO: 510611 - DNA, 25 bp, Mus musculus
aatatgacggcgtgttttctgcaga

SEQ ID NO: 510612 - DNA, 25 bp, Mus musculus
aatatgagaggaacgggagatatga

SEQ ID NO: 510613 - DNA, 25 bp, Mus musculus
aatatgagaggatcgggagatatga

SEQ ID NO: 510614 - DNA, 25 bp, Mus musculus
aatatgagctccctgaggatccccg

SEQ ID NO: 510615 - DNA, 25 bp, Mus musculus
aatatgagctccgtgaggatccccg

SEQ ID NO: 510616 - DNA, 25 bp, Mus musculus
aatatgaggcagacatgtgtgtgag

SEQ ID NO: 510617 - DNA, 25 bp, Mus musculus
aatatgaggcagtcatgtgtgtgag

SEQ ID NO: 510618 - DNA, 25 bp, Mus musculus
aatatgatgagcagattgtgcgccg

SEQ ID NO: 510619 - DNA, 25 bp, Mus musculus
aatatgatgagctgattgtgcgccg

SEQ ID NO: 510620 - DNA, 25 bp, Mus musculus
aatatgcaggataatagtgttcaag

SEQ ID NO: 510621 - DNA, 25 bp, Mus musculus
aatatgcaggattatagtgttcaag

SEQ ID NO: 510622 - DNA, 25 bp, Mus musculus
aatatgcctggactatctgcctgtg

SEQ ID NO: 510623 - DNA, 25 bp, Mus musculus
aatatgcctggagtatctgcctgtg

SEQ ID NO: 510624 - DNA, 25 bp, Mus musculus
aatatgcgtgccctggaattagggt

SEQ ID NO: 510625 - DNA, 25 bp, Mus musculus
aatatgcgtgccgtggaattagggt

SEQ ID NO: 510626 - DNA, 25 bp, Mus musculus
aatatgctacctccaaaggcagctt

SEQ ID NO: 510627 - DNA, 25 bp, Mus musculus
aatatgctacctgcaaaggcagctt

SEQ ID NO: 510628 - DNA, 25 bp, Mus musculus
aatatgctctacatccggcagatgg

SEQ ID NO: 510629 - DNA, 25 bp, Mus musculus
aatatgctctacttccggcagatgg

SEQ ID NO: 510630 - DNA, 25 bp, Mus musculus
aatatgcttcgccagaagtttcctt

SEQ ID NO: 510631 - DNA, 25 bp, Mus musculus
aatatgcttcgcgagaagtttcctt

SEQ ID NO: 510632 - DNA, 25 bp, Mus musculus
aatatggaatcccaacctctcttcg

SEQ ID NO: 510633 - DNA, 25 bp, Mus musculus
aatatggaatccgaacctctcttcg

SEQ ID NO: 510634 - DNA, 25 bp, Mus musculus
aatatggcacccaaatattagttcc

SEQ ID NO: 510635 - DNA, 25 bp, Mus musculus
aatatggcaccctaatattagttcc

SEQ ID NO: 510636 - DNA, 25 bp, Mus musculus
aatatggcatgtattcggataagcc

SEQ ID NO: 510637 - DNA, 25 bp, Mus musculus
aatatggcatgttttcggataagcc

SEQ ID NO: 510638 - DNA, 25 bp, Mus musculus
aatatggcttctcaggagaagctgg

SEQ ID NO: 510639 - DNA, 25 bp, Mus musculus
aatatggcttctgaggagaagctgg

SEQ ID NO: 510640 - DNA, 25 bp, Mus musculus
aatatgggcagtcgcaccctgaaca

SEQ ID NO: 510641 - DNA, 25 bp, Mus musculus
aatatgggcagtggcaccctgaaca

SEQ ID NO: 510642 - DNA, 25 bp, Mus musculus
aatatggggtgtaccctcttagagg

SEQ ID NO: 510643 - DNA, 25 bp, Mus musculus
aatatggggtgttccctcttagagg

SEQ ID NO: 510644 - DNA, 25 bp, Mus musculus
aatatggtctgaacccacagtgaac

SEQ ID NO: 510645 - DNA, 25 bp, Mus musculus
aatatggtctgatcccacagtgaac

SEQ ID NO: 510646 - DNA, 25 bp, Mus musculus
aatatggtgcgacagtttctggcag

SEQ ID NO: 510647 - DNA, 25 bp, Mus musculus
aatatggtgcgagagtttctggcag

SEQ ID NO: 510648 - DNA, 25 bp, Mus musculus
aatatgtaggccacctgtagctgcc

SEQ ID NO: 510649 - DNA, 25 bp, Mus musculus
aatatgtaggcctcctgtagctgcc

SEQ ID NO: 510650 - DNA, 25 bp, Mus musculus
aatatgtcgcgccagctgagagccc

SEQ ID NO: 510651 - DNA, 25 bp, Mus musculus
aatatgtcgcgcgagctgagagccc

SEQ ID NO: 510652 - DNA, 25 bp, Mus musculus
aatatgtgagagcatgcccatggtc

SEQ ID NO: 510653 - DNA, 25 bp, Mus musculus
aatatgtgagaggatgcccatggtc

SEQ ID NO: 510654 - DNA, 25 bp, Mus musculus
aatatgtgcagaagctgccagccca

SEQ ID NO: 510655 - DNA, 25 bp, Mus musculus
aatatgtgcagatgctgccagccca

SEQ ID NO: 510656 - DNA, 25 bp, Mus musculus
aatatgttagagatgcacttcagcc

SEQ ID NO: 510657 - DNA, 25 bp, Mus musculus
aatatgttagagttgcacttcagcc

SEQ ID NO: 510658 - DNA, 25 bp, Mus musculus
aatatgttcccaagactctttcttg

SEQ ID NO: 510659 - DNA, 25 bp, Mus musculus
aatatgttcccatgactctttcttg

SEQ ID NO: 510660 - DNA, 25 bp, Mus musculus
aatatgtttgtgcaccccggagagc

SEQ ID NO: 510661 - DNA, 25 bp, Mus musculus
aatatgtttgtggaccccggagagc

SEQ ID NO: 510662 - DNA, 25 bp, Mus musculus
aatattaatgtgctttccgtttgca

SEQ ID NO: 510663 - DNA, 25 bp, Mus musculus
aatattaatgtggtttccgtttgca

SEQ ID NO: 510664 - DNA, 25 bp, Mus musculus
aatattatggctctgcatgggatgc

SEQ ID NO: 510665 - DNA, 25 bp, Mus musculus
aatattatggctgtgcatgggatgc

SEQ ID NO: 510666 - DNA, 25 bp, Mus musculus
aatattcacggaaccattctggcca

SEQ ID NO: 510667 - DNA, 25 bp, Mus musculus
aatattcacggatccattctggcca

SEQ ID NO: 510668 - DNA, 25 bp, Mus musculus
aatattcactctccattaggaagtt

SEQ ID NO: 510669 - DNA, 25 bp, Mus musculus
aatattcactctgcattaggaagtt

SEQ ID NO: 510670 - DNA, 25 bp, Mus musculus
aatattccaaacagatggcagagct

SEQ ID NO: 510671 - DNA, 25 bp, Mus musculus
aatattccaaactgatggcagagct

SEQ ID NO: 510672 - DNA, 25 bp, Mus musculus
aatattcctgtacatcaatgttaag

SEQ ID NO: 510673 - DNA, 25 bp, Mus musculus
aatattcctgtagatcaatgttaag

SEQ ID NO: 510674 - DNA, 25 bp, Mus musculus
aatattctagctacattctctgacg

SEQ ID NO: 510675 - DNA, 25 bp, Mus musculus
aatattctagcttcattctctgacg

SEQ ID NO: 510676 - DNA, 25 bp, Mus musculus
aatattctgctcatgggtgtttctc

SEQ ID NO: 510677 - DNA, 25 bp, Mus musculus
aatattctgctcttgggtgtttctc

SEQ ID NO: 510678 - DNA, 25 bp, Mus musculus
aatattgcaaggcaagttgtcgaga

SEQ ID NO: 510679 - DNA, 25 bp, Mus musculus
aatattgcaagggaagttgtcgaga

SEQ ID NO: 510680 - DNA, 25 bp, Mus musculus
aatattgtatacaaagactcttgat

SEQ ID NO: 510681 - DNA, 25 bp, Mus musculus
aatattgtatactaagactcttgat

SEQ ID NO: 510682 - DNA, 25 bp, Mus musculus
aatattgtcgttcgcttcgcaagaa

SEQ ID NO: 510683 - DNA, 25 bp, Mus musculus
aatattgtcgttggcttcgcaagaa

SEQ ID NO: 510684 - DNA, 25 bp, Mus musculus
aatattgtgcacagtgatttaaagc

SEQ ID NO: 510685 - DNA, 25 bp, Mus musculus
aatattgtgcactgtgatttaaagc

SEQ ID NO: 510686 - DNA, 25 bp, Mus musculus
aatattgtgggtcttcgtccggtcg

SEQ ID NO: 510687 - DNA, 25 bp, Mus musculus
aatattgtgggtgttcgtccggtcg

SEQ ID NO: 510688 - DNA, 25 bp, Mus musculus
aatatttgagctatgcatcctaacg

SEQ ID NO: 510689 - DNA, 25 bp, Mus musculus
aatatttgagctttgcatcctaacg

SEQ ID NO: 510690 - DNA, 25 bp, Mus musculus
aatattttgtataagagtcactgac

SEQ ID NO: 510691 - DNA, 25 bp, Mus musculus
aatattttgtattagagtcactgac

SEQ ID NO: 510692 - DNA, 25 bp, Mus musculus
aatcaaaaaagcatccaatcacacg

SEQ ID NO: 510693 - DNA, 25 bp, Mus musculus
aatcaaaaaagcttccaatcacacg

SEQ ID NO: 510694 - DNA, 25 bp, Mus musculus
aatcaaaaaggaaggtttccagcac

SEQ ID NO: 510695 - DNA, 25 bp, Mus musculus
aatcaaaaaggatggtttccagcac

SEQ ID NO: 510696 - DNA, 25 bp, Mus musculus
aatcaaaagcctacctcggaagaca

SEQ ID NO: 510697 - DNA, 25 bp, Mus musculus
aatcaaaagccttcctcggaagaca

SEQ ID NO: 510698 - DNA, 25 bp, Mus musculus
aatcaaaaggcaaagctctatagtg

SEQ ID NO: 510699 - DNA, 25 bp, Mus musculus
aatcaaaaggcatagctctatagtg

SEQ ID NO: 510700 - DNA, 25 bp, Mus musculus
aatcaaaatgttcgcccagcagaaa

SEQ ID NO: 510701 - DNA, 25 bp, Mus musculus
aatcaaaatgttggcccagcagaaa

SEQ ID NO: 510702 - DNA, 25 bp, Mus musculus
aatcaaacccagatccctccagtag

SEQ ID NO: 510703 - DNA, 25 bp, Mus musculus
aatcaaacccagttccctccagtag

SEQ ID NO: 510704 - DNA, 25 bp, Mus musculus
aatcaaactgcacaacaaggtgttc

SEQ ID NO: 510705 - DNA, 25 bp, Mus musculus
aatcaaactgcagaacaaggtgttc

SEQ ID NO: 510706 - DNA, 25 bp, Mus musculus
aatcaaagagatagctgtgactgtg

SEQ ID NO: 510707 - DNA, 25 bp, Mus musculus
aatcaaagagattgctgtgactgtg

SEQ ID NO: 510708 - DNA, 25 bp, Mus musculus
aatcaaaggccaagaatttgtcagc

SEQ ID NO: 510709 - DNA, 25 bp, Mus musculus
aatcaaaggccatgaatttgtcagc

SEQ ID NO: 510710 - DNA, 25 bp, Mus musculus
aatcaaagggctaaatgacaggcca

SEQ ID NO: 510711 - DNA, 25 bp, Mus musculus
aatcaaagggcttaatgacaggcca

SEQ ID NO: 510712 - DNA, 25 bp, Mus musculus
aatcaaagtctacctctgaagaaaa

SEQ ID NO: 510713 - DNA, 25 bp, Mus musculus
aatcaaagtctagctctgaagaaaa

SEQ ID NO: 510714 - DNA, 25 bp, Mus musculus
aatcaaagtgaacaaaaccctgccg

SEQ ID NO: 510715 - DNA, 25 bp, Mus musculus
aatcaaagtgaagaaaaccctgccg

SEQ ID NO: 510716 - DNA, 25 bp, Mus musculus
aatcaaatacgccttcagtctgctg

SEQ ID NO: 510717 - DNA, 25 bp, Mus musculus
aatcaaatacgcgttcagtctgctg

SEQ ID NO: 510718 - DNA, 25 bp, Mus musculus
aatcaacaacatccgtccagagagg

SEQ ID NO: 510719 - DNA, 25 bp, Mus musculus
aatcaacaacatgcgtccagagagg

SEQ ID NO: 510720 - DNA, 25 bp, Mus musculus
aatcaacaccaacccggagagtcct

SEQ ID NO: 510721 - DNA, 25 bp, Mus musculus
aatcaacaccaagccggagagtcct

SEQ ID NO: 510722 - DNA, 25 bp, Mus musculus
aatcaacactaaccaggaagctctg

SEQ ID NO: 510723 - DNA, 25 bp, Mus musculus
aatcaacactaagcaggaagctctg

SEQ ID NO: 510724 - DNA, 25 bp, Mus musculus
aatcaacagactacagcaggaggcc

SEQ ID NO: 510725 - DNA, 25 bp, Mus musculus
aatcaacagacttcagcaggaggcc

SEQ ID NO: 510726 - DNA, 25 bp, Mus musculus
aatcaacaggagagctgacttcctc

SEQ ID NO: 510727 - DNA, 25 bp, Mus musculus
aatcaacaggagtgctgacttcctc

SEQ ID NO: 510728 - DNA, 25 bp, Mus musculus
aatcaacatgatctgggcctgctgg

SEQ ID NO: 510729 - DNA, 25 bp, Mus musculus
aatcaacatgatgtgggcctgctgg

SEQ ID NO: 510730 - DNA, 25 bp, Mus musculus
aatcaacccgcccagcagtggtggg

SEQ ID NO: 510731 - DNA, 25 bp, Mus musculus
aatcaacccgccgagcagtggtggg

SEQ ID NO: 510732 - DNA, 25 bp, Mus musculus
aatcaaccctgcagaacagctctgg

SEQ ID NO: 510733 - DNA, 25 bp, Mus musculus
aatcaaccctgctgaacagctctgg

SEQ ID NO: 510734 - DNA, 25 bp, Mus musculus
aatcaacccttcacccaattcattg

SEQ ID NO: 510735 - DNA, 25 bp, Mus musculus
aatcaacccttctcccaattcattg

SEQ ID NO: 510736 - DNA, 25 bp, Mus musculus
aatcaacctggtagatctggcaggc

SEQ ID NO: 510737 - DNA, 25 bp, Mus musculus
aatcaacctggttgatctggcaggc

SEQ ID NO: 510738 - DNA, 25 bp, Mus musculus
aatcaacgctttcgcggtgacgggc

SEQ ID NO: 510739 - DNA, 25 bp, Mus musculus
aatcaacgctttggcggtgacgggc

SEQ ID NO: 510740 - DNA, 25 bp, Mus musculus
aatcaacggaaaaatgcgaagctgt

SEQ ID NO: 510741 - DNA, 25 bp, Mus musculus
aatcaacggaaatatgcgaagctgt

SEQ ID NO: 510742 - DNA, 25 bp, Mus musculus
aatcaactctttactcagaatcacg

SEQ ID NO: 510743 - DNA, 25 bp, Mus musculus
aatcaactcttttctcagaatcacg

SEQ ID NO: 510744 - DNA, 25 bp, Mus musculus
aatcaacttgaacaccttccaaagg

SEQ ID NO: 510745 - DNA, 25 bp, Mus musculus
aatcaacttgaagaccttccaaagg

SEQ ID NO: 510746 - DNA, 25 bp, Mus musculus
aatcaagaaaatcaaagtcgtcttc

SEQ ID NO: 510747 - DNA, 25 bp, Mus musculus
aatcaagaaaatgaaagtcgtcttc

SEQ ID NO: 510748 - DNA, 25 bp, Mus musculus
aatcaagaagctatgggagccttcc

SEQ ID NO: 510749 - DNA, 25 bp, Mus musculus
aatcaagaagctttgggagccttcc

SEQ ID NO: 510750 - DNA, 25 bp, Mus musculus
aatcaagagctccacatcagggtcc

SEQ ID NO: 510751 - DNA, 25 bp, Mus musculus
aatcaagagctcgacatcagggtcc

SEQ ID NO: 510752 - DNA, 25 bp, Mus musculus
aatcaagaggtcagaccgccgtggg

SEQ ID NO: 510753 - DNA, 25 bp, Mus musculus
aatcaagaggtccagttccaaagcc

SEQ ID NO: 510754 - DNA, 25 bp, Mus musculus
aatcaagaggtcgagttccaaagcc

SEQ ID NO: 510755 - DNA, 25 bp, Mus musculus
aatcaagaggtctgaccgccgtggg

SEQ ID NO: 510756 - DNA, 25 bp, Mus musculus
aatcaagagtgaaaaacctgaagag

SEQ ID NO: 510757 - DNA, 25 bp, Mus musculus
aatcaagagtgataaacctgaagag

SEQ ID NO: 510758 - DNA, 25 bp, Mus musculus
aatcaagcaggacgacaagtgtctg

SEQ ID NO: 510759 - DNA, 25 bp, Mus musculus
aatcaagcaggaggacaagtgtctg

SEQ ID NO: 510760 - DNA, 25 bp, Mus musculus
aatcaagcagttagatgaagagatc

SEQ ID NO: 510761 - DNA, 25 bp, Mus musculus
aatcaagcagtttgatgaagagatc

SEQ ID NO: 510762 - DNA, 25 bp, Mus musculus
aatcaagcatgcattcaagtggagg

SEQ ID NO: 510763 - DNA, 25 bp, Mus musculus
aatcaagcatgctttcaagtggagg

SEQ ID NO: 510764 - DNA, 25 bp, Mus musculus
aatcaagctcatcgctgaaggcgaa

SEQ ID NO: 510765 - DNA, 25 bp, Mus musculus
aatcaagctcatggctgaaggcgaa

SEQ ID NO: 510766 - DNA, 25 bp, Mus musculus
aatcaagctttgcttgttcctgcat

SEQ ID NO: 510767 - DNA, 25 bp, Mus musculus
aatcaagctttggttgttcctgcat

SEQ ID NO: 510768 - DNA, 25 bp, Mus musculus
aatcaaggagcgagtggaagaaaaa

SEQ ID NO: 510769 - DNA, 25 bp, Mus musculus
aatcaaggagcgtgtggaagaaaaa

SEQ ID NO: 510770 - DNA, 25 bp, Mus musculus
aatcaaggcacacgaggacgaggcc

SEQ ID NO: 510771 - DNA, 25 bp, Mus musculus
aatcaaggcacaggaggacgaggcc

SEQ ID NO: 510772 - DNA, 25 bp, Mus musculus
aatcaaggcggcctctgagctctac

SEQ ID NO: 510773 - DNA, 25 bp, Mus musculus
aatcaaggcggcgtctgagctctac

SEQ ID NO: 510774 - DNA, 25 bp, Mus musculus
aatcaagggaatccccaaacttgat

SEQ ID NO: 510775 - DNA, 25 bp, Mus musculus
aatcaagggaatgcccaaacttgat

SEQ ID NO: 510776 - DNA, 25 bp, Mus musculus
aatcaagtagtgacagaacttggcc

SEQ ID NO: 510777 - DNA, 25 bp, Mus musculus
aatcaagtagtgtcagaacttggcc

SEQ ID NO: 510778 - DNA, 25 bp, Mus musculus
aatcaagtcccgattccgcatcagg

SEQ ID NO: 510779 - DNA, 25 bp, Mus musculus
aatcaagtcccgtttccgcatcagg

SEQ ID NO: 510780 - DNA, 25 bp, Mus musculus
aatcaagtggatcttggcagctaca

SEQ ID NO: 510781 - DNA, 25 bp, Mus musculus
aatcaagtggatgttggcagctaca

SEQ ID NO: 510782 - DNA, 25 bp, Mus musculus
aatcaattcttcatgaattgcaggc

SEQ ID NO: 510783 - DNA, 25 bp, Mus musculus
aatcaattcttcttgaattgcaggc

SEQ ID NO: 510784 - DNA, 25 bp, Mus musculus
aatcacaccagaagttgggaagcag

SEQ ID NO: 510785 - DNA, 25 bp, Mus musculus
aatcacaccagatgttgggaagcag

SEQ ID NO: 510786 - DNA, 25 bp, Mus musculus
aatcacacgccaccaagcacaagat

SEQ ID NO: 510787 - DNA, 25 bp, Mus musculus
aatcacacgccagcaagcacaagat

SEQ ID NO: 510788 - DNA, 25 bp, Mus musculus
aatcacacggagaaccatggctgcc

SEQ ID NO: 510789 - DNA, 25 bp, Mus musculus
aatcacacggagtaccatggctgcc

SEQ ID NO: 510790 - DNA, 25 bp, Mus musculus
aatcacagctgtcgccgtggagtct

SEQ ID NO: 510791 - DNA, 25 bp, Mus musculus
aatcacagctgtggccgtggagtct

SEQ ID NO: 510792 - DNA, 25 bp, Mus musculus
aatcacaggccgatgactgcggtgg

SEQ ID NO: 510793 - DNA, 25 bp, Mus musculus
aatcacaggccgttgactgcggtgg

SEQ ID NO: 510794 - DNA, 25 bp, Mus musculus
aatcacagtggacatcgggacaccg

SEQ ID NO: 510795 - DNA, 25 bp, Mus musculus
aatcacagtggagatcgggacaccg

SEQ ID NO: 510796 - DNA, 25 bp, Mus musculus
aatcacatgatgctaaagatagctg

SEQ ID NO: 510797 - DNA, 25 bp, Mus musculus
aatcacatgatggtaaagatagctg

SEQ ID NO: 510798 - DNA, 25 bp, Mus musculus
aatcaccacggcctactatcgcgga

SEQ ID NO: 510799 - DNA, 25 bp, Mus musculus
aatcaccacggcgtactatcgcgga

SEQ ID NO: 510800 - DNA, 25 bp, Mus musculus
aatcaccagaacaattaccagccct

SEQ ID NO: 510801 - DNA, 25 bp, Mus musculus
aatcaccagaactattaccagccct

SEQ ID NO: 510802 - DNA, 25 bp, Mus musculus
aatcacctgctgatcaatatgttgc

SEQ ID NO: 510803 - DNA, 25 bp, Mus musculus
aatcacctgctgttcaatatgttgc

SEQ ID NO: 510804 - DNA, 25 bp, Mus musculus
aatcacctggataggcagcctctga

SEQ ID NO: 510805 - DNA, 25 bp, Mus musculus
aatcacctggattggcagcctctga

SEQ ID NO: 510806 - DNA, 25 bp, Mus musculus
aatcacgaccctcgcacgaggcgag

SEQ ID NO: 510807 - DNA, 25 bp, Mus musculus
aatcacgaccctggcacgaggcgag

SEQ ID NO: 510808 - DNA, 25 bp, Mus musculus
aatcacgatgcacggcctgacggtg

SEQ ID NO: 510809 - DNA, 25 bp, Mus musculus
aatcacgatgcagggcctgacggtg

SEQ ID NO: 510810 - DNA, 25 bp, Mus musculus
aatcactcgaatccggatgagaccc

SEQ ID NO: 510811 - DNA, 25 bp, Mus musculus
aatcactcgaatgcggatgagaccc

SEQ ID NO: 510812 - DNA, 25 bp, Mus musculus
aatcactgatcgaactggtgtgtcg

SEQ ID NO: 510813 - DNA, 25 bp, Mus musculus
aatcactgatcgtactggtgtgtcg

SEQ ID NO: 510814 - DNA, 25 bp, Mus musculus
aatcactgtcaacttgaaggcaaag

SEQ ID NO: 510815 - DNA, 25 bp, Mus musculus
aatcactgtcaagttgaaggcaaag

SEQ ID NO: 510816 - DNA, 25 bp, Mus musculus
aatcactgtgaacgaaaagattcca

SEQ ID NO: 510817 - DNA, 25 bp, Mus musculus
aatcactgtgaaggaaaagattcca

SEQ ID NO: 510818 - DNA, 25 bp, Mus musculus
aatcacttctcgcacaatgaggcag

SEQ ID NO: 510819 - DNA, 25 bp, Mus musculus
aatcacttctcggacaatgaggcag

SEQ ID NO: 510820 - DNA, 25 bp, Mus musculus
aatcagaaaggactcatcacactgt

SEQ ID NO: 510821 - DNA, 25 bp, Mus musculus
aatcagaaaggagtcatcacactgt

SEQ ID NO: 510822 - DNA, 25 bp, Mus musculus
aatcagaaccttctgggtaccatcc

SEQ ID NO: 510823 - DNA, 25 bp, Mus musculus
aatcagaaccttgtgggtaccatcc

SEQ ID NO: 510824 - DNA, 25 bp, Mus musculus
aatcagaagtgtacagtgcctgcca

SEQ ID NO: 510825 - DNA, 25 bp, Mus musculus
aatcagaagtgttcagtgcctgcca

SEQ ID NO: 510826 - DNA, 25 bp, Mus musculus
aatcagacaataatgaaggttcatc

SEQ ID NO: 510827 - DNA, 25 bp, Mus musculus
aatcagacaatattgaaggttcatc

SEQ ID NO: 510828 - DNA, 25 bp, Mus musculus
aatcagacgggacgctacagtgacg

SEQ ID NO: 510829 - DNA, 25 bp, Mus musculus
aatcagacgggaggctacagtgacg

SEQ ID NO: 510830 - DNA, 25 bp, Mus musculus
aatcagacttctatacccagcaacg

SEQ ID NO: 510831 - DNA, 25 bp, Mus musculus
aatcagacttctttacccagcaacg

SEQ ID NO: 510832 - DNA, 25 bp, Mus musculus
aatcagacttggatttctgcccaga

SEQ ID NO: 510833 - DNA, 25 bp, Mus musculus
aatcagacttggttttctgcccaga

SEQ ID NO: 510834 - DNA, 25 bp, Mus musculus
aatcagagacatagatgcagcaacg

SEQ ID NO: 510835 - DNA, 25 bp, Mus musculus
aatcagagacattgatgcagcaacg

SEQ ID NO: 510836 - DNA, 25 bp, Mus musculus
aatcagagcgaaccccacattcgtg

SEQ ID NO: 510837 - DNA, 25 bp, Mus musculus
aatcagagcgaagcccacattcgtg

SEQ ID NO: 510838 - DNA, 25 bp, Mus musculus
aatcagagcttaagcatctgtgtgc

SEQ ID NO: 510839 - DNA, 25 bp, Mus musculus
aatcagagcttatgcatctgtgtgc

SEQ ID NO: 510840 - DNA, 25 bp, Mus musculus
aatcagaggctaacattcgtaaact

SEQ ID NO: 510841 - DNA, 25 bp, Mus musculus
aatcagaggctatcattcgtaaact

SEQ ID NO: 510842 - DNA, 25 bp, Mus musculus
aatcagatgcagagtgagcattcgg

SEQ ID NO: 510843 - DNA, 25 bp, Mus musculus
aatcagatgcagtgtgagcattcgg

SEQ ID NO: 510844 - DNA, 25 bp, Mus musculus
aatcagattctcagctatggagccg

SEQ ID NO: 510845 - DNA, 25 bp, Mus musculus
aatcagattctctgctatggagccg

SEQ ID NO: 510846 - DNA, 25 bp, Mus musculus
aatcagcaagaaagaaatgcagcct

SEQ ID NO: 510847 - DNA, 25 bp, Mus musculus
aatcagcaagaatgaaatgcagcct

SEQ ID NO: 510848 - DNA, 25 bp, Mus musculus
aatcagcagctgaattccagaagcc

SEQ ID NO: 510849 - DNA, 25 bp, Mus musculus
aatcagcagctgtattccagaagcc

SEQ ID NO: 510850 - DNA, 25 bp, Mus musculus
aatcagccagagaagccaggactgc

SEQ ID NO: 510851 - DNA, 25 bp, Mus musculus
aatcagccagagtagccaggactgc

SEQ ID NO: 510852 - DNA, 25 bp, Mus musculus
aatcagcctgctagggttcctgggc

SEQ ID NO: 510853 - DNA, 25 bp, Mus musculus
aatcagcctgcttgggttcctgggc

SEQ ID NO: 510854 - DNA, 25 bp, Mus musculus
aatcagcctttgctccagcatgtgc

SEQ ID NO: 510855 - DNA, 25 bp, Mus musculus
aatcagcctttggtccagcatgtgc

SEQ ID NO: 510856 - DNA, 25 bp, Mus musculus
aatcagcggatgaagtggccttcat

SEQ ID NO: 510857 - DNA, 25 bp, Mus musculus
aatcagcggatgtagtggccttcat

SEQ ID NO: 510858 - DNA, 25 bp, Mus musculus
aatcagcttggtcgtgtctttgtca

SEQ ID NO: 510859 - DNA, 25 bp, Mus musculus
aatcagcttggtggtgtctttgtca

SEQ ID NO: 510860 - DNA, 25 bp, Mus musculus
aatcaggacgctcagcgtgtgcagc

SEQ ID NO: 510861 - DNA, 25 bp, Mus musculus
aatcaggacgctgagcgtgtgcagc

SEQ ID NO: 510862 - DNA, 25 bp, Mus musculus
aatcaggctgacaggcttctcccgg

SEQ ID NO: 510863 - DNA, 25 bp, Mus musculus
aatcaggctgactggcttctcccgg

SEQ ID NO: 510864 - DNA, 25 bp, Mus musculus
aatcagtcaagcctgcaatgctaag

SEQ ID NO: 510865 - DNA, 25 bp, Mus musculus
aatcagtcaagcgtgcaatgctaag

SEQ ID NO: 510866 - DNA, 25 bp, Mus musculus
aatcagtccaggcagccatggagaa

SEQ ID NO: 510867 - DNA, 25 bp, Mus musculus
aatcagtccagggagccatggagaa

SEQ ID NO: 510868 - DNA, 25 bp, Mus musculus
aatcagtcctctatgtaatcaacag

SEQ ID NO: 510869 - DNA, 25 bp, Mus musculus
aatcagtcctctttgtaatcaacag

SEQ ID NO: 510870 - DNA, 25 bp, Mus musculus
aatcagtgatttatgaaccagatgc

SEQ ID NO: 510871 - DNA, 25 bp, Mus musculus
aatcagtgatttttgaaccagatgc

SEQ ID NO: 510872 - DNA, 25 bp, Mus musculus
aatcagtgcttccagcgttctctcg

SEQ ID NO: 510873 - DNA, 25 bp, Mus musculus
aatcagtgcttcgagcgttctctcg

SEQ ID NO: 510874 - DNA, 25 bp, Mus musculus
aatcagttccccatggttcttgccg

SEQ ID NO: 510875 - DNA, 25 bp, Mus musculus
aatcagttccccttggttcttgccg

SEQ ID NO: 510876 - DNA, 25 bp, Mus musculus
aatcatagagatagcagcctgtcac

SEQ ID NO: 510877 - DNA, 25 bp, Mus musculus
aatcatagagattgcagcctgtcac

SEQ ID NO: 510878 - DNA, 25 bp, Mus musculus
aatcatagaggaagcccattacagg

SEQ ID NO: 510879 - DNA, 25 bp, Mus musculus
aatcatagaggatgcccattacagg

SEQ ID NO: 510880 - DNA, 25 bp, Mus musculus
aatcatagagttaataggaaaccgc

SEQ ID NO: 510881 - DNA, 25 bp, Mus musculus
aatcatagagtttataggaaaccgc

SEQ ID NO: 510882 - DNA, 25 bp, Mus musculus
aatcatagtgaaatagaacggcggc

SEQ ID NO: 510883 - DNA, 25 bp, Mus musculus
aatcatagtgaattagaacggcggc

SEQ ID NO: 510884 - DNA, 25 bp, Mus musculus
aatcatatttgtcgactggaaaaag

SEQ ID NO: 510885 - DNA, 25 bp, Mus musculus
aatcatatttgtggactggaaaaag

SEQ ID NO: 510886 - DNA, 25 bp, Mus musculus
aatcatcaccatactcattgacccg

SEQ ID NO: 510887 - DNA, 25 bp, Mus musculus
aatcatcaccattctcattgacccg

SEQ ID NO: 510888 - DNA, 25 bp, Mus musculus
aatcatcactgaaggttccccagaa

SEQ ID NO: 510889 - DNA, 25 bp, Mus musculus
aatcatcactgatggttccccagaa

SEQ ID NO: 510890 - DNA, 25 bp, Mus musculus
aatcatcagcctcaaagctctggag

SEQ ID NO: 510891 - DNA, 25 bp, Mus musculus
aatcatcagcctgaaagctctggag

SEQ ID NO: 510892 - DNA, 25 bp, Mus musculus
aatcatccagcacacttggaacagg

SEQ ID NO: 510893 - DNA, 25 bp, Mus musculus
aatcatccagcagacttggaacagg

SEQ ID NO: 510894 - DNA, 25 bp, Mus musculus
aatcatcccaacaggtaggcgcggc

SEQ ID NO: 510895 - DNA, 25 bp, Mus musculus
aatcatcccaactggtaggcgcggc

SEQ ID NO: 510896 - DNA, 25 bp, Mus musculus
aatcatccgctgagtgcacctggcc

SEQ ID NO: 510897 - DNA, 25 bp, Mus musculus
aatcatccgctgtgtgcacctggcc

SEQ ID NO: 510898 - DNA, 25 bp, Mus musculus
aatcatcgacacacctcagttccag

SEQ ID NO: 510899 - DNA, 25 bp, Mus musculus
aatcatcgacactcctcagttccag

SEQ ID NO: 510900 - DNA, 25 bp, Mus musculus
aatcatcgctacatcgccacaacgt

SEQ ID NO: 510901 - DNA, 25 bp, Mus musculus
aatcatcgctacttcgccacaacgt

SEQ ID NO: 510902 - DNA, 25 bp, Mus musculus
aatcatctgcaccttgtacacgacc

SEQ ID NO: 510903 - DNA, 25 bp, Mus musculus
aatcatctgcacgttgtacacgacc

SEQ ID NO: 510904 - DNA, 25 bp, Mus musculus
aatcatgatgcgctcctgaggttta

SEQ ID NO: 510905 - DNA, 25 bp, Mus musculus
aatcatgatgcggtcctgaggttta

SEQ ID NO: 510906 - DNA, 25 bp, Mus musculus
aatcatgcctgaaatgccggaggcc

SEQ ID NO: 510907 - DNA, 25 bp, Mus musculus
aatcatgcctgatatgccggaggcc

SEQ ID NO: 510908 - DNA, 25 bp, Mus musculus
aatcatgggatgaagagactgcaac

SEQ ID NO: 510909 - DNA, 25 bp, Mus musculus
aatcatgggatgtagagactgcaac

SEQ ID NO: 510910 - DNA, 25 bp, Mus musculus
aatcatgggcatactgcggagccta

SEQ ID NO: 510911 - DNA, 25 bp, Mus musculus
aatcatgggcattctgcggagccta

SEQ ID NO: 510912 - DNA, 25 bp, Mus musculus
aatcatgtccctctctcttcagaac

SEQ ID NO: 510913 - DNA, 25 bp, Mus musculus
aatcatgtccctgtctcttcagaac

SEQ ID NO: 510914 - DNA, 25 bp, Mus musculus
aatcattacaagatcgggagacacg

SEQ ID NO: 510915 - DNA, 25 bp, Mus musculus
aatcattacaagttcgggagacacg

SEQ ID NO: 510916 - DNA, 25 bp, Mus musculus
aatcattcctatctggagtctctga

SEQ ID NO: 510917 - DNA, 25 bp, Mus musculus
aatcattcctatgtggagtctctga

SEQ ID NO: 510918 - DNA, 25 bp, Mus musculus
aatcattcgcacatccctggctgta

SEQ ID NO: 510919 - DNA, 25 bp, Mus musculus
aatcattcgcacttccctggctgta

SEQ ID NO: 510920 - DNA, 25 bp, Mus musculus
aatcattctgctcctcgttgccggg

SEQ ID NO: 510921 - DNA, 25 bp, Mus musculus
aatcattctgctgctcgttgccggg

SEQ ID NO: 510922 - DNA, 25 bp, Mus musculus
aatcatttaatcacataggcaaccc

SEQ ID NO: 510923 - DNA, 25 bp, Mus musculus
aatcatttaatctcataggcaaccc

SEQ ID NO: 510924 - DNA, 25 bp, Mus musculus
aatcattttcgcaggttccctgtaa

SEQ ID NO: 510925 - DNA, 25 bp, Mus musculus
aatcattttcgctggttccctgtaa

SEQ ID NO: 510926 - DNA, 25 bp, Mus musculus
aatccaaaagcgctgaactctccct

SEQ ID NO: 510927 - DNA, 25 bp, Mus musculus
aatccaaaagcggtgaactctccct

SEQ ID NO: 510928 - DNA, 25 bp, Mus musculus
aatccaaacgcgcagtgaatagcct

SEQ ID NO: 510929 - DNA, 25 bp, Mus musculus
aatccaaacgcggagtgaatagcct

SEQ ID NO: 510930 - DNA, 25 bp, Mus musculus
aatccaaaggccattttctcgaggg

SEQ ID NO: 510931 - DNA, 25 bp, Mus musculus
aatccaaaggcctttttctcgaggg

SEQ ID NO: 510932 - DNA, 25 bp, Mus musculus
aatccaaatgaacaggcaggtccaa

SEQ ID NO: 510933 - DNA, 25 bp, Mus musculus
aatccaaatgaagaggcaggtccaa

SEQ ID NO: 510934 - DNA, 25 bp, Mus musculus
aatccaaatgcgcaccaggagaaca

SEQ ID NO: 510935 - DNA, 25 bp, Mus musculus
aatccaaatgcggaccaggagaaca

SEQ ID NO: 510936 - DNA, 25 bp, Mus musculus
aatccacaacccagaacctgaggac

SEQ ID NO: 510937 - DNA, 25 bp, Mus musculus
aatccacaaccctgaacctgaggac

SEQ ID NO: 510938 - DNA, 25 bp, Mus musculus
aatccacatgagcatagtgaagctg

SEQ ID NO: 510939 - DNA, 25 bp, Mus musculus
aatccacatgaggatagtgaagctg

SEQ ID NO: 510940 - DNA, 25 bp, Mus musculus
aatccacattgtcgcctttgcagag

SEQ ID NO: 510941 - DNA, 25 bp, Mus musculus
aatccacattgtggcctttgcagag

SEQ ID NO: 510942 - DNA, 25 bp, Mus musculus
aatccacctaaaaatgaagagccag

SEQ ID NO: 510943 - DNA, 25 bp, Mus musculus
aatccacctaaatatgaagagccag

SEQ ID NO: 510944 - DNA, 25 bp, Mus musculus
aatccacgaagcctacctgaagaac

SEQ ID NO: 510945 - DNA, 25 bp, Mus musculus
aatccacgaagcgtacctgaagaac

SEQ ID NO: 510946 - DNA, 25 bp, Mus musculus
aatccacgtagacagagccgtcaag

SEQ ID NO: 510947 - DNA, 25 bp, Mus musculus
aatccacgtagagagagccgtcaag

SEQ ID NO: 510948 - DNA, 25 bp, Mus musculus
aatccagaggctctttctgagctgt

SEQ ID NO: 510949 - DNA, 25 bp, Mus musculus
aatccagaggctgtttctgagctgt

SEQ ID NO: 510950 - DNA, 25 bp, Mus musculus
aatccagatatgcttgctggagaga

SEQ ID NO: 510951 - DNA, 25 bp, Mus musculus
aatccagatatggttgctggagaga

SEQ ID NO: 510952 - DNA, 25 bp, Mus musculus
aatccagatcccaaagcccggtata

SEQ ID NO: 510953 - DNA, 25 bp, Mus musculus
aatccagatccctaagcccggtata

SEQ ID NO: 510954 - DNA, 25 bp, Mus musculus
aatccagatcttcaggttcatcaag

SEQ ID NO: 510955 - DNA, 25 bp, Mus musculus
aatccagatcttgaggttcatcaag

SEQ ID NO: 510956 - DNA, 25 bp, Mus musculus
aatccagatgtgaatgttttccaga

SEQ ID NO: 510957 - DNA, 25 bp, Mus musculus
aatccagatgtgtatgttttccaga

SEQ ID NO: 510958 - DNA, 25 bp, Mus musculus
aatccagcatcgcaggcacaagtcc

SEQ ID NO: 510959 - DNA, 25 bp, Mus musculus
aatccagcatcggaggcacaagtcc

SEQ ID NO: 510960 - DNA, 25 bp, Mus musculus
aatccaggcagccttcattctttcc

SEQ ID NO: 510961 - DNA, 25 bp, Mus musculus
aatccaggcagcgttcattctttcc

SEQ ID NO: 510962 - DNA, 25 bp, Mus musculus
aatccaggctatatgttaagtccag

SEQ ID NO: 510963 - DNA, 25 bp, Mus musculus
aatccaggctatttgttaagtccag

SEQ ID NO: 510964 - DNA, 25 bp, Mus musculus
aatccagttgtgcttctctgggccg

SEQ ID NO: 510965 - DNA, 25 bp, Mus musculus
aatccagttgtggttctctgggccg

SEQ ID NO: 510966 - DNA, 25 bp, Mus musculus
aatccataccacaataagagagtgg

SEQ ID NO: 510967 - DNA, 25 bp, Mus musculus
aatccataccactataagagagtgg

SEQ ID NO: 510968 - DNA, 25 bp, Mus musculus
aatccatcattgcagctgcatgttc

SEQ ID NO: 510969 - DNA, 25 bp, Mus musculus
aatccatcattggagctgcatgttc

SEQ ID NO: 510970 - DNA, 25 bp, Mus musculus
aatccatgagtacaatcaggacatg

SEQ ID NO: 510971 - DNA, 25 bp, Mus musculus
aatccatgagtagaatcaggacatg

SEQ ID NO: 510972 - DNA, 25 bp, Mus musculus
aatccatttggtaacagccgtctgg

SEQ ID NO: 510973 - DNA, 25 bp, Mus musculus
aatccatttggttacagccgtctgg

SEQ ID NO: 510974 - DNA, 25 bp, Mus musculus
aatcccaggatccacctgctcagaa

SEQ ID NO: 510975 - DNA, 25 bp, Mus musculus
aatcccaggatcgacctgctcagaa

SEQ ID NO: 510976 - DNA, 25 bp, Mus musculus
aatcccatggtcatgtgactccaga

SEQ ID NO: 510977 - DNA, 25 bp, Mus musculus
aatcccatggtcttgtgactccaga

SEQ ID NO: 510978 - DNA, 25 bp, Mus musculus
aatcccattagacaatgcccagtag

SEQ ID NO: 510979 - DNA, 25 bp, Mus musculus
aatcccattagagaatgcccagtag

SEQ ID NO: 510980 - DNA, 25 bp, Mus musculus
aatcccattctcagaagaactccgc

SEQ ID NO: 510981 - DNA, 25 bp, Mus musculus
aatcccattctctgaagaactccgc

SEQ ID NO: 510982 - DNA, 25 bp, Mus musculus
aatccccatcatcatgaactggcac

SEQ ID NO: 510983 - DNA, 25 bp, Mus musculus
aatccccatcatgatgaactggcac

SEQ ID NO: 510984 - DNA, 25 bp, Mus musculus
aatccccatttccaaagcccatgaa

SEQ ID NO: 510985 - DNA, 25 bp, Mus musculus
aatccccatttcgaaagcccatgaa

SEQ ID NO: 510986 - DNA, 25 bp, Mus musculus
aatccccgaagaagatgggaatgac

SEQ ID NO: 510987 - DNA, 25 bp, Mus musculus
aatccccgaagatgatgggaatgac

SEQ ID NO: 510988 - DNA, 25 bp, Mus musculus
aatccccgacttcggatgacatctc

SEQ ID NO: 510989 - DNA, 25 bp, Mus musculus
aatccccgacttgggatgacatctc

SEQ ID NO: 510990 - DNA, 25 bp, Mus musculus
aatcccctggatctgaggagagtga

SEQ ID NO: 510991 - DNA, 25 bp, Mus musculus
aatcccctggatgtgaggagagtga

SEQ ID NO: 510992 - DNA, 25 bp, Mus musculus
aatcccggctgcaggtgtgccgaaa

SEQ ID NO: 510993 - DNA, 25 bp, Mus musculus
aatcccggctgctggtgtgccgaaa

SEQ ID NO: 510994 - DNA, 25 bp, Mus musculus
aatccctatgtaaaaaattgctacc

SEQ ID NO: 510995 - DNA, 25 bp, Mus musculus
aatccctatgtataaaattgctacc

SEQ ID NO: 510996 - DNA, 25 bp, Mus musculus
aatccctcaaagagaagcctccaag

SEQ ID NO: 510997 - DNA, 25 bp, Mus musculus
aatccctcaaagtgaagcctccaag

SEQ ID NO: 510998 - DNA, 25 bp, Mus musculus
aatccctcgagaatccctgcagttg

SEQ ID NO: 510999 - DNA, 25 bp, Mus musculus
aatccctcgagattccctgcagttg

SEQ ID NO: 511000 - DNA, 25 bp, Mus musculus
aatccctctagaccagtgccagggc

SEQ ID NO: 511001 - DNA, 25 bp, Mus musculus
aatccctctagagcagtgccagggc

SEQ ID NO: 511002 - DNA, 25 bp, Mus musculus
aatccctctgcgcaagttcacatct

SEQ ID NO: 511003 - DNA, 25 bp, Mus musculus
aatccctctgcggaagttcacatct

SEQ ID NO: 511004 - DNA, 25 bp, Mus musculus
aatccctgaggactacgagagtcac

SEQ ID NO: 511005 - DNA, 25 bp, Mus musculus
aatccctgaggagtacgagagtcac

SEQ ID NO: 511006 - DNA, 25 bp, Mus musculus
aatccctggagcagtctggttctct

SEQ ID NO: 511007 - DNA, 25 bp, Mus musculus
aatccctggagctgtctggttctct

SEQ ID NO: 511008 - DNA, 25 bp, Mus musculus
aatccctgggttagcgactgctaca

SEQ ID NO: 511009 - DNA, 25 bp, Mus musculus
aatccctgggtttgcgactgctaca

SEQ ID NO: 511010 - DNA, 25 bp, Mus musculus
aatccctgtggaaagtatatggtaa

SEQ ID NO: 511011 - DNA, 25 bp, Mus musculus
aatccctgtggatagtatatggtaa

SEQ ID NO: 511012 - DNA, 25 bp, Mus musculus
aatcccttgtagacccattcctgtg

SEQ ID NO: 511013 - DNA, 25 bp, Mus musculus
aatcccttgtagtcccattcctgtg

SEQ ID NO: 511014 - DNA, 25 bp, Mus musculus
aatccgacagcgaataaaccacttg

SEQ ID NO: 511015 - DNA, 25 bp, Mus musculus
aatccgacagcgtataaaccacttg

SEQ ID NO: 511016 - DNA, 25 bp, Mus musculus
aatccgccaagaaagtcaggaacaa

SEQ ID NO: 511017 - DNA, 25 bp, Mus musculus
aatccgccaagatagtcaggaacaa

SEQ ID NO: 511018 - DNA, 25 bp, Mus musculus
aatccgcgtgtgagttcatctccac

SEQ ID NO: 511019 - DNA, 25 bp, Mus musculus
aatccgcgtgtgtgttcatctccac

SEQ ID NO: 511020 - DNA, 25 bp, Mus musculus
aatccggctgctcggacggcgagtt

SEQ ID NO: 511021 - DNA, 25 bp, Mus musculus
aatccggctgctgggacggcgagtt

SEQ ID NO: 511022 - DNA, 25 bp, Mus musculus
aatccgggaagaccactattgtcaa

SEQ ID NO: 511023 - DNA, 25 bp, Mus musculus
aatccgggaagagcactattgtcaa

SEQ ID NO: 511024 - DNA, 25 bp, Mus musculus
aatccgtcgaagcagcacaacaggt

SEQ ID NO: 511025 - DNA, 25 bp, Mus musculus
aatccgtcgaaggagcacaacaggt

SEQ ID NO: 511026 - DNA, 25 bp, Mus musculus
aatccgtgaggtatcatcactacaa

SEQ ID NO: 511027 - DNA, 25 bp, Mus musculus
aatccgtgaggtttcatcactacaa

SEQ ID NO: 511028 - DNA, 25 bp, Mus musculus
aatccgttcgccaggcaactaagcg

SEQ ID NO: 511029 - DNA, 25 bp, Mus musculus
aatccgttcgcctggcaactaagcg

SEQ ID NO: 511030 - DNA, 25 bp, Mus musculus
aatcctagagccatgcaggcgctgc

SEQ ID NO: 511031 - DNA, 25 bp, Mus musculus
aatcctagagccttgcaggcgctgc

SEQ ID NO: 511032 - DNA, 25 bp, Mus musculus
aatcctagggtgaatacttattttg

SEQ ID NO: 511033 - DNA, 25 bp, Mus musculus
aatcctagggtgtatacttattttg

SEQ ID NO: 511034 - DNA, 25 bp, Mus musculus
aatcctatgactccaaacatgtcaa

SEQ ID NO: 511035 - DNA, 25 bp, Mus musculus
aatcctatgactgcaaacatgtcaa

SEQ ID NO: 511036 - DNA, 25 bp, Mus musculus
aatcctatgcctattcaattgtagc

SEQ ID NO: 511037 - DNA, 25 bp, Mus musculus
aatcctatgccttttcaattgtagc

SEQ ID NO: 511038 - DNA, 25 bp, Mus musculus
aatcctatggtgcaagaagctatac

SEQ ID NO: 511039 - DNA, 25 bp, Mus musculus
aatcctatggtggaagaagctatac

SEQ ID NO: 511040 - DNA, 25 bp, Mus musculus
aatcctcacagtacttatggcagca

SEQ ID NO: 511041 - DNA, 25 bp, Mus musculus
aatcctcacagttcttatggcagca

SEQ ID NO: 511042 - DNA, 25 bp, Mus musculus
aatcctcactaacgcagtgggaaag

SEQ ID NO: 511043 - DNA, 25 bp, Mus musculus
aatcctcactaaggcagtgggaaag

SEQ ID NO: 511044 - DNA, 25 bp, Mus musculus
aatcctccagaacgaatcgtggcag

SEQ ID NO: 511045 - DNA, 25 bp, Mus musculus
aatcctccagaaggaatcgtggcag

SEQ ID NO: 511046 - DNA, 25 bp, Mus musculus
aatcctccatagcaatggcctgtag

SEQ ID NO: 511047 - DNA, 25 bp, Mus musculus
aatcctccataggaatggcctgtag

SEQ ID NO: 511048 - DNA, 25 bp, Mus musculus
aatcctccctaccagtttgagctcg

SEQ ID NO: 511049 - DNA, 25 bp, Mus musculus
aatcctccctacgagtttgagctcg

SEQ ID NO: 511050 - DNA, 25 bp, Mus musculus
aatcctcctcttcaagtcgggctag

SEQ ID NO: 511051 - DNA, 25 bp, Mus musculus
aatcctcctcttgaagtcgggctag

SEQ ID NO: 511052 - DNA, 25 bp, Mus musculus
aatcctcgacttcggactggccagg

SEQ ID NO: 511053 - DNA, 25 bp, Mus musculus
aatcctcgacttgggactggccagg

SEQ ID NO: 511054 - DNA, 25 bp, Mus musculus
aatcctctgcggcttgggagccgca

SEQ ID NO: 511055 - DNA, 25 bp, Mus musculus
aatcctctgcgggttgggagccgca

SEQ ID NO: 511056 - DNA, 25 bp, Mus musculus
aatcctctgggtcgtgacagctctc

SEQ ID NO: 511057 - DNA, 25 bp, Mus musculus
aatcctctgggtggtgacagctctc

SEQ ID NO: 511058 - DNA, 25 bp, Mus musculus
aatcctcttcatcggctgcattacg

SEQ ID NO: 511059 - DNA, 25 bp, Mus musculus
aatcctcttcatgggctgcattacg

SEQ ID NO: 511060 - DNA, 25 bp, Mus musculus
aatcctgaaggacggcccaactggg

SEQ ID NO: 511061 - DNA, 25 bp, Mus musculus
aatcctgaaggagggcccaactggg

SEQ ID NO: 511062 - DNA, 25 bp, Mus musculus
aatcctgacacccactggcactgtg

SEQ ID NO: 511063 - DNA, 25 bp, Mus musculus
aatcctgacaccgactggcactgtg

SEQ ID NO: 511064 - DNA, 25 bp, Mus musculus
aatcctgatgctaccctgaggcacc

SEQ ID NO: 511065 - DNA, 25 bp, Mus musculus
aatcctgatgctctatatgaagacc

SEQ ID NO: 511066 - DNA, 25 bp, Mus musculus
aatcctgatgctgtatatgaagacc

SEQ ID NO: 511067 - DNA, 25 bp, Mus musculus
aatcctgatgcttccctgaggcacc

SEQ ID NO: 511068 - DNA, 25 bp, Mus musculus
aatcctgcagggaggagagcagcac

SEQ ID NO: 511069 - DNA, 25 bp, Mus musculus
aatcctgcagggtggagagcagcac

SEQ ID NO: 511070 - DNA, 25 bp, Mus musculus
aatcctgcccctagttcctcattag

SEQ ID NO: 511071 - DNA, 25 bp, Mus musculus
aatcctgccccttgttcctcattag

SEQ ID NO: 511072 - DNA, 25 bp, Mus musculus
aatcctgctgacattctggttatcg

SEQ ID NO: 511073 - DNA, 25 bp, Mus musculus
aatcctgctgactttctggttatcg

SEQ ID NO: 511074 - DNA, 25 bp, Mus musculus
aatcctggaatgagggtctccttgc

SEQ ID NO: 511075 - DNA, 25 bp, Mus musculus
aatcctggaatgtgggtctccttgc

SEQ ID NO: 511076 - DNA, 25 bp, Mus musculus
aatcctggaccgcatgcgctccttt

SEQ ID NO: 511077 - DNA, 25 bp, Mus musculus
aatcctggaccggatgcgctccttt

SEQ ID NO: 511078 - DNA, 25 bp, Mus musculus
aatcctggcttcatctacgagagaa

SEQ ID NO: 511079 - DNA, 25 bp, Mus musculus
aatcctggcttcttctacgagagaa

SEQ ID NO: 511080 - DNA, 25 bp, Mus musculus
aatcctgggcagagcttcgagatcc

SEQ ID NO: 511081 - DNA, 25 bp, Mus musculus
aatcctgggcagtgcttcgagatcc

SEQ ID NO: 511082 - DNA, 25 bp, Mus musculus
aatcctgtccatccacttgtctcta

SEQ ID NO: 511083 - DNA, 25 bp, Mus musculus
aatcctgtccatgcacttgtctcta

SEQ ID NO: 511084 - DNA, 25 bp, Mus musculus
aatcctgtggcgaaggcagtgtgaa

SEQ ID NO: 511085 - DNA, 25 bp, Mus musculus
aatcctgtggcgtaggcagtgtgaa

SEQ ID NO: 511086 - DNA, 25 bp, Mus musculus
aatccttacaacaatggctgcttgg

SEQ ID NO: 511087 - DNA, 25 bp, Mus musculus
aatccttacaactatggctgcttgg

SEQ ID NO: 511088 - DNA, 25 bp, Mus musculus
aatccttaccacaatcagagagtag

SEQ ID NO: 511089 - DNA, 25 bp, Mus musculus
aatccttaccactatcagagagtag

SEQ ID NO: 511090 - DNA, 25 bp, Mus musculus
aatccttcaacgctgtacaagattg

SEQ ID NO: 511091 - DNA, 25 bp, Mus musculus
aatccttcaacggtgtacaagattg

SEQ ID NO: 511092 - DNA, 25 bp, Mus musculus
aatccttcggaacggcagaggtcag

SEQ ID NO: 511093 - DNA, 25 bp, Mus musculus
aatccttcggaagggcagaggtcag

SEQ ID NO: 511094 - DNA, 25 bp, Mus musculus
aatccttgtcgtatctgggagatga

SEQ ID NO: 511095 - DNA, 25 bp, Mus musculus
aatccttgtcgtttctgggagatga

SEQ ID NO: 511096 - DNA, 25 bp, Mus musculus
aatccttgtggtaaatgctgcctac

SEQ ID NO: 511097 - DNA, 25 bp, Mus musculus
aatccttgtggttaatgctgcctac

SEQ ID NO: 511098 - DNA, 25 bp, Mus musculus
aatcgaataatacagcagcccggga

SEQ ID NO: 511099 - DNA, 25 bp, Mus musculus
aatcgaataatagagcagcccggga

SEQ ID NO: 511100 - DNA, 25 bp, Mus musculus
aatcgacatgcaaaataagccaatc

SEQ ID NO: 511101 - DNA, 25 bp, Mus musculus
aatcgacatgcataataagccaatc

SEQ ID NO: 511102 - DNA, 25 bp, Mus musculus
aatcgaccttccacctacacataag

SEQ ID NO: 511103 - DNA, 25 bp, Mus musculus
aatcgaccttcctcctacacataag

SEQ ID NO: 511104 - DNA, 25 bp, Mus musculus
aatcgacgacgtcaccccgatgaag

SEQ ID NO: 511105 - DNA, 25 bp, Mus musculus
aatcgacgacgtgaccccgatgaag

SEQ ID NO: 511106 - DNA, 25 bp, Mus musculus
aatcgactggttcgtggaagttgcc

SEQ ID NO: 511107 - DNA, 25 bp, Mus musculus
aatcgactggttggtggaagttgcc

SEQ ID NO: 511108 - DNA, 25 bp, Mus musculus
aatcgagacctgatgtgcagcgggc

SEQ ID NO: 511109 - DNA, 25 bp, Mus musculus
aatcgagacctgttgtgcagcgggc

SEQ ID NO: 511110 - DNA, 25 bp, Mus musculus
aatcgagcagagacacgcggcatag

SEQ ID NO: 511111 - DNA, 25 bp, Mus musculus
aatcgagcagagcatcttgggacat

SEQ ID NO: 511112 - DNA, 25 bp, Mus musculus
aatcgagcagaggatcttgggacat

SEQ ID NO: 511113 - DNA, 25 bp, Mus musculus
aatcgagcagagtcacgcggcatag

SEQ ID NO: 511114 - DNA, 25 bp, Mus musculus
aatcgagggcgcactggacactgtg

SEQ ID NO: 511115 - DNA, 25 bp, Mus musculus
aatcgagggcgctctggacactgtg

SEQ ID NO: 511116 - DNA, 25 bp, Mus musculus
aatcgataatgccagagaactccaa

SEQ ID NO: 511117 - DNA, 25 bp, Mus musculus
aatcgataatgcgagagaactccaa

SEQ ID NO: 511118 - DNA, 25 bp, Mus musculus
aatcgatgccatctgcaagcagaga

SEQ ID NO: 511119 - DNA, 25 bp, Mus musculus
aatcgatgccatgtgcaagcagaga

SEQ ID NO: 511120 - DNA, 25 bp, Mus musculus
aatcgcacgtccacaccggtgcgga

SEQ ID NO: 511121 - DNA, 25 bp, Mus musculus
aatcgcacgtcctcaccggtgcgga

SEQ ID NO: 511122 - DNA, 25 bp, Mus musculus
aatcgcaggattagagccgtttttc

SEQ ID NO: 511123 - DNA, 25 bp, Mus musculus
aatcgcaggatttgagccgtttttc

SEQ ID NO: 511124 - DNA, 25 bp, Mus musculus
aatcgcatgcaccagtctttgcatc

SEQ ID NO: 511125 - DNA, 25 bp, Mus musculus
aatcgcatgcacgagtctttgcatc

SEQ ID NO: 511126 - DNA, 25 bp, Mus musculus
aatcgccacaggagagtgcgggcca

SEQ ID NO: 511127 - DNA, 25 bp, Mus musculus
aatcgccacaggtgagtgcgggcca

SEQ ID NO: 511128 - DNA, 25 bp, Mus musculus
aatcgccagccgcttatgaatcaga

SEQ ID NO: 511129 - DNA, 25 bp, Mus musculus
aatcgccagccggttatgaatcaga

SEQ ID NO: 511130 - DNA, 25 bp, Mus musculus
aatcgccgagagagagctgagctaa

SEQ ID NO: 511131 - DNA, 25 bp, Mus musculus
aatcgccgagagtgagctgagctaa

SEQ ID NO: 511132 - DNA, 25 bp, Mus musculus
aatcgccttcggacccagacagtta

SEQ ID NO: 511133 - DNA, 25 bp, Mus musculus
aatcgccttcggtcccagacagtta

SEQ ID NO: 511134 - DNA, 25 bp, Mus musculus
aatcgcgccgaacccaggtgggcta

SEQ ID NO: 511135 - DNA, 25 bp, Mus musculus
aatcgcgccgaagccaggtgggcta

SEQ ID NO: 511136 - DNA, 25 bp, Mus musculus
aatcgctaccatctgctgctctgcg

SEQ ID NO: 511137 - DNA, 25 bp, Mus musculus
aatcgctaccatgtgctgctctgcg

SEQ ID NO: 511138 - DNA, 25 bp, Mus musculus
aatcgctacttgacattggaccaag

SEQ ID NO: 511139 - DNA, 25 bp, Mus musculus
aatcgctacttgtcattggaccaag

SEQ ID NO: 511140 - DNA, 25 bp, Mus musculus
aatcgctgggcgaattgcagaattc

SEQ ID NO: 511141 - DNA, 25 bp, Mus musculus
aatcgctgggcgtattgcagaattc

SEQ ID NO: 511142 - DNA, 25 bp, Mus musculus
aatcgctgtacaaccacctgcggcg

SEQ ID NO: 511143 - DNA, 25 bp, Mus musculus
aatcgctgtacatccacctgcggcg

SEQ ID NO: 511144 - DNA, 25 bp, Mus musculus
aatcgctgtgctctcggctccgagt

SEQ ID NO: 511145 - DNA, 25 bp, Mus musculus
aatcgctgtgctgtcggctccgagt

SEQ ID NO: 511146 - DNA, 25 bp, Mus musculus
aatcggaaaagcaaaggacttcagc

SEQ ID NO: 511147 - DNA, 25 bp, Mus musculus
aatcggaaaagctaaggacttcagc

SEQ ID NO: 511148 - DNA, 25 bp, Mus musculus
aatcggagccccaggagttgaagaa

SEQ ID NO: 511149 - DNA, 25 bp, Mus musculus
aatcggagcccctggagttgaagaa

SEQ ID NO: 511150 - DNA, 25 bp, Mus musculus
aatcggaggttcaggatgtggacac

SEQ ID NO: 511151 - DNA, 25 bp, Mus musculus
aatcggaggttctggatgtggacac

SEQ ID NO: 511152 - DNA, 25 bp, Mus musculus
aatcggcccttaccagaaactatcg

SEQ ID NO: 511153 - DNA, 25 bp, Mus musculus
aatcggcccttagcagaaactatcg

SEQ ID NO: 511154 - DNA, 25 bp, Mus musculus
aatcggctgggtaccgggctagctc

SEQ ID NO: 511155 - DNA, 25 bp, Mus musculus
aatcggctgggttccgggctagctc

SEQ ID NO: 511156 - DNA, 25 bp, Mus musculus
aatcggctgtcacaggtgcaggcct

SEQ ID NO: 511157 - DNA, 25 bp, Mus musculus
aatcggctgtcagaggtgcaggcct

SEQ ID NO: 511158 - DNA, 25 bp, Mus musculus
aatcgggagaagagctaagtcatac

SEQ ID NO: 511159 - DNA, 25 bp, Mus musculus
aatcgggagaagtgctaagtcatac

SEQ ID NO: 511160 - DNA, 25 bp, Mus musculus
aatcgggcagagcttccaaccaggt

SEQ ID NO: 511161 - DNA, 25 bp, Mus musculus
aatcgggcagaggttccaaccaggt

SEQ ID NO: 511162 - DNA, 25 bp, Mus musculus
aatcgggcattcagctgcttttttc

SEQ ID NO: 511163 - DNA, 25 bp, Mus musculus
aatcgggcattctgctgcttttttc

SEQ ID NO: 511164 - DNA, 25 bp, Mus musculus
aatcgggccttcctggctcagctgc

SEQ ID NO: 511165 - DNA, 25 bp, Mus musculus
aatcgggccttcgtggctcagctgc

SEQ ID NO: 511166 - DNA, 25 bp, Mus musculus
aatcgggttgagattaacgacgtgg

SEQ ID NO: 511167 - DNA, 25 bp, Mus musculus
aatcgggttgagtttaacgacgtgg

SEQ ID NO: 511168 - DNA, 25 bp, Mus musculus
aatcggtgtggaccagctggcctac

SEQ ID NO: 511169 - DNA, 25 bp, Mus musculus
aatcggtgtggagcagctggcctac

SEQ ID NO: 511170 - DNA, 25 bp, Mus musculus
aatcgtccctctctatggagctgtg

SEQ ID NO: 511171 - DNA, 25 bp, Mus musculus
aatcgtccctctgtatggagctgtg

SEQ ID NO: 511172 - DNA, 25 bp, Mus musculus
aatcgtgacgacatctcggactttc

SEQ ID NO: 511173 - DNA, 25 bp, Mus musculus
aatcgtgacgacttctcggactttc

SEQ ID NO: 511174 - DNA, 25 bp, Mus musculus
aatcgtgtcctcagctggcaaattc

SEQ ID NO: 511175 - DNA, 25 bp, Mus musculus
aatcgtgtcctctgctggcaaattc

SEQ ID NO: 511176 - DNA, 25 bp, Mus musculus
aatcgtgtctttcatgatttccgaa

SEQ ID NO: 511177 - DNA, 25 bp, Mus musculus
aatcgtgtctttgatgatttccgaa

SEQ ID NO: 511178 - DNA, 25 bp, Mus musculus
aatcgttcaattcgagcagcagcta

SEQ ID NO: 511179 - DNA, 25 bp, Mus musculus
aatcgttcaattggagcagcagcta

SEQ ID NO: 511180 - DNA, 25 bp, Mus musculus
aatcgttcccgaagcgccgcgcgtg

SEQ ID NO: 511181 - DNA, 25 bp, Mus musculus
aatcgttcccgatgcgccgcgcgtg

SEQ ID NO: 511182 - DNA, 25 bp, Mus musculus
aatcgttggatcctttggtgtggac

SEQ ID NO: 511183 - DNA, 25 bp, Mus musculus
aatcgttggatcgtttggtgtggac

SEQ ID NO: 511184 - DNA, 25 bp, Mus musculus
aatctaaaacatagagccctggtga

SEQ ID NO: 511185 - DNA, 25 bp, Mus musculus
aatctaaaacattgagccctggtga

SEQ ID NO: 511186 - DNA, 25 bp, Mus musculus
aatctaaaagcaaggatgccatcag

SEQ ID NO: 511187 - DNA, 25 bp, Mus musculus
aatctaaaagcatggatgccatcag

SEQ ID NO: 511188 - DNA, 25 bp, Mus musculus
aatctaaaaggcatagactccagcc

SEQ ID NO: 511189 - DNA, 25 bp, Mus musculus
aatctaaaaggcttagactccagcc

SEQ ID NO: 511190 - DNA, 25 bp, Mus musculus
aatctaaacaatccatctagaagcc

SEQ ID NO: 511191 - DNA, 25 bp, Mus musculus
aatctaaacaatgcatctagaagcc

SEQ ID NO: 511192 - DNA, 25 bp, Mus musculus
aatctaacaatgataggagccatgc

SEQ ID NO: 511193 - DNA, 25 bp, Mus musculus
aatctaacaatgttaggagccatgc

SEQ ID NO: 511194 - DNA, 25 bp, Mus musculus
aatctaacatcaaggcctcgctggc

SEQ ID NO: 511195 - DNA, 25 bp, Mus musculus
aatctaacatcatggcctcgctggc

SEQ ID NO: 511196 - DNA, 25 bp, Mus musculus
aatctaaggaagaagatgaagtgac

SEQ ID NO: 511197 - DNA, 25 bp, Mus musculus
aatctaaggaagtagatgaagtgac

SEQ ID NO: 511198 - DNA, 25 bp, Mus musculus
aatctaaggttcctcacagtgggcc

SEQ ID NO: 511199 - DNA, 25 bp, Mus musculus
aatctaaggttcgtcacagtgggcc

SEQ ID NO: 511200 - DNA, 25 bp, Mus musculus
aatctacagagcattcagttcaggg

SEQ ID NO: 511201 - DNA, 25 bp, Mus musculus
aatctacagagctttcagttcaggg

SEQ ID NO: 511202 - DNA, 25 bp, Mus musculus
aatctacagcacaggtcggatggaa

SEQ ID NO: 511203 - DNA, 25 bp, Mus musculus
aatctacagcactggtcggatggaa

SEQ ID NO: 511204 - DNA, 25 bp, Mus musculus
aatctacagcgtcgactggagccgg

SEQ ID NO: 511205 - DNA, 25 bp, Mus musculus
aatctacagcgtggactggagccgg

SEQ ID NO: 511206 - DNA, 25 bp, Mus musculus
aatctaccaacacgcgttcccttat

SEQ ID NO: 511207 - DNA, 25 bp, Mus musculus
aatctaccaacaggcgttcccttat

SEQ ID NO: 511208 - DNA, 25 bp, Mus musculus
aatctacgaccgacgggagtacagg

SEQ ID NO: 511209 - DNA, 25 bp, Mus musculus
aatctacgaccgtcgggagtacagg

SEQ ID NO: 511210 - DNA, 25 bp, Mus musculus
aatctacgtgatcgtcactgacaag

SEQ ID NO: 511211 - DNA, 25 bp, Mus musculus
aatctacgtgatggtcactgacaag

SEQ ID NO: 511212 - DNA, 25 bp, Mus musculus
aatctactccctcaaggcaaaatga

SEQ ID NO: 511213 - DNA, 25 bp, Mus musculus
aatctactccctgaaggcaaaatga

SEQ ID NO: 511214 - DNA, 25 bp, Mus musculus
aatctactctgacttccgtgagatt

SEQ ID NO: 511215 - DNA, 25 bp, Mus musculus
aatctactctgagttccgtgagatt

SEQ ID NO: 511216 - DNA, 25 bp, Mus musculus
aatctactgttgatggtgtctggca

SEQ ID NO: 511217 - DNA, 25 bp, Mus musculus
aatctactgttgttggtgtctggca

SEQ ID NO: 511218 - DNA, 25 bp, Mus musculus
aatctagacggcacgtgcagcagca

SEQ ID NO: 511219 - DNA, 25 bp, Mus musculus
aatctagacggctcgtgcagcagca

SEQ ID NO: 511220 - DNA, 25 bp, Mus musculus
aatctaggcctaccaagcggagcga

SEQ ID NO: 511221 - DNA, 25 bp, Mus musculus
aatctaggcctagcaagcggagcga

SEQ ID NO: 511222 - DNA, 25 bp, Mus musculus
aatctatcacacagaactggagaaa

SEQ ID NO: 511223 - DNA, 25 bp, Mus musculus
aatctatcacactgaactggagaaa

SEQ ID NO: 511224 - DNA, 25 bp, Mus musculus
aatctatcactgatgtccatctgaa

SEQ ID NO: 511225 - DNA, 25 bp, Mus musculus
aatctatcactgttgtccatctgaa

SEQ ID NO: 511226 - DNA, 25 bp, Mus musculus
aatctatcgttcaccggtcttctga

SEQ ID NO: 511227 - DNA, 25 bp, Mus musculus
aatctatcgttctccggtcttctga

SEQ ID NO: 511228 - DNA, 25 bp, Mus musculus
aatctatctcttacgcgtccggtgg

SEQ ID NO: 511229 - DNA, 25 bp, Mus musculus
aatctatctctttcgcgtccggtgg

SEQ ID NO: 511230 - DNA, 25 bp, Mus musculus
aatctatctgtcacatctcctcttg

SEQ ID NO: 511231 - DNA, 25 bp, Mus musculus
aatctatctgtctcatctcctcttg

SEQ ID NO: 511232 - DNA, 25 bp, Mus musculus
aatctatgcagaagaccctgacaat

SEQ ID NO: 511233 - DNA, 25 bp, Mus musculus
aatctatgcagatgaccctgacaat

SEQ ID NO: 511234 - DNA, 25 bp, Mus musculus
aatctatgggcaatgctcagattca

SEQ ID NO: 511235 - DNA, 25 bp, Mus musculus
aatctatgggcattgctcagattca

SEQ ID NO: 511236 - DNA, 25 bp, Mus musculus
aatctcaaagtcagctgggagaaag

SEQ ID NO: 511237 - DNA, 25 bp, Mus musculus
aatctcaaagtctgctgggagaaag

SEQ ID NO: 511238 - DNA, 25 bp, Mus musculus
aatctcacacgcagcagtggatgta

SEQ ID NO: 511239 - DNA, 25 bp, Mus musculus
aatctcacacgctgcagtggatgta

SEQ ID NO: 511240 - DNA, 25 bp, Mus musculus
aatctcacaggaagcggtacacagg

SEQ ID NO: 511241 - DNA, 25 bp, Mus musculus
aatctcacaggatgcggtacacagg

SEQ ID NO: 511242 - DNA, 25 bp, Mus musculus
aatctcacatccaatgggacaaggt

SEQ ID NO: 511243 - DNA, 25 bp, Mus musculus
aatctcacatcctatgggacaaggt

SEQ ID NO: 511244 - DNA, 25 bp, Mus musculus
aatctcacggttagcttattgaaca

SEQ ID NO: 511245 - DNA, 25 bp, Mus musculus
aatctcacggtttgcttattgaaca

SEQ ID NO: 511246 - DNA, 25 bp, Mus musculus
aatctcagcaacctaagcagacgca

SEQ ID NO: 511247 - DNA, 25 bp, Mus musculus
aatctcagcaacgtaagcagacgca

SEQ ID NO: 511248 - DNA, 25 bp, Mus musculus
aatctcatcgtcacttgtactcgtg

SEQ ID NO: 511249 - DNA, 25 bp, Mus musculus
aatctcatcgtctcttgtactcgtg

SEQ ID NO: 511250 - DNA, 25 bp, Mus musculus
aatctcatctacacccgagaccatt

SEQ ID NO: 511251 - DNA, 25 bp, Mus musculus
aatctcatctactcccgagaccatt

SEQ ID NO: 511252 - DNA, 25 bp, Mus musculus
aatctcatgctgatcgccatccaac

SEQ ID NO: 511253 - DNA, 25 bp, Mus musculus
aatctcatgctgttcgccatccaac

SEQ ID NO: 511254 - DNA, 25 bp, Mus musculus
aatctcattgcaacttgaactggcc

SEQ ID NO: 511255 - DNA, 25 bp, Mus musculus
aatctcattgcatcttgaactggcc

SEQ ID NO: 511256 - DNA, 25 bp, Mus musculus
aatctcattgtactgtcacagcacc

SEQ ID NO: 511257 - DNA, 25 bp, Mus musculus
aatctcattgtagtgtcacagcacc

SEQ ID NO: 511258 - DNA, 25 bp, Mus musculus
aatctcccaaccagaagcgtacgtg

SEQ ID NO: 511259 - DNA, 25 bp, Mus musculus
aatctcccaacctgaagcgtacgtg

SEQ ID NO: 511260 - DNA, 25 bp, Mus musculus
aatctcccgggcatggtgcaggaag

SEQ ID NO: 511261 - DNA, 25 bp, Mus musculus
aatctcccgggcttggtgcaggaag

SEQ ID NO: 511262 - DNA, 25 bp, Mus musculus
aatctcctagagacagtgttcttcc

SEQ ID NO: 511263 - DNA, 25 bp, Mus musculus
aatctcctagagtcagtgttcttcc

SEQ ID NO: 511264 - DNA, 25 bp, Mus musculus
aatctcctggagactgtgcctcctg

SEQ ID NO: 511265 - DNA, 25 bp, Mus musculus
aatctcctggagtctgtgcctcctg

SEQ ID NO: 511266 - DNA, 25 bp, Mus musculus
aatctcgggaaaaggtggtgaagct

SEQ ID NO: 511267 - DNA, 25 bp, Mus musculus
aatctcgggaaatggtggtgaagct

SEQ ID NO: 511268 - DNA, 25 bp, Mus musculus
aatctcgggaggagactcgaaatgc

SEQ ID NO: 511269 - DNA, 25 bp, Mus musculus
aatctcgggaggtgactcgaaatgc

SEQ ID NO: 511270 - DNA, 25 bp, Mus musculus
aatctctacattaagaacttggatg

SEQ ID NO: 511271 - DNA, 25 bp, Mus musculus
aatctctacatttagaacttggatg

SEQ ID NO: 511272 - DNA, 25 bp, Mus musculus
aatctctcccacatcatccttgtgg

SEQ ID NO: 511273 - DNA, 25 bp, Mus musculus
aatctctcccacttcatccttgtgg

SEQ ID NO: 511274 - DNA, 25 bp, Mus musculus
aatctctcctttcctaccatctatg

SEQ ID NO: 511275 - DNA, 25 bp, Mus musculus
aatctctcctttgctaccatctatg

SEQ ID NO: 511276 - DNA, 25 bp, Mus musculus
aatctctctcctcatgatcctgata

SEQ ID NO: 511277 - DNA, 25 bp, Mus musculus
aatctctctcctgatgatcctgata

SEQ ID NO: 511278 - DNA, 25 bp, Mus musculus
aatctctcttgcattgccgttaagc

SEQ ID NO: 511279 - DNA, 25 bp, Mus musculus
aatctctcttgctttgccgttaagc

SEQ ID NO: 511280 - DNA, 25 bp, Mus musculus
aatctctggaccagtgccttctgcc

SEQ ID NO: 511281 - DNA, 25 bp, Mus musculus
aatctctggacctgtgccttctgcc

SEQ ID NO: 511282 - DNA, 25 bp, Mus musculus
aatctctgtttgatgggcacatgga

SEQ ID NO: 511283 - DNA, 25 bp, Mus musculus
aatctctgtttgttgggcacatgga

SEQ ID NO: 511284 - DNA, 25 bp, Mus musculus
aatctcttccggagtcccagaatca

SEQ ID NO: 511285 - DNA, 25 bp, Mus musculus
aatctcttccggtgtcccagaatca

SEQ ID NO: 511286 - DNA, 25 bp, Mus musculus
aatctgaagcagctagagcaagccc

SEQ ID NO: 511287 - DNA, 25 bp, Mus musculus
aatctgaagcaggtagagcaagccc

SEQ ID NO: 511288 - DNA, 25 bp, Mus musculus
aatctgactattctggagcttcctg

SEQ ID NO: 511289 - DNA, 25 bp, Mus musculus
aatctgactattgtggagcttcctg

SEQ ID NO: 511290 - DNA, 25 bp, Mus musculus
aatctgactcacatcaaagctgggt

SEQ ID NO: 511291 - DNA, 25 bp, Mus musculus
aatctgactcacttcaaagctgggt

SEQ ID NO: 511292 - DNA, 25 bp, Mus musculus
aatctgaggaagctattcccaatat

SEQ ID NO: 511293 - DNA, 25 bp, Mus musculus
aatctgaggaaggtattcccaatat

SEQ ID NO: 511294 - DNA, 25 bp, Mus musculus
aatctgatcaaacccatcttgtcag

SEQ ID NO: 511295 - DNA, 25 bp, Mus musculus
aatctgatcaaagccatcttgtcag

SEQ ID NO: 511296 - DNA, 25 bp, Mus musculus
aatctgattctgcagtgttgctaag

SEQ ID NO: 511297 - DNA, 25 bp, Mus musculus
aatctgattctggagtgttgctaag

SEQ ID NO: 511298 - DNA, 25 bp, Mus musculus
aatctgcagatccatcatgtgggtc

SEQ ID NO: 511299 - DNA, 25 bp, Mus musculus
aatctgcagatcgatcatgtgggtc

SEQ ID NO: 511300 - DNA, 25 bp, Mus musculus
aatctgcagtgacaggaatcgttgt

SEQ ID NO: 511301 - DNA, 25 bp, Mus musculus
aatctgcagtgagaggaatcgttgt

SEQ ID NO: 511302 - DNA, 25 bp, Mus musculus
aatctgcagtgcacactcagtgaaa

SEQ ID NO: 511303 - DNA, 25 bp, Mus musculus
aatctgcagtgctcactcagtgaaa

SEQ ID NO: 511304 - DNA, 25 bp, Mus musculus
aatctgccaccaattcccttgagag

SEQ ID NO: 511305 - DNA, 25 bp, Mus musculus
aatctgccaccatttcccttgagag

SEQ ID NO: 511306 - DNA, 25 bp, Mus musculus
aatctgccatccatcctttgaaaag

SEQ ID NO: 511307 - DNA, 25 bp, Mus musculus
aatctgccatccttcctttgaaaag

SEQ ID NO: 511308 - DNA, 25 bp, Mus musculus
aatctgccgggtctctcctcaggtc

SEQ ID NO: 511309 - DNA, 25 bp, Mus musculus
aatctgccgggtgtctcctcaggtc

SEQ ID NO: 511310 - DNA, 25 bp, Mus musculus
aatctgcctgctcatcaccattcag

SEQ ID NO: 511311 - DNA, 25 bp, Mus musculus
aatctgcctgctgatcaccattcag

SEQ ID NO: 511312 - DNA, 25 bp, Mus musculus
aatctgcctgtaaaacctgagccat

SEQ ID NO: 511313 - DNA, 25 bp, Mus musculus
aatctgcctgtataacctgagccat

SEQ ID NO: 511314 - DNA, 25 bp, Mus musculus
aatctgcggctgatgctgaagatgc

SEQ ID NO: 511315 - DNA, 25 bp, Mus musculus
aatctgcggctgttgctgaagatgc

SEQ ID NO: 511316 - DNA, 25 bp, Mus musculus
aatctgctacaccatctttgacctg

SEQ ID NO: 511317 - DNA, 25 bp, Mus musculus
aatctgctacacgatctttgacctg

SEQ ID NO: 511318 - DNA, 25 bp, Mus musculus
aatctgctagggagccgctctccct

SEQ ID NO: 511319 - DNA, 25 bp, Mus musculus
aatctgctagggtgccgctctccct

SEQ ID NO: 511320 - DNA, 25 bp, Mus musculus
aatctgctatgacgcttaactgctg

SEQ ID NO: 511321 - DNA, 25 bp, Mus musculus
aatctgctatgaggcttaactgctg

SEQ ID NO: 511322 - DNA, 25 bp, Mus musculus
aatctgctctggcagcctaagtctg

SEQ ID NO: 511323 - DNA, 25 bp, Mus musculus
aatctgctctgggagcctaagtctg

SEQ ID NO: 511324 - DNA, 25 bp, Mus musculus
aatctgctgtgacctgagacccggt

SEQ ID NO: 511325 - DNA, 25 bp, Mus musculus
aatctgctgtgagctgagacccggt

SEQ ID NO: 511326 - DNA, 25 bp, Mus musculus
aatctgcttagacaccaagctggcg

SEQ ID NO: 511327 - DNA, 25 bp, Mus musculus
aatctgcttagagaccaagctggcg

SEQ ID NO: 511328 - DNA, 25 bp, Mus musculus
aatctgcttggacgccattaaccgg

SEQ ID NO: 511329 - DNA, 25 bp, Mus musculus
aatctgcttggaggccattaaccgg

SEQ ID NO: 511330 - DNA, 25 bp, Mus musculus
aatctggacttcaccacttttggag

SEQ ID NO: 511331 - DNA, 25 bp, Mus musculus
aatctggacttctccacttttggag

SEQ ID NO: 511332 - DNA, 25 bp, Mus musculus
aatctggatctacctcctgggctga

SEQ ID NO: 511333 - DNA, 25 bp, Mus musculus
aatctggatctagctcctgggctga

SEQ ID NO: 511334 - DNA, 25 bp, Mus musculus
aatctggcatccaaaagcggttggg

SEQ ID NO: 511335 - DNA, 25 bp, Mus musculus
aatctggcatcctaaagcggttggg

SEQ ID NO: 511336 - DNA, 25 bp, Mus musculus
aatctggccaacctcatctactact

SEQ ID NO: 511337 - DNA, 25 bp, Mus musculus
aatctggccaacgtcatctactact

SEQ ID NO: 511338 - DNA, 25 bp, Mus musculus
aatctggccagcctgcatcgtggtg

SEQ ID NO: 511339 - DNA, 25 bp, Mus musculus
aatctggccagcgtgcatcgtggtg

SEQ ID NO: 511340 - DNA, 25 bp, Mus musculus
aatctggccataattgaggctctga

SEQ ID NO: 511341 - DNA, 25 bp, Mus musculus
aatctggccatatttgaggctctga

SEQ ID NO: 511342 - DNA, 25 bp, Mus musculus
aatctggtcaatctccctctctgtg

SEQ ID NO: 511343 - DNA, 25 bp, Mus musculus
aatctggtcaatgtccctctctgtg

SEQ ID NO: 511344 - DNA, 25 bp, Mus musculus
aatctggtgtggatcgagtaagaat

SEQ ID NO: 511345 - DNA, 25 bp, Mus musculus
aatctggtgtggttcgagtaagaat

SEQ ID NO: 511346 - DNA, 25 bp, Mus musculus
aatctgtaccggcagggcagcagta

SEQ ID NO: 511347 - DNA, 25 bp, Mus musculus
aatctgtaccgggagggcagcagta

SEQ ID NO: 511348 - DNA, 25 bp, Mus musculus
aatctgtatcctacaggatgagccg

SEQ ID NO: 511349 - DNA, 25 bp, Mus musculus
aatctgtatccttcaggatgagccg

SEQ ID NO: 511350 - DNA, 25 bp, Mus musculus
aatctgtatcgaatcgagggcaccg

SEQ ID NO: 511351 - DNA, 25 bp, Mus musculus
aatctgtatcgattcgagggcaccg

SEQ ID NO: 511352 - DNA, 25 bp, Mus musculus
aatctgtctccgacatcaagcatac

SEQ ID NO: 511353 - DNA, 25 bp, Mus musculus
aatctgtctccgtcatcaagcatac

SEQ ID NO: 511354 - DNA, 25 bp, Mus musculus
aatctgtctttcaggtttgccagaa

SEQ ID NO: 511355 - DNA, 25 bp, Mus musculus
aatctgtctttctggtttgccagaa

SEQ ID NO: 511356 - DNA, 25 bp, Mus musculus
aatctgtggtatcattgtagcagcc

SEQ ID NO: 511357 - DNA, 25 bp, Mus musculus
aatctgtggtatgattgtagcagcc

SEQ ID NO: 511358 - DNA, 25 bp, Mus musculus
aatctgtggttcaggacttaattct

SEQ ID NO: 511359 - DNA, 25 bp, Mus musculus
aatctgtggttctggacttaattct

SEQ ID NO: 511360 - DNA, 25 bp, Mus musculus
aatctgttccgacgtcaggccgagg

SEQ ID NO: 511361 - DNA, 25 bp, Mus musculus
aatctgttccgaggtcaggccgagg

SEQ ID NO: 511362 - DNA, 25 bp, Mus musculus
aatctgttttctagaagctagctcg

SEQ ID NO: 511363 - DNA, 25 bp, Mus musculus
aatctgttttcttgaagctagctcg

SEQ ID NO: 511364 - DNA, 25 bp, Mus musculus
aatcttagcctacagaaacaccgcc

SEQ ID NO: 511365 - DNA, 25 bp, Mus musculus
aatcttagcctagagaaacaccgcc

SEQ ID NO: 511366 - DNA, 25 bp, Mus musculus
aatcttcacggacactctgaagtgg

SEQ ID NO: 511367 - DNA, 25 bp, Mus musculus
aatcttcacggagactctgaagtgg

SEQ ID NO: 511368 - DNA, 25 bp, Mus musculus
aatcttcatttgaaattcctggcac

SEQ ID NO: 511369 - DNA, 25 bp, Mus musculus
aatcttcatttgtaattcctggcac

SEQ ID NO: 511370 - DNA, 25 bp, Mus musculus
aatcttccaggacaagttcgatgtg

SEQ ID NO: 511371 - DNA, 25 bp, Mus musculus
aatcttccaggagaagttcgatgtg

SEQ ID NO: 511372 - DNA, 25 bp, Mus musculus
aatcttccagtgagagcttgcctat

SEQ ID NO: 511373 - DNA, 25 bp, Mus musculus
aatcttccagtgtgagcttgcctat

SEQ ID NO: 511374 - DNA, 25 bp, Mus musculus
aatcttcctgagctccttccgggtg

SEQ ID NO: 511375 - DNA, 25 bp, Mus musculus
aatcttcctgaggtccttccgggtg

SEQ ID NO: 511376 - DNA, 25 bp, Mus musculus
aatcttcgaaggactcctcgaagcg

SEQ ID NO: 511377 - DNA, 25 bp, Mus musculus
aatcttcgaaggtctcctcgaagcg

SEQ ID NO: 511378 - DNA, 25 bp, Mus musculus
aatcttctcatccaccagcagggct

SEQ ID NO: 511379 - DNA, 25 bp, Mus musculus
aatcttctcatcgaccagcagggct

SEQ ID NO: 511380 - DNA, 25 bp, Mus musculus
aatcttctgagacgctttttacctc

SEQ ID NO: 511381 - DNA, 25 bp, Mus musculus
aatcttctgagaggctttttacctc

SEQ ID NO: 511382 - DNA, 25 bp, Mus musculus
aatcttgaaagcacgtggattggaa

SEQ ID NO: 511383 - DNA, 25 bp, Mus musculus
aatcttgaaagctcgtggattggaa

SEQ ID NO: 511384 - DNA, 25 bp, Mus musculus
aatcttgagcctatcatttcctcag

SEQ ID NO: 511385 - DNA, 25 bp, Mus musculus
aatcttgagcctttcatttcctcag

SEQ ID NO: 511386 - DNA, 25 bp, Mus musculus
aatcttgcagctatatacacggaaa

SEQ ID NO: 511387 - DNA, 25 bp, Mus musculus
aatcttgcagctttatacacggaaa

SEQ ID NO: 511388 - DNA, 25 bp, Mus musculus
aatcttgctatgaaatgttaccctg

SEQ ID NO: 511389 - DNA, 25 bp, Mus musculus
aatcttgctatgtaatgttaccctg

SEQ ID NO: 511390 - DNA, 25 bp, Mus musculus
aatcttgcttgcatcatcagttcat

SEQ ID NO: 511391 - DNA, 25 bp, Mus musculus
aatcttgcttgcttcatcagttcat

SEQ ID NO: 511392 - DNA, 25 bp, Mus musculus
aatcttgggaagatacattcctggg

SEQ ID NO: 511393 - DNA, 25 bp, Mus musculus
aatcttgggaagttacattcctggg

SEQ ID NO: 511394 - DNA, 25 bp, Mus musculus
aatcttgggagcatgtaggtcctgc

SEQ ID NO: 511395 - DNA, 25 bp, Mus musculus
aatcttgggagcttgtaggtcctgc

SEQ ID NO: 511396 - DNA, 25 bp, Mus musculus
aatcttggtagaagagagcaacgtg

SEQ ID NO: 511397 - DNA, 25 bp, Mus musculus
aatcttggtagatgagagcaacgtg

SEQ ID NO: 511398 - DNA, 25 bp, Mus musculus
aatcttgtggaacctgctactcatt

SEQ ID NO: 511399 - DNA, 25 bp, Mus musculus
aatcttgtggaagctgctactcatt

SEQ ID NO: 511400 - DNA, 25 bp, Mus musculus
aatctttatggacttctacatggcc

SEQ ID NO: 511401 - DNA, 25 bp, Mus musculus
aatctttatggagttctacatggcc

SEQ ID NO: 511402 - DNA, 25 bp, Mus musculus
aatctttccttcaaagacttgctga

SEQ ID NO: 511403 - DNA, 25 bp, Mus musculus
aatctttccttctaagacttgctga

SEQ ID NO: 511404 - DNA, 25 bp, Mus musculus
aatctttctgcaaccagtttgaaga

SEQ ID NO: 511405 - DNA, 25 bp, Mus musculus
aatctttctgcatccagtttgaaga

SEQ ID NO: 511406 - DNA, 25 bp, Mus musculus
aatctttctggccaccaagacgtcg

SEQ ID NO: 511407 - DNA, 25 bp, Mus musculus
aatctttctggcgaccaagacgtcg

SEQ ID NO: 511408 - DNA, 25 bp, Mus musculus
aatctttgaggcacagattgctggg

SEQ ID NO: 511409 - DNA, 25 bp, Mus musculus
aatctttgaggctcagattgctggg

SEQ ID NO: 511410 - DNA, 25 bp, Mus musculus
aatctttgaggtcagcttcttggaa

SEQ ID NO: 511411 - DNA, 25 bp, Mus musculus
aatctttgaggtgagcttcttggaa

SEQ ID NO: 511412 - DNA, 25 bp, Mus musculus
aatctttgcagacctgatagtcttg

SEQ ID NO: 511413 - DNA, 25 bp, Mus musculus
aatctttgcagagctgatagtcttg

SEQ ID NO: 511414 - DNA, 25 bp, Mus musculus
aatcttttaacgcaactacctcagc

SEQ ID NO: 511415 - DNA, 25 bp, Mus musculus
aatcttttaacggaactacctcagc

SEQ ID NO: 511416 - DNA, 25 bp, Mus musculus
aatcttttgcctcggctccttaggc

SEQ ID NO: 511417 - DNA, 25 bp, Mus musculus
aatcttttgcctgggctccttaggc

SEQ ID NO: 511418 - DNA, 25 bp, Mus musculus
aatgaaaaacggatctatctgaagg

SEQ ID NO: 511419 - DNA, 25 bp, Mus musculus
aatgaaaaacggttctatctgaagg

SEQ ID NO: 511420 - DNA, 25 bp, Mus musculus
aatgaaaaagctcctactgagaatt

SEQ ID NO: 511421 - DNA, 25 bp, Mus musculus
aatgaaaaagctgctactgagaatt

SEQ ID NO: 511422 - DNA, 25 bp, Mus musculus
aatgaaaagccgaccagcctcttgt

SEQ ID NO: 511423 - DNA, 25 bp, Mus musculus
aatgaaaagccgtccagcctcttgt

SEQ ID NO: 511424 - DNA, 25 bp, Mus musculus
aatgaaaaggttcttctccagctct

SEQ ID NO: 511425 - DNA, 25 bp, Mus musculus
aatgaaaaggttgttctccagctct

SEQ ID NO: 511426 - DNA, 25 bp, Mus musculus
aatgaaaattgtcccaaagcctaca

SEQ ID NO: 511427 - DNA, 25 bp, Mus musculus
aatgaaaattgtgccaaagcctaca

SEQ ID NO: 511428 - DNA, 25 bp, Mus musculus
aatgaaacaagccacacacagggct

SEQ ID NO: 511429 - DNA, 25 bp, Mus musculus
aatgaaacaagcgacacacagggct

SEQ ID NO: 511430 - DNA, 25 bp, Mus musculus
aatgaaacgataccaagttggaaag

SEQ ID NO: 511431 - DNA, 25 bp, Mus musculus
aatgaaacgatagcaagttggaaag

SEQ ID NO: 511432 - DNA, 25 bp, Mus musculus
aatgaaactactccccactctgatg

SEQ ID NO: 511433 - DNA, 25 bp, Mus musculus
aatgaaactactgcccactctgatg

SEQ ID NO: 511434 - DNA, 25 bp, Mus musculus
aatgaaagcctacatggaattagtc

SEQ ID NO: 511435 - DNA, 25 bp, Mus musculus
aatgaaagcctagatggaattagtc

SEQ ID NO: 511436 - DNA, 25 bp, Mus musculus
aatgaaagctttctgtatgtcagag

SEQ ID NO: 511437 - DNA, 25 bp, Mus musculus
aatgaaagctttgtgtatgtcagag

SEQ ID NO: 511438 - DNA, 25 bp, Mus musculus
aatgaaaggcacatcttaagactgg

SEQ ID NO: 511439 - DNA, 25 bp, Mus musculus
aatgaaaggcacttcttaagactgg

SEQ ID NO: 511440 - DNA, 25 bp, Mus musculus
aatgaaaggcctaatgtctgtgagt

SEQ ID NO: 511441 - DNA, 25 bp, Mus musculus
aatgaaaggccttatgtctgtgagt

SEQ ID NO: 511442 - DNA, 25 bp, Mus musculus
aatgaaagtggtatcctggcaagca

SEQ ID NO: 511443 - DNA, 25 bp, Mus musculus
aatgaaagtggtttcctggcaagca

SEQ ID NO: 511444 - DNA, 25 bp, Mus musculus
aatgaaatcagcagtggcgcccgtt

SEQ ID NO: 511445 - DNA, 25 bp, Mus musculus
aatgaaatcagctgtggcgcccgtt

SEQ ID NO: 511446 - DNA, 25 bp, Mus musculus
aatgaaatccgtaggctggaacggc

SEQ ID NO: 511447 - DNA, 25 bp, Mus musculus
aatgaaatccgttggctggaacggc

SEQ ID NO: 511448 - DNA, 25 bp, Mus musculus
aatgaaatgatgacaagtcttcaca

SEQ ID NO: 511449 - DNA, 25 bp, Mus musculus
aatgaaatgatgtcaagtcttcaca

SEQ ID NO: 511450 - DNA, 25 bp, Mus musculus
aatgaaattaggcaagatgaggagc

SEQ ID NO: 511451 - DNA, 25 bp, Mus musculus
aatgaaattagggaagatgaggagc

SEQ ID NO: 511452 - DNA, 25 bp, Mus musculus
aatgaaattatgcaactttggagaa

SEQ ID NO: 511453 - DNA, 25 bp, Mus musculus
aatgaaattatggaactttggagaa

SEQ ID NO: 511454 - DNA, 25 bp, Mus musculus
aatgaaattgaaagcctgggatcca

SEQ ID NO: 511455 - DNA, 25 bp, Mus musculus
aatgaaattgaatgcctgggatcca

SEQ ID NO: 511456 - DNA, 25 bp, Mus musculus
aatgaaccgcacatgccacaaaacg

SEQ ID NO: 511457 - DNA, 25 bp, Mus musculus
aatgaaccgcacttgccacaaaacg

SEQ ID NO: 511458 - DNA, 25 bp, Mus musculus
aatgaacctgaaagcaaagaccgag

SEQ ID NO: 511459 - DNA, 25 bp, Mus musculus
aatgaacctgaacctgcaacccagc

SEQ ID NO: 511460 - DNA, 25 bp, Mus musculus
aatgaacctgaagctgcaacccagc

SEQ ID NO: 511461 - DNA, 25 bp, Mus musculus
aatgaacctgaatgcaaagaccgag

SEQ ID NO: 511462 - DNA, 25 bp, Mus musculus
aatgaactcacgagcatctgcgtgg

SEQ ID NO: 511463 - DNA, 25 bp, Mus musculus
aatgaactcacgtgcatctgcgtgg

SEQ ID NO: 511464 - DNA, 25 bp, Mus musculus
aatgaactcttgaaagggtattcac

SEQ ID NO: 511465 - DNA, 25 bp, Mus musculus
aatgaactcttgtaagggtattcac

SEQ ID NO: 511466 - DNA, 25 bp, Mus musculus
aatgaactgtaacacgtgaagggcc

SEQ ID NO: 511467 - DNA, 25 bp, Mus musculus
aatgaactgtaagacgtgaagggcc

SEQ ID NO: 511468 - DNA, 25 bp, Mus musculus
aatgaacttgtacaactgcaagaag

SEQ ID NO: 511469 - DNA, 25 bp, Mus musculus
aatgaacttgtagaactgcaagaag

SEQ ID NO: 511470 - DNA, 25 bp, Mus musculus
aatgaactttgacccccgctggatg

SEQ ID NO: 511471 - DNA, 25 bp, Mus musculus
aatgaactttgagccccgctggatg

SEQ ID NO: 511472 - DNA, 25 bp, Mus musculus
aatgaagaacccacccaagctggag

SEQ ID NO: 511473 - DNA, 25 bp, Mus musculus
aatgaagaaccctcccaagctggag

SEQ ID NO: 511474 - DNA, 25 bp, Mus musculus
aatgaagaagagacagagaggaagc

SEQ ID NO: 511475 - DNA, 25 bp, Mus musculus
aatgaagaagagcatgatgccccag

SEQ ID NO: 511476 - DNA, 25 bp, Mus musculus
aatgaagaagaggatgatgccccag

SEQ ID NO: 511477 - DNA, 25 bp, Mus musculus
aatgaagaagagtcagagaggaagc

SEQ ID NO: 511478 - DNA, 25 bp, Mus musculus
aatgaagaatccatcaacgctgtac

SEQ ID NO: 511479 - DNA, 25 bp, Mus musculus
aatgaagaatccttcaacgctgtac

SEQ ID NO: 511480 - DNA, 25 bp, Mus musculus
aatgaagacttgaggcgaatggctg

SEQ ID NO: 511481 - DNA, 25 bp, Mus musculus
aatgaagacttgtggcgaatggctg

SEQ ID NO: 511482 - DNA, 25 bp, Mus musculus
aatgaagagacccacagcagtgacg

SEQ ID NO: 511483 - DNA, 25 bp, Mus musculus
aatgaagagaccgacagcagtgacg

SEQ ID NO: 511484 - DNA, 25 bp, Mus musculus
aatgaagagcccatctagcaactgg

SEQ ID NO: 511485 - DNA, 25 bp, Mus musculus
aatgaagagcccttctagcaactgg

SEQ ID NO: 511486 - DNA, 25 bp, Mus musculus
aatgaagagttcacaaaggaaaagt

SEQ ID NO: 511487 - DNA, 25 bp, Mus musculus
aatgaagagttctcaaaggaaaagt

SEQ ID NO: 511488 - DNA, 25 bp, Mus musculus
aatgaagatgtaacaatgcacggcc

SEQ ID NO: 511489 - DNA, 25 bp, Mus musculus
aatgaagatgtatcaatgcacggcc

SEQ ID NO: 511490 - DNA, 25 bp, Mus musculus
aatgaagcactcacctgatctaatg

SEQ ID NO: 511491 - DNA, 25 bp, Mus musculus
aatgaagcactctcctgatctaatg

SEQ ID NO: 511492 - DNA, 25 bp, Mus musculus
aatgaagcagctactccctgccaag

SEQ ID NO: 511493 - DNA, 25 bp, Mus musculus
aatgaagcagcttctccctgccaag

SEQ ID NO: 511494 - DNA, 25 bp, Mus musculus
aatgaagccacaaggcactgggtgg

SEQ ID NO: 511495 - DNA, 25 bp, Mus musculus
aatgaagccacatggcactgggtgg

SEQ ID NO: 511496 - DNA, 25 bp, Mus musculus
aatgaagcccggaaatacgttcgca

SEQ ID NO: 511497 - DNA, 25 bp, Mus musculus
aatgaagcccggtaatacgttcgca

SEQ ID NO: 511498 - DNA, 25 bp, Mus musculus
aatgaagccctgaagaggtaccggt

SEQ ID NO: 511499 - DNA, 25 bp, Mus musculus
aatgaagccctgtagaggtaccggt

SEQ ID NO: 511500 - DNA, 25 bp, Mus musculus
aatgaagcctggcatggctcctgct

SEQ ID NO: 511501 - DNA, 25 bp, Mus musculus
aatgaagcctgggatggctcctgct

SEQ ID NO: 511502 - DNA, 25 bp, Mus musculus
aatgaagctgagaggtagcattcat

SEQ ID NO: 511503 - DNA, 25 bp, Mus musculus
aatgaagctgagtggtagcattcat

SEQ ID NO: 511504 - DNA, 25 bp, Mus musculus
aatgaagctgatcactgctctggtg

SEQ ID NO: 511505 - DNA, 25 bp, Mus musculus
aatgaagctgatgactgctctggtg

SEQ ID NO: 511506 - DNA, 25 bp, Mus musculus
aatgaaggacaaccagacaggcttc

SEQ ID NO: 511507 - DNA, 25 bp, Mus musculus
aatgaaggacaagcagacaggcttc

SEQ ID NO: 511508 - DNA, 25 bp, Mus musculus
aatgaaggagccatctgcccagcgg

SEQ ID NO: 511509 - DNA, 25 bp, Mus musculus
aatgaaggagccttctgcccagcgg

SEQ ID NO: 511510 - DNA, 25 bp, Mus musculus
aatgaaggatgacagctacgcacca

SEQ ID NO: 511511 - DNA, 25 bp, Mus musculus
aatgaaggatgagagctacgcacca

SEQ ID NO: 511512 - DNA, 25 bp, Mus musculus
aatgaaggcttaatcccaagcaact

SEQ ID NO: 511513 - DNA, 25 bp, Mus musculus
aatgaaggcttattcccaagcaact

SEQ ID NO: 511514 - DNA, 25 bp, Mus musculus
aatgaagtcaatcctttcttggaca

SEQ ID NO: 511515 - DNA, 25 bp, Mus musculus
aatgaagtcaatgctttcttggaca

SEQ ID NO: 511516 - DNA, 25 bp, Mus musculus
aatgaagtcagacggcacacaaagg

SEQ ID NO: 511517 - DNA, 25 bp, Mus musculus
aatgaagtcagagggcacacaaagg

SEQ ID NO: 511518 - DNA, 25 bp, Mus musculus
aatgaagtccctcacaaacctctgc

SEQ ID NO: 511519 - DNA, 25 bp, Mus musculus
aatgaagtccctgacaaacctctgc

SEQ ID NO: 511520 - DNA, 25 bp, Mus musculus
aatgaagtggctcccctcacagcag

SEQ ID NO: 511521 - DNA, 25 bp, Mus musculus
aatgaagtggctgccctcacagcag

SEQ ID NO: 511522 - DNA, 25 bp, Mus musculus
aatgaagtgtttctgattgacagac

SEQ ID NO: 511523 - DNA, 25 bp, Mus musculus
aatgaagtgtttgtgattgacagac

SEQ ID NO: 511524 - DNA, 25 bp, Mus musculus
aatgaataagcaagaggctgtagcc

SEQ ID NO: 511525 - DNA, 25 bp, Mus musculus
aatgaataagcatgaggctgtagcc

SEQ ID NO: 511526 - DNA, 25 bp, Mus musculus
aatgaatacctacaagcagatgaag

SEQ ID NO: 511527 - DNA, 25 bp, Mus musculus
aatgaatacctagaagcagatgaag

SEQ ID NO: 511528 - DNA, 25 bp, Mus musculus
aatgaatactcgaccaagtgccagg

SEQ ID NO: 511529 - DNA, 25 bp, Mus musculus
aatgaatactcgtccaagtgccagg

SEQ ID NO: 511530 - DNA, 25 bp, Mus musculus
aatgaatatgccagcctcaaagcca

SEQ ID NO: 511531 - DNA, 25 bp, Mus musculus
aatgaatatgcctgcctcaaagcca

SEQ ID NO: 511532 - DNA, 25 bp, Mus musculus
aatgaatctaggatttagtgttggc

SEQ ID NO: 511533 - DNA, 25 bp, Mus musculus
aatgaatctaggttttagtgttggc

SEQ ID NO: 511534 - DNA, 25 bp, Mus musculus
aatgaatgacatccgcccaaaggtg

SEQ ID NO: 511535 - DNA, 25 bp, Mus musculus
aatgaatgacatgcgcccaaaggtg

SEQ ID NO: 511536 - DNA, 25 bp, Mus musculus
aatgaatgagaaagctggatactat

SEQ ID NO: 511537 - DNA, 25 bp, Mus musculus
aatgaatgagaatgctggatactat

SEQ ID NO: 511538 - DNA, 25 bp, Mus musculus
aatgaatgatgtcctccctaacagc

SEQ ID NO: 511539 - DNA, 25 bp, Mus musculus
aatgaatgatgtgctccctaacagc

SEQ ID NO: 511540 - DNA, 25 bp, Mus musculus
aatgaatgcatacagccaagttcaa

SEQ ID NO: 511541 - DNA, 25 bp, Mus musculus
aatgaatgcatagagccaagttcaa

SEQ ID NO: 511542 - DNA, 25 bp, Mus musculus
aatgaatgtgagagaagcagcccaa

SEQ ID NO: 511543 - DNA, 25 bp, Mus musculus
aatgaatgtgagtgaagcagcccaa

SEQ ID NO: 511544 - DNA, 25 bp, Mus musculus
aatgaattacctcgcatccaagggc

SEQ ID NO: 511545 - DNA, 25 bp, Mus musculus
aatgaattacctggcatccaagggc

SEQ ID NO: 511546 - DNA, 25 bp, Mus musculus
aatgaattacgtcgggcagctggcc

SEQ ID NO: 511547 - DNA, 25 bp, Mus musculus
aatgaattacgtggggcagctggcc

SEQ ID NO: 511548 - DNA, 25 bp, Mus musculus
aatgaatttcccaggcttttaggat

SEQ ID NO: 511549 - DNA, 25 bp, Mus musculus
aatgaatttccctggcttttaggat

SEQ ID NO: 511550 - DNA, 25 bp, Mus musculus
aatgacaaaaagactgtatgacgcc

SEQ ID NO: 511551 - DNA, 25 bp, Mus musculus
aatgacaaaaagctccaacgagctg

SEQ ID NO: 511552 - DNA, 25 bp, Mus musculus
aatgacaaaaaggtccaacgagctg

SEQ ID NO: 511553 - DNA, 25 bp, Mus musculus
aatgacaaaaagtctgtatgacgcc

SEQ ID NO: 511554 - DNA, 25 bp, Mus musculus
aatgacaatgatctgcccatggagg

SEQ ID NO: 511555 - DNA, 25 bp, Mus musculus
aatgacaatgatgtgcccatggagg

SEQ ID NO: 511556 - DNA, 25 bp, Mus musculus
aatgacaattaactgtaacaatgcg

SEQ ID NO: 511557 - DNA, 25 bp, Mus musculus
aatgacaattaagtgtaacaatgcg

SEQ ID NO: 511558 - DNA, 25 bp, Mus musculus
aatgacaccttcagcagagagccag

SEQ ID NO: 511559 - DNA, 25 bp, Mus musculus
aatgacaccttctgcagagagccag

SEQ ID NO: 511560 - DNA, 25 bp, Mus musculus
aatgacacgaagaggagctgggtcc

SEQ ID NO: 511561 - DNA, 25 bp, Mus musculus
aatgacacgaagtggagctgggtcc

SEQ ID NO: 511562 - DNA, 25 bp, Mus musculus
aatgacacgatgcagcttcgagagt

SEQ ID NO: 511563 - DNA, 25 bp, Mus musculus
aatgacacgatggagcttcgagagt

SEQ ID NO: 511564 - DNA, 25 bp, Mus musculus
aatgacacggaaactgctctggcag

SEQ ID NO: 511565 - DNA, 25 bp, Mus musculus
aatgacacggaatctgctctggcag

SEQ ID NO: 511566 - DNA, 25 bp, Mus musculus
aatgacactcacatatgacccgact

SEQ ID NO: 511567 - DNA, 25 bp, Mus musculus
aatgacactcacttatgacccgact

SEQ ID NO: 511568 - DNA, 25 bp, Mus musculus
aatgacagagctctaccagtcttta

SEQ ID NO: 511569 - DNA, 25 bp, Mus musculus
aatgacagagctgtaccagtcttta

SEQ ID NO: 511570 - DNA, 25 bp, Mus musculus
aatgacagatctctcctggagaacc

SEQ ID NO: 511571 - DNA, 25 bp, Mus musculus
aatgacagatctgtcctggagaacc

SEQ ID NO: 511572 - DNA, 25 bp, Mus musculus
aatgacagccacacatgggttactg

SEQ ID NO: 511573 - DNA, 25 bp, Mus musculus
aatgacagccactcatgggttactg

SEQ ID NO: 511574 - DNA, 25 bp, Mus musculus
aatgacagccgtaaagcacgaacag

SEQ ID NO: 511575 - DNA, 25 bp, Mus musculus
aatgacagccgttaagcacgaacag

SEQ ID NO: 511576 - DNA, 25 bp, Mus musculus
aatgacagttccaacgatgacaaaa

SEQ ID NO: 511577 - DNA, 25 bp, Mus musculus
aatgacagttcctacgatgacaaaa

SEQ ID NO: 511578 - DNA, 25 bp, Mus musculus
aatgacatagacatctttgagatca

SEQ ID NO: 511579 - DNA, 25 bp, Mus musculus
aatgacatagacttctttgagatca

SEQ ID NO: 511580 - DNA, 25 bp, Mus musculus
aatgacatagtaattggtatcctgg

SEQ ID NO: 511581 - DNA, 25 bp, Mus musculus
aatgacatagtatttggtatcctgg

SEQ ID NO: 511582 - DNA, 25 bp, Mus musculus
aatgacatcaagatggcagccaagc

SEQ ID NO: 511583 - DNA, 25 bp, Mus musculus
aatgacatcaagttggcagccaagc

SEQ ID NO: 511584 - DNA, 25 bp, Mus musculus
aatgacatcaccaaaacctgcctgg

SEQ ID NO: 511585 - DNA, 25 bp, Mus musculus
aatgacatcacctaaacctgcctgg

SEQ ID NO: 511586 - DNA, 25 bp, Mus musculus
aatgacatggatagtttaacctcag

SEQ ID NO: 511587 - DNA, 25 bp, Mus musculus
aatgacatggattgtttaacctcag

SEQ ID NO: 511588 - DNA, 25 bp, Mus musculus
aatgacattggtctgtctagcctgg

SEQ ID NO: 511589 - DNA, 25 bp, Mus musculus
aatgacattggtgtgtctagcctgg

SEQ ID NO: 511590 - DNA, 25 bp, Mus musculus
aatgaccaggtaccaatcagctcca

SEQ ID NO: 511591 - DNA, 25 bp, Mus musculus
aatgaccaggtagcaatcagctcca

SEQ ID NO: 511592 - DNA, 25 bp, Mus musculus
aatgaccagtgtctaaaagtgtccc

SEQ ID NO: 511593 - DNA, 25 bp, Mus musculus
aatgaccagtgtgtaaaagtgtccc

SEQ ID NO: 511594 - DNA, 25 bp, Mus musculus
aatgaccatggtcatcgggtgccca

SEQ ID NO: 511595 - DNA, 25 bp, Mus musculus
aatgaccatggtgatcgggtgccca

SEQ ID NO: 511596 - DNA, 25 bp, Mus musculus
aatgacccagaaccgagccctgcag

SEQ ID NO: 511597 - DNA, 25 bp, Mus musculus
aatgacccagaagcgagccctgcag

SEQ ID NO: 511598 - DNA, 25 bp, Mus musculus
aatgaccccgacagccggcatgtca

SEQ ID NO: 511599 - DNA, 25 bp, Mus musculus
aatgaccccgactgccggcatgtca

SEQ ID NO: 511600 - DNA, 25 bp, Mus musculus
aatgacccctggaagaactgcacgc

SEQ ID NO: 511601 - DNA, 25 bp, Mus musculus
aatgacccctggtagaactgcacgc

SEQ ID NO: 511602 - DNA, 25 bp, Mus musculus
aatgacccgggaagctgcgtagctg

SEQ ID NO: 511603 - DNA, 25 bp, Mus musculus
aatgacccgggatgctgcgtagctg

SEQ ID NO: 511604 - DNA, 25 bp, Mus musculus
aatgacctcaggattacagatgcct

SEQ ID NO: 511605 - DNA, 25 bp, Mus musculus
aatgacctcaggtttacagatgcct

SEQ ID NO: 511606 - DNA, 25 bp, Mus musculus
aatgacctccacacccagattgaaa

SEQ ID NO: 511607 - DNA, 25 bp, Mus musculus
aatgacctccactcccagattgaaa

SEQ ID NO: 511608 - DNA, 25 bp, Mus musculus
aatgacctctatcccactgtgaaag

SEQ ID NO: 511609 - DNA, 25 bp, Mus musculus
aatgacctctatgccactgtgaaag

SEQ ID NO: 511610 - DNA, 25 bp, Mus musculus
aatgacctctgccattgcccgctgg

SEQ ID NO: 511611 - DNA, 25 bp, Mus musculus
aatgacctctgcgattgcccgctgg

SEQ ID NO: 511612 - DNA, 25 bp, Mus musculus
aatgacctgactaacttcactagtg

SEQ ID NO: 511613 - DNA, 25 bp, Mus musculus
aatgacctgacttacttcactagtg

SEQ ID NO: 511614 - DNA, 25 bp, Mus musculus
aatgacctgatgatactacgcctca

SEQ ID NO: 511615 - DNA, 25 bp, Mus musculus
aatgacctgatgttactacgcctca

SEQ ID NO: 511616 - DNA, 25 bp, Mus musculus
aatgaccttggcctacgataatggc

SEQ ID NO: 511617 - DNA, 25 bp, Mus musculus
aatgaccttggcgtacgataatggc

SEQ ID NO: 511618 - DNA, 25 bp, Mus musculus
aatgacgaaaatcaagatggtgtca

SEQ ID NO: 511619 - DNA, 25 bp, Mus musculus
aatgacgaaaatgaagatggtgtca

SEQ ID NO: 511620 - DNA, 25 bp, Mus musculus
aatgacgacctgcataaagcctatg

SEQ ID NO: 511621 - DNA, 25 bp, Mus musculus
aatgacgacctggataaagcctatg

SEQ ID NO: 511622 - DNA, 25 bp, Mus musculus
aatgacgaggaacaatacgaggcat

SEQ ID NO: 511623 - DNA, 25 bp, Mus musculus
aatgacgaggaagaatacgaggcat

SEQ ID NO: 511624 - DNA, 25 bp, Mus musculus
aatgacgaggcacaccctctggtgg

SEQ ID NO: 511625 - DNA, 25 bp, Mus musculus
aatgacgaggcagaccctctggtgg

SEQ ID NO: 511626 - DNA, 25 bp, Mus musculus
aatgacggcgccaacaacatcaaag

SEQ ID NO: 511627 - DNA, 25 bp, Mus musculus
aatgacggcgcctacaacatcaaag

SEQ ID NO: 511628 - DNA, 25 bp, Mus musculus
aatgacgtggatctgcagaagatag

SEQ ID NO: 511629 - DNA, 25 bp, Mus musculus
aatgacgtggatgtgcagaagatag

SEQ ID NO: 511630 - DNA, 25 bp, Mus musculus
aatgactacttcacttgcataacta

SEQ ID NO: 511631 - DNA, 25 bp, Mus musculus
aatgactacttctcttgcataacta

SEQ ID NO: 511632 - DNA, 25 bp, Mus musculus
aatgactcagaccaacaaggctgtc

SEQ ID NO: 511633 - DNA, 25 bp, Mus musculus
aatgactcagacgaacaaggctgtc

SEQ ID NO: 511634 - DNA, 25 bp, Mus musculus
aatgactcctacatgtcagccaacg

SEQ ID NO: 511635 - DNA, 25 bp, Mus musculus
aatgactcctacttgtcagccaacg

SEQ ID NO: 511636 - DNA, 25 bp, Mus musculus
aatgactctcctctgggcctggctg

SEQ ID NO: 511637 - DNA, 25 bp, Mus musculus
aatgactctcctgtgggcctggctg

SEQ ID NO: 511638 - DNA, 25 bp, Mus musculus
aatgactctgcgcacggtattattg

SEQ ID NO: 511639 - DNA, 25 bp, Mus musculus
aatgactctgcggacggtattattg

SEQ ID NO: 511640 - DNA, 25 bp, Mus musculus
aatgactggagcctcagtgatacag

SEQ ID NO: 511641 - DNA, 25 bp, Mus musculus
aatgactggagcgtcagtgatacag

SEQ ID NO: 511642 - DNA, 25 bp, Mus musculus
aatgactgtgatccttccaggaatg

SEQ ID NO: 511643 - DNA, 25 bp, Mus musculus
aatgactgtgatgcttccaggaatg

SEQ ID NO: 511644 - DNA, 25 bp, Mus musculus
aatgacttatcgctacatggacgac

SEQ ID NO: 511645 - DNA, 25 bp, Mus musculus
aatgacttatcggtacatggacgac

SEQ ID NO: 511646 - DNA, 25 bp, Mus musculus
aatgacttcctcagtggccttgtag

SEQ ID NO: 511647 - DNA, 25 bp, Mus musculus
aatgacttcctctgtggccttgtag

SEQ ID NO: 511648 - DNA, 25 bp, Mus musculus
aatgacttctccagaaaacgacagt

SEQ ID NO: 511649 - DNA, 25 bp, Mus musculus
aatgacttctcctgaaaacgacagt

SEQ ID NO: 511650 - DNA, 25 bp, Mus musculus
aatgagaaaacaagggcggtagcga

SEQ ID NO: 511651 - DNA, 25 bp, Mus musculus
aatgagaaaacatgggcggtagcga

SEQ ID NO: 511652 - DNA, 25 bp, Mus musculus
aatgagaaagtgacgcagtctgacc

SEQ ID NO: 511653 - DNA, 25 bp, Mus musculus
aatgagaaagtgtcgcagtctgacc

SEQ ID NO: 511654 - DNA, 25 bp, Mus musculus
aatgagaacacacgcagtgtctccg

SEQ ID NO: 511655 - DNA, 25 bp, Mus musculus
aatgagaacacaggcagtgtctccg

SEQ ID NO: 511656 - DNA, 25 bp, Mus musculus
aatgagacaagacacatgctggaaa

SEQ ID NO: 511657 - DNA, 25 bp, Mus musculus
aatgagacaagagacatgctggaaa

SEQ ID NO: 511658 - DNA, 25 bp, Mus musculus
aatgagacacgacgcgcccatgcag

SEQ ID NO: 511659 - DNA, 25 bp, Mus musculus
aatgagacacgaggcgcccatgcag

SEQ ID NO: 511660 - DNA, 25 bp, Mus musculus
aatgagacaggcatctgcgagtgca

SEQ ID NO: 511661 - DNA, 25 bp, Mus musculus
aatgagacaggcttctgcgagtgca

SEQ ID NO: 511662 - DNA, 25 bp, Mus musculus
aatgagaccacaccccataggacag

SEQ ID NO: 511663 - DNA, 25 bp, Mus musculus
aatgagaccacagcccataggacag

SEQ ID NO: 511664 - DNA, 25 bp, Mus musculus
aatgagaccagcacggagaccaggg

SEQ ID NO: 511665 - DNA, 25 bp, Mus musculus
aatgagaccagctcggagaccaggg

SEQ ID NO: 511666 - DNA, 25 bp, Mus musculus
aatgagaccatacctaagaacctgg

SEQ ID NO: 511667 - DNA, 25 bp, Mus musculus
aatgagaccatagctaagaacctgg

SEQ ID NO: 511668 - DNA, 25 bp, Mus musculus
aatgagacccccaacctcatctgga

SEQ ID NO: 511669 - DNA, 25 bp, Mus musculus
aatgagaccccctacctcatctgga

SEQ ID NO: 511670 - DNA, 25 bp, Mus musculus
aatgagacctacctgcaccgcattg

SEQ ID NO: 511671 - DNA, 25 bp, Mus musculus
aatgagacctacgtgcaccgcattg

SEQ ID NO: 511672 - DNA, 25 bp, Mus musculus
aatgagagaagtcttgcagaagtac

SEQ ID NO: 511673 - DNA, 25 bp, Mus musculus
aatgagagaagtgttgcagaagtac

SEQ ID NO: 511674 - DNA, 25 bp, Mus musculus
aatgagagcgctctttctcatcccc

SEQ ID NO: 511675 - DNA, 25 bp, Mus musculus
aatgagagcgctgtttctcatcccc

SEQ ID NO: 511676 - DNA, 25 bp, Mus musculus
aatgagagtctcctgtgtcgcacac

SEQ ID NO: 511677 - DNA, 25 bp, Mus musculus
aatgagagtctcgtgtgtcgcacac

SEQ ID NO: 511678 - DNA, 25 bp, Mus musculus
aatgagatcgccaccgtcgcttacc

SEQ ID NO: 511679 - DNA, 25 bp, Mus musculus
aatgagatcgcctccgtcgcttacc

SEQ ID NO: 511680 - DNA, 25 bp, Mus musculus
aatgagatgcacacctcaagtgccg

SEQ ID NO: 511681 - DNA, 25 bp, Mus musculus
aatgagatgcactcctcaagtgccg

SEQ ID NO: 511682 - DNA, 25 bp, Mus musculus
aatgagatggccacgcggaagagta

SEQ ID NO: 511683 - DNA, 25 bp, Mus musculus
aatgagatggcctcgcggaagagta

SEQ ID NO: 511684 - DNA, 25 bp, Mus musculus
aatgagatggtgatcaagcggctgc

SEQ ID NO: 511685 - DNA, 25 bp, Mus musculus
aatgagatggtgttcaagcggctgc

SEQ ID NO: 511686 - DNA, 25 bp, Mus musculus
aatgagattatgctgctaaagtccc

SEQ ID NO: 511687 - DNA, 25 bp, Mus musculus
aatgagattatggtgctaaagtccc

SEQ ID NO: 511688 - DNA, 25 bp, Mus musculus
aatgagcaccttcgccgacagttcg

SEQ ID NO: 511689 - DNA, 25 bp, Mus musculus
aatgagcaccttggccgacagttcg

SEQ ID NO: 511690 - DNA, 25 bp, Mus musculus
aatgagcagccgaggcccctacgga

SEQ ID NO: 511691 - DNA, 25 bp, Mus musculus
aatgagcagccgtggcccctacgga

SEQ ID NO: 511692 - DNA, 25 bp, Mus musculus
aatgagcagctgattcccgagcctg

SEQ ID NO: 511693 - DNA, 25 bp, Mus musculus
aatgagcagctgtttcccgagcctg

SEQ ID NO: 511694 - DNA, 25 bp, Mus musculus
aatgagcaggcacctattgtcgccc

SEQ ID NO: 511695 - DNA, 25 bp, Mus musculus
aatgagcaggcagctattgtcgccc

SEQ ID NO: 511696 - DNA, 25 bp, Mus musculus
aatgagccagcaacccagacagcag

SEQ ID NO: 511697 - DNA, 25 bp, Mus musculus
aatgagccagcaccatgccgagtga

SEQ ID NO: 511698 - DNA, 25 bp, Mus musculus
aatgagccagcagcatgccgagtga

SEQ ID NO: 511699 - DNA, 25 bp, Mus musculus
aatgagccagcatcccagacagcag

SEQ ID NO: 511700 - DNA, 25 bp, Mus musculus
aatgagccaggacataatcaaatac

SEQ ID NO: 511701 - DNA, 25 bp, Mus musculus
aatgagccaggagataatcaaatac

SEQ ID NO: 511702 - DNA, 25 bp, Mus musculus
aatgagccgagactccaagtgcatc

SEQ ID NO: 511703 - DNA, 25 bp, Mus musculus
aatgagccgagagtccaagtgcatc

SEQ ID NO: 511704 - DNA, 25 bp, Mus musculus
aatgagccgcctcaagatgaaggca

SEQ ID NO: 511705 - DNA, 25 bp, Mus musculus
aatgagccgcctgaagatgaaggca

SEQ ID NO: 511706 - DNA, 25 bp, Mus musculus
aatgagcctaccagaatgctggttg

SEQ ID NO: 511707 - DNA, 25 bp, Mus musculus
aatgagcctacctgaatgctggttg

SEQ ID NO: 511708 - DNA, 25 bp, Mus musculus
aatgagcctagcagacgtgcttcag

SEQ ID NO: 511709 - DNA, 25 bp, Mus musculus
aatgagcctagctgacgtgcttcag

SEQ ID NO: 511710 - DNA, 25 bp, Mus musculus
aatgagctagagattcctgtggaag

SEQ ID NO: 511711 - DNA, 25 bp, Mus musculus
aatgagctagagtttcctgtggaag

SEQ ID NO: 511712 - DNA, 25 bp, Mus musculus
aatgagctcagtcccatctcgctga

SEQ ID NO: 511713 - DNA, 25 bp, Mus musculus
aatgagctcagtgccatctcgctga

SEQ ID NO: 511714 - DNA, 25 bp, Mus musculus
aatgagctcattccccactgtcacg

SEQ ID NO: 511715 - DNA, 25 bp, Mus musculus
aatgagctcattgcccactgtcacg

SEQ ID NO: 511716 - DNA, 25 bp, Mus musculus
aatgagctgatgagcgactttgaga

SEQ ID NO: 511717 - DNA, 25 bp, Mus musculus
aatgagctgatgtgcgactttgaga

SEQ ID NO: 511718 - DNA, 25 bp, Mus musculus
aatgagctgttcaagctgacacggg

SEQ ID NO: 511719 - DNA, 25 bp, Mus musculus
aatgagctgttctagctgacacggg

SEQ ID NO: 511720 - DNA, 25 bp, Mus musculus
aatgaggacacgaggcctggagttc

SEQ ID NO: 511721 - DNA, 25 bp, Mus musculus
aatgaggacacgatggagccactgc

SEQ ID NO: 511722 - DNA, 25 bp, Mus musculus
aatgaggacacgtggcctggagttc

SEQ ID NO: 511723 - DNA, 25 bp, Mus musculus
aatgaggacacgttggagccactgc

SEQ ID NO: 511724 - DNA, 25 bp, Mus musculus
aatgaggagatgatcagggaccacc

SEQ ID NO: 511725 - DNA, 25 bp, Mus musculus
aatgaggagatgttcagggaccacc

SEQ ID NO: 511726 - DNA, 25 bp, Mus musculus
aatgaggagggcaacttcgtcacac

SEQ ID NO: 511727 - DNA, 25 bp, Mus musculus
aatgaggagggctacttcgtcacac

SEQ ID NO: 511728 - DNA, 25 bp, Mus musculus
aatgaggatgacagctggaatggca

SEQ ID NO: 511729 - DNA, 25 bp, Mus musculus
aatgaggatgactgctggaatggca

SEQ ID NO: 511730 - DNA, 25 bp, Mus musculus
aatgaggatgccctaatgaatgctg

SEQ ID NO: 511731 - DNA, 25 bp, Mus musculus
aatgaggatgccgtaatgaatgctg

SEQ ID NO: 511732 - DNA, 25 bp, Mus musculus
aatgaggctcctccggatacagcga

SEQ ID NO: 511733 - DNA, 25 bp, Mus musculus
aatgaggctcctgcggatacagcga

SEQ ID NO: 511734 - DNA, 25 bp, Mus musculus
aatgagggtgtcagctccgtgcttc

SEQ ID NO: 511735 - DNA, 25 bp, Mus musculus
aatgagggtgtctgctccgtgcttc

SEQ ID NO: 511736 - DNA, 25 bp, Mus musculus
aatgaggtatacagggacttaagag

SEQ ID NO: 511737 - DNA, 25 bp, Mus musculus
aatgaggtatactgggacttaagag

SEQ ID NO: 511738 - DNA, 25 bp, Mus musculus
aatgaggtccgcagcttgctgggtc

SEQ ID NO: 511739 - DNA, 25 bp, Mus musculus
aatgaggtccgctgcttgctgggtc

SEQ ID NO: 511740 - DNA, 25 bp, Mus musculus
aatgaggtctctcgactcggcgtgc

SEQ ID NO: 511741 - DNA, 25 bp, Mus musculus
aatgaggtctctggactcggcgtgc

SEQ ID NO: 511742 - DNA, 25 bp, Mus musculus
aatgaggtgctccatctcaggtcac

SEQ ID NO: 511743 - DNA, 25 bp, Mus musculus
aatgaggtgctcgatctcaggtcac

SEQ ID NO: 511744 - DNA, 25 bp, Mus musculus
aatgaggtggaaaaccagatcctca

SEQ ID NO: 511745 - DNA, 25 bp, Mus musculus
aatgaggtggaataccagatcctca

SEQ ID NO: 511746 - DNA, 25 bp, Mus musculus
aatgaggtgtccatggtgctcacgg

SEQ ID NO: 511747 - DNA, 25 bp, Mus musculus
aatgaggtgtccttggtgctcacgg

SEQ ID NO: 511748 - DNA, 25 bp, Mus musculus
aatgagtacagcaacatagaggagt

SEQ ID NO: 511749 - DNA, 25 bp, Mus musculus
aatgagtacagctacatagaggagt

SEQ ID NO: 511750 - DNA, 25 bp, Mus musculus
aatgagtaccacaggctgggtcgga

SEQ ID NO: 511751 - DNA, 25 bp, Mus musculus
aatgagtaccactggctgggtcgga

SEQ ID NO: 511752 - DNA, 25 bp, Mus musculus
aatgagtcaaacacaaacagcgagg

SEQ ID NO: 511753 - DNA, 25 bp, Mus musculus
aatgagtcaaactcaaacagcgagg

SEQ ID NO: 511754 - DNA, 25 bp, Mus musculus
aatgagtctgcaagtcttaaatgac

SEQ ID NO: 511755 - DNA, 25 bp, Mus musculus
aatgagtctgcatgtcttaaatgac

SEQ ID NO: 511756 - DNA, 25 bp, Mus musculus
aatgagtgcatcaccgggcaaaacc

SEQ ID NO: 511757 - DNA, 25 bp, Mus musculus
aatgagtgcatctccgggcaaaacc

SEQ ID NO: 511758 - DNA, 25 bp, Mus musculus
aatgagtggcagagcaccagggttc

SEQ ID NO: 511759 - DNA, 25 bp, Mus musculus
aatgagtggcagtgcaccagggttc

SEQ ID NO: 511760 - DNA, 25 bp, Mus musculus
aatgagtgtgagacaggtgtgcatc

SEQ ID NO: 511761 - DNA, 25 bp, Mus musculus
aatgagtgtgagaccgggcagcaca

SEQ ID NO: 511762 - DNA, 25 bp, Mus musculus
aatgagtgtgagtcaggtgtgcatc

SEQ ID NO: 511763 - DNA, 25 bp, Mus musculus
aatgagtgtgagtccgggcagcaca

SEQ ID NO: 511764 - DNA, 25 bp, Mus musculus
aatgagttaggcctggaccctcatg

SEQ ID NO: 511765 - DNA, 25 bp, Mus musculus
aatgagttaggcgtggaccctcatg

SEQ ID NO: 511766 - DNA, 25 bp, Mus musculus
aatgagttcagccacgacagtcgca

SEQ ID NO: 511767 - DNA, 25 bp, Mus musculus
aatgagttcagcgacgacagtcgca

SEQ ID NO: 511768 - DNA, 25 bp, Mus musculus
aatgagtttctgacccgcttaaaag

SEQ ID NO: 511769 - DNA, 25 bp, Mus musculus
aatgagtttctgtcccgcttaaaag

SEQ ID NO: 511770 - DNA, 25 bp, Mus musculus
aatgataaacgaaggagcttcctgg

SEQ ID NO: 511771 - DNA, 25 bp, Mus musculus
aatgataaacgatggagcttcctgg

SEQ ID NO: 511772 - DNA, 25 bp, Mus musculus
aatgataagatccttcccatcagcc

SEQ ID NO: 511773 - DNA, 25 bp, Mus musculus
aatgataagatcgttcccatcagcc

SEQ ID NO: 511774 - DNA, 25 bp, Mus musculus
aatgatactcctcaaaacactctga

SEQ ID NO: 511775 - DNA, 25 bp, Mus musculus
aatgatactcctgaaaacactctga

SEQ ID NO: 511776 - DNA, 25 bp, Mus musculus
aatgataggctgagtctctcaaagt

SEQ ID NO: 511777 - DNA, 25 bp, Mus musculus
aatgataggctgtgtctctcaaagt

SEQ ID NO: 511778 - DNA, 25 bp, Mus musculus
aatgatagggtgagcagcatgtgcc

SEQ ID NO: 511779 - DNA, 25 bp, Mus musculus
aatgatagggtgtgcagcatgtgcc

SEQ ID NO: 511780 - DNA, 25 bp, Mus musculus
aatgatatcataatgcagtcttgaa

SEQ ID NO: 511781 - DNA, 25 bp, Mus musculus
aatgatatcatattgcagtcttgaa

SEQ ID NO: 511782 - DNA, 25 bp, Mus musculus
aatgatatttccaaagtttgcagga

SEQ ID NO: 511783 - DNA, 25 bp, Mus musculus
aatgatatttcctaagtttgcagga

SEQ ID NO: 511784 - DNA, 25 bp, Mus musculus
aatgatcaaacccagaattgttctc

SEQ ID NO: 511785 - DNA, 25 bp, Mus musculus
aatgatcaaaccgagaattgttctc

SEQ ID NO: 511786 - DNA, 25 bp, Mus musculus
aatgatcaatcgctgtgctctcggc

SEQ ID NO: 511787 - DNA, 25 bp, Mus musculus
aatgatcaatcggtgtgctctcggc

SEQ ID NO: 511788 - DNA, 25 bp, Mus musculus
aatgatcacaggcactgacttggtg

SEQ ID NO: 511789 - DNA, 25 bp, Mus musculus
aatgatcacagggactgacttggtg

SEQ ID NO: 511790 - DNA, 25 bp, Mus musculus
aatgatcacagtcccctcgctcagt

SEQ ID NO: 511791 - DNA, 25 bp, Mus musculus
aatgatcacagtgccctcgctcagt

SEQ ID NO: 511792 - DNA, 25 bp, Mus musculus
aatgatcagaggcagaagatttata

SEQ ID NO: 511793 - DNA, 25 bp, Mus musculus
aatgatcagagggagaagatttata

SEQ ID NO: 511794 - DNA, 25 bp, Mus musculus
aatgatcagatcaacccatggagac

SEQ ID NO: 511795 - DNA, 25 bp, Mus musculus
aatgatcagatctacccatggagac

SEQ ID NO: 511796 - DNA, 25 bp, Mus musculus
aatgatccactgcaagcagcacgtg

SEQ ID NO: 511797 - DNA, 25 bp, Mus musculus
aatgatccactggaagcagcacgtg

SEQ ID NO: 511798 - DNA, 25 bp, Mus musculus
aatgatccctccaaaatttactctc

SEQ ID NO: 511799 - DNA, 25 bp, Mus musculus
aatgatccctcctaaatttactctc

SEQ ID NO: 511800 - DNA, 25 bp, Mus musculus
aatgatccggctagatgaagttccc

SEQ ID NO: 511801 - DNA, 25 bp, Mus musculus
aatgatccggcttgatgaagttccc

SEQ ID NO: 511802 - DNA, 25 bp, Mus musculus
aatgatcgacaacaacctgcgggag

SEQ ID NO: 511803 - DNA, 25 bp, Mus musculus
aatgatcgacaagaacctgcgggag

SEQ ID NO: 511804 - DNA, 25 bp, Mus musculus
aatgatcgagatagtaaaggatgcc

SEQ ID NO: 511805 - DNA, 25 bp, Mus musculus
aatgatcgagattgtaaaggatgcc

SEQ ID NO: 511806 - DNA, 25 bp, Mus musculus
aatgatcggcaaagcagtggagcac

SEQ ID NO: 511807 - DNA, 25 bp, Mus musculus
aatgatcggcaatgcagtggagcac

SEQ ID NO: 511808 - DNA, 25 bp, Mus musculus
aatgatcggcttcctgtctccaaga

SEQ ID NO: 511809 - DNA, 25 bp, Mus musculus
aatgatcggcttgctgtctccaaga

SEQ ID NO: 511810 - DNA, 25 bp, Mus musculus
aatgatcgggatcagttgtacacag

SEQ ID NO: 511811 - DNA, 25 bp, Mus musculus
aatgatcgggatgagttgtacacag

SEQ ID NO: 511812 - DNA, 25 bp, Mus musculus
aatgatcttgctcttgtggatgtca

SEQ ID NO: 511813 - DNA, 25 bp, Mus musculus
aatgatcttgctgttgtggatgtca

SEQ ID NO: 511814 - DNA, 25 bp, Mus musculus
aatgatgaccgcatgtgcctagacc

SEQ ID NO: 511815 - DNA, 25 bp, Mus musculus
aatgatgaccgcttgtgcctagacc

SEQ ID NO: 511816 - DNA, 25 bp, Mus musculus
aatgatgaggatcatggacctcaga

SEQ ID NO: 511817 - DNA, 25 bp, Mus musculus
aatgatgaggatgatggacctcaga

SEQ ID NO: 511818 - DNA, 25 bp, Mus musculus
aatgatgaggccaatgcagaggagt

SEQ ID NO: 511819 - DNA, 25 bp, Mus musculus
aatgatgaggcctatgcagaggagt

SEQ ID NO: 511820 - DNA, 25 bp, Mus musculus
aatgatgattccaagtcacctggaa

SEQ ID NO: 511821 - DNA, 25 bp, Mus musculus
aatgatgattcctagtcacctggaa

SEQ ID NO: 511822 - DNA, 25 bp, Mus musculus
aatgatgcagcgagtattcagagga

SEQ ID NO: 511823 - DNA, 25 bp, Mus musculus
aatgatgcagcgtgtattcagagga

SEQ ID NO: 511824 - DNA, 25 bp, Mus musculus
aatgatgcatttcgttcctttgttc

SEQ ID NO: 511825 - DNA, 25 bp, Mus musculus
aatgatgcatttggttcctttgttc

SEQ ID NO: 511826 - DNA, 25 bp, Mus musculus
aatgatgccaataggttcaggaaaa

SEQ ID NO: 511827 - DNA, 25 bp, Mus musculus
aatgatgccaattggttcaggaaaa

SEQ ID NO: 511828 - DNA, 25 bp, Mus musculus
aatgatggaggcatatgtgcctggc

SEQ ID NO: 511829 - DNA, 25 bp, Mus musculus
aatgatggaggcttatgtgcctggc

SEQ ID NO: 511830 - DNA, 25 bp, Mus musculus
aatgatggtttcaatctgtgaacag

SEQ ID NO: 511831 - DNA, 25 bp, Mus musculus
aatgatggtttctatctgtgaacag

SEQ ID NO: 511832 - DNA, 25 bp, Mus musculus
aatgatgtatcccaagccaaagccc

SEQ ID NO: 511833 - DNA, 25 bp, Mus musculus
aatgatgtatccgaagccaaagccc

SEQ ID NO: 511834 - DNA, 25 bp, Mus musculus
aatgatgtgaaacttgacttcaagg

SEQ ID NO: 511835 - DNA, 25 bp, Mus musculus
aatgatgtgaaagttgacttcaagg

SEQ ID NO: 511836 - DNA, 25 bp, Mus musculus
aatgatgttttgaagcagcgagagc

SEQ ID NO: 511837 - DNA, 25 bp, Mus musculus
aatgatgttttgtagcagcgagagc

SEQ ID NO: 511838 - DNA, 25 bp, Mus musculus
aatgattaacagcaagccaggcagc

SEQ ID NO: 511839 - DNA, 25 bp, Mus musculus
aatgattaacaggaagccaggcagc

SEQ ID NO: 511840 - DNA, 25 bp, Mus musculus
aatgattaaggactgtgatgtggcc

SEQ ID NO: 511841 - DNA, 25 bp, Mus musculus
aatgattaaggagtgtgatgtggcc

SEQ ID NO: 511842 - DNA, 25 bp, Mus musculus
aatgattacaatcaagtaagtgccc

SEQ ID NO: 511843 - DNA, 25 bp, Mus musculus
aatgattacaatgaagtaagtgccc

SEQ ID NO: 511844 - DNA, 25 bp, Mus musculus
aatgattggcagctataattttggg

SEQ ID NO: 511845 - DNA, 25 bp, Mus musculus
aatgattggcaggtataattttggg

SEQ ID NO: 511846 - DNA, 25 bp, Mus musculus
aatgattgttcgagcaagacagatg

SEQ ID NO: 511847 - DNA, 25 bp, Mus musculus
aatgattgttcgtgcaagacagatg

SEQ ID NO: 511848 - DNA, 25 bp, Mus musculus
aatgatttaccgaccaatgtctatg

SEQ ID NO: 511849 - DNA, 25 bp, Mus musculus
aatgatttaccgtccaatgtctatg

SEQ ID NO: 511850 - DNA, 25 bp, Mus musculus
aatgattttgaaagcctcagtagtg

SEQ ID NO: 511851 - DNA, 25 bp, Mus musculus
aatgattttgaatgcctcagtagtg

SEQ ID NO: 511852 - DNA, 25 bp, Mus musculus
aatgcaaaatggatgccgagtcatg

SEQ ID NO: 511853 - DNA, 25 bp, Mus musculus
aatgcaaaatggttgccgagtcatg

SEQ ID NO: 511854 - DNA, 25 bp, Mus musculus
aatgcaaacacgcagggatctgtga

SEQ ID NO: 511855 - DNA, 25 bp, Mus musculus
aatgcaaacacggagggatctgtga

SEQ ID NO: 511856 - DNA, 25 bp, Mus musculus
aatgcaaagaaaaggcgggaaccgt

SEQ ID NO: 511857 - DNA, 25 bp, Mus musculus
aatgcaaagaaatggcgggaaccgt

SEQ ID NO: 511858 - DNA, 25 bp, Mus musculus
aatgcaaagagtactgtggagtccc

SEQ ID NO: 511859 - DNA, 25 bp, Mus musculus
aatgcaaagagttctgtggagtccc

SEQ ID NO: 511860 - DNA, 25 bp, Mus musculus
aatgcaaagcagcaatgaggaaggc

SEQ ID NO: 511861 - DNA, 25 bp, Mus musculus
aatgcaaagcaggaatgaggaaggc

SEQ ID NO: 511862 - DNA, 25 bp, Mus musculus
aatgcaaccgttcccagtgcctgga

SEQ ID NO: 511863 - DNA, 25 bp, Mus musculus
aatgcaaccgttgccagtgcctgga

SEQ ID NO: 511864 - DNA, 25 bp, Mus musculus
aatgcaagacacaaacttggctgga

SEQ ID NO: 511865 - DNA, 25 bp, Mus musculus
aatgcaagacactaacttggctgga

SEQ ID NO: 511866 - DNA, 25 bp, Mus musculus
aatgcaagagggcaccgcaaaccct

SEQ ID NO: 511867 - DNA, 25 bp, Mus musculus
aatgcaagaggggaccgcaaaccct

SEQ ID NO: 511868 - DNA, 25 bp, Mus musculus
aatgcaagttcacacagaaacccag

SEQ ID NO: 511869 - DNA, 25 bp, Mus musculus
aatgcaagttcagacagaaacccag

SEQ ID NO: 511870 - DNA, 25 bp, Mus musculus
aatgcaatagagcaagagttccggc

SEQ ID NO: 511871 - DNA, 25 bp, Mus musculus
aatgcaatagaggaagagttccggc

SEQ ID NO: 511872 - DNA, 25 bp, Mus musculus
aatgcaatcgacacaaaccctggcg

SEQ ID NO: 511873 - DNA, 25 bp, Mus musculus
aatgcaatcgactcaaaccctggcg

SEQ ID NO: 511874 - DNA, 25 bp, Mus musculus
aatgcaattcttactccacgctcag

SEQ ID NO: 511875 - DNA, 25 bp, Mus musculus
aatgcaattctttctccacgctcag

SEQ ID NO: 511876 - DNA, 25 bp, Mus musculus
aatgcaattttcacagattcagatc

SEQ ID NO: 511877 - DNA, 25 bp, Mus musculus
aatgcaattttctcagattcagatc

SEQ ID NO: 511878 - DNA, 25 bp, Mus musculus
aatgcacaatatcaaggatatcgac

SEQ ID NO: 511879 - DNA, 25 bp, Mus musculus
aatgcacaatatgaaggatatcgac

SEQ ID NO: 511880 - DNA, 25 bp, Mus musculus
aatgcacactctcgaagccaatggc

SEQ ID NO: 511881 - DNA, 25 bp, Mus musculus
aatgcacactctggaagccaatggc

SEQ ID NO: 511882 - DNA, 25 bp, Mus musculus
aatgcaccagtgatcagaagaaaag

SEQ ID NO: 511883 - DNA, 25 bp, Mus musculus
aatgcaccagtgttcagaagaaaag

SEQ ID NO: 511884 - DNA, 25 bp, Mus musculus
aatgcacccctgcactactatgaaa

SEQ ID NO: 511885 - DNA, 25 bp, Mus musculus
aatgcacccctggactactatgaaa

SEQ ID NO: 511886 - DNA, 25 bp, Mus musculus
aatgcacccttgaacttggctgagt

SEQ ID NO: 511887 - DNA, 25 bp, Mus musculus
aatgcacccttgtacttggctgagt

SEQ ID NO: 511888 - DNA, 25 bp, Mus musculus
aatgcacctagcactgcacctagtg

SEQ ID NO: 511889 - DNA, 25 bp, Mus musculus
aatgcacctagctctgcacctagtg

SEQ ID NO: 511890 - DNA, 25 bp, Mus musculus
aatgcagaaggaaggacaggatgtc

SEQ ID NO: 511891 - DNA, 25 bp, Mus musculus
aatgcagaaggatggacaggatgtc

SEQ ID NO: 511892 - DNA, 25 bp, Mus musculus
aatgcagacctgaactccatggaaa

SEQ ID NO: 511893 - DNA, 25 bp, Mus musculus
aatgcagacctgtactccatggaaa

SEQ ID NO: 511894 - DNA, 25 bp, Mus musculus
aatgcagagaagacaactggtggaa

SEQ ID NO: 511895 - DNA, 25 bp, Mus musculus
aatgcagagaagtcaactggtggaa

SEQ ID NO: 511896 - DNA, 25 bp, Mus musculus
aatgcagagcctccggctttctata

SEQ ID NO: 511897 - DNA, 25 bp, Mus musculus
aatgcagagcctgcggctttctata

SEQ ID NO: 511898 - DNA, 25 bp, Mus musculus
aatgcagagtcaagaaagggaatcc

SEQ ID NO: 511899 - DNA, 25 bp, Mus musculus
aatgcagagtcatgaaagggaatcc

SEQ ID NO: 511900 - DNA, 25 bp, Mus musculus
aatgcagcacatcttggaggtctcc

SEQ ID NO: 511901 - DNA, 25 bp, Mus musculus
aatgcagcacatgttggaggtctcc

SEQ ID NO: 511902 - DNA, 25 bp, Mus musculus
aatgcagccaatcaaggactacgcc

SEQ ID NO: 511903 - DNA, 25 bp, Mus musculus
aatgcagccaatgaaggactacgcc

SEQ ID NO: 511904 - DNA, 25 bp, Mus musculus
aatgcagccacgcagatcttcttct

SEQ ID NO: 511905 - DNA, 25 bp, Mus musculus
aatgcagccacggagatcttcttct

SEQ ID NO: 511906 - DNA, 25 bp, Mus musculus
aatgcagctcatcttttgatgaccc

SEQ ID NO: 511907 - DNA, 25 bp, Mus musculus
aatgcagctcatgttttgatgaccc

SEQ ID NO: 511908 - DNA, 25 bp, Mus musculus
aatgcagctcttcagaacagcactg

SEQ ID NO: 511909 - DNA, 25 bp, Mus musculus
aatgcagctcttgagaacagcactg

SEQ ID NO: 511910 - DNA, 25 bp, Mus musculus
aatgcaggaatgagaaaatactttc

SEQ ID NO: 511911 - DNA, 25 bp, Mus musculus
aatgcaggaatgtgaaaatactttc

SEQ ID NO: 511912 - DNA, 25 bp, Mus musculus
aatgcaggatgtccacgttcttgtc

SEQ ID NO: 511913 - DNA, 25 bp, Mus musculus
aatgcaggatgtgcacgttcttgtc

SEQ ID NO: 511914 - DNA, 25 bp, Mus musculus
aatgcaggcaatcccaataaagccg

SEQ ID NO: 511915 - DNA, 25 bp, Mus musculus
aatgcaggcaatgccaataaagccg

SEQ ID NO: 511916 - DNA, 25 bp, Mus musculus
aatgcaggcgtaagtcttccctgtt

SEQ ID NO: 511917 - DNA, 25 bp, Mus musculus
aatgcaggcgtatgtcttccctgtt

SEQ ID NO: 511918 - DNA, 25 bp, Mus musculus
aatgcagggccccattccagagcga

SEQ ID NO: 511919 - DNA, 25 bp, Mus musculus
aatgcagggcccgattccagagcga

SEQ ID NO: 511920 - DNA, 25 bp, Mus musculus
aatgcaggggcaagaaatggcctcg

SEQ ID NO: 511921 - DNA, 25 bp, Mus musculus
aatgcaggggcatgaaatggcctcg

SEQ ID NO: 511922 - DNA, 25 bp, Mus musculus
aatgcagttcatccaggaagtagcc

SEQ ID NO: 511923 - DNA, 25 bp, Mus musculus
aatgcagttcatgcaggaagtagcc

SEQ ID NO: 511924 - DNA, 25 bp, Mus musculus
aatgcatccacaaaaggcggccagg

SEQ ID NO: 511925 - DNA, 25 bp, Mus musculus
aatgcatccacataaggcggccagg

SEQ ID NO: 511926 - DNA, 25 bp, Mus musculus
aatgcatccattagcaacacacggg

SEQ ID NO: 511927 - DNA, 25 bp, Mus musculus
aatgcatccatttgcaacacacggg

SEQ ID NO: 511928 - DNA, 25 bp, Mus musculus
aatgcatcgtgcaggaccgagtgcc

SEQ ID NO: 511929 - DNA, 25 bp, Mus musculus
aatgcatcgtgctggaccgagtgcc

SEQ ID NO: 511930 - DNA, 25 bp, Mus musculus
aatgcatctgcaattgaccagctta

SEQ ID NO: 511931 - DNA, 25 bp, Mus musculus
aatgcatctgcatttgaccagctta

SEQ ID NO: 511932 - DNA, 25 bp, Mus musculus
aatgcatcttaacagaaatacagag

SEQ ID NO: 511933 - DNA, 25 bp, Mus musculus
aatgcatcttaagagaaatacagag

SEQ ID NO: 511934 - DNA, 25 bp, Mus musculus
aatgcatgatgaccaggcaaacccc

SEQ ID NO: 511935 - DNA, 25 bp, Mus musculus
aatgcatgatgagcaggcaaacccc

SEQ ID NO: 511936 - DNA, 25 bp, Mus musculus
aatgcatgcggcaagcccattgggc

SEQ ID NO: 511937 - DNA, 25 bp, Mus musculus
aatgcatgcggctagcccattgggc

SEQ ID NO: 511938 - DNA, 25 bp, Mus musculus
aatgcatgtcagcactgtgcaaaga

SEQ ID NO: 511939 - DNA, 25 bp, Mus musculus
aatgcatgtcaggactgtgcaaaga

SEQ ID NO: 511940 - DNA, 25 bp, Mus musculus
aatgcattcgacacggaccacaatg

SEQ ID NO: 511941 - DNA, 25 bp, Mus musculus
aatgcattcgactcggaccacaatg

SEQ ID NO: 511942 - DNA, 25 bp, Mus musculus
aatgcattgacaagattatcggccg

SEQ ID NO: 511943 - DNA, 25 bp, Mus musculus
aatgcattgacatgattatcggccg

SEQ ID NO: 511944 - DNA, 25 bp, Mus musculus
aatgcattgagaaacttcgcctgtc

SEQ ID NO: 511945 - DNA, 25 bp, Mus musculus
aatgcattgagatacttcgcctgtc

SEQ ID NO: 511946 - DNA, 25 bp, Mus musculus
aatgcattggagattactccggacc

SEQ ID NO: 511947 - DNA, 25 bp, Mus musculus
aatgcattggagtttactccggacc

SEQ ID NO: 511948 - DNA, 25 bp, Mus musculus
aatgccaaagagatcgccagaaccg

SEQ ID NO: 511949 - DNA, 25 bp, Mus musculus
aatgccaaagagttcgccagaaccg

SEQ ID NO: 511950 - DNA, 25 bp, Mus musculus
aatgccacatcactggcggatggag

SEQ ID NO: 511951 - DNA, 25 bp, Mus musculus
aatgccacatcagtggcggatggag

SEQ ID NO: 511952 - DNA, 25 bp, Mus musculus
aatgccagaacaaccataagtctct

SEQ ID NO: 511953 - DNA, 25 bp, Mus musculus
aatgccagaacatccataagtctct

SEQ ID NO: 511954 - DNA, 25 bp, Mus musculus
aatgccagcacgcataactcagtca

SEQ ID NO: 511955 - DNA, 25 bp, Mus musculus
aatgccagcacggataactcagtca

SEQ ID NO: 511956 - DNA, 25 bp, Mus musculus
aatgccagcaggcacgttgtcaccc

SEQ ID NO: 511957 - DNA, 25 bp, Mus musculus
aatgccagcagggacgttgtcaccc

SEQ ID NO: 511958 - DNA, 25 bp, Mus musculus
aatgccagcctgatacccacttcat

SEQ ID NO: 511959 - DNA, 25 bp, Mus musculus
aatgccagcctgttacccacttcat

SEQ ID NO: 511960 - DNA, 25 bp, Mus musculus
aatgccaggaacaaggacgagatgt

SEQ ID NO: 511961 - DNA, 25 bp, Mus musculus
aatgccaggaactaggacgagatgt

SEQ ID NO: 511962 - DNA, 25 bp, Mus musculus
aatgccaggactaggcctgtgagaa

SEQ ID NO: 511963 - DNA, 25 bp, Mus musculus
aatgccaggacttggcctgtgagaa

SEQ ID NO: 511964 - DNA, 25 bp, Mus musculus
aatgccagtgacacacagatttcct

SEQ ID NO: 511965 - DNA, 25 bp, Mus musculus
aatgccagtgactcacagatttcct

SEQ ID NO: 511966 - DNA, 25 bp, Mus musculus
aatgccagtgcccaacaggtcttta

SEQ ID NO: 511967 - DNA, 25 bp, Mus musculus
aatgccagtgccgaacaggtcttta

SEQ ID NO: 511968 - DNA, 25 bp, Mus musculus
aatgccatccatccaccggatactg

SEQ ID NO: 511969 - DNA, 25 bp, Mus musculus
aatgccatccatgcaccggatactg

SEQ ID NO: 511970 - DNA, 25 bp, Mus musculus
aatgccatcctaaccaacccagtgg

SEQ ID NO: 511971 - DNA, 25 bp, Mus musculus
aatgccatcctatccaacccagtgg

SEQ ID NO: 511972 - DNA, 25 bp, Mus musculus
aatgccatcggtccagagtacagtt

SEQ ID NO: 511973 - DNA, 25 bp, Mus musculus
aatgccatcggtgcagagtacagtt

SEQ ID NO: 511974 - DNA, 25 bp, Mus musculus
aatgccatgaacagggctttctgga

SEQ ID NO: 511975 - DNA, 25 bp, Mus musculus
aatgccatgaactgggctttctgga

SEQ ID NO: 511976 - DNA, 25 bp, Mus musculus
aatgccatgacacaaagtggcgtga

SEQ ID NO: 511977 - DNA, 25 bp, Mus musculus
aatgccatgacagaaagtggcgtga

SEQ ID NO: 511978 - DNA, 25 bp, Mus musculus
aatgccatgaggctgtttggtgact

SEQ ID NO: 511979 - DNA, 25 bp, Mus musculus
aatgccatgagggtgtttggtgact

SEQ ID NO: 511980 - DNA, 25 bp, Mus musculus
aatgccatgggaaaagccgtcatca

SEQ ID NO: 511981 - DNA, 25 bp, Mus musculus
aatgccatgggataagccgtcatca

SEQ ID NO: 511982 - DNA, 25 bp, Mus musculus
aatgccatgggcaccaccatggtgg

SEQ ID NO: 511983 - DNA, 25 bp, Mus musculus
aatgccatgggctccaccatggtgg

SEQ ID NO: 511984 - DNA, 25 bp, Mus musculus
aatgccattcagcagatgggtggcc

SEQ ID NO: 511985 - DNA, 25 bp, Mus musculus
aatgccattcaggagatgggtggcc

SEQ ID NO: 511986 - DNA, 25 bp, Mus musculus
aatgccattgatccgagggaactgt

SEQ ID NO: 511987 - DNA, 25 bp, Mus musculus
aatgccattgatgcgagggaactgt

SEQ ID NO: 511988 - DNA, 25 bp, Mus musculus
aatgcccaacgacgaggccagagcc

SEQ ID NO: 511989 - DNA, 25 bp, Mus musculus
aatgcccaacgaggaggccagagcc

SEQ ID NO: 511990 - DNA, 25 bp, Mus musculus
aatgcccactgtccattatgaaatg

SEQ ID NO: 511991 - DNA, 25 bp, Mus musculus
aatgcccactgtgcattatgaaatg

SEQ ID NO: 511992 - DNA, 25 bp, Mus musculus
aatgcccactttataggactgtaga

SEQ ID NO: 511993 - DNA, 25 bp, Mus musculus
aatgcccactttttaggactgtaga

SEQ ID NO: 511994 - DNA, 25 bp, Mus musculus
aatgcccagcaactacacttccgga

SEQ ID NO: 511995 - DNA, 25 bp, Mus musculus
aatgcccagcaagtacacttccgga

SEQ ID NO: 511996 - DNA, 25 bp, Mus musculus
aatgcccaggaaacagccaagagtg

SEQ ID NO: 511997 - DNA, 25 bp, Mus musculus
aatgcccaggaatcagccaagagtg

SEQ ID NO: 511998 - DNA, 25 bp, Mus musculus
aatgcccaggctattgctgacctca

SEQ ID NO: 511999 - DNA, 25 bp, Mus musculus
aatgcccaggcttttgctgacctca

SEQ ID NO: 512000 - DNA, 25 bp, Mus musculus
aatgcccaggttatcctggctggaa

SEQ ID NO: 512001 - DNA, 25 bp, Mus musculus
aatgcccaggttttcctggctggaa

SEQ ID NO: 512002 - DNA, 25 bp, Mus musculus
aatgccccagccactagctattgtg

SEQ ID NO: 512003 - DNA, 25 bp, Mus musculus
aatgccccagcctctagctattgtg

SEQ ID NO: 512004 - DNA, 25 bp, Mus musculus
aatgccccagtgctgttgttaatga

SEQ ID NO: 512005 - DNA, 25 bp, Mus musculus
aatgccccagtggtgttgttaatga

SEQ ID NO: 512006 - DNA, 25 bp, Mus musculus
aatgcccctggaagcactgtgacca

SEQ ID NO: 512007 - DNA, 25 bp, Mus musculus
aatgcccctggatgcactgtgacca

SEQ ID NO: 512008 - DNA, 25 bp, Mus musculus
aatgcccctgtgattgagaagagcc

SEQ ID NO: 512009 - DNA, 25 bp, Mus musculus
aatgcccctgtgtttgagaagagcc

SEQ ID NO: 512010 - DNA, 25 bp, Mus musculus
aatgcccgtctcctcctgtgcaaga

SEQ ID NO: 512011 - DNA, 25 bp, Mus musculus
aatgcccgtctcgtcctgtgcaaga

SEQ ID NO: 512012 - DNA, 25 bp, Mus musculus
aatgccctgaagcaggatatgagca

SEQ ID NO: 512013 - DNA, 25 bp, Mus musculus
aatgccctgaaggaggatatgagca

SEQ ID NO: 512014 - DNA, 25 bp, Mus musculus
aatgccctgccaccaagtgacgtga

SEQ ID NO: 512015 - DNA, 25 bp, Mus musculus
aatgccctgccagcaagtgacgtga

SEQ ID NO: 512016 - DNA, 25 bp, Mus musculus
aatgcccttggaatttctgtgggcc

SEQ ID NO: 512017 - DNA, 25 bp, Mus musculus
aatgcccttggacaaggtggttctg

SEQ ID NO: 512018 - DNA, 25 bp, Mus musculus
aatgcccttggagaaggtggttctg

SEQ ID NO: 512019 - DNA, 25 bp, Mus musculus
aatgcccttggattttctgtgggcc

SEQ ID NO: 512020 - DNA, 25 bp, Mus musculus
aatgccgaatgaaaatgataagctg

SEQ ID NO: 512021 - DNA, 25 bp, Mus musculus
aatgccgaatgataatgataagctg

SEQ ID NO: 512022 - DNA, 25 bp, Mus musculus
aatgccgccattcttattgtatacg

SEQ ID NO: 512023 - DNA, 25 bp, Mus musculus
aatgccgccattgttattgtatacg

SEQ ID NO: 512024 - DNA, 25 bp, Mus musculus
aatgccgcgggtctacatcggccgc

SEQ ID NO: 512025 - DNA, 25 bp, Mus musculus
aatgccgcgggtgtacatcggccgc

SEQ ID NO: 512026 - DNA, 25 bp, Mus musculus
aatgccggacacagaatcaaattca

SEQ ID NO: 512027 - DNA, 25 bp, Mus musculus
aatgccggacactgaatcaaattca

SEQ ID NO: 512028 - DNA, 25 bp, Mus musculus
aatgccggatcacatctaactttgt

SEQ ID NO: 512029 - DNA, 25 bp, Mus musculus
aatgccggatcagatctaactttgt

SEQ ID NO: 512030 - DNA, 25 bp, Mus musculus
aatgccgggctcacaatgctgccga

SEQ ID NO: 512031 - DNA, 25 bp, Mus musculus
aatgccgggctctcaatgctgccga

SEQ ID NO: 512032 - DNA, 25 bp, Mus musculus
aatgccgtcttcctctcaaaccaag

SEQ ID NO: 512033 - DNA, 25 bp, Mus musculus
aatgccgtcttcgtctcaaaccaag

SEQ ID NO: 512034 - DNA, 25 bp, Mus musculus
aatgcctaccgccaggtaaaggaag

SEQ ID NO: 512035 - DNA, 25 bp, Mus musculus
aatgcctaccgcgaggtaaaggaag

SEQ ID NO: 512036 - DNA, 25 bp, Mus musculus
aatgcctactatctgcccaacaaga

SEQ ID NO: 512037 - DNA, 25 bp, Mus musculus
aatgcctactatgtgcccaacaaga

SEQ ID NO: 512038 - DNA, 25 bp, Mus musculus
aatgcctcctcaagtatcagctccg

SEQ ID NO: 512039 - DNA, 25 bp, Mus musculus
aatgcctcctcatgtatcagctccg

SEQ ID NO: 512040 - DNA, 25 bp, Mus musculus
aatgcctctggaaaacatgtcccca

SEQ ID NO: 512041 - DNA, 25 bp, Mus musculus
aatgcctctggataacatgtcccca

SEQ ID NO: 512042 - DNA, 25 bp, Mus musculus
aatgcctgccagctgctgcaacaga

SEQ ID NO: 512043 - DNA, 25 bp, Mus musculus
aatgcctgccaggtgctgcaacaga

SEQ ID NO: 512044 - DNA, 25 bp, Mus musculus
aatgcctgctgcacacgttccacaa

SEQ ID NO: 512045 - DNA, 25 bp, Mus musculus
aatgcctgctgctcacgttccacaa

SEQ ID NO: 512046 - DNA, 25 bp, Mus musculus
aatgcctggccgcttcctcagtgtc

SEQ ID NO: 512047 - DNA, 25 bp, Mus musculus
aatgcctggccggttcctcagtgtc

SEQ ID NO: 512048 - DNA, 25 bp, Mus musculus
aatgccttagtaccagccgttgcct

SEQ ID NO: 512049 - DNA, 25 bp, Mus musculus
aatgccttagtagcagccgttgcct

SEQ ID NO: 512050 - DNA, 25 bp, Mus musculus
aatgccttccgtaggaagcatgact

SEQ ID NO: 512051 - DNA, 25 bp, Mus musculus
aatgccttccgttggaagcatgact

SEQ ID NO: 512052 - DNA, 25 bp, Mus musculus
aatgccttcgaccaataccgagacc

SEQ ID NO: 512053 - DNA, 25 bp, Mus musculus
aatgccttcgacgaataccgagacc

SEQ ID NO: 512054 - DNA, 25 bp, Mus musculus
aatgccttctaaactactggacatg

SEQ ID NO: 512055 - DNA, 25 bp, Mus musculus
aatgccttctaatctactggacatg

SEQ ID NO: 512056 - DNA, 25 bp, Mus musculus
aatgcgaacggtccgatcaagaagc

SEQ ID NO: 512057 - DNA, 25 bp, Mus musculus
aatgcgaacggtgcgatcaagaagc

SEQ ID NO: 512058 - DNA, 25 bp, Mus musculus
aatgcgaagcctaccgcaagctctt

SEQ ID NO: 512059 - DNA, 25 bp, Mus musculus
aatgcgaagccttccgcaagctctt

SEQ ID NO: 512060 - DNA, 25 bp, Mus musculus
aatgcgaagctgaaattggtcattt

SEQ ID NO: 512061 - DNA, 25 bp, Mus musculus
aatgcgaagctgtaattggtcattt

SEQ ID NO: 512062 - DNA, 25 bp, Mus musculus
aatgcgaccttgaatcagcaactga

SEQ ID NO: 512063 - DNA, 25 bp, Mus musculus
aatgcgaccttgtatcagcaactga

SEQ ID NO: 512064 - DNA, 25 bp, Mus musculus
aatgcgagtgccaaataggtcttta

SEQ ID NO: 512065 - DNA, 25 bp, Mus musculus
aatgcgagtgcctaataggtcttta

SEQ ID NO: 512066 - DNA, 25 bp, Mus musculus
aatgcgatgcagatcgtgggctttc

SEQ ID NO: 512067 - DNA, 25 bp, Mus musculus
aatgcgatgcagttcgtgggctttc

SEQ ID NO: 512068 - DNA, 25 bp, Mus musculus
aatgcgattttaatactggcgtgga

SEQ ID NO: 512069 - DNA, 25 bp, Mus musculus
aatgcgattttattactggcgtgga

SEQ ID NO: 512070 - DNA, 25 bp, Mus musculus
aatgcgcaaggcagaataccctctg

SEQ ID NO: 512071 - DNA, 25 bp, Mus musculus
aatgcgcaaggctgaataccctctg

SEQ ID NO: 512072 - DNA, 25 bp, Mus musculus
aatgcgccgcagcaagtctccagct

SEQ ID NO: 512073 - DNA, 25 bp, Mus musculus
aatgcgccgcaggaagtctccagct

SEQ ID NO: 512074 - DNA, 25 bp, Mus musculus
aatgcgccttgtagagcctgtgggt

SEQ ID NO: 512075 - DNA, 25 bp, Mus musculus
aatgcgccttgttgagcctgtgggt

SEQ ID NO: 512076 - DNA, 25 bp, Mus musculus
aatgcgcgcaccactgtcctggcag

SEQ ID NO: 512077 - DNA, 25 bp, Mus musculus
aatgcgcgcacctctgtcctggcag

SEQ ID NO: 512078 - DNA, 25 bp, Mus musculus
aatgcggaatatatgtctccatctg

SEQ ID NO: 512079 - DNA, 25 bp, Mus musculus
aatgcggaatatttgtctccatctg

SEQ ID NO: 512080 - DNA, 25 bp, Mus musculus
aatgcggattctcatggtgggctta

SEQ ID NO: 512081 - DNA, 25 bp, Mus musculus
aatgcggattctgatggtgggctta

SEQ ID NO: 512082 - DNA, 25 bp, Mus musculus
aatgcggcatcacctcctctaagac

SEQ ID NO: 512083 - DNA, 25 bp, Mus musculus
aatgcggcatcagctcctctaagac

SEQ ID NO: 512084 - DNA, 25 bp, Mus musculus
aatgcggcgctcagggaacaaggaa

SEQ ID NO: 512085 - DNA, 25 bp, Mus musculus
aatgcggcgctctgggaacaaggaa

SEQ ID NO: 512086 - DNA, 25 bp, Mus musculus
aatgcgggaactcgcaaatcttgct

SEQ ID NO: 512087 - DNA, 25 bp, Mus musculus
aatgcgggaactggcaaatcttgct

SEQ ID NO: 512088 - DNA, 25 bp, Mus musculus
aatgcggtcacgagaacgcgcgctt

SEQ ID NO: 512089 - DNA, 25 bp, Mus musculus
aatgcggtcacgtgaacgcgcgctt

SEQ ID NO: 512090 - DNA, 25 bp, Mus musculus
aatgcgtaagccacagggaatggag

SEQ ID NO: 512091 - DNA, 25 bp, Mus musculus
aatgcgtaagcctcagggaatggag

SEQ ID NO: 512092 - DNA, 25 bp, Mus musculus
aatgcgttgaagacaaagagtatga

SEQ ID NO: 512093 - DNA, 25 bp, Mus musculus
aatgcgttgaagtcaaagagtatga

SEQ ID NO: 512094 - DNA, 25 bp, Mus musculus
aatgctacaggaaacggtgctggcc

SEQ ID NO: 512095 - DNA, 25 bp, Mus musculus
aatgctacaggatacggtgctggcc

SEQ ID NO: 512096 - DNA, 25 bp, Mus musculus
aatgctacagtaagccggagctgcc

SEQ ID NO: 512097 - DNA, 25 bp, Mus musculus
aatgctacagtatgccggagctgcc

SEQ ID NO: 512098 - DNA, 25 bp, Mus musculus
aatgctaccaagattgccctgcgcg

SEQ ID NO: 512099 - DNA, 25 bp, Mus musculus
aatgctaccaagtttgccctgcgcg

SEQ ID NO: 512100 - DNA, 25 bp, Mus musculus
aatgctaccactatgtgtttcaacg

SEQ ID NO: 512101 - DNA, 25 bp, Mus musculus
aatgctaccactttgtgtttcaacg

SEQ ID NO: 512102 - DNA, 25 bp, Mus musculus
aatgctactacacatccctggtttg

SEQ ID NO: 512103 - DNA, 25 bp, Mus musculus
aatgctactacagatccctggtttg

SEQ ID NO: 512104 - DNA, 25 bp, Mus musculus
aatgctactgctcgccatcctgctg

SEQ ID NO: 512105 - DNA, 25 bp, Mus musculus
aatgctactgctggccatcctgctg

SEQ ID NO: 512106 - DNA, 25 bp, Mus musculus
aatgctagaagaaggctctttccga

SEQ ID NO: 512107 - DNA, 25 bp, Mus musculus
aatgctagaagatggctctttccga

SEQ ID NO: 512108 - DNA, 25 bp, Mus musculus
aatgctagaatacagtcactaccag

SEQ ID NO: 512109 - DNA, 25 bp, Mus musculus
aatgctagaatagagtcactaccag

SEQ ID NO: 512110 - DNA, 25 bp, Mus musculus
aatgctagccacagtgccttcctgc

SEQ ID NO: 512111 - DNA, 25 bp, Mus musculus
aatgctagccactgtgccttcctgc

SEQ ID NO: 512112 - DNA, 25 bp, Mus musculus
aatgctagccctagagaaagcagac

SEQ ID NO: 512113 - DNA, 25 bp, Mus musculus
aatgctagcccttgagaaagcagac

SEQ ID NO: 512114 - DNA, 25 bp, Mus musculus
aatgctaggtggattgctctttggc

SEQ ID NO: 512115 - DNA, 25 bp, Mus musculus
aatgctaggtggtttgctctttggc

SEQ ID NO: 512116 - DNA, 25 bp, Mus musculus
aatgctagtgccctgagaaagactg

SEQ ID NO: 512117 - DNA, 25 bp, Mus musculus
aatgctagtgccgtgagaaagactg

SEQ ID NO: 512118 - DNA, 25 bp, Mus musculus
aatgctatatagagtgcccggaatg

SEQ ID NO: 512119 - DNA, 25 bp, Mus musculus
aatgctatatagtgtgcccggaatg

SEQ ID NO: 512120 - DNA, 25 bp, Mus musculus
aatgctattggccttccagtcccac

SEQ ID NO: 512121 - DNA, 25 bp, Mus musculus
aatgctattggcgttccagtcccac

SEQ ID NO: 512122 - DNA, 25 bp, Mus musculus
aatgctcaacatccacccatccttg

SEQ ID NO: 512123 - DNA, 25 bp, Mus musculus
aatgctcaacatgcacccatccttg

SEQ ID NO: 512124 - DNA, 25 bp, Mus musculus
aatgctcaccgacaagtatgaagac

SEQ ID NO: 512125 - DNA, 25 bp, Mus musculus
aatgctcaccgagaagtatgaagac

SEQ ID NO: 512126 - DNA, 25 bp, Mus musculus
aatgctcagctgagccagccggagt

SEQ ID NO: 512127 - DNA, 25 bp, Mus musculus
aatgctcagctgtgccagccggagt

SEQ ID NO: 512128 - DNA, 25 bp, Mus musculus
aatgctcctgctatcatcttcatcg

SEQ ID NO: 512129 - DNA, 25 bp, Mus musculus
aatgctcctgctttcatcttcatcg

SEQ ID NO: 512130 - DNA, 25 bp, Mus musculus
aatgctcctggtcgccgtcagcaag

SEQ ID NO: 512131 - DNA, 25 bp, Mus musculus
aatgctcctggtggccgtcagcaag

SEQ ID NO: 512132 - DNA, 25 bp, Mus musculus
aatgctccttttcagttaccgctga

SEQ ID NO: 512133 - DNA, 25 bp, Mus musculus
aatgctccttttgagttaccgctga

SEQ ID NO: 512134 - DNA, 25 bp, Mus musculus
aatgctcgcgacacgcgcgccggga

SEQ ID NO: 512135 - DNA, 25 bp, Mus musculus
aatgctcgcgactcgcgcgccggga

SEQ ID NO: 512136 - DNA, 25 bp, Mus musculus
aatgctcgtcggcttctgggtgatc

SEQ ID NO: 512137 - DNA, 25 bp, Mus musculus
aatgctcgtcgggttctgggtgatc

SEQ ID NO: 512138 - DNA, 25 bp, Mus musculus
aatgctctatgtcgaatttgtctga

SEQ ID NO: 512139 - DNA, 25 bp, Mus musculus
aatgctctatgtggaatttgtctga

SEQ ID NO: 512140 - DNA, 25 bp, Mus musculus
aatgctctcgttacatctcctgatg

SEQ ID NO: 512141 - DNA, 25 bp, Mus musculus
aatgctctcgtttcatctcctgatg

SEQ ID NO: 512142 - DNA, 25 bp, Mus musculus
aatgctctttgcatcggaggcctgc

SEQ ID NO: 512143 - DNA, 25 bp, Mus musculus
aatgctctttgcttcggaggcctgc

SEQ ID NO: 512144 - DNA, 25 bp, Mus musculus
aatgctcttttcagttgcattagca

SEQ ID NO: 512145 - DNA, 25 bp, Mus musculus
aatgctcttttctgttgcattagca

SEQ ID NO: 512146 - DNA, 25 bp, Mus musculus
aatgctgacgtcattgctggttttg

SEQ ID NO: 512147 - DNA, 25 bp, Mus musculus
aatgctgacgtctttgctggttttg

SEQ ID NO: 512148 - DNA, 25 bp, Mus musculus
aatgctgagaggatcgtgcagacct

SEQ ID NO: 512149 - DNA, 25 bp, Mus musculus
aatgctgagaggttcgtgcagacct

SEQ ID NO: 512150 - DNA, 25 bp, Mus musculus
aatgctgcaggtcatccgagccgtc

SEQ ID NO: 512151 - DNA, 25 bp, Mus musculus
aatgctgcaggtgatccgagccgtc

SEQ ID NO: 512152 - DNA, 25 bp, Mus musculus
aatgctgcatctcctacttgaaaga

SEQ ID NO: 512153 - DNA, 25 bp, Mus musculus
aatgctgcatctgctacttgaaaga

SEQ ID NO: 512154 - DNA, 25 bp, Mus musculus
aatgctgccatgctacccttgatcg

SEQ ID NO: 512155 - DNA, 25 bp, Mus musculus
aatgctgccatggtacccttgatcg

SEQ ID NO: 512156 - DNA, 25 bp, Mus musculus
aatgctgccattatcgtgatcactg

SEQ ID NO: 512157 - DNA, 25 bp, Mus musculus
aatgctgccattttcgtgatcactg

SEQ ID NO: 512158 - DNA, 25 bp, Mus musculus
aatgctgcggtacaggatcctgtcc

SEQ ID NO: 512159 - DNA, 25 bp, Mus musculus
aatgctgcggtagaggatcctgtcc

SEQ ID NO: 512160 - DNA, 25 bp, Mus musculus
aatgctgctgaacgtgggaattctg

SEQ ID NO: 512161 - DNA, 25 bp, Mus musculus
aatgctgctgaaggtgggaattctg

SEQ ID NO: 512162 - DNA, 25 bp, Mus musculus
aatgctgctgttcatcctgatgaaa

SEQ ID NO: 512163 - DNA, 25 bp, Mus musculus
aatgctgctgttgatcctgatgaaa

SEQ ID NO: 512164 - DNA, 25 bp, Mus musculus
aatgctgctttcaccctgtatgagt

SEQ ID NO: 512165 - DNA, 25 bp, Mus musculus
aatgctgctttctccctgtatgagt

SEQ ID NO: 512166 - DNA, 25 bp, Mus musculus
aatgctggactcagccatttatccc

SEQ ID NO: 512167 - DNA, 25 bp, Mus musculus
aatgctggactctgccatttatccc

SEQ ID NO: 512168 - DNA, 25 bp, Mus musculus
aatgctggcatgacaagagtggacc

SEQ ID NO: 512169 - DNA, 25 bp, Mus musculus
aatgctggcatgtcaagagtggacc

SEQ ID NO: 512170 - DNA, 25 bp, Mus musculus
aatgctggctaccttagagcctgaa

SEQ ID NO: 512171 - DNA, 25 bp, Mus musculus
aatgctggctacgttagagcctgaa

SEQ ID NO: 512172 - DNA, 25 bp, Mus musculus
aatgctgggaagaaaagtttgagac

SEQ ID NO: 512173 - DNA, 25 bp, Mus musculus
aatgctgggaagtaaagtttgagac

SEQ ID NO: 512174 - DNA, 25 bp, Mus musculus
aatgctggtacaaccacgatttcct

SEQ ID NO: 512175 - DNA, 25 bp, Mus musculus
aatgctggtacatccacgatttcct

SEQ ID NO: 512176 - DNA, 25 bp, Mus musculus
aatgctgtaggccatggcatagttc

SEQ ID NO: 512177 - DNA, 25 bp, Mus musculus
aatgctgtaggcgatggcatagttc

SEQ ID NO: 512178 - DNA, 25 bp, Mus musculus
aatgctgtcccgcagcccgagaaca

SEQ ID NO: 512179 - DNA, 25 bp, Mus musculus
aatgctgtcccggagcccgagaaca

SEQ ID NO: 512180 - DNA, 25 bp, Mus musculus
aatgctgtggcaagtatagggccca

SEQ ID NO: 512181 - DNA, 25 bp, Mus musculus
aatgctgtggcatgtatagggccca

SEQ ID NO: 512182 - DNA, 25 bp, Mus musculus
aatgctgtggtcctgctgatcctgc

SEQ ID NO: 512183 - DNA, 25 bp, Mus musculus
aatgctgtggtcgtgctgatcctgc

SEQ ID NO: 512184 - DNA, 25 bp, Mus musculus
aatgctgtgtggaatcaagcacctt

SEQ ID NO: 512185 - DNA, 25 bp, Mus musculus
aatgctgtgtggtatcaagcacctt

SEQ ID NO: 512186 - DNA, 25 bp, Mus musculus
aatgctgtttgaaactgtgtgcgac

SEQ ID NO: 512187 - DNA, 25 bp, Mus musculus
aatgctgtttgatactgtgtgcgac

SEQ ID NO: 512188 - DNA, 25 bp, Mus musculus
aatgcttcaactagctggtgaagaa

SEQ ID NO: 512189 - DNA, 25 bp, Mus musculus
aatgcttcaacttgctggtgaagaa

SEQ ID NO: 512190 - DNA, 25 bp, Mus musculus
aatgcttcctgtcagggagccatgg

SEQ ID NO: 512191 - DNA, 25 bp, Mus musculus
aatgcttcctgtgagggagccatgg

SEQ ID NO: 512192 - DNA, 25 bp, Mus musculus
aatgcttcttggaggagatccatca

SEQ ID NO: 512193 - DNA, 25 bp, Mus musculus
aatgcttcttggtggagatccatca

SEQ ID NO: 512194 - DNA, 25 bp, Mus musculus
aatgcttgccaaactcttctctatg

SEQ ID NO: 512195 - DNA, 25 bp, Mus musculus
aatgcttgccaatctcttctctatg

SEQ ID NO: 512196 - DNA, 25 bp, Mus musculus
aatgctttccgtcaagtaacgccag

SEQ ID NO: 512197 - DNA, 25 bp, Mus musculus
aatgctttccgtgaagtaacgccag

SEQ ID NO: 512198 - DNA, 25 bp, Mus musculus
aatgctttgaaactatgggacctac

SEQ ID NO: 512199 - DNA, 25 bp, Mus musculus
aatgctttgaaagtatgggacctac

SEQ ID NO: 512200 - DNA, 25 bp, Mus musculus
aatgctttgagcctcagcttctcaa

SEQ ID NO: 512201 - DNA, 25 bp, Mus musculus
aatgctttgagcgtcagcttctcaa

SEQ ID NO: 512202 - DNA, 25 bp, Mus musculus
aatgctttggtgactcatttggatg

SEQ ID NO: 512203 - DNA, 25 bp, Mus musculus
aatgctttggtgtctcatttggatg

SEQ ID NO: 512204 - DNA, 25 bp, Mus musculus
aatggaaaacaacccaaaggcgctg

SEQ ID NO: 512205 - DNA, 25 bp, Mus musculus
aatggaaaacaagccaaaggcgctg

SEQ ID NO: 512206 - DNA, 25 bp, Mus musculus
aatggaaacaccacacagaagaact

SEQ ID NO: 512207 - DNA, 25 bp, Mus musculus
aatggaaacacctcacagaagaact

SEQ ID NO: 512208 - DNA, 25 bp, Mus musculus
aatggaaaccaaacctctggaatgg

SEQ ID NO: 512209 - DNA, 25 bp, Mus musculus
aatggaaaccaatcctctggaatgg

SEQ ID NO: 512210 - DNA, 25 bp, Mus musculus
aatggaaatcagatgagatcaccac

SEQ ID NO: 512211 - DNA, 25 bp, Mus musculus
aatggaaatcagttgagatcaccac

SEQ ID NO: 512212 - DNA, 25 bp, Mus musculus
aatggaaatgtgctatgcaaggcct

SEQ ID NO: 512213 - DNA, 25 bp, Mus musculus
aatggaaatgtggtatgcaaggcct

SEQ ID NO: 512214 - DNA, 25 bp, Mus musculus
aatggaaattggagtgcagcatcag

SEQ ID NO: 512215 - DNA, 25 bp, Mus musculus
aatggaaattggtgtgcagcatcag

SEQ ID NO: 512216 - DNA, 25 bp, Mus musculus
aatggaacaatgacccaagtacagg

SEQ ID NO: 512217 - DNA, 25 bp, Mus musculus
aatggaacaatgtcccaagtacagg

SEQ ID NO: 512218 - DNA, 25 bp, Mus musculus
aatggaacactgaggatccgtcggg

SEQ ID NO: 512219 - DNA, 25 bp, Mus musculus
aatggaacactgtggatccgtcggg

SEQ ID NO: 512220 - DNA, 25 bp, Mus musculus
aatggaacagagaccaggagatgcc

SEQ ID NO: 512221 - DNA, 25 bp, Mus musculus
aatggaacagagtccaggagatgcc

SEQ ID NO: 512222 - DNA, 25 bp, Mus musculus
aatggaacataaccttggaatccta

SEQ ID NO: 512223 - DNA, 25 bp, Mus musculus
aatggaacataagcttggaatccta

SEQ ID NO: 512224 - DNA, 25 bp, Mus musculus
aatggaacccagatccacagacagt

SEQ ID NO: 512225 - DNA, 25 bp, Mus musculus
aatggaacccagttccacagacagt

SEQ ID NO: 512226 - DNA, 25 bp, Mus musculus
aatggaacctgactggctgggaccc

SEQ ID NO: 512227 - DNA, 25 bp, Mus musculus
aatggaacctgagtggctgggaccc

SEQ ID NO: 512228 - DNA, 25 bp, Mus musculus
aatggaactgtcatatacacaggag

SEQ ID NO: 512229 - DNA, 25 bp, Mus musculus
aatggaactgtcttatacacaggag

SEQ ID NO: 512230 - DNA, 25 bp, Mus musculus
aatggaagaagaccaaaacatcctc

SEQ ID NO: 512231 - DNA, 25 bp, Mus musculus
aatggaagaagagcaaaacatcctc

SEQ ID NO: 512232 - DNA, 25 bp, Mus musculus
aatggaagcacaccgtggccaccgc

SEQ ID NO: 512233 - DNA, 25 bp, Mus musculus
aatggaagcacagcgtggccaccgc

SEQ ID NO: 512234 - DNA, 25 bp, Mus musculus
aatggaaggcccaaagaaagcccag

SEQ ID NO: 512235 - DNA, 25 bp, Mus musculus
aatggaaggccctaagaaagcccag

SEQ ID NO: 512236 - DNA, 25 bp, Mus musculus
aatggaaggctcagctccgctgtgc

SEQ ID NO: 512237 - DNA, 25 bp, Mus musculus
aatggaaggctctgctccgctgtgc

SEQ ID NO: 512238 - DNA, 25 bp, Mus musculus
aatggaagtcatccaattcagcaag

SEQ ID NO: 512239 - DNA, 25 bp, Mus musculus
aatggaagtcatgcaattcagcaag

SEQ ID NO: 512240 - DNA, 25 bp, Mus musculus
aatggaatgagcatacatgactgcc

SEQ ID NO: 512241 - DNA, 25 bp, Mus musculus
aatggaatgagcttacatgactgcc

SEQ ID NO: 512242 - DNA, 25 bp, Mus musculus
aatggaatgatccaggaaaatttac

SEQ ID NO: 512243 - DNA, 25 bp, Mus musculus
aatggaatgatcgaggaaaatttac

SEQ ID NO: 512244 - DNA, 25 bp, Mus musculus
aatggaatggtaacatgtatgcaaa

SEQ ID NO: 512245 - DNA, 25 bp, Mus musculus
aatggaatggtatcatgtatgcaaa

SEQ ID NO: 512246 - DNA, 25 bp, Mus musculus
aatggaattacccttctgattctcg

SEQ ID NO: 512247 - DNA, 25 bp, Mus musculus
aatggaattaccgttctgattctcg

SEQ ID NO: 512248 - DNA, 25 bp, Mus musculus
aatggaattgctagtaaagatcaac

SEQ ID NO: 512249 - DNA, 25 bp, Mus musculus
aatggaattgcttgtaaagatcaac

SEQ ID NO: 512250 - DNA, 25 bp, Mus musculus
aatggacaaagcacaggcaccaagc

SEQ ID NO: 512251 - DNA, 25 bp, Mus musculus
aatggacaaagctcaggcaccaagc

SEQ ID NO: 512252 - DNA, 25 bp, Mus musculus
aatggacaatgtaccttgaacaggc

SEQ ID NO: 512253 - DNA, 25 bp, Mus musculus
aatggacaatgttccttgaacaggc

SEQ ID NO: 512254 - DNA, 25 bp, Mus musculus
aatggacacacgactgatctctggc

SEQ ID NO: 512255 - DNA, 25 bp, Mus musculus
aatggacacacgtctgatctctggc

SEQ ID NO: 512256 - DNA, 25 bp, Mus musculus
aatggacacagtcaacgtcttcaac

SEQ ID NO: 512257 - DNA, 25 bp, Mus musculus
aatggacacagtgaacgtcttcaac

SEQ ID NO: 512258 - DNA, 25 bp, Mus musculus
aatggacaccagaccaaaggtgtct

SEQ ID NO: 512259 - DNA, 25 bp, Mus musculus
aatggacaccagtccaaaggtgtct

SEQ ID NO: 512260 - DNA, 25 bp, Mus musculus
aatggacagatgagtgagtggcccc

SEQ ID NO: 512261 - DNA, 25 bp, Mus musculus
aatggacagatgtgtgagtggcccc

SEQ ID NO: 512262 - DNA, 25 bp, Mus musculus
aatggacagcaaattgtggcagaaa

SEQ ID NO: 512263 - DNA, 25 bp, Mus musculus
aatggacagcaatttgtggcagaaa

SEQ ID NO: 512264 - DNA, 25 bp, Mus musculus
aatggacagccaaggcattgccggc

SEQ ID NO: 512265 - DNA, 25 bp, Mus musculus
aatggacagccatggcattgccggc

SEQ ID NO: 512266 - DNA, 25 bp, Mus musculus
aatggacagtgccaggttccgtatc

SEQ ID NO: 512267 - DNA, 25 bp, Mus musculus
aatggacagtgcgaggttccgtatc

SEQ ID NO: 512268 - DNA, 25 bp, Mus musculus
aatggacagtgtccagattctacca

SEQ ID NO: 512269 - DNA, 25 bp, Mus musculus
aatggacagtgtgcagattctacca

SEQ ID NO: 512270 - DNA, 25 bp, Mus musculus
aatggacatccgcacaaagagtcaa

SEQ ID NO: 512271 - DNA, 25 bp, Mus musculus
aatggacatccggacaaagagtcaa

SEQ ID NO: 512272 - DNA, 25 bp, Mus musculus
aatggaccacatatctgaaggcgcg

SEQ ID NO: 512273 - DNA, 25 bp, Mus musculus
aatggaccacatttctgaaggcgcg

SEQ ID NO: 512274 - DNA, 25 bp, Mus musculus
aatggaccacgaacttctaaagaac

SEQ ID NO: 512275 - DNA, 25 bp, Mus musculus
aatggaccacgatcttctaaagaac

SEQ ID NO: 512276 - DNA, 25 bp, Mus musculus
aatggacccttgcagtggcttgaca

SEQ ID NO: 512277 - DNA, 25 bp, Mus musculus
aatggacccttggagtggcttgaca

SEQ ID NO: 512278 - DNA, 25 bp, Mus musculus
aatggaccgcataactgacttttac

SEQ ID NO: 512279 - DNA, 25 bp, Mus musculus
aatggaccgcattactgacttttac

SEQ ID NO: 512280 - DNA, 25 bp, Mus musculus
aatggacctaccaaggccttagtct

SEQ ID NO: 512281 - DNA, 25 bp, Mus musculus
aatggacctacctaggccttagtct

SEQ ID NO: 512282 - DNA, 25 bp, Mus musculus
aatggacctcccagagaccggaagt

SEQ ID NO: 512283 - DNA, 25 bp, Mus musculus
aatggacctccctgagaccggaagt

SEQ ID NO: 512284 - DNA, 25 bp, Mus musculus
aatggacgagaaagagttcgttgcc

SEQ ID NO: 512285 - DNA, 25 bp, Mus musculus
aatggacgagaatgagttcgttgcc

SEQ ID NO: 512286 - DNA, 25 bp, Mus musculus
aatggacgccctaaattctgagacg

SEQ ID NO: 512287 - DNA, 25 bp, Mus musculus
aatggacgcccttaattctgagacg

SEQ ID NO: 512288 - DNA, 25 bp, Mus musculus
aatggacggtgcatgctttaacagc

SEQ ID NO: 512289 - DNA, 25 bp, Mus musculus
aatggacggtgcttgctttaacagc

SEQ ID NO: 512290 - DNA, 25 bp, Mus musculus
aatggactcgctacagaagcaggaa

SEQ ID NO: 512291 - DNA, 25 bp, Mus musculus
aatggactcgcttcagaagcaggaa

SEQ ID NO: 512292 - DNA, 25 bp, Mus musculus
aatggactggaactggaccaggcac

SEQ ID NO: 512293 - DNA, 25 bp, Mus musculus
aatggactggaagtggaccaggcac

SEQ ID NO: 512294 - DNA, 25 bp, Mus musculus
aatggactggtcagagctttaccca

SEQ ID NO: 512295 - DNA, 25 bp, Mus musculus
aatggactggtctgagctttaccca

SEQ ID NO: 512296 - DNA, 25 bp, Mus musculus
aatggacttagaagtggagcaactt

SEQ ID NO: 512297 - DNA, 25 bp, Mus musculus
aatggacttagatgtggagcaactt

SEQ ID NO: 512298 - DNA, 25 bp, Mus musculus
aatggacttccaactgtgtgcatgc

SEQ ID NO: 512299 - DNA, 25 bp, Mus musculus
aatggacttccatctgtgtgcatgc

SEQ ID NO: 512300 - DNA, 25 bp, Mus musculus
aatggagacatcacctccttgtcat

SEQ ID NO: 512301 - DNA, 25 bp, Mus musculus
aatggagacatctcctccttgtcat

SEQ ID NO: 512302 - DNA, 25 bp, Mus musculus
aatggagacattcctacacagcttc

SEQ ID NO: 512303 - DNA, 25 bp, Mus musculus
aatggagacattgctacacagcttc

SEQ ID NO: 512304 - DNA, 25 bp, Mus musculus
aatggagagaccaacaaggcggaga

SEQ ID NO: 512305 - DNA, 25 bp, Mus musculus
aatggagagacctacaaggcggaga

SEQ ID NO: 512306 - DNA, 25 bp, Mus musculus
aatggagagcacatatcccggtcgc

SEQ ID NO: 512307 - DNA, 25 bp, Mus musculus
aatggagagcacttatcccggtcgc

SEQ ID NO: 512308 - DNA, 25 bp, Mus musculus
aatggagagtgtattgttcaaatgc

SEQ ID NO: 512309 - DNA, 25 bp, Mus musculus
aatggagagtgttttgttcaaatgc

SEQ ID NO: 512310 - DNA, 25 bp, Mus musculus
aatggagatcgtacagaccatgaac

SEQ ID NO: 512311 - DNA, 25 bp, Mus musculus
aatggagatcgttcagaccatgaac

SEQ ID NO: 512312 - DNA, 25 bp, Mus musculus
aatggagcattcctagcagaggaga

SEQ ID NO: 512313 - DNA, 25 bp, Mus musculus
aatggagcattcgtagcagaggaga

SEQ ID NO: 512314 - DNA, 25 bp, Mus musculus
aatggagccaataaacactttgcaa

SEQ ID NO: 512315 - DNA, 25 bp, Mus musculus
aatggagccaattaacactttgcaa

SEQ ID NO: 512316 - DNA, 25 bp, Mus musculus
aatggagcccagagcaaggccgtgt

SEQ ID NO: 512317 - DNA, 25 bp, Mus musculus
aatggagcccagtgcaaggccgtgt

SEQ ID NO: 512318 - DNA, 25 bp, Mus musculus
aatggagcctctatggaccacgacc

SEQ ID NO: 512319 - DNA, 25 bp, Mus musculus
aatggagcctctttggaccacgacc

SEQ ID NO: 512320 - DNA, 25 bp, Mus musculus
aatggagcgctcattacatgatgct

SEQ ID NO: 512321 - DNA, 25 bp, Mus musculus
aatggagcgctctttacatgatgct

SEQ ID NO: 512322 - DNA, 25 bp, Mus musculus
aatggagctccacaatgtgcacggg

SEQ ID NO: 512323 - DNA, 25 bp, Mus musculus
aatggagctccagaatgtgcacggg

SEQ ID NO: 512324 - DNA, 25 bp, Mus musculus
aatggagcttctccactctggaggc

SEQ ID NO: 512325 - DNA, 25 bp, Mus musculus
aatggagcttctgcactctggaggc

SEQ ID NO: 512326 - DNA, 25 bp, Mus musculus
aatggagctttaccccctgacctca

SEQ ID NO: 512327 - DNA, 25 bp, Mus musculus
aatggagctttagcccctgacctca

SEQ ID NO: 512328 - DNA, 25 bp, Mus musculus
aatggaggaacaccactgctctacg

SEQ ID NO: 512329 - DNA, 25 bp, Mus musculus
aatggaggaacagcactgctctacg

SEQ ID NO: 512330 - DNA, 25 bp, Mus musculus
aatggaggcctcagtattgacacgg

SEQ ID NO: 512331 - DNA, 25 bp, Mus musculus
aatggaggcctctgtattgacacgg

SEQ ID NO: 512332 - DNA, 25 bp, Mus musculus
aatggagggcaacgtatacatagga

SEQ ID NO: 512333 - DNA, 25 bp, Mus musculus
aatggagggcaaggtatacatagga

SEQ ID NO: 512334 - DNA, 25 bp, Mus musculus
aatggaggtaaaagctggattggcc

SEQ ID NO: 512335 - DNA, 25 bp, Mus musculus
aatggaggtaaatgctggattggcc

SEQ ID NO: 512336 - DNA, 25 bp, Mus musculus
aatggaggtcccagatactacgtgg

SEQ ID NO: 512337 - DNA, 25 bp, Mus musculus
aatggaggtccctgatactacgtgg

SEQ ID NO: 512338 - DNA, 25 bp, Mus musculus
aatggaggtgcaacatttccgaacc

SEQ ID NO: 512339 - DNA, 25 bp, Mus musculus
aatggaggtgcatcatttccgaacc

SEQ ID NO: 512340 - DNA, 25 bp, Mus musculus
aatggagtaggcacacaggtcttca

SEQ ID NO: 512341 - DNA, 25 bp, Mus musculus
aatggagtaggctcacaggtcttca

SEQ ID NO: 512342 - DNA, 25 bp, Mus musculus
aatggagtatgtctttgaactggaa

SEQ ID NO: 512343 - DNA, 25 bp, Mus musculus
aatggagtatgtgtttgaactggaa

SEQ ID NO: 512344 - DNA, 25 bp, Mus musculus
aatggagtccagattaactatccca

SEQ ID NO: 512345 - DNA, 25 bp, Mus musculus
aatggagtccagtttaactatccca

SEQ ID NO: 512346 - DNA, 25 bp, Mus musculus
aatggagtcccaacagtacctggca

SEQ ID NO: 512347 - DNA, 25 bp, Mus musculus
aatggagtcccatcagtacctggca

SEQ ID NO: 512348 - DNA, 25 bp, Mus musculus
aatggagtctgcaaggaaccatggc

SEQ ID NO: 512349 - DNA, 25 bp, Mus musculus
aatggagtctgctaggaaccatggc

SEQ ID NO: 512350 - DNA, 25 bp, Mus musculus
aatggagttttgctaacctgagggc

SEQ ID NO: 512351 - DNA, 25 bp, Mus musculus
aatggagttttggtaacctgagggc

SEQ ID NO: 512352 - DNA, 25 bp, Mus musculus
aatggataatcgacccaagttggat

SEQ ID NO: 512353 - DNA, 25 bp, Mus musculus
aatggataatcgtcccaagttggat

SEQ ID NO: 512354 - DNA, 25 bp, Mus musculus
aatggatctcgcagtggccctggga

SEQ ID NO: 512355 - DNA, 25 bp, Mus musculus
aatggatctcgctgtggccctggga

SEQ ID NO: 512356 - DNA, 25 bp, Mus musculus
aatggatcttcactgtgggaccacc

SEQ ID NO: 512357 - DNA, 25 bp, Mus musculus
aatggatcttcagtgtgggaccacc

SEQ ID NO: 512358 - DNA, 25 bp, Mus musculus
aatggatcttgccactggcgtgtgc

SEQ ID NO: 512359 - DNA, 25 bp, Mus musculus
aatggatcttgcgactggcgtgtgc

SEQ ID NO: 512360 - DNA, 25 bp, Mus musculus
aatggatggattagatactctgcat

SEQ ID NO: 512361 - DNA, 25 bp, Mus musculus
aatggatggatttgatactctgcat

SEQ ID NO: 512362 - DNA, 25 bp, Mus musculus
aatggattccctaataattattggg

SEQ ID NO: 512363 - DNA, 25 bp, Mus musculus
aatggattcccttataattattggg

SEQ ID NO: 512364 - DNA, 25 bp, Mus musculus
aatggattccggcacgatggttcga

SEQ ID NO: 512365 - DNA, 25 bp, Mus musculus
aatggattccgggacgatggttcga

SEQ ID NO: 512366 - DNA, 25 bp, Mus musculus
aatggattctcgacttcaaaggata

SEQ ID NO: 512367 - DNA, 25 bp, Mus musculus
aatggattctcgtcttcaaaggata

SEQ ID NO: 512368 - DNA, 25 bp, Mus musculus
aatggattctctaacaactactggg

SEQ ID NO: 512369 - DNA, 25 bp, Mus musculus
aatggattctcttacaactactggg

SEQ ID NO: 512370 - DNA, 25 bp, Mus musculus
aatggattctgtcgtgccttctgac

SEQ ID NO: 512371 - DNA, 25 bp, Mus musculus
aatggattctgtggtgccttctgac

SEQ ID NO: 512372 - DNA, 25 bp, Mus musculus
aatggattgatgatgtcagaacaga

SEQ ID NO: 512373 - DNA, 25 bp, Mus musculus
aatggattgatgttgtcagaacaga

SEQ ID NO: 512374 - DNA, 25 bp, Mus musculus
aatggattgcgtcatatattagctg

SEQ ID NO: 512375 - DNA, 25 bp, Mus musculus
aatggattgcgtgatatattagctg

SEQ ID NO: 512376 - DNA, 25 bp, Mus musculus
aatggatttgctatcatccggcccc

SEQ ID NO: 512377 - DNA, 25 bp, Mus musculus
aatggatttgctttcatccggcccc

SEQ ID NO: 512378 - DNA, 25 bp, Mus musculus
aatggcaaattcctctacagtgtcc

SEQ ID NO: 512379 - DNA, 25 bp, Mus musculus
aatggcaaattcgtctacagtgtcc

SEQ ID NO: 512380 - DNA, 25 bp, Mus musculus
aatggcaaccttcaccatgacgctg

SEQ ID NO: 512381 - DNA, 25 bp, Mus musculus
aatggcaaccttgaccatgacgctg

SEQ ID NO: 512382 - DNA, 25 bp, Mus musculus
aatggcaagtgcctcatcctaagaa

SEQ ID NO: 512383 - DNA, 25 bp, Mus musculus
aatggcaagtgcgtcatcctaagaa

SEQ ID NO: 512384 - DNA, 25 bp, Mus musculus
aatggcaattggagttctctcccga

SEQ ID NO: 512385 - DNA, 25 bp, Mus musculus
aatggcaattggtgttctctcccga

SEQ ID NO: 512386 - DNA, 25 bp, Mus musculus
aatggcacacgaaacttccaggact

SEQ ID NO: 512387 - DNA, 25 bp, Mus musculus
aatggcacacgatacttccaggact

SEQ ID NO: 512388 - DNA, 25 bp, Mus musculus
aatggcacctatcgacaagtctata

SEQ ID NO: 512389 - DNA, 25 bp, Mus musculus
aatggcacctatggacaagtctata

SEQ ID NO: 512390 - DNA, 25 bp, Mus musculus
aatggcaccttcagtgctaagggtg

SEQ ID NO: 512391 - DNA, 25 bp, Mus musculus
aatggcaccttctgtgctaagggtg

SEQ ID NO: 512392 - DNA, 25 bp, Mus musculus
aatggcaccttgaagattatcgaca

SEQ ID NO: 512393 - DNA, 25 bp, Mus musculus
aatggcaccttgctagcagcttgtg

SEQ ID NO: 512394 - DNA, 25 bp, Mus musculus
aatggcaccttggtagcagcttgtg

SEQ ID NO: 512395 - DNA, 25 bp, Mus musculus
aatggcaccttgtagattatcgaca

SEQ ID NO: 512396 - DNA, 25 bp, Mus musculus
aatggcactagcaccagtacagggc

SEQ ID NO: 512397 - DNA, 25 bp, Mus musculus
aatggcactagctccagtacagggc

SEQ ID NO: 512398 - DNA, 25 bp, Mus musculus
aatggcactaggagctgccccaact

SEQ ID NO: 512399 - DNA, 25 bp, Mus musculus
aatggcactaggtgctgccccaact

SEQ ID NO: 512400 - DNA, 25 bp, Mus musculus
aatggcactgtaagtttaacagacg

SEQ ID NO: 512401 - DNA, 25 bp, Mus musculus
aatggcactgtatgtttaacagacg

SEQ ID NO: 512402 - DNA, 25 bp, Mus musculus
aatggcagcaaccactcagacggta

SEQ ID NO: 512403 - DNA, 25 bp, Mus musculus
aatggcagcaacgactcagacggta

SEQ ID NO: 512404 - DNA, 25 bp, Mus musculus
aatggcagcattacacctgtgcaag

SEQ ID NO: 512405 - DNA, 25 bp, Mus musculus
aatggcagcattcatctgatgtact

SEQ ID NO: 512406 - DNA, 25 bp, Mus musculus
aatggcagcattgatctgatgtact

SEQ ID NO: 512407 - DNA, 25 bp, Mus musculus
aatggcagcatttcacctgtgcaag

SEQ ID NO: 512408 - DNA, 25 bp, Mus musculus
aatggcagccttagactttctcgaa

SEQ ID NO: 512409 - DNA, 25 bp, Mus musculus
aatggcagcctttgactttctcgaa

SEQ ID NO: 512410 - DNA, 25 bp, Mus musculus
aatggcagcgagctatctgtcaagc

SEQ ID NO: 512411 - DNA, 25 bp, Mus musculus
aatggcagcgaggtatctgtcaagc

SEQ ID NO: 512412 - DNA, 25 bp, Mus musculus
aatggcagctttcactgcaccaaca

SEQ ID NO: 512413 - DNA, 25 bp, Mus musculus
aatggcagctttgactgcaccaaca

SEQ ID NO: 512414 - DNA, 25 bp, Mus musculus
aatggcaggaccagaatgaaggtca

SEQ ID NO: 512415 - DNA, 25 bp, Mus musculus
aatggcaggacctgaatgaaggtca

SEQ ID NO: 512416 - DNA, 25 bp, Mus musculus
aatggcatccacagcgagaacaaca

SEQ ID NO: 512417 - DNA, 25 bp, Mus musculus
aatggcatccactgcgagaacaaca

SEQ ID NO: 512418 - DNA, 25 bp, Mus musculus
aatggcatccagagcaaagacgtcg

SEQ ID NO: 512419 - DNA, 25 bp, Mus musculus
aatggcatccagtgcaaagacgtcg

SEQ ID NO: 512420 - DNA, 25 bp, Mus musculus
aatggcatgacgcacaagaaggctc

SEQ ID NO: 512421 - DNA, 25 bp, Mus musculus
aatggcatgacggacaagaaggctc

SEQ ID NO: 512422 - DNA, 25 bp, Mus musculus
aatggcatgggtccgcccttctctg

SEQ ID NO: 512423 - DNA, 25 bp, Mus musculus
aatggcatgggtgcgcccttctctg

SEQ ID NO: 512424 - DNA, 25 bp, Mus musculus
aatggcattcctactaacaggatta

SEQ ID NO: 512425 - DNA, 25 bp, Mus musculus
aatggcattccttctaacaggatta

SEQ ID NO: 512426 - DNA, 25 bp, Mus musculus
aatggcattctgcttggtcttagga

SEQ ID NO: 512427 - DNA, 25 bp, Mus musculus
aatggcattctggttggtcttagga

SEQ ID NO: 512428 - DNA, 25 bp, Mus musculus
aatggccaacatcccgaagaaaaca

SEQ ID NO: 512429 - DNA, 25 bp, Mus musculus
aatggccaacatgccgaagaaaaca

SEQ ID NO: 512430 - DNA, 25 bp, Mus musculus
aatggccaatggcagattatccaca

SEQ ID NO: 512431 - DNA, 25 bp, Mus musculus
aatggccaatgggagattatccaca

SEQ ID NO: 512432 - DNA, 25 bp, Mus musculus
aatggccaattccttacgaggagaa

SEQ ID NO: 512433 - DNA, 25 bp, Mus musculus
aatggccaattcgttacgaggagaa

SEQ ID NO: 512434 - DNA, 25 bp, Mus musculus
aatggccaccctcaagcacgctttt

SEQ ID NO: 512435 - DNA, 25 bp, Mus musculus
aatggccaccctgaagcacgctttt

SEQ ID NO: 512436 - DNA, 25 bp, Mus musculus
aatggccacctgaatcccactggct

SEQ ID NO: 512437 - DNA, 25 bp, Mus musculus
aatggccacctgtatcccactggct

SEQ ID NO: 512438 - DNA, 25 bp, Mus musculus
aatggccacgccaagggccgcttgt

SEQ ID NO: 512439 - DNA, 25 bp, Mus musculus
aatggccacgcctagggccgcttgt

SEQ ID NO: 512440 - DNA, 25 bp, Mus musculus
aatggccagaggatccgtgtctgac

SEQ ID NO: 512441 - DNA, 25 bp, Mus musculus
aatggccagaggttccgtgtctgac

SEQ ID NO: 512442 - DNA, 25 bp, Mus musculus
aatggccagcatattccgagtactg

SEQ ID NO: 512443 - DNA, 25 bp, Mus musculus
aatggccagcattttccgagtactg

SEQ ID NO: 512444 - DNA, 25 bp, Mus musculus
aatggccagccaagaccccttgaat

SEQ ID NO: 512445 - DNA, 25 bp, Mus musculus
aatggccagccatgaccccttgaat

SEQ ID NO: 512446 - DNA, 25 bp, Mus musculus
aatggccattcccttcttcacgggc

SEQ ID NO: 512447 - DNA, 25 bp, Mus musculus
aatggccattccgttcttcacgggc

SEQ ID NO: 512448 - DNA, 25 bp, Mus musculus
aatggcccctcaaggcatggctgtg

SEQ ID NO: 512449 - DNA, 25 bp, Mus musculus
aatggcccctcatggcatggctgtg

SEQ ID NO: 512450 - DNA, 25 bp, Mus musculus
aatggcccctggagcactgctgtta

SEQ ID NO: 512451 - DNA, 25 bp, Mus musculus
aatggcccctggtgcactgctgtta

SEQ ID NO: 512452 - DNA, 25 bp, Mus musculus
aatggccctgctagctagggaggcc

SEQ ID NO: 512453 - DNA, 25 bp, Mus musculus
aatggccctgcttgctagggaggcc

SEQ ID NO: 512454 - DNA, 25 bp, Mus musculus
aatggccctgtcagcacagtgtgcg

SEQ ID NO: 512455 - DNA, 25 bp, Mus musculus
aatggccctgtctgcacagtgtgcg

SEQ ID NO: 512456 - DNA, 25 bp, Mus musculus
aatggccctgttacccagtggaagg

SEQ ID NO: 512457 - DNA, 25 bp, Mus musculus
aatggccctgtttcccagtggaagg

SEQ ID NO: 512458 - DNA, 25 bp, Mus musculus
aatggccgatgcctcaacatagtgc

SEQ ID NO: 512459 - DNA, 25 bp, Mus musculus
aatggccgatgcgtcaacatagtgc

SEQ ID NO: 512460 - DNA, 25 bp, Mus musculus
aatggccgccagatcaactcaatcg

SEQ ID NO: 512461 - DNA, 25 bp, Mus musculus
aatggccgccagttcaactcaatcg

SEQ ID NO: 512462 - DNA, 25 bp, Mus musculus
aatggccgctggaggatgactgcac

SEQ ID NO: 512463 - DNA, 25 bp, Mus musculus
aatggccgctggtggatgactgcac

SEQ ID NO: 512464 - DNA, 25 bp, Mus musculus
aatggccggaccctcaaagtgggca

SEQ ID NO: 512465 - DNA, 25 bp, Mus musculus
aatggccggaccgtcaaagtgggca

SEQ ID NO: 512466 - DNA, 25 bp, Mus musculus
aatggcctctgactgacagctccga

SEQ ID NO: 512467 - DNA, 25 bp, Mus musculus
aatggcctctgagtgacagctccga

SEQ ID NO: 512468 - DNA, 25 bp, Mus musculus
aatggcctgatgacaaaccccgaga

SEQ ID NO: 512469 - DNA, 25 bp, Mus musculus
aatggcctgatgctttattggcgtc

SEQ ID NO: 512470 - DNA, 25 bp, Mus musculus
aatggcctgatggtttattggcgtc

SEQ ID NO: 512471 - DNA, 25 bp, Mus musculus
aatggcctgatgtcaaaccccgaga

SEQ ID NO: 512472 - DNA, 25 bp, Mus musculus
aatggcctttggagcaatgaaaagc

SEQ ID NO: 512473 - DNA, 25 bp, Mus musculus
aatggcctttggtgcaatgaaaagc

SEQ ID NO: 512474 - DNA, 25 bp, Mus musculus
aatggccttttgaaattactgtagg

SEQ ID NO: 512475 - DNA, 25 bp, Mus musculus
aatggccttttgtaattactgtagg

SEQ ID NO: 512476 - DNA, 25 bp, Mus musculus
aatggcgaacacctgcatatccggg

SEQ ID NO: 512477 - DNA, 25 bp, Mus musculus
aatggcgaacacgtgcatatccggg

SEQ ID NO: 512478 - DNA, 25 bp, Mus musculus
aatggcgaggagagcgtcatcgata

SEQ ID NO: 512479 - DNA, 25 bp, Mus musculus
aatggcgaggagtgcgtcatcgata

SEQ ID NO: 512480 - DNA, 25 bp, Mus musculus
aatggcggcggccattaggattcgg

SEQ ID NO: 512481 - DNA, 25 bp, Mus musculus
aatggcggcggcgattaggattcgg

SEQ ID NO: 512482 - DNA, 25 bp, Mus musculus
aatggcgtcctcaaggttcctgccc

SEQ ID NO: 512483 - DNA, 25 bp, Mus musculus
aatggcgtcctctaggttcctgccc

SEQ ID NO: 512484 - DNA, 25 bp, Mus musculus
aatggcgtgaagaatgcaactgggc

SEQ ID NO: 512485 - DNA, 25 bp, Mus musculus
aatggcgtgaagtatgcaactgggc

SEQ ID NO: 512486 - DNA, 25 bp, Mus musculus
aatggcgtggtcatccacttgccgg

SEQ ID NO: 512487 - DNA, 25 bp, Mus musculus
aatggcgtggtcttccacttgccgg

SEQ ID NO: 512488 - DNA, 25 bp, Mus musculus
aatggcgttgacaggcgtcagaagc

SEQ ID NO: 512489 - DNA, 25 bp, Mus musculus
aatggcgttgactggcgtcagaagc

SEQ ID NO: 512490 - DNA, 25 bp, Mus musculus
aatggctacaacacagactacggcg

SEQ ID NO: 512491 - DNA, 25 bp, Mus musculus
aatggctacaactcagactacggcg

SEQ ID NO: 512492 - DNA, 25 bp, Mus musculus
aatggctaccgccatgacagtttcc

SEQ ID NO: 512493 - DNA, 25 bp, Mus musculus
aatggctaccgcgatgacagtttcc

SEQ ID NO: 512494 - DNA, 25 bp, Mus musculus
aatggctacggaatttgcagagaac

SEQ ID NO: 512495 - DNA, 25 bp, Mus musculus
aatggctacggattttgcagagaac

SEQ ID NO: 512496 - DNA, 25 bp, Mus musculus
aatggctatattagcgctgccgagc

SEQ ID NO: 512497 - DNA, 25 bp, Mus musculus
aatggctatatttgcgctgccgagc

SEQ ID NO: 512498 - DNA, 25 bp, Mus musculus
aatggctatgcgctcaattgtgtgg

SEQ ID NO: 512499 - DNA, 25 bp, Mus musculus
aatggctatgcggtcaattgtgtgg

SEQ ID NO: 512500 - DNA, 25 bp, Mus musculus
aatggctcatcaacttggcatctct

SEQ ID NO: 512501 - DNA, 25 bp, Mus musculus
aatggctcatcatcttggcatctct

SEQ ID NO: 512502 - DNA, 25 bp, Mus musculus
aatggctcgtttccactcagtgtca

SEQ ID NO: 512503 - DNA, 25 bp, Mus musculus
aatggctcgtttgcactcagtgtca

SEQ ID NO: 512504 - DNA, 25 bp, Mus musculus
aatggctgaagaaggaaccaggagc

SEQ ID NO: 512505 - DNA, 25 bp, Mus musculus
aatggctgaagatggaaccaggagc

SEQ ID NO: 512506 - DNA, 25 bp, Mus musculus
aatggctgcgccatggctggaagtc

SEQ ID NO: 512507 - DNA, 25 bp, Mus musculus
aatggctgcgccttggctggaagtc

SEQ ID NO: 512508 - DNA, 25 bp, Mus musculus
aatggctgctgaatgaaatccgtag

SEQ ID NO: 512509 - DNA, 25 bp, Mus musculus
aatggctgctgattgaaatccgtag

SEQ ID NO: 512510 - DNA, 25 bp, Mus musculus
aatggctggcagcaacagatacaga

SEQ ID NO: 512511 - DNA, 25 bp, Mus musculus
aatggctggcaggaacagatacaga

SEQ ID NO: 512512 - DNA, 25 bp, Mus musculus
aatggctggctacgaaattcttcgg

SEQ ID NO: 512513 - DNA, 25 bp, Mus musculus
aatggctggctaggaaattcttcgg

SEQ ID NO: 512514 - DNA, 25 bp, Mus musculus
aatggctgggaaacaagaacgagac

SEQ ID NO: 512515 - DNA, 25 bp, Mus musculus
aatggctgggaatcaagaacgagac

SEQ ID NO: 512516 - DNA, 25 bp, Mus musculus
aatggctgtggacgaacttcagagc

SEQ ID NO: 512517 - DNA, 25 bp, Mus musculus
aatggctgtggaggaacttcagagc

SEQ ID NO: 512518 - DNA, 25 bp, Mus musculus
aatggctgtggcacgccactgtttg

SEQ ID NO: 512519 - DNA, 25 bp, Mus musculus
aatggctgtggctcgccactgtttg

SEQ ID NO: 512520 - DNA, 25 bp, Mus musculus
aatggcttcactactcagcaaattt

SEQ ID NO: 512521 - DNA, 25 bp, Mus musculus
aatggcttcacttctcagcaaattt

SEQ ID NO: 512522 - DNA, 25 bp, Mus musculus
aatggcttcgatcctgagctgtatg

SEQ ID NO: 512523 - DNA, 25 bp, Mus musculus
aatggcttcgatgctgagctgtatg

SEQ ID NO: 512524 - DNA, 25 bp, Mus musculus
aatggctttcccaacgagtactggg

SEQ ID NO: 512525 - DNA, 25 bp, Mus musculus
aatggctttccctacgagtactggg

SEQ ID NO: 512526 - DNA, 25 bp, Mus musculus
aatggctttctgcatccaccgtcag

SEQ ID NO: 512527 - DNA, 25 bp, Mus musculus
aatggctttctggatccaccgtcag

SEQ ID NO: 512528 - DNA, 25 bp, Mus musculus
aatgggaaacacacacttggcgaga

SEQ ID NO: 512529 - DNA, 25 bp, Mus musculus
aatgggaaacactcacttggcgaga

SEQ ID NO: 512530 - DNA, 25 bp, Mus musculus
aatgggaacaagatcagcatcctcc

SEQ ID NO: 512531 - DNA, 25 bp, Mus musculus
aatgggaacaagttcagcatcctcc

SEQ ID NO: 512532 - DNA, 25 bp, Mus musculus
aatgggaacatcctcgactaccagc

SEQ ID NO: 512533 - DNA, 25 bp, Mus musculus
aatgggaacatcgtcgactaccagc

SEQ ID NO: 512534 - DNA, 25 bp, Mus musculus
aatgggaacgccaatatagccgcca

SEQ ID NO: 512535 - DNA, 25 bp, Mus musculus
aatgggaacgcctatatagccgcca

SEQ ID NO: 512536 - DNA, 25 bp, Mus musculus
aatgggaagacaagatgacctttgg

SEQ ID NO: 512537 - DNA, 25 bp, Mus musculus
aatgggaagacatgatgacctttgg

SEQ ID NO: 512538 - DNA, 25 bp, Mus musculus
aatgggaagacccttcggaaggcat

SEQ ID NO: 512539 - DNA, 25 bp, Mus musculus
aatgggaagaccgttcggaaggcat

SEQ ID NO: 512540 - DNA, 25 bp, Mus musculus
aatgggaagagcaccgtgatcaatg

SEQ ID NO: 512541 - DNA, 25 bp, Mus musculus
aatgggaagagctccgtgatcaatg

SEQ ID NO: 512542 - DNA, 25 bp, Mus musculus
aatgggaaggagctcaatggaaaac

SEQ ID NO: 512543 - DNA, 25 bp, Mus musculus
aatgggaaggaggtcaatggaaaac

SEQ ID NO: 512544 - DNA, 25 bp, Mus musculus
aatgggaattccagccccagggtgg

SEQ ID NO: 512545 - DNA, 25 bp, Mus musculus
aatgggaattcctgccccagggtgg

SEQ ID NO: 512546 - DNA, 25 bp, Mus musculus
aatgggacattgagacagtgtttac

SEQ ID NO: 512547 - DNA, 25 bp, Mus musculus
aatgggacattgtgacagtgtttac

SEQ ID NO: 512548 - DNA, 25 bp, Mus musculus
aatgggaccattattgcctatggcc

SEQ ID NO: 512549 - DNA, 25 bp, Mus musculus
aatgggaccatttttgcctatggcc

SEQ ID NO: 512550 - DNA, 25 bp, Mus musculus
aatgggactgatcaacaaggaagag

SEQ ID NO: 512551 - DNA, 25 bp, Mus musculus
aatgggactgatgaacaaggaagag

SEQ ID NO: 512552 - DNA, 25 bp, Mus musculus
aatgggactgtcctcagaggcagac

SEQ ID NO: 512553 - DNA, 25 bp, Mus musculus
aatgggactgtcgtcagaggcagac

SEQ ID NO: 512554 - DNA, 25 bp, Mus musculus
aatgggacttctcacgtgattacag

SEQ ID NO: 512555 - DNA, 25 bp, Mus musculus
aatgggacttctgacgtgattacag

SEQ ID NO: 512556 - DNA, 25 bp, Mus musculus
aatgggagctaccaatcgccctcaa

SEQ ID NO: 512557 - DNA, 25 bp, Mus musculus
aatgggagctacgaatcgccctcaa

SEQ ID NO: 512558 - DNA, 25 bp, Mus musculus
aatgggaggcacctaggaccccaag

SEQ ID NO: 512559 - DNA, 25 bp, Mus musculus
aatgggaggcacgtaggaccccaag

SEQ ID NO: 512560 - DNA, 25 bp, Mus musculus
aatgggatcaaacacgtccatgcat

SEQ ID NO: 512561 - DNA, 25 bp, Mus musculus
aatgggatcaaagacgtccatgcat

SEQ ID NO: 512562 - DNA, 25 bp, Mus musculus
aatgggatcgggacaaagttcgaga

SEQ ID NO: 512563 - DNA, 25 bp, Mus musculus
aatgggatcgggtcaaagttcgaga

SEQ ID NO: 512564 - DNA, 25 bp, Mus musculus
aatgggatgatgacaagtttcacgg

SEQ ID NO: 512565 - DNA, 25 bp, Mus musculus
aatgggatgatgtcaagtttcacgg

SEQ ID NO: 512566 - DNA, 25 bp, Mus musculus
aatgggcaccacagagtccagctgt

SEQ ID NO: 512567 - DNA, 25 bp, Mus musculus
aatgggcaccactgagtccagctgt

SEQ ID NO: 512568 - DNA, 25 bp, Mus musculus
aatgggcaggcacaggtcgaggata

SEQ ID NO: 512569 - DNA, 25 bp, Mus musculus
aatgggcaggcagaggtcgaggata

SEQ ID NO: 512570 - DNA, 25 bp, Mus musculus
aatgggcataaactccctagagacc

SEQ ID NO: 512571 - DNA, 25 bp, Mus musculus
aatgggcataaagtccctagagacc

SEQ ID NO: 512572 - DNA, 25 bp, Mus musculus
aatgggccagatcttcatgtacgac

SEQ ID NO: 512573 - DNA, 25 bp, Mus musculus
aatgggccagatgttcatgtacgac

SEQ ID NO: 512574 - DNA, 25 bp, Mus musculus
aatgggcccatgaatgagaatgttc

SEQ ID NO: 512575 - DNA, 25 bp, Mus musculus
aatgggcccatgtatgagaatgttc

SEQ ID NO: 512576 - DNA, 25 bp, Mus musculus
aatgggccggctcctttggcatcaa

SEQ ID NO: 512577 - DNA, 25 bp, Mus musculus
aatgggccggctgctttggcatcaa

SEQ ID NO: 512578 - DNA, 25 bp, Mus musculus
aatgggcctgctccgacttctggtg

SEQ ID NO: 512579 - DNA, 25 bp, Mus musculus
aatgggcctgctgcgacttctggtg

SEQ ID NO: 512580 - DNA, 25 bp, Mus musculus
aatgggcctggccataggaacgcat

SEQ ID NO: 512581 - DNA, 25 bp, Mus musculus
aatgggcctggcgataggaacgcat

SEQ ID NO: 512582 - DNA, 25 bp, Mus musculus
aatgggctacagagagtagtatacg

SEQ ID NO: 512583 - DNA, 25 bp, Mus musculus
aatgggctacagtgagtagtatacg

SEQ ID NO: 512584 - DNA, 25 bp, Mus musculus
aatgggctactccacacaagctgcc

SEQ ID NO: 512585 - DNA, 25 bp, Mus musculus
aatgggctactcgacacaagctgcc

SEQ ID NO: 512586 - DNA, 25 bp, Mus musculus
aatgggctacttatggtctggacct

SEQ ID NO: 512587 - DNA, 25 bp, Mus musculus
aatgggctacttttggtctggacct

SEQ ID NO: 512588 - DNA, 25 bp, Mus musculus
aatgggctccataccagttgttgga

SEQ ID NO: 512589 - DNA, 25 bp, Mus musculus
aatgggctccattccagttgttgga

SEQ ID NO: 512590 - DNA, 25 bp, Mus musculus
aatgggctgaccacccctctgacag

SEQ ID NO: 512591 - DNA, 25 bp, Mus musculus
aatgggctgacctcccctctgacag

SEQ ID NO: 512592 - DNA, 25 bp, Mus musculus
aatgggctggacattctattggaca

SEQ ID NO: 512593 - DNA, 25 bp, Mus musculus
aatgggctggactttctattggaca

SEQ ID NO: 512594 - DNA, 25 bp, Mus musculus
aatgggctttggagatcctctctca

SEQ ID NO: 512595 - DNA, 25 bp, Mus musculus
aatgggctttggtgatcctctctca

SEQ ID NO: 512596 - DNA, 25 bp, Mus musculus
aatgggtactggcacaccgacggct

SEQ ID NO: 512597 - DNA, 25 bp, Mus musculus
aatgggtactgggacaccgacggct

SEQ ID NO: 512598 - DNA, 25 bp, Mus musculus
aatgggtagactatggaactacttg

SEQ ID NO: 512599 - DNA, 25 bp, Mus musculus
aatgggtagactttggaactacttg

SEQ ID NO: 512600 - DNA, 25 bp, Mus musculus
aatgggtaggtcaacagaaagtgcc

SEQ ID NO: 512601 - DNA, 25 bp, Mus musculus
aatgggtaggtctacagaaagtgcc

SEQ ID NO: 512602 - DNA, 25 bp, Mus musculus
aatgggtccacgacctgcagctgct

SEQ ID NO: 512603 - DNA, 25 bp, Mus musculus
aatgggtccacgtcctgcagctgct

SEQ ID NO: 512604 - DNA, 25 bp, Mus musculus
aatgggtctccactcttaaccaacg

SEQ ID NO: 512605 - DNA, 25 bp, Mus musculus
aatgggtctccagtcttaaccaacg

SEQ ID NO: 512606 - DNA, 25 bp, Mus musculus
aatgggtcttatcacattggcatgg

SEQ ID NO: 512607 - DNA, 25 bp, Mus musculus
aatgggtcttatgacattggcatgg

SEQ ID NO: 512608 - DNA, 25 bp, Mus musculus
aatgggtgacatagctctggcactc

SEQ ID NO: 512609 - DNA, 25 bp, Mus musculus
aatgggtgacattgctctggcactc

SEQ ID NO: 512610 - DNA, 25 bp, Mus musculus
aatgggtgactgagggtgatacctc

SEQ ID NO: 512611 - DNA, 25 bp, Mus musculus
aatgggtgactgtgggtgatacctc

SEQ ID NO: 512612 - DNA, 25 bp, Mus musculus
aatgggtgggacagagaaacaagat

SEQ ID NO: 512613 - DNA, 25 bp, Mus musculus
aatgggtgggactgagaaacaagat

SEQ ID NO: 512614 - DNA, 25 bp, Mus musculus
aatgggtgtcttctgtccgcttctc

SEQ ID NO: 512615 - DNA, 25 bp, Mus musculus
aatgggtgtcttgtgtccgcttctc

SEQ ID NO: 512616 - DNA, 25 bp, Mus musculus
aatgggttcgccaggttaggcgcaa

SEQ ID NO: 512617 - DNA, 25 bp, Mus musculus
aatgggttcgcctggttaggcgcaa

SEQ ID NO: 512618 - DNA, 25 bp, Mus musculus
aatgggtttggaaagaatggcctct

SEQ ID NO: 512619 - DNA, 25 bp, Mus musculus
aatgggtttggatagaatggcctct

SEQ ID NO: 512620 - DNA, 25 bp, Mus musculus
aatggtaaaggccagtgccactgta

SEQ ID NO: 512621 - DNA, 25 bp, Mus musculus
aatggtaaaggcgagtgccactgta

SEQ ID NO: 512622 - DNA, 25 bp, Mus musculus
aatggtacaaccaggcggtgggatc

SEQ ID NO: 512623 - DNA, 25 bp, Mus musculus
aatggtacaacctggcggtgggatc

SEQ ID NO: 512624 - DNA, 25 bp, Mus musculus
aatggtaccaagatgtcaatgacaa

SEQ ID NO: 512625 - DNA, 25 bp, Mus musculus
aatggtaccaagttgtcaatgacaa

SEQ ID NO: 512626 - DNA, 25 bp, Mus musculus
aatggtagccgaagaagaacacccg

SEQ ID NO: 512627 - DNA, 25 bp, Mus musculus
aatggtagccgatgaagaacacccg

SEQ ID NO: 512628 - DNA, 25 bp, Mus musculus
aatggtaggtagctagccgttcctg

SEQ ID NO: 512629 - DNA, 25 bp, Mus musculus
aatggtaggtaggtagccgttcctg

SEQ ID NO: 512630 - DNA, 25 bp, Mus musculus
aatggtagtgagatgtctcggcccc

SEQ ID NO: 512631 - DNA, 25 bp, Mus musculus
aatggtagtgagttgtctcggcccc

SEQ ID NO: 512632 - DNA, 25 bp, Mus musculus
aatggtcaagcactcagctgcctgc

SEQ ID NO: 512633 - DNA, 25 bp, Mus musculus
aatggtcaagcagtcagctgcctgc

SEQ ID NO: 512634 - DNA, 25 bp, Mus musculus
aatggtcagcgacggctacagtcta

SEQ ID NO: 512635 - DNA, 25 bp, Mus musculus
aatggtcagcgagggctacagtcta

SEQ ID NO: 512636 - DNA, 25 bp, Mus musculus
aatggtcatggtcaacattgcacat

SEQ ID NO: 512637 - DNA, 25 bp, Mus musculus
aatggtcatggtgaacattgcacat

SEQ ID NO: 512638 - DNA, 25 bp, Mus musculus
aatggtctggctacatatttggaaa

SEQ ID NO: 512639 - DNA, 25 bp, Mus musculus
aatggtctggcttcatatttggaaa

SEQ ID NO: 512640 - DNA, 25 bp, Mus musculus
aatggtctttgcagcacgttcttcc

SEQ ID NO: 512641 - DNA, 25 bp, Mus musculus
aatggtctttgctgcacgttcttcc

SEQ ID NO: 512642 - DNA, 25 bp, Mus musculus
aatggtgacttcatggtgcgagaga

SEQ ID NO: 512643 - DNA, 25 bp, Mus musculus
aatggtgacttcttggtgcgagaga

SEQ ID NO: 512644 - DNA, 25 bp, Mus musculus
aatggtgagcacaaggagaaggacc

SEQ ID NO: 512645 - DNA, 25 bp, Mus musculus
aatggtgagcactaggagaaggacc

SEQ ID NO: 512646 - DNA, 25 bp, Mus musculus
aatggtgagtgccagactgtcccag

SEQ ID NO: 512647 - DNA, 25 bp, Mus musculus
aatggtgagtgcgagactgtcccag

SEQ ID NO: 512648 - DNA, 25 bp, Mus musculus
aatggtgatggtcctccctgtcttc

SEQ ID NO: 512649 - DNA, 25 bp, Mus musculus
aatggtgatggtgctccctgtcttc

SEQ ID NO: 512650 - DNA, 25 bp, Mus musculus
aatggtgcaacaagaaaactggctc

SEQ ID NO: 512651 - DNA, 25 bp, Mus musculus
aatggtgcaacatgaaaactggctc

SEQ ID NO: 512652 - DNA, 25 bp, Mus musculus
aatggtgccagcctgatcctccgag

SEQ ID NO: 512653 - DNA, 25 bp, Mus musculus
aatggtgccagcgtgatcctccgag

SEQ ID NO: 512654 - DNA, 25 bp, Mus musculus
aatggtgccccaagtcactttccct

SEQ ID NO: 512655 - DNA, 25 bp, Mus musculus
aatggtgccccatgtcactttccct

SEQ ID NO: 512656 - DNA, 25 bp, Mus musculus
aatggtgccttgctctgtcagcttg

SEQ ID NO: 512657 - DNA, 25 bp, Mus musculus
aatggtgccttggtctgtcagcttg

SEQ ID NO: 512658 - DNA, 25 bp, Mus musculus
aatggtggaaggatcgggaccatca

SEQ ID NO: 512659 - DNA, 25 bp, Mus musculus
aatggtggaaggttcgggaccatca

SEQ ID NO: 512660 - DNA, 25 bp, Mus musculus
aatggtggactaccacgcagcgaac

SEQ ID NO: 512661 - DNA, 25 bp, Mus musculus
aatggtggactagcacgcagcgaac

SEQ ID NO: 512662 - DNA, 25 bp, Mus musculus
aatggtggcagtctctccagacctc

SEQ ID NO: 512663 - DNA, 25 bp, Mus musculus
aatggtggcagtgtctccagacctc

SEQ ID NO: 512664 - DNA, 25 bp, Mus musculus
aatggtgggcccacttaggcctaag

SEQ ID NO: 512665 - DNA, 25 bp, Mus musculus
aatggtgggccctcttaggcctaag

SEQ ID NO: 512666 - DNA, 25 bp, Mus musculus
aatggtggtcgtcccgctctatgac

SEQ ID NO: 512667 - DNA, 25 bp, Mus musculus
aatggtggtcgtgccgctctatgac

SEQ ID NO: 512668 - DNA, 25 bp, Mus musculus
aatggtggtggaatctggctgggca

SEQ ID NO: 512669 - DNA, 25 bp, Mus musculus
aatggtggtggattctggctgggca

SEQ ID NO: 512670 - DNA, 25 bp, Mus musculus
aatggtgtcactccagcactggctg

SEQ ID NO: 512671 - DNA, 25 bp, Mus musculus
aatggtgtcactgcagcactggctg

SEQ ID NO: 512672 - DNA, 25 bp, Mus musculus
aatggtgtccaacctcacgtcgctc

SEQ ID NO: 512673 - DNA, 25 bp, Mus musculus
aatggtgtccaagctcacgtcgctc

SEQ ID NO: 512674 - DNA, 25 bp, Mus musculus
aatggtgtggacatccactcactgg

SEQ ID NO: 512675 - DNA, 25 bp, Mus musculus
aatggtgtggacttccactcactgg

SEQ ID NO: 512676 - DNA, 25 bp, Mus musculus
aatggtgtgggcaattctttctgcc

SEQ ID NO: 512677 - DNA, 25 bp, Mus musculus
aatggtgtgggctattctttctgcc

SEQ ID NO: 512678 - DNA, 25 bp, Mus musculus
aatggtgtgttgcttaggaagctcc

SEQ ID NO: 512679 - DNA, 25 bp, Mus musculus
aatggtgtgttggttaggaagctcc

SEQ ID NO: 512680 - DNA, 25 bp, Mus musculus
aatggttaattgatcccaagagagc

SEQ ID NO: 512681 - DNA, 25 bp, Mus musculus
aatggttaattgttcccaagagagc

SEQ ID NO: 512682 - DNA, 25 bp, Mus musculus
aatggttaccgcagcacacagccca

SEQ ID NO: 512683 - DNA, 25 bp, Mus musculus
aatggttaccgctgcacacagccca

SEQ ID NO: 512684 - DNA, 25 bp, Mus musculus
aatggttccttcattgagcacctcc

SEQ ID NO: 512685 - DNA, 25 bp, Mus musculus
aatggttccttctttgagcacctcc

SEQ ID NO: 512686 - DNA, 25 bp, Mus musculus
aatggttcgggaccacactgtatga

SEQ ID NO: 512687 - DNA, 25 bp, Mus musculus
aatggttcgggagcacactgtatga

SEQ ID NO: 512688 - DNA, 25 bp, Mus musculus
aatggttcgtgacctaattgatcat

SEQ ID NO: 512689 - DNA, 25 bp, Mus musculus
aatggttcgtgagctaattgatcat

SEQ ID NO: 512690 - DNA, 25 bp, Mus musculus
aatggttgcattaaatcccttcctg

SEQ ID NO: 512691 - DNA, 25 bp, Mus musculus
aatggttgcatttaatcccttcctg

SEQ ID NO: 512692 - DNA, 25 bp, Mus musculus
aatggttgtgtacaagactgatggc

SEQ ID NO: 512693 - DNA, 25 bp, Mus musculus
aatggttgtgtagaagactgatggc

SEQ ID NO: 512694 - DNA, 25 bp, Mus musculus
aatggtttcctgaacttggccctgc

SEQ ID NO: 512695 - DNA, 25 bp, Mus musculus
aatggtttcctgtacttggccctgc

SEQ ID NO: 512696 - DNA, 25 bp, Mus musculus
aatggtttctccactggacatctgt

SEQ ID NO: 512697 - DNA, 25 bp, Mus musculus
aatggtttctcctctggacatctgt

SEQ ID NO: 512698 - DNA, 25 bp, Mus musculus
aatgtaacacgaagtaccgaggaca

SEQ ID NO: 512699 - DNA, 25 bp, Mus musculus
aatgtaacacgatgtaccgaggaca

SEQ ID NO: 512700 - DNA, 25 bp, Mus musculus
aatgtaactacgagcggtacagagg

SEQ ID NO: 512701 - DNA, 25 bp, Mus musculus
aatgtaactacgtgcggtacagagg

SEQ ID NO: 512702 - DNA, 25 bp, Mus musculus
aatgtaactcaaagctggaccccac

SEQ ID NO: 512703 - DNA, 25 bp, Mus musculus
aatgtaactcaatgctggaccccac

SEQ ID NO: 512704 - DNA, 25 bp, Mus musculus
aatgtaacttggctccgctccgtgg

SEQ ID NO: 512705 - DNA, 25 bp, Mus musculus
aatgtaacttgggtccgctccgtgg

SEQ ID NO: 512706 - DNA, 25 bp, Mus musculus
aatgtaagccccacctcatggagtg

SEQ ID NO: 512707 - DNA, 25 bp, Mus musculus
aatgtaagcccctcctcatggagtg

SEQ ID NO: 512708 - DNA, 25 bp, Mus musculus
aatgtaatcatcctaggacccacgg

SEQ ID NO: 512709 - DNA, 25 bp, Mus musculus
aatgtaatcatcgtaggacccacgg

SEQ ID NO: 512710 - DNA, 25 bp, Mus musculus
aatgtacctccacccagagggcttc

SEQ ID NO: 512711 - DNA, 25 bp, Mus musculus
aatgtacctccagccagagggcttc

SEQ ID NO: 512712 - DNA, 25 bp, Mus musculus
aatgtacttgggactgtcgtggtcc

SEQ ID NO: 512713 - DNA, 25 bp, Mus musculus
aatgtacttgggtctgtcgtggtcc

SEQ ID NO: 512714 - DNA, 25 bp, Mus musculus
aatgtagaatcgctgagcacacacc

SEQ ID NO: 512715 - DNA, 25 bp, Mus musculus
aatgtagaatcggtgagcacacacc

SEQ ID NO: 512716 - DNA, 25 bp, Mus musculus
aatgtagctgacaactgtccccggg

SEQ ID NO: 512717 - DNA, 25 bp, Mus musculus
aatgtagctgactactgtccccggg

SEQ ID NO: 512718 - DNA, 25 bp, Mus musculus
aatgtaggacacaccaggcattcat

SEQ ID NO: 512719 - DNA, 25 bp, Mus musculus
aatgtaggacactccaggcattcat

SEQ ID NO: 512720 - DNA, 25 bp, Mus musculus
aatgtcacaattccaccgtctgcaa

SEQ ID NO: 512721 - DNA, 25 bp, Mus musculus
aatgtcacaattgcaccgtctgcaa

SEQ ID NO: 512722 - DNA, 25 bp, Mus musculus
aatgtcacaggaagtttactgagtc

SEQ ID NO: 512723 - DNA, 25 bp, Mus musculus
aatgtcacaggatgtttactgagtc

SEQ ID NO: 512724 - DNA, 25 bp, Mus musculus
aatgtcacaggtcagaaccttgacc

SEQ ID NO: 512725 - DNA, 25 bp, Mus musculus
aatgtcacaggtgagaaccttgacc

SEQ ID NO: 512726 - DNA, 25 bp, Mus musculus
aatgtcaccaacaacctcaagtctc

SEQ ID NO: 512727 - DNA, 25 bp, Mus musculus
aatgtcaccaactacctcaagtctc

SEQ ID NO: 512728 - DNA, 25 bp, Mus musculus
aatgtcaccctaagcctacccagag

SEQ ID NO: 512729 - DNA, 25 bp, Mus musculus
aatgtcaccctatgcctacccagag

SEQ ID NO: 512730 - DNA, 25 bp, Mus musculus
aatgtcaccttcagccccgtggaag

SEQ ID NO: 512731 - DNA, 25 bp, Mus musculus
aatgtcaccttctgccccgtggaag

SEQ ID NO: 512732 - DNA, 25 bp, Mus musculus
aatgtcactagacgagaccaaggaa

SEQ ID NO: 512733 - DNA, 25 bp, Mus musculus
aatgtcactagaggagaccaaggaa

SEQ ID NO: 512734 - DNA, 25 bp, Mus musculus
aatgtcagacagaataggcttcccc

SEQ ID NO: 512735 - DNA, 25 bp, Mus musculus
aatgtcagacagtataggcttcccc

SEQ ID NO: 512736 - DNA, 25 bp, Mus musculus
aatgtcagcccacgacaattgggcc

SEQ ID NO: 512737 - DNA, 25 bp, Mus musculus
aatgtcagcccaggacaattgggcc

SEQ ID NO: 512738 - DNA, 25 bp, Mus musculus
aatgtcagcggtacgtgggagttca

SEQ ID NO: 512739 - DNA, 25 bp, Mus musculus
aatgtcagcggttcgtgggagttca

SEQ ID NO: 512740 - DNA, 25 bp, Mus musculus
aatgtcagctgcagacagaaaagga

SEQ ID NO: 512741 - DNA, 25 bp, Mus musculus
aatgtcagctgctgacagaaaagga

SEQ ID NO: 512742 - DNA, 25 bp, Mus musculus
aatgtcaggttcaccgcgtatagga

SEQ ID NO: 512743 - DNA, 25 bp, Mus musculus
aatgtcaggttctccgcgtatagga

SEQ ID NO: 512744 - DNA, 25 bp, Mus musculus
aatgtcagtgacacaattgccatca

SEQ ID NO: 512745 - DNA, 25 bp, Mus musculus
aatgtcagtgactcaattgccatca

SEQ ID NO: 512746 - DNA, 25 bp, Mus musculus
aatgtcatccagaaggtcatcaaca

SEQ ID NO: 512747 - DNA, 25 bp, Mus musculus
aatgtcatccagtaggtcatcaaca

SEQ ID NO: 512748 - DNA, 25 bp, Mus musculus
aatgtcatctagagagagggcttta

SEQ ID NO: 512749 - DNA, 25 bp, Mus musculus
aatgtcatctagtgagagggcttta

SEQ ID NO: 512750 - DNA, 25 bp, Mus musculus
aatgtcatgaccctgtgtgccatgc

SEQ ID NO: 512751 - DNA, 25 bp, Mus musculus
aatgtcatgaccgtgtgtgccatgc

SEQ ID NO: 512752 - DNA, 25 bp, Mus musculus
aatgtcatgatgatccagtcctgca

SEQ ID NO: 512753 - DNA, 25 bp, Mus musculus
aatgtcatgatgttccagtcctgca

SEQ ID NO: 512754 - DNA, 25 bp, Mus musculus
aatgtcatgcccatgaatgcgctca

SEQ ID NO: 512755 - DNA, 25 bp, Mus musculus
aatgtcatgcccttgaatgcgctca

SEQ ID NO: 512756 - DNA, 25 bp, Mus musculus
aatgtcccgtttcctcaagttcagc

SEQ ID NO: 512757 - DNA, 25 bp, Mus musculus
aatgtcccgtttgctcaagttcagc

SEQ ID NO: 512758 - DNA, 25 bp, Mus musculus
aatgtccctatgaccccaagctgga

SEQ ID NO: 512759 - DNA, 25 bp, Mus musculus
aatgtccctatgtccccaagctgga

SEQ ID NO: 512760 - DNA, 25 bp, Mus musculus
aatgtccctgtgcttagttcggagg

SEQ ID NO: 512761 - DNA, 25 bp, Mus musculus
aatgtccctgtggttagttcggagg

SEQ ID NO: 512762 - DNA, 25 bp, Mus musculus
aatgtccgctccacactgtcctgaa

SEQ ID NO: 512763 - DNA, 25 bp, Mus musculus
aatgtccgctcctcactgtcctgaa

SEQ ID NO: 512764 - DNA, 25 bp, Mus musculus
aatgtcctcttaacaccatggtgag

SEQ ID NO: 512765 - DNA, 25 bp, Mus musculus
aatgtcctcttatcaccatggtgag

SEQ ID NO: 512766 - DNA, 25 bp, Mus musculus
aatgtcgaacctcgttctgtggctg

SEQ ID NO: 512767 - DNA, 25 bp, Mus musculus
aatgtcgaacctggttctgtggctg

SEQ ID NO: 512768 - DNA, 25 bp, Mus musculus
aatgtcgccaaaccctgtgacgagg

SEQ ID NO: 512769 - DNA, 25 bp, Mus musculus
aatgtcgccaaagcctgtgacgagg

SEQ ID NO: 512770 - DNA, 25 bp, Mus musculus
aatgtcgccgcacggcccagagtgt

SEQ ID NO: 512771 - DNA, 25 bp, Mus musculus
aatgtcgccgcagggcccagagtgt

SEQ ID NO: 512772 - DNA, 25 bp, Mus musculus
aatgtcgtggcacccacttcagggc

SEQ ID NO: 512773 - DNA, 25 bp, Mus musculus
aatgtcgtggcagccacttcagggc

SEQ ID NO: 512774 - DNA, 25 bp, Mus musculus
aatgtcgtggtcatagcctgccctg

SEQ ID NO: 512775 - DNA, 25 bp, Mus musculus
aatgtcgtggtcttagcctgccctg

SEQ ID NO: 512776 - DNA, 25 bp, Mus musculus
aatgtcgtttccctcaccctgatag

SEQ ID NO: 512777 - DNA, 25 bp, Mus musculus
aatgtcgtttccgtcaccctgatag

SEQ ID NO: 512778 - DNA, 25 bp, Mus musculus
aatgtctaacaaagtgagtgatccg

SEQ ID NO: 512779 - DNA, 25 bp, Mus musculus
aatgtctaacaatgtgagtgatccg

SEQ ID NO: 512780 - DNA, 25 bp, Mus musculus
aatgtctaccaacgagtagccagga

SEQ ID NO: 512781 - DNA, 25 bp, Mus musculus
aatgtctaccaaggagtagccagga

SEQ ID NO: 512782 - DNA, 25 bp, Mus musculus
aatgtctcactactgccgaaagacg

SEQ ID NO: 512783 - DNA, 25 bp, Mus musculus
aatgtctcactagtgccgaaagacg

SEQ ID NO: 512784 - DNA, 25 bp, Mus musculus
aatgtctcccgtcttctagtgttca

SEQ ID NO: 512785 - DNA, 25 bp, Mus musculus
aatgtctcccgtgttctagtgttca

SEQ ID NO: 512786 - DNA, 25 bp, Mus musculus
aatgtctcctgcctgtccgtccagg

SEQ ID NO: 512787 - DNA, 25 bp, Mus musculus
aatgtctcctgcgtgtccgtccagg

SEQ ID NO: 512788 - DNA, 25 bp, Mus musculus
aatgtctcggcaagaagacggtgga

SEQ ID NO: 512789 - DNA, 25 bp, Mus musculus
aatgtctcggcatgaagacggtgga

SEQ ID NO: 512790 - DNA, 25 bp, Mus musculus
aatgtctcgggcattcggacagagg

SEQ ID NO: 512791 - DNA, 25 bp, Mus musculus
aatgtctcgggctttcggacagagg

SEQ ID NO: 512792 - DNA, 25 bp, Mus musculus
aatgtctctgaactgccagcgtcgg

SEQ ID NO: 512793 - DNA, 25 bp, Mus musculus
aatgtctctgaagtgccagcgtcgg

SEQ ID NO: 512794 - DNA, 25 bp, Mus musculus
aatgtctgcgccatcgccgatttcg

SEQ ID NO: 512795 - DNA, 25 bp, Mus musculus
aatgtctgcgccttcgccgatttcg

SEQ ID NO: 512796 - DNA, 25 bp, Mus musculus
aatgtctgctgccaaagccatcgca

SEQ ID NO: 512797 - DNA, 25 bp, Mus musculus
aatgtctgctgcgaaagccatcgca

SEQ ID NO: 512798 - DNA, 25 bp, Mus musculus
aatgtctgttctagttttgcgggta

SEQ ID NO: 512799 - DNA, 25 bp, Mus musculus
aatgtctgttcttgttttgcgggta

SEQ ID NO: 512800 - DNA, 25 bp, Mus musculus
aatgtcttatctatggcccagctgc

SEQ ID NO: 512801 - DNA, 25 bp, Mus musculus
aatgtcttatctttggcccagctgc

SEQ ID NO: 512802 - DNA, 25 bp, Mus musculus
aatgtcttccggaccctgagagagg

SEQ ID NO: 512803 - DNA, 25 bp, Mus musculus
aatgtcttccggacctacgacaggg

SEQ ID NO: 512804 - DNA, 25 bp, Mus musculus
aatgtcttccggtccctgagagagg

SEQ ID NO: 512805 - DNA, 25 bp, Mus musculus
aatgtcttccggtcctacgacaggg

SEQ ID NO: 512806 - DNA, 25 bp, Mus musculus
aatgtctttgaaccccatgtggctg

SEQ ID NO: 512807 - DNA, 25 bp, Mus musculus
aatgtctttgaagcccatgtggctg

SEQ ID NO: 512808 - DNA, 25 bp, Mus musculus
aatgtctttgacaggctaggccgga

SEQ ID NO: 512809 - DNA, 25 bp, Mus musculus
aatgtctttgactggctaggccgga

SEQ ID NO: 512810 - DNA, 25 bp, Mus musculus
aatgtgaaaacaaacctggcagctt

SEQ ID NO: 512811 - DNA, 25 bp, Mus musculus
aatgtgaaaacatacctggcagctt

SEQ ID NO: 512812 - DNA, 25 bp, Mus musculus
aatgtgaaagcaagtcctaagagag

SEQ ID NO: 512813 - DNA, 25 bp, Mus musculus
aatgtgaaagcatgtcctaagagag

SEQ ID NO: 512814 - DNA, 25 bp, Mus musculus
aatgtgaaccacatccggaccagtc

SEQ ID NO: 512815 - DNA, 25 bp, Mus musculus
aatgtgaaccacttccggaccagtc

SEQ ID NO: 512816 - DNA, 25 bp, Mus musculus
aatgtgaaccccacgaacactaggc

SEQ ID NO: 512817 - DNA, 25 bp, Mus musculus
aatgtgaacccctcgaacactaggc

SEQ ID NO: 512818 - DNA, 25 bp, Mus musculus
aatgtgaacgcaagaagcaggcttg

SEQ ID NO: 512819 - DNA, 25 bp, Mus musculus
aatgtgaacgcatgaagcaggcttg

SEQ ID NO: 512820 - DNA, 25 bp, Mus musculus
aatgtgaagcagcacgctgatcaga

SEQ ID NO: 512821 - DNA, 25 bp, Mus musculus
aatgtgaagcaggacgctgatcaga

SEQ ID NO: 512822 - DNA, 25 bp, Mus musculus
aatgtgaagtacaagtgaaaaacgg

SEQ ID NO: 512823 - DNA, 25 bp, Mus musculus
aatgtgaagtactagtgaaaaacgg

SEQ ID NO: 512824 - DNA, 25 bp, Mus musculus
aatgtgaagtgccttagttgtgacc

SEQ ID NO: 512825 - DNA, 25 bp, Mus musculus
aatgtgaagtgcgttagttgtgacc

SEQ ID NO: 512826 - DNA, 25 bp, Mus musculus
aatgtgaccacaccagtatcagaag

SEQ ID NO: 512827 - DNA, 25 bp, Mus musculus
aatgtgaccacagcagtatcagaag

SEQ ID NO: 512828 - DNA, 25 bp, Mus musculus
aatgtgaccgcaaccaacgcgttct

SEQ ID NO: 512829 - DNA, 25 bp, Mus musculus
aatgtgaccgcatccaacgcgttct

SEQ ID NO: 512830 - DNA, 25 bp, Mus musculus
aatgtgactactccagagaagcggc

SEQ ID NO: 512831 - DNA, 25 bp, Mus musculus
aatgtgactactgcagagaagcggc

SEQ ID NO: 512832 - DNA, 25 bp, Mus musculus
aatgtgagaagtctcacccaggaac

SEQ ID NO: 512833 - DNA, 25 bp, Mus musculus
aatgtgagaagtgtcacccaggaac

SEQ ID NO: 512834 - DNA, 25 bp, Mus musculus
aatgtgagagctccaagttggcccc

SEQ ID NO: 512835 - DNA, 25 bp, Mus musculus
aatgtgagagctgcaagttggcccc

SEQ ID NO: 512836 - DNA, 25 bp, Mus musculus
aatgtgagcacaaaccatatttcag

SEQ ID NO: 512837 - DNA, 25 bp, Mus musculus
aatgtgagcacataccatatttcag

SEQ ID NO: 512838 - DNA, 25 bp, Mus musculus
aatgtgagctcacgcaacgttgacc

SEQ ID NO: 512839 - DNA, 25 bp, Mus musculus
aatgtgagctcaggcaacgttgacc

SEQ ID NO: 512840 - DNA, 25 bp, Mus musculus
aatgtgaggcgccagagtgacacct

SEQ ID NO: 512841 - DNA, 25 bp, Mus musculus
aatgtgaggcgcgagagtgacacct

SEQ ID NO: 512842 - DNA, 25 bp, Mus musculus
aatgtgaggtttctctttggaacca

SEQ ID NO: 512843 - DNA, 25 bp, Mus musculus
aatgtgaggtttgtctttggaacca

SEQ ID NO: 512844 - DNA, 25 bp, Mus musculus
aatgtgatatgtaaccaagggtgac

SEQ ID NO: 512845 - DNA, 25 bp, Mus musculus
aatgtgatatgttaccaagggtgac

SEQ ID NO: 512846 - DNA, 25 bp, Mus musculus
aatgtgatcctccatgtgggtagta

SEQ ID NO: 512847 - DNA, 25 bp, Mus musculus
aatgtgatcctcgatgtgggtagta

SEQ ID NO: 512848 - DNA, 25 bp, Mus musculus
aatgtgatgctacacagggacggcc

SEQ ID NO: 512849 - DNA, 25 bp, Mus musculus
aatgtgatgctagacagggacggcc

SEQ ID NO: 512850 - DNA, 25 bp, Mus musculus
aatgtgatgtgaagagaatagctga

SEQ ID NO: 512851 - DNA, 25 bp, Mus musculus
aatgtgatgtgatgagaatagctga

SEQ ID NO: 512852 - DNA, 25 bp, Mus musculus
aatgtgcaaaagcaagatgcaggac

SEQ ID NO: 512853 - DNA, 25 bp, Mus musculus
aatgtgcaaaaggaagatgcaggac

SEQ ID NO: 512854 - DNA, 25 bp, Mus musculus
aatgtgcaaagaacaacagacgggc

SEQ ID NO: 512855 - DNA, 25 bp, Mus musculus
aatgtgcaaagatcaacagacgggc

SEQ ID NO: 512856 - DNA, 25 bp, Mus musculus
aatgtgcacaagcatgagcccctcg

SEQ ID NO: 512857 - DNA, 25 bp, Mus musculus
aatgtgcacaaggatgagcccctcg

SEQ ID NO: 512858 - DNA, 25 bp, Mus musculus
aatgtgcactgaaggagcaggtagc

SEQ ID NO: 512859 - DNA, 25 bp, Mus musculus
aatgtgcactgatggagcaggtagc

SEQ ID NO: 512860 - DNA, 25 bp, Mus musculus
aatgtgcccatccaagcagcctgtt

SEQ ID NO: 512861 - DNA, 25 bp, Mus musculus
aatgtgcccatcgaagcagcctgtt

SEQ ID NO: 512862 - DNA, 25 bp, Mus musculus
aatgtgcccattcctcctgatccag

SEQ ID NO: 512863 - DNA, 25 bp, Mus musculus
aatgtgcccattgctcctgatccag

SEQ ID NO: 512864 - DNA, 25 bp, Mus musculus
aatgtgccgaaaatacctacaaatc

SEQ ID NO: 512865 - DNA, 25 bp, Mus musculus
aatgtgccgaaattacctacaaatc

SEQ ID NO: 512866 - DNA, 25 bp, Mus musculus
aatgtgccgataaccccggtggagg

SEQ ID NO: 512867 - DNA, 25 bp, Mus musculus
aatgtgccgatatccccggtggagg

SEQ ID NO: 512868 - DNA, 25 bp, Mus musculus
aatgtgccgccaagggaaaccttcg

SEQ ID NO: 512869 - DNA, 25 bp, Mus musculus
aatgtgccgccatgggaaaccttcg

SEQ ID NO: 512870 - DNA, 25 bp, Mus musculus
aatgtgccgggtaccgatttcagca

SEQ ID NO: 512871 - DNA, 25 bp, Mus musculus
aatgtgccgggttccgatttcagca

SEQ ID NO: 512872 - DNA, 25 bp, Mus musculus
aatgtgccgtgaagtatgtgagcag

SEQ ID NO: 512873 - DNA, 25 bp, Mus musculus
aatgtgccgtgatgtatgtgagcag

SEQ ID NO: 512874 - DNA, 25 bp, Mus musculus
aatgtgcctgtgaaccaggctacac

SEQ ID NO: 512875 - DNA, 25 bp, Mus musculus
aatgtgcctgtgtaccaggctacac

SEQ ID NO: 512876 - DNA, 25 bp, Mus musculus
aatgtgccttccctggagtctgccc

SEQ ID NO: 512877 - DNA, 25 bp, Mus musculus
aatgtgccttccgtggagtctgccc

SEQ ID NO: 512878 - DNA, 25 bp, Mus musculus
aatgtgcgcacaacactaagtgtct

SEQ ID NO: 512879 - DNA, 25 bp, Mus musculus
aatgtgcgcacatcactaagtgtct

SEQ ID NO: 512880 - DNA, 25 bp, Mus musculus
aatgtgcggaataccctgtggagac

SEQ ID NO: 512881 - DNA, 25 bp, Mus musculus
aatgtgcggaattccctgtggagac

SEQ ID NO: 512882 - DNA, 25 bp, Mus musculus
aatgtgctaggtaggaagaaagccc

SEQ ID NO: 512883 - DNA, 25 bp, Mus musculus
aatgtgctaggttggaagaaagccc

SEQ ID NO: 512884 - DNA, 25 bp, Mus musculus
aatgtgctccggagctgagcgccaa

SEQ ID NO: 512885 - DNA, 25 bp, Mus musculus
aatgtgctccggtgctgagcgccaa

SEQ ID NO: 512886 - DNA, 25 bp, Mus musculus
aatgtgctgacaatcctatgatgtt

SEQ ID NO: 512887 - DNA, 25 bp, Mus musculus
aatgtgctgacattcctatgatgtt

SEQ ID NO: 512888 - DNA, 25 bp, Mus musculus
aatgtgctgcttccatccgcagagc

SEQ ID NO: 512889 - DNA, 25 bp, Mus musculus
aatgtgctgcttgcatccgcagagc

SEQ ID NO: 512890 - DNA, 25 bp, Mus musculus
aatgtgctggatacggcagaaagcc

SEQ ID NO: 512891 - DNA, 25 bp, Mus musculus
aatgtgctggattcggcagaaagcc

SEQ ID NO: 512892 - DNA, 25 bp, Mus musculus
aatgtgctggcccatccttgcattg

SEQ ID NO: 512893 - DNA, 25 bp, Mus musculus
aatgtgctggccgatccttgcattg

SEQ ID NO: 512894 - DNA, 25 bp, Mus musculus
aatgtgcttttgagctgactcggga

SEQ ID NO: 512895 - DNA, 25 bp, Mus musculus
aatgtgcttttgtgctgactcggga

SEQ ID NO: 512896 - DNA, 25 bp, Mus musculus
aatgtggaattgcttcattttcctg

SEQ ID NO: 512897 - DNA, 25 bp, Mus musculus
aatgtggaattggttcattttcctg

SEQ ID NO: 512898 - DNA, 25 bp, Mus musculus
aatgtggaccagcatgtgcacgagc

SEQ ID NO: 512899 - DNA, 25 bp, Mus musculus
aatgtggaccaggatgtgcacgagc

SEQ ID NO: 512900 - DNA, 25 bp, Mus musculus
aatgtggacgctaacaatgacgggc

SEQ ID NO: 512901 - DNA, 25 bp, Mus musculus
aatgtggacgcttacaatgacgggc

SEQ ID NO: 512902 - DNA, 25 bp, Mus musculus
aatgtggacgttcagttggagaacc

SEQ ID NO: 512903 - DNA, 25 bp, Mus musculus
aatgtggacgttgagttggagaacc

SEQ ID NO: 512904 - DNA, 25 bp, Mus musculus
aatgtggactctatcatctccctct

SEQ ID NO: 512905 - DNA, 25 bp, Mus musculus
aatgtggactctttcatctccctct

SEQ ID NO: 512906 - DNA, 25 bp, Mus musculus
aatgtggacttaactgaagaagggt

SEQ ID NO: 512907 - DNA, 25 bp, Mus musculus
aatgtggacttatctgaagaagggt

SEQ ID NO: 512908 - DNA, 25 bp, Mus musculus
aatgtggagactcttgaatacaaga

SEQ ID NO: 512909 - DNA, 25 bp, Mus musculus
aatgtggagactgttgaatacaaga

SEQ ID NO: 512910 - DNA, 25 bp, Mus musculus
aatgtggagcagaccttcttcaatg

SEQ ID NO: 512911 - DNA, 25 bp, Mus musculus
aatgtggagcagatttctgagggca

SEQ ID NO: 512912 - DNA, 25 bp, Mus musculus
aatgtggagcagtccttcttcaatg

SEQ ID NO: 512913 - DNA, 25 bp, Mus musculus
aatgtggagcagttttctgagggca

SEQ ID NO: 512914 - DNA, 25 bp, Mus musculus
aatgtggcagccatcttagaactgg

SEQ ID NO: 512915 - DNA, 25 bp, Mus musculus
aatgtggcagccttcttagaactgg

SEQ ID NO: 512916 - DNA, 25 bp, Mus musculus
aatgtggcatccagaatggctgtga

SEQ ID NO: 512917 - DNA, 25 bp, Mus musculus
aatgtggcatcctgaatggctgtga

SEQ ID NO: 512918 - DNA, 25 bp, Mus musculus
aatgtggcctataacagtgtgctag

SEQ ID NO: 512919 - DNA, 25 bp, Mus musculus
aatgtggcctattacagtgtgctag

SEQ ID NO: 512920 - DNA, 25 bp, Mus musculus
aatgtggcctcacatttcttctagt

SEQ ID NO: 512921 - DNA, 25 bp, Mus musculus
aatgtggcctcagatttcttctagt

SEQ ID NO: 512922 - DNA, 25 bp, Mus musculus
aatgtggcttccctgctgtaggaaa

SEQ ID NO: 512923 - DNA, 25 bp, Mus musculus
aatgtggcttccgtgctgtaggaaa

SEQ ID NO: 512924 - DNA, 25 bp, Mus musculus
aatgtgggagatctttactttaggg

SEQ ID NO: 512925 - DNA, 25 bp, Mus musculus
aatgtgggagatgtttactttaggg

SEQ ID NO: 512926 - DNA, 25 bp, Mus musculus
aatgtgggtgtacacaggcaagacc

SEQ ID NO: 512927 - DNA, 25 bp, Mus musculus
aatgtgggtgtagacaggcaagacc

SEQ ID NO: 512928 - DNA, 25 bp, Mus musculus
aatgtggtaactactaggtgccccg

SEQ ID NO: 512929 - DNA, 25 bp, Mus musculus
aatgtggtaacttctaggtgccccg

SEQ ID NO: 512930 - DNA, 25 bp, Mus musculus
aatgtggtccctagccctctgccta

SEQ ID NO: 512931 - DNA, 25 bp, Mus musculus
aatgtggtcccttgccctctgccta

SEQ ID NO: 512932 - DNA, 25 bp, Mus musculus
aatgtggtgcgtctcctcctggcta

SEQ ID NO: 512933 - DNA, 25 bp, Mus musculus
aatgtggtgcgtgtcctcctggcta

SEQ ID NO: 512934 - DNA, 25 bp, Mus musculus
aatgtggttcctattcatgttccgc

SEQ ID NO: 512935 - DNA, 25 bp, Mus musculus
aatgtggttccttttcatgttccgc

SEQ ID NO: 512936 - DNA, 25 bp, Mus musculus
aatgtgtacttccagatgttgtgcc

SEQ ID NO: 512937 - DNA, 25 bp, Mus musculus
aatgtgtacttcgagatgttgtgcc

SEQ ID NO: 512938 - DNA, 25 bp, Mus musculus
aatgtgtagagcctgaggagaccac

SEQ ID NO: 512939 - DNA, 25 bp, Mus musculus
aatgtgtagagcgtgaggagaccac

SEQ ID NO: 512940 - DNA, 25 bp, Mus musculus
aatgtgtcactaccagcatgggcac

SEQ ID NO: 512941 - DNA, 25 bp, Mus musculus
aatgtgtcactagcagcatgggcac

SEQ ID NO: 512942 - DNA, 25 bp, Mus musculus
aatgtgtccattatactgccctggg

SEQ ID NO: 512943 - DNA, 25 bp, Mus musculus
aatgtgtccattttactgccctggg

SEQ ID NO: 512944 - DNA, 25 bp, Mus musculus
aatgtgtccgtcatcctctgcggaa

SEQ ID NO: 512945 - DNA, 25 bp, Mus musculus
aatgtgtccgtcttcctctgcggaa

SEQ ID NO: 512946 - DNA, 25 bp, Mus musculus
aatgtgtctgacattttggtgaaga

SEQ ID NO: 512947 - DNA, 25 bp, Mus musculus
aatgtgtctgactttttggtgaaga

SEQ ID NO: 512948 - DNA, 25 bp, Mus musculus
aatgtgtgctggattacatgactcc

SEQ ID NO: 512949 - DNA, 25 bp, Mus musculus
aatgtgtgctggtttacatgactcc

SEQ ID NO: 512950 - DNA, 25 bp, Mus musculus
aatgtgtggagacctggttctgttc

SEQ ID NO: 512951 - DNA, 25 bp, Mus musculus
aatgtgtggagagctggttctgttc

SEQ ID NO: 512952 - DNA, 25 bp, Mus musculus
aatgtgtgggcgatgacattgcctg

SEQ ID NO: 512953 - DNA, 25 bp, Mus musculus
aatgtgtgggcgttgacattgcctg

SEQ ID NO: 512954 - DNA, 25 bp, Mus musculus
aatgtgttactaccgctttgggcag

SEQ ID NO: 512955 - DNA, 25 bp, Mus musculus
aatgtgttactagcgctttgggcag

SEQ ID NO: 512956 - DNA, 25 bp, Mus musculus
aatgtgttctgtctaaactttggcg

SEQ ID NO: 512957 - DNA, 25 bp, Mus musculus
aatgtgttctgtctggaccaccaca

SEQ ID NO: 512958 - DNA, 25 bp, Mus musculus
aatgtgttctgtgtaaactttggcg

SEQ ID NO: 512959 - DNA, 25 bp, Mus musculus
aatgtgttctgtgtggaccaccaca

SEQ ID NO: 512960 - DNA, 25 bp, Mus musculus
aatgtgttgagacaattgtgaaggc

SEQ ID NO: 512961 - DNA, 25 bp, Mus musculus
aatgtgttgagagaattgtgaaggc

SEQ ID NO: 512962 - DNA, 25 bp, Mus musculus
aatgtgttgcatatgaatccttgaa

SEQ ID NO: 512963 - DNA, 25 bp, Mus musculus
aatgtgttgcatttgaatccttgaa

SEQ ID NO: 512964 - DNA, 25 bp, Mus musculus
aatgttaaaaacagtgactccagag

SEQ ID NO: 512965 - DNA, 25 bp, Mus musculus
aatgttaaaaactgtgactccagag

SEQ ID NO: 512966 - DNA, 25 bp, Mus musculus
aatgttagcgctctccccggagact

SEQ ID NO: 512967 - DNA, 25 bp, Mus musculus
aatgttagcgctgtccccggagact

SEQ ID NO: 512968 - DNA, 25 bp, Mus musculus
aatgttaggcacaggcgactctggc

SEQ ID NO: 512969 - DNA, 25 bp, Mus musculus
aatgttaggcactggcgactctggc

SEQ ID NO: 512970 - DNA, 25 bp, Mus musculus
aatgttattattcggcccaaatgac

SEQ ID NO: 512971 - DNA, 25 bp, Mus musculus
aatgttattattgggcccaaatgac

SEQ ID NO: 512972 - DNA, 25 bp, Mus musculus
aatgttattctaaccactggtggca

SEQ ID NO: 512973 - DNA, 25 bp, Mus musculus
aatgttattctatccactggtggca

SEQ ID NO: 512974 - DNA, 25 bp, Mus musculus
aatgttccctgtacaccgtgtccag

SEQ ID NO: 512975 - DNA, 25 bp, Mus musculus
aatgttccctgttcaccgtgtccag

SEQ ID NO: 512976 - DNA, 25 bp, Mus musculus
aatgttcgcccaccagaaagtcacc

SEQ ID NO: 512977 - DNA, 25 bp, Mus musculus
aatgttcgcccagcagaaagtcacc

SEQ ID NO: 512978 - DNA, 25 bp, Mus musculus
aatgttctacagataggaagtcaac

SEQ ID NO: 512979 - DNA, 25 bp, Mus musculus
aatgttctacagttaggaagtcaac

SEQ ID NO: 512980 - DNA, 25 bp, Mus musculus
aatgttctataccattgagccctgg

SEQ ID NO: 512981 - DNA, 25 bp, Mus musculus
aatgttctatacgattgagccctgg

SEQ ID NO: 512982 - DNA, 25 bp, Mus musculus
aatgttctatgacctctgcctgctg

SEQ ID NO: 512983 - DNA, 25 bp, Mus musculus
aatgttctatgagctctgcctgctg

SEQ ID NO: 512984 - DNA, 25 bp, Mus musculus
aatgttctgtacatgttagaaacaa

SEQ ID NO: 512985 - DNA, 25 bp, Mus musculus
aatgttctgtacttgttagaaacaa

SEQ ID NO: 512986 - DNA, 25 bp, Mus musculus
aatgttgaagagcactaccaaaatc

SEQ ID NO: 512987 - DNA, 25 bp, Mus musculus
aatgttgaagaggactaccaaaatc

SEQ ID NO: 512988 - DNA, 25 bp, Mus musculus
aatgttgagcgacaattctgcgacc

SEQ ID NO: 512989 - DNA, 25 bp, Mus musculus
aatgttgagcgagaattctgcgacc

SEQ ID NO: 512990 - DNA, 25 bp, Mus musculus
aatgttgattgacatgtccctgcag

SEQ ID NO: 512991 - DNA, 25 bp, Mus musculus
aatgttgattgagatgtccctgcag

SEQ ID NO: 512992 - DNA, 25 bp, Mus musculus
aatgttgcctacctggacgtacgta

SEQ ID NO: 512993 - DNA, 25 bp, Mus musculus
aatgttgcctacgtggacgtacgta

SEQ ID NO: 512994 - DNA, 25 bp, Mus musculus
aatgtttacaggcagcctcctgcct

SEQ ID NO: 512995 - DNA, 25 bp, Mus musculus
aatgtttacagggagcctcctgcct

SEQ ID NO: 512996 - DNA, 25 bp, Mus musculus
aatgtttcttttaacgccaacagag

SEQ ID NO: 512997 - DNA, 25 bp, Mus musculus
aatgtttctttttacgccaacagag

SEQ ID NO: 512998 - DNA, 25 bp, Mus musculus
aatgtttgatggctttacttacaag

SEQ ID NO: 512999 - DNA, 25 bp, Mus musculus
aatgtttgatgggtttacttacaag

SEQ ID NO: 513000 - DNA, 25 bp, Mus musculus
aatgtttgcaggaccaaagatggaa

SEQ ID NO: 513001 - DNA, 25 bp, Mus musculus
aatgtttgcaggtccaaagatggaa

SEQ ID NO: 513002 - DNA, 25 bp, Mus musculus
aatgtttgtctcaccttggaggatg

SEQ ID NO: 513003 - DNA, 25 bp, Mus musculus
aatgtttgtctctccttggaggatg

SEQ ID NO: 513004 - DNA, 25 bp, Mus musculus
aatgttttcacaccacagaaatccc

SEQ ID NO: 513005 - DNA, 25 bp, Mus musculus
aatgttttcacagcacagaaatccc

SEQ ID NO: 513006 - DNA, 25 bp, Mus musculus
aatgtttttagtcttggctcccgtg

SEQ ID NO: 513007 - DNA, 25 bp, Mus musculus
aatgtttttagtgttggctcccgtg

SEQ ID NO: 513008 - DNA, 25 bp, Mus musculus
aattaaaagccacactaagtcagta

SEQ ID NO: 513009 - DNA, 25 bp, Mus musculus
aattaaaagccagactaagtcagta

SEQ ID NO: 513010 - DNA, 25 bp, Mus musculus
aattaaacaactaccagaatcagac

SEQ ID NO: 513011 - DNA, 25 bp, Mus musculus
aattaaacaacttccagaatcagac

SEQ ID NO: 513012 - DNA, 25 bp, Mus musculus
aattaaacattcctgttcagcagtg

SEQ ID NO: 513013 - DNA, 25 bp, Mus musculus
aattaaacattcgtgttcagcagtg

SEQ ID NO: 513014 - DNA, 25 bp, Mus musculus
aattaaacttgcagcggaccaccca

SEQ ID NO: 513015 - DNA, 25 bp, Mus musculus
aattaaacttgctgcggaccaccca

SEQ ID NO: 513016 - DNA, 25 bp, Mus musculus
aattaaagccctcaaccagatccgg

SEQ ID NO: 513017 - DNA, 25 bp, Mus musculus
aattaaagccctgaaccagatccgg

SEQ ID NO: 513018 - DNA, 25 bp, Mus musculus
aattaaagggtgaccatttggagct

SEQ ID NO: 513019 - DNA, 25 bp, Mus musculus
aattaaagggtgtccatttggagct

SEQ ID NO: 513020 - DNA, 25 bp, Mus musculus
aattaaagttctcattcagagaggc

SEQ ID NO: 513021 - DNA, 25 bp, Mus musculus
aattaaagttctgattcagagaggc

SEQ ID NO: 513022 - DNA, 25 bp, Mus musculus
aattaacaagctcaccatcccggag

SEQ ID NO: 513023 - DNA, 25 bp, Mus musculus
aattaacaagctgaccatcccggag

SEQ ID NO: 513024 - DNA, 25 bp, Mus musculus
aattaaccagcgcttagatatgatg

SEQ ID NO: 513025 - DNA, 25 bp, Mus musculus
aattaaccagcggttagatatgatg

SEQ ID NO: 513026 - DNA, 25 bp, Mus musculus
aattaaccctgaatcctccagaagg

SEQ ID NO: 513027 - DNA, 25 bp, Mus musculus
aattaaccctgattcctccagaagg

SEQ ID NO: 513028 - DNA, 25 bp, Mus musculus
aattaactcgcccagtgtggactgt

SEQ ID NO: 513029 - DNA, 25 bp, Mus musculus
aattaactcgccgagtgtggactgt

SEQ ID NO: 513030 - DNA, 25 bp, Mus musculus
aattaacttggtagatggctttagc

SEQ ID NO: 513031 - DNA, 25 bp, Mus musculus
aattaacttggttgatggctttagc

SEQ ID NO: 513032 - DNA, 25 bp, Mus musculus
aattaagaggagaaatagcaggacc

SEQ ID NO: 513033 - DNA, 25 bp, Mus musculus
aattaagaggagtaatagcaggacc

SEQ ID NO: 513034 - DNA, 25 bp, Mus musculus
aattaagattctcagtgtaggcgga

SEQ ID NO: 513035 - DNA, 25 bp, Mus musculus
aattaagattctgagtgtaggcgga

SEQ ID NO: 513036 - DNA, 25 bp, Mus musculus
aattaagggctgatggtagatagga

SEQ ID NO: 513037 - DNA, 25 bp, Mus musculus
aattaagggctgttggtagatagga

SEQ ID NO: 513038 - DNA, 25 bp, Mus musculus
aattaagtgactaggccacagtcac

SEQ ID NO: 513039 - DNA, 25 bp, Mus musculus
aattaagtgacttggccacagtcac

SEQ ID NO: 513040 - DNA, 25 bp, Mus musculus
aattaatgtgagcaaatgcagacat

SEQ ID NO: 513041 - DNA, 25 bp, Mus musculus
aattaatgtgaggaaatgcagacat

SEQ ID NO: 513042 - DNA, 25 bp, Mus musculus
aattaatgttttctggcatgtaacc

SEQ ID NO: 513043 - DNA, 25 bp, Mus musculus
aattaatgttttgtggcatgtaacc

SEQ ID NO: 513044 - DNA, 25 bp, Mus musculus
aattacaacgtgagtaacgtgcaag

SEQ ID NO: 513045 - DNA, 25 bp, Mus musculus
aattacaacgtgtgtaacgtgcaag

SEQ ID NO: 513046 - DNA, 25 bp, Mus musculus
aattacaagagtatcctgggcatca

SEQ ID NO: 513047 - DNA, 25 bp, Mus musculus
aattacaagagtttcctgggcatca

SEQ ID NO: 513048 - DNA, 25 bp, Mus musculus
aattacacctatcgacggagacaac

SEQ ID NO: 513049 - DNA, 25 bp, Mus musculus
aattacacctatggacggagacaac

SEQ ID NO: 513050 - DNA, 25 bp, Mus musculus
aattaccaatgaccaaaaccgcctg

SEQ ID NO: 513051 - DNA, 25 bp, Mus musculus
aattaccaatgagcaaaaccgcctg

SEQ ID NO: 513052 - DNA, 25 bp, Mus musculus
aattaccatgctcggcattaccatc

SEQ ID NO: 513053 - DNA, 25 bp, Mus musculus
aattaccatgctgggcattaccatc

SEQ ID NO: 513054 - DNA, 25 bp, Mus musculus
aattacctgaagagacaaagttgga

SEQ ID NO: 513055 - DNA, 25 bp, Mus musculus
aattacctgaagtgacaaagttgga

SEQ ID NO: 513056 - DNA, 25 bp, Mus musculus
aattacctgacgctggaagctccag

SEQ ID NO: 513057 - DNA, 25 bp, Mus musculus
aattacctgacggtggaagctccag

SEQ ID NO: 513058 - DNA, 25 bp, Mus musculus
aattacctgcgcatctcagaggcca

SEQ ID NO: 513059 - DNA, 25 bp, Mus musculus
aattacctgcgcttctcagaggcca

SEQ ID NO: 513060 - DNA, 25 bp, Mus musculus
aattacctggcaaccaagggcgagg

SEQ ID NO: 513061 - DNA, 25 bp, Mus musculus
aattacctggcatccaagggcgagg

SEQ ID NO: 513062 - DNA, 25 bp, Mus musculus
aattaccttgatcatgctcttatga

SEQ ID NO: 513063 - DNA, 25 bp, Mus musculus
aattaccttgatgatgctcttatga

SEQ ID NO: 513064 - DNA, 25 bp, Mus musculus
aattacgtggctccagttgactcca

SEQ ID NO: 513065 - DNA, 25 bp, Mus musculus
aattacgtggctgcagttgactcca

SEQ ID NO: 513066 - DNA, 25 bp, Mus musculus
aattactatgatccctgctctgagg

SEQ ID NO: 513067 - DNA, 25 bp, Mus musculus
aattactatgatgcctgctctgagg

SEQ ID NO: 513068 - DNA, 25 bp, Mus musculus
aattactgacggatctccttccaaa

SEQ ID NO: 513069 - DNA, 25 bp, Mus musculus
aattactgacggttctccttccaaa

SEQ ID NO: 513070 - DNA, 25 bp, Mus musculus
aattactgtgtgaaaaaacatcttc

SEQ ID NO: 513071 - DNA, 25 bp, Mus musculus
aattactgtgtgtaaaaacatcttc

SEQ ID NO: 513072 - DNA, 25 bp, Mus musculus
aattacttcaatcccatgtttgctg

SEQ ID NO: 513073 - DNA, 25 bp, Mus musculus
aattacttcaatgccatgtttgctg

SEQ ID NO: 513074 - DNA, 25 bp, Mus musculus
aattacttcagaagctagtgactgg

SEQ ID NO: 513075 - DNA, 25 bp, Mus musculus
aattacttcagatgctagtgactgg

SEQ ID NO: 513076 - DNA, 25 bp, Mus musculus
aattacttgatacctcagggtctac

SEQ ID NO: 513077 - DNA, 25 bp, Mus musculus
aattacttgatagctcagggtctac

SEQ ID NO: 513078 - DNA, 25 bp, Mus musculus
aattagaaagcacagtgggaggctc

SEQ ID NO: 513079 - DNA, 25 bp, Mus musculus
aattagaaagcagagtgggaggctc

SEQ ID NO: 513080 - DNA, 25 bp, Mus musculus
aattagaagcctagcttcagggtgg

SEQ ID NO: 513081 - DNA, 25 bp, Mus musculus
aattagaagccttgcttcagggtgg

SEQ ID NO: 513082 - DNA, 25 bp, Mus musculus
aattagaaggcaatattcctggagc

SEQ ID NO: 513083 - DNA, 25 bp, Mus musculus
aattagaaggcattattcctggagc

SEQ ID NO: 513084 - DNA, 25 bp, Mus musculus
aattagaagttcactgcaccaagtg

SEQ ID NO: 513085 - DNA, 25 bp, Mus musculus
aattagaagttctctgcaccaagtg

SEQ ID NO: 513086 - DNA, 25 bp, Mus musculus
aattagacctttctggcgacattac

SEQ ID NO: 513087 - DNA, 25 bp, Mus musculus
aattagacctttgtggcgacattac

SEQ ID NO: 513088 - DNA, 25 bp, Mus musculus
aattagacggctccaacaagatgac

SEQ ID NO: 513089 - DNA, 25 bp, Mus musculus
aattagacggctgcaacaagatgac

SEQ ID NO: 513090 - DNA, 25 bp, Mus musculus
aattagcaccaaaccacgaggaagc

SEQ ID NO: 513091 - DNA, 25 bp, Mus musculus
aattagcaccaatccacgaggaagc

SEQ ID NO: 513092 - DNA, 25 bp, Mus musculus
aattaggaagctagagtctgcggtg

SEQ ID NO: 513093 - DNA, 25 bp, Mus musculus
aattaggaagcttgagtctgcggtg

SEQ ID NO: 513094 - DNA, 25 bp, Mus musculus
aattaggatgcaattgccttgtgtg

SEQ ID NO: 513095 - DNA, 25 bp, Mus musculus
aattaggatgcatttgccttgtgtg

SEQ ID NO: 513096 - DNA, 25 bp, Mus musculus
aattagggaagaagaggagcctccc

SEQ ID NO: 513097 - DNA, 25 bp, Mus musculus
aattagggaagatgaggagcctccc

SEQ ID NO: 513098 - DNA, 25 bp, Mus musculus
aattagtacttgagagtcctcttca

SEQ ID NO: 513099 - DNA, 25 bp, Mus musculus
aattagtacttgtgagtcctcttca

SEQ ID NO: 513100 - DNA, 25 bp, Mus musculus
aattagtctccgatatttatcttgg

SEQ ID NO: 513101 - DNA, 25 bp, Mus musculus
aattagtctccgttatttatcttgg

SEQ ID NO: 513102 - DNA, 25 bp, Mus musculus
aattagttacatatgaacacctggg

SEQ ID NO: 513103 - DNA, 25 bp, Mus musculus
aattagttacatttgaacacctggg

SEQ ID NO: 513104 - DNA, 25 bp, Mus musculus
aattataatgcaagccctttgctgg

SEQ ID NO: 513105 - DNA, 25 bp, Mus musculus
aattataatgcatgccctttgctgg

SEQ ID NO: 513106 - DNA, 25 bp, Mus musculus
aattatacaccacggcatctggagg

SEQ ID NO: 513107 - DNA, 25 bp, Mus musculus
aattatacaccagggcatctggagg

SEQ ID NO: 513108 - DNA, 25 bp, Mus musculus
aattatcccatccattccgtggaag

SEQ ID NO: 513109 - DNA, 25 bp, Mus musculus
aattatcccatcgattccgtggaag

SEQ ID NO: 513110 - DNA, 25 bp, Mus musculus
aattatcgccaccaacacataccaa

SEQ ID NO: 513111 - DNA, 25 bp, Mus musculus
aattatcgccacgaacacataccaa

SEQ ID NO: 513112 - DNA, 25 bp, Mus musculus
aattatctaaatagtgtgtctggca

SEQ ID NO: 513113 - DNA, 25 bp, Mus musculus
aattatctaaattgtgtgtctggca

SEQ ID NO: 513114 - DNA, 25 bp, Mus musculus
aattatctttaaccaactgtgcggt

SEQ ID NO: 513115 - DNA, 25 bp, Mus musculus
aattatctttaagcaactgtgcggt

SEQ ID NO: 513116 - DNA, 25 bp, Mus musculus
aattatgcttccatcattcgccgtg

SEQ ID NO: 513117 - DNA, 25 bp, Mus musculus
aattatgcttccttcattcgccgtg

SEQ ID NO: 513118 - DNA, 25 bp, Mus musculus
aattatggatcccaacattgttggc

SEQ ID NO: 513119 - DNA, 25 bp, Mus musculus
aattatggatccgaacattgttggc

SEQ ID NO: 513120 - DNA, 25 bp, Mus musculus
aattatggcatgactcgtatggacc

SEQ ID NO: 513121 - DNA, 25 bp, Mus musculus
aattatggcatgtctcgtatggacc

SEQ ID NO: 513122 - DNA, 25 bp, Mus musculus
aattatgtagaaaagaaaagctcac

SEQ ID NO: 513123 - DNA, 25 bp, Mus musculus
aattatgtagaatagaaaagctcac

SEQ ID NO: 513124 - DNA, 25 bp, Mus musculus
aattatgtctacaaagagagggacc

SEQ ID NO: 513125 - DNA, 25 bp, Mus musculus
aattatgtctactaagagagggacc

SEQ ID NO: 513126 - DNA, 25 bp, Mus musculus
aattattaaatcaagttgccttctg

SEQ ID NO: 513127 - DNA, 25 bp, Mus musculus
aattattaaatctagttgccttctg

SEQ ID NO: 513128 - DNA, 25 bp, Mus musculus
aattattctggcctttatgtctgta

SEQ ID NO: 513129 - DNA, 25 bp, Mus musculus
aattattctggcgtttatgtctgta

SEQ ID NO: 513130 - DNA, 25 bp, Mus musculus
aattattcttctattactgcaacca

SEQ ID NO: 513131 - DNA, 25 bp, Mus musculus
aattattcttcttttactgcaacca

SEQ ID NO: 513132 - DNA, 25 bp, Mus musculus
aattatttaagcaggctccggagaa

SEQ ID NO: 513133 - DNA, 25 bp, Mus musculus
aattatttaagctggctccggagaa

SEQ ID NO: 513134 - DNA, 25 bp, Mus musculus
aattatttgaagaactagggaagca

SEQ ID NO: 513135 - DNA, 25 bp, Mus musculus
aattatttgaagtactagggaagca

SEQ ID NO: 513136 - DNA, 25 bp, Mus musculus
aattatttgggaaagctatacgaca

SEQ ID NO: 513137 - DNA, 25 bp, Mus musculus
aattatttgggatagctatacgaca

SEQ ID NO: 513138 - DNA, 25 bp, Mus musculus
aattcaaaacaccagcgaaagtggg

SEQ ID NO: 513139 - DNA, 25 bp, Mus musculus
aattcaaaacacgagcgaaagtggg

SEQ ID NO: 513140 - DNA, 25 bp, Mus musculus
aattcaacctgcctcaagttagcag

SEQ ID NO: 513141 - DNA, 25 bp, Mus musculus
aattcaacctgcgtcaagttagcag

SEQ ID NO: 513142 - DNA, 25 bp, Mus musculus
aattcaacgggcaactgtgccacat

SEQ ID NO: 513143 - DNA, 25 bp, Mus musculus
aattcaacgggctactgtgccacat

SEQ ID NO: 513144 - DNA, 25 bp, Mus musculus
aattcaacgttcaagagttagcaag

SEQ ID NO: 513145 - DNA, 25 bp, Mus musculus
aattcaacgttctagagttagcaag

SEQ ID NO: 513146 - DNA, 25 bp, Mus musculus
aattcaactgccataaacgctgtgc

SEQ ID NO: 513147 - DNA, 25 bp, Mus musculus
aattcaactgccttaaacgctgtgc

SEQ ID NO: 513148 - DNA, 25 bp, Mus musculus
aattcaagctggagttcctgggaga

SEQ ID NO: 513149 - DNA, 25 bp, Mus musculus
aattcaagctggtgttcctgggaga

SEQ ID NO: 513150 - DNA, 25 bp, Mus musculus
aattcacaacttccattacactggg

SEQ ID NO: 513151 - DNA, 25 bp, Mus musculus
aattcacaacttgcattacactggg

SEQ ID NO: 513152 - DNA, 25 bp, Mus musculus
aattcacaccgactcttcagccagg

SEQ ID NO: 513153 - DNA, 25 bp, Mus musculus
aattcacaccgagtcttcagccagg

SEQ ID NO: 513154 - DNA, 25 bp, Mus musculus
aattcacactgactcatccctgatc

SEQ ID NO: 513155 - DNA, 25 bp, Mus musculus
aattcacactgagtcatccctgatc

SEQ ID NO: 513156 - DNA, 25 bp, Mus musculus
aattcacccggcaggagcccgtcta

SEQ ID NO: 513157 - DNA, 25 bp, Mus musculus
aattcacccggctggagcccgtcta

SEQ ID NO: 513158 - DNA, 25 bp, Mus musculus
aattcaccgggaagagggtcattgt

SEQ ID NO: 513159 - DNA, 25 bp, Mus musculus
aattcaccgggatgagggtcattgt

SEQ ID NO: 513160 - DNA, 25 bp, Mus musculus
aattcacctgccactcggagtgccg

SEQ ID NO: 513161 - DNA, 25 bp, Mus musculus
aattcacctgcctctcggagtgccg

SEQ ID NO: 513162 - DNA, 25 bp, Mus musculus
aattcacgtccaatggtcaaaaagg

SEQ ID NO: 513163 - DNA, 25 bp, Mus musculus
aattcacgtccattggtcaaaaagg

SEQ ID NO: 513164 - DNA, 25 bp, Mus musculus
aattcacgtggaccaatccactgca

SEQ ID NO: 513165 - DNA, 25 bp, Mus musculus
aattcacgtggagcaatccactgca

SEQ ID NO: 513166 - DNA, 25 bp, Mus musculus
aattcacttgttaagccaggattac

SEQ ID NO: 513167 - DNA, 25 bp, Mus musculus
aattcacttgtttagccaggattac

SEQ ID NO: 513168 - DNA, 25 bp, Mus musculus
aattcagaccatacggattcaacaa

SEQ ID NO: 513169 - DNA, 25 bp, Mus musculus
aattcagaccattcggattcaacaa

SEQ ID NO: 513170 - DNA, 25 bp, Mus musculus
aattcagactaccaactcacctaca

SEQ ID NO: 513171 - DNA, 25 bp, Mus musculus
aattcagactacgaactcacctaca

SEQ ID NO: 513172 - DNA, 25 bp, Mus musculus
aattcagatccaatgtgtttatgga

SEQ ID NO: 513173 - DNA, 25 bp, Mus musculus
aattcagatccattgtgtttatgga

SEQ ID NO: 513174 - DNA, 25 bp, Mus musculus
aattcagcaagtagttagctcaggg

SEQ ID NO: 513175 - DNA, 25 bp, Mus musculus
aattcagcaagttgttagctcaggg

SEQ ID NO: 513176 - DNA, 25 bp, Mus musculus
aattcagcacatcctgctgacggag

SEQ ID NO: 513177 - DNA, 25 bp, Mus musculus
aattcagcacatgctgctgacggag

SEQ ID NO: 513178 - DNA, 25 bp, Mus musculus
aattcagcagcaagtaaagttacaa

SEQ ID NO: 513179 - DNA, 25 bp, Mus musculus
aattcagcagcatgtaaagttacaa

SEQ ID NO: 513180 - DNA, 25 bp, Mus musculus
aattcaggcgaacctgagtcacgaa

SEQ ID NO: 513181 - DNA, 25 bp, Mus musculus
aattcaggcgaagctgagtcacgaa

SEQ ID NO: 513182 - DNA, 25 bp, Mus musculus
aattcaggtgccacaacttttccag

SEQ ID NO: 513183 - DNA, 25 bp, Mus musculus
aattcaggtgcctcaacttttccag

SEQ ID NO: 513184 - DNA, 25 bp, Mus musculus
aattcagtcagcactgccccagtgg

SEQ ID NO: 513185 - DNA, 25 bp, Mus musculus
aattcagtcagctctgccccagtgg

SEQ ID NO: 513186 - DNA, 25 bp, Mus musculus
aattcagtcttcagggtctcaagat

SEQ ID NO: 513187 - DNA, 25 bp, Mus musculus
aattcagtcttctgggtctcaagat

SEQ ID NO: 513188 - DNA, 25 bp, Mus musculus
aattcagtgaccaactgcttgggac

SEQ ID NO: 513189 - DNA, 25 bp, Mus musculus
aattcagtgacctactgcttgggac

SEQ ID NO: 513190 - DNA, 25 bp, Mus musculus
aattcatacccgagatagccccaaa

SEQ ID NO: 513191 - DNA, 25 bp, Mus musculus
aattcatacccgtgatagccccaaa

SEQ ID NO: 513192 - DNA, 25 bp, Mus musculus
aattcatagttcattaatcaaggac

SEQ ID NO: 513193 - DNA, 25 bp, Mus musculus
aattcatagttctttaatcaaggac

SEQ ID NO: 513194 - DNA, 25 bp, Mus musculus
aattcatcaattcccgaaaagagca

SEQ ID NO: 513195 - DNA, 25 bp, Mus musculus
aattcatcaattgccgaaaagagca

SEQ ID NO: 513196 - DNA, 25 bp, Mus musculus
aattcatcacccacctcttcaagtg

SEQ ID NO: 513197 - DNA, 25 bp, Mus musculus
aattcatcaccctcctcttcaagtg

SEQ ID NO: 513198 - DNA, 25 bp, Mus musculus
aattcatcctccatgagccacctgt

SEQ ID NO: 513199 - DNA, 25 bp, Mus musculus
aattcatcctccttgagccacctgt

SEQ ID NO: 513200 - DNA, 25 bp, Mus musculus
aattcatctatgctatttcgccagg

SEQ ID NO: 513201 - DNA, 25 bp, Mus musculus
aattcatctatggtatttcgccagg

SEQ ID NO: 513202 - DNA, 25 bp, Mus musculus
aattcatctcatcttgctctgcacc

SEQ ID NO: 513203 - DNA, 25 bp, Mus musculus
aattcatctcatgttgctctgcacc

SEQ ID NO: 513204 - DNA, 25 bp, Mus musculus
aattccaagatcctgctgcctctct

SEQ ID NO: 513205 - DNA, 25 bp, Mus musculus
aattccaagatcgtgctgcctctct

SEQ ID NO: 513206 - DNA, 25 bp, Mus musculus
aattccaagccaaagtgaaatacag

SEQ ID NO: 513207 - DNA, 25 bp, Mus musculus
aattccaagccatagtgaaatacag

SEQ ID NO: 513208 - DNA, 25 bp, Mus musculus
aattccaatgagaagcatctgaccc

SEQ ID NO: 513209 - DNA, 25 bp, Mus musculus
aattccaatgagtagcatctgaccc

SEQ ID NO: 513210 - DNA, 25 bp, Mus musculus
aattccaccgtcagcaaaaacaccg

SEQ ID NO: 513211 - DNA, 25 bp, Mus musculus
aattccaccgtctgcaaaaacaccg

SEQ ID NO: 513212 - DNA, 25 bp, Mus musculus
aattccagactactgcagcctccaa

SEQ ID NO: 513213 - DNA, 25 bp, Mus musculus
aattccagactagtgcagcctccaa

SEQ ID NO: 513214 - DNA, 25 bp, Mus musculus
aattccagtgctaaaggtattggca

SEQ ID NO: 513215 - DNA, 25 bp, Mus musculus
aattccagtgcttaaggtattggca

SEQ ID NO: 513216 - DNA, 25 bp, Mus musculus
aattccatcaaaagcaactctcttt

SEQ ID NO: 513217 - DNA, 25 bp, Mus musculus
aattccatcaaatgcaactctcttt

SEQ ID NO: 513218 - DNA, 25 bp, Mus musculus
aattccatcaagcaaaggaaaccca

SEQ ID NO: 513219 - DNA, 25 bp, Mus musculus
aattccatcaaggaaaggaaaccca

SEQ ID NO: 513220 - DNA, 25 bp, Mus musculus
aattccatctctactagcaaatctg

SEQ ID NO: 513221 - DNA, 25 bp, Mus musculus
aattccatctcttctagcaaatctg

SEQ ID NO: 513222 - DNA, 25 bp, Mus musculus
aattccatctgtacccctgacttct

SEQ ID NO: 513223 - DNA, 25 bp, Mus musculus
aattccatctgttcccctgacttct

SEQ ID NO: 513224 - DNA, 25 bp, Mus musculus
aattccatgttaagtgaaaatggcc

SEQ ID NO: 513225 - DNA, 25 bp, Mus musculus
aattccatgttatgtgaaaatggcc

SEQ ID NO: 513226 - DNA, 25 bp, Mus musculus
aattccccatgcagaaaacacttga

SEQ ID NO: 513227 - DNA, 25 bp, Mus musculus
aattccccatgctgaaaacacttga

SEQ ID NO: 513228 - DNA, 25 bp, Mus musculus
aattccgctgtcactcacgagcctg

SEQ ID NO: 513229 - DNA, 25 bp, Mus musculus
aattccgctgtctctcacgagcctg

SEQ ID NO: 513230 - DNA, 25 bp, Mus musculus
aattccggaggtcaccctggtcgcg

SEQ ID NO: 513231 - DNA, 25 bp, Mus musculus
aattccggaggtgaccctggtcgcg

SEQ ID NO: 513232 - DNA, 25 bp, Mus musculus
aattccgggatgagggaaagctgat

SEQ ID NO: 513233 - DNA, 25 bp, Mus musculus
aattccgggatgtgggaaagctgat

SEQ ID NO: 513234 - DNA, 25 bp, Mus musculus
aattcctaagcaatctctgttcccg

SEQ ID NO: 513235 - DNA, 25 bp, Mus musculus
aattcctaagcattctctgttcccg

SEQ ID NO: 513236 - DNA, 25 bp, Mus musculus
aattcctaccacaacgttcctgctg

SEQ ID NO: 513237 - DNA, 25 bp, Mus musculus
aattcctaccactacgttcctgctg

SEQ ID NO: 513238 - DNA, 25 bp, Mus musculus
aattcctagctacgtccggagttcg

SEQ ID NO: 513239 - DNA, 25 bp, Mus musculus
aattcctagctaggtccggagttcg

SEQ ID NO: 513240 - DNA, 25 bp, Mus musculus
aattcctatgagctgggctccctgc

SEQ ID NO: 513241 - DNA, 25 bp, Mus musculus
aattcctatgaggtgggctccctgc

SEQ ID NO: 513242 - DNA, 25 bp, Mus musculus
aattcctcaaatatggcatgactcc

SEQ ID NO: 513243 - DNA, 25 bp, Mus musculus
aattcctcaaatttggcatgactcc

SEQ ID NO: 513244 - DNA, 25 bp, Mus musculus
aattcctcatctcggacaccgctgg

SEQ ID NO: 513245 - DNA, 25 bp, Mus musculus
aattcctcatctgggacaccgctgg

SEQ ID NO: 513246 - DNA, 25 bp, Mus musculus
aattcctcgatgatcccaaatacag

SEQ ID NO: 513247 - DNA, 25 bp, Mus musculus
aattcctcgatgttcccaaatacag

SEQ ID NO: 513248 - DNA, 25 bp, Mus musculus
aattcctcttgcaatggctcctgtc

SEQ ID NO: 513249 - DNA, 25 bp, Mus musculus
aattcctcttgctatggctcctgtc

SEQ ID NO: 513250 - DNA, 25 bp, Mus musculus
aattcctgccctctggttacctgca

SEQ ID NO: 513251 - DNA, 25 bp, Mus musculus
aattcctgccctgtggttacctgca

SEQ ID NO: 513252 - DNA, 25 bp, Mus musculus
aattcctggcaaagatcagattgac

SEQ ID NO: 513253 - DNA, 25 bp, Mus musculus
aattcctggcaatgatcagattgac

SEQ ID NO: 513254 - DNA, 25 bp, Mus musculus
aattccttaccaatcccagactgga

SEQ ID NO: 513255 - DNA, 25 bp, Mus musculus
aattccttaccattcccagactgga

SEQ ID NO: 513256 - DNA, 25 bp, Mus musculus
aattccttggagacggtgggcacgc

SEQ ID NO: 513257 - DNA, 25 bp, Mus musculus
aattccttggagtcggtgggcacgc

SEQ ID NO: 513258 - DNA, 25 bp, Mus musculus
aattcgaaaagaagtgcccatcacc

SEQ ID NO: 513259 - DNA, 25 bp, Mus musculus
aattcgaaaagatgtgcccatcacc

SEQ ID NO: 513260 - DNA, 25 bp, Mus musculus
aattcggcgagtctgaaagcctcag

SEQ ID NO: 513261 - DNA, 25 bp, Mus musculus
aattcggcgagtgtgaaagcctcag

SEQ ID NO: 513262 - DNA, 25 bp, Mus musculus
aattcggtgactatgacattgaaga

SEQ ID NO: 513263 - DNA, 25 bp, Mus musculus
aattcggtgactttgacattgaaga

SEQ ID NO: 513264 - DNA, 25 bp, Mus musculus
aattcggtgtgtccaagcccgggaa

SEQ ID NO: 513265 - DNA, 25 bp, Mus musculus
aattcggtgtgtgcaagcccgggaa

SEQ ID NO: 513266 - DNA, 25 bp, Mus musculus
aattcgtgcgcgacctggtgcgtgc

SEQ ID NO: 513267 - DNA, 25 bp, Mus musculus
aattcgtgcgcgtcctggtgcgtgc

SEQ ID NO: 513268 - DNA, 25 bp, Mus musculus
aattctacaatgcctgggagcctcc

SEQ ID NO: 513269 - DNA, 25 bp, Mus musculus
aattctacaatggctgggagcctcc

SEQ ID NO: 513270 - DNA, 25 bp, Mus musculus
aattctacaattacttgcctgaggg

SEQ ID NO: 513271 - DNA, 25 bp, Mus musculus
aattctacaatttcttgcctgaggg

SEQ ID NO: 513272 - DNA, 25 bp, Mus musculus
aattctaccgcaacggcaagtatga

SEQ ID NO: 513273 - DNA, 25 bp, Mus musculus
aattctaccgcatcggcaagtatga

SEQ ID NO: 513274 - DNA, 25 bp, Mus musculus
aattctaccgctactaccaggtggc

SEQ ID NO: 513275 - DNA, 25 bp, Mus musculus
aattctaccgcttctaccaggtggc

SEQ ID NO: 513276 - DNA, 25 bp, Mus musculus
aattctacctgtaccctgacatcag

SEQ ID NO: 513277 - DNA, 25 bp, Mus musculus
aattctacctgttccctgacatcag

SEQ ID NO: 513278 - DNA, 25 bp, Mus musculus
aattctagctggagttggtactatt

SEQ ID NO: 513279 - DNA, 25 bp, Mus musculus
aattctagctggtgttggtactatt

SEQ ID NO: 513280 - DNA, 25 bp, Mus musculus
aattctaggtttcgataggtgcaga

SEQ ID NO: 513281 - DNA, 25 bp, Mus musculus
aattctaggtttggataggtgcaga

SEQ ID NO: 513282 - DNA, 25 bp, Mus musculus
aattctatgctgaagatccatgtaa

SEQ ID NO: 513283 - DNA, 25 bp, Mus musculus
aattctatgctgtagatccatgtaa

SEQ ID NO: 513284 - DNA, 25 bp, Mus musculus
aattctattcctcgagcaatcccca

SEQ ID NO: 513285 - DNA, 25 bp, Mus musculus
aattctattcctggagcaatcccca

SEQ ID NO: 513286 - DNA, 25 bp, Mus musculus
aattctcagcgacagaacggcctca

SEQ ID NO: 513287 - DNA, 25 bp, Mus musculus
aattctcagcgagagaacggcctca

SEQ ID NO: 513288 - DNA, 25 bp, Mus musculus
aattctcatcatcgccctggctgga

SEQ ID NO: 513289 - DNA, 25 bp, Mus musculus
aattctcatcatggccctggctgga

SEQ ID NO: 513290 - DNA, 25 bp, Mus musculus
aattctcatcgtcgagatctttggc

SEQ ID NO: 513291 - DNA, 25 bp, Mus musculus
aattctcatcgtggagatctttggc

SEQ ID NO: 513292 - DNA, 25 bp, Mus musculus
aattctcgcaaaaccatgtactgtg

SEQ ID NO: 513293 - DNA, 25 bp, Mus musculus
aattctcgcaaatccatgtactgtg

SEQ ID NO: 513294 - DNA, 25 bp, Mus musculus
aattctcgtatcatagaggcctgcg

SEQ ID NO: 513295 - DNA, 25 bp, Mus musculus
aattctcgtatcttagaggcctgcg

SEQ ID NO: 513296 - DNA, 25 bp, Mus musculus
aattctctaggacctgcactggaac

SEQ ID NO: 513297 - DNA, 25 bp, Mus musculus
aattctctaggagctgcactggaac

SEQ ID NO: 513298 - DNA, 25 bp, Mus musculus
aattctctcttccacgtggtgaccg

SEQ ID NO: 513299 - DNA, 25 bp, Mus musculus
aattctctcttcgacgtggtgaccg

SEQ ID NO: 513300 - DNA, 25 bp, Mus musculus
aattctctgcccattggaggtgtgg

SEQ ID NO: 513301 - DNA, 25 bp, Mus musculus
aattctctgccctttggaggtgtgg

SEQ ID NO: 513302 - DNA, 25 bp, Mus musculus
aattctctggcgagaggctgcagaa

SEQ ID NO: 513303 - DNA, 25 bp, Mus musculus
aattctctggcgtgaggctgcagaa

SEQ ID NO: 513304 - DNA, 25 bp, Mus musculus
aattctctggttatcttcgcaggca

SEQ ID NO: 513305 - DNA, 25 bp, Mus musculus
aattctctggttttcttcgcaggca

SEQ ID NO: 513306 - DNA, 25 bp, Mus musculus
aattctgaaactcctcgatgttgtc

SEQ ID NO: 513307 - DNA, 25 bp, Mus musculus
aattctgaaactgctcgatgttgtc

SEQ ID NO: 513308 - DNA, 25 bp, Mus musculus
aattctgaccaactctaacttgcct

SEQ ID NO: 513309 - DNA, 25 bp, Mus musculus
aattctgaccaagtctaacttgcct

SEQ ID NO: 513310 - DNA, 25 bp, Mus musculus
aattctgagctgactaacccctccg

SEQ ID NO: 513311 - DNA, 25 bp, Mus musculus
aattctgagctgtctaacccctccg

SEQ ID NO: 513312 - DNA, 25 bp, Mus musculus
aattctgagtgccaccaggacctgg

SEQ ID NO: 513313 - DNA, 25 bp, Mus musculus
aattctgagtgcgaccaggacctgg

SEQ ID NO: 513314 - DNA, 25 bp, Mus musculus
aattctgatggccacagcttcctaa

SEQ ID NO: 513315 - DNA, 25 bp, Mus musculus
aattctgatggcgacagcttcctaa

SEQ ID NO: 513316 - DNA, 25 bp, Mus musculus
aattctgcaggaacagcatggtgac

SEQ ID NO: 513317 - DNA, 25 bp, Mus musculus
aattctgcaggatcagcatggtgac

SEQ ID NO: 513318 - DNA, 25 bp, Mus musculus
aattctgcatagagaaccaccaacc

SEQ ID NO: 513319 - DNA, 25 bp, Mus musculus
aattctgcatagtgaaccaccaacc

SEQ ID NO: 513320 - DNA, 25 bp, Mus musculus
aattctgccgagacttgaagctaga

SEQ ID NO: 513321 - DNA, 25 bp, Mus musculus
aattctgccgagtcttgaagctaga

SEQ ID NO: 513322 - DNA, 25 bp, Mus musculus
aattctgccgcccttatcaggacca

SEQ ID NO: 513323 - DNA, 25 bp, Mus musculus
aattctgccgccgttatcaggacca

SEQ ID NO: 513324 - DNA, 25 bp, Mus musculus
aattctggacatacacaagatgaac

SEQ ID NO: 513325 - DNA, 25 bp, Mus musculus
aattctggacattcacaagatgaac

SEQ ID NO: 513326 - DNA, 25 bp, Mus musculus
aattctggattcagtagcttcacag

SEQ ID NO: 513327 - DNA, 25 bp, Mus musculus
aattctggattctgtagcttcacag

SEQ ID NO: 513328 - DNA, 25 bp, Mus musculus
aattctggccccatgtcttgctttc

SEQ ID NO: 513329 - DNA, 25 bp, Mus musculus
aattctggccccttgtcttgctttc

SEQ ID NO: 513330 - DNA, 25 bp, Mus musculus
aattctggctcaacactttggccag

SEQ ID NO: 513331 - DNA, 25 bp, Mus musculus
aattctggctcatcactttggccag

SEQ ID NO: 513332 - DNA, 25 bp, Mus musculus
aattctgtacctcggcgggcagctg

SEQ ID NO: 513333 - DNA, 25 bp, Mus musculus
aattctgtacctgggcgggcagctg

SEQ ID NO: 513334 - DNA, 25 bp, Mus musculus
aattctgttggtcctgggactctgc

SEQ ID NO: 513335 - DNA, 25 bp, Mus musculus
aattctgttggtgctgggactctgc

SEQ ID NO: 513336 - DNA, 25 bp, Mus musculus
aattctgttgttctacattgacacg

SEQ ID NO: 513337 - DNA, 25 bp, Mus musculus
aattctgttgttgtacattgacacg

SEQ ID NO: 513338 - DNA, 25 bp, Mus musculus
aattcttaccagctaattttggcag

SEQ ID NO: 513339 - DNA, 25 bp, Mus musculus
aattcttaccaggtaattttggcag

SEQ ID NO: 513340 - DNA, 25 bp, Mus musculus
aattcttaccgccaaactgacggat

SEQ ID NO: 513341 - DNA, 25 bp, Mus musculus
aattcttaccgcgaaactgacggat

SEQ ID NO: 513342 - DNA, 25 bp, Mus musculus
aattcttatcgccaaggatgcaaac

SEQ ID NO: 513343 - DNA, 25 bp, Mus musculus
aattcttatcgcgaaggatgcaaac

SEQ ID NO: 513344 - DNA, 25 bp, Mus musculus
aattcttcaattacctgcccctcag

SEQ ID NO: 513345 - DNA, 25 bp, Mus musculus
aattcttcaatttcctgcccctcag

SEQ ID NO: 513346 - DNA, 25 bp, Mus musculus
aattcttctccccagagtgagactt

SEQ ID NO: 513347 - DNA, 25 bp, Mus musculus
aattcttctcccgagagtgagactt

SEQ ID NO: 513348 - DNA, 25 bp, Mus musculus
aattcttctcttacgccacgacatg

SEQ ID NO: 513349 - DNA, 25 bp, Mus musculus
aattcttctctttcgccacgacatg

SEQ ID NO: 513350 - DNA, 25 bp, Mus musculus
aattcttgctgcaacttggagtgcc

SEQ ID NO: 513351 - DNA, 25 bp, Mus musculus
aattcttgctgctacttggagtgcc

SEQ ID NO: 513352 - DNA, 25 bp, Mus musculus
aattcttgctgtcgaaagcttaaac

SEQ ID NO: 513353 - DNA, 25 bp, Mus musculus
aattcttgctgtggaaagcttaaac

SEQ ID NO: 513354 - DNA, 25 bp, Mus musculus
aattcttggtcaacggaaatgcggg

SEQ ID NO: 513355 - DNA, 25 bp, Mus musculus
aattcttggtcatcggaaatgcggg

SEQ ID NO: 513356 - DNA, 25 bp, Mus musculus
aattctttagagcaaatgctggaaa

SEQ ID NO: 513357 - DNA, 25 bp, Mus musculus
aattctttagaggaaatgctggaaa

SEQ ID NO: 513358 - DNA, 25 bp, Mus musculus
aattctttatctctttagcattcgg

SEQ ID NO: 513359 - DNA, 25 bp, Mus musculus
aattctttatctgtttagcattcgg

SEQ ID NO: 513360 - DNA, 25 bp, Mus musculus
aattctttccaaagtccaggctcaa

SEQ ID NO: 513361 - DNA, 25 bp, Mus musculus
aattctttccaatgtccaggctcaa

SEQ ID NO: 513362 - DNA, 25 bp, Mus musculus
aattctttctttctagtgtgtaagg

SEQ ID NO: 513363 - DNA, 25 bp, Mus musculus
aattctttctttgtagtgtgtaagg

SEQ ID NO: 513364 - DNA, 25 bp, Mus musculus
aattctttgcaacctatggatctgg

SEQ ID NO: 513365 - DNA, 25 bp, Mus musculus
aattctttgcaagctatggatctgg

SEQ ID NO: 513366 - DNA, 25 bp, Mus musculus
aattctttgtggagtttgtgcatca

SEQ ID NO: 513367 - DNA, 25 bp, Mus musculus
aattctttgtggtgtttgtgcatca

SEQ ID NO: 513368 - DNA, 25 bp, Mus musculus
aattctttgttaaaggctgggattc

SEQ ID NO: 513369 - DNA, 25 bp, Mus musculus
aattctttgttataggctgggattc

SEQ ID NO: 513370 - DNA, 25 bp, Mus musculus
aattgaaacccaagcaccagcccta

SEQ ID NO: 513371 - DNA, 25 bp, Mus musculus
aattgaaacccatgcaccagcccta

SEQ ID NO: 513372 - DNA, 25 bp, Mus musculus
aattgaaactccaacgcagatatct

SEQ ID NO: 513373 - DNA, 25 bp, Mus musculus
aattgaaactcctacgcagatatct

SEQ ID NO: 513374 - DNA, 25 bp, Mus musculus
aattgaacagttatcccacactcac

SEQ ID NO: 513375 - DNA, 25 bp, Mus musculus
aattgaacagttttcccacactcac

SEQ ID NO: 513376 - DNA, 25 bp, Mus musculus
aattgaaccgtgcacagacccgttg

SEQ ID NO: 513377 - DNA, 25 bp, Mus musculus
aattgaaccgtggacagacccgttg

SEQ ID NO: 513378 - DNA, 25 bp, Mus musculus
aattgaagaacactccgcatacagc

SEQ ID NO: 513379 - DNA, 25 bp, Mus musculus
aattgaagaacagtccgcatacagc

SEQ ID NO: 513380 - DNA, 25 bp, Mus musculus
aattgaagccttacataaaaggagg

SEQ ID NO: 513381 - DNA, 25 bp, Mus musculus
aattgaagcctttcataaaaggagg

SEQ ID NO: 513382 - DNA, 25 bp, Mus musculus
aattgaagctggaattcgaggagca

SEQ ID NO: 513383 - DNA, 25 bp, Mus musculus
aattgaagctggtattcgaggagca

SEQ ID NO: 513384 - DNA, 25 bp, Mus musculus
aattgaagcttgaaaatgaggcttg

SEQ ID NO: 513385 - DNA, 25 bp, Mus musculus
aattgaagcttgtaaatgaggcttg

SEQ ID NO: 513386 - DNA, 25 bp, Mus musculus
aattgaataaagctagccgtgatcc

SEQ ID NO: 513387 - DNA, 25 bp, Mus musculus
aattgaataaaggtagccgtgatcc

SEQ ID NO: 513388 - DNA, 25 bp, Mus musculus
aattgaatggctacattcaaggcaa

SEQ ID NO: 513389 - DNA, 25 bp, Mus musculus
aattgaatggcttcattcaaggcaa

SEQ ID NO: 513390 - DNA, 25 bp, Mus musculus
aattgaatgtgaagcgaaaggaaac

SEQ ID NO: 513391 - DNA, 25 bp, Mus musculus
aattgaatgtgatgcgaaaggaaac

SEQ ID NO: 513392 - DNA, 25 bp, Mus musculus
aattgacaaatcactacttccaccc

SEQ ID NO: 513393 - DNA, 25 bp, Mus musculus
aattgacaaatctctacttccaccc

SEQ ID NO: 513394 - DNA, 25 bp, Mus musculus
aattgacactcccagcttggaggag

SEQ ID NO: 513395 - DNA, 25 bp, Mus musculus
aattgacactccgagcttggaggag

SEQ ID NO: 513396 - DNA, 25 bp, Mus musculus
aattgacagacgatatgcttgggtg

SEQ ID NO: 513397 - DNA, 25 bp, Mus musculus
aattgacagacgttatgcttgggtg

SEQ ID NO: 513398 - DNA, 25 bp, Mus musculus
aattgacctaatacctcgagacagg

SEQ ID NO: 513399 - DNA, 25 bp, Mus musculus
aattgacctaattcctcgagacagg

SEQ ID NO: 513400 - DNA, 25 bp, Mus musculus
aattgactttggcattgcgggcacc

SEQ ID NO: 513401 - DNA, 25 bp, Mus musculus
aattgactttgggattgcgggcacc

SEQ ID NO: 513402 - DNA, 25 bp, Mus musculus
aattgagaagcccaaagccttatcc

SEQ ID NO: 513403 - DNA, 25 bp, Mus musculus
aattgagaagccgaaagccttatcc

SEQ ID NO: 513404 - DNA, 25 bp, Mus musculus
aattgagagtatagccgtggcggcc

SEQ ID NO: 513405 - DNA, 25 bp, Mus musculus
aattgagagtattgccgtggcggcc

SEQ ID NO: 513406 - DNA, 25 bp, Mus musculus
aattgagagtgacccgtttgactgg

SEQ ID NO: 513407 - DNA, 25 bp, Mus musculus
aattgagagtgagccgtttgactgg

SEQ ID NO: 513408 - DNA, 25 bp, Mus musculus
aattgaggagcgctataggcccagc

SEQ ID NO: 513409 - DNA, 25 bp, Mus musculus
aattgaggagcggtataggcccagc

SEQ ID NO: 513410 - DNA, 25 bp, Mus musculus
aattgaggtggtctttactgttcac

SEQ ID NO: 513411 - DNA, 25 bp, Mus musculus
aattgaggtggtgtttactgttcac

SEQ ID NO: 513412 - DNA, 25 bp, Mus musculus
aattgagtgtctacagttgctcgcc

SEQ ID NO: 513413 - DNA, 25 bp, Mus musculus
aattgagtgtcttcagttgctcgcc

SEQ ID NO: 513414 - DNA, 25 bp, Mus musculus
aattgatgaaagctcactcacaggg

SEQ ID NO: 513415 - DNA, 25 bp, Mus musculus
aattgatgaaaggtcactcacaggg

SEQ ID NO: 513416 - DNA, 25 bp, Mus musculus
aattgatgacccagtccggaccgcc

SEQ ID NO: 513417 - DNA, 25 bp, Mus musculus
aattgatgaccctgtccggaccgcc

SEQ ID NO: 513418 - DNA, 25 bp, Mus musculus
aattgatgggtcacacaaggtcacc

SEQ ID NO: 513419 - DNA, 25 bp, Mus musculus
aattgatgggtctcacaaggtcacc

SEQ ID NO: 513420 - DNA, 25 bp, Mus musculus
aattgatgtgtaatgatgggattcc

SEQ ID NO: 513421 - DNA, 25 bp, Mus musculus
aattgatgtgtattgatgggattcc

SEQ ID NO: 513422 - DNA, 25 bp, Mus musculus
aattgattgataagctgaaagagga

SEQ ID NO: 513423 - DNA, 25 bp, Mus musculus
aattgattgatatgctgaaagagga

SEQ ID NO: 513424 - DNA, 25 bp, Mus musculus
aattgattgcccattgtgtaagaac

SEQ ID NO: 513425 - DNA, 25 bp, Mus musculus
aattgattgccctttgtgtaagaac

SEQ ID NO: 513426 - DNA, 25 bp, Mus musculus
aattgatttcccagctcgtagtatc

SEQ ID NO: 513427 - DNA, 25 bp, Mus musculus
aattgatttccctgctcgtagtatc

SEQ ID NO: 513428 - DNA, 25 bp, Mus musculus
aattgcaatggcactgcggcctgtg

SEQ ID NO: 513429 - DNA, 25 bp, Mus musculus
aattgcaatggctctgcggcctgtg

SEQ ID NO: 513430 - DNA, 25 bp, Mus musculus
aattgcagatgtaactgggattcct

SEQ ID NO: 513431 - DNA, 25 bp, Mus musculus
aattgcagatgttactgggattcct

SEQ ID NO: 513432 - DNA, 25 bp, Mus musculus
aattgcagccctacgatcagagctg

SEQ ID NO: 513433 - DNA, 25 bp, Mus musculus
aattgcagcccttcgatcagagctg

SEQ ID NO: 513434 - DNA, 25 bp, Mus musculus
aattgcagcgggactcggcactgat

SEQ ID NO: 513435 - DNA, 25 bp, Mus musculus
aattgcagcgggtctcggcactgat

SEQ ID NO: 513436 - DNA, 25 bp, Mus musculus
aattgcagtctgacccaggttccag

SEQ ID NO: 513437 - DNA, 25 bp, Mus musculus
aattgcagtctgtcccaggttccag

SEQ ID NO: 513438 - DNA, 25 bp, Mus musculus
aattgcagttttctctggactatga

SEQ ID NO: 513439 - DNA, 25 bp, Mus musculus
aattgcagttttgtctggactatga

SEQ ID NO: 513440 - DNA, 25 bp, Mus musculus
aattgcatcatcagcagatggcgga

SEQ ID NO: 513441 - DNA, 25 bp, Mus musculus
aattgcatcatctgcagatggcgga

SEQ ID NO: 513442 - DNA, 25 bp, Mus musculus
aattgccaatataccagcagcagct

SEQ ID NO: 513443 - DNA, 25 bp, Mus musculus
aattgccaatattccagcagcagct

SEQ ID NO: 513444 - DNA, 25 bp, Mus musculus
aattgccagaccagggaagccccag

SEQ ID NO: 513445 - DNA, 25 bp, Mus musculus
aattgccagacctgggaagccccag

SEQ ID NO: 513446 - DNA, 25 bp, Mus musculus
aattgcccaagaagtggattacgga

SEQ ID NO: 513447 - DNA, 25 bp, Mus musculus
aattgcccaagatgtggattacgga

SEQ ID NO: 513448 - DNA, 25 bp, Mus musculus
aattgcccacggacccttctggaga

SEQ ID NO: 513449 - DNA, 25 bp, Mus musculus
aattgcccacggtcccttctggaga

SEQ ID NO: 513450 - DNA, 25 bp, Mus musculus
aattgcccagtcacagtctggtacg

SEQ ID NO: 513451 - DNA, 25 bp, Mus musculus
aattgcccagtctcagtctggtacg

SEQ ID NO: 513452 - DNA, 25 bp, Mus musculus
aattgccctagaaggtgaaattggg

SEQ ID NO: 513453 - DNA, 25 bp, Mus musculus
aattgccctagatggtgaaattggg

SEQ ID NO: 513454 - DNA, 25 bp, Mus musculus
aattgcctatagcattttgtgggac

SEQ ID NO: 513455 - DNA, 25 bp, Mus musculus
aattgcctataggattttgtgggac

SEQ ID NO: 513456 - DNA, 25 bp, Mus musculus
aattgcctcaatcgcccctggagca

SEQ ID NO: 513457 - DNA, 25 bp, Mus musculus
aattgcctcaatggcccctggagca

SEQ ID NO: 513458 - DNA, 25 bp, Mus musculus
aattgccttcaacaacttggtgcag

SEQ ID NO: 513459 - DNA, 25 bp, Mus musculus
aattgccttcaagaacttggtgcag

SEQ ID NO: 513460 - DNA, 25 bp, Mus musculus
aattgcgttcccaactccgtgtgcg

SEQ ID NO: 513461 - DNA, 25 bp, Mus musculus
aattgcgttccctactccgtgtgcg

SEQ ID NO: 513462 - DNA, 25 bp, Mus musculus
aattgctaaaggaggcaaagcgtgg

SEQ ID NO: 513463 - DNA, 25 bp, Mus musculus
aattgctaaaggtggcaaagcgtgg

SEQ ID NO: 513464 - DNA, 25 bp, Mus musculus
aattgctagtgcaagcaggtgctga

SEQ ID NO: 513465 - DNA, 25 bp, Mus musculus
aattgctagtgctagcaggtgctga

SEQ ID NO: 513466 - DNA, 25 bp, Mus musculus
aattgctcagtgcagaatttttgga

SEQ ID NO: 513467 - DNA, 25 bp, Mus musculus
aattgctcagtggagaatttttgga

SEQ ID NO: 513468 - DNA, 25 bp, Mus musculus
aattgctcggaaccgggaaggctat

SEQ ID NO: 513469 - DNA, 25 bp, Mus musculus
aattgctcggaagcgggaaggctat

SEQ ID NO: 513470 - DNA, 25 bp, Mus musculus
aattgctgccctaccacgggatagc

SEQ ID NO: 513471 - DNA, 25 bp, Mus musculus
aattgctgcccttccacgggatagc

SEQ ID NO: 513472 - DNA, 25 bp, Mus musculus
aattgctgctctcatcctgaatcgg

SEQ ID NO: 513473 - DNA, 25 bp, Mus musculus
aattgctgctctgatcctgaatcgg

SEQ ID NO: 513474 - DNA, 25 bp, Mus musculus
aattgctggcttaaatcgccttcgg

SEQ ID NO: 513475 - DNA, 25 bp, Mus musculus
aattgctggctttaatcgccttcgg

SEQ ID NO: 513476 - DNA, 25 bp, Mus musculus
aattgctgttgcaaaaggtggttcc

SEQ ID NO: 513477 - DNA, 25 bp, Mus musculus
aattgctgttgctaaaggtggttcc

SEQ ID NO: 513478 - DNA, 25 bp, Mus musculus
aattgcttcaacaacgaaacataag

SEQ ID NO: 513479 - DNA, 25 bp, Mus musculus
aattgcttcaactacgaaacataag

SEQ ID NO: 513480 - DNA, 25 bp, Mus musculus
aattgcttctttatgcgatccagag

SEQ ID NO: 513481 - DNA, 25 bp, Mus musculus
aattgcttctttttgcgatccagag

SEQ ID NO: 513482 - DNA, 25 bp, Mus musculus
aattgctttatgagcctgttttgcc

SEQ ID NO: 513483 - DNA, 25 bp, Mus musculus
aattgctttatgtgcctgttttgcc

SEQ ID NO: 513484 - DNA, 25 bp, Mus musculus
aattgctttcatcctagacgcaaat

SEQ ID NO: 513485 - DNA, 25 bp, Mus musculus
aattgctttcatgctagacgcaaat

SEQ ID NO: 513486 - DNA, 25 bp, Mus musculus
aattggaaaactcggcgtatggtga

SEQ ID NO: 513487 - DNA, 25 bp, Mus musculus
aattggaaaactgggcgtatggtga

SEQ ID NO: 513488 - DNA, 25 bp, Mus musculus
aattggaacagcctcccctgaaagc

SEQ ID NO: 513489 - DNA, 25 bp, Mus musculus
aattggaacagcgtcccctgaaagc

SEQ ID NO: 513490 - DNA, 25 bp, Mus musculus
aattggaagaacacattactgctgc

SEQ ID NO: 513491 - DNA, 25 bp, Mus musculus
aattggaagaactcattactgctgc

SEQ ID NO: 513492 - DNA, 25 bp, Mus musculus
aattggaatagcctgtgcttatgcc

SEQ ID NO: 513493 - DNA, 25 bp, Mus musculus
aattggaatagcgtgtgcttatgcc

SEQ ID NO: 513494 - DNA, 25 bp, Mus musculus
aattggaatatcaaacatgatctga

SEQ ID NO: 513495 - DNA, 25 bp, Mus musculus
aattggaatatctaacatgatctga

SEQ ID NO: 513496 - DNA, 25 bp, Mus musculus
aattggacagaacggaaaggcctca

SEQ ID NO: 513497 - DNA, 25 bp, Mus musculus
aattggacagaagggaaaggcctca

SEQ ID NO: 513498 - DNA, 25 bp, Mus musculus
aattggactgagaggccccagtttc

SEQ ID NO: 513499 - DNA, 25 bp, Mus musculus
aattggactgagtggccccagtttc

SEQ ID NO: 513500 - DNA, 25 bp, Mus musculus
aattggagaaaaccattgatgactt

SEQ ID NO: 513501 - DNA, 25 bp, Mus musculus
aattggagaaaagcattgatgactt

SEQ ID NO: 513502 - DNA, 25 bp, Mus musculus
aattggaggccgagattcgaaagct

SEQ ID NO: 513503 - DNA, 25 bp, Mus musculus
aattggaggccgtgattcgaaagct

SEQ ID NO: 513504 - DNA, 25 bp, Mus musculus
aattggaggtgcagtgtccacaagg

SEQ ID NO: 513505 - DNA, 25 bp, Mus musculus
aattggaggtgctgtgtccacaagg

SEQ ID NO: 513506 - DNA, 25 bp, Mus musculus
aattggagttgaccattcgaatcac

SEQ ID NO: 513507 - DNA, 25 bp, Mus musculus
aattggagttgagcattcgaatcac

SEQ ID NO: 513508 - DNA, 25 bp, Mus musculus
aattggatgaacaccctgggcgtta

SEQ ID NO: 513509 - DNA, 25 bp, Mus musculus
aattggatgaaccttcgggatgccg

SEQ ID NO: 513510 - DNA, 25 bp, Mus musculus
aattggatgaacgttcgggatgccg

SEQ ID NO: 513511 - DNA, 25 bp, Mus musculus
aattggatgaactccctgggcgtta

SEQ ID NO: 513512 - DNA, 25 bp, Mus musculus
aattggatgccaatggtaccaaacg

SEQ ID NO: 513513 - DNA, 25 bp, Mus musculus
aattggatgccattggtaccaaacg

SEQ ID NO: 513514 - DNA, 25 bp, Mus musculus
aattggatgcgcaacacgcagacag

SEQ ID NO: 513515 - DNA, 25 bp, Mus musculus
aattggatgcgctacacgcagacag

SEQ ID NO: 513516 - DNA, 25 bp, Mus musculus
aattggcacgggacatgcagaccga

SEQ ID NO: 513517 - DNA, 25 bp, Mus musculus
aattggcacgggtcatgcagaccga

SEQ ID NO: 513518 - DNA, 25 bp, Mus musculus
aattggcatcctagtccctttcacg

SEQ ID NO: 513519 - DNA, 25 bp, Mus musculus
aattggcatccttgtccctttcacg

SEQ ID NO: 513520 - DNA, 25 bp, Mus musculus
aattggcctccaagaccgagagctc

SEQ ID NO: 513521 - DNA, 25 bp, Mus musculus
aattggcctccatgaccgagagctc

SEQ ID NO: 513522 - DNA, 25 bp, Mus musculus
aattggcctgatcaatcatttgatg

SEQ ID NO: 513523 - DNA, 25 bp, Mus musculus
aattggcctgatgaatcatttgatg

SEQ ID NO: 513524 - DNA, 25 bp, Mus musculus
aattggcgagacacatcctcacagg

SEQ ID NO: 513525 - DNA, 25 bp, Mus musculus
aattggcgagactcatcctcacagg

SEQ ID NO: 513526 - DNA, 25 bp, Mus musculus
aattggcggatgaacattcggagtg

SEQ ID NO: 513527 - DNA, 25 bp, Mus musculus
aattggcggatgtacattcggagtg

SEQ ID NO: 513528 - DNA, 25 bp, Mus musculus
aattggcggtatattgtgcccatga

SEQ ID NO: 513529 - DNA, 25 bp, Mus musculus
aattggcggtattttgtgcccatga

SEQ ID NO: 513530 - DNA, 25 bp, Mus musculus
aattggctagtacggagaaaacaga

SEQ ID NO: 513531 - DNA, 25 bp, Mus musculus
aattggctagtagggagaaaacaga

SEQ ID NO: 513532 - DNA, 25 bp, Mus musculus
aattggcttctaaattaccatggag

SEQ ID NO: 513533 - DNA, 25 bp, Mus musculus
aattggcttctatattaccatggag

SEQ ID NO: 513534 - DNA, 25 bp, Mus musculus
aattggctttgcatttggagcctta

SEQ ID NO: 513535 - DNA, 25 bp, Mus musculus
aattggctttgcttttggagcctta

SEQ ID NO: 513536 - DNA, 25 bp, Mus musculus
aattgggacgcacgcgcgaccacag

SEQ ID NO: 513537 - DNA, 25 bp, Mus musculus
aattgggacgcaggcgcgaccacag

SEQ ID NO: 513538 - DNA, 25 bp, Mus musculus
aattgggactctagcacatcttgac

SEQ ID NO: 513539 - DNA, 25 bp, Mus musculus
aattgggactcttgcacatcttgac

SEQ ID NO: 513540 - DNA, 25 bp, Mus musculus
aattgggatgatctcttggcccgcc

SEQ ID NO: 513541 - DNA, 25 bp, Mus musculus
aattgggatgatgtcttggcccgcc

SEQ ID NO: 513542 - DNA, 25 bp, Mus musculus
aattgggccacacgtaaaccacctg

SEQ ID NO: 513543 - DNA, 25 bp, Mus musculus
aattgggccacaggtaaaccacctg

SEQ ID NO: 513544 - DNA, 25 bp, Mus musculus
aattgggcctatctcttgcttcatc

SEQ ID NO: 513545 - DNA, 25 bp, Mus musculus
aattgggcctatgtcttgcttcatc

SEQ ID NO: 513546 - DNA, 25 bp, Mus musculus
aattggtacacacgagtgttgtctc

SEQ ID NO: 513547 - DNA, 25 bp, Mus musculus
aattggtacacaggagtgttgtctc

SEQ ID NO: 513548 - DNA, 25 bp, Mus musculus
aattggtgacaaaattgggatgttt

SEQ ID NO: 513549 - DNA, 25 bp, Mus musculus
aattggtgacaatattgggatgttt

SEQ ID NO: 513550 - DNA, 25 bp, Mus musculus
aattggtgtgtcagatccggaaaaa

SEQ ID NO: 513551 - DNA, 25 bp, Mus musculus
aattggtgtgtctgatccggaaaaa

SEQ ID NO: 513552 - DNA, 25 bp, Mus musculus
aattggttaggaaaattgcagccct

SEQ ID NO: 513553 - DNA, 25 bp, Mus musculus
aattggttaggataattgcagccct

SEQ ID NO: 513554 - DNA, 25 bp, Mus musculus
aattggttgtggaattgtggaaagc

SEQ ID NO: 513555 - DNA, 25 bp, Mus musculus
aattggttgtggtattgtggaaagc

SEQ ID NO: 513556 - DNA, 25 bp, Mus musculus
aattgtaagcaccttaggagaaggg

SEQ ID NO: 513557 - DNA, 25 bp, Mus musculus
aattgtaagcacgttaggagaaggg

SEQ ID NO: 513558 - DNA, 25 bp, Mus musculus
aattgtagacataggctcatttgcc

SEQ ID NO: 513559 - DNA, 25 bp, Mus musculus
aattgtagacattggctcatttgcc

SEQ ID NO: 513560 - DNA, 25 bp, Mus musculus
aattgtagcttaaccactttcagtg

SEQ ID NO: 513561 - DNA, 25 bp, Mus musculus
aattgtagcttatccactttcagtg

SEQ ID NO: 513562 - DNA, 25 bp, Mus musculus
aattgtataatcctgagggctagcc

SEQ ID NO: 513563 - DNA, 25 bp, Mus musculus
aattgtataatcgtgagggctagcc

SEQ ID NO: 513564 - DNA, 25 bp, Mus musculus
aattgtatctgtaggagatgaccag

SEQ ID NO: 513565 - DNA, 25 bp, Mus musculus
aattgtatctgttggagatgaccag

SEQ ID NO: 513566 - DNA, 25 bp, Mus musculus
aattgtatgcggaagagatctctga

SEQ ID NO: 513567 - DNA, 25 bp, Mus musculus
aattgtatgcggtagagatctctga

SEQ ID NO: 513568 - DNA, 25 bp, Mus musculus
aattgtcacctgcagcagaatcggg

SEQ ID NO: 513569 - DNA, 25 bp, Mus musculus
aattgtcacctggagcagaatcggg

SEQ ID NO: 513570 - DNA, 25 bp, Mus musculus
aattgtcactctccgccaggtgctg

SEQ ID NO: 513571 - DNA, 25 bp, Mus musculus
aattgtcactctgcgccaggtgctg

SEQ ID NO: 513572 - DNA, 25 bp, Mus musculus
aattgtcagaaaattgctgaatacc

SEQ ID NO: 513573 - DNA, 25 bp, Mus musculus
aattgtcagaaatttgctgaatacc

SEQ ID NO: 513574 - DNA, 25 bp, Mus musculus
aattgtcagcaactgtgacagaggc

SEQ ID NO: 513575 - DNA, 25 bp, Mus musculus
aattgtcagcaagtgtgacagaggc

SEQ ID NO: 513576 - DNA, 25 bp, Mus musculus
aattgtcgcgatcctagtctcaggg

SEQ ID NO: 513577 - DNA, 25 bp, Mus musculus
aattgtcgcgatgctagtctcaggg

SEQ ID NO: 513578 - DNA, 25 bp, Mus musculus
aattgtctccgtcttcctctatgga

SEQ ID NO: 513579 - DNA, 25 bp, Mus musculus
aattgtctccgtgttcctctatgga

SEQ ID NO: 513580 - DNA, 25 bp, Mus musculus
aattgtgaagacctgtctctgaaga

SEQ ID NO: 513581 - DNA, 25 bp, Mus musculus
aattgtgaagacgtgtctctgaaga

SEQ ID NO: 513582 - DNA, 25 bp, Mus musculus
aattgtgaatgcataacagcccagg

SEQ ID NO: 513583 - DNA, 25 bp, Mus musculus
aattgtgaatgcttaacagcccagg

SEQ ID NO: 513584 - DNA, 25 bp, Mus musculus
aattgtgacctcacgctggctctgg

SEQ ID NO: 513585 - DNA, 25 bp, Mus musculus
aattgtgacctctcgctggctctgg

SEQ ID NO: 513586 - DNA, 25 bp, Mus musculus
aattgtgacgatcctcatgaatgac

SEQ ID NO: 513587 - DNA, 25 bp, Mus musculus
aattgtgacgatgctcatgaatgac

SEQ ID NO: 513588 - DNA, 25 bp, Mus musculus
aattgtgactgtaagttgaagtggc

SEQ ID NO: 513589 - DNA, 25 bp, Mus musculus
aattgtgactgttagttgaagtggc

SEQ ID NO: 513590 - DNA, 25 bp, Mus musculus
aattgtgagcacagtaggctttggg

SEQ ID NO: 513591 - DNA, 25 bp, Mus musculus
aattgtgagcactgtaggctttggg

SEQ ID NO: 513592 - DNA, 25 bp, Mus musculus
aattgtgcagtaatggcatcaaggg

SEQ ID NO: 513593 - DNA, 25 bp, Mus musculus
aattgtgcagtaatttctgaatcac

SEQ ID NO: 513594 - DNA, 25 bp, Mus musculus
aattgtgcagtattggcatcaaggg

SEQ ID NO: 513595 - DNA, 25 bp, Mus musculus
aattgtgcagtattttctgaatcac

SEQ ID NO: 513596 - DNA, 25 bp, Mus musculus
aattgtggaggcagcaagttcggct

SEQ ID NO: 513597 - DNA, 25 bp, Mus musculus
aattgtggaggctgcaagttcggct

SEQ ID NO: 513598 - DNA, 25 bp, Mus musculus
aattgtggctgtaaatgttcctcct

SEQ ID NO: 513599 - DNA, 25 bp, Mus musculus
aattgtggctgttaatgttcctcct

SEQ ID NO: 513600 - DNA, 25 bp, Mus musculus
aattgtgggacccaattgcttcaac

SEQ ID NO: 513601 - DNA, 25 bp, Mus musculus
aattgtgggaccgaattgcttcaac

SEQ ID NO: 513602 - DNA, 25 bp, Mus musculus
aattgtgggtgcagcgactaaagga

SEQ ID NO: 513603 - DNA, 25 bp, Mus musculus
aattgtgggtgctgcgactaaagga

SEQ ID NO: 513604 - DNA, 25 bp, Mus musculus
aattgtggtgggatctgcaaactca

SEQ ID NO: 513605 - DNA, 25 bp, Mus musculus
aattgtggtgggttctgcaaactca

SEQ ID NO: 513606 - DNA, 25 bp, Mus musculus
aattgtgttcccatgccctgagcag

SEQ ID NO: 513607 - DNA, 25 bp, Mus musculus
aattgtgttcccttgccctgagcag

SEQ ID NO: 513608 - DNA, 25 bp, Mus musculus
aattgtgtttccagcccgggcaata

SEQ ID NO: 513609 - DNA, 25 bp, Mus musculus
aattgtgtttcctgcccgggcaata

SEQ ID NO: 513610 - DNA, 25 bp, Mus musculus
aattgttcacaacccacgagctcca

SEQ ID NO: 513611 - DNA, 25 bp, Mus musculus
aattgttcacaagccacgagctcca

SEQ ID NO: 513612 - DNA, 25 bp, Mus musculus
aattgttggccacctgtactgtctg

SEQ ID NO: 513613 - DNA, 25 bp, Mus musculus
aattgttggccagctgtactgtctg

SEQ ID NO: 513614 - DNA, 25 bp, Mus musculus
aattgttgtgtgatgcgttacacca

SEQ ID NO: 513615 - DNA, 25 bp, Mus musculus
aattgttgtgtgttgcgttacacca

SEQ ID NO: 513616 - DNA, 25 bp, Mus musculus
aatttaaaaggtcaagcggagctgc

SEQ ID NO: 513617 - DNA, 25 bp, Mus musculus
aatttaaaaggtgaagcggagctgc

SEQ ID NO: 513618 - DNA, 25 bp, Mus musculus
aatttaaggacgcacctgatgggcc

SEQ ID NO: 513619 - DNA, 25 bp, Mus musculus
aatttaaggacggacctgatgggcc

SEQ ID NO: 513620 - DNA, 25 bp, Mus musculus
aatttaatcctgattttgctgaagc

SEQ ID NO: 513621 - DNA, 25 bp, Mus musculus
aatttaatcctgtttttgctgaagc

SEQ ID NO: 513622 - DNA, 25 bp, Mus musculus
aatttaccacatatgacatcccgag

SEQ ID NO: 513623 - DNA, 25 bp, Mus musculus
aatttaccacatttgacatcccgag

SEQ ID NO: 513624 - DNA, 25 bp, Mus musculus
aatttactcaagagctccaacctcg

SEQ ID NO: 513625 - DNA, 25 bp, Mus musculus
aatttactcaagtgctccaacctcg

SEQ ID NO: 513626 - DNA, 25 bp, Mus musculus
aatttagcctttcgtacagatagcc

SEQ ID NO: 513627 - DNA, 25 bp, Mus musculus
aatttagcctttggtacagatagcc

SEQ ID NO: 513628 - DNA, 25 bp, Mus musculus
aatttagtgtgtaccacccgcctgt

SEQ ID NO: 513629 - DNA, 25 bp, Mus musculus
aatttagtgtgttccacccgcctgt

SEQ ID NO: 513630 - DNA, 25 bp, Mus musculus
aatttatatcccattgccagaggaa

SEQ ID NO: 513631 - DNA, 25 bp, Mus musculus
aatttatatccctttgccagaggaa

SEQ ID NO: 513632 - DNA, 25 bp, Mus musculus
aatttatcctgccaaaaacccagca

SEQ ID NO: 513633 - DNA, 25 bp, Mus musculus
aatttatcctgcgaaaaacccagca

SEQ ID NO: 513634 - DNA, 25 bp, Mus musculus
aatttatctgttctgggacctctca

SEQ ID NO: 513635 - DNA, 25 bp, Mus musculus
aatttatctgttgtgggacctctca

SEQ ID NO: 513636 - DNA, 25 bp, Mus musculus
aatttatgtagtcgtcaaagagccc

SEQ ID NO: 513637 - DNA, 25 bp, Mus musculus
aatttatgtagtggtcaaagagccc

SEQ ID NO: 513638 - DNA, 25 bp, Mus musculus
aatttattacagaacagggaacatg

SEQ ID NO: 513639 - DNA, 25 bp, Mus musculus
aatttattacagtacagggaacatg

SEQ ID NO: 513640 - DNA, 25 bp, Mus musculus
aatttattcagaatctgacgttggg

SEQ ID NO: 513641 - DNA, 25 bp, Mus musculus
aatttattcagattctgacgttggg

SEQ ID NO: 513642 - DNA, 25 bp, Mus musculus
aatttcaacagacagtctctgactg

SEQ ID NO: 513643 - DNA, 25 bp, Mus musculus
aatttcaacagagagtctctgactg

SEQ ID NO: 513644 - DNA, 25 bp, Mus musculus
aatttcaagtatctcaaaggtaagg

SEQ ID NO: 513645 - DNA, 25 bp, Mus musculus
aatttcaagtatgtcaaaggtaagg

SEQ ID NO: 513646 - DNA, 25 bp, Mus musculus
aatttcaagtggagtgaacttcaga

SEQ ID NO: 513647 - DNA, 25 bp, Mus musculus
aatttcaagtggtgtgaacttcaga

SEQ ID NO: 513648 - DNA, 25 bp, Mus musculus
aatttcacctacagccctgacaaca

SEQ ID NO: 513649 - DNA, 25 bp, Mus musculus
aatttcacctactgccctgacaaca

SEQ ID NO: 513650 - DNA, 25 bp, Mus musculus
aatttcacgattagcttctacaaag

SEQ ID NO: 513651 - DNA, 25 bp, Mus musculus
aatttcacgatttgcttctacaaag

SEQ ID NO: 513652 - DNA, 25 bp, Mus musculus
aatttcactacactggctcaggagg

SEQ ID NO: 513653 - DNA, 25 bp, Mus musculus
aatttcactacagtggctcaggagg

SEQ ID NO: 513654 - DNA, 25 bp, Mus musculus
aatttcagcaaaccacctccatttt

SEQ ID NO: 513655 - DNA, 25 bp, Mus musculus
aatttcagcaaagcacctccatttt

SEQ ID NO: 513656 - DNA, 25 bp, Mus musculus
aatttcagctccctgactttctgaa

SEQ ID NO: 513657 - DNA, 25 bp, Mus musculus
aatttcagctccgtgactttctgaa

SEQ ID NO: 513658 - DNA, 25 bp, Mus musculus
aatttcatagctcggtatctgatcc

SEQ ID NO: 513659 - DNA, 25 bp, Mus musculus
aatttcatagctgggtatctgatcc

SEQ ID NO: 513660 - DNA, 25 bp, Mus musculus
aatttccatgagctcatgctggccc

SEQ ID NO: 513661 - DNA, 25 bp, Mus musculus
aatttccatgaggtcatgctggccc

SEQ ID NO: 513662 - DNA, 25 bp, Mus musculus
aatttcccacacatcaagccatgag

SEQ ID NO: 513663 - DNA, 25 bp, Mus musculus
aatttcccacacttcaagccatgag

SEQ ID NO: 513664 - DNA, 25 bp, Mus musculus
aatttccctgtcatcctgaccagag

SEQ ID NO: 513665 - DNA, 25 bp, Mus musculus
aatttccctgtcttcctgaccagag

SEQ ID NO: 513666 - DNA, 25 bp, Mus musculus
aatttccggtgtcgctcgcattggg

SEQ ID NO: 513667 - DNA, 25 bp, Mus musculus
aatttccggtgtggctcgcattggg

SEQ ID NO: 513668 - DNA, 25 bp, Mus musculus
aatttcctacgaatcctgcagcggg

SEQ ID NO: 513669 - DNA, 25 bp, Mus musculus
aatttcctacgattcctgcagcggg

SEQ ID NO: 513670 - DNA, 25 bp, Mus musculus
aatttcgactttctcggagtctgga

SEQ ID NO: 513671 - DNA, 25 bp, Mus musculus
aatttcgactttgtcggagtctgga

SEQ ID NO: 513672 - DNA, 25 bp, Mus musculus
aatttcgagttgctggaatcaatgc

SEQ ID NO: 513673 - DNA, 25 bp, Mus musculus
aatttcgagttggtggaatcaatgc

SEQ ID NO: 513674 - DNA, 25 bp, Mus musculus
aatttcgcagagaagggcaccaagc

SEQ ID NO: 513675 - DNA, 25 bp, Mus musculus
aatttcgcagagtagggcaccaagc

SEQ ID NO: 513676 - DNA, 25 bp, Mus musculus
aatttcgcctctcagtgaatgccgg

SEQ ID NO: 513677 - DNA, 25 bp, Mus musculus
aatttcgcctctgagtgaatgccgg

SEQ ID NO: 513678 - DNA, 25 bp, Mus musculus
aatttctagggcagcatttttcagc

SEQ ID NO: 513679 - DNA, 25 bp, Mus musculus
aatttctagggctgcatttttcagc

SEQ ID NO: 513680 - DNA, 25 bp, Mus musculus
aatttctagtttcgtcaatcctgac

SEQ ID NO: 513681 - DNA, 25 bp, Mus musculus
aatttctagtttggtcaatcctgac

SEQ ID NO: 513682 - DNA, 25 bp, Mus musculus
aatttctcaccactggtatcagtac

SEQ ID NO: 513683 - DNA, 25 bp, Mus musculus
aatttctcaccagtggtatcagtac

SEQ ID NO: 513684 - DNA, 25 bp, Mus musculus
aatttctgaaaactcgggatgacct

SEQ ID NO: 513685 - DNA, 25 bp, Mus musculus
aatttctgaaaagtcgggatgacct

SEQ ID NO: 513686 - DNA, 25 bp, Mus musculus
aatttcttcagcactcccttctgag

SEQ ID NO: 513687 - DNA, 25 bp, Mus musculus
aatttcttcagctctcccttctgag

SEQ ID NO: 513688 - DNA, 25 bp, Mus musculus
aatttcttcgatacgcaccatgccg

SEQ ID NO: 513689 - DNA, 25 bp, Mus musculus
aatttcttcgattcgcaccatgccg

SEQ ID NO: 513690 - DNA, 25 bp, Mus musculus
aatttcttggtgaccgtggagcgcg

SEQ ID NO: 513691 - DNA, 25 bp, Mus musculus
aatttcttggtgtccgtggagcgcg

SEQ ID NO: 513692 - DNA, 25 bp, Mus musculus
aatttgaaacggacacagagccatc

SEQ ID NO: 513693 - DNA, 25 bp, Mus musculus
aatttgaaacggtcacagagccatc

SEQ ID NO: 513694 - DNA, 25 bp, Mus musculus
aatttgaaagatctactgagcaatc

SEQ ID NO: 513695 - DNA, 25 bp, Mus musculus
aatttgaaagatgtactgagcaatc

SEQ ID NO: 513696 - DNA, 25 bp, Mus musculus
aatttgaactgcagtggcttccgga

SEQ ID NO: 513697 - DNA, 25 bp, Mus musculus
aatttgaactgctgtggcttccgga

SEQ ID NO: 513698 - DNA, 25 bp, Mus musculus
aatttgaagtagatggtgacagccc

SEQ ID NO: 513699 - DNA, 25 bp, Mus musculus
aatttgaagtagttggtgacagccc

SEQ ID NO: 513700 - DNA, 25 bp, Mus musculus
aatttgacatctcgtacaatgagtc

SEQ ID NO: 513701 - DNA, 25 bp, Mus musculus
aatttgacatctggtacaatgagtc

SEQ ID NO: 513702 - DNA, 25 bp, Mus musculus
aatttgactttaaaggcgatccgct

SEQ ID NO: 513703 - DNA, 25 bp, Mus musculus
aatttgactttataggcgatccgct

SEQ ID NO: 513704 - DNA, 25 bp, Mus musculus
aatttgatcggcacgctgttgggat

SEQ ID NO: 513705 - DNA, 25 bp, Mus musculus
aatttgatcggctcgctgttgggat

SEQ ID NO: 513706 - DNA, 25 bp, Mus musculus
aatttgatgtttcatctcccaatgg

SEQ ID NO: 513707 - DNA, 25 bp, Mus musculus
aatttgatgtttgatctcccaatgg

SEQ ID NO: 513708 - DNA, 25 bp, Mus musculus
aatttgattctaacattgcaccagc

SEQ ID NO: 513709 - DNA, 25 bp, Mus musculus
aatttgattctatcattgcaccagc

SEQ ID NO: 513710 - DNA, 25 bp, Mus musculus
aatttgcaacaaatctcaggtcgga

SEQ ID NO: 513711 - DNA, 25 bp, Mus musculus
aatttgcaacaattctcaggtcgga

SEQ ID NO: 513712 - DNA, 25 bp, Mus musculus
aatttgcaaggacatctcctgtccc

SEQ ID NO: 513713 - DNA, 25 bp, Mus musculus
aatttgcaaggagatctcctgtccc

SEQ ID NO: 513714 - DNA, 25 bp, Mus musculus
aatttgcacatcagtgcctgcagct

SEQ ID NO: 513715 - DNA, 25 bp, Mus musculus
aatttgcacatctgtgcctgcagct

SEQ ID NO: 513716 - DNA, 25 bp, Mus musculus
aatttgcactccataccaaccagtg

SEQ ID NO: 513717 - DNA, 25 bp, Mus musculus
aatttgcactccttaccaaccagtg

SEQ ID NO: 513718 - DNA, 25 bp, Mus musculus
aatttgcagccgaaggaacctgtgc

SEQ ID NO: 513719 - DNA, 25 bp, Mus musculus
aatttgcagccgtaggaacctgtgc

SEQ ID NO: 513720 - DNA, 25 bp, Mus musculus
aatttgccaccacttgctgtgttcc

SEQ ID NO: 513721 - DNA, 25 bp, Mus musculus
aatttgccaccagttgctgtgttcc

SEQ ID NO: 513722 - DNA, 25 bp, Mus musculus
aatttgccatcgagcgcaagtgcca

SEQ ID NO: 513723 - DNA, 25 bp, Mus musculus
aatttgccatcgtgcgcaagtgcca

SEQ ID NO: 513724 - DNA, 25 bp, Mus musculus
aatttgcccgtgcaggtgtgtgacc

SEQ ID NO: 513725 - DNA, 25 bp, Mus musculus
aatttgcccgtggaggtgtgtgacc

SEQ ID NO: 513726 - DNA, 25 bp, Mus musculus
aatttgcgatcgagcccttgcatgc

SEQ ID NO: 513727 - DNA, 25 bp, Mus musculus
aatttgcgatcgtgcccttgcatgc

SEQ ID NO: 513728 - DNA, 25 bp, Mus musculus
aatttgctagaactgtaatccctgc

SEQ ID NO: 513729 - DNA, 25 bp, Mus musculus
aatttgctagaagtgtaatccctgc

SEQ ID NO: 513730 - DNA, 25 bp, Mus musculus
aatttggaccgtcatggaatggacc

SEQ ID NO: 513731 - DNA, 25 bp, Mus musculus
aatttggaccgtgatggaatggacc

SEQ ID NO: 513732 - DNA, 25 bp, Mus musculus
aatttggagtctacgtgcgctcgga

SEQ ID NO: 513733 - DNA, 25 bp, Mus musculus
aatttggagtcttcgtgcgctcgga

SEQ ID NO: 513734 - DNA, 25 bp, Mus musculus
aatttggagttgcatgaattcgtct

SEQ ID NO: 513735 - DNA, 25 bp, Mus musculus
aatttggagttggatgaattcgtct

SEQ ID NO: 513736 - DNA, 25 bp, Mus musculus
aatttggatctacactggtaacctc

SEQ ID NO: 513737 - DNA, 25 bp, Mus musculus
aatttggatctagactggtaacctc

SEQ ID NO: 513738 - DNA, 25 bp, Mus musculus
aatttggatggtctggccaatgctc

SEQ ID NO: 513739 - DNA, 25 bp, Mus musculus
aatttggatggtgtggccaatgctc

SEQ ID NO: 513740 - DNA, 25 bp, Mus musculus
aatttggattcgctgtctcttgggc

SEQ ID NO: 513741 - DNA, 25 bp, Mus musculus
aatttggattcggtgtctcttgggc

SEQ ID NO: 513742 - DNA, 25 bp, Mus musculus
aatttggcatgactccctccaaagg

SEQ ID NO: 513743 - DNA, 25 bp, Mus musculus
aatttggcatgagtccctccaaagg

SEQ ID NO: 513744 - DNA, 25 bp, Mus musculus
aatttggctcccctattctgctgca

SEQ ID NO: 513745 - DNA, 25 bp, Mus musculus
aatttggctcccgtattctgctgca

SEQ ID NO: 513746 - DNA, 25 bp, Mus musculus
aatttgggactcatatcatttgggc

SEQ ID NO: 513747 - DNA, 25 bp, Mus musculus
aatttgggactcttatcatttgggc

SEQ ID NO: 513748 - DNA, 25 bp, Mus musculus
aatttgggagccctgtccgcaatga

SEQ ID NO: 513749 - DNA, 25 bp, Mus musculus
aatttgggagccgtgtccgcaatga

SEQ ID NO: 513750 - DNA, 25 bp, Mus musculus
aatttgggtgttaatcagcatctat

SEQ ID NO: 513751 - DNA, 25 bp, Mus musculus
aatttgggtgtttatcagcatctat

SEQ ID NO: 513752 - DNA, 25 bp, Mus musculus
aatttggtgccacacgtttagcccg

SEQ ID NO: 513753 - DNA, 25 bp, Mus musculus
aatttggtgccagacgtttagcccg

SEQ ID NO: 513754 - DNA, 25 bp, Mus musculus
aatttgtcaagcctatctttacgga

SEQ ID NO: 513755 - DNA, 25 bp, Mus musculus
aatttgtcaagcgtatctttacgga

SEQ ID NO: 513756 - DNA, 25 bp, Mus musculus
aatttgtcaagtcgatgcagctggc

SEQ ID NO: 513757 - DNA, 25 bp, Mus musculus
aatttgtcaagtggatgcagctggc

SEQ ID NO: 513758 - DNA, 25 bp, Mus musculus
aatttgtctaatctctcaggctgac

SEQ ID NO: 513759 - DNA, 25 bp, Mus musculus
aatttgtctaatgtctcaggctgac

SEQ ID NO: 513760 - DNA, 25 bp, Mus musculus
aatttgtgatgaaggcctgagccaa

SEQ ID NO: 513761 - DNA, 25 bp, Mus musculus
aatttgtgatgatggcctgagccaa

SEQ ID NO: 513762 - DNA, 25 bp, Mus musculus
aatttgttatgaaacctccacaggt

SEQ ID NO: 513763 - DNA, 25 bp, Mus musculus
aatttgttatgatacctccacaggt

SEQ ID NO: 513764 - DNA, 25 bp, Mus musculus
aatttgttcaggacagacatagaaa

SEQ ID NO: 513765 - DNA, 25 bp, Mus musculus
aatttgttcaggtcagacatagaaa

SEQ ID NO: 513766 - DNA, 25 bp, Mus musculus
aattttaaatcgctacaagatggcg

SEQ ID NO: 513767 - DNA, 25 bp, Mus musculus
aattttaaatcggtacaagatggcg

SEQ ID NO: 513768 - DNA, 25 bp, Mus musculus
aattttaattagcacatgggactag

SEQ ID NO: 513769 - DNA, 25 bp, Mus musculus
aattttaattaggacatgggactag

SEQ ID NO: 513770 - DNA, 25 bp, Mus musculus
aattttaccccaacactgctgaatg

SEQ ID NO: 513771 - DNA, 25 bp, Mus musculus
aattttaccccatcactgctgaatg

SEQ ID NO: 513772 - DNA, 25 bp, Mus musculus
aattttatctcacctcaccaatgaa

SEQ ID NO: 513773 - DNA, 25 bp, Mus musculus
aattttatctcagctcaccaatgaa

SEQ ID NO: 513774 - DNA, 25 bp, Mus musculus
aattttcacggtcgcgtcacgcggg

SEQ ID NO: 513775 - DNA, 25 bp, Mus musculus
aattttcacggtggcgtcacgcggg

SEQ ID NO: 513776 - DNA, 25 bp, Mus musculus
aattttcaggatcgctgtattctgc

SEQ ID NO: 513777 - DNA, 25 bp, Mus musculus
aattttcaggatggctgtattctgc

SEQ ID NO: 513778 - DNA, 25 bp, Mus musculus
aattttccaaccaatctgcacccta

SEQ ID NO: 513779 - DNA, 25 bp, Mus musculus
aattttccaacctatctgcacccta

SEQ ID NO: 513780 - DNA, 25 bp, Mus musculus
aattttcctgtactatgaaggctga

SEQ ID NO: 513781 - DNA, 25 bp, Mus musculus
aattttcctgtagtatgaaggctga

SEQ ID NO: 513782 - DNA, 25 bp, Mus musculus
aattttcctttcatccttgtccttg

SEQ ID NO: 513783 - DNA, 25 bp, Mus musculus
aattttcctttcttccttgtccttg

SEQ ID NO: 513784 - DNA, 25 bp, Mus musculus
aattttcgaacactctttcccatag

SEQ ID NO: 513785 - DNA, 25 bp, Mus musculus
aattttcgaacagtctttcccatag

SEQ ID NO: 513786 - DNA, 25 bp, Mus musculus
aattttctagacacatacaagctgc

SEQ ID NO: 513787 - DNA, 25 bp, Mus musculus
aattttctagactcatacaagctgc

SEQ ID NO: 513788 - DNA, 25 bp, Mus musculus
aattttctcagcctgactgtggaag

SEQ ID NO: 513789 - DNA, 25 bp, Mus musculus
aattttctcagcgtgactgtggaag

SEQ ID NO: 513790 - DNA, 25 bp, Mus musculus
aattttctggagattctgcccctgc

SEQ ID NO: 513791 - DNA, 25 bp, Mus musculus
aattttctggagtttctgcccctgc

SEQ ID NO: 513792 - DNA, 25 bp, Mus musculus
aattttctgggacggaccgagcgca

SEQ ID NO: 513793 - DNA, 25 bp, Mus musculus
aattttctgggagggaccgagcgca

SEQ ID NO: 513794 - DNA, 25 bp, Mus musculus
aattttctgtgactaccccatccca

SEQ ID NO: 513795 - DNA, 25 bp, Mus musculus
aattttctgtgagtaccccatccca

SEQ ID NO: 513796 - DNA, 25 bp, Mus musculus
aattttcttggcacaaggagacatc

SEQ ID NO: 513797 - DNA, 25 bp, Mus musculus
aattttcttggctcaaggagacatc

SEQ ID NO: 513798 - DNA, 25 bp, Mus musculus
aattttgagcgtctgagcaggcagc

SEQ ID NO: 513799 - DNA, 25 bp, Mus musculus
aattttgagcgtgtgagcaggcagc

SEQ ID NO: 513800 - DNA, 25 bp, Mus musculus
aattttgatattctctctggaactc

SEQ ID NO: 513801 - DNA, 25 bp, Mus musculus
aattttgatattgtctctggaactc

SEQ ID NO: 513802 - DNA, 25 bp, Mus musculus
aattttgcatcaagtcaagctggaa

SEQ ID NO: 513803 - DNA, 25 bp, Mus musculus
aattttgcatcatgtcaagctggaa

SEQ ID NO: 513804 - DNA, 25 bp, Mus musculus
aattttgccgtcatacaacttgctt

SEQ ID NO: 513805 - DNA, 25 bp, Mus musculus
aattttgccgtcttacaacttgctt

SEQ ID NO: 513806 - DNA, 25 bp, Mus musculus
aattttgcggagacaaggcccctag

SEQ ID NO: 513807 - DNA, 25 bp, Mus musculus
aattttgcggagtcaaggcccctag

SEQ ID NO: 513808 - DNA, 25 bp, Mus musculus
aattttgcgtgactctctgcgtcag

SEQ ID NO: 513809 - DNA, 25 bp, Mus musculus
aattttgcgtgagtctctgcgtcag

SEQ ID NO: 513810 - DNA, 25 bp, Mus musculus
aattttggacggactggtcgcacca

SEQ ID NO: 513811 - DNA, 25 bp, Mus musculus
aattttggacggtctggtcgcacca

SEQ ID NO: 513812 - DNA, 25 bp, Mus musculus
aattttgggcttcatggatccggcc

SEQ ID NO: 513813 - DNA, 25 bp, Mus musculus
aattttgggcttgatggatccggcc

SEQ ID NO: 513814 - DNA, 25 bp, Mus musculus
aattttggtgaaccaagaattcaag

SEQ ID NO: 513815 - DNA, 25 bp, Mus musculus
aattttggtgaagcaagaattcaag

SEQ ID NO: 513816 - DNA, 25 bp, Mus musculus
aatttttccatgctctcttagctgc

SEQ ID NO: 513817 - DNA, 25 bp, Mus musculus
aatttttccatggtctcttagctgc

SEQ ID NO: 513818 - DNA, 25 bp, Mus musculus
aatttttcgcatcaccccccatgag

SEQ ID NO: 513819 - DNA, 25 bp, Mus musculus
aatttttcgcatgaccccccatgag

SEQ ID NO: 513820 - DNA, 25 bp, Mus musculus
aatttttctgcgagcttctccaaag

SEQ ID NO: 513821 - DNA, 25 bp, Mus musculus
aatttttctgcgtgcttctccaaag

SEQ ID NO: 513822 - DNA, 25 bp, Mus musculus
aatttttggtgacacacactgagcc

SEQ ID NO: 513823 - DNA, 25 bp, Mus musculus
aatttttggtgagacacactgagcc

SEQ ID NO: 513824 - DNA, 25 bp, Mus musculus
acaaaaacaacaacctgaaggagag

SEQ ID NO: 513825 - DNA, 25 bp, Mus musculus
acaaaaacaacatcctgaaggagag

SEQ ID NO: 513826 - DNA, 25 bp, Mus musculus
acaaaaacttttctagccaatcttg

SEQ ID NO: 513827 - DNA, 25 bp, Mus musculus
acaaaaacttttgtagccaatcttg

SEQ ID NO: 513828 - DNA, 25 bp, Mus musculus
acaaaaagtgttacacccatggaag

SEQ ID NO: 513829 - DNA, 25 bp, Mus musculus
acaaaaagtgtttcacccatggaag

SEQ ID NO: 513830 - DNA, 25 bp, Mus musculus
acaaaactgaggctgggaaatggac

SEQ ID NO: 513831 - DNA, 25 bp, Mus musculus
acaaaactgagggtgggaaatggac

SEQ ID NO: 513832 - DNA, 25 bp, Mus musculus
acaaaactggatatttgccctatca

SEQ ID NO: 513833 - DNA, 25 bp, Mus musculus
acaaaactggatttttgccctatca

SEQ ID NO: 513834 - DNA, 25 bp, Mus musculus
acaaaactgtttccgaaatgcagac

SEQ ID NO: 513835 - DNA, 25 bp, Mus musculus
acaaaactgtttgcgaaatgcagac

SEQ ID NO: 513836 - DNA, 25 bp, Mus musculus
acaaaagaaagacccgttcagccgg

SEQ ID NO: 513837 - DNA, 25 bp, Mus musculus
acaaaagaaagagccgttcagccgg

SEQ ID NO: 513838 - DNA, 25 bp, Mus musculus
acaaaagagactcagggcttccgcc

SEQ ID NO: 513839 - DNA, 25 bp, Mus musculus
acaaaagagactgagggcttccgcc

SEQ ID NO: 513840 - DNA, 25 bp, Mus musculus
acaaaaggatccatgccagaaacaa

SEQ ID NO: 513841 - DNA, 25 bp, Mus musculus
acaaaaggatccttgccagaaacaa

SEQ ID NO: 513842 - DNA, 25 bp, Mus musculus
acaaaaggtacaaggtaagcagtcc

SEQ ID NO: 513843 - DNA, 25 bp, Mus musculus
acaaaaggtacatggtaagcagtcc

SEQ ID NO: 513844 - DNA, 25 bp, Mus musculus
acaaaagttgttagccatggcagcc

SEQ ID NO: 513845 - DNA, 25 bp, Mus musculus
acaaaagttgtttgccatggcagcc

SEQ ID NO: 513846 - DNA, 25 bp, Mus musculus
acaaaatatcctctaaggtacacac

SEQ ID NO: 513847 - DNA, 25 bp, Mus musculus
acaaaatatcctgtaaggtacacac

SEQ ID NO: 513848 - DNA, 25 bp, Mus musculus
acaaacaaccctacgctgacctgat

SEQ ID NO: 513849 - DNA, 25 bp, Mus musculus
acaaacaacccttcgctgacctgat

SEQ ID NO: 513850 - DNA, 25 bp, Mus musculus
acaaacaacgcaacgaggacttccg

SEQ ID NO: 513851 - DNA, 25 bp, Mus musculus
acaaacaacgcatcgaggacttccg

SEQ ID NO: 513852 - DNA, 25 bp, Mus musculus
acaaacaagcccctgagtgtcaagg

SEQ ID NO: 513853 - DNA, 25 bp, Mus musculus
acaaacaagcccgtgagtgtcaagg

SEQ ID NO: 513854 - DNA, 25 bp, Mus musculus
acaaacagaccaaggaagaactgaa

SEQ ID NO: 513855 - DNA, 25 bp, Mus musculus
acaaacagaccatggaagaactgaa

SEQ ID NO: 513856 - DNA, 25 bp, Mus musculus
acaaacatatagagaagatgctgga

SEQ ID NO: 513857 - DNA, 25 bp, Mus musculus
acaaacatatagtgaagatgctgga

SEQ ID NO: 513858 - DNA, 25 bp, Mus musculus
acaaaccctttgagtccatcgacca

SEQ ID NO: 513859 - DNA, 25 bp, Mus musculus
acaaaccctttgtgtccatcgacca

SEQ ID NO: 513860 - DNA, 25 bp, Mus musculus
acaaaccgtctgataaggccaccct

SEQ ID NO: 513861 - DNA, 25 bp, Mus musculus
acaaaccgtctgttaaggccaccct

SEQ ID NO: 513862 - DNA, 25 bp, Mus musculus
acaaacctgaccacacagccgggtt

SEQ ID NO: 513863 - DNA, 25 bp, Mus musculus
acaaacctgacctcacagccgggtt

SEQ ID NO: 513864 - DNA, 25 bp, Mus musculus
acaaactccttgcagggcttgcggt

SEQ ID NO: 513865 - DNA, 25 bp, Mus musculus
acaaactccttggagggcttgcggt

SEQ ID NO: 513866 - DNA, 25 bp, Mus musculus
acaaactgcgcactgccgtggagga

SEQ ID NO: 513867 - DNA, 25 bp, Mus musculus
acaaactgcgcagtgccgtggagga

SEQ ID NO: 513868 - DNA, 25 bp, Mus musculus
acaaactgcgctcggaccctggtga

SEQ ID NO: 513869 - DNA, 25 bp, Mus musculus
acaaactgcgctgggaccctggtga

SEQ ID NO: 513870 - DNA, 25 bp, Mus musculus
acaaactgctcaccactgaaggagc

SEQ ID NO: 513871 - DNA, 25 bp, Mus musculus
acaaactgctcagcactgaaggagc

SEQ ID NO: 513872 - DNA, 25 bp, Mus musculus
acaaactttctaccgcatgagaaga

SEQ ID NO: 513873 - DNA, 25 bp, Mus musculus
acaaactttctagcgcatgagaaga

SEQ ID NO: 513874 - DNA, 25 bp, Mus musculus
acaaactttgcaccgattggtggtg

SEQ ID NO: 513875 - DNA, 25 bp, Mus musculus
acaaactttgcagcgattggtggtg

SEQ ID NO: 513876 - DNA, 25 bp, Mus musculus
acaaagaagagaacgggaagccagg

SEQ ID NO: 513877 - DNA, 25 bp, Mus musculus
acaaagaagagacccttctccagcg

SEQ ID NO: 513878 - DNA, 25 bp, Mus musculus
acaaagaagagagccttctccagcg

SEQ ID NO: 513879 - DNA, 25 bp, Mus musculus
acaaagaagagatcgggaagccagg

SEQ ID NO: 513880 - DNA, 25 bp, Mus musculus
acaaagaagtctatggaggatgcca

SEQ ID NO: 513881 - DNA, 25 bp, Mus musculus
acaaagaagtctttggaggatgcca

SEQ ID NO: 513882 - DNA, 25 bp, Mus musculus
acaaagaagttgcagatggaactac

SEQ ID NO: 513883 - DNA, 25 bp, Mus musculus
acaaagaagttggagatggaactac

SEQ ID NO: 513884 - DNA, 25 bp, Mus musculus
acaaagaatcaaatgagagcaagac

SEQ ID NO: 513885 - DNA, 25 bp, Mus musculus
acaaagaatcaattgagagcaagac

SEQ ID NO: 513886 - DNA, 25 bp, Mus musculus
acaaagacaagcacagccgcaacga

SEQ ID NO: 513887 - DNA, 25 bp, Mus musculus
acaaagacaagctcagccgcaacga

SEQ ID NO: 513888 - DNA, 25 bp, Mus musculus
acaaagacgaccctaccacaggagc

SEQ ID NO: 513889 - DNA, 25 bp, Mus musculus
acaaagacgaccgtaccacaggagc

SEQ ID NO: 513890 - DNA, 25 bp, Mus musculus
acaaagagctctccatggtaaagat

SEQ ID NO: 513891 - DNA, 25 bp, Mus musculus
acaaagagctctgcatggtaaagat

SEQ ID NO: 513892 - DNA, 25 bp, Mus musculus
acaaagaggtacaggagcaggccca

SEQ ID NO: 513893 - DNA, 25 bp, Mus musculus
acaaagaggtactggagcaggccca

SEQ ID NO: 513894 - DNA, 25 bp, Mus musculus
acaaagatgaaaaccaggaaatcct

SEQ ID NO: 513895 - DNA, 25 bp, Mus musculus
acaaagatgaaatccaggaaatcct

SEQ ID NO: 513896 - DNA, 25 bp, Mus musculus
acaaagcaagtcatcaccaagaagt

SEQ ID NO: 513897 - DNA, 25 bp, Mus musculus
acaaagcaagtcttcaccaagaagt

SEQ ID NO: 513898 - DNA, 25 bp, Mus musculus
acaaagcacttgagagttcagggcc

SEQ ID NO: 513899 - DNA, 25 bp, Mus musculus
acaaagcacttgtgagttcagggcc

SEQ ID NO: 513900 - DNA, 25 bp, Mus musculus
acaaagccaagtcggatgcatggaa

SEQ ID NO: 513901 - DNA, 25 bp, Mus musculus
acaaagccaagtgggatgcatggaa

SEQ ID NO: 513902 - DNA, 25 bp, Mus musculus
acaaagccacgtcggatgcaagaaa

SEQ ID NO: 513903 - DNA, 25 bp, Mus musculus
acaaagccacgtgggatgcaagaaa

SEQ ID NO: 513904 - DNA, 25 bp, Mus musculus
acaaagcccctgatggtgagcacgg

SEQ ID NO: 513905 - DNA, 25 bp, Mus musculus
acaaagcccctgttggtgagcacgg

SEQ ID NO: 513906 - DNA, 25 bp, Mus musculus
acaaagccgagacctcctttcgcag

SEQ ID NO: 513907 - DNA, 25 bp, Mus musculus
acaaagccgagagctcctttcgcag

SEQ ID NO: 513908 - DNA, 25 bp, Mus musculus
acaaagcctacgaggacgcagctga

SEQ ID NO: 513909 - DNA, 25 bp, Mus musculus
acaaagcctacgtggacgcagctga

SEQ ID NO: 513910 - DNA, 25 bp, Mus musculus
acaaagctgcctaccgacaggtcca

SEQ ID NO: 513911 - DNA, 25 bp, Mus musculus
acaaagctgccttccgacaggtcca

SEQ ID NO: 513912 - DNA, 25 bp, Mus musculus
acaaaggaagctcccgcctgcagga

SEQ ID NO: 513913 - DNA, 25 bp, Mus musculus
acaaaggaagctgccgcctgcagga

SEQ ID NO: 513914 - DNA, 25 bp, Mus musculus
acaaaggagcttagtgagtttgcta

SEQ ID NO: 513915 - DNA, 25 bp, Mus musculus
acaaaggagctttgtgagtttgcta

SEQ ID NO: 513916 - DNA, 25 bp, Mus musculus
acaaaggcattgagacagacggttc

SEQ ID NO: 513917 - DNA, 25 bp, Mus musculus
acaaaggcattgtgacagacggttc

SEQ ID NO: 513918 - DNA, 25 bp, Mus musculus
acaaaggcgagactcagcgatgccc

SEQ ID NO: 513919 - DNA, 25 bp, Mus musculus
acaaaggcgagagtcagcgatgccc

SEQ ID NO: 513920 - DNA, 25 bp, Mus musculus
acaaaggcggctccgcaggatcaag

SEQ ID NO: 513921 - DNA, 25 bp, Mus musculus
acaaaggcggctgcgcaggatcaag

SEQ ID NO: 513922 - DNA, 25 bp, Mus musculus
acaaagggatcacctacctctttga

SEQ ID NO: 513923 - DNA, 25 bp, Mus musculus
acaaagggatcagctacctctttga

SEQ ID NO: 513924 - DNA, 25 bp, Mus musculus
acaaagtgcttcatcagctgcgtat

SEQ ID NO: 513925 - DNA, 25 bp, Mus musculus
acaaagtgcttcttcagctgcgtat

SEQ ID NO: 513926 - DNA, 25 bp, Mus musculus
acaaagtggcgtacacaggctccac

SEQ ID NO: 513927 - DNA, 25 bp, Mus musculus
acaaagtggcgttcacaggctccac

SEQ ID NO: 513928 - DNA, 25 bp, Mus musculus
acaaagttgccccagctggctttga

SEQ ID NO: 513929 - DNA, 25 bp, Mus musculus
acaaagttgcccgagctggctttga

SEQ ID NO: 513930 - DNA, 25 bp, Mus musculus
acaaatccattgagccttatctgaa

SEQ ID NO: 513931 - DNA, 25 bp, Mus musculus
acaaatccattgtgccttatctgaa

SEQ ID NO: 513932 - DNA, 25 bp, Mus musculus
acaaatctgcatccatgtcaccggg

SEQ ID NO: 513933 - DNA, 25 bp, Mus musculus
acaaatctgcatgcatgtcaccggg

SEQ ID NO: 513934 - DNA, 25 bp, Mus musculus
acaaatcttcgaaggactcctcgaa

SEQ ID NO: 513935 - DNA, 25 bp, Mus musculus
acaaatcttcgatggactcctcgaa

SEQ ID NO: 513936 - DNA, 25 bp, Mus musculus
acaaatgagtacctggctatcaagc

SEQ ID NO: 513937 - DNA, 25 bp, Mus musculus
acaaatgagtacgtggctatcaagc

SEQ ID NO: 513938 - DNA, 25 bp, Mus musculus
acaaatgcacttctggaaagaaaac

SEQ ID NO: 513939 - DNA, 25 bp, Mus musculus
acaaatgcacttgtggaaagaaaac

SEQ ID NO: 513940 - DNA, 25 bp, Mus musculus
acaaatgcaggcctaagtcttccct

SEQ ID NO: 513941 - DNA, 25 bp, Mus musculus
acaaatgcaggcgtaagtcttccct

SEQ ID NO: 513942 - DNA, 25 bp, Mus musculus
acaaatgccagcctgatacccactt

SEQ ID NO: 513943 - DNA, 25 bp, Mus musculus
acaaatgccagcgtgatacccactt

SEQ ID NO: 513944 - DNA, 25 bp, Mus musculus
acaaatgccgggagaaggtggccaa

SEQ ID NO: 513945 - DNA, 25 bp, Mus musculus
acaaatgccgggtgaaggtggccaa

SEQ ID NO: 513946 - DNA, 25 bp, Mus musculus
acaaatggagagcaacccatggacc

SEQ ID NO: 513947 - DNA, 25 bp, Mus musculus
acaaatggagaggaacccatggacc

SEQ ID NO: 513948 - DNA, 25 bp, Mus musculus
acaaatggagccactttggaccacg

SEQ ID NO: 513949 - DNA, 25 bp, Mus musculus
acaaatggagcctctttggaccacg

SEQ ID NO: 513950 - DNA, 25 bp, Mus musculus
acaaatgtcgttcccctgacaagga

SEQ ID NO: 513951 - DNA, 25 bp, Mus musculus
acaaatgtcgttgccctgacaagga

SEQ ID NO: 513952 - DNA, 25 bp, Mus musculus
acaaatgtgcatattaccttaagga

SEQ ID NO: 513953 - DNA, 25 bp, Mus musculus
acaaatgtgcattttaccttaagga

SEQ ID NO: 513954 - DNA, 25 bp, Mus musculus
acaaattgcatgatgaagaggaaag

SEQ ID NO: 513955 - DNA, 25 bp, Mus musculus
acaaattgcatgttgaagaggaaag

SEQ ID NO: 513956 - DNA, 25 bp, Mus musculus
acaacaaaggagagactgccttcca

SEQ ID NO: 513957 - DNA, 25 bp, Mus musculus
acaacaaaggagtgactgccttcca

SEQ ID NO: 513958 - DNA, 25 bp, Mus musculus
acaacaacagagagcagcacaaaag

SEQ ID NO: 513959 - DNA, 25 bp, Mus musculus
acaacaacagagtgcagcacaaaag

SEQ ID NO: 513960 - DNA, 25 bp, Mus musculus
acaacaacgggacctatggcaagat

SEQ ID NO: 513961 - DNA, 25 bp, Mus musculus
acaacaacgggagctatggcaagat

SEQ ID NO: 513962 - DNA, 25 bp, Mus musculus
acaacaagacctacgactcttcctg

SEQ ID NO: 513963 - DNA, 25 bp, Mus musculus
acaacaagaccttcgactcttcctg

SEQ ID NO: 513964 - DNA, 25 bp, Mus musculus
acaacaattacgatgagaccctcag

SEQ ID NO: 513965 - DNA, 25 bp, Mus musculus
acaacaattacgttgagaccctcag

SEQ ID NO: 513966 - DNA, 25 bp, Mus musculus
acaacacagcagacaccccaggatg

SEQ ID NO: 513967 - DNA, 25 bp, Mus musculus
acaacacagcagtcaccccaggatg

SEQ ID NO: 513968 - DNA, 25 bp, Mus musculus
acaacacatctgactttggcagagt

SEQ ID NO: 513969 - DNA, 25 bp, Mus musculus
acaacacatctgtctttggcagagt

SEQ ID NO: 513970 - DNA, 25 bp, Mus musculus
acaacacccctgaaccgggagagtg

SEQ ID NO: 513971 - DNA, 25 bp, Mus musculus
acaacacccctgtaccgggagagtg

SEQ ID NO: 513972 - DNA, 25 bp, Mus musculus
acaacacgagaaccggcgcaggcag

SEQ ID NO: 513973 - DNA, 25 bp, Mus musculus
acaacacgagaagcggcgcaggcag

SEQ ID NO: 513974 - DNA, 25 bp, Mus musculus
acaacacgggcgaggagacccggct

SEQ ID NO: 513975 - DNA, 25 bp, Mus musculus
acaacacgggcgtggagacccggct

SEQ ID NO: 513976 - DNA, 25 bp, Mus musculus
acaacacgtacaagcgcaacaccag

SEQ ID NO: 513977 - DNA, 25 bp, Mus musculus
acaacacgtacatgcgcaacaccag

SEQ ID NO: 513978 - DNA, 25 bp, Mus musculus
acaacacgtatgctgaaccccaatt

SEQ ID NO: 513979 - DNA, 25 bp, Mus musculus
acaacacgtatggtgaaccccaatt

SEQ ID NO: 513980 - DNA, 25 bp, Mus musculus
acaacactgcttagcagtctgtctc

SEQ ID NO: 513981 - DNA, 25 bp, Mus musculus
acaacactgctttgcagtctgtctc

SEQ ID NO: 513982 - DNA, 25 bp, Mus musculus
acaacagatcaaccgaactgcccgg

SEQ ID NO: 513983 - DNA, 25 bp, Mus musculus
acaacagatcaagcgaactgcccgg

SEQ ID NO: 513984 - DNA, 25 bp, Mus musculus
acaacagatcacaacagctccagct

SEQ ID NO: 513985 - DNA, 25 bp, Mus musculus
acaacagatcactacagctccagct

SEQ ID NO: 513986 - DNA, 25 bp, Mus musculus
acaacagatctgctgcccatgcggg

SEQ ID NO: 513987 - DNA, 25 bp, Mus musculus
acaacagatctggtgcccatgcggg

SEQ ID NO: 513988 - DNA, 25 bp, Mus musculus
acaacagccacaacatcaggagcag

SEQ ID NO: 513989 - DNA, 25 bp, Mus musculus
acaacagccacatcatcaggagcag

SEQ ID NO: 513990 - DNA, 25 bp, Mus musculus
acaacaggagaacggaactgtttct

SEQ ID NO: 513991 - DNA, 25 bp, Mus musculus
acaacaggagaagggaactgtttct

SEQ ID NO: 513992 - DNA, 25 bp, Mus musculus
acaacaggtggcaacagtcatacag

SEQ ID NO: 513993 - DNA, 25 bp, Mus musculus
acaacaggtggctacagtcatacag

SEQ ID NO: 513994 - DNA, 25 bp, Mus musculus
acaacaggttctacatccaatggca

SEQ ID NO: 513995 - DNA, 25 bp, Mus musculus
acaacaggttcttcatccaatggca

SEQ ID NO: 513996 - DNA, 25 bp, Mus musculus
acaacagtgacaagtccagcaccta

SEQ ID NO: 513997 - DNA, 25 bp, Mus musculus
acaacagtgacatgtccagcaccta

SEQ ID NO: 513998 - DNA, 25 bp, Mus musculus
acaacagtggagatattcaataagc

SEQ ID NO: 513999 - DNA, 25 bp, Mus musculus
acaacagtggagttattcaataagc

SEQ ID NO: 514000 - DNA, 25 bp, Mus musculus
acaacagttgacagctatgtggctg

SEQ ID NO: 514001 - DNA, 25 bp, Mus musculus
acaacagttgactgctatgtggctg

SEQ ID NO: 514002 - DNA, 25 bp, Mus musculus
acaacagtttctagccatcaatgga

SEQ ID NO: 514003 - DNA, 25 bp, Mus musculus
acaacagtttcttgccatcaatgga

SEQ ID NO: 514004 - DNA, 25 bp, Mus musculus
acaacatatacaccacatccaaagg

SEQ ID NO: 514005 - DNA, 25 bp, Mus musculus
acaacatatacagcacatccaaagg

SEQ ID NO: 514006 - DNA, 25 bp, Mus musculus
acaacatcaacactgtcctggagtc

SEQ ID NO: 514007 - DNA, 25 bp, Mus musculus
acaacatcaacagtgtcctggagtc

SEQ ID NO: 514008 - DNA, 25 bp, Mus musculus
acaacatccacgctgaaatctgctt

SEQ ID NO: 514009 - DNA, 25 bp, Mus musculus
acaacatccacggtgaaatctgctt

SEQ ID NO: 514010 - DNA, 25 bp, Mus musculus
acaacatccattaacacccagagga

SEQ ID NO: 514011 - DNA, 25 bp, Mus musculus
acaacatccatttacacccagagga

SEQ ID NO: 514012 - DNA, 25 bp, Mus musculus
acaacatcgtgaagtgccagaagct

SEQ ID NO: 514013 - DNA, 25 bp, Mus musculus
acaacatcgtgatgtgccagaagct

SEQ ID NO: 514014 - DNA, 25 bp, Mus musculus
acaacatcgtttcctggccattggg

SEQ ID NO: 514015 - DNA, 25 bp, Mus musculus
acaacatcgtttgctggccattggg

SEQ ID NO: 514016 - DNA, 25 bp, Mus musculus
acaacatcttcccaagtgtccttga

SEQ ID NO: 514017 - DNA, 25 bp, Mus musculus
acaacatcttccgaagtgtccttga

SEQ ID NO: 514018 - DNA, 25 bp, Mus musculus
acaacatctttcagactcggatgca

SEQ ID NO: 514019 - DNA, 25 bp, Mus musculus
acaacatctttctgactcggatgca

SEQ ID NO: 514020 - DNA, 25 bp, Mus musculus
acaacatgaagcagttcatccgcta

SEQ ID NO: 514021 - DNA, 25 bp, Mus musculus
acaacatgaagctgttcatccgcta

SEQ ID NO: 514022 - DNA, 25 bp, Mus musculus
acaacatgcagccttcttggtgccc

SEQ ID NO: 514023 - DNA, 25 bp, Mus musculus
acaacatgcagcgttcttggtgccc

SEQ ID NO: 514024 - DNA, 25 bp, Mus musculus
acaacatgccaaattggctggcaca

SEQ ID NO: 514025 - DNA, 25 bp, Mus musculus
acaacatgccaatttggctggcaca

SEQ ID NO: 514026 - DNA, 25 bp, Mus musculus
acaacatgggcacgaagcggaagca

SEQ ID NO: 514027 - DNA, 25 bp, Mus musculus
acaacatgggcaggaagcggaagca

SEQ ID NO: 514028 - DNA, 25 bp, Mus musculus
acaacattgtgcacttggaagatct

SEQ ID NO: 514029 - DNA, 25 bp, Mus musculus
acaacattgtgctcttggaagatct

SEQ ID NO: 514030 - DNA, 25 bp, Mus musculus
acaacattgtggcaccgtataagat

SEQ ID NO: 514031 - DNA, 25 bp, Mus musculus
acaacattgtgggaccgtataagat

SEQ ID NO: 514032 - DNA, 25 bp, Mus musculus
acaaccaagggcagactccactgca

SEQ ID NO: 514033 - DNA, 25 bp, Mus musculus
acaaccaagggctgactccactgca

SEQ ID NO: 514034 - DNA, 25 bp, Mus musculus
acaaccaagtaacgagtgtccctca

SEQ ID NO: 514035 - DNA, 25 bp, Mus musculus
acaaccaagtaaggagtgtccctca

SEQ ID NO: 514036 - DNA, 25 bp, Mus musculus
acaaccaagtttactcaaggtcatc

SEQ ID NO: 514037 - DNA, 25 bp, Mus musculus
acaaccaagttttctcaaggtcatc

SEQ ID NO: 514038 - DNA, 25 bp, Mus musculus
acaaccaccttcagtacagcactat

SEQ ID NO: 514039 - DNA, 25 bp, Mus musculus
acaaccaccttctgtacagcactat

SEQ ID NO: 514040 - DNA, 25 bp, Mus musculus
acaaccagacggcatacatgccttc

SEQ ID NO: 514041 - DNA, 25 bp, Mus musculus
acaaccagacgggatacatgccttc

SEQ ID NO: 514042 - DNA, 25 bp, Mus musculus
acaaccaggacaccttgaaatgcgg

SEQ ID NO: 514043 - DNA, 25 bp, Mus musculus
acaaccaggacagcttgaaatgcgg

SEQ ID NO: 514044 - DNA, 25 bp, Mus musculus
acaacccagcccagtatgactatga

SEQ ID NO: 514045 - DNA, 25 bp, Mus musculus
acaacccagccctgtatgactatga

SEQ ID NO: 514046 - DNA, 25 bp, Mus musculus
acaacccatctaccagtggctgcag

SEQ ID NO: 514047 - DNA, 25 bp, Mus musculus
acaacccatctagcagtggctgcag

SEQ ID NO: 514048 - DNA, 25 bp, Mus musculus
acaacccttcgcagacctgattggt

SEQ ID NO: 514049 - DNA, 25 bp, Mus musculus
acaacccttcgctgacctgattggt

SEQ ID NO: 514050 - DNA, 25 bp, Mus musculus
acaaccgctctgagctagctgacca

SEQ ID NO: 514051 - DNA, 25 bp, Mus musculus
acaaccgctctgtgctagctgacca

SEQ ID NO: 514052 - DNA, 25 bp, Mus musculus
acaaccgctgtaaagacaccctggc

SEQ ID NO: 514053 - DNA, 25 bp, Mus musculus
acaaccgctgtatagacaccctggc

SEQ ID NO: 514054 - DNA, 25 bp, Mus musculus
acaaccggatccagggtggctacga

SEQ ID NO: 514055 - DNA, 25 bp, Mus musculus
acaaccggatcctgggtggctacga

SEQ ID NO: 514056 - DNA, 25 bp, Mus musculus
acaaccggctaaatcaccgtgctag

SEQ ID NO: 514057 - DNA, 25 bp, Mus musculus
acaaccggctaattcaccgtgctag

SEQ ID NO: 514058 - DNA, 25 bp, Mus musculus
acaaccgttggaactgccaaaagga

SEQ ID NO: 514059 - DNA, 25 bp, Mus musculus
acaaccgttggatctgccaaaagga

SEQ ID NO: 514060 - DNA, 25 bp, Mus musculus
acaacctaccccatggttcaagcta

SEQ ID NO: 514061 - DNA, 25 bp, Mus musculus
acaacctaccccttggttcaagcta

SEQ ID NO: 514062 - DNA, 25 bp, Mus musculus
acaacctactttcctgactatgcag

SEQ ID NO: 514063 - DNA, 25 bp, Mus musculus
acaacctactttgctgactatgcag

SEQ ID NO: 514064 - DNA, 25 bp, Mus musculus
acaacctatgccaaagagggagaag

SEQ ID NO: 514065 - DNA, 25 bp, Mus musculus
acaacctatgcctaagagggagaag

SEQ ID NO: 514066 - DNA, 25 bp, Mus musculus
acaacctcctccagtggccagtttg

SEQ ID NO: 514067 - DNA, 25 bp, Mus musculus
acaacctcctcctgtggccagtttg

SEQ ID NO: 514068 - DNA, 25 bp, Mus musculus
acaacctgaagaagcgcttcgacca

SEQ ID NO: 514069 - DNA, 25 bp, Mus musculus
acaacctgaagatgcgcttcgacca

SEQ ID NO: 514070 - DNA, 25 bp, Mus musculus
acaacctgaccaagcacatgcgctg

SEQ ID NO: 514071 - DNA, 25 bp, Mus musculus
acaacctgaccatgcacatgcgctg

SEQ ID NO: 514072 - DNA, 25 bp, Mus musculus
acaacctgagatccgctgcggaaga

SEQ ID NO: 514073 - DNA, 25 bp, Mus musculus
acaacctgagatgcgctgcggaaga

SEQ ID NO: 514074 - DNA, 25 bp, Mus musculus
acaacctgctgcaggtcagtgagga

SEQ ID NO: 514075 - DNA, 25 bp, Mus musculus
acaacctgctgctggtcagtgagga

SEQ ID NO: 514076 - DNA, 25 bp, Mus musculus
acaacctggaaactacattctaaag

SEQ ID NO: 514077 - DNA, 25 bp, Mus musculus
acaacctggaaagtacattctaaag

SEQ ID NO: 514078 - DNA, 25 bp, Mus musculus
acaaccttctggacctcactgtggc

SEQ ID NO: 514079 - DNA, 25 bp, Mus musculus
acaaccttctggtcctcactgtggc

SEQ ID NO: 514080 - DNA, 25 bp, Mus musculus
acaaccttgatccagaaagccatcg

SEQ ID NO: 514081 - DNA, 25 bp, Mus musculus
acaaccttgatcgagaaagccatcg

SEQ ID NO: 514082 - DNA, 25 bp, Mus musculus
acaacgagaggactggccgtgctca

SEQ ID NO: 514083 - DNA, 25 bp, Mus musculus
acaacgagaggagtggccgtgctca

SEQ ID NO: 514084 - DNA, 25 bp, Mus musculus
acaacgcaacacaaaaccaagcaag

SEQ ID NO: 514085 - DNA, 25 bp, Mus musculus
acaacgcaacactaaaccaagcaag

SEQ ID NO: 514086 - DNA, 25 bp, Mus musculus
acaacgcgcggtcctggtcaggaat

SEQ ID NO: 514087 - DNA, 25 bp, Mus musculus
acaacgcgcggtgctggtcaggaat

SEQ ID NO: 514088 - DNA, 25 bp, Mus musculus
acaacggcagcacagagtacggact

SEQ ID NO: 514089 - DNA, 25 bp, Mus musculus
acaacggcagcagagagtacggact

SEQ ID NO: 514090 - DNA, 25 bp, Mus musculus
acaacgggcaggagttcagtctgct

SEQ ID NO: 514091 - DNA, 25 bp, Mus musculus
acaacgggcaggtgttcagtctgct

SEQ ID NO: 514092 - DNA, 25 bp, Mus musculus
acaacggtcggccacgcagcttgtg

SEQ ID NO: 514093 - DNA, 25 bp, Mus musculus
acaacggtcggcgacgcagcttgtg

SEQ ID NO: 514094 - DNA, 25 bp, Mus musculus
acaacggtgacacgtagctgggacc

SEQ ID NO: 514095 - DNA, 25 bp, Mus musculus
acaacggtgacaggtagctgggacc

SEQ ID NO: 514096 - DNA, 25 bp, Mus musculus
acaacgtagattataagctggagac

SEQ ID NO: 514097 - DNA, 25 bp, Mus musculus
acaacgtagattttaagctggagac

SEQ ID NO: 514098 - DNA, 25 bp, Mus musculus
acaacgtcaacacacggtgccagaa

SEQ ID NO: 514099 - DNA, 25 bp, Mus musculus
acaacgtcaacagacggtgccagaa

SEQ ID NO: 514100 - DNA, 25 bp, Mus musculus
acaacgtggcatatgaggagactac

SEQ ID NO: 514101 - DNA, 25 bp, Mus musculus
acaacgtggcatttgaggagactac

SEQ ID NO: 514102 - DNA, 25 bp, Mus musculus
acaacgtgtttcagcgccatgaacg

SEQ ID NO: 514103 - DNA, 25 bp, Mus musculus
acaacgtgtttctgcgccatgaacg

SEQ ID NO: 514104 - DNA, 25 bp, Mus musculus
acaacgttgtgtccttcaccaggca

SEQ ID NO: 514105 - DNA, 25 bp, Mus musculus
acaacgttgtgtgcttcaccaggca

SEQ ID NO: 514106 - DNA, 25 bp, Mus musculus
acaactatgacccagaccgggcctg

SEQ ID NO: 514107 - DNA, 25 bp, Mus musculus
acaactatgaccgagaccgggcctg

SEQ ID NO: 514108 - DNA, 25 bp, Mus musculus
acaactccaattctctacagatgaa

SEQ ID NO: 514109 - DNA, 25 bp, Mus musculus
acaactccaattgtctacagatgaa

SEQ ID NO: 514110 - DNA, 25 bp, Mus musculus
acaactccagatcggtatacgccag

SEQ ID NO: 514111 - DNA, 25 bp, Mus musculus
acaactccagatgggtatacgccag

SEQ ID NO: 514112 - DNA, 25 bp, Mus musculus
acaactcgcgcgatgtcctggagat

SEQ ID NO: 514113 - DNA, 25 bp, Mus musculus
acaactcgcgcgttgtcctggagat

SEQ ID NO: 514114 - DNA, 25 bp, Mus musculus
acaactctcaataacttcatgggtc

SEQ ID NO: 514115 - DNA, 25 bp, Mus musculus
acaactctcaattacttcatgggtc

SEQ ID NO: 514116 - DNA, 25 bp, Mus musculus
acaactctccggatggcaacactga

SEQ ID NO: 514117 - DNA, 25 bp, Mus musculus
acaactctccggttggcaacactga

SEQ ID NO: 514118 - DNA, 25 bp, Mus musculus
acaactgacaagcacctttctcctg

SEQ ID NO: 514119 - DNA, 25 bp, Mus musculus
acaactgacaaggacctttctcctg

SEQ ID NO: 514120 - DNA, 25 bp, Mus musculus
acaactgagagccttgttcactggg

SEQ ID NO: 514121 - DNA, 25 bp, Mus musculus
acaactgagagcgttgttcactggg

SEQ ID NO: 514122 - DNA, 25 bp, Mus musculus
acaactgagggacgtgaccgtcttg

SEQ ID NO: 514123 - DNA, 25 bp, Mus musculus
acaactgagggaggtgaccgtcttg

SEQ ID NO: 514124 - DNA, 25 bp, Mus musculus
acaactgcgtgacggtgcccaattc

SEQ ID NO: 514125 - DNA, 25 bp, Mus musculus
acaactgcgtgagggtgcccaattc

SEQ ID NO: 514126 - DNA, 25 bp, Mus musculus
acaactgctatcacgtggagcctca

SEQ ID NO: 514127 - DNA, 25 bp, Mus musculus
acaactgctatctcgtggagcctca

SEQ ID NO: 514128 - DNA, 25 bp, Mus musculus
acaactgcttcactggcggacgacc

SEQ ID NO: 514129 - DNA, 25 bp, Mus musculus
acaactgcttcagtggcggacgacc

SEQ ID NO: 514130 - DNA, 25 bp, Mus musculus
acaactggaggaagaccgaagacag

SEQ ID NO: 514131 - DNA, 25 bp, Mus musculus
acaactggaggatgaccgaagacag

SEQ ID NO: 514132 - DNA, 25 bp, Mus musculus
acaactggattgctcaccaggatga

SEQ ID NO: 514133 - DNA, 25 bp, Mus musculus
acaactggattggtcaccaggatga

SEQ ID NO: 514134 - DNA, 25 bp, Mus musculus
acaactgggatacatgggcggctca

SEQ ID NO: 514135 - DNA, 25 bp, Mus musculus
acaactgggatagatgggcggctca

SEQ ID NO: 514136 - DNA, 25 bp, Mus musculus
acaactgggcagacttcagttccac

SEQ ID NO: 514137 - DNA, 25 bp, Mus musculus
acaactgggcagtcttcagttccac

SEQ ID NO: 514138 - DNA, 25 bp, Mus musculus
acaactgggcctaggagtcacctgg

SEQ ID NO: 514139 - DNA, 25 bp, Mus musculus
acaactgggccttggagtcacctgg

SEQ ID NO: 514140 - DNA, 25 bp, Mus musculus
acaactggtgatatcagtgattcca

SEQ ID NO: 514141 - DNA, 25 bp, Mus musculus
acaactggtgatttcagtgattcca

SEQ ID NO: 514142 - DNA, 25 bp, Mus musculus
acaactgtaccccagagttccaggc

SEQ ID NO: 514143 - DNA, 25 bp, Mus musculus
acaactgtacccgagagttccaggc

SEQ ID NO: 514144 - DNA, 25 bp, Mus musculus
acaactgtcagacaaacgtgatggg

SEQ ID NO: 514145 - DNA, 25 bp, Mus musculus
acaactgtcagagaaacgtgatggg

SEQ ID NO: 514146 - DNA, 25 bp, Mus musculus
acaactgtctgcagcgcccggaaaa

SEQ ID NO: 514147 - DNA, 25 bp, Mus musculus
acaactgtctgctgcgcccggaaaa

SEQ ID NO: 514148 - DNA, 25 bp, Mus musculus
acaactgtgagacacgcagaggcca

SEQ ID NO: 514149 - DNA, 25 bp, Mus musculus
acaactgtgagagacgcagaggcca

SEQ ID NO: 514150 - DNA, 25 bp, Mus musculus
acaacttcgtgaagcttgttgcctg

SEQ ID NO: 514151 - DNA, 25 bp, Mus musculus
acaacttcgtgatgcttgttgcctg

SEQ ID NO: 514152 - DNA, 25 bp, Mus musculus
acaacttctctcagcagtgcctgag

SEQ ID NO: 514153 - DNA, 25 bp, Mus musculus
acaacttctctctgcagtgcctgag

SEQ ID NO: 514154 - DNA, 25 bp, Mus musculus
acaacttgctgaacgagcggatcct

SEQ ID NO: 514155 - DNA, 25 bp, Mus musculus
acaacttgctgatcgagcggatcct

SEQ ID NO: 514156 - DNA, 25 bp, Mus musculus
acaagaaacctgagggaagcaccgc

SEQ ID NO: 514157 - DNA, 25 bp, Mus musculus
acaagaaacctgtgggaagcaccgc

SEQ ID NO: 514158 - DNA, 25 bp, Mus musculus
acaagaaagaccactggagcgccca

SEQ ID NO: 514159 - DNA, 25 bp, Mus musculus
acaagaaagacctctggagcgccca

SEQ ID NO: 514160 - DNA, 25 bp, Mus musculus
acaagaaaggcgagggcaaccagta

SEQ ID NO: 514161 - DNA, 25 bp, Mus musculus
acaagaaaggcgtgggcaaccagta

SEQ ID NO: 514162 - DNA, 25 bp, Mus musculus
acaagaaatcctactgctcaattga

SEQ ID NO: 514163 - DNA, 25 bp, Mus musculus
acaagaaatccttctgctcaattga

SEQ ID NO: 514164 - DNA, 25 bp, Mus musculus
acaagaacaaacatcatcaaagtgg

SEQ ID NO: 514165 - DNA, 25 bp, Mus musculus
acaagaacaaacttcatcaaagtgg

SEQ ID NO: 514166 - DNA, 25 bp, Mus musculus
acaagaacctcacactgaaattcca

SEQ ID NO: 514167 - DNA, 25 bp, Mus musculus
acaagaacctcagactgaaattcca

SEQ ID NO: 514168 - DNA, 25 bp, Mus musculus
acaagaactacaattgtggaatgag

SEQ ID NO: 514169 - DNA, 25 bp, Mus musculus
acaagaactacatttgtggaatgag

SEQ ID NO: 514170 - DNA, 25 bp, Mus musculus
acaagaagccgaatcagcctagcag

SEQ ID NO: 514171 - DNA, 25 bp, Mus musculus
acaagaagccgattcagcctagcag

SEQ ID NO: 514172 - DNA, 25 bp, Mus musculus
acaagaaggagacgcgccggttaca

SEQ ID NO: 514173 - DNA, 25 bp, Mus musculus
acaagaaggagaggcgccggttaca

SEQ ID NO: 514174 - DNA, 25 bp, Mus musculus
acaagaaggatcactccaacaccgg

SEQ ID NO: 514175 - DNA, 25 bp, Mus musculus
acaagaaggatctctccaacaccgg

SEQ ID NO: 514176 - DNA, 25 bp, Mus musculus
acaagaaggcccctggaagccactg

SEQ ID NO: 514177 - DNA, 25 bp, Mus musculus
acaagaaggcccgtggaagccactg

SEQ ID NO: 514178 - DNA, 25 bp, Mus musculus
acaagaaggcttcggcatccaggcc

SEQ ID NO: 514179 - DNA, 25 bp, Mus musculus
acaagaaggcttgggcatccaggcc

SEQ ID NO: 514180 - DNA, 25 bp, Mus musculus
acaagacaacgcaggtctcaccggg

SEQ ID NO: 514181 - DNA, 25 bp, Mus musculus
acaagacaacgctggtctcaccggg

SEQ ID NO: 514182 - DNA, 25 bp, Mus musculus
acaagaccattacaccctgctggag

SEQ ID NO: 514183 - DNA, 25 bp, Mus musculus
acaagaccattagaccctgctggag

SEQ ID NO: 514184 - DNA, 25 bp, Mus musculus
acaagacgaggtcgaggctggcgct

SEQ ID NO: 514185 - DNA, 25 bp, Mus musculus
acaagacgaggtggaggctggcgct

SEQ ID NO: 514186 - DNA, 25 bp, Mus musculus
acaagacttccaccttctgccggag

SEQ ID NO: 514187 - DNA, 25 bp, Mus musculus
acaagacttccagcttctgccggag

SEQ ID NO: 514188 - DNA, 25 bp, Mus musculus
acaagacttgggaccctcagtgttc

SEQ ID NO: 514189 - DNA, 25 bp, Mus musculus
acaagacttgggtccctcagtgttc

SEQ ID NO: 514190 - DNA, 25 bp, Mus musculus
acaagagccagaccagtggcaagag

SEQ ID NO: 514191 - DNA, 25 bp, Mus musculus
acaagagccagagcagtggcaagag

SEQ ID NO: 514192 - DNA, 25 bp, Mus musculus
acaagagcctgtatgtggcagaata

SEQ ID NO: 514193 - DNA, 25 bp, Mus musculus
acaagagcctgtttgtggcagaata

SEQ ID NO: 514194 - DNA, 25 bp, Mus musculus
acaagaggatctacaccacccgaca

SEQ ID NO: 514195 - DNA, 25 bp, Mus musculus
acaagaggatcttcaccacccgaca

SEQ ID NO: 514196 - DNA, 25 bp, Mus musculus
acaagaggctgactccacccttcaa

SEQ ID NO: 514197 - DNA, 25 bp, Mus musculus
acaagaggctgagtccacccttcaa

SEQ ID NO: 514198 - DNA, 25 bp, Mus musculus
acaagagggataaggctttgggtca

SEQ ID NO: 514199 - DNA, 25 bp, Mus musculus
acaagagggatatggctttgggtca

SEQ ID NO: 514200 - DNA, 25 bp, Mus musculus
acaagagggccactactgaggaccg

SEQ ID NO: 514201 - DNA, 25 bp, Mus musculus
acaagagggccagtactgaggaccg

SEQ ID NO: 514202 - DNA, 25 bp, Mus musculus
acaagagtgtctacagcatcctgca

SEQ ID NO: 514203 - DNA, 25 bp, Mus musculus
acaagagtgtcttcagcatcctgca

SEQ ID NO: 514204 - DNA, 25 bp, Mus musculus
acaagatgacgtcggctccccgtag

SEQ ID NO: 514205 - DNA, 25 bp, Mus musculus
acaagatgacgtgggctccccgtag

SEQ ID NO: 514206 - DNA, 25 bp, Mus musculus
acaagatgagcgagagcacgctggt

SEQ ID NO: 514207 - DNA, 25 bp, Mus musculus
acaagatgagcgtgagcacgctggt

SEQ ID NO: 514208 - DNA, 25 bp, Mus musculus
acaagatgagctcggtgagagaggc

SEQ ID NO: 514209 - DNA, 25 bp, Mus musculus
acaagatgagctgggtgagagaggc

SEQ ID NO: 514210 - DNA, 25 bp, Mus musculus
acaagatgatacatcctgtagtgcg

SEQ ID NO: 514211 - DNA, 25 bp, Mus musculus
acaagatgatacttcctgtagtgcg

SEQ ID NO: 514212 - DNA, 25 bp, Mus musculus
acaagatgtccactgccaaggccaa

SEQ ID NO: 514213 - DNA, 25 bp, Mus musculus
acaagatgtccagtgccaaggccaa

SEQ ID NO: 514214 - DNA, 25 bp, Mus musculus
acaagattccttagcagctcaccat

SEQ ID NO: 514215 - DNA, 25 bp, Mus musculus
acaagattcctttgcagctcaccat

SEQ ID NO: 514216 - DNA, 25 bp, Mus musculus
acaagcaaaaaacagtggctttgcc

SEQ ID NO: 514217 - DNA, 25 bp, Mus musculus
acaagcaaaaaagagtggctttgcc

SEQ ID NO: 514218 - DNA, 25 bp, Mus musculus
acaagcaatatcagctggcagactg

SEQ ID NO: 514219 - DNA, 25 bp, Mus musculus
acaagcaatatctgctggcagactg

SEQ ID NO: 514220 - DNA, 25 bp, Mus musculus
acaagcaccactcgagtgatgtcct

SEQ ID NO: 514221 - DNA, 25 bp, Mus musculus
acaagcaccactggagtgatgtcct

SEQ ID NO: 514222 - DNA, 25 bp, Mus musculus
acaagcaccttgattatacaccagt

SEQ ID NO: 514223 - DNA, 25 bp, Mus musculus
acaagcaccttgtttatacaccagt

SEQ ID NO: 514224 - DNA, 25 bp, Mus musculus
acaagcagactgcaggcctcaagcc

SEQ ID NO: 514225 - DNA, 25 bp, Mus musculus
acaagcagactggaggcctcaagcc

SEQ ID NO: 514226 - DNA, 25 bp, Mus musculus
acaagcagcgacattgagggctgac

SEQ ID NO: 514227 - DNA, 25 bp, Mus musculus
acaagcagcgactttgagggctgac

SEQ ID NO: 514228 - DNA, 25 bp, Mus musculus
acaagcatcgagatatatttctcca

SEQ ID NO: 514229 - DNA, 25 bp, Mus musculus
acaagcatcgagttatatttctcca

SEQ ID NO: 514230 - DNA, 25 bp, Mus musculus
acaagcatgaagaaaaccaccggcc

SEQ ID NO: 514231 - DNA, 25 bp, Mus musculus
acaagcatgaagtaaaccaccggcc

SEQ ID NO: 514232 - DNA, 25 bp, Mus musculus
acaagcatgcatattctggaggaag

SEQ ID NO: 514233 - DNA, 25 bp, Mus musculus
acaagcatgcattttctggaggaag

SEQ ID NO: 514234 - DNA, 25 bp, Mus musculus
acaagccacactatgctggccaagt

SEQ ID NO: 514235 - DNA, 25 bp, Mus musculus
acaagccacactttgctggccaagt

SEQ ID NO: 514236 - DNA, 25 bp, Mus musculus
acaagcccaacccatcatagatcag

SEQ ID NO: 514237 - DNA, 25 bp, Mus musculus
acaagcccaaccgatcatagatcag

SEQ ID NO: 514238 - DNA, 25 bp, Mus musculus
acaagcccagtgactgcggccgaag

SEQ ID NO: 514239 - DNA, 25 bp, Mus musculus
acaagcccagtgtctgcggccgaag

SEQ ID NO: 514240 - DNA, 25 bp, Mus musculus
acaagcccgtgactgtcaaggtgta

SEQ ID NO: 514241 - DNA, 25 bp, Mus musculus
acaagcccgtgagtgtcaaggtgta

SEQ ID NO: 514242 - DNA, 25 bp, Mus musculus
acaagccctggaagtctgcggaagc

SEQ ID NO: 514243 - DNA, 25 bp, Mus musculus
acaagccctggatgtctgcggaagc

SEQ ID NO: 514244 - DNA, 25 bp, Mus musculus
acaagcccttctatcacagttgttg

SEQ ID NO: 514245 - DNA, 25 bp, Mus musculus
acaagcccttctttcacagttgttg

SEQ ID NO: 514246 - DNA, 25 bp, Mus musculus
acaagccgctcacccagggagatcg

SEQ ID NO: 514247 - DNA, 25 bp, Mus musculus
acaagccgctcagccagggagatcg

SEQ ID NO: 514248 - DNA, 25 bp, Mus musculus
acaagccggcctcgaaatcagagcc

SEQ ID NO: 514249 - DNA, 25 bp, Mus musculus
acaagccggcctggaaatcagagcc

SEQ ID NO: 514250 - DNA, 25 bp, Mus musculus
acaagcctatctcctagaggagaca

SEQ ID NO: 514251 - DNA, 25 bp, Mus musculus
acaagcctatctgctagaggagaca

SEQ ID NO: 514252 - DNA, 25 bp, Mus musculus
acaagcctggctacccaggaagtag

SEQ ID NO: 514253 - DNA, 25 bp, Mus musculus
acaagcctggcttcccaggaagtag

SEQ ID NO: 514254 - DNA, 25 bp, Mus musculus
acaagcggaattatttctctctcag

SEQ ID NO: 514255 - DNA, 25 bp, Mus musculus
acaagcggaattttttctctctcag

SEQ ID NO: 514256 - DNA, 25 bp, Mus musculus
acaagcggggtcagggtctccaagt

SEQ ID NO: 514257 - DNA, 25 bp, Mus musculus
acaagcggggtctgggtctccaagt

SEQ ID NO: 514258 - DNA, 25 bp, Mus musculus
acaagcgttgcaaggacaagaagaa

SEQ ID NO: 514259 - DNA, 25 bp, Mus musculus
acaagcgttgcatggacaagaagaa

SEQ ID NO: 514260 - DNA, 25 bp, Mus musculus
acaagctacgtgcagcccggctcaa

SEQ ID NO: 514261 - DNA, 25 bp, Mus musculus
acaagctacgtggagcccggctcaa

SEQ ID NO: 514262 - DNA, 25 bp, Mus musculus
acaagctactgacggacgagcggac

SEQ ID NO: 514263 - DNA, 25 bp, Mus musculus
acaagctactgagggacgagcggac

SEQ ID NO: 514264 - DNA, 25 bp, Mus musculus
acaagctagccaagaggccctacgt

SEQ ID NO: 514265 - DNA, 25 bp, Mus musculus
acaagctagccatgaggccctacgt

SEQ ID NO: 514266 - DNA, 25 bp, Mus musculus
acaagctaggctatagtctttgatg

SEQ ID NO: 514267 - DNA, 25 bp, Mus musculus
acaagctaggctttagtctttgatg

SEQ ID NO: 514268 - DNA, 25 bp, Mus musculus
acaagctccaccaggactacatcgg

SEQ ID NO: 514269 - DNA, 25 bp, Mus musculus
acaagctccacctggactacatcgg

SEQ ID NO: 514270 - DNA, 25 bp, Mus musculus
acaagctcttggactggagagcgct

SEQ ID NO: 514271 - DNA, 25 bp, Mus musculus
acaagctcttggtctggagagcgct

SEQ ID NO: 514272 - DNA, 25 bp, Mus musculus
acaagctgaattagaagctgttcgg

SEQ ID NO: 514273 - DNA, 25 bp, Mus musculus
acaagctgaatttgaagctgttcgg

SEQ ID NO: 514274 - DNA, 25 bp, Mus musculus
acaagctgacctcccccagttggtt

SEQ ID NO: 514275 - DNA, 25 bp, Mus musculus
acaagctgacctgccccagttggtt

SEQ ID NO: 514276 - DNA, 25 bp, Mus musculus
acaagctggatcaggcaagctccag

SEQ ID NO: 514277 - DNA, 25 bp, Mus musculus
acaagctggatctggcaagctccag

SEQ ID NO: 514278 - DNA, 25 bp, Mus musculus
acaagctgtgaaagtggtaataaac

SEQ ID NO: 514279 - DNA, 25 bp, Mus musculus
acaagctgtgaatgtggtaataaac

SEQ ID NO: 514280 - DNA, 25 bp, Mus musculus
acaagctgttggaggcactgggcaa

SEQ ID NO: 514281 - DNA, 25 bp, Mus musculus
acaagctgttggtggcactgggcaa

SEQ ID NO: 514282 - DNA, 25 bp, Mus musculus
acaaggaacaatcgctctgagaaca

SEQ ID NO: 514283 - DNA, 25 bp, Mus musculus
acaaggaacaatggctctgagaaca

SEQ ID NO: 514284 - DNA, 25 bp, Mus musculus
acaaggaacccacgacctggtgaag

SEQ ID NO: 514285 - DNA, 25 bp, Mus musculus
acaaggaacccaggacctggtgaag

SEQ ID NO: 514286 - DNA, 25 bp, Mus musculus
acaaggaagaacagacggacggtct

SEQ ID NO: 514287 - DNA, 25 bp, Mus musculus
acaaggaagaactgacggacggtct

SEQ ID NO: 514288 - DNA, 25 bp, Mus musculus
acaaggaagaccaggagccaatcag

SEQ ID NO: 514289 - DNA, 25 bp, Mus musculus
acaaggaagacctggagccaatcag

SEQ ID NO: 514290 - DNA, 25 bp, Mus musculus
acaaggaaggtaagatggagcccat

SEQ ID NO: 514291 - DNA, 25 bp, Mus musculus
acaaggaaggtatgatggagcccat

SEQ ID NO: 514292 - DNA, 25 bp, Mus musculus
acaaggaatctgactcactcccgat

SEQ ID NO: 514293 - DNA, 25 bp, Mus musculus
acaaggaatctgtctcactcccgat

SEQ ID NO: 514294 - DNA, 25 bp, Mus musculus
acaaggacaggtcccagtgtactga

SEQ ID NO: 514295 - DNA, 25 bp, Mus musculus
acaaggacaggtgccagtgtactga

SEQ ID NO: 514296 - DNA, 25 bp, Mus musculus
acaaggaccacacccaccatgaaag

SEQ ID NO: 514297 - DNA, 25 bp, Mus musculus
acaaggaccacagccaccatgaaag

SEQ ID NO: 514298 - DNA, 25 bp, Mus musculus
acaaggaccccgagcctcagtcagg

SEQ ID NO: 514299 - DNA, 25 bp, Mus musculus
acaaggaccccgtgcctcagtcagg

SEQ ID NO: 514300 - DNA, 25 bp, Mus musculus
acaaggacccgcctgataagccaac

SEQ ID NO: 514301 - DNA, 25 bp, Mus musculus
acaaggacccgcgtgataagccaac

SEQ ID NO: 514302 - DNA, 25 bp, Mus musculus
acaaggacctgcagccgagtcacag

SEQ ID NO: 514303 - DNA, 25 bp, Mus musculus
acaaggacctgctgccgagtcacag

SEQ ID NO: 514304 - DNA, 25 bp, Mus musculus
acaaggacctgtcggacctggtatc

SEQ ID NO: 514305 - DNA, 25 bp, Mus musculus
acaaggacctgtgggacctggtatc

SEQ ID NO: 514306 - DNA, 25 bp, Mus musculus
acaaggagaccaccgaggagtcagt

SEQ ID NO: 514307 - DNA, 25 bp, Mus musculus
acaaggagaccagcgaggagtcagt

SEQ ID NO: 514308 - DNA, 25 bp, Mus musculus
acaaggagactgcagggagtaatca

SEQ ID NO: 514309 - DNA, 25 bp, Mus musculus
acaaggagactggagggagtaatca

SEQ ID NO: 514310 - DNA, 25 bp, Mus musculus
acaaggagggtccattcttgggaca

SEQ ID NO: 514311 - DNA, 25 bp, Mus musculus
acaaggagggtcgattcttgggaca

SEQ ID NO: 514312 - DNA, 25 bp, Mus musculus
acaaggaggtggaaatcgcgtacag

SEQ ID NO: 514313 - DNA, 25 bp, Mus musculus
acaaggaggtggtaatcgcgtacag

SEQ ID NO: 514314 - DNA, 25 bp, Mus musculus
acaaggagtttgagcaactggcccc

SEQ ID NO: 514315 - DNA, 25 bp, Mus musculus
acaaggagtttgtgcaactggcccc

SEQ ID NO: 514316 - DNA, 25 bp, Mus musculus
acaaggatgactagaatgggccaag

SEQ ID NO: 514317 - DNA, 25 bp, Mus musculus
acaaggatgacttgaatgggccaag

SEQ ID NO: 514318 - DNA, 25 bp, Mus musculus
acaaggatgagaccgaacatcccaa

SEQ ID NO: 514319 - DNA, 25 bp, Mus musculus
acaaggatgagacgccttggtgcta

SEQ ID NO: 514320 - DNA, 25 bp, Mus musculus
acaaggatgagagcgaacatcccaa

SEQ ID NO: 514321 - DNA, 25 bp, Mus musculus
acaaggatgagaggccttggtgcta

SEQ ID NO: 514322 - DNA, 25 bp, Mus musculus
acaaggcaccctcactacgctctgg

SEQ ID NO: 514323 - DNA, 25 bp, Mus musculus
acaaggcaccctgactacgctctgg

SEQ ID NO: 514324 - DNA, 25 bp, Mus musculus
acaaggccagctacgagcacgtgga

SEQ ID NO: 514325 - DNA, 25 bp, Mus musculus
acaaggccagcttcgagcacgtgga

SEQ ID NO: 514326 - DNA, 25 bp, Mus musculus
acaaggcccatgcagcactgactga

SEQ ID NO: 514327 - DNA, 25 bp, Mus musculus
acaaggcccatggagcactgactga

SEQ ID NO: 514328 - DNA, 25 bp, Mus musculus
acaaggccccggagtggaatgacga

SEQ ID NO: 514329 - DNA, 25 bp, Mus musculus
acaaggccccggtgtggaatgacga

SEQ ID NO: 514330 - DNA, 25 bp, Mus musculus
acaaggcccctgaggtgaaggctaa

SEQ ID NO: 514331 - DNA, 25 bp, Mus musculus
acaaggcccctgtggtgaaggctaa

SEQ ID NO: 514332 - DNA, 25 bp, Mus musculus
acaaggcgatctctgactgtgacct

SEQ ID NO: 514333 - DNA, 25 bp, Mus musculus
acaaggcgatctgtgactgtgacct

SEQ ID NO: 514334 - DNA, 25 bp, Mus musculus
acaaggcgatttctcggccacacca

SEQ ID NO: 514335 - DNA, 25 bp, Mus musculus
acaaggcgatttgtcggccacacca

SEQ ID NO: 514336 - DNA, 25 bp, Mus musculus
acaaggctggctcccctcctgggaa

SEQ ID NO: 514337 - DNA, 25 bp, Mus musculus
acaaggctggctgccctcctgggaa

SEQ ID NO: 514338 - DNA, 25 bp, Mus musculus
acaagggacaggagcgaccagcaca

SEQ ID NO: 514339 - DNA, 25 bp, Mus musculus
acaagggacaggtgcgaccagcaca

SEQ ID NO: 514340 - DNA, 25 bp, Mus musculus
acaagggcaagaactaccccatcat

SEQ ID NO: 514341 - DNA, 25 bp, Mus musculus
acaagggcaagatctaccccatcat

SEQ ID NO: 514342 - DNA, 25 bp, Mus musculus
acaagggctcaaagaggaggattac

SEQ ID NO: 514343 - DNA, 25 bp, Mus musculus
acaagggctcaatgaggaggattac

SEQ ID NO: 514344 - DNA, 25 bp, Mus musculus
acaaggtccaaccaatccaatgttg

SEQ ID NO: 514345 - DNA, 25 bp, Mus musculus
acaaggtccaacgaatccaatgttg

SEQ ID NO: 514346 - DNA, 25 bp, Mus musculus
acaaggtgactcacacgcgggaggc

SEQ ID NO: 514347 - DNA, 25 bp, Mus musculus
acaaggtgactctcacgcgggaggc

SEQ ID NO: 514348 - DNA, 25 bp, Mus musculus
acaaggtggaccagacccagatgca

SEQ ID NO: 514349 - DNA, 25 bp, Mus musculus
acaaggtggacctgacccagatgca

SEQ ID NO: 514350 - DNA, 25 bp, Mus musculus
acaaggtggcctccctcgaggaagt

SEQ ID NO: 514351 - DNA, 25 bp, Mus musculus
acaaggtggcctgcctcgaggaagt

SEQ ID NO: 514352 - DNA, 25 bp, Mus musculus
acaaggtggctcagcaccgtgggct

SEQ ID NO: 514353 - DNA, 25 bp, Mus musculus
acaaggtggctctgcaccgtgggct

SEQ ID NO: 514354 - DNA, 25 bp, Mus musculus
acaaggtgtttgaggaggcagcaac

SEQ ID NO: 514355 - DNA, 25 bp, Mus musculus
acaaggtgtttgtggaggcagcaac

SEQ ID NO: 514356 - DNA, 25 bp, Mus musculus
acaagtaagaccactcagaggacag

SEQ ID NO: 514357 - DNA, 25 bp, Mus musculus
acaagtaagacctctcagaggacag

SEQ ID NO: 514358 - DNA, 25 bp, Mus musculus
acaagtacaagtataactcgtacag

SEQ ID NO: 514359 - DNA, 25 bp, Mus musculus
acaagtacaagtttaactcgtacag

SEQ ID NO: 514360 - DNA, 25 bp, Mus musculus
acaagtacaataacatgttggtgag

SEQ ID NO: 514361 - DNA, 25 bp, Mus musculus
acaagtacaatatcatgttggtgag

SEQ ID NO: 514362 - DNA, 25 bp, Mus musculus
acaagtagctaacgatgtcgccacc

SEQ ID NO: 514363 - DNA, 25 bp, Mus musculus
acaagtagctaaggatgtcgccacc

SEQ ID NO: 514364 - DNA, 25 bp, Mus musculus
acaagtagtctactcctggcaagtg

SEQ ID NO: 514365 - DNA, 25 bp, Mus musculus
acaagtagtctagtcctggcaagtg

SEQ ID NO: 514366 - DNA, 25 bp, Mus musculus
acaagtatgaccctcctttggaaga

SEQ ID NO: 514367 - DNA, 25 bp, Mus musculus
acaagtatgaccgtcctttggaaga

SEQ ID NO: 514368 - DNA, 25 bp, Mus musculus
acaagtcactgtcattcctggagca

SEQ ID NO: 514369 - DNA, 25 bp, Mus musculus
acaagtcactgtgattcctggagca

SEQ ID NO: 514370 - DNA, 25 bp, Mus musculus
acaagtcccacacagcagcttggtg

SEQ ID NO: 514371 - DNA, 25 bp, Mus musculus
acaagtcccacagagcagcttggtg

SEQ ID NO: 514372 - DNA, 25 bp, Mus musculus
acaagtcccagaaccgcagtgaaga

SEQ ID NO: 514373 - DNA, 25 bp, Mus musculus
acaagtcccagatccgcagtgaaga

SEQ ID NO: 514374 - DNA, 25 bp, Mus musculus
acaagtgacatgaaaccccattggg

SEQ ID NO: 514375 - DNA, 25 bp, Mus musculus
acaagtgacatgtaaccccattggg

SEQ ID NO: 514376 - DNA, 25 bp, Mus musculus
acaagtgcacaaaggaagctcccgc

SEQ ID NO: 514377 - DNA, 25 bp, Mus musculus
acaagtgcacaatggaagctcccgc

SEQ ID NO: 514378 - DNA, 25 bp, Mus musculus
acaagtgccactcccgtccaggttg

SEQ ID NO: 514379 - DNA, 25 bp, Mus musculus
acaagtgccactgccgtccaggttg

SEQ ID NO: 514380 - DNA, 25 bp, Mus musculus
acaagtgggagaaaaaggctagtga

SEQ ID NO: 514381 - DNA, 25 bp, Mus musculus
acaagtgggagataaaggctagtga

SEQ ID NO: 514382 - DNA, 25 bp, Mus musculus
acaagtgtgacaaggtggccatctt

SEQ ID NO: 514383 - DNA, 25 bp, Mus musculus
acaagtgtgacatggtggccatctt

SEQ ID NO: 514384 - DNA, 25 bp, Mus musculus
acaagtgtgccaatgcttctgcgca

SEQ ID NO: 514385 - DNA, 25 bp, Mus musculus
acaagtgtgccattgcttctgcgca

SEQ ID NO: 514386 - DNA, 25 bp, Mus musculus
acaagttactgaccggctggaggtc

SEQ ID NO: 514387 - DNA, 25 bp, Mus musculus
acaagttactgagcggctggaggtc

SEQ ID NO: 514388 - DNA, 25 bp, Mus musculus
acaagttgaagaagacacccctaga

SEQ ID NO: 514389 - DNA, 25 bp, Mus musculus
acaagttgaagatgacacccctaga

SEQ ID NO: 514390 - DNA, 25 bp, Mus musculus
acaagttgagtacattggtgcagaa

SEQ ID NO: 514391 - DNA, 25 bp, Mus musculus
acaagttgagtagattggtgcagaa

SEQ ID NO: 514392 - DNA, 25 bp, Mus musculus
acaagttgattgagtattaccagca

SEQ ID NO: 514393 - DNA, 25 bp, Mus musculus
acaagttgattgtgtattaccagca

SEQ ID NO: 514394 - DNA, 25 bp, Mus musculus
acaagttgggaaccccaccttgagg

SEQ ID NO: 514395 - DNA, 25 bp, Mus musculus
acaagttgggaagcccaccttgagg

SEQ ID NO: 514396 - DNA, 25 bp, Mus musculus
acaagttggtgaatttggtggagac

SEQ ID NO: 514397 - DNA, 25 bp, Mus musculus
acaagttggtgattttggtggagac

SEQ ID NO: 514398 - DNA, 25 bp, Mus musculus
acaagttgtactcgagaatgtatca

SEQ ID NO: 514399 - DNA, 25 bp, Mus musculus
acaagttgtactggagaatgtatca

SEQ ID NO: 514400 - DNA, 25 bp, Mus musculus
acaagttgttgcaggacagcagcct

SEQ ID NO: 514401 - DNA, 25 bp, Mus musculus
acaagttgttgctggacagcagcct

SEQ ID NO: 514402 - DNA, 25 bp, Mus musculus
acaagtttctctcgcataccaggga

SEQ ID NO: 514403 - DNA, 25 bp, Mus musculus
acaagtttctctggcataccaggga

SEQ ID NO: 514404 - DNA, 25 bp, Mus musculus
acaagtttgacccaactcgttggct

SEQ ID NO: 514405 - DNA, 25 bp, Mus musculus
acaagtttgaccgaactcgttggct

SEQ ID NO: 514406 - DNA, 25 bp, Mus musculus
acaagtttggcaccatccggcagac

SEQ ID NO: 514407 - DNA, 25 bp, Mus musculus
acaagtttggcagcatccggcagac

SEQ ID NO: 514408 - DNA, 25 bp, Mus musculus
acaagtttgtggctcagttgcagac

SEQ ID NO: 514409 - DNA, 25 bp, Mus musculus
acaagtttgtgggtcagttgcagac

SEQ ID NO: 514410 - DNA, 25 bp, Mus musculus
acaataaaccctcgacttggctggg

SEQ ID NO: 514411 - DNA, 25 bp, Mus musculus
acaataaaccctggacttggctggg

SEQ ID NO: 514412 - DNA, 25 bp, Mus musculus
acaataaagcgcacagtgggcgaat

SEQ ID NO: 514413 - DNA, 25 bp, Mus musculus
acaataaagcgctcagtgggcgaat

SEQ ID NO: 514414 - DNA, 25 bp, Mus musculus
acaatacaggtacgactcgcaccgc

SEQ ID NO: 514415 - DNA, 25 bp, Mus musculus
acaatacaggtaggactcgcaccgc

SEQ ID NO: 514416 - DNA, 25 bp, Mus musculus
acaatacccaaacctgaagacagtg

SEQ ID NO: 514417 - DNA, 25 bp, Mus musculus
acaatacccaaagctgaagacagtg

SEQ ID NO: 514418 - DNA, 25 bp, Mus musculus
acaatagcagcaccctcagttcaga

SEQ ID NO: 514419 - DNA, 25 bp, Mus musculus
acaatagcagcagcctcagttcaga

SEQ ID NO: 514420 - DNA, 25 bp, Mus musculus
acaatatgacgacagcccatctgca

SEQ ID NO: 514421 - DNA, 25 bp, Mus musculus
acaatatgacgagagcccatctgca

SEQ ID NO: 514422 - DNA, 25 bp, Mus musculus
acaatatgctacctccaaaggcagc

SEQ ID NO: 514423 - DNA, 25 bp, Mus musculus
acaatatgctacgtccaaaggcagc

SEQ ID NO: 514424 - DNA, 25 bp, Mus musculus
acaatcatgggcatactgcggagcc

SEQ ID NO: 514425 - DNA, 25 bp, Mus musculus
acaatcatgggcttactgcggagcc

SEQ ID NO: 514426 - DNA, 25 bp, Mus musculus
acaatcctgtgcctgtgcattagca

SEQ ID NO: 514427 - DNA, 25 bp, Mus musculus
acaatcctgtgcgtgtgcattagca

SEQ ID NO: 514428 - DNA, 25 bp, Mus musculus
acaatcgcccgaccacttggaatca

SEQ ID NO: 514429 - DNA, 25 bp, Mus musculus
acaatcgcccgagcacttggaatca

SEQ ID NO: 514430 - DNA, 25 bp, Mus musculus
acaatcgcttcgaacacagtctcgg

SEQ ID NO: 514431 - DNA, 25 bp, Mus musculus
acaatcgcttcgtacacagtctcgg

SEQ ID NO: 514432 - DNA, 25 bp, Mus musculus
acaatcttgggaagttacattcctg

SEQ ID NO: 514433 - DNA, 25 bp, Mus musculus
acaatcttgggatgttacattcctg

SEQ ID NO: 514434 - DNA, 25 bp, Mus musculus
acaatgacagacagccttgtgagga

SEQ ID NO: 514435 - DNA, 25 bp, Mus musculus
acaatgacagactgccttgtgagga

SEQ ID NO: 514436 - DNA, 25 bp, Mus musculus
acaatgacatgcatgaaaggcacat

SEQ ID NO: 514437 - DNA, 25 bp, Mus musculus
acaatgacatgcttgaaaggcacat

SEQ ID NO: 514438 - DNA, 25 bp, Mus musculus
acaatgaccactatgactctgagaa

SEQ ID NO: 514439 - DNA, 25 bp, Mus musculus
acaatgaccactttgactctgagaa

SEQ ID NO: 514440 - DNA, 25 bp, Mus musculus
acaatgacggagatcctgatagccg

SEQ ID NO: 514441 - DNA, 25 bp, Mus musculus
acaatgacggagttcctgatagccg

SEQ ID NO: 514442 - DNA, 25 bp, Mus musculus
acaatgagcaaactgtcacgtgatg

SEQ ID NO: 514443 - DNA, 25 bp, Mus musculus
acaatgagcaaagtgtcacgtgatg

SEQ ID NO: 514444 - DNA, 25 bp, Mus musculus
acaatgagctgaacattgtgctgga

SEQ ID NO: 514445 - DNA, 25 bp, Mus musculus
acaatgagctgaagaaaggaccagc

SEQ ID NO: 514446 - DNA, 25 bp, Mus musculus
acaatgagctgatcattgtgctgga

SEQ ID NO: 514447 - DNA, 25 bp, Mus musculus
acaatgagctgatgaaaggaccagc

SEQ ID NO: 514448 - DNA, 25 bp, Mus musculus
acaatgaggctcaagtgaacccgga

SEQ ID NO: 514449 - DNA, 25 bp, Mus musculus
acaatgaggctctagtgaacccgga

SEQ ID NO: 514450 - DNA, 25 bp, Mus musculus
acaatgatcggcaaagcagtggagc

SEQ ID NO: 514451 - DNA, 25 bp, Mus musculus
acaatgatcggctaagcagtggagc

SEQ ID NO: 514452 - DNA, 25 bp, Mus musculus
acaatgatggccaacgggaggtcct

SEQ ID NO: 514453 - DNA, 25 bp, Mus musculus
acaatgatggcctacgggaggtcct

SEQ ID NO: 514454 - DNA, 25 bp, Mus musculus
acaatgcaccttcctgctaccatag

SEQ ID NO: 514455 - DNA, 25 bp, Mus musculus
acaatgcaccttgctgctaccatag

SEQ ID NO: 514456 - DNA, 25 bp, Mus musculus
acaatgcactcaagggaaggtcaga

SEQ ID NO: 514457 - DNA, 25 bp, Mus musculus
acaatgcactcatgggaaggtcaga

SEQ ID NO: 514458 - DNA, 25 bp, Mus musculus
acaatgcagaagccccaaacctaca

SEQ ID NO: 514459 - DNA, 25 bp, Mus musculus
acaatgcagaaggcccaaacctaca

SEQ ID NO: 514460 - DNA, 25 bp, Mus musculus
acaatgccaaagacaagacagatca

SEQ ID NO: 514461 - DNA, 25 bp, Mus musculus
acaatgccaaagtcaagacagatca

SEQ ID NO: 514462 - DNA, 25 bp, Mus musculus
acaatgcccaggaaatcctcgtggg

SEQ ID NO: 514463 - DNA, 25 bp, Mus musculus
acaatgcccaggtaatcctcgtggg

SEQ ID NO: 514464 - DNA, 25 bp, Mus musculus
acaatgcctccgacaaggatttggc

SEQ ID NO: 514465 - DNA, 25 bp, Mus musculus
acaatgcctccgtcaaggatttggc

SEQ ID NO: 514466 - DNA, 25 bp, Mus musculus
acaatgctgtgtccatcccggagcc

SEQ ID NO: 514467 - DNA, 25 bp, Mus musculus
acaatgctgtgtgcatcccggagcc

SEQ ID NO: 514468 - DNA, 25 bp, Mus musculus
acaatgcttatacccagctgggcaa

SEQ ID NO: 514469 - DNA, 25 bp, Mus musculus
acaatgcttatagccagctgggcaa

SEQ ID NO: 514470 - DNA, 25 bp, Mus musculus
acaatggagacaacacctccttgtc

SEQ ID NO: 514471 - DNA, 25 bp, Mus musculus
acaatggagacatcacctccttgtc

SEQ ID NO: 514472 - DNA, 25 bp, Mus musculus
acaatggcacaccaggccgtgatgg

SEQ ID NO: 514473 - DNA, 25 bp, Mus musculus
acaatggcacacgaggccgtgatgg

SEQ ID NO: 514474 - DNA, 25 bp, Mus musculus
acaatggctccaagctgcccttcaa

SEQ ID NO: 514475 - DNA, 25 bp, Mus musculus
acaatggctccatgctgcccttcaa

SEQ ID NO: 514476 - DNA, 25 bp, Mus musculus
acaatgggacctacaacctttcaga

SEQ ID NO: 514477 - DNA, 25 bp, Mus musculus
acaatgggaccttcaacctttcaga

SEQ ID NO: 514478 - DNA, 25 bp, Mus musculus
acaatgggaggtccatccggagcca

SEQ ID NO: 514479 - DNA, 25 bp, Mus musculus
acaatgggaggtgcatccggagcca

SEQ ID NO: 514480 - DNA, 25 bp, Mus musculus
acaatgggccctcccgtcaggtgtg

SEQ ID NO: 514481 - DNA, 25 bp, Mus musculus
acaatgggccctgccgtcaggtgtg

SEQ ID NO: 514482 - DNA, 25 bp, Mus musculus
acaatgggtccacgtcctgcagctg

SEQ ID NO: 514483 - DNA, 25 bp, Mus musculus
acaatgggtccaggtcctgcagctg

SEQ ID NO: 514484 - DNA, 25 bp, Mus musculus
acaatggtatccctttccccagcgg

SEQ ID NO: 514485 - DNA, 25 bp, Mus musculus
acaatggtatccgtttccccagcgg

SEQ ID NO: 514486 - DNA, 25 bp, Mus musculus
acaatggtggcacgcgattcaggcc

SEQ ID NO: 514487 - DNA, 25 bp, Mus musculus
acaatggtggcaggcgattcaggcc

SEQ ID NO: 514488 - DNA, 25 bp, Mus musculus
acaatgtatgtgaccttgtttgacc

SEQ ID NO: 514489 - DNA, 25 bp, Mus musculus
acaatgtatgtgtccttgtttgacc

SEQ ID NO: 514490 - DNA, 25 bp, Mus musculus
acaatgtcacctatgaggacgcggg

SEQ ID NO: 514491 - DNA, 25 bp, Mus musculus
acaatgtcacctttgaggacgcggg

SEQ ID NO: 514492 - DNA, 25 bp, Mus musculus
acaatgtccaggcactattcgaggg

SEQ ID NO: 514493 - DNA, 25 bp, Mus musculus
acaatgtccagggactattcgaggg

SEQ ID NO: 514494 - DNA, 25 bp, Mus musculus
acaatgtcctcaaccgggcgtcgcg

SEQ ID NO: 514495 - DNA, 25 bp, Mus musculus
acaatgtcctcatccgggcgtcgcg

SEQ ID NO: 514496 - DNA, 25 bp, Mus musculus
acaatgtgggacagagcggcccagc

SEQ ID NO: 514497 - DNA, 25 bp, Mus musculus
acaatgtgggactgagcggcccagc

SEQ ID NO: 514498 - DNA, 25 bp, Mus musculus
acaatgttaactcccatctccatga

SEQ ID NO: 514499 - DNA, 25 bp, Mus musculus
acaatgttaactgccatctccatga

SEQ ID NO: 514500 - DNA, 25 bp, Mus musculus
acaatgttgcaacccgttgaaaggt

SEQ ID NO: 514501 - DNA, 25 bp, Mus musculus
acaatgttgcaagccgttgaaaggt

SEQ ID NO: 514502 - DNA, 25 bp, Mus musculus
acaattctctagcacctgcactgga

SEQ ID NO: 514503 - DNA, 25 bp, Mus musculus
acaattctctaggacctgcactgga

SEQ ID NO: 514504 - DNA, 25 bp, Mus musculus
acaattctggcccagcccaaggaga

SEQ ID NO: 514505 - DNA, 25 bp, Mus musculus
acaattctggccgagcccaaggaga

SEQ ID NO: 514506 - DNA, 25 bp, Mus musculus
acaattgaaacacactctggctata

SEQ ID NO: 514507 - DNA, 25 bp, Mus musculus
acaattgaaacagactctggctata

SEQ ID NO: 514508 - DNA, 25 bp, Mus musculus
acaattgtgatgaatgagggctgga

SEQ ID NO: 514509 - DNA, 25 bp, Mus musculus
acaattgtgatgtatgagggctgga

SEQ ID NO: 514510 - DNA, 25 bp, Mus musculus
acaatttaaagacagcaggctaaaa

SEQ ID NO: 514511 - DNA, 25 bp, Mus musculus
acaatttaaagagagcaggctaaaa

SEQ ID NO: 514512 - DNA, 25 bp, Mus musculus
acaatttcattcagccccgacttgg

SEQ ID NO: 514513 - DNA, 25 bp, Mus musculus
acaatttcattctgccccgacttgg

SEQ ID NO: 514514 - DNA, 25 bp, Mus musculus
acaatttgggcacaggccccgcgga

SEQ ID NO: 514515 - DNA, 25 bp, Mus musculus
acaatttgggcagaggccccgcgga

SEQ ID NO: 514516 - DNA, 25 bp, Mus musculus
acaatttttcccaccgcagactggc

SEQ ID NO: 514517 - DNA, 25 bp, Mus musculus
acaatttttccctccgcagactggc

SEQ ID NO: 514518 - DNA, 25 bp, Mus musculus
acacaaacttggctggacagcactg

SEQ ID NO: 514519 - DNA, 25 bp, Mus musculus
acacaaacttgggtggacagcactg

SEQ ID NO: 514520 - DNA, 25 bp, Mus musculus
acacaaatgaatcggaggctctgcc

SEQ ID NO: 514521 - DNA, 25 bp, Mus musculus
acacaaatgaatgggaggctctgcc

SEQ ID NO: 514522 - DNA, 25 bp, Mus musculus
acacaacccagcctggcgtgtcgta

SEQ ID NO: 514523 - DNA, 25 bp, Mus musculus
acacaacccagcgtggcgtgtcgta

SEQ ID NO: 514524 - DNA, 25 bp, Mus musculus
acacaactatgaccgagaccgggcc

SEQ ID NO: 514525 - DNA, 25 bp, Mus musculus
acacaactatgagcgagaccgggcc

SEQ ID NO: 514526 - DNA, 25 bp, Mus musculus
acacaagccaggaagtactgaaacc

SEQ ID NO: 514527 - DNA, 25 bp, Mus musculus
acacaagccaggtagtactgaaacc

SEQ ID NO: 514528 - DNA, 25 bp, Mus musculus
acacaagctttcctggtccagagga

SEQ ID NO: 514529 - DNA, 25 bp, Mus musculus
acacaagctttcgtggtccagagga

SEQ ID NO: 514530 - DNA, 25 bp, Mus musculus
acacaagtggttctttttaagcatg

SEQ ID NO: 514531 - DNA, 25 bp, Mus musculus
acacaagtggttgtttttaagcatg

SEQ ID NO: 514532 - DNA, 25 bp, Mus musculus
acacaattagaacgcattattcctg

SEQ ID NO: 514533 - DNA, 25 bp, Mus musculus
acacaattagaaggcattattcctg

SEQ ID NO: 514534 - DNA, 25 bp, Mus musculus
acacacaactatcaccgagaccggg

SEQ ID NO: 514535 - DNA, 25 bp, Mus musculus
acacacaactatgaccgagaccggg

SEQ ID NO: 514536 - DNA, 25 bp, Mus musculus
acacacacggaaccggtgagcagag

SEQ ID NO: 514537 - DNA, 25 bp, Mus musculus
acacacacggaagcggtgagcagag

SEQ ID NO: 514538 - DNA, 25 bp, Mus musculus
acacacacgtggagggcttcaagga

SEQ ID NO: 514539 - DNA, 25 bp, Mus musculus
acacacacgtggtgggcttcaagga

SEQ ID NO: 514540 - DNA, 25 bp, Mus musculus
acacacagaacgcagactatgccta

SEQ ID NO: 514541 - DNA, 25 bp, Mus musculus
acacacagaacggagactatgccta

SEQ ID NO: 514542 - DNA, 25 bp, Mus musculus
acacacaggacgaagtcgcaacgac

SEQ ID NO: 514543 - DNA, 25 bp, Mus musculus
acacacaggacgtagtcgcaacgac

SEQ ID NO: 514544 - DNA, 25 bp, Mus musculus
acacacaggccacatttctcacaga

SEQ ID NO: 514545 - DNA, 25 bp, Mus musculus
acacacaggccagatttctcacaga

SEQ ID NO: 514546 - DNA, 25 bp, Mus musculus
acacacccccaacgcatggagaaga

SEQ ID NO: 514547 - DNA, 25 bp, Mus musculus
acacacccccaaggcatggagaaga

SEQ ID NO: 514548 - DNA, 25 bp, Mus musculus
acacacgagattcaccgctacacgg

SEQ ID NO: 514549 - DNA, 25 bp, Mus musculus
acacacgagattgaccgctacacgg

SEQ ID NO: 514550 - DNA, 25 bp, Mus musculus
acacacggcaccctgactaacgatg

SEQ ID NO: 514551 - DNA, 25 bp, Mus musculus
acacacggcaccgtgactaacgatg

SEQ ID NO: 514552 - DNA, 25 bp, Mus musculus
acacacgtgacgcaatggaatcctc

SEQ ID NO: 514553 - DNA, 25 bp, Mus musculus
acacacgtgacggaatggaatcctc

SEQ ID NO: 514554 - DNA, 25 bp, Mus musculus
acacactcaacgcaggctgtgtcca

SEQ ID NO: 514555 - DNA, 25 bp, Mus musculus
acacactcaacggaggctgtgtcca

SEQ ID NO: 514556 - DNA, 25 bp, Mus musculus
acacactcccaacacgcattttgtg

SEQ ID NO: 514557 - DNA, 25 bp, Mus musculus
acacactcccaagacgcattttgtg

SEQ ID NO: 514558 - DNA, 25 bp, Mus musculus
acacactgaggcaggaatggccccg

SEQ ID NO: 514559 - DNA, 25 bp, Mus musculus
acacactgaggctggaatggccccg

SEQ ID NO: 514560 - DNA, 25 bp, Mus musculus
acacactgcaggaccgctagacgga

SEQ ID NO: 514561 - DNA, 25 bp, Mus musculus
acacactgcaggtccgctagacgga

SEQ ID NO: 514562 - DNA, 25 bp, Mus musculus
acacactgctcgatgcctccagagt

SEQ ID NO: 514563 - DNA, 25 bp, Mus musculus
acacactgctcgttgcctccagagt

SEQ ID NO: 514564 - DNA, 25 bp, Mus musculus
acacactggatgctgctgcatgtct

SEQ ID NO: 514565 - DNA, 25 bp, Mus musculus
acacactggatggtgctgcatgtct

SEQ ID NO: 514566 - DNA, 25 bp, Mus musculus
acacactggcacattcatgccctga

SEQ ID NO: 514567 - DNA, 25 bp, Mus musculus
acacactggcactttcatgccctga

SEQ ID NO: 514568 - DNA, 25 bp, Mus musculus
acacactgtcagacaccttcttggt

SEQ ID NO: 514569 - DNA, 25 bp, Mus musculus
acacactgtcagtcaccttcttggt

SEQ ID NO: 514570 - DNA, 25 bp, Mus musculus
acacactgtggcagattccgatcac

SEQ ID NO: 514571 - DNA, 25 bp, Mus musculus
acacactgtggctgattccgatcac

SEQ ID NO: 514572 - DNA, 25 bp, Mus musculus
acacacttgcagagagctcagccca

SEQ ID NO: 514573 - DNA, 25 bp, Mus musculus
acacacttgcagtgagctcagccca

SEQ ID NO: 514574 - DNA, 25 bp, Mus musculus
acacacttgccaaggttgtgcctcc

SEQ ID NO: 514575 - DNA, 25 bp, Mus musculus
acacacttgccatggttgtgcctcc

SEQ ID NO: 514576 - DNA, 25 bp, Mus musculus
acacactttacaactcagcattggg

SEQ ID NO: 514577 - DNA, 25 bp, Mus musculus
acacactttacatctcagcattggg

SEQ ID NO: 514578 - DNA, 25 bp, Mus musculus
acacacttttctatgctcaaagcac

SEQ ID NO: 514579 - DNA, 25 bp, Mus musculus
acacacttttctttgctcaaagcac

SEQ ID NO: 514580 - DNA, 25 bp, Mus musculus
acacagaactgcagcgaggacctgg

SEQ ID NO: 514581 - DNA, 25 bp, Mus musculus
acacagaactgctgcgaggacctgg

SEQ ID NO: 514582 - DNA, 25 bp, Mus musculus
acacagaactggcaaagctccgaca

SEQ ID NO: 514583 - DNA, 25 bp, Mus musculus
acacagaactgggaaagctccgaca

SEQ ID NO: 514584 - DNA, 25 bp, Mus musculus
acacagaagaggaacctggccctga

SEQ ID NO: 514585 - DNA, 25 bp, Mus musculus
acacagaagaggtacctggccctga

SEQ ID NO: 514586 - DNA, 25 bp, Mus musculus
acacagacatttcgcattgagaagt

SEQ ID NO: 514587 - DNA, 25 bp, Mus musculus
acacagacatttggcattgagaagt

SEQ ID NO: 514588 - DNA, 25 bp, Mus musculus
acacagacccaacaagaagaacgga

SEQ ID NO: 514589 - DNA, 25 bp, Mus musculus
acacagacccaagaagaagaacgga

SEQ ID NO: 514590 - DNA, 25 bp, Mus musculus
acacagaccccaaggtggtggccca

SEQ ID NO: 514591 - DNA, 25 bp, Mus musculus
acacagaccccatggtggtggccca

SEQ ID NO: 514592 - DNA, 25 bp, Mus musculus
acacagacctcgagggcttcagcta

SEQ ID NO: 514593 - DNA, 25 bp, Mus musculus
acacagacctcgtgggcttcagcta

SEQ ID NO: 514594 - DNA, 25 bp, Mus musculus
acacagagaccactgaagccaccga

SEQ ID NO: 514595 - DNA, 25 bp, Mus musculus
acacagagaccagtgaagccaccga

SEQ ID NO: 514596 - DNA, 25 bp, Mus musculus
acacagagcagaaccgggagaccct

SEQ ID NO: 514597 - DNA, 25 bp, Mus musculus
acacagagcagatccgggagaccct

SEQ ID NO: 514598 - DNA, 25 bp, Mus musculus
acacagagcttgcagaaactacaga

SEQ ID NO: 514599 - DNA, 25 bp, Mus musculus
acacagagcttggagaaactacaga

SEQ ID NO: 514600 - DNA, 25 bp, Mus musculus
acacagaggacactttctctaccag

SEQ ID NO: 514601 - DNA, 25 bp, Mus musculus
acacagaggacagtttctctaccag

SEQ ID NO: 514602 - DNA, 25 bp, Mus musculus
acacagagtgtgaacattgagcagc

SEQ ID NO: 514603 - DNA, 25 bp, Mus musculus
acacagagtgtgtacattgagcagc

SEQ ID NO: 514604 - DNA, 25 bp, Mus musculus
acacagatgaaccaccttgtcatgg

SEQ ID NO: 514605 - DNA, 25 bp, Mus musculus
acacagatgaacgaccttgtcatgg

SEQ ID NO: 514606 - DNA, 25 bp, Mus musculus
acacagatggcccagtgtgcaaaat

SEQ ID NO: 514607 - DNA, 25 bp, Mus musculus
acacagatggccgagtgtgcaaaat

SEQ ID NO: 514608 - DNA, 25 bp, Mus musculus
acacagcaaggaagagagggcacca

SEQ ID NO: 514609 - DNA, 25 bp, Mus musculus
acacagcaaggaccactgggcggaa

SEQ ID NO: 514610 - DNA, 25 bp, Mus musculus
acacagcaaggagcactgggcggaa

SEQ ID NO: 514611 - DNA, 25 bp, Mus musculus
acacagcaaggatgagagggcacca

SEQ ID NO: 514612 - DNA, 25 bp, Mus musculus
acacagcacaccctggcaaggactg

SEQ ID NO: 514613 - DNA, 25 bp, Mus musculus
acacagcacaccgtggcaaggactg

SEQ ID NO: 514614 - DNA, 25 bp, Mus musculus
acacagcagcttcgtgcacacctag

SEQ ID NO: 514615 - DNA, 25 bp, Mus musculus
acacagcagcttggtgcacacctag

SEQ ID NO: 514616 - DNA, 25 bp, Mus musculus
acacagcaggccaccaggcagatgt

SEQ ID NO: 514617 - DNA, 25 bp, Mus musculus
acacagcaggcctccaggcagatgt

SEQ ID NO: 514618 - DNA, 25 bp, Mus musculus
acacagcatcccaggtgcggctgct

SEQ ID NO: 514619 - DNA, 25 bp, Mus musculus
acacagcatccctggtgcggctgct

SEQ ID NO: 514620 - DNA, 25 bp, Mus musculus
acacagccaacgagcggcgcctgaa

SEQ ID NO: 514621 - DNA, 25 bp, Mus musculus
acacagccaacgtgcggcgcctgaa

SEQ ID NO: 514622 - DNA, 25 bp, Mus musculus
acacagcccttcacttgcagttaag

SEQ ID NO: 514623 - DNA, 25 bp, Mus musculus
acacagcccttctcttgcagttaag

SEQ ID NO: 514624 - DNA, 25 bp, Mus musculus
acacagccttcacgttcaccttgtt

SEQ ID NO: 514625 - DNA, 25 bp, Mus musculus
acacagccttcaggttcaccttgtt

SEQ ID NO: 514626 - DNA, 25 bp, Mus musculus
acacagcgacctcgctaaaaagtcc

SEQ ID NO: 514627 - DNA, 25 bp, Mus musculus
acacagcgacctggctaaaaagtcc

SEQ ID NO: 514628 - DNA, 25 bp, Mus musculus
acacagctcgttatgccgctgcact

SEQ ID NO: 514629 - DNA, 25 bp, Mus musculus
acacagctcgttttgccgctgcact

SEQ ID NO: 514630 - DNA, 25 bp, Mus musculus
acacagctgcccaaaagctgaaggg

SEQ ID NO: 514631 - DNA, 25 bp, Mus musculus
acacagctgccctaaagctgaaggg

SEQ ID NO: 514632 - DNA, 25 bp, Mus musculus
acacagctggacagagccgtcgctg

SEQ ID NO: 514633 - DNA, 25 bp, Mus musculus
acacagctggactgagccgtcgctg

SEQ ID NO: 514634 - DNA, 25 bp, Mus musculus
acacagctggtaaggcaccagcgcc

SEQ ID NO: 514635 - DNA, 25 bp, Mus musculus
acacagctggtatggcaccagcgcc

SEQ ID NO: 514636 - DNA, 25 bp, Mus musculus
acacagctgtggactctggctccta

SEQ ID NO: 514637 - DNA, 25 bp, Mus musculus
acacagctgtggtctctggctccta

SEQ ID NO: 514638 - DNA, 25 bp, Mus musculus
acacagcttcatcagcacggagccg

SEQ ID NO: 514639 - DNA, 25 bp, Mus musculus
acacagcttcatgagcacggagccg

SEQ ID NO: 514640 - DNA, 25 bp, Mus musculus
acacaggcttgcaacctgcagcact

SEQ ID NO: 514641 - DNA, 25 bp, Mus musculus
acacaggcttgctacctgcagcact

SEQ ID NO: 514642 - DNA, 25 bp, Mus musculus
acacagggtcatcgactcccggctt

SEQ ID NO: 514643 - DNA, 25 bp, Mus musculus
acacagggtcatggactcccggctt

SEQ ID NO: 514644 - DNA, 25 bp, Mus musculus
acacaggtacagaacgagtggatgg

SEQ ID NO: 514645 - DNA, 25 bp, Mus musculus
acacaggtacagtacgagtggatgg

SEQ ID NO: 514646 - DNA, 25 bp, Mus musculus
acacaggtacatctggtccatcctt

SEQ ID NO: 514647 - DNA, 25 bp, Mus musculus
acacaggtacatgtggtccatcctt

SEQ ID NO: 514648 - DNA, 25 bp, Mus musculus
acacaggtcgaaacctgcacagcca

SEQ ID NO: 514649 - DNA, 25 bp, Mus musculus
acacaggtcgaatcctgcacagcca

SEQ ID NO: 514650 - DNA, 25 bp, Mus musculus
acacaggtgcaactgtctctgcttg

SEQ ID NO: 514651 - DNA, 25 bp, Mus musculus
acacaggtgcaagtgtctctgcttg

SEQ ID NO: 514652 - DNA, 25 bp, Mus musculus
acacaggttgctacttgaccaaaag

SEQ ID NO: 514653 - DNA, 25 bp, Mus musculus
acacaggttgcttcttgaccaaaag

SEQ ID NO: 514654 - DNA, 25 bp, Mus musculus
acacagtggaggactgcgctccggt

SEQ ID NO: 514655 - DNA, 25 bp, Mus musculus
acacagtggaggtctgcgctccggt

SEQ ID NO: 514656 - DNA, 25 bp, Mus musculus
acacagtgtgatcgccccaacaagt

SEQ ID NO: 514657 - DNA, 25 bp, Mus musculus
acacagtgtgatggccccaacaagt

SEQ ID NO: 514658 - DNA, 25 bp, Mus musculus
acacagttgtcacagtccatgattc

SEQ ID NO: 514659 - DNA, 25 bp, Mus musculus
acacagttgtcagagtccatgattc

SEQ ID NO: 514660 - DNA, 25 bp, Mus musculus
acacatacaagcagccaaagttaaa

SEQ ID NO: 514661 - DNA, 25 bp, Mus musculus
acacatacaagctgccaaagttaaa

SEQ ID NO: 514662 - DNA, 25 bp, Mus musculus
acacatacacacaaggatttggaca

SEQ ID NO: 514663 - DNA, 25 bp, Mus musculus
acacatacacactaggatttggaca

SEQ ID NO: 514664 - DNA, 25 bp, Mus musculus
acacatacccaccatcgggccttca

SEQ ID NO: 514665 - DNA, 25 bp, Mus musculus
acacatacccacgatcgggccttca

SEQ ID NO: 514666 - DNA, 25 bp, Mus musculus
acacatagccaacatcgggcgcctg

SEQ ID NO: 514667 - DNA, 25 bp, Mus musculus
acacatagccaagatcgggcgcctg

SEQ ID NO: 514668 - DNA, 25 bp, Mus musculus
acacatcaacacaggtcgaaacctg

SEQ ID NO: 514669 - DNA, 25 bp, Mus musculus
acacatcaacactggtcgaaacctg

SEQ ID NO: 514670 - DNA, 25 bp, Mus musculus
acacatcactggcaattacgcttct

SEQ ID NO: 514671 - DNA, 25 bp, Mus musculus
acacatcactgggaattacgcttct

SEQ ID NO: 514672 - DNA, 25 bp, Mus musculus
acacatcgtggcaatctccttcaca

SEQ ID NO: 514673 - DNA, 25 bp, Mus musculus
acacatcgtggctatctccttcaca

SEQ ID NO: 514674 - DNA, 25 bp, Mus musculus
acacatctgaaaataagagagcttc

SEQ ID NO: 514675 - DNA, 25 bp, Mus musculus
acacatctgaaattaagagagcttc

SEQ ID NO: 514676 - DNA, 25 bp, Mus musculus
acacatctgggcagtgactttcccc

SEQ ID NO: 514677 - DNA, 25 bp, Mus musculus
acacatctgggctgtgactttcccc

SEQ ID NO: 514678 - DNA, 25 bp, Mus musculus
acacatgacatgcaagcagtggaca

SEQ ID NO: 514679 - DNA, 25 bp, Mus musculus
acacatgacatggaagcagtggaca

SEQ ID NO: 514680 - DNA, 25 bp, Mus musculus
acacatgacttccagtccaaaggcg

SEQ ID NO: 514681 - DNA, 25 bp, Mus musculus
acacatgacttcgagtccaaaggcg

SEQ ID NO: 514682 - DNA, 25 bp, Mus musculus
acacatgaggagcacctcaccaagg

SEQ ID NO: 514683 - DNA, 25 bp, Mus musculus
acacatgaggaggacctcaccaagg

SEQ ID NO: 514684 - DNA, 25 bp, Mus musculus
acacatggccaaagctagggccgcc

SEQ ID NO: 514685 - DNA, 25 bp, Mus musculus
acacatggccaatgctagggccgcc

SEQ ID NO: 514686 - DNA, 25 bp, Mus musculus
acacatgttttcactcggtattata

SEQ ID NO: 514687 - DNA, 25 bp, Mus musculus
acacatgttttctctcggtattata

SEQ ID NO: 514688 - DNA, 25 bp, Mus musculus
acacattgctggctattgcctttga

SEQ ID NO: 514689 - DNA, 25 bp, Mus musculus
acacattgctgggtattgcctttga

SEQ ID NO: 514690 - DNA, 25 bp, Mus musculus
acacattgtctgagggcctgccctg

SEQ ID NO: 514691 - DNA, 25 bp, Mus musculus
acacattgtctgtgggcctgccctg

SEQ ID NO: 514692 - DNA, 25 bp, Mus musculus
acaccaaaggcccaaagcatggcag

SEQ ID NO: 514693 - DNA, 25 bp, Mus musculus
acaccaaaggccgaaagcatggcag

SEQ ID NO: 514694 - DNA, 25 bp, Mus musculus
acaccaacctgcacgcctgggaaat

SEQ ID NO: 514695 - DNA, 25 bp, Mus musculus
acaccaacctgctcgcctgggaaat

SEQ ID NO: 514696 - DNA, 25 bp, Mus musculus
acaccaagaaaactcagcctgactg

SEQ ID NO: 514697 - DNA, 25 bp, Mus musculus
acaccaagaaaagtcagcctgactg

SEQ ID NO: 514698 - DNA, 25 bp, Mus musculus
acaccaagaccacggctgaggtgag

SEQ ID NO: 514699 - DNA, 25 bp, Mus musculus
acaccaagaccagggctgaggtgag

SEQ ID NO: 514700 - DNA, 25 bp, Mus musculus
acaccaagagggatggcatcgtggc

SEQ ID NO: 514701 - DNA, 25 bp, Mus musculus
acaccaagagggttggcatcgtggc

SEQ ID NO: 514702 - DNA, 25 bp, Mus musculus
acaccaagatgtcgaagccgcccag

SEQ ID NO: 514703 - DNA, 25 bp, Mus musculus
acaccaagatgtggaagccgcccag

SEQ ID NO: 514704 - DNA, 25 bp, Mus musculus
acaccaagccttaggtcccacgagg

SEQ ID NO: 514705 - DNA, 25 bp, Mus musculus
acaccaagcctttggtcccacgagg

SEQ ID NO: 514706 - DNA, 25 bp, Mus musculus
acaccaatgtggaagctctcaaaaa

SEQ ID NO: 514707 - DNA, 25 bp, Mus musculus
acaccaatgtggtagctctcaaaaa

SEQ ID NO: 514708 - DNA, 25 bp, Mus musculus
acaccacagaaaaccctagaagaat

SEQ ID NO: 514709 - DNA, 25 bp, Mus musculus
acaccacagaaatccctagaagaat

SEQ ID NO: 514710 - DNA, 25 bp, Mus musculus
acaccaccgggaagcagctctttga

SEQ ID NO: 514711 - DNA, 25 bp, Mus musculus
acaccaccgggatgcagctctttga

SEQ ID NO: 514712 - DNA, 25 bp, Mus musculus
acaccacgtccacgagtggcacaag

SEQ ID NO: 514713 - DNA, 25 bp, Mus musculus
acaccacgtccaggagtggcacaag

SEQ ID NO: 514714 - DNA, 25 bp, Mus musculus
acaccactaacaccagcctgattaa

SEQ ID NO: 514715 - DNA, 25 bp, Mus musculus
acaccactaacagcagcctgattaa

SEQ ID NO: 514716 - DNA, 25 bp, Mus musculus
acaccactacggacgggctgtgatc

SEQ ID NO: 514717 - DNA, 25 bp, Mus musculus
acaccactacggtcgggctgtgatc

SEQ ID NO: 514718 - DNA, 25 bp, Mus musculus
acaccactgctcaacgctgtgcgtg

SEQ ID NO: 514719 - DNA, 25 bp, Mus musculus
acaccactgctctacgctgtgcgtg

SEQ ID NO: 514720 - DNA, 25 bp, Mus musculus
acaccagaactgactggagacctga

SEQ ID NO: 514721 - DNA, 25 bp, Mus musculus
acaccagaactgtctggagacctga

SEQ ID NO: 514722 - DNA, 25 bp, Mus musculus
acaccagaagttcggaagcagaatc

SEQ ID NO: 514723 - DNA, 25 bp, Mus musculus
acaccagaagttgggaagcagaatc

SEQ ID NO: 514724 - DNA, 25 bp, Mus musculus
acaccagacagaagcgctcagctga

SEQ ID NO: 514725 - DNA, 25 bp, Mus musculus
acaccagacagatgcgctcagctga

SEQ ID NO: 514726 - DNA, 25 bp, Mus musculus
acaccagcctggactccgttatgac

SEQ ID NO: 514727 - DNA, 25 bp, Mus musculus
acaccagcctggtctccgttatgac

SEQ ID NO: 514728 - DNA, 25 bp, Mus musculus
acaccagctgccaaagtgcctgaga

SEQ ID NO: 514729 - DNA, 25 bp, Mus musculus
acaccagctgcctaagtgcctgaga

SEQ ID NO: 514730 - DNA, 25 bp, Mus musculus
acaccagctttcatgacacttggga

SEQ ID NO: 514731 - DNA, 25 bp, Mus musculus
acaccagctttcttgacacttggga

SEQ ID NO: 514732 - DNA, 25 bp, Mus musculus
acaccaggcactccatcaaaggctt

SEQ ID NO: 514733 - DNA, 25 bp, Mus musculus
acaccaggcactgcatcaaaggctt

SEQ ID NO: 514734 - DNA, 25 bp, Mus musculus
acaccaggcggtcgcagagatcgac

SEQ ID NO: 514735 - DNA, 25 bp, Mus musculus
acaccaggcggtggcagagatcgac

SEQ ID NO: 514736 - DNA, 25 bp, Mus musculus
acaccaggctctatccagtgtcagt

SEQ ID NO: 514737 - DNA, 25 bp, Mus musculus
acaccaggctctttccagtgtcagt

SEQ ID NO: 514738 - DNA, 25 bp, Mus musculus
acaccagtgtgaatatgtgggaccc

SEQ ID NO: 514739 - DNA, 25 bp, Mus musculus
acaccagtgtgattatgtgggaccc

SEQ ID NO: 514740 - DNA, 25 bp, Mus musculus
acaccagtttaaaggcattggaatg

SEQ ID NO: 514741 - DNA, 25 bp, Mus musculus
acaccagtttaatggcattggaatg

SEQ ID NO: 514742 - DNA, 25 bp, Mus musculus
acaccatcatcgaggacggacacag

SEQ ID NO: 514743 - DNA, 25 bp, Mus musculus
acaccatcatcgtggacggacacag

SEQ ID NO: 514744 - DNA, 25 bp, Mus musculus
acaccatcatgaactgcacacagac

SEQ ID NO: 514745 - DNA, 25 bp, Mus musculus
acaccatcatgatctgcacacagac

SEQ ID NO: 514746 - DNA, 25 bp, Mus musculus
acaccatctcggaatacatctacca

SEQ ID NO: 514747 - DNA, 25 bp, Mus musculus
acaccatctcggtatacatctacca

SEQ ID NO: 514748 - DNA, 25 bp, Mus musculus
acaccatcttcccatattgccgtgg

SEQ ID NO: 514749 - DNA, 25 bp, Mus musculus
acaccatcttccgatattgccgtgg

SEQ ID NO: 514750 - DNA, 25 bp, Mus musculus
acaccatgaggcctccatcatcaat

SEQ ID NO: 514751 - DNA, 25 bp, Mus musculus
acaccatgaggcgtccatcatcaat

SEQ ID NO: 514752 - DNA, 25 bp, Mus musculus
acaccatgatgaaggatcagtatgc

SEQ ID NO: 514753 - DNA, 25 bp, Mus musculus
acaccatgatgatggatcagtatgc

SEQ ID NO: 514754 - DNA, 25 bp, Mus musculus
acaccatgatggctctcaggctcag

SEQ ID NO: 514755 - DNA, 25 bp, Mus musculus
acaccatgatgggtctcaggctcag

SEQ ID NO: 514756 - DNA, 25 bp, Mus musculus
acaccatgctaactacctgaatgca

SEQ ID NO: 514757 - DNA, 25 bp, Mus musculus
acaccatgctaagtacctgaatgca

SEQ ID NO: 514758 - DNA, 25 bp, Mus musculus
acaccatggatgctaccccagcgag

SEQ ID NO: 514759 - DNA, 25 bp, Mus musculus
acaccatggatggtaccccagcgag

SEQ ID NO: 514760 - DNA, 25 bp, Mus musculus
acaccatgggccctgagcgtatctt

SEQ ID NO: 514761 - DNA, 25 bp, Mus musculus
acaccatgggccgtgagcgtatctt

SEQ ID NO: 514762 - DNA, 25 bp, Mus musculus
acaccatggtatccacgggctgctg

SEQ ID NO: 514763 - DNA, 25 bp, Mus musculus
acaccatggtatgcacgggctgctg

SEQ ID NO: 514764 - DNA, 25 bp, Mus musculus
acaccattgaaacaagctctagaag

SEQ ID NO: 514765 - DNA, 25 bp, Mus musculus
acaccattgaaagaagctctagaag

SEQ ID NO: 514766 - DNA, 25 bp, Mus musculus
acaccattgagaagcaggccatcac

SEQ ID NO: 514767 - DNA, 25 bp, Mus musculus
acaccattgagatgcaggccatcac

SEQ ID NO: 514768 - DNA, 25 bp, Mus musculus
acaccatttgtgctctgggtgatgg

SEQ ID NO: 514769 - DNA, 25 bp, Mus musculus
acaccatttgtggtctgggtgatgg

SEQ ID NO: 514770 - DNA, 25 bp, Mus musculus
acacccaagagcatcagctttgatt

SEQ ID NO: 514771 - DNA, 25 bp, Mus musculus
acacccaagagcttcagctttgatt

SEQ ID NO: 514772 - DNA, 25 bp, Mus musculus
acacccaccttgaggatcaagatac

SEQ ID NO: 514773 - DNA, 25 bp, Mus musculus
acacccaccttgtggatcaagatac

SEQ ID NO: 514774 - DNA, 25 bp, Mus musculus
acacccagacaactatatactcaag

SEQ ID NO: 514775 - DNA, 25 bp, Mus musculus
acacccagacaagtatatactcaag

SEQ ID NO: 514776 - DNA, 25 bp, Mus musculus
acacccagtgcaacccagaaggctt

SEQ ID NO: 514777 - DNA, 25 bp, Mus musculus
acacccagtgcatcccagaaggctt

SEQ ID NO: 514778 - DNA, 25 bp, Mus musculus
acacccatcctacggcttctgggtg

SEQ ID NO: 514779 - DNA, 25 bp, Mus musculus
acacccatcctagggcttctgggtg

SEQ ID NO: 514780 - DNA, 25 bp, Mus musculus
acaccccagaaactgacgaagctct

SEQ ID NO: 514781 - DNA, 25 bp, Mus musculus
acaccccagaaagtgacgaagctct

SEQ ID NO: 514782 - DNA, 25 bp, Mus musculus
acacccgaatcactgaggccatggc

SEQ ID NO: 514783 - DNA, 25 bp, Mus musculus
acacccgaatcagtgaggccatggc

SEQ ID NO: 514784 - DNA, 25 bp, Mus musculus
acacccgccagaagtgggcagcgtt

SEQ ID NO: 514785 - DNA, 25 bp, Mus musculus
acacccgccagatgtgggcagcgtt

SEQ ID NO: 514786 - DNA, 25 bp, Mus musculus
acacccgctctgagcagtgctacag

SEQ ID NO: 514787 - DNA, 25 bp, Mus musculus
acacccgctctgtgcagtgctacag

SEQ ID NO: 514788 - DNA, 25 bp, Mus musculus
acacccggatctcaagtatatcagc

SEQ ID NO: 514789 - DNA, 25 bp, Mus musculus
acacccggatctgaagtatatcagc

SEQ ID NO: 514790 - DNA, 25 bp, Mus musculus
acacccgtggacatgtggagcgttg

SEQ ID NO: 514791 - DNA, 25 bp, Mus musculus
acacccgtggacttgtggagcgttg

SEQ ID NO: 514792 - DNA, 25 bp, Mus musculus
acaccctacagaagaccgtgctcag

SEQ ID NO: 514793 - DNA, 25 bp, Mus musculus
acaccctacagatgaccgtgctcag

SEQ ID NO: 514794 - DNA, 25 bp, Mus musculus
acaccctattacatgagccctgagc

SEQ ID NO: 514795 - DNA, 25 bp, Mus musculus
acaccctattacttgagccctgagc

SEQ ID NO: 514796 - DNA, 25 bp, Mus musculus
acaccctcaacgagctgcgggacga

SEQ ID NO: 514797 - DNA, 25 bp, Mus musculus
acaccctcaacgtgctgcgggacga

SEQ ID NO: 514798 - DNA, 25 bp, Mus musculus
acaccctccagaagttcagaaccag

SEQ ID NO: 514799 - DNA, 25 bp, Mus musculus
acaccctccagatgttcagaaccag

SEQ ID NO: 514800 - DNA, 25 bp, Mus musculus
acaccctctgccactatttgctggt

SEQ ID NO: 514801 - DNA, 25 bp, Mus musculus
acaccctctgcctctatttgctggt

SEQ ID NO: 514802 - DNA, 25 bp, Mus musculus
acaccctgcactcggtggatgcaga

SEQ ID NO: 514803 - DNA, 25 bp, Mus musculus
acaccctgcactgggtggatgcaga

SEQ ID NO: 514804 - DNA, 25 bp, Mus musculus
acaccctgctcgcatgcctgctgct

SEQ ID NO: 514805 - DNA, 25 bp, Mus musculus
acaccctgctcggatgcctgctgct

SEQ ID NO: 514806 - DNA, 25 bp, Mus musculus
acaccctggagaatgccgacctggc

SEQ ID NO: 514807 - DNA, 25 bp, Mus musculus
acaccctggagattgccgacctggc

SEQ ID NO: 514808 - DNA, 25 bp, Mus musculus
acaccctgttgaagagctcttagat

SEQ ID NO: 514809 - DNA, 25 bp, Mus musculus
acaccctgttgatgagctcttagat

SEQ ID NO: 514810 - DNA, 25 bp, Mus musculus
acacccttcatcagctggtgcggga

SEQ ID NO: 514811 - DNA, 25 bp, Mus musculus
acacccttcatctgctggtgcggga

SEQ ID NO: 514812 - DNA, 25 bp, Mus musculus
acaccgaatgagcacacgtggcctg

SEQ ID NO: 514813 - DNA, 25 bp, Mus musculus
acaccgaatgaggacacgtggcctg

SEQ ID NO: 514814 - DNA, 25 bp, Mus musculus
acaccgacaacgagggctgtatcca

SEQ ID NO: 514815 - DNA, 25 bp, Mus musculus
acaccgacaacgtgggctgtatcca

SEQ ID NO: 514816 - DNA, 25 bp, Mus musculus
acaccgacaagaaggccgccgagtt

SEQ ID NO: 514817 - DNA, 25 bp, Mus musculus
acaccgacaagatggccgccgagtt

SEQ ID NO: 514818 - DNA, 25 bp, Mus musculus
acaccgactgtaatttattagcttg

SEQ ID NO: 514819 - DNA, 25 bp, Mus musculus
acaccgactgtattttattagcttg

SEQ ID NO: 514820 - DNA, 25 bp, Mus musculus
acaccgagataactgctttcacgtt

SEQ ID NO: 514821 - DNA, 25 bp, Mus musculus
acaccgagataagtgctttcacgtt

SEQ ID NO: 514822 - DNA, 25 bp, Mus musculus
acaccgaggagcagaaagtggcccc

SEQ ID NO: 514823 - DNA, 25 bp, Mus musculus
acaccgaggagctgaaagtggcccc

SEQ ID NO: 514824 - DNA, 25 bp, Mus musculus
acaccgagtcttcagccaggtacct

SEQ ID NO: 514825 - DNA, 25 bp, Mus musculus
acaccgagtcttgagccaggtacct

SEQ ID NO: 514826 - DNA, 25 bp, Mus musculus
acaccgatgagtcccactgtgttga

SEQ ID NO: 514827 - DNA, 25 bp, Mus musculus
acaccgatgagtgccactgtgttga

SEQ ID NO: 514828 - DNA, 25 bp, Mus musculus
acaccgcttcacagttcattaagag

SEQ ID NO: 514829 - DNA, 25 bp, Mus musculus
acaccgcttcactgttcattaagag

SEQ ID NO: 514830 - DNA, 25 bp, Mus musculus
acaccggaagctccgggaacaagtg

SEQ ID NO: 514831 - DNA, 25 bp, Mus musculus
acaccggaagctgcgggaacaagtg

SEQ ID NO: 514832 - DNA, 25 bp, Mus musculus
acaccggagggtaatgcccacctca

SEQ ID NO: 514833 - DNA, 25 bp, Mus musculus
acaccggagggttatgcccacctca

SEQ ID NO: 514834 - DNA, 25 bp, Mus musculus
acaccggatcttcgccgagtgccag

SEQ ID NO: 514835 - DNA, 25 bp, Mus musculus
acaccggatcttggccgagtgccag

SEQ ID NO: 514836 - DNA, 25 bp, Mus musculus
acaccggccgaactggacagtggaa

SEQ ID NO: 514837 - DNA, 25 bp, Mus musculus
acaccggccgaagtggacagtggaa

SEQ ID NO: 514838 - DNA, 25 bp, Mus musculus
acaccggcggtgactaccggcagct

SEQ ID NO: 514839 - DNA, 25 bp, Mus musculus
acaccggcggtgtctaccggcagct

SEQ ID NO: 514840 - DNA, 25 bp, Mus musculus
acaccggcttctacactactgtggc

SEQ ID NO: 514841 - DNA, 25 bp, Mus musculus
acaccggcttcttcactactgtggc

SEQ ID NO: 514842 - DNA, 25 bp, Mus musculus
acaccgggaccaagggccagctttg

SEQ ID NO: 514843 - DNA, 25 bp, Mus musculus
acaccgggaccatgggccagctttg

SEQ ID NO: 514844 - DNA, 25 bp, Mus musculus
acaccggtgcagatgcctcctttgg

SEQ ID NO: 514845 - DNA, 25 bp, Mus musculus
acaccggtgcagttgcctcctttgg

SEQ ID NO: 514846 - DNA, 25 bp, Mus musculus
acaccggttagacaacgaatcacag

SEQ ID NO: 514847 - DNA, 25 bp, Mus musculus
acaccggttagagaacgaatcacag

SEQ ID NO: 514848 - DNA, 25 bp, Mus musculus
acaccgtcaccaagcccaagagagg

SEQ ID NO: 514849 - DNA, 25 bp, Mus musculus
acaccgtcaccatgcccaagagagg

SEQ ID NO: 514850 - DNA, 25 bp, Mus musculus
acaccgtcatagagggcctgaggcg

SEQ ID NO: 514851 - DNA, 25 bp, Mus musculus
acaccgtcatagtgggcctgaggcg

SEQ ID NO: 514852 - DNA, 25 bp, Mus musculus
acaccgtgcattaagcctgccggag

SEQ ID NO: 514853 - DNA, 25 bp, Mus musculus
acaccgtgcatttagcctgccggag

SEQ ID NO: 514854 - DNA, 25 bp, Mus musculus
acaccgtggtatctgagggccgtcc

SEQ ID NO: 514855 - DNA, 25 bp, Mus musculus
acaccgtggtatgtgagggccgtcc

SEQ ID NO: 514856 - DNA, 25 bp, Mus musculus
acaccgtggtgcagtacgacgagaa

SEQ ID NO: 514857 - DNA, 25 bp, Mus musculus
acaccgtggtgctgtacgacgagaa

SEQ ID NO: 514858 - DNA, 25 bp, Mus musculus
acaccgtgtaccagcaggtggtggc

SEQ ID NO: 514859 - DNA, 25 bp, Mus musculus
acaccgtgtacctgcaggtggtggc

SEQ ID NO: 514860 - DNA, 25 bp, Mus musculus
acaccgtttaccaagagctggagaa

SEQ ID NO: 514861 - DNA, 25 bp, Mus musculus
acaccgtttacctagagctggagaa

SEQ ID NO: 514862 - DNA, 25 bp, Mus musculus
acacctaagtcaaagcagtctccta

SEQ ID NO: 514863 - DNA, 25 bp, Mus musculus
acacctaagtcatagcagtctccta

SEQ ID NO: 514864 - DNA, 25 bp, Mus musculus
acacctacagccagagcggcggcgg

SEQ ID NO: 514865 - DNA, 25 bp, Mus musculus
acacctacagcctgagcggcggcgg

SEQ ID NO: 514866 - DNA, 25 bp, Mus musculus
acacctagccagactcggctagcaa

SEQ ID NO: 514867 - DNA, 25 bp, Mus musculus
acacctagccagtctcggctagcaa

SEQ ID NO: 514868 - DNA, 25 bp, Mus musculus
acacctaggaagatcgtgatttcca

SEQ ID NO: 514869 - DNA, 25 bp, Mus musculus
acacctaggaagttcgtgatttcca

SEQ ID NO: 514870 - DNA, 25 bp, Mus musculus
acacctatggcgcttctcaggtggc

SEQ ID NO: 514871 - DNA, 25 bp, Mus musculus
acacctatggcggttctcaggtggc

SEQ ID NO: 514872 - DNA, 25 bp, Mus musculus
acacctcacgccagctcaggaggag

SEQ ID NO: 514873 - DNA, 25 bp, Mus musculus
acacctcacgcctgctcaggaggag

SEQ ID NO: 514874 - DNA, 25 bp, Mus musculus
acacctcagactaccgcactgatga

SEQ ID NO: 514875 - DNA, 25 bp, Mus musculus
acacctcagacttccgcactgatga

SEQ ID NO: 514876 - DNA, 25 bp, Mus musculus
acacctcgggccaagcactgtgcag

SEQ ID NO: 514877 - DNA, 25 bp, Mus musculus
acacctcgggcctagcactgtgcag

SEQ ID NO: 514878 - DNA, 25 bp, Mus musculus
acacctctgtggatgagaactatga

SEQ ID NO: 514879 - DNA, 25 bp, Mus musculus
acacctctgtggttgagaactatga

SEQ ID NO: 514880 - DNA, 25 bp, Mus musculus
acacctgcaagaaggccggctctat

SEQ ID NO: 514881 - DNA, 25 bp, Mus musculus
acacctgcaagatggccggctctat

SEQ ID NO: 514882 - DNA, 25 bp, Mus musculus
acacctgccaaaagttatgctccag

SEQ ID NO: 514883 - DNA, 25 bp, Mus musculus
acacctgccaaatgttatgctccag

SEQ ID NO: 514884 - DNA, 25 bp, Mus musculus
acacctgctgtcatccgtgcaggct

SEQ ID NO: 514885 - DNA, 25 bp, Mus musculus
acacctgctgtcttccgtgcaggct

SEQ ID NO: 514886 - DNA, 25 bp, Mus musculus
acacctggaaccaggttactccact

SEQ ID NO: 514887 - DNA, 25 bp, Mus musculus
acacctggaacctggttactccact

SEQ ID NO: 514888 - DNA, 25 bp, Mus musculus
acacctgggtcgagtggcccgcaga

SEQ ID NO: 514889 - DNA, 25 bp, Mus musculus
acacctgggtcgtgtggcccgcaga

SEQ ID NO: 514890 - DNA, 25 bp, Mus musculus
acacctgggtgtctaccggcccgtg

SEQ ID NO: 514891 - DNA, 25 bp, Mus musculus
acacctgggtgtgtaccggcccgtg

SEQ ID NO: 514892 - DNA, 25 bp, Mus musculus
acacctggtttacagccaaatggat

SEQ ID NO: 514893 - DNA, 25 bp, Mus musculus
acacctggtttagagccaaatggat

SEQ ID NO: 514894 - DNA, 25 bp, Mus musculus
acacctgtaatccacagctccagag

SEQ ID NO: 514895 - DNA, 25 bp, Mus musculus
acacctgtaatcgacagctccagag

SEQ ID NO: 514896 - DNA, 25 bp, Mus musculus
acacctgtgagacgaagcaaagatc

SEQ ID NO: 514897 - DNA, 25 bp, Mus musculus
acacctgtgagaggaagcaaagatc

SEQ ID NO: 514898 - DNA, 25 bp, Mus musculus
acacctgtgtgtcaacgccccagga

SEQ ID NO: 514899 - DNA, 25 bp, Mus musculus
acacctgtgtgtgaacgccccagga

SEQ ID NO: 514900 - DNA, 25 bp, Mus musculus
acacctgtgtttcttgccctgaggg

SEQ ID NO: 514901 - DNA, 25 bp, Mus musculus
acacctgtgtttgttgccctgaggg

SEQ ID NO: 514902 - DNA, 25 bp, Mus musculus
acaccttatgtgcagcaggagacat

SEQ ID NO: 514903 - DNA, 25 bp, Mus musculus
acaccttatgtggagcaggagacat

SEQ ID NO: 514904 - DNA, 25 bp, Mus musculus
acaccttcacccaagtggtttctca

SEQ ID NO: 514905 - DNA, 25 bp, Mus musculus
acaccttcaccctagtggtttctca

SEQ ID NO: 514906 - DNA, 25 bp, Mus musculus
acaccttcctggattatatcatggg

SEQ ID NO: 514907 - DNA, 25 bp, Mus musculus
acaccttcctggtttatatcatggg

SEQ ID NO: 514908 - DNA, 25 bp, Mus musculus
acaccttcttggcacgtaactgaag

SEQ ID NO: 514909 - DNA, 25 bp, Mus musculus
acaccttcttgggacgtaactgaag

SEQ ID NO: 514910 - DNA, 25 bp, Mus musculus
acacctttcacacccatcagggaag

SEQ ID NO: 514911 - DNA, 25 bp, Mus musculus
acacctttcacagccatcagggaag

SEQ ID NO: 514912 - DNA, 25 bp, Mus musculus
acacgaccttcaccagacttatcaa

SEQ ID NO: 514913 - DNA, 25 bp, Mus musculus
acacgaccttcagcagacttatcaa

SEQ ID NO: 514914 - DNA, 25 bp, Mus musculus
acacgagcctccctgatgcagagat

SEQ ID NO: 514915 - DNA, 25 bp, Mus musculus
acacgagcctccgtgatgcagagat

SEQ ID NO: 514916 - DNA, 25 bp, Mus musculus
acacgagctgttcggccatggcagc

SEQ ID NO: 514917 - DNA, 25 bp, Mus musculus
acacgagctgttgggccatggcagc

SEQ ID NO: 514918 - DNA, 25 bp, Mus musculus
acacgatgcatcctagcaggcgcag

SEQ ID NO: 514919 - DNA, 25 bp, Mus musculus
acacgatgcatcgtagcaggcgcag

SEQ ID NO: 514920 - DNA, 25 bp, Mus musculus
acacgcaccgagagaccaggctcgg

SEQ ID NO: 514921 - DNA, 25 bp, Mus musculus
acacgcaccgagtgaccaggctcgg

SEQ ID NO: 514922 - DNA, 25 bp, Mus musculus
acacgccacgtgatttgctaccaaa

SEQ ID NO: 514923 - DNA, 25 bp, Mus musculus
acacgccacgtgttttgctaccaaa

SEQ ID NO: 514924 - DNA, 25 bp, Mus musculus
acacgcccatgaatgctggccttgg

SEQ ID NO: 514925 - DNA, 25 bp, Mus musculus
acacgcccatgattgctggccttgg

SEQ ID NO: 514926 - DNA, 25 bp, Mus musculus
acacgccggcctcgaatgcggcata

SEQ ID NO: 514927 - DNA, 25 bp, Mus musculus
acacgccggcctggaatgcggcata

SEQ ID NO: 514928 - DNA, 25 bp, Mus musculus
acacgcctgaagcttgactcccaag

SEQ ID NO: 514929 - DNA, 25 bp, Mus musculus
acacgcctgaaggttgactcccaag

SEQ ID NO: 514930 - DNA, 25 bp, Mus musculus
acacgcctttatcctgctgacatcg

SEQ ID NO: 514931 - DNA, 25 bp, Mus musculus
acacgcctttatgctgctgacatcg

SEQ ID NO: 514932 - DNA, 25 bp, Mus musculus
acacgctcatgcacagcaccttgga

SEQ ID NO: 514933 - DNA, 25 bp, Mus musculus
acacgctcatgctcagcaccttgga

SEQ ID NO: 514934 - DNA, 25 bp, Mus musculus
acacgctgacttagggccctttggg

SEQ ID NO: 514935 - DNA, 25 bp, Mus musculus
acacgctgactttgggccctttggg

SEQ ID NO: 514936 - DNA, 25 bp, Mus musculus
acacgcttgtccactcaagtttggg

SEQ ID NO: 514937 - DNA, 25 bp, Mus musculus
acacgcttgtcctctcaagtttggg

SEQ ID NO: 514938 - DNA, 25 bp, Mus musculus
acacggaaaggacagcggctgctct

SEQ ID NO: 514939 - DNA, 25 bp, Mus musculus
acacggaaaggagagcggctgctct

SEQ ID NO: 514940 - DNA, 25 bp, Mus musculus
acacggaaccccagacttggtgcaa

SEQ ID NO: 514941 - DNA, 25 bp, Mus musculus
acacggaacccctgacttggtgcaa

SEQ ID NO: 514942 - DNA, 25 bp, Mus musculus
acacggaaccggagagcagagcagc

SEQ ID NO: 514943 - DNA, 25 bp, Mus musculus
acacggaaccggtgagcagagcagc

SEQ ID NO: 514944 - DNA, 25 bp, Mus musculus
acacggaagcatatcttgctttgca

SEQ ID NO: 514945 - DNA, 25 bp, Mus musculus
acacggaagcatttcttgctttgca

SEQ ID NO: 514946 - DNA, 25 bp, Mus musculus
acacggaagcgcaagtcagagccag

SEQ ID NO: 514947 - DNA, 25 bp, Mus musculus
acacggaagcgctagtcagagccag

SEQ ID NO: 514948 - DNA, 25 bp, Mus musculus
acacggagctcgacaagtcacccag

SEQ ID NO: 514949 - DNA, 25 bp, Mus musculus
acacggagctcgtcaagtcacccag

SEQ ID NO: 514950 - DNA, 25 bp, Mus musculus
acacggcagagaacactgggcagag

SEQ ID NO: 514951 - DNA, 25 bp, Mus musculus
acacggcagagatcactgggcagag

SEQ ID NO: 514952 - DNA, 25 bp, Mus musculus
acacggccaagaacgcactgctgga

SEQ ID NO: 514953 - DNA, 25 bp, Mus musculus
acacggccaagatcgcactgctgga

SEQ ID NO: 514954 - DNA, 25 bp, Mus musculus
acacggccggccaggagagatacag

SEQ ID NO: 514955 - DNA, 25 bp, Mus musculus
acacggccggcctggagagatacag

SEQ ID NO: 514956 - DNA, 25 bp, Mus musculus
acacggcgcgcacaataaattaatg

SEQ ID NO: 514957 - DNA, 25 bp, Mus musculus
acacggcgcgcagaataaattaatg

SEQ ID NO: 514958 - DNA, 25 bp, Mus musculus
acacggcgctggctgccgtcatctg

SEQ ID NO: 514959 - DNA, 25 bp, Mus musculus
acacggcgctgggtgccgtcatctg

SEQ ID NO: 514960 - DNA, 25 bp, Mus musculus
acacggcgtcccagcaggagcggct

SEQ ID NO: 514961 - DNA, 25 bp, Mus musculus
acacggcgtccctgcaggagcggct

SEQ ID NO: 514962 - DNA, 25 bp, Mus musculus
acacggctggctcggccaagcgctt

SEQ ID NO: 514963 - DNA, 25 bp, Mus musculus
acacggctggctgggccaagcgctt

SEQ ID NO: 514964 - DNA, 25 bp, Mus musculus
acacgggaaccaccaggaaggagct

SEQ ID NO: 514965 - DNA, 25 bp, Mus musculus
acacgggaaccagcaggaaggagct

SEQ ID NO: 514966 - DNA, 25 bp, Mus musculus
acacgggatgctagtgccctcctgg

SEQ ID NO: 514967 - DNA, 25 bp, Mus musculus
acacgggatgcttgtgccctcctgg

SEQ ID NO: 514968 - DNA, 25 bp, Mus musculus
acacgggccatcatgcacgggtcat

SEQ ID NO: 514969 - DNA, 25 bp, Mus musculus
acacgggccatcttgcacgggtcat

SEQ ID NO: 514970 - DNA, 25 bp, Mus musculus
acacggtagaggactcgcgtggtca

SEQ ID NO: 514971 - DNA, 25 bp, Mus musculus
acacggtagaggtctcgcgtggtca

SEQ ID NO: 514972 - DNA, 25 bp, Mus musculus
acacggtgacgtccaactggctggc

SEQ ID NO: 514973 - DNA, 25 bp, Mus musculus
acacggtgacgtgcaactggctggc

SEQ ID NO: 514974 - DNA, 25 bp, Mus musculus
acacggtgctggacatgctccgaga

SEQ ID NO: 514975 - DNA, 25 bp, Mus musculus
acacggtgctggtcatgctccgaga

SEQ ID NO: 514976 - DNA, 25 bp, Mus musculus
acacggtggctcacgatgcggacat

SEQ ID NO: 514977 - DNA, 25 bp, Mus musculus
acacggtggctctcgatgcggacat

SEQ ID NO: 514978 - DNA, 25 bp, Mus musculus
acacgtatgctgaaccccaattcta

SEQ ID NO: 514979 - DNA, 25 bp, Mus musculus
acacgtatgctgtaccccaattcta

SEQ ID NO: 514980 - DNA, 25 bp, Mus musculus
acacgtcagtcaacgcgggcagttc

SEQ ID NO: 514981 - DNA, 25 bp, Mus musculus
acacgtcagtcatcgcgggcagttc

SEQ ID NO: 514982 - DNA, 25 bp, Mus musculus
acacgtctgcccctaagatttccgg

SEQ ID NO: 514983 - DNA, 25 bp, Mus musculus
acacgtctgcccgtaagatttccgg

SEQ ID NO: 514984 - DNA, 25 bp, Mus musculus
acacgtgaacgaaaccctcttctgg

SEQ ID NO: 514985 - DNA, 25 bp, Mus musculus
acacgtgaacgataccctcttctgg

SEQ ID NO: 514986 - DNA, 25 bp, Mus musculus
acacgtgaacgtagaaggattttca

SEQ ID NO: 514987 - DNA, 25 bp, Mus musculus
acacgtgaacgttgaaggattttca

SEQ ID NO: 514988 - DNA, 25 bp, Mus musculus
acacgtgacggaatggaatcctcct

SEQ ID NO: 514989 - DNA, 25 bp, Mus musculus
acacgtgacggattggaatcctcct

SEQ ID NO: 514990 - DNA, 25 bp, Mus musculus
acacgtgccagacggcttatcacca

SEQ ID NO: 514991 - DNA, 25 bp, Mus musculus
acacgtgccagagggcttatcacca

SEQ ID NO: 514992 - DNA, 25 bp, Mus musculus
acacgtggcggcaaccgctgtgcct

SEQ ID NO: 514993 - DNA, 25 bp, Mus musculus
acacgtggcggctaccgctgtgcct

SEQ ID NO: 514994 - DNA, 25 bp, Mus musculus
acacgtggcttactttgtacccatg

SEQ ID NO: 514995 - DNA, 25 bp, Mus musculus
acacgtggcttagtttgtacccatg

SEQ ID NO: 514996 - DNA, 25 bp, Mus musculus
acacgtggctttctatgctctggag

SEQ ID NO: 514997 - DNA, 25 bp, Mus musculus
acacgtggctttgtatgctctggag

SEQ ID NO: 514998 - DNA, 25 bp, Mus musculus
acacgtgtgcggaggcaccctgctg

SEQ ID NO: 514999 - DNA, 25 bp, Mus musculus
acacgtgtgcggtggcaccctgctg

SEQ ID NO: 515000 - DNA, 25 bp, Mus musculus
acactaatgagcaatgaagttccgg

SEQ ID NO: 515001 - DNA, 25 bp, Mus musculus
acactaatgagctatgaagttccgg

SEQ ID NO: 515002 - DNA, 25 bp, Mus musculus
acactacagtatagcttccatcctg

SEQ ID NO: 515003 - DNA, 25 bp, Mus musculus
acactacagtattgcttccatcctg

SEQ ID NO: 515004 - DNA, 25 bp, Mus musculus
acactactcacaagccagctgcagg

SEQ ID NO: 515005 - DNA, 25 bp, Mus musculus
acactactcacacgttctcttggga

SEQ ID NO: 515006 - DNA, 25 bp, Mus musculus
acactactcacaggttctcttggga

SEQ ID NO: 515007 - DNA, 25 bp, Mus musculus
acactactcacatgccagctgcagg

SEQ ID NO: 515008 - DNA, 25 bp, Mus musculus
acactagaccttctccagttggagc

SEQ ID NO: 515009 - DNA, 25 bp, Mus musculus
acactagaccttgtccagttggagc

SEQ ID NO: 515010 - DNA, 25 bp, Mus musculus
acactaggagaaaacattgctgata

SEQ ID NO: 515011 - DNA, 25 bp, Mus musculus
acactaggagaatacattgctgata

SEQ ID NO: 515012 - DNA, 25 bp, Mus musculus
acactagtgatgacacccacgcaca

SEQ ID NO: 515013 - DNA, 25 bp, Mus musculus
acactagtgatgtcacccacgcaca

SEQ ID NO: 515014 - DNA, 25 bp, Mus musculus
acactatcgtggaacccacccagga

SEQ ID NO: 515015 - DNA, 25 bp, Mus musculus
acactatcgtggtacccacccagga

SEQ ID NO: 515016 - DNA, 25 bp, Mus musculus
acactattcgggagaagatgctacg

SEQ ID NO: 515017 - DNA, 25 bp, Mus musculus
acactattcgggtgaagatgctacg

SEQ ID NO: 515018 - DNA, 25 bp, Mus musculus
acactattttctcccaccagatgat

SEQ ID NO: 515019 - DNA, 25 bp, Mus musculus
acactattttctgccaccagatgat

SEQ ID NO: 515020 - DNA, 25 bp, Mus musculus
acactcaaggagagcgctgccatca

SEQ ID NO: 515021 - DNA, 25 bp, Mus musculus
acactcaaggagtgcgctgccatca

SEQ ID NO: 515022 - DNA, 25 bp, Mus musculus
acactcaagtgccaaccaggacagt

SEQ ID NO: 515023 - DNA, 25 bp, Mus musculus
acactcaagtgcgaaccaggacagt

SEQ ID NO: 515024 - DNA, 25 bp, Mus musculus
acactcaccgggaggatccaggagg

SEQ ID NO: 515025 - DNA, 25 bp, Mus musculus
acactcaccgggtggatccaggagg

SEQ ID NO: 515026 - DNA, 25 bp, Mus musculus
acactcactcttaccacctgtggtg

SEQ ID NO: 515027 - DNA, 25 bp, Mus musculus
acactcactctttccacctgtggtg

SEQ ID NO: 515028 - DNA, 25 bp, Mus musculus
acactcagaaacaaggaagaaggct

SEQ ID NO: 515029 - DNA, 25 bp, Mus musculus
acactcagaaactaggaagaaggct

SEQ ID NO: 515030 - DNA, 25 bp, Mus musculus
acactcaggagaccgtgggcctcgt

SEQ ID NO: 515031 - DNA, 25 bp, Mus musculus
acactcaggagagcgtgggcctcgt

SEQ ID NO: 515032 - DNA, 25 bp, Mus musculus
acactcatcactcggttggcaagac

SEQ ID NO: 515033 - DNA, 25 bp, Mus musculus
acactcatcactgggttggcaagac

SEQ ID NO: 515034 - DNA, 25 bp, Mus musculus
acactccagaaacacaaatcttcct

SEQ ID NO: 515035 - DNA, 25 bp, Mus musculus
acactccagaaagacaaatcttcct

SEQ ID NO: 515036 - DNA, 25 bp, Mus musculus
acactccctcctaatggtgaatgga

SEQ ID NO: 515037 - DNA, 25 bp, Mus musculus
acactccctccttatggtgaatgga

SEQ ID NO: 515038 - DNA, 25 bp, Mus musculus
acactccgagatctaagagccaccg

SEQ ID NO: 515039 - DNA, 25 bp, Mus musculus
acactccgagatgtaagagccaccg

SEQ ID NO: 515040 - DNA, 25 bp, Mus musculus
acactcctgtgaagcctccgtgctg

SEQ ID NO: 515041 - DNA, 25 bp, Mus musculus
acactcctgtgatgcctccgtgctg

SEQ ID NO: 515042 - DNA, 25 bp, Mus musculus
acactccttcctcgtgtccggaaag

SEQ ID NO: 515043 - DNA, 25 bp, Mus musculus
acactccttcctggtgtccggaaag

SEQ ID NO: 515044 - DNA, 25 bp, Mus musculus
acactcgccatgagggccccatgtt

SEQ ID NO: 515045 - DNA, 25 bp, Mus musculus
acactcgccatgtgggccccatgtt

SEQ ID NO: 515046 - DNA, 25 bp, Mus musculus
acactcggccgaacgggactggtac

SEQ ID NO: 515047 - DNA, 25 bp, Mus musculus
acactcggccgatcgggactggtac

SEQ ID NO: 515048 - DNA, 25 bp, Mus musculus
acactcgggccaagcgggagaagct

SEQ ID NO: 515049 - DNA, 25 bp, Mus musculus
acactcgggccatgcgggagaagct

SEQ ID NO: 515050 - DNA, 25 bp, Mus musculus
acactctacatcctagcacggatca

SEQ ID NO: 515051 - DNA, 25 bp, Mus musculus
acactctacatcgtagcacggatca

SEQ ID NO: 515052 - DNA, 25 bp, Mus musculus
acactcttacgacacagtggtgtgg

SEQ ID NO: 515053 - DNA, 25 bp, Mus musculus
acactcttacgagacagtggtgtgg

SEQ ID NO: 515054 - DNA, 25 bp, Mus musculus
acactgaaatcgctcctggaaaagg

SEQ ID NO: 515055 - DNA, 25 bp, Mus musculus
acactgaaatcggtcctggaaaagg

SEQ ID NO: 515056 - DNA, 25 bp, Mus musculus
acactgaaccccacgtacaacgagg

SEQ ID NO: 515057 - DNA, 25 bp, Mus musculus
acactgaacccctcgtacaacgagg

SEQ ID NO: 515058 - DNA, 25 bp, Mus musculus
acactgaaggatcccctgggttctg

SEQ ID NO: 515059 - DNA, 25 bp, Mus musculus
acactgaaggatgccctgggttctg

SEQ ID NO: 515060 - DNA, 25 bp, Mus musculus
acactgacccacatcaatgaggtct

SEQ ID NO: 515061 - DNA, 25 bp, Mus musculus
acactgacccacttcaatgaggtct

SEQ ID NO: 515062 - DNA, 25 bp, Mus musculus
acactgactctaagggtcccaccgg

SEQ ID NO: 515063 - DNA, 25 bp, Mus musculus
acactgactctatgggtcccaccgg

SEQ ID NO: 515064 - DNA, 25 bp, Mus musculus
acactgatgcagaacggcggtcagt

SEQ ID NO: 515065 - DNA, 25 bp, Mus musculus
acactgatgcagtacggcggtcagt

SEQ ID NO: 515066 - DNA, 25 bp, Mus musculus
acactgatgcggcagcagagcctgc

SEQ ID NO: 515067 - DNA, 25 bp, Mus musculus
acactgatgcgggagcagagcctgc

SEQ ID NO: 515068 - DNA, 25 bp, Mus musculus
acactgcagacgaacgtgcagctca

SEQ ID NO: 515069 - DNA, 25 bp, Mus musculus
acactgcagacgtacgtgcagctca

SEQ ID NO: 515070 - DNA, 25 bp, Mus musculus
acactgcaggacagggtggctacaa

SEQ ID NO: 515071 - DNA, 25 bp, Mus musculus
acactgcaggacaggtacgagctca

SEQ ID NO: 515072 - DNA, 25 bp, Mus musculus
acactgcaggactgggtggctacaa

SEQ ID NO: 515073 - DNA, 25 bp, Mus musculus
acactgcaggactggtacgagctca

SEQ ID NO: 515074 - DNA, 25 bp, Mus musculus
acactgcagggccagatactccttc

SEQ ID NO: 515075 - DNA, 25 bp, Mus musculus
acactgcagggcgagatactccttc

SEQ ID NO: 515076 - DNA, 25 bp, Mus musculus
acactgccgtccacgggtggctgga

SEQ ID NO: 515077 - DNA, 25 bp, Mus musculus
acactgccgtcctcgggtggctgga

SEQ ID NO: 515078 - DNA, 25 bp, Mus musculus
acactgcgggcaccgaaagaagaag

SEQ ID NO: 515079 - DNA, 25 bp, Mus musculus
acactgcgggcagcgaaagaagaag

SEQ ID NO: 515080 - DNA, 25 bp, Mus musculus
acactgctgtggctgccgacgctcg

SEQ ID NO: 515081 - DNA, 25 bp, Mus musculus
acactgctgtgggtgccgacgctcg

SEQ ID NO: 515082 - DNA, 25 bp, Mus musculus
acactggacacactgctttttatcc

SEQ ID NO: 515083 - DNA, 25 bp, Mus musculus
acactggacacagtgctttttatcc

SEQ ID NO: 515084 - DNA, 25 bp, Mus musculus
acactggaggacaccggtatctatc

SEQ ID NO: 515085 - DNA, 25 bp, Mus musculus
acactggaggactccggtatctatc

SEQ ID NO: 515086 - DNA, 25 bp, Mus musculus
acactggcaagtctactgttacaaa

SEQ ID NO: 515087 - DNA, 25 bp, Mus musculus
acactggcaagtgtactgttacaaa

SEQ ID NO: 515088 - DNA, 25 bp, Mus musculus
acactggccgagctaaggccccaga

SEQ ID NO: 515089 - DNA, 25 bp, Mus musculus
acactggccgaggtaaggccccaga

SEQ ID NO: 515090 - DNA, 25 bp, Mus musculus
acactggctgagcagctccgaacat

SEQ ID NO: 515091 - DNA, 25 bp, Mus musculus
acactggctgaggagctccgaacat

SEQ ID NO: 515092 - DNA, 25 bp, Mus musculus
acactgggacccaacgcacgagagg

SEQ ID NO: 515093 - DNA, 25 bp, Mus musculus
acactgggaccctacgcacgagagg

SEQ ID NO: 515094 - DNA, 25 bp, Mus musculus
acactggtacagatattctctgaag

SEQ ID NO: 515095 - DNA, 25 bp, Mus musculus
acactggtacagttattctctgaag

SEQ ID NO: 515096 - DNA, 25 bp, Mus musculus
acactggtggtacagttcacggtga

SEQ ID NO: 515097 - DNA, 25 bp, Mus musculus
acactggtggtagagttcacggtga

SEQ ID NO: 515098 - DNA, 25 bp, Mus musculus
acactggtgtctccgtggcacggca

SEQ ID NO: 515099 - DNA, 25 bp, Mus musculus
acactggtgtctgcgtggcacggca

SEQ ID NO: 515100 - DNA, 25 bp, Mus musculus
acactgtactcgagcctgtcactgc

SEQ ID NO: 515101 - DNA, 25 bp, Mus musculus
acactgtactcgtgcctgtcactgc

SEQ ID NO: 515102 - DNA, 25 bp, Mus musculus
acactgtcacggcaggcaaaggcag

SEQ ID NO: 515103 - DNA, 25 bp, Mus musculus
acactgtcacgggaggcaaaggcag

SEQ ID NO: 515104 - DNA, 25 bp, Mus musculus
acactgtcagaaacatctccctcga

SEQ ID NO: 515105 - DNA, 25 bp, Mus musculus
acactgtcagaatcatctccctcga

SEQ ID NO: 515106 - DNA, 25 bp, Mus musculus
acactgtcctgtaggatgaacaagc

SEQ ID NO: 515107 - DNA, 25 bp, Mus musculus
acactgtcctgttggatgaacaagc

SEQ ID NO: 515108 - DNA, 25 bp, Mus musculus
acactgtcgctcatccagggcctgg

SEQ ID NO: 515109 - DNA, 25 bp, Mus musculus
acactgtcgctcttccagggcctgg

SEQ ID NO: 515110 - DNA, 25 bp, Mus musculus
acactgtctgtgcagcttcagtgtg

SEQ ID NO: 515111 - DNA, 25 bp, Mus musculus
acactgtctgtggagcttcagtgtg

SEQ ID NO: 515112 - DNA, 25 bp, Mus musculus
acactgtgagagacagggctgaatt

SEQ ID NO: 515113 - DNA, 25 bp, Mus musculus
acactgtgagagtcagggctgaatt

SEQ ID NO: 515114 - DNA, 25 bp, Mus musculus
acactgttacatcagacaggaagcc

SEQ ID NO: 515115 - DNA, 25 bp, Mus musculus
acactgttacatgagacaggaagcc

SEQ ID NO: 515116 - DNA, 25 bp, Mus musculus
acactgtttggcctctttcacggag

SEQ ID NO: 515117 - DNA, 25 bp, Mus musculus
acactgtttggcgtctttcacggag

SEQ ID NO: 515118 - DNA, 25 bp, Mus musculus
acacttaagaatcatgtctctgcat

SEQ ID NO: 515119 - DNA, 25 bp, Mus musculus
acacttaagaatgatgtctctgcat

SEQ ID NO: 515120 - DNA, 25 bp, Mus musculus
acacttatctacagagagacatacc

SEQ ID NO: 515121 - DNA, 25 bp, Mus musculus
acacttatctactgagagacatacc

SEQ ID NO: 515122 - DNA, 25 bp, Mus musculus
acacttcattggctggtatctgaag

SEQ ID NO: 515123 - DNA, 25 bp, Mus musculus
acacttcattgggtggtatctgaag

SEQ ID NO: 515124 - DNA, 25 bp, Mus musculus
acacttccaaccaccagagacgagg

SEQ ID NO: 515125 - DNA, 25 bp, Mus musculus
acacttccaacctccagagacgagg

SEQ ID NO: 515126 - DNA, 25 bp, Mus musculus
acacttcccgagaggacgaagagcc

SEQ ID NO: 515127 - DNA, 25 bp, Mus musculus
acacttcccgagtggacgaagagcc

SEQ ID NO: 515128 - DNA, 25 bp, Mus musculus
acacttcgagatcttctccttgtcc

SEQ ID NO: 515129 - DNA, 25 bp, Mus musculus
acacttcgagatgttctccttgtcc

SEQ ID NO: 515130 - DNA, 25 bp, Mus musculus
acacttctatgcctcctgctcatag

SEQ ID NO: 515131 - DNA, 25 bp, Mus musculus
acacttctatgcgtcctgctcatag

SEQ ID NO: 515132 - DNA, 25 bp, Mus musculus
acacttctctgtcgacattattgat

SEQ ID NO: 515133 - DNA, 25 bp, Mus musculus
acacttctctgtggacattattgat

SEQ ID NO: 515134 - DNA, 25 bp, Mus musculus
acacttcttcctctaggtggcaaca

SEQ ID NO: 515135 - DNA, 25 bp, Mus musculus
acacttcttcctgtaggtggcaaca

SEQ ID NO: 515136 - DNA, 25 bp, Mus musculus
acacttgccacgctcaggaaacagc

SEQ ID NO: 515137 - DNA, 25 bp, Mus musculus
acacttgccacggtcaggaaacagc

SEQ ID NO: 515138 - DNA, 25 bp, Mus musculus
acactttctcttagtcggaggagct

SEQ ID NO: 515139 - DNA, 25 bp, Mus musculus
acactttctctttgtcggaggagct

SEQ ID NO: 515140 - DNA, 25 bp, Mus musculus
acactttgccagagtagtcagacct

SEQ ID NO: 515141 - DNA, 25 bp, Mus musculus
acactttgccagtgtagtcagacct

SEQ ID NO: 515142 - DNA, 25 bp, Mus musculus
acagaaaagctaaaggagtcacctc

SEQ ID NO: 515143 - DNA, 25 bp, Mus musculus
acagaaaagctataggagtcacctc

SEQ ID NO: 515144 - DNA, 25 bp, Mus musculus
acagaaaagtgcaggacgccgggcc

SEQ ID NO: 515145 - DNA, 25 bp, Mus musculus
acagaaaagtgctggacgccgggcc

SEQ ID NO: 515146 - DNA, 25 bp, Mus musculus
acagaaaatatactaagcttgccaa

SEQ ID NO: 515147 - DNA, 25 bp, Mus musculus
acagaaaatatagtaagcttgccaa

SEQ ID NO: 515148 - DNA, 25 bp, Mus musculus
acagaaaattcaaccaacatcagtt

SEQ ID NO: 515149 - DNA, 25 bp, Mus musculus
acagaaaattcatccaacatcagtt

SEQ ID NO: 515150 - DNA, 25 bp, Mus musculus
acagaaacatcaccgggcacattta

SEQ ID NO: 515151 - DNA, 25 bp, Mus musculus
acagaaacatcagcgggcacattta

SEQ ID NO: 515152 - DNA, 25 bp, Mus musculus
acagaaagataacacagacccagga

SEQ ID NO: 515153 - DNA, 25 bp, Mus musculus
acagaaagataagacagacccagga

SEQ ID NO: 515154 - DNA, 25 bp, Mus musculus
acagaacagtctatttactccaaag

SEQ ID NO: 515155 - DNA, 25 bp, Mus musculus
acagaacagtctttttactccaaag

SEQ ID NO: 515156 - DNA, 25 bp, Mus musculus
acagaacatccacatctgccacata

SEQ ID NO: 515157 - DNA, 25 bp, Mus musculus
acagaacatccagatctgccacata

SEQ ID NO: 515158 - DNA, 25 bp, Mus musculus
acagaacccctgaaatcagcaaagc

SEQ ID NO: 515159 - DNA, 25 bp, Mus musculus
acagaacccctgtaatcagcaaagc

SEQ ID NO: 515160 - DNA, 25 bp, Mus musculus
acagaacggaacacaaacctggatc

SEQ ID NO: 515161 - DNA, 25 bp, Mus musculus
acagaacggaactcaaacctggatc

SEQ ID NO: 515162 - DNA, 25 bp, Mus musculus
acagaactcaagaaagagactgatt

SEQ ID NO: 515163 - DNA, 25 bp, Mus musculus
acagaactcaagtaagagactgatt

SEQ ID NO: 515164 - DNA, 25 bp, Mus musculus
acagaactgaacagcgccacagaca

SEQ ID NO: 515165 - DNA, 25 bp, Mus musculus
acagaactgaactgcgccacagaca

SEQ ID NO: 515166 - DNA, 25 bp, Mus musculus
acagaactgggccacttcctgcggg

SEQ ID NO: 515167 - DNA, 25 bp, Mus musculus
acagaactgggcgacttcctgcggg

SEQ ID NO: 515168 - DNA, 25 bp, Mus musculus
acagaagaacatcgctcaagaaact

SEQ ID NO: 515169 - DNA, 25 bp, Mus musculus
acagaagaacatggctcaagaaact

SEQ ID NO: 515170 - DNA, 25 bp, Mus musculus
acagaagaccgcctaccagcggaac

SEQ ID NO: 515171 - DNA, 25 bp, Mus musculus
acagaagaccgcgtaccagcggaac

SEQ ID NO: 515172 - DNA, 25 bp, Mus musculus
acagaagacctgagctctagttggg

SEQ ID NO: 515173 - DNA, 25 bp, Mus musculus
acagaagacctgtgctctagttggg

SEQ ID NO: 515174 - DNA, 25 bp, Mus musculus
acagaagactctagggatgctgaga

SEQ ID NO: 515175 - DNA, 25 bp, Mus musculus
acagaagactcttgggatgctgaga

SEQ ID NO: 515176 - DNA, 25 bp, Mus musculus
acagaagagaaacaggtgtttgccc

SEQ ID NO: 515177 - DNA, 25 bp, Mus musculus
acagaagagaaagaggtgtttgccc

SEQ ID NO: 515178 - DNA, 25 bp, Mus musculus
acagaagagccacggaaatccccag

SEQ ID NO: 515179 - DNA, 25 bp, Mus musculus
acagaagagccagggaaatccccag

SEQ ID NO: 515180 - DNA, 25 bp, Mus musculus
acagaagcaagacaagccccggaca

SEQ ID NO: 515181 - DNA, 25 bp, Mus musculus
acagaagcaagagaagccccggaca

SEQ ID NO: 515182 - DNA, 25 bp, Mus musculus
acagaagccacacggtggacccata

SEQ ID NO: 515183 - DNA, 25 bp, Mus musculus
acagaagccacagggtggacccata

SEQ ID NO: 515184 - DNA, 25 bp, Mus musculus
acagaagccgtcagcgtgggacact

SEQ ID NO: 515185 - DNA, 25 bp, Mus musculus
acagaagccgtctgcgtgggacact

SEQ ID NO: 515186 - DNA, 25 bp, Mus musculus
acagaagccttcacatcccaggcag

SEQ ID NO: 515187 - DNA, 25 bp, Mus musculus
acagaagccttctcatcccaggcag

SEQ ID NO: 515188 - DNA, 25 bp, Mus musculus
acagaagcgctgaaccagggcaaca

SEQ ID NO: 515189 - DNA, 25 bp, Mus musculus
acagaagcgctgtaccagggcaaca

SEQ ID NO: 515190 - DNA, 25 bp, Mus musculus
acagaagctcaacgaggccagtcgg

SEQ ID NO: 515191 - DNA, 25 bp, Mus musculus
acagaagctcaaggaggccagtcgg

SEQ ID NO: 515192 - DNA, 25 bp, Mus musculus
acagaagctgctcagttgcttacag

SEQ ID NO: 515193 - DNA, 25 bp, Mus musculus
acagaagctgctgagttgcttacag

SEQ ID NO: 515194 - DNA, 25 bp, Mus musculus
acagaaggctatccgcctacagcag

SEQ ID NO: 515195 - DNA, 25 bp, Mus musculus
acagaaggctatgcgcctacagcag

SEQ ID NO: 515196 - DNA, 25 bp, Mus musculus
acagaaggtgacagtggcgaaggca

SEQ ID NO: 515197 - DNA, 25 bp, Mus musculus
acagaaggtgactgtggcgaaggca

SEQ ID NO: 515198 - DNA, 25 bp, Mus musculus
acagaagtcagtatgtcagatgaag

SEQ ID NO: 515199 - DNA, 25 bp, Mus musculus
acagaagtcagtttgtcagatgaag

SEQ ID NO: 515200 - DNA, 25 bp, Mus musculus
acagaagtcatgcaggtccctaggg

SEQ ID NO: 515201 - DNA, 25 bp, Mus musculus
acagaagtcatggaggtccctaggg

SEQ ID NO: 515202 - DNA, 25 bp, Mus musculus
acagaagtcgtgaaggccaaggctg

SEQ ID NO: 515203 - DNA, 25 bp, Mus musculus
acagaagtcgtgtaggccaaggctg

SEQ ID NO: 515204 - DNA, 25 bp, Mus musculus
acagaatgaatgcatacagccaagt

SEQ ID NO: 515205 - DNA, 25 bp, Mus musculus
acagaatgaatggatacagccaagt

SEQ ID NO: 515206 - DNA, 25 bp, Mus musculus
acagaatgtaccacagctgttgatc

SEQ ID NO: 515207 - DNA, 25 bp, Mus musculus
acagaatgtacctcagctgttgatc

SEQ ID NO: 515208 - DNA, 25 bp, Mus musculus
acagaattaccaagacagactgtca

SEQ ID NO: 515209 - DNA, 25 bp, Mus musculus
acagaattaccatgacagactgtca

SEQ ID NO: 515210 - DNA, 25 bp, Mus musculus
acagacaaaacaaaatgctctcaag

SEQ ID NO: 515211 - DNA, 25 bp, Mus musculus
acagacaaaacataatgctctcaag

SEQ ID NO: 515212 - DNA, 25 bp, Mus musculus
acagacaagactctgctgagctcac

SEQ ID NO: 515213 - DNA, 25 bp, Mus musculus
acagacaagactgtgctgagctcac

SEQ ID NO: 515214 - DNA, 25 bp, Mus musculus
acagacaatacaacaaggacagaga

SEQ ID NO: 515215 - DNA, 25 bp, Mus musculus
acagacaatacatcaaggacagaga

SEQ ID NO: 515216 - DNA, 25 bp, Mus musculus
acagacacggcgacccagcaggagc

SEQ ID NO: 515217 - DNA, 25 bp, Mus musculus
acagacacggcgtcccagcaggagc

SEQ ID NO: 515218 - DNA, 25 bp, Mus musculus
acagacacgtttctaggcatttgcg

SEQ ID NO: 515219 - DNA, 25 bp, Mus musculus
acagacacgtttgtaggcatttgcg

SEQ ID NO: 515220 - DNA, 25 bp, Mus musculus
acagacactgccagggacctcaagc

SEQ ID NO: 515221 - DNA, 25 bp, Mus musculus
acagacactgcctgggacctcaagc

SEQ ID NO: 515222 - DNA, 25 bp, Mus musculus
acagacactgtgcagaccttcgtca

SEQ ID NO: 515223 - DNA, 25 bp, Mus musculus
acagacactgtggagaccttcgtca

SEQ ID NO: 515224 - DNA, 25 bp, Mus musculus
acagacagcaggcatagctgccgca

SEQ ID NO: 515225 - DNA, 25 bp, Mus musculus
acagacagcagggatagctgccgca

SEQ ID NO: 515226 - DNA, 25 bp, Mus musculus
acagacaggcccacaggctgaggaa

SEQ ID NO: 515227 - DNA, 25 bp, Mus musculus
acagacaggccctcaggctgaggaa

SEQ ID NO: 515228 - DNA, 25 bp, Mus musculus
acagacaggtagacggcaccacgtt

SEQ ID NO: 515229 - DNA, 25 bp, Mus musculus
acagacaggtagtcggcaccacgtt

SEQ ID NO: 515230 - DNA, 25 bp, Mus musculus
acagacatcaagaacctgtttttcc

SEQ ID NO: 515231 - DNA, 25 bp, Mus musculus
acagacatcaagtacctgtttttcc

SEQ ID NO: 515232 - DNA, 25 bp, Mus musculus
acagacatcatgctgcacctgactg

SEQ ID NO: 515233 - DNA, 25 bp, Mus musculus
acagacatcatggtgcacctgactg

SEQ ID NO: 515234 - DNA, 25 bp, Mus musculus
acagacatcgccatccaggcagagg

SEQ ID NO: 515235 - DNA, 25 bp, Mus musculus
acagacatcgccttccaggcagagg

SEQ ID NO: 515236 - DNA, 25 bp, Mus musculus
acagacatgacaagacggcagctgg

SEQ ID NO: 515237 - DNA, 25 bp, Mus musculus
acagacatgacatgacggcagctgg

SEQ ID NO: 515238 - DNA, 25 bp, Mus musculus
acagacatgcagagcacctcggaga

SEQ ID NO: 515239 - DNA, 25 bp, Mus musculus
acagacatgcagtgcacctcggaga

SEQ ID NO: 515240 - DNA, 25 bp, Mus musculus
acagacattaacagaactgtcagtg

SEQ ID NO: 515241 - DNA, 25 bp, Mus musculus
acagacattaactgaactgtcagtg

SEQ ID NO: 515242 - DNA, 25 bp, Mus musculus
acagaccaacgacggcatgctctct

SEQ ID NO: 515243 - DNA, 25 bp, Mus musculus
acagaccaacgagggcatgctctct

SEQ ID NO: 515244 - DNA, 25 bp, Mus musculus
acagaccaagcactaggatttggcc

SEQ ID NO: 515245 - DNA, 25 bp, Mus musculus
acagaccaagcagtaggatttggcc

SEQ ID NO: 515246 - DNA, 25 bp, Mus musculus
acagaccaggaaaactattttggac

SEQ ID NO: 515247 - DNA, 25 bp, Mus musculus
acagaccaggaatactattttggac

SEQ ID NO: 515248 - DNA, 25 bp, Mus musculus
acagaccatcaaattgagtattggg

SEQ ID NO: 515249 - DNA, 25 bp, Mus musculus
acagaccatcaatttgagtattggg

SEQ ID NO: 515250 - DNA, 25 bp, Mus musculus
acagaccccaagctggtggcccagg

SEQ ID NO: 515251 - DNA, 25 bp, Mus musculus
acagaccccaaggtggtggcccagg

SEQ ID NO: 515252 - DNA, 25 bp, Mus musculus
acagacccggctccctctacttctg

SEQ ID NO: 515253 - DNA, 25 bp, Mus musculus
acagacccggctgcctctacttctg

SEQ ID NO: 515254 - DNA, 25 bp, Mus musculus
acagacccgtgtccgggaggacact

SEQ ID NO: 515255 - DNA, 25 bp, Mus musculus
acagacccgtgtgcgggaggacact

SEQ ID NO: 515256 - DNA, 25 bp, Mus musculus
acagacctgactatgtgaacatcca

SEQ ID NO: 515257 - DNA, 25 bp, Mus musculus
acagacctgactttgtgaacatcca

SEQ ID NO: 515258 - DNA, 25 bp, Mus musculus
acagacctgagacggaccctgcagg

SEQ ID NO: 515259 - DNA, 25 bp, Mus musculus
acagacctgagagggaccctgcagg

SEQ ID NO: 515260 - DNA, 25 bp, Mus musculus
acagacctgggaaacacagtgctcc

SEQ ID NO: 515261 - DNA, 25 bp, Mus musculus
acagacctgggatacacagtgctcc

SEQ ID NO: 515262 - DNA, 25 bp, Mus musculus
acagacggtggccacggaaatccgt

SEQ ID NO: 515263 - DNA, 25 bp, Mus musculus
acagacggtggcgacggaaatccgt

SEQ ID NO: 515264 - DNA, 25 bp, Mus musculus
acagactacatgcagcaggtgtccc

SEQ ID NO: 515265 - DNA, 25 bp, Mus musculus
acagactacatggagcaggtgtccc

SEQ ID NO: 515266 - DNA, 25 bp, Mus musculus
acagactacccacgaggtggccagt

SEQ ID NO: 515267 - DNA, 25 bp, Mus musculus
acagactacccaggaggtggccagt

SEQ ID NO: 515268 - DNA, 25 bp, Mus musculus
acagactctgcaatctgtcccagag

SEQ ID NO: 515269 - DNA, 25 bp, Mus musculus
acagactctgcattctgtcccagag

SEQ ID NO: 515270 - DNA, 25 bp, Mus musculus
acagactctgccctttaacgagccg

SEQ ID NO: 515271 - DNA, 25 bp, Mus musculus
acagactctgccgtttaacgagccg

SEQ ID NO: 515272 - DNA, 25 bp, Mus musculus
acagactgaggcatctagcagacag

SEQ ID NO: 515273 - DNA, 25 bp, Mus musculus
acagactgaggcttctagcagacag

SEQ ID NO: 515274 - DNA, 25 bp, Mus musculus
acagactgctgcctcaagacctact

SEQ ID NO: 515275 - DNA, 25 bp, Mus musculus
acagactgctgcgtcaagacctact

SEQ ID NO: 515276 - DNA, 25 bp, Mus musculus
acagactgctgtcgtgcagagagat

SEQ ID NO: 515277 - DNA, 25 bp, Mus musculus
acagactgctgtggtgcagagagat

SEQ ID NO: 515278 - DNA, 25 bp, Mus musculus
acagactggaagcttcggctcccgg

SEQ ID NO: 515279 - DNA, 25 bp, Mus musculus
acagactggaaggttcggctcccgg

SEQ ID NO: 515280 - DNA, 25 bp, Mus musculus
acagacttccccaactggcatactg

SEQ ID NO: 515281 - DNA, 25 bp, Mus musculus
acagacttcccctactggcatactg

SEQ ID NO: 515282 - DNA, 25 bp, Mus musculus
acagacttggctctgggcttcatcc

SEQ ID NO: 515283 - DNA, 25 bp, Mus musculus
acagacttggctgtgggcttcatcc

SEQ ID NO: 515284 - DNA, 25 bp, Mus musculus
acagagaaaacaccgggctcaagtg

SEQ ID NO: 515285 - DNA, 25 bp, Mus musculus
acagagaaaacagcgggctcaagtg

SEQ ID NO: 515286 - DNA, 25 bp, Mus musculus
acagagaaagcacagtggatcacct

SEQ ID NO: 515287 - DNA, 25 bp, Mus musculus
acagagaaagcagagtggatcacct

SEQ ID NO: 515288 - DNA, 25 bp, Mus musculus
acagagaaccagcatcacacaacgg

SEQ ID NO: 515289 - DNA, 25 bp, Mus musculus
acagagaaccaggatcacacaacgg

SEQ ID NO: 515290 - DNA, 25 bp, Mus musculus
acagagaacctcagactccatcttt

SEQ ID NO: 515291 - DNA, 25 bp, Mus musculus
acagagaacctctgactccatcttt

SEQ ID NO: 515292 - DNA, 25 bp, Mus musculus
acagagaactgcctgtccaagtctc

SEQ ID NO: 515293 - DNA, 25 bp, Mus musculus
acagagaactgcgtgtccaagtctc

SEQ ID NO: 515294 - DNA, 25 bp, Mus musculus
acagagaagaggcaatggtcttcgt

SEQ ID NO: 515295 - DNA, 25 bp, Mus musculus
acagagaagagggaatggtcttcgt

SEQ ID NO: 515296 - DNA, 25 bp, Mus musculus
acagagaagagtcggtcagcctggc

SEQ ID NO: 515297 - DNA, 25 bp, Mus musculus
acagagaagagtgggtcagcctggc

SEQ ID NO: 515298 - DNA, 25 bp, Mus musculus
acagagaatatcaatacttcttggg

SEQ ID NO: 515299 - DNA, 25 bp, Mus musculus
acagagaatatctatacttcttggg

SEQ ID NO: 515300 - DNA, 25 bp, Mus musculus
acagagaatggcaggtcccctcctc

SEQ ID NO: 515301 - DNA, 25 bp, Mus musculus
acagagaatggctggtcccctcctc

SEQ ID NO: 515302 - DNA, 25 bp, Mus musculus
acagagacgacccactctgcagtct

SEQ ID NO: 515303 - DNA, 25 bp, Mus musculus
acagagacgaccgactctgcagtct

SEQ ID NO: 515304 - DNA, 25 bp, Mus musculus
acagagacgctgctctatggcacct

SEQ ID NO: 515305 - DNA, 25 bp, Mus musculus
acagagacgctggtctatggcacct

SEQ ID NO: 515306 - DNA, 25 bp, Mus musculus
acagagactggaacagaccagctca

SEQ ID NO: 515307 - DNA, 25 bp, Mus musculus
acagagactggatcagaccagctca

SEQ ID NO: 515308 - DNA, 25 bp, Mus musculus
acagagactggcctcgtcagcccgg

SEQ ID NO: 515309 - DNA, 25 bp, Mus musculus
acagagactggcgtcgtcagcccgg

SEQ ID NO: 515310 - DNA, 25 bp, Mus musculus
acagagagaggtacccatgaggagc

SEQ ID NO: 515311 - DNA, 25 bp, Mus musculus
acagagagaggttcccatgaggagc

SEQ ID NO: 515312 - DNA, 25 bp, Mus musculus
acagagagcagcctgaacctgggtc

SEQ ID NO: 515313 - DNA, 25 bp, Mus musculus
acagagagcagcgtgaacctgggtc

SEQ ID NO: 515314 - DNA, 25 bp, Mus musculus
acagagaggcatcaccatacctggc

SEQ ID NO: 515315 - DNA, 25 bp, Mus musculus
acagagaggcatgaccatacctggc

SEQ ID NO: 515316 - DNA, 25 bp, Mus musculus
acagagaggtagatattggaatacc

SEQ ID NO: 515317 - DNA, 25 bp, Mus musculus
acagagaggtagttattggaatacc

SEQ ID NO: 515318 - DNA, 25 bp, Mus musculus
acagagagtgaccttatgagagccc

SEQ ID NO: 515319 - DNA, 25 bp, Mus musculus
acagagagtgacgttatgagagccc

SEQ ID NO: 515320 - DNA, 25 bp, Mus musculus
acagagatgggcctcagcacccaga

SEQ ID NO: 515321 - DNA, 25 bp, Mus musculus
acagagatgggcgtcagcacccaga

SEQ ID NO: 515322 - DNA, 25 bp, Mus musculus
acagagatggtccagtggcacagct

SEQ ID NO: 515323 - DNA, 25 bp, Mus musculus
acagagatggtcgagtggcacagct

SEQ ID NO: 515324 - DNA, 25 bp, Mus musculus
acagagattgtgagccgagtgtcaa

SEQ ID NO: 515325 - DNA, 25 bp, Mus musculus
acagagattgtgtgccgagtgtcaa

SEQ ID NO: 515326 - DNA, 25 bp, Mus musculus
acagagcaactccagcgttaccgct

SEQ ID NO: 515327 - DNA, 25 bp, Mus musculus
acagagcaactcgagcgttaccgct

SEQ ID NO: 515328 - DNA, 25 bp, Mus musculus
acagagcagagcattcacagaggac

SEQ ID NO: 515329 - DNA, 25 bp, Mus musculus
acagagcagagctttcacagaggac

SEQ ID NO: 515330 - DNA, 25 bp, Mus musculus
acagagcatcctcggtggccagcct

SEQ ID NO: 515331 - DNA, 25 bp, Mus musculus
acagagcatcctgggtggccagcct

SEQ ID NO: 515332 - DNA, 25 bp, Mus musculus
acagagccaagcagcgcagtcagac

SEQ ID NO: 515333 - DNA, 25 bp, Mus musculus
acagagccaagctgcgcagtcagac

SEQ ID NO: 515334 - DNA, 25 bp, Mus musculus
acagagccagttacggggtgtgccc

SEQ ID NO: 515335 - DNA, 25 bp, Mus musculus
acagagccagttcgagtggtttgcc

SEQ ID NO: 515336 - DNA, 25 bp, Mus musculus
acagagccagttggagtggtttgcc

SEQ ID NO: 515337 - DNA, 25 bp, Mus musculus
acagagccagtttcggggtgtgccc

SEQ ID NO: 515338 - DNA, 25 bp, Mus musculus
acagagccctctctggtggagcgac

SEQ ID NO: 515339 - DNA, 25 bp, Mus musculus
acagagccctctgtggtggagcgac

SEQ ID NO: 515340 - DNA, 25 bp, Mus musculus
acagagccggaaacatgcagggtca

SEQ ID NO: 515341 - DNA, 25 bp, Mus musculus
acagagccggaatcatgcagggtca

SEQ ID NO: 515342 - DNA, 25 bp, Mus musculus
acagagcctcgacgaattgggcacc

SEQ ID NO: 515343 - DNA, 25 bp, Mus musculus
acagagcctcgaggaattgggcacc

SEQ ID NO: 515344 - DNA, 25 bp, Mus musculus
acagagcctcggacgcgaagaacgc

SEQ ID NO: 515345 - DNA, 25 bp, Mus musculus
acagagcctcggtcgcgaagaacgc

SEQ ID NO: 515346 - DNA, 25 bp, Mus musculus
acagagctcaggcaggactggctgg

SEQ ID NO: 515347 - DNA, 25 bp, Mus musculus
acagagctcagggaggactggctgg

SEQ ID NO: 515348 - DNA, 25 bp, Mus musculus
acagagctcagtccctttcggccct

SEQ ID NO: 515349 - DNA, 25 bp, Mus musculus
acagagctcagtgcctttcggccct

SEQ ID NO: 515350 - DNA, 25 bp, Mus musculus
acagaggacgagctcaaggagttcc

SEQ ID NO: 515351 - DNA, 25 bp, Mus musculus
acagaggacgaggtcaaggagttcc

SEQ ID NO: 515352 - DNA, 25 bp, Mus musculus
acagaggattctacagcccacatgc

SEQ ID NO: 515353 - DNA, 25 bp, Mus musculus
acagaggattcttcagcccacatgc

SEQ ID NO: 515354 - DNA, 25 bp, Mus musculus
acagaggcagctatgtcaccacacc

SEQ ID NO: 515355 - DNA, 25 bp, Mus musculus
acagaggcagctttgtcaccacacc

SEQ ID NO: 515356 - DNA, 25 bp, Mus musculus
acagaggccctcagctgcagtcctg

SEQ ID NO: 515357 - DNA, 25 bp, Mus musculus
acagaggccctctgctgcagtcctg

SEQ ID NO: 515358 - DNA, 25 bp, Mus musculus
acagaggcgcctccaaaatgggcta

SEQ ID NO: 515359 - DNA, 25 bp, Mus musculus
acagaggcgcctgcaaaatgggcta

SEQ ID NO: 515360 - DNA, 25 bp, Mus musculus
acagaggcggtacctcagctggctc

SEQ ID NO: 515361 - DNA, 25 bp, Mus musculus
acagaggcggtagctcagctggctc

SEQ ID NO: 515362 - DNA, 25 bp, Mus musculus
acagaggctgttccccacagaagct

SEQ ID NO: 515363 - DNA, 25 bp, Mus musculus
acagaggctgttgcccacagaagct

SEQ ID NO: 515364 - DNA, 25 bp, Mus musculus
acagagggaactaaaggaaatagct

SEQ ID NO: 515365 - DNA, 25 bp, Mus musculus
acagagggaacttaaggaaatagct

SEQ ID NO: 515366 - DNA, 25 bp, Mus musculus
acagagggccaactccatgaagttt

SEQ ID NO: 515367 - DNA, 25 bp, Mus musculus
acagagggccaagtccatgaagttt

SEQ ID NO: 515368 - DNA, 25 bp, Mus musculus
acagagggctctcgcgccatcagtg

SEQ ID NO: 515369 - DNA, 25 bp, Mus musculus
acagagggctctggcgccatcagtg

SEQ ID NO: 515370 - DNA, 25 bp, Mus musculus
acagagggctggcatatcgtaccag

SEQ ID NO: 515371 - DNA, 25 bp, Mus musculus
acagagggctgggatatcgtaccag

SEQ ID NO: 515372 - DNA, 25 bp, Mus musculus
acagagggttccaatcgctgccact

SEQ ID NO: 515373 - DNA, 25 bp, Mus musculus
acagagggttcctatcgctgccact

SEQ ID NO: 515374 - DNA, 25 bp, Mus musculus
acagaggtcacaaatggcaccttgg

SEQ ID NO: 515375 - DNA, 25 bp, Mus musculus
acagaggtcacatatggcaccttgg

SEQ ID NO: 515376 - DNA, 25 bp, Mus musculus
acagaggtcatcaggctcacgcagc

SEQ ID NO: 515377 - DNA, 25 bp, Mus musculus
acagaggtcatctggctcacgcagc

SEQ ID NO: 515378 - DNA, 25 bp, Mus musculus
acagaggttcctccgctacttctca

SEQ ID NO: 515379 - DNA, 25 bp, Mus musculus
acagaggttcctgcgctacttctca

SEQ ID NO: 515380 - DNA, 25 bp, Mus musculus
acagagtacaagagccgctgcccac

SEQ ID NO: 515381 - DNA, 25 bp, Mus musculus
acagagtacaagtgccgctgcccac

SEQ ID NO: 515382 - DNA, 25 bp, Mus musculus
acagagtatggaagacttgcaatgg

SEQ ID NO: 515383 - DNA, 25 bp, Mus musculus
acagagtatggatgacttgcaatgg

SEQ ID NO: 515384 - DNA, 25 bp, Mus musculus
acagagtccaggagatgccaaacag

SEQ ID NO: 515385 - DNA, 25 bp, Mus musculus
acagagtccaggtgatgccaaacag

SEQ ID NO: 515386 - DNA, 25 bp, Mus musculus
acagagtctatgctcagtcaccggc

SEQ ID NO: 515387 - DNA, 25 bp, Mus musculus
acagagtctatggtcagtcaccggc

SEQ ID NO: 515388 - DNA, 25 bp, Mus musculus
acagagtctttcactgctattgcag

SEQ ID NO: 515389 - DNA, 25 bp, Mus musculus
acagagtctttctctgctattgcag

SEQ ID NO: 515390 - DNA, 25 bp, Mus musculus
acagagtgacgtaccgtgggcagca

SEQ ID NO: 515391 - DNA, 25 bp, Mus musculus
acagagtgacgttccgtgggcagca

SEQ ID NO: 515392 - DNA, 25 bp, Mus musculus
acagagttttggcacgcctcctcct

SEQ ID NO: 515393 - DNA, 25 bp, Mus musculus
acagagttttgggacgcctcctcct

SEQ ID NO: 515394 - DNA, 25 bp, Mus musculus
acagatagccacagttaaagtgaga

SEQ ID NO: 515395 - DNA, 25 bp, Mus musculus
acagatagccactgttaaagtgaga

SEQ ID NO: 515396 - DNA, 25 bp, Mus musculus
acagatcagtacaactcccggtggc

SEQ ID NO: 515397 - DNA, 25 bp, Mus musculus
acagatcagtactactcccggtggc

SEQ ID NO: 515398 - DNA, 25 bp, Mus musculus
acagatccctccctgatcaagataa

SEQ ID NO: 515399 - DNA, 25 bp, Mus musculus
acagatccctccgtgatcaagataa

SEQ ID NO: 515400 - DNA, 25 bp, Mus musculus
acagatccctctcacaggcttcgtg

SEQ ID NO: 515401 - DNA, 25 bp, Mus musculus
acagatccctctgacaggcttcgtg

SEQ ID NO: 515402 - DNA, 25 bp, Mus musculus
acagatcctggcaacaactgcctgc

SEQ ID NO: 515403 - DNA, 25 bp, Mus musculus
acagatcctggctacaactgcctgc

SEQ ID NO: 515404 - DNA, 25 bp, Mus musculus
acagatcgttaccaccagaggagat

SEQ ID NO: 515405 - DNA, 25 bp, Mus musculus
acagatcgttacgaccagaggagat

SEQ ID NO: 515406 - DNA, 25 bp, Mus musculus
acagatctgatgatcggttatggga

SEQ ID NO: 515407 - DNA, 25 bp, Mus musculus
acagatctgatgttcggttatggga

SEQ ID NO: 515408 - DNA, 25 bp, Mus musculus
acagatcttgtaccaccacttccgg

SEQ ID NO: 515409 - DNA, 25 bp, Mus musculus
acagatcttgtagcaccacttccgg

SEQ ID NO: 515410 - DNA, 25 bp, Mus musculus
acagatgaagtcaatagatgcagga

SEQ ID NO: 515411 - DNA, 25 bp, Mus musculus
acagatgaagtctatagatgcagga

SEQ ID NO: 515412 - DNA, 25 bp, Mus musculus
acagatgaagtgagtgttccctgcc

SEQ ID NO: 515413 - DNA, 25 bp, Mus musculus
acagatgaagtgtgtgttccctgcc

SEQ ID NO: 515414 - DNA, 25 bp, Mus musculus
acagatgaggacacgcacctggtga

SEQ ID NO: 515415 - DNA, 25 bp, Mus musculus
acagatgaggactcgcacctggtga

SEQ ID NO: 515416 - DNA, 25 bp, Mus musculus
acagatgcagtcagtgcgcccgagt

SEQ ID NO: 515417 - DNA, 25 bp, Mus musculus
acagatgcagtctgtgcgcccgagt

SEQ ID NO: 515418 - DNA, 25 bp, Mus musculus
acagatgccatcagcaaaccagagc

SEQ ID NO: 515419 - DNA, 25 bp, Mus musculus
acagatgccatctgcaaaccagagc

SEQ ID NO: 515420 - DNA, 25 bp, Mus musculus
acagatgcggctcttcattcacaac

SEQ ID NO: 515421 - DNA, 25 bp, Mus musculus
acagatgcggctgttcattcacaac

SEQ ID NO: 515422 - DNA, 25 bp, Mus musculus
acagatgctgggaggccgacagtac

SEQ ID NO: 515423 - DNA, 25 bp, Mus musculus
acagatgctgggtggccgacagtac

SEQ ID NO: 515424 - DNA, 25 bp, Mus musculus
acagatggcaaacggaagaccattg

SEQ ID NO: 515425 - DNA, 25 bp, Mus musculus
acagatggcaaagggaagaccattg

SEQ ID NO: 515426 - DNA, 25 bp, Mus musculus
acagatggcagacctttttggaaaa

SEQ ID NO: 515427 - DNA, 25 bp, Mus musculus
acagatggcagacttccggaagcag

SEQ ID NO: 515428 - DNA, 25 bp, Mus musculus
acagatggcagagctttttggaaaa

SEQ ID NO: 515429 - DNA, 25 bp, Mus musculus
acagatggcagagttccggaagcag

SEQ ID NO: 515430 - DNA, 25 bp, Mus musculus
acagatgggcttctttctcttctca

SEQ ID NO: 515431 - DNA, 25 bp, Mus musculus
acagatgggcttgtttctcttctca

SEQ ID NO: 515432 - DNA, 25 bp, Mus musculus
acagatggtcttagctttgtctcag

SEQ ID NO: 515433 - DNA, 25 bp, Mus musculus
acagatggtctttgctttgtctcag

SEQ ID NO: 515434 - DNA, 25 bp, Mus musculus
acagatgtccctaccccaggcaatg

SEQ ID NO: 515435 - DNA, 25 bp, Mus musculus
acagatgtcccttccccaggcaatg

SEQ ID NO: 515436 - DNA, 25 bp, Mus musculus
acagatgtgtgactggccccgaccc

SEQ ID NO: 515437 - DNA, 25 bp, Mus musculus
acagatgtgtgagtggccccgaccc

SEQ ID NO: 515438 - DNA, 25 bp, Mus musculus
acagattatactcggcaaattgagc

SEQ ID NO: 515439 - DNA, 25 bp, Mus musculus
acagattatactgggcaaattgagc

SEQ ID NO: 515440 - DNA, 25 bp, Mus musculus
acagattggagccactacccagcaa

SEQ ID NO: 515441 - DNA, 25 bp, Mus musculus
acagattggagcgactacccagcaa

SEQ ID NO: 515442 - DNA, 25 bp, Mus musculus
acagattgtgatcccacgaggcagc

SEQ ID NO: 515443 - DNA, 25 bp, Mus musculus
acagattgtgatgccacgaggcagc

SEQ ID NO: 515444 - DNA, 25 bp, Mus musculus
acagatttgaccagttttgggccat

SEQ ID NO: 515445 - DNA, 25 bp, Mus musculus
acagatttgacctgttttgggccat

SEQ ID NO: 515446 - DNA, 25 bp, Mus musculus
acagcaaaaatcaaatgactctgcc

SEQ ID NO: 515447 - DNA, 25 bp, Mus musculus
acagcaaaaatctaatgactctgcc

SEQ ID NO: 515448 - DNA, 25 bp, Mus musculus
acagcaaagtgcatcattactattg

SEQ ID NO: 515449 - DNA, 25 bp, Mus musculus
acagcaaagtgcttcattactattg

SEQ ID NO: 515450 - DNA, 25 bp, Mus musculus
acagcaacatgtcgctctgggaagc

SEQ ID NO: 515451 - DNA, 25 bp, Mus musculus
acagcaacatgtggctctgggaagc

SEQ ID NO: 515452 - DNA, 25 bp, Mus musculus
acagcaacctcgaccagctgctggg

SEQ ID NO: 515453 - DNA, 25 bp, Mus musculus
acagcaacctcgtccagctgctggg

SEQ ID NO: 515454 - DNA, 25 bp, Mus musculus
acagcaactcgcctctctttagaag

SEQ ID NO: 515455 - DNA, 25 bp, Mus musculus
acagcaactcgcgtctctttagaag

SEQ ID NO: 515456 - DNA, 25 bp, Mus musculus
acagcaactgaacaatggatttttc

SEQ ID NO: 515457 - DNA, 25 bp, Mus musculus
acagcaactgaagaatggatttttc

SEQ ID NO: 515458 - DNA, 25 bp, Mus musculus
acagcaaggatcctcgctacggagc

SEQ ID NO: 515459 - DNA, 25 bp, Mus musculus
acagcaaggatcgtcgctacggagc

SEQ ID NO: 515460 - DNA, 25 bp, Mus musculus
acagcaaggcccacgggcccatggt

SEQ ID NO: 515461 - DNA, 25 bp, Mus musculus
acagcaaggccctcgggcccatggt

SEQ ID NO: 515462 - DNA, 25 bp, Mus musculus
acagcaatcatacagtgggtgtcct

SEQ ID NO: 515463 - DNA, 25 bp, Mus musculus
acagcaatcatagagtgggtgtcct

SEQ ID NO: 515464 - DNA, 25 bp, Mus musculus
acagcaatcttgcaagtgttgaaga

SEQ ID NO: 515465 - DNA, 25 bp, Mus musculus
acagcaatcttggaagtgttgaaga

SEQ ID NO: 515466 - DNA, 25 bp, Mus musculus
acagcaatggatcttatctaaatga

SEQ ID NO: 515467 - DNA, 25 bp, Mus musculus
acagcaatggatgttatctaaatga

SEQ ID NO: 515468 - DNA, 25 bp, Mus musculus
acagcaatggcccaatgcggtacac

SEQ ID NO: 515469 - DNA, 25 bp, Mus musculus
acagcaatggccgaatgcggtacac

SEQ ID NO: 515470 - DNA, 25 bp, Mus musculus
acagcaattactctctctgcaggac

SEQ ID NO: 515471 - DNA, 25 bp, Mus musculus
acagcaattactgtctctgcaggac

SEQ ID NO: 515472 - DNA, 25 bp, Mus musculus
acagcacaatatcccccagagggag

SEQ ID NO: 515473 - DNA, 25 bp, Mus musculus
acagcacaatatgccccagagggag

SEQ ID NO: 515474 - DNA, 25 bp, Mus musculus
acagcacagcccaatgcaacctggg

SEQ ID NO: 515475 - DNA, 25 bp, Mus musculus
acagcacagccctatgcaacctggg

SEQ ID NO: 515476 - DNA, 25 bp, Mus musculus
acagcacatggaattcagaactacc

SEQ ID NO: 515477 - DNA, 25 bp, Mus musculus
acagcacatggatttcagaactacc

SEQ ID NO: 515478 - DNA, 25 bp, Mus musculus
acagcaccagggagtccagccggtg

SEQ ID NO: 515479 - DNA, 25 bp, Mus musculus
acagcaccagggtgtccagccggtg

SEQ ID NO: 515480 - DNA, 25 bp, Mus musculus
acagcaccatcgctgagaacggctt

SEQ ID NO: 515481 - DNA, 25 bp, Mus musculus
acagcaccatcggtgagaacggctt

SEQ ID NO: 515482 - DNA, 25 bp, Mus musculus
acagcaccggaacctcttaattatg

SEQ ID NO: 515483 - DNA, 25 bp, Mus musculus
acagcaccggaagctcttaattatg

SEQ ID NO: 515484 - DNA, 25 bp, Mus musculus
acagcacgctgacctgcatgcagca

SEQ ID NO: 515485 - DNA, 25 bp, Mus musculus
acagcacgctgagctgcatgcagca

SEQ ID NO: 515486 - DNA, 25 bp, Mus musculus
acagcactcactactgttcccagga

SEQ ID NO: 515487 - DNA, 25 bp, Mus musculus
acagcactcacttctgttcccagga

SEQ ID NO: 515488 - DNA, 25 bp, Mus musculus
acagcactcgtgaactttcttcagc

SEQ ID NO: 515489 - DNA, 25 bp, Mus musculus
acagcactcgtgtactttcttcagc

SEQ ID NO: 515490 - DNA, 25 bp, Mus musculus
acagcactgtatccctggtagatgc

SEQ ID NO: 515491 - DNA, 25 bp, Mus musculus
acagcactgtatgcctggtagatgc

SEQ ID NO: 515492 - DNA, 25 bp, Mus musculus
acagcacttgagcagataaagaaat

SEQ ID NO: 515493 - DNA, 25 bp, Mus musculus
acagcacttgaggagataaagaaat

SEQ ID NO: 515494 - DNA, 25 bp, Mus musculus
acagcagaaactcgctggtgtcact

SEQ ID NO: 515495 - DNA, 25 bp, Mus musculus
acagcagaaactggctggtgtcact

SEQ ID NO: 515496 - DNA, 25 bp, Mus musculus
acagcagacagtatgcaagtcatgt

SEQ ID NO: 515497 - DNA, 25 bp, Mus musculus
acagcagacagtttgcaagtcatgt

SEQ ID NO: 515498 - DNA, 25 bp, Mus musculus
acagcagacccacgcacaagtggag

SEQ ID NO: 515499 - DNA, 25 bp, Mus musculus
acagcagacccaggcacaagtggag

SEQ ID NO: 515500 - DNA, 25 bp, Mus musculus
acagcagactaccaccttcacggga

SEQ ID NO: 515501 - DNA, 25 bp, Mus musculus
acagcagactacgaccttcacggga

SEQ ID NO: 515502 - DNA, 25 bp, Mus musculus
acagcagagtggctccaacagcaaa

SEQ ID NO: 515503 - DNA, 25 bp, Mus musculus
acagcagagtgggtccaacagcaaa

SEQ ID NO: 515504 - DNA, 25 bp, Mus musculus
acagcagatcatccctgtggcaaaa

SEQ ID NO: 515505 - DNA, 25 bp, Mus musculus
acagcagatcatgcctgtggcaaaa

SEQ ID NO: 515506 - DNA, 25 bp, Mus musculus
acagcagcattccttctgattgaag

SEQ ID NO: 515507 - DNA, 25 bp, Mus musculus
acagcagcattcgttctgattgaag

SEQ ID NO: 515508 - DNA, 25 bp, Mus musculus
acagcagccacaacaagagacccat

SEQ ID NO: 515509 - DNA, 25 bp, Mus musculus
acagcagccacatcaagagacccat

SEQ ID NO: 515510 - DNA, 25 bp, Mus musculus
acagcagccatcctgcctctcatgg

SEQ ID NO: 515511 - DNA, 25 bp, Mus musculus
acagcagccatcgtgcctctcatgg

SEQ ID NO: 515512 - DNA, 25 bp, Mus musculus
acagcagccggacagccaagagtgt

SEQ ID NO: 515513 - DNA, 25 bp, Mus musculus
acagcagccggagagccaagagtgt

SEQ ID NO: 515514 - DNA, 25 bp, Mus musculus
acagcagcgctcacggatgctggct

SEQ ID NO: 515515 - DNA, 25 bp, Mus musculus
acagcagcgctctcggatgctggct

SEQ ID NO: 515516 - DNA, 25 bp, Mus musculus
acagcagcgggcactgccgctgtga

SEQ ID NO: 515517 - DNA, 25 bp, Mus musculus
acagcagcgggctctgccgctgtga

SEQ ID NO: 515518 - DNA, 25 bp, Mus musculus
acagcagctaccagaacccagtcag

SEQ ID NO: 515519 - DNA, 25 bp, Mus musculus
acagcagctacctgaacccagtcag

SEQ ID NO: 515520 - DNA, 25 bp, Mus musculus
acagcagctgaactcatggctggca

SEQ ID NO: 515521 - DNA, 25 bp, Mus musculus
acagcagctgaagtcatggctggca

SEQ ID NO: 515522 - DNA, 25 bp, Mus musculus
acagcaggagatccggaccctagag

SEQ ID NO: 515523 - DNA, 25 bp, Mus musculus
acagcaggagatgcggaccctagag

SEQ ID NO: 515524 - DNA, 25 bp, Mus musculus
acagcaggaggcaggcagcacacac

SEQ ID NO: 515525 - DNA, 25 bp, Mus musculus
acagcaggaggctggcagcacacac

SEQ ID NO: 515526 - DNA, 25 bp, Mus musculus
acagcaggagttaggcgcgatgctt

SEQ ID NO: 515527 - DNA, 25 bp, Mus musculus
acagcaggagtttggcgcgatgctt

SEQ ID NO: 515528 - DNA, 25 bp, Mus musculus
acagcaggtccaagtgattgagatg

SEQ ID NO: 515529 - DNA, 25 bp, Mus musculus
acagcaggtccatgtgattgagatg

SEQ ID NO: 515530 - DNA, 25 bp, Mus musculus
acagcaggttcccagcgctacgaag

SEQ ID NO: 515531 - DNA, 25 bp, Mus musculus
acagcaggttccgagcgctacgaag

SEQ ID NO: 515532 - DNA, 25 bp, Mus musculus
acagcagtacgcatctcaggcacaa

SEQ ID NO: 515533 - DNA, 25 bp, Mus musculus
acagcagtacgcttctcaggcacaa

SEQ ID NO: 515534 - DNA, 25 bp, Mus musculus
acagcagtgtttctcctggccacac

SEQ ID NO: 515535 - DNA, 25 bp, Mus musculus
acagcagtgtttgtcctggccacac

SEQ ID NO: 515536 - DNA, 25 bp, Mus musculus
acagcagttacaccactcagggcta

SEQ ID NO: 515537 - DNA, 25 bp, Mus musculus
acagcagttacagcactcagggcta

SEQ ID NO: 515538 - DNA, 25 bp, Mus musculus
acagcataaaggctctaagagatca

SEQ ID NO: 515539 - DNA, 25 bp, Mus musculus
acagcataaagggtctaagagatca

SEQ ID NO: 515540 - DNA, 25 bp, Mus musculus
acagcatagaggctgtgggcgccca

SEQ ID NO: 515541 - DNA, 25 bp, Mus musculus
acagcatagagggtgtgggcgccca

SEQ ID NO: 515542 - DNA, 25 bp, Mus musculus
acagcatccgccaggaggacggctt

SEQ ID NO: 515543 - DNA, 25 bp, Mus musculus
acagcatccgcctggaggacggctt

SEQ ID NO: 515544 - DNA, 25 bp, Mus musculus
acagcatctcccaccctgaagagta

SEQ ID NO: 515545 - DNA, 25 bp, Mus musculus
acagcatctccctccctgaagagta

SEQ ID NO: 515546 - DNA, 25 bp, Mus musculus
acagcatgagtgaccctggagtaag

SEQ ID NO: 515547 - DNA, 25 bp, Mus musculus
acagcatgagtgtccctggagtaag

SEQ ID NO: 515548 - DNA, 25 bp, Mus musculus
acagcatggagtccctctttcctgc

SEQ ID NO: 515549 - DNA, 25 bp, Mus musculus
acagcatggagtgcctctttcctgc

SEQ ID NO: 515550 - DNA, 25 bp, Mus musculus
acagcatgtggacacgttcttccag

SEQ ID NO: 515551 - DNA, 25 bp, Mus musculus
acagcatgtggagacgttcttccag

SEQ ID NO: 515552 - DNA, 25 bp, Mus musculus
acagcatttcagaggaggttgtatc

SEQ ID NO: 515553 - DNA, 25 bp, Mus musculus
acagcatttcagtggaggttgtatc

SEQ ID NO: 515554 - DNA, 25 bp, Mus musculus
acagccaaggctactgtgcccagta

SEQ ID NO: 515555 - DNA, 25 bp, Mus musculus
acagccaaggcttctgtgcccagta

SEQ ID NO: 515556 - DNA, 25 bp, Mus musculus
acagccacaacaacaggagcaggag

SEQ ID NO: 515557 - DNA, 25 bp, Mus musculus
acagccacaacatcaggagcaggag

SEQ ID NO: 515558 - DNA, 25 bp, Mus musculus
acagccacacatccagtggctgaag

SEQ ID NO: 515559 - DNA, 25 bp, Mus musculus
acagccacacatgcagtggctgaag

SEQ ID NO: 515560 - DNA, 25 bp, Mus musculus
acagccacatacaggaatccgagtc

SEQ ID NO: 515561 - DNA, 25 bp, Mus musculus
acagccacatactggaatccgagtc

SEQ ID NO: 515562 - DNA, 25 bp, Mus musculus
acagccaccataaactgactatgtg

SEQ ID NO: 515563 - DNA, 25 bp, Mus musculus
acagccaccatatactgactatgtg

SEQ ID NO: 515564 - DNA, 25 bp, Mus musculus
acagccacctttcacaaacacggag

SEQ ID NO: 515565 - DNA, 25 bp, Mus musculus
acagccacctttgacaaacacggag

SEQ ID NO: 515566 - DNA, 25 bp, Mus musculus
acagccacgacaaaactatgagtgg

SEQ ID NO: 515567 - DNA, 25 bp, Mus musculus
acagccacgacataactatgagtgg

SEQ ID NO: 515568 - DNA, 25 bp, Mus musculus
acagccactgggagggccggagcct

SEQ ID NO: 515569 - DNA, 25 bp, Mus musculus
acagccactgggtgggccggagcct

SEQ ID NO: 515570 - DNA, 25 bp, Mus musculus
acagccagccaccagtcttcaaggt

SEQ ID NO: 515571 - DNA, 25 bp, Mus musculus
acagccagccacgagtcttcaaggt

SEQ ID NO: 515572 - DNA, 25 bp, Mus musculus
acagccagccgtagcactttccatg

SEQ ID NO: 515573 - DNA, 25 bp, Mus musculus
acagccagccgttgcactttccatg

SEQ ID NO: 515574 - DNA, 25 bp, Mus musculus
acagccagccttctcgactatgaca

SEQ ID NO: 515575 - DNA, 25 bp, Mus musculus
acagccagccttgtcgactatgaca

SEQ ID NO: 515576 - DNA, 25 bp, Mus musculus
acagccagtggtcgaagactctgag

SEQ ID NO: 515577 - DNA, 25 bp, Mus musculus
acagccagtggtggaagactctgag

SEQ ID NO: 515578 - DNA, 25 bp, Mus musculus
acagccatgaataccgggtgtgcca

SEQ ID NO: 515579 - DNA, 25 bp, Mus musculus
acagccatgaattccgggtgtgcca

SEQ ID NO: 515580 - DNA, 25 bp, Mus musculus
acagccatggttaccttcagccacg

SEQ ID NO: 515581 - DNA, 25 bp, Mus musculus
acagccatggtttccttcagccacg

SEQ ID NO: 515582 - DNA, 25 bp, Mus musculus
acagccatgttgcagcagtctctgg

SEQ ID NO: 515583 - DNA, 25 bp, Mus musculus
acagccatgttggagcagtctctgg

SEQ ID NO: 515584 - DNA, 25 bp, Mus musculus
acagcccaagcaacaaaagaagata

SEQ ID NO: 515585 - DNA, 25 bp, Mus musculus
acagcccaagcatcaaaagaagata

SEQ ID NO: 515586 - DNA, 25 bp, Mus musculus
acagcccaggcgaaaccaggagaga

SEQ ID NO: 515587 - DNA, 25 bp, Mus musculus
acagcccaggcgtaaccaggagaga

SEQ ID NO: 515588 - DNA, 25 bp, Mus musculus
acagccccaggtaagcagctcacgt

SEQ ID NO: 515589 - DNA, 25 bp, Mus musculus
acagccccaggttagcagctcacgt

SEQ ID NO: 515590 - DNA, 25 bp, Mus musculus
acagccccagttcggagtgtggact

SEQ ID NO: 515591 - DNA, 25 bp, Mus musculus
acagccccagttgggagtgtggact

SEQ ID NO: 515592 - DNA, 25 bp, Mus musculus
acagccctcatacacacggaagcat

SEQ ID NO: 515593 - DNA, 25 bp, Mus musculus
acagccctcatagacacggaagcat

SEQ ID NO: 515594 - DNA, 25 bp, Mus musculus
acagccctcatcaatggccatttga

SEQ ID NO: 515595 - DNA, 25 bp, Mus musculus
acagccctcatctatggccatttga

SEQ ID NO: 515596 - DNA, 25 bp, Mus musculus
acagccctgggacagatggatctcc

SEQ ID NO: 515597 - DNA, 25 bp, Mus musculus
acagccctgggagagatggatctcc

SEQ ID NO: 515598 - DNA, 25 bp, Mus musculus
acagccctgtctcggtcctgagatc

SEQ ID NO: 515599 - DNA, 25 bp, Mus musculus
acagccctgtctgggtcctgagatc

SEQ ID NO: 515600 - DNA, 25 bp, Mus musculus
acagccctttgcatgtgggacagca

SEQ ID NO: 515601 - DNA, 25 bp, Mus musculus
acagccctttgcttgtgggacagca

SEQ ID NO: 515602 - DNA, 25 bp, Mus musculus
acagccgatgcactgtactaaggaa

SEQ ID NO: 515603 - DNA, 25 bp, Mus musculus
acagccgatgcagtgtactaaggaa

SEQ ID NO: 515604 - DNA, 25 bp, Mus musculus
acagccgcagggagctaggccactg

SEQ ID NO: 515605 - DNA, 25 bp, Mus musculus
acagccgcagggtgctaggccactg

SEQ ID NO: 515606 - DNA, 25 bp, Mus musculus
acagccgcgatcagcacggcgtggc

SEQ ID NO: 515607 - DNA, 25 bp, Mus musculus
acagccgcgatctgcacggcgtggc

SEQ ID NO: 515608 - DNA, 25 bp, Mus musculus
acagccgctcagagcatgagcgcca

SEQ ID NO: 515609 - DNA, 25 bp, Mus musculus
acagccgctcagtgcatgagcgcca

SEQ ID NO: 515610 - DNA, 25 bp, Mus musculus
acagccgctctgcaagtctaatacc

SEQ ID NO: 515611 - DNA, 25 bp, Mus musculus
acagccgctctggaagtctaatacc

SEQ ID NO: 515612 - DNA, 25 bp, Mus musculus
acagccggagccactgcgggagcct

SEQ ID NO: 515613 - DNA, 25 bp, Mus musculus
acagccggagcctctgcgggagcct

SEQ ID NO: 515614 - DNA, 25 bp, Mus musculus
acagccggaggtcacccgtctggct

SEQ ID NO: 515615 - DNA, 25 bp, Mus musculus
acagccggaggtgacccgtctggct

SEQ ID NO: 515616 - DNA, 25 bp, Mus musculus
acagccggccagcaggtcgtgtcca

SEQ ID NO: 515617 - DNA, 25 bp, Mus musculus
acagccggccaggaggtcgtgtcca

SEQ ID NO: 515618 - DNA, 25 bp, Mus musculus
acagccgtaaagcacgaacaggagt

SEQ ID NO: 515619 - DNA, 25 bp, Mus musculus
acagccgtaaaggacgaacaggagt

SEQ ID NO: 515620 - DNA, 25 bp, Mus musculus
acagccgtgcagaggaccaaggcag

SEQ ID NO: 515621 - DNA, 25 bp, Mus musculus
acagccgtgcagtggaccaaggcag

SEQ ID NO: 515622 - DNA, 25 bp, Mus musculus
acagcctaaggcacctgattgaaca

SEQ ID NO: 515623 - DNA, 25 bp, Mus musculus
acagcctaaggctcctgattgaaca

SEQ ID NO: 515624 - DNA, 25 bp, Mus musculus
acagcctcaaacctcagagactcag

SEQ ID NO: 515625 - DNA, 25 bp, Mus musculus
acagcctcaaacgtcagagactcag

SEQ ID NO: 515626 - DNA, 25 bp, Mus musculus
acagcctcaggcatcgggacctggc

SEQ ID NO: 515627 - DNA, 25 bp, Mus musculus
acagcctcaggcttcgggacctggc

SEQ ID NO: 515628 - DNA, 25 bp, Mus musculus
acagcctctacaccactttgagtga

SEQ ID NO: 515629 - DNA, 25 bp, Mus musculus
acagcctctacagcactttgagtga

SEQ ID NO: 515630 - DNA, 25 bp, Mus musculus
acagcctgagctatgaggacttcct

SEQ ID NO: 515631 - DNA, 25 bp, Mus musculus
acagcctgagctttgaggacttcct

SEQ ID NO: 515632 - DNA, 25 bp, Mus musculus
acagcctgccccaggcagtgaggaa

SEQ ID NO: 515633 - DNA, 25 bp, Mus musculus
acagcctgcccctggcagtgaggaa

SEQ ID NO: 515634 - DNA, 25 bp, Mus musculus
acagcctggaacagcgtggagtcct

SEQ ID NO: 515635 - DNA, 25 bp, Mus musculus
acagcctggaactgcgtggagtcct

SEQ ID NO: 515636 - DNA, 25 bp, Mus musculus
acagcctggccaacgggctgcggca

SEQ ID NO: 515637 - DNA, 25 bp, Mus musculus
acagcctggccatcgggctgcggca

SEQ ID NO: 515638 - DNA, 25 bp, Mus musculus
acagcctgtcatccctttgtctatg

SEQ ID NO: 515639 - DNA, 25 bp, Mus musculus
acagcctgtcatgcctttgtctatg

SEQ ID NO: 515640 - DNA, 25 bp, Mus musculus
acagcctgtgagaaattctccaaca

SEQ ID NO: 515641 - DNA, 25 bp, Mus musculus
acagcctgtgagtaattctccaaca

SEQ ID NO: 515642 - DNA, 25 bp, Mus musculus
acagccttaattaccccaggtcctg

SEQ ID NO: 515643 - DNA, 25 bp, Mus musculus
acagccttaatttccccaggtcctg

SEQ ID NO: 515644 - DNA, 25 bp, Mus musculus
acagccttcacgatcaccttgttaa

SEQ ID NO: 515645 - DNA, 25 bp, Mus musculus
acagccttcacgttcaccttgttaa

SEQ ID NO: 515646 - DNA, 25 bp, Mus musculus
acagccttctcaatctagatcatca

SEQ ID NO: 515647 - DNA, 25 bp, Mus musculus
acagccttctcattctagatcatca

SEQ ID NO: 515648 - DNA, 25 bp, Mus musculus
acagccttgcctcagtgatgcagag

SEQ ID NO: 515649 - DNA, 25 bp, Mus musculus
acagccttgcctgagtgatgcagag

SEQ ID NO: 515650 - DNA, 25 bp, Mus musculus
acagccttgtccacattgtccaaag

SEQ ID NO: 515651 - DNA, 25 bp, Mus musculus
acagccttgtcctcattgtccaaag

SEQ ID NO: 515652 - DNA, 25 bp, Mus musculus
acagccttgtttaatcatgtcttca

SEQ ID NO: 515653 - DNA, 25 bp, Mus musculus
acagccttgttttatcatgtcttca

SEQ ID NO: 515654 - DNA, 25 bp, Mus musculus
acagcgaagggcctgacttgcgaca

SEQ ID NO: 515655 - DNA, 25 bp, Mus musculus
acagcgaagggcgtgacttgcgaca

SEQ ID NO: 515656 - DNA, 25 bp, Mus musculus
acagcgagaagcagaacagcaggcc

SEQ ID NO: 515657 - DNA, 25 bp, Mus musculus
acagcgagaagctgaacagcaggcc

SEQ ID NO: 515658 - DNA, 25 bp, Mus musculus
acagcgagattccagaagctccgcg

SEQ ID NO: 515659 - DNA, 25 bp, Mus musculus
acagcgagattcgagaagctccgcg

SEQ ID NO: 515660 - DNA, 25 bp, Mus musculus
acagcgaggaggcacgccttcagcc

SEQ ID NO: 515661 - DNA, 25 bp, Mus musculus
acagcgaggagggacgccttcagcc

SEQ ID NO: 515662 - DNA, 25 bp, Mus musculus
acagcgatcgtcatcctctctccag

SEQ ID NO: 515663 - DNA, 25 bp, Mus musculus
acagcgatcgtcttcctctctccag

SEQ ID NO: 515664 - DNA, 25 bp, Mus musculus
acagcgcagtccagcttagatgatc

SEQ ID NO: 515665 - DNA, 25 bp, Mus musculus
acagcgcagtcctgcttagatgatc

SEQ ID NO: 515666 - DNA, 25 bp, Mus musculus
acagcgcctgaacccttgagagaga

SEQ ID NO: 515667 - DNA, 25 bp, Mus musculus
acagcgcctgaagccttgagagaga

SEQ ID NO: 515668 - DNA, 25 bp, Mus musculus
acagcgcctggccaccgtggtgaat

SEQ ID NO: 515669 - DNA, 25 bp, Mus musculus
acagcgcctggcgaccgtggtgaat

SEQ ID NO: 515670 - DNA, 25 bp, Mus musculus
acagcgctaacaaagttcttacctc

SEQ ID NO: 515671 - DNA, 25 bp, Mus musculus
acagcgctaacatagttcttacctc

SEQ ID NO: 515672 - DNA, 25 bp, Mus musculus
acagcgctgcttagtacacacccat

SEQ ID NO: 515673 - DNA, 25 bp, Mus musculus
acagcgctgctttgtacacacccat

SEQ ID NO: 515674 - DNA, 25 bp, Mus musculus
acagcgcttttcacatttacaatgc

SEQ ID NO: 515675 - DNA, 25 bp, Mus musculus
acagcgcttttctcatttacaatgc

SEQ ID NO: 515676 - DNA, 25 bp, Mus musculus
acagcggaacctcggactgaccgcg

SEQ ID NO: 515677 - DNA, 25 bp, Mus musculus
acagcggaacctgggactgaccgcg

SEQ ID NO: 515678 - DNA, 25 bp, Mus musculus
acagcggaaggaacgccccgctgca

SEQ ID NO: 515679 - DNA, 25 bp, Mus musculus
acagcggaaggatcgccccgctgca

SEQ ID NO: 515680 - DNA, 25 bp, Mus musculus
acagcggaccagacttctgcgacta

SEQ ID NO: 515681 - DNA, 25 bp, Mus musculus
acagcggaccagtcttctgcgacta

SEQ ID NO: 515682 - DNA, 25 bp, Mus musculus
acagcggccctcctataagcaaaag

SEQ ID NO: 515683 - DNA, 25 bp, Mus musculus
acagcggccctcgtataagcaaaag

SEQ ID NO: 515684 - DNA, 25 bp, Mus musculus
acagcggcggcaagaggatgaacaa

SEQ ID NO: 515685 - DNA, 25 bp, Mus musculus
acagcggcggcatgaggatgaacaa

SEQ ID NO: 515686 - DNA, 25 bp, Mus musculus
acagcggcgggcagagaaagcatct

SEQ ID NO: 515687 - DNA, 25 bp, Mus musculus
acagcggcgggctgagaaagcatct

SEQ ID NO: 515688 - DNA, 25 bp, Mus musculus
acagcggctcttagaggagttccgg

SEQ ID NO: 515689 - DNA, 25 bp, Mus musculus
acagcggctctttgaggagttccgg

SEQ ID NO: 515690 - DNA, 25 bp, Mus musculus
acagcgggaacacgataggatcatg

SEQ ID NO: 515691 - DNA, 25 bp, Mus musculus
acagcgggaacaggataggatcatg

SEQ ID NO: 515692 - DNA, 25 bp, Mus musculus
acagcgggagaaccagcactctagc

SEQ ID NO: 515693 - DNA, 25 bp, Mus musculus
acagcgggagaagcagcactctagc

SEQ ID NO: 515694 - DNA, 25 bp, Mus musculus
acagcgggatcaacctgacgaccga

SEQ ID NO: 515695 - DNA, 25 bp, Mus musculus
acagcgggatcatcctgacgaccga

SEQ ID NO: 515696 - DNA, 25 bp, Mus musculus
acagcgggctcaagtggcatttgaa

SEQ ID NO: 515697 - DNA, 25 bp, Mus musculus
acagcgggctcatgtggcatttgaa

SEQ ID NO: 515698 - DNA, 25 bp, Mus musculus
acagcgggtggcacagacttggact

SEQ ID NO: 515699 - DNA, 25 bp, Mus musculus
acagcgggtggctcagacttggact

SEQ ID NO: 515700 - DNA, 25 bp, Mus musculus
acagcgtatccgagccaagggaacc

SEQ ID NO: 515701 - DNA, 25 bp, Mus musculus
acagcgtatccgtgccaagggaacc

SEQ ID NO: 515702 - DNA, 25 bp, Mus musculus
acagcgtccgccctcagcatgatgg

SEQ ID NO: 515703 - DNA, 25 bp, Mus musculus
acagcgtccgccgtcagcatgatgg

SEQ ID NO: 515704 - DNA, 25 bp, Mus musculus
acagcgtctggactcatcccgcaga

SEQ ID NO: 515705 - DNA, 25 bp, Mus musculus
acagcgtctggagtcatcccgcaga

SEQ ID NO: 515706 - DNA, 25 bp, Mus musculus
acagcgtggaccagcatgtgtacga

SEQ ID NO: 515707 - DNA, 25 bp, Mus musculus
acagcgtggacctgcatgtgtacga

SEQ ID NO: 515708 - DNA, 25 bp, Mus musculus
acagcgtgtcggatacaagaagagc

SEQ ID NO: 515709 - DNA, 25 bp, Mus musculus
acagcgtgtcggttacaagaagagc

SEQ ID NO: 515710 - DNA, 25 bp, Mus musculus
acagcgtttatgagttcaaaggaga

SEQ ID NO: 515711 - DNA, 25 bp, Mus musculus
acagcgtttatgtgttcaaaggaga

SEQ ID NO: 515712 - DNA, 25 bp, Mus musculus
acagctactaccaggcagttagtga

SEQ ID NO: 515713 - DNA, 25 bp, Mus musculus
acagctactacctggcagttagtga

SEQ ID NO: 515714 - DNA, 25 bp, Mus musculus
acagctactcctacgtgtggtggga

SEQ ID NO: 515715 - DNA, 25 bp, Mus musculus
acagctactccttcgtgtggtggga

SEQ ID NO: 515716 - DNA, 25 bp, Mus musculus
acagctagcaaactcttaaactttc

SEQ ID NO: 515717 - DNA, 25 bp, Mus musculus
acagctagcaaagtcttaaactttc

SEQ ID NO: 515718 - DNA, 25 bp, Mus musculus
acagctagctggctggcagcagagc

SEQ ID NO: 515719 - DNA, 25 bp, Mus musculus
acagctagctgggtggcagcagagc

SEQ ID NO: 515720 - DNA, 25 bp, Mus musculus
acagctagtggcatttcttgagaac

SEQ ID NO: 515721 - DNA, 25 bp, Mus musculus
acagctagtggcttttcttgagaac

SEQ ID NO: 515722 - DNA, 25 bp, Mus musculus
acagctatcttgcagtcacgtctgg

SEQ ID NO: 515723 - DNA, 25 bp, Mus musculus
acagctatcttggagtcacgtctgg

SEQ ID NO: 515724 - DNA, 25 bp, Mus musculus
acagctatgacccttactcctgagg

SEQ ID NO: 515725 - DNA, 25 bp, Mus musculus
acagctatgaccgttactcctgagg

SEQ ID NO: 515726 - DNA, 25 bp, Mus musculus
acagctcagcagatccaggcactaa

SEQ ID NO: 515727 - DNA, 25 bp, Mus musculus
acagctcagcagttccaggcactaa

SEQ ID NO: 515728 - DNA, 25 bp, Mus musculus
acagctcagtgcagtgatggagtgt

SEQ ID NO: 515729 - DNA, 25 bp, Mus musculus
acagctcagtgctgtgatggagtgt

SEQ ID NO: 515730 - DNA, 25 bp, Mus musculus
acagctcatcacagtcctcagagac

SEQ ID NO: 515731 - DNA, 25 bp, Mus musculus
acagctcatcactgtcctcagagac

SEQ ID NO: 515732 - DNA, 25 bp, Mus musculus
acagctcatgcaagagaatgcccag

SEQ ID NO: 515733 - DNA, 25 bp, Mus musculus
acagctcatgcatgagaatgcccag

SEQ ID NO: 515734 - DNA, 25 bp, Mus musculus
acagctcccgatctcgattctacag

SEQ ID NO: 515735 - DNA, 25 bp, Mus musculus
acagctcccgatgtcgattctacag

SEQ ID NO: 515736 - DNA, 25 bp, Mus musculus
acagctccgtcgattagtttaagag

SEQ ID NO: 515737 - DNA, 25 bp, Mus musculus
acagctccgtcgtttagtttaagag

SEQ ID NO: 515738 - DNA, 25 bp, Mus musculus
acagctccttgtcttcatgtttcca

SEQ ID NO: 515739 - DNA, 25 bp, Mus musculus
acagctccttgtgttcatgtttcca

SEQ ID NO: 515740 - DNA, 25 bp, Mus musculus
acagctcgtcccaaactaggtaaag

SEQ ID NO: 515741 - DNA, 25 bp, Mus musculus
acagctcgtccctaactaggtaaag

SEQ ID NO: 515742 - DNA, 25 bp, Mus musculus
acagctctgcctagtgcatctccag

SEQ ID NO: 515743 - DNA, 25 bp, Mus musculus
acagctctgccttgtgcatctccag

SEQ ID NO: 515744 - DNA, 25 bp, Mus musculus
acagctcttcggcacaaccgaacta

SEQ ID NO: 515745 - DNA, 25 bp, Mus musculus
acagctcttcgggacaaccgaacta

SEQ ID NO: 515746 - DNA, 25 bp, Mus musculus
acagctcttcttcaatgggacagaa

SEQ ID NO: 515747 - DNA, 25 bp, Mus musculus
acagctcttcttgaatgggacagaa

SEQ ID NO: 515748 - DNA, 25 bp, Mus musculus
acagctctttgtaggtgtgtaactg

SEQ ID NO: 515749 - DNA, 25 bp, Mus musculus
acagctctttgttggtgtgtaactg

SEQ ID NO: 515750 - DNA, 25 bp, Mus musculus
acagctgaaacccaagagggaacag

SEQ ID NO: 515751 - DNA, 25 bp, Mus musculus
acagctgaaaccgaagagggaacag

SEQ ID NO: 515752 - DNA, 25 bp, Mus musculus
acagctgaaggaagcacacagggcc

SEQ ID NO: 515753 - DNA, 25 bp, Mus musculus
acagctgaaggatgcacacagggcc

SEQ ID NO: 515754 - DNA, 25 bp, Mus musculus
acagctgagcggattttccagaagc

SEQ ID NO: 515755 - DNA, 25 bp, Mus musculus
acagctgagcggtttttccagaagc

SEQ ID NO: 515756 - DNA, 25 bp, Mus musculus
acagctgcaggtccttgaaccaaag

SEQ ID NO: 515757 - DNA, 25 bp, Mus musculus
acagctgcaggtgcttgaaccaaag

SEQ ID NO: 515758 - DNA, 25 bp, Mus musculus
acagctgctggtctggaccatcgag

SEQ ID NO: 515759 - DNA, 25 bp, Mus musculus
acagctgctggtgtggaccatcgag

SEQ ID NO: 515760 - DNA, 25 bp, Mus musculus
acagctggagcacgaccacgtgcct

SEQ ID NO: 515761 - DNA, 25 bp, Mus musculus
acagctggagcaggaccacgtgcct

SEQ ID NO: 515762 - DNA, 25 bp, Mus musculus
acagctggagcgcacagaagccacc

SEQ ID NO: 515763 - DNA, 25 bp, Mus musculus
acagctggagcggacagaagccacc

SEQ ID NO: 515764 - DNA, 25 bp, Mus musculus
acagctgggcagcacggctgtcctc

SEQ ID NO: 515765 - DNA, 25 bp, Mus musculus
acagctgggcaggacggctgtcctc

SEQ ID NO: 515766 - DNA, 25 bp, Mus musculus
acagctgtatgtagcctgtggtagg

SEQ ID NO: 515767 - DNA, 25 bp, Mus musculus
acagctgtatgttgcctgtggtagg

SEQ ID NO: 515768 - DNA, 25 bp, Mus musculus
acagctgtctgcatcacggtggtca

SEQ ID NO: 515769 - DNA, 25 bp, Mus musculus
acagctgtctgcttcacggtggtca

SEQ ID NO: 515770 - DNA, 25 bp, Mus musculus
acagctgtggcgaggttcctccgag

SEQ ID NO: 515771 - DNA, 25 bp, Mus musculus
acagctgtggcgtggttcctccgag

SEQ ID NO: 515772 - DNA, 25 bp, Mus musculus
acagcttaccttaggattcaaacag

SEQ ID NO: 515773 - DNA, 25 bp, Mus musculus
acagcttacctttggattcaaacag

SEQ ID NO: 515774 - DNA, 25 bp, Mus musculus
acagcttagtgtacaggtaatttct

SEQ ID NO: 515775 - DNA, 25 bp, Mus musculus
acagcttagtgttcaggtaatttct

SEQ ID NO: 515776 - DNA, 25 bp, Mus musculus
acagcttcatgaccacggagccgct

SEQ ID NO: 515777 - DNA, 25 bp, Mus musculus
acagcttcatgagcacggagccgct

SEQ ID NO: 515778 - DNA, 25 bp, Mus musculus
acagcttcgatgagggcagtgtgtc

SEQ ID NO: 515779 - DNA, 25 bp, Mus musculus
acagcttcgatgtgggcagtgtgtc

SEQ ID NO: 515780 - DNA, 25 bp, Mus musculus
acagcttctttgaagtactccgaat

SEQ ID NO: 515781 - DNA, 25 bp, Mus musculus
acagcttctttgtagtactccgaat

SEQ ID NO: 515782 - DNA, 25 bp, Mus musculus
acagcttgaagacgacattgtatca

SEQ ID NO: 515783 - DNA, 25 bp, Mus musculus
acagcttgaagaggacattgtatca

SEQ ID NO: 515784 - DNA, 25 bp, Mus musculus
acagcttgcagccatcagttctgca

SEQ ID NO: 515785 - DNA, 25 bp, Mus musculus
acagcttgcagcgatcagttctgca

SEQ ID NO: 515786 - DNA, 25 bp, Mus musculus
acagcttgttgtcggcacttctcac

SEQ ID NO: 515787 - DNA, 25 bp, Mus musculus
acagcttgttgtgggcacttctcac

SEQ ID NO: 515788 - DNA, 25 bp, Mus musculus
acagctttgccgacttcccagacat

SEQ ID NO: 515789 - DNA, 25 bp, Mus musculus
acagctttgccgtcttcccagacat

SEQ ID NO: 515790 - DNA, 25 bp, Mus musculus
acagctttgtgacaagggttttgac

SEQ ID NO: 515791 - DNA, 25 bp, Mus musculus
acagctttgtgagaagggttttgac

SEQ ID NO: 515792 - DNA, 25 bp, Mus musculus
acagcttttaggaggagtggcagaa

SEQ ID NO: 515793 - DNA, 25 bp, Mus musculus
acagcttttaggtggagtggcagaa

SEQ ID NO: 515794 - DNA, 25 bp, Mus musculus
acagcttttggcactatgagctctg

SEQ ID NO: 515795 - DNA, 25 bp, Mus musculus
acagcttttggctctatgagctctg

SEQ ID NO: 515796 - DNA, 25 bp, Mus musculus
acaggaaaaggaaattgctagagaa

SEQ ID NO: 515797 - DNA, 25 bp, Mus musculus
acaggaaaaggacatctctagttct

SEQ ID NO: 515798 - DNA, 25 bp, Mus musculus
acaggaaaaggagatctctagttct

SEQ ID NO: 515799 - DNA, 25 bp, Mus musculus
acaggaaaaggatattgctagagaa

SEQ ID NO: 515800 - DNA, 25 bp, Mus musculus
acaggaaatgaccagaagaaagcca

SEQ ID NO: 515801 - DNA, 25 bp, Mus musculus
acaggaaatgacgagaagaaagcca

SEQ ID NO: 515802 - DNA, 25 bp, Mus musculus
acaggaaccgaacagtgtaagaagg

SEQ ID NO: 515803 - DNA, 25 bp, Mus musculus
acaggaaccgaagagtgtaagaagg

SEQ ID NO: 515804 - DNA, 25 bp, Mus musculus
acaggaaccggaaccattcacctac

SEQ ID NO: 515805 - DNA, 25 bp, Mus musculus
acaggaaccggatccattcacctac

SEQ ID NO: 515806 - DNA, 25 bp, Mus musculus
acaggaagacagcactgcggtcccc

SEQ ID NO: 515807 - DNA, 25 bp, Mus musculus
acaggaagacaggactgcggtcccc

SEQ ID NO: 515808 - DNA, 25 bp, Mus musculus
acaggaagatctctggacacactga

SEQ ID NO: 515809 - DNA, 25 bp, Mus musculus
acaggaagatctgtggacacactga

SEQ ID NO: 515810 - DNA, 25 bp, Mus musculus
acaggaagccacatccgctggaagg

SEQ ID NO: 515811 - DNA, 25 bp, Mus musculus
acaggaagccacttccgctggaagg

SEQ ID NO: 515812 - DNA, 25 bp, Mus musculus
acaggaagcgccacgaagggagtct

SEQ ID NO: 515813 - DNA, 25 bp, Mus musculus
acaggaagcgcctcgaagggagtct

SEQ ID NO: 515814 - DNA, 25 bp, Mus musculus
acaggaatcagtcggtgtgggaaca

SEQ ID NO: 515815 - DNA, 25 bp, Mus musculus
acaggaatcagtgggtgtgggaaca

SEQ ID NO: 515816 - DNA, 25 bp, Mus musculus
acaggaatggttatgaatttgaccg

SEQ ID NO: 515817 - DNA, 25 bp, Mus musculus
acaggaatggttttgaatttgaccg

SEQ ID NO: 515818 - DNA, 25 bp, Mus musculus
acaggacaagcgatccagacgcagg

SEQ ID NO: 515819 - DNA, 25 bp, Mus musculus
acaggacaagcgttccagacgcagg

SEQ ID NO: 515820 - DNA, 25 bp, Mus musculus
acaggacagacactttatgcttcag

SEQ ID NO: 515821 - DNA, 25 bp, Mus musculus
acaggacagacagtttatgcttcag

SEQ ID NO: 515822 - DNA, 25 bp, Mus musculus
acaggacaggaaatgacgagaagaa

SEQ ID NO: 515823 - DNA, 25 bp, Mus musculus
acaggacaggaattgacgagaagaa

SEQ ID NO: 515824 - DNA, 25 bp, Mus musculus
acaggacagggaaccccggcaggca

SEQ ID NO: 515825 - DNA, 25 bp, Mus musculus
acaggacagggatccccggcaggca

SEQ ID NO: 515826 - DNA, 25 bp, Mus musculus
acaggacagttccaggcccggacag

SEQ ID NO: 515827 - DNA, 25 bp, Mus musculus
acaggacagttcgaggcccggacag

SEQ ID NO: 515828 - DNA, 25 bp, Mus musculus
acaggacattctacgggctgctcga

SEQ ID NO: 515829 - DNA, 25 bp, Mus musculus
acaggacattcttcgggctgctcga

SEQ ID NO: 515830 - DNA, 25 bp, Mus musculus
acaggacccgcaactggaggagcct

SEQ ID NO: 515831 - DNA, 25 bp, Mus musculus
acaggacccgcatctggaggagcct

SEQ ID NO: 515832 - DNA, 25 bp, Mus musculus
acaggaccgccgagctcaacagcta

SEQ ID NO: 515833 - DNA, 25 bp, Mus musculus
acaggaccgccgtgctcaacagcta

SEQ ID NO: 515834 - DNA, 25 bp, Mus musculus
acaggacctgatcgatcccctggct

SEQ ID NO: 515835 - DNA, 25 bp, Mus musculus
acaggacctgatggatcccctggct

SEQ ID NO: 515836 - DNA, 25 bp, Mus musculus
acaggacctggcatcggtggaccaa

SEQ ID NO: 515837 - DNA, 25 bp, Mus musculus
acaggacctggcttcggtggaccaa

SEQ ID NO: 515838 - DNA, 25 bp, Mus musculus
acaggacggcatccctttgccttca

SEQ ID NO: 515839 - DNA, 25 bp, Mus musculus
acaggacggcatgcctttgccttca

SEQ ID NO: 515840 - DNA, 25 bp, Mus musculus
acaggacggccccattcagaagctg

SEQ ID NO: 515841 - DNA, 25 bp, Mus musculus
acaggacggcccgattcagaagctg

SEQ ID NO: 515842 - DNA, 25 bp, Mus musculus
acaggactccccaagaggaacgagg

SEQ ID NO: 515843 - DNA, 25 bp, Mus musculus
acaggactcccctagaggaacgagg

SEQ ID NO: 515844 - DNA, 25 bp, Mus musculus
acaggacttcacatactgtgtttcc

SEQ ID NO: 515845 - DNA, 25 bp, Mus musculus
acaggacttcacttactgtgtttcc

SEQ ID NO: 515846 - DNA, 25 bp, Mus musculus
acaggagaaatgcacacattcagca

SEQ ID NO: 515847 - DNA, 25 bp, Mus musculus
acaggagaaatggacacattcagca

SEQ ID NO: 515848 - DNA, 25 bp, Mus musculus
acaggagacattcacctttgcctta

SEQ ID NO: 515849 - DNA, 25 bp, Mus musculus
acaggagacattgacctttgcctta

SEQ ID NO: 515850 - DNA, 25 bp, Mus musculus
acaggagcaaccagagtaagtaacc

SEQ ID NO: 515851 - DNA, 25 bp, Mus musculus
acaggagcaacctgagtaagtaacc

SEQ ID NO: 515852 - DNA, 25 bp, Mus musculus
acaggagccagcatctcagtgcgcg

SEQ ID NO: 515853 - DNA, 25 bp, Mus musculus
acaggagccagcttctcagtgcgcg

SEQ ID NO: 515854 - DNA, 25 bp, Mus musculus
acaggaggatcaccctcccgaggga

SEQ ID NO: 515855 - DNA, 25 bp, Mus musculus
acaggaggatcagcctcccgaggga

SEQ ID NO: 515856 - DNA, 25 bp, Mus musculus
acaggagggaggaccatctacggaa

SEQ ID NO: 515857 - DNA, 25 bp, Mus musculus
acaggagggaggtccatctacggaa

SEQ ID NO: 515858 - DNA, 25 bp, Mus musculus
acaggaggtatactacctaattcgt

SEQ ID NO: 515859 - DNA, 25 bp, Mus musculus
acaggaggtatagtacctaattcgt

SEQ ID NO: 515860 - DNA, 25 bp, Mus musculus
acaggaggtgcacaagctagccaag

SEQ ID NO: 515861 - DNA, 25 bp, Mus musculus
acaggaggtgcagaagctagccaag

SEQ ID NO: 515862 - DNA, 25 bp, Mus musculus
acaggaggtggaaaaagtgctaaag

SEQ ID NO: 515863 - DNA, 25 bp, Mus musculus
acaggaggtggataaagtgctaaag

SEQ ID NO: 515864 - DNA, 25 bp, Mus musculus
acaggagtactgagcgtgaaattca

SEQ ID NO: 515865 - DNA, 25 bp, Mus musculus
acaggagtactgtgcgtgaaattca

SEQ ID NO: 515866 - DNA, 25 bp, Mus musculus
acaggagtcttccacgtcacaccag

SEQ ID NO: 515867 - DNA, 25 bp, Mus musculus
acaggagtcttcgacgtcacaccag

SEQ ID NO: 515868 - DNA, 25 bp, Mus musculus
acaggagtgtggctgctaggcgccc

SEQ ID NO: 515869 - DNA, 25 bp, Mus musculus
acaggagtgtgggtgctaggcgccc

SEQ ID NO: 515870 - DNA, 25 bp, Mus musculus
acaggagtttctcgttcccaatgat

SEQ ID NO: 515871 - DNA, 25 bp, Mus musculus
acaggagtttctggttcccaatgat

SEQ ID NO: 515872 - DNA, 25 bp, Mus musculus
acaggatgctctccatttccgtctc

SEQ ID NO: 515873 - DNA, 25 bp, Mus musculus
acaggatgctctgcatttccgtctc

SEQ ID NO: 515874 - DNA, 25 bp, Mus musculus
acaggatgctgaactaatcgtggca

SEQ ID NO: 515875 - DNA, 25 bp, Mus musculus
acaggatgctgatctaatcgtggca

SEQ ID NO: 515876 - DNA, 25 bp, Mus musculus
acaggatggctcaccagcactgtga

SEQ ID NO: 515877 - DNA, 25 bp, Mus musculus
acaggatggctctccagcactgtga

SEQ ID NO: 515878 - DNA, 25 bp, Mus musculus
acaggatgtcggagatatgggaaaa

SEQ ID NO: 515879 - DNA, 25 bp, Mus musculus
acaggatgtcggtgatatgggaaaa

SEQ ID NO: 515880 - DNA, 25 bp, Mus musculus
acaggattcctgcaacatccaccta

SEQ ID NO: 515881 - DNA, 25 bp, Mus musculus
acaggattcctggaacatccaccta

SEQ ID NO: 515882 - DNA, 25 bp, Mus musculus
acaggattggccagaactggtagat

SEQ ID NO: 515883 - DNA, 25 bp, Mus musculus
acaggattggcctgaactggtagat

SEQ ID NO: 515884 - DNA, 25 bp, Mus musculus
acaggcaaagccagcggcaatggga

SEQ ID NO: 515885 - DNA, 25 bp, Mus musculus
acaggcaaagcctgcggcaatggga

SEQ ID NO: 515886 - DNA, 25 bp, Mus musculus
acaggcaaatacattgacaaagcca

SEQ ID NO: 515887 - DNA, 25 bp, Mus musculus
acaggcaaatactttgacaaagcca

SEQ ID NO: 515888 - DNA, 25 bp, Mus musculus
acaggcacgttgagacctgaactgc

SEQ ID NO: 515889 - DNA, 25 bp, Mus musculus
acaggcacgttgtgacctgaactgc

SEQ ID NO: 515890 - DNA, 25 bp, Mus musculus
acaggcacttatatggttacttggg

SEQ ID NO: 515891 - DNA, 25 bp, Mus musculus
acaggcacttatttggttacttggg

SEQ ID NO: 515892 - DNA, 25 bp, Mus musculus
acaggcagagcgataccaggaggcc

SEQ ID NO: 515893 - DNA, 25 bp, Mus musculus
acaggcagagcgttaccaggaggcc

SEQ ID NO: 515894 - DNA, 25 bp, Mus musculus
acaggcagcatgcactcagatgact

SEQ ID NO: 515895 - DNA, 25 bp, Mus musculus
acaggcagcatggactcagatgact

SEQ ID NO: 515896 - DNA, 25 bp, Mus musculus
acaggcagggcaccttagttcaccg

SEQ ID NO: 515897 - DNA, 25 bp, Mus musculus
acaggcagggcagcttagttcaccg

SEQ ID NO: 515898 - DNA, 25 bp, Mus musculus
acaggcagtattccaaggtattata

SEQ ID NO: 515899 - DNA, 25 bp, Mus musculus
acaggcagtattgcaaggtattata

SEQ ID NO: 515900 - DNA, 25 bp, Mus musculus
acaggcagtgggaagtctttcacca

SEQ ID NO: 515901 - DNA, 25 bp, Mus musculus
acaggcagtgggtagtctttcacca

SEQ ID NO: 515902 - DNA, 25 bp, Mus musculus
acaggcatgctacagactgtgcgca

SEQ ID NO: 515903 - DNA, 25 bp, Mus musculus
acaggcatgctagagactgtgcgca

SEQ ID NO: 515904 - DNA, 25 bp, Mus musculus
acaggcatggacagcggaggctcct

SEQ ID NO: 515905 - DNA, 25 bp, Mus musculus
acaggcatggactgcggaggctcct

SEQ ID NO: 515906 - DNA, 25 bp, Mus musculus
acaggccaaagaccggttatatcag

SEQ ID NO: 515907 - DNA, 25 bp, Mus musculus
acaggccaaagagcggttatatcag

SEQ ID NO: 515908 - DNA, 25 bp, Mus musculus
acaggccagattactcacagacaag

SEQ ID NO: 515909 - DNA, 25 bp, Mus musculus
acaggccagatttctcacagacaag

SEQ ID NO: 515910 - DNA, 25 bp, Mus musculus
acaggccagtgtccctgtaaggatg

SEQ ID NO: 515911 - DNA, 25 bp, Mus musculus
acaggccagtgtgcctgtaaggatg

SEQ ID NO: 515912 - DNA, 25 bp, Mus musculus
acaggccatgaacatggtagtcact

SEQ ID NO: 515913 - DNA, 25 bp, Mus musculus
acaggccatgaagatggtagtcact

SEQ ID NO: 515914 - DNA, 25 bp, Mus musculus
acaggcccacagactgctgcagttt

SEQ ID NO: 515915 - DNA, 25 bp, Mus musculus
acaggcccacagtctgctgcagttt

SEQ ID NO: 515916 - DNA, 25 bp, Mus musculus
acaggcccatggcacaagcacaagc

SEQ ID NO: 515917 - DNA, 25 bp, Mus musculus
acaggcccatgggacaagcacaagc

SEQ ID NO: 515918 - DNA, 25 bp, Mus musculus
acaggccctacgacgagggtctgcg

SEQ ID NO: 515919 - DNA, 25 bp, Mus musculus
acaggccctacgtcgagggtctgcg

SEQ ID NO: 515920 - DNA, 25 bp, Mus musculus
acaggccctcgcaggtgctggagct

SEQ ID NO: 515921 - DNA, 25 bp, Mus musculus
acaggccctcgctggtgctggagct

SEQ ID NO: 515922 - DNA, 25 bp, Mus musculus
acaggccgcgacctctttgccgagg

SEQ ID NO: 515923 - DNA, 25 bp, Mus musculus
acaggccgcgacgtctttgccgagg

SEQ ID NO: 515924 - DNA, 25 bp, Mus musculus
acaggccggctcagctgccagtttg

SEQ ID NO: 515925 - DNA, 25 bp, Mus musculus
acaggccggctctgctgccagtttg

SEQ ID NO: 515926 - DNA, 25 bp, Mus musculus
acaggcctatgtcgactaagtatcc

SEQ ID NO: 515927 - DNA, 25 bp, Mus musculus
acaggcctatgtggactaagtatcc

SEQ ID NO: 515928 - DNA, 25 bp, Mus musculus
acaggcctgcggcagcctgcgtggg

SEQ ID NO: 515929 - DNA, 25 bp, Mus musculus
acaggcctgcgggagcctgcgtggg

SEQ ID NO: 515930 - DNA, 25 bp, Mus musculus
acaggcctgttcctcgtgcgggaaa

SEQ ID NO: 515931 - DNA, 25 bp, Mus musculus
acaggcctgttcgtcgtgcgggaaa

SEQ ID NO: 515932 - DNA, 25 bp, Mus musculus
acaggcgaactcagagagacctgca

SEQ ID NO: 515933 - DNA, 25 bp, Mus musculus
acaggcgaactctgagagacctgca

SEQ ID NO: 515934 - DNA, 25 bp, Mus musculus
acaggcgcatctctgcaaggagcaa

SEQ ID NO: 515935 - DNA, 25 bp, Mus musculus
acaggcgcatctgtgcaaggagcaa

SEQ ID NO: 515936 - DNA, 25 bp, Mus musculus
acaggcgccccactgaagatacaca

SEQ ID NO: 515937 - DNA, 25 bp, Mus musculus
acaggcgccccagtgaagatacaca

SEQ ID NO: 515938 - DNA, 25 bp, Mus musculus
acaggcgctcaaagcctactatctg

SEQ ID NO: 515939 - DNA, 25 bp, Mus musculus
acaggcgctcaatgcctactatctg

SEQ ID NO: 515940 - DNA, 25 bp, Mus musculus
acaggctacgggatctcggacacca

SEQ ID NO: 515941 - DNA, 25 bp, Mus musculus
acaggctacgggttctcggacacca

SEQ ID NO: 515942 - DNA, 25 bp, Mus musculus
acaggctcacccctggtggaggacc

SEQ ID NO: 515943 - DNA, 25 bp, Mus musculus
acaggctcacccgtggtggaggacc

SEQ ID NO: 515944 - DNA, 25 bp, Mus musculus
acaggctccgtgatgggcacaaagg

SEQ ID NO: 515945 - DNA, 25 bp, Mus musculus
acaggctccgtgttgggcacaaagg

SEQ ID NO: 515946 - DNA, 25 bp, Mus musculus
acaggctcttctcagggttccaggc

SEQ ID NO: 515947 - DNA, 25 bp, Mus musculus
acaggctcttctgagggttccaggc

SEQ ID NO: 515948 - DNA, 25 bp, Mus musculus
acaggctgagcacggctgatattgc

SEQ ID NO: 515949 - DNA, 25 bp, Mus musculus
acaggctgagcagggctgatattgc

SEQ ID NO: 515950 - DNA, 25 bp, Mus musculus
acaggctgatttactctccaccagg

SEQ ID NO: 515951 - DNA, 25 bp, Mus musculus
acaggctgattttctctccaccagg

SEQ ID NO: 515952 - DNA, 25 bp, Mus musculus
acaggctggagtagttgcccatcct

SEQ ID NO: 515953 - DNA, 25 bp, Mus musculus
acaggctggagttgttgcccatcct

SEQ ID NO: 515954 - DNA, 25 bp, Mus musculus
acagggaaagccacgcggataccga

SEQ ID NO: 515955 - DNA, 25 bp, Mus musculus
acagggaaagcctcgcggataccga

SEQ ID NO: 515956 - DNA, 25 bp, Mus musculus
acagggaagtctacctcggaggcca

SEQ ID NO: 515957 - DNA, 25 bp, Mus musculus
acagggaagtcttcctcggaggcca

SEQ ID NO: 515958 - DNA, 25 bp, Mus musculus
acagggacaagtctcccctgtggca

SEQ ID NO: 515959 - DNA, 25 bp, Mus musculus
acagggacaagtgtcccctgtggca

SEQ ID NO: 515960 - DNA, 25 bp, Mus musculus
acagggacatacatcgcctggtgtt

SEQ ID NO: 515961 - DNA, 25 bp, Mus musculus
acagggacatacttcgcctggtgtt

SEQ ID NO: 515962 - DNA, 25 bp, Mus musculus
acagggacgactactcatccgcggg

SEQ ID NO: 515963 - DNA, 25 bp, Mus musculus
acagggacgacttctcatccgcggg

SEQ ID NO: 515964 - DNA, 25 bp, Mus musculus
acagggactgtcctgtcaccactca

SEQ ID NO: 515965 - DNA, 25 bp, Mus musculus
acagggactgtcgtgtcaccactca

SEQ ID NO: 515966 - DNA, 25 bp, Mus musculus
acagggagacctccatggtgcatga

SEQ ID NO: 515967 - DNA, 25 bp, Mus musculus
acagggagacctgcatggtgcatga

SEQ ID NO: 515968 - DNA, 25 bp, Mus musculus
acagggcaacgtcggcctcaccaat

SEQ ID NO: 515969 - DNA, 25 bp, Mus musculus
acagggcaacgtgggcctcaccaat

SEQ ID NO: 515970 - DNA, 25 bp, Mus musculus
acagggcacgtgactgagtcgagct

SEQ ID NO: 515971 - DNA, 25 bp, Mus musculus
acagggcacgtgtctgagtcgagct

SEQ ID NO: 515972 - DNA, 25 bp, Mus musculus
acagggcagctgcactccatgtcca

SEQ ID NO: 515973 - DNA, 25 bp, Mus musculus
acagggcagctggactccatgtcca

SEQ ID NO: 515974 - DNA, 25 bp, Mus musculus
acagggcaggaaagtaaatgccaac

SEQ ID NO: 515975 - DNA, 25 bp, Mus musculus
acagggcaggaatgtaaatgccaac

SEQ ID NO: 515976 - DNA, 25 bp, Mus musculus
acagggccttctcaagcagccaagc

SEQ ID NO: 515977 - DNA, 25 bp, Mus musculus
acagggccttctgaagcagccaagc

SEQ ID NO: 515978 - DNA, 25 bp, Mus musculus
acagggcgccataaacgagctcact

SEQ ID NO: 515979 - DNA, 25 bp, Mus musculus
acagggcgccattaacgagctcact

SEQ ID NO: 515980 - DNA, 25 bp, Mus musculus
acagggcggaggaccagaagactca

SEQ ID NO: 515981 - DNA, 25 bp, Mus musculus
acagggcggaggtccagaagactca

SEQ ID NO: 515982 - DNA, 25 bp, Mus musculus
acagggctacagctcctacaggaca

SEQ ID NO: 515983 - DNA, 25 bp, Mus musculus
acagggctacaggtcctacaggaca

SEQ ID NO: 515984 - DNA, 25 bp, Mus musculus
acagggctccggctctcgcttaggt

SEQ ID NO: 515985 - DNA, 25 bp, Mus musculus
acagggctccgggtctcgcttaggt

SEQ ID NO: 515986 - DNA, 25 bp, Mus musculus
acagggctgctgatgccggccggcg

SEQ ID NO: 515987 - DNA, 25 bp, Mus musculus
acagggctgctgttgccggccggcg

SEQ ID NO: 515988 - DNA, 25 bp, Mus musculus
acagggcttcaaaaagcttgctgag

SEQ ID NO: 515989 - DNA, 25 bp, Mus musculus
acagggcttcaataagcttgctgag

SEQ ID NO: 515990 - DNA, 25 bp, Mus musculus
acagggtagaatatgtacgaggtca

SEQ ID NO: 515991 - DNA, 25 bp, Mus musculus
acagggtagaatttgtacgaggtca

SEQ ID NO: 515992 - DNA, 25 bp, Mus musculus
acagggtgatcccagccttcatgtg

SEQ ID NO: 515993 - DNA, 25 bp, Mus musculus
acagggtgatccgagccttcatgtg

SEQ ID NO: 515994 - DNA, 25 bp, Mus musculus
acagggtggcccattatctctccca

SEQ ID NO: 515995 - DNA, 25 bp, Mus musculus
acagggtggccctttatctctccca

SEQ ID NO: 515996 - DNA, 25 bp, Mus musculus
acagggtgtggccaagagtcctcac

SEQ ID NO: 515997 - DNA, 25 bp, Mus musculus
acagggtgtggcgaagagtcctcac

SEQ ID NO: 515998 - DNA, 25 bp, Mus musculus
acagggttggaccaagagcagctcc

SEQ ID NO: 515999 - DNA, 25 bp, Mus musculus
acagggttggacgaagagcagctcc

SEQ ID NO: 516000 - DNA, 25 bp, Mus musculus
acaggtacaaggcttccgagaggct

SEQ ID NO: 516001 - DNA, 25 bp, Mus musculus
acaggtacaagggttccgagaggct

SEQ ID NO: 516002 - DNA, 25 bp, Mus musculus
acaggtacatccatgtggacattga

SEQ ID NO: 516003 - DNA, 25 bp, Mus musculus
acaggtacatccttgtggacattga

SEQ ID NO: 516004 - DNA, 25 bp, Mus musculus
acaggtagccatcggcagaaagaaa

SEQ ID NO: 516005 - DNA, 25 bp, Mus musculus
acaggtagccatgggcagaaagaaa

SEQ ID NO: 516006 - DNA, 25 bp, Mus musculus
acaggtatgcttcatcccgggtgac

SEQ ID NO: 516007 - DNA, 25 bp, Mus musculus
acaggtatgcttgatcccgggtgac

SEQ ID NO: 516008 - DNA, 25 bp, Mus musculus
acaggtgaagagacgagccgaagac

SEQ ID NO: 516009 - DNA, 25 bp, Mus musculus
acaggtgaagagtcgagccgaagac

SEQ ID NO: 516010 - DNA, 25 bp, Mus musculus
acaggtgaagatcctgcagcggata

SEQ ID NO: 516011 - DNA, 25 bp, Mus musculus
acaggtgaagatgctgcagcggata

SEQ ID NO: 516012 - DNA, 25 bp, Mus musculus
acaggtgagacacgacatgcacgca

SEQ ID NO: 516013 - DNA, 25 bp, Mus musculus
acaggtgagacaggacatgcacgca

SEQ ID NO: 516014 - DNA, 25 bp, Mus musculus
acaggtgagcccaccaacggtcaca

SEQ ID NO: 516015 - DNA, 25 bp, Mus musculus
acaggtgagccctccaacggtcaca

SEQ ID NO: 516016 - DNA, 25 bp, Mus musculus
acaggtgcaagtctctctgcttgca

SEQ ID NO: 516017 - DNA, 25 bp, Mus musculus
acaggtgcaagtgtctctgcttgca

SEQ ID NO: 516018 - DNA, 25 bp, Mus musculus
acaggtgcacctcctttgatggctt

SEQ ID NO: 516019 - DNA, 25 bp, Mus musculus
acaggtgcacctgctttgatggctt

SEQ ID NO: 516020 - DNA, 25 bp, Mus musculus
acaggtgcctgcagaagcatatggc

SEQ ID NO: 516021 - DNA, 25 bp, Mus musculus
acaggtgcctgctgaagcatatggc

SEQ ID NO: 516022 - DNA, 25 bp, Mus musculus
acaggtgctggcactgcgcatagac

SEQ ID NO: 516023 - DNA, 25 bp, Mus musculus
acaggtgctggctctgcgcatagac

SEQ ID NO: 516024 - DNA, 25 bp, Mus musculus
acaggtgctgtacatctctccgatc

SEQ ID NO: 516025 - DNA, 25 bp, Mus musculus
acaggtgctgtagatctctccgatc

SEQ ID NO: 516026 - DNA, 25 bp, Mus musculus
acaggtgcttctcagagccttttgg

SEQ ID NO: 516027 - DNA, 25 bp, Mus musculus
acaggtgcttctgagagccttttgg

SEQ ID NO: 516028 - DNA, 25 bp, Mus musculus
acaggtggagtcaacaccatcaggg

SEQ ID NO: 516029 - DNA, 25 bp, Mus musculus
acaggtggagtctacaccatcaggg

SEQ ID NO: 516030 - DNA, 25 bp, Mus musculus
acaggtggatgccttcatgtagttg

SEQ ID NO: 516031 - DNA, 25 bp, Mus musculus
acaggtggatgcgttcatgtagttg

SEQ ID NO: 516032 - DNA, 25 bp, Mus musculus
acaggtggcatcctgcatccaccag

SEQ ID NO: 516033 - DNA, 25 bp, Mus musculus
acaggtggcatcgtgcatccaccag

SEQ ID NO: 516034 - DNA, 25 bp, Mus musculus
acaggtggtcagagctttaaagaaa

SEQ ID NO: 516035 - DNA, 25 bp, Mus musculus
acaggtggtcagtgctttaaagaaa

SEQ ID NO: 516036 - DNA, 25 bp, Mus musculus
acaggtggtgcgctttgaatgcaat

SEQ ID NO: 516037 - DNA, 25 bp, Mus musculus
acaggtggtgcggtttgaatgcaat

SEQ ID NO: 516038 - DNA, 25 bp, Mus musculus
acaggtggtggacgccacagctcac

SEQ ID NO: 516039 - DNA, 25 bp, Mus musculus
acaggtggtggaggccacagctcac

SEQ ID NO: 516040 - DNA, 25 bp, Mus musculus
acaggtgtctgaaagctaaagggtg

SEQ ID NO: 516041 - DNA, 25 bp, Mus musculus
acaggtgtctgatagctaaagggtg

SEQ ID NO: 516042 - DNA, 25 bp, Mus musculus
acaggttcagcgagacggcgcagca

SEQ ID NO: 516043 - DNA, 25 bp, Mus musculus
acaggttcagcgtgacggcgcagca

SEQ ID NO: 516044 - DNA, 25 bp, Mus musculus
acaggttccaaccacatgatgttga

SEQ ID NO: 516045 - DNA, 25 bp, Mus musculus
acaggttccaacgacatgatgttga

SEQ ID NO: 516046 - DNA, 25 bp, Mus musculus
acaggttccacgagtcatgtcaaca

SEQ ID NO: 516047 - DNA, 25 bp, Mus musculus
acaggttccacgtgtcatgtcaaca

SEQ ID NO: 516048 - DNA, 25 bp, Mus musculus
acaggttctcaccagttatgtcagg

SEQ ID NO: 516049 - DNA, 25 bp, Mus musculus
acaggttctcacgagttatgtcagg

SEQ ID NO: 516050 - DNA, 25 bp, Mus musculus
acaggttctgctcaatggaagtcgc

SEQ ID NO: 516051 - DNA, 25 bp, Mus musculus
acaggttctgctgaatggaagtcgc

SEQ ID NO: 516052 - DNA, 25 bp, Mus musculus
acaggtttgggcaagtccacgctca

SEQ ID NO: 516053 - DNA, 25 bp, Mus musculus
acaggtttgggctagtccacgctca

SEQ ID NO: 516054 - DNA, 25 bp, Mus musculus
acagtaaagcagataatttggccta

SEQ ID NO: 516055 - DNA, 25 bp, Mus musculus
acagtaaagcagttaatttggccta

SEQ ID NO: 516056 - DNA, 25 bp, Mus musculus
acagtaacagtcctctgcggccaag

SEQ ID NO: 516057 - DNA, 25 bp, Mus musculus
acagtaacagtcgtctgcggccaag

SEQ ID NO: 516058 - DNA, 25 bp, Mus musculus
acagtaatagcacggaatccttacc

SEQ ID NO: 516059 - DNA, 25 bp, Mus musculus
acagtaatagcagggaatccttacc

SEQ ID NO: 516060 - DNA, 25 bp, Mus musculus
acagtacagcatctgtgctgcccag

SEQ ID NO: 516061 - DNA, 25 bp, Mus musculus
acagtacagcatgtgtgctgcccag

SEQ ID NO: 516062 - DNA, 25 bp, Mus musculus
acagtacccaacagtgcccagcagg

SEQ ID NO: 516063 - DNA, 25 bp, Mus musculus
acagtacccaactgtgcccagcagg

SEQ ID NO: 516064 - DNA, 25 bp, Mus musculus
acagtaccttctactgcctacagac

SEQ ID NO: 516065 - DNA, 25 bp, Mus musculus
acagtaccttcttctgcctacagac

SEQ ID NO: 516066 - DNA, 25 bp, Mus musculus
acagtactactacagcaccagcgag

SEQ ID NO: 516067 - DNA, 25 bp, Mus musculus
acagtactactagagcaccagcgag

SEQ ID NO: 516068 - DNA, 25 bp, Mus musculus
acagtactatgcctacctcacggac

SEQ ID NO: 516069 - DNA, 25 bp, Mus musculus
acagtactatgcgtacctcacggac

SEQ ID NO: 516070 - DNA, 25 bp, Mus musculus
acagtataaactacattgatgtgac

SEQ ID NO: 516071 - DNA, 25 bp, Mus musculus
acagtataaacttcattgatgtgac

SEQ ID NO: 516072 - DNA, 25 bp, Mus musculus
acagtatatattccaggcgggcgcg

SEQ ID NO: 516073 - DNA, 25 bp, Mus musculus
acagtatatattgcaggcgggcgcg

SEQ ID NO: 516074 - DNA, 25 bp, Mus musculus
acagtatcgaggaacggcgcatcca

SEQ ID NO: 516075 - DNA, 25 bp, Mus musculus
acagtatcgaggtacggcgcatcca

SEQ ID NO: 516076 - DNA, 25 bp, Mus musculus
acagtatggcgtcgcccagacacga

SEQ ID NO: 516077 - DNA, 25 bp, Mus musculus
acagtatggcgtggcccagacacga

SEQ ID NO: 516078 - DNA, 25 bp, Mus musculus
acagtatttgccatctctccagaga

SEQ ID NO: 516079 - DNA, 25 bp, Mus musculus
acagtatttgccttctctccagaga

SEQ ID NO: 516080 - DNA, 25 bp, Mus musculus
acagtcagcagcaccgggtcatcgg

SEQ ID NO: 516081 - DNA, 25 bp, Mus musculus
acagtcagcagctccgggtcatcgg

SEQ ID NO: 516082 - DNA, 25 bp, Mus musculus
acagtcagccagagggaccaagcgc

SEQ ID NO: 516083 - DNA, 25 bp, Mus musculus
acagtcagccagtgggaccaagcgc

SEQ ID NO: 516084 - DNA, 25 bp, Mus musculus
acagtcagcccaagggcacctcggg

SEQ ID NO: 516085 - DNA, 25 bp, Mus musculus
acagtcagcccatgggcacctcggg

SEQ ID NO: 516086 - DNA, 25 bp, Mus musculus
acagtcagctcgagccaggacccag

SEQ ID NO: 516087 - DNA, 25 bp, Mus musculus
acagtcagctcgtgccaggacccag

SEQ ID NO: 516088 - DNA, 25 bp, Mus musculus
acagtcaggtgcagggcctgtccag

SEQ ID NO: 516089 - DNA, 25 bp, Mus musculus
acagtcaggtgctgggcctgtccag

SEQ ID NO: 516090 - DNA, 25 bp, Mus musculus
acagtccaggagaactgggtgtgtc

SEQ ID NO: 516091 - DNA, 25 bp, Mus musculus
acagtccaggagtactgggtgtgtc

SEQ ID NO: 516092 - DNA, 25 bp, Mus musculus
acagtccaggatcgccgacagtttc

SEQ ID NO: 516093 - DNA, 25 bp, Mus musculus
acagtccaggatggccgacagtttc

SEQ ID NO: 516094 - DNA, 25 bp, Mus musculus
acagtccatggacaggtacgtgctg

SEQ ID NO: 516095 - DNA, 25 bp, Mus musculus
acagtccatggagaggtacgtgctg

SEQ ID NO: 516096 - DNA, 25 bp, Mus musculus
acagtccccgagctgaaattgtcag

SEQ ID NO: 516097 - DNA, 25 bp, Mus musculus
acagtccccgaggtgaaattgtcag

SEQ ID NO: 516098 - DNA, 25 bp, Mus musculus
acagtccctagacccggcaagacat

SEQ ID NO: 516099 - DNA, 25 bp, Mus musculus
acagtccctagagccggcaagacat

SEQ ID NO: 516100 - DNA, 25 bp, Mus musculus
acagtccggtgtagctaagtgacca

SEQ ID NO: 516101 - DNA, 25 bp, Mus musculus
acagtccggtgttgctaagtgacca

SEQ ID NO: 516102 - DNA, 25 bp, Mus musculus
acagtcctgaggctcgagaggccat

SEQ ID NO: 516103 - DNA, 25 bp, Mus musculus
acagtcctgagggtcgagaggccat

SEQ ID NO: 516104 - DNA, 25 bp, Mus musculus
acagtcgatggcctccggaagacct

SEQ ID NO: 516105 - DNA, 25 bp, Mus musculus
acagtcgatggcgtccggaagacct

SEQ ID NO: 516106 - DNA, 25 bp, Mus musculus
acagtcgattctaagacaagcaggg

SEQ ID NO: 516107 - DNA, 25 bp, Mus musculus
acagtcgattcttagacaagcaggg

SEQ ID NO: 516108 - DNA, 25 bp, Mus musculus
acagtctatttactccaaaggattg

SEQ ID NO: 516109 - DNA, 25 bp, Mus musculus
acagtctatttagtccaaaggattg

SEQ ID NO: 516110 - DNA, 25 bp, Mus musculus
acagtctcacgccatggatcgccat

SEQ ID NO: 516111 - DNA, 25 bp, Mus musculus
acagtctcacgcgatggatcgccat

SEQ ID NO: 516112 - DNA, 25 bp, Mus musculus
acagtctctagcatcgccatgtaca

SEQ ID NO: 516113 - DNA, 25 bp, Mus musculus
acagtctctagcttcgccatgtaca

SEQ ID NO: 516114 - DNA, 25 bp, Mus musculus
acagtgaaactgacggagcgatcgc

SEQ ID NO: 516115 - DNA, 25 bp, Mus musculus
acagtgaaactgtcggagcgatcgc

SEQ ID NO: 516116 - DNA, 25 bp, Mus musculus
acagtgaacgtgaggccaccttggg

SEQ ID NO: 516117 - DNA, 25 bp, Mus musculus
acagtgaacgtgtggccaccttggg

SEQ ID NO: 516118 - DNA, 25 bp, Mus musculus
acagtgaagctactgccccgacact

SEQ ID NO: 516119 - DNA, 25 bp, Mus musculus
acagtgaagctagtgccccgacact

SEQ ID NO: 516120 - DNA, 25 bp, Mus musculus
acagtgaagggtatgctgcaaaact

SEQ ID NO: 516121 - DNA, 25 bp, Mus musculus
acagtgaagggtttgctgcaaaact

SEQ ID NO: 516122 - DNA, 25 bp, Mus musculus
acagtgacaacccaaggcttccctt

SEQ ID NO: 516123 - DNA, 25 bp, Mus musculus
acagtgacaaccgaaggcttccctt

SEQ ID NO: 516124 - DNA, 25 bp, Mus musculus
acagtgacactcctgctgagggccc

SEQ ID NO: 516125 - DNA, 25 bp, Mus musculus
acagtgacactcgtgctgagggccc

SEQ ID NO: 516126 - DNA, 25 bp, Mus musculus
acagtgacctcgaaccctgtgtcct

SEQ ID NO: 516127 - DNA, 25 bp, Mus musculus
acagtgacctcgtaccctgtgtcct

SEQ ID NO: 516128 - DNA, 25 bp, Mus musculus
acagtgacctgcaggatcggcggaa

SEQ ID NO: 516129 - DNA, 25 bp, Mus musculus
acagtgacctgctggatcggcggaa

SEQ ID NO: 516130 - DNA, 25 bp, Mus musculus
acagtgacgtcaaacctgaaacaac

SEQ ID NO: 516131 - DNA, 25 bp, Mus musculus
acagtgacgtcatacctgaaacaac

SEQ ID NO: 516132 - DNA, 25 bp, Mus musculus
acagtgactgggacactccaggcca

SEQ ID NO: 516133 - DNA, 25 bp, Mus musculus
acagtgactgggtcactccaggcca

SEQ ID NO: 516134 - DNA, 25 bp, Mus musculus
acagtgacttagctgagatgtgcct

SEQ ID NO: 516135 - DNA, 25 bp, Mus musculus
acagtgacttaggtgagatgtgcct

SEQ ID NO: 516136 - DNA, 25 bp, Mus musculus
acagtgagacaaaagatatcaacac

SEQ ID NO: 516137 - DNA, 25 bp, Mus musculus
acagtgagacaatagatatcaacac

SEQ ID NO: 516138 - DNA, 25 bp, Mus musculus
acagtgagctgcctccttgaggatg

SEQ ID NO: 516139 - DNA, 25 bp, Mus musculus
acagtgagctgcgtccttgaggatg

SEQ ID NO: 516140 - DNA, 25 bp, Mus musculus
acagtgagggcaacagctgccgggc

SEQ ID NO: 516141 - DNA, 25 bp, Mus musculus
acagtgagggcacaccaaggcaaat

SEQ ID NO: 516142 - DNA, 25 bp, Mus musculus
acagtgagggcagaccaaggcaaat

SEQ ID NO: 516143 - DNA, 25 bp, Mus musculus
acagtgagggcatcagctgccgggc

SEQ ID NO: 516144 - DNA, 25 bp, Mus musculus
acagtgagtaaccacgtgtacctgg

SEQ ID NO: 516145 - DNA, 25 bp, Mus musculus
acagtgagtaacgacgtgtacctgg

SEQ ID NO: 516146 - DNA, 25 bp, Mus musculus
acagtgataagcactggatctttgc

SEQ ID NO: 516147 - DNA, 25 bp, Mus musculus
acagtgataagctctggatctttgc

SEQ ID NO: 516148 - DNA, 25 bp, Mus musculus
acagtgatcatcctggtactctact

SEQ ID NO: 516149 - DNA, 25 bp, Mus musculus
acagtgatcatcgtggtactctact

SEQ ID NO: 516150 - DNA, 25 bp, Mus musculus
acagtgatgaggacttccccaagga

SEQ ID NO: 516151 - DNA, 25 bp, Mus musculus
acagtgatgaggtcttccccaagga

SEQ ID NO: 516152 - DNA, 25 bp, Mus musculus
acagtgattgtacaaccagagccag

SEQ ID NO: 516153 - DNA, 25 bp, Mus musculus
acagtgattgtagaaccagagccag

SEQ ID NO: 516154 - DNA, 25 bp, Mus musculus
acagtgcagttcactcagccagtcc

SEQ ID NO: 516155 - DNA, 25 bp, Mus musculus
acagtgcagttctctcagccagtcc

SEQ ID NO: 516156 - DNA, 25 bp, Mus musculus
acagtgccctcgctcagttctgcaa

SEQ ID NO: 516157 - DNA, 25 bp, Mus musculus
acagtgccctcggtcagttctgcaa

SEQ ID NO: 516158 - DNA, 25 bp, Mus musculus
acagtgcccttgacaccatgagcta

SEQ ID NO: 516159 - DNA, 25 bp, Mus musculus
acagtgcccttgtcaccatgagcta

SEQ ID NO: 516160 - DNA, 25 bp, Mus musculus
acagtgcctggaccttgtatcccaa

SEQ ID NO: 516161 - DNA, 25 bp, Mus musculus
acagtgcctggagcttgtatcccaa

SEQ ID NO: 516162 - DNA, 25 bp, Mus musculus
acagtgcgtggcagcacatgggcca

SEQ ID NO: 516163 - DNA, 25 bp, Mus musculus
acagtgcgtggctgcacatgggcca

SEQ ID NO: 516164 - DNA, 25 bp, Mus musculus
acagtgctgcagcccgactctgcag

SEQ ID NO: 516165 - DNA, 25 bp, Mus musculus
acagtgctgcaggccgactctgcag

SEQ ID NO: 516166 - DNA, 25 bp, Mus musculus
acagtgctgcccaggatggacaaca

SEQ ID NO: 516167 - DNA, 25 bp, Mus musculus
acagtgctgccctggatggacaaca

SEQ ID NO: 516168 - DNA, 25 bp, Mus musculus
acagtgctgtttcggcctcctctct

SEQ ID NO: 516169 - DNA, 25 bp, Mus musculus
acagtgctgtttgggcctcctctct

SEQ ID NO: 516170 - DNA, 25 bp, Mus musculus
acagtgcttcttactgtctcggaca

SEQ ID NO: 516171 - DNA, 25 bp, Mus musculus
acagtgcttctttctgtctcggaca

SEQ ID NO: 516172 - DNA, 25 bp, Mus musculus
acagtggaggtcagcgctccggtct

SEQ ID NO: 516173 - DNA, 25 bp, Mus musculus
acagtggaggtctgcgctccggtct

SEQ ID NO: 516174 - DNA, 25 bp, Mus musculus
acagtggaggtgactttatgatgcc

SEQ ID NO: 516175 - DNA, 25 bp, Mus musculus
acagtggaggtgtctttatgatgcc

SEQ ID NO: 516176 - DNA, 25 bp, Mus musculus
acagtggcctctaccctggtctcat

SEQ ID NO: 516177 - DNA, 25 bp, Mus musculus
acagtggcctcttccctggtctcat

SEQ ID NO: 516178 - DNA, 25 bp, Mus musculus
acagtggcttacacctcaactacca

SEQ ID NO: 516179 - DNA, 25 bp, Mus musculus
acagtggcttactcctcaactacca

SEQ ID NO: 516180 - DNA, 25 bp, Mus musculus
acagtggcttcacctggaacaagag

SEQ ID NO: 516181 - DNA, 25 bp, Mus musculus
acagtggcttcagctggaacaagag

SEQ ID NO: 516182 - DNA, 25 bp, Mus musculus
acagtgggagacaagccggtcaaca

SEQ ID NO: 516183 - DNA, 25 bp, Mus musculus
acagtgggagactagccggtcaaca

SEQ ID NO: 516184 - DNA, 25 bp, Mus musculus
acagtgggccttaaaggcacgcagc

SEQ ID NO: 516185 - DNA, 25 bp, Mus musculus
acagtgggcctttaaggcacgcagc

SEQ ID NO: 516186 - DNA, 25 bp, Mus musculus
acagtgggtggtaccaggcctagct

SEQ ID NO: 516187 - DNA, 25 bp, Mus musculus
acagtgggtggttccaggcctagct

SEQ ID NO: 516188 - DNA, 25 bp, Mus musculus
acagtggtagtacccgactttgggc

SEQ ID NO: 516189 - DNA, 25 bp, Mus musculus
acagtggtagtagccgactttgggc

SEQ ID NO: 516190 - DNA, 25 bp, Mus musculus
acagtggtgggccacatttaggaaa

SEQ ID NO: 516191 - DNA, 25 bp, Mus musculus
acagtggtgggcgacatttaggaaa

SEQ ID NO: 516192 - DNA, 25 bp, Mus musculus
acagtggtgtggagagcacctccga

SEQ ID NO: 516193 - DNA, 25 bp, Mus musculus
acagtggtgtggtgagcacctccga

SEQ ID NO: 516194 - DNA, 25 bp, Mus musculus
acagtgtcaggtccttccagagacc

SEQ ID NO: 516195 - DNA, 25 bp, Mus musculus
acagtgtcaggtgcttccagagacc

SEQ ID NO: 516196 - DNA, 25 bp, Mus musculus
acagtgtcggtcagccaatgctgag

SEQ ID NO: 516197 - DNA, 25 bp, Mus musculus
acagtgtcggtctgccaatgctgag

SEQ ID NO: 516198 - DNA, 25 bp, Mus musculus
acagtgtctatcaatacccctgaga

SEQ ID NO: 516199 - DNA, 25 bp, Mus musculus
acagtgtctatctatacccctgaga

SEQ ID NO: 516200 - DNA, 25 bp, Mus musculus
acagtgtcttcacaaagaaaatggg

SEQ ID NO: 516201 - DNA, 25 bp, Mus musculus
acagtgtcttcagaaagaaaatggg

SEQ ID NO: 516202 - DNA, 25 bp, Mus musculus
acagtgtgactgatgggattcctcc

SEQ ID NO: 516203 - DNA, 25 bp, Mus musculus
acagtgtgactgttgggattcctcc

SEQ ID NO: 516204 - DNA, 25 bp, Mus musculus
acagtgtgtacacggccctgttcct

SEQ ID NO: 516205 - DNA, 25 bp, Mus musculus
acagtgtgtacagggccctgttcct

SEQ ID NO: 516206 - DNA, 25 bp, Mus musculus
acagtgttgaagacttcgtggctta

SEQ ID NO: 516207 - DNA, 25 bp, Mus musculus
acagtgttgaagtcttcgtggctta

SEQ ID NO: 516208 - DNA, 25 bp, Mus musculus
acagttaaggaaactcgagcagagg

SEQ ID NO: 516209 - DNA, 25 bp, Mus musculus
acagttaaggaatctcgagcagagg

SEQ ID NO: 516210 - DNA, 25 bp, Mus musculus
acagttaatgtgcaaatcttgcgac

SEQ ID NO: 516211 - DNA, 25 bp, Mus musculus
acagttaatgtggaaatcttgcgac

SEQ ID NO: 516212 - DNA, 25 bp, Mus musculus
acagttactactccgcctggaaatc

SEQ ID NO: 516213 - DNA, 25 bp, Mus musculus
acagttactactgcgcctggaaatc

SEQ ID NO: 516214 - DNA, 25 bp, Mus musculus
acagttagtaccaggtacctgcatg

SEQ ID NO: 516215 - DNA, 25 bp, Mus musculus
acagttagtacctggtacctgcatg

SEQ ID NO: 516216 - DNA, 25 bp, Mus musculus
acagttatctggaccacaggaggca

SEQ ID NO: 516217 - DNA, 25 bp, Mus musculus
acagttatctggtccacaggaggca

SEQ ID NO: 516218 - DNA, 25 bp, Mus musculus
acagttcagacaaggcccctgtggt

SEQ ID NO: 516219 - DNA, 25 bp, Mus musculus
acagttcagacatggcccctgtggt

SEQ ID NO: 516220 - DNA, 25 bp, Mus musculus
acagttcaggaaaatagtcgcattg

SEQ ID NO: 516221 - DNA, 25 bp, Mus musculus
acagttcaggaatatagtcgcattg

SEQ ID NO: 516222 - DNA, 25 bp, Mus musculus
acagttcatcataggacccggaggg

SEQ ID NO: 516223 - DNA, 25 bp, Mus musculus
acagttcatcattggacccggaggg

SEQ ID NO: 516224 - DNA, 25 bp, Mus musculus
acagttcatgctcaacaatcacacg

SEQ ID NO: 516225 - DNA, 25 bp, Mus musculus
acagttcatgctgaacaatcacacg

SEQ ID NO: 516226 - DNA, 25 bp, Mus musculus
acagttccccacctctgaacaaaat

SEQ ID NO: 516227 - DNA, 25 bp, Mus musculus
acagttccccacgtctgaacaaaat

SEQ ID NO: 516228 - DNA, 25 bp, Mus musculus
acagttccgggcctctctagctagc

SEQ ID NO: 516229 - DNA, 25 bp, Mus musculus
acagttccgggcgtctctagctagc

SEQ ID NO: 516230 - DNA, 25 bp, Mus musculus
acagttgactgcaatgtggctgtca

SEQ ID NO: 516231 - DNA, 25 bp, Mus musculus
acagttgactgctatgtggctgtca

SEQ ID NO: 516232 - DNA, 25 bp, Mus musculus
acagttgcctccatgctggaacgct

SEQ ID NO: 516233 - DNA, 25 bp, Mus musculus
acagttgcctccttgctggaacgct

SEQ ID NO: 516234 - DNA, 25 bp, Mus musculus
acagttgcgcgaacctgtcacctca

SEQ ID NO: 516235 - DNA, 25 bp, Mus musculus
acagttgcgcgatcctgtcacctca

SEQ ID NO: 516236 - DNA, 25 bp, Mus musculus
acagttgcgtgaaccggaaccagat

SEQ ID NO: 516237 - DNA, 25 bp, Mus musculus
acagttgcgtgatccggaaccagat

SEQ ID NO: 516238 - DNA, 25 bp, Mus musculus
acagttgctatgcagctcgctgagg

SEQ ID NO: 516239 - DNA, 25 bp, Mus musculus
acagttgctatggagctcgctgagg

SEQ ID NO: 516240 - DNA, 25 bp, Mus musculus
acagttggtaccctgggtcgcctca

SEQ ID NO: 516241 - DNA, 25 bp, Mus musculus
acagttggtaccgtgggtcgcctca

SEQ ID NO: 516242 - DNA, 25 bp, Mus musculus
acagttgtggccctcttttccttca

SEQ ID NO: 516243 - DNA, 25 bp, Mus musculus
acagttgtggccgtcttttccttca

SEQ ID NO: 516244 - DNA, 25 bp, Mus musculus
acagttgttcctcccatggtgggag

SEQ ID NO: 516245 - DNA, 25 bp, Mus musculus
acagttgttcctgccatggtgggag

SEQ ID NO: 516246 - DNA, 25 bp, Mus musculus
acagtttctcttccggccctgggat

SEQ ID NO: 516247 - DNA, 25 bp, Mus musculus
acagtttctcttgcggccctgggat

SEQ ID NO: 516248 - DNA, 25 bp, Mus musculus
acagtttgctgcagggtaaggagct

SEQ ID NO: 516249 - DNA, 25 bp, Mus musculus
acagtttgctgctgggtaaggagct

SEQ ID NO: 516250 - DNA, 25 bp, Mus musculus
acagttttgagaatccagtcctgca

SEQ ID NO: 516251 - DNA, 25 bp, Mus musculus
acagttttgagattccagtcctgca

SEQ ID NO: 516252 - DNA, 25 bp, Mus musculus
acagtttttccaacccaagccggtg

SEQ ID NO: 516253 - DNA, 25 bp, Mus musculus
acagtttttccatcccaagccggtg

SEQ ID NO: 516254 - DNA, 25 bp, Mus musculus
acagtttttggacgcagtctgtcag

SEQ ID NO: 516255 - DNA, 25 bp, Mus musculus
acagtttttggaggcagtctgtcag

SEQ ID NO: 516256 - DNA, 25 bp, Mus musculus
acataaaccatccttgctacagcct

SEQ ID NO: 516257 - DNA, 25 bp, Mus musculus
acataaaccatcgttgctacagcct

SEQ ID NO: 516258 - DNA, 25 bp, Mus musculus
acataaccactcactctgtgcacag

SEQ ID NO: 516259 - DNA, 25 bp, Mus musculus
acataaccactccaaaagctgccag

SEQ ID NO: 516260 - DNA, 25 bp, Mus musculus
acataaccactcgaaaagctgccag

SEQ ID NO: 516261 - DNA, 25 bp, Mus musculus
acataaccactctctctgtgcacag

SEQ ID NO: 516262 - DNA, 25 bp, Mus musculus
acataagcgaatctctgccttccga

SEQ ID NO: 516263 - DNA, 25 bp, Mus musculus
acataagcgaatgtctgccttccga

SEQ ID NO: 516264 - DNA, 25 bp, Mus musculus
acataatggagcacgaggcaccctt

SEQ ID NO: 516265 - DNA, 25 bp, Mus musculus
acataatggagctcgaggcaccctt

SEQ ID NO: 516266 - DNA, 25 bp, Mus musculus
acatacaaacaacgcaacgaggact

SEQ ID NO: 516267 - DNA, 25 bp, Mus musculus
acatacaaacaaggcaacgaggact

SEQ ID NO: 516268 - DNA, 25 bp, Mus musculus
acatacagacccagcttcccgggag

SEQ ID NO: 516269 - DNA, 25 bp, Mus musculus
acatacagaccctgcttcccgggag

SEQ ID NO: 516270 - DNA, 25 bp, Mus musculus
acatacagagatcgtcgagtggcac

SEQ ID NO: 516271 - DNA, 25 bp, Mus musculus
acatacagagatggtcgagtggcac

SEQ ID NO: 516272 - DNA, 25 bp, Mus musculus
acatacattcaaaagagaccgggac

SEQ ID NO: 516273 - DNA, 25 bp, Mus musculus
acatacattcaatagagaccgggac

SEQ ID NO: 516274 - DNA, 25 bp, Mus musculus
acataccaccttcggcatcatgtga

SEQ ID NO: 516275 - DNA, 25 bp, Mus musculus
acataccaccttgggcatcatgtga

SEQ ID NO: 516276 - DNA, 25 bp, Mus musculus
acatacctacagctgggaagtgaga

SEQ ID NO: 516277 - DNA, 25 bp, Mus musculus
acatacctacaggtgggaagtgaga

SEQ ID NO: 516278 - DNA, 25 bp, Mus musculus
acatacggcggaaacccactaggct

SEQ ID NO: 516279 - DNA, 25 bp, Mus musculus
acatacggcggatacccactaggct

SEQ ID NO: 516280 - DNA, 25 bp, Mus musculus
acatactcagaaactctctccagac

SEQ ID NO: 516281 - DNA, 25 bp, Mus musculus
acatactcagaatctctctccagac

SEQ ID NO: 516282 - DNA, 25 bp, Mus musculus
acatactcccagacctggcagagca

SEQ ID NO: 516283 - DNA, 25 bp, Mus musculus
acatactcccagtcctggcagagca

SEQ ID NO: 516284 - DNA, 25 bp, Mus musculus
acatagaatcggagcccctggagtt

SEQ ID NO: 516285 - DNA, 25 bp, Mus musculus
acatagaatcggtgcccctggagtt

SEQ ID NO: 516286 - DNA, 25 bp, Mus musculus
acatagagaaccacgcctgcctggg

SEQ ID NO: 516287 - DNA, 25 bp, Mus musculus
acatagagaacctcgcctgcctggg

SEQ ID NO: 516288 - DNA, 25 bp, Mus musculus
acatagaggcctctaccactgactg

SEQ ID NO: 516289 - DNA, 25 bp, Mus musculus
acatagaggcctgtaccactgactg

SEQ ID NO: 516290 - DNA, 25 bp, Mus musculus
acatagatgaagagcagaagtcaga

SEQ ID NO: 516291 - DNA, 25 bp, Mus musculus
acatagatgaagtgcagaagtcaga

SEQ ID NO: 516292 - DNA, 25 bp, Mus musculus
acatagcaagctccacaagggaact

SEQ ID NO: 516293 - DNA, 25 bp, Mus musculus
acatagcaagctgcacaagggaact

SEQ ID NO: 516294 - DNA, 25 bp, Mus musculus
acatagcaattaaggtaggaggagg

SEQ ID NO: 516295 - DNA, 25 bp, Mus musculus
acatagcaattatggtaggaggagg

SEQ ID NO: 516296 - DNA, 25 bp, Mus musculus
acatagccaacaacgggcgcctggt

SEQ ID NO: 516297 - DNA, 25 bp, Mus musculus
acatagccaacatcgggcgcctggt

SEQ ID NO: 516298 - DNA, 25 bp, Mus musculus
acatagccaagtcccaggatgctga

SEQ ID NO: 516299 - DNA, 25 bp, Mus musculus
acatagccaagtgccaggatgctga

SEQ ID NO: 516300 - DNA, 25 bp, Mus musculus
acataggacttgaatgtgacagagt

SEQ ID NO: 516301 - DNA, 25 bp, Mus musculus
acataggacttgtatgtgacagagt

SEQ ID NO: 516302 - DNA, 25 bp, Mus musculus
acataggtgagaagcattgccgtcc

SEQ ID NO: 516303 - DNA, 25 bp, Mus musculus
acataggtgagatgcattgccgtcc

SEQ ID NO: 516304 - DNA, 25 bp, Mus musculus
acatatactcgacgctgttgcggga

SEQ ID NO: 516305 - DNA, 25 bp, Mus musculus
acatatactcgaggctgttgcggga

SEQ ID NO: 516306 - DNA, 25 bp, Mus musculus
acatatcccactactgctccggaaa

SEQ ID NO: 516307 - DNA, 25 bp, Mus musculus
acatatcccacttctgctccggaaa

SEQ ID NO: 516308 - DNA, 25 bp, Mus musculus
acatatgtagtgattggagatggac

SEQ ID NO: 516309 - DNA, 25 bp, Mus musculus
acatatgtagtgtttggagatggac

SEQ ID NO: 516310 - DNA, 25 bp, Mus musculus
acatatgtttcaacttttcctcggg

SEQ ID NO: 516311 - DNA, 25 bp, Mus musculus
acatatgtttcatcttttcctcggg

SEQ ID NO: 516312 - DNA, 25 bp, Mus musculus
acatcaacagaacgaggtgcagcct

SEQ ID NO: 516313 - DNA, 25 bp, Mus musculus
acatcaacagaaggaggtgcagcct

SEQ ID NO: 516314 - DNA, 25 bp, Mus musculus
acatcaagaacaaccccgaatattc

SEQ ID NO: 516315 - DNA, 25 bp, Mus musculus
acatcaagaacatccccgaatattc

SEQ ID NO: 516316 - DNA, 25 bp, Mus musculus
acatcaagacctctctgatgatgac

SEQ ID NO: 516317 - DNA, 25 bp, Mus musculus
acatcaagacctgtctgatgatgac

SEQ ID NO: 516318 - DNA, 25 bp, Mus musculus
acatcaagatgcattgctgtgtggc

SEQ ID NO: 516319 - DNA, 25 bp, Mus musculus
acatcaagatgctttgctgtgtggc

SEQ ID NO: 516320 - DNA, 25 bp, Mus musculus
acatcaagcaggaagggattggagc

SEQ ID NO: 516321 - DNA, 25 bp, Mus musculus
acatcaagcaggtagggattggagc

SEQ ID NO: 516322 - DNA, 25 bp, Mus musculus
acatcaagggctcgatccggatgca

SEQ ID NO: 516323 - DNA, 25 bp, Mus musculus
acatcaagggctggatccggatgca

SEQ ID NO: 516324 - DNA, 25 bp, Mus musculus
acatcaattttcagtgctctttggg

SEQ ID NO: 516325 - DNA, 25 bp, Mus musculus
acatcaattttctgtgctctttggg

SEQ ID NO: 516326 - DNA, 25 bp, Mus musculus
acatcaccaaccagtcctcttttga

SEQ ID NO: 516327 - DNA, 25 bp, Mus musculus
acatcaccaacctgtcctcttttga

SEQ ID NO: 516328 - DNA, 25 bp, Mus musculus
acatcaccacagctcttcgggacaa

SEQ ID NO: 516329 - DNA, 25 bp, Mus musculus
acatcaccacaggtcttcgggacaa

SEQ ID NO: 516330 - DNA, 25 bp, Mus musculus
acatcaccatggacatctgtcctgg

SEQ ID NO: 516331 - DNA, 25 bp, Mus musculus
acatcaccatggtcatctgtcctgg

SEQ ID NO: 516332 - DNA, 25 bp, Mus musculus
acatcacctaccagagacagcctga

SEQ ID NO: 516333 - DNA, 25 bp, Mus musculus
acatcacctacctgagacagcctga

SEQ ID NO: 516334 - DNA, 25 bp, Mus musculus
acatcacgctggagctccatggaga

SEQ ID NO: 516335 - DNA, 25 bp, Mus musculus
acatcacgctggtgctccatggaga

SEQ ID NO: 516336 - DNA, 25 bp, Mus musculus
acatcactggcaattacgcttctca

SEQ ID NO: 516337 - DNA, 25 bp, Mus musculus
acatcactggcatttacgcttctca

SEQ ID NO: 516338 - DNA, 25 bp, Mus musculus
acatcactgtagatgcccattcaag

SEQ ID NO: 516339 - DNA, 25 bp, Mus musculus
acatcactgtagttgcccattcaag

SEQ ID NO: 516340 - DNA, 25 bp, Mus musculus
acatcagacgccacagggcttgatg

SEQ ID NO: 516341 - DNA, 25 bp, Mus musculus
acatcagacgcctcagggcttgatg

SEQ ID NO: 516342 - DNA, 25 bp, Mus musculus
acatcagagccccagtacagtctac

SEQ ID NO: 516343 - DNA, 25 bp, Mus musculus
acatcagagcccgagtacagtctac

SEQ ID NO: 516344 - DNA, 25 bp, Mus musculus
acatcagcaacgctggacatccagg

SEQ ID NO: 516345 - DNA, 25 bp, Mus musculus
acatcagcaacggtggacatccagg

SEQ ID NO: 516346 - DNA, 25 bp, Mus musculus
acatcaggacaaccctcatgaggga

SEQ ID NO: 516347 - DNA, 25 bp, Mus musculus
acatcaggacaagcctcatgaggga

SEQ ID NO: 516348 - DNA, 25 bp, Mus musculus
acatcagggctgctgcccatgtatg

SEQ ID NO: 516349 - DNA, 25 bp, Mus musculus
acatcagggctggtgcccatgtatg

SEQ ID NO: 516350 - DNA, 25 bp, Mus musculus
acatcagggtggcatggctgcccct

SEQ ID NO: 516351 - DNA, 25 bp, Mus musculus
acatcagggtgggatggctgcccct

SEQ ID NO: 516352 - DNA, 25 bp, Mus musculus
acatcagtgcccacgaggtcggagg

SEQ ID NO: 516353 - DNA, 25 bp, Mus musculus
acatcagtgccctcgaggtcggagg

SEQ ID NO: 516354 - DNA, 25 bp, Mus musculus
acatcagtgcggcagaactgcgcca

SEQ ID NO: 516355 - DNA, 25 bp, Mus musculus
acatcagtgcgggagaactgcgcca

SEQ ID NO: 516356 - DNA, 25 bp, Mus musculus
acatcagtggcgcatggagataaac

SEQ ID NO: 516357 - DNA, 25 bp, Mus musculus
acatcagtggcggatggagataaac

SEQ ID NO: 516358 - DNA, 25 bp, Mus musculus
acatcagtgggaaccctggcctgtg

SEQ ID NO: 516359 - DNA, 25 bp, Mus musculus
acatcagtgggatccctggcctgtg

SEQ ID NO: 516360 - DNA, 25 bp, Mus musculus
acatcatcatgcacattgtggaggg

SEQ ID NO: 516361 - DNA, 25 bp, Mus musculus
acatcatcatgctcattgtggaggg

SEQ ID NO: 516362 - DNA, 25 bp, Mus musculus
acatcatccaagactgagccagtcc

SEQ ID NO: 516363 - DNA, 25 bp, Mus musculus
acatcatccaagtctgagccagtcc

SEQ ID NO: 516364 - DNA, 25 bp, Mus musculus
acatcatcccatagagaaccccagg

SEQ ID NO: 516365 - DNA, 25 bp, Mus musculus
acatcatcccattgagaaccccagg

SEQ ID NO: 516366 - DNA, 25 bp, Mus musculus
acatcatccgggagcttgccactaa

SEQ ID NO: 516367 - DNA, 25 bp, Mus musculus
acatcatccgggtgcttgccactaa

SEQ ID NO: 516368 - DNA, 25 bp, Mus musculus
acatcatccttgatctttctggaaa

SEQ ID NO: 516369 - DNA, 25 bp, Mus musculus
acatcatccttgttctttctggaaa

SEQ ID NO: 516370 - DNA, 25 bp, Mus musculus
acatcatgatggagcgggagcgcaa

SEQ ID NO: 516371 - DNA, 25 bp, Mus musculus
acatcatgatggtgcgggagcgcaa

SEQ ID NO: 516372 - DNA, 25 bp, Mus musculus
acatcatgcggcagggaaagggcca

SEQ ID NO: 516373 - DNA, 25 bp, Mus musculus
acatcatgcggctgggaaagggcca

SEQ ID NO: 516374 - DNA, 25 bp, Mus musculus
acatcatgctgcagcgctgccgaga

SEQ ID NO: 516375 - DNA, 25 bp, Mus musculus
acatcatgctgctgcgctgccgaga

SEQ ID NO: 516376 - DNA, 25 bp, Mus musculus
acatcatggtataccccttactaaa

SEQ ID NO: 516377 - DNA, 25 bp, Mus musculus
acatcatggtattccccttactaaa

SEQ ID NO: 516378 - DNA, 25 bp, Mus musculus
acatcatgttgcaggacaagcacgc

SEQ ID NO: 516379 - DNA, 25 bp, Mus musculus
acatcatgttgctggacaagcacgc

SEQ ID NO: 516380 - DNA, 25 bp, Mus musculus
acatcattaagaagaagggatggag

SEQ ID NO: 516381 - DNA, 25 bp, Mus musculus
acatcattaagatgaagggatggag

SEQ ID NO: 516382 - DNA, 25 bp, Mus musculus
acatcattacataaagggctgaaga

SEQ ID NO: 516383 - DNA, 25 bp, Mus musculus
acatcattacattaagggctgaaga

SEQ ID NO: 516384 - DNA, 25 bp, Mus musculus
acatcattggcaagaacctcctggc

SEQ ID NO: 516385 - DNA, 25 bp, Mus musculus
acatcattggcatgaacctcctggc

SEQ ID NO: 516386 - DNA, 25 bp, Mus musculus
acatcatttcagctttccgtccatc

SEQ ID NO: 516387 - DNA, 25 bp, Mus musculus
acatcatttcaggtttccgtccatc

SEQ ID NO: 516388 - DNA, 25 bp, Mus musculus
acatcattttggacctcactcccaa

SEQ ID NO: 516389 - DNA, 25 bp, Mus musculus
acatcattttggtcctcactcccaa

SEQ ID NO: 516390 - DNA, 25 bp, Mus musculus
acatccagagccaggtgcgaacctt

SEQ ID NO: 516391 - DNA, 25 bp, Mus musculus
acatccagagcctggtgcgaacctt

SEQ ID NO: 516392 - DNA, 25 bp, Mus musculus
acatccagcaagacaggcaaaagtg

SEQ ID NO: 516393 - DNA, 25 bp, Mus musculus
acatccagcaagtcaggcaaaagtg

SEQ ID NO: 516394 - DNA, 25 bp, Mus musculus
acatccaggtgacggacagggagcc

SEQ ID NO: 516395 - DNA, 25 bp, Mus musculus
acatccaggtgagggacagggagcc

SEQ ID NO: 516396 - DNA, 25 bp, Mus musculus
acatccaggtggcagacctcatcct

SEQ ID NO: 516397 - DNA, 25 bp, Mus musculus
acatccaggtgggagacctcatcct

SEQ ID NO: 516398 - DNA, 25 bp, Mus musculus
acatcccaaggtatggtctcccgac

SEQ ID NO: 516399 - DNA, 25 bp, Mus musculus
acatcccaaggtttggtctcccgac

SEQ ID NO: 516400 - DNA, 25 bp, Mus musculus
acatccccagtgacaagcagcgttt

SEQ ID NO: 516401 - DNA, 25 bp, Mus musculus
acatccccagtgtcaagcagcgttt

SEQ ID NO: 516402 - DNA, 25 bp, Mus musculus
acatcccctacgaggacccaagtgg

SEQ ID NO: 516403 - DNA, 25 bp, Mus musculus
acatcccctacgtggacccaagtgg

SEQ ID NO: 516404 - DNA, 25 bp, Mus musculus
acatcccctcggaattccaggcagg

SEQ ID NO: 516405 - DNA, 25 bp, Mus musculus
acatcccctcggtattccaggcagg

SEQ ID NO: 516406 - DNA, 25 bp, Mus musculus
acatcccctggtatgtgctggctgg

SEQ ID NO: 516407 - DNA, 25 bp, Mus musculus
acatcccctggtttgtgctggctgg

SEQ ID NO: 516408 - DNA, 25 bp, Mus musculus
acatcccgagcactgaactacgcgt

SEQ ID NO: 516409 - DNA, 25 bp, Mus musculus
acatcccgagcagtgaactacgcgt

SEQ ID NO: 516410 - DNA, 25 bp, Mus musculus
acatccctcagcaccagcagcaggt

SEQ ID NO: 516411 - DNA, 25 bp, Mus musculus
acatccctcagctccagcagcaggt

SEQ ID NO: 516412 - DNA, 25 bp, Mus musculus
acatccctgatgcagattgatgaca

SEQ ID NO: 516413 - DNA, 25 bp, Mus musculus
acatccctgatggagattgatgaca

SEQ ID NO: 516414 - DNA, 25 bp, Mus musculus
acatccctgcatcgctcctggtgga

SEQ ID NO: 516415 - DNA, 25 bp, Mus musculus
acatccctgcatggctcctggtgga

SEQ ID NO: 516416 - DNA, 25 bp, Mus musculus
acatccgcagcacggtgttccggga

SEQ ID NO: 516417 - DNA, 25 bp, Mus musculus
acatccgcagcagggtgttccggga

SEQ ID NO: 516418 - DNA, 25 bp, Mus musculus
acatccggcggcctgtctacgatgc

SEQ ID NO: 516419 - DNA, 25 bp, Mus musculus
acatccggcggcgtgtctacgatgc

SEQ ID NO: 516420 - DNA, 25 bp, Mus musculus
acatccgggcgaccttcaagaggct

SEQ ID NO: 516421 - DNA, 25 bp, Mus musculus
acatccgggcgagcttcaagaggct

SEQ ID NO: 516422 - DNA, 25 bp, Mus musculus
acatccgtgactctgctgcagccgt

SEQ ID NO: 516423 - DNA, 25 bp, Mus musculus
acatccgtgactgtgctgcagccgt

SEQ ID NO: 516424 - DNA, 25 bp, Mus musculus
acatcctagaggagcgagccgcgcc

SEQ ID NO: 516425 - DNA, 25 bp, Mus musculus
acatcctagaggtgcgagccgcgcc

SEQ ID NO: 516426 - DNA, 25 bp, Mus musculus
acatcctatgagagtagtggatcag

SEQ ID NO: 516427 - DNA, 25 bp, Mus musculus
acatcctatgagtgtagtggatcag

SEQ ID NO: 516428 - DNA, 25 bp, Mus musculus
acatcctcaggtctctgtgcagatc

SEQ ID NO: 516429 - DNA, 25 bp, Mus musculus
acatcctcaggtgtctgtgcagatc

SEQ ID NO: 516430 - DNA, 25 bp, Mus musculus
acatcctgaaggagagggctgagct

SEQ ID NO: 516431 - DNA, 25 bp, Mus musculus
acatcctgaaggtgagggctgagct

SEQ ID NO: 516432 - DNA, 25 bp, Mus musculus
acatcctgcgcgaactgtcagacca

SEQ ID NO: 516433 - DNA, 25 bp, Mus musculus
acatcctgcgcgtactgtcagacca

SEQ ID NO: 516434 - DNA, 25 bp, Mus musculus
acatcctggtgacctgagcagaggc

SEQ ID NO: 516435 - DNA, 25 bp, Mus musculus
acatcctggtgagctgagcagaggc

SEQ ID NO: 516436 - DNA, 25 bp, Mus musculus
acatccttaggaatgctttggtgtc

SEQ ID NO: 516437 - DNA, 25 bp, Mus musculus
acatccttaggattgctttggtgtc

SEQ ID NO: 516438 - DNA, 25 bp, Mus musculus
acatccttggctctatggctctacg

SEQ ID NO: 516439 - DNA, 25 bp, Mus musculus
acatccttggctgtatggctctacg

SEQ ID NO: 516440 - DNA, 25 bp, Mus musculus
acatccttttcactcctctgtgaag

SEQ ID NO: 516441 - DNA, 25 bp, Mus musculus
acatccttttcagtcctctgtgaag

SEQ ID NO: 516442 - DNA, 25 bp, Mus musculus
acatcgaaattacgaggagcccacg

SEQ ID NO: 516443 - DNA, 25 bp, Mus musculus
acatcgaaattaggaggagcccacg

SEQ ID NO: 516444 - DNA, 25 bp, Mus musculus
acatcgacattcacaacttcctggg

SEQ ID NO: 516445 - DNA, 25 bp, Mus musculus
acatcgacattctcaacttcctggg

SEQ ID NO: 516446 - DNA, 25 bp, Mus musculus
acatcgacgagtcctctcttggaca

SEQ ID NO: 516447 - DNA, 25 bp, Mus musculus
acatcgacgagtctcgcgaccctag

SEQ ID NO: 516448 - DNA, 25 bp, Mus musculus
acatcgacgagtgctctcttggaca

SEQ ID NO: 516449 - DNA, 25 bp, Mus musculus
acatcgacgagtgtcgcgaccctag

SEQ ID NO: 516450 - DNA, 25 bp, Mus musculus
acatcgaggcctctgtagatctgca

SEQ ID NO: 516451 - DNA, 25 bp, Mus musculus
acatcgaggcctgtgtagatctgca

SEQ ID NO: 516452 - DNA, 25 bp, Mus musculus
acatcgaggcgcacaagaagcttaa

SEQ ID NO: 516453 - DNA, 25 bp, Mus musculus
acatcgaggcgctcaagaagcttaa

SEQ ID NO: 516454 - DNA, 25 bp, Mus musculus
acatcgagtgctaccgctgctccgt

SEQ ID NO: 516455 - DNA, 25 bp, Mus musculus
acatcgagtgcttccgctgctccgt

SEQ ID NO: 516456 - DNA, 25 bp, Mus musculus
acatcgcagatcatgcaggcaatcc

SEQ ID NO: 516457 - DNA, 25 bp, Mus musculus
acatcgcagatcttgcaggcaatcc

SEQ ID NO: 516458 - DNA, 25 bp, Mus musculus
acatcgcagcgaaagagaagctgct

SEQ ID NO: 516459 - DNA, 25 bp, Mus musculus
acatcgcagcgatagagaagctgct

SEQ ID NO: 516460 - DNA, 25 bp, Mus musculus
acatcgccccagctccaagaattaa

SEQ ID NO: 516461 - DNA, 25 bp, Mus musculus
acatcgccccaggtccaagaattaa

SEQ ID NO: 516462 - DNA, 25 bp, Mus musculus
acatcgggcacgaggacttcctaca

SEQ ID NO: 516463 - DNA, 25 bp, Mus musculus
acatcgggcacgtggacttcctaca

SEQ ID NO: 516464 - DNA, 25 bp, Mus musculus
acatcgggctcaaccttctcaatga

SEQ ID NO: 516465 - DNA, 25 bp, Mus musculus
acatcgggctcatccttctcaatga

SEQ ID NO: 516466 - DNA, 25 bp, Mus musculus
acatcggtgaatccctgacggtgcc

SEQ ID NO: 516467 - DNA, 25 bp, Mus musculus
acatcggtgaatgcctgacggtgcc

SEQ ID NO: 516468 - DNA, 25 bp, Mus musculus
acatcgtgaagtcccagaagctgac

SEQ ID NO: 516469 - DNA, 25 bp, Mus musculus
acatcgtgaagtgccagaagctgac

SEQ ID NO: 516470 - DNA, 25 bp, Mus musculus
acatcgtgcgggatgcagtggcccc

SEQ ID NO: 516471 - DNA, 25 bp, Mus musculus
acatcgtgcgggttgcagtggcccc

SEQ ID NO: 516472 - DNA, 25 bp, Mus musculus
acatcgtggtggcaggacactccaa

SEQ ID NO: 516473 - DNA, 25 bp, Mus musculus
acatcgtggtgggaggacactccaa

SEQ ID NO: 516474 - DNA, 25 bp, Mus musculus
acatcgttactgcagccttgccgct

SEQ ID NO: 516475 - DNA, 25 bp, Mus musculus
acatcgttactggagccttgccgct

SEQ ID NO: 516476 - DNA, 25 bp, Mus musculus
acatctaccagaagcgctgtgaggc

SEQ ID NO: 516477 - DNA, 25 bp, Mus musculus
acatctaccagatgcgctgtgaggc

SEQ ID NO: 516478 - DNA, 25 bp, Mus musculus
acatctacccggagcagttctccta

SEQ ID NO: 516479 - DNA, 25 bp, Mus musculus
acatctacccggtgcagttctccta

SEQ ID NO: 516480 - DNA, 25 bp, Mus musculus
acatctacgtggaccctgtgcagtt

SEQ ID NO: 516481 - DNA, 25 bp, Mus musculus
acatctacgtggtccctgtgcagtt

SEQ ID NO: 516482 - DNA, 25 bp, Mus musculus
acatctactgatcctagacacttgg

SEQ ID NO: 516483 - DNA, 25 bp, Mus musculus
acatctactgatcgctcctacaagc

SEQ ID NO: 516484 - DNA, 25 bp, Mus musculus
acatctactgatgctagacacttgg

SEQ ID NO: 516485 - DNA, 25 bp, Mus musculus
acatctactgatggctcctacaagc

SEQ ID NO: 516486 - DNA, 25 bp, Mus musculus
acatctaggactcggcagagcttgg

SEQ ID NO: 516487 - DNA, 25 bp, Mus musculus
acatctaggactgggcagagcttgg

SEQ ID NO: 516488 - DNA, 25 bp, Mus musculus
acatctatgagaagagcggtgccaa

SEQ ID NO: 516489 - DNA, 25 bp, Mus musculus
acatctatgagatgagcggtgccaa

SEQ ID NO: 516490 - DNA, 25 bp, Mus musculus
acatctatgcccaccatcggaacag

SEQ ID NO: 516491 - DNA, 25 bp, Mus musculus
acatctatgccctccatcggaacag

SEQ ID NO: 516492 - DNA, 25 bp, Mus musculus
acatctatggccatggtggccggca

SEQ ID NO: 516493 - DNA, 25 bp, Mus musculus
acatctatggccttggtggccggca

SEQ ID NO: 516494 - DNA, 25 bp, Mus musculus
acatctcagaaaacgggagaagtgc

SEQ ID NO: 516495 - DNA, 25 bp, Mus musculus
acatctcagaaatcgggagaagtgc

SEQ ID NO: 516496 - DNA, 25 bp, Mus musculus
acatctccgagcacacttgcgctgg

SEQ ID NO: 516497 - DNA, 25 bp, Mus musculus
acatctccgagctcacttgcgctgg

SEQ ID NO: 516498 - DNA, 25 bp, Mus musculus
acatctcctttgctgccaaagacct

SEQ ID NO: 516499 - DNA, 25 bp, Mus musculus
acatctcctttggtgccaaagacct

SEQ ID NO: 516500 - DNA, 25 bp, Mus musculus
acatctctgctgaagtagacaaaga

SEQ ID NO: 516501 - DNA, 25 bp, Mus musculus
acatctctgctgtagtagacaaaga

SEQ ID NO: 516502 - DNA, 25 bp, Mus musculus
acatctctggcccaaagcaatccaa

SEQ ID NO: 516503 - DNA, 25 bp, Mus musculus
acatctctggccgaaagcaatccaa

SEQ ID NO: 516504 - DNA, 25 bp, Mus musculus
acatctcttaacaagctgttggagg

SEQ ID NO: 516505 - DNA, 25 bp, Mus musculus
acatctcttaactagctgttggagg

SEQ ID NO: 516506 - DNA, 25 bp, Mus musculus
acatctgactagcaaaggccctggg

SEQ ID NO: 516507 - DNA, 25 bp, Mus musculus
acatctgactaggaaaggccctggg

SEQ ID NO: 516508 - DNA, 25 bp, Mus musculus
acatctgattctcccgtggttgcca

SEQ ID NO: 516509 - DNA, 25 bp, Mus musculus
acatctgattctgccgtggttgcca

SEQ ID NO: 516510 - DNA, 25 bp, Mus musculus
acatctgatttgaaggcagactcaa

SEQ ID NO: 516511 - DNA, 25 bp, Mus musculus
acatctgatttgtaggcagactcaa

SEQ ID NO: 516512 - DNA, 25 bp, Mus musculus
acatctgcaaggaggccccaagagg

SEQ ID NO: 516513 - DNA, 25 bp, Mus musculus
acatctgcaaggtggccccaagagg

SEQ ID NO: 516514 - DNA, 25 bp, Mus musculus
acatctgcctggagcgggtgatccc

SEQ ID NO: 516515 - DNA, 25 bp, Mus musculus
acatctgcctggtgcgggtgatccc

SEQ ID NO: 516516 - DNA, 25 bp, Mus musculus
acatctgccttaagggagaccctgg

SEQ ID NO: 516517 - DNA, 25 bp, Mus musculus
acatctgccttatgggagaccctgg

SEQ ID NO: 516518 - DNA, 25 bp, Mus musculus
acatctgctaaaagcccaggcccaa

SEQ ID NO: 516519 - DNA, 25 bp, Mus musculus
acatctgctaaatgcccaggcccaa

SEQ ID NO: 516520 - DNA, 25 bp, Mus musculus
acatctgtgtggacggagtctgccg

SEQ ID NO: 516521 - DNA, 25 bp, Mus musculus
acatctgtgtggtcggagtctgccg

SEQ ID NO: 516522 - DNA, 25 bp, Mus musculus
acatcttactgtaccgacggccact

SEQ ID NO: 516523 - DNA, 25 bp, Mus musculus
acatcttactgttccgacggccact

SEQ ID NO: 516524 - DNA, 25 bp, Mus musculus
acatcttatactccattgtggacag

SEQ ID NO: 516525 - DNA, 25 bp, Mus musculus
acatcttatactgcattgtggacag

SEQ ID NO: 516526 - DNA, 25 bp, Mus musculus
acatcttctggacgcagaattgtgg

SEQ ID NO: 516527 - DNA, 25 bp, Mus musculus
acatcttctggaggcagaattgtgg

SEQ ID NO: 516528 - DNA, 25 bp, Mus musculus
acatcttgagcgagaaggcatcttc

SEQ ID NO: 516529 - DNA, 25 bp, Mus musculus
acatcttgagcgtgaaggcatcttc

SEQ ID NO: 516530 - DNA, 25 bp, Mus musculus
acatcttgagttcatggaagacatt

SEQ ID NO: 516531 - DNA, 25 bp, Mus musculus
acatcttgagttgatggaagacatt

SEQ ID NO: 516532 - DNA, 25 bp, Mus musculus
acatcttgctacagtggtgacagga

SEQ ID NO: 516533 - DNA, 25 bp, Mus musculus
acatcttgctactgtggtgacagga

SEQ ID NO: 516534 - DNA, 25 bp, Mus musculus
acatgaaagcgtagactcacctgga

SEQ ID NO: 516535 - DNA, 25 bp, Mus musculus
acatgaaagcgttgactcacctgga

SEQ ID NO: 516536 - DNA, 25 bp, Mus musculus
acatgaaaggataaagggctccttc

SEQ ID NO: 516537 - DNA, 25 bp, Mus musculus
acatgaaaggattaagggctccttc

SEQ ID NO: 516538 - DNA, 25 bp, Mus musculus
acatgaaagtccacgatgacctgaa

SEQ ID NO: 516539 - DNA, 25 bp, Mus musculus
acatgaaagtcctcgatgacctgaa

SEQ ID NO: 516540 - DNA, 25 bp, Mus musculus
acatgaaccatgagcgcatcccttt

SEQ ID NO: 516541 - DNA, 25 bp, Mus musculus
acatgaaccatgtgcgcatcccttt

SEQ ID NO: 516542 - DNA, 25 bp, Mus musculus
acatgaagatgtcaagaaggcgctg

SEQ ID NO: 516543 - DNA, 25 bp, Mus musculus
acatgaagatgtgaagaaggcgctg

SEQ ID NO: 516544 - DNA, 25 bp, Mus musculus
acatgaaggatcagatgtcagcttc

SEQ ID NO: 516545 - DNA, 25 bp, Mus musculus
acatgaaggatctgatgtcagcttc

SEQ ID NO: 516546 - DNA, 25 bp, Mus musculus
acatgaaggccaaccccattcaggg

SEQ ID NO: 516547 - DNA, 25 bp, Mus musculus
acatgaaggccatccccattcaggg

SEQ ID NO: 516548 - DNA, 25 bp, Mus musculus
acatgaagtcttagagagagacatc

SEQ ID NO: 516549 - DNA, 25 bp, Mus musculus
acatgaagtctttgagagagacatc

SEQ ID NO: 516550 - DNA, 25 bp, Mus musculus
acatgaatctgaaggtggaagaaca

SEQ ID NO: 516551 - DNA, 25 bp, Mus musculus
acatgaatctgatggtggaagaaca

SEQ ID NO: 516552 - DNA, 25 bp, Mus musculus
acatgaatggacacagccctaccca

SEQ ID NO: 516553 - DNA, 25 bp, Mus musculus
acatgaatggactcagccctaccca

SEQ ID NO: 516554 - DNA, 25 bp, Mus musculus
acatgacattttaacgcttcctgaa

SEQ ID NO: 516555 - DNA, 25 bp, Mus musculus
acatgacatttttacgcttcctgaa

SEQ ID NO: 516556 - DNA, 25 bp, Mus musculus
acatgaccatgtatgtcactgcatc

SEQ ID NO: 516557 - DNA, 25 bp, Mus musculus
acatgaccatgtttgtcactgcatc

SEQ ID NO: 516558 - DNA, 25 bp, Mus musculus
acatgacggtcgaccccagcgatag

SEQ ID NO: 516559 - DNA, 25 bp, Mus musculus
acatgacggtcgtccccagcgatag

SEQ ID NO: 516560 - DNA, 25 bp, Mus musculus
acatgactgtctcgagtgaagaggt

SEQ ID NO: 516561 - DNA, 25 bp, Mus musculus
acatgactgtctggagtgaagaggt

SEQ ID NO: 516562 - DNA, 25 bp, Mus musculus
acatgagcctgtccctgctgatctg

SEQ ID NO: 516563 - DNA, 25 bp, Mus musculus
acatgagcctgtgcctgctgatctg

SEQ ID NO: 516564 - DNA, 25 bp, Mus musculus
acatgaggaaccacaaagcccacct

SEQ ID NO: 516565 - DNA, 25 bp, Mus musculus
acatgaggaacctcaaagcccacct

SEQ ID NO: 516566 - DNA, 25 bp, Mus musculus
acatgaggacagaccgcaggctgca

SEQ ID NO: 516567 - DNA, 25 bp, Mus musculus
acatgaggacagtccgcaggctgca

SEQ ID NO: 516568 - DNA, 25 bp, Mus musculus
acatgaggaccacctttagatgttc

SEQ ID NO: 516569 - DNA, 25 bp, Mus musculus
acatgaggaccagctttagatgttc

SEQ ID NO: 516570 - DNA, 25 bp, Mus musculus
acatgaggacccctttttgtggcta

SEQ ID NO: 516571 - DNA, 25 bp, Mus musculus
acatgaggacccgtttttgtggcta

SEQ ID NO: 516572 - DNA, 25 bp, Mus musculus
acatgaggagttcctggtgctcact

SEQ ID NO: 516573 - DNA, 25 bp, Mus musculus
acatgaggagttgctggtgctcact

SEQ ID NO: 516574 - DNA, 25 bp, Mus musculus
acatgaggccaacaagtatgcttcc

SEQ ID NO: 516575 - DNA, 25 bp, Mus musculus
acatgaggccaagaagtatgcttcc

SEQ ID NO: 516576 - DNA, 25 bp, Mus musculus
acatgaggtgaacccagcctatgcc

SEQ ID NO: 516577 - DNA, 25 bp, Mus musculus
acatgaggtgaagccagcctatgcc

SEQ ID NO: 516578 - DNA, 25 bp, Mus musculus
acatgagttctgagttcctgcgctt

SEQ ID NO: 516579 - DNA, 25 bp, Mus musculus
acatgagttctgtgttcctgcgctt

SEQ ID NO: 516580 - DNA, 25 bp, Mus musculus
acatgatatctgagcagctgaccca

SEQ ID NO: 516581 - DNA, 25 bp, Mus musculus
acatgatatctgtgcagctgaccca

SEQ ID NO: 516582 - DNA, 25 bp, Mus musculus
acatgatcaagcaggagggagatgc

SEQ ID NO: 516583 - DNA, 25 bp, Mus musculus
acatgatcaagctggagggagatgc

SEQ ID NO: 516584 - DNA, 25 bp, Mus musculus
acatgatcgatgacgccttcgcgcg

SEQ ID NO: 516585 - DNA, 25 bp, Mus musculus
acatgatcgatgtcgccttcgcgcg

SEQ ID NO: 516586 - DNA, 25 bp, Mus musculus
acatgatgcagaagctctcggtgca

SEQ ID NO: 516587 - DNA, 25 bp, Mus musculus
acatgatgcagatgctctcggtgca

SEQ ID NO: 516588 - DNA, 25 bp, Mus musculus
acatgattaatgaggtggatgctga

SEQ ID NO: 516589 - DNA, 25 bp, Mus musculus
acatgattaatgtggtggatgctga

SEQ ID NO: 516590 - DNA, 25 bp, Mus musculus
acatgcaaactgaggatggagtgga

SEQ ID NO: 516591 - DNA, 25 bp, Mus musculus
acatgcaaactgtggatggagtgga

SEQ ID NO: 516592 - DNA, 25 bp, Mus musculus
acatgcacagaaagagcttcagaag

SEQ ID NO: 516593 - DNA, 25 bp, Mus musculus
acatgcacagaatgagcttcagaag

SEQ ID NO: 516594 - DNA, 25 bp, Mus musculus
acatgcacctggatacatccctggc

SEQ ID NO: 516595 - DNA, 25 bp, Mus musculus
acatgcacctggttacatccctggc

SEQ ID NO: 516596 - DNA, 25 bp, Mus musculus
acatgcacgcatcctcgggagtcca

SEQ ID NO: 516597 - DNA, 25 bp, Mus musculus
acatgcacgcatgctcgggagtcca

SEQ ID NO: 516598 - DNA, 25 bp, Mus musculus
acatgcagagcaccggacacacgct

SEQ ID NO: 516599 - DNA, 25 bp, Mus musculus
acatgcagagcagcggacacacgct

SEQ ID NO: 516600 - DNA, 25 bp, Mus musculus
acatgcatcagtacacgcccgtgag

SEQ ID NO: 516601 - DNA, 25 bp, Mus musculus
acatgcatcagttcacgcccgtgag

SEQ ID NO: 516602 - DNA, 25 bp, Mus musculus
acatgcatgtatcttttaaaggaaa

SEQ ID NO: 516603 - DNA, 25 bp, Mus musculus
acatgcatgtatgttttaaaggaaa

SEQ ID NO: 516604 - DNA, 25 bp, Mus musculus
acatgccaacttcaccataggcgaa

SEQ ID NO: 516605 - DNA, 25 bp, Mus musculus
acatgccaacttgaccataggcgaa

SEQ ID NO: 516606 - DNA, 25 bp, Mus musculus
acatgccaatttcgctggcacactg

SEQ ID NO: 516607 - DNA, 25 bp, Mus musculus
acatgccaatttggctggcacactg

SEQ ID NO: 516608 - DNA, 25 bp, Mus musculus
acatgccacctcagccgtacaagat

SEQ ID NO: 516609 - DNA, 25 bp, Mus musculus
acatgccacctctgccgtacaagat

SEQ ID NO: 516610 - DNA, 25 bp, Mus musculus
acatgccgactcattgacctccgtg

SEQ ID NO: 516611 - DNA, 25 bp, Mus musculus
acatgccgactctttgacctccgtg

SEQ ID NO: 516612 - DNA, 25 bp, Mus musculus
acatgccgcctcagggtgggacaga

SEQ ID NO: 516613 - DNA, 25 bp, Mus musculus
acatgccgcctctgggtgggacaga

SEQ ID NO: 516614 - DNA, 25 bp, Mus musculus
acatgcctggagcagagggataacc

SEQ ID NO: 516615 - DNA, 25 bp, Mus musculus
acatgcctggaggagagggataacc

SEQ ID NO: 516616 - DNA, 25 bp, Mus musculus
acatgccttacgacatgatcccagc

SEQ ID NO: 516617 - DNA, 25 bp, Mus musculus
acatgccttacgtcatgatcccagc

SEQ ID NO: 516618 - DNA, 25 bp, Mus musculus
acatgccttgtgaccatcatgctgg

SEQ ID NO: 516619 - DNA, 25 bp, Mus musculus
acatgccttgtgcagaactctctgg

SEQ ID NO: 516620 - DNA, 25 bp, Mus musculus
acatgccttgtggagaactctctgg

SEQ ID NO: 516621 - DNA, 25 bp, Mus musculus
acatgccttgtgtccatcatgctgg

SEQ ID NO: 516622 - DNA, 25 bp, Mus musculus
acatgcgtcgggatgtccaggaaat

SEQ ID NO: 516623 - DNA, 25 bp, Mus musculus
acatgcgtcgggttgtccaggaaat

SEQ ID NO: 516624 - DNA, 25 bp, Mus musculus
acatgctccggtctccaggttcgat

SEQ ID NO: 516625 - DNA, 25 bp, Mus musculus
acatgctccggtgtccaggttcgat

SEQ ID NO: 516626 - DNA, 25 bp, Mus musculus
acatgctccgtgcacaaggcaaggc

SEQ ID NO: 516627 - DNA, 25 bp, Mus musculus
acatgctccgtggacaaggcaaggc

SEQ ID NO: 516628 - DNA, 25 bp, Mus musculus
acatgctctactatctgcagcggca

SEQ ID NO: 516629 - DNA, 25 bp, Mus musculus
acatgctctactttctgcagcggca

SEQ ID NO: 516630 - DNA, 25 bp, Mus musculus
acatgctgactgaggggaagaaccc

SEQ ID NO: 516631 - DNA, 25 bp, Mus musculus
acatgctgactgtggggaagaaccc

SEQ ID NO: 516632 - DNA, 25 bp, Mus musculus
acatgctgattcctgcgcagcatca

SEQ ID NO: 516633 - DNA, 25 bp, Mus musculus
acatgctgattcgtgcgcagcatca

SEQ ID NO: 516634 - DNA, 25 bp, Mus musculus
acatgctgctgccagccgcttggag

SEQ ID NO: 516635 - DNA, 25 bp, Mus musculus
acatgctgctgcgagccgcttggag

SEQ ID NO: 516636 - DNA, 25 bp, Mus musculus
acatgctgcttgacctcagcatcag

SEQ ID NO: 516637 - DNA, 25 bp, Mus musculus
acatgctgcttgtcctcagcatcag

SEQ ID NO: 516638 - DNA, 25 bp, Mus musculus
acatgctgtcctcagtatacaataa

SEQ ID NO: 516639 - DNA, 25 bp, Mus musculus
acatgctgtcctgagtatacaataa

SEQ ID NO: 516640 - DNA, 25 bp, Mus musculus
acatggaaatctcggttggaaaaca

SEQ ID NO: 516641 - DNA, 25 bp, Mus musculus
acatggaaatctgggttggaaaaca

SEQ ID NO: 516642 - DNA, 25 bp, Mus musculus
acatggacaagcaccctggaggact

SEQ ID NO: 516643 - DNA, 25 bp, Mus musculus
acatggacaagctccctggaggact

SEQ ID NO: 516644 - DNA, 25 bp, Mus musculus
acatggacatcgaggcgctcaagaa

SEQ ID NO: 516645 - DNA, 25 bp, Mus musculus
acatggacatcgtggcgctcaagaa

SEQ ID NO: 516646 - DNA, 25 bp, Mus musculus
acatggaccccgagggcttagctct

SEQ ID NO: 516647 - DNA, 25 bp, Mus musculus
acatggaccccgtgggcttagctct

SEQ ID NO: 516648 - DNA, 25 bp, Mus musculus
acatggacgagtctagcagcacccc

SEQ ID NO: 516649 - DNA, 25 bp, Mus musculus
acatggacgagtgtagcagcacccc

SEQ ID NO: 516650 - DNA, 25 bp, Mus musculus
acatggacgccccaagagacttcac

SEQ ID NO: 516651 - DNA, 25 bp, Mus musculus
acatggacgcccgaagagacttcac

SEQ ID NO: 516652 - DNA, 25 bp, Mus musculus
acatggactccaattaacccagtga

SEQ ID NO: 516653 - DNA, 25 bp, Mus musculus
acatggactccatttaacccagtga

SEQ ID NO: 516654 - DNA, 25 bp, Mus musculus
acatggagcaagattggcaggagct

SEQ ID NO: 516655 - DNA, 25 bp, Mus musculus
acatggagcaagtttggcaggagct

SEQ ID NO: 516656 - DNA, 25 bp, Mus musculus
acatggagcctgatagggagagacc

SEQ ID NO: 516657 - DNA, 25 bp, Mus musculus
acatggagcctgttagggagagacc

SEQ ID NO: 516658 - DNA, 25 bp, Mus musculus
acatggagctctaccgactgtccgg

SEQ ID NO: 516659 - DNA, 25 bp, Mus musculus
acatggagctcttccgactgtccgg

SEQ ID NO: 516660 - DNA, 25 bp, Mus musculus
acatggagctgcatcgcaggtcccc

SEQ ID NO: 516661 - DNA, 25 bp, Mus musculus
acatggagctgcttcgcaggtcccc

SEQ ID NO: 516662 - DNA, 25 bp, Mus musculus
acatggaggaagcacagccgccatc

SEQ ID NO: 516663 - DNA, 25 bp, Mus musculus
acatggaggaaggacagccgccatc

SEQ ID NO: 516664 - DNA, 25 bp, Mus musculus
acatggaggttcctccagggtgcaa

SEQ ID NO: 516665 - DNA, 25 bp, Mus musculus
acatggaggttcgtccagggtgcaa

SEQ ID NO: 516666 - DNA, 25 bp, Mus musculus
acatggagtggcctctcaggctgac

SEQ ID NO: 516667 - DNA, 25 bp, Mus musculus
acatggagtggcgtctcaggctgac

SEQ ID NO: 516668 - DNA, 25 bp, Mus musculus
acatggagtttgatctgaatggaaa

SEQ ID NO: 516669 - DNA, 25 bp, Mus musculus
acatggagtttgttctgaatggaaa

SEQ ID NO: 516670 - DNA, 25 bp, Mus musculus
acatggatccgcacagagcccagca

SEQ ID NO: 516671 - DNA, 25 bp, Mus musculus
acatggatccgctcagagcccagca

SEQ ID NO: 516672 - DNA, 25 bp, Mus musculus
acatggcagaacacgtgattgtcgg

SEQ ID NO: 516673 - DNA, 25 bp, Mus musculus
acatggcagaactcgtgattgtcgg

SEQ ID NO: 516674 - DNA, 25 bp, Mus musculus
acatggcagataaggatgagctctt

SEQ ID NO: 516675 - DNA, 25 bp, Mus musculus
acatggcagatatggatgagctctt

SEQ ID NO: 516676 - DNA, 25 bp, Mus musculus
acatggcagtgtatcctgagggcca

SEQ ID NO: 516677 - DNA, 25 bp, Mus musculus
acatggcagtgtttcctgagggcca

SEQ ID NO: 516678 - DNA, 25 bp, Mus musculus
acatggccaaagctagggccgccct

SEQ ID NO: 516679 - DNA, 25 bp, Mus musculus
acatggccaaaggtagggccgccct

SEQ ID NO: 516680 - DNA, 25 bp, Mus musculus
acatggcccatgctgtgcacccaaa

SEQ ID NO: 516681 - DNA, 25 bp, Mus musculus
acatggcccatggtgtgcacccaaa

SEQ ID NO: 516682 - DNA, 25 bp, Mus musculus
acatggccgccgattcttgcgggcc

SEQ ID NO: 516683 - DNA, 25 bp, Mus musculus
acatggccgccgtttcttgcgggcc

SEQ ID NO: 516684 - DNA, 25 bp, Mus musculus
acatggcgcccgcttaaaatgcagg

SEQ ID NO: 516685 - DNA, 25 bp, Mus musculus
acatggcgcccggttaaaatgcagg

SEQ ID NO: 516686 - DNA, 25 bp, Mus musculus
acatggcgcgacatctggagcagtg

SEQ ID NO: 516687 - DNA, 25 bp, Mus musculus
acatggcgcgacttctggagcagtg

SEQ ID NO: 516688 - DNA, 25 bp, Mus musculus
acatggcgttgcaggtgcgagtcct

SEQ ID NO: 516689 - DNA, 25 bp, Mus musculus
acatggcgttgctggtgcgagtcct

SEQ ID NO: 516690 - DNA, 25 bp, Mus musculus
acatggctttgtctggtgctcagag

SEQ ID NO: 516691 - DNA, 25 bp, Mus musculus
acatggctttgtgtggtgctcagag

SEQ ID NO: 516692 - DNA, 25 bp, Mus musculus
acatgggaaacaacacgccacacgg

SEQ ID NO: 516693 - DNA, 25 bp, Mus musculus
acatgggaaacatcacgccacacgg

SEQ ID NO: 516694 - DNA, 25 bp, Mus musculus
acatgggaggccacaagctggccta

SEQ ID NO: 516695 - DNA, 25 bp, Mus musculus
acatgggaggcctcaagctggccta

SEQ ID NO: 516696 - DNA, 25 bp, Mus musculus
acatgggcaagaacgtgtacagctg

SEQ ID NO: 516697 - DNA, 25 bp, Mus musculus
acatgggcaagatcgtgtacagctg

SEQ ID NO: 516698 - DNA, 25 bp, Mus musculus
acatgggctttgacacagtggtggc

SEQ ID NO: 516699 - DNA, 25 bp, Mus musculus
acatgggctttgtcacagtggtggc

SEQ ID NO: 516700 - DNA, 25 bp, Mus musculus
acatgggtatgaccaagaggagccc

SEQ ID NO: 516701 - DNA, 25 bp, Mus musculus
acatgggtatgagcaagaggagccc

SEQ ID NO: 516702 - DNA, 25 bp, Mus musculus
acatgggtgctgagcgtctgcagca

SEQ ID NO: 516703 - DNA, 25 bp, Mus musculus
acatgggtgctgtgcgtctgcagca

SEQ ID NO: 516704 - DNA, 25 bp, Mus musculus
acatgggttcctccagctctacggc

SEQ ID NO: 516705 - DNA, 25 bp, Mus musculus
acatgggttcctgcagctctacggc

SEQ ID NO: 516706 - DNA, 25 bp, Mus musculus
acatggtaacccaggactacacagt

SEQ ID NO: 516707 - DNA, 25 bp, Mus musculus
acatggtaaccctggactacacagt

SEQ ID NO: 516708 - DNA, 25 bp, Mus musculus
acatggtatgagcttcctgtccatc

SEQ ID NO: 516709 - DNA, 25 bp, Mus musculus
acatggtatgaggttcctgtccatc

SEQ ID NO: 516710 - DNA, 25 bp, Mus musculus
acatggtggctcattctggtgtgtc

SEQ ID NO: 516711 - DNA, 25 bp, Mus musculus
acatggtggctctttctggtgtgtc

SEQ ID NO: 516712 - DNA, 25 bp, Mus musculus
acatggttgaccagctagtgagccc

SEQ ID NO: 516713 - DNA, 25 bp, Mus musculus
acatggttgacctgctagtgagccc

SEQ ID NO: 516714 - DNA, 25 bp, Mus musculus
acatggttgggcagagctatccacc

SEQ ID NO: 516715 - DNA, 25 bp, Mus musculus
acatggttgggctgagctatccacc

SEQ ID NO: 516716 - DNA, 25 bp, Mus musculus
acatggttttcaaatccatgctgag

SEQ ID NO: 516717 - DNA, 25 bp, Mus musculus
acatggttttcatatccatgctgag

SEQ ID NO: 516718 - DNA, 25 bp, Mus musculus
acatgtacacagaaggagtggcgga

SEQ ID NO: 516719 - DNA, 25 bp, Mus musculus
acatgtacacagtaggagtggcgga

SEQ ID NO: 516720 - DNA, 25 bp, Mus musculus
acatgtacagttctgaaaaatgcaa

SEQ ID NO: 516721 - DNA, 25 bp, Mus musculus
acatgtacagttgtgaaaaatgcaa

SEQ ID NO: 516722 - DNA, 25 bp, Mus musculus
acatgtatatcacgtactgctgtga

SEQ ID NO: 516723 - DNA, 25 bp, Mus musculus
acatgtatatcaggtactgctgtga

SEQ ID NO: 516724 - DNA, 25 bp, Mus musculus
acatgtcaacatcaccataggcgac

SEQ ID NO: 516725 - DNA, 25 bp, Mus musculus
acatgtcaacatgaccataggcgac

SEQ ID NO: 516726 - DNA, 25 bp, Mus musculus
acatgtcagagtcggagtcctacta

SEQ ID NO: 516727 - DNA, 25 bp, Mus musculus
acatgtcagagtgggagtcctacta

SEQ ID NO: 516728 - DNA, 25 bp, Mus musculus
acatgtcgcggcacgtgttcctcac

SEQ ID NO: 516729 - DNA, 25 bp, Mus musculus
acatgtcgcggctcgtgttcctcac

SEQ ID NO: 516730 - DNA, 25 bp, Mus musculus
acatgtctatgacggttcggcgcca

SEQ ID NO: 516731 - DNA, 25 bp, Mus musculus
acatgtctatgagggttcggcgcca

SEQ ID NO: 516732 - DNA, 25 bp, Mus musculus
acatgtctgctaaggaacgtttccg

SEQ ID NO: 516733 - DNA, 25 bp, Mus musculus
acatgtctgctatggaacgtttccg

SEQ ID NO: 516734 - DNA, 25 bp, Mus musculus
acatgtgaacagagtcccctgcctg

SEQ ID NO: 516735 - DNA, 25 bp, Mus musculus
acatgtgaacagtgtcccctgcctg

SEQ ID NO: 516736 - DNA, 25 bp, Mus musculus
acatgtgactttaggagaggaagcc

SEQ ID NO: 516737 - DNA, 25 bp, Mus musculus
acatgtgacttttggagaggaagcc

SEQ ID NO: 516738 - DNA, 25 bp, Mus musculus
acatgtgccaacaccagcctcggcc

SEQ ID NO: 516739 - DNA, 25 bp, Mus musculus
acatgtgccaactccagcctcggcc

SEQ ID NO: 516740 - DNA, 25 bp, Mus musculus
acatgtggaactaaacttctctacc

SEQ ID NO: 516741 - DNA, 25 bp, Mus musculus
acatgtggaacttaacttctctacc

SEQ ID NO: 516742 - DNA, 25 bp, Mus musculus
acatgtggagcaatgtggctgtatg

SEQ ID NO: 516743 - DNA, 25 bp, Mus musculus
acatgtggagcattgtggctgtatg

SEQ ID NO: 516744 - DNA, 25 bp, Mus musculus
acatgtgggtgcagctggatatagt

SEQ ID NO: 516745 - DNA, 25 bp, Mus musculus
acatgtgggtgctgctggatatagt

SEQ ID NO: 516746 - DNA, 25 bp, Mus musculus
acatgtgtcctccaggtcagttgtg

SEQ ID NO: 516747 - DNA, 25 bp, Mus musculus
acatgtgtcctcgaggtcagttgtg

SEQ ID NO: 516748 - DNA, 25 bp, Mus musculus
acatgttctaccagccggaatcgcc

SEQ ID NO: 516749 - DNA, 25 bp, Mus musculus
acatgttctacctgccggaatcgcc

SEQ ID NO: 516750 - DNA, 25 bp, Mus musculus
acatgttctttgctggcggctttcc

SEQ ID NO: 516751 - DNA, 25 bp, Mus musculus
acatgttctttggtggcggctttcc

SEQ ID NO: 516752 - DNA, 25 bp, Mus musculus
acatgtttagtcatcagtagagtac

SEQ ID NO: 516753 - DNA, 25 bp, Mus musculus
acatgtttagtcttcagtagagtac

SEQ ID NO: 516754 - DNA, 25 bp, Mus musculus
acatgtttgaagaagccctgcgagc

SEQ ID NO: 516755 - DNA, 25 bp, Mus musculus
acatgtttgaagtagccctgcgagc

SEQ ID NO: 516756 - DNA, 25 bp, Mus musculus
acatgtttgtaaacgctggcgtgcc

SEQ ID NO: 516757 - DNA, 25 bp, Mus musculus
acatgtttgtaatcgctggcgtgcc

SEQ ID NO: 516758 - DNA, 25 bp, Mus musculus
acattaacagaactgtcagtgatcg

SEQ ID NO: 516759 - DNA, 25 bp, Mus musculus
acattaacagaagtgtcagtgatcg

SEQ ID NO: 516760 - DNA, 25 bp, Mus musculus
acattaacctgaagccaccgactca

SEQ ID NO: 516761 - DNA, 25 bp, Mus musculus
acattaacctgatgccaccgactca

SEQ ID NO: 516762 - DNA, 25 bp, Mus musculus
acattaccccaacagggacatccat

SEQ ID NO: 516763 - DNA, 25 bp, Mus musculus
acattaccccaagagggacatccat

SEQ ID NO: 516764 - DNA, 25 bp, Mus musculus
acattaccgagaagctggcaggagg

SEQ ID NO: 516765 - DNA, 25 bp, Mus musculus
acattaccgagatgctggcaggagg

SEQ ID NO: 516766 - DNA, 25 bp, Mus musculus
acattaggcagaaaacggagttggg

SEQ ID NO: 516767 - DNA, 25 bp, Mus musculus
acattaggcagataacggagttggg

SEQ ID NO: 516768 - DNA, 25 bp, Mus musculus
acattataaaatccgcaagcttgac

SEQ ID NO: 516769 - DNA, 25 bp, Mus musculus
acattataaaatgcgcaagcttgac

SEQ ID NO: 516770 - DNA, 25 bp, Mus musculus
acattatgggatcgtaccaatccag

SEQ ID NO: 516771 - DNA, 25 bp, Mus musculus
acattatgggatggtaccaatccag

SEQ ID NO: 516772 - DNA, 25 bp, Mus musculus
acattatgtatgagatatttctcca

SEQ ID NO: 516773 - DNA, 25 bp, Mus musculus
acattatgtatgtgatatttctcca

SEQ ID NO: 516774 - DNA, 25 bp, Mus musculus
acattccaggtgctgcaaggcaatg

SEQ ID NO: 516775 - DNA, 25 bp, Mus musculus
acattccaggtggtgcaaggcaatg

SEQ ID NO: 516776 - DNA, 25 bp, Mus musculus
acattcccctcaacactttcgttga

SEQ ID NO: 516777 - DNA, 25 bp, Mus musculus
acattcccctcatcactttcgttga

SEQ ID NO: 516778 - DNA, 25 bp, Mus musculus
acattcccgtccctacatggcatat

SEQ ID NO: 516779 - DNA, 25 bp, Mus musculus
acattcccgtccgtacatggcatat

SEQ ID NO: 516780 - DNA, 25 bp, Mus musculus
acattccggaatcccaagatggtca

SEQ ID NO: 516781 - DNA, 25 bp, Mus musculus
acattccggaatgccaagatggtca

SEQ ID NO: 516782 - DNA, 25 bp, Mus musculus
acattcctatgtctgccgggcccag

SEQ ID NO: 516783 - DNA, 25 bp, Mus musculus
acattcctatgtgtgccgggcccag

SEQ ID NO: 516784 - DNA, 25 bp, Mus musculus
acattcctcgagctcgagcaggcca

SEQ ID NO: 516785 - DNA, 25 bp, Mus musculus
acattcctcgaggtcgagcaggcca

SEQ ID NO: 516786 - DNA, 25 bp, Mus musculus
acattcctgcgccaatcttgggtga

SEQ ID NO: 516787 - DNA, 25 bp, Mus musculus
acattcctgcgcgaatcttgggtga

SEQ ID NO: 516788 - DNA, 25 bp, Mus musculus
acattcgagctgcaaatcttgcccg

SEQ ID NO: 516789 - DNA, 25 bp, Mus musculus
acattcgagctggaaatcttgcccg

SEQ ID NO: 516790 - DNA, 25 bp, Mus musculus
acattcggctgacataattcacagg

SEQ ID NO: 516791 - DNA, 25 bp, Mus musculus
acattcggctgagataattcacagg

SEQ ID NO: 516792 - DNA, 25 bp, Mus musculus
acattcgggactatgtgcgtcagga

SEQ ID NO: 516793 - DNA, 25 bp, Mus musculus
acattcgggactttgtgcgtcagga

SEQ ID NO: 516794 - DNA, 25 bp, Mus musculus
acattctcaacgagagcctcacgga

SEQ ID NO: 516795 - DNA, 25 bp, Mus musculus
acattctcaacgtgagcctcacgga

SEQ ID NO: 516796 - DNA, 25 bp, Mus musculus
acattctgcctaacaagtttctgta

SEQ ID NO: 516797 - DNA, 25 bp, Mus musculus
acattctgcctatcaagtttctgta

SEQ ID NO: 516798 - DNA, 25 bp, Mus musculus
acattctgtttgaggacacagcgag

SEQ ID NO: 516799 - DNA, 25 bp, Mus musculus
acattctgtttgtggacacagcgag

SEQ ID NO: 516800 - DNA, 25 bp, Mus musculus
acattcttaacacggaagcggtgcg

SEQ ID NO: 516801 - DNA, 25 bp, Mus musculus
acattcttaacagggaagcggtgcg

SEQ ID NO: 516802 - DNA, 25 bp, Mus musculus
acattcttctggctgtaggacccga

SEQ ID NO: 516803 - DNA, 25 bp, Mus musculus
acattcttctgggtgtaggacccga

SEQ ID NO: 516804 - DNA, 25 bp, Mus musculus
acattgaaagaaattagcaccacat

SEQ ID NO: 516805 - DNA, 25 bp, Mus musculus
acattgaaagaatttagcaccacat

SEQ ID NO: 516806 - DNA, 25 bp, Mus musculus
acattgacccgtctgctaagggctg

SEQ ID NO: 516807 - DNA, 25 bp, Mus musculus
acattgacccgtgtgctaagggctg

SEQ ID NO: 516808 - DNA, 25 bp, Mus musculus
acattgactacaccgacaacgtggg

SEQ ID NO: 516809 - DNA, 25 bp, Mus musculus
acattgactacacgatgaggtgcat

SEQ ID NO: 516810 - DNA, 25 bp, Mus musculus
acattgactacagcgacaacgtggg

SEQ ID NO: 516811 - DNA, 25 bp, Mus musculus
acattgactacaggatgaggtgcat

SEQ ID NO: 516812 - DNA, 25 bp, Mus musculus
acattgacttccatgctgagaagga

SEQ ID NO: 516813 - DNA, 25 bp, Mus musculus
acattgacttccttgctgagaagga

SEQ ID NO: 516814 - DNA, 25 bp, Mus musculus
acattgagaccgcacagcagactac

SEQ ID NO: 516815 - DNA, 25 bp, Mus musculus
acattgagaccggacagcagactac

SEQ ID NO: 516816 - DNA, 25 bp, Mus musculus
acattgagccgactgtcaggagctg

SEQ ID NO: 516817 - DNA, 25 bp, Mus musculus
acattgagccgagtgtcaggagctg

SEQ ID NO: 516818 - DNA, 25 bp, Mus musculus
acattgaggcggctgccatgctgct

SEQ ID NO: 516819 - DNA, 25 bp, Mus musculus
acattgaggcgggtgccatgctgct

SEQ ID NO: 516820 - DNA, 25 bp, Mus musculus
acattgaggctcaccatgacagcat

SEQ ID NO: 516821 - DNA, 25 bp, Mus musculus
acattgaggctctccatgacagcat

SEQ ID NO: 516822 - DNA, 25 bp, Mus musculus
acattgatctcaagtgcaaggaacg

SEQ ID NO: 516823 - DNA, 25 bp, Mus musculus
acattgatctcatgtgcaaggaacg

SEQ ID NO: 516824 - DNA, 25 bp, Mus musculus
acattgatggagatggccaggtcaa

SEQ ID NO: 516825 - DNA, 25 bp, Mus musculus
acattgatggagttggccaggtcaa

SEQ ID NO: 516826 - DNA, 25 bp, Mus musculus
acattgcaaaatcccagttaggcat

SEQ ID NO: 516827 - DNA, 25 bp, Mus musculus
acattgcaaaatgccagttaggcat

SEQ ID NO: 516828 - DNA, 25 bp, Mus musculus
acattgcaaatgaagacatgctcaa

SEQ ID NO: 516829 - DNA, 25 bp, Mus musculus
acattgcaaatgtagacatgctcaa

SEQ ID NO: 516830 - DNA, 25 bp, Mus musculus
acattgcaagcaaggtgcggcccgg

SEQ ID NO: 516831 - DNA, 25 bp, Mus musculus
acattgcaagcatggtgcggcccgg

SEQ ID NO: 516832 - DNA, 25 bp, Mus musculus
acattgcagaggaaccaaccgctca

SEQ ID NO: 516833 - DNA, 25 bp, Mus musculus
acattgcagaggtaccaaccgctca

SEQ ID NO: 516834 - DNA, 25 bp, Mus musculus
acattgcagagtcgctagttgcaga

SEQ ID NO: 516835 - DNA, 25 bp, Mus musculus
acattgcagagtggctagttgcaga

SEQ ID NO: 516836 - DNA, 25 bp, Mus musculus
acattgccacatagcagaggaacca

SEQ ID NO: 516837 - DNA, 25 bp, Mus musculus
acattgccacattgcagaggaacca

SEQ ID NO: 516838 - DNA, 25 bp, Mus musculus
acattgcccgacagacagctcaggg

SEQ ID NO: 516839 - DNA, 25 bp, Mus musculus
acattgcccgactgacagctcaggg

SEQ ID NO: 516840 - DNA, 25 bp, Mus musculus
acattgccgtcaaattacattcatt

SEQ ID NO: 516841 - DNA, 25 bp, Mus musculus
acattgccgtcatattacattcatt

SEQ ID NO: 516842 - DNA, 25 bp, Mus musculus
acattgcctgctcggaacattcgag

SEQ ID NO: 516843 - DNA, 25 bp, Mus musculus
acattgcctgctgggaacattcgag

SEQ ID NO: 516844 - DNA, 25 bp, Mus musculus
acattgctctggcactctactcagc

SEQ ID NO: 516845 - DNA, 25 bp, Mus musculus
acattgctctgggactctactcagc

SEQ ID NO: 516846 - DNA, 25 bp, Mus musculus
acattgctgcagaatactgatacag

SEQ ID NO: 516847 - DNA, 25 bp, Mus musculus
acattgctgcagtatactgatacag

SEQ ID NO: 516848 - DNA, 25 bp, Mus musculus
acattgcttcacaatgcagtctgag

SEQ ID NO: 516849 - DNA, 25 bp, Mus musculus
acattgcttcactatgcagtctgag

SEQ ID NO: 516850 - DNA, 25 bp, Mus musculus
acattgcttggtccaggaggcgtaa

SEQ ID NO: 516851 - DNA, 25 bp, Mus musculus
acattgcttggtgcaggaggcgtaa

SEQ ID NO: 516852 - DNA, 25 bp, Mus musculus
acattggagggccaccacagcaaac

SEQ ID NO: 516853 - DNA, 25 bp, Mus musculus
acattggagggcgaccacagcaaac

SEQ ID NO: 516854 - DNA, 25 bp, Mus musculus
acattggatcgtacacagtgagggc

SEQ ID NO: 516855 - DNA, 25 bp, Mus musculus
acattggatcgttcacagtgagggc

SEQ ID NO: 516856 - DNA, 25 bp, Mus musculus
acattggctcttactcagtccgagc

SEQ ID NO: 516857 - DNA, 25 bp, Mus musculus
acattggctctttctcagtccgagc

SEQ ID NO: 516858 - DNA, 25 bp, Mus musculus
acattggtgagacagcatggagctt

SEQ ID NO: 516859 - DNA, 25 bp, Mus musculus
acattggtgagagagcatggagctt

SEQ ID NO: 516860 - DNA, 25 bp, Mus musculus
acattgtaggggctgcgccatgcac

SEQ ID NO: 516861 - DNA, 25 bp, Mus musculus
acattgtagggggtgcgccatgcac

SEQ ID NO: 516862 - DNA, 25 bp, Mus musculus
acattgtcccaacggagaagatgag

SEQ ID NO: 516863 - DNA, 25 bp, Mus musculus
acattgtcccaagggagaagatgag

SEQ ID NO: 516864 - DNA, 25 bp, Mus musculus
acattgtgcactaggaagatctttg

SEQ ID NO: 516865 - DNA, 25 bp, Mus musculus
acattgtgcacttggaagatctttg

SEQ ID NO: 516866 - DNA, 25 bp, Mus musculus
acattgtggacaaaattctggctca

SEQ ID NO: 516867 - DNA, 25 bp, Mus musculus
acattgtggacataattctggctca

SEQ ID NO: 516868 - DNA, 25 bp, Mus musculus
acattgtgggatcgctttgaagtac

SEQ ID NO: 516869 - DNA, 25 bp, Mus musculus
acattgtgggatggctttgaagtac

SEQ ID NO: 516870 - DNA, 25 bp, Mus musculus
acattgtggttgataactgtgccat

SEQ ID NO: 516871 - DNA, 25 bp, Mus musculus
acattgtggttgttaactgtgccat

SEQ ID NO: 516872 - DNA, 25 bp, Mus musculus
acattgtgtacgatccttcacacct

SEQ ID NO: 516873 - DNA, 25 bp, Mus musculus
acattgtgtacgttccttcacacct

SEQ ID NO: 516874 - DNA, 25 bp, Mus musculus
acattgtgtatgaggtagagggcca

SEQ ID NO: 516875 - DNA, 25 bp, Mus musculus
acattgtgtatgtggtagagggcca

SEQ ID NO: 516876 - DNA, 25 bp, Mus musculus
acattgttggccctgctgtgcgcaa

SEQ ID NO: 516877 - DNA, 25 bp, Mus musculus
acattgttggccgtgctgtgcgcaa

SEQ ID NO: 516878 - DNA, 25 bp, Mus musculus
acatttaactttcgccagagtgaag

SEQ ID NO: 516879 - DNA, 25 bp, Mus musculus
acatttaactttggccagagtgaag

SEQ ID NO: 516880 - DNA, 25 bp, Mus musculus
acatttacatccagctgggcttttc

SEQ ID NO: 516881 - DNA, 25 bp, Mus musculus
acatttacatcctgctgggcttttc

SEQ ID NO: 516882 - DNA, 25 bp, Mus musculus
acatttagagttcagctctcagttg

SEQ ID NO: 516883 - DNA, 25 bp, Mus musculus
acatttagagttgagctctcagttg

SEQ ID NO: 516884 - DNA, 25 bp, Mus musculus
acatttatgctcacaaagtccttct

SEQ ID NO: 516885 - DNA, 25 bp, Mus musculus
acatttatgctctcaaagtccttct

SEQ ID NO: 516886 - DNA, 25 bp, Mus musculus
acatttcaaggcattggcttgtatc

SEQ ID NO: 516887 - DNA, 25 bp, Mus musculus
acatttcaaggctttggcttgtatc

SEQ ID NO: 516888 - DNA, 25 bp, Mus musculus
acatttcaatgaagagtctcctctg

SEQ ID NO: 516889 - DNA, 25 bp, Mus musculus
acatttcaatgatgagtctcctctg

SEQ ID NO: 516890 - DNA, 25 bp, Mus musculus
acatttcagaaaatggcccaccaga

SEQ ID NO: 516891 - DNA, 25 bp, Mus musculus
acatttcagaaattggcccaccaga

SEQ ID NO: 516892 - DNA, 25 bp, Mus musculus
acatttcattgtagcagagtcctct

SEQ ID NO: 516893 - DNA, 25 bp, Mus musculus
acatttcattgttgcagagtcctct

SEQ ID NO: 516894 - DNA, 25 bp, Mus musculus
acatttccaggactgactgggaccc

SEQ ID NO: 516895 - DNA, 25 bp, Mus musculus
acatttccaggagtgactgggaccc

SEQ ID NO: 516896 - DNA, 25 bp, Mus musculus
acatttcccacaacgaccgggtcta

SEQ ID NO: 516897 - DNA, 25 bp, Mus musculus
acatttcccacatcgaccgggtcta

SEQ ID NO: 516898 - DNA, 25 bp, Mus musculus
acatttctgagacggatgatcataa

SEQ ID NO: 516899 - DNA, 25 bp, Mus musculus
acatttctgagagggatgatcataa

SEQ ID NO: 516900 - DNA, 25 bp, Mus musculus
acatttgggataacctctatagcag

SEQ ID NO: 516901 - DNA, 25 bp, Mus musculus
acatttgggatatcctctatagcag

SEQ ID NO: 516902 - DNA, 25 bp, Mus musculus
acatttgggctgacagcttcgggcc

SEQ ID NO: 516903 - DNA, 25 bp, Mus musculus
acatttgggctgtcagcttcgggcc

SEQ ID NO: 516904 - DNA, 25 bp, Mus musculus
acatttgtaatgaagactgctacct

SEQ ID NO: 516905 - DNA, 25 bp, Mus musculus
acatttgtaatgtagactgctacct

SEQ ID NO: 516906 - DNA, 25 bp, Mus musculus
acatttgtgccacccatgatggcca

SEQ ID NO: 516907 - DNA, 25 bp, Mus musculus
acatttgtgccagccatgatggcca

SEQ ID NO: 516908 - DNA, 25 bp, Mus musculus
acattttatcaaagacgtcagccaa

SEQ ID NO: 516909 - DNA, 25 bp, Mus musculus
acattttatcaatgacgtcagccaa

SEQ ID NO: 516910 - DNA, 25 bp, Mus musculus
acattttctgctcatgaaaagaagc

SEQ ID NO: 516911 - DNA, 25 bp, Mus musculus
acattttctgctgatgaaaagaagc

SEQ ID NO: 516912 - DNA, 25 bp, Mus musculus
acattttgaactcccctcagatttc

SEQ ID NO: 516913 - DNA, 25 bp, Mus musculus
acattttgaactgccctcagatttc

SEQ ID NO: 516914 - DNA, 25 bp, Mus musculus
acattttgcccacgctgggaaagga

SEQ ID NO: 516915 - DNA, 25 bp, Mus musculus
acattttgcccaggctgggaaagga

SEQ ID NO: 516916 - DNA, 25 bp, Mus musculus
acatttttaagcatggaacagtagc

SEQ ID NO: 516917 - DNA, 25 bp, Mus musculus
acatttttaagcttggaacagtagc

SEQ ID NO: 516918 - DNA, 25 bp, Mus musculus
accaaaaaataaatagccctgcatt

SEQ ID NO: 516919 - DNA, 25 bp, Mus musculus
accaaaaaataattagccctgcatt

SEQ ID NO: 516920 - DNA, 25 bp, Mus musculus
accaaaaacctgcacaaagcactga

SEQ ID NO: 516921 - DNA, 25 bp, Mus musculus
accaaaaacctggacaaagcactga

SEQ ID NO: 516922 - DNA, 25 bp, Mus musculus
accaaaaagcctcgcatcaacagct

SEQ ID NO: 516923 - DNA, 25 bp, Mus musculus
accaaaaagcctggcatcaacagct

SEQ ID NO: 516924 - DNA, 25 bp, Mus musculus
accaaaacggccagggaggtgcgcg

SEQ ID NO: 516925 - DNA, 25 bp, Mus musculus
accaaaacggcctgggaggtgcgcg

SEQ ID NO: 516926 - DNA, 25 bp, Mus musculus
accaaaagcactccgagactcgatg

SEQ ID NO: 516927 - DNA, 25 bp, Mus musculus
accaaaagcactgcgagactcgatg

SEQ ID NO: 516928 - DNA, 25 bp, Mus musculus
accaaacaaagtcccctactatatc

SEQ ID NO: 516929 - DNA, 25 bp, Mus musculus
accaaacaaagtgccctactatatc

SEQ ID NO: 516930 - DNA, 25 bp, Mus musculus
accaaacaccaaagatctggatgtc

SEQ ID NO: 516931 - DNA, 25 bp, Mus musculus
accaaacaccaatgatctggatgtc

SEQ ID NO: 516932 - DNA, 25 bp, Mus musculus
accaaacagctgacatatgatgagg

SEQ ID NO: 516933 - DNA, 25 bp, Mus musculus
accaaacagctgtcatatgatgagg

SEQ ID NO: 516934 - DNA, 25 bp, Mus musculus
accaaaccagcaccgtggctgtgaa

SEQ ID NO: 516935 - DNA, 25 bp, Mus musculus
accaaaccagcagcgtggctgtgaa

SEQ ID NO: 516936 - DNA, 25 bp, Mus musculus
accaaacctgtgataacctgtctca

SEQ ID NO: 516937 - DNA, 25 bp, Mus musculus
accaaacctgtgttaacctgtctca

SEQ ID NO: 516938 - DNA, 25 bp, Mus musculus
accaaacgatgaccaccttgccttg

SEQ ID NO: 516939 - DNA, 25 bp, Mus musculus
accaaacgatgagcaccttgccttg

SEQ ID NO: 516940 - DNA, 25 bp, Mus musculus
accaaacttgcacctactacttcag

SEQ ID NO: 516941 - DNA, 25 bp, Mus musculus
accaaacttgcagctactacttcag

SEQ ID NO: 516942 - DNA, 25 bp, Mus musculus
accaaactttatagcatgagctggg

SEQ ID NO: 516943 - DNA, 25 bp, Mus musculus
accaaactttattgcatgagctggg

SEQ ID NO: 516944 - DNA, 25 bp, Mus musculus
accaaagacttgcacctggacgaca

SEQ ID NO: 516945 - DNA, 25 bp, Mus musculus
accaaagacttggacctggacgaca

SEQ ID NO: 516946 - DNA, 25 bp, Mus musculus
accaaagatgaaacggaggagacgg

SEQ ID NO: 516947 - DNA, 25 bp, Mus musculus
accaaagatgaatcggaggagacgg

SEQ ID NO: 516948 - DNA, 25 bp, Mus musculus
accaaagcagccctgggaatggtgt

SEQ ID NO: 516949 - DNA, 25 bp, Mus musculus
accaaagcagccgtgggaatggtgt

SEQ ID NO: 516950 - DNA, 25 bp, Mus musculus
accaaagccttcagtgtggactgtg

SEQ ID NO: 516951 - DNA, 25 bp, Mus musculus
accaaagccttctgtgtggactgtg

SEQ ID NO: 516952 - DNA, 25 bp, Mus musculus
accaaagcttagaggtggaagagag

SEQ ID NO: 516953 - DNA, 25 bp, Mus musculus
accaaagcttagtggtggaagagag

SEQ ID NO: 516954 - DNA, 25 bp, Mus musculus
accaaaggaaagcatctgcattaaa

SEQ ID NO: 516955 - DNA, 25 bp, Mus musculus
accaaaggaaaggatctgcattaaa

SEQ ID NO: 516956 - DNA, 25 bp, Mus musculus
accaaaggccgaaagcatggcagaa

SEQ ID NO: 516957 - DNA, 25 bp, Mus musculus
accaaaggccgatagcatggcagaa

SEQ ID NO: 516958 - DNA, 25 bp, Mus musculus
accaaagtatctcaacctaaatcag

SEQ ID NO: 516959 - DNA, 25 bp, Mus musculus
accaaagtatctgaacctaaatcag

SEQ ID NO: 516960 - DNA, 25 bp, Mus musculus
accaaagtctagatctgctgctcat

SEQ ID NO: 516961 - DNA, 25 bp, Mus musculus
accaaagtctagttctgctgctcat

SEQ ID NO: 516962 - DNA, 25 bp, Mus musculus
accaaatagctgagaacctaaccgt

SEQ ID NO: 516963 - DNA, 25 bp, Mus musculus
accaaatagctgtgaacctaaccgt

SEQ ID NO: 516964 - DNA, 25 bp, Mus musculus
accaaatctactctgagttccgtga

SEQ ID NO: 516965 - DNA, 25 bp, Mus musculus
accaaatctactgtgagttccgtga

SEQ ID NO: 516966 - DNA, 25 bp, Mus musculus
accaaatgacagaggcacacaagct

SEQ ID NO: 516967 - DNA, 25 bp, Mus musculus
accaaatgacagtggcacacaagct

SEQ ID NO: 516968 - DNA, 25 bp, Mus musculus
accaaatggctgaggctcgccactg

SEQ ID NO: 516969 - DNA, 25 bp, Mus musculus
accaaatggctgtggctcgccactg

SEQ ID NO: 516970 - DNA, 25 bp, Mus musculus
accaaatgggcaacgggcgaggcaa

SEQ ID NO: 516971 - DNA, 25 bp, Mus musculus
accaaatgggcatcgggcgaggcaa

SEQ ID NO: 516972 - DNA, 25 bp, Mus musculus
accaaatgtgccctgatgtatgtga

SEQ ID NO: 516973 - DNA, 25 bp, Mus musculus
accaaatgtgccgtgatgtatgtga

SEQ ID NO: 516974 - DNA, 25 bp, Mus musculus
accaaattataaaggcgttctgatg

SEQ ID NO: 516975 - DNA, 25 bp, Mus musculus
accaaattataatggcgttctgatg

SEQ ID NO: 516976 - DNA, 25 bp, Mus musculus
accaacaagaccaagaagacggagg

SEQ ID NO: 516977 - DNA, 25 bp, Mus musculus
accaacaagacctagaagacggagg

SEQ ID NO: 516978 - DNA, 25 bp, Mus musculus
accaacacaagcacagcagggacca

SEQ ID NO: 516979 - DNA, 25 bp, Mus musculus
accaacacaagctcagcagggacca

SEQ ID NO: 516980 - DNA, 25 bp, Mus musculus
accaacacagttatagcaaagaagc

SEQ ID NO: 516981 - DNA, 25 bp, Mus musculus
accaacacagttttagcaaagaagc

SEQ ID NO: 516982 - DNA, 25 bp, Mus musculus
accaacacgggtcgcttgagcagca

SEQ ID NO: 516983 - DNA, 25 bp, Mus musculus
accaacacgggtggcttgagcagca

SEQ ID NO: 516984 - DNA, 25 bp, Mus musculus
accaacacgtacagtgctttgccac

SEQ ID NO: 516985 - DNA, 25 bp, Mus musculus
accaacacgtactgtgctttgccac

SEQ ID NO: 516986 - DNA, 25 bp, Mus musculus
accaacagccatcattaggccagaa

SEQ ID NO: 516987 - DNA, 25 bp, Mus musculus
accaacagccatgattaggccagaa

SEQ ID NO: 516988 - DNA, 25 bp, Mus musculus
accaacatccccaagctgaaggctg

SEQ ID NO: 516989 - DNA, 25 bp, Mus musculus
accaacatcccctagctgaaggctg

SEQ ID NO: 516990 - DNA, 25 bp, Mus musculus
accaacatcctcctggttgatgaaa

SEQ ID NO: 516991 - DNA, 25 bp, Mus musculus
accaacatcctcgtggttgatgaaa

SEQ ID NO: 516992 - DNA, 25 bp, Mus musculus
accaacattgtcaacctctgtggca

SEQ ID NO: 516993 - DNA, 25 bp, Mus musculus
accaacattgtctacctctgtggca

SEQ ID NO: 516994 - DNA, 25 bp, Mus musculus
accaaccagtccacttttgacaaca

SEQ ID NO: 516995 - DNA, 25 bp, Mus musculus
accaaccagtcctcttttgacaaca

SEQ ID NO: 516996 - DNA, 25 bp, Mus musculus
accaacccactgaggtgaagcacct

SEQ ID NO: 516997 - DNA, 25 bp, Mus musculus
accaacccactgtggtgaagcacct

SEQ ID NO: 516998 - DNA, 25 bp, Mus musculus
accaaccccacaagggctcagggat

SEQ ID NO: 516999 - DNA, 25 bp, Mus musculus
accaaccccacatgggctcagggat

SEQ ID NO: 517000 - DNA, 25 bp, Mus musculus
accaaccctagccttatgattgatg

SEQ ID NO: 517001 - DNA, 25 bp, Mus musculus
accaaccctagcgttatgattgatg

SEQ ID NO: 517002 - DNA, 25 bp, Mus musculus
accaacctgtatcggcgccatgact

SEQ ID NO: 517003 - DNA, 25 bp, Mus musculus
accaacctgtatgggcgccatgact

SEQ ID NO: 517004 - DNA, 25 bp, Mus musculus
accaacgacaacatgtcctactctg

SEQ ID NO: 517005 - DNA, 25 bp, Mus musculus
accaacgacaacttgtcctactctg

SEQ ID NO: 517006 - DNA, 25 bp, Mus musculus
accaacgagactcggcagccgctga

SEQ ID NO: 517007 - DNA, 25 bp, Mus musculus
accaacgagactgggcagccgctga

SEQ ID NO: 517008 - DNA, 25 bp, Mus musculus
accaacgagctgaggaacaatctcc

SEQ ID NO: 517009 - DNA, 25 bp, Mus musculus
accaacgagctgtggaacaatctcc

SEQ ID NO: 517010 - DNA, 25 bp, Mus musculus
accaacgagggcatgctctctgtgg

SEQ ID NO: 517011 - DNA, 25 bp, Mus musculus
accaacgagggcttgctctctgtgg

SEQ ID NO: 517012 - DNA, 25 bp, Mus musculus
accaacgcctcccatgatgatgtcg

SEQ ID NO: 517013 - DNA, 25 bp, Mus musculus
accaacgcctccgatgatgatgtcg

SEQ ID NO: 517014 - DNA, 25 bp, Mus musculus
accaacgtccgtcagcctgacagag

SEQ ID NO: 517015 - DNA, 25 bp, Mus musculus
accaacgtccgtgagcctgacagag

SEQ ID NO: 517016 - DNA, 25 bp, Mus musculus
accaacgtcgtcatccggctcgaag

SEQ ID NO: 517017 - DNA, 25 bp, Mus musculus
accaacgtcgtcttccggctcgaag

SEQ ID NO: 517018 - DNA, 25 bp, Mus musculus
accaacgtggcccagactagcgatg

SEQ ID NO: 517019 - DNA, 25 bp, Mus musculus
accaacgtggccgagactagcgatg

SEQ ID NO: 517020 - DNA, 25 bp, Mus musculus
accaactcactgcaggttagctggg

SEQ ID NO: 517021 - DNA, 25 bp, Mus musculus
accaactcactggaggttagctggg

SEQ ID NO: 517022 - DNA, 25 bp, Mus musculus
accaactgccgacaattctgtcaag

SEQ ID NO: 517023 - DNA, 25 bp, Mus musculus
accaactgccgagaattctgtcaag

SEQ ID NO: 517024 - DNA, 25 bp, Mus musculus
accaactggcggcagcctatgagca

SEQ ID NO: 517025 - DNA, 25 bp, Mus musculus
accaactggcgggagcctatgagca

SEQ ID NO: 517026 - DNA, 25 bp, Mus musculus
accaactggtatcgcgtgcagcccg

SEQ ID NO: 517027 - DNA, 25 bp, Mus musculus
accaactggtatggcgtgcagcccg

SEQ ID NO: 517028 - DNA, 25 bp, Mus musculus
accaacttgggaaaaatatatgcca

SEQ ID NO: 517029 - DNA, 25 bp, Mus musculus
accaacttgggataaatatatgcca

SEQ ID NO: 517030 - DNA, 25 bp, Mus musculus
accaagaaaagtcagcctgactgca

SEQ ID NO: 517031 - DNA, 25 bp, Mus musculus
accaagaaaagtgagcctgactgca

SEQ ID NO: 517032 - DNA, 25 bp, Mus musculus
accaagaagatcaggttgctttggg

SEQ ID NO: 517033 - DNA, 25 bp, Mus musculus
accaagaagatctggttgctttggg

SEQ ID NO: 517034 - DNA, 25 bp, Mus musculus
accaagaagcatcagtatgagatta

SEQ ID NO: 517035 - DNA, 25 bp, Mus musculus
accaagaagcatgagtatgagatta

SEQ ID NO: 517036 - DNA, 25 bp, Mus musculus
accaagaagggaaccgcaggcacag

SEQ ID NO: 517037 - DNA, 25 bp, Mus musculus
accaagaagggatccgcaggcacag

SEQ ID NO: 517038 - DNA, 25 bp, Mus musculus
accaagacccacatccaggagtgca

SEQ ID NO: 517039 - DNA, 25 bp, Mus musculus
accaagacccacttccaggagtgca

SEQ ID NO: 517040 - DNA, 25 bp, Mus musculus
accaagaccggcctgaagtcggaca

SEQ ID NO: 517041 - DNA, 25 bp, Mus musculus
accaagaccggcgtgaagtcggaca

SEQ ID NO: 517042 - DNA, 25 bp, Mus musculus
accaagacgagtctttgatgggcac

SEQ ID NO: 517043 - DNA, 25 bp, Mus musculus
accaagacgagtgtttgatgggcac

SEQ ID NO: 517044 - DNA, 25 bp, Mus musculus
accaagactgcactgttctttggat

SEQ ID NO: 517045 - DNA, 25 bp, Mus musculus
accaagactgcagtgttctttggat

SEQ ID NO: 517046 - DNA, 25 bp, Mus musculus
accaagagaaaaacagttacagtca

SEQ ID NO: 517047 - DNA, 25 bp, Mus musculus
accaagagaaaatcagttacagtca

SEQ ID NO: 517048 - DNA, 25 bp, Mus musculus
accaagagccatctggatggtggct

SEQ ID NO: 517049 - DNA, 25 bp, Mus musculus
accaagagccatgtggatggtggct

SEQ ID NO: 517050 - DNA, 25 bp, Mus musculus
accaagagcctgctggtgtgcaaca

SEQ ID NO: 517051 - DNA, 25 bp, Mus musculus
accaagagcctggtggtgtgcaaca

SEQ ID NO: 517052 - DNA, 25 bp, Mus musculus
accaagagcgcaaggctgcggaagc

SEQ ID NO: 517053 - DNA, 25 bp, Mus musculus
accaagagcgcatggctgcggaagc

SEQ ID NO: 517054 - DNA, 25 bp, Mus musculus
accaagagcggcatgatcctttgca

SEQ ID NO: 517055 - DNA, 25 bp, Mus musculus
accaagagcggcttgatcctttgca

SEQ ID NO: 517056 - DNA, 25 bp, Mus musculus
accaagaggagtctctcaagcacag

SEQ ID NO: 517057 - DNA, 25 bp, Mus musculus
accaagaggagtgtctcaagcacag

SEQ ID NO: 517058 - DNA, 25 bp, Mus musculus
accaagaggcagaatgccggcgctc

SEQ ID NO: 517059 - DNA, 25 bp, Mus musculus
accaagaggcagtatgccggcgctc

SEQ ID NO: 517060 - DNA, 25 bp, Mus musculus
accaagaggcgacaactggaggacc

SEQ ID NO: 517061 - DNA, 25 bp, Mus musculus
accaagaggcgagaactggaggacc

SEQ ID NO: 517062 - DNA, 25 bp, Mus musculus
accaagagggttatcttcttctctg

SEQ ID NO: 517063 - DNA, 25 bp, Mus musculus
accaagagggttttcttcttctctg

SEQ ID NO: 517064 - DNA, 25 bp, Mus musculus
accaagataatcaggacttcaccac

SEQ ID NO: 517065 - DNA, 25 bp, Mus musculus
accaagataatctggacttcaccac

SEQ ID NO: 517066 - DNA, 25 bp, Mus musculus
accaagatctcgctcacgatccaaa

SEQ ID NO: 517067 - DNA, 25 bp, Mus musculus
accaagatctcggtcacgatccaaa

SEQ ID NO: 517068 - DNA, 25 bp, Mus musculus
accaagcagccccaggaagtgtttg

SEQ ID NO: 517069 - DNA, 25 bp, Mus musculus
accaagcagcccgaggaagtgtttg

SEQ ID NO: 517070 - DNA, 25 bp, Mus musculus
accaagcagctgcttcactgtatgg

SEQ ID NO: 517071 - DNA, 25 bp, Mus musculus
accaagcagctggttcactgtatgg

SEQ ID NO: 517072 - DNA, 25 bp, Mus musculus
accaagcctgacaatgacatccgag

SEQ ID NO: 517073 - DNA, 25 bp, Mus musculus
accaagcctgactatgacatccgag

SEQ ID NO: 517074 - DNA, 25 bp, Mus musculus
accaagcgaggacatgcttgtgaag

SEQ ID NO: 517075 - DNA, 25 bp, Mus musculus
accaagcgaggagatgcttgtgaag

SEQ ID NO: 517076 - DNA, 25 bp, Mus musculus
accaagcgccggctgttcatcattg

SEQ ID NO: 517077 - DNA, 25 bp, Mus musculus
accaagcgccgggtgttcatcattg

SEQ ID NO: 517078 - DNA, 25 bp, Mus musculus
accaagcgtaaaagtgcctcctcct

SEQ ID NO: 517079 - DNA, 25 bp, Mus musculus
accaagcgtaaatgtgcctcctcct

SEQ ID NO: 517080 - DNA, 25 bp, Mus musculus
accaagctccgaccggcaagagaga

SEQ ID NO: 517081 - DNA, 25 bp, Mus musculus
accaagctccgagcggcaagagaga

SEQ ID NO: 517082 - DNA, 25 bp, Mus musculus
accaagctgggtccctgtaacgaca

SEQ ID NO: 517083 - DNA, 25 bp, Mus musculus
accaagctgggtgcctgtaacgaca

SEQ ID NO: 517084 - DNA, 25 bp, Mus musculus
accaagctgtgtagtactttgtgca

SEQ ID NO: 517085 - DNA, 25 bp, Mus musculus
accaagctgtgttgtactttgtgca

SEQ ID NO: 517086 - DNA, 25 bp, Mus musculus
accaagcttgagagccaccttgatg

SEQ ID NO: 517087 - DNA, 25 bp, Mus musculus
accaagcttgagtgccaccttgatg

SEQ ID NO: 517088 - DNA, 25 bp, Mus musculus
accaaggaagtcactggcatgagca

SEQ ID NO: 517089 - DNA, 25 bp, Mus musculus
accaaggaagtctctggcatgagca

SEQ ID NO: 517090 - DNA, 25 bp, Mus musculus
accaaggacatgactggaaaggaag

SEQ ID NO: 517091 - DNA, 25 bp, Mus musculus
accaaggacatgtctggaaaggaag

SEQ ID NO: 517092 - DNA, 25 bp, Mus musculus
accaaggactagagctctcacccag

SEQ ID NO: 517093 - DNA, 25 bp, Mus musculus
accaaggactagtgctctcacccag

SEQ ID NO: 517094 - DNA, 25 bp, Mus musculus
accaaggactccatgaatatcaagg

SEQ ID NO: 517095 - DNA, 25 bp, Mus musculus
accaaggactccttgaatatcaagg

SEQ ID NO: 517096 - DNA, 25 bp, Mus musculus
accaaggagctgcactcccatttct

SEQ ID NO: 517097 - DNA, 25 bp, Mus musculus
accaaggagctggactcccatttct

SEQ ID NO: 517098 - DNA, 25 bp, Mus musculus
accaaggatgacagcaccaattcca

SEQ ID NO: 517099 - DNA, 25 bp, Mus musculus
accaaggatgactgcaccaattcca

SEQ ID NO: 517100 - DNA, 25 bp, Mus musculus
accaaggctggcaagccttttagct

SEQ ID NO: 517101 - DNA, 25 bp, Mus musculus
accaaggctggctagccttttagct

SEQ ID NO: 517102 - DNA, 25 bp, Mus musculus
accaagggcagacggcacctcactg

SEQ ID NO: 517103 - DNA, 25 bp, Mus musculus
accaagggcagagggcacctcactg

SEQ ID NO: 517104 - DNA, 25 bp, Mus musculus
accaagggcagcaacgagtgtgtgt

SEQ ID NO: 517105 - DNA, 25 bp, Mus musculus
accaagggcagctacgagtgtgtgt

SEQ ID NO: 517106 - DNA, 25 bp, Mus musculus
accaagggctccatctactgccagg

SEQ ID NO: 517107 - DNA, 25 bp, Mus musculus
accaagggctccttctactgccagg

SEQ ID NO: 517108 - DNA, 25 bp, Mus musculus
accaaggtcaaacgcatagcagagg

SEQ ID NO: 517109 - DNA, 25 bp, Mus musculus
accaaggtcaaaggcatagcagagg

SEQ ID NO: 517110 - DNA, 25 bp, Mus musculus
accaaggtgactctgcggagcctca

SEQ ID NO: 517111 - DNA, 25 bp, Mus musculus
accaaggtgactgtgcggagcctca

SEQ ID NO: 517112 - DNA, 25 bp, Mus musculus
accaaggtgggcaaagatgagctct

SEQ ID NO: 517113 - DNA, 25 bp, Mus musculus
accaaggtgggctaagatgagctct

SEQ ID NO: 517114 - DNA, 25 bp, Mus musculus
accaaggttgtacagattcgctgag

SEQ ID NO: 517115 - DNA, 25 bp, Mus musculus
accaaggttgtagagattcgctgag

SEQ ID NO: 517116 - DNA, 25 bp, Mus musculus
accaagtgacaacgtgtttctaaat

SEQ ID NO: 517117 - DNA, 25 bp, Mus musculus
accaagtgacaaggtgtttctaaat

SEQ ID NO: 517118 - DNA, 25 bp, Mus musculus
accaagtgtctcatcgttggcctca

SEQ ID NO: 517119 - DNA, 25 bp, Mus musculus
accaagtgtctcttcgttggcctca

SEQ ID NO: 517120 - DNA, 25 bp, Mus musculus
accaagttcagaaggcccagctcta

SEQ ID NO: 517121 - DNA, 25 bp, Mus musculus
accaagttcagatggcccagctcta

SEQ ID NO: 517122 - DNA, 25 bp, Mus musculus
accaagttggtcaggattccttaca

SEQ ID NO: 517123 - DNA, 25 bp, Mus musculus
accaagttggtctggattccttaca

SEQ ID NO: 517124 - DNA, 25 bp, Mus musculus
accaataaatcaactatggagagtg

SEQ ID NO: 517125 - DNA, 25 bp, Mus musculus
accaataaatcatctatggagagtg

SEQ ID NO: 517126 - DNA, 25 bp, Mus musculus
accaatatctatccgccaccactgc

SEQ ID NO: 517127 - DNA, 25 bp, Mus musculus
accaatatctatgcgccaccactgc

SEQ ID NO: 517128 - DNA, 25 bp, Mus musculus
accaatatgctaatgagtgtgccca

SEQ ID NO: 517129 - DNA, 25 bp, Mus musculus
accaatatgctattgagtgtgccca

SEQ ID NO: 517130 - DNA, 25 bp, Mus musculus
accaatatgtagcaggctgcagccc

SEQ ID NO: 517131 - DNA, 25 bp, Mus musculus
accaatatgtaggaggctgcagccc

SEQ ID NO: 517132 - DNA, 25 bp, Mus musculus
accaatattatgcagtcacgccatg

SEQ ID NO: 517133 - DNA, 25 bp, Mus musculus
accaatattatggagtcacgccatg

SEQ ID NO: 517134 - DNA, 25 bp, Mus musculus
accaatcagaaacagtagcccctac

SEQ ID NO: 517135 - DNA, 25 bp, Mus musculus
accaatcagaaagagtagcccctac

SEQ ID NO: 517136 - DNA, 25 bp, Mus musculus
accaatcattgacgtgtgacccaac

SEQ ID NO: 517137 - DNA, 25 bp, Mus musculus
accaatcattgaggtgtgacccaac

SEQ ID NO: 517138 - DNA, 25 bp, Mus musculus
accaatccaaggagggctgcaggag

SEQ ID NO: 517139 - DNA, 25 bp, Mus musculus
accaatccaaggtgggctgcaggag

SEQ ID NO: 517140 - DNA, 25 bp, Mus musculus
accaatccaatgatgttccatctca

SEQ ID NO: 517141 - DNA, 25 bp, Mus musculus
accaatccaatgttgttccatctca

SEQ ID NO: 517142 - DNA, 25 bp, Mus musculus
accaatcccggcagccggtgtcagg

SEQ ID NO: 517143 - DNA, 25 bp, Mus musculus
accaatcccggctgccggtgtcagg

SEQ ID NO: 517144 - DNA, 25 bp, Mus musculus
accaatcctttcctggaagatgaga

SEQ ID NO: 517145 - DNA, 25 bp, Mus musculus
accaatcctttcgtggaagatgaga

SEQ ID NO: 517146 - DNA, 25 bp, Mus musculus
accaatcgaggtcctgtgtgagagc

SEQ ID NO: 517147 - DNA, 25 bp, Mus musculus
accaatcgaggtgctgtgtgagagc

SEQ ID NO: 517148 - DNA, 25 bp, Mus musculus
accaatctctcgcagggcgtcctgt

SEQ ID NO: 517149 - DNA, 25 bp, Mus musculus
accaatctctcggagggcgtcctgt

SEQ ID NO: 517150 - DNA, 25 bp, Mus musculus
accaatgtagccactgtgtttccag

SEQ ID NO: 517151 - DNA, 25 bp, Mus musculus
accaatgtagcctctgtgtttccag

SEQ ID NO: 517152 - DNA, 25 bp, Mus musculus
accaatgtggtacggcctgtcagca

SEQ ID NO: 517153 - DNA, 25 bp, Mus musculus
accaatgtggtagggcctgtcagca

SEQ ID NO: 517154 - DNA, 25 bp, Mus musculus
accaattaatgacaggtggcagaga

SEQ ID NO: 517155 - DNA, 25 bp, Mus musculus
accaattaatgagaggtggcagaga

SEQ ID NO: 517156 - DNA, 25 bp, Mus musculus
accaattgcacaccgcctagcaggg

SEQ ID NO: 517157 - DNA, 25 bp, Mus musculus
accaattgcacagcgcctagcaggg

SEQ ID NO: 517158 - DNA, 25 bp, Mus musculus
accaatttgactccactacacagag

SEQ ID NO: 517159 - DNA, 25 bp, Mus musculus
accaatttgactgcactacacagag

SEQ ID NO: 517160 - DNA, 25 bp, Mus musculus
accacaagccgaactggatgcatgc

SEQ ID NO: 517161 - DNA, 25 bp, Mus musculus
accacaagccgatctggatgcatgc

SEQ ID NO: 517162 - DNA, 25 bp, Mus musculus
accacaaggcgaattgtcggccaca

SEQ ID NO: 517163 - DNA, 25 bp, Mus musculus
accacaaggcgatttgtcggccaca

SEQ ID NO: 517164 - DNA, 25 bp, Mus musculus
accacacaaggtcgccagggagcac

SEQ ID NO: 517165 - DNA, 25 bp, Mus musculus
accacacaaggtggccagggagcac

SEQ ID NO: 517166 - DNA, 25 bp, Mus musculus
accacacagcagagctgctgacaca

SEQ ID NO: 517167 - DNA, 25 bp, Mus musculus
accacacagcagtgctgctgacaca

SEQ ID NO: 517168 - DNA, 25 bp, Mus musculus
accacagaaaagctaaaggagtcac

SEQ ID NO: 517169 - DNA, 25 bp, Mus musculus
accacagaaaaggtaaaggagtcac

SEQ ID NO: 517170 - DNA, 25 bp, Mus musculus
accacagaggacagactattaccct

SEQ ID NO: 517171 - DNA, 25 bp, Mus musculus
accacagaggactgactattaccct

SEQ ID NO: 517172 - DNA, 25 bp, Mus musculus
accacagatgcccatggactctgca

SEQ ID NO: 517173 - DNA, 25 bp, Mus musculus
accacagatgccgatggactctgca

SEQ ID NO: 517174 - DNA, 25 bp, Mus musculus
accacagccaagcactggaactgca

SEQ ID NO: 517175 - DNA, 25 bp, Mus musculus
accacagccaaggactggaactgca

SEQ ID NO: 517176 - DNA, 25 bp, Mus musculus
accacagcttccatagtcagtgtct

SEQ ID NO: 517177 - DNA, 25 bp, Mus musculus
accacagcttccttagtcagtgtct

SEQ ID NO: 517178 - DNA, 25 bp, Mus musculus
accacaggaacccaagagtgtaaga

SEQ ID NO: 517179 - DNA, 25 bp, Mus musculus
accacaggaaccgaagagtgtaaga

SEQ ID NO: 517180 - DNA, 25 bp, Mus musculus
accacaggcgctcaatgcctactat

SEQ ID NO: 517181 - DNA, 25 bp, Mus musculus
accacaggcgctgaatgcctactat

SEQ ID NO: 517182 - DNA, 25 bp, Mus musculus
accacagtactaaccgtcgtaggcg

SEQ ID NO: 517183 - DNA, 25 bp, Mus musculus
accacagtactatccgtcgtaggcg

SEQ ID NO: 517184 - DNA, 25 bp, Mus musculus
accacagtcacacagccagcctttg

SEQ ID NO: 517185 - DNA, 25 bp, Mus musculus
accacagtcacagagccagcctttg

SEQ ID NO: 517186 - DNA, 25 bp, Mus musculus
accacagtgcatcgaggacaccctg

SEQ ID NO: 517187 - DNA, 25 bp, Mus musculus
accacagtgcatggaggacaccctg

SEQ ID NO: 517188 - DNA, 25 bp, Mus musculus
accacagtggctatgccggagaggt

SEQ ID NO: 517189 - DNA, 25 bp, Mus musculus
accacagtggctttgccggagaggt

SEQ ID NO: 517190 - DNA, 25 bp, Mus musculus
accacagtggtgatgtgctgttgtg

SEQ ID NO: 517191 - DNA, 25 bp, Mus musculus
accacagtggtgttgtgctgttgtg

SEQ ID NO: 517192 - DNA, 25 bp, Mus musculus
accacagttgccaccttgctggaac

SEQ ID NO: 517193 - DNA, 25 bp, Mus musculus
accacagttgcctccttgctggaac

SEQ ID NO: 517194 - DNA, 25 bp, Mus musculus
accacatcagcacaggaagagcctg

SEQ ID NO: 517195 - DNA, 25 bp, Mus musculus
accacatcagcagaggaagagcctg

SEQ ID NO: 517196 - DNA, 25 bp, Mus musculus
accacatctgggagtactacagctg

SEQ ID NO: 517197 - DNA, 25 bp, Mus musculus
accacatctgggtgtactacagctg

SEQ ID NO: 517198 - DNA, 25 bp, Mus musculus
accacatgcttgaccgggcccatgg

SEQ ID NO: 517199 - DNA, 25 bp, Mus musculus
accacatgcttgtccgggcccatgg

SEQ ID NO: 517200 - DNA, 25 bp, Mus musculus
accacatggcggaagactgcaggga

SEQ ID NO: 517201 - DNA, 25 bp, Mus musculus
accacatggcggtagactgcaggga

SEQ ID NO: 517202 - DNA, 25 bp, Mus musculus
accacatgtgacatttggagaggaa

SEQ ID NO: 517203 - DNA, 25 bp, Mus musculus
accacatgtgacttttggagaggaa

SEQ ID NO: 517204 - DNA, 25 bp, Mus musculus
accaccaaagatcccggacaagcag

SEQ ID NO: 517205 - DNA, 25 bp, Mus musculus
accaccaaagatgccggacaagcag

SEQ ID NO: 517206 - DNA, 25 bp, Mus musculus
accaccaagtggctcgggatctgaa

SEQ ID NO: 517207 - DNA, 25 bp, Mus musculus
accaccaagtgggtcgggatctgaa

SEQ ID NO: 517208 - DNA, 25 bp, Mus musculus
accaccagaaaccttcatggagaag

SEQ ID NO: 517209 - DNA, 25 bp, Mus musculus
accaccagaaacgttcatggagaag

SEQ ID NO: 517210 - DNA, 25 bp, Mus musculus
accaccagcagtaataacaacagta

SEQ ID NO: 517211 - DNA, 25 bp, Mus musculus
accaccagcagttataacaacagta

SEQ ID NO: 517212 - DNA, 25 bp, Mus musculus
accaccaggcagcatgagcgagctg

SEQ ID NO: 517213 - DNA, 25 bp, Mus musculus
accaccaggcaggatgagcgagctg

SEQ ID NO: 517214 - DNA, 25 bp, Mus musculus
accaccagtctgatctgcacagcgg

SEQ ID NO: 517215 - DNA, 25 bp, Mus musculus
accaccagtctgttctgcacagcgg

SEQ ID NO: 517216 - DNA, 25 bp, Mus musculus
accaccatgacacggactgtactga

SEQ ID NO: 517217 - DNA, 25 bp, Mus musculus
accaccatgacagggactgtactga

SEQ ID NO: 517218 - DNA, 25 bp, Mus musculus
accaccatgatcattgattttgcca

SEQ ID NO: 517219 - DNA, 25 bp, Mus musculus
accaccatgatctttgattttgcca

SEQ ID NO: 517220 - DNA, 25 bp, Mus musculus
accaccatggatcccgagctggagt

SEQ ID NO: 517221 - DNA, 25 bp, Mus musculus
accaccatggatgccgagctggagt

SEQ ID NO: 517222 - DNA, 25 bp, Mus musculus
accaccattcaaattgacagcaaag

SEQ ID NO: 517223 - DNA, 25 bp, Mus musculus
accaccattcaatttgacagcaaag

SEQ ID NO: 517224 - DNA, 25 bp, Mus musculus
accacccacggtagaagaacagcca

SEQ ID NO: 517225 - DNA, 25 bp, Mus musculus
accacccacggttgaagaacagcca

SEQ ID NO: 517226 - DNA, 25 bp, Mus musculus
accaccccagttacagagatggaga

SEQ ID NO: 517227 - DNA, 25 bp, Mus musculus
accaccccagtttcagagatggaga

SEQ ID NO: 517228 - DNA, 25 bp, Mus musculus
accaccccgccgagtgaggctgaag

SEQ ID NO: 517229 - DNA, 25 bp, Mus musculus
accaccccgccgtgtgaggctgaag

SEQ ID NO: 517230 - DNA, 25 bp, Mus musculus
accacccctgggatctatggctgct

SEQ ID NO: 517231 - DNA, 25 bp, Mus musculus
accacccctgggttctatggctgct

SEQ ID NO: 517232 - DNA, 25 bp, Mus musculus
accacccggagacgacgccttgaga

SEQ ID NO: 517233 - DNA, 25 bp, Mus musculus
accacccggagaggacgccttgaga

SEQ ID NO: 517234 - DNA, 25 bp, Mus musculus
accacccgggtgcagatagatcgag

SEQ ID NO: 517235 - DNA, 25 bp, Mus musculus
accacccgggtggagatagatcgag

SEQ ID NO: 517236 - DNA, 25 bp, Mus musculus
accaccctgaggatgtagaacctgc

SEQ ID NO: 517237 - DNA, 25 bp, Mus musculus
accaccctgaggttgtagaacctgc

SEQ ID NO: 517238 - DNA, 25 bp, Mus musculus
accaccgacgcaacgctcagaaagt

SEQ ID NO: 517239 - DNA, 25 bp, Mus musculus
accaccgacgcatcgctcagaaagt

SEQ ID NO: 517240 - DNA, 25 bp, Mus musculus
accaccgctgagcacgaggaccttg

SEQ ID NO: 517241 - DNA, 25 bp, Mus musculus
accaccgctgaggacgaggaccttg

SEQ ID NO: 517242 - DNA, 25 bp, Mus musculus
accaccgtggcaccaacaacctgta

SEQ ID NO: 517243 - DNA, 25 bp, Mus musculus
accaccgtggcagcaacaacctgta

SEQ ID NO: 517244 - DNA, 25 bp, Mus musculus
accacctaagccctctaaggcaaag

SEQ ID NO: 517245 - DNA, 25 bp, Mus musculus
accacctaagccgtctaaggcaaag

SEQ ID NO: 517246 - DNA, 25 bp, Mus musculus
accacctatgttaggcagacatctt

SEQ ID NO: 517247 - DNA, 25 bp, Mus musculus
accacctatgtttggcagacatctt

SEQ ID NO: 517248 - DNA, 25 bp, Mus musculus
accacctccacccaaggttgaggat

SEQ ID NO: 517249 - DNA, 25 bp, Mus musculus
accacctccaccgaaggttgaggat

SEQ ID NO: 517250 - DNA, 25 bp, Mus musculus
accacctctgtgctgctgcagttgg

SEQ ID NO: 517251 - DNA, 25 bp, Mus musculus
accacctctgtggtgctgcagttgg

SEQ ID NO: 517252 - DNA, 25 bp, Mus musculus
accacctcttggcagtctttgtaga

SEQ ID NO: 517253 - DNA, 25 bp, Mus musculus
accacctcttgggagtctttgtaga

SEQ ID NO: 517254 - DNA, 25 bp, Mus musculus
accacctgaggaagatccccaggga

SEQ ID NO: 517255 - DNA, 25 bp, Mus musculus
accacctgaggatgatccccaggga

SEQ ID NO: 517256 - DNA, 25 bp, Mus musculus
accacctggaccacatcaagaaggt

SEQ ID NO: 517257 - DNA, 25 bp, Mus musculus
accacctggacctcatcaagaaggt

SEQ ID NO: 517258 - DNA, 25 bp, Mus musculus
accacctgggacaggactcgagcag

SEQ ID NO: 517259 - DNA, 25 bp, Mus musculus
accacctgggacatggagctacaaa

SEQ ID NO: 517260 - DNA, 25 bp, Mus musculus
accacctgggactggactcgagcag

SEQ ID NO: 517261 - DNA, 25 bp, Mus musculus
accacctgggacttggagctacaaa

SEQ ID NO: 517262 - DNA, 25 bp, Mus musculus
accacctggtggagattcctcccaa

SEQ ID NO: 517263 - DNA, 25 bp, Mus musculus
accacctggtggtgattcctcccaa

SEQ ID NO: 517264 - DNA, 25 bp, Mus musculus
accaccttctagctcacgtatttac

SEQ ID NO: 517265 - DNA, 25 bp, Mus musculus
accaccttctaggtcacgtatttac

SEQ ID NO: 517266 - DNA, 25 bp, Mus musculus
accacgaaatgactaatcaggagtc

SEQ ID NO: 517267 - DNA, 25 bp, Mus musculus
accacgaaatgagtaatcaggagtc

SEQ ID NO: 517268 - DNA, 25 bp, Mus musculus
accacgaacaccatagcaccattgt

SEQ ID NO: 517269 - DNA, 25 bp, Mus musculus
accacgaacaccttagcaccattgt

SEQ ID NO: 517270 - DNA, 25 bp, Mus musculus
accacgaaggtgcatgcactgaaga

SEQ ID NO: 517271 - DNA, 25 bp, Mus musculus
accacgaaggtggatgcactgaaga

SEQ ID NO: 517272 - DNA, 25 bp, Mus musculus
accacgagacaacaagcaagcaggg

SEQ ID NO: 517273 - DNA, 25 bp, Mus musculus
accacgagacaagaagcaagcaggg

SEQ ID NO: 517274 - DNA, 25 bp, Mus musculus
accacgagtcaacacccaatgctgt

SEQ ID NO: 517275 - DNA, 25 bp, Mus musculus
accacgagtcaagacccaatgctgt

SEQ ID NO: 517276 - DNA, 25 bp, Mus musculus
accacgagttccatgccaagtgtgt

SEQ ID NO: 517277 - DNA, 25 bp, Mus musculus
accacgagttccttgccaagtgtgt

SEQ ID NO: 517278 - DNA, 25 bp, Mus musculus
accacgatgactagtacctcaatgc

SEQ ID NO: 517279 - DNA, 25 bp, Mus musculus
accacgatgacttgtacctcaatgc

SEQ ID NO: 517280 - DNA, 25 bp, Mus musculus
accacgccaaccaggaggtgcagcg

SEQ ID NO: 517281 - DNA, 25 bp, Mus musculus
accacgccaacctggaggtgcagcg

SEQ ID NO: 517282 - DNA, 25 bp, Mus musculus
accacgcccagtaaggcccagaagt

SEQ ID NO: 517283 - DNA, 25 bp, Mus musculus
accacgcccagttaggcccagaagt

SEQ ID NO: 517284 - DNA, 25 bp, Mus musculus
accacgcccctgcacagggataaga

SEQ ID NO: 517285 - DNA, 25 bp, Mus musculus
accacgcccctggacagggataaga

SEQ ID NO: 517286 - DNA, 25 bp, Mus musculus
accacgcggaagcagaagcgcatct

SEQ ID NO: 517287 - DNA, 25 bp, Mus musculus
accacgcggaaggagaagcgcatct

SEQ ID NO: 517288 - DNA, 25 bp, Mus musculus
accacgcggttcagctctttcggag

SEQ ID NO: 517289 - DNA, 25 bp, Mus musculus
accacgcggttctgctctttcggag

SEQ ID NO: 517290 - DNA, 25 bp, Mus musculus
accacgctctcaacgatatgacttc

SEQ ID NO: 517291 - DNA, 25 bp, Mus musculus
accacgctctcatcgatatgacttc

SEQ ID NO: 517292 - DNA, 25 bp, Mus musculus
accacggagcccagtcgctgtgagt

SEQ ID NO: 517293 - DNA, 25 bp, Mus musculus
accacggagccctgtcgctgtgagt

SEQ ID NO: 517294 - DNA, 25 bp, Mus musculus
accacggcaacaaggccttgaacgg

SEQ ID NO: 517295 - DNA, 25 bp, Mus musculus
accacggcaacatggccttgaacgg

SEQ ID NO: 517296 - DNA, 25 bp, Mus musculus
accacggccagtcgactttcctgga

SEQ ID NO: 517297 - DNA, 25 bp, Mus musculus
accacggccagtggactttcctgga

SEQ ID NO: 517298 - DNA, 25 bp, Mus musculus
accacggcctacaatcgcggagcta

SEQ ID NO: 517299 - DNA, 25 bp, Mus musculus
accacggcctactatcgcggagcta

SEQ ID NO: 517300 - DNA, 25 bp, Mus musculus
accacgggcttcagtctgcactcag

SEQ ID NO: 517301 - DNA, 25 bp, Mus musculus
accacgggcttctgtctgcactcag

SEQ ID NO: 517302 - DNA, 25 bp, Mus musculus
accacggtggccaaaattcttagct

SEQ ID NO: 517303 - DNA, 25 bp, Mus musculus
accacggtggcctaaattcttagct

SEQ ID NO: 517304 - DNA, 25 bp, Mus musculus
accactagatgactgccagaaactc

SEQ ID NO: 517305 - DNA, 25 bp, Mus musculus
accactagatgagtgccagaaactc

SEQ ID NO: 517306 - DNA, 25 bp, Mus musculus
accactcatctgagggacctcactg

SEQ ID NO: 517307 - DNA, 25 bp, Mus musculus
accactcatctgtgggacctcactg

SEQ ID NO: 517308 - DNA, 25 bp, Mus musculus
accactcggcggcatgtgctggatt

SEQ ID NO: 517309 - DNA, 25 bp, Mus musculus
accactcggcgggatgtgctggatt

SEQ ID NO: 517310 - DNA, 25 bp, Mus musculus
accactctccggaaaaagcacagat

SEQ ID NO: 517311 - DNA, 25 bp, Mus musculus
accactctccggtaaaagcacagat

SEQ ID NO: 517312 - DNA, 25 bp, Mus musculus
accactctgcagctatgtgggccct

SEQ ID NO: 517313 - DNA, 25 bp, Mus musculus
accactctgcaggtatgtgggccct

SEQ ID NO: 517314 - DNA, 25 bp, Mus musculus
accactctgtctacagcacattcaa

SEQ ID NO: 517315 - DNA, 25 bp, Mus musculus
accactctgtcttcagcacattcaa

SEQ ID NO: 517316 - DNA, 25 bp, Mus musculus
accactgcaatgcacagaatcccag

SEQ ID NO: 517317 - DNA, 25 bp, Mus musculus
accactgcaatggacagaatcccag

SEQ ID NO: 517318 - DNA, 25 bp, Mus musculus
accactgcacatcgcggcttctgag

SEQ ID NO: 517319 - DNA, 25 bp, Mus musculus
accactgcacatggcggcttctgag

SEQ ID NO: 517320 - DNA, 25 bp, Mus musculus
accactgcacttaacttcacatact

SEQ ID NO: 517321 - DNA, 25 bp, Mus musculus
accactgcactttacttcacatact

SEQ ID NO: 517322 - DNA, 25 bp, Mus musculus
accactgctctacgctgtgcgtggg

SEQ ID NO: 517323 - DNA, 25 bp, Mus musculus
accactgctctaggctgtgcgtggg

SEQ ID NO: 517324 - DNA, 25 bp, Mus musculus
accactgctgggacctcaatgccgg

SEQ ID NO: 517325 - DNA, 25 bp, Mus musculus
accactgctgggtcctcaatgccgg

SEQ ID NO: 517326 - DNA, 25 bp, Mus musculus
accactggactgatgtcgctgccag

SEQ ID NO: 517327 - DNA, 25 bp, Mus musculus
accactggactgttgtcgctgccag

SEQ ID NO: 517328 - DNA, 25 bp, Mus musculus
accactggataaccctgctgcagag

SEQ ID NO: 517329 - DNA, 25 bp, Mus musculus
accactggataagcctgctgcagag

SEQ ID NO: 517330 - DNA, 25 bp, Mus musculus
accactggctatcaggaagctgcag

SEQ ID NO: 517331 - DNA, 25 bp, Mus musculus
accactggctatgaggaagctgcag

SEQ ID NO: 517332 - DNA, 25 bp, Mus musculus
accactgtgaagattgtcataaaga

SEQ ID NO: 517333 - DNA, 25 bp, Mus musculus
accactgtgaagtttgtcataaaga

SEQ ID NO: 517334 - DNA, 25 bp, Mus musculus
accactgttcctccgcaggattgta

SEQ ID NO: 517335 - DNA, 25 bp, Mus musculus
accactgttcctgcgcaggattgta

SEQ ID NO: 517336 - DNA, 25 bp, Mus musculus
accactgttgctcgcttatgaagac

SEQ ID NO: 517337 - DNA, 25 bp, Mus musculus
accactgttgctggcttatgaagac

SEQ ID NO: 517338 - DNA, 25 bp, Mus musculus
accacttggtggcttgaaattatgt

SEQ ID NO: 517339 - DNA, 25 bp, Mus musculus
accacttggtgggttgaaattatgt

SEQ ID NO: 517340 - DNA, 25 bp, Mus musculus
accactttgtgtctgactgcaggaa

SEQ ID NO: 517341 - DNA, 25 bp, Mus musculus
accactttgtgtgtgactgcaggaa

SEQ ID NO: 517342 - DNA, 25 bp, Mus musculus
accagaaaaggcaagaaatcatcaa

SEQ ID NO: 517343 - DNA, 25 bp, Mus musculus
accagaaaaggctagaaatcatcaa

SEQ ID NO: 517344 - DNA, 25 bp, Mus musculus
accagaaacctcctacggccgagag

SEQ ID NO: 517345 - DNA, 25 bp, Mus musculus
accagaaacctcgtacggccgagag

SEQ ID NO: 517346 - DNA, 25 bp, Mus musculus
accagaaatccaagtctgcctccgt

SEQ ID NO: 517347 - DNA, 25 bp, Mus musculus
accagaaatccatgtctgcctccgt

SEQ ID NO: 517348 - DNA, 25 bp, Mus musculus
accagaacaattaccagccctacta

SEQ ID NO: 517349 - DNA, 25 bp, Mus musculus
accagaacaatttccagccctacta

SEQ ID NO: 517350 - DNA, 25 bp, Mus musculus
accagaacgctcagggggacaagag

SEQ ID NO: 517351 - DNA, 25 bp, Mus musculus
accagaacgctctgggggacaagag

SEQ ID NO: 517352 - DNA, 25 bp, Mus musculus
accagaacggcaaccatgtggttca

SEQ ID NO: 517353 - DNA, 25 bp, Mus musculus
accagaacggcatccatgtggttca

SEQ ID NO: 517354 - DNA, 25 bp, Mus musculus
accagaagatgtaagtgatgtgccc

SEQ ID NO: 517355 - DNA, 25 bp, Mus musculus
accagaagatgttagtgatgtgccc

SEQ ID NO: 517356 - DNA, 25 bp, Mus musculus
accagaagggtcaccaggcatacca

SEQ ID NO: 517357 - DNA, 25 bp, Mus musculus
accagaagggtctccaggcatacca

SEQ ID NO: 517358 - DNA, 25 bp, Mus musculus
accagaatatctctggccatggaca

SEQ ID NO: 517359 - DNA, 25 bp, Mus musculus
accagaatatctgtggccatggaca

SEQ ID NO: 517360 - DNA, 25 bp, Mus musculus
accagaatatggaggctgactgttc

SEQ ID NO: 517361 - DNA, 25 bp, Mus musculus
accagaatatggtggctgactgttc

SEQ ID NO: 517362 - DNA, 25 bp, Mus musculus
accagaccagaaacacttctgagtc

SEQ ID NO: 517363 - DNA, 25 bp, Mus musculus
accagaccagaatcacttctgagtc

SEQ ID NO: 517364 - DNA, 25 bp, Mus musculus
accagacgatatctttgcggttgga

SEQ ID NO: 517365 - DNA, 25 bp, Mus musculus
accagacgatatgtttgcggttgga

SEQ ID NO: 517366 - DNA, 25 bp, Mus musculus
accagacggagaagcctagtgctat

SEQ ID NO: 517367 - DNA, 25 bp, Mus musculus
accagacggagatgcctagtgctat

SEQ ID NO: 517368 - DNA, 25 bp, Mus musculus
accagactagcaactctcagtgggt

SEQ ID NO: 517369 - DNA, 25 bp, Mus musculus
accagactagcatctctcagtgggt

SEQ ID NO: 517370 - DNA, 25 bp, Mus musculus
accagactgaagagacttataatga

SEQ ID NO: 517371 - DNA, 25 bp, Mus musculus
accagactgaagtgacttataatga

SEQ ID NO: 517372 - DNA, 25 bp, Mus musculus
accagactgtggacttcgtcagcag

SEQ ID NO: 517373 - DNA, 25 bp, Mus musculus
accagactgtggtcttcgtcagcag

SEQ ID NO: 517374 - DNA, 25 bp, Mus musculus
accagacttggtcgcgcccgaagtg

SEQ ID NO: 517375 - DNA, 25 bp, Mus musculus
accagacttggtggcgcccgaagtg

SEQ ID NO: 517376 - DNA, 25 bp, Mus musculus
accagagaaacaccaggccatgcat

SEQ ID NO: 517377 - DNA, 25 bp, Mus musculus
accagagaaacagcaggccatgcat

SEQ ID NO: 517378 - DNA, 25 bp, Mus musculus
accagagaagaaatcacttagacag

SEQ ID NO: 517379 - DNA, 25 bp, Mus musculus
accagagaagaattcacttagacag

SEQ ID NO: 517380 - DNA, 25 bp, Mus musculus
accagagaatcacatgctgctgctc

SEQ ID NO: 517381 - DNA, 25 bp, Mus musculus
accagagaatcagatgctgctgctc

SEQ ID NO: 517382 - DNA, 25 bp, Mus musculus
accagagagggtagcagagcctgct

SEQ ID NO: 517383 - DNA, 25 bp, Mus musculus
accagagagggttgcagagcctgct

SEQ ID NO: 517384 - DNA, 25 bp, Mus musculus
accagagccgccagctggtgtgtga

SEQ ID NO: 517385 - DNA, 25 bp, Mus musculus
accagagccgcctgctggtgtgtga

SEQ ID NO: 517386 - DNA, 25 bp, Mus musculus
accagagcctggctaccctgggaag

SEQ ID NO: 517387 - DNA, 25 bp, Mus musculus
accagagcctgggtaccctgggaag

SEQ ID NO: 517388 - DNA, 25 bp, Mus musculus
accagagcgatcaggcctcagttgg

SEQ ID NO: 517389 - DNA, 25 bp, Mus musculus
accagagcgatctggcctcagttgg

SEQ ID NO: 517390 - DNA, 25 bp, Mus musculus
accagagcgggcatctgtgggcaac

SEQ ID NO: 517391 - DNA, 25 bp, Mus musculus
accagagcgggcttctgtgggcaac

SEQ ID NO: 517392 - DNA, 25 bp, Mus musculus
accagaggacctacgtcctggaggt

SEQ ID NO: 517393 - DNA, 25 bp, Mus musculus
accagaggaccttcgtcctggaggt

SEQ ID NO: 517394 - DNA, 25 bp, Mus musculus
accagaggactaaccaacctcctag

SEQ ID NO: 517395 - DNA, 25 bp, Mus musculus
accagaggactatccaacctcctag

SEQ ID NO: 517396 - DNA, 25 bp, Mus musculus
accagagggacaaggaacgagaacg

SEQ ID NO: 517397 - DNA, 25 bp, Mus musculus
accagagggacatggaacgagaacg

SEQ ID NO: 517398 - DNA, 25 bp, Mus musculus
accagagggcctcaaagagagaaag

SEQ ID NO: 517399 - DNA, 25 bp, Mus musculus
accagagggcctgaaagagagaaag

SEQ ID NO: 517400 - DNA, 25 bp, Mus musculus
accagagtcaggagtcccggtggac

SEQ ID NO: 517401 - DNA, 25 bp, Mus musculus
accagagtcaggtgtcccggtggac

SEQ ID NO: 517402 - DNA, 25 bp, Mus musculus
accagagtccagagtgcctgagact

SEQ ID NO: 517403 - DNA, 25 bp, Mus musculus
accagagtccagtgtgcctgagact

SEQ ID NO: 517404 - DNA, 25 bp, Mus musculus
accagagtccttccgtgggtcaaag

SEQ ID NO: 517405 - DNA, 25 bp, Mus musculus
accagagtccttgcgtgggtcaaag

SEQ ID NO: 517406 - DNA, 25 bp, Mus musculus
accagagttatgactggaggcagca

SEQ ID NO: 517407 - DNA, 25 bp, Mus musculus
accagagttatgtctggaggcagca

SEQ ID NO: 517408 - DNA, 25 bp, Mus musculus
accagagttcgtaggccaaggagtg

SEQ ID NO: 517409 - DNA, 25 bp, Mus musculus
accagagttcgttggccaaggagtg

SEQ ID NO: 517410 - DNA, 25 bp, Mus musculus
accagatcctagaggtgacccggtt

SEQ ID NO: 517411 - DNA, 25 bp, Mus musculus
accagatcctagtggtgacccggtt

SEQ ID NO: 517412 - DNA, 25 bp, Mus musculus
accagatctcatagccaccacgtgg

SEQ ID NO: 517413 - DNA, 25 bp, Mus musculus
accagatctcattgccaccacgtgg

SEQ ID NO: 517414 - DNA, 25 bp, Mus musculus
accagatgacaactgcagggcccgt

SEQ ID NO: 517415 - DNA, 25 bp, Mus musculus
accagatgacaagtgcagggcccgt

SEQ ID NO: 517416 - DNA, 25 bp, Mus musculus
accagatgagctacggtacttgcca

SEQ ID NO: 517417 - DNA, 25 bp, Mus musculus
accagatgagcttcggtacttgcca

SEQ ID NO: 517418 - DNA, 25 bp, Mus musculus
accagcaagatgataacaatgtatg

SEQ ID NO: 517419 - DNA, 25 bp, Mus musculus
accagcaagatgttaacaatgtatg

SEQ ID NO: 517420 - DNA, 25 bp, Mus musculus
accagcaagcgccagagcaagtgga

SEQ ID NO: 517421 - DNA, 25 bp, Mus musculus
accagcaagcgcgagagcaagtgga

SEQ ID NO: 517422 - DNA, 25 bp, Mus musculus
accagcaatatcatgaacaggctgc

SEQ ID NO: 517423 - DNA, 25 bp, Mus musculus
accagcaatatcttgaacaggctgc

SEQ ID NO: 517424 - DNA, 25 bp, Mus musculus
accagcacctgtaaagaccatgacc

SEQ ID NO: 517425 - DNA, 25 bp, Mus musculus
accagcacctgttaagaccatgacc

SEQ ID NO: 517426 - DNA, 25 bp, Mus musculus
accagcagacagagttttaacgtct

SEQ ID NO: 517427 - DNA, 25 bp, Mus musculus
accagcagacagtgttttaacgtct

SEQ ID NO: 517428 - DNA, 25 bp, Mus musculus
accagcagctcaatttctacccaag

SEQ ID NO: 517429 - DNA, 25 bp, Mus musculus
accagcagctcattttctacccaag

SEQ ID NO: 517430 - DNA, 25 bp, Mus musculus
accagcaggagcctgaaggcgcact

SEQ ID NO: 517431 - DNA, 25 bp, Mus musculus
accagcaggagcgtgaaggcgcact

SEQ ID NO: 517432 - DNA, 25 bp, Mus musculus
accagcaggtgacacagatggccct

SEQ ID NO: 517433 - DNA, 25 bp, Mus musculus
accagcaggtgagacagatggccct

SEQ ID NO: 517434 - DNA, 25 bp, Mus musculus
accagcagtgccaacgaggacatgc

SEQ ID NO: 517435 - DNA, 25 bp, Mus musculus
accagcagtgcctacgaggacatgc

SEQ ID NO: 517436 - DNA, 25 bp, Mus musculus
accagcagtttaaccagcagatgct

SEQ ID NO: 517437 - DNA, 25 bp, Mus musculus
accagcagtttatccagcagatgct

SEQ ID NO: 517438 - DNA, 25 bp, Mus musculus
accagcatctgcagaagactggcag

SEQ ID NO: 517439 - DNA, 25 bp, Mus musculus
accagcatctgctgaagactggcag

SEQ ID NO: 517440 - DNA, 25 bp, Mus musculus
accagcatggcacggttcaagcgag

SEQ ID NO: 517441 - DNA, 25 bp, Mus musculus
accagcatggcagggttcaagcgag

SEQ ID NO: 517442 - DNA, 25 bp, Mus musculus
accagccaaggccaacacagacggg

SEQ ID NO: 517443 - DNA, 25 bp, Mus musculus
accagccaaggcgaacacagacggg

SEQ ID NO: 517444 - DNA, 25 bp, Mus musculus
accagcccgttgcttgtgaaaccat

SEQ ID NO: 517445 - DNA, 25 bp, Mus musculus
accagcccgttggttgtgaaaccat

SEQ ID NO: 517446 - DNA, 25 bp, Mus musculus
accagccctactaaaggaggacgct

SEQ ID NO: 517447 - DNA, 25 bp, Mus musculus
accagccctacttaaggaggacgct

SEQ ID NO: 517448 - DNA, 25 bp, Mus musculus
accagccctggcattcactgcgaag

SEQ ID NO: 517449 - DNA, 25 bp, Mus musculus
accagccctggctttcactgcgaag

SEQ ID NO: 517450 - DNA, 25 bp, Mus musculus
accagccggtggaactcagcccggg

SEQ ID NO: 517451 - DNA, 25 bp, Mus musculus
accagccggtggtactcagcccggg

SEQ ID NO: 517452 - DNA, 25 bp, Mus musculus
accagcctcactctggactagagaa

SEQ ID NO: 517453 - DNA, 25 bp, Mus musculus
accagcctcactgtggactagagaa

SEQ ID NO: 517454 - DNA, 25 bp, Mus musculus
accagcctcgatctgacagtggagg

SEQ ID NO: 517455 - DNA, 25 bp, Mus musculus
accagcctcgatgtgacagtggagg

SEQ ID NO: 517456 - DNA, 25 bp, Mus musculus
accagcctgaagctccggaagtcac

SEQ ID NO: 517457 - DNA, 25 bp, Mus musculus
accagcctgaaggtccggaagtcac

SEQ ID NO: 517458 - DNA, 25 bp, Mus musculus
accagcctgacacgtaaggacagga

SEQ ID NO: 517459 - DNA, 25 bp, Mus musculus
accagcctgacaggtaaggacagga

SEQ ID NO: 517460 - DNA, 25 bp, Mus musculus
accagcctgagaacccgcagcattt

SEQ ID NO: 517461 - DNA, 25 bp, Mus musculus
accagcctgagatcccgcagcattt

SEQ ID NO: 517462 - DNA, 25 bp, Mus musculus
accagcctgccgaattcatcgagga

SEQ ID NO: 517463 - DNA, 25 bp, Mus musculus
accagcctgccgtattcatcgagga

SEQ ID NO: 517464 - DNA, 25 bp, Mus musculus
accagcctgtggagagtatctcatg

SEQ ID NO: 517465 - DNA, 25 bp, Mus musculus
accagcctgtggtgagtatctcatg

SEQ ID NO: 517466 - DNA, 25 bp, Mus musculus
accagcctttggagtgcatagtaga

SEQ ID NO: 517467 - DNA, 25 bp, Mus musculus
accagcctttggtgtgcatagtaga

SEQ ID NO: 517468 - DNA, 25 bp, Mus musculus
accagcgaatcacccaggatgtgga

SEQ ID NO: 517469 - DNA, 25 bp, Mus musculus
accagcgaatcagccaggatgtgga

SEQ ID NO: 517470 - DNA, 25 bp, Mus musculus
accagcggacatcagccagaagcaa

SEQ ID NO: 517471 - DNA, 25 bp, Mus musculus
accagcggacatgagccagaagcaa

SEQ ID NO: 517472 - DNA, 25 bp, Mus musculus
accagcgggtccctgctgacatgat

SEQ ID NO: 517473 - DNA, 25 bp, Mus musculus
accagcgggtccgtgctgacatgat

SEQ ID NO: 517474 - DNA, 25 bp, Mus musculus
accagcggtggcagagacccctgac

SEQ ID NO: 517475 - DNA, 25 bp, Mus musculus
accagcggtggctgagacccctgac

SEQ ID NO: 517476 - DNA, 25 bp, Mus musculus
accagcgtgccgaagagaacgagct

SEQ ID NO: 517477 - DNA, 25 bp, Mus musculus
accagcgtgccgtagagaacgagct

SEQ ID NO: 517478 - DNA, 25 bp, Mus musculus
accagcgttataagatcaagatgac

SEQ ID NO: 517479 - DNA, 25 bp, Mus musculus
accagcgttatatgatcaagatgac

SEQ ID NO: 517480 - DNA, 25 bp, Mus musculus
accagctcagcaccaggcaaagagg

SEQ ID NO: 517481 - DNA, 25 bp, Mus musculus
accagctcagcagcaggcaaagagg

SEQ ID NO: 517482 - DNA, 25 bp, Mus musculus
accagctccggaattcgtcccgtgg

SEQ ID NO: 517483 - DNA, 25 bp, Mus musculus
accagctccggatttcgtcccgtgg

SEQ ID NO: 517484 - DNA, 25 bp, Mus musculus
accagctcctccaaacccattcagc

SEQ ID NO: 517485 - DNA, 25 bp, Mus musculus
accagctcctcctaacccattcagc

SEQ ID NO: 517486 - DNA, 25 bp, Mus musculus
accagctcctggctaacccgggtat

SEQ ID NO: 517487 - DNA, 25 bp, Mus musculus
accagctcctgggtaacccgggtat

SEQ ID NO: 517488 - DNA, 25 bp, Mus musculus
accagctggacacggctctggcaaa

SEQ ID NO: 517489 - DNA, 25 bp, Mus musculus
accagctggacagggctctggcaaa

SEQ ID NO: 517490 - DNA, 25 bp, Mus musculus
accagctgtcagcaggtcagcgaca

SEQ ID NO: 517491 - DNA, 25 bp, Mus musculus
accagctgtcaggaggtcagcgaca

SEQ ID NO: 517492 - DNA, 25 bp, Mus musculus
accagcttttctacattgcctttgc

SEQ ID NO: 517493 - DNA, 25 bp, Mus musculus
accagcttttcttcattgcctttgc

SEQ ID NO: 517494 - DNA, 25 bp, Mus musculus
accaggaacagaccgctagaggccg

SEQ ID NO: 517495 - DNA, 25 bp, Mus musculus
accaggaacagagcgctagaggccg

SEQ ID NO: 517496 - DNA, 25 bp, Mus musculus
accaggaagaaccacatactgaaga

SEQ ID NO: 517497 - DNA, 25 bp, Mus musculus
accaggaagaacgacatactgaaga

SEQ ID NO: 517498 - DNA, 25 bp, Mus musculus
accaggacgacacagccaatggacc

SEQ ID NO: 517499 - DNA, 25 bp, Mus musculus
accaggacgacagagccaatggacc

SEQ ID NO: 517500 - DNA, 25 bp, Mus musculus
accaggactgtcacgttcccagggc

SEQ ID NO: 517501 - DNA, 25 bp, Mus musculus
accaggactgtctcgttcccagggc

SEQ ID NO: 517502 - DNA, 25 bp, Mus musculus
accaggagagcgaaggcgagaagga

SEQ ID NO: 517503 - DNA, 25 bp, Mus musculus
accaggagagcgtaggcgagaagga

SEQ ID NO: 517504 - DNA, 25 bp, Mus musculus
accaggagctcaagcaactgaaggc

SEQ ID NO: 517505 - DNA, 25 bp, Mus musculus
accaggagctcatgcaactgaaggc

SEQ ID NO: 517506 - DNA, 25 bp, Mus musculus
accaggagctgcacgtggactcagt

SEQ ID NO: 517507 - DNA, 25 bp, Mus musculus
accaggagctgctcgtggactcagt

SEQ ID NO: 517508 - DNA, 25 bp, Mus musculus
accaggaggctaatctctccacggt

SEQ ID NO: 517509 - DNA, 25 bp, Mus musculus
accaggaggctattctctccacggt

SEQ ID NO: 517510 - DNA, 25 bp, Mus musculus
accaggatcacacaacggagaatct

SEQ ID NO: 517511 - DNA, 25 bp, Mus musculus
accaggatcacagaacggagaatct

SEQ ID NO: 517512 - DNA, 25 bp, Mus musculus
accaggatctacagccattcactgc

SEQ ID NO: 517513 - DNA, 25 bp, Mus musculus
accaggatctactgccattcactgc

SEQ ID NO: 517514 - DNA, 25 bp, Mus musculus
accaggatggccagtggcacccagc

SEQ ID NO: 517515 - DNA, 25 bp, Mus musculus
accaggatggcctgtggcacccagc

SEQ ID NO: 517516 - DNA, 25 bp, Mus musculus
accaggatgtggatgtcaagtactt

SEQ ID NO: 517517 - DNA, 25 bp, Mus musculus
accaggatgtggttgtcaagtactt

SEQ ID NO: 517518 - DNA, 25 bp, Mus musculus
accaggattggtccacatgggcccc

SEQ ID NO: 517519 - DNA, 25 bp, Mus musculus
accaggattggtgcacatgggcccc

SEQ ID NO: 517520 - DNA, 25 bp, Mus musculus
accaggcagggcactgcacgcatgc

SEQ ID NO: 517521 - DNA, 25 bp, Mus musculus
accaggcagggctctgcacgcatgc

SEQ ID NO: 517522 - DNA, 25 bp, Mus musculus
accaggcatcaaaggcgatgtggga

SEQ ID NO: 517523 - DNA, 25 bp, Mus musculus
accaggcatcaatggcgatgtggga

SEQ ID NO: 517524 - DNA, 25 bp, Mus musculus
accaggcattggagccagtgaacag

SEQ ID NO: 517525 - DNA, 25 bp, Mus musculus
accaggcattggtgccagtgaacag

SEQ ID NO: 517526 - DNA, 25 bp, Mus musculus
accaggcccaggaccaagaaggaag

SEQ ID NO: 517527 - DNA, 25 bp, Mus musculus
accaggcccaggtccaagaaggaag

SEQ ID NO: 517528 - DNA, 25 bp, Mus musculus
accaggcccgacagtaagcctcagt

SEQ ID NO: 517529 - DNA, 25 bp, Mus musculus
accaggcccgactgtaagcctcagt

SEQ ID NO: 517530 - DNA, 25 bp, Mus musculus
accaggcccgtgaccgcctagagga

SEQ ID NO: 517531 - DNA, 25 bp, Mus musculus
accaggcccgtgtccgcctagagga

SEQ ID NO: 517532 - DNA, 25 bp, Mus musculus
accaggccgagcaggttctgcatga

SEQ ID NO: 517533 - DNA, 25 bp, Mus musculus
accaggccgagctggttctgcatga

SEQ ID NO: 517534 - DNA, 25 bp, Mus musculus
accaggccgccactgtcctatgtgg

SEQ ID NO: 517535 - DNA, 25 bp, Mus musculus
accaggccgccagtgtcctatgtgg

SEQ ID NO: 517536 - DNA, 25 bp, Mus musculus
accaggcctgggatgacgccaagag

SEQ ID NO: 517537 - DNA, 25 bp, Mus musculus
accaggcctgggttgacgccaagag

SEQ ID NO: 517538 - DNA, 25 bp, Mus musculus
accaggctggctccatgctagcaag

SEQ ID NO: 517539 - DNA, 25 bp, Mus musculus
accaggctggctgcatgctagcaag

SEQ ID NO: 517540 - DNA, 25 bp, Mus musculus
accaggctggtgagttcgcctcccg

SEQ ID NO: 517541 - DNA, 25 bp, Mus musculus
accaggctggtgtgttcgcctcccg

SEQ ID NO: 517542 - DNA, 25 bp, Mus musculus
accaggctttctctgctgcttccgg

SEQ ID NO: 517543 - DNA, 25 bp, Mus musculus
accaggctttctgtgctgcttccgg

SEQ ID NO: 517544 - DNA, 25 bp, Mus musculus
accagggactgccaggcctgcatgc

SEQ ID NO: 517545 - DNA, 25 bp, Mus musculus
accagggactgcgaggcctgcatgc

SEQ ID NO: 517546 - DNA, 25 bp, Mus musculus
accagggcctgtagaataggatcac

SEQ ID NO: 517547 - DNA, 25 bp, Mus musculus
accagggcctgttgaataggatcac

SEQ ID NO: 517548 - DNA, 25 bp, Mus musculus
accagggtgttgctttctcacaaag

SEQ ID NO: 517549 - DNA, 25 bp, Mus musculus
accagggtgttggtttctcacaaag

SEQ ID NO: 517550 - DNA, 25 bp, Mus musculus
accaggtagaaacactgcgggcagc

SEQ ID NO: 517551 - DNA, 25 bp, Mus musculus
accaggtagaaagactgcgggcagc

SEQ ID NO: 517552 - DNA, 25 bp, Mus musculus
accaggtcaaagctgcaggagattg

SEQ ID NO: 517553 - DNA, 25 bp, Mus musculus
accaggtcaaaggtgcaggagattg

SEQ ID NO: 517554 - DNA, 25 bp, Mus musculus
accaggtcgctcaggatatccaggc

SEQ ID NO: 517555 - DNA, 25 bp, Mus musculus
accaggtcgctctggatatccaggc

SEQ ID NO: 517556 - DNA, 25 bp, Mus musculus
accaggtggaacagtataagaagga

SEQ ID NO: 517557 - DNA, 25 bp, Mus musculus
accaggtggaactgtataagaagga

SEQ ID NO: 517558 - DNA, 25 bp, Mus musculus
accaggttctggacagtgctgcgat

SEQ ID NO: 517559 - DNA, 25 bp, Mus musculus
accaggttctggtcagtgctgcgat

SEQ ID NO: 517560 - DNA, 25 bp, Mus musculus
accaggttggccaagctcgcctgct

SEQ ID NO: 517561 - DNA, 25 bp, Mus musculus
accaggttggcctagctcgcctgct

SEQ ID NO: 517562 - DNA, 25 bp, Mus musculus
accagtcctcttatgacaacatcag

SEQ ID NO: 517563 - DNA, 25 bp, Mus musculus
accagtcctcttttgacaacatcag

SEQ ID NO: 517564 - DNA, 25 bp, Mus musculus
accagtctaacccatgcctagtcaa

SEQ ID NO: 517565 - DNA, 25 bp, Mus musculus
accagtctaaccgatgcctagtcaa

SEQ ID NO: 517566 - DNA, 25 bp, Mus musculus
accagtctcactccatggagccaga

SEQ ID NO: 517567 - DNA, 25 bp, Mus musculus
accagtctcactgcatggagccaga

SEQ ID NO: 517568 - DNA, 25 bp, Mus musculus
accagtgatgggaaagtcattacag

SEQ ID NO: 517569 - DNA, 25 bp, Mus musculus
accagtgatgggtaagtcattacag

SEQ ID NO: 517570 - DNA, 25 bp, Mus musculus
accagtgccttcactactcttcaat

SEQ ID NO: 517571 - DNA, 25 bp, Mus musculus
accagtgccttctctactcttcaat

SEQ ID NO: 517572 - DNA, 25 bp, Mus musculus
accagtggaagtcgccaatatgacc

SEQ ID NO: 517573 - DNA, 25 bp, Mus musculus
accagtggaagtggccaatatgacc

SEQ ID NO: 517574 - DNA, 25 bp, Mus musculus
accagtggacttccagggtgttaca

SEQ ID NO: 517575 - DNA, 25 bp, Mus musculus
accagtggacttgcagggtgttaca

SEQ ID NO: 517576 - DNA, 25 bp, Mus musculus
accagtggatcaagtttaagtcagt

SEQ ID NO: 517577 - DNA, 25 bp, Mus musculus
accagtggatcatgtttaagtcagt

SEQ ID NO: 517578 - DNA, 25 bp, Mus musculus
accagtggcggaagtagttgcgggc

SEQ ID NO: 517579 - DNA, 25 bp, Mus musculus
accagtggcggatgtagttgcgggc

SEQ ID NO: 517580 - DNA, 25 bp, Mus musculus
accagtggctcccaatggctacaac

SEQ ID NO: 517581 - DNA, 25 bp, Mus musculus
accagtggctccgaatggctacaac

SEQ ID NO: 517582 - DNA, 25 bp, Mus musculus
accagtggtggtagtatcaggactg

SEQ ID NO: 517583 - DNA, 25 bp, Mus musculus
accagtggtggttgtatcaggactg

SEQ ID NO: 517584 - DNA, 25 bp, Mus musculus
accagtgtgggaccaagcaagcctg

SEQ ID NO: 517585 - DNA, 25 bp, Mus musculus
accagtgtgggagcaagcaagcctg

SEQ ID NO: 517586 - DNA, 25 bp, Mus musculus
accagtgtgtaaaagtgtccccact

SEQ ID NO: 517587 - DNA, 25 bp, Mus musculus
accagtgtgtaatagtgtccccact

SEQ ID NO: 517588 - DNA, 25 bp, Mus musculus
accagttaaaagagcacaggtcctg

SEQ ID NO: 517589 - DNA, 25 bp, Mus musculus
accagttaaaagtgcacaggtcctg

SEQ ID NO: 517590 - DNA, 25 bp, Mus musculus
accagttatggcaaccaccaacggg

SEQ ID NO: 517591 - DNA, 25 bp, Mus musculus
accagttatggctaccaccaacggg

SEQ ID NO: 517592 - DNA, 25 bp, Mus musculus
accagttcaagacgcctcaggagtt

SEQ ID NO: 517593 - DNA, 25 bp, Mus musculus
accagttcaagaggcctcaggagtt

SEQ ID NO: 517594 - DNA, 25 bp, Mus musculus
accagttcctcgctagggacggaga

SEQ ID NO: 517595 - DNA, 25 bp, Mus musculus
accagttcctcggtagggacggaga

SEQ ID NO: 517596 - DNA, 25 bp, Mus musculus
accagttttcggagtgatcgtctca

SEQ ID NO: 517597 - DNA, 25 bp, Mus musculus
accagttttcggtgtgatcgtctca

SEQ ID NO: 517598 - DNA, 25 bp, Mus musculus
accataagttcccacagaaagctcc

SEQ ID NO: 517599 - DNA, 25 bp, Mus musculus
accataagttccgacagaaagctcc

SEQ ID NO: 517600 - DNA, 25 bp, Mus musculus
accatacaggtacgcctttccctga

SEQ ID NO: 517601 - DNA, 25 bp, Mus musculus
accatacaggtaggcctttccctga

SEQ ID NO: 517602 - DNA, 25 bp, Mus musculus
accataccatccagacactgtttag

SEQ ID NO: 517603 - DNA, 25 bp, Mus musculus
accataccatcctgacactgtttag

SEQ ID NO: 517604 - DNA, 25 bp, Mus musculus
accatagcgggcactaccagtgtca

SEQ ID NO: 517605 - DNA, 25 bp, Mus musculus
accatagcgggctctaccagtgtca

SEQ ID NO: 517606 - DNA, 25 bp, Mus musculus
accataggtcagaaagtgagcccct

SEQ ID NO: 517607 - DNA, 25 bp, Mus musculus
accataggtcagtaagtgagcccct

SEQ ID NO: 517608 - DNA, 25 bp, Mus musculus
accatcaaaccactagatgactgcc

SEQ ID NO: 517609 - DNA, 25 bp, Mus musculus
accatcaaaccagtagatgactgcc

SEQ ID NO: 517610 - DNA, 25 bp, Mus musculus
accatcaagtggaagccctcttgtt

SEQ ID NO: 517611 - DNA, 25 bp, Mus musculus
accatcaagtggtagccctcttgtt

SEQ ID NO: 517612 - DNA, 25 bp, Mus musculus
accatcaagtgtcggcgtctgcaga

SEQ ID NO: 517613 - DNA, 25 bp, Mus musculus
accatcaagtgtgggcgtctgcaga

SEQ ID NO: 517614 - DNA, 25 bp, Mus musculus
accatcacggctcacttcacgaagg

SEQ ID NO: 517615 - DNA, 25 bp, Mus musculus
accatcacggctgacttcacgaagg

SEQ ID NO: 517616 - DNA, 25 bp, Mus musculus
accatcagcctccacgtgtggaggg

SEQ ID NO: 517617 - DNA, 25 bp, Mus musculus
accatcagcctcgacgtgtggaggg

SEQ ID NO: 517618 - DNA, 25 bp, Mus musculus
accatcagtcctcaggtattggctg

SEQ ID NO: 517619 - DNA, 25 bp, Mus musculus
accatcagtcctgaggtattggctg

SEQ ID NO: 517620 - DNA, 25 bp, Mus musculus
accatcatgaatcccatcgggccgg

SEQ ID NO: 517621 - DNA, 25 bp, Mus musculus
accatcatgaatgccatcgggccgg

SEQ ID NO: 517622 - DNA, 25 bp, Mus musculus
accatcatggcactggagtttgacg

SEQ ID NO: 517623 - DNA, 25 bp, Mus musculus
accatcatggcagtggagtttgacg

SEQ ID NO: 517624 - DNA, 25 bp, Mus musculus
accatccaccatatgcggagctgct

SEQ ID NO: 517625 - DNA, 25 bp, Mus musculus
accatccaccatttgcggagctgct

SEQ ID NO: 517626 - DNA, 25 bp, Mus musculus
accatccataggagagctccagttg

SEQ ID NO: 517627 - DNA, 25 bp, Mus musculus
accatccataggtgagctccagttg

SEQ ID NO: 517628 - DNA, 25 bp, Mus musculus
accatcccattccatcaggtgaacg

SEQ ID NO: 517629 - DNA, 25 bp, Mus musculus
accatcccattcgatcaggtgaacg

SEQ ID NO: 517630 - DNA, 25 bp, Mus musculus
accatccccaagatcggcattgaga

SEQ ID NO: 517631 - DNA, 25 bp, Mus musculus
accatccccaagttcggcattgaga

SEQ ID NO: 517632 - DNA, 25 bp, Mus musculus
accatccccactatacagcgtggaa

SEQ ID NO: 517633 - DNA, 25 bp, Mus musculus
accatccccactttacagcgtggaa

SEQ ID NO: 517634 - DNA, 25 bp, Mus musculus
accatcctgcggacggactgggcgt

SEQ ID NO: 517635 - DNA, 25 bp, Mus musculus
accatcctgcggtcggactgggcgt

SEQ ID NO: 517636 - DNA, 25 bp, Mus musculus
accatcctggcactatttgatgctg

SEQ ID NO: 517637 - DNA, 25 bp, Mus musculus
accatcctggcagtatttgatgctg

SEQ ID NO: 517638 - DNA, 25 bp, Mus musculus
accatcctgtgtcgctgtgagaata

SEQ ID NO: 517639 - DNA, 25 bp, Mus musculus
accatcctgtgtggctgtgagaata

SEQ ID NO: 517640 - DNA, 25 bp, Mus musculus
accatccttcggattgatgatctga

SEQ ID NO: 517641 - DNA, 25 bp, Mus musculus
accatccttcggtttgatgatctga

SEQ ID NO: 517642 - DNA, 25 bp, Mus musculus
accatccttgctacagcctagaaca

SEQ ID NO: 517643 - DNA, 25 bp, Mus musculus
accatccttgcttcagcctagaaca

SEQ ID NO: 517644 - DNA, 25 bp, Mus musculus
accatccttggcatcacaggagcaa

SEQ ID NO: 517645 - DNA, 25 bp, Mus musculus
accatccttggcttcacaggagcaa

SEQ ID NO: 517646 - DNA, 25 bp, Mus musculus
accatcgaggcgctaaagcgcaaga

SEQ ID NO: 517647 - DNA, 25 bp, Mus musculus
accatcgaggcggtaaagcgcaaga

SEQ ID NO: 517648 - DNA, 25 bp, Mus musculus
accatcgccgagagccttgcagatg

SEQ ID NO: 517649 - DNA, 25 bp, Mus musculus
accatcgccgagtgccttgcagatg

SEQ ID NO: 517650 - DNA, 25 bp, Mus musculus
accatcgcggcgaactggcatggca

SEQ ID NO: 517651 - DNA, 25 bp, Mus musculus
accatcgcggcgtactggcatggca

SEQ ID NO: 517652 - DNA, 25 bp, Mus musculus
accatcgctgtcaccggctgcttga

SEQ ID NO: 517653 - DNA, 25 bp, Mus musculus
accatcgctgtctccggctgcttga

SEQ ID NO: 517654 - DNA, 25 bp, Mus musculus
accatcgtggttattggcctctttg

SEQ ID NO: 517655 - DNA, 25 bp, Mus musculus
accatcgtggtttttggcctctttg

SEQ ID NO: 517656 - DNA, 25 bp, Mus musculus
accatctcacaacggacagaaacac

SEQ ID NO: 517657 - DNA, 25 bp, Mus musculus
accatctcacaagggacagaaacac

SEQ ID NO: 517658 - DNA, 25 bp, Mus musculus
accatctctccacctggcgacagct

SEQ ID NO: 517659 - DNA, 25 bp, Mus musculus
accatctctccagctggcgacagct

SEQ ID NO: 517660 - DNA, 25 bp, Mus musculus
accatctgtggaacagggccccggg

SEQ ID NO: 517661 - DNA, 25 bp, Mus musculus
accatctgtggatcagggccccggg

SEQ ID NO: 517662 - DNA, 25 bp, Mus musculus
accatcttcccaaattgccgtggct

SEQ ID NO: 517663 - DNA, 25 bp, Mus musculus
accatcttcccatattgccgtggct

SEQ ID NO: 517664 - DNA, 25 bp, Mus musculus
accatcttcgtcattgccgttgtca

SEQ ID NO: 517665 - DNA, 25 bp, Mus musculus
accatcttcgtctttgccgttgtca

SEQ ID NO: 517666 - DNA, 25 bp, Mus musculus
accatgaagatcaggacttcggagc

SEQ ID NO: 517667 - DNA, 25 bp, Mus musculus
accatgaagatctggacttcggagc

SEQ ID NO: 517668 - DNA, 25 bp, Mus musculus
accatgaagtatcgaacaaccccag

SEQ ID NO: 517669 - DNA, 25 bp, Mus musculus
accatgaagtatggaacaaccccag

SEQ ID NO: 517670 - DNA, 25 bp, Mus musculus
accatgaatcttacgcgcgccggcg

SEQ ID NO: 517671 - DNA, 25 bp, Mus musculus
accatgaatctttcgcgcgccggcg

SEQ ID NO: 517672 - DNA, 25 bp, Mus musculus
accatgacccacctgttggcaggag

SEQ ID NO: 517673 - DNA, 25 bp, Mus musculus
accatgacccacgtgttggcaggag

SEQ ID NO: 517674 - DNA, 25 bp, Mus musculus
accatgactgtgctcgagccatagc

SEQ ID NO: 517675 - DNA, 25 bp, Mus musculus
accatgactgtggtcgagccatagc

SEQ ID NO: 517676 - DNA, 25 bp, Mus musculus
accatgactgttaaccaggtcccta

SEQ ID NO: 517677 - DNA, 25 bp, Mus musculus
accatgactgtttaccaggtcccta

SEQ ID NO: 517678 - DNA, 25 bp, Mus musculus
accatgaggactcgcggcaagaata

SEQ ID NO: 517679 - DNA, 25 bp, Mus musculus
accatgaggactggcggcaagaata

SEQ ID NO: 517680 - DNA, 25 bp, Mus musculus
accatgagtatcaggatgaagagga

SEQ ID NO: 517681 - DNA, 25 bp, Mus musculus
accatgagtatctggatgaagagga

SEQ ID NO: 517682 - DNA, 25 bp, Mus musculus
accatgagttagcacaagtttattc

SEQ ID NO: 517683 - DNA, 25 bp, Mus musculus
accatgagttaggacaagtttattc

SEQ ID NO: 517684 - DNA, 25 bp, Mus musculus
accatgatcatacacaactgctgca

SEQ ID NO: 517685 - DNA, 25 bp, Mus musculus
accatgatcatagacaactgctgca

SEQ ID NO: 517686 - DNA, 25 bp, Mus musculus
accatgatcctgaccaatttgactg

SEQ ID NO: 517687 - DNA, 25 bp, Mus musculus
accatgatcctgtccaatttgactg

SEQ ID NO: 517688 - DNA, 25 bp, Mus musculus
accatgatcttcagggcaccgaggc

SEQ ID NO: 517689 - DNA, 25 bp, Mus musculus
accatgatcttctgggcaccgaggc

SEQ ID NO: 517690 - DNA, 25 bp, Mus musculus
accatgatggaacacgacggacagc

SEQ ID NO: 517691 - DNA, 25 bp, Mus musculus
accatgatggaagacgacggacagc

SEQ ID NO: 517692 - DNA, 25 bp, Mus musculus
accatgattagaactcccagaccca

SEQ ID NO: 517693 - DNA, 25 bp, Mus musculus
accatgattagatctcccagaccca

SEQ ID NO: 517694 - DNA, 25 bp, Mus musculus
accatgattggtctcgctgtcgaca

SEQ ID NO: 517695 - DNA, 25 bp, Mus musculus
accatgattggtgtcgctgtcgaca

SEQ ID NO: 517696 - DNA, 25 bp, Mus musculus
accatgcaggtgcaaagggactgtc

SEQ ID NO: 517697 - DNA, 25 bp, Mus musculus
accatgcaggtggaaagggactgtc

SEQ ID NO: 517698 - DNA, 25 bp, Mus musculus
accatgctaacgaggagggctctga

SEQ ID NO: 517699 - DNA, 25 bp, Mus musculus
accatgctaacgtggagggctctga

SEQ ID NO: 517700 - DNA, 25 bp, Mus musculus
accatgctggagagccgtgtctgct

SEQ ID NO: 517701 - DNA, 25 bp, Mus musculus
accatgctggagtgccgtgtctgct

SEQ ID NO: 517702 - DNA, 25 bp, Mus musculus
accatggaggaccatgacagctatg

SEQ ID NO: 517703 - DNA, 25 bp, Mus musculus
accatggaggacgatgacagctatg

SEQ ID NO: 517704 - DNA, 25 bp, Mus musculus
accatggatgagctagctgagatgc

SEQ ID NO: 517705 - DNA, 25 bp, Mus musculus
accatggatgaggtagctgagatgc

SEQ ID NO: 517706 - DNA, 25 bp, Mus musculus
accatggcatggacgccctgggtga

SEQ ID NO: 517707 - DNA, 25 bp, Mus musculus
accatggcatggaggctcttggcga

SEQ ID NO: 517708 - DNA, 25 bp, Mus musculus
accatggcatggtcgccctgggtga

SEQ ID NO: 517709 - DNA, 25 bp, Mus musculus
accatggcatggtggctcttggcga

SEQ ID NO: 517710 - DNA, 25 bp, Mus musculus
accatggccgaaaacctgtaccgag

SEQ ID NO: 517711 - DNA, 25 bp, Mus musculus
accatggccgaatacctgtaccgag

SEQ ID NO: 517712 - DNA, 25 bp, Mus musculus
accatgggatgtacgctgagcgcag

SEQ ID NO: 517713 - DNA, 25 bp, Mus musculus
accatgggatgttcgctgagcgcag

SEQ ID NO: 517714 - DNA, 25 bp, Mus musculus
accatgggggcacccaaagttactg

SEQ ID NO: 517715 - DNA, 25 bp, Mus musculus
accatgggggcagccaaagttactg

SEQ ID NO: 517716 - DNA, 25 bp, Mus musculus
accatggtgaatccgggcagcagct

SEQ ID NO: 517717 - DNA, 25 bp, Mus musculus
accatggtgaatgcgggcagcagct

SEQ ID NO: 517718 - DNA, 25 bp, Mus musculus
accatggtgatccacattggcctgc

SEQ ID NO: 517719 - DNA, 25 bp, Mus musculus
accatggtgatcgacattggcctgc

SEQ ID NO: 517720 - DNA, 25 bp, Mus musculus
accatggttgctcagtcacaagtgg

SEQ ID NO: 517721 - DNA, 25 bp, Mus musculus
accatggttgctgagtcacaagtgg

SEQ ID NO: 517722 - DNA, 25 bp, Mus musculus
accatgtacgatcgcttccagaggg

SEQ ID NO: 517723 - DNA, 25 bp, Mus musculus
accatgtacgatggcttccagaggg

SEQ ID NO: 517724 - DNA, 25 bp, Mus musculus
accatgtgggccatcccggagttgc

SEQ ID NO: 517725 - DNA, 25 bp, Mus musculus
accatgtgggccttcccggagttgc

SEQ ID NO: 517726 - DNA, 25 bp, Mus musculus
accatgtgtcccctgtggctactca

SEQ ID NO: 517727 - DNA, 25 bp, Mus musculus
accatgtgtcccgtgtggctactca

SEQ ID NO: 517728 - DNA, 25 bp, Mus musculus
accatgtgtgggacggcactgagac

SEQ ID NO: 517729 - DNA, 25 bp, Mus musculus
accatgtgtgggtcggcactgagac

SEQ ID NO: 517730 - DNA, 25 bp, Mus musculus
accatgtttgatccggtgctcatcc

SEQ ID NO: 517731 - DNA, 25 bp, Mus musculus
accatgtttgatgcggtgctcatcc

SEQ ID NO: 517732 - DNA, 25 bp, Mus musculus
accattaatcgtactgctcgactgt

SEQ ID NO: 517733 - DNA, 25 bp, Mus musculus
accattaatcgttctgctcgactgt

SEQ ID NO: 517734 - DNA, 25 bp, Mus musculus
accattatcattcagccctttgacg

SEQ ID NO: 517735 - DNA, 25 bp, Mus musculus
accattatcattgagccctttgacg

SEQ ID NO: 517736 - DNA, 25 bp, Mus musculus
accattcaggtgactaccctgtcca

SEQ ID NO: 517737 - DNA, 25 bp, Mus musculus
accattcaggtgtctaccctgtcca

SEQ ID NO: 517738 - DNA, 25 bp, Mus musculus
accattcccggaacaacctgatgga

SEQ ID NO: 517739 - DNA, 25 bp, Mus musculus
accattcccggatcaacctgatgga

SEQ ID NO: 517740 - DNA, 25 bp, Mus musculus
accattcttgtcagcctggcccttg

SEQ ID NO: 517741 - DNA, 25 bp, Mus musculus
accattcttgtctgcctggcccttg

SEQ ID NO: 517742 - DNA, 25 bp, Mus musculus
accattgctgccacagcggtgacca

SEQ ID NO: 517743 - DNA, 25 bp, Mus musculus
accattgctgcctcagcggtgacca

SEQ ID NO: 517744 - DNA, 25 bp, Mus musculus
accattgctgctctgcgccgaggag

SEQ ID NO: 517745 - DNA, 25 bp, Mus musculus
accattgctgctgtgcgccgaggag

SEQ ID NO: 517746 - DNA, 25 bp, Mus musculus
accattgcttggaagtttgactctc

SEQ ID NO: 517747 - DNA, 25 bp, Mus musculus
accattgcttggtagtttgactctc

SEQ ID NO: 517748 - DNA, 25 bp, Mus musculus
accattggcggtctgatatcatcac

SEQ ID NO: 517749 - DNA, 25 bp, Mus musculus
accattggcggtgtgatatcatcac

SEQ ID NO: 517750 - DNA, 25 bp, Mus musculus
accattggggcactggaccacgcag

SEQ ID NO: 517751 - DNA, 25 bp, Mus musculus
accattggggcagtggaccacgcag

SEQ ID NO: 517752 - DNA, 25 bp, Mus musculus
accatttcagaacctgcccagctgg

SEQ ID NO: 517753 - DNA, 25 bp, Mus musculus
accatttcagaagctgcccagctgg

SEQ ID NO: 517754 - DNA, 25 bp, Mus musculus
accattttaaccctgatggagcatc

SEQ ID NO: 517755 - DNA, 25 bp, Mus musculus
accattttaaccgtgatggagcatc

SEQ ID NO: 517756 - DNA, 25 bp, Mus musculus
acccaaaaagagatacattgccact

SEQ ID NO: 517757 - DNA, 25 bp, Mus musculus
acccaaaaagagttacattgccact

SEQ ID NO: 517758 - DNA, 25 bp, Mus musculus
acccaaaccaagagcaaagtctatc

SEQ ID NO: 517759 - DNA, 25 bp, Mus musculus
acccaaaccaagtgcaaagtctatc

SEQ ID NO: 517760 - DNA, 25 bp, Mus musculus
acccaaagaggtctacaggcagcag

SEQ ID NO: 517761 - DNA, 25 bp, Mus musculus
acccaaagaggtgtacaggcagcag

SEQ ID NO: 517762 - DNA, 25 bp, Mus musculus
acccaaaggtgtctgggcacgtcat

SEQ ID NO: 517763 - DNA, 25 bp, Mus musculus
acccaaaggtgtgtgggcacgtcat

SEQ ID NO: 517764 - DNA, 25 bp, Mus musculus
acccaaatagtgctgtcttcctgct

SEQ ID NO: 517765 - DNA, 25 bp, Mus musculus
acccaaatagtggtgtcttcctgct

SEQ ID NO: 517766 - DNA, 25 bp, Mus musculus
acccaacagtacactgatcatcagc

SEQ ID NO: 517767 - DNA, 25 bp, Mus musculus
acccaacagtactctgatcatcagc

SEQ ID NO: 517768 - DNA, 25 bp, Mus musculus
acccaaccatggacagtgtgttaag

SEQ ID NO: 517769 - DNA, 25 bp, Mus musculus
acccaaccatggtcagtgtgttaag

SEQ ID NO: 517770 - DNA, 25 bp, Mus musculus
acccaacggcttccatcattgcaaa

SEQ ID NO: 517771 - DNA, 25 bp, Mus musculus
acccaacggcttgcatcattgcaaa

SEQ ID NO: 517772 - DNA, 25 bp, Mus musculus
acccaactatgtccgtgtctcagaa

SEQ ID NO: 517773 - DNA, 25 bp, Mus musculus
acccaactatgtgcgtgtctcagaa

SEQ ID NO: 517774 - DNA, 25 bp, Mus musculus
acccaactcattagtgatcatcaca

SEQ ID NO: 517775 - DNA, 25 bp, Mus musculus
acccaactcatttgtgatcatcaca

SEQ ID NO: 517776 - DNA, 25 bp, Mus musculus
acccaagagatgaagggtctcctca

SEQ ID NO: 517777 - DNA, 25 bp, Mus musculus
acccaagagatgagacttacaagcc

SEQ ID NO: 517778 - DNA, 25 bp, Mus musculus
acccaagagatgtagggtctcctca

SEQ ID NO: 517779 - DNA, 25 bp, Mus musculus
acccaagagatgtgacttacaagcc

SEQ ID NO: 517780 - DNA, 25 bp, Mus musculus
acccaagcccaacactgacgaaggg

SEQ ID NO: 517781 - DNA, 25 bp, Mus musculus
acccaagcccaagactgacgaaggg

SEQ ID NO: 517782 - DNA, 25 bp, Mus musculus
acccaagctgcgcaagaggaaccta

SEQ ID NO: 517783 - DNA, 25 bp, Mus musculus
acccaagctgcggaagaggaaccta

SEQ ID NO: 517784 - DNA, 25 bp, Mus musculus
acccacaagcccaggaagtctgcgg

SEQ ID NO: 517785 - DNA, 25 bp, Mus musculus
acccacaagccctggaagtctgcgg

SEQ ID NO: 517786 - DNA, 25 bp, Mus musculus
acccacagctctcgccaatggaggg

SEQ ID NO: 517787 - DNA, 25 bp, Mus musculus
acccacagctctggccaatggaggg

SEQ ID NO: 517788 - DNA, 25 bp, Mus musculus
acccacatctataagcacccagaag

SEQ ID NO: 517789 - DNA, 25 bp, Mus musculus
acccacatctattagcacccagaag

SEQ ID NO: 517790 - DNA, 25 bp, Mus musculus
acccacatgacaccgggagcgatgg

SEQ ID NO: 517791 - DNA, 25 bp, Mus musculus
acccacatgacagcgggagcgatgg

SEQ ID NO: 517792 - DNA, 25 bp, Mus musculus
acccaccgggacaggccagtgttga

SEQ ID NO: 517793 - DNA, 25 bp, Mus musculus
acccaccgggactggccagtgttga

SEQ ID NO: 517794 - DNA, 25 bp, Mus musculus
acccaccttgtgcatcaagatacca

SEQ ID NO: 517795 - DNA, 25 bp, Mus musculus
acccaccttgtggatcaagatacca

SEQ ID NO: 517796 - DNA, 25 bp, Mus musculus
acccacgctccaatgctcagtattg

SEQ ID NO: 517797 - DNA, 25 bp, Mus musculus
acccacgctccattgctcagtattg

SEQ ID NO: 517798 - DNA, 25 bp, Mus musculus
acccacgctgaacgaaagggacacg

SEQ ID NO: 517799 - DNA, 25 bp, Mus musculus
acccacgctgaaggaaagggacacg

SEQ ID NO: 517800 - DNA, 25 bp, Mus musculus
acccacgggcggatgatttgctcca

SEQ ID NO: 517801 - DNA, 25 bp, Mus musculus
acccacgggcggttgatttgctcca

SEQ ID NO: 517802 - DNA, 25 bp, Mus musculus
acccacggttgaagaacagccaccg

SEQ ID NO: 517803 - DNA, 25 bp, Mus musculus
acccacggttgatgaacagccaccg

SEQ ID NO: 517804 - DNA, 25 bp, Mus musculus
acccactgcctgagactgctgtgcg

SEQ ID NO: 517805 - DNA, 25 bp, Mus musculus
acccactgcctgaggatctgaaggt

SEQ ID NO: 517806 - DNA, 25 bp, Mus musculus
acccactgcctgtgactgctgtgcg

SEQ ID NO: 517807 - DNA, 25 bp, Mus musculus
acccactgcctgtggatctgaaggt

SEQ ID NO: 517808 - DNA, 25 bp, Mus musculus
acccactttctgacaggtgtgtgcg

SEQ ID NO: 517809 - DNA, 25 bp, Mus musculus
acccactttctgtcaggtgtgtgcg

SEQ ID NO: 517810 - DNA, 25 bp, Mus musculus
acccagaagcgccatgatgcagaga

SEQ ID NO: 517811 - DNA, 25 bp, Mus musculus
acccagaagcgcgatgatgcagaga

SEQ ID NO: 517812 - DNA, 25 bp, Mus musculus
acccagaaggcccagattgttcggc

SEQ ID NO: 517813 - DNA, 25 bp, Mus musculus
acccagaaggccgagattgttcggc

SEQ ID NO: 517814 - DNA, 25 bp, Mus musculus
acccagagcagacggccttgttcct

SEQ ID NO: 517815 - DNA, 25 bp, Mus musculus
acccagagcagagggccttgttcct

SEQ ID NO: 517816 - DNA, 25 bp, Mus musculus
acccagagcagcagcgtcgcttggc

SEQ ID NO: 517817 - DNA, 25 bp, Mus musculus
acccagagcagctgcgtcgcttggc

SEQ ID NO: 517818 - DNA, 25 bp, Mus musculus
acccagagctggctgaacagatcaa

SEQ ID NO: 517819 - DNA, 25 bp, Mus musculus
acccagagctgggtgaacagatcaa

SEQ ID NO: 517820 - DNA, 25 bp, Mus musculus
acccagaggacgctttcagccggga

SEQ ID NO: 517821 - DNA, 25 bp, Mus musculus
acccagaggacggtttcagccggga

SEQ ID NO: 517822 - DNA, 25 bp, Mus musculus
acccagaggcaacaaattgagagca

SEQ ID NO: 517823 - DNA, 25 bp, Mus musculus
acccagaggcaagaaattgagagca

SEQ ID NO: 517824 - DNA, 25 bp, Mus musculus
acccagagggcaatctctgcattag

SEQ ID NO: 517825 - DNA, 25 bp, Mus musculus
acccagagggcattctctgcattag

SEQ ID NO: 517826 - DNA, 25 bp, Mus musculus
acccagagggcgagccagcttccag

SEQ ID NO: 517827 - DNA, 25 bp, Mus musculus
acccagagggcgtgccagcttccag

SEQ ID NO: 517828 - DNA, 25 bp, Mus musculus
acccagatgcagctggtcagaggcc

SEQ ID NO: 517829 - DNA, 25 bp, Mus musculus
acccagatgcaggtggtcagaggcc

SEQ ID NO: 517830 - DNA, 25 bp, Mus musculus
acccagatgccactgatgagaagcc

SEQ ID NO: 517831 - DNA, 25 bp, Mus musculus
acccagatgccagtgatgagaagcc

SEQ ID NO: 517832 - DNA, 25 bp, Mus musculus
acccagatgtcccaagtcgggccag

SEQ ID NO: 517833 - DNA, 25 bp, Mus musculus
acccagatgtccgaagtcgggccag

SEQ ID NO: 517834 - DNA, 25 bp, Mus musculus
acccagatgtggagcgctgcctcag

SEQ ID NO: 517835 - DNA, 25 bp, Mus musculus
acccagatgtggtgcgctgcctcag

SEQ ID NO: 517836 - DNA, 25 bp, Mus musculus
acccagattgtcatgtggacggagg

SEQ ID NO: 517837 - DNA, 25 bp, Mus musculus
acccagattgtcttgtggacggagg

SEQ ID NO: 517838 - DNA, 25 bp, Mus musculus
acccagcaaatacgcctgcaggcgg

SEQ ID NO: 517839 - DNA, 25 bp, Mus musculus
acccagcaaataggcctgcaggcgg

SEQ ID NO: 517840 - DNA, 25 bp, Mus musculus
acccagcatggacttggagaggatc

SEQ ID NO: 517841 - DNA, 25 bp, Mus musculus
acccagcatggagttggagaggatc

SEQ ID NO: 517842 - DNA, 25 bp, Mus musculus
acccagccatggagagactcggtct

SEQ ID NO: 517843 - DNA, 25 bp, Mus musculus
acccagccatggtgagactcggtct

SEQ ID NO: 517844 - DNA, 25 bp, Mus musculus
acccagcccgggagttgggcaagct

SEQ ID NO: 517845 - DNA, 25 bp, Mus musculus
acccagcccgggtgttgggcaagct

SEQ ID NO: 517846 - DNA, 25 bp, Mus musculus
acccagctagcacctccaaaggaag

SEQ ID NO: 517847 - DNA, 25 bp, Mus musculus
acccagctagcagctccaaaggaag

SEQ ID NO: 517848 - DNA, 25 bp, Mus musculus
acccagctcatgctgatgggccttt

SEQ ID NO: 517849 - DNA, 25 bp, Mus musculus
acccagctcatggtgatgggccttt

SEQ ID NO: 517850 - DNA, 25 bp, Mus musculus
acccagctccctatctggagttagc

SEQ ID NO: 517851 - DNA, 25 bp, Mus musculus
acccagctccctttctggagttagc

SEQ ID NO: 517852 - DNA, 25 bp, Mus musculus
acccagctgacgagatgagactcca

SEQ ID NO: 517853 - DNA, 25 bp, Mus musculus
acccagctgacgtgatgagactcca

SEQ ID NO: 517854 - DNA, 25 bp, Mus musculus
acccagctgaggacatgagcctatc

SEQ ID NO: 517855 - DNA, 25 bp, Mus musculus
acccagctgaggtcatgagcctatc

SEQ ID NO: 517856 - DNA, 25 bp, Mus musculus
acccagctgggtccggaagagccat

SEQ ID NO: 517857 - DNA, 25 bp, Mus musculus
acccagctgggtgcggaagagccat

SEQ ID NO: 517858 - DNA, 25 bp, Mus musculus
acccagctgtgccttcttccagtgt

SEQ ID NO: 517859 - DNA, 25 bp, Mus musculus
acccagctgtgcgttcttccagtgt

SEQ ID NO: 517860 - DNA, 25 bp, Mus musculus
acccaggaagaaaggcaccacgtgg

SEQ ID NO: 517861 - DNA, 25 bp, Mus musculus
acccaggaagaatggcaccacgtgg

SEQ ID NO: 517862 - DNA, 25 bp, Mus musculus
acccaggaagccctcatcacagtga

SEQ ID NO: 517863 - DNA, 25 bp, Mus musculus
acccaggaagccgtcatcacagtga

SEQ ID NO: 517864 - DNA, 25 bp, Mus musculus
acccaggaggatccccttggagaga

SEQ ID NO: 517865 - DNA, 25 bp, Mus musculus
acccaggaggatgcccttggagaga

SEQ ID NO: 517866 - DNA, 25 bp, Mus musculus
acccagggcatgaggagtctgaccg

SEQ ID NO: 517867 - DNA, 25 bp, Mus musculus
acccagggcatgtggagtctgaccg

SEQ ID NO: 517868 - DNA, 25 bp, Mus musculus
acccagggctccattgaggcccata

SEQ ID NO: 517869 - DNA, 25 bp, Mus musculus
acccagggctcctttgaggcccata

SEQ ID NO: 517870 - DNA, 25 bp, Mus musculus
acccagggtctcagcgtggcaggcc

SEQ ID NO: 517871 - DNA, 25 bp, Mus musculus
acccagggtctctgcgtggcaggcc

SEQ ID NO: 517872 - DNA, 25 bp, Mus musculus
acccaggttccgcagaacaagatcg

SEQ ID NO: 517873 - DNA, 25 bp, Mus musculus
acccaggttccggagaacaagatcg

SEQ ID NO: 517874 - DNA, 25 bp, Mus musculus
acccagtactcaagtcggaggctcc

SEQ ID NO: 517875 - DNA, 25 bp, Mus musculus
acccagtactcatgtcggaggctcc

SEQ ID NO: 517876 - DNA, 25 bp, Mus musculus
acccagtccaggaggaaatgggaga

SEQ ID NO: 517877 - DNA, 25 bp, Mus musculus
acccagtccaggtggaaatgggaga

SEQ ID NO: 517878 - DNA, 25 bp, Mus musculus
acccagtgatccaggccagactagc

SEQ ID NO: 517879 - DNA, 25 bp, Mus musculus
acccagtgatcctggccagactagc

SEQ ID NO: 517880 - DNA, 25 bp, Mus musculus
acccagtgctggaccggatccgcaa

SEQ ID NO: 517881 - DNA, 25 bp, Mus musculus
acccagtgctggtccggatccgcaa

SEQ ID NO: 517882 - DNA, 25 bp, Mus musculus
acccagtggaatacaccgggaagag

SEQ ID NO: 517883 - DNA, 25 bp, Mus musculus
acccagtggaattcaccgggaagag

SEQ ID NO: 517884 - DNA, 25 bp, Mus musculus
acccagtggcaacgtcaccaagagc

SEQ ID NO: 517885 - DNA, 25 bp, Mus musculus
acccagtggcaaggtcaccaagagc

SEQ ID NO: 517886 - DNA, 25 bp, Mus musculus
acccagtgtgctcgcctagttggga

SEQ ID NO: 517887 - DNA, 25 bp, Mus musculus
acccagtgtgctggcctagttggga

SEQ ID NO: 517888 - DNA, 25 bp, Mus musculus
acccagtgtgggacacagtggttgt

SEQ ID NO: 517889 - DNA, 25 bp, Mus musculus
acccagtgtgggtcacagtggttgt

SEQ ID NO: 517890 - DNA, 25 bp, Mus musculus
acccagttctggagtgtttcaaagg

SEQ ID NO: 517891 - DNA, 25 bp, Mus musculus
acccagttctggtgtgtttcaaagg

SEQ ID NO: 517892 - DNA, 25 bp, Mus musculus
acccatactgttatgtggagttcca

SEQ ID NO: 517893 - DNA, 25 bp, Mus musculus
acccatactgttttgtggagttcca

SEQ ID NO: 517894 - DNA, 25 bp, Mus musculus
acccatcccaagattccagctggag

SEQ ID NO: 517895 - DNA, 25 bp, Mus musculus
acccatcccaagtttccagctggag

SEQ ID NO: 517896 - DNA, 25 bp, Mus musculus
acccatcggtggagatttcccagca

SEQ ID NO: 517897 - DNA, 25 bp, Mus musculus
acccatcggtggtgatttcccagca

SEQ ID NO: 517898 - DNA, 25 bp, Mus musculus
acccatctctggaccagcttgctga

SEQ ID NO: 517899 - DNA, 25 bp, Mus musculus
acccatctctggtccagcttgctga

SEQ ID NO: 517900 - DNA, 25 bp, Mus musculus
acccatgacaacagagagcatctag

SEQ ID NO: 517901 - DNA, 25 bp, Mus musculus
acccatgacaactgagagcatctag

SEQ ID NO: 517902 - DNA, 25 bp, Mus musculus
acccatgcagatccaaaagtccagg

SEQ ID NO: 517903 - DNA, 25 bp, Mus musculus
acccatgcagatgcaaaagtccagg

SEQ ID NO: 517904 - DNA, 25 bp, Mus musculus
acccatgcttcaactggaccggagg

SEQ ID NO: 517905 - DNA, 25 bp, Mus musculus
acccatgcttcatctggaccggagg

SEQ ID NO: 517906 - DNA, 25 bp, Mus musculus
acccatggccctcagtttgtatcga

SEQ ID NO: 517907 - DNA, 25 bp, Mus musculus
acccatggccctgagtttgtatcga

SEQ ID NO: 517908 - DNA, 25 bp, Mus musculus
acccatgggcctctaccgttgagca

SEQ ID NO: 517909 - DNA, 25 bp, Mus musculus
acccatgggcctgtaccgttgagca

SEQ ID NO: 517910 - DNA, 25 bp, Mus musculus
acccatttgctcatgggtttggcag

SEQ ID NO: 517911 - DNA, 25 bp, Mus musculus
acccatttgctcttgggtttggcag

SEQ ID NO: 517912 - DNA, 25 bp, Mus musculus
acccatttggcacgaggtggacatc

SEQ ID NO: 517913 - DNA, 25 bp, Mus musculus
acccatttggcaggaggtggacatc

SEQ ID NO: 517914 - DNA, 25 bp, Mus musculus
accccaaaatgacagagctctacca

SEQ ID NO: 517915 - DNA, 25 bp, Mus musculus
accccaaaatgagagagctctacca

SEQ ID NO: 517916 - DNA, 25 bp, Mus musculus
accccaaaggagcaatgatcactca

SEQ ID NO: 517917 - DNA, 25 bp, Mus musculus
accccaaaggaggaatgatcactca

SEQ ID NO: 517918 - DNA, 25 bp, Mus musculus
accccaacatgactcggcctgtgga

SEQ ID NO: 517919 - DNA, 25 bp, Mus musculus
accccaacatgagtcggcctgtgga

SEQ ID NO: 517920 - DNA, 25 bp, Mus musculus
accccaacatggactccactgtgga

SEQ ID NO: 517921 - DNA, 25 bp, Mus musculus
accccaacatggtctccactgtgga

SEQ ID NO: 517922 - DNA, 25 bp, Mus musculus
accccaaccggaagaagctgctgga

SEQ ID NO: 517923 - DNA, 25 bp, Mus musculus
accccaaccggatgaagctgctgga

SEQ ID NO: 517924 - DNA, 25 bp, Mus musculus
accccaacctgcaggtgctgggagc

SEQ ID NO: 517925 - DNA, 25 bp, Mus musculus
accccaacctgctggtgctgggagc

SEQ ID NO: 517926 - DNA, 25 bp, Mus musculus
accccaagaatgagtctttggtagc

SEQ ID NO: 517927 - DNA, 25 bp, Mus musculus
accccaagaatgtgtctttggtagc

SEQ ID NO: 517928 - DNA, 25 bp, Mus musculus
accccaagactcaggagcagtgtgg

SEQ ID NO: 517929 - DNA, 25 bp, Mus musculus
accccaagactctggagcagtgtgg

SEQ ID NO: 517930 - DNA, 25 bp, Mus musculus
accccaagctggacgcaggactcgt

SEQ ID NO: 517931 - DNA, 25 bp, Mus musculus
accccaagctggtcgcaggactcgt

SEQ ID NO: 517932 - DNA, 25 bp, Mus musculus
accccaagtgaacactcccatgtga

SEQ ID NO: 517933 - DNA, 25 bp, Mus musculus
accccaagtgaagactcccatgtga

SEQ ID NO: 517934 - DNA, 25 bp, Mus musculus
accccaagttgaacctggccttcat

SEQ ID NO: 517935 - DNA, 25 bp, Mus musculus
accccaagttgatcctggccttcat

SEQ ID NO: 517936 - DNA, 25 bp, Mus musculus
accccaagtttgaagaactgcagaa

SEQ ID NO: 517937 - DNA, 25 bp, Mus musculus
accccaagtttgtagaactgcagaa

SEQ ID NO: 517938 - DNA, 25 bp, Mus musculus
accccacagctgaatgtagcctgtg

SEQ ID NO: 517939 - DNA, 25 bp, Mus musculus
accccacagctgtatgtagcctgtg

SEQ ID NO: 517940 - DNA, 25 bp, Mus musculus
accccacgaggacgacagactgaag

SEQ ID NO: 517941 - DNA, 25 bp, Mus musculus
accccacgaggaggacagactgaag

SEQ ID NO: 517942 - DNA, 25 bp, Mus musculus
accccacggtggaggtggacctgca

SEQ ID NO: 517943 - DNA, 25 bp, Mus musculus
accccacggtggtggtggacctgca

SEQ ID NO: 517944 - DNA, 25 bp, Mus musculus
accccagacaagaagggctgccgag

SEQ ID NO: 517945 - DNA, 25 bp, Mus musculus
accccagacaagtagggctgccgag

SEQ ID NO: 517946 - DNA, 25 bp, Mus musculus
accccagagtgtagagcggaagcaa

SEQ ID NO: 517947 - DNA, 25 bp, Mus musculus
accccagagtgttgagcggaagcaa

SEQ ID NO: 517948 - DNA, 25 bp, Mus musculus
accccagcctgcaggagtgggatgc

SEQ ID NO: 517949 - DNA, 25 bp, Mus musculus
accccagcctgctggagtgggatgc

SEQ ID NO: 517950 - DNA, 25 bp, Mus musculus
accccagcgcccaagatcaagaaag

SEQ ID NO: 517951 - DNA, 25 bp, Mus musculus
accccagcgccctagatcaagaaag

SEQ ID NO: 517952 - DNA, 25 bp, Mus musculus
accccagctaccatgtcacaagtag

SEQ ID NO: 517953 - DNA, 25 bp, Mus musculus
accccagctaccttgtcacaagtag

SEQ ID NO: 517954 - DNA, 25 bp, Mus musculus
accccagctatgatcggagttccta

SEQ ID NO: 517955 - DNA, 25 bp, Mus musculus
accccagctatgttcggagttccta

SEQ ID NO: 517956 - DNA, 25 bp, Mus musculus
accccaggacaacctcactgctaat

SEQ ID NO: 517957 - DNA, 25 bp, Mus musculus
accccaggacaagctcactgctaat

SEQ ID NO: 517958 - DNA, 25 bp, Mus musculus
accccaggatgaccaggaaaaactt

SEQ ID NO: 517959 - DNA, 25 bp, Mus musculus
accccaggatgagcaggaaaaactt

SEQ ID NO: 517960 - DNA, 25 bp, Mus musculus
accccagggacgcttgctgctgctg

SEQ ID NO: 517961 - DNA, 25 bp, Mus musculus
accccagggacggttgctgctgctg

SEQ ID NO: 517962 - DNA, 25 bp, Mus musculus
accccagggtgcagtgttcctggcc

SEQ ID NO: 517963 - DNA, 25 bp, Mus musculus
accccagggtgctgtgttcctggcc

SEQ ID NO: 517964 - DNA, 25 bp, Mus musculus
accccagtagccatcagctcatgta

SEQ ID NO: 517965 - DNA, 25 bp, Mus musculus
accccagtagccttcagctcatgta

SEQ ID NO: 517966 - DNA, 25 bp, Mus musculus
accccagtcataaggcatcccagat

SEQ ID NO: 517967 - DNA, 25 bp, Mus musculus
accccagtcatatggcatcccagat

SEQ ID NO: 517968 - DNA, 25 bp, Mus musculus
accccagtcatgcaaagcctctgtg

SEQ ID NO: 517969 - DNA, 25 bp, Mus musculus
accccagtcatggaaagcctctgtg

SEQ ID NO: 517970 - DNA, 25 bp, Mus musculus
accccagtgactatgtgcgcgccat

SEQ ID NO: 517971 - DNA, 25 bp, Mus musculus
accccagtgactttgtgcgcgccat

SEQ ID NO: 517972 - DNA, 25 bp, Mus musculus
accccagtgcatagtcttaacaggc

SEQ ID NO: 517973 - DNA, 25 bp, Mus musculus
accccagtgcattgtcttaacaggc

SEQ ID NO: 517974 - DNA, 25 bp, Mus musculus
accccagtgtatcctccgttagtct

SEQ ID NO: 517975 - DNA, 25 bp, Mus musculus
accccagtgtatgctccgttagtct

SEQ ID NO: 517976 - DNA, 25 bp, Mus musculus
accccatagaagagatgtgtccacc

SEQ ID NO: 517977 - DNA, 25 bp, Mus musculus
accccatagaagtgatgtgtccacc

SEQ ID NO: 517978 - DNA, 25 bp, Mus musculus
accccatcactaacattgagggcag

SEQ ID NO: 517979 - DNA, 25 bp, Mus musculus
accccatcactatcattgagggcag

SEQ ID NO: 517980 - DNA, 25 bp, Mus musculus
accccatcctggcaggaatgttctg

SEQ ID NO: 517981 - DNA, 25 bp, Mus musculus
accccatcctgggaggaatgttctg

SEQ ID NO: 517982 - DNA, 25 bp, Mus musculus
accccatgaacaattcttccacaga

SEQ ID NO: 517983 - DNA, 25 bp, Mus musculus
accccatgaacatttcttccacaga

SEQ ID NO: 517984 - DNA, 25 bp, Mus musculus
accccatgcctgacgggtgcgagag

SEQ ID NO: 517985 - DNA, 25 bp, Mus musculus
accccatgcctgtcgggtgcgagag

SEQ ID NO: 517986 - DNA, 25 bp, Mus musculus
accccatgttctccgggagatccag

SEQ ID NO: 517987 - DNA, 25 bp, Mus musculus
accccatgttctgcgggagatccag

SEQ ID NO: 517988 - DNA, 25 bp, Mus musculus
accccgacgggaacgcacttctgtg

SEQ ID NO: 517989 - DNA, 25 bp, Mus musculus
accccgacgggatcgcacttctgtg

SEQ ID NO: 517990 - DNA, 25 bp, Mus musculus
accccgactctacgtgagacgtaca

SEQ ID NO: 517991 - DNA, 25 bp, Mus musculus
accccgactctaggtgagacgtaca

SEQ ID NO: 517992 - DNA, 25 bp, Mus musculus
accccgactgagaggaagcggcaag

SEQ ID NO: 517993 - DNA, 25 bp, Mus musculus
accccgactgagtggaagcggcaag

SEQ ID NO: 517994 - DNA, 25 bp, Mus musculus
accccgagatgtcgccattttgcag

SEQ ID NO: 517995 - DNA, 25 bp, Mus musculus
accccgagatgtggccattttgcag

SEQ ID NO: 517996 - DNA, 25 bp, Mus musculus
accccgagtcccagattgtggagga

SEQ ID NO: 517997 - DNA, 25 bp, Mus musculus
accccgagtccctgattgtggagga

SEQ ID NO: 517998 - DNA, 25 bp, Mus musculus
accccgccgggtaccgtgtgcagtg

SEQ ID NO: 517999 - DNA, 25 bp, Mus musculus
accccgccgggttccgtgtgcagtg

SEQ ID NO: 518000 - DNA, 25 bp, Mus musculus
accccgcgcagcacgagagactgat

SEQ ID NO: 518001 - DNA, 25 bp, Mus musculus
accccgcgcagctcgagagactgat

SEQ ID NO: 518002 - DNA, 25 bp, Mus musculus
accccgctggtgaggataacaacgc

SEQ ID NO: 518003 - DNA, 25 bp, Mus musculus
accccgctggtgtggataacaacgc

SEQ ID NO: 518004 - DNA, 25 bp, Mus musculus
accccggccaagaactctgtggcaa

SEQ ID NO: 518005 - DNA, 25 bp, Mus musculus
accccggccaagtactctgtggcaa

SEQ ID NO: 518006 - DNA, 25 bp, Mus musculus
accccggccaggaagactctagacg

SEQ ID NO: 518007 - DNA, 25 bp, Mus musculus
accccggccaggtagactctagacg

SEQ ID NO: 518008 - DNA, 25 bp, Mus musculus
accccgggtggcatccgagtcttga

SEQ ID NO: 518009 - DNA, 25 bp, Mus musculus
accccgggtggcttccgagtcttga

SEQ ID NO: 518010 - DNA, 25 bp, Mus musculus
accccgtgtgttactgtcgcgccgg

SEQ ID NO: 518011 - DNA, 25 bp, Mus musculus
accccgtgtgtttctgtcgcgccgg

SEQ ID NO: 518012 - DNA, 25 bp, Mus musculus
acccctagctccagtaagttcagtc

SEQ ID NO: 518013 - DNA, 25 bp, Mus musculus
acccctagctcctgtaagttcagtc

SEQ ID NO: 518014 - DNA, 25 bp, Mus musculus
acccctccgaaacagaatctgagcg

SEQ ID NO: 518015 - DNA, 25 bp, Mus musculus
acccctccgaaagagaatctgagcg

SEQ ID NO: 518016 - DNA, 25 bp, Mus musculus
acccctcttataccttttctgacag

SEQ ID NO: 518017 - DNA, 25 bp, Mus musculus
acccctcttatagcttttctgacag

SEQ ID NO: 518018 - DNA, 25 bp, Mus musculus
acccctgaaatcagcaaagccaggc

SEQ ID NO: 518019 - DNA, 25 bp, Mus musculus
acccctgaaatctgcaaagccaggc

SEQ ID NO: 518020 - DNA, 25 bp, Mus musculus
acccctgaatgacgacgtcttcact

SEQ ID NO: 518021 - DNA, 25 bp, Mus musculus
acccctgaatgaggacgtcttcact

SEQ ID NO: 518022 - DNA, 25 bp, Mus musculus
acccctgacaaccacctgggatgat

SEQ ID NO: 518023 - DNA, 25 bp, Mus musculus
acccctgacaacgacctgggatgat

SEQ ID NO: 518024 - DNA, 25 bp, Mus musculus
acccctgaggagagccggcgtttca

SEQ ID NO: 518025 - DNA, 25 bp, Mus musculus
acccctgaggagtgccggcgtttca

SEQ ID NO: 518026 - DNA, 25 bp, Mus musculus
acccctgatgtcagccgtcttctgt

SEQ ID NO: 518027 - DNA, 25 bp, Mus musculus
acccctgatgtctgccgtcttctgt

SEQ ID NO: 518028 - DNA, 25 bp, Mus musculus
acccctgcgctccatggtggaggac

SEQ ID NO: 518029 - DNA, 25 bp, Mus musculus
acccctgcgctcgatggtggaggac

SEQ ID NO: 518030 - DNA, 25 bp, Mus musculus
acccctggactcagtacttccgagg

SEQ ID NO: 518031 - DNA, 25 bp, Mus musculus
acccctggactctgtacttccgagg

SEQ ID NO: 518032 - DNA, 25 bp, Mus musculus
acccctggcaggaagatccggaaga

SEQ ID NO: 518033 - DNA, 25 bp, Mus musculus
acccctggcaggtagatccggaaga

SEQ ID NO: 518034 - DNA, 25 bp, Mus musculus
acccctggctgtcacggttctggac

SEQ ID NO: 518035 - DNA, 25 bp, Mus musculus
acccctggctgtgacggttctggac

SEQ ID NO: 518036 - DNA, 25 bp, Mus musculus
acccctgggagccaaagccggactg

SEQ ID NO: 518037 - DNA, 25 bp, Mus musculus
acccctgggagcgaaagccggactg

SEQ ID NO: 518038 - DNA, 25 bp, Mus musculus
acccctgggttcaatggctgctctg

SEQ ID NO: 518039 - DNA, 25 bp, Mus musculus
acccctgggttctatggctgctctg

SEQ ID NO: 518040 - DNA, 25 bp, Mus musculus
acccctgtcttcaccatgcaaagag

SEQ ID NO: 518041 - DNA, 25 bp, Mus musculus
acccctgtcttctccatgcaaagag

SEQ ID NO: 518042 - DNA, 25 bp, Mus musculus
accccttcatcaaggagtaccaggc

SEQ ID NO: 518043 - DNA, 25 bp, Mus musculus
accccttcatcatggagtaccaggc

SEQ ID NO: 518044 - DNA, 25 bp, Mus musculus
accccttccaggaggatgtctacgt

SEQ ID NO: 518045 - DNA, 25 bp, Mus musculus
accccttccaggtggatgtctacgt

SEQ ID NO: 518046 - DNA, 25 bp, Mus musculus
accccttgagccctccgaagatgag

SEQ ID NO: 518047 - DNA, 25 bp, Mus musculus
accccttgagccgtccgaagatgag

SEQ ID NO: 518048 - DNA, 25 bp, Mus musculus
accccttgcctgatgtggcccatgt

SEQ ID NO: 518049 - DNA, 25 bp, Mus musculus
accccttgcctgttgtggcccatgt

SEQ ID NO: 518050 - DNA, 25 bp, Mus musculus
acccgaaggctgcatatgtgtatga

SEQ ID NO: 518051 - DNA, 25 bp, Mus musculus
acccgaaggctggatatgtgtatga

SEQ ID NO: 518052 - DNA, 25 bp, Mus musculus
acccgaagggctacagggtcagaag

SEQ ID NO: 518053 - DNA, 25 bp, Mus musculus
acccgaagggcttcagggtcagaag

SEQ ID NO: 518054 - DNA, 25 bp, Mus musculus
acccgacctggaagagcgtgcccgg

SEQ ID NO: 518055 - DNA, 25 bp, Mus musculus
acccgacctggatgagcgtgcccgg

SEQ ID NO: 518056 - DNA, 25 bp, Mus musculus
acccgactgggtccgtctgttcgcg

SEQ ID NO: 518057 - DNA, 25 bp, Mus musculus
acccgactgggtgcgtctgttcgcg

SEQ ID NO: 518058 - DNA, 25 bp, Mus musculus
acccgagcgtcgactgtgattaccg

SEQ ID NO: 518059 - DNA, 25 bp, Mus musculus
acccgagcgtcgtctgtgattaccg

SEQ ID NO: 518060 - DNA, 25 bp, Mus musculus
acccgaggagccagccgttggcatt

SEQ ID NO: 518061 - DNA, 25 bp, Mus musculus
acccgaggagcctgccgttggcatt

SEQ ID NO: 518062 - DNA, 25 bp, Mus musculus
acccgaggccacagcatcatcaatg

SEQ ID NO: 518063 - DNA, 25 bp, Mus musculus
acccgaggccactgcatcatcaatg

SEQ ID NO: 518064 - DNA, 25 bp, Mus musculus
acccgagggccactactcagaggac

SEQ ID NO: 518065 - DNA, 25 bp, Mus musculus
acccgagggccagtactcagaggac

SEQ ID NO: 518066 - DNA, 25 bp, Mus musculus
acccgaggtattcatatacaagctg

SEQ ID NO: 518067 - DNA, 25 bp, Mus musculus
acccgaggtattgatatacaagctg

SEQ ID NO: 518068 - DNA, 25 bp, Mus musculus
acccgagtcagaactccatcacagg

SEQ ID NO: 518069 - DNA, 25 bp, Mus musculus
acccgagtcagatctccatcacagg

SEQ ID NO: 518070 - DNA, 25 bp, Mus musculus
acccgagtccggaaacgtgcgctgt

SEQ ID NO: 518071 - DNA, 25 bp, Mus musculus
acccgagtccggtaacgtgcgctgt

SEQ ID NO: 518072 - DNA, 25 bp, Mus musculus
acccgagtctgcagcggcgccattg

SEQ ID NO: 518073 - DNA, 25 bp, Mus musculus
acccgagtctgctgcggcgccattg

SEQ ID NO: 518074 - DNA, 25 bp, Mus musculus
acccgatgcagtagagtcccatcct

SEQ ID NO: 518075 - DNA, 25 bp, Mus musculus
acccgatgcagttgagtcccatcct

SEQ ID NO: 518076 - DNA, 25 bp, Mus musculus
acccgcaatggcaggcgaagctgag

SEQ ID NO: 518077 - DNA, 25 bp, Mus musculus
acccgcaatggctggcgaagctgag

SEQ ID NO: 518078 - DNA, 25 bp, Mus musculus
acccgcaggcggagtgcagcctcag

SEQ ID NO: 518079 - DNA, 25 bp, Mus musculus
acccgcaggcggtgtgcagcctcag

SEQ ID NO: 518080 - DNA, 25 bp, Mus musculus
acccgcccgccaagggagacgagga

SEQ ID NO: 518081 - DNA, 25 bp, Mus musculus
acccgcccgccatgggagacgagga

SEQ ID NO: 518082 - DNA, 25 bp, Mus musculus
acccgcccttcgagggccactgtgg

SEQ ID NO: 518083 - DNA, 25 bp, Mus musculus
acccgcccttcgtgggccactgtgg

SEQ ID NO: 518084 - DNA, 25 bp, Mus musculus
acccgcccttgaacttgaagcgcgt

SEQ ID NO: 518085 - DNA, 25 bp, Mus musculus
acccgcccttgatcttgaagcgcgt

SEQ ID NO: 518086 - DNA, 25 bp, Mus musculus
acccgcctggagagcagaccatggg

SEQ ID NO: 518087 - DNA, 25 bp, Mus musculus
acccgcctggagtgcagaccatggg

SEQ ID NO: 518088 - DNA, 25 bp, Mus musculus
acccgcgcgtcaatcacttgtacag

SEQ ID NO: 518089 - DNA, 25 bp, Mus musculus
acccgcgcgtcattcacttgtacag

SEQ ID NO: 518090 - DNA, 25 bp, Mus musculus
acccgctggtccacagctgtgttga

SEQ ID NO: 518091 - DNA, 25 bp, Mus musculus
acccgctggtcctcagctgtgttga

SEQ ID NO: 518092 - DNA, 25 bp, Mus musculus
acccggacaaggaggtgatcggcat

SEQ ID NO: 518093 - DNA, 25 bp, Mus musculus
acccggacaaggtggtgatcggcat

SEQ ID NO: 518094 - DNA, 25 bp, Mus musculus
acccggaggcacatctatgacacca

SEQ ID NO: 518095 - DNA, 25 bp, Mus musculus
acccggaggcacttctatgacacca

SEQ ID NO: 518096 - DNA, 25 bp, Mus musculus
acccggagtctcaggaatcatgctt

SEQ ID NO: 518097 - DNA, 25 bp, Mus musculus
acccggagtctctggaatcatgctt

SEQ ID NO: 518098 - DNA, 25 bp, Mus musculus
acccggcactacctgggatcagcag

SEQ ID NO: 518099 - DNA, 25 bp, Mus musculus
acccggcactacgtgggatcagcag

SEQ ID NO: 518100 - DNA, 25 bp, Mus musculus
acccggcagcctcaatggagatcat

SEQ ID NO: 518101 - DNA, 25 bp, Mus musculus
acccggcagcctgaatggagatcat

SEQ ID NO: 518102 - DNA, 25 bp, Mus musculus
acccggcagggcatgtttactatgg

SEQ ID NO: 518103 - DNA, 25 bp, Mus musculus
acccggcagggcttgtttactatgg

SEQ ID NO: 518104 - DNA, 25 bp, Mus musculus
acccggcaggtacaacggagcagca

SEQ ID NO: 518105 - DNA, 25 bp, Mus musculus
acccggcaggtagaacggagcagca

SEQ ID NO: 518106 - DNA, 25 bp, Mus musculus
acccggcctcaaagctggtttcaga

SEQ ID NO: 518107 - DNA, 25 bp, Mus musculus
acccggcctcaatgctggtttcaga

SEQ ID NO: 518108 - DNA, 25 bp, Mus musculus
acccgggacatgagaccgcggcgca

SEQ ID NO: 518109 - DNA, 25 bp, Mus musculus
acccgggacatgtgaccgcggcgca

SEQ ID NO: 518110 - DNA, 25 bp, Mus musculus
acccgggacattctgctacctgatg

SEQ ID NO: 518111 - DNA, 25 bp, Mus musculus
acccgggacattgtgctacctgatg

SEQ ID NO: 518112 - DNA, 25 bp, Mus musculus
acccgggactgcagcggccaatgcg

SEQ ID NO: 518113 - DNA, 25 bp, Mus musculus
acccgggactgctgcggccaatgcg

SEQ ID NO: 518114 - DNA, 25 bp, Mus musculus
acccgggagctaagtgagcttgacc

SEQ ID NO: 518115 - DNA, 25 bp, Mus musculus
acccgggagctatgtgagcttgacc

SEQ ID NO: 518116 - DNA, 25 bp, Mus musculus
acccgggcagaacaatccctgctga

SEQ ID NO: 518117 - DNA, 25 bp, Mus musculus
acccgggcagaagaatccctgctga

SEQ ID NO: 518118 - DNA, 25 bp, Mus musculus
acccggtgcgtcacgtgccaggaga

SEQ ID NO: 518119 - DNA, 25 bp, Mus musculus
acccggtgcgtctcgtgccaggaga

SEQ ID NO: 518120 - DNA, 25 bp, Mus musculus
acccgtacctgcagcgacggcggag

SEQ ID NO: 518121 - DNA, 25 bp, Mus musculus
acccgtacctgctgcgacggcggag

SEQ ID NO: 518122 - DNA, 25 bp, Mus musculus
acccgtcacaggaagcagtaggtat

SEQ ID NO: 518123 - DNA, 25 bp, Mus musculus
acccgtcacaggtagcagtaggtat

SEQ ID NO: 518124 - DNA, 25 bp, Mus musculus
acccgtctgaaacgaaatcctgcca

SEQ ID NO: 518125 - DNA, 25 bp, Mus musculus
acccgtctgaaaggaaatcctgcca

SEQ ID NO: 518126 - DNA, 25 bp, Mus musculus
acccgtgcggttcacgcatttggcg

SEQ ID NO: 518127 - DNA, 25 bp, Mus musculus
acccgtgcggttgacgcatttggcg

SEQ ID NO: 518128 - DNA, 25 bp, Mus musculus
acccgtggcgccactgcggtggttc

SEQ ID NO: 518129 - DNA, 25 bp, Mus musculus
acccgtggcgcctctgcggtggttc

SEQ ID NO: 518130 - DNA, 25 bp, Mus musculus
acccgtgggcgtctgtctgtaccga

SEQ ID NO: 518131 - DNA, 25 bp, Mus musculus
acccgtgggcgtgtgtctgtaccga

SEQ ID NO: 518132 - DNA, 25 bp, Mus musculus
acccgtgtccggcaggacactgtgt

SEQ ID NO: 518133 - DNA, 25 bp, Mus musculus
acccgtgtccgggaggacactgtgt

SEQ ID NO: 518134 - DNA, 25 bp, Mus musculus
accctaaaaaggctatggctatgaa

SEQ ID NO: 518135 - DNA, 25 bp, Mus musculus
accctaaaaagggtatggctatgaa

SEQ ID NO: 518136 - DNA, 25 bp, Mus musculus
accctaagtgtcaaggtgatgagag

SEQ ID NO: 518137 - DNA, 25 bp, Mus musculus
accctaagtgtctaggtgatgagag

SEQ ID NO: 518138 - DNA, 25 bp, Mus musculus
accctaatattacttccgtcacagg

SEQ ID NO: 518139 - DNA, 25 bp, Mus musculus
accctaatattagttccgtcacagg

SEQ ID NO: 518140 - DNA, 25 bp, Mus musculus
accctacgcacgagaggagggacag

SEQ ID NO: 518141 - DNA, 25 bp, Mus musculus
accctacgcacgtgaggagggacag

SEQ ID NO: 518142 - DNA, 25 bp, Mus musculus
accctactctggatgcctttgacct

SEQ ID NO: 518143 - DNA, 25 bp, Mus musculus
accctactctggttgcctttgacct

SEQ ID NO: 518144 - DNA, 25 bp, Mus musculus
accctactgttgaggcctccaacat

SEQ ID NO: 518145 - DNA, 25 bp, Mus musculus
accctactgttgtggcctccaacat

SEQ ID NO: 518146 - DNA, 25 bp, Mus musculus
accctagcgttaagattgatgatct

SEQ ID NO: 518147 - DNA, 25 bp, Mus musculus
accctagcgttatgattgatgatct

SEQ ID NO: 518148 - DNA, 25 bp, Mus musculus
accctaggacagagcacgggcaact

SEQ ID NO: 518149 - DNA, 25 bp, Mus musculus
accctaggacagtgcacgggcaact

SEQ ID NO: 518150 - DNA, 25 bp, Mus musculus
accctcaacttcatctttattccta

SEQ ID NO: 518151 - DNA, 25 bp, Mus musculus
accctcaacttcttctttattccta

SEQ ID NO: 518152 - DNA, 25 bp, Mus musculus
accctcacaattcccgccgtggctt

SEQ ID NO: 518153 - DNA, 25 bp, Mus musculus
accctcacaattgccgccgtggctt

SEQ ID NO: 518154 - DNA, 25 bp, Mus musculus
accctcaggatgctgcagaacccag

SEQ ID NO: 518155 - DNA, 25 bp, Mus musculus
accctcaggatggtgcagaacccag

SEQ ID NO: 518156 - DNA, 25 bp, Mus musculus
accctcagtcgacttctgcaggcaa

SEQ ID NO: 518157 - DNA, 25 bp, Mus musculus
accctcagtcgagttctgcaggcaa

SEQ ID NO: 518158 - DNA, 25 bp, Mus musculus
accctcatgtggaccagtatgaaac

SEQ ID NO: 518159 - DNA, 25 bp, Mus musculus
accctcatgtggtccagtatgaaac

SEQ ID NO: 518160 - DNA, 25 bp, Mus musculus
accctccagaggagcggctctctgg

SEQ ID NO: 518161 - DNA, 25 bp, Mus musculus
accctccagaggtgcggctctctgg

SEQ ID NO: 518162 - DNA, 25 bp, Mus musculus
accctccctaggactgtcctgaaag

SEQ ID NO: 518163 - DNA, 25 bp, Mus musculus
accctccctaggtctgtcctgaaag

SEQ ID NO: 518164 - DNA, 25 bp, Mus musculus
accctcctgggactctgagacaaga

SEQ ID NO: 518165 - DNA, 25 bp, Mus musculus
accctcctgggagtctgagacaaga

SEQ ID NO: 518166 - DNA, 25 bp, Mus musculus
accctcgacagcaagagtcattaat

SEQ ID NO: 518167 - DNA, 25 bp, Mus musculus
accctcgacagctagagtcattaat

SEQ ID NO: 518168 - DNA, 25 bp, Mus musculus
accctcggaatcaggagctcttagg

SEQ ID NO: 518169 - DNA, 25 bp, Mus musculus
accctcggaatctggagctcttagg

SEQ ID NO: 518170 - DNA, 25 bp, Mus musculus
accctcggccagatccagtggaagc

SEQ ID NO: 518171 - DNA, 25 bp, Mus musculus
accctcggccagttccagtggaagc

SEQ ID NO: 518172 - DNA, 25 bp, Mus musculus
accctctcaggcagcgggaggcaaa

SEQ ID NO: 518173 - DNA, 25 bp, Mus musculus
accctctcaggctgcgggaggcaaa

SEQ ID NO: 518174 - DNA, 25 bp, Mus musculus
accctctcctccaaggtctgaagag

SEQ ID NO: 518175 - DNA, 25 bp, Mus musculus
accctctcctcctaggtctgaagag

SEQ ID NO: 518176 - DNA, 25 bp, Mus musculus
accctctggagaaggtgggcccagt

SEQ ID NO: 518177 - DNA, 25 bp, Mus musculus
accctctggagatggtgggcccagt

SEQ ID NO: 518178 - DNA, 25 bp, Mus musculus
accctctttacaatggatgatgtgg

SEQ ID NO: 518179 - DNA, 25 bp, Mus musculus
accctctttacattggatgatgtgg

SEQ ID NO: 518180 - DNA, 25 bp, Mus musculus
accctgaacatgcaggcctcttcta

SEQ ID NO: 518181 - DNA, 25 bp, Mus musculus
accctgaacatggaggcctcttcta

SEQ ID NO: 518182 - DNA, 25 bp, Mus musculus
accctgaagaatcgctggcttcagc

SEQ ID NO: 518183 - DNA, 25 bp, Mus musculus
accctgaagaatggctggcttcagc

SEQ ID NO: 518184 - DNA, 25 bp, Mus musculus
accctgaagtggctgaggcggccca

SEQ ID NO: 518185 - DNA, 25 bp, Mus musculus
accctgaagtgggtgaggcggccca

SEQ ID NO: 518186 - DNA, 25 bp, Mus musculus
accctgaatcctccagaaggaatcg

SEQ ID NO: 518187 - DNA, 25 bp, Mus musculus
accctgaatcctgcagaaggaatcg

SEQ ID NO: 518188 - DNA, 25 bp, Mus musculus
accctgaatggtcgcagcggagcaa

SEQ ID NO: 518189 - DNA, 25 bp, Mus musculus
accctgaatggtggcagcggagcaa

SEQ ID NO: 518190 - DNA, 25 bp, Mus musculus
accctgacccagaatgagatggtgt

SEQ ID NO: 518191 - DNA, 25 bp, Mus musculus
accctgacccagtatgagatggtgt

SEQ ID NO: 518192 - DNA, 25 bp, Mus musculus
accctgactcagacgtggtggaaaa

SEQ ID NO: 518193 - DNA, 25 bp, Mus musculus
accctgactcagtcgtggtggaaaa

SEQ ID NO: 518194 - DNA, 25 bp, Mus musculus
accctgactctgaatctatgcaaag

SEQ ID NO: 518195 - DNA, 25 bp, Mus musculus
accctgactctgtatctatgcaaag

SEQ ID NO: 518196 - DNA, 25 bp, Mus musculus
accctgagccggctgtgcaaaccag

SEQ ID NO: 518197 - DNA, 25 bp, Mus musculus
accctgagccgggtgtgcaaaccag

SEQ ID NO: 518198 - DNA, 25 bp, Mus musculus
accctgagctcaaggtcgtccaatg

SEQ ID NO: 518199 - DNA, 25 bp, Mus musculus
accctgagctcatggtcgtccaatg

SEQ ID NO: 518200 - DNA, 25 bp, Mus musculus
accctgaggagtacgcactgcgtga

SEQ ID NO: 518201 - DNA, 25 bp, Mus musculus
accctgaggagttcgcactgcgtga

SEQ ID NO: 518202 - DNA, 25 bp, Mus musculus
accctgaggtgacgcagaggatcta

SEQ ID NO: 518203 - DNA, 25 bp, Mus musculus
accctgaggtgaggcagaggatcta

SEQ ID NO: 518204 - DNA, 25 bp, Mus musculus
accctgagtgttccctcaaaagcta

SEQ ID NO: 518205 - DNA, 25 bp, Mus musculus
accctgagtgttgcctcaaaagcta

SEQ ID NO: 518206 - DNA, 25 bp, Mus musculus
accctgatcacacggaaatgggaga

SEQ ID NO: 518207 - DNA, 25 bp, Mus musculus
accctgatcacagggaaatgggaga

SEQ ID NO: 518208 - DNA, 25 bp, Mus musculus
accctgatgggcacaggcctccgaa

SEQ ID NO: 518209 - DNA, 25 bp, Mus musculus
accctgatgggctcaggcctccgaa

SEQ ID NO: 518210 - DNA, 25 bp, Mus musculus
accctgattgggatgagtgttttag

SEQ ID NO: 518211 - DNA, 25 bp, Mus musculus
accctgattgggttgagtgttttag

SEQ ID NO: 518212 - DNA, 25 bp, Mus musculus
accctgcaaaagagtgagattgcgc

SEQ ID NO: 518213 - DNA, 25 bp, Mus musculus
accctgcaaaagtgtgagattgcgc

SEQ ID NO: 518214 - DNA, 25 bp, Mus musculus
accctgcagctgacggtgaccctgt

SEQ ID NO: 518215 - DNA, 25 bp, Mus musculus
accctgcagctgtcggtgaccctgt

SEQ ID NO: 518216 - DNA, 25 bp, Mus musculus
accctgcagtggagagctgtgtgct

SEQ ID NO: 518217 - DNA, 25 bp, Mus musculus
accctgcagtggctgtactctgcaa

SEQ ID NO: 518218 - DNA, 25 bp, Mus musculus
accctgcagtgggtgtactctgcaa

SEQ ID NO: 518219 - DNA, 25 bp, Mus musculus
accctgcagtggtgagctgtgtgct

SEQ ID NO: 518220 - DNA, 25 bp, Mus musculus
accctgcatcctcgaacggtgacag

SEQ ID NO: 518221 - DNA, 25 bp, Mus musculus
accctgcatcctggaacggtgacag

SEQ ID NO: 518222 - DNA, 25 bp, Mus musculus
accctgcgcggactcatcagctggg

SEQ ID NO: 518223 - DNA, 25 bp, Mus musculus
accctgcgcggagtcatcagctggg

SEQ ID NO: 518224 - DNA, 25 bp, Mus musculus
accctgctctcgactctgaattgac

SEQ ID NO: 518225 - DNA, 25 bp, Mus musculus
accctgctctcgtctctgaattgac

SEQ ID NO: 518226 - DNA, 25 bp, Mus musculus
accctgctcttcagggaggtcagtt

SEQ ID NO: 518227 - DNA, 25 bp, Mus musculus
accctgctcttctgggaggtcagtt

SEQ ID NO: 518228 - DNA, 25 bp, Mus musculus
accctgctgcagataagctggaaga

SEQ ID NO: 518229 - DNA, 25 bp, Mus musculus
accctgctgcagttaagctggaaga

SEQ ID NO: 518230 - DNA, 25 bp, Mus musculus
accctgcttaggaccggcctcgtgt

SEQ ID NO: 518231 - DNA, 25 bp, Mus musculus
accctgcttaggtccggcctcgtgt

SEQ ID NO: 518232 - DNA, 25 bp, Mus musculus
accctgcttctgagagctcgggcgg

SEQ ID NO: 518233 - DNA, 25 bp, Mus musculus
accctgcttctgtgagctcgggcgg

SEQ ID NO: 518234 - DNA, 25 bp, Mus musculus
accctggacagaaggagtcatcttc

SEQ ID NO: 518235 - DNA, 25 bp, Mus musculus
accctggacagatggagtcatcttc

SEQ ID NO: 518236 - DNA, 25 bp, Mus musculus
accctggagcagagaaaattttatg

SEQ ID NO: 518237 - DNA, 25 bp, Mus musculus
accctggagcagtgaaaattttatg

SEQ ID NO: 518238 - DNA, 25 bp, Mus musculus
accctggaggccctaaagattcagg

SEQ ID NO: 518239 - DNA, 25 bp, Mus musculus
accctggaggccgtaaagattcagg

SEQ ID NO: 518240 - DNA, 25 bp, Mus musculus
accctggagtacaacccctatgctt

SEQ ID NO: 518241 - DNA, 25 bp, Mus musculus
accctggagtactacccctatgctt

SEQ ID NO: 518242 - DNA, 25 bp, Mus musculus
accctggccaggaaggacctcgtgg

SEQ ID NO: 518243 - DNA, 25 bp, Mus musculus
accctggccaggtaggacctcgtgg

SEQ ID NO: 518244 - DNA, 25 bp, Mus musculus
accctggcgacgatgctgagttccg

SEQ ID NO: 518245 - DNA, 25 bp, Mus musculus
accctggcgacgttgctgagttccg

SEQ ID NO: 518246 - DNA, 25 bp, Mus musculus
accctggctaggcaagcggacacgt

SEQ ID NO: 518247 - DNA, 25 bp, Mus musculus
accctggctagggaagcggacacgt

SEQ ID NO: 518248 - DNA, 25 bp, Mus musculus
accctggctgttacccagagaagaa

SEQ ID NO: 518249 - DNA, 25 bp, Mus musculus
accctggctgtttcccagagaagaa

SEQ ID NO: 518250 - DNA, 25 bp, Mus musculus
accctgggcctgctcaagttcaaga

SEQ ID NO: 518251 - DNA, 25 bp, Mus musculus
accctgggcctggtcaagttcaaga

SEQ ID NO: 518252 - DNA, 25 bp, Mus musculus
accctgtaatatccctaagcctggt

SEQ ID NO: 518253 - DNA, 25 bp, Mus musculus
accctgtaatatgcctaagcctggt

SEQ ID NO: 518254 - DNA, 25 bp, Mus musculus
accctgtcttttcgctgctcactgg

SEQ ID NO: 518255 - DNA, 25 bp, Mus musculus
accctgtcttttggctgctcactgg

SEQ ID NO: 518256 - DNA, 25 bp, Mus musculus
accctgtgtggacgaccaaggctgc

SEQ ID NO: 518257 - DNA, 25 bp, Mus musculus
accctgtgtggaggaccaaggctgc

SEQ ID NO: 518258 - DNA, 25 bp, Mus musculus
accctgtgtttccatggataataag

SEQ ID NO: 518259 - DNA, 25 bp, Mus musculus
accctgtgtttcgatggataataag

SEQ ID NO: 518260 - DNA, 25 bp, Mus musculus
acccttcagcagacgccggagagag

SEQ ID NO: 518261 - DNA, 25 bp, Mus musculus
acccttcagcagtcgccggagagag

SEQ ID NO: 518262 - DNA, 25 bp, Mus musculus
acccttccagcccttgcttgtggtg

SEQ ID NO: 518263 - DNA, 25 bp, Mus musculus
acccttccagccgttgcttgtggtg

SEQ ID NO: 518264 - DNA, 25 bp, Mus musculus
acccttcgcatgcacctgtgtcgga

SEQ ID NO: 518265 - DNA, 25 bp, Mus musculus
acccttcgcatggacctgtgtcgga

SEQ ID NO: 518266 - DNA, 25 bp, Mus musculus
acccttcgctctccgagatggtgga

SEQ ID NO: 518267 - DNA, 25 bp, Mus musculus
acccttcgctctgcgagatggtgga

SEQ ID NO: 518268 - DNA, 25 bp, Mus musculus
acccttctcatgatcagccggcata

SEQ ID NO: 518269 - DNA, 25 bp, Mus musculus
acccttctcatgttcagccggcata

SEQ ID NO: 518270 - DNA, 25 bp, Mus musculus
acccttctggagatgagcctatctt

SEQ ID NO: 518271 - DNA, 25 bp, Mus musculus
acccttctggagttgagcctatctt

SEQ ID NO: 518272 - DNA, 25 bp, Mus musculus
acccttctgttgataaagatggagc

SEQ ID NO: 518273 - DNA, 25 bp, Mus musculus
acccttctgttgttaaagatggagc

SEQ ID NO: 518274 - DNA, 25 bp, Mus musculus
acccttgactgaaggctgacgttgg

SEQ ID NO: 518275 - DNA, 25 bp, Mus musculus
acccttgactgatggctgacgttgg

SEQ ID NO: 518276 - DNA, 25 bp, Mus musculus
acccttgaggacagccatcgcctgg

SEQ ID NO: 518277 - DNA, 25 bp, Mus musculus
acccttgaggactgccatcgcctgg

SEQ ID NO: 518278 - DNA, 25 bp, Mus musculus
acccttgcgagacctttgagcgtgg

SEQ ID NO: 518279 - DNA, 25 bp, Mus musculus
acccttgcgagagctttgagcgtgg

SEQ ID NO: 518280 - DNA, 25 bp, Mus musculus
acccttgcggctcacacaaagcagg

SEQ ID NO: 518281 - DNA, 25 bp, Mus musculus
acccttgcggctgacacaaagcagg

SEQ ID NO: 518282 - DNA, 25 bp, Mus musculus
acccttgcttgtcgaggattggctg

SEQ ID NO: 518283 - DNA, 25 bp, Mus musculus
acccttgcttgtggaggattggctg

SEQ ID NO: 518284 - DNA, 25 bp, Mus musculus
acccttggagcacccagctaagcga

SEQ ID NO: 518285 - DNA, 25 bp, Mus musculus
acccttggagcagccagctaagcga

SEQ ID NO: 518286 - DNA, 25 bp, Mus musculus
acccttgggaaacgagagtctagag

SEQ ID NO: 518287 - DNA, 25 bp, Mus musculus
acccttgggaaaggagagtctagag

SEQ ID NO: 518288 - DNA, 25 bp, Mus musculus
acccttggtcatcgtcagtgtgaac

SEQ ID NO: 518289 - DNA, 25 bp, Mus musculus
acccttggtcatggtcagtgtgaac

SEQ ID NO: 518290 - DNA, 25 bp, Mus musculus
acccttgtacttcgctgagtggcag

SEQ ID NO: 518291 - DNA, 25 bp, Mus musculus
acccttgtacttggctgagtggcag

SEQ ID NO: 518292 - DNA, 25 bp, Mus musculus
accctttccaggaagagcatctcag

SEQ ID NO: 518293 - DNA, 25 bp, Mus musculus
accctttccaggtagagcatctcag

SEQ ID NO: 518294 - DNA, 25 bp, Mus musculus
accctttctaccacaggtgctgagg

SEQ ID NO: 518295 - DNA, 25 bp, Mus musculus
accctttctacctcaggtgctgagg

SEQ ID NO: 518296 - DNA, 25 bp, Mus musculus
accctttgattaagatccgaatgaa

SEQ ID NO: 518297 - DNA, 25 bp, Mus musculus
accctttgattatgatccgaatgaa

SEQ ID NO: 518298 - DNA, 25 bp, Mus musculus
accgaaagccagagagtggcatgtg

SEQ ID NO: 518299 - DNA, 25 bp, Mus musculus
accgaaagccagtgagtggcatgtg

SEQ ID NO: 518300 - DNA, 25 bp, Mus musculus
accgaaagtgggacctgcaggcagc

SEQ ID NO: 518301 - DNA, 25 bp, Mus musculus
accgaaagtgggtcctgcaggcagc

SEQ ID NO: 518302 - DNA, 25 bp, Mus musculus
accgaagaacctcgcgaaggagaag

SEQ ID NO: 518303 - DNA, 25 bp, Mus musculus
accgaagaacctggcgaaggagaag

SEQ ID NO: 518304 - DNA, 25 bp, Mus musculus
accgaagcttgtatgatcaaggagt

SEQ ID NO: 518305 - DNA, 25 bp, Mus musculus
accgaagcttgtttgatcaaggagt

SEQ ID NO: 518306 - DNA, 25 bp, Mus musculus
accgaagtagcgactcttcagtggg

SEQ ID NO: 518307 - DNA, 25 bp, Mus musculus
accgaagtagcgtctcttcagtggg

SEQ ID NO: 518308 - DNA, 25 bp, Mus musculus
accgaagtatagagggctgctgtat

SEQ ID NO: 518309 - DNA, 25 bp, Mus musculus
accgaagtatagtgggctgctgtat

SEQ ID NO: 518310 - DNA, 25 bp, Mus musculus
accgaagtgagcagaagcacgccaa

SEQ ID NO: 518311 - DNA, 25 bp, Mus musculus
accgaagtgagctgaagcacgccaa

SEQ ID NO: 518312 - DNA, 25 bp, Mus musculus
accgaattgcggagtgagccgccgt

SEQ ID NO: 518313 - DNA, 25 bp, Mus musculus
accgaattgcggtgtgagccgccgt

SEQ ID NO: 518314 - DNA, 25 bp, Mus musculus
accgacaaggccagcttcgagcacg

SEQ ID NO: 518315 - DNA, 25 bp, Mus musculus
accgacaaggcctgcttcgagcacg

SEQ ID NO: 518316 - DNA, 25 bp, Mus musculus
accgacaccgagacagagatacagc

SEQ ID NO: 518317 - DNA, 25 bp, Mus musculus
accgacaccgagtcagagatacagc

SEQ ID NO: 518318 - DNA, 25 bp, Mus musculus
accgacatgggcacaatgcaggaaa

SEQ ID NO: 518319 - DNA, 25 bp, Mus musculus
accgacatgggctcaatgcaggaaa

SEQ ID NO: 518320 - DNA, 25 bp, Mus musculus
accgaccagggcatcaaaaacttgc

SEQ ID NO: 518321 - DNA, 25 bp, Mus musculus
accgaccagggcttcaaaaacttgc

SEQ ID NO: 518322 - DNA, 25 bp, Mus musculus
accgacctcagcctgggctttgaca

SEQ ID NO: 518323 - DNA, 25 bp, Mus musculus
accgacctcagcgtgggctttgaca

SEQ ID NO: 518324 - DNA, 25 bp, Mus musculus
accgacctgtcaatacaggacccag

SEQ ID NO: 518325 - DNA, 25 bp, Mus musculus
accgacctgtcattacaggacccag

SEQ ID NO: 518326 - DNA, 25 bp, Mus musculus
accgacgcacggctgctgagaatga

SEQ ID NO: 518327 - DNA, 25 bp, Mus musculus
accgacgcacgggtgctgagaatga

SEQ ID NO: 518328 - DNA, 25 bp, Mus musculus
accgactaccggatgcgctgaggag

SEQ ID NO: 518329 - DNA, 25 bp, Mus musculus
accgactaccggttgcgctgaggag

SEQ ID NO: 518330 - DNA, 25 bp, Mus musculus
accgagaatgctcaggtgaaacttg

SEQ ID NO: 518331 - DNA, 25 bp, Mus musculus
accgagaatgctgaggtgaaacttg

SEQ ID NO: 518332 - DNA, 25 bp, Mus musculus
accgagacaagacccagagcagtgg

SEQ ID NO: 518333 - DNA, 25 bp, Mus musculus
accgagacaagagccagagcagtgg

SEQ ID NO: 518334 - DNA, 25 bp, Mus musculus
accgagataagtcctttcacgtttc

SEQ ID NO: 518335 - DNA, 25 bp, Mus musculus
accgagataagtgctttcacgtttc

SEQ ID NO: 518336 - DNA, 25 bp, Mus musculus
accgagatatcaaaggtcctgcggg

SEQ ID NO: 518337 - DNA, 25 bp, Mus musculus
accgagatatcaaggcgggaaatat

SEQ ID NO: 518338 - DNA, 25 bp, Mus musculus
accgagatatcataggtcctgcggg

SEQ ID NO: 518339 - DNA, 25 bp, Mus musculus
accgagatatcatggcgggaaatat

SEQ ID NO: 518340 - DNA, 25 bp, Mus musculus
accgagatcattcagggcacgcaga

SEQ ID NO: 518341 - DNA, 25 bp, Mus musculus
accgagatcattgagggcacgcaga

SEQ ID NO: 518342 - DNA, 25 bp, Mus musculus
accgagatccgcctcaagtattttg

SEQ ID NO: 518343 - DNA, 25 bp, Mus musculus
accgagatccgcgtcaagtattttg

SEQ ID NO: 518344 - DNA, 25 bp, Mus musculus
accgagatgaatcgacgcattgtgg

SEQ ID NO: 518345 - DNA, 25 bp, Mus musculus
accgagatgaatggacgcattgtgg

SEQ ID NO: 518346 - DNA, 25 bp, Mus musculus
accgagccagtgaatgacagcagcg

SEQ ID NO: 518347 - DNA, 25 bp, Mus musculus
accgagccagtgtatgacagcagcg

SEQ ID NO: 518348 - DNA, 25 bp, Mus musculus
accgagcggcttacgcgctgcggga

SEQ ID NO: 518349 - DNA, 25 bp, Mus musculus
accgagcggctttcgcgctgcggga

SEQ ID NO: 518350 - DNA, 25 bp, Mus musculus
accgagcgtctcaacggctgctgct

SEQ ID NO: 518351 - DNA, 25 bp, Mus musculus
accgagcgtctctacggctgctgct

SEQ ID NO: 518352 - DNA, 25 bp, Mus musculus
accgaggacgagagcagggccaccc

SEQ ID NO: 518353 - DNA, 25 bp, Mus musculus
accgaggacgagtgcagggccaccc

SEQ ID NO: 518354 - DNA, 25 bp, Mus musculus
accgaggaggaaccagactccactg

SEQ ID NO: 518355 - DNA, 25 bp, Mus musculus
accgaggaggaagcagactccactg

SEQ ID NO: 518356 - DNA, 25 bp, Mus musculus
accgaggccaacctgtgtgtgtata

SEQ ID NO: 518357 - DNA, 25 bp, Mus musculus
accgaggccaacgtgtgtgtgtata

SEQ ID NO: 518358 - DNA, 25 bp, Mus musculus
accgaggcttcgacatcttgggctg

SEQ ID NO: 518359 - DNA, 25 bp, Mus musculus
accgaggcttcgtcatcttgggctg

SEQ ID NO: 518360 - DNA, 25 bp, Mus musculus
accgagtagcagctgccgatggaca

SEQ ID NO: 518361 - DNA, 25 bp, Mus musculus
accgagtagcaggtgccgatggaca

SEQ ID NO: 518362 - DNA, 25 bp, Mus musculus
accgagtagtgacgcagaatcccgg

SEQ ID NO: 518363 - DNA, 25 bp, Mus musculus
accgagtagtgaggcagaatcccgg

SEQ ID NO: 518364 - DNA, 25 bp, Mus musculus
accgagtcctgaagatccatgaaaa

SEQ ID NO: 518365 - DNA, 25 bp, Mus musculus
accgagtcctgatgatccatgaaaa

SEQ ID NO: 518366 - DNA, 25 bp, Mus musculus
accgagtgacagagttcctccagca

SEQ ID NO: 518367 - DNA, 25 bp, Mus musculus
accgagtgacagtgttcctccagca

SEQ ID NO: 518368 - DNA, 25 bp, Mus musculus
accgagtgcatgaacttcgtgaagc

SEQ ID NO: 518369 - DNA, 25 bp, Mus musculus
accgagtgcatgtacttcgtgaagc

SEQ ID NO: 518370 - DNA, 25 bp, Mus musculus
accgagtggagcagattgctgcaat

SEQ ID NO: 518371 - DNA, 25 bp, Mus musculus
accgagtggagctgattgctgcaat

SEQ ID NO: 518372 - DNA, 25 bp, Mus musculus
accgatcgggacagcacaggacggt

SEQ ID NO: 518373 - DNA, 25 bp, Mus musculus
accgatcgggactgcacaggacggt

SEQ ID NO: 518374 - DNA, 25 bp, Mus musculus
accgatgaataccatccggagcggg

SEQ ID NO: 518375 - DNA, 25 bp, Mus musculus
accgatgaatacgatccggagcggg

SEQ ID NO: 518376 - DNA, 25 bp, Mus musculus
accgatgccgccactctgattggag

SEQ ID NO: 518377 - DNA, 25 bp, Mus musculus
accgatgccgcctctctgattggag

SEQ ID NO: 518378 - DNA, 25 bp, Mus musculus
accgatgcggagatccacaccttct

SEQ ID NO: 518379 - DNA, 25 bp, Mus musculus
accgatgcggagttccacaccttct

SEQ ID NO: 518380 - DNA, 25 bp, Mus musculus
accgatggacgcacaggcatgaggc

SEQ ID NO: 518381 - DNA, 25 bp, Mus musculus
accgatggacgctcaggcatgaggc

SEQ ID NO: 518382 - DNA, 25 bp, Mus musculus
accgatggatgtaccctggtgatgg

SEQ ID NO: 518383 - DNA, 25 bp, Mus musculus
accgatggatgttccctggtgatgg

SEQ ID NO: 518384 - DNA, 25 bp, Mus musculus
accgatgggtacaggcttctggaag

SEQ ID NO: 518385 - DNA, 25 bp, Mus musculus
accgatgggtactggcttctggaag

SEQ ID NO: 518386 - DNA, 25 bp, Mus musculus
accgatgtggaaagcttcgatttaa

SEQ ID NO: 518387 - DNA, 25 bp, Mus musculus
accgatgtggaatgcttcgatttaa

SEQ ID NO: 518388 - DNA, 25 bp, Mus musculus
accgattcgtcactgttggaccacg

SEQ ID NO: 518389 - DNA, 25 bp, Mus musculus
accgattcgtcagtgttggaccacg

SEQ ID NO: 518390 - DNA, 25 bp, Mus musculus
accgatttcggcctttgcaaggaat

SEQ ID NO: 518391 - DNA, 25 bp, Mus musculus
accgatttcggcgtttgcaaggaat

SEQ ID NO: 518392 - DNA, 25 bp, Mus musculus
accgcaccacggatgtgacacagac

SEQ ID NO: 518393 - DNA, 25 bp, Mus musculus
accgcaccacggttgtgacacagac

SEQ ID NO: 518394 - DNA, 25 bp, Mus musculus
accgcaccctgacagttggtttcaa

SEQ ID NO: 518395 - DNA, 25 bp, Mus musculus
accgcaccctgagagttggtttcaa

SEQ ID NO: 518396 - DNA, 25 bp, Mus musculus
accgcacctggaacgtcgtggtcca

SEQ ID NO: 518397 - DNA, 25 bp, Mus musculus
accgcacctggatcgtcgtggtcca

SEQ ID NO: 518398 - DNA, 25 bp, Mus musculus
accgcactgaacagctggcccttga

SEQ ID NO: 518399 - DNA, 25 bp, Mus musculus
accgcactgaactgctggcccttga

SEQ ID NO: 518400 - DNA, 25 bp, Mus musculus
accgcagaatctctggatggtgcaa

SEQ ID NO: 518401 - DNA, 25 bp, Mus musculus
accgcagaatctgtggatggtgcaa

SEQ ID NO: 518402 - DNA, 25 bp, Mus musculus
accgcagagaagaggtgggacttct

SEQ ID NO: 518403 - DNA, 25 bp, Mus musculus
accgcagagaagtggtgggacttct

SEQ ID NO: 518404 - DNA, 25 bp, Mus musculus
accgcaggctcccagttcaaggcgt

SEQ ID NO: 518405 - DNA, 25 bp, Mus musculus
accgcaggctccgagttcaaggcgt

SEQ ID NO: 518406 - DNA, 25 bp, Mus musculus
accgcagtgtgcctttccagagctg

SEQ ID NO: 518407 - DNA, 25 bp, Mus musculus
accgcagtgtgcgtttccagagctg

SEQ ID NO: 518408 - DNA, 25 bp, Mus musculus
accgcagttggactgtgagtcgcct

SEQ ID NO: 518409 - DNA, 25 bp, Mus musculus
accgcagttggagtgtgagtcgcct

SEQ ID NO: 518410 - DNA, 25 bp, Mus musculus
accgcagttgtccagaagcgctttg

SEQ ID NO: 518411 - DNA, 25 bp, Mus musculus
accgcagttgtcgagaagcgctttg

SEQ ID NO: 518412 - DNA, 25 bp, Mus musculus
accgcagttttgagcgcttccgccg

SEQ ID NO: 518413 - DNA, 25 bp, Mus musculus
accgcagttttgtgcgcttccgccg

SEQ ID NO: 518414 - DNA, 25 bp, Mus musculus
accgcatgatcaagcacgaccggga

SEQ ID NO: 518415 - DNA, 25 bp, Mus musculus
accgcatgatcatgcacgaccggga

SEQ ID NO: 518416 - DNA, 25 bp, Mus musculus
accgccaagaaaaatggccagctgg

SEQ ID NO: 518417 - DNA, 25 bp, Mus musculus
accgccaagaaatatggccagctgg

SEQ ID NO: 518418 - DNA, 25 bp, Mus musculus
accgccaagagacccgtagtctgca

SEQ ID NO: 518419 - DNA, 25 bp, Mus musculus
accgccaagagagccgtagtctgca

SEQ ID NO: 518420 - DNA, 25 bp, Mus musculus
accgccacagtcaggagccctggtt

SEQ ID NO: 518421 - DNA, 25 bp, Mus musculus
accgccacagtctggagccctggtt

SEQ ID NO: 518422 - DNA, 25 bp, Mus musculus
accgccacctggaggcaaagtcact

SEQ ID NO: 518423 - DNA, 25 bp, Mus musculus
accgccacctggtggcaaagtcact

SEQ ID NO: 518424 - DNA, 25 bp, Mus musculus
accgccagttttccgagggctgagc

SEQ ID NO: 518425 - DNA, 25 bp, Mus musculus
accgccagttttgcgagggctgagc

SEQ ID NO: 518426 - DNA, 25 bp, Mus musculus
accgccataccacaggtgagaagcc

SEQ ID NO: 518427 - DNA, 25 bp, Mus musculus
accgccataccagaggtgagaagcc

SEQ ID NO: 518428 - DNA, 25 bp, Mus musculus
accgcccagcagagcacggagagag

SEQ ID NO: 518429 - DNA, 25 bp, Mus musculus
accgcccagcagtgcacggagagag

SEQ ID NO: 518430 - DNA, 25 bp, Mus musculus
accgcccagtacagcttttggctct

SEQ ID NO: 518431 - DNA, 25 bp, Mus musculus
accgcccagtactgcttttggctct

SEQ ID NO: 518432 - DNA, 25 bp, Mus musculus
accgccccgagtagtagacactctt

SEQ ID NO: 518433 - DNA, 25 bp, Mus musculus
accgccccgagttgtagacactctt

SEQ ID NO: 518434 - DNA, 25 bp, Mus musculus
accgccgcctaaaaagcttgctgtt

SEQ ID NO: 518435 - DNA, 25 bp, Mus musculus
accgccgcctaataagcttgctgtt

SEQ ID NO: 518436 - DNA, 25 bp, Mus musculus
accgccggctctccgcttagagaag

SEQ ID NO: 518437 - DNA, 25 bp, Mus musculus
accgccggctctgcgcttagagaag

SEQ ID NO: 518438 - DNA, 25 bp, Mus musculus
accgccggtggtctgcgtcaacgtc

SEQ ID NO: 518439 - DNA, 25 bp, Mus musculus
accgccggtggtgtgcgtcaacgtc

SEQ ID NO: 518440 - DNA, 25 bp, Mus musculus
accgcctcgccaaggcgggtagcag

SEQ ID NO: 518441 - DNA, 25 bp, Mus musculus
accgcctcgccatggcgggtagcag

SEQ ID NO: 518442 - DNA, 25 bp, Mus musculus
accgcctcgggcaggtgcacgtgct

SEQ ID NO: 518443 - DNA, 25 bp, Mus musculus
accgcctcgggctggtgcacgtgct

SEQ ID NO: 518444 - DNA, 25 bp, Mus musculus
accgccttcgcaaggagctggagtc

SEQ ID NO: 518445 - DNA, 25 bp, Mus musculus
accgccttcgcatggagctggagtc

SEQ ID NO: 518446 - DNA, 25 bp, Mus musculus
accgcgagcaacacctgttggagga

SEQ ID NO: 518447 - DNA, 25 bp, Mus musculus
accgcgagcaactcctgttggagga

SEQ ID NO: 518448 - DNA, 25 bp, Mus musculus
accgcgatgggtcatatgatatgca

SEQ ID NO: 518449 - DNA, 25 bp, Mus musculus
accgcgatgggtgatatgatatgca

SEQ ID NO: 518450 - DNA, 25 bp, Mus musculus
accgcgctgtcaaggctcgaaagtc

SEQ ID NO: 518451 - DNA, 25 bp, Mus musculus
accgcgctgtcatggctcgaaagtc

SEQ ID NO: 518452 - DNA, 25 bp, Mus musculus
accgcggccagcaatcctgtcgtga

SEQ ID NO: 518453 - DNA, 25 bp, Mus musculus
accgcggccagctatcctgtcgtga

SEQ ID NO: 518454 - DNA, 25 bp, Mus musculus
accgcggccgggaaacatcctgctg

SEQ ID NO: 518455 - DNA, 25 bp, Mus musculus
accgcggccgggtaacatcctgctg

SEQ ID NO: 518456 - DNA, 25 bp, Mus musculus
accgcggcggcgactttcagtttca

SEQ ID NO: 518457 - DNA, 25 bp, Mus musculus
accgcggcggcgtctttcagtttca

SEQ ID NO: 518458 - DNA, 25 bp, Mus musculus
accgcgggtcctacaagcccgtgat

SEQ ID NO: 518459 - DNA, 25 bp, Mus musculus
accgcgggtccttcaagcccgtgat

SEQ ID NO: 518460 - DNA, 25 bp, Mus musculus
accgcgtcgtacctgcgactctggg

SEQ ID NO: 518461 - DNA, 25 bp, Mus musculus
accgcgtcgtacgtgcgactctggg

SEQ ID NO: 518462 - DNA, 25 bp, Mus musculus
accgctagacggacgacaacttctg

SEQ ID NO: 518463 - DNA, 25 bp, Mus musculus
accgctagacggtcgacaacttctg

SEQ ID NO: 518464 - DNA, 25 bp, Mus musculus
accgctcacatgagtcagagcacag

SEQ ID NO: 518465 - DNA, 25 bp, Mus musculus
accgctcacatgtgtcagagcacag

SEQ ID NO: 518466 - DNA, 25 bp, Mus musculus
accgctcagttactgtttaccatgg

SEQ ID NO: 518467 - DNA, 25 bp, Mus musculus
accgctcagttagtgtttaccatgg

SEQ ID NO: 518468 - DNA, 25 bp, Mus musculus
accgctccggacctggagaacgcag

SEQ ID NO: 518469 - DNA, 25 bp, Mus musculus
accgctccggacgtggagaacgcag

SEQ ID NO: 518470 - DNA, 25 bp, Mus musculus
accgctctatccagaggctgcaggc

SEQ ID NO: 518471 - DNA, 25 bp, Mus musculus
accgctctatcctgaggctgcaggc

SEQ ID NO: 518472 - DNA, 25 bp, Mus musculus
accgctgaccaccagtacatggagg

SEQ ID NO: 518473 - DNA, 25 bp, Mus musculus
accgctgaccacgagtacatggagg

SEQ ID NO: 518474 - DNA, 25 bp, Mus musculus
accgctgagattattcagagtgacc

SEQ ID NO: 518475 - DNA, 25 bp, Mus musculus
accgctgagatttttcagagtgacc

SEQ ID NO: 518476 - DNA, 25 bp, Mus musculus
accgctgaggaaactgtaaaagcta

SEQ ID NO: 518477 - DNA, 25 bp, Mus musculus
accgctgaggaatctgtaaaagcta

SEQ ID NO: 518478 - DNA, 25 bp, Mus musculus
accgctggaccaagtctctcctgga

SEQ ID NO: 518479 - DNA, 25 bp, Mus musculus
accgctggaccatgtctctcctgga

SEQ ID NO: 518480 - DNA, 25 bp, Mus musculus
accgctggaggtcccatgtcttcca

SEQ ID NO: 518481 - DNA, 25 bp, Mus musculus
accgctggaggtgccatgtcttcca

SEQ ID NO: 518482 - DNA, 25 bp, Mus musculus
accgctggcgagacctggcatggct

SEQ ID NO: 518483 - DNA, 25 bp, Mus musculus
accgctggcgagtcctggcatggct

SEQ ID NO: 518484 - DNA, 25 bp, Mus musculus
accgctgggctgatgtgcagttacc

SEQ ID NO: 518485 - DNA, 25 bp, Mus musculus
accgctgggctgttgtgcagttacc

SEQ ID NO: 518486 - DNA, 25 bp, Mus musculus
accgctgtaaagacaccctggccaa

SEQ ID NO: 518487 - DNA, 25 bp, Mus musculus
accgctgtaaagtcaccctggccaa

SEQ ID NO: 518488 - DNA, 25 bp, Mus musculus
accgctgtgaggcttccaacatagt

SEQ ID NO: 518489 - DNA, 25 bp, Mus musculus
accgctgtgagggttccaacatagt

SEQ ID NO: 518490 - DNA, 25 bp, Mus musculus
accgcttcaatgagacacaggcctg

SEQ ID NO: 518491 - DNA, 25 bp, Mus musculus
accgcttcaatgtgacacaggcctg

SEQ ID NO: 518492 - DNA, 25 bp, Mus musculus
accggaagtgaacgcagcttcccgc
